United States Patent 11,369,692 (MATERIALS AND METHODS FOR TREATMENT OF DUCHENNE MUSCULAR DYSTROPHY) - sequence listing, part 41

SEQ ID NO: 1357612 - DNA, 22 bp, Artificial Sequence
  chemically synthesized
gacatttcctttgagactaaga

SEQ ID NO: 1357613 - DNA, 22 bp, Artificial Sequence
  chemically synthesized
ttttctctttctttcttagtct

SEQ ID NO: 1357614 - DNA, 22 bp, Artificial Sequence
  chemically synthesized
gttttctctttctttcttagtc

SEQ ID NO: 1357615 - DNA, 22 bp, Artificial Sequence
  chemically synthesized
tgttttctctttctttcttagt

SEQ ID NO: 1357616 - DNA, 22 bp, Artificial Sequence
  chemically synthesized
cctttgagactaagaaagaaag

SEQ ID NO: 1357617 - DNA, 22 bp, Artificial Sequence
  chemically synthesized
ctttgagactaagaaagaaaga

SEQ ID NO: 1357618 - DNA, 22 bp, Artificial Sequence
  chemically synthesized
tgtactttgttttctctttctt

SEQ ID NO: 1357619 - DNA, 22 bp, Artificial Sequence
  chemically synthesized
tgagactaagaaagaaagagaa

SEQ ID NO: 1357620 - DNA, 22 bp, Artificial Sequence
  chemically synthesized
gagactaagaaagaaagagaaa

SEQ ID NO: 1357621 - DNA, 22 bp, Artificial Sequence
  chemically synthesized
agactaagaaagaaagagaaaa

SEQ ID NO: 1357622 - DNA, 22 bp, Artificial Sequence
  chemically synthesized
tctgtgtactttgttttctctt

SEQ ID NO: 1357623 - DNA, 22 bp, Artificial Sequence
  chemically synthesized
gttatctgtgtactttgttttc

SEQ ID NO: 1357624 - DNA, 22 bp, Artificial Sequence
  chemically synthesized
agaaagaaagagaaaacaaagt

SEQ ID NO: 1357625 - DNA, 22 bp, Artificial Sequence
  chemically synthesized
ggttatctgtgtactttgtttt

SEQ ID NO: 1357626 - DNA, 22 bp, Artificial Sequence
  chemically synthesized
tggttatctgtgtactttgttt

SEQ ID NO: 1357627 - DNA, 22 bp, Artificial Sequence
  chemically synthesized
ttggttatctgtgtactttgtt

SEQ ID NO: 1357628 - DNA, 22 bp, Artificial Sequence
  chemically synthesized
tcgtgtttttggttatctgtgt

SEQ ID NO: 1357629 - DNA, 22 bp, Artificial Sequence
  chemically synthesized
atataatctgtcgtgtttttgg

SEQ ID NO: 1357630 - DNA, 22 bp, Artificial Sequence
  chemically synthesized
gatgattcatataatctgtcgt

SEQ ID NO: 1357631 - DNA, 22 bp, Artificial Sequence
  chemically synthesized
ggatgattcatataatctgtcg

SEQ ID NO: 1357632 - DNA, 22 bp, Artificial Sequence
  chemically synthesized
atttggatgattcatataatct

SEQ ID NO: 1357633 - DNA, 22 bp, Artificial Sequence
  chemically synthesized
aatttggatgattcatataatc

SEQ ID NO: 1357634 - DNA, 22 bp, Artificial Sequence
  chemically synthesized
cttaatttggatgattcatata

SEQ ID NO: 1357635 - DNA, 22 bp, Artificial Sequence
  chemically synthesized
gttgcttaatttggatgattca

SEQ ID NO: 1357636 - DNA, 22 bp, Artificial Sequence
  chemically synthesized
aaatgttggttgcttaatttgg

SEQ ID NO: 1357637 - DNA, 22 bp, Artificial Sequence
  chemically synthesized
tatgaatcatccaaattaagca

SEQ ID NO: 1357638 - DNA, 22 bp, Artificial Sequence
  chemically synthesized
gactaaaatgttggttgcttaa

SEQ ID NO: 1357639 - DNA, 22 bp, Artificial Sequence
  chemically synthesized
agactaaaatgttggttgctta

SEQ ID NO: 1357640 - DNA, 22 bp, Artificial Sequence
  chemically synthesized
taaatcttagactaaaatgttg

SEQ ID NO: 1357641 - DNA, 22 bp, Artificial Sequence
  chemically synthesized
agcaaccaacattttagtctaa

SEQ ID NO: 1357642 - DNA, 22 bp, Artificial Sequence
  chemically synthesized
taaaaattataaatcttagact

SEQ ID NO: 1357643 - DNA, 22 bp, Artificial Sequence
  chemically synthesized
aatatattgtaaaaattataaa

SEQ ID NO: 1357644 - DNA, 22 bp, Artificial Sequence
  chemically synthesized
tagtctaagatttataattttt

SEQ ID NO: 1357645 - DNA, 22 bp, Artificial Sequence
  chemically synthesized
agtctaagatttataattttta

SEQ ID NO: 1357646 - DNA, 22 bp, Artificial Sequence
  chemically synthesized
gtctaagatttataatttttac

SEQ ID NO: 1357647 - DNA, 22 bp, Artificial Sequence
  chemically synthesized
agatttataatttttacaatat

SEQ ID NO: 1357648 - DNA, 22 bp, Artificial Sequence
  chemically synthesized
tccagtgtactcaatatattgt

SEQ ID NO: 1357649 - DNA, 22 bp, Artificial Sequence
  chemically synthesized
gtccagtgtactcaatatattg

SEQ ID NO: 1357650 - DNA, 22 bp, Artificial Sequence
  chemically synthesized
tgtccagtgtactcaatatatt

SEQ ID NO: 1357651 - DNA, 22 bp, Artificial Sequence
  chemically synthesized
ataatttttacaatatattgag

SEQ ID NO: 1357652 - DNA, 22 bp, Artificial Sequence
  chemically synthesized
ttgtccagtgtactcaatatat

SEQ ID NO: 1357653 - DNA, 22 bp, Artificial Sequence
  chemically synthesized
taatttttacaatatattgagt

SEQ ID NO: 1357654 - DNA, 22 bp, Artificial Sequence
  chemically synthesized
tttgtccagtgtactcaatata

SEQ ID NO: 1357655 - DNA, 22 bp, Artificial Sequence
  chemically synthesized
ttttgtccagtgtactcaatat

SEQ ID NO: 1357656 - DNA, 22 bp, Artificial Sequence
  chemically synthesized
ttacaatatattgagtacactg

SEQ ID NO: 1357657 - DNA, 22 bp, Artificial Sequence
  chemically synthesized
tacaatatattgagtacactgg

SEQ ID NO: 1357658 - DNA, 22 bp, Artificial Sequence
  chemically synthesized
acaatatattgagtacactgga

SEQ ID NO: 1357659 - DNA, 22 bp, Artificial Sequence
  chemically synthesized
caatatattgagtacactggac

SEQ ID NO: 1357660 - DNA, 22 bp, Artificial Sequence
  chemically synthesized
agtagatacttttttgtccagt

SEQ ID NO: 1357661 - DNA, 22 bp, Artificial Sequence
  chemically synthesized
agtacactggacaaaaaagtat

SEQ ID NO: 1357662 - DNA, 22 bp, Artificial Sequence
  chemically synthesized
gacaaaaaagtatctacttagg

SEQ ID NO: 1357663 - DNA, 22 bp, Artificial Sequence
  chemically synthesized
cttaggattatcccatcctgtt

SEQ ID NO: 1357664 - DNA, 22 bp, Artificial Sequence
  chemically synthesized
aggattatcccatcctgttcta

SEQ ID NO: 1357665 - DNA, 22 bp, Artificial Sequence
  chemically synthesized
ggattatcccatcctgttctat

SEQ ID NO: 1357666 - DNA, 22 bp, Artificial Sequence
  chemically synthesized
tcccatcctgttctattttgtg

SEQ ID NO: 1357667 - DNA, 22 bp, Artificial Sequence
  chemically synthesized
ttctattttgtgtgtgtgtgtg

SEQ ID NO: 1357668 - DNA, 22 bp, Artificial Sequence
  chemically synthesized
tattttgtgtgtgtgtgtgtgt

SEQ ID NO: 1357669 - DNA, 22 bp, Artificial Sequence
  chemically synthesized
ttttgtgtgtgtgtgtgtgtgt

SEQ ID NO: 1357670 - DNA, 22 bp, Artificial Sequence
  chemically synthesized
tgtgtgtgtgtgtgtgtgtgtg

SEQ ID NO: 1357671 - DNA, 22 bp, Artificial Sequence
  chemically synthesized
gtgtgtgtgtgtgtgtgtgtgt

SEQ ID NO: 1357672 - DNA, 22 bp, Artificial Sequence
  chemically synthesized
tgtgtgtgtgtgtgtgtgtgtg

SEQ ID NO: 1357673 - DNA, 22 bp, Artificial Sequence
  chemically synthesized
tacacacacacacacacacaca

SEQ ID NO: 1357674 - DNA, 22 bp, Artificial Sequence
  chemically synthesized
gtacacacacacacacacacac

SEQ ID NO: 1357675 - DNA, 22 bp, Artificial Sequence
  chemically synthesized
tgtacacacacacacacacaca

SEQ ID NO: 1357676 - DNA, 22 bp, Artificial Sequence
  chemically synthesized
ttttgtacacacacacacacac

SEQ ID NO: 1357677 - DNA, 22 bp, Artificial Sequence
  chemically synthesized
gcatgcattattttgtacacac

SEQ ID NO: 1357678 - DNA, 22 bp, Artificial Sequence
  chemically synthesized
tgaatactggcatgcattattt

SEQ ID NO: 1357679 - DNA, 22 bp, Artificial Sequence
  chemically synthesized
atgaatactggcatgcattatt

SEQ ID NO: 1357680 - DNA, 22 bp, Artificial Sequence
  chemically synthesized
gaaaagccttatgaatactggc

SEQ ID NO: 1357681 - DNA, 22 bp, Artificial Sequence
  chemically synthesized
agattggaaaagccttatgaat

SEQ ID NO: 1357682 - DNA, 22 bp, Artificial Sequence
  chemically synthesized
aggcatcattcagattggaaaa

SEQ ID NO: 1357683 - DNA, 22 bp, Artificial Sequence
  chemically synthesized
ataaggcttttccaatctgaat

SEQ ID NO: 1357684 - DNA, 22 bp, Artificial Sequence
  chemically synthesized
aaactcaggcatcattcagatt

SEQ ID NO: 1357685 - DNA, 22 bp, Artificial Sequence
  chemically synthesized
gaaactcaggcatcattcagat

SEQ ID NO: 1357686 - DNA, 22 bp, Artificial Sequence
  chemically synthesized
ttccaatctgaatgatgcctga

SEQ ID NO: 1357687 - DNA, 22 bp, Artificial Sequence
  chemically synthesized
tccaatctgaatgatgcctgag

SEQ ID NO: 1357688 - DNA, 22 bp, Artificial Sequence
  chemically synthesized
ccaatctgaatgatgcctgagt

SEQ ID NO: 1357689 - DNA, 22 bp, Artificial Sequence
  chemically synthesized
caatctgaatgatgcctgagtt

SEQ ID NO: 1357690 - DNA, 22 bp, Artificial Sequence
  chemically synthesized
tatacatatttgaaactcaggc

SEQ ID NO: 1357691 - DNA, 22 bp, Artificial Sequence
  chemically synthesized
aatgatgcctgagtttcaaata

SEQ ID NO: 1357692 - DNA, 22 bp, Artificial Sequence
  chemically synthesized
catcactgtatacatatttgaa

SEQ ID NO: 1357693 - DNA, 22 bp, Artificial Sequence
  chemically synthesized
gccattacatcactgtatacat

SEQ ID NO: 1357694 - DNA, 22 bp, Artificial Sequence
  chemically synthesized
agccattacatcactgtataca

SEQ ID NO: 1357695 - DNA, 22 bp, Artificial Sequence
  chemically synthesized
agtttcaaatatgtatacagtg

SEQ ID NO: 1357696 - DNA, 22 bp, Artificial Sequence
  chemically synthesized
tttagccattacatcactgtat

SEQ ID NO: 1357697 - DNA, 22 bp, Artificial Sequence
  chemically synthesized
caaatatgtatacagtgatgta

SEQ ID NO: 1357698 - DNA, 22 bp, Artificial Sequence
  chemically synthesized
ttgtttagccattacatcactg

SEQ ID NO: 1357699 - DNA, 22 bp, Artificial Sequence
  chemically synthesized
aaatatgtatacagtgatgtaa

SEQ ID NO: 1357700 - DNA, 22 bp, Artificial Sequence
  chemically synthesized
actattgtttagccattacatc

SEQ ID NO: 1357701 - DNA, 22 bp, Artificial Sequence
  chemically synthesized
tctgactattgtttagccatta

SEQ ID NO: 1357702 - DNA, 22 bp, Artificial Sequence
  chemically synthesized
atctgactattgtttagccatt

SEQ ID NO: 1357703 - DNA, 22 bp, Artificial Sequence
  chemically synthesized
cacagcatttatctgactattg

SEQ ID NO: 1357704 - DNA, 22 bp, Artificial Sequence
  chemically synthesized
aacaatagtcagataaatgctg

SEQ ID NO: 1357705 - DNA, 22 bp, Artificial Sequence
  chemically synthesized
taggtacacaaatgaatgacta

SEQ ID NO: 1357706 - DNA, 22 bp, Artificial Sequence
  chemically synthesized
gtaggtacacaaatgaatgact

SEQ ID NO: 1357707 - DNA, 22 bp, Artificial Sequence
  chemically synthesized
acagcttgtaggtacacaaatg

SEQ ID NO: 1357708 - DNA, 22 bp, Artificial Sequence
  chemically synthesized
tgtagtcattcatttgtgtacc

SEQ ID NO: 1357709 - DNA, 22 bp, Artificial Sequence
  chemically synthesized
tgcctaacagcttgtaggtaca

SEQ ID NO: 1357710 - DNA, 22 bp, Artificial Sequence
  chemically synthesized
attgtgcctaacagcttgtagg

SEQ ID NO: 1357711 - DNA, 22 bp, Artificial Sequence
  chemically synthesized
atttgtgtacctacaagctgtt

SEQ ID NO: 1357712 - DNA, 22 bp, Artificial Sequence
  chemically synthesized
gtgtacctacaagctgttaggc

SEQ ID NO: 1357713 - DNA, 22 bp, Artificial Sequence
  chemically synthesized
tgtacctacaagctgttaggca

SEQ ID NO: 1357714 - DNA, 22 bp, Artificial Sequence
  chemically synthesized
tatgtggattaattgtgcctaa

SEQ ID NO: 1357715 - DNA, 22 bp, Artificial Sequence
  chemically synthesized
ttatatgtggattaattgtgcc

SEQ ID NO: 1357716 - DNA, 22 bp, Artificial Sequence
  chemically synthesized
attatatgtggattaattgtgc

SEQ ID NO: 1357717 - DNA, 22 bp, Artificial Sequence
  chemically synthesized
caagctgttaggcacaattaat

SEQ ID NO: 1357718 - DNA, 22 bp, Artificial Sequence
  chemically synthesized
tgcttattatatgtggattaat

SEQ ID NO: 1357719 - DNA, 22 bp, Artificial Sequence
  chemically synthesized
ttaggcacaattaatccacata

SEQ ID NO: 1357720 - DNA, 22 bp, Artificial Sequence
  chemically synthesized
ggcacaattaatccacatataa

SEQ ID NO: 1357721 - DNA, 22 bp, Artificial Sequence
  chemically synthesized
aggagatagcctgtgcttatta

SEQ ID NO: 1357722 - DNA, 22 bp, Artificial Sequence
  chemically synthesized
gaggagatagcctgtgcttatt

SEQ ID NO: 1357723 - DNA, 22 bp, Artificial Sequence
  chemically synthesized
atccacatataataagcacagg

SEQ ID NO: 1357724 - DNA, 22 bp, Artificial Sequence
  chemically synthesized
cttgaggagatagcctgtgctt

SEQ ID NO: 1357725 - DNA, 22 bp, Artificial Sequence
  chemically synthesized
ctccttgaggagatagcctgtg

SEQ ID NO: 1357726 - DNA, 22 bp, Artificial Sequence
  chemically synthesized
gctccttgaggagatagcctgt

SEQ ID NO: 1357727 - DNA, 22 bp, Artificial Sequence
  chemically synthesized
ttgctccttgaggagatagcct

SEQ ID NO: 1357728 - DNA, 22 bp, Artificial Sequence
  chemically synthesized
tcttgctccttgaggagatagc

SEQ ID NO: 1357729 - DNA, 22 bp, Artificial Sequence
  chemically synthesized
actctcttgctccttgaggaga

SEQ ID NO: 1357730 - DNA, 22 bp, Artificial Sequence
  chemically synthesized
actcactctcttgctccttgag

SEQ ID NO: 1357731 - DNA, 22 bp, Artificial Sequence
  chemically synthesized
tgactcactctcttgctccttg

SEQ ID NO: 1357732 - DNA, 22 bp, Artificial Sequence
  chemically synthesized
ctgactcactctcttgctcctt

SEQ ID NO: 1357733 - DNA, 22 bp, Artificial Sequence
  chemically synthesized
tctcctcaaggagcaagagagt

SEQ ID NO: 1357734 - DNA, 22 bp, Artificial Sequence
  chemically synthesized
ggcttctgactcactctcttgc

SEQ ID NO: 1357735 - DNA, 22 bp, Artificial Sequence
  chemically synthesized
tcggcttctgactcactctctt

SEQ ID NO: 1357736 - DNA, 22 bp, Artificial Sequence
  chemically synthesized
ctcggcttctgactcactctct

SEQ ID NO: 1357737 - DNA, 22 bp, Artificial Sequence
  chemically synthesized
ctcaaggagcaagagagtgagt

SEQ ID NO: 1357738 - DNA, 22 bp, Artificial Sequence
  chemically synthesized
cttctcggcttctgactcactc

SEQ ID NO: 1357739 - DNA, 22 bp, Artificial Sequence
  chemically synthesized
aaggagcaagagagtgagtcag

SEQ ID NO: 1357740 - DNA, 22 bp, Artificial Sequence
  chemically synthesized
gcttctcggcttctgactcact

SEQ ID NO: 1357741 - DNA, 22 bp, Artificial Sequence
  chemically synthesized
tcagtttgcttctcggcttctg

SEQ ID NO: 1357742 - DNA, 22 bp, Artificial Sequence
  chemically synthesized
gctgtcagtttgcttctcggct

SEQ ID NO: 1357743 - DNA, 22 bp, Artificial Sequence
  chemically synthesized
agctgtcagtttgcttctcggc

SEQ ID NO: 1357744 - DNA, 22 bp, Artificial Sequence
  chemically synthesized
tagctgtcagtttgcttctcgg

SEQ ID NO: 1357745 - DNA, 22 bp, Artificial Sequence
  chemically synthesized
ttttagctgtcagtttgcttct

SEQ ID NO: 1357746 - DNA, 22 bp, Artificial Sequence
  chemically synthesized
tatcccctattttagctgtcag

SEQ ID NO: 1357747 - DNA, 22 bp, Artificial Sequence
  chemically synthesized
gacaagcaattatatcccctat

SEQ ID NO: 1357748 - DNA, 22 bp, Artificial Sequence
  chemically synthesized
tagacaagcaattatatcccct

SEQ ID NO: 1357749 - DNA, 22 bp, Artificial Sequence
  chemically synthesized
acagctaaaataggggatataa

SEQ ID NO: 1357750 - DNA, 22 bp, Artificial Sequence
  chemically synthesized
aaataggggatataattgcttg

SEQ ID NO: 1357751 - DNA, 22 bp, Artificial Sequence
  chemically synthesized
tggataattctagacaagcaat

SEQ ID NO: 1357752 - DNA, 22 bp, Artificial Sequence
  chemically synthesized
actatggataattctagacaag

SEQ ID NO: 1357753 - DNA, 22 bp, Artificial Sequence
  chemically synthesized
taaactcactatggataattct

SEQ ID NO: 1357754 - DNA, 22 bp, Artificial Sequence
  chemically synthesized
ttgtaaactcactatggataat

SEQ ID NO: 1357755 - DNA, 22 bp, Artificial Sequence
  chemically synthesized
attgtaaactcactatggataa

SEQ ID NO: 1357756 - DNA, 22 bp, Artificial Sequence
  chemically synthesized
cttgtctagaattatccatagt

SEQ ID NO: 1357757 - DNA, 22 bp, Artificial Sequence
  chemically synthesized
ttattgtaaactcactatggat

SEQ ID NO: 1357758 - DNA, 22 bp, Artificial Sequence
  chemically synthesized
gtctagaattatccatagtgag

SEQ ID NO: 1357759 - DNA, 22 bp, Artificial Sequence
  chemically synthesized
tctagaattatccatagtgagt

SEQ ID NO: 1357760 - DNA, 22 bp, Artificial Sequence
  chemically synthesized
gaattatccatagtgagtttac

SEQ ID NO: 1357761 - DNA, 22 bp, Artificial Sequence
  chemically synthesized
tccatagtgagtttacaataag

SEQ ID NO: 1357762 - DNA, 22 bp, Artificial Sequence
  chemically synthesized
acaataagaatacatattgggg

SEQ ID NO: 1357763 - DNA, 22 bp, Artificial Sequence
  chemically synthesized
caataagaatacatattggggc

SEQ ID NO: 1357764 - DNA, 22 bp, Artificial Sequence
  chemically synthesized
ggtcagaaaatggggccccaat

SEQ ID NO: 1357765 - DNA, 22 bp, Artificial Sequence
  chemically synthesized
ccctaggtcagaaaatggggcc

SEQ ID NO: 1357766 - DNA, 22 bp, Artificial Sequence
  chemically synthesized
ctaccctaggtcagaaaatggg

SEQ ID NO: 1357767 - DNA, 22 bp, Artificial Sequence
  chemically synthesized
actaccctaggtcagaaaatgg

SEQ ID NO: 1357768 - DNA, 22 bp, Artificial Sequence
  chemically synthesized
cttactaccctaggtcagaaaa

SEQ ID NO: 1357769 - DNA, 22 bp, Artificial Sequence
  chemically synthesized
gggccccattttctgacctagg

SEQ ID NO: 1357770 - DNA, 22 bp, Artificial Sequence
  chemically synthesized
aaagaattccttactaccctag

SEQ ID NO: 1357771 - DNA, 22 bp, Artificial Sequence
  chemically synthesized
aaaagaattccttactacccta

SEQ ID NO: 1357772 - DNA, 22 bp, Artificial Sequence
  chemically synthesized
tttaaaagaattccttactacc

SEQ ID NO: 1357773 - DNA, 22 bp, Artificial Sequence
  chemically synthesized
tctgacctagggtagtaaggaa

SEQ ID NO: 1357774 - DNA, 22 bp, Artificial Sequence
  chemically synthesized
ctgacctagggtagtaaggaat

SEQ ID NO: 1357775 - DNA, 22 bp, Artificial Sequence
  chemically synthesized
tgacctagggtagtaaggaatt

SEQ ID NO: 1357776 - DNA, 22 bp, Artificial Sequence
  chemically synthesized
acctagggtagtaaggaattct

SEQ ID NO: 1357777 - DNA, 22 bp, Artificial Sequence
  chemically synthesized
tagaatattgtttaaaagaatt

SEQ ID NO: 1357778 - DNA, 22 bp, Artificial Sequence
  chemically synthesized
gggtagtaaggaattcttttaa

SEQ ID NO: 1357779 - DNA, 22 bp, Artificial Sequence
  chemically synthesized
atagaatattgtttaaaagaat

SEQ ID NO: 1357780 - DNA, 22 bp, Artificial Sequence
  chemically synthesized
cttatagaatattgtttaaaag

SEQ ID NO: 1357781 - DNA, 22 bp, Artificial Sequence
  chemically synthesized
ccttatagaatattgtttaaaa

SEQ ID NO: 1357782 - DNA, 22 bp, Artificial Sequence
  chemically synthesized
tccttatagaatattgtttaaa

SEQ ID NO: 1357783 - DNA, 22 bp, Artificial Sequence
  chemically synthesized
tctttccttatagaatattgtt

SEQ ID NO: 1357784 - DNA, 22 bp, Artificial Sequence
  chemically synthesized
atctttccttatagaatattgt

SEQ ID NO: 1357785 - DNA, 22 bp, Artificial Sequence
  chemically synthesized
tatctttccttatagaatattg

SEQ ID NO: 1357786 - DNA, 22 bp, Artificial Sequence
  chemically synthesized
ttatctttccttatagaatatt

SEQ ID NO: 1357787 - DNA, 22 bp, Artificial Sequence
  chemically synthesized
tttttatctttccttatagaat

SEQ ID NO: 1357788 - DNA, 22 bp, Artificial Sequence
  chemically synthesized
ttttaaacaatattctataagg

SEQ ID NO: 1357789 - DNA, 22 bp, Artificial Sequence
  chemically synthesized
ttaaacaatattctataaggaa

SEQ ID NO: 1357790 - DNA, 22 bp, Artificial Sequence
  chemically synthesized
taaacaatattctataaggaaa

SEQ ID NO: 1357791 - DNA, 22 bp, Artificial Sequence
  chemically synthesized
aaacaatattctataaggaaag

SEQ ID NO: 1357792 - DNA, 22 bp, Artificial Sequence
  chemically synthesized
aacaatattctataaggaaaga

SEQ ID NO: 1357793 - DNA, 22 bp, Artificial Sequence
  chemically synthesized
atattatttttatctttcctta

SEQ ID NO: 1357794 - DNA, 22 bp, Artificial Sequence
  chemically synthesized
ttaatattatttttatctttcc

SEQ ID NO: 1357795 - DNA, 22 bp, Artificial Sequence
  chemically synthesized
tataaggaaagataaaaataat

SEQ ID NO: 1357796 - DNA, 22 bp, Artificial Sequence
  chemically synthesized
taaggaaagataaaaataatat

SEQ ID NO: 1357797 - DNA, 22 bp, Artificial Sequence
  chemically synthesized
caccaatgactattaatattat

SEQ ID NO: 1357798 - DNA, 22 bp, Artificial Sequence
  chemically synthesized
ccaccaatgactattaatatta

SEQ ID NO: 1357799 - DNA, 22 bp, Artificial Sequence
  chemically synthesized
ttccaccaatgactattaatat

SEQ ID NO: 1357800 - DNA, 22 bp, Artificial Sequence
  chemically synthesized
tcaccatgtctcttccaccaat

SEQ ID NO: 1357801 - DNA, 22 bp, Artificial Sequence
  chemically synthesized
atagtcattggtggaagagaca

SEQ ID NO: 1357802 - DNA, 22 bp, Artificial Sequence
  chemically synthesized
ccaaaaaccactatcaccatgt

SEQ ID NO: 1357803 - DNA, 22 bp, Artificial Sequence
  chemically synthesized
tcccaaaaaccactatcaccat

SEQ ID NO: 1357804 - DNA, 22 bp, Artificial Sequence
  chemically synthesized
gtggaagagacatggtgatagt

SEQ ID NO: 1357805 - DNA, 22 bp, Artificial Sequence
  chemically synthesized
gaatgttctcccaaaaaccact

SEQ ID NO: 1357806 - DNA, 22 bp, Artificial Sequence
  chemically synthesized
ggaatgttctcccaaaaaccac

SEQ ID NO: 1357807 - DNA, 22 bp, Artificial Sequence
  chemically synthesized
ttggaatgttctcccaaaaacc

SEQ ID NO: 1357808 - DNA, 22 bp, Artificial Sequence
  chemically synthesized
cttggaatgttctcccaaaaac

SEQ ID NO: 1357809 - DNA, 22 bp, Artificial Sequence
  chemically synthesized
ccacttcttggaatgttctccc

SEQ ID NO: 1357810 - DNA, 22 bp, Artificial Sequence
  chemically synthesized
ttcccacttcttggaatgttct

SEQ ID NO: 1357811 - DNA, 22 bp, Artificial Sequence
  chemically synthesized
gttcccacttcttggaatgttc

SEQ ID NO: 1357812 - DNA, 22 bp, Artificial Sequence
  chemically synthesized
ttgggagaacattccaagaagt

SEQ ID NO: 1357813 - DNA, 22 bp, Artificial Sequence
  chemically synthesized
tgacttgttcccacttcttgga

SEQ ID NO: 1357814 - DNA, 22 bp, Artificial Sequence
  chemically synthesized
tgggagaacattccaagaagtg

SEQ ID NO: 1357815 - DNA, 22 bp, Artificial Sequence
  chemically synthesized
gggagaacattccaagaagtgg

SEQ ID NO: 1357816 - DNA, 22 bp, Artificial Sequence
  chemically synthesized
ggagaacattccaagaagtggg

SEQ ID NO: 1357817 - DNA, 22 bp, Artificial Sequence
  chemically synthesized
tgtctatgacttgttcccactt

SEQ ID NO: 1357818 - DNA, 22 bp, Artificial Sequence
  chemically synthesized
gtgtctatgacttgttcccact

SEQ ID NO: 1357819 - DNA, 22 bp, Artificial Sequence
  chemically synthesized
tgtgtctatgacttgttcccac

SEQ ID NO: 1357820 - DNA, 22 bp, Artificial Sequence
  chemically synthesized
caagaagtgggaacaagtcata

SEQ ID NO: 1357821 - DNA, 22 bp, Artificial Sequence
  chemically synthesized
atgtaattttgtgtctatgact

SEQ ID NO: 1357822 - DNA, 22 bp, Artificial Sequence
  chemically synthesized
gttcatgtaattttgtgtctat

SEQ ID NO: 1357823 - DNA, 22 bp, Artificial Sequence
  chemically synthesized
ggttcatgtaattttgtgtcta

SEQ ID NO: 1357824 - DNA, 22 bp, Artificial Sequence
  chemically synthesized
tggttcatgtaattttgtgtct

SEQ ID NO: 1357825 - DNA, 22 bp, Artificial Sequence
  chemically synthesized
agcaaataaaataactttggtt

SEQ ID NO: 1357826 - DNA, 22 bp, Artificial Sequence
  chemically synthesized
gttcagcaaataaaataacttt

SEQ ID NO: 1357827 - DNA, 22 bp, Artificial Sequence
  chemically synthesized
ggttcagcaaataaaataactt

SEQ ID NO: 1357828 - DNA, 22 bp, Artificial Sequence
  chemically synthesized
tggttcagcaaataaaataact

SEQ ID NO: 1357829 - DNA, 22 bp, Artificial Sequence
  chemically synthesized
catgaaccaaagttattttatt

SEQ ID NO: 1357830 - DNA, 22 bp, Artificial Sequence
  chemically synthesized
ctttggttcagcaaataaaata

SEQ ID NO: 1357831 - DNA, 22 bp, Artificial Sequence
  chemically synthesized
gatataaaattactttggttca

SEQ ID NO: 1357832 - DNA, 22 bp, Artificial Sequence
  chemically synthesized
ttttatttgctgaaccaaagta

SEQ ID NO: 1357833 - DNA, 22 bp, Artificial Sequence
  chemically synthesized
tctagatataaaattactttgg

SEQ ID NO: 1357834 - DNA, 22 bp, Artificial Sequence
  chemically synthesized
tatttgctgaaccaaagtaatt

SEQ ID NO: 1357835 - DNA, 22 bp, Artificial Sequence
  chemically synthesized
atttgctgaaccaaagtaattt

SEQ ID NO: 1357836 - DNA, 22 bp, Artificial Sequence
  chemically synthesized
tgtctagatataaaattacttt

SEQ ID NO: 1357837 - DNA, 22 bp, Artificial Sequence
  chemically synthesized
tttgctgaaccaaagtaatttt

SEQ ID NO: 1357838 - DNA, 22 bp, Artificial Sequence
  chemically synthesized
ctgtctagatataaaattactt

SEQ ID NO: 1357839 - DNA, 22 bp, Artificial Sequence
  chemically synthesized
gctgaaccaaagtaattttata

SEQ ID NO: 1357840 - DNA, 22 bp, Artificial Sequence
  chemically synthesized
ctgaaccaaagtaattttatat

SEQ ID NO: 1357841 - DNA, 22 bp, Artificial Sequence
  chemically synthesized
aaccaaagtaattttatatcta

SEQ ID NO: 1357842 - DNA, 22 bp, Artificial Sequence
  chemically synthesized
cccaccaggaacacttctgtct

SEQ ID NO: 1357843 - DNA, 22 bp, Artificial Sequence
  chemically synthesized
ttccccaccaggaacacttctg

SEQ ID NO: 1357844 - DNA, 22 bp, Artificial Sequence
  chemically synthesized
tatatctagacagaagtgttcc

SEQ ID NO: 1357845 - DNA, 22 bp, Artificial Sequence
  chemically synthesized
atatctagacagaagtgttcct

SEQ ID NO: 1357846 - DNA, 22 bp, Artificial Sequence
  chemically synthesized
ctgttccccaccaggaacactt

SEQ ID NO: 1357847 - DNA, 22 bp, Artificial Sequence
  chemically synthesized
tatctagacagaagtgttcctg

SEQ ID NO: 1357848 - DNA, 22 bp, Artificial Sequence
  chemically synthesized
atctgctgttccccaccaggaa

SEQ ID NO: 1357849 - DNA, 22 bp, Artificial Sequence
  chemically synthesized
gacagaagtgttcctggtgggg

SEQ ID NO: 1357850 - DNA, 22 bp, Artificial Sequence
  chemically synthesized
ctgatctgctgttccccaccag

SEQ ID NO: 1357851 - DNA, 22 bp, Artificial Sequence
  chemically synthesized
acctcctgatctgctgttcccc

SEQ ID NO: 1357852 - DNA, 22 bp, Artificial Sequence
  chemically synthesized
tcacctcctgatctgctgttcc

SEQ ID NO: 1357853 - DNA, 22 bp, Artificial Sequence
  chemically synthesized
ctggtggggaacagcagatcag

SEQ ID NO: 1357854 - DNA, 22 bp, Artificial Sequence
  chemically synthesized
atgtctctcacctcctgatctg

SEQ ID NO: 1357855 - DNA, 22 bp, Artificial Sequence
  chemically synthesized
gtggggaacagcagatcaggag

SEQ ID NO: 1357856 - DNA, 22 bp, Artificial Sequence
  chemically synthesized
ctcatgtctctcacctcctgat

SEQ ID NO: 1357857 - DNA, 22 bp, Artificial Sequence
  chemically synthesized
acagtatggcatctgctcatgt

SEQ ID NO: 1357858 - DNA, 22 bp, Artificial Sequence
  chemically synthesized
cacagtatggcatctgctcatg

SEQ ID NO: 1357859 - DNA, 22 bp, Artificial Sequence
  chemically synthesized
tcacagtatggcatctgctcat

SEQ ID NO: 1357860 - DNA, 22 bp, Artificial Sequence
  chemically synthesized
acgtacaaggtctttcacagta

SEQ ID NO: 1357861 - DNA, 22 bp, Artificial Sequence
  chemically synthesized
tgaaagaccttgtacgttagga

SEQ ID NO: 1357862 - DNA, 22 bp, Artificial Sequence
  chemically synthesized
agggtaaaatccaaggtcctaa

SEQ ID NO: 1357863 - DNA, 22 bp, Artificial Sequence
  chemically synthesized
cagggtaaaatccaaggtccta

SEQ ID NO: 1357864 - DNA, 22 bp, Artificial Sequence
  chemically synthesized
gcttcagggtaaaatccaaggt

SEQ ID NO: 1357865 - DNA, 22 bp, Artificial Sequence
  chemically synthesized
gtacgttaggaccttggatttt

SEQ ID NO: 1357866 - DNA, 22 bp, Artificial Sequence
  chemically synthesized
tagcttcagggtaaaatccaag

SEQ ID NO: 1357867 - DNA, 22 bp, Artificial Sequence
  chemically synthesized
tacgttaggaccttggatttta

SEQ ID NO: 1357868 - DNA, 22 bp, Artificial Sequence
  chemically synthesized
ctagcttcagggtaaaatccaa

SEQ ID NO: 1357869 - DNA, 22 bp, Artificial Sequence
  chemically synthesized
ggaccttggattttaccctgaa

SEQ ID NO: 1357870 - DNA, 22 bp, Artificial Sequence
  chemically synthesized
gagaatcttctagcttcagggt

SEQ ID NO: 1357871 - DNA, 22 bp, Artificial Sequence
  chemically synthesized
agagaatcttctagcttcaggg

SEQ ID NO: 1357872 - DNA, 22 bp, Artificial Sequence
  chemically synthesized
tagagaatcttctagcttcagg

SEQ ID NO: 1357873 - DNA, 22 bp, Artificial Sequence
  chemically synthesized
ggattttaccctgaagctagaa

SEQ ID NO: 1357874 - DNA, 22 bp, Artificial Sequence
  chemically synthesized
gattttaccctgaagctagaag

SEQ ID NO: 1357875 - DNA, 22 bp, Artificial Sequence
  chemically synthesized
acgtcctttagagaatcttcta

SEQ ID NO: 1357876 - DNA, 22 bp, Artificial Sequence
  chemically synthesized
taccctgaagctagaagattct

SEQ ID NO: 1357877 - DNA, 22 bp, Artificial Sequence
  chemically synthesized
aacgtcctttagagaatcttct

SEQ ID NO: 1357878 - DNA, 22 bp, Artificial Sequence
  chemically synthesized
accctgaagctagaagattctc

SEQ ID NO: 1357879 - DNA, 22 bp, Artificial Sequence
  chemically synthesized
ccctgaagctagaagattctct

SEQ ID NO: 1357880 - DNA, 22 bp, Artificial Sequence
  chemically synthesized
cagcttaacgtcctttagagaa

SEQ ID NO: 1357881 - DNA, 22 bp, Artificial Sequence
  chemically synthesized
aagctagaagattctctaaagg

SEQ ID NO: 1357882 - DNA, 22 bp, Artificial Sequence
  chemically synthesized
gaagattctctaaaggacgtta

SEQ ID NO: 1357883 - DNA, 22 bp, Artificial Sequence
  chemically synthesized
tgtgcctccagcttaacgtcct

SEQ ID NO: 1357884 - DNA, 22 bp, Artificial Sequence
  chemically synthesized
tctaaaggacgttaagctggag

SEQ ID NO: 1357885 - DNA, 22 bp, Artificial Sequence
  chemically synthesized
taaaggacgttaagctggaggc

SEQ ID NO: 1357886 - DNA, 22 bp, Artificial Sequence
  chemically synthesized
aaggacgttaagctggaggcac

SEQ ID NO: 1357887 - DNA, 22 bp, Artificial Sequence
  chemically synthesized
aaacaaataagattgtgtgcct

SEQ ID NO: 1357888 - DNA, 22 bp, Artificial Sequence
  chemically synthesized
taaaacaaataagattgtgtgc

SEQ ID NO: 1357889 - DNA, 22 bp, Artificial Sequence
  chemically synthesized
ctaaaacaaataagattgtgtg

SEQ ID NO: 1357890 - DNA, 22 bp, Artificial Sequence
  chemically synthesized
agctggaggcacacaatcttat

SEQ ID NO: 1357891 - DNA, 22 bp, Artificial Sequence
  chemically synthesized
agtttctaaaacaaataagatt

SEQ ID NO: 1357892 - DNA, 22 bp, Artificial Sequence
  chemically synthesized
gaggcacacaatcttatttgtt

SEQ ID NO: 1357893 - DNA, 22 bp, Artificial Sequence
  chemically synthesized
cccccgttgagtttctaaaaca

SEQ ID NO: 1357894 - DNA, 22 bp, Artificial Sequence
  chemically synthesized
ctgcccccgttgagtttctaaa

SEQ ID NO: 1357895 - DNA, 22 bp, Artificial Sequence
  chemically synthesized
atttgttttagaaactcaacgg

SEQ ID NO: 1357896 - DNA, 22 bp, Artificial Sequence
  chemically synthesized
taattgctgcccccgttgagtt

SEQ ID NO: 1357897 - DNA, 22 bp, Artificial Sequence
  chemically synthesized
tttgttttagaaactcaacggg

SEQ ID NO: 1357898 - DNA, 22 bp, Artificial Sequence
  chemically synthesized
gtaattgctgcccccgttgagt

SEQ ID NO: 1357899 - DNA, 22 bp, Artificial Sequence
  chemically synthesized
gttttagaaactcaacgggggc

SEQ ID NO: 1357900 - DNA, 22 bp, Artificial Sequence
  chemically synthesized
ttttagaaactcaacgggggca

SEQ ID NO: 1357901 - DNA, 22 bp, Artificial Sequence
  chemically synthesized
tagaaactcaacgggggcagca

SEQ ID NO: 1357902 - DNA, 22 bp, Artificial Sequence
  chemically synthesized
agaaactcaacgggggcagcaa

SEQ ID NO: 1357903 - DNA, 22 bp, Artificial Sequence
  chemically synthesized
gaaactcaacgggggcagcaat

SEQ ID NO: 1357904 - DNA, 22 bp, Artificial Sequence
  chemically synthesized
agaaaatcccaccttgtaattg

SEQ ID NO: 1357905 - DNA, 22 bp, Artificial Sequence
  chemically synthesized
aacgggggcagcaattacaagg

SEQ ID NO: 1357906 - DNA, 22 bp, Artificial Sequence
  chemically synthesized
cagaaaatcccaccttgtaatt

SEQ ID NO: 1357907 - DNA, 22 bp, Artificial Sequence
  chemically synthesized
gtcttcagaaaatcccaccttg

SEQ ID NO: 1357908 - DNA, 22 bp, Artificial Sequence
  chemically synthesized
aatctggtcttcagaaaatccc

SEQ ID NO: 1357909 - DNA, 22 bp, Artificial Sequence
  chemically synthesized
caatctggtcttcagaaaatcc

SEQ ID NO: 1357910 - DNA, 22 bp, Artificial Sequence
  chemically synthesized
tcaatctggtcttcagaaaatc

SEQ ID NO: 1357911 - DNA, 22 bp, Artificial Sequence
  chemically synthesized
ctttcaatctggtcttcagaaa

SEQ ID NO: 1357912 - DNA, 22 bp, Artificial Sequence
  chemically synthesized
caaggtgggattttctgaagac

SEQ ID NO: 1357913 - DNA, 22 bp, Artificial Sequence
  chemically synthesized
gctttcaatctggtcttcagaa

SEQ ID NO: 1357914 - DNA, 22 bp, Artificial Sequence
  chemically synthesized
cttgctttcaatctggtcttca

SEQ ID NO: 1357915 - DNA, 22 bp, Artificial Sequence
  chemically synthesized
tctgaagaccagattgaaagca

SEQ ID NO: 1357916 - DNA, 22 bp, Artificial Sequence
  chemically synthesized
ctgaagaccagattgaaagcaa

SEQ ID NO: 1357917 - DNA, 22 bp, Artificial Sequence
  chemically synthesized
tgaagaccagattgaaagcaag

SEQ ID NO: 1357918 - DNA, 22 bp, Artificial Sequence
  chemically synthesized
aagaccagattgaaagcaagga

SEQ ID NO: 1357919 - DNA, 22 bp, Artificial Sequence
  chemically synthesized
tgcgtgtgtgaatgatctcctt

SEQ ID NO: 1357920 - DNA, 22 bp, Artificial Sequence
  chemically synthesized
gtgcgtgtgtgaatgatctcct

SEQ ID NO: 1357921 - DNA, 22 bp, Artificial Sequence
  chemically synthesized
tgtttgtgcgtgtgtgaatgat

SEQ ID NO: 1357922 - DNA, 22 bp, Artificial Sequence
  chemically synthesized
aaagcaaggagatcattcacac

SEQ ID NO: 1357923 - DNA, 22 bp, Artificial Sequence
  chemically synthesized
atgtttgtgcgtgtgtgaatga

SEQ ID NO: 1357924 - DNA, 22 bp, Artificial Sequence
  chemically synthesized
tatgtttgtgcgtgtgtgaatg

SEQ ID NO: 1357925 - DNA, 22 bp, Artificial Sequence
  chemically synthesized
attttatgtttgtgcgtgtgtg

SEQ ID NO: 1357926 - DNA, 22 bp, Artificial Sequence
  chemically synthesized
tgattttatgtttgtgcgtgtg

SEQ ID NO: 1357927 - DNA, 22 bp, Artificial Sequence
  chemically synthesized
cctctgattttatgtttgtgcg

SEQ ID NO: 1357928 - DNA, 22 bp, Artificial Sequence
  chemically synthesized
acacacgcacaaacataaaatc

SEQ ID NO: 1357929 - DNA, 22 bp, Artificial Sequence
  chemically synthesized
tataaacagatacatagatcaa

SEQ ID NO: 1357930 - DNA, 22 bp, Artificial Sequence
  chemically synthesized
gtataaacagatacatagatca

SEQ ID NO: 1357931 - DNA, 22 bp, Artificial Sequence
  chemically synthesized
ttgatctatgtatctgtttata

SEQ ID NO: 1357932 - DNA, 22 bp, Artificial Sequence
  chemically synthesized
gataccaacttgtataaacaga

SEQ ID NO: 1357933 - DNA, 22 bp, Artificial Sequence
  chemically synthesized
tgatctatgtatctgtttatac

SEQ ID NO: 1357934 - DNA, 22 bp, Artificial Sequence
  chemically synthesized
ggataccaacttgtataaacag

SEQ ID NO: 1357935 - DNA, 22 bp, Artificial Sequence
  chemically synthesized
gatctatgtatctgtttataca

SEQ ID NO: 1357936 - DNA, 22 bp, Artificial Sequence
  chemically synthesized
atctatgtatctgtttatacaa

SEQ ID NO: 1357937 - DNA, 22 bp, Artificial Sequence
  chemically synthesized
tgtatctgtttatacaagttgg

SEQ ID NO: 1357938 - DNA, 22 bp, Artificial Sequence
  chemically synthesized
tttatacaagttggtatccaaa

SEQ ID NO: 1357939 - DNA, 22 bp, Artificial Sequence
  chemically synthesized
atacaagttggtatccaaatgt

SEQ ID NO: 1357940 - DNA, 22 bp, Artificial Sequence
  chemically synthesized
aaagataaatgtacatttggat

SEQ ID NO: 1357941 - DNA, 22 bp, Artificial Sequence
  chemically synthesized
tacaagttggtatccaaatgta

SEQ ID NO: 1357942 - DNA, 22 bp, Artificial Sequence
  chemically synthesized
taaaagataaatgtacatttgg

SEQ ID NO: 1357943 - DNA, 22 bp, Artificial Sequence
  chemically synthesized
gtatccaaatgtacatttatct

SEQ ID NO: 1357944 - DNA, 22 bp, Artificial Sequence
  chemically synthesized
atgtatataactctaaaagata

SEQ ID NO: 1357945 - DNA, 22 bp, Artificial Sequence
  chemically synthesized
atcttttagagttatatacatt

SEQ ID NO: 1357946 - DNA, 22 bp, Artificial Sequence
  chemically synthesized
tcttttagagttatatacatta

SEQ ID NO: 1357947 - DNA, 22 bp, Artificial Sequence
  chemically synthesized
atcacaaataactaatgtatat

SEQ ID NO: 1357948 - DNA, 22 bp, Artificial Sequence
  chemically synthesized
ttaatcacaaataactaatgta

SEQ ID NO: 1357949 - DNA, 22 bp, Artificial Sequence
  chemically synthesized
ttagagttatatacattagtta

SEQ ID NO: 1357950 - DNA, 22 bp, Artificial Sequence
  chemically synthesized
tagagttatatacattagttat

SEQ ID NO: 1357951 - DNA, 22 bp, Artificial Sequence
  chemically synthesized
agagttatatacattagttatt

SEQ ID NO: 1357952 - DNA, 22 bp, Artificial Sequence
  chemically synthesized
ttgttaatcacaaataactaat

SEQ ID NO: 1357953 - DNA, 22 bp, Artificial Sequence
  chemically synthesized
gagttatatacattagttattt

SEQ ID NO: 1357954 - DNA, 22 bp, Artificial Sequence
  chemically synthesized
ttattgttaatcacaaataact

SEQ ID NO: 1357955 - DNA, 22 bp, Artificial Sequence
  chemically synthesized
tatacattagttatttgtgatt

SEQ ID NO: 1357956 - DNA, 22 bp, Artificial Sequence
  chemically synthesized
actattattgttaatcacaaat

SEQ ID NO: 1357957 - DNA, 22 bp, Artificial Sequence
  chemically synthesized
aactattattgttaatcacaaa

SEQ ID NO: 1357958 - DNA, 22 bp, Artificial Sequence
  chemically synthesized
taactattattgttaatcacaa

SEQ ID NO: 1357959 - DNA, 22 bp, Artificial Sequence
  chemically synthesized
ttttaactattattgttaatca

SEQ ID NO: 1357960 - DNA, 22 bp, Artificial Sequence
  chemically synthesized
gttatttgtgattaacaataat

SEQ ID NO: 1357961 - DNA, 22 bp, Artificial Sequence
  chemically synthesized
tattattttaactattattgtt

SEQ ID NO: 1357962 - DNA, 22 bp, Artificial Sequence
  chemically synthesized
gtattattttaactattattgt

SEQ ID NO: 1357963 - DNA, 22 bp, Artificial Sequence
  chemically synthesized
tgtattattttaactattattg

SEQ ID NO: 1357964 - DNA, 22 bp, Artificial Sequence
  chemically synthesized
tttgtgattaacaataatagtt

SEQ ID NO: 1357965 - DNA, 22 bp, Artificial Sequence
  chemically synthesized
tttgtattattttaactattat

SEQ ID NO: 1357966 - DNA, 22 bp, Artificial Sequence
  chemically synthesized
ctttgtattattttaactatta

SEQ ID NO: 1357967 - DNA, 22 bp, Artificial Sequence
  chemically synthesized
gtgattaacaataatagttaaa

SEQ ID NO: 1357968 - DNA, 22 bp, Artificial Sequence
  chemically synthesized
tctttgtattattttaactatt

SEQ ID NO: 1357969 - DNA, 22 bp, Artificial Sequence
  chemically synthesized
tgattaacaataatagttaaaa

SEQ ID NO: 1357970 - DNA, 22 bp, Artificial Sequence
  chemically synthesized
ttctttgtattattttaactat

SEQ ID NO: 1357971 - DNA, 22 bp, Artificial Sequence
  chemically synthesized
acaataatagttaaaataatac

SEQ ID NO: 1357972 - DNA, 22 bp, Artificial Sequence
  chemically synthesized
agaataatttttctttgtatta

SEQ ID NO: 1357973 - DNA, 22 bp, Artificial Sequence
  chemically synthesized
aaataatacaaagaaaaattat

SEQ ID NO: 1357974 - DNA, 22 bp, Artificial Sequence
  chemically synthesized
gtgagggtcaaagtgttgagaa

SEQ ID NO: 1357975 - DNA, 22 bp, Artificial Sequence
  chemically synthesized
ggtgagggtcaaagtgttgaga

SEQ ID NO: 1357976 - DNA, 22 bp, Artificial Sequence
  chemically synthesized
ttggtgagggtcaaagtgttga

SEQ ID NO: 1357977 - DNA, 22 bp, Artificial Sequence
  chemically synthesized
cttggtgagggtcaaagtgttg

SEQ ID NO: 1357978 - DNA, 22 bp, Artificial Sequence
  chemically synthesized
ttctcaacactttgaccctcac

SEQ ID NO: 1357979 - DNA, 22 bp, Artificial Sequence
  chemically synthesized
tcaacactttgaccctcaccaa

SEQ ID NO: 1357980 - DNA, 22 bp, Artificial Sequence
  chemically synthesized
aacactttgaccctcaccaaga

SEQ ID NO: 1357981 - DNA, 22 bp, Artificial Sequence
  chemically synthesized
tgaccctcaccaagaaacttta

SEQ ID NO: 1357982 - DNA, 22 bp, Artificial Sequence
  chemically synthesized
gaccctcaccaagaaactttat

SEQ ID NO: 1357983 - DNA, 22 bp, Artificial Sequence
  chemically synthesized
aaagggggatatataaagtttc

SEQ ID NO: 1357984 - DNA, 22 bp, Artificial Sequence
  chemically synthesized
accctcaccaagaaactttata

SEQ ID NO: 1357985 - DNA, 22 bp, Artificial Sequence
  chemically synthesized
aaaagggggatatataaagttt

SEQ ID NO: 1357986 - DNA, 22 bp, Artificial Sequence
  chemically synthesized
taaaagggggatatataaagtt

SEQ ID NO: 1357987 - DNA, 22 bp, Artificial Sequence
  chemically synthesized
gctttaaaagggggatatataa

SEQ ID NO: 1357988 - DNA, 22 bp, Artificial Sequence
  chemically synthesized
accaagaaactttatatatccc

SEQ ID NO: 1357989 - DNA, 22 bp, Artificial Sequence
  chemically synthesized
ttggctttaaaagggggatata

SEQ ID NO: 1357990 - DNA, 22 bp, Artificial Sequence
  chemically synthesized
ttgttggctttaaaagggggat

SEQ ID NO: 1357991 - DNA, 22 bp, Artificial Sequence
  chemically synthesized
attgttggctttaaaaggggga

SEQ ID NO: 1357992 - DNA, 22 bp, Artificial Sequence
  chemically synthesized
cttattgttggctttaaaaggg

SEQ ID NO: 1357993 - DNA, 22 bp, Artificial Sequence
  chemically synthesized
acttattgttggctttaaaagg

SEQ ID NO: 1357994 - DNA, 22 bp, Artificial Sequence
  chemically synthesized
tatatatcccccttttaaagcc

SEQ ID NO: 1357995 - DNA, 22 bp, Artificial Sequence
  chemically synthesized
atatatcccccttttaaagcca

SEQ ID NO: 1357996 - DNA, 22 bp, Artificial Sequence
  chemically synthesized
tatatcccccttttaaagccaa

SEQ ID NO: 1357997 - DNA, 22 bp, Artificial Sequence
  chemically synthesized
acaagcttacttattgttggct

SEQ ID NO: 1357998 - DNA, 22 bp, Artificial Sequence
  chemically synthesized
cacaagcttacttattgttggc

SEQ ID NO: 1357999 - DNA, 22 bp, Artificial Sequence
  chemically synthesized
ttaaagccaacaataagtaagc

SEQ ID NO: 1358000 - DNA, 22 bp, Artificial Sequence
  chemically synthesized
taaagccaacaataagtaagct

SEQ ID NO: 1358001 - DNA, 22 bp, Artificial Sequence
  chemically synthesized
aaagccaacaataagtaagctt

SEQ ID NO: 1358002 - DNA, 22 bp, Artificial Sequence
  chemically synthesized
aagccaacaataagtaagcttg

SEQ ID NO: 1358003 - DNA, 22 bp, Artificial Sequence
  chemically synthesized
ggaaaaataatgccccttcaca

SEQ ID NO: 1358004 - DNA, 22 bp, Artificial Sequence
  chemically synthesized
aagaggaaattaggaaaaataa

SEQ ID NO: 1358005 - DNA, 22 bp, Artificial Sequence
  chemically synthesized
gtgaaggggcattatttttcct

SEQ ID NO: 1358006 - DNA, 22 bp, Artificial Sequence
  chemically synthesized
tgaaggggcattatttttccta

SEQ ID NO: 1358007 - DNA, 22 bp, Artificial Sequence
  chemically synthesized
tcctcaagaggaaattaggaaa

SEQ ID NO: 1358008 - DNA, 22 bp, Artificial Sequence
  chemically synthesized
ctgtcctcaagaggaaattagg

SEQ ID NO: 1358009 - DNA, 22 bp, Artificial Sequence
  chemically synthesized
ctactgtcctcaagaggaaatt

SEQ ID NO: 1358010 - DNA, 22 bp, Artificial Sequence
  chemically synthesized
tttttcctaatttcctcttgag

SEQ ID NO: 1358011 - DNA, 22 bp, Artificial Sequence
  chemically synthesized
ttcctaatttcctcttgaggac

SEQ ID NO: 1358012 - DNA, 22 bp, Artificial Sequence
  chemically synthesized
tcctaatttcctcttgaggaca

SEQ ID NO: 1358013 - DNA, 22 bp, Artificial Sequence
  chemically synthesized
cctaatttcctcttgaggacag

SEQ ID NO: 1358014 - DNA, 22 bp, Artificial Sequence
  chemically synthesized
ctaatttcctcttgaggacagt

SEQ ID NO: 1358015 - DNA, 22 bp, Artificial Sequence
  chemically synthesized
agcatgtctactactgtcctca

SEQ ID NO: 1358016 - DNA, 22 bp, Artificial Sequence
  chemically synthesized
atttcctcttgaggacagtagt

SEQ ID NO: 1358017 - DNA, 22 bp, Artificial Sequence
  chemically synthesized
agctgagcatgtctactactgt

SEQ ID NO: 1358018 - DNA, 22 bp, Artificial Sequence
  chemically synthesized
cctcttgaggacagtagtagac

SEQ ID NO: 1358019 - DNA, 22 bp, Artificial Sequence
  chemically synthesized
ctcttgaggacagtagtagaca

SEQ ID NO: 1358020 - DNA, 22 bp, Artificial Sequence
  chemically synthesized
ttgaggacagtagtagacatgc

SEQ ID NO: 1358021 - DNA, 22 bp, Artificial Sequence
  chemically synthesized
gcactgagctgagcatgtctac

SEQ ID NO: 1358022 - DNA, 22 bp, Artificial Sequence
  chemically synthesized
gaggacagtagtagacatgctc

SEQ ID NO: 1358023 - DNA, 22 bp, Artificial Sequence
  chemically synthesized
tggcactgagctgagcatgtct

SEQ ID NO: 1358024 - DNA, 22 bp, Artificial Sequence
  chemically synthesized
aggacagtagtagacatgctca

SEQ ID NO: 1358025 - DNA, 22 bp, Artificial Sequence
  chemically synthesized
ctggcactgagctgagcatgtc

SEQ ID NO: 1358026 - DNA, 22 bp, Artificial Sequence
  chemically synthesized
ccatatttctggcactgagctg

SEQ ID NO: 1358027 - DNA, 22 bp, Artificial Sequence
  chemically synthesized
agagcctaccatatttctggca

SEQ ID NO: 1358028 - DNA, 22 bp, Artificial Sequence
  chemically synthesized
attgagagcctaccatatttct

SEQ ID NO: 1358029 - DNA, 22 bp, Artificial Sequence
  chemically synthesized
agctcagtgccagaaatatggt

SEQ ID NO: 1358030 - DNA, 22 bp, Artificial Sequence
  chemically synthesized
agtgccagaaatatggtaggct

SEQ ID NO: 1358031 - DNA, 22 bp, Artificial Sequence
  chemically synthesized
gtattaattgagagcctaccat

SEQ ID NO: 1358032 - DNA, 22 bp, Artificial Sequence
  chemically synthesized
actagtattaattgagagccta

SEQ ID NO: 1358033 - DNA, 22 bp, Artificial Sequence
  chemically synthesized
aactagtattaattgagagcct

SEQ ID NO: 1358034 - DNA, 22 bp, Artificial Sequence
  chemically synthesized
tttaactagtattaattgagag

SEQ ID NO: 1358035 - DNA, 22 bp, Artificial Sequence
  chemically synthesized
atttaactagtattaattgaga

SEQ ID NO: 1358036 - DNA, 22 bp, Artificial Sequence
  chemically synthesized
tcaattaatactagttaaataa

SEQ ID NO: 1358037 - DNA, 22 bp, Artificial Sequence
  chemically synthesized
gacaagccaatatttatttaac

SEQ ID NO: 1358038 - DNA, 22 bp, Artificial Sequence
  chemically synthesized
aattaatactagttaaataaat

SEQ ID NO: 1358039 - DNA, 22 bp, Artificial Sequence
  chemically synthesized
atactagttaaataaatattgg

SEQ ID NO: 1358040 - DNA, 22 bp, Artificial Sequence
  chemically synthesized
gttaaataaatattggcttgtc

SEQ ID NO: 1358041 - DNA, 22 bp, Artificial Sequence
  chemically synthesized
aataaatattggcttgtccagg

SEQ ID NO: 1358042 - DNA, 22 bp, Artificial Sequence
  chemically synthesized
caaaggcaagtaatcctggaca

SEQ ID NO: 1358043 - DNA, 22 bp, Artificial Sequence
  chemically synthesized
cctacaaaggcaagtaatcctg

SEQ ID NO: 1358044 - DNA, 22 bp, Artificial Sequence
  chemically synthesized
tacctacaaaggcaagtaatcc

SEQ ID NO: 1358045 - DNA, 22 bp, Artificial Sequence
  chemically synthesized
gcttgtccaggattacttgcct

SEQ ID NO: 1358046 - DNA, 22 bp, Artificial Sequence
  chemically synthesized
cctctacctacaaaggcaagta

SEQ ID NO: 1358047 - DNA, 22 bp, Artificial Sequence
  chemically synthesized
gcctctacctacaaaggcaagt

SEQ ID NO: 1358048 - DNA, 22 bp, Artificial Sequence
  chemically synthesized
gtccaggattacttgcctttgt

SEQ ID NO: 1358049 - DNA, 22 bp, Artificial Sequence
  chemically synthesized
tccaggattacttgcctttgta

SEQ ID NO: 1358050 - DNA, 22 bp, Artificial Sequence
  chemically synthesized
aacttgcctctacctacaaagg

SEQ ID NO: 1358051 - DNA, 22 bp, Artificial Sequence
  chemically synthesized
aaacttgcctctacctacaaag

SEQ ID NO: 1358052 - DNA, 22 bp, Artificial Sequence
  chemically synthesized
taaacttgcctctacctacaaa

SEQ ID NO: 1358053 - DNA, 22 bp, Artificial Sequence
  chemically synthesized
ggttttaaacttgcctctacct

SEQ ID NO: 1358054 - DNA, 22 bp, Artificial Sequence
  chemically synthesized
cttgcctttgtaggtagaggca

SEQ ID NO: 1358055 - DNA, 22 bp, Artificial Sequence
  chemically synthesized
gcctttgtaggtagaggcaagt

SEQ ID NO: 1358056 - DNA, 22 bp, Artificial Sequence
  chemically synthesized
cctgggttttaaacttgcctct

SEQ ID NO: 1358057 - DNA, 22 bp, Artificial Sequence
  chemically synthesized
cctttgtaggtagaggcaagtt

SEQ ID NO: 1358058 - DNA, 22 bp, Artificial Sequence
  chemically synthesized
tgtaggtagaggcaagtttaaa

SEQ ID NO: 1358059 - DNA, 22 bp, Artificial Sequence
  chemically synthesized
gtaggtagaggcaagtttaaaa

SEQ ID NO: 1358060 - DNA, 22 bp, Artificial Sequence
  chemically synthesized
agactacctgggttttaaactt

SEQ ID NO: 1358061 - DNA, 22 bp, Artificial Sequence
  chemically synthesized
taggtagaggcaagtttaaaac

SEQ ID NO: 1358062 - DNA, 22 bp, Artificial Sequence
  chemically synthesized
acaatgcctgagactacctggg

SEQ ID NO: 1358063 - DNA, 22 bp, Artificial Sequence
  chemically synthesized
gacaatgcctgagactacctgg

SEQ ID NO: 1358064 - DNA, 22 bp, Artificial Sequence
  chemically synthesized
aaaacccaggtagtctcaggca

SEQ ID NO: 1358065 - DNA, 22 bp, Artificial Sequence
  chemically synthesized
aaacccaggtagtctcaggcat

SEQ ID NO: 1358066 - DNA, 22 bp, Artificial Sequence
  chemically synthesized
gtccacgggcatggtaacttga

SEQ ID NO: 1358067 - DNA, 22 bp, Artificial Sequence
  chemically synthesized
aggcattgtcaagttaccatgc

SEQ ID NO: 1358068 - DNA, 22 bp, Artificial Sequence
  chemically synthesized
tgctggtccacgggcatggtaa

SEQ ID NO: 1358069 - DNA, 22 bp, Artificial Sequence
  chemically synthesized
tcaagttaccatgcccgtggac

SEQ ID NO: 1358070 - DNA, 22 bp, Artificial Sequence
  chemically synthesized
gaagttatgctggtccacgggc

SEQ ID NO: 1358071 - DNA, 22 bp, Artificial Sequence
  chemically synthesized
ccatgcccgtggaccagcataa

SEQ ID NO: 1358072 - DNA, 22 bp, Artificial Sequence
  chemically synthesized
tatgacaagcgctagaagttat

SEQ ID NO: 1358073 - DNA, 22 bp, Artificial Sequence
  chemically synthesized
tgaccaaaaaccctatatgaca

SEQ ID NO: 1358074 - DNA, 22 bp, Artificial Sequence
  chemically synthesized
atgaccaaaaaccctatatgac

SEQ ID NO: 1358075 - DNA, 22 bp, Artificial Sequence
  chemically synthesized
ctagcgcttgtcatatagggtt

SEQ ID NO: 1358076 - DNA, 22 bp, Artificial Sequence
  chemically synthesized
tttatgaccaaaaaccctatat

SEQ ID NO: 1358077 - DNA, 22 bp, Artificial Sequence
  chemically synthesized
tagcgcttgtcatatagggttt

SEQ ID NO: 1358078 - DNA, 22 bp, Artificial Sequence
  chemically synthesized
gcgcttgtcatatagggttttt

SEQ ID NO: 1358079 - DNA, 22 bp, Artificial Sequence
  chemically synthesized
aggttgtttatgaccaaaaacc

SEQ ID NO: 1358080 - DNA, 22 bp, Artificial Sequence
  chemically synthesized
caggttgtttatgaccaaaaac

SEQ ID NO: 1358081 - DNA, 22 bp, Artificial Sequence
  chemically synthesized
gtcatatagggtttttggtcat

SEQ ID NO: 1358082 - DNA, 22 bp, Artificial Sequence
  chemically synthesized
tcatatagggtttttggtcata

SEQ ID NO: 1358083 - DNA, 22 bp, Artificial Sequence
  chemically synthesized
tgtttcaggttgtttatgacca

SEQ ID NO: 1358084 - DNA, 22 bp, Artificial Sequence
  chemically synthesized
taaggtgttgtgtttcaggttg

SEQ ID NO: 1358085 - DNA, 22 bp, Artificial Sequence
  chemically synthesized
ttggtcataaacaacctgaaac

SEQ ID NO: 1358086 - DNA, 22 bp, Artificial Sequence
  chemically synthesized
gtaaggtgttgtgtttcaggtt

SEQ ID NO: 1358087 - DNA, 22 bp, Artificial Sequence
  chemically synthesized
tggtcataaacaacctgaaaca

SEQ ID NO: 1358088 - DNA, 22 bp, Artificial Sequence
  chemically synthesized
tgtaaggtgttgtgtttcaggt

SEQ ID NO: 1358089 - DNA, 22 bp, Artificial Sequence
  chemically synthesized
ggtcataaacaacctgaaacac

SEQ ID NO: 1358090 - DNA, 22 bp, Artificial Sequence
  chemically synthesized
gtcataaacaacctgaaacaca

SEQ ID NO: 1358091 - DNA, 22 bp, Artificial Sequence
  chemically synthesized
ctttgtaaggtgttgtgtttca

SEQ ID NO: 1358092 - DNA, 22 bp, Artificial Sequence
  chemically synthesized
tatgtcctactttgtaaggtgt

SEQ ID NO: 1358093 - DNA, 22 bp, Artificial Sequence
  chemically synthesized
tatatgtcctactttgtaaggt

SEQ ID NO: 1358094 - DNA, 22 bp, Artificial Sequence
  chemically synthesized
aaacacaacaccttacaaagta

SEQ ID NO: 1358095 - DNA, 22 bp, Artificial Sequence
  chemically synthesized
acaaagtaggacatatagaata

SEQ ID NO: 1358096 - DNA, 22 bp, Artificial Sequence
  chemically synthesized
caaagtaggacatatagaatac

SEQ ID NO: 1358097 - DNA, 22 bp, Artificial Sequence
  chemically synthesized
aataaaatatcatgatgatgga

SEQ ID NO: 1358098 - DNA, 22 bp, Artificial Sequence
  chemically synthesized
attgaataaaatatcatgatga

SEQ ID NO: 1358099 - DNA, 22 bp, Artificial Sequence
  chemically synthesized
catcatcatgatattttattca

SEQ ID NO: 1358100 - DNA, 22 bp, Artificial Sequence
  chemically synthesized
tatgggaacgtgcatcactgat

SEQ ID NO: 1358101 - DNA, 22 bp, Artificial Sequence
  chemically synthesized
ttatatgggaacgtgcatcact

SEQ ID NO: 1358102 - DNA, 22 bp, Artificial Sequence
  chemically synthesized
tattatatgggaacgtgcatca

SEQ ID NO: 1358103 - DNA, 22 bp, Artificial Sequence
  chemically synthesized
tattcaatcagtgatgcacgtt

SEQ ID NO: 1358104 - DNA, 22 bp, Artificial Sequence
  chemically synthesized
ctattatatgggaacgtgcatc

SEQ ID NO: 1358105 - DNA, 22 bp, Artificial Sequence
  chemically synthesized
attcaatcagtgatgcacgttc

SEQ ID NO: 1358106 - DNA, 22 bp, Artificial Sequence
  chemically synthesized
ttcaatcagtgatgcacgttcc

SEQ ID NO: 1358107 - DNA, 22 bp, Artificial Sequence
  chemically synthesized
aatcagtgatgcacgttcccat

SEQ ID NO: 1358108 - DNA, 22 bp, Artificial Sequence
  chemically synthesized
gaatgcaatccatttctattat

SEQ ID NO: 1358109 - DNA, 22 bp, Artificial Sequence
  chemically synthesized
ctagaatgcaatccatttctat

SEQ ID NO: 1358110 - DNA, 22 bp, Artificial Sequence
  chemically synthesized
ccatataatagaaatggattgc

SEQ ID NO: 1358111 - DNA, 22 bp, Artificial Sequence
  chemically synthesized
atctgctagaatgcaatccatt

SEQ ID NO: 1358112 - DNA, 22 bp, Artificial Sequence
  chemically synthesized
atgctaatctgctagaatgcaa

SEQ ID NO: 1358113 - DNA, 22 bp, Artificial Sequence
  chemically synthesized
aatgctaatctgctagaatgca

SEQ ID NO: 1358114 - DNA, 22 bp, Artificial Sequence
  chemically synthesized
cattctagcagattagcattaa

SEQ ID NO: 1358115 - DNA, 22 bp, Artificial Sequence
  chemically synthesized
tagcagattagcattaaaccat

SEQ ID NO: 1358116 - DNA, 22 bp, Artificial Sequence
  chemically synthesized
aaggtacaaaggatggtttaat

SEQ ID NO: 1358117 - DNA, 22 bp, Artificial Sequence
  chemically synthesized
gcagattagcattaaaccatcc

SEQ ID NO: 1358118 - DNA, 22 bp, Artificial Sequence
  chemically synthesized
tcactcaaggtacaaaggatgg

SEQ ID NO: 1358119 - DNA, 22 bp, Artificial Sequence
  chemically synthesized
gcattaaaccatcctttgtacc

SEQ ID NO: 1358120 - DNA, 22 bp, Artificial Sequence
  chemically synthesized
ataagtctatcactcaaggtac

SEQ ID NO: 1358121 - DNA, 22 bp, Artificial Sequence
  chemically synthesized
aaccatcctttgtaccttgagt

SEQ ID NO: 1358122 - DNA, 22 bp, Artificial Sequence
  chemically synthesized
taaattaataagtctatcactc

SEQ ID NO: 1358123 - DNA, 22 bp, Artificial Sequence
  chemically synthesized
gtaaattaataagtctatcact

SEQ ID NO: 1358124 - DNA, 22 bp, Artificial Sequence
  chemically synthesized
tgtaccttgagtgatagactta

SEQ ID NO: 1358125 - DNA, 22 bp, Artificial Sequence
  chemically synthesized
gtaccttgagtgatagacttat

SEQ ID NO: 1358126 - DNA, 22 bp, Artificial Sequence
  chemically synthesized
taccttgagtgatagacttatt

SEQ ID NO: 1358127 - DNA, 22 bp, Artificial Sequence
  chemically synthesized
gagtgatagacttattaattta

SEQ ID NO: 1358128 - DNA, 22 bp, Artificial Sequence
  chemically synthesized
agtgatagacttattaatttac

SEQ ID NO: 1358129 - DNA, 22 bp, Artificial Sequence
  chemically synthesized
atcgaggataagtcttgtaaat

SEQ ID NO: 1358130 - DNA, 22 bp, Artificial Sequence
  chemically synthesized
attaatttacaagacttatcct

SEQ ID NO: 1358131 - DNA, 22 bp, Artificial Sequence
  chemically synthesized
ttaatttacaagacttatcctc

SEQ ID NO: 1358132 - DNA, 22 bp, Artificial Sequence
  chemically synthesized
atttacaagacttatcctcgat

SEQ ID NO: 1358133 - DNA, 22 bp, Artificial Sequence
  chemically synthesized
acaagacttatcctcgattagg

SEQ ID NO: 1358134 - DNA, 22 bp, Artificial Sequence
  chemically synthesized
caagacttatcctcgattaggt

SEQ ID NO: 1358135 - DNA, 22 bp, Artificial Sequence
  chemically synthesized
gggtatcatcaccaaacctaat

SEQ ID NO: 1358136 - DNA, 22 bp, Artificial Sequence
  chemically synthesized
atcctcgattaggtttggtgat

SEQ ID NO: 1358137 - DNA, 22 bp, Artificial Sequence
  chemically synthesized
tcctcgattaggtttggtgatg

SEQ ID NO: 1358138 - DNA, 22 bp, Artificial Sequence
  chemically synthesized
aaggctagggtatcatcaccaa

SEQ ID NO: 1358139 - DNA, 22 bp, Artificial Sequence
  chemically synthesized
tgaaggctagggtatcatcacc

SEQ ID NO: 1358140 - DNA, 22 bp, Artificial Sequence
  chemically synthesized
ctgaaggctagggtatcatcac

SEQ ID NO: 1358141 - DNA, 22 bp, Artificial Sequence
  chemically synthesized
gattaggtttggtgatgatacc

SEQ ID NO: 1358142 - DNA, 22 bp, Artificial Sequence
  chemically synthesized
tctgaaggctagggtatcatca

SEQ ID NO: 1358143 - DNA, 22 bp, Artificial Sequence
  chemically synthesized
gttttctgaaggctagggtatc

SEQ ID NO: 1358144 - DNA, 22 bp, Artificial Sequence
  chemically synthesized
ggtttggtgatgataccctagc

SEQ ID NO: 1358145 - DNA, 22 bp, Artificial Sequence
  chemically synthesized
ggttttctgaaggctagggtat

SEQ ID NO: 1358146 - DNA, 22 bp, Artificial Sequence
  chemically synthesized
ttggttttctgaaggctagggt

SEQ ID NO: 1358147 - DNA, 22 bp, Artificial Sequence
  chemically synthesized
ggtgatgataccctagccttca

SEQ ID NO: 1358148 - DNA, 22 bp, Artificial Sequence
  chemically synthesized
gtgatgataccctagccttcag

SEQ ID NO: 1358149 - DNA, 22 bp, Artificial Sequence
  chemically synthesized
ataagctcttggttttctgaag

SEQ ID NO: 1358150 - DNA, 22 bp, Artificial Sequence
  chemically synthesized
aataagctcttggttttctgaa

SEQ ID NO: 1358151 - DNA, 22 bp, Artificial Sequence
  chemically synthesized
taataagctcttggttttctga

SEQ ID NO: 1358152 - DNA, 22 bp, Artificial Sequence
  chemically synthesized
gacctttaataagctcttggtt

SEQ ID NO: 1358153 - DNA, 22 bp, Artificial Sequence
  chemically synthesized
gccttcagaaaaccaagagctt

SEQ ID NO: 1358154 - DNA, 22 bp, Artificial Sequence
  chemically synthesized
cagaaaaccaagagcttattaa

SEQ ID NO: 1358155 - DNA, 22 bp, Artificial Sequence
  chemically synthesized
agaaaaccaagagcttattaaa

SEQ ID NO: 1358156 - DNA, 22 bp, Artificial Sequence
  chemically synthesized
aaaaatacagcattagaccttt

SEQ ID NO: 1358157 - DNA, 22 bp, Artificial Sequence
  chemically synthesized
gaaaaatacagcattagacctt

SEQ ID NO: 1358158 - DNA, 22 bp, Artificial Sequence
  chemically synthesized
attaaaggtctaatgctgtatt

SEQ ID NO: 1358159 - DNA, 22 bp, Artificial Sequence
  chemically synthesized
ttaaaggtctaatgctgtattt

SEQ ID NO: 1358160 - DNA, 22 bp, Artificial Sequence
  chemically synthesized
aaggtctaatgctgtatttttc

SEQ ID NO: 1358161 - DNA, 22 bp, Artificial Sequence
  chemically synthesized
caaaataaaaatttgaaaaata

SEQ ID NO: 1358162 - DNA, 22 bp, Artificial Sequence
  chemically synthesized
atgctgtatttttcaaattttt

SEQ ID NO: 1358163 - DNA, 22 bp, Artificial Sequence
  chemically synthesized
taatgattgcaaaataaaaatt

SEQ ID NO: 1358164 - DNA, 22 bp, Artificial Sequence
  chemically synthesized
tatttttcaaatttttattttg

SEQ ID NO: 1358165 - DNA, 22 bp, Artificial Sequence
  chemically synthesized
ttcaaatttttattttgcaatc

SEQ ID NO: 1358166 - DNA, 22 bp, Artificial Sequence
  chemically synthesized
tgagtctataatgattgcaaaa

SEQ ID NO: 1358167 - DNA, 22 bp, Artificial Sequence
  chemically synthesized
tcaaatttttattttgcaatca

SEQ ID NO: 1358168 - DNA, 22 bp, Artificial Sequence
  chemically synthesized
caaatttttattttgcaatcat

SEQ ID NO: 1358169 - DNA, 22 bp, Artificial Sequence
  chemically synthesized
aaatttttattttgcaatcatt

SEQ ID NO: 1358170 - DNA, 22 bp, Artificial Sequence
  chemically synthesized
ctgtgagtctataatgattgca

SEQ ID NO: 1358171 - DNA, 22 bp, Artificial Sequence
  chemically synthesized
cctgtgagtctataatgattgc

SEQ ID NO: 1358172 - DNA, 22 bp, Artificial Sequence
  chemically synthesized
ttattttgcaatcattatagac

SEQ ID NO: 1358173 - DNA, 22 bp, Artificial Sequence
  chemically synthesized
tattttgcaatcattatagact

SEQ ID NO: 1358174 - DNA, 22 bp, Artificial Sequence
  chemically synthesized
cgacttcctgtgagtctataat

SEQ ID NO: 1358175 - DNA, 22 bp, Artificial Sequence
  chemically synthesized
attttgcaatcattatagactc

SEQ ID NO: 1358176 - DNA, 22 bp, Artificial Sequence
  chemically synthesized
gcgacttcctgtgagtctataa

SEQ ID NO: 1358177 - DNA, 22 bp, Artificial Sequence
  chemically synthesized
ttttgcaatcattatagactca

SEQ ID NO: 1358178 - DNA, 22 bp, Artificial Sequence
  chemically synthesized
tgcgacttcctgtgagtctata

SEQ ID NO: 1358179 - DNA, 22 bp, Artificial Sequence
  chemically synthesized
tttgcgacttcctgtgagtcta

SEQ ID NO: 1358180 - DNA, 22 bp, Artificial Sequence
  chemically synthesized
tgcaatcattatagactcacag

SEQ ID NO: 1358181 - DNA, 22 bp, Artificial Sequence
  chemically synthesized
ctttgcgacttcctgtgagtct

SEQ ID NO: 1358182 - DNA, 22 bp, Artificial Sequence
  chemically synthesized
gcaatcattatagactcacagg

SEQ ID NO: 1358183 - DNA, 22 bp, Artificial Sequence
  chemically synthesized
caatcattatagactcacagga

SEQ ID NO: 1358184 - DNA, 22 bp, Artificial Sequence
  chemically synthesized
catatttctttgcgacttcctg

SEQ ID NO: 1358185 - DNA, 22 bp, Artificial Sequence
  chemically synthesized
ttgcatatttctttgcgacttc

SEQ ID NO: 1358186 - DNA, 22 bp, Artificial Sequence
  chemically synthesized
tagactcacaggaagtcgcaaa

SEQ ID NO: 1358187 - DNA, 22 bp, Artificial Sequence
  chemically synthesized
acaggaagtcgcaaagaaatat

SEQ ID NO: 1358188 - DNA, 22 bp, Artificial Sequence
  chemically synthesized
cacaagacattgttgcatattt

SEQ ID NO: 1358189 - DNA, 22 bp, Artificial Sequence
  chemically synthesized
gcacaagacattgttgcatatt

SEQ ID NO: 1358190 - DNA, 22 bp, Artificial Sequence
  chemically synthesized
ggagaggtaaagtgaagtttgc

SEQ ID NO: 1358191 - DNA, 22 bp, Artificial Sequence
  chemically synthesized
gtgcaaacttcactttacctct

SEQ ID NO: 1358192 - DNA, 22 bp, Artificial Sequence
  chemically synthesized
tgcaaacttcactttacctctc

SEQ ID NO: 1358193 - DNA, 22 bp, Artificial Sequence
  chemically synthesized
tacatggtatcaacattgggag

SEQ ID NO: 1358194 - DNA, 22 bp, Artificial Sequence
  chemically synthesized
cactttacctctcccaatgttg

SEQ ID NO: 1358195 - DNA, 22 bp, Artificial Sequence
  chemically synthesized
actttacctctcccaatgttga

SEQ ID NO: 1358196 - DNA, 22 bp, Artificial Sequence
  chemically synthesized
tagttatacatggtatcaacat

SEQ ID NO: 1358197 - DNA, 22 bp, Artificial Sequence
  chemically synthesized
tacctctcccaatgttgatacc

SEQ ID NO: 1358198 - DNA, 22 bp, Artificial Sequence
  chemically synthesized
acctctcccaatgttgatacca

SEQ ID NO: 1358199 - DNA, 22 bp, Artificial Sequence
  chemically synthesized
cctctcccaatgttgataccat

SEQ ID NO: 1358200 - DNA, 22 bp, Artificial Sequence
  chemically synthesized
tactatagttatacatggtatc

SEQ ID NO: 1358201 - DNA, 22 bp, Artificial Sequence
  chemically synthesized
tcccaatgttgataccatgtat

SEQ ID NO: 1358202 - DNA, 22 bp, Artificial Sequence
  chemically synthesized
ccaatgttgataccatgtataa

SEQ ID NO: 1358203 - DNA, 22 bp, Artificial Sequence
  chemically synthesized
tattgtactatagttatacatg

SEQ ID NO: 1358204 - DNA, 22 bp, Artificial Sequence
  chemically synthesized
atattgtactatagttatacat

SEQ ID NO: 1358205 - DNA, 22 bp, Artificial Sequence
  chemically synthesized
tatattgtactatagttataca

SEQ ID NO: 1358206 - DNA, 22 bp, Artificial Sequence
  chemically synthesized
ttatattgtactatagttatac

SEQ ID NO: 1358207 - DNA, 22 bp, Artificial Sequence
  chemically synthesized
ataccatgtataactatagtac

SEQ ID NO: 1358208 - DNA, 22 bp, Artificial Sequence
  chemically synthesized
ccagtttttatattgtactata

SEQ ID NO: 1358209 - DNA, 22 bp, Artificial Sequence
  chemically synthesized
cccagtttttatattgtactat

SEQ ID NO: 1358210 - DNA, 22 bp, Artificial Sequence
  chemically synthesized
tagcaataatttcccagttttt

SEQ ID NO: 1358211 - DNA, 22 bp, Artificial Sequence
  chemically synthesized
tagtacaatataaaaactggga

SEQ ID NO: 1358212 - DNA, 22 bp, Artificial Sequence
  chemically synthesized
tgaattatagcaataatttccc

SEQ ID NO: 1358213 - DNA, 22 bp, Artificial Sequence
  chemically synthesized
tatgaattatagcaataatttc

SEQ ID NO: 1358214 - DNA, 22 bp, Artificial Sequence
  chemically synthesized
ggaaattattgctataattcat

SEQ ID NO: 1358215 - DNA, 22 bp, Artificial Sequence
  chemically synthesized
ttgctataattcatagagctta

SEQ ID NO: 1358216 - DNA, 22 bp, Artificial Sequence
  chemically synthesized
gtaaagcccgaataagctctat

SEQ ID NO: 1358217 - DNA, 22 bp, Artificial Sequence
  chemically synthesized
ctataattcatagagcttattc

SEQ ID NO: 1358218 - DNA, 22 bp, Artificial Sequence
  chemically synthesized
tctggtaaagcccgaataagct

SEQ ID NO: 1358219 - DNA, 22 bp, Artificial Sequence
  chemically synthesized
taattcatagagcttattcggg

SEQ ID NO: 1358220 - DNA, 22 bp, Artificial Sequence
  chemically synthesized
tctatctggtaaagcccgaata

SEQ ID NO: 1358221 - DNA, 22 bp, Artificial Sequence
  chemically synthesized
gtctatctggtaaagcccgaat

SEQ ID NO: 1358222 - DNA, 22 bp, Artificial Sequence
  chemically synthesized
atagagcttattcgggctttac

SEQ ID NO: 1358223 - DNA, 22 bp, Artificial Sequence
  chemically synthesized
attcgggctttaccagatagac

SEQ ID NO: 1358224 - DNA, 22 bp, Artificial Sequence
  chemically synthesized
ttcgggctttaccagatagaca

SEQ ID NO: 1358225 - DNA, 22 bp, Artificial Sequence
  chemically synthesized
gggctttaccagatagacaagt

SEQ ID NO: 1358226 - DNA, 22 bp, Artificial Sequence
  chemically synthesized
taccagatagacaagtatgcac

SEQ ID NO: 1358227 - DNA, 22 bp, Artificial Sequence
  chemically synthesized
accagatagacaagtatgcact

SEQ ID NO: 1358228 - DNA, 22 bp, Artificial Sequence
  chemically synthesized
ccagatagacaagtatgcactt

SEQ ID NO: 1358229 - DNA, 22 bp, Artificial Sequence
  chemically synthesized
gtgtgactctggtgtgtgtgtg

SEQ ID NO: 1358230 - DNA, 22 bp, Artificial Sequence
  chemically synthesized
tgtgactctggtgtgtgtgtgt

SEQ ID NO: 1358231 - DNA, 22 bp, Artificial Sequence
  chemically synthesized
acacacaaacacacacacacac

SEQ ID NO: 1358232 - DNA, 22 bp, Artificial Sequence
  chemically synthesized
cacacacaaacacacacacaca

SEQ ID NO: 1358233 - DNA, 22 bp, Artificial Sequence
  chemically synthesized
tggtgtgtgtgtgtgtgtgttt

SEQ ID NO: 1358234 - DNA, 22 bp, Artificial Sequence
  chemically synthesized
gtgtgtgtgtgtgtgtgtttgt

SEQ ID NO: 1358235 - DNA, 22 bp, Artificial Sequence
  chemically synthesized
ataatgtcgaatagagcttcac

SEQ ID NO: 1358236 - DNA, 22 bp, Artificial Sequence
  chemically synthesized
gataatgtcgaatagagcttca

SEQ ID NO: 1358237 - DNA, 22 bp, Artificial Sequence
  chemically synthesized
cacttgataatgtcgaatagag

SEQ ID NO: 1358238 - DNA, 22 bp, Artificial Sequence
  chemically synthesized
gtgtgtgaagctctattcgaca

SEQ ID NO: 1358239 - DNA, 22 bp, Artificial Sequence
  chemically synthesized
tgtgtgaagctctattcgacat

SEQ ID NO: 1358240 - DNA, 22 bp, Artificial Sequence
  chemically synthesized
cacaaagctacacttgataatg

SEQ ID NO: 1358241 - DNA, 22 bp, Artificial Sequence
  chemically synthesized
ttacacaaagctacacttgata

SEQ ID NO: 1358242 - DNA, 22 bp, Artificial Sequence
  chemically synthesized
gttacacaaagctacacttgat

SEQ ID NO: 1358243 - DNA, 22 bp, Artificial Sequence
  chemically synthesized
tattcgacattatcaagtgtag

SEQ ID NO: 1358244 - DNA, 22 bp, Artificial Sequence
  chemically synthesized
ttcgacattatcaagtgtagct

SEQ ID NO: 1358245 - DNA, 22 bp, Artificial Sequence
  chemically synthesized
gacattatcaagtgtagctttg

SEQ ID NO: 1358246 - DNA, 22 bp, Artificial Sequence
  chemically synthesized
tggtgtttgttacacaaagcta

SEQ ID NO: 1358247 - DNA, 22 bp, Artificial Sequence
  chemically synthesized
attgtggtgtttgttacacaaa

SEQ ID NO: 1358248 - DNA, 22 bp, Artificial Sequence
  chemically synthesized
tcaagtgtagctttgtgtaaca

SEQ ID NO: 1358249 - DNA, 22 bp, Artificial Sequence
  chemically synthesized
gattgtggtgtttgttacacaa

SEQ ID NO: 1358250 - DNA, 22 bp, Artificial Sequence
  chemically synthesized
tgattgtggtgtttgttacaca

SEQ ID NO: 1358251 - DNA, 22 bp, Artificial Sequence
  chemically synthesized
aatattttgattgtggtgtttg

SEQ ID NO: 1358252 - DNA, 22 bp, Artificial Sequence
  chemically synthesized
ctcaatattttgattgtggtgt

SEQ ID NO: 1358253 - DNA, 22 bp, Artificial Sequence
  chemically synthesized
tgtgtaacaaacaccacaatca

SEQ ID NO: 1358254 - DNA, 22 bp, Artificial Sequence
  chemically synthesized
gtgtaacaaacaccacaatcaa

SEQ ID NO: 1358255 - DNA, 22 bp, Artificial Sequence
  chemically synthesized
tgtaacaaacaccacaatcaaa

SEQ ID NO: 1358256 - DNA, 22 bp, Artificial Sequence
  chemically synthesized
tggtgatggacctgctcaatat

SEQ ID NO: 1358257 - DNA, 22 bp, Artificial Sequence
  chemically synthesized
gtggtgatggacctgctcaata

SEQ ID NO: 1358258 - DNA, 22 bp, Artificial Sequence
  chemically synthesized
agcaggtccatcaccacaaggc

SEQ ID NO: 1358259 - DNA, 22 bp, Artificial Sequence
  chemically synthesized
tataatggtgccacaatggagc

SEQ ID NO: 1358260 - DNA, 22 bp, Artificial Sequence
  chemically synthesized
cattgtggcaccattatatagc

SEQ ID NO: 1358261 - DNA, 22 bp, Artificial Sequence
  chemically synthesized
tggcaccattatatagcatacc

SEQ ID NO: 1358262 - DNA, 22 bp, Artificial Sequence
  chemically synthesized
tatagcataccctctgccttat

SEQ ID NO: 1358263 - DNA, 22 bp, Artificial Sequence
  chemically synthesized
ccagaggtcaggaataaggcag

SEQ ID NO: 1358264 - DNA, 22 bp, Artificial Sequence
  chemically synthesized
gttgccagaggtcaggaataag

SEQ ID NO: 1358265 - DNA, 22 bp, Artificial Sequence
  chemically synthesized
tgccttattcctgacctctggc

SEQ ID NO: 1358266 - DNA, 22 bp, Artificial Sequence
  chemically synthesized
ccttattcctgacctctggcaa

SEQ ID NO: 1358267 - DNA, 22 bp, Artificial Sequence
  chemically synthesized
agaacagatattggttgccaga

SEQ ID NO: 1358268 - DNA, 22 bp, Artificial Sequence
  chemically synthesized
attcctgacctctggcaaccaa

SEQ ID NO: 1358269 - DNA, 22 bp, Artificial Sequence
  chemically synthesized
ttcctgacctctggcaaccaat

SEQ ID NO: 1358270 - DNA, 22 bp, Artificial Sequence
  chemically synthesized
ctgacctctggcaaccaatatc

SEQ ID NO: 1358271 - DNA, 22 bp, Artificial Sequence
  chemically synthesized
atattaagaacagatattggtt

SEQ ID NO: 1358272 - DNA, 22 bp, Artificial Sequence
  chemically synthesized
acctctggcaaccaatatctgt

SEQ ID NO: 1358273 - DNA, 22 bp, Artificial Sequence
  chemically synthesized
tggcaaccaatatctgttctta

SEQ ID NO: 1358274 - DNA, 22 bp, Artificial Sequence
  chemically synthesized
gcaaccaatatctgttcttaat

SEQ ID NO: 1358275 - DNA, 22 bp, Artificial Sequence
  chemically synthesized
agaacagatattgatattaaga

SEQ ID NO: 1358276 - DNA, 22 bp, Artificial Sequence
  chemically synthesized
tagatattaagaacagatattg

SEQ ID NO: 1358277 - DNA, 22 bp, Artificial Sequence
  chemically synthesized
ttcttaatatcaatatctgttc

SEQ ID NO: 1358278 - DNA, 22 bp, Artificial Sequence
  chemically synthesized
ttaatatcaatatctgttctta

SEQ ID NO: 1358279 - DNA, 22 bp, Artificial Sequence
  chemically synthesized
aatatcaatatctgttcttaat

SEQ ID NO: 1358280 - DNA, 22 bp, Artificial Sequence
  chemically synthesized
atatcaatatctgttcttaata

SEQ ID NO: 1358281 - DNA, 22 bp, Artificial Sequence
  chemically synthesized
aaatataattatagatattaag

SEQ ID NO: 1358282 - DNA, 22 bp, Artificial Sequence
  chemically synthesized
ctgaaatataattatagatatt

SEQ ID NO: 1358283 - DNA, 22 bp, Artificial Sequence
  chemically synthesized
ttcttaatatctataattatat

SEQ ID NO: 1358284 - DNA, 22 bp, Artificial Sequence
  chemically synthesized
ttaatatctataattatatttc

SEQ ID NO: 1358285 - DNA, 22 bp, Artificial Sequence
  chemically synthesized
aatatctataattatatttcag

SEQ ID NO: 1358286 - DNA, 22 bp, Artificial Sequence
  chemically synthesized
tatataacattactgaaatata

SEQ ID NO: 1358287 - DNA, 22 bp, Artificial Sequence
  chemically synthesized
atatctataattatatttcagt

SEQ ID NO: 1358288 - DNA, 22 bp, Artificial Sequence
  chemically synthesized
gtatataacattactgaaatat

SEQ ID NO: 1358289 - DNA, 22 bp, Artificial Sequence
  chemically synthesized
ttgtatataacattactgaaat

SEQ ID NO: 1358290 - DNA, 22 bp, Artificial Sequence
  chemically synthesized
cttgtatataacattactgaaa

SEQ ID NO: 1358291 - DNA, 22 bp, Artificial Sequence
  chemically synthesized
tttcttgtatataacattactg

SEQ ID NO: 1358292 - DNA, 22 bp, Artificial Sequence
  chemically synthesized
taattatatttcagtaatgtta

SEQ ID NO: 1358293 - DNA, 22 bp, Artificial Sequence
  chemically synthesized
tgttatttcttgtatataacat

SEQ ID NO: 1358294 - DNA, 22 bp, Artificial Sequence
  chemically synthesized
tatttcagtaatgttatataca

SEQ ID NO: 1358295 - DNA, 22 bp, Artificial Sequence
  chemically synthesized
cagtaatgttatatacaagaaa

SEQ ID NO: 1358296 - DNA, 22 bp, Artificial Sequence
  chemically synthesized
aatactgtgttatttcttgtat

SEQ ID NO: 1358297 - DNA, 22 bp, Artificial Sequence
  chemically synthesized
agtaatgttatatacaagaaat

SEQ ID NO: 1358298 - DNA, 22 bp, Artificial Sequence
  chemically synthesized
tatacaagaaataacacagtat

SEQ ID NO: 1358299 - DNA, 22 bp, Artificial Sequence
  chemically synthesized
agcaaaaaaaagtcaaaggtta

SEQ ID NO: 1358300 - DNA, 22 bp, Artificial Sequence
  chemically synthesized
aacctttgacttttttttgctc

SEQ ID NO: 1358301 - DNA, 22 bp, Artificial Sequence
  chemically synthesized
acctttgacttttttttgctca

SEQ ID NO: 1358302 - DNA, 22 bp, Artificial Sequence
  chemically synthesized
tgacttttttttgctcaatatg

SEQ ID NO: 1358303 - DNA, 22 bp, Artificial Sequence
  chemically synthesized
gacttttttttgctcaatatgg

SEQ ID NO: 1358304 - DNA, 22 bp, Artificial Sequence
  chemically synthesized
acttttttttgctcaatatggt

SEQ ID NO: 1358305 - DNA, 22 bp, Artificial Sequence
  chemically synthesized
ttttttgctcaatatggtgctc

SEQ ID NO: 1358306 - DNA, 22 bp, Artificial Sequence
  chemically synthesized
tttttgctcaatatggtgctct

SEQ ID NO: 1358307 - DNA, 22 bp, Artificial Sequence
  chemically synthesized
caatggatgtcaagagcaccat

SEQ ID NO: 1358308 - DNA, 22 bp, Artificial Sequence
  chemically synthesized
ttttgctcaatatggtgctctt

SEQ ID NO: 1358309 - DNA, 22 bp, Artificial Sequence
  chemically synthesized
tttgctcaatatggtgctcttg

SEQ ID NO: 1358310 - DNA, 22 bp, Artificial Sequence
  chemically synthesized
ttgctcaatatggtgctcttga

SEQ ID NO: 1358311 - DNA, 22 bp, Artificial Sequence
  chemically synthesized
tgctcaatatggtgctcttgac

SEQ ID NO: 1358312 - DNA, 22 bp, Artificial Sequence
  chemically synthesized
gctcaatatggtgctcttgaca

SEQ ID NO: 1358313 - DNA, 22 bp, Artificial Sequence
  chemically synthesized
ctcaatatggtgctcttgacat

SEQ ID NO: 1358314 - DNA, 22 bp, Artificial Sequence
  chemically synthesized
acaactccaatggatgtcaaga

SEQ ID NO: 1358315 - DNA, 22 bp, Artificial Sequence
  chemically synthesized
aatatggtgctcttgacatcca

SEQ ID NO: 1358316 - DNA, 22 bp, Artificial Sequence
  chemically synthesized
aatattcacaactccaatggat

SEQ ID NO: 1358317 - DNA, 22 bp, Artificial Sequence
  chemically synthesized
atactcaatattcacaactcca

SEQ ID NO: 1358318 - DNA, 22 bp, Artificial Sequence
  chemically synthesized
ttgacatccattggagttgtga

SEQ ID NO: 1358319 - DNA, 22 bp, Artificial Sequence
  chemically synthesized
gacatccattggagttgtgaat

SEQ ID NO: 1358320 - DNA, 22 bp, Artificial Sequence
  chemically synthesized
ctgatactcaatattcacaact

SEQ ID NO: 1358321 - DNA, 22 bp, Artificial Sequence
  chemically synthesized
acatccattggagttgtgaata

SEQ ID NO: 1358322 - DNA, 22 bp, Artificial Sequence
  chemically synthesized
gagttgtgaatattgagtatca

SEQ ID NO: 1358323 - DNA, 22 bp, Artificial Sequence
  chemically synthesized
aaggaatgaactactgatactc

SEQ ID NO: 1358324 - DNA, 22 bp, Artificial Sequence
  chemically synthesized
aaaggaatgaactactgatact

SEQ ID NO: 1358325 - DNA, 22 bp, Artificial Sequence
  chemically synthesized
tgaatattgagtatcagtagtt

SEQ ID NO: 1358326 - DNA, 22 bp, Artificial Sequence
  chemically synthesized
cacaacaatttaaaggaatgaa

SEQ ID NO: 1358327 - DNA, 22 bp, Artificial Sequence
  chemically synthesized
agtatcagtagttcattccttt

SEQ ID NO: 1358328 - DNA, 22 bp, Artificial Sequence
  chemically synthesized
aatactacacaacaatttaaag

SEQ ID NO: 1358329 - DNA, 22 bp, Artificial Sequence
  chemically synthesized
attcctttaaattgttgtgtag

SEQ ID NO: 1358330 - DNA, 22 bp, Artificial Sequence
  chemically synthesized
ataccactaaatactacacaac

SEQ ID NO: 1358331 - DNA, 22 bp, Artificial Sequence
  chemically synthesized
ctttaaattgttgtgtagtatt

SEQ ID NO: 1358332 - DNA, 22 bp, Artificial Sequence
  chemically synthesized
taaattgttgtgtagtatttag

SEQ ID NO: 1358333 - DNA, 22 bp, Artificial Sequence
  chemically synthesized
aaattgttgtgtagtatttagt

SEQ ID NO: 1358334 - DNA, 22 bp, Artificial Sequence
  chemically synthesized
tatactcataccactaaatact

SEQ ID NO: 1358335 - DNA, 22 bp, Artificial Sequence
  chemically synthesized
aattgttgtgtagtatttagtg

SEQ ID NO: 1358336 - DNA, 22 bp, Artificial Sequence
  chemically synthesized
ttatatactcataccactaaat

SEQ ID NO: 1358337 - DNA, 22 bp, Artificial Sequence
  chemically synthesized
ttgtgtagtatttagtggtatg

SEQ ID NO: 1358338 - DNA, 22 bp, Artificial Sequence
  chemically synthesized
tgtagtatttagtggtatgagt

SEQ ID NO: 1358339 - DNA, 22 bp, Artificial Sequence
  chemically synthesized
aacaaactgttatatactcata

SEQ ID NO: 1358340 - DNA, 22 bp, Artificial Sequence
  chemically synthesized
ttaaacaaactgttatatactc

SEQ ID NO: 1358341 - DNA, 22 bp, Artificial Sequence
  chemically synthesized
agtggtatgagtatataacagt

SEQ ID NO: 1358342 - DNA, 22 bp, Artificial Sequence
  chemically synthesized
gtggtatgagtatataacagtt

SEQ ID NO: 1358343 - DNA, 22 bp, Artificial Sequence
  chemically synthesized
aagtatccatcaatgagtgact

SEQ ID NO: 1358344 - DNA, 22 bp, Artificial Sequence
  chemically synthesized
gtttaacagtcactcattgatg

SEQ ID NO: 1358345 - DNA, 22 bp, Artificial Sequence
  chemically synthesized
tttaacagtcactcattgatgg

SEQ ID NO: 1358346 - DNA, 22 bp, Artificial Sequence
  chemically synthesized
aacagtcactcattgatggata

SEQ ID NO: 1358347 - DNA, 22 bp, Artificial Sequence
  chemically synthesized
acagtcactcattgatggatac

SEQ ID NO: 1358348 - DNA, 22 bp, Artificial Sequence
  chemically synthesized
gaaacaagaaacagctcaagta

SEQ ID NO: 1358349 - DNA, 22 bp, Artificial Sequence
  chemically synthesized
attgatggatacttgagctgtt

SEQ ID NO: 1358350 - DNA, 22 bp, Artificial Sequence
  chemically synthesized
atggatacttgagctgtttctt

SEQ ID NO: 1358351 - DNA, 22 bp, Artificial Sequence
  chemically synthesized
gagctgtttcttgtttctagct

SEQ ID NO: 1358352 - DNA, 22 bp, Artificial Sequence
  chemically synthesized
agctgtttcttgtttctagcta

SEQ ID NO: 1358353 - DNA, 22 bp, Artificial Sequence
  chemically synthesized
acatgaatgcagtagctagaaa

SEQ ID NO: 1358354 - DNA, 22 bp, Artificial Sequence
  chemically synthesized
gacatgaatgcagtagctagaa

SEQ ID NO: 1358355 - DNA, 22 bp, Artificial Sequence
  chemically synthesized
tttcttgtttctagctactgca

SEQ ID NO: 1358356 - DNA, 22 bp, Artificial Sequence
  chemically synthesized
cttgtttctagctactgcattc

SEQ ID NO: 1358357 - DNA, 22 bp, Artificial Sequence
  chemically synthesized
ttgtttctagctactgcattca

SEQ ID NO: 1358358 - DNA, 22 bp, Artificial Sequence
  chemically synthesized
gtttctagctactgcattcatg

SEQ ID NO: 1358359 - DNA, 22 bp, Artificial Sequence
  chemically synthesized
tttctagctactgcattcatgt

SEQ ID NO: 1358360 - DNA, 22 bp, Artificial Sequence
  chemically synthesized
acccaaaaaccttgacatgaat

SEQ ID NO: 1358361 - DNA, 22 bp, Artificial Sequence
  chemically synthesized
ctagctactgcattcatgtcaa

SEQ ID NO: 1358362 - DNA, 22 bp, Artificial Sequence
  chemically synthesized
tagctactgcattcatgtcaag

SEQ ID NO: 1358363 - DNA, 22 bp, Artificial Sequence
  chemically synthesized
gctactgcattcatgtcaaggt

SEQ ID NO: 1358364 - DNA, 22 bp, Artificial Sequence
  chemically synthesized
tgttcacccaaaaaccttgaca

SEQ ID NO: 1358365 - DNA, 22 bp, Artificial Sequence
  chemically synthesized
atgttcacccaaaaaccttgac

SEQ ID NO: 1358366 - DNA, 22 bp, Artificial Sequence
  chemically synthesized
ctgcattcatgtcaaggttttt

SEQ ID NO: 1358367 - DNA, 22 bp, Artificial Sequence
  chemically synthesized
cattcatgtcaaggtttttggg

SEQ ID NO: 1358368 - DNA, 22 bp, Artificial Sequence
  chemically synthesized
atgtttatgttcacccaaaaac

SEQ ID NO: 1358369 - DNA, 22 bp, Artificial Sequence
  chemically synthesized
atgtcaaggtttttgggtgaac

SEQ ID NO: 1358370 - DNA, 22 bp, Artificial Sequence
  chemically synthesized
tcccagaaaattgatgtttatg

SEQ ID NO: 1358371 - DNA, 22 bp, Artificial Sequence
  chemically synthesized
atcccagaaaattgatgtttat

SEQ ID NO: 1358372 - DNA, 22 bp, Artificial Sequence
  chemically synthesized
ttgggtgaacataaacatcaat

SEQ ID NO: 1358373 - DNA, 22 bp, Artificial Sequence
  chemically synthesized
tgggtgaacataaacatcaatt

SEQ ID NO: 1358374 - DNA, 22 bp, Artificial Sequence
  chemically synthesized
gggtgaacataaacatcaattt

SEQ ID NO: 1358375 - DNA, 22 bp, Artificial Sequence
  chemically synthesized
ggtgaacataaacatcaatttt

SEQ ID NO: 1358376 - DNA, 22 bp, Artificial Sequence
  chemically synthesized
atatttatcccagaaaattgat

SEQ ID NO: 1358377 - DNA, 22 bp, Artificial Sequence
  chemically synthesized
gatatttatcccagaaaattga

SEQ ID NO: 1358378 - DNA, 22 bp, Artificial Sequence
  chemically synthesized
ttgatatttatcccagaaaatt

SEQ ID NO: 1358379 - DNA, 22 bp, Artificial Sequence
  chemically synthesized
tactcttgatatttatcccaga

SEQ ID NO: 1358380 - DNA, 22 bp, Artificial Sequence
  chemically synthesized
tctgggataaatatcaagagta

SEQ ID NO: 1358381 - DNA, 22 bp, Artificial Sequence
  chemically synthesized
ctgggataaatatcaagagtac

SEQ ID NO: 1358382 - DNA, 22 bp, Artificial Sequence
  chemically synthesized
tgggataaatatcaagagtaca

SEQ ID NO: 1358383 - DNA, 22 bp, Artificial Sequence
  chemically synthesized
ggataaatatcaagagtacaat

SEQ ID NO: 1358384 - DNA, 22 bp, Artificial Sequence
  chemically synthesized
aacatgcagtcaccatacagcc

SEQ ID NO: 1358385 - DNA, 22 bp, Artificial Sequence
  chemically synthesized
aaattaaacatgcagtcaccat

SEQ ID NO: 1358386 - DNA, 22 bp, Artificial Sequence
  chemically synthesized
taaaattaaacatgcagtcacc

SEQ ID NO: 1358387 - DNA, 22 bp, Artificial Sequence
  chemically synthesized
ctgggctgtatggtgactgcat

SEQ ID NO: 1358388 - DNA, 22 bp, Artificial Sequence
  chemically synthesized
ctaaaattaaacatgcagtcac

SEQ ID NO: 1358389 - DNA, 22 bp, Artificial Sequence
  chemically synthesized
ttctaaaattaaacatgcagtc

SEQ ID NO: 1358390 - DNA, 22 bp, Artificial Sequence
  chemically synthesized
ggctgtatggtgactgcatgtt

SEQ ID NO: 1358391 - DNA, 22 bp, Artificial Sequence
  chemically synthesized
cttctaaaattaaacatgcagt

SEQ ID NO: 1358392 - DNA, 22 bp, Artificial Sequence
  chemically synthesized
tatggtgactgcatgtttaatt

SEQ ID NO: 1358393 - DNA, 22 bp, Artificial Sequence
  chemically synthesized
ggagtttcttctaaaattaaac

SEQ ID NO: 1358394 - DNA, 22 bp, Artificial Sequence
  chemically synthesized
aggagtttcttctaaaattaaa

SEQ ID NO: 1358395 - DNA, 22 bp, Artificial Sequence
  chemically synthesized
catgtttaattttagaagaaac

SEQ ID NO: 1358396 - DNA, 22 bp, Artificial Sequence
  chemically synthesized
gaaaacagtttaggagtttctt

SEQ ID NO: 1358397 - DNA, 22 bp, Artificial Sequence
  chemically synthesized
tagaaaacagtttaggagtttc

SEQ ID NO: 1358398 - DNA, 22 bp, Artificial Sequence
  chemically synthesized
aattttagaagaaactcctaaa

SEQ ID NO: 1358399 - DNA, 22 bp, Artificial Sequence
  chemically synthesized
attttagaagaaactcctaaac

SEQ ID NO: 1358400 - DNA, 22 bp, Artificial Sequence
  chemically synthesized
tagaagaaactcctaaactgtt

SEQ ID NO: 1358401 - DNA, 22 bp, Artificial Sequence
  chemically synthesized
agaagaaactcctaaactgttt

SEQ ID NO: 1358402 - DNA, 22 bp, Artificial Sequence
  chemically synthesized
gaagaaactcctaaactgtttt

SEQ ID NO: 1358403 - DNA, 22 bp, Artificial Sequence
  chemically synthesized
ctaaactgttttctagaatggt

SEQ ID NO: 1358404 - DNA, 22 bp, Artificial Sequence
  chemically synthesized
aactgttttctagaatggttgt

SEQ ID NO: 1358405 - DNA, 22 bp, Artificial Sequence
  chemically synthesized
ttttctagaatggttgtaccat

SEQ ID NO: 1358406 - DNA, 22 bp, Artificial Sequence
  chemically synthesized
atgggaatgtaaaatggtacaa

SEQ ID NO: 1358407 - DNA, 22 bp, Artificial Sequence
  chemically synthesized
tctagaatggttgtaccatttt

SEQ ID NO: 1358408 - DNA, 22 bp, Artificial Sequence
  chemically synthesized
ctagaatggttgtaccatttta

SEQ ID NO: 1358409 - DNA, 22 bp, Artificial Sequence
  chemically synthesized
ctgatgggaatgtaaaatggta

SEQ ID NO: 1358410 - DNA, 22 bp, Artificial Sequence
  chemically synthesized
tagaatggttgtaccattttac

SEQ ID NO: 1358411 - DNA, 22 bp, Artificial Sequence
  chemically synthesized
gaatggttgtaccattttacat

SEQ ID NO: 1358412 - DNA, 22 bp, Artificial Sequence
  chemically synthesized
atattgctgatgggaatgtaaa

SEQ ID NO: 1358413 - DNA, 22 bp, Artificial Sequence
  chemically synthesized
taatattgctgatgggaatgta

SEQ ID NO: 1358414 - DNA, 22 bp, Artificial Sequence
  chemically synthesized
ctaatattgctgatgggaatgt

SEQ ID NO: 1358415 - DNA, 22 bp, Artificial Sequence
  chemically synthesized
tctaatattgctgatgggaatg

SEQ ID NO: 1358416 - DNA, 22 bp, Artificial Sequence
  chemically synthesized
taccattttacattcccatcag

SEQ ID NO: 1358417 - DNA, 22 bp, Artificial Sequence
  chemically synthesized
ggtctttctaatattgctgatg

SEQ ID NO: 1358418 - DNA, 22 bp, Artificial Sequence
  chemically synthesized
tacattcccatcagcaatatta

SEQ ID NO: 1358419 - DNA, 22 bp, Artificial Sequence
  chemically synthesized
acattcccatcagcaatattag

SEQ ID NO: 1358420 - DNA, 22 bp, Artificial Sequence
  chemically synthesized
cattcccatcagcaatattaga

SEQ ID NO: 1358421 - DNA, 22 bp, Artificial Sequence
  chemically synthesized
ccatcagcaatattagaaagac

SEQ ID NO: 1358422 - DNA, 22 bp, Artificial Sequence
  chemically synthesized
acagggatgcaaaggaactggg

SEQ ID NO: 1358423 - DNA, 22 bp, Artificial Sequence
  chemically synthesized
gaaagacccagttcctttgcat

SEQ ID NO: 1358424 - DNA, 22 bp, Artificial Sequence
  chemically synthesized
aaagctaacagggatgcaaagg

SEQ ID NO: 1358425 - DNA, 22 bp, Artificial Sequence
  chemically synthesized
ctttgcatccctgttagctttc

SEQ ID NO: 1358426 - DNA, 22 bp, Artificial Sequence
  chemically synthesized
tgcatccctgttagctttcagt

SEQ ID NO: 1358427 - DNA, 22 bp, Artificial Sequence
  chemically synthesized
gcatccctgttagctttcagtg

SEQ ID NO: 1358428 - DNA, 22 bp, Artificial Sequence
  chemically synthesized
catccctgttagctttcagtgt

SEQ ID NO: 1358429 - DNA, 22 bp, Artificial Sequence
  chemically synthesized
ttagctttcagtgttgtcactg

SEQ ID NO: 1358430 - DNA, 22 bp, Artificial Sequence
  chemically synthesized
aaaaaagaaaaacagtgacaac

SEQ ID NO: 1358431 - DNA, 22 bp, Artificial Sequence
  chemically synthesized
gctttcagtgttgtcactgttt

SEQ ID NO: 1358432 - DNA, 22 bp, Artificial Sequence
  chemically synthesized
aaattaaaaaaagaaaaacagt

SEQ ID NO: 1358433 - DNA, 22 bp, Artificial Sequence
  chemically synthesized
tcagtgttgtcactgtttttct

SEQ ID NO: 1358434 - DNA, 22 bp, Artificial Sequence
  chemically synthesized
cagtgttgtcactgtttttctt

SEQ ID NO: 1358435 - DNA, 22 bp, Artificial Sequence
  chemically synthesized
agtgttgtcactgtttttcttt

SEQ ID NO: 1358436 - DNA, 22 bp, Artificial Sequence
  chemically synthesized
tcactgtttttctttttttaat

SEQ ID NO: 1358437 - DNA, 22 bp, Artificial Sequence
  chemically synthesized
tcagaatggctaaaattaaaaa

SEQ ID NO: 1358438 - DNA, 22 bp, Artificial Sequence
  chemically synthesized
tttttctttttttaattttagc

SEQ ID NO: 1358439 - DNA, 22 bp, Artificial Sequence
  chemically synthesized
ttctttttttaattttagccat

SEQ ID NO: 1358440 - DNA, 22 bp, Artificial Sequence
  chemically synthesized
tctttttttaattttagccatt

SEQ ID NO: 1358441 - DNA, 22 bp, Artificial Sequence
  chemically synthesized
tacacctatcagaatggctaaa

SEQ ID NO: 1358442 - DNA, 22 bp, Artificial Sequence
  chemically synthesized
ctttttttaattttagccattc

SEQ ID NO: 1358443 - DNA, 22 bp, Artificial Sequence
  chemically synthesized
tttttttaattttagccattct

SEQ ID NO: 1358444 - DNA, 22 bp, Artificial Sequence
  chemically synthesized
tttttaattttagccattctga

SEQ ID NO: 1358445 - DNA, 22 bp, Artificial Sequence
  chemically synthesized
ttttaattttagccattctgat

SEQ ID NO: 1358446 - DNA, 22 bp, Artificial Sequence
  chemically synthesized
tttaattttagccattctgata

SEQ ID NO: 1358447 - DNA, 22 bp, Artificial Sequence
  chemically synthesized
tcactatacacctatcagaatg

SEQ ID NO: 1358448 - DNA, 22 bp, Artificial Sequence
  chemically synthesized
ttaattttagccattctgatag

SEQ ID NO: 1358449 - DNA, 22 bp, Artificial Sequence
  chemically synthesized
taattttagccattctgatagg

SEQ ID NO: 1358450 - DNA, 22 bp, Artificial Sequence
  chemically synthesized
aattttagccattctgataggt

SEQ ID NO: 1358451 - DNA, 22 bp, Artificial Sequence
  chemically synthesized
attttagccattctgataggtg

SEQ ID NO: 1358452 - DNA, 22 bp, Artificial Sequence
  chemically synthesized
tagccattctgataggtgtata

SEQ ID NO: 1358453 - DNA, 22 bp, Artificial Sequence
  chemically synthesized
agccattctgataggtgtatag

SEQ ID NO: 1358454 - DNA, 22 bp, Artificial Sequence
  chemically synthesized
gccattctgataggtgtatagt

SEQ ID NO: 1358455 - DNA, 22 bp, Artificial Sequence
  chemically synthesized
caatgagttatcactatacacc

SEQ ID NO: 1358456 - DNA, 22 bp, Artificial Sequence
  chemically synthesized
acactacaatgagttatcacta

SEQ ID NO: 1358457 - DNA, 22 bp, Artificial Sequence
  chemically synthesized
tgataggtgtatagtgataact

SEQ ID NO: 1358458 - DNA, 22 bp, Artificial Sequence
  chemically synthesized
ataggtgtatagtgataactca

SEQ ID NO: 1358459 - DNA, 22 bp, Artificial Sequence
  chemically synthesized
aagaaatgcaaattaacactac

SEQ ID NO: 1358460 - DNA, 22 bp, Artificial Sequence
  chemically synthesized
gccattaaagaaatgcaaatta

SEQ ID NO: 1358461 - DNA, 22 bp, Artificial Sequence
  chemically synthesized
attgtagtgttaatttgcattt

SEQ ID NO: 1358462 - DNA, 22 bp, Artificial Sequence
  chemically synthesized
actagccattaaagaaatgcaa

SEQ ID NO: 1358463 - DNA, 22 bp, Artificial Sequence
  chemically synthesized
cactagccattaaagaaatgca

SEQ ID NO: 1358464 - DNA, 22 bp, Artificial Sequence
  chemically synthesized
tagtgttaatttgcatttcttt

SEQ ID NO: 1358465 - DNA, 22 bp, Artificial Sequence
  chemically synthesized
agcttcactagccattaaagaa

SEQ ID NO: 1358466 - DNA, 22 bp, Artificial Sequence
  chemically synthesized
atttgcatttctttaatggcta

SEQ ID NO: 1358467 - DNA, 22 bp, Artificial Sequence
  chemically synthesized
gcatttctttaatggctagtga

SEQ ID NO: 1358468 - DNA, 22 bp, Artificial Sequence
  chemically synthesized
catttctttaatggctagtgaa

SEQ ID NO: 1358469 - DNA, 22 bp, Artificial Sequence
  chemically synthesized
ctttaatggctagtgaagctga

SEQ ID NO: 1358470 - DNA, 22 bp, Artificial Sequence
  chemically synthesized
tttaatggctagtgaagctgaa

SEQ ID NO: 1358471 - DNA, 22 bp, Artificial Sequence
  chemically synthesized
taatggctagtgaagctgaaca

SEQ ID NO: 1358472 - DNA, 22 bp, Artificial Sequence
  chemically synthesized
aatggctagtgaagctgaacat

SEQ ID NO: 1358473 - DNA, 22 bp, Artificial Sequence
  chemically synthesized
atggctagtgaagctgaacatc

SEQ ID NO: 1358474 - DNA, 22 bp, Artificial Sequence
  chemically synthesized
gtgaagctgaacatctttttat

SEQ ID NO: 1358475 - DNA, 22 bp, Artificial Sequence
  chemically synthesized
aacatctttttatgcatttctt

SEQ ID NO: 1358476 - DNA, 22 bp, Artificial Sequence
  chemically synthesized
tttatgcatttctttaccatct

SEQ ID NO: 1358477 - DNA, 22 bp, Artificial Sequence
  chemically synthesized
aagaggatatacagatggtaaa

SEQ ID NO: 1358478 - DNA, 22 bp, Artificial Sequence
  chemically synthesized
ttatgcatttctttaccatctg

SEQ ID NO: 1358479 - DNA, 22 bp, Artificial Sequence
  chemically synthesized
tatgcatttctttaccatctgt

SEQ ID NO: 1358480 - DNA, 22 bp, Artificial Sequence
  chemically synthesized
atgcatttctttaccatctgta

SEQ ID NO: 1358481 - DNA, 22 bp, Artificial Sequence
  chemically synthesized
tgcatttctttaccatctgtat

SEQ ID NO: 1358482 - DNA, 22 bp, Artificial Sequence
  chemically synthesized
actgaagaggatatacagatgg

SEQ ID NO: 1358483 - DNA, 22 bp, Artificial Sequence
  chemically synthesized
cactgaagaggatatacagatg

SEQ ID NO: 1358484 - DNA, 22 bp, Artificial Sequence
  chemically synthesized
ctttaccatctgtatatcctct

SEQ ID NO: 1358485 - DNA, 22 bp, Artificial Sequence
  chemically synthesized
tttaccatctgtatatcctctt

SEQ ID NO: 1358486 - DNA, 22 bp, Artificial Sequence
  chemically synthesized
taccatctgtatatcctcttca

SEQ ID NO: 1358487 - DNA, 22 bp, Artificial Sequence
  chemically synthesized
accatctgtatatcctcttcag

SEQ ID NO: 1358488 - DNA, 22 bp, Artificial Sequence
  chemically synthesized
atagacatttcactgaagagga

SEQ ID NO: 1358489 - DNA, 22 bp, Artificial Sequence
  chemically synthesized
ccatctgtatatcctcttcagt

SEQ ID NO: 1358490 - DNA, 22 bp, Artificial Sequence
  chemically synthesized
aatagacatttcactgaagagg

SEQ ID NO: 1358491 - DNA, 22 bp, Artificial Sequence
  chemically synthesized
tatatcctcttcagtgaaatgt

SEQ ID NO: 1358492 - DNA, 22 bp, Artificial Sequence
  chemically synthesized
ttcagtgaaatgtctattaagg

SEQ ID NO: 1358493 - DNA, 22 bp, Artificial Sequence
  chemically synthesized
cagtgaaatgtctattaaggct

SEQ ID NO: 1358494 - DNA, 22 bp, Artificial Sequence
  chemically synthesized
agtgaaatgtctattaaggctt

SEQ ID NO: 1358495 - DNA, 22 bp, Artificial Sequence
  chemically synthesized
gtggaaaaaaatgtgggaaaag

SEQ ID NO: 1358496 - DNA, 22 bp, Artificial Sequence
  chemically synthesized
ttaaggcttttcccacattttt

SEQ ID NO: 1358497 - DNA, 22 bp, Artificial Sequence
  chemically synthesized
aggcttttcccacatttttttc

SEQ ID NO: 1358498 - DNA, 22 bp, Artificial Sequence
  chemically synthesized
ttcccacatttttttccactag

SEQ ID NO: 1358499 - DNA, 22 bp, Artificial Sequence
  chemically synthesized
tcccacatttttttccactaga

SEQ ID NO: 1358500 - DNA, 22 bp, Artificial Sequence
  chemically synthesized
cccacatttttttccactagat

SEQ ID NO: 1358501 - DNA, 22 bp, Artificial Sequence
  chemically synthesized
aaaccacaaataatctagtgga

SEQ ID NO: 1358502 - DNA, 22 bp, Artificial Sequence
  chemically synthesized
ccacatttttttccactagatt

SEQ ID NO: 1358503 - DNA, 22 bp, Artificial Sequence
  chemically synthesized
agcactaaaaccacaaataatc

SEQ ID NO: 1358504 - DNA, 22 bp, Artificial Sequence
  chemically synthesized
ttttccactagattatttgtgg

SEQ ID NO: 1358505 - DNA, 22 bp, Artificial Sequence
  chemically synthesized
tttccactagattatttgtggt

SEQ ID NO: 1358506 - DNA, 22 bp, Artificial Sequence
  chemically synthesized
ttccactagattatttgtggtt

SEQ ID NO: 1358507 - DNA, 22 bp, Artificial Sequence
  chemically synthesized
tccactagattatttgtggttt

SEQ ID NO: 1358508 - DNA, 22 bp, Artificial Sequence
  chemically synthesized
ccactagattatttgtggtttt

SEQ ID NO: 1358509 - DNA, 22 bp, Artificial Sequence
  chemically synthesized
cactagattatttgtggtttta

SEQ ID NO: 1358510 - DNA, 22 bp, Artificial Sequence
  chemically synthesized
aaaactgagcactaaaaccaca

SEQ ID NO: 1358511 - DNA, 22 bp, Artificial Sequence
  chemically synthesized
gattatttgtggttttagtgct

SEQ ID NO: 1358512 - DNA, 22 bp, Artificial Sequence
  chemically synthesized
tttgtggttttagtgctcagtt

SEQ ID NO: 1358513 - DNA, 22 bp, Artificial Sequence
  chemically synthesized
gtggttttagtgctcagttttg

SEQ ID NO: 1358514 - DNA, 22 bp, Artificial Sequence
  chemically synthesized
tggttttagtgctcagttttga

SEQ ID NO: 1358515 - DNA, 22 bp, Artificial Sequence
  chemically synthesized
gaatatataaatatcactcaaa

SEQ ID NO: 1358516 - DNA, 22 bp, Artificial Sequence
  chemically synthesized
tagtgctcagttttgagtgata

SEQ ID NO: 1358517 - DNA, 22 bp, Artificial Sequence
  chemically synthesized
agtgctcagttttgagtgatat

SEQ ID NO: 1358518 - DNA, 22 bp, Artificial Sequence
  chemically synthesized
gtgctcagttttgagtgatatt

SEQ ID NO: 1358519 - DNA, 22 bp, Artificial Sequence
  chemically synthesized
gtatctagaatatataaatatc

SEQ ID NO: 1358520 - DNA, 22 bp, Artificial Sequence
  chemically synthesized
agttttgagtgatatttatata

SEQ ID NO: 1358521 - DNA, 22 bp, Artificial Sequence
  chemically synthesized
tgagtgatatttatatattcta

SEQ ID NO: 1358522 - DNA, 22 bp, Artificial Sequence
  chemically synthesized
gagtgatatttatatattctag

SEQ ID NO: 1358523 - DNA, 22 bp, Artificial Sequence
  chemically synthesized
agtgatatttatatattctaga

SEQ ID NO: 1358524 - DNA, 22 bp, Artificial Sequence
  chemically synthesized
aaagaactagtatctagaatat

SEQ ID NO: 1358525 - DNA, 22 bp, Artificial Sequence
  chemically synthesized
taaagtctcaaagaactagtat

SEQ ID NO: 1358526 - DNA, 22 bp, Artificial Sequence
  chemically synthesized
atatattctagatactagttct

SEQ ID NO: 1358527 - DNA, 22 bp, Artificial Sequence
  chemically synthesized
gtaaagtctcaaagaactagta

SEQ ID NO: 1358528 - DNA, 22 bp, Artificial Sequence
  chemically synthesized
tatattctagatactagttctt

SEQ ID NO: 1358529 - DNA, 22 bp, Artificial Sequence
  chemically synthesized
tgtaaagtctcaaagaactagt

SEQ ID NO: 1358530 - DNA, 22 bp, Artificial Sequence
  chemically synthesized
tctttgtaaagtctcaaagaac

SEQ ID NO: 1358531 - DNA, 22 bp, Artificial Sequence
  chemically synthesized
tagatactagttctttgagact

SEQ ID NO: 1358532 - DNA, 22 bp, Artificial Sequence
  chemically synthesized
gatactagttctttgagacttt

SEQ ID NO: 1358533 - DNA, 22 bp, Artificial Sequence
  chemically synthesized
atctatctttgtaaagtctcaa

SEQ ID NO: 1358534 - DNA, 22 bp, Artificial Sequence
  chemically synthesized
aatctatctttgtaaagtctca

SEQ ID NO: 1358535 - DNA, 22 bp, Artificial Sequence
  chemically synthesized
cttaatctatctttgtaaagtc

SEQ ID NO: 1358536 - DNA, 22 bp, Artificial Sequence
  chemically synthesized
ccttaatctatctttgtaaagt

SEQ ID NO: 1358537 - DNA, 22 bp, Artificial Sequence
  chemically synthesized
tccttaatctatctttgtaaag

SEQ ID NO: 1358538 - DNA, 22 bp, Artificial Sequence
  chemically synthesized
gttctttgagactttacaaaga

SEQ ID NO: 1358539 - DNA, 22 bp, Artificial Sequence
  chemically synthesized
tttccttaatctatctttgtaa

SEQ ID NO: 1358540 - DNA, 22 bp, Artificial Sequence
  chemically synthesized
ctttccttaatctatctttgta

SEQ ID NO: 1358541 - DNA, 22 bp, Artificial Sequence
  chemically synthesized
tctttccttaatctatctttgt

SEQ ID NO: 1358542 - DNA, 22 bp, Artificial Sequence
  chemically synthesized
tttgagactttacaaagataga

SEQ ID NO: 1358543 - DNA, 22 bp, Artificial Sequence
  chemically synthesized
ttctttccttaatctatctttg

SEQ ID NO: 1358544 - DNA, 22 bp, Artificial Sequence
  chemically synthesized
tttctttccttaatctatcttt

SEQ ID NO: 1358545 - DNA, 22 bp, Artificial Sequence
  chemically synthesized
tgagactttacaaagatagatt

SEQ ID NO: 1358546 - DNA, 22 bp, Artificial Sequence
  chemically synthesized
gagactttacaaagatagatta

SEQ ID NO: 1358547 - DNA, 22 bp, Artificial Sequence
  chemically synthesized
agactttacaaagatagattaa

SEQ ID NO: 1358548 - DNA, 22 bp, Artificial Sequence
  chemically synthesized
tacaaagatagattaaggaaag

SEQ ID NO: 1358549 - DNA, 22 bp, Artificial Sequence
  chemically synthesized
acaaagatagattaaggaaaga

SEQ ID NO: 1358550 - DNA, 22 bp, Artificial Sequence
  chemically synthesized
caaagatagattaaggaaagaa

SEQ ID NO: 1358551 - DNA, 22 bp, Artificial Sequence
  chemically synthesized
acccatgtcctttttctttcct

SEQ ID NO: 1358552 - DNA, 22 bp, Artificial Sequence
  chemically synthesized
aacccatgtcctttttctttcc

SEQ ID NO: 1358553 - DNA, 22 bp, Artificial Sequence
  chemically synthesized
taacccatgtcctttttctttc

SEQ ID NO: 1358554 - DNA, 22 bp, Artificial Sequence
  chemically synthesized
ttaacccatgtcctttttcttt

SEQ ID NO: 1358555 - DNA, 22 bp, Artificial Sequence
  chemically synthesized
tttttaacccatgtcctttttc

SEQ ID NO: 1358556 - DNA, 22 bp, Artificial Sequence
  chemically synthesized
ctgtttttaacccatgtccttt

SEQ ID NO: 1358557 - DNA, 22 bp, Artificial Sequence
  chemically synthesized
actgtttttaacccatgtcctt

SEQ ID NO: 1358558 - DNA, 22 bp, Artificial Sequence
  chemically synthesized
tactgtttttaacccatgtcct

SEQ ID NO: 1358559 - DNA, 22 bp, Artificial Sequence
  chemically synthesized
aggaaagaaaaaggacatgggt

SEQ ID NO: 1358560 - DNA, 22 bp, Artificial Sequence
  chemically synthesized
ttactgtttttaacccatgtcc

SEQ ID NO: 1358561 - DNA, 22 bp, Artificial Sequence
  chemically synthesized
tttactgtttttaacccatgtc

SEQ ID NO: 1358562 - DNA, 22 bp, Artificial Sequence
  chemically synthesized
ttttttactgtttttaacccat

SEQ ID NO: 1358563 - DNA, 22 bp, Artificial Sequence
  chemically synthesized
gttttttactgtttttaaccca

SEQ ID NO: 1358564 - DNA, 22 bp, Artificial Sequence
  chemically synthesized
tgttttttactgtttttaaccc

SEQ ID NO: 1358565 - DNA, 22 bp, Artificial Sequence
  chemically synthesized
attttgttttttactgttttta

SEQ ID NO: 1358566 - DNA, 22 bp, Artificial Sequence
  chemically synthesized
gattttgttttttactgttttt

SEQ ID NO: 1358567 - DNA, 22 bp, Artificial Sequence
  chemically synthesized
ttgattttgttttttactgttt

SEQ ID NO: 1358568 - DNA, 22 bp, Artificial Sequence
  chemically synthesized
tggttcttgattttgtttttta

SEQ ID NO: 1358569 - DNA, 22 bp, Artificial Sequence
  chemically synthesized
gtggttcttgattttgtttttt

SEQ ID NO: 1358570 - DNA, 22 bp, Artificial Sequence
  chemically synthesized
aaaacagtaaaaaacaaaatca

SEQ ID NO: 1358571 - DNA, 22 bp, Artificial Sequence
  chemically synthesized
acttgtggttcttgattttgtt

SEQ ID NO: 1358572 - DNA, 22 bp, Artificial Sequence
  chemically synthesized
cacttgtggttcttgattttgt

SEQ ID NO: 1358573 - DNA, 22 bp, Artificial Sequence
  chemically synthesized
tcacttgtggttcttgattttg

SEQ ID NO: 1358574 - DNA, 22 bp, Artificial Sequence
  chemically synthesized
ttcacttgtggttcttgatttt

SEQ ID NO: 1358575 - DNA, 22 bp, Artificial Sequence
  chemically synthesized
cttttcacttgtggttcttgat

SEQ ID NO: 1358576 - DNA, 22 bp, Artificial Sequence
  chemically synthesized
ccatactgcttttcacttgtgg

SEQ ID NO: 1358577 - DNA, 22 bp, Artificial Sequence
  chemically synthesized
cccatactgcttttcacttgtg

SEQ ID NO: 1358578 - DNA, 22 bp, Artificial Sequence
  chemically synthesized
atttcccatactgcttttcact

SEQ ID NO: 1358579 - DNA, 22 bp, Artificial Sequence
  chemically synthesized
gatttcccatactgcttttcac

SEQ ID NO: 1358580 - DNA, 22 bp, Artificial Sequence
  chemically synthesized
tgatttcccatactgcttttca

SEQ ID NO: 1358581 - DNA, 22 bp, Artificial Sequence
  chemically synthesized
ttgatttcccatactgcttttc

SEQ ID NO: 1358582 - DNA, 22 bp, Artificial Sequence
  chemically synthesized
tttgatttcccatactgctttt

SEQ ID NO: 1358583 - DNA, 22 bp, Artificial Sequence
  chemically synthesized
ttttgatttcccatactgcttt

SEQ ID NO: 1358584 - DNA, 22 bp, Artificial Sequence
  chemically synthesized
ccttttttgatttcccatactg

SEQ ID NO: 1358585 - DNA, 22 bp, Artificial Sequence
  chemically synthesized
ttcccttttttgatttcccata

SEQ ID NO: 1358586 - DNA, 22 bp, Artificial Sequence
  chemically synthesized
ggtgctgttcccttttttgatt

SEQ ID NO: 1358587 - DNA, 22 bp, Artificial Sequence
  chemically synthesized
tcattgggtgctgttccctttt

SEQ ID NO: 1358588 - DNA, 22 bp, Artificial Sequence
  chemically synthesized
gtcattgggtgctgttcccttt

SEQ ID NO: 1358589 - DNA, 22 bp, Artificial Sequence
  chemically synthesized
tgtcattgggtgctgttccctt

SEQ ID NO: 1358590 - DNA, 22 bp, Artificial Sequence
  chemically synthesized
ttgtcattgggtgctgttccct

SEQ ID NO: 1358591 - DNA, 22 bp, Artificial Sequence
  chemically synthesized
tttgtcattgggtgctgttccc

SEQ ID NO: 1358592 - DNA, 22 bp, Artificial Sequence
  chemically synthesized
ctttttgtcattgggtgctgtt

SEQ ID NO: 1358593 - DNA, 22 bp, Artificial Sequence
  chemically synthesized
gctttttgtcattgggtgctgt

SEQ ID NO: 1358594 - DNA, 22 bp, Artificial Sequence
  chemically synthesized
atatataaatatataataaaga

SEQ ID NO: 1358595 - DNA, 22 bp, Artificial Sequence
  chemically synthesized
catatataaatatataataaag

SEQ ID NO: 1358596 - DNA, 22 bp, Artificial Sequence
  chemically synthesized
aagcttcatatataaatatata

SEQ ID NO: 1358597 - DNA, 22 bp, Artificial Sequence
  chemically synthesized
gttaaagcttcatatataaata

SEQ ID NO: 1358598 - DNA, 22 bp, Artificial Sequence
  chemically synthesized
ggttaaagcttcatatataaat

SEQ ID NO: 1358599 - DNA, 22 bp, Artificial Sequence
  chemically synthesized
tggttaaagcttcatatataaa

SEQ ID NO: 1358600 - DNA, 22 bp, Artificial Sequence
  chemically synthesized
tattatatatttatatatgaag

SEQ ID NO: 1358601 - DNA, 22 bp, Artificial Sequence
  chemically synthesized
attatatatttatatatgaagc

SEQ ID NO: 1358602 - DNA, 22 bp, Artificial Sequence
  chemically synthesized
attttggttaaagcttcatata

SEQ ID NO: 1358603 - DNA, 22 bp, Artificial Sequence
  chemically synthesized
ttatatatttatatatgaagct

SEQ ID NO: 1358604 - DNA, 22 bp, Artificial Sequence
  chemically synthesized
cattttggttaaagcttcatat

SEQ ID NO: 1358605 - DNA, 22 bp, Artificial Sequence
  chemically synthesized
tcattttggttaaagcttcata

SEQ ID NO: 1358606 - DNA, 22 bp, Artificial Sequence
  chemically synthesized
tatatttatatatgaagcttta

SEQ ID NO: 1358607 - DNA, 22 bp, Artificial Sequence
  chemically synthesized
atatatgaagctttaaccaaaa

SEQ ID NO: 1358608 - DNA, 22 bp, Artificial Sequence
  chemically synthesized
tatatgaagctttaaccaaaat

SEQ ID NO: 1358609 - DNA, 22 bp, Artificial Sequence
  chemically synthesized
tatgacaaagcactttcatttt

SEQ ID NO: 1358610 - DNA, 22 bp, Artificial Sequence
  chemically synthesized
atatgacaaagcactttcattt

SEQ ID NO: 1358611 - DNA, 22 bp, Artificial Sequence
  chemically synthesized
tatatgacaaagcactttcatt

SEQ ID NO: 1358612 - DNA, 22 bp, Artificial Sequence
  chemically synthesized
taaccaaaatgaaagtgctttg

SEQ ID NO: 1358613 - DNA, 22 bp, Artificial Sequence
  chemically synthesized
aaccaaaatgaaagtgctttgt

SEQ ID NO: 1358614 - DNA, 22 bp, Artificial Sequence
  chemically synthesized
accaaaatgaaagtgctttgtc

SEQ ID NO: 1358615 - DNA, 22 bp, Artificial Sequence
  chemically synthesized
tgaaaattttatatgacaaagc

SEQ ID NO: 1358616 - DNA, 22 bp, Artificial Sequence
  chemically synthesized
atgaaaattttatatgacaaag

SEQ ID NO: 1358617 - DNA, 22 bp, Artificial Sequence
  chemically synthesized
tatgaaaattttatatgacaaa

SEQ ID NO: 1358618 - DNA, 22 bp, Artificial Sequence
  chemically synthesized
cattttatgaaaattttatatg

SEQ ID NO: 1358619 - DNA, 22 bp, Artificial Sequence
  chemically synthesized
attgcattttatgaaaatttta

SEQ ID NO: 1358620 - DNA, 22 bp, Artificial Sequence
  chemically synthesized
gattgcattttatgaaaatttt

SEQ ID NO: 1358621 - DNA, 22 bp, Artificial Sequence
  chemically synthesized
tgattgcattttatgaaaattt

SEQ ID NO: 1358622 - DNA, 22 bp, Artificial Sequence
  chemically synthesized
tgtcatataaaattttcataaa

SEQ ID NO: 1358623 - DNA, 22 bp, Artificial Sequence
  chemically synthesized
gtcatataaaattttcataaaa

SEQ ID NO: 1358624 - DNA, 22 bp, Artificial Sequence
  chemically synthesized
tcatataaaattttcataaaat

SEQ ID NO: 1358625 - DNA, 22 bp, Artificial Sequence
  chemically synthesized
taataatgatattttgattgca

SEQ ID NO: 1358626 - DNA, 22 bp, Artificial Sequence
  chemically synthesized
tcataaaatgcaatcaaaatat

SEQ ID NO: 1358627 - DNA, 22 bp, Artificial Sequence
  chemically synthesized
cataaaatgcaatcaaaatatc

SEQ ID NO: 1358628 - DNA, 22 bp, Artificial Sequence
  chemically synthesized
ataaaatgcaatcaaaatatca

SEQ ID NO: 1358629 - DNA, 22 bp, Artificial Sequence
  chemically synthesized
catataatatgttataataatg

SEQ ID NO: 1358630 - DNA, 22 bp, Artificial Sequence
  chemically synthesized
acatataatatgttataataat

SEQ ID NO: 1358631 - DNA, 22 bp, Artificial Sequence
  chemically synthesized
cagatgtttacatataatatgt

SEQ ID NO: 1358632 - DNA, 22 bp, Artificial Sequence
  chemically synthesized
ttataacatattatatgtaaac

SEQ ID NO: 1358633 - DNA, 22 bp, Artificial Sequence
  chemically synthesized
taacatattatatgtaaacatc

SEQ ID NO: 1358634 - DNA, 22 bp, Artificial Sequence
  chemically synthesized
atgaacataattacagatgttt

SEQ ID NO: 1358635 - DNA, 22 bp, Artificial Sequence
  chemically synthesized
aatgaacataattacagatgtt

SEQ ID NO: 1358636 - DNA, 22 bp, Artificial Sequence
  chemically synthesized
taatgaacataattacagatgt

SEQ ID NO: 1358637 - DNA, 22 bp, Artificial Sequence
  chemically synthesized
tatgtaaacatctgtaattatg

SEQ ID NO: 1358638 - DNA, 22 bp, Artificial Sequence
  chemically synthesized
atgtgtaatgctttaatgaaca

SEQ ID NO: 1358639 - DNA, 22 bp, Artificial Sequence
  chemically synthesized
gatgtgtaatgctttaatgaac

SEQ ID NO: 1358640 - DNA, 22 bp, Artificial Sequence
  chemically synthesized
cttgatgtgtaatgctttaatg

SEQ ID NO: 1358641 - DNA, 22 bp, Artificial Sequence
  chemically synthesized
taattatgttcattaaagcatt

SEQ ID NO: 1358642 - DNA, 22 bp, Artificial Sequence
  chemically synthesized
tgttcattaaagcattacacat

SEQ ID NO: 1358643 - DNA, 22 bp, Artificial Sequence
  chemically synthesized
aataagttacttgatgtgtaat

SEQ ID NO: 1358644 - DNA, 22 bp, Artificial Sequence
  chemically synthesized
aaataagttacttgatgtgtaa

SEQ ID NO: 1358645 - DNA, 22 bp, Artificial Sequence
  chemically synthesized
taaataagttacttgatgtgta

SEQ ID NO: 1358646 - DNA, 22 bp, Artificial Sequence
  chemically synthesized
ttaaataagttacttgatgtgt

SEQ ID NO: 1358647 - DNA, 22 bp, Artificial Sequence
  chemically synthesized
attaaagcattacacatcaagt

SEQ ID NO: 1358648 - DNA, 22 bp, Artificial Sequence
  chemically synthesized
aagcattacacatcaagtaact

SEQ ID NO: 1358649 - DNA, 22 bp, Artificial Sequence
  chemically synthesized
cacatcaagtaacttatttaaa

SEQ ID NO: 1358650 - DNA, 22 bp, Artificial Sequence
  chemically synthesized
cccatatatatttttaaataag

SEQ ID NO: 1358651 - DNA, 22 bp, Artificial Sequence
  chemically synthesized
ccccatatatatttttaaataa

SEQ ID NO: 1358652 - DNA, 22 bp, Artificial Sequence
  chemically synthesized
ggtttccccatatatattttta

SEQ ID NO: 1358653 - DNA, 22 bp, Artificial Sequence
  chemically synthesized
atttaaaaatatatatggggaa

SEQ ID NO: 1358654 - DNA, 22 bp, Artificial Sequence
  chemically synthesized
tttaaaaatatatatggggaaa

SEQ ID NO: 1358655 - DNA, 22 bp, Artificial Sequence
  chemically synthesized
aaaaatatatatggggaaacct

SEQ ID NO: 1358656 - DNA, 22 bp, Artificial Sequence
  chemically synthesized
aaaatatatatggggaaaccta

SEQ ID NO: 1358657 - DNA, 22 bp, Artificial Sequence
  chemically synthesized
gaaccaaacacattaggtttcc

SEQ ID NO: 1358658 - DNA, 22 bp, Artificial Sequence
  chemically synthesized
cctggaaccaaacacattaggt

SEQ ID NO: 1358659 - DNA, 22 bp, Artificial Sequence
  chemically synthesized
ttacctggaaccaaacacatta

SEQ ID NO: 1358660 - DNA, 22 bp, Artificial Sequence
  chemically synthesized
attacctggaaccaaacacatt

SEQ ID NO: 1358661 - DNA, 22 bp, Artificial Sequence
  chemically synthesized
tattacctggaaccaaacacat

SEQ ID NO: 1358662 - DNA, 22 bp, Artificial Sequence
  chemically synthesized
accactttattacctggaacca

SEQ ID NO: 1358663 - DNA, 22 bp, Artificial Sequence
  chemically synthesized
ctcaccactttattacctggaa

SEQ ID NO: 1358664 - DNA, 22 bp, Artificial Sequence
  chemically synthesized
gctcaccactttattacctgga

SEQ ID NO: 1358665 - DNA, 22 bp, Artificial Sequence
  chemically synthesized
atgtgtttggttccaggtaata

SEQ ID NO: 1358666 - DNA, 22 bp, Artificial Sequence
  chemically synthesized
ttgctcaccactttattacctg

SEQ ID NO: 1358667 - DNA, 22 bp, Artificial Sequence
  chemically synthesized
ttcttgctcaccactttattac

SEQ ID NO: 1358668 - DNA, 22 bp, Artificial Sequence
  chemically synthesized
ggttccaggtaataaagtggtg

SEQ ID NO: 1358669 - DNA, 22 bp, Artificial Sequence
  chemically synthesized
gttccaggtaataaagtggtga

SEQ ID NO: 1358670 - DNA, 22 bp, Artificial Sequence
  chemically synthesized
aactgttcttgctcaccacttt

SEQ ID NO: 1358671 - DNA, 22 bp, Artificial Sequence
  chemically synthesized
caggtaataaagtggtgagcaa

SEQ ID NO: 1358672 - DNA, 22 bp, Artificial Sequence
  chemically synthesized
tgaaccaagacacctcaactgt

SEQ ID NO: 1358673 - DNA, 22 bp, Artificial Sequence
  chemically synthesized
tatgaaccaagacacctcaact

SEQ ID NO: 1358674 - DNA, 22 bp, Artificial Sequence
  chemically synthesized
tgtggtaagttctatgaaccaa

SEQ ID NO: 1358675 - DNA, 22 bp, Artificial Sequence
  chemically synthesized
aggtgtcttggttcatagaact

SEQ ID NO: 1358676 - DNA, 22 bp, Artificial Sequence
  chemically synthesized
ccagtcggattatgtggtaagt

SEQ ID NO: 1358677 - DNA, 22 bp, Artificial Sequence
  chemically synthesized
gccagtcggattatgtggtaag

SEQ ID NO: 1358678 - DNA, 22 bp, Artificial Sequence
  chemically synthesized
ggttcatagaacttaccacata

SEQ ID NO: 1358679 - DNA, 22 bp, Artificial Sequence
  chemically synthesized
gttcatagaacttaccacataa

SEQ ID NO: 1358680 - DNA, 22 bp, Artificial Sequence
  chemically synthesized
atagaacttaccacataatccg

SEQ ID NO: 1358681 - DNA, 22 bp, Artificial Sequence
  chemically synthesized
atacttgccagtcggattatgt

SEQ ID NO: 1358682 - DNA, 22 bp, Artificial Sequence
  chemically synthesized
attaatacttgccagtcggatt

SEQ ID NO: 1358683 - DNA, 22 bp, Artificial Sequence
  chemically synthesized
accacataatccgactggcaag

SEQ ID NO: 1358684 - DNA, 22 bp, Artificial Sequence
  chemically synthesized
ccacataatccgactggcaagt

SEQ ID NO: 1358685 - DNA, 22 bp, Artificial Sequence
  chemically synthesized
catatgtatgtacgtgactaat

SEQ ID NO: 1358686 - DNA, 22 bp, Artificial Sequence
  chemically synthesized
gcaagtattaattagtcacgta

SEQ ID NO: 1358687 - DNA, 22 bp, Artificial Sequence
  chemically synthesized
tgattccatatgtatgtacgtg

SEQ ID NO: 1358688 - DNA, 22 bp, Artificial Sequence
  chemically synthesized
ttatgattccatatgtatgtac

SEQ ID NO: 1358689 - DNA, 22 bp, Artificial Sequence
  chemically synthesized
attagtcacgtacatacatatg

SEQ ID NO: 1358690 - DNA, 22 bp, Artificial Sequence
  chemically synthesized
gtcacgtacatacatatggaat

SEQ ID NO: 1358691 - DNA, 22 bp, Artificial Sequence
  chemically synthesized
ataacacatagcactgttatga

SEQ ID NO: 1358692 - DNA, 22 bp, Artificial Sequence
  chemically synthesized
ttcataacacatagcactgtta

SEQ ID NO: 1358693 - DNA, 22 bp, Artificial Sequence
  chemically synthesized
ccacgtaacatctgttcataac

SEQ ID NO: 1358694 - DNA, 22 bp, Artificial Sequence
  chemically synthesized
taccacgtaacatctgttcata

SEQ ID NO: 1358695 - DNA, 22 bp, Artificial Sequence
  chemically synthesized
ctctaccacgtaacatctgttc

SEQ ID NO: 1358696 - DNA, 22 bp, Artificial Sequence
  chemically synthesized
tgtgttatgaacagatgttacg

SEQ ID NO: 1358697 - DNA, 22 bp, Artificial Sequence
  chemically synthesized
tgaacagatgttacgtggtaga

SEQ ID NO: 1358698 - DNA, 22 bp, Artificial Sequence
  chemically synthesized
agtacatcaaattcctctacca

SEQ ID NO: 1358699 - DNA, 22 bp, Artificial Sequence
  chemically synthesized
cgtggtagaggaatttgatgta

SEQ ID NO: 1358700 - DNA, 22 bp, Artificial Sequence
  chemically synthesized
gatagacatcaaaatcccctaa

SEQ ID NO: 1358701 - DNA, 22 bp, Artificial Sequence
  chemically synthesized
tggatagacatcaaaatcccct

SEQ ID NO: 1358702 - DNA, 22 bp, Artificial Sequence
  chemically synthesized
gatgtacttaggggattttgat

SEQ ID NO: 1358703 - DNA, 22 bp, Artificial Sequence
  chemically synthesized
atgtacttaggggattttgatg

SEQ ID NO: 1358704 - DNA, 22 bp, Artificial Sequence
  chemically synthesized
cctctggatagacatcaaaatc

SEQ ID NO: 1358705 - DNA, 22 bp, Artificial Sequence
  chemically synthesized
acctctggatagacatcaaaat

SEQ ID NO: 1358706 - DNA, 22 bp, Artificial Sequence
  chemically synthesized
aggggattttgatgtctatcca

SEQ ID NO: 1358707 - DNA, 22 bp, Artificial Sequence
  chemically synthesized
caagcttacctctggatagaca

SEQ ID NO: 1358708 - DNA, 22 bp, Artificial Sequence
  chemically synthesized
ggggattttgatgtctatccag

SEQ ID NO: 1358709 - DNA, 22 bp, Artificial Sequence
  chemically synthesized
cacctacaagcttacctctgga

SEQ ID NO: 1358710 - DNA, 22 bp, Artificial Sequence
  chemically synthesized
ccacctacaagcttacctctgg

SEQ ID NO: 1358711 - DNA, 22 bp, Artificial Sequence
  chemically synthesized
tccacctacaagcttacctctg

SEQ ID NO: 1358712 - DNA, 22 bp, Artificial Sequence
  chemically synthesized
tgatgtctatccagaggtaagc

SEQ ID NO: 1358713 - DNA, 22 bp, Artificial Sequence
  chemically synthesized
gatgtctatccagaggtaagct

SEQ ID NO: 1358714 - DNA, 22 bp, Artificial Sequence
  chemically synthesized
atgtctatccagaggtaagctt

SEQ ID NO: 1358715 - DNA, 22 bp, Artificial Sequence
  chemically synthesized
tccagaggtaagcttgtaggtg

SEQ ID NO: 1358716 - DNA, 22 bp, Artificial Sequence
  chemically synthesized
atgacaccattttccacctaca

SEQ ID NO: 1358717 - DNA, 22 bp, Artificial Sequence
  chemically synthesized
gatgacaccattttccacctac

SEQ ID NO: 1358718 - DNA, 22 bp, Artificial Sequence
  chemically synthesized
ccttgatgacaccattttccac

SEQ ID NO: 1358719 - DNA, 22 bp, Artificial Sequence
  chemically synthesized
accttgatgacaccattttcca

SEQ ID NO: 1358720 - DNA, 22 bp, Artificial Sequence
  chemically synthesized
taccttgatgacaccattttcc

SEQ ID NO: 1358721 - DNA, 22 bp, Artificial Sequence
  chemically synthesized
ttaccttgatgacaccattttc

SEQ ID NO: 1358722 - DNA, 22 bp, Artificial Sequence
  chemically synthesized
tttaccttgatgacaccatttt

SEQ ID NO: 1358723 - DNA, 22 bp, Artificial Sequence
  chemically synthesized
ttttaccttgatgacaccattt

SEQ ID NO: 1358724 - DNA, 22 bp, Artificial Sequence
  chemically synthesized
gtaggtggaaaatggtgtcatc

SEQ ID NO: 1358725 - DNA, 22 bp, Artificial Sequence
  chemically synthesized
taggtggaaaatggtgtcatca

SEQ ID NO: 1358726 - DNA, 22 bp, Artificial Sequence
  chemically synthesized
cccttttttaccttgatgacac

SEQ ID NO: 1358727 - DNA, 22 bp, Artificial Sequence
  chemically synthesized
ccccttttttaccttgatgaca

SEQ ID NO: 1358728 - DNA, 22 bp, Artificial Sequence
  chemically synthesized
cccgtttccccttttttacctt

SEQ ID NO: 1358729 - DNA, 22 bp, Artificial Sequence
  chemically synthesized
gaacctccccgtttcccctttt

SEQ ID NO: 1358730 - DNA, 22 bp, Artificial Sequence
  chemically synthesized
tctagaacctccccgtttcccc

SEQ ID NO: 1358731 - DNA, 22 bp, Artificial Sequence
  chemically synthesized
gtctagaacctccccgtttccc

SEQ ID NO: 1358732 - DNA, 22 bp, Artificial Sequence
  chemically synthesized
tttgtctagaacctccccgttt

SEQ ID NO: 1358733 - DNA, 22 bp, Artificial Sequence
  chemically synthesized
tatttgtctagaacctccccgt

SEQ ID NO: 1358734 - DNA, 22 bp, Artificial Sequence
  chemically synthesized
ctatttgtctagaacctccccg

SEQ ID NO: 1358735 - DNA, 22 bp, Artificial Sequence
  chemically synthesized
tctatttgtctagaacctcccc

SEQ ID NO: 1358736 - DNA, 22 bp, Artificial Sequence
  chemically synthesized
ttctatttgtctagaacctccc

SEQ ID NO: 1358737 - DNA, 22 bp, Artificial Sequence
  chemically synthesized
tgtatgcttttctatttgtcta

SEQ ID NO: 1358738 - DNA, 22 bp, Artificial Sequence
  chemically synthesized
gtgtatgcttttctatttgtct

SEQ ID NO: 1358739 - DNA, 22 bp, Artificial Sequence
  chemically synthesized
tgtgtatgcttttctatttgtc

SEQ ID NO: 1358740 - DNA, 22 bp, Artificial Sequence
  chemically synthesized
ttgtgtatgcttttctatttgt

SEQ ID NO: 1358741 - DNA, 22 bp, Artificial Sequence
  chemically synthesized
cagtacttttgtgtatgctttt

SEQ ID NO: 1358742 - DNA, 22 bp, Artificial Sequence
  chemically synthesized
tagacaaatagaaaagcataca

SEQ ID NO: 1358743 - DNA, 22 bp, Artificial Sequence
  chemically synthesized
gacaaatagaaaagcatacaca

SEQ ID NO: 1358744 - DNA, 22 bp, Artificial Sequence
  chemically synthesized
tctacagtacttttgtgtatgc

SEQ ID NO: 1358745 - DNA, 22 bp, Artificial Sequence
  chemically synthesized
atctacagtacttttgtgtatg

SEQ ID NO: 1358746 - DNA, 22 bp, Artificial Sequence
  chemically synthesized
tatctacagtacttttgtgtat

SEQ ID NO: 1358747 - DNA, 22 bp, Artificial Sequence
  chemically synthesized
ttatctacagtacttttgtgta

SEQ ID NO: 1358748 - DNA, 22 bp, Artificial Sequence
  chemically synthesized
tttatctacagtacttttgtgt

SEQ ID NO: 1358749 - DNA, 22 bp, Artificial Sequence
  chemically synthesized
ttttatctacagtacttttgtg

SEQ ID NO: 1358750 - DNA, 22 bp, Artificial Sequence
  chemically synthesized
tttttatctacagtacttttgt

SEQ ID NO: 1358751 - DNA, 22 bp, Artificial Sequence
  chemically synthesized
ttttttatctacagtacttttg

SEQ ID NO: 1358752 - DNA, 22 bp, Artificial Sequence
  chemically synthesized
tttttttatctacagtactttt

SEQ ID NO: 1358753 - DNA, 22 bp, Artificial Sequence
  chemically synthesized
ttttttttatctacagtacttt

SEQ ID NO: 1358754 - DNA, 22 bp, Artificial Sequence
  chemically synthesized
tttttttttatctacagtactt

SEQ ID NO: 1358755 - DNA, 22 bp, Artificial Sequence
  chemically synthesized
ggtatagctttttttttttatc

SEQ ID NO: 1358756 - DNA, 22 bp, Artificial Sequence
  chemically synthesized
actaggtatagctttttttttt

SEQ ID NO: 1358757 - DNA, 22 bp, Artificial Sequence
  chemically synthesized
cctgactaggtatagctttttt

SEQ ID NO: 1358758 - DNA, 22 bp, Artificial Sequence
  chemically synthesized
tagataaaaaaaaaaagctata

SEQ ID NO: 1358759 - DNA, 22 bp, Artificial Sequence
  chemically synthesized
ttccctgactaggtatagcttt

SEQ ID NO: 1358760 - DNA, 22 bp, Artificial Sequence
  chemically synthesized
gttccctgactaggtatagctt

SEQ ID NO: 1358761 - DNA, 22 bp, Artificial Sequence
  chemically synthesized
tgttccctgactaggtatagct

SEQ ID NO: 1358762 - DNA, 22 bp, Artificial Sequence
  chemically synthesized
ttgttccctgactaggtatagc

SEQ ID NO: 1358763 - DNA, 22 bp, Artificial Sequence
  chemically synthesized
tttgttccctgactaggtatag

SEQ ID NO: 1358764 - DNA, 22 bp, Artificial Sequence
  chemically synthesized
tttttgttccctgactaggtat

SEQ ID NO: 1358765 - DNA, 22 bp, Artificial Sequence
  chemically synthesized
ctttttgttccctgactaggta

SEQ ID NO: 1358766 - DNA, 22 bp, Artificial Sequence
  chemically synthesized
tctttttgttccctgactaggt

SEQ ID NO: 1358767 - DNA, 22 bp, Artificial Sequence
  chemically synthesized
gctttctttttgttccctgact

SEQ ID NO: 1358768 - DNA, 22 bp, Artificial Sequence
  chemically synthesized
ctggctttctttttgttccctg

SEQ ID NO: 1358769 - DNA, 22 bp, Artificial Sequence
  chemically synthesized
actggctttctttttgttccct

SEQ ID NO: 1358770 - DNA, 22 bp, Artificial Sequence
  chemically synthesized
tacctagtcagggaacaaaaag

SEQ ID NO: 1358771 - DNA, 22 bp, Artificial Sequence
  chemically synthesized
gcccccttactggctttctttt

SEQ ID NO: 1358772 - DNA, 22 bp, Artificial Sequence
  chemically synthesized
gtcagggaacaaaaagaaagcc

SEQ ID NO: 1358773 - DNA, 22 bp, Artificial Sequence
  chemically synthesized
cctcgcccccttactggctttc

SEQ ID NO: 1358774 - DNA, 22 bp, Artificial Sequence
  chemically synthesized
gcctcgcccccttactggcttt

SEQ ID NO: 1358775 - DNA, 22 bp, Artificial Sequence
  chemically synthesized
tgcctcgcccccttactggctt

SEQ ID NO: 1358776 - DNA, 22 bp, Artificial Sequence
  chemically synthesized
ctttgcctcgcccccttactgg

SEQ ID NO: 1358777 - DNA, 22 bp, Artificial Sequence
  chemically synthesized
cctttgcctcgcccccttactg

SEQ ID NO: 1358778 - DNA, 22 bp, Artificial Sequence
  chemically synthesized
ccatcatgtttcctttgcctcg

SEQ ID NO: 1358779 - DNA, 22 bp, Artificial Sequence
  chemically synthesized
cccatcatgtttcctttgcctc

SEQ ID NO: 1358780 - DNA, 22 bp, Artificial Sequence
  chemically synthesized
atttcccatcatgtttcctttg

SEQ ID NO: 1358781 - DNA, 22 bp, Artificial Sequence
  chemically synthesized
tctcatttcccatcatgtttcc

SEQ ID NO: 1358782 - DNA, 22 bp, Artificial Sequence
  chemically synthesized
ctatctcatttcccatcatgtt

SEQ ID NO: 1358783 - DNA, 22 bp, Artificial Sequence
  chemically synthesized
tcctatctcatttcccatcatg

SEQ ID NO: 1358784 - DNA, 22 bp, Artificial Sequence
  chemically synthesized
cctctcctatctcatttcccat

SEQ ID NO: 1358785 - DNA, 22 bp, Artificial Sequence
  chemically synthesized
cctacctctcctatctcatttc

SEQ ID NO: 1358786 - DNA, 22 bp, Artificial Sequence
  chemically synthesized
gacactgcctacctctcctatc

SEQ ID NO: 1358787 - DNA, 22 bp, Artificial Sequence
  chemically synthesized
aaaatcaaagtctagacactgc

SEQ ID NO: 1358788 - DNA, 22 bp, Artificial Sequence
  chemically synthesized
aaaaatcaaagtctagacactg

SEQ ID NO: 1358789 - DNA, 22 bp, Artificial Sequence
  chemically synthesized
gactttgatttttaaatgtgtt

SEQ ID NO: 1358790 - DNA, 22 bp, Artificial Sequence
  chemically synthesized
tgatttttaaatgtgttttgtt

SEQ ID NO: 1358791 - DNA, 22 bp, Artificial Sequence
  chemically synthesized
gatttttaaatgtgttttgttt

SEQ ID NO: 1358792 - DNA, 22 bp, Artificial Sequence
  chemically synthesized
atttttaaatgtgttttgtttt

SEQ ID NO: 1358793 - DNA, 22 bp, Artificial Sequence
  chemically synthesized
ttaaatgtgttttgttttgttt

SEQ ID NO: 1358794 - DNA, 22 bp, Artificial Sequence
  chemically synthesized
taaatgtgttttgttttgtttt

SEQ ID NO: 1358795 - DNA, 22 bp, Artificial Sequence
  chemically synthesized
ggaaagccaaacaaaacaaaac

SEQ ID NO: 1358796 - DNA, 22 bp, Artificial Sequence
  chemically synthesized
aaatgtgttttgttttgttttg

SEQ ID NO: 1358797 - DNA, 22 bp, Artificial Sequence
  chemically synthesized
aatgtgttttgttttgttttgt

SEQ ID NO: 1358798 - DNA, 22 bp, Artificial Sequence
  chemically synthesized
ctaggaaagccaaacaaaacaa

SEQ ID NO: 1358799 - DNA, 22 bp, Artificial Sequence
  chemically synthesized
gttgctaggaaagccaaacaaa

SEQ ID NO: 1358800 - DNA, 22 bp, Artificial Sequence
  chemically synthesized
ggttgctaggaaagccaaacaa

SEQ ID NO: 1358801 - DNA, 22 bp, Artificial Sequence
  chemically synthesized
ttggttgctaggaaagccaaac

SEQ ID NO: 1358802 - DNA, 22 bp, Artificial Sequence
  chemically synthesized
tgttttgttttgtttggctttc

SEQ ID NO: 1358803 - DNA, 22 bp, Artificial Sequence
  chemically synthesized
gttttgttttgtttggctttcc

SEQ ID NO: 1358804 - DNA, 22 bp, Artificial Sequence
  chemically synthesized
tcttggttgctaggaaagccaa

SEQ ID NO: 1358805 - DNA, 22 bp, Artificial Sequence
  chemically synthesized
ttttgttttgtttggctttcct

SEQ ID NO: 1358806 - DNA, 22 bp, Artificial Sequence
  chemically synthesized
ctcttggttgctaggaaagcca

SEQ ID NO: 1358807 - DNA, 22 bp, Artificial Sequence
  chemically synthesized
tgttttgtttggctttcctagc

SEQ ID NO: 1358808 - DNA, 22 bp, Artificial Sequence
  chemically synthesized
gttttgtttggctttcctagca

SEQ ID NO: 1358809 - DNA, 22 bp, Artificial Sequence
  chemically synthesized
ttttgtttggctttcctagcaa

SEQ ID NO: 1358810 - DNA, 22 bp, Artificial Sequence
  chemically synthesized
gtagtttctcttggttgctagg

SEQ ID NO: 1358811 - DNA, 22 bp, Artificial Sequence
  chemically synthesized
tgtttggctttcctagcaacca

SEQ ID NO: 1358812 - DNA, 22 bp, Artificial Sequence
  chemically synthesized
gtttggctttcctagcaaccaa

SEQ ID NO: 1358813 - DNA, 22 bp, Artificial Sequence
  chemically synthesized
tttggctttcctagcaaccaag

SEQ ID NO: 1358814 - DNA, 22 bp, Artificial Sequence
  chemically synthesized
ggctttcctagcaaccaagaga

SEQ ID NO: 1358815 - DNA, 22 bp, Artificial Sequence
  chemically synthesized
gctttcctagcaaccaagagaa

SEQ ID NO: 1358816 - DNA, 22 bp, Artificial Sequence
  chemically synthesized
aatcatgttagtagtttctctt

SEQ ID NO: 1358817 - DNA, 22 bp, Artificial Sequence
  chemically synthesized
tcctagcaaccaagagaaacta

SEQ ID NO: 1358818 - DNA, 22 bp, Artificial Sequence
  chemically synthesized
cctagcaaccaagagaaactac

SEQ ID NO: 1358819 - DNA, 22 bp, Artificial Sequence
  chemically synthesized
ctagcaaccaagagaaactact

SEQ ID NO: 1358820 - DNA, 22 bp, Artificial Sequence
  chemically synthesized
ttaaatcatgttagtagtttct

SEQ ID NO: 1358821 - DNA, 22 bp, Artificial Sequence
  chemically synthesized
gttaaatcatgttagtagtttc

SEQ ID NO: 1358822 - DNA, 22 bp, Artificial Sequence
  chemically synthesized
gcaaccaagagaaactactaac

SEQ ID NO: 1358823 - DNA, 22 bp, Artificial Sequence
  chemically synthesized
gaagataccaccacttgttaaa

SEQ ID NO: 1358824 - DNA, 22 bp, Artificial Sequence
  chemically synthesized
ctaacatgatttaacaagtggt

SEQ ID NO: 1358825 - DNA, 22 bp, Artificial Sequence
  chemically synthesized
aattcgaagataccaccacttg

SEQ ID NO: 1358826 - DNA, 22 bp, Artificial Sequence
  chemically synthesized
acatgatttaacaagtggtggt

SEQ ID NO: 1358827 - DNA, 22 bp, Artificial Sequence
  chemically synthesized
aacaagtggtggtatcttcgaa

SEQ ID NO: 1358828 - DNA, 22 bp, Artificial Sequence
  chemically synthesized
acaagtggtggtatcttcgaat

SEQ ID NO: 1358829 - DNA, 22 bp, Artificial Sequence
  chemically synthesized
atgcagccaattaaattcgaag

SEQ ID NO: 1358830 - DNA, 22 bp, Artificial Sequence
  chemically synthesized
catgcagccaattaaattcgaa

SEQ ID NO: 1358831 - DNA, 22 bp, Artificial Sequence
  chemically synthesized
aacttcatgcagccaattaaat

SEQ ID NO: 1358832 - DNA, 22 bp, Artificial Sequence
  chemically synthesized
taaacttcatgcagccaattaa

SEQ ID NO: 1358833 - DNA, 22 bp, Artificial Sequence
  chemically synthesized
tctaaacttcatgcagccaatt

SEQ ID NO: 1358834 - DNA, 22 bp, Artificial Sequence
  chemically synthesized
cgaatttaattggctgcatgaa

SEQ ID NO: 1358835 - DNA, 22 bp, Artificial Sequence
  chemically synthesized
gaatttaattggctgcatgaag

SEQ ID NO: 1358836 - DNA, 22 bp, Artificial Sequence
  chemically synthesized
ataatccactctctaaacttca

SEQ ID NO: 1358837 - DNA, 22 bp, Artificial Sequence
  chemically synthesized
aattggctgcatgaagtttaga

SEQ ID NO: 1358838 - DNA, 22 bp, Artificial Sequence
  chemically synthesized
gataatccactctctaaacttc

SEQ ID NO: 1358839 - DNA, 22 bp, Artificial Sequence
  chemically synthesized
attggctgcatgaagtttagag

SEQ ID NO: 1358840 - DNA, 22 bp, Artificial Sequence
  chemically synthesized
ttgataatccactctctaaact

SEQ ID NO: 1358841 - DNA, 22 bp, Artificial Sequence
  chemically synthesized
gctgcatgaagtttagagagtg

SEQ ID NO: 1358842 - DNA, 22 bp, Artificial Sequence
  chemically synthesized
gtattcttgataatccactctc

SEQ ID NO: 1358843 - DNA, 22 bp, Artificial Sequence
  chemically synthesized
catgaagtttagagagtggatt

SEQ ID NO: 1358844 - DNA, 22 bp, Artificial Sequence
  chemically synthesized
cgtattcttgataatccactct

SEQ ID NO: 1358845 - DNA, 22 bp, Artificial Sequence
  chemically synthesized
tcgtattcttgataatccactc

SEQ ID NO: 1358846 - DNA, 22 bp, Artificial Sequence
  chemically synthesized
tttcgtattcttgataatccac

SEQ ID NO: 1358847 - DNA, 22 bp, Artificial Sequence
  chemically synthesized
tctttcgtattcttgataatcc

SEQ ID NO: 1358848 - DNA, 22 bp, Artificial Sequence
  chemically synthesized
agagagtggattatcaagaata

SEQ ID NO: 1358849 - DNA, 22 bp, Artificial Sequence
  chemically synthesized
cattctctttcgtattcttgat

SEQ ID NO: 1358850 - DNA, 22 bp, Artificial Sequence
  chemically synthesized
gagagtggattatcaagaatac

SEQ ID NO: 1358851 - DNA, 22 bp, Artificial Sequence
  chemically synthesized
tgcattctctttcgtattcttg

SEQ ID NO: 1358852 - DNA, 22 bp, Artificial Sequence
  chemically synthesized
tctgcattctctttcgtattct

SEQ ID NO: 1358853 - DNA, 22 bp, Artificial Sequence
  chemically synthesized
ctctgcattctctttcgtattc

SEQ ID NO: 1358854 - DNA, 22 bp, Artificial Sequence
  chemically synthesized
cagtttctctgcattctctttc

SEQ ID NO: 1358855 - DNA, 22 bp, Artificial Sequence
  chemically synthesized
ccagtttctctgcattctcttt

SEQ ID NO: 1358856 - DNA, 22 bp, Artificial Sequence
  chemically synthesized
tcaagaatacgaaagagaatgc

SEQ ID NO: 1358857 - DNA, 22 bp, Artificial Sequence
  chemically synthesized
tccagtttctctgcattctctt

SEQ ID NO: 1358858 - DNA, 22 bp, Artificial Sequence
  chemically synthesized
ctttccagtttctctgcattct

SEQ ID NO: 1358859 - DNA, 22 bp, Artificial Sequence
  chemically synthesized
cctttccagtttctctgcattc

SEQ ID NO: 1358860 - DNA, 22 bp, Artificial Sequence
  chemically synthesized
tcctttccagtttctctgcatt

SEQ ID NO: 1358861 - DNA, 22 bp, Artificial Sequence
  chemically synthesized
ggaatacagcagcctttccttt

SEQ ID NO: 1358862 - DNA, 22 bp, Artificial Sequence
  chemically synthesized
actaggaatacagcagcctttc

SEQ ID NO: 1358863 - DNA, 22 bp, Artificial Sequence
  chemically synthesized
tcactaggaatacagcagcctt

SEQ ID NO: 1358864 - DNA, 22 bp, Artificial Sequence
  chemically synthesized
tctcactaggaatacagcagcc

SEQ ID NO: 1358865 - DNA, 22 bp, Artificial Sequence
  chemically synthesized
ctctcactaggaatacagcagc

SEQ ID NO: 1358866 - DNA, 22 bp, Artificial Sequence
  chemically synthesized
tctctcactaggaatacagcag

SEQ ID NO: 1358867 - DNA, 22 bp, Artificial Sequence
  chemically synthesized
gaaaggaaaggctgctgtattc

SEQ ID NO: 1358868 - DNA, 22 bp, Artificial Sequence
  chemically synthesized
gcgcaatatattttctctcact

SEQ ID NO: 1358869 - DNA, 22 bp, Artificial Sequence
  chemically synthesized
ctgtattcctagtgagagaaaa

SEQ ID NO: 1358870 - DNA, 22 bp, Artificial Sequence
  chemically synthesized
tattcctagtgagagaaaatat

SEQ ID NO: 1358871 - DNA, 22 bp, Artificial Sequence
  chemically synthesized
ctagtgagagaaaatatattgc

SEQ ID NO: 1358872 - DNA, 22 bp, Artificial Sequence
  chemically synthesized
ccatcatcctagcgcaatatat

SEQ ID NO: 1358873 - DNA, 22 bp, Artificial Sequence
  chemically synthesized
gtgagagaaaatatattgcgct

SEQ ID NO: 1358874 - DNA, 22 bp, Artificial Sequence
  chemically synthesized
taccatcatcctagcgcaatat

SEQ ID NO: 1358875 - DNA, 22 bp, Artificial Sequence
  chemically synthesized
ctctaccatcatcctagcgcaa

SEQ ID NO: 1358876 - DNA, 22 bp, Artificial Sequence
  chemically synthesized
tctcctctaccatcatcctagc

SEQ ID NO: 1358877 - DNA, 22 bp, Artificial Sequence
  chemically synthesized
atctcctctaccatcatcctag

SEQ ID NO: 1358878 - DNA, 22 bp, Artificial Sequence
  chemically synthesized
tatctcctctaccatcatccta

SEQ ID NO: 1358879 - DNA, 22 bp, Artificial Sequence
  chemically synthesized
tttatctcctctaccatcatcc

SEQ ID NO: 1358880 - DNA, 22 bp, Artificial Sequence
  chemically synthesized
tctttatctcctctaccatcat

SEQ ID NO: 1358881 - DNA, 22 bp, Artificial Sequence
  chemically synthesized
ctctttatctcctctaccatca

SEQ ID NO: 1358882 - DNA, 22 bp, Artificial Sequence
  chemically synthesized
cgctaggatgatggtagaggag

SEQ ID NO: 1358883 - DNA, 22 bp, Artificial Sequence
  chemically synthesized
atccacttctctttatctcctc

SEQ ID NO: 1358884 - DNA, 22 bp, Artificial Sequence
  chemically synthesized
ggatgatggtagaggagataaa

SEQ ID NO: 1358885 - DNA, 22 bp, Artificial Sequence
  chemically synthesized
catccacttctctttatctcct

SEQ ID NO: 1358886 - DNA, 22 bp, Artificial Sequence
  chemically synthesized
tcatccacttctctttatctcc

SEQ ID NO: 1358887 - DNA, 22 bp, Artificial Sequence
  chemically synthesized
atatattttcatccacttctct

SEQ ID NO: 1358888 - DNA, 22 bp, Artificial Sequence
  chemically synthesized
taatatattttcatccacttct

SEQ ID NO: 1358889 - DNA, 22 bp, Artificial Sequence
  chemically synthesized
tcctctaatatattttcatcca

SEQ ID NO: 1358890 - DNA, 22 bp, Artificial Sequence
  chemically synthesized
atcctctaatatattttcatcc

SEQ ID NO: 1358891 - DNA, 22 bp, Artificial Sequence
  chemically synthesized
tatcctctaatatattttcatc

SEQ ID NO: 1358892 - DNA, 22 bp, Artificial Sequence
  chemically synthesized
tgggttttatcctctaatatat

SEQ ID NO: 1358893 - DNA, 22 bp, Artificial Sequence
  chemically synthesized
ccagtcactgtgggttttatcc

SEQ ID NO: 1358894 - DNA, 22 bp, Artificial Sequence
  chemically synthesized
agtcattgccagtcactgtggg

SEQ ID NO: 1358895 - DNA, 22 bp, Artificial Sequence
  chemically synthesized
gaggataaaacccacagtgact

SEQ ID NO: 1358896 - DNA, 22 bp, Artificial Sequence
  chemically synthesized
taagtcattgccagtcactgtg

SEQ ID NO: 1358897 - DNA, 22 bp, Artificial Sequence
  chemically synthesized
ctaagtcattgccagtcactgt

SEQ ID NO: 1358898 - DNA, 22 bp, Artificial Sequence
  chemically synthesized
tttctaagtcattgccagtcac

SEQ ID NO: 1358899 - DNA, 22 bp, Artificial Sequence
  chemically synthesized
cccagttatttctaagtcattg

SEQ ID NO: 1358900 - DNA, 22 bp, Artificial Sequence
  chemically synthesized
acccagttatttctaagtcatt

SEQ ID NO: 1358901 - DNA, 22 bp, Artificial Sequence
  chemically synthesized
tacccagttatttctaagtcat

SEQ ID NO: 1358902 - DNA, 22 bp, Artificial Sequence
  chemically synthesized
ttacccagttatttctaagtca

SEQ ID NO: 1358903 - DNA, 22 bp, Artificial Sequence
  chemically synthesized
tttacccagttatttctaagtc

SEQ ID NO: 1358904 - DNA, 22 bp, Artificial Sequence
  chemically synthesized
ttttacccagttatttctaagt

SEQ ID NO: 1358905 - DNA, 22 bp, Artificial Sequence
  chemically synthesized
atcttttttacccagttatttc

SEQ ID NO: 1358906 - DNA, 22 bp, Artificial Sequence
  chemically synthesized
gcaatgacttagaaataactgg

SEQ ID NO: 1358907 - DNA, 22 bp, Artificial Sequence
  chemically synthesized
tgatcttttttacccagttatt

SEQ ID NO: 1358908 - DNA, 22 bp, Artificial Sequence
  chemically synthesized
aaactctgatcttttttaccca

SEQ ID NO: 1358909 - DNA, 22 bp, Artificial Sequence
  chemically synthesized
gaaactctgatcttttttaccc

SEQ ID NO: 1358910 - DNA, 22 bp, Artificial Sequence
  chemically synthesized
agaaataactgggtaaaaaaga

SEQ ID NO: 1358911 - DNA, 22 bp, Artificial Sequence
  chemically synthesized
gaaataactgggtaaaaaagat

SEQ ID NO: 1358912 - DNA, 22 bp, Artificial Sequence
  chemically synthesized
atccttgaaactctgatctttt

SEQ ID NO: 1358913 - DNA, 22 bp, Artificial Sequence
  chemically synthesized
ggtaaaaaagatcagagtttca

SEQ ID NO: 1358914 - DNA, 22 bp, Artificial Sequence
  chemically synthesized
acaagccagaaacatatctcat

SEQ ID NO: 1358915 - DNA, 22 bp, Artificial Sequence
  chemically synthesized
cacaagccagaaacatatctca

SEQ ID NO: 1358916 - DNA, 22 bp, Artificial Sequence
  chemically synthesized
caaggatgagatatgtttctgg

SEQ ID NO: 1358917 - DNA, 22 bp, Artificial Sequence
  chemically synthesized
aaggatgagatatgtttctggc

SEQ ID NO: 1358918 - DNA, 22 bp, Artificial Sequence
  chemically synthesized
acccagtttcacaagccagaaa

SEQ ID NO: 1358919 - DNA, 22 bp, Artificial Sequence
  chemically synthesized
ctggcttgtgaaactgggtgaa

SEQ ID NO: 1358920 - DNA, 22 bp, Artificial Sequence
  chemically synthesized
tggcttgtgaaactgggtgaat

SEQ ID NO: 1358921 - DNA, 22 bp, Artificial Sequence
  chemically synthesized
aatggtgcaaccattcacccag

SEQ ID NO: 1358922 - DNA, 22 bp, Artificial Sequence
  chemically synthesized
gcttgtgaaactgggtgaatgg

SEQ ID NO: 1358923 - DNA, 22 bp, Artificial Sequence
  chemically synthesized
gtgaaactgggtgaatggttgc

SEQ ID NO: 1358924 - DNA, 22 bp, Artificial Sequence
  chemically synthesized
tcattgaatggtgcaaccattc

SEQ ID NO: 1358925 - DNA, 22 bp, Artificial Sequence
  chemically synthesized
tgaaactgggtgaatggttgca

SEQ ID NO: 1358926 - DNA, 22 bp, Artificial Sequence
  chemically synthesized
atcattgaatggtgcaaccatt

SEQ ID NO: 1358927 - DNA, 22 bp, Artificial Sequence
  chemically synthesized
ttatcattgaatggtgcaacca

SEQ ID NO: 1358928 - DNA, 22 bp, Artificial Sequence
  chemically synthesized
cttatcattgaatggtgcaacc

SEQ ID NO: 1358929 - DNA, 22 bp, Artificial Sequence
  chemically synthesized
tcttatcattgaatggtgcaac

SEQ ID NO: 1358930 - DNA, 22 bp, Artificial Sequence
  chemically synthesized
ttcttatcattgaatggtgcaa

SEQ ID NO: 1358931 - DNA, 22 bp, Artificial Sequence
  chemically synthesized
ggtgaatggttgcaccattcaa

SEQ ID NO: 1358932 - DNA, 22 bp, Artificial Sequence
  chemically synthesized
tttttcttatcattgaatggtg

SEQ ID NO: 1358933 - DNA, 22 bp, Artificial Sequence
  chemically synthesized
attgtttttcttatcattgaat

SEQ ID NO: 1358934 - DNA, 22 bp, Artificial Sequence
  chemically synthesized
tcattgtttttcttatcattga

SEQ ID NO: 1358935 - DNA, 22 bp, Artificial Sequence
  chemically synthesized
ctcattgtttttcttatcattg

SEQ ID NO: 1358936 - DNA, 22 bp, Artificial Sequence
  chemically synthesized
cttctcattgtttttcttatca

SEQ ID NO: 1358937 - DNA, 22 bp, Artificial Sequence
  chemically synthesized
ccttctcattgtttttcttatc

SEQ ID NO: 1358938 - DNA, 22 bp, Artificial Sequence
  chemically synthesized
caccattcaatgataagaaaaa

SEQ ID NO: 1358939 - DNA, 22 bp, Artificial Sequence
  chemically synthesized
cttccttctcattgtttttctt

SEQ ID NO: 1358940 - DNA, 22 bp, Artificial Sequence
  chemically synthesized
aatgataagaaaaacaatgaga

SEQ ID NO: 1358941 - DNA, 22 bp, Artificial Sequence
  chemically synthesized
accgcacaaaacctgcttcctt

SEQ ID NO: 1358942 - DNA, 22 bp, Artificial Sequence
  chemically synthesized
caccgcacaaaacctgcttcct

SEQ ID NO: 1358943 - DNA, 22 bp, Artificial Sequence
  chemically synthesized
ttcaccgcacaaaacctgcttc

SEQ ID NO: 1358944 - DNA, 22 bp, Artificial Sequence
  chemically synthesized
tcttcaccgcacaaaacctgct

SEQ ID NO: 1358945 - DNA, 22 bp, Artificial Sequence
  chemically synthesized
ctcttcaccgcacaaaacctgc

SEQ ID NO: 1358946 - DNA, 22 bp, Artificial Sequence
  chemically synthesized
tctcttcaccgcacaaaacctg

SEQ ID NO: 1358947 - DNA, 22 bp, Artificial Sequence
  chemically synthesized
aacagaactttctcttcaccgc

SEQ ID NO: 1358948 - DNA, 22 bp, Artificial Sequence
  chemically synthesized
tgtgcggtgaagagaaagttct

SEQ ID NO: 1358949 - DNA, 22 bp, Artificial Sequence
  chemically synthesized
aatgccctaaacagaactttct

SEQ ID NO: 1358950 - DNA, 22 bp, Artificial Sequence
  chemically synthesized
gtgcggtgaagagaaagttctg

SEQ ID NO: 1358951 - DNA, 22 bp, Artificial Sequence
  chemically synthesized
tgcggtgaagagaaagttctgt

SEQ ID NO: 1358952 - DNA, 22 bp, Artificial Sequence
  chemically synthesized
taaatgccctaaacagaacttt

SEQ ID NO: 1358953 - DNA, 22 bp, Artificial Sequence
  chemically synthesized
cctctaaatgccctaaacagaa

SEQ ID NO: 1358954 - DNA, 22 bp, Artificial Sequence
  chemically synthesized
tgtttagggcatttagagggag

SEQ ID NO: 1358955 - DNA, 22 bp, Artificial Sequence
  chemically synthesized
tgtgatagtcacctccctctaa

SEQ ID NO: 1358956 - DNA, 22 bp, Artificial Sequence
  chemically synthesized
atgtgatagtcacctccctcta

SEQ ID NO: 1358957 - DNA, 22 bp, Artificial Sequence
  chemically synthesized
tttagggcatttagagggaggt

SEQ ID NO: 1358958 - DNA, 22 bp, Artificial Sequence
  chemically synthesized
ttatgtgatagtcacctccctc

SEQ ID NO: 1358959 - DNA, 22 bp, Artificial Sequence
  chemically synthesized
agggcatttagagggaggtgac

SEQ ID NO: 1358960 - DNA, 22 bp, Artificial Sequence
  chemically synthesized
gggcatttagagggaggtgact

SEQ ID NO: 1358961 - DNA, 22 bp, Artificial Sequence
  chemically synthesized
cattcttatgtgatagtcacct

SEQ ID NO: 1358962 - DNA, 22 bp, Artificial Sequence
  chemically synthesized
agagggaggtgactatcacata

SEQ ID NO: 1358963 - DNA, 22 bp, Artificial Sequence
  chemically synthesized
gagggaggtgactatcacataa

SEQ ID NO: 1358964 - DNA, 22 bp, Artificial Sequence
  chemically synthesized
ggtggcatctccattcttatgt

SEQ ID NO: 1358965 - DNA, 22 bp, Artificial Sequence
  chemically synthesized
cctgggtggcatctccattctt

SEQ ID NO: 1358966 - DNA, 22 bp, Artificial Sequence
  chemically synthesized
aactgcctgggtggcatctcca

SEQ ID NO: 1358967 - DNA, 22 bp, Artificial Sequence
  chemically synthesized
tcacataagaatggagatgcca

SEQ ID NO: 1358968 - DNA, 22 bp, Artificial Sequence
  chemically synthesized
caactgcctgggtggcatctcc

SEQ ID NO: 1358969 - DNA, 22 bp, Artificial Sequence
  chemically synthesized
tgatttcaactgcctgggtggc

SEQ ID NO: 1358970 - DNA, 22 bp, Artificial Sequence
  chemically synthesized
cagaactgtgatttcaactgcc

SEQ ID NO: 1358971 - DNA, 22 bp, Artificial Sequence
  chemically synthesized
caatgaattccagaactgtgat

SEQ ID NO: 1358972 - DNA, 22 bp, Artificial Sequence
  chemically synthesized
tccaatgaattccagaactgtg

SEQ ID NO: 1358973 - DNA, 22 bp, Artificial Sequence
  chemically synthesized
ctccaatgaattccagaactgt

SEQ ID NO: 1358974 - DNA, 22 bp, Artificial Sequence
  chemically synthesized
gatttctccaatgaattccaga

SEQ ID NO: 1358975 - DNA, 22 bp, Artificial Sequence
  chemically synthesized
agatttctccaatgaattccag

SEQ ID NO: 1358976 - DNA, 22 bp, Artificial Sequence
  chemically synthesized
aaatcacagttctggaattcat

SEQ ID NO: 1358977 - DNA, 22 bp, Artificial Sequence
  chemically synthesized
gcttagatttctccaatgaatt

SEQ ID NO: 1358978 - DNA, 22 bp, Artificial Sequence
  chemically synthesized
tagcttagatttctccaatgaa

SEQ ID NO: 1358979 - DNA, 22 bp, Artificial Sequence
  chemically synthesized
tacctctagcttagatttctcc

SEQ ID NO: 1358980 - DNA, 22 bp, Artificial Sequence
  chemically synthesized
tggaattcattggagaaatcta

SEQ ID NO: 1358981 - DNA, 22 bp, Artificial Sequence
  chemically synthesized
gaattcattggagaaatctaag

SEQ ID NO: 1358982 - DNA, 22 bp, Artificial Sequence
  chemically synthesized
attggagaaatctaagctagag

SEQ ID NO: 1358983 - DNA, 22 bp, Artificial Sequence
  chemically synthesized
accaagttatacctctagctta

SEQ ID NO: 1358984 - DNA, 22 bp, Artificial Sequence
  chemically synthesized
gagaaatctaagctagaggtat

SEQ ID NO: 1358985 - DNA, 22 bp, Artificial Sequence
  chemically synthesized
agctagaggtataacttggtta

SEQ ID NO: 1358986 - DNA, 22 bp, Artificial Sequence
  chemically synthesized
tatacagataactaaccaagtt

SEQ ID NO: 1358987 - DNA, 22 bp, Artificial Sequence
  chemically synthesized
atatacagataactaaccaagt

SEQ ID NO: 1358988 - DNA, 22 bp, Artificial Sequence
  chemically synthesized
gaggtataacttggttagttat

SEQ ID NO: 1358989 - DNA, 22 bp, Artificial Sequence
  chemically synthesized
acacttatatacagataactaa

SEQ ID NO: 1358990 - DNA, 22 bp, Artificial Sequence
  chemically synthesized
ttaacacttatatacagataac

SEQ ID NO: 1358991 - DNA, 22 bp, Artificial Sequence
  chemically synthesized
attaacacttatatacagataa

SEQ ID NO: 1358992 - DNA, 22 bp, Artificial Sequence
  chemically synthesized
tattaacacttatatacagata

SEQ ID NO: 1358993 - DNA, 22 bp, Artificial Sequence
  chemically synthesized
ggttagttatctgtatataagt

SEQ ID NO: 1358994 - DNA, 22 bp, Artificial Sequence
  chemically synthesized
gttagttatctgtatataagtg

SEQ ID NO: 1358995 - DNA, 22 bp, Artificial Sequence
  chemically synthesized
gttatctgtatataagtgttaa

SEQ ID NO: 1358996 - DNA, 22 bp, Artificial Sequence
  chemically synthesized
tgtccacagctttattaacact

SEQ ID NO: 1358997 - DNA, 22 bp, Artificial Sequence
  chemically synthesized
atgtccacagctttattaacac

SEQ ID NO: 1358998 - DNA, 22 bp, Artificial Sequence
  chemically synthesized
tctgtatataagtgttaataaa

SEQ ID NO: 1358999 - DNA, 22 bp, Artificial Sequence
  chemically synthesized
tatataagtgttaataaagctg

SEQ ID NO: 1359000 - DNA, 22 bp, Artificial Sequence
  chemically synthesized
cacttatgtccacagctttatt

SEQ ID NO: 1359001 - DNA, 22 bp, Artificial Sequence
  chemically synthesized
gatcattgcacttatgtccaca

SEQ ID NO: 1359002 - DNA, 22 bp, Artificial Sequence
  chemically synthesized
ctcgatcattgcacttatgtcc

SEQ ID NO: 1359003 - DNA, 22 bp, Artificial Sequence
  chemically synthesized
cctcgatcattgcacttatgtc

SEQ ID NO: 1359004 - DNA, 22 bp, Artificial Sequence
  chemically synthesized
ataaagctgtggacataagtgc

SEQ ID NO: 1359005 - DNA, 22 bp, Artificial Sequence
  chemically synthesized
ttcctcgatcattgcacttatg

SEQ ID NO: 1359006 - DNA, 22 bp, Artificial Sequence
  chemically synthesized
tggacataagtgcaatgatcga

SEQ ID NO: 1359007 - DNA, 22 bp, Artificial Sequence
  chemically synthesized
ataatgatctcttcctcgatca

SEQ ID NO: 1359008 - DNA, 22 bp, Artificial Sequence
  chemically synthesized
tcataatgatctcttcctcgat

SEQ ID NO: 1359009 - DNA, 22 bp, Artificial Sequence
  chemically synthesized
ctcataatgatctcttcctcga

SEQ ID NO: 1359010 - DNA, 22 bp, Artificial Sequence
  chemically synthesized
ttctcataatgatctcttcctc

SEQ ID NO: 1359011 - DNA, 22 bp, Artificial Sequence
  chemically synthesized
tcttctcataatgatctcttcc

SEQ ID NO: 1359012 - DNA, 22 bp, Artificial Sequence
  chemically synthesized
gcataattctcttctcataatg

SEQ ID NO: 1359013 - DNA, 22 bp, Artificial Sequence
  chemically synthesized
gtcctagcataattctcttctc

SEQ ID NO: 1359014 - DNA, 22 bp, Artificial Sequence
  chemically synthesized
ggatctagtcctagcataattc

SEQ ID NO: 1359015 - DNA, 22 bp, Artificial Sequence
  chemically synthesized
gggatctagtcctagcataatt

SEQ ID NO: 1359016 - DNA, 22 bp, Artificial Sequence
  chemically synthesized
tgagaagagaattatgctagga

SEQ ID NO: 1359017 - DNA, 22 bp, Artificial Sequence
  chemically synthesized
cttgggatctagtcctagcata

SEQ ID NO: 1359018 - DNA, 22 bp, Artificial Sequence
  chemically synthesized
ccttgggatctagtcctagcat

SEQ ID NO: 1359019 - DNA, 22 bp, Artificial Sequence
  chemically synthesized
ggtttccttgggatctagtcct

SEQ ID NO: 1359020 - DNA, 22 bp, Artificial Sequence
  chemically synthesized
aaaattaggtttccttgggatc

SEQ ID NO: 1359021 - DNA, 22 bp, Artificial Sequence
  chemically synthesized
tgctaggactagatcccaagga

SEQ ID NO: 1359022 - DNA, 22 bp, Artificial Sequence
  chemically synthesized
aaaaattaggtttccttgggat

SEQ ID NO: 1359023 - DNA, 22 bp, Artificial Sequence
  chemically synthesized
taaaaattaggtttccttggga

SEQ ID NO: 1359024 - DNA, 22 bp, Artificial Sequence
  chemically synthesized
ggactagatcccaaggaaacct

SEQ ID NO: 1359025 - DNA, 22 bp, Artificial Sequence
  chemically synthesized
agcctttaaaaattaggtttcc

SEQ ID NO: 1359026 - DNA, 22 bp, Artificial Sequence
  chemically synthesized
tcagcctttaaaaattaggttt

SEQ ID NO: 1359027 - DNA, 22 bp, Artificial Sequence
  chemically synthesized
ctcagcctttaaaaattaggtt

SEQ ID NO: 1359028 - DNA, 22 bp, Artificial Sequence
  chemically synthesized
gatcccaaggaaacctaatttt

SEQ ID NO: 1359029 - DNA, 22 bp, Artificial Sequence
  chemically synthesized
ttctcagcctttaaaaattagg

SEQ ID NO: 1359030 - DNA, 22 bp, Artificial Sequence
  chemically synthesized
tcttctcagcctttaaaaatta

SEQ ID NO: 1359031 - DNA, 22 bp, Artificial Sequence
  chemically synthesized
atcctctcttctcagcctttaa

SEQ ID NO: 1359032 - DNA, 22 bp, Artificial Sequence
  chemically synthesized
caggctgatcctctcttctcag

SEQ ID NO: 1359033 - DNA, 22 bp, Artificial Sequence
  chemically synthesized
atttttaaaggctgagaagaga

SEQ ID NO: 1359034 - DNA, 22 bp, Artificial Sequence
  chemically synthesized
ttaaaggctgagaagagaggat

SEQ ID NO: 1359035 - DNA, 22 bp, Artificial Sequence
  chemically synthesized
cattgcaggctgatcctctctt

SEQ ID NO: 1359036 - DNA, 22 bp, Artificial Sequence
  chemically synthesized
taaaggctgagaagagaggatc

SEQ ID NO: 1359037 - DNA, 22 bp, Artificial Sequence
  chemically synthesized
aaaggctgagaagagaggatca

SEQ ID NO: 1359038 - DNA, 22 bp, Artificial Sequence
  chemically synthesized
aaggctgagaagagaggatcag

SEQ ID NO: 1359039 - DNA, 22 bp, Artificial Sequence
  chemically synthesized
agtctgcattgcaggctgatcc

SEQ ID NO: 1359040 - DNA, 22 bp, Artificial Sequence
  chemically synthesized
agaagagaggatcagcctgcaa

SEQ ID NO: 1359041 - DNA, 22 bp, Artificial Sequence
  chemically synthesized
tattcagtctgcattgcaggct

SEQ ID NO: 1359042 - DNA, 22 bp, Artificial Sequence
  chemically synthesized
gtattcagtctgcattgcaggc

SEQ ID NO: 1359043 - DNA, 22 bp, Artificial Sequence
  chemically synthesized
gagggtgtttgtattcagtctg

SEQ ID NO: 1359044 - DNA, 22 bp, Artificial Sequence
  chemically synthesized
ggagggtgtttgtattcagtct

SEQ ID NO: 1359045 - DNA, 22 bp, Artificial Sequence
  chemically synthesized
tggagggtgtttgtattcagtc

SEQ ID NO: 1359046 - DNA, 22 bp, Artificial Sequence
  chemically synthesized
ctttggagggtgtttgtattca

SEQ ID NO: 1359047 - DNA, 22 bp, Artificial Sequence
  chemically synthesized
caatgcagactgaatacaaaca

SEQ ID NO: 1359048 - DNA, 22 bp, Artificial Sequence
  chemically synthesized
ctactttggagggtgtttgtat

SEQ ID NO: 1359049 - DNA, 22 bp, Artificial Sequence
  chemically synthesized
actactactttggagggtgttt

SEQ ID NO: 1359050 - DNA, 22 bp, Artificial Sequence
  chemically synthesized
cactactactttggagggtgtt

SEQ ID NO: 1359051 - DNA, 22 bp, Artificial Sequence
  chemically synthesized
aatacaaacaccctccaaagta

SEQ ID NO: 1359052 - DNA, 22 bp, Artificial Sequence
  chemically synthesized
atggcttcactactactttgga

SEQ ID NO: 1359053 - DNA, 22 bp, Artificial Sequence
  chemically synthesized
tcatggcttcactactactttg

SEQ ID NO: 1359054 - DNA, 22 bp, Artificial Sequence
  chemically synthesized
tcctctcatggcttcactacta

SEQ ID NO: 1359055 - DNA, 22 bp, Artificial Sequence
  chemically synthesized
caaagtagtagtgaagccatga

SEQ ID NO: 1359056 - DNA, 22 bp, Artificial Sequence
  chemically synthesized
tgcactgtcctctcatggcttc

SEQ ID NO: 1359057 - DNA, 22 bp, Artificial Sequence
  chemically synthesized
agatctgtgcactgtcctctca

SEQ ID NO: 1359058 - DNA, 22 bp, Artificial Sequence
  chemically synthesized
aagatctgtgcactgtcctctc

SEQ ID NO: 1359059 - DNA, 22 bp, Artificial Sequence
  chemically synthesized
taagatctgtgcactgtcctct

SEQ ID NO: 1359060 - DNA, 22 bp, Artificial Sequence
  chemically synthesized
tcgtctttaagatctgtgcact

SEQ ID NO: 1359061 - DNA, 22 bp, Artificial Sequence
  chemically synthesized
aaaatgttgtcgtctttaagat

SEQ ID NO: 1359062 - DNA, 22 bp, Artificial Sequence
  chemically synthesized
aaaaatgttgtcgtctttaaga

SEQ ID NO: 1359063 - DNA, 22 bp, Artificial Sequence
  chemically synthesized
ttaaaaatgttgtcgtctttaa

SEQ ID NO: 1359064 - DNA, 22 bp, Artificial Sequence
  chemically synthesized
cttaaaaatgttgtcgtcttta

SEQ ID NO: 1359065 - DNA, 22 bp, Artificial Sequence
  chemically synthesized
ccttcttaaaaatgttgtcgtc

SEQ ID NO: 1359066 - DNA, 22 bp, Artificial Sequence
  chemically synthesized
tcccttcttaaaaatgttgtcg

SEQ ID NO: 1359067 - DNA, 22 bp, Artificial Sequence
  chemically synthesized
ctcccttcttaaaaatgttgtc

SEQ ID NO: 1359068 - DNA, 22 bp, Artificial Sequence
  chemically synthesized
tctcccttcttaaaaatgttgt

SEQ ID NO: 1359069 - DNA, 22 bp, Artificial Sequence
  chemically synthesized
aaagacgacaacatttttaaga

SEQ ID NO: 1359070 - DNA, 22 bp, Artificial Sequence
  chemically synthesized
aagacgacaacatttttaagaa

SEQ ID NO: 1359071 - DNA, 22 bp, Artificial Sequence
  chemically synthesized
ttaagaagggagaaaatggtca

SEQ ID NO: 1359072 - DNA, 22 bp, Artificial Sequence
  chemically synthesized
taagaagggagaaaatggtcac

SEQ ID NO: 1359073 - DNA, 22 bp, Artificial Sequence
  chemically synthesized
aagaagggagaaaatggtcact

SEQ ID NO: 1359074 - DNA, 22 bp, Artificial Sequence
  chemically synthesized
cagaaggtcaatagtgaccatt

SEQ ID NO: 1359075 - DNA, 22 bp, Artificial Sequence
  chemically synthesized
agaagggagaaaatggtcacta

SEQ ID NO: 1359076 - DNA, 22 bp, Artificial Sequence
  chemically synthesized
gcagaaggtcaatagtgaccat

SEQ ID NO: 1359077 - DNA, 22 bp, Artificial Sequence
  chemically synthesized
aacttgcagaaggtcaatagtg

SEQ ID NO: 1359078 - DNA, 22 bp, Artificial Sequence
  chemically synthesized
gaacttgcagaaggtcaatagt

SEQ ID NO: 1359079 - DNA, 22 bp, Artificial Sequence
  chemically synthesized
ttgaacttgcagaaggtcaata

SEQ ID NO: 1359080 - DNA, 22 bp, Artificial Sequence
  chemically synthesized
cttgaacttgcagaaggtcaat

SEQ ID NO: 1359081 - DNA, 22 bp, Artificial Sequence
  chemically synthesized
tcttgaacttgcagaaggtcaa

SEQ ID NO: 1359082 - DNA, 22 bp, Artificial Sequence
  chemically synthesized
gtctttcttgaacttgcagaag

SEQ ID NO: 1359083 - DNA, 22 bp, Artificial Sequence
  chemically synthesized
cgtctttcttgaacttgcagaa

SEQ ID NO: 1359084 - DNA, 22 bp, Artificial Sequence
  chemically synthesized
ttcgtctttcttgaacttgcag

SEQ ID NO: 1359085 - DNA, 22 bp, Artificial Sequence
  chemically synthesized
cttcgtctttcttgaacttgca

SEQ ID NO: 1359086 - DNA, 22 bp, Artificial Sequence
  chemically synthesized
ttgaccttctgcaagttcaaga

SEQ ID NO: 1359087 - DNA, 22 bp, Artificial Sequence
  chemically synthesized
accttctgcaagttcaagaaag

SEQ ID NO: 1359088 - DNA, 22 bp, Artificial Sequence
  chemically synthesized
atgaaatttcttcgtctttctt

SEQ ID NO: 1359089 - DNA, 22 bp, Artificial Sequence
  chemically synthesized
ctgcaagttcaagaaagacgaa

SEQ ID NO: 1359090 - DNA, 22 bp, Artificial Sequence
  chemically synthesized
tgcaagttcaagaaagacgaag

SEQ ID NO: 1359091 - DNA, 22 bp, Artificial Sequence
  chemically synthesized
caagttcaagaaagacgaagaa

SEQ ID NO: 1359092 - DNA, 22 bp, Artificial Sequence
  chemically synthesized
gaaccaattaatgaaatttctt

SEQ ID NO: 1359093 - DNA, 22 bp, Artificial Sequence
  chemically synthesized
aagaaagacgaagaaatttcat

SEQ ID NO: 1359094 - DNA, 22 bp, Artificial Sequence
  chemically synthesized
tagaaccaattaatgaaatttc

SEQ ID NO: 1359095 - DNA, 22 bp, Artificial Sequence
  chemically synthesized
atgtctctagaaccaattaatg

SEQ ID NO: 1359096 - DNA, 22 bp, Artificial Sequence
  chemically synthesized
catgtctctagaaccaattaat

SEQ ID NO: 1359097 - DNA, 22 bp, Artificial Sequence
  chemically synthesized
cattaattggttctagagacat

SEQ ID NO: 1359098 - DNA, 22 bp, Artificial Sequence
  chemically synthesized
attaattggttctagagacatg

SEQ ID NO: 1359099 - DNA, 22 bp, Artificial Sequence
  chemically synthesized
attggttctagagacatgaagt

SEQ ID NO: 1359100 - DNA, 22 bp, Artificial Sequence
  chemically synthesized
aagtgaagtagaggacttcatg

SEQ ID NO: 1359101 - DNA, 22 bp, Artificial Sequence
  chemically synthesized
gttctagagacatgaagtcctc

SEQ ID NO: 1359102 - DNA, 22 bp, Artificial Sequence
  chemically synthesized
agttcaagtgaagtagaggact

SEQ ID NO: 1359103 - DNA, 22 bp, Artificial Sequence
  chemically synthesized
tagagacatgaagtcctctact

SEQ ID NO: 1359104 - DNA, 22 bp, Artificial Sequence
  chemically synthesized
gagacatgaagtcctctacttc

SEQ ID NO: 1359105 - DNA, 22 bp, Artificial Sequence
  chemically synthesized
ctaagttcaagtgaagtagagg

SEQ ID NO: 1359106 - DNA, 22 bp, Artificial Sequence
  chemically synthesized
accctgctaagttcaagtgaag

SEQ ID NO: 1359107 - DNA, 22 bp, Artificial Sequence
  chemically synthesized
caccctgctaagttcaagtgaa

SEQ ID NO: 1359108 - DNA, 22 bp, Artificial Sequence
  chemically synthesized
aagcttcaccctgctaagttca

SEQ ID NO: 1359109 - DNA, 22 bp, Artificial Sequence
  chemically synthesized
tacttcacttgaacttagcagg

SEQ ID NO: 1359110 - DNA, 22 bp, Artificial Sequence
  chemically synthesized
ttcaagcttcaccctgctaagt

SEQ ID NO: 1359111 - DNA, 22 bp, Artificial Sequence
  chemically synthesized
cttcacttgaacttagcagggt

SEQ ID NO: 1359112 - DNA, 22 bp, Artificial Sequence
  chemically synthesized
tattcaagcttcaccctgctaa

SEQ ID NO: 1359113 - DNA, 22 bp, Artificial Sequence
  chemically synthesized
ctattcaagcttcaccctgcta

SEQ ID NO: 1359114 - DNA, 22 bp, Artificial Sequence
  chemically synthesized
tctattcaagcttcaccctgct

SEQ ID NO: 1359115 - DNA, 22 bp, Artificial Sequence
  chemically synthesized
cacttgaacttagcagggtgaa

SEQ ID NO: 1359116 - DNA, 22 bp, Artificial Sequence
  chemically synthesized
ttctattcaagcttcaccctgc

SEQ ID NO: 1359117 - DNA, 22 bp, Artificial Sequence
  chemically synthesized
acttgaacttagcagggtgaag

SEQ ID NO: 1359118 - DNA, 22 bp, Artificial Sequence
  chemically synthesized
tttttctattcaagcttcaccc

SEQ ID NO: 1359119 - DNA, 22 bp, Artificial Sequence
  chemically synthesized
gaacttagcagggtgaagcttg

SEQ ID NO: 1359120 - DNA, 22 bp, Artificial Sequence
  chemically synthesized
aacttagcagggtgaagcttga

SEQ ID NO: 1359121 - DNA, 22 bp, Artificial Sequence
  chemically synthesized
attatttttctattcaagcttc

SEQ ID NO: 1359122 - DNA, 22 bp, Artificial Sequence
  chemically synthesized
cattatttttctattcaagctt

SEQ ID NO: 1359123 - DNA, 22 bp, Artificial Sequence
  chemically synthesized
tcattatttttctattcaagct

SEQ ID NO: 1359124 - DNA, 22 bp, Artificial Sequence
  chemically synthesized
agcagggtgaagcttgaataga

SEQ ID NO: 1359125 - DNA, 22 bp, Artificial Sequence
  chemically synthesized
gcagggtgaagcttgaatagaa

SEQ ID NO: 1359126 - DNA, 22 bp, Artificial Sequence
  chemically synthesized
catgctttcattatttttctat

SEQ ID NO: 1359127 - DNA, 22 bp, Artificial Sequence
  chemically synthesized
attgcatgctttcattattttt

SEQ ID NO: 1359128 - DNA, 22 bp, Artificial Sequence
  chemically synthesized
aattgcatgctttcattatttt

SEQ ID NO: 1359129 - DNA, 22 bp, Artificial Sequence
  chemically synthesized
taattgcatgctttcattattt

SEQ ID NO: 1359130 - DNA, 22 bp, Artificial Sequence
  chemically synthesized
ttaattgcatgctttcattatt

SEQ ID NO: 1359131 - DNA, 22 bp, Artificial Sequence
  chemically synthesized
ttttaattgcatgctttcatta

SEQ ID NO: 1359132 - DNA, 22 bp, Artificial Sequence
  chemically synthesized
gaatagaaaaataatgaaagca

SEQ ID NO: 1359133 - DNA, 22 bp, Artificial Sequence
  chemically synthesized
cttttaattgcatgctttcatt

SEQ ID NO: 1359134 - DNA, 22 bp, Artificial Sequence
  chemically synthesized
aatagaaaaataatgaaagcat

SEQ ID NO: 1359135 - DNA, 22 bp, Artificial Sequence
  chemically synthesized
tcttttaattgcatgctttcat

SEQ ID NO: 1359136 - DNA, 22 bp, Artificial Sequence
  chemically synthesized
ttcttttaattgcatgctttca

SEQ ID NO: 1359137 - DNA, 22 bp, Artificial Sequence
  chemically synthesized
ttttcttttaattgcatgcttt

SEQ ID NO: 1359138 - DNA, 22 bp, Artificial Sequence
  chemically synthesized
tcttttcttttaattgcatgct

SEQ ID NO: 1359139 - DNA, 22 bp, Artificial Sequence
  chemically synthesized
agattctcttttcttttaattg

SEQ ID NO: 1359140 - DNA, 22 bp, Artificial Sequence
  chemically synthesized
gacaagatattgagattctctt

SEQ ID NO: 1359141 - DNA, 22 bp, Artificial Sequence
  chemically synthesized
aaagaaaagagaatctcaatat

SEQ ID NO: 1359142 - DNA, 22 bp, Artificial Sequence
  chemically synthesized
tatgcatcagttggacaagata

SEQ ID NO: 1359143 - DNA, 22 bp, Artificial Sequence
  chemically synthesized
atatgcatcagttggacaagat

SEQ ID NO: 1359144 - DNA, 22 bp, Artificial Sequence
  chemically synthesized
ttatatgcatcagttggacaag

SEQ ID NO: 1359145 - DNA, 22 bp, Artificial Sequence
  chemically synthesized
tctcttatatgcatcagttgga

SEQ ID NO: 1359146 - DNA, 22 bp, Artificial Sequence
  chemically synthesized
tatctcttatatgcatcagttg

SEQ ID NO: 1359147 - DNA, 22 bp, Artificial Sequence
  chemically synthesized
aatatcttgtccaactgatgca

SEQ ID NO: 1359148 - DNA, 22 bp, Artificial Sequence
  chemically synthesized
ctatctcttatatgcatcagtt

SEQ ID NO: 1359149 - DNA, 22 bp, Artificial Sequence
  chemically synthesized
tctatctcttatatgcatcagt

SEQ ID NO: 1359150 - DNA, 22 bp, Artificial Sequence
  chemically synthesized
tttctatctcttatatgcatca

SEQ ID NO: 1359151 - DNA, 22 bp, Artificial Sequence
  chemically synthesized
ctttctatctcttatatgcatc

SEQ ID NO: 1359152 - DNA, 22 bp, Artificial Sequence
  chemically synthesized
gtccaactgatgcatataagag

SEQ ID NO: 1359153 - DNA, 22 bp, Artificial Sequence
  chemically synthesized
tcttctttctatctcttatatg

SEQ ID NO: 1359154 - DNA, 22 bp, Artificial Sequence
  chemically synthesized
tccaactgatgcatataagaga

SEQ ID NO: 1359155 - DNA, 22 bp, Artificial Sequence
  chemically synthesized
atgcatataagagatagaaaga

SEQ ID NO: 1359156 - DNA, 22 bp, Artificial Sequence
  chemically synthesized
tggtaaaaatacaaaaataaag

SEQ ID NO: 1359157 - DNA, 22 bp, Artificial Sequence
  chemically synthesized
ttatggtaaaaatacaaaaata

SEQ ID NO: 1359158 - DNA, 22 bp, Artificial Sequence
  chemically synthesized
tgttatggtaaaaatacaaaaa

SEQ ID NO: 1359159 - DNA, 22 bp, Artificial Sequence
  chemically synthesized
tgctttatttttgtatttttac

SEQ ID NO: 1359160 - DNA, 22 bp, Artificial Sequence
  chemically synthesized
gctttatttttgtatttttacc

SEQ ID NO: 1359161 - DNA, 22 bp, Artificial Sequence
  chemically synthesized
ctttatttttgtatttttacca

SEQ ID NO: 1359162 - DNA, 22 bp, Artificial Sequence
  chemically synthesized
taaattctgttatggtaaaaat

SEQ ID NO: 1359163 - DNA, 22 bp, Artificial Sequence
  chemically synthesized
tatttttgtatttttaccataa

SEQ ID NO: 1359164 - DNA, 22 bp, Artificial Sequence
  chemically synthesized
atttttgtatttttaccataac

SEQ ID NO: 1359165 - DNA, 22 bp, Artificial Sequence
  chemically synthesized
tttttgtatttttaccataaca

SEQ ID NO: 1359166 - DNA, 22 bp, Artificial Sequence
  chemically synthesized
gattataaattctgttatggta

SEQ ID NO: 1359167 - DNA, 22 bp, Artificial Sequence
  chemically synthesized
ttgtatttttaccataacagaa

SEQ ID NO: 1359168 - DNA, 22 bp, Artificial Sequence
  chemically synthesized
tgtatttttaccataacagaat

SEQ ID NO: 1359169 - DNA, 22 bp, Artificial Sequence
  chemically synthesized
gtatttttaccataacagaatt

SEQ ID NO: 1359170 - DNA, 22 bp, Artificial Sequence
  chemically synthesized
tatttttaccataacagaattt

SEQ ID NO: 1359171 - DNA, 22 bp, Artificial Sequence
  chemically synthesized
agaaaattagattataaattct

SEQ ID NO: 1359172 - DNA, 22 bp, Artificial Sequence
  chemically synthesized
aagaaaattagattataaattc

SEQ ID NO: 1359173 - DNA, 22 bp, Artificial Sequence
  chemically synthesized
ttaccataacagaatttataat

SEQ ID NO: 1359174 - DNA, 22 bp, Artificial Sequence
  chemically synthesized
taccataacagaatttataatc

SEQ ID NO: 1359175 - DNA, 22 bp, Artificial Sequence
  chemically synthesized
accataacagaatttataatct

SEQ ID NO: 1359176 - DNA, 22 bp, Artificial Sequence
  chemically synthesized
tttaagaaaattagattataaa

SEQ ID NO: 1359177 - DNA, 22 bp, Artificial Sequence
  chemically synthesized
ccataacagaatttataatcta

SEQ ID NO: 1359178 - DNA, 22 bp, Artificial Sequence
  chemically synthesized
gtttaagaaaattagattataa

SEQ ID NO: 1359179 - DNA, 22 bp, Artificial Sequence
  chemically synthesized
ataatttgtttaagaaaattag

SEQ ID NO: 1359180 - DNA, 22 bp, Artificial Sequence
  chemically synthesized
gataatttgtttaagaaaatta

SEQ ID NO: 1359181 - DNA, 22 bp, Artificial Sequence
  chemically synthesized
tgataatttgtttaagaaaatt

SEQ ID NO: 1359182 - DNA, 22 bp, Artificial Sequence
  chemically synthesized
ttgataatttgtttaagaaaat

SEQ ID NO: 1359183 - DNA, 22 bp, Artificial Sequence
  chemically synthesized
tttgataatttgtttaagaaaa

SEQ ID NO: 1359184 - DNA, 22 bp, Artificial Sequence
  chemically synthesized
ttttgataatttgtttaagaaa

SEQ ID NO: 1359185 - DNA, 22 bp, Artificial Sequence
  chemically synthesized
ataatctaattttcttaaacaa

SEQ ID NO: 1359186 - DNA, 22 bp, Artificial Sequence
  chemically synthesized
ttttttgataatttgtttaaga

SEQ ID NO: 1359187 - DNA, 22 bp, Artificial Sequence
  chemically synthesized
taatctaattttcttaaacaaa

SEQ ID NO: 1359188 - DNA, 22 bp, Artificial Sequence
  chemically synthesized
cttttttgataatttgtttaag

SEQ ID NO: 1359189 - DNA, 22 bp, Artificial Sequence
  chemically synthesized
gtttcttttttgataatttgtt

SEQ ID NO: 1359190 - DNA, 22 bp, Artificial Sequence
  chemically synthesized
attttcttaaacaaattatcaa

SEQ ID NO: 1359191 - DNA, 22 bp, Artificial Sequence
  chemically synthesized
ttggtttcttttttgataattt

SEQ ID NO: 1359192 - DNA, 22 bp, Artificial Sequence
  chemically synthesized
gttggtttcttttttgataatt

SEQ ID NO: 1359193 - DNA, 22 bp, Artificial Sequence
  chemically synthesized
tgttggtttcttttttgataat

SEQ ID NO: 1359194 - DNA, 22 bp, Artificial Sequence
  chemically synthesized
tcttaaacaaattatcaaaaaa

SEQ ID NO: 1359195 - DNA, 22 bp, Artificial Sequence
  chemically synthesized
cttaaacaaattatcaaaaaag

SEQ ID NO: 1359196 - DNA, 22 bp, Artificial Sequence
  chemically synthesized
ttaaacaaattatcaaaaaaga

SEQ ID NO: 1359197 - DNA, 22 bp, Artificial Sequence
  chemically synthesized
aaacaaattatcaaaaaagaaa

SEQ ID NO: 1359198 - DNA, 22 bp, Artificial Sequence
  chemically synthesized
aacaaattatcaaaaaagaaac

SEQ ID NO: 1359199 - DNA, 22 bp, Artificial Sequence
  chemically synthesized
gcagtaactttgttggtttctt

SEQ ID NO: 1359200 - DNA, 22 bp, Artificial Sequence
  chemically synthesized
tcaaaaaagaaaccaacaaagt

SEQ ID NO: 1359201 - DNA, 22 bp, Artificial Sequence
  chemically synthesized
aacattagcagtaactttgttg

SEQ ID NO: 1359202 - DNA, 22 bp, Artificial Sequence
  chemically synthesized
atattcaacattagcagtaact

SEQ ID NO: 1359203 - DNA, 22 bp, Artificial Sequence
  chemically synthesized
aatattcaacattagcagtaac

SEQ ID NO: 1359204 - DNA, 22 bp, Artificial Sequence
  chemically synthesized
taatattcaacattagcagtaa

SEQ ID NO: 1359205 - DNA, 22 bp, Artificial Sequence
  chemically synthesized
ataatagtactttaatattcaa

SEQ ID NO: 1359206 - DNA, 22 bp, Artificial Sequence
  chemically synthesized
ctgctaatgttgaatattaaag

SEQ ID NO: 1359207 - DNA, 22 bp, Artificial Sequence
  chemically synthesized
ttaataatagtactttaatatt

SEQ ID NO: 1359208 - DNA, 22 bp, Artificial Sequence
  chemically synthesized
ctaatgttgaatattaaagtac

SEQ ID NO: 1359209 - DNA, 22 bp, Artificial Sequence
  chemically synthesized
atgttgaatattaaagtactat

SEQ ID NO: 1359210 - DNA, 22 bp, Artificial Sequence
  chemically synthesized
agaagctattaataatagtact

SEQ ID NO: 1359211 - DNA, 22 bp, Artificial Sequence
  chemically synthesized
aatattaaagtactattattaa

SEQ ID NO: 1359212 - DNA, 22 bp, Artificial Sequence
  chemically synthesized
attaagaagctattaataatag

SEQ ID NO: 1359213 - DNA, 22 bp, Artificial Sequence
  chemically synthesized
aattaagaagctattaataata

SEQ ID NO: 1359214 - DNA, 22 bp, Artificial Sequence
  chemically synthesized
ttaattaagaagctattaataa

SEQ ID NO: 1359215 - DNA, 22 bp, Artificial Sequence
  chemically synthesized
cttaattaagaagctattaata

SEQ ID NO: 1359216 - DNA, 22 bp, Artificial Sequence
  chemically synthesized
aagtactattattaatagcttc

SEQ ID NO: 1359217 - DNA, 22 bp, Artificial Sequence
  chemically synthesized
tttcttaattaagaagctatta

SEQ ID NO: 1359218 - DNA, 22 bp, Artificial Sequence
  chemically synthesized
atttcttaattaagaagctatt

SEQ ID NO: 1359219 - DNA, 22 bp, Artificial Sequence
  chemically synthesized
tttatttcttaattaagaagct

SEQ ID NO: 1359220 - DNA, 22 bp, Artificial Sequence
  chemically synthesized
ttattaatagcttcttaattaa

SEQ ID NO: 1359221 - DNA, 22 bp, Artificial Sequence
  chemically synthesized
ttaatagcttcttaattaagaa

SEQ ID NO: 1359222 - DNA, 22 bp, Artificial Sequence
  chemically synthesized
atagcttcttaattaagaaata

SEQ ID NO: 1359223 - DNA, 22 bp, Artificial Sequence
  chemically synthesized
cttaattaagaaataaataatt

SEQ ID NO: 1359224 - DNA, 22 bp, Artificial Sequence
  chemically synthesized
taacaaacatataattatttat

SEQ ID NO: 1359225 - DNA, 22 bp, Artificial Sequence
  chemically synthesized
ttaattaagaaataaataatta

SEQ ID NO: 1359226 - DNA, 22 bp, Artificial Sequence
  chemically synthesized
aattaagaaataaataattata

SEQ ID NO: 1359227 - DNA, 22 bp, Artificial Sequence
  chemically synthesized
attaagaaataaataattatat

SEQ ID NO: 1359228 - DNA, 22 bp, Artificial Sequence
  chemically synthesized
ccaattgtaacaaacatataat

SEQ ID NO: 1359229 - DNA, 22 bp, Artificial Sequence
  chemically synthesized
agaaataaataattatatgttt

SEQ ID NO: 1359230 - DNA, 22 bp, Artificial Sequence
  chemically synthesized
aaatgtcattcccaattgtaac

SEQ ID NO: 1359231 - DNA, 22 bp, Artificial Sequence
  chemically synthesized
tatgtttgttacaattgggaat

SEQ ID NO: 1359232 - DNA, 22 bp, Artificial Sequence
  chemically synthesized
tattcaaatgtcattcccaatt

SEQ ID NO: 1359233 - DNA, 22 bp, Artificial Sequence
  chemically synthesized
ttatattcaaatgtcattccca

SEQ ID NO: 1359234 - DNA, 22 bp, Artificial Sequence
  chemically synthesized
attatattcaaatgtcattccc

SEQ ID NO: 1359235 - DNA, 22 bp, Artificial Sequence
  chemically synthesized
gttacaattgggaatgacattt

SEQ ID NO: 1359236 - DNA, 22 bp, Artificial Sequence
  chemically synthesized
ttacaattgggaatgacatttg

SEQ ID NO: 1359237 - DNA, 22 bp, Artificial Sequence
  chemically synthesized
caattgggaatgacatttgaat

SEQ ID NO: 1359238 - DNA, 22 bp, Artificial Sequence
  chemically synthesized
ggaatgacatttgaatataata

SEQ ID NO: 1359239 - DNA, 22 bp, Artificial Sequence
  chemically synthesized
ggaaaaaaaaacaacttattat

SEQ ID NO: 1359240 - DNA, 22 bp, Artificial Sequence
  chemically synthesized
gaatataataagttgttttttt

SEQ ID NO: 1359241 - DNA, 22 bp, Artificial Sequence
  chemically synthesized
aatataataagttgtttttttt

SEQ ID NO: 1359242 - DNA, 22 bp, Artificial Sequence
  chemically synthesized
caacacggttgggaaaaaaaaa

SEQ ID NO: 1359243 - DNA, 22 bp, Artificial Sequence
  chemically synthesized
tttttttttcccaaccgtgttg

SEQ ID NO: 1359244 - DNA, 22 bp, Artificial Sequence
  chemically synthesized
ttttttcccaaccgtgttgtag

SEQ ID NO: 1359245 - DNA, 22 bp, Artificial Sequence
  chemically synthesized
tttttcccaaccgtgttgtagt

SEQ ID NO: 1359246 - DNA, 22 bp, Artificial Sequence
  chemically synthesized
ttttcccaaccgtgttgtagtg

SEQ ID NO: 1359247 - DNA, 22 bp, Artificial Sequence
  chemically synthesized
tttcccaaccgtgttgtagtgt

SEQ ID NO: 1359248 - DNA, 22 bp, Artificial Sequence
  chemically synthesized
ttcccaaccgtgttgtagtgtt

SEQ ID NO: 1359249 - DNA, 22 bp, Artificial Sequence
  chemically synthesized
aaaagtgtaaagaacactacaa

SEQ ID NO: 1359250 - DNA, 22 bp, Artificial Sequence
  chemically synthesized
tcccaaccgtgttgtagtgttc

SEQ ID NO: 1359251 - DNA, 22 bp, Artificial Sequence
  chemically synthesized
gaaaagtgtaaagaacactaca

SEQ ID NO: 1359252 - DNA, 22 bp, Artificial Sequence
  chemically synthesized
cccaaccgtgttgtagtgttct

SEQ ID NO: 1359253 - DNA, 22 bp, Artificial Sequence
  chemically synthesized
ccaaccgtgttgtagtgttctt

SEQ ID NO: 1359254 - DNA, 22 bp, Artificial Sequence
  chemically synthesized
catttgaaaagtgtaaagaaca

SEQ ID NO: 1359255 - DNA, 22 bp, Artificial Sequence
  chemically synthesized
ccatttgaaaagtgtaaagaac

SEQ ID NO: 1359256 - DNA, 22 bp, Artificial Sequence
  chemically synthesized
tccatttgaaaagtgtaaagaa

SEQ ID NO: 1359257 - DNA, 22 bp, Artificial Sequence
  chemically synthesized
ttccatttgaaaagtgtaaaga

SEQ ID NO: 1359258 - DNA, 22 bp, Artificial Sequence
  chemically synthesized
tagtgttctttacacttttcaa

SEQ ID NO: 1359259 - DNA, 22 bp, Artificial Sequence
  chemically synthesized
aatacatttttccatttgaaaa

SEQ ID NO: 1359260 - DNA, 22 bp, Artificial Sequence
  chemically synthesized
tttacacttttcaaatggaaaa

SEQ ID NO: 1359261 - DNA, 22 bp, Artificial Sequence
  chemically synthesized
tacacttttcaaatggaaaaat

SEQ ID NO: 1359262 - DNA, 22 bp, Artificial Sequence
  chemically synthesized
acacttttcaaatggaaaaatg

SEQ ID NO: 1359263 - DNA, 22 bp, Artificial Sequence
  chemically synthesized
cacttttcaaatggaaaaatgt

SEQ ID NO: 1359264 - DNA, 22 bp, Artificial Sequence
  chemically synthesized
ttcaaatggaaaaatgtattca

SEQ ID NO: 1359265 - DNA, 22 bp, Artificial Sequence
  chemically synthesized
tcaaatggaaaaatgtattcag

SEQ ID NO: 1359266 - DNA, 22 bp, Artificial Sequence
  chemically synthesized
caaatggaaaaatgtattcagt

SEQ ID NO: 1359267 - DNA, 22 bp, Artificial Sequence
  chemically synthesized
aaatggaaaaatgtattcagtg

SEQ ID NO: 1359268 - DNA, 22 bp, Artificial Sequence
  chemically synthesized
agtgttgtattatttatcatgt

SEQ ID NO: 1359269 - DNA, 22 bp, Artificial Sequence
  chemically synthesized
ataagatcagtaacatgataaa

SEQ ID NO: 1359270 - DNA, 22 bp, Artificial Sequence
  chemically synthesized
ctgataagatcagtaacatgat

SEQ ID NO: 1359271 - DNA, 22 bp, Artificial Sequence
  chemically synthesized
actgataagatcagtaacatga

SEQ ID NO: 1359272 - DNA, 22 bp, Artificial Sequence
  chemically synthesized
tactgataagatcagtaacatg

SEQ ID NO: 1359273 - DNA, 22 bp, Artificial Sequence
  chemically synthesized
tattatttatcatgttactgat

SEQ ID NO: 1359274 - DNA, 22 bp, Artificial Sequence
  chemically synthesized
gctttactgataagatcagtaa

SEQ ID NO: 1359275 - DNA, 22 bp, Artificial Sequence
  chemically synthesized
ggctttactgataagatcagta

SEQ ID NO: 1359276 - DNA, 22 bp, Artificial Sequence
  chemically synthesized
tggctttactgataagatcagt

SEQ ID NO: 1359277 - DNA, 22 bp, Artificial Sequence
  chemically synthesized
tttatcatgttactgatcttat

SEQ ID NO: 1359278 - DNA, 22 bp, Artificial Sequence
  chemically synthesized
ttggctttactgataagatcag

SEQ ID NO: 1359279 - DNA, 22 bp, Artificial Sequence
  chemically synthesized
atcatgttactgatcttatcag

SEQ ID NO: 1359280 - DNA, 22 bp, Artificial Sequence
  chemically synthesized
tcatgttactgatcttatcagt

SEQ ID NO: 1359281 - DNA, 22 bp, Artificial Sequence
  chemically synthesized
ctgatcttatcagtaaagccaa

SEQ ID NO: 1359282 - DNA, 22 bp, Artificial Sequence
  chemically synthesized
cgtatgaaagtttttggcttta

SEQ ID NO: 1359283 - DNA, 22 bp, Artificial Sequence
  chemically synthesized
acgtatgaaagtttttggcttt

SEQ ID NO: 1359284 - DNA, 22 bp, Artificial Sequence
  chemically synthesized
atcttatcagtaaagccaaaaa

SEQ ID NO: 1359285 - DNA, 22 bp, Artificial Sequence
  chemically synthesized
atcagtaaagccaaaaactttc

SEQ ID NO: 1359286 - DNA, 22 bp, Artificial Sequence
  chemically synthesized
tcagtaaagccaaaaactttca

SEQ ID NO: 1359287 - DNA, 22 bp, Artificial Sequence
  chemically synthesized
agtggtttacgtatgaaagttt

SEQ ID NO: 1359288 - DNA, 22 bp, Artificial Sequence
  chemically synthesized
gaaattaagtggtttacgtatg

SEQ ID NO: 1359289 - DNA, 22 bp, Artificial Sequence
  chemically synthesized
ggaaattaagtggtttacgtat

SEQ ID NO: 1359290 - DNA, 22 bp, Artificial Sequence
  chemically synthesized
cttggaaattaagtggtttacg

SEQ ID NO: 1359291 - DNA, 22 bp, Artificial Sequence
  chemically synthesized
tcatacgtaaaccacttaattt

SEQ ID NO: 1359292 - DNA, 22 bp, Artificial Sequence
  chemically synthesized
catacgtaaaccacttaatttc

SEQ ID NO: 1359293 - DNA, 22 bp, Artificial Sequence
  chemically synthesized
atacgtaaaccacttaatttcc

SEQ ID NO: 1359294 - DNA, 22 bp, Artificial Sequence
  chemically synthesized
aatttccaagtaatgtgtatgt

SEQ ID NO: 1359295 - DNA, 22 bp, Artificial Sequence
  chemically synthesized
atttccaagtaatgtgtatgta

SEQ ID NO: 1359296 - DNA, 22 bp, Artificial Sequence
  chemically synthesized
ccaagtaatgtgtatgtatgtg

SEQ ID NO: 1359297 - DNA, 22 bp, Artificial Sequence
  chemically synthesized
caagtaatgtgtatgtatgtgt

SEQ ID NO: 1359298 - DNA, 22 bp, Artificial Sequence
  chemically synthesized
tcatacatacacagaggcacac

SEQ ID NO: 1359299 - DNA, 22 bp, Artificial Sequence
  chemically synthesized
tctatcatacatacacagaggc

SEQ ID NO: 1359300 - DNA, 22 bp, Artificial Sequence
  chemically synthesized
tgtctatcatacatacacagag

SEQ ID NO: 1359301 - DNA, 22 bp, Artificial Sequence
  chemically synthesized
ctgtctatcatacatacacaga

SEQ ID NO: 1359302 - DNA, 22 bp, Artificial Sequence
  chemically synthesized
tctgtctatcatacatacacag

SEQ ID NO: 1359303 - DNA, 22 bp, Artificial Sequence
  chemically synthesized
tctttctgtctatcatacatac

SEQ ID NO: 1359304 - DNA, 22 bp, Artificial Sequence
  chemically synthesized
gtctttctgtctatcatacata

SEQ ID NO: 1359305 - DNA, 22 bp, Artificial Sequence
  chemically synthesized
tgtctttctgtctatcatacat

SEQ ID NO: 1359306 - DNA, 22 bp, Artificial Sequence
  chemically synthesized
ttgtctttctgtctatcataca

SEQ ID NO: 1359307 - DNA, 22 bp, Artificial Sequence
  chemically synthesized
tttgtctttctgtctatcatac

SEQ ID NO: 1359308 - DNA, 22 bp, Artificial Sequence
  chemically synthesized
tttttgtctttctgtctatcat

SEQ ID NO: 1359309 - DNA, 22 bp, Artificial Sequence
  chemically synthesized
tctttttgtctttctgtctatc

SEQ ID NO: 1359310 - DNA, 22 bp, Artificial Sequence
  chemically synthesized
tgtgtatgtatgatagacagaa

SEQ ID NO: 1359311 - DNA, 22 bp, Artificial Sequence
  chemically synthesized
ctctttttgtctttctgtctat

SEQ ID NO: 1359312 - DNA, 22 bp, Artificial Sequence
  chemically synthesized
tgtatgtatgatagacagaaag

SEQ ID NO: 1359313 - DNA, 22 bp, Artificial Sequence
  chemically synthesized
gtgtgcatagatcttctctttt

SEQ ID NO: 1359314 - DNA, 22 bp, Artificial Sequence
  chemically synthesized
ctagtgtgcatagatcttctct

SEQ ID NO: 1359315 - DNA, 22 bp, Artificial Sequence
  chemically synthesized
aatattactagtgtgcatagat

SEQ ID NO: 1359316 - DNA, 22 bp, Artificial Sequence
  chemically synthesized
caatattactagtgtgcataga

SEQ ID NO: 1359317 - DNA, 22 bp, Artificial Sequence
  chemically synthesized
tcaatattactagtgtgcatag

SEQ ID NO: 1359318 - DNA, 22 bp, Artificial Sequence
  chemically synthesized
tttcaatattactagtgtgcat

SEQ ID NO: 1359319 - DNA, 22 bp, Artificial Sequence
  chemically synthesized
ctttcaatattactagtgtgca

SEQ ID NO: 1359320 - DNA, 22 bp, Artificial Sequence
  chemically synthesized
atttctttcaatattactagtg

SEQ ID NO: 1359321 - DNA, 22 bp, Artificial Sequence
  chemically synthesized
gctcatttctttcaatattact

SEQ ID NO: 1359322 - DNA, 22 bp, Artificial Sequence
  chemically synthesized
tgcacactagtaatattgaaag

SEQ ID NO: 1359323 - DNA, 22 bp, Artificial Sequence
  chemically synthesized
gtaatattgaaagaaatgagct

SEQ ID NO: 1359324 - DNA, 22 bp, Artificial Sequence
  chemically synthesized
aaagaaatgagctaatttactt

SEQ ID NO: 1359325 - DNA, 22 bp, Artificial Sequence
  chemically synthesized
tgacagtgtgatgaatgaagta

SEQ ID NO: 1359326 - DNA, 22 bp, Artificial Sequence
  chemically synthesized
atgacagtgtgatgaatgaagt

SEQ ID NO: 1359327 - DNA, 22 bp, Artificial Sequence
  chemically synthesized
tatgacagtgtgatgaatgaag

SEQ ID NO: 1359328 - DNA, 22 bp, Artificial Sequence
  chemically synthesized
atttacttcattcatcacactg

SEQ ID NO: 1359329 - DNA, 22 bp, Artificial Sequence
  chemically synthesized
acttcattcatcacactgtcat

SEQ ID NO: 1359330 - DNA, 22 bp, Artificial Sequence
  chemically synthesized
cttcattcatcacactgtcata

SEQ ID NO: 1359331 - DNA, 22 bp, Artificial Sequence
  chemically synthesized
cattcatcacactgtcataaag

SEQ ID NO: 1359332 - DNA, 22 bp, Artificial Sequence
  chemically synthesized
attcatcacactgtcataaaga

SEQ ID NO: 1359333 - DNA, 22 bp, Artificial Sequence
  chemically synthesized
ggaaaaaagaaagtctttatga

SEQ ID NO: 1359334 - DNA, 22 bp, Artificial Sequence
  chemically synthesized
taggaaaaaagaaagtctttat

SEQ ID NO: 1359335 - DNA, 22 bp, Artificial Sequence
  chemically synthesized
atcacactgtcataaagacttt

SEQ ID NO: 1359336 - DNA, 22 bp, Artificial Sequence
  chemically synthesized
ctaggaaaaaagaaagtcttta

SEQ ID NO: 1359337 - DNA, 22 bp, Artificial Sequence
  chemically synthesized
tctaggaaaaaagaaagtcttt

SEQ ID NO: 1359338 - DNA, 22 bp, Artificial Sequence
  chemically synthesized
ttctaggaaaaaagaaagtctt

SEQ ID NO: 1359339 - DNA, 22 bp, Artificial Sequence
  chemically synthesized
tcataaagactttcttttttcc

SEQ ID NO: 1359340 - DNA, 22 bp, Artificial Sequence
  chemically synthesized
tatgagataccacttttctagg

SEQ ID NO: 1359341 - DNA, 22 bp, Artificial Sequence
  chemically synthesized
tcttttttcctagaaaagtggt

SEQ ID NO: 1359342 - DNA, 22 bp, Artificial Sequence
  chemically synthesized
cttttttcctagaaaagtggta

SEQ ID NO: 1359343 - DNA, 22 bp, Artificial Sequence
  chemically synthesized
ttttttcctagaaaagtggtat

SEQ ID NO: 1359344 - DNA, 22 bp, Artificial Sequence
  chemically synthesized
ttttcctagaaaagtggtatct

SEQ ID NO: 1359345 - DNA, 22 bp, Artificial Sequence
  chemically synthesized
tttcctagaaaagtggtatctc

SEQ ID NO: 1359346 - DNA, 22 bp, Artificial Sequence
  chemically synthesized
ttcctagaaaagtggtatctca

SEQ ID NO: 1359347 - DNA, 22 bp, Artificial Sequence
  chemically synthesized
gatgaggttgtatgagatacca

SEQ ID NO: 1359348 - DNA, 22 bp, Artificial Sequence
  chemically synthesized
tcctagaaaagtggtatctcat

SEQ ID NO: 1359349 - DNA, 22 bp, Artificial Sequence
  chemically synthesized
cctagaaaagtggtatctcata

SEQ ID NO: 1359350 - DNA, 22 bp, Artificial Sequence
  chemically synthesized
ctagaaaagtggtatctcatac

SEQ ID NO: 1359351 - DNA, 22 bp, Artificial Sequence
  chemically synthesized
gaaaagtggtatctcatacaac

SEQ ID NO: 1359352 - DNA, 22 bp, Artificial Sequence
  chemically synthesized
gtgtatgagattagatgaggtt

SEQ ID NO: 1359353 - DNA, 22 bp, Artificial Sequence
  chemically synthesized
tagtgtatgagattagatgagg

SEQ ID NO: 1359354 - DNA, 22 bp, Artificial Sequence
  chemically synthesized
ctagtgtatgagattagatgag

SEQ ID NO: 1359355 - DNA, 22 bp, Artificial Sequence
  chemically synthesized
tctagtgtatgagattagatga

SEQ ID NO: 1359356 - DNA, 22 bp, Artificial Sequence
  chemically synthesized
ttctagtgtatgagattagatg

SEQ ID NO: 1359357 - DNA, 22 bp, Artificial Sequence
  chemically synthesized
atacaacctcatctaatctcat

SEQ ID NO: 1359358 - DNA, 22 bp, Artificial Sequence
  chemically synthesized
atccatttttctagtgtatgag

SEQ ID NO: 1359359 - DNA, 22 bp, Artificial Sequence
  chemically synthesized
atctaatctcatacactagaaa

SEQ ID NO: 1359360 - DNA, 22 bp, Artificial Sequence
  chemically synthesized
atctcatacactagaaaaatgg

SEQ ID NO: 1359361 - DNA, 22 bp, Artificial Sequence
  chemically synthesized
atcaatgctgatccatttttct

SEQ ID NO: 1359362 - DNA, 22 bp, Artificial Sequence
  chemically synthesized
aatcaatgctgatccatttttc

SEQ ID NO: 1359363 - DNA, 22 bp, Artificial Sequence
  chemically synthesized
taatcaatgctgatccattttt

SEQ ID NO: 1359364 - DNA, 22 bp, Artificial Sequence
  chemically synthesized
atacactagaaaaatggatcag

SEQ ID NO: 1359365 - DNA, 22 bp, Artificial Sequence
  chemically synthesized
ttttaatcaatgctgatccatt

SEQ ID NO: 1359366 - DNA, 22 bp, Artificial Sequence
  chemically synthesized
attttaatcaatgctgatccat

SEQ ID NO: 1359367 - DNA, 22 bp, Artificial Sequence
  chemically synthesized
tattttaatcaatgctgatcca

SEQ ID NO: 1359368 - DNA, 22 bp, Artificial Sequence
  chemically synthesized
ttttattttaatcaatgctgat

SEQ ID NO: 1359369 - DNA, 22 bp, Artificial Sequence
  chemically synthesized
attttattttaatcaatgctga

SEQ ID NO: 1359370 - DNA, 22 bp, Artificial Sequence
  chemically synthesized
gaaaaatggatcagcattgatt

SEQ ID NO: 1359371 - DNA, 22 bp, Artificial Sequence
  chemically synthesized
gaatttattttattttaatcaa

SEQ ID NO: 1359372 - DNA, 22 bp, Artificial Sequence
  chemically synthesized
ttagaatttattttattttaat

SEQ ID NO: 1359373 - DNA, 22 bp, Artificial Sequence
  chemically synthesized
attaaaataaaataaattctaa

SEQ ID NO: 1359374 - DNA, 22 bp, Artificial Sequence
  chemically synthesized
aaataaaataaattctaacaat

SEQ ID NO: 1359375 - DNA, 22 bp, Artificial Sequence
  chemically synthesized
tataaaaataagaaattgttag

SEQ ID NO: 1359376 - DNA, 22 bp, Artificial Sequence
  chemically synthesized
taacaatttcttatttttatat

SEQ ID NO: 1359377 - DNA, 22 bp, Artificial Sequence
  chemically synthesized
agatgtgtgattatataaaaat

SEQ ID NO: 1359378 - DNA, 22 bp, Artificial Sequence
  chemically synthesized
acaatttcttatttttatataa

SEQ ID NO: 1359379 - DNA, 22 bp, Artificial Sequence
  chemically synthesized
cttatttttatataatcacaca

SEQ ID NO: 1359380 - DNA, 22 bp, Artificial Sequence
  chemically synthesized
ttatttttatataatcacacat

SEQ ID NO: 1359381 - DNA, 22 bp, Artificial Sequence
  chemically synthesized
taatgacactaagatgtgtgat

SEQ ID NO: 1359382 - DNA, 22 bp, Artificial Sequence
  chemically synthesized
atttttatataatcacacatct

SEQ ID NO: 1359383 - DNA, 22 bp, Artificial Sequence
  chemically synthesized
tttttatataatcacacatctt

SEQ ID NO: 1359384 - DNA, 22 bp, Artificial Sequence
  chemically synthesized
ctataatgacactaagatgtgt

SEQ ID NO: 1359385 - DNA, 22 bp, Artificial Sequence
  chemically synthesized
ttatataatcacacatcttagt

SEQ ID NO: 1359386 - DNA, 22 bp, Artificial Sequence
  chemically synthesized
tatataatcacacatcttagtg

SEQ ID NO: 1359387 - DNA, 22 bp, Artificial Sequence
  chemically synthesized
ctgctataatgacactaagatg

SEQ ID NO: 1359388 - DNA, 22 bp, Artificial Sequence
  chemically synthesized
atataatcacacatcttagtgt

SEQ ID NO: 1359389 - DNA, 22 bp, Artificial Sequence
  chemically synthesized
actgctataatgacactaagat

SEQ ID NO: 1359390 - DNA, 22 bp, Artificial Sequence
  chemically synthesized
tataatcacacatcttagtgtc

SEQ ID NO: 1359391 - DNA, 22 bp, Artificial Sequence
  chemically synthesized
taacttactgctataatgacac

SEQ ID NO: 1359392 - DNA, 22 bp, Artificial Sequence
  chemically synthesized
ataacttactgctataatgaca

SEQ ID NO: 1359393 - DNA, 22 bp, Artificial Sequence
  chemically synthesized
tataacttactgctataatgac

SEQ ID NO: 1359394 - DNA, 22 bp, Artificial Sequence
  chemically synthesized
ttataacttactgctataatga

SEQ ID NO: 1359395 - DNA, 22 bp, Artificial Sequence
  chemically synthesized
tttttataacttactgctataa

SEQ ID NO: 1359396 - DNA, 22 bp, Artificial Sequence
  chemically synthesized
agtgtcattatagcagtaagtt

SEQ ID NO: 1359397 - DNA, 22 bp, Artificial Sequence
  chemically synthesized
gtgtcattatagcagtaagtta

SEQ ID NO: 1359398 - DNA, 22 bp, Artificial Sequence
  chemically synthesized
tagcagtaagttataaaaacaa

SEQ ID NO: 1359399 - DNA, 22 bp, Artificial Sequence
  chemically synthesized
aatatacaaatatacattgttt

SEQ ID NO: 1359400 - DNA, 22 bp, Artificial Sequence
  chemically synthesized
atattaaatatacaaatataca

SEQ ID NO: 1359401 - DNA, 22 bp, Artificial Sequence
  chemically synthesized
aatattaaatatacaaatatac

SEQ ID NO: 1359402 - DNA, 22 bp, Artificial Sequence
  chemically synthesized
taatattaaatatacaaatata

SEQ ID NO: 1359403 - DNA, 22 bp, Artificial Sequence
  chemically synthesized
taaaaacaatgtatatttgtat

SEQ ID NO: 1359404 - DNA, 22 bp, Artificial Sequence
  chemically synthesized
tttaatattaaatatacaaata

SEQ ID NO: 1359405 - DNA, 22 bp, Artificial Sequence
  chemically synthesized
ctctttaatattaaatatacaa

SEQ ID NO: 1359406 - DNA, 22 bp, Artificial Sequence
  chemically synthesized
tagcactactctttaatattaa

SEQ ID NO: 1359407 - DNA, 22 bp, Artificial Sequence
  chemically synthesized
gtagcactactctttaatatta

SEQ ID NO: 1359408 - DNA, 22 bp, Artificial Sequence
  chemically synthesized
atttgtagcactactctttaat

SEQ ID NO: 1359409 - DNA, 22 bp, Artificial Sequence
  chemically synthesized
gtatatttaatattaaagagta

SEQ ID NO: 1359410 - DNA, 22 bp, Artificial Sequence
  chemically synthesized
tatatttaatattaaagagtag

SEQ ID NO: 1359411 - DNA, 22 bp, Artificial Sequence
  chemically synthesized
aatattaaagagtagtgctaca

SEQ ID NO: 1359412 - DNA, 22 bp, Artificial Sequence
  chemically synthesized
atattaaagagtagtgctacaa

SEQ ID NO: 1359413 - DNA, 22 bp, Artificial Sequence
  chemically synthesized
aagagtagtgctacaaattaac

SEQ ID NO: 1359414 - DNA, 22 bp, Artificial Sequence
  chemically synthesized
ggagacccagtaggttaatttg

SEQ ID NO: 1359415 - DNA, 22 bp, Artificial Sequence
  chemically synthesized
cggagacccagtaggttaattt

SEQ ID NO: 1359416 - DNA, 22 bp, Artificial Sequence
  chemically synthesized
caaattaacctactgggtctcc

SEQ ID NO: 1359417 - DNA, 22 bp, Artificial Sequence
  chemically synthesized
agaaatatatttcggagaccca

SEQ ID NO: 1359418 - DNA, 22 bp, Artificial Sequence
  chemically synthesized
attcagaaatatatttcggaga

SEQ ID NO: 1359419 - DNA, 22 bp, Artificial Sequence
  chemically synthesized
aattcagaaatatatttcggag

SEQ ID NO: 1359420 - DNA, 22 bp, Artificial Sequence
  chemically synthesized
acctactgggtctccgaaatat

SEQ ID NO: 1359421 - DNA, 22 bp, Artificial Sequence
  chemically synthesized
ctgggtctccgaaatatatttc

SEQ ID NO: 1359422 - DNA, 22 bp, Artificial Sequence
  chemically synthesized
ggtctccgaaatatatttctga

SEQ ID NO: 1359423 - DNA, 22 bp, Artificial Sequence
  chemically synthesized
tagaaataagccttaattcaga

SEQ ID NO: 1359424 - DNA, 22 bp, Artificial Sequence
  chemically synthesized
cgaaatatatttctgaattaag

SEQ ID NO: 1359425 - DNA, 22 bp, Artificial Sequence
  chemically synthesized
gataagctatagaaataagcct

SEQ ID NO: 1359426 - DNA, 22 bp, Artificial Sequence
  chemically synthesized
ggataagctatagaaataagcc

SEQ ID NO: 1359427 - DNA, 22 bp, Artificial Sequence
  chemically synthesized
tggataagctatagaaataagc

SEQ ID NO: 1359428 - DNA, 22 bp, Artificial Sequence
  chemically synthesized
ctgaattaaggcttatttctat

SEQ ID NO: 1359429 - DNA, 22 bp, Artificial Sequence
  chemically synthesized
tgaattaaggcttatttctata

SEQ ID NO: 1359430 - DNA, 22 bp, Artificial Sequence
  chemically synthesized
aattaaggcttatttctatagc

SEQ ID NO: 1359431 - DNA, 22 bp, Artificial Sequence
  chemically synthesized
atctttggataagctatagaaa

SEQ ID NO: 1359432 - DNA, 22 bp, Artificial Sequence
  chemically synthesized
ttgatctttggataagctatag

SEQ ID NO: 1359433 - DNA, 22 bp, Artificial Sequence
  chemically synthesized
aggcttatttctatagcttatc

SEQ ID NO: 1359434 - DNA, 22 bp, Artificial Sequence
  chemically synthesized
atttctatagcttatccaaaga

SEQ ID NO: 1359435 - DNA, 22 bp, Artificial Sequence
  chemically synthesized
taaggttattgatctttggata

SEQ ID NO: 1359436 - DNA, 22 bp, Artificial Sequence
  chemically synthesized
tttctatagcttatccaaagat

SEQ ID NO: 1359437 - DNA, 22 bp, Artificial Sequence
  chemically synthesized
ctatagcttatccaaagatcaa

SEQ ID NO: 1359438 - DNA, 22 bp, Artificial Sequence
  chemically synthesized
actgtaaggttattgatctttg

SEQ ID NO: 1359439 - DNA, 22 bp, Artificial Sequence
  chemically synthesized
tatagcttatccaaagatcaat

SEQ ID NO: 1359440 - DNA, 22 bp, Artificial Sequence
  chemically synthesized
aactgtaaggttattgatcttt

SEQ ID NO: 1359441 - DNA, 22 bp, Artificial Sequence
  chemically synthesized
tagcttatccaaagatcaataa

SEQ ID NO: 1359442 - DNA, 22 bp, Artificial Sequence
  chemically synthesized
ttaactgtaaggttattgatct

SEQ ID NO: 1359443 - DNA, 22 bp, Artificial Sequence
  chemically synthesized
cttaactgtaaggttattgatc

SEQ ID NO: 1359444 - DNA, 22 bp, Artificial Sequence
  chemically synthesized
atccaaagatcaataaccttac

SEQ ID NO: 1359445 - DNA, 22 bp, Artificial Sequence
  chemically synthesized
tccaaagatcaataaccttaca

SEQ ID NO: 1359446 - DNA, 22 bp, Artificial Sequence
  chemically synthesized
aaatgcatcttcttaactgtaa

SEQ ID NO: 1359447 - DNA, 22 bp, Artificial Sequence
  chemically synthesized
aaaatgcatcttcttaactgta

SEQ ID NO: 1359448 - DNA, 22 bp, Artificial Sequence
  chemically synthesized
tttaaaatgcatcttcttaact

SEQ ID NO: 1359449 - DNA, 22 bp, Artificial Sequence
  chemically synthesized
atttaaaatgcatcttcttaac

SEQ ID NO: 1359450 - DNA, 22 bp, Artificial Sequence
  chemically synthesized
acatttatttaaaatgcatctt

SEQ ID NO: 1359451 - DNA, 22 bp, Artificial Sequence
  chemically synthesized
aacatttatttaaaatgcatct

SEQ ID NO: 1359452 - DNA, 22 bp, Artificial Sequence
  chemically synthesized
taacatttatttaaaatgcatc

SEQ ID NO: 1359453 - DNA, 22 bp, Artificial Sequence
  chemically synthesized
acagttaagaagatgcatttta

SEQ ID NO: 1359454 - DNA, 22 bp, Artificial Sequence
  chemically synthesized
cagttaagaagatgcattttaa

SEQ ID NO: 1359455 - DNA, 22 bp, Artificial Sequence
  chemically synthesized
agaagatgcattttaaataaat

SEQ ID NO: 1359456 - DNA, 22 bp, Artificial Sequence
  chemically synthesized
tcaggataatataaattttaac

SEQ ID NO: 1359457 - DNA, 22 bp, Artificial Sequence
  chemically synthesized
taaataaatgttaaaatttata

SEQ ID NO: 1359458 - DNA, 22 bp, Artificial Sequence
  chemically synthesized
aaataaatgttaaaatttatat

SEQ ID NO: 1359459 - DNA, 22 bp, Artificial Sequence
  chemically synthesized
aataaatgttaaaatttatatt

SEQ ID NO: 1359460 - DNA, 22 bp, Artificial Sequence
  chemically synthesized
gtatataaaactatcaggataa

SEQ ID NO: 1359461 - DNA, 22 bp, Artificial Sequence
  chemically synthesized
aaatttatattatcctgatagt

SEQ ID NO: 1359462 - DNA, 22 bp, Artificial Sequence
  chemically synthesized
actagtatataaaactatcagg

SEQ ID NO: 1359463 - DNA, 22 bp, Artificial Sequence
  chemically synthesized
atattatcctgatagttttata

SEQ ID NO: 1359464 - DNA, 22 bp, Artificial Sequence
  chemically synthesized
tattatcctgatagttttatat

SEQ ID NO: 1359465 - DNA, 22 bp, Artificial Sequence
  chemically synthesized
tcctgatagttttatatactag

SEQ ID NO: 1359466 - DNA, 22 bp, Artificial Sequence
  chemically synthesized
tccagtaactaactagtatata

SEQ ID NO: 1359467 - DNA, 22 bp, Artificial Sequence
  chemically synthesized
atagttttatatactagttagt

SEQ ID NO: 1359468 - DNA, 22 bp, Artificial Sequence
  chemically synthesized
gtattgtccagtaactaactag

SEQ ID NO: 1359469 - DNA, 22 bp, Artificial Sequence
  chemically synthesized
agtattgtccagtaactaacta

SEQ ID NO: 1359470 - DNA, 22 bp, Artificial Sequence
  chemically synthesized
tttagtattgtccagtaactaa

SEQ ID NO: 1359471 - DNA, 22 bp, Artificial Sequence
  chemically synthesized
tatatactagttagttactgga

SEQ ID NO: 1359472 - DNA, 22 bp, Artificial Sequence
  chemically synthesized
atatactagttagttactggac

SEQ ID NO: 1359473 - DNA, 22 bp, Artificial Sequence
  chemically synthesized
tatactagttagttactggaca

SEQ ID NO: 1359474 - DNA, 22 bp, Artificial Sequence
  chemically synthesized
gttagttactggacaatactaa

SEQ ID NO: 1359475 - DNA, 22 bp, Artificial Sequence
  chemically synthesized
catggtatcaattgtttagtat

SEQ ID NO: 1359476 - DNA, 22 bp, Artificial Sequence
  chemically synthesized
gttactggacaatactaaacaa

SEQ ID NO: 1359477 - DNA, 22 bp, Artificial Sequence
  chemically synthesized
ccatggtatcaattgtttagta

SEQ ID NO: 1359478 - DNA, 22 bp, Artificial Sequence
  chemically synthesized
ctggacaatactaaacaattga

SEQ ID NO: 1359479 - DNA, 22 bp, Artificial Sequence
  chemically synthesized
gacaatactaaacaattgatac

SEQ ID NO: 1359480 - DNA, 22 bp, Artificial Sequence
  chemically synthesized
tcatgtgcgtttccatggtatc

SEQ ID NO: 1359481 - DNA, 22 bp, Artificial Sequence
  chemically synthesized
attatcatgtgcgtttccatgg

SEQ ID NO: 1359482 - DNA, 22 bp, Artificial Sequence
  chemically synthesized
aacaattgataccatggaaacg

SEQ ID NO: 1359483 - DNA, 22 bp, Artificial Sequence
  chemically synthesized
ttgattatcatgtgcgtttcca

SEQ ID NO: 1359484 - DNA, 22 bp, Artificial Sequence
  chemically synthesized
ataccatggaaacgcacatgat

SEQ ID NO: 1359485 - DNA, 22 bp, Artificial Sequence
  chemically synthesized
aaaaaaaaaaaaaaaaaaaaaa

SEQ ID NO: 1359486 - DNA, 22 bp, Artificial Sequence
  chemically synthesized
tctcaaaaaaaaaaaaaaaaaa

SEQ ID NO: 1359487 - DNA, 22 bp, Artificial Sequence
  chemically synthesized
tgtctcaaaaaaaaaaaaaaaa

SEQ ID NO: 1359488 - DNA, 22 bp, Artificial Sequence
  chemically synthesized
tttttttttttttttttttttt

SEQ ID NO: 1359489 - DNA, 22 bp, Artificial Sequence
  chemically synthesized
tttttttttttttttttttttg

SEQ ID NO: 1359490 - DNA, 22 bp, Artificial Sequence
  chemically synthesized
ttttttttttttttttttttga

SEQ ID NO: 1359491 - DNA, 22 bp, Artificial Sequence
  chemically synthesized
tttttttttttttttttttgag

SEQ ID NO: 1359492 - DNA, 22 bp, Artificial Sequence
  chemically synthesized
ttttttttttttttttttgaga

SEQ ID NO: 1359493 - DNA, 22 bp, Artificial Sequence
  chemically synthesized
tttttttttttttttttgagac

SEQ ID NO: 1359494 - DNA, 22 bp, Artificial Sequence
  chemically synthesized
ttttttttttttttttgagaca

SEQ ID NO: 1359495 - DNA, 22 bp, Artificial Sequence
  chemically synthesized
tttttttttttttttgagacag

SEQ ID NO: 1359496 - DNA, 22 bp, Artificial Sequence
  chemically synthesized
ttttttttttttttgagacaga

SEQ ID NO: 1359497 - DNA, 22 bp, Artificial Sequence
  chemically synthesized
tttttttttttttgagacagag

SEQ ID NO: 1359498 - DNA, 22 bp, Artificial Sequence
  chemically synthesized
ttttttttttttgagacagagt

SEQ ID NO: 1359499 - DNA, 22 bp, Artificial Sequence
  chemically synthesized
tttttttttttgagacagagtc

SEQ ID NO: 1359500 - DNA, 22 bp, Artificial Sequence
  chemically synthesized
ttttttttttgagacagagtct

SEQ ID NO: 1359501 - DNA, 22 bp, Artificial Sequence
  chemically synthesized
ggtgaaagagtgagactctgtc

SEQ ID NO: 1359502 - DNA, 22 bp, Artificial Sequence
  chemically synthesized
tttttttttgagacagagtctc

SEQ ID NO: 1359503 - DNA, 22 bp, Artificial Sequence
  chemically synthesized
ttttttttgagacagagtctca

SEQ ID NO: 1359504 - DNA, 22 bp, Artificial Sequence
  chemically synthesized
tttttttgagacagagtctcac

SEQ ID NO: 1359505 - DNA, 22 bp, Artificial Sequence
  chemically synthesized
ttttttgagacagagtctcact

SEQ ID NO: 1359506 - DNA, 22 bp, Artificial Sequence
  chemically synthesized
tttttgagacagagtctcactc

SEQ ID NO: 1359507 - DNA, 22 bp, Artificial Sequence
  chemically synthesized
ttttgagacagagtctcactct

SEQ ID NO: 1359508 - DNA, 22 bp, Artificial Sequence
  chemically synthesized
tttgagacagagtctcactctt

SEQ ID NO: 1359509 - DNA, 22 bp, Artificial Sequence
  chemically synthesized
cagcctgggtgaaagagtgaga

SEQ ID NO: 1359510 - DNA, 22 bp, Artificial Sequence
  chemically synthesized
ttgagacagagtctcactcttt

SEQ ID NO: 1359511 - DNA, 22 bp, Artificial Sequence
  chemically synthesized
tgagacagagtctcactctttc

SEQ ID NO: 1359512 - DNA, 22 bp, Artificial Sequence
  chemically synthesized
gagacagagtctcactctttca

SEQ ID NO: 1359513 - DNA, 22 bp, Artificial Sequence
  chemically synthesized
agacagagtctcactctttcac

SEQ ID NO: 1359514 - DNA, 22 bp, Artificial Sequence
  chemically synthesized
tactccagcctgggtgaaagag

SEQ ID NO: 1359515 - DNA, 22 bp, Artificial Sequence
  chemically synthesized
gccactgtactccagcctgggt

SEQ ID NO: 1359516 - DNA, 22 bp, Artificial Sequence
  chemically synthesized
actctttcacccaggctggagt

SEQ ID NO: 1359517 - DNA, 22 bp, Artificial Sequence
  chemically synthesized
tttcacccaggctggagtacag

SEQ ID NO: 1359518 - DNA, 22 bp, Artificial Sequence
  chemically synthesized
tcacccaggctggagtacagtg

SEQ ID NO: 1359519 - DNA, 22 bp, Artificial Sequence
  chemically synthesized
cacccaggctggagtacagtgg

SEQ ID NO: 1359520 - DNA, 22 bp, Artificial Sequence
  chemically synthesized
acccaggctggagtacagtggc

SEQ ID NO: 1359521 - DNA, 22 bp, Artificial Sequence
  chemically synthesized
cagtgagcggagatctcgccac

SEQ ID NO: 1359522 - DNA, 22 bp, Artificial Sequence
  chemically synthesized
gagtacagtggcgagatctccg

SEQ ID NO: 1359523 - DNA, 22 bp, Artificial Sequence
  chemically synthesized
agcccgggaggtggaagttgca

SEQ ID NO: 1359524 - DNA, 22 bp, Artificial Sequence
  chemically synthesized
gagcccgggaggtggaagttgc

SEQ ID NO: 1359525 - DNA, 22 bp, Artificial Sequence
  chemically synthesized
cgctcactgcaacttccacctc

SEQ ID NO: 1359526 - DNA, 22 bp, Artificial Sequence
  chemically synthesized
actgcaacttccacctcccggg

SEQ ID NO: 1359527 - DNA, 22 bp, Artificial Sequence
  chemically synthesized
caacttccacctcccgggctca

SEQ ID NO: 1359528 - DNA, 22 bp, Artificial Sequence
  chemically synthesized
tggcaggagaatcacttgagcc

SEQ ID NO: 1359529 - DNA, 22 bp, Artificial Sequence
  chemically synthesized
ccacctcccgggctcaagtgat

SEQ ID NO: 1359530 - DNA, 22 bp, Artificial Sequence
  chemically synthesized
cacctcccgggctcaagtgatt

SEQ ID NO: 1359531 - DNA, 22 bp, Artificial Sequence
  chemically synthesized
ccgggctcaagtgattctcctg

SEQ ID NO: 1359532 - DNA, 22 bp, Artificial Sequence
  chemically synthesized
aggaggctgtggcaggagaatc

SEQ ID NO: 1359533 - DNA, 22 bp, Artificial Sequence
  chemically synthesized
ctcaggaggctgtggcaggaga

SEQ ID NO: 1359534 - DNA, 22 bp, Artificial Sequence
  chemically synthesized
aagtgattctcctgccacagcc

SEQ ID NO: 1359535 - DNA, 22 bp, Artificial Sequence
  chemically synthesized
taatcccagctactcaggaggc

SEQ ID NO: 1359536 - DNA, 22 bp, Artificial Sequence
  chemically synthesized
tcctgccacagcctcctgagta

SEQ ID NO: 1359537 - DNA, 22 bp, Artificial Sequence
  chemically synthesized
ctgccacagcctcctgagtagc

SEQ ID NO: 1359538 - DNA, 22 bp, Artificial Sequence
  chemically synthesized
ccacagcctcctgagtagctgg

SEQ ID NO: 1359539 - DNA, 22 bp, Artificial Sequence
  chemically synthesized
ctgagtagctgggattacaggt

SEQ ID NO: 1359540 - DNA, 22 bp, Artificial Sequence
  chemically synthesized
agtagctgggattacaggtgca

SEQ ID NO: 1359541 - DNA, 22 bp, Artificial Sequence
  chemically synthesized
gccagacgtggtggcgtgcacc

SEQ ID NO: 1359542 - DNA, 22 bp, Artificial Sequence
  chemically synthesized
ggattacaggtgcacgccacca

SEQ ID NO: 1359543 - DNA, 22 bp, Artificial Sequence
  chemically synthesized
caggtgcacgccaccacgtctg

SEQ ID NO: 1359544 - DNA, 22 bp, Artificial Sequence
  chemically synthesized
aaatacaaaaattagccagacg

SEQ ID NO: 1359545 - DNA, 22 bp, Artificial Sequence
  chemically synthesized
ctaaaatacaaaaattagccag

SEQ ID NO: 1359546 - DNA, 22 bp, Artificial Sequence
  chemically synthesized
tactaaaatacaaaaattagcc

SEQ ID NO: 1359547 - DNA, 22 bp, Artificial Sequence
  chemically synthesized
gctaatttttgtattttagtag

SEQ ID NO: 1359548 - DNA, 22 bp, Artificial Sequence
  chemically synthesized
atttttgtattttagtagagat

SEQ ID NO: 1359549 - DNA, 22 bp, Artificial Sequence
  chemically synthesized
ttgtattttagtagagatgtgg

SEQ ID NO: 1359550 - DNA, 22 bp, Artificial Sequence
  chemically synthesized
tgtattttagtagagatgtggt

SEQ ID NO: 1359551 - DNA, 22 bp, Artificial Sequence
  chemically synthesized
gtattttagtagagatgtggtt

SEQ ID NO: 1359552 - DNA, 22 bp, Artificial Sequence
  chemically synthesized
tattttagtagagatgtggttt

SEQ ID NO: 1359553 - DNA, 22 bp, Artificial Sequence
  chemically synthesized
gccaacatggtgaaaccacatc

SEQ ID NO: 1359554 - DNA, 22 bp, Artificial Sequence
  chemically synthesized
tagtagagatgtggtttcacca

SEQ ID NO: 1359555 - DNA, 22 bp, Artificial Sequence
  chemically synthesized
agtagagatgtggtttcaccat

SEQ ID NO: 1359556 - DNA, 22 bp, Artificial Sequence
  chemically synthesized
gtagagatgtggtttcaccatg

SEQ ID NO: 1359557 - DNA, 22 bp, Artificial Sequence
  chemically synthesized
cagaccagcctggccaacatgg

SEQ ID NO: 1359558 - DNA, 22 bp, Artificial Sequence
  chemically synthesized
caccatgttggccaggctggtc

SEQ ID NO: 1359559 - DNA, 22 bp, Artificial Sequence
  chemically synthesized
accatgttggccaggctggtct

SEQ ID NO: 1359560 - DNA, 22 bp, Artificial Sequence
  chemically synthesized
aggtcaggaattccagaccagc

SEQ ID NO: 1359561 - DNA, 22 bp, Artificial Sequence
  chemically synthesized
gccaggctggtctggaattcct

SEQ ID NO: 1359562 - DNA, 22 bp, Artificial Sequence
  chemically synthesized
gtctggaattcctgacctcagg

SEQ ID NO: 1359563 - DNA, 22 bp, Artificial Sequence
  chemically synthesized
gaattcctgacctcaggtgatc

SEQ ID NO: 1359564 - DNA, 22 bp, Artificial Sequence
  chemically synthesized
ggaggccaaggcgggcagatca

SEQ ID NO: 1359565 - DNA, 22 bp, Artificial Sequence
  chemically synthesized
ctgacctcaggtgatctgcccg

SEQ ID NO: 1359566 - DNA, 22 bp, Artificial Sequence
  chemically synthesized
gggaggccaaggcgggcagatc

SEQ ID NO: 1359567 - DNA, 22 bp, Artificial Sequence
  chemically synthesized
tgggaggccaaggcgggcagat

SEQ ID NO: 1359568 - DNA, 22 bp, Artificial Sequence
  chemically synthesized
acctcaggtgatctgcccgcct

SEQ ID NO: 1359569 - DNA, 22 bp, Artificial Sequence
  chemically synthesized
aggtgatctgcccgccttggcc

SEQ ID NO: 1359570 - DNA, 22 bp, Artificial Sequence
  chemically synthesized
taatcccaacactttgggaggc

SEQ ID NO: 1359571 - DNA, 22 bp, Artificial Sequence
  chemically synthesized
cccgccttggcctcccaaagtg

SEQ ID NO: 1359572 - DNA, 22 bp, Artificial Sequence
  chemically synthesized
atgcctgtaatcccaacacttt

SEQ ID NO: 1359573 - DNA, 22 bp, Artificial Sequence
  chemically synthesized
ggcctcccaaagtgttgggatt

SEQ ID NO: 1359574 - DNA, 22 bp, Artificial Sequence
  chemically synthesized
gcctcccaaagtgttgggatta

SEQ ID NO: 1359575 - DNA, 22 bp, Artificial Sequence
  chemically synthesized
ccaaagtgttgggattacaggc

SEQ ID NO: 1359576 - DNA, 22 bp, Artificial Sequence
  chemically synthesized
gtcgcggtggctcatgcctgta

SEQ ID NO: 1359577 - DNA, 22 bp, Artificial Sequence
  chemically synthesized
gctggtcgcggtggctcatgcc

SEQ ID NO: 1359578 - DNA, 22 bp, Artificial Sequence
  chemically synthesized
ttggctggtcgcggtggctcat

SEQ ID NO: 1359579 - DNA, 22 bp, Artificial Sequence
  chemically synthesized
ggattacaggcatgagccaccg

SEQ ID NO: 1359580 - DNA, 22 bp, Artificial Sequence
  chemically synthesized
gttattggctggtcgcggtggc

SEQ ID NO: 1359581 - DNA, 22 bp, Artificial Sequence
  chemically synthesized
caggcatgagccaccgcgacca

SEQ ID NO: 1359582 - DNA, 22 bp, Artificial Sequence
  chemically synthesized
ttggttattggctggtcgcggt

SEQ ID NO: 1359583 - DNA, 22 bp, Artificial Sequence
  chemically synthesized
aaagcctattggttattggctg

SEQ ID NO: 1359584 - DNA, 22 bp, Artificial Sequence
  chemically synthesized
aaattaaaagcctattggttat

SEQ ID NO: 1359585 - DNA, 22 bp, Artificial Sequence
  chemically synthesized
caaattaaaagcctattggtta

SEQ ID NO: 1359586 - DNA, 22 bp, Artificial Sequence
  chemically synthesized
tttcaaattaaaagcctattgg

SEQ ID NO: 1359587 - DNA, 22 bp, Artificial Sequence
  chemically synthesized
atttcaaattaaaagcctattg

SEQ ID NO: 1359588 - DNA, 22 bp, Artificial Sequence
  chemically synthesized
cccaataatttatttcaaatta

SEQ ID NO: 1359589 - DNA, 22 bp, Artificial Sequence
  chemically synthesized
ttaatttgaaataaattattgg

SEQ ID NO: 1359590 - DNA, 22 bp, Artificial Sequence
  chemically synthesized
taatttgaaataaattattggg

SEQ ID NO: 1359591 - DNA, 22 bp, Artificial Sequence
  chemically synthesized
aatttgaaataaattattgggg

SEQ ID NO: 1359592 - DNA, 22 bp, Artificial Sequence
  chemically synthesized
atttgaaataaattattgggga

SEQ ID NO: 1359593 - DNA, 22 bp, Artificial Sequence
  chemically synthesized
gaaataaattattggggagtat

SEQ ID NO: 1359594 - DNA, 22 bp, Artificial Sequence
  chemically synthesized
aaataaattattggggagtatt

SEQ ID NO: 1359595 - DNA, 22 bp, Artificial Sequence
  chemically synthesized
ttggggagtatttctgacttcc

SEQ ID NO: 1359596 - DNA, 22 bp, Artificial Sequence
  chemically synthesized
gggagtatttctgacttccctt

SEQ ID NO: 1359597 - DNA, 22 bp, Artificial Sequence
  chemically synthesized
ctgacttccctttgcctcccac

SEQ ID NO: 1359598 - DNA, 22 bp, Artificial Sequence
  chemically synthesized
tgacttccctttgcctcccacc

SEQ ID NO: 1359599 - DNA, 22 bp, Artificial Sequence
  chemically synthesized
acttccctttgcctcccaccct

SEQ ID NO: 1359600 - DNA, 22 bp, Artificial Sequence
  chemically synthesized
aagatgtataaatgagggtggg

SEQ ID NO: 1359601 - DNA, 22 bp, Artificial Sequence
  chemically synthesized
ccctttgcctcccaccctcatt

SEQ ID NO: 1359602 - DNA, 22 bp, Artificial Sequence
  chemically synthesized
cctttgcctcccaccctcattt

SEQ ID NO: 1359603 - DNA, 22 bp, Artificial Sequence
  chemically synthesized
ttcaagatgtataaatgagggt

SEQ ID NO: 1359604 - DNA, 22 bp, Artificial Sequence
  chemically synthesized
tgcctcccaccctcatttatac

SEQ ID NO: 1359605 - DNA, 22 bp, Artificial Sequence
  chemically synthesized
gcctcccaccctcatttataca

SEQ ID NO: 1359606 - DNA, 22 bp, Artificial Sequence
  chemically synthesized
cctcccaccctcatttatacat

SEQ ID NO: 1359607 - DNA, 22 bp, Artificial Sequence
  chemically synthesized
ccaccctcatttatacatcttg

SEQ ID NO: 1359608 - DNA, 22 bp, Artificial Sequence
  chemically synthesized
atttatacatcttgaataattc

SEQ ID NO: 1359609 - DNA, 22 bp, Artificial Sequence
  chemically synthesized
atacatcttgaataattctgtt

SEQ ID NO: 1359610 - DNA, 22 bp, Artificial Sequence
  chemically synthesized
tacatcttgaataattctgttc

SEQ ID NO: 1359611 - DNA, 22 bp, Artificial Sequence
  chemically synthesized
gaataattctgttccatcacga

SEQ ID NO: 1359612 - DNA, 22 bp, Artificial Sequence
  chemically synthesized
aataattctgttccatcacgat

SEQ ID NO: 1359613 - DNA, 22 bp, Artificial Sequence
  chemically synthesized
aaaataatgtcagagatcgtga

SEQ ID NO: 1359614 - DNA, 22 bp, Artificial Sequence
  chemically synthesized
aaaaataatgtcagagatcgtg

SEQ ID NO: 1359615 - DNA, 22 bp, Artificial Sequence
  chemically synthesized
tgttccatcacgatctctgaca

SEQ ID NO: 1359616 - DNA, 22 bp, Artificial Sequence
  chemically synthesized
ttccatcacgatctctgacatt

SEQ ID NO: 1359617 - DNA, 22 bp, Artificial Sequence
  chemically synthesized
catatttaaaaataatgtcaga

SEQ ID NO: 1359618 - DNA, 22 bp, Artificial Sequence
  chemically synthesized
catcacgatctctgacattatt

SEQ ID NO: 1359619 - DNA, 22 bp, Artificial Sequence
  chemically synthesized
tgacattatttttaaatatgta

SEQ ID NO: 1359620 - DNA, 22 bp, Artificial Sequence
  chemically synthesized
acattatttttaaatatgtaga

SEQ ID NO: 1359621 - DNA, 22 bp, Artificial Sequence
  chemically synthesized
tttttaaatatgtagatatgtg

SEQ ID NO: 1359622 - DNA, 22 bp, Artificial Sequence
  chemically synthesized
ttaaatatgtagatatgtgtgc

SEQ ID NO: 1359623 - DNA, 22 bp, Artificial Sequence
  chemically synthesized
taaatatgtagatatgtgtgca

SEQ ID NO: 1359624 - DNA, 22 bp, Artificial Sequence
  chemically synthesized
aaatatgtagatatgtgtgcat

SEQ ID NO: 1359625 - DNA, 22 bp, Artificial Sequence
  chemically synthesized
aatatgtagatatgtgtgcatt

SEQ ID NO: 1359626 - DNA, 22 bp, Artificial Sequence
  chemically synthesized
ataaagaggtaatgaatgcaca

SEQ ID NO: 1359627 - DNA, 22 bp, Artificial Sequence
  chemically synthesized
atctcataaagaggtaatgaat

SEQ ID NO: 1359628 - DNA, 22 bp, Artificial Sequence
  chemically synthesized
tcatctcataaagaggtaatga

SEQ ID NO: 1359629 - DNA, 22 bp, Artificial Sequence
  chemically synthesized
tctcatctcataaagaggtaat

SEQ ID NO: 1359630 - DNA, 22 bp, Artificial Sequence
  chemically synthesized
ttctctcatctcataaagaggt

SEQ ID NO: 1359631 - DNA, 22 bp, Artificial Sequence
  chemically synthesized
attctctcatctcataaagagg

SEQ ID NO: 1359632 - DNA, 22 bp, Artificial Sequence
  chemically synthesized
tattctctcatctcataaagag

SEQ ID NO: 1359633 - DNA, 22 bp, Artificial Sequence
  chemically synthesized
attacctctttatgagatgaga

SEQ ID NO: 1359634 - DNA, 22 bp, Artificial Sequence
  chemically synthesized
cctctttatgagatgagagaat

SEQ ID NO: 1359635 - DNA, 22 bp, Artificial Sequence
  chemically synthesized
acaagcaattttattctctcat

SEQ ID NO: 1359636 - DNA, 22 bp, Artificial Sequence
  chemically synthesized
cacaagcaattttattctctca

SEQ ID NO: 1359637 - DNA, 22 bp, Artificial Sequence
  chemically synthesized
tttatgagatgagagaataaaa

SEQ ID NO: 1359638 - DNA, 22 bp, Artificial Sequence
  chemically synthesized
acttcacaagcaattttattct

SEQ ID NO: 1359639 - DNA, 22 bp, Artificial Sequence
  chemically synthesized
tatgagatgagagaataaaatt

SEQ ID NO: 1359640 - DNA, 22 bp, Artificial Sequence
  chemically synthesized
atgagatgagagaataaaattg

SEQ ID NO: 1359641 - DNA, 22 bp, Artificial Sequence
  chemically synthesized
tgacttcacaagcaattttatt

SEQ ID NO: 1359642 - DNA, 22 bp, Artificial Sequence
  chemically synthesized
tgagatgagagaataaaattgc

SEQ ID NO: 1359643 - DNA, 22 bp, Artificial Sequence
  chemically synthesized
tctgacttcacaagcaatttta

SEQ ID NO: 1359644 - DNA, 22 bp, Artificial Sequence
  chemically synthesized
ctctgacttcacaagcaatttt

SEQ ID NO: 1359645 - DNA, 22 bp, Artificial Sequence
  chemically synthesized
agtttctctgacttcacaagca

SEQ ID NO: 1359646 - DNA, 22 bp, Artificial Sequence
  chemically synthesized
gaaataatactgagtttctctg

SEQ ID NO: 1359647 - DNA, 22 bp, Artificial Sequence
  chemically synthesized
cttgtgaagtcagagaaactca

SEQ ID NO: 1359648 - DNA, 22 bp, Artificial Sequence
  chemically synthesized
gtgaagtcagagaaactcagta

SEQ ID NO: 1359649 - DNA, 22 bp, Artificial Sequence
  chemically synthesized
tgaagtcagagaaactcagtat

SEQ ID NO: 1359650 - DNA, 22 bp, Artificial Sequence
  chemically synthesized
atatatatgattagaaataata

SEQ ID NO: 1359651 - DNA, 22 bp, Artificial Sequence
  chemically synthesized
tcatatatatgattagaaataa

SEQ ID NO: 1359652 - DNA, 22 bp, Artificial Sequence
  chemically synthesized
gcattctcatatatatgattag

SEQ ID NO: 1359653 - DNA, 22 bp, Artificial Sequence
  chemically synthesized
agtattatttctaatcatatat

SEQ ID NO: 1359654 - DNA, 22 bp, Artificial Sequence
  chemically synthesized
tttctaatcatatatatgagaa

SEQ ID NO: 1359655 - DNA, 22 bp, Artificial Sequence
  chemically synthesized
ctaatcatatatatgagaatgc

SEQ ID NO: 1359656 - DNA, 22 bp, Artificial Sequence
  chemically synthesized
taatcatatatatgagaatgcc

SEQ ID NO: 1359657 - DNA, 22 bp, Artificial Sequence
  chemically synthesized
atcatatatatgagaatgccaa

SEQ ID NO: 1359658 - DNA, 22 bp, Artificial Sequence
  chemically synthesized
tacgataacgtcaacattggca

SEQ ID NO: 1359659 - DNA, 22 bp, Artificial Sequence
  chemically synthesized
tgtacgataacgtcaacattgg

SEQ ID NO: 1359660 - DNA, 22 bp, Artificial Sequence
  chemically synthesized
agcaatgtgcactctgtacgat

SEQ ID NO: 1359661 - DNA, 22 bp, Artificial Sequence
  chemically synthesized
gagttaagcaatgtgcactctg

SEQ ID NO: 1359662 - DNA, 22 bp, Artificial Sequence
  chemically synthesized
acgttatcgtacagagtgcaca

SEQ ID NO: 1359663 - DNA, 22 bp, Artificial Sequence
  chemically synthesized
tcgtacagagtgcacattgctt

SEQ ID NO: 1359664 - DNA, 22 bp, Artificial Sequence
  chemically synthesized
tgaggtaaatgacacccctgga

SEQ ID NO: 1359665 - DNA, 22 bp, Artificial Sequence
  chemically synthesized
tgctatgaggtaaatgacaccc

SEQ ID NO: 1359666 - DNA, 22 bp, Artificial Sequence
  chemically synthesized
cttaactccaggggtgtcattt

SEQ ID NO: 1359667 - DNA, 22 bp, Artificial Sequence
  chemically synthesized
aactccaggggtgtcatttacc

SEQ ID NO: 1359668 - DNA, 22 bp, Artificial Sequence
  chemically synthesized
actccaggggtgtcatttacct

SEQ ID NO: 1359669 - DNA, 22 bp, Artificial Sequence
  chemically synthesized
atattatgctatgaggtaaatg

SEQ ID NO: 1359670 - DNA, 22 bp, Artificial Sequence
  chemically synthesized
caggggtgtcatttacctcata

SEQ ID NO: 1359671 - DNA, 22 bp, Artificial Sequence
  chemically synthesized
ttaatattatgctatgaggtaa

SEQ ID NO: 1359672 - DNA, 22 bp, Artificial Sequence
  chemically synthesized
acctcatagcataatattaata

SEQ ID NO: 1359673 - DNA, 22 bp, Artificial Sequence
  chemically synthesized
cctcatagcataatattaatag

SEQ ID NO: 1359674 - DNA, 22 bp, Artificial Sequence
  chemically synthesized
atagcataatattaatagtcca

SEQ ID NO: 1359675 - DNA, 22 bp, Artificial Sequence
  chemically synthesized
gagtgtaccagtaacgtggact

SEQ ID NO: 1359676 - DNA, 22 bp, Artificial Sequence
  chemically synthesized
tagagtgtaccagtaacgtgga

SEQ ID NO: 1359677 - DNA, 22 bp, Artificial Sequence
  chemically synthesized
atagtccacgttactggtacac

SEQ ID NO: 1359678 - DNA, 22 bp, Artificial Sequence
  chemically synthesized
tacaattctagagtgtaccagt

SEQ ID NO: 1359679 - DNA, 22 bp, Artificial Sequence
  chemically synthesized
ctggtacactctagaattgtac

SEQ ID NO: 1359680 - DNA, 22 bp, Artificial Sequence
  chemically synthesized
atatagtgtacactgtacaatt

SEQ ID NO: 1359681 - DNA, 22 bp, Artificial Sequence
  chemically synthesized
gtacactctagaattgtacagt

SEQ ID NO: 1359682 - DNA, 22 bp, Artificial Sequence
  chemically synthesized
tagaattgtacagtgtacacta

SEQ ID NO: 1359683 - DNA, 22 bp, Artificial Sequence
  chemically synthesized
catacattcatatagtgtacac

SEQ ID NO: 1359684 - DNA, 22 bp, Artificial Sequence
  chemically synthesized
gaattgtacagtgtacactata

SEQ ID NO: 1359685 - DNA, 22 bp, Artificial Sequence
  chemically synthesized
gttgcatacattcatatagtgt

SEQ ID NO: 1359686 - DNA, 22 bp, Artificial Sequence
  chemically synthesized
agttgcatacattcatatagtg

SEQ ID NO: 1359687 - DNA, 22 bp, Artificial Sequence
  chemically synthesized
tacagtgtacactatatgaatg

SEQ ID NO: 1359688 - DNA, 22 bp, Artificial Sequence
  chemically synthesized
tatgaatgtatgcaactaaata

SEQ ID NO: 1359689 - DNA, 22 bp, Artificial Sequence
  chemically synthesized
gtcatccacagtgtgatattta

SEQ ID NO: 1359690 - DNA, 22 bp, Artificial Sequence
  chemically synthesized
tgttagtcatccacagtgtgat

SEQ ID NO: 1359691 - DNA, 22 bp, Artificial Sequence
  chemically synthesized
attatgttagtcatccacagtg

SEQ ID NO: 1359692 - DNA, 22 bp, Artificial Sequence
  chemically synthesized
cattatgttagtcatccacagt

SEQ ID NO: 1359693 - DNA, 22 bp, Artificial Sequence
  chemically synthesized
aatatcacactgtggatgacta

SEQ ID NO: 1359694 - DNA, 22 bp, Artificial Sequence
  chemically synthesized
tcttcattatgttagtcatcca

SEQ ID NO: 1359695 - DNA, 22 bp, Artificial Sequence
  chemically synthesized
atcttcattatgttagtcatcc

SEQ ID NO: 1359696 - DNA, 22 bp, Artificial Sequence
  chemically synthesized
ttatcttcattatgttagtcat

SEQ ID NO: 1359697 - DNA, 22 bp, Artificial Sequence
  chemically synthesized
tcttatcttcattatgttagtc

SEQ ID NO: 1359698 - DNA, 22 bp, Artificial Sequence
  chemically synthesized
ctcttatcttcattatgttagt

SEQ ID NO: 1359699 - DNA, 22 bp, Artificial Sequence
  chemically synthesized
tctcttatcttcattatgttag

SEQ ID NO: 1359700 - DNA, 22 bp, Artificial Sequence
  chemically synthesized
ttctcttatcttcattatgtta

SEQ ID NO: 1359701 - DNA, 22 bp, Artificial Sequence
  chemically synthesized
tggatgactaacataatgaaga

SEQ ID NO: 1359702 - DNA, 22 bp, Artificial Sequence
  chemically synthesized
atttttctcttatcttcattat

SEQ ID NO: 1359703 - DNA, 22 bp, Artificial Sequence
  chemically synthesized
cataaactaatttttctcttat

SEQ ID NO: 1359704 - DNA, 22 bp, Artificial Sequence
  chemically synthesized
acataatgaagataagagaaaa

SEQ ID NO: 1359705 - DNA, 22 bp, Artificial Sequence
  chemically synthesized
acataaactaatttttctctta

SEQ ID NO: 1359706 - DNA, 22 bp, Artificial Sequence
  chemically synthesized
tacataaactaatttttctctt

SEQ ID NO: 1359707 - DNA, 22 bp, Artificial Sequence
  chemically synthesized
ttacataaactaatttttctct

SEQ ID NO: 1359708 - DNA, 22 bp, Artificial Sequence
  chemically synthesized
tttacataaactaatttttctc

SEQ ID NO: 1359709 - DNA, 22 bp, Artificial Sequence
  chemically synthesized
cctttttacataaactaatttt

SEQ ID NO: 1359710 - DNA, 22 bp, Artificial Sequence
  chemically synthesized
ttgcctttttacataaactaat

SEQ ID NO: 1359711 - DNA, 22 bp, Artificial Sequence
  chemically synthesized
ctgttgcctttttacataaact

SEQ ID NO: 1359712 - DNA, 22 bp, Artificial Sequence
  chemically synthesized
taattactgttgcctttttaca

SEQ ID NO: 1359713 - DNA, 22 bp, Artificial Sequence
  chemically synthesized
ctataattactgttgccttttt

SEQ ID NO: 1359714 - DNA, 22 bp, Artificial Sequence
  chemically synthesized
gtttatgtaaaaaggcaacagt

SEQ ID NO: 1359715 - DNA, 22 bp, Artificial Sequence
  chemically synthesized
agttactataattactgttgcc

SEQ ID NO: 1359716 - DNA, 22 bp, Artificial Sequence
  chemically synthesized
aagttactataattactgttgc

SEQ ID NO: 1359717 - DNA, 22 bp, Artificial Sequence
  chemically synthesized
atgtaaaaaggcaacagtaatt

SEQ ID NO: 1359718 - DNA, 22 bp, Artificial Sequence
  chemically synthesized
tgtaaaaaggcaacagtaatta

SEQ ID NO: 1359719 - DNA, 22 bp, Artificial Sequence
  chemically synthesized
tttaagttactataattactgt

SEQ ID NO: 1359720 - DNA, 22 bp, Artificial Sequence
  chemically synthesized
gcataaacagtaggttatttaa

SEQ ID NO: 1359721 - DNA, 22 bp, Artificial Sequence
  chemically synthesized
ggcataaacagtaggttattta

SEQ ID NO: 1359722 - DNA, 22 bp, Artificial Sequence
  chemically synthesized
tagtaacttaaataacctactg

SEQ ID NO: 1359723 - DNA, 22 bp, Artificial Sequence
  chemically synthesized
aatagtacttggcataaacagt

SEQ ID NO: 1359724 - DNA, 22 bp, Artificial Sequence
  chemically synthesized
tgaatagtacttggcataaaca

SEQ ID NO: 1359725 - DNA, 22 bp, Artificial Sequence
  chemically synthesized
aaataacctactgtttatgcca

SEQ ID NO: 1359726 - DNA, 22 bp, Artificial Sequence
  chemically synthesized
aataacctactgtttatgccaa

SEQ ID NO: 1359727 - DNA, 22 bp, Artificial Sequence
  chemically synthesized
ttctgaatagtacttggcataa

SEQ ID NO: 1359728 - DNA, 22 bp, Artificial Sequence
  chemically synthesized
ctgtttatgccaagtactattc

SEQ ID NO: 1359729 - DNA, 22 bp, Artificial Sequence
  chemically synthesized
tttatgccaagtactattcaga

SEQ ID NO: 1359730 - DNA, 22 bp, Artificial Sequence
  chemically synthesized
acgtgccatactattctgaata

SEQ ID NO: 1359731 - DNA, 22 bp, Artificial Sequence
  chemically synthesized
atgccaagtactattcagaata

SEQ ID NO: 1359732 - DNA, 22 bp, Artificial Sequence
  chemically synthesized
tgccaagtactattcagaatag

SEQ ID NO: 1359733 - DNA, 22 bp, Artificial Sequence
  chemically synthesized
catagattaacgtgccatacta

SEQ ID NO: 1359734 - DNA, 22 bp, Artificial Sequence
  chemically synthesized
acatagattaacgtgccatact

SEQ ID NO: 1359735 - DNA, 22 bp, Artificial Sequence
  chemically synthesized
ttcagaatagtatggcacgtta

SEQ ID NO: 1359736 - DNA, 22 bp, Artificial Sequence
  chemically synthesized
agaatagtatggcacgttaatc

SEQ ID NO: 1359737 - DNA, 22 bp, Artificial Sequence
  chemically synthesized
taaaaaaatggtttacatagat

SEQ ID NO: 1359738 - DNA, 22 bp, Artificial Sequence
  chemically synthesized
gtattgtaaaaaaatggtttac

SEQ ID NO: 1359739 - DNA, 22 bp, Artificial Sequence
  chemically synthesized
agtattgtaaaaaaatggttta

SEQ ID NO: 1359740 - DNA, 22 bp, Artificial Sequence
  chemically synthesized
atctatgtaaaccattttttta

SEQ ID NO: 1359741 - DNA, 22 bp, Artificial Sequence
  chemically synthesized
tgtaaaccatttttttacaata

SEQ ID NO: 1359742 - DNA, 22 bp, Artificial Sequence
  chemically synthesized
aacatgatttagtattgtaaaa

SEQ ID NO: 1359743 - DNA, 22 bp, Artificial Sequence
  chemically synthesized
acctgaacatgatttagtattg

SEQ ID NO: 1359744 - DNA, 22 bp, Artificial Sequence
  chemically synthesized
ggctaacctgaacatgatttag

SEQ ID NO: 1359745 - DNA, 22 bp, Artificial Sequence
  chemically synthesized
ttttacaatactaaatcatgtt

SEQ ID NO: 1359746 - DNA, 22 bp, Artificial Sequence
  chemically synthesized
tttacaatactaaatcatgttc

SEQ ID NO: 1359747 - DNA, 22 bp, Artificial Sequence
  chemically synthesized
ttacaatactaaatcatgttca

SEQ ID NO: 1359748 - DNA, 22 bp, Artificial Sequence
  chemically synthesized
tacaatactaaatcatgttcag

SEQ ID NO: 1359749 - DNA, 22 bp, Artificial Sequence
  chemically synthesized
acaatactaaatcatgttcagg

SEQ ID NO: 1359750 - DNA, 22 bp, Artificial Sequence
  chemically synthesized
caatactaaatcatgttcaggt

SEQ ID NO: 1359751 - DNA, 22 bp, Artificial Sequence
  chemically synthesized
agaactgggctaacctgaacat

SEQ ID NO: 1359752 - DNA, 22 bp, Artificial Sequence
  chemically synthesized
aatcatgttcaggttagcccag

SEQ ID NO: 1359753 - DNA, 22 bp, Artificial Sequence
  chemically synthesized
catgaacaaaaagctaagaact

SEQ ID NO: 1359754 - DNA, 22 bp, Artificial Sequence
  chemically synthesized
aggttagcccagttcttagctt

SEQ ID NO: 1359755 - DNA, 22 bp, Artificial Sequence
  chemically synthesized
tgctacatgaacaaaaagctaa

SEQ ID NO: 1359756 - DNA, 22 bp, Artificial Sequence
  chemically synthesized
gcccagttcttagctttttgtt

SEQ ID NO: 1359757 - DNA, 22 bp, Artificial Sequence
  chemically synthesized
ttagctttttgttcatgtagca

SEQ ID NO: 1359758 - DNA, 22 bp, Artificial Sequence
  chemically synthesized
agctttttgttcatgtagcaca

SEQ ID NO: 1359759 - DNA, 22 bp, Artificial Sequence
  chemically synthesized
tgtacaggcaactgtgctacat

SEQ ID NO: 1359760 - DNA, 22 bp, Artificial Sequence
  chemically synthesized
gctttttgttcatgtagcacag

SEQ ID NO: 1359761 - DNA, 22 bp, Artificial Sequence
  chemically synthesized
tttgttcatgtagcacagttgc

SEQ ID NO: 1359762 - DNA, 22 bp, Artificial Sequence
  chemically synthesized
agttatgtacaggcaactgtgc

SEQ ID NO: 1359763 - DNA, 22 bp, Artificial Sequence
  chemically synthesized
ttgttcatgtagcacagttgcc

SEQ ID NO: 1359764 - DNA, 22 bp, Artificial Sequence
  chemically synthesized
cagttatgtacaggcaactgtg

SEQ ID NO: 1359765 - DNA, 22 bp, Artificial Sequence
  chemically synthesized
tgttcatgtagcacagttgcct

SEQ ID NO: 1359766 - DNA, 22 bp, Artificial Sequence
  chemically synthesized
gttcatgtagcacagttgcctg

SEQ ID NO: 1359767 - DNA, 22 bp, Artificial Sequence
  chemically synthesized
ttcatgtagcacagttgcctgt

SEQ ID NO: 1359768 - DNA, 22 bp, Artificial Sequence
  chemically synthesized
tttcagttatgtacaggcaact

SEQ ID NO: 1359769 - DNA, 22 bp, Artificial Sequence
  chemically synthesized
atttcagttatgtacaggcaac

SEQ ID NO: 1359770 - DNA, 22 bp, Artificial Sequence
  chemically synthesized
atgtagcacagttgcctgtaca

SEQ ID NO: 1359771 - DNA, 22 bp, Artificial Sequence
  chemically synthesized
gagtttatttcagttatgtaca

SEQ ID NO: 1359772 - DNA, 22 bp, Artificial Sequence
  chemically synthesized
agagtttatttcagttatgtac

SEQ ID NO: 1359773 - DNA, 22 bp, Artificial Sequence
  chemically synthesized
tagagtttatttcagttatgta

SEQ ID NO: 1359774 - DNA, 22 bp, Artificial Sequence
  chemically synthesized
ttagagtttatttcagttatgt

SEQ ID NO: 1359775 - DNA, 22 bp, Artificial Sequence
  chemically synthesized
ttttagagtttatttcagttat

SEQ ID NO: 1359776 - DNA, 22 bp, Artificial Sequence
  chemically synthesized
ttcttttagagtttatttcagt

SEQ ID NO: 1359777 - DNA, 22 bp, Artificial Sequence
  chemically synthesized
cctgtacataactgaaataaac

SEQ ID NO: 1359778 - DNA, 22 bp, Artificial Sequence
  chemically synthesized
gttgttcttttagagtttattt

SEQ ID NO: 1359779 - DNA, 22 bp, Artificial Sequence
  chemically synthesized
tacataactgaaataaactcta

SEQ ID NO: 1359780 - DNA, 22 bp, Artificial Sequence
  chemically synthesized
actagttgttcttttagagttt

SEQ ID NO: 1359781 - DNA, 22 bp, Artificial Sequence
  chemically synthesized
aaataaactctaaaagaacaac

SEQ ID NO: 1359782 - DNA, 22 bp, Artificial Sequence
  chemically synthesized
gagtggtctcactagttgttct

SEQ ID NO: 1359783 - DNA, 22 bp, Artificial Sequence
  chemically synthesized
agagtggtctcactagttgttc

SEQ ID NO: 1359784 - DNA, 22 bp, Artificial Sequence
  chemically synthesized
taaaagaacaactagtgagacc

SEQ ID NO: 1359785 - DNA, 22 bp, Artificial Sequence
  chemically synthesized
aaagaacaactagtgagaccac

SEQ ID NO: 1359786 - DNA, 22 bp, Artificial Sequence
  chemically synthesized
gccatccttagagtggtctcac

SEQ ID NO: 1359787 - DNA, 22 bp, Artificial Sequence
  chemically synthesized
cagttagccatccttagagtgg

SEQ ID NO: 1359788 - DNA, 22 bp, Artificial Sequence
  chemically synthesized
gtgagaccactctaaggatggc

SEQ ID NO: 1359789 - DNA, 22 bp, Artificial Sequence
  chemically synthesized
taatcatctacagttagccatc

SEQ ID NO: 1359790 - DNA, 22 bp, Artificial Sequence
  chemically synthesized
gtaatcatctacagttagccat

SEQ ID NO: 1359791 - DNA, 22 bp, Artificial Sequence
  chemically synthesized
tttgtaatcatctacagttagc

SEQ ID NO: 1359792 - DNA, 22 bp, Artificial Sequence
  chemically synthesized
gtttgtaatcatctacagttag

SEQ ID NO: 1359793 - DNA, 22 bp, Artificial Sequence
  chemically synthesized
taaggatggctaactgtagatg

SEQ ID NO: 1359794 - DNA, 22 bp, Artificial Sequence
  chemically synthesized
gtttgtttgtaatcatctacag

SEQ ID NO: 1359795 - DNA, 22 bp, Artificial Sequence
  chemically synthesized
aggatggctaactgtagatgat

SEQ ID NO: 1359796 - DNA, 22 bp, Artificial Sequence
  chemically synthesized
actgtagatgattacaaacaaa

SEQ ID NO: 1359797 - DNA, 22 bp, Artificial Sequence
  chemically synthesized
atgcagccctggtttgtttgta

SEQ ID NO: 1359798 - DNA, 22 bp, Artificial Sequence
  chemically synthesized
tagatgattacaaacaaaccag

SEQ ID NO: 1359799 - DNA, 22 bp, Artificial Sequence
  chemically synthesized
caaacaaaccagggctgcatta

SEQ ID NO: 1359800 - DNA, 22 bp, Artificial Sequence
  chemically synthesized
tgaagatgaaaaagatcaaaaa

SEQ ID NO: 1359801 - DNA, 22 bp, Artificial Sequence
  chemically synthesized
cattagttttatttttgatctt

SEQ ID NO: 1359802 - DNA, 22 bp, Artificial Sequence
  chemically synthesized
gtgaagatgaaaaagatcaaaa

SEQ ID NO: 1359803 - DNA, 22 bp, Artificial Sequence
  chemically synthesized
tgtgaagatgaaaaagatcaaa

SEQ ID NO: 1359804 - DNA, 22 bp, Artificial Sequence
  chemically synthesized
ctttgtgaagatgaaaaagatc

SEQ ID NO: 1359805 - DNA, 22 bp, Artificial Sequence
  chemically synthesized
gttttatttttgatctttttca

SEQ ID NO: 1359806 - DNA, 22 bp, Artificial Sequence
  chemically synthesized
actttgtgaagatgaaaaagat

SEQ ID NO: 1359807 - DNA, 22 bp, Artificial Sequence
  chemically synthesized
ttactttgtgaagatgaaaaag

SEQ ID NO: 1359808 - DNA, 22 bp, Artificial Sequence
  chemically synthesized
cttactttgtgaagatgaaaaa

SEQ ID NO: 1359809 - DNA, 22 bp, Artificial Sequence
  chemically synthesized
tatttttgatctttttcatctt

SEQ ID NO: 1359810 - DNA, 22 bp, Artificial Sequence
  chemically synthesized
atttttgatctttttcatcttc

SEQ ID NO: 1359811 - DNA, 22 bp, Artificial Sequence
  chemically synthesized
ttcttactttgtgaagatgaaa

SEQ ID NO: 1359812 - DNA, 22 bp, Artificial Sequence
  chemically synthesized
tttttgatctttttcatcttca

SEQ ID NO: 1359813 - DNA, 22 bp, Artificial Sequence
  chemically synthesized
ttgatctttttcatcttcacaa

SEQ ID NO: 1359814 - DNA, 22 bp, Artificial Sequence
  chemically synthesized
actcttcttactttgtgaagat

SEQ ID NO: 1359815 - DNA, 22 bp, Artificial Sequence
  chemically synthesized
tgatctttttcatcttcacaaa

SEQ ID NO: 1359816 - DNA, 22 bp, Artificial Sequence
  chemically synthesized
gatctttttcatcttcacaaag

SEQ ID NO: 1359817 - DNA, 22 bp, Artificial Sequence
  chemically synthesized
atctttttcatcttcacaaagt

SEQ ID NO: 1359818 - DNA, 22 bp, Artificial Sequence
  chemically synthesized
tctcactcttcttactttgtga

SEQ ID NO: 1359819 - DNA, 22 bp, Artificial Sequence
  chemically synthesized
ctatctcactcttcttactttg

SEQ ID NO: 1359820 - DNA, 22 bp, Artificial Sequence
  chemically synthesized
tttcatcttcacaaagtaagaa

SEQ ID NO: 1359821 - DNA, 22 bp, Artificial Sequence
  chemically synthesized
ttcatcttcacaaagtaagaag

SEQ ID NO: 1359822 - DNA, 22 bp, Artificial Sequence
  chemically synthesized
tcatcttcacaaagtaagaaga

SEQ ID NO: 1359823 - DNA, 22 bp, Artificial Sequence
  chemically synthesized
ttactatctcactcttcttact

SEQ ID NO: 1359824 - DNA, 22 bp, Artificial Sequence
  chemically synthesized
catcttcacaaagtaagaagag

SEQ ID NO: 1359825 - DNA, 22 bp, Artificial Sequence
  chemically synthesized
attactatctcactcttcttac

SEQ ID NO: 1359826 - DNA, 22 bp, Artificial Sequence
  chemically synthesized
atcttcacaaagtaagaagagt

SEQ ID NO: 1359827 - DNA, 22 bp, Artificial Sequence
  chemically synthesized
tattactatctcactcttctta

SEQ ID NO: 1359828 - DNA, 22 bp, Artificial Sequence
  chemically synthesized
cacaaagtaagaagagtgagat

SEQ ID NO: 1359829 - DNA, 22 bp, Artificial Sequence
  chemically synthesized
acaaagtaagaagagtgagata

SEQ ID NO: 1359830 - DNA, 22 bp, Artificial Sequence
  chemically synthesized
acaattttattactatctcact

SEQ ID NO: 1359831 - DNA, 22 bp, Artificial Sequence
  chemically synthesized
cacaattttattactatctcac

SEQ ID NO: 1359832 - DNA, 22 bp, Artificial Sequence
  chemically synthesized
tttcacaattttattactatct

SEQ ID NO: 1359833 - DNA, 22 bp, Artificial Sequence
  chemically synthesized
gtttcacaattttattactatc

SEQ ID NO: 1359834 - DNA, 22 bp, Artificial Sequence
  chemically synthesized
tcttgtttcacaattttattac

SEQ ID NO: 1359835 - DNA, 22 bp, Artificial Sequence
  chemically synthesized
tgataatatccataacagttat

SEQ ID NO: 1359836 - DNA, 22 bp, Artificial Sequence
  chemically synthesized
tgaaacaagataactgttatgg

SEQ ID NO: 1359837 - DNA, 22 bp, Artificial Sequence
  chemically synthesized
tctatgataatatccataacag

SEQ ID NO: 1359838 - DNA, 22 bp, Artificial Sequence
  chemically synthesized
catagggagctgtctatgataa

SEQ ID NO: 1359839 - DNA, 22 bp, Artificial Sequence
  chemically synthesized
gcatagggagctgtctatgata

SEQ ID NO: 1359840 - DNA, 22 bp, Artificial Sequence
  chemically synthesized
ttatggatattatcatagacag

SEQ ID NO: 1359841 - DNA, 22 bp, Artificial Sequence
  chemically synthesized
tggatattatcatagacagctc

SEQ ID NO: 1359842 - DNA, 22 bp, Artificial Sequence
  chemically synthesized
gacttgcatagggagctgtcta

SEQ ID NO: 1359843 - DNA, 22 bp, Artificial Sequence
  chemically synthesized
tagacttgcatagggagctgtc

SEQ ID NO: 1359844 - DNA, 22 bp, Artificial Sequence
  chemically synthesized
tctagacttgcatagggagctg

SEQ ID NO: 1359845 - DNA, 22 bp, Artificial Sequence
  chemically synthesized
tcatagacagctccctatgcaa

SEQ ID NO: 1359846 - DNA, 22 bp, Artificial Sequence
  chemically synthesized
atgcccattctctagacttgca

SEQ ID NO: 1359847 - DNA, 22 bp, Artificial Sequence
  chemically synthesized
cctatgcaagtctagagaatgg

SEQ ID NO: 1359848 - DNA, 22 bp, Artificial Sequence
  chemically synthesized
aataactcatgcccattctcta

SEQ ID NO: 1359849 - DNA, 22 bp, Artificial Sequence
  chemically synthesized
tgcaagtctagagaatgggcat

SEQ ID NO: 1359850 - DNA, 22 bp, Artificial Sequence
  chemically synthesized
agatatcctaaataactcatgc

SEQ ID NO: 1359851 - DNA, 22 bp, Artificial Sequence
  chemically synthesized
gagaatgggcatgagttattta

SEQ ID NO: 1359852 - DNA, 22 bp, Artificial Sequence
  chemically synthesized
gataaaaactgagatatcctaa

SEQ ID NO: 1359853 - DNA, 22 bp, Artificial Sequence
  chemically synthesized
agataaaaactgagatatccta

SEQ ID NO: 1359854 - DNA, 22 bp, Artificial Sequence
  chemically synthesized
ttagataaaaactgagatatcc

SEQ ID NO: 1359855 - DNA, 22 bp, Artificial Sequence
  chemically synthesized
cttagataaaaactgagatatc

SEQ ID NO: 1359856 - DNA, 22 bp, Artificial Sequence
  chemically synthesized
tcttagataaaaactgagatat

SEQ ID NO: 1359857 - DNA, 22 bp, Artificial Sequence
  chemically synthesized
tattttcttagataaaaactga

SEQ ID NO: 1359858 - DNA, 22 bp, Artificial Sequence
  chemically synthesized
tttaggatatctcagtttttat

SEQ ID NO: 1359859 - DNA, 22 bp, Artificial Sequence
  chemically synthesized
aggatatctcagtttttatcta

SEQ ID NO: 1359860 - DNA, 22 bp, Artificial Sequence
  chemically synthesized
ggatatctcagtttttatctaa

SEQ ID NO: 1359861 - DNA, 22 bp, Artificial Sequence
  chemically synthesized
gcatattatattttcttagata

SEQ ID NO: 1359862 - DNA, 22 bp, Artificial Sequence
  chemically synthesized
agtttttatctaagaaaatata

SEQ ID NO: 1359863 - DNA, 22 bp, Artificial Sequence
  chemically synthesized
tagacattggcatattatattt

SEQ ID NO: 1359864 - DNA, 22 bp, Artificial Sequence
  chemically synthesized
ttatctaagaaaatataatatg

SEQ ID NO: 1359865 - DNA, 22 bp, Artificial Sequence
  chemically synthesized
tatctaagaaaatataatatgc

SEQ ID NO: 1359866 - DNA, 22 bp, Artificial Sequence
  chemically synthesized
atctaagaaaatataatatgcc

SEQ ID NO: 1359867 - DNA, 22 bp, Artificial Sequence
  chemically synthesized
tctaagaaaatataatatgcca

SEQ ID NO: 1359868 - DNA, 22 bp, Artificial Sequence
  chemically synthesized
aaagcctatagacattggcata

SEQ ID NO: 1359869 - DNA, 22 bp, Artificial Sequence
  chemically synthesized
agaaaatataatatgccaatgt

SEQ ID NO: 1359870 - DNA, 22 bp, Artificial Sequence
  chemically synthesized
ctcaaagcctatagacattggc

SEQ ID NO: 1359871 - DNA, 22 bp, Artificial Sequence
  chemically synthesized
actcaaagcctatagacattgg

SEQ ID NO: 1359872 - DNA, 22 bp, Artificial Sequence
  chemically synthesized
tttactcaaagcctatagacat

SEQ ID NO: 1359873 - DNA, 22 bp, Artificial Sequence
  chemically synthesized
ggttgtttactcaaagcctata

SEQ ID NO: 1359874 - DNA, 22 bp, Artificial Sequence
  chemically synthesized
gggttgtttactcaaagcctat

SEQ ID NO: 1359875 - DNA, 22 bp, Artificial Sequence
  chemically synthesized
tgggttgtttactcaaagccta

SEQ ID NO: 1359876 - DNA, 22 bp, Artificial Sequence
  chemically synthesized
aaattttgggttgtttactcaa

SEQ ID NO: 1359877 - DNA, 22 bp, Artificial Sequence
  chemically synthesized
taggctttgagtaaacaaccca

SEQ ID NO: 1359878 - DNA, 22 bp, Artificial Sequence
  chemically synthesized
tgagtaaacaacccaaaatttt

SEQ ID NO: 1359879 - DNA, 22 bp, Artificial Sequence
  chemically synthesized
gagtaaacaacccaaaatttta

SEQ ID NO: 1359880 - DNA, 22 bp, Artificial Sequence
  chemically synthesized
agtaaacaacccaaaattttaa

SEQ ID NO: 1359881 - DNA, 22 bp, Artificial Sequence
  chemically synthesized
aaaataaaacccattaaaattt

SEQ ID NO: 1359882 - DNA, 22 bp, Artificial Sequence
  chemically synthesized
aaaaataaaacccattaaaatt

SEQ ID NO: 1359883 - DNA, 22 bp, Artificial Sequence
  chemically synthesized
taaaaataaaacccattaaaat

SEQ ID NO: 1359884 - DNA, 22 bp, Artificial Sequence
  chemically synthesized
tttaaaaataaaacccattaaa

SEQ ID NO: 1359885 - DNA, 22 bp, Artificial Sequence
  chemically synthesized
aggatgctctttaaaaataaaa

SEQ ID NO: 1359886 - DNA, 22 bp, Artificial Sequence
  chemically synthesized
taatgggttttatttttaaaga

SEQ ID NO: 1359887 - DNA, 22 bp, Artificial Sequence
  chemically synthesized
aatgggttttatttttaaagag

SEQ ID NO: 1359888 - DNA, 22 bp, Artificial Sequence
  chemically synthesized
atgggttttatttttaaagagc

SEQ ID NO: 1359889 - DNA, 22 bp, Artificial Sequence
  chemically synthesized
gacatgtcccattgaggatgct

SEQ ID NO: 1359890 - DNA, 22 bp, Artificial Sequence
  chemically synthesized
tatttttaaagagcatcctcaa

SEQ ID NO: 1359891 - DNA, 22 bp, Artificial Sequence
  chemically synthesized
atttttaaagagcatcctcaat

SEQ ID NO: 1359892 - DNA, 22 bp, Artificial Sequence
  chemically synthesized
tttttaaagagcatcctcaatg

SEQ ID NO: 1359893 - DNA, 22 bp, Artificial Sequence
  chemically synthesized
ttaaagagcatcctcaatggga

SEQ ID NO: 1359894 - DNA, 22 bp, Artificial Sequence
  chemically synthesized
taaagagcatcctcaatgggac

SEQ ID NO: 1359895 - DNA, 22 bp, Artificial Sequence
  chemically synthesized
aaagagcatcctcaatgggaca

SEQ ID NO: 1359896 - DNA, 22 bp, Artificial Sequence
  chemically synthesized
aagagcatcctcaatgggacat

SEQ ID NO: 1359897 - DNA, 22 bp, Artificial Sequence
  chemically synthesized
acaagaactagacatgtcccat

SEQ ID NO: 1359898 - DNA, 22 bp, Artificial Sequence
  chemically synthesized
taacaagaactagacatgtccc

SEQ ID NO: 1359899 - DNA, 22 bp, Artificial Sequence
  chemically synthesized
ctaacaagaactagacatgtcc

SEQ ID NO: 1359900 - DNA, 22 bp, Artificial Sequence
  chemically synthesized
aatgggacatgtctagttcttg

SEQ ID NO: 1359901 - DNA, 22 bp, Artificial Sequence
  chemically synthesized
gttcttgttagaagatactatg

SEQ ID NO: 1359902 - DNA, 22 bp, Artificial Sequence
  chemically synthesized
ttgttagaagatactatgattc

SEQ ID NO: 1359903 - DNA, 22 bp, Artificial Sequence
  chemically synthesized
gttagaagatactatgattcct

SEQ ID NO: 1359904 - DNA, 22 bp, Artificial Sequence
  chemically synthesized
ttagaagatactatgattcctg

SEQ ID NO: 1359905 - DNA, 22 bp, Artificial Sequence
  chemically synthesized
gaagatactatgattcctgcca

SEQ ID NO: 1359906 - DNA, 22 bp, Artificial Sequence
  chemically synthesized
tgattcctgccattttatattt

SEQ ID NO: 1359907 - DNA, 22 bp, Artificial Sequence
  chemically synthesized
aaaaggatagaacaaaatataa

SEQ ID NO: 1359908 - DNA, 22 bp, Artificial Sequence
  chemically synthesized
taaaaaggatagaacaaaatat

SEQ ID NO: 1359909 - DNA, 22 bp, Artificial Sequence
  chemically synthesized
ctgccattttatattttgttct

SEQ ID NO: 1359910 - DNA, 22 bp, Artificial Sequence
  chemically synthesized
ccattttatattttgttctatc

SEQ ID NO: 1359911 - DNA, 22 bp, Artificial Sequence
  chemically synthesized
atagaattctaaaaaggataga

SEQ ID NO: 1359912 - DNA, 22 bp, Artificial Sequence
  chemically synthesized
aatagaattctaaaaaggatag

SEQ ID NO: 1359913 - DNA, 22 bp, Artificial Sequence
  chemically synthesized
tatattttgttctatccttttt

SEQ ID NO: 1359914 - DNA, 22 bp, Artificial Sequence
  chemically synthesized
taatagaattctaaaaaggata

SEQ ID NO: 1359915 - DNA, 22 bp, Artificial Sequence
  chemically synthesized
atattttgttctatccttttta

SEQ ID NO: 1359916 - DNA, 22 bp, Artificial Sequence
  chemically synthesized
tattttgttctatcctttttag

SEQ ID NO: 1359917 - DNA, 22 bp, Artificial Sequence
  chemically synthesized
agattttaatagaattctaaaa

SEQ ID NO: 1359918 - DNA, 22 bp, Artificial Sequence
  chemically synthesized
tgttctatcctttttagaattc

SEQ ID NO: 1359919 - DNA, 22 bp, Artificial Sequence
  chemically synthesized
gttctatcctttttagaattct

SEQ ID NO: 1359920 - DNA, 22 bp, Artificial Sequence
  chemically synthesized
tcagattttaatagaattctaa

SEQ ID NO: 1359921 - DNA, 22 bp, Artificial Sequence
  chemically synthesized
ttctatcctttttagaattcta

SEQ ID NO: 1359922 - DNA, 22 bp, Artificial Sequence
  chemically synthesized
tatcctttttagaattctatta

SEQ ID NO: 1359923 - DNA, 22 bp, Artificial Sequence
  chemically synthesized
tcctttttagaattctattaaa

SEQ ID NO: 1359924 - DNA, 22 bp, Artificial Sequence
  chemically synthesized
tcacgatctctcagattttaat

SEQ ID NO: 1359925 - DNA, 22 bp, Artificial Sequence
  chemically synthesized
tttagaattctattaaaatctg

SEQ ID NO: 1359926 - DNA, 22 bp, Artificial Sequence
  chemically synthesized
ttagaattctattaaaatctga

SEQ ID NO: 1359927 - DNA, 22 bp, Artificial Sequence
  chemically synthesized
tagaattctattaaaatctgag

SEQ ID NO: 1359928 - DNA, 22 bp, Artificial Sequence
  chemically synthesized
agaattctattaaaatctgaga

SEQ ID NO: 1359929 - DNA, 22 bp, Artificial Sequence
  chemically synthesized
gaattctattaaaatctgagag

SEQ ID NO: 1359930 - DNA, 22 bp, Artificial Sequence
  chemically synthesized
tattaaaatctgagagatcgtg

SEQ ID NO: 1359931 - DNA, 22 bp, Artificial Sequence
  chemically synthesized
accagtcagttgtcacgatctc

SEQ ID NO: 1359932 - DNA, 22 bp, Artificial Sequence
  chemically synthesized
ttaaaatctgagagatcgtgac

SEQ ID NO: 1359933 - DNA, 22 bp, Artificial Sequence
  chemically synthesized
aaccagtcagttgtcacgatct

SEQ ID NO: 1359934 - DNA, 22 bp, Artificial Sequence
  chemically synthesized
ttaaccagtcagttgtcacgat

SEQ ID NO: 1359935 - DNA, 22 bp, Artificial Sequence
  chemically synthesized
aaatctgagagatcgtgacaac

SEQ ID NO: 1359936 - DNA, 22 bp, Artificial Sequence
  chemically synthesized
aagattcttaaccagtcagttg

SEQ ID NO: 1359937 - DNA, 22 bp, Artificial Sequence
  chemically synthesized
agagatcgtgacaactgactgg

SEQ ID NO: 1359938 - DNA, 22 bp, Artificial Sequence
  chemically synthesized
actggttaagaatctttaatcc

SEQ ID NO: 1359939 - DNA, 22 bp, Artificial Sequence
  chemically synthesized
gttaagaatctttaatcctact

SEQ ID NO: 1359940 - DNA, 22 bp, Artificial Sequence
  chemically synthesized
agaatctttaatcctactgtca

SEQ ID NO: 1359941 - DNA, 22 bp, Artificial Sequence
  chemically synthesized
atggtggcagcatgacagtagg

SEQ ID NO: 1359942 - DNA, 22 bp, Artificial Sequence
  chemically synthesized
aatggtggcagcatgacagtag

SEQ ID NO: 1359943 - DNA, 22 bp, Artificial Sequence
  chemically synthesized
taatggtggcagcatgacagta

SEQ ID NO: 1359944 - DNA, 22 bp, Artificial Sequence
  chemically synthesized
taatcctactgtcatgctgcca

SEQ ID NO: 1359945 - DNA, 22 bp, Artificial Sequence
  chemically synthesized
aatcctactgtcatgctgccac

SEQ ID NO: 1359946 - DNA, 22 bp, Artificial Sequence
  chemically synthesized
atcctactgtcatgctgccacc

SEQ ID NO: 1359947 - DNA, 22 bp, Artificial Sequence
  chemically synthesized
ctgtcatgctgccaccattaaa

SEQ ID NO: 1359948 - DNA, 22 bp, Artificial Sequence
  chemically synthesized
tcatgctgccaccattaaaatc

SEQ ID NO: 1359949 - DNA, 22 bp, Artificial Sequence
  chemically synthesized
gtacgtggtagagtcaggattt

SEQ ID NO: 1359950 - DNA, 22 bp, Artificial Sequence
  chemically synthesized
ccaccattaaaatcctgactct

SEQ ID NO: 1359951 - DNA, 22 bp, Artificial Sequence
  chemically synthesized
agctggtacgtggtagagtcag

SEQ ID NO: 1359952 - DNA, 22 bp, Artificial Sequence
  chemically synthesized
aaatcctgactctaccacgtac

SEQ ID NO: 1359953 - DNA, 22 bp, Artificial Sequence
  chemically synthesized
aggtagctcagctggtacgtgg

SEQ ID NO: 1359954 - DNA, 22 bp, Artificial Sequence
  chemically synthesized
aaggtagctcagctggtacgtg

SEQ ID NO: 1359955 - DNA, 22 bp, Artificial Sequence
  chemically synthesized
cttaaggtagctcagctggtac

SEQ ID NO: 1359956 - DNA, 22 bp, Artificial Sequence
  chemically synthesized
gcttaaggtagctcagctggta

SEQ ID NO: 1359957 - DNA, 22 bp, Artificial Sequence
  chemically synthesized
actctaccacgtaccagctgag

SEQ ID NO: 1359958 - DNA, 22 bp, Artificial Sequence
  chemically synthesized
taccacgtaccagctgagctac

SEQ ID NO: 1359959 - DNA, 22 bp, Artificial Sequence
  chemically synthesized
ccacgtaccagctgagctacct

SEQ ID NO: 1359960 - DNA, 22 bp, Artificial Sequence
  chemically synthesized
agtaatttgcttaaggtagctc

SEQ ID NO: 1359961 - DNA, 22 bp, Artificial Sequence
  chemically synthesized
agctaccttaagcaaattactt

SEQ ID NO: 1359962 - DNA, 22 bp, Artificial Sequence
  chemically synthesized
ccttaagcaaattacttaatct

SEQ ID NO: 1359963 - DNA, 22 bp, Artificial Sequence
  chemically synthesized
aagcaaattacttaatctccct

SEQ ID NO: 1359964 - DNA, 22 bp, Artificial Sequence
  chemically synthesized
agcaaattacttaatctccctg

SEQ ID NO: 1359965 - DNA, 22 bp, Artificial Sequence
  chemically synthesized
cttaatctccctgtacctctac

SEQ ID NO: 1359966 - DNA, 22 bp, Artificial Sequence
  chemically synthesized
ccagatgaatatgtagaggtac

SEQ ID NO: 1359967 - DNA, 22 bp, Artificial Sequence
  chemically synthesized
accagatgaatatgtagaggta

SEQ ID NO: 1359968 - DNA, 22 bp, Artificial Sequence
  chemically synthesized
aatctccctgtacctctacata

SEQ ID NO: 1359969 - DNA, 22 bp, Artificial Sequence
  chemically synthesized
atctccctgtacctctacatat

SEQ ID NO: 1359970 - DNA, 22 bp, Artificial Sequence
  chemically synthesized
aatttaccagatgaatatgtag

SEQ ID NO: 1359971 - DNA, 22 bp, Artificial Sequence
  chemically synthesized
cctgtacctctacatattcatc

SEQ ID NO: 1359972 - DNA, 22 bp, Artificial Sequence
  chemically synthesized
tacctctacatattcatctggt

SEQ ID NO: 1359973 - DNA, 22 bp, Artificial Sequence
  chemically synthesized
tacatattcatctggtaaattt

SEQ ID NO: 1359974 - DNA, 22 bp, Artificial Sequence
  chemically synthesized
catattcatctggtaaatttag

SEQ ID NO: 1359975 - DNA, 22 bp, Artificial Sequence
  chemically synthesized
atctggtaaatttagatgatta

SEQ ID NO: 1359976 - DNA, 22 bp, Artificial Sequence
  chemically synthesized
gaaggtggggaaacataatcat

SEQ ID NO: 1359977 - DNA, 22 bp, Artificial Sequence
  chemically synthesized
gtaaatttagatgattatgttt

SEQ ID NO: 1359978 - DNA, 22 bp, Artificial Sequence
  chemically synthesized
tagaaggtggggaaacataatc

SEQ ID NO: 1359979 - DNA, 22 bp, Artificial Sequence
  chemically synthesized
actctagaaggtggggaaacat

SEQ ID NO: 1359980 - DNA, 22 bp, Artificial Sequence
  chemically synthesized
agatgattatgtttccccacct

SEQ ID NO: 1359981 - DNA, 22 bp, Artificial Sequence
  chemically synthesized
gatgattatgtttccccacctt

SEQ ID NO: 1359982 - DNA, 22 bp, Artificial Sequence
  chemically synthesized
catattaactctagaaggtggg

SEQ ID NO: 1359983 - DNA, 22 bp, Artificial Sequence
  chemically synthesized
tgtttccccaccttctagagtt

SEQ ID NO: 1359984 - DNA, 22 bp, Artificial Sequence
  chemically synthesized
ccccaccttctagagttaatat

SEQ ID NO: 1359985 - DNA, 22 bp, Artificial Sequence
  chemically synthesized
cccaccttctagagttaatatg

SEQ ID NO: 1359986 - DNA, 22 bp, Artificial Sequence
  chemically synthesized
ctagagttaatatggaacttat

SEQ ID NO: 1359987 - DNA, 22 bp, Artificial Sequence
  chemically synthesized
tagagttaatatggaacttatc

SEQ ID NO: 1359988 - DNA, 22 bp, Artificial Sequence
  chemically synthesized
gagttaatatggaacttatcac

SEQ ID NO: 1359989 - DNA, 22 bp, Artificial Sequence
  chemically synthesized
catcacatacatatgtgataag

SEQ ID NO: 1359990 - DNA, 22 bp, Artificial Sequence
  chemically synthesized
atatggaacttatcacatatgt

SEQ ID NO: 1359991 - DNA, 22 bp, Artificial Sequence
  chemically synthesized
attacatcacatacatatgtga

SEQ ID NO: 1359992 - DNA, 22 bp, Artificial Sequence
  chemically synthesized
tgattacatcacatacatatgt

SEQ ID NO: 1359993 - DNA, 22 bp, Artificial Sequence
  chemically synthesized
tctgattacatcacatacatat

SEQ ID NO: 1359994 - DNA, 22 bp, Artificial Sequence
  chemically synthesized
ctctgattacatcacatacata

SEQ ID NO: 1359995 - DNA, 22 bp, Artificial Sequence
  chemically synthesized
atcacatatgtatgtgatgtaa

SEQ ID NO: 1359996 - DNA, 22 bp, Artificial Sequence
  chemically synthesized
tcacatatgtatgtgatgtaat

SEQ ID NO: 1359997 - DNA, 22 bp, Artificial Sequence
  chemically synthesized
taataagtgtcaggcacttctc

SEQ ID NO: 1359998 - DNA, 22 bp, Artificial Sequence
  chemically synthesized
acaagcctgtaataagtgtcag

SEQ ID NO: 1359999 - DNA, 22 bp, Artificial Sequence
  chemically synthesized
aacaagcctgtaataagtgtca

SEQ ID NO: 1360000 - DNA, 22 bp, Artificial Sequence
  chemically synthesized
ccatttaacaagcctgtaataa

SEQ ID NO: 1360001 - DNA, 22 bp, Artificial Sequence
  chemically synthesized
accatttaacaagcctgtaata

SEQ ID NO: 1360002 - DNA, 22 bp, Artificial Sequence
  chemically synthesized
tatttaccatttaacaagcctg

SEQ ID NO: 1360003 - DNA, 22 bp, Artificial Sequence
  chemically synthesized
acacttattacaggcttgttaa

SEQ ID NO: 1360004 - DNA, 22 bp, Artificial Sequence
  chemically synthesized
attacaggcttgttaaatggta

SEQ ID NO: 1360005 - DNA, 22 bp, Artificial Sequence
  chemically synthesized
ttacaggcttgttaaatggtaa

SEQ ID NO: 1360006 - DNA, 22 bp, Artificial Sequence
  chemically synthesized
caggcttgttaaatggtaaata

SEQ ID NO: 1360007 - DNA, 22 bp, Artificial Sequence
  chemically synthesized
aatgataatactgtatttacca

SEQ ID NO: 1360008 - DNA, 22 bp, Artificial Sequence
  chemically synthesized
caatgataatactgtatttacc

SEQ ID NO: 1360009 - DNA, 22 bp, Artificial Sequence
  chemically synthesized
gttaaatggtaaatacagtatt

SEQ ID NO: 1360010 - DNA, 22 bp, Artificial Sequence
  chemically synthesized
atcttcaatgataatactgtat

SEQ ID NO: 1360011 - DNA, 22 bp, Artificial Sequence
  chemically synthesized
ttaaatggtaaatacagtatta

SEQ ID NO: 1360012 - DNA, 22 bp, Artificial Sequence
  chemically synthesized
aatggtaaatacagtattatca

SEQ ID NO: 1360013 - DNA, 22 bp, Artificial Sequence
  chemically synthesized
acctaatcttcaatgataatac

SEQ ID NO: 1360014 - DNA, 22 bp, Artificial Sequence
  chemically synthesized
gattcacctaatcttcaatgat

SEQ ID NO: 1360015 - DNA, 22 bp, Artificial Sequence
  chemically synthesized
tagattcacctaatcttcaatg

SEQ ID NO: 1360016 - DNA, 22 bp, Artificial Sequence
  chemically synthesized
ttctagattcacctaatcttca

SEQ ID NO: 1360017 - DNA, 22 bp, Artificial Sequence
  chemically synthesized
tcattgaagattaggtgaatct

SEQ ID NO: 1360018 - DNA, 22 bp, Artificial Sequence
  chemically synthesized
aagattaggtgaatctagaata

SEQ ID NO: 1360019 - DNA, 22 bp, Artificial Sequence
  chemically synthesized
tgtgtgcatagcactattctag

SEQ ID NO: 1360020 - DNA, 22 bp, Artificial Sequence
  chemically synthesized
gtgtgtgcatagcactattcta

SEQ ID NO: 1360021 - DNA, 22 bp, Artificial Sequence
  chemically synthesized
ggtgaatctagaatagtgctat

SEQ ID NO: 1360022 - DNA, 22 bp, Artificial Sequence
  chemically synthesized
acagtaccttgtgtgtgcatag

SEQ ID NO: 1360023 - DNA, 22 bp, Artificial Sequence
  chemically synthesized
ttgacagtaccttgtgtgtgca

SEQ ID NO: 1360024 - DNA, 22 bp, Artificial Sequence
  chemically synthesized
gaatagtgctatgcacacacaa

SEQ ID NO: 1360025 - DNA, 22 bp, Artificial Sequence
  chemically synthesized
tgcacacacaaggtactgtcaa

SEQ ID NO: 1360026 - DNA, 22 bp, Artificial Sequence
  chemically synthesized
catacacagctattgacagtac

SEQ ID NO: 1360027 - DNA, 22 bp, Artificial Sequence
  chemically synthesized
acatacacagctattgacagta

SEQ ID NO: 1360028 - DNA, 22 bp, Artificial Sequence
  chemically synthesized
tcttacatacacagctattgac

SEQ ID NO: 1360029 - DNA, 22 bp, Artificial Sequence
  chemically synthesized
atctgtcttacatacacagcta

SEQ ID NO: 1360030 - DNA, 22 bp, Artificial Sequence
  chemically synthesized
tcaatagctgtgtatgtaagac

SEQ ID NO: 1360031 - DNA, 22 bp, Artificial Sequence
  chemically synthesized
atgaaacattgatctgtcttac

SEQ ID NO: 1360032 - DNA, 22 bp, Artificial Sequence
  chemically synthesized
tgtatgtaagacagatcaatgt

SEQ ID NO: 1360033 - DNA, 22 bp, Artificial Sequence
  chemically synthesized
caagaagcagtgaggcaaaaag

SEQ ID NO: 1360034 - DNA, 22 bp, Artificial Sequence
  chemically synthesized
cattaatcctttttgcctcact

SEQ ID NO: 1360035 - DNA, 22 bp, Artificial Sequence
  chemically synthesized
attaatcctttttgcctcactg

SEQ ID NO: 1360036 - DNA, 22 bp, Artificial Sequence
  chemically synthesized
atcctttttgcctcactgcttc

SEQ ID NO: 1360037 - DNA, 22 bp, Artificial Sequence
  chemically synthesized
gagaatgattgcaagaagcagt

SEQ ID NO: 1360038 - DNA, 22 bp, Artificial Sequence
  chemically synthesized
tttgcctcactgcttcttgcaa

SEQ ID NO: 1360039 - DNA, 22 bp, Artificial Sequence
  chemically synthesized
ttgcctcactgcttcttgcaat

SEQ ID NO: 1360040 - DNA, 22 bp, Artificial Sequence
  chemically synthesized
tgcctcactgcttcttgcaatc

SEQ ID NO: 1360041 - DNA, 22 bp, Artificial Sequence
  chemically synthesized
gcctcactgcttcttgcaatca

SEQ ID NO: 1360042 - DNA, 22 bp, Artificial Sequence
  chemically synthesized
cctcactgcttcttgcaatcat

SEQ ID NO: 1360043 - DNA, 22 bp, Artificial Sequence
  chemically synthesized
actgcttcttgcaatcattctc

SEQ ID NO: 1360044 - DNA, 22 bp, Artificial Sequence
  chemically synthesized
cttcttgcaatcattctctaat

SEQ ID NO: 1360045 - DNA, 22 bp, Artificial Sequence
  chemically synthesized
cttgcaatcattctctaattca

SEQ ID NO: 1360046 - DNA, 22 bp, Artificial Sequence
  chemically synthesized
ttgcaatcattctctaattcac

SEQ ID NO: 1360047 - DNA, 22 bp, Artificial Sequence
  chemically synthesized
gcaatcattctctaattcacat

SEQ ID NO: 1360048 - DNA, 22 bp, Artificial Sequence
  chemically synthesized
caatcattctctaattcacatc

SEQ ID NO: 1360049 - DNA, 22 bp, Artificial Sequence
  chemically synthesized
tctaattcacatctctgtatgt

SEQ ID NO: 1360050 - DNA, 22 bp, Artificial Sequence
  chemically synthesized
taattcacatctctgtatgtcc

SEQ ID NO: 1360051 - DNA, 22 bp, Artificial Sequence
  chemically synthesized
attcacatctctgtatgtccat

SEQ ID NO: 1360052 - DNA, 22 bp, Artificial Sequence
  chemically synthesized
acatctctgtatgtccatactc

SEQ ID NO: 1360053 - DNA, 22 bp, Artificial Sequence
  chemically synthesized
taaataggcataagagtatgga

SEQ ID NO: 1360054 - DNA, 22 bp, Artificial Sequence
  chemically synthesized
ataaataggcataagagtatgg

SEQ ID NO: 1360055 - DNA, 22 bp, Artificial Sequence
  chemically synthesized
tataaataggcataagagtatg

SEQ ID NO: 1360056 - DNA, 22 bp, Artificial Sequence
  chemically synthesized
ttataaataggcataagagtat

SEQ ID NO: 1360057 - DNA, 22 bp, Artificial Sequence
  chemically synthesized
tgtatgtccatactcttatgcc

SEQ ID NO: 1360058 - DNA, 22 bp, Artificial Sequence
  chemically synthesized
tatgtccatactcttatgccta

SEQ ID NO: 1360059 - DNA, 22 bp, Artificial Sequence
  chemically synthesized
aagaatccatttttataaatag

SEQ ID NO: 1360060 - DNA, 22 bp, Artificial Sequence
  chemically synthesized
attgaagaatccatttttataa

SEQ ID NO: 1360061 - DNA, 22 bp, Artificial Sequence
  chemically synthesized
ttatgcctatttataaaaatgg

SEQ ID NO: 1360062 - DNA, 22 bp, Artificial Sequence
  chemically synthesized
tcattgaagaatccatttttat

SEQ ID NO: 1360063 - DNA, 22 bp, Artificial Sequence
  chemically synthesized
atgcctatttataaaaatggat

SEQ ID NO: 1360064 - DNA, 22 bp, Artificial Sequence
  chemically synthesized
tgcctatttataaaaatggatt

SEQ ID NO: 1360065 - DNA, 22 bp, Artificial Sequence
  chemically synthesized
tttataaaaatggattcttcaa

SEQ ID NO: 1360066 - DNA, 22 bp, Artificial Sequence
  chemically synthesized
tggacattctcattgaagaatc

SEQ ID NO: 1360067 - DNA, 22 bp, Artificial Sequence
  chemically synthesized
ataaaaatggattcttcaatga

SEQ ID NO: 1360068 - DNA, 22 bp, Artificial Sequence
  chemically synthesized
taaaaatggattcttcaatgag

SEQ ID NO: 1360069 - DNA, 22 bp, Artificial Sequence
  chemically synthesized
tgaatagtgtgattatggacat

SEQ ID NO: 1360070 - DNA, 22 bp, Artificial Sequence
  chemically synthesized
atgaatagtgtgattatggaca

SEQ ID NO: 1360071 - DNA, 22 bp, Artificial Sequence
  chemically synthesized
ttcaatgagaatgtccataatc

SEQ ID NO: 1360072 - DNA, 22 bp, Artificial Sequence
  chemically synthesized
caatgagaatgtccataatcac

SEQ ID NO: 1360073 - DNA, 22 bp, Artificial Sequence
  chemically synthesized
cttatgaatagtgtgattatgg

SEQ ID NO: 1360074 - DNA, 22 bp, Artificial Sequence
  chemically synthesized
aatgagaatgtccataatcaca

SEQ ID NO: 1360075 - DNA, 22 bp, Artificial Sequence
  chemically synthesized
ttcataagtaatcatttatgat

SEQ ID NO: 1360076 - DNA, 22 bp, Artificial Sequence
  chemically synthesized
ataagtaatcatttatgattga

SEQ ID NO: 1360077 - DNA, 22 bp, Artificial Sequence
  chemically synthesized
taaagcatggtacaaatcaatc

SEQ ID NO: 1360078 - DNA, 22 bp, Artificial Sequence
  chemically synthesized
atgattgatttgtaccatgctt

SEQ ID NO: 1360079 - DNA, 22 bp, Artificial Sequence
  chemically synthesized
tgattgatttgtaccatgcttt

SEQ ID NO: 1360080 - DNA, 22 bp, Artificial Sequence
  chemically synthesized
atttgtaccatgctttataact

SEQ ID NO: 1360081 - DNA, 22 bp, Artificial Sequence
  chemically synthesized
taaaatatcaagaaagttataa

SEQ ID NO: 1360082 - DNA, 22 bp, Artificial Sequence
  chemically synthesized
gtaccatgctttataactttct

SEQ ID NO: 1360083 - DNA, 22 bp, Artificial Sequence
  chemically synthesized
taccatgctttataactttctt

SEQ ID NO: 1360084 - DNA, 22 bp, Artificial Sequence
  chemically synthesized
ctataaaatatcaagaaagtta

SEQ ID NO: 1360085 - DNA, 22 bp, Artificial Sequence
  chemically synthesized
tataactttcttgatattttat

SEQ ID NO: 1360086 - DNA, 22 bp, Artificial Sequence
  chemically synthesized
ataactttcttgatattttata

SEQ ID NO: 1360087 - DNA, 22 bp, Artificial Sequence
  chemically synthesized
taactttcttgatattttatag

SEQ ID NO: 1360088 - DNA, 22 bp, Artificial Sequence
  chemically synthesized
tcttgatattttatagtagttg

SEQ ID NO: 1360089 - DNA, 22 bp, Artificial Sequence
  chemically synthesized
cttgatattttatagtagttgt

SEQ ID NO: 1360090 - DNA, 22 bp, Artificial Sequence
  chemically synthesized
ttgatattttatagtagttgta

SEQ ID NO: 1360091 - DNA, 22 bp, Artificial Sequence
  chemically synthesized
gatattttatagtagttgtacg

SEQ ID NO: 1360092 - DNA, 22 bp, Artificial Sequence
  chemically synthesized
atattttatagtagttgtacgc

SEQ ID NO: 1360093 - DNA, 22 bp, Artificial Sequence
  chemically synthesized
tatagtagttgtacgcatatac

SEQ ID NO: 1360094 - DNA, 22 bp, Artificial Sequence
  chemically synthesized
atagtagttgtacgcatataca

SEQ ID NO: 1360095 - DNA, 22 bp, Artificial Sequence
  chemically synthesized
tagtagttgtacgcatatacat

SEQ ID NO: 1360096 - DNA, 22 bp, Artificial Sequence
  chemically synthesized
tacgcatatacatatgtgtgtg

SEQ ID NO: 1360097 - DNA, 22 bp, Artificial Sequence
  chemically synthesized
agtcagagaacagatacacaca

SEQ ID NO: 1360098 - DNA, 22 bp, Artificial Sequence
  chemically synthesized
taagtcagagaacagatacaca

SEQ ID NO: 1360099 - DNA, 22 bp, Artificial Sequence
  chemically synthesized
tgagacagcaactctaagtcag

SEQ ID NO: 1360100 - DNA, 22 bp, Artificial Sequence
  chemically synthesized
atgagacagcaactctaagtca

SEQ ID NO: 1360101 - DNA, 22 bp, Artificial Sequence
  chemically synthesized
tatgagacagcaactctaagtc

SEQ ID NO: 1360102 - DNA, 22 bp, Artificial Sequence
  chemically synthesized
ttatgagacagcaactctaagt

SEQ ID NO: 1360103 - DNA, 22 bp, Artificial Sequence
  chemically synthesized
tttatgagacagcaactctaag

SEQ ID NO: 1360104 - DNA, 22 bp, Artificial Sequence
  chemically synthesized
ctttttatgagacagcaactct

SEQ ID NO: 1360105 - DNA, 22 bp, Artificial Sequence
  chemically synthesized
ttctctgacttagagttgctgt

SEQ ID NO: 1360106 - DNA, 22 bp, Artificial Sequence
  chemically synthesized
gctttttatgagacagcaactc

SEQ ID NO: 1360107 - DNA, 22 bp, Artificial Sequence
  chemically synthesized
tgctttttatgagacagcaact

SEQ ID NO: 1360108 - DNA, 22 bp, Artificial Sequence
  chemically synthesized
tctgacttagagttgctgtctc

SEQ ID NO: 1360109 - DNA, 22 bp, Artificial Sequence
  chemically synthesized
tttgctttttatgagacagcaa

SEQ ID NO: 1360110 - DNA, 22 bp, Artificial Sequence
  chemically synthesized
tgacttagagttgctgtctcat

SEQ ID NO: 1360111 - DNA, 22 bp, Artificial Sequence
  chemically synthesized
tctttgctttttatgagacagc

SEQ ID NO: 1360112 - DNA, 22 bp, Artificial Sequence
  chemically synthesized
acttagagttgctgtctcataa

SEQ ID NO: 1360113 - DNA, 22 bp, Artificial Sequence
  chemically synthesized
tgttctctttgctttttatgag

SEQ ID NO: 1360114 - DNA, 22 bp, Artificial Sequence
  chemically synthesized
agagttgctgtctcataaaaag

SEQ ID NO: 1360115 - DNA, 22 bp, Artificial Sequence
  chemically synthesized
gagttgctgtctcataaaaagc

SEQ ID NO: 1360116 - DNA, 22 bp, Artificial Sequence
  chemically synthesized
ctgtctcataaaaagcaaagag

SEQ ID NO: 1360117 - DNA, 22 bp, Artificial Sequence
  chemically synthesized
aacacctatgttctctttgctt

SEQ ID NO: 1360118 - DNA, 22 bp, Artificial Sequence
  chemically synthesized
tctcataaaaagcaaagagaac

SEQ ID NO: 1360119 - DNA, 22 bp, Artificial Sequence
  chemically synthesized
ttgaacacctatgttctctttg

SEQ ID NO: 1360120 - DNA, 22 bp, Artificial Sequence
  chemically synthesized
ataaaaagcaaagagaacatag

SEQ ID NO: 1360121 - DNA, 22 bp, Artificial Sequence
  chemically synthesized
aacattgttgaacacctatgtt

SEQ ID NO: 1360122 - DNA, 22 bp, Artificial Sequence
  chemically synthesized
taactcaacattgttgaacacc

SEQ ID NO: 1360123 - DNA, 22 bp, Artificial Sequence
  chemically synthesized
ataactcaacattgttgaacac

SEQ ID NO: 1360124 - DNA, 22 bp, Artificial Sequence
  chemically synthesized
cttataactcaacattgttgaa

SEQ ID NO: 1360125 - DNA, 22 bp, Artificial Sequence
  chemically synthesized
attgcttataactcaacattgt

SEQ ID NO: 1360126 - DNA, 22 bp, Artificial Sequence
  chemically synthesized
aattgcttataactcaacattg

SEQ ID NO: 1360127 - DNA, 22 bp, Artificial Sequence
  chemically synthesized
taattgcttataactcaacatt

SEQ ID NO: 1360128 - DNA, 22 bp, Artificial Sequence
  chemically synthesized
ttaattgcttataactcaacat

SEQ ID NO: 1360129 - DNA, 22 bp, Artificial Sequence
  chemically synthesized
ggtttttaattgcttataactc

SEQ ID NO: 1360130 - DNA, 22 bp, Artificial Sequence
  chemically synthesized
aacaatgttgagttataagcaa

SEQ ID NO: 1360131 - DNA, 22 bp, Artificial Sequence
  chemically synthesized
acattaggtttttaattgctta

SEQ ID NO: 1360132 - DNA, 22 bp, Artificial Sequence
  chemically synthesized
aacattaggtttttaattgctt

SEQ ID NO: 1360133 - DNA, 22 bp, Artificial Sequence
  chemically synthesized
taacattaggtttttaattgct

SEQ ID NO: 1360134 - DNA, 22 bp, Artificial Sequence
  chemically synthesized
ttaacattaggtttttaattgc

SEQ ID NO: 1360135 - DNA, 22 bp, Artificial Sequence
  chemically synthesized
tttaacattaggtttttaattg

SEQ ID NO: 1360136 - DNA, 22 bp, Artificial Sequence
  chemically synthesized
ttttaacattaggtttttaatt

SEQ ID NO: 1360137 - DNA, 22 bp, Artificial Sequence
  chemically synthesized
tttttaacattaggtttttaat

SEQ ID NO: 1360138 - DNA, 22 bp, Artificial Sequence
  chemically synthesized
agttataagcaattaaaaacct

SEQ ID NO: 1360139 - DNA, 22 bp, Artificial Sequence
  chemically synthesized
taagcaattaaaaacctaatgt

SEQ ID NO: 1360140 - DNA, 22 bp, Artificial Sequence
  chemically synthesized
agcaactttttttaacattagg

SEQ ID NO: 1360141 - DNA, 22 bp, Artificial Sequence
  chemically synthesized
aaaacctaatgttaaaaaaagt

SEQ ID NO: 1360142 - DNA, 22 bp, Artificial Sequence
  chemically synthesized
atgttaaaaaaagttgctcaat

SEQ ID NO: 1360143 - DNA, 22 bp, Artificial Sequence
  chemically synthesized
aaaaaagttgctcaatatcata

SEQ ID NO: 1360144 - DNA, 22 bp, Artificial Sequence
  chemically synthesized
gatagaatagtaatatgatatt

SEQ ID NO: 1360145 - DNA, 22 bp, Artificial Sequence
  chemically synthesized
ctcaatatcatattactattct

SEQ ID NO: 1360146 - DNA, 22 bp, Artificial Sequence
  chemically synthesized
aatatcatattactattctatc

SEQ ID NO: 1360147 - DNA, 22 bp, Artificial Sequence
  chemically synthesized
gaggaagtaagactcgatagaa

SEQ ID NO: 1360148 - DNA, 22 bp, Artificial Sequence
  chemically synthesized
ggaggaagtaagactcgataga

SEQ ID NO: 1360149 - DNA, 22 bp, Artificial Sequence
  chemically synthesized
tggaggaagtaagactcgatag

SEQ ID NO: 1360150 - DNA, 22 bp, Artificial Sequence
  chemically synthesized
gctttggaggaagtaagactcg

SEQ ID NO: 1360151 - DNA, 22 bp, Artificial Sequence
  chemically synthesized
ctattctatcgagtcttacttc

SEQ ID NO: 1360152 - DNA, 22 bp, Artificial Sequence
  chemically synthesized
ttctatcgagtcttacttcctc

SEQ ID NO: 1360153 - DNA, 22 bp, Artificial Sequence
  chemically synthesized
tcagttagctttggaggaagta

SEQ ID NO: 1360154 - DNA, 22 bp, Artificial Sequence
  chemically synthesized
atcagttagctttggaggaagt

SEQ ID NO: 1360155 - DNA, 22 bp, Artificial Sequence
  chemically synthesized
tatcgagtcttacttcctccaa

SEQ ID NO: 1360156 - DNA, 22 bp, Artificial Sequence
  chemically synthesized
tcgagtcttacttcctccaaag

SEQ ID NO: 1360157 - DNA, 22 bp, Artificial Sequence
  chemically synthesized
acttcctccaaagctaactgat

SEQ ID NO: 1360158 - DNA, 22 bp, Artificial Sequence
  chemically synthesized
cttcctccaaagctaactgata

SEQ ID NO: 1360159 - DNA, 22 bp, Artificial Sequence
  chemically synthesized
cctccaaagctaactgataagt

SEQ ID NO: 1360160 - DNA, 22 bp, Artificial Sequence
  chemically synthesized
ctccaaagctaactgataagta

SEQ ID NO: 1360161 - DNA, 22 bp, Artificial Sequence
  chemically synthesized
caaagctaactgataagtacat

SEQ ID NO: 1360162 - DNA, 22 bp, Artificial Sequence
  chemically synthesized
atcatggatgaatgtaatgtac

SEQ ID NO: 1360163 - DNA, 22 bp, Artificial Sequence
  chemically synthesized
actgataagtacattacattca

SEQ ID NO: 1360164 - DNA, 22 bp, Artificial Sequence
  chemically synthesized
aatctaatcatggatgaatgta

SEQ ID NO: 1360165 - DNA, 22 bp, Artificial Sequence
  chemically synthesized
ataagtacattacattcatcca

SEQ ID NO: 1360166 - DNA, 22 bp, Artificial Sequence
  chemically synthesized
agtaattcaatctaatcatgga

SEQ ID NO: 1360167 - DNA, 22 bp, Artificial Sequence
  chemically synthesized
gagtaattcaatctaatcatgg

SEQ ID NO: 1360168 - DNA, 22 bp, Artificial Sequence
  chemically synthesized
cattcatccatgattagattga

SEQ ID NO: 1360169 - DNA, 22 bp, Artificial Sequence
  chemically synthesized
atccatgattagattgaattac

SEQ ID NO: 1360170 - DNA, 22 bp, Artificial Sequence
  chemically synthesized
gattgaattactcaaatgcctt

SEQ ID NO: 1360171 - DNA, 22 bp, Artificial Sequence
  chemically synthesized
aattactcaaatgccttctatc

SEQ ID NO: 1360172 - DNA, 22 bp, Artificial Sequence
  chemically synthesized
ctcaaatgccttctatctcttt

SEQ ID NO: 1360173 - DNA, 22 bp, Artificial Sequence
  chemically synthesized
aaatgccttctatctctttatt

SEQ ID NO: 1360174 - DNA, 22 bp, Artificial Sequence
  chemically synthesized
aataaagccagaatcacaataa

SEQ ID NO: 1360175 - DNA, 22 bp, Artificial Sequence
  chemically synthesized
aaataaagccagaatcacaata

SEQ ID NO: 1360176 - DNA, 22 bp, Artificial Sequence
  chemically synthesized
ctatctctttattgtgattctg

SEQ ID NO: 1360177 - DNA, 22 bp, Artificial Sequence
  chemically synthesized
tatctctttattgtgattctgg

SEQ ID NO: 1360178 - DNA, 22 bp, Artificial Sequence
  chemically synthesized
agtttaaataaagccagaatca

SEQ ID NO: 1360179 - DNA, 22 bp, Artificial Sequence
  chemically synthesized
tctctttattgtgattctggct

SEQ ID NO: 1360180 - DNA, 22 bp, Artificial Sequence
  chemically synthesized
cagtttaaataaagccagaatc

SEQ ID NO: 1360181 - DNA, 22 bp, Artificial Sequence
  chemically synthesized
tttattgtgattctggctttat

SEQ ID NO: 1360182 - DNA, 22 bp, Artificial Sequence
  chemically synthesized
tattgtgattctggctttattt

SEQ ID NO: 1360183 - DNA, 22 bp, Artificial Sequence
  chemically synthesized
acatttcagtttaaataaagcc

SEQ ID NO: 1360184 - DNA, 22 bp, Artificial Sequence
  chemically synthesized
attgtgattctggctttattta

SEQ ID NO: 1360185 - DNA, 22 bp, Artificial Sequence
  chemically synthesized
ttgtgattctggctttatttaa

SEQ ID NO: 1360186 - DNA, 22 bp, Artificial Sequence
  chemically synthesized
tgattctggctttatttaaact

SEQ ID NO: 1360187 - DNA, 22 bp, Artificial Sequence
  chemically synthesized
gaaaacattgacatttcagttt

SEQ ID NO: 1360188 - DNA, 22 bp, Artificial Sequence
  chemically synthesized
tggctttatttaaactgaaatg

SEQ ID NO: 1360189 - DNA, 22 bp, Artificial Sequence
  chemically synthesized
gctttatttaaactgaaatgtc

SEQ ID NO: 1360190 - DNA, 22 bp, Artificial Sequence
  chemically synthesized
tatttaaactgaaatgtcaatg

SEQ ID NO: 1360191 - DNA, 22 bp, Artificial Sequence
  chemically synthesized
atttaaactgaaatgtcaatgt

SEQ ID NO: 1360192 - DNA, 22 bp, Artificial Sequence
  chemically synthesized
tttaaactgaaatgtcaatgtt

SEQ ID NO: 1360193 - DNA, 22 bp, Artificial Sequence
  chemically synthesized
aaactgaaatgtcaatgttttc

SEQ ID NO: 1360194 - DNA, 22 bp, Artificial Sequence
  chemically synthesized
aactgaaatgtcaatgttttct

SEQ ID NO: 1360195 - DNA, 22 bp, Artificial Sequence
  chemically synthesized
aaatgtcaatgttttctaggta

SEQ ID NO: 1360196 - DNA, 22 bp, Artificial Sequence
  chemically synthesized
caaaaatggtaaaaatacctag

SEQ ID NO: 1360197 - DNA, 22 bp, Artificial Sequence
  chemically synthesized
tctaggtatttttaccattttt

SEQ ID NO: 1360198 - DNA, 22 bp, Artificial Sequence
  chemically synthesized
ctaggtatttttaccatttttg

SEQ ID NO: 1360199 - DNA, 22 bp, Artificial Sequence
  chemically synthesized
tcccaatatctgcaaaaatggt

SEQ ID NO: 1360200 - DNA, 22 bp, Artificial Sequence
  chemically synthesized
taggtatttttaccatttttgc

SEQ ID NO: 1360201 - DNA, 22 bp, Artificial Sequence
  chemically synthesized
ggtatttttaccatttttgcag

SEQ ID NO: 1360202 - DNA, 22 bp, Artificial Sequence
  chemically synthesized
ttaccatttttgcagatattgg

SEQ ID NO: 1360203 - DNA, 22 bp, Artificial Sequence
  chemically synthesized
taccatttttgcagatattggg

SEQ ID NO: 1360204 - DNA, 22 bp, Artificial Sequence
  chemically synthesized
accatttttgcagatattggga

SEQ ID NO: 1360205 - DNA, 22 bp, Artificial Sequence
  chemically synthesized
ccatttttgcagatattgggat

SEQ ID NO: 1360206 - DNA, 22 bp, Artificial Sequence
  chemically synthesized
gtgaaagtgattatcccaatat

SEQ ID NO: 1360207 - DNA, 22 bp, Artificial Sequence
  chemically synthesized
ttgcagatattgggataatcac

SEQ ID NO: 1360208 - DNA, 22 bp, Artificial Sequence
  chemically synthesized
tgcagatattgggataatcact

SEQ ID NO: 1360209 - DNA, 22 bp, Artificial Sequence
  chemically synthesized
gcagatattgggataatcactt

SEQ ID NO: 1360210 - DNA, 22 bp, Artificial Sequence
  chemically synthesized
cagatattgggataatcacttt

SEQ ID NO: 1360211 - DNA, 22 bp, Artificial Sequence
  chemically synthesized
gaggaccgttagtgaaagtgat

SEQ ID NO: 1360212 - DNA, 22 bp, Artificial Sequence
  chemically synthesized
tggaggaccgttagtgaaagtg

SEQ ID NO: 1360213 - DNA, 22 bp, Artificial Sequence
  chemically synthesized
ggataatcactttcactaacgg

SEQ ID NO: 1360214 - DNA, 22 bp, Artificial Sequence
  chemically synthesized
aaaattctggaggaccgttagt

SEQ ID NO: 1360215 - DNA, 22 bp, Artificial Sequence
  chemically synthesized
tcactaacggtcctccagaatt

SEQ ID NO: 1360216 - DNA, 22 bp, Artificial Sequence
  chemically synthesized
cactaacggtcctccagaattt

SEQ ID NO: 1360217 - DNA, 22 bp, Artificial Sequence
  chemically synthesized
actaacggtcctccagaatttt

SEQ ID NO: 1360218 - DNA, 22 bp, Artificial Sequence
  chemically synthesized
gagaaatgtctaaaaattctgg

SEQ ID NO: 1360219 - DNA, 22 bp, Artificial Sequence
  chemically synthesized
ttggagaaatgtctaaaaattc

SEQ ID NO: 1360220 - DNA, 22 bp, Artificial Sequence
  chemically synthesized
acggtcctccagaatttttaga

SEQ ID NO: 1360221 - DNA, 22 bp, Artificial Sequence
  chemically synthesized
attggagaaatgtctaaaaatt

SEQ ID NO: 1360222 - DNA, 22 bp, Artificial Sequence
  chemically synthesized
cagaatttttagacatttctcc

SEQ ID NO: 1360223 - DNA, 22 bp, Artificial Sequence
  chemically synthesized
atatagatgcttattggagaaa

SEQ ID NO: 1360224 - DNA, 22 bp, Artificial Sequence
  chemically synthesized
gttaatatagatgcttattgga

SEQ ID NO: 1360225 - DNA, 22 bp, Artificial Sequence
  chemically synthesized
ttagacatttctccaataagca

SEQ ID NO: 1360226 - DNA, 22 bp, Artificial Sequence
  chemically synthesized
agttaatatagatgcttattgg

SEQ ID NO: 1360227 - DNA, 22 bp, Artificial Sequence
  chemically synthesized
tagacatttctccaataagcat

SEQ ID NO: 1360228 - DNA, 22 bp, Artificial Sequence
  chemically synthesized
agacatttctccaataagcatc

SEQ ID NO: 1360229 - DNA, 22 bp, Artificial Sequence
  chemically synthesized
gacatttctccaataagcatct

SEQ ID NO: 1360230 - DNA, 22 bp, Artificial Sequence
  chemically synthesized
gtttagttaatatagatgctta

SEQ ID NO: 1360231 - DNA, 22 bp, Artificial Sequence
  chemically synthesized
ctccaataagcatctatattaa

SEQ ID NO: 1360232 - DNA, 22 bp, Artificial Sequence
  chemically synthesized
atgctagtttagttaatataga

SEQ ID NO: 1360233 - DNA, 22 bp, Artificial Sequence
  chemically synthesized
tccaataagcatctatattaac

SEQ ID NO: 1360234 - DNA, 22 bp, Artificial Sequence
  chemically synthesized
aatgctagtttagttaatatag

SEQ ID NO: 1360235 - DNA, 22 bp, Artificial Sequence
  chemically synthesized
caataagcatctatattaacta

SEQ ID NO: 1360236 - DNA, 22 bp, Artificial Sequence
  chemically synthesized
tttaatgctagtttagttaata

SEQ ID NO: 1360237 - DNA, 22 bp, Artificial Sequence
  chemically synthesized
atttaatgctagtttagttaat

SEQ ID NO: 1360238 - DNA, 22 bp, Artificial Sequence
  chemically synthesized
tatttaatgctagtttagttaa

SEQ ID NO: 1360239 - DNA, 22 bp, Artificial Sequence
  chemically synthesized
cactttatttaatgctagttta

SEQ ID NO: 1360240 - DNA, 22 bp, Artificial Sequence
  chemically synthesized
gcactttatttaatgctagttt

SEQ ID NO: 1360241 - DNA, 22 bp, Artificial Sequence
  chemically synthesized
tattaactaaactagcattaaa

SEQ ID NO: 1360242 - DNA, 22 bp, Artificial Sequence
  chemically synthesized
actaaactagcattaaataaag

SEQ ID NO: 1360243 - DNA, 22 bp, Artificial Sequence
  chemically synthesized
aactagcattaaataaagtgca

SEQ ID NO: 1360244 - DNA, 22 bp, Artificial Sequence
  chemically synthesized
tgacaaggtaagtttgcacttt

SEQ ID NO: 1360245 - DNA, 22 bp, Artificial Sequence
  chemically synthesized
gcattaaataaagtgcaaactt

SEQ ID NO: 1360246 - DNA, 22 bp, Artificial Sequence
  chemically synthesized
catagttatgacaaggtaagtt

SEQ ID NO: 1360247 - DNA, 22 bp, Artificial Sequence
  chemically synthesized
aataaagtgcaaacttaccttg

SEQ ID NO: 1360248 - DNA, 22 bp, Artificial Sequence
  chemically synthesized
gagaatacagaattgcatagtt

SEQ ID NO: 1360249 - DNA, 22 bp, Artificial Sequence
  chemically synthesized
agagaatacagaattgcatagt

SEQ ID NO: 1360250 - DNA, 22 bp, Artificial Sequence
  chemically synthesized
accttgtcataactatgcaatt

SEQ ID NO: 1360251 - DNA, 22 bp, Artificial Sequence
  chemically synthesized
tagagaatacagaattgcatag

SEQ ID NO: 1360252 - DNA, 22 bp, Artificial Sequence
  chemically synthesized
ccttgtcataactatgcaattc

SEQ ID NO: 1360253 - DNA, 22 bp, Artificial Sequence
  chemically synthesized
gtcataactatgcaattctgta

SEQ ID NO: 1360254 - DNA, 22 bp, Artificial Sequence
  chemically synthesized
tcataactatgcaattctgtat

SEQ ID NO: 1360255 - DNA, 22 bp, Artificial Sequence
  chemically synthesized
tgcaattctgtattctctaaag

SEQ ID NO: 1360256 - DNA, 22 bp, Artificial Sequence
  chemically synthesized
agtaatatgaaaaatcatcctt

SEQ ID NO: 1360257 - DNA, 22 bp, Artificial Sequence
  chemically synthesized
tgtattctctaaaggatgattt

SEQ ID NO: 1360258 - DNA, 22 bp, Artificial Sequence
  chemically synthesized
tattctctaaaggatgattttt

SEQ ID NO: 1360259 - DNA, 22 bp, Artificial Sequence
  chemically synthesized
ttgagtaatatgaaaaatcatc

SEQ ID NO: 1360260 - DNA, 22 bp, Artificial Sequence
  chemically synthesized
tctaaaggatgatttttcatat

SEQ ID NO: 1360261 - DNA, 22 bp, Artificial Sequence
  chemically synthesized
taaaggatgatttttcatatta

SEQ ID NO: 1360262 - DNA, 22 bp, Artificial Sequence
  chemically synthesized
aaggatgatttttcatattact

SEQ ID NO: 1360263 - DNA, 22 bp, Artificial Sequence
  chemically synthesized
agtcagaattgttgagtaatat

SEQ ID NO: 1360264 - DNA, 22 bp, Artificial Sequence
  chemically synthesized
ctcagtcagaattgttgagtaa

SEQ ID NO: 1360265 - DNA, 22 bp, Artificial Sequence
  chemically synthesized
aattgctcagtcagaattgttg

SEQ ID NO: 1360266 - DNA, 22 bp, Artificial Sequence
  chemically synthesized
ttcatattactcaacaattctg

SEQ ID NO: 1360267 - DNA, 22 bp, Artificial Sequence
  chemically synthesized
caattgctcagtcagaattgtt

SEQ ID NO: 1360268 - DNA, 22 bp, Artificial Sequence
  chemically synthesized
tcatattactcaacaattctga

SEQ ID NO: 1360269 - DNA, 22 bp, Artificial Sequence
  chemically synthesized
catattactcaacaattctgac

SEQ ID NO: 1360270 - DNA, 22 bp, Artificial Sequence
  chemically synthesized
atattactcaacaattctgact

SEQ ID NO: 1360271 - DNA, 22 bp, Artificial Sequence
  chemically synthesized
aatttcaattgctcagtcagaa

SEQ ID NO: 1360272 - DNA, 22 bp, Artificial Sequence
  chemically synthesized
ctcaacaattctgactgagcaa

SEQ ID NO: 1360273 - DNA, 22 bp, Artificial Sequence
  chemically synthesized
aacaattctgactgagcaattg

SEQ ID NO: 1360274 - DNA, 22 bp, Artificial Sequence
  chemically synthesized
tcatagtctcaatttcaattgc

SEQ ID NO: 1360275 - DNA, 22 bp, Artificial Sequence
  chemically synthesized
atcatagtctcaatttcaattg

SEQ ID NO: 1360276 - DNA, 22 bp, Artificial Sequence
  chemically synthesized
tgactgagcaattgaaattgag

SEQ ID NO: 1360277 - DNA, 22 bp, Artificial Sequence
  chemically synthesized
actgagcaattgaaattgagac

SEQ ID NO: 1360278 - DNA, 22 bp, Artificial Sequence
  chemically synthesized
agcaattgaaattgagactatg

SEQ ID NO: 1360279 - DNA, 22 bp, Artificial Sequence
  chemically synthesized
agtgtaaaacatttatcatagt

SEQ ID NO: 1360280 - DNA, 22 bp, Artificial Sequence
  chemically synthesized
cagtgtaaaacatttatcatag

SEQ ID NO: 1360281 - DNA, 22 bp, Artificial Sequence
  chemically synthesized
aaattgagactatgataaatgt

SEQ ID NO: 1360282 - DNA, 22 bp, Artificial Sequence
  chemically synthesized
agactatgataaatgttttaca

SEQ ID NO: 1360283 - DNA, 22 bp, Artificial Sequence
  chemically synthesized
tgataaatgttttacactgaag

SEQ ID NO: 1360284 - DNA, 22 bp, Artificial Sequence
  chemically synthesized
tataatgaaatgagccttcagt

SEQ ID NO: 1360285 - DNA, 22 bp, Artificial Sequence
  chemically synthesized
ctgtataatgaaatgagccttc

SEQ ID NO: 1360286 - DNA, 22 bp, Artificial Sequence
  chemically synthesized
actactgtataatgaaatgagc

SEQ ID NO: 1360287 - DNA, 22 bp, Artificial Sequence
  chemically synthesized
tacactgaaggctcatttcatt

SEQ ID NO: 1360288 - DNA, 22 bp, Artificial Sequence
  chemically synthesized
acactgaaggctcatttcatta

SEQ ID NO: 1360289 - DNA, 22 bp, Artificial Sequence
  chemically synthesized
cactgaaggctcatttcattat

SEQ ID NO: 1360290 - DNA, 22 bp, Artificial Sequence
  chemically synthesized
aactgactactgtataatgaaa

SEQ ID NO: 1360291 - DNA, 22 bp, Artificial Sequence
  chemically synthesized
caactgactactgtataatgaa

SEQ ID NO: 1360292 - DNA, 22 bp, Artificial Sequence
  chemically synthesized
aaggctcatttcattatacagt

SEQ ID NO: 1360293 - DNA, 22 bp, Artificial Sequence
  chemically synthesized
atttcattatacagtagtcagt

SEQ ID NO: 1360294 - DNA, 22 bp, Artificial Sequence
  chemically synthesized
ggaaaccccatttcaactgact

SEQ ID NO: 1360295 - DNA, 22 bp, Artificial Sequence
  chemically synthesized
cattatacagtagtcagttgaa

SEQ ID NO: 1360296 - DNA, 22 bp, Artificial Sequence
  chemically synthesized
cggaaaccccatttcaactgac

SEQ ID NO: 1360297 - DNA, 22 bp, Artificial Sequence
  chemically synthesized
attatacagtagtcagttgaaa

SEQ ID NO: 1360298 - DNA, 22 bp, Artificial Sequence
  chemically synthesized
ttcggaaaccccatttcaactg

SEQ ID NO: 1360299 - DNA, 22 bp, Artificial Sequence
  chemically synthesized
cttcggaaaccccatttcaact

SEQ ID NO: 1360300 - DNA, 22 bp, Artificial Sequence
  chemically synthesized
tacagtagtcagttgaaatggg

SEQ ID NO: 1360301 - DNA, 22 bp, Artificial Sequence
  chemically synthesized
aaaataccttcttcggaaaccc

SEQ ID NO: 1360302 - DNA, 22 bp, Artificial Sequence
  chemically synthesized
ctaaaaataccttcttcggaaa

SEQ ID NO: 1360303 - DNA, 22 bp, Artificial Sequence
  chemically synthesized
cctaaaaataccttcttcggaa

SEQ ID NO: 1360304 - DNA, 22 bp, Artificial Sequence
  chemically synthesized
aaatggggtttccgaagaaggt

SEQ ID NO: 1360305 - DNA, 22 bp, Artificial Sequence
  chemically synthesized
cacttcctaaaaataccttctt

SEQ ID NO: 1360306 - DNA, 22 bp, Artificial Sequence
  chemically synthesized
tgcacttcctaaaaataccttc

SEQ ID NO: 1360307 - DNA, 22 bp, Artificial Sequence
  chemically synthesized
tactctgcacttcctaaaaata

SEQ ID NO: 1360308 - DNA, 22 bp, Artificial Sequence
  chemically synthesized
ccgaagaaggtatttttaggaa

SEQ ID NO: 1360309 - DNA, 22 bp, Artificial Sequence
  chemically synthesized
cgaagaaggtatttttaggaag

SEQ ID NO: 1360310 - DNA, 22 bp, Artificial Sequence
  chemically synthesized
ctgtactctgcacttcctaaaa

SEQ ID NO: 1360311 - DNA, 22 bp, Artificial Sequence
  chemically synthesized
cctgtactctgcacttcctaaa

SEQ ID NO: 1360312 - DNA, 22 bp, Artificial Sequence
  chemically synthesized
tcctgtactctgcacttcctaa

SEQ ID NO: 1360313 - DNA, 22 bp, Artificial Sequence
  chemically synthesized
ttcctgtactctgcacttccta

SEQ ID NO: 1360314 - DNA, 22 bp, Artificial Sequence
  chemically synthesized
tttcctgtactctgcacttcct

SEQ ID NO: 1360315 - DNA, 22 bp, Artificial Sequence
  chemically synthesized
agctttttcctgtactctgcac

SEQ ID NO: 1360316 - DNA, 22 bp, Artificial Sequence
  chemically synthesized
ttaggaagtgcagagtacagga

SEQ ID NO: 1360317 - DNA, 22 bp, Artificial Sequence
  chemically synthesized
taggaagtgcagagtacaggaa

SEQ ID NO: 1360318 - DNA, 22 bp, Artificial Sequence
  chemically synthesized
aggaagtgcagagtacaggaaa

SEQ ID NO: 1360319 - DNA, 22 bp, Artificial Sequence
  chemically synthesized
ggaagtgcagagtacaggaaaa

SEQ ID NO: 1360320 - DNA, 22 bp, Artificial Sequence
  chemically synthesized
tataacgtattcagctttttcc

SEQ ID NO: 1360321 - DNA, 22 bp, Artificial Sequence
  chemically synthesized
aattgtataacgtattcagctt

SEQ ID NO: 1360322 - DNA, 22 bp, Artificial Sequence
  chemically synthesized
aaattgtataacgtattcagct

SEQ ID NO: 1360323 - DNA, 22 bp, Artificial Sequence
  chemically synthesized
aataaatatttaaattgtataa

SEQ ID NO: 1360324 - DNA, 22 bp, Artificial Sequence
  chemically synthesized
caataaatatttaaattgtata

SEQ ID NO: 1360325 - DNA, 22 bp, Artificial Sequence
  chemically synthesized
aatacgttatacaatttaaata

SEQ ID NO: 1360326 - DNA, 22 bp, Artificial Sequence
  chemically synthesized
gtagaaaagcttcaataaatat

SEQ ID NO: 1360327 - DNA, 22 bp, Artificial Sequence
  chemically synthesized
agtagaaaagcttcaataaata

SEQ ID NO: 1360328 - DNA, 22 bp, Artificial Sequence
  chemically synthesized
tacaatttaaatatttattgaa

SEQ ID NO: 1360329 - DNA, 22 bp, Artificial Sequence
  chemically synthesized
ccttagtagaaaagcttcaata

SEQ ID NO: 1360330 - DNA, 22 bp, Artificial Sequence
  chemically synthesized
aaatatttattgaagcttttct

SEQ ID NO: 1360331 - DNA, 22 bp, Artificial Sequence
  chemically synthesized
aatatttattgaagcttttcta

SEQ ID NO: 1360332 - DNA, 22 bp, Artificial Sequence
  chemically synthesized
ccaaaatgttgccttagtagaa

SEQ ID NO: 1360333 - DNA, 22 bp, Artificial Sequence
  chemically synthesized
attgaagcttttctactaaggc

SEQ ID NO: 1360334 - DNA, 22 bp, Artificial Sequence
  chemically synthesized
ttgaagcttttctactaaggca

SEQ ID NO: 1360335 - DNA, 22 bp, Artificial Sequence
  chemically synthesized
aagcttttctactaaggcaaca

SEQ ID NO: 1360336 - DNA, 22 bp, Artificial Sequence
  chemically synthesized
tgaatattaccaaaatgttgcc

SEQ ID NO: 1360337 - DNA, 22 bp, Artificial Sequence
  chemically synthesized
tgtgaatattaccaaaatgttg

SEQ ID NO: 1360338 - DNA, 22 bp, Artificial Sequence
  chemically synthesized
ttctactaaggcaacattttgg

SEQ ID NO: 1360339 - DNA, 22 bp, Artificial Sequence
  chemically synthesized
ctgtgaatattaccaaaatgtt

SEQ ID NO: 1360340 - DNA, 22 bp, Artificial Sequence
  chemically synthesized
tctactaaggcaacattttggt

SEQ ID NO: 1360341 - DNA, 22 bp, Artificial Sequence
  chemically synthesized
ctactaaggcaacattttggta

SEQ ID NO: 1360342 - DNA, 22 bp, Artificial Sequence
  chemically synthesized
tactaaggcaacattttggtaa

SEQ ID NO: 1360343 - DNA, 22 bp, Artificial Sequence
  chemically synthesized
tttctgtgaatattaccaaaat

SEQ ID NO: 1360344 - DNA, 22 bp, Artificial Sequence
  chemically synthesized
ctaaggcaacattttggtaata

SEQ ID NO: 1360345 - DNA, 22 bp, Artificial Sequence
  chemically synthesized
ctatttctgtgaatattaccaa

SEQ ID NO: 1360346 - DNA, 22 bp, Artificial Sequence
  chemically synthesized
aggcaacattttggtaatattc

SEQ ID NO: 1360347 - DNA, 22 bp, Artificial Sequence
  chemically synthesized
ccatattgctatttctgtgaat

SEQ ID NO: 1360348 - DNA, 22 bp, Artificial Sequence
  chemically synthesized
ctcccatattgctatttctgtg

SEQ ID NO: 1360349 - DNA, 22 bp, Artificial Sequence
  chemically synthesized
cctcccatattgctatttctgt

SEQ ID NO: 1360350 - DNA, 22 bp, Artificial Sequence
  chemically synthesized
tggtaatattcacagaaatagc

SEQ ID NO: 1360351 - DNA, 22 bp, Artificial Sequence
  chemically synthesized
ggtaatattcacagaaatagca

SEQ ID NO: 1360352 - DNA, 22 bp, Artificial Sequence
  chemically synthesized
gtaatattcacagaaatagcaa

SEQ ID NO: 1360353 - DNA, 22 bp, Artificial Sequence
  chemically synthesized
atttcctcccatattgctattt

SEQ ID NO: 1360354 - DNA, 22 bp, Artificial Sequence
  chemically synthesized
cccctaatttcctcccatattg

SEQ ID NO: 1360355 - DNA, 22 bp, Artificial Sequence
  chemically synthesized
acccctaatttcctcccatatt

SEQ ID NO: 1360356 - DNA, 22 bp, Artificial Sequence
  chemically synthesized
acagaaatagcaatatgggagg

SEQ ID NO: 1360357 - DNA, 22 bp, Artificial Sequence
  chemically synthesized
tttacccctaatttcctcccat

SEQ ID NO: 1360358 - DNA, 22 bp, Artificial Sequence
  chemically synthesized
ccatctatttacccctaatttc

SEQ ID NO: 1360359 - DNA, 22 bp, Artificial Sequence
  chemically synthesized
taccatctatttacccctaatt

SEQ ID NO: 1360360 - DNA, 22 bp, Artificial Sequence
  chemically synthesized
cacagtctctaccatctattta

SEQ ID NO: 1360361 - DNA, 22 bp, Artificial Sequence
  chemically synthesized
ccacagtctctaccatctattt

SEQ ID NO: 1360362 - DNA, 22 bp, Artificial Sequence
  chemically synthesized
gtttccacagtctctaccatct

SEQ ID NO: 1360363 - DNA, 22 bp, Artificial Sequence
  chemically synthesized
ggtttccacagtctctaccatc

SEQ ID NO: 1360364 - DNA, 22 bp, Artificial Sequence
  chemically synthesized
ggggtaaatagatggtagagac

SEQ ID NO: 1360365 - DNA, 22 bp, Artificial Sequence
  chemically synthesized
ggtgtcttggtttccacagtct

SEQ ID NO: 1360366 - DNA, 22 bp, Artificial Sequence
  chemically synthesized
gcattaggtgtcttggtttcca

SEQ ID NO: 1360367 - DNA, 22 bp, Artificial Sequence
  chemically synthesized
agcattaggtgtcttggtttcc

SEQ ID NO: 1360368 - DNA, 22 bp, Artificial Sequence
  chemically synthesized
tagcattaggtgtcttggtttc

SEQ ID NO: 1360369 - DNA, 22 bp, Artificial Sequence
  chemically synthesized
ttagcattaggtgtcttggttt

SEQ ID NO: 1360370 - DNA, 22 bp, Artificial Sequence
  chemically synthesized
tggaaaccaagacacctaatgc

SEQ ID NO: 1360371 - DNA, 22 bp, Artificial Sequence
  chemically synthesized
atgaatgaggatcccactttta

SEQ ID NO: 1360372 - DNA, 22 bp, Artificial Sequence
  chemically synthesized
catgaatgaggatcccactttt

SEQ ID NO: 1360373 - DNA, 22 bp, Artificial Sequence
  chemically synthesized
atgctaaaagtgggatcctcat

SEQ ID NO: 1360374 - DNA, 22 bp, Artificial Sequence
  chemically synthesized
atgacttcatgaatgaggatcc

SEQ ID NO: 1360375 - DNA, 22 bp, Artificial Sequence
  chemically synthesized
aatgacttcatgaatgaggatc

SEQ ID NO: 1360376 - DNA, 22 bp, Artificial Sequence
  chemically synthesized
aaagtgggatcctcattcatga

SEQ ID NO: 1360377 - DNA, 22 bp, Artificial Sequence
  chemically synthesized
caatttaatgacttcatgaatg

SEQ ID NO: 1360378 - DNA, 22 bp, Artificial Sequence
  chemically synthesized
gatctccaatttaatgacttca

SEQ ID NO: 1360379 - DNA, 22 bp, Artificial Sequence
  chemically synthesized
cgatctccaatttaatgacttc

SEQ ID NO: 1360380 - DNA, 22 bp, Artificial Sequence
  chemically synthesized
tcgatctccaatttaatgactt

SEQ ID NO: 1360381 - DNA, 22 bp, Artificial Sequence
  chemically synthesized
ctttcgatctccaatttaatga

SEQ ID NO: 1360382 - DNA, 22 bp, Artificial Sequence
  chemically synthesized
attcatgaagtcattaaattgg

SEQ ID NO: 1360383 - DNA, 22 bp, Artificial Sequence
  chemically synthesized
ttcctttcgatctccaatttaa

SEQ ID NO: 1360384 - DNA, 22 bp, Artificial Sequence
  chemically synthesized
atgaagtcattaaattggagat

SEQ ID NO: 1360385 - DNA, 22 bp, Artificial Sequence
  chemically synthesized
cataaagaggtctgttcctttc

SEQ ID NO: 1360386 - DNA, 22 bp, Artificial Sequence
  chemically synthesized
aattggagatcgaaaggaacag

SEQ ID NO: 1360387 - DNA, 22 bp, Artificial Sequence
  chemically synthesized
ccataaagaggtctgttccttt

SEQ ID NO: 1360388 - DNA, 22 bp, Artificial Sequence
  chemically synthesized
gagatcgaaaggaacagacctc

SEQ ID NO: 1360389 - DNA, 22 bp, Artificial Sequence
  chemically synthesized
aggaaaataatatttccataaa

SEQ ID NO: 1360390 - DNA, 22 bp, Artificial Sequence
  chemically synthesized
taaggaaaataatatttccata

SEQ ID NO: 1360391 - DNA, 22 bp, Artificial Sequence
  chemically synthesized
tttatggaaatattattttcct

SEQ ID NO: 1360392 - DNA, 22 bp, Artificial Sequence
  chemically synthesized
tatggaaatattattttcctta

SEQ ID NO: 1360393 - DNA, 22 bp, Artificial Sequence
  chemically synthesized
atggaaatattattttccttag

SEQ ID NO: 1360394 - DNA, 22 bp, Artificial Sequence
  chemically synthesized
tggaaatattattttccttaga

SEQ ID NO: 1360395 - DNA, 22 bp, Artificial Sequence
  chemically synthesized
gaaaaaatgatgaaattctaag

SEQ ID NO: 1360396 - DNA, 22 bp, Artificial Sequence
  chemically synthesized
ttttccttagaatttcatcatt

SEQ ID NO: 1360397 - DNA, 22 bp, Artificial Sequence
  chemically synthesized
tccttagaatttcatcattttt

SEQ ID NO: 1360398 - DNA, 22 bp, Artificial Sequence
  chemically synthesized
ccttagaatttcatcatttttt

SEQ ID NO: 1360399 - DNA, 22 bp, Artificial Sequence
  chemically synthesized
cttagaatttcatcattttttc

SEQ ID NO: 1360400 - DNA, 22 bp, Artificial Sequence
  chemically synthesized
agaatttcatcattttttctag

SEQ ID NO: 1360401 - DNA, 22 bp, Artificial Sequence
  chemically synthesized
gaatttcatcattttttctaga

SEQ ID NO: 1360402 - DNA, 22 bp, Artificial Sequence
  chemically synthesized
catcattttttctagatgtgtc

SEQ ID NO: 1360403 - DNA, 22 bp, Artificial Sequence
  chemically synthesized
atcattttttctagatgtgtct

SEQ ID NO: 1360404 - DNA, 22 bp, Artificial Sequence
  chemically synthesized
aaaaaaaaaaatcagagaagac

SEQ ID NO: 1360405 - DNA, 22 bp, Artificial Sequence
  chemically synthesized
tttctagatgtgtcttctctga

SEQ ID NO: 1360406 - DNA, 22 bp, Artificial Sequence
  chemically synthesized
ttctagatgtgtcttctctgat

SEQ ID NO: 1360407 - DNA, 22 bp, Artificial Sequence
  chemically synthesized
tctagatgtgtcttctctgatt

SEQ ID NO: 1360408 - DNA, 22 bp, Artificial Sequence
  chemically synthesized
ctagatgtgtcttctctgattt

SEQ ID NO: 1360409 - DNA, 22 bp, Artificial Sequence
  chemically synthesized
tagatgtgtcttctctgatttt

SEQ ID NO: 1360410 - DNA, 22 bp, Artificial Sequence
  chemically synthesized
gatgtgtcttctctgatttttt

SEQ ID NO: 1360411 - DNA, 22 bp, Artificial Sequence
  chemically synthesized
ctctgattttttttttttagtg

SEQ ID NO: 1360412 - DNA, 22 bp, Artificial Sequence
  chemically synthesized
tctgattttttttttttagtgc

SEQ ID NO: 1360413 - DNA, 22 bp, Artificial Sequence
  chemically synthesized
tgattttttttttttagtgctt

SEQ ID NO: 1360414 - DNA, 22 bp, Artificial Sequence
  chemically synthesized
attttttttttttagtgctttt

SEQ ID NO: 1360415 - DNA, 22 bp, Artificial Sequence
  chemically synthesized
aataaagaagacaaaagcacta

SEQ ID NO: 1360416 - DNA, 22 bp, Artificial Sequence
  chemically synthesized
tttttttttagtgcttttgtct

SEQ ID NO: 1360417 - DNA, 22 bp, Artificial Sequence
  chemically synthesized
ttttttttagtgcttttgtctt

SEQ ID NO: 1360418 - DNA, 22 bp, Artificial Sequence
  chemically synthesized
tttttttagtgcttttgtcttc

SEQ ID NO: 1360419 - DNA, 22 bp, Artificial Sequence
  chemically synthesized
ttttttagtgcttttgtcttct

SEQ ID NO: 1360420 - DNA, 22 bp, Artificial Sequence
  chemically synthesized
tttttagtgcttttgtcttctt

SEQ ID NO: 1360421 - DNA, 22 bp, Artificial Sequence
  chemically synthesized
ttttagtgcttttgtcttcttt

SEQ ID NO: 1360422 - DNA, 22 bp, Artificial Sequence
  chemically synthesized
tttagtgcttttgtcttcttta

SEQ ID NO: 1360423 - DNA, 22 bp, Artificial Sequence
  chemically synthesized
ttagtgcttttgtcttctttat

SEQ ID NO: 1360424 - DNA, 22 bp, Artificial Sequence
  chemically synthesized
tagtgcttttgtcttctttatt

SEQ ID NO: 1360425 - DNA, 22 bp, Artificial Sequence
  chemically synthesized
agtgcttttgtcttctttattg

SEQ ID NO: 1360426 - DNA, 22 bp, Artificial Sequence
  chemically synthesized
gtgcttttgtcttctttattga

SEQ ID NO: 1360427 - DNA, 22 bp, Artificial Sequence
  chemically synthesized
ttgtcttctttattgaatttcc

SEQ ID NO: 1360428 - DNA, 22 bp, Artificial Sequence
  chemically synthesized
tgtcttctttattgaatttccg

SEQ ID NO: 1360429 - DNA, 22 bp, Artificial Sequence
  chemically synthesized
gtcttctttattgaatttccga

SEQ ID NO: 1360430 - DNA, 22 bp, Artificial Sequence
  chemically synthesized
tcttctttattgaatttccgat

SEQ ID NO: 1360431 - DNA, 22 bp, Artificial Sequence
  chemically synthesized
ctttattgaatttccgatctcc

SEQ ID NO: 1360432 - DNA, 22 bp, Artificial Sequence
  chemically synthesized
tttattgaatttccgatctcct

SEQ ID NO: 1360433 - DNA, 22 bp, Artificial Sequence
  chemically synthesized
tattgaatttccgatctcctct

SEQ ID NO: 1360434 - DNA, 22 bp, Artificial Sequence
  chemically synthesized
attgaatttccgatctcctctt

SEQ ID NO: 1360435 - DNA, 22 bp, Artificial Sequence
  chemically synthesized
ttgaatttccgatctcctcttc

SEQ ID NO: 1360436 - DNA, 22 bp, Artificial Sequence
  chemically synthesized
aatttccgatctcctcttcaca

SEQ ID NO: 1360437 - DNA, 22 bp, Artificial Sequence
  chemically synthesized
gaaagataatagagtgtgaaga

SEQ ID NO: 1360438 - DNA, 22 bp, Artificial Sequence
  chemically synthesized
ccgatctcctcttcacactcta

SEQ ID NO: 1360439 - DNA, 22 bp, Artificial Sequence
  chemically synthesized
cgatctcctcttcacactctat

SEQ ID NO: 1360440 - DNA, 22 bp, Artificial Sequence
  chemically synthesized
ctcttcacactctattatcttt

SEQ ID NO: 1360441 - DNA, 22 bp, Artificial Sequence
  chemically synthesized
ttcacactctattatctttcta

SEQ ID NO: 1360442 - DNA, 22 bp, Artificial Sequence
  chemically synthesized
cacactctattatctttctagc

SEQ ID NO: 1360443 - DNA, 22 bp, Artificial Sequence
  chemically synthesized
acactctattatctttctagct

SEQ ID NO: 1360444 - DNA, 22 bp, Artificial Sequence
  chemically synthesized
atggagtggatgagaccagcta

SEQ ID NO: 1360445 - DNA, 22 bp, Artificial Sequence
  chemically synthesized
tattatctttctagctggtctc

SEQ ID NO: 1360446 - DNA, 22 bp, Artificial Sequence
  chemically synthesized
ttatctttctagctggtctcat

SEQ ID NO: 1360447 - DNA, 22 bp, Artificial Sequence
  chemically synthesized
tctttctagctggtctcatcca

SEQ ID NO: 1360448 - DNA, 22 bp, Artificial Sequence
  chemically synthesized
tctagctggtctcatccactcc

SEQ ID NO: 1360449 - DNA, 22 bp, Artificial Sequence
  chemically synthesized
ctagctggtctcatccactcca

SEQ ID NO: 1360450 - DNA, 22 bp, Artificial Sequence
  chemically synthesized
tagctggtctcatccactccat

SEQ ID NO: 1360451 - DNA, 22 bp, Artificial Sequence
  chemically synthesized
aatatgcaactcatggagtgga

SEQ ID NO: 1360452 - DNA, 22 bp, Artificial Sequence
  chemically synthesized
aaatatgcaactcatggagtgg

SEQ ID NO: 1360453 - DNA, 22 bp, Artificial Sequence
  chemically synthesized
gctggtctcatccactccatga

SEQ ID NO: 1360454 - DNA, 22 bp, Artificial Sequence
  chemically synthesized
gtctcatccactccatgagttg

SEQ ID NO: 1360455 - DNA, 22 bp, Artificial Sequence
  chemically synthesized
gggatttaaatatgcaactcat

SEQ ID NO: 1360456 - DNA, 22 bp, Artificial Sequence
  chemically synthesized
atccactccatgagttgcatat

SEQ ID NO: 1360457 - DNA, 22 bp, Artificial Sequence
  chemically synthesized
ttagggatttaaatatgcaact

SEQ ID NO: 1360458 - DNA, 22 bp, Artificial Sequence
  chemically synthesized
catgagttgcatatttaaatcc

SEQ ID NO: 1360459 - DNA, 22 bp, Artificial Sequence
  chemically synthesized
gaaatgaagtcattattaggga

SEQ ID NO: 1360460 - DNA, 22 bp, Artificial Sequence
  chemically synthesized
catatttaaatccctaataatg

SEQ ID NO: 1360461 - DNA, 22 bp, Artificial Sequence
  chemically synthesized
tgcctagaaatgaagtcattat

SEQ ID NO: 1360462 - DNA, 22 bp, Artificial Sequence
  chemically synthesized
aaatccctaataatgacttcat

SEQ ID NO: 1360463 - DNA, 22 bp, Artificial Sequence
  chemically synthesized
aatccctaataatgacttcatt

SEQ ID NO: 1360464 - DNA, 22 bp, Artificial Sequence
  chemically synthesized
ataatgacttcatttctaggca

SEQ ID NO: 1360465 - DNA, 22 bp, Artificial Sequence
  chemically synthesized
tgtagcgcgtgggtattgtgcc

SEQ ID NO: 1360466 - DNA, 22 bp, Artificial Sequence
  chemically synthesized
atgtagcgcgtgggtattgtgc

SEQ ID NO: 1360467 - DNA, 22 bp, Artificial Sequence
  chemically synthesized
tatgtagcgcgtgggtattgtg

SEQ ID NO: 1360468 - DNA, 22 bp, Artificial Sequence
  chemically synthesized
ttatgtagcgcgtgggtattgt

SEQ ID NO: 1360469 - DNA, 22 bp, Artificial Sequence
  chemically synthesized
catttctaggcacaatacccac

SEQ ID NO: 1360470 - DNA, 22 bp, Artificial Sequence
  chemically synthesized
atttctaggcacaatacccacg

SEQ ID NO: 1360471 - DNA, 22 bp, Artificial Sequence
  chemically synthesized
tatttttatgtagcgcgtgggt

SEQ ID NO: 1360472 - DNA, 22 bp, Artificial Sequence
  chemically synthesized
ctaggcacaatacccacgcgct

SEQ ID NO: 1360473 - DNA, 22 bp, Artificial Sequence
  chemically synthesized
gtatttttatgtagcgcgtggg

SEQ ID NO: 1360474 - DNA, 22 bp, Artificial Sequence
  chemically synthesized
taggcacaatacccacgcgcta

SEQ ID NO: 1360475 - DNA, 22 bp, Artificial Sequence
  chemically synthesized
tgtatttttatgtagcgcgtgg

SEQ ID NO: 1360476 - DNA, 22 bp, Artificial Sequence
  chemically synthesized
ggcacaatacccacgcgctaca

SEQ ID NO: 1360477 - DNA, 22 bp, Artificial Sequence
  chemically synthesized
ttttgtatttttatgtagcgcg

SEQ ID NO: 1360478 - DNA, 22 bp, Artificial Sequence
  chemically synthesized
gttttgtatttttatgtagcgc

SEQ ID NO: 1360479 - DNA, 22 bp, Artificial Sequence
  chemically synthesized
tgttttgtatttttatgtagcg

SEQ ID NO: 1360480 - DNA, 22 bp, Artificial Sequence
  chemically synthesized
ttttgttttgtatttttatgta

SEQ ID NO: 1360481 - DNA, 22 bp, Artificial Sequence
  chemically synthesized
gttttgttttgtatttttatgt

SEQ ID NO: 1360482 - DNA, 22 bp, Artificial Sequence
  chemically synthesized
aggtgtttgttttgttttgtat

SEQ ID NO: 1360483 - DNA, 22 bp, Artificial Sequence
  chemically synthesized
cataaaaatacaaaacaaaaca

SEQ ID NO: 1360484 - DNA, 22 bp, Artificial Sequence
  chemically synthesized
ggggtgtggatgctaaggtgtt

SEQ ID NO: 1360485 - DNA, 22 bp, Artificial Sequence
  chemically synthesized
gaacaacaggaaggattagggg

SEQ ID NO: 1360486 - DNA, 22 bp, Artificial Sequence
  chemically synthesized
agcatccacacccctaatcctt

SEQ ID NO: 1360487 - DNA, 22 bp, Artificial Sequence
  chemically synthesized
gcatccacacccctaatccttc

SEQ ID NO: 1360488 - DNA, 22 bp, Artificial Sequence
  chemically synthesized
gaagggaaattggaacaacagg

SEQ ID NO: 1360489 - DNA, 22 bp, Artificial Sequence
  chemically synthesized
atccttcctgttgttccaattt

SEQ ID NO: 1360490 - DNA, 22 bp, Artificial Sequence
  chemically synthesized
caaggagattggaagggaaatt

SEQ ID NO: 1360491 - DNA, 22 bp, Artificial Sequence
  chemically synthesized
cctgttgttccaatttcccttc

SEQ ID NO: 1360492 - DNA, 22 bp, Artificial Sequence
  chemically synthesized
gcaaggagattggaagggaaat

SEQ ID NO: 1360493 - DNA, 22 bp, Artificial Sequence
  chemically synthesized
ctgttgttccaatttcccttcc

SEQ ID NO: 1360494 - DNA, 22 bp, Artificial Sequence
  chemically synthesized
ttgttccaatttcccttccaat

SEQ ID NO: 1360495 - DNA, 22 bp, Artificial Sequence
  chemically synthesized
ttccaatttcccttccaatctc

SEQ ID NO: 1360496 - DNA, 22 bp, Artificial Sequence
  chemically synthesized
caatttcccttccaatctcctt

SEQ ID NO: 1360497 - DNA, 22 bp, Artificial Sequence
  chemically synthesized
cccttccaatctccttgcaaat

SEQ ID NO: 1360498 - DNA, 22 bp, Artificial Sequence
  chemically synthesized
ccttccaatctccttgcaaatg

SEQ ID NO: 1360499 - DNA, 22 bp, Artificial Sequence
  chemically synthesized
ggtggataatggtgccatttgc

SEQ ID NO: 1360500 - DNA, 22 bp, Artificial Sequence
  chemically synthesized
ccaatctccttgcaaatggcac

SEQ ID NO: 1360501 - DNA, 22 bp, Artificial Sequence
  chemically synthesized
caatctccttgcaaatggcacc

SEQ ID NO: 1360502 - DNA, 22 bp, Artificial Sequence
  chemically synthesized
cttgcaaatggcaccattatcc

SEQ ID NO: 1360503 - DNA, 22 bp, Artificial Sequence
  chemically synthesized
gcaaatggcaccattatccacc

SEQ ID NO: 1360504 - DNA, 22 bp, Artificial Sequence
  chemically synthesized
caaatggcaccattatccaccc

SEQ ID NO: 1360505 - DNA, 22 bp, Artificial Sequence
  chemically synthesized
catgaaatgcacacctgggtgg

SEQ ID NO: 1360506 - DNA, 22 bp, Artificial Sequence
  chemically synthesized
tgtgctccatgaaatgcacacc

SEQ ID NO: 1360507 - DNA, 22 bp, Artificial Sequence
  chemically synthesized
tccacccaggtgtgcatttcat

SEQ ID NO: 1360508 - DNA, 22 bp, Artificial Sequence
  chemically synthesized
catgctgtgtgctccatgaaat

SEQ ID NO: 1360509 - DNA, 22 bp, Artificial Sequence
  chemically synthesized
tattgcatgctgtgtgctccat

SEQ ID NO: 1360510 - DNA, 22 bp, Artificial Sequence
  chemically synthesized
gtgttgtattgcatgctgtgtg

SEQ ID NO: 1360511 - DNA, 22 bp, Artificial Sequence
  chemically synthesized
catggagcacacagcatgcaat

SEQ ID NO: 1360512 - DNA, 22 bp, Artificial Sequence
  chemically synthesized
atggagcacacagcatgcaata

SEQ ID NO: 1360513 - DNA, 22 bp, Artificial Sequence
  chemically synthesized
tatatgagatagaatcaatagg

SEQ ID NO: 1360514 - DNA, 22 bp, Artificial Sequence
  chemically synthesized
gtatatgagatagaatcaatag

SEQ ID NO: 1360515 - DNA, 22 bp, Artificial Sequence
  chemically synthesized
aagatttgtatatgagatagaa

SEQ ID NO: 1360516 - DNA, 22 bp, Artificial Sequence
  chemically synthesized
ttcaagatttgtatatgagata

SEQ ID NO: 1360517 - DNA, 22 bp, Artificial Sequence
  chemically synthesized
ctattgattctatctcatatac

SEQ ID NO: 1360518 - DNA, 22 bp, Artificial Sequence
  chemically synthesized
ttgattctatctcatatacaaa

SEQ ID NO: 1360519 - DNA, 22 bp, Artificial Sequence
  chemically synthesized
attctatctcatatacaaatct

SEQ ID NO: 1360520 - DNA, 22 bp, Artificial Sequence
  chemically synthesized
tatctcatatacaaatcttgaa

SEQ ID NO: 1360521 - DNA, 22 bp, Artificial Sequence
  chemically synthesized
tctcatatacaaatcttgaata

SEQ ID NO: 1360522 - DNA, 22 bp, Artificial Sequence
  chemically synthesized
atatacaaatcttgaatagatt

SEQ ID NO: 1360523 - DNA, 22 bp, Artificial Sequence
  chemically synthesized
gaatagatttacttctttcatc

SEQ ID NO: 1360524 - DNA, 22 bp, Artificial Sequence
  chemically synthesized
aatagatttacttctttcatct

SEQ ID NO: 1360525 - DNA, 22 bp, Artificial Sequence
  chemically synthesized
gaatggggacagtggagatgaa

SEQ ID NO: 1360526 - DNA, 22 bp, Artificial Sequence
  chemically synthesized
gactagaatggggacagtggag

SEQ ID NO: 1360527 - DNA, 22 bp, Artificial Sequence
  chemically synthesized
acttctttcatctccactgtcc

SEQ ID NO: 1360528 - DNA, 22 bp, Artificial Sequence
  chemically synthesized
ggactagaatggggacagtgga

SEQ ID NO: 1360529 - DNA, 22 bp, Artificial Sequence
  chemically synthesized
cttctttcatctccactgtccc

SEQ ID NO: 1360530 - DNA, 22 bp, Artificial Sequence
  chemically synthesized
ctttcatctccactgtccccat

SEQ ID NO: 1360531 - DNA, 22 bp, Artificial Sequence
  chemically synthesized
tttcatctccactgtccccatt

SEQ ID NO: 1360532 - DNA, 22 bp, Artificial Sequence
  chemically synthesized
tcatctccactgtccccattct

SEQ ID NO: 1360533 - DNA, 22 bp, Artificial Sequence
  chemically synthesized
catctccactgtccccattcta

SEQ ID NO: 1360534 - DNA, 22 bp, Artificial Sequence
  chemically synthesized
atctccactgtccccattctag

SEQ ID NO: 1360535 - DNA, 22 bp, Artificial Sequence
  chemically synthesized
cactgtccccattctagtccaa

SEQ ID NO: 1360536 - DNA, 22 bp, Artificial Sequence
  chemically synthesized
tccccattctagtccaaatcac

SEQ ID NO: 1360537 - DNA, 22 bp, Artificial Sequence
  chemically synthesized
atccaaaagaaggtgatttgga

SEQ ID NO: 1360538 - DNA, 22 bp, Artificial Sequence
  chemically synthesized
tagtccaaatcaccttcttttg

SEQ ID NO: 1360539 - DNA, 22 bp, Artificial Sequence
  chemically synthesized
cggtagctcatccaaaagaagg

SEQ ID NO: 1360540 - DNA, 22 bp, Artificial Sequence
  chemically synthesized
gtccaaatcaccttcttttgga

SEQ ID NO: 1360541 - DNA, 22 bp, Artificial Sequence
  chemically synthesized
aagcaattacggtagctcatcc

SEQ ID NO: 1360542 - DNA, 22 bp, Artificial Sequence
  chemically synthesized
cttttggatgagctaccgtaat

SEQ ID NO: 1360543 - DNA, 22 bp, Artificial Sequence
  chemically synthesized
ttttggatgagctaccgtaatt

SEQ ID NO: 1360544 - DNA, 22 bp, Artificial Sequence
  chemically synthesized
tcaatctgaagcaattacggta

SEQ ID NO: 1360545 - DNA, 22 bp, Artificial Sequence
  chemically synthesized
ttggatgagctaccgtaattgc

SEQ ID NO: 1360546 - DNA, 22 bp, Artificial Sequence
  chemically synthesized
tggatgagctaccgtaattgct

SEQ ID NO: 1360547 - DNA, 22 bp, Artificial Sequence
  chemically synthesized
ggatgagctaccgtaattgctt

SEQ ID NO: 1360548 - DNA, 22 bp, Artificial Sequence
  chemically synthesized
gatgagctaccgtaattgcttc

SEQ ID NO: 1360549 - DNA, 22 bp, Artificial Sequence
  chemically synthesized
ccgtaattgcttcagattgata

SEQ ID NO: 1360550 - DNA, 22 bp, Artificial Sequence
  chemically synthesized
gggtagatgaaggactatcaat

SEQ ID NO: 1360551 - DNA, 22 bp, Artificial Sequence
  chemically synthesized
cttcagattgatagtccttcat

SEQ ID NO: 1360552 - DNA, 22 bp, Artificial Sequence
  chemically synthesized
cagattgatagtccttcatcta

SEQ ID NO: 1360553 - DNA, 22 bp, Artificial Sequence
  chemically synthesized
agattgatagtccttcatctac

SEQ ID NO: 1360554 - DNA, 22 bp, Artificial Sequence
  chemically synthesized
gcaagtgcctagggtagatgaa

SEQ ID NO: 1360555 - DNA, 22 bp, Artificial Sequence
  chemically synthesized
atagtccttcatctaccctagg

SEQ ID NO: 1360556 - DNA, 22 bp, Artificial Sequence
  chemically synthesized
catctaccctaggcacttgcca

SEQ ID NO: 1360557 - DNA, 22 bp, Artificial Sequence
  chemically synthesized
tgtgaaagagattggcaagtgc

SEQ ID NO: 1360558 - DNA, 22 bp, Artificial Sequence
  chemically synthesized
atctaccctaggcacttgccaa

SEQ ID NO: 1360559 - DNA, 22 bp, Artificial Sequence
  chemically synthesized
gtgtgaaagagattggcaagtg

SEQ ID NO: 1360560 - DNA, 22 bp, Artificial Sequence
  chemically synthesized
tgtgtgaaagagattggcaagt

SEQ ID NO: 1360561 - DNA, 22 bp, Artificial Sequence
  chemically synthesized
ttttgtgtgaaagagattggca

SEQ ID NO: 1360562 - DNA, 22 bp, Artificial Sequence
  chemically synthesized
ccctaggcacttgccaatctct

SEQ ID NO: 1360563 - DNA, 22 bp, Artificial Sequence
  chemically synthesized
tgttttgtgtgaaagagattgg

SEQ ID NO: 1360564 - DNA, 22 bp, Artificial Sequence
  chemically synthesized
ggcacttgccaatctctttcac

SEQ ID NO: 1360565 - DNA, 22 bp, Artificial Sequence
  chemically synthesized
tcactctgttttgtgtgaaaga

SEQ ID NO: 1360566 - DNA, 22 bp, Artificial Sequence
  chemically synthesized
gccaatctctttcacacaaaac

SEQ ID NO: 1360567 - DNA, 22 bp, Artificial Sequence
  chemically synthesized
ccaatctctttcacacaaaaca

SEQ ID NO: 1360568 - DNA, 22 bp, Artificial Sequence
  chemically synthesized
agactatcactctgttttgtgt

SEQ ID NO: 1360569 - DNA, 22 bp, Artificial Sequence
  chemically synthesized
aagactatcactctgttttgtg

SEQ ID NO: 1360570 - DNA, 22 bp, Artificial Sequence
  chemically synthesized
taagactatcactctgttttgt

SEQ ID NO: 1360571 - DNA, 22 bp, Artificial Sequence
  chemically synthesized
ttaagactatcactctgttttg

SEQ ID NO: 1360572 - DNA, 22 bp, Artificial Sequence
  chemically synthesized
tttaagactatcactctgtttt

SEQ ID NO: 1360573 - DNA, 22 bp, Artificial Sequence
  chemically synthesized
tttcacacaaaacagagtgata

SEQ ID NO: 1360574 - DNA, 22 bp, Artificial Sequence
  chemically synthesized
tattttttaagactatcactct

SEQ ID NO: 1360575 - DNA, 22 bp, Artificial Sequence
  chemically synthesized
tcacacaaaacagagtgatagt

SEQ ID NO: 1360576 - DNA, 22 bp, Artificial Sequence
  chemically synthesized
gtattttttaagactatcactc

SEQ ID NO: 1360577 - DNA, 22 bp, Artificial Sequence
  chemically synthesized
cacacaaaacagagtgatagtc

SEQ ID NO: 1360578 - DNA, 22 bp, Artificial Sequence
  chemically synthesized
acacaaaacagagtgatagtct

SEQ ID NO: 1360579 - DNA, 22 bp, Artificial Sequence
  chemically synthesized
atgtaaacatatttgtattttt

SEQ ID NO: 1360580 - DNA, 22 bp, Artificial Sequence
  chemically synthesized
aaaaaatacaaatatgtttaca

SEQ ID NO: 1360581 - DNA, 22 bp, Artificial Sequence
  chemically synthesized
aaaaatacaaatatgtttacat

SEQ ID NO: 1360582 - DNA, 22 bp, Artificial Sequence
  chemically synthesized
aggtagaaaactgatgtaaaca

SEQ ID NO: 1360583 - DNA, 22 bp, Artificial Sequence
  chemically synthesized
caggtagaaaactgatgtaaac

SEQ ID NO: 1360584 - DNA, 22 bp, Artificial Sequence
  chemically synthesized
tgggtttcaggtagaaaactga

SEQ ID NO: 1360585 - DNA, 22 bp, Artificial Sequence
  chemically synthesized
atgggtttcaggtagaaaactg

SEQ ID NO: 1360586 - DNA, 22 bp, Artificial Sequence
  chemically synthesized
acatcagttttctacctgaaac

SEQ ID NO: 1360587 - DNA, 22 bp, Artificial Sequence
  chemically synthesized
catcagttttctacctgaaacc

SEQ ID NO: 1360588 - DNA, 22 bp, Artificial Sequence
  chemically synthesized
tctacctgaaacccataaggct

SEQ ID NO: 1360589 - DNA, 22 bp, Artificial Sequence
  chemically synthesized
agatcaatggacagccttatgg

SEQ ID NO: 1360590 - DNA, 22 bp, Artificial Sequence
  chemically synthesized
ctacctgaaacccataaggctg

SEQ ID NO: 1360591 - DNA, 22 bp, Artificial Sequence
  chemically synthesized
tacctgaaacccataaggctgt

SEQ ID NO: 1360592 - DNA, 22 bp, Artificial Sequence
  chemically synthesized
cctgaaacccataaggctgtcc

SEQ ID NO: 1360593 - DNA, 22 bp, Artificial Sequence
  chemically synthesized
tactaagatcaatggacagcct

SEQ ID NO: 1360594 - DNA, 22 bp, Artificial Sequence
  chemically synthesized
atactaagatcaatggacagcc

SEQ ID NO: 1360595 - DNA, 22 bp, Artificial Sequence
  chemically synthesized
tatactaagatcaatggacagc

SEQ ID NO: 1360596 - DNA, 22 bp, Artificial Sequence
  chemically synthesized
aaacccataaggctgtccattg

SEQ ID NO: 1360597 - DNA, 22 bp, Artificial Sequence
  chemically synthesized
tttatactaagatcaatggaca

SEQ ID NO: 1360598 - DNA, 22 bp, Artificial Sequence
  chemically synthesized
tctttatactaagatcaatgga

SEQ ID NO: 1360599 - DNA, 22 bp, Artificial Sequence
  chemically synthesized
ctctttatactaagatcaatgg

SEQ ID NO: 1360600 - DNA, 22 bp, Artificial Sequence
  chemically synthesized
tctctttatactaagatcaatg

SEQ ID NO: 1360601 - DNA, 22 bp, Artificial Sequence
  chemically synthesized
ttctctttatactaagatcaat

SEQ ID NO: 1360602 - DNA, 22 bp, Artificial Sequence
  chemically synthesized
tttttctctttatactaagatc

SEQ ID NO: 1360603 - DNA, 22 bp, Artificial Sequence
  chemically synthesized
tccattgatcttagtataaaga

SEQ ID NO: 1360604 - DNA, 22 bp, Artificial Sequence
  chemically synthesized
tagaaattatttttctctttat

SEQ ID NO: 1360605 - DNA, 22 bp, Artificial Sequence
  chemically synthesized
atcttagtataaagagaaaaat

SEQ ID NO: 1360606 - DNA, 22 bp, Artificial Sequence
  chemically synthesized
aaggttatagaaattatttttc

SEQ ID NO: 1360607 - DNA, 22 bp, Artificial Sequence
  chemically synthesized
gaaggttatagaaattattttt

SEQ ID NO: 1360608 - DNA, 22 bp, Artificial Sequence
  chemically synthesized
agtataaagagaaaaataattt

SEQ ID NO: 1360609 - DNA, 22 bp, Artificial Sequence
  chemically synthesized
gtataaagagaaaaataatttc

SEQ ID NO: 1360610 - DNA, 22 bp, Artificial Sequence
  chemically synthesized
agagccttgaaggttatagaaa

SEQ ID NO: 1360611 - DNA, 22 bp, Artificial Sequence
  chemically synthesized
gggtccaatcattcagagcctt

SEQ ID NO: 1360612 - DNA, 22 bp, Artificial Sequence
  chemically synthesized
ctataaccttcaaggctctgaa

SEQ ID NO: 1360613 - DNA, 22 bp, Artificial Sequence
  chemically synthesized
tataaccttcaaggctctgaat

SEQ ID NO: 1360614 - DNA, 22 bp, Artificial Sequence
  chemically synthesized
taaccttcaaggctctgaatga

SEQ ID NO: 1360615 - DNA, 22 bp, Artificial Sequence
  chemically synthesized
caaggctctgaatgattggacc

SEQ ID NO: 1360616 - DNA, 22 bp, Artificial Sequence
  chemically synthesized
aaggctctgaatgattggaccc

SEQ ID NO: 1360617 - DNA, 22 bp, Artificial Sequence
  chemically synthesized
aatggccgactggggtccaatc

SEQ ID NO: 1360618 - DNA, 22 bp, Artificial Sequence
  chemically synthesized
catctgaatggccgactggggt

SEQ ID NO: 1360619 - DNA, 22 bp, Artificial Sequence
  chemically synthesized
tgaatgattggaccccagtcgg

SEQ ID NO: 1360620 - DNA, 22 bp, Artificial Sequence
  chemically synthesized
gcatctgaatggccgactgggg

SEQ ID NO: 1360621 - DNA, 22 bp, Artificial Sequence
  chemically synthesized
aatgattggaccccagtcggcc

SEQ ID NO: 1360622 - DNA, 22 bp, Artificial Sequence
  chemically synthesized
gaccccagtcggccattcagat

SEQ ID NO: 1360623 - DNA, 22 bp, Artificial Sequence
  chemically synthesized
agatgcaagcttgttccacact

SEQ ID NO: 1360624 - DNA, 22 bp, Artificial Sequence
  chemically synthesized
gagtacagtgagggcagaaaag

SEQ ID NO: 1360625 - DNA, 22 bp, Artificial Sequence
  chemically synthesized
ctagagtacagtgagggcagaa

SEQ ID NO: 1360626 - DNA, 22 bp, Artificial Sequence
  chemically synthesized
gttccacacttttctgccctca

SEQ ID NO: 1360627 - DNA, 22 bp, Artificial Sequence
  chemically synthesized
cctagagtacagtgagggcaga

SEQ ID NO: 1360628 - DNA, 22 bp, Artificial Sequence
  chemically synthesized
ttccacacttttctgccctcac

SEQ ID NO: 1360629 - DNA, 22 bp, Artificial Sequence
  chemically synthesized
tcctagagtacagtgagggcag

SEQ ID NO: 1360630 - DNA, 22 bp, Artificial Sequence
  chemically synthesized
cacacttttctgccctcactgt

SEQ ID NO: 1360631 - DNA, 22 bp, Artificial Sequence
  chemically synthesized
ttctgccctcactgtactctag

SEQ ID NO: 1360632 - DNA, 22 bp, Artificial Sequence
  chemically synthesized
tctgccctcactgtactctagg

SEQ ID NO: 1360633 - DNA, 22 bp, Artificial Sequence
  chemically synthesized
ctgccctcactgtactctagga

SEQ ID NO: 1360634 - DNA, 22 bp, Artificial Sequence
  chemically synthesized
tgccctcactgtactctaggaa

SEQ ID NO: 1360635 - DNA, 22 bp, Artificial Sequence
  chemically synthesized
ccctcactgtactctaggaaag

SEQ ID NO: 1360636 - DNA, 22 bp, Artificial Sequence
  chemically synthesized
aaacaagtacagctttcctaga

SEQ ID NO: 1360637 - DNA, 22 bp, Artificial Sequence
  chemically synthesized
actgtactctaggaaagctgta

SEQ ID NO: 1360638 - DNA, 22 bp, Artificial Sequence
  chemically synthesized
tactctaggaaagctgtacttg

SEQ ID NO: 1360639 - DNA, 22 bp, Artificial Sequence
  chemically synthesized
taggaaagctgtacttgtttta

SEQ ID NO: 1360640 - DNA, 22 bp, Artificial Sequence
  chemically synthesized
ggaaagctgtacttgttttaga

SEQ ID NO: 1360641 - DNA, 22 bp, Artificial Sequence
  chemically synthesized
tacttgttttagatctttctcc

SEQ ID NO: 1360642 - DNA, 22 bp, Artificial Sequence
  chemically synthesized
gttttagatctttctccatacc

SEQ ID NO: 1360643 - DNA, 22 bp, Artificial Sequence
  chemically synthesized
aatgtggaaaatggtatggaga

SEQ ID NO: 1360644 - DNA, 22 bp, Artificial Sequence
  chemically synthesized
ttttagatctttctccatacca

SEQ ID NO: 1360645 - DNA, 22 bp, Artificial Sequence
  chemically synthesized
tgaatgtggaaaatggtatgga

SEQ ID NO: 1360646 - DNA, 22 bp, Artificial Sequence
  chemically synthesized
ctgaatgtggaaaatggtatgg

SEQ ID NO: 1360647 - DNA, 22 bp, Artificial Sequence
  chemically synthesized
tagatctttctccataccattt

SEQ ID NO: 1360648 - DNA, 22 bp, Artificial Sequence
  chemically synthesized
agatctttctccataccatttt

SEQ ID NO: 1360649 - DNA, 22 bp, Artificial Sequence
  chemically synthesized
gatctttctccataccattttc

SEQ ID NO: 1360650 - DNA, 22 bp, Artificial Sequence
  chemically synthesized
tctccataccattttccacatt

SEQ ID NO: 1360651 - DNA, 22 bp, Artificial Sequence
  chemically synthesized
ctccataccattttccacattc

SEQ ID NO: 1360652 - DNA, 22 bp, Artificial Sequence
  chemically synthesized
tccataccattttccacattca

SEQ ID NO: 1360653 - DNA, 22 bp, Artificial Sequence
  chemically synthesized
cataccattttccacattcaga

SEQ ID NO: 1360654 - DNA, 22 bp, Artificial Sequence
  chemically synthesized
tcagagggagcaatgtttctga

SEQ ID NO: 1360655 - DNA, 22 bp, Artificial Sequence
  chemically synthesized
tccacattcagaaacattgctc

SEQ ID NO: 1360656 - DNA, 22 bp, Artificial Sequence
  chemically synthesized
ccacattcagaaacattgctcc

SEQ ID NO: 1360657 - DNA, 22 bp, Artificial Sequence
  chemically synthesized
cacattcagaaacattgctccc

SEQ ID NO: 1360658 - DNA, 22 bp, Artificial Sequence
  chemically synthesized
agaaacattgctccctctgaca

SEQ ID NO: 1360659 - DNA, 22 bp, Artificial Sequence
  chemically synthesized
ctccctctgacagggacatttt

SEQ ID NO: 1360660 - DNA, 22 bp, Artificial Sequence
  chemically synthesized
cctctgacagggacatttttgc

SEQ ID NO: 1360661 - DNA, 22 bp, Artificial Sequence
  chemically synthesized
tgacagggacatttttgctccc

SEQ ID NO: 1360662 - DNA, 22 bp, Artificial Sequence
  chemically synthesized
acagggacatttttgctccctc

SEQ ID NO: 1360663 - DNA, 22 bp, Artificial Sequence
  chemically synthesized
tccaaaagaaaagagggagcaa

SEQ ID NO: 1360664 - DNA, 22 bp, Artificial Sequence
  chemically synthesized
gagtatagttgtccaaaagaaa

SEQ ID NO: 1360665 - DNA, 22 bp, Artificial Sequence
  chemically synthesized
ttgctccctcttttcttttgga

SEQ ID NO: 1360666 - DNA, 22 bp, Artificial Sequence
  chemically synthesized
tgctccctcttttcttttggac

SEQ ID NO: 1360667 - DNA, 22 bp, Artificial Sequence
  chemically synthesized
gctccctcttttcttttggaca

SEQ ID NO: 1360668 - DNA, 22 bp, Artificial Sequence
  chemically synthesized
ctccctcttttcttttggacaa

SEQ ID NO: 1360669 - DNA, 22 bp, Artificial Sequence
  chemically synthesized
cctcttttcttttggacaacta

SEQ ID NO: 1360670 - DNA, 22 bp, Artificial Sequence
  chemically synthesized
ttttcttttggacaactatact

SEQ ID NO: 1360671 - DNA, 22 bp, Artificial Sequence
  chemically synthesized
ttcttttggacaactatactct

SEQ ID NO: 1360672 - DNA, 22 bp, Artificial Sequence
  chemically synthesized
tcttttggacaactatactcta

SEQ ID NO: 1360673 - DNA, 22 bp, Artificial Sequence
  chemically synthesized
cttttggacaactatactctaa

SEQ ID NO: 1360674 - DNA, 22 bp, Artificial Sequence
  chemically synthesized
ttttggacaactatactctaac

SEQ ID NO: 1360675 - DNA, 22 bp, Artificial Sequence
  chemically synthesized
ttggacaactatactctaacct

SEQ ID NO: 1360676 - DNA, 22 bp, Artificial Sequence
  chemically synthesized
tggacaactatactctaacctc

SEQ ID NO: 1360677 - DNA, 22 bp, Artificial Sequence
  chemically synthesized
ggacaactatactctaacctca

SEQ ID NO: 1360678 - DNA, 22 bp, Artificial Sequence
  chemically synthesized
gacaactatactctaacctcat

SEQ ID NO: 1360679 - DNA, 22 bp, Artificial Sequence
  chemically synthesized
aaagcaaggcaaagaagaatga

SEQ ID NO: 1360680 - DNA, 22 bp, Artificial Sequence
  chemically synthesized
tactctaacctcattcttcttt

SEQ ID NO: 1360681 - DNA, 22 bp, Artificial Sequence
  chemically synthesized
taacctcattcttctttgcctt

SEQ ID NO: 1360682 - DNA, 22 bp, Artificial Sequence
  chemically synthesized
acctcattcttctttgccttgc

SEQ ID NO: 1360683 - DNA, 22 bp, Artificial Sequence
  chemically synthesized
attcttctttgccttgctttga

SEQ ID NO: 1360684 - DNA, 22 bp, Artificial Sequence
  chemically synthesized
agaaaaaaaaaatattcaaagc

SEQ ID NO: 1360685 - DNA, 22 bp, Artificial Sequence
  chemically synthesized
ttctttgccttgctttgaatat

SEQ ID NO: 1360686 - DNA, 22 bp, Artificial Sequence
  chemically synthesized
tgagaaaaaaaaaatattcaaa

SEQ ID NO: 1360687 - DNA, 22 bp, Artificial Sequence
  chemically synthesized
ctttgccttgctttgaatattt

SEQ ID NO: 1360688 - DNA, 22 bp, Artificial Sequence
  chemically synthesized
ctgagaaaaaaaaaatattcaa

SEQ ID NO: 1360689 - DNA, 22 bp, Artificial Sequence
  chemically synthesized
tttgccttgctttgaatatttt

SEQ ID NO: 1360690 - DNA, 22 bp, Artificial Sequence
  chemically synthesized
tgccttgctttgaatatttttt

SEQ ID NO: 1360691 - DNA, 22 bp, Artificial Sequence
  chemically synthesized
gccttgctttgaatattttttt

SEQ ID NO: 1360692 - DNA, 22 bp, Artificial Sequence
  chemically synthesized
ccttgctttgaatatttttttt

SEQ ID NO: 1360693 - DNA, 22 bp, Artificial Sequence
  chemically synthesized
gctttgaatattttttttttct

SEQ ID NO: 1360694 - DNA, 22 bp, Artificial Sequence
  chemically synthesized
ctttgaatattttttttttctc

SEQ ID NO: 1360695 - DNA, 22 bp, Artificial Sequence
  chemically synthesized
gggaaatacttctgagaaaaaa

SEQ ID NO: 1360696 - DNA, 22 bp, Artificial Sequence
  chemically synthesized
tgaatattttttttttctcaga

SEQ ID NO: 1360697 - DNA, 22 bp, Artificial Sequence
  chemically synthesized
gaatattttttttttctcagaa

SEQ ID NO: 1360698 - DNA, 22 bp, Artificial Sequence
  chemically synthesized
aatattttttttttctcagaag

SEQ ID NO: 1360699 - DNA, 22 bp, Artificial Sequence
  chemically synthesized
gaaattggggaaatacttctga

SEQ ID NO: 1360700 - DNA, 22 bp, Artificial Sequence
  chemically synthesized
cgaaattggggaaatacttctg

SEQ ID NO: 1360701 - DNA, 22 bp, Artificial Sequence
  chemically synthesized
tttttttctcagaagtatttcc

SEQ ID NO: 1360702 - DNA, 22 bp, Artificial Sequence
  chemically synthesized
ttttttctcagaagtatttccc

SEQ ID NO: 1360703 - DNA, 22 bp, Artificial Sequence
  chemically synthesized
tttttctcagaagtatttcccc

SEQ ID NO: 1360704 - DNA, 22 bp, Artificial Sequence
  chemically synthesized
ttttctcagaagtatttcccca

SEQ ID NO: 1360705 - DNA, 22 bp, Artificial Sequence
  chemically synthesized
tttctcagaagtatttccccaa

SEQ ID NO: 1360706 - DNA, 22 bp, Artificial Sequence
  chemically synthesized
ttctcagaagtatttccccaat

SEQ ID NO: 1360707 - DNA, 22 bp, Artificial Sequence
  chemically synthesized
tctcagaagtatttccccaatt

SEQ ID NO: 1360708 - DNA, 22 bp, Artificial Sequence
  chemically synthesized
ctcagaagtatttccccaattt

SEQ ID NO: 1360709 - DNA, 22 bp, Artificial Sequence
  chemically synthesized
gaccagtcttcgaaattgggga

SEQ ID NO: 1360710 - DNA, 22 bp, Artificial Sequence
  chemically synthesized
tcagaagtatttccccaatttc

SEQ ID NO: 1360711 - DNA, 22 bp, Artificial Sequence
  chemically synthesized
agaagtatttccccaatttcga

SEQ ID NO: 1360712 - DNA, 22 bp, Artificial Sequence
  chemically synthesized
ccccaatttcgaagactggtct

SEQ ID NO: 1360713 - DNA, 22 bp, Artificial Sequence
  chemically synthesized
cccaatttcgaagactggtcta

SEQ ID NO: 1360714 - DNA, 22 bp, Artificial Sequence
  chemically synthesized
cgaagactggtctaactctccc

SEQ ID NO: 1360715 - DNA, 22 bp, Artificial Sequence
  chemically synthesized
gaagactggtctaactctccct

SEQ ID NO: 1360716 - DNA, 22 bp, Artificial Sequence
  chemically synthesized
taataagaatgtataataggga

SEQ ID NO: 1360717 - DNA, 22 bp, Artificial Sequence
  chemically synthesized
gtctaactctccctattataca

SEQ ID NO: 1360718 - DNA, 22 bp, Artificial Sequence
  chemically synthesized
actctccctattatacattctt

SEQ ID NO: 1360719 - DNA, 22 bp, Artificial Sequence
  chemically synthesized
tccctattatacattcttatta

SEQ ID NO: 1360720 - DNA, 22 bp, Artificial Sequence
  chemically synthesized
cctattatacattcttattaca

SEQ ID NO: 1360721 - DNA, 22 bp, Artificial Sequence
  chemically synthesized
ttatacattcttattacaatgt

SEQ ID NO: 1360722 - DNA, 22 bp, Artificial Sequence
  chemically synthesized
tagaataaagcacacattgtaa

SEQ ID NO: 1360723 - DNA, 22 bp, Artificial Sequence
  chemically synthesized
tacattcttattacaatgtgtg

SEQ ID NO: 1360724 - DNA, 22 bp, Artificial Sequence
  chemically synthesized
ttattacaatgtgtgctttatt

SEQ ID NO: 1360725 - DNA, 22 bp, Artificial Sequence
  chemically synthesized
attacaatgtgtgctttattct

SEQ ID NO: 1360726 - DNA, 22 bp, Artificial Sequence
  chemically synthesized
ttacaatgtgtgctttattcta

SEQ ID NO: 1360727 - DNA, 22 bp, Artificial Sequence
  chemically synthesized
gagataagggctatagaataaa

SEQ ID NO: 1360728 - DNA, 22 bp, Artificial Sequence
  chemically synthesized
caatgtgtgctttattctatag

SEQ ID NO: 1360729 - DNA, 22 bp, Artificial Sequence
  chemically synthesized
cattggagataagggctataga

SEQ ID NO: 1360730 - DNA, 22 bp, Artificial Sequence
  chemically synthesized
gcattggagataagggctatag

SEQ ID NO: 1360731 - DNA, 22 bp, Artificial Sequence
  chemically synthesized
cttgcattggagataagggcta

SEQ ID NO: 1360732 - DNA, 22 bp, Artificial Sequence
  chemically synthesized
tattctatagcccttatctcca

SEQ ID NO: 1360733 - DNA, 22 bp, Artificial Sequence
  chemically synthesized
attctatagcccttatctccaa

SEQ ID NO: 1360734 - DNA, 22 bp, Artificial Sequence
  chemically synthesized
ttctatagcccttatctccaat

SEQ ID NO: 1360735 - DNA, 22 bp, Artificial Sequence
  chemically synthesized
tatagcccttatctccaatgca

SEQ ID NO: 1360736 - DNA, 22 bp, Artificial Sequence
  chemically synthesized
tagcccttatctccaatgcaag

SEQ ID NO: 1360737 - DNA, 22 bp, Artificial Sequence
  chemically synthesized
atctccaatgcaagtagtttgc

SEQ ID NO: 1360738 - DNA, 22 bp, Artificial Sequence
  chemically synthesized
tctccaatgcaagtagtttgcg

SEQ ID NO: 1360739 - DNA, 22 bp, Artificial Sequence
  chemically synthesized
aatacacacacacgcaaactac

SEQ ID NO: 1360740 - DNA, 22 bp, Artificial Sequence
  chemically synthesized
caatgcaagtagtttgcgtgtg

SEQ ID NO: 1360741 - DNA, 22 bp, Artificial Sequence
  chemically synthesized
gcgtgtgtgtgtatttaatatg

SEQ ID NO: 1360742 - DNA, 22 bp, Artificial Sequence
  chemically synthesized
aaggaggatgtgcatattaaat

SEQ ID NO: 1360743 - DNA, 22 bp, Artificial Sequence
  chemically synthesized
cgtgtgtgtgtatttaatatgc

SEQ ID NO: 1360744 - DNA, 22 bp, Artificial Sequence
  chemically synthesized
caaggaggatgtgcatattaaa

SEQ ID NO: 1360745 - DNA, 22 bp, Artificial Sequence
  chemically synthesized
gcatttcaaggaggatgtgcat

SEQ ID NO: 1360746 - DNA, 22 bp, Artificial Sequence
  chemically synthesized
aatatgcacatcctccttgaaa

SEQ ID NO: 1360747 - DNA, 22 bp, Artificial Sequence
  chemically synthesized
atatgcacatcctccttgaaat

SEQ ID NO: 1360748 - DNA, 22 bp, Artificial Sequence
  chemically synthesized
aaagagagactagcatttcaag

SEQ ID NO: 1360749 - DNA, 22 bp, Artificial Sequence
  chemically synthesized
cttgaaatgctagtctctcttt

SEQ ID NO: 1360750 - DNA, 22 bp, Artificial Sequence
  chemically synthesized
aacaagtgaactcaaagagaga

SEQ ID NO: 1360751 - DNA, 22 bp, Artificial Sequence
  chemically synthesized
gaaatgctagtctctctttgag

SEQ ID NO: 1360752 - DNA, 22 bp, Artificial Sequence
  chemically synthesized
taaacaagtgaactcaaagaga

SEQ ID NO: 1360753 - DNA, 22 bp, Artificial Sequence
  chemically synthesized
aaatgctagtctctctttgagt

SEQ ID NO: 1360754 - DNA, 22 bp, Artificial Sequence
  chemically synthesized
gtctctctttgagttcacttgt

SEQ ID NO: 1360755 - DNA, 22 bp, Artificial Sequence
  chemically synthesized
gcgatagtattctaaacaagtg

SEQ ID NO: 1360756 - DNA, 22 bp, Artificial Sequence
  chemically synthesized
tctttgagttcacttgtttaga

SEQ ID NO: 1360757 - DNA, 22 bp, Artificial Sequence
  chemically synthesized
tggcgatagtattctaaacaag

SEQ ID NO: 1360758 - DNA, 22 bp, Artificial Sequence
  chemically synthesized
tttgagttcacttgtttagaat

SEQ ID NO: 1360759 - DNA, 22 bp, Artificial Sequence
  chemically synthesized
tgagttcacttgtttagaatac

SEQ ID NO: 1360760 - DNA, 22 bp, Artificial Sequence
  chemically synthesized
gagttcacttgtttagaatact

SEQ ID NO: 1360761 - DNA, 22 bp, Artificial Sequence
  chemically synthesized
tgctctggcgatagtattctaa

SEQ ID NO: 1360762 - DNA, 22 bp, Artificial Sequence
  chemically synthesized
agttcacttgtttagaatacta

SEQ ID NO: 1360763 - DNA, 22 bp, Artificial Sequence
  chemically synthesized
tgctatgctctggcgatagtat

SEQ ID NO: 1360764 - DNA, 22 bp, Artificial Sequence
  chemically synthesized
acttgtttagaatactatcgcc

SEQ ID NO: 1360765 - DNA, 22 bp, Artificial Sequence
  chemically synthesized
gtttagaatactatcgccagag

SEQ ID NO: 1360766 - DNA, 22 bp, Artificial Sequence
  chemically synthesized
tttagaatactatcgccagagc

SEQ ID NO: 1360767 - DNA, 22 bp, Artificial Sequence
  chemically synthesized
agaatactatcgccagagcata

SEQ ID NO: 1360768 - DNA, 22 bp, Artificial Sequence
  chemically synthesized
gaatactatcgccagagcatag

SEQ ID NO: 1360769 - DNA, 22 bp, Artificial Sequence
  chemically synthesized
tgccaggtactgtgctatgctc

SEQ ID NO: 1360770 - DNA, 22 bp, Artificial Sequence
  chemically synthesized
gtgccaggtactgtgctatgct

SEQ ID NO: 1360771 - DNA, 22 bp, Artificial Sequence
  chemically synthesized
tgtgccaggtactgtgctatgc

SEQ ID NO: 1360772 - DNA, 22 bp, Artificial Sequence
  chemically synthesized
tcgccagagcatagcacagtac

SEQ ID NO: 1360773 - DNA, 22 bp, Artificial Sequence
  chemically synthesized
agtgcccattttgtgccaggta

SEQ ID NO: 1360774 - DNA, 22 bp, Artificial Sequence
  chemically synthesized
gcacaaaatgggcactcaatat

SEQ ID NO: 1360775 - DNA, 22 bp, Artificial Sequence
  chemically synthesized
tccatgtaacaaatacacatat

SEQ ID NO: 1360776 - DNA, 22 bp, Artificial Sequence
  chemically synthesized
gtccatgtaacaaatacacata

SEQ ID NO: 1360777 - DNA, 22 bp, Artificial Sequence
  chemically synthesized
atttgtccatgtaacaaataca

SEQ ID NO: 1360778 - DNA, 22 bp, Artificial Sequence
  chemically synthesized
attcatttgtccatgtaacaaa

SEQ ID NO: 1360779 - DNA, 22 bp, Artificial Sequence
  chemically synthesized
aatatgtgtatttgttacatgg

SEQ ID NO: 1360780 - DNA, 22 bp, Artificial Sequence
  chemically synthesized
ttgattcatttgtccatgtaac

SEQ ID NO: 1360781 - DNA, 22 bp, Artificial Sequence
  chemically synthesized
attgattcatttgtccatgtaa

SEQ ID NO: 1360782 - DNA, 22 bp, Artificial Sequence
  chemically synthesized
tccatttattgattcatttgtc

SEQ ID NO: 1360783 - DNA, 22 bp, Artificial Sequence
  chemically synthesized
ttatccatttattgattcattt

SEQ ID NO: 1360784 - DNA, 22 bp, Artificial Sequence
  chemically synthesized
gttacatggacaaatgaatcaa

SEQ ID NO: 1360785 - DNA, 22 bp, Artificial Sequence
  chemically synthesized
gttatccatttattgattcatt

SEQ ID NO: 1360786 - DNA, 22 bp, Artificial Sequence
  chemically synthesized
ttacatggacaaatgaatcaat

SEQ ID NO: 1360787 - DNA, 22 bp, Artificial Sequence
  chemically synthesized
catggacaaatgaatcaataaa

SEQ ID NO: 1360788 - DNA, 22 bp, Artificial Sequence
  chemically synthesized
atgatttgttatccatttattg

SEQ ID NO: 1360789 - DNA, 22 bp, Artificial Sequence
  chemically synthesized
cagctgatgatttgttatccat

SEQ ID NO: 1360790 - DNA, 22 bp, Artificial Sequence
  chemically synthesized
acagctgatgatttgttatcca

SEQ ID NO: 1360791 - DNA, 22 bp, Artificial Sequence
  chemically synthesized
aagaagggacttacagctgatg

SEQ ID NO: 1360792 - DNA, 22 bp, Artificial Sequence
  chemically synthesized
aaagaagggacttacagctgat

SEQ ID NO: 1360793 - DNA, 22 bp, Artificial Sequence
  chemically synthesized
ggtgaccacagtttaaagaagg

SEQ ID NO: 1360794 - DNA, 22 bp, Artificial Sequence
  chemically synthesized
gggtgaccacagtttaaagaag

SEQ ID NO: 1360795 - DNA, 22 bp, Artificial Sequence
  chemically synthesized
tgggtgaccacagtttaaagaa

SEQ ID NO: 1360796 - DNA, 22 bp, Artificial Sequence
  chemically synthesized
taagtcccttctttaaactgtg

SEQ ID NO: 1360797 - DNA, 22 bp, Artificial Sequence
  chemically synthesized
tgtggttttgggtgaccacagt

SEQ ID NO: 1360798 - DNA, 22 bp, Artificial Sequence
  chemically synthesized
tattgtgtggttttgggtgacc

SEQ ID NO: 1360799 - DNA, 22 bp, Artificial Sequence
  chemically synthesized
ctttaaactgtggtcacccaaa

SEQ ID NO: 1360800 - DNA, 22 bp, Artificial Sequence
  chemically synthesized
gtattgtgtggttttgggtgac

SEQ ID NO: 1360801 - DNA, 22 bp, Artificial Sequence
  chemically synthesized
tttaaactgtggtcacccaaaa

SEQ ID NO: 1360802 - DNA, 22 bp, Artificial Sequence
  chemically synthesized
taaactgtggtcacccaaaacc

SEQ ID NO: 1360803 - DNA, 22 bp, Artificial Sequence
  chemically synthesized
aaactgtggtcacccaaaacca

SEQ ID NO: 1360804 - DNA, 22 bp, Artificial Sequence
  chemically synthesized
aactgtggtcacccaaaaccac

SEQ ID NO: 1360805 - DNA, 22 bp, Artificial Sequence
  chemically synthesized
aaacttgtattgtgtggttttg

SEQ ID NO: 1360806 - DNA, 22 bp, Artificial Sequence
  chemically synthesized
taaaacttgtattgtgtggttt

SEQ ID NO: 1360807 - DNA, 22 bp, Artificial Sequence
  chemically synthesized
tggtcacccaaaaccacacaat

SEQ ID NO: 1360808 - DNA, 22 bp, Artificial Sequence
  chemically synthesized
tctaaaacttgtattgtgtggt

SEQ ID NO: 1360809 - DNA, 22 bp, Artificial Sequence
  chemically synthesized
tagagagtcacttattttgata

SEQ ID NO: 1360810 - DNA, 22 bp, Artificial Sequence
  chemically synthesized
agagagtcacttattttgatac

SEQ ID NO: 1360811 - DNA, 22 bp, Artificial Sequence
  chemically synthesized
gagagtcacttattttgatact

SEQ ID NO: 1360812 - DNA, 22 bp, Artificial Sequence
  chemically synthesized
aaaataaatccaaaaataaaag

SEQ ID NO: 1360813 - DNA, 22 bp, Artificial Sequence
  chemically synthesized
tcaaaataaatccaaaaataaa

SEQ ID NO: 1360814 - DNA, 22 bp, Artificial Sequence
  chemically synthesized
attttgatacttttatttttgg

SEQ ID NO: 1360815 - DNA, 22 bp, Artificial Sequence
  chemically synthesized
ttttgatacttttatttttgga

SEQ ID NO: 1360816 - DNA, 22 bp, Artificial Sequence
  chemically synthesized
gctctcaaaataaatccaaaaa

SEQ ID NO: 1360817 - DNA, 22 bp, Artificial Sequence
  chemically synthesized
tgatacttttatttttggattt

SEQ ID NO: 1360818 - DNA, 22 bp, Artificial Sequence
  chemically synthesized
gatacttttatttttggattta

SEQ ID NO: 1360819 - DNA, 22 bp, Artificial Sequence
  chemically synthesized
atacttttatttttggatttat

SEQ ID NO: 1360820 - DNA, 22 bp, Artificial Sequence
  chemically synthesized
ttatttttggatttattttgag

SEQ ID NO: 1360821 - DNA, 22 bp, Artificial Sequence
  chemically synthesized
tatttttggatttattttgaga

SEQ ID NO: 1360822 - DNA, 22 bp, Artificial Sequence
  chemically synthesized
atttttggatttattttgagag

SEQ ID NO: 1360823 - DNA, 22 bp, Artificial Sequence
  chemically synthesized
aaaatggattggctctcaaaat

SEQ ID NO: 1360824 - DNA, 22 bp, Artificial Sequence
  chemically synthesized
tttttggatttattttgagagc

SEQ ID NO: 1360825 - DNA, 22 bp, Artificial Sequence
  chemically synthesized
ttggatttattttgagagccaa

SEQ ID NO: 1360826 - DNA, 22 bp, Artificial Sequence
  chemically synthesized
tggatttattttgagagccaat

SEQ ID NO: 1360827 - DNA, 22 bp, Artificial Sequence
  chemically synthesized
ggatttattttgagagccaatc

SEQ ID NO: 1360828 - DNA, 22 bp, Artificial Sequence
  chemically synthesized
gatttattttgagagccaatcc

SEQ ID NO: 1360829 - DNA, 22 bp, Artificial Sequence
  chemically synthesized
aatgtctgaaaatggattggct

SEQ ID NO: 1360830 - DNA, 22 bp, Artificial Sequence
  chemically synthesized
aaatgtctgaaaatggattggc

SEQ ID NO: 1360831 - DNA, 22 bp, Artificial Sequence
  chemically synthesized
taaatgtctgaaaatggattgg

SEQ ID NO: 1360832 - DNA, 22 bp, Artificial Sequence
  chemically synthesized
attttgagagccaatccatttt

SEQ ID NO: 1360833 - DNA, 22 bp, Artificial Sequence
  chemically synthesized
ttttgagagccaatccattttc

SEQ ID NO: 1360834 - DNA, 22 bp, Artificial Sequence
  chemically synthesized
ctttaaatgtctgaaaatggat

SEQ ID NO: 1360835 - DNA, 22 bp, Artificial Sequence
  chemically synthesized
actttaaatgtctgaaaatgga

SEQ ID NO: 1360836 - DNA, 22 bp, Artificial Sequence
  chemically synthesized
tactttaaatgtctgaaaatgg

SEQ ID NO: 1360837 - DNA, 22 bp, Artificial Sequence
  chemically synthesized
tgagagccaatccattttcaga

SEQ ID NO: 1360838 - DNA, 22 bp, Artificial Sequence
  chemically synthesized
gagagccaatccattttcagac

SEQ ID NO: 1360839 - DNA, 22 bp, Artificial Sequence
  chemically synthesized
agagccaatccattttcagaca

SEQ ID NO: 1360840 - DNA, 22 bp, Artificial Sequence
  chemically synthesized
cagtgttttactttaaatgtct

SEQ ID NO: 1360841 - DNA, 22 bp, Artificial Sequence
  chemically synthesized
gcagtgttttactttaaatgtc

SEQ ID NO: 1360842 - DNA, 22 bp, Artificial Sequence
  chemically synthesized
tgcagtgttttactttaaatgt

SEQ ID NO: 1360843 - DNA, 22 bp, Artificial Sequence
  chemically synthesized
ttgcagtgttttactttaaatg

SEQ ID NO: 1360844 - DNA, 22 bp, Artificial Sequence
  chemically synthesized
tggcttttgcagtgttttactt

SEQ ID NO: 1360845 - DNA, 22 bp, Artificial Sequence
  chemically synthesized
tcagacatttaaagtaaaacac

SEQ ID NO: 1360846 - DNA, 22 bp, Artificial Sequence
  chemically synthesized
cagacatttaaagtaaaacact

SEQ ID NO: 1360847 - DNA, 22 bp, Artificial Sequence
  chemically synthesized
agacatttaaagtaaaacactg

SEQ ID NO: 1360848 - DNA, 22 bp, Artificial Sequence
  chemically synthesized
aagcctatggcttttgcagtgt

SEQ ID NO: 1360849 - DNA, 22 bp, Artificial Sequence
  chemically synthesized
ctcaagcctatggcttttgcag

SEQ ID NO: 1360850 - DNA, 22 bp, Artificial Sequence
  chemically synthesized
aaagtaaaacactgcaaaagcc

SEQ ID NO: 1360851 - DNA, 22 bp, Artificial Sequence
  chemically synthesized
gctcaagcctatggcttttgca

SEQ ID NO: 1360852 - DNA, 22 bp, Artificial Sequence
  chemically synthesized
aagtaaaacactgcaaaagcca

SEQ ID NO: 1360853 - DNA, 22 bp, Artificial Sequence
  chemically synthesized
tgctcaagcctatggcttttgc

SEQ ID NO: 1360854 - DNA, 22 bp, Artificial Sequence
  chemically synthesized
actttgctcaagcctatggctt

SEQ ID NO: 1360855 - DNA, 22 bp, Artificial Sequence
  chemically synthesized
caaaagccataggcttgagcaa

SEQ ID NO: 1360856 - DNA, 22 bp, Artificial Sequence
  chemically synthesized
tcacagaggttcactttgctca

SEQ ID NO: 1360857 - DNA, 22 bp, Artificial Sequence
  chemically synthesized
gagcaaagtgaacctctgtgat

SEQ ID NO: 1360858 - DNA, 22 bp, Artificial Sequence
  chemically synthesized
agcaaagtgaacctctgtgata

SEQ ID NO: 1360859 - DNA, 22 bp, Artificial Sequence
  chemically synthesized
tcagagagcaccaagtgttatc

SEQ ID NO: 1360860 - DNA, 22 bp, Artificial Sequence
  chemically synthesized
atgggctgtcagagagcaccaa

SEQ ID NO: 1360861 - DNA, 22 bp, Artificial Sequence
  chemically synthesized
tgtgataacacttggtgctctc

SEQ ID NO: 1360862 - DNA, 22 bp, Artificial Sequence
  chemically synthesized
taatgggctgtcagagagcacc

SEQ ID NO: 1360863 - DNA, 22 bp, Artificial Sequence
  chemically synthesized
tgataacacttggtgctctctg

SEQ ID NO: 1360864 - DNA, 22 bp, Artificial Sequence
  chemically synthesized
ggtgctctctgacagcccatta

SEQ ID NO: 1360865 - DNA, 22 bp, Artificial Sequence
  chemically synthesized
gtgctctctgacagcccattag

SEQ ID NO: 1360866 - DNA, 22 bp, Artificial Sequence
  chemically synthesized
tctgacagcccattagagacgg

SEQ ID NO: 1360867 - DNA, 22 bp, Artificial Sequence
  chemically synthesized
ggtgtacacaccccgtctctaa

SEQ ID NO: 1360868 - DNA, 22 bp, Artificial Sequence
  chemically synthesized
tgacagcccattagagacgggg

SEQ ID NO: 1360869 - DNA, 22 bp, Artificial Sequence
  chemically synthesized
acagcccattagagacggggtg

SEQ ID NO: 1360870 - DNA, 22 bp, Artificial Sequence
  chemically synthesized
gattaggtgtacacaccccgtc

SEQ ID NO: 1360871 - DNA, 22 bp, Artificial Sequence
  chemically synthesized
ggattaggtgtacacaccccgt

SEQ ID NO: 1360872 - DNA, 22 bp, Artificial Sequence
  chemically synthesized
tggattaggtgtacacaccccg

SEQ ID NO: 1360873 - DNA, 22 bp, Artificial Sequence
  chemically synthesized
ctttggattaggtgtacacacc

SEQ ID NO: 1360874 - DNA, 22 bp, Artificial Sequence
  chemically synthesized
gagacggggtgtgtacacctaa

SEQ ID NO: 1360875 - DNA, 22 bp, Artificial Sequence
  chemically synthesized
gaggattcctttggattaggtg

SEQ ID NO: 1360876 - DNA, 22 bp, Artificial Sequence
  chemically synthesized
aagagctagaggattcctttgg

SEQ ID NO: 1360877 - DNA, 22 bp, Artificial Sequence
  chemically synthesized
ctgaagagctagaggattcctt

SEQ ID NO: 1360878 - DNA, 22 bp, Artificial Sequence
  chemically synthesized
atccaaaggaatcctctagctc

SEQ ID NO: 1360879 - DNA, 22 bp, Artificial Sequence
  chemically synthesized
tagctcttcagcagctgttcac

SEQ ID NO: 1360880 - DNA, 22 bp, Artificial Sequence
  chemically synthesized
gctcttcagcagctgttcacat

SEQ ID NO: 1360881 - DNA, 22 bp, Artificial Sequence
  chemically synthesized
ttcagcagctgttcacatggct

SEQ ID NO: 1360882 - DNA, 22 bp, Artificial Sequence
  chemically synthesized
cagcagctgttcacatggctca

SEQ ID NO: 1360883 - DNA, 22 bp, Artificial Sequence
  chemically synthesized
aagggcagggcatgagccatgt

SEQ ID NO: 1360884 - DNA, 22 bp, Artificial Sequence
  chemically synthesized
agcagctgttcacatggctcat

SEQ ID NO: 1360885 - DNA, 22 bp, Artificial Sequence
  chemically synthesized
ttcacatggctcatgccctgcc

SEQ ID NO: 1360886 - DNA, 22 bp, Artificial Sequence
  chemically synthesized
gtagacgctgaagggcagggca

SEQ ID NO: 1360887 - DNA, 22 bp, Artificial Sequence
  chemically synthesized
agtagacgctgaagggcagggc

SEQ ID NO: 1360888 - DNA, 22 bp, Artificial Sequence
  chemically synthesized
acatggctcatgccctgccctt

SEQ ID NO: 1360889 - DNA, 22 bp, Artificial Sequence
  chemically synthesized
atttagtagacgctgaagggca

SEQ ID NO: 1360890 - DNA, 22 bp, Artificial Sequence
  chemically synthesized
atgccctgcccttcagcgtcta

SEQ ID NO: 1360891 - DNA, 22 bp, Artificial Sequence
  chemically synthesized
gggaatcctgatttagtagacg

SEQ ID NO: 1360892 - DNA, 22 bp, Artificial Sequence
  chemically synthesized
cccttcagcgtctactaaatca

SEQ ID NO: 1360893 - DNA, 22 bp, Artificial Sequence
  chemically synthesized
cagcgtctactaaatcaggatt

SEQ ID NO: 1360894 - DNA, 22 bp, Artificial Sequence
  chemically synthesized
agacagctggggaatcctgatt

SEQ ID NO: 1360895 - DNA, 22 bp, Artificial Sequence
  chemically synthesized
agcgtctactaaatcaggattc

SEQ ID NO: 1360896 - DNA, 22 bp, Artificial Sequence
  chemically synthesized
ctaaatcaggattccccagctg

SEQ ID NO: 1360897 - DNA, 22 bp, Artificial Sequence
  chemically synthesized
cgggaagctcagacagctgggg

SEQ ID NO: 1360898 - DNA, 22 bp, Artificial Sequence
  chemically synthesized
acgggaagctcagacagctggg

SEQ ID NO: 1360899 - DNA, 22 bp, Artificial Sequence
  chemically synthesized
aatcaggattccccagctgtct

SEQ ID NO: 1360900 - DNA, 22 bp, Artificial Sequence
  chemically synthesized
aaatcgcttacgggaagctcag

SEQ ID NO: 1360901 - DNA, 22 bp, Artificial Sequence
  chemically synthesized
cccagctgtctgagcttcccgt

SEQ ID NO: 1360902 - DNA, 22 bp, Artificial Sequence
  chemically synthesized
actaaaatcgcttacgggaagc

SEQ ID NO: 1360903 - DNA, 22 bp, Artificial Sequence
  chemically synthesized
tctgagcttcccgtaagcgatt

SEQ ID NO: 1360904 - DNA, 22 bp, Artificial Sequence
  chemically synthesized
taggtggttaactaaaatcgct

SEQ ID NO: 1360905 - DNA, 22 bp, Artificial Sequence
  chemically synthesized
agcttcccgtaagcgattttag

SEQ ID NO: 1360906 - DNA, 22 bp, Artificial Sequence
  chemically synthesized
gtaggtggttaactaaaatcgc

SEQ ID NO: 1360907 - DNA, 22 bp, Artificial Sequence
  chemically synthesized
gcttgtaggtggttaactaaaa

SEQ ID NO: 1360908 - DNA, 22 bp, Artificial Sequence
  chemically synthesized
cccgtaagcgattttagttaac

SEQ ID NO: 1360909 - DNA, 22 bp, Artificial Sequence
  chemically synthesized
ccgtaagcgattttagttaacc

SEQ ID NO: 1360910 - DNA, 22 bp, Artificial Sequence
  chemically synthesized
tagttaaccacctacaagccaa

SEQ ID NO: 1360911 - DNA, 22 bp, Artificial Sequence
  chemically synthesized
agttaaccacctacaagccaac

SEQ ID NO: 1360912 - DNA, 22 bp, Artificial Sequence
  chemically synthesized
gttaaccacctacaagccaaca

SEQ ID NO: 1360913 - DNA, 22 bp, Artificial Sequence
  chemically synthesized
accacctacaagccaacatttc

SEQ ID NO: 1360914 - DNA, 22 bp, Artificial Sequence
  chemically synthesized
caagccaacatttcttgcatct

SEQ ID NO: 1360915 - DNA, 22 bp, Artificial Sequence
  chemically synthesized
aagagcgtaatcagatgcaaga

SEQ ID NO: 1360916 - DNA, 22 bp, Artificial Sequence
  chemically synthesized
aaagagcgtaatcagatgcaag

SEQ ID NO: 1360917 - DNA, 22 bp, Artificial Sequence
  chemically synthesized
taaagagcgtaatcagatgcaa

SEQ ID NO: 1360918 - DNA, 22 bp, Artificial Sequence
  chemically synthesized
gactttaaagagcgtaatcaga

SEQ ID NO: 1360919 - DNA, 22 bp, Artificial Sequence
  chemically synthesized
cttgcatctgattacgctcttt

SEQ ID NO: 1360920 - DNA, 22 bp, Artificial Sequence
  chemically synthesized
ttgcatctgattacgctcttta

SEQ ID NO: 1360921 - DNA, 22 bp, Artificial Sequence
  chemically synthesized
gcatctgattacgctctttaaa

SEQ ID NO: 1360922 - DNA, 22 bp, Artificial Sequence
  chemically synthesized
catctgattacgctctttaaag

SEQ ID NO: 1360923 - DNA, 22 bp, Artificial Sequence
  chemically synthesized
attacgctctttaaagtctaat

SEQ ID NO: 1360924 - DNA, 22 bp, Artificial Sequence
  chemically synthesized
ggaagcaaaagggaaattagac

SEQ ID NO: 1360925 - DNA, 22 bp, Artificial Sequence
  chemically synthesized
cgctctttaaagtctaatttcc

SEQ ID NO: 1360926 - DNA, 22 bp, Artificial Sequence
  chemically synthesized
tttaaagtctaatttccctttt

SEQ ID NO: 1360927 - DNA, 22 bp, Artificial Sequence
  chemically synthesized
taaagtctaatttcccttttgc

SEQ ID NO: 1360928 - DNA, 22 bp, Artificial Sequence
  chemically synthesized
aaagtctaatttcccttttgct

SEQ ID NO: 1360929 - DNA, 22 bp, Artificial Sequence
  chemically synthesized
aagtctaatttcccttttgctt

SEQ ID NO: 1360930 - DNA, 22 bp, Artificial Sequence
  chemically synthesized
caaaataactaggaagcaaaag

SEQ ID NO: 1360931 - DNA, 22 bp, Artificial Sequence
  chemically synthesized
atttcccttttgcttcctagtt

SEQ ID NO: 1360932 - DNA, 22 bp, Artificial Sequence
  chemically synthesized
acatgttgcaaaataactagga

SEQ ID NO: 1360933 - DNA, 22 bp, Artificial Sequence
  chemically synthesized
cccttttgcttcctagttattt

SEQ ID NO: 1360934 - DNA, 22 bp, Artificial Sequence
  chemically synthesized
ccttttgcttcctagttatttt

SEQ ID NO: 1360935 - DNA, 22 bp, Artificial Sequence
  chemically synthesized
ttgcttcctagttattttgcaa

SEQ ID NO: 1360936 - DNA, 22 bp, Artificial Sequence
  chemically synthesized
tgcttcctagttattttgcaac

SEQ ID NO: 1360937 - DNA, 22 bp, Artificial Sequence
  chemically synthesized
gcttcctagttattttgcaaca

SEQ ID NO: 1360938 - DNA, 22 bp, Artificial Sequence
  chemically synthesized
cttcctagttattttgcaacat

SEQ ID NO: 1360939 - DNA, 22 bp, Artificial Sequence
  chemically synthesized
cctagttattttgcaacatgtg

SEQ ID NO: 1360940 - DNA, 22 bp, Artificial Sequence
  chemically synthesized
ctagttattttgcaacatgtga

SEQ ID NO: 1360941 - DNA, 22 bp, Artificial Sequence
  chemically synthesized
gttattttgcaacatgtgagtc

SEQ ID NO: 1360942 - DNA, 22 bp, Artificial Sequence
  chemically synthesized
ttttgcaacatgtgagtcattg

SEQ ID NO: 1360943 - DNA, 22 bp, Artificial Sequence
  chemically synthesized
tgcaacatgtgagtcattggga

SEQ ID NO: 1360944 - DNA, 22 bp, Artificial Sequence
  chemically synthesized
gcaacatgtgagtcattgggat

SEQ ID NO: 1360945 - DNA, 22 bp, Artificial Sequence
  chemically synthesized
taaaaatgatgaatcccaatga

SEQ ID NO: 1360946 - DNA, 22 bp, Artificial Sequence
  chemically synthesized
caacatgtgagtcattgggatt

SEQ ID NO: 1360947 - DNA, 22 bp, Artificial Sequence
  chemically synthesized
ggattcatcatttttacagatt

SEQ ID NO: 1360948 - DNA, 22 bp, Artificial Sequence
  chemically synthesized
atcatttttacagattattatt

SEQ ID NO: 1360949 - DNA, 22 bp, Artificial Sequence
  chemically synthesized
agtaagtgaaaaaataataatc

SEQ ID NO: 1360950 - DNA, 22 bp, Artificial Sequence
  chemically synthesized
gttgagtaagtgaaaaaataat

SEQ ID NO: 1360951 - DNA, 22 bp, Artificial Sequence
  chemically synthesized
ttacagattattattttttcac

SEQ ID NO: 1360952 - DNA, 22 bp, Artificial Sequence
  chemically synthesized
tacagattattattttttcact

SEQ ID NO: 1360953 - DNA, 22 bp, Artificial Sequence
  chemically synthesized
acagattattattttttcactt

SEQ ID NO: 1360954 - DNA, 22 bp, Artificial Sequence
  chemically synthesized
cagattattattttttcactta

SEQ ID NO: 1360955 - DNA, 22 bp, Artificial Sequence
  chemically synthesized
ataaactagttgagtaagtgaa

SEQ ID NO: 1360956 - DNA, 22 bp, Artificial Sequence
  chemically synthesized
ttattttttcacttactcaact

SEQ ID NO: 1360957 - DNA, 22 bp, Artificial Sequence
  chemically synthesized
ttttttcacttactcaactagt

SEQ ID NO: 1360958 - DNA, 22 bp, Artificial Sequence
  chemically synthesized
tttcacttactcaactagttta

SEQ ID NO: 1360959 - DNA, 22 bp, Artificial Sequence
  chemically synthesized
ttcacttactcaactagtttat

SEQ ID NO: 1360960 - DNA, 22 bp, Artificial Sequence
  chemically synthesized
tcacttactcaactagtttatt

SEQ ID NO: 1360961 - DNA, 22 bp, Artificial Sequence
  chemically synthesized
cacttactcaactagtttatta

SEQ ID NO: 1360962 - DNA, 22 bp, Artificial Sequence
  chemically synthesized
acttactcaactagtttattaa

SEQ ID NO: 1360963 - DNA, 22 bp, Artificial Sequence
  chemically synthesized
agtgaacaaaatattaataaac

SEQ ID NO: 1360964 - DNA, 22 bp, Artificial Sequence
  chemically synthesized
actcaactagtttattaatatt

SEQ ID NO: 1360965 - DNA, 22 bp, Artificial Sequence
  chemically synthesized
ctcaactagtttattaatattt

SEQ ID NO: 1360966 - DNA, 22 bp, Artificial Sequence
  chemically synthesized
aactagtttattaatattttgt

SEQ ID NO: 1360967 - DNA, 22 bp, Artificial Sequence
  chemically synthesized
gtgactaagtgaacaaaatatt

SEQ ID NO: 1360968 - DNA, 22 bp, Artificial Sequence
  chemically synthesized
gtttattaatattttgttcact

SEQ ID NO: 1360969 - DNA, 22 bp, Artificial Sequence
  chemically synthesized
attaatattttgttcacttagt

SEQ ID NO: 1360970 - DNA, 22 bp, Artificial Sequence
  chemically synthesized
ttaatattttgttcacttagtc

SEQ ID NO: 1360971 - DNA, 22 bp, Artificial Sequence
  chemically synthesized
gaaataaattggtgactaagtg

SEQ ID NO: 1360972 - DNA, 22 bp, Artificial Sequence
  chemically synthesized
atattttgttcacttagtcacc

SEQ ID NO: 1360973 - DNA, 22 bp, Artificial Sequence
  chemically synthesized
tgttcacttagtcaccaattta

SEQ ID NO: 1360974 - DNA, 22 bp, Artificial Sequence
  chemically synthesized
gttcacttagtcaccaatttat

SEQ ID NO: 1360975 - DNA, 22 bp, Artificial Sequence
  chemically synthesized
ttcacttagtcaccaatttatt

SEQ ID NO: 1360976 - DNA, 22 bp, Artificial Sequence
  chemically synthesized
acttagtcaccaatttatttct

SEQ ID NO: 1360977 - DNA, 22 bp, Artificial Sequence
  chemically synthesized
agaacgatgtattagaaataaa

SEQ ID NO: 1360978 - DNA, 22 bp, Artificial Sequence
  chemically synthesized
aagaacgatgtattagaaataa

SEQ ID NO: 1360979 - DNA, 22 bp, Artificial Sequence
  chemically synthesized
agtcaccaatttatttctaata

SEQ ID NO: 1360980 - DNA, 22 bp, Artificial Sequence
  chemically synthesized
gtcaccaatttatttctaatac

SEQ ID NO: 1360981 - DNA, 22 bp, Artificial Sequence
  chemically synthesized
gtgcttaagaacgatgtattag

SEQ ID NO: 1360982 - DNA, 22 bp, Artificial Sequence
  chemically synthesized
tgttggtgcttaagaacgatgt

SEQ ID NO: 1360983 - DNA, 22 bp, Artificial Sequence
  chemically synthesized
atgttggtgcttaagaacgatg

SEQ ID NO: 1360984 - DNA, 22 bp, Artificial Sequence
  chemically synthesized
tatgttggtgcttaagaacgat

SEQ ID NO: 1360985 - DNA, 22 bp, Artificial Sequence
  chemically synthesized
atttctaatacatcgttcttaa

SEQ ID NO: 1360986 - DNA, 22 bp, Artificial Sequence
  chemically synthesized
ttatgttggtgcttaagaacga

SEQ ID NO: 1360987 - DNA, 22 bp, Artificial Sequence
  chemically synthesized
tttctaatacatcgttcttaag

SEQ ID NO: 1360988 - DNA, 22 bp, Artificial Sequence
  chemically synthesized
tttatgttggtgcttaagaacg

SEQ ID NO: 1360989 - DNA, 22 bp, Artificial Sequence
  chemically synthesized
ctaatacatcgttcttaagcac

SEQ ID NO: 1360990 - DNA, 22 bp, Artificial Sequence
  chemically synthesized
ctttttatgttggtgcttaaga

SEQ ID NO: 1360991 - DNA, 22 bp, Artificial Sequence
  chemically synthesized
taatacatcgttcttaagcacc

SEQ ID NO: 1360992 - DNA, 22 bp, Artificial Sequence
  chemically synthesized
atacatcgttcttaagcaccaa

SEQ ID NO: 1360993 - DNA, 22 bp, Artificial Sequence
  chemically synthesized
agtaattcctttttatgttggt

SEQ ID NO: 1360994 - DNA, 22 bp, Artificial Sequence
  chemically synthesized
ttaagcaccaacataaaaagga

SEQ ID NO: 1360995 - DNA, 22 bp, Artificial Sequence
  chemically synthesized
aagcaccaacataaaaaggaat

SEQ ID NO: 1360996 - DNA, 22 bp, Artificial Sequence
  chemically synthesized
agcaccaacataaaaaggaatt

SEQ ID NO: 1360997 - DNA, 22 bp, Artificial Sequence
  chemically synthesized
atcaaaggcaaattgagtaatt

SEQ ID NO: 1360998 - DNA, 22 bp, Artificial Sequence
  chemically synthesized
catcaaaggcaaattgagtaat

SEQ ID NO: 1360999 - DNA, 22 bp, Artificial Sequence
  chemically synthesized
tcatcaaaggcaaattgagtaa

SEQ ID NO: 1361000 - DNA, 22 bp, Artificial Sequence
  chemically synthesized
ctcaatttgcctttgatgaaaa

SEQ ID NO: 1361001 - DNA, 22 bp, Artificial Sequence
  chemically synthesized
aatttgcctttgatgaaaatac

SEQ ID NO: 1361002 - DNA, 22 bp, Artificial Sequence
  chemically synthesized
gcctttgatgaaaatacgtggg

SEQ ID NO: 1361003 - DNA, 22 bp, Artificial Sequence
  chemically synthesized
cctttgatgaaaatacgtgggc

SEQ ID NO: 1361004 - DNA, 22 bp, Artificial Sequence
  chemically synthesized
tgatgaaaatacgtgggccatt

SEQ ID NO: 1361005 - DNA, 22 bp, Artificial Sequence
  chemically synthesized
gatgaaaatacgtgggccattc

SEQ ID NO: 1361006 - DNA, 22 bp, Artificial Sequence
  chemically synthesized
atgaaaatacgtgggccattct

SEQ ID NO: 1361007 - DNA, 22 bp, Artificial Sequence
  chemically synthesized
aagaaataagaaagaaaaatca

SEQ ID NO: 1361008 - DNA, 22 bp, Artificial Sequence
  chemically synthesized
tgattttgtgatttttctttct

SEQ ID NO: 1361009 - DNA, 22 bp, Artificial Sequence
  chemically synthesized
attttgtgatttttctttctta

SEQ ID NO: 1361010 - DNA, 22 bp, Artificial Sequence
  chemically synthesized
tgtgatttttctttcttatttc

SEQ ID NO: 1361011 - DNA, 22 bp, Artificial Sequence
  chemically synthesized
gtgatttttctttcttatttct

SEQ ID NO: 1361012 - DNA, 22 bp, Artificial Sequence
  chemically synthesized
tgatttttctttcttatttctt

SEQ ID NO: 1361013 - DNA, 22 bp, Artificial Sequence
  chemically synthesized
tgtgaggaaaaattaaagaaat

SEQ ID NO: 1361014 - DNA, 22 bp, Artificial Sequence
  chemically synthesized
ttctttcttatttctttaattt

SEQ ID NO: 1361015 - DNA, 22 bp, Artificial Sequence
  chemically synthesized
tctttcttatttctttaatttt

SEQ ID NO: 1361016 - DNA, 22 bp, Artificial Sequence
  chemically synthesized
ctttcttatttctttaattttt

SEQ ID NO: 1361017 - DNA, 22 bp, Artificial Sequence
  chemically synthesized
tttcttatttctttaatttttc

SEQ ID NO: 1361018 - DNA, 22 bp, Artificial Sequence
  chemically synthesized
gaagctgtgtgaggaaaaatta

SEQ ID NO: 1361019 - DNA, 22 bp, Artificial Sequence
  chemically synthesized
tcttatttctttaatttttcct

SEQ ID NO: 1361020 - DNA, 22 bp, Artificial Sequence
  chemically synthesized
ggaagctgtgtgaggaaaaatt

SEQ ID NO: 1361021 - DNA, 22 bp, Artificial Sequence
  chemically synthesized
cttatttctttaatttttcctc

SEQ ID NO: 1361022 - DNA, 22 bp, Artificial Sequence
  chemically synthesized
ttatttctttaatttttcctca

SEQ ID NO: 1361023 - DNA, 22 bp, Artificial Sequence
  chemically synthesized
atttctttaatttttcctcaca

SEQ ID NO: 1361024 - DNA, 22 bp, Artificial Sequence
  chemically synthesized
tttctttaatttttcctcacac

SEQ ID NO: 1361025 - DNA, 22 bp, Artificial Sequence
  chemically synthesized
gccttggaagctgtgtgaggaa

SEQ ID NO: 1361026 - DNA, 22 bp, Artificial Sequence
  chemically synthesized
agccttggaagctgtgtgagga

SEQ ID NO: 1361027 - DNA, 22 bp, Artificial Sequence
  chemically synthesized
tagccttggaagctgtgtgagg

SEQ ID NO: 1361028 - DNA, 22 bp, Artificial Sequence
  chemically synthesized
ctttaatttttcctcacacagc

SEQ ID NO: 1361029 - DNA, 22 bp, Artificial Sequence
  chemically synthesized
tttaatttttcctcacacagct

SEQ ID NO: 1361030 - DNA, 22 bp, Artificial Sequence
  chemically synthesized
taatttttcctcacacagcttc

SEQ ID NO: 1361031 - DNA, 22 bp, Artificial Sequence
  chemically synthesized
aatttttcctcacacagcttcc

SEQ ID NO: 1361032 - DNA, 22 bp, Artificial Sequence
  chemically synthesized
atttttcctcacacagcttcca

SEQ ID NO: 1361033 - DNA, 22 bp, Artificial Sequence
  chemically synthesized
ttcctcacacagcttccaaggc

SEQ ID NO: 1361034 - DNA, 22 bp, Artificial Sequence
  chemically synthesized
tcctcacacagcttccaaggct

SEQ ID NO: 1361035 - DNA, 22 bp, Artificial Sequence
  chemically synthesized
cctcacacagcttccaaggcta

SEQ ID NO: 1361036 - DNA, 22 bp, Artificial Sequence
  chemically synthesized
ctcacacagcttccaaggctaa

SEQ ID NO: 1361037 - DNA, 22 bp, Artificial Sequence
  chemically synthesized
caagtgcagattttagccttgg

SEQ ID NO: 1361038 - DNA, 22 bp, Artificial Sequence
  chemically synthesized
acacagcttccaaggctaaaat

SEQ ID NO: 1361039 - DNA, 22 bp, Artificial Sequence
  chemically synthesized
ttacaagtgcagattttagcct

SEQ ID NO: 1361040 - DNA, 22 bp, Artificial Sequence
  chemically synthesized
ccaaggctaaaatctgcacttg

SEQ ID NO: 1361041 - DNA, 22 bp, Artificial Sequence
  chemically synthesized
caaggctaaaatctgcacttgt

SEQ ID NO: 1361042 - DNA, 22 bp, Artificial Sequence
  chemically synthesized
aaatctgcacttgtaacagtgt

SEQ ID NO: 1361043 - DNA, 22 bp, Artificial Sequence
  chemically synthesized
aagggcaagggagtcagtacac

SEQ ID NO: 1361044 - DNA, 22 bp, Artificial Sequence
  chemically synthesized
cacttgtaacagtgtactgact

SEQ ID NO: 1361045 - DNA, 22 bp, Artificial Sequence
  chemically synthesized
aaagggcaagggagtcagtaca

SEQ ID NO: 1361046 - DNA, 22 bp, Artificial Sequence
  chemically synthesized
acttaaagggcaagggagtcag

SEQ ID NO: 1361047 - DNA, 22 bp, Artificial Sequence
  chemically synthesized
gtaacagtgtactgactccctt

SEQ ID NO: 1361048 - DNA, 22 bp, Artificial Sequence
  chemically synthesized
taacagtgtactgactcccttg

SEQ ID NO: 1361049 - DNA, 22 bp, Artificial Sequence
  chemically synthesized
agtgctgacttaaagggcaagg

SEQ ID NO: 1361050 - DNA, 22 bp, Artificial Sequence
  chemically synthesized
agctaagtgctgacttaaaggg

SEQ ID NO: 1361051 - DNA, 22 bp, Artificial Sequence
  chemically synthesized
actcccttgccctttaagtcag

SEQ ID NO: 1361052 - DNA, 22 bp, Artificial Sequence
  chemically synthesized
gcctgagctaagtgctgactta

SEQ ID NO: 1361053 - DNA, 22 bp, Artificial Sequence
  chemically synthesized
agcctgagctaagtgctgactt

SEQ ID NO: 1361054 - DNA, 22 bp, Artificial Sequence
  chemically synthesized
ccttgccctttaagtcagcact

SEQ ID NO: 1361055 - DNA, 22 bp, Artificial Sequence
  chemically synthesized
gccctttaagtcagcacttagc

SEQ ID NO: 1361056 - DNA, 22 bp, Artificial Sequence
  chemically synthesized
ccctttaagtcagcacttagct

SEQ ID NO: 1361057 - DNA, 22 bp, Artificial Sequence
  chemically synthesized
taagtcagcacttagctcaggc

SEQ ID NO: 1361058 - DNA, 22 bp, Artificial Sequence
  chemically synthesized
aagtcagcacttagctcaggct

SEQ ID NO: 1361059 - DNA, 22 bp, Artificial Sequence
  chemically synthesized
caatagtaccttagcctgagct

SEQ ID NO: 1361060 - DNA, 22 bp, Artificial Sequence
  chemically synthesized
agtcagcacttagctcaggcta

SEQ ID NO: 1361061 - DNA, 22 bp, Artificial Sequence
  chemically synthesized
cggttgcaatagtaccttagcc

SEQ ID NO: 1361062 - DNA, 22 bp, Artificial Sequence
  chemically synthesized
agctcaggctaaggtactattg

SEQ ID NO: 1361063 - DNA, 22 bp, Artificial Sequence
  chemically synthesized
gctcaggctaaggtactattgc

SEQ ID NO: 1361064 - DNA, 22 bp, Artificial Sequence
  chemically synthesized
tcagattacggttgcaatagta

SEQ ID NO: 1361065 - DNA, 22 bp, Artificial Sequence
  chemically synthesized
atcagattacggttgcaatagt

SEQ ID NO: 1361066 - DNA, 22 bp, Artificial Sequence
  chemically synthesized
tatcagattacggttgcaatag

SEQ ID NO: 1361067 - DNA, 22 bp, Artificial Sequence
  chemically synthesized
aggctaaggtactattgcaacc

SEQ ID NO: 1361068 - DNA, 22 bp, Artificial Sequence
  chemically synthesized
ctttatcagattacggttgcaa

SEQ ID NO: 1361069 - DNA, 22 bp, Artificial Sequence
  chemically synthesized
cctttatcagattacggttgca

SEQ ID NO: 1361070 - DNA, 22 bp, Artificial Sequence
  chemically synthesized
ttcctttatcagattacggttg

SEQ ID NO: 1361071 - DNA, 22 bp, Artificial Sequence
  chemically synthesized
aggtactattgcaaccgtaatc

SEQ ID NO: 1361072 - DNA, 22 bp, Artificial Sequence
  chemically synthesized
tctcttcctttatcagattacg

SEQ ID NO: 1361073 - DNA, 22 bp, Artificial Sequence
  chemically synthesized
gtctcttcctttatcagattac

SEQ ID NO: 1361074 - DNA, 22 bp, Artificial Sequence
  chemically synthesized
ttgcaaccgtaatctgataaag

SEQ ID NO: 1361075 - DNA, 22 bp, Artificial Sequence
  chemically synthesized
aacttgtctcttcctttatcag

SEQ ID NO: 1361076 - DNA, 22 bp, Artificial Sequence
  chemically synthesized
caaccgtaatctgataaaggaa

SEQ ID NO: 1361077 - DNA, 22 bp, Artificial Sequence
  chemically synthesized
cactcaacttgtctcttccttt

SEQ ID NO: 1361078 - DNA, 22 bp, Artificial Sequence
  chemically synthesized
gcactcaacttgtctcttcctt

SEQ ID NO: 1361079 - DNA, 22 bp, Artificial Sequence
  chemically synthesized
tttgcactcaacttgtctcttc

SEQ ID NO: 1361080 - DNA, 22 bp, Artificial Sequence
  chemically synthesized
atttgcactcaacttgtctctt

SEQ ID NO: 1361081 - DNA, 22 bp, Artificial Sequence
  chemically synthesized
tatttgcactcaacttgtctct

SEQ ID NO: 1361082 - DNA, 22 bp, Artificial Sequence
  chemically synthesized
ataaaggaagagacaagttgag

SEQ ID NO: 1361083 - DNA, 22 bp, Artificial Sequence
  chemically synthesized
atctttatttgcactcaacttg

SEQ ID NO: 1361084 - DNA, 22 bp, Artificial Sequence
  chemically synthesized
gcactcatctttatttgcactc

SEQ ID NO: 1361085 - DNA, 22 bp, Artificial Sequence
  chemically synthesized
ctggcactcatctttatttgca

SEQ ID NO: 1361086 - DNA, 22 bp, Artificial Sequence
  chemically synthesized
attcctggcactcatctttatt

SEQ ID NO: 1361087 - DNA, 22 bp, Artificial Sequence
  chemically synthesized
tcattcctggcactcatcttta

SEQ ID NO: 1361088 - DNA, 22 bp, Artificial Sequence
  chemically synthesized
ctcattcctggcactcatcttt

SEQ ID NO: 1361089 - DNA, 22 bp, Artificial Sequence
  chemically synthesized
tctcattcctggcactcatctt

SEQ ID NO: 1361090 - DNA, 22 bp, Artificial Sequence
  chemically synthesized
ttctcattcctggcactcatct

SEQ ID NO: 1361091 - DNA, 22 bp, Artificial Sequence
  chemically synthesized
agtgcaaataaagatgagtgcc

SEQ ID NO: 1361092 - DNA, 22 bp, Artificial Sequence
  chemically synthesized
tttctcattcctggcactcatc

SEQ ID NO: 1361093 - DNA, 22 bp, Artificial Sequence
  chemically synthesized
ttttctcattcctggcactcat

SEQ ID NO: 1361094 - DNA, 22 bp, Artificial Sequence
  chemically synthesized
taaaagggcataaacatcagta

SEQ ID NO: 1361095 - DNA, 22 bp, Artificial Sequence
  chemically synthesized
ctgatgtttatgcccttttata

SEQ ID NO: 1361096 - DNA, 22 bp, Artificial Sequence
  chemically synthesized
atgtttatgcccttttatagtc

SEQ ID NO: 1361097 - DNA, 22 bp, Artificial Sequence
  chemically synthesized
tcatggaatcaggactataaaa

SEQ ID NO: 1361098 - DNA, 22 bp, Artificial Sequence
  chemically synthesized
atgcccttttatagtcctgatt

SEQ ID NO: 1361099 - DNA, 22 bp, Artificial Sequence
  chemically synthesized
agactgtcatggaatcaggact

SEQ ID NO: 1361100 - DNA, 22 bp, Artificial Sequence
  chemically synthesized
tgcccttttatagtcctgattc

SEQ ID NO: 1361101 - DNA, 22 bp, Artificial Sequence
  chemically synthesized
gctaagactgtcatggaatcag

SEQ ID NO: 1361102 - DNA, 22 bp, Artificial Sequence
  chemically synthesized
ggctaagactgtcatggaatca

SEQ ID NO: 1361103 - DNA, 22 bp, Artificial Sequence
  chemically synthesized
tggctaagactgtcatggaatc

SEQ ID NO: 1361104 - DNA, 22 bp, Artificial Sequence
  chemically synthesized
ttggctaagactgtcatggaat

SEQ ID NO: 1361105 - DNA, 22 bp, Artificial Sequence
  chemically synthesized
ttatagtcctgattccatgaca

SEQ ID NO: 1361106 - DNA, 22 bp, Artificial Sequence
  chemically synthesized
tatagtcctgattccatgacag

SEQ ID NO: 1361107 - DNA, 22 bp, Artificial Sequence
  chemically synthesized
atagtcctgattccatgacagt

SEQ ID NO: 1361108 - DNA, 22 bp, Artificial Sequence
  chemically synthesized
cttttggctaagactgtcatgg

SEQ ID NO: 1361109 - DNA, 22 bp, Artificial Sequence
  chemically synthesized
tagtcctgattccatgacagtc

SEQ ID NO: 1361110 - DNA, 22 bp, Artificial Sequence
  chemically synthesized
tgcttttggctaagactgtcat

SEQ ID NO: 1361111 - DNA, 22 bp, Artificial Sequence
  chemically synthesized
cactctgcttttggctaagact

SEQ ID NO: 1361112 - DNA, 22 bp, Artificial Sequence
  chemically synthesized
ccactctgcttttggctaagac

SEQ ID NO: 1361113 - DNA, 22 bp, Artificial Sequence
  chemically synthesized
attccatgacagtcttagccaa

SEQ ID NO: 1361114 - DNA, 22 bp, Artificial Sequence
  chemically synthesized
ttccactctgcttttggctaag

SEQ ID NO: 1361115 - DNA, 22 bp, Artificial Sequence
  chemically synthesized
cttccactctgcttttggctaa

SEQ ID NO: 1361116 - DNA, 22 bp, Artificial Sequence
  chemically synthesized
catgacagtcttagccaaaagc

SEQ ID NO: 1361117 - DNA, 22 bp, Artificial Sequence
  chemically synthesized
ccttcttccactctgcttttgg

SEQ ID NO: 1361118 - DNA, 22 bp, Artificial Sequence
  chemically synthesized
tcccttcttccactctgctttt

SEQ ID NO: 1361119 - DNA, 22 bp, Artificial Sequence
  chemically synthesized
agccaaaagcagagtggaagaa

SEQ ID NO: 1361120 - DNA, 22 bp, Artificial Sequence
  chemically synthesized
aagcgttctcccttcttccact

SEQ ID NO: 1361121 - DNA, 22 bp, Artificial Sequence
  chemically synthesized
gccaaaagcagagtggaagaag

SEQ ID NO: 1361122 - DNA, 22 bp, Artificial Sequence
  chemically synthesized
aaagcgttctcccttcttccac

SEQ ID NO: 1361123 - DNA, 22 bp, Artificial Sequence
  chemically synthesized
taaagcgttctcccttcttcca

SEQ ID NO: 1361124 - DNA, 22 bp, Artificial Sequence
  chemically synthesized
ttttaaagcgttctcccttctt

SEQ ID NO: 1361125 - DNA, 22 bp, Artificial Sequence
  chemically synthesized
gttttaaagcgttctcccttct

SEQ ID NO: 1361126 - DNA, 22 bp, Artificial Sequence
  chemically synthesized
tgttttaaagcgttctcccttc

SEQ ID NO: 1361127 - DNA, 22 bp, Artificial Sequence
  chemically synthesized
ttttgttttaaagcgttctccc

SEQ ID NO: 1361128 - DNA, 22 bp, Artificial Sequence
  chemically synthesized
gttttgttttaaagcgttctcc

SEQ ID NO: 1361129 - DNA, 22 bp, Artificial Sequence
  chemically synthesized
tgttttgttttaaagcgttctc

SEQ ID NO: 1361130 - DNA, 22 bp, Artificial Sequence
  chemically synthesized
ttttgttttgttttaaagcgtt

SEQ ID NO: 1361131 - DNA, 22 bp, Artificial Sequence
  chemically synthesized
gttttgttttgttttaaagcgt

SEQ ID NO: 1361132 - DNA, 22 bp, Artificial Sequence
  chemically synthesized
tgttttgttttgttttaaagcg

SEQ ID NO: 1361133 - DNA, 22 bp, Artificial Sequence
  chemically synthesized
ttgttttgttttgttttaaagc

SEQ ID NO: 1361134 - DNA, 22 bp, Artificial Sequence
  chemically synthesized
gcttttgttttgttttgtttta

SEQ ID NO: 1361135 - DNA, 22 bp, Artificial Sequence
  chemically synthesized
ggcttttgttttgttttgtttt

SEQ ID NO: 1361136 - DNA, 22 bp, Artificial Sequence
  chemically synthesized
ttggcttttgttttgttttgtt

SEQ ID NO: 1361137 - DNA, 22 bp, Artificial Sequence
  chemically synthesized
cttggcttttgttttgttttgt

SEQ ID NO: 1361138 - DNA, 22 bp, Artificial Sequence
  chemically synthesized
ttcttggcttttgttttgtttt

SEQ ID NO: 1361139 - DNA, 22 bp, Artificial Sequence
  chemically synthesized
ccctcttcttggcttttgtttt

SEQ ID NO: 1361140 - DNA, 22 bp, Artificial Sequence
  chemically synthesized
taaaacaaaacaaaacaaaagc

SEQ ID NO: 1361141 - DNA, 22 bp, Artificial Sequence
  chemically synthesized
accctcttcttggcttttgttt

SEQ ID NO: 1361142 - DNA, 22 bp, Artificial Sequence
  chemically synthesized
aaaacaaaacaaaacaaaagcc

SEQ ID NO: 1361143 - DNA, 22 bp, Artificial Sequence
  chemically synthesized
taccctcttcttggcttttgtt

SEQ ID NO: 1361144 - DNA, 22 bp, Artificial Sequence
  chemically synthesized
aaacaaaacaaaacaaaagcca

SEQ ID NO: 1361145 - DNA, 22 bp, Artificial Sequence
  chemically synthesized
ttaccctcttcttggcttttgt

SEQ ID NO: 1361146 - DNA, 22 bp, Artificial Sequence
  chemically synthesized
aatgtttttaccctcttcttgg

SEQ ID NO: 1361147 - DNA, 22 bp, Artificial Sequence
  chemically synthesized
aaatgtttttaccctcttcttg

SEQ ID NO: 1361148 - DNA, 22 bp, Artificial Sequence
  chemically synthesized
taaatgtttttaccctcttctt

SEQ ID NO: 1361149 - DNA, 22 bp, Artificial Sequence
  chemically synthesized
ccctttaaatgtttttaccctc

SEQ ID NO: 1361150 - DNA, 22 bp, Artificial Sequence
  chemically synthesized
accctttaaatgtttttaccct

SEQ ID NO: 1361151 - DNA, 22 bp, Artificial Sequence
  chemically synthesized
tgggcaaataaaatgcttaccc

SEQ ID NO: 1361152 - DNA, 22 bp, Artificial Sequence
  chemically synthesized
caattatgggcaaataaaatgc

SEQ ID NO: 1361153 - DNA, 22 bp, Artificial Sequence
  chemically synthesized
ccaattatgggcaaataaaatg

SEQ ID NO: 1361154 - DNA, 22 bp, Artificial Sequence
  chemically synthesized
aaagggtaagcattttatttgc

SEQ ID NO: 1361155 - DNA, 22 bp, Artificial Sequence
  chemically synthesized
aagggtaagcattttatttgcc

SEQ ID NO: 1361156 - DNA, 22 bp, Artificial Sequence
  chemically synthesized
tttccaattatgggcaaataaa

SEQ ID NO: 1361157 - DNA, 22 bp, Artificial Sequence
  chemically synthesized
tatttgcccataattggaaata

SEQ ID NO: 1361158 - DNA, 22 bp, Artificial Sequence
  chemically synthesized
atttgcccataattggaaataa

SEQ ID NO: 1361159 - DNA, 22 bp, Artificial Sequence
  chemically synthesized
cggtgtcccatattatttccaa

SEQ ID NO: 1361160 - DNA, 22 bp, Artificial Sequence
  chemically synthesized
tttgcccataattggaaataat

SEQ ID NO: 1361161 - DNA, 22 bp, Artificial Sequence
  chemically synthesized
gcccataattggaaataatatg

SEQ ID NO: 1361162 - DNA, 22 bp, Artificial Sequence
  chemically synthesized
cccataattggaaataatatgg

SEQ ID NO: 1361163 - DNA, 22 bp, Artificial Sequence
  chemically synthesized
ccattacggtgtcccatattat

SEQ ID NO: 1361164 - DNA, 22 bp, Artificial Sequence
  chemically synthesized
gaaataatatgggacaccgtaa

SEQ ID NO: 1361165 - DNA, 22 bp, Artificial Sequence
  chemically synthesized
agcacaattaccattacggtgt

SEQ ID NO: 1361166 - DNA, 22 bp, Artificial Sequence
  chemically synthesized
gctgagcacaattaccattacg

SEQ ID NO: 1361167 - DNA, 22 bp, Artificial Sequence
  chemically synthesized
aaaaaggtcagtgttagctgag

SEQ ID NO: 1361168 - DNA, 22 bp, Artificial Sequence
  chemically synthesized
aaaaaaggtcagtgttagctga

SEQ ID NO: 1361169 - DNA, 22 bp, Artificial Sequence
  chemically synthesized
taaaaaaggtcagtgttagctg

SEQ ID NO: 1361170 - DNA, 22 bp, Artificial Sequence
  chemically synthesized
ttaaaaaaggtcagtgttagct

SEQ ID NO: 1361171 - DNA, 22 bp, Artificial Sequence
  chemically synthesized
atttttaaaaaaggtcagtgtt

SEQ ID NO: 1361172 - DNA, 22 bp, Artificial Sequence
  chemically synthesized
gatttttaaaaaaggtcagtgt

SEQ ID NO: 1361173 - DNA, 22 bp, Artificial Sequence
  chemically synthesized
tgatttttaaaaaaggtcagtg

SEQ ID NO: 1361174 - DNA, 22 bp, Artificial Sequence
  chemically synthesized
tgctcagctaacactgaccttt

SEQ ID NO: 1361175 - DNA, 22 bp, Artificial Sequence
  chemically synthesized
agctaacactgaccttttttaa

SEQ ID NO: 1361176 - DNA, 22 bp, Artificial Sequence
  chemically synthesized
acactgaccttttttaaaaatc

SEQ ID NO: 1361177 - DNA, 22 bp, Artificial Sequence
  chemically synthesized
tcatgaaaattttgatttttaa

SEQ ID NO: 1361178 - DNA, 22 bp, Artificial Sequence
  chemically synthesized
actatcatgaaaattttgattt

SEQ ID NO: 1361179 - DNA, 22 bp, Artificial Sequence
  chemically synthesized
accttttttaaaaatcaaaatt

SEQ ID NO: 1361180 - DNA, 22 bp, Artificial Sequence
  chemically synthesized
cactatcatgaaaattttgatt

SEQ ID NO: 1361181 - DNA, 22 bp, Artificial Sequence
  chemically synthesized
tcttcactatcatgaaaatttt

SEQ ID NO: 1361182 - DNA, 22 bp, Artificial Sequence
  chemically synthesized
ttttaaaaatcaaaattttcat

SEQ ID NO: 1361183 - DNA, 22 bp, Artificial Sequence
  chemically synthesized
tttaaaaatcaaaattttcatg

SEQ ID NO: 1361184 - DNA, 22 bp, Artificial Sequence
  chemically synthesized
ttaaaaatcaaaattttcatga

SEQ ID NO: 1361185 - DNA, 22 bp, Artificial Sequence
  chemically synthesized
taaaaatcaaaattttcatgat

SEQ ID NO: 1361186 - DNA, 22 bp, Artificial Sequence
  chemically synthesized
aaaaatcaaaattttcatgata

SEQ ID NO: 1361187 - DNA, 22 bp, Artificial Sequence
  chemically synthesized
aaaatcaaaattttcatgatag

SEQ ID NO: 1361188 - DNA, 22 bp, Artificial Sequence
  chemically synthesized
aatgtgttgtcttcactatcat

SEQ ID NO: 1361189 - DNA, 22 bp, Artificial Sequence
  chemically synthesized
aaatgtgttgtcttcactatca

SEQ ID NO: 1361190 - DNA, 22 bp, Artificial Sequence
  chemically synthesized
taaatgtgttgtcttcactatc

SEQ ID NO: 1361191 - DNA, 22 bp, Artificial Sequence
  chemically synthesized
ttaaatgtgttgtcttcactat

SEQ ID NO: 1361192 - DNA, 22 bp, Artificial Sequence
  chemically synthesized
tcatgatagtgaagacaacaca

SEQ ID NO: 1361193 - DNA, 22 bp, Artificial Sequence
  chemically synthesized
tcaacttttaaatgtgttgtct

SEQ ID NO: 1361194 - DNA, 22 bp, Artificial Sequence
  chemically synthesized
catgatagtgaagacaacacat

SEQ ID NO: 1361195 - DNA, 22 bp, Artificial Sequence
  chemically synthesized
gtcaacttttaaatgtgttgtc

SEQ ID NO: 1361196 - DNA, 22 bp, Artificial Sequence
  chemically synthesized
atgatagtgaagacaacacatt

SEQ ID NO: 1361197 - DNA, 22 bp, Artificial Sequence
  chemically synthesized
atttgtcaacttttaaatgtgt

SEQ ID NO: 1361198 - DNA, 22 bp, Artificial Sequence
  chemically synthesized
ctaatttgtcaacttttaaatg

SEQ ID NO: 1361199 - DNA, 22 bp, Artificial Sequence
  chemically synthesized
gctaatttgtcaacttttaaat

SEQ ID NO: 1361200 - DNA, 22 bp, Artificial Sequence
  chemically synthesized
ttgctaatttgtcaacttttaa

SEQ ID NO: 1361201 - DNA, 22 bp, Artificial Sequence
  chemically synthesized
aaaagttgacaaattagcaaga

SEQ ID NO: 1361202 - DNA, 22 bp, Artificial Sequence
  chemically synthesized
aaagttgacaaattagcaagag

SEQ ID NO: 1361203 - DNA, 22 bp, Artificial Sequence
  chemically synthesized
acatatatatcacgaagtctct

SEQ ID NO: 1361204 - DNA, 22 bp, Artificial Sequence
  chemically synthesized
acaaattagcaagagacttcgt

SEQ ID NO: 1361205 - DNA, 22 bp, Artificial Sequence
  chemically synthesized
gcaagagacttcgtgatatata

SEQ ID NO: 1361206 - DNA, 22 bp, Artificial Sequence
  chemically synthesized
cgtgatatatatgtgaattcct

SEQ ID NO: 1361207 - DNA, 22 bp, Artificial Sequence
  chemically synthesized
gtgatatatatgtgaattcctc

SEQ ID NO: 1361208 - DNA, 22 bp, Artificial Sequence
  chemically synthesized
ctcattgttgatatgcccatgt

SEQ ID NO: 1361209 - DNA, 22 bp, Artificial Sequence
  chemically synthesized
attgttgatatgcccatgtatg

SEQ ID NO: 1361210 - DNA, 22 bp, Artificial Sequence
  chemically synthesized
ataaatatgaaaaccatacatg

SEQ ID NO: 1361211 - DNA, 22 bp, Artificial Sequence
  chemically synthesized
aataaatatgaaaaccatacat

SEQ ID NO: 1361212 - DNA, 22 bp, Artificial Sequence
  chemically synthesized
ttgatatgcccatgtatggttt

SEQ ID NO: 1361213 - DNA, 22 bp, Artificial Sequence
  chemically synthesized
atatgcccatgtatggttttca

SEQ ID NO: 1361214 - DNA, 22 bp, Artificial Sequence
  chemically synthesized
tatttaataaatatgaaaacca

SEQ ID NO: 1361215 - DNA, 22 bp, Artificial Sequence
  chemically synthesized
atatttaataaatatgaaaacc

SEQ ID NO: 1361216 - DNA, 22 bp, Artificial Sequence
  chemically synthesized
tttatatttaataaatatgaaa

SEQ ID NO: 1361217 - DNA, 22 bp, Artificial Sequence
  chemically synthesized
gtttatatttaataaatatgaa

SEQ ID NO: 1361218 - DNA, 22 bp, Artificial Sequence
  chemically synthesized
tgtttatatttaataaatatga

SEQ ID NO: 1361219 - DNA, 22 bp, Artificial Sequence
  chemically synthesized
ttgtttatatttaataaatatg

SEQ ID NO: 1361220 - DNA, 22 bp, Artificial Sequence
  chemically synthesized
tttgtttatatttaataaatat

SEQ ID NO: 1361221 - DNA, 22 bp, Artificial Sequence
  chemically synthesized
tcatatttattaaatataaaca

SEQ ID NO: 1361222 - DNA, 22 bp, Artificial Sequence
  chemically synthesized
catatttattaaatataaacaa

SEQ ID NO: 1361223 - DNA, 22 bp, Artificial Sequence
  chemically synthesized
atatttattaaatataaacaaa

SEQ ID NO: 1361224 - DNA, 22 bp, Artificial Sequence
  chemically synthesized
gaatcatgatgttttttgttta

SEQ ID NO: 1361225 - DNA, 22 bp, Artificial Sequence
  chemically synthesized
attaaatataaacaaaaaacat

SEQ ID NO: 1361226 - DNA, 22 bp, Artificial Sequence
  chemically synthesized
ttaaatataaacaaaaaacatc

SEQ ID NO: 1361227 - DNA, 22 bp, Artificial Sequence
  chemically synthesized
aatataaacaaaaaacatcatg

SEQ ID NO: 1361228 - DNA, 22 bp, Artificial Sequence
  chemically synthesized
aaaaaatcagatgctcgaatca

SEQ ID NO: 1361229 - DNA, 22 bp, Artificial Sequence
  chemically synthesized
caaaaaatcagatgctcgaatc

SEQ ID NO: 1361230 - DNA, 22 bp, Artificial Sequence
  chemically synthesized
aagaaacttcaaaaaatcagat

SEQ ID NO: 1361231 - DNA, 22 bp, Artificial Sequence
  chemically synthesized
aaagaaacttcaaaaaatcaga

SEQ ID NO: 1361232 - DNA, 22 bp, Artificial Sequence
  chemically synthesized
taaagaaacttcaaaaaatcag

SEQ ID NO: 1361233 - DNA, 22 bp, Artificial Sequence
  chemically synthesized
gagcatctgattttttgaagtt

SEQ ID NO: 1361234 - DNA, 22 bp, Artificial Sequence
  chemically synthesized
agataattttaaagaaacttca

SEQ ID NO: 1361235 - DNA, 22 bp, Artificial Sequence
  chemically synthesized
attttttgaagtttctttaaaa

SEQ ID NO: 1361236 - DNA, 22 bp, Artificial Sequence
  chemically synthesized
tttgaagtttctttaaaattat

SEQ ID NO: 1361237 - DNA, 22 bp, Artificial Sequence
  chemically synthesized
gagaggattaagataattttaa

SEQ ID NO: 1361238 - DNA, 22 bp, Artificial Sequence
  chemically synthesized
ttgaagtttctttaaaattatc

SEQ ID NO: 1361239 - DNA, 22 bp, Artificial Sequence
  chemically synthesized
ggagaggattaagataatttta

SEQ ID NO: 1361240 - DNA, 22 bp, Artificial Sequence
  chemically synthesized
tgaagtttctttaaaattatct

SEQ ID NO: 1361241 - DNA, 22 bp, Artificial Sequence
  chemically synthesized
tggagaggattaagataatttt

SEQ ID NO: 1361242 - DNA, 22 bp, Artificial Sequence
  chemically synthesized
gaagtttctttaaaattatctt

SEQ ID NO: 1361243 - DNA, 22 bp, Artificial Sequence
  chemically synthesized
aagtttctttaaaattatctta

SEQ ID NO: 1361244 - DNA, 22 bp, Artificial Sequence
  chemically synthesized
ctttaaaattatcttaatcctc

SEQ ID NO: 1361245 - DNA, 22 bp, Artificial Sequence
  chemically synthesized
atgggttttggagaggattaag

SEQ ID NO: 1361246 - DNA, 22 bp, Artificial Sequence
  chemically synthesized
tttaaaattatcttaatcctct

SEQ ID NO: 1361247 - DNA, 22 bp, Artificial Sequence
  chemically synthesized
aatgggttttggagaggattaa

SEQ ID NO: 1361248 - DNA, 22 bp, Artificial Sequence
  chemically synthesized
taaaattatcttaatcctctcc

SEQ ID NO: 1361249 - DNA, 22 bp, Artificial Sequence
  chemically synthesized
aaaattatcttaatcctctcca

SEQ ID NO: 1361250 - DNA, 22 bp, Artificial Sequence
  chemically synthesized
aaattatcttaatcctctccaa

SEQ ID NO: 1361251 - DNA, 22 bp, Artificial Sequence
  chemically synthesized
tcttaatcctctccaaaaccca

SEQ ID NO: 1361252 - DNA, 22 bp, Artificial Sequence
  chemically synthesized
aatcctctccaaaacccattaa

SEQ ID NO: 1361253 - DNA, 22 bp, Artificial Sequence
  chemically synthesized
atcctctccaaaacccattaag

SEQ ID NO: 1361254 - DNA, 22 bp, Artificial Sequence
  chemically synthesized
tccaaaacccattaagccatct

SEQ ID NO: 1361255 - DNA, 22 bp, Artificial Sequence
  chemically synthesized
caaaacccattaagccatctac

SEQ ID NO: 1361256 - DNA, 22 bp, Artificial Sequence
  chemically synthesized
tccatgtaatgaaatgagaatg

SEQ ID NO: 1361257 - DNA, 22 bp, Artificial Sequence
  chemically synthesized
atccatgtaatgaaatgagaat

SEQ ID NO: 1361258 - DNA, 22 bp, Artificial Sequence
  chemically synthesized
agccatctacattctcatttca

SEQ ID NO: 1361259 - DNA, 22 bp, Artificial Sequence
  chemically synthesized
cattctcatttcattacatgga

SEQ ID NO: 1361260 - DNA, 22 bp, Artificial Sequence
  chemically synthesized
aagccaatgcttatccatgtaa

SEQ ID NO: 1361261 - DNA, 22 bp, Artificial Sequence
  chemically synthesized
ttaaagccaatgcttatccatg

SEQ ID NO: 1361262 - DNA, 22 bp, Artificial Sequence
  chemically synthesized
tcatttcattacatggataagc

SEQ ID NO: 1361263 - DNA, 22 bp, Artificial Sequence
  chemically synthesized
atttcattacatggataagcat

SEQ ID NO: 1361264 - DNA, 22 bp, Artificial Sequence
  chemically synthesized
cattacatggataagcattggc

SEQ ID NO: 1361265 - DNA, 22 bp, Artificial Sequence
  chemically synthesized
attacatggataagcattggct

SEQ ID NO: 1361266 - DNA, 22 bp, Artificial Sequence
  chemically synthesized
aaatgcattattaaagccaatg

SEQ ID NO: 1361267 - DNA, 22 bp, Artificial Sequence
  chemically synthesized
catggataagcattggctttaa

SEQ ID NO: 1361268 - DNA, 22 bp, Artificial Sequence
  chemically synthesized
gctttaataatgcattttaatg

SEQ ID NO: 1361269 - DNA, 22 bp, Artificial Sequence
  chemically synthesized
taataatgcattttaatgtacc

SEQ ID NO: 1361270 - DNA, 22 bp, Artificial Sequence
  chemically synthesized
aataatgcattttaatgtacct

SEQ ID NO: 1361271 - DNA, 22 bp, Artificial Sequence
  chemically synthesized
ataatgcattttaatgtacctc

SEQ ID NO: 1361272 - DNA, 22 bp, Artificial Sequence
  chemically synthesized
tgtcaacgaagaggaggtacat

SEQ ID NO: 1361273 - DNA, 22 bp, Artificial Sequence
  chemically synthesized
taatgtacctcctcttcgttga

SEQ ID NO: 1361274 - DNA, 22 bp, Artificial Sequence
  chemically synthesized
aatgtacctcctcttcgttgac

SEQ ID NO: 1361275 - DNA, 22 bp, Artificial Sequence
  chemically synthesized
atgtacctcctcttcgttgaca

SEQ ID NO: 1361276 - DNA, 22 bp, Artificial Sequence
  chemically synthesized
gtagaaaaatgtggttgtgtca

SEQ ID NO: 1361277 - DNA, 22 bp, Artificial Sequence
  chemically synthesized
agtagaaaaatgtggttgtgtc

SEQ ID NO: 1361278 - DNA, 22 bp, Artificial Sequence
  chemically synthesized
tagtagaaaaatgtggttgtgt

SEQ ID NO: 1361279 - DNA, 22 bp, Artificial Sequence
  chemically synthesized
ctcttcgttgacacaaccacat

SEQ ID NO: 1361280 - DNA, 22 bp, Artificial Sequence
  chemically synthesized
ttttagtagaaaaatgtggttg

SEQ ID NO: 1361281 - DNA, 22 bp, Artificial Sequence
  chemically synthesized
attttagtagaaaaatgtggtt

SEQ ID NO: 1361282 - DNA, 22 bp, Artificial Sequence
  chemically synthesized
ttcgttgacacaaccacatttt

SEQ ID NO: 1361283 - DNA, 22 bp, Artificial Sequence
  chemically synthesized
cgttgacacaaccacatttttc

SEQ ID NO: 1361284 - DNA, 22 bp, Artificial Sequence
  chemically synthesized
tttattttagtagaaaaatgtg

SEQ ID NO: 1361285 - DNA, 22 bp, Artificial Sequence
  chemically synthesized
gttgacacaaccacatttttct

SEQ ID NO: 1361286 - DNA, 22 bp, Artificial Sequence
  chemically synthesized
gttatttattttagtagaaaaa

SEQ ID NO: 1361287 - DNA, 22 bp, Artificial Sequence
  chemically synthesized
acacaaccacatttttctacta

SEQ ID NO: 1361288 - DNA, 22 bp, Artificial Sequence
  chemically synthesized
agttatttattttagtagaaaa

SEQ ID NO: 1361289 - DNA, 22 bp, Artificial Sequence
  chemically synthesized
gtttagttatttattttagtag

SEQ ID NO: 1361290 - DNA, 22 bp, Artificial Sequence
  chemically synthesized
agtttagttatttattttagta

SEQ ID NO: 1361291 - DNA, 22 bp, Artificial Sequence
  chemically synthesized
tagtttagttatttattttagt

SEQ ID NO: 1361292 - DNA, 22 bp, Artificial Sequence
  chemically synthesized
attttagtttagttatttattt

SEQ ID NO: 1361293 - DNA, 22 bp, Artificial Sequence
  chemically synthesized
ttcattttagtttagttattta

SEQ ID NO: 1361294 - DNA, 22 bp, Artificial Sequence
  chemically synthesized
ttctactaaaataaataactaa

SEQ ID NO: 1361295 - DNA, 22 bp, Artificial Sequence
  chemically synthesized
tctactaaaataaataactaaa

SEQ ID NO: 1361296 - DNA, 22 bp, Artificial Sequence
  chemically synthesized
ctactaaaataaataactaaac

SEQ ID NO: 1361297 - DNA, 22 bp, Artificial Sequence
  chemically synthesized
ttattcattttagtttagttat

SEQ ID NO: 1361298 - DNA, 22 bp, Artificial Sequence
  chemically synthesized
tactaaaataaataactaaact

SEQ ID NO: 1361299 - DNA, 22 bp, Artificial Sequence
  chemically synthesized
attattcattttagtttagtta

SEQ ID NO: 1361300 - DNA, 22 bp, Artificial Sequence
  chemically synthesized
ctaaaataaataactaaactaa

SEQ ID NO: 1361301 - DNA, 22 bp, Artificial Sequence
  chemically synthesized
tttattattcattttagtttag

SEQ ID NO: 1361302 - DNA, 22 bp, Artificial Sequence
  chemically synthesized
gtttattattcattttagttta

SEQ ID NO: 1361303 - DNA, 22 bp, Artificial Sequence
  chemically synthesized
aaataaataactaaactaaaat

SEQ ID NO: 1361304 - DNA, 22 bp, Artificial Sequence
  chemically synthesized
tgtttattattcattttagttt

SEQ ID NO: 1361305 - DNA, 22 bp, Artificial Sequence
  chemically synthesized
ttgtttattattcattttagtt

SEQ ID NO: 1361306 - DNA, 22 bp, Artificial Sequence
  chemically synthesized
tttttgtttattattcatttta

SEQ ID NO: 1361307 - DNA, 22 bp, Artificial Sequence
  chemically synthesized
atttttgtttattattcatttt

SEQ ID NO: 1361308 - DNA, 22 bp, Artificial Sequence
  chemically synthesized
tatttttgtttattattcattt

SEQ ID NO: 1361309 - DNA, 22 bp, Artificial Sequence
  chemically synthesized
cctttatttttgtttattattc

SEQ ID NO: 1361310 - DNA, 22 bp, Artificial Sequence
  chemically synthesized
gcctttatttttgtttattatt

SEQ ID NO: 1361311 - DNA, 22 bp, Artificial Sequence
  chemically synthesized
tgcctttatttttgtttattat

SEQ ID NO: 1361312 - DNA, 22 bp, Artificial Sequence
  chemically synthesized
aactaaaatgaataataaacaa

SEQ ID NO: 1361313 - DNA, 22 bp, Artificial Sequence
  chemically synthesized
aaatgaataataaacaaaaata

SEQ ID NO: 1361314 - DNA, 22 bp, Artificial Sequence
  chemically synthesized
aggaagagctttgcctttattt

SEQ ID NO: 1361315 - DNA, 22 bp, Artificial Sequence
  chemically synthesized
aataaaagaatctgaggaagag

SEQ ID NO: 1361316 - DNA, 22 bp, Artificial Sequence
  chemically synthesized
gaataaaagaatctgaggaaga

SEQ ID NO: 1361317 - DNA, 22 bp, Artificial Sequence
  chemically synthesized
ccatttgaataaaagaatctga

SEQ ID NO: 1361318 - DNA, 22 bp, Artificial Sequence
  chemically synthesized
attgccatttgaataaaagaat

SEQ ID NO: 1361319 - DNA, 22 bp, Artificial Sequence
  chemically synthesized
ttcctcagattcttttattcaa

SEQ ID NO: 1361320 - DNA, 22 bp, Artificial Sequence
  chemically synthesized
cctcagattcttttattcaaat

SEQ ID NO: 1361321 - DNA, 22 bp, Artificial Sequence
  chemically synthesized
ctcagattcttttattcaaatg

SEQ ID NO: 1361322 - DNA, 22 bp, Artificial Sequence
  chemically synthesized
agattcttttattcaaatggca

SEQ ID NO: 1361323 - DNA, 22 bp, Artificial Sequence
  chemically synthesized
ttttattcaaatggcaattaga

SEQ ID NO: 1361324 - DNA, 22 bp, Artificial Sequence
  chemically synthesized
ttattcaaatggcaattagacc

SEQ ID NO: 1361325 - DNA, 22 bp, Artificial Sequence
  chemically synthesized
tattcaaatggcaattagacct

SEQ ID NO: 1361326 - DNA, 22 bp, Artificial Sequence
  chemically synthesized
attcaaatggcaattagaccta

SEQ ID NO: 1361327 - DNA, 22 bp, Artificial Sequence
  chemically synthesized
gtgaataatatgtaggtctaat

SEQ ID NO: 1361328 - DNA, 22 bp, Artificial Sequence
  chemically synthesized
ttcaaatggcaattagacctac

SEQ ID NO: 1361329 - DNA, 22 bp, Artificial Sequence
  chemically synthesized
aaatggcaattagacctacata

SEQ ID NO: 1361330 - DNA, 22 bp, Artificial Sequence
  chemically synthesized
agactggtgaataatatgtagg

SEQ ID NO: 1361331 - DNA, 22 bp, Artificial Sequence
  chemically synthesized
gacctacatattattcaccagt

SEQ ID NO: 1361332 - DNA, 22 bp, Artificial Sequence
  chemically synthesized
aaatatatctaagactggtgaa

SEQ ID NO: 1361333 - DNA, 22 bp, Artificial Sequence
  chemically synthesized
catattattcaccagtcttaga

SEQ ID NO: 1361334 - DNA, 22 bp, Artificial Sequence
  chemically synthesized
gaaatctgaaatatatctaaga

SEQ ID NO: 1361335 - DNA, 22 bp, Artificial Sequence
  chemically synthesized
ggaaatctgaaatatatctaag

SEQ ID NO: 1361336 - DNA, 22 bp, Artificial Sequence
  chemically synthesized
ttcaccagtcttagatatattt

SEQ ID NO: 1361337 - DNA, 22 bp, Artificial Sequence
  chemically synthesized
accagtcttagatatatttcag

SEQ ID NO: 1361338 - DNA, 22 bp, Artificial Sequence
  chemically synthesized
atgccaatttggaaatctgaaa

SEQ ID NO: 1361339 - DNA, 22 bp, Artificial Sequence
  chemically synthesized
tcatgccaatttggaaatctga

SEQ ID NO: 1361340 - DNA, 22 bp, Artificial Sequence
  chemically synthesized
ctcatgccaatttggaaatctg

SEQ ID NO: 1361341 - DNA, 22 bp, Artificial Sequence
  chemically synthesized
tctcatgccaatttggaaatct

SEQ ID NO: 1361342 - DNA, 22 bp, Artificial Sequence
  chemically synthesized
agatatatttcagatttccaaa

SEQ ID NO: 1361343 - DNA, 22 bp, Artificial Sequence
  chemically synthesized
gatatatttcagatttccaaat

SEQ ID NO: 1361344 - DNA, 22 bp, Artificial Sequence
  chemically synthesized
attttctcatgccaatttggaa

SEQ ID NO: 1361345 - DNA, 22 bp, Artificial Sequence
  chemically synthesized
cagatttccaaattggcatgag

SEQ ID NO: 1361346 - DNA, 22 bp, Artificial Sequence
  chemically synthesized
agatttccaaattggcatgaga

SEQ ID NO: 1361347 - DNA, 22 bp, Artificial Sequence
  chemically synthesized
atgaattgattttctcatgcca

SEQ ID NO: 1361348 - DNA, 22 bp, Artificial Sequence
  chemically synthesized
ccaaattggcatgagaaaatca

SEQ ID NO: 1361349 - DNA, 22 bp, Artificial Sequence
  chemically synthesized
caaattggcatgagaaaatcaa

SEQ ID NO: 1361350 - DNA, 22 bp, Artificial Sequence
  chemically synthesized
gcaaattgatgaattgattttc

SEQ ID NO: 1361351 - DNA, 22 bp, Artificial Sequence
  chemically synthesized
gcatgagaaaatcaattcatca

SEQ ID NO: 1361352 - DNA, 22 bp, Artificial Sequence
  chemically synthesized
aaaatgctagcaaattgatgaa

SEQ ID NO: 1361353 - DNA, 22 bp, Artificial Sequence
  chemically synthesized
tccataaattaaaaatgctagc

SEQ ID NO: 1361354 - DNA, 22 bp, Artificial Sequence
  chemically synthesized
atcaatttgctagcatttttaa

SEQ ID NO: 1361355 - DNA, 22 bp, Artificial Sequence
  chemically synthesized
gctagcatttttaatttatgga

SEQ ID NO: 1361356 - DNA, 22 bp, Artificial Sequence
  chemically synthesized
agaaaataattgtccataaatt

SEQ ID NO: 1361357 - DNA, 22 bp, Artificial Sequence
  chemically synthesized
ctagcatttttaatttatggac

SEQ ID NO: 1361358 - DNA, 22 bp, Artificial Sequence
  chemically synthesized
aagaaaataattgtccataaat

SEQ ID NO: 1361359 - DNA, 22 bp, Artificial Sequence
  chemically synthesized
taagaaaataattgtccataaa

SEQ ID NO: 1361360 - DNA, 22 bp, Artificial Sequence
  chemically synthesized
gcatttttaatttatggacaat

SEQ ID NO: 1361361 - DNA, 22 bp, Artificial Sequence
  chemically synthesized
ttaatttatggacaattatttt

SEQ ID NO: 1361362 - DNA, 22 bp, Artificial Sequence
  chemically synthesized
taatttatggacaattattttc

SEQ ID NO: 1361363 - DNA, 22 bp, Artificial Sequence
  chemically synthesized
aatttatggacaattattttct

SEQ ID NO: 1361364 - DNA, 22 bp, Artificial Sequence
  chemically synthesized
cataccattttaagaaaataat

SEQ ID NO: 1361365 - DNA, 22 bp, Artificial Sequence
  chemically synthesized
atttatggacaattattttctt

SEQ ID NO: 1361366 - DNA, 22 bp, Artificial Sequence
  chemically synthesized
attacataccattttaagaaaa

SEQ ID NO: 1361367 - DNA, 22 bp, Artificial Sequence
  chemically synthesized
atggacaattattttcttaaaa

SEQ ID NO: 1361368 - DNA, 22 bp, Artificial Sequence
  chemically synthesized
gattacataccattttaagaaa

SEQ ID NO: 1361369 - DNA, 22 bp, Artificial Sequence
  chemically synthesized
tggacaattattttcttaaaat

SEQ ID NO: 1361370 - DNA, 22 bp, Artificial Sequence
  chemically synthesized
tgattacataccattttaagaa

SEQ ID NO: 1361371 - DNA, 22 bp, Artificial Sequence
  chemically synthesized
agtattttgattacataccatt

SEQ ID NO: 1361372 - DNA, 22 bp, Artificial Sequence
  chemically synthesized
ttttcttaaaatggtatgtaat

SEQ ID NO: 1361373 - DNA, 22 bp, Artificial Sequence
  chemically synthesized
actcagtattttgattacatac

SEQ ID NO: 1361374 - DNA, 22 bp, Artificial Sequence
  chemically synthesized
aactcagtattttgattacata

SEQ ID NO: 1361375 - DNA, 22 bp, Artificial Sequence
  chemically synthesized
tcttaaaatggtatgtaatcaa

SEQ ID NO: 1361376 - DNA, 22 bp, Artificial Sequence
  chemically synthesized
taactcagtattttgattacat

SEQ ID NO: 1361377 - DNA, 22 bp, Artificial Sequence
  chemically synthesized
cttaaaatggtatgtaatcaaa

SEQ ID NO: 1361378 - DNA, 22 bp, Artificial Sequence
  chemically synthesized
ttaactcagtattttgattaca

SEQ ID NO: 1361379 - DNA, 22 bp, Artificial Sequence
  chemically synthesized
ttaaaatggtatgtaatcaaaa

SEQ ID NO: 1361380 - DNA, 22 bp, Artificial Sequence
  chemically synthesized
aaaatggtatgtaatcaaaata

SEQ ID NO: 1361381 - DNA, 22 bp, Artificial Sequence
  chemically synthesized
aaatggtatgtaatcaaaatac

SEQ ID NO: 1361382 - DNA, 22 bp, Artificial Sequence
  chemically synthesized
agaatttttaactcagtatttt

SEQ ID NO: 1361383 - DNA, 22 bp, Artificial Sequence
  chemically synthesized
cagaatttttaactcagtattt

SEQ ID NO: 1361384 - DNA, 22 bp, Artificial Sequence
  chemically synthesized
tcagaatttttaactcagtatt

SEQ ID NO: 1361385 - DNA, 22 bp, Artificial Sequence
  chemically synthesized
tttcagaatttttaactcagta

SEQ ID NO: 1361386 - DNA, 22 bp, Artificial Sequence
  chemically synthesized
aatgactctttcagaattttta

SEQ ID NO: 1361387 - DNA, 22 bp, Artificial Sequence
  chemically synthesized
aaatgactctttcagaattttt

SEQ ID NO: 1361388 - DNA, 22 bp, Artificial Sequence
  chemically synthesized
ttaaatgactctttcagaattt

SEQ ID NO: 1361389 - DNA, 22 bp, Artificial Sequence
  chemically synthesized
ttcttaaatgactctttcagaa

SEQ ID NO: 1361390 - DNA, 22 bp, Artificial Sequence
  chemically synthesized
agttaaaaattctgaaagagtc

SEQ ID NO: 1361391 - DNA, 22 bp, Artificial Sequence
  chemically synthesized
ttgttcttaaatgactctttca

SEQ ID NO: 1361392 - DNA, 22 bp, Artificial Sequence
  chemically synthesized
ttgttgttcttaaatgactctt

SEQ ID NO: 1361393 - DNA, 22 bp, Artificial Sequence
  chemically synthesized
gttgttgttcttaaatgactct

SEQ ID NO: 1361394 - DNA, 22 bp, Artificial Sequence
  chemically synthesized
aaaattctgaaagagtcattta

SEQ ID NO: 1361395 - DNA, 22 bp, Artificial Sequence
  chemically synthesized
tttgttgttgttcttaaatgac

SEQ ID NO: 1361396 - DNA, 22 bp, Artificial Sequence
  chemically synthesized
ttgtttgttgttgttcttaaat

SEQ ID NO: 1361397 - DNA, 22 bp, Artificial Sequence
  chemically synthesized
tgaaagagtcatttaagaacaa

SEQ ID NO: 1361398 - DNA, 22 bp, Artificial Sequence
  chemically synthesized
ttgttgtttgttgttgttctta

SEQ ID NO: 1361399 - DNA, 22 bp, Artificial Sequence
  chemically synthesized
aaagagtcatttaagaacaaca

SEQ ID NO: 1361400 - DNA, 22 bp, Artificial Sequence
  chemically synthesized
ctgttgttgtttgttgttgttc

SEQ ID NO: 1361401 - DNA, 22 bp, Artificial Sequence
  chemically synthesized
ttgctgttgttgtttgttgttg

SEQ ID NO: 1361402 - DNA, 22 bp, Artificial Sequence
  chemically synthesized
aagaacaacaacaaacaacaac

SEQ ID NO: 1361403 - DNA, 22 bp, Artificial Sequence
  chemically synthesized
agaacaacaacaaacaacaaca

SEQ ID NO: 1361404 - DNA, 22 bp, Artificial Sequence
  chemically synthesized
ataaaatgttgttgctgttgtt

SEQ ID NO: 1361405 - DNA, 22 bp, Artificial Sequence
  chemically synthesized
ccatgctgataaaatgttgttg

SEQ ID NO: 1361406 - DNA, 22 bp, Artificial Sequence
  chemically synthesized
gccatgctgataaaatgttgtt

SEQ ID NO: 1361407 - DNA, 22 bp, Artificial Sequence
  chemically synthesized
cttgccatgctgataaaatgtt

SEQ ID NO: 1361408 - DNA, 22 bp, Artificial Sequence
  chemically synthesized
ccttgccatgctgataaaatgt

SEQ ID NO: 1361409 - DNA, 22 bp, Artificial Sequence
  chemically synthesized
tcatttccttgccatgctgata

SEQ ID NO: 1361410 - DNA, 22 bp, Artificial Sequence
  chemically synthesized
aaatggagttgtcatttccttg

SEQ ID NO: 1361411 - DNA, 22 bp, Artificial Sequence
  chemically synthesized
tatcagcatggcaaggaaatga

SEQ ID NO: 1361412 - DNA, 22 bp, Artificial Sequence
  chemically synthesized
atcagcatggcaaggaaatgac

SEQ ID NO: 1361413 - DNA, 22 bp, Artificial Sequence
  chemically synthesized
tcagcatggcaaggaaatgaca

SEQ ID NO: 1361414 - DNA, 22 bp, Artificial Sequence
  chemically synthesized
attgaaatggagttgtcatttc

SEQ ID NO: 1361415 - DNA, 22 bp, Artificial Sequence
  chemically synthesized
aattgaaatggagttgtcattt

SEQ ID NO: 1361416 - DNA, 22 bp, Artificial Sequence
  chemically synthesized
taattgaaatggagttgtcatt

SEQ ID NO: 1361417 - DNA, 22 bp, Artificial Sequence
  chemically synthesized
catttcaattaaaggatcattg

SEQ ID NO: 1361418 - DNA, 22 bp, Artificial Sequence
  chemically synthesized
ggggagaatggacaatgatcct

SEQ ID NO: 1361419 - DNA, 22 bp, Artificial Sequence
  chemically synthesized
caattaaaggatcattgtccat

SEQ ID NO: 1361420 - DNA, 22 bp, Artificial Sequence
  chemically synthesized
aattaaaggatcattgtccatt

SEQ ID NO: 1361421 - DNA, 22 bp, Artificial Sequence
  chemically synthesized
atgggaactgggggagaatgga

SEQ ID NO: 1361422 - DNA, 22 bp, Artificial Sequence
  chemically synthesized
aaggatcattgtccattctccc

SEQ ID NO: 1361423 - DNA, 22 bp, Artificial Sequence
  chemically synthesized
actaatgggaactgggggagaa

SEQ ID NO: 1361424 - DNA, 22 bp, Artificial Sequence
  chemically synthesized
ctcactaatgggaactggggga

SEQ ID NO: 1361425 - DNA, 22 bp, Artificial Sequence
  chemically synthesized
tccattctcccccagttcccat

SEQ ID NO: 1361426 - DNA, 22 bp, Artificial Sequence
  chemically synthesized
tcccccagttcccattagtgag

SEQ ID NO: 1361427 - DNA, 22 bp, Artificial Sequence
  chemically synthesized
tgaaccccattcctcactaatg

SEQ ID NO: 1361428 - DNA, 22 bp, Artificial Sequence
  chemically synthesized
ccccagttcccattagtgagga

SEQ ID NO: 1361429 - DNA, 22 bp, Artificial Sequence
  chemically synthesized
tcattatgaaccccattcctca

SEQ ID NO: 1361430 - DNA, 22 bp, Artificial Sequence
  chemically synthesized
tgtcattatgaaccccattcct

SEQ ID NO: 1361431 - DNA, 22 bp, Artificial Sequence
  chemically synthesized
ccattagtgaggaatggggttc

SEQ ID NO: 1361432 - DNA, 22 bp, Artificial Sequence
  chemically synthesized
actctgtcattatgaaccccat

SEQ ID NO: 1361433 - DNA, 22 bp, Artificial Sequence
  chemically synthesized
cactctgtcattatgaacccca

SEQ ID NO: 1361434 - DNA, 22 bp, Artificial Sequence
  chemically synthesized
tcactctgtcattatgaacccc

SEQ ID NO: 1361435 - DNA, 22 bp, Artificial Sequence
  chemically synthesized
gtgaggaatggggttcataatg

SEQ ID NO: 1361436 - DNA, 22 bp, Artificial Sequence
  chemically synthesized
actttcactctgtcattatgaa

SEQ ID NO: 1361437 - DNA, 22 bp, Artificial Sequence
  chemically synthesized
aatgcctcactttcactctgtc

SEQ ID NO: 1361438 - DNA, 22 bp, Artificial Sequence
  chemically synthesized
cctcaatgcctcactttcactc

SEQ ID NO: 1361439 - DNA, 22 bp, Artificial Sequence
  chemically synthesized
tccctcaatgcctcactttcac

SEQ ID NO: 1361440 - DNA, 22 bp, Artificial Sequence
  chemically synthesized
ataatgacagagtgaaagtgag

SEQ ID NO: 1361441 - DNA, 22 bp, Artificial Sequence
  chemically synthesized
ctccctcaatgcctcactttca

SEQ ID NO: 1361442 - DNA, 22 bp, Artificial Sequence
  chemically synthesized
ccttctccctcaatgcctcact

SEQ ID NO: 1361443 - DNA, 22 bp, Artificial Sequence
  chemically synthesized
gccttctccctcaatgcctcac

SEQ ID NO: 1361444 - DNA, 22 bp, Artificial Sequence
  chemically synthesized
tgccttctccctcaatgcctca

SEQ ID NO: 1361445 - DNA, 22 bp, Artificial Sequence
  chemically synthesized
ttgccttctccctcaatgcctc

SEQ ID NO: 1361446 - DNA, 22 bp, Artificial Sequence
  chemically synthesized
tgatcttttgccttctccctca

SEQ ID NO: 1361447 - DNA, 22 bp, Artificial Sequence
  chemically synthesized
gtgatcttttgccttctccctc

SEQ ID NO: 1361448 - DNA, 22 bp, Artificial Sequence
  chemically synthesized
tgtgatcttttgccttctccct

SEQ ID NO: 1361449 - DNA, 22 bp, Artificial Sequence
  chemically synthesized
ttgtgatcttttgccttctccc

SEQ ID NO: 1361450 - DNA, 22 bp, Artificial Sequence
  chemically synthesized
ttttgtgatcttttgccttctc

SEQ ID NO: 1361451 - DNA, 22 bp, Artificial Sequence
  chemically synthesized
cttttgtgatcttttgccttct

SEQ ID NO: 1361452 - DNA, 22 bp, Artificial Sequence
  chemically synthesized
tcttttgtgatcttttgccttc

SEQ ID NO: 1361453 - DNA, 22 bp, Artificial Sequence
  chemically synthesized
ctttcttttgtgatcttttgcc

SEQ ID NO: 1361454 - DNA, 22 bp, Artificial Sequence
  chemically synthesized
ctgctttcttttgtgatctttt

SEQ ID NO: 1361455 - DNA, 22 bp, Artificial Sequence
  chemically synthesized
agggagaaggcaaaagatcaca

SEQ ID NO: 1361456 - DNA, 22 bp, Artificial Sequence
  chemically synthesized
gaaatcaatgtattcctgcttt

SEQ ID NO: 1361457 - DNA, 22 bp, Artificial Sequence
  chemically synthesized
agaaatcaatgtattcctgctt

SEQ ID NO: 1361458 - DNA, 22 bp, Artificial Sequence
  chemically synthesized
gtttagaaatcaatgtattcct

SEQ ID NO: 1361459 - DNA, 22 bp, Artificial Sequence
  chemically synthesized
ggtttagaaatcaatgtattcc

SEQ ID NO: 1361460 - DNA, 22 bp, Artificial Sequence
  chemically synthesized
gatttggtttagaaatcaatgt

SEQ ID NO: 1361461 - DNA, 22 bp, Artificial Sequence
  chemically synthesized
gtagtctggatttggtttagaa

SEQ ID NO: 1361462 - DNA, 22 bp, Artificial Sequence
  chemically synthesized
agtagtctggatttggtttaga

SEQ ID NO: 1361463 - DNA, 22 bp, Artificial Sequence
  chemically synthesized
ttagtagtctggatttggttta

SEQ ID NO: 1361464 - DNA, 22 bp, Artificial Sequence
  chemically synthesized
atttctaaaccaaatccagact

SEQ ID NO: 1361465 - DNA, 22 bp, Artificial Sequence
  chemically synthesized
ctaaaccaaatccagactacta

SEQ ID NO: 1361466 - DNA, 22 bp, Artificial Sequence
  chemically synthesized
taaaccaaatccagactactaa

SEQ ID NO: 1361467 - DNA, 22 bp, Artificial Sequence
  chemically synthesized
aaccaaatccagactactaaga

SEQ ID NO: 1361468 - DNA, 22 bp, Artificial Sequence
  chemically synthesized
agaaaaccaatgttcttagtag

SEQ ID NO: 1361469 - DNA, 22 bp, Artificial Sequence
  chemically synthesized
ctaagaacattggttttctcag

SEQ ID NO: 1361470 - DNA, 22 bp, Artificial Sequence
  chemically synthesized
agaacattggttttctcagggc

SEQ ID NO: 1361471 - DNA, 22 bp, Artificial Sequence
  chemically synthesized
gttttctcagggcttactatca

SEQ ID NO: 1361472 - DNA, 22 bp, Artificial Sequence
  chemically synthesized
cgtagtatatgtaatgatagta

SEQ ID NO: 1361473 - DNA, 22 bp, Artificial Sequence
  chemically synthesized
gcgtagtatatgtaatgatagt

SEQ ID NO: 1361474 - DNA, 22 bp, Artificial Sequence
  chemically synthesized
tctcagggcttactatcattac

SEQ ID NO: 1361475 - DNA, 22 bp, Artificial Sequence
  chemically synthesized
tgcgtagtatatgtaatgatag

SEQ ID NO: 1361476 - DNA, 22 bp, Artificial Sequence
  chemically synthesized
ctcagggcttactatcattaca

SEQ ID NO: 1361477 - DNA, 22 bp, Artificial Sequence
  chemically synthesized
tcagggcttactatcattacat

SEQ ID NO: 1361478 - DNA, 22 bp, Artificial Sequence
  chemically synthesized
agggcttactatcattacatat

SEQ ID NO: 1361479 - DNA, 22 bp, Artificial Sequence
  chemically synthesized
aaggtgactttgcgtagtatat

SEQ ID NO: 1361480 - DNA, 22 bp, Artificial Sequence
  chemically synthesized
actatcattacatatactacgc

SEQ ID NO: 1361481 - DNA, 22 bp, Artificial Sequence
  chemically synthesized
ctatcattacatatactacgca

SEQ ID NO: 1361482 - DNA, 22 bp, Artificial Sequence
  chemically synthesized
tgaaggtgactttgcgtagtat

SEQ ID NO: 1361483 - DNA, 22 bp, Artificial Sequence
  chemically synthesized
tcattacatatactacgcaaag

SEQ ID NO: 1361484 - DNA, 22 bp, Artificial Sequence
  chemically synthesized
caacctctgaaggtgactttgc

SEQ ID NO: 1361485 - DNA, 22 bp, Artificial Sequence
  chemically synthesized
catatactacgcaaagtcacct

SEQ ID NO: 1361486 - DNA, 22 bp, Artificial Sequence
  chemically synthesized
gaggcctacaacctctgaaggt

SEQ ID NO: 1361487 - DNA, 22 bp, Artificial Sequence
  chemically synthesized
tggaggcctacaacctctgaag

SEQ ID NO: 1361488 - DNA, 22 bp, Artificial Sequence
  chemically synthesized
cgcaaagtcaccttcagaggtt

SEQ ID NO: 1361489 - DNA, 22 bp, Artificial Sequence
  chemically synthesized
ctggaggcctacaacctctgaa

SEQ ID NO: 1361490 - DNA, 22 bp, Artificial Sequence
  chemically synthesized
tctggaggcctacaacctctga

SEQ ID NO: 1361491 - DNA, 22 bp, Artificial Sequence
  chemically synthesized
cagaggttgtaggcctccagaa

SEQ ID NO: 1361492 - DNA, 22 bp, Artificial Sequence
  chemically synthesized
agaggttgtaggcctccagaaa

SEQ ID NO: 1361493 - DNA, 22 bp, Artificial Sequence
  chemically synthesized
taggcctccagaaaattgctct

SEQ ID NO: 1361494 - DNA, 22 bp, Artificial Sequence
  chemically synthesized
agtaggcaacggaacacacaga

SEQ ID NO: 1361495 - DNA, 22 bp, Artificial Sequence
  chemically synthesized
cagaaaattgctctgtgtgttc

SEQ ID NO: 1361496 - DNA, 22 bp, Artificial Sequence
  chemically synthesized
cagtaggcaacggaacacacag

SEQ ID NO: 1361497 - DNA, 22 bp, Artificial Sequence
  chemically synthesized
ggaatttcagtaggcaacggaa

SEQ ID NO: 1361498 - DNA, 22 bp, Artificial Sequence
  chemically synthesized
gggaatttcagtaggcaacgga

SEQ ID NO: 1361499 - DNA, 22 bp, Artificial Sequence
  chemically synthesized
ctctgtgtgttccgttgcctac

SEQ ID NO: 1361500 - DNA, 22 bp, Artificial Sequence
  chemically synthesized
tgtgtgttccgttgcctactga

SEQ ID NO: 1361501 - DNA, 22 bp, Artificial Sequence
  chemically synthesized
tgtgttccgttgcctactgaaa

SEQ ID NO: 1361502 - DNA, 22 bp, Artificial Sequence
  chemically synthesized
aaaatacttgggaatttcagta

SEQ ID NO: 1361503 - DNA, 22 bp, Artificial Sequence
  chemically synthesized
gttcaaaatacttgggaatttc

SEQ ID NO: 1361504 - DNA, 22 bp, Artificial Sequence
  chemically synthesized
cgttgcctactgaaattcccaa

SEQ ID NO: 1361505 - DNA, 22 bp, Artificial Sequence
  chemically synthesized
cctactgaaattcccaagtatt

SEQ ID NO: 1361506 - DNA, 22 bp, Artificial Sequence
  chemically synthesized
atatcactcgttcaaaatactt

SEQ ID NO: 1361507 - DNA, 22 bp, Artificial Sequence
  chemically synthesized
ctgaaattcccaagtattttga

SEQ ID NO: 1361508 - DNA, 22 bp, Artificial Sequence
  chemically synthesized
aaattcccaagtattttgaacg

SEQ ID NO: 1361509 - DNA, 22 bp, Artificial Sequence
  chemically synthesized
atctgatatcactcgttcaaaa

SEQ ID NO: 1361510 - DNA, 22 bp, Artificial Sequence
  chemically synthesized
aatctgatatcactcgttcaaa

SEQ ID NO: 1361511 - DNA, 22 bp, Artificial Sequence
  chemically synthesized
taatctgatatcactcgttcaa

SEQ ID NO: 1361512 - DNA, 22 bp, Artificial Sequence
  chemically synthesized
ccaagtattttgaacgagtgat

SEQ ID NO: 1361513 - DNA, 22 bp, Artificial Sequence
  chemically synthesized
ttttaatctgatatcactcgtt

SEQ ID NO: 1361514 - DNA, 22 bp, Artificial Sequence
  chemically synthesized
attttaatctgatatcactcgt

SEQ ID NO: 1361515 - DNA, 22 bp, Artificial Sequence
  chemically synthesized
tattttaatctgatatcactcg

SEQ ID NO: 1361516 - DNA, 22 bp, Artificial Sequence
  chemically synthesized
gatctttattttaatctgatat

SEQ ID NO: 1361517 - DNA, 22 bp, Artificial Sequence
  chemically synthesized
tgaacgagtgatatcagattaa

SEQ ID NO: 1361518 - DNA, 22 bp, Artificial Sequence
  chemically synthesized
gaacgagtgatatcagattaaa

SEQ ID NO: 1361519 - DNA, 22 bp, Artificial Sequence
  chemically synthesized
aacgagtgatatcagattaaaa

SEQ ID NO: 1361520 - DNA, 22 bp, Artificial Sequence
  chemically synthesized
agctcgatctttattttaatct

SEQ ID NO: 1361521 - DNA, 22 bp, Artificial Sequence
  chemically synthesized
tgagctcgatctttattttaat

SEQ ID NO: 1361522 - DNA, 22 bp, Artificial Sequence
  chemically synthesized
aactctgagctcgatctttatt

SEQ ID NO: 1361523 - DNA, 22 bp, Artificial Sequence
  chemically synthesized
ttcaactctgagctcgatcttt

SEQ ID NO: 1361524 - DNA, 22 bp, Artificial Sequence
  chemically synthesized
tattcaactctgagctcgatct

SEQ ID NO: 1361525 - DNA, 22 bp, Artificial Sequence
  chemically synthesized
ctattcaactctgagctcgatc

SEQ ID NO: 1361526 - DNA, 22 bp, Artificial Sequence
  chemically synthesized
aaataaagatcgagctcagagt

SEQ ID NO: 1361527 - DNA, 22 bp, Artificial Sequence
  chemically synthesized
agggataatttctattcaactc

SEQ ID NO: 1361528 - DNA, 22 bp, Artificial Sequence
  chemically synthesized
aagggataatttctattcaact

SEQ ID NO: 1361529 - DNA, 22 bp, Artificial Sequence
  chemically synthesized
taagggataatttctattcaac

SEQ ID NO: 1361530 - DNA, 22 bp, Artificial Sequence
  chemically synthesized
ccattttaagggataatttcta

SEQ ID NO: 1361531 - DNA, 22 bp, Artificial Sequence
  chemically synthesized
agagttgaatagaaattatccc

SEQ ID NO: 1361532 - DNA, 22 bp, Artificial Sequence
  chemically synthesized
ggctgccattttaagggataat

SEQ ID NO: 1361533 - DNA, 22 bp, Artificial Sequence
  chemically synthesized
aggctgccattttaagggataa

SEQ ID NO: 1361534 - DNA, 22 bp, Artificial Sequence
  chemically synthesized
tttaggctgccattttaaggga

SEQ ID NO: 1361535 - DNA, 22 bp, Artificial Sequence
  chemically synthesized
aatagaaattatcccttaaaat

SEQ ID NO: 1361536 - DNA, 22 bp, Artificial Sequence
  chemically synthesized
tgtttaggctgccattttaagg

SEQ ID NO: 1361537 - DNA, 22 bp, Artificial Sequence
  chemically synthesized
ctgtttaggctgccattttaag

SEQ ID NO: 1361538 - DNA, 22 bp, Artificial Sequence
  chemically synthesized
acatcttctgtttaggctgcca

SEQ ID NO: 1361539 - DNA, 22 bp, Artificial Sequence
  chemically synthesized
tcccttaaaatggcagcctaaa

SEQ ID NO: 1361540 - DNA, 22 bp, Artificial Sequence
  chemically synthesized
tagctcacatcttctgtttagg

SEQ ID NO: 1361541 - DNA, 22 bp, Artificial Sequence
  chemically synthesized
atagctcacatcttctgtttag

SEQ ID NO: 1361542 - DNA, 22 bp, Artificial Sequence
  chemically synthesized
aaaatggcagcctaaacagaag

SEQ ID NO: 1361543 - DNA, 22 bp, Artificial Sequence
  chemically synthesized
tatagctcacatcttctgttta

SEQ ID NO: 1361544 - DNA, 22 bp, Artificial Sequence
  chemically synthesized
aaatggcagcctaaacagaaga

SEQ ID NO: 1361545 - DNA, 22 bp, Artificial Sequence
  chemically synthesized
ttatagctcacatcttctgttt

SEQ ID NO: 1361546 - DNA, 22 bp, Artificial Sequence
  chemically synthesized
ttttatagctcacatcttctgt

SEQ ID NO: 1361547 - DNA, 22 bp, Artificial Sequence
  chemically synthesized
cctcttttatagctcacatctt

SEQ ID NO: 1361548 - DNA, 22 bp, Artificial Sequence
  chemically synthesized
aacagaagatgtgagctataaa

SEQ ID NO: 1361549 - DNA, 22 bp, Artificial Sequence
  chemically synthesized
aaaacacaaagatcagtactcc

SEQ ID NO: 1361550 - DNA, 22 bp, Artificial Sequence
  chemically synthesized
taaaagagggagtactgatctt

SEQ ID NO: 1361551 - DNA, 22 bp, Artificial Sequence
  chemically synthesized
ccattaaaaacacaaagatcag

SEQ ID NO: 1361552 - DNA, 22 bp, Artificial Sequence
  chemically synthesized
attcccattaaaaacacaaaga

SEQ ID NO: 1361553 - DNA, 22 bp, Artificial Sequence
  chemically synthesized
cctcattcccattaaaaacaca

SEQ ID NO: 1361554 - DNA, 22 bp, Artificial Sequence
  chemically synthesized
tacctcattcccattaaaaaca

SEQ ID NO: 1361555 - DNA, 22 bp, Artificial Sequence
  chemically synthesized
atctttgtgtttttaatgggaa

SEQ ID NO: 1361556 - DNA, 22 bp, Artificial Sequence
  chemically synthesized
tgtgtttttaatgggaatgagg

SEQ ID NO: 1361557 - DNA, 22 bp, Artificial Sequence
  chemically synthesized
gtgtttttaatgggaatgaggt

SEQ ID NO: 1361558 - DNA, 22 bp, Artificial Sequence
  chemically synthesized
tgtttttaatgggaatgaggta

SEQ ID NO: 1361559 - DNA, 22 bp, Artificial Sequence
  chemically synthesized
acggccatacaacctctacctc

SEQ ID NO: 1361560 - DNA, 22 bp, Artificial Sequence
  chemically synthesized
ttaatgggaatgaggtagaggt

SEQ ID NO: 1361561 - DNA, 22 bp, Artificial Sequence
  chemically synthesized
taatgggaatgaggtagaggtt

SEQ ID NO: 1361562 - DNA, 22 bp, Artificial Sequence
  chemically synthesized
aatgggaatgaggtagaggttg

SEQ ID NO: 1361563 - DNA, 22 bp, Artificial Sequence
  chemically synthesized
atgggaatgaggtagaggttgt

SEQ ID NO: 1361564 - DNA, 22 bp, Artificial Sequence
  chemically synthesized
atctcacggccatacaacctct

SEQ ID NO: 1361565 - DNA, 22 bp, Artificial Sequence
  chemically synthesized
tatggccgtgagatgaggactc

SEQ ID NO: 1361566 - DNA, 22 bp, Artificial Sequence
  chemically synthesized
aaaaaaaataaaataaaaagag

SEQ ID NO: 1361567 - DNA, 22 bp, Artificial Sequence
  chemically synthesized
aaagttaaaaaaaaataaaata

SEQ ID NO: 1361568 - DNA, 22 bp, Artificial Sequence
  chemically synthesized
aaaagttaaaaaaaaataaaat

SEQ ID NO: 1361569 - DNA, 22 bp, Artificial Sequence
  chemically synthesized
aacttaaaagttaaaaaaaaat

SEQ ID NO: 1361570 - DNA, 22 bp, Artificial Sequence
  chemically synthesized
tttttattttatttttttttaa

SEQ ID NO: 1361571 - DNA, 22 bp, Artificial Sequence
  chemically synthesized
tttattttatttttttttaact

SEQ ID NO: 1361572 - DNA, 22 bp, Artificial Sequence
  chemically synthesized
ttattttatttttttttaactt

SEQ ID NO: 1361573 - DNA, 22 bp, Artificial Sequence
  chemically synthesized
tattttatttttttttaacttt

SEQ ID NO: 1361574 - DNA, 22 bp, Artificial Sequence
  chemically synthesized
attttatttttttttaactttt

SEQ ID NO: 1361575 - DNA, 22 bp, Artificial Sequence
  chemically synthesized
ttttatttttttttaactttta

SEQ ID NO: 1361576 - DNA, 22 bp, Artificial Sequence
  chemically synthesized
tagccctgaacttaaaagttaa

SEQ ID NO: 1361577 - DNA, 22 bp, Artificial Sequence
  chemically synthesized
gtagccctgaacttaaaagtta

SEQ ID NO: 1361578 - DNA, 22 bp, Artificial Sequence
  chemically synthesized
tatttttttttaacttttaagt

SEQ ID NO: 1361579 - DNA, 22 bp, Artificial Sequence
  chemically synthesized
atttttttttaacttttaagtt

SEQ ID NO: 1361580 - DNA, 22 bp, Artificial Sequence
  chemically synthesized
tttttttttaacttttaagttc

SEQ ID NO: 1361581 - DNA, 22 bp, Artificial Sequence
  chemically synthesized
cacttgtagccctgaacttaaa

SEQ ID NO: 1361582 - DNA, 22 bp, Artificial Sequence
  chemically synthesized
ttttttaacttttaagttcagg

SEQ ID NO: 1361583 - DNA, 22 bp, Artificial Sequence
  chemically synthesized
tttttaacttttaagttcaggg

SEQ ID NO: 1361584 - DNA, 22 bp, Artificial Sequence
  chemically synthesized
ttttaacttttaagttcagggc

SEQ ID NO: 1361585 - DNA, 22 bp, Artificial Sequence
  chemically synthesized
tttaacttttaagttcagggct

SEQ ID NO: 1361586 - DNA, 22 bp, Artificial Sequence
  chemically synthesized
ttaacttttaagttcagggcta

SEQ ID NO: 1361587 - DNA, 22 bp, Artificial Sequence
  chemically synthesized
taacttttaagttcagggctac

SEQ ID NO: 1361588 - DNA, 22 bp, Artificial Sequence
  chemically synthesized
aacttttaagttcagggctaca

SEQ ID NO: 1361589 - DNA, 22 bp, Artificial Sequence
  chemically synthesized
acttttaagttcagggctacaa

SEQ ID NO: 1361590 - DNA, 22 bp, Artificial Sequence
  chemically synthesized
ttaagttcagggctacaagtgc

SEQ ID NO: 1361591 - DNA, 22 bp, Artificial Sequence
  chemically synthesized
tgtaacaaacctgcacttgtag

SEQ ID NO: 1361592 - DNA, 22 bp, Artificial Sequence
  chemically synthesized
taagttcagggctacaagtgca

SEQ ID NO: 1361593 - DNA, 22 bp, Artificial Sequence
  chemically synthesized
aagttcagggctacaagtgcag

SEQ ID NO: 1361594 - DNA, 22 bp, Artificial Sequence
  chemically synthesized
agttcagggctacaagtgcagg

SEQ ID NO: 1361595 - DNA, 22 bp, Artificial Sequence
  chemically synthesized
cctatgtaacaaacctgcactt

SEQ ID NO: 1361596 - DNA, 22 bp, Artificial Sequence
  chemically synthesized
acctatgtaacaaacctgcact

SEQ ID NO: 1361597 - DNA, 22 bp, Artificial Sequence
  chemically synthesized
agggctacaagtgcaggtttgt

SEQ ID NO: 1361598 - DNA, 22 bp, Artificial Sequence
  chemically synthesized
caagtgcaggtttgttacatag

SEQ ID NO: 1361599 - DNA, 22 bp, Artificial Sequence
  chemically synthesized
tggcacaagtttacctatgtaa

SEQ ID NO: 1361600 - DNA, 22 bp, Artificial Sequence
  chemically synthesized
gttacataggtaaacttgtgcc

SEQ ID NO: 1361601 - DNA, 22 bp, Artificial Sequence
  chemically synthesized
ttacataggtaaacttgtgcca

SEQ ID NO: 1361602 - DNA, 22 bp, Artificial Sequence
  chemically synthesized
cataggtaaacttgtgccatag

SEQ ID NO: 1361603 - DNA, 22 bp, Artificial Sequence
  chemically synthesized
tacagcaaacccctatggcaca

SEQ ID NO: 1361604 - DNA, 22 bp, Artificial Sequence
  chemically synthesized
gtgccataggggtttgctgtac

SEQ ID NO: 1361605 - DNA, 22 bp, Artificial Sequence
  chemically synthesized
tgccataggggtttgctgtaca

SEQ ID NO: 1361606 - DNA, 22 bp, Artificial Sequence
  chemically synthesized
ggtgatgaaataatctgtacag

SEQ ID NO: 1361607 - DNA, 22 bp, Artificial Sequence
  chemically synthesized
atacctgggtgatgaaataatc

SEQ ID NO: 1361608 - DNA, 22 bp, Artificial Sequence
  chemically synthesized
gatacctgggtgatgaaataat

SEQ ID NO: 1361609 - DNA, 22 bp, Artificial Sequence
  chemically synthesized
gctgtacagattatttcatcac

SEQ ID NO: 1361610 - DNA, 22 bp, Artificial Sequence
  chemically synthesized
ctgtacagattatttcatcacc

SEQ ID NO: 1361611 - DNA, 22 bp, Artificial Sequence
  chemically synthesized
ggcttgatacctgggtgatgaa

SEQ ID NO: 1361612 - DNA, 22 bp, Artificial Sequence
  chemically synthesized
tacagattatttcatcacccag

SEQ ID NO: 1361613 - DNA, 22 bp, Artificial Sequence
  chemically synthesized
atgggtactaggcttgatacct

SEQ ID NO: 1361614 - DNA, 22 bp, Artificial Sequence
  chemically synthesized
tttcatcacccaggtatcaagc

SEQ ID NO: 1361615 - DNA, 22 bp, Artificial Sequence
  chemically synthesized
catcacccaggtatcaagccta

SEQ ID NO: 1361616 - DNA, 22 bp, Artificial Sequence
  chemically synthesized
atcacccaggtatcaagcctag

SEQ ID NO: 1361617 - DNA, 22 bp, Artificial Sequence
  chemically synthesized
gtacccattagttgcttttcct

SEQ ID NO: 1361618 - DNA, 22 bp, Artificial Sequence
  chemically synthesized
gaggaggaagaggatcaggaaa

SEQ ID NO: 1361619 - DNA, 22 bp, Artificial Sequence
  chemically synthesized
gttgcttttcctgatcctcttc

SEQ ID NO: 1361620 - DNA, 22 bp, Artificial Sequence
  chemically synthesized
cttttcctgatcctcttcctcc

SEQ ID NO: 1361621 - DNA, 22 bp, Artificial Sequence
  chemically synthesized
ttcctgatcctcttcctcctcc

SEQ ID NO: 1361622 - DNA, 22 bp, Artificial Sequence
  chemically synthesized
tcctgatcctcttcctcctcca

SEQ ID NO: 1361623 - DNA, 22 bp, Artificial Sequence
  chemically synthesized
cctgatcctcttcctcctccaa

SEQ ID NO: 1361624 - DNA, 22 bp, Artificial Sequence
  chemically synthesized
ctgatcctcttcctcctccaac

SEQ ID NO: 1361625 - DNA, 22 bp, Artificial Sequence
  chemically synthesized
ggagggtagagggttggaggag

SEQ ID NO: 1361626 - DNA, 22 bp, Artificial Sequence
  chemically synthesized
cggagggtagagggttggagga

SEQ ID NO: 1361627 - DNA, 22 bp, Artificial Sequence
  chemically synthesized
tcggagggtagagggttggagg

SEQ ID NO: 1361628 - DNA, 22 bp, Artificial Sequence
  chemically synthesized
atcctcttcctcctccaaccct

SEQ ID NO: 1361629 - DNA, 22 bp, Artificial Sequence
  chemically synthesized
ttcctcctccaaccctctaccc

SEQ ID NO: 1361630 - DNA, 22 bp, Artificial Sequence
  chemically synthesized
gggcctttcggagggtagaggg

SEQ ID NO: 1361631 - DNA, 22 bp, Artificial Sequence
  chemically synthesized
cctcctccaaccctctaccctc

SEQ ID NO: 1361632 - DNA, 22 bp, Artificial Sequence
  chemically synthesized
ctcctccaaccctctaccctcc

SEQ ID NO: 1361633 - DNA, 22 bp, Artificial Sequence
  chemically synthesized
ctccaaccctctaccctccgaa

SEQ ID NO: 1361634 - DNA, 22 bp, Artificial Sequence
  chemically synthesized
caaccctctaccctccgaaagg

SEQ ID NO: 1361635 - DNA, 22 bp, Artificial Sequence
  chemically synthesized
taccctccgaaaggccccaggg

SEQ ID NO: 1361636 - DNA, 22 bp, Artificial Sequence
  chemically synthesized
ccctccgaaaggccccagggtg

SEQ ID NO: 1361637 - DNA, 22 bp, Artificial Sequence
  chemically synthesized
cgaaaggccccagggtgtgttg

SEQ ID NO: 1361638 - DNA, 22 bp, Artificial Sequence
  chemically synthesized
atatagagagaaacaacacacc

SEQ ID NO: 1361639 - DNA, 22 bp, Artificial Sequence
  chemically synthesized
aaagtgtcctcatatagagaga

SEQ ID NO: 1361640 - DNA, 22 bp, Artificial Sequence
  chemically synthesized
aaaagtgtcctcatatagagag

SEQ ID NO: 1361641 - DNA, 22 bp, Artificial Sequence
  chemically synthesized
tgcttaaaagtgtcctcatata

SEQ ID NO: 1361642 - DNA, 22 bp, Artificial Sequence
  chemically synthesized
atgcttaaaagtgtcctcatat

SEQ ID NO: 1361643 - DNA, 22 bp, Artificial Sequence
  chemically synthesized
tttctctctatatgaggacact

SEQ ID NO: 1361644 - DNA, 22 bp, Artificial Sequence
  chemically synthesized
tcttatgcttaaaagtgtcctc

SEQ ID NO: 1361645 - DNA, 22 bp, Artificial Sequence
  chemically synthesized
ctctctatatgaggacactttt

SEQ ID NO: 1361646 - DNA, 22 bp, Artificial Sequence
  chemically synthesized
tctctatatgaggacactttta

SEQ ID NO: 1361647 - DNA, 22 bp, Artificial Sequence
  chemically synthesized
ctgtcttatgcttaaaagtgtc

SEQ ID NO: 1361648 - DNA, 22 bp, Artificial Sequence
  chemically synthesized
tctatatgaggacacttttaag

SEQ ID NO: 1361649 - DNA, 22 bp, Artificial Sequence
  chemically synthesized
tgctgtcttatgcttaaaagtg

SEQ ID NO: 1361650 - DNA, 22 bp, Artificial Sequence
  chemically synthesized
tatatgaggacacttttaagca

SEQ ID NO: 1361651 - DNA, 22 bp, Artificial Sequence
  chemically synthesized
tatgaggacacttttaagcata

SEQ ID NO: 1361652 - DNA, 22 bp, Artificial Sequence
  chemically synthesized
ttaagcataagacagcagagcc

SEQ ID NO: 1361653 - DNA, 22 bp, Artificial Sequence
  chemically synthesized
taagcataagacagcagagcca

SEQ ID NO: 1361654 - DNA, 22 bp, Artificial Sequence
  chemically synthesized
aagcataagacagcagagccat

SEQ ID NO: 1361655 - DNA, 22 bp, Artificial Sequence
  chemically synthesized
agcataagacagcagagccatt

SEQ ID NO: 1361656 - DNA, 22 bp, Artificial Sequence
  chemically synthesized
ataggcagcagacaaatgagaa

SEQ ID NO: 1361657 - DNA, 22 bp, Artificial Sequence
  chemically synthesized
cccttcctcattctcatttgtc

SEQ ID NO: 1361658 - DNA, 22 bp, Artificial Sequence
  chemically synthesized
tgataggcagcagacaaatgag

SEQ ID NO: 1361659 - DNA, 22 bp, Artificial Sequence
  chemically synthesized
ccttcctcattctcatttgtct

SEQ ID NO: 1361660 - DNA, 22 bp, Artificial Sequence
  chemically synthesized
cctcattctcatttgtctgctg

SEQ ID NO: 1361661 - DNA, 22 bp, Artificial Sequence
  chemically synthesized
ctcattctcatttgtctgctgc

SEQ ID NO: 1361662 - DNA, 22 bp, Artificial Sequence
  chemically synthesized
attctcatttgtctgctgccta

SEQ ID NO: 1361663 - DNA, 22 bp, Artificial Sequence
  chemically synthesized
agcacaattctgataggcagca

SEQ ID NO: 1361664 - DNA, 22 bp, Artificial Sequence
  chemically synthesized
aagcacaattctgataggcagc

SEQ ID NO: 1361665 - DNA, 22 bp, Artificial Sequence
  chemically synthesized
tcatttgtctgctgcctatcag

SEQ ID NO: 1361666 - DNA, 22 bp, Artificial Sequence
  chemically synthesized
ttaagcacaattctgataggca

SEQ ID NO: 1361667 - DNA, 22 bp, Artificial Sequence
  chemically synthesized
cttaagcacaattctgataggc

SEQ ID NO: 1361668 - DNA, 22 bp, Artificial Sequence
  chemically synthesized
atttgtctgctgcctatcagaa

SEQ ID NO: 1361669 - DNA, 22 bp, Artificial Sequence
  chemically synthesized
tcttaagcacaattctgatagg

SEQ ID NO: 1361670 - DNA, 22 bp, Artificial Sequence
  chemically synthesized
gtctgctgcctatcagaattgt

SEQ ID NO: 1361671 - DNA, 22 bp, Artificial Sequence
  chemically synthesized
tctgctgcctatcagaattgtg

SEQ ID NO: 1361672 - DNA, 22 bp, Artificial Sequence
  chemically synthesized
ctgcctatcagaattgtgctta

SEQ ID NO: 1361673 - DNA, 22 bp, Artificial Sequence
  chemically synthesized
cctatcagaattgtgcttaaga

SEQ ID NO: 1361674 - DNA, 22 bp, Artificial Sequence
  chemically synthesized
agggcatataaattttcttaag

SEQ ID NO: 1361675 - DNA, 22 bp, Artificial Sequence
  chemically synthesized
tcagaattgtgcttaagaaaat

SEQ ID NO: 1361676 - DNA, 22 bp, Artificial Sequence
  chemically synthesized
aagggcatataaattttcttaa

SEQ ID NO: 1361677 - DNA, 22 bp, Artificial Sequence
  chemically synthesized
taagggcatataaattttctta

SEQ ID NO: 1361678 - DNA, 22 bp, Artificial Sequence
  chemically synthesized
tgcttaagaaaatttatatgcc

SEQ ID NO: 1361679 - DNA, 22 bp, Artificial Sequence
  chemically synthesized
cagcgttttaagggcatataaa

SEQ ID NO: 1361680 - DNA, 22 bp, Artificial Sequence
  chemically synthesized
gctccagcgttttaagggcata

SEQ ID NO: 1361681 - DNA, 22 bp, Artificial Sequence
  chemically synthesized
aagaaaatttatatgcccttaa

SEQ ID NO: 1361682 - DNA, 22 bp, Artificial Sequence
  chemically synthesized
ggctccagcgttttaagggcat

SEQ ID NO: 1361683 - DNA, 22 bp, Artificial Sequence
  chemically synthesized
agaaaatttatatgcccttaaa

SEQ ID NO: 1361684 - DNA, 22 bp, Artificial Sequence
  chemically synthesized
atatgcccttaaaacgctggag

SEQ ID NO: 1361685 - DNA, 22 bp, Artificial Sequence
  chemically synthesized
tatgcccttaaaacgctggagc

SEQ ID NO: 1361686 - DNA, 22 bp, Artificial Sequence
  chemically synthesized
aaaacgctggagccaaatgtat

SEQ ID NO: 1361687 - DNA, 22 bp, Artificial Sequence
  chemically synthesized
aaacgctggagccaaatgtatt

SEQ ID NO: 1361688 - DNA, 22 bp, Artificial Sequence
  chemically synthesized
gagccaaatgtatttttttggt

SEQ ID NO: 1361689 - DNA, 22 bp, Artificial Sequence
  chemically synthesized
aatatggcccaacaaaaagacc

SEQ ID NO: 1361690 - DNA, 22 bp, Artificial Sequence
  chemically synthesized
gaatatggcccaacaaaaagac

SEQ ID NO: 1361691 - DNA, 22 bp, Artificial Sequence
  chemically synthesized
cttgaatatggcccaacaaaaa

SEQ ID NO: 1361692 - DNA, 22 bp, Artificial Sequence
  chemically synthesized
ccttgaatatggcccaacaaaa

SEQ ID NO: 1361693 - DNA, 22 bp, Artificial Sequence
  chemically synthesized
ttttggtctttttgttgggcca

SEQ ID NO: 1361694 - DNA, 22 bp, Artificial Sequence
  chemically synthesized
cttccttgaatatggcccaaca

SEQ ID NO: 1361695 - DNA, 22 bp, Artificial Sequence
  chemically synthesized
tttggtctttttgttgggccat

SEQ ID NO: 1361696 - DNA, 22 bp, Artificial Sequence
  chemically synthesized
ttggtctttttgttgggccata

SEQ ID NO: 1361697 - DNA, 22 bp, Artificial Sequence
  chemically synthesized
tggtctttttgttgggccatat

SEQ ID NO: 1361698 - DNA, 22 bp, Artificial Sequence
  chemically synthesized
ggtctttttgttgggccatatt

SEQ ID NO: 1361699 - DNA, 22 bp, Artificial Sequence
  chemically synthesized
gtctttttgttgggccatattc

SEQ ID NO: 1361700 - DNA, 22 bp, Artificial Sequence
  chemically synthesized
aagattacttccttgaatatgg

SEQ ID NO: 1361701 - DNA, 22 bp, Artificial Sequence
  chemically synthesized
tttgttgggccatattcaagga

SEQ ID NO: 1361702 - DNA, 22 bp, Artificial Sequence
  chemically synthesized
ttgttgggccatattcaaggaa

SEQ ID NO: 1361703 - DNA, 22 bp, Artificial Sequence
  chemically synthesized
tgttgggccatattcaaggaag

SEQ ID NO: 1361704 - DNA, 22 bp, Artificial Sequence
  chemically synthesized
gttgggccatattcaaggaagt

SEQ ID NO: 1361705 - DNA, 22 bp, Artificial Sequence
  chemically synthesized
ttgggccatattcaaggaagta

SEQ ID NO: 1361706 - DNA, 22 bp, Artificial Sequence
  chemically synthesized
cccattcaagattacttccttg

SEQ ID NO: 1361707 - DNA, 22 bp, Artificial Sequence
  chemically synthesized
ccccattcaagattacttcctt

SEQ ID NO: 1361708 - DNA, 22 bp, Artificial Sequence
  chemically synthesized
ggccatattcaaggaagtaatc

SEQ ID NO: 1361709 - DNA, 22 bp, Artificial Sequence
  chemically synthesized
tttccccattcaagattacttc

SEQ ID NO: 1361710 - DNA, 22 bp, Artificial Sequence
  chemically synthesized
tgtttccccattcaagattact

SEQ ID NO: 1361711 - DNA, 22 bp, Artificial Sequence
  chemically synthesized
ctgtttccccattcaagattac

SEQ ID NO: 1361712 - DNA, 22 bp, Artificial Sequence
  chemically synthesized
tctgtttccccattcaagatta

SEQ ID NO: 1361713 - DNA, 22 bp, Artificial Sequence
  chemically synthesized
aaggaagtaatcttgaatgggg

SEQ ID NO: 1361714 - DNA, 22 bp, Artificial Sequence
  chemically synthesized
gaatggggaaacagaaaggcta

SEQ ID NO: 1361715 - DNA, 22 bp, Artificial Sequence
  chemically synthesized
acacccagggcatagcctttct

SEQ ID NO: 1361716 - DNA, 22 bp, Artificial Sequence
  chemically synthesized
aatggggaaacagaaaggctat

SEQ ID NO: 1361717 - DNA, 22 bp, Artificial Sequence
  chemically synthesized
aacacccagggcatagcctttc

SEQ ID NO: 1361718 - DNA, 22 bp, Artificial Sequence
  chemically synthesized
taacacccagggcatagccttt

SEQ ID NO: 1361719 - DNA, 22 bp, Artificial Sequence
  chemically synthesized
tgaaatactttaacacccaggg

SEQ ID NO: 1361720 - DNA, 22 bp, Artificial Sequence
  chemically synthesized
gagattatgaaatactttaaca

SEQ ID NO: 1361721 - DNA, 22 bp, Artificial Sequence
  chemically synthesized
tagagattatgaaatactttaa

SEQ ID NO: 1361722 - DNA, 22 bp, Artificial Sequence
  chemically synthesized
tgccctgggtgttaaagtattt

SEQ ID NO: 1361723 - DNA, 22 bp, Artificial Sequence
  chemically synthesized
ctctagagattatgaaatactt

SEQ ID NO: 1361724 - DNA, 22 bp, Artificial Sequence
  chemically synthesized
ggtgttaaagtatttcataatc

SEQ ID NO: 1361725 - DNA, 22 bp, Artificial Sequence
  chemically synthesized
aagtatttcataatctctagag

SEQ ID NO: 1361726 - DNA, 22 bp, Artificial Sequence
  chemically synthesized
aaccagatggctcctctagaga

SEQ ID NO: 1361727 - DNA, 22 bp, Artificial Sequence
  chemically synthesized
aaaccagatggctcctctagag

SEQ ID NO: 1361728 - DNA, 22 bp, Artificial Sequence
  chemically synthesized
ttaaaccagatggctcctctag

SEQ ID NO: 1361729 - DNA, 22 bp, Artificial Sequence
  chemically synthesized
cttaaaccagatggctcctcta

SEQ ID NO: 1361730 - DNA, 22 bp, Artificial Sequence
  chemically synthesized
cataatctctagaggagccatc

SEQ ID NO: 1361731 - DNA, 22 bp, Artificial Sequence
  chemically synthesized
ataatctctagaggagccatct

SEQ ID NO: 1361732 - DNA, 22 bp, Artificial Sequence
  chemically synthesized
aatgtgccttcttaaaccagat

SEQ ID NO: 1361733 - DNA, 22 bp, Artificial Sequence
  chemically synthesized
tagaggagccatctggtttaag

SEQ ID NO: 1361734 - DNA, 22 bp, Artificial Sequence
  chemically synthesized
gaggagccatctggtttaagaa

SEQ ID NO: 1361735 - DNA, 22 bp, Artificial Sequence
  chemically synthesized
tagcattcaatgtgccttctta

SEQ ID NO: 1361736 - DNA, 22 bp, Artificial Sequence
  chemically synthesized
gtttaagaaggcacattgaatg

SEQ ID NO: 1361737 - DNA, 22 bp, Artificial Sequence
  chemically synthesized
cagcatattatagcattcaatg

SEQ ID NO: 1361738 - DNA, 22 bp, Artificial Sequence
  chemically synthesized
aagaaggcacattgaatgctat

SEQ ID NO: 1361739 - DNA, 22 bp, Artificial Sequence
  chemically synthesized
agaaggcacattgaatgctata

SEQ ID NO: 1361740 - DNA, 22 bp, Artificial Sequence
  chemically synthesized
atatattacagcatattatagc

SEQ ID NO: 1361741 - DNA, 22 bp, Artificial Sequence
  chemically synthesized
cctcatatattacagcatatta

SEQ ID NO: 1361742 - DNA, 22 bp, Artificial Sequence
  chemically synthesized
ccctcatatattacagcatatt

SEQ ID NO: 1361743 - DNA, 22 bp, Artificial Sequence
  chemically synthesized
tttccctcatatattacagcat

SEQ ID NO: 1361744 - DNA, 22 bp, Artificial Sequence
  chemically synthesized
aatgctataatatgctgtaata

SEQ ID NO: 1361745 - DNA, 22 bp, Artificial Sequence
  chemically synthesized
taatatgctgtaatatatgagg

SEQ ID NO: 1361746 - DNA, 22 bp, Artificial Sequence
  chemically synthesized
atagtataaaaagtctgtttcc

SEQ ID NO: 1361747 - DNA, 22 bp, Artificial Sequence
  chemically synthesized
taatatatgagggaaacagact

SEQ ID NO: 1361748 - DNA, 22 bp, Artificial Sequence
  chemically synthesized
gatagtataaaaagtctgtttc

SEQ ID NO: 1361749 - DNA, 22 bp, Artificial Sequence
  chemically synthesized
atgaaaggcttgatagtataaa

SEQ ID NO: 1361750 - DNA, 22 bp, Artificial Sequence
  chemically synthesized
catgaaaggcttgatagtataa

SEQ ID NO: 1361751 - DNA, 22 bp, Artificial Sequence
  chemically synthesized
tcatgaaaggcttgatagtata

SEQ ID NO: 1361752 - DNA, 22 bp, Artificial Sequence
  chemically synthesized
ttcatgaaaggcttgatagtat

SEQ ID NO: 1361753 - DNA, 22 bp, Artificial Sequence
  chemically synthesized
tttcatgaaaggcttgatagta

SEQ ID NO: 1361754 - DNA, 22 bp, Artificial Sequence
  chemically synthesized
tttatactatcaagcctttcat

SEQ ID NO: 1361755 - DNA, 22 bp, Artificial Sequence
  chemically synthesized
ttatactatcaagcctttcatg

SEQ ID NO: 1361756 - DNA, 22 bp, Artificial Sequence
  chemically synthesized
atgaaattttttcatgaaaggc

SEQ ID NO: 1361757 - DNA, 22 bp, Artificial Sequence
  chemically synthesized
tatactatcaagcctttcatga

SEQ ID NO: 1361758 - DNA, 22 bp, Artificial Sequence
  chemically synthesized
catgaaattttttcatgaaagg

SEQ ID NO: 1361759 - DNA, 22 bp, Artificial Sequence
  chemically synthesized
atactatcaagcctttcatgaa

SEQ ID NO: 1361760 - DNA, 22 bp, Artificial Sequence
  chemically synthesized
tcatgaaattttttcatgaaag

SEQ ID NO: 1361761 - DNA, 22 bp, Artificial Sequence
  chemically synthesized
tactatcaagcctttcatgaaa

SEQ ID NO: 1361762 - DNA, 22 bp, Artificial Sequence
  chemically synthesized
ttcatgaaattttttcatgaaa

SEQ ID NO: 1361763 - DNA, 22 bp, Artificial Sequence
  chemically synthesized
tttcatgaaattttttcatgaa

SEQ ID NO: 1361764 - DNA, 22 bp, Artificial Sequence
  chemically synthesized
ttttttcatgaaattttttcat

SEQ ID NO: 1361765 - DNA, 22 bp, Artificial Sequence
  chemically synthesized
tcaagcctttcatgaaaaaatt

SEQ ID NO: 1361766 - DNA, 22 bp, Artificial Sequence
  chemically synthesized
attttttcatgaaattttttca

SEQ ID NO: 1361767 - DNA, 22 bp, Artificial Sequence
  chemically synthesized
tttattttttcatgaaattttt

SEQ ID NO: 1361768 - DNA, 22 bp, Artificial Sequence
  chemically synthesized
gtttattttttcatgaaatttt

SEQ ID NO: 1361769 - DNA, 22 bp, Artificial Sequence
  chemically synthesized
tgtttattttttcatgaaattt

SEQ ID NO: 1361770 - DNA, 22 bp, Artificial Sequence
  chemically synthesized
tcatgaaaaaatttcatgaaaa

SEQ ID NO: 1361771 - DNA, 22 bp, Artificial Sequence
  chemically synthesized
catgaaaaaatttcatgaaaaa

SEQ ID NO: 1361772 - DNA, 22 bp, Artificial Sequence
  chemically synthesized
atgaaaaaatttcatgaaaaaa

SEQ ID NO: 1361773 - DNA, 22 bp, Artificial Sequence
  chemically synthesized
aaatgattttgtttattttttc

SEQ ID NO: 1361774 - DNA, 22 bp, Artificial Sequence
  chemically synthesized
aaagctaaaatgattttgttta

SEQ ID NO: 1361775 - DNA, 22 bp, Artificial Sequence
  chemically synthesized
catgaaaaaataaacaaaatca

SEQ ID NO: 1361776 - DNA, 22 bp, Artificial Sequence
  chemically synthesized
atgaaaaaataaacaaaatcat

SEQ ID NO: 1361777 - DNA, 22 bp, Artificial Sequence
  chemically synthesized
caagattaaaagctaaaatgat

SEQ ID NO: 1361778 - DNA, 22 bp, Artificial Sequence
  chemically synthesized
aatatagttccaagattaaaag

SEQ ID NO: 1361779 - DNA, 22 bp, Artificial Sequence
  chemically synthesized
tactaaatatagttccaagatt

SEQ ID NO: 1361780 - DNA, 22 bp, Artificial Sequence
  chemically synthesized
ctatactaaatatagttccaag

SEQ ID NO: 1361781 - DNA, 22 bp, Artificial Sequence
  chemically synthesized
tagcttttaatcttggaactat

SEQ ID NO: 1361782 - DNA, 22 bp, Artificial Sequence
  chemically synthesized
agcttttaatcttggaactata

SEQ ID NO: 1361783 - DNA, 22 bp, Artificial Sequence
  chemically synthesized
gcttttaatcttggaactatat

SEQ ID NO: 1361784 - DNA, 22 bp, Artificial Sequence
  chemically synthesized
ttaatcttggaactatatttag

SEQ ID NO: 1361785 - DNA, 22 bp, Artificial Sequence
  chemically synthesized
taatcttggaactatatttagt

SEQ ID NO: 1361786 - DNA, 22 bp, Artificial Sequence
  chemically synthesized
aatcttggaactatatttagta

SEQ ID NO: 1361787 - DNA, 22 bp, Artificial Sequence
  chemically synthesized
atcttggaactatatttagtat

SEQ ID NO: 1361788 - DNA, 22 bp, Artificial Sequence
  chemically synthesized
tgaatcactcctatactaaata

SEQ ID NO: 1361789 - DNA, 22 bp, Artificial Sequence
  chemically synthesized
gtgaatcactcctatactaaat

SEQ ID NO: 1361790 - DNA, 22 bp, Artificial Sequence
  chemically synthesized
tttgtgaatcactcctatacta

SEQ ID NO: 1361791 - DNA, 22 bp, Artificial Sequence
  chemically synthesized
ggaactatatttagtataggag

SEQ ID NO: 1361792 - DNA, 22 bp, Artificial Sequence
  chemically synthesized
gaactatatttagtataggagt

SEQ ID NO: 1361793 - DNA, 22 bp, Artificial Sequence
  chemically synthesized
ctatttgtgaatcactcctata

SEQ ID NO: 1361794 - DNA, 22 bp, Artificial Sequence
  chemically synthesized
tgctatttgtgaatcactccta

SEQ ID NO: 1361795 - DNA, 22 bp, Artificial Sequence
  chemically synthesized
tatttagtataggagtgattca

SEQ ID NO: 1361796 - DNA, 22 bp, Artificial Sequence
  chemically synthesized
agtataggagtgattcacaaat

SEQ ID NO: 1361797 - DNA, 22 bp, Artificial Sequence
  chemically synthesized
gtataggagtgattcacaaata

SEQ ID NO: 1361798 - DNA, 22 bp, Artificial Sequence
  chemically synthesized
gaatgggagagtaactctgcta

SEQ ID NO: 1361799 - DNA, 22 bp, Artificial Sequence
  chemically synthesized
cgaatgggagagtaactctgct

SEQ ID NO: 1361800 - DNA, 22 bp, Artificial Sequence
  chemically synthesized
acaaatagcagagttactctcc

SEQ ID NO: 1361801 - DNA, 22 bp, Artificial Sequence
  chemically synthesized
ataaccccttcgaatgggagag

SEQ ID NO: 1361802 - DNA, 22 bp, Artificial Sequence
  chemically synthesized
tgataaccccttcgaatgggag

SEQ ID NO: 1361803 - DNA, 22 bp, Artificial Sequence
  chemically synthesized
cagagattctgataaccccttc

SEQ ID NO: 1361804 - DNA, 22 bp, Artificial Sequence
  chemically synthesized
ctctcccattcgaaggggttat

SEQ ID NO: 1361805 - DNA, 22 bp, Artificial Sequence
  chemically synthesized
ccagagattctgataacccctt

SEQ ID NO: 1361806 - DNA, 22 bp, Artificial Sequence
  chemically synthesized
tcccattcgaaggggttatcag

SEQ ID NO: 1361807 - DNA, 22 bp, Artificial Sequence
  chemically synthesized
ccattcgaaggggttatcagaa

SEQ ID NO: 1361808 - DNA, 22 bp, Artificial Sequence
  chemically synthesized
gaaggggttatcagaatctctg

SEQ ID NO: 1361809 - DNA, 22 bp, Artificial Sequence
  chemically synthesized
aaagtgaatgtgtcttccagag

SEQ ID NO: 1361810 - DNA, 22 bp, Artificial Sequence
  chemically synthesized
tcagaatctctggaagacacat

SEQ ID NO: 1361811 - DNA, 22 bp, Artificial Sequence
  chemically synthesized
atactaaaagtgaatgtgtctt

SEQ ID NO: 1361812 - DNA, 22 bp, Artificial Sequence
  chemically synthesized
aatactaaaagtgaatgtgtct

SEQ ID NO: 1361813 - DNA, 22 bp, Artificial Sequence
  chemically synthesized
cttaatactaaaagtgaatgtg

SEQ ID NO: 1361814 - DNA, 22 bp, Artificial Sequence
  chemically synthesized
tacttaatactaaaagtgaatg

SEQ ID NO: 1361815 - DNA, 22 bp, Artificial Sequence
  chemically synthesized
tggaagacacattcacttttag

SEQ ID NO: 1361816 - DNA, 22 bp, Artificial Sequence
  chemically synthesized
cctctacttaatactaaaagtg

SEQ ID NO: 1361817 - DNA, 22 bp, Artificial Sequence
  chemically synthesized
gaagacacattcacttttagta

SEQ ID NO: 1361818 - DNA, 22 bp, Artificial Sequence
  chemically synthesized
aagctccctctacttaatacta

SEQ ID NO: 1361819 - DNA, 22 bp, Artificial Sequence
  chemically synthesized
caagctccctctacttaatact

SEQ ID NO: 1361820 - DNA, 22 bp, Artificial Sequence
  chemically synthesized
acttttagtattaagtagaggg

SEQ ID NO: 1361821 - DNA, 22 bp, Artificial Sequence
  chemically synthesized
caaaatttcaagctccctctac

SEQ ID NO: 1361822 - DNA, 22 bp, Artificial Sequence
  chemically synthesized
gcaaaatttcaagctccctcta

SEQ ID NO: 1361823 - DNA, 22 bp, Artificial Sequence
  chemically synthesized
ttagtattaagtagagggagct

SEQ ID NO: 1361824 - DNA, 22 bp, Artificial Sequence
  chemically synthesized
tagtattaagtagagggagctt

SEQ ID NO: 1361825 - DNA, 22 bp, Artificial Sequence
  chemically synthesized
agtattaagtagagggagcttg

SEQ ID NO: 1361826 - DNA, 22 bp, Artificial Sequence
  chemically synthesized
gtattaagtagagggagcttga

SEQ ID NO: 1361827 - DNA, 22 bp, Artificial Sequence
  chemically synthesized
aaatccttgcaaaatttcaagc

SEQ ID NO: 1361828 - DNA, 22 bp, Artificial Sequence
  chemically synthesized
agtagagggagcttgaaatttt

SEQ ID NO: 1361829 - DNA, 22 bp, Artificial Sequence
  chemically synthesized
tccctaaaatccttgcaaaatt

SEQ ID NO: 1361830 - DNA, 22 bp, Artificial Sequence
  chemically synthesized
tagaattgtccctaaaatcctt

SEQ ID NO: 1361831 - DNA, 22 bp, Artificial Sequence
  chemically synthesized
atagaattgtccctaaaatcct

SEQ ID NO: 1361832 - DNA, 22 bp, Artificial Sequence
  chemically synthesized
gaaattttgcaaggattttagg

SEQ ID NO: 1361833 - DNA, 22 bp, Artificial Sequence
  chemically synthesized
aaattttgcaaggattttaggg

SEQ ID NO: 1361834 - DNA, 22 bp, Artificial Sequence
  chemically synthesized
tgcaaggattttagggacaatt

SEQ ID NO: 1361835 - DNA, 22 bp, Artificial Sequence
  chemically synthesized
tgtcacttatagaattgtccct

SEQ ID NO: 1361836 - DNA, 22 bp, Artificial Sequence
  chemically synthesized
gcaaggattttagggacaattc

SEQ ID NO: 1361837 - DNA, 22 bp, Artificial Sequence
  chemically synthesized
atgtcacttatagaattgtccc

SEQ ID NO: 1361838 - DNA, 22 bp, Artificial Sequence
  chemically synthesized
caaggattttagggacaattct

SEQ ID NO: 1361839 - DNA, 22 bp, Artificial Sequence
  chemically synthesized
tttatgtcacttatagaattgt

SEQ ID NO: 1361840 - DNA, 22 bp, Artificial Sequence
  chemically synthesized
tatttatgtcacttatagaatt

SEQ ID NO: 1361841 - DNA, 22 bp, Artificial Sequence
  chemically synthesized
ctatttatgtcacttatagaat

SEQ ID NO: 1361842 - DNA, 22 bp, Artificial Sequence
  chemically synthesized
tctatttatgtcacttatagaa

SEQ ID NO: 1361843 - DNA, 22 bp, Artificial Sequence
  chemically synthesized
ttctatttatgtcacttataga

SEQ ID NO: 1361844 - DNA, 22 bp, Artificial Sequence
  chemically synthesized
tttctatttatgtcacttatag

SEQ ID NO: 1361845 - DNA, 22 bp, Artificial Sequence
  chemically synthesized
tagggacaattctataagtgac

SEQ ID NO: 1361846 - DNA, 22 bp, Artificial Sequence
  chemically synthesized
agggacaattctataagtgaca

SEQ ID NO: 1361847 - DNA, 22 bp, Artificial Sequence
  chemically synthesized
gggacaattctataagtgacat

SEQ ID NO: 1361848 - DNA, 22 bp, Artificial Sequence
  chemically synthesized
gagggttttttctatttatgtc

SEQ ID NO: 1361849 - DNA, 22 bp, Artificial Sequence
  chemically synthesized
ggagggttttttctatttatgt

SEQ ID NO: 1361850 - DNA, 22 bp, Artificial Sequence
  chemically synthesized
tataagtgacataaatagaaaa

SEQ ID NO: 1361851 - DNA, 22 bp, Artificial Sequence
  chemically synthesized
taagtgacataaatagaaaaaa

SEQ ID NO: 1361852 - DNA, 22 bp, Artificial Sequence
  chemically synthesized
ccaagtttggagggttttttct

SEQ ID NO: 1361853 - DNA, 22 bp, Artificial Sequence
  chemically synthesized
accaagtttggagggttttttc

SEQ ID NO: 1361854 - DNA, 22 bp, Artificial Sequence
  chemically synthesized
taccaagtttggagggtttttt

SEQ ID NO: 1361855 - DNA, 22 bp, Artificial Sequence
  chemically synthesized
ttttaccaagtttggagggttt

SEQ ID NO: 1361856 - DNA, 22 bp, Artificial Sequence
  chemically synthesized
ttattttaccaagtttggaggg

SEQ ID NO: 1361857 - DNA, 22 bp, Artificial Sequence
  chemically synthesized
attattttaccaagtttggagg

SEQ ID NO: 1361858 - DNA, 22 bp, Artificial Sequence
  chemically synthesized
caaacttggtaaaataataaat

SEQ ID NO: 1361859 - DNA, 22 bp, Artificial Sequence
  chemically synthesized
ggtaaaataataaattatccca

SEQ ID NO: 1361860 - DNA, 22 bp, Artificial Sequence
  chemically synthesized
gtaaaataataaattatcccat

SEQ ID NO: 1361861 - DNA, 22 bp, Artificial Sequence
  chemically synthesized
aaatggcaacaccatgggataa

SEQ ID NO: 1361862 - DNA, 22 bp, Artificial Sequence
  chemically synthesized
tcccatggtgttgccattttaa

SEQ ID NO: 1361863 - DNA, 22 bp, Artificial Sequence
  chemically synthesized
atacagatatcaaagttaaaat

SEQ ID NO: 1361864 - DNA, 22 bp, Artificial Sequence
  chemically synthesized
aatacagatatcaaagttaaaa

SEQ ID NO: 1361865 - DNA, 22 bp, Artificial Sequence
  chemically synthesized
taatacagatatcaaagttaaa

SEQ ID NO: 1361866 - DNA, 22 bp, Artificial Sequence
  chemically synthesized
attttaatacagatatcaaagt

SEQ ID NO: 1361867 - DNA, 22 bp, Artificial Sequence
  chemically synthesized
cattttaatacagatatcaaag

SEQ ID NO: 1361868 - DNA, 22 bp, Artificial Sequence
  chemically synthesized
ccattttaactttgatatctgt

SEQ ID NO: 1361869 - DNA, 22 bp, Artificial Sequence
  chemically synthesized
aagtttcattttaatacagata

SEQ ID NO: 1361870 - DNA, 22 bp, Artificial Sequence
  chemically synthesized
tgaagtttcattttaatacaga

SEQ ID NO: 1361871 - DNA, 22 bp, Artificial Sequence
  chemically synthesized
taactttgatatctgtattaaa

SEQ ID NO: 1361872 - DNA, 22 bp, Artificial Sequence
  chemically synthesized
aactttgatatctgtattaaaa

SEQ ID NO: 1361873 - DNA, 22 bp, Artificial Sequence
  chemically synthesized
actttgatatctgtattaaaat

SEQ ID NO: 1361874 - DNA, 22 bp, Artificial Sequence
  chemically synthesized
gagttctgaagtttcattttaa

SEQ ID NO: 1361875 - DNA, 22 bp, Artificial Sequence
  chemically synthesized
tgatatctgtattaaaatgaaa

SEQ ID NO: 1361876 - DNA, 22 bp, Artificial Sequence
  chemically synthesized
ggagttctgaagtttcatttta

SEQ ID NO: 1361877 - DNA, 22 bp, Artificial Sequence
  chemically synthesized
gatatctgtattaaaatgaaac

SEQ ID NO: 1361878 - DNA, 22 bp, Artificial Sequence
  chemically synthesized
atatctgtattaaaatgaaact

SEQ ID NO: 1361879 - DNA, 22 bp, Artificial Sequence
  chemically synthesized
tattaaaatgaaacttcagaac

SEQ ID NO: 1361880 - DNA, 22 bp, Artificial Sequence
  chemically synthesized
acatatgtttggagttctgaag

SEQ ID NO: 1361881 - DNA, 22 bp, Artificial Sequence
  chemically synthesized
aaatgaaacttcagaactccaa

SEQ ID NO: 1361882 - DNA, 22 bp, Artificial Sequence
  chemically synthesized
taaaatattgacatatgtttgg

SEQ ID NO: 1361883 - DNA, 22 bp, Artificial Sequence
  chemically synthesized
cagaactccaaacatatgtcaa

SEQ ID NO: 1361884 - DNA, 22 bp, Artificial Sequence
  chemically synthesized
agaactccaaacatatgtcaat

SEQ ID NO: 1361885 - DNA, 22 bp, Artificial Sequence
  chemically synthesized
atgctataaaatattgacatat

SEQ ID NO: 1361886 - DNA, 22 bp, Artificial Sequence
  chemically synthesized
catgctataaaatattgacata

SEQ ID NO: 1361887 - DNA, 22 bp, Artificial Sequence
  chemically synthesized
caaacatatgtcaatattttat

SEQ ID NO: 1361888 - DNA, 22 bp, Artificial Sequence
  chemically synthesized
gggtttcatgctataaaatatt

SEQ ID NO: 1361889 - DNA, 22 bp, Artificial Sequence
  chemically synthesized
ggggtttcatgctataaaatat

SEQ ID NO: 1361890 - DNA, 22 bp, Artificial Sequence
  chemically synthesized
cttggggtttcatgctataaaa

SEQ ID NO: 1361891 - DNA, 22 bp, Artificial Sequence
  chemically synthesized
ccttggggtttcatgctataaa

SEQ ID NO: 1361892 - DNA, 22 bp, Artificial Sequence
  chemically synthesized
gacttccttggggtttcatgct

SEQ ID NO: 1361893 - DNA, 22 bp, Artificial Sequence
  chemically synthesized
gttagacttccttggggtttca

SEQ ID NO: 1361894 - DNA, 22 bp, Artificial Sequence
  chemically synthesized
ttagttagacttccttggggtt

SEQ ID NO: 1361895 - DNA, 22 bp, Artificial Sequence
  chemically synthesized
tatagcatgaaaccccaaggaa

SEQ ID NO: 1361896 - DNA, 22 bp, Artificial Sequence
  chemically synthesized
atagcatgaaaccccaaggaag

SEQ ID NO: 1361897 - DNA, 22 bp, Artificial Sequence
  chemically synthesized
tagcatgaaaccccaaggaagt

SEQ ID NO: 1361898 - DNA, 22 bp, Artificial Sequence
  chemically synthesized
cgtaaaacatctattagttaga

SEQ ID NO: 1361899 - DNA, 22 bp, Artificial Sequence
  chemically synthesized
cctacgtaaaacatctattagt

SEQ ID NO: 1361900 - DNA, 22 bp, Artificial Sequence
  chemically synthesized
ccctacgtaaaacatctattag

SEQ ID NO: 1361901 - DNA, 22 bp, Artificial Sequence
  chemically synthesized
tccctacgtaaaacatctatta

SEQ ID NO: 1361902 - DNA, 22 bp, Artificial Sequence
  chemically synthesized
ttccctacgtaaaacatctatt

SEQ ID NO: 1361903 - DNA, 22 bp, Artificial Sequence
  chemically synthesized
accttttccctacgtaaaacat

SEQ ID NO: 1361904 - DNA, 22 bp, Artificial Sequence
  chemically synthesized
caccttttccctacgtaaaaca

SEQ ID NO: 1361905 - DNA, 22 bp, Artificial Sequence
  chemically synthesized
actaatagatgttttacgtagg

SEQ ID NO: 1361906 - DNA, 22 bp, Artificial Sequence
  chemically synthesized
atagatgttttacgtagggaaa

SEQ ID NO: 1361907 - DNA, 22 bp, Artificial Sequence
  chemically synthesized
tagtcttcaccttttccctacg

SEQ ID NO: 1361908 - DNA, 22 bp, Artificial Sequence
  chemically synthesized
gtagtcttcaccttttccctac

SEQ ID NO: 1361909 - DNA, 22 bp, Artificial Sequence
  chemically synthesized
tacgtagggaaaaggtgaagac

SEQ ID NO: 1361910 - DNA, 22 bp, Artificial Sequence
  chemically synthesized
acgtagggaaaaggtgaagact

SEQ ID NO: 1361911 - DNA, 22 bp, Artificial Sequence
  chemically synthesized
cgtagggaaaaggtgaagacta

SEQ ID NO: 1361912 - DNA, 22 bp, Artificial Sequence
  chemically synthesized
caaactatttatttgcttggtt

SEQ ID NO: 1361913 - DNA, 22 bp, Artificial Sequence
  chemically synthesized
aaaaaacaaacaaaccaagcaa

SEQ ID NO: 1361914 - DNA, 22 bp, Artificial Sequence
  chemically synthesized
caaaaaacaaacaaaccaagca

SEQ ID NO: 1361915 - DNA, 22 bp, Artificial Sequence
  chemically synthesized
atcttcaaaaaacaaacaaacc

SEQ ID NO: 1361916 - DNA, 22 bp, Artificial Sequence
  chemically synthesized
tttatttgcttggtttgtttgt

SEQ ID NO: 1361917 - DNA, 22 bp, Artificial Sequence
  chemically synthesized
atttgcttggtttgtttgtttt

SEQ ID NO: 1361918 - DNA, 22 bp, Artificial Sequence
  chemically synthesized
tttgcttggtttgtttgttttt

SEQ ID NO: 1361919 - DNA, 22 bp, Artificial Sequence
  chemically synthesized
gcttggtttgtttgttttttga

SEQ ID NO: 1361920 - DNA, 22 bp, Artificial Sequence
  chemically synthesized
cttggtttgtttgttttttgaa

SEQ ID NO: 1361921 - DNA, 22 bp, Artificial Sequence
  chemically synthesized
ggtttgtttgttttttgaagat

SEQ ID NO: 1361922 - DNA, 22 bp, Artificial Sequence
  chemically synthesized
gtttgtttgttttttgaagatc

SEQ ID NO: 1361923 - DNA, 22 bp, Artificial Sequence
  chemically synthesized
aatgcagtatactgatcttcaa

SEQ ID NO: 1361924 - DNA, 22 bp, Artificial Sequence
  chemically synthesized
gtttgttttttgaagatcagta

SEQ ID NO: 1361925 - DNA, 22 bp, Artificial Sequence
  chemically synthesized
tttgttttttgaagatcagtat

SEQ ID NO: 1361926 - DNA, 22 bp, Artificial Sequence
  chemically synthesized
gttttttgaagatcagtatact

SEQ ID NO: 1361927 - DNA, 22 bp, Artificial Sequence
  chemically synthesized
ttttttgaagatcagtatactg

SEQ ID NO: 1361928 - DNA, 22 bp, Artificial Sequence
  chemically synthesized
tttgaagatcagtatactgcat

SEQ ID NO: 1361929 - DNA, 22 bp, Artificial Sequence
  chemically synthesized
ttgaagatcagtatactgcatt

SEQ ID NO: 1361930 - DNA, 22 bp, Artificial Sequence
  chemically synthesized
tagagtgtgctcaatgcagtat

SEQ ID NO: 1361931 - DNA, 22 bp, Artificial Sequence
  chemically synthesized
tgaagatcagtatactgcattg

SEQ ID NO: 1361932 - DNA, 22 bp, Artificial Sequence
  chemically synthesized
gtagagtgtgctcaatgcagta

SEQ ID NO: 1361933 - DNA, 22 bp, Artificial Sequence
  chemically synthesized
gaagatcagtatactgcattga

SEQ ID NO: 1361934 - DNA, 22 bp, Artificial Sequence
  chemically synthesized
aagatcagtatactgcattgag

SEQ ID NO: 1361935 - DNA, 22 bp, Artificial Sequence
  chemically synthesized
cccttgtagagtgtgctcaatg

SEQ ID NO: 1361936 - DNA, 22 bp, Artificial Sequence
  chemically synthesized
ccccttgtagagtgtgctcaat

SEQ ID NO: 1361937 - DNA, 22 bp, Artificial Sequence
  chemically synthesized
cattgagcacactctacaaggg

SEQ ID NO: 1361938 - DNA, 22 bp, Artificial Sequence
  chemically synthesized
atgaaaatatttccccttgtag

SEQ ID NO: 1361939 - DNA, 22 bp, Artificial Sequence
  chemically synthesized
catgaaaatatttccccttgta

SEQ ID NO: 1361940 - DNA, 22 bp, Artificial Sequence
  chemically synthesized
agcacactctacaaggggaaat

SEQ ID NO: 1361941 - DNA, 22 bp, Artificial Sequence
  chemically synthesized
tacaaggggaaatattttcatg

SEQ ID NO: 1361942 - DNA, 22 bp, Artificial Sequence
  chemically synthesized
caaggggaaatattttcatgaa

SEQ ID NO: 1361943 - DNA, 22 bp, Artificial Sequence
  chemically synthesized
aatgcaaccaggtttcatgaaa

SEQ ID NO: 1361944 - DNA, 22 bp, Artificial Sequence
  chemically synthesized
ttaaatgcaaccaggtttcatg

SEQ ID NO: 1361945 - DNA, 22 bp, Artificial Sequence
  chemically synthesized
attaaatgcaaccaggtttcat

SEQ ID NO: 1361946 - DNA, 22 bp, Artificial Sequence
  chemically synthesized
tattaaatgcaaccaggtttca

SEQ ID NO: 1361947 - DNA, 22 bp, Artificial Sequence
  chemically synthesized
ttattaaatgcaaccaggtttc

SEQ ID NO: 1361948 - DNA, 22 bp, Artificial Sequence
  chemically synthesized
tcatgaaacctggttgcattta

SEQ ID NO: 1361949 - DNA, 22 bp, Artificial Sequence
  chemically synthesized
catgaaacctggttgcatttaa

SEQ ID NO: 1361950 - DNA, 22 bp, Artificial Sequence
  chemically synthesized
atgaaacctggttgcatttaat

SEQ ID NO: 1361951 - DNA, 22 bp, Artificial Sequence
  chemically synthesized
gttgcatttaataaaaacgttt

SEQ ID NO: 1361952 - DNA, 22 bp, Artificial Sequence
  chemically synthesized
cagtgtgggaaataaacgtttt

SEQ ID NO: 1361953 - DNA, 22 bp, Artificial Sequence
  chemically synthesized
catttaataaaaacgtttattt

SEQ ID NO: 1361954 - DNA, 22 bp, Artificial Sequence
  chemically synthesized
aataaaaacgtttatttcccac

SEQ ID NO: 1361955 - DNA, 22 bp, Artificial Sequence
  chemically synthesized
ataaaaacgtttatttcccaca

SEQ ID NO: 1361956 - DNA, 22 bp, Artificial Sequence
  chemically synthesized
gggaaggtcatgggctgcagtg

SEQ ID NO: 1361957 - DNA, 22 bp, Artificial Sequence
  chemically synthesized
tggggaaggtcatgggctgcag

SEQ ID NO: 1361958 - DNA, 22 bp, Artificial Sequence
  chemically synthesized
ctggggaaggtcatgggctgca

SEQ ID NO: 1361959 - DNA, 22 bp, Artificial Sequence
  chemically synthesized
atttcccacactgcagcccatg

SEQ ID NO: 1361960 - DNA, 22 bp, Artificial Sequence
  chemically synthesized
tctggggaaggtcatgggctgc

SEQ ID NO: 1361961 - DNA, 22 bp, Artificial Sequence
  chemically synthesized
tttcccacactgcagcccatga

SEQ ID NO: 1361962 - DNA, 22 bp, Artificial Sequence
  chemically synthesized
cccacactgcagcccatgacct

SEQ ID NO: 1361963 - DNA, 22 bp, Artificial Sequence
  chemically synthesized
ccacactgcagcccatgacctt

SEQ ID NO: 1361964 - DNA, 22 bp, Artificial Sequence
  chemically synthesized
gaatattttctggggaaggtca

SEQ ID NO: 1361965 - DNA, 22 bp, Artificial Sequence
  chemically synthesized
cagcccatgaccttccccagaa

SEQ ID NO: 1361966 - DNA, 22 bp, Artificial Sequence
  chemically synthesized
gtattggaatattttctgggga

SEQ ID NO: 1361967 - DNA, 22 bp, Artificial Sequence
  chemically synthesized
gttcgtattggaatattttctg

SEQ ID NO: 1361968 - DNA, 22 bp, Artificial Sequence
  chemically synthesized
ccccagaaaatattccaatacg

SEQ ID NO: 1361969 - DNA, 22 bp, Artificial Sequence
  chemically synthesized
cccagaaaatattccaatacga

SEQ ID NO: 1361970 - DNA, 22 bp, Artificial Sequence
  chemically synthesized
tcaaggcagttggttcgtattg

SEQ ID NO: 1361971 - DNA, 22 bp, Artificial Sequence
  chemically synthesized
ttatcaaggcagttggttcgta

SEQ ID NO: 1361972 - DNA, 22 bp, Artificial Sequence
  chemically synthesized
tgttatcaaggcagttggttcg

SEQ ID NO: 1361973 - DNA, 22 bp, Artificial Sequence
  chemically synthesized
tgttctgttatcaaggcagttg

SEQ ID NO: 1361974 - DNA, 22 bp, Artificial Sequence
  chemically synthesized
gtgttctgttatcaaggcagtt

SEQ ID NO: 1361975 - DNA, 22 bp, Artificial Sequence
  chemically synthesized
caatacgaaccaactgccttga

SEQ ID NO: 1361976 - DNA, 22 bp, Artificial Sequence
  chemically synthesized
ggaggtttgtgttctgttatca

SEQ ID NO: 1361977 - DNA, 22 bp, Artificial Sequence
  chemically synthesized
tagtcctaggaggtttgtgttc

SEQ ID NO: 1361978 - DNA, 22 bp, Artificial Sequence
  chemically synthesized
ccttgataacagaacacaaacc

SEQ ID NO: 1361979 - DNA, 22 bp, Artificial Sequence
  chemically synthesized
ctatagtcctaggaggtttgtg

SEQ ID NO: 1361980 - DNA, 22 bp, Artificial Sequence
  chemically synthesized
gataacagaacacaaacctcct

SEQ ID NO: 1361981 - DNA, 22 bp, Artificial Sequence
  chemically synthesized
ataacagaacacaaacctccta

SEQ ID NO: 1361982 - DNA, 22 bp, Artificial Sequence
  chemically synthesized
acaaagtcctgctatagtccta

SEQ ID NO: 1361983 - DNA, 22 bp, Artificial Sequence
  chemically synthesized
tcacaaagtcctgctatagtcc

SEQ ID NO: 1361984 - DNA, 22 bp, Artificial Sequence
  chemically synthesized
ctcacaaagtcctgctatagtc

SEQ ID NO: 1361985 - DNA, 22 bp, Artificial Sequence
  chemically synthesized
tctcacaaagtcctgctatagt

SEQ ID NO: 1361986 - DNA, 22 bp, Artificial Sequence
  chemically synthesized
tttctcacaaagtcctgctata

SEQ ID NO: 1361987 - DNA, 22 bp, Artificial Sequence
  chemically synthesized
ctttctcacaaagtcctgctat

SEQ ID NO: 1361988 - DNA, 22 bp, Artificial Sequence
  chemically synthesized
tctttctcacaaagtcctgcta

SEQ ID NO: 1361989 - DNA, 22 bp, Artificial Sequence
  chemically synthesized
ctaggactatagcaggactttg

SEQ ID NO: 1361990 - DNA, 22 bp, Artificial Sequence
  chemically synthesized
ggactatagcaggactttgtga

SEQ ID NO: 1361991 - DNA, 22 bp, Artificial Sequence
  chemically synthesized
tagcaggactttgtgagaaaga

SEQ ID NO: 1361992 - DNA, 22 bp, Artificial Sequence
  chemically synthesized
agagagaggcaatggttttctt

SEQ ID NO: 1361993 - DNA, 22 bp, Artificial Sequence
  chemically synthesized
tgtgagaaagaaaaccattgcc

SEQ ID NO: 1361994 - DNA, 22 bp, Artificial Sequence
  chemically synthesized
gattcagagagaggcaatggtt

SEQ ID NO: 1361995 - DNA, 22 bp, Artificial Sequence
  chemically synthesized
gtgagaaagaaaaccattgcct

SEQ ID NO: 1361996 - DNA, 22 bp, Artificial Sequence
  chemically synthesized
tgagaaagaaaaccattgcctc

SEQ ID NO: 1361997 - DNA, 22 bp, Artificial Sequence
  chemically synthesized
attggattcagagagaggcaat

SEQ ID NO: 1361998 - DNA, 22 bp, Artificial Sequence
  chemically synthesized
gattggattcagagagaggcaa

SEQ ID NO: 1361999 - DNA, 22 bp, Artificial Sequence
  chemically synthesized
tgattggattcagagagaggca

SEQ ID NO: 1362000 - DNA, 22 bp, Artificial Sequence
  chemically synthesized
aggttttgattggattcagaga

SEQ ID NO: 1362001 - DNA, 22 bp, Artificial Sequence
  chemically synthesized
cctctctctgaatccaatcaaa

SEQ ID NO: 1362002 - DNA, 22 bp, Artificial Sequence
  chemically synthesized
tctctgaatccaatcaaaacct

SEQ ID NO: 1362003 - DNA, 22 bp, Artificial Sequence
  chemically synthesized
tacagtacattcaggttttgat

SEQ ID NO: 1362004 - DNA, 22 bp, Artificial Sequence
  chemically synthesized
atacagtacattcaggttttga

SEQ ID NO: 1362005 - DNA, 22 bp, Artificial Sequence
  chemically synthesized
tctgaatccaatcaaaacctga

SEQ ID NO: 1362006 - DNA, 22 bp, Artificial Sequence
  chemically synthesized
tatacagtacattcaggttttg

SEQ ID NO: 1362007 - DNA, 22 bp, Artificial Sequence
  chemically synthesized
ttatacagtacattcaggtttt

SEQ ID NO: 1362008 - DNA, 22 bp, Artificial Sequence
  chemically synthesized
tgaatccaatcaaaacctgaat

SEQ ID NO: 1362009 - DNA, 22 bp, Artificial Sequence
  chemically synthesized
aatccaatcaaaacctgaatgt

SEQ ID NO: 1362010 - DNA, 22 bp, Artificial Sequence
  chemically synthesized
tttttatacagtacattcaggt

SEQ ID NO: 1362011 - DNA, 22 bp, Artificial Sequence
  chemically synthesized
atttttatacagtacattcagg

SEQ ID NO: 1362012 - DNA, 22 bp, Artificial Sequence
  chemically synthesized
gtttatttttatacagtacatt

SEQ ID NO: 1362013 - DNA, 22 bp, Artificial Sequence
  chemically synthesized
ggtttatttttatacagtacat

SEQ ID NO: 1362014 - DNA, 22 bp, Artificial Sequence
  chemically synthesized
aatgtactgtataaaaataaac

SEQ ID NO: 1362015 - DNA, 22 bp, Artificial Sequence
  chemically synthesized
tataaaaataaaccaaggtcat

SEQ ID NO: 1362016 - DNA, 22 bp, Artificial Sequence
  chemically synthesized
aaggcacgccaaatcacaatga

SEQ ID NO: 1362017 - DNA, 22 bp, Artificial Sequence
  chemically synthesized
gaaggcacgccaaatcacaatg

SEQ ID NO: 1362018 - DNA, 22 bp, Artificial Sequence
  chemically synthesized
ttccttgtcattgtgatttggc

SEQ ID NO: 1362019 - DNA, 22 bp, Artificial Sequence
  chemically synthesized
cttgtcattgtgatttggcgtg

SEQ ID NO: 1362020 - DNA, 22 bp, Artificial Sequence
  chemically synthesized
gtcattgtgatttggcgtgcct

SEQ ID NO: 1362021 - DNA, 22 bp, Artificial Sequence
  chemically synthesized
tcattgtgatttggcgtgcctt

SEQ ID NO: 1362022 - DNA, 22 bp, Artificial Sequence
  chemically synthesized
tgatttggcgtgccttcaaatt

SEQ ID NO: 1362023 - DNA, 22 bp, Artificial Sequence
  chemically synthesized
aaatatacagggtatataattt

SEQ ID NO: 1362024 - DNA, 22 bp, Artificial Sequence
  chemically synthesized
ggcgtgccttcaaattatatac

SEQ ID NO: 1362025 - DNA, 22 bp, Artificial Sequence
  chemically synthesized
gaaatatacagggtatataatt

SEQ ID NO: 1362026 - DNA, 22 bp, Artificial Sequence
  chemically synthesized
gcgtgccttcaaattatatacc

SEQ ID NO: 1362027 - DNA, 22 bp, Artificial Sequence
  chemically synthesized
tttgaaatatacagggtatata

SEQ ID NO: 1362028 - DNA, 22 bp, Artificial Sequence
  chemically synthesized
caaattatataccctgtatatt

SEQ ID NO: 1362029 - DNA, 22 bp, Artificial Sequence
  chemically synthesized
aaattatataccctgtatattt

SEQ ID NO: 1362030 - DNA, 22 bp, Artificial Sequence
  chemically synthesized
tataccctgtatatttcaaata

SEQ ID NO: 1362031 - DNA, 22 bp, Artificial Sequence
  chemically synthesized
atggaggcggtgcagttatttg

SEQ ID NO: 1362032 - DNA, 22 bp, Artificial Sequence
  chemically synthesized
tatatttcaaataactgcaccg

SEQ ID NO: 1362033 - DNA, 22 bp, Artificial Sequence
  chemically synthesized
agttaatggaggcggtgcagtt

SEQ ID NO: 1362034 - DNA, 22 bp, Artificial Sequence
  chemically synthesized
caaataactgcaccgcctccat

SEQ ID NO: 1362035 - DNA, 22 bp, Artificial Sequence
  chemically synthesized
aaataactgcaccgcctccatt

SEQ ID NO: 1362036 - DNA, 22 bp, Artificial Sequence
  chemically synthesized
aagtgatgtcaaactcagttaa

SEQ ID NO: 1362037 - DNA, 22 bp, Artificial Sequence
  chemically synthesized
caccgcctccattaactgagtt

SEQ ID NO: 1362038 - DNA, 22 bp, Artificial Sequence
  chemically synthesized
attaaagtgatgtcaaactcag

SEQ ID NO: 1362039 - DNA, 22 bp, Artificial Sequence
  chemically synthesized
cattaactgagtttgacatcac

SEQ ID NO: 1362040 - DNA, 22 bp, Artificial Sequence
  chemically synthesized
actgagtttgacatcactttaa

SEQ ID NO: 1362041 - DNA, 22 bp, Artificial Sequence
  chemically synthesized
aaaagatacattgattaaagtg

SEQ ID NO: 1362042 - DNA, 22 bp, Artificial Sequence
  chemically synthesized
agtttgacatcactttaatcaa

SEQ ID NO: 1362043 - DNA, 22 bp, Artificial Sequence
  chemically synthesized
tgaaaagatacattgattaaag

SEQ ID NO: 1362044 - DNA, 22 bp, Artificial Sequence
  chemically synthesized
attctgaaaagatacattgatt

SEQ ID NO: 1362045 - DNA, 22 bp, Artificial Sequence
  chemically synthesized
gacatcactttaatcaatgtat

SEQ ID NO: 1362046 - DNA, 22 bp, Artificial Sequence
  chemically synthesized
cattctgaaaagatacattgat

SEQ ID NO: 1362047 - DNA, 22 bp, Artificial Sequence
  chemically synthesized
acatcactttaatcaatgtatc

SEQ ID NO: 1362048 - DNA, 22 bp, Artificial Sequence
  chemically synthesized
tcattctgaaaagatacattga

SEQ ID NO: 1362049 - DNA, 22 bp, Artificial Sequence
  chemically synthesized
cctttcattctgaaaagataca

SEQ ID NO: 1362050 - DNA, 22 bp, Artificial Sequence
  chemically synthesized
tgcctttcattctgaaaagata

SEQ ID NO: 1362051 - DNA, 22 bp, Artificial Sequence
  chemically synthesized
ctgcctttcattctgaaaagat

SEQ ID NO: 1362052 - DNA, 22 bp, Artificial Sequence
  chemically synthesized
taatcaatgtatcttttcagaa

SEQ ID NO: 1362053 - DNA, 22 bp, Artificial Sequence
  chemically synthesized
aatcaatgtatcttttcagaat

SEQ ID NO: 1362054 - DNA, 22 bp, Artificial Sequence
  chemically synthesized
atcaatgtatcttttcagaatg

SEQ ID NO: 1362055 - DNA, 22 bp, Artificial Sequence
  chemically synthesized
acatttctgcctttcattctga

SEQ ID NO: 1362056 - DNA, 22 bp, Artificial Sequence
  chemically synthesized
gacatttctgcctttcattctg

SEQ ID NO: 1362057 - DNA, 22 bp, Artificial Sequence
  chemically synthesized
ttcagaatgaaaggcagaaatg

SEQ ID NO: 1362058 - DNA, 22 bp, Artificial Sequence
  chemically synthesized
tcagaatgaaaggcagaaatgt

SEQ ID NO: 1362059 - DNA, 22 bp, Artificial Sequence
  chemically synthesized
cagaatgaaaggcagaaatgtc

SEQ ID NO: 1362060 - DNA, 22 bp, Artificial Sequence
  chemically synthesized
agaatgaaaggcagaaatgtca

SEQ ID NO: 1362061 - DNA, 22 bp, Artificial Sequence
  chemically synthesized
taatggtaggaatttgacattt

SEQ ID NO: 1362062 - DNA, 22 bp, Artificial Sequence
  chemically synthesized
ataatggtaggaatttgacatt

SEQ ID NO: 1362063 - DNA, 22 bp, Artificial Sequence
  chemically synthesized
aaagaatttataatggtaggaa

SEQ ID NO: 1362064 - DNA, 22 bp, Artificial Sequence
  chemically synthesized
gagagttaaaagaatttataat

SEQ ID NO: 1362065 - DNA, 22 bp, Artificial Sequence
  chemically synthesized
ctaccattataaattcttttaa

SEQ ID NO: 1362066 - DNA, 22 bp, Artificial Sequence
  chemically synthesized
ccattataaattcttttaactc

SEQ ID NO: 1362067 - DNA, 22 bp, Artificial Sequence
  chemically synthesized
atgcagattagagagttaaaag

SEQ ID NO: 1362068 - DNA, 22 bp, Artificial Sequence
  chemically synthesized
aatgcagattagagagttaaaa

SEQ ID NO: 1362069 - DNA, 22 bp, Artificial Sequence
  chemically synthesized
tttaatgcagattagagagtta

SEQ ID NO: 1362070 - DNA, 22 bp, Artificial Sequence
  chemically synthesized
atttaatgcagattagagagtt

SEQ ID NO: 1362071 - DNA, 22 bp, Artificial Sequence
  chemically synthesized
taaattcttttaactctctaat

SEQ ID NO: 1362072 - DNA, 22 bp, Artificial Sequence
  chemically synthesized
tatttaatgcagattagagagt

SEQ ID NO: 1362073 - DNA, 22 bp, Artificial Sequence
  chemically synthesized
ttatttaatgcagattagagag

SEQ ID NO: 1362074 - DNA, 22 bp, Artificial Sequence
  chemically synthesized
ttttaactctctaatctgcatt

SEQ ID NO: 1362075 - DNA, 22 bp, Artificial Sequence
  chemically synthesized
ttaactctctaatctgcattaa

SEQ ID NO: 1362076 - DNA, 22 bp, Artificial Sequence
  chemically synthesized
taactctctaatctgcattaaa

SEQ ID NO: 1362077 - DNA, 22 bp, Artificial Sequence
  chemically synthesized
aactctctaatctgcattaaat

SEQ ID NO: 1362078 - DNA, 22 bp, Artificial Sequence
  chemically synthesized
actctctaatctgcattaaata

SEQ ID NO: 1362079 - DNA, 22 bp, Artificial Sequence
  chemically synthesized
aaagacaaccttttatttaatg

SEQ ID NO: 1362080 - DNA, 22 bp, Artificial Sequence
  chemically synthesized
tcaaagacaaccttttatttaa

SEQ ID NO: 1362081 - DNA, 22 bp, Artificial Sequence
  chemically synthesized
tctaatctgcattaaataaaag

SEQ ID NO: 1362082 - DNA, 22 bp, Artificial Sequence
  chemically synthesized
ctcaaagacaaccttttattta

SEQ ID NO: 1362083 - DNA, 22 bp, Artificial Sequence
  chemically synthesized
taatctgcattaaataaaaggt

SEQ ID NO: 1362084 - DNA, 22 bp, Artificial Sequence
  chemically synthesized
tttctcaaagacaaccttttat

SEQ ID NO: 1362085 - DNA, 22 bp, Artificial Sequence
  chemically synthesized
atctgcattaaataaaaggttg

SEQ ID NO: 1362086 - DNA, 22 bp, Artificial Sequence
  chemically synthesized
ttatttctcaaagacaaccttt

SEQ ID NO: 1362087 - DNA, 22 bp, Artificial Sequence
  chemically synthesized
attatttctcaaagacaacctt

SEQ ID NO: 1362088 - DNA, 22 bp, Artificial Sequence
  chemically synthesized
cattaaataaaaggttgtcttt

SEQ ID NO: 1362089 - DNA, 22 bp, Artificial Sequence
  chemically synthesized
aataaaaggttgtctttgagaa

SEQ ID NO: 1362090 - DNA, 22 bp, Artificial Sequence
  chemically synthesized
gagcatttattatttctcaaag

SEQ ID NO: 1362091 - DNA, 22 bp, Artificial Sequence
  chemically synthesized
agagcatttattatttctcaaa

SEQ ID NO: 1362092 - DNA, 22 bp, Artificial Sequence
  chemically synthesized
tagagcatttattatttctcaa

SEQ ID NO: 1362093 - DNA, 22 bp, Artificial Sequence
  chemically synthesized
tttagagcatttattatttctc

SEQ ID NO: 1362094 - DNA, 22 bp, Artificial Sequence
  chemically synthesized
ctttagagcatttattatttct

SEQ ID NO: 1362095 - DNA, 22 bp, Artificial Sequence
  chemically synthesized
tatttctttagagcatttatta

SEQ ID NO: 1362096 - DNA, 22 bp, Artificial Sequence
  chemically synthesized
tctttgagaaataataaatgct

SEQ ID NO: 1362097 - DNA, 22 bp, Artificial Sequence
  chemically synthesized
gttatatttctttagagcattt

SEQ ID NO: 1362098 - DNA, 22 bp, Artificial Sequence
  chemically synthesized
tgagaaataataaatgctctaa

SEQ ID NO: 1362099 - DNA, 22 bp, Artificial Sequence
  chemically synthesized
gagaaataataaatgctctaaa

SEQ ID NO: 1362100 - DNA, 22 bp, Artificial Sequence
  chemically synthesized
agaaataataaatgctctaaag

SEQ ID NO: 1362101 - DNA, 22 bp, Artificial Sequence
  chemically synthesized
atgctagttatatttctttaga

SEQ ID NO: 1362102 - DNA, 22 bp, Artificial Sequence
  chemically synthesized
aaataaaattgatgctagttat

SEQ ID NO: 1362103 - DNA, 22 bp, Artificial Sequence
  chemically synthesized
aaaataaaattgatgctagtta

SEQ ID NO: 1362104 - DNA, 22 bp, Artificial Sequence
  chemically synthesized
taaaataaaattgatgctagtt

SEQ ID NO: 1362105 - DNA, 22 bp, Artificial Sequence
  chemically synthesized
taaagaaatataactagcatca

SEQ ID NO: 1362106 - DNA, 22 bp, Artificial Sequence
  chemically synthesized
aagaaatataactagcatcaat

SEQ ID NO: 1362107 - DNA, 22 bp, Artificial Sequence
  chemically synthesized
cattttaaaataaaattgatgc

SEQ ID NO: 1362108 - DNA, 22 bp, Artificial Sequence
  chemically synthesized
ccagttacattttaaaataaaa

SEQ ID NO: 1362109 - DNA, 22 bp, Artificial Sequence
  chemically synthesized
cccagttacattttaaaataaa

SEQ ID NO: 1362110 - DNA, 22 bp, Artificial Sequence
  chemically synthesized
tcccagttacattttaaaataa

SEQ ID NO: 1362111 - DNA, 22 bp, Artificial Sequence
  chemically synthesized
ttcccagttacattttaaaata

SEQ ID NO: 1362112 - DNA, 22 bp, Artificial Sequence
  chemically synthesized
gcatcaattttattttaaaatg

SEQ ID NO: 1362113 - DNA, 22 bp, Artificial Sequence
  chemically synthesized
atcttttcccagttacatttta

SEQ ID NO: 1362114 - DNA, 22 bp, Artificial Sequence
  chemically synthesized
aatcttttcccagttacatttt

SEQ ID NO: 1362115 - DNA, 22 bp, Artificial Sequence
  chemically synthesized
tattttaaaatgtaactgggaa

SEQ ID NO: 1362116 - DNA, 22 bp, Artificial Sequence
  chemically synthesized
acatttaatcttttcccagtta

SEQ ID NO: 1362117 - DNA, 22 bp, Artificial Sequence
  chemically synthesized
attttaaaatgtaactgggaaa

SEQ ID NO: 1362118 - DNA, 22 bp, Artificial Sequence
  chemically synthesized
ttttaaaatgtaactgggaaaa

SEQ ID NO: 1362119 - DNA, 22 bp, Artificial Sequence
  chemically synthesized
taaaatgtaactgggaaaagat

SEQ ID NO: 1362120 - DNA, 22 bp, Artificial Sequence
  chemically synthesized
aaaatgtaactgggaaaagatt

SEQ ID NO: 1362121 - DNA, 22 bp, Artificial Sequence
  chemically synthesized
aaatgtaactgggaaaagatta

SEQ ID NO: 1362122 - DNA, 22 bp, Artificial Sequence
  chemically synthesized
tatgaagagatgtgttgacatt

SEQ ID NO: 1362123 - DNA, 22 bp, Artificial Sequence
  chemically synthesized
ggaaaagattaaatgtcaacac

SEQ ID NO: 1362124 - DNA, 22 bp, Artificial Sequence
  chemically synthesized
tgtatgaagagatgtgttgaca

SEQ ID NO: 1362125 - DNA, 22 bp, Artificial Sequence
  chemically synthesized
aatgtcaacacatctcttcata

SEQ ID NO: 1362126 - DNA, 22 bp, Artificial Sequence
  chemically synthesized
ggaaatcacctctgtatgaaga

SEQ ID NO: 1362127 - DNA, 22 bp, Artificial Sequence
  chemically synthesized
gggaaatcacctctgtatgaag

SEQ ID NO: 1362128 - DNA, 22 bp, Artificial Sequence
  chemically synthesized
ttgggaaatcacctctgtatga

SEQ ID NO: 1362129 - DNA, 22 bp, Artificial Sequence
  chemically synthesized
cttgggaaatcacctctgtatg

SEQ ID NO: 1362130 - DNA, 22 bp, Artificial Sequence
  chemically synthesized
atagtttcttgggaaatcacct

SEQ ID NO: 1362131 - DNA, 22 bp, Artificial Sequence
  chemically synthesized
aatagtttcttgggaaatcacc

SEQ ID NO: 1362132 - DNA, 22 bp, Artificial Sequence
  chemically synthesized
taatagtttcttgggaaatcac

SEQ ID NO: 1362133 - DNA, 22 bp, Artificial Sequence
  chemically synthesized
ttcatacagaggtgatttccca

SEQ ID NO: 1362134 - DNA, 22 bp, Artificial Sequence
  chemically synthesized
catacagaggtgatttcccaag

SEQ ID NO: 1362135 - DNA, 22 bp, Artificial Sequence
  chemically synthesized
atacagaggtgatttcccaaga

SEQ ID NO: 1362136 - DNA, 22 bp, Artificial Sequence
  chemically synthesized
atgtaagtaaggctttaatagt

SEQ ID NO: 1362137 - DNA, 22 bp, Artificial Sequence
  chemically synthesized
cccaagaaactattaaagcctt

SEQ ID NO: 1362138 - DNA, 22 bp, Artificial Sequence
  chemically synthesized
ccaagaaactattaaagcctta

SEQ ID NO: 1362139 - DNA, 22 bp, Artificial Sequence
  chemically synthesized
ggaggggcccctcatgtaagta

SEQ ID NO: 1362140 - DNA, 22 bp, Artificial Sequence
  chemically synthesized
gggaggggcccctcatgtaagt

SEQ ID NO: 1362141 - DNA, 22 bp, Artificial Sequence
  chemically synthesized
ttaaagccttacttacatgagg

SEQ ID NO: 1362142 - DNA, 22 bp, Artificial Sequence
  chemically synthesized
aagccttacttacatgaggggc

SEQ ID NO: 1362143 - DNA, 22 bp, Artificial Sequence
  chemically synthesized
gatacagccttgggaggggccc

SEQ ID NO: 1362144 - DNA, 22 bp, Artificial Sequence
  chemically synthesized
acttacatgaggggcccctccc

SEQ ID NO: 1362145 - DNA, 22 bp, Artificial Sequence
  chemically synthesized
cttacatgaggggcccctccca

SEQ ID NO: 1362146 - DNA, 22 bp, Artificial Sequence
  chemically synthesized
acatgaggggcccctcccaagg

SEQ ID NO: 1362147 - DNA, 22 bp, Artificial Sequence
  chemically synthesized
catgaggggcccctcccaaggc

SEQ ID NO: 1362148 - DNA, 22 bp, Artificial Sequence
  chemically synthesized
agaaaaataatagaaaattgga

SEQ ID NO: 1362149 - DNA, 22 bp, Artificial Sequence
  chemically synthesized
ccaaggctgtatccaattttct

SEQ ID NO: 1362150 - DNA, 22 bp, Artificial Sequence
  chemically synthesized
aagaaaaataatagaaaattgg

SEQ ID NO: 1362151 - DNA, 22 bp, Artificial Sequence
  chemically synthesized
taagaaaaataatagaaaattg

SEQ ID NO: 1362152 - DNA, 22 bp, Artificial Sequence
  chemically synthesized
ttttaagaaaaataatagaaaa

SEQ ID NO: 1362153 - DNA, 22 bp, Artificial Sequence
  chemically synthesized
tatccaattttctattattttt

SEQ ID NO: 1362154 - DNA, 22 bp, Artificial Sequence
  chemically synthesized
ggggtgctattttaagaaaaat

SEQ ID NO: 1362155 - DNA, 22 bp, Artificial Sequence
  chemically synthesized
tctattatttttcttaaaatag

SEQ ID NO: 1362156 - DNA, 22 bp, Artificial Sequence
  chemically synthesized
ctattatttttcttaaaatagc

SEQ ID NO: 1362157 - DNA, 22 bp, Artificial Sequence
  chemically synthesized
tattatttttcttaaaatagca

SEQ ID NO: 1362158 - DNA, 22 bp, Artificial Sequence
  chemically synthesized
tacaattgggggtgctatttta

SEQ ID NO: 1362159 - DNA, 22 bp, Artificial Sequence
  chemically synthesized
ttatttttcttaaaatagcacc

SEQ ID NO: 1362160 - DNA, 22 bp, Artificial Sequence
  chemically synthesized
tttttcttaaaatagcaccccc

SEQ ID NO: 1362161 - DNA, 22 bp, Artificial Sequence
  chemically synthesized
aggttatacaattgggggtgct

SEQ ID NO: 1362162 - DNA, 22 bp, Artificial Sequence
  chemically synthesized
ttcttaaaatagcacccccaat

SEQ ID NO: 1362163 - DNA, 22 bp, Artificial Sequence
  chemically synthesized
tcttaaaatagcacccccaatt

SEQ ID NO: 1362164 - DNA, 22 bp, Artificial Sequence
  chemically synthesized
cttaaaatagcacccccaattg

SEQ ID NO: 1362165 - DNA, 22 bp, Artificial Sequence
  chemically synthesized
ttaaaatagcacccccaattgt

SEQ ID NO: 1362166 - DNA, 22 bp, Artificial Sequence
  chemically synthesized
aaaatagcacccccaattgtat

SEQ ID NO: 1362167 - DNA, 22 bp, Artificial Sequence
  chemically synthesized
aaatagcacccccaattgtata

SEQ ID NO: 1362168 - DNA, 22 bp, Artificial Sequence
  chemically synthesized
tggggcctgaggttatacaatt

SEQ ID NO: 1362169 - DNA, 22 bp, Artificial Sequence
  chemically synthesized
atggggcctgaggttatacaat

SEQ ID NO: 1362170 - DNA, 22 bp, Artificial Sequence
  chemically synthesized
tataacctcaggccccataaat

SEQ ID NO: 1362171 - DNA, 22 bp, Artificial Sequence
  chemically synthesized
aggccccataaatcctttcttc

SEQ ID NO: 1362172 - DNA, 22 bp, Artificial Sequence
  chemically synthesized
acaacacagaacgaaccaggaa

SEQ ID NO: 1362173 - DNA, 22 bp, Artificial Sequence
  chemically synthesized
tctgacaacacagaacgaacca

SEQ ID NO: 1362174 - DNA, 22 bp, Artificial Sequence
  chemically synthesized
cctgtctgacaacacagaacga

SEQ ID NO: 1362175 - DNA, 22 bp, Artificial Sequence
  chemically synthesized
tcttcctggttcgttctgtgtt

SEQ ID NO: 1362176 - DNA, 22 bp, Artificial Sequence
  chemically synthesized
cttcctggttcgttctgtgttg

SEQ ID NO: 1362177 - DNA, 22 bp, Artificial Sequence
  chemically synthesized
ttcctggttcgttctgtgttgt

SEQ ID NO: 1362178 - DNA, 22 bp, Artificial Sequence
  chemically synthesized
cctggttcgttctgtgttgtca

SEQ ID NO: 1362179 - DNA, 22 bp, Artificial Sequence
  chemically synthesized
ctggttcgttctgtgttgtcag

SEQ ID NO: 1362180 - DNA, 22 bp, Artificial Sequence
  chemically synthesized
gttcgttctgtgttgtcagaca

SEQ ID NO: 1362181 - DNA, 22 bp, Artificial Sequence
  chemically synthesized
atgtacattccctgtctgacaa

SEQ ID NO: 1362182 - DNA, 22 bp, Artificial Sequence
  chemically synthesized
gttctgtgttgtcagacaggga

SEQ ID NO: 1362183 - DNA, 22 bp, Artificial Sequence
  chemically synthesized
tgtgttgtcagacagggaatgt

SEQ ID NO: 1362184 - DNA, 22 bp, Artificial Sequence
  chemically synthesized
tgttgtcagacagggaatgtac

SEQ ID NO: 1362185 - DNA, 22 bp, Artificial Sequence
  chemically synthesized
acaaatgagactaatgtacatt

SEQ ID NO: 1362186 - DNA, 22 bp, Artificial Sequence
  chemically synthesized
tcagacagggaatgtacattag

SEQ ID NO: 1362187 - DNA, 22 bp, Artificial Sequence
  chemically synthesized
aggaattgacaaatgagactaa

SEQ ID NO: 1362188 - DNA, 22 bp, Artificial Sequence
  chemically synthesized
aaggaattgacaaatgagacta

SEQ ID NO: 1362189 - DNA, 22 bp, Artificial Sequence
  chemically synthesized
taaggaattgacaaatgagact

SEQ ID NO: 1362190 - DNA, 22 bp, Artificial Sequence
  chemically synthesized
ttaaggaattgacaaatgagac

SEQ ID NO: 1362191 - DNA, 22 bp, Artificial Sequence
  chemically synthesized
tttaaggaattgacaaatgaga

SEQ ID NO: 1362192 - DNA, 22 bp, Artificial Sequence
  chemically synthesized
gtctcatttgtcaattccttaa

SEQ ID NO: 1362193 - DNA, 22 bp, Artificial Sequence
  chemically synthesized
aacacacatcattttttaagga

SEQ ID NO: 1362194 - DNA, 22 bp, Artificial Sequence
  chemically synthesized
aaacacacatcattttttaagg

SEQ ID NO: 1362195 - DNA, 22 bp, Artificial Sequence
  chemically synthesized
atttgtcaattccttaaaaaat

SEQ ID NO: 1362196 - DNA, 22 bp, Artificial Sequence
  chemically synthesized
taaacacacatcattttttaag

SEQ ID NO: 1362197 - DNA, 22 bp, Artificial Sequence
  chemically synthesized
ttttaaacacacatcatttttt

SEQ ID NO: 1362198 - DNA, 22 bp, Artificial Sequence
  chemically synthesized
gtcaattccttaaaaaatgatg

SEQ ID NO: 1362199 - DNA, 22 bp, Artificial Sequence
  chemically synthesized
tcaattccttaaaaaatgatgt

SEQ ID NO: 1362200 - DNA, 22 bp, Artificial Sequence
  chemically synthesized
tattttaaacacacatcatttt

SEQ ID NO: 1362201 - DNA, 22 bp, Artificial Sequence
  chemically synthesized
ctattttaaacacacatcattt

SEQ ID NO: 1362202 - DNA, 22 bp, Artificial Sequence
  chemically synthesized
tctattttaaacacacatcatt

SEQ ID NO: 1362203 - DNA, 22 bp, Artificial Sequence
  chemically synthesized
cttaaaaaatgatgtgtgttta

SEQ ID NO: 1362204 - DNA, 22 bp, Artificial Sequence
  chemically synthesized
aattttctattttaaacacaca

SEQ ID NO: 1362205 - DNA, 22 bp, Artificial Sequence
  chemically synthesized
taaattttctattttaaacaca

SEQ ID NO: 1362206 - DNA, 22 bp, Artificial Sequence
  chemically synthesized
aaaaaatgatgtgtgtttaaaa

SEQ ID NO: 1362207 - DNA, 22 bp, Artificial Sequence
  chemically synthesized
ctaaattttctattttaaacac

SEQ ID NO: 1362208 - DNA, 22 bp, Artificial Sequence
  chemically synthesized
aaaaatgatgtgtgtttaaaat

SEQ ID NO: 1362209 - DNA, 22 bp, Artificial Sequence
  chemically synthesized
tctaaattttctattttaaaca

SEQ ID NO: 1362210 - DNA, 22 bp, Artificial Sequence
  chemically synthesized
ttctaaattttctattttaaac

SEQ ID NO: 1362211 - DNA, 22 bp, Artificial Sequence
  chemically synthesized
atttttctaaattttctatttt

SEQ ID NO: 1362212 - DNA, 22 bp, Artificial Sequence
  chemically synthesized
ttcatttttctaaattttctat

SEQ ID NO: 1362213 - DNA, 22 bp, Artificial Sequence
  chemically synthesized
tgttcatttttctaaattttct

SEQ ID NO: 1362214 - DNA, 22 bp, Artificial Sequence
  chemically synthesized
ctgttcatttttctaaattttc

SEQ ID NO: 1362215 - DNA, 22 bp, Artificial Sequence
  chemically synthesized
tctgttcatttttctaaatttt

SEQ ID NO: 1362216 - DNA, 22 bp, Artificial Sequence
  chemically synthesized
aaaatagaaaatttagaaaaat

SEQ ID NO: 1362217 - DNA, 22 bp, Artificial Sequence
  chemically synthesized
aaatagaaaatttagaaaaatg

SEQ ID NO: 1362218 - DNA, 22 bp, Artificial Sequence
  chemically synthesized
aagataattttctgttcatttt

SEQ ID NO: 1362219 - DNA, 22 bp, Artificial Sequence
  chemically synthesized
aaagataattttctgttcattt

SEQ ID NO: 1362220 - DNA, 22 bp, Artificial Sequence
  chemically synthesized
taaagataattttctgttcatt

SEQ ID NO: 1362221 - DNA, 22 bp, Artificial Sequence
  chemically synthesized
tttaaagataattttctgttca

SEQ ID NO: 1362222 - DNA, 22 bp, Artificial Sequence
  chemically synthesized
ctttaaagataattttctgttc

SEQ ID NO: 1362223 - DNA, 22 bp, Artificial Sequence
  chemically synthesized
tctttaaagataattttctgtt

SEQ ID NO: 1362224 - DNA, 22 bp, Artificial Sequence
  chemically synthesized
agaaaaatgaacagaaaattat

SEQ ID NO: 1362225 - DNA, 22 bp, Artificial Sequence
  chemically synthesized
gaaaaatgaacagaaaattatc

SEQ ID NO: 1362226 - DNA, 22 bp, Artificial Sequence
  chemically synthesized
acctttctttaaagataatttt

SEQ ID NO: 1362227 - DNA, 22 bp, Artificial Sequence
  chemically synthesized
gaaattaacctttctttaaaga

SEQ ID NO: 1362228 - DNA, 22 bp, Artificial Sequence
  chemically synthesized
attagaaattaacctttcttta

SEQ ID NO: 1362229 - DNA, 22 bp, Artificial Sequence
  chemically synthesized
tctttaaagaaaggttaatttc

SEQ ID NO: 1362230 - DNA, 22 bp, Artificial Sequence
  chemically synthesized
agagggtctaattagaaattaa

SEQ ID NO: 1362231 - DNA, 22 bp, Artificial Sequence
  chemically synthesized
taaagaaaggttaatttctaat

SEQ ID NO: 1362232 - DNA, 22 bp, Artificial Sequence
  chemically synthesized
aaagaaaggttaatttctaatt

SEQ ID NO: 1362233 - DNA, 22 bp, Artificial Sequence
  chemically synthesized
ctaagagggtctaattagaaat

SEQ ID NO: 1362234 - DNA, 22 bp, Artificial Sequence
  chemically synthesized
aagaaaggttaatttctaatta

SEQ ID NO: 1362235 - DNA, 22 bp, Artificial Sequence
  chemically synthesized
cctaagagggtctaattagaaa

SEQ ID NO: 1362236 - DNA, 22 bp, Artificial Sequence
  chemically synthesized
atttctaattagaccctcttag

SEQ ID NO: 1362237 - DNA, 22 bp, Artificial Sequence
  chemically synthesized
ctaattagaccctcttaggaaa

SEQ ID NO: 1362238 - DNA, 22 bp, Artificial Sequence
  chemically synthesized
taattagaccctcttaggaaac

SEQ ID NO: 1362239 - DNA, 22 bp, Artificial Sequence
  chemically synthesized
attagaccctcttaggaaactt

SEQ ID NO: 1362240 - DNA, 22 bp, Artificial Sequence
  chemically synthesized
aaatcacagggtataaagtttc

SEQ ID NO: 1362241 - DNA, 22 bp, Artificial Sequence
  chemically synthesized
gaccctcttaggaaactttata

SEQ ID NO: 1362242 - DNA, 22 bp, Artificial Sequence
  chemically synthesized
ttaggaaactttataccctgtg

SEQ ID NO: 1362243 - DNA, 22 bp, Artificial Sequence
  chemically synthesized
tatgcattcaaatcacagggta

SEQ ID NO: 1362244 - DNA, 22 bp, Artificial Sequence
  chemically synthesized
aggaaactttataccctgtgat

SEQ ID NO: 1362245 - DNA, 22 bp, Artificial Sequence
  chemically synthesized
atatgcattcaaatcacagggt

SEQ ID NO: 1362246 - DNA, 22 bp, Artificial Sequence
  chemically synthesized
ggaaactttataccctgtgatt

SEQ ID NO: 1362247 - DNA, 22 bp, Artificial Sequence
  chemically synthesized
tataccctgtgatttgaatgca

SEQ ID NO: 1362248 - DNA, 22 bp, Artificial Sequence
  chemically synthesized
ataccctgtgatttgaatgcat

SEQ ID NO: 1362249 - DNA, 22 bp, Artificial Sequence
  chemically synthesized
taccctgtgatttgaatgcata

SEQ ID NO: 1362250 - DNA, 22 bp, Artificial Sequence
  chemically synthesized
tatatatgcacatttatatgca

SEQ ID NO: 1362251 - DNA, 22 bp, Artificial Sequence
  chemically synthesized
atatatatgcacatttatatgc

SEQ ID NO: 1362252 - DNA, 22 bp, Artificial Sequence
  chemically synthesized
tgatttgaatgcatataaatgt

SEQ ID NO: 1362253 - DNA, 22 bp, Artificial Sequence
  chemically synthesized
gaatgcatataaatgtgcatat

SEQ ID NO: 1362254 - DNA, 22 bp, Artificial Sequence
  chemically synthesized
aatgcatataaatgtgcatata

SEQ ID NO: 1362255 - DNA, 22 bp, Artificial Sequence
  chemically synthesized
gtatgagtatatatatttatat

SEQ ID NO: 1362256 - DNA, 22 bp, Artificial Sequence
  chemically synthesized
ggtatgagtatatatatttata

SEQ ID NO: 1362257 - DNA, 22 bp, Artificial Sequence
  chemically synthesized
tggtatgagtatatatatttat

SEQ ID NO: 1362258 - DNA, 22 bp, Artificial Sequence
  chemically synthesized
atcacacatacaagaaacacag

SEQ ID NO: 1362259 - DNA, 22 bp, Artificial Sequence
  chemically synthesized
ataccaaaatactgtgtttctt

SEQ ID NO: 1362260 - DNA, 22 bp, Artificial Sequence
  chemically synthesized
catcacacatacaagaaacaca

SEQ ID NO: 1362261 - DNA, 22 bp, Artificial Sequence
  chemically synthesized
tttcatcacacatacaagaaac

SEQ ID NO: 1362262 - DNA, 22 bp, Artificial Sequence
  chemically synthesized
atttcatcacacatacaagaaa

SEQ ID NO: 1362263 - DNA, 22 bp, Artificial Sequence
  chemically synthesized
tatttcatcacacatacaagaa

SEQ ID NO: 1362264 - DNA, 22 bp, Artificial Sequence
  chemically synthesized
tttatttcatcacacatacaag

SEQ ID NO: 1362265 - DNA, 22 bp, Artificial Sequence
  chemically synthesized
tgtttcttgtatgtgtgatgaa

SEQ ID NO: 1362266 - DNA, 22 bp, Artificial Sequence
  chemically synthesized
atcaactctttatttcatcaca

SEQ ID NO: 1362267 - DNA, 22 bp, Artificial Sequence
  chemically synthesized
catcaactctttatttcatcac

SEQ ID NO: 1362268 - DNA, 22 bp, Artificial Sequence
  chemically synthesized
tcatcaactctttatttcatca

SEQ ID NO: 1362269 - DNA, 22 bp, Artificial Sequence
  chemically synthesized
ttcatcaactctttatttcatc

SEQ ID NO: 1362270 - DNA, 22 bp, Artificial Sequence
  chemically synthesized
cttgtatgtgtgatgaaataaa

SEQ ID NO: 1362271 - DNA, 22 bp, Artificial Sequence
  chemically synthesized
tttcatcaactctttatttcat

SEQ ID NO: 1362272 - DNA, 22 bp, Artificial Sequence
  chemically synthesized
ttgtatgtgtgatgaaataaag

SEQ ID NO: 1362273 - DNA, 22 bp, Artificial Sequence
  chemically synthesized
gtatgtgtgatgaaataaagag

SEQ ID NO: 1362274 - DNA, 22 bp, Artificial Sequence
  chemically synthesized
tatgtgtgatgaaataaagagt

SEQ ID NO: 1362275 - DNA, 22 bp, Artificial Sequence
  chemically synthesized
tcatactttttcatcaactctt

SEQ ID NO: 1362276 - DNA, 22 bp, Artificial Sequence
  chemically synthesized
atcatactttttcatcaactct

SEQ ID NO: 1362277 - DNA, 22 bp, Artificial Sequence
  chemically synthesized
aaaatgatttatcatacttttt

SEQ ID NO: 1362278 - DNA, 22 bp, Artificial Sequence
  chemically synthesized
ttaaaaatgatttatcatactt

SEQ ID NO: 1362279 - DNA, 22 bp, Artificial Sequence
  chemically synthesized
attaaaaatgatttatcatact

SEQ ID NO: 1362280 - DNA, 22 bp, Artificial Sequence
  chemically synthesized
acttattaaaaatgatttatca

SEQ ID NO: 1362281 - DNA, 22 bp, Artificial Sequence
  chemically synthesized
atgaaaaagtatgataaatcat

SEQ ID NO: 1362282 - DNA, 22 bp, Artificial Sequence
  chemically synthesized
ctaacttattaaaaatgattta

SEQ ID NO: 1362283 - DNA, 22 bp, Artificial Sequence
  chemically synthesized
cctaacttattaaaaatgattt

SEQ ID NO: 1362284 - DNA, 22 bp, Artificial Sequence
  chemically synthesized
tcctaacttattaaaaatgatt

SEQ ID NO: 1362285 - DNA, 22 bp, Artificial Sequence
  chemically synthesized
taatattttcctaacttattaa

SEQ ID NO: 1362286 - DNA, 22 bp, Artificial Sequence
  chemically synthesized
ttgtaatattttcctaacttat

SEQ ID NO: 1362287 - DNA, 22 bp, Artificial Sequence
  chemically synthesized
tattgtaatattttcctaactt

SEQ ID NO: 1362288 - DNA, 22 bp, Artificial Sequence
  chemically synthesized
ctattgtaatattttcctaact

SEQ ID NO: 1362289 - DNA, 22 bp, Artificial Sequence
  chemically synthesized
ttaataagttaggaaaatatta

SEQ ID NO: 1362290 - DNA, 22 bp, Artificial Sequence
  chemically synthesized
caccttctattgtaatattttc

SEQ ID NO: 1362291 - DNA, 22 bp, Artificial Sequence
  chemically synthesized
taataagttaggaaaatattac

SEQ ID NO: 1362292 - DNA, 22 bp, Artificial Sequence
  chemically synthesized
ccaccttctattgtaatatttt

SEQ ID NO: 1362293 - DNA, 22 bp, Artificial Sequence
  chemically synthesized
aataagttaggaaaatattaca

SEQ ID NO: 1362294 - DNA, 22 bp, Artificial Sequence
  chemically synthesized
ataagttaggaaaatattacaa

SEQ ID NO: 1362295 - DNA, 22 bp, Artificial Sequence
  chemically synthesized
cttccaccttctattgtaatat

SEQ ID NO: 1362296 - DNA, 22 bp, Artificial Sequence
  chemically synthesized
tccttccaccttctattgtaat

SEQ ID NO: 1362297 - DNA, 22 bp, Artificial Sequence
  chemically synthesized
ctccttccaccttctattgtaa

SEQ ID NO: 1362298 - DNA, 22 bp, Artificial Sequence
  chemically synthesized
cttctccttccaccttctattg

SEQ ID NO: 1362299 - DNA, 22 bp, Artificial Sequence
  chemically synthesized
ggaaaatattacaatagaaggt

SEQ ID NO: 1362300 - DNA, 22 bp, Artificial Sequence
  chemically synthesized
ccttctccttccaccttctatt

SEQ ID NO: 1362301 - DNA, 22 bp, Artificial Sequence
  chemically synthesized
tccttctccttccaccttctat

SEQ ID NO: 1362302 - DNA, 22 bp, Artificial Sequence
  chemically synthesized
ccaaactttccttctccttcca

SEQ ID NO: 1362303 - DNA, 22 bp, Artificial Sequence
  chemically synthesized
cccaaactttccttctccttcc

SEQ ID NO: 1362304 - DNA, 22 bp, Artificial Sequence
  chemically synthesized
caatagaaggtggaaggagaag

SEQ ID NO: 1362305 - DNA, 22 bp, Artificial Sequence
  chemically synthesized
aagagtaaaacaaagtcatttc

SEQ ID NO: 1362306 - DNA, 22 bp, Artificial Sequence
  chemically synthesized
tctcaagagtaaaacaaagtca

SEQ ID NO: 1362307 - DNA, 22 bp, Artificial Sequence
  chemically synthesized
atctcaagagtaaaacaaagtc

SEQ ID NO: 1362308 - DNA, 22 bp, Artificial Sequence
  chemically synthesized
tatctcaagagtaaaacaaagt

SEQ ID NO: 1362309 - DNA, 22 bp, Artificial Sequence
  chemically synthesized
gggaaatgactttgttttactc

SEQ ID NO: 1362310 - DNA, 22 bp, Artificial Sequence
  chemically synthesized
ggaaatgactttgttttactct

SEQ ID NO: 1362311 - DNA, 22 bp, Artificial Sequence
  chemically synthesized
atcaaaattttatctcaagagt

SEQ ID NO: 1362312 - DNA, 22 bp, Artificial Sequence
  chemically synthesized
catcaaaattttatctcaagag

SEQ ID NO: 1362313 - DNA, 22 bp, Artificial Sequence
  chemically synthesized
tcatcaaaattttatctcaaga

SEQ ID NO: 1362314 - DNA, 22 bp, Artificial Sequence
  chemically synthesized
tgttttactcttgagataaaat

SEQ ID NO: 1362315 - DNA, 22 bp, Artificial Sequence
  chemically synthesized
tctttcatcaaaattttatctc

SEQ ID NO: 1362316 - DNA, 22 bp, Artificial Sequence
  chemically synthesized
gttttactcttgagataaaatt

SEQ ID NO: 1362317 - DNA, 22 bp, Artificial Sequence
  chemically synthesized
ttttactcttgagataaaattt

SEQ ID NO: 1362318 - DNA, 22 bp, Artificial Sequence
  chemically synthesized
ttatctttcatcaaaattttat

SEQ ID NO: 1362319 - DNA, 22 bp, Artificial Sequence
  chemically synthesized
attatctttcatcaaaatttta

SEQ ID NO: 1362320 - DNA, 22 bp, Artificial Sequence
  chemically synthesized
tactcttgagataaaattttga

SEQ ID NO: 1362321 - DNA, 22 bp, Artificial Sequence
  chemically synthesized
tattatctttcatcaaaatttt

SEQ ID NO: 1362322 - DNA, 22 bp, Artificial Sequence
  chemically synthesized
actcttgagataaaattttgat

SEQ ID NO: 1362323 - DNA, 22 bp, Artificial Sequence
  chemically synthesized
ctcttgagataaaattttgatg

SEQ ID NO: 1362324 - DNA, 22 bp, Artificial Sequence
  chemically synthesized
ttttattatctttcatcaaaat

SEQ ID NO: 1362325 - DNA, 22 bp, Artificial Sequence
  chemically synthesized
ttgagataaaattttgatgaaa

SEQ ID NO: 1362326 - DNA, 22 bp, Artificial Sequence
  chemically synthesized
tattttattatctttcatcaaa

SEQ ID NO: 1362327 - DNA, 22 bp, Artificial Sequence
  chemically synthesized
gagataaaattttgatgaaaga

SEQ ID NO: 1362328 - DNA, 22 bp, Artificial Sequence
  chemically synthesized
agataaaattttgatgaaagat

SEQ ID NO: 1362329 - DNA, 22 bp, Artificial Sequence
  chemically synthesized
aaaattctattttattatcttt

SEQ ID NO: 1362330 - DNA, 22 bp, Artificial Sequence
  chemically synthesized
caaaattctattttattatctt

SEQ ID NO: 1362331 - DNA, 22 bp, Artificial Sequence
  chemically synthesized
tcaaaattctattttattatct

SEQ ID NO: 1362332 - DNA, 22 bp, Artificial Sequence
  chemically synthesized
ttcaaaattctattttattatc

SEQ ID NO: 1362333 - DNA, 22 bp, Artificial Sequence
  chemically synthesized
tgatgaaagataataaaataga

SEQ ID NO: 1362334 - DNA, 22 bp, Artificial Sequence
  chemically synthesized
gatgaaagataataaaatagaa

SEQ ID NO: 1362335 - DNA, 22 bp, Artificial Sequence
  chemically synthesized
atgaaagataataaaatagaat

SEQ ID NO: 1362336 - DNA, 22 bp, Artificial Sequence
  chemically synthesized
gaaacatcaggtgtttttcaaa

SEQ ID NO: 1362337 - DNA, 22 bp, Artificial Sequence
  chemically synthesized
ggaaacatcaggtgtttttcaa

SEQ ID NO: 1362338 - DNA, 22 bp, Artificial Sequence
  chemically synthesized
tcttggaaacatcaggtgtttt

SEQ ID NO: 1362339 - DNA, 22 bp, Artificial Sequence
  chemically synthesized
tgaaaaacacctgatgtttcca

SEQ ID NO: 1362340 - DNA, 22 bp, Artificial Sequence
  chemically synthesized
aaatcattgtcttggaaacatc

SEQ ID NO: 1362341 - DNA, 22 bp, Artificial Sequence
  chemically synthesized
gaaaaacacctgatgtttccaa

SEQ ID NO: 1362342 - DNA, 22 bp, Artificial Sequence
  chemically synthesized
aaaaacacctgatgtttccaag

SEQ ID NO: 1362343 - DNA, 22 bp, Artificial Sequence
  chemically synthesized
atgtttccaagacaatgatttt

SEQ ID NO: 1362344 - DNA, 22 bp, Artificial Sequence
  chemically synthesized
ataaaagagattaaaatcattg

SEQ ID NO: 1362345 - DNA, 22 bp, Artificial Sequence
  chemically synthesized
aataaaagagattaaaatcatt

SEQ ID NO: 1362346 - DNA, 22 bp, Artificial Sequence
  chemically synthesized
ccaagacaatgattttaatctc

SEQ ID NO: 1362347 - DNA, 22 bp, Artificial Sequence
  chemically synthesized
caagacaatgattttaatctct

SEQ ID NO: 1362348 - DNA, 22 bp, Artificial Sequence
  chemically synthesized
tgtagtttaataaaagagatta

SEQ ID NO: 1362349 - DNA, 22 bp, Artificial Sequence
  chemically synthesized
gtgtagtttaataaaagagatt

SEQ ID NO: 1362350 - DNA, 22 bp, Artificial Sequence
  chemically synthesized
accacttgtgtagtttaataaa

SEQ ID NO: 1362351 - DNA, 22 bp, Artificial Sequence
  chemically synthesized
aaccacttgtgtagtttaataa

SEQ ID NO: 1362352 - DNA, 22 bp, Artificial Sequence
  chemically synthesized
taaccacttgtgtagtttaata

SEQ ID NO: 1362353 - DNA, 22 bp, Artificial Sequence
  chemically synthesized
ttaaccacttgtgtagtttaat

SEQ ID NO: 1362354 - DNA, 22 bp, Artificial Sequence
  chemically synthesized
taatctcttttattaaactaca

SEQ ID NO: 1362355 - DNA, 22 bp, Artificial Sequence
  chemically synthesized
aatctcttttattaaactacac

SEQ ID NO: 1362356 - DNA, 22 bp, Artificial Sequence
  chemically synthesized
atctcttttattaaactacaca

SEQ ID NO: 1362357 - DNA, 22 bp, Artificial Sequence
  chemically synthesized
ttttattaaactacacaagtgg

SEQ ID NO: 1362358 - DNA, 22 bp, Artificial Sequence
  chemically synthesized
tcaagtttttaaccacttgtgt

SEQ ID NO: 1362359 - DNA, 22 bp, Artificial Sequence
  chemically synthesized
ttattaaactacacaagtggtt

SEQ ID NO: 1362360 - DNA, 22 bp, Artificial Sequence
  chemically synthesized
tattaaactacacaagtggtta

SEQ ID NO: 1362361 - DNA, 22 bp, Artificial Sequence
  chemically synthesized
attaaactacacaagtggttaa

SEQ ID NO: 1362362 - DNA, 22 bp, Artificial Sequence
  chemically synthesized
ttaaactacacaagtggttaaa

SEQ ID NO: 1362363 - DNA, 22 bp, Artificial Sequence
  chemically synthesized
aactacacaagtggttaaaaac

SEQ ID NO: 1362364 - DNA, 22 bp, Artificial Sequence
  chemically synthesized
cacaagtggttaaaaacttgac

SEQ ID NO: 1362365 - DNA, 22 bp, Artificial Sequence
  chemically synthesized
catatgaaacaaattgtcaagt

SEQ ID NO: 1362366 - DNA, 22 bp, Artificial Sequence
  chemically synthesized
ctacatatgaaacaaattgtca

SEQ ID NO: 1362367 - DNA, 22 bp, Artificial Sequence
  chemically synthesized
gctacatatgaaacaaattgtc

SEQ ID NO: 1362368 - DNA, 22 bp, Artificial Sequence
  chemically synthesized
aaaacttgacaatttgtttcat

SEQ ID NO: 1362369 - DNA, 22 bp, Artificial Sequence
  chemically synthesized
catgtcatttgctacatatgaa

SEQ ID NO: 1362370 - DNA, 22 bp, Artificial Sequence
  chemically synthesized
gacaatttgtttcatatgtagc

SEQ ID NO: 1362371 - DNA, 22 bp, Artificial Sequence
  chemically synthesized
acaatttgtttcatatgtagca

SEQ ID NO: 1362372 - DNA, 22 bp, Artificial Sequence
  chemically synthesized
tactccatgtcatttgctacat

SEQ ID NO: 1362373 - DNA, 22 bp, Artificial Sequence
  chemically synthesized
gtttcatatgtagcaaatgaca

SEQ ID NO: 1362374 - DNA, 22 bp, Artificial Sequence
  chemically synthesized
tttcatatgtagcaaatgacat

SEQ ID NO: 1362375 - DNA, 22 bp, Artificial Sequence
  chemically synthesized
catatgtagcaaatgacatgga

SEQ ID NO: 1362376 - DNA, 22 bp, Artificial Sequence
  chemically synthesized
aaatccctgtactccatgtcat

SEQ ID NO: 1362377 - DNA, 22 bp, Artificial Sequence
  chemically synthesized
atatgtagcaaatgacatggag

SEQ ID NO: 1362378 - DNA, 22 bp, Artificial Sequence
  chemically synthesized
gaaatccctgtactccatgtca

SEQ ID NO: 1362379 - DNA, 22 bp, Artificial Sequence
  chemically synthesized
atttgaaatccctgtactccat

SEQ ID NO: 1362380 - DNA, 22 bp, Artificial Sequence
  chemically synthesized
tagcattcatttgaaatccctg

SEQ ID NO: 1362381 - DNA, 22 bp, Artificial Sequence
  chemically synthesized
ctatagcattcatttgaaatcc

SEQ ID NO: 1362382 - DNA, 22 bp, Artificial Sequence
  chemically synthesized
ttcctatagcattcatttgaaa

SEQ ID NO: 1362383 - DNA, 22 bp, Artificial Sequence
  chemically synthesized
attcctatagcattcatttgaa

SEQ ID NO: 1362384 - DNA, 22 bp, Artificial Sequence
  chemically synthesized
tattcctatagcattcatttga

SEQ ID NO: 1362385 - DNA, 22 bp, Artificial Sequence
  chemically synthesized
tttattcctatagcattcattt

SEQ ID NO: 1362386 - DNA, 22 bp, Artificial Sequence
  chemically synthesized
ctctttattcctatagcattca

SEQ ID NO: 1362387 - DNA, 22 bp, Artificial Sequence
  chemically synthesized
cctctttattcctatagcattc

SEQ ID NO: 1362388 - DNA, 22 bp, Artificial Sequence
  chemically synthesized
caaatgaatgctataggaataa

SEQ ID NO: 1362389 - DNA, 22 bp, Artificial Sequence
  chemically synthesized
aaatgaatgctataggaataaa

SEQ ID NO: 1362390 - DNA, 22 bp, Artificial Sequence
  chemically synthesized
atacagcttcctctttattcct

SEQ ID NO: 1362391 - DNA, 22 bp, Artificial Sequence
  chemically synthesized
taggaataaagaggaagctgta

SEQ ID NO: 1362392 - DNA, 22 bp, Artificial Sequence
  chemically synthesized
ggcacagatattaatacagctt

SEQ ID NO: 1362393 - DNA, 22 bp, Artificial Sequence
  chemically synthesized
gggcacagatattaatacagct

SEQ ID NO: 1362394 - DNA, 22 bp, Artificial Sequence
  chemically synthesized
atcatttgggcacagatattaa

SEQ ID NO: 1362395 - DNA, 22 bp, Artificial Sequence
  chemically synthesized
caaattcatcatttgggcacag

SEQ ID NO: 1362396 - DNA, 22 bp, Artificial Sequence
  chemically synthesized
tattaatatctgtgcccaaatg

SEQ ID NO: 1362397 - DNA, 22 bp, Artificial Sequence
  chemically synthesized
aattgcaaattcatcatttggg

SEQ ID NO: 1362398 - DNA, 22 bp, Artificial Sequence
  chemically synthesized
atatctgtgcccaaatgatgaa

SEQ ID NO: 1362399 - DNA, 22 bp, Artificial Sequence
  chemically synthesized
tgcccaaatgatgaatttgcaa

SEQ ID NO: 1362400 - DNA, 22 bp, Artificial Sequence
  chemically synthesized
gacagtactgaattgcaaattc

SEQ ID NO: 1362401 - DNA, 22 bp, Artificial Sequence
  chemically synthesized
cagctagacagtactgaattgc

SEQ ID NO: 1362402 - DNA, 22 bp, Artificial Sequence
  chemically synthesized
ttccagctagacagtactgaat

SEQ ID NO: 1362403 - DNA, 22 bp, Artificial Sequence
  chemically synthesized
acactattccagctagacagta

SEQ ID NO: 1362404 - DNA, 22 bp, Artificial Sequence
  chemically synthesized
gcaattcagtactgtctagctg

SEQ ID NO: 1362405 - DNA, 22 bp, Artificial Sequence
  chemically synthesized
caattcagtactgtctagctgg

SEQ ID NO: 1362406 - DNA, 22 bp, Artificial Sequence
  chemically synthesized
gctgacactattccagctagac

SEQ ID NO: 1362407 - DNA, 22 bp, Artificial Sequence
  chemically synthesized
agtactgtctagctggaatagt

SEQ ID NO: 1362408 - DNA, 22 bp, Artificial Sequence
  chemically synthesized
tctagctggaatagtgtcagcc

SEQ ID NO: 1362409 - DNA, 22 bp, Artificial Sequence
  chemically synthesized
gctggaatagtgtcagccaaca

SEQ ID NO: 1362410 - DNA, 22 bp, Artificial Sequence
  chemically synthesized
aggggaaaaaggtgttggctga

SEQ ID NO: 1362411 - DNA, 22 bp, Artificial Sequence
  chemically synthesized
aaggggaaaaaggtgttggctg

SEQ ID NO: 1362412 - DNA, 22 bp, Artificial Sequence
  chemically synthesized
gaatagtgtcagccaacacctt

SEQ ID NO: 1362413 - DNA, 22 bp, Artificial Sequence
  chemically synthesized
tttaaggggaaaaaggtgttgg

SEQ ID NO: 1362414 - DNA, 22 bp, Artificial Sequence
  chemically synthesized
cattatttaaggggaaaaaggt

SEQ ID NO: 1362415 - DNA, 22 bp, Artificial Sequence
  chemically synthesized
tgcataattacattatttaagg

SEQ ID NO: 1362416 - DNA, 22 bp, Artificial Sequence
  chemically synthesized
tatgcataattacattatttaa

SEQ ID NO: 1362417 - DNA, 22 bp, Artificial Sequence
  chemically synthesized
tttccccttaaataatgtaatt

SEQ ID NO: 1362418 - DNA, 22 bp, Artificial Sequence
  chemically synthesized
ttccccttaaataatgtaatta

SEQ ID NO: 1362419 - DNA, 22 bp, Artificial Sequence
  chemically synthesized
tccccttaaataatgtaattat

SEQ ID NO: 1362420 - DNA, 22 bp, Artificial Sequence
  chemically synthesized
ccccttaaataatgtaattatg

SEQ ID NO: 1362421 - DNA, 22 bp, Artificial Sequence
  chemically synthesized
cccttaaataatgtaattatgc

SEQ ID NO: 1362422 - DNA, 22 bp, Artificial Sequence
  chemically synthesized
caaagtgttctatgcataatta

SEQ ID NO: 1362423 - DNA, 22 bp, Artificial Sequence
  chemically synthesized
aaataatgtaattatgcataga

SEQ ID NO: 1362424 - DNA, 22 bp, Artificial Sequence
  chemically synthesized
aataatgtaattatgcatagaa

SEQ ID NO: 1362425 - DNA, 22 bp, Artificial Sequence
  chemically synthesized
aaaaaagactacaaagtgttct

SEQ ID NO: 1362426 - DNA, 22 bp, Artificial Sequence
  chemically synthesized
aaaaaaagactacaaagtgttc

SEQ ID NO: 1362427 - DNA, 22 bp, Artificial Sequence
  chemically synthesized
taaaaaaagactacaaagtgtt

SEQ ID NO: 1362428 - DNA, 22 bp, Artificial Sequence
  chemically synthesized
tgcatagaacactttgtagtct

SEQ ID NO: 1362429 - DNA, 22 bp, Artificial Sequence
  chemically synthesized
aactttaaaaaaagactacaaa

SEQ ID NO: 1362430 - DNA, 22 bp, Artificial Sequence
  chemically synthesized
taaactttaaaaaaagactaca

SEQ ID NO: 1362431 - DNA, 22 bp, Artificial Sequence
  chemically synthesized
ctctaaactttaaaaaaagact

SEQ ID NO: 1362432 - DNA, 22 bp, Artificial Sequence
  chemically synthesized
tgtagtctttttttaaagttta

SEQ ID NO: 1362433 - DNA, 22 bp, Artificial Sequence
  chemically synthesized
gtagtctttttttaaagtttag

SEQ ID NO: 1362434 - DNA, 22 bp, Artificial Sequence
  chemically synthesized
tagtctttttttaaagtttaga

SEQ ID NO: 1362435 - DNA, 22 bp, Artificial Sequence
  chemically synthesized
tttttaaagtttagagtaacat

SEQ ID NO: 1362436 - DNA, 22 bp, Artificial Sequence
  chemically synthesized
ttttaaagtttagagtaacatc

SEQ ID NO: 1362437 - DNA, 22 bp, Artificial Sequence
  chemically synthesized
tttaaagtttagagtaacatct

SEQ ID NO: 1362438 - DNA, 22 bp, Artificial Sequence
  chemically synthesized
ttaaagtttagagtaacatcta

SEQ ID NO: 1362439 - DNA, 22 bp, Artificial Sequence
  chemically synthesized
taaagtttagagtaacatctat

SEQ ID NO: 1362440 - DNA, 22 bp, Artificial Sequence
  chemically synthesized
aaagtttagagtaacatctata

SEQ ID NO: 1362441 - DNA, 22 bp, Artificial Sequence
  chemically synthesized
aagtttagagtaacatctatat

SEQ ID NO: 1362442 - DNA, 22 bp, Artificial Sequence
  chemically synthesized
agagtaacatctatatgacata

SEQ ID NO: 1362443 - DNA, 22 bp, Artificial Sequence
  chemically synthesized
gagtaacatctatatgacatac

SEQ ID NO: 1362444 - DNA, 22 bp, Artificial Sequence
  chemically synthesized
tgaaaaatacaatagagtatgt

SEQ ID NO: 1362445 - DNA, 22 bp, Artificial Sequence
  chemically synthesized
tatgacatactctattgtattt

SEQ ID NO: 1362446 - DNA, 22 bp, Artificial Sequence
  chemically synthesized
catgacataacattatgaaaaa

SEQ ID NO: 1362447 - DNA, 22 bp, Artificial Sequence
  chemically synthesized
acatgacataacattatgaaaa

SEQ ID NO: 1362448 - DNA, 22 bp, Artificial Sequence
  chemically synthesized
tattgtatttttcataatgtta

SEQ ID NO: 1362449 - DNA, 22 bp, Artificial Sequence
  chemically synthesized
ttgtatttttcataatgttatg

SEQ ID NO: 1362450 - DNA, 22 bp, Artificial Sequence
  chemically synthesized
tatttttcataatgttatgtca

SEQ ID NO: 1362451 - DNA, 22 bp, Artificial Sequence
  chemically synthesized
gtgtatcttacatgacataaca

SEQ ID NO: 1362452 - DNA, 22 bp, Artificial Sequence
  chemically synthesized
ggtgtatcttacatgacataac

SEQ ID NO: 1362453 - DNA, 22 bp, Artificial Sequence
  chemically synthesized
tggtgtatcttacatgacataa

SEQ ID NO: 1362454 - DNA, 22 bp, Artificial Sequence
  chemically synthesized
ttggtgtatcttacatgacata

SEQ ID NO: 1362455 - DNA, 22 bp, Artificial Sequence
  chemically synthesized
ttcataatgttatgtcatgtaa

SEQ ID NO: 1362456 - DNA, 22 bp, Artificial Sequence
  chemically synthesized
tcataatgttatgtcatgtaag

SEQ ID NO: 1362457 - DNA, 22 bp, Artificial Sequence
  chemically synthesized
cataatgttatgtcatgtaaga

SEQ ID NO: 1362458 - DNA, 22 bp, Artificial Sequence
  chemically synthesized
ataatgttatgtcatgtaagat

SEQ ID NO: 1362459 - DNA, 22 bp, Artificial Sequence
  chemically synthesized
atacaaagcttttggtgtatct

SEQ ID NO: 1362460 - DNA, 22 bp, Artificial Sequence
  chemically synthesized
tgtcatgtaagatacaccaaaa

SEQ ID NO: 1362461 - DNA, 22 bp, Artificial Sequence
  chemically synthesized
ttaatacaaagcttttggtgta

SEQ ID NO: 1362462 - DNA, 22 bp, Artificial Sequence
  chemically synthesized
atgatatactgttaatacaaag

SEQ ID NO: 1362463 - DNA, 22 bp, Artificial Sequence
  chemically synthesized
aattgatgatatactgttaata

SEQ ID NO: 1362464 - DNA, 22 bp, Artificial Sequence
  chemically synthesized
atctaaattgatgatatactgt

SEQ ID NO: 1362465 - DNA, 22 bp, Artificial Sequence
  chemically synthesized
ctgatctaaattgatgatatac

SEQ ID NO: 1362466 - DNA, 22 bp, Artificial Sequence
  chemically synthesized
tgtattaacagtatatcatcaa

SEQ ID NO: 1362467 - DNA, 22 bp, Artificial Sequence
  chemically synthesized
gtattaacagtatatcatcaat

SEQ ID NO: 1362468 - DNA, 22 bp, Artificial Sequence
  chemically synthesized
tattaacagtatatcatcaatt

SEQ ID NO: 1362469 - DNA, 22 bp, Artificial Sequence
  chemically synthesized
acagtatatcatcaatttagat

SEQ ID NO: 1362470 - DNA, 22 bp, Artificial Sequence
  chemically synthesized
cgaaaaagagattgctgatcta

SEQ ID NO: 1362471 - DNA, 22 bp, Artificial Sequence
  chemically synthesized
actacgaaaaagagattgctga

SEQ ID NO: 1362472 - DNA, 22 bp, Artificial Sequence
  chemically synthesized
aactacgaaaaagagattgctg

SEQ ID NO: 1362473 - DNA, 22 bp, Artificial Sequence
  chemically synthesized
agatcagcaatctctttttcgt

SEQ ID NO: 1362474 - DNA, 22 bp, Artificial Sequence
  chemically synthesized
gatcagcaatctctttttcgta

SEQ ID NO: 1362475 - DNA, 22 bp, Artificial Sequence
  chemically synthesized
aagacatcttaactacgaaaaa

SEQ ID NO: 1362476 - DNA, 22 bp, Artificial Sequence
  chemically synthesized
aaagacatcttaactacgaaaa

SEQ ID NO: 1362477 - DNA, 22 bp, Artificial Sequence
  chemically synthesized
taaagacatcttaactacgaaa

SEQ ID NO: 1362478 - DNA, 22 bp, Artificial Sequence
  chemically synthesized
ttaaagacatcttaactacgaa

SEQ ID NO: 1362479 - DNA, 22 bp, Artificial Sequence
  chemically synthesized
tttttcgtagttaagatgtctt

SEQ ID NO: 1362480 - DNA, 22 bp, Artificial Sequence
  chemically synthesized
cagaatcttttaaagacatctt

SEQ ID NO: 1362481 - DNA, 22 bp, Artificial Sequence
  chemically synthesized
tttcgtagttaagatgtcttta

SEQ ID NO: 1362482 - DNA, 22 bp, Artificial Sequence
  chemically synthesized
ttcgtagttaagatgtctttaa

SEQ ID NO: 1362483 - DNA, 22 bp, Artificial Sequence
  chemically synthesized
tcgtagttaagatgtctttaaa

SEQ ID NO: 1362484 - DNA, 22 bp, Artificial Sequence
  chemically synthesized
cgtagttaagatgtctttaaaa

SEQ ID NO: 1362485 - DNA, 22 bp, Artificial Sequence
  chemically synthesized
atctgcagaatcttttaaagac

SEQ ID NO: 1362486 - DNA, 22 bp, Artificial Sequence
  chemically synthesized
gtagttaagatgtctttaaaag

SEQ ID NO: 1362487 - DNA, 22 bp, Artificial Sequence
  chemically synthesized
catctgcagaatcttttaaaga

SEQ ID NO: 1362488 - DNA, 22 bp, Artificial Sequence
  chemically synthesized
gaatttcatctgcagaatcttt

SEQ ID NO: 1362489 - DNA, 22 bp, Artificial Sequence
  chemically synthesized
agatgtctttaaaagattctgc

SEQ ID NO: 1362490 - DNA, 22 bp, Artificial Sequence
  chemically synthesized
agaatttcatctgcagaatctt

SEQ ID NO: 1362491 - DNA, 22 bp, Artificial Sequence
  chemically synthesized
tagaatttcatctgcagaatct

SEQ ID NO: 1362492 - DNA, 22 bp, Artificial Sequence
  chemically synthesized
ttagaatttcatctgcagaatc

SEQ ID NO: 1362493 - DNA, 22 bp, Artificial Sequence
  chemically synthesized
taaaagattctgcagatgaaat

SEQ ID NO: 1362494 - DNA, 22 bp, Artificial Sequence
  chemically synthesized
aaaagattctgcagatgaaatt

SEQ ID NO: 1362495 - DNA, 22 bp, Artificial Sequence
  chemically synthesized
aaagattctgcagatgaaattc

SEQ ID NO: 1362496 - DNA, 22 bp, Artificial Sequence
  chemically synthesized
ataaaatcaccttttagaattt

SEQ ID NO: 1362497 - DNA, 22 bp, Artificial Sequence
  chemically synthesized
tgcagatgaaattctaaaaggt

SEQ ID NO: 1362498 - DNA, 22 bp, Artificial Sequence
  chemically synthesized
cagatgaaattctaaaaggtga

SEQ ID NO: 1362499 - DNA, 22 bp, Artificial Sequence
  chemically synthesized
aggtctaataaaatcacctttt

SEQ ID NO: 1362500 - DNA, 22 bp, Artificial Sequence
  chemically synthesized
taaaaggtgattttattagacc

SEQ ID NO: 1362501 - DNA, 22 bp, Artificial Sequence
  chemically synthesized
aaaggtgattttattagacctc

SEQ ID NO: 1362502 - DNA, 22 bp, Artificial Sequence
  chemically synthesized
aatgatgtaagtcatctgaggt

SEQ ID NO: 1362503 - DNA, 22 bp, Artificial Sequence
  chemically synthesized
aaatgatgtaagtcatctgagg

SEQ ID NO: 1362504 - DNA, 22 bp, Artificial Sequence
  chemically synthesized
tattagacctcagatgacttac

SEQ ID NO: 1362505 - DNA, 22 bp, Artificial Sequence
  chemically synthesized
attagacctcagatgacttaca

SEQ ID NO: 1362506 - DNA, 22 bp, Artificial Sequence
  chemically synthesized
ttagacctcagatgacttacat

SEQ ID NO: 1362507 - DNA, 22 bp, Artificial Sequence
  chemically synthesized
aatatatttaaatgatgtaagt

SEQ ID NO: 1362508 - DNA, 22 bp, Artificial Sequence
  chemically synthesized
gacctcagatgacttacatcat

SEQ ID NO: 1362509 - DNA, 22 bp, Artificial Sequence
  chemically synthesized
gaatatatttaaatgatgtaag

SEQ ID NO: 1362510 - DNA, 22 bp, Artificial Sequence
  chemically synthesized
atttgaatatatttaaatgatg

SEQ ID NO: 1362511 - DNA, 22 bp, Artificial Sequence
  chemically synthesized
catttgaatatatttaaatgat

SEQ ID NO: 1362512 - DNA, 22 bp, Artificial Sequence
  chemically synthesized
agatgacttacatcatttaaat

SEQ ID NO: 1362513 - DNA, 22 bp, Artificial Sequence
  chemically synthesized
acatcatttaaatatattcaaa

SEQ ID NO: 1362514 - DNA, 22 bp, Artificial Sequence
  chemically synthesized
catcatttaaatatattcaaat

SEQ ID NO: 1362515 - DNA, 22 bp, Artificial Sequence
  chemically synthesized
caaatagacatttcatttgaat

SEQ ID NO: 1362516 - DNA, 22 bp, Artificial Sequence
  chemically synthesized
aaatatattcaaatgaaatgtc

SEQ ID NO: 1362517 - DNA, 22 bp, Artificial Sequence
  chemically synthesized
aatatattcaaatgaaatgtct

SEQ ID NO: 1362518 - DNA, 22 bp, Artificial Sequence
  chemically synthesized
aaatagtgtactgcaaatagac

SEQ ID NO: 1362519 - DNA, 22 bp, Artificial Sequence
  chemically synthesized
aaatgaaatgtctatttgcagt

SEQ ID NO: 1362520 - DNA, 22 bp, Artificial Sequence
  chemically synthesized
ttcaaatagtgtactgcaaata

SEQ ID NO: 1362521 - DNA, 22 bp, Artificial Sequence
  chemically synthesized
taaagaattattcaaatagtgt

SEQ ID NO: 1362522 - DNA, 22 bp, Artificial Sequence
  chemically synthesized
tttgcagtacactatttgaata

SEQ ID NO: 1362523 - DNA, 22 bp, Artificial Sequence
  chemically synthesized
gcagtacactatttgaataatt

SEQ ID NO: 1362524 - DNA, 22 bp, Artificial Sequence
  chemically synthesized
cagtacactatttgaataattc

SEQ ID NO: 1362525 - DNA, 22 bp, Artificial Sequence
  chemically synthesized
aaataatgcattgtaaagaatt

SEQ ID NO: 1362526 - DNA, 22 bp, Artificial Sequence
  chemically synthesized
ctcaaataatgcattgtaaaga

SEQ ID NO: 1362527 - DNA, 22 bp, Artificial Sequence
  chemically synthesized
tttgaataattctttacaatgc

SEQ ID NO: 1362528 - DNA, 22 bp, Artificial Sequence
  chemically synthesized
gaataattctttacaatgcatt

SEQ ID NO: 1362529 - DNA, 22 bp, Artificial Sequence
  chemically synthesized
aataattctttacaatgcatta

SEQ ID NO: 1362530 - DNA, 22 bp, Artificial Sequence
  chemically synthesized
gaattactcaaataatgcattg

SEQ ID NO: 1362531 - DNA, 22 bp, Artificial Sequence
  chemically synthesized
agaattactcaaataatgcatt

SEQ ID NO: 1362532 - DNA, 22 bp, Artificial Sequence
  chemically synthesized
tagaattactcaaataatgcat

SEQ ID NO: 1362533 - DNA, 22 bp, Artificial Sequence
  chemically synthesized
ttagaattactcaaataatgca

SEQ ID NO: 1362534 - DNA, 22 bp, Artificial Sequence
  chemically synthesized
acttttagaattactcaaataa

SEQ ID NO: 1362535 - DNA, 22 bp, Artificial Sequence
  chemically synthesized
tttacaatgcattatttgagta

SEQ ID NO: 1362536 - DNA, 22 bp, Artificial Sequence
  chemically synthesized
tacaatgcattatttgagtaat

SEQ ID NO: 1362537 - DNA, 22 bp, Artificial Sequence
  chemically synthesized
ttcacttttagaattactcaaa

SEQ ID NO: 1362538 - DNA, 22 bp, Artificial Sequence
  chemically synthesized
acaatgcattatttgagtaatt

SEQ ID NO: 1362539 - DNA, 22 bp, Artificial Sequence
  chemically synthesized
caatgcattatttgagtaattc

SEQ ID NO: 1362540 - DNA, 22 bp, Artificial Sequence
  chemically synthesized
tattgttcacttttagaattac

SEQ ID NO: 1362541 - DNA, 22 bp, Artificial Sequence
  chemically synthesized
tttgagtaattctaaaagtgaa

SEQ ID NO: 1362542 - DNA, 22 bp, Artificial Sequence
  chemically synthesized
gagtaattctaaaagtgaacaa

SEQ ID NO: 1362543 - DNA, 22 bp, Artificial Sequence
  chemically synthesized
agtaattctaaaagtgaacaat

SEQ ID NO: 1362544 - DNA, 22 bp, Artificial Sequence
  chemically synthesized
tcaaacatattgtattgttcac

SEQ ID NO: 1362545 - DNA, 22 bp, Artificial Sequence
  chemically synthesized
tattgtcaaacatattgtattg

SEQ ID NO: 1362546 - DNA, 22 bp, Artificial Sequence
  chemically synthesized
taaaagtgaacaatacaatatg

SEQ ID NO: 1362547 - DNA, 22 bp, Artificial Sequence
  chemically synthesized
aaagtgaacaatacaatatgtt

SEQ ID NO: 1362548 - DNA, 22 bp, Artificial Sequence
  chemically synthesized
aaagagatcactgtattgtcaa

SEQ ID NO: 1362549 - DNA, 22 bp, Artificial Sequence
  chemically synthesized
aaaagagatcactgtattgtca

SEQ ID NO: 1362550 - DNA, 22 bp, Artificial Sequence
  chemically synthesized
taaaagagatcactgtattgtc

SEQ ID NO: 1362551 - DNA, 22 bp, Artificial Sequence
  chemically synthesized
ccctttaaaagagatcactgta

SEQ ID NO: 1362552 - DNA, 22 bp, Artificial Sequence
  chemically synthesized
gacaatacagtgatctctttta

SEQ ID NO: 1362553 - DNA, 22 bp, Artificial Sequence
  chemically synthesized
acaatacagtgatctcttttaa

SEQ ID NO: 1362554 - DNA, 22 bp, Artificial Sequence
  chemically synthesized
accaaaacagttaccctttaaa

SEQ ID NO: 1362555 - DNA, 22 bp, Artificial Sequence
  chemically synthesized
aaccaaaacagttaccctttaa

SEQ ID NO: 1362556 - DNA, 22 bp, Artificial Sequence
  chemically synthesized
taaccaaaacagttacccttta

SEQ ID NO: 1362557 - DNA, 22 bp, Artificial Sequence
  chemically synthesized
ttaaccaaaacagttacccttt

SEQ ID NO: 1362558 - DNA, 22 bp, Artificial Sequence
  chemically synthesized
tttaaccaaaacagttaccctt

SEQ ID NO: 1362559 - DNA, 22 bp, Artificial Sequence
  chemically synthesized
ttttttaaccaaaacagttacc

SEQ ID NO: 1362560 - DNA, 22 bp, Artificial Sequence
  chemically synthesized
ttgttttttaaccaaaacagtt

SEQ ID NO: 1362561 - DNA, 22 bp, Artificial Sequence
  chemically synthesized
ttttaaagggtaactgttttgg

SEQ ID NO: 1362562 - DNA, 22 bp, Artificial Sequence
  chemically synthesized
gttgttttttaaccaaaacagt

SEQ ID NO: 1362563 - DNA, 22 bp, Artificial Sequence
  chemically synthesized
tgttgttttttaaccaaaacag

SEQ ID NO: 1362564 - DNA, 22 bp, Artificial Sequence
  chemically synthesized
ttaaagggtaactgttttggtt

SEQ ID NO: 1362565 - DNA, 22 bp, Artificial Sequence
  chemically synthesized
taaagggtaactgttttggtta

SEQ ID NO: 1362566 - DNA, 22 bp, Artificial Sequence
  chemically synthesized
aaagggtaactgttttggttaa

SEQ ID NO: 1362567 - DNA, 22 bp, Artificial Sequence
  chemically synthesized
aagggtaactgttttggttaaa

SEQ ID NO: 1362568 - DNA, 22 bp, Artificial Sequence
  chemically synthesized
caaaagtacgttttgttgtttt

SEQ ID NO: 1362569 - DNA, 22 bp, Artificial Sequence
  chemically synthesized
acaaaagtacgttttgttgttt

SEQ ID NO: 1362570 - DNA, 22 bp, Artificial Sequence
  chemically synthesized
ttttggttaaaaaacaacaaaa

SEQ ID NO: 1362571 - DNA, 22 bp, Artificial Sequence
  chemically synthesized
tggttaaaaaacaacaaaacgt

SEQ ID NO: 1362572 - DNA, 22 bp, Artificial Sequence
  chemically synthesized
ggttaaaaaacaacaaaacgta

SEQ ID NO: 1362573 - DNA, 22 bp, Artificial Sequence
  chemically synthesized
gttaaaaaacaacaaaacgtac

SEQ ID NO: 1362574 - DNA, 22 bp, Artificial Sequence
  chemically synthesized
ataaacttacaaaagtacgttt

SEQ ID NO: 1362575 - DNA, 22 bp, Artificial Sequence
  chemically synthesized
gataaacttacaaaagtacgtt

SEQ ID NO: 1362576 - DNA, 22 bp, Artificial Sequence
  chemically synthesized
aaaaacaacaaaacgtactttt

SEQ ID NO: 1362577 - DNA, 22 bp, Artificial Sequence
  chemically synthesized
ccgtagtttgataaacttacaa

SEQ ID NO: 1362578 - DNA, 22 bp, Artificial Sequence
  chemically synthesized
gccgtagtttgataaacttaca

SEQ ID NO: 1362579 - DNA, 22 bp, Artificial Sequence
  chemically synthesized
taaatttgccgtagtttgataa

SEQ ID NO: 1362580 - DNA, 22 bp, Artificial Sequence
  chemically synthesized
gtaaatttgccgtagtttgata

SEQ ID NO: 1362581 - DNA, 22 bp, Artificial Sequence
  chemically synthesized
ttgtaagtttatcaaactacgg

SEQ ID NO: 1362582 - DNA, 22 bp, Artificial Sequence
  chemically synthesized
tgtaagtttatcaaactacggc

SEQ ID NO: 1362583 - DNA, 22 bp, Artificial Sequence
  chemically synthesized
gtaagtttatcaaactacggca

SEQ ID NO: 1362584 - DNA, 22 bp, Artificial Sequence
  chemically synthesized
taagtttatcaaactacggcaa

SEQ ID NO: 1362585 - DNA, 22 bp, Artificial Sequence
  chemically synthesized
aatccagtttgtaaatttgccg

SEQ ID NO: 1362586 - DNA, 22 bp, Artificial Sequence
  chemically synthesized
gaatccagtttgtaaatttgcc

SEQ ID NO: 1362587 - DNA, 22 bp, Artificial Sequence
  chemically synthesized
atcaaactacggcaaatttaca

SEQ ID NO: 1362588 - DNA, 22 bp, Artificial Sequence
  chemically synthesized
tcaaactacggcaaatttacaa

SEQ ID NO: 1362589 - DNA, 22 bp, Artificial Sequence
  chemically synthesized
acatttgaatccagtttgtaaa

SEQ ID NO: 1362590 - DNA, 22 bp, Artificial Sequence
  chemically synthesized
gacatttgaatccagtttgtaa

SEQ ID NO: 1362591 - DNA, 22 bp, Artificial Sequence
  chemically synthesized
cggcaaatttacaaactggatt

SEQ ID NO: 1362592 - DNA, 22 bp, Artificial Sequence
  chemically synthesized
gatgtttgacatttgaatccag

SEQ ID NO: 1362593 - DNA, 22 bp, Artificial Sequence
  chemically synthesized
ggatgtttgacatttgaatcca

SEQ ID NO: 1362594 - DNA, 22 bp, Artificial Sequence
  chemically synthesized
cttggatgtttgacatttgaat

SEQ ID NO: 1362595 - DNA, 22 bp, Artificial Sequence
  chemically synthesized
acaaactggattcaaatgtcaa

SEQ ID NO: 1362596 - DNA, 22 bp, Artificial Sequence
  chemically synthesized
ctacttggatgtttgacatttg

SEQ ID NO: 1362597 - DNA, 22 bp, Artificial Sequence
  chemically synthesized
caaactggattcaaatgtcaaa

SEQ ID NO: 1362598 - DNA, 22 bp, Artificial Sequence
  chemically synthesized
gattcaaatgtcaaacatccaa

SEQ ID NO: 1362599 - DNA, 22 bp, Artificial Sequence
  chemically synthesized
acaacatactgctacttggatg

SEQ ID NO: 1362600 - DNA, 22 bp, Artificial Sequence
  chemically synthesized
gacaacatactgctacttggat

SEQ ID NO: 1362601 - DNA, 22 bp, Artificial Sequence
  chemically synthesized
aaatgtcaaacatccaagtagc

SEQ ID NO: 1362602 - DNA, 22 bp, Artificial Sequence
  chemically synthesized
tttgacaacatactgctacttg

SEQ ID NO: 1362603 - DNA, 22 bp, Artificial Sequence
  chemically synthesized
ctgtttgacaacatactgctac

SEQ ID NO: 1362604 - DNA, 22 bp, Artificial Sequence
  chemically synthesized
gctgtttgacaacatactgcta

SEQ ID NO: 1362605 - DNA, 22 bp, Artificial Sequence
  chemically synthesized
tgctgtttgacaacatactgct

SEQ ID NO: 1362606 - DNA, 22 bp, Artificial Sequence
  chemically synthesized
aattttgctgtttgacaacata

SEQ ID NO: 1362607 - DNA, 22 bp, Artificial Sequence
  chemically synthesized
tacattaaattttgctgtttga

SEQ ID NO: 1362608 - DNA, 22 bp, Artificial Sequence
  chemically synthesized
tattatacattaaattttgctg

SEQ ID NO: 1362609 - DNA, 22 bp, Artificial Sequence
  chemically synthesized
tcaaacagcaaaatttaatgta

SEQ ID NO: 1362610 - DNA, 22 bp, Artificial Sequence
  chemically synthesized
agggctatattatacattaaat

SEQ ID NO: 1362611 - DNA, 22 bp, Artificial Sequence
  chemically synthesized
aatgtataatatagccctgagt

SEQ ID NO: 1362612 - DNA, 22 bp, Artificial Sequence
  chemically synthesized
atgtataatatagccctgagta

SEQ ID NO: 1362613 - DNA, 22 bp, Artificial Sequence
  chemically synthesized
gtaagaaaaaacggagatatac

SEQ ID NO: 1362614 - DNA, 22 bp, Artificial Sequence
  chemically synthesized
ggtaagaaaaaacggagatata

SEQ ID NO: 1362615 - DNA, 22 bp, Artificial Sequence
  chemically synthesized
agtatatctccgttttttctta

SEQ ID NO: 1362616 - DNA, 22 bp, Artificial Sequence
  chemically synthesized
cgttttttcttaccaaactcat

SEQ ID NO: 1362617 - DNA, 22 bp, Artificial Sequence
  chemically synthesized
tgcaacatgacaatgagtttgg

SEQ ID NO: 1362618 - DNA, 22 bp, Artificial Sequence
  chemically synthesized
tttcttaccaaactcattgtca

SEQ ID NO: 1362619 - DNA, 22 bp, Artificial Sequence
  chemically synthesized
ttcttaccaaactcattgtcat

SEQ ID NO: 1362620 - DNA, 22 bp, Artificial Sequence
  chemically synthesized
tcttaccaaactcattgtcatg

SEQ ID NO: 1362621 - DNA, 22 bp, Artificial Sequence
  chemically synthesized
cttaccaaactcattgtcatgt

SEQ ID NO: 1362622 - DNA, 22 bp, Artificial Sequence
  chemically synthesized
ttaccaaactcattgtcatgtt

SEQ ID NO: 1362623 - DNA, 22 bp, Artificial Sequence
  chemically synthesized
accaaactcattgtcatgttgc

SEQ ID NO: 1362624 - DNA, 22 bp, Artificial Sequence
  chemically synthesized
ccaaactcattgtcatgttgca

SEQ ID NO: 1362625 - DNA, 22 bp, Artificial Sequence
  chemically synthesized
attgtcatgttgcataggcatt

SEQ ID NO: 1362626 - DNA, 22 bp, Artificial Sequence
  chemically synthesized
aaaaatcatcaagtaatgccta

SEQ ID NO: 1362627 - DNA, 22 bp, Artificial Sequence
  chemically synthesized
aaaaaatcatcaagtaatgcct

SEQ ID NO: 1362628 - DNA, 22 bp, Artificial Sequence
  chemically synthesized
tcatgttgcataggcattactt

SEQ ID NO: 1362629 - DNA, 22 bp, Artificial Sequence
  chemically synthesized
catttaaaaaatcatcaagtaa

SEQ ID NO: 1362630 - DNA, 22 bp, Artificial Sequence
  chemically synthesized
cataggcattacttgatgattt

SEQ ID NO: 1362631 - DNA, 22 bp, Artificial Sequence
  chemically synthesized
acgctgcatttaaaaaatcatc

SEQ ID NO: 1362632 - DNA, 22 bp, Artificial Sequence
  chemically synthesized
cacgctgcatttaaaaaatcat

SEQ ID NO: 1362633 - DNA, 22 bp, Artificial Sequence
  chemically synthesized
tcacgctgcatttaaaaaatca

SEQ ID NO: 1362634 - DNA, 22 bp, Artificial Sequence
  chemically synthesized
ttcacgctgcatttaaaaaatc

SEQ ID NO: 1362635 - DNA, 22 bp, Artificial Sequence
  chemically synthesized
tttcacgctgcatttaaaaaat

SEQ ID NO: 1362636 - DNA, 22 bp, Artificial Sequence
  chemically synthesized
cttgatgattttttaaatgcag

SEQ ID NO: 1362637 - DNA, 22 bp, Artificial Sequence
  chemically synthesized
gatgattttttaaatgcagcgt

SEQ ID NO: 1362638 - DNA, 22 bp, Artificial Sequence
  chemically synthesized
taggattttttcacgctgcatt

SEQ ID NO: 1362639 - DNA, 22 bp, Artificial Sequence
  chemically synthesized
atgattttttaaatgcagcgtg

SEQ ID NO: 1362640 - DNA, 22 bp, Artificial Sequence
  chemically synthesized
tttaaatgcagcgtgaaaaaat

SEQ ID NO: 1362641 - DNA, 22 bp, Artificial Sequence
  chemically synthesized
ttaaatgcagcgtgaaaaaatc

SEQ ID NO: 1362642 - DNA, 22 bp, Artificial Sequence
  chemically synthesized
taaatgcagcgtgaaaaaatcc

SEQ ID NO: 1362643 - DNA, 22 bp, Artificial Sequence
  chemically synthesized
aaatgcagcgtgaaaaaatcct

SEQ ID NO: 1362644 - DNA, 22 bp, Artificial Sequence
  chemically synthesized
aatgcagcgtgaaaaaatccta

SEQ ID NO: 1362645 - DNA, 22 bp, Artificial Sequence
  chemically synthesized
ggacatgccctgtaggattttt

SEQ ID NO: 1362646 - DNA, 22 bp, Artificial Sequence
  chemically synthesized
gggacatgccctgtaggatttt

SEQ ID NO: 1362647 - DNA, 22 bp, Artificial Sequence
  chemically synthesized
tgggacatgccctgtaggattt

SEQ ID NO: 1362648 - DNA, 22 bp, Artificial Sequence
  chemically synthesized
ttgggacatgccctgtaggatt

SEQ ID NO: 1362649 - DNA, 22 bp, Artificial Sequence
  chemically synthesized
tttgggacatgccctgtaggat

SEQ ID NO: 1362650 - DNA, 22 bp, Artificial Sequence
  chemically synthesized
cagggcatgtcccaaaaagatt

SEQ ID NO: 1362651 - DNA, 22 bp, Artificial Sequence
  chemically synthesized
gaatgcgaagaaaggtaatctt

SEQ ID NO: 1362652 - DNA, 22 bp, Artificial Sequence
  chemically synthesized
agaatgcgaagaaaggtaatct

SEQ ID NO: 1362653 - DNA, 22 bp, Artificial Sequence
  chemically synthesized
ttagaatgcgaagaaaggtaat

SEQ ID NO: 1362654 - DNA, 22 bp, Artificial Sequence
  chemically synthesized
aattcttagaatgcgaagaaag

SEQ ID NO: 1362655 - DNA, 22 bp, Artificial Sequence
  chemically synthesized
caattcttagaatgcgaagaaa

SEQ ID NO: 1362656 - DNA, 22 bp, Artificial Sequence
  chemically synthesized
tcaattcttagaatgcgaagaa

SEQ ID NO: 1362657 - DNA, 22 bp, Artificial Sequence
  chemically synthesized
cctttcttcgcattctaagaat

SEQ ID NO: 1362658 - DNA, 22 bp, Artificial Sequence
  chemically synthesized
aaataactttcaattcttagaa

SEQ ID NO: 1362659 - DNA, 22 bp, Artificial Sequence
  chemically synthesized
tcttcgcattctaagaattgaa

SEQ ID NO: 1362660 - DNA, 22 bp, Artificial Sequence
  chemically synthesized
cttcgcattctaagaattgaaa

SEQ ID NO: 1362661 - DNA, 22 bp, Artificial Sequence
  chemically synthesized
ttcgcattctaagaattgaaag

SEQ ID NO: 1362662 - DNA, 22 bp, Artificial Sequence
  chemically synthesized
cgcattctaagaattgaaagtt

SEQ ID NO: 1362663 - DNA, 22 bp, Artificial Sequence
  chemically synthesized
gcattctaagaattgaaagtta

SEQ ID NO: 1362664 - DNA, 22 bp, Artificial Sequence
  chemically synthesized
tcatagatattcaaataacttt

SEQ ID NO: 1362665 - DNA, 22 bp, Artificial Sequence
  chemically synthesized
gtcatagatattcaaataactt

SEQ ID NO: 1362666 - DNA, 22 bp, Artificial Sequence
  chemically synthesized
tgtcatagatattcaaataact

SEQ ID NO: 1362667 - DNA, 22 bp, Artificial Sequence
  chemically synthesized
taagaattgaaagttatttgaa

SEQ ID NO: 1362668 - DNA, 22 bp, Artificial Sequence
  chemically synthesized
agaattgaaagttatttgaata

SEQ ID NO: 1362669 - DNA, 22 bp, Artificial Sequence
  chemically synthesized
ctttgtcatagatattcaaata

SEQ ID NO: 1362670 - DNA, 22 bp, Artificial Sequence
  chemically synthesized
tgctttgtcatagatattcaaa

SEQ ID NO: 1362671 - DNA, 22 bp, Artificial Sequence
  chemically synthesized
aaagttatttgaatatctatga

SEQ ID NO: 1362672 - DNA, 22 bp, Artificial Sequence
  chemically synthesized
cactctgctttgtcatagatat

SEQ ID NO: 1362673 - DNA, 22 bp, Artificial Sequence
  chemically synthesized
tttgaatatctatgacaaagca

SEQ ID NO: 1362674 - DNA, 22 bp, Artificial Sequence
  chemically synthesized
gaatatctatgacaaagcagag

SEQ ID NO: 1362675 - DNA, 22 bp, Artificial Sequence
  chemically synthesized
aatatctatgacaaagcagagt

SEQ ID NO: 1362676 - DNA, 22 bp, Artificial Sequence
  chemically synthesized
agcaaggtaaatctacactctg

SEQ ID NO: 1362677 - DNA, 22 bp, Artificial Sequence
  chemically synthesized
tgacaaagcagagtgtagattt

SEQ ID NO: 1362678 - DNA, 22 bp, Artificial Sequence
  chemically synthesized
aaattaagcaaggtaaatctac

SEQ ID NO: 1362679 - DNA, 22 bp, Artificial Sequence
  chemically synthesized
ctgaaattaagcaaggtaaatc

SEQ ID NO: 1362680 - DNA, 22 bp, Artificial Sequence
  chemically synthesized
tgctgaaattaagcaaggtaaa

SEQ ID NO: 1362681 - DNA, 22 bp, Artificial Sequence
  chemically synthesized
accttgcttaatttcagcagaa

SEQ ID NO: 1362682 - DNA, 22 bp, Artificial Sequence
  chemically synthesized
ccttgcttaatttcagcagaat

SEQ ID NO: 1362683 - DNA, 22 bp, Artificial Sequence
  chemically synthesized
aaagaatatatgcaattctgct

SEQ ID NO: 1362684 - DNA, 22 bp, Artificial Sequence
  chemically synthesized
gaaagaatatatgcaattctgc

SEQ ID NO: 1362685 - DNA, 22 bp, Artificial Sequence
  chemically synthesized
gcttaatttcagcagaattgca

SEQ ID NO: 1362686 - DNA, 22 bp, Artificial Sequence
  chemically synthesized
tgaaagaatatatgcaattctg

SEQ ID NO: 1362687 - DNA, 22 bp, Artificial Sequence
  chemically synthesized
cttaatttcagcagaattgcat

SEQ ID NO: 1362688 - DNA, 22 bp, Artificial Sequence
  chemically synthesized
aatttcagcagaattgcatata

SEQ ID NO: 1362689 - DNA, 22 bp, Artificial Sequence
  chemically synthesized
atttcagcagaattgcatatat

SEQ ID NO: 1362690 - DNA, 22 bp, Artificial Sequence
  chemically synthesized
cagcagaattgcatatattctt

SEQ ID NO: 1362691 - DNA, 22 bp, Artificial Sequence
  chemically synthesized
agcagaattgcatatattcttt

SEQ ID NO: 1362692 - DNA, 22 bp, Artificial Sequence
  chemically synthesized
catatattctttcaaaattgct

SEQ ID NO: 1362693 - DNA, 22 bp, Artificial Sequence
  chemically synthesized
tttcaaaattgctctatatact

SEQ ID NO: 1362694 - DNA, 22 bp, Artificial Sequence
  chemically synthesized
acatcatatacaagtatataga

SEQ ID NO: 1362695 - DNA, 22 bp, Artificial Sequence
  chemically synthesized
tcaaaattgctctatatacttg

SEQ ID NO: 1362696 - DNA, 22 bp, Artificial Sequence
  chemically synthesized
caaaattgctctatatacttgt

SEQ ID NO: 1362697 - DNA, 22 bp, Artificial Sequence
  chemically synthesized
aaaattgctctatatacttgta

SEQ ID NO: 1362698 - DNA, 22 bp, Artificial Sequence
  chemically synthesized
cataattaacatcatatacaag

SEQ ID NO: 1362699 - DNA, 22 bp, Artificial Sequence
  chemically synthesized
tacataattaacatcatataca

SEQ ID NO: 1362700 - DNA, 22 bp, Artificial Sequence
  chemically synthesized
ctctatatacttgtatatgatg

SEQ ID NO: 1362701 - DNA, 22 bp, Artificial Sequence
  chemically synthesized
tatatacttgtatatgatgtta

SEQ ID NO: 1362702 - DNA, 22 bp, Artificial Sequence
  chemically synthesized
tatacttgtatatgatgttaat

SEQ ID NO: 1362703 - DNA, 22 bp, Artificial Sequence
  chemically synthesized
gtatatgatgttaattatgtag

SEQ ID NO: 1362704 - DNA, 22 bp, Artificial Sequence
  chemically synthesized
tatatgatgttaattatgtaga

SEQ ID NO: 1362705 - DNA, 22 bp, Artificial Sequence
  chemically synthesized
tatatatatatattctacataa

SEQ ID NO: 1362706 - DNA, 22 bp, Artificial Sequence
  chemically synthesized
atatatatatatattctacata

SEQ ID NO: 1362707 - DNA, 22 bp, Artificial Sequence
  chemically synthesized
tatatatatatatattctacat

SEQ ID NO: 1362708 - DNA, 22 bp, Artificial Sequence
  chemically synthesized
gtgattttatatatatatatat

SEQ ID NO: 1362709 - DNA, 22 bp, Artificial Sequence
  chemically synthesized
attatgtagaatatatatatat

SEQ ID NO: 1362710 - DNA, 22 bp, Artificial Sequence
  chemically synthesized
tgtagaatatatatatatataa

SEQ ID NO: 1362711 - DNA, 22 bp, Artificial Sequence
  chemically synthesized
atatatgtaacataaataccat

SEQ ID NO: 1362712 - DNA, 22 bp, Artificial Sequence
  chemically synthesized
gatatatgtaacataaatacca

SEQ ID NO: 1362713 - DNA, 22 bp, Artificial Sequence
  chemically synthesized
tgatatatgtaacataaatacc

SEQ ID NO: 1362714 - DNA, 22 bp, Artificial Sequence
  chemically synthesized
gtgattttgatggtatttatgt

SEQ ID NO: 1362715 - DNA, 22 bp, Artificial Sequence
  chemically synthesized
tttgatatatgtaacataaata

SEQ ID NO: 1362716 - DNA, 22 bp, Artificial Sequence
  chemically synthesized
ctttgatatatgtaacataaat

SEQ ID NO: 1362717 - DNA, 22 bp, Artificial Sequence
  chemically synthesized
tttctttgatatatgtaacata

SEQ ID NO: 1362718 - DNA, 22 bp, Artificial Sequence
  chemically synthesized
atttctttgatatatgtaacat

SEQ ID NO: 1362719 - DNA, 22 bp, Artificial Sequence
  chemically synthesized
tgatggtatttatgttacatat

SEQ ID NO: 1362720 - DNA, 22 bp, Artificial Sequence
  chemically synthesized
tatttctttgatatatgtaaca

SEQ ID NO: 1362721 - DNA, 22 bp, Artificial Sequence
  chemically synthesized
gatggtatttatgttacatata

SEQ ID NO: 1362722 - DNA, 22 bp, Artificial Sequence
  chemically synthesized
ttatttctttgatatatgtaac

SEQ ID NO: 1362723 - DNA, 22 bp, Artificial Sequence
  chemically synthesized
atggtatttatgttacatatat

SEQ ID NO: 1362724 - DNA, 22 bp, Artificial Sequence
  chemically synthesized
tttttatttctttgatatatgt

SEQ ID NO: 1362725 - DNA, 22 bp, Artificial Sequence
  chemically synthesized
gtttttatttctttgatatatg

SEQ ID NO: 1362726 - DNA, 22 bp, Artificial Sequence
  chemically synthesized
tgtttttatttctttgatatat

SEQ ID NO: 1362727 - DNA, 22 bp, Artificial Sequence
  chemically synthesized
ttgtttttatttctttgatata

SEQ ID NO: 1362728 - DNA, 22 bp, Artificial Sequence
  chemically synthesized
tttgtttttatttctttgatat

SEQ ID NO: 1362729 - DNA, 22 bp, Artificial Sequence
  chemically synthesized
atgttacatatatcaaagaaat

SEQ ID NO: 1362730 - DNA, 22 bp, Artificial Sequence
  chemically synthesized
ttttttgtttttatttctttga

SEQ ID NO: 1362731 - DNA, 22 bp, Artificial Sequence
  chemically synthesized
tgttacatatatcaaagaaata

SEQ ID NO: 1362732 - DNA, 22 bp, Artificial Sequence
  chemically synthesized
attttttgtttttatttctttg

SEQ ID NO: 1362733 - DNA, 22 bp, Artificial Sequence
  chemically synthesized
tattttttgtttttatttcttt

SEQ ID NO: 1362734 - DNA, 22 bp, Artificial Sequence
  chemically synthesized
ttattttttgtttttatttctt

SEQ ID NO: 1362735 - DNA, 22 bp, Artificial Sequence
  chemically synthesized
catatatcaaagaaataaaaac

SEQ ID NO: 1362736 - DNA, 22 bp, Artificial Sequence
  chemically synthesized
caatatacacacacatttttat

SEQ ID NO: 1362737 - DNA, 22 bp, Artificial Sequence
  chemically synthesized
gcaatatacacacacattttta

SEQ ID NO: 1362738 - DNA, 22 bp, Artificial Sequence
  chemically synthesized
tttgcaatatacacacacattt

SEQ ID NO: 1362739 - DNA, 22 bp, Artificial Sequence
  chemically synthesized
ttgtttgcaatatacacacaca

SEQ ID NO: 1362740 - DNA, 22 bp, Artificial Sequence
  chemically synthesized
caaatatatgcatggcatatat

SEQ ID NO: 1362741 - DNA, 22 bp, Artificial Sequence
  chemically synthesized
caaacaacagatatatgccatg

SEQ ID NO: 1362742 - DNA, 22 bp, Artificial Sequence
  chemically synthesized
tcattacaaatatatgcatggc

SEQ ID NO: 1362743 - DNA, 22 bp, Artificial Sequence
  chemically synthesized
ctatcattacaaatatatgcat

SEQ ID NO: 1362744 - DNA, 22 bp, Artificial Sequence
  chemically synthesized
actatcattacaaatatatgca

SEQ ID NO: 1362745 - DNA, 22 bp, Artificial Sequence
  chemically synthesized
tatttactatcattacaaatat

SEQ ID NO: 1362746 - DNA, 22 bp, Artificial Sequence
  chemically synthesized
ttatatttactatcattacaaa

SEQ ID NO: 1362747 - DNA, 22 bp, Artificial Sequence
  chemically synthesized
aaaaactattatatttactatc

SEQ ID NO: 1362748 - DNA, 22 bp, Artificial Sequence
  chemically synthesized
gattgaaaaactattatattta

SEQ ID NO: 1362749 - DNA, 22 bp, Artificial Sequence
  chemically synthesized
agattgaaaaactattatattt

SEQ ID NO: 1362750 - DNA, 22 bp, Artificial Sequence
  chemically synthesized
gtaatgatagtaaatataatag

SEQ ID NO: 1362751 - DNA, 22 bp, Artificial Sequence
  chemically synthesized
tagattgaaaaactattatatt

SEQ ID NO: 1362752 - DNA, 22 bp, Artificial Sequence
  chemically synthesized
taatgatagtaaatataatagt

SEQ ID NO: 1362753 - DNA, 22 bp, Artificial Sequence
  chemically synthesized
ttagattgaaaaactattatat

SEQ ID NO: 1362754 - DNA, 22 bp, Artificial Sequence
  chemically synthesized
cttttagattgaaaaactatta

SEQ ID NO: 1362755 - DNA, 22 bp, Artificial Sequence
  chemically synthesized
ttacttttagattgaaaaacta

SEQ ID NO: 1362756 - DNA, 22 bp, Artificial Sequence
  chemically synthesized
gtggacatcattattactttta

SEQ ID NO: 1362757 - DNA, 22 bp, Artificial Sequence
  chemically synthesized
ggtggacatcattattactttt

SEQ ID NO: 1362758 - DNA, 22 bp, Artificial Sequence
  chemically synthesized
tggtggacatcattattacttt

SEQ ID NO: 1362759 - DNA, 22 bp, Artificial Sequence
  chemically synthesized
ttggtggacatcattattactt

SEQ ID NO: 1362760 - DNA, 22 bp, Artificial Sequence
  chemically synthesized
ttcaatctaaaagtaataatga

SEQ ID NO: 1362761 - DNA, 22 bp, Artificial Sequence
  chemically synthesized
ttttggtggacatcattattac

SEQ ID NO: 1362762 - DNA, 22 bp, Artificial Sequence
  chemically synthesized
tcaatctaaaagtaataatgat

SEQ ID NO: 1362763 - DNA, 22 bp, Artificial Sequence
  chemically synthesized
cttttggtggacatcattatta

SEQ ID NO: 1362764 - DNA, 22 bp, Artificial Sequence
  chemically synthesized
caatctaaaagtaataatgatg

SEQ ID NO: 1362765 - DNA, 22 bp, Artificial Sequence
  chemically synthesized
aatctaaaagtaataatgatgt

SEQ ID NO: 1362766 - DNA, 22 bp, Artificial Sequence
  chemically synthesized
aaagtaataatgatgtccacca

SEQ ID NO: 1362767 - DNA, 22 bp, Artificial Sequence
  chemically synthesized
ataaatttcttttggtggacat

SEQ ID NO: 1362768 - DNA, 22 bp, Artificial Sequence
  chemically synthesized
cataaatttcttttggtggaca

SEQ ID NO: 1362769 - DNA, 22 bp, Artificial Sequence
  chemically synthesized
cttcataaatttcttttggtgg

SEQ ID NO: 1362770 - DNA, 22 bp, Artificial Sequence
  chemically synthesized
gcttcataaatttcttttggtg

SEQ ID NO: 1362771 - DNA, 22 bp, Artificial Sequence
  chemically synthesized
gcttgcttcataaatttctttt

SEQ ID NO: 1362772 - DNA, 22 bp, Artificial Sequence
  chemically synthesized
ttggcttgcttcataaatttct

SEQ ID NO: 1362773 - DNA, 22 bp, Artificial Sequence
  chemically synthesized
cattgttggcttgcttcataaa

SEQ ID NO: 1362774 - DNA, 22 bp, Artificial Sequence
  chemically synthesized
acattgttggcttgcttcataa

SEQ ID NO: 1362775 - DNA, 22 bp, Artificial Sequence
  chemically synthesized
cttacattgttggcttgcttca

SEQ ID NO: 1362776 - DNA, 22 bp, Artificial Sequence
  chemically synthesized
acttacattgttggcttgcttc

SEQ ID NO: 1362777 - DNA, 22 bp, Artificial Sequence
  chemically synthesized
atgaagcaagccaacaatgtaa

SEQ ID NO: 1362778 - DNA, 22 bp, Artificial Sequence
  chemically synthesized
tgaagcaagccaacaatgtaag

SEQ ID NO: 1362779 - DNA, 22 bp, Artificial Sequence
  chemically synthesized
taatacaatatttacttacatt

SEQ ID NO: 1362780 - DNA, 22 bp, Artificial Sequence
  chemically synthesized
ataatacaatatttacttacat

SEQ ID NO: 1362781 - DNA, 22 bp, Artificial Sequence
  chemically synthesized
tataatacaatatttacttaca

SEQ ID NO: 1362782 - DNA, 22 bp, Artificial Sequence
  chemically synthesized
ccagactttataatacaatatt

SEQ ID NO: 1362783 - DNA, 22 bp, Artificial Sequence
  chemically synthesized
aaagctaccagactttataata

SEQ ID NO: 1362784 - DNA, 22 bp, Artificial Sequence
  chemically synthesized
agtcacattaaaagctaccaga

SEQ ID NO: 1362785 - DNA, 22 bp, Artificial Sequence
  chemically synthesized
tattataaagtctggtagcttt

SEQ ID NO: 1362786 - DNA, 22 bp, Artificial Sequence
  chemically synthesized
taaagtctggtagcttttaatg

SEQ ID NO: 1362787 - DNA, 22 bp, Artificial Sequence
  chemically synthesized
tccatgtattgagtcacattaa

SEQ ID NO: 1362788 - DNA, 22 bp, Artificial Sequence
  chemically synthesized
gtagcttttaatgtgactcaat

SEQ ID NO: 1362789 - DNA, 22 bp, Artificial Sequence
  chemically synthesized
acattgtccatgtattgagtca

SEQ ID NO: 1362790 - DNA, 22 bp, Artificial Sequence
  chemically synthesized
ttaatgtgactcaatacatgga

SEQ ID NO: 1362791 - DNA, 22 bp, Artificial Sequence
  chemically synthesized
taatgtgactcaatacatggac

SEQ ID NO: 1362792 - DNA, 22 bp, Artificial Sequence
  chemically synthesized
aatgtgactcaatacatggaca

SEQ ID NO: 1362793 - DNA, 22 bp, Artificial Sequence
  chemically synthesized
atgtgactcaatacatggacaa

SEQ ID NO: 1362794 - DNA, 22 bp, Artificial Sequence
  chemically synthesized
tggaaataagttaacattgtcc

SEQ ID NO: 1362795 - DNA, 22 bp, Artificial Sequence
  chemically synthesized
gtggaaataagttaacattgtc

SEQ ID NO: 1362796 - DNA, 22 bp, Artificial Sequence
  chemically synthesized
tgtggaaataagttaacattgt

SEQ ID NO: 1362797 - DNA, 22 bp, Artificial Sequence
  chemically synthesized
aatacatggacaatgttaactt

SEQ ID NO: 1362798 - DNA, 22 bp, Artificial Sequence
  chemically synthesized
ggaaaactttgtggaaataagt

SEQ ID NO: 1362799 - DNA, 22 bp, Artificial Sequence
  chemically synthesized
ccactgggaaaactttgtggaa

SEQ ID NO: 1362800 - DNA, 22 bp, Artificial Sequence
  chemically synthesized
gccactgggaaaactttgtgga

SEQ ID NO: 1362801 - DNA, 22 bp, Artificial Sequence
  chemically synthesized
tgccactgggaaaactttgtgg

SEQ ID NO: 1362802 - DNA, 22 bp, Artificial Sequence
  chemically synthesized
acttatttccacaaagttttcc

SEQ ID NO: 1362803 - DNA, 22 bp, Artificial Sequence
  chemically synthesized
atttccacaaagttttcccagt

SEQ ID NO: 1362804 - DNA, 22 bp, Artificial Sequence
  chemically synthesized
tttccacaaagttttcccagtg

SEQ ID NO: 1362805 - DNA, 22 bp, Artificial Sequence
  chemically synthesized
ccacaaagttttcccagtggca

SEQ ID NO: 1362806 - DNA, 22 bp, Artificial Sequence
  chemically synthesized
cacaaagttttcccagtggcaa

SEQ ID NO: 1362807 - DNA, 22 bp, Artificial Sequence
  chemically synthesized
aaaaaaaaggcagaagttttgc

SEQ ID NO: 1362808 - DNA, 22 bp, Artificial Sequence
  chemically synthesized
ctaaaaaaaaaggcagaagttt

SEQ ID NO: 1362809 - DNA, 22 bp, Artificial Sequence
  chemically synthesized
tcccagtggcaaaacttctgcc

SEQ ID NO: 1362810 - DNA, 22 bp, Artificial Sequence
  chemically synthesized
cccagtggcaaaacttctgcct

SEQ ID NO: 1362811 - DNA, 22 bp, Artificial Sequence
  chemically synthesized
ccagtggcaaaacttctgcctt

SEQ ID NO: 1362812 - DNA, 22 bp, Artificial Sequence
  chemically synthesized
cacaactactaaaaaaaaaggc

SEQ ID NO: 1362813 - DNA, 22 bp, Artificial Sequence
  chemically synthesized
ctgcctttttttttagtagttg

SEQ ID NO: 1362814 - DNA, 22 bp, Artificial Sequence
  chemically synthesized
tgcctttttttttagtagttgt

SEQ ID NO: 1362815 - DNA, 22 bp, Artificial Sequence
  chemically synthesized
cctttttttttagtagttgtgg

SEQ ID NO: 1362816 - DNA, 22 bp, Artificial Sequence
  chemically synthesized
caaataagtaatgctccacaac

SEQ ID NO: 1362817 - DNA, 22 bp, Artificial Sequence
  chemically synthesized
tttttttagtagttgtggagca

SEQ ID NO: 1362818 - DNA, 22 bp, Artificial Sequence
  chemically synthesized
ttttttagtagttgtggagcat

SEQ ID NO: 1362819 - DNA, 22 bp, Artificial Sequence
  chemically synthesized
tccaaataagtaatgctccaca

SEQ ID NO: 1362820 - DNA, 22 bp, Artificial Sequence
  chemically synthesized
tttttagtagttgtggagcatt

SEQ ID NO: 1362821 - DNA, 22 bp, Artificial Sequence
  chemically synthesized
ttttagtagttgtggagcatta

SEQ ID NO: 1362822 - DNA, 22 bp, Artificial Sequence
  chemically synthesized
tttagtagttgtggagcattac

SEQ ID NO: 1362823 - DNA, 22 bp, Artificial Sequence
  chemically synthesized
ttagtagttgtggagcattact

SEQ ID NO: 1362824 - DNA, 22 bp, Artificial Sequence
  chemically synthesized
tagtagttgtggagcattactt

SEQ ID NO: 1362825 - DNA, 22 bp, Artificial Sequence
  chemically synthesized
agtagttgtggagcattactta

SEQ ID NO: 1362826 - DNA, 22 bp, Artificial Sequence
  chemically synthesized
gtagttgtggagcattacttat

SEQ ID NO: 1362827 - DNA, 22 bp, Artificial Sequence
  chemically synthesized
tggagcattacttatttggaga

SEQ ID NO: 1362828 - DNA, 22 bp, Artificial Sequence
  chemically synthesized
agaatgaaaaaataaatctctc

SEQ ID NO: 1362829 - DNA, 22 bp, Artificial Sequence
  chemically synthesized
cttatttggagagatttatttt

SEQ ID NO: 1362830 - DNA, 22 bp, Artificial Sequence
  chemically synthesized
taattaagaatgaaaaaataaa

SEQ ID NO: 1362831 - DNA, 22 bp, Artificial Sequence
  chemically synthesized
atttggagagatttattttttc

SEQ ID NO: 1362832 - DNA, 22 bp, Artificial Sequence
  chemically synthesized
tttggagagatttattttttca

SEQ ID NO: 1362833 - DNA, 22 bp, Artificial Sequence
  chemically synthesized
ggagagatttattttttcattc

SEQ ID NO: 1362834 - DNA, 22 bp, Artificial Sequence
  chemically synthesized
gagagatttattttttcattct

SEQ ID NO: 1362835 - DNA, 22 bp, Artificial Sequence
  chemically synthesized
attttttcattcttaattatag

SEQ ID NO: 1362836 - DNA, 22 bp, Artificial Sequence
  chemically synthesized
ttttttcattcttaattatagg

SEQ ID NO: 1362837 - DNA, 22 bp, Artificial Sequence
  chemically synthesized
tttcattcttaattataggcat

SEQ ID NO: 1362838 - DNA, 22 bp, Artificial Sequence
  chemically synthesized
ttcattcttaattataggcatt

SEQ ID NO: 1362839 - DNA, 22 bp, Artificial Sequence
  chemically synthesized
tcattcttaattataggcattg

SEQ ID NO: 1362840 - DNA, 22 bp, Artificial Sequence
  chemically synthesized
cattcttaattataggcattgc

SEQ ID NO: 1362841 - DNA, 22 bp, Artificial Sequence
  chemically synthesized
attcttaattataggcattgcc

SEQ ID NO: 1362842 - DNA, 22 bp, Artificial Sequence
  chemically synthesized
aaatagatatgagggcaatgcc

SEQ ID NO: 1362843 - DNA, 22 bp, Artificial Sequence
  chemically synthesized
taaaatagatatgagggcaatg

SEQ ID NO: 1362844 - DNA, 22 bp, Artificial Sequence
  chemically synthesized
ttaattataggcattgccctca

SEQ ID NO: 1362845 - DNA, 22 bp, Artificial Sequence
  chemically synthesized
aattataggcattgccctcata

SEQ ID NO: 1362846 - DNA, 22 bp, Artificial Sequence
  chemically synthesized
ttctaaaatagatatgagggca

SEQ ID NO: 1362847 - DNA, 22 bp, Artificial Sequence
  chemically synthesized
attataggcattgccctcatat

SEQ ID NO: 1362848 - DNA, 22 bp, Artificial Sequence
  chemically synthesized
taggcattgccctcatatctat

SEQ ID NO: 1362849 - DNA, 22 bp, Artificial Sequence
  chemically synthesized
tggagtgtagttattctaaaat

SEQ ID NO: 1362850 - DNA, 22 bp, Artificial Sequence
  chemically synthesized
ccctcatatctattttagaata

SEQ ID NO: 1362851 - DNA, 22 bp, Artificial Sequence
  chemically synthesized
gtggagtgtagttattctaaaa

SEQ ID NO: 1362852 - DNA, 22 bp, Artificial Sequence
  chemically synthesized
acttgtggagtgtagttattct

SEQ ID NO: 1362853 - DNA, 22 bp, Artificial Sequence
  chemically synthesized
atatctattttagaataactac

SEQ ID NO: 1362854 - DNA, 22 bp, Artificial Sequence
  chemically synthesized
gacttgtggagtgtagttattc

SEQ ID NO: 1362855 - DNA, 22 bp, Artificial Sequence
  chemically synthesized
tgacttgtggagtgtagttatt

SEQ ID NO: 1362856 - DNA, 22 bp, Artificial Sequence
  chemically synthesized
ttttagaataactacactccac

SEQ ID NO: 1362857 - DNA, 22 bp, Artificial Sequence
  chemically synthesized
tagaataactacactccacaag

SEQ ID NO: 1362858 - DNA, 22 bp, Artificial Sequence
  chemically synthesized
agaataactacactccacaagt

SEQ ID NO: 1362859 - DNA, 22 bp, Artificial Sequence
  chemically synthesized
gaataactacactccacaagtc

SEQ ID NO: 1362860 - DNA, 22 bp, Artificial Sequence
  chemically synthesized
cccacccatctttgacttgtgg

SEQ ID NO: 1362861 - DNA, 22 bp, Artificial Sequence
  chemically synthesized
ccccacccatctttgacttgtg

SEQ ID NO: 1362862 - DNA, 22 bp, Artificial Sequence
  chemically synthesized
ttccccacccatctttgacttg

SEQ ID NO: 1362863 - DNA, 22 bp, Artificial Sequence
  chemically synthesized
tctcttccccacccatctttga

SEQ ID NO: 1362864 - DNA, 22 bp, Artificial Sequence
  chemically synthesized
cactccacaagtcaaagatggg

SEQ ID NO: 1362865 - DNA, 22 bp, Artificial Sequence
  chemically synthesized
atctcttccccacccatctttg

SEQ ID NO: 1362866 - DNA, 22 bp, Artificial Sequence
  chemically synthesized
cacaagtcaaagatgggtgggg

SEQ ID NO: 1362867 - DNA, 22 bp, Artificial Sequence
  chemically synthesized
tgtgtcccgaagagatgggagt

SEQ ID NO: 1362868 - DNA, 22 bp, Artificial Sequence
  chemically synthesized
ccatctcttcgggacacacagt

SEQ ID NO: 1362869 - DNA, 22 bp, Artificial Sequence
  chemically synthesized
ttcgggacacacagtccttatc

SEQ ID NO: 1362870 - DNA, 22 bp, Artificial Sequence
  chemically synthesized
cgggacacacagtccttatcat

SEQ ID NO: 1362871 - DNA, 22 bp, Artificial Sequence
  chemically synthesized
gggacacacagtccttatcata

SEQ ID NO: 1362872 - DNA, 22 bp, Artificial Sequence
  chemically synthesized
tggcacaacagtaaaaataata

SEQ ID NO: 1362873 - DNA, 22 bp, Artificial Sequence
  chemically synthesized
atcatatattatttttactgtt

SEQ ID NO: 1362874 - DNA, 22 bp, Artificial Sequence
  chemically synthesized
tcatatattatttttactgttg

SEQ ID NO: 1362875 - DNA, 22 bp, Artificial Sequence
  chemically synthesized
aaaatggactgtggcacaacag

SEQ ID NO: 1362876 - DNA, 22 bp, Artificial Sequence
  chemically synthesized
aaaaatggactgtggcacaaca

SEQ ID NO: 1362877 - DNA, 22 bp, Artificial Sequence
  chemically synthesized
tttttactgttgtgccacagtc

SEQ ID NO: 1362878 - DNA, 22 bp, Artificial Sequence
  chemically synthesized
ttactgttgtgccacagtccat

SEQ ID NO: 1362879 - DNA, 22 bp, Artificial Sequence
  chemically synthesized
tactgttgtgccacagtccatt

SEQ ID NO: 1362880 - DNA, 22 bp, Artificial Sequence
  chemically synthesized
actgttgtgccacagtccattt

SEQ ID NO: 1362881 - DNA, 22 bp, Artificial Sequence
  chemically synthesized
ctgttgtgccacagtccatttt

SEQ ID NO: 1362882 - DNA, 22 bp, Artificial Sequence
  chemically synthesized
atgaaggatttaaaaatggact

SEQ ID NO: 1362883 - DNA, 22 bp, Artificial Sequence
  chemically synthesized
ttgtgccacagtccatttttaa

SEQ ID NO: 1362884 - DNA, 22 bp, Artificial Sequence
  chemically synthesized
tgccacagtccatttttaaatc

SEQ ID NO: 1362885 - DNA, 22 bp, Artificial Sequence
  chemically synthesized
agaaagtcatgatgactaatga

SEQ ID NO: 1362886 - DNA, 22 bp, Artificial Sequence
  chemically synthesized
aagaaagtcatgatgactaatg

SEQ ID NO: 1362887 - DNA, 22 bp, Artificial Sequence
  chemically synthesized
taagaaagtcatgatgactaat

SEQ ID NO: 1362888 - DNA, 22 bp, Artificial Sequence
  chemically synthesized
ttaaatccttcattagtcatca

SEQ ID NO: 1362889 - DNA, 22 bp, Artificial Sequence
  chemically synthesized
ttaagaaagtcatgatgactaa

SEQ ID NO: 1362890 - DNA, 22 bp, Artificial Sequence
  chemically synthesized
taaatccttcattagtcatcat

SEQ ID NO: 1362891 - DNA, 22 bp, Artificial Sequence
  chemically synthesized
aaatccttcattagtcatcatg

SEQ ID NO: 1362892 - DNA, 22 bp, Artificial Sequence
  chemically synthesized
aatccttcattagtcatcatga

SEQ ID NO: 1362893 - DNA, 22 bp, Artificial Sequence
  chemically synthesized
tttttaagaaagtcatgatgac

SEQ ID NO: 1362894 - DNA, 22 bp, Artificial Sequence
  chemically synthesized
atttttaagaaagtcatgatga

SEQ ID NO: 1362895 - DNA, 22 bp, Artificial Sequence
  chemically synthesized
gtttatttttaagaaagtcatg

SEQ ID NO: 1362896 - DNA, 22 bp, Artificial Sequence
  chemically synthesized
cgtttatttttaagaaagtcat

SEQ ID NO: 1362897 - DNA, 22 bp, Artificial Sequence
  chemically synthesized
cattagtcatcatgactttctt

SEQ ID NO: 1362898 - DNA, 22 bp, Artificial Sequence
  chemically synthesized
attagtcatcatgactttctta

SEQ ID NO: 1362899 - DNA, 22 bp, Artificial Sequence
  chemically synthesized
tttcgtttatttttaagaaagt

SEQ ID NO: 1362900 - DNA, 22 bp, Artificial Sequence
  chemically synthesized
gtcatcatgactttcttaaaaa

SEQ ID NO: 1362901 - DNA, 22 bp, Artificial Sequence
  chemically synthesized
tcttaaaaataaacgaaatagt

SEQ ID NO: 1362902 - DNA, 22 bp, Artificial Sequence
  chemically synthesized
cttaaaaataaacgaaatagtt

SEQ ID NO: 1362903 - DNA, 22 bp, Artificial Sequence
  chemically synthesized
atatagaaatacaactatttcg

SEQ ID NO: 1362904 - DNA, 22 bp, Artificial Sequence
  chemically synthesized
ttaaaaataaacgaaatagttg

SEQ ID NO: 1362905 - DNA, 22 bp, Artificial Sequence
  chemically synthesized
catatagaaatacaactatttc

SEQ ID NO: 1362906 - DNA, 22 bp, Artificial Sequence
  chemically synthesized
tcatatagaaatacaactattt

SEQ ID NO: 1362907 - DNA, 22 bp, Artificial Sequence
  chemically synthesized
aaaaataaacgaaatagttgta

SEQ ID NO: 1362908 - DNA, 22 bp, Artificial Sequence
  chemically synthesized
aaaataaacgaaatagttgtat

SEQ ID NO: 1362909 - DNA, 22 bp, Artificial Sequence
  chemically synthesized
tctttcatatagaaatacaact

SEQ ID NO: 1362910 - DNA, 22 bp, Artificial Sequence
  chemically synthesized
gtctttcatatagaaatacaac

SEQ ID NO: 1362911 - DNA, 22 bp, Artificial Sequence
  chemically synthesized
gtttgtctttcatatagaaata

SEQ ID NO: 1362912 - DNA, 22 bp, Artificial Sequence
  chemically synthesized
agtttgtctttcatatagaaat

SEQ ID NO: 1362913 - DNA, 22 bp, Artificial Sequence
  chemically synthesized
tagtttgtctttcatatagaaa

SEQ ID NO: 1362914 - DNA, 22 bp, Artificial Sequence
  chemically synthesized
ttagtttgtctttcatatagaa

SEQ ID NO: 1362915 - DNA, 22 bp, Artificial Sequence
  chemically synthesized
tttagtttgtctttcatataga

SEQ ID NO: 1362916 - DNA, 22 bp, Artificial Sequence
  chemically synthesized
aattttttagtttgtctttcat

SEQ ID NO: 1362917 - DNA, 22 bp, Artificial Sequence
  chemically synthesized
tatttctatatgaaagacaaac

SEQ ID NO: 1362918 - DNA, 22 bp, Artificial Sequence
  chemically synthesized
agttcaattttttagtttgtct

SEQ ID NO: 1362919 - DNA, 22 bp, Artificial Sequence
  chemically synthesized
cagttcaattttttagtttgtc

SEQ ID NO: 1362920 - DNA, 22 bp, Artificial Sequence
  chemically synthesized
tcagttcaattttttagtttgt

SEQ ID NO: 1362921 - DNA, 22 bp, Artificial Sequence
  chemically synthesized
ctatatgaaagacaaactaaaa

SEQ ID NO: 1362922 - DNA, 22 bp, Artificial Sequence
  chemically synthesized
ttcagttcaattttttagtttg

SEQ ID NO: 1362923 - DNA, 22 bp, Artificial Sequence
  chemically synthesized
tatatgaaagacaaactaaaaa

SEQ ID NO: 1362924 - DNA, 22 bp, Artificial Sequence
  chemically synthesized
tatgaaagacaaactaaaaaat

SEQ ID NO: 1362925 - DNA, 22 bp, Artificial Sequence
  chemically synthesized
tgagccagcttttcagttcaat

SEQ ID NO: 1362926 - DNA, 22 bp, Artificial Sequence
  chemically synthesized
ttatgagccagcttttcagttc

SEQ ID NO: 1362927 - DNA, 22 bp, Artificial Sequence
  chemically synthesized
aaaaattgaactgaaaagctgg

SEQ ID NO: 1362928 - DNA, 22 bp, Artificial Sequence
  chemically synthesized
atgtctattatgagccagcttt

SEQ ID NO: 1362929 - DNA, 22 bp, Artificial Sequence
  chemically synthesized
catgtctattatgagccagctt

SEQ ID NO: 1362930 - DNA, 22 bp, Artificial Sequence
  chemically synthesized
tttcatgtctattatgagccag

SEQ ID NO: 1362931 - DNA, 22 bp, Artificial Sequence
  chemically synthesized
aactgaaaagctggctcataat

SEQ ID NO: 1362932 - DNA, 22 bp, Artificial Sequence
  chemically synthesized
ttgtttcatgtctattatgagc

SEQ ID NO: 1362933 - DNA, 22 bp, Artificial Sequence
  chemically synthesized
gttgtttcatgtctattatgag

SEQ ID NO: 1362934 - DNA, 22 bp, Artificial Sequence
  chemically synthesized
aaaagctggctcataatagaca

SEQ ID NO: 1362935 - DNA, 22 bp, Artificial Sequence
  chemically synthesized
gctcataatagacatgaaacaa

SEQ ID NO: 1362936 - DNA, 22 bp, Artificial Sequence
  chemically synthesized
ataatagacatgaaacaacaag

SEQ ID NO: 1362937 - DNA, 22 bp, Artificial Sequence
  chemically synthesized
gtagtaaagtcaccttgttgtt

SEQ ID NO: 1362938 - DNA, 22 bp, Artificial Sequence
  chemically synthesized
agtagtaaagtcaccttgttgt

SEQ ID NO: 1362939 - DNA, 22 bp, Artificial Sequence
  chemically synthesized
tatttagtagtaaagtcacctt

SEQ ID NO: 1362940 - DNA, 22 bp, Artificial Sequence
  chemically synthesized
attatatttagtagtaaagtca

SEQ ID NO: 1362941 - DNA, 22 bp, Artificial Sequence
  chemically synthesized
ctaattatatttagtagtaaag

SEQ ID NO: 1362942 - DNA, 22 bp, Artificial Sequence
  chemically synthesized
aggaactcctaattatatttag

SEQ ID NO: 1362943 - DNA, 22 bp, Artificial Sequence
  chemically synthesized
gaggaactcctaattatattta

SEQ ID NO: 1362944 - DNA, 22 bp, Artificial Sequence
  chemically synthesized
tactactaaatataattaggag

SEQ ID NO: 1362945 - DNA, 22 bp, Artificial Sequence
  chemically synthesized
actactaaatataattaggagt

SEQ ID NO: 1362946 - DNA, 22 bp, Artificial Sequence
  chemically synthesized
ctactaaatataattaggagtt

SEQ ID NO: 1362947 - DNA, 22 bp, Artificial Sequence
  chemically synthesized
ctaaatataattaggagttcct

SEQ ID NO: 1362948 - DNA, 22 bp, Artificial Sequence
  chemically synthesized
aatataattaggagttcctcaa

SEQ ID NO: 1362949 - DNA, 22 bp, Artificial Sequence
  chemically synthesized
ggtaaacgacatacaaacttga

SEQ ID NO: 1362950 - DNA, 22 bp, Artificial Sequence
  chemically synthesized
gggtaaacgacatacaaacttg

SEQ ID NO: 1362951 - DNA, 22 bp, Artificial Sequence
  chemically synthesized
ttgggtaaacgacatacaaact

SEQ ID NO: 1362952 - DNA, 22 bp, Artificial Sequence
  chemically synthesized
ggagttcctcaagtttgtatgt

SEQ ID NO: 1362953 - DNA, 22 bp, Artificial Sequence
  chemically synthesized
cttgggtaaacgacatacaaac

SEQ ID NO: 1362954 - DNA, 22 bp, Artificial Sequence
  chemically synthesized
ctcaagtttgtatgtcgtttac

SEQ ID NO: 1362955 - DNA, 22 bp, Artificial Sequence
  chemically synthesized
aagtttgtatgtcgtttaccca

SEQ ID NO: 1362956 - DNA, 22 bp, Artificial Sequence
  chemically synthesized
gtatgtcgtttacccaagaaat

SEQ ID NO: 1362957 - DNA, 22 bp, Artificial Sequence
  chemically synthesized
tatgtcgtttacccaagaaatc

SEQ ID NO: 1362958 - DNA, 22 bp, Artificial Sequence
  chemically synthesized
tcaaatgatcagatgatttctt

SEQ ID NO: 1362959 - DNA, 22 bp, Artificial Sequence
  chemically synthesized
tgctatcaaatgatcagatgat

SEQ ID NO: 1362960 - DNA, 22 bp, Artificial Sequence
  chemically synthesized
acccaagaaatcatctgatcat

SEQ ID NO: 1362961 - DNA, 22 bp, Artificial Sequence
  chemically synthesized
cccaagaaatcatctgatcatt

SEQ ID NO: 1362962 - DNA, 22 bp, Artificial Sequence
  chemically synthesized
aaataatgatgtgatctatgct

SEQ ID NO: 1362963 - DNA, 22 bp, Artificial Sequence
  chemically synthesized
caaataatgatgtgatctatgc

SEQ ID NO: 1362964 - DNA, 22 bp, Artificial Sequence
  chemically synthesized
atcatttgatagcatagatcac

SEQ ID NO: 1362965 - DNA, 22 bp, Artificial Sequence
  chemically synthesized
tttcaaataatgatgtgatcta

SEQ ID NO: 1362966 - DNA, 22 bp, Artificial Sequence
  chemically synthesized
gatagcatagatcacatcatta

SEQ ID NO: 1362967 - DNA, 22 bp, Artificial Sequence
  chemically synthesized
atagcatagatcacatcattat

SEQ ID NO: 1362968 - DNA, 22 bp, Artificial Sequence
  chemically synthesized
tagcatatcatgataattattt

SEQ ID NO: 1362969 - DNA, 22 bp, Artificial Sequence
  chemically synthesized
tgtagcatatcatgataattat

SEQ ID NO: 1362970 - DNA, 22 bp, Artificial Sequence
  chemically synthesized
ctgtagcatatcatgataatta

SEQ ID NO: 1362971 - DNA, 22 bp, Artificial Sequence
  chemically synthesized
tctgtagcatatcatgataatt

SEQ ID NO: 1362972 - DNA, 22 bp, Artificial Sequence
  chemically synthesized
ttctgtagcatatcatgataat

SEQ ID NO: 1362973 - DNA, 22 bp, Artificial Sequence
  chemically synthesized
ttttctgtagcatatcatgata

SEQ ID NO: 1362974 - DNA, 22 bp, Artificial Sequence
  chemically synthesized
tttgaaataattatcatgatat

SEQ ID NO: 1362975 - DNA, 22 bp, Artificial Sequence
  chemically synthesized
gaaataattatcatgatatgct

SEQ ID NO: 1362976 - DNA, 22 bp, Artificial Sequence
  chemically synthesized
aaataattatcatgatatgcta

SEQ ID NO: 1362977 - DNA, 22 bp, Artificial Sequence
  chemically synthesized
aaatgctcttttctgtagcata

SEQ ID NO: 1362978 - DNA, 22 bp, Artificial Sequence
  chemically synthesized
caaatgctcttttctgtagcat

SEQ ID NO: 1362979 - DNA, 22 bp, Artificial Sequence
  chemically synthesized
tttcaaatgctcttttctgtag

SEQ ID NO: 1362980 - DNA, 22 bp, Artificial Sequence
  chemically synthesized
tcatgatatgctacagaaaaga

SEQ ID NO: 1362981 - DNA, 22 bp, Artificial Sequence
  chemically synthesized
ctatttcaaatgctcttttctg

SEQ ID NO: 1362982 - DNA, 22 bp, Artificial Sequence
  chemically synthesized
actatttcaaatgctcttttct

SEQ ID NO: 1362983 - DNA, 22 bp, Artificial Sequence
  chemically synthesized
acatttactatttcaaatgctc

SEQ ID NO: 1362984 - DNA, 22 bp, Artificial Sequence
  chemically synthesized
ctcacatttactatttcaaatg

SEQ ID NO: 1362985 - DNA, 22 bp, Artificial Sequence
  chemically synthesized
actcacatttactatttcaaat

SEQ ID NO: 1362986 - DNA, 22 bp, Artificial Sequence
  chemically synthesized
cagaaaagagcatttgaaatag

SEQ ID NO: 1362987 - DNA, 22 bp, Artificial Sequence
  chemically synthesized
ttactcacatttactatttcaa

SEQ ID NO: 1362988 - DNA, 22 bp, Artificial Sequence
  chemically synthesized
cttactcacatttactatttca

SEQ ID NO: 1362989 - DNA, 22 bp, Artificial Sequence
  chemically synthesized
atgtttcttactcacatttact

SEQ ID NO: 1362990 - DNA, 22 bp, Artificial Sequence
  chemically synthesized
aatgtttcttactcacatttac

SEQ ID NO: 1362991 - DNA, 22 bp, Artificial Sequence
  chemically synthesized
taatgtttcttactcacattta

SEQ ID NO: 1362992 - DNA, 22 bp, Artificial Sequence
  chemically synthesized
attttaatgtttcttactcaca

SEQ ID NO: 1362993 - DNA, 22 bp, Artificial Sequence
  chemically synthesized
gaaatagtaaatgtgagtaaga

SEQ ID NO: 1362994 - DNA, 22 bp, Artificial Sequence
  chemically synthesized
aattttaatgtttcttactcac

SEQ ID NO: 1362995 - DNA, 22 bp, Artificial Sequence
  chemically synthesized
aaatagtaaatgtgagtaagaa

SEQ ID NO: 1362996 - DNA, 22 bp, Artificial Sequence
  chemically synthesized
ataaagatttaattttaatgtt

SEQ ID NO: 1362997 - DNA, 22 bp, Artificial Sequence
  chemically synthesized
aaattaaatctttatcaatact

SEQ ID NO: 1362998 - DNA, 22 bp, Artificial Sequence
  chemically synthesized
aaggatgtgaaaagtattgata

SEQ ID NO: 1362999 - DNA, 22 bp, Artificial Sequence
  chemically synthesized
aatctttatcaatacttttcac

SEQ ID NO: 1363000 - DNA, 22 bp, Artificial Sequence
  chemically synthesized
tatcaatacttttcacatcctt

SEQ ID NO: 1363001 - DNA, 22 bp, Artificial Sequence
  chemically synthesized
atcaatacttttcacatccttc

SEQ ID NO: 1363002 - DNA, 22 bp, Artificial Sequence
  chemically synthesized
ggacggataattgaaggatgtg

SEQ ID NO: 1363003 - DNA, 22 bp, Artificial Sequence
  chemically synthesized
tcaatacttttcacatccttca

SEQ ID NO: 1363004 - DNA, 22 bp, Artificial Sequence
  chemically synthesized
ttcacatccttcaattatccgt

SEQ ID NO: 1363005 - DNA, 22 bp, Artificial Sequence
  chemically synthesized
tcacatccttcaattatccgtc

SEQ ID NO: 1363006 - DNA, 22 bp, Artificial Sequence
  chemically synthesized
cacatccttcaattatccgtcc

SEQ ID NO: 1363007 - DNA, 22 bp, Artificial Sequence
  chemically synthesized
acatccttcaattatccgtccc

SEQ ID NO: 1363008 - DNA, 22 bp, Artificial Sequence
  chemically synthesized
caattatccgtcccaactcatt

SEQ ID NO: 1363009 - DNA, 22 bp, Artificial Sequence
  chemically synthesized
aattatccgtcccaactcattt

SEQ ID NO: 1363010 - DNA, 22 bp, Artificial Sequence
  chemically synthesized
tccgtcccaactcattttattc

SEQ ID NO: 1363011 - DNA, 22 bp, Artificial Sequence
  chemically synthesized
acacatcatggataaaataaag

SEQ ID NO: 1363012 - DNA, 22 bp, Artificial Sequence
  chemically synthesized
tgacacatcatggataaaataa

SEQ ID NO: 1363013 - DNA, 22 bp, Artificial Sequence
  chemically synthesized
attttattctttattttatcca

SEQ ID NO: 1363014 - DNA, 22 bp, Artificial Sequence
  chemically synthesized
tctgacacatcatggataaaat

SEQ ID NO: 1363015 - DNA, 22 bp, Artificial Sequence
  chemically synthesized
ctctgacacatcatggataaaa

SEQ ID NO: 1363016 - DNA, 22 bp, Artificial Sequence
  chemically synthesized
tattctttattttatccatgat

SEQ ID NO: 1363017 - DNA, 22 bp, Artificial Sequence
  chemically synthesized
attctttattttatccatgatg

SEQ ID NO: 1363018 - DNA, 22 bp, Artificial Sequence
  chemically synthesized
ttctttattttatccatgatgt

SEQ ID NO: 1363019 - DNA, 22 bp, Artificial Sequence
  chemically synthesized
tttattttatccatgatgtgtc

SEQ ID NO: 1363020 - DNA, 22 bp, Artificial Sequence
  chemically synthesized
tattttatccatgatgtgtcag

SEQ ID NO: 1363021 - DNA, 22 bp, Artificial Sequence
  chemically synthesized
gaaaaagtttctctgacacatc

SEQ ID NO: 1363022 - DNA, 22 bp, Artificial Sequence
  chemically synthesized
attttatccatgatgtgtcaga

SEQ ID NO: 1363023 - DNA, 22 bp, Artificial Sequence
  chemically synthesized
ttttatccatgatgtgtcagag

SEQ ID NO: 1363024 - DNA, 22 bp, Artificial Sequence
  chemically synthesized
tatccatgatgtgtcagagaaa

SEQ ID NO: 1363025 - DNA, 22 bp, Artificial Sequence
  chemically synthesized
atccatgatgtgtcagagaaac

SEQ ID NO: 1363026 - DNA, 22 bp, Artificial Sequence
  chemically synthesized
tccatgatgtgtcagagaaact

SEQ ID NO: 1363027 - DNA, 22 bp, Artificial Sequence
  chemically synthesized
aaagttagaaaaagtttctctg

SEQ ID NO: 1363028 - DNA, 22 bp, Artificial Sequence
  chemically synthesized
catggaggcctaaaagttagaa

SEQ ID NO: 1363029 - DNA, 22 bp, Artificial Sequence
  chemically synthesized
tttctaacttttaggcctccat

SEQ ID NO: 1363030 - DNA, 22 bp, Artificial Sequence
  chemically synthesized
tataggaactacatggaggcct

SEQ ID NO: 1363031 - DNA, 22 bp, Artificial Sequence
  chemically synthesized
ttctaacttttaggcctccatg

SEQ ID NO: 1363032 - DNA, 22 bp, Artificial Sequence
  chemically synthesized
tctaacttttaggcctccatgt

SEQ ID NO: 1363033 - DNA, 22 bp, Artificial Sequence
  chemically synthesized
ctaacttttaggcctccatgta

SEQ ID NO: 1363034 - DNA, 22 bp, Artificial Sequence
  chemically synthesized
ctgtataggaactacatggagg

SEQ ID NO: 1363035 - DNA, 22 bp, Artificial Sequence
  chemically synthesized
taacttttaggcctccatgtag

SEQ ID NO: 1363036 - DNA, 22 bp, Artificial Sequence
  chemically synthesized
acttttaggcctccatgtagtt

SEQ ID NO: 1363037 - DNA, 22 bp, Artificial Sequence
  chemically synthesized
actactgtataggaactacatg

SEQ ID NO: 1363038 - DNA, 22 bp, Artificial Sequence
  chemically synthesized
ttaggcctccatgtagttccta

SEQ ID NO: 1363039 - DNA, 22 bp, Artificial Sequence
  chemically synthesized
taggcctccatgtagttcctat

SEQ ID NO: 1363040 - DNA, 22 bp, Artificial Sequence
  chemically synthesized
aggcctccatgtagttcctata

SEQ ID NO: 1363041 - DNA, 22 bp, Artificial Sequence
  chemically synthesized
aactaactactgtataggaact

SEQ ID NO: 1363042 - DNA, 22 bp, Artificial Sequence
  chemically synthesized
ggcctccatgtagttcctatac

SEQ ID NO: 1363043 - DNA, 22 bp, Artificial Sequence
  chemically synthesized
aattgaactaactactgtatag

SEQ ID NO: 1363044 - DNA, 22 bp, Artificial Sequence
  chemically synthesized
catgtagttcctatacagtagt

SEQ ID NO: 1363045 - DNA, 22 bp, Artificial Sequence
  chemically synthesized
tcaattgaactaactactgtat

SEQ ID NO: 1363046 - DNA, 22 bp, Artificial Sequence
  chemically synthesized
ctatacagtagttagttcaatt

SEQ ID NO: 1363047 - DNA, 22 bp, Artificial Sequence
  chemically synthesized
acatatattctcaattgaacta

SEQ ID NO: 1363048 - DNA, 22 bp, Artificial Sequence
  chemically synthesized
tacagtagttagttcaattgag

SEQ ID NO: 1363049 - DNA, 22 bp, Artificial Sequence
  chemically synthesized
acctgacatatattctcaattg

SEQ ID NO: 1363050 - DNA, 22 bp, Artificial Sequence
  chemically synthesized
ctgacctgacatatattctcaa

SEQ ID NO: 1363051 - DNA, 22 bp, Artificial Sequence
  chemically synthesized
gttcaattgagaatatatgtca

SEQ ID NO: 1363052 - DNA, 22 bp, Artificial Sequence
  chemically synthesized
aattgagaatatatgtcaggtc

SEQ ID NO: 1363053 - DNA, 22 bp, Artificial Sequence
  chemically synthesized
cataaaggttactgacctgaca

SEQ ID NO: 1363054 - DNA, 22 bp, Artificial Sequence
  chemically synthesized
agaatatatgtcaggtcagtaa

SEQ ID NO: 1363055 - DNA, 22 bp, Artificial Sequence
  chemically synthesized
gtaacagttacataaaggttac

SEQ ID NO: 1363056 - DNA, 22 bp, Artificial Sequence
  chemically synthesized
agtaacagttacataaaggtta

SEQ ID NO: 1363057 - DNA, 22 bp, Artificial Sequence
  chemically synthesized
cgtatttagtaacagttacata

SEQ ID NO: 1363058 - DNA, 22 bp, Artificial Sequence
  chemically synthesized
ccgtatttagtaacagttacat

SEQ ID NO: 1363059 - DNA, 22 bp, Artificial Sequence
  chemically synthesized
atacttccgtatttagtaacag

SEQ ID NO: 1363060 - DNA, 22 bp, Artificial Sequence
  chemically synthesized
gttgatacttccgtatttagta

SEQ ID NO: 1363061 - DNA, 22 bp, Artificial Sequence
  chemically synthesized
tatgtaactgttactaaatacg

SEQ ID NO: 1363062 - DNA, 22 bp, Artificial Sequence
  chemically synthesized
atgtaactgttactaaatacgg

SEQ ID NO: 1363063 - DNA, 22 bp, Artificial Sequence
  chemically synthesized
tgtaactgttactaaatacgga

SEQ ID NO: 1363064 - DNA, 22 bp, Artificial Sequence
  chemically synthesized
attagttgatacttccgtattt

SEQ ID NO: 1363065 - DNA, 22 bp, Artificial Sequence
  chemically synthesized
gattagttgatacttccgtatt

SEQ ID NO: 1363066 - DNA, 22 bp, Artificial Sequence
  chemically synthesized
tgattagttgatacttccgtat

SEQ ID NO: 1363067 - DNA, 22 bp, Artificial Sequence
  chemically synthesized
ttttgattagttgatacttccg

SEQ ID NO: 1363068 - DNA, 22 bp, Artificial Sequence
  chemically synthesized
ttactaaatacggaagtatcaa

SEQ ID NO: 1363069 - DNA, 22 bp, Artificial Sequence
  chemically synthesized
ttattttgattagttgatactt

SEQ ID NO: 1363070 - DNA, 22 bp, Artificial Sequence
  chemically synthesized
ctaaatacggaagtatcaacta

SEQ ID NO: 1363071 - DNA, 22 bp, Artificial Sequence
  chemically synthesized
aatacggaagtatcaactaatc

SEQ ID NO: 1363072 - DNA, 22 bp, Artificial Sequence
  chemically synthesized
agttattattttgattagttga

SEQ ID NO: 1363073 - DNA, 22 bp, Artificial Sequence
  chemically synthesized
tatatctgagttattattttga

SEQ ID NO: 1363074 - DNA, 22 bp, Artificial Sequence
  chemically synthesized
gtatatctgagttattattttg

SEQ ID NO: 1363075 - DNA, 22 bp, Artificial Sequence
  chemically synthesized
atcaaaataataactcagatat

SEQ ID NO: 1363076 - DNA, 22 bp, Artificial Sequence
  chemically synthesized
tgagatagtttgtatatctgag

SEQ ID NO: 1363077 - DNA, 22 bp, Artificial Sequence
  chemically synthesized
ctgtgagatagtttgtatatct

SEQ ID NO: 1363078 - DNA, 22 bp, Artificial Sequence
  chemically synthesized
attgctgtgagatagtttgtat

SEQ ID NO: 1363079 - DNA, 22 bp, Artificial Sequence
  chemically synthesized
gattgctgtgagatagtttgta

SEQ ID NO: 1363080 - DNA, 22 bp, Artificial Sequence
  chemically synthesized
tgattgctgtgagatagtttgt

SEQ ID NO: 1363081 - DNA, 22 bp, Artificial Sequence
  chemically synthesized
ttttgattgctgtgagatagtt

SEQ ID NO: 1363082 - DNA, 22 bp, Artificial Sequence
  chemically synthesized
attttgattgctgtgagatagt

SEQ ID NO: 1363083 - DNA, 22 bp, Artificial Sequence
  chemically synthesized
agatatacaaactatctcacag

SEQ ID NO: 1363084 - DNA, 22 bp, Artificial Sequence
  chemically synthesized
taacagatttattttgattgct

SEQ ID NO: 1363085 - DNA, 22 bp, Artificial Sequence
  chemically synthesized
actataacagatttattttgat

SEQ ID NO: 1363086 - DNA, 22 bp, Artificial Sequence
  chemically synthesized
gactataacagatttattttga

SEQ ID NO: 1363087 - DNA, 22 bp, Artificial Sequence
  chemically synthesized
tctcacagcaatcaaaataaat

SEQ ID NO: 1363088 - DNA, 22 bp, Artificial Sequence
  chemically synthesized
acagcaatcaaaataaatctgt

SEQ ID NO: 1363089 - DNA, 22 bp, Artificial Sequence
  chemically synthesized
ttatagtcaaatgacattctgc

SEQ ID NO: 1363090 - DNA, 22 bp, Artificial Sequence
  chemically synthesized
cagtaatagaatatgcagaatg

SEQ ID NO: 1363091 - DNA, 22 bp, Artificial Sequence
  chemically synthesized
tagtcaaatgacattctgcata

SEQ ID NO: 1363092 - DNA, 22 bp, Artificial Sequence
  chemically synthesized
acaaaccactgcagtaatagaa

SEQ ID NO: 1363093 - DNA, 22 bp, Artificial Sequence
  chemically synthesized
attaacaaaccactgcagtaat

SEQ ID NO: 1363094 - DNA, 22 bp, Artificial Sequence
  chemically synthesized
gattaacaaaccactgcagtaa

SEQ ID NO: 1363095 - DNA, 22 bp, Artificial Sequence
  chemically synthesized
tgcatattctattactgcagtg

SEQ ID NO: 1363096 - DNA, 22 bp, Artificial Sequence
  chemically synthesized
ttgattaacaaaccactgcagt

SEQ ID NO: 1363097 - DNA, 22 bp, Artificial Sequence
  chemically synthesized
catattctattactgcagtggt

SEQ ID NO: 1363098 - DNA, 22 bp, Artificial Sequence
  chemically synthesized
cttgattaacaaaccactgcag

SEQ ID NO: 1363099 - DNA, 22 bp, Artificial Sequence
  chemically synthesized
tattactgcagtggtttgttaa

SEQ ID NO: 1363100 - DNA, 22 bp, Artificial Sequence
  chemically synthesized
ttactgcagtggtttgttaatc

SEQ ID NO: 1363101 - DNA, 22 bp, Artificial Sequence
  chemically synthesized
ctgcagtggtttgttaatcaag

SEQ ID NO: 1363102 - DNA, 22 bp, Artificial Sequence
  chemically synthesized
aacacatgatttcttgattaac

SEQ ID NO: 1363103 - DNA, 22 bp, Artificial Sequence
  chemically synthesized
cagtggtttgttaatcaagaaa

SEQ ID NO: 1363104 - DNA, 22 bp, Artificial Sequence
  chemically synthesized
cgatagaactaaacacatgatt

SEQ ID NO: 1363105 - DNA, 22 bp, Artificial Sequence
  chemically synthesized
gttaatcaagaaatcatgtgtt

SEQ ID NO: 1363106 - DNA, 22 bp, Artificial Sequence
  chemically synthesized
gcgatagaactaaacacatgat

SEQ ID NO: 1363107 - DNA, 22 bp, Artificial Sequence
  chemically synthesized
ttaatcaagaaatcatgtgttt

SEQ ID NO: 1363108 - DNA, 22 bp, Artificial Sequence
  chemically synthesized
tgcgatagaactaaacacatga

SEQ ID NO: 1363109 - DNA, 22 bp, Artificial Sequence
  chemically synthesized
tttgcgatagaactaaacacat

SEQ ID NO: 1363110 - DNA, 22 bp, Artificial Sequence
  chemically synthesized
atcaagaaatcatgtgtttagt

SEQ ID NO: 1363111 - DNA, 22 bp, Artificial Sequence
  chemically synthesized
ctttgcgatagaactaaacaca

SEQ ID NO: 1363112 - DNA, 22 bp, Artificial Sequence
  chemically synthesized
tctttgcgatagaactaaacac

SEQ ID NO: 1363113 - DNA, 22 bp, Artificial Sequence
  chemically synthesized
ttctttgcgatagaactaaaca

SEQ ID NO: 1363114 - DNA, 22 bp, Artificial Sequence
  chemically synthesized
agttctatcgcaaagaaaaact

SEQ ID NO: 1363115 - DNA, 22 bp, Artificial Sequence
  chemically synthesized
gttctatcgcaaagaaaaactt

SEQ ID NO: 1363116 - DNA, 22 bp, Artificial Sequence
  chemically synthesized
tatcgcaaagaaaaacttttac

SEQ ID NO: 1363117 - DNA, 22 bp, Artificial Sequence
  chemically synthesized
tcgcaaagaaaaacttttacac

SEQ ID NO: 1363118 - DNA, 22 bp, Artificial Sequence
  chemically synthesized
aacagaaatggagtgtaaaagt

SEQ ID NO: 1363119 - DNA, 22 bp, Artificial Sequence
  chemically synthesized
caacagaaatggagtgtaaaag

SEQ ID NO: 1363120 - DNA, 22 bp, Artificial Sequence
  chemically synthesized
tcaacagaaatggagtgtaaaa

SEQ ID NO: 1363121 - DNA, 22 bp, Artificial Sequence
  chemically synthesized
ttcaacagaaatggagtgtaaa

SEQ ID NO: 1363122 - DNA, 22 bp, Artificial Sequence
  chemically synthesized
ggaaaacttttcaacagaaatg

SEQ ID NO: 1363123 - DNA, 22 bp, Artificial Sequence
  chemically synthesized
ttacactccatttctgttgaaa

SEQ ID NO: 1363124 - DNA, 22 bp, Artificial Sequence
  chemically synthesized
attgggaaaacttttcaacaga

SEQ ID NO: 1363125 - DNA, 22 bp, Artificial Sequence
  chemically synthesized
tacactccatttctgttgaaaa

SEQ ID NO: 1363126 - DNA, 22 bp, Artificial Sequence
  chemically synthesized
cattgggaaaacttttcaacag

SEQ ID NO: 1363127 - DNA, 22 bp, Artificial Sequence
  chemically synthesized
acactccatttctgttgaaaag

SEQ ID NO: 1363128 - DNA, 22 bp, Artificial Sequence
  chemically synthesized
tcattgggaaaacttttcaaca

SEQ ID NO: 1363129 - DNA, 22 bp, Artificial Sequence
  chemically synthesized
cactccatttctgttgaaaagt

SEQ ID NO: 1363130 - DNA, 22 bp, Artificial Sequence
  chemically synthesized
ttcattgggaaaacttttcaac

SEQ ID NO: 1363131 - DNA, 22 bp, Artificial Sequence
  chemically synthesized
catttctgttgaaaagttttcc

SEQ ID NO: 1363132 - DNA, 22 bp, Artificial Sequence
  chemically synthesized
ctgttgaaaagttttcccaatg

SEQ ID NO: 1363133 - DNA, 22 bp, Artificial Sequence
  chemically synthesized
tgttgaaaagttttcccaatga

SEQ ID NO: 1363134 - DNA, 22 bp, Artificial Sequence
  chemically synthesized
ttgaaaagttttcccaatgaaa

SEQ ID NO: 1363135 - DNA, 22 bp, Artificial Sequence
  chemically synthesized
aggaatatatatttttcattgg

SEQ ID NO: 1363136 - DNA, 22 bp, Artificial Sequence
  chemically synthesized
aaaagttttcccaatgaaaaat

SEQ ID NO: 1363137 - DNA, 22 bp, Artificial Sequence
  chemically synthesized
ttcaggaatatatatttttcat

SEQ ID NO: 1363138 - DNA, 22 bp, Artificial Sequence
  chemically synthesized
attcaggaatatatatttttca

SEQ ID NO: 1363139 - DNA, 22 bp, Artificial Sequence
  chemically synthesized
tcccaatgaaaaatatatattc

SEQ ID NO: 1363140 - DNA, 22 bp, Artificial Sequence
  chemically synthesized
cccaatgaaaaatatatattcc

SEQ ID NO: 1363141 - DNA, 22 bp, Artificial Sequence
  chemically synthesized
ccaatgaaaaatatatattcct

SEQ ID NO: 1363142 - DNA, 22 bp, Artificial Sequence
  chemically synthesized
catatatatatgtatttattca

SEQ ID NO: 1363143 - DNA, 22 bp, Artificial Sequence
  chemically synthesized
tatatactgcatatatatatgt

SEQ ID NO: 1363144 - DNA, 22 bp, Artificial Sequence
  chemically synthesized
ctgaataaatacatatatatat

SEQ ID NO: 1363145 - DNA, 22 bp, Artificial Sequence
  chemically synthesized
aataaatacatatatatatgca

SEQ ID NO: 1363146 - DNA, 22 bp, Artificial Sequence
  chemically synthesized
caaagaagcataaatgttatat

SEQ ID NO: 1363147 - DNA, 22 bp, Artificial Sequence
  chemically synthesized
gcaaagaagcataaatgttata

SEQ ID NO: 1363148 - DNA, 22 bp, Artificial Sequence
  chemically synthesized
tcacagtagtttgcaaagaagc

SEQ ID NO: 1363149 - DNA, 22 bp, Artificial Sequence
  chemically synthesized
aattatcacagtagtttgcaaa

SEQ ID NO: 1363150 - DNA, 22 bp, Artificial Sequence
  chemically synthesized
aaattatcacagtagtttgcaa

SEQ ID NO: 1363151 - DNA, 22 bp, Artificial Sequence
  chemically synthesized
taaattatcacagtagtttgca

SEQ ID NO: 1363152 - DNA, 22 bp, Artificial Sequence
  chemically synthesized
atgcttctttgcaaactactgt

SEQ ID NO: 1363153 - DNA, 22 bp, Artificial Sequence
  chemically synthesized
tgcttctttgcaaactactgtg

SEQ ID NO: 1363154 - DNA, 22 bp, Artificial Sequence
  chemically synthesized
attttaaattatcacagtagtt

SEQ ID NO: 1363155 - DNA, 22 bp, Artificial Sequence
  chemically synthesized
ctttgcaaactactgtgataat

SEQ ID NO: 1363156 - DNA, 22 bp, Artificial Sequence
  chemically synthesized
tttgcaaactactgtgataatt

SEQ ID NO: 1363157 - DNA, 22 bp, Artificial Sequence
  chemically synthesized
tgcaaactactgtgataattta

SEQ ID NO: 1363158 - DNA, 22 bp, Artificial Sequence
  chemically synthesized
gcaaactactgtgataatttaa

SEQ ID NO: 1363159 - DNA, 22 bp, Artificial Sequence
  chemically synthesized
ggtagattgattttaaattatc

SEQ ID NO: 1363160 - DNA, 22 bp, Artificial Sequence
  chemically synthesized
caaactactgtgataatttaaa

SEQ ID NO: 1363161 - DNA, 22 bp, Artificial Sequence
  chemically synthesized
attaggtagattgattttaaat

SEQ ID NO: 1363162 - DNA, 22 bp, Artificial Sequence
  chemically synthesized
ctgtgataatttaaaatcaatc

SEQ ID NO: 1363163 - DNA, 22 bp, Artificial Sequence
  chemically synthesized
actaattaggtagattgatttt

SEQ ID NO: 1363164 - DNA, 22 bp, Artificial Sequence
  chemically synthesized
tgataatttaaaatcaatctac

SEQ ID NO: 1363165 - DNA, 22 bp, Artificial Sequence
  chemically synthesized
tgacaagctcactaattaggta

SEQ ID NO: 1363166 - DNA, 22 bp, Artificial Sequence
  chemically synthesized
gtgacaagctcactaattaggt

SEQ ID NO: 1363167 - DNA, 22 bp, Artificial Sequence
  chemically synthesized
aaaatcaatctacctaattagt

SEQ ID NO: 1363168 - DNA, 22 bp, Artificial Sequence
  chemically synthesized
aaatcaatctacctaattagtg

SEQ ID NO: 1363169 - DNA, 22 bp, Artificial Sequence
  chemically synthesized
gtttgtgacaagctcactaatt

SEQ ID NO: 1363170 - DNA, 22 bp, Artificial Sequence
  chemically synthesized
agtttgtgacaagctcactaat

SEQ ID NO: 1363171 - DNA, 22 bp, Artificial Sequence
  chemically synthesized
cctaattagtgagcttgtcaca

SEQ ID NO: 1363172 - DNA, 22 bp, Artificial Sequence
  chemically synthesized
attagtgagcttgtcacaaact

SEQ ID NO: 1363173 - DNA, 22 bp, Artificial Sequence
  chemically synthesized
tggcataacgtttagtttgtga

SEQ ID NO: 1363174 - DNA, 22 bp, Artificial Sequence
  chemically synthesized
gtgagcttgtcacaaactaaac

SEQ ID NO: 1363175 - DNA, 22 bp, Artificial Sequence
  chemically synthesized
ctgtggcataacgtttagtttg

SEQ ID NO: 1363176 - DNA, 22 bp, Artificial Sequence
  chemically synthesized
actgtggcataacgtttagttt

SEQ ID NO: 1363177 - DNA, 22 bp, Artificial Sequence
  chemically synthesized
tactgtggcataacgtttagtt

SEQ ID NO: 1363178 - DNA, 22 bp, Artificial Sequence
  chemically synthesized
gtcacaaactaaacgttatgcc

SEQ ID NO: 1363179 - DNA, 22 bp, Artificial Sequence
  chemically synthesized
tcacaaactaaacgttatgcca

SEQ ID NO: 1363180 - DNA, 22 bp, Artificial Sequence
  chemically synthesized
aaaatatattttactgtggcat

SEQ ID NO: 1363181 - DNA, 22 bp, Artificial Sequence
  chemically synthesized
aacgttatgccacagtaaaata

SEQ ID NO: 1363182 - DNA, 22 bp, Artificial Sequence
  chemically synthesized
tgccacagtaaaatatattttt

SEQ ID NO: 1363183 - DNA, 22 bp, Artificial Sequence
  chemically synthesized
taagtacaaagtaactaaaaat

SEQ ID NO: 1363184 - DNA, 22 bp, Artificial Sequence
  chemically synthesized
ttgtaagtacaaagtaactaaa

SEQ ID NO: 1363185 - DNA, 22 bp, Artificial Sequence
  chemically synthesized
ttagttactttgtacttacaac

SEQ ID NO: 1363186 - DNA, 22 bp, Artificial Sequence
  chemically synthesized
tagttactttgtacttacaaca

SEQ ID NO: 1363187 - DNA, 22 bp, Artificial Sequence
  chemically synthesized
agttactttgtacttacaacag

SEQ ID NO: 1363188 - DNA, 22 bp, Artificial Sequence
  chemically synthesized
gttactttgtacttacaacagt

SEQ ID NO: 1363189 - DNA, 22 bp, Artificial Sequence
  chemically synthesized
ctttgtacttacaacagtcctc

SEQ ID NO: 1363190 - DNA, 22 bp, Artificial Sequence
  chemically synthesized
gtgggaagaagtagaggactgt

SEQ ID NO: 1363191 - DNA, 22 bp, Artificial Sequence
  chemically synthesized
ggtgggaagaagtagaggactg

SEQ ID NO: 1363192 - DNA, 22 bp, Artificial Sequence
  chemically synthesized
tgtacttacaacagtcctctac

SEQ ID NO: 1363193 - DNA, 22 bp, Artificial Sequence
  chemically synthesized
tggtgggaagaagtagaggact

SEQ ID NO: 1363194 - DNA, 22 bp, Artificial Sequence
  chemically synthesized
gtacttacaacagtcctctact

SEQ ID NO: 1363195 - DNA, 22 bp, Artificial Sequence
  chemically synthesized
tacttacaacagtcctctactt

SEQ ID NO: 1363196 - DNA, 22 bp, Artificial Sequence
  chemically synthesized
acaacagtcctctacttcttcc

SEQ ID NO: 1363197 - DNA, 22 bp, Artificial Sequence
  chemically synthesized
caacagtcctctacttcttccc

SEQ ID NO: 1363198 - DNA, 22 bp, Artificial Sequence
  chemically synthesized
aaaatgctttggtgggaagaag

SEQ ID NO: 1363199 - DNA, 22 bp, Artificial Sequence
  chemically synthesized
caaaatgctttggtgggaagaa

SEQ ID NO: 1363200 - DNA, 22 bp, Artificial Sequence
  chemically synthesized
tcaaaatgctttggtgggaaga

SEQ ID NO: 1363201 - DNA, 22 bp, Artificial Sequence
  chemically synthesized
ttcaaaatgctttggtgggaag

SEQ ID NO: 1363202 - DNA, 22 bp, Artificial Sequence
  chemically synthesized
tacttcttcccaccaaagcatt

SEQ ID NO: 1363203 - DNA, 22 bp, Artificial Sequence
  chemically synthesized
cttcttcccaccaaagcatttt

SEQ ID NO: 1363204 - DNA, 22 bp, Artificial Sequence
  chemically synthesized
atatacacttttcaaaatgctt

SEQ ID NO: 1363205 - DNA, 22 bp, Artificial Sequence
  chemically synthesized
gatatacacttttcaaaatgct

SEQ ID NO: 1363206 - DNA, 22 bp, Artificial Sequence
  chemically synthesized
cttcccaccaaagcattttgaa

SEQ ID NO: 1363207 - DNA, 22 bp, Artificial Sequence
  chemically synthesized
ttcccaccaaagcattttgaaa

SEQ ID NO: 1363208 - DNA, 22 bp, Artificial Sequence
  chemically synthesized
cccaccaaagcattttgaaaag

SEQ ID NO: 1363209 - DNA, 22 bp, Artificial Sequence
  chemically synthesized
ccttgatatacacttttcaaaa

SEQ ID NO: 1363210 - DNA, 22 bp, Artificial Sequence
  chemically synthesized
ccaccaaagcattttgaaaagt

SEQ ID NO: 1363211 - DNA, 22 bp, Artificial Sequence
  chemically synthesized
tcgctgccttgatatacacttt

SEQ ID NO: 1363212 - DNA, 22 bp, Artificial Sequence
  chemically synthesized
atcgctgccttgatatacactt

SEQ ID NO: 1363213 - DNA, 22 bp, Artificial Sequence
  chemically synthesized
tatcgctgccttgatatacact

SEQ ID NO: 1363214 - DNA, 22 bp, Artificial Sequence
  chemically synthesized
ttatcgctgccttgatatacac

SEQ ID NO: 1363215 - DNA, 22 bp, Artificial Sequence
  chemically synthesized
tttatcgctgccttgatataca

SEQ ID NO: 1363216 - DNA, 22 bp, Artificial Sequence
  chemically synthesized
ttttatcgctgccttgatatac

SEQ ID NO: 1363217 - DNA, 22 bp, Artificial Sequence
  chemically synthesized
tttttatcgctgccttgatata

SEQ ID NO: 1363218 - DNA, 22 bp, Artificial Sequence
  chemically synthesized
tgaaaagtgtatatcaaggcag

SEQ ID NO: 1363219 - DNA, 22 bp, Artificial Sequence
  chemically synthesized
gaaaagtgtatatcaaggcagc

SEQ ID NO: 1363220 - DNA, 22 bp, Artificial Sequence
  chemically synthesized
aaaagtgtatatcaaggcagcg

SEQ ID NO: 1363221 - DNA, 22 bp, Artificial Sequence
  chemically synthesized
ccaggttttttttatcgctgcc

SEQ ID NO: 1363222 - DNA, 22 bp, Artificial Sequence
  chemically synthesized
accaggttttttttatcgctgc

SEQ ID NO: 1363223 - DNA, 22 bp, Artificial Sequence
  chemically synthesized
taccaggttttttttatcgctg

SEQ ID NO: 1363224 - DNA, 22 bp, Artificial Sequence
  chemically synthesized
ttaccaggttttttttatcgct

SEQ ID NO: 1363225 - DNA, 22 bp, Artificial Sequence
  chemically synthesized
aagaacttttaccaggtttttt

SEQ ID NO: 1363226 - DNA, 22 bp, Artificial Sequence
  chemically synthesized
gaagaacttttaccaggttttt

SEQ ID NO: 1363227 - DNA, 22 bp, Artificial Sequence
  chemically synthesized
gagcaataaagtttgaagaact

SEQ ID NO: 1363228 - DNA, 22 bp, Artificial Sequence
  chemically synthesized
ctggagcaataaagtttgaaga

SEQ ID NO: 1363229 - DNA, 22 bp, Artificial Sequence
  chemically synthesized
gtaaaagttcttcaaactttat

SEQ ID NO: 1363230 - DNA, 22 bp, Artificial Sequence
  chemically synthesized
agcctactggagcaataaagtt

SEQ ID NO: 1363231 - DNA, 22 bp, Artificial Sequence
  chemically synthesized
aagcctactggagcaataaagt

SEQ ID NO: 1363232 - DNA, 22 bp, Artificial Sequence
  chemically synthesized
taagcctactggagcaataaag

SEQ ID NO: 1363233 - DNA, 22 bp, Artificial Sequence
  chemically synthesized
ttaagcctactggagcaataaa

SEQ ID NO: 1363234 - DNA, 22 bp, Artificial Sequence
  chemically synthesized
tttttaagcctactggagcaat

SEQ ID NO: 1363235 - DNA, 22 bp, Artificial Sequence
  chemically synthesized
ttcaaactttattgctccagta

SEQ ID NO: 1363236 - DNA, 22 bp, Artificial Sequence
  chemically synthesized
caaactttattgctccagtagg

SEQ ID NO: 1363237 - DNA, 22 bp, Artificial Sequence
  chemically synthesized
attgtttttaagcctactggag

SEQ ID NO: 1363238 - DNA, 22 bp, Artificial Sequence
  chemically synthesized
aaactttattgctccagtaggc

SEQ ID NO: 1363239 - DNA, 22 bp, Artificial Sequence
  chemically synthesized
tcattgtttttaagcctactgg

SEQ ID NO: 1363240 - DNA, 22 bp, Artificial Sequence
  chemically synthesized
ctcattgtttttaagcctactg

SEQ ID NO: 1363241 - DNA, 22 bp, Artificial Sequence
  chemically synthesized
tattgctccagtaggcttaaaa

SEQ ID NO: 1363242 - DNA, 22 bp, Artificial Sequence
  chemically synthesized
gtttctcattgtttttaagcct

SEQ ID NO: 1363243 - DNA, 22 bp, Artificial Sequence
  chemically synthesized
attgctccagtaggcttaaaaa

SEQ ID NO: 1363244 - DNA, 22 bp, Artificial Sequence
  chemically synthesized
ttgctccagtaggcttaaaaac

SEQ ID NO: 1363245 - DNA, 22 bp, Artificial Sequence
  chemically synthesized
ttggtttctcattgtttttaag

SEQ ID NO: 1363246 - DNA, 22 bp, Artificial Sequence
  chemically synthesized
gttggtttctcattgtttttaa

SEQ ID NO: 1363247 - DNA, 22 bp, Artificial Sequence
  chemically synthesized
ctccagtaggcttaaaaacaat

SEQ ID NO: 1363248 - DNA, 22 bp, Artificial Sequence
  chemically synthesized
cagtaggcttaaaaacaatgag

SEQ ID NO: 1363249 - DNA, 22 bp, Artificial Sequence
  chemically synthesized
aagtttgttggtttctcattgt

SEQ ID NO: 1363250 - DNA, 22 bp, Artificial Sequence
  chemically synthesized
ctgaagtttgttggtttctcat

SEQ ID NO: 1363251 - DNA, 22 bp, Artificial Sequence
  chemically synthesized
aaaaacaatgagaaaccaacaa

SEQ ID NO: 1363252 - DNA, 22 bp, Artificial Sequence
  chemically synthesized
aaaacaatgagaaaccaacaaa

SEQ ID NO: 1363253 - DNA, 22 bp, Artificial Sequence
  chemically synthesized
aagctgctgaagtttgttggtt

SEQ ID NO: 1363254 - DNA, 22 bp, Artificial Sequence
  chemically synthesized
aaagctgctgaagtttgttggt

SEQ ID NO: 1363255 - DNA, 22 bp, Artificial Sequence
  chemically synthesized
taaagctgctgaagtttgttgg

SEQ ID NO: 1363256 - DNA, 22 bp, Artificial Sequence
  chemically synthesized
ttaaagctgctgaagtttgttg

SEQ ID NO: 1363257 - DNA, 22 bp, Artificial Sequence
  chemically synthesized
tttaaagctgctgaagtttgtt

SEQ ID NO: 1363258 - DNA, 22 bp, Artificial Sequence
  chemically synthesized
ttttaaagctgctgaagtttgt

SEQ ID NO: 1363259 - DNA, 22 bp, Artificial Sequence
  chemically synthesized
tttttaaagctgctgaagtttg

SEQ ID NO: 1363260 - DNA, 22 bp, Artificial Sequence
  chemically synthesized
ctttttttaaagctgctgaagt

SEQ ID NO: 1363261 - DNA, 22 bp, Artificial Sequence
  chemically synthesized
aagtgttactttttttaaagct

SEQ ID NO: 1363262 - DNA, 22 bp, Artificial Sequence
  chemically synthesized
cagcagctttaaaaaaagtaac

SEQ ID NO: 1363263 - DNA, 22 bp, Artificial Sequence
  chemically synthesized
agcagctttaaaaaaagtaaca

SEQ ID NO: 1363264 - DNA, 22 bp, Artificial Sequence
  chemically synthesized
taaaaaaagtaacacttcagtt

SEQ ID NO: 1363265 - DNA, 22 bp, Artificial Sequence
  chemically synthesized
aaaaaaagtaacacttcagttt

SEQ ID NO: 1363266 - DNA, 22 bp, Artificial Sequence
  chemically synthesized
aaaaaagtaacacttcagtttt

SEQ ID NO: 1363267 - DNA, 22 bp, Artificial Sequence
  chemically synthesized
ggagaaaaacgaataggaaaaa

SEQ ID NO: 1363268 - DNA, 22 bp, Artificial Sequence
  chemically synthesized
cggagaaaaacgaataggaaaa

SEQ ID NO: 1363269 - DNA, 22 bp, Artificial Sequence
  chemically synthesized
ccttcggagaaaaacgaatagg

SEQ ID NO: 1363270 - DNA, 22 bp, Artificial Sequence
  chemically synthesized
cagtttttcctattcgtttttc

SEQ ID NO: 1363271 - DNA, 22 bp, Artificial Sequence
  chemically synthesized
agtttttcctattcgtttttct

SEQ ID NO: 1363272 - DNA, 22 bp, Artificial Sequence
  chemically synthesized
ttcctattcgtttttctccgaa

SEQ ID NO: 1363273 - DNA, 22 bp, Artificial Sequence
  chemically synthesized
tcctattcgtttttctccgaag

SEQ ID NO: 1363274 - DNA, 22 bp, Artificial Sequence
  chemically synthesized
ggaggcaattaccttcggagaa

SEQ ID NO: 1363275 - DNA, 22 bp, Artificial Sequence
  chemically synthesized
cctattcgtttttctccgaagg

SEQ ID NO: 1363276 - DNA, 22 bp, Artificial Sequence
  chemically synthesized
ctattcgtttttctccgaaggt

SEQ ID NO: 1363277 - DNA, 22 bp, Artificial Sequence
  chemically synthesized
ttcgtttttctccgaaggtaat

SEQ ID NO: 1363278 - DNA, 22 bp, Artificial Sequence
  chemically synthesized
agatctgggaggcaattacctt

SEQ ID NO: 1363279 - DNA, 22 bp, Artificial Sequence
  chemically synthesized
gtttttctccgaaggtaattgc

SEQ ID NO: 1363280 - DNA, 22 bp, Artificial Sequence
  chemically synthesized
ttctccgaaggtaattgcctcc

SEQ ID NO: 1363281 - DNA, 22 bp, Artificial Sequence
  chemically synthesized
tctccgaaggtaattgcctccc

SEQ ID NO: 1363282 - DNA, 22 bp, Artificial Sequence
  chemically synthesized
ctccgaaggtaattgcctccca

SEQ ID NO: 1363283 - DNA, 22 bp, Artificial Sequence
  chemically synthesized
tccgaaggtaattgcctcccag

SEQ ID NO: 1363284 - DNA, 22 bp, Artificial Sequence
  chemically synthesized
caggactcagatctgggaggca

SEQ ID NO: 1363285 - DNA, 22 bp, Artificial Sequence
  chemically synthesized
cgaaggtaattgcctcccagat

SEQ ID NO: 1363286 - DNA, 22 bp, Artificial Sequence
  chemically synthesized
cccctacaggactcagatctgg

SEQ ID NO: 1363287 - DNA, 22 bp, Artificial Sequence
  chemically synthesized
ccccctacaggactcagatctg

SEQ ID NO: 1363288 - DNA, 22 bp, Artificial Sequence
  chemically synthesized
tccccctacaggactcagatct

SEQ ID NO: 1363289 - DNA, 22 bp, Artificial Sequence
  chemically synthesized
actttccccctacaggactcag

SEQ ID NO: 1363290 - DNA, 22 bp, Artificial Sequence
  chemically synthesized
cctcccagatctgagtcctgta

SEQ ID NO: 1363291 - DNA, 22 bp, Artificial Sequence
  chemically synthesized
ccagatctgagtcctgtagggg

SEQ ID NO: 1363292 - DNA, 22 bp, Artificial Sequence
  chemically synthesized
ggatcactcactttccccctac

SEQ ID NO: 1363293 - DNA, 22 bp, Artificial Sequence
  chemically synthesized
agtcctgtagggggaaagtgag

SEQ ID NO: 1363294 - DNA, 22 bp, Artificial Sequence
  chemically synthesized
agtgttgggatcactcactttc

SEQ ID NO: 1363295 - DNA, 22 bp, Artificial Sequence
  chemically synthesized
actcagtgttgggatcactcac

SEQ ID NO: 1363296 - DNA, 22 bp, Artificial Sequence
  chemically synthesized
tagggggaaagtgagtgatccc

SEQ ID NO: 1363297 - DNA, 22 bp, Artificial Sequence
  chemically synthesized
actcactcagtgttgggatcac

SEQ ID NO: 1363298 - DNA, 22 bp, Artificial Sequence
  chemically synthesized
tgttgactcactcagtgttggg

SEQ ID NO: 1363299 - DNA, 22 bp, Artificial Sequence
  chemically synthesized
ctgtgttgactcactcagtgtt

SEQ ID NO: 1363300 - DNA, 22 bp, Artificial Sequence
  chemically synthesized
gcatcagttactgtgttgactc

SEQ ID NO: 1363301 - DNA, 22 bp, Artificial Sequence
  chemically synthesized
agtgagtcaacacagtaactga

SEQ ID NO: 1363302 - DNA, 22 bp, Artificial Sequence
  chemically synthesized
cagaatcctggcatcagttact

SEQ ID NO: 1363303 - DNA, 22 bp, Artificial Sequence
  chemically synthesized
tacagaatcctggcatcagtta

SEQ ID NO: 1363304 - DNA, 22 bp, Artificial Sequence
  chemically synthesized
aaatatccgggggcctctacag

SEQ ID NO: 1363305 - DNA, 22 bp, Artificial Sequence
  chemically synthesized
atgccaggattctgtagaggcc

SEQ ID NO: 1363306 - DNA, 22 bp, Artificial Sequence
  chemically synthesized
gaaatatccgggggcctctaca

SEQ ID NO: 1363307 - DNA, 22 bp, Artificial Sequence
  chemically synthesized
gaatttgaaatatccgggggcc

SEQ ID NO: 1363308 - DNA, 22 bp, Artificial Sequence
  chemically synthesized
tgtagaggcccccggatatttc

SEQ ID NO: 1363309 - DNA, 22 bp, Artificial Sequence
  chemically synthesized
tagaggcccccggatatttcaa

SEQ ID NO: 1363310 - DNA, 22 bp, Artificial Sequence
  chemically synthesized
tgcgcaggtcctggaatttgaa

SEQ ID NO: 1363311 - DNA, 22 bp, Artificial Sequence
  chemically synthesized
gtgcgcaggtcctggaatttga

SEQ ID NO: 1363312 - DNA, 22 bp, Artificial Sequence
  chemically synthesized
cttgtgcgcaggtcctggaatt

SEQ ID NO: 1363313 - DNA, 22 bp, Artificial Sequence
  chemically synthesized
gcttgtgcgcaggtcctggaat

SEQ ID NO: 1363314 - DNA, 22 bp, Artificial Sequence
  chemically synthesized
caaattccaggacctgcgcaca

SEQ ID NO: 1363315 - DNA, 22 bp, Artificial Sequence
  chemically synthesized
aaattccaggacctgcgcacaa

SEQ ID NO: 1363316 - DNA, 22 bp, Artificial Sequence
  chemically synthesized
caggacctgcgcacaagcaagt

SEQ ID NO: 1363317 - DNA, 22 bp, Artificial Sequence
  chemically synthesized
agagagaaggcgggtcacttgc

SEQ ID NO: 1363318 - DNA, 22 bp, Artificial Sequence
  chemically synthesized
gagagagaaggcgggtcacttg

SEQ ID NO: 1363319 - DNA, 22 bp, Artificial Sequence
  chemically synthesized
cgcacaagcaagtgacccgcct

SEQ ID NO: 1363320 - DNA, 22 bp, Artificial Sequence
  chemically synthesized
tgggaaaccaacttgagagaga

SEQ ID NO: 1363321 - DNA, 22 bp, Artificial Sequence
  chemically synthesized
ttatgggaaaccaacttgagag

SEQ ID NO: 1363322 - DNA, 22 bp, Artificial Sequence
  chemically synthesized
ctctctcaagttggtttcccat

SEQ ID NO: 1363323 - DNA, 22 bp, Artificial Sequence
  chemically synthesized
tctctcaagttggtttcccata

SEQ ID NO: 1363324 - DNA, 22 bp, Artificial Sequence
  chemically synthesized
tctcaagttggtttcccataat

SEQ ID NO: 1363325 - DNA, 22 bp, Artificial Sequence
  chemically synthesized
tcaagttggtttcccataatag

SEQ ID NO: 1363326 - DNA, 22 bp, Artificial Sequence
  chemically synthesized
aagttggtttcccataatagga

SEQ ID NO: 1363327 - DNA, 22 bp, Artificial Sequence
  chemically synthesized
gtttcccataataggactgtcc

SEQ ID NO: 1363328 - DNA, 22 bp, Artificial Sequence
  chemically synthesized
tatgtagtgaccatggacagtc

SEQ ID NO: 1363329 - DNA, 22 bp, Artificial Sequence
  chemically synthesized
atatgtagtgaccatggacagt

SEQ ID NO: 1363330 - DNA, 22 bp, Artificial Sequence
  chemically synthesized
cccataataggactgtccatgg

SEQ ID NO: 1363331 - DNA, 22 bp, Artificial Sequence
  chemically synthesized
ccataataggactgtccatggt

SEQ ID NO: 1363332 - DNA, 22 bp, Artificial Sequence
  chemically synthesized
gaagcacaaccttatatgtagt

SEQ ID NO: 1363333 - DNA, 22 bp, Artificial Sequence
  chemically synthesized
tccatggtcactacatataagg

SEQ ID NO: 1363334 - DNA, 22 bp, Artificial Sequence
  chemically synthesized
ccatgctggaagcacaacctta

SEQ ID NO: 1363335 - DNA, 22 bp, Artificial Sequence
  chemically synthesized
gccatgctggaagcacaacctt

SEQ ID NO: 1363336 - DNA, 22 bp, Artificial Sequence
  chemically synthesized
catataaggttgtgcttccagc

SEQ ID NO: 1363337 - DNA, 22 bp, Artificial Sequence
  chemically synthesized
acagagcttgccatgctggaag

SEQ ID NO: 1363338 - DNA, 22 bp, Artificial Sequence
  chemically synthesized
aattcacagagcttgccatgct

SEQ ID NO: 1363339 - DNA, 22 bp, Artificial Sequence
  chemically synthesized
gaattcacagagcttgccatgc

SEQ ID NO: 1363340 - DNA, 22 bp, Artificial Sequence
  chemically synthesized
tttgaattcacagagcttgcca

SEQ ID NO: 1363341 - DNA, 22 bp, Artificial Sequence
  chemically synthesized
tgcttccagcatggcaagctct

SEQ ID NO: 1363342 - DNA, 22 bp, Artificial Sequence
  chemically synthesized
ccagcatggcaagctctgtgaa

SEQ ID NO: 1363343 - DNA, 22 bp, Artificial Sequence
  chemically synthesized
cagcatggcaagctctgtgaat

SEQ ID NO: 1363344 - DNA, 22 bp, Artificial Sequence
  chemically synthesized
agcattgtttgaattcacagag

SEQ ID NO: 1363345 - DNA, 22 bp, Artificial Sequence
  chemically synthesized
tgtgaattcaaacaatgctcaa

SEQ ID NO: 1363346 - DNA, 22 bp, Artificial Sequence
  chemically synthesized
atcagaacacagttgagcattg

SEQ ID NO: 1363347 - DNA, 22 bp, Artificial Sequence
  chemically synthesized
tgaattcaaacaatgctcaact

SEQ ID NO: 1363348 - DNA, 22 bp, Artificial Sequence
  chemically synthesized
gatattaatcagaacacagttg

SEQ ID NO: 1363349 - DNA, 22 bp, Artificial Sequence
  chemically synthesized
ggatattaatcagaacacagtt

SEQ ID NO: 1363350 - DNA, 22 bp, Artificial Sequence
  chemically synthesized
aaacaatgctcaactgtgttct

SEQ ID NO: 1363351 - DNA, 22 bp, Artificial Sequence
  chemically synthesized
gtttggatattaatcagaacac

SEQ ID NO: 1363352 - DNA, 22 bp, Artificial Sequence
  chemically synthesized
tggtttggatattaatcagaac

SEQ ID NO: 1363353 - DNA, 22 bp, Artificial Sequence
  chemically synthesized
ttctggtttggatattaatcag

SEQ ID NO: 1363354 - DNA, 22 bp, Artificial Sequence
  chemically synthesized
aactgtgttctgattaatatcc

SEQ ID NO: 1363355 - DNA, 22 bp, Artificial Sequence
  chemically synthesized
tgctattctggtttggatatta

SEQ ID NO: 1363356 - DNA, 22 bp, Artificial Sequence
  chemically synthesized
tgttctgattaatatccaaacc

SEQ ID NO: 1363357 - DNA, 22 bp, Artificial Sequence
  chemically synthesized
tgattaatatccaaaccagaat

SEQ ID NO: 1363358 - DNA, 22 bp, Artificial Sequence
  chemically synthesized
tgtccactgtgctattctggtt

SEQ ID NO: 1363359 - DNA, 22 bp, Artificial Sequence
  chemically synthesized
attaatatccaaaccagaatag

SEQ ID NO: 1363360 - DNA, 22 bp, Artificial Sequence
  chemically synthesized
atatccaaaccagaatagcaca

SEQ ID NO: 1363361 - DNA, 22 bp, Artificial Sequence
  chemically synthesized
aaagcaagtactatgtccactg

SEQ ID NO: 1363362 - DNA, 22 bp, Artificial Sequence
  chemically synthesized
aaaagcaagtactatgtccact

SEQ ID NO: 1363363 - DNA, 22 bp, Artificial Sequence
  chemically synthesized
taaaagcaagtactatgtccac

SEQ ID NO: 1363364 - DNA, 22 bp, Artificial Sequence
  chemically synthesized
gaaggctttaaaagcaagtact

SEQ ID NO: 1363365 - DNA, 22 bp, Artificial Sequence
  chemically synthesized
agaaggctttaaaagcaagtac

SEQ ID NO: 1363366 - DNA, 22 bp, Artificial Sequence
  chemically synthesized
tgtttagaaggctttaaaagca

SEQ ID NO: 1363367 - DNA, 22 bp, Artificial Sequence
  chemically synthesized
gtgtttagaaggctttaaaagc

SEQ ID NO: 1363368 - DNA, 22 bp, Artificial Sequence
  chemically synthesized
tgtgtttagaaggctttaaaag

SEQ ID NO: 1363369 - DNA, 22 bp, Artificial Sequence
  chemically synthesized
ttgtgtttagaaggctttaaaa

SEQ ID NO: 1363370 - DNA, 22 bp, Artificial Sequence
  chemically synthesized
aatagtttttgtgtttagaagg

SEQ ID NO: 1363371 - DNA, 22 bp, Artificial Sequence
  chemically synthesized
gcttttaaagccttctaaacac

SEQ ID NO: 1363372 - DNA, 22 bp, Artificial Sequence
  chemically synthesized
cttttaaagccttctaaacaca

SEQ ID NO: 1363373 - DNA, 22 bp, Artificial Sequence
  chemically synthesized
tactgaatagtttttgtgttta

SEQ ID NO: 1363374 - DNA, 22 bp, Artificial Sequence
  chemically synthesized
ttaaagccttctaaacacaaaa

SEQ ID NO: 1363375 - DNA, 22 bp, Artificial Sequence
  chemically synthesized
gtactgaatagtttttgtgttt

SEQ ID NO: 1363376 - DNA, 22 bp, Artificial Sequence
  chemically synthesized
taaagccttctaaacacaaaaa

SEQ ID NO: 1363377 - DNA, 22 bp, Artificial Sequence
  chemically synthesized
tgtactgaatagtttttgtgtt

SEQ ID NO: 1363378 - DNA, 22 bp, Artificial Sequence
  chemically synthesized
aaagccttctaaacacaaaaac

SEQ ID NO: 1363379 - DNA, 22 bp, Artificial Sequence
  chemically synthesized
ttgtactgaatagtttttgtgt

SEQ ID NO: 1363380 - DNA, 22 bp, Artificial Sequence
  chemically synthesized
aagccttctaaacacaaaaact

SEQ ID NO: 1363381 - DNA, 22 bp, Artificial Sequence
  chemically synthesized
tgcttttgtactgaatagtttt

SEQ ID NO: 1363382 - DNA, 22 bp, Artificial Sequence
  chemically synthesized
ctaaacacaaaaactattcagt

SEQ ID NO: 1363383 - DNA, 22 bp, Artificial Sequence
  chemically synthesized
ttatgcttttgtactgaatagt

SEQ ID NO: 1363384 - DNA, 22 bp, Artificial Sequence
  chemically synthesized
taaacacaaaaactattcagta

SEQ ID NO: 1363385 - DNA, 22 bp, Artificial Sequence
  chemically synthesized
aacacaaaaactattcagtaca

SEQ ID NO: 1363386 - DNA, 22 bp, Artificial Sequence
  chemically synthesized
cagaaagtattgttatgctttt

SEQ ID NO: 1363387 - DNA, 22 bp, Artificial Sequence
  chemically synthesized
ttcagtacaaaagcataacaat

SEQ ID NO: 1363388 - DNA, 22 bp, Artificial Sequence
  chemically synthesized
agtacaaaagcataacaatact

SEQ ID NO: 1363389 - DNA, 22 bp, Artificial Sequence
  chemically synthesized
acatgaaagttacagaaagtat

SEQ ID NO: 1363390 - DNA, 22 bp, Artificial Sequence
  chemically synthesized
ataaattcacatgaaagttaca

SEQ ID NO: 1363391 - DNA, 22 bp, Artificial Sequence
  chemically synthesized
ttaataaattcacatgaaagtt

SEQ ID NO: 1363392 - DNA, 22 bp, Artificial Sequence
  chemically synthesized
tgttaataaattcacatgaaag

SEQ ID NO: 1363393 - DNA, 22 bp, Artificial Sequence
  chemically synthesized
ctctgttaataaattcacatga

SEQ ID NO: 1363394 - DNA, 22 bp, Artificial Sequence
  chemically synthesized
tctgtaactttcatgtgaattt

SEQ ID NO: 1363395 - DNA, 22 bp, Artificial Sequence
  chemically synthesized
tgctctgttaataaattcacat

SEQ ID NO: 1363396 - DNA, 22 bp, Artificial Sequence
  chemically synthesized
ctgtaactttcatgtgaattta

SEQ ID NO: 1363397 - DNA, 22 bp, Artificial Sequence
  chemically synthesized
ctgctctgttaataaattcaca

SEQ ID NO: 1363398 - DNA, 22 bp, Artificial Sequence
  chemically synthesized
tgtaactttcatgtgaatttat

SEQ ID NO: 1363399 - DNA, 22 bp, Artificial Sequence
  chemically synthesized
tctgctctgttaataaattcac

SEQ ID NO: 1363400 - DNA, 22 bp, Artificial Sequence
  chemically synthesized
taactttcatgtgaatttatta

SEQ ID NO: 1363401 - DNA, 22 bp, Artificial Sequence
  chemically synthesized
tcatgtgaatttattaacagag

SEQ ID NO: 1363402 - DNA, 22 bp, Artificial Sequence
  chemically synthesized
catgtgaatttattaacagagc

SEQ ID NO: 1363403 - DNA, 22 bp, Artificial Sequence
  chemically synthesized
atgtgaatttattaacagagca

SEQ ID NO: 1363404 - DNA, 22 bp, Artificial Sequence
  chemically synthesized
aatccggattttctgctctgtt

SEQ ID NO: 1363405 - DNA, 22 bp, Artificial Sequence
  chemically synthesized
gaatccggattttctgctctgt

SEQ ID NO: 1363406 - DNA, 22 bp, Artificial Sequence
  chemically synthesized
tgaatccggattttctgctctg

SEQ ID NO: 1363407 - DNA, 22 bp, Artificial Sequence
  chemically synthesized
attaacagagcagaaaatccgg

SEQ ID NO: 1363408 - DNA, 22 bp, Artificial Sequence
  chemically synthesized
ttaacagagcagaaaatccgga

SEQ ID NO: 1363409 - DNA, 22 bp, Artificial Sequence
  chemically synthesized
acagagcagaaaatccggattc

SEQ ID NO: 1363410 - DNA, 22 bp, Artificial Sequence
  chemically synthesized
aaagtcaattttgaatccggat

SEQ ID NO: 1363411 - DNA, 22 bp, Artificial Sequence
  chemically synthesized
aaaagtcaattttgaatccgga

SEQ ID NO: 1363412 - DNA, 22 bp, Artificial Sequence
  chemically synthesized
agaggataaaaaaggcatttaa

SEQ ID NO: 1363413 - DNA, 22 bp, Artificial Sequence
  chemically synthesized
aaaattgacttttaaatgcctt

SEQ ID NO: 1363414 - DNA, 22 bp, Artificial Sequence
  chemically synthesized
ttgagaggataaaaaaggcatt

SEQ ID NO: 1363415 - DNA, 22 bp, Artificial Sequence
  chemically synthesized
acttttaaatgccttttttatc

SEQ ID NO: 1363416 - DNA, 22 bp, Artificial Sequence
  chemically synthesized
gtgttgttgagaggataaaaaa

SEQ ID NO: 1363417 - DNA, 22 bp, Artificial Sequence
  chemically synthesized
ggtgttgttgagaggataaaaa

SEQ ID NO: 1363418 - DNA, 22 bp, Artificial Sequence
  chemically synthesized
tggtgttgttgagaggataaaa

SEQ ID NO: 1363419 - DNA, 22 bp, Artificial Sequence
  chemically synthesized
ttaaatgccttttttatcctct

SEQ ID NO: 1363420 - DNA, 22 bp, Artificial Sequence
  chemically synthesized
ttggtgttgttgagaggataaa

SEQ ID NO: 1363421 - DNA, 22 bp, Artificial Sequence
  chemically synthesized
taaatgccttttttatcctctc

SEQ ID NO: 1363422 - DNA, 22 bp, Artificial Sequence
  chemically synthesized
aaatgccttttttatcctctca

SEQ ID NO: 1363423 - DNA, 22 bp, Artificial Sequence
  chemically synthesized
aatgccttttttatcctctcaa

SEQ ID NO: 1363424 - DNA, 22 bp, Artificial Sequence
  chemically synthesized
ttttatcctctcaacaacacca

SEQ ID NO: 1363425 - DNA, 22 bp, Artificial Sequence
  chemically synthesized
tttatcctctcaacaacaccaa

SEQ ID NO: 1363426 - DNA, 22 bp, Artificial Sequence
  chemically synthesized
ttatcctctcaacaacaccaaa

SEQ ID NO: 1363427 - DNA, 22 bp, Artificial Sequence
  chemically synthesized
tatcctctcaacaacaccaaaa

SEQ ID NO: 1363428 - DNA, 22 bp, Artificial Sequence
  chemically synthesized
gtagagtgaaatttttggtgtt

SEQ ID NO: 1363429 - DNA, 22 bp, Artificial Sequence
  chemically synthesized
atcctctcaacaacaccaaaaa

SEQ ID NO: 1363430 - DNA, 22 bp, Artificial Sequence
  chemically synthesized
ggtagagtgaaatttttggtgt

SEQ ID NO: 1363431 - DNA, 22 bp, Artificial Sequence
  chemically synthesized
tcctctcaacaacaccaaaaat

SEQ ID NO: 1363432 - DNA, 22 bp, Artificial Sequence
  chemically synthesized
tttggtagagtgaaatttttgg

SEQ ID NO: 1363433 - DNA, 22 bp, Artificial Sequence
  chemically synthesized
atttggtagagtgaaatttttg

SEQ ID NO: 1363434 - DNA, 22 bp, Artificial Sequence
  chemically synthesized
tatttggtagagtgaaattttt

SEQ ID NO: 1363435 - DNA, 22 bp, Artificial Sequence
  chemically synthesized
tcaacaacaccaaaaatttcac

SEQ ID NO: 1363436 - DNA, 22 bp, Artificial Sequence
  chemically synthesized
ttatttggtagagtgaaatttt

SEQ ID NO: 1363437 - DNA, 22 bp, Artificial Sequence
  chemically synthesized
tttatttggtagagtgaaattt

SEQ ID NO: 1363438 - DNA, 22 bp, Artificial Sequence
  chemically synthesized
aacaacaccaaaaatttcactc

SEQ ID NO: 1363439 - DNA, 22 bp, Artificial Sequence
  chemically synthesized
ctttttatttggtagagtgaaa

SEQ ID NO: 1363440 - DNA, 22 bp, Artificial Sequence
  chemically synthesized
ggcattcctttttatttggtag

SEQ ID NO: 1363441 - DNA, 22 bp, Artificial Sequence
  chemically synthesized
tgggcattcctttttatttggt

SEQ ID NO: 1363442 - DNA, 22 bp, Artificial Sequence
  chemically synthesized
ttctgggcattcctttttattt

SEQ ID NO: 1363443 - DNA, 22 bp, Artificial Sequence
  chemically synthesized
cactctaccaaataaaaaggaa

SEQ ID NO: 1363444 - DNA, 22 bp, Artificial Sequence
  chemically synthesized
actctaccaaataaaaaggaat

SEQ ID NO: 1363445 - DNA, 22 bp, Artificial Sequence
  chemically synthesized
taccaaataaaaaggaatgccc

SEQ ID NO: 1363446 - DNA, 22 bp, Artificial Sequence
  chemically synthesized
ccaaataaaaaggaatgcccag

SEQ ID NO: 1363447 - DNA, 22 bp, Artificial Sequence
  chemically synthesized
gtagacagtggatacataacaa

SEQ ID NO: 1363448 - DNA, 22 bp, Artificial Sequence
  chemically synthesized
ggtagacagtggatacataaca

SEQ ID NO: 1363449 - DNA, 22 bp, Artificial Sequence
  chemically synthesized
tggtagacagtggatacataac

SEQ ID NO: 1363450 - DNA, 22 bp, Artificial Sequence
  chemically synthesized
gttatgtatccactgtctacca

SEQ ID NO: 1363451 - DNA, 22 bp, Artificial Sequence
  chemically synthesized
ttatgtatccactgtctaccaa

SEQ ID NO: 1363452 - DNA, 22 bp, Artificial Sequence
  chemically synthesized
tgtatccactgtctaccaaagt

SEQ ID NO: 1363453 - DNA, 22 bp, Artificial Sequence
  chemically synthesized
aatcccaaggggaaaaaataac

SEQ ID NO: 1363454 - DNA, 22 bp, Artificial Sequence
  chemically synthesized
tctaccaaagttattttttccc

SEQ ID NO: 1363455 - DNA, 22 bp, Artificial Sequence
  chemically synthesized
attgaatcccaaggggaaaaaa

SEQ ID NO: 1363456 - DNA, 22 bp, Artificial Sequence
  chemically synthesized
gattgaatcccaaggggaaaaa

SEQ ID NO: 1363457 - DNA, 22 bp, Artificial Sequence
  chemically synthesized
tgattgaatcccaaggggaaaa

SEQ ID NO: 1363458 - DNA, 22 bp, Artificial Sequence
  chemically synthesized
ccaaagttattttttccccttg

SEQ ID NO: 1363459 - DNA, 22 bp, Artificial Sequence
  chemically synthesized
ttgattgaatcccaaggggaaa

SEQ ID NO: 1363460 - DNA, 22 bp, Artificial Sequence
  chemically synthesized
ttttttccccttgggattcaat

SEQ ID NO: 1363461 - DNA, 22 bp, Artificial Sequence
  chemically synthesized
tttccccttgggattcaatcaa

SEQ ID NO: 1363462 - DNA, 22 bp, Artificial Sequence
  chemically synthesized
ttccccttgggattcaatcaaa

SEQ ID NO: 1363463 - DNA, 22 bp, Artificial Sequence
  chemically synthesized
tccccttgggattcaatcaaaa

SEQ ID NO: 1363464 - DNA, 22 bp, Artificial Sequence
  chemically synthesized
ccccttgggattcaatcaaaag

SEQ ID NO: 1363465 - DNA, 22 bp, Artificial Sequence
  chemically synthesized
cccttgggattcaatcaaaagt

SEQ ID NO: 1363466 - DNA, 22 bp, Artificial Sequence
  chemically synthesized
gcatcatcaatacataactttt

SEQ ID NO: 1363467 - DNA, 22 bp, Artificial Sequence
  chemically synthesized
gggattcaatcaaaagttatgt

SEQ ID NO: 1363468 - DNA, 22 bp, Artificial Sequence
  chemically synthesized
ggattcaatcaaaagttatgta

SEQ ID NO: 1363469 - DNA, 22 bp, Artificial Sequence
  chemically synthesized
ttggcatcatcaatacataact

SEQ ID NO: 1363470 - DNA, 22 bp, Artificial Sequence
  chemically synthesized
aatcaaaagttatgtattgatg

SEQ ID NO: 1363471 - DNA, 22 bp, Artificial Sequence
  chemically synthesized
agactgttggcatcatcaatac

SEQ ID NO: 1363472 - DNA, 22 bp, Artificial Sequence
  chemically synthesized
ttcagactgttggcatcatcaa

SEQ ID NO: 1363473 - DNA, 22 bp, Artificial Sequence
  chemically synthesized
attcagactgttggcatcatca

SEQ ID NO: 1363474 - DNA, 22 bp, Artificial Sequence
  chemically synthesized
ttattcagactgttggcatcat

SEQ ID NO: 1363475 - DNA, 22 bp, Artificial Sequence
  chemically synthesized
tcttattcagactgttggcatc

SEQ ID NO: 1363476 - DNA, 22 bp, Artificial Sequence
  chemically synthesized
ctcttattcagactgttggcat

SEQ ID NO: 1363477 - DNA, 22 bp, Artificial Sequence
  chemically synthesized
tgtattgatgatgccaacagtc

SEQ ID NO: 1363478 - DNA, 22 bp, Artificial Sequence
  chemically synthesized
cttctcttattcagactgttgg

SEQ ID NO: 1363479 - DNA, 22 bp, Artificial Sequence
  chemically synthesized
ctgcttctcttattcagactgt

SEQ ID NO: 1363480 - DNA, 22 bp, Artificial Sequence
  chemically synthesized
atgatgccaacagtctgaataa

SEQ ID NO: 1363481 - DNA, 22 bp, Artificial Sequence
  chemically synthesized
ctgctgcttctcttattcagac

SEQ ID NO: 1363482 - DNA, 22 bp, Artificial Sequence
  chemically synthesized
tgctgctgcttctcttattcag

SEQ ID NO: 1363483 - DNA, 22 bp, Artificial Sequence
  chemically synthesized
cattctgctgctgcttctctta

SEQ ID NO: 1363484 - DNA, 22 bp, Artificial Sequence
  chemically synthesized
ctgcattctgctgctgcttctc

SEQ ID NO: 1363485 - DNA, 22 bp, Artificial Sequence
  chemically synthesized
agctgctgcattctgctgctgc

SEQ ID NO: 1363486 - DNA, 22 bp, Artificial Sequence
  chemically synthesized
aataagagaagcagcagcagaa

SEQ ID NO: 1363487 - DNA, 22 bp, Artificial Sequence
  chemically synthesized
agaattcagctgctgcattctg

SEQ ID NO: 1363488 - DNA, 22 bp, Artificial Sequence
  chemically synthesized
cagaattcagctgctgcattct

SEQ ID NO: 1363489 - DNA, 22 bp, Artificial Sequence
  chemically synthesized
ccttcagaattcagctgctgca

SEQ ID NO: 1363490 - DNA, 22 bp, Artificial Sequence
  chemically synthesized
tgccttcagaattcagctgctg

SEQ ID NO: 1363491 - DNA, 22 bp, Artificial Sequence
  chemically synthesized
tacacacacacattctgccttc

SEQ ID NO: 1363492 - DNA, 22 bp, Artificial Sequence
  chemically synthesized
aattctgaaggcagaatgtgtg

SEQ ID NO: 1363493 - DNA, 22 bp, Artificial Sequence
  chemically synthesized
tgaaggcagaatgtgtgtgtgt

SEQ ID NO: 1363494 - DNA, 22 bp, Artificial Sequence
  chemically synthesized
aaggcagaatgtgtgtgtgtat

SEQ ID NO: 1363495 - DNA, 22 bp, Artificial Sequence
  chemically synthesized
gcaggaaaacatgtcccatgag

SEQ ID NO: 1363496 - DNA, 22 bp, Artificial Sequence
  chemically synthesized
agcaggaaaacatgtcccatga

SEQ ID NO: 1363497 - DNA, 22 bp, Artificial Sequence
  chemically synthesized
tagcaggaaaacatgtcccatg

SEQ ID NO: 1363498 - DNA, 22 bp, Artificial Sequence
  chemically synthesized
ttttagcaggaaaacatgtccc

SEQ ID NO: 1363499 - DNA, 22 bp, Artificial Sequence
  chemically synthesized
attttagcaggaaaacatgtcc

SEQ ID NO: 1363500 - DNA, 22 bp, Artificial Sequence
  chemically synthesized
tattttagcaggaaaacatgtc

SEQ ID NO: 1363501 - DNA, 22 bp, Artificial Sequence
  chemically synthesized
tttattttagcaggaaaacatg

SEQ ID NO: 1363502 - DNA, 22 bp, Artificial Sequence
  chemically synthesized
atgggacatgttttcctgctaa

SEQ ID NO: 1363503 - DNA, 22 bp, Artificial Sequence
  chemically synthesized
taagagtattctttattttagc

SEQ ID NO: 1363504 - DNA, 22 bp, Artificial Sequence
  chemically synthesized
cattataagagtattctttatt

SEQ ID NO: 1363505 - DNA, 22 bp, Artificial Sequence
  chemically synthesized
tcctgctaaaataaagaatact

SEQ ID NO: 1363506 - DNA, 22 bp, Artificial Sequence
  chemically synthesized
ctgcattataagagtattcttt

SEQ ID NO: 1363507 - DNA, 22 bp, Artificial Sequence
  chemically synthesized
cctgctaaaataaagaatactc

SEQ ID NO: 1363508 - DNA, 22 bp, Artificial Sequence
  chemically synthesized
cctgcattataagagtattctt

SEQ ID NO: 1363509 - DNA, 22 bp, Artificial Sequence
  chemically synthesized
ctgctaaaataaagaatactct

SEQ ID NO: 1363510 - DNA, 22 bp, Artificial Sequence
  chemically synthesized
tcctgcattataagagtattct

SEQ ID NO: 1363511 - DNA, 22 bp, Artificial Sequence
  chemically synthesized
tttcctgcattataagagtatt

SEQ ID NO: 1363512 - DNA, 22 bp, Artificial Sequence
  chemically synthesized
ctaaaataaagaatactcttat

SEQ ID NO: 1363513 - DNA, 22 bp, Artificial Sequence
  chemically synthesized
ctttcctgcattataagagtat

SEQ ID NO: 1363514 - DNA, 22 bp, Artificial Sequence
  chemically synthesized
aaataaagaatactcttataat

SEQ ID NO: 1363515 - DNA, 22 bp, Artificial Sequence
  chemically synthesized
agaaaaatttctttcctgcatt

SEQ ID NO: 1363516 - DNA, 22 bp, Artificial Sequence
  chemically synthesized
gagaaaaatttctttcctgcat

SEQ ID NO: 1363517 - DNA, 22 bp, Artificial Sequence
  chemically synthesized
ggatttgagaaaaatttctttc

SEQ ID NO: 1363518 - DNA, 22 bp, Artificial Sequence
  chemically synthesized
ttataatgcaggaaagaaattt

SEQ ID NO: 1363519 - DNA, 22 bp, Artificial Sequence
  chemically synthesized
aggatttgagaaaaatttcttt

SEQ ID NO: 1363520 - DNA, 22 bp, Artificial Sequence
  chemically synthesized
ataatgcaggaaagaaattttt

SEQ ID NO: 1363521 - DNA, 22 bp, Artificial Sequence
  chemically synthesized
taatgcaggaaagaaatttttc

SEQ ID NO: 1363522 - DNA, 22 bp, Artificial Sequence
  chemically synthesized
aaatttaggatttgagaaaaat

SEQ ID NO: 1363523 - DNA, 22 bp, Artificial Sequence
  chemically synthesized
acaactgaaatttaggatttga

SEQ ID NO: 1363524 - DNA, 22 bp, Artificial Sequence
  chemically synthesized
ttctcaaatcctaaatttcagt

SEQ ID NO: 1363525 - DNA, 22 bp, Artificial Sequence
  chemically synthesized
gcataattcacaactgaaattt

SEQ ID NO: 1363526 - DNA, 22 bp, Artificial Sequence
  chemically synthesized
tctcaaatcctaaatttcagtt

SEQ ID NO: 1363527 - DNA, 22 bp, Artificial Sequence
  chemically synthesized
agcataattcacaactgaaatt

SEQ ID NO: 1363528 - DNA, 22 bp, Artificial Sequence
  chemically synthesized
ctcaaatcctaaatttcagttg

SEQ ID NO: 1363529 - DNA, 22 bp, Artificial Sequence
  chemically synthesized
tagcataattcacaactgaaat

SEQ ID NO: 1363530 - DNA, 22 bp, Artificial Sequence
  chemically synthesized
tcaaatcctaaatttcagttgt

SEQ ID NO: 1363531 - DNA, 22 bp, Artificial Sequence
  chemically synthesized
aaatcctaaatttcagttgtga

SEQ ID NO: 1363532 - DNA, 22 bp, Artificial Sequence
  chemically synthesized
aatttcagttgtgaattatgct

SEQ ID NO: 1363533 - DNA, 22 bp, Artificial Sequence
  chemically synthesized
gtaaagaagttttagcataatt

SEQ ID NO: 1363534 - DNA, 22 bp, Artificial Sequence
  chemically synthesized
ttagtaaagaagttttagcata

SEQ ID NO: 1363535 - DNA, 22 bp, Artificial Sequence
  chemically synthesized
cagttgtgaattatgctaaaac

SEQ ID NO: 1363536 - DNA, 22 bp, Artificial Sequence
  chemically synthesized
gttagtaaagaagttttagcat

SEQ ID NO: 1363537 - DNA, 22 bp, Artificial Sequence
  chemically synthesized
agttgtgaattatgctaaaact

SEQ ID NO: 1363538 - DNA, 22 bp, Artificial Sequence
  chemically synthesized
tgaattatgctaaaacttcttt

SEQ ID NO: 1363539 - DNA, 22 bp, Artificial Sequence
  chemically synthesized
tgctaaaacttctttactaaca

SEQ ID NO: 1363540 - DNA, 22 bp, Artificial Sequence
  chemically synthesized
aaacttctttactaacaaatta

SEQ ID NO: 1363541 - DNA, 22 bp, Artificial Sequence
  chemically synthesized
ctttactaacaaattattcttt

SEQ ID NO: 1363542 - DNA, 22 bp, Artificial Sequence
  chemically synthesized
tttactaacaaattattctttc

SEQ ID NO: 1363543 - DNA, 22 bp, Artificial Sequence
  chemically synthesized
tactaacaaattattctttctt

SEQ ID NO: 1363544 - DNA, 22 bp, Artificial Sequence
  chemically synthesized
actaacaaattattctttcttc

SEQ ID NO: 1363545 - DNA, 22 bp, Artificial Sequence
  chemically synthesized
ctaacaaattattctttcttcc

SEQ ID NO: 1363546 - DNA, 22 bp, Artificial Sequence
  chemically synthesized
gcaccagagaaatggaagaaag

SEQ ID NO: 1363547 - DNA, 22 bp, Artificial Sequence
  chemically synthesized
acaaattattctttcttccatt

SEQ ID NO: 1363548 - DNA, 22 bp, Artificial Sequence
  chemically synthesized
agaattggcaccagagaaatgg

SEQ ID NO: 1363549 - DNA, 22 bp, Artificial Sequence
  chemically synthesized
aagaattggcaccagagaaatg

SEQ ID NO: 1363550 - DNA, 22 bp, Artificial Sequence
  chemically synthesized
taagaattggcaccagagaaat

SEQ ID NO: 1363551 - DNA, 22 bp, Artificial Sequence
  chemically synthesized
ttctttcttccatttctctggt

SEQ ID NO: 1363552 - DNA, 22 bp, Artificial Sequence
  chemically synthesized
tttcttccatttctctggtgcc

SEQ ID NO: 1363553 - DNA, 22 bp, Artificial Sequence
  chemically synthesized
tcttccatttctctggtgccaa

SEQ ID NO: 1363554 - DNA, 22 bp, Artificial Sequence
  chemically synthesized
cttccatttctctggtgccaat

SEQ ID NO: 1363555 - DNA, 22 bp, Artificial Sequence
  chemically synthesized
ttccatttctctggtgccaatt

SEQ ID NO: 1363556 - DNA, 22 bp, Artificial Sequence
  chemically synthesized
ccatttctctggtgccaattct

SEQ ID NO: 1363557 - DNA, 22 bp, Artificial Sequence
  chemically synthesized
catttctctggtgccaattctt

SEQ ID NO: 1363558 - DNA, 22 bp, Artificial Sequence
  chemically synthesized
aaaaaatggtgttttaagaatt

SEQ ID NO: 1363559 - DNA, 22 bp, Artificial Sequence
  chemically synthesized
ctctggtgccaattcttaaaac

SEQ ID NO: 1363560 - DNA, 22 bp, Artificial Sequence
  chemically synthesized
tctggtgccaattcttaaaaca

SEQ ID NO: 1363561 - DNA, 22 bp, Artificial Sequence
  chemically synthesized
tggtgccaattcttaaaacacc

SEQ ID NO: 1363562 - DNA, 22 bp, Artificial Sequence
  chemically synthesized
gtgccaattcttaaaacaccat

SEQ ID NO: 1363563 - DNA, 22 bp, Artificial Sequence
  chemically synthesized
aatgtctaaaaaaatggtgttt

SEQ ID NO: 1363564 - DNA, 22 bp, Artificial Sequence
  chemically synthesized
actcaatgtctaaaaaaatggt

SEQ ID NO: 1363565 - DNA, 22 bp, Artificial Sequence
  chemically synthesized
ttaaaacaccatttttttagac

SEQ ID NO: 1363566 - DNA, 22 bp, Artificial Sequence
  chemically synthesized
aaaacaccatttttttagacat

SEQ ID NO: 1363567 - DNA, 22 bp, Artificial Sequence
  chemically synthesized
aaacaccatttttttagacatt

SEQ ID NO: 1363568 - DNA, 22 bp, Artificial Sequence
  chemically synthesized
aatgatcattaactcaatgtct

SEQ ID NO: 1363569 - DNA, 22 bp, Artificial Sequence
  chemically synthesized
ttttagacattgagttaatgat

SEQ ID NO: 1363570 - DNA, 22 bp, Artificial Sequence
  chemically synthesized
tttagacattgagttaatgatc

SEQ ID NO: 1363571 - DNA, 22 bp, Artificial Sequence
  chemically synthesized
ttagacattgagttaatgatca

SEQ ID NO: 1363572 - DNA, 22 bp, Artificial Sequence
  chemically synthesized
agaaccattaaatgatcattaa

SEQ ID NO: 1363573 - DNA, 22 bp, Artificial Sequence
  chemically synthesized
tagacattgagttaatgatcat

SEQ ID NO: 1363574 - DNA, 22 bp, Artificial Sequence
  chemically synthesized
agacattgagttaatgatcatt

SEQ ID NO: 1363575 - DNA, 22 bp, Artificial Sequence
  chemically synthesized
gacattgagttaatgatcattt

SEQ ID NO: 1363576 - DNA, 22 bp, Artificial Sequence
  chemically synthesized
ttcagaaccattaaatgatcat

SEQ ID NO: 1363577 - DNA, 22 bp, Artificial Sequence
  chemically synthesized
tattcagaaccattaaatgatc

SEQ ID NO: 1363578 - DNA, 22 bp, Artificial Sequence
  chemically synthesized
agttaatgatcatttaatggtt

SEQ ID NO: 1363579 - DNA, 22 bp, Artificial Sequence
  chemically synthesized
atgatcatttaatggttctgaa

SEQ ID NO: 1363580 - DNA, 22 bp, Artificial Sequence
  chemically synthesized
atacagaaaacaagcctctatt

SEQ ID NO: 1363581 - DNA, 22 bp, Artificial Sequence
  chemically synthesized
aatacagaaaacaagcctctat

SEQ ID NO: 1363582 - DNA, 22 bp, Artificial Sequence
  chemically synthesized
aatggttctgaatagaggcttg

SEQ ID NO: 1363583 - DNA, 22 bp, Artificial Sequence
  chemically synthesized
atggttctgaatagaggcttgt

SEQ ID NO: 1363584 - DNA, 22 bp, Artificial Sequence
  chemically synthesized
acttaatacagaaaacaagcct

SEQ ID NO: 1363585 - DNA, 22 bp, Artificial Sequence
  chemically synthesized
tgaatagaggcttgttttctgt

SEQ ID NO: 1363586 - DNA, 22 bp, Artificial Sequence
  chemically synthesized
tattcacttaatacagaaaaca

SEQ ID NO: 1363587 - DNA, 22 bp, Artificial Sequence
  chemically synthesized
aatagaggcttgttttctgtat

SEQ ID NO: 1363588 - DNA, 22 bp, Artificial Sequence
  chemically synthesized
gttttctgtattaagtgaatac

SEQ ID NO: 1363589 - DNA, 22 bp, Artificial Sequence
  chemically synthesized
ttttctgtattaagtgaataca

SEQ ID NO: 1363590 - DNA, 22 bp, Artificial Sequence
  chemically synthesized
tctgtattaagtgaatacagtt

SEQ ID NO: 1363591 - DNA, 22 bp, Artificial Sequence
  chemically synthesized
ctgtattaagtgaatacagttg

SEQ ID NO: 1363592 - DNA, 22 bp, Artificial Sequence
  chemically synthesized
aatgacataatacaactgtatt

SEQ ID NO: 1363593 - DNA, 22 bp, Artificial Sequence
  chemically synthesized
tgtattaagtgaatacagttgt

SEQ ID NO: 1363594 - DNA, 22 bp, Artificial Sequence
  chemically synthesized
tattaagtgaatacagttgtat

SEQ ID NO: 1363595 - DNA, 22 bp, Artificial Sequence
  chemically synthesized
catgctgaatgacataatacaa

SEQ ID NO: 1363596 - DNA, 22 bp, Artificial Sequence
  chemically synthesized
agtgaatacagttgtattatgt

SEQ ID NO: 1363597 - DNA, 22 bp, Artificial Sequence
  chemically synthesized
acatgctgaatgacataataca

SEQ ID NO: 1363598 - DNA, 22 bp, Artificial Sequence
  chemically synthesized
tattatgtcattcagcatgtaa

SEQ ID NO: 1363599 - DNA, 22 bp, Artificial Sequence
  chemically synthesized
gcaaagaatgatttacatgctg

SEQ ID NO: 1363600 - DNA, 22 bp, Artificial Sequence
  chemically synthesized
ttggcaaagaatgatttacatg

SEQ ID NO: 1363601 - DNA, 22 bp, Artificial Sequence
  chemically synthesized
tgtcattcagcatgtaaatcat

SEQ ID NO: 1363602 - DNA, 22 bp, Artificial Sequence
  chemically synthesized
tattggcaaagaatgatttaca

SEQ ID NO: 1363603 - DNA, 22 bp, Artificial Sequence
  chemically synthesized
ctattggcaaagaatgatttac

SEQ ID NO: 1363604 - DNA, 22 bp, Artificial Sequence
  chemically synthesized
tctattggcaaagaatgattta

SEQ ID NO: 1363605 - DNA, 22 bp, Artificial Sequence
  chemically synthesized
agcatgtaaatcattctttgcc

SEQ ID NO: 1363606 - DNA, 22 bp, Artificial Sequence
  chemically synthesized
tttgccaatagaaagcttcttc

SEQ ID NO: 1363607 - DNA, 22 bp, Artificial Sequence
  chemically synthesized
tgccaatagaaagcttcttcat

SEQ ID NO: 1363608 - DNA, 22 bp, Artificial Sequence
  chemically synthesized
gccaatagaaagcttcttcatc

SEQ ID NO: 1363609 - DNA, 22 bp, Artificial Sequence
  chemically synthesized
ccaatagaaagcttcttcatct

SEQ ID NO: 1363610 - DNA, 22 bp, Artificial Sequence
  chemically synthesized
cataaaagtaataaggaacaag

SEQ ID NO: 1363611 - DNA, 22 bp, Artificial Sequence
  chemically synthesized
ttgcataaaagtaataaggaac

SEQ ID NO: 1363612 - DNA, 22 bp, Artificial Sequence
  chemically synthesized
cttcatcttgttccttattact

SEQ ID NO: 1363613 - DNA, 22 bp, Artificial Sequence
  chemically synthesized
ttcatcttgttccttattactt

SEQ ID NO: 1363614 - DNA, 22 bp, Artificial Sequence
  chemically synthesized
gcctgttgcataaaagtaataa

SEQ ID NO: 1363615 - DNA, 22 bp, Artificial Sequence
  chemically synthesized
catcttgttccttattactttt

SEQ ID NO: 1363616 - DNA, 22 bp, Artificial Sequence
  chemically synthesized
atcttgttccttattactttta

SEQ ID NO: 1363617 - DNA, 22 bp, Artificial Sequence
  chemically synthesized
ggctcgcctgttgcataaaagt

SEQ ID NO: 1363618 - DNA, 22 bp, Artificial Sequence
  chemically synthesized
gggctcgcctgttgcataaaag

SEQ ID NO: 1363619 - DNA, 22 bp, Artificial Sequence
  chemically synthesized
gttccttattacttttatgcaa

SEQ ID NO: 1363620 - DNA, 22 bp, Artificial Sequence
  chemically synthesized
tgggctcgcctgttgcataaaa

SEQ ID NO: 1363621 - DNA, 22 bp, Artificial Sequence
  chemically synthesized
ttccttattacttttatgcaac

SEQ ID NO: 1363622 - DNA, 22 bp, Artificial Sequence
  chemically synthesized
cttattacttttatgcaacagg

SEQ ID NO: 1363623 - DNA, 22 bp, Artificial Sequence
  chemically synthesized
attacttttatgcaacaggcga

SEQ ID NO: 1363624 - DNA, 22 bp, Artificial Sequence
  chemically synthesized
tcaattttgggctcgcctgttg

SEQ ID NO: 1363625 - DNA, 22 bp, Artificial Sequence
  chemically synthesized
ttacttttatgcaacaggcgag

SEQ ID NO: 1363626 - DNA, 22 bp, Artificial Sequence
  chemically synthesized
tatcaattttgggctcgcctgt

SEQ ID NO: 1363627 - DNA, 22 bp, Artificial Sequence
  chemically synthesized
ctatcaattttgggctcgcctg

SEQ ID NO: 1363628 - DNA, 22 bp, Artificial Sequence
  chemically synthesized
cttttatgcaacaggcgagccc

SEQ ID NO: 1363629 - DNA, 22 bp, Artificial Sequence
  chemically synthesized
tctatcaattttgggctcgcct

SEQ ID NO: 1363630 - DNA, 22 bp, Artificial Sequence
  chemically synthesized
ttatgcaacaggcgagcccaaa

SEQ ID NO: 1363631 - DNA, 22 bp, Artificial Sequence
  chemically synthesized
tatgcaacaggcgagcccaaaa

SEQ ID NO: 1363632 - DNA, 22 bp, Artificial Sequence
  chemically synthesized
atgcaacaggcgagcccaaaat

SEQ ID NO: 1363633 - DNA, 22 bp, Artificial Sequence
  chemically synthesized
tgcaacaggcgagcccaaaatt

SEQ ID NO: 1363634 - DNA, 22 bp, Artificial Sequence
  chemically synthesized
caatgttttctatcaattttgg

SEQ ID NO: 1363635 - DNA, 22 bp, Artificial Sequence
  chemically synthesized
ccaatgttttctatcaattttg

SEQ ID NO: 1363636 - DNA, 22 bp, Artificial Sequence
  chemically synthesized
aaaaatgtttccaatgttttct

SEQ ID NO: 1363637 - DNA, 22 bp, Artificial Sequence
  chemically synthesized
aaaaaatgtttccaatgttttc

SEQ ID NO: 1363638 - DNA, 22 bp, Artificial Sequence
  chemically synthesized
taaaaaatgtttccaatgtttt

SEQ ID NO: 1363639 - DNA, 22 bp, Artificial Sequence
  chemically synthesized
tttaaaaaatgtttccaatgtt

SEQ ID NO: 1363640 - DNA, 22 bp, Artificial Sequence
  chemically synthesized
ctttaaaaaatgtttccaatgt

SEQ ID NO: 1363641 - DNA, 22 bp, Artificial Sequence
  chemically synthesized
tctttaaaaaatgtttccaatg

SEQ ID NO: 1363642 - DNA, 22 bp, Artificial Sequence
  chemically synthesized
atagaaaacattggaaacattt

SEQ ID NO: 1363643 - DNA, 22 bp, Artificial Sequence
  chemically synthesized
taaaaagaatatctttctttaa

SEQ ID NO: 1363644 - DNA, 22 bp, Artificial Sequence
  chemically synthesized
gaaacattttttaaagaaagat

SEQ ID NO: 1363645 - DNA, 22 bp, Artificial Sequence
  chemically synthesized
taactataaaaagaatatcttt

SEQ ID NO: 1363646 - DNA, 22 bp, Artificial Sequence
  chemically synthesized
ttataactataaaaagaatatc

SEQ ID NO: 1363647 - DNA, 22 bp, Artificial Sequence
  chemically synthesized
tttaaagaaagatattcttttt

SEQ ID NO: 1363648 - DNA, 22 bp, Artificial Sequence
  chemically synthesized
ttaaagaaagatattcttttta

SEQ ID NO: 1363649 - DNA, 22 bp, Artificial Sequence
  chemically synthesized
taaagaaagatattctttttat

SEQ ID NO: 1363650 - DNA, 22 bp, Artificial Sequence
  chemically synthesized
aaagaaagatattctttttata

SEQ ID NO: 1363651 - DNA, 22 bp, Artificial Sequence
  chemically synthesized
aagaaagatattctttttatag

SEQ ID NO: 1363652 - DNA, 22 bp, Artificial Sequence
  chemically synthesized
gtagggattattataactataa

SEQ ID NO: 1363653 - DNA, 22 bp, Artificial Sequence
  chemically synthesized
agtagggattattataactata

SEQ ID NO: 1363654 - DNA, 22 bp, Artificial Sequence
  chemically synthesized
tagtagggattattataactat

SEQ ID NO: 1363655 - DNA, 22 bp, Artificial Sequence
  chemically synthesized
tttttatagttataataatccc

SEQ ID NO: 1363656 - DNA, 22 bp, Artificial Sequence
  chemically synthesized
tttatagttataataatcccta

SEQ ID NO: 1363657 - DNA, 22 bp, Artificial Sequence
  chemically synthesized
ttatagttataataatccctac

SEQ ID NO: 1363658 - DNA, 22 bp, Artificial Sequence
  chemically synthesized
tatagttataataatccctact

SEQ ID NO: 1363659 - DNA, 22 bp, Artificial Sequence
  chemically synthesized
atagttataataatccctacta

SEQ ID NO: 1363660 - DNA, 22 bp, Artificial Sequence
  chemically synthesized
aaacaaaaattttagtagggat

SEQ ID NO: 1363661 - DNA, 22 bp, Artificial Sequence
  chemically synthesized
tagttataataatccctactaa

SEQ ID NO: 1363662 - DNA, 22 bp, Artificial Sequence
  chemically synthesized
taataatccctactaaaatttt

SEQ ID NO: 1363663 - DNA, 22 bp, Artificial Sequence
  chemically synthesized
ctaaaatttttgtttgagtgtt

SEQ ID NO: 1363664 - DNA, 22 bp, Artificial Sequence
  chemically synthesized
aaatttttgtttgagtgttttt

SEQ ID NO: 1363665 - DNA, 22 bp, Artificial Sequence
  chemically synthesized
acaaatggtacaataaaaacac

SEQ ID NO: 1363666 - DNA, 22 bp, Artificial Sequence
  chemically synthesized
aacaaatggtacaataaaaaca

SEQ ID NO: 1363667 - DNA, 22 bp, Artificial Sequence
  chemically synthesized
taacaaatggtacaataaaaac

SEQ ID NO: 1363668 - DNA, 22 bp, Artificial Sequence
  chemically synthesized
ttgtttgagtgtttttattgta

SEQ ID NO: 1363669 - DNA, 22 bp, Artificial Sequence
  chemically synthesized
tgtttgagtgtttttattgtac

SEQ ID NO: 1363670 - DNA, 22 bp, Artificial Sequence
  chemically synthesized
gtttgagtgtttttattgtacc

SEQ ID NO: 1363671 - DNA, 22 bp, Artificial Sequence
  chemically synthesized
tttgagtgtttttattgtacca

SEQ ID NO: 1363672 - DNA, 22 bp, Artificial Sequence
  chemically synthesized
tcactttaacaaatggtacaat

SEQ ID NO: 1363673 - DNA, 22 bp, Artificial Sequence
  chemically synthesized
gagtgtttttattgtaccattt

SEQ ID NO: 1363674 - DNA, 22 bp, Artificial Sequence
  chemically synthesized
agtgtttttattgtaccatttg

SEQ ID NO: 1363675 - DNA, 22 bp, Artificial Sequence
  chemically synthesized
ttattgtaccatttgttaaagt

SEQ ID NO: 1363676 - DNA, 22 bp, Artificial Sequence
  chemically synthesized
tattgtaccatttgttaaagtg

SEQ ID NO: 1363677 - DNA, 22 bp, Artificial Sequence
  chemically synthesized
attgtaccatttgttaaagtga

SEQ ID NO: 1363678 - DNA, 22 bp, Artificial Sequence
  chemically synthesized
ttgtaccatttgttaaagtgac

SEQ ID NO: 1363679 - DNA, 22 bp, Artificial Sequence
  chemically synthesized
taccatttgttaaagtgacaga

SEQ ID NO: 1363680 - DNA, 22 bp, Artificial Sequence
  chemically synthesized
acatagaaaaatgagtctgtca

SEQ ID NO: 1363681 - DNA, 22 bp, Artificial Sequence
  chemically synthesized
gacatagaaaaatgagtctgtc

SEQ ID NO: 1363682 - DNA, 22 bp, Artificial Sequence
  chemically synthesized
gttaaagtgacagactcatttt

SEQ ID NO: 1363683 - DNA, 22 bp, Artificial Sequence
  chemically synthesized
ttaaagtgacagactcattttt

SEQ ID NO: 1363684 - DNA, 22 bp, Artificial Sequence
  chemically synthesized
aatgtttgacatagaaaaatga

SEQ ID NO: 1363685 - DNA, 22 bp, Artificial Sequence
  chemically synthesized
aagtgacagactcatttttcta

SEQ ID NO: 1363686 - DNA, 22 bp, Artificial Sequence
  chemically synthesized
atttttctatgtcaaacattca

SEQ ID NO: 1363687 - DNA, 22 bp, Artificial Sequence
  chemically synthesized
cagtcgcaagcagttgaatgtt

SEQ ID NO: 1363688 - DNA, 22 bp, Artificial Sequence
  chemically synthesized
ttctatgtcaaacattcaactg

SEQ ID NO: 1363689 - DNA, 22 bp, Artificial Sequence
  chemically synthesized
tctatgtcaaacattcaactgc

SEQ ID NO: 1363690 - DNA, 22 bp, Artificial Sequence
  chemically synthesized
ctatgtcaaacattcaactgct

SEQ ID NO: 1363691 - DNA, 22 bp, Artificial Sequence
  chemically synthesized
attgcagtcgcaagcagttgaa

SEQ ID NO: 1363692 - DNA, 22 bp, Artificial Sequence
  chemically synthesized
tatgtcaaacattcaactgctt

SEQ ID NO: 1363693 - DNA, 22 bp, Artificial Sequence
  chemically synthesized
tgtcaaacattcaactgcttgc

SEQ ID NO: 1363694 - DNA, 22 bp, Artificial Sequence
  chemically synthesized
ctcattgcagtcgcaagcagtt

SEQ ID NO: 1363695 - DNA, 22 bp, Artificial Sequence
  chemically synthesized
ttactcattgcagtcgcaagca

SEQ ID NO: 1363696 - DNA, 22 bp, Artificial Sequence
  chemically synthesized
tctattactcattgcagtcgca

SEQ ID NO: 1363697 - DNA, 22 bp, Artificial Sequence
  chemically synthesized
atctattactcattgcagtcgc

SEQ ID NO: 1363698 - DNA, 22 bp, Artificial Sequence
  chemically synthesized
tatctattactcattgcagtcg

SEQ ID NO: 1363699 - DNA, 22 bp, Artificial Sequence
  chemically synthesized
ttatctattactcattgcagtc

SEQ ID NO: 1363700 - DNA, 22 bp, Artificial Sequence
  chemically synthesized
aactgcttgcgactgcaatgag

SEQ ID NO: 1363701 - DNA, 22 bp, Artificial Sequence
  chemically synthesized
atttttatctattactcattgc

SEQ ID NO: 1363702 - DNA, 22 bp, Artificial Sequence
  chemically synthesized
aatttttatctattactcattg

SEQ ID NO: 1363703 - DNA, 22 bp, Artificial Sequence
  chemically synthesized
taatttttatctattactcatt

SEQ ID NO: 1363704 - DNA, 22 bp, Artificial Sequence
  chemically synthesized
cttgcgactgcaatgagtaata

SEQ ID NO: 1363705 - DNA, 22 bp, Artificial Sequence
  chemically synthesized
ttaatttttatctattactcat

SEQ ID NO: 1363706 - DNA, 22 bp, Artificial Sequence
  chemically synthesized
tttaatttttatctattactca

SEQ ID NO: 1363707 - DNA, 22 bp, Artificial Sequence
  chemically synthesized
ttttaatttttatctattactc

SEQ ID NO: 1363708 - DNA, 22 bp, Artificial Sequence
  chemically synthesized
gcgactgcaatgagtaatagat

SEQ ID NO: 1363709 - DNA, 22 bp, Artificial Sequence
  chemically synthesized
cgactgcaatgagtaatagata

SEQ ID NO: 1363710 - DNA, 22 bp, Artificial Sequence
  chemically synthesized
aatatttttttaatttttatct

SEQ ID NO: 1363711 - DNA, 22 bp, Artificial Sequence
  chemically synthesized
caatgagtaatagataaaaatt

SEQ ID NO: 1363712 - DNA, 22 bp, Artificial Sequence
  chemically synthesized
actcaatatttttttaattttt

SEQ ID NO: 1363713 - DNA, 22 bp, Artificial Sequence
  chemically synthesized
aggtaaacatcacagtctgact

SEQ ID NO: 1363714 - DNA, 22 bp, Artificial Sequence
  chemically synthesized
aaaaaatattgagtcagactgt

SEQ ID NO: 1363715 - DNA, 22 bp, Artificial Sequence
  chemically synthesized
ttaaggtaaacatcacagtctg

SEQ ID NO: 1363716 - DNA, 22 bp, Artificial Sequence
  chemically synthesized
actattaaggtaaacatcacag

SEQ ID NO: 1363717 - DNA, 22 bp, Artificial Sequence
  chemically synthesized
agtcagactgtgatgtttacct

SEQ ID NO: 1363718 - DNA, 22 bp, Artificial Sequence
  chemically synthesized
tgatgtttaccttaatagttaa

SEQ ID NO: 1363719 - DNA, 22 bp, Artificial Sequence
  chemically synthesized
aaacacaaaatgtacaattaac

SEQ ID NO: 1363720 - DNA, 22 bp, Artificial Sequence
  chemically synthesized
taaaacacaaaatgtacaatta

SEQ ID NO: 1363721 - DNA, 22 bp, Artificial Sequence
  chemically synthesized
accttaatagttaattgtacat

SEQ ID NO: 1363722 - DNA, 22 bp, Artificial Sequence
  chemically synthesized
ccttaatagttaattgtacatt

SEQ ID NO: 1363723 - DNA, 22 bp, Artificial Sequence
  chemically synthesized
aatagttaattgtacattttgt

SEQ ID NO: 1363724 - DNA, 22 bp, Artificial Sequence
  chemically synthesized
atagttaattgtacattttgtg

SEQ ID NO: 1363725 - DNA, 22 bp, Artificial Sequence
  chemically synthesized
attgtacattttgtgttttaga

SEQ ID NO: 1363726 - DNA, 22 bp, Artificial Sequence
  chemically synthesized
tgacaataatattctaaaacac

SEQ ID NO: 1363727 - DNA, 22 bp, Artificial Sequence
  chemically synthesized
tacattttgtgttttagaatat

SEQ ID NO: 1363728 - DNA, 22 bp, Artificial Sequence
  chemically synthesized
tgtgttttagaatattattgtc

SEQ ID NO: 1363729 - DNA, 22 bp, Artificial Sequence
  chemically synthesized
gtgttttagaatattattgtca

SEQ ID NO: 1363730 - DNA, 22 bp, Artificial Sequence
  chemically synthesized
tgttttagaatattattgtcat

SEQ ID NO: 1363731 - DNA, 22 bp, Artificial Sequence
  chemically synthesized
tagaatattattgtcataacat

SEQ ID NO: 1363732 - DNA, 22 bp, Artificial Sequence
  chemically synthesized
gggaaaatagcaatgttatgac

SEQ ID NO: 1363733 - DNA, 22 bp, Artificial Sequence
  chemically synthesized
agaatattattgtcataacatt

SEQ ID NO: 1363734 - DNA, 22 bp, Artificial Sequence
  chemically synthesized
gaatattattgtcataacattg

SEQ ID NO: 1363735 - DNA, 22 bp, Artificial Sequence
  chemically synthesized
ctggggaaaatagcaatgttat

SEQ ID NO: 1363736 - DNA, 22 bp, Artificial Sequence
  chemically synthesized
gctggggaaaatagcaatgtta

SEQ ID NO: 1363737 - DNA, 22 bp, Artificial Sequence
  chemically synthesized
tgctggggaaaatagcaatgtt

SEQ ID NO: 1363738 - DNA, 22 bp, Artificial Sequence
  chemically synthesized
ttgctggggaaaatagcaatgt

SEQ ID NO: 1363739 - DNA, 22 bp, Artificial Sequence
  chemically synthesized
ttgtcataacattgctattttc

SEQ ID NO: 1363740 - DNA, 22 bp, Artificial Sequence
  chemically synthesized
tcataacattgctattttcccc

SEQ ID NO: 1363741 - DNA, 22 bp, Artificial Sequence
  chemically synthesized
atacaccttttgctggggaaaa

SEQ ID NO: 1363742 - DNA, 22 bp, Artificial Sequence
  chemically synthesized
tctcatacaccttttgctgggg

SEQ ID NO: 1363743 - DNA, 22 bp, Artificial Sequence
  chemically synthesized
atctcatacaccttttgctggg

SEQ ID NO: 1363744 - DNA, 22 bp, Artificial Sequence
  chemically synthesized
tatctcatacaccttttgctgg

SEQ ID NO: 1363745 - DNA, 22 bp, Artificial Sequence
  chemically synthesized
ctattttccccagcaaaaggtg

SEQ ID NO: 1363746 - DNA, 22 bp, Artificial Sequence
  chemically synthesized
tgttttatctcatacacctttt

SEQ ID NO: 1363747 - DNA, 22 bp, Artificial Sequence
  chemically synthesized
ttttccccagcaaaaggtgtat

SEQ ID NO: 1363748 - DNA, 22 bp, Artificial Sequence
  chemically synthesized
atgttttatctcatacaccttt

SEQ ID NO: 1363749 - DNA, 22 bp, Artificial Sequence
  chemically synthesized
tccccagcaaaaggtgtatgag

SEQ ID NO: 1363750 - DNA, 22 bp, Artificial Sequence
  chemically synthesized
ccccagcaaaaggtgtatgaga

SEQ ID NO: 1363751 - DNA, 22 bp, Artificial Sequence
  chemically synthesized
cccagcaaaaggtgtatgagat

SEQ ID NO: 1363752 - DNA, 22 bp, Artificial Sequence
  chemically synthesized
ggccttatgttttatctcatac

SEQ ID NO: 1363753 - DNA, 22 bp, Artificial Sequence
  chemically synthesized
aaattaggccttatgttttatc

SEQ ID NO: 1363754 - DNA, 22 bp, Artificial Sequence
  chemically synthesized
aattaaaattaggccttatgtt

SEQ ID NO: 1363755 - DNA, 22 bp, Artificial Sequence
  chemically synthesized
aaattaaaattaggccttatgt

SEQ ID NO: 1363756 - DNA, 22 bp, Artificial Sequence
  chemically synthesized
taaattaaaattaggccttatg

SEQ ID NO: 1363757 - DNA, 22 bp, Artificial Sequence
  chemically synthesized
gggaaaagaatgttttaaatta

SEQ ID NO: 1363758 - DNA, 22 bp, Artificial Sequence
  chemically synthesized
attttaatttaaaacattcttt

SEQ ID NO: 1363759 - DNA, 22 bp, Artificial Sequence
  chemically synthesized
taatttaaaacattcttttccc

SEQ ID NO: 1363760 - DNA, 22 bp, Artificial Sequence
  chemically synthesized
aatttaaaacattcttttccct

SEQ ID NO: 1363761 - DNA, 22 bp, Artificial Sequence
  chemically synthesized
atttaaaacattcttttcccta

SEQ ID NO: 1363762 - DNA, 22 bp, Artificial Sequence
  chemically synthesized
aaaacattcttttccctaggtc

SEQ ID NO: 1363763 - DNA, 22 bp, Artificial Sequence
  chemically synthesized
aaacattcttttccctaggtca

SEQ ID NO: 1363764 - DNA, 22 bp, Artificial Sequence
  chemically synthesized
agaggaaaggaggtgacctagg

SEQ ID NO: 1363765 - DNA, 22 bp, Artificial Sequence
  chemically synthesized
ttttccctaggtcacctccttt

SEQ ID NO: 1363766 - DNA, 22 bp, Artificial Sequence
  chemically synthesized
ttccctaggtcacctcctttcc

SEQ ID NO: 1363767 - DNA, 22 bp, Artificial Sequence
  chemically synthesized
tccctaggtcacctcctttcct

SEQ ID NO: 1363768 - DNA, 22 bp, Artificial Sequence
  chemically synthesized
ccctaggtcacctcctttcctc

SEQ ID NO: 1363769 - DNA, 22 bp, Artificial Sequence
  chemically synthesized
cctaggtcacctcctttcctct

SEQ ID NO: 1363770 - DNA, 22 bp, Artificial Sequence
  chemically synthesized
gacaaccacactgagaggaaag

SEQ ID NO: 1363771 - DNA, 22 bp, Artificial Sequence
  chemically synthesized
agacaaccacactgagaggaaa

SEQ ID NO: 1363772 - DNA, 22 bp, Artificial Sequence
  chemically synthesized
ggtcacctcctttcctctcagt

SEQ ID NO: 1363773 - DNA, 22 bp, Artificial Sequence
  chemically synthesized
ctttcctctcagtgtggttgtc

SEQ ID NO: 1363774 - DNA, 22 bp, Artificial Sequence
  chemically synthesized
tatgcatatttagacaaccaca

SEQ ID NO: 1363775 - DNA, 22 bp, Artificial Sequence
  chemically synthesized
atatgcatatttagacaaccac

SEQ ID NO: 1363776 - DNA, 22 bp, Artificial Sequence
  chemically synthesized
tcctctcagtgtggttgtctaa

SEQ ID NO: 1363777 - DNA, 22 bp, Artificial Sequence
  chemically synthesized
cctctcagtgtggttgtctaaa

SEQ ID NO: 1363778 - DNA, 22 bp, Artificial Sequence
  chemically synthesized
cttatatgcatatttagacaac

SEQ ID NO: 1363779 - DNA, 22 bp, Artificial Sequence
  chemically synthesized
ctctcagtgtggttgtctaaat

SEQ ID NO: 1363780 - DNA, 22 bp, Artificial Sequence
  chemically synthesized
gcttatatgcatatttagacaa

SEQ ID NO: 1363781 - DNA, 22 bp, Artificial Sequence
  chemically synthesized
tgcttatatgcatatttagaca

SEQ ID NO: 1363782 - DNA, 22 bp, Artificial Sequence
  chemically synthesized
tcagtgtggttgtctaaatatg

SEQ ID NO: 1363783 - DNA, 22 bp, Artificial Sequence
  chemically synthesized
agtgtggttgtctaaatatgca

SEQ ID NO: 1363784 - DNA, 22 bp, Artificial Sequence
  chemically synthesized
tgaaaattttgcttatatgcat

SEQ ID NO: 1363785 - DNA, 22 bp, Artificial Sequence
  chemically synthesized
atgaaaattttgcttatatgca

SEQ ID NO: 1363786 - DNA, 22 bp, Artificial Sequence
  chemically synthesized
tatgaaaattttgcttatatgc

SEQ ID NO: 1363787 - DNA, 22 bp, Artificial Sequence
  chemically synthesized
tctaaatatgcatataagcaaa

SEQ ID NO: 1363788 - DNA, 22 bp, Artificial Sequence
  chemically synthesized
ttttatgaaaattttgcttata

SEQ ID NO: 1363789 - DNA, 22 bp, Artificial Sequence
  chemically synthesized
aatatgcatataagcaaaattt

SEQ ID NO: 1363790 - DNA, 22 bp, Artificial Sequence
  chemically synthesized
tgttgttttatgaaaattttgc

SEQ ID NO: 1363791 - DNA, 22 bp, Artificial Sequence
  chemically synthesized
tatgttgttttatgaaaatttt

SEQ ID NO: 1363792 - DNA, 22 bp, Artificial Sequence
  chemically synthesized
ctatgttgttttatgaaaattt

SEQ ID NO: 1363793 - DNA, 22 bp, Artificial Sequence
  chemically synthesized
tctatgttgttttatgaaaatt

SEQ ID NO: 1363794 - DNA, 22 bp, Artificial Sequence
  chemically synthesized
ttctatgttgttttatgaaaat

SEQ ID NO: 1363795 - DNA, 22 bp, Artificial Sequence
  chemically synthesized
tttctatgttgttttatgaaaa

SEQ ID NO: 1363796 - DNA, 22 bp, Artificial Sequence
  chemically synthesized
attttttctatgttgttttatg

SEQ ID NO: 1363797 - DNA, 22 bp, Artificial Sequence
  chemically synthesized
cattttttctatgttgttttat

SEQ ID NO: 1363798 - DNA, 22 bp, Artificial Sequence
  chemically synthesized
tcattttttctatgttgtttta

SEQ ID NO: 1363799 - DNA, 22 bp, Artificial Sequence
  chemically synthesized
ttcattttttctatgttgtttt

SEQ ID NO: 1363800 - DNA, 22 bp, Artificial Sequence
  chemically synthesized
tttcattttttctatgttgttt

SEQ ID NO: 1363801 - DNA, 22 bp, Artificial Sequence
  chemically synthesized
tcataaaacaacatagaaaaaa

SEQ ID NO: 1363802 - DNA, 22 bp, Artificial Sequence
  chemically synthesized
cataaaacaacatagaaaaaat

SEQ ID NO: 1363803 - DNA, 22 bp, Artificial Sequence
  chemically synthesized
ataaaacaacatagaaaaaatg

SEQ ID NO: 1363804 - DNA, 22 bp, Artificial Sequence
  chemically synthesized
gagccaaatcagccccaaaaca

SEQ ID NO: 1363805 - DNA, 22 bp, Artificial Sequence
  chemically synthesized
agagccaaatcagccccaaaac

SEQ ID NO: 1363806 - DNA, 22 bp, Artificial Sequence
  chemically synthesized
acatgcagacttagagccaaat

SEQ ID NO: 1363807 - DNA, 22 bp, Artificial Sequence
  chemically synthesized
ttttggggctgatttggctcta

SEQ ID NO: 1363808 - DNA, 22 bp, Artificial Sequence
  chemically synthesized
tggggctgatttggctctaagt

SEQ ID NO: 1363809 - DNA, 22 bp, Artificial Sequence
  chemically synthesized
ggggctgatttggctctaagtc

SEQ ID NO: 1363810 - DNA, 22 bp, Artificial Sequence
  chemically synthesized
gggctgatttggctctaagtct

SEQ ID NO: 1363811 - DNA, 22 bp, Artificial Sequence
  chemically synthesized
atgctaacatgcagacttagag

SEQ ID NO: 1363812 - DNA, 22 bp, Artificial Sequence
  chemically synthesized
atttggctctaagtctgcatgt

SEQ ID NO: 1363813 - DNA, 22 bp, Artificial Sequence
  chemically synthesized
ggctctaagtctgcatgttagc

SEQ ID NO: 1363814 - DNA, 22 bp, Artificial Sequence
  chemically synthesized
gctctaagtctgcatgttagca

SEQ ID NO: 1363815 - DNA, 22 bp, Artificial Sequence
  chemically synthesized
taagtctgcatgttagcatcag

SEQ ID NO: 1363816 - DNA, 22 bp, Artificial Sequence
  chemically synthesized
agtctgcatgttagcatcagtg

SEQ ID NO: 1363817 - DNA, 22 bp, Artificial Sequence
  chemically synthesized
acagcatagagggacactgatg

SEQ ID NO: 1363818 - DNA, 22 bp, Artificial Sequence
  chemically synthesized
catgttagcatcagtgtccctc

SEQ ID NO: 1363819 - DNA, 22 bp, Artificial Sequence
  chemically synthesized
tacctcacagcatagagggaca

SEQ ID NO: 1363820 - DNA, 22 bp, Artificial Sequence
  chemically synthesized
gcatcagtgtccctctatgctg

SEQ ID NO: 1363821 - DNA, 22 bp, Artificial Sequence
  chemically synthesized
ggcaatattgtacctcacagca

SEQ ID NO: 1363822 - DNA, 22 bp, Artificial Sequence
  chemically synthesized
tgggcaatattgtacctcacag

SEQ ID NO: 1363823 - DNA, 22 bp, Artificial Sequence
  chemically synthesized
tactctgggcaatattgtacct

SEQ ID NO: 1363824 - DNA, 22 bp, Artificial Sequence
  chemically synthesized
atactctgggcaatattgtacc

SEQ ID NO: 1363825 - DNA, 22 bp, Artificial Sequence
  chemically synthesized
tatgctgtgaggtacaatattg

SEQ ID NO: 1363826 - DNA, 22 bp, Artificial Sequence
  chemically synthesized
tgctgtgaggtacaatattgcc

SEQ ID NO: 1363827 - DNA, 22 bp, Artificial Sequence
  chemically synthesized
tgaggtacaatattgcccagag

SEQ ID NO: 1363828 - DNA, 22 bp, Artificial Sequence
  chemically synthesized
cccagagtataagtgccctttg

SEQ ID NO: 1363829 - DNA, 22 bp, Artificial Sequence
  chemically synthesized
acagtgcaagatacaaagggca

SEQ ID NO: 1363830 - DNA, 22 bp, Artificial Sequence
  chemically synthesized
tagaaaactcacagtgcaagat

SEQ ID NO: 1363831 - DNA, 22 bp, Artificial Sequence
  chemically synthesized
gtagaaaactcacagtgcaaga

SEQ ID NO: 1363832 - DNA, 22 bp, Artificial Sequence
  chemically synthesized
tgtttgtagaaaactcacagtg

SEQ ID NO: 1363833 - DNA, 22 bp, Artificial Sequence
  chemically synthesized
atgtttgtagaaaactcacagt

SEQ ID NO: 1363834 - DNA, 22 bp, Artificial Sequence
  chemically synthesized
tgtatcttgcactgtgagtttt

SEQ ID NO: 1363835 - DNA, 22 bp, Artificial Sequence
  chemically synthesized
gtatcttgcactgtgagttttc

SEQ ID NO: 1363836 - DNA, 22 bp, Artificial Sequence
  chemically synthesized
tatcttgcactgtgagttttct

SEQ ID NO: 1363837 - DNA, 22 bp, Artificial Sequence
  chemically synthesized
gcactgtgagttttctacaaac

SEQ ID NO: 1363838 - DNA, 22 bp, Artificial Sequence
  chemically synthesized
cactgtgagttttctacaaaca

SEQ ID NO: 1363839 - DNA, 22 bp, Artificial Sequence
  chemically synthesized
aacaagggtttatgtttgtaga

SEQ ID NO: 1363840 - DNA, 22 bp, Artificial Sequence
  chemically synthesized
tgagttttctacaaacataaac

SEQ ID NO: 1363841 - DNA, 22 bp, Artificial Sequence
  chemically synthesized
gcctaaacaagggtttatgttt

SEQ ID NO: 1363842 - DNA, 22 bp, Artificial Sequence
  chemically synthesized
ggcctaaacaagggtttatgtt

SEQ ID NO: 1363843 - DNA, 22 bp, Artificial Sequence
  chemically synthesized
tctacaaacataaacccttgtt

SEQ ID NO: 1363844 - DNA, 22 bp, Artificial Sequence
  chemically synthesized
ctacaaacataaacccttgttt

SEQ ID NO: 1363845 - DNA, 22 bp, Artificial Sequence
  chemically synthesized
acgccttggcctaaacaagggt

SEQ ID NO: 1363846 - DNA, 22 bp, Artificial Sequence
  chemically synthesized
tacaaacataaacccttgttta

SEQ ID NO: 1363847 - DNA, 22 bp, Artificial Sequence
  chemically synthesized
caaacataaacccttgtttagg

SEQ ID NO: 1363848 - DNA, 22 bp, Artificial Sequence
  chemically synthesized
tattcacgccttggcctaaaca

SEQ ID NO: 1363849 - DNA, 22 bp, Artificial Sequence
  chemically synthesized
gtttaggccaaggcgtgaatac

SEQ ID NO: 1363850 - DNA, 22 bp, Artificial Sequence
  chemically synthesized
tttaggccaaggcgtgaataca

SEQ ID NO: 1363851 - DNA, 22 bp, Artificial Sequence
  chemically synthesized
ggaccgacaagttgtattcacg

SEQ ID NO: 1363852 - DNA, 22 bp, Artificial Sequence
  chemically synthesized
gggaccgacaagttgtattcac

SEQ ID NO: 1363853 - DNA, 22 bp, Artificial Sequence
  chemically synthesized
aggccaaggcgtgaatacaact

SEQ ID NO: 1363854 - DNA, 22 bp, Artificial Sequence
  chemically synthesized
ggccaaggcgtgaatacaactt

SEQ ID NO: 1363855 - DNA, 22 bp, Artificial Sequence
  chemically synthesized
gtttgggaccgacaagttgtat

SEQ ID NO: 1363856 - DNA, 22 bp, Artificial Sequence
  chemically synthesized
atgttggtttgggaccgacaag

SEQ ID NO: 1363857 - DNA, 22 bp, Artificial Sequence
  chemically synthesized
ccacgtgatattgatgttggtt

SEQ ID NO: 1363858 - DNA, 22 bp, Artificial Sequence
  chemically synthesized
gtcggtcccaaaccaacatcaa

SEQ ID NO: 1363859 - DNA, 22 bp, Artificial Sequence
  chemically synthesized
tcggtcccaaaccaacatcaat

SEQ ID NO: 1363860 - DNA, 22 bp, Artificial Sequence
  chemically synthesized
agaagttcccacgtgatattga

SEQ ID NO: 1363861 - DNA, 22 bp, Artificial Sequence
  chemically synthesized
tcagaagttcccacgtgatatt

SEQ ID NO: 1363862 - DNA, 22 bp, Artificial Sequence
  chemically synthesized
ctcagaagttcccacgtgatat

SEQ ID NO: 1363863 - DNA, 22 bp, Artificial Sequence
  chemically synthesized
catttctcagaagttcccacgt

SEQ ID NO: 1363864 - DNA, 22 bp, Artificial Sequence
  chemically synthesized
gcatttctcagaagttcccacg

SEQ ID NO: 1363865 - DNA, 22 bp, Artificial Sequence
  chemically synthesized
gtgtcaacttgcatttctcaga

SEQ ID NO: 1363866 - DNA, 22 bp, Artificial Sequence
  chemically synthesized
aggtctcgtgtcaacttgcatt

SEQ ID NO: 1363867 - DNA, 22 bp, Artificial Sequence
  chemically synthesized
gaggtctcgtgtcaacttgcat

SEQ ID NO: 1363868 - DNA, 22 bp, Artificial Sequence
  chemically synthesized
tgaggtctcgtgtcaacttgca

SEQ ID NO: 1363869 - DNA, 22 bp, Artificial Sequence
  chemically synthesized
ttgaggtctcgtgtcaacttgc

SEQ ID NO: 1363870 - DNA, 22 bp, Artificial Sequence
  chemically synthesized
ctgagaaatgcaagttgacacg

SEQ ID NO: 1363871 - DNA, 22 bp, Artificial Sequence
  chemically synthesized
tgagaaatgcaagttgacacga

SEQ ID NO: 1363872 - DNA, 22 bp, Artificial Sequence
  chemically synthesized
acttttgaggtctcgtgtcaac

SEQ ID NO: 1363873 - DNA, 22 bp, Artificial Sequence
  chemically synthesized
agaaatgcaagttgacacgaga

SEQ ID NO: 1363874 - DNA, 22 bp, Artificial Sequence
  chemically synthesized
tgacttttgaggtctcgtgtca

SEQ ID NO: 1363875 - DNA, 22 bp, Artificial Sequence
  chemically synthesized
ctgacttttgaggtctcgtgtc

SEQ ID NO: 1363876 - DNA, 22 bp, Artificial Sequence
  chemically synthesized
acacgagacctcaaaagtcaga

SEQ ID NO: 1363877 - DNA, 22 bp, Artificial Sequence
  chemically synthesized
tgtcccaaccccagaatttctg

SEQ ID NO: 1363878 - DNA, 22 bp, Artificial Sequence
  chemically synthesized
aaaagtcagaaattctggggtt

SEQ ID NO: 1363879 - DNA, 22 bp, Artificial Sequence
  chemically synthesized
tggggttgggacacagcactct

SEQ ID NO: 1363880 - DNA, 22 bp, Artificial Sequence
  chemically synthesized
gggttgggacacagcactctgt

SEQ ID NO: 1363881 - DNA, 22 bp, Artificial Sequence
  chemically synthesized
gaatcaccggtaaaacacagag

SEQ ID NO: 1363882 - DNA, 22 bp, Artificial Sequence
  chemically synthesized
ggacacagcactctgtgtttta

SEQ ID NO: 1363883 - DNA, 22 bp, Artificial Sequence
  chemically synthesized
accatgcattagaatcaccggt

SEQ ID NO: 1363884 - DNA, 22 bp, Artificial Sequence
  chemically synthesized
tgtgttttaccggtgattctaa

SEQ ID NO: 1363885 - DNA, 22 bp, Artificial Sequence
  chemically synthesized
tgttttaccggtgattctaatg

SEQ ID NO: 1363886 - DNA, 22 bp, Artificial Sequence
  chemically synthesized
aaagttgaccatgcattagaat

SEQ ID NO: 1363887 - DNA, 22 bp, Artificial Sequence
  chemically synthesized
tcaaagttgaccatgcattaga

SEQ ID NO: 1363888 - DNA, 22 bp, Artificial Sequence
  chemically synthesized
ctcaaagttgaccatgcattag

SEQ ID NO: 1363889 - DNA, 22 bp, Artificial Sequence
  chemically synthesized
taccggtgattctaatgcatgg

SEQ ID NO: 1363890 - DNA, 22 bp, Artificial Sequence
  chemically synthesized
accggtgattctaatgcatggt

SEQ ID NO: 1363891 - DNA, 22 bp, Artificial Sequence
  chemically synthesized
ccggtgattctaatgcatggtc

SEQ ID NO: 1363892 - DNA, 22 bp, Artificial Sequence
  chemically synthesized
gggtttctcaaagttgaccatg

SEQ ID NO: 1363893 - DNA, 22 bp, Artificial Sequence
  chemically synthesized
agggtttctcaaagttgaccat

SEQ ID NO: 1363894 - DNA, 22 bp, Artificial Sequence
  chemically synthesized
tagggtttctcaaagttgacca

SEQ ID NO: 1363895 - DNA, 22 bp, Artificial Sequence
  chemically synthesized
taatgcatggtcaactttgaga

SEQ ID NO: 1363896 - DNA, 22 bp, Artificial Sequence
  chemically synthesized
atgcatggtcaactttgagaaa

SEQ ID NO: 1363897 - DNA, 22 bp, Artificial Sequence
  chemically synthesized
gaaacatacactttagggtttc

SEQ ID NO: 1363898 - DNA, 22 bp, Artificial Sequence
  chemically synthesized
agaaacatacactttagggttt

SEQ ID NO: 1363899 - DNA, 22 bp, Artificial Sequence
  chemically synthesized
tagaaacatacactttagggtt

SEQ ID NO: 1363900 - DNA, 22 bp, Artificial Sequence
  chemically synthesized
ttagaaacatacactttagggt

SEQ ID NO: 1363901 - DNA, 22 bp, Artificial Sequence
  chemically synthesized
tttttagaaacatacactttag

SEQ ID NO: 1363902 - DNA, 22 bp, Artificial Sequence
  chemically synthesized
tgagaaaccctaaagtgtatgt

SEQ ID NO: 1363903 - DNA, 22 bp, Artificial Sequence
  chemically synthesized
gagaaaccctaaagtgtatgtt

SEQ ID NO: 1363904 - DNA, 22 bp, Artificial Sequence
  chemically synthesized
agaaaccctaaagtgtatgttt

SEQ ID NO: 1363905 - DNA, 22 bp, Artificial Sequence
  chemically synthesized
gaaccacggttgtttttagaaa

SEQ ID NO: 1363906 - DNA, 22 bp, Artificial Sequence
  chemically synthesized
agaaccacggttgtttttagaa

SEQ ID NO: 1363907 - DNA, 22 bp, Artificial Sequence
  chemically synthesized
aagtgtatgtttctaaaaacaa

SEQ ID NO: 1363908 - DNA, 22 bp, Artificial Sequence
  chemically synthesized
catttagaaccacggttgtttt

SEQ ID NO: 1363909 - DNA, 22 bp, Artificial Sequence
  chemically synthesized
ttacatttagaaccacggttgt

SEQ ID NO: 1363910 - DNA, 22 bp, Artificial Sequence
  chemically synthesized
gttacatttagaaccacggttg

SEQ ID NO: 1363911 - DNA, 22 bp, Artificial Sequence
  chemically synthesized
tgttacatttagaaccacggtt

SEQ ID NO: 1363912 - DNA, 22 bp, Artificial Sequence
  chemically synthesized
ctaaaaacaaccgtggttctaa

SEQ ID NO: 1363913 - DNA, 22 bp, Artificial Sequence
  chemically synthesized
taaaaacaaccgtggttctaaa

SEQ ID NO: 1363914 - DNA, 22 bp, Artificial Sequence
  chemically synthesized
aaaacaaccgtggttctaaatg

SEQ ID NO: 1363915 - DNA, 22 bp, Artificial Sequence
  chemically synthesized
cccaggacacatctttgttaca

SEQ ID NO: 1363916 - DNA, 22 bp, Artificial Sequence
  chemically synthesized
gacattacccaggacacatctt

SEQ ID NO: 1363917 - DNA, 22 bp, Artificial Sequence
  chemically synthesized
taaatgtaacaaagatgtgtcc

SEQ ID NO: 1363918 - DNA, 22 bp, Artificial Sequence
  chemically synthesized
agacattacccaggacacatct

SEQ ID NO: 1363919 - DNA, 22 bp, Artificial Sequence
  chemically synthesized
tagacattacccaggacacatc

SEQ ID NO: 1363920 - DNA, 22 bp, Artificial Sequence
  chemically synthesized
aatgtaacaaagatgtgtcctg

SEQ ID NO: 1363921 - DNA, 22 bp, Artificial Sequence
  chemically synthesized
gtgctttagacattacccagga

SEQ ID NO: 1363922 - DNA, 22 bp, Artificial Sequence
  chemically synthesized
ggtgctttagacattacccagg

SEQ ID NO: 1363923 - DNA, 22 bp, Artificial Sequence
  chemically synthesized
tcaggatttggtgctttagaca

SEQ ID NO: 1363924 - DNA, 22 bp, Artificial Sequence
  chemically synthesized
ggtaatgtctaaagcaccaaat

SEQ ID NO: 1363925 - DNA, 22 bp, Artificial Sequence
  chemically synthesized
agatctatcaggatttggtgct

SEQ ID NO: 1363926 - DNA, 22 bp, Artificial Sequence
  chemically synthesized
agggcattcagatctatcagga

SEQ ID NO: 1363927 - DNA, 22 bp, Artificial Sequence
  chemically synthesized
aagcaccaaatcctgatagatc

SEQ ID NO: 1363928 - DNA, 22 bp, Artificial Sequence
  chemically synthesized
aatgtatctcagggcattcaga

SEQ ID NO: 1363929 - DNA, 22 bp, Artificial Sequence
  chemically synthesized
atagatctgaatgccctgagat

SEQ ID NO: 1363930 - DNA, 22 bp, Artificial Sequence
  chemically synthesized
aatggcaattaaatgtatctca

SEQ ID NO: 1363931 - DNA, 22 bp, Artificial Sequence
  chemically synthesized
aatgccctgagatacatttaat

SEQ ID NO: 1363932 - DNA, 22 bp, Artificial Sequence
  chemically synthesized
aggctgaatggcaattaaatgt

SEQ ID NO: 1363933 - DNA, 22 bp, Artificial Sequence
  chemically synthesized
tcaactaaggctgaatggcaat

SEQ ID NO: 1363934 - DNA, 22 bp, Artificial Sequence
  chemically synthesized
agatacatttaattgccattca

SEQ ID NO: 1363935 - DNA, 22 bp, Artificial Sequence
  chemically synthesized
attatcaactaaggctgaatgg

SEQ ID NO: 1363936 - DNA, 22 bp, Artificial Sequence
  chemically synthesized
tgattatcaactaaggctgaat

SEQ ID NO: 1363937 - DNA, 22 bp, Artificial Sequence
  chemically synthesized
aattgccattcagccttagttg

SEQ ID NO: 1363938 - DNA, 22 bp, Artificial Sequence
  chemically synthesized
attgccattcagccttagttga

SEQ ID NO: 1363939 - DNA, 22 bp, Artificial Sequence
  chemically synthesized
ccattcagccttagttgataat

SEQ ID NO: 1363940 - DNA, 22 bp, Artificial Sequence
  chemically synthesized
agccttagttgataatcagaat

SEQ ID NO: 1363941 - DNA, 22 bp, Artificial Sequence
  chemically synthesized
taggtgccaaataaattctgat

SEQ ID NO: 1363942 - DNA, 22 bp, Artificial Sequence
  chemically synthesized
agttgataatcagaatttattt

SEQ ID NO: 1363943 - DNA, 22 bp, Artificial Sequence
  chemically synthesized
gttgataatcagaatttatttg

SEQ ID NO: 1363944 - DNA, 22 bp, Artificial Sequence
  chemically synthesized
ataatcagaatttatttggcac

SEQ ID NO: 1363945 - DNA, 22 bp, Artificial Sequence
  chemically synthesized
cacacaatgcagaaatcattat

SEQ ID NO: 1363946 - DNA, 22 bp, Artificial Sequence
  chemically synthesized
atttggcacctataatgatttc

SEQ ID NO: 1363947 - DNA, 22 bp, Artificial Sequence
  chemically synthesized
tttggcacctataatgatttct

SEQ ID NO: 1363948 - DNA, 22 bp, Artificial Sequence
  chemically synthesized
ggcacctataatgatttctgca

SEQ ID NO: 1363949 - DNA, 22 bp, Artificial Sequence
  chemically synthesized
gcacctataatgatttctgcat

SEQ ID NO: 1363950 - DNA, 22 bp, Artificial Sequence
  chemically synthesized
taatgatttctgcattgtgtgg

SEQ ID NO: 1363951 - DNA, 22 bp, Artificial Sequence
  chemically synthesized
agggaagtatatgcattccaca

SEQ ID NO: 1363952 - DNA, 22 bp, Artificial Sequence
  chemically synthesized
aagggaagtatatgcattccac

SEQ ID NO: 1363953 - DNA, 22 bp, Artificial Sequence
  chemically synthesized
ctgcattgtgtggaatgcatat

SEQ ID NO: 1363954 - DNA, 22 bp, Artificial Sequence
  chemically synthesized
tgcattgtgtggaatgcatata

SEQ ID NO: 1363955 - DNA, 22 bp, Artificial Sequence
  chemically synthesized
cattgtgtggaatgcatatact

SEQ ID NO: 1363956 - DNA, 22 bp, Artificial Sequence
  chemically synthesized
taaaatcttaagggaagtatat

SEQ ID NO: 1363957 - DNA, 22 bp, Artificial Sequence
  chemically synthesized
tgtggaatgcatatacttccct

SEQ ID NO: 1363958 - DNA, 22 bp, Artificial Sequence
  chemically synthesized
gattataaaatcttaagggaag

SEQ ID NO: 1363959 - DNA, 22 bp, Artificial Sequence
  chemically synthesized
cacctggattataaaatcttaa

SEQ ID NO: 1363960 - DNA, 22 bp, Artificial Sequence
  chemically synthesized
gcacctggattataaaatctta

SEQ ID NO: 1363961 - DNA, 22 bp, Artificial Sequence
  chemically synthesized
cccttaagattttataatccag

SEQ ID NO: 1363962 - DNA, 22 bp, Artificial Sequence
  chemically synthesized
ccttaagattttataatccagg

SEQ ID NO: 1363963 - DNA, 22 bp, Artificial Sequence
  chemically synthesized
aagattttataatccaggtgca

SEQ ID NO: 1363964 - DNA, 22 bp, Artificial Sequence
  chemically synthesized
taagcatatatttgcacctgga

SEQ ID NO: 1363965 - DNA, 22 bp, Artificial Sequence
  chemically synthesized
agattttataatccaggtgcaa

SEQ ID NO: 1363966 - DNA, 22 bp, Artificial Sequence
  chemically synthesized
ttgtaagcatatatttgcacct

SEQ ID NO: 1363967 - DNA, 22 bp, Artificial Sequence
  chemically synthesized
tataatccaggtgcaaatatat

SEQ ID NO: 1363968 - DNA, 22 bp, Artificial Sequence
  chemically synthesized
ataatccaggtgcaaatatatg

SEQ ID NO: 1363969 - DNA, 22 bp, Artificial Sequence
  chemically synthesized
taatccaggtgcaaatatatgc

SEQ ID NO: 1363970 - DNA, 22 bp, Artificial Sequence
  chemically synthesized
cagttattgtaagcatatattt

SEQ ID NO: 1363971 - DNA, 22 bp, Artificial Sequence
  chemically synthesized
ccagttattgtaagcatatatt

SEQ ID NO: 1363972 - DNA, 22 bp, Artificial Sequence
  chemically synthesized
tccagttattgtaagcatatat

SEQ ID NO: 1363973 - DNA, 22 bp, Artificial Sequence
  chemically synthesized
ttccagttattgtaagcatata

SEQ ID NO: 1363974 - DNA, 22 bp, Artificial Sequence
  chemically synthesized
acttttccagttattgtaagca

SEQ ID NO: 1363975 - DNA, 22 bp, Artificial Sequence
  chemically synthesized
cacttttccagttattgtaagc

SEQ ID NO: 1363976 - DNA, 22 bp, Artificial Sequence
  chemically synthesized
tcacttttccagttattgtaag

SEQ ID NO: 1363977 - DNA, 22 bp, Artificial Sequence
  chemically synthesized
cgtgcctttcacttttccagtt

SEQ ID NO: 1363978 - DNA, 22 bp, Artificial Sequence
  chemically synthesized
acgtgcctttcacttttccagt

SEQ ID NO: 1363979 - DNA, 22 bp, Artificial Sequence
  chemically synthesized
tacgtgcctttcacttttccag

SEQ ID NO: 1363980 - DNA, 22 bp, Artificial Sequence
  chemically synthesized
ttttacgtgcctttcacttttc

SEQ ID NO: 1363981 - DNA, 22 bp, Artificial Sequence
  chemically synthesized
attttacgtgcctttcactttt

SEQ ID NO: 1363982 - DNA, 22 bp, Artificial Sequence
  chemically synthesized
acaataactggaaaagtgaaag

SEQ ID NO: 1363983 - DNA, 22 bp, Artificial Sequence
  chemically synthesized
tattttacgtgcctttcacttt

SEQ ID NO: 1363984 - DNA, 22 bp, Artificial Sequence
  chemically synthesized
caataactggaaaagtgaaagg

SEQ ID NO: 1363985 - DNA, 22 bp, Artificial Sequence
  chemically synthesized
aattttattttacgtgcctttc

SEQ ID NO: 1363986 - DNA, 22 bp, Artificial Sequence
  chemically synthesized
gaaaagtgaaaggcacgtaaaa

SEQ ID NO: 1363987 - DNA, 22 bp, Artificial Sequence
  chemically synthesized
ggtctaaattttattttacgtg

SEQ ID NO: 1363988 - DNA, 22 bp, Artificial Sequence
  chemically synthesized
ttcggtctaaattttattttac

SEQ ID NO: 1363989 - DNA, 22 bp, Artificial Sequence
  chemically synthesized
gttcggtctaaattttatttta

SEQ ID NO: 1363990 - DNA, 22 bp, Artificial Sequence
  chemically synthesized
aatttgttcggtctaaatttta

SEQ ID NO: 1363991 - DNA, 22 bp, Artificial Sequence
  chemically synthesized
gagttcaatttgttcggtctaa

SEQ ID NO: 1363992 - DNA, 22 bp, Artificial Sequence
  chemically synthesized
aactggagttcaatttgttcgg

SEQ ID NO: 1363993 - DNA, 22 bp, Artificial Sequence
  chemically synthesized
agaccgaacaaattgaactcca

SEQ ID NO: 1363994 - DNA, 22 bp, Artificial Sequence
  chemically synthesized
gaccgaacaaattgaactccag

SEQ ID NO: 1363995 - DNA, 22 bp, Artificial Sequence
  chemically synthesized
tggtgacacagtctgaactgga

SEQ ID NO: 1363996 - DNA, 22 bp, Artificial Sequence
  chemically synthesized
aactccagttcagactgtgtca

SEQ ID NO: 1363997 - DNA, 22 bp, Artificial Sequence
  chemically synthesized
cagttcagactgtgtcaccaca

SEQ ID NO: 1363998 - DNA, 22 bp, Artificial Sequence
  chemically synthesized
agactgtgtcaccacagtactt

SEQ ID NO: 1363999 - DNA, 22 bp, Artificial Sequence
  chemically synthesized
agggacacaagaaagtactgtg

SEQ ID NO: 1364000 - DNA, 22 bp, Artificial Sequence
  chemically synthesized
tgtcaccacagtactttcttgt

SEQ ID NO: 1364001 - DNA, 22 bp, Artificial Sequence
  chemically synthesized
aaggagaaagataagtgattaa

SEQ ID NO: 1364002 - DNA, 22 bp, Artificial Sequence
  chemically synthesized
tcttgtgtcccttaatcactta

SEQ ID NO: 1364003 - DNA, 22 bp, Artificial Sequence
  chemically synthesized
cttgtgtcccttaatcacttat

SEQ ID NO: 1364004 - DNA, 22 bp, Artificial Sequence
  chemically synthesized
ttgtgtcccttaatcacttatc

SEQ ID NO: 1364005 - DNA, 22 bp, Artificial Sequence
  chemically synthesized
gtgtcccttaatcacttatctt

SEQ ID NO: 1364006 - DNA, 22 bp, Artificial Sequence
  chemically synthesized
tgtcccttaatcacttatcttt

SEQ ID NO: 1364007 - DNA, 22 bp, Artificial Sequence
  chemically synthesized
aggactaaaggagaaagataag

SEQ ID NO: 1364008 - DNA, 22 bp, Artificial Sequence
  chemically synthesized
tgaggactaaaggagaaagata

SEQ ID NO: 1364009 - DNA, 22 bp, Artificial Sequence
  chemically synthesized
ttctgaggactaaaggagaaag

SEQ ID NO: 1364010 - DNA, 22 bp, Artificial Sequence
  chemically synthesized
aatcacttatctttctccttta

SEQ ID NO: 1364011 - DNA, 22 bp, Artificial Sequence
  chemically synthesized
atcacttatctttctcctttag

SEQ ID NO: 1364012 - DNA, 22 bp, Artificial Sequence
  chemically synthesized
atctttctcctttagtcctcag

SEQ ID NO: 1364013 - DNA, 22 bp, Artificial Sequence
  chemically synthesized
tctttctcctttagtcctcaga

SEQ ID NO: 1364014 - DNA, 22 bp, Artificial Sequence
  chemically synthesized
caagatgtagttattctgagga

SEQ ID NO: 1364015 - DNA, 22 bp, Artificial Sequence
  chemically synthesized
tctcctttagtcctcagaataa

SEQ ID NO: 1364016 - DNA, 22 bp, Artificial Sequence
  chemically synthesized
ctcctttagtcctcagaataac

SEQ ID NO: 1364017 - DNA, 22 bp, Artificial Sequence
  chemically synthesized
tcctttagtcctcagaataact

SEQ ID NO: 1364018 - DNA, 22 bp, Artificial Sequence
  chemically synthesized
ctttagtcctcagaataactac

SEQ ID NO: 1364019 - DNA, 22 bp, Artificial Sequence
  chemically synthesized
tagtcctcagaataactacatc

SEQ ID NO: 1364020 - DNA, 22 bp, Artificial Sequence
  chemically synthesized
agtcctcagaataactacatct

SEQ ID NO: 1364021 - DNA, 22 bp, Artificial Sequence
  chemically synthesized
ataagacctacaagatgtagtt

SEQ ID NO: 1364022 - DNA, 22 bp, Artificial Sequence
  chemically synthesized
gtcctcagaataactacatctt

SEQ ID NO: 1364023 - DNA, 22 bp, Artificial Sequence
  chemically synthesized
agaataactacatcttgtaggt

SEQ ID NO: 1364024 - DNA, 22 bp, Artificial Sequence
  chemically synthesized
tggggctaataagacctacaag

SEQ ID NO: 1364025 - DNA, 22 bp, Artificial Sequence
  chemically synthesized
ttatggggctaataagacctac

SEQ ID NO: 1364026 - DNA, 22 bp, Artificial Sequence
  chemically synthesized
attatggggctaataagaccta

SEQ ID NO: 1364027 - DNA, 22 bp, Artificial Sequence
  chemically synthesized
tattatggggctaataagacct

SEQ ID NO: 1364028 - DNA, 22 bp, Artificial Sequence
  chemically synthesized
ctttattatggggctaataaga

SEQ ID NO: 1364029 - DNA, 22 bp, Artificial Sequence
  chemically synthesized
catcttgtaggtcttattagcc

SEQ ID NO: 1364030 - DNA, 22 bp, Artificial Sequence
  chemically synthesized
gtaggtcttattagccccataa

SEQ ID NO: 1364031 - DNA, 22 bp, Artificial Sequence
  chemically synthesized
taggtcttattagccccataat

SEQ ID NO: 1364032 - DNA, 22 bp, Artificial Sequence
  chemically synthesized
agcaagttcctttattatgggg

SEQ ID NO: 1364033 - DNA, 22 bp, Artificial Sequence
  chemically synthesized
gagcaagttcctttattatggg

SEQ ID NO: 1364034 - DNA, 22 bp, Artificial Sequence
  chemically synthesized
attagccccataataaaggaac

SEQ ID NO: 1364035 - DNA, 22 bp, Artificial Sequence
  chemically synthesized
ttagccccataataaaggaact

SEQ ID NO: 1364036 - DNA, 22 bp, Artificial Sequence
  chemically synthesized
gccccataataaaggaacttgc

SEQ ID NO: 1364037 - DNA, 22 bp, Artificial Sequence
  chemically synthesized
aaaatggaaatttgagcaagtt

SEQ ID NO: 1364038 - DNA, 22 bp, Artificial Sequence
  chemically synthesized
ttaaaaatggaaatttgagcaa

SEQ ID NO: 1364039 - DNA, 22 bp, Artificial Sequence
  chemically synthesized
tgacagttattaaaaatggaaa

SEQ ID NO: 1364040 - DNA, 22 bp, Artificial Sequence
  chemically synthesized
tgtgacagttattaaaaatgga

SEQ ID NO: 1364041 - DNA, 22 bp, Artificial Sequence
  chemically synthesized
gctcaaatttccatttttaata

SEQ ID NO: 1364042 - DNA, 22 bp, Artificial Sequence
  chemically synthesized
ctcaaatttccatttttaataa

SEQ ID NO: 1364043 - DNA, 22 bp, Artificial Sequence
  chemically synthesized
aaatttccatttttaataactg

SEQ ID NO: 1364044 - DNA, 22 bp, Artificial Sequence
  chemically synthesized
aaaattctgtgacagttattaa

SEQ ID NO: 1364045 - DNA, 22 bp, Artificial Sequence
  chemically synthesized
aaaaattctgtgacagttatta

SEQ ID NO: 1364046 - DNA, 22 bp, Artificial Sequence
  chemically synthesized
taaaaattctgtgacagttatt

SEQ ID NO: 1364047 - DNA, 22 bp, Artificial Sequence
  chemically synthesized
ttaaaaattctgtgacagttat

SEQ ID NO: 1364048 - DNA, 22 bp, Artificial Sequence
  chemically synthesized
ccatttttaataactgtcacag

SEQ ID NO: 1364049 - DNA, 22 bp, Artificial Sequence
  chemically synthesized
catttttaataactgtcacaga

SEQ ID NO: 1364050 - DNA, 22 bp, Artificial Sequence
  chemically synthesized
ttaataactgtcacagaatttt

SEQ ID NO: 1364051 - DNA, 22 bp, Artificial Sequence
  chemically synthesized
taataactgtcacagaattttt

SEQ ID NO: 1364052 - DNA, 22 bp, Artificial Sequence
  chemically synthesized
aaataaatttttaaaaattctg

SEQ ID NO: 1364053 - DNA, 22 bp, Artificial Sequence
  chemically synthesized
aataactgtcacagaattttta

SEQ ID NO: 1364054 - DNA, 22 bp, Artificial Sequence
  chemically synthesized
ataactgtcacagaatttttaa

SEQ ID NO: 1364055 - DNA, 22 bp, Artificial Sequence
  chemically synthesized
tcacagaatttttaaaaattta

SEQ ID NO: 1364056 - DNA, 22 bp, Artificial Sequence
  chemically synthesized
aaaataacaagttaaaataaat

SEQ ID NO: 1364057 - DNA, 22 bp, Artificial Sequence
  chemically synthesized
gaaaataacaagttaaaataaa

SEQ ID NO: 1364058 - DNA, 22 bp, Artificial Sequence
  chemically synthesized
ttaaaaatttattttaacttgt

SEQ ID NO: 1364059 - DNA, 22 bp, Artificial Sequence
  chemically synthesized
taaaaatttattttaacttgtt

SEQ ID NO: 1364060 - DNA, 22 bp, Artificial Sequence
  chemically synthesized
aaaaatttattttaacttgtta

SEQ ID NO: 1364061 - DNA, 22 bp, Artificial Sequence
  chemically synthesized
aaaatttattttaacttgttat

SEQ ID NO: 1364062 - DNA, 22 bp, Artificial Sequence
  chemically synthesized
taagtatttgaaaataacaagt

SEQ ID NO: 1364063 - DNA, 22 bp, Artificial Sequence
  chemically synthesized
attttaacttgttattttcaaa

SEQ ID NO: 1364064 - DNA, 22 bp, Artificial Sequence
  chemically synthesized
ttttaacttgttattttcaaat

SEQ ID NO: 1364065 - DNA, 22 bp, Artificial Sequence
  chemically synthesized
tgaatctataagtatttgaaaa

SEQ ID NO: 1364066 - DNA, 22 bp, Artificial Sequence
  chemically synthesized
taacttgttattttcaaatact

SEQ ID NO: 1364067 - DNA, 22 bp, Artificial Sequence
  chemically synthesized
aacttgttattttcaaatactt

SEQ ID NO: 1364068 - DNA, 22 bp, Artificial Sequence
  chemically synthesized
ctgtgaatctataagtatttga

SEQ ID NO: 1364069 - DNA, 22 bp, Artificial Sequence
  chemically synthesized
acttgttattttcaaatactta

SEQ ID NO: 1364070 - DNA, 22 bp, Artificial Sequence
  chemically synthesized
gttattttcaaatacttataga

SEQ ID NO: 1364071 - DNA, 22 bp, Artificial Sequence
  chemically synthesized
ttattttcaaatacttatagat

SEQ ID NO: 1364072 - DNA, 22 bp, Artificial Sequence
  chemically synthesized
ttttcaaatacttatagattca

SEQ ID NO: 1364073 - DNA, 22 bp, Artificial Sequence
  chemically synthesized
tcaaatacttatagattcacag

SEQ ID NO: 1364074 - DNA, 22 bp, Artificial Sequence
  chemically synthesized
caaatacttatagattcacagg

SEQ ID NO: 1364075 - DNA, 22 bp, Artificial Sequence
  chemically synthesized
tccccgcaaattcctgtgaatc

SEQ ID NO: 1364076 - DNA, 22 bp, Artificial Sequence
  chemically synthesized
aaatacttatagattcacagga

SEQ ID NO: 1364077 - DNA, 22 bp, Artificial Sequence
  chemically synthesized
tatactatccccgcaaattcct

SEQ ID NO: 1364078 - DNA, 22 bp, Artificial Sequence
  chemically synthesized
atagattcacaggaatttgcgg

SEQ ID NO: 1364079 - DNA, 22 bp, Artificial Sequence
  chemically synthesized
tgtatactatccccgcaaattc

SEQ ID NO: 1364080 - DNA, 22 bp, Artificial Sequence
  chemically synthesized
tagattcacaggaatttgcggg

SEQ ID NO: 1364081 - DNA, 22 bp, Artificial Sequence
  chemically synthesized
acaggaatttgcggggatagta

SEQ ID NO: 1364082 - DNA, 22 bp, Artificial Sequence
  chemically synthesized
gcggggatagtatacagagatc

SEQ ID NO: 1364083 - DNA, 22 bp, Artificial Sequence
  chemically synthesized
cggggatagtatacagagatcc

SEQ ID NO: 1364084 - DNA, 22 bp, Artificial Sequence
  chemically synthesized
ggtgaagggtacatgggatctc

SEQ ID NO: 1364085 - DNA, 22 bp, Artificial Sequence
  chemically synthesized
ggagaaactgggtgaagggtac

SEQ ID NO: 1364086 - DNA, 22 bp, Artificial Sequence
  chemically synthesized
gggagaaactgggtgaagggta

SEQ ID NO: 1364087 - DNA, 22 bp, Artificial Sequence
  chemically synthesized
tgggagaaactgggtgaagggt

SEQ ID NO: 1364088 - DNA, 22 bp, Artificial Sequence
  chemically synthesized
atctttgggagaaactgggtga

SEQ ID NO: 1364089 - DNA, 22 bp, Artificial Sequence
  chemically synthesized
tagttaatctttgggagaaact

SEQ ID NO: 1364090 - DNA, 22 bp, Artificial Sequence
  chemically synthesized
ttgtagttaatctttgggagaa

SEQ ID NO: 1364091 - DNA, 22 bp, Artificial Sequence
  chemically synthesized
cacccagtttctcccaaagatt

SEQ ID NO: 1364092 - DNA, 22 bp, Artificial Sequence
  chemically synthesized
acccagtttctcccaaagatta

SEQ ID NO: 1364093 - DNA, 22 bp, Artificial Sequence
  chemically synthesized
tagttattgtagttaatctttg

SEQ ID NO: 1364094 - DNA, 22 bp, Artificial Sequence
  chemically synthesized
aattgtagttattgtagttaat

SEQ ID NO: 1364095 - DNA, 22 bp, Artificial Sequence
  chemically synthesized
ctcccaaagattaactacaata

SEQ ID NO: 1364096 - DNA, 22 bp, Artificial Sequence
  chemically synthesized
tcccaaagattaactacaataa

SEQ ID NO: 1364097 - DNA, 22 bp, Artificial Sequence
  chemically synthesized
ccaaagattaactacaataact

SEQ ID NO: 1364098 - DNA, 22 bp, Artificial Sequence
  chemically synthesized
taggatactgaattgtagttat

SEQ ID NO: 1364099 - DNA, 22 bp, Artificial Sequence
  chemically synthesized
ttgtaggatactgaattgtagt

SEQ ID NO: 1364100 - DNA, 22 bp, Artificial Sequence
  chemically synthesized
actacaataactacaattcagt

SEQ ID NO: 1364101 - DNA, 22 bp, Artificial Sequence
  chemically synthesized
tagttattgtaggatactgaat

SEQ ID NO: 1364102 - DNA, 22 bp, Artificial Sequence
  chemically synthesized
caataactacaattcagtatcc

SEQ ID NO: 1364103 - DNA, 22 bp, Artificial Sequence
  chemically synthesized
aattgtagttattgtaggatac

SEQ ID NO: 1364104 - DNA, 22 bp, Artificial Sequence
  chemically synthesized
caattcagtatcctacaataac

SEQ ID NO: 1364105 - DNA, 22 bp, Artificial Sequence
  chemically synthesized
atactgaattgtagttattgta

SEQ ID NO: 1364106 - DNA, 22 bp, Artificial Sequence
  chemically synthesized
gatactgaattgtagttattgt

SEQ ID NO: 1364107 - DNA, 22 bp, Artificial Sequence
  chemically synthesized
tgatactgaattgtagttattg

SEQ ID NO: 1364108 - DNA, 22 bp, Artificial Sequence
  chemically synthesized
agtatcctacaataactacaat

SEQ ID NO: 1364109 - DNA, 22 bp, Artificial Sequence
  chemically synthesized
gttttgatactgaattgtagtt

SEQ ID NO: 1364110 - DNA, 22 bp, Artificial Sequence
  chemically synthesized
ctggttttgatactgaattgta

SEQ ID NO: 1364111 - DNA, 22 bp, Artificial Sequence
  chemically synthesized
cctggttttgatactgaattgt

SEQ ID NO: 1364112 - DNA, 22 bp, Artificial Sequence
  chemically synthesized
caataactacaattcagtatca

SEQ ID NO: 1364113 - DNA, 22 bp, Artificial Sequence
  chemically synthesized
caattcagtatcaaaaccagga

SEQ ID NO: 1364114 - DNA, 22 bp, Artificial Sequence
  chemically synthesized
agtatcaaaaccaggaaactga

SEQ ID NO: 1364115 - DNA, 22 bp, Artificial Sequence
  chemically synthesized
acattgatatgtatacatattt

SEQ ID NO: 1364116 - DNA, 22 bp, Artificial Sequence
  chemically synthesized
atatgtatacatatttctattt

SEQ ID NO: 1364117 - DNA, 22 bp, Artificial Sequence
  chemically synthesized
cacaaatcagtgatgaaataga

SEQ ID NO: 1364118 - DNA, 22 bp, Artificial Sequence
  chemically synthesized
aggttacacaaatcagtgatga

SEQ ID NO: 1364119 - DNA, 22 bp, Artificial Sequence
  chemically synthesized
ctatttcatcactgatttgtgt

SEQ ID NO: 1364120 - DNA, 22 bp, Artificial Sequence
  chemically synthesized
tatttcatcactgatttgtgta

SEQ ID NO: 1364121 - DNA, 22 bp, Artificial Sequence
  chemically synthesized
tggaggttgaggttacacaaat

SEQ ID NO: 1364122 - DNA, 22 bp, Artificial Sequence
  chemically synthesized
tttcatcactgatttgtgtaac

SEQ ID NO: 1364123 - DNA, 22 bp, Artificial Sequence
  chemically synthesized
gtggaggttgaggttacacaaa

SEQ ID NO: 1364124 - DNA, 22 bp, Artificial Sequence
  chemically synthesized
catcactgatttgtgtaacctc

SEQ ID NO: 1364125 - DNA, 22 bp, Artificial Sequence
  chemically synthesized
tttgtggaggttgaggttacac

SEQ ID NO: 1364126 - DNA, 22 bp, Artificial Sequence
  chemically synthesized
atcactgatttgtgtaacctca

SEQ ID NO: 1364127 - DNA, 22 bp, Artificial Sequence
  chemically synthesized
atttgtggaggttgaggttaca

SEQ ID NO: 1364128 - DNA, 22 bp, Artificial Sequence
  chemically synthesized
atttgtgtaacctcaacctcca

SEQ ID NO: 1364129 - DNA, 22 bp, Artificial Sequence
  chemically synthesized
gtgtaacctcaacctccacaaa

SEQ ID NO: 1364130 - DNA, 22 bp, Artificial Sequence
  chemically synthesized
tgtaacctcaacctccacaaat

SEQ ID NO: 1364131 - DNA, 22 bp, Artificial Sequence
  chemically synthesized
tggtgatgaaacaggtgtttat

SEQ ID NO: 1364132 - DNA, 22 bp, Artificial Sequence
  chemically synthesized
aacctccacaaataaacacctg

SEQ ID NO: 1364133 - DNA, 22 bp, Artificial Sequence
  chemically synthesized
tgtggtgatgaaacaggtgttt

SEQ ID NO: 1364134 - DNA, 22 bp, Artificial Sequence
  chemically synthesized
cacaaataaacacctgtttcat

SEQ ID NO: 1364135 - DNA, 22 bp, Artificial Sequence
  chemically synthesized
tttcatcaccacagagatttgc

SEQ ID NO: 1364136 - DNA, 22 bp, Artificial Sequence
  chemically synthesized
catcaccacagagatttgcctc

SEQ ID NO: 1364137 - DNA, 22 bp, Artificial Sequence
  chemically synthesized
atcaccacagagatttgcctca

SEQ ID NO: 1364138 - DNA, 22 bp, Artificial Sequence
  chemically synthesized
taaaggggtagcatgaggcaaa

SEQ ID NO: 1364139 - DNA, 22 bp, Artificial Sequence
  chemically synthesized
tgactgtaaaggggtagcatga

SEQ ID NO: 1364140 - DNA, 22 bp, Artificial Sequence
  chemically synthesized
ttgtgactgtaaaggggtagca

SEQ ID NO: 1364141 - DNA, 22 bp, Artificial Sequence
  chemically synthesized
gcctcatgctacccctttacag

SEQ ID NO: 1364142 - DNA, 22 bp, Artificial Sequence
  chemically synthesized
cctcatgctacccctttacagt

SEQ ID NO: 1364143 - DNA, 22 bp, Artificial Sequence
  chemically synthesized
atgctacccctttacagtcaca

SEQ ID NO: 1364144 - DNA, 22 bp, Artificial Sequence
  chemically synthesized
gggagggtgactgttgtgactg

SEQ ID NO: 1364145 - DNA, 22 bp, Artificial Sequence
  chemically synthesized
agggagggtgactgttgtgact

SEQ ID NO: 1364146 - DNA, 22 bp, Artificial Sequence
  chemically synthesized
cccctttacagtcacaacagtc

SEQ ID NO: 1364147 - DNA, 22 bp, Artificial Sequence
  chemically synthesized
tacagtcacaacagtcaccctc

SEQ ID NO: 1364148 - DNA, 22 bp, Artificial Sequence
  chemically synthesized
gggatatttagggagggtgact

SEQ ID NO: 1364149 - DNA, 22 bp, Artificial Sequence
  chemically synthesized
acagtcacaacagtcaccctcc

SEQ ID NO: 1364150 - DNA, 22 bp, Artificial Sequence
  chemically synthesized
agggatatttagggagggtgac

SEQ ID NO: 1364151 - DNA, 22 bp, Artificial Sequence
  chemically synthesized
cagtcacaacagtcaccctccc

SEQ ID NO: 1364152 - DNA, 22 bp, Artificial Sequence
  chemically synthesized
tagggatatttagggagggtga

SEQ ID NO: 1364153 - DNA, 22 bp, Artificial Sequence
  chemically synthesized
gtaccaggctttagggatattt

SEQ ID NO: 1364154 - DNA, 22 bp, Artificial Sequence
  chemically synthesized
attggtaccaggctttagggat

SEQ ID NO: 1364155 - DNA, 22 bp, Artificial Sequence
  chemically synthesized
cctaaatatccctaaagcctgg

SEQ ID NO: 1364156 - DNA, 22 bp, Artificial Sequence
  chemically synthesized
aatatccctaaagcctggtacc

SEQ ID NO: 1364157 - DNA, 22 bp, Artificial Sequence
  chemically synthesized
aagcctggtaccaatcaatttg

SEQ ID NO: 1364158 - DNA, 22 bp, Artificial Sequence
  chemically synthesized
cagtgatggagaacaaattgat

SEQ ID NO: 1364159 - DNA, 22 bp, Artificial Sequence
  chemically synthesized
gtaccaatcaatttgttctcca

SEQ ID NO: 1364160 - DNA, 22 bp, Artificial Sequence
  chemically synthesized
aaatgacaaaattacagtgatg

SEQ ID NO: 1364161 - DNA, 22 bp, Artificial Sequence
  chemically synthesized
aaaatgacaaaattacagtgat

SEQ ID NO: 1364162 - DNA, 22 bp, Artificial Sequence
  chemically synthesized
ttaaaatgacaaaattacagtg

SEQ ID NO: 1364163 - DNA, 22 bp, Artificial Sequence
  chemically synthesized
gttctccatcactgtaattttg

SEQ ID NO: 1364164 - DNA, 22 bp, Artificial Sequence
  chemically synthesized
ttctccatcactgtaattttgt

SEQ ID NO: 1364165 - DNA, 22 bp, Artificial Sequence
  chemically synthesized
atattcttaaaatgacaaaatt

SEQ ID NO: 1364166 - DNA, 22 bp, Artificial Sequence
  chemically synthesized
tccatcactgtaattttgtcat

SEQ ID NO: 1364167 - DNA, 22 bp, Artificial Sequence
  chemically synthesized
catcactgtaattttgtcattt

SEQ ID NO: 1364168 - DNA, 22 bp, Artificial Sequence
  chemically synthesized
tctaatattcttaaaatgacaa

SEQ ID NO: 1364169 - DNA, 22 bp, Artificial Sequence
  chemically synthesized
atctaatattcttaaaatgaca

SEQ ID NO: 1364170 - DNA, 22 bp, Artificial Sequence
  chemically synthesized
catttatctaatattcttaaaa

SEQ ID NO: 1364171 - DNA, 22 bp, Artificial Sequence
  chemically synthesized
taattttgtcattttaagaata

SEQ ID NO: 1364172 - DNA, 22 bp, Artificial Sequence
  chemically synthesized
tgtcattttaagaatattagat

SEQ ID NO: 1364173 - DNA, 22 bp, Artificial Sequence
  chemically synthesized
gtcattttaagaatattagata

SEQ ID NO: 1364174 - DNA, 22 bp, Artificial Sequence
  chemically synthesized
tcattttaagaatattagataa

SEQ ID NO: 1364175 - DNA, 22 bp, Artificial Sequence
  chemically synthesized
taagaatattagataaatgcaa

SEQ ID NO: 1364176 - DNA, 22 bp, Artificial Sequence
  chemically synthesized
cataccgaatcattgcatttat

SEQ ID NO: 1364177 - DNA, 22 bp, Artificial Sequence
  chemically synthesized
aagaatattagataaatgcaat

SEQ ID NO: 1364178 - DNA, 22 bp, Artificial Sequence
  chemically synthesized
agaatattagataaatgcaatg

SEQ ID NO: 1364179 - DNA, 22 bp, Artificial Sequence
  chemically synthesized
aaaaggttacataccgaatcat

SEQ ID NO: 1364180 - DNA, 22 bp, Artificial Sequence
  chemically synthesized
gataaatgcaatgattcggtat

SEQ ID NO: 1364181 - DNA, 22 bp, Artificial Sequence
  chemically synthesized
ggtatgtaaccttttgagattg

SEQ ID NO: 1364182 - DNA, 22 bp, Artificial Sequence
  chemically synthesized
ttgagattggcttttttttttt

SEQ ID NO: 1364183 - DNA, 22 bp, Artificial Sequence
  chemically synthesized
tgagattggctttttttttttt

SEQ ID NO: 1364184 - DNA, 22 bp, Artificial Sequence
  chemically synthesized
gagattggcttttttttttttt

SEQ ID NO: 1364185 - DNA, 22 bp, Artificial Sequence
  chemically synthesized
agattggctttttttttttttt

SEQ ID NO: 1364186 - DNA, 22 bp, Artificial Sequence
  chemically synthesized
aagtacagaatgccaaaaaaaa

SEQ ID NO: 1364187 - DNA, 22 bp, Artificial Sequence
  chemically synthesized
gctttttttttttttttggcat

SEQ ID NO: 1364188 - DNA, 22 bp, Artificial Sequence
  chemically synthesized
tttttttttttttggcattctg

SEQ ID NO: 1364189 - DNA, 22 bp, Artificial Sequence
  chemically synthesized
ttttttttttttggcattctgt

SEQ ID NO: 1364190 - DNA, 22 bp, Artificial Sequence
  chemically synthesized
tttttttttttggcattctgta

SEQ ID NO: 1364191 - DNA, 22 bp, Artificial Sequence
  chemically synthesized
ttttttttttggcattctgtac

SEQ ID NO: 1364192 - DNA, 22 bp, Artificial Sequence
  chemically synthesized
aatggatctcaagtacagaatg

SEQ ID NO: 1364193 - DNA, 22 bp, Artificial Sequence
  chemically synthesized
tttttttttggcattctgtact

SEQ ID NO: 1364194 - DNA, 22 bp, Artificial Sequence
  chemically synthesized
aaatggatctcaagtacagaat

SEQ ID NO: 1364195 - DNA, 22 bp, Artificial Sequence
  chemically synthesized
ttttttttggcattctgtactt

SEQ ID NO: 1364196 - DNA, 22 bp, Artificial Sequence
  chemically synthesized
tttttttggcattctgtacttg

SEQ ID NO: 1364197 - DNA, 22 bp, Artificial Sequence
  chemically synthesized
ttttttggcattctgtacttga

SEQ ID NO: 1364198 - DNA, 22 bp, Artificial Sequence
  chemically synthesized
tttttggcattctgtacttgag

SEQ ID NO: 1364199 - DNA, 22 bp, Artificial Sequence
  chemically synthesized
ttttggcattctgtacttgaga

SEQ ID NO: 1364200 - DNA, 22 bp, Artificial Sequence
  chemically synthesized
tttggcattctgtacttgagat

SEQ ID NO: 1364201 - DNA, 22 bp, Artificial Sequence
  chemically synthesized
ttggcattctgtacttgagatc

SEQ ID NO: 1364202 - DNA, 22 bp, Artificial Sequence
  chemically synthesized
tggcattctgtacttgagatcc

SEQ ID NO: 1364203 - DNA, 22 bp, Artificial Sequence
  chemically synthesized
ggcattctgtacttgagatcca

SEQ ID NO: 1364204 - DNA, 22 bp, Artificial Sequence
  chemically synthesized
gcattctgtacttgagatccat

SEQ ID NO: 1364205 - DNA, 22 bp, Artificial Sequence
  chemically synthesized
atgacaacttaaatggatctca

SEQ ID NO: 1364206 - DNA, 22 bp, Artificial Sequence
  chemically synthesized
ttgatgacaacttaaatggatc

SEQ ID NO: 1364207 - DNA, 22 bp, Artificial Sequence
  chemically synthesized
tgtacttgagatccatttaagt

SEQ ID NO: 1364208 - DNA, 22 bp, Artificial Sequence
  chemically synthesized
tacttgagatccatttaagttg

SEQ ID NO: 1364209 - DNA, 22 bp, Artificial Sequence
  chemically synthesized
gagatccatttaagttgtcatc

SEQ ID NO: 1364210 - DNA, 22 bp, Artificial Sequence
  chemically synthesized
agatccatttaagttgtcatca

SEQ ID NO: 1364211 - DNA, 22 bp, Artificial Sequence
  chemically synthesized
aagttgtcatcaatagcttatt

SEQ ID NO: 1364212 - DNA, 22 bp, Artificial Sequence
  chemically synthesized
agttgtcatcaatagcttattt

SEQ ID NO: 1364213 - DNA, 22 bp, Artificial Sequence
  chemically synthesized
agcaataaaaggaaataagcta

SEQ ID NO: 1364214 - DNA, 22 bp, Artificial Sequence
  chemically synthesized
ctcagcaataaaaggaaataag

SEQ ID NO: 1364215 - DNA, 22 bp, Artificial Sequence
  chemically synthesized
tcatcaatagcttatttccttt

SEQ ID NO: 1364216 - DNA, 22 bp, Artificial Sequence
  chemically synthesized
ctactcagcaataaaaggaaat

SEQ ID NO: 1364217 - DNA, 22 bp, Artificial Sequence
  chemically synthesized
atttccttttattgctgagtag

SEQ ID NO: 1364218 - DNA, 22 bp, Artificial Sequence
  chemically synthesized
tttccttttattgctgagtagt

SEQ ID NO: 1364219 - DNA, 22 bp, Artificial Sequence
  chemically synthesized
ccttttattgctgagtagtagt

SEQ ID NO: 1364220 - DNA, 22 bp, Artificial Sequence
  chemically synthesized
cttttattgctgagtagtagtt

SEQ ID NO: 1364221 - DNA, 22 bp, Artificial Sequence
  chemically synthesized
ttattgctgagtagtagttcat

SEQ ID NO: 1364222 - DNA, 22 bp, Artificial Sequence
  chemically synthesized
tattgctgagtagtagttcatg

SEQ ID NO: 1364223 - DNA, 22 bp, Artificial Sequence
  chemically synthesized
attgctgagtagtagttcatgg

SEQ ID NO: 1364224 - DNA, 22 bp, Artificial Sequence
  chemically synthesized
ttgctgagtagtagttcatggc

SEQ ID NO: 1364225 - DNA, 22 bp, Artificial Sequence
  chemically synthesized
tagaacatccatgccatgaact

SEQ ID NO: 1364226 - DNA, 22 bp, Artificial Sequence
  chemically synthesized
ctgagtagtagttcatggcatg

SEQ ID NO: 1364227 - DNA, 22 bp, Artificial Sequence
  chemically synthesized
agtagtagttcatggcatggat

SEQ ID NO: 1364228 - DNA, 22 bp, Artificial Sequence
  chemically synthesized
atggcatggatgttctatagtt

SEQ ID NO: 1364229 - DNA, 22 bp, Artificial Sequence
  chemically synthesized
tatagttactttattcacatac

SEQ ID NO: 1364230 - DNA, 22 bp, Artificial Sequence
  chemically synthesized
tagttactttattcacatactg

SEQ ID NO: 1364231 - DNA, 22 bp, Artificial Sequence
  chemically synthesized
ctttattcacatactgtgggat

SEQ ID NO: 1364232 - DNA, 22 bp, Artificial Sequence
  chemically synthesized
gaaacaacgaaaatatcccaca

SEQ ID NO: 1364233 - DNA, 22 bp, Artificial Sequence
  chemically synthesized
tattcacatactgtgggatatt

SEQ ID NO: 1364234 - DNA, 22 bp, Artificial Sequence
  chemically synthesized
attcacatactgtgggatattt

SEQ ID NO: 1364235 - DNA, 22 bp, Artificial Sequence
  chemically synthesized
ttcacatactgtgggatatttt

SEQ ID NO: 1364236 - DNA, 22 bp, Artificial Sequence
  chemically synthesized
acatactgtgggatattttcgt

SEQ ID NO: 1364237 - DNA, 22 bp, Artificial Sequence
  chemically synthesized
tgggatattttcgttgtttcca

SEQ ID NO: 1364238 - DNA, 22 bp, Artificial Sequence
  chemically synthesized
tagtgaccaaaccctggaaaca

SEQ ID NO: 1364239 - DNA, 22 bp, Artificial Sequence
  chemically synthesized
gtagtgaccaaaccctggaaac

SEQ ID NO: 1364240 - DNA, 22 bp, Artificial Sequence
  chemically synthesized
tttgtagtgaccaaaccctgga

SEQ ID NO: 1364241 - DNA, 22 bp, Artificial Sequence
  chemically synthesized
atttgtagtgaccaaaccctgg

SEQ ID NO: 1364242 - DNA, 22 bp, Artificial Sequence
  chemically synthesized
tatttgtagtgaccaaaccctg

SEQ ID NO: 1364243 - DNA, 22 bp, Artificial Sequence
  chemically synthesized
tcgttgtttccagggtttggtc

SEQ ID NO: 1364244 - DNA, 22 bp, Artificial Sequence
  chemically synthesized
cgttgtttccagggtttggtca

SEQ ID NO: 1364245 - DNA, 22 bp, Artificial Sequence
  chemically synthesized
gttgtttccagggtttggtcac

SEQ ID NO: 1364246 - DNA, 22 bp, Artificial Sequence
  chemically synthesized
cagctttatttgtagtgaccaa

SEQ ID NO: 1364247 - DNA, 22 bp, Artificial Sequence
  chemically synthesized
gcagctttatttgtagtgacca

SEQ ID NO: 1364248 - DNA, 22 bp, Artificial Sequence
  chemically synthesized
tttccagggtttggtcactaca

SEQ ID NO: 1364249 - DNA, 22 bp, Artificial Sequence
  chemically synthesized
tgcagctttatttgtagtgacc

SEQ ID NO: 1364250 - DNA, 22 bp, Artificial Sequence
  chemically synthesized
ccagggtttggtcactacaaat

SEQ ID NO: 1364251 - DNA, 22 bp, Artificial Sequence
  chemically synthesized
ttttgcagctttatttgtagtg

SEQ ID NO: 1364252 - DNA, 22 bp, Artificial Sequence
  chemically synthesized
cagggtttggtcactacaaata

SEQ ID NO: 1364253 - DNA, 22 bp, Artificial Sequence
  chemically synthesized
catgattgttttgcagctttat

SEQ ID NO: 1364254 - DNA, 22 bp, Artificial Sequence
  chemically synthesized
ggtcactacaaataaagctgca

SEQ ID NO: 1364255 - DNA, 22 bp, Artificial Sequence
  chemically synthesized
gtcactacaaataaagctgcaa

SEQ ID NO: 1364256 - DNA, 22 bp, Artificial Sequence
  chemically synthesized
caaataaagctgcaaaacaatc

SEQ ID NO: 1364257 - DNA, 22 bp, Artificial Sequence
  chemically synthesized
caaaacaatcatgtagtttttc

SEQ ID NO: 1364258 - DNA, 22 bp, Artificial Sequence
  chemically synthesized
gaggaatgaaaaatgaaaaact

SEQ ID NO: 1364259 - DNA, 22 bp, Artificial Sequence
  chemically synthesized
ggacatgaatctagaggaatga

SEQ ID NO: 1364260 - DNA, 22 bp, Artificial Sequence
  chemically synthesized
tgggacatgaatctagaggaat

SEQ ID NO: 1364261 - DNA, 22 bp, Artificial Sequence
  chemically synthesized
ttcatttttcattcctctagat

SEQ ID NO: 1364262 - DNA, 22 bp, Artificial Sequence
  chemically synthesized
tcatttttcattcctctagatt

SEQ ID NO: 1364263 - DNA, 22 bp, Artificial Sequence
  chemically synthesized
catttttcattcctctagattc

SEQ ID NO: 1364264 - DNA, 22 bp, Artificial Sequence
  chemically synthesized
atttttcattcctctagattca

SEQ ID NO: 1364265 - DNA, 22 bp, Artificial Sequence
  chemically synthesized
ttcattcctctagattcatgtc

SEQ ID NO: 1364266 - DNA, 22 bp, Artificial Sequence
  chemically synthesized
tcattcctctagattcatgtcc

SEQ ID NO: 1364267 - DNA, 22 bp, Artificial Sequence
  chemically synthesized
cattcctctagattcatgtccc

SEQ ID NO: 1364268 - DNA, 22 bp, Artificial Sequence
  chemically synthesized
taaccacactctgggacatgaa

SEQ ID NO: 1364269 - DNA, 22 bp, Artificial Sequence
  chemically synthesized
attcctctagattcatgtccca

SEQ ID NO: 1364270 - DNA, 22 bp, Artificial Sequence
  chemically synthesized
ctctagattcatgtcccagagt

SEQ ID NO: 1364271 - DNA, 22 bp, Artificial Sequence
  chemically synthesized
tagattcatgtcccagagtgtg

SEQ ID NO: 1364272 - DNA, 22 bp, Artificial Sequence
  chemically synthesized
gattcatgtcccagagtgtggt

SEQ ID NO: 1364273 - DNA, 22 bp, Artificial Sequence
  chemically synthesized
tatggtaaattataaccacact

SEQ ID NO: 1364274 - DNA, 22 bp, Artificial Sequence
  chemically synthesized
atatggtaaattataaccacac

SEQ ID NO: 1364275 - DNA, 22 bp, Artificial Sequence
  chemically synthesized
atgtcccagagtgtggttataa

SEQ ID NO: 1364276 - DNA, 22 bp, Artificial Sequence
  chemically synthesized
aaatttatatggtaaattataa

SEQ ID NO: 1364277 - DNA, 22 bp, Artificial Sequence
  chemically synthesized
taaaatttatatggtaaattat

SEQ ID NO: 1364278 - DNA, 22 bp, Artificial Sequence
  chemically synthesized
ttctaaaatttatatggtaaat

SEQ ID NO: 1364279 - DNA, 22 bp, Artificial Sequence
  chemically synthesized
attctaaaatttatatggtaaa

SEQ ID NO: 1364280 - DNA, 22 bp, Artificial Sequence
  chemically synthesized
taatttaccatataaattttag

SEQ ID NO: 1364281 - DNA, 22 bp, Artificial Sequence
  chemically synthesized
tagataaacttattctaaaatt

SEQ ID NO: 1364282 - DNA, 22 bp, Artificial Sequence
  chemically synthesized
gtagataaacttattctaaaat

SEQ ID NO: 1364283 - DNA, 22 bp, Artificial Sequence
  chemically synthesized
accatataaattttagaataag

SEQ ID NO: 1364284 - DNA, 22 bp, Artificial Sequence
  chemically synthesized
tttgtagataaacttattctaa

SEQ ID NO: 1364285 - DNA, 22 bp, Artificial Sequence
  chemically synthesized
ccatataaattttagaataagt

SEQ ID NO: 1364286 - DNA, 22 bp, Artificial Sequence
  chemically synthesized
tagatctatttgtagataaact

SEQ ID NO: 1364287 - DNA, 22 bp, Artificial Sequence
  chemically synthesized
tagaataagtttatctacaaat

SEQ ID NO: 1364288 - DNA, 22 bp, Artificial Sequence
  chemically synthesized
agaataagtttatctacaaata

SEQ ID NO: 1364289 - DNA, 22 bp, Artificial Sequence
  chemically synthesized
gaataagtttatctacaaatag

SEQ ID NO: 1364290 - DNA, 22 bp, Artificial Sequence
  chemically synthesized
tagatagatctgtagatctatt

SEQ ID NO: 1364291 - DNA, 22 bp, Artificial Sequence
  chemically synthesized
tgtagatagatctgtagatcta

SEQ ID NO: 1364292 - DNA, 22 bp, Artificial Sequence
  chemically synthesized
atctacaaatagatctacagat

SEQ ID NO: 1364293 - DNA, 22 bp, Artificial Sequence
  chemically synthesized
tctacaaatagatctacagatc

SEQ ID NO: 1364294 - DNA, 22 bp, Artificial Sequence
  chemically synthesized
caaatagatctacagatctatc

SEQ ID NO: 1364295 - DNA, 22 bp, Artificial Sequence
  chemically synthesized
aaagatattctgtagatagatc

SEQ ID NO: 1364296 - DNA, 22 bp, Artificial Sequence
  chemically synthesized
cctgaaagatattctgtagata

SEQ ID NO: 1364297 - DNA, 22 bp, Artificial Sequence
  chemically synthesized
tacctgaaagatattctgtaga

SEQ ID NO: 1364298 - DNA, 22 bp, Artificial Sequence
  chemically synthesized
cagatctatctacagaatatct

SEQ ID NO: 1364299 - DNA, 22 bp, Artificial Sequence
  chemically synthesized
tcaaaattctacctgaaagata

SEQ ID NO: 1364300 - DNA, 22 bp, Artificial Sequence
  chemically synthesized
tctacagaatatctttcaggta

SEQ ID NO: 1364301 - DNA, 22 bp, Artificial Sequence
  chemically synthesized
ctatcaaaattctacctgaaag

SEQ ID NO: 1364302 - DNA, 22 bp, Artificial Sequence
  chemically synthesized
cagaatatctttcaggtagaat

SEQ ID NO: 1364303 - DNA, 22 bp, Artificial Sequence
  chemically synthesized
atgcaattcctatcaaaattct

SEQ ID NO: 1364304 - DNA, 22 bp, Artificial Sequence
  chemically synthesized
aatgcaattcctatcaaaattc

SEQ ID NO: 1364305 - DNA, 22 bp, Artificial Sequence
  chemically synthesized
taatgcaattcctatcaaaatt

SEQ ID NO: 1364306 - DNA, 22 bp, Artificial Sequence
  chemically synthesized
tcaggtagaattttgataggaa

SEQ ID NO: 1364307 - DNA, 22 bp, Artificial Sequence
  chemically synthesized
caggtagaattttgataggaat

SEQ ID NO: 1364308 - DNA, 22 bp, Artificial Sequence
  chemically synthesized
aggtagaattttgataggaatt

SEQ ID NO: 1364309 - DNA, 22 bp, Artificial Sequence
  chemically synthesized
ataattttaatgcaattcctat

SEQ ID NO: 1364310 - DNA, 22 bp, Artificial Sequence
  chemically synthesized
tgataggaattgcattaaaatt

SEQ ID NO: 1364311 - DNA, 22 bp, Artificial Sequence
  chemically synthesized
gataggaattgcattaaaatta

SEQ ID NO: 1364312 - DNA, 22 bp, Artificial Sequence
  chemically synthesized
ataggaattgcattaaaattat

SEQ ID NO: 1364313 - DNA, 22 bp, Artificial Sequence
  chemically synthesized
caaaatgtattcataattttaa

SEQ ID NO: 1364314 - DNA, 22 bp, Artificial Sequence
  chemically synthesized
ccaaaatgtattcataatttta

SEQ ID NO: 1364315 - DNA, 22 bp, Artificial Sequence
  chemically synthesized
ttccaaaatgtattcataattt

SEQ ID NO: 1364316 - DNA, 22 bp, Artificial Sequence
  chemically synthesized
cattaaaattatgaatacattt

SEQ ID NO: 1364317 - DNA, 22 bp, Artificial Sequence
  chemically synthesized
aaattatgaatacattttggaa

SEQ ID NO: 1364318 - DNA, 22 bp, Artificial Sequence
  chemically synthesized
tgaatacattttggaagaattg

SEQ ID NO: 1364319 - DNA, 22 bp, Artificial Sequence
  chemically synthesized
tggaagaattgatgtttttacc

SEQ ID NO: 1364320 - DNA, 22 bp, Artificial Sequence
  chemically synthesized
ggaagaattgatgtttttaccg

SEQ ID NO: 1364321 - DNA, 22 bp, Artificial Sequence
  chemically synthesized
gaggaatcaatgcggtaaaaac

SEQ ID NO: 1364322 - DNA, 22 bp, Artificial Sequence
  chemically synthesized
gaagaattgatgtttttaccgc

SEQ ID NO: 1364323 - DNA, 22 bp, Artificial Sequence
  chemically synthesized
atgaattggaggaatcaatgcg

SEQ ID NO: 1364324 - DNA, 22 bp, Artificial Sequence
  chemically synthesized
atgtttttaccgcattgattcc

SEQ ID NO: 1364325 - DNA, 22 bp, Artificial Sequence
  chemically synthesized
tgttaatgaattggaggaatca

SEQ ID NO: 1364326 - DNA, 22 bp, Artificial Sequence
  chemically synthesized
ttaccgcattgattcctccaat

SEQ ID NO: 1364327 - DNA, 22 bp, Artificial Sequence
  chemically synthesized
taccgcattgattcctccaatt

SEQ ID NO: 1364328 - DNA, 22 bp, Artificial Sequence
  chemically synthesized
accgcattgattcctccaattc

SEQ ID NO: 1364329 - DNA, 22 bp, Artificial Sequence
  chemically synthesized
ccgcattgattcctccaattca

SEQ ID NO: 1364330 - DNA, 22 bp, Artificial Sequence
  chemically synthesized
gacatatgtactatgttaatga

SEQ ID NO: 1364331 - DNA, 22 bp, Artificial Sequence
  chemically synthesized
attcctccaattcattaacata

SEQ ID NO: 1364332 - DNA, 22 bp, Artificial Sequence
  chemically synthesized
ctccaattcattaacatagtac

SEQ ID NO: 1364333 - DNA, 22 bp, Artificial Sequence
  chemically synthesized
aatattggacatatgtactatg

SEQ ID NO: 1364334 - DNA, 22 bp, Artificial Sequence
  chemically synthesized
caattcattaacatagtacata

SEQ ID NO: 1364335 - DNA, 22 bp, Artificial Sequence
  chemically synthesized
attaacatagtacatatgtcca

SEQ ID NO: 1364336 - DNA, 22 bp, Artificial Sequence
  chemically synthesized
acatagtacatatgtccaatat

SEQ ID NO: 1364337 - DNA, 22 bp, Artificial Sequence
  chemically synthesized
aagataacctaaatattggaca

SEQ ID NO: 1364338 - DNA, 22 bp, Artificial Sequence
  chemically synthesized
aggttatctttaatttatttca

SEQ ID NO: 1364339 - DNA, 22 bp, Artificial Sequence
  chemically synthesized
ggttatctttaatttatttcat

SEQ ID NO: 1364340 - DNA, 22 bp, Artificial Sequence
  chemically synthesized
tctttaatttatttcatcatac

SEQ ID NO: 1364341 - DNA, 22 bp, Artificial Sequence
  chemically synthesized
tgtaaaaaagccgagtatgatg

SEQ ID NO: 1364342 - DNA, 22 bp, Artificial Sequence
  chemically synthesized
taatttatttcatcatactcgg

SEQ ID NO: 1364343 - DNA, 22 bp, Artificial Sequence
  chemically synthesized
aatttatttcatcatactcggc

SEQ ID NO: 1364344 - DNA, 22 bp, Artificial Sequence
  chemically synthesized
atttatttcatcatactcggct

SEQ ID NO: 1364345 - DNA, 22 bp, Artificial Sequence
  chemically synthesized
atttcatcatactcggcttttt

SEQ ID NO: 1364346 - DNA, 22 bp, Artificial Sequence
  chemically synthesized
tttcatcatactcggctttttt

SEQ ID NO: 1364347 - DNA, 22 bp, Artificial Sequence
  chemically synthesized
catcatactcggcttttttaca

SEQ ID NO: 1364348 - DNA, 22 bp, Artificial Sequence
  chemically synthesized
atcatactcggcttttttacac

SEQ ID NO: 1364349 - DNA, 22 bp, Artificial Sequence
  chemically synthesized
atcacaacacaaagcactgtgt

SEQ ID NO: 1364350 - DNA, 22 bp, Artificial Sequence
  chemically synthesized
ggcttttttacacagtgctttg

SEQ ID NO: 1364351 - DNA, 22 bp, Artificial Sequence
  chemically synthesized
ttttacacagtgctttgtgttg

SEQ ID NO: 1364352 - DNA, 22 bp, Artificial Sequence
  chemically synthesized
tttacacagtgctttgtgttgt

SEQ ID NO: 1364353 - DNA, 22 bp, Artificial Sequence
  chemically synthesized
atatatctaatcacaacacaaa

SEQ ID NO: 1364354 - DNA, 22 bp, Artificial Sequence
  chemically synthesized
ttacacagtgctttgtgttgtg

SEQ ID NO: 1364355 - DNA, 22 bp, Artificial Sequence
  chemically synthesized
tacacagtgctttgtgttgtga

SEQ ID NO: 1364356 - DNA, 22 bp, Artificial Sequence
  chemically synthesized
acacagtgctttgtgttgtgat

SEQ ID NO: 1364357 - DNA, 22 bp, Artificial Sequence
  chemically synthesized
cacagtgctttgtgttgtgatt

SEQ ID NO: 1364358 - DNA, 22 bp, Artificial Sequence
  chemically synthesized
gaaatattaatatatctaatca

SEQ ID NO: 1364359 - DNA, 22 bp, Artificial Sequence
  chemically synthesized
tgtgttgtgattagatatatta

SEQ ID NO: 1364360 - DNA, 22 bp, Artificial Sequence
  chemically synthesized
tattagaaatattaatatatct

SEQ ID NO: 1364361 - DNA, 22 bp, Artificial Sequence
  chemically synthesized
gtgttgtgattagatatattaa

SEQ ID NO: 1364362 - DNA, 22 bp, Artificial Sequence
  chemically synthesized
tgttgtgattagatatattaat

SEQ ID NO: 1364363 - DNA, 22 bp, Artificial Sequence
  chemically synthesized
tgattagatatattaatatttc

SEQ ID NO: 1364364 - DNA, 22 bp, Artificial Sequence
  chemically synthesized
gatatattaatatttctaatat

SEQ ID NO: 1364365 - DNA, 22 bp, Artificial Sequence
  chemically synthesized
atatttctaatataatggcact

SEQ ID NO: 1364366 - DNA, 22 bp, Artificial Sequence
  chemically synthesized
ctaatataatggcactactgtc

SEQ ID NO: 1364367 - DNA, 22 bp, Artificial Sequence
  chemically synthesized
taatataatggcactactgtcg

SEQ ID NO: 1364368 - DNA, 22 bp, Artificial Sequence
  chemically synthesized
atataatggcactactgtcggt

SEQ ID NO: 1364369 - DNA, 22 bp, Artificial Sequence
  chemically synthesized
tgcaatcacatgcataaccgac

SEQ ID NO: 1364370 - DNA, 22 bp, Artificial Sequence
  chemically synthesized
gtgcaatcacatgcataaccga

SEQ ID NO: 1364371 - DNA, 22 bp, Artificial Sequence
  chemically synthesized
tgtgcaatcacatgcataaccg

SEQ ID NO: 1364372 - DNA, 22 bp, Artificial Sequence
  chemically synthesized
ttgtgcaatcacatgcataacc

SEQ ID NO: 1364373 - DNA, 22 bp, Artificial Sequence
  chemically synthesized
tttgtgcaatcacatgcataac

SEQ ID NO: 1364374 - DNA, 22 bp, Artificial Sequence
  chemically synthesized
ttttgtgcaatcacatgcataa

SEQ ID NO: 1364375 - DNA, 22 bp, Artificial Sequence
  chemically synthesized
tttttgtgcaatcacatgcata

SEQ ID NO: 1364376 - DNA, 22 bp, Artificial Sequence
  chemically synthesized
ctttttttgtgcaatcacatgc

SEQ ID NO: 1364377 - DNA, 22 bp, Artificial Sequence
  chemically synthesized
ctgtcggttatgcatgtgattg

SEQ ID NO: 1364378 - DNA, 22 bp, Artificial Sequence
  chemically synthesized
cctttttttgtgcaatcacatg

SEQ ID NO: 1364379 - DNA, 22 bp, Artificial Sequence
  chemically synthesized
tcctttttttgtgcaatcacat

SEQ ID NO: 1364380 - DNA, 22 bp, Artificial Sequence
  chemically synthesized
tcggttatgcatgtgattgcac

SEQ ID NO: 1364381 - DNA, 22 bp, Artificial Sequence
  chemically synthesized
ttttcctttttttgtgcaatca

SEQ ID NO: 1364382 - DNA, 22 bp, Artificial Sequence
  chemically synthesized
ctgttttcctttttttgtgcaa

SEQ ID NO: 1364383 - DNA, 22 bp, Artificial Sequence
  chemically synthesized
tgctgttttcctttttttgtgc

SEQ ID NO: 1364384 - DNA, 22 bp, Artificial Sequence
  chemically synthesized
tgcatgtgattgcacaaaaaaa

SEQ ID NO: 1364385 - DNA, 22 bp, Artificial Sequence
  chemically synthesized
gaaactctgctgttttcctttt

SEQ ID NO: 1364386 - DNA, 22 bp, Artificial Sequence
  chemically synthesized
ggaaactctgctgttttccttt

SEQ ID NO: 1364387 - DNA, 22 bp, Artificial Sequence
  chemically synthesized
tggaaactctgctgttttcctt

SEQ ID NO: 1364388 - DNA, 22 bp, Artificial Sequence
  chemically synthesized
cacaaaaaaaggaaaacagcag

SEQ ID NO: 1364389 - DNA, 22 bp, Artificial Sequence
  chemically synthesized
ccaaaacccgttcttttcctgt

SEQ ID NO: 1364390 - DNA, 22 bp, Artificial Sequence
  chemically synthesized
caaaacccgttcttttcctgtt

SEQ ID NO: 1364391 - DNA, 22 bp, Artificial Sequence
  chemically synthesized
aaaagcaaaaacaaacaggaaa

SEQ ID NO: 1364392 - DNA, 22 bp, Artificial Sequence
  chemically synthesized
aaaaagcaaaaacaaacaggaa

SEQ ID NO: 1364393 - DNA, 22 bp, Artificial Sequence
  chemically synthesized
ttaaaaagcaaaaacaaacagg

SEQ ID NO: 1364394 - DNA, 22 bp, Artificial Sequence
  chemically synthesized
cttaaaaagcaaaaacaaacag

SEQ ID NO: 1364395 - DNA, 22 bp, Artificial Sequence
  chemically synthesized
ttttcctgtttgtttttgcttt

SEQ ID NO: 1364396 - DNA, 22 bp, Artificial Sequence
  chemically synthesized
ttcctgtttgtttttgcttttt

SEQ ID NO: 1364397 - DNA, 22 bp, Artificial Sequence
  chemically synthesized
tcctgtttgtttttgcttttta

SEQ ID NO: 1364398 - DNA, 22 bp, Artificial Sequence
  chemically synthesized
cctgtttgtttttgctttttaa

SEQ ID NO: 1364399 - DNA, 22 bp, Artificial Sequence
  chemically synthesized
aatgaaaatttcttaaaaagca

SEQ ID NO: 1364400 - DNA, 22 bp, Artificial Sequence
  chemically synthesized
ctgtttgtttttgctttttaag

SEQ ID NO: 1364401 - DNA, 22 bp, Artificial Sequence
  chemically synthesized
aaatgaaaatttcttaaaaagc

SEQ ID NO: 1364402 - DNA, 22 bp, Artificial Sequence
  chemically synthesized
ttaaatgaaaatttcttaaaaa

SEQ ID NO: 1364403 - DNA, 22 bp, Artificial Sequence
  chemically synthesized
tttgtttttgctttttaagaaa

SEQ ID NO: 1364404 - DNA, 22 bp, Artificial Sequence
  chemically synthesized
gtttttgctttttaagaaattt

SEQ ID NO: 1364405 - DNA, 22 bp, Artificial Sequence
  chemically synthesized
tttttgctttttaagaaatttt

SEQ ID NO: 1364406 - DNA, 22 bp, Artificial Sequence
  chemically synthesized
catctcttaaatgaaaatttct

SEQ ID NO: 1364407 - DNA, 22 bp, Artificial Sequence
  chemically synthesized
ttgctttttaagaaattttcat

SEQ ID NO: 1364408 - DNA, 22 bp, Artificial Sequence
  chemically synthesized
tgctttttaagaaattttcatt

SEQ ID NO: 1364409 - DNA, 22 bp, Artificial Sequence
  chemically synthesized
gctttttaagaaattttcattt

SEQ ID NO: 1364410 - DNA, 22 bp, Artificial Sequence
  chemically synthesized
ctttttaagaaattttcattta

SEQ ID NO: 1364411 - DNA, 22 bp, Artificial Sequence
  chemically synthesized
tttaagaaattttcatttaaga

SEQ ID NO: 1364412 - DNA, 22 bp, Artificial Sequence
  chemically synthesized
ttaagaaattttcatttaagag

SEQ ID NO: 1364413 - DNA, 22 bp, Artificial Sequence
  chemically synthesized
taagaaattttcatttaagaga

SEQ ID NO: 1364414 - DNA, 22 bp, Artificial Sequence
  chemically synthesized
aagaaattttcatttaagagat

SEQ ID NO: 1364415 - DNA, 22 bp, Artificial Sequence
  chemically synthesized
agaaattttcatttaagagatg

SEQ ID NO: 1364416 - DNA, 22 bp, Artificial Sequence
  chemically synthesized
gatgacagagcaagcctccatc

SEQ ID NO: 1364417 - DNA, 22 bp, Artificial Sequence
  chemically synthesized
tcatttaagagatggaggcttg

SEQ ID NO: 1364418 - DNA, 22 bp, Artificial Sequence
  chemically synthesized
catttaagagatggaggcttgc

SEQ ID NO: 1364419 - DNA, 22 bp, Artificial Sequence
  chemically synthesized
atttaagagatggaggcttgct

SEQ ID NO: 1364420 - DNA, 22 bp, Artificial Sequence
  chemically synthesized
cagcctggatgacagagcaagc

SEQ ID NO: 1364421 - DNA, 22 bp, Artificial Sequence
  chemically synthesized
aagagatggaggcttgctctgt

SEQ ID NO: 1364422 - DNA, 22 bp, Artificial Sequence
  chemically synthesized
agagatggaggcttgctctgtc

SEQ ID NO: 1364423 - DNA, 22 bp, Artificial Sequence
  chemically synthesized
cactccagcctggatgacagag

SEQ ID NO: 1364424 - DNA, 22 bp, Artificial Sequence
  chemically synthesized
tgtcgctacactccagcctgga

SEQ ID NO: 1364425 - DNA, 22 bp, Artificial Sequence
  chemically synthesized
gctctgtcatccaggctggagt

SEQ ID NO: 1364426 - DNA, 22 bp, Artificial Sequence
  chemically synthesized
ctctgtcatccaggctggagtg

SEQ ID NO: 1364427 - DNA, 22 bp, Artificial Sequence
  chemically synthesized
tgtcatccaggctggagtgtag

SEQ ID NO: 1364428 - DNA, 22 bp, Artificial Sequence
  chemically synthesized
tcatccaggctggagtgtagcg

SEQ ID NO: 1364429 - DNA, 22 bp, Artificial Sequence
  chemically synthesized
taacgaggtatgattgtgtcgc

SEQ ID NO: 1364430 - DNA, 22 bp, Artificial Sequence
  chemically synthesized
gagtgtagcgacacaatcatac

SEQ ID NO: 1364431 - DNA, 22 bp, Artificial Sequence
  chemically synthesized
agactataacgaggtatgattg

SEQ ID NO: 1364432 - DNA, 22 bp, Artificial Sequence
  chemically synthesized
gagactataacgaggtatgatt

SEQ ID NO: 1364433 - DNA, 22 bp, Artificial Sequence
  chemically synthesized
agcccaggagtttgagactata

SEQ ID NO: 1364434 - DNA, 22 bp, Artificial Sequence
  chemically synthesized
gagcccaggagtttgagactat

SEQ ID NO: 1364435 - DNA, 22 bp, Artificial Sequence
  chemically synthesized
gttatagtctcaaactcctggg

SEQ ID NO: 1364436 - DNA, 22 bp, Artificial Sequence
  chemically synthesized
tagtctcaaactcctgggctca

SEQ ID NO: 1364437 - DNA, 22 bp, Artificial Sequence
  chemically synthesized
aggcaggaggatcacttgagcc

SEQ ID NO: 1364438 - DNA, 22 bp, Artificial Sequence
  chemically synthesized
aaactcctgggctcaagtgatc

SEQ ID NO: 1364439 - DNA, 22 bp, Artificial Sequence
  chemically synthesized
ctgggctcaagtgatcctcctg

SEQ ID NO: 1364440 - DNA, 22 bp, Artificial Sequence
  chemically synthesized
agaagattgaggcaggaggatc

SEQ ID NO: 1364441 - DNA, 22 bp, Artificial Sequence
  chemically synthesized
ggctcaagtgatcctcctgcct

SEQ ID NO: 1364442 - DNA, 22 bp, Artificial Sequence
  chemically synthesized
ctcagaagattgaggcaggagg

SEQ ID NO: 1364443 - DNA, 22 bp, Artificial Sequence
  chemically synthesized
aagtgatcctcctgcctcaatc

SEQ ID NO: 1364444 - DNA, 22 bp, Artificial Sequence
  chemically synthesized
tagacccagctactcagaagat

SEQ ID NO: 1364445 - DNA, 22 bp, Artificial Sequence
  chemically synthesized
ctgcctcaatcttctgagtagc

SEQ ID NO: 1364446 - DNA, 22 bp, Artificial Sequence
  chemically synthesized
acctgtagacccagctactcag

SEQ ID NO: 1364447 - DNA, 22 bp, Artificial Sequence
  chemically synthesized
cctcaatcttctgagtagctgg

SEQ ID NO: 1364448 - DNA, 22 bp, Artificial Sequence
  chemically synthesized
aatcttctgagtagctgggtct

SEQ ID NO: 1364449 - DNA, 22 bp, Artificial Sequence
  chemically synthesized
ctgagtagctgggtctacaggt

SEQ ID NO: 1364450 - DNA, 22 bp, Artificial Sequence
  chemically synthesized
tgagtagctgggtctacaggtg

SEQ ID NO: 1364451 - DNA, 22 bp, Artificial Sequence
  chemically synthesized
agtagctgggtctacaggtgaa

SEQ ID NO: 1364452 - DNA, 22 bp, Artificial Sequence
  chemically synthesized
aatatggtggcattcacctgta

SEQ ID NO: 1364453 - DNA, 22 bp, Artificial Sequence
  chemically synthesized
gctgaatatggtggcattcacc

SEQ ID NO: 1364454 - DNA, 22 bp, Artificial Sequence
  chemically synthesized
ggtctacaggtgaatgccacca

SEQ ID NO: 1364455 - DNA, 22 bp, Artificial Sequence
  chemically synthesized
aattagctgaatatggtggcat

SEQ ID NO: 1364456 - DNA, 22 bp, Artificial Sequence
  chemically synthesized
caggtgaatgccaccatattca

SEQ ID NO: 1364457 - DNA, 22 bp, Artificial Sequence
  chemically synthesized
aaaaaaatattaaattagctga

SEQ ID NO: 1364458 - DNA, 22 bp, Artificial Sequence
  chemically synthesized
taaaaaaaatattaaattagct

SEQ ID NO: 1364459 - DNA, 22 bp, Artificial Sequence
  chemically synthesized
tctctaaaaaaaatattaaatt

SEQ ID NO: 1364460 - DNA, 22 bp, Artificial Sequence
  chemically synthesized
agctaatttaatatttttttta

SEQ ID NO: 1364461 - DNA, 22 bp, Artificial Sequence
  chemically synthesized
atttaatattttttttagagac

SEQ ID NO: 1364462 - DNA, 22 bp, Artificial Sequence
  chemically synthesized
aatattttttttagagacaggg

SEQ ID NO: 1364463 - DNA, 22 bp, Artificial Sequence
  chemically synthesized
atattttttttagagacagggt

SEQ ID NO: 1364464 - DNA, 22 bp, Artificial Sequence
  chemically synthesized
cgcaacataacaagaccctgtc

SEQ ID NO: 1364465 - DNA, 22 bp, Artificial Sequence
  chemically synthesized
tttttagagacagggtcttgtt

SEQ ID NO: 1364466 - DNA, 22 bp, Artificial Sequence
  chemically synthesized
ttttagagacagggtcttgtta

SEQ ID NO: 1364467 - DNA, 22 bp, Artificial Sequence
  chemically synthesized
tttagagacagggtcttgttat

SEQ ID NO: 1364468 - DNA, 22 bp, Artificial Sequence
  chemically synthesized
ttagagacagggtcttgttatg

SEQ ID NO: 1364469 - DNA, 22 bp, Artificial Sequence
  chemically synthesized
tagagacagggtcttgttatgt

SEQ ID NO: 1364470 - DNA, 22 bp, Artificial Sequence
  chemically synthesized
agagacagggtcttgttatgtt

SEQ ID NO: 1364471 - DNA, 22 bp, Artificial Sequence
  chemically synthesized
gagacagggtcttgttatgttg

SEQ ID NO: 1364472 - DNA, 22 bp, Artificial Sequence
  chemically synthesized
aagaccagcctgcgcaacataa

SEQ ID NO: 1364473 - DNA, 22 bp, Artificial Sequence
  chemically synthesized
gttatgttgcgcaggctggtct

SEQ ID NO: 1364474 - DNA, 22 bp, Artificial Sequence
  chemically synthesized
ttatgttgcgcaggctggtctt

SEQ ID NO: 1364475 - DNA, 22 bp, Artificial Sequence
  chemically synthesized
aggccagaagttaaagaccagc

SEQ ID NO: 1364476 - DNA, 22 bp, Artificial Sequence
  chemically synthesized
gaggccagaagttaaagaccag

SEQ ID NO: 1364477 - DNA, 22 bp, Artificial Sequence
  chemically synthesized
tgttgcgcaggctggtctttaa

SEQ ID NO: 1364478 - DNA, 22 bp, Artificial Sequence
  chemically synthesized
cttgaggccagaagttaaagac

SEQ ID NO: 1364479 - DNA, 22 bp, Artificial Sequence
  chemically synthesized
cgcaggctggtctttaacttct

SEQ ID NO: 1364480 - DNA, 22 bp, Artificial Sequence
  chemically synthesized
gtctttaacttctggcctcaag

SEQ ID NO: 1364481 - DNA, 22 bp, Artificial Sequence
  chemically synthesized
aggcaggaggattacttgaggc

SEQ ID NO: 1364482 - DNA, 22 bp, Artificial Sequence
  chemically synthesized
taacttctggcctcaagtaatc

SEQ ID NO: 1364483 - DNA, 22 bp, Artificial Sequence
  chemically synthesized
aacttctggcctcaagtaatcc

SEQ ID NO: 1364484 - DNA, 22 bp, Artificial Sequence
  chemically synthesized
acttctggcctcaagtaatcct

SEQ ID NO: 1364485 - DNA, 22 bp, Artificial Sequence
  chemically synthesized
ctggcctcaagtaatcctcctg

SEQ ID NO: 1364486 - DNA, 22 bp, Artificial Sequence
  chemically synthesized
gggaggctgaggcaggaggatt

SEQ ID NO: 1364487 - DNA, 22 bp, Artificial Sequence
  chemically synthesized
tggcctcaagtaatcctcctgc

SEQ ID NO: 1364488 - DNA, 22 bp, Artificial Sequence
  chemically synthesized
gcctcaagtaatcctcctgcct

SEQ ID NO: 1364489 - DNA, 22 bp, Artificial Sequence
  chemically synthesized
ctggggaggctgaggcaggagg

SEQ ID NO: 1364490 - DNA, 22 bp, Artificial Sequence
  chemically synthesized
aagtaatcctcctgcctcagcc

SEQ ID NO: 1364491 - DNA, 22 bp, Artificial Sequence
  chemically synthesized
taatcccagctcctggggaggc

SEQ ID NO: 1364492 - DNA, 22 bp, Artificial Sequence
  chemically synthesized
ctgcctcagcctccccaggagc

SEQ ID NO: 1364493 - DNA, 22 bp, Artificial Sequence
  chemically synthesized
cctcagcctccccaggagctgg

SEQ ID NO: 1364494 - DNA, 22 bp, Artificial Sequence
  chemically synthesized
atgcctataatcccagctcctg

SEQ ID NO: 1364495 - DNA, 22 bp, Artificial Sequence
  chemically synthesized
agcctccccaggagctgggatt

SEQ ID NO: 1364496 - DNA, 22 bp, Artificial Sequence
  chemically synthesized
cccaggagctgggattataggc

SEQ ID NO: 1364497 - DNA, 22 bp, Artificial Sequence
  chemically synthesized
gccgagtgtggtggctcatgcc

SEQ ID NO: 1364498 - DNA, 22 bp, Artificial Sequence
  chemically synthesized
ggattataggcatgagccacca

SEQ ID NO: 1364499 - DNA, 22 bp, Artificial Sequence
  chemically synthesized
caaactggccgagtgtggtggc

SEQ ID NO: 1364500 - DNA, 22 bp, Artificial Sequence
  chemically synthesized
acaaactggccgagtgtggtgg

SEQ ID NO: 1364501 - DNA, 22 bp, Artificial Sequence
  chemically synthesized
tacaaactggccgagtgtggtg

SEQ ID NO: 1364502 - DNA, 22 bp, Artificial Sequence
  chemically synthesized
taggcatgagccaccacactcg

SEQ ID NO: 1364503 - DNA, 22 bp, Artificial Sequence
  chemically synthesized
ttacaaactggccgagtgtggt

SEQ ID NO: 1364504 - DNA, 22 bp, Artificial Sequence
  chemically synthesized
tttacaaactggccgagtgtgg

SEQ ID NO: 1364505 - DNA, 22 bp, Artificial Sequence
  chemically synthesized
tttttacaaactggccgagtgt

SEQ ID NO: 1364506 - DNA, 22 bp, Artificial Sequence
  chemically synthesized
ctttttacaaactggccgagtg

SEQ ID NO: 1364507 - DNA, 22 bp, Artificial Sequence
  chemically synthesized
aatgtgcttctttttacaaact

SEQ ID NO: 1364508 - DNA, 22 bp, Artificial Sequence
  chemically synthesized
aaatgtgcttctttttacaaac

SEQ ID NO: 1364509 - DNA, 22 bp, Artificial Sequence
  chemically synthesized
taaatgtgcttctttttacaaa

SEQ ID NO: 1364510 - DNA, 22 bp, Artificial Sequence
  chemically synthesized
ttaaatgtgcttctttttacaa

SEQ ID NO: 1364511 - DNA, 22 bp, Artificial Sequence
  chemically synthesized
ggccagtttgtaaaaagaagca

SEQ ID NO: 1364512 - DNA, 22 bp, Artificial Sequence
  chemically synthesized
gtaaaaagaagcacatttaaaa

SEQ ID NO: 1364513 - DNA, 22 bp, Artificial Sequence
  chemically synthesized
taaaaagaagcacatttaaaaa

SEQ ID NO: 1364514 - DNA, 22 bp, Artificial Sequence
  chemically synthesized
acaacgtaaacatttttaaatg

SEQ ID NO: 1364515 - DNA, 22 bp, Artificial Sequence
  chemically synthesized
aacaacgtaaacatttttaaat

SEQ ID NO: 1364516 - DNA, 22 bp, Artificial Sequence
  chemically synthesized
taacaacgtaaacatttttaaa

SEQ ID NO: 1364517 - DNA, 22 bp, Artificial Sequence
  chemically synthesized
ttaacaacgtaaacatttttaa

SEQ ID NO: 1364518 - DNA, 22 bp, Artificial Sequence
  chemically synthesized
tttaacaacgtaaacattttta

SEQ ID NO: 1364519 - DNA, 22 bp, Artificial Sequence
  chemically synthesized
aaaaatgtttacgttgttaaaa

SEQ ID NO: 1364520 - DNA, 22 bp, Artificial Sequence
  chemically synthesized
aaaatgtttacgttgttaaaaa

SEQ ID NO: 1364521 - DNA, 22 bp, Artificial Sequence
  chemically synthesized
acgttgttaaaaaatgttatat

SEQ ID NO: 1364522 - DNA, 22 bp, Artificial Sequence
  chemically synthesized
cgttgttaaaaaatgttatatg

SEQ ID NO: 1364523 - DNA, 22 bp, Artificial Sequence
  chemically synthesized
ttaaaaaatgttatatgcttgt

SEQ ID NO: 1364524 - DNA, 22 bp, Artificial Sequence
  chemically synthesized
aaaaatgttatatgcttgttgg

SEQ ID NO: 1364525 - DNA, 22 bp, Artificial Sequence
  chemically synthesized
aaagaagacatacaagcggcca

SEQ ID NO: 1364526 - DNA, 22 bp, Artificial Sequence
  chemically synthesized
gaaagaagacatacaagcggcc

SEQ ID NO: 1364527 - DNA, 22 bp, Artificial Sequence
  chemically synthesized
tatgcttgttggccgcttgtat

SEQ ID NO: 1364528 - DNA, 22 bp, Artificial Sequence
  chemically synthesized
ttgaaagaagacatacaagcgg

SEQ ID NO: 1364529 - DNA, 22 bp, Artificial Sequence
  chemically synthesized
cttgaaagaagacatacaagcg

SEQ ID NO: 1364530 - DNA, 22 bp, Artificial Sequence
  chemically synthesized
gttggccgcttgtatgtcttct

SEQ ID NO: 1364531 - DNA, 22 bp, Artificial Sequence
  chemically synthesized
ttggccgcttgtatgtcttctt

SEQ ID NO: 1364532 - DNA, 22 bp, Artificial Sequence
  chemically synthesized
gccgcttgtatgtcttctttca

SEQ ID NO: 1364533 - DNA, 22 bp, Artificial Sequence
  chemically synthesized
aacagacacttcttgaaagaag

SEQ ID NO: 1364534 - DNA, 22 bp, Artificial Sequence
  chemically synthesized
gtatgtcttctttcaagaagtg

SEQ ID NO: 1364535 - DNA, 22 bp, Artificial Sequence
  chemically synthesized
tatgtcttctttcaagaagtgt

SEQ ID NO: 1364536 - DNA, 22 bp, Artificial Sequence
  chemically synthesized
acacacccggcctgaacagaca

SEQ ID NO: 1364537 - DNA, 22 bp, Artificial Sequence
  chemically synthesized
ctttcaagaagtgtctgttcag

SEQ ID NO: 1364538 - DNA, 22 bp, Artificial Sequence
  chemically synthesized
tttcaagaagtgtctgttcagg

SEQ ID NO: 1364539 - DNA, 22 bp, Artificial Sequence
  chemically synthesized
tcaagaagtgtctgttcaggcc

SEQ ID NO: 1364540 - DNA, 22 bp, Artificial Sequence
  chemically synthesized
caagaagtgtctgttcaggccg

SEQ ID NO: 1364541 - DNA, 22 bp, Artificial Sequence
  chemically synthesized
aagaagtgtctgttcaggccgg

SEQ ID NO: 1364542 - DNA, 22 bp, Artificial Sequence
  chemically synthesized
caggcatgagctaacacacccg

SEQ ID NO: 1364543 - DNA, 22 bp, Artificial Sequence
  chemically synthesized
ttcaggccgggtgtgttagctc

SEQ ID NO: 1364544 - DNA, 22 bp, Artificial Sequence
  chemically synthesized
aggccgggtgtgttagctcatg

SEQ ID NO: 1364545 - DNA, 22 bp, Artificial Sequence
  chemically synthesized
aaagtaatagaattacaggcat

SEQ ID NO: 1364546 - DNA, 22 bp, Artificial Sequence
  chemically synthesized
tcaaagtaatagaattacaggc

SEQ ID NO: 1364547 - DNA, 22 bp, Artificial Sequence
  chemically synthesized
ctcaaagtaatagaattacagg

SEQ ID NO: 1364548 - DNA, 22 bp, Artificial Sequence
  chemically synthesized
gctcatgcctgtaattctatta

SEQ ID NO: 1364549 - DNA, 22 bp, Artificial Sequence
  chemically synthesized
aacttctcaaagtaatagaatt

SEQ ID NO: 1364550 - DNA, 22 bp, Artificial Sequence
  chemically synthesized
atgcctgtaattctattacttt

SEQ ID NO: 1364551 - DNA, 22 bp, Artificial Sequence
  chemically synthesized
cctcaacttctcaaagtaatag

SEQ ID NO: 1364552 - DNA, 22 bp, Artificial Sequence
  chemically synthesized
cctgcctcaacttctcaaagta

SEQ ID NO: 1364553 - DNA, 22 bp, Artificial Sequence
  chemically synthesized
taattctattactttgagaagt

SEQ ID NO: 1364554 - DNA, 22 bp, Artificial Sequence
  chemically synthesized
tattactttgagaagttgaggc

SEQ ID NO: 1364555 - DNA, 22 bp, Artificial Sequence
  chemically synthesized
ttactttgagaagttgaggcag

SEQ ID NO: 1364556 - DNA, 22 bp, Artificial Sequence
  chemically synthesized
aaagcgatctgcctgcctcaac

SEQ ID NO: 1364557 - DNA, 22 bp, Artificial Sequence
  chemically synthesized
ctttgagaagttgaggcaggca

SEQ ID NO: 1364558 - DNA, 22 bp, Artificial Sequence
  chemically synthesized
agctcaaagcgatctgcctgcc

SEQ ID NO: 1364559 - DNA, 22 bp, Artificial Sequence
  chemically synthesized
tgagaagttgaggcaggcagat

SEQ ID NO: 1364560 - DNA, 22 bp, Artificial Sequence
  chemically synthesized
gagaagttgaggcaggcagatc

SEQ ID NO: 1364561 - DNA, 22 bp, Artificial Sequence
  chemically synthesized
agaagttgaggcaggcagatcg

SEQ ID NO: 1364562 - DNA, 22 bp, Artificial Sequence
  chemically synthesized
ctgagctcaaagcgatctgcct

SEQ ID NO: 1364563 - DNA, 22 bp, Artificial Sequence
  chemically synthesized
aactcctgagctcaaagcgatc

SEQ ID NO: 1364564 - DNA, 22 bp, Artificial Sequence
  chemically synthesized
gaactcctgagctcaaagcgat

SEQ ID NO: 1364565 - DNA, 22 bp, Artificial Sequence
  chemically synthesized
aggcaggcagatcgctttgagc

SEQ ID NO: 1364566 - DNA, 22 bp, Artificial Sequence
  chemically synthesized
gtcttgaactcctgagctcaaa

SEQ ID NO: 1364567 - DNA, 22 bp, Artificial Sequence
  chemically synthesized
gctggtcttgaactcctgagct

SEQ ID NO: 1364568 - DNA, 22 bp, Artificial Sequence
  chemically synthesized
tgagctcaggagttcaagacca

SEQ ID NO: 1364569 - DNA, 22 bp, Artificial Sequence
  chemically synthesized
gagctcaggagttcaagaccag

SEQ ID NO: 1364570 - DNA, 22 bp, Artificial Sequence
  chemically synthesized
agctcaggagttcaagaccagc

SEQ ID NO: 1364571 - DNA, 22 bp, Artificial Sequence
  chemically synthesized
accatgtcgccctggctggtct

SEQ ID NO: 1364572 - DNA, 22 bp, Artificial Sequence
  chemically synthesized
caccatgtcgccctggctggtc

SEQ ID NO: 1364573 - DNA, 22 bp, Artificial Sequence
  chemically synthesized
aggagttcaagaccagccaggg

SEQ ID NO: 1364574 - DNA, 22 bp, Artificial Sequence
  chemically synthesized
aagaccagccagggcgacatgg

SEQ ID NO: 1364575 - DNA, 22 bp, Artificial Sequence
  chemically synthesized
gagatggggtttcaccatgtcg

SEQ ID NO: 1364576 - DNA, 22 bp, Artificial Sequence
  chemically synthesized
agagatggggtttcaccatgtc

SEQ ID NO: 1364577 - DNA, 22 bp, Artificial Sequence
  chemically synthesized
tagagatggggtttcaccatgt

SEQ ID NO: 1364578 - DNA, 22 bp, Artificial Sequence
  chemically synthesized
ttagagatggggtttcaccatg

SEQ ID NO: 1364579 - DNA, 22 bp, Artificial Sequence
  chemically synthesized
tttagagatggggtttcaccat

SEQ ID NO: 1364580 - DNA, 22 bp, Artificial Sequence
  chemically synthesized
ttttagagatggggtttcacca

SEQ ID NO: 1364581 - DNA, 22 bp, Artificial Sequence
  chemically synthesized
tttttagagatggggtttcacc

SEQ ID NO: 1364582 - DNA, 22 bp, Artificial Sequence
  chemically synthesized
tattttttttagagatggggtt

SEQ ID NO: 1364583 - DNA, 22 bp, Artificial Sequence
  chemically synthesized
acatcacggctgtatttttttt

SEQ ID NO: 1364584 - DNA, 22 bp, Artificial Sequence
  chemically synthesized
taaaaaaaatacagccgtgatg

SEQ ID NO: 1364585 - DNA, 22 bp, Artificial Sequence
  chemically synthesized
aaaaaaatacagccgtgatgtc

SEQ ID NO: 1364586 - DNA, 22 bp, Artificial Sequence
  chemically synthesized
tgatgacaggcgcctgacatca

SEQ ID NO: 1364587 - DNA, 22 bp, Artificial Sequence
  chemically synthesized
agtggctgtgatgacaggcgcc

SEQ ID NO: 1364588 - DNA, 22 bp, Artificial Sequence
  chemically synthesized
ctgagtggctgtgatgacaggc

SEQ ID NO: 1364589 - DNA, 22 bp, Artificial Sequence
  chemically synthesized
agcctcctgagtggctgtgatg

SEQ ID NO: 1364590 - DNA, 22 bp, Artificial Sequence
  chemically synthesized
cagcctcagcctcctgagtggc

SEQ ID NO: 1364591 - DNA, 22 bp, Artificial Sequence
  chemically synthesized
tccagcctcagcctcctgagtg

SEQ ID NO: 1364592 - DNA, 22 bp, Artificial Sequence
  chemically synthesized
tcatcacagccactcaggaggc

SEQ ID NO: 1364593 - DNA, 22 bp, Artificial Sequence
  chemically synthesized
aagcgattctccagcctcagcc

SEQ ID NO: 1364594 - DNA, 22 bp, Artificial Sequence
  chemically synthesized
ctcaagcgattctccagcctca

SEQ ID NO: 1364595 - DNA, 22 bp, Artificial Sequence
  chemically synthesized
aggaggctgaggctggagaatc

SEQ ID NO: 1364596 - DNA, 22 bp, Artificial Sequence
  chemically synthesized
ccctgctcaagcgattctccag

SEQ ID NO: 1364597 - DNA, 22 bp, Artificial Sequence
  chemically synthesized
acctcccctgctcaagcgattc

SEQ ID NO: 1364598 - DNA, 22 bp, Artificial Sequence
  chemically synthesized
cacctcccctgctcaagcgatt

SEQ ID NO: 1364599 - DNA, 22 bp, Artificial Sequence
  chemically synthesized
aggctggagaatcgcttgagca

SEQ ID NO: 1364600 - DNA, 22 bp, Artificial Sequence
  chemically synthesized
caaacttcacctcccctgctca

SEQ ID NO: 1364601 - DNA, 22 bp, Artificial Sequence
  chemically synthesized
gagaatcgcttgagcaggggag

SEQ ID NO: 1364602 - DNA, 22 bp, Artificial Sequence
  chemically synthesized
actgcaaacttcacctcccctg

SEQ ID NO: 1364603 - DNA, 22 bp, Artificial Sequence
  chemically synthesized
ggctcactgcaaacttcacctc

SEQ ID NO: 1364604 - DNA, 22 bp, Artificial Sequence
  chemically synthesized
gagcaggggaggtgaagtttgc

SEQ ID NO: 1364605 - DNA, 22 bp, Artificial Sequence
  chemically synthesized
agcaggggaggtgaagtttgca

SEQ ID NO: 1364606 - DNA, 22 bp, Artificial Sequence
  chemically synthesized
aagtgcagtggcacagtctcgg

SEQ ID NO: 1364607 - DNA, 22 bp, Artificial Sequence
  chemically synthesized
gcagtgagccgagactgtgcca

SEQ ID NO: 1364608 - DNA, 22 bp, Artificial Sequence
  chemically synthesized
cagtgagccgagactgtgccac

SEQ ID NO: 1364609 - DNA, 22 bp, Artificial Sequence
  chemically synthesized
gtccaggctgaagtgcagtggc

SEQ ID NO: 1364610 - DNA, 22 bp, Artificial Sequence
  chemically synthesized
agtccaggctgaagtgcagtgg

SEQ ID NO: 1364611 - DNA, 22 bp, Artificial Sequence
  chemically synthesized
ttagtccaggctgaagtgcagt

SEQ ID NO: 1364612 - DNA, 22 bp, Artificial Sequence
  chemically synthesized
ctcttagtccaggctgaagtgc

SEQ ID NO: 1364613 - DNA, 22 bp, Artificial Sequence
  chemically synthesized
gctcttagtccaggctgaagtg

SEQ ID NO: 1364614 - DNA, 22 bp, Artificial Sequence
  chemically synthesized
tgccactgcacttcagcctgga

SEQ ID NO: 1364615 - DNA, 22 bp, Artificial Sequence
  chemically synthesized
cacttcagcctggactaagagc

SEQ ID NO: 1364616 - DNA, 22 bp, Artificial Sequence
  chemically synthesized
agatagggtcttgctcttagtc

SEQ ID NO: 1364617 - DNA, 22 bp, Artificial Sequence
  chemically synthesized
gagatagggtcttgctcttagt

SEQ ID NO: 1364618 - DNA, 22 bp, Artificial Sequence
  chemically synthesized
tgagatagggtcttgctcttag

SEQ ID NO: 1364619 - DNA, 22 bp, Artificial Sequence
  chemically synthesized
ttgagatagggtcttgctctta

SEQ ID NO: 1364620 - DNA, 22 bp, Artificial Sequence
  chemically synthesized
tttgagatagggtcttgctctt

SEQ ID NO: 1364621 - DNA, 22 bp, Artificial Sequence
  chemically synthesized
cagcctggactaagagcaagac

SEQ ID NO: 1364622 - DNA, 22 bp, Artificial Sequence
  chemically synthesized
ttttgagatagggtcttgctct

SEQ ID NO: 1364623 - DNA, 22 bp, Artificial Sequence
  chemically synthesized
agcctggactaagagcaagacc

SEQ ID NO: 1364624 - DNA, 22 bp, Artificial Sequence
  chemically synthesized
tttttgagatagggtcttgctc

SEQ ID NO: 1364625 - DNA, 22 bp, Artificial Sequence
  chemically synthesized
ttttttgagatagggtcttgct

SEQ ID NO: 1364626 - DNA, 22 bp, Artificial Sequence
  chemically synthesized
tttttttgagatagggtcttgc

SEQ ID NO: 1364627 - DNA, 22 bp, Artificial Sequence
  chemically synthesized
ttttttttgagatagggtcttg

SEQ ID NO: 1364628 - DNA, 22 bp, Artificial Sequence
  chemically synthesized
tttttttttgagatagggtctt

SEQ ID NO: 1364629 - DNA, 22 bp, Artificial Sequence
  chemically synthesized
ttttttttttgagatagggtct

SEQ ID NO: 1364630 - DNA, 22 bp, Artificial Sequence
  chemically synthesized
gactaagagcaagaccctatct

SEQ ID NO: 1364631 - DNA, 22 bp, Artificial Sequence
  chemically synthesized
tttttttttttgagatagggtc

SEQ ID NO: 1364632 - DNA, 22 bp, Artificial Sequence
  chemically synthesized
ttttttttttttgagatagggt

SEQ ID NO: 1364633 - DNA, 22 bp, Artificial Sequence
  chemically synthesized
tttttttttttttgagataggg

SEQ ID NO: 1364634 - DNA, 22 bp, Artificial Sequence
  chemically synthesized
ttttttttttttttgagatagg

SEQ ID NO: 1364635 - DNA, 22 bp, Artificial Sequence
  chemically synthesized
agagcaagaccctatctcaaaa

SEQ ID NO: 1364636 - DNA, 22 bp, Artificial Sequence
  chemically synthesized
tctcaaaaaaaaaaaaaaaagt

SEQ ID NO: 1364637 - DNA, 22 bp, Artificial Sequence
  chemically synthesized
aaaaaaaaaaaaaaaagtgtct

SEQ ID NO: 1364638 - DNA, 22 bp, Artificial Sequence
  chemically synthesized
aaaatgggcaaagtatatgaac

SEQ ID NO: 1364639 - DNA, 22 bp, Artificial Sequence
  chemically synthesized
attaaaaatgggcaaagtatat

SEQ ID NO: 1364640 - DNA, 22 bp, Artificial Sequence
  chemically synthesized
ttcatatactttgcccattttt

SEQ ID NO: 1364641 - DNA, 22 bp, Artificial Sequence
  chemically synthesized
atatactttgcccatttttaat

SEQ ID NO: 1364642 - DNA, 22 bp, Artificial Sequence
  chemically synthesized
tgcccatttttaatgaatgtat

SEQ ID NO: 1364643 - DNA, 22 bp, Artificial Sequence
  chemically synthesized
gcccatttttaatgaatgtatt

SEQ ID NO: 1364644 - DNA, 22 bp, Artificial Sequence
  chemically synthesized
cccatttttaatgaatgtattt

SEQ ID NO: 1364645 - DNA, 22 bp, Artificial Sequence
  chemically synthesized
aatcaacaaaccaaatacaaat

SEQ ID NO: 1364646 - DNA, 22 bp, Artificial Sequence
  chemically synthesized
ttaatgaatgtatttgtatttg

SEQ ID NO: 1364647 - DNA, 22 bp, Artificial Sequence
  chemically synthesized
aaatcaacaaaccaaatacaaa

SEQ ID NO: 1364648 - DNA, 22 bp, Artificial Sequence
  chemically synthesized
taatgaatgtatttgtatttgg

SEQ ID NO: 1364649 - DNA, 22 bp, Artificial Sequence
  chemically synthesized
aatgaatgtatttgtatttggt

SEQ ID NO: 1364650 - DNA, 22 bp, Artificial Sequence
  chemically synthesized
atgaatgtatttgtatttggtt

SEQ ID NO: 1364651 - DNA, 22 bp, Artificial Sequence
  chemically synthesized
taagaaacttaaatcaacaaac

SEQ ID NO: 1364652 - DNA, 22 bp, Artificial Sequence
  chemically synthesized
gtatttggtttgttgatttaag

SEQ ID NO: 1364653 - DNA, 22 bp, Artificial Sequence
  chemically synthesized
tatttggtttgttgatttaagt

SEQ ID NO: 1364654 - DNA, 22 bp, Artificial Sequence
  chemically synthesized
ggtttgttgatttaagtttctt

SEQ ID NO: 1364655 - DNA, 22 bp, Artificial Sequence
  chemically synthesized
gtttgttgatttaagtttctta

SEQ ID NO: 1364656 - DNA, 22 bp, Artificial Sequence
  chemically synthesized
gtatccagaatctataagaaac

SEQ ID NO: 1364657 - DNA, 22 bp, Artificial Sequence
  chemically synthesized
gttgatttaagtttcttataga

SEQ ID NO: 1364658 - DNA, 22 bp, Artificial Sequence
  chemically synthesized
ttgatttaagtttcttatagat

SEQ ID NO: 1364659 - DNA, 22 bp, Artificial Sequence
  chemically synthesized
atttaagtttcttatagattct

SEQ ID NO: 1364660 - DNA, 22 bp, Artificial Sequence
  chemically synthesized
aagtttcttatagattctggat

SEQ ID NO: 1364661 - DNA, 22 bp, Artificial Sequence
  chemically synthesized
agtttcttatagattctggata

SEQ ID NO: 1364662 - DNA, 22 bp, Artificial Sequence
  chemically synthesized
acaaaggcctagtatccagaat

SEQ ID NO: 1364663 - DNA, 22 bp, Artificial Sequence
  chemically synthesized
cttatagattctggatactagg

SEQ ID NO: 1364664 - DNA, 22 bp, Artificial Sequence
  chemically synthesized
ttatagattctggatactaggc

SEQ ID NO: 1364665 - DNA, 22 bp, Artificial Sequence
  chemically synthesized
atagattctggatactaggcct

SEQ ID NO: 1364666 - DNA, 22 bp, Artificial Sequence
  chemically synthesized
tagattctggatactaggcctt

SEQ ID NO: 1364667 - DNA, 22 bp, Artificial Sequence
  chemically synthesized
tggatactaggcctttgtcaga

SEQ ID NO: 1364668 - DNA, 22 bp, Artificial Sequence
  chemically synthesized
acaaaatatgcatctgacaaag

SEQ ID NO: 1364669 - DNA, 22 bp, Artificial Sequence
  chemically synthesized
gatactaggcctttgtcagatg

SEQ ID NO: 1364670 - DNA, 22 bp, Artificial Sequence
  chemically synthesized
ggcctttgtcagatgcatattt

SEQ ID NO: 1364671 - DNA, 22 bp, Artificial Sequence
  chemically synthesized
tgtcagatgcatattttgtgaa

SEQ ID NO: 1364672 - DNA, 22 bp, Artificial Sequence
  chemically synthesized
gtcagatgcatattttgtgaat

SEQ ID NO: 1364673 - DNA, 22 bp, Artificial Sequence
  chemically synthesized
tcagatgcatattttgtgaata

SEQ ID NO: 1364674 - DNA, 22 bp, Artificial Sequence
  chemically synthesized
tgtgaatattttctcccattct

SEQ ID NO: 1364675 - DNA, 22 bp, Artificial Sequence
  chemically synthesized
gtgaatattttctcccattctt

SEQ ID NO: 1364676 - DNA, 22 bp, Artificial Sequence
  chemically synthesized
tgaatattttctcccattcttc

SEQ ID NO: 1364677 - DNA, 22 bp, Artificial Sequence
  chemically synthesized
tctcccattcttcgtctgttta

SEQ ID NO: 1364678 - DNA, 22 bp, Artificial Sequence
  chemically synthesized
ctcccattcttcgtctgtttac

SEQ ID NO: 1364679 - DNA, 22 bp, Artificial Sequence
  chemically synthesized
tcccattcttcgtctgtttact

SEQ ID NO: 1364680 - DNA, 22 bp, Artificial Sequence
  chemically synthesized
ccattcttcgtctgtttacttt

SEQ ID NO: 1364681 - DNA, 22 bp, Artificial Sequence
  chemically synthesized
ttcgtctgtttactttgttgat

SEQ ID NO: 1364682 - DNA, 22 bp, Artificial Sequence
  chemically synthesized
cgtctgtttactttgttgatgt

SEQ ID NO: 1364683 - DNA, 22 bp, Artificial Sequence
  chemically synthesized
gtctgtttactttgttgatgtt

SEQ ID NO: 1364684 - DNA, 22 bp, Artificial Sequence
  chemically synthesized
caaagcaaaagaaacatcaaca

SEQ ID NO: 1364685 - DNA, 22 bp, Artificial Sequence
  chemically synthesized
tgcaaagcaaaagaaacatcaa

SEQ ID NO: 1364686 - DNA, 22 bp, Artificial Sequence
  chemically synthesized
ctgcaaagcaaaagaaacatca

SEQ ID NO: 1364687 - DNA, 22 bp, Artificial Sequence
  chemically synthesized
tttactttgttgatgtttcttt

SEQ ID NO: 1364688 - DNA, 22 bp, Artificial Sequence
  chemically synthesized
actttgttgatgtttcttttgc

SEQ ID NO: 1364689 - DNA, 22 bp, Artificial Sequence
  chemically synthesized
ctttgttgatgtttcttttgct

SEQ ID NO: 1364690 - DNA, 22 bp, Artificial Sequence
  chemically synthesized
tgttgatgtttcttttgctttg

SEQ ID NO: 1364691 - DNA, 22 bp, Artificial Sequence
  chemically synthesized
gttgatgtttcttttgctttgc

SEQ ID NO: 1364692 - DNA, 22 bp, Artificial Sequence
  chemically synthesized
ttgatgtttcttttgctttgca

SEQ ID NO: 1364693 - DNA, 22 bp, Artificial Sequence
  chemically synthesized
agccaaagagcttctgcaaagc

SEQ ID NO: 1364694 - DNA, 22 bp, Artificial Sequence
  chemically synthesized
atgtttcttttgctttgcagaa

SEQ ID NO: 1364695 - DNA, 22 bp, Artificial Sequence
  chemically synthesized
actaagccaaagagcttctgca

SEQ ID NO: 1364696 - DNA, 22 bp, Artificial Sequence
  chemically synthesized
gactaagccaaagagcttctgc

SEQ ID NO: 1364697 - DNA, 22 bp, Artificial Sequence
  chemically synthesized
cttttgctttgcagaagctctt

SEQ ID NO: 1364698 - DNA, 22 bp, Artificial Sequence
  chemically synthesized
ttttgctttgcagaagctcttt

SEQ ID NO: 1364699 - DNA, 22 bp, Artificial Sequence
  chemically synthesized
ttgctttgcagaagctctttgg

SEQ ID NO: 1364700 - DNA, 22 bp, Artificial Sequence
  chemically synthesized
tgctttgcagaagctctttggc

SEQ ID NO: 1364701 - DNA, 22 bp, Artificial Sequence
  chemically synthesized
gctttgcagaagctctttggct

SEQ ID NO: 1364702 - DNA, 22 bp, Artificial Sequence
  chemically synthesized
ctttgcagaagctctttggctt

SEQ ID NO: 1364703 - DNA, 22 bp, Artificial Sequence
  chemically synthesized
tgcagaagctctttggcttagt

SEQ ID NO: 1364704 - DNA, 22 bp, Artificial Sequence
  chemically synthesized
gcagaagctctttggcttagtc

SEQ ID NO: 1364705 - DNA, 22 bp, Artificial Sequence
  chemically synthesized
cagaagctctttggcttagtca

SEQ ID NO: 1364706 - DNA, 22 bp, Artificial Sequence
  chemically synthesized
acaagtggaacttgactaagcc

SEQ ID NO: 1364707 - DNA, 22 bp, Artificial Sequence
  chemically synthesized
tttggcttagtcaagttccact

SEQ ID NO: 1364708 - DNA, 22 bp, Artificial Sequence
  chemically synthesized
tggcttagtcaagttccacttg

SEQ ID NO: 1364709 - DNA, 22 bp, Artificial Sequence
  chemically synthesized
ggcttagtcaagttccacttgt

SEQ ID NO: 1364710 - DNA, 22 bp, Artificial Sequence
  chemically synthesized
gcttagtcaagttccacttgtc

SEQ ID NO: 1364711 - DNA, 22 bp, Artificial Sequence
  chemically synthesized
agtcaagttccacttgtcaatt

SEQ ID NO: 1364712 - DNA, 22 bp, Artificial Sequence
  chemically synthesized
gtcaagttccacttgtcaattt

SEQ ID NO: 1364713 - DNA, 22 bp, Artificial Sequence
  chemically synthesized
caacaaaaacaaaaattgacaa

SEQ ID NO: 1364714 - DNA, 22 bp, Artificial Sequence
  chemically synthesized
cacttgtcaatttttgtttttg

SEQ ID NO: 1364715 - DNA, 22 bp, Artificial Sequence
  chemically synthesized
gtcaatttttgtttttgttgca

SEQ ID NO: 1364716 - DNA, 22 bp, Artificial Sequence
  chemically synthesized
tcaatttttgtttttgttgcaa

SEQ ID NO: 1364717 - DNA, 22 bp, Artificial Sequence
  chemically synthesized
agtccccaaaagccattgcaac

SEQ ID NO: 1364718 - DNA, 22 bp, Artificial Sequence
  chemically synthesized
ttgtttttgttgcaatggcttt

SEQ ID NO: 1364719 - DNA, 22 bp, Artificial Sequence
  chemically synthesized
tgtttttgttgcaatggctttt

SEQ ID NO: 1364720 - DNA, 22 bp, Artificial Sequence
  chemically synthesized
gtttttgttgcaatggcttttg

SEQ ID NO: 1364721 - DNA, 22 bp, Artificial Sequence
  chemically synthesized
tgactaagtccccaaaagccat

SEQ ID NO: 1364722 - DNA, 22 bp, Artificial Sequence
  chemically synthesized
tttttgttgcaatggcttttgg

SEQ ID NO: 1364723 - DNA, 22 bp, Artificial Sequence
  chemically synthesized
atgactaagtccccaaaagcca

SEQ ID NO: 1364724 - DNA, 22 bp, Artificial Sequence
  chemically synthesized
ttgttgcaatggcttttgggga

SEQ ID NO: 1364725 - DNA, 22 bp, Artificial Sequence
  chemically synthesized
tgttgcaatggcttttggggac

SEQ ID NO: 1364726 - DNA, 22 bp, Artificial Sequence
  chemically synthesized
gttgcaatggcttttggggact

SEQ ID NO: 1364727 - DNA, 22 bp, Artificial Sequence
  chemically synthesized
ttgcaatggcttttggggactt

SEQ ID NO: 1364728 - DNA, 22 bp, Artificial Sequence
  chemically synthesized
caatggcttttggggacttagt

SEQ ID NO: 1364729 - DNA, 22 bp, Artificial Sequence
  chemically synthesized
gcaaagaatttatgactaagtc

SEQ ID NO: 1364730 - DNA, 22 bp, Artificial Sequence
  chemically synthesized
ggcaaagaatttatgactaagt

SEQ ID NO: 1364731 - DNA, 22 bp, Artificial Sequence
  chemically synthesized
gtcttggcaaagaatttatgac

SEQ ID NO: 1364732 - DNA, 22 bp, Artificial Sequence
  chemically synthesized
ttggggacttagtcataaattc

SEQ ID NO: 1364733 - DNA, 22 bp, Artificial Sequence
  chemically synthesized
tggggacttagtcataaattct

SEQ ID NO: 1364734 - DNA, 22 bp, Artificial Sequence
  chemically synthesized
ggggacttagtcataaattctt

SEQ ID NO: 1364735 - DNA, 22 bp, Artificial Sequence
  chemically synthesized
gggacttagtcataaattcttt

SEQ ID NO: 1364736 - DNA, 22 bp, Artificial Sequence
  chemically synthesized
cattggtcttggcaaagaattt

SEQ ID NO: 1364737 - DNA, 22 bp, Artificial Sequence
  chemically synthesized
acattggtcttggcaaagaatt

SEQ ID NO: 1364738 - DNA, 22 bp, Artificial Sequence
  chemically synthesized
tacattggtcttggcaaagaat

SEQ ID NO: 1364739 - DNA, 22 bp, Artificial Sequence
  chemically synthesized
ttacattggtcttggcaaagaa

SEQ ID NO: 1364740 - DNA, 22 bp, Artificial Sequence
  chemically synthesized
tttacattggtcttggcaaaga

SEQ ID NO: 1364741 - DNA, 22 bp, Artificial Sequence
  chemically synthesized
ttttacattggtcttggcaaag

SEQ ID NO: 1364742 - DNA, 22 bp, Artificial Sequence
  chemically synthesized
agtcataaattctttgccaaga

SEQ ID NO: 1364743 - DNA, 22 bp, Artificial Sequence
  chemically synthesized
gtcataaattctttgccaagac

SEQ ID NO: 1364744 - DNA, 22 bp, Artificial Sequence
  chemically synthesized
ggaagtacccttttttacattg

SEQ ID NO: 1364745 - DNA, 22 bp, Artificial Sequence
  chemically synthesized
tttgccaagaccaatgtaaaaa

SEQ ID NO: 1364746 - DNA, 22 bp, Artificial Sequence
  chemically synthesized
tgccaagaccaatgtaaaaaag

SEQ ID NO: 1364747 - DNA, 22 bp, Artificial Sequence
  chemically synthesized
gccaagaccaatgtaaaaaagg

SEQ ID NO: 1364748 - DNA, 22 bp, Artificial Sequence
  chemically synthesized
ccaagaccaatgtaaaaaaggg

SEQ ID NO: 1364749 - DNA, 22 bp, Artificial Sequence
  chemically synthesized
gaagaaaacctaggaagtaccc

SEQ ID NO: 1364750 - DNA, 22 bp, Artificial Sequence
  chemically synthesized
taaaaaatcctagaagaaaacc

SEQ ID NO: 1364751 - DNA, 22 bp, Artificial Sequence
  chemically synthesized
atactgtaaaaaatcctagaag

SEQ ID NO: 1364752 - DNA, 22 bp, Artificial Sequence
  chemically synthesized
cctaggttttcttctaggattt

SEQ ID NO: 1364753 - DNA, 22 bp, Artificial Sequence
  chemically synthesized
ctaggttttcttctaggatttt

SEQ ID NO: 1364754 - DNA, 22 bp, Artificial Sequence
  chemically synthesized
ggttttcttctaggatttttta

SEQ ID NO: 1364755 - DNA, 22 bp, Artificial Sequence
  chemically synthesized
tcttctaggattttttacagta

SEQ ID NO: 1364756 - DNA, 22 bp, Artificial Sequence
  chemically synthesized
cttctaggattttttacagtat

SEQ ID NO: 1364757 - DNA, 22 bp, Artificial Sequence
  chemically synthesized
ttctaggattttttacagtatg

SEQ ID NO: 1364758 - DNA, 22 bp, Artificial Sequence
  chemically synthesized
aatataagacctcatactgtaa

SEQ ID NO: 1364759 - DNA, 22 bp, Artificial Sequence
  chemically synthesized
aaatataagacctcatactgta

SEQ ID NO: 1364760 - DNA, 22 bp, Artificial Sequence
  chemically synthesized
ctaggattttttacagtatgag

SEQ ID NO: 1364761 - DNA, 22 bp, Artificial Sequence
  chemically synthesized
taggattttttacagtatgagg

SEQ ID NO: 1364762 - DNA, 22 bp, Artificial Sequence
  chemically synthesized
ggattttttacagtatgaggtc

SEQ ID NO: 1364763 - DNA, 22 bp, Artificial Sequence
  chemically synthesized
aaggtttaaatataagacctca

SEQ ID NO: 1364764 - DNA, 22 bp, Artificial Sequence
  chemically synthesized
tttacagtatgaggtcttatat

SEQ ID NO: 1364765 - DNA, 22 bp, Artificial Sequence
  chemically synthesized
ttacagtatgaggtcttatatt

SEQ ID NO: 1364766 - DNA, 22 bp, Artificial Sequence
  chemically synthesized
tacagtatgaggtcttatattt

SEQ ID NO: 1364767 - DNA, 22 bp, Artificial Sequence
  chemically synthesized
acagtatgaggtcttatattta

SEQ ID NO: 1364768 - DNA, 22 bp, Artificial Sequence
  chemically synthesized
cagtatgaggtcttatatttaa

SEQ ID NO: 1364769 - DNA, 22 bp, Artificial Sequence
  chemically synthesized
acggtgaactaaaggtttaaat

SEQ ID NO: 1364770 - DNA, 22 bp, Artificial Sequence
  chemically synthesized
atatttaaacctttagttcacc

SEQ ID NO: 1364771 - DNA, 22 bp, Artificial Sequence
  chemically synthesized
tatttaaacctttagttcaccg

SEQ ID NO: 1364772 - DNA, 22 bp, Artificial Sequence
  chemically synthesized
aaacctttagttcaccgtcagt

SEQ ID NO: 1364773 - DNA, 22 bp, Artificial Sequence
  chemically synthesized
aacctttagttcaccgtcagtt

SEQ ID NO: 1364774 - DNA, 22 bp, Artificial Sequence
  chemically synthesized
tatacaaaaatcaactgacggt

SEQ ID NO: 1364775 - DNA, 22 bp, Artificial Sequence
  chemically synthesized
attatatacaaaaatcaactga

SEQ ID NO: 1364776 - DNA, 22 bp, Artificial Sequence
  chemically synthesized
cattatatacaaaaatcaactg

SEQ ID NO: 1364777 - DNA, 22 bp, Artificial Sequence
  chemically synthesized
tagttcaccgtcagttgatttt

SEQ ID NO: 1364778 - DNA, 22 bp, Artificial Sequence
  chemically synthesized
tcattatatacaaaaatcaact

SEQ ID NO: 1364779 - DNA, 22 bp, Artificial Sequence
  chemically synthesized
agttcaccgtcagttgattttt

SEQ ID NO: 1364780 - DNA, 22 bp, Artificial Sequence
  chemically synthesized
ttcattatatacaaaaatcaac

SEQ ID NO: 1364781 - DNA, 22 bp, Artificial Sequence
  chemically synthesized
gttcaccgtcagttgatttttg

SEQ ID NO: 1364782 - DNA, 22 bp, Artificial Sequence
  chemically synthesized
cttttcattatatacaaaaatc

SEQ ID NO: 1364783 - DNA, 22 bp, Artificial Sequence
  chemically synthesized
accgtcagttgatttttgtata

SEQ ID NO: 1364784 - DNA, 22 bp, Artificial Sequence
  chemically synthesized
tacttttcattatatacaaaaa

SEQ ID NO: 1364785 - DNA, 22 bp, Artificial Sequence
  chemically synthesized
gacctctacttttcattatata

SEQ ID NO: 1364786 - DNA, 22 bp, Artificial Sequence
  chemically synthesized
atttttgtatataatgaaaagt

SEQ ID NO: 1364787 - DNA, 22 bp, Artificial Sequence
  chemically synthesized
aaattggacctctacttttcat

SEQ ID NO: 1364788 - DNA, 22 bp, Artificial Sequence
  chemically synthesized
ttgtatataatgaaaagtagag

SEQ ID NO: 1364789 - DNA, 22 bp, Artificial Sequence
  chemically synthesized
tgtatataatgaaaagtagagg

SEQ ID NO: 1364790 - DNA, 22 bp, Artificial Sequence
  chemically synthesized
gtatataatgaaaagtagaggt

SEQ ID NO: 1364791 - DNA, 22 bp, Artificial Sequence
  chemically synthesized
tatataatgaaaagtagaggtc

SEQ ID NO: 1364792 - DNA, 22 bp, Artificial Sequence
  chemically synthesized
gccacatgcagaagattgaaat

SEQ ID NO: 1364793 - DNA, 22 bp, Artificial Sequence
  chemically synthesized
gctggccacatgcagaagattg

SEQ ID NO: 1364794 - DNA, 22 bp, Artificial Sequence
  chemically synthesized
ggaaaactggctggccacatgc

SEQ ID NO: 1364795 - DNA, 22 bp, Artificial Sequence
  chemically synthesized
caatcttctgcatgtggccagc

SEQ ID NO: 1364796 - DNA, 22 bp, Artificial Sequence
  chemically synthesized
aatcttctgcatgtggccagcc

SEQ ID NO: 1364797 - DNA, 22 bp, Artificial Sequence
  chemically synthesized
ctgcatgtggccagccagtttt

SEQ ID NO: 1364798 - DNA, 22 bp, Artificial Sequence
  chemically synthesized
tgcatgtggccagccagttttc

SEQ ID NO: 1364799 - DNA, 22 bp, Artificial Sequence
  chemically synthesized
catgtggccagccagttttccc

SEQ ID NO: 1364800 - DNA, 22 bp, Artificial Sequence
  chemically synthesized
aatagatggtgctgggaaaact

SEQ ID NO: 1364801 - DNA, 22 bp, Artificial Sequence
  chemically synthesized
ttcaatagatggtgctgggaaa

SEQ ID NO: 1364802 - DNA, 22 bp, Artificial Sequence
  chemically synthesized
ctattcaatagatggtgctggg

SEQ ID NO: 1364803 - DNA, 22 bp, Artificial Sequence
  chemically synthesized
cctattcaatagatggtgctgg

SEQ ID NO: 1364804 - DNA, 22 bp, Artificial Sequence
  chemically synthesized
tcccagcaccatctattgaata

SEQ ID NO: 1364805 - DNA, 22 bp, Artificial Sequence
  chemically synthesized
cccagcaccatctattgaatag

SEQ ID NO: 1364806 - DNA, 22 bp, Artificial Sequence
  chemically synthesized
ccagcaccatctattgaatagg

SEQ ID NO: 1364807 - DNA, 22 bp, Artificial Sequence
  chemically synthesized
ttgaataggaagtcctttcccc

SEQ ID NO: 1364808 - DNA, 22 bp, Artificial Sequence
  chemically synthesized
aataggaagtcctttccccatt

SEQ ID NO: 1364809 - DNA, 22 bp, Artificial Sequence
  chemically synthesized
agtcaacaaaaataagcaatgg

SEQ ID NO: 1364810 - DNA, 22 bp, Artificial Sequence
  chemically synthesized
actaagtcaacaaaaataagca

SEQ ID NO: 1364811 - DNA, 22 bp, Artificial Sequence
  chemically synthesized
gactaagtcaacaaaaataagc

SEQ ID NO: 1364812 - DNA, 22 bp, Artificial Sequence
  chemically synthesized
tgactaagtcaacaaaaataag

SEQ ID NO: 1364813 - DNA, 22 bp, Artificial Sequence
  chemically synthesized
tccccattgcttatttttgttg

SEQ ID NO: 1364814 - DNA, 22 bp, Artificial Sequence
  chemically synthesized
ccccattgcttatttttgttga

SEQ ID NO: 1364815 - DNA, 22 bp, Artificial Sequence
  chemically synthesized
cccattgcttatttttgttgac

SEQ ID NO: 1364816 - DNA, 22 bp, Artificial Sequence
  chemically synthesized
atctttgactaagtcaacaaaa

SEQ ID NO: 1364817 - DNA, 22 bp, Artificial Sequence
  chemically synthesized
cttatttttgttgacttagtca

SEQ ID NO: 1364818 - DNA, 22 bp, Artificial Sequence
  chemically synthesized
atttttgttgacttagtcaaag

SEQ ID NO: 1364819 - DNA, 22 bp, Artificial Sequence
  chemically synthesized
taaccatctgatctttgactaa

SEQ ID NO: 1364820 - DNA, 22 bp, Artificial Sequence
  chemically synthesized
tttttgttgacttagtcaaaga

SEQ ID NO: 1364821 - DNA, 22 bp, Artificial Sequence
  chemically synthesized
ttgttgacttagtcaaagatca

SEQ ID NO: 1364822 - DNA, 22 bp, Artificial Sequence
  chemically synthesized
tgttgacttagtcaaagatcag

SEQ ID NO: 1364823 - DNA, 22 bp, Artificial Sequence
  chemically synthesized
gttgacttagtcaaagatcaga

SEQ ID NO: 1364824 - DNA, 22 bp, Artificial Sequence
  chemically synthesized
ttgacttagtcaaagatcagat

SEQ ID NO: 1364825 - DNA, 22 bp, Artificial Sequence
  chemically synthesized
acttagtcaaagatcagatggt

SEQ ID NO: 1364826 - DNA, 22 bp, Artificial Sequence
  chemically synthesized
agtcaaagatcagatggttata

SEQ ID NO: 1364827 - DNA, 22 bp, Artificial Sequence
  chemically synthesized
gtcaaagatcagatggttatag

SEQ ID NO: 1364828 - DNA, 22 bp, Artificial Sequence
  chemically synthesized
taggtgtgtcgctttgtttctg

SEQ ID NO: 1364829 - DNA, 22 bp, Artificial Sequence
  chemically synthesized
tgtttctgggttcactattctg

SEQ ID NO: 1364830 - DNA, 22 bp, Artificial Sequence
  chemically synthesized
gtttctgggttcactattctgt

SEQ ID NO: 1364831 - DNA, 22 bp, Artificial Sequence
  chemically synthesized
tttctgggttcactattctgtt

SEQ ID NO: 1364832 - DNA, 22 bp, Artificial Sequence
  chemically synthesized
ctgggttcactattctgttcca

SEQ ID NO: 1364833 - DNA, 22 bp, Artificial Sequence
  chemically synthesized
tgggttcactattctgttccat

SEQ ID NO: 1364834 - DNA, 22 bp, Artificial Sequence
  chemically synthesized
ggttcactattctgttccattg

SEQ ID NO: 1364835 - DNA, 22 bp, Artificial Sequence
  chemically synthesized
actattctgttccattggtcta

SEQ ID NO: 1364836 - DNA, 22 bp, Artificial Sequence
  chemically synthesized
ttctgttccattggtctatggt

SEQ ID NO: 1364837 - DNA, 22 bp, Artificial Sequence
  chemically synthesized
gtacaaaaacagaccatagacc

SEQ ID NO: 1364838 - DNA, 22 bp, Artificial Sequence
  chemically synthesized
tgttccattggtctatggtctg

SEQ ID NO: 1364839 - DNA, 22 bp, Artificial Sequence
  chemically synthesized
ttccattggtctatggtctgtt

SEQ ID NO: 1364840 - DNA, 22 bp, Artificial Sequence
  chemically synthesized
cattggtctatggtctgttttt

SEQ ID NO: 1364841 - DNA, 22 bp, Artificial Sequence
  chemically synthesized
gtctatggtctgtttttgtacc

SEQ ID NO: 1364842 - DNA, 22 bp, Artificial Sequence
  chemically synthesized
tggtctgtttttgtaccagtac

SEQ ID NO: 1364843 - DNA, 22 bp, Artificial Sequence
  chemically synthesized
tttttgtaccagtaccatgctg

SEQ ID NO: 1364844 - DNA, 22 bp, Artificial Sequence
  chemically synthesized
cagtaacccaaacagcatggta

SEQ ID NO: 1364845 - DNA, 22 bp, Artificial Sequence
  chemically synthesized
ttgtaccagtaccatgctgttt

SEQ ID NO: 1364846 - DNA, 22 bp, Artificial Sequence
  chemically synthesized
tgtaccagtaccatgctgtttg

SEQ ID NO: 1364847 - DNA, 22 bp, Artificial Sequence
  chemically synthesized
gtaccagtaccatgctgtttgg

SEQ ID NO: 1364848 - DNA, 22 bp, Artificial Sequence
  chemically synthesized
taccagtaccatgctgtttggg

SEQ ID NO: 1364849 - DNA, 22 bp, Artificial Sequence
  chemically synthesized
taagcctacagtaacccaaaca

SEQ ID NO: 1364850 - DNA, 22 bp, Artificial Sequence
  chemically synthesized
tactataagcctacagtaaccc

SEQ ID NO: 1364851 - DNA, 22 bp, Artificial Sequence
  chemically synthesized
aagctatactataagcctacag

SEQ ID NO: 1364852 - DNA, 22 bp, Artificial Sequence
  chemically synthesized
caagctatactataagcctaca

SEQ ID NO: 1364853 - DNA, 22 bp, Artificial Sequence
  chemically synthesized
tttgggttactgtaggcttata

SEQ ID NO: 1364854 - DNA, 22 bp, Artificial Sequence
  chemically synthesized
acttcaagctatactataagcc

SEQ ID NO: 1364855 - DNA, 22 bp, Artificial Sequence
  chemically synthesized
gggttactgtaggcttatagta

SEQ ID NO: 1364856 - DNA, 22 bp, Artificial Sequence
  chemically synthesized
ggttactgtaggcttatagtat

SEQ ID NO: 1364857 - DNA, 22 bp, Artificial Sequence
  chemically synthesized
cctgacttcaagctatactata

SEQ ID NO: 1364858 - DNA, 22 bp, Artificial Sequence
  chemically synthesized
ctgtaggcttatagtatagctt

SEQ ID NO: 1364859 - DNA, 22 bp, Artificial Sequence
  chemically synthesized
taggcttatagtatagcttgaa

SEQ ID NO: 1364860 - DNA, 22 bp, Artificial Sequence
  chemically synthesized
atagtatagcttgaagtcaggt

SEQ ID NO: 1364861 - DNA, 22 bp, Artificial Sequence
  chemically synthesized
tagtatagcttgaagtcaggta

SEQ ID NO: 1364862 - DNA, 22 bp, Artificial Sequence
  chemically synthesized
gaagtcaggtagtgtgatgcct

SEQ ID NO: 1364863 - DNA, 22 bp, Artificial Sequence
  chemically synthesized
aagtcaggtagtgtgatgcctc

SEQ ID NO: 1364864 - DNA, 22 bp, Artificial Sequence
  chemically synthesized
aaagaataaagcaagaggcatc

SEQ ID NO: 1364865 - DNA, 22 bp, Artificial Sequence
  chemically synthesized
agctaaaagaataaagcaagag

SEQ ID NO: 1364866 - DNA, 22 bp, Artificial Sequence
  chemically synthesized
aagctaaaagaataaagcaaga

SEQ ID NO: 1364867 - DNA, 22 bp, Artificial Sequence
  chemically synthesized
ttgctttattcttttagcttaa

SEQ ID NO: 1364868 - DNA, 22 bp, Artificial Sequence
  chemically synthesized
gctttattcttttagcttaaga

SEQ ID NO: 1364869 - DNA, 22 bp, Artificial Sequence
  chemically synthesized
ctttattcttttagcttaagat

SEQ ID NO: 1364870 - DNA, 22 bp, Artificial Sequence
  chemically synthesized
tattcttttagcttaagattgc

SEQ ID NO: 1364871 - DNA, 22 bp, Artificial Sequence
  chemically synthesized
attcttttagcttaagattgct

SEQ ID NO: 1364872 - DNA, 22 bp, Artificial Sequence
  chemically synthesized
ttcttttagcttaagattgctt

SEQ ID NO: 1364873 - DNA, 22 bp, Artificial Sequence
  chemically synthesized
ttttagcttaagattgctttgg

SEQ ID NO: 1364874 - DNA, 22 bp, Artificial Sequence
  chemically synthesized
ttagcttaagattgctttggct

SEQ ID NO: 1364875 - DNA, 22 bp, Artificial Sequence
  chemically synthesized
tagcttaagattgctttggctc

SEQ ID NO: 1364876 - DNA, 22 bp, Artificial Sequence
  chemically synthesized
agcttaagattgctttggctct

SEQ ID NO: 1364877 - DNA, 22 bp, Artificial Sequence
  chemically synthesized
gcttaagattgctttggctcta

SEQ ID NO: 1364878 - DNA, 22 bp, Artificial Sequence
  chemically synthesized
aagattgctttggctctatggg

SEQ ID NO: 1364879 - DNA, 22 bp, Artificial Sequence
  chemically synthesized
agattgctttggctctatgggc

SEQ ID NO: 1364880 - DNA, 22 bp, Artificial Sequence
  chemically synthesized
tatggaaccaaaagagcccata

SEQ ID NO: 1364881 - DNA, 22 bp, Artificial Sequence
  chemically synthesized
gtatggaaccaaaagagcccat

SEQ ID NO: 1364882 - DNA, 22 bp, Artificial Sequence
  chemically synthesized
ctttggctctatgggctctttt

SEQ ID NO: 1364883 - DNA, 22 bp, Artificial Sequence
  chemically synthesized
tggctctatgggctcttttggt

SEQ ID NO: 1364884 - DNA, 22 bp, Artificial Sequence
  chemically synthesized
ggctctatgggctcttttggtt

SEQ ID NO: 1364885 - DNA, 22 bp, Artificial Sequence
  chemically synthesized
gctctatgggctcttttggttc

SEQ ID NO: 1364886 - DNA, 22 bp, Artificial Sequence
  chemically synthesized
atccaaatttgtatggaaccaa

SEQ ID NO: 1364887 - DNA, 22 bp, Artificial Sequence
  chemically synthesized
tatgggctcttttggttccata

SEQ ID NO: 1364888 - DNA, 22 bp, Artificial Sequence
  chemically synthesized
tgggctcttttggttccataca

SEQ ID NO: 1364889 - DNA, 22 bp, Artificial Sequence
  chemically synthesized
ttttggttccatacaaatttgg

SEQ ID NO: 1364890 - DNA, 22 bp, Artificial Sequence
  chemically synthesized
gaaaagactaatccaaatttgt

SEQ ID NO: 1364891 - DNA, 22 bp, Artificial Sequence
  chemically synthesized
ttggttccatacaaatttggat

SEQ ID NO: 1364892 - DNA, 22 bp, Artificial Sequence
  chemically synthesized
tggttccatacaaatttggatt

SEQ ID NO: 1364893 - DNA, 22 bp, Artificial Sequence
  chemically synthesized
ggttccatacaaatttggatta

SEQ ID NO: 1364894 - DNA, 22 bp, Artificial Sequence
  chemically synthesized
attagaaaagactaatccaaat

SEQ ID NO: 1364895 - DNA, 22 bp, Artificial Sequence
  chemically synthesized
gttccatacaaatttggattag

SEQ ID NO: 1364896 - DNA, 22 bp, Artificial Sequence
  chemically synthesized
cattagaaaagactaatccaaa

SEQ ID NO: 1364897 - DNA, 22 bp, Artificial Sequence
  chemically synthesized
tcattagaaaagactaatccaa

SEQ ID NO: 1364898 - DNA, 22 bp, Artificial Sequence
  chemically synthesized
catacaaatttggattagtctt

SEQ ID NO: 1364899 - DNA, 22 bp, Artificial Sequence
  chemically synthesized
attttcattagaaaagactaat

SEQ ID NO: 1364900 - DNA, 22 bp, Artificial Sequence
  chemically synthesized
cattttcattagaaaagactaa

SEQ ID NO: 1364901 - DNA, 22 bp, Artificial Sequence
  chemically synthesized
tcattttcattagaaaagacta

SEQ ID NO: 1364902 - DNA, 22 bp, Artificial Sequence
  chemically synthesized
ttcattttcattagaaaagact

SEQ ID NO: 1364903 - DNA, 22 bp, Artificial Sequence
  chemically synthesized
atttttcattttcattagaaaa

SEQ ID NO: 1364904 - DNA, 22 bp, Artificial Sequence
  chemically synthesized
catttttcattttcattagaaa

SEQ ID NO: 1364905 - DNA, 22 bp, Artificial Sequence
  chemically synthesized
tcatttttcattttcattagaa

SEQ ID NO: 1364906 - DNA, 22 bp, Artificial Sequence
  chemically synthesized
ggattagtcttttctaatgaaa

SEQ ID NO: 1364907 - DNA, 22 bp, Artificial Sequence
  chemically synthesized
gattagtcttttctaatgaaaa

SEQ ID NO: 1364908 - DNA, 22 bp, Artificial Sequence
  chemically synthesized
gtcttttctaatgaaaatgaaa

SEQ ID NO: 1364909 - DNA, 22 bp, Artificial Sequence
  chemically synthesized
ttctaatgaaaatgaaaaatga

SEQ ID NO: 1364910 - DNA, 22 bp, Artificial Sequence
  chemically synthesized
tctaatgaaaatgaaaaatgaa

SEQ ID NO: 1364911 - DNA, 22 bp, Artificial Sequence
  chemically synthesized
ccaacgtcaattttcatttttc

SEQ ID NO: 1364912 - DNA, 22 bp, Artificial Sequence
  chemically synthesized
ctaatgaaaatgaaaaatgaaa

SEQ ID NO: 1364913 - DNA, 22 bp, Artificial Sequence
  chemically synthesized
taatgaaaatgaaaaatgaaaa

SEQ ID NO: 1364914 - DNA, 22 bp, Artificial Sequence
  chemically synthesized
atgaaaatgaaaaatgaaaatt

SEQ ID NO: 1364915 - DNA, 22 bp, Artificial Sequence
  chemically synthesized
tcaaactaccaacgtcaatttt

SEQ ID NO: 1364916 - DNA, 22 bp, Artificial Sequence
  chemically synthesized
atcaaactaccaacgtcaattt

SEQ ID NO: 1364917 - DNA, 22 bp, Artificial Sequence
  chemically synthesized
atcttatcaaactaccaacgtc

SEQ ID NO: 1364918 - DNA, 22 bp, Artificial Sequence
  chemically synthesized
agtgctaatcttatcaaactac

SEQ ID NO: 1364919 - DNA, 22 bp, Artificial Sequence
  chemically synthesized
acgttggtagtttgataagatt

SEQ ID NO: 1364920 - DNA, 22 bp, Artificial Sequence
  chemically synthesized
cagattcagtgctaatcttatc

SEQ ID NO: 1364921 - DNA, 22 bp, Artificial Sequence
  chemically synthesized
acagattcagtgctaatcttat

SEQ ID NO: 1364922 - DNA, 22 bp, Artificial Sequence
  chemically synthesized
gtagtttgataagattagcact

SEQ ID NO: 1364923 - DNA, 22 bp, Artificial Sequence
  chemically synthesized
gataagattagcactgaatctg

SEQ ID NO: 1364924 - DNA, 22 bp, Artificial Sequence
  chemically synthesized
ataagattagcactgaatctgt

SEQ ID NO: 1364925 - DNA, 22 bp, Artificial Sequence
  chemically synthesized
cccaaagcaatttacagattca

SEQ ID NO: 1364926 - DNA, 22 bp, Artificial Sequence
  chemically synthesized
gcactgaatctgtaaattgctt

SEQ ID NO: 1364927 - DNA, 22 bp, Artificial Sequence
  chemically synthesized
aatctgtaaattgctttgggca

SEQ ID NO: 1364928 - DNA, 22 bp, Artificial Sequence
  chemically synthesized
aaatggccatactgcccaaagc

SEQ ID NO: 1364929 - DNA, 22 bp, Artificial Sequence
  chemically synthesized
ttaaaatggccatactgcccaa

SEQ ID NO: 1364930 - DNA, 22 bp, Artificial Sequence
  chemically synthesized
taaattgctttgggcagtatgg

SEQ ID NO: 1364931 - DNA, 22 bp, Artificial Sequence
  chemically synthesized
ctttgggcagtatggccatttt

SEQ ID NO: 1364932 - DNA, 22 bp, Artificial Sequence
  chemically synthesized
tgggcagtatggccattttaac

SEQ ID NO: 1364933 - DNA, 22 bp, Artificial Sequence
  chemically synthesized
gggcagtatggccattttaaca

SEQ ID NO: 1364934 - DNA, 22 bp, Artificial Sequence
  chemically synthesized
ggcagtatggccattttaacaa

SEQ ID NO: 1364935 - DNA, 22 bp, Artificial Sequence
  chemically synthesized
gaagaataaatattgttaaaat

SEQ ID NO: 1364936 - DNA, 22 bp, Artificial Sequence
  chemically synthesized
gattggaagaataaatattgtt

SEQ ID NO: 1364937 - DNA, 22 bp, Artificial Sequence
  chemically synthesized
ggattggaagaataaatattgt

SEQ ID NO: 1364938 - DNA, 22 bp, Artificial Sequence
  chemically synthesized
ttggattggaagaataaatatt

SEQ ID NO: 1364939 - DNA, 22 bp, Artificial Sequence
  chemically synthesized
atgctcttggattggaagaata

SEQ ID NO: 1364940 - DNA, 22 bp, Artificial Sequence
  chemically synthesized
catgctcttggattggaagaat

SEQ ID NO: 1364941 - DNA, 22 bp, Artificial Sequence
  chemically synthesized
taacaatatttattcttccaat

SEQ ID NO: 1364942 - DNA, 22 bp, Artificial Sequence
  chemically synthesized
aacaatatttattcttccaatc

SEQ ID NO: 1364943 - DNA, 22 bp, Artificial Sequence
  chemically synthesized
acaatatttattcttccaatcc

SEQ ID NO: 1364944 - DNA, 22 bp, Artificial Sequence
  chemically synthesized
attcttccaatccaagagcatg

SEQ ID NO: 1364945 - DNA, 22 bp, Artificial Sequence
  chemically synthesized
ttcttccaatccaagagcatga

SEQ ID NO: 1364946 - DNA, 22 bp, Artificial Sequence
  chemically synthesized
ttccaatccaagagcatgaaat

SEQ ID NO: 1364947 - DNA, 22 bp, Artificial Sequence
  chemically synthesized
ccaatccaagagcatgaaatgt

SEQ ID NO: 1364948 - DNA, 22 bp, Artificial Sequence
  chemically synthesized
caatccaagagcatgaaatgtt

SEQ ID NO: 1364949 - DNA, 22 bp, Artificial Sequence
  chemically synthesized
aaagaaatcagagacaacacaa

SEQ ID NO: 1364950 - DNA, 22 bp, Artificial Sequence
  chemically synthesized
tgcatttatttgtgttgtctct

SEQ ID NO: 1364951 - DNA, 22 bp, Artificial Sequence
  chemically synthesized
ctgaaagaaatcagagacaaca

SEQ ID NO: 1364952 - DNA, 22 bp, Artificial Sequence
  chemically synthesized
gcatttatttgtgttgtctctg

SEQ ID NO: 1364953 - DNA, 22 bp, Artificial Sequence
  chemically synthesized
catttatttgtgttgtctctga

SEQ ID NO: 1364954 - DNA, 22 bp, Artificial Sequence
  chemically synthesized
atttgtgttgtctctgatttct

SEQ ID NO: 1364955 - DNA, 22 bp, Artificial Sequence
  chemically synthesized
tttgtgttgtctctgatttctt

SEQ ID NO: 1364956 - DNA, 22 bp, Artificial Sequence
  chemically synthesized
caaaacactgctgaaagaaatc

SEQ ID NO: 1364957 - DNA, 22 bp, Artificial Sequence
  chemically synthesized
gtgttgtctctgatttctttca

SEQ ID NO: 1364958 - DNA, 22 bp, Artificial Sequence
  chemically synthesized
tgttgtctctgatttctttcag

SEQ ID NO: 1364959 - DNA, 22 bp, Artificial Sequence
  chemically synthesized
tctctgatttctttcagcagtg

SEQ ID NO: 1364960 - DNA, 22 bp, Artificial Sequence
  chemically synthesized
tgatttctttcagcagtgtttt

SEQ ID NO: 1364961 - DNA, 22 bp, Artificial Sequence
  chemically synthesized
atttctttcagcagtgttttgt

SEQ ID NO: 1364962 - DNA, 22 bp, Artificial Sequence
  chemically synthesized
tacaaggagaactacaaaacac

SEQ ID NO: 1364963 - DNA, 22 bp, Artificial Sequence
  chemically synthesized
ctttcagcagtgttttgtagtt

SEQ ID NO: 1364964 - DNA, 22 bp, Artificial Sequence
  chemically synthesized
tttcagcagtgttttgtagttc

SEQ ID NO: 1364965 - DNA, 22 bp, Artificial Sequence
  chemically synthesized
tcagcagtgttttgtagttctc

SEQ ID NO: 1364966 - DNA, 22 bp, Artificial Sequence
  chemically synthesized
cagcagtgttttgtagttctcc

SEQ ID NO: 1364967 - DNA, 22 bp, Artificial Sequence
  chemically synthesized
agcagtgttttgtagttctcct

SEQ ID NO: 1364968 - DNA, 22 bp, Artificial Sequence
  chemically synthesized
tgtagttctccttgtatagttc

SEQ ID NO: 1364969 - DNA, 22 bp, Artificial Sequence
  chemically synthesized
gtagttctccttgtatagttct

SEQ ID NO: 1364970 - DNA, 22 bp, Artificial Sequence
  chemically synthesized
tagttctccttgtatagttctt

SEQ ID NO: 1364971 - DNA, 22 bp, Artificial Sequence
  chemically synthesized
accaaggaggtgaaagaactat

SEQ ID NO: 1364972 - DNA, 22 bp, Artificial Sequence
  chemically synthesized
tccttgtatagttctttcacct

SEQ ID NO: 1364973 - DNA, 22 bp, Artificial Sequence
  chemically synthesized
cttgtatagttctttcacctcc

SEQ ID NO: 1364974 - DNA, 22 bp, Artificial Sequence
  chemically synthesized
gtatagttctttcacctccttg

SEQ ID NO: 1364975 - DNA, 22 bp, Artificial Sequence
  chemically synthesized
tatagttctttcacctccttgg

SEQ ID NO: 1364976 - DNA, 22 bp, Artificial Sequence
  chemically synthesized
atgaccatgcagctaaccaagg

SEQ ID NO: 1364977 - DNA, 22 bp, Artificial Sequence
  chemically synthesized
catgaccatgcagctaaccaag

SEQ ID NO: 1364978 - DNA, 22 bp, Artificial Sequence
  chemically synthesized
tcatgaccatgcagctaaccaa

SEQ ID NO: 1364979 - DNA, 22 bp, Artificial Sequence
  chemically synthesized
ttcatgaccatgcagctaacca

SEQ ID NO: 1364980 - DNA, 22 bp, Artificial Sequence
  chemically synthesized
tttcacctccttggttagctgc

SEQ ID NO: 1364981 - DNA, 22 bp, Artificial Sequence
  chemically synthesized
tttcatgaccatgcagctaacc

SEQ ID NO: 1364982 - DNA, 22 bp, Artificial Sequence
  chemically synthesized
tcacctccttggttagctgcat

SEQ ID NO: 1364983 - DNA, 22 bp, Artificial Sequence
  chemically synthesized
tttttcatgaccatgcagctaa

SEQ ID NO: 1364984 - DNA, 22 bp, Artificial Sequence
  chemically synthesized
cacctccttggttagctgcatg

SEQ ID NO: 1364985 - DNA, 22 bp, Artificial Sequence
  chemically synthesized
acctccttggttagctgcatgg

SEQ ID NO: 1364986 - DNA, 22 bp, Artificial Sequence
  chemically synthesized
attctttttcatgaccatgcag

SEQ ID NO: 1364987 - DNA, 22 bp, Artificial Sequence
  chemically synthesized
cattctttttcatgaccatgca

SEQ ID NO: 1364988 - DNA, 22 bp, Artificial Sequence
  chemically synthesized
cttggttagctgcatggtcatg

SEQ ID NO: 1364989 - DNA, 22 bp, Artificial Sequence
  chemically synthesized
ggttagctgcatggtcatgaaa

SEQ ID NO: 1364990 - DNA, 22 bp, Artificial Sequence
  chemically synthesized
gttagctgcatggtcatgaaaa

SEQ ID NO: 1364991 - DNA, 22 bp, Artificial Sequence
  chemically synthesized
gctgcatggtcatgaaaaagaa

SEQ ID NO: 1364992 - DNA, 22 bp, Artificial Sequence
  chemically synthesized
catggtcatgaaaaagaatgaa

SEQ ID NO: 1364993 - DNA, 22 bp, Artificial Sequence
  chemically synthesized
caaagtacatgatttcattctt

SEQ ID NO: 1364994 - DNA, 22 bp, Artificial Sequence
  chemically synthesized
ctgcaaagtacatgatttcatt

SEQ ID NO: 1364995 - DNA, 22 bp, Artificial Sequence
  chemically synthesized
gctgcaaagtacatgatttcat

SEQ ID NO: 1364996 - DNA, 22 bp, Artificial Sequence
  chemically synthesized
atcttgctgcaaagtacatgat

SEQ ID NO: 1364997 - DNA, 22 bp, Artificial Sequence
  chemically synthesized
cattcatcttgctgcaaagtac

SEQ ID NO: 1364998 - DNA, 22 bp, Artificial Sequence
  chemically synthesized
cagctgcattcatcttgctgca

SEQ ID NO: 1364999 - DNA, 22 bp, Artificial Sequence
  chemically synthesized
tgcagcaagatgaatgcagctg

SEQ ID NO: 1365000 - DNA, 22 bp, Artificial Sequence
  chemically synthesized
gcagcaagatgaatgcagctgg

SEQ ID NO: 1365001 - DNA, 22 bp, Artificial Sequence
  chemically synthesized
cagcaagatgaatgcagctgga

SEQ ID NO: 1365002 - DNA, 22 bp, Artificial Sequence
  chemically synthesized
cataggataatggcctccagct

SEQ ID NO: 1365003 - DNA, 22 bp, Artificial Sequence
  chemically synthesized
gcataggataatggcctccagc

SEQ ID NO: 1365004 - DNA, 22 bp, Artificial Sequence
  chemically synthesized
atttgcataggataatggcctc

SEQ ID NO: 1365005 - DNA, 22 bp, Artificial Sequence
  chemically synthesized
tgttaatttgcataggataatg

SEQ ID NO: 1365006 - DNA, 22 bp, Artificial Sequence
  chemically synthesized
ctgtgttaatttgcataggata

SEQ ID NO: 1365007 - DNA, 22 bp, Artificial Sequence
  chemically synthesized
ttcctgtgttaatttgcatagg

SEQ ID NO: 1365008 - DNA, 22 bp, Artificial Sequence
  chemically synthesized
gaggccattatcctatgcaaat

SEQ ID NO: 1365009 - DNA, 22 bp, Artificial Sequence
  chemically synthesized
tgttcctgtgttaatttgcata

SEQ ID NO: 1365010 - DNA, 22 bp, Artificial Sequence
  chemically synthesized
ctgttcctgtgttaatttgcat

SEQ ID NO: 1365011 - DNA, 22 bp, Artificial Sequence
  chemically synthesized
tctgttcctgtgttaatttgca

SEQ ID NO: 1365012 - DNA, 22 bp, Artificial Sequence
  chemically synthesized
gttttctgttcctgtgttaatt

SEQ ID NO: 1365013 - DNA, 22 bp, Artificial Sequence
  chemically synthesized
ggttttctgttcctgtgttaat

SEQ ID NO: 1365014 - DNA, 22 bp, Artificial Sequence
  chemically synthesized
tcctatgcaaattaacacagga

SEQ ID NO: 1365015 - DNA, 22 bp, Artificial Sequence
  chemically synthesized
tgcaaattaacacaggaacaga

SEQ ID NO: 1365016 - DNA, 22 bp, Artificial Sequence
  chemically synthesized
acacaggaacagaaaaccaaat

SEQ ID NO: 1365017 - DNA, 22 bp, Artificial Sequence
  chemically synthesized
taagtgagaacatgcggtattt

SEQ ID NO: 1365018 - DNA, 22 bp, Artificial Sequence
  chemically synthesized
ataagtgagaacatgcggtatt

SEQ ID NO: 1365019 - DNA, 22 bp, Artificial Sequence
  chemically synthesized
ccatttataagtgagaacatgc

SEQ ID NO: 1365020 - DNA, 22 bp, Artificial Sequence
  chemically synthesized
ctcccatttataagtgagaaca

SEQ ID NO: 1365021 - DNA, 22 bp, Artificial Sequence
  chemically synthesized
gctcccatttataagtgagaac

SEQ ID NO: 1365022 - DNA, 22 bp, Artificial Sequence
  chemically synthesized
tgctcccatttataagtgagaa

SEQ ID NO: 1365023 - DNA, 22 bp, Artificial Sequence
  chemically synthesized
agtgttttgctcccatttataa

SEQ ID NO: 1365024 - DNA, 22 bp, Artificial Sequence
  chemically synthesized
tgtactcagtgttttgctccca

SEQ ID NO: 1365025 - DNA, 22 bp, Artificial Sequence
  chemically synthesized
tcacttataaatgggagcaaaa

SEQ ID NO: 1365026 - DNA, 22 bp, Artificial Sequence
  chemically synthesized
acttataaatgggagcaaaaca

SEQ ID NO: 1365027 - DNA, 22 bp, Artificial Sequence
  chemically synthesized
ataaatgggagcaaaacactga

SEQ ID NO: 1365028 - DNA, 22 bp, Artificial Sequence
  chemically synthesized
taaatgggagcaaaacactgag

SEQ ID NO: 1365029 - DNA, 22 bp, Artificial Sequence
  chemically synthesized
tgtccactgtgtactcagtgtt

SEQ ID NO: 1365030 - DNA, 22 bp, Artificial Sequence
  chemically synthesized
atgtccactgtgtactcagtgt

SEQ ID NO: 1365031 - DNA, 22 bp, Artificial Sequence
  chemically synthesized
tatgtccactgtgtactcagtg

SEQ ID NO: 1365032 - DNA, 22 bp, Artificial Sequence
  chemically synthesized
ccatctttatgtccactgtgta

SEQ ID NO: 1365033 - DNA, 22 bp, Artificial Sequence
  chemically synthesized
ttcccatctttatgtccactgt

SEQ ID NO: 1365034 - DNA, 22 bp, Artificial Sequence
  chemically synthesized
gttcccatctttatgtccactg

SEQ ID NO: 1365035 - DNA, 22 bp, Artificial Sequence
  chemically synthesized
ttgttcccatctttatgtccac

SEQ ID NO: 1365036 - DNA, 22 bp, Artificial Sequence
  chemically synthesized
agtacacagtggacataaagat

SEQ ID NO: 1365037 - DNA, 22 bp, Artificial Sequence
  chemically synthesized
gtagtccccagtatctcttgtt

SEQ ID NO: 1365038 - DNA, 22 bp, Artificial Sequence
  chemically synthesized
tagtagtccccagtatctcttg

SEQ ID NO: 1365039 - DNA, 22 bp, Artificial Sequence
  chemically synthesized
cccctctagtagtccccagtat

SEQ ID NO: 1365040 - DNA, 22 bp, Artificial Sequence
  chemically synthesized
cattccccctctagtagtcccc

SEQ ID NO: 1365041 - DNA, 22 bp, Artificial Sequence
  chemically synthesized
cctccattccccctctagtagt

SEQ ID NO: 1365042 - DNA, 22 bp, Artificial Sequence
  chemically synthesized
ccctccattccccctctagtag

SEQ ID NO: 1365043 - DNA, 22 bp, Artificial Sequence
  chemically synthesized
gggactactagagggggaatgg

SEQ ID NO: 1365044 - DNA, 22 bp, Artificial Sequence
  chemically synthesized
acacccgcttccctccattccc

SEQ ID NO: 1365045 - DNA, 22 bp, Artificial Sequence
  chemically synthesized
ctagagggggaatggagggaag

SEQ ID NO: 1365046 - DNA, 22 bp, Artificial Sequence
  chemically synthesized
agctcacacccgcttccctcca

SEQ ID NO: 1365047 - DNA, 22 bp, Artificial Sequence
  chemically synthesized
cagctcacacccgcttccctcc

SEQ ID NO: 1365048 - DNA, 22 bp, Artificial Sequence
  chemically synthesized
tcagctcacacccgcttccctc

SEQ ID NO: 1365049 - DNA, 22 bp, Artificial Sequence
  chemically synthesized
gagggggaatggagggaagcgg

SEQ ID NO: 1365050 - DNA, 22 bp, Artificial Sequence
  chemically synthesized
ttcagctcacacccgcttccct

SEQ ID NO: 1365051 - DNA, 22 bp, Artificial Sequence
  chemically synthesized
tacccagtaggtagtttttcag

SEQ ID NO: 1365052 - DNA, 22 bp, Artificial Sequence
  chemically synthesized
aaaaactacctactgggtacaa

SEQ ID NO: 1365053 - DNA, 22 bp, Artificial Sequence
  chemically synthesized
cctactgggtacaatgctcact

SEQ ID NO: 1365054 - DNA, 22 bp, Artificial Sequence
  chemically synthesized
ctgggtacaatgctcactacct

SEQ ID NO: 1365055 - DNA, 22 bp, Artificial Sequence
  chemically synthesized
ggtacaatgctcactacctggg

SEQ ID NO: 1365056 - DNA, 22 bp, Artificial Sequence
  chemically synthesized
atgatccagtcacccaggtagt

SEQ ID NO: 1365057 - DNA, 22 bp, Artificial Sequence
  chemically synthesized
gggtactgatgatccagtcacc

SEQ ID NO: 1365058 - DNA, 22 bp, Artificial Sequence
  chemically synthesized
ggggtactgatgatccagtcac

SEQ ID NO: 1365059 - DNA, 22 bp, Artificial Sequence
  chemically synthesized
actacctgggtgactggatcat

SEQ ID NO: 1365060 - DNA, 22 bp, Artificial Sequence
  chemically synthesized
cctgggtgactggatcatcagt

SEQ ID NO: 1365061 - DNA, 22 bp, Artificial Sequence
  chemically synthesized
ggtgactggatcatcagtaccc

SEQ ID NO: 1365062 - DNA, 22 bp, Artificial Sequence
  chemically synthesized
tgtgatgtggaggtttggggta

SEQ ID NO: 1365063 - DNA, 22 bp, Artificial Sequence
  chemically synthesized
gatcatcagtaccccaaacctc

SEQ ID NO: 1365064 - DNA, 22 bp, Artificial Sequence
  chemically synthesized
caagggcatattgtgtgatgtg

SEQ ID NO: 1365065 - DNA, 22 bp, Artificial Sequence
  chemically synthesized
ttacaagggcatattgtgtgat

SEQ ID NO: 1365066 - DNA, 22 bp, Artificial Sequence
  chemically synthesized
gttacaagggcatattgtgtga

SEQ ID NO: 1365067 - DNA, 22 bp, Artificial Sequence
  chemically synthesized
cacatcacacaatatgcccttg

SEQ ID NO: 1365068 - DNA, 22 bp, Artificial Sequence
  chemically synthesized
aggagtttgttacaagggcata

SEQ ID NO: 1365069 - DNA, 22 bp, Artificial Sequence
  chemically synthesized
aatcgggggtacatgttcagga

SEQ ID NO: 1365070 - DNA, 22 bp, Artificial Sequence
  chemically synthesized
gaatcgggggtacatgttcagg

SEQ ID NO: 1365071 - DNA, 22 bp, Artificial Sequence
  chemically synthesized
tgaatcgggggtacatgttcag

SEQ ID NO: 1365072 - DNA, 22 bp, Artificial Sequence
  chemically synthesized
gtaacaaactcctgaacatgta

SEQ ID NO: 1365073 - DNA, 22 bp, Artificial Sequence
  chemically synthesized
taacaaactcctgaacatgtac

SEQ ID NO: 1365074 - DNA, 22 bp, Artificial Sequence
  chemically synthesized
attttgaatcgggggtacatgt

SEQ ID NO: 1365075 - DNA, 22 bp, Artificial Sequence
  chemically synthesized
cattttgaatcgggggtacatg

SEQ ID NO: 1365076 - DNA, 22 bp, Artificial Sequence
  chemically synthesized
tcattttgaatcgggggtacat

SEQ ID NO: 1365077 - DNA, 22 bp, Artificial Sequence
  chemically synthesized
aactttcattttgaatcggggg

SEQ ID NO: 1365078 - DNA, 22 bp, Artificial Sequence
  chemically synthesized
ctgaacatgtacccccgattca

SEQ ID NO: 1365079 - DNA, 22 bp, Artificial Sequence
  chemically synthesized
caactttcattttgaatcgggg

SEQ ID NO: 1365080 - DNA, 22 bp, Artificial Sequence
  chemically synthesized
aacatgtacccccgattcaaaa

SEQ ID NO: 1365081 - DNA, 22 bp, Artificial Sequence
  chemically synthesized
acaaaataatttcaactttcat

SEQ ID NO: 1365082 - DNA, 22 bp, Artificial Sequence
  chemically synthesized
aacaaaataatttcaactttca

SEQ ID NO: 1365083 - DNA, 22 bp, Artificial Sequence
  chemically synthesized
taacaaaataatttcaactttc

SEQ ID NO: 1365084 - DNA, 22 bp, Artificial Sequence
  chemically synthesized
aaattttaacaaaataatttca

SEQ ID NO: 1365085 - DNA, 22 bp, Artificial Sequence
  chemically synthesized
aaaatgaaagttgaaattattt

SEQ ID NO: 1365086 - DNA, 22 bp, Artificial Sequence
  chemically synthesized
attaaaattttaacaaaataat

SEQ ID NO: 1365087 - DNA, 22 bp, Artificial Sequence
  chemically synthesized
cattaaaattttaacaaaataa

SEQ ID NO: 1365088 - DNA, 22 bp, Artificial Sequence
  chemically synthesized
taatttcattaaaattttaaca

SEQ ID NO: 1365089 - DNA, 22 bp, Artificial Sequence
  chemically synthesized
aaattattttgttaaaatttta

SEQ ID NO: 1365090 - DNA, 22 bp, Artificial Sequence
  chemically synthesized
ttttgttaaaattttaatgaaa

SEQ ID NO: 1365091 - DNA, 22 bp, Artificial Sequence
  chemically synthesized
taaacaattgtaatttcattaa

SEQ ID NO: 1365092 - DNA, 22 bp, Artificial Sequence
  chemically synthesized
tgttaaaattttaatgaaatta

SEQ ID NO: 1365093 - DNA, 22 bp, Artificial Sequence
  chemically synthesized
gttaaaattttaatgaaattac

SEQ ID NO: 1365094 - DNA, 22 bp, Artificial Sequence
  chemically synthesized
ttaaaattttaatgaaattaca

SEQ ID NO: 1365095 - DNA, 22 bp, Artificial Sequence
  chemically synthesized
atctgtaaacaattgtaatttc

SEQ ID NO: 1365096 - DNA, 22 bp, Artificial Sequence
  chemically synthesized
aaattttaatgaaattacaatt

SEQ ID NO: 1365097 - DNA, 22 bp, Artificial Sequence
  chemically synthesized
attcatctgtaaacaattgtaa

SEQ ID NO: 1365098 - DNA, 22 bp, Artificial Sequence
  chemically synthesized
taatgaaattacaattgtttac

SEQ ID NO: 1365099 - DNA, 22 bp, Artificial Sequence
  chemically synthesized
attaattcatctgtaaacaatt

SEQ ID NO: 1365100 - DNA, 22 bp, Artificial Sequence
  chemically synthesized
aatgaaattacaattgtttaca

SEQ ID NO: 1365101 - DNA, 22 bp, Artificial Sequence
  chemically synthesized
atgaaattacaattgtttacag

SEQ ID NO: 1365102 - DNA, 22 bp, Artificial Sequence
  chemically synthesized
caattgtttacagatgaattaa

SEQ ID NO: 1365103 - DNA, 22 bp, Artificial Sequence
  chemically synthesized
aaaaatgtatgtctaattaatt

SEQ ID NO: 1365104 - DNA, 22 bp, Artificial Sequence
  chemically synthesized
gaaaaatgtatgtctaattaat

SEQ ID NO: 1365105 - DNA, 22 bp, Artificial Sequence
  chemically synthesized
tttacagatgaattaattagac

SEQ ID NO: 1365106 - DNA, 22 bp, Artificial Sequence
  chemically synthesized
tgaaaaatgtatgtctaattaa

SEQ ID NO: 1365107 - DNA, 22 bp, Artificial Sequence
  chemically synthesized
ttgaaaaatgtatgtctaatta

SEQ ID NO: 1365108 - DNA, 22 bp, Artificial Sequence
  chemically synthesized
acagatgaattaattagacata

SEQ ID NO: 1365109 - DNA, 22 bp, Artificial Sequence
  chemically synthesized
cagatgaattaattagacatac

SEQ ID NO: 1365110 - DNA, 22 bp, Artificial Sequence
  chemically synthesized
tatttttgaaaaatgtatgtct

SEQ ID NO: 1365111 - DNA, 22 bp, Artificial Sequence
  chemically synthesized
atatttttgaaaaatgtatgtc

SEQ ID NO: 1365112 - DNA, 22 bp, Artificial Sequence
  chemically synthesized
tatatttttgaaaaatgtatgt

SEQ ID NO: 1365113 - DNA, 22 bp, Artificial Sequence
  chemically synthesized
tgctttatatttttgaaaaatg

SEQ ID NO: 1365114 - DNA, 22 bp, Artificial Sequence
  chemically synthesized
attagacatacatttttcaaaa

SEQ ID NO: 1365115 - DNA, 22 bp, Artificial Sequence
  chemically synthesized
gacatacatttttcaaaaatat

SEQ ID NO: 1365116 - DNA, 22 bp, Artificial Sequence
  chemically synthesized
taataaaaattatgctttatat

SEQ ID NO: 1365117 - DNA, 22 bp, Artificial Sequence
  chemically synthesized
actgtaataaaaattatgcttt

SEQ ID NO: 1365118 - DNA, 22 bp, Artificial Sequence
  chemically synthesized
ttcaaaaatataaagcataatt

SEQ ID NO: 1365119 - DNA, 22 bp, Artificial Sequence
  chemically synthesized
tcaaaaatataaagcataattt

SEQ ID NO: 1365120 - DNA, 22 bp, Artificial Sequence
  chemically synthesized
caaaaatataaagcataatttt

SEQ ID NO: 1365121 - DNA, 22 bp, Artificial Sequence
  chemically synthesized
aaaaatataaagcataattttt

SEQ ID NO: 1365122 - DNA, 22 bp, Artificial Sequence
  chemically synthesized
aaaaaatgtgtatgagttcact

SEQ ID NO: 1365123 - DNA, 22 bp, Artificial Sequence
  chemically synthesized
aaaaaaatgtgtatgagttcac

SEQ ID NO: 1365124 - DNA, 22 bp, Artificial Sequence
  chemically synthesized
ttattacagtgaactcatacac

SEQ ID NO: 1365125 - DNA, 22 bp, Artificial Sequence
  chemically synthesized
tattacagtgaactcatacaca

SEQ ID NO: 1365126 - DNA, 22 bp, Artificial Sequence
  chemically synthesized
attacagtgaactcatacacat

SEQ ID NO: 1365127 - DNA, 22 bp, Artificial Sequence
  chemically synthesized
ttacagtgaactcatacacatt

SEQ ID NO: 1365128 - DNA, 22 bp, Artificial Sequence
  chemically synthesized
cagtgaactcatacacattttt

SEQ ID NO: 1365129 - DNA, 22 bp, Artificial Sequence
  chemically synthesized
atacacatttttttaaattact

SEQ ID NO: 1365130 - DNA, 22 bp, Artificial Sequence
  chemically synthesized
agtgtagacaaaaaaaagtaat

SEQ ID NO: 1365131 - DNA, 22 bp, Artificial Sequence
  chemically synthesized
ttttaaattacttttttttgtc

SEQ ID NO: 1365132 - DNA, 22 bp, Artificial Sequence
  chemically synthesized
tttaaattacttttttttgtct

SEQ ID NO: 1365133 - DNA, 22 bp, Artificial Sequence
  chemically synthesized
ttaaattacttttttttgtcta

SEQ ID NO: 1365134 - DNA, 22 bp, Artificial Sequence
  chemically synthesized
taaattacttttttttgtctac

SEQ ID NO: 1365135 - DNA, 22 bp, Artificial Sequence
  chemically synthesized
aaattacttttttttgtctaca

SEQ ID NO: 1365136 - DNA, 22 bp, Artificial Sequence
  chemically synthesized
aattacttttttttgtctacac

SEQ ID NO: 1365137 - DNA, 22 bp, Artificial Sequence
  chemically synthesized
cttttttttgtctacacttaga

SEQ ID NO: 1365138 - DNA, 22 bp, Artificial Sequence
  chemically synthesized
caacatgtatcatctaagtgta

SEQ ID NO: 1365139 - DNA, 22 bp, Artificial Sequence
  chemically synthesized
acaacatgtatcatctaagtgt

SEQ ID NO: 1365140 - DNA, 22 bp, Artificial Sequence
  chemically synthesized
tacaacatgtatcatctaagtg

SEQ ID NO: 1365141 - DNA, 22 bp, Artificial Sequence
  chemically synthesized
ttttttgtctacacttagatga

SEQ ID NO: 1365142 - DNA, 22 bp, Artificial Sequence
  chemically synthesized
tttttgtctacacttagatgat

SEQ ID NO: 1365143 - DNA, 22 bp, Artificial Sequence
  chemically synthesized
ttttgtctacacttagatgata

SEQ ID NO: 1365144 - DNA, 22 bp, Artificial Sequence
  chemically synthesized
tttgtctacacttagatgatac

SEQ ID NO: 1365145 - DNA, 22 bp, Artificial Sequence
  chemically synthesized
attttacaacatgtatcatcta

SEQ ID NO: 1365146 - DNA, 22 bp, Artificial Sequence
  chemically synthesized
ttgtctacacttagatgataca

SEQ ID NO: 1365147 - DNA, 22 bp, Artificial Sequence
  chemically synthesized
cattttacaacatgtatcatct

SEQ ID NO: 1365148 - DNA, 22 bp, Artificial Sequence
  chemically synthesized
tgtctacacttagatgatacat

SEQ ID NO: 1365149 - DNA, 22 bp, Artificial Sequence
  chemically synthesized
gtctacacttagatgatacatg

SEQ ID NO: 1365150 - DNA, 22 bp, Artificial Sequence
  chemically synthesized
tctacacttagatgatacatgt

SEQ ID NO: 1365151 - DNA, 22 bp, Artificial Sequence
  chemically synthesized
cacttagatgatacatgttgta

SEQ ID NO: 1365152 - DNA, 22 bp, Artificial Sequence
  chemically synthesized
agatgatacatgttgtaaaatg

SEQ ID NO: 1365153 - DNA, 22 bp, Artificial Sequence
  chemically synthesized
gatgatacatgttgtaaaatga

SEQ ID NO: 1365154 - DNA, 22 bp, Artificial Sequence
  chemically synthesized
gaatataatcatgggccagtct

SEQ ID NO: 1365155 - DNA, 22 bp, Artificial Sequence
  chemically synthesized
taaaatgaagactggcccatga

SEQ ID NO: 1365156 - DNA, 22 bp, Artificial Sequence
  chemically synthesized
atattggaatataatcatgggc

SEQ ID NO: 1365157 - DNA, 22 bp, Artificial Sequence
  chemically synthesized
gttaatattggaatataatcat

SEQ ID NO: 1365158 - DNA, 22 bp, Artificial Sequence
  chemically synthesized
gcccatgattatattccaatat

SEQ ID NO: 1365159 - DNA, 22 bp, Artificial Sequence
  chemically synthesized
ataacacaaggatgactggtta

SEQ ID NO: 1365160 - DNA, 22 bp, Artificial Sequence
  chemically synthesized
tattccaatattaaccagtcat

SEQ ID NO: 1365161 - DNA, 22 bp, Artificial Sequence
  chemically synthesized
aataacacaaggatgactggtt

SEQ ID NO: 1365162 - DNA, 22 bp, Artificial Sequence
  chemically synthesized
tttaataacacaaggatgactg

SEQ ID NO: 1365163 - DNA, 22 bp, Artificial Sequence
  chemically synthesized
caatattaaccagtcatccttg

SEQ ID NO: 1365164 - DNA, 22 bp, Artificial Sequence
  chemically synthesized
accagtcatccttgtgttatta

SEQ ID NO: 1365165 - DNA, 22 bp, Artificial Sequence
  chemically synthesized
atatgccatctatttaataaca

SEQ ID NO: 1365166 - DNA, 22 bp, Artificial Sequence
  chemically synthesized
attaatatgccatctatttaat

SEQ ID NO: 1365167 - DNA, 22 bp, Artificial Sequence
  chemically synthesized
taattaatatgccatctattta

SEQ ID NO: 1365168 - DNA, 22 bp, Artificial Sequence
  chemically synthesized
ctaattaatatgccatctattt

SEQ ID NO: 1365169 - DNA, 22 bp, Artificial Sequence
  chemically synthesized
tctaattaatatgccatctatt

SEQ ID NO: 1365170 - DNA, 22 bp, Artificial Sequence
  chemically synthesized
tttctaattaatatgccatcta

SEQ ID NO: 1365171 - DNA, 22 bp, Artificial Sequence
  chemically synthesized
gtgttattaaatagatggcata

SEQ ID NO: 1365172 - DNA, 22 bp, Artificial Sequence
  chemically synthesized
tgttattaaatagatggcatat

SEQ ID NO: 1365173 - DNA, 22 bp, Artificial Sequence
  chemically synthesized
agttctttctaattaatatgcc

SEQ ID NO: 1365174 - DNA, 22 bp, Artificial Sequence
  chemically synthesized
ttaaatagatggcatattaatt

SEQ ID NO: 1365175 - DNA, 22 bp, Artificial Sequence
  chemically synthesized
aatagatggcatattaattaga

SEQ ID NO: 1365176 - DNA, 22 bp, Artificial Sequence
  chemically synthesized
ccatattcagttctttctaatt

SEQ ID NO: 1365177 - DNA, 22 bp, Artificial Sequence
  chemically synthesized
accatattcagttctttctaat

SEQ ID NO: 1365178 - DNA, 22 bp, Artificial Sequence
  chemically synthesized
cgtttaccatattcagttcttt

SEQ ID NO: 1365179 - DNA, 22 bp, Artificial Sequence
  chemically synthesized
acgtttaccatattcagttctt

SEQ ID NO: 1365180 - DNA, 22 bp, Artificial Sequence
  chemically synthesized
tacgtttaccatattcagttct

SEQ ID NO: 1365181 - DNA, 22 bp, Artificial Sequence
  chemically synthesized
actttacgtttaccatattcag

SEQ ID NO: 1365182 - DNA, 22 bp, Artificial Sequence
  chemically synthesized
attagaaagaactgaatatggt

SEQ ID NO: 1365183 - DNA, 22 bp, Artificial Sequence
  chemically synthesized
ttcactttacgtttaccatatt

SEQ ID NO: 1365184 - DNA, 22 bp, Artificial Sequence
  chemically synthesized
gttcactttacgtttaccatat

SEQ ID NO: 1365185 - DNA, 22 bp, Artificial Sequence
  chemically synthesized
gaaagaactgaatatggtaaac

SEQ ID NO: 1365186 - DNA, 22 bp, Artificial Sequence
  chemically synthesized
cttgttcactttacgtttacca

SEQ ID NO: 1365187 - DNA, 22 bp, Artificial Sequence
  chemically synthesized
actccttgttcactttacgttt

SEQ ID NO: 1365188 - DNA, 22 bp, Artificial Sequence
  chemically synthesized
aatatggtaaacgtaaagtgaa

SEQ ID NO: 1365189 - DNA, 22 bp, Artificial Sequence
  chemically synthesized
agaattaactccttgttcactt

SEQ ID NO: 1365190 - DNA, 22 bp, Artificial Sequence
  chemically synthesized
aagaattaactccttgttcact

SEQ ID NO: 1365191 - DNA, 22 bp, Artificial Sequence
  chemically synthesized
tttaagaattaactccttgttc

SEQ ID NO: 1365192 - DNA, 22 bp, Artificial Sequence
  chemically synthesized
caattatttaagaattaactcc

SEQ ID NO: 1365193 - DNA, 22 bp, Artificial Sequence
  chemically synthesized
ccaattatttaagaattaactc

SEQ ID NO: 1365194 - DNA, 22 bp, Artificial Sequence
  chemically synthesized
gggtttccaattatttaagaat

SEQ ID NO: 1365195 - DNA, 22 bp, Artificial Sequence
  chemically synthesized
agggtttccaattatttaagaa

SEQ ID NO: 1365196 - DNA, 22 bp, Artificial Sequence
  chemically synthesized
tagggtttccaattatttaaga

SEQ ID NO: 1365197 - DNA, 22 bp, Artificial Sequence
  chemically synthesized
attcttaaataattggaaaccc

SEQ ID NO: 1365198 - DNA, 22 bp, Artificial Sequence
  chemically synthesized
ttaaataattggaaaccctaaa

SEQ ID NO: 1365199 - DNA, 22 bp, Artificial Sequence
  chemically synthesized
aaataattggaaaccctaaagg

SEQ ID NO: 1365200 - DNA, 22 bp, Artificial Sequence
  chemically synthesized
aataattggaaaccctaaaggc

SEQ ID NO: 1365201 - DNA, 22 bp, Artificial Sequence
  chemically synthesized
caaagtaatataaaataatgcc

SEQ ID NO: 1365202 - DNA, 22 bp, Artificial Sequence
  chemically synthesized
gaaaccctaaaggcattatttt

SEQ ID NO: 1365203 - DNA, 22 bp, Artificial Sequence
  chemically synthesized
ccaaagtaatataaaataatgc

SEQ ID NO: 1365204 - DNA, 22 bp, Artificial Sequence
  chemically synthesized
cacttccaaagtaatataaaat

SEQ ID NO: 1365205 - DNA, 22 bp, Artificial Sequence
  chemically synthesized
aaggcattattttatattactt

SEQ ID NO: 1365206 - DNA, 22 bp, Artificial Sequence
  chemically synthesized
ttttatattactttggaagtgc

SEQ ID NO: 1365207 - DNA, 22 bp, Artificial Sequence
  chemically synthesized
ggaaaatgaccctgcacttcca

SEQ ID NO: 1365208 - DNA, 22 bp, Artificial Sequence
  chemically synthesized
tatattactttggaagtgcagg

SEQ ID NO: 1365209 - DNA, 22 bp, Artificial Sequence
  chemically synthesized
atattactttggaagtgcaggg

SEQ ID NO: 1365210 - DNA, 22 bp, Artificial Sequence
  chemically synthesized
tattactttggaagtgcagggt

SEQ ID NO: 1365211 - DNA, 22 bp, Artificial Sequence
  chemically synthesized
ctttggaagtgcagggtcattt

SEQ ID NO: 1365212 - DNA, 22 bp, Artificial Sequence
  chemically synthesized
tggaagtgcagggtcattttcc

SEQ ID NO: 1365213 - DNA, 22 bp, Artificial Sequence
  chemically synthesized
ggaagtgcagggtcattttccc

SEQ ID NO: 1365214 - DNA, 22 bp, Artificial Sequence
  chemically synthesized
gaagtgcagggtcattttccca

SEQ ID NO: 1365215 - DNA, 22 bp, Artificial Sequence
  chemically synthesized
aataatcaaacaagttgggaaa

SEQ ID NO: 1365216 - DNA, 22 bp, Artificial Sequence
  chemically synthesized
tattaaataatcaaacaagttg

SEQ ID NO: 1365217 - DNA, 22 bp, Artificial Sequence
  chemically synthesized
gaattatattaaataatcaaac

SEQ ID NO: 1365218 - DNA, 22 bp, Artificial Sequence
  chemically synthesized
ggaattatattaaataatcaaa

SEQ ID NO: 1365219 - DNA, 22 bp, Artificial Sequence
  chemically synthesized
tcccaacttgtttgattattta

SEQ ID NO: 1365220 - DNA, 22 bp, Artificial Sequence
  chemically synthesized
cccaacttgtttgattatttaa

SEQ ID NO: 1365221 - DNA, 22 bp, Artificial Sequence
  chemically synthesized
ccaacttgtttgattatttaat

SEQ ID NO: 1365222 - DNA, 22 bp, Artificial Sequence
  chemically synthesized
gtttgattatttaatataattc

SEQ ID NO: 1365223 - DNA, 22 bp, Artificial Sequence
  chemically synthesized
tttgattatttaatataattcc

SEQ ID NO: 1365224 - DNA, 22 bp, Artificial Sequence
  chemically synthesized
atcataatgcttggaattatat

SEQ ID NO: 1365225 - DNA, 22 bp, Artificial Sequence
  chemically synthesized
gattatttaatataattccaag

SEQ ID NO: 1365226 - DNA, 22 bp, Artificial Sequence
  chemically synthesized
attatttaatataattccaagc

SEQ ID NO: 1365227 - DNA, 22 bp, Artificial Sequence
  chemically synthesized
cattaatcataatgcttggaat

SEQ ID NO: 1365228 - DNA, 22 bp, Artificial Sequence
  chemically synthesized
tttaatataattccaagcatta

SEQ ID NO: 1365229 - DNA, 22 bp, Artificial Sequence
  chemically synthesized
aatataattccaagcattatga

SEQ ID NO: 1365230 - DNA, 22 bp, Artificial Sequence
  chemically synthesized
atataattccaagcattatgat

SEQ ID NO: 1365231 - DNA, 22 bp, Artificial Sequence
  chemically synthesized
tgaagctgcattaatcataatg

SEQ ID NO: 1365232 - DNA, 22 bp, Artificial Sequence
  chemically synthesized
tcctgtgaagctgcattaatca

SEQ ID NO: 1365233 - DNA, 22 bp, Artificial Sequence
  chemically synthesized
gtcctgtgaagctgcattaatc

SEQ ID NO: 1365234 - DNA, 22 bp, Artificial Sequence
  chemically synthesized
caagcattatgattaatgcagc

SEQ ID NO: 1365235 - DNA, 22 bp, Artificial Sequence
  chemically synthesized
tttgtcctgtgaagctgcatta

SEQ ID NO: 1365236 - DNA, 22 bp, Artificial Sequence
  chemically synthesized
atttgtcctgtgaagctgcatt

SEQ ID NO: 1365237 - DNA, 22 bp, Artificial Sequence
  chemically synthesized
aacttatttgtcctgtgaagct

SEQ ID NO: 1365238 - DNA, 22 bp, Artificial Sequence
  chemically synthesized
caacttatttgtcctgtgaagc

SEQ ID NO: 1365239 - DNA, 22 bp, Artificial Sequence
  chemically synthesized
tgattaatgcagcttcacagga

SEQ ID NO: 1365240 - DNA, 22 bp, Artificial Sequence
  chemically synthesized
ttcaacttatttgtcctgtgaa

SEQ ID NO: 1365241 - DNA, 22 bp, Artificial Sequence
  chemically synthesized
tcttcaacttatttgtcctgtg

SEQ ID NO: 1365242 - DNA, 22 bp, Artificial Sequence
  chemically synthesized
ctcttcaacttatttgtcctgt

SEQ ID NO: 1365243 - DNA, 22 bp, Artificial Sequence
  chemically synthesized
atgcagcttcacaggacaaata

SEQ ID NO: 1365244 - DNA, 22 bp, Artificial Sequence
  chemically synthesized
tttctcttcaacttatttgtcc

SEQ ID NO: 1365245 - DNA, 22 bp, Artificial Sequence
  chemically synthesized
cacaggacaaataagttgaaga

SEQ ID NO: 1365246 - DNA, 22 bp, Artificial Sequence
  chemically synthesized
acaggacaaataagttgaagag

SEQ ID NO: 1365247 - DNA, 22 bp, Artificial Sequence
  chemically synthesized
ataagcctgtttctcttcaact

SEQ ID NO: 1365248 - DNA, 22 bp, Artificial Sequence
  chemically synthesized
cctaataagcctgtttctcttc

SEQ ID NO: 1365249 - DNA, 22 bp, Artificial Sequence
  chemically synthesized
aagagaaacaggcttattaggt

SEQ ID NO: 1365250 - DNA, 22 bp, Artificial Sequence
  chemically synthesized
tataagtatattacctaataag

SEQ ID NO: 1365251 - DNA, 22 bp, Artificial Sequence
  chemically synthesized
atataagtatattacctaataa

SEQ ID NO: 1365252 - DNA, 22 bp, Artificial Sequence
  chemically synthesized
tatataagtatattacctaata

SEQ ID NO: 1365253 - DNA, 22 bp, Artificial Sequence
  chemically synthesized
tgaattttatataagtatatta

SEQ ID NO: 1365254 - DNA, 22 bp, Artificial Sequence
  chemically synthesized
gtgaattttatataagtatatt

SEQ ID NO: 1365255 - DNA, 22 bp, Artificial Sequence
  chemically synthesized
attaggtaatatacttatataa

SEQ ID NO: 1365256 - DNA, 22 bp, Artificial Sequence
  chemically synthesized
ttaggtaatatacttatataaa

SEQ ID NO: 1365257 - DNA, 22 bp, Artificial Sequence
  chemically synthesized
ggtaatatacttatataaaatt

SEQ ID NO: 1365258 - DNA, 22 bp, Artificial Sequence
  chemically synthesized
atcaataaatttgtgaatttta

SEQ ID NO: 1365259 - DNA, 22 bp, Artificial Sequence
  chemically synthesized
cctaatcaataaatttgtgaat

SEQ ID NO: 1365260 - DNA, 22 bp, Artificial Sequence
  chemically synthesized
ccctaatcaataaatttgtgaa

SEQ ID NO: 1365261 - DNA, 22 bp, Artificial Sequence
  chemically synthesized
tccctaatcaataaatttgtga

SEQ ID NO: 1365262 - DNA, 22 bp, Artificial Sequence
  chemically synthesized
ttccctaatcaataaatttgtg

SEQ ID NO: 1365263 - DNA, 22 bp, Artificial Sequence
  chemically synthesized
tttccctaatcaataaatttgt

SEQ ID NO: 1365264 - DNA, 22 bp, Artificial Sequence
  chemically synthesized
atataaaattcacaaatttatt

SEQ ID NO: 1365265 - DNA, 22 bp, Artificial Sequence
  chemically synthesized
tataaaattcacaaatttattg

SEQ ID NO: 1365266 - DNA, 22 bp, Artificial Sequence
  chemically synthesized
acaaatttattgattagggaaa

SEQ ID NO: 1365267 - DNA, 22 bp, Artificial Sequence
  chemically synthesized
attgattagggaaaaaatcatt

SEQ ID NO: 1365268 - DNA, 22 bp, Artificial Sequence
  chemically synthesized
ttgattagggaaaaaatcatta

SEQ ID NO: 1365269 - DNA, 22 bp, Artificial Sequence
  chemically synthesized
attagggaaaaaatcattatgg

SEQ ID NO: 1365270 - DNA, 22 bp, Artificial Sequence
  chemically synthesized
gggaaaaaatcattatggatca

SEQ ID NO: 1365271 - DNA, 22 bp, Artificial Sequence
  chemically synthesized
tggaaaaaggaagtagaaatga

SEQ ID NO: 1365272 - DNA, 22 bp, Artificial Sequence
  chemically synthesized
tggatcatttctacttcctttt

SEQ ID NO: 1365273 - DNA, 22 bp, Artificial Sequence
  chemically synthesized
ctacttcctttttccacagtga

SEQ ID NO: 1365274 - DNA, 22 bp, Artificial Sequence
  chemically synthesized
aaccaatatggatcactgtgga

SEQ ID NO: 1365275 - DNA, 22 bp, Artificial Sequence
  chemically synthesized
tacttcctttttccacagtgat

SEQ ID NO: 1365276 - DNA, 22 bp, Artificial Sequence
  chemically synthesized
caaccaatatggatcactgtgg

SEQ ID NO: 1365277 - DNA, 22 bp, Artificial Sequence
  chemically synthesized
cttcctttttccacagtgatcc

SEQ ID NO: 1365278 - DNA, 22 bp, Artificial Sequence
  chemically synthesized
cctttttccacagtgatccata

SEQ ID NO: 1365279 - DNA, 22 bp, Artificial Sequence
  chemically synthesized
ctttttccacagtgatccatat

SEQ ID NO: 1365280 - DNA, 22 bp, Artificial Sequence
  chemically synthesized
tttccacagtgatccatattgg

SEQ ID NO: 1365281 - DNA, 22 bp, Artificial Sequence
  chemically synthesized
ttccacagtgatccatattggt

SEQ ID NO: 1365282 - DNA, 22 bp, Artificial Sequence
  chemically synthesized
tccacagtgatccatattggtt

SEQ ID NO: 1365283 - DNA, 22 bp, Artificial Sequence
  chemically synthesized
ccacagtgatccatattggttg

SEQ ID NO: 1365284 - DNA, 22 bp, Artificial Sequence
  chemically synthesized
cacagtgatccatattggttga

SEQ ID NO: 1365285 - DNA, 22 bp, Artificial Sequence
  chemically synthesized
taatatgggtaacatttcaacc

SEQ ID NO: 1365286 - DNA, 22 bp, Artificial Sequence
  chemically synthesized
ataatatgggtaacatttcaac

SEQ ID NO: 1365287 - DNA, 22 bp, Artificial Sequence
  chemically synthesized
gttgaaatgttacccatattat

SEQ ID NO: 1365288 - DNA, 22 bp, Artificial Sequence
  chemically synthesized
agaaatatatgccttataatat

SEQ ID NO: 1365289 - DNA, 22 bp, Artificial Sequence
  chemically synthesized
aaatgttacccatattataagg

SEQ ID NO: 1365290 - DNA, 22 bp, Artificial Sequence
  chemically synthesized
aacacctaagaaatatatgcct

SEQ ID NO: 1365291 - DNA, 22 bp, Artificial Sequence
  chemically synthesized
cccatattataaggcatatatt

SEQ ID NO: 1365292 - DNA, 22 bp, Artificial Sequence
  chemically synthesized
aaacacctaagaaatatatgcc

SEQ ID NO: 1365293 - DNA, 22 bp, Artificial Sequence
  chemically synthesized
taaacacctaagaaatatatgc

SEQ ID NO: 1365294 - DNA, 22 bp, Artificial Sequence
  chemically synthesized
ttaaacacctaagaaatatatg

SEQ ID NO: 1365295 - DNA, 22 bp, Artificial Sequence
  chemically synthesized
tttaaacacctaagaaatatat

SEQ ID NO: 1365296 - DNA, 22 bp, Artificial Sequence
  chemically synthesized
taaggcatatatttcttaggtg

SEQ ID NO: 1365297 - DNA, 22 bp, Artificial Sequence
  chemically synthesized
aagagattttttaaacacctaa

SEQ ID NO: 1365298 - DNA, 22 bp, Artificial Sequence
  chemically synthesized
actaaagagattttttaaacac

SEQ ID NO: 1365299 - DNA, 22 bp, Artificial Sequence
  chemically synthesized
aactaaagagattttttaaaca

SEQ ID NO: 1365300 - DNA, 22 bp, Artificial Sequence
  chemically synthesized
gacttaactaaagagatttttt

SEQ ID NO: 1365301 - DNA, 22 bp, Artificial Sequence
  chemically synthesized
cttaggtgtttaaaaaatctct

SEQ ID NO: 1365302 - DNA, 22 bp, Artificial Sequence
  chemically synthesized
ttaggtgtttaaaaaatctctt

SEQ ID NO: 1365303 - DNA, 22 bp, Artificial Sequence
  chemically synthesized
aggtgtttaaaaaatctcttta

SEQ ID NO: 1365304 - DNA, 22 bp, Artificial Sequence
  chemically synthesized
ggtgtttaaaaaatctctttag

SEQ ID NO: 1365305 - DNA, 22 bp, Artificial Sequence
  chemically synthesized
ccattggacttaactaaagaga

SEQ ID NO: 1365306 - DNA, 22 bp, Artificial Sequence
  chemically synthesized
cccattggacttaactaaagag

SEQ ID NO: 1365307 - DNA, 22 bp, Artificial Sequence
  chemically synthesized
tcccattggacttaactaaaga

SEQ ID NO: 1365308 - DNA, 22 bp, Artificial Sequence
  chemically synthesized
aaaaaatctctttagttaagtc

SEQ ID NO: 1365309 - DNA, 22 bp, Artificial Sequence
  chemically synthesized
aaaaatctctttagttaagtcc

SEQ ID NO: 1365310 - DNA, 22 bp, Artificial Sequence
  chemically synthesized
gcatattttcccattggactta

SEQ ID NO: 1365311 - DNA, 22 bp, Artificial Sequence
  chemically synthesized
tttagttaagtccaatgggaaa

SEQ ID NO: 1365312 - DNA, 22 bp, Artificial Sequence
  chemically synthesized
tagttaagtccaatgggaaaat

SEQ ID NO: 1365313 - DNA, 22 bp, Artificial Sequence
  chemically synthesized
acaaactagcatattttcccat

SEQ ID NO: 1365314 - DNA, 22 bp, Artificial Sequence
  chemically synthesized
agttaagtccaatgggaaaata

SEQ ID NO: 1365315 - DNA, 22 bp, Artificial Sequence
  chemically synthesized
gttaagtccaatgggaaaatat

SEQ ID NO: 1365316 - DNA, 22 bp, Artificial Sequence
  chemically synthesized
actcacaaactagcatattttc

SEQ ID NO: 1365317 - DNA, 22 bp, Artificial Sequence
  chemically synthesized
agtccaatgggaaaatatgcta

SEQ ID NO: 1365318 - DNA, 22 bp, Artificial Sequence
  chemically synthesized
taaactcactcacaaactagca

SEQ ID NO: 1365319 - DNA, 22 bp, Artificial Sequence
  chemically synthesized
gtgcctataaactcactcacaa

SEQ ID NO: 1365320 - DNA, 22 bp, Artificial Sequence
  chemically synthesized
gtcctagtgcctataaactcac

SEQ ID NO: 1365321 - DNA, 22 bp, Artificial Sequence
  chemically synthesized
tggtcctagtgcctataaactc

SEQ ID NO: 1365322 - DNA, 22 bp, Artificial Sequence
  chemically synthesized
ctggtcctagtgcctataaact

SEQ ID NO: 1365323 - DNA, 22 bp, Artificial Sequence
  chemically synthesized
gtttgtgagtgagtttataggc

SEQ ID NO: 1365324 - DNA, 22 bp, Artificial Sequence
  chemically synthesized
tctggtcctagtgcctataaac

SEQ ID NO: 1365325 - DNA, 22 bp, Artificial Sequence
  chemically synthesized
ttctggtcctagtgcctataaa

SEQ ID NO: 1365326 - DNA, 22 bp, Artificial Sequence
  chemically synthesized
tttctggtcctagtgcctataa

SEQ ID NO: 1365327 - DNA, 22 bp, Artificial Sequence
  chemically synthesized
gtgagtgagtttataggcacta

SEQ ID NO: 1365328 - DNA, 22 bp, Artificial Sequence
  chemically synthesized
tgagtgagtttataggcactag

SEQ ID NO: 1365329 - DNA, 22 bp, Artificial Sequence
  chemically synthesized
ttttttctggtcctagtgccta

SEQ ID NO: 1365330 - DNA, 22 bp, Artificial Sequence
  chemically synthesized
attttttctggtcctagtgcct

SEQ ID NO: 1365331 - DNA, 22 bp, Artificial Sequence
  chemically synthesized
tcttattttttctggtcctagt

SEQ ID NO: 1365332 - DNA, 22 bp, Artificial Sequence
  chemically synthesized
gtcttattttttctggtcctag

SEQ ID NO: 1365333 - DNA, 22 bp, Artificial Sequence
  chemically synthesized
tttgtcttattttttctggtcc

SEQ ID NO: 1365334 - DNA, 22 bp, Artificial Sequence
  chemically synthesized
ataggcactaggaccagaaaaa

SEQ ID NO: 1365335 - DNA, 22 bp, Artificial Sequence
  chemically synthesized
tatttgtcttattttttctggt

SEQ ID NO: 1365336 - DNA, 22 bp, Artificial Sequence
  chemically synthesized
taggcactaggaccagaaaaaa

SEQ ID NO: 1365337 - DNA, 22 bp, Artificial Sequence
  chemically synthesized
aattctatttgtcttatttttt

SEQ ID NO: 1365338 - DNA, 22 bp, Artificial Sequence
  chemically synthesized
gaattctatttgtcttattttt

SEQ ID NO: 1365339 - DNA, 22 bp, Artificial Sequence
  chemically synthesized
cttgaattctatttgtcttatt

SEQ ID NO: 1365340 - DNA, 22 bp, Artificial Sequence
  chemically synthesized
ggaccagaaaaaataagacaaa

SEQ ID NO: 1365341 - DNA, 22 bp, Artificial Sequence
  chemically synthesized
caaattgcttgaattctatttg

SEQ ID NO: 1365342 - DNA, 22 bp, Artificial Sequence
  chemically synthesized
gacaccctccaaattgcttgaa

SEQ ID NO: 1365343 - DNA, 22 bp, Artificial Sequence
  chemically synthesized
ggacaccctccaaattgcttga

SEQ ID NO: 1365344 - DNA, 22 bp, Artificial Sequence
  chemically synthesized
tttggacaccctccaaattgct

SEQ ID NO: 1365345 - DNA, 22 bp, Artificial Sequence
  chemically synthesized
tctatttggacaccctccaaat

SEQ ID NO: 1365346 - DNA, 22 bp, Artificial Sequence
  chemically synthesized
gtctatttggacaccctccaaa

SEQ ID NO: 1365347 - DNA, 22 bp, Artificial Sequence
  chemically synthesized
tgtctatttggacaccctccaa

SEQ ID NO: 1365348 - DNA, 22 bp, Artificial Sequence
  chemically synthesized
ttgtctatttggacaccctcca

SEQ ID NO: 1365349 - DNA, 22 bp, Artificial Sequence
  chemically synthesized
aagcaatttggagggtgtccaa

SEQ ID NO: 1365350 - DNA, 22 bp, Artificial Sequence
  chemically synthesized
ggagggtgtccaaatagacaaa

SEQ ID NO: 1365351 - DNA, 22 bp, Artificial Sequence
  chemically synthesized
gagggtgtccaaatagacaaaa

SEQ ID NO: 1365352 - DNA, 22 bp, Artificial Sequence
  chemically synthesized
tcaaaacatcagtgaaacattt

SEQ ID NO: 1365353 - DNA, 22 bp, Artificial Sequence
  chemically synthesized
ctatcaaaacatcagtgaaaca

SEQ ID NO: 1365354 - DNA, 22 bp, Artificial Sequence
  chemically synthesized
aatgcaattcctatcaaaacat

SEQ ID NO: 1365355 - DNA, 22 bp, Artificial Sequence
  chemically synthesized
gaatgcaattcctatcaaaaca

SEQ ID NO: 1365356 - DNA, 22 bp, Artificial Sequence
  chemically synthesized
cactgatgttttgataggaatt

SEQ ID NO: 1365357 - DNA, 22 bp, Artificial Sequence
  chemically synthesized
tagtttgaatgcaattcctatc

SEQ ID NO: 1365358 - DNA, 22 bp, Artificial Sequence
  chemically synthesized
actgatgttttgataggaattg

SEQ ID NO: 1365359 - DNA, 22 bp, Artificial Sequence
  chemically synthesized
atgttttgataggaattgcatt

SEQ ID NO: 1365360 - DNA, 22 bp, Artificial Sequence
  chemically synthesized
atctatagtttgaatgcaattc

SEQ ID NO: 1365361 - DNA, 22 bp, Artificial Sequence
  chemically synthesized
tgataggaattgcattcaaact

SEQ ID NO: 1365362 - DNA, 22 bp, Artificial Sequence
  chemically synthesized
gataggaattgcattcaaacta

SEQ ID NO: 1365363 - DNA, 22 bp, Artificial Sequence
  chemically synthesized
ataggaattgcattcaaactat

SEQ ID NO: 1365364 - DNA, 22 bp, Artificial Sequence
  chemically synthesized
caaaactaatctatagtttgaa

SEQ ID NO: 1365365 - DNA, 22 bp, Artificial Sequence
  chemically synthesized
ccaaaactaatctatagtttga

SEQ ID NO: 1365366 - DNA, 22 bp, Artificial Sequence
  chemically synthesized
ttccaaaactaatctatagttt

SEQ ID NO: 1365367 - DNA, 22 bp, Artificial Sequence
  chemically synthesized
cattcaaactatagattagttt

SEQ ID NO: 1365368 - DNA, 22 bp, Artificial Sequence
  chemically synthesized
aaactatagattagttttggaa

SEQ ID NO: 1365369 - DNA, 22 bp, Artificial Sequence
  chemically synthesized
tagattagttttggaagaattg

SEQ ID NO: 1365370 - DNA, 22 bp, Artificial Sequence
  chemically synthesized
gttttggaagaattgatatatt

SEQ ID NO: 1365371 - DNA, 22 bp, Artificial Sequence
  chemically synthesized
tggaagaattgatatatttact

SEQ ID NO: 1365372 - DNA, 22 bp, Artificial Sequence
  chemically synthesized
ggaagaattgatatatttacta

SEQ ID NO: 1365373 - DNA, 22 bp, Artificial Sequence
  chemically synthesized
gaggatacaacatagtaaatat

SEQ ID NO: 1365374 - DNA, 22 bp, Artificial Sequence
  chemically synthesized
gaagaattgatatatttactat

SEQ ID NO: 1365375 - DNA, 22 bp, Artificial Sequence
  chemically synthesized
atggaattggaggatacaacat

SEQ ID NO: 1365376 - DNA, 22 bp, Artificial Sequence
  chemically synthesized
atatatttactatgttgtatcc

SEQ ID NO: 1365377 - DNA, 22 bp, Artificial Sequence
  chemically synthesized
tattaatggaattggaggatac

SEQ ID NO: 1365378 - DNA, 22 bp, Artificial Sequence
  chemically synthesized
actatgttgtatcctccaattc

SEQ ID NO: 1365379 - DNA, 22 bp, Artificial Sequence
  chemically synthesized
ctatgttgtatcctccaattcc

SEQ ID NO: 1365380 - DNA, 22 bp, Artificial Sequence
  chemically synthesized
tgttgtatcctccaattccatt

SEQ ID NO: 1365381 - DNA, 22 bp, Artificial Sequence
  chemically synthesized
tatcctccaattccattaatac

SEQ ID NO: 1365382 - DNA, 22 bp, Artificial Sequence
  chemically synthesized
caattccattaatacagtatat

SEQ ID NO: 1365383 - DNA, 22 bp, Artificial Sequence
  chemically synthesized
aataaacggagatatatactgt

SEQ ID NO: 1365384 - DNA, 22 bp, Artificial Sequence
  chemically synthesized
aaataaacggagatatatactg

SEQ ID NO: 1365385 - DNA, 22 bp, Artificial Sequence
  chemically synthesized
cattaatacagtatatatctcc

SEQ ID NO: 1365386 - DNA, 22 bp, Artificial Sequence
  chemically synthesized
atacagtatatatctccgttta

SEQ ID NO: 1365387 - DNA, 22 bp, Artificial Sequence
  chemically synthesized
aggaaataatgcaaagacttaa

SEQ ID NO: 1365388 - DNA, 22 bp, Artificial Sequence
  chemically synthesized
cgtttatttaagtctttgcatt

SEQ ID NO: 1365389 - DNA, 22 bp, Artificial Sequence
  chemically synthesized
aaaagctaaggaaataatgcaa

SEQ ID NO: 1365390 - DNA, 22 bp, Artificial Sequence
  chemically synthesized
atttaagtctttgcattatttc

SEQ ID NO: 1365391 - DNA, 22 bp, Artificial Sequence
  chemically synthesized
tttaagtctttgcattatttcc

SEQ ID NO: 1365392 - DNA, 22 bp, Artificial Sequence
  chemically synthesized
aagtctttgcattatttcctta

SEQ ID NO: 1365393 - DNA, 22 bp, Artificial Sequence
  chemically synthesized
agtctttgcattatttccttag

SEQ ID NO: 1365394 - DNA, 22 bp, Artificial Sequence
  chemically synthesized
caaactaaaaagctaaggaaat

SEQ ID NO: 1365395 - DNA, 22 bp, Artificial Sequence
  chemically synthesized
tgcattatttccttagcttttt

SEQ ID NO: 1365396 - DNA, 22 bp, Artificial Sequence
  chemically synthesized
gcattatttccttagcttttta

SEQ ID NO: 1365397 - DNA, 22 bp, Artificial Sequence
  chemically synthesized
tatactacaaactaaaaagcta

SEQ ID NO: 1365398 - DNA, 22 bp, Artificial Sequence
  chemically synthesized
cattatttccttagctttttag

SEQ ID NO: 1365399 - DNA, 22 bp, Artificial Sequence
  chemically synthesized
tttccttagctttttagtttgt

SEQ ID NO: 1365400 - DNA, 22 bp, Artificial Sequence
  chemically synthesized
ccttagctttttagtttgtagt

SEQ ID NO: 1365401 - DNA, 22 bp, Artificial Sequence
  chemically synthesized
ccagatctatatactacaaact

SEQ ID NO: 1365402 - DNA, 22 bp, Artificial Sequence
  chemically synthesized
cttagctttttagtttgtagta

SEQ ID NO: 1365403 - DNA, 22 bp, Artificial Sequence
  chemically synthesized
accagatctatatactacaaac

SEQ ID NO: 1365404 - DNA, 22 bp, Artificial Sequence
  chemically synthesized
agctttttagtttgtagtatat

SEQ ID NO: 1365405 - DNA, 22 bp, Artificial Sequence
  chemically synthesized
gctttttagtttgtagtatata

SEQ ID NO: 1365406 - DNA, 22 bp, Artificial Sequence
  chemically synthesized
tttagtttgtagtatatagatc

SEQ ID NO: 1365407 - DNA, 22 bp, Artificial Sequence
  chemically synthesized
ttagtttgtagtatatagatct

SEQ ID NO: 1365408 - DNA, 22 bp, Artificial Sequence
  chemically synthesized
tagtttgtagtatatagatctg

SEQ ID NO: 1365409 - DNA, 22 bp, Artificial Sequence
  chemically synthesized
agtttgtagtatatagatctgg

SEQ ID NO: 1365410 - DNA, 22 bp, Artificial Sequence
  chemically synthesized
ataaaacatttaccagatctat

SEQ ID NO: 1365411 - DNA, 22 bp, Artificial Sequence
  chemically synthesized
gtttgtagtatatagatctggt

SEQ ID NO: 1365412 - DNA, 22 bp, Artificial Sequence
  chemically synthesized
gtagtatatagatctggtaaat

SEQ ID NO: 1365413 - DNA, 22 bp, Artificial Sequence
  chemically synthesized
tagtatatagatctggtaaatg

SEQ ID NO: 1365414 - DNA, 22 bp, Artificial Sequence
  chemically synthesized
tgaatctaataaaacatttacc

SEQ ID NO: 1365415 - DNA, 22 bp, Artificial Sequence
  chemically synthesized
atgaatctaataaaacatttac

SEQ ID NO: 1365416 - DNA, 22 bp, Artificial Sequence
  chemically synthesized
gtaaatgttttattagattcat

SEQ ID NO: 1365417 - DNA, 22 bp, Artificial Sequence
  chemically synthesized
aaacaatgaaatacttatgaat

SEQ ID NO: 1365418 - DNA, 22 bp, Artificial Sequence
  chemically synthesized
tgaaacaatgaaatacttatga

SEQ ID NO: 1365419 - DNA, 22 bp, Artificial Sequence
  chemically synthesized
tattagattcataagtatttca

SEQ ID NO: 1365420 - DNA, 22 bp, Artificial Sequence
  chemically synthesized
attagattcataagtatttcat

SEQ ID NO: 1365421 - DNA, 22 bp, Artificial Sequence
  chemically synthesized
ttagattcataagtatttcatt

SEQ ID NO: 1365422 - DNA, 22 bp, Artificial Sequence
  chemically synthesized
gattcataagtatttcattgtt

SEQ ID NO: 1365423 - DNA, 22 bp, Artificial Sequence
  chemically synthesized
cagtcactctgaaacaatgaaa

SEQ ID NO: 1365424 - DNA, 22 bp, Artificial Sequence
  chemically synthesized
gcagtcactctgaaacaatgaa

SEQ ID NO: 1365425 - DNA, 22 bp, Artificial Sequence
  chemically synthesized
ataagtatttcattgtttcaga

SEQ ID NO: 1365426 - DNA, 22 bp, Artificial Sequence
  chemically synthesized
acatagtatcttgcagtcactc

SEQ ID NO: 1365427 - DNA, 22 bp, Artificial Sequence
  chemically synthesized
cacatagtatcttgcagtcact

SEQ ID NO: 1365428 - DNA, 22 bp, Artificial Sequence
  chemically synthesized
cattgtttcagagtgactgcaa

SEQ ID NO: 1365429 - DNA, 22 bp, Artificial Sequence
  chemically synthesized
tcacatagtatcttgcagtcac

SEQ ID NO: 1365430 - DNA, 22 bp, Artificial Sequence
  chemically synthesized
attgtttcagagtgactgcaag

SEQ ID NO: 1365431 - DNA, 22 bp, Artificial Sequence
  chemically synthesized
ttcacatagtatcttgcagtca

SEQ ID NO: 1365432 - DNA, 22 bp, Artificial Sequence
  chemically synthesized
tttcagagtgactgcaagatac

SEQ ID NO: 1365433 - DNA, 22 bp, Artificial Sequence
  chemically synthesized
cagagtgactgcaagatactat

SEQ ID NO: 1365434 - DNA, 22 bp, Artificial Sequence
  chemically synthesized
agagtgactgcaagatactatg

SEQ ID NO: 1365435 - DNA, 22 bp, Artificial Sequence
  chemically synthesized
aaacccaaaatttttcacatag

SEQ ID NO: 1365436 - DNA, 22 bp, Artificial Sequence
  chemically synthesized
ctgaaacccaaaatttttcaca

SEQ ID NO: 1365437 - DNA, 22 bp, Artificial Sequence
  chemically synthesized
caagatactatgtgaaaaattt

SEQ ID NO: 1365438 - DNA, 22 bp, Artificial Sequence
  chemically synthesized
actactgaaacccaaaattttt

SEQ ID NO: 1365439 - DNA, 22 bp, Artificial Sequence
  chemically synthesized
tgtgaaaaattttgggtttcag

SEQ ID NO: 1365440 - DNA, 22 bp, Artificial Sequence
  chemically synthesized
tatacaagcaattaactactga

SEQ ID NO: 1365441 - DNA, 22 bp, Artificial Sequence
  chemically synthesized
gtatacaagcaattaactactg

SEQ ID NO: 1365442 - DNA, 22 bp, Artificial Sequence
  chemically synthesized
tgtatacaagcaattaactact

SEQ ID NO: 1365443 - DNA, 22 bp, Artificial Sequence
  chemically synthesized
ttgtatacaagcaattaactac

SEQ ID NO: 1365444 - DNA, 22 bp, Artificial Sequence
  chemically synthesized
tgggtttcagtagttaattgct

SEQ ID NO: 1365445 - DNA, 22 bp, Artificial Sequence
  chemically synthesized
gggtttcagtagttaattgctt

SEQ ID NO: 1365446 - DNA, 22 bp, Artificial Sequence
  chemically synthesized
ggtttcagtagttaattgcttg

SEQ ID NO: 1365447 - DNA, 22 bp, Artificial Sequence
  chemically synthesized
tatttttgtatacaagcaatta

SEQ ID NO: 1365448 - DNA, 22 bp, Artificial Sequence
  chemically synthesized
attgtatttttgtatacaagca

SEQ ID NO: 1365449 - DNA, 22 bp, Artificial Sequence
  chemically synthesized
cagtagttaattgcttgtatac

SEQ ID NO: 1365450 - DNA, 22 bp, Artificial Sequence
  chemically synthesized
agtagttaattgcttgtataca

SEQ ID NO: 1365451 - DNA, 22 bp, Artificial Sequence
  chemically synthesized
aaaattaattgtatttttgtat

SEQ ID NO: 1365452 - DNA, 22 bp, Artificial Sequence
  chemically synthesized
attgcttgtatacaaaaataca

SEQ ID NO: 1365453 - DNA, 22 bp, Artificial Sequence
  chemically synthesized
ttaaaaattaattgtatttttg

SEQ ID NO: 1365454 - DNA, 22 bp, Artificial Sequence
  chemically synthesized
cttgtatacaaaaatacaatta

SEQ ID NO: 1365455 - DNA, 22 bp, Artificial Sequence
  chemically synthesized
gtatacaaaaatacaattaatt

SEQ ID NO: 1365456 - DNA, 22 bp, Artificial Sequence
  chemically synthesized
tatacaaaaatacaattaattt

SEQ ID NO: 1365457 - DNA, 22 bp, Artificial Sequence
  chemically synthesized
tcacagtaaaatgattattaaa

SEQ ID NO: 1365458 - DNA, 22 bp, Artificial Sequence
  chemically synthesized
atcacagtaaaatgattattaa

SEQ ID NO: 1365459 - DNA, 22 bp, Artificial Sequence
  chemically synthesized
aatcttatcacagtaaaatgat

SEQ ID NO: 1365460 - DNA, 22 bp, Artificial Sequence
  chemically synthesized
atttttaataatcattttactg

SEQ ID NO: 1365461 - DNA, 22 bp, Artificial Sequence
  chemically synthesized
ttaataatcattttactgtgat

SEQ ID NO: 1365462 - DNA, 22 bp, Artificial Sequence
  chemically synthesized
atattaaatcttatcacagtaa

SEQ ID NO: 1365463 - DNA, 22 bp, Artificial Sequence
  chemically synthesized
taataatcattttactgtgata

SEQ ID NO: 1365464 - DNA, 22 bp, Artificial Sequence
  chemically synthesized
aataatcattttactgtgataa

SEQ ID NO: 1365465 - DNA, 22 bp, Artificial Sequence
  chemically synthesized
ataatcattttactgtgataag

SEQ ID NO: 1365466 - DNA, 22 bp, Artificial Sequence
  chemically synthesized
ggtagatctcatattaaatctt

SEQ ID NO: 1365467 - DNA, 22 bp, Artificial Sequence
  chemically synthesized
tactgtgataagatttaatatg

SEQ ID NO: 1365468 - DNA, 22 bp, Artificial Sequence
  chemically synthesized
actgtgataagatttaatatga

SEQ ID NO: 1365469 - DNA, 22 bp, Artificial Sequence
  chemically synthesized
gttgggtagatctcatattaaa

SEQ ID NO: 1365470 - DNA, 22 bp, Artificial Sequence
  chemically synthesized
ctgtgataagatttaatatgag

SEQ ID NO: 1365471 - DNA, 22 bp, Artificial Sequence
  chemically synthesized
ttcgttgggtagatctcatatt

SEQ ID NO: 1365472 - DNA, 22 bp, Artificial Sequence
  chemically synthesized
tgataagatttaatatgagatc

SEQ ID NO: 1365473 - DNA, 22 bp, Artificial Sequence
  chemically synthesized
agaatctgttcgttgggtagat

SEQ ID NO: 1365474 - DNA, 22 bp, Artificial Sequence
  chemically synthesized
aagaatctgttcgttgggtaga

SEQ ID NO: 1365475 - DNA, 22 bp, Artificial Sequence
  chemically synthesized
aatatgagatctacccaacgaa

SEQ ID NO: 1365476 - DNA, 22 bp, Artificial Sequence
  chemically synthesized
atatgagatctacccaacgaac

SEQ ID NO: 1365477 - DNA, 22 bp, Artificial Sequence
  chemically synthesized
taatttaagaatctgttcgttg

SEQ ID NO: 1365478 - DNA, 22 bp, Artificial Sequence
  chemically synthesized
cccaacgaacagattcttaaat

SEQ ID NO: 1365479 - DNA, 22 bp, Artificial Sequence
  chemically synthesized
tatgtaacaatacagcattata

SEQ ID NO: 1365480 - DNA, 22 bp, Artificial Sequence
  chemically synthesized
ttaaattataatgctgtattgt

SEQ ID NO: 1365481 - DNA, 22 bp, Artificial Sequence
  chemically synthesized
aaattataatgctgtattgtta

SEQ ID NO: 1365482 - DNA, 22 bp, Artificial Sequence
  chemically synthesized
aattataatgctgtattgttac

SEQ ID NO: 1365483 - DNA, 22 bp, Artificial Sequence
  chemically synthesized
taatgctgtattgttacatata

SEQ ID NO: 1365484 - DNA, 22 bp, Artificial Sequence
  chemically synthesized
tacaacatcgtatctatatgta

SEQ ID NO: 1365485 - DNA, 22 bp, Artificial Sequence
  chemically synthesized
ctgtacaacatcgtatctatat

SEQ ID NO: 1365486 - DNA, 22 bp, Artificial Sequence
  chemically synthesized
tattgttacatatagatacgat

SEQ ID NO: 1365487 - DNA, 22 bp, Artificial Sequence
  chemically synthesized
ttacatatagatacgatgttgt

SEQ ID NO: 1365488 - DNA, 22 bp, Artificial Sequence
  chemically synthesized
gagatctgctgtacaacatcgt

SEQ ID NO: 1365489 - DNA, 22 bp, Artificial Sequence
  chemically synthesized
tagagatctgctgtacaacatc

SEQ ID NO: 1365490 - DNA, 22 bp, Artificial Sequence
  chemically synthesized
catatagatacgatgttgtaca

SEQ ID NO: 1365491 - DNA, 22 bp, Artificial Sequence
  chemically synthesized
tataagatgaataagttctaga

SEQ ID NO: 1365492 - DNA, 22 bp, Artificial Sequence
  chemically synthesized
tacagcagatctctagaactta

SEQ ID NO: 1365493 - DNA, 22 bp, Artificial Sequence
  chemically synthesized
atataagatgaataagttctag

SEQ ID NO: 1365494 - DNA, 22 bp, Artificial Sequence
  chemically synthesized
atttatataagatgaataagtt

SEQ ID NO: 1365495 - DNA, 22 bp, Artificial Sequence
  chemically synthesized
catttatataagatgaataagt

SEQ ID NO: 1365496 - DNA, 22 bp, Artificial Sequence
  chemically synthesized
tagaacttattcatcttatata

SEQ ID NO: 1365497 - DNA, 22 bp, Artificial Sequence
  chemically synthesized
gaacttattcatcttatataaa

SEQ ID NO: 1365498 - DNA, 22 bp, Artificial Sequence
  chemically synthesized
attcatcttatataaatgaaac

SEQ ID NO: 1365499 - DNA, 22 bp, Artificial Sequence
  chemically synthesized
ttcatcttatataaatgaaact

SEQ ID NO: 1365500 - DNA, 22 bp, Artificial Sequence
  chemically synthesized
atcaatgaatatgaagtttcat

SEQ ID NO: 1365501 - DNA, 22 bp, Artificial Sequence
  chemically synthesized
atcttatataaatgaaacttca

SEQ ID NO: 1365502 - DNA, 22 bp, Artificial Sequence
  chemically synthesized
ctaatcaatgaatatgaagttt

SEQ ID NO: 1365503 - DNA, 22 bp, Artificial Sequence
  chemically synthesized
atataaatgaaacttcatattc

SEQ ID NO: 1365504 - DNA, 22 bp, Artificial Sequence
  chemically synthesized
tataaatgaaacttcatattca

SEQ ID NO: 1365505 - DNA, 22 bp, Artificial Sequence
  chemically synthesized
taaaagtcaattgctaatcaat

SEQ ID NO: 1365506 - DNA, 22 bp, Artificial Sequence
  chemically synthesized
ataaaagtcaattgctaatcaa

SEQ ID NO: 1365507 - DNA, 22 bp, Artificial Sequence
  chemically synthesized
catattcattgattagcaattg

SEQ ID NO: 1365508 - DNA, 22 bp, Artificial Sequence
  chemically synthesized
atattcattgattagcaattga

SEQ ID NO: 1365509 - DNA, 22 bp, Artificial Sequence
  chemically synthesized
attgattagcaattgactttta

SEQ ID NO: 1365510 - DNA, 22 bp, Artificial Sequence
  chemically synthesized
attagcaattgacttttataag

SEQ ID NO: 1365511 - DNA, 22 bp, Artificial Sequence
  chemically synthesized
ggatacaagatcaacttataaa

SEQ ID NO: 1365512 - DNA, 22 bp, Artificial Sequence
  chemically synthesized
aggatacaagatcaacttataa

SEQ ID NO: 1365513 - DNA, 22 bp, Artificial Sequence
  chemically synthesized
gcaattgacttttataagttga

SEQ ID NO: 1365514 - DNA, 22 bp, Artificial Sequence
  chemically synthesized
aggtcttaggatacaagatcaa

SEQ ID NO: 1365515 - DNA, 22 bp, Artificial Sequence
  chemically synthesized
acttttataagttgatcttgta

SEQ ID NO: 1365516 - DNA, 22 bp, Artificial Sequence
  chemically synthesized
ttaaggtcttaggatacaagat

SEQ ID NO: 1365517 - DNA, 22 bp, Artificial Sequence
  chemically synthesized
gttaaggtcttaggatacaaga

SEQ ID NO: 1365518 - DNA, 22 bp, Artificial Sequence
  chemically synthesized
ttataagttgatcttgtatcct

SEQ ID NO: 1365519 - DNA, 22 bp, Artificial Sequence
  chemically synthesized
tataagttgatcttgtatccta

SEQ ID NO: 1365520 - DNA, 22 bp, Artificial Sequence
  chemically synthesized
ataagttgatcttgtatcctaa

SEQ ID NO: 1365521 - DNA, 22 bp, Artificial Sequence
  chemically synthesized
taagttgatcttgtatcctaag

SEQ ID NO: 1365522 - DNA, 22 bp, Artificial Sequence
  chemically synthesized
atcttgtatcctaagaccttaa

SEQ ID NO: 1365523 - DNA, 22 bp, Artificial Sequence
  chemically synthesized
gaaatgatgagtttgttaaggt

SEQ ID NO: 1365524 - DNA, 22 bp, Artificial Sequence
  chemically synthesized
agaaatgatgagtttgttaagg

SEQ ID NO: 1365525 - DNA, 22 bp, Artificial Sequence
  chemically synthesized
gtatcctaagaccttaacaaac

SEQ ID NO: 1365526 - DNA, 22 bp, Artificial Sequence
  chemically synthesized
tatcctaagaccttaacaaact

SEQ ID NO: 1365527 - DNA, 22 bp, Artificial Sequence
  chemically synthesized
ttagaaatgatgagtttgttaa

SEQ ID NO: 1365528 - DNA, 22 bp, Artificial Sequence
  chemically synthesized
ctcttagaaatgatgagtttgt

SEQ ID NO: 1365529 - DNA, 22 bp, Artificial Sequence
  chemically synthesized
agaccttaacaaactcatcatt

SEQ ID NO: 1365530 - DNA, 22 bp, Artificial Sequence
  chemically synthesized
caaagttactcttagaaatgat

SEQ ID NO: 1365531 - DNA, 22 bp, Artificial Sequence
  chemically synthesized
tacaaagttactcttagaaatg

SEQ ID NO: 1365532 - DNA, 22 bp, Artificial Sequence
  chemically synthesized
aacaaactcatcatttctaaga

SEQ ID NO: 1365533 - DNA, 22 bp, Artificial Sequence
  chemically synthesized
acaaactcatcatttctaagag

SEQ ID NO: 1365534 - DNA, 22 bp, Artificial Sequence
  chemically synthesized
atcatttctaagagtaactttg

SEQ ID NO: 1365535 - DNA, 22 bp, Artificial Sequence
  chemically synthesized
ctaagagtaactttgtagaata

SEQ ID NO: 1365536 - DNA, 22 bp, Artificial Sequence
  chemically synthesized
taagagtaactttgtagaatac

SEQ ID NO: 1365537 - DNA, 22 bp, Artificial Sequence
  chemically synthesized
tgtaaaatcccaggtattctac

SEQ ID NO: 1365538 - DNA, 22 bp, Artificial Sequence
  chemically synthesized
agagtaactttgtagaatacct

SEQ ID NO: 1365539 - DNA, 22 bp, Artificial Sequence
  chemically synthesized
tgatgatctatgtaaaatccca

SEQ ID NO: 1365540 - DNA, 22 bp, Artificial Sequence
  chemically synthesized
tgtagaatacctgggattttac

SEQ ID NO: 1365541 - DNA, 22 bp, Artificial Sequence
  chemically synthesized
gtagaatacctgggattttaca

SEQ ID NO: 1365542 - DNA, 22 bp, Artificial Sequence
  chemically synthesized
tagaatacctgggattttacat

SEQ ID NO: 1365543 - DNA, 22 bp, Artificial Sequence
  chemically synthesized
cagatgttatgatgatctatgt

SEQ ID NO: 1365544 - DNA, 22 bp, Artificial Sequence
  chemically synthesized
gcagatgttatgatgatctatg

SEQ ID NO: 1365545 - DNA, 22 bp, Artificial Sequence
  chemically synthesized
ggattttacatagatcatcata

SEQ ID NO: 1365546 - DNA, 22 bp, Artificial Sequence
  chemically synthesized
catttgcagatgttatgatgat

SEQ ID NO: 1365547 - DNA, 22 bp, Artificial Sequence
  chemically synthesized
tctccatttgcagatgttatga

SEQ ID NO: 1365548 - DNA, 22 bp, Artificial Sequence
  chemically synthesized
tacatagatcatcataacatct

SEQ ID NO: 1365549 - DNA, 22 bp, Artificial Sequence
  chemically synthesized
acatagatcatcataacatctg

SEQ ID NO: 1365550 - DNA, 22 bp, Artificial Sequence
  chemically synthesized
catagatcatcataacatctgc

SEQ ID NO: 1365551 - DNA, 22 bp, Artificial Sequence
  chemically synthesized
tactgtctccatttgcagatgt

SEQ ID NO: 1365552 - DNA, 22 bp, Artificial Sequence
  chemically synthesized
caaatggagacagtataacttt

SEQ ID NO: 1365553 - DNA, 22 bp, Artificial Sequence
  chemically synthesized
ttccttcctgatttgtacgctt

SEQ ID NO: 1365554 - DNA, 22 bp, Artificial Sequence
  chemically synthesized
tccttcctgatttgtacgcttt

SEQ ID NO: 1365555 - DNA, 22 bp, Artificial Sequence
  chemically synthesized
ccttcctgatttgtacgctttt

SEQ ID NO: 1365556 - DNA, 22 bp, Artificial Sequence
  chemically synthesized
cttcctgatttgtacgctttta

SEQ ID NO: 1365557 - DNA, 22 bp, Artificial Sequence
  chemically synthesized
cctgatttgtacgcttttatcc

SEQ ID NO: 1365558 - DNA, 22 bp, Artificial Sequence
  chemically synthesized
ctgatttgtacgcttttatcca

SEQ ID NO: 1365559 - DNA, 22 bp, Artificial Sequence
  chemically synthesized
atttgtacgcttttatccactt

SEQ ID NO: 1365560 - DNA, 22 bp, Artificial Sequence
  chemically synthesized
gtacgcttttatccacttttct

SEQ ID NO: 1365561 - DNA, 22 bp, Artificial Sequence
  chemically synthesized
tacgcttttatccacttttctt

SEQ ID NO: 1365562 - DNA, 22 bp, Artificial Sequence
  chemically synthesized
gtgtaaaaatgcaagaaaagtg

SEQ ID NO: 1365563 - DNA, 22 bp, Artificial Sequence
  chemically synthesized
gctagtgtaaaaatgcaagaaa

SEQ ID NO: 1365564 - DNA, 22 bp, Artificial Sequence
  chemically synthesized
tagctagtgtaaaaatgcaaga

SEQ ID NO: 1365565 - DNA, 22 bp, Artificial Sequence
  chemically synthesized
ttatccacttttcttgcatttt

SEQ ID NO: 1365566 - DNA, 22 bp, Artificial Sequence
  chemically synthesized
tatccacttttcttgcattttt

SEQ ID NO: 1365567 - DNA, 22 bp, Artificial Sequence
  chemically synthesized
atccacttttcttgcattttta

SEQ ID NO: 1365568 - DNA, 22 bp, Artificial Sequence
  chemically synthesized
tccacttttcttgcatttttac

SEQ ID NO: 1365569 - DNA, 22 bp, Artificial Sequence
  chemically synthesized
gaagttctagctagtgtaaaaa

SEQ ID NO: 1365570 - DNA, 22 bp, Artificial Sequence
  chemically synthesized
ttcttgcatttttacactagct

SEQ ID NO: 1365571 - DNA, 22 bp, Artificial Sequence
  chemically synthesized
tcttgcatttttacactagcta

SEQ ID NO: 1365572 - DNA, 22 bp, Artificial Sequence
  chemically synthesized
cttgcatttttacactagctag

SEQ ID NO: 1365573 - DNA, 22 bp, Artificial Sequence
  chemically synthesized
ttgcatttttacactagctaga

SEQ ID NO: 1365574 - DNA, 22 bp, Artificial Sequence
  chemically synthesized
gcatttttacactagctagaac

SEQ ID NO: 1365575 - DNA, 22 bp, Artificial Sequence
  chemically synthesized
atagtactggaagttctagcta

SEQ ID NO: 1365576 - DNA, 22 bp, Artificial Sequence
  chemically synthesized
catttttacactagctagaact

SEQ ID NO: 1365577 - DNA, 22 bp, Artificial Sequence
  chemically synthesized
ttcatagtactggaagttctag

SEQ ID NO: 1365578 - DNA, 22 bp, Artificial Sequence
  chemically synthesized
ttacactagctagaacttccag

SEQ ID NO: 1365579 - DNA, 22 bp, Artificial Sequence
  chemically synthesized
ttattcatagtactggaagttc

SEQ ID NO: 1365580 - DNA, 22 bp, Artificial Sequence
  chemically synthesized
tacactagctagaacttccagt

SEQ ID NO: 1365581 - DNA, 22 bp, Artificial Sequence
  chemically synthesized
acactagctagaacttccagta

SEQ ID NO: 1365582 - DNA, 22 bp, Artificial Sequence
  chemically synthesized
cactagctagaacttccagtac

SEQ ID NO: 1365583 - DNA, 22 bp, Artificial Sequence
  chemically synthesized
ctattattcatagtactggaag

SEQ ID NO: 1365584 - DNA, 22 bp, Artificial Sequence
  chemically synthesized
gctagaacttccagtactatga

SEQ ID NO: 1365585 - DNA, 22 bp, Artificial Sequence
  chemically synthesized
agccctactattattcatagta

SEQ ID NO: 1365586 - DNA, 22 bp, Artificial Sequence
  chemically synthesized
cagccctactattattcatagt

SEQ ID NO: 1365587 - DNA, 22 bp, Artificial Sequence
  chemically synthesized
gaacttccagtactatgaataa

SEQ ID NO: 1365588 - DNA, 22 bp, Artificial Sequence
  chemically synthesized
tcagccctactattattcatag

SEQ ID NO: 1365589 - DNA, 22 bp, Artificial Sequence
  chemically synthesized
ctttcagccctactattattca

SEQ ID NO: 1365590 - DNA, 22 bp, Artificial Sequence
  chemically synthesized
ccagtactatgaataatagtag

SEQ ID NO: 1365591 - DNA, 22 bp, Artificial Sequence
  chemically synthesized
cagtactatgaataatagtagg

SEQ ID NO: 1365592 - DNA, 22 bp, Artificial Sequence
  chemically synthesized
tgaataatagtagggctgaaag

SEQ ID NO: 1365593 - DNA, 22 bp, Artificial Sequence
  chemically synthesized
aggcaaagacggttgctttcag

SEQ ID NO: 1365594 - DNA, 22 bp, Artificial Sequence
  chemically synthesized
ggattaaggcaaagacggttgc

SEQ ID NO: 1365595 - DNA, 22 bp, Artificial Sequence
  chemically synthesized
atattaggattaaggcaaagac

SEQ ID NO: 1365596 - DNA, 22 bp, Artificial Sequence
  chemically synthesized
aaagcaaccgtctttgccttaa

SEQ ID NO: 1365597 - DNA, 22 bp, Artificial Sequence
  chemically synthesized
ctaatattaggattaaggcaaa

SEQ ID NO: 1365598 - DNA, 22 bp, Artificial Sequence
  chemically synthesized
cctaatattaggattaaggcaa

SEQ ID NO: 1365599 - DNA, 22 bp, Artificial Sequence
  chemically synthesized
ttcctaatattaggattaaggc

SEQ ID NO: 1365600 - DNA, 22 bp, Artificial Sequence
  chemically synthesized
cttcctaatattaggattaagg

SEQ ID NO: 1365601 - DNA, 22 bp, Artificial Sequence
  chemically synthesized
tcttcctaatattaggattaag

SEQ ID NO: 1365602 - DNA, 22 bp, Artificial Sequence
  chemically synthesized
cacctttcttcctaatattagg

SEQ ID NO: 1365603 - DNA, 22 bp, Artificial Sequence
  chemically synthesized
acacctttcttcctaatattag

SEQ ID NO: 1365604 - DNA, 22 bp, Artificial Sequence
  chemically synthesized
tgccttaatcctaatattagga

SEQ ID NO: 1365605 - DNA, 22 bp, Artificial Sequence
  chemically synthesized
gccttaatcctaatattaggaa

SEQ ID NO: 1365606 - DNA, 22 bp, Artificial Sequence
  chemically synthesized
ccttaatcctaatattaggaag

SEQ ID NO: 1365607 - DNA, 22 bp, Artificial Sequence
  chemically synthesized
aatcctaatattaggaagaaag

SEQ ID NO: 1365608 - DNA, 22 bp, Artificial Sequence
  chemically synthesized
atcctaatattaggaagaaagg

SEQ ID NO: 1365609 - DNA, 22 bp, Artificial Sequence
  chemically synthesized
atattaggaagaaaggtgtaaa

SEQ ID NO: 1365610 - DNA, 22 bp, Artificial Sequence
  chemically synthesized
taataataatgaaagaatttac

SEQ ID NO: 1365611 - DNA, 22 bp, Artificial Sequence
  chemically synthesized
ggaagaaaggtgtaaattcttt

SEQ ID NO: 1365612 - DNA, 22 bp, Artificial Sequence
  chemically synthesized
acattgtaataataatgaaaga

SEQ ID NO: 1365613 - DNA, 22 bp, Artificial Sequence
  chemically synthesized
tagctaacattgtaataataat

SEQ ID NO: 1365614 - DNA, 22 bp, Artificial Sequence
  chemically synthesized
atagctaacattgtaataataa

SEQ ID NO: 1365615 - DNA, 22 bp, Artificial Sequence
  chemically synthesized
tttcattattattacaatgtta

SEQ ID NO: 1365616 - DNA, 22 bp, Artificial Sequence
  chemically synthesized
tcattattattacaatgttagc

SEQ ID NO: 1365617 - DNA, 22 bp, Artificial Sequence
  chemically synthesized
cattattattacaatgttagct

SEQ ID NO: 1365618 - DNA, 22 bp, Artificial Sequence
  chemically synthesized
cagaaatcttatagctaacatt

SEQ ID NO: 1365619 - DNA, 22 bp, Artificial Sequence
  chemically synthesized
attattattacaatgttagcta

SEQ ID NO: 1365620 - DNA, 22 bp, Artificial Sequence
  chemically synthesized
ttattacaatgttagctataag

SEQ ID NO: 1365621 - DNA, 22 bp, Artificial Sequence
  chemically synthesized
ttacaatgttagctataagatt

SEQ ID NO: 1365622 - DNA, 22 bp, Artificial Sequence
  chemically synthesized
caatgttagctataagatttct

SEQ ID NO: 1365623 - DNA, 22 bp, Artificial Sequence
  chemically synthesized
gaaaagaataactacagaaatc

SEQ ID NO: 1365624 - DNA, 22 bp, Artificial Sequence
  chemically synthesized
ggaaaagaataactacagaaat

SEQ ID NO: 1365625 - DNA, 22 bp, Artificial Sequence
  chemically synthesized
gctataagatttctgtagttat

SEQ ID NO: 1365626 - DNA, 22 bp, Artificial Sequence
  chemically synthesized
aacttggaaaagaataactaca

SEQ ID NO: 1365627 - DNA, 22 bp, Artificial Sequence
  chemically synthesized
taagatttctgtagttattctt

SEQ ID NO: 1365628 - DNA, 22 bp, Artificial Sequence
  chemically synthesized
ctgtagttattcttttccaagt

SEQ ID NO: 1365629 - DNA, 22 bp, Artificial Sequence
  chemically synthesized
tgtagttattcttttccaagtt

SEQ ID NO: 1365630 - DNA, 22 bp, Artificial Sequence
  chemically synthesized
tagttattcttttccaagttga

SEQ ID NO: 1365631 - DNA, 22 bp, Artificial Sequence
  chemically synthesized
ttcttttccaagttgaggacgt

SEQ ID NO: 1365632 - DNA, 22 bp, Artificial Sequence
  chemically synthesized
acaatggaggagaacgtcctca

SEQ ID NO: 1365633 - DNA, 22 bp, Artificial Sequence
  chemically synthesized
ttttccaagttgaggacgttct

SEQ ID NO: 1365634 - DNA, 22 bp, Artificial Sequence
  chemically synthesized
ttccaagttgaggacgttctcc

SEQ ID NO: 1365635 - DNA, 22 bp, Artificial Sequence
  chemically synthesized
tccaagttgaggacgttctcct

SEQ ID NO: 1365636 - DNA, 22 bp, Artificial Sequence
  chemically synthesized
ccaagttgaggacgttctcctc

SEQ ID NO: 1365637 - DNA, 22 bp, Artificial Sequence
  chemically synthesized
caagttgaggacgttctcctcc

SEQ ID NO: 1365638 - DNA, 22 bp, Artificial Sequence
  chemically synthesized
agaaaactaacaatggaggaga

SEQ ID NO: 1365639 - DNA, 22 bp, Artificial Sequence
  chemically synthesized
tcagaaaactaacaatggagga

SEQ ID NO: 1365640 - DNA, 22 bp, Artificial Sequence
  chemically synthesized
aggacgttctcctccattgtta

SEQ ID NO: 1365641 - DNA, 22 bp, Artificial Sequence
  chemically synthesized
tcctccattgttagttttctga

SEQ ID NO: 1365642 - DNA, 22 bp, Artificial Sequence
  chemically synthesized
tgataaaagctctcagaaaact

SEQ ID NO: 1365643 - DNA, 22 bp, Artificial Sequence
  chemically synthesized
atgataaaagctctcagaaaac

SEQ ID NO: 1365644 - DNA, 22 bp, Artificial Sequence
  chemically synthesized
ctccattgttagttttctgaga

SEQ ID NO: 1365645 - DNA, 22 bp, Artificial Sequence
  chemically synthesized
cattgttagttttctgagagct

SEQ ID NO: 1365646 - DNA, 22 bp, Artificial Sequence
  chemically synthesized
ttagttttctgagagcttttat

SEQ ID NO: 1365647 - DNA, 22 bp, Artificial Sequence
  chemically synthesized
gttttctgagagcttttatcat

SEQ ID NO: 1365648 - DNA, 22 bp, Artificial Sequence
  chemically synthesized
agtgccccatttatgataaaag

SEQ ID NO: 1365649 - DNA, 22 bp, Artificial Sequence
  chemically synthesized
tctgagagcttttatcataaat

SEQ ID NO: 1365650 - DNA, 22 bp, Artificial Sequence
  chemically synthesized
ctgagagcttttatcataaatg

SEQ ID NO: 1365651 - DNA, 22 bp, Artificial Sequence
  chemically synthesized
tgagagcttttatcataaatgg

SEQ ID NO: 1365652 - DNA, 22 bp, Artificial Sequence
  chemically synthesized
agagcttttatcataaatgggg

SEQ ID NO: 1365653 - DNA, 22 bp, Artificial Sequence
  chemically synthesized
acaaaattcagtgccccattta

SEQ ID NO: 1365654 - DNA, 22 bp, Artificial Sequence
  chemically synthesized
gacaaaattcagtgccccattt

SEQ ID NO: 1365655 - DNA, 22 bp, Artificial Sequence
  chemically synthesized
ttatcataaatggggcactgaa

SEQ ID NO: 1365656 - DNA, 22 bp, Artificial Sequence
  chemically synthesized
tatcataaatggggcactgaat

SEQ ID NO: 1365657 - DNA, 22 bp, Artificial Sequence
  chemically synthesized
atcataaatggggcactgaatt

SEQ ID NO: 1365658 - DNA, 22 bp, Artificial Sequence
  chemically synthesized
tcataaatggggcactgaattt

SEQ ID NO: 1365659 - DNA, 22 bp, Artificial Sequence
  chemically synthesized
atggaggggaaaaaacgtttga

SEQ ID NO: 1365660 - DNA, 22 bp, Artificial Sequence
  chemically synthesized
aattttgtcaaacgttttttcc

SEQ ID NO: 1365661 - DNA, 22 bp, Artificial Sequence
  chemically synthesized
tgtcaaacgttttttcccctcc

SEQ ID NO: 1365662 - DNA, 22 bp, Artificial Sequence
  chemically synthesized
gtcaaacgttttttcccctcca

SEQ ID NO: 1365663 - DNA, 22 bp, Artificial Sequence
  chemically synthesized
tcaaacgttttttcccctccat

SEQ ID NO: 1365664 - DNA, 22 bp, Artificial Sequence
  chemically synthesized
atcatatcaattgatggagggg

SEQ ID NO: 1365665 - DNA, 22 bp, Artificial Sequence
  chemically synthesized
gatcatatcaattgatggaggg

SEQ ID NO: 1365666 - DNA, 22 bp, Artificial Sequence
  chemically synthesized
tttcccctccatcaattgatat

SEQ ID NO: 1365667 - DNA, 22 bp, Artificial Sequence
  chemically synthesized
ttcccctccatcaattgatatg

SEQ ID NO: 1365668 - DNA, 22 bp, Artificial Sequence
  chemically synthesized
tcccctccatcaattgatatga

SEQ ID NO: 1365669 - DNA, 22 bp, Artificial Sequence
  chemically synthesized
cccctccatcaattgatatgat

SEQ ID NO: 1365670 - DNA, 22 bp, Artificial Sequence
  chemically synthesized
ccctccatcaattgatatgatc

SEQ ID NO: 1365671 - DNA, 22 bp, Artificial Sequence
  chemically synthesized
catcaattgatatgatcaagtg

SEQ ID NO: 1365672 - DNA, 22 bp, Artificial Sequence
  chemically synthesized
aagaagaataatcacttgatca

SEQ ID NO: 1365673 - DNA, 22 bp, Artificial Sequence
  chemically synthesized
agaagctaaagaagaataatca

SEQ ID NO: 1365674 - DNA, 22 bp, Artificial Sequence
  chemically synthesized
atatgatcaagtgattattctt

SEQ ID NO: 1365675 - DNA, 22 bp, Artificial Sequence
  chemically synthesized
tattaagaagctaaagaagaat

SEQ ID NO: 1365676 - DNA, 22 bp, Artificial Sequence
  chemically synthesized
cacattatattaagaagctaaa

SEQ ID NO: 1365677 - DNA, 22 bp, Artificial Sequence
  chemically synthesized
acacattatattaagaagctaa

SEQ ID NO: 1365678 - DNA, 22 bp, Artificial Sequence
  chemically synthesized
tacacattatattaagaagcta

SEQ ID NO: 1365679 - DNA, 22 bp, Artificial Sequence
  chemically synthesized
ttacacattatattaagaagct

SEQ ID NO: 1365680 - DNA, 22 bp, Artificial Sequence
  chemically synthesized
ttcttctttagcttcttaatat

SEQ ID NO: 1365681 - DNA, 22 bp, Artificial Sequence
  chemically synthesized
ttctttagcttcttaatataat

SEQ ID NO: 1365682 - DNA, 22 bp, Artificial Sequence
  chemically synthesized
ctttagcttcttaatataatgt

SEQ ID NO: 1365683 - DNA, 22 bp, Artificial Sequence
  chemically synthesized
acaaatttttacacattatatt

SEQ ID NO: 1365684 - DNA, 22 bp, Artificial Sequence
  chemically synthesized
tttagcttcttaatataatgtg

SEQ ID NO: 1365685 - DNA, 22 bp, Artificial Sequence
  chemically synthesized
aacaaatttttacacattatat

SEQ ID NO: 1365686 - DNA, 22 bp, Artificial Sequence
  chemically synthesized
tagcttcttaatataatgtgta

SEQ ID NO: 1365687 - DNA, 22 bp, Artificial Sequence
  chemically synthesized
agcttcttaatataatgtgtaa

SEQ ID NO: 1365688 - DNA, 22 bp, Artificial Sequence
  chemically synthesized
gcttcttaatataatgtgtaaa

SEQ ID NO: 1365689 - DNA, 22 bp, Artificial Sequence
  chemically synthesized
cttaatataatgtgtaaaaatt

SEQ ID NO: 1365690 - DNA, 22 bp, Artificial Sequence
  chemically synthesized
ttaatataatgtgtaaaaattt

SEQ ID NO: 1365691 - DNA, 22 bp, Artificial Sequence
  chemically synthesized
aatataatgtgtaaaaatttgt

SEQ ID NO: 1365692 - DNA, 22 bp, Artificial Sequence
  chemically synthesized
atataatgtgtaaaaatttgtt

SEQ ID NO: 1365693 - DNA, 22 bp, Artificial Sequence
  chemically synthesized
atggatatagagacaaaaagcc

SEQ ID NO: 1365694 - DNA, 22 bp, Artificial Sequence
  chemically synthesized
gttaaggctttttgtctctata

SEQ ID NO: 1365695 - DNA, 22 bp, Artificial Sequence
  chemically synthesized
ttaaggctttttgtctctatat

SEQ ID NO: 1365696 - DNA, 22 bp, Artificial Sequence
  chemically synthesized
aggctttttgtctctatatcca

SEQ ID NO: 1365697 - DNA, 22 bp, Artificial Sequence
  chemically synthesized
cagaccaataaaactcatggat

SEQ ID NO: 1365698 - DNA, 22 bp, Artificial Sequence
  chemically synthesized
tttgtctctatatccatgagtt

SEQ ID NO: 1365699 - DNA, 22 bp, Artificial Sequence
  chemically synthesized
ttgtctctatatccatgagttt

SEQ ID NO: 1365700 - DNA, 22 bp, Artificial Sequence
  chemically synthesized
tgtctctatatccatgagtttt

SEQ ID NO: 1365701 - DNA, 22 bp, Artificial Sequence
  chemically synthesized
gtctctatatccatgagtttta

SEQ ID NO: 1365702 - DNA, 22 bp, Artificial Sequence
  chemically synthesized
tctctatatccatgagttttat

SEQ ID NO: 1365703 - DNA, 22 bp, Artificial Sequence
  chemically synthesized
tatatccatgagttttattggt

SEQ ID NO: 1365704 - DNA, 22 bp, Artificial Sequence
  chemically synthesized
tatccatgagttttattggtct

SEQ ID NO: 1365705 - DNA, 22 bp, Artificial Sequence
  chemically synthesized
tattggtctgtaatttgttgac

SEQ ID NO: 1365706 - DNA, 22 bp, Artificial Sequence
  chemically synthesized
attggtctgtaatttgttgact

SEQ ID NO: 1365707 - DNA, 22 bp, Artificial Sequence
  chemically synthesized
ttggtctgtaatttgttgactc

SEQ ID NO: 1365708 - DNA, 22 bp, Artificial Sequence
  chemically synthesized
gtctgtaatttgttgactcttc

SEQ ID NO: 1365709 - DNA, 22 bp, Artificial Sequence
  chemically synthesized
taatttgttgactcttctactg

SEQ ID NO: 1365710 - DNA, 22 bp, Artificial Sequence
  chemically synthesized
gttgactcttctactgtgctta

SEQ ID NO: 1365711 - DNA, 22 bp, Artificial Sequence
  chemically synthesized
ttgactcttctactgtgcttac

SEQ ID NO: 1365712 - DNA, 22 bp, Artificial Sequence
  chemically synthesized
ataataaaaccaggtaagcaca

SEQ ID NO: 1365713 - DNA, 22 bp, Artificial Sequence
  chemically synthesized
gataataaaaccaggtaagcac

SEQ ID NO: 1365714 - DNA, 22 bp, Artificial Sequence
  chemically synthesized
actcttctactgtgcttacctg

SEQ ID NO: 1365715 - DNA, 22 bp, Artificial Sequence
  chemically synthesized
tgataataaaaccaggtaagca

SEQ ID NO: 1365716 - DNA, 22 bp, Artificial Sequence
  chemically synthesized
ttctactgtgcttacctggttt

SEQ ID NO: 1365717 - DNA, 22 bp, Artificial Sequence
  chemically synthesized
ctactgtgcttacctggtttta

SEQ ID NO: 1365718 - DNA, 22 bp, Artificial Sequence
  chemically synthesized
tactgtgcttacctggttttat

SEQ ID NO: 1365719 - DNA, 22 bp, Artificial Sequence
  chemically synthesized
ctgtgcttacctggttttatta

SEQ ID NO: 1365720 - DNA, 22 bp, Artificial Sequence
  chemically synthesized
tgcttacctggttttattatca

SEQ ID NO: 1365721 - DNA, 22 bp, Artificial Sequence
  chemically synthesized
tgaggaagaagtattttgataa

SEQ ID NO: 1365722 - DNA, 22 bp, Artificial Sequence
  chemically synthesized
acctggttttattatcaaaata

SEQ ID NO: 1365723 - DNA, 22 bp, Artificial Sequence
  chemically synthesized
atgaggaagaagtattttgata

SEQ ID NO: 1365724 - DNA, 22 bp, Artificial Sequence
  chemically synthesized
cctggttttattatcaaaatac

SEQ ID NO: 1365725 - DNA, 22 bp, Artificial Sequence
  chemically synthesized
tatgaggaagaagtattttgat

SEQ ID NO: 1365726 - DNA, 22 bp, Artificial Sequence
  chemically synthesized
gttttattatcaaaatacttct

SEQ ID NO: 1365727 - DNA, 22 bp, Artificial Sequence
  chemically synthesized
tattatcaaaatacttcttcct

SEQ ID NO: 1365728 - DNA, 22 bp, Artificial Sequence
  chemically synthesized
attatcaaaatacttcttcctc

SEQ ID NO: 1365729 - DNA, 22 bp, Artificial Sequence
  chemically synthesized
ttatcaaaatacttcttcctca

SEQ ID NO: 1365730 - DNA, 22 bp, Artificial Sequence
  chemically synthesized
caaatgtactttatgaggaaga

SEQ ID NO: 1365731 - DNA, 22 bp, Artificial Sequence
  chemically synthesized
ccaaatgtactttatgaggaag

SEQ ID NO: 1365732 - DNA, 22 bp, Artificial Sequence
  chemically synthesized
tcaaaatacttcttcctcataa

SEQ ID NO: 1365733 - DNA, 22 bp, Artificial Sequence
  chemically synthesized
cttcctcataaagtacatttgg

SEQ ID NO: 1365734 - DNA, 22 bp, Artificial Sequence
  chemically synthesized
ttcctcataaagtacatttgga

SEQ ID NO: 1365735 - DNA, 22 bp, Artificial Sequence
  chemically synthesized
cctcataaagtacatttggaag

SEQ ID NO: 1365736 - DNA, 22 bp, Artificial Sequence
  chemically synthesized
ctcataaagtacatttggaagt

SEQ ID NO: 1365737 - DNA, 22 bp, Artificial Sequence
  chemically synthesized
ataaagtacatttggaagtgtt

SEQ ID NO: 1365738 - DNA, 22 bp, Artificial Sequence
  chemically synthesized
cagaaaatagaagaggaggcaa

SEQ ID NO: 1365739 - DNA, 22 bp, Artificial Sequence
  chemically synthesized
ccagaaaatagaagaggaggca

SEQ ID NO: 1365740 - DNA, 22 bp, Artificial Sequence
  chemically synthesized
ggaagtgttgcctcctcttcta

SEQ ID NO: 1365741 - DNA, 22 bp, Artificial Sequence
  chemically synthesized
gaagtgttgcctcctcttctat

SEQ ID NO: 1365742 - DNA, 22 bp, Artificial Sequence
  chemically synthesized
tcaacttccagaaaatagaaga

SEQ ID NO: 1365743 - DNA, 22 bp, Artificial Sequence
  chemically synthesized
cctcctcttctattttctggaa

SEQ ID NO: 1365744 - DNA, 22 bp, Artificial Sequence
  chemically synthesized
ctcttctattttctggaagttg

SEQ ID NO: 1365745 - DNA, 22 bp, Artificial Sequence
  chemically synthesized
ttctattttctggaagttgaca

SEQ ID NO: 1365746 - DNA, 22 bp, Artificial Sequence
  chemically synthesized
ctattttctggaagttgacagt

SEQ ID NO: 1365747 - DNA, 22 bp, Artificial Sequence
  chemically synthesized
tattttctggaagttgacagtt

SEQ ID NO: 1365748 - DNA, 22 bp, Artificial Sequence
  chemically synthesized
ttttctggaagttgacagttct

SEQ ID NO: 1365749 - DNA, 22 bp, Artificial Sequence
  chemically synthesized
tctggaagttgacagttctctc

SEQ ID NO: 1365750 - DNA, 22 bp, Artificial Sequence
  chemically synthesized
aagtgatgaaaggagagaactg

SEQ ID NO: 1365751 - DNA, 22 bp, Artificial Sequence
  chemically synthesized
ctggaagttgacagttctctcc

SEQ ID NO: 1365752 - DNA, 22 bp, Artificial Sequence
  chemically synthesized
caagtgatgaaaggagagaact

SEQ ID NO: 1365753 - DNA, 22 bp, Artificial Sequence
  chemically synthesized
tggaagttgacagttctctcct

SEQ ID NO: 1365754 - DNA, 22 bp, Artificial Sequence
  chemically synthesized
tcaagtgatgaaaggagagaac

SEQ ID NO: 1365755 - DNA, 22 bp, Artificial Sequence
  chemically synthesized
ttcaagtgatgaaaggagagaa

SEQ ID NO: 1365756 - DNA, 22 bp, Artificial Sequence
  chemically synthesized
gaagttgacagttctctccttt

SEQ ID NO: 1365757 - DNA, 22 bp, Artificial Sequence
  chemically synthesized
acagttctctcctttcatcact

SEQ ID NO: 1365758 - DNA, 22 bp, Artificial Sequence
  chemically synthesized
tctcctttcatcacttgaaaaa

SEQ ID NO: 1365759 - DNA, 22 bp, Artificial Sequence
  chemically synthesized
tcctttcatcacttgaaaaatg

SEQ ID NO: 1365760 - DNA, 22 bp, Artificial Sequence
  chemically synthesized
ctttcatcacttgaaaaatgtc

SEQ ID NO: 1365761 - DNA, 22 bp, Artificial Sequence
  chemically synthesized
tcatcacttgaaaaatgtcata

SEQ ID NO: 1365762 - DNA, 22 bp, Artificial Sequence
  chemically synthesized
catcacttgaaaaatgtcatac

SEQ ID NO: 1365763 - DNA, 22 bp, Artificial Sequence
  chemically synthesized
atcacttgaaaaatgtcatact

SEQ ID NO: 1365764 - DNA, 22 bp, Artificial Sequence
  chemically synthesized
gaaaaatgtcatacttcttcct

SEQ ID NO: 1365765 - DNA, 22 bp, Artificial Sequence
  chemically synthesized
aaaaatgtcatacttcttcctt

SEQ ID NO: 1365766 - DNA, 22 bp, Artificial Sequence
  chemically synthesized
tgtgaaaccatgaaagcccgaa

SEQ ID NO: 1365767 - DNA, 22 bp, Artificial Sequence
  chemically synthesized
atgtgaaaccatgaaagcccga

SEQ ID NO: 1365768 - DNA, 22 bp, Artificial Sequence
  chemically synthesized
ttatgtgaaaccatgaaagccc

SEQ ID NO: 1365769 - DNA, 22 bp, Artificial Sequence
  chemically synthesized
cttatgtgaaaccatgaaagcc

SEQ ID NO: 1365770 - DNA, 22 bp, Artificial Sequence
  chemically synthesized
cttccttcgggctttcatggtt

SEQ ID NO: 1365771 - DNA, 22 bp, Artificial Sequence
  chemically synthesized
ttccttcgggctttcatggttt

SEQ ID NO: 1365772 - DNA, 22 bp, Artificial Sequence
  chemically synthesized
ccttcgggctttcatggtttca

SEQ ID NO: 1365773 - DNA, 22 bp, Artificial Sequence
  chemically synthesized
cttcgggctttcatggtttcac

SEQ ID NO: 1365774 - DNA, 22 bp, Artificial Sequence
  chemically synthesized
cgggctttcatggtttcacata

SEQ ID NO: 1365775 - DNA, 22 bp, Artificial Sequence
  chemically synthesized
gggctttcatggtttcacataa

SEQ ID NO: 1365776 - DNA, 22 bp, Artificial Sequence
  chemically synthesized
aaatggcagaggatttcttatg

SEQ ID NO: 1365777 - DNA, 22 bp, Artificial Sequence
  chemically synthesized
tcatggtttcacataagaaatc

SEQ ID NO: 1365778 - DNA, 22 bp, Artificial Sequence
  chemically synthesized
catggtttcacataagaaatcc

SEQ ID NO: 1365779 - DNA, 22 bp, Artificial Sequence
  chemically synthesized
atggtttcacataagaaatcct

SEQ ID NO: 1365780 - DNA, 22 bp, Artificial Sequence
  chemically synthesized
cacataagaaatcctctgccat

SEQ ID NO: 1365781 - DNA, 22 bp, Artificial Sequence
  chemically synthesized
acataagaaatcctctgccatt

SEQ ID NO: 1365782 - DNA, 22 bp, Artificial Sequence
  chemically synthesized
taggcaaaaaagttcaaatggc

SEQ ID NO: 1365783 - DNA, 22 bp, Artificial Sequence
  chemically synthesized
tctataggcaaaaaagttcaaa

SEQ ID NO: 1365784 - DNA, 22 bp, Artificial Sequence
  chemically synthesized
atctataggcaaaaaagttcaa

SEQ ID NO: 1365785 - DNA, 22 bp, Artificial Sequence
  chemically synthesized
tatctataggcaaaaaagttca

SEQ ID NO: 1365786 - DNA, 22 bp, Artificial Sequence
  chemically synthesized
tgccatttgaacttttttgcct

SEQ ID NO: 1365787 - DNA, 22 bp, Artificial Sequence
  chemically synthesized
ccatttgaacttttttgcctat

SEQ ID NO: 1365788 - DNA, 22 bp, Artificial Sequence
  chemically synthesized
gaacttttttgcctatagataa

SEQ ID NO: 1365789 - DNA, 22 bp, Artificial Sequence
  chemically synthesized
aacttttttgcctatagataaa

SEQ ID NO: 1365790 - DNA, 22 bp, Artificial Sequence
  chemically synthesized
ttttgcctatagataaagtgtc

SEQ ID NO: 1365791 - DNA, 22 bp, Artificial Sequence
  chemically synthesized
tttgcctatagataaagtgtct

SEQ ID NO: 1365792 - DNA, 22 bp, Artificial Sequence
  chemically synthesized
ttgcctatagataaagtgtctt

SEQ ID NO: 1365793 - DNA, 22 bp, Artificial Sequence
  chemically synthesized
tgcctatagataaagtgtcttt

SEQ ID NO: 1365794 - DNA, 22 bp, Artificial Sequence
  chemically synthesized
gcctatagataaagtgtctttt

SEQ ID NO: 1365795 - DNA, 22 bp, Artificial Sequence
  chemically synthesized
cctatagataaagtgtcttttt

SEQ ID NO: 1365796 - DNA, 22 bp, Artificial Sequence
  chemically synthesized
aaaacagtgaaagagaaaaaga

SEQ ID NO: 1365797 - DNA, 22 bp, Artificial Sequence
  chemically synthesized
tagataaagtgtctttttctct

SEQ ID NO: 1365798 - DNA, 22 bp, Artificial Sequence
  chemically synthesized
aaaaacagtgaaagagaaaaag

SEQ ID NO: 1365799 - DNA, 22 bp, Artificial Sequence
  chemically synthesized
aaaaaagtcttaaaaacagtga

SEQ ID NO: 1365800 - DNA, 22 bp, Artificial Sequence
  chemically synthesized
aaaaaaagtcttaaaaacagtg

SEQ ID NO: 1365801 - DNA, 22 bp, Artificial Sequence
  chemically synthesized
taaaaaaagtcttaaaaacagt

SEQ ID NO: 1365802 - DNA, 22 bp, Artificial Sequence
  chemically synthesized
ttaaaaaaagtcttaaaaacag

SEQ ID NO: 1365803 - DNA, 22 bp, Artificial Sequence
  chemically synthesized
tttctctttcactgtttttaag

SEQ ID NO: 1365804 - DNA, 22 bp, Artificial Sequence
  chemically synthesized
tttaaaaaaagtcttaaaaaca

SEQ ID NO: 1365805 - DNA, 22 bp, Artificial Sequence
  chemically synthesized
ttctctttcactgtttttaaga

SEQ ID NO: 1365806 - DNA, 22 bp, Artificial Sequence
  chemically synthesized
ttttaaaaaaagtcttaaaaac

SEQ ID NO: 1365807 - DNA, 22 bp, Artificial Sequence
  chemically synthesized
tctctttcactgtttttaagac

SEQ ID NO: 1365808 - DNA, 22 bp, Artificial Sequence
  chemically synthesized
tttttaaaaaaagtcttaaaaa

SEQ ID NO: 1365809 - DNA, 22 bp, Artificial Sequence
  chemically synthesized
ctctttcactgtttttaagact

SEQ ID NO: 1365810 - DNA, 22 bp, Artificial Sequence
  chemically synthesized
ttttttaaaaaaagtcttaaaa

SEQ ID NO: 1365811 - DNA, 22 bp, Artificial Sequence
  chemically synthesized
tctttcactgtttttaagactt

SEQ ID NO: 1365812 - DNA, 22 bp, Artificial Sequence
  chemically synthesized
tttttttaaaaaaagtcttaaa

SEQ ID NO: 1365813 - DNA, 22 bp, Artificial Sequence
  chemically synthesized
tttcactgtttttaagactttt

SEQ ID NO: 1365814 - DNA, 22 bp, Artificial Sequence
  chemically synthesized
tcactgtttttaagactttttt

SEQ ID NO: 1365815 - DNA, 22 bp, Artificial Sequence
  chemically synthesized
cactgtttttaagacttttttt

SEQ ID NO: 1365816 - DNA, 22 bp, Artificial Sequence
  chemically synthesized
tattttttttttaaaaaaagtc

SEQ ID NO: 1365817 - DNA, 22 bp, Artificial Sequence
  chemically synthesized
actgtttttaagacttttttta

SEQ ID NO: 1365818 - DNA, 22 bp, Artificial Sequence
  chemically synthesized
gttatattttttttttaaaaaa

SEQ ID NO: 1365819 - DNA, 22 bp, Artificial Sequence
  chemically synthesized
tttttaagactttttttaaaaa

SEQ ID NO: 1365820 - DNA, 22 bp, Artificial Sequence
  chemically synthesized
ttaagactttttttaaaaaaaa

SEQ ID NO: 1365821 - DNA, 22 bp, Artificial Sequence
  chemically synthesized
taagactttttttaaaaaaaaa

SEQ ID NO: 1365822 - DNA, 22 bp, Artificial Sequence
  chemically synthesized
aagactttttttaaaaaaaaaa

SEQ ID NO: 1365823 - DNA, 22 bp, Artificial Sequence
  chemically synthesized
agactttttttaaaaaaaaaat

SEQ ID NO: 1365824 - DNA, 22 bp, Artificial Sequence
  chemically synthesized
aaaactagttatattttttttt

SEQ ID NO: 1365825 - DNA, 22 bp, Artificial Sequence
  chemically synthesized
tttttaaaaaaaaaatataact

SEQ ID NO: 1365826 - DNA, 22 bp, Artificial Sequence
  chemically synthesized
ttttaaaaaaaaaatataacta

SEQ ID NO: 1365827 - DNA, 22 bp, Artificial Sequence
  chemically synthesized
tttaaaaaaaaaatataactag

SEQ ID NO: 1365828 - DNA, 22 bp, Artificial Sequence
  chemically synthesized
ttaaaaaaaaaatataactagt

SEQ ID NO: 1365829 - DNA, 22 bp, Artificial Sequence
  chemically synthesized
taaaaaaaaaatataactagtt

SEQ ID NO: 1365830 - DNA, 22 bp, Artificial Sequence
  chemically synthesized
aaaaaaaaaatataactagttt

SEQ ID NO: 1365831 - DNA, 22 bp, Artificial Sequence
  chemically synthesized
aaaaaaaaatataactagtttt

SEQ ID NO: 1365832 - DNA, 22 bp, Artificial Sequence
  chemically synthesized
gacgcatcatagtcaaatgtct

SEQ ID NO: 1365833 - DNA, 22 bp, Artificial Sequence
  chemically synthesized
agacgcatcatagtcaaatgtc

SEQ ID NO: 1365834 - DNA, 22 bp, Artificial Sequence
  chemically synthesized
gttttcagacatttgactatga

SEQ ID NO: 1365835 - DNA, 22 bp, Artificial Sequence
  chemically synthesized
atgcttagacgcatcatagtca

SEQ ID NO: 1365836 - DNA, 22 bp, Artificial Sequence
  chemically synthesized
tcagacatttgactatgatgcg

SEQ ID NO: 1365837 - DNA, 22 bp, Artificial Sequence
  chemically synthesized
cagacatttgactatgatgcgt

SEQ ID NO: 1365838 - DNA, 22 bp, Artificial Sequence
  chemically synthesized
agacatttgactatgatgcgtc

SEQ ID NO: 1365839 - DNA, 22 bp, Artificial Sequence
  chemically synthesized
gactatgatgcgtctaagcatg

SEQ ID NO: 1365840 - DNA, 22 bp, Artificial Sequence
  chemically synthesized
actatgatgcgtctaagcatga

SEQ ID NO: 1365841 - DNA, 22 bp, Artificial Sequence
  chemically synthesized
tgatgcgtctaagcatgagttt

SEQ ID NO: 1365842 - DNA, 22 bp, Artificial Sequence
  chemically synthesized
agtatacaggataaacccaaag

SEQ ID NO: 1365843 - DNA, 22 bp, Artificial Sequence
  chemically synthesized
agcatgagtttctttgggttta

SEQ ID NO: 1365844 - DNA, 22 bp, Artificial Sequence
  chemically synthesized
aaggagctgagtatacaggata

SEQ ID NO: 1365845 - DNA, 22 bp, Artificial Sequence
  chemically synthesized
ctttgggtttatcctgtatact

SEQ ID NO: 1365846 - DNA, 22 bp, Artificial Sequence
  chemically synthesized
tttgggtttatcctgtatactc

SEQ ID NO: 1365847 - DNA, 22 bp, Artificial Sequence
  chemically synthesized
tgggtttatcctgtatactcag

SEQ ID NO: 1365848 - DNA, 22 bp, Artificial Sequence
  chemically synthesized
gggtttatcctgtatactcagc

SEQ ID NO: 1365849 - DNA, 22 bp, Artificial Sequence
  chemically synthesized
cagattcaaggagctgagtata

SEQ ID NO: 1365850 - DNA, 22 bp, Artificial Sequence
  chemically synthesized
ggtttatcctgtatactcagct

SEQ ID NO: 1365851 - DNA, 22 bp, Artificial Sequence
  chemically synthesized
atcctgtatactcagctccttg

SEQ ID NO: 1365852 - DNA, 22 bp, Artificial Sequence
  chemically synthesized
tcctgtatactcagctccttga

SEQ ID NO: 1365853 - DNA, 22 bp, Artificial Sequence
  chemically synthesized
tatactcagctccttgaatctg

SEQ ID NO: 1365854 - DNA, 22 bp, Artificial Sequence
  chemically synthesized
taaaatgcaaaaccctacagat

SEQ ID NO: 1365855 - DNA, 22 bp, Artificial Sequence
  chemically synthesized
gtaaaatgcaaaaccctacaga

SEQ ID NO: 1365856 - DNA, 22 bp, Artificial Sequence
  chemically synthesized
agctccttgaatctgtagggtt

SEQ ID NO: 1365857 - DNA, 22 bp, Artificial Sequence
  chemically synthesized
tgtaaaatgcaaaaccctacag

SEQ ID NO: 1365858 - DNA, 22 bp, Artificial Sequence
  chemically synthesized
cttgaatctgtagggttttgca

SEQ ID NO: 1365859 - DNA, 22 bp, Artificial Sequence
  chemically synthesized
gaatctgtagggttttgcattt

SEQ ID NO: 1365860 - DNA, 22 bp, Artificial Sequence
  chemically synthesized
aatctgtagggttttgcatttt

SEQ ID NO: 1365861 - DNA, 22 bp, Artificial Sequence
  chemically synthesized
tagggttttgcattttacaaaa

SEQ ID NO: 1365862 - DNA, 22 bp, Artificial Sequence
  chemically synthesized
aaaaataccaaattttgtaaaa

SEQ ID NO: 1365863 - DNA, 22 bp, Artificial Sequence
  chemically synthesized
tgcattttacaaaatttggtat

SEQ ID NO: 1365864 - DNA, 22 bp, Artificial Sequence
  chemically synthesized
gcattttacaaaatttggtatt

SEQ ID NO: 1365865 - DNA, 22 bp, Artificial Sequence
  chemically synthesized
cattttacaaaatttggtattt

SEQ ID NO: 1365866 - DNA, 22 bp, Artificial Sequence
  chemically synthesized
tacaaaatttggtatttttcaa

SEQ ID NO: 1365867 - DNA, 22 bp, Artificial Sequence
  chemically synthesized
acaaaatttggtatttttcaat

SEQ ID NO: 1365868 - DNA, 22 bp, Artificial Sequence
  chemically synthesized
aagcacataatgattgaaaaat

SEQ ID NO: 1365869 - DNA, 22 bp, Artificial Sequence
  chemically synthesized
caaaatttggtatttttcaatc

SEQ ID NO: 1365870 - DNA, 22 bp, Artificial Sequence
  chemically synthesized
ggtatttttcaatcattatgtg

SEQ ID NO: 1365871 - DNA, 22 bp, Artificial Sequence
  chemically synthesized
gtatttttcaatcattatgtgc

SEQ ID NO: 1365872 - DNA, 22 bp, Artificial Sequence
  chemically synthesized
aacaagtactcaagcacataat

SEQ ID NO: 1365873 - DNA, 22 bp, Artificial Sequence
  chemically synthesized
ttgaacaagtactcaagcacat

SEQ ID NO: 1365874 - DNA, 22 bp, Artificial Sequence
  chemically synthesized
ttcaatcattatgtgcttgagt

SEQ ID NO: 1365875 - DNA, 22 bp, Artificial Sequence
  chemically synthesized
tcaatcattatgtgcttgagta

SEQ ID NO: 1365876 - DNA, 22 bp, Artificial Sequence
  chemically synthesized
caatcattatgtgcttgagtac

SEQ ID NO: 1365877 - DNA, 22 bp, Artificial Sequence
  chemically synthesized
aatcattatgtgcttgagtact

SEQ ID NO: 1365878 - DNA, 22 bp, Artificial Sequence
  chemically synthesized
tgtgcttgagtacttgttcaac

SEQ ID NO: 1365879 - DNA, 22 bp, Artificial Sequence
  chemically synthesized
aaaaagggagggtgttgttgaa

SEQ ID NO: 1365880 - DNA, 22 bp, Artificial Sequence
  chemically synthesized
caaaaagggagggtgttgttga

SEQ ID NO: 1365881 - DNA, 22 bp, Artificial Sequence
  chemically synthesized
gagtacttgttcaacaacaccc

SEQ ID NO: 1365882 - DNA, 22 bp, Artificial Sequence
  chemically synthesized
agtacttgttcaacaacaccct

SEQ ID NO: 1365883 - DNA, 22 bp, Artificial Sequence
  chemically synthesized
gttcaacaacaccctccctttt

SEQ ID NO: 1365884 - DNA, 22 bp, Artificial Sequence
  chemically synthesized
ttcaacaacaccctcccttttt

SEQ ID NO: 1365885 - DNA, 22 bp, Artificial Sequence
  chemically synthesized
aacaacaccctccctttttgaa

SEQ ID NO: 1365886 - DNA, 22 bp, Artificial Sequence
  chemically synthesized
tgccatcagagtttcaaaaagg

SEQ ID NO: 1365887 - DNA, 22 bp, Artificial Sequence
  chemically synthesized
atgccatcagagtttcaaaaag

SEQ ID NO: 1365888 - DNA, 22 bp, Artificial Sequence
  chemically synthesized
cggtttatgccatcagagtttc

SEQ ID NO: 1365889 - DNA, 22 bp, Artificial Sequence
  chemically synthesized
cctttttgaaactctgatggca

SEQ ID NO: 1365890 - DNA, 22 bp, Artificial Sequence
  chemically synthesized
tttgaaactctgatggcataaa

SEQ ID NO: 1365891 - DNA, 22 bp, Artificial Sequence
  chemically synthesized
ttgaaactctgatggcataaac

SEQ ID NO: 1365892 - DNA, 22 bp, Artificial Sequence
  chemically synthesized
tgaaactctgatggcataaacc

SEQ ID NO: 1365893 - DNA, 22 bp, Artificial Sequence
  chemically synthesized
gaaactctgatggcataaaccg

SEQ ID NO: 1365894 - DNA, 22 bp, Artificial Sequence
  chemically synthesized
aaactctgatggcataaaccgt

SEQ ID NO: 1365895 - DNA, 22 bp, Artificial Sequence
  chemically synthesized
taataaaagatctacggtttat

SEQ ID NO: 1365896 - DNA, 22 bp, Artificial Sequence
  chemically synthesized
tgatggcataaaccgtagatct

SEQ ID NO: 1365897 - DNA, 22 bp, Artificial Sequence
  chemically synthesized
atggcataaaccgtagatcttt

SEQ ID NO: 1365898 - DNA, 22 bp, Artificial Sequence
  chemically synthesized
tgggattataataaaagatcta

SEQ ID NO: 1365899 - DNA, 22 bp, Artificial Sequence
  chemically synthesized
tcctatgggattataataaaag

SEQ ID NO: 1365900 - DNA, 22 bp, Artificial Sequence
  chemically synthesized
agttgtcctatgggattataat

SEQ ID NO: 1365901 - DNA, 22 bp, Artificial Sequence
  chemically synthesized
tcagttgtcctatgggattata

SEQ ID NO: 1365902 - DNA, 22 bp, Artificial Sequence
  chemically synthesized
ttattataatcccataggacaa

SEQ ID NO: 1365903 - DNA, 22 bp, Artificial Sequence
  chemically synthesized
tattataatcccataggacaac

SEQ ID NO: 1365904 - DNA, 22 bp, Artificial Sequence
  chemically synthesized
attataatcccataggacaact

SEQ ID NO: 1365905 - DNA, 22 bp, Artificial Sequence
  chemically synthesized
ttataatcccataggacaactg

SEQ ID NO: 1365906 - DNA, 22 bp, Artificial Sequence
  chemically synthesized
taatcccataggacaactgaga

SEQ ID NO: 1365907 - DNA, 22 bp, Artificial Sequence
  chemically synthesized
aaatgaaaatattctcagttgt

SEQ ID NO: 1365908 - DNA, 22 bp, Artificial Sequence
  chemically synthesized
aaaatgaaaatattctcagttg

SEQ ID NO: 1365909 - DNA, 22 bp, Artificial Sequence
  chemically synthesized
taaaatgaaaatattctcagtt

SEQ ID NO: 1365910 - DNA, 22 bp, Artificial Sequence
  chemically synthesized
ttaaaatgaaaatattctcagt

SEQ ID NO: 1365911 - DNA, 22 bp, Artificial Sequence
  chemically synthesized
agaatattttcattttaaaaat

SEQ ID NO: 1365912 - DNA, 22 bp, Artificial Sequence
  chemically synthesized
tcattttaaaaatcgttttttt

SEQ ID NO: 1365913 - DNA, 22 bp, Artificial Sequence
  chemically synthesized
cattttaaaaatcgtttttttc

SEQ ID NO: 1365914 - DNA, 22 bp, Artificial Sequence
  chemically synthesized
attttaaaaatcgtttttttcc

SEQ ID NO: 1365915 - DNA, 22 bp, Artificial Sequence
  chemically synthesized
taaaaatcgtttttttccttct

SEQ ID NO: 1365916 - DNA, 22 bp, Artificial Sequence
  chemically synthesized
aaaaatcgtttttttccttctt

SEQ ID NO: 1365917 - DNA, 22 bp, Artificial Sequence
  chemically synthesized
cacagtcgtaacaagaaggaaa

SEQ ID NO: 1365918 - DNA, 22 bp, Artificial Sequence
  chemically synthesized
aaaatcgtttttttccttcttg

SEQ ID NO: 1365919 - DNA, 22 bp, Artificial Sequence
  chemically synthesized
ttttccttcttgttacgactgt

SEQ ID NO: 1365920 - DNA, 22 bp, Artificial Sequence
  chemically synthesized
tttccttcttgttacgactgtg

SEQ ID NO: 1365921 - DNA, 22 bp, Artificial Sequence
  chemically synthesized
ttccttcttgttacgactgtgt

SEQ ID NO: 1365922 - DNA, 22 bp, Artificial Sequence
  chemically synthesized
tccttcttgttacgactgtgta

SEQ ID NO: 1365923 - DNA, 22 bp, Artificial Sequence
  chemically synthesized
ccttcttgttacgactgtgtaa

SEQ ID NO: 1365924 - DNA, 22 bp, Artificial Sequence
  chemically synthesized
cttcttgttacgactgtgtaat

SEQ ID NO: 1365925 - DNA, 22 bp, Artificial Sequence
  chemically synthesized
cttgttacgactgtgtaatttc

SEQ ID NO: 1365926 - DNA, 22 bp, Artificial Sequence
  chemically synthesized
ttgttacgactgtgtaatttct

SEQ ID NO: 1365927 - DNA, 22 bp, Artificial Sequence
  chemically synthesized
gttacgactgtgtaatttctat

SEQ ID NO: 1365928 - DNA, 22 bp, Artificial Sequence
  chemically synthesized
ttacgactgtgtaatttctatt

SEQ ID NO: 1365929 - DNA, 22 bp, Artificial Sequence
  chemically synthesized
cgactgtgtaatttctattgtc

SEQ ID NO: 1365930 - DNA, 22 bp, Artificial Sequence
  chemically synthesized
tgtgcagaaagataggacaata

SEQ ID NO: 1365931 - DNA, 22 bp, Artificial Sequence
  chemically synthesized
tgtaatttctattgtcctatct

SEQ ID NO: 1365932 - DNA, 22 bp, Artificial Sequence
  chemically synthesized
ctattgtcctatctttctgcac

SEQ ID NO: 1365933 - DNA, 22 bp, Artificial Sequence
  chemically synthesized
tattgtcctatctttctgcaca

SEQ ID NO: 1365934 - DNA, 22 bp, Artificial Sequence
  chemically synthesized
ttgtcctatctttctgcacaca

SEQ ID NO: 1365935 - DNA, 22 bp, Artificial Sequence
  chemically synthesized
tcctatctttctgcacacagat

SEQ ID NO: 1365936 - DNA, 22 bp, Artificial Sequence
  chemically synthesized
tctttctgcacacagatttccc

SEQ ID NO: 1365937 - DNA, 22 bp, Artificial Sequence
  chemically synthesized
tctgcacacagatttcccctgt

SEQ ID NO: 1365938 - DNA, 22 bp, Artificial Sequence
  chemically synthesized
ctgcacacagatttcccctgtc

SEQ ID NO: 1365939 - DNA, 22 bp, Artificial Sequence
  chemically synthesized
tgcacacagatttcccctgtct

SEQ ID NO: 1365940 - DNA, 22 bp, Artificial Sequence
  chemically synthesized
cacacagatttcccctgtctcc

SEQ ID NO: 1365941 - DNA, 22 bp, Artificial Sequence
  chemically synthesized
aacagtagaatggaggtgagga

SEQ ID NO: 1365942 - DNA, 22 bp, Artificial Sequence
  chemically synthesized
cccctgtctcctcacctccatt

SEQ ID NO: 1365943 - DNA, 22 bp, Artificial Sequence
  chemically synthesized
ccctgtctcctcacctccattc

SEQ ID NO: 1365944 - DNA, 22 bp, Artificial Sequence
  chemically synthesized
tctcctcacctccattctactg

SEQ ID NO: 1365945 - DNA, 22 bp, Artificial Sequence
  chemically synthesized
aataaatggtctcaacagtaga

SEQ ID NO: 1365946 - DNA, 22 bp, Artificial Sequence
  chemically synthesized
ctcacctccattctactgttga

SEQ ID NO: 1365947 - DNA, 22 bp, Artificial Sequence
  chemically synthesized
acctccattctactgttgagac

SEQ ID NO: 1365948 - DNA, 22 bp, Artificial Sequence
  chemically synthesized
cattctactgttgagaccattt

SEQ ID NO: 1365949 - DNA, 22 bp, Artificial Sequence
  chemically synthesized
tactgttgagaccatttattga

SEQ ID NO: 1365950 - DNA, 22 bp, Artificial Sequence
  chemically synthesized
ctgttgagaccatttattgaac

SEQ ID NO: 1365951 - DNA, 22 bp, Artificial Sequence
  chemically synthesized
ttgagaccatttattgaacttt

SEQ ID NO: 1365952 - DNA, 22 bp, Artificial Sequence
  chemically synthesized
agaccatttattgaactttttt

SEQ ID NO: 1365953 - DNA, 22 bp, Artificial Sequence
  chemically synthesized
aaaatatcgtaatcaaaaaaaa

SEQ ID NO: 1365954 - DNA, 22 bp, Artificial Sequence
  chemically synthesized
attgaacttttttttgattacg

SEQ ID NO: 1365955 - DNA, 22 bp, Artificial Sequence
  chemically synthesized
ttgaacttttttttgattacga

SEQ ID NO: 1365956 - DNA, 22 bp, Artificial Sequence
  chemically synthesized
gaactaaaaatatcgtaatcaa

SEQ ID NO: 1365957 - DNA, 22 bp, Artificial Sequence
  chemically synthesized
agaactaaaaatatcgtaatca

SEQ ID NO: 1365958 - DNA, 22 bp, Artificial Sequence
  chemically synthesized
tagaactaaaaatatcgtaatc

SEQ ID NO: 1365959 - DNA, 22 bp, Artificial Sequence
  chemically synthesized
aacttttttttgattacgatat

SEQ ID NO: 1365960 - DNA, 22 bp, Artificial Sequence
  chemically synthesized
ttttttgattacgatattttta

SEQ ID NO: 1365961 - DNA, 22 bp, Artificial Sequence
  chemically synthesized
tttttgattacgatatttttag

SEQ ID NO: 1365962 - DNA, 22 bp, Artificial Sequence
  chemically synthesized
ttttgattacgatatttttagt

SEQ ID NO: 1365963 - DNA, 22 bp, Artificial Sequence
  chemically synthesized
tttgattacgatatttttagtt

SEQ ID NO: 1365964 - DNA, 22 bp, Artificial Sequence
  chemically synthesized
ttgattacgatatttttagttc

SEQ ID NO: 1365965 - DNA, 22 bp, Artificial Sequence
  chemically synthesized
tgattacgatatttttagttct

SEQ ID NO: 1365966 - DNA, 22 bp, Artificial Sequence
  chemically synthesized
gattacgatatttttagttcta

SEQ ID NO: 1365967 - DNA, 22 bp, Artificial Sequence
  chemically synthesized
attacgatatttttagttctaa

SEQ ID NO: 1365968 - DNA, 22 bp, Artificial Sequence
  chemically synthesized
cgatatttttagttctaaaatg

SEQ ID NO: 1365969 - DNA, 22 bp, Artificial Sequence
  chemically synthesized
ttagttctaaaatgtcatgtcg

SEQ ID NO: 1365970 - DNA, 22 bp, Artificial Sequence
  chemically synthesized
tagttctaaaatgtcatgtcgt

SEQ ID NO: 1365971 - DNA, 22 bp, Artificial Sequence
  chemically synthesized
agttctaaaatgtcatgtcgtt

SEQ ID NO: 1365972 - DNA, 22 bp, Artificial Sequence
  chemically synthesized
gttctaaaatgtcatgtcgttc

SEQ ID NO: 1365973 - DNA, 22 bp, Artificial Sequence
  chemically synthesized
taaaatgtcatgtcgttctatg

SEQ ID NO: 1365974 - DNA, 22 bp, Artificial Sequence
  chemically synthesized
aaatgtcatgtcgttctatgtc

SEQ ID NO: 1365975 - DNA, 22 bp, Artificial Sequence
  chemically synthesized
tatgtcttctatttctttctga

SEQ ID NO: 1365976 - DNA, 22 bp, Artificial Sequence
  chemically synthesized
tgtcttctatttctttctgact

SEQ ID NO: 1365977 - DNA, 22 bp, Artificial Sequence
  chemically synthesized
ctatttctttctgacttttccc

SEQ ID NO: 1365978 - DNA, 22 bp, Artificial Sequence
  chemically synthesized
tatttctttctgacttttccca

SEQ ID NO: 1365979 - DNA, 22 bp, Artificial Sequence
  chemically synthesized
tttctttctgacttttcccatt

SEQ ID NO: 1365980 - DNA, 22 bp, Artificial Sequence
  chemically synthesized
caacaaataaaaaatgggaaaa

SEQ ID NO: 1365981 - DNA, 22 bp, Artificial Sequence
  chemically synthesized
gcaacaaataaaaaatgggaaa

SEQ ID NO: 1365982 - DNA, 22 bp, Artificial Sequence
  chemically synthesized
tgcaacaaataaaaaatgggaa

SEQ ID NO: 1365983 - DNA, 22 bp, Artificial Sequence
  chemically synthesized
ctttctgacttttcccattttt

SEQ ID NO: 1365984 - DNA, 22 bp, Artificial Sequence
  chemically synthesized
tttctgacttttcccatttttt

SEQ ID NO: 1365985 - DNA, 22 bp, Artificial Sequence
  chemically synthesized
tctgacttttcccattttttat

SEQ ID NO: 1365986 - DNA, 22 bp, Artificial Sequence
  chemically synthesized
ctgacttttcccattttttatt

SEQ ID NO: 1365987 - DNA, 22 bp, Artificial Sequence
  chemically synthesized
tgacttttcccattttttattt

SEQ ID NO: 1365988 - DNA, 22 bp, Artificial Sequence
  chemically synthesized
acttttcccattttttatttgt

SEQ ID NO: 1365989 - DNA, 22 bp, Artificial Sequence
  chemically synthesized
aaacattttgcaacaaataaaa

SEQ ID NO: 1365990 - DNA, 22 bp, Artificial Sequence
  chemically synthesized
aaaacattttgcaacaaataaa

SEQ ID NO: 1365991 - DNA, 22 bp, Artificial Sequence
  chemically synthesized
taaaacattttgcaacaaataa

SEQ ID NO: 1365992 - DNA, 22 bp, Artificial Sequence
  chemically synthesized
ttaaaacattttgcaacaaata

SEQ ID NO: 1365993 - DNA, 22 bp, Artificial Sequence
  chemically synthesized
ttcccattttttatttgttgca

SEQ ID NO: 1365994 - DNA, 22 bp, Artificial Sequence
  chemically synthesized
tttaaaacattttgcaacaaat

SEQ ID NO: 1365995 - DNA, 22 bp, Artificial Sequence
  chemically synthesized
tcccattttttatttgttgcaa

SEQ ID NO: 1365996 - DNA, 22 bp, Artificial Sequence
  chemically synthesized
cccattttttatttgttgcaaa

SEQ ID NO: 1365997 - DNA, 22 bp, Artificial Sequence
  chemically synthesized
ccattttttatttgttgcaaaa

SEQ ID NO: 1365998 - DNA, 22 bp, Artificial Sequence
  chemically synthesized
tttatttgttgcaaaatgtttt

SEQ ID NO: 1365999 - DNA, 22 bp, Artificial Sequence
  chemically synthesized
agtaagctttttaaaacatttt

SEQ ID NO: 1366000 - DNA, 22 bp, Artificial Sequence
  chemically synthesized
ttatttgttgcaaaatgtttta

SEQ ID NO: 1366001 - DNA, 22 bp, Artificial Sequence
  chemically synthesized
tatttgttgcaaaatgttttaa

SEQ ID NO: 1366002 - DNA, 22 bp, Artificial Sequence
  chemically synthesized
atttgttgcaaaatgttttaaa

SEQ ID NO: 1366003 - DNA, 22 bp, Artificial Sequence
  chemically synthesized
ttgagtaagctttttaaaacat

SEQ ID NO: 1366004 - DNA, 22 bp, Artificial Sequence
  chemically synthesized
tttgttgcaaaatgttttaaaa

SEQ ID NO: 1366005 - DNA, 22 bp, Artificial Sequence
  chemically synthesized
gttgcaaaatgttttaaaaagc

SEQ ID NO: 1366006 - DNA, 22 bp, Artificial Sequence
  chemically synthesized
ttgcaaaatgttttaaaaagct

SEQ ID NO: 1366007 - DNA, 22 bp, Artificial Sequence
  chemically synthesized
caaaatgttttaaaaagcttac

SEQ ID NO: 1366008 - DNA, 22 bp, Artificial Sequence
  chemically synthesized
taaaaagcttactcaacaattt

SEQ ID NO: 1366009 - DNA, 22 bp, Artificial Sequence
  chemically synthesized
aaaaagcttactcaacaatttt

SEQ ID NO: 1366010 - DNA, 22 bp, Artificial Sequence
  chemically synthesized
aaaagcttactcaacaattttc

SEQ ID NO: 1366011 - DNA, 22 bp, Artificial Sequence
  chemically synthesized
aagtagccatcccgaaaattgt

SEQ ID NO: 1366012 - DNA, 22 bp, Artificial Sequence
  chemically synthesized
actcaacaattttcgggatggc

SEQ ID NO: 1366013 - DNA, 22 bp, Artificial Sequence
  chemically synthesized
ctcaacaattttcgggatggct

SEQ ID NO: 1366014 - DNA, 22 bp, Artificial Sequence
  chemically synthesized
aacaattttcgggatggctact

SEQ ID NO: 1366015 - DNA, 22 bp, Artificial Sequence
  chemically synthesized
gcaaggatattaaagtagccat

SEQ ID NO: 1366016 - DNA, 22 bp, Artificial Sequence
  chemically synthesized
tctagcaaggatattaaagtag

SEQ ID NO: 1366017 - DNA, 22 bp, Artificial Sequence
  chemically synthesized
tcgggatggctactttaatatc

SEQ ID NO: 1366018 - DNA, 22 bp, Artificial Sequence
  chemically synthesized
cgggatggctactttaatatcc

SEQ ID NO: 1366019 - DNA, 22 bp, Artificial Sequence
  chemically synthesized
gggatggctactttaatatcct

SEQ ID NO: 1366020 - DNA, 22 bp, Artificial Sequence
  chemically synthesized
ctttaatatccttgctagataa

SEQ ID NO: 1366021 - DNA, 22 bp, Artificial Sequence
  chemically synthesized
taatatccttgctagataattc

SEQ ID NO: 1366022 - DNA, 22 bp, Artificial Sequence
  chemically synthesized
aatatccttgctagataattct

SEQ ID NO: 1366023 - DNA, 22 bp, Artificial Sequence
  chemically synthesized
atatccttgctagataattctg

SEQ ID NO: 1366024 - DNA, 22 bp, Artificial Sequence
  chemically synthesized
acatgacaaagatgacagaatt

SEQ ID NO: 1366025 - DNA, 22 bp, Artificial Sequence
  chemically synthesized
gctagataattctgtcatcttt

SEQ ID NO: 1366026 - DNA, 22 bp, Artificial Sequence
  chemically synthesized
tactgacatgacaaagatgaca

SEQ ID NO: 1366027 - DNA, 22 bp, Artificial Sequence
  chemically synthesized
ctagataattctgtcatctttg

SEQ ID NO: 1366028 - DNA, 22 bp, Artificial Sequence
  chemically synthesized
atactgacatgacaaagatgac

SEQ ID NO: 1366029 - DNA, 22 bp, Artificial Sequence
  chemically synthesized
gataattctgtcatctttgtca

SEQ ID NO: 1366030 - DNA, 22 bp, Artificial Sequence
  chemically synthesized
tgtcatctttgtcatgtcagta

SEQ ID NO: 1366031 - DNA, 22 bp, Artificial Sequence
  chemically synthesized
tcatctttgtcatgtcagtata

SEQ ID NO: 1366032 - DNA, 22 bp, Artificial Sequence
  chemically synthesized
tgtcatgtcagtataagtgact

SEQ ID NO: 1366033 - DNA, 22 bp, Artificial Sequence
  chemically synthesized
gtcatgtcagtataagtgacta

SEQ ID NO: 1366034 - DNA, 22 bp, Artificial Sequence
  chemically synthesized
tcatgtcagtataagtgactac

SEQ ID NO: 1366035 - DNA, 22 bp, Artificial Sequence
  chemically synthesized
gaatgcaaaaagatagtagtca

SEQ ID NO: 1366036 - DNA, 22 bp, Artificial Sequence
  chemically synthesized
aactggaatgcaaaaagatagt

SEQ ID NO: 1366037 - DNA, 22 bp, Artificial Sequence
  chemically synthesized
ctatctttttgcattccagttg

SEQ ID NO: 1366038 - DNA, 22 bp, Artificial Sequence
  chemically synthesized
tctttttgcattccagttgaga

SEQ ID NO: 1366039 - DNA, 22 bp, Artificial Sequence
  chemically synthesized
tttgcattccagttgagatttt

SEQ ID NO: 1366040 - DNA, 22 bp, Artificial Sequence
  chemically synthesized
ttgcattccagttgagattttc

SEQ ID NO: 1366041 - DNA, 22 bp, Artificial Sequence
  chemically synthesized
tgcattccagttgagattttct

SEQ ID NO: 1366042 - DNA, 22 bp, Artificial Sequence
  chemically synthesized
gcattccagttgagattttctt

SEQ ID NO: 1366043 - DNA, 22 bp, Artificial Sequence
  chemically synthesized
cattccagttgagattttcttt

SEQ ID NO: 1366044 - DNA, 22 bp, Artificial Sequence
  chemically synthesized
cagttgagattttcttttttgg

SEQ ID NO: 1366045 - DNA, 22 bp, Artificial Sequence
  chemically synthesized
agattttcttttttggcatttg

SEQ ID NO: 1366046 - DNA, 22 bp, Artificial Sequence
  chemically synthesized
ataatgtaatatcccaaatgcc

SEQ ID NO: 1366047 - DNA, 22 bp, Artificial Sequence
  chemically synthesized
tcttttttggcatttgggatat

SEQ ID NO: 1366048 - DNA, 22 bp, Artificial Sequence
  chemically synthesized
cttttttggcatttgggatatt

SEQ ID NO: 1366049 - DNA, 22 bp, Artificial Sequence
  chemically synthesized
ttttttggcatttgggatatta

SEQ ID NO: 1366050 - DNA, 22 bp, Artificial Sequence
  chemically synthesized
ttttggcatttgggatattaca

SEQ ID NO: 1366051 - DNA, 22 bp, Artificial Sequence
  chemically synthesized
tttggcatttgggatattacat

SEQ ID NO: 1366052 - DNA, 22 bp, Artificial Sequence
  chemically synthesized
ttggcatttgggatattacatt

SEQ ID NO: 1366053 - DNA, 22 bp, Artificial Sequence
  chemically synthesized
tggcatttgggatattacatta

SEQ ID NO: 1366054 - DNA, 22 bp, Artificial Sequence
  chemically synthesized
ggcatttgggatattacattat

SEQ ID NO: 1366055 - DNA, 22 bp, Artificial Sequence
  chemically synthesized
gcatttgggatattacattatc

SEQ ID NO: 1366056 - DNA, 22 bp, Artificial Sequence
  chemically synthesized
aataagatccagagtctgataa

SEQ ID NO: 1366057 - DNA, 22 bp, Artificial Sequence
  chemically synthesized
gggatattacattatcagactc

SEQ ID NO: 1366058 - DNA, 22 bp, Artificial Sequence
  chemically synthesized
aaataagatccagagtctgata

SEQ ID NO: 1366059 - DNA, 22 bp, Artificial Sequence
  chemically synthesized
ggatattacattatcagactct

SEQ ID NO: 1366060 - DNA, 22 bp, Artificial Sequence
  chemically synthesized
cattatcagactctggatctta

SEQ ID NO: 1366061 - DNA, 22 bp, Artificial Sequence
  chemically synthesized
aaatagatttaaataagatcca

SEQ ID NO: 1366062 - DNA, 22 bp, Artificial Sequence
  chemically synthesized
tcagactctggatcttatttaa

SEQ ID NO: 1366063 - DNA, 22 bp, Artificial Sequence
  chemically synthesized
tggatcttatttaaatctattt

SEQ ID NO: 1366064 - DNA, 22 bp, Artificial Sequence
  chemically synthesized
gatcttatttaaatctatttta

SEQ ID NO: 1366065 - DNA, 22 bp, Artificial Sequence
  chemically synthesized
atttaaatctattttagctcgt

SEQ ID NO: 1366066 - DNA, 22 bp, Artificial Sequence
  chemically synthesized
tttaaatctattttagctcgtc

SEQ ID NO: 1366067 - DNA, 22 bp, Artificial Sequence
  chemically synthesized
aaatctattttagctcgtcccc

SEQ ID NO: 1366068 - DNA, 22 bp, Artificial Sequence
  chemically synthesized
aatctattttagctcgtcccct

SEQ ID NO: 1366069 - DNA, 22 bp, Artificial Sequence
  chemically synthesized
caccagaacagtcagaagggga

SEQ ID NO: 1366070 - DNA, 22 bp, Artificial Sequence
  chemically synthesized
ccaccagaacagtcagaagggg

SEQ ID NO: 1366071 - DNA, 22 bp, Artificial Sequence
  chemically synthesized
ttttagctcgtccccttctgac

SEQ ID NO: 1366072 - DNA, 22 bp, Artificial Sequence
  chemically synthesized
tagctcgtccccttctgactgt

SEQ ID NO: 1366073 - DNA, 22 bp, Artificial Sequence
  chemically synthesized
tcttccaccagaacagtcagaa

SEQ ID NO: 1366074 - DNA, 22 bp, Artificial Sequence
  chemically synthesized
agctcgtccccttctgactgtt

SEQ ID NO: 1366075 - DNA, 22 bp, Artificial Sequence
  chemically synthesized
gctcgtccccttctgactgttc

SEQ ID NO: 1366076 - DNA, 22 bp, Artificial Sequence
  chemically synthesized
tatcttccaccagaacagtcag

SEQ ID NO: 1366077 - DNA, 22 bp, Artificial Sequence
  chemically synthesized
gtccccttctgactgttctggt

SEQ ID NO: 1366078 - DNA, 22 bp, Artificial Sequence
  chemically synthesized
cctctatcttccaccagaacag

SEQ ID NO: 1366079 - DNA, 22 bp, Artificial Sequence
  chemically synthesized
tacctctatcttccaccagaac

SEQ ID NO: 1366080 - DNA, 22 bp, Artificial Sequence
  chemically synthesized
ctacctctatcttccaccagaa

SEQ ID NO: 1366081 - DNA, 22 bp, Artificial Sequence
  chemically synthesized
ctgactgttctggtggaagata

SEQ ID NO: 1366082 - DNA, 22 bp, Artificial Sequence
  chemically synthesized
tgactgttctggtggaagatag

SEQ ID NO: 1366083 - DNA, 22 bp, Artificial Sequence
  chemically synthesized
actgttctggtggaagatagag

SEQ ID NO: 1366084 - DNA, 22 bp, Artificial Sequence
  chemically synthesized
ttctggtggaagatagaggtag

SEQ ID NO: 1366085 - DNA, 22 bp, Artificial Sequence
  chemically synthesized
tggtggaagatagaggtagaag

SEQ ID NO: 1366086 - DNA, 22 bp, Artificial Sequence
  chemically synthesized
gtggaagatagaggtagaagtg

SEQ ID NO: 1366087 - DNA, 22 bp, Artificial Sequence
  chemically synthesized
gcaataaggcagcacacttcta

SEQ ID NO: 1366088 - DNA, 22 bp, Artificial Sequence
  chemically synthesized
ccacctggcaataaggcagcac

SEQ ID NO: 1366089 - DNA, 22 bp, Artificial Sequence
  chemically synthesized
actcccacctggcaataaggca

SEQ ID NO: 1366090 - DNA, 22 bp, Artificial Sequence
  chemically synthesized
cactcccacctggcaataaggc

SEQ ID NO: 1366091 - DNA, 22 bp, Artificial Sequence
  chemically synthesized
ccttattgccaggtgggagtga

SEQ ID NO: 1366092 - DNA, 22 bp, Artificial Sequence
  chemically synthesized
attgccaggtgggagtgaaggt

SEQ ID NO: 1366093 - DNA, 22 bp, Artificial Sequence
  chemically synthesized
ttgccaggtgggagtgaaggtc

SEQ ID NO: 1366094 - DNA, 22 bp, Artificial Sequence
  chemically synthesized
ccaggtgggagtgaaggtcctg

SEQ ID NO: 1366095 - DNA, 22 bp, Artificial Sequence
  chemically synthesized
aagtatcaaccatagatggagt

SEQ ID NO: 1366096 - DNA, 22 bp, Artificial Sequence
  chemically synthesized
taaagtatcaaccatagatgga

SEQ ID NO: 1366097 - DNA, 22 bp, Artificial Sequence
  chemically synthesized
gttccccactccatctatggtt

SEQ ID NO: 1366098 - DNA, 22 bp, Artificial Sequence
  chemically synthesized
cccactccatctatggttgata

SEQ ID NO: 1366099 - DNA, 22 bp, Artificial Sequence
  chemically synthesized
catctatggttgatactttaga

SEQ ID NO: 1366100 - DNA, 22 bp, Artificial Sequence
  chemically synthesized
tggttgatactttagagattat

SEQ ID NO: 1366101 - DNA, 22 bp, Artificial Sequence
  chemically synthesized
atactttagagattattgtgtg

SEQ ID NO: 1366102 - DNA, 22 bp, Artificial Sequence
  chemically synthesized
tagagattattgtgtgtgtgtg

SEQ ID NO: 1366103 - DNA, 22 bp, Artificial Sequence
  chemically synthesized
agagattattgtgtgtgtgtgt

SEQ ID NO: 1366104 - DNA, 22 bp, Artificial Sequence
  chemically synthesized
gagattattgtgtgtgtgtgtg

SEQ ID NO: 1366105 - DNA, 22 bp, Artificial Sequence
  chemically synthesized
ttgtgtgtgtgtgtgtgtgtgt

SEQ ID NO: 1366106 - DNA, 22 bp, Artificial Sequence
  chemically synthesized
tgtgtgtgtgtgtgtgtgtgtg

SEQ ID NO: 1366107 - DNA, 22 bp, Artificial Sequence
  chemically synthesized
cagaacacacacacacacacac

SEQ ID NO: 1366108 - DNA, 22 bp, Artificial Sequence
  chemically synthesized
acagaacacacacacacacaca

SEQ ID NO: 1366109 - DNA, 22 bp, Artificial Sequence
  chemically synthesized
tttacagaacacacacacacac

SEQ ID NO: 1366110 - DNA, 22 bp, Artificial Sequence
  chemically synthesized
atttacagaacacacacacaca

SEQ ID NO: 1366111 - DNA, 22 bp, Artificial Sequence
  chemically synthesized
agatggtgtcaagtaaaattta

SEQ ID NO: 1366112 - DNA, 22 bp, Artificial Sequence
  chemically synthesized
tgtaaataaattttacttgaca

SEQ ID NO: 1366113 - DNA, 22 bp, Artificial Sequence
  chemically synthesized
taaataaattttacttgacacc

SEQ ID NO: 1366114 - DNA, 22 bp, Artificial Sequence
  chemically synthesized
aagggaattaagatggtgtcaa

SEQ ID NO: 1366115 - DNA, 22 bp, Artificial Sequence
  chemically synthesized
aaagggaattaagatggtgtca

SEQ ID NO: 1366116 - DNA, 22 bp, Artificial Sequence
  chemically synthesized
taaagggaattaagatggtgtc

SEQ ID NO: 1366117 - DNA, 22 bp, Artificial Sequence
  chemically synthesized
attttaaagggaattaagatgg

SEQ ID NO: 1366118 - DNA, 22 bp, Artificial Sequence
  chemically synthesized
tacttgacaccatcttaattcc

SEQ ID NO: 1366119 - DNA, 22 bp, Artificial Sequence
  chemically synthesized
ctaattttaaagggaattaaga

SEQ ID NO: 1366120 - DNA, 22 bp, Artificial Sequence
  chemically synthesized
acttgacaccatcttaattccc

SEQ ID NO: 1366121 - DNA, 22 bp, Artificial Sequence
  chemically synthesized
actaattttaaagggaattaag

SEQ ID NO: 1366122 - DNA, 22 bp, Artificial Sequence
  chemically synthesized
cttgacaccatcttaattccct

SEQ ID NO: 1366123 - DNA, 22 bp, Artificial Sequence
  chemically synthesized
cttactaattttaaagggaatt

SEQ ID NO: 1366124 - DNA, 22 bp, Artificial Sequence
  chemically synthesized
gacaccatcttaattcccttta

SEQ ID NO: 1366125 - DNA, 22 bp, Artificial Sequence
  chemically synthesized
acaccatcttaattccctttaa

SEQ ID NO: 1366126 - DNA, 22 bp, Artificial Sequence
  chemically synthesized
cagatatctacttactaatttt

SEQ ID NO: 1366127 - DNA, 22 bp, Artificial Sequence
  chemically synthesized
aattccctttaaaattagtaag

SEQ ID NO: 1366128 - DNA, 22 bp, Artificial Sequence
  chemically synthesized
attccctttaaaattagtaagt

SEQ ID NO: 1366129 - DNA, 22 bp, Artificial Sequence
  chemically synthesized
cctttaaaattagtaagtagat

SEQ ID NO: 1366130 - DNA, 22 bp, Artificial Sequence
  chemically synthesized
acaaggttccagatatctactt

SEQ ID NO: 1366131 - DNA, 22 bp, Artificial Sequence
  chemically synthesized
taaaattagtaagtagatatct

SEQ ID NO: 1366132 - DNA, 22 bp, Artificial Sequence
  chemically synthesized
aaaattagtaagtagatatctg

SEQ ID NO: 1366133 - DNA, 22 bp, Artificial Sequence
  chemically synthesized
aaattagtaagtagatatctgg

SEQ ID NO: 1366134 - DNA, 22 bp, Artificial Sequence
  chemically synthesized
gtaagtagatatctggaacctt

SEQ ID NO: 1366135 - DNA, 22 bp, Artificial Sequence
  chemically synthesized
aaaatgaactcacaaggttcca

SEQ ID NO: 1366136 - DNA, 22 bp, Artificial Sequence
  chemically synthesized
aaaaatgaactcacaaggttcc

SEQ ID NO: 1366137 - DNA, 22 bp, Artificial Sequence
  chemically synthesized
aacatttaaaaatgaactcaca

SEQ ID NO: 1366138 - DNA, 22 bp, Artificial Sequence
  chemically synthesized
gaaccttgtgagttcattttta

SEQ ID NO: 1366139 - DNA, 22 bp, Artificial Sequence
  chemically synthesized
gtgagttcatttttaaatgttc

SEQ ID NO: 1366140 - DNA, 22 bp, Artificial Sequence
  chemically synthesized
tgagttcatttttaaatgttca

SEQ ID NO: 1366141 - DNA, 22 bp, Artificial Sequence
  chemically synthesized
atttttaaatgttcagattttt

SEQ ID NO: 1366142 - DNA, 22 bp, Artificial Sequence
  chemically synthesized
tccagtggaaaaaaaaatctga

SEQ ID NO: 1366143 - DNA, 22 bp, Artificial Sequence
  chemically synthesized
gtccagtggaaaaaaaaatctg

SEQ ID NO: 1366144 - DNA, 22 bp, Artificial Sequence
  chemically synthesized
tgtccagtggaaaaaaaaatct

SEQ ID NO: 1366145 - DNA, 22 bp, Artificial Sequence
  chemically synthesized
ttgtccagtggaaaaaaaaatc

SEQ ID NO: 1366146 - DNA, 22 bp, Artificial Sequence
  chemically synthesized
ttaaatgttcagattttttttt

SEQ ID NO: 1366147 - DNA, 22 bp, Artificial Sequence
  chemically synthesized
tttgtccagtggaaaaaaaaat

SEQ ID NO: 1366148 - DNA, 22 bp, Artificial Sequence
  chemically synthesized
taaatgttcagatttttttttc

SEQ ID NO: 1366149 - DNA, 22 bp, Artificial Sequence
  chemically synthesized
ttttgtccagtggaaaaaaaaa

SEQ ID NO: 1366150 - DNA, 22 bp, Artificial Sequence
  chemically synthesized
aaatgttcagatttttttttcc

SEQ ID NO: 1366151 - DNA, 22 bp, Artificial Sequence
  chemically synthesized
tttttgtccagtggaaaaaaaa

SEQ ID NO: 1366152 - DNA, 22 bp, Artificial Sequence
  chemically synthesized
aatgttcagatttttttttcca

SEQ ID NO: 1366153 - DNA, 22 bp, Artificial Sequence
  chemically synthesized
ttttttgtccagtggaaaaaaa

SEQ ID NO: 1366154 - DNA, 22 bp, Artificial Sequence
  chemically synthesized
tttttttgtccagtggaaaaaa

SEQ ID NO: 1366155 - DNA, 22 bp, Artificial Sequence
  chemically synthesized
ttttttttgtccagtggaaaaa

SEQ ID NO: 1366156 - DNA, 22 bp, Artificial Sequence
  chemically synthesized
tttttttttgtccagtggaaaa

SEQ ID NO: 1366157 - DNA, 22 bp, Artificial Sequence
  chemically synthesized
ttttttttttgtccagtggaaa

SEQ ID NO: 1366158 - DNA, 22 bp, Artificial Sequence
  chemically synthesized
tttttttttttgtccagtggaa

SEQ ID NO: 1366159 - DNA, 22 bp, Artificial Sequence
  chemically synthesized
agatttttttttccactggaca

SEQ ID NO: 1366160 - DNA, 22 bp, Artificial Sequence
  chemically synthesized
tttttttttttttgtccagtgg

SEQ ID NO: 1366161 - DNA, 22 bp, Artificial Sequence
  chemically synthesized
ttttttccactggacaaaaaaa

SEQ ID NO: 1366162 - DNA, 22 bp, Artificial Sequence
  chemically synthesized
aagctctttttttttttttgtc

SEQ ID NO: 1366163 - DNA, 22 bp, Artificial Sequence
  chemically synthesized
tttttccactggacaaaaaaaa

SEQ ID NO: 1366164 - DNA, 22 bp, Artificial Sequence
  chemically synthesized
ttttccactggacaaaaaaaaa

SEQ ID NO: 1366165 - DNA, 22 bp, Artificial Sequence
  chemically synthesized
tttccactggacaaaaaaaaaa

SEQ ID NO: 1366166 - DNA, 22 bp, Artificial Sequence
  chemically synthesized
ttccactggacaaaaaaaaaaa

SEQ ID NO: 1366167 - DNA, 22 bp, Artificial Sequence
  chemically synthesized
tccactggacaaaaaaaaaaaa

SEQ ID NO: 1366168 - DNA, 22 bp, Artificial Sequence
  chemically synthesized
ccactggacaaaaaaaaaaaaa

SEQ ID NO: 1366169 - DNA, 22 bp, Artificial Sequence
  chemically synthesized
cactggacaaaaaaaaaaaaag

SEQ ID NO: 1366170 - DNA, 22 bp, Artificial Sequence
  chemically synthesized
gacaaaaaaaaaaaaagagctt

SEQ ID NO: 1366171 - DNA, 22 bp, Artificial Sequence
  chemically synthesized
tggaaatgtgagttaaagctct

SEQ ID NO: 1366172 - DNA, 22 bp, Artificial Sequence
  chemically synthesized
tctatggaaatgtgagttaaag

SEQ ID NO: 1366173 - DNA, 22 bp, Artificial Sequence
  chemically synthesized
attgtctatggaaatgtgagtt

SEQ ID NO: 1366174 - DNA, 22 bp, Artificial Sequence
  chemically synthesized
cattgtctatggaaatgtgagt

SEQ ID NO: 1366175 - DNA, 22 bp, Artificial Sequence
  chemically synthesized
taactcacatttccatagacaa

SEQ ID NO: 1366176 - DNA, 22 bp, Artificial Sequence
  chemically synthesized
aactcacatttccatagacaat

SEQ ID NO: 1366177 - DNA, 22 bp, Artificial Sequence
  chemically synthesized
actcacatttccatagacaatg

SEQ ID NO: 1366178 - DNA, 22 bp, Artificial Sequence
  chemically synthesized
acatttccatagacaatgaagc

SEQ ID NO: 1366179 - DNA, 22 bp, Artificial Sequence
  chemically synthesized
tgtgaatgccatgggcttcatt

SEQ ID NO: 1366180 - DNA, 22 bp, Artificial Sequence
  chemically synthesized
ccatagacaatgaagcccatgg

SEQ ID NO: 1366181 - DNA, 22 bp, Artificial Sequence
  chemically synthesized
catagacaatgaagcccatggc

SEQ ID NO: 1366182 - DNA, 22 bp, Artificial Sequence
  chemically synthesized
aaatcacatcgttatgtgaatg

SEQ ID NO: 1366183 - DNA, 22 bp, Artificial Sequence
  chemically synthesized
acataacgatgtgatttcagga

SEQ ID NO: 1366184 - DNA, 22 bp, Artificial Sequence
  chemically synthesized
atatgtagtaccaagtcctgaa

SEQ ID NO: 1366185 - DNA, 22 bp, Artificial Sequence
  chemically synthesized
tagatagtactgatatgtagta

SEQ ID NO: 1366186 - DNA, 22 bp, Artificial Sequence
  chemically synthesized
caggacttggtactacatatca

SEQ ID NO: 1366187 - DNA, 22 bp, Artificial Sequence
  chemically synthesized
tatagatagtactgatatgtag

SEQ ID NO: 1366188 - DNA, 22 bp, Artificial Sequence
  chemically synthesized
aggacttggtactacatatcag

SEQ ID NO: 1366189 - DNA, 22 bp, Artificial Sequence
  chemically synthesized
actctatagatagtactgatat

SEQ ID NO: 1366190 - DNA, 22 bp, Artificial Sequence
  chemically synthesized
gactctatagatagtactgata

SEQ ID NO: 1366191 - DNA, 22 bp, Artificial Sequence
  chemically synthesized
ttgactctatagatagtactga

SEQ ID NO: 1366192 - DNA, 22 bp, Artificial Sequence
  chemically synthesized
ggtactacatatcagtactatc

SEQ ID NO: 1366193 - DNA, 22 bp, Artificial Sequence
  chemically synthesized
cttgactctatagatagtactg

SEQ ID NO: 1366194 - DNA, 22 bp, Artificial Sequence
  chemically synthesized
gtactacatatcagtactatct

SEQ ID NO: 1366195 - DNA, 22 bp, Artificial Sequence
  chemically synthesized
tcttgactctatagatagtact

SEQ ID NO: 1366196 - DNA, 22 bp, Artificial Sequence
  chemically synthesized
tttcttgactctatagatagta

SEQ ID NO: 1366197 - DNA, 22 bp, Artificial Sequence
  chemically synthesized
ctttcttgactctatagatagt

SEQ ID NO: 1366198 - DNA, 22 bp, Artificial Sequence
  chemically synthesized
tctttcttgactctatagatag

SEQ ID NO: 1366199 - DNA, 22 bp, Artificial Sequence
  chemically synthesized
catatcagtactatctatagag

SEQ ID NO: 1366200 - DNA, 22 bp, Artificial Sequence
  chemically synthesized
gtaagcaaatgttttctttctt

SEQ ID NO: 1366201 - DNA, 22 bp, Artificial Sequence
  chemically synthesized
tctatagagtcaagaaagaaaa

SEQ ID NO: 1366202 - DNA, 22 bp, Artificial Sequence
  chemically synthesized
ggtaagcaaatgttttctttct

SEQ ID NO: 1366203 - DNA, 22 bp, Artificial Sequence
  chemically synthesized
tagagtcaagaaagaaaacatt

SEQ ID NO: 1366204 - DNA, 22 bp, Artificial Sequence
  chemically synthesized
tatttggtaagcaaatgttttc

SEQ ID NO: 1366205 - DNA, 22 bp, Artificial Sequence
  chemically synthesized
atatttggtaagcaaatgtttt

SEQ ID NO: 1366206 - DNA, 22 bp, Artificial Sequence
  chemically synthesized
cttatatttggtaagcaaatgt

SEQ ID NO: 1366207 - DNA, 22 bp, Artificial Sequence
  chemically synthesized
gcttatatttggtaagcaaatg

SEQ ID NO: 1366208 - DNA, 22 bp, Artificial Sequence
  chemically synthesized
tgcttatatttggtaagcaaat

SEQ ID NO: 1366209 - DNA, 22 bp, Artificial Sequence
  chemically synthesized
agttttgcttatatttggtaag

SEQ ID NO: 1366210 - DNA, 22 bp, Artificial Sequence
  chemically synthesized
gagttttgcttatatttggtaa

SEQ ID NO: 1366211 - DNA, 22 bp, Artificial Sequence
  chemically synthesized
tgagttttgcttatatttggta

SEQ ID NO: 1366212 - DNA, 22 bp, Artificial Sequence
  chemically synthesized
gttttgagttttgcttatattt

SEQ ID NO: 1366213 - DNA, 22 bp, Artificial Sequence
  chemically synthesized
gcttaccaaatataagcaaaac

SEQ ID NO: 1366214 - DNA, 22 bp, Artificial Sequence
  chemically synthesized
cttaccaaatataagcaaaact

SEQ ID NO: 1366215 - DNA, 22 bp, Artificial Sequence
  chemically synthesized
accaaatataagcaaaactcaa

SEQ ID NO: 1366216 - DNA, 22 bp, Artificial Sequence
  chemically synthesized
ccaaatataagcaaaactcaaa

SEQ ID NO: 1366217 - DNA, 22 bp, Artificial Sequence
  chemically synthesized
acaacacaggcaaattagtttt

SEQ ID NO: 1366218 - DNA, 22 bp, Artificial Sequence
  chemically synthesized
cacaacacaggcaaattagttt

SEQ ID NO: 1366219 - DNA, 22 bp, Artificial Sequence
  chemically synthesized
tcacaacacaggcaaattagtt

SEQ ID NO: 1366220 - DNA, 22 bp, Artificial Sequence
  chemically synthesized
ttttcacaacacaggcaaatta

SEQ ID NO: 1366221 - DNA, 22 bp, Artificial Sequence
  chemically synthesized
aaaactaatttgcctgtgttgt

SEQ ID NO: 1366222 - DNA, 22 bp, Artificial Sequence
  chemically synthesized
atttgcctgtgttgtgaaaata

SEQ ID NO: 1366223 - DNA, 22 bp, Artificial Sequence
  chemically synthesized
gcctgtgttgtgaaaataatga

SEQ ID NO: 1366224 - DNA, 22 bp, Artificial Sequence
  chemically synthesized
cctgtgttgtgaaaataatgac

SEQ ID NO: 1366225 - DNA, 22 bp, Artificial Sequence
  chemically synthesized
tgttgtgaaaataatgactcct

SEQ ID NO: 1366226 - DNA, 22 bp, Artificial Sequence
  chemically synthesized
tgaaaataatgactcctcactt

SEQ ID NO: 1366227 - DNA, 22 bp, Artificial Sequence
  chemically synthesized
ggaatcaatccacaaagtgagg

SEQ ID NO: 1366228 - DNA, 22 bp, Artificial Sequence
  chemically synthesized
ataaaacagttgggaatcaatc

SEQ ID NO: 1366229 - DNA, 22 bp, Artificial Sequence
  chemically synthesized
ctcactttgtggattgattccc

SEQ ID NO: 1366230 - DNA, 22 bp, Artificial Sequence
  chemically synthesized
actttgtggattgattcccaac

SEQ ID NO: 1366231 - DNA, 22 bp, Artificial Sequence
  chemically synthesized
cctcataaaacagttgggaatc

SEQ ID NO: 1366232 - DNA, 22 bp, Artificial Sequence
  chemically synthesized
acctcataaaacagttgggaat

SEQ ID NO: 1366233 - DNA, 22 bp, Artificial Sequence
  chemically synthesized
tgtggattgattcccaactgtt

SEQ ID NO: 1366234 - DNA, 22 bp, Artificial Sequence
  chemically synthesized
gtggattgattcccaactgttt

SEQ ID NO: 1366235 - DNA, 22 bp, Artificial Sequence
  chemically synthesized
tggattgattcccaactgtttt

SEQ ID NO: 1366236 - DNA, 22 bp, Artificial Sequence
  chemically synthesized
tacatttacctcataaaacagt

SEQ ID NO: 1366237 - DNA, 22 bp, Artificial Sequence
  chemically synthesized
attcccaactgttttatgaggt

SEQ ID NO: 1366238 - DNA, 22 bp, Artificial Sequence
  chemically synthesized
atccctgtacatttacctcata

SEQ ID NO: 1366239 - DNA, 22 bp, Artificial Sequence
  chemically synthesized
ccaactgttttatgaggtaaat

SEQ ID NO: 1366240 - DNA, 22 bp, Artificial Sequence
  chemically synthesized
attaatccctgtacatttacct

SEQ ID NO: 1366241 - DNA, 22 bp, Artificial Sequence
  chemically synthesized
cattaatccctgtacatttacc

SEQ ID NO: 1366242 - DNA, 22 bp, Artificial Sequence
  chemically synthesized
ttttatgaggtaaatgtacagg

SEQ ID NO: 1366243 - DNA, 22 bp, Artificial Sequence
  chemically synthesized
tatgaggtaaatgtacagggat

SEQ ID NO: 1366244 - DNA, 22 bp, Artificial Sequence
  chemically synthesized
atgaggtaaatgtacagggatt

SEQ ID NO: 1366245 - DNA, 22 bp, Artificial Sequence
  chemically synthesized
aaaatcttcattaatccctgta

SEQ ID NO: 1366246 - DNA, 22 bp, Artificial Sequence
  chemically synthesized
tgaggtaaatgtacagggatta

SEQ ID NO: 1366247 - DNA, 22 bp, Artificial Sequence
  chemically synthesized
aaaaatcttcattaatccctgt

SEQ ID NO: 1366248 - DNA, 22 bp, Artificial Sequence
  chemically synthesized
taaaaatcttcattaatccctg

SEQ ID NO: 1366249 - DNA, 22 bp, Artificial Sequence
  chemically synthesized
agaaatctttaaaaatcttcat

SEQ ID NO: 1366250 - DNA, 22 bp, Artificial Sequence
  chemically synthesized
cattcagaaatctttaaaaatc

SEQ ID NO: 1366251 - DNA, 22 bp, Artificial Sequence
  chemically synthesized
acattcagaaatctttaaaaat

SEQ ID NO: 1366252 - DNA, 22 bp, Artificial Sequence
  chemically synthesized
ttacattcagaaatctttaaaa

SEQ ID NO: 1366253 - DNA, 22 bp, Artificial Sequence
  chemically synthesized
cttacattcagaaatctttaaa

SEQ ID NO: 1366254 - DNA, 22 bp, Artificial Sequence
  chemically synthesized
tcttacattcagaaatctttaa

SEQ ID NO: 1366255 - DNA, 22 bp, Artificial Sequence
  chemically synthesized
atgaagatttttaaagatttct

SEQ ID NO: 1366256 - DNA, 22 bp, Artificial Sequence
  chemically synthesized
ataatacctttcttacattcag

SEQ ID NO: 1366257 - DNA, 22 bp, Artificial Sequence
  chemically synthesized
ttaaagatttctgaatgtaaga

SEQ ID NO: 1366258 - DNA, 22 bp, Artificial Sequence
  chemically synthesized
taaagatttctgaatgtaagaa

SEQ ID NO: 1366259 - DNA, 22 bp, Artificial Sequence
  chemically synthesized
aaagatttctgaatgtaagaaa

SEQ ID NO: 1366260 - DNA, 22 bp, Artificial Sequence
  chemically synthesized
aagatttctgaatgtaagaaag

SEQ ID NO: 1366261 - DNA, 22 bp, Artificial Sequence
  chemically synthesized
tactcataatacctttcttaca

SEQ ID NO: 1366262 - DNA, 22 bp, Artificial Sequence
  chemically synthesized
gtactcataatacctttcttac

SEQ ID NO: 1366263 - DNA, 22 bp, Artificial Sequence
  chemically synthesized
tgtactcataatacctttctta

SEQ ID NO: 1366264 - DNA, 22 bp, Artificial Sequence
  chemically synthesized
tctttgtactcataataccttt

SEQ ID NO: 1366265 - DNA, 22 bp, Artificial Sequence
  chemically synthesized
ctgaatgtaagaaaggtattat

SEQ ID NO: 1366266 - DNA, 22 bp, Artificial Sequence
  chemically synthesized
tgaatgtaagaaaggtattatg

SEQ ID NO: 1366267 - DNA, 22 bp, Artificial Sequence
  chemically synthesized
ctatctttgtactcataatacc

SEQ ID NO: 1366268 - DNA, 22 bp, Artificial Sequence
  chemically synthesized
aatgtaagaaaggtattatgag

SEQ ID NO: 1366269 - DNA, 22 bp, Artificial Sequence
  chemically synthesized
actatctttgtactcataatac

SEQ ID NO: 1366270 - DNA, 22 bp, Artificial Sequence
  chemically synthesized
gcatcaatgcatttactatctt

SEQ ID NO: 1366271 - DNA, 22 bp, Artificial Sequence
  chemically synthesized
tgagtacaaagatagtaaatgc

SEQ ID NO: 1366272 - DNA, 22 bp, Artificial Sequence
  chemically synthesized
actagcatcaatgcatttacta

SEQ ID NO: 1366273 - DNA, 22 bp, Artificial Sequence
  chemically synthesized
agctcactagcatcaatgcatt

SEQ ID NO: 1366274 - DNA, 22 bp, Artificial Sequence
  chemically synthesized
tcagctcactagcatcaatgca

SEQ ID NO: 1366275 - DNA, 22 bp, Artificial Sequence
  chemically synthesized
attctcagctcactagcatcaa

SEQ ID NO: 1366276 - DNA, 22 bp, Artificial Sequence
  chemically synthesized
ctgattctcagctcactagcat

SEQ ID NO: 1366277 - DNA, 22 bp, Artificial Sequence
  chemically synthesized
aaacatgttactgattctcagc

SEQ ID NO: 1366278 - DNA, 22 bp, Artificial Sequence
  chemically synthesized
atgctagtgagctgagaatcag

SEQ ID NO: 1366279 - DNA, 22 bp, Artificial Sequence
  chemically synthesized
ttaaaacatgttactgattctc

SEQ ID NO: 1366280 - DNA, 22 bp, Artificial Sequence
  chemically synthesized
gtgagctgagaatcagtaacat

SEQ ID NO: 1366281 - DNA, 22 bp, Artificial Sequence
  chemically synthesized
agaatcagtaacatgttttaat

SEQ ID NO: 1366282 - DNA, 22 bp, Artificial Sequence
  chemically synthesized
ataccccataagagatacaact

SEQ ID NO: 1366283 - DNA, 22 bp, Artificial Sequence
  chemically synthesized
actaataccccataagagatac

SEQ ID NO: 1366284 - DNA, 22 bp, Artificial Sequence
  chemically synthesized
cactaataccccataagagata

SEQ ID NO: 1366285 - DNA, 22 bp, Artificial Sequence
  chemically synthesized
taatagttgtatctcttatggg

SEQ ID NO: 1366286 - DNA, 22 bp, Artificial Sequence
  chemically synthesized
aatagttgtatctcttatgggg

SEQ ID NO: 1366287 - DNA, 22 bp, Artificial Sequence
  chemically synthesized
atagttgtatctcttatggggt

SEQ ID NO: 1366288 - DNA, 22 bp, Artificial Sequence
  chemically synthesized
ccaggatcttcactaatacccc

SEQ ID NO: 1366289 - DNA, 22 bp, Artificial Sequence
  chemically synthesized
tatctcttatggggtattagtg

SEQ ID NO: 1366290 - DNA, 22 bp, Artificial Sequence
  chemically synthesized
ctaccaggatcttcactaatac

SEQ ID NO: 1366291 - DNA, 22 bp, Artificial Sequence
  chemically synthesized
cctaccaggatcttcactaata

SEQ ID NO: 1366292 - DNA, 22 bp, Artificial Sequence
  chemically synthesized
ttatggggtattagtgaagatc

SEQ ID NO: 1366293 - DNA, 22 bp, Artificial Sequence
  chemically synthesized
tatttcctaccaggatcttcac

SEQ ID NO: 1366294 - DNA, 22 bp, Artificial Sequence
  chemically synthesized
atggggtattagtgaagatcct

SEQ ID NO: 1366295 - DNA, 22 bp, Artificial Sequence
  chemically synthesized
tggggtattagtgaagatcctg

SEQ ID NO: 1366296 - DNA, 22 bp, Artificial Sequence
  chemically synthesized
cctatatttcctaccaggatct

SEQ ID NO: 1366297 - DNA, 22 bp, Artificial Sequence
  chemically synthesized
ctacctatatttcctaccagga

SEQ ID NO: 1366298 - DNA, 22 bp, Artificial Sequence
  chemically synthesized
gtgaagatcctggtaggaaata

SEQ ID NO: 1366299 - DNA, 22 bp, Artificial Sequence
  chemically synthesized
aatctgctacctatatttccta

SEQ ID NO: 1366300 - DNA, 22 bp, Artificial Sequence
  chemically synthesized
gaatctgctacctatatttcct

SEQ ID NO: 1366301 - DNA, 22 bp, Artificial Sequence
  chemically synthesized
tgaatctgctacctatatttcc

SEQ ID NO: 1366302 - DNA, 22 bp, Artificial Sequence
  chemically synthesized
ttgaatctgctacctatatttc

SEQ ID NO: 1366303 - DNA, 22 bp, Artificial Sequence
  chemically synthesized
aatgcttttgaatctgctacct

SEQ ID NO: 1366304 - DNA, 22 bp, Artificial Sequence
  chemically synthesized
gtaggaaatataggtagcagat

SEQ ID NO: 1366305 - DNA, 22 bp, Artificial Sequence
  chemically synthesized
ttaaatgcttttgaatctgcta

SEQ ID NO: 1366306 - DNA, 22 bp, Artificial Sequence
  chemically synthesized
tctgttaaatgcttttgaatct

SEQ ID NO: 1366307 - DNA, 22 bp, Artificial Sequence
  chemically synthesized
ttatctgttaaatgcttttgaa

SEQ ID NO: 1366308 - DNA, 22 bp, Artificial Sequence
  chemically synthesized
accgaattattatctgttaaat

SEQ ID NO: 1366309 - DNA, 22 bp, Artificial Sequence
  chemically synthesized
caccgaattattatctgttaaa

SEQ ID NO: 1366310 - DNA, 22 bp, Artificial Sequence
  chemically synthesized
tcaccgaattattatctgttaa

SEQ ID NO: 1366311 - DNA, 22 bp, Artificial Sequence
  chemically synthesized
tttcaccgaattattatctgtt

SEQ ID NO: 1366312 - DNA, 22 bp, Artificial Sequence
  chemically synthesized
aaaagcatttaacagataataa

SEQ ID NO: 1366313 - DNA, 22 bp, Artificial Sequence
  chemically synthesized
tccatagttctttcaccgaatt

SEQ ID NO: 1366314 - DNA, 22 bp, Artificial Sequence
  chemically synthesized
gtccatagttctttcaccgaat

SEQ ID NO: 1366315 - DNA, 22 bp, Artificial Sequence
  chemically synthesized
aacagataataattcggtgaaa

SEQ ID NO: 1366316 - DNA, 22 bp, Artificial Sequence
  chemically synthesized
acagataataattcggtgaaag

SEQ ID NO: 1366317 - DNA, 22 bp, Artificial Sequence
  chemically synthesized
tatgtttgtccatagttctttc

SEQ ID NO: 1366318 - DNA, 22 bp, Artificial Sequence
  chemically synthesized
cctatatgtttgtccatagttc

SEQ ID NO: 1366319 - DNA, 22 bp, Artificial Sequence
  chemically synthesized
ggtgaaagaactatggacaaac

SEQ ID NO: 1366320 - DNA, 22 bp, Artificial Sequence
  chemically synthesized
atcagcctgcctatatgtttgt

SEQ ID NO: 1366321 - DNA, 22 bp, Artificial Sequence
  chemically synthesized
tcatcagcctgcctatatgttt

SEQ ID NO: 1366322 - DNA, 22 bp, Artificial Sequence
  chemically synthesized
ttctcatcagcctgcctatatg

SEQ ID NO: 1366323 - DNA, 22 bp, Artificial Sequence
  chemically synthesized
gttctcatcagcctgcctatat

SEQ ID NO: 1366324 - DNA, 22 bp, Artificial Sequence
  chemically synthesized
tggacaaacatataggcaggct

SEQ ID NO: 1366325 - DNA, 22 bp, Artificial Sequence
  chemically synthesized
tttgttctcatcagcctgccta

SEQ ID NO: 1366326 - DNA, 22 bp, Artificial Sequence
  chemically synthesized
atttgttctcatcagcctgcct

SEQ ID NO: 1366327 - DNA, 22 bp, Artificial Sequence
  chemically synthesized
accatcccttatttgttctcat

SEQ ID NO: 1366328 - DNA, 22 bp, Artificial Sequence
  chemically synthesized
ggtgactcaccatcccttattt

SEQ ID NO: 1366329 - DNA, 22 bp, Artificial Sequence
  chemically synthesized
ctaggtgactcaccatccctta

SEQ ID NO: 1366330 - DNA, 22 bp, Artificial Sequence
  chemically synthesized
atgagaacaaataagggatggt

SEQ ID NO: 1366331 - DNA, 22 bp, Artificial Sequence
  chemically synthesized
gctaggtgactcaccatccctt

SEQ ID NO: 1366332 - DNA, 22 bp, Artificial Sequence
  chemically synthesized
cttgctaggtgactcaccatcc

SEQ ID NO: 1366333 - DNA, 22 bp, Artificial Sequence
  chemically synthesized
ctgcttgctaggtgactcacca

SEQ ID NO: 1366334 - DNA, 22 bp, Artificial Sequence
  chemically synthesized
gctgcttgctaggtgactcacc

SEQ ID NO: 1366335 - DNA, 22 bp, Artificial Sequence
  chemically synthesized
ttgctgcttgctaggtgactca

SEQ ID NO: 1366336 - DNA, 22 bp, Artificial Sequence
  chemically synthesized
tcttgctgcttgctaggtgact

SEQ ID NO: 1366337 - DNA, 22 bp, Artificial Sequence
  chemically synthesized
cctctcttgctgcttgctaggt

SEQ ID NO: 1366338 - DNA, 22 bp, Artificial Sequence
  chemically synthesized
gcaagcagcaagagaggtaatt

SEQ ID NO: 1366339 - DNA, 22 bp, Artificial Sequence
  chemically synthesized
gaggtagaaacaaattacctct

SEQ ID NO: 1366340 - DNA, 22 bp, Artificial Sequence
  chemically synthesized
ggcctggaggtagaaacaaatt

SEQ ID NO: 1366341 - DNA, 22 bp, Artificial Sequence
  chemically synthesized
acatattaggcctggaggtaga

SEQ ID NO: 1366342 - DNA, 22 bp, Artificial Sequence
  chemically synthesized
gacatattaggcctggaggtag

SEQ ID NO: 1366343 - DNA, 22 bp, Artificial Sequence
  chemically synthesized
ccttgacatattaggcctggag

SEQ ID NO: 1366344 - DNA, 22 bp, Artificial Sequence
  chemically synthesized
accttgacatattaggcctgga

SEQ ID NO: 1366345 - DNA, 22 bp, Artificial Sequence
  chemically synthesized
taccttgacatattaggcctgg

SEQ ID NO: 1366346 - DNA, 22 bp, Artificial Sequence
  chemically synthesized
gtttctacctccaggcctaata

SEQ ID NO: 1366347 - DNA, 22 bp, Artificial Sequence
  chemically synthesized
tttctacctccaggcctaatat

SEQ ID NO: 1366348 - DNA, 22 bp, Artificial Sequence
  chemically synthesized
ctttaccttgacatattaggcc

SEQ ID NO: 1366349 - DNA, 22 bp, Artificial Sequence
  chemically synthesized
ctacctccaggcctaatatgtc

SEQ ID NO: 1366350 - DNA, 22 bp, Artificial Sequence
  chemically synthesized
ttcctttaccttgacatattag

SEQ ID NO: 1366351 - DNA, 22 bp, Artificial Sequence
  chemically synthesized
tacctccaggcctaatatgtca

SEQ ID NO: 1366352 - DNA, 22 bp, Artificial Sequence
  chemically synthesized
cctccaggcctaatatgtcaag

SEQ ID NO: 1366353 - DNA, 22 bp, Artificial Sequence
  chemically synthesized
caggcctaatatgtcaaggtaa

SEQ ID NO: 1366354 - DNA, 22 bp, Artificial Sequence
  chemically synthesized
caacattattcctttaccttga

SEQ ID NO: 1366355 - DNA, 22 bp, Artificial Sequence
  chemically synthesized
ttccaacattattcctttacct

SEQ ID NO: 1366356 - DNA, 22 bp, Artificial Sequence
  chemically synthesized
ctattccaacattattccttta

SEQ ID NO: 1366357 - DNA, 22 bp, Artificial Sequence
  chemically synthesized
atatgtcaaggtaaaggaataa

SEQ ID NO: 1366358 - DNA, 22 bp, Artificial Sequence
  chemically synthesized
ttgctattccaacattattcct

SEQ ID NO: 1366359 - DNA, 22 bp, Artificial Sequence
  chemically synthesized
tattgctattccaacattattc

SEQ ID NO: 1366360 - DNA, 22 bp, Artificial Sequence
  chemically synthesized
ctattgctattccaacattatt

SEQ ID NO: 1366361 - DNA, 22 bp, Artificial Sequence
  chemically synthesized
tctattgctattccaacattat

SEQ ID NO: 1366362 - DNA, 22 bp, Artificial Sequence
  chemically synthesized
ttctattgctattccaacatta

SEQ ID NO: 1366363 - DNA, 22 bp, Artificial Sequence
  chemically synthesized
cccttttctattgctattccaa

SEQ ID NO: 1366364 - DNA, 22 bp, Artificial Sequence
  chemically synthesized
gtagtgactgcccttttctatt

SEQ ID NO: 1366365 - DNA, 22 bp, Artificial Sequence
  chemically synthesized
gaatagcaatagaaaagggcag

SEQ ID NO: 1366366 - DNA, 22 bp, Artificial Sequence
  chemically synthesized
aggtcctggtagtgactgccct

SEQ ID NO: 1366367 - DNA, 22 bp, Artificial Sequence
  chemically synthesized
actaaggtcctggtagtgactg

SEQ ID NO: 1366368 - DNA, 22 bp, Artificial Sequence
  chemically synthesized
acatatgcctcactaaggtcct

SEQ ID NO: 1366369 - DNA, 22 bp, Artificial Sequence
  chemically synthesized
cacatatgcctcactaaggtcc

SEQ ID NO: 1366370 - DNA, 22 bp, Artificial Sequence
  chemically synthesized
cacttcacatatgcctcactaa

SEQ ID NO: 1366371 - DNA, 22 bp, Artificial Sequence
  chemically synthesized
ccaggaccttagtgaggcatat

SEQ ID NO: 1366372 - DNA, 22 bp, Artificial Sequence
  chemically synthesized
tgttccacttcacatatgcctc

SEQ ID NO: 1366373 - DNA, 22 bp, Artificial Sequence
  chemically synthesized
gtgttccacttcacatatgcct

SEQ ID NO: 1366374 - DNA, 22 bp, Artificial Sequence
  chemically synthesized
gatatttgtgttccacttcaca

SEQ ID NO: 1366375 - DNA, 22 bp, Artificial Sequence
  chemically synthesized
agtgaggcatatgtgaagtgga

SEQ ID NO: 1366376 - DNA, 22 bp, Artificial Sequence
  chemically synthesized
ggatatttgtgttccacttcac

SEQ ID NO: 1366377 - DNA, 22 bp, Artificial Sequence
  chemically synthesized
gtgaggcatatgtgaagtggaa

SEQ ID NO: 1366378 - DNA, 22 bp, Artificial Sequence
  chemically synthesized
gacatcagagggcaagggaaaa

SEQ ID NO: 1366379 - DNA, 22 bp, Artificial Sequence
  chemically synthesized
tttttcccttgccctctgatgt

SEQ ID NO: 1366380 - DNA, 22 bp, Artificial Sequence
  chemically synthesized
ttttcccttgccctctgatgtc

SEQ ID NO: 1366381 - DNA, 22 bp, Artificial Sequence
  chemically synthesized
tttcccttgccctctgatgtcc

SEQ ID NO: 1366382 - DNA, 22 bp, Artificial Sequence
  chemically synthesized
ttcccttgccctctgatgtcca

SEQ ID NO: 1366383 - DNA, 22 bp, Artificial Sequence
  chemically synthesized
tgtgacaccagctggacatcag

SEQ ID NO: 1366384 - DNA, 22 bp, Artificial Sequence
  chemically synthesized
tcccttgccctctgatgtccag

SEQ ID NO: 1366385 - DNA, 22 bp, Artificial Sequence
  chemically synthesized
cccttgccctctgatgtccagc

SEQ ID NO: 1366386 - DNA, 22 bp, Artificial Sequence
  chemically synthesized
ccttgccctctgatgtccagct

SEQ ID NO: 1366387 - DNA, 22 bp, Artificial Sequence
  chemically synthesized
gccctctgatgtccagctggtg

SEQ ID NO: 1366388 - DNA, 22 bp, Artificial Sequence
  chemically synthesized
ccctctgatgtccagctggtgt

SEQ ID NO: 1366389 - DNA, 22 bp, Artificial Sequence
  chemically synthesized
ggaaattatgtgacaccagctg

SEQ ID NO: 1366390 - DNA, 22 bp, Artificial Sequence
  chemically synthesized
aggaaattatgtgacaccagct

SEQ ID NO: 1366391 - DNA, 22 bp, Artificial Sequence
  chemically synthesized
taggaaattatgtgacaccagc

SEQ ID NO: 1366392 - DNA, 22 bp, Artificial Sequence
  chemically synthesized
ttaggaaattatgtgacaccag

SEQ ID NO: 1366393 - DNA, 22 bp, Artificial Sequence
  chemically synthesized
tgatgtccagctggtgtcacat

SEQ ID NO: 1366394 - DNA, 22 bp, Artificial Sequence
  chemically synthesized
atgtccagctggtgtcacataa

SEQ ID NO: 1366395 - DNA, 22 bp, Artificial Sequence
  chemically synthesized
acttttaggaaattatgtgaca

SEQ ID NO: 1366396 - DNA, 22 bp, Artificial Sequence
  chemically synthesized
tgcactaacttttaggaaatta

SEQ ID NO: 1366397 - DNA, 22 bp, Artificial Sequence
  chemically synthesized
gtgcactaacttttaggaaatt

SEQ ID NO: 1366398 - DNA, 22 bp, Artificial Sequence
  chemically synthesized
ttgtgcactaacttttaggaaa

SEQ ID NO: 1366399 - DNA, 22 bp, Artificial Sequence
  chemically synthesized
gtgtcacataatttcctaaaag

SEQ ID NO: 1366400 - DNA, 22 bp, Artificial Sequence
  chemically synthesized
cctaaaagttagtgcacaagag

SEQ ID NO: 1366401 - DNA, 22 bp, Artificial Sequence
  chemically synthesized
tatcaccaacgcctcttgtgca

SEQ ID NO: 1366402 - DNA, 22 bp, Artificial Sequence
  chemically synthesized
ctaaaagttagtgcacaagagg

SEQ ID NO: 1366403 - DNA, 22 bp, Artificial Sequence
  chemically synthesized
gtatcaccaacgcctcttgtgc

SEQ ID NO: 1366404 - DNA, 22 bp, Artificial Sequence
  chemically synthesized
aaagttagtgcacaagaggcgt

SEQ ID NO: 1366405 - DNA, 22 bp, Artificial Sequence
  chemically synthesized
atttgtatcaccaacgcctctt

SEQ ID NO: 1366406 - DNA, 22 bp, Artificial Sequence
  chemically synthesized
catttgtatcaccaacgcctct

SEQ ID NO: 1366407 - DNA, 22 bp, Artificial Sequence
  chemically synthesized
ttcatttgtatcaccaacgcct

SEQ ID NO: 1366408 - DNA, 22 bp, Artificial Sequence
  chemically synthesized
gtgcacaagaggcgttggtgat

SEQ ID NO: 1366409 - DNA, 22 bp, Artificial Sequence
  chemically synthesized
tctcttcatttgtatcaccaac

SEQ ID NO: 1366410 - DNA, 22 bp, Artificial Sequence
  chemically synthesized
gtctcttcatttgtatcaccaa

SEQ ID NO: 1366411 - DNA, 22 bp, Artificial Sequence
  chemically synthesized
gaaagcttgtctcttcatttgt

SEQ ID NO: 1366412 - DNA, 22 bp, Artificial Sequence
  chemically synthesized
ccctggaaagcttgtctcttca

SEQ ID NO: 1366413 - DNA, 22 bp, Artificial Sequence
  chemically synthesized
gccctggaaagcttgtctcttc

SEQ ID NO: 1366414 - DNA, 22 bp, Artificial Sequence
  chemically synthesized
gtgatacaaatgaagagacaag

SEQ ID NO: 1366415 - DNA, 22 bp, Artificial Sequence
  chemically synthesized
tgccctggaaagcttgtctctt

SEQ ID NO: 1366416 - DNA, 22 bp, Artificial Sequence
  chemically synthesized
ttgccctggaaagcttgtctct

SEQ ID NO: 1366417 - DNA, 22 bp, Artificial Sequence
  chemically synthesized
tttgccctggaaagcttgtctc

SEQ ID NO: 1366418 - DNA, 22 bp, Artificial Sequence
  chemically synthesized
ttttttgccctggaaagcttgt

SEQ ID NO: 1366419 - DNA, 22 bp, Artificial Sequence
  chemically synthesized
ccctgttttttgccctggaaag

SEQ ID NO: 1366420 - DNA, 22 bp, Artificial Sequence
  chemically synthesized
tgccctgttttttgccctggaa

SEQ ID NO: 1366421 - DNA, 22 bp, Artificial Sequence
  chemically synthesized
tctgccctgttttttgccctgg

SEQ ID NO: 1366422 - DNA, 22 bp, Artificial Sequence
  chemically synthesized
caattctctgccctgttttttg

SEQ ID NO: 1366423 - DNA, 22 bp, Artificial Sequence
  chemically synthesized
gcaattctctgccctgtttttt

SEQ ID NO: 1366424 - DNA, 22 bp, Artificial Sequence
  chemically synthesized
tgcaattctctgccctgttttt

SEQ ID NO: 1366425 - DNA, 22 bp, Artificial Sequence
  chemically synthesized
tccagggcaaaaaacagggcag

SEQ ID NO: 1366426 - DNA, 22 bp, Artificial Sequence
  chemically synthesized
ccagggcaaaaaacagggcaga

SEQ ID NO: 1366427 - DNA, 22 bp, Artificial Sequence
  chemically synthesized
cagggcaaaaaacagggcagag

SEQ ID NO: 1366428 - DNA, 22 bp, Artificial Sequence
  chemically synthesized
ccacacccattttgcaattctc

SEQ ID NO: 1366429 - DNA, 22 bp, Artificial Sequence
  chemically synthesized
gctaccacacccattttgcaat

SEQ ID NO: 1366430 - DNA, 22 bp, Artificial Sequence
  chemically synthesized
ctcgctaccacacccattttgc

SEQ ID NO: 1366431 - DNA, 22 bp, Artificial Sequence
  chemically synthesized
cactcctcgctaccacacccat

SEQ ID NO: 1366432 - DNA, 22 bp, Artificial Sequence
  chemically synthesized
caaaatgggtgtggtagcgagg

SEQ ID NO: 1366433 - DNA, 22 bp, Artificial Sequence
  chemically synthesized
gtggcagtggctccactcctcg

SEQ ID NO: 1366434 - DNA, 22 bp, Artificial Sequence
  chemically synthesized
tattagtggcagtggctccact

SEQ ID NO: 1366435 - DNA, 22 bp, Artificial Sequence
  chemically synthesized
agttgtattagtggcagtggct

SEQ ID NO: 1366436 - DNA, 22 bp, Artificial Sequence
  chemically synthesized
cagttgtattagtggcagtggc

SEQ ID NO: 1366437 - DNA, 22 bp, Artificial Sequence
  chemically synthesized
ttcagttgtattagtggcagtg

SEQ ID NO: 1366438 - DNA, 22 bp, Artificial Sequence
  chemically synthesized
aaaattcttcagttgtattagt

SEQ ID NO: 1366439 - DNA, 22 bp, Artificial Sequence
  chemically synthesized
ctaaaaattcttcagttgtatt

SEQ ID NO: 1366440 - DNA, 22 bp, Artificial Sequence
  chemically synthesized
gctaaaaattcttcagttgtat

SEQ ID NO: 1366441 - DNA, 22 bp, Artificial Sequence
  chemically synthesized
cttgctaaaaattcttcagttg

SEQ ID NO: 1366442 - DNA, 22 bp, Artificial Sequence
  chemically synthesized
ccactaatacaactgaagaatt

SEQ ID NO: 1366443 - DNA, 22 bp, Artificial Sequence
  chemically synthesized
atacaactgaagaatttttagc

SEQ ID NO: 1366444 - DNA, 22 bp, Artificial Sequence
  chemically synthesized
aagaatttttagcaagcaggct

SEQ ID NO: 1366445 - DNA, 22 bp, Artificial Sequence
  chemically synthesized
aaatggtaggggtgagcctgct

SEQ ID NO: 1366446 - DNA, 22 bp, Artificial Sequence
  chemically synthesized
ttagcaagcaggctcaccccta

SEQ ID NO: 1366447 - DNA, 22 bp, Artificial Sequence
  chemically synthesized
tagcaagcaggctcacccctac

SEQ ID NO: 1366448 - DNA, 22 bp, Artificial Sequence
  chemically synthesized
agcaagcaggctcacccctacc

SEQ ID NO: 1366449 - DNA, 22 bp, Artificial Sequence
  chemically synthesized
gcaagcaggctcacccctacca

SEQ ID NO: 1366450 - DNA, 22 bp, Artificial Sequence
  chemically synthesized
agtatccatccaagactgaaat

SEQ ID NO: 1366451 - DNA, 22 bp, Artificial Sequence
  chemically synthesized
acccctaccatttcagtcttgg

SEQ ID NO: 1366452 - DNA, 22 bp, Artificial Sequence
  chemically synthesized
gtactgagtatccatccaagac

SEQ ID NO: 1366453 - DNA, 22 bp, Artificial Sequence
  chemically synthesized
ccatttcagtcttggatggata

SEQ ID NO: 1366454 - DNA, 22 bp, Artificial Sequence
  chemically synthesized
cagtcttggatggatactcagt

SEQ ID NO: 1366455 - DNA, 22 bp, Artificial Sequence
  chemically synthesized
agtcttggatggatactcagta

SEQ ID NO: 1366456 - DNA, 22 bp, Artificial Sequence
  chemically synthesized
caaggtatcacactagtactga

SEQ ID NO: 1366457 - DNA, 22 bp, Artificial Sequence
  chemically synthesized
ggatggatactcagtactagtg

SEQ ID NO: 1366458 - DNA, 22 bp, Artificial Sequence
  chemically synthesized
tacaaggtatcacactagtact

SEQ ID NO: 1366459 - DNA, 22 bp, Artificial Sequence
  chemically synthesized
gatggatactcagtactagtgt

SEQ ID NO: 1366460 - DNA, 22 bp, Artificial Sequence
  chemically synthesized
ctacaaggtatcacactagtac

SEQ ID NO: 1366461 - DNA, 22 bp, Artificial Sequence
  chemically synthesized
tctacaaggtatcacactagta

SEQ ID NO: 1366462 - DNA, 22 bp, Artificial Sequence
  chemically synthesized
atcatattttctacaaggtatc

SEQ ID NO: 1366463 - DNA, 22 bp, Artificial Sequence
  chemically synthesized
agtactagtgtgataccttgta

SEQ ID NO: 1366464 - DNA, 22 bp, Artificial Sequence
  chemically synthesized
gatcatattttctacaaggtat

SEQ ID NO: 1366465 - DNA, 22 bp, Artificial Sequence
  chemically synthesized
atccttgatcatattttctaca

SEQ ID NO: 1366466 - DNA, 22 bp, Artificial Sequence
  chemically synthesized
gtgtgataccttgtagaaaata

SEQ ID NO: 1366467 - DNA, 22 bp, Artificial Sequence
  chemically synthesized
ttcatccttgatcatattttct

SEQ ID NO: 1366468 - DNA, 22 bp, Artificial Sequence
  chemically synthesized
gtagaaaatatgatcaaggatg

SEQ ID NO: 1366469 - DNA, 22 bp, Artificial Sequence
  chemically synthesized
tagaaaatatgatcaaggatga

SEQ ID NO: 1366470 - DNA, 22 bp, Artificial Sequence
  chemically synthesized
cgtaggatctattcatccttga

SEQ ID NO: 1366471 - DNA, 22 bp, Artificial Sequence
  chemically synthesized
cattgcgtaggatctattcatc

SEQ ID NO: 1366472 - DNA, 22 bp, Artificial Sequence
  chemically synthesized
aaaatgaaggcaaaggctacat

SEQ ID NO: 1366473 - DNA, 22 bp, Artificial Sequence
  chemically synthesized
cgcaatgtagcctttgccttca

SEQ ID NO: 1366474 - DNA, 22 bp, Artificial Sequence
  chemically synthesized
agagatgtagggttgaaaatga

SEQ ID NO: 1366475 - DNA, 22 bp, Artificial Sequence
  chemically synthesized
tgccttcattttcaaccctaca

SEQ ID NO: 1366476 - DNA, 22 bp, Artificial Sequence
  chemically synthesized
gccttcattttcaaccctacat

SEQ ID NO: 1366477 - DNA, 22 bp, Artificial Sequence
  chemically synthesized
ccttcattttcaaccctacatc

SEQ ID NO: 1366478 - DNA, 22 bp, Artificial Sequence
  chemically synthesized
aaggaagttcagagatgtaggg

SEQ ID NO: 1366479 - DNA, 22 bp, Artificial Sequence
  chemically synthesized
cattttcaaccctacatctctg

SEQ ID NO: 1366480 - DNA, 22 bp, Artificial Sequence
  chemically synthesized
attttcaaccctacatctctga

SEQ ID NO: 1366481 - DNA, 22 bp, Artificial Sequence
  chemically synthesized
tcaaccctacatctctgaactt

SEQ ID NO: 1366482 - DNA, 22 bp, Artificial Sequence
  chemically synthesized
caaccctacatctctgaacttc

SEQ ID NO: 1366483 - DNA, 22 bp, Artificial Sequence
  chemically synthesized
aaccctacatctctgaacttcc

SEQ ID NO: 1366484 - DNA, 22 bp, Artificial Sequence
  chemically synthesized
catctctgaacttccttgagtt

SEQ ID NO: 1366485 - DNA, 22 bp, Artificial Sequence
  chemically synthesized
tgaacttccttgagttatgtta

SEQ ID NO: 1366486 - DNA, 22 bp, Artificial Sequence
  chemically synthesized
aacttccttgagttatgttatg

SEQ ID NO: 1366487 - DNA, 22 bp, Artificial Sequence
  chemically synthesized
ccttgagttatgttatgtgctt

SEQ ID NO: 1366488 - DNA, 22 bp, Artificial Sequence
  chemically synthesized
cttgagttatgttatgtgcttt

SEQ ID NO: 1366489 - DNA, 22 bp, Artificial Sequence
  chemically synthesized
gagttatgttatgtgctttcct

SEQ ID NO: 1366490 - DNA, 22 bp, Artificial Sequence
  chemically synthesized
agatataatagtaggaaagcac

SEQ ID NO: 1366491 - DNA, 22 bp, Artificial Sequence
  chemically synthesized
agttatgttatgtgctttccta

SEQ ID NO: 1366492 - DNA, 22 bp, Artificial Sequence
  chemically synthesized
tgttatgtgctttcctactatt

SEQ ID NO: 1366493 - DNA, 22 bp, Artificial Sequence
  chemically synthesized
aataatctgagatataatagta

SEQ ID NO: 1366494 - DNA, 22 bp, Artificial Sequence
  chemically synthesized
aaataatctgagatataatagt

SEQ ID NO: 1366495 - DNA, 22 bp, Artificial Sequence
  chemically synthesized
tgtgctttcctactattatatc

SEQ ID NO: 1366496 - DNA, 22 bp, Artificial Sequence
  chemically synthesized
taaataatctgagatataatag

SEQ ID NO: 1366497 - DNA, 22 bp, Artificial Sequence
  chemically synthesized
ttaaataatctgagatataata

SEQ ID NO: 1366498 - DNA, 22 bp, Artificial Sequence
  chemically synthesized
tttaaataatctgagatataat

SEQ ID NO: 1366499 - DNA, 22 bp, Artificial Sequence
  chemically synthesized
tcctactattatatctcagatt

SEQ ID NO: 1366500 - DNA, 22 bp, Artificial Sequence
  chemically synthesized
cctactattatatctcagatta

SEQ ID NO: 1366501 - DNA, 22 bp, Artificial Sequence
  chemically synthesized
ctactattatatctcagattat

SEQ ID NO: 1366502 - DNA, 22 bp, Artificial Sequence
  chemically synthesized
ctattatatctcagattattta

SEQ ID NO: 1366503 - DNA, 22 bp, Artificial Sequence
  chemically synthesized
ttatatctcagattatttaaaa

SEQ ID NO: 1366504 - DNA, 22 bp, Artificial Sequence
  chemically synthesized
tatctcagattatttaaaaaat

SEQ ID NO: 1366505 - DNA, 22 bp, Artificial Sequence
  chemically synthesized
agattatttaaaaaattcatca

SEQ ID NO: 1366506 - DNA, 22 bp, Artificial Sequence
  chemically synthesized
agaaaacatgtatgatgaattt

SEQ ID NO: 1366507 - DNA, 22 bp, Artificial Sequence
  chemically synthesized
tttaaaaaattcatcatacatg

SEQ ID NO: 1366508 - DNA, 22 bp, Artificial Sequence
  chemically synthesized
catgctcagaaaacatgtatga

SEQ ID NO: 1366509 - DNA, 22 bp, Artificial Sequence
  chemically synthesized
aaaaaattcatcatacatgttt

SEQ ID NO: 1366510 - DNA, 22 bp, Artificial Sequence
  chemically synthesized
aaaaattcatcatacatgtttt

SEQ ID NO: 1366511 - DNA, 22 bp, Artificial Sequence
  chemically synthesized
atcatacatgttttctgagcat

SEQ ID NO: 1366512 - DNA, 22 bp, Artificial Sequence
  chemically synthesized
tctgagcatgcagctttactcc

SEQ ID NO: 1366513 - DNA, 22 bp, Artificial Sequence
  chemically synthesized
ctgagcatgcagctttactccc

SEQ ID NO: 1366514 - DNA, 22 bp, Artificial Sequence
  chemically synthesized
tgagcatgcagctttactccct

SEQ ID NO: 1366515 - DNA, 22 bp, Artificial Sequence
  chemically synthesized
agcatgcagctttactcccttt

SEQ ID NO: 1366516 - DNA, 22 bp, Artificial Sequence
  chemically synthesized
tcacacatgcaaaaagggagta

SEQ ID NO: 1366517 - DNA, 22 bp, Artificial Sequence
  chemically synthesized
atcacacatgcaaaaagggagt

SEQ ID NO: 1366518 - DNA, 22 bp, Artificial Sequence
  chemically synthesized
tttatcacacatgcaaaaaggg

SEQ ID NO: 1366519 - DNA, 22 bp, Artificial Sequence
  chemically synthesized
atttatcacacatgcaaaaagg

SEQ ID NO: 1366520 - DNA, 22 bp, Artificial Sequence
  chemically synthesized
tactccctttttgcatgtgtga

SEQ ID NO: 1366521 - DNA, 22 bp, Artificial Sequence
  chemically synthesized
actccctttttgcatgtgtgat

SEQ ID NO: 1366522 - DNA, 22 bp, Artificial Sequence
  chemically synthesized
ctccctttttgcatgtgtgata

SEQ ID NO: 1366523 - DNA, 22 bp, Artificial Sequence
  chemically synthesized
cctttttgcatgtgtgataaat

SEQ ID NO: 1366524 - DNA, 22 bp, Artificial Sequence
  chemically synthesized
tttgcatgtgtgataaataaat

SEQ ID NO: 1366525 - DNA, 22 bp, Artificial Sequence
  chemically synthesized
aacatacacccaatttatttat

SEQ ID NO: 1366526 - DNA, 22 bp, Artificial Sequence
  chemically synthesized
ttgcatgtgtgataaataaatt

SEQ ID NO: 1366527 - DNA, 22 bp, Artificial Sequence
  chemically synthesized
aaacatacacccaatttattta

SEQ ID NO: 1366528 - DNA, 22 bp, Artificial Sequence
  chemically synthesized
tgcatgtgtgataaataaattg

SEQ ID NO: 1366529 - DNA, 22 bp, Artificial Sequence
  chemically synthesized
gcatgtgtgataaataaattgg

SEQ ID NO: 1366530 - DNA, 22 bp, Artificial Sequence
  chemically synthesized
catgtgtgataaataaattggg

SEQ ID NO: 1366531 - DNA, 22 bp, Artificial Sequence
  chemically synthesized
catcaggtaagaaacaccttaa

SEQ ID NO: 1366532 - DNA, 22 bp, Artificial Sequence
  chemically synthesized
ccatcaggtaagaaacacctta

SEQ ID NO: 1366533 - DNA, 22 bp, Artificial Sequence
  chemically synthesized
ggtgtatgtttaaggtgtttct

SEQ ID NO: 1366534 - DNA, 22 bp, Artificial Sequence
  chemically synthesized
ccttccatcaggtaagaaacac

SEQ ID NO: 1366535 - DNA, 22 bp, Artificial Sequence
  chemically synthesized
gccttccatcaggtaagaaaca

SEQ ID NO: 1366536 - DNA, 22 bp, Artificial Sequence
  chemically synthesized
aaggtgtttcttacctgatgga

SEQ ID NO: 1366537 - DNA, 22 bp, Artificial Sequence
  chemically synthesized
aggtgtttcttacctgatggaa

SEQ ID NO: 1366538 - DNA, 22 bp, Artificial Sequence
  chemically synthesized
atggagcttgccttccatcagg

SEQ ID NO: 1366539 - DNA, 22 bp, Artificial Sequence
  chemically synthesized
gatggagcttgccttccatcag

SEQ ID NO: 1366540 - DNA, 22 bp, Artificial Sequence
  chemically synthesized
tgatggagcttgccttccatca

SEQ ID NO: 1366541 - DNA, 22 bp, Artificial Sequence
  chemically synthesized
ttttgatggagcttgccttcca

SEQ ID NO: 1366542 - DNA, 22 bp, Artificial Sequence
  chemically synthesized
cttacctgatggaaggcaagct

SEQ ID NO: 1366543 - DNA, 22 bp, Artificial Sequence
  chemically synthesized
ttacctgatggaaggcaagctc

SEQ ID NO: 1366544 - DNA, 22 bp, Artificial Sequence
  chemically synthesized
acctgatggaaggcaagctcca

SEQ ID NO: 1366545 - DNA, 22 bp, Artificial Sequence
  chemically synthesized
cctgatggaaggcaagctccat

SEQ ID NO: 1366546 - DNA, 22 bp, Artificial Sequence
  chemically synthesized
atggaaggcaagctccatcaaa

SEQ ID NO: 1366547 - DNA, 22 bp, Artificial Sequence
  chemically synthesized
aaaaggaagacacaactgtttt

SEQ ID NO: 1366548 - DNA, 22 bp, Artificial Sequence
  chemically synthesized
catcaaaacagttgtgtcttcc

SEQ ID NO: 1366549 - DNA, 22 bp, Artificial Sequence
  chemically synthesized
tgtcttcctttttagttgcttt

SEQ ID NO: 1366550 - DNA, 22 bp, Artificial Sequence
  chemically synthesized
cctttttagttgctttatcact

SEQ ID NO: 1366551 - DNA, 22 bp, Artificial Sequence
  chemically synthesized
ctttttagttgctttatcacta

SEQ ID NO: 1366552 - DNA, 22 bp, Artificial Sequence
  chemically synthesized
tttagttgctttatcactattg

SEQ ID NO: 1366553 - DNA, 22 bp, Artificial Sequence
  chemically synthesized
ttagttgctttatcactattgc

SEQ ID NO: 1366554 - DNA, 22 bp, Artificial Sequence
  chemically synthesized
tagttgctttatcactattgct

SEQ ID NO: 1366555 - DNA, 22 bp, Artificial Sequence
  chemically synthesized
agttgctttatcactattgctt

SEQ ID NO: 1366556 - DNA, 22 bp, Artificial Sequence
  chemically synthesized
gttgctttatcactattgcttg

SEQ ID NO: 1366557 - DNA, 22 bp, Artificial Sequence
  chemically synthesized
acacaacaaaatgacaagcaat

SEQ ID NO: 1366558 - DNA, 22 bp, Artificial Sequence
  chemically synthesized
ctttatcactattgcttgtcat

SEQ ID NO: 1366559 - DNA, 22 bp, Artificial Sequence
  chemically synthesized
ttcacacaacaaaatgacaagc

SEQ ID NO: 1366560 - DNA, 22 bp, Artificial Sequence
  chemically synthesized
attcacacaacaaaatgacaag

SEQ ID NO: 1366561 - DNA, 22 bp, Artificial Sequence
  chemically synthesized
tatcactattgcttgtcatttt

SEQ ID NO: 1366562 - DNA, 22 bp, Artificial Sequence
  chemically synthesized
tattcacacaacaaaatgacaa

SEQ ID NO: 1366563 - DNA, 22 bp, Artificial Sequence
  chemically synthesized
atcactattgcttgtcattttg

SEQ ID NO: 1366564 - DNA, 22 bp, Artificial Sequence
  chemically synthesized
tcactattgcttgtcattttgt

SEQ ID NO: 1366565 - DNA, 22 bp, Artificial Sequence
  chemically synthesized
ttgcttgtcattttgttgtgtg

SEQ ID NO: 1366566 - DNA, 22 bp, Artificial Sequence
  chemically synthesized
cttgtcattttgttgtgtgaat

SEQ ID NO: 1366567 - DNA, 22 bp, Artificial Sequence
  chemically synthesized
gtcattttgttgtgtgaataaa

SEQ ID NO: 1366568 - DNA, 22 bp, Artificial Sequence
  chemically synthesized
tcattttgttgtgtgaataaaa

SEQ ID NO: 1366569 - DNA, 22 bp, Artificial Sequence
  chemically synthesized
caagtggagacaattttattca

SEQ ID NO: 1366570 - DNA, 22 bp, Artificial Sequence
  chemically synthesized
tgttgtgtgaataaaattgtct

SEQ ID NO: 1366571 - DNA, 22 bp, Artificial Sequence
  chemically synthesized
gttgtgtgaataaaattgtctc

SEQ ID NO: 1366572 - DNA, 22 bp, Artificial Sequence
  chemically synthesized
ttgtgtgaataaaattgtctcc

SEQ ID NO: 1366573 - DNA, 22 bp, Artificial Sequence
  chemically synthesized
tgtgaataaaattgtctccact

SEQ ID NO: 1366574 - DNA, 22 bp, Artificial Sequence
  chemically synthesized
tctccacttgcaatttctttgt

SEQ ID NO: 1366575 - DNA, 22 bp, Artificial Sequence
  chemically synthesized
cacttgcaatttctttgtatta

SEQ ID NO: 1366576 - DNA, 22 bp, Artificial Sequence
  chemically synthesized
gcaatttctttgtattatatcc

SEQ ID NO: 1366577 - DNA, 22 bp, Artificial Sequence
  chemically synthesized
caatttctttgtattatatcct

SEQ ID NO: 1366578 - DNA, 22 bp, Artificial Sequence
  chemically synthesized
ctttgtattatatcctttgtgt

SEQ ID NO: 1366579 - DNA, 22 bp, Artificial Sequence
  chemically synthesized
tttgtattatatcctttgtgta

SEQ ID NO: 1366580 - DNA, 22 bp, Artificial Sequence
  chemically synthesized
tgtattatatcctttgtgtatt

SEQ ID NO: 1366581 - DNA, 22 bp, Artificial Sequence
  chemically synthesized
gtattatatcctttgtgtatta

SEQ ID NO: 1366582 - DNA, 22 bp, Artificial Sequence
  chemically synthesized
tattatatcctttgtgtattat

SEQ ID NO: 1366583 - DNA, 22 bp, Artificial Sequence
  chemically synthesized
tatcctttgtgtattatatgct

SEQ ID NO: 1366584 - DNA, 22 bp, Artificial Sequence
  chemically synthesized
tgtgtattatatgctccctcat

SEQ ID NO: 1366585 - DNA, 22 bp, Artificial Sequence
  chemically synthesized
gtgtattatatgctccctcatt

SEQ ID NO: 1366586 - DNA, 22 bp, Artificial Sequence
  chemically synthesized
tgtattatatgctccctcattc

SEQ ID NO: 1366587 - DNA, 22 bp, Artificial Sequence
  chemically synthesized
aacaaagcccagaagaatgagg

SEQ ID NO: 1366588 - DNA, 22 bp, Artificial Sequence
  chemically synthesized
aaacaaagcccagaagaatgag

SEQ ID NO: 1366589 - DNA, 22 bp, Artificial Sequence
  chemically synthesized
tatgctccctcattcttctggg

SEQ ID NO: 1366590 - DNA, 22 bp, Artificial Sequence
  chemically synthesized
cctcattcttctgggctttgtt

SEQ ID NO: 1366591 - DNA, 22 bp, Artificial Sequence
  chemically synthesized
ataaagtaaatttaaacaaagc

SEQ ID NO: 1366592 - DNA, 22 bp, Artificial Sequence
  chemically synthesized
cataaagtaaatttaaacaaag

SEQ ID NO: 1366593 - DNA, 22 bp, Artificial Sequence
  chemically synthesized
attcttctgggctttgtttaaa

SEQ ID NO: 1366594 - DNA, 22 bp, Artificial Sequence
  chemically synthesized
ttctgggctttgtttaaattta

SEQ ID NO: 1366595 - DNA, 22 bp, Artificial Sequence
  chemically synthesized
ctgggctttgtttaaatttact

SEQ ID NO: 1366596 - DNA, 22 bp, Artificial Sequence
  chemically synthesized
tgggctttgtttaaatttactt

SEQ ID NO: 1366597 - DNA, 22 bp, Artificial Sequence
  chemically synthesized
ggctttgtttaaatttacttta

SEQ ID NO: 1366598 - DNA, 22 bp, Artificial Sequence
  chemically synthesized
aaaaaaataatcttcataaagt

SEQ ID NO: 1366599 - DNA, 22 bp, Artificial Sequence
  chemically synthesized
tgtttaaatttactttatgaag

SEQ ID NO: 1366600 - DNA, 22 bp, Artificial Sequence
  chemically synthesized
gtttaaatttactttatgaaga

SEQ ID NO: 1366601 - DNA, 22 bp, Artificial Sequence
  chemically synthesized
tttaaatttactttatgaagat

SEQ ID NO: 1366602 - DNA, 22 bp, Artificial Sequence
  chemically synthesized
aaatttactttatgaagattat

SEQ ID NO: 1366603 - DNA, 22 bp, Artificial Sequence
  chemically synthesized
aatttactttatgaagattatt

SEQ ID NO: 1366604 - DNA, 22 bp, Artificial Sequence
  chemically synthesized
actttatgaagattattttttt

SEQ ID NO: 1366605 - DNA, 22 bp, Artificial Sequence
  chemically synthesized
ctttatgaagattatttttttt

SEQ ID NO: 1366606 - DNA, 22 bp, Artificial Sequence
  chemically synthesized
tatgaagattattttttttagc

SEQ ID NO: 1366607 - DNA, 22 bp, Artificial Sequence
  chemically synthesized
atgaagattattttttttagct

SEQ ID NO: 1366608 - DNA, 22 bp, Artificial Sequence
  chemically synthesized
tgaagattattttttttagctt

SEQ ID NO: 1366609 - DNA, 22 bp, Artificial Sequence
  chemically synthesized
tgagtgggagtgaggagaagct

SEQ ID NO: 1366610 - DNA, 22 bp, Artificial Sequence
  chemically synthesized
ttttttttagcttctcctcact

SEQ ID NO: 1366611 - DNA, 22 bp, Artificial Sequence
  chemically synthesized
tttttagcttctcctcactccc

SEQ ID NO: 1366612 - DNA, 22 bp, Artificial Sequence
  chemically synthesized
ttttagcttctcctcactccca

SEQ ID NO: 1366613 - DNA, 22 bp, Artificial Sequence
  chemically synthesized
tttagcttctcctcactcccac

SEQ ID NO: 1366614 - DNA, 22 bp, Artificial Sequence
  chemically synthesized
ttagcttctcctcactcccact

SEQ ID NO: 1366615 - DNA, 22 bp, Artificial Sequence
  chemically synthesized
gacccatctatgagtgggagtg

SEQ ID NO: 1366616 - DNA, 22 bp, Artificial Sequence
  chemically synthesized
tagcttctcctcactcccactc

SEQ ID NO: 1366617 - DNA, 22 bp, Artificial Sequence
  chemically synthesized
agcttctcctcactcccactca

SEQ ID NO: 1366618 - DNA, 22 bp, Artificial Sequence
  chemically synthesized
gcttctcctcactcccactcat

SEQ ID NO: 1366619 - DNA, 22 bp, Artificial Sequence
  chemically synthesized
ttagacccatctatgagtggga

SEQ ID NO: 1366620 - DNA, 22 bp, Artificial Sequence
  chemically synthesized
ctcctcactcccactcatagat

SEQ ID NO: 1366621 - DNA, 22 bp, Artificial Sequence
  chemically synthesized
tcctcactcccactcatagatg

SEQ ID NO: 1366622 - DNA, 22 bp, Artificial Sequence
  chemically synthesized
atattgttagacccatctatga

SEQ ID NO: 1366623 - DNA, 22 bp, Artificial Sequence
  chemically synthesized
ctcactcccactcatagatggg

SEQ ID NO: 1366624 - DNA, 22 bp, Artificial Sequence
  chemically synthesized
actcccactcatagatgggtct

SEQ ID NO: 1366625 - DNA, 22 bp, Artificial Sequence
  chemically synthesized
ccactcatagatgggtctaaca

SEQ ID NO: 1366626 - DNA, 22 bp, Artificial Sequence
  chemically synthesized
atagatgggtctaacaatatga

SEQ ID NO: 1366627 - DNA, 22 bp, Artificial Sequence
  chemically synthesized
agtagtaaagatgcattcatat

SEQ ID NO: 1366628 - DNA, 22 bp, Artificial Sequence
  chemically synthesized
cagctgagtagtaaagatgcat

SEQ ID NO: 1366629 - DNA, 22 bp, Artificial Sequence
  chemically synthesized
acagctgagtagtaaagatgca

SEQ ID NO: 1366630 - DNA, 22 bp, Artificial Sequence
  chemically synthesized
acaatatgaatgcatctttact

SEQ ID NO: 1366631 - DNA, 22 bp, Artificial Sequence
  chemically synthesized
atatcaagaagtttacagctga

SEQ ID NO: 1366632 - DNA, 22 bp, Artificial Sequence
  chemically synthesized
aatatcaagaagtttacagctg

SEQ ID NO: 1366633 - DNA, 22 bp, Artificial Sequence
  chemically synthesized
ttaatatcaagaagtttacagc

SEQ ID NO: 1366634 - DNA, 22 bp, Artificial Sequence
  chemically synthesized
tactactcagctgtaaacttct

SEQ ID NO: 1366635 - DNA, 22 bp, Artificial Sequence
  chemically synthesized
actactcagctgtaaacttctt

SEQ ID NO: 1366636 - DNA, 22 bp, Artificial Sequence
  chemically synthesized
attcttaatatcaagaagttta

SEQ ID NO: 1366637 - DNA, 22 bp, Artificial Sequence
  chemically synthesized
ctactcagctgtaaacttcttg

SEQ ID NO: 1366638 - DNA, 22 bp, Artificial Sequence
  chemically synthesized
ctcagctgtaaacttcttgata

SEQ ID NO: 1366639 - DNA, 22 bp, Artificial Sequence
  chemically synthesized
agctgtaaacttcttgatatta

SEQ ID NO: 1366640 - DNA, 22 bp, Artificial Sequence
  chemically synthesized
taaacttcttgatattaagaat

SEQ ID NO: 1366641 - DNA, 22 bp, Artificial Sequence
  chemically synthesized
cttgatattaagaattaattgc

SEQ ID NO: 1366642 - DNA, 22 bp, Artificial Sequence
  chemically synthesized
ttgatattaagaattaattgct

SEQ ID NO: 1366643 - DNA, 22 bp, Artificial Sequence
  chemically synthesized
gatattaagaattaattgctat

SEQ ID NO: 1366644 - DNA, 22 bp, Artificial Sequence
  chemically synthesized
atattaagaattaattgctatt

SEQ ID NO: 1366645 - DNA, 22 bp, Artificial Sequence
  chemically synthesized
tcaacataatataaatagcaat

SEQ ID NO: 1366646 - DNA, 22 bp, Artificial Sequence
  chemically synthesized
agaattaattgctatttatatt

SEQ ID NO: 1366647 - DNA, 22 bp, Artificial Sequence
  chemically synthesized
aagttatcaacataatataaat

SEQ ID NO: 1366648 - DNA, 22 bp, Artificial Sequence
  chemically synthesized
attgctatttatattatgttga

SEQ ID NO: 1366649 - DNA, 22 bp, Artificial Sequence
  chemically synthesized
agagctaaagttatcaacataa

SEQ ID NO: 1366650 - DNA, 22 bp, Artificial Sequence
  chemically synthesized
gagagctaaagttatcaacata

SEQ ID NO: 1366651 - DNA, 22 bp, Artificial Sequence
  chemically synthesized
tgagagctaaagttatcaacat

SEQ ID NO: 1366652 - DNA, 22 bp, Artificial Sequence
  chemically synthesized
ctatttatattatgttgataac

SEQ ID NO: 1366653 - DNA, 22 bp, Artificial Sequence
  chemically synthesized
ttgagagctaaagttatcaaca

SEQ ID NO: 1366654 - DNA, 22 bp, Artificial Sequence
  chemically synthesized
tttatattatgttgataacttt

SEQ ID NO: 1366655 - DNA, 22 bp, Artificial Sequence
  chemically synthesized
atattatgttgataactttagc

SEQ ID NO: 1366656 - DNA, 22 bp, Artificial Sequence
  chemically synthesized
tattatgttgataactttagct

SEQ ID NO: 1366657 - DNA, 22 bp, Artificial Sequence
  chemically synthesized
tgttgataactttagctctcaa

SEQ ID NO: 1366658 - DNA, 22 bp, Artificial Sequence
  chemically synthesized
cacccaatgtgcttttgagagc

SEQ ID NO: 1366659 - DNA, 22 bp, Artificial Sequence
  chemically synthesized
ataactttagctctcaaaagca

SEQ ID NO: 1366660 - DNA, 22 bp, Artificial Sequence
  chemically synthesized
ttacacccaatgtgcttttgag

SEQ ID NO: 1366661 - DNA, 22 bp, Artificial Sequence
  chemically synthesized
ctattacacccaatgtgctttt

SEQ ID NO: 1366662 - DNA, 22 bp, Artificial Sequence
  chemically synthesized
tagctctcaaaagcacattggg

SEQ ID NO: 1366663 - DNA, 22 bp, Artificial Sequence
  chemically synthesized
agctctcaaaagcacattgggt

SEQ ID NO: 1366664 - DNA, 22 bp, Artificial Sequence
  chemically synthesized
aactcctattacacccaatgtg

SEQ ID NO: 1366665 - DNA, 22 bp, Artificial Sequence
  chemically synthesized
gctctcaaaagcacattgggtg

SEQ ID NO: 1366666 - DNA, 22 bp, Artificial Sequence
  chemically synthesized
tcaaaagcacattgggtgtaat

SEQ ID NO: 1366667 - DNA, 22 bp, Artificial Sequence
  chemically synthesized
aaaagcacattgggtgtaatag

SEQ ID NO: 1366668 - DNA, 22 bp, Artificial Sequence
  chemically synthesized
atatcactaaactcctattaca

SEQ ID NO: 1366669 - DNA, 22 bp, Artificial Sequence
  chemically synthesized
caactgatatcactaaactcct

SEQ ID NO: 1366670 - DNA, 22 bp, Artificial Sequence
  chemically synthesized
ccaactgatatcactaaactcc

SEQ ID NO: 1366671 - DNA, 22 bp, Artificial Sequence
  chemically synthesized
tccaactgatatcactaaactc

SEQ ID NO: 1366672 - DNA, 22 bp, Artificial Sequence
  chemically synthesized
ttccaactgatatcactaaact

SEQ ID NO: 1366673 - DNA, 22 bp, Artificial Sequence
  chemically synthesized
ggtgtaataggagtttagtgat

SEQ ID NO: 1366674 - DNA, 22 bp, Artificial Sequence
  chemically synthesized
tttccaactgatatcactaaac

SEQ ID NO: 1366675 - DNA, 22 bp, Artificial Sequence
  chemically synthesized
ttttccaactgatatcactaaa

SEQ ID NO: 1366676 - DNA, 22 bp, Artificial Sequence
  chemically synthesized
cttttttccaactgatatcact

SEQ ID NO: 1366677 - DNA, 22 bp, Artificial Sequence
  chemically synthesized
ccttttttccaactgatatcac

SEQ ID NO: 1366678 - DNA, 22 bp, Artificial Sequence
  chemically synthesized
tttccttttttccaactgatat

SEQ ID NO: 1366679 - DNA, 22 bp, Artificial Sequence
  chemically synthesized
cctgtttccttttttccaactg

SEQ ID NO: 1366680 - DNA, 22 bp, Artificial Sequence
  chemically synthesized
gcctgtttccttttttccaact

SEQ ID NO: 1366681 - DNA, 22 bp, Artificial Sequence
  chemically synthesized
ttgcctgtttccttttttccaa

SEQ ID NO: 1366682 - DNA, 22 bp, Artificial Sequence
  chemically synthesized
agtgatatcagttggaaaaaag

SEQ ID NO: 1366683 - DNA, 22 bp, Artificial Sequence
  chemically synthesized
gtgatatcagttggaaaaaagg

SEQ ID NO: 1366684 - DNA, 22 bp, Artificial Sequence
  chemically synthesized
tcttgcctgtttccttttttcc

SEQ ID NO: 1366685 - DNA, 22 bp, Artificial Sequence
  chemically synthesized
cctctcttgcctgtttcctttt

SEQ ID NO: 1366686 - DNA, 22 bp, Artificial Sequence
  chemically synthesized
ccctctcttgcctgtttccttt

SEQ ID NO: 1366687 - DNA, 22 bp, Artificial Sequence
  chemically synthesized
tttccctctcttgcctgtttcc

SEQ ID NO: 1366688 - DNA, 22 bp, Artificial Sequence
  chemically synthesized
atttccctctcttgcctgtttc

SEQ ID NO: 1366689 - DNA, 22 bp, Artificial Sequence
  chemically synthesized
tatttccctctcttgcctgttt

SEQ ID NO: 1366690 - DNA, 22 bp, Artificial Sequence
  chemically synthesized
tttatttccctctcttgcctgt

SEQ ID NO: 1366691 - DNA, 22 bp, Artificial Sequence
  chemically synthesized
gaaaaaaggaaacaggcaagag

SEQ ID NO: 1366692 - DNA, 22 bp, Artificial Sequence
  chemically synthesized
ctttatttccctctcttgcctg

SEQ ID NO: 1366693 - DNA, 22 bp, Artificial Sequence
  chemically synthesized
gatcataaatttctttatttcc

SEQ ID NO: 1366694 - DNA, 22 bp, Artificial Sequence
  chemically synthesized
tgatgatctggatcataaattt

SEQ ID NO: 1366695 - DNA, 22 bp, Artificial Sequence
  chemically synthesized
atgatgatctggatcataaatt

SEQ ID NO: 1366696 - DNA, 22 bp, Artificial Sequence
  chemically synthesized
tatgatgatctggatcataaat

SEQ ID NO: 1366697 - DNA, 22 bp, Artificial Sequence
  chemically synthesized
aattttatgatgatctggatca

SEQ ID NO: 1366698 - DNA, 22 bp, Artificial Sequence
  chemically synthesized
aaattttatgatgatctggatc

SEQ ID NO: 1366699 - DNA, 22 bp, Artificial Sequence
  chemically synthesized
taaattttatgatgatctggat

SEQ ID NO: 1366700 - DNA, 22 bp, Artificial Sequence
  chemically synthesized
ttttaaattttatgatgatctg

SEQ ID NO: 1366701 - DNA, 22 bp, Artificial Sequence
  chemically synthesized
attttaaattttatgatgatct

SEQ ID NO: 1366702 - DNA, 22 bp, Artificial Sequence
  chemically synthesized
atgatccagatcatcataaaat

SEQ ID NO: 1366703 - DNA, 22 bp, Artificial Sequence
  chemically synthesized
tgatccagatcatcataaaatt

SEQ ID NO: 1366704 - DNA, 22 bp, Artificial Sequence
  chemically synthesized
aaagtttattttaaattttatg

SEQ ID NO: 1366705 - DNA, 22 bp, Artificial Sequence
  chemically synthesized
aaacattcaaagtttattttaa

SEQ ID NO: 1366706 - DNA, 22 bp, Artificial Sequence
  chemically synthesized
tcaaacattcaaagtttatttt

SEQ ID NO: 1366707 - DNA, 22 bp, Artificial Sequence
  chemically synthesized
ctctcaaacattcaaagtttat

SEQ ID NO: 1366708 - DNA, 22 bp, Artificial Sequence
  chemically synthesized
ctactctcaaacattcaaagtt

SEQ ID NO: 1366709 - DNA, 22 bp, Artificial Sequence
  chemically synthesized
gctactctcaaacattcaaagt

SEQ ID NO: 1366710 - DNA, 22 bp, Artificial Sequence
  chemically synthesized
gtttgctactctcaaacattca

SEQ ID NO: 1366711 - DNA, 22 bp, Artificial Sequence
  chemically synthesized
aaaataaactttgaatgtttga

SEQ ID NO: 1366712 - DNA, 22 bp, Artificial Sequence
  chemically synthesized
ggtttgctactctcaaacattc

SEQ ID NO: 1366713 - DNA, 22 bp, Artificial Sequence
  chemically synthesized
aaataaactttgaatgtttgag

SEQ ID NO: 1366714 - DNA, 22 bp, Artificial Sequence
  chemically synthesized
aaagagatttggtttgctactc

SEQ ID NO: 1366715 - DNA, 22 bp, Artificial Sequence
  chemically synthesized
tgaatgtttgagagtagcaaac

SEQ ID NO: 1366716 - DNA, 22 bp, Artificial Sequence
  chemically synthesized
gaatgtttgagagtagcaaacc

SEQ ID NO: 1366717 - DNA, 22 bp, Artificial Sequence
  chemically synthesized
tcaaagagatttggtttgctac

SEQ ID NO: 1366718 - DNA, 22 bp, Artificial Sequence
  chemically synthesized
aatgtttgagagtagcaaacca

SEQ ID NO: 1366719 - DNA, 22 bp, Artificial Sequence
  chemically synthesized
gagagtagcaaaccaaatctct

SEQ ID NO: 1366720 - DNA, 22 bp, Artificial Sequence
  chemically synthesized
agagtagcaaaccaaatctctt

SEQ ID NO: 1366721 - DNA, 22 bp, Artificial Sequence
  chemically synthesized
gcatacactctcaaagagattt

SEQ ID NO: 1366722 - DNA, 22 bp, Artificial Sequence
  chemically synthesized
agcatacactctcaaagagatt

SEQ ID NO: 1366723 - DNA, 22 bp, Artificial Sequence
  chemically synthesized
tagcatacactctcaaagagat

SEQ ID NO: 1366724 - DNA, 22 bp, Artificial Sequence
  chemically synthesized
ttagcatacactctcaaagaga

SEQ ID NO: 1366725 - DNA, 22 bp, Artificial Sequence
  chemically synthesized
ttttagcatacactctcaaaga

SEQ ID NO: 1366726 - DNA, 22 bp, Artificial Sequence
  chemically synthesized
cttttagcatacactctcaaag

SEQ ID NO: 1366727 - DNA, 22 bp, Artificial Sequence
  chemically synthesized
ataatttcttttagcatacact

SEQ ID NO: 1366728 - DNA, 22 bp, Artificial Sequence
  chemically synthesized
tttgagagtgtatgctaaaaga

SEQ ID NO: 1366729 - DNA, 22 bp, Artificial Sequence
  chemically synthesized
tgagagtgtatgctaaaagaaa

SEQ ID NO: 1366730 - DNA, 22 bp, Artificial Sequence
  chemically synthesized
gagagtgtatgctaaaagaaat

SEQ ID NO: 1366731 - DNA, 22 bp, Artificial Sequence
  chemically synthesized
agagtgtatgctaaaagaaatt

SEQ ID NO: 1366732 - DNA, 22 bp, Artificial Sequence
  chemically synthesized
aaagaaattatgaaccttggta

SEQ ID NO: 1366733 - DNA, 22 bp, Artificial Sequence
  chemically synthesized
tggtcatcccatagtaccaagg

SEQ ID NO: 1366734 - DNA, 22 bp, Artificial Sequence
  chemically synthesized
tcactatggtcatcccatagta

SEQ ID NO: 1366735 - DNA, 22 bp, Artificial Sequence
  chemically synthesized
gtcactatggtcatcccatagt

SEQ ID NO: 1366736 - DNA, 22 bp, Artificial Sequence
  chemically synthesized
tgaaccttggtactatgggatg

SEQ ID NO: 1366737 - DNA, 22 bp, Artificial Sequence
  chemically synthesized
ggtactatgggatgaccatagt

SEQ ID NO: 1366738 - DNA, 22 bp, Artificial Sequence
  chemically synthesized
gtactatgggatgaccatagtg

SEQ ID NO: 1366739 - DNA, 22 bp, Artificial Sequence
  chemically synthesized
aatgagaatttgtcactatggt

SEQ ID NO: 1366740 - DNA, 22 bp, Artificial Sequence
  chemically synthesized
aaatgagaatttgtcactatgg

SEQ ID NO: 1366741 - DNA, 22 bp, Artificial Sequence
  chemically synthesized
taaatgagaatttgtcactatg

SEQ ID NO: 1366742 - DNA, 22 bp, Artificial Sequence
  chemically synthesized
tgggatgaccatagtgacaaat

SEQ ID NO: 1366743 - DNA, 22 bp, Artificial Sequence
  chemically synthesized
ttttaaatgagaatttgtcact

SEQ ID NO: 1366744 - DNA, 22 bp, Artificial Sequence
  chemically synthesized
cattgttttaaatgagaatttg

SEQ ID NO: 1366745 - DNA, 22 bp, Artificial Sequence
  chemically synthesized
cacggcccagttccattgtttt

SEQ ID NO: 1366746 - DNA, 22 bp, Artificial Sequence
  chemically synthesized
ttccacggcccagttccattgt

SEQ ID NO: 1366747 - DNA, 22 bp, Artificial Sequence
  chemically synthesized
attccacggcccagttccattg

SEQ ID NO: 1366748 - DNA, 22 bp, Artificial Sequence
  chemically synthesized
tcatttaaaacaatggaactgg

SEQ ID NO: 1366749 - DNA, 22 bp, Artificial Sequence
  chemically synthesized
atttaaaacaatggaactgggc

SEQ ID NO: 1366750 - DNA, 22 bp, Artificial Sequence
  chemically synthesized
aaaacaatggaactgggccgtg

SEQ ID NO: 1366751 - DNA, 22 bp, Artificial Sequence
  chemically synthesized
aaacaatggaactgggccgtgg

SEQ ID NO: 1366752 - DNA, 22 bp, Artificial Sequence
  chemically synthesized
ataaataaatacacatttattc

SEQ ID NO: 1366753 - DNA, 22 bp, Artificial Sequence
  chemically synthesized
cataaataaatacacatttatt

SEQ ID NO: 1366754 - DNA, 22 bp, Artificial Sequence
  chemically synthesized
ggccgtggaataaatgtgtatt

SEQ ID NO: 1366755 - DNA, 22 bp, Artificial Sequence
  chemically synthesized
ataaatgtttcataaataaata

SEQ ID NO: 1366756 - DNA, 22 bp, Artificial Sequence
  chemically synthesized
gccctaataaatgtttcataaa

SEQ ID NO: 1366757 - DNA, 22 bp, Artificial Sequence
  chemically synthesized
atttatgaaacatttattaggg

SEQ ID NO: 1366758 - DNA, 22 bp, Artificial Sequence
  chemically synthesized
tttatgaaacatttattagggc

SEQ ID NO: 1366759 - DNA, 22 bp, Artificial Sequence
  chemically synthesized
atgcagaaaatctggccctaat

SEQ ID NO: 1366760 - DNA, 22 bp, Artificial Sequence
  chemically synthesized
atgaaacatttattagggccag

SEQ ID NO: 1366761 - DNA, 22 bp, Artificial Sequence
  chemically synthesized
aatgcagaaaatctggccctaa

SEQ ID NO: 1366762 - DNA, 22 bp, Artificial Sequence
  chemically synthesized
tgaaacatttattagggccaga

SEQ ID NO: 1366763 - DNA, 22 bp, Artificial Sequence
  chemically synthesized
taatgcagaaaatctggcccta

SEQ ID NO: 1366764 - DNA, 22 bp, Artificial Sequence
  chemically synthesized
atatctttaatgcagaaaatct

SEQ ID NO: 1366765 - DNA, 22 bp, Artificial Sequence
  chemically synthesized
attagggccagattttctgcat

SEQ ID NO: 1366766 - DNA, 22 bp, Artificial Sequence
  chemically synthesized
ttagggccagattttctgcatt

SEQ ID NO: 1366767 - DNA, 22 bp, Artificial Sequence
  chemically synthesized
gctcatatctttaatgcagaaa

SEQ ID NO: 1366768 - DNA, 22 bp, Artificial Sequence
  chemically synthesized
gggccagattttctgcattaaa

SEQ ID NO: 1366769 - DNA, 22 bp, Artificial Sequence
  chemically synthesized
ttagctcatatctttaatgcag

SEQ ID NO: 1366770 - DNA, 22 bp, Artificial Sequence
  chemically synthesized
aagttgttagctcatatcttta

SEQ ID NO: 1366771 - DNA, 22 bp, Artificial Sequence
  chemically synthesized
tctgcattaaagatatgagcta

SEQ ID NO: 1366772 - DNA, 22 bp, Artificial Sequence
  chemically synthesized
ctgcattaaagatatgagctaa

SEQ ID NO: 1366773 - DNA, 22 bp, Artificial Sequence
  chemically synthesized
tgcattaaagatatgagctaac

SEQ ID NO: 1366774 - DNA, 22 bp, Artificial Sequence
  chemically synthesized
cattaaagatatgagctaacaa

SEQ ID NO: 1366775 - DNA, 22 bp, Artificial Sequence
  chemically synthesized
aagatatgagctaacaacttca

SEQ ID NO: 1366776 - DNA, 22 bp, Artificial Sequence
  chemically synthesized
agggcagggacctgaagttgtt

SEQ ID NO: 1366777 - DNA, 22 bp, Artificial Sequence
  chemically synthesized
gagggcagggacctgaagttgt

SEQ ID NO: 1366778 - DNA, 22 bp, Artificial Sequence
  chemically synthesized
tttgagggcagggacctgaagt

SEQ ID NO: 1366779 - DNA, 22 bp, Artificial Sequence
  chemically synthesized
acaacttcaggtccctgccctc

SEQ ID NO: 1366780 - DNA, 22 bp, Artificial Sequence
  chemically synthesized
caggtccctgccctcaaataga

SEQ ID NO: 1366781 - DNA, 22 bp, Artificial Sequence
  chemically synthesized
aggtccctgccctcaaatagat

SEQ ID NO: 1366782 - DNA, 22 bp, Artificial Sequence
  chemically synthesized
atatacccaaggtataatctat

SEQ ID NO: 1366783 - DNA, 22 bp, Artificial Sequence
  chemically synthesized
aatatacccaaggtataatcta

SEQ ID NO: 1366784 - DNA, 22 bp, Artificial Sequence
  chemically synthesized
taatatacccaaggtataatct

SEQ ID NO: 1366785 - DNA, 22 bp, Artificial Sequence
  chemically synthesized
ttaatatacccaaggtataatc

SEQ ID NO: 1366786 - DNA, 22 bp, Artificial Sequence
  chemically synthesized
ccctcaaatagattataccttg

SEQ ID NO: 1366787 - DNA, 22 bp, Artificial Sequence
  chemically synthesized
ttttaatatacccaaggtataa

SEQ ID NO: 1366788 - DNA, 22 bp, Artificial Sequence
  chemically synthesized
cttttaatatacccaaggtata

SEQ ID NO: 1366789 - DNA, 22 bp, Artificial Sequence
  chemically synthesized
tcttttaatatacccaaggtat

SEQ ID NO: 1366790 - DNA, 22 bp, Artificial Sequence
  chemically synthesized
ttcttttaatatacccaaggta

SEQ ID NO: 1366791 - DNA, 22 bp, Artificial Sequence
  chemically synthesized
aaatagattataccttgggtat

SEQ ID NO: 1366792 - DNA, 22 bp, Artificial Sequence
  chemically synthesized
taccttgggtatattaaaagaa

SEQ ID NO: 1366793 - DNA, 22 bp, Artificial Sequence
  chemically synthesized
aaatgtcaacttttcttttaat

SEQ ID NO: 1366794 - DNA, 22 bp, Artificial Sequence
  chemically synthesized
gggtatattaaaagaaaagttg

SEQ ID NO: 1366795 - DNA, 22 bp, Artificial Sequence
  chemically synthesized
ggtatattaaaagaaaagttga

SEQ ID NO: 1366796 - DNA, 22 bp, Artificial Sequence
  chemically synthesized
gcaggtcgattaaaatgtcaac

SEQ ID NO: 1366797 - DNA, 22 bp, Artificial Sequence
  chemically synthesized
aaagaaaagttgacattttaat

SEQ ID NO: 1366798 - DNA, 22 bp, Artificial Sequence
  chemically synthesized
tcaattagcaggtcgattaaaa

SEQ ID NO: 1366799 - DNA, 22 bp, Artificial Sequence
  chemically synthesized
atcaattagcaggtcgattaaa

SEQ ID NO: 1366800 - DNA, 22 bp, Artificial Sequence
  chemically synthesized
aagtttatcaattagcaggtcg

SEQ ID NO: 1366801 - DNA, 22 bp, Artificial Sequence
  chemically synthesized
acattttaatcgacctgctaat

SEQ ID NO: 1366802 - DNA, 22 bp, Artificial Sequence
  chemically synthesized
ttgaagtttatcaattagcagg

SEQ ID NO: 1366803 - DNA, 22 bp, Artificial Sequence
  chemically synthesized
attgaagtttatcaattagcag

SEQ ID NO: 1366804 - DNA, 22 bp, Artificial Sequence
  chemically synthesized
taatcgacctgctaattgataa

SEQ ID NO: 1366805 - DNA, 22 bp, Artificial Sequence
  chemically synthesized
aatcgacctgctaattgataaa

SEQ ID NO: 1366806 - DNA, 22 bp, Artificial Sequence
  chemically synthesized
atcgacctgctaattgataaac

SEQ ID NO: 1366807 - DNA, 22 bp, Artificial Sequence
  chemically synthesized
aagcttattgaagtttatcaat

SEQ ID NO: 1366808 - DNA, 22 bp, Artificial Sequence
  chemically synthesized
caagcttattgaagtttatcaa

SEQ ID NO: 1366809 - DNA, 22 bp, Artificial Sequence
  chemically synthesized
ctaattgataaacttcaataag

SEQ ID NO: 1366810 - DNA, 22 bp, Artificial Sequence
  chemically synthesized
attgataaacttcaataagctt

SEQ ID NO: 1366811 - DNA, 22 bp, Artificial Sequence
  chemically synthesized
agacgaaagtcttcaagcttat

SEQ ID NO: 1366812 - DNA, 22 bp, Artificial Sequence
  chemically synthesized
ataaacttcaataagcttgaag

SEQ ID NO: 1366813 - DNA, 22 bp, Artificial Sequence
  chemically synthesized
tgagacgaaagtcttcaagctt

SEQ ID NO: 1366814 - DNA, 22 bp, Artificial Sequence
  chemically synthesized
tctgagacgaaagtcttcaagc

SEQ ID NO: 1366815 - DNA, 22 bp, Artificial Sequence
  chemically synthesized
caataagcttgaagactttcgt

SEQ ID NO: 1366816 - DNA, 22 bp, Artificial Sequence
  chemically synthesized
aataagcttgaagactttcgtc

SEQ ID NO: 1366817 - DNA, 22 bp, Artificial Sequence
  chemically synthesized
ggtacctctctgagacgaaagt

SEQ ID NO: 1366818 - DNA, 22 bp, Artificial Sequence
  chemically synthesized
ttaggtacctctctgagacgaa

SEQ ID NO: 1366819 - DNA, 22 bp, Artificial Sequence
  chemically synthesized
ctattaggtacctctctgagac

SEQ ID NO: 1366820 - DNA, 22 bp, Artificial Sequence
  chemically synthesized
gctattaggtacctctctgaga

SEQ ID NO: 1366821 - DNA, 22 bp, Artificial Sequence
  chemically synthesized
gaagactttcgtctcagagagg

SEQ ID NO: 1366822 - DNA, 22 bp, Artificial Sequence
  chemically synthesized
aagactttcgtctcagagaggt

SEQ ID NO: 1366823 - DNA, 22 bp, Artificial Sequence
  chemically synthesized
gtcttgctattaggtacctctc

SEQ ID NO: 1366824 - DNA, 22 bp, Artificial Sequence
  chemically synthesized
tcgtctcagagaggtacctaat

SEQ ID NO: 1366825 - DNA, 22 bp, Artificial Sequence
  chemically synthesized
cgtctcagagaggtacctaata

SEQ ID NO: 1366826 - DNA, 22 bp, Artificial Sequence
  chemically synthesized
gtctcagagaggtacctaatag

SEQ ID NO: 1366827 - DNA, 22 bp, Artificial Sequence
  chemically synthesized
aaacctggtcttgctattaggt

SEQ ID NO: 1366828 - DNA, 22 bp, Artificial Sequence
  chemically synthesized
aaaacctggtcttgctattagg

SEQ ID NO: 1366829 - DNA, 22 bp, Artificial Sequence
  chemically synthesized
taaaacctggtcttgctattag

SEQ ID NO: 1366830 - DNA, 22 bp, Artificial Sequence
  chemically synthesized
agagaggtacctaatagcaaga

SEQ ID NO: 1366831 - DNA, 22 bp, Artificial Sequence
  chemically synthesized
tctttaaaacctggtcttgcta

SEQ ID NO: 1366832 - DNA, 22 bp, Artificial Sequence
  chemically synthesized
atagcaagaccaggttttaaag

SEQ ID NO: 1366833 - DNA, 22 bp, Artificial Sequence
  chemically synthesized
tagtaggcagtgcatacggtgt

SEQ ID NO: 1366834 - DNA, 22 bp, Artificial Sequence
  chemically synthesized
atagtaggcagtgcatacggtg

SEQ ID NO: 1366835 - DNA, 22 bp, Artificial Sequence
  chemically synthesized
tatagtaggcagtgcatacggt

SEQ ID NO: 1366836 - DNA, 22 bp, Artificial Sequence
  chemically synthesized
taaagataacaccgtatgcact

SEQ ID NO: 1366837 - DNA, 22 bp, Artificial Sequence
  chemically synthesized
aaagataacaccgtatgcactg

SEQ ID NO: 1366838 - DNA, 22 bp, Artificial Sequence
  chemically synthesized
aagataacaccgtatgcactgc

SEQ ID NO: 1366839 - DNA, 22 bp, Artificial Sequence
  chemically synthesized
aatgacaatattttatagtagg

SEQ ID NO: 1366840 - DNA, 22 bp, Artificial Sequence
  chemically synthesized
acctaaatgacaatattttata

SEQ ID NO: 1366841 - DNA, 22 bp, Artificial Sequence
  chemically synthesized
aacctaaatgacaatattttat

SEQ ID NO: 1366842 - DNA, 22 bp, Artificial Sequence
  chemically synthesized
atttaacctaaatgacaatatt

SEQ ID NO: 1366843 - DNA, 22 bp, Artificial Sequence
  chemically synthesized
aatttaacctaaatgacaatat

SEQ ID NO: 1366844 - DNA, 22 bp, Artificial Sequence
  chemically synthesized
cctactataaaatattgtcatt

SEQ ID NO: 1366845 - DNA, 22 bp, Artificial Sequence
  chemically synthesized
ctataaaatattgtcatttagg

SEQ ID NO: 1366846 - DNA, 22 bp, Artificial Sequence
  chemically synthesized
taaaatattgtcatttaggtta

SEQ ID NO: 1366847 - DNA, 22 bp, Artificial Sequence
  chemically synthesized
aaacgcaatgcttaatttaacc

SEQ ID NO: 1366848 - DNA, 22 bp, Artificial Sequence
  chemically synthesized
aaaacgcaatgcttaatttaac

SEQ ID NO: 1366849 - DNA, 22 bp, Artificial Sequence
  chemically synthesized
taaaacgcaatgcttaatttaa

SEQ ID NO: 1366850 - DNA, 22 bp, Artificial Sequence
  chemically synthesized
ttaaaacgcaatgcttaattta

SEQ ID NO: 1366851 - DNA, 22 bp, Artificial Sequence
  chemically synthesized
tttaaaacgcaatgcttaattt

SEQ ID NO: 1366852 - DNA, 22 bp, Artificial Sequence
  chemically synthesized
tcatttaggttaaattaagcat

SEQ ID NO: 1366853 - DNA, 22 bp, Artificial Sequence
  chemically synthesized
aggttaaattaagcattgcgtt

SEQ ID NO: 1366854 - DNA, 22 bp, Artificial Sequence
  chemically synthesized
ggttaaattaagcattgcgttt

SEQ ID NO: 1366855 - DNA, 22 bp, Artificial Sequence
  chemically synthesized
ggagcagctttttaaaacgcaa

SEQ ID NO: 1366856 - DNA, 22 bp, Artificial Sequence
  chemically synthesized
gggagcagctttttaaaacgca

SEQ ID NO: 1366857 - DNA, 22 bp, Artificial Sequence
  chemically synthesized
aattaagcattgcgttttaaaa

SEQ ID NO: 1366858 - DNA, 22 bp, Artificial Sequence
  chemically synthesized
agcattgcgttttaaaaagctg

SEQ ID NO: 1366859 - DNA, 22 bp, Artificial Sequence
  chemically synthesized
gtgtatgcgtttgggagcagct

SEQ ID NO: 1366860 - DNA, 22 bp, Artificial Sequence
  chemically synthesized
cgttttaaaaagctgctcccaa

SEQ ID NO: 1366861 - DNA, 22 bp, Artificial Sequence
  chemically synthesized
tctagtgtatgcgtttgggagc

SEQ ID NO: 1366862 - DNA, 22 bp, Artificial Sequence
  chemically synthesized
gtctagtgtatgcgtttgggag

SEQ ID NO: 1366863 - DNA, 22 bp, Artificial Sequence
  chemically synthesized
taaaaagctgctcccaaacgca

SEQ ID NO: 1366864 - DNA, 22 bp, Artificial Sequence
  chemically synthesized
aaaaagctgctcccaaacgcat

SEQ ID NO: 1366865 - DNA, 22 bp, Artificial Sequence
  chemically synthesized
aaaagctgctcccaaacgcata

SEQ ID NO: 1366866 - DNA, 22 bp, Artificial Sequence
  chemically synthesized
atcttgtctagtgtatgcgttt

SEQ ID NO: 1366867 - DNA, 22 bp, Artificial Sequence
  chemically synthesized
catcttgtctagtgtatgcgtt

SEQ ID NO: 1366868 - DNA, 22 bp, Artificial Sequence
  chemically synthesized
tcatcttgtctagtgtatgcgt

SEQ ID NO: 1366869 - DNA, 22 bp, Artificial Sequence
  chemically synthesized
ttcatcttgtctagtgtatgcg

SEQ ID NO: 1366870 - DNA, 22 bp, Artificial Sequence
  chemically synthesized
ctcccaaacgcatacactagac

SEQ ID NO: 1366871 - DNA, 22 bp, Artificial Sequence
  chemically synthesized
agacttttcatcttgtctagtg

SEQ ID NO: 1366872 - DNA, 22 bp, Artificial Sequence
  chemically synthesized
ccaaacgcatacactagacaag

SEQ ID NO: 1366873 - DNA, 22 bp, Artificial Sequence
  chemically synthesized
atctgagacttttcatcttgtc

SEQ ID NO: 1366874 - DNA, 22 bp, Artificial Sequence
  chemically synthesized
ttgatctgagacttttcatctt

SEQ ID NO: 1366875 - DNA, 22 bp, Artificial Sequence
  chemically synthesized
attattgatctgagacttttca

SEQ ID NO: 1366876 - DNA, 22 bp, Artificial Sequence
  chemically synthesized
gattattgatctgagacttttc

SEQ ID NO: 1366877 - DNA, 22 bp, Artificial Sequence
  chemically synthesized
tgattattgatctgagactttt

SEQ ID NO: 1366878 - DNA, 22 bp, Artificial Sequence
  chemically synthesized
gacaagatgaaaagtctcagat

SEQ ID NO: 1366879 - DNA, 22 bp, Artificial Sequence
  chemically synthesized
agatgagaactttgattattga

SEQ ID NO: 1366880 - DNA, 22 bp, Artificial Sequence
  chemically synthesized
gagatgagaactttgattattg

SEQ ID NO: 1366881 - DNA, 22 bp, Artificial Sequence
  chemically synthesized
ttgagatgagaactttgattat

SEQ ID NO: 1366882 - DNA, 22 bp, Artificial Sequence
  chemically synthesized
cttgagatgagaactttgatta

SEQ ID NO: 1366883 - DNA, 22 bp, Artificial Sequence
  chemically synthesized
ttcttgagatgagaactttgat

SEQ ID NO: 1366884 - DNA, 22 bp, Artificial Sequence
  chemically synthesized
cttcttgagatgagaactttga

SEQ ID NO: 1366885 - DNA, 22 bp, Artificial Sequence
  chemically synthesized
tcttcttgagatgagaactttg

SEQ ID NO: 1366886 - DNA, 22 bp, Artificial Sequence
  chemically synthesized
agatcaataatcaaagttctca

SEQ ID NO: 1366887 - DNA, 22 bp, Artificial Sequence
  chemically synthesized
ttttcttcttgagatgagaact

SEQ ID NO: 1366888 - DNA, 22 bp, Artificial Sequence
  chemically synthesized
ttattttcttcttgagatgaga

SEQ ID NO: 1366889 - DNA, 22 bp, Artificial Sequence
  chemically synthesized
attattttcttcttgagatgag

SEQ ID NO: 1366890 - DNA, 22 bp, Artificial Sequence
  chemically synthesized
tattattttcttcttgagatga

SEQ ID NO: 1366891 - DNA, 22 bp, Artificial Sequence
  chemically synthesized
tttattattttcttcttgagat

SEQ ID NO: 1366892 - DNA, 22 bp, Artificial Sequence
  chemically synthesized
ctctttattattttcttcttga

SEQ ID NO: 1366893 - DNA, 22 bp, Artificial Sequence
  chemically synthesized
actctttattattttcttcttg

SEQ ID NO: 1366894 - DNA, 22 bp, Artificial Sequence
  chemically synthesized
tactctttattattttcttctt

SEQ ID NO: 1366895 - DNA, 22 bp, Artificial Sequence
  chemically synthesized
ttactctttattattttcttct

SEQ ID NO: 1366896 - DNA, 22 bp, Artificial Sequence
  chemically synthesized
tcatctcaagaagaaaataata

SEQ ID NO: 1366897 - DNA, 22 bp, Artificial Sequence
  chemically synthesized
gtttttactctttattattttc

SEQ ID NO: 1366898 - DNA, 22 bp, Artificial Sequence
  chemically synthesized
atctcaagaagaaaataataaa

SEQ ID NO: 1366899 - DNA, 22 bp, Artificial Sequence
  chemically synthesized
attagtttttactctttattat

SEQ ID NO: 1366900 - DNA, 22 bp, Artificial Sequence
  chemically synthesized
gattagtttttactctttatta

SEQ ID NO: 1366901 - DNA, 22 bp, Artificial Sequence
  chemically synthesized
tgattagtttttactctttatt

SEQ ID NO: 1366902 - DNA, 22 bp, Artificial Sequence
  chemically synthesized
aagaagaaaataataaagagta

SEQ ID NO: 1366903 - DNA, 22 bp, Artificial Sequence
  chemically synthesized
ttttgattagtttttactcttt

SEQ ID NO: 1366904 - DNA, 22 bp, Artificial Sequence
  chemically synthesized
attttgattagtttttactctt

SEQ ID NO: 1366905 - DNA, 22 bp, Artificial Sequence
  chemically synthesized
tattttgattagtttttactct

SEQ ID NO: 1366906 - DNA, 22 bp, Artificial Sequence
  chemically synthesized
ttattttgattagtttttactc

SEQ ID NO: 1366907 - DNA, 22 bp, Artificial Sequence
  chemically synthesized
tttttattttgattagttttta

SEQ ID NO: 1366908 - DNA, 22 bp, Artificial Sequence
  chemically synthesized
tgtttttattttgattagtttt

SEQ ID NO: 1366909 - DNA, 22 bp, Artificial Sequence
  chemically synthesized
ctgtttttattttgattagttt

SEQ ID NO: 1366910 - DNA, 22 bp, Artificial Sequence
  chemically synthesized
tctgtttttattttgattagtt

SEQ ID NO: 1366911 - DNA, 22 bp, Artificial Sequence
  chemically synthesized
ttctgtttttattttgattagt

SEQ ID NO: 1366912 - DNA, 22 bp, Artificial Sequence
  chemically synthesized
tttttctgtttttattttgatt

SEQ ID NO: 1366913 - DNA, 22 bp, Artificial Sequence
  chemically synthesized
ctgtttttctgtttttattttg

SEQ ID NO: 1366914 - DNA, 22 bp, Artificial Sequence
  chemically synthesized
actgtttttctgtttttatttt

SEQ ID NO: 1366915 - DNA, 22 bp, Artificial Sequence
  chemically synthesized
tactgtttttctgtttttattt

SEQ ID NO: 1366916 - DNA, 22 bp, Artificial Sequence
  chemically synthesized
tttactgtttttctgtttttat

SEQ ID NO: 1366917 - DNA, 22 bp, Artificial Sequence
  chemically synthesized
ctttactgtttttctgttttta

SEQ ID NO: 1366918 - DNA, 22 bp, Artificial Sequence
  chemically synthesized
atcaaaataaaaacagaaaaac

SEQ ID NO: 1366919 - DNA, 22 bp, Artificial Sequence
  chemically synthesized
atgaatcttctttactgttttt

SEQ ID NO: 1366920 - DNA, 22 bp, Artificial Sequence
  chemically synthesized
ttaatgaatcttctttactgtt

SEQ ID NO: 1366921 - DNA, 22 bp, Artificial Sequence
  chemically synthesized
gttaatgaatcttctttactgt

SEQ ID NO: 1366922 - DNA, 22 bp, Artificial Sequence
  chemically synthesized
tgttaatgaatcttctttactg

SEQ ID NO: 1366923 - DNA, 22 bp, Artificial Sequence
  chemically synthesized
tttgttaatgaatcttctttac

SEQ ID NO: 1366924 - DNA, 22 bp, Artificial Sequence
  chemically synthesized
aaaaaatagctctttgttaatg

SEQ ID NO: 1366925 - DNA, 22 bp, Artificial Sequence
  chemically synthesized
gaaaaaatagctctttgttaat

SEQ ID NO: 1366926 - DNA, 22 bp, Artificial Sequence
  chemically synthesized
tgaaaaaatagctctttgttaa

SEQ ID NO: 1366927 - DNA, 22 bp, Artificial Sequence
  chemically synthesized
accgttttgaaaaaatagctct

SEQ ID NO: 1366928 - DNA, 22 bp, Artificial Sequence
  chemically synthesized
ttgaccgttttgaaaaaatagc

SEQ ID NO: 1366929 - DNA, 22 bp, Artificial Sequence
  chemically synthesized
attaacaaagagctattttttc

SEQ ID NO: 1366930 - DNA, 22 bp, Artificial Sequence
  chemically synthesized
attgaccgttttgaaaaaatag

SEQ ID NO: 1366931 - DNA, 22 bp, Artificial Sequence
  chemically synthesized
tattgaccgttttgaaaaaata

SEQ ID NO: 1366932 - DNA, 22 bp, Artificial Sequence
  chemically synthesized
acaaagagctattttttcaaaa

SEQ ID NO: 1366933 - DNA, 22 bp, Artificial Sequence
  chemically synthesized
tcaattttattgaccgttttga

SEQ ID NO: 1366934 - DNA, 22 bp, Artificial Sequence
  chemically synthesized
ttttttcaaaacggtcaataaa

SEQ ID NO: 1366935 - DNA, 22 bp, Artificial Sequence
  chemically synthesized
gcacattgtcaattttattgac

SEQ ID NO: 1366936 - DNA, 22 bp, Artificial Sequence
  chemically synthesized
agcacattgtcaattttattga

SEQ ID NO: 1366937 - DNA, 22 bp, Artificial Sequence
  chemically synthesized
tttcaaaacggtcaataaaatt

SEQ ID NO: 1366938 - DNA, 22 bp, Artificial Sequence
  chemically synthesized
tagcacattgtcaattttattg

SEQ ID NO: 1366939 - DNA, 22 bp, Artificial Sequence
  chemically synthesized
ttcaaaacggtcaataaaattg

SEQ ID NO: 1366940 - DNA, 22 bp, Artificial Sequence
  chemically synthesized
ttagcacattgtcaattttatt

SEQ ID NO: 1366941 - DNA, 22 bp, Artificial Sequence
  chemically synthesized
tcaaaacggtcaataaaattga

SEQ ID NO: 1366942 - DNA, 22 bp, Artificial Sequence
  chemically synthesized
caaaacggtcaataaaattgac

SEQ ID NO: 1366943 - DNA, 22 bp, Artificial Sequence
  chemically synthesized
aaaacggtcaataaaattgaca

SEQ ID NO: 1366944 - DNA, 22 bp, Artificial Sequence
  chemically synthesized
tcacttttagcacattgtcaat

SEQ ID NO: 1366945 - DNA, 22 bp, Artificial Sequence
  chemically synthesized
gtcacttttagcacattgtcaa

SEQ ID NO: 1366946 - DNA, 22 bp, Artificial Sequence
  chemically synthesized
tgtcacttttagcacattgtca

SEQ ID NO: 1366947 - DNA, 22 bp, Artificial Sequence
  chemically synthesized
tttgtcacttttagcacattgt

SEQ ID NO: 1366948 - DNA, 22 bp, Artificial Sequence
  chemically synthesized
ctttgtcacttttagcacattg

SEQ ID NO: 1366949 - DNA, 22 bp, Artificial Sequence
  chemically synthesized
tctttgtcacttttagcacatt

SEQ ID NO: 1366950 - DNA, 22 bp, Artificial Sequence
  chemically synthesized
ttctttgtcacttttagcacat

SEQ ID NO: 1366951 - DNA, 22 bp, Artificial Sequence
  chemically synthesized
tttctttgtcacttttagcaca

SEQ ID NO: 1366952 - DNA, 22 bp, Artificial Sequence
  chemically synthesized
aattttttctttgtcactttta

SEQ ID NO: 1366953 - DNA, 22 bp, Artificial Sequence
  chemically synthesized
tcaattttttctttgtcacttt

SEQ ID NO: 1366954 - DNA, 22 bp, Artificial Sequence
  chemically synthesized
acaatgtgctaaaagtgacaaa

SEQ ID NO: 1366955 - DNA, 22 bp, Artificial Sequence
  chemically synthesized
tgtcctctcaattttttctttg

SEQ ID NO: 1366956 - DNA, 22 bp, Artificial Sequence
  chemically synthesized
gtgtcctctcaattttttcttt

SEQ ID NO: 1366957 - DNA, 22 bp, Artificial Sequence
  chemically synthesized
aaagtgacaaagaaaaaattga

SEQ ID NO: 1366958 - DNA, 22 bp, Artificial Sequence
  chemically synthesized
atacgggtaacttgtgtcctct

SEQ ID NO: 1366959 - DNA, 22 bp, Artificial Sequence
  chemically synthesized
tgatacgggtaacttgtgtcct

SEQ ID NO: 1366960 - DNA, 22 bp, Artificial Sequence
  chemically synthesized
ctgatacgggtaacttgtgtcc

SEQ ID NO: 1366961 - DNA, 22 bp, Artificial Sequence
  chemically synthesized
atttctgatacgggtaacttgt

SEQ ID NO: 1366962 - DNA, 22 bp, Artificial Sequence
  chemically synthesized
catttctgatacgggtaacttg

SEQ ID NO: 1366963 - DNA, 22 bp, Artificial Sequence
  chemically synthesized
cttcatttctgatacgggtaac

SEQ ID NO: 1366964 - DNA, 22 bp, Artificial Sequence
  chemically synthesized
agaggacacaagttacccgtat

SEQ ID NO: 1366965 - DNA, 22 bp, Artificial Sequence
  chemically synthesized
cctacttcatttctgatacggg

SEQ ID NO: 1366966 - DNA, 22 bp, Artificial Sequence
  chemically synthesized
tagtaatattccctacttcatt

SEQ ID NO: 1366967 - DNA, 22 bp, Artificial Sequence
  chemically synthesized
cccgtatcagaaatgaagtagg

SEQ ID NO: 1366968 - DNA, 22 bp, Artificial Sequence
  chemically synthesized
caggcctgtagtaatattccct

SEQ ID NO: 1366969 - DNA, 22 bp, Artificial Sequence
  chemically synthesized
ccaggcctgtagtaatattccc

SEQ ID NO: 1366970 - DNA, 22 bp, Artificial Sequence
  chemically synthesized
tccaggcctgtagtaatattcc

SEQ ID NO: 1366971 - DNA, 22 bp, Artificial Sequence
  chemically synthesized
tattttccaggcctgtagtaat

SEQ ID NO: 1366972 - DNA, 22 bp, Artificial Sequence
  chemically synthesized
gtattttccaggcctgtagtaa

SEQ ID NO: 1366973 - DNA, 22 bp, Artificial Sequence
  chemically synthesized
tgtattttccaggcctgtagta

SEQ ID NO: 1366974 - DNA, 22 bp, Artificial Sequence
  chemically synthesized
tttgtattttccaggcctgtag

SEQ ID NO: 1366975 - DNA, 22 bp, Artificial Sequence
  chemically synthesized
ctttgtattttccaggcctgta

SEQ ID NO: 1366976 - DNA, 22 bp, Artificial Sequence
  chemically synthesized
tctttgtattttccaggcctgt

SEQ ID NO: 1366977 - DNA, 22 bp, Artificial Sequence
  chemically synthesized
ttctttgtattttccaggcctg

SEQ ID NO: 1366978 - DNA, 22 bp, Artificial Sequence
  chemically synthesized
tttctttgtattttccaggcct

SEQ ID NO: 1366979 - DNA, 22 bp, Artificial Sequence
  chemically synthesized
ttttctttgtattttccaggcc

SEQ ID NO: 1366980 - DNA, 22 bp, Artificial Sequence
  chemically synthesized
tttttctttgtattttccaggc

SEQ ID NO: 1366981 - DNA, 22 bp, Artificial Sequence
  chemically synthesized
ttttttctttgtattttccagg

SEQ ID NO: 1366982 - DNA, 22 bp, Artificial Sequence
  chemically synthesized
tttttttctttgtattttccag

SEQ ID NO: 1366983 - DNA, 22 bp, Artificial Sequence
  chemically synthesized
ctacaggcctggaaaatacaaa

SEQ ID NO: 1366984 - DNA, 22 bp, Artificial Sequence
  chemically synthesized
tctttttttttctttgtatttt

SEQ ID NO: 1366985 - DNA, 22 bp, Artificial Sequence
  chemically synthesized
caggcctggaaaatacaaagaa

SEQ ID NO: 1366986 - DNA, 22 bp, Artificial Sequence
  chemically synthesized
ctgtctttttttttctttgtat

SEQ ID NO: 1366987 - DNA, 22 bp, Artificial Sequence
  chemically synthesized
actgtctttttttttctttgta

SEQ ID NO: 1366988 - DNA, 22 bp, Artificial Sequence
  chemically synthesized
gaaaatacaaagaaaaaaaaag

SEQ ID NO: 1366989 - DNA, 22 bp, Artificial Sequence
  chemically synthesized
atagtaaacccttactgtcttt

SEQ ID NO: 1366990 - DNA, 22 bp, Artificial Sequence
  chemically synthesized
ttcatagtaaacccttactgtc

SEQ ID NO: 1366991 - DNA, 22 bp, Artificial Sequence
  chemically synthesized
tgtgaagaattgttcatagtaa

SEQ ID NO: 1366992 - DNA, 22 bp, Artificial Sequence
  chemically synthesized
atgtgaagaattgttcatagta

SEQ ID NO: 1366993 - DNA, 22 bp, Artificial Sequence
  chemically synthesized
aatacttatgtgaagaattgtt

SEQ ID NO: 1366994 - DNA, 22 bp, Artificial Sequence
  chemically synthesized
ttaaatacttatgtgaagaatt

SEQ ID NO: 1366995 - DNA, 22 bp, Artificial Sequence
  chemically synthesized
actatgaacaattcttcacata

SEQ ID NO: 1366996 - DNA, 22 bp, Artificial Sequence
  chemically synthesized
ctatgaacaattcttcacataa

SEQ ID NO: 1366997 - DNA, 22 bp, Artificial Sequence
  chemically synthesized
aattattaaatacttatgtgaa

SEQ ID NO: 1366998 - DNA, 22 bp, Artificial Sequence
  chemically synthesized
tgaacaattcttcacataagta

SEQ ID NO: 1366999 - DNA, 22 bp, Artificial Sequence
  chemically synthesized
atctaaattattaaatacttat

SEQ ID NO: 1367000 - DNA, 22 bp, Artificial Sequence
  chemically synthesized
catctaaattattaaatactta

SEQ ID NO: 1367001 - DNA, 22 bp, Artificial Sequence
  chemically synthesized
tttcatctaaattattaaatac

SEQ ID NO: 1367002 - DNA, 22 bp, Artificial Sequence
  chemically synthesized
ttcacataagtatttaataatt

SEQ ID NO: 1367003 - DNA, 22 bp, Artificial Sequence
  chemically synthesized
cacataagtatttaataattta

SEQ ID NO: 1367004 - DNA, 22 bp, Artificial Sequence
  chemically synthesized
acataagtatttaataatttag

SEQ ID NO: 1367005 - DNA, 22 bp, Artificial Sequence
  chemically synthesized
aagaatcaatctatttcatcta

SEQ ID NO: 1367006 - DNA, 22 bp, Artificial Sequence
  chemically synthesized
gaagaatcaatctatttcatct

SEQ ID NO: 1367007 - DNA, 22 bp, Artificial Sequence
  chemically synthesized
tgaagaatcaatctatttcatc

SEQ ID NO: 1367008 - DNA, 22 bp, Artificial Sequence
  chemically synthesized
ttgaagaatcaatctatttcat

SEQ ID NO: 1367009 - DNA, 22 bp, Artificial Sequence
  chemically synthesized
aataatttagatgaaatagatt

SEQ ID NO: 1367010 - DNA, 22 bp, Artificial Sequence
  chemically synthesized
ataatttagatgaaatagattg

SEQ ID NO: 1367011 - DNA, 22 bp, Artificial Sequence
  chemically synthesized
tgccttttgaagaatcaatcta

SEQ ID NO: 1367012 - DNA, 22 bp, Artificial Sequence
  chemically synthesized
gtgccttttgaagaatcaatct

SEQ ID NO: 1367013 - DNA, 22 bp, Artificial Sequence
  chemically synthesized
agatgaaatagattgattcttc

SEQ ID NO: 1367014 - DNA, 22 bp, Artificial Sequence
  chemically synthesized
gatgaaatagattgattcttca

SEQ ID NO: 1367015 - DNA, 22 bp, Artificial Sequence
  chemically synthesized
cagtagtttgtgccttttgaag

SEQ ID NO: 1367016 - DNA, 22 bp, Artificial Sequence
  chemically synthesized
acagtagtttgtgccttttgaa

SEQ ID NO: 1367017 - DNA, 22 bp, Artificial Sequence
  chemically synthesized
atttacagtagtttgtgccttt

SEQ ID NO: 1367018 - DNA, 22 bp, Artificial Sequence
  chemically synthesized
attcttcaaaaggcacaaacta

SEQ ID NO: 1367019 - DNA, 22 bp, Artificial Sequence
  chemically synthesized
attgatttacagtagtttgtgc

SEQ ID NO: 1367020 - DNA, 22 bp, Artificial Sequence
  chemically synthesized
ttcaaaaggcacaaactactgt

SEQ ID NO: 1367021 - DNA, 22 bp, Artificial Sequence
  chemically synthesized
tattcattgatttacagtagtt

SEQ ID NO: 1367022 - DNA, 22 bp, Artificial Sequence
  chemically synthesized
caaaaggcacaaactactgtaa

SEQ ID NO: 1367023 - DNA, 22 bp, Artificial Sequence
  chemically synthesized
atattcattgatttacagtagt

SEQ ID NO: 1367024 - DNA, 22 bp, Artificial Sequence
  chemically synthesized
aaaaggcacaaactactgtaaa

SEQ ID NO: 1367025 - DNA, 22 bp, Artificial Sequence
  chemically synthesized
tatattcattgatttacagtag

SEQ ID NO: 1367026 - DNA, 22 bp, Artificial Sequence
  chemically synthesized
tccattttatattcattgattt

SEQ ID NO: 1367027 - DNA, 22 bp, Artificial Sequence
  chemically synthesized
aaattatccattttatattcat

SEQ ID NO: 1367028 - DNA, 22 bp, Artificial Sequence
  chemically synthesized
ctgtaaatcaatgaatataaaa

SEQ ID NO: 1367029 - DNA, 22 bp, Artificial Sequence
  chemically synthesized
taaatcaatgaatataaaatgg

SEQ ID NO: 1367030 - DNA, 22 bp, Artificial Sequence
  chemically synthesized
ggccattcaaattatccatttt

SEQ ID NO: 1367031 - DNA, 22 bp, Artificial Sequence
  chemically synthesized
aatagccaaagtctaggccatt

SEQ ID NO: 1367032 - DNA, 22 bp, Artificial Sequence
  chemically synthesized
ttaaatagccaaagtctaggcc

SEQ ID NO: 1367033 - DNA, 22 bp, Artificial Sequence
  chemically synthesized
ctattaaatagccaaagtctag

SEQ ID NO: 1367034 - DNA, 22 bp, Artificial Sequence
  chemically synthesized
gaatggcctagactttggctat

SEQ ID NO: 1367035 - DNA, 22 bp, Artificial Sequence
  chemically synthesized
aatggcctagactttggctatt

SEQ ID NO: 1367036 - DNA, 22 bp, Artificial Sequence
  chemically synthesized
gtatatccaaattactattaaa

SEQ ID NO: 1367037 - DNA, 22 bp, Artificial Sequence
  chemically synthesized
gactttggctatttaatagtaa

SEQ ID NO: 1367038 - DNA, 22 bp, Artificial Sequence
  chemically synthesized
tctagtatatccaaattactat

SEQ ID NO: 1367039 - DNA, 22 bp, Artificial Sequence
  chemically synthesized
tggctatttaatagtaatttgg

SEQ ID NO: 1367040 - DNA, 22 bp, Artificial Sequence
  chemically synthesized
ggctatttaatagtaatttgga

SEQ ID NO: 1367041 - DNA, 22 bp, Artificial Sequence
  chemically synthesized
gctatttaatagtaatttggat

SEQ ID NO: 1367042 - DNA, 22 bp, Artificial Sequence
  chemically synthesized
attatctagtatatccaaatta

SEQ ID NO: 1367043 - DNA, 22 bp, Artificial Sequence
  chemically synthesized
tttaatagtaatttggatatac

SEQ ID NO: 1367044 - DNA, 22 bp, Artificial Sequence
  chemically synthesized
tactcattatctagtatatcca

SEQ ID NO: 1367045 - DNA, 22 bp, Artificial Sequence
  chemically synthesized
aatagtaatttggatatactag

SEQ ID NO: 1367046 - DNA, 22 bp, Artificial Sequence
  chemically synthesized
atagtaatttggatatactaga

SEQ ID NO: 1367047 - DNA, 22 bp, Artificial Sequence
  chemically synthesized
acagttatactcattatctagt

SEQ ID NO: 1367048 - DNA, 22 bp, Artificial Sequence
  chemically synthesized
aacagttatactcattatctag

SEQ ID NO: 1367049 - DNA, 22 bp, Artificial Sequence
  chemically synthesized
cttaacagttatactcattatc

SEQ ID NO: 1367050 - DNA, 22 bp, Artificial Sequence
  chemically synthesized
ccttaacagttatactcattat

SEQ ID NO: 1367051 - DNA, 22 bp, Artificial Sequence
  chemically synthesized
ggatatactagataatgagtat

SEQ ID NO: 1367052 - DNA, 22 bp, Artificial Sequence
  chemically synthesized
gatatactagataatgagtata

SEQ ID NO: 1367053 - DNA, 22 bp, Artificial Sequence
  chemically synthesized
tatttccttaacagttatactc

SEQ ID NO: 1367054 - DNA, 22 bp, Artificial Sequence
  chemically synthesized
gataatgagtataactgttaag

SEQ ID NO: 1367055 - DNA, 22 bp, Artificial Sequence
  chemically synthesized
tgagttatatttccttaacagt

SEQ ID NO: 1367056 - DNA, 22 bp, Artificial Sequence
  chemically synthesized
aattatgagttatatttcctta

SEQ ID NO: 1367057 - DNA, 22 bp, Artificial Sequence
  chemically synthesized
aaattatgagttatatttcctt

SEQ ID NO: 1367058 - DNA, 22 bp, Artificial Sequence
  chemically synthesized
taaattatgagttatatttcct

SEQ ID NO: 1367059 - DNA, 22 bp, Artificial Sequence
  chemically synthesized
ttaaattatgagttatatttcc

SEQ ID NO: 1367060 - DNA, 22 bp, Artificial Sequence
  chemically synthesized
ttaaggaaatataactcataat

SEQ ID NO: 1367061 - DNA, 22 bp, Artificial Sequence
  chemically synthesized
tagaagtttttaaattatgagt

SEQ ID NO: 1367062 - DNA, 22 bp, Artificial Sequence
  chemically synthesized
gtagaagtttttaaattatgag

SEQ ID NO: 1367063 - DNA, 22 bp, Artificial Sequence
  chemically synthesized
aggaaatataactcataattta

SEQ ID NO: 1367064 - DNA, 22 bp, Artificial Sequence
  chemically synthesized
tgtagaagtttttaaattatga

SEQ ID NO: 1367065 - DNA, 22 bp, Artificial Sequence
  chemically synthesized
ttgtagaagtttttaaattatg

SEQ ID NO: 1367066 - DNA, 22 bp, Artificial Sequence
  chemically synthesized
cttttgtagaagtttttaaatt

SEQ ID NO: 1367067 - DNA, 22 bp, Artificial Sequence
  chemically synthesized
gcttttgtagaagtttttaaat

SEQ ID NO: 1367068 - DNA, 22 bp, Artificial Sequence
  chemically synthesized
ataatttaaaaacttctacaaa

SEQ ID NO: 1367069 - DNA, 22 bp, Artificial Sequence
  chemically synthesized
tagaagtttgcttttgtagaag

SEQ ID NO: 1367070 - DNA, 22 bp, Artificial Sequence
  chemically synthesized
aaaaacttctacaaaagcaaac

SEQ ID NO: 1367071 - DNA, 22 bp, Artificial Sequence
  chemically synthesized
aaaacttctacaaaagcaaact

SEQ ID NO: 1367072 - DNA, 22 bp, Artificial Sequence
  chemically synthesized
caatgcagttatagaagtttgc

SEQ ID NO: 1367073 - DNA, 22 bp, Artificial Sequence
  chemically synthesized
ccaatgcagttatagaagtttg

SEQ ID NO: 1367074 - DNA, 22 bp, Artificial Sequence
  chemically synthesized
tccaatgcagttatagaagttt

SEQ ID NO: 1367075 - DNA, 22 bp, Artificial Sequence
  chemically synthesized
ttccaatgcagttatagaagtt

SEQ ID NO: 1367076 - DNA, 22 bp, Artificial Sequence
  chemically synthesized
ctacaaaagcaaacttctataa

SEQ ID NO: 1367077 - DNA, 22 bp, Artificial Sequence
  chemically synthesized
tacaaaagcaaacttctataac

SEQ ID NO: 1367078 - DNA, 22 bp, Artificial Sequence
  chemically synthesized
caaaagcaaacttctataactg

SEQ ID NO: 1367079 - DNA, 22 bp, Artificial Sequence
  chemically synthesized
gcatacttttccaatgcagtta

SEQ ID NO: 1367080 - DNA, 22 bp, Artificial Sequence
  chemically synthesized
ctataactgcattggaaaagta

SEQ ID NO: 1367081 - DNA, 22 bp, Artificial Sequence
  chemically synthesized
acaagattggcatacttttcca

SEQ ID NO: 1367082 - DNA, 22 bp, Artificial Sequence
  chemically synthesized
tataactgcattggaaaagtat

SEQ ID NO: 1367083 - DNA, 22 bp, Artificial Sequence
  chemically synthesized
cacaagattggcatacttttcc

SEQ ID NO: 1367084 - DNA, 22 bp, Artificial Sequence
  chemically synthesized
taactgcattggaaaagtatgc

SEQ ID NO: 1367085 - DNA, 22 bp, Artificial Sequence
  chemically synthesized
ttcacaagattggcatactttt

SEQ ID NO: 1367086 - DNA, 22 bp, Artificial Sequence
  chemically synthesized
attcttcacaagattggcatac

SEQ ID NO: 1367087 - DNA, 22 bp, Artificial Sequence
  chemically synthesized
cattggaaaagtatgccaatct

SEQ ID NO: 1367088 - DNA, 22 bp, Artificial Sequence
  chemically synthesized
gtgttaattcttcacaagattg

SEQ ID NO: 1367089 - DNA, 22 bp, Artificial Sequence
  chemically synthesized
gaaaagtatgccaatcttgtga

SEQ ID NO: 1367090 - DNA, 22 bp, Artificial Sequence
  chemically synthesized
gtgaagaattaacaccaattct

SEQ ID NO: 1367091 - DNA, 22 bp, Artificial Sequence
  chemically synthesized
tgaagaattaacaccaattcta

SEQ ID NO: 1367092 - DNA, 22 bp, Artificial Sequence
  chemically synthesized
gaaaagaatgtgtagaattggt

SEQ ID NO: 1367093 - DNA, 22 bp, Artificial Sequence
  chemically synthesized
tggaaaagaatgtgtagaattg

SEQ ID NO: 1367094 - DNA, 22 bp, Artificial Sequence
  chemically synthesized
catgttctggaaaagaatgtgt

SEQ ID NO: 1367095 - DNA, 22 bp, Artificial Sequence
  chemically synthesized
acaccaattctacacattcttt

SEQ ID NO: 1367096 - DNA, 22 bp, Artificial Sequence
  chemically synthesized
ccatgttctggaaaagaatgtg

SEQ ID NO: 1367097 - DNA, 22 bp, Artificial Sequence
  chemically synthesized
ccttccatgttctggaaaagaa

SEQ ID NO: 1367098 - DNA, 22 bp, Artificial Sequence
  chemically synthesized
cccttccatgttctggaaaaga

SEQ ID NO: 1367099 - DNA, 22 bp, Artificial Sequence
  chemically synthesized
ttcccttccatgttctggaaaa

SEQ ID NO: 1367100 - DNA, 22 bp, Artificial Sequence
  chemically synthesized
cttcccttccatgttctggaaa

SEQ ID NO: 1367101 - DNA, 22 bp, Artificial Sequence
  chemically synthesized
tcttcccttccatgttctggaa

SEQ ID NO: 1367102 - DNA, 22 bp, Artificial Sequence
  chemically synthesized
tacacattcttttccagaacat

SEQ ID NO: 1367103 - DNA, 22 bp, Artificial Sequence
  chemically synthesized
cacattcttttccagaacatgg

SEQ ID NO: 1367104 - DNA, 22 bp, Artificial Sequence
  chemically synthesized
ttttcttcccttccatgttctg

SEQ ID NO: 1367105 - DNA, 22 bp, Artificial Sequence
  chemically synthesized
ttttccagaacatggaagggaa

SEQ ID NO: 1367106 - DNA, 22 bp, Artificial Sequence
  chemically synthesized
agaattgttttcttcccttcca

SEQ ID NO: 1367107 - DNA, 22 bp, Artificial Sequence
  chemically synthesized
ttccagaacatggaagggaaga

SEQ ID NO: 1367108 - DNA, 22 bp, Artificial Sequence
  chemically synthesized
tccagaacatggaagggaagaa

SEQ ID NO: 1367109 - DNA, 22 bp, Artificial Sequence
  chemically synthesized
ccagaacatggaagggaagaaa

SEQ ID NO: 1367110 - DNA, 22 bp, Artificial Sequence
  chemically synthesized
cagaacatggaagggaagaaaa

SEQ ID NO: 1367111 - DNA, 22 bp, Artificial Sequence
  chemically synthesized
aacacatatactcagaattgtt

SEQ ID NO: 1367112 - DNA, 22 bp, Artificial Sequence
  chemically synthesized
gactcaacacatatactcagaa

SEQ ID NO: 1367113 - DNA, 22 bp, Artificial Sequence
  chemically synthesized
ctggactcaacacatatactca

SEQ ID NO: 1367114 - DNA, 22 bp, Artificial Sequence
  chemically synthesized
ttgctggactcaacacatatac

SEQ ID NO: 1367115 - DNA, 22 bp, Artificial Sequence
  chemically synthesized
tgagtatatgtgttgagtccag

SEQ ID NO: 1367116 - DNA, 22 bp, Artificial Sequence
  chemically synthesized
agtatatgtgttgagtccagca

SEQ ID NO: 1367117 - DNA, 22 bp, Artificial Sequence
  chemically synthesized
ggtatcaggctattgctggact

SEQ ID NO: 1367118 - DNA, 22 bp, Artificial Sequence
  chemically synthesized
gggtatcaggctattgctggac

SEQ ID NO: 1367119 - DNA, 22 bp, Artificial Sequence
  chemically synthesized
gtttgggtatcaggctattgct

SEQ ID NO: 1367120 - DNA, 22 bp, Artificial Sequence
  chemically synthesized
tggtttgggtatcaggctattg

SEQ ID NO: 1367121 - DNA, 22 bp, Artificial Sequence
  chemically synthesized
ctggtttgggtatcaggctatt

SEQ ID NO: 1367122 - DNA, 22 bp, Artificial Sequence
  chemically synthesized
tctggtttgggtatcaggctat

SEQ ID NO: 1367123 - DNA, 22 bp, Artificial Sequence
  chemically synthesized
ttctggtttgggtatcaggcta

SEQ ID NO: 1367124 - DNA, 22 bp, Artificial Sequence
  chemically synthesized
agtccagcaatagcctgatacc

SEQ ID NO: 1367125 - DNA, 22 bp, Artificial Sequence
  chemically synthesized
tttttctggtttgggtatcagg

SEQ ID NO: 1367126 - DNA, 22 bp, Artificial Sequence
  chemically synthesized
tactgtttttctggtttgggta

SEQ ID NO: 1367127 - DNA, 22 bp, Artificial Sequence
  chemically synthesized
gtactgtttttctggtttgggt

SEQ ID NO: 1367128 - DNA, 22 bp, Artificial Sequence
  chemically synthesized
tgtactgtttttctggtttggg

SEQ ID NO: 1367129 - DNA, 22 bp, Artificial Sequence
  chemically synthesized
ttgtactgtttttctggtttgg

SEQ ID NO: 1367130 - DNA, 22 bp, Artificial Sequence
  chemically synthesized
ttttgtactgtttttctggttt

SEQ ID NO: 1367131 - DNA, 22 bp, Artificial Sequence
  chemically synthesized
cttttgtactgtttttctggtt

SEQ ID NO: 1367132 - DNA, 22 bp, Artificial Sequence
  chemically synthesized
ttcttttgtactgtttttctgg

SEQ ID NO: 1367133 - DNA, 22 bp, Artificial Sequence
  chemically synthesized
cttcttttgtactgtttttctg

SEQ ID NO: 1367134 - DNA, 22 bp, Artificial Sequence
  chemically synthesized
tcttcttttgtactgtttttct

SEQ ID NO: 1367135 - DNA, 22 bp, Artificial Sequence
  chemically synthesized
atacccaaaccagaaaaacagt

SEQ ID NO: 1367136 - DNA, 22 bp, Artificial Sequence
  chemically synthesized
tagttttcttcttttgtactgt

SEQ ID NO: 1367137 - DNA, 22 bp, Artificial Sequence
  chemically synthesized
atagttttcttcttttgtactg

SEQ ID NO: 1367138 - DNA, 22 bp, Artificial Sequence
  chemically synthesized
taaggaatatggatttatagtt

SEQ ID NO: 1367139 - DNA, 22 bp, Artificial Sequence
  chemically synthesized
gtaaggaatatggatttatagt

SEQ ID NO: 1367140 - DNA, 22 bp, Artificial Sequence
  chemically synthesized
atatttgtaaggaatatggatt

SEQ ID NO: 1367141 - DNA, 22 bp, Artificial Sequence
  chemically synthesized
cattaatatttgtaaggaatat

SEQ ID NO: 1367142 - DNA, 22 bp, Artificial Sequence
  chemically synthesized
ccattaatatttgtaaggaata

SEQ ID NO: 1367143 - DNA, 22 bp, Artificial Sequence
  chemically synthesized
tccattaatatttgtaaggaat

SEQ ID NO: 1367144 - DNA, 22 bp, Artificial Sequence
  chemically synthesized
taaatccatattccttacaaat

SEQ ID NO: 1367145 - DNA, 22 bp, Artificial Sequence
  chemically synthesized
ataaattttccattaatatttg

SEQ ID NO: 1367146 - DNA, 22 bp, Artificial Sequence
  chemically synthesized
tattaataaattttccattaat

SEQ ID NO: 1367147 - DNA, 22 bp, Artificial Sequence
  chemically synthesized
cttacaaatattaatggaaaat

SEQ ID NO: 1367148 - DNA, 22 bp, Artificial Sequence
  chemically synthesized
acaaatattaatggaaaattta

SEQ ID NO: 1367149 - DNA, 22 bp, Artificial Sequence
  chemically synthesized
aaattgtattaataaattttcc

SEQ ID NO: 1367150 - DNA, 22 bp, Artificial Sequence
  chemically synthesized
caaatattaatggaaaatttat

SEQ ID NO: 1367151 - DNA, 22 bp, Artificial Sequence
  chemically synthesized
tgtgctgaaattgtattaataa

SEQ ID NO: 1367152 - DNA, 22 bp, Artificial Sequence
  chemically synthesized
atgtgctgaaattgtattaata

SEQ ID NO: 1367153 - DNA, 22 bp, Artificial Sequence
  chemically synthesized
tatgtgctgaaattgtattaat

SEQ ID NO: 1367154 - DNA, 22 bp, Artificial Sequence
  chemically synthesized
atggaaaatttattaatacaat

SEQ ID NO: 1367155 - DNA, 22 bp, Artificial Sequence
  chemically synthesized
aattttatgtgctgaaattgta

SEQ ID NO: 1367156 - DNA, 22 bp, Artificial Sequence
  chemically synthesized
ctgaattttatgtgctgaaatt

SEQ ID NO: 1367157 - DNA, 22 bp, Artificial Sequence
  chemically synthesized
attaatacaatttcagcacata

SEQ ID NO: 1367158 - DNA, 22 bp, Artificial Sequence
  chemically synthesized
ttaatacaatttcagcacataa

SEQ ID NO: 1367159 - DNA, 22 bp, Artificial Sequence
  chemically synthesized
atacaatttcagcacataaaat

SEQ ID NO: 1367160 - DNA, 22 bp, Artificial Sequence
  chemically synthesized
gtacattgctgaattttatgtg

SEQ ID NO: 1367161 - DNA, 22 bp, Artificial Sequence
  chemically synthesized
cagcacataaaattcagcaatg

SEQ ID NO: 1367162 - DNA, 22 bp, Artificial Sequence
  chemically synthesized
agcacataaaattcagcaatgt

SEQ ID NO: 1367163 - DNA, 22 bp, Artificial Sequence
  chemically synthesized
agcaatgtactaatggatcact

SEQ ID NO: 1367164 - DNA, 22 bp, Artificial Sequence
  chemically synthesized
gaaataaaccccaagtgatcca

SEQ ID NO: 1367165 - DNA, 22 bp, Artificial Sequence
  chemically synthesized
catcctggaaataaaccccaag

SEQ ID NO: 1367166 - DNA, 22 bp, Artificial Sequence
  chemically synthesized
acatcctggaaataaaccccaa

SEQ ID NO: 1367167 - DNA, 22 bp, Artificial Sequence
  chemically synthesized
atggatcacttggggtttattt

SEQ ID NO: 1367168 - DNA, 22 bp, Artificial Sequence
  chemically synthesized
ggggtttatttccaggatgtaa

SEQ ID NO: 1367169 - DNA, 22 bp, Artificial Sequence
  chemically synthesized
gggtttatttccaggatgtaaa

SEQ ID NO: 1367170 - DNA, 22 bp, Artificial Sequence
  chemically synthesized
aaatatcaagccagatttacat

SEQ ID NO: 1367171 - DNA, 22 bp, Artificial Sequence
  chemically synthesized
caaatatcaagccagatttaca

SEQ ID NO: 1367172 - DNA, 22 bp, Artificial Sequence
  chemically synthesized
tcaaatatcaagccagatttac

SEQ ID NO: 1367173 - DNA, 22 bp, Artificial Sequence
  chemically synthesized
atttccaggatgtaaatctggc

SEQ ID NO: 1367174 - DNA, 22 bp, Artificial Sequence
  chemically synthesized
tttccaggatgtaaatctggct

SEQ ID NO: 1367175 - DNA, 22 bp, Artificial Sequence
  chemically synthesized
attttcaaatatcaagccagat

SEQ ID NO: 1367176 - DNA, 22 bp, Artificial Sequence
  chemically synthesized
ccaggatgtaaatctggcttga

SEQ ID NO: 1367177 - DNA, 22 bp, Artificial Sequence
  chemically synthesized
caggatgtaaatctggcttgat

SEQ ID NO: 1367178 - DNA, 22 bp, Artificial Sequence
  chemically synthesized
tagtgactaattttcaaatatc

SEQ ID NO: 1367179 - DNA, 22 bp, Artificial Sequence
  chemically synthesized
gcttgatatttgaaaattagtc

SEQ ID NO: 1367180 - DNA, 22 bp, Artificial Sequence
  chemically synthesized
gatatttgaaaattagtcacta

SEQ ID NO: 1367181 - DNA, 22 bp, Artificial Sequence
  chemically synthesized
atatttgaaaattagtcactac

SEQ ID NO: 1367182 - DNA, 22 bp, Artificial Sequence
  chemically synthesized
atatggtagattgtagtgacta

SEQ ID NO: 1367183 - DNA, 22 bp, Artificial Sequence
  chemically synthesized
ttaatatggtagattgtagtga

SEQ ID NO: 1367184 - DNA, 22 bp, Artificial Sequence
  chemically synthesized
gaaaattagtcactacaatcta

SEQ ID NO: 1367185 - DNA, 22 bp, Artificial Sequence
  chemically synthesized
aaaattagtcactacaatctac

SEQ ID NO: 1367186 - DNA, 22 bp, Artificial Sequence
  chemically synthesized
tgacctgttaatatggtagatt

SEQ ID NO: 1367187 - DNA, 22 bp, Artificial Sequence
  chemically synthesized
tatgacctgttaatatggtaga

SEQ ID NO: 1367188 - DNA, 22 bp, Artificial Sequence
  chemically synthesized
gtcactacaatctaccatatta

SEQ ID NO: 1367189 - DNA, 22 bp, Artificial Sequence
  chemically synthesized
ctctatgacctgttaatatggt

SEQ ID NO: 1367190 - DNA, 22 bp, Artificial Sequence
  chemically synthesized
cctctatgacctgttaatatgg

SEQ ID NO: 1367191 - DNA, 22 bp, Artificial Sequence
  chemically synthesized
tcctctatgacctgttaatatg

SEQ ID NO: 1367192 - DNA, 22 bp, Artificial Sequence
  chemically synthesized
ttcctctatgacctgttaatat

SEQ ID NO: 1367193 - DNA, 22 bp, Artificial Sequence
  chemically synthesized
caatctaccatattaacaggtc

SEQ ID NO: 1367194 - DNA, 22 bp, Artificial Sequence
  chemically synthesized
ccatattaacaggtcatagagg

SEQ ID NO: 1367195 - DNA, 22 bp, Artificial Sequence
  chemically synthesized
ataacatcgtgtgatttttcct

SEQ ID NO: 1367196 - DNA, 22 bp, Artificial Sequence
  chemically synthesized
acaggtcatagaggaaaaatca

SEQ ID NO: 1367197 - DNA, 22 bp, Artificial Sequence
  chemically synthesized
ctgataacatcgtgtgattttt

SEQ ID NO: 1367198 - DNA, 22 bp, Artificial Sequence
  chemically synthesized
actgataacatcgtgtgatttt

SEQ ID NO: 1367199 - DNA, 22 bp, Artificial Sequence
  chemically synthesized
gtacatttactgataacatcgt

SEQ ID NO: 1367200 - DNA, 22 bp, Artificial Sequence
  chemically synthesized
agtacatttactgataacatcg

SEQ ID NO: 1367201 - DNA, 22 bp, Artificial Sequence
  chemically synthesized
tagtacatttactgataacatc

SEQ ID NO: 1367202 - DNA, 22 bp, Artificial Sequence
  chemically synthesized
ttagtacatttactgataacat

SEQ ID NO: 1367203 - DNA, 22 bp, Artificial Sequence
  chemically synthesized
tcaaatgcttttagtacattta

SEQ ID NO: 1367204 - DNA, 22 bp, Artificial Sequence
  chemically synthesized
gtcaaatgcttttagtacattt

SEQ ID NO: 1367205 - DNA, 22 bp, Artificial Sequence
  chemically synthesized
tcagtaaatgtactaaaagcat

SEQ ID NO: 1367206 - DNA, 22 bp, Artificial Sequence
  chemically synthesized
gatatatcagtttgtcaaatgc

SEQ ID NO: 1367207 - DNA, 22 bp, Artificial Sequence
  chemically synthesized
aagattagatatatcagtttgt

SEQ ID NO: 1367208 - DNA, 22 bp, Artificial Sequence
  chemically synthesized
caagattagatatatcagtttg

SEQ ID NO: 1367209 - DNA, 22 bp, Artificial Sequence
  chemically synthesized
aaagcatttgacaaactgatat

SEQ ID NO: 1367210 - DNA, 22 bp, Artificial Sequence
  chemically synthesized
tttcaagattagatatatcagt

SEQ ID NO: 1367211 - DNA, 22 bp, Artificial Sequence
  chemically synthesized
gacaaactgatatatctaatct

SEQ ID NO: 1367212 - DNA, 22 bp, Artificial Sequence
  chemically synthesized
acaaactgatatatctaatctt

SEQ ID NO: 1367213 - DNA, 22 bp, Artificial Sequence
  chemically synthesized
agacaggttgtttcaagattag

SEQ ID NO: 1367214 - DNA, 22 bp, Artificial Sequence
  chemically synthesized
cagacaggttgtttcaagatta

SEQ ID NO: 1367215 - DNA, 22 bp, Artificial Sequence
  chemically synthesized
tcagacaggttgtttcaagatt

SEQ ID NO: 1367216 - DNA, 22 bp, Artificial Sequence
  chemically synthesized
ttcagacaggttgtttcaagat

SEQ ID NO: 1367217 - DNA, 22 bp, Artificial Sequence
  chemically synthesized
atatatctaatcttgaaacaac

SEQ ID NO: 1367218 - DNA, 22 bp, Artificial Sequence
  chemically synthesized
tttttcagacaggttgtttcaa

SEQ ID NO: 1367219 - DNA, 22 bp, Artificial Sequence
  chemically synthesized
gtcctatttttcagacaggttg

SEQ ID NO: 1367220 - DNA, 22 bp, Artificial Sequence
  chemically synthesized
agtcctatttttcagacaggtt

SEQ ID NO: 1367221 - DNA, 22 bp, Artificial Sequence
  chemically synthesized
tagtcctatttttcagacaggt

SEQ ID NO: 1367222 - DNA, 22 bp, Artificial Sequence
  chemically synthesized
atcttgaaacaacctgtctgaa

SEQ ID NO: 1367223 - DNA, 22 bp, Artificial Sequence
  chemically synthesized
ctttagtcctatttttcagaca

SEQ ID NO: 1367224 - DNA, 22 bp, Artificial Sequence
  chemically synthesized
tcctttagtcctatttttcaga

SEQ ID NO: 1367225 - DNA, 22 bp, Artificial Sequence
  chemically synthesized
gaaacaacctgtctgaaaaata

SEQ ID NO: 1367226 - DNA, 22 bp, Artificial Sequence
  chemically synthesized
aaacaacctgtctgaaaaatag

SEQ ID NO: 1367227 - DNA, 22 bp, Artificial Sequence
  chemically synthesized
aggaaattctcctttagtccta

SEQ ID NO: 1367228 - DNA, 22 bp, Artificial Sequence
  chemically synthesized
tctgaaaaataggactaaagga

SEQ ID NO: 1367229 - DNA, 22 bp, Artificial Sequence
  chemically synthesized
agttgaggaaattctcctttag

SEQ ID NO: 1367230 - DNA, 22 bp, Artificial Sequence
  chemically synthesized
aaaaataggactaaaggagaat

SEQ ID NO: 1367231 - DNA, 22 bp, Artificial Sequence
  chemically synthesized
ttaagttgaggaaattctcctt

SEQ ID NO: 1367232 - DNA, 22 bp, Artificial Sequence
  chemically synthesized
attaagttgaggaaattctcct

SEQ ID NO: 1367233 - DNA, 22 bp, Artificial Sequence
  chemically synthesized
tttattaagttgaggaaattct

SEQ ID NO: 1367234 - DNA, 22 bp, Artificial Sequence
  chemically synthesized
aaggagaatttcctcaacttaa

SEQ ID NO: 1367235 - DNA, 22 bp, Artificial Sequence
  chemically synthesized
tgtagatgttgtttattaagtt

SEQ ID NO: 1367236 - DNA, 22 bp, Artificial Sequence
  chemically synthesized
atgtagatgttgtttattaagt

SEQ ID NO: 1367237 - DNA, 22 bp, Artificial Sequence
  chemically synthesized
cctcaacttaataaacaacatc

SEQ ID NO: 1367238 - DNA, 22 bp, Artificial Sequence
  chemically synthesized
taggtttatgtagatgttgttt

SEQ ID NO: 1367239 - DNA, 22 bp, Artificial Sequence
  chemically synthesized
ctcaacttaataaacaacatct

SEQ ID NO: 1367240 - DNA, 22 bp, Artificial Sequence
  chemically synthesized
aacttaataaacaacatctaca

SEQ ID NO: 1367241 - DNA, 22 bp, Artificial Sequence
  chemically synthesized
gctgtaggtttatgtagatgtt

SEQ ID NO: 1367242 - DNA, 22 bp, Artificial Sequence
  chemically synthesized
aataaacaacatctacataaac

SEQ ID NO: 1367243 - DNA, 22 bp, Artificial Sequence
  chemically synthesized
ataaacaacatctacataaacc

SEQ ID NO: 1367244 - DNA, 22 bp, Artificial Sequence
  chemically synthesized
agtatgaagttagctgtaggtt

SEQ ID NO: 1367245 - DNA, 22 bp, Artificial Sequence
  chemically synthesized
ttaagtatgaagttagctgtag

SEQ ID NO: 1367246 - DNA, 22 bp, Artificial Sequence
  chemically synthesized
actattaagtatgaagttagct

SEQ ID NO: 1367247 - DNA, 22 bp, Artificial Sequence
  chemically synthesized
cataaacctacagctaacttca

SEQ ID NO: 1367248 - DNA, 22 bp, Artificial Sequence
  chemically synthesized
cactattaagtatgaagttagc

SEQ ID NO: 1367249 - DNA, 22 bp, Artificial Sequence
  chemically synthesized
atacttcactattaagtatgaa

SEQ ID NO: 1367250 - DNA, 22 bp, Artificial Sequence
  chemically synthesized
aatacttcactattaagtatga

SEQ ID NO: 1367251 - DNA, 22 bp, Artificial Sequence
  chemically synthesized
cagctaacttcatacttaatag

SEQ ID NO: 1367252 - DNA, 22 bp, Artificial Sequence
  chemically synthesized
acttcatacttaatagtgaagt

SEQ ID NO: 1367253 - DNA, 22 bp, Artificial Sequence
  chemically synthesized
catacttaatagtgaagtatta

SEQ ID NO: 1367254 - DNA, 22 bp, Artificial Sequence
  chemically synthesized
atacttaatagtgaagtattaa

SEQ ID NO: 1367255 - DNA, 22 bp, Artificial Sequence
  chemically synthesized
aggggaaagcatttaatacttc

SEQ ID NO: 1367256 - DNA, 22 bp, Artificial Sequence
  chemically synthesized
aatagtgaagtattaaatgctt

SEQ ID NO: 1367257 - DNA, 22 bp, Artificial Sequence
  chemically synthesized
atagtgaagtattaaatgcttt

SEQ ID NO: 1367258 - DNA, 22 bp, Artificial Sequence
  chemically synthesized
acaatattaaggggaaagcatt

SEQ ID NO: 1367259 - DNA, 22 bp, Artificial Sequence
  chemically synthesized
ttcacaatattaaggggaaagc

SEQ ID NO: 1367260 - DNA, 22 bp, Artificial Sequence
  chemically synthesized
gttcacaatattaaggggaaag

SEQ ID NO: 1367261 - DNA, 22 bp, Artificial Sequence
  chemically synthesized
acgccttgttcacaatattaag

SEQ ID NO: 1367262 - DNA, 22 bp, Artificial Sequence
  chemically synthesized
aatgctttccccttaatattgt

SEQ ID NO: 1367263 - DNA, 22 bp, Artificial Sequence
  chemically synthesized
tccccttaatattgtgaacaag

SEQ ID NO: 1367264 - DNA, 22 bp, Artificial Sequence
  chemically synthesized
ccccttaatattgtgaacaagg

SEQ ID NO: 1367265 - DNA, 22 bp, Artificial Sequence
  chemically synthesized
cccttaatattgtgaacaaggc

SEQ ID NO: 1367266 - DNA, 22 bp, Artificial Sequence
  chemically synthesized
aatattgtgaacaaggcgtgaa

SEQ ID NO: 1367267 - DNA, 22 bp, Artificial Sequence
  chemically synthesized
atattgtgaacaaggcgtgaat

SEQ ID NO: 1367268 - DNA, 22 bp, Artificial Sequence
  chemically synthesized
tgaacaaggcgtgaatgcacac

SEQ ID NO: 1367269 - DNA, 22 bp, Artificial Sequence
  chemically synthesized
tagcagtacgtgaataagagtg

SEQ ID NO: 1367270 - DNA, 22 bp, Artificial Sequence
  chemically synthesized
gtagcagtacgtgaataagagt

SEQ ID NO: 1367271 - DNA, 22 bp, Artificial Sequence
  chemically synthesized
gaacttgtagcagtacgtgaat

SEQ ID NO: 1367272 - DNA, 22 bp, Artificial Sequence
  chemically synthesized
accactcttattcacgtactgc

SEQ ID NO: 1367273 - DNA, 22 bp, Artificial Sequence
  chemically synthesized
gctagaacttgtagcagtacgt

SEQ ID NO: 1367274 - DNA, 22 bp, Artificial Sequence
  chemically synthesized
cactggctagaacttgtagcag

SEQ ID NO: 1367275 - DNA, 22 bp, Artificial Sequence
  chemically synthesized
ttattcacgtactgctacaagt

SEQ ID NO: 1367276 - DNA, 22 bp, Artificial Sequence
  chemically synthesized
attcacgtactgctacaagttc

SEQ ID NO: 1367277 - DNA, 22 bp, Artificial Sequence
  chemically synthesized
ttcacgtactgctacaagttct

SEQ ID NO: 1367278 - DNA, 22 bp, Artificial Sequence
  chemically synthesized
attgcactggctagaacttgta

SEQ ID NO: 1367279 - DNA, 22 bp, Artificial Sequence
  chemically synthesized
acgtactgctacaagttctagc

SEQ ID NO: 1367280 - DNA, 22 bp, Artificial Sequence
  chemically synthesized
cctcattgcactggctagaact

SEQ ID NO: 1367281 - DNA, 22 bp, Artificial Sequence
  chemically synthesized
gcctcattgcactggctagaac

SEQ ID NO: 1367282 - DNA, 22 bp, Artificial Sequence
  chemically synthesized
tcttgcctcattgcactggcta

SEQ ID NO: 1367283 - DNA, 22 bp, Artificial Sequence
  chemically synthesized
ctacaagttctagccagtgcaa

SEQ ID NO: 1367284 - DNA, 22 bp, Artificial Sequence
  chemically synthesized
attgtcttgcctcattgcactg

SEQ ID NO: 1367285 - DNA, 22 bp, Artificial Sequence
  chemically synthesized
caagttctagccagtgcaatga

SEQ ID NO: 1367286 - DNA, 22 bp, Artificial Sequence
  chemically synthesized
aattgtcttgcctcattgcact

SEQ ID NO: 1367287 - DNA, 22 bp, Artificial Sequence
  chemically synthesized
atttaattgtcttgcctcattg

SEQ ID NO: 1367288 - DNA, 22 bp, Artificial Sequence
  chemically synthesized
tagccagtgcaatgaggcaaga

SEQ ID NO: 1367289 - DNA, 22 bp, Artificial Sequence
  chemically synthesized
gccagtgcaatgaggcaagaca

SEQ ID NO: 1367290 - DNA, 22 bp, Artificial Sequence
  chemically synthesized
tatggattgatttaattgtctt

SEQ ID NO: 1367291 - DNA, 22 bp, Artificial Sequence
  chemically synthesized
ccatctgtatggattgatttaa

SEQ ID NO: 1367292 - DNA, 22 bp, Artificial Sequence
  chemically synthesized
cccatctgtatggattgattta

SEQ ID NO: 1367293 - DNA, 22 bp, Artificial Sequence
  chemically synthesized
tcccatctgtatggattgattt

SEQ ID NO: 1367294 - DNA, 22 bp, Artificial Sequence
  chemically synthesized
ctttcccatctgtatggattga

SEQ ID NO: 1367295 - DNA, 22 bp, Artificial Sequence
  chemically synthesized
cctttcccatctgtatggattg

SEQ ID NO: 1367296 - DNA, 22 bp, Artificial Sequence
  chemically synthesized
tgtcttcctttcccatctgtat

SEQ ID NO: 1367297 - DNA, 22 bp, Artificial Sequence
  chemically synthesized
atgtcttcctttcccatctgta

SEQ ID NO: 1367298 - DNA, 22 bp, Artificial Sequence
  chemically synthesized
tatgtcttcctttcccatctgt

SEQ ID NO: 1367299 - DNA, 22 bp, Artificial Sequence
  chemically synthesized
aatcaatccatacagatgggaa

SEQ ID NO: 1367300 - DNA, 22 bp, Artificial Sequence
  chemically synthesized
catataagggacaattttatgt

SEQ ID NO: 1367301 - DNA, 22 bp, Artificial Sequence
  chemically synthesized
atgccatctacatataagggac

SEQ ID NO: 1367302 - DNA, 22 bp, Artificial Sequence
  chemically synthesized
catgccatctacatataaggga

SEQ ID NO: 1367303 - DNA, 22 bp, Artificial Sequence
  chemically synthesized
tcatgccatctacatataaggg

SEQ ID NO: 1367304 - DNA, 22 bp, Artificial Sequence
  chemically synthesized
ttttcatgccatctacatataa

SEQ ID NO: 1367305 - DNA, 22 bp, Artificial Sequence
  chemically synthesized
attttcatgccatctacatata

SEQ ID NO: 1367306 - DNA, 22 bp, Artificial Sequence
  chemically synthesized
tattttcatgccatctacatat

SEQ ID NO: 1367307 - DNA, 22 bp, Artificial Sequence
  chemically synthesized
tcccttatatgtagatggcatg

SEQ ID NO: 1367308 - DNA, 22 bp, Artificial Sequence
  chemically synthesized
aaaattttattttcatgccatc

SEQ ID NO: 1367309 - DNA, 22 bp, Artificial Sequence
  chemically synthesized
gaaaattttattttcatgccat

SEQ ID NO: 1367310 - DNA, 22 bp, Artificial Sequence
  chemically synthesized
atatgtagatggcatgaaaata

SEQ ID NO: 1367311 - DNA, 22 bp, Artificial Sequence
  chemically synthesized
tatgtagatggcatgaaaataa

SEQ ID NO: 1367312 - DNA, 22 bp, Artificial Sequence
  chemically synthesized
tagatagcttgaaaattttatt

SEQ ID NO: 1367313 - DNA, 22 bp, Artificial Sequence
  chemically synthesized
atagatagcttgaaaattttat

SEQ ID NO: 1367314 - DNA, 22 bp, Artificial Sequence
  chemically synthesized
tttatagatagcttgaaaattt

SEQ ID NO: 1367315 - DNA, 22 bp, Artificial Sequence
  chemically synthesized
ggagattatttatagatagctt

SEQ ID NO: 1367316 - DNA, 22 bp, Artificial Sequence
  chemically synthesized
taggagattatttatagatagc

SEQ ID NO: 1367317 - DNA, 22 bp, Artificial Sequence
  chemically synthesized
ctaggagattatttatagatag

SEQ ID NO: 1367318 - DNA, 22 bp, Artificial Sequence
  chemically synthesized
tcaagctatctataaataatct

SEQ ID NO: 1367319 - DNA, 22 bp, Artificial Sequence
  chemically synthesized
caagctatctataaataatctc

SEQ ID NO: 1367320 - DNA, 22 bp, Artificial Sequence
  chemically synthesized
aagctatctataaataatctcc

SEQ ID NO: 1367321 - DNA, 22 bp, Artificial Sequence
  chemically synthesized
tcaataatttctaggagattat

SEQ ID NO: 1367322 - DNA, 22 bp, Artificial Sequence
  chemically synthesized
atcaataatttctaggagatta

SEQ ID NO: 1367323 - DNA, 22 bp, Artificial Sequence
  chemically synthesized
tctataaataatctcctagaaa

SEQ ID NO: 1367324 - DNA, 22 bp, Artificial Sequence
  chemically synthesized
acttatcaataatttctaggag

SEQ ID NO: 1367325 - DNA, 22 bp, Artificial Sequence
  chemically synthesized
taaataatctcctagaaattat

SEQ ID NO: 1367326 - DNA, 22 bp, Artificial Sequence
  chemically synthesized
atgaattcacttatcaataatt

SEQ ID NO: 1367327 - DNA, 22 bp, Artificial Sequence
  chemically synthesized
gatgaattcacttatcaataat

SEQ ID NO: 1367328 - DNA, 22 bp, Artificial Sequence
  chemically synthesized
ccttgatgaattcacttatcaa

SEQ ID NO: 1367329 - DNA, 22 bp, Artificial Sequence
  chemically synthesized
ctagaaattattgataagtgaa

SEQ ID NO: 1367330 - DNA, 22 bp, Artificial Sequence
  chemically synthesized
ctaccttgatgaattcacttat

SEQ ID NO: 1367331 - DNA, 22 bp, Artificial Sequence
  chemically synthesized
gaaattattgataagtgaattc

SEQ ID NO: 1367332 - DNA, 22 bp, Artificial Sequence
  chemically synthesized
catcctgctaccttgatgaatt

SEQ ID NO: 1367333 - DNA, 22 bp, Artificial Sequence
  chemically synthesized
gcatcctgctaccttgatgaat

SEQ ID NO: 1367334 - DNA, 22 bp, Artificial Sequence
  chemically synthesized
ttgataagtgaattcatcaagg

SEQ ID NO: 1367335 - DNA, 22 bp, Artificial Sequence
  chemically synthesized
ataagtgaattcatcaaggtag

SEQ ID NO: 1367336 - DNA, 22 bp, Artificial Sequence
  chemically synthesized
tcttgcatcctgctaccttgat

SEQ ID NO: 1367337 - DNA, 22 bp, Artificial Sequence
  chemically synthesized
atcttgcatcctgctaccttga

SEQ ID NO: 1367338 - DNA, 22 bp, Artificial Sequence
  chemically synthesized
tatatttatcttgcatcctgct

SEQ ID NO: 1367339 - DNA, 22 bp, Artificial Sequence
  chemically synthesized
gtatatttatcttgcatcctgc

SEQ ID NO: 1367340 - DNA, 22 bp, Artificial Sequence
  chemically synthesized
tgtatatttatcttgcatcctg

SEQ ID NO: 1367341 - DNA, 22 bp, Artificial Sequence
  chemically synthesized
ttgtatatttatcttgcatcct

SEQ ID NO: 1367342 - DNA, 22 bp, Artificial Sequence
  chemically synthesized
atcaaggtagcaggatgcaaga

SEQ ID NO: 1367343 - DNA, 22 bp, Artificial Sequence
  chemically synthesized
caatcaatttttgtatatttat

SEQ ID NO: 1367344 - DNA, 22 bp, Artificial Sequence
  chemically synthesized
atgtaaatggttacaatcaatt

SEQ ID NO: 1367345 - DNA, 22 bp, Artificial Sequence
  chemically synthesized
tgggaggtgctaatgtaaatgg

SEQ ID NO: 1367346 - DNA, 22 bp, Artificial Sequence
  chemically synthesized
gtgggaggtgctaatgtaaatg

SEQ ID NO: 1367347 - DNA, 22 bp, Artificial Sequence
  chemically synthesized
attgtaaccatttacattagca

SEQ ID NO: 1367348 - DNA, 22 bp, Artificial Sequence
  chemically synthesized
atttgtgggaggtgctaatgta

SEQ ID NO: 1367349 - DNA, 22 bp, Artificial Sequence
  chemically synthesized
catttgtgggaggtgctaatgt

SEQ ID NO: 1367350 - DNA, 22 bp, Artificial Sequence
  chemically synthesized
taaccatttacattagcacctc

SEQ ID NO: 1367351 - DNA, 22 bp, Artificial Sequence
  chemically synthesized
agaatttcatttgtgggaggtg

SEQ ID NO: 1367352 - DNA, 22 bp, Artificial Sequence
  chemically synthesized
acattagcacctcccacaaatg

SEQ ID NO: 1367353 - DNA, 22 bp, Artificial Sequence
  chemically synthesized
cattagcacctcccacaaatga

SEQ ID NO: 1367354 - DNA, 22 bp, Artificial Sequence
  chemically synthesized
gatctaagaatttcatttgtgg

SEQ ID NO: 1367355 - DNA, 22 bp, Artificial Sequence
  chemically synthesized
agatctaagaatttcatttgtg

SEQ ID NO: 1367356 - DNA, 22 bp, Artificial Sequence
  chemically synthesized
tagatctaagaatttcatttgt

SEQ ID NO: 1367357 - DNA, 22 bp, Artificial Sequence
  chemically synthesized
gcacctcccacaaatgaaattc

SEQ ID NO: 1367358 - DNA, 22 bp, Artificial Sequence
  chemically synthesized
gttttagatctaagaatttcat

SEQ ID NO: 1367359 - DNA, 22 bp, Artificial Sequence
  chemically synthesized
ctagttttagatctaagaattt

SEQ ID NO: 1367360 - DNA, 22 bp, Artificial Sequence
  chemically synthesized
gctagttttagatctaagaatt

SEQ ID NO: 1367361 - DNA, 22 bp, Artificial Sequence
  chemically synthesized
tgctagttttagatctaagaat

SEQ ID NO: 1367362 - DNA, 22 bp, Artificial Sequence
  chemically synthesized
ccacaaatgaaattcttagatc

SEQ ID NO: 1367363 - DNA, 22 bp, Artificial Sequence
  chemically synthesized
ttagatctaaaactagcaaaat

SEQ ID NO: 1367364 - DNA, 22 bp, Artificial Sequence
  chemically synthesized
agatctaaaactagcaaaatac

SEQ ID NO: 1367365 - DNA, 22 bp, Artificial Sequence
  chemically synthesized
gatctaaaactagcaaaataca

SEQ ID NO: 1367366 - DNA, 22 bp, Artificial Sequence
  chemically synthesized
atatagatatggtatgtatttt

SEQ ID NO: 1367367 - DNA, 22 bp, Artificial Sequence
  chemically synthesized
ctcatatagatatggtatgtat

SEQ ID NO: 1367368 - DNA, 22 bp, Artificial Sequence
  chemically synthesized
aaactagcaaaatacataccat

SEQ ID NO: 1367369 - DNA, 22 bp, Artificial Sequence
  chemically synthesized
cctcatatagatatggtatgta

SEQ ID NO: 1367370 - DNA, 22 bp, Artificial Sequence
  chemically synthesized
tcctcatatagatatggtatgt

SEQ ID NO: 1367371 - DNA, 22 bp, Artificial Sequence
  chemically synthesized
gcaaaatacataccatatctat

SEQ ID NO: 1367372 - DNA, 22 bp, Artificial Sequence
  chemically synthesized
cagttttcctcatatagatatg

SEQ ID NO: 1367373 - DNA, 22 bp, Artificial Sequence
  chemically synthesized
atcagagggttgcagttttcct

SEQ ID NO: 1367374 - DNA, 22 bp, Artificial Sequence
  chemically synthesized
catcagagggttgcagttttcc

SEQ ID NO: 1367375 - DNA, 22 bp, Artificial Sequence
  chemically synthesized
tcatcagagggttgcagttttc

SEQ ID NO: 1367376 - DNA, 22 bp, Artificial Sequence
  chemically synthesized
tttcatcagagggttgcagttt

SEQ ID NO: 1367377 - DNA, 22 bp, Artificial Sequence
  chemically synthesized
ctttcatcagagggttgcagtt

SEQ ID NO: 1367378 - DNA, 22 bp, Artificial Sequence
  chemically synthesized
tatgaggaaaactgcaaccctc

SEQ ID NO: 1367379 - DNA, 22 bp, Artificial Sequence
  chemically synthesized
tgatttctttcatcagagggtt

SEQ ID NO: 1367380 - DNA, 22 bp, Artificial Sequence
  chemically synthesized
tatgatttctttcatcagaggg

SEQ ID NO: 1367381 - DNA, 22 bp, Artificial Sequence
  chemically synthesized
ctatgatttctttcatcagagg

SEQ ID NO: 1367382 - DNA, 22 bp, Artificial Sequence
  chemically synthesized
tcttctatgatttctttcatca

SEQ ID NO: 1367383 - DNA, 22 bp, Artificial Sequence
  chemically synthesized
caaccctctgatgaaagaaatc

SEQ ID NO: 1367384 - DNA, 22 bp, Artificial Sequence
  chemically synthesized
tgatgaaagaaatcatagaaga

SEQ ID NO: 1367385 - DNA, 22 bp, Artificial Sequence
  chemically synthesized
atgaaagaaatcatagaagata

SEQ ID NO: 1367386 - DNA, 22 bp, Artificial Sequence
  chemically synthesized
ccatccatgaatatggattatc

SEQ ID NO: 1367387 - DNA, 22 bp, Artificial Sequence
  chemically synthesized
cccatccatgaatatggattat

SEQ ID NO: 1367388 - DNA, 22 bp, Artificial Sequence
  chemically synthesized
agccttcccatccatgaatatg

SEQ ID NO: 1367389 - DNA, 22 bp, Artificial Sequence
  chemically synthesized
acataataaaaatattgagcct

SEQ ID NO: 1367390 - DNA, 22 bp, Artificial Sequence
  chemically synthesized
atggatgggaaggctcaatatt

SEQ ID NO: 1367391 - DNA, 22 bp, Artificial Sequence
  chemically synthesized
agaataactgacataataaaaa

SEQ ID NO: 1367392 - DNA, 22 bp, Artificial Sequence
  chemically synthesized
gagaataactgacataataaaa

SEQ ID NO: 1367393 - DNA, 22 bp, Artificial Sequence
  chemically synthesized
aatatttttattatgtcagtta

SEQ ID NO: 1367394 - DNA, 22 bp, Artificial Sequence
  chemically synthesized
tagatcaatttgagaataactg

SEQ ID NO: 1367395 - DNA, 22 bp, Artificial Sequence
  chemically synthesized
ttattatgtcagttattctcaa

SEQ ID NO: 1367396 - DNA, 22 bp, Artificial Sequence
  chemically synthesized
tattatgtcagttattctcaaa

SEQ ID NO: 1367397 - DNA, 22 bp, Artificial Sequence
  chemically synthesized
attatgtcagttattctcaaat

SEQ ID NO: 1367398 - DNA, 22 bp, Artificial Sequence
  chemically synthesized
ttatgtcagttattctcaaatt

SEQ ID NO: 1367399 - DNA, 22 bp, Artificial Sequence
  chemically synthesized
agtctatagatcaatttgagaa

SEQ ID NO: 1367400 - DNA, 22 bp, Artificial Sequence
  chemically synthesized
tgtcagttattctcaaattgat

SEQ ID NO: 1367401 - DNA, 22 bp, Artificial Sequence
  chemically synthesized
cattgagtctatagatcaattt

SEQ ID NO: 1367402 - DNA, 22 bp, Artificial Sequence
  chemically synthesized
ggattacattgagtctatagat

SEQ ID NO: 1367403 - DNA, 22 bp, Artificial Sequence
  chemically synthesized
ttctcaaattgatctatagact

SEQ ID NO: 1367404 - DNA, 22 bp, Artificial Sequence
  chemically synthesized
tcaaattgatctatagactcaa

SEQ ID NO: 1367405 - DNA, 22 bp, Artificial Sequence
  chemically synthesized
attgggattacattgagtctat

SEQ ID NO: 1367406 - DNA, 22 bp, Artificial Sequence
  chemically synthesized
gattgggattacattgagtcta

SEQ ID NO: 1367407 - DNA, 22 bp, Artificial Sequence
  chemically synthesized
aaattgatctatagactcaatg

SEQ ID NO: 1367408 - DNA, 22 bp, Artificial Sequence
  chemically synthesized
tgattgggattacattgagtct

SEQ ID NO: 1367409 - DNA, 22 bp, Artificial Sequence
  chemically synthesized
atctatagactcaatgtaatcc

SEQ ID NO: 1367410 - DNA, 22 bp, Artificial Sequence
  chemically synthesized
agattttgattgggattacatt

SEQ ID NO: 1367411 - DNA, 22 bp, Artificial Sequence
  chemically synthesized
ctgagattttgattgggattac

SEQ ID NO: 1367412 - DNA, 22 bp, Artificial Sequence
  chemically synthesized
tagactcaatgtaatcccaatc

SEQ ID NO: 1367413 - DNA, 22 bp, Artificial Sequence
  chemically synthesized
aatgtaatcccaatcaaaatct

SEQ ID NO: 1367414 - DNA, 22 bp, Artificial Sequence
  chemically synthesized
caaagtaactactgagattttg

SEQ ID NO: 1367415 - DNA, 22 bp, Artificial Sequence
  chemically synthesized
atatctgcaaagtaactactga

SEQ ID NO: 1367416 - DNA, 22 bp, Artificial Sequence
  chemically synthesized
ttaatatctgcaaagtaactac

SEQ ID NO: 1367417 - DNA, 22 bp, Artificial Sequence
  chemically synthesized
gttaatatctgcaaagtaacta

SEQ ID NO: 1367418 - DNA, 22 bp, Artificial Sequence
  chemically synthesized
tgttaatatctgcaaagtaact

SEQ ID NO: 1367419 - DNA, 22 bp, Artificial Sequence
  chemically synthesized
tttgttaatatctgcaaagtaa

SEQ ID NO: 1367420 - DNA, 22 bp, Artificial Sequence
  chemically synthesized
agtagttactttgcagatatta

SEQ ID NO: 1367421 - DNA, 22 bp, Artificial Sequence
  chemically synthesized
gaatctctttgttaatatctgc

SEQ ID NO: 1367422 - DNA, 22 bp, Artificial Sequence
  chemically synthesized
agaatctctttgttaatatctg

SEQ ID NO: 1367423 - DNA, 22 bp, Artificial Sequence
  chemically synthesized
tagaatctctttgttaatatct

SEQ ID NO: 1367424 - DNA, 22 bp, Artificial Sequence
  chemically synthesized
ttagaatctctttgttaatatc

SEQ ID NO: 1367425 - DNA, 22 bp, Artificial Sequence
  chemically synthesized
ctttgcagatattaacaaagag

SEQ ID NO: 1367426 - DNA, 22 bp, Artificial Sequence
  chemically synthesized
tgcagatattaacaaagagatt

SEQ ID NO: 1367427 - DNA, 22 bp, Artificial Sequence
  chemically synthesized
gcagatattaacaaagagattc

SEQ ID NO: 1367428 - DNA, 22 bp, Artificial Sequence
  chemically synthesized
cagatattaacaaagagattct

SEQ ID NO: 1367429 - DNA, 22 bp, Artificial Sequence
  chemically synthesized
catatcatttttagaatctctt

SEQ ID NO: 1367430 - DNA, 22 bp, Artificial Sequence
  chemically synthesized
ccatatcatttttagaatctct

SEQ ID NO: 1367431 - DNA, 22 bp, Artificial Sequence
  chemically synthesized
tccatatcatttttagaatctc

SEQ ID NO: 1367432 - DNA, 22 bp, Artificial Sequence
  chemically synthesized
cctttccatatcatttttagaa

SEQ ID NO: 1367433 - DNA, 22 bp, Artificial Sequence
  chemically synthesized
gcctttccatatcatttttaga

SEQ ID NO: 1367434 - DNA, 22 bp, Artificial Sequence
  chemically synthesized
acaaagagattctaaaaatgat

SEQ ID NO: 1367435 - DNA, 22 bp, Artificial Sequence
  chemically synthesized
ttgcctttccatatcattttta

SEQ ID NO: 1367436 - DNA, 22 bp, Artificial Sequence
  chemically synthesized
cttgcctttccatatcattttt

SEQ ID NO: 1367437 - DNA, 22 bp, Artificial Sequence
  chemically synthesized
aaggtttcttgcctttccatat

SEQ ID NO: 1367438 - DNA, 22 bp, Artificial Sequence
  chemically synthesized
ttcaaggtttcttgcctttcca

SEQ ID NO: 1367439 - DNA, 22 bp, Artificial Sequence
  chemically synthesized
taaaaatgatatggaaaggcaa

SEQ ID NO: 1367440 - DNA, 22 bp, Artificial Sequence
  chemically synthesized
aaaatgatatggaaaggcaaga

SEQ ID NO: 1367441 - DNA, 22 bp, Artificial Sequence
  chemically synthesized
gctattcaaggtttcttgcctt

SEQ ID NO: 1367442 - DNA, 22 bp, Artificial Sequence
  chemically synthesized
ggctattcaaggtttcttgcct

SEQ ID NO: 1367443 - DNA, 22 bp, Artificial Sequence
  chemically synthesized
tggctattcaaggtttcttgcc

SEQ ID NO: 1367444 - DNA, 22 bp, Artificial Sequence
  chemically synthesized
ttttggctattcaaggtttctt

SEQ ID NO: 1367445 - DNA, 22 bp, Artificial Sequence
  chemically synthesized
aatgttgttttggctattcaag

SEQ ID NO: 1367446 - DNA, 22 bp, Artificial Sequence
  chemically synthesized
caatgttgttttggctattcaa

SEQ ID NO: 1367447 - DNA, 22 bp, Artificial Sequence
  chemically synthesized
gaatagccaaaacaacattgaa

SEQ ID NO: 1367448 - DNA, 22 bp, Artificial Sequence
  chemically synthesized
aatagccaaaacaacattgaag

SEQ ID NO: 1367449 - DNA, 22 bp, Artificial Sequence
  chemically synthesized
caggtgtgagccaccacgccca

SEQ ID NO: 1367450 - DNA, 22 bp, Artificial Sequence
  chemically synthesized
aagggctgggcgtggtggctca

SEQ ID NO: 1367451 - DNA, 22 bp, Artificial Sequence
  chemically synthesized
ggattacaggtgtgagccacca

SEQ ID NO: 1367452 - DNA, 22 bp, Artificial Sequence
  chemically synthesized
ggcgtggtggctcacacctgta

SEQ ID NO: 1367453 - DNA, 22 bp, Artificial Sequence
  chemically synthesized
ccaaagtgctgggattacaggt

SEQ ID NO: 1367454 - DNA, 22 bp, Artificial Sequence
  chemically synthesized
gcctcccaaagtgctgggatta

SEQ ID NO: 1367455 - DNA, 22 bp, Artificial Sequence
  chemically synthesized
ggcctcccaaagtgctgggatt

SEQ ID NO: 1367456 - DNA, 22 bp, Artificial Sequence
  chemically synthesized
acacctgtaatcccagcacttt

SEQ ID NO: 1367457 - DNA, 22 bp, Artificial Sequence
  chemically synthesized
cccaccttggcctcccaaagtg

SEQ ID NO: 1367458 - DNA, 22 bp, Artificial Sequence
  chemically synthesized
taatcccagcactttgggaggc

SEQ ID NO: 1367459 - DNA, 22 bp, Artificial Sequence
  chemically synthesized
aagtgatctgcccaccttggcc

SEQ ID NO: 1367460 - DNA, 22 bp, Artificial Sequence
  chemically synthesized
acctcaagtgatctgcccacct

SEQ ID NO: 1367461 - DNA, 22 bp, Artificial Sequence
  chemically synthesized
tgggaggccaaggtgggcagat

SEQ ID NO: 1367462 - DNA, 22 bp, Artificial Sequence
  chemically synthesized
gggaggccaaggtgggcagatc

SEQ ID NO: 1367463 - DNA, 22 bp, Artificial Sequence
  chemically synthesized
ctgacctcaagtgatctgccca

SEQ ID NO: 1367464 - DNA, 22 bp, Artificial Sequence
  chemically synthesized
ggaggccaaggtgggcagatca

SEQ ID NO: 1367465 - DNA, 22 bp, Artificial Sequence
  chemically synthesized
atactcctgacctcaagtgatc

SEQ ID NO: 1367466 - DNA, 22 bp, Artificial Sequence
  chemically synthesized
gtctcatactcctgacctcaag

SEQ ID NO: 1367467 - DNA, 22 bp, Artificial Sequence
  chemically synthesized
gccaggctggtctcatactcct

SEQ ID NO: 1367468 - DNA, 22 bp, Artificial Sequence
  chemically synthesized
gaggtcaggagtatgagaccag

SEQ ID NO: 1367469 - DNA, 22 bp, Artificial Sequence
  chemically synthesized
aggtcaggagtatgagaccagc

SEQ ID NO: 1367470 - DNA, 22 bp, Artificial Sequence
  chemically synthesized
atgatgttggccaggctggtct

SEQ ID NO: 1367471 - DNA, 22 bp, Artificial Sequence
  chemically synthesized
catgatgttggccaggctggtc

SEQ ID NO: 1367472 - DNA, 22 bp, Artificial Sequence
  chemically synthesized
gtacagacggggcttcatgatg

SEQ ID NO: 1367473 - DNA, 22 bp, Artificial Sequence
  chemically synthesized
agtacagacggggcttcatgat

SEQ ID NO: 1367474 - DNA, 22 bp, Artificial Sequence
  chemically synthesized
tagtacagacggggcttcatga

SEQ ID NO: 1367475 - DNA, 22 bp, Artificial Sequence
  chemically synthesized
ttagtacagacggggcttcatg

SEQ ID NO: 1367476 - DNA, 22 bp, Artificial Sequence
  chemically synthesized
tttttagtacagacggggcttc

SEQ ID NO: 1367477 - DNA, 22 bp, Artificial Sequence
  chemically synthesized
gccaacatcatgaagccccgtc

SEQ ID NO: 1367478 - DNA, 22 bp, Artificial Sequence
  chemically synthesized
ttgtttttagtacagacggggc

SEQ ID NO: 1367479 - DNA, 22 bp, Artificial Sequence
  chemically synthesized
gttgtttttagtacagacgggg

SEQ ID NO: 1367480 - DNA, 22 bp, Artificial Sequence
  chemically synthesized
tgttgtttttagtacagacggg

SEQ ID NO: 1367481 - DNA, 22 bp, Artificial Sequence
  chemically synthesized
ttgttgtttttagtacagacgg

SEQ ID NO: 1367482 - DNA, 22 bp, Artificial Sequence
  chemically synthesized
atttttgttgtttttagtacag

SEQ ID NO: 1367483 - DNA, 22 bp, Artificial Sequence
  chemically synthesized
ccagctaatttttgttgttttt

SEQ ID NO: 1367484 - DNA, 22 bp, Artificial Sequence
  chemically synthesized
tactaaaaacaacaaaaattag

SEQ ID NO: 1367485 - DNA, 22 bp, Artificial Sequence
  chemically synthesized
aaaacaacaaaaattagctggg

SEQ ID NO: 1367486 - DNA, 22 bp, Artificial Sequence
  chemically synthesized
caggcgtgtgccaccactccca

SEQ ID NO: 1367487 - DNA, 22 bp, Artificial Sequence
  chemically synthesized
ggattacaggcgtgtgccacca

SEQ ID NO: 1367488 - DNA, 22 bp, Artificial Sequence
  chemically synthesized
gctgggagtggtggcacacgcc

SEQ ID NO: 1367489 - DNA, 22 bp, Artificial Sequence
  chemically synthesized
ggagtggtggcacacgcctgta

SEQ ID NO: 1367490 - DNA, 22 bp, Artificial Sequence
  chemically synthesized
aagtagctgggattacaggcgt

SEQ ID NO: 1367491 - DNA, 22 bp, Artificial Sequence
  chemically synthesized
tcaagtagctgggattacaggc

SEQ ID NO: 1367492 - DNA, 22 bp, Artificial Sequence
  chemically synthesized
agcctctcaagtagctgggatt

SEQ ID NO: 1367493 - DNA, 22 bp, Artificial Sequence
  chemically synthesized
cagcctctcaagtagctgggat

SEQ ID NO: 1367494 - DNA, 22 bp, Artificial Sequence
  chemically synthesized
atttcagcctctcaagtagctg

SEQ ID NO: 1367495 - DNA, 22 bp, Artificial Sequence
  chemically synthesized
catttcagcctctcaagtagct

SEQ ID NO: 1367496 - DNA, 22 bp, Artificial Sequence
  chemically synthesized
tcatttcagcctctcaagtagc

SEQ ID NO: 1367497 - DNA, 22 bp, Artificial Sequence
  chemically synthesized
tttcatttcagcctctcaagta

SEQ ID NO: 1367498 - DNA, 22 bp, Artificial Sequence
  chemically synthesized
taatcccagctacttgagaggc

SEQ ID NO: 1367499 - DNA, 22 bp, Artificial Sequence
  chemically synthesized
aagcgattctttcatttcagcc

SEQ ID NO: 1367500 - DNA, 22 bp, Artificial Sequence
  chemically synthesized
cttgagaggctgaaatgaaaga

SEQ ID NO: 1367501 - DNA, 22 bp, Artificial Sequence
  chemically synthesized
ggttcaagcgattctttcattt

SEQ ID NO: 1367502 - DNA, 22 bp, Artificial Sequence
  chemically synthesized
gagaggctgaaatgaaagaatc

SEQ ID NO: 1367503 - DNA, 22 bp, Artificial Sequence
  chemically synthesized
ctgggttcaagcgattctttca

SEQ ID NO: 1367504 - DNA, 22 bp, Artificial Sequence
  chemically synthesized
agaggctgaaatgaaagaatcg

SEQ ID NO: 1367505 - DNA, 22 bp, Artificial Sequence
  chemically synthesized
cgcctcctgggttcaagcgatt

SEQ ID NO: 1367506 - DNA, 22 bp, Artificial Sequence
  chemically synthesized
aaatgaaagaatcgcttgaacc

SEQ ID NO: 1367507 - DNA, 22 bp, Artificial Sequence
  chemically synthesized
caatctccgcctcctgggttca

SEQ ID NO: 1367508 - DNA, 22 bp, Artificial Sequence
  chemically synthesized
actgcaatctccgcctcctggg

SEQ ID NO: 1367509 - DNA, 22 bp, Artificial Sequence
  chemically synthesized
ggctcactgcaatctccgcctc

SEQ ID NO: 1367510 - DNA, 22 bp, Artificial Sequence
  chemically synthesized
gaacccaggaggcggagattgc

SEQ ID NO: 1367511 - DNA, 22 bp, Artificial Sequence
  chemically synthesized
aacccaggaggcggagattgca

SEQ ID NO: 1367512 - DNA, 22 bp, Artificial Sequence
  chemically synthesized
gagtgcaatggcatgatctcgg

SEQ ID NO: 1367513 - DNA, 22 bp, Artificial Sequence
  chemically synthesized
cagtgagccgagatcatgccat

SEQ ID NO: 1367514 - DNA, 22 bp, Artificial Sequence
  chemically synthesized
tcacccaggctggagtgcaatg

SEQ ID NO: 1367515 - DNA, 22 bp, Artificial Sequence
  chemically synthesized
tgtcacccaggctggagtgcaa

SEQ ID NO: 1367516 - DNA, 22 bp, Artificial Sequence
  chemically synthesized
tctgtcacccaggctggagtgc

SEQ ID NO: 1367517 - DNA, 22 bp, Artificial Sequence
  chemically synthesized
tctctgtcacccaggctggagt

SEQ ID NO: 1367518 - DNA, 22 bp, Artificial Sequence
  chemically synthesized
cctctctctgtcacccaggctg

SEQ ID NO: 1367519 - DNA, 22 bp, Artificial Sequence
  chemically synthesized
cactccagcctgggtgacagag

SEQ ID NO: 1367520 - DNA, 22 bp, Artificial Sequence
  chemically synthesized
cagcctgggtgacagagagagg

SEQ ID NO: 1367521 - DNA, 22 bp, Artificial Sequence
  chemically synthesized
agatggagtctccctctctctg

SEQ ID NO: 1367522 - DNA, 22 bp, Artificial Sequence
  chemically synthesized
gagatggagtctccctctctct

SEQ ID NO: 1367523 - DNA, 22 bp, Artificial Sequence
  chemically synthesized
tttgagatggagtctccctctc

SEQ ID NO: 1367524 - DNA, 22 bp, Artificial Sequence
  chemically synthesized
gtttgagatggagtctccctct

SEQ ID NO: 1367525 - DNA, 22 bp, Artificial Sequence
  chemically synthesized
ggtgacagagagagggagactc

SEQ ID NO: 1367526 - DNA, 22 bp, Artificial Sequence
  chemically synthesized
tttgtttgagatggagtctccc

SEQ ID NO: 1367527 - DNA, 22 bp, Artificial Sequence
  chemically synthesized
gtttgtttgagatggagtctcc

SEQ ID NO: 1367528 - DNA, 22 bp, Artificial Sequence
  chemically synthesized
tttgtttgtttgagatggagtc

SEQ ID NO: 1367529 - DNA, 22 bp, Artificial Sequence
  chemically synthesized
gtttgtttgtttgagatggagt

SEQ ID NO: 1367530 - DNA, 22 bp, Artificial Sequence
  chemically synthesized
tttgtttgtttgtttgagatgg

SEQ ID NO: 1367531 - DNA, 22 bp, Artificial Sequence
  chemically synthesized
gtttgtttgtttgtttgagatg

SEQ ID NO: 1367532 - DNA, 22 bp, Artificial Sequence
  chemically synthesized
tttgtttgtttgtttgtttgag

SEQ ID NO: 1367533 - DNA, 22 bp, Artificial Sequence
  chemically synthesized
gtttgtttgtttgtttgtttga

SEQ ID NO: 1367534 - DNA, 22 bp, Artificial Sequence
  chemically synthesized
tgtttgtttgtttgtttgtttg

SEQ ID NO: 1367535 - DNA, 22 bp, Artificial Sequence
  chemically synthesized
ttgtttgtttgtttgtttgttt

SEQ ID NO: 1367536 - DNA, 22 bp, Artificial Sequence
  chemically synthesized
tttttgtttgtttgtttgtttg

SEQ ID NO: 1367537 - DNA, 22 bp, Artificial Sequence
  chemically synthesized
catctcaaacaaacaaacaaac

SEQ ID NO: 1367538 - DNA, 22 bp, Artificial Sequence
  chemically synthesized
aatattgtttttgtttgtttgt

SEQ ID NO: 1367539 - DNA, 22 bp, Artificial Sequence
  chemically synthesized
caatattgtttttgtttgtttg

SEQ ID NO: 1367540 - DNA, 22 bp, Artificial Sequence
  chemically synthesized
aaacaaacaaacaaacaaacaa

SEQ ID NO: 1367541 - DNA, 22 bp, Artificial Sequence
  chemically synthesized
tccttcaatattgtttttgttt

SEQ ID NO: 1367542 - DNA, 22 bp, Artificial Sequence
  chemically synthesized
gtccttcaatattgtttttgtt

SEQ ID NO: 1367543 - DNA, 22 bp, Artificial Sequence
  chemically synthesized
tgcttgtccttcaatattgttt

SEQ ID NO: 1367544 - DNA, 22 bp, Artificial Sequence
  chemically synthesized
gtgcttgtccttcaatattgtt

SEQ ID NO: 1367545 - DNA, 22 bp, Artificial Sequence
  chemically synthesized
tgtgcttgtccttcaatattgt

SEQ ID NO: 1367546 - DNA, 22 bp, Artificial Sequence
  chemically synthesized
actttgtgcttgtccttcaata

SEQ ID NO: 1367547 - DNA, 22 bp, Artificial Sequence
  chemically synthesized
tgactttgtgcttgtccttcaa

SEQ ID NO: 1367548 - DNA, 22 bp, Artificial Sequence
  chemically synthesized
ctgactttgtgcttgtccttca

SEQ ID NO: 1367549 - DNA, 22 bp, Artificial Sequence
  chemically synthesized
aatcttctgactttgtgcttgt

SEQ ID NO: 1367550 - DNA, 22 bp, Artificial Sequence
  chemically synthesized
aaggacaagcacaaagtcagaa

SEQ ID NO: 1367551 - DNA, 22 bp, Artificial Sequence
  chemically synthesized
aagtagagcagtctcaatcttc

SEQ ID NO: 1367552 - DNA, 22 bp, Artificial Sequence
  chemically synthesized
gaagtagagcagtctcaatctt

SEQ ID NO: 1367553 - DNA, 22 bp, Artificial Sequence
  chemically synthesized
ccgaagtcttgaagtagagcag

SEQ ID NO: 1367554 - DNA, 22 bp, Artificial Sequence
  chemically synthesized
attaccgaagtcttgaagtaga

SEQ ID NO: 1367555 - DNA, 22 bp, Artificial Sequence
  chemically synthesized
gattaccgaagtcttgaagtag

SEQ ID NO: 1367556 - DNA, 22 bp, Artificial Sequence
  chemically synthesized
agactgctctacttcaagactt

SEQ ID NO: 1367557 - DNA, 22 bp, Artificial Sequence
  chemically synthesized
tcttgattaccgaagtcttgaa

SEQ ID NO: 1367558 - DNA, 22 bp, Artificial Sequence
  chemically synthesized
ctctacttcaagacttcggtaa

SEQ ID NO: 1367559 - DNA, 22 bp, Artificial Sequence
  chemically synthesized
tacttcaagacttcggtaatca

SEQ ID NO: 1367560 - DNA, 22 bp, Artificial Sequence
  chemically synthesized
cttcaagacttcggtaatcaag

SEQ ID NO: 1367561 - DNA, 22 bp, Artificial Sequence
  chemically synthesized
caagacttcggtaatcaagaca

SEQ ID NO: 1367562 - DNA, 22 bp, Artificial Sequence
  chemically synthesized
ccaataagacactgtcttgatt

SEQ ID NO: 1367563 - DNA, 22 bp, Artificial Sequence
  chemically synthesized
aagacttcggtaatcaagacag

SEQ ID NO: 1367564 - DNA, 22 bp, Artificial Sequence
  chemically synthesized
gccaataagacactgtcttgat

SEQ ID NO: 1367565 - DNA, 22 bp, Artificial Sequence
  chemically synthesized
tgccaataagacactgtcttga

SEQ ID NO: 1367566 - DNA, 22 bp, Artificial Sequence
  chemically synthesized
ttgccaataagacactgtcttg

SEQ ID NO: 1367567 - DNA, 22 bp, Artificial Sequence
  chemically synthesized
ttttgccaataagacactgtct

SEQ ID NO: 1367568 - DNA, 22 bp, Artificial Sequence
  chemically synthesized
cttttgccaataagacactgtc

SEQ ID NO: 1367569 - DNA, 22 bp, Artificial Sequence
  chemically synthesized
cggtaatcaagacagtgtctta

SEQ ID NO: 1367570 - DNA, 22 bp, Artificial Sequence
  chemically synthesized
ttcttttgccaataagacactg

SEQ ID NO: 1367571 - DNA, 22 bp, Artificial Sequence
  chemically synthesized
ggtaatcaagacagtgtcttat

SEQ ID NO: 1367572 - DNA, 22 bp, Artificial Sequence
  chemically synthesized
atctcttcttttgccaataaga

SEQ ID NO: 1367573 - DNA, 22 bp, Artificial Sequence
  chemically synthesized
cattgatctcttcttttgccaa

SEQ ID NO: 1367574 - DNA, 22 bp, Artificial Sequence
  chemically synthesized
ttccattgatctcttcttttgc

SEQ ID NO: 1367575 - DNA, 22 bp, Artificial Sequence
  chemically synthesized
tgttccattgatctcttctttt

SEQ ID NO: 1367576 - DNA, 22 bp, Artificial Sequence
  chemically synthesized
ttctgttccattgatctcttct

SEQ ID NO: 1367577 - DNA, 22 bp, Artificial Sequence
  chemically synthesized
tattctgttccattgatctctt

SEQ ID NO: 1367578 - DNA, 22 bp, Artificial Sequence
  chemically synthesized
attggcaaaagaagagatcaat

SEQ ID NO: 1367579 - DNA, 22 bp, Artificial Sequence
  chemically synthesized
ttggcaaaagaagagatcaatg

SEQ ID NO: 1367580 - DNA, 22 bp, Artificial Sequence
  chemically synthesized
tctattctgttccattgatctc

SEQ ID NO: 1367581 - DNA, 22 bp, Artificial Sequence
  chemically synthesized
gcaaaagaagagatcaatggaa

SEQ ID NO: 1367582 - DNA, 22 bp, Artificial Sequence
  chemically synthesized
ggctctctattctgttccattg

SEQ ID NO: 1367583 - DNA, 22 bp, Artificial Sequence
  chemically synthesized
ctgggctctctattctgttcca

SEQ ID NO: 1367584 - DNA, 22 bp, Artificial Sequence
  chemically synthesized
ttcctgggctctctattctgtt

SEQ ID NO: 1367585 - DNA, 22 bp, Artificial Sequence
  chemically synthesized
attcctgggctctctattctgt

SEQ ID NO: 1367586 - DNA, 22 bp, Artificial Sequence
  chemically synthesized
tgtgggtttattcctgggctct

SEQ ID NO: 1367587 - DNA, 22 bp, Artificial Sequence
  chemically synthesized
atgtgggtttattcctgggctc

SEQ ID NO: 1367588 - DNA, 22 bp, Artificial Sequence
  chemically synthesized
tatttatgtgggtttattcctg

SEQ ID NO: 1367589 - DNA, 22 bp, Artificial Sequence
  chemically synthesized
actatatttatgtgggtttatt

SEQ ID NO: 1367590 - DNA, 22 bp, Artificial Sequence
  chemically synthesized
tcaaacatcagtcagttgacta

SEQ ID NO: 1367591 - DNA, 22 bp, Artificial Sequence
  chemically synthesized
cgttatcaaacatcagtcagtt

SEQ ID NO: 1367592 - DNA, 22 bp, Artificial Sequence
  chemically synthesized
ctccgttatcaaacatcagtca

SEQ ID NO: 1367593 - DNA, 22 bp, Artificial Sequence
  chemically synthesized
gctccgttatcaaacatcagtc

SEQ ID NO: 1367594 - DNA, 22 bp, Artificial Sequence
  chemically synthesized
tgctccgttatcaaacatcagt

SEQ ID NO: 1367595 - DNA, 22 bp, Artificial Sequence
  chemically synthesized
tctttgctccgttatcaaacat

SEQ ID NO: 1367596 - DNA, 22 bp, Artificial Sequence
  chemically synthesized
actgatgtttgataacggagca

SEQ ID NO: 1367597 - DNA, 22 bp, Artificial Sequence
  chemically synthesized
aaaaggttgtctttgctccgtt

SEQ ID NO: 1367598 - DNA, 22 bp, Artificial Sequence
  chemically synthesized
atgtttgataacggagcaaaga

SEQ ID NO: 1367599 - DNA, 22 bp, Artificial Sequence
  chemically synthesized
ttgaaaaggttgtctttgctcc

SEQ ID NO: 1367600 - DNA, 22 bp, Artificial Sequence
  chemically synthesized
attgaaaaggttgtctttgctc

SEQ ID NO: 1367601 - DNA, 22 bp, Artificial Sequence
  chemically synthesized
gataacggagcaaagacaacct

SEQ ID NO: 1367602 - DNA, 22 bp, Artificial Sequence
  chemically synthesized
ataacggagcaaagacaacctt

SEQ ID NO: 1367603 - DNA, 22 bp, Artificial Sequence
  chemically synthesized
cagcaccatttattgaaaaggt

SEQ ID NO: 1367604 - DNA, 22 bp, Artificial Sequence
  chemically synthesized
ttccagcaccatttattgaaaa

SEQ ID NO: 1367605 - DNA, 22 bp, Artificial Sequence
  chemically synthesized
ttcaataaatggtgctggaaca

SEQ ID NO: 1367606 - DNA, 22 bp, Artificial Sequence
  chemically synthesized
tcaataaatggtgctggaacaa

SEQ ID NO: 1367607 - DNA, 22 bp, Artificial Sequence
  chemically synthesized
caataaatggtgctggaacaac

SEQ ID NO: 1367608 - DNA, 22 bp, Artificial Sequence
  chemically synthesized
aataaatggtgctggaacaact

SEQ ID NO: 1367609 - DNA, 22 bp, Artificial Sequence
  chemically synthesized
catgtggatgcccagttgttcc

SEQ ID NO: 1367610 - DNA, 22 bp, Artificial Sequence
  chemically synthesized
gcatgtggatgcccagttgttc

SEQ ID NO: 1367611 - DNA, 22 bp, Artificial Sequence
  chemically synthesized
gaacaactgggcatccacatgc

SEQ ID NO: 1367612 - DNA, 22 bp, Artificial Sequence
  chemically synthesized
tgaaaggtgtttgcatgtggat

SEQ ID NO: 1367613 - DNA, 22 bp, Artificial Sequence
  chemically synthesized
gtgaaaggtgtttgcatgtgga

SEQ ID NO: 1367614 - DNA, 22 bp, Artificial Sequence
  chemically synthesized
atgtttgtgaaaggtgtttgca

SEQ ID NO: 1367615 - DNA, 22 bp, Artificial Sequence
  chemically synthesized
ggcatccacatgcaaacacctt

SEQ ID NO: 1367616 - DNA, 22 bp, Artificial Sequence
  chemically synthesized
agttaatgtttgtgaaaggtgt

SEQ ID NO: 1367617 - DNA, 22 bp, Artificial Sequence
  chemically synthesized
gagttaatgtttgtgaaaggtg

SEQ ID NO: 1367618 - DNA, 22 bp, Artificial Sequence
  chemically synthesized
tgagttaatgtttgtgaaaggt

SEQ ID NO: 1367619 - DNA, 22 bp, Artificial Sequence
  chemically synthesized
atccattttgagttaatgtttg

SEQ ID NO: 1367620 - DNA, 22 bp, Artificial Sequence
  chemically synthesized
tgatccattttgagttaatgtt

SEQ ID NO: 1367621 - DNA, 22 bp, Artificial Sequence
  chemically synthesized
ctgatccattttgagttaatgt

SEQ ID NO: 1367622 - DNA, 22 bp, Artificial Sequence
  chemically synthesized
agtttctgatccattttgagtt

SEQ ID NO: 1367623 - DNA, 22 bp, Artificial Sequence
  chemically synthesized
tcacaaacattaactcaaaatg

SEQ ID NO: 1367624 - DNA, 22 bp, Artificial Sequence
  chemically synthesized
aagtttctgatccattttgagt

SEQ ID NO: 1367625 - DNA, 22 bp, Artificial Sequence
  chemically synthesized
cacaaacattaactcaaaatgg

SEQ ID NO: 1367626 - DNA, 22 bp, Artificial Sequence
  chemically synthesized
acaaacattaactcaaaatgga

SEQ ID NO: 1367627 - DNA, 22 bp, Artificial Sequence
  chemically synthesized
catttaagtttctgatccattt

SEQ ID NO: 1367628 - DNA, 22 bp, Artificial Sequence
  chemically synthesized
acatttaagtttctgatccatt

SEQ ID NO: 1367629 - DNA, 22 bp, Artificial Sequence
  chemically synthesized
tacatttaagtttctgatccat

SEQ ID NO: 1367630 - DNA, 22 bp, Artificial Sequence
  chemically synthesized
actcaaaatggatcagaaactt

SEQ ID NO: 1367631 - DNA, 22 bp, Artificial Sequence
  chemically synthesized
cattttacatttaagtttctga

SEQ ID NO: 1367632 - DNA, 22 bp, Artificial Sequence
  chemically synthesized
gcattttacatttaagtttctg

SEQ ID NO: 1367633 - DNA, 22 bp, Artificial Sequence
  chemically synthesized
tgcattttacatttaagtttct

SEQ ID NO: 1367634 - DNA, 22 bp, Artificial Sequence
  chemically synthesized
aaaatggatcagaaacttaaat

SEQ ID NO: 1367635 - DNA, 22 bp, Artificial Sequence
  chemically synthesized
tagttttgcattttacatttaa

SEQ ID NO: 1367636 - DNA, 22 bp, Artificial Sequence
  chemically synthesized
atagttttgcattttacattta

SEQ ID NO: 1367637 - DNA, 22 bp, Artificial Sequence
  chemically synthesized
tatagttttgcattttacattt

SEQ ID NO: 1367638 - DNA, 22 bp, Artificial Sequence
  chemically synthesized
tgggctttatagttttgcattt

SEQ ID NO: 1367639 - DNA, 22 bp, Artificial Sequence
  chemically synthesized
tgtgggctttatagttttgcat

SEQ ID NO: 1367640 - DNA, 22 bp, Artificial Sequence
  chemically synthesized
ctgtgggctttatagttttgca

SEQ ID NO: 1367641 - DNA, 22 bp, Artificial Sequence
  chemically synthesized
aaatgtaaaatgcaaaactata

SEQ ID NO: 1367642 - DNA, 22 bp, Artificial Sequence
  chemically synthesized
aatgtaaaatgcaaaactataa

SEQ ID NO: 1367643 - DNA, 22 bp, Artificial Sequence
  chemically synthesized
tcttctgtgggctttatagttt

SEQ ID NO: 1367644 - DNA, 22 bp, Artificial Sequence
  chemically synthesized
tgttatcttctgtgggctttat

SEQ ID NO: 1367645 - DNA, 22 bp, Artificial Sequence
  chemically synthesized
ctatgttatcttctgtgggctt

SEQ ID NO: 1367646 - DNA, 22 bp, Artificial Sequence
  chemically synthesized
tcctatgttatcttctgtgggc

SEQ ID NO: 1367647 - DNA, 22 bp, Artificial Sequence
  chemically synthesized
ctcctatgttatcttctgtggg

SEQ ID NO: 1367648 - DNA, 22 bp, Artificial Sequence
  chemically synthesized
tctcctatgttatcttctgtgg

SEQ ID NO: 1367649 - DNA, 22 bp, Artificial Sequence
  chemically synthesized
taaagcccacagaagataacat

SEQ ID NO: 1367650 - DNA, 22 bp, Artificial Sequence
  chemically synthesized
aaaagtcatcaccagacccata

SEQ ID NO: 1367651 - DNA, 22 bp, Artificial Sequence
  chemically synthesized
tatctaaaaagtcatcaccaga

SEQ ID NO: 1367652 - DNA, 22 bp, Artificial Sequence
  chemically synthesized
tatgggtctggtgatgactttt

SEQ ID NO: 1367653 - DNA, 22 bp, Artificial Sequence
  chemically synthesized
gtgttatatctaaaaagtcatc

SEQ ID NO: 1367654 - DNA, 22 bp, Artificial Sequence
  chemically synthesized
ggtgttatatctaaaaagtcat

SEQ ID NO: 1367655 - DNA, 22 bp, Artificial Sequence
  chemically synthesized
tggtgttatatctaaaaagtca

SEQ ID NO: 1367656 - DNA, 22 bp, Artificial Sequence
  chemically synthesized
gtgatgactttttagatataac

SEQ ID NO: 1367657 - DNA, 22 bp, Artificial Sequence
  chemically synthesized
cataggtcatgtctttggtgtt

SEQ ID NO: 1367658 - DNA, 22 bp, Artificial Sequence
  chemically synthesized
gcataggtcatgtctttggtgt

SEQ ID NO: 1367659 - DNA, 22 bp, Artificial Sequence
  chemically synthesized
tttagatataacaccaaagaca

SEQ ID NO: 1367660 - DNA, 22 bp, Artificial Sequence
  chemically synthesized
ttgcataggtcatgtctttggt

SEQ ID NO: 1367661 - DNA, 22 bp, Artificial Sequence
  chemically synthesized
ttagatataacaccaaagacat

SEQ ID NO: 1367662 - DNA, 22 bp, Artificial Sequence
  chemically synthesized
cttgcataggtcatgtctttgg

SEQ ID NO: 1367663 - DNA, 22 bp, Artificial Sequence
  chemically synthesized
tagatataacaccaaagacatg

SEQ ID NO: 1367664 - DNA, 22 bp, Artificial Sequence
  chemically synthesized
agatataacaccaaagacatga

SEQ ID NO: 1367665 - DNA, 22 bp, Artificial Sequence
  chemically synthesized
gatataacaccaaagacatgac

SEQ ID NO: 1367666 - DNA, 22 bp, Artificial Sequence
  chemically synthesized
tttcttgcataggtcatgtctt

SEQ ID NO: 1367667 - DNA, 22 bp, Artificial Sequence
  chemically synthesized
tcaattatttcttgcataggtc

SEQ ID NO: 1367668 - DNA, 22 bp, Artificial Sequence
  chemically synthesized
atcaattatttcttgcataggt

SEQ ID NO: 1367669 - DNA, 22 bp, Artificial Sequence
  chemically synthesized
cttatcaattatttcttgcata

SEQ ID NO: 1367670 - DNA, 22 bp, Artificial Sequence
  chemically synthesized
atgaagtcctgcttatcaatta

SEQ ID NO: 1367671 - DNA, 22 bp, Artificial Sequence
  chemically synthesized
tgcaagaaataattgataagca

SEQ ID NO: 1367672 - DNA, 22 bp, Artificial Sequence
  chemically synthesized
aatattaatgaagtcctgctta

SEQ ID NO: 1367673 - DNA, 22 bp, Artificial Sequence
  chemically synthesized
caatattaatgaagtcctgctt

SEQ ID NO: 1367674 - DNA, 22 bp, Artificial Sequence
  chemically synthesized
tcaatattaatgaagtcctgct

SEQ ID NO: 1367675 - DNA, 22 bp, Artificial Sequence
  chemically synthesized
ttcaatattaatgaagtcctgc

SEQ ID NO: 1367676 - DNA, 22 bp, Artificial Sequence
  chemically synthesized
ataagcaggacttcattaatat

SEQ ID NO: 1367677 - DNA, 22 bp, Artificial Sequence
  chemically synthesized
cagcatagaatttttcaatatt

SEQ ID NO: 1367678 - DNA, 22 bp, Artificial Sequence
  chemically synthesized
gcagcatagaatttttcaatat

SEQ ID NO: 1367679 - DNA, 22 bp, Artificial Sequence
  chemically synthesized
tgcagcatagaatttttcaata

SEQ ID NO: 1367680 - DNA, 22 bp, Artificial Sequence
  chemically synthesized
ttgcagcatagaatttttcaat

SEQ ID NO: 1367681 - DNA, 22 bp, Artificial Sequence
  chemically synthesized
cattaatattgaaaaattctat

SEQ ID NO: 1367682 - DNA, 22 bp, Artificial Sequence
  chemically synthesized
attaatattgaaaaattctatg

SEQ ID NO: 1367683 - DNA, 22 bp, Artificial Sequence
  chemically synthesized
atattgaaaaattctatgctgc

SEQ ID NO: 1367684 - DNA, 22 bp, Artificial Sequence
  chemically synthesized
acaatgtcttttgcagcataga

SEQ ID NO: 1367685 - DNA, 22 bp, Artificial Sequence
  chemically synthesized
gacaatgtcttttgcagcatag

SEQ ID NO: 1367686 - DNA, 22 bp, Artificial Sequence
  chemically synthesized
tgacaatgtcttttgcagcata

SEQ ID NO: 1367687 - DNA, 22 bp, Artificial Sequence
  chemically synthesized
ttgacaatgtcttttgcagcat

SEQ ID NO: 1367688 - DNA, 22 bp, Artificial Sequence
  chemically synthesized
ttttgacaatgtcttttgcagc

SEQ ID NO: 1367689 - DNA, 22 bp, Artificial Sequence
  chemically synthesized
aaaaattctatgctgcaaaaga

SEQ ID NO: 1367690 - DNA, 22 bp, Artificial Sequence
  chemically synthesized
cattcttttgacaatgtctttt

SEQ ID NO: 1367691 - DNA, 22 bp, Artificial Sequence
  chemically synthesized
acattcttttgacaatgtcttt

SEQ ID NO: 1367692 - DNA, 22 bp, Artificial Sequence
  chemically synthesized
tacattcttttgacaatgtctt

SEQ ID NO: 1367693 - DNA, 22 bp, Artificial Sequence
  chemically synthesized
tatgctgcaaaagacattgtca

SEQ ID NO: 1367694 - DNA, 22 bp, Artificial Sequence
  chemically synthesized
tgctgcaaaagacattgtcaaa

SEQ ID NO: 1367695 - DNA, 22 bp, Artificial Sequence
  chemically synthesized
tctttacattcttttgacaatg

SEQ ID NO: 1367696 - DNA, 22 bp, Artificial Sequence
  chemically synthesized
gtctttacattcttttgacaat

SEQ ID NO: 1367697 - DNA, 22 bp, Artificial Sequence
  chemically synthesized
caaaagacattgtcaaaagaat

SEQ ID NO: 1367698 - DNA, 22 bp, Artificial Sequence
  chemically synthesized
tggcttgtctttacattctttt

SEQ ID NO: 1367699 - DNA, 22 bp, Artificial Sequence
  chemically synthesized
tgtggcttgtctttacattctt

SEQ ID NO: 1367700 - DNA, 22 bp, Artificial Sequence
  chemically synthesized
ttctgtggcttgtctttacatt

SEQ ID NO: 1367701 - DNA, 22 bp, Artificial Sequence
  chemically synthesized
ctattctgtggcttgtctttac

SEQ ID NO: 1367702 - DNA, 22 bp, Artificial Sequence
  chemically synthesized
tcaaaagaatgtaaagacaagc

SEQ ID NO: 1367703 - DNA, 22 bp, Artificial Sequence
  chemically synthesized
tcctattctgtggcttgtcttt

SEQ ID NO: 1367704 - DNA, 22 bp, Artificial Sequence
  chemically synthesized
tctcctattctgtggcttgtct

SEQ ID NO: 1367705 - DNA, 22 bp, Artificial Sequence
  chemically synthesized
caaatattctctcctattctgt

SEQ ID NO: 1367706 - DNA, 22 bp, Artificial Sequence
  chemically synthesized
gcaaatattctctcctattctg

SEQ ID NO: 1367707 - DNA, 22 bp, Artificial Sequence
  chemically synthesized
tgcaaatattctctcctattct

SEQ ID NO: 1367708 - DNA, 22 bp, Artificial Sequence
  chemically synthesized
ttgcaaatattctctcctattc

SEQ ID NO: 1367709 - DNA, 22 bp, Artificial Sequence
  chemically synthesized
atatgtcttttgcaaatattct

SEQ ID NO: 1367710 - DNA, 22 bp, Artificial Sequence
  chemically synthesized
cctgatatgtcttttgcaaata

SEQ ID NO: 1367711 - DNA, 22 bp, Artificial Sequence
  chemically synthesized
gataacagtccattacctgata

SEQ ID NO: 1367712 - DNA, 22 bp, Artificial Sequence
  chemically synthesized
ggataacagtccattacctgat

SEQ ID NO: 1367713 - DNA, 22 bp, Artificial Sequence
  chemically synthesized
gcaaaagacatatcaggtaatg

SEQ ID NO: 1367714 - DNA, 22 bp, Artificial Sequence
  chemically synthesized
tggataacagtccattacctga

SEQ ID NO: 1367715 - DNA, 22 bp, Artificial Sequence
  chemically synthesized
caaaagacatatcaggtaatgg

SEQ ID NO: 1367716 - DNA, 22 bp, Artificial Sequence
  chemically synthesized
tatattttggataacagtccat

SEQ ID NO: 1367717 - DNA, 22 bp, Artificial Sequence
  chemically synthesized
gtatattttggataacagtcca

SEQ ID NO: 1367718 - DNA, 22 bp, Artificial Sequence
  chemically synthesized
tgtatattttggataacagtcc

SEQ ID NO: 1367719 - DNA, 22 bp, Artificial Sequence
  chemically synthesized
tttgtatattttggataacagt

SEQ ID NO: 1367720 - DNA, 22 bp, Artificial Sequence
  chemically synthesized
acagttctttgtatattttgga

SEQ ID NO: 1367721 - DNA, 22 bp, Artificial Sequence
  chemically synthesized
aacagttctttgtatattttgg

SEQ ID NO: 1367722 - DNA, 22 bp, Artificial Sequence
  chemically synthesized
taacagttctttgtatattttg

SEQ ID NO: 1367723 - DNA, 22 bp, Artificial Sequence
  chemically synthesized
ttaacagttctttgtatatttt

SEQ ID NO: 1367724 - DNA, 22 bp, Artificial Sequence
  chemically synthesized
atttttaacagttctttgtata

SEQ ID NO: 1367725 - DNA, 22 bp, Artificial Sequence
  chemically synthesized
ttatccaaaatatacaaagaac

SEQ ID NO: 1367726 - DNA, 22 bp, Artificial Sequence
  chemically synthesized
ttgatttttaacagttctttgt

SEQ ID NO: 1367727 - DNA, 22 bp, Artificial Sequence
  chemically synthesized
tccaaaatatacaaagaactgt

SEQ ID NO: 1367728 - DNA, 22 bp, Artificial Sequence
  chemically synthesized
ttgttgatttttaacagttctt

SEQ ID NO: 1367729 - DNA, 22 bp, Artificial Sequence
  chemically synthesized
attgttgatttttaacagttct

SEQ ID NO: 1367730 - DNA, 22 bp, Artificial Sequence
  chemically synthesized
ttattgttgatttttaacagtt

SEQ ID NO: 1367731 - DNA, 22 bp, Artificial Sequence
  chemically synthesized
cttattgttgatttttaacagt

SEQ ID NO: 1367732 - DNA, 22 bp, Artificial Sequence
  chemically synthesized
tcttattgttgatttttaacag

SEQ ID NO: 1367733 - DNA, 22 bp, Artificial Sequence
  chemically synthesized
ttttcttattgttgatttttaa

SEQ ID NO: 1367734 - DNA, 22 bp, Artificial Sequence
  chemically synthesized
gttttcttattgttgattttta

SEQ ID NO: 1367735 - DNA, 22 bp, Artificial Sequence
  chemically synthesized
tttgttttcttattgttgattt

SEQ ID NO: 1367736 - DNA, 22 bp, Artificial Sequence
  chemically synthesized
ttaaaaatcaacaataagaaaa

SEQ ID NO: 1367737 - DNA, 22 bp, Artificial Sequence
  chemically synthesized
aaaatcaacaataagaaaacaa

SEQ ID NO: 1367738 - DNA, 22 bp, Artificial Sequence
  chemically synthesized
aaatagagttgtttgttttctt

SEQ ID NO: 1367739 - DNA, 22 bp, Artificial Sequence
  chemically synthesized
aaaatagagttgtttgttttct

SEQ ID NO: 1367740 - DNA, 22 bp, Artificial Sequence
  chemically synthesized
taaaatagagttgtttgttttc

SEQ ID NO: 1367741 - DNA, 22 bp, Artificial Sequence
  chemically synthesized
ttaaaatagagttgtttgtttt

SEQ ID NO: 1367742 - DNA, 22 bp, Artificial Sequence
  chemically synthesized
cccatttttaaaatagagttgt

SEQ ID NO: 1367743 - DNA, 22 bp, Artificial Sequence
  chemically synthesized
gcccatttttaaaatagagttg

SEQ ID NO: 1367744 - DNA, 22 bp, Artificial Sequence
  chemically synthesized
tgcccatttttaaaatagagtt

SEQ ID NO: 1367745 - DNA, 22 bp, Artificial Sequence
  chemically synthesized
aggtgttttgcccatttttaaa

SEQ ID NO: 1367746 - DNA, 22 bp, Artificial Sequence
  chemically synthesized
ttaaggtgttttgcccattttt

SEQ ID NO: 1367747 - DNA, 22 bp, Artificial Sequence
  chemically synthesized
tctgttaaggtgttttgcccat

SEQ ID NO: 1367748 - DNA, 22 bp, Artificial Sequence
  chemically synthesized
tattttaaaaatgggcaaaaca

SEQ ID NO: 1367749 - DNA, 22 bp, Artificial Sequence
  chemically synthesized
ttttaaaaatgggcaaaacacc

SEQ ID NO: 1367750 - DNA, 22 bp, Artificial Sequence
  chemically synthesized
taaaaatgggcaaaacacctta

SEQ ID NO: 1367751 - DNA, 22 bp, Artificial Sequence
  chemically synthesized
aaaaatgggcaaaacaccttaa

SEQ ID NO: 1367752 - DNA, 22 bp, Artificial Sequence
  chemically synthesized
gtgagttatctgttaaggtgtt

SEQ ID NO: 1367753 - DNA, 22 bp, Artificial Sequence
  chemically synthesized
aaaatgggcaaaacaccttaac

SEQ ID NO: 1367754 - DNA, 22 bp, Artificial Sequence
  chemically synthesized
ggtgagttatctgttaaggtgt

SEQ ID NO: 1367755 - DNA, 22 bp, Artificial Sequence
  chemically synthesized
tggtgagttatctgttaaggtg

SEQ ID NO: 1367756 - DNA, 22 bp, Artificial Sequence
  chemically synthesized
tttggtgagttatctgttaagg

SEQ ID NO: 1367757 - DNA, 22 bp, Artificial Sequence
  chemically synthesized
ctttggtgagttatctgttaag

SEQ ID NO: 1367758 - DNA, 22 bp, Artificial Sequence
  chemically synthesized
tatatcttctttggtgagttat

SEQ ID NO: 1367759 - DNA, 22 bp, Artificial Sequence
  chemically synthesized
catctgtatatcttctttggtg

SEQ ID NO: 1367760 - DNA, 22 bp, Artificial Sequence
  chemically synthesized
aacagataactcaccaaagaag

SEQ ID NO: 1367761 - DNA, 22 bp, Artificial Sequence
  chemically synthesized
ccatctgtatatcttctttggt

SEQ ID NO: 1367762 - DNA, 22 bp, Artificial Sequence
  chemically synthesized
acagataactcaccaaagaaga

SEQ ID NO: 1367763 - DNA, 22 bp, Artificial Sequence
  chemically synthesized
tccatctgtatatcttctttgg

SEQ ID NO: 1367764 - DNA, 22 bp, Artificial Sequence
  chemically synthesized
ttttccatctgtatatcttctt

SEQ ID NO: 1367765 - DNA, 22 bp, Artificial Sequence
  chemically synthesized
accaaagaagatatacagatgg

SEQ ID NO: 1367766 - DNA, 22 bp, Artificial Sequence
  chemically synthesized
atacgcctgttttccatctgta

SEQ ID NO: 1367767 - DNA, 22 bp, Artificial Sequence
  chemically synthesized
catacgcctgttttccatctgt

SEQ ID NO: 1367768 - DNA, 22 bp, Artificial Sequence
  chemically synthesized
tcatacgcctgttttccatctg

SEQ ID NO: 1367769 - DNA, 22 bp, Artificial Sequence
  chemically synthesized
ttcatacgcctgttttccatct

SEQ ID NO: 1367770 - DNA, 22 bp, Artificial Sequence
  chemically synthesized
atgacatatgatgtgaagcgtc

SEQ ID NO: 1367771 - DNA, 22 bp, Artificial Sequence
  chemically synthesized
ctgatgacatatgatgtgaagc

SEQ ID NO: 1367772 - DNA, 22 bp, Artificial Sequence
  chemically synthesized
cctgatgacatatgatgtgaag

SEQ ID NO: 1367773 - DNA, 22 bp, Artificial Sequence
  chemically synthesized
caatttcctgatgacatatgat

SEQ ID NO: 1367774 - DNA, 22 bp, Artificial Sequence
  chemically synthesized
gcaatttcctgatgacatatga

SEQ ID NO: 1367775 - DNA, 22 bp, Artificial Sequence
  chemically synthesized
atttgcaatttcctgatgacat

SEQ ID NO: 1367776 - DNA, 22 bp, Artificial Sequence
  chemically synthesized
aatttgcaatttcctgatgaca

SEQ ID NO: 1367777 - DNA, 22 bp, Artificial Sequence
  chemically synthesized
taatttgcaatttcctgatgac

SEQ ID NO: 1367778 - DNA, 22 bp, Artificial Sequence
  chemically synthesized
cacatcatatgtcatcaggaaa

SEQ ID NO: 1367779 - DNA, 22 bp, Artificial Sequence
  chemically synthesized
acatcatatgtcatcaggaaat

SEQ ID NO: 1367780 - DNA, 22 bp, Artificial Sequence
  chemically synthesized
ttttaatttgcaatttcctgat

SEQ ID NO: 1367781 - DNA, 22 bp, Artificial Sequence
  chemically synthesized
ttgttttaatttgcaatttcct

SEQ ID NO: 1367782 - DNA, 22 bp, Artificial Sequence
  chemically synthesized
caaattaaaacaacaatgtgat

SEQ ID NO: 1367783 - DNA, 22 bp, Artificial Sequence
  chemically synthesized
agaggtatgtagtagcatcaca

SEQ ID NO: 1367784 - DNA, 22 bp, Artificial Sequence
  chemically synthesized
taagaggtatgtagtagcatca

SEQ ID NO: 1367785 - DNA, 22 bp, Artificial Sequence
  chemically synthesized
aaacaacaatgtgatgctacta

SEQ ID NO: 1367786 - DNA, 22 bp, Artificial Sequence
  chemically synthesized
accattctaagaggtatgtagt

SEQ ID NO: 1367787 - DNA, 22 bp, Artificial Sequence
  chemically synthesized
agtgttgaccattctaagaggt

SEQ ID NO: 1367788 - DNA, 22 bp, Artificial Sequence
  chemically synthesized
tgagtgttgaccattctaagag

SEQ ID NO: 1367789 - DNA, 22 bp, Artificial Sequence
  chemically synthesized
ttctgagtgttgaccattctaa

SEQ ID NO: 1367790 - DNA, 22 bp, Artificial Sequence
  chemically synthesized
ctacatacctcttagaatggtc

SEQ ID NO: 1367791 - DNA, 22 bp, Artificial Sequence
  chemically synthesized
catacctcttagaatggtcaac

SEQ ID NO: 1367792 - DNA, 22 bp, Artificial Sequence
  chemically synthesized
ttagaatggtcaacactcagaa

SEQ ID NO: 1367793 - DNA, 22 bp, Artificial Sequence
  chemically synthesized
ggtggtgtcactgttctgagtg

SEQ ID NO: 1367794 - DNA, 22 bp, Artificial Sequence
  chemically synthesized
agaatggtcaacactcagaaca

SEQ ID NO: 1367795 - DNA, 22 bp, Artificial Sequence
  chemically synthesized
gaatggtcaacactcagaacag

SEQ ID NO: 1367796 - DNA, 22 bp, Artificial Sequence
  chemically synthesized
accagcattgggtggtgtcact

SEQ ID NO: 1367797 - DNA, 22 bp, Artificial Sequence
  chemically synthesized
agaacagtgacaccacccaatg

SEQ ID NO: 1367798 - DNA, 22 bp, Artificial Sequence
  chemically synthesized
catatcctcaccagcattgggt

SEQ ID NO: 1367799 - DNA, 22 bp, Artificial Sequence
  chemically synthesized
ctccatatcctcaccagcattg

SEQ ID NO: 1367800 - DNA, 22 bp, Artificial Sequence
  chemically synthesized
ttactccatatcctcaccagca

SEQ ID NO: 1367801 - DNA, 22 bp, Artificial Sequence
  chemically synthesized
ctattactccatatcctcacca

SEQ ID NO: 1367802 - DNA, 22 bp, Artificial Sequence
  chemically synthesized
gtgaggatatggagtaatagga

SEQ ID NO: 1367803 - DNA, 22 bp, Artificial Sequence
  chemically synthesized
acaagcaatgaacaagagttcc

SEQ ID NO: 1367804 - DNA, 22 bp, Artificial Sequence
  chemically synthesized
tcacaagcaatgaacaagagtt

SEQ ID NO: 1367805 - DNA, 22 bp, Artificial Sequence
  chemically synthesized
cattctcacaagcaatgaacaa

SEQ ID NO: 1367806 - DNA, 22 bp, Artificial Sequence
  chemically synthesized
acattctcacaagcaatgaaca

SEQ ID NO: 1367807 - DNA, 22 bp, Artificial Sequence
  chemically synthesized
tacaagtttacattctcacaag

SEQ ID NO: 1367808 - DNA, 22 bp, Artificial Sequence
  chemically synthesized
ttgttcattgcttgtgagaatg

SEQ ID NO: 1367809 - DNA, 22 bp, Artificial Sequence
  chemically synthesized
gttcattgcttgtgagaatgta

SEQ ID NO: 1367810 - DNA, 22 bp, Artificial Sequence
  chemically synthesized
ttcattgcttgtgagaatgtaa

SEQ ID NO: 1367811 - DNA, 22 bp, Artificial Sequence
  chemically synthesized
attgcttgtgagaatgtaaact

SEQ ID NO: 1367812 - DNA, 22 bp, Artificial Sequence
  chemically synthesized
agtggttgtacaagtttacatt

SEQ ID NO: 1367813 - DNA, 22 bp, Artificial Sequence
  chemically synthesized
cagtggttgtacaagtttacat

SEQ ID NO: 1367814 - DNA, 22 bp, Artificial Sequence
  chemically synthesized
tcagtggttgtacaagtttaca

SEQ ID NO: 1367815 - DNA, 22 bp, Artificial Sequence
  chemically synthesized
cttgtgagaatgtaaacttgta

SEQ ID NO: 1367816 - DNA, 22 bp, Artificial Sequence
  chemically synthesized
attttcagtggttgtacaagtt

SEQ ID NO: 1367817 - DNA, 22 bp, Artificial Sequence
  chemically synthesized
gtgagaatgtaaacttgtacaa

SEQ ID NO: 1367818 - DNA, 22 bp, Artificial Sequence
  chemically synthesized
tgagaatgtaaacttgtacaac

SEQ ID NO: 1367819 - DNA, 22 bp, Artificial Sequence
  chemically synthesized
aactgattttcagtggttgtac

SEQ ID NO: 1367820 - DNA, 22 bp, Artificial Sequence
  chemically synthesized
aaactgattttcagtggttgta

SEQ ID NO: 1367821 - DNA, 22 bp, Artificial Sequence
  chemically synthesized
gtacaaccactgaaaatcagtt

SEQ ID NO: 1367822 - DNA, 22 bp, Artificial Sequence
  chemically synthesized
tacaaccactgaaaatcagttt

SEQ ID NO: 1367823 - DNA, 22 bp, Artificial Sequence
  chemically synthesized
taaaaaatccttaaactgattt

SEQ ID NO: 1367824 - DNA, 22 bp, Artificial Sequence
  chemically synthesized
gtaaaaaatccttaaactgatt

SEQ ID NO: 1367825 - DNA, 22 bp, Artificial Sequence
  chemically synthesized
tgtaaaaaatccttaaactgat

SEQ ID NO: 1367826 - DNA, 22 bp, Artificial Sequence
  chemically synthesized
gttttgtaaaaaatccttaaac

SEQ ID NO: 1367827 - DNA, 22 bp, Artificial Sequence
  chemically synthesized
agttttgtaaaaaatccttaaa

SEQ ID NO: 1367828 - DNA, 22 bp, Artificial Sequence
  chemically synthesized
aaaatcagtttaaggatttttt

SEQ ID NO: 1367829 - DNA, 22 bp, Artificial Sequence
  chemically synthesized
aaggattttttacaaaactaaa

SEQ ID NO: 1367830 - DNA, 22 bp, Artificial Sequence
  chemically synthesized
aggattttttacaaaactaaac

SEQ ID NO: 1367831 - DNA, 22 bp, Artificial Sequence
  chemically synthesized
atcatatagcaagagtatgttt

SEQ ID NO: 1367832 - DNA, 22 bp, Artificial Sequence
  chemically synthesized
tttacaaaactaaacatactct

SEQ ID NO: 1367833 - DNA, 22 bp, Artificial Sequence
  chemically synthesized
gatcatatagcaagagtatgtt

SEQ ID NO: 1367834 - DNA, 22 bp, Artificial Sequence
  chemically synthesized
ttacaaaactaaacatactctt

SEQ ID NO: 1367835 - DNA, 22 bp, Artificial Sequence
  chemically synthesized
tacaaaactaaacatactcttg

SEQ ID NO: 1367836 - DNA, 22 bp, Artificial Sequence
  chemically synthesized
acaaaactaaacatactcttgc

SEQ ID NO: 1367837 - DNA, 22 bp, Artificial Sequence
  chemically synthesized
cttgatcatatagcaagagtat

SEQ ID NO: 1367838 - DNA, 22 bp, Artificial Sequence
  chemically synthesized
caaaactaaacatactcttgct

SEQ ID NO: 1367839 - DNA, 22 bp, Artificial Sequence
  chemically synthesized
attacttgatcatatagcaaga

SEQ ID NO: 1367840 - DNA, 22 bp, Artificial Sequence
  chemically synthesized
aacatactcttgctatatgatc

SEQ ID NO: 1367841 - DNA, 22 bp, Artificial Sequence
  chemically synthesized
ttgctatatgatcaagtaatta

SEQ ID NO: 1367842 - DNA, 22 bp, Artificial Sequence
  chemically synthesized
gctatatgatcaagtaattaga

SEQ ID NO: 1367843 - DNA, 22 bp, Artificial Sequence
  chemically synthesized
ctatatgatcaagtaattagac

SEQ ID NO: 1367844 - DNA, 22 bp, Artificial Sequence
  chemically synthesized
tatgatcaagtaattagactct

SEQ ID NO: 1367845 - DNA, 22 bp, Artificial Sequence
  chemically synthesized
ggtaaataccaaagagtctaat

SEQ ID NO: 1367846 - DNA, 22 bp, Artificial Sequence
  chemically synthesized
gggtaaataccaaagagtctaa

SEQ ID NO: 1367847 - DNA, 22 bp, Artificial Sequence
  chemically synthesized
tttgggtaaataccaaagagtc

SEQ ID NO: 1367848 - DNA, 22 bp, Artificial Sequence
  chemically synthesized
atttgggtaaataccaaagagt

SEQ ID NO: 1367849 - DNA, 22 bp, Artificial Sequence
  chemically synthesized
agcttatttgggtaaataccaa

SEQ ID NO: 1367850 - DNA, 22 bp, Artificial Sequence
  chemically synthesized
cagcttatttgggtaaatacca

SEQ ID NO: 1367851 - DNA, 22 bp, Artificial Sequence
  chemically synthesized
tcagcttatttgggtaaatacc

SEQ ID NO: 1367852 - DNA, 22 bp, Artificial Sequence
  chemically synthesized
gactctttggtatttacccaaa

SEQ ID NO: 1367853 - DNA, 22 bp, Artificial Sequence
  chemically synthesized
tttggtatttacccaaataagc

SEQ ID NO: 1367854 - DNA, 22 bp, Artificial Sequence
  chemically synthesized
tggtatttacccaaataagctg

SEQ ID NO: 1367855 - DNA, 22 bp, Artificial Sequence
  chemically synthesized
ggtatttacccaaataagctga

SEQ ID NO: 1367856 - DNA, 22 bp, Artificial Sequence
  chemically synthesized
gtatttacccaaataagctgaa

SEQ ID NO: 1367857 - DNA, 22 bp, Artificial Sequence
  chemically synthesized
tgcggacataagttttcagctt

SEQ ID NO: 1367858 - DNA, 22 bp, Artificial Sequence
  chemically synthesized
gtgcggacataagttttcagct

SEQ ID NO: 1367859 - DNA, 22 bp, Artificial Sequence
  chemically synthesized
tgtgcggacataagttttcagc

SEQ ID NO: 1367860 - DNA, 22 bp, Artificial Sequence
  chemically synthesized
ttgtgcggacataagttttcag

SEQ ID NO: 1367861 - DNA, 22 bp, Artificial Sequence
  chemically synthesized
acccaaataagctgaaaactta

SEQ ID NO: 1367862 - DNA, 22 bp, Artificial Sequence
  chemically synthesized
cccaaataagctgaaaacttat

SEQ ID NO: 1367863 - DNA, 22 bp, Artificial Sequence
  chemically synthesized
caggtttttgtgcggacataag

SEQ ID NO: 1367864 - DNA, 22 bp, Artificial Sequence
  chemically synthesized
aaaacttatgtccgcacaaaaa

SEQ ID NO: 1367865 - DNA, 22 bp, Artificial Sequence
  chemically synthesized
taaacatccatctgcaggtttt

SEQ ID NO: 1367866 - DNA, 22 bp, Artificial Sequence
  chemically synthesized
atgtccgcacaaaaacctgcag

SEQ ID NO: 1367867 - DNA, 22 bp, Artificial Sequence
  chemically synthesized
tgtccgcacaaaaacctgcaga

SEQ ID NO: 1367868 - DNA, 22 bp, Artificial Sequence
  chemically synthesized
ctataaacatccatctgcaggt

SEQ ID NO: 1367869 - DNA, 22 bp, Artificial Sequence
  chemically synthesized
tgaataaagctgctataaacat

SEQ ID NO: 1367870 - DNA, 22 bp, Artificial Sequence
  chemically synthesized
cagatggatgtttatagcagct

SEQ ID NO: 1367871 - DNA, 22 bp, Artificial Sequence
  chemically synthesized
aggcaattatgaataaagctgc

SEQ ID NO: 1367872 - DNA, 22 bp, Artificial Sequence
  chemically synthesized
caagttcaggcaattatgaata

SEQ ID NO: 1367873 - DNA, 22 bp, Artificial Sequence
  chemically synthesized
ccaagttcaggcaattatgaat

SEQ ID NO: 1367874 - DNA, 22 bp, Artificial Sequence
  chemically synthesized
atagcagctttattcataattg

SEQ ID NO: 1367875 - DNA, 22 bp, Artificial Sequence
  chemically synthesized
tagcagctttattcataattgc

SEQ ID NO: 1367876 - DNA, 22 bp, Artificial Sequence
  chemically synthesized
tttccaagttcaggcaattatg

SEQ ID NO: 1367877 - DNA, 22 bp, Artificial Sequence
  chemically synthesized
ttgtttccaagttcaggcaatt

SEQ ID NO: 1367878 - DNA, 22 bp, Artificial Sequence
  chemically synthesized
gttgtttccaagttcaggcaat

SEQ ID NO: 1367879 - DNA, 22 bp, Artificial Sequence
  chemically synthesized
tattcataattgcctgaacttg

SEQ ID NO: 1367880 - DNA, 22 bp, Artificial Sequence
  chemically synthesized
attcataattgcctgaacttgg

SEQ ID NO: 1367881 - DNA, 22 bp, Artificial Sequence
  chemically synthesized
ttcataattgcctgaacttgga

SEQ ID NO: 1367882 - DNA, 22 bp, Artificial Sequence
  chemically synthesized
ataattgcctgaacttggaaac

SEQ ID NO: 1367883 - DNA, 22 bp, Artificial Sequence
  chemically synthesized
aagaacatcttgttgtttccaa

SEQ ID NO: 1367884 - DNA, 22 bp, Artificial Sequence
  chemically synthesized
ctgaagaacatcttgttgtttc

SEQ ID NO: 1367885 - DNA, 22 bp, Artificial Sequence
  chemically synthesized
cctgaacttggaaacaacaaga

SEQ ID NO: 1367886 - DNA, 22 bp, Artificial Sequence
  chemically synthesized
acctactgaagaacatcttgtt

SEQ ID NO: 1367887 - DNA, 22 bp, Artificial Sequence
  chemically synthesized
aacttggaaacaacaagatgtt

SEQ ID NO: 1367888 - DNA, 22 bp, Artificial Sequence
  chemically synthesized
ggaaacaacaagatgttcttca

SEQ ID NO: 1367889 - DNA, 22 bp, Artificial Sequence
  chemically synthesized
gaaacaacaagatgttcttcag

SEQ ID NO: 1367890 - DNA, 22 bp, Artificial Sequence
  chemically synthesized
tccattcacctactgaagaaca

SEQ ID NO: 1367891 - DNA, 22 bp, Artificial Sequence
  chemically synthesized
atccattcacctactgaagaac

SEQ ID NO: 1367892 - DNA, 22 bp, Artificial Sequence
  chemically synthesized
tttatccattcacctactgaag

SEQ ID NO: 1367893 - DNA, 22 bp, Artificial Sequence
  chemically synthesized
atttatccattcacctactgaa

SEQ ID NO: 1367894 - DNA, 22 bp, Artificial Sequence
  chemically synthesized
ttcagtaggtgaatggataaat

SEQ ID NO: 1367895 - DNA, 22 bp, Artificial Sequence
  chemically synthesized
aatgtaccagtttatttatcca

SEQ ID NO: 1367896 - DNA, 22 bp, Artificial Sequence
  chemically synthesized
cagtaggtgaatggataaataa

SEQ ID NO: 1367897 - DNA, 22 bp, Artificial Sequence
  chemically synthesized
agtaggtgaatggataaataaa

SEQ ID NO: 1367898 - DNA, 22 bp, Artificial Sequence
  chemically synthesized
tagtctgaatgtaccagtttat

SEQ ID NO: 1367899 - DNA, 22 bp, Artificial Sequence
  chemically synthesized
gcatctatagtctgaatgtacc

SEQ ID NO: 1367900 - DNA, 22 bp, Artificial Sequence
  chemically synthesized
agcatctatagtctgaatgtac

SEQ ID NO: 1367901 - DNA, 22 bp, Artificial Sequence
  chemically synthesized
tagcatctatagtctgaatgta

SEQ ID NO: 1367902 - DNA, 22 bp, Artificial Sequence
  chemically synthesized
ttagcatctatagtctgaatgt

SEQ ID NO: 1367903 - DNA, 22 bp, Artificial Sequence
  chemically synthesized
tttagcatctatagtctgaatg

SEQ ID NO: 1367904 - DNA, 22 bp, Artificial Sequence
  chemically synthesized
tttttagcatctatagtctgaa

SEQ ID NO: 1367905 - DNA, 22 bp, Artificial Sequence
  chemically synthesized
ctttttagcatctatagtctga

SEQ ID NO: 1367906 - DNA, 22 bp, Artificial Sequence
  chemically synthesized
atttctttttagcatctatagt

SEQ ID NO: 1367907 - DNA, 22 bp, Artificial Sequence
  chemically synthesized
gtacattcagactatagatgct

SEQ ID NO: 1367908 - DNA, 22 bp, Artificial Sequence
  chemically synthesized
atagctcatttctttttagcat

SEQ ID NO: 1367909 - DNA, 22 bp, Artificial Sequence
  chemically synthesized
gatagctcatttctttttagca

SEQ ID NO: 1367910 - DNA, 22 bp, Artificial Sequence
  chemically synthesized
agactatagatgctaaaaagaa

SEQ ID NO: 1367911 - DNA, 22 bp, Artificial Sequence
  chemically synthesized
atgtcttgatagctcatttctt

SEQ ID NO: 1367912 - DNA, 22 bp, Artificial Sequence
  chemically synthesized
tagatgctaaaaagaaatgagc

SEQ ID NO: 1367913 - DNA, 22 bp, Artificial Sequence
  chemically synthesized
catgtcttgatagctcatttct

SEQ ID NO: 1367914 - DNA, 22 bp, Artificial Sequence
  chemically synthesized
tcatgtcttgatagctcatttc

SEQ ID NO: 1367915 - DNA, 22 bp, Artificial Sequence
  chemically synthesized
aaaagaaatgagctatcaagac

SEQ ID NO: 1367916 - DNA, 22 bp, Artificial Sequence
  chemically synthesized
gtgtattttcatgtcttgatag

SEQ ID NO: 1367917 - DNA, 22 bp, Artificial Sequence
  chemically synthesized
agtgtattttcatgtcttgata

SEQ ID NO: 1367918 - DNA, 22 bp, Artificial Sequence
  chemically synthesized
cttagtgtattttcatgtcttg

SEQ ID NO: 1367919 - DNA, 22 bp, Artificial Sequence
  chemically synthesized
ccttagtgtattttcatgtctt

SEQ ID NO: 1367920 - DNA, 22 bp, Artificial Sequence
  chemically synthesized
agtttccttagtgtattttcat

SEQ ID NO: 1367921 - DNA, 22 bp, Artificial Sequence
  chemically synthesized
aagtttccttagtgtattttca

SEQ ID NO: 1367922 - DNA, 22 bp, Artificial Sequence
  chemically synthesized
tcaagacatgaaaatacactaa

SEQ ID NO: 1367923 - DNA, 22 bp, Artificial Sequence
  chemically synthesized
gaaacaggcatttaagtttcct

SEQ ID NO: 1367924 - DNA, 22 bp, Artificial Sequence
  chemically synthesized
agttagaaacaggcatttaagt

SEQ ID NO: 1367925 - DNA, 22 bp, Artificial Sequence
  chemically synthesized
cagttagaaacaggcatttaag

SEQ ID NO: 1367926 - DNA, 22 bp, Artificial Sequence
  chemically synthesized
cttcagttagaaacaggcattt

SEQ ID NO: 1367927 - DNA, 22 bp, Artificial Sequence
  chemically synthesized
ccttcagttagaaacaggcatt

SEQ ID NO: 1367928 - DNA, 22 bp, Artificial Sequence
  chemically synthesized
aggaaacttaaatgcctgtttc

SEQ ID NO: 1367929 - DNA, 22 bp, Artificial Sequence
  chemically synthesized
gcttccttcagttagaaacagg

SEQ ID NO: 1367930 - DNA, 22 bp, Artificial Sequence
  chemically synthesized
agattggcttccttcagttaga

SEQ ID NO: 1367931 - DNA, 22 bp, Artificial Sequence
  chemically synthesized
aaatgcctgtttctaactgaag

SEQ ID NO: 1367932 - DNA, 22 bp, Artificial Sequence
  chemically synthesized
cagattggcttccttcagttag

SEQ ID NO: 1367933 - DNA, 22 bp, Artificial Sequence
  chemically synthesized
aatgcctgtttctaactgaagg

SEQ ID NO: 1367934 - DNA, 22 bp, Artificial Sequence
  chemically synthesized
tcagattggcttccttcagtta

SEQ ID NO: 1367935 - DNA, 22 bp, Artificial Sequence
  chemically synthesized
tttctaactgaaggaagccaat

SEQ ID NO: 1367936 - DNA, 22 bp, Artificial Sequence
  chemically synthesized
ctaactgaaggaagccaatctg

SEQ ID NO: 1367937 - DNA, 22 bp, Artificial Sequence
  chemically synthesized
taactgaaggaagccaatctga

SEQ ID NO: 1367938 - DNA, 22 bp, Artificial Sequence
  chemically synthesized
actgaaggaagccaatctgaaa

SEQ ID NO: 1367939 - DNA, 22 bp, Artificial Sequence
  chemically synthesized
aaggaagccaatctgaaaatgc

SEQ ID NO: 1367940 - DNA, 22 bp, Artificial Sequence
  chemically synthesized
cagtatatagaagcattttcag

SEQ ID NO: 1367941 - DNA, 22 bp, Artificial Sequence
  chemically synthesized
gaatcctacagtatatagaagc

SEQ ID NO: 1367942 - DNA, 22 bp, Artificial Sequence
  chemically synthesized
aaaatgcttctatatactgtag

SEQ ID NO: 1367943 - DNA, 22 bp, Artificial Sequence
  chemically synthesized
gatgtcatatagttggaatcct

SEQ ID NO: 1367944 - DNA, 22 bp, Artificial Sequence
  chemically synthesized
ctatatactgtaggattccaac

SEQ ID NO: 1367945 - DNA, 22 bp, Artificial Sequence
  chemically synthesized
tatatactgtaggattccaact

SEQ ID NO: 1367946 - DNA, 22 bp, Artificial Sequence
  chemically synthesized
ctggatgtcatatagttggaat

SEQ ID NO: 1367947 - DNA, 22 bp, Artificial Sequence
  chemically synthesized
tatactgtaggattccaactat

SEQ ID NO: 1367948 - DNA, 22 bp, Artificial Sequence
  chemically synthesized
cctggatgtcatatagttggaa

SEQ ID NO: 1367949 - DNA, 22 bp, Artificial Sequence
  chemically synthesized
tcctggatgtcatatagttgga

SEQ ID NO: 1367950 - DNA, 22 bp, Artificial Sequence
  chemically synthesized
cctttcctggatgtcatatagt

SEQ ID NO: 1367951 - DNA, 22 bp, Artificial Sequence
  chemically synthesized
acctttcctggatgtcatatag

SEQ ID NO: 1367952 - DNA, 22 bp, Artificial Sequence
  chemically synthesized
taggattccaactatatgacat

SEQ ID NO: 1367953 - DNA, 22 bp, Artificial Sequence
  chemically synthesized
tacctttcctggatgtcatata

SEQ ID NO: 1367954 - DNA, 22 bp, Artificial Sequence
  chemically synthesized
ataattttacctttcctggatg

SEQ ID NO: 1367955 - DNA, 22 bp, Artificial Sequence
  chemically synthesized
caactatatgacatccaggaaa

SEQ ID NO: 1367956 - DNA, 22 bp, Artificial Sequence
  chemically synthesized
cataattttacctttcctggat

SEQ ID NO: 1367957 - DNA, 22 bp, Artificial Sequence
  chemically synthesized
tcttcataattttacctttcct

SEQ ID NO: 1367958 - DNA, 22 bp, Artificial Sequence
  chemically synthesized
tatgacatccaggaaaggtaaa

SEQ ID NO: 1367959 - DNA, 22 bp, Artificial Sequence
  chemically synthesized
ctatcttcataattttaccttt

SEQ ID NO: 1367960 - DNA, 22 bp, Artificial Sequence
  chemically synthesized
actatcttcataattttacctt

SEQ ID NO: 1367961 - DNA, 22 bp, Artificial Sequence
  chemically synthesized
tactatcttcataattttacct

SEQ ID NO: 1367962 - DNA, 22 bp, Artificial Sequence
  chemically synthesized
ttactatcttcataattttacc

SEQ ID NO: 1367963 - DNA, 22 bp, Artificial Sequence
  chemically synthesized
atatttttactatcttcataat

SEQ ID NO: 1367964 - DNA, 22 bp, Artificial Sequence
  chemically synthesized
gcaaccactgatatttttacta

SEQ ID NO: 1367965 - DNA, 22 bp, Artificial Sequence
  chemically synthesized
tgaagatagtaaaaatatcagt

SEQ ID NO: 1367966 - DNA, 22 bp, Artificial Sequence
  chemically synthesized
acccctggcaaccactgatatt

SEQ ID NO: 1367967 - DNA, 22 bp, Artificial Sequence
  chemically synthesized
ccaactaacccctggcaaccac

SEQ ID NO: 1367968 - DNA, 22 bp, Artificial Sequence
  chemically synthesized
cctgccaactaacccctggcaa

SEQ ID NO: 1367969 - DNA, 22 bp, Artificial Sequence
  chemically synthesized
gtcatgcctccctgccaactaa

SEQ ID NO: 1367970 - DNA, 22 bp, Artificial Sequence
  chemically synthesized
cctagtcatgcctccctgccaa

SEQ ID NO: 1367971 - DNA, 22 bp, Artificial Sequence
  chemically synthesized
ccaggggttagttggcagggag

SEQ ID NO: 1367972 - DNA, 22 bp, Artificial Sequence
  chemically synthesized
tgcctagtcatgcctccctgcc

SEQ ID NO: 1367973 - DNA, 22 bp, Artificial Sequence
  chemically synthesized
tgctctgcctagtcatgcctcc

SEQ ID NO: 1367974 - DNA, 22 bp, Artificial Sequence
  chemically synthesized
gtgctctgcctagtcatgcctc

SEQ ID NO: 1367975 - DNA, 22 bp, Artificial Sequence
  chemically synthesized
gttggcagggaggcatgactag

SEQ ID NO: 1367976 - DNA, 22 bp, Artificial Sequence
  chemically synthesized
gcagggaggcatgactaggcag

SEQ ID NO: 1367977 - DNA, 22 bp, Artificial Sequence
  chemically synthesized
aaatatttgtgctctgcctagt

SEQ ID NO: 1367978 - DNA, 22 bp, Artificial Sequence
  chemically synthesized
acctaaaatatttgtgctctgc

SEQ ID NO: 1367979 - DNA, 22 bp, Artificial Sequence
  chemically synthesized
actgacctaaaatatttgtgct

SEQ ID NO: 1367980 - DNA, 22 bp, Artificial Sequence
  chemically synthesized
cactgacctaaaatatttgtgc

SEQ ID NO: 1367981 - DNA, 22 bp, Artificial Sequence
  chemically synthesized
ggcagagcacaaatattttagg

SEQ ID NO: 1367982 - DNA, 22 bp, Artificial Sequence
  chemically synthesized
taggtcagtgaaactactctgt

SEQ ID NO: 1367983 - DNA, 22 bp, Artificial Sequence
  chemically synthesized
tgataatatcatacagagtagt

SEQ ID NO: 1367984 - DNA, 22 bp, Artificial Sequence
  chemically synthesized
aggtcagtgaaactactctgta

SEQ ID NO: 1367985 - DNA, 22 bp, Artificial Sequence
  chemically synthesized
ggtcagtgaaactactctgtat

SEQ ID NO: 1367986 - DNA, 22 bp, Artificial Sequence
  chemically synthesized
ctatgataatatcatacagagt

SEQ ID NO: 1367987 - DNA, 22 bp, Artificial Sequence
  chemically synthesized
ctctgtatgatattatcatagt

SEQ ID NO: 1367988 - DNA, 22 bp, Artificial Sequence
  chemically synthesized
tgtatgatattatcatagtaga

SEQ ID NO: 1367989 - DNA, 22 bp, Artificial Sequence
  chemically synthesized
tagtgatgtgtatctactatga

SEQ ID NO: 1367990 - DNA, 22 bp, Artificial Sequence
  chemically synthesized
atagtgatgtgtatctactatg

SEQ ID NO: 1367991 - DNA, 22 bp, Artificial Sequence
  chemically synthesized
tatgatattatcatagtagata

SEQ ID NO: 1367992 - DNA, 22 bp, Artificial Sequence
  chemically synthesized
gacaaatttatagtgatgtgta

SEQ ID NO: 1367993 - DNA, 22 bp, Artificial Sequence
  chemically synthesized
ggacaaatttatagtgatgtgt

SEQ ID NO: 1367994 - DNA, 22 bp, Artificial Sequence
  chemically synthesized
tcatagtagatacacatcacta

SEQ ID NO: 1367995 - DNA, 22 bp, Artificial Sequence
  chemically synthesized
tgtgtttggacaaatttatagt

SEQ ID NO: 1367996 - DNA, 22 bp, Artificial Sequence
  chemically synthesized
tgtgtgtttggacaaatttata

SEQ ID NO: 1367997 - DNA, 22 bp, Artificial Sequence
  chemically synthesized
ctgtgtgtttggacaaatttat

SEQ ID NO: 1367998 - DNA, 22 bp, Artificial Sequence
  chemically synthesized
tctgtgtgtttggacaaattta

SEQ ID NO: 1367999 - DNA, 22 bp, Artificial Sequence
  chemically synthesized
tgttttctgtgtgtttggacaa

SEQ ID NO: 1368000 - DNA, 22 bp, Artificial Sequence
  chemically synthesized
ttgtgttttctgtgtgtttgga

SEQ ID NO: 1368001 - DNA, 22 bp, Artificial Sequence
  chemically synthesized
ttgttgtgttttctgtgtgttt

SEQ ID NO: 1368002 - DNA, 22 bp, Artificial Sequence
  chemically synthesized
taaatttgtccaaacacacaga

SEQ ID NO: 1368003 - DNA, 22 bp, Artificial Sequence
  chemically synthesized
gttgttgtgttttctgtgtgtt

SEQ ID NO: 1368004 - DNA, 22 bp, Artificial Sequence
  chemically synthesized
ttgttgttgtgttttctgtgtg

SEQ ID NO: 1368005 - DNA, 22 bp, Artificial Sequence
  chemically synthesized
ctcttgttgttgtgttttctgt

SEQ ID NO: 1368006 - DNA, 22 bp, Artificial Sequence
  chemically synthesized
actcttgttgttgtgttttctg

SEQ ID NO: 1368007 - DNA, 22 bp, Artificial Sequence
  chemically synthesized
gtccaaacacacagaaaacaca

SEQ ID NO: 1368008 - DNA, 22 bp, Artificial Sequence
  chemically synthesized
tccaaacacacagaaaacacaa

SEQ ID NO: 1368009 - DNA, 22 bp, Artificial Sequence
  chemically synthesized
gagtttactcttgttgttgtgt

SEQ ID NO: 1368010 - DNA, 22 bp, Artificial Sequence
  chemically synthesized
cattagagtttactcttgttgt

SEQ ID NO: 1368011 - DNA, 22 bp, Artificial Sequence
  chemically synthesized
agatccataggttccattagag

SEQ ID NO: 1368012 - DNA, 22 bp, Artificial Sequence
  chemically synthesized
taactcagatccataggttcca

SEQ ID NO: 1368013 - DNA, 22 bp, Artificial Sequence
  chemically synthesized
taatggaacctatggatctgag

SEQ ID NO: 1368014 - DNA, 22 bp, Artificial Sequence
  chemically synthesized
atggaacctatggatctgagtt

SEQ ID NO: 1368015 - DNA, 22 bp, Artificial Sequence
  chemically synthesized
cgtcaacacatcattataactc

SEQ ID NO: 1368016 - DNA, 22 bp, Artificial Sequence
  chemically synthesized
tggatctgagttataatgatgt

SEQ ID NO: 1368017 - DNA, 22 bp, Artificial Sequence
  chemically synthesized
agttataatgatgtgttgacgt

SEQ ID NO: 1368018 - DNA, 22 bp, Artificial Sequence
  chemically synthesized
caataaatgaacctacgtcaac

SEQ ID NO: 1368019 - DNA, 22 bp, Artificial Sequence
  chemically synthesized
taatgatgtgttgacgtaggtt

SEQ ID NO: 1368020 - DNA, 22 bp, Artificial Sequence
  chemically synthesized
gttacaataaatgaacctacgt

SEQ ID NO: 1368021 - DNA, 22 bp, Artificial Sequence
  chemically synthesized
acgtaggttcatttattgtaac

SEQ ID NO: 1368022 - DNA, 22 bp, Artificial Sequence
  chemically synthesized
accagagtggtacattcgttac

SEQ ID NO: 1368023 - DNA, 22 bp, Artificial Sequence
  chemically synthesized
tcaccagagtggtacattcgtt

SEQ ID NO: 1368024 - DNA, 22 bp, Artificial Sequence
  chemically synthesized
atttattgtaacgaatgtacca

SEQ ID NO: 1368025 - DNA, 22 bp, Artificial Sequence
  chemically synthesized
attgtaacgaatgtaccactct

SEQ ID NO: 1368026 - DNA, 22 bp, Artificial Sequence
  chemically synthesized
ataactctcaccagagtggtac

SEQ ID NO: 1368027 - DNA, 22 bp, Artificial Sequence
  chemically synthesized
ttgtaacgaatgtaccactctg

SEQ ID NO: 1368028 - DNA, 22 bp, Artificial Sequence
  chemically synthesized
ttaataactctcaccagagtgg

SEQ ID NO: 1368029 - DNA, 22 bp, Artificial Sequence
  chemically synthesized
taacgaatgtaccactctggtg

SEQ ID NO: 1368030 - DNA, 22 bp, Artificial Sequence
  chemically synthesized
tcattattaataactctcacca

SEQ ID NO: 1368031 - DNA, 22 bp, Artificial Sequence
  chemically synthesized
tgtcattattaataactctcac

SEQ ID NO: 1368032 - DNA, 22 bp, Artificial Sequence
  chemically synthesized
tggtgagagttattaataatga

SEQ ID NO: 1368033 - DNA, 22 bp, Artificial Sequence
  chemically synthesized
gtgagagttattaataatgaca

SEQ ID NO: 1368034 - DNA, 22 bp, Artificial Sequence
  chemically synthesized
tgcccgcacgagcatggcctct

SEQ ID NO: 1368035 - DNA, 22 bp, Artificial Sequence
  chemically synthesized
ttaataatgacagaggccatgc

SEQ ID NO: 1368036 - DNA, 22 bp, Artificial Sequence
  chemically synthesized
ataatgacagaggccatgctcg

SEQ ID NO: 1368037 - DNA, 22 bp, Artificial Sequence
  chemically synthesized
cccattgtgcccgcacgagcat

SEQ ID NO: 1368038 - DNA, 22 bp, Artificial Sequence
  chemically synthesized
ccatctacccattgtgcccgca

SEQ ID NO: 1368039 - DNA, 22 bp, Artificial Sequence
  chemically synthesized
cccatctacccattgtgcccgc

SEQ ID NO: 1368040 - DNA, 22 bp, Artificial Sequence
  chemically synthesized
gtgcgggcacaatgggtagatg

SEQ ID NO: 1368041 - DNA, 22 bp, Artificial Sequence
  chemically synthesized
aaagacagagatttcccatcta

SEQ ID NO: 1368042 - DNA, 22 bp, Artificial Sequence
  chemically synthesized
acagcaaaattgaaagacagag

SEQ ID NO: 1368043 - DNA, 22 bp, Artificial Sequence
  chemically synthesized
ggttcacagcaaaattgaaaga

SEQ ID NO: 1368044 - DNA, 22 bp, Artificial Sequence
  chemically synthesized
aggttcacagcaaaattgaaag

SEQ ID NO: 1368045 - DNA, 22 bp, Artificial Sequence
  chemically synthesized
taggttcacagcaaaattgaaa

SEQ ID NO: 1368046 - DNA, 22 bp, Artificial Sequence
  chemically synthesized
tgtctttcaattttgctgtgaa

SEQ ID NO: 1368047 - DNA, 22 bp, Artificial Sequence
  chemically synthesized
gagaacctttaggttcacagca

SEQ ID NO: 1368048 - DNA, 22 bp, Artificial Sequence
  chemically synthesized
tctttcaattttgctgtgaacc

SEQ ID NO: 1368049 - DNA, 22 bp, Artificial Sequence
  chemically synthesized
ggagaacctttaggttcacagc

SEQ ID NO: 1368050 - DNA, 22 bp, Artificial Sequence
  chemically synthesized
tggagaacctttaggttcacag

SEQ ID NO: 1368051 - DNA, 22 bp, Artificial Sequence
  chemically synthesized
ttggagaacctttaggttcaca

SEQ ID NO: 1368052 - DNA, 22 bp, Artificial Sequence
  chemically synthesized
tcaattttgctgtgaacctaaa

SEQ ID NO: 1368053 - DNA, 22 bp, Artificial Sequence
  chemically synthesized
caattttgctgtgaacctaaag

SEQ ID NO: 1368054 - DNA, 22 bp, Artificial Sequence
  chemically synthesized
tttttggagaacctttaggttc

SEQ ID NO: 1368055 - DNA, 22 bp, Artificial Sequence
  chemically synthesized
aattttgctgtgaacctaaagg

SEQ ID NO: 1368056 - DNA, 22 bp, Artificial Sequence
  chemically synthesized
atttttggagaacctttaggtt

SEQ ID NO: 1368057 - DNA, 22 bp, Artificial Sequence
  chemically synthesized
tatttttggagaacctttaggt

SEQ ID NO: 1368058 - DNA, 22 bp, Artificial Sequence
  chemically synthesized
tgctgtgaacctaaaggttctc

SEQ ID NO: 1368059 - DNA, 22 bp, Artificial Sequence
  chemically synthesized
gctgtgaacctaaaggttctcc

SEQ ID NO: 1368060 - DNA, 22 bp, Artificial Sequence
  chemically synthesized
ctgtgaacctaaaggttctcca

SEQ ID NO: 1368061 - DNA, 22 bp, Artificial Sequence
  chemically synthesized
atagactttatttttggagaac

SEQ ID NO: 1368062 - DNA, 22 bp, Artificial Sequence
  chemically synthesized
tgaacctaaaggttctccaaaa

SEQ ID NO: 1368063 - DNA, 22 bp, Artificial Sequence
  chemically synthesized
ttaatagactttatttttggag

SEQ ID NO: 1368064 - DNA, 22 bp, Artificial Sequence
  chemically synthesized
aaggttctccaaaaataaagtc

SEQ ID NO: 1368065 - DNA, 22 bp, Artificial Sequence
  chemically synthesized
tccaaaaataaagtctattaac

SEQ ID NO: 1368066 - DNA, 22 bp, Artificial Sequence
  chemically synthesized
caaaaataaagtctattaacaa

SEQ ID NO: 1368067 - DNA, 22 bp, Artificial Sequence
  chemically synthesized
acagaatgcaagtgattgttaa

SEQ ID NO: 1368068 - DNA, 22 bp, Artificial Sequence
  chemically synthesized
attcacagaatgcaagtgattg

SEQ ID NO: 1368069 - DNA, 22 bp, Artificial Sequence
  chemically synthesized
ttaattcacagaatgcaagtga

SEQ ID NO: 1368070 - DNA, 22 bp, Artificial Sequence
  chemically synthesized
attattaattcacagaatgcaa

SEQ ID NO: 1368071 - DNA, 22 bp, Artificial Sequence
  chemically synthesized
ttaacaatcacttgcattctgt

SEQ ID NO: 1368072 - DNA, 22 bp, Artificial Sequence
  chemically synthesized
acaatcacttgcattctgtgaa

SEQ ID NO: 1368073 - DNA, 22 bp, Artificial Sequence
  chemically synthesized
gcattctgtgaattaataatga

SEQ ID NO: 1368074 - DNA, 22 bp, Artificial Sequence
  chemically synthesized
cattctgtgaattaataatgaa

SEQ ID NO: 1368075 - DNA, 22 bp, Artificial Sequence
  chemically synthesized
catgtccatatgttcattatta

SEQ ID NO: 1368076 - DNA, 22 bp, Artificial Sequence
  chemically synthesized
ccatgtccatatgttcattatt

SEQ ID NO: 1368077 - DNA, 22 bp, Artificial Sequence
  chemically synthesized
tgtgaattaataatgaacatat

SEQ ID NO: 1368078 - DNA, 22 bp, Artificial Sequence
  chemically synthesized
aatttccatgtccatatgttca

SEQ ID NO: 1368079 - DNA, 22 bp, Artificial Sequence
  chemically synthesized
tgaattaataatgaacatatgg

SEQ ID NO: 1368080 - DNA, 22 bp, Artificial Sequence
  chemically synthesized
aaatttccatgtccatatgttc

SEQ ID NO: 1368081 - DNA, 22 bp, Artificial Sequence
  chemically synthesized
taaatttccatgtccatatgtt

SEQ ID NO: 1368082 - DNA, 22 bp, Artificial Sequence
  chemically synthesized
tattttaaatttccatgtccat

SEQ ID NO: 1368083 - DNA, 22 bp, Artificial Sequence
  chemically synthesized
ataatgaacatatggacatgga

SEQ ID NO: 1368084 - DNA, 22 bp, Artificial Sequence
  chemically synthesized
tgacatagtaaaatatactata

SEQ ID NO: 1368085 - DNA, 22 bp, Artificial Sequence
  chemically synthesized
gtgacatagtaaaatatactat

SEQ ID NO: 1368086 - DNA, 22 bp, Artificial Sequence
  chemically synthesized
tgtgacatagtaaaatatacta

SEQ ID NO: 1368087 - DNA, 22 bp, Artificial Sequence
  chemically synthesized
ttgtgacatagtaaaatatact

SEQ ID NO: 1368088 - DNA, 22 bp, Artificial Sequence
  chemically synthesized
atttttgtgacatagtaaaata

SEQ ID NO: 1368089 - DNA, 22 bp, Artificial Sequence
  chemically synthesized
aaaatatagtatattttactat

SEQ ID NO: 1368090 - DNA, 22 bp, Artificial Sequence
  chemically synthesized
aatttttgtgacatagtaaaat

SEQ ID NO: 1368091 - DNA, 22 bp, Artificial Sequence
  chemically synthesized
aaatatagtatattttactatg

SEQ ID NO: 1368092 - DNA, 22 bp, Artificial Sequence
  chemically synthesized
tatttaatttttgtgacatagt

SEQ ID NO: 1368093 - DNA, 22 bp, Artificial Sequence
  chemically synthesized
atatttaatttttgtgacatag

SEQ ID NO: 1368094 - DNA, 22 bp, Artificial Sequence
  chemically synthesized
gatttatatttaatttttgtga

SEQ ID NO: 1368095 - DNA, 22 bp, Artificial Sequence
  chemically synthesized
ttagatttatatttaatttttg

SEQ ID NO: 1368096 - DNA, 22 bp, Artificial Sequence
  chemically synthesized
gttagatttatatttaattttt

SEQ ID NO: 1368097 - DNA, 22 bp, Artificial Sequence
  chemically synthesized
tactatgtcacaaaaattaaat

SEQ ID NO: 1368098 - DNA, 22 bp, Artificial Sequence
  chemically synthesized
actatgtcacaaaaattaaata

SEQ ID NO: 1368099 - DNA, 22 bp, Artificial Sequence
  chemically synthesized
ctatgtcacaaaaattaaatat

SEQ ID NO: 1368100 - DNA, 22 bp, Artificial Sequence
  chemically synthesized
tgtcacaaaaattaaatataaa

SEQ ID NO: 1368101 - DNA, 22 bp, Artificial Sequence
  chemically synthesized
aatataaatctaacaagccatg

SEQ ID NO: 1368102 - DNA, 22 bp, Artificial Sequence
  chemically synthesized
accatgtaagtacatggcttgt

SEQ ID NO: 1368103 - DNA, 22 bp, Artificial Sequence
  chemically synthesized
caccatgtaagtacatggcttg

SEQ ID NO: 1368104 - DNA, 22 bp, Artificial Sequence
  chemically synthesized
tcaccatgtaagtacatggctt

SEQ ID NO: 1368105 - DNA, 22 bp, Artificial Sequence
  chemically synthesized
ctttcaccatgtaagtacatgg

SEQ ID NO: 1368106 - DNA, 22 bp, Artificial Sequence
  chemically synthesized
gctttcaccatgtaagtacatg

SEQ ID NO: 1368107 - DNA, 22 bp, Artificial Sequence
  chemically synthesized
tgctttcaccatgtaagtacat

SEQ ID NO: 1368108 - DNA, 22 bp, Artificial Sequence
  chemically synthesized
ttgctttcaccatgtaagtaca

SEQ ID NO: 1368109 - DNA, 22 bp, Artificial Sequence
  chemically synthesized
tttgctttcaccatgtaagtac

SEQ ID NO: 1368110 - DNA, 22 bp, Artificial Sequence
  chemically synthesized
ttttgctttcaccatgtaagta

SEQ ID NO: 1368111 - DNA, 22 bp, Artificial Sequence
  chemically synthesized
tttttgctttcaccatgtaagt

SEQ ID NO: 1368112 - DNA, 22 bp, Artificial Sequence
  chemically synthesized
acaagccatgtacttacatggt

SEQ ID NO: 1368113 - DNA, 22 bp, Artificial Sequence
  chemically synthesized
ttttttgctttcaccatgtaag

SEQ ID NO: 1368114 - DNA, 22 bp, Artificial Sequence
  chemically synthesized
aaacttttttttgctttcacca

SEQ ID NO: 1368115 - DNA, 22 bp, Artificial Sequence
  chemically synthesized
taaaacttttttttgctttcac

SEQ ID NO: 1368116 - DNA, 22 bp, Artificial Sequence
  chemically synthesized
ctaaaacttttttttgctttca

SEQ ID NO: 1368117 - DNA, 22 bp, Artificial Sequence
  chemically synthesized
cttctaaaacttttttttgctt

SEQ ID NO: 1368118 - DNA, 22 bp, Artificial Sequence
  chemically synthesized
acttctaaaacttttttttgct

SEQ ID NO: 1368119 - DNA, 22 bp, Artificial Sequence
  chemically synthesized
acatggtgaaagcaaaaaaaag

SEQ ID NO: 1368120 - DNA, 22 bp, Artificial Sequence
  chemically synthesized
catggtgaaagcaaaaaaaagt

SEQ ID NO: 1368121 - DNA, 22 bp, Artificial Sequence
  chemically synthesized
tgatttacttctaaaacttttt

SEQ ID NO: 1368122 - DNA, 22 bp, Artificial Sequence
  chemically synthesized
tatgatttacttctaaaacttt

SEQ ID NO: 1368123 - DNA, 22 bp, Artificial Sequence
  chemically synthesized
gatgttctatgatttacttcta

SEQ ID NO: 1368124 - DNA, 22 bp, Artificial Sequence
  chemically synthesized
agatgttctatgatttacttct

SEQ ID NO: 1368125 - DNA, 22 bp, Artificial Sequence
  chemically synthesized
atttagatgttctatgatttac

SEQ ID NO: 1368126 - DNA, 22 bp, Artificial Sequence
  chemically synthesized
attaatttagatgttctatgat

SEQ ID NO: 1368127 - DNA, 22 bp, Artificial Sequence
  chemically synthesized
cattaatttagatgttctatga

SEQ ID NO: 1368128 - DNA, 22 bp, Artificial Sequence
  chemically synthesized
tagaagtaaatcatagaacatc

SEQ ID NO: 1368129 - DNA, 22 bp, Artificial Sequence
  chemically synthesized
ttcattaatttagatgttctat

SEQ ID NO: 1368130 - DNA, 22 bp, Artificial Sequence
  chemically synthesized
agaagtaaatcatagaacatct

SEQ ID NO: 1368131 - DNA, 22 bp, Artificial Sequence
  chemically synthesized
cttcattaatttagatgttcta

SEQ ID NO: 1368132 - DNA, 22 bp, Artificial Sequence
  chemically synthesized
gaagtaaatcatagaacatcta

SEQ ID NO: 1368133 - DNA, 22 bp, Artificial Sequence
  chemically synthesized
aatccacgagcacaatatattt

SEQ ID NO: 1368134 - DNA, 22 bp, Artificial Sequence
  chemically synthesized
aattaatgaagaaatatattgt

SEQ ID NO: 1368135 - DNA, 22 bp, Artificial Sequence
  chemically synthesized
tcaatccacgagcacaatatat

SEQ ID NO: 1368136 - DNA, 22 bp, Artificial Sequence
  chemically synthesized
atgaagaaatatattgtgctcg

SEQ ID NO: 1368137 - DNA, 22 bp, Artificial Sequence
  chemically synthesized
aatctctcaatccacgagcaca

SEQ ID NO: 1368138 - DNA, 22 bp, Artificial Sequence
  chemically synthesized
tgttgaatctctcaatccacga

SEQ ID NO: 1368139 - DNA, 22 bp, Artificial Sequence
  chemically synthesized
ctgtgttgaatctctcaatcca

SEQ ID NO: 1368140 - DNA, 22 bp, Artificial Sequence
  chemically synthesized
tgctcgtggattgagagattca

SEQ ID NO: 1368141 - DNA, 22 bp, Artificial Sequence
  chemically synthesized
acattactgtgttgaatctctc

SEQ ID NO: 1368142 - DNA, 22 bp, Artificial Sequence
  chemically synthesized
gtggattgagagattcaacaca

SEQ ID NO: 1368143 - DNA, 22 bp, Artificial Sequence
  chemically synthesized
ggtaaaattgacattactgtgt

SEQ ID NO: 1368144 - DNA, 22 bp, Artificial Sequence
  chemically synthesized
gggtaaaattgacattactgtg

SEQ ID NO: 1368145 - DNA, 22 bp, Artificial Sequence
  chemically synthesized
agagattcaacacagtaatgtc

SEQ ID NO: 1368146 - DNA, 22 bp, Artificial Sequence
  chemically synthesized
aacacagtaatgtcaattttac

SEQ ID NO: 1368147 - DNA, 22 bp, Artificial Sequence
  chemically synthesized
tgtaacagtttgggtaaaattg

SEQ ID NO: 1368148 - DNA, 22 bp, Artificial Sequence
  chemically synthesized
tgtaaactgtgtaacagtttgg

SEQ ID NO: 1368149 - DNA, 22 bp, Artificial Sequence
  chemically synthesized
tacccaaactgttacacagttt

SEQ ID NO: 1368150 - DNA, 22 bp, Artificial Sequence
  chemically synthesized
acccaaactgttacacagttta

SEQ ID NO: 1368151 - DNA, 22 bp, Artificial Sequence
  chemically synthesized
ataaaaattgtgtaaactgtgt

SEQ ID NO: 1368152 - DNA, 22 bp, Artificial Sequence
  chemically synthesized
cccaaactgttacacagtttac

SEQ ID NO: 1368153 - DNA, 22 bp, Artificial Sequence
  chemically synthesized
gataaaaattgtgtaaactgtg

SEQ ID NO: 1368154 - DNA, 22 bp, Artificial Sequence
  chemically synthesized
tgataaaaattgtgtaaactgt

SEQ ID NO: 1368155 - DNA, 22 bp, Artificial Sequence
  chemically synthesized
agattttgataaaaattgtgta

SEQ ID NO: 1368156 - DNA, 22 bp, Artificial Sequence
  chemically synthesized
ttacacagtttacacaattttt

SEQ ID NO: 1368157 - DNA, 22 bp, Artificial Sequence
  chemically synthesized
ctgagattttgataaaaattgt

SEQ ID NO: 1368158 - DNA, 22 bp, Artificial Sequence
  chemically synthesized
cacagtttacacaatttttatc

SEQ ID NO: 1368159 - DNA, 22 bp, Artificial Sequence
  chemically synthesized
acacaatttttatcaaaatctc

SEQ ID NO: 1368160 - DNA, 22 bp, Artificial Sequence
  chemically synthesized
cacaatttttatcaaaatctca

SEQ ID NO: 1368161 - DNA, 22 bp, Artificial Sequence
  chemically synthesized
caaaaatattgctgagattttg

SEQ ID NO: 1368162 - DNA, 22 bp, Artificial Sequence
  chemically synthesized
aattccaaaaatattgctgaga

SEQ ID NO: 1368163 - DNA, 22 bp, Artificial Sequence
  chemically synthesized
ttatcaaaatctcagcaatatt

SEQ ID NO: 1368164 - DNA, 22 bp, Artificial Sequence
  chemically synthesized
tatcaaaatctcagcaatattt

SEQ ID NO: 1368165 - DNA, 22 bp, Artificial Sequence
  chemically synthesized
atcaaaatctcagcaatatttt

SEQ ID NO: 1368166 - DNA, 22 bp, Artificial Sequence
  chemically synthesized
tcaaaatctcagcaatattttt

SEQ ID NO: 1368167 - DNA, 22 bp, Artificial Sequence
  chemically synthesized
cacctaaattccaaaaatattg

SEQ ID NO: 1368168 - DNA, 22 bp, Artificial Sequence
  chemically synthesized
ctacacctaaattccaaaaata

SEQ ID NO: 1368169 - DNA, 22 bp, Artificial Sequence
  chemically synthesized
cctacacctaaattccaaaaat

SEQ ID NO: 1368170 - DNA, 22 bp, Artificial Sequence
  chemically synthesized
tcctacacctaaattccaaaaa

SEQ ID NO: 1368171 - DNA, 22 bp, Artificial Sequence
  chemically synthesized
ttcctacacctaaattccaaaa

SEQ ID NO: 1368172 - DNA, 22 bp, Artificial Sequence
  chemically synthesized
agcaatatttttggaatttagg

SEQ ID NO: 1368173 - DNA, 22 bp, Artificial Sequence
  chemically synthesized
acataaatttttcctacaccta

SEQ ID NO: 1368174 - DNA, 22 bp, Artificial Sequence
  chemically synthesized
cacataaatttttcctacacct

SEQ ID NO: 1368175 - DNA, 22 bp, Artificial Sequence
  chemically synthesized
tcacataaatttttcctacacc

SEQ ID NO: 1368176 - DNA, 22 bp, Artificial Sequence
  chemically synthesized
ttcacataaatttttcctacac

SEQ ID NO: 1368177 - DNA, 22 bp, Artificial Sequence
  chemically synthesized
ttggaatttaggtgtaggaaaa

SEQ ID NO: 1368178 - DNA, 22 bp, Artificial Sequence
  chemically synthesized
tggaatttaggtgtaggaaaaa

SEQ ID NO: 1368179 - DNA, 22 bp, Artificial Sequence
  chemically synthesized
ggaatttaggtgtaggaaaaat

SEQ ID NO: 1368180 - DNA, 22 bp, Artificial Sequence
  chemically synthesized
gaatttaggtgtaggaaaaatt

SEQ ID NO: 1368181 - DNA, 22 bp, Artificial Sequence
  chemically synthesized
gagtgccttttcacataaattt

SEQ ID NO: 1368182 - DNA, 22 bp, Artificial Sequence
  chemically synthesized
aggtgtaggaaaaatttatgtg

SEQ ID NO: 1368183 - DNA, 22 bp, Artificial Sequence
  chemically synthesized
agagtgccttttcacataaatt

SEQ ID NO: 1368184 - DNA, 22 bp, Artificial Sequence
  chemically synthesized
ggtgtaggaaaaatttatgtga

SEQ ID NO: 1368185 - DNA, 22 bp, Artificial Sequence
  chemically synthesized
tagagtgccttttcacataaat

SEQ ID NO: 1368186 - DNA, 22 bp, Artificial Sequence
  chemically synthesized
acataaattttagagtgccttt

SEQ ID NO: 1368187 - DNA, 22 bp, Artificial Sequence
  chemically synthesized
cacataaattttagagtgcctt

SEQ ID NO: 1368188 - DNA, 22 bp, Artificial Sequence
  chemically synthesized
tcacataaattttagagtgcct

SEQ ID NO: 1368189 - DNA, 22 bp, Artificial Sequence
  chemically synthesized
ttcacataaattttagagtgcc

SEQ ID NO: 1368190 - DNA, 22 bp, Artificial Sequence
  chemically synthesized
atgtgaaaaggcactctaaaat

SEQ ID NO: 1368191 - DNA, 22 bp, Artificial Sequence
  chemically synthesized
tgtgaaaaggcactctaaaatt

SEQ ID NO: 1368192 - DNA, 22 bp, Artificial Sequence
  chemically synthesized
ccttttcacataaattttagag

SEQ ID NO: 1368193 - DNA, 22 bp, Artificial Sequence
  chemically synthesized
aatccattgccttttcacataa

SEQ ID NO: 1368194 - DNA, 22 bp, Artificial Sequence
  chemically synthesized
taaatccattgccttttcacat

SEQ ID NO: 1368195 - DNA, 22 bp, Artificial Sequence
  chemically synthesized
ttctaaatccattgccttttca

SEQ ID NO: 1368196 - DNA, 22 bp, Artificial Sequence
  chemically synthesized
taaaatttatgtgaaaaggcaa

SEQ ID NO: 1368197 - DNA, 22 bp, Artificial Sequence
  chemically synthesized
aaatttatgtgaaaaggcaatg

SEQ ID NO: 1368198 - DNA, 22 bp, Artificial Sequence
  chemically synthesized
gctattctaaatccattgcctt

SEQ ID NO: 1368199 - DNA, 22 bp, Artificial Sequence
  chemically synthesized
agctattctaaatccattgcct

SEQ ID NO: 1368200 - DNA, 22 bp, Artificial Sequence
  chemically synthesized
tagctattctaaatccattgcc

SEQ ID NO: 1368201 - DNA, 22 bp, Artificial Sequence
  chemically synthesized
atgtgaaaaggcaatggattta

SEQ ID NO: 1368202 - DNA, 22 bp, Artificial Sequence
  chemically synthesized
ttttagctattctaaatccatt

SEQ ID NO: 1368203 - DNA, 22 bp, Artificial Sequence
  chemically synthesized
tgtgaaaaggcaatggatttag

SEQ ID NO: 1368204 - DNA, 22 bp, Artificial Sequence
  chemically synthesized
aacattgttttagctattctaa

SEQ ID NO: 1368205 - DNA, 22 bp, Artificial Sequence
  chemically synthesized
caacattgttttagctattcta

SEQ ID NO: 1368206 - DNA, 22 bp, Artificial Sequence
  chemically synthesized
tcaacattgttttagctattct

SEQ ID NO: 1368207 - DNA, 22 bp, Artificial Sequence
  chemically synthesized
ttcaacattgttttagctattc

SEQ ID NO: 1368208 - DNA, 22 bp, Artificial Sequence
  chemically synthesized
cttttcaacattgttttagcta

SEQ ID NO: 1368209 - DNA, 22 bp, Artificial Sequence
  chemically synthesized
ccttttcaacattgttttagct

SEQ ID NO: 1368210 - DNA, 22 bp, Artificial Sequence
  chemically synthesized
ttccttttcaacattgttttag

SEQ ID NO: 1368211 - DNA, 22 bp, Artificial Sequence
  chemically synthesized
attcttccttttcaacattgtt

SEQ ID NO: 1368212 - DNA, 22 bp, Artificial Sequence
  chemically synthesized
agaatagctaaaacaatgttga

SEQ ID NO: 1368213 - DNA, 22 bp, Artificial Sequence
  chemically synthesized
cattcttccttttcaacattgt

SEQ ID NO: 1368214 - DNA, 22 bp, Artificial Sequence
  chemically synthesized
gaatagctaaaacaatgttgaa

SEQ ID NO: 1368215 - DNA, 22 bp, Artificial Sequence
  chemically synthesized
cttcattcttccttttcaacat

SEQ ID NO: 1368216 - DNA, 22 bp, Artificial Sequence
  chemically synthesized
acttcattcttccttttcaaca

SEQ ID NO: 1368217 - DNA, 22 bp, Artificial Sequence
  chemically synthesized
ttacttcattcttccttttcaa

SEQ ID NO: 1368218 - DNA, 22 bp, Artificial Sequence
  chemically synthesized
ctcttacttcattcttcctttt

SEQ ID NO: 1368219 - DNA, 22 bp, Artificial Sequence
  chemically synthesized
aaacaatgttgaaaaggaagaa

SEQ ID NO: 1368220 - DNA, 22 bp, Artificial Sequence
  chemically synthesized
ttcctcttacttcattcttcct

SEQ ID NO: 1368221 - DNA, 22 bp, Artificial Sequence
  chemically synthesized
attcctcttacttcattcttcc

SEQ ID NO: 1368222 - DNA, 22 bp, Artificial Sequence
  chemically synthesized
aaaaggaagaatgaagtaagag

SEQ ID NO: 1368223 - DNA, 22 bp, Artificial Sequence
  chemically synthesized
gtagacttattcctcttacttc

SEQ ID NO: 1368224 - DNA, 22 bp, Artificial Sequence
  chemically synthesized
agtctggtagacttattcctct

SEQ ID NO: 1368225 - DNA, 22 bp, Artificial Sequence
  chemically synthesized
cagtctggtagacttattcctc

SEQ ID NO: 1368226 - DNA, 22 bp, Artificial Sequence
  chemically synthesized
ataagtcttcagtctggtagac

SEQ ID NO: 1368227 - DNA, 22 bp, Artificial Sequence
  chemically synthesized
aataagtcttcagtctggtaga

SEQ ID NO: 1368228 - DNA, 22 bp, Artificial Sequence
  chemically synthesized
tttaataagtcttcagtctggt

SEQ ID NO: 1368229 - DNA, 22 bp, Artificial Sequence
  chemically synthesized
tagctatttaataagtcttcag

SEQ ID NO: 1368230 - DNA, 22 bp, Artificial Sequence
  chemically synthesized
ctgtagctatttaataagtctt

SEQ ID NO: 1368231 - DNA, 22 bp, Artificial Sequence
  chemically synthesized
ccagactgaagacttattaaat

SEQ ID NO: 1368232 - DNA, 22 bp, Artificial Sequence
  chemically synthesized
attactgtagctatttaataag

SEQ ID NO: 1368233 - DNA, 22 bp, Artificial Sequence
  chemically synthesized
gattactgtagctatttaataa

SEQ ID NO: 1368234 - DNA, 22 bp, Artificial Sequence
  chemically synthesized
tcttgattactgtagctattta

SEQ ID NO: 1368235 - DNA, 22 bp, Artificial Sequence
  chemically synthesized
aagacttattaaatagctacag

SEQ ID NO: 1368236 - DNA, 22 bp, Artificial Sequence
  chemically synthesized
attaaatagctacagtaatcaa

SEQ ID NO: 1368237 - DNA, 22 bp, Artificial Sequence
  chemically synthesized
ttaaatagctacagtaatcaag

SEQ ID NO: 1368238 - DNA, 22 bp, Artificial Sequence
  chemically synthesized
aatagctacagtaatcaagata

SEQ ID NO: 1368239 - DNA, 22 bp, Artificial Sequence
  chemically synthesized
cagtaatcaagatagtgtggtg

SEQ ID NO: 1368240 - DNA, 22 bp, Artificial Sequence
  chemically synthesized
tcccaacaccaacaccacacta

SEQ ID NO: 1368241 - DNA, 22 bp, Artificial Sequence
  chemically synthesized
cgtgtctatcccaacaccaaca

SEQ ID NO: 1368242 - DNA, 22 bp, Artificial Sequence
  chemically synthesized
atctgcgtgtctatcccaacac

SEQ ID NO: 1368243 - DNA, 22 bp, Artificial Sequence
  chemically synthesized
cattaatctgcgtgtctatccc

SEQ ID NO: 1368244 - DNA, 22 bp, Artificial Sequence
  chemically synthesized
ttccattaatctgcgtgtctat

SEQ ID NO: 1368245 - DNA, 22 bp, Artificial Sequence
  chemically synthesized
tgttccattaatctgcgtgtct

SEQ ID NO: 1368246 - DNA, 22 bp, Artificial Sequence
  chemically synthesized
gtgttgggatagacacgcagat

SEQ ID NO: 1368247 - DNA, 22 bp, Artificial Sequence
  chemically synthesized
ttctgttccattaatctgcgtg

SEQ ID NO: 1368248 - DNA, 22 bp, Artificial Sequence
  chemically synthesized
tattctgttccattaatctgcg

SEQ ID NO: 1368249 - DNA, 22 bp, Artificial Sequence
  chemically synthesized
ggatagacacgcagattaatgg

SEQ ID NO: 1368250 - DNA, 22 bp, Artificial Sequence
  chemically synthesized
aagtctctattctgttccatta

SEQ ID NO: 1368251 - DNA, 22 bp, Artificial Sequence
  chemically synthesized
tgaagtctctattctgttccat

SEQ ID NO: 1368252 - DNA, 22 bp, Artificial Sequence
  chemically synthesized
ctgaagtctctattctgttcca

SEQ ID NO: 1368253 - DNA, 22 bp, Artificial Sequence
  chemically synthesized
tttctgaagtctctattctgtt

SEQ ID NO: 1368254 - DNA, 22 bp, Artificial Sequence
  chemically synthesized
atggaacagaatagagacttca

SEQ ID NO: 1368255 - DNA, 22 bp, Artificial Sequence
  chemically synthesized
tgtgggtctatttctgaagtct

SEQ ID NO: 1368256 - DNA, 22 bp, Artificial Sequence
  chemically synthesized
gtgtgggtctatttctgaagtc

SEQ ID NO: 1368257 - DNA, 22 bp, Artificial Sequence
  chemically synthesized
agcaatttgtgtgggtctattt

SEQ ID NO: 1368258 - DNA, 22 bp, Artificial Sequence
  chemically synthesized
cagaaatagacccacacaaatt

SEQ ID NO: 1368259 - DNA, 22 bp, Artificial Sequence
  chemically synthesized
agaaatagacccacacaaattg

SEQ ID NO: 1368260 - DNA, 22 bp, Artificial Sequence
  chemically synthesized
tgtcaaaatcagttgagcaatt

SEQ ID NO: 1368261 - DNA, 22 bp, Artificial Sequence
  chemically synthesized
cactgtgtcaaaatcagttgag

SEQ ID NO: 1368262 - DNA, 22 bp, Artificial Sequence
  chemically synthesized
gcactgtgtcaaaatcagttga

SEQ ID NO: 1368263 - DNA, 22 bp, Artificial Sequence
  chemically synthesized
tgcactgtgtcaaaatcagttg

SEQ ID NO: 1368264 - DNA, 22 bp, Artificial Sequence
  chemically synthesized
ttttgcactgtgtcaaaatcag

SEQ ID NO: 1368265 - DNA, 22 bp, Artificial Sequence
  chemically synthesized
aattattttgcactgtgtcaaa

SEQ ID NO: 1368266 - DNA, 22 bp, Artificial Sequence
  chemically synthesized
ctcaactgattttgacacagtg

SEQ ID NO: 1368267 - DNA, 22 bp, Artificial Sequence
  chemically synthesized
aactgattttgacacagtgcaa

SEQ ID NO: 1368268 - DNA, 22 bp, Artificial Sequence
  chemically synthesized
cactgaattattttgcactgtg

SEQ ID NO: 1368269 - DNA, 22 bp, Artificial Sequence
  chemically synthesized
ctccactgaattattttgcact

SEQ ID NO: 1368270 - DNA, 22 bp, Artificial Sequence
  chemically synthesized
gctccactgaattattttgcac

SEQ ID NO: 1368271 - DNA, 22 bp, Artificial Sequence
  chemically synthesized
attttgacacagtgcaaaataa

SEQ ID NO: 1368272 - DNA, 22 bp, Artificial Sequence
  chemically synthesized
tgctccactgaattattttgca

SEQ ID NO: 1368273 - DNA, 22 bp, Artificial Sequence
  chemically synthesized
tgacacagtgcaaaataattca

SEQ ID NO: 1368274 - DNA, 22 bp, Artificial Sequence
  chemically synthesized
tctttgctccactgaattattt

SEQ ID NO: 1368275 - DNA, 22 bp, Artificial Sequence
  chemically synthesized
gacacagtgcaaaataattcag

SEQ ID NO: 1368276 - DNA, 22 bp, Artificial Sequence
  chemically synthesized
acacagtgcaaaataattcagt

SEQ ID NO: 1368277 - DNA, 22 bp, Artificial Sequence
  chemically synthesized
aaaagactatctttgctccact

SEQ ID NO: 1368278 - DNA, 22 bp, Artificial Sequence
  chemically synthesized
agtggagcaaagatagtctttt

SEQ ID NO: 1368279 - DNA, 22 bp, Artificial Sequence
  chemically synthesized
agacccatgtgttgaaaagact

SEQ ID NO: 1368280 - DNA, 22 bp, Artificial Sequence
  chemically synthesized
taagacccatgtgttgaaaaga

SEQ ID NO: 1368281 - DNA, 22 bp, Artificial Sequence
  chemically synthesized
ttctaagacccatgtgttgaaa

SEQ ID NO: 1368282 - DNA, 22 bp, Artificial Sequence
  chemically synthesized
gttctaagacccatgtgttgaa

SEQ ID NO: 1368283 - DNA, 22 bp, Artificial Sequence
  chemically synthesized
tccacttgttctaagacccatg

SEQ ID NO: 1368284 - DNA, 22 bp, Artificial Sequence
  chemically synthesized
gtccacttgttctaagacccat

SEQ ID NO: 1368285 - DNA, 22 bp, Artificial Sequence
  chemically synthesized
tgtccacttgttctaagaccca

SEQ ID NO: 1368286 - DNA, 22 bp, Artificial Sequence
  chemically synthesized
ttgtccacttgttctaagaccc

SEQ ID NO: 1368287 - DNA, 22 bp, Artificial Sequence
  chemically synthesized
ttcaacacatgggtcttagaac

SEQ ID NO: 1368288 - DNA, 22 bp, Artificial Sequence
  chemically synthesized
tcaacacatgggtcttagaaca

SEQ ID NO: 1368289 - DNA, 22 bp, Artificial Sequence
  chemically synthesized
tttttgtccacttgttctaaga

SEQ ID NO: 1368290 - DNA, 22 bp, Artificial Sequence
  chemically synthesized
caacacatgggtcttagaacaa

SEQ ID NO: 1368291 - DNA, 22 bp, Artificial Sequence
  chemically synthesized
aacacatgggtcttagaacaag

SEQ ID NO: 1368292 - DNA, 22 bp, Artificial Sequence
  chemically synthesized
cattatttttgtccacttgttc

SEQ ID NO: 1368293 - DNA, 22 bp, Artificial Sequence
  chemically synthesized
ccattatttttgtccacttgtt

SEQ ID NO: 1368294 - DNA, 22 bp, Artificial Sequence
  chemically synthesized
tccattatttttgtccacttgt

SEQ ID NO: 1368295 - DNA, 22 bp, Artificial Sequence
  chemically synthesized
tttccattatttttgtccactt

SEQ ID NO: 1368296 - DNA, 22 bp, Artificial Sequence
  chemically synthesized
ctttccattatttttgtccact

SEQ ID NO: 1368297 - DNA, 22 bp, Artificial Sequence
  chemically synthesized
tctttccattatttttgtccac

SEQ ID NO: 1368298 - DNA, 22 bp, Artificial Sequence
  chemically synthesized
ttctttccattatttttgtcca

SEQ ID NO: 1368299 - DNA, 22 bp, Artificial Sequence
  chemically synthesized
tttctttccattatttttgtcc

SEQ ID NO: 1368300 - DNA, 22 bp, Artificial Sequence
  chemically synthesized
ttttctttccattatttttgtc

SEQ ID NO: 1368301 - DNA, 22 bp, Artificial Sequence
  chemically synthesized
agaacaagtggacaaaaataat

SEQ ID NO: 1368302 - DNA, 22 bp, Artificial Sequence
  chemically synthesized
ttttttctttccattatttttg

SEQ ID NO: 1368303 - DNA, 22 bp, Artificial Sequence
  chemically synthesized
gaacaagtggacaaaaataatg

SEQ ID NO: 1368304 - DNA, 22 bp, Artificial Sequence
  chemically synthesized
cttttttctttccattattttt

SEQ ID NO: 1368305 - DNA, 22 bp, Artificial Sequence
  chemically synthesized
ttcttttttctttccattattt

SEQ ID NO: 1368306 - DNA, 22 bp, Artificial Sequence
  chemically synthesized
cttcttttttctttccattatt

SEQ ID NO: 1368307 - DNA, 22 bp, Artificial Sequence
  chemically synthesized
tcttcttttttctttccattat

SEQ ID NO: 1368308 - DNA, 22 bp, Artificial Sequence
  chemically synthesized
ttcttcttttttctttccatta

SEQ ID NO: 1368309 - DNA, 22 bp, Artificial Sequence
  chemically synthesized
tttcttcttttttctttccatt

SEQ ID NO: 1368310 - DNA, 22 bp, Artificial Sequence
  chemically synthesized
tttttcttcttttttctttcca

SEQ ID NO: 1368311 - DNA, 22 bp, Artificial Sequence
  chemically synthesized
tgtcaaggttctttttcttctt

SEQ ID NO: 1368312 - DNA, 22 bp, Artificial Sequence
  chemically synthesized
cataaggtgtaaagttatgtca

SEQ ID NO: 1368313 - DNA, 22 bp, Artificial Sequence
  chemically synthesized
gcataaggtgtaaagttatgtc

SEQ ID NO: 1368314 - DNA, 22 bp, Artificial Sequence
  chemically synthesized
tgcataaggtgtaaagttatgt

SEQ ID NO: 1368315 - DNA, 22 bp, Artificial Sequence
  chemically synthesized
ttttgcataaggtgtaaagtta

SEQ ID NO: 1368316 - DNA, 22 bp, Artificial Sequence
  chemically synthesized
attttgcataaggtgtaaagtt

SEQ ID NO: 1368317 - DNA, 22 bp, Artificial Sequence
  chemically synthesized
tattttgcataaggtgtaaagt

SEQ ID NO: 1368318 - DNA, 22 bp, Artificial Sequence
  chemically synthesized
cattttattttgcataaggtgt

SEQ ID NO: 1368319 - DNA, 22 bp, Artificial Sequence
  chemically synthesized
gacataactttacaccttatgc

SEQ ID NO: 1368320 - DNA, 22 bp, Artificial Sequence
  chemically synthesized
gcattttattttgcataaggtg

SEQ ID NO: 1368321 - DNA, 22 bp, Artificial Sequence
  chemically synthesized
acataactttacaccttatgca

SEQ ID NO: 1368322 - DNA, 22 bp, Artificial Sequence
  chemically synthesized
tttgcattttattttgcataag

SEQ ID NO: 1368323 - DNA, 22 bp, Artificial Sequence
  chemically synthesized
tacaccttatgcaaaataaaat

SEQ ID NO: 1368324 - DNA, 22 bp, Artificial Sequence
  chemically synthesized
acaccttatgcaaaataaaatg

SEQ ID NO: 1368325 - DNA, 22 bp, Artificial Sequence
  chemically synthesized
atcatctatttgcattttattt

SEQ ID NO: 1368326 - DNA, 22 bp, Artificial Sequence
  chemically synthesized
caccttatgcaaaataaaatgc

SEQ ID NO: 1368327 - DNA, 22 bp, Artificial Sequence
  chemically synthesized
aattcatcatctatttgcattt

SEQ ID NO: 1368328 - DNA, 22 bp, Artificial Sequence
  chemically synthesized
aaattcatcatctatttgcatt

SEQ ID NO: 1368329 - DNA, 22 bp, Artificial Sequence
  chemically synthesized
atgcaaaataaaatgcaaatag

SEQ ID NO: 1368330 - DNA, 22 bp, Artificial Sequence
  chemically synthesized
tgcaaaataaaatgcaaataga

SEQ ID NO: 1368331 - DNA, 22 bp, Artificial Sequence
  chemically synthesized
acatttaaattcatcatctatt

SEQ ID NO: 1368332 - DNA, 22 bp, Artificial Sequence
  chemically synthesized
cacatttaaattcatcatctat

SEQ ID NO: 1368333 - DNA, 22 bp, Artificial Sequence
  chemically synthesized
tgtttcacatttaaattcatca

SEQ ID NO: 1368334 - DNA, 22 bp, Artificial Sequence
  chemically synthesized
gtgtttcacatttaaattcatc

SEQ ID NO: 1368335 - DNA, 22 bp, Artificial Sequence
  chemically synthesized
tgtgtttcacatttaaattcat

SEQ ID NO: 1368336 - DNA, 22 bp, Artificial Sequence
  chemically synthesized
ttttgtgtttcacatttaaatt

SEQ ID NO: 1368337 - DNA, 22 bp, Artificial Sequence
  chemically synthesized
ttattttgtgtttcacatttaa

SEQ ID NO: 1368338 - DNA, 22 bp, Artificial Sequence
  chemically synthesized
attattttgtgtttcacattta

SEQ ID NO: 1368339 - DNA, 22 bp, Artificial Sequence
  chemically synthesized
taaaatatttattattttgtgt

SEQ ID NO: 1368340 - DNA, 22 bp, Artificial Sequence
  chemically synthesized
gtaaaatatttattattttgtg

SEQ ID NO: 1368341 - DNA, 22 bp, Artificial Sequence
  chemically synthesized
tgtaaaatatttattattttgt

SEQ ID NO: 1368342 - DNA, 22 bp, Artificial Sequence
  chemically synthesized
aaatgtgaaacacaaaataata

SEQ ID NO: 1368343 - DNA, 22 bp, Artificial Sequence
  chemically synthesized
ttgtaaaatatttattattttg

SEQ ID NO: 1368344 - DNA, 22 bp, Artificial Sequence
  chemically synthesized
aatgtgaaacacaaaataataa

SEQ ID NO: 1368345 - DNA, 22 bp, Artificial Sequence
  chemically synthesized
tatgtttttgtaaaatatttat

SEQ ID NO: 1368346 - DNA, 22 bp, Artificial Sequence
  chemically synthesized
ctgtatgtttttgtaaaatatt

SEQ ID NO: 1368347 - DNA, 22 bp, Artificial Sequence
  chemically synthesized
tcctgtatgtttttgtaaaata

SEQ ID NO: 1368348 - DNA, 22 bp, Artificial Sequence
  chemically synthesized
aagactctcctgtatgtttttg

SEQ ID NO: 1368349 - DNA, 22 bp, Artificial Sequence
  chemically synthesized
atcctgaagactctcctgtatg

SEQ ID NO: 1368350 - DNA, 22 bp, Artificial Sequence
  chemically synthesized
catcctgaagactctcctgtat

SEQ ID NO: 1368351 - DNA, 22 bp, Artificial Sequence
  chemically synthesized
tcatcctgaagactctcctgta

SEQ ID NO: 1368352 - DNA, 22 bp, Artificial Sequence
  chemically synthesized
tacaaaaacatacaggagagtc

SEQ ID NO: 1368353 - DNA, 22 bp, Artificial Sequence
  chemically synthesized
acaaaaacatacaggagagtct

SEQ ID NO: 1368354 - DNA, 22 bp, Artificial Sequence
  chemically synthesized
caaaaacatacaggagagtctt

SEQ ID NO: 1368355 - DNA, 22 bp, Artificial Sequence
  chemically synthesized
gcctttcatcctgaagactctc

SEQ ID NO: 1368356 - DNA, 22 bp, Artificial Sequence
  chemically synthesized
ctagcctttcatcctgaagact

SEQ ID NO: 1368357 - DNA, 22 bp, Artificial Sequence
  chemically synthesized
ctcctagcctttcatcctgaag

SEQ ID NO: 1368358 - DNA, 22 bp, Artificial Sequence
  chemically synthesized
agaactcctcctagcctttcat

SEQ ID NO: 1368359 - DNA, 22 bp, Artificial Sequence
  chemically synthesized
caggatgaaaggctaggaggag

SEQ ID NO: 1368360 - DNA, 22 bp, Artificial Sequence
  chemically synthesized
aggatgaaaggctaggaggagt

SEQ ID NO: 1368361 - DNA, 22 bp, Artificial Sequence
  chemically synthesized
acgtcaaatctaagaactcctc

SEQ ID NO: 1368362 - DNA, 22 bp, Artificial Sequence
  chemically synthesized
aacgtcaaatctaagaactcct

SEQ ID NO: 1368363 - DNA, 22 bp, Artificial Sequence
  chemically synthesized
taacgtcaaatctaagaactcc

SEQ ID NO: 1368364 - DNA, 22 bp, Artificial Sequence
  chemically synthesized
ggaggagttcttagatttgacg

SEQ ID NO: 1368365 - DNA, 22 bp, Artificial Sequence
  chemically synthesized
aggcacacgattttaacgtcaa

SEQ ID NO: 1368366 - DNA, 22 bp, Artificial Sequence
  chemically synthesized
aaggcacacgattttaacgtca

SEQ ID NO: 1368367 - DNA, 22 bp, Artificial Sequence
  chemically synthesized
taaggcacacgattttaacgtc

SEQ ID NO: 1368368 - DNA, 22 bp, Artificial Sequence
  chemically synthesized
ttaaggcacacgattttaacgt

SEQ ID NO: 1368369 - DNA, 22 bp, Artificial Sequence
  chemically synthesized
ttagatttgacgttaaaatcgt

SEQ ID NO: 1368370 - DNA, 22 bp, Artificial Sequence
  chemically synthesized
agatttgacgttaaaatcgtgt

SEQ ID NO: 1368371 - DNA, 22 bp, Artificial Sequence
  chemically synthesized
gatttgacgttaaaatcgtgtg

SEQ ID NO: 1368372 - DNA, 22 bp, Artificial Sequence
  chemically synthesized
tgtcttttaaggcacacgattt

SEQ ID NO: 1368373 - DNA, 22 bp, Artificial Sequence
  chemically synthesized
gacgttaaaatcgtgtgcctta

SEQ ID NO: 1368374 - DNA, 22 bp, Artificial Sequence
  chemically synthesized
acgttaaaatcgtgtgccttaa

SEQ ID NO: 1368375 - DNA, 22 bp, Artificial Sequence
  chemically synthesized
tcaaattgtgtcttttaaggca

SEQ ID NO: 1368376 - DNA, 22 bp, Artificial Sequence
  chemically synthesized
atcaaattgtgtcttttaaggc

SEQ ID NO: 1368377 - DNA, 22 bp, Artificial Sequence
  chemically synthesized
aaatcgtgtgccttaaaagaca

SEQ ID NO: 1368378 - DNA, 22 bp, Artificial Sequence
  chemically synthesized
tatgtcaaatttatcaaattgt

SEQ ID NO: 1368379 - DNA, 22 bp, Artificial Sequence
  chemically synthesized
gtatgtcaaatttatcaaattg

SEQ ID NO: 1368380 - DNA, 22 bp, Artificial Sequence
  chemically synthesized
tgtatgtcaaatttatcaaatt

SEQ ID NO: 1368381 - DNA, 22 bp, Artificial Sequence
  chemically synthesized
aaaagacacaatttgataaatt

SEQ ID NO: 1368382 - DNA, 22 bp, Artificial Sequence
  chemically synthesized
aaagacacaatttgataaattt

SEQ ID NO: 1368383 - DNA, 22 bp, Artificial Sequence
  chemically synthesized
aaattttgtatgtcaaatttat

SEQ ID NO: 1368384 - DNA, 22 bp, Artificial Sequence
  chemically synthesized
aaaattttgtatgtcaaattta

SEQ ID NO: 1368385 - DNA, 22 bp, Artificial Sequence
  chemically synthesized
taaaattttgtatgtcaaattt

SEQ ID NO: 1368386 - DNA, 22 bp, Artificial Sequence
  chemically synthesized
gataaatttgacatacaaaatt

SEQ ID NO: 1368387 - DNA, 22 bp, Artificial Sequence
  chemically synthesized
ataaatttgacatacaaaattt

SEQ ID NO: 1368388 - DNA, 22 bp, Artificial Sequence
  chemically synthesized
agagcaaaattttaaaattttg

SEQ ID NO: 1368389 - DNA, 22 bp, Artificial Sequence
  chemically synthesized
tcagagcaaaattttaaaattt

SEQ ID NO: 1368390 - DNA, 22 bp, Artificial Sequence
  chemically synthesized
ctcagagcaaaattttaaaatt

SEQ ID NO: 1368391 - DNA, 22 bp, Artificial Sequence
  chemically synthesized
tctcagagcaaaattttaaaat

SEQ ID NO: 1368392 - DNA, 22 bp, Artificial Sequence
  chemically synthesized
gacatacaaaattttaaaattt

SEQ ID NO: 1368393 - DNA, 22 bp, Artificial Sequence
  chemically synthesized
acatacaaaattttaaaatttt

SEQ ID NO: 1368394 - DNA, 22 bp, Artificial Sequence
  chemically synthesized
gcagcatctttctcagagcaaa

SEQ ID NO: 1368395 - DNA, 22 bp, Artificial Sequence
  chemically synthesized
ggcagcatctttctcagagcaa

SEQ ID NO: 1368396 - DNA, 22 bp, Artificial Sequence
  chemically synthesized
ttggcagcatctttctcagagc

SEQ ID NO: 1368397 - DNA, 22 bp, Artificial Sequence
  chemically synthesized
taaaattttgctctgagaaaga

SEQ ID NO: 1368398 - DNA, 22 bp, Artificial Sequence
  chemically synthesized
aaaattttgctctgagaaagat

SEQ ID NO: 1368399 - DNA, 22 bp, Artificial Sequence
  chemically synthesized
aaattttgctctgagaaagatg

SEQ ID NO: 1368400 - DNA, 22 bp, Artificial Sequence
  chemically synthesized
atcctcttggcagcatctttct

SEQ ID NO: 1368401 - DNA, 22 bp, Artificial Sequence
  chemically synthesized
catcctcttggcagcatctttc

SEQ ID NO: 1368402 - DNA, 22 bp, Artificial Sequence
  chemically synthesized
ttcatcctcttggcagcatctt

SEQ ID NO: 1368403 - DNA, 22 bp, Artificial Sequence
  chemically synthesized
tgctctgagaaagatgctgcca

SEQ ID NO: 1368404 - DNA, 22 bp, Artificial Sequence
  chemically synthesized
gctctgagaaagatgctgccaa

SEQ ID NO: 1368405 - DNA, 22 bp, Artificial Sequence
  chemically synthesized
ctctgagaaagatgctgccaag

SEQ ID NO: 1368406 - DNA, 22 bp, Artificial Sequence
  chemically synthesized
tctcttcatcctcttggcagca

SEQ ID NO: 1368407 - DNA, 22 bp, Artificial Sequence
  chemically synthesized
tgagaaagatgctgccaagagg

SEQ ID NO: 1368408 - DNA, 22 bp, Artificial Sequence
  chemically synthesized
agaaagatgctgccaagaggat

SEQ ID NO: 1368409 - DNA, 22 bp, Artificial Sequence
  chemically synthesized
gatgtgcagcctgtctcttcat

SEQ ID NO: 1368410 - DNA, 22 bp, Artificial Sequence
  chemically synthesized
tcgatgtgcagcctgtctcttc

SEQ ID NO: 1368411 - DNA, 22 bp, Artificial Sequence
  chemically synthesized
ctcgatgtgcagcctgtctctt

SEQ ID NO: 1368412 - DNA, 22 bp, Artificial Sequence
  chemically synthesized
ccaagaggatgaagagacaggc

SEQ ID NO: 1368413 - DNA, 22 bp, Artificial Sequence
  chemically synthesized
tctcgatgtgcagcctgtctct

SEQ ID NO: 1368414 - DNA, 22 bp, Artificial Sequence
  chemically synthesized
ttctcgatgtgcagcctgtctc

SEQ ID NO: 1368415 - DNA, 22 bp, Artificial Sequence
  chemically synthesized
caggtatttttctcgatgtgca

SEQ ID NO: 1368416 - DNA, 22 bp, Artificial Sequence
  chemically synthesized
gcaggtatttttctcgatgtgc

SEQ ID NO: 1368417 - DNA, 22 bp, Artificial Sequence
  chemically synthesized
cacatcgagaaaaatacctgca

SEQ ID NO: 1368418 - DNA, 22 bp, Artificial Sequence
  chemically synthesized
gtgcatggtcagatatatggtt

SEQ ID NO: 1368419 - DNA, 22 bp, Artificial Sequence
  chemically synthesized
gatactagtgcatggtcagata

SEQ ID NO: 1368420 - DNA, 22 bp, Artificial Sequence
  chemically synthesized
caaaccatatatctgaccatgc

SEQ ID NO: 1368421 - DNA, 22 bp, Artificial Sequence
  chemically synthesized
gtctagatactagtgcatggtc

SEQ ID NO: 1368422 - DNA, 22 bp, Artificial Sequence
  chemically synthesized
agtctagatactagtgcatggt

SEQ ID NO: 1368423 - DNA, 22 bp, Artificial Sequence
  chemically synthesized
atttagtctagatactagtgca

SEQ ID NO: 1368424 - DNA, 22 bp, Artificial Sequence
  chemically synthesized
catttagtctagatactagtgc

SEQ ID NO: 1368425 - DNA, 22 bp, Artificial Sequence
  chemically synthesized
ttcatttagtctagatactagt

SEQ ID NO: 1368426 - DNA, 22 bp, Artificial Sequence
  chemically synthesized
accatgcactagtatctagact

SEQ ID NO: 1368427 - DNA, 22 bp, Artificial Sequence
  chemically synthesized
catgaattcttcatttagtcta

SEQ ID NO: 1368428 - DNA, 22 bp, Artificial Sequence
  chemically synthesized
ggttacatgaattcttcattta

SEQ ID NO: 1368429 - DNA, 22 bp, Artificial Sequence
  chemically synthesized
gggttacatgaattcttcattt

SEQ ID NO: 1368430 - DNA, 22 bp, Artificial Sequence
  chemically synthesized
gtatctagactaaatgaagaat

SEQ ID NO: 1368431 - DNA, 22 bp, Artificial Sequence
  chemically synthesized
tgggttacatgaattcttcatt

SEQ ID NO: 1368432 - DNA, 22 bp, Artificial Sequence
  chemically synthesized
ttgggttacatgaattcttcat

SEQ ID NO: 1368433 - DNA, 22 bp, Artificial Sequence
  chemically synthesized
cttttgggttacatgaattctt

SEQ ID NO: 1368434 - DNA, 22 bp, Artificial Sequence
  chemically synthesized
acttttgggttacatgaattct

SEQ ID NO: 1368435 - DNA, 22 bp, Artificial Sequence
  chemically synthesized
tacttttgggttacatgaattc

SEQ ID NO: 1368436 - DNA, 22 bp, Artificial Sequence
  chemically synthesized
gactaaatgaagaattcatgta

SEQ ID NO: 1368437 - DNA, 22 bp, Artificial Sequence
  chemically synthesized
ttacttttgggttacatgaatt

SEQ ID NO: 1368438 - DNA, 22 bp, Artificial Sequence
  chemically synthesized
tttttacttttgggttacatga

SEQ ID NO: 1368439 - DNA, 22 bp, Artificial Sequence
  chemically synthesized
gtttttacttttgggttacatg

SEQ ID NO: 1368440 - DNA, 22 bp, Artificial Sequence
  chemically synthesized
aatgaagaattcatgtaaccca

SEQ ID NO: 1368441 - DNA, 22 bp, Artificial Sequence
  chemically synthesized
tgtttttacttttgggttacat

SEQ ID NO: 1368442 - DNA, 22 bp, Artificial Sequence
  chemically synthesized
ttttgtttttacttttgggtta

SEQ ID NO: 1368443 - DNA, 22 bp, Artificial Sequence
  chemically synthesized
tgtctattttgtttttactttt

SEQ ID NO: 1368444 - DNA, 22 bp, Artificial Sequence
  chemically synthesized
gtgtctattttgtttttacttt

SEQ ID NO: 1368445 - DNA, 22 bp, Artificial Sequence
  chemically synthesized
tgtgtctattttgtttttactt

SEQ ID NO: 1368446 - DNA, 22 bp, Artificial Sequence
  chemically synthesized
atgtaacccaaaagtaaaaaca

SEQ ID NO: 1368447 - DNA, 22 bp, Artificial Sequence
  chemically synthesized
ttgtgtctattttgtttttact

SEQ ID NO: 1368448 - DNA, 22 bp, Artificial Sequence
  chemically synthesized
tttgtgtctattttgtttttac

SEQ ID NO: 1368449 - DNA, 22 bp, Artificial Sequence
  chemically synthesized
ttttgtgtctattttgttttta

SEQ ID NO: 1368450 - DNA, 22 bp, Artificial Sequence
  chemically synthesized
atggatttttttgtgtctattt

SEQ ID NO: 1368451 - DNA, 22 bp, Artificial Sequence
  chemically synthesized
taatggatttttttgtgtctat

SEQ ID NO: 1368452 - DNA, 22 bp, Artificial Sequence
  chemically synthesized
ctaatggatttttttgtgtcta

SEQ ID NO: 1368453 - DNA, 22 bp, Artificial Sequence
  chemically synthesized
tctaatggatttttttgtgtct

SEQ ID NO: 1368454 - DNA, 22 bp, Artificial Sequence
  chemically synthesized
ttctaatggatttttttgtgtc

SEQ ID NO: 1368455 - DNA, 22 bp, Artificial Sequence
  chemically synthesized
cccatttttctaatggattttt

SEQ ID NO: 1368456 - DNA, 22 bp, Artificial Sequence
  chemically synthesized
gcccatttttctaatggatttt

SEQ ID NO: 1368457 - DNA, 22 bp, Artificial Sequence
  chemically synthesized
tgcccatttttctaatggattt

SEQ ID NO: 1368458 - DNA, 22 bp, Artificial Sequence
  chemically synthesized
ttgcccatttttctaatggatt

SEQ ID NO: 1368459 - DNA, 22 bp, Artificial Sequence
  chemically synthesized
catgtcttttgcccatttttct

SEQ ID NO: 1368460 - DNA, 22 bp, Artificial Sequence
  chemically synthesized
gtgaaatgtctccatgtctttt

SEQ ID NO: 1368461 - DNA, 22 bp, Artificial Sequence
  chemically synthesized
gaaaaatgggcaaaagacatgg

SEQ ID NO: 1368462 - DNA, 22 bp, Artificial Sequence
  chemically synthesized
ggtgaaatgtctccatgtcttt

SEQ ID NO: 1368463 - DNA, 22 bp, Artificial Sequence
  chemically synthesized
tggtgaaatgtctccatgtctt

SEQ ID NO: 1368464 - DNA, 22 bp, Artificial Sequence
  chemically synthesized
tctttggtgaaatgtctccatg

SEQ ID NO: 1368465 - DNA, 22 bp, Artificial Sequence
  chemically synthesized
tgtgttgtctttggtgaaatgt

SEQ ID NO: 1368466 - DNA, 22 bp, Artificial Sequence
  chemically synthesized
tccgccatctatgtgttgtctt

SEQ ID NO: 1368467 - DNA, 22 bp, Artificial Sequence
  chemically synthesized
atccgccatctatgtgttgtct

SEQ ID NO: 1368468 - DNA, 22 bp, Artificial Sequence
  chemically synthesized
caccaaagacaacacatagatg

SEQ ID NO: 1368469 - DNA, 22 bp, Artificial Sequence
  chemically synthesized
accaaagacaacacatagatgg

SEQ ID NO: 1368470 - DNA, 22 bp, Artificial Sequence
  chemically synthesized
acaagcttatccgccatctatg

SEQ ID NO: 1368471 - DNA, 22 bp, Artificial Sequence
  chemically synthesized
cacaagcttatccgccatctat

SEQ ID NO: 1368472 - DNA, 22 bp, Artificial Sequence
  chemically synthesized
tcacaagcttatccgccatcta

SEQ ID NO: 1368473 - DNA, 22 bp, Artificial Sequence
  chemically synthesized
ttcacaagcttatccgccatct

SEQ ID NO: 1368474 - DNA, 22 bp, Artificial Sequence
  chemically synthesized
aacatcttttcacaagcttatc

SEQ ID NO: 1368475 - DNA, 22 bp, Artificial Sequence
  chemically synthesized
agagccaatgatgctgaacatc

SEQ ID NO: 1368476 - DNA, 22 bp, Artificial Sequence
  chemically synthesized
cctaagagccaatgatgctgaa

SEQ ID NO: 1368477 - DNA, 22 bp, Artificial Sequence
  chemically synthesized
gtgaaaagatgttcagcatcat

SEQ ID NO: 1368478 - DNA, 22 bp, Artificial Sequence
  chemically synthesized
ccctaagagccaatgatgctga

SEQ ID NO: 1368479 - DNA, 22 bp, Artificial Sequence
  chemically synthesized
tgaaaagatgttcagcatcatt

SEQ ID NO: 1368480 - DNA, 22 bp, Artificial Sequence
  chemically synthesized
gaatttccctaagagccaatga

SEQ ID NO: 1368481 - DNA, 22 bp, Artificial Sequence
  chemically synthesized
attcgaatttccctaagagcca

SEQ ID NO: 1368482 - DNA, 22 bp, Artificial Sequence
  chemically synthesized
aattcgaatttccctaagagcc

SEQ ID NO: 1368483 - DNA, 22 bp, Artificial Sequence
  chemically synthesized
taattcgaatttccctaagagc

SEQ ID NO: 1368484 - DNA, 22 bp, Artificial Sequence
  chemically synthesized
agcatcattggctcttagggaa

SEQ ID NO: 1368485 - DNA, 22 bp, Artificial Sequence
  chemically synthesized
aggttttaattcgaatttccct

SEQ ID NO: 1368486 - DNA, 22 bp, Artificial Sequence
  chemically synthesized
gctcttagggaaattcgaatta

SEQ ID NO: 1368487 - DNA, 22 bp, Artificial Sequence
  chemically synthesized
ttagggaaattcgaattaaaac

SEQ ID NO: 1368488 - DNA, 22 bp, Artificial Sequence
  chemically synthesized
tatcgtattgaggttttaattc

SEQ ID NO: 1368489 - DNA, 22 bp, Artificial Sequence
  chemically synthesized
agggaaattcgaattaaaacct

SEQ ID NO: 1368490 - DNA, 22 bp, Artificial Sequence
  chemically synthesized
gggaaattcgaattaaaacctc

SEQ ID NO: 1368491 - DNA, 22 bp, Artificial Sequence
  chemically synthesized
gaattaaaacctcaatacgata

SEQ ID NO: 1368492 - DNA, 22 bp, Artificial Sequence
  chemically synthesized
atatgcacagagttatatcgta

SEQ ID NO: 1368493 - DNA, 22 bp, Artificial Sequence
  chemically synthesized
taatatgcacagagttatatcg

SEQ ID NO: 1368494 - DNA, 22 bp, Artificial Sequence
  chemically synthesized
aaacctcaatacgatataactc

SEQ ID NO: 1368495 - DNA, 22 bp, Artificial Sequence
  chemically synthesized
gccattctaatatgcacagagt

SEQ ID NO: 1368496 - DNA, 22 bp, Artificial Sequence
  chemically synthesized
aatacgatataactctgtgcat

SEQ ID NO: 1368497 - DNA, 22 bp, Artificial Sequence
  chemically synthesized
agccattctaatatgcacagag

SEQ ID NO: 1368498 - DNA, 22 bp, Artificial Sequence
  chemically synthesized
acttagccattctaatatgcac

SEQ ID NO: 1368499 - DNA, 22 bp, Artificial Sequence
  chemically synthesized
aacttagccattctaatatgca

SEQ ID NO: 1368500 - DNA, 22 bp, Artificial Sequence
  chemically synthesized
taacttagccattctaatatgc

SEQ ID NO: 1368501 - DNA, 22 bp, Artificial Sequence
  chemically synthesized
ttaacttagccattctaatatg

SEQ ID NO: 1368502 - DNA, 22 bp, Artificial Sequence
  chemically synthesized
tttaacttagccattctaatat

SEQ ID NO: 1368503 - DNA, 22 bp, Artificial Sequence
  chemically synthesized
ttttttaacttagccattctaa

SEQ ID NO: 1368504 - DNA, 22 bp, Artificial Sequence
  chemically synthesized
tgtgcatattagaatggctaag

SEQ ID NO: 1368505 - DNA, 22 bp, Artificial Sequence
  chemically synthesized
tgcatattagaatggctaagtt

SEQ ID NO: 1368506 - DNA, 22 bp, Artificial Sequence
  chemically synthesized
tcactattttttaacttagcca

SEQ ID NO: 1368507 - DNA, 22 bp, Artificial Sequence
  chemically synthesized
atgttgtcactattttttaact

SEQ ID NO: 1368508 - DNA, 22 bp, Artificial Sequence
  chemically synthesized
gatgttgtcactattttttaac

SEQ ID NO: 1368509 - DNA, 22 bp, Artificial Sequence
  chemically synthesized
gaatggctaagttaaaaaatag

SEQ ID NO: 1368510 - DNA, 22 bp, Artificial Sequence
  chemically synthesized
ccagtgtttgatgttgtcacta

SEQ ID NO: 1368511 - DNA, 22 bp, Artificial Sequence
  chemically synthesized
gccagtgtttgatgttgtcact

SEQ ID NO: 1368512 - DNA, 22 bp, Artificial Sequence
  chemically synthesized
agttaaaaaatagtgacaacat

SEQ ID NO: 1368513 - DNA, 22 bp, Artificial Sequence
  chemically synthesized
ttgccagtgtttgatgttgtca

SEQ ID NO: 1368514 - DNA, 22 bp, Artificial Sequence
  chemically synthesized
aaaaatagtgacaacatcaaac

SEQ ID NO: 1368515 - DNA, 22 bp, Artificial Sequence
  chemically synthesized
cattcttgccagtgtttgatgt

SEQ ID NO: 1368516 - DNA, 22 bp, Artificial Sequence
  chemically synthesized
tgcattcttgccagtgtttgat

SEQ ID NO: 1368517 - DNA, 22 bp, Artificial Sequence
  chemically synthesized
tctgcattcttgccagtgtttg

SEQ ID NO: 1368518 - DNA, 22 bp, Artificial Sequence
  chemically synthesized
ctctgcattcttgccagtgttt

SEQ ID NO: 1368519 - DNA, 22 bp, Artificial Sequence
  chemically synthesized
atttctctgcattcttgccagt

SEQ ID NO: 1368520 - DNA, 22 bp, Artificial Sequence
  chemically synthesized
gcaagaatgcagagaaatgaga

SEQ ID NO: 1368521 - DNA, 22 bp, Artificial Sequence
  chemically synthesized
caccaacaatgtgtaagtgatc

SEQ ID NO: 1368522 - DNA, 22 bp, Artificial Sequence
  chemically synthesized
ccaccaacaatgtgtaagtgat

SEQ ID NO: 1368523 - DNA, 22 bp, Artificial Sequence
  chemically synthesized
atgtttccaccaacaatgtgta

SEQ ID NO: 1368524 - DNA, 22 bp, Artificial Sequence
  chemically synthesized
ccatctcatgtttccaccaaca

SEQ ID NO: 1368525 - DNA, 22 bp, Artificial Sequence
  chemically synthesized
accatctcatgtttccaccaac

SEQ ID NO: 1368526 - DNA, 22 bp, Artificial Sequence
  chemically synthesized
taccatctcatgtttccaccaa

SEQ ID NO: 1368527 - DNA, 22 bp, Artificial Sequence
  chemically synthesized
acacattgttggtggaaacatg

SEQ ID NO: 1368528 - DNA, 22 bp, Artificial Sequence
  chemically synthesized
cacattgttggtggaaacatga

SEQ ID NO: 1368529 - DNA, 22 bp, Artificial Sequence
  chemically synthesized
cagagtacctttaccatctcat

SEQ ID NO: 1368530 - DNA, 22 bp, Artificial Sequence
  chemically synthesized
ttggtggaaacatgagatggta

SEQ ID NO: 1368531 - DNA, 22 bp, Artificial Sequence
  chemically synthesized
acagagtacctttaccatctca

SEQ ID NO: 1368532 - DNA, 22 bp, Artificial Sequence
  chemically synthesized
tacagagtacctttaccatctc

SEQ ID NO: 1368533 - DNA, 22 bp, Artificial Sequence
  chemically synthesized
ttacagagtacctttaccatct

SEQ ID NO: 1368534 - DNA, 22 bp, Artificial Sequence
  chemically synthesized
gtggaaacatgagatggtaaag

SEQ ID NO: 1368535 - DNA, 22 bp, Artificial Sequence
  chemically synthesized
caatgcaccaaacttttacaga

SEQ ID NO: 1368536 - DNA, 22 bp, Artificial Sequence
  chemically synthesized
acaatgcaccaaacttttacag

SEQ ID NO: 1368537 - DNA, 22 bp, Artificial Sequence
  chemically synthesized
tacaatgcaccaaacttttaca

SEQ ID NO: 1368538 - DNA, 22 bp, Artificial Sequence
  chemically synthesized
ttacaatgcaccaaacttttac

SEQ ID NO: 1368539 - DNA, 22 bp, Artificial Sequence
  chemically synthesized
tttacaatgcaccaaactttta

SEQ ID NO: 1368540 - DNA, 22 bp, Artificial Sequence
  chemically synthesized
gttttttacaatgcaccaaact

SEQ ID NO: 1368541 - DNA, 22 bp, Artificial Sequence
  chemically synthesized
agttttttacaatgcaccaaac

SEQ ID NO: 1368542 - DNA, 22 bp, Artificial Sequence
  chemically synthesized
tgtaaaagtttggtgcattgta

SEQ ID NO: 1368543 - DNA, 22 bp, Artificial Sequence
  chemically synthesized
taaaagtttggtgcattgtaaa

SEQ ID NO: 1368544 - DNA, 22 bp, Artificial Sequence
  chemically synthesized
tatgtttagttttttacaatgc

SEQ ID NO: 1368545 - DNA, 22 bp, Artificial Sequence
  chemically synthesized
gttgtatgtttagttttttaca

SEQ ID NO: 1368546 - DNA, 22 bp, Artificial Sequence
  chemically synthesized
ggtgcattgtaaaaaactaaac

SEQ ID NO: 1368547 - DNA, 22 bp, Artificial Sequence
  chemically synthesized
gtgcattgtaaaaaactaaaca

SEQ ID NO: 1368548 - DNA, 22 bp, Artificial Sequence
  chemically synthesized
taggttagttgtatgtttagtt

SEQ ID NO: 1368549 - DNA, 22 bp, Artificial Sequence
  chemically synthesized
ggctgtaggttagttgtatgtt

SEQ ID NO: 1368550 - DNA, 22 bp, Artificial Sequence
  chemically synthesized
taaaaaactaaacatacaacta

SEQ ID NO: 1368551 - DNA, 22 bp, Artificial Sequence
  chemically synthesized
tgggctgtaggttagttgtatg

SEQ ID NO: 1368552 - DNA, 22 bp, Artificial Sequence
  chemically synthesized
ctgggctgtaggttagttgtat

SEQ ID NO: 1368553 - DNA, 22 bp, Artificial Sequence
  chemically synthesized
aacatacaactaacctacagcc

SEQ ID NO: 1368554 - DNA, 22 bp, Artificial Sequence
  chemically synthesized
atgccatggaatgaaatttctg

SEQ ID NO: 1368555 - DNA, 22 bp, Artificial Sequence
  chemically synthesized
acctacagcccagaaatttcat

SEQ ID NO: 1368556 - DNA, 22 bp, Artificial Sequence
  chemically synthesized
ggattaatgccatggaatgaaa

SEQ ID NO: 1368557 - DNA, 22 bp, Artificial Sequence
  chemically synthesized
cagcccagaaatttcattccat

SEQ ID NO: 1368558 - DNA, 22 bp, Artificial Sequence
  chemically synthesized
tctgggattaatgccatggaat

SEQ ID NO: 1368559 - DNA, 22 bp, Artificial Sequence
  chemically synthesized
atctgggattaatgccatggaa

SEQ ID NO: 1368560 - DNA, 22 bp, Artificial Sequence
  chemically synthesized
atttatctgggattaatgccat

SEQ ID NO: 1368561 - DNA, 22 bp, Artificial Sequence
  chemically synthesized
catttatctgggattaatgcca

SEQ ID NO: 1368562 - DNA, 22 bp, Artificial Sequence
  chemically synthesized
tcatttatctgggattaatgcc

SEQ ID NO: 1368563 - DNA, 22 bp, Artificial Sequence
  chemically synthesized
cattccatggcattaatcccag

SEQ ID NO: 1368564 - DNA, 22 bp, Artificial Sequence
  chemically synthesized
attccatggcattaatcccaga

SEQ ID NO: 1368565 - DNA, 22 bp, Artificial Sequence
  chemically synthesized
catggcattaatcccagataaa

SEQ ID NO: 1368566 - DNA, 22 bp, Artificial Sequence
  chemically synthesized
tgagcaaattttcatttatctg

SEQ ID NO: 1368567 - DNA, 22 bp, Artificial Sequence
  chemically synthesized
atgagcaaattttcatttatct

SEQ ID NO: 1368568 - DNA, 22 bp, Artificial Sequence
  chemically synthesized
tatgagcaaattttcatttatc

SEQ ID NO: 1368569 - DNA, 22 bp, Artificial Sequence
  chemically synthesized
ttatgagcaaattttcatttat

SEQ ID NO: 1368570 - DNA, 22 bp, Artificial Sequence
  chemically synthesized
tttatgagcaaattttcattta

SEQ ID NO: 1368571 - DNA, 22 bp, Artificial Sequence
  chemically synthesized
ttttatgagcaaattttcattt

SEQ ID NO: 1368572 - DNA, 22 bp, Artificial Sequence
  chemically synthesized
atcccagataaatgaaaatttg

SEQ ID NO: 1368573 - DNA, 22 bp, Artificial Sequence
  chemically synthesized
atgtacagtttttttatgagca

SEQ ID NO: 1368574 - DNA, 22 bp, Artificial Sequence
  chemically synthesized
tgaagactcatgtacagttttt

SEQ ID NO: 1368575 - DNA, 22 bp, Artificial Sequence
  chemically synthesized
ctatgaagactcatgtacagtt

SEQ ID NO: 1368576 - DNA, 22 bp, Artificial Sequence
  chemically synthesized
gctcataaaaaaactgtacatg

SEQ ID NO: 1368577 - DNA, 22 bp, Artificial Sequence
  chemically synthesized
ctcataaaaaaactgtacatga

SEQ ID NO: 1368578 - DNA, 22 bp, Artificial Sequence
  chemically synthesized
ataaaaaaactgtacatgagtc

SEQ ID NO: 1368579 - DNA, 22 bp, Artificial Sequence
  chemically synthesized
caaatacagctgctatgaagac

SEQ ID NO: 1368580 - DNA, 22 bp, Artificial Sequence
  chemically synthesized
ttacaaatacagctgctatgaa

SEQ ID NO: 1368581 - DNA, 22 bp, Artificial Sequence
  chemically synthesized
tacatgagtcttcatagcagct

SEQ ID NO: 1368582 - DNA, 22 bp, Artificial Sequence
  chemically synthesized
cctattacaaatacagctgcta

SEQ ID NO: 1368583 - DNA, 22 bp, Artificial Sequence
  chemically synthesized
tgcctattacaaatacagctgc

SEQ ID NO: 1368584 - DNA, 22 bp, Artificial Sequence
  chemically synthesized
ctgcctattacaaatacagctg

SEQ ID NO: 1368585 - DNA, 22 bp, Artificial Sequence
  chemically synthesized
cagtttctgcctattacaaata

SEQ ID NO: 1368586 - DNA, 22 bp, Artificial Sequence
  chemically synthesized
catagcagctgtatttgtaata

SEQ ID NO: 1368587 - DNA, 22 bp, Artificial Sequence
  chemically synthesized
ccagtttctgcctattacaaat

SEQ ID NO: 1368588 - DNA, 22 bp, Artificial Sequence
  chemically synthesized
atagcagctgtatttgtaatag

SEQ ID NO: 1368589 - DNA, 22 bp, Artificial Sequence
  chemically synthesized
tttccagtttctgcctattaca

SEQ ID NO: 1368590 - DNA, 22 bp, Artificial Sequence
  chemically synthesized
ggttgtttccagtttctgccta

SEQ ID NO: 1368591 - DNA, 22 bp, Artificial Sequence
  chemically synthesized
tatttgtaataggcagaaactg

SEQ ID NO: 1368592 - DNA, 22 bp, Artificial Sequence
  chemically synthesized
gtaataggcagaaactggaaac

SEQ ID NO: 1368593 - DNA, 22 bp, Artificial Sequence
  chemically synthesized
taataggcagaaactggaaaca

SEQ ID NO: 1368594 - DNA, 22 bp, Artificial Sequence
  chemically synthesized
aaggacatctgggttgtttcca

SEQ ID NO: 1368595 - DNA, 22 bp, Artificial Sequence
  chemically synthesized
ttgaaggacatctgggttgttt

SEQ ID NO: 1368596 - DNA, 22 bp, Artificial Sequence
  chemically synthesized
cctgttgaaggacatctgggtt

SEQ ID NO: 1368597 - DNA, 22 bp, Artificial Sequence
  chemically synthesized
gcctgttgaaggacatctgggt

SEQ ID NO: 1368598 - DNA, 22 bp, Artificial Sequence
  chemically synthesized
gaaacaacccagatgtccttca

SEQ ID NO: 1368599 - DNA, 22 bp, Artificial Sequence
  chemically synthesized
accatttgcctgttgaaggaca

SEQ ID NO: 1368600 - DNA, 22 bp, Artificial Sequence
  chemically synthesized
attaaccatttgcctgttgaag

SEQ ID NO: 1368601 - DNA, 22 bp, Artificial Sequence
  chemically synthesized
gattaaccatttgcctgttgaa

SEQ ID NO: 1368602 - DNA, 22 bp, Artificial Sequence
  chemically synthesized
caacaggcaaatggttaatcaa

SEQ ID NO: 1368603 - DNA, 22 bp, Artificial Sequence
  chemically synthesized
aacaggcaaatggttaatcaaa

SEQ ID NO: 1368604 - DNA, 22 bp, Artificial Sequence
  chemically synthesized
catggtatgaatatgccagttt

SEQ ID NO: 1368605 - DNA, 22 bp, Artificial Sequence
  chemically synthesized
atcaaactggcatattcatacc

SEQ ID NO: 1368606 - DNA, 22 bp, Artificial Sequence
  chemically synthesized
agtagtattccatggtatgaat

SEQ ID NO: 1368607 - DNA, 22 bp, Artificial Sequence
  chemically synthesized
ctgagtagtattccatggtatg

SEQ ID NO: 1368608 - DNA, 22 bp, Artificial Sequence
  chemically synthesized
gcatattcataccatggaatac

SEQ ID NO: 1368609 - DNA, 22 bp, Artificial Sequence
  chemically synthesized
tactgctgagtagtattccatg

SEQ ID NO: 1368610 - DNA, 22 bp, Artificial Sequence
  chemically synthesized
gtactgctgagtagtattccat

SEQ ID NO: 1368611 - DNA, 22 bp, Artificial Sequence
  chemically synthesized
tgtactgctgagtagtattcca

SEQ ID NO: 1368612 - DNA, 22 bp, Artificial Sequence
  chemically synthesized
ctttgtactgctgagtagtatt

SEQ ID NO: 1368613 - DNA, 22 bp, Artificial Sequence
  chemically synthesized
ataccatggaatactactcagc

SEQ ID NO: 1368614 - DNA, 22 bp, Artificial Sequence
  chemically synthesized
ctcagcagtacaaaggaacaca

SEQ ID NO: 1368615 - DNA, 22 bp, Artificial Sequence
  chemically synthesized
agcagtacaaaggaacacattg

SEQ ID NO: 1368616 - DNA, 22 bp, Artificial Sequence
  chemically synthesized
taatgtgcatcaacaatgtgtt

SEQ ID NO: 1368617 - DNA, 22 bp, Artificial Sequence
  chemically synthesized
gtaatgtgcatcaacaatgtgt

SEQ ID NO: 1368618 - DNA, 22 bp, Artificial Sequence
  chemically synthesized
cagatttgtaatgtgcatcaac

SEQ ID NO: 1368619 - DNA, 22 bp, Artificial Sequence
  chemically synthesized
ccagatttgtaatgtgcatcaa

SEQ ID NO: 1368620 - DNA, 22 bp, Artificial Sequence
  chemically synthesized
ttccagatttgtaatgtgcatc

SEQ ID NO: 1368621 - DNA, 22 bp, Artificial Sequence
  chemically synthesized
gagattcttccagatttgtaat

SEQ ID NO: 1368622 - DNA, 22 bp, Artificial Sequence
  chemically synthesized
tggagattcttccagatttgta

SEQ ID NO: 1368623 - DNA, 22 bp, Artificial Sequence
  chemically synthesized
ttgatgcacattacaaatctgg

SEQ ID NO: 1368624 - DNA, 22 bp, Artificial Sequence
  chemically synthesized
tctggagattcttccagatttg

SEQ ID NO: 1368625 - DNA, 22 bp, Artificial Sequence
  chemically synthesized
atgcacattacaaatctggaag

SEQ ID NO: 1368626 - DNA, 22 bp, Artificial Sequence
  chemically synthesized
agcataattctctggagattct

SEQ ID NO: 1368627 - DNA, 22 bp, Artificial Sequence
  chemically synthesized
caaatctggaagaatctccaga

SEQ ID NO: 1368628 - DNA, 22 bp, Artificial Sequence
  chemically synthesized
actcagcataattctctggaga

SEQ ID NO: 1368629 - DNA, 22 bp, Artificial Sequence
  chemically synthesized
ttcactcagcataattctctgg

SEQ ID NO: 1368630 - DNA, 22 bp, Artificial Sequence
  chemically synthesized
gttcactcagcataattctctg

SEQ ID NO: 1368631 - DNA, 22 bp, Artificial Sequence
  chemically synthesized
gaagaatctccagagaattatg

SEQ ID NO: 1368632 - DNA, 22 bp, Artificial Sequence
  chemically synthesized
gccttgttcactcagcataatt

SEQ ID NO: 1368633 - DNA, 22 bp, Artificial Sequence
  chemically synthesized
ggactagccttgttcactcagc

SEQ ID NO: 1368634 - DNA, 22 bp, Artificial Sequence
  chemically synthesized
cagagaattatgctgagtgaac

SEQ ID NO: 1368635 - DNA, 22 bp, Artificial Sequence
  chemically synthesized
aggactagccttgttcactcag

SEQ ID NO: 1368636 - DNA, 22 bp, Artificial Sequence
  chemically synthesized
tttaggactagccttgttcact

SEQ ID NO: 1368637 - DNA, 22 bp, Artificial Sequence
  chemically synthesized
tgctgagtgaacaaggctagtc

SEQ ID NO: 1368638 - DNA, 22 bp, Artificial Sequence
  chemically synthesized
tgtagctatttaggactagcct

SEQ ID NO: 1368639 - DNA, 22 bp, Artificial Sequence
  chemically synthesized
agtgaacaaggctagtcctaaa

SEQ ID NO: 1368640 - DNA, 22 bp, Artificial Sequence
  chemically synthesized
tattatgtagctatttaggact

SEQ ID NO: 1368641 - DNA, 22 bp, Artificial Sequence
  chemically synthesized
gtcctaaatagctacataatac

SEQ ID NO: 1368642 - DNA, 22 bp, Artificial Sequence
  chemically synthesized
tgtaaatgaaaccctgtattat

SEQ ID NO: 1368643 - DNA, 22 bp, Artificial Sequence
  chemically synthesized
aatagctacataatacagggtt

SEQ ID NO: 1368644 - DNA, 22 bp, Artificial Sequence
  chemically synthesized
aaaagtgttatgtaaatgaaac

SEQ ID NO: 1368645 - DNA, 22 bp, Artificial Sequence
  chemically synthesized
cataatacagggtttcatttac

SEQ ID NO: 1368646 - DNA, 22 bp, Artificial Sequence
  chemically synthesized
tcatctcaaaagtgttatgtaa

SEQ ID NO: 1368647 - DNA, 22 bp, Artificial Sequence
  chemically synthesized
atcatctcaaaagtgttatgta

SEQ ID NO: 1368648 - DNA, 22 bp, Artificial Sequence
  chemically synthesized
tatcatctcaaaagtgttatgt

SEQ ID NO: 1368649 - DNA, 22 bp, Artificial Sequence
  chemically synthesized
catttacataacacttttgaga

SEQ ID NO: 1368650 - DNA, 22 bp, Artificial Sequence
  chemically synthesized
atttacataacacttttgagat

SEQ ID NO: 1368651 - DNA, 22 bp, Artificial Sequence
  chemically synthesized
tataattttatcatctcaaaag

SEQ ID NO: 1368652 - DNA, 22 bp, Artificial Sequence
  chemically synthesized
gtataattttatcatctcaaaa

SEQ ID NO: 1368653 - DNA, 22 bp, Artificial Sequence
  chemically synthesized
acataacacttttgagatgata

SEQ ID NO: 1368654 - DNA, 22 bp, Artificial Sequence
  chemically synthesized
tttgtataattttatcatctca

SEQ ID NO: 1368655 - DNA, 22 bp, Artificial Sequence
  chemically synthesized
cataacacttttgagatgataa

SEQ ID NO: 1368656 - DNA, 22 bp, Artificial Sequence
  chemically synthesized
tatttgtataattttatcatct

SEQ ID NO: 1368657 - DNA, 22 bp, Artificial Sequence
  chemically synthesized
ttgagatgataaaattatacaa

SEQ ID NO: 1368658 - DNA, 22 bp, Artificial Sequence
  chemically synthesized
tgagatgataaaattatacaaa

SEQ ID NO: 1368659 - DNA, 22 bp, Artificial Sequence
  chemically synthesized
atatgatctctatttgtataat

SEQ ID NO: 1368660 - DNA, 22 bp, Artificial Sequence
  chemically synthesized
gagatgataaaattatacaaat

SEQ ID NO: 1368661 - DNA, 22 bp, Artificial Sequence
  chemically synthesized
agatgataaaattatacaaata

SEQ ID NO: 1368662 - DNA, 22 bp, Artificial Sequence
  chemically synthesized
ctaatatgatctctatttgtat

SEQ ID NO: 1368663 - DNA, 22 bp, Artificial Sequence
  chemically synthesized
gcaactactaatatgatctcta

SEQ ID NO: 1368664 - DNA, 22 bp, Artificial Sequence
  chemically synthesized
tagcaactactaatatgatctc

SEQ ID NO: 1368665 - DNA, 22 bp, Artificial Sequence
  chemically synthesized
tacaaatagagatcatattagt

SEQ ID NO: 1368666 - DNA, 22 bp, Artificial Sequence
  chemically synthesized
atctctagcaactactaatatg

SEQ ID NO: 1368667 - DNA, 22 bp, Artificial Sequence
  chemically synthesized
aatctctagcaactactaatat

SEQ ID NO: 1368668 - DNA, 22 bp, Artificial Sequence
  chemically synthesized
cttaatctctagcaactactaa

SEQ ID NO: 1368669 - DNA, 22 bp, Artificial Sequence
  chemically synthesized
aggcactccttaatctctagca

SEQ ID NO: 1368670 - DNA, 22 bp, Artificial Sequence
  chemically synthesized
ccctcaggcactccttaatctc

SEQ ID NO: 1368671 - DNA, 22 bp, Artificial Sequence
  chemically synthesized
gtagttgctagagattaaggag

SEQ ID NO: 1368672 - DNA, 22 bp, Artificial Sequence
  chemically synthesized
ctgccctcaggcactccttaat

SEQ ID NO: 1368673 - DNA, 22 bp, Artificial Sequence
  chemically synthesized
cctgccctcaggcactccttaa

SEQ ID NO: 1368674 - DNA, 22 bp, Artificial Sequence
  chemically synthesized
tcctgccctcaggcactcctta

SEQ ID NO: 1368675 - DNA, 22 bp, Artificial Sequence
  chemically synthesized
ttcctgccctcaggcactcctt

SEQ ID NO: 1368676 - DNA, 22 bp, Artificial Sequence
  chemically synthesized
tttcctgccctcaggcactcct

SEQ ID NO: 1368677 - DNA, 22 bp, Artificial Sequence
  chemically synthesized
ttttcctgccctcaggcactcc

SEQ ID NO: 1368678 - DNA, 22 bp, Artificial Sequence
  chemically synthesized
ctagagattaaggagtgcctga

SEQ ID NO: 1368679 - DNA, 22 bp, Artificial Sequence
  chemically synthesized
gagattaaggagtgcctgaggg

SEQ ID NO: 1368680 - DNA, 22 bp, Artificial Sequence
  chemically synthesized
aggagtgcctgagggcaggaaa

SEQ ID NO: 1368681 - DNA, 22 bp, Artificial Sequence
  chemically synthesized
atggtcagacccacttttttcc

SEQ ID NO: 1368682 - DNA, 22 bp, Artificial Sequence
  chemically synthesized
catggtcagacccacttttttc

SEQ ID NO: 1368683 - DNA, 22 bp, Artificial Sequence
  chemically synthesized
tcatggtcagacccactttttt

SEQ ID NO: 1368684 - DNA, 22 bp, Artificial Sequence
  chemically synthesized
agggcaggaaaaaagtgggtct

SEQ ID NO: 1368685 - DNA, 22 bp, Artificial Sequence
  chemically synthesized
ccctttcatggtcagacccact

SEQ ID NO: 1368686 - DNA, 22 bp, Artificial Sequence
  chemically synthesized
atgttgccctttcatggtcaga

SEQ ID NO: 1368687 - DNA, 22 bp, Artificial Sequence
  chemically synthesized
accatgaaagggcaacatgagt

SEQ ID NO: 1368688 - DNA, 22 bp, Artificial Sequence
  chemically synthesized
catcaccacaaggatcactcat

SEQ ID NO: 1368689 - DNA, 22 bp, Artificial Sequence
  chemically synthesized
ccatcaccacaaggatcactca

SEQ ID NO: 1368690 - DNA, 22 bp, Artificial Sequence
  chemically synthesized
gtggtgatggaaatatcctgta

SEQ ID NO: 1368691 - DNA, 22 bp, Artificial Sequence
  chemically synthesized
tggtgatggaaatatcctgtat

SEQ ID NO: 1368692 - DNA, 22 bp, Artificial Sequence
  chemically synthesized
acatcagcacagataaaataca

SEQ ID NO: 1368693 - DNA, 22 bp, Artificial Sequence
  chemically synthesized
caacaagatattgacatcagca

SEQ ID NO: 1368694 - DNA, 22 bp, Artificial Sequence
  chemically synthesized
tattttatctgtgctgatgtca

SEQ ID NO: 1368695 - DNA, 22 bp, Artificial Sequence
  chemically synthesized
tatctgtgctgatgtcaatatc

SEQ ID NO: 1368696 - DNA, 22 bp, Artificial Sequence
  chemically synthesized
atctgtgctgatgtcaatatct

SEQ ID NO: 1368697 - DNA, 22 bp, Artificial Sequence
  chemically synthesized
tctgtgctgatgtcaatatctt

SEQ ID NO: 1368698 - DNA, 22 bp, Artificial Sequence
  chemically synthesized
tgctgatgtcaatatcttgttg

SEQ ID NO: 1368699 - DNA, 22 bp, Artificial Sequence
  chemically synthesized
tagaacaatattacaacaagat

SEQ ID NO: 1368700 - DNA, 22 bp, Artificial Sequence
  chemically synthesized
atgtcaatatcttgttgtaata

SEQ ID NO: 1368701 - DNA, 22 bp, Artificial Sequence
  chemically synthesized
gttgtaatattgttctatagtt

SEQ ID NO: 1368702 - DNA, 22 bp, Artificial Sequence
  chemically synthesized
ttgtaatattgttctatagttc

SEQ ID NO: 1368703 - DNA, 22 bp, Artificial Sequence
  chemically synthesized
aggtaaagtcacagaactatag

SEQ ID NO: 1368704 - DNA, 22 bp, Artificial Sequence
  chemically synthesized
aaggtaaagtcacagaactata

SEQ ID NO: 1368705 - DNA, 22 bp, Artificial Sequence
  chemically synthesized
taatattgttctatagttctgt

SEQ ID NO: 1368706 - DNA, 22 bp, Artificial Sequence
  chemically synthesized
cttaaggtaaagtcacagaact

SEQ ID NO: 1368707 - DNA, 22 bp, Artificial Sequence
  chemically synthesized
ttctatagttctgtgactttac

SEQ ID NO: 1368708 - DNA, 22 bp, Artificial Sequence
  chemically synthesized
tatagttctgtgactttacctt

SEQ ID NO: 1368709 - DNA, 22 bp, Artificial Sequence
  chemically synthesized
tagttctgtgactttaccttaa

SEQ ID NO: 1368710 - DNA, 22 bp, Artificial Sequence
  chemically synthesized
cccagtccctccttaaggtaaa

SEQ ID NO: 1368711 - DNA, 22 bp, Artificial Sequence
  chemically synthesized
acccagtccctccttaaggtaa

SEQ ID NO: 1368712 - DNA, 22 bp, Artificial Sequence
  chemically synthesized
tacccagtccctccttaaggta

SEQ ID NO: 1368713 - DNA, 22 bp, Artificial Sequence
  chemically synthesized
tgtgactttaccttaaggaggg

SEQ ID NO: 1368714 - DNA, 22 bp, Artificial Sequence
  chemically synthesized
tgactttaccttaaggagggac

SEQ ID NO: 1368715 - DNA, 22 bp, Artificial Sequence
  chemically synthesized
tgtgccattttacccagtccct

SEQ ID NO: 1368716 - DNA, 22 bp, Artificial Sequence
  chemically synthesized
taccttaaggagggactgggta

SEQ ID NO: 1368717 - DNA, 22 bp, Artificial Sequence
  chemically synthesized
accttaaggagggactgggtaa

SEQ ID NO: 1368718 - DNA, 22 bp, Artificial Sequence
  chemically synthesized
ccttaaggagggactgggtaaa

SEQ ID NO: 1368719 - DNA, 22 bp, Artificial Sequence
  chemically synthesized
aaggagggactgggtaaaatgg

SEQ ID NO: 1368720 - DNA, 22 bp, Artificial Sequence
  chemically synthesized
aggagggactgggtaaaatggc

SEQ ID NO: 1368721 - DNA, 22 bp, Artificial Sequence
  chemically synthesized
ggtaaaatggcacacaggatct

SEQ ID NO: 1368722 - DNA, 22 bp, Artificial Sequence
  chemically synthesized
taagaaataatacagaaagatc

SEQ ID NO: 1368723 - DNA, 22 bp, Artificial Sequence
  chemically synthesized
acatgcagttgtaagaaataat

SEQ ID NO: 1368724 - DNA, 22 bp, Artificial Sequence
  chemically synthesized
tctgtattatttcttacaactg

SEQ ID NO: 1368725 - DNA, 22 bp, Artificial Sequence
  chemically synthesized
taaattcacatgcagttgtaag

SEQ ID NO: 1368726 - DNA, 22 bp, Artificial Sequence
  chemically synthesized
ctgtattatttcttacaactgc

SEQ ID NO: 1368727 - DNA, 22 bp, Artificial Sequence
  chemically synthesized
tgtattatttcttacaactgca

SEQ ID NO: 1368728 - DNA, 22 bp, Artificial Sequence
  chemically synthesized
tattatttcttacaactgcatg

SEQ ID NO: 1368729 - DNA, 22 bp, Artificial Sequence
  chemically synthesized
tttcttacaactgcatgtgaat

SEQ ID NO: 1368730 - DNA, 22 bp, Artificial Sequence
  chemically synthesized
cttacaactgcatgtgaattta

SEQ ID NO: 1368731 - DNA, 22 bp, Artificial Sequence
  chemically synthesized
ttacaactgcatgtgaatttac

SEQ ID NO: 1368732 - DNA, 22 bp, Artificial Sequence
  chemically synthesized
acaactgcatgtgaatttacag

SEQ ID NO: 1368733 - DNA, 22 bp, Artificial Sequence
  chemically synthesized
caactgcatgtgaatttacagt

SEQ ID NO: 1368734 - DNA, 22 bp, Artificial Sequence
  chemically synthesized
catgtgaatttacagttatcta

SEQ ID NO: 1368735 - DNA, 22 bp, Artificial Sequence
  chemically synthesized
aaaaaaaaagatagatagataa

SEQ ID NO: 1368736 - DNA, 22 bp, Artificial Sequence
  chemically synthesized
aaaaaaaaaagatagatagata

SEQ ID NO: 1368737 - DNA, 22 bp, Artificial Sequence
  chemically synthesized
taaaaaaaaaagatagatagat

SEQ ID NO: 1368738 - DNA, 22 bp, Artificial Sequence
  chemically synthesized
ttaaaaaaaaaagatagataga

SEQ ID NO: 1368739 - DNA, 22 bp, Artificial Sequence
  chemically synthesized
tcttttaaaaaaaaaagataga

SEQ ID NO: 1368740 - DNA, 22 bp, Artificial Sequence
  chemically synthesized
acagttatctatctatcttttt

SEQ ID NO: 1368741 - DNA, 22 bp, Artificial Sequence
  chemically synthesized
cagttatctatctatctttttt

SEQ ID NO: 1368742 - DNA, 22 bp, Artificial Sequence
  chemically synthesized
tctatctatcttttttttttaa

SEQ ID NO: 1368743 - DNA, 22 bp, Artificial Sequence
  chemically synthesized
tctatcttttttttttaaaaga

SEQ ID NO: 1368744 - DNA, 22 bp, Artificial Sequence
  chemically synthesized
aacccagcccactgtcttttaa

SEQ ID NO: 1368745 - DNA, 22 bp, Artificial Sequence
  chemically synthesized
tcttttttttttaaaagacagt

SEQ ID NO: 1368746 - DNA, 22 bp, Artificial Sequence
  chemically synthesized
ttttttttaaaagacagtgggc

SEQ ID NO: 1368747 - DNA, 22 bp, Artificial Sequence
  chemically synthesized
tttttttaaaagacagtgggct

SEQ ID NO: 1368748 - DNA, 22 bp, Artificial Sequence
  chemically synthesized
ttttttaaaagacagtgggctg

SEQ ID NO: 1368749 - DNA, 22 bp, Artificial Sequence
  chemically synthesized
ataggctaaacccagcccactg

SEQ ID NO: 1368750 - DNA, 22 bp, Artificial Sequence
  chemically synthesized
tttttaaaagacagtgggctgg

SEQ ID NO: 1368751 - DNA, 22 bp, Artificial Sequence
  chemically synthesized
ttttaaaagacagtgggctggg

SEQ ID NO: 1368752 - DNA, 22 bp, Artificial Sequence
  chemically synthesized
tttaaaagacagtgggctgggt

SEQ ID NO: 1368753 - DNA, 22 bp, Artificial Sequence
  chemically synthesized
ttaaaagacagtgggctgggtt

SEQ ID NO: 1368754 - DNA, 22 bp, Artificial Sequence
  chemically synthesized
gctcataggctaaacccagccc

SEQ ID NO: 1368755 - DNA, 22 bp, Artificial Sequence
  chemically synthesized
taaaagacagtgggctgggttt

SEQ ID NO: 1368756 - DNA, 22 bp, Artificial Sequence
  chemically synthesized
ggctcataggctaaacccagcc

SEQ ID NO: 1368757 - DNA, 22 bp, Artificial Sequence
  chemically synthesized
aaaagacagtgggctgggttta

SEQ ID NO: 1368758 - DNA, 22 bp, Artificial Sequence
  chemically synthesized
tggctcataggctaaacccagc

SEQ ID NO: 1368759 - DNA, 22 bp, Artificial Sequence
  chemically synthesized
aaagacagtgggctgggtttag

SEQ ID NO: 1368760 - DNA, 22 bp, Artificial Sequence
  chemically synthesized
taaactttggctcataggctaa

SEQ ID NO: 1368761 - DNA, 22 bp, Artificial Sequence
  chemically synthesized
ggtttagcctatgagccaaagt

SEQ ID NO: 1368762 - DNA, 22 bp, Artificial Sequence
  chemically synthesized
agcctatgagccaaagtttaca

SEQ ID NO: 1368763 - DNA, 22 bp, Artificial Sequence
  chemically synthesized
gcctatgagccaaagtttacag

SEQ ID NO: 1368764 - DNA, 22 bp, Artificial Sequence
  chemically synthesized
tgagccaaagtttacagactcc

SEQ ID NO: 1368765 - DNA, 22 bp, Artificial Sequence
  chemically synthesized
acagactcctgccatacgacac

SEQ ID NO: 1368766 - DNA, 22 bp, Artificial Sequence
  chemically synthesized
cagactcctgccatacgacact

SEQ ID NO: 1368767 - DNA, 22 bp, Artificial Sequence
  chemically synthesized
tatgcacgaatgtcagtgtcgt

SEQ ID NO: 1368768 - DNA, 22 bp, Artificial Sequence
  chemically synthesized
gtatgcacgaatgtcagtgtcg

SEQ ID NO: 1368769 - DNA, 22 bp, Artificial Sequence
  chemically synthesized
tttgtatgcacgaatgtcagtg

SEQ ID NO: 1368770 - DNA, 22 bp, Artificial Sequence
  chemically synthesized
ctgccatacgacactgacattc

SEQ ID NO: 1368771 - DNA, 22 bp, Artificial Sequence
  chemically synthesized
atttgtatgcacgaatgtcagt

SEQ ID NO: 1368772 - DNA, 22 bp, Artificial Sequence
  chemically synthesized
ccatacgacactgacattcgtg

SEQ ID NO: 1368773 - DNA, 22 bp, Artificial Sequence
  chemically synthesized
tatttatttgtatgcacgaatg

SEQ ID NO: 1368774 - DNA, 22 bp, Artificial Sequence
  chemically synthesized
atatttatttgtatgcacgaat

SEQ ID NO: 1368775 - DNA, 22 bp, Artificial Sequence
  chemically synthesized
tcttatatttatttgtatgcac

SEQ ID NO: 1368776 - DNA, 22 bp, Artificial Sequence
  chemically synthesized
atcttatatttatttgtatgca

SEQ ID NO: 1368777 - DNA, 22 bp, Artificial Sequence
  chemically synthesized
tatcttatatttatttgtatgc

SEQ ID NO: 1368778 - DNA, 22 bp, Artificial Sequence
  chemically synthesized
acattcgtgcatacaaataaat

SEQ ID NO: 1368779 - DNA, 22 bp, Artificial Sequence
  chemically synthesized
gtgcatacaaataaatataaga

SEQ ID NO: 1368780 - DNA, 22 bp, Artificial Sequence
  chemically synthesized
acaatgtagttttatcttatat

SEQ ID NO: 1368781 - DNA, 22 bp, Artificial Sequence
  chemically synthesized
cacaatgtagttttatcttata

SEQ ID NO: 1368782 - DNA, 22 bp, Artificial Sequence
  chemically synthesized
catcaggcttcacaatgtagtt

SEQ ID NO: 1368783 - DNA, 22 bp, Artificial Sequence
  chemically synthesized
atctccatcaggcttcacaatg

SEQ ID NO: 1368784 - DNA, 22 bp, Artificial Sequence
  chemically synthesized
atgccacctaatctccatcagg

SEQ ID NO: 1368785 - DNA, 22 bp, Artificial Sequence
  chemically synthesized
cattgtgaagcctgatggagat

SEQ ID NO: 1368786 - DNA, 22 bp, Artificial Sequence
  chemically synthesized
tgaagcctgatggagattaggt

SEQ ID NO: 1368787 - DNA, 22 bp, Artificial Sequence
  chemically synthesized
aacatgacattgatgccaccta

SEQ ID NO: 1368788 - DNA, 22 bp, Artificial Sequence
  chemically synthesized
atggagattaggtggcatcaat

SEQ ID NO: 1368789 - DNA, 22 bp, Artificial Sequence
  chemically synthesized
ggtggcatcaatgtcatgttta

SEQ ID NO: 1368790 - DNA, 22 bp, Artificial Sequence
  chemically synthesized
acaaaaaaaagcaagtgcaaca

SEQ ID NO: 1368791 - DNA, 22 bp, Artificial Sequence
  chemically synthesized
aacaaaaaaaagcaagtgcaac

SEQ ID NO: 1368792 - DNA, 22 bp, Artificial Sequence
  chemically synthesized
taacaaaaaaaagcaagtgcaa

SEQ ID NO: 1368793 - DNA, 22 bp, Artificial Sequence
  chemically synthesized
ttaacaaaaaaaagcaagtgca

SEQ ID NO: 1368794 - DNA, 22 bp, Artificial Sequence
  chemically synthesized
aacactgttgcacttgcttttt

SEQ ID NO: 1368795 - DNA, 22 bp, Artificial Sequence
  chemically synthesized
acactgttgcacttgctttttt

SEQ ID NO: 1368796 - DNA, 22 bp, Artificial Sequence
  chemically synthesized
cagtatccttttaacaaaaaaa

SEQ ID NO: 1368797 - DNA, 22 bp, Artificial Sequence
  chemically synthesized
ttgcacttgcttttttttgtta

SEQ ID NO: 1368798 - DNA, 22 bp, Artificial Sequence
  chemically synthesized
cacttgcttttttttgttaaaa

SEQ ID NO: 1368799 - DNA, 22 bp, Artificial Sequence
  chemically synthesized
gttgcagtatccttttaacaaa

SEQ ID NO: 1368800 - DNA, 22 bp, Artificial Sequence
  chemically synthesized
gcttttttttgttaaaaggata

SEQ ID NO: 1368801 - DNA, 22 bp, Artificial Sequence
  chemically synthesized
cttttttttgttaaaaggatac

SEQ ID NO: 1368802 - DNA, 22 bp, Artificial Sequence
  chemically synthesized
ttttttgttaaaaggatactgc

SEQ ID NO: 1368803 - DNA, 22 bp, Artificial Sequence
  chemically synthesized
tataatctagttgcagtatcct

SEQ ID NO: 1368804 - DNA, 22 bp, Artificial Sequence
  chemically synthesized
tttttgttaaaaggatactgca

SEQ ID NO: 1368805 - DNA, 22 bp, Artificial Sequence
  chemically synthesized
ttttgttaaaaggatactgcaa

SEQ ID NO: 1368806 - DNA, 22 bp, Artificial Sequence
  chemically synthesized
tttgttaaaaggatactgcaac

SEQ ID NO: 1368807 - DNA, 22 bp, Artificial Sequence
  chemically synthesized
ttgttaaaaggatactgcaact

SEQ ID NO: 1368808 - DNA, 22 bp, Artificial Sequence
  chemically synthesized
tgttaaaaggatactgcaacta

SEQ ID NO: 1368809 - DNA, 22 bp, Artificial Sequence
  chemically synthesized
cgttatataatctagttgcagt

SEQ ID NO: 1368810 - DNA, 22 bp, Artificial Sequence
  chemically synthesized
gttaaaaggatactgcaactag

SEQ ID NO: 1368811 - DNA, 22 bp, Artificial Sequence
  chemically synthesized
ttaaaaggatactgcaactaga

SEQ ID NO: 1368812 - DNA, 22 bp, Artificial Sequence
  chemically synthesized
aaaggatactgcaactagatta

SEQ ID NO: 1368813 - DNA, 22 bp, Artificial Sequence
  chemically synthesized
agtgtgttacgttatataatct

SEQ ID NO: 1368814 - DNA, 22 bp, Artificial Sequence
  chemically synthesized
aagtgtgttacgttatataatc

SEQ ID NO: 1368815 - DNA, 22 bp, Artificial Sequence
  chemically synthesized
taagtgtgttacgttatataat

SEQ ID NO: 1368816 - DNA, 22 bp, Artificial Sequence
  chemically synthesized
ttaagtgtgttacgttatataa

SEQ ID NO: 1368817 - DNA, 22 bp, Artificial Sequence
  chemically synthesized
ttttaagtgtgttacgttatat

SEQ ID NO: 1368818 - DNA, 22 bp, Artificial Sequence
  chemically synthesized
caactagattatataacgtaac

SEQ ID NO: 1368819 - DNA, 22 bp, Artificial Sequence
  chemically synthesized
gattatataacgtaacacactt

SEQ ID NO: 1368820 - DNA, 22 bp, Artificial Sequence
  chemically synthesized
gataattcttttaagtgtgtta

SEQ ID NO: 1368821 - DNA, 22 bp, Artificial Sequence
  chemically synthesized
tataacgtaacacacttaaaag

SEQ ID NO: 1368822 - DNA, 22 bp, Artificial Sequence
  chemically synthesized
aattagataattcttttaagtg

SEQ ID NO: 1368823 - DNA, 22 bp, Artificial Sequence
  chemically synthesized
ctgaattagataattcttttaa

SEQ ID NO: 1368824 - DNA, 22 bp, Artificial Sequence
  chemically synthesized
cctgaattagataattctttta

SEQ ID NO: 1368825 - DNA, 22 bp, Artificial Sequence
  chemically synthesized
tcctgaattagataattctttt

SEQ ID NO: 1368826 - DNA, 22 bp, Artificial Sequence
  chemically synthesized
aaattttcctgaattagataat

SEQ ID NO: 1368827 - DNA, 22 bp, Artificial Sequence
  chemically synthesized
aaaattttcctgaattagataa

SEQ ID NO: 1368828 - DNA, 22 bp, Artificial Sequence
  chemically synthesized
aaaagaattatctaattcagga

SEQ ID NO: 1368829 - DNA, 22 bp, Artificial Sequence
  chemically synthesized
aaagaattatctaattcaggaa

SEQ ID NO: 1368830 - DNA, 22 bp, Artificial Sequence
  chemically synthesized
catatttaaaattttcctgaat

SEQ ID NO: 1368831 - DNA, 22 bp, Artificial Sequence
  chemically synthesized
gcatatttaaaattttcctgaa

SEQ ID NO: 1368832 - DNA, 22 bp, Artificial Sequence
  chemically synthesized
atttgcatatttaaaattttcc

SEQ ID NO: 1368833 - DNA, 22 bp, Artificial Sequence
  chemically synthesized
tgatttgcatatttaaaatttt

SEQ ID NO: 1368834 - DNA, 22 bp, Artificial Sequence
  chemically synthesized
tctaattcaggaaaattttaaa

SEQ ID NO: 1368835 - DNA, 22 bp, Artificial Sequence
  chemically synthesized
attcaggaaaattttaaatatg

SEQ ID NO: 1368836 - DNA, 22 bp, Artificial Sequence
  chemically synthesized
aggaaaattttaaatatgcaaa

SEQ ID NO: 1368837 - DNA, 22 bp, Artificial Sequence
  chemically synthesized
aacgatacccagaattctgatt

SEQ ID NO: 1368838 - DNA, 22 bp, Artificial Sequence
  chemically synthesized
aaacgatacccagaattctgat

SEQ ID NO: 1368839 - DNA, 22 bp, Artificial Sequence
  chemically synthesized
taaatatgcaaatcagaattct

SEQ ID NO: 1368840 - DNA, 22 bp, Artificial Sequence
  chemically synthesized
aaatatgcaaatcagaattctg

SEQ ID NO: 1368841 - DNA, 22 bp, Artificial Sequence
  chemically synthesized
aatatgcaaatcagaattctgg

SEQ ID NO: 1368842 - DNA, 22 bp, Artificial Sequence
  chemically synthesized
tttaaacgatacccagaattct

SEQ ID NO: 1368843 - DNA, 22 bp, Artificial Sequence
  chemically synthesized
atttaaacgatacccagaattc

SEQ ID NO: 1368844 - DNA, 22 bp, Artificial Sequence
  chemically synthesized
tatttaaacgatacccagaatt

SEQ ID NO: 1368845 - DNA, 22 bp, Artificial Sequence
  chemically synthesized
aatattttatttaaacgatacc

SEQ ID NO: 1368846 - DNA, 22 bp, Artificial Sequence
  chemically synthesized
taaatattttatttaaacgata

SEQ ID NO: 1368847 - DNA, 22 bp, Artificial Sequence
  chemically synthesized
tgggtatcgtttaaataaaata

SEQ ID NO: 1368848 - DNA, 22 bp, Artificial Sequence
  chemically synthesized
caagactctaaatattttattt

SEQ ID NO: 1368849 - DNA, 22 bp, Artificial Sequence
  chemically synthesized
acaagactctaaatattttatt

SEQ ID NO: 1368850 - DNA, 22 bp, Artificial Sequence
  chemically synthesized
ggtatcgtttaaataaaatatt

SEQ ID NO: 1368851 - DNA, 22 bp, Artificial Sequence
  chemically synthesized
tacaagactctaaatattttat

SEQ ID NO: 1368852 - DNA, 22 bp, Artificial Sequence
  chemically synthesized
ttacaagactctaaatatttta

SEQ ID NO: 1368853 - DNA, 22 bp, Artificial Sequence
  chemically synthesized
tttttacaagactctaaatatt

SEQ ID NO: 1368854 - DNA, 22 bp, Artificial Sequence
  chemically synthesized
aaataaaatatttagagtcttg

SEQ ID NO: 1368855 - DNA, 22 bp, Artificial Sequence
  chemically synthesized
aataaaatatttagagtcttgt

SEQ ID NO: 1368856 - DNA, 22 bp, Artificial Sequence
  chemically synthesized
agagcctgtttttacaagactc

SEQ ID NO: 1368857 - DNA, 22 bp, Artificial Sequence
  chemically synthesized
agagtcttgtaaaaacaggctc

SEQ ID NO: 1368858 - DNA, 22 bp, Artificial Sequence
  chemically synthesized
gagtcttgtaaaaacaggctct

SEQ ID NO: 1368859 - DNA, 22 bp, Artificial Sequence
  chemically synthesized
gtaaaaacaggctctcagtgcc

SEQ ID NO: 1368860 - DNA, 22 bp, Artificial Sequence
  chemically synthesized
taaaaacaggctctcagtgcca

SEQ ID NO: 1368861 - DNA, 22 bp, Artificial Sequence
  chemically synthesized
acaataacacaatggcactgag

SEQ ID NO: 1368862 - DNA, 22 bp, Artificial Sequence
  chemically synthesized
agtattaacaataacacaatgg

SEQ ID NO: 1368863 - DNA, 22 bp, Artificial Sequence
  chemically synthesized
gagtattaacaataacacaatg

SEQ ID NO: 1368864 - DNA, 22 bp, Artificial Sequence
  chemically synthesized
tgagtattaacaataacacaat

SEQ ID NO: 1368865 - DNA, 22 bp, Artificial Sequence
  chemically synthesized
tcagtgccattgtgttattgtt

SEQ ID NO: 1368866 - DNA, 22 bp, Artificial Sequence
  chemically synthesized
agtgccattgtgttattgttaa

SEQ ID NO: 1368867 - DNA, 22 bp, Artificial Sequence
  chemically synthesized
tgaaacagttttgagtattaac

SEQ ID NO: 1368868 - DNA, 22 bp, Artificial Sequence
  chemically synthesized
atgaaacagttttgagtattaa

SEQ ID NO: 1368869 - DNA, 22 bp, Artificial Sequence
  chemically synthesized
tgttattgttaatactcaaaac

SEQ ID NO: 1368870 - DNA, 22 bp, Artificial Sequence
  chemically synthesized
ttgttaatactcaaaactgttt

SEQ ID NO: 1368871 - DNA, 22 bp, Artificial Sequence
  chemically synthesized
ttaatactcaaaactgtttcat

SEQ ID NO: 1368872 - DNA, 22 bp, Artificial Sequence
  chemically synthesized
aataaataaacttatgaaacag

SEQ ID NO: 1368873 - DNA, 22 bp, Artificial Sequence
  chemically synthesized
caataaataaacttatgaaaca

SEQ ID NO: 1368874 - DNA, 22 bp, Artificial Sequence
  chemically synthesized
atactcaaaactgtttcataag

SEQ ID NO: 1368875 - DNA, 22 bp, Artificial Sequence
  chemically synthesized
tcaataaataaacttatgaaac

SEQ ID NO: 1368876 - DNA, 22 bp, Artificial Sequence
  chemically synthesized
ggctttcaataaataaacttat

SEQ ID NO: 1368877 - DNA, 22 bp, Artificial Sequence
  chemically synthesized
aaaactgtttcataagtttatt

SEQ ID NO: 1368878 - DNA, 22 bp, Artificial Sequence
  chemically synthesized
gtctaggctttcaataaataaa

SEQ ID NO: 1368879 - DNA, 22 bp, Artificial Sequence
  chemically synthesized
ggtctaggctttcaataaataa

SEQ ID NO: 1368880 - DNA, 22 bp, Artificial Sequence
  chemically synthesized
tttcataagtttatttattgaa

SEQ ID NO: 1368881 - DNA, 22 bp, Artificial Sequence
  chemically synthesized
cataagtttatttattgaaagc

SEQ ID NO: 1368882 - DNA, 22 bp, Artificial Sequence
  chemically synthesized
ataagtttatttattgaaagcc

SEQ ID NO: 1368883 - DNA, 22 bp, Artificial Sequence
  chemically synthesized
atttattgaaagcctagaccaa

SEQ ID NO: 1368884 - DNA, 22 bp, Artificial Sequence
  chemically synthesized
tgtagtaataacttggtctagg

SEQ ID NO: 1368885 - DNA, 22 bp, Artificial Sequence
  chemically synthesized
tttattgaaagcctagaccaag

SEQ ID NO: 1368886 - DNA, 22 bp, Artificial Sequence
  chemically synthesized
gtgtagtaataacttggtctag

SEQ ID NO: 1368887 - DNA, 22 bp, Artificial Sequence
  chemically synthesized
ttgtgtagtaataacttggtct

SEQ ID NO: 1368888 - DNA, 22 bp, Artificial Sequence
  chemically synthesized
attgaaagcctagaccaagtta

SEQ ID NO: 1368889 - DNA, 22 bp, Artificial Sequence
  chemically synthesized
cttgtgtagtaataacttggtc

SEQ ID NO: 1368890 - DNA, 22 bp, Artificial Sequence
  chemically synthesized
ttgaaagcctagaccaagttat

SEQ ID NO: 1368891 - DNA, 22 bp, Artificial Sequence
  chemically synthesized
tcttgtgtagtaataacttggt

SEQ ID NO: 1368892 - DNA, 22 bp, Artificial Sequence
  chemically synthesized
tttcttgtgtagtaataacttg

SEQ ID NO: 1368893 - DNA, 22 bp, Artificial Sequence
  chemically synthesized
aaagcctagaccaagttattac

SEQ ID NO: 1368894 - DNA, 22 bp, Artificial Sequence
  chemically synthesized
ctctttcttgtgtagtaataac

SEQ ID NO: 1368895 - DNA, 22 bp, Artificial Sequence
  chemically synthesized
actctttcttgtgtagtaataa

SEQ ID NO: 1368896 - DNA, 22 bp, Artificial Sequence
  chemically synthesized
tactctttcttgtgtagtaata

SEQ ID NO: 1368897 - DNA, 22 bp, Artificial Sequence
  chemically synthesized
tttactctttcttgtgtagtaa

SEQ ID NO: 1368898 - DNA, 22 bp, Artificial Sequence
  chemically synthesized
ctttactctttcttgtgtagta

SEQ ID NO: 1368899 - DNA, 22 bp, Artificial Sequence
  chemically synthesized
gaccaagttattactacacaag

SEQ ID NO: 1368900 - DNA, 22 bp, Artificial Sequence
  chemically synthesized
tctttactctttcttgtgtagt

SEQ ID NO: 1368901 - DNA, 22 bp, Artificial Sequence
  chemically synthesized
ttttctttactctttcttgtgt

SEQ ID NO: 1368902 - DNA, 22 bp, Artificial Sequence
  chemically synthesized
tattgttttctttactctttct

SEQ ID NO: 1368903 - DNA, 22 bp, Artificial Sequence
  chemically synthesized
atattgttttctttactctttc

SEQ ID NO: 1368904 - DNA, 22 bp, Artificial Sequence
  chemically synthesized
ttactacacaagaaagagtaaa

SEQ ID NO: 1368905 - DNA, 22 bp, Artificial Sequence
  chemically synthesized
ctacacaagaaagagtaaagaa

SEQ ID NO: 1368906 - DNA, 22 bp, Artificial Sequence
  chemically synthesized
cacaagaaagagtaaagaaaac

SEQ ID NO: 1368907 - DNA, 22 bp, Artificial Sequence
  chemically synthesized
aaatgtcatccacatagattta

SEQ ID NO: 1368908 - DNA, 22 bp, Artificial Sequence
  chemically synthesized
taaaatgtcatccacatagatt

SEQ ID NO: 1368909 - DNA, 22 bp, Artificial Sequence
  chemically synthesized
cactctaaaatgtcatccacat

SEQ ID NO: 1368910 - DNA, 22 bp, Artificial Sequence
  chemically synthesized
aagttgcactctaaaatgtcat

SEQ ID NO: 1368911 - DNA, 22 bp, Artificial Sequence
  chemically synthesized
ctgaagttgcactctaaaatgt

SEQ ID NO: 1368912 - DNA, 22 bp, Artificial Sequence
  chemically synthesized
gctgaagttgcactctaaaatg

SEQ ID NO: 1368913 - DNA, 22 bp, Artificial Sequence
  chemically synthesized
tgtggatgacattttagagtgc

SEQ ID NO: 1368914 - DNA, 22 bp, Artificial Sequence
  chemically synthesized
caagtttgctgaagttgcactc

SEQ ID NO: 1368915 - DNA, 22 bp, Artificial Sequence
  chemically synthesized
agcctacaagtttgctgaagtt

SEQ ID NO: 1368916 - DNA, 22 bp, Artificial Sequence
  chemically synthesized
gagcctacaagtttgctgaagt

SEQ ID NO: 1368917 - DNA, 22 bp, Artificial Sequence
  chemically synthesized
tagagtgcaacttcagcaaact

SEQ ID NO: 1368918 - DNA, 22 bp, Artificial Sequence
  chemically synthesized
agagtgcaacttcagcaaactt

SEQ ID NO: 1368919 - DNA, 22 bp, Artificial Sequence
  chemically synthesized
atttgagcctacaagtttgctg

SEQ ID NO: 1368920 - DNA, 22 bp, Artificial Sequence
  chemically synthesized
gagtgcaacttcagcaaacttg

SEQ ID NO: 1368921 - DNA, 22 bp, Artificial Sequence
  chemically synthesized
aatttgagcctacaagtttgct

SEQ ID NO: 1368922 - DNA, 22 bp, Artificial Sequence
  chemically synthesized
taatttgagcctacaagtttgc

SEQ ID NO: 1368923 - DNA, 22 bp, Artificial Sequence
  chemically synthesized
cagcaaacttgtaggctcaaat

SEQ ID NO: 1368924 - DNA, 22 bp, Artificial Sequence
  chemically synthesized
agcaaacttgtaggctcaaatt

SEQ ID NO: 1368925 - DNA, 22 bp, Artificial Sequence
  chemically synthesized
ggaaaggattttaatttgagcc

SEQ ID NO: 1368926 - DNA, 22 bp, Artificial Sequence
  chemically synthesized
gtaggctcaaattaaaatcctt

SEQ ID NO: 1368927 - DNA, 22 bp, Artificial Sequence
  chemically synthesized
taggctcaaattaaaatccttt

SEQ ID NO: 1368928 - DNA, 22 bp, Artificial Sequence
  chemically synthesized
aagaaagaaattaggaaaggat

SEQ ID NO: 1368929 - DNA, 22 bp, Artificial Sequence
  chemically synthesized
aaagaaagaaattaggaaagga

SEQ ID NO: 1368930 - DNA, 22 bp, Artificial Sequence
  chemically synthesized
taaagaaagaaattaggaaagg

SEQ ID NO: 1368931 - DNA, 22 bp, Artificial Sequence
  chemically synthesized
ttaaagaaagaaattaggaaag

SEQ ID NO: 1368932 - DNA, 22 bp, Artificial Sequence
  chemically synthesized
aaattaaaatcctttcctaatt

SEQ ID NO: 1368933 - DNA, 22 bp, Artificial Sequence
  chemically synthesized
tttaaagaaagaaattaggaaa

SEQ ID NO: 1368934 - DNA, 22 bp, Artificial Sequence
  chemically synthesized
ttttaaagaaagaaattaggaa

SEQ ID NO: 1368935 - DNA, 22 bp, Artificial Sequence
  chemically synthesized
cttttttaaagaaagaaattag

SEQ ID NO: 1368936 - DNA, 22 bp, Artificial Sequence
  chemically synthesized
gcttttttaaagaaagaaatta

SEQ ID NO: 1368937 - DNA, 22 bp, Artificial Sequence
  chemically synthesized
aaatcctttcctaatttctttc

SEQ ID NO: 1368938 - DNA, 22 bp, Artificial Sequence
  chemically synthesized
tgcttttttaaagaaagaaatt

SEQ ID NO: 1368939 - DNA, 22 bp, Artificial Sequence
  chemically synthesized
ttgcttttttaaagaaagaaat

SEQ ID NO: 1368940 - DNA, 22 bp, Artificial Sequence
  chemically synthesized
ttttgcttttttaaagaaagaa

SEQ ID NO: 1368941 - DNA, 22 bp, Artificial Sequence
  chemically synthesized
cttttgcttttttaaagaaaga

SEQ ID NO: 1368942 - DNA, 22 bp, Artificial Sequence
  chemically synthesized
tcttttgcttttttaaagaaag

SEQ ID NO: 1368943 - DNA, 22 bp, Artificial Sequence
  chemically synthesized
ttcttttgcttttttaaagaaa

SEQ ID NO: 1368944 - DNA, 22 bp, Artificial Sequence
  chemically synthesized
tttcttttgcttttttaaagaa

SEQ ID NO: 1368945 - DNA, 22 bp, Artificial Sequence
  chemically synthesized
tcctaatttctttctttaaaaa

SEQ ID NO: 1368946 - DNA, 22 bp, Artificial Sequence
  chemically synthesized
ttttcttttgcttttttaaaga

SEQ ID NO: 1368947 - DNA, 22 bp, Artificial Sequence
  chemically synthesized
cctaatttctttctttaaaaaa

SEQ ID NO: 1368948 - DNA, 22 bp, Artificial Sequence
  chemically synthesized
ctaatttctttctttaaaaaag

SEQ ID NO: 1368949 - DNA, 22 bp, Artificial Sequence
  chemically synthesized
atttctttctttaaaaaagcaa

SEQ ID NO: 1368950 - DNA, 22 bp, Artificial Sequence
  chemically synthesized
ctttctttaaaaaagcaaaaga

SEQ ID NO: 1368951 - DNA, 22 bp, Artificial Sequence
  chemically synthesized
tttctttaaaaaagcaaaagaa

SEQ ID NO: 1368952 - DNA, 22 bp, Artificial Sequence
  chemically synthesized
tctttaaaaaagcaaaagaaaa

SEQ ID NO: 1368953 - DNA, 22 bp, Artificial Sequence
  chemically synthesized
ctttaaaaaagcaaaagaaaaa

SEQ ID NO: 1368954 - DNA, 22 bp, Artificial Sequence
  chemically synthesized
tttaaaaaagcaaaagaaaaaa

SEQ ID NO: 1368955 - DNA, 22 bp, Artificial Sequence
  chemically synthesized
acagggaggggatttttttctt

SEQ ID NO: 1368956 - DNA, 22 bp, Artificial Sequence
  chemically synthesized
taaaaaagcaaaagaaaaaaat

SEQ ID NO: 1368957 - DNA, 22 bp, Artificial Sequence
  chemically synthesized
aaaaaagcaaaagaaaaaaatc

SEQ ID NO: 1368958 - DNA, 22 bp, Artificial Sequence
  chemically synthesized
taacagggaggggatttttttc

SEQ ID NO: 1368959 - DNA, 22 bp, Artificial Sequence
  chemically synthesized
aaaaagcaaaagaaaaaaatcc

SEQ ID NO: 1368960 - DNA, 22 bp, Artificial Sequence
  chemically synthesized
agaacagagtaaaaaaataatt

SEQ ID NO: 1368961 - DNA, 22 bp, Artificial Sequence
  chemically synthesized
aagaacagagtaaaaaaataat

SEQ ID NO: 1368962 - DNA, 22 bp, Artificial Sequence
  chemically synthesized
taagaacagagtaaaaaaataa

SEQ ID NO: 1368963 - DNA, 22 bp, Artificial Sequence
  chemically synthesized
cctgttagaattatttttttac

SEQ ID NO: 1368964 - DNA, 22 bp, Artificial Sequence
  chemically synthesized
ttagaattatttttttactctg

SEQ ID NO: 1368965 - DNA, 22 bp, Artificial Sequence
  chemically synthesized
gaattatttttttactctgttc

SEQ ID NO: 1368966 - DNA, 22 bp, Artificial Sequence
  chemically synthesized
tttttttactctgttcttaaaa

SEQ ID NO: 1368967 - DNA, 22 bp, Artificial Sequence
  chemically synthesized
ttttactctgttcttaaaacca

SEQ ID NO: 1368968 - DNA, 22 bp, Artificial Sequence
  chemically synthesized
tttactctgttcttaaaaccac

SEQ ID NO: 1368969 - DNA, 22 bp, Artificial Sequence
  chemically synthesized
ttactctgttcttaaaaccacc

SEQ ID NO: 1368970 - DNA, 22 bp, Artificial Sequence
  chemically synthesized
tactctgttcttaaaaccacca

SEQ ID NO: 1368971 - DNA, 22 bp, Artificial Sequence
  chemically synthesized
actctgttcttaaaaccaccat

SEQ ID NO: 1368972 - DNA, 22 bp, Artificial Sequence
  chemically synthesized
ccatggaaaaaaatggtggttt

SEQ ID NO: 1368973 - DNA, 22 bp, Artificial Sequence
  chemically synthesized
ctctgttcttaaaaccaccatt

SEQ ID NO: 1368974 - DNA, 22 bp, Artificial Sequence
  chemically synthesized
gccatggaaaaaaatggtggtt

SEQ ID NO: 1368975 - DNA, 22 bp, Artificial Sequence
  chemically synthesized
tgttcttaaaaccaccattttt

SEQ ID NO: 1368976 - DNA, 22 bp, Artificial Sequence
  chemically synthesized
ttcttaaaaccaccattttttt

SEQ ID NO: 1368977 - DNA, 22 bp, Artificial Sequence
  chemically synthesized
gccttgccatggaaaaaaatgg

SEQ ID NO: 1368978 - DNA, 22 bp, Artificial Sequence
  chemically synthesized
agccttgccatggaaaaaaatg

SEQ ID NO: 1368979 - DNA, 22 bp, Artificial Sequence
  chemically synthesized
ttaaaaccaccatttttttcca

SEQ ID NO: 1368980 - DNA, 22 bp, Artificial Sequence
  chemically synthesized
aaaaccaccatttttttccatg

SEQ ID NO: 1368981 - DNA, 22 bp, Artificial Sequence
  chemically synthesized
aaaccaccatttttttccatgg

SEQ ID NO: 1368982 - DNA, 22 bp, Artificial Sequence
  chemically synthesized
tcaggatgaaaacttagccttg

SEQ ID NO: 1368983 - DNA, 22 bp, Artificial Sequence
  chemically synthesized
atcaggatgaaaacttagcctt

SEQ ID NO: 1368984 - DNA, 22 bp, Artificial Sequence
  chemically synthesized
ttttccatggcaaggctaagtt

SEQ ID NO: 1368985 - DNA, 22 bp, Artificial Sequence
  chemically synthesized
tttccatggcaaggctaagttt

SEQ ID NO: 1368986 - DNA, 22 bp, Artificial Sequence
  chemically synthesized
ttccatggcaaggctaagtttt

SEQ ID NO: 1368987 - DNA, 22 bp, Artificial Sequence
  chemically synthesized
tccatggcaaggctaagttttc

SEQ ID NO: 1368988 - DNA, 22 bp, Artificial Sequence
  chemically synthesized
ccatggcaaggctaagttttca

SEQ ID NO: 1368989 - DNA, 22 bp, Artificial Sequence
  chemically synthesized
catggcaaggctaagttttcat

SEQ ID NO: 1368990 - DNA, 22 bp, Artificial Sequence
  chemically synthesized
agaaaaaccttatcaggatgaa

SEQ ID NO: 1368991 - DNA, 22 bp, Artificial Sequence
  chemically synthesized
cagaaaaaccttatcaggatga

SEQ ID NO: 1368992 - DNA, 22 bp, Artificial Sequence
  chemically synthesized
aaccttcagaaaaaccttatca

SEQ ID NO: 1368993 - DNA, 22 bp, Artificial Sequence
  chemically synthesized
agttttcatcctgataaggttt

SEQ ID NO: 1368994 - DNA, 22 bp, Artificial Sequence
  chemically synthesized
tcatcctgataaggtttttctg

SEQ ID NO: 1368995 - DNA, 22 bp, Artificial Sequence
  chemically synthesized
catcctgataaggtttttctga

SEQ ID NO: 1368996 - DNA, 22 bp, Artificial Sequence
  chemically synthesized
atcctgataaggtttttctgaa

SEQ ID NO: 1368997 - DNA, 22 bp, Artificial Sequence
  chemically synthesized
ggatgacacattaaaccttcag

SEQ ID NO: 1368998 - DNA, 22 bp, Artificial Sequence
  chemically synthesized
ataaggtttttctgaaggttta

SEQ ID NO: 1368999 - DNA, 22 bp, Artificial Sequence
  chemically synthesized
aggatgacacattaaaccttca

SEQ ID NO: 1369000 - DNA, 22 bp, Artificial Sequence
  chemically synthesized
ttaggatgacacattaaacctt

SEQ ID NO: 1369001 - DNA, 22 bp, Artificial Sequence
  chemically synthesized
cttaggatgacacattaaacct

SEQ ID NO: 1369002 - DNA, 22 bp, Artificial Sequence
  chemically synthesized
tttcttaggatgacacattaaa

SEQ ID NO: 1369003 - DNA, 22 bp, Artificial Sequence
  chemically synthesized
ttctgaaggtttaatgtgtcat

SEQ ID NO: 1369004 - DNA, 22 bp, Artificial Sequence
  chemically synthesized
tctgaaggtttaatgtgtcatc

SEQ ID NO: 1369005 - DNA, 22 bp, Artificial Sequence
  chemically synthesized
ctgaaggtttaatgtgtcatcc

SEQ ID NO: 1369006 - DNA, 22 bp, Artificial Sequence
  chemically synthesized
tgaaggtttaatgtgtcatcct

SEQ ID NO: 1369007 - DNA, 22 bp, Artificial Sequence
  chemically synthesized
ccaattgtttcttaggatgaca

SEQ ID NO: 1369008 - DNA, 22 bp, Artificial Sequence
  chemically synthesized
aaggtttaatgtgtcatcctaa

SEQ ID NO: 1369009 - DNA, 22 bp, Artificial Sequence
  chemically synthesized
accaattgtttcttaggatgac

SEQ ID NO: 1369010 - DNA, 22 bp, Artificial Sequence
  chemically synthesized
ttaccaattgtttcttaggatg

SEQ ID NO: 1369011 - DNA, 22 bp, Artificial Sequence
  chemically synthesized
aatgtgtcatcctaagaaacaa

SEQ ID NO: 1369012 - DNA, 22 bp, Artificial Sequence
  chemically synthesized
atgtgtcatcctaagaaacaat

SEQ ID NO: 1369013 - DNA, 22 bp, Artificial Sequence
  chemically synthesized
tcaattcttaccaattgtttct

SEQ ID NO: 1369014 - DNA, 22 bp, Artificial Sequence
  chemically synthesized
atcaattcttaccaattgtttc

SEQ ID NO: 1369015 - DNA, 22 bp, Artificial Sequence
  chemically synthesized
ttatcaattcttaccaattgtt

SEQ ID NO: 1369016 - DNA, 22 bp, Artificial Sequence
  chemically synthesized
ttcttatcaattcttaccaatt

SEQ ID NO: 1369017 - DNA, 22 bp, Artificial Sequence
  chemically synthesized
tgttcttatcaattcttaccaa

SEQ ID NO: 1369018 - DNA, 22 bp, Artificial Sequence
  chemically synthesized
ctgttcttatcaattcttacca

SEQ ID NO: 1369019 - DNA, 22 bp, Artificial Sequence
  chemically synthesized
agaaacaattggtaagaattga

SEQ ID NO: 1369020 - DNA, 22 bp, Artificial Sequence
  chemically synthesized
gatcttctgttcttatcaattc

SEQ ID NO: 1369021 - DNA, 22 bp, Artificial Sequence
  chemically synthesized
gtaagaattgataagaacagaa

SEQ ID NO: 1369022 - DNA, 22 bp, Artificial Sequence
  chemically synthesized
ggcaccgcaatcgttggatctt

SEQ ID NO: 1369023 - DNA, 22 bp, Artificial Sequence
  chemically synthesized
aggcaccgcaatcgttggatct

SEQ ID NO: 1369024 - DNA, 22 bp, Artificial Sequence
  chemically synthesized
ataagaacagaagatccaacga

SEQ ID NO: 1369025 - DNA, 22 bp, Artificial Sequence
  chemically synthesized
taggcaccgcaatcgttggatc

SEQ ID NO: 1369026 - DNA, 22 bp, Artificial Sequence
  chemically synthesized
gagctttaggcaccgcaatcgt

SEQ ID NO: 1369027 - DNA, 22 bp, Artificial Sequence
  chemically synthesized
agaatagcctcgagctttaggc

SEQ ID NO: 1369028 - DNA, 22 bp, Artificial Sequence
  chemically synthesized
cggtgcctaaagctcgaggcta

SEQ ID NO: 1369029 - DNA, 22 bp, Artificial Sequence
  chemically synthesized
aagctcgaggctattcttagtt

SEQ ID NO: 1369030 - DNA, 22 bp, Artificial Sequence
  chemically synthesized
gaaaaatatgcacaactaagaa

SEQ ID NO: 1369031 - DNA, 22 bp, Artificial Sequence
  chemically synthesized
gaggctattcttagttgtgcat

SEQ ID NO: 1369032 - DNA, 22 bp, Artificial Sequence
  chemically synthesized
ttcttagttgtgcatatttttc

SEQ ID NO: 1369033 - DNA, 22 bp, Artificial Sequence
  chemically synthesized
ttagttgtgcatatttttcgag

SEQ ID NO: 1369034 - DNA, 22 bp, Artificial Sequence
  chemically synthesized
atataatcacgtgctcgaaaaa

SEQ ID NO: 1369035 - DNA, 22 bp, Artificial Sequence
  chemically synthesized
agttgtgcatatttttcgagca

SEQ ID NO: 1369036 - DNA, 22 bp, Artificial Sequence
  chemically synthesized
catataatcacgtgctcgaaaa

SEQ ID NO: 1369037 - DNA, 22 bp, Artificial Sequence
  chemically synthesized
gttgtgcatatttttcgagcac

SEQ ID NO: 1369038 - DNA, 22 bp, Artificial Sequence
  chemically synthesized
tcatataatcacgtgctcgaaa

SEQ ID NO: 1369039 - DNA, 22 bp, Artificial Sequence
  chemically synthesized
tgcatatttttcgagcacgtga

SEQ ID NO: 1369040 - DNA, 22 bp, Artificial Sequence
  chemically synthesized
ttcgagcacgtgattatatgaa

SEQ ID NO: 1369041 - DNA, 22 bp, Artificial Sequence
  chemically synthesized
tcgagcacgtgattatatgaaa

SEQ ID NO: 1369042 - DNA, 22 bp, Artificial Sequence
  chemically synthesized
cgagcacgtgattatatgaaag

SEQ ID NO: 1369043 - DNA, 22 bp, Artificial Sequence
  chemically synthesized
gagcacgtgattatatgaaagt

SEQ ID NO: 1369044 - DNA, 22 bp, Artificial Sequence
  chemically synthesized
aaaaatatgtgcagaactttca

SEQ ID NO: 1369045 - DNA, 22 bp, Artificial Sequence
  chemically synthesized
caaaaatatgtgcagaactttc

SEQ ID NO: 1369046 - DNA, 22 bp, Artificial Sequence
  chemically synthesized
tatgaaagttctgcacatattt

SEQ ID NO: 1369047 - DNA, 22 bp, Artificial Sequence
  chemically synthesized
atagaagtcttcaaaaatatgt

SEQ ID NO: 1369048 - DNA, 22 bp, Artificial Sequence
  chemically synthesized
catagaagtcttcaaaaatatg

SEQ ID NO: 1369049 - DNA, 22 bp, Artificial Sequence
  chemically synthesized
tttcatagaagtcttcaaaaat

SEQ ID NO: 1369050 - DNA, 22 bp, Artificial Sequence
  chemically synthesized
atttcatagaagtcttcaaaaa

SEQ ID NO: 1369051 - DNA, 22 bp, Artificial Sequence
  chemically synthesized
tatttcatagaagtcttcaaaa

SEQ ID NO: 1369052 - DNA, 22 bp, Artificial Sequence
  chemically synthesized
tgcacatatttttgaagacttc

SEQ ID NO: 1369053 - DNA, 22 bp, Artificial Sequence
  chemically synthesized
cacatatttttgaagacttcta

SEQ ID NO: 1369054 - DNA, 22 bp, Artificial Sequence
  chemically synthesized
ggcccctttatttcatagaagt

SEQ ID NO: 1369055 - DNA, 22 bp, Artificial Sequence
  chemically synthesized
gggcccctttatttcatagaag

SEQ ID NO: 1369056 - DNA, 22 bp, Artificial Sequence
  chemically synthesized
tgggcccctttatttcatagaa

SEQ ID NO: 1369057 - DNA, 22 bp, Artificial Sequence
  chemically synthesized
ttgggcccctttatttcataga

SEQ ID NO: 1369058 - DNA, 22 bp, Artificial Sequence
  chemically synthesized
ttgaagacttctatgaaataaa

SEQ ID NO: 1369059 - DNA, 22 bp, Artificial Sequence
  chemically synthesized
tgaagacttctatgaaataaag

SEQ ID NO: 1369060 - DNA, 22 bp, Artificial Sequence
  chemically synthesized
gaagacttctatgaaataaagg

SEQ ID NO: 1369061 - DNA, 22 bp, Artificial Sequence
  chemically synthesized
agcttttgggcccctttatttc

SEQ ID NO: 1369062 - DNA, 22 bp, Artificial Sequence
  chemically synthesized
aagacttctatgaaataaaggg

SEQ ID NO: 1369063 - DNA, 22 bp, Artificial Sequence
  chemically synthesized
aagcttttgggcccctttattt

SEQ ID NO: 1369064 - DNA, 22 bp, Artificial Sequence
  chemically synthesized
ctatgaaataaaggggcccaaa

SEQ ID NO: 1369065 - DNA, 22 bp, Artificial Sequence
  chemically synthesized
tatgaaataaaggggcccaaaa

SEQ ID NO: 1369066 - DNA, 22 bp, Artificial Sequence
  chemically synthesized
tgaaataaaggggcccaaaagc

SEQ ID NO: 1369067 - DNA, 22 bp, Artificial Sequence
  chemically synthesized
tcaggaagcaaatgaagcttaa

SEQ ID NO: 1369068 - DNA, 22 bp, Artificial Sequence
  chemically synthesized
agttgtcaggaagcaaatgaag

SEQ ID NO: 1369069 - DNA, 22 bp, Artificial Sequence
  chemically synthesized
gagttgtcaggaagcaaatgaa

SEQ ID NO: 1369070 - DNA, 22 bp, Artificial Sequence
  chemically synthesized
aagcttcatttgcttcctgaca

SEQ ID NO: 1369071 - DNA, 22 bp, Artificial Sequence
  chemically synthesized
agcttcatttgcttcctgacaa

SEQ ID NO: 1369072 - DNA, 22 bp, Artificial Sequence
  chemically synthesized
cagatgatttgagttgtcagga

SEQ ID NO: 1369073 - DNA, 22 bp, Artificial Sequence
  chemically synthesized
ccagatgatttgagttgtcagg

SEQ ID NO: 1369074 - DNA, 22 bp, Artificial Sequence
  chemically synthesized
tccagatgatttgagttgtcag

SEQ ID NO: 1369075 - DNA, 22 bp, Artificial Sequence
  chemically synthesized
catttgcttcctgacaactcaa

SEQ ID NO: 1369076 - DNA, 22 bp, Artificial Sequence
  chemically synthesized
atttgcttcctgacaactcaaa

SEQ ID NO: 1369077 - DNA, 22 bp, Artificial Sequence
  chemically synthesized
ctttccagatgatttgagttgt

SEQ ID NO: 1369078 - DNA, 22 bp, Artificial Sequence
  chemically synthesized
tcctttccagatgatttgagtt

SEQ ID NO: 1369079 - DNA, 22 bp, Artificial Sequence
  chemically synthesized
gcttcctgacaactcaaatcat

SEQ ID NO: 1369080 - DNA, 22 bp, Artificial Sequence
  chemically synthesized
tctcctttccagatgatttgag

SEQ ID NO: 1369081 - DNA, 22 bp, Artificial Sequence
  chemically synthesized
cttcctgacaactcaaatcatc

SEQ ID NO: 1369082 - DNA, 22 bp, Artificial Sequence
  chemically synthesized
ctctcctttccagatgatttga

SEQ ID NO: 1369083 - DNA, 22 bp, Artificial Sequence
  chemically synthesized
cctgacaactcaaatcatctgg

SEQ ID NO: 1369084 - DNA, 22 bp, Artificial Sequence
  chemically synthesized
ctgacaactcaaatcatctgga

SEQ ID NO: 1369085 - DNA, 22 bp, Artificial Sequence
  chemically synthesized
acaactcaaatcatctggaaag

SEQ ID NO: 1369086 - DNA, 22 bp, Artificial Sequence
  chemically synthesized
aaagcttctctcctttccagat

SEQ ID NO: 1369087 - DNA, 22 bp, Artificial Sequence
  chemically synthesized
tcaaagcttctctcctttccag

SEQ ID NO: 1369088 - DNA, 22 bp, Artificial Sequence
  chemically synthesized
aaatcatctggaaaggagagaa

SEQ ID NO: 1369089 - DNA, 22 bp, Artificial Sequence
  chemically synthesized
cataaatcctctcaaagcttct

SEQ ID NO: 1369090 - DNA, 22 bp, Artificial Sequence
  chemically synthesized
ctacataaatcctctcaaagct

SEQ ID NO: 1369091 - DNA, 22 bp, Artificial Sequence
  chemically synthesized
gaaaggagagaagctttgagag

SEQ ID NO: 1369092 - DNA, 22 bp, Artificial Sequence
  chemically synthesized
atctgctacataaatcctctca

SEQ ID NO: 1369093 - DNA, 22 bp, Artificial Sequence
  chemically synthesized
catctgctacataaatcctctc

SEQ ID NO: 1369094 - DNA, 22 bp, Artificial Sequence
  chemically synthesized
tgagaggatttatgtagcagat

SEQ ID NO: 1369095 - DNA, 22 bp, Artificial Sequence
  chemically synthesized
gagaggatttatgtagcagatg

SEQ ID NO: 1369096 - DNA, 22 bp, Artificial Sequence
  chemically synthesized
agaggatttatgtagcagatga

SEQ ID NO: 1369097 - DNA, 22 bp, Artificial Sequence
  chemically synthesized
atgtagcagatgaagctgcaca

SEQ ID NO: 1369098 - DNA, 22 bp, Artificial Sequence
  chemically synthesized
gagaaaatagcatgtgcagctt

SEQ ID NO: 1369099 - DNA, 22 bp, Artificial Sequence
  chemically synthesized
tgtagcagatgaagctgcacat

SEQ ID NO: 1369100 - DNA, 22 bp, Artificial Sequence
  chemically synthesized
ttagagaaaatagcatgtgcag

SEQ ID NO: 1369101 - DNA, 22 bp, Artificial Sequence
  chemically synthesized
aaaactattagagaaaatagca

SEQ ID NO: 1369102 - DNA, 22 bp, Artificial Sequence
  chemically synthesized
aaaaactattagagaaaatagc

SEQ ID NO: 1369103 - DNA, 22 bp, Artificial Sequence
  chemically synthesized
taaaaactattagagaaaatag

SEQ ID NO: 1369104 - DNA, 22 bp, Artificial Sequence
  chemically synthesized
tttaaaaactattagagaaaat

SEQ ID NO: 1369105 - DNA, 22 bp, Artificial Sequence
  chemically synthesized
tctttaaaaactattagagaaa

SEQ ID NO: 1369106 - DNA, 22 bp, Artificial Sequence
  chemically synthesized
cacatgctattttctctaatag

SEQ ID NO: 1369107 - DNA, 22 bp, Artificial Sequence
  chemically synthesized
tctctttaaaaactattagaga

SEQ ID NO: 1369108 - DNA, 22 bp, Artificial Sequence
  chemically synthesized
tctctctttaaaaactattaga

SEQ ID NO: 1369109 - DNA, 22 bp, Artificial Sequence
  chemically synthesized
tctctctctttaaaaactatta

SEQ ID NO: 1369110 - DNA, 22 bp, Artificial Sequence
  chemically synthesized
tctctctctctttaaaaactat

SEQ ID NO: 1369111 - DNA, 22 bp, Artificial Sequence
  chemically synthesized
tctctctctctctttaaaaact

SEQ ID NO: 1369112 - DNA, 22 bp, Artificial Sequence
  chemically synthesized
ttttctctaatagtttttaaag

SEQ ID NO: 1369113 - DNA, 22 bp, Artificial Sequence
  chemically synthesized
tctctctctctctctttaaaaa

SEQ ID NO: 1369114 - DNA, 22 bp, Artificial Sequence
  chemically synthesized
tctctaatagtttttaaagaga

SEQ ID NO: 1369115 - DNA, 22 bp, Artificial Sequence
  chemically synthesized
tctctctctctctctctttaaa

SEQ ID NO: 1369116 - DNA, 22 bp, Artificial Sequence
  chemically synthesized
ctctaatagtttttaaagagag

SEQ ID NO: 1369117 - DNA, 22 bp, Artificial Sequence
  chemically synthesized
tctaatagtttttaaagagaga

SEQ ID NO: 1369118 - DNA, 22 bp, Artificial Sequence
  chemically synthesized
tctctctctctctctctcttta

SEQ ID NO: 1369119 - DNA, 22 bp, Artificial Sequence
  chemically synthesized
taatagtttttaaagagagaga

SEQ ID NO: 1369120 - DNA, 22 bp, Artificial Sequence
  chemically synthesized
tctctctctctctctctctctt

SEQ ID NO: 1369121 - DNA, 22 bp, Artificial Sequence
  chemically synthesized
atagtttttaaagagagagaga

SEQ ID NO: 1369122 - DNA, 22 bp, Artificial Sequence
  chemically synthesized
aaagactctctctctctctctc

SEQ ID NO: 1369123 - DNA, 22 bp, Artificial Sequence
  chemically synthesized
ttaaagagagagagagagagag

SEQ ID NO: 1369124 - DNA, 22 bp, Artificial Sequence
  chemically synthesized
taaagagagagagagagagaga

SEQ ID NO: 1369125 - DNA, 22 bp, Artificial Sequence
  chemically synthesized
aaagagagagagagagagagag

SEQ ID NO: 1369126 - DNA, 22 bp, Artificial Sequence
  chemically synthesized
aagagagagagagagagagaga

SEQ ID NO: 1369127 - DNA, 22 bp, Artificial Sequence
  chemically synthesized
aaaacaggatgccactcaaaga

SEQ ID NO: 1369128 - DNA, 22 bp, Artificial Sequence
  chemically synthesized
tagtgaggtattcaaaacagga

SEQ ID NO: 1369129 - DNA, 22 bp, Artificial Sequence
  chemically synthesized
tgtagtgaggtattcaaaacag

SEQ ID NO: 1369130 - DNA, 22 bp, Artificial Sequence
  chemically synthesized
tgagtggcatcctgttttgaat

SEQ ID NO: 1369131 - DNA, 22 bp, Artificial Sequence
  chemically synthesized
gagtggcatcctgttttgaata

SEQ ID NO: 1369132 - DNA, 22 bp, Artificial Sequence
  chemically synthesized
agtggcatcctgttttgaatac

SEQ ID NO: 1369133 - DNA, 22 bp, Artificial Sequence
  chemically synthesized
aggcattctgtagtgaggtatt

SEQ ID NO: 1369134 - DNA, 22 bp, Artificial Sequence
  chemically synthesized
aaggcattctgtagtgaggtat

SEQ ID NO: 1369135 - DNA, 22 bp, Artificial Sequence
  chemically synthesized
taaggcattctgtagtgaggta

SEQ ID NO: 1369136 - DNA, 22 bp, Artificial Sequence
  chemically synthesized
ttaaggcattctgtagtgaggt

SEQ ID NO: 1369137 - DNA, 22 bp, Artificial Sequence
  chemically synthesized
tttaaggcattctgtagtgagg

SEQ ID NO: 1369138 - DNA, 22 bp, Artificial Sequence
  chemically synthesized
tttttaaggcattctgtagtga

SEQ ID NO: 1369139 - DNA, 22 bp, Artificial Sequence
  chemically synthesized
ttttgaatacctcactacagaa

SEQ ID NO: 1369140 - DNA, 22 bp, Artificial Sequence
  chemically synthesized
ctttttaaggcattctgtagtg

SEQ ID NO: 1369141 - DNA, 22 bp, Artificial Sequence
  chemically synthesized
tgaatacctcactacagaatgc

SEQ ID NO: 1369142 - DNA, 22 bp, Artificial Sequence
  chemically synthesized
gaatacctcactacagaatgcc

SEQ ID NO: 1369143 - DNA, 22 bp, Artificial Sequence
  chemically synthesized
aatacctcactacagaatgcct

SEQ ID NO: 1369144 - DNA, 22 bp, Artificial Sequence
  chemically synthesized
catttctttttaaggcattctg

SEQ ID NO: 1369145 - DNA, 22 bp, Artificial Sequence
  chemically synthesized
ccatttctttttaaggcattct

SEQ ID NO: 1369146 - DNA, 22 bp, Artificial Sequence
  chemically synthesized
tccatttctttttaaggcattc

SEQ ID NO: 1369147 - DNA, 22 bp, Artificial Sequence
  chemically synthesized
tttccatttctttttaaggcat

SEQ ID NO: 1369148 - DNA, 22 bp, Artificial Sequence
  chemically synthesized
ctttccatttctttttaaggca

SEQ ID NO: 1369149 - DNA, 22 bp, Artificial Sequence
  chemically synthesized
tctttccatttctttttaaggc

SEQ ID NO: 1369150 - DNA, 22 bp, Artificial Sequence
  chemically synthesized
actacagaatgccttaaaaaga

SEQ ID NO: 1369151 - DNA, 22 bp, Artificial Sequence
  chemically synthesized
tgttttctttccatttcttttt

SEQ ID NO: 1369152 - DNA, 22 bp, Artificial Sequence
  chemically synthesized
cagaatgccttaaaaagaaatg

SEQ ID NO: 1369153 - DNA, 22 bp, Artificial Sequence
  chemically synthesized
gtgttttctttccatttctttt

SEQ ID NO: 1369154 - DNA, 22 bp, Artificial Sequence
  chemically synthesized
tttgtgttttctttccatttct

SEQ ID NO: 1369155 - DNA, 22 bp, Artificial Sequence
  chemically synthesized
atttgtgttttctttccatttc

SEQ ID NO: 1369156 - DNA, 22 bp, Artificial Sequence
  chemically synthesized
aaaaagaaatggaaagaaaaca

SEQ ID NO: 1369157 - DNA, 22 bp, Artificial Sequence
  chemically synthesized
aaaagaaatggaaagaaaacac

SEQ ID NO: 1369158 - DNA, 22 bp, Artificial Sequence
  chemically synthesized
taaatggtgtttatttgtgttt

SEQ ID NO: 1369159 - DNA, 22 bp, Artificial Sequence
  chemically synthesized
aaccaaattataaatggtgttt

SEQ ID NO: 1369160 - DNA, 22 bp, Artificial Sequence
  chemically synthesized
gaaccaaattataaatggtgtt

SEQ ID NO: 1369161 - DNA, 22 bp, Artificial Sequence
  chemically synthesized
tgaaccaaattataaatggtgt

SEQ ID NO: 1369162 - DNA, 22 bp, Artificial Sequence
  chemically synthesized
agaaaattttgaaccaaattat

SEQ ID NO: 1369163 - DNA, 22 bp, Artificial Sequence
  chemically synthesized
tggggctcagaaaattttgaac

SEQ ID NO: 1369164 - DNA, 22 bp, Artificial Sequence
  chemically synthesized
ataatttggttcaaaattttct

SEQ ID NO: 1369165 - DNA, 22 bp, Artificial Sequence
  chemically synthesized
attgtggggctcagaaaatttt

SEQ ID NO: 1369166 - DNA, 22 bp, Artificial Sequence
  chemically synthesized
taatttggttcaaaattttctg

SEQ ID NO: 1369167 - DNA, 22 bp, Artificial Sequence
  chemically synthesized
ggttcaaaattttctgagcccc

SEQ ID NO: 1369168 - DNA, 22 bp, Artificial Sequence
  chemically synthesized
gttcaaaattttctgagcccca

SEQ ID NO: 1369169 - DNA, 22 bp, Artificial Sequence
  chemically synthesized
aaaattttctgagccccacaat

SEQ ID NO: 1369170 - DNA, 22 bp, Artificial Sequence
  chemically synthesized
agtgagtaagtatattcattgt

SEQ ID NO: 1369171 - DNA, 22 bp, Artificial Sequence
  chemically synthesized
cagtgagtaagtatattcattg

SEQ ID NO: 1369172 - DNA, 22 bp, Artificial Sequence
  chemically synthesized
tctgagccccacaatgaatata

SEQ ID NO: 1369173 - DNA, 22 bp, Artificial Sequence
  chemically synthesized
ctgagccccacaatgaatatac

SEQ ID NO: 1369174 - DNA, 22 bp, Artificial Sequence
  chemically synthesized
tgagccccacaatgaatatact

SEQ ID NO: 1369175 - DNA, 22 bp, Artificial Sequence
  chemically synthesized
agccccacaatgaatatactta

SEQ ID NO: 1369176 - DNA, 22 bp, Artificial Sequence
  chemically synthesized
aggcttcagtgagtaagtatat

SEQ ID NO: 1369177 - DNA, 22 bp, Artificial Sequence
  chemically synthesized
tcaggcttcagtgagtaagtat

SEQ ID NO: 1369178 - DNA, 22 bp, Artificial Sequence
  chemically synthesized
actctcaggcttcagtgagtaa

SEQ ID NO: 1369179 - DNA, 22 bp, Artificial Sequence
  chemically synthesized
tgactctcaggcttcagtgagt

SEQ ID NO: 1369180 - DNA, 22 bp, Artificial Sequence
  chemically synthesized
acaggctctgactctcaggctt

SEQ ID NO: 1369181 - DNA, 22 bp, Artificial Sequence
  chemically synthesized
actcactgaagcctgagagtca

SEQ ID NO: 1369182 - DNA, 22 bp, Artificial Sequence
  chemically synthesized
ctcactgaagcctgagagtcag

SEQ ID NO: 1369183 - DNA, 22 bp, Artificial Sequence
  chemically synthesized
cattaacaggctctgactctca

SEQ ID NO: 1369184 - DNA, 22 bp, Artificial Sequence
  chemically synthesized
ccattaacaggctctgactctc

SEQ ID NO: 1369185 - DNA, 22 bp, Artificial Sequence
  chemically synthesized
actgaagcctgagagtcagagc

SEQ ID NO: 1369186 - DNA, 22 bp, Artificial Sequence
  chemically synthesized
atttccattaacaggctctgac

SEQ ID NO: 1369187 - DNA, 22 bp, Artificial Sequence
  chemically synthesized
aagcctgagagtcagagcctgt

SEQ ID NO: 1369188 - DNA, 22 bp, Artificial Sequence
  chemically synthesized
tgatttccattaacaggctctg

SEQ ID NO: 1369189 - DNA, 22 bp, Artificial Sequence
  chemically synthesized
tctgatttccattaacaggctc

SEQ ID NO: 1369190 - DNA, 22 bp, Artificial Sequence
  chemically synthesized
ctctgatttccattaacaggct

SEQ ID NO: 1369191 - DNA, 22 bp, Artificial Sequence
  chemically synthesized
tctctgatttccattaacaggc

SEQ ID NO: 1369192 - DNA, 22 bp, Artificial Sequence
  chemically synthesized
agagtcagagcctgttaatgga

SEQ ID NO: 1369193 - DNA, 22 bp, Artificial Sequence
  chemically synthesized
gaatcaaatattttctctgatt

SEQ ID NO: 1369194 - DNA, 22 bp, Artificial Sequence
  chemically synthesized
ttaatggaaatcagagaaaata

SEQ ID NO: 1369195 - DNA, 22 bp, Artificial Sequence
  chemically synthesized
aattcgaatcaaatattttctc

SEQ ID NO: 1369196 - DNA, 22 bp, Artificial Sequence
  chemically synthesized
aaattcgaatcaaatattttct

SEQ ID NO: 1369197 - DNA, 22 bp, Artificial Sequence
  chemically synthesized
atggaaatcagagaaaatattt

SEQ ID NO: 1369198 - DNA, 22 bp, Artificial Sequence
  chemically synthesized
atttaaattcgaatcaaatatt

SEQ ID NO: 1369199 - DNA, 22 bp, Artificial Sequence
  chemically synthesized
tgaaacctcatttaaattcgaa

SEQ ID NO: 1369200 - DNA, 22 bp, Artificial Sequence
  chemically synthesized
gtgaaacctcatttaaattcga

SEQ ID NO: 1369201 - DNA, 22 bp, Artificial Sequence
  chemically synthesized
gattcgaatttaaatgaggttt

SEQ ID NO: 1369202 - DNA, 22 bp, Artificial Sequence
  chemically synthesized
aatccatttgtgaaacctcatt

SEQ ID NO: 1369203 - DNA, 22 bp, Artificial Sequence
  chemically synthesized
attcgaatttaaatgaggtttc

SEQ ID NO: 1369204 - DNA, 22 bp, Artificial Sequence
  chemically synthesized
gaatttaaatgaggtttcacaa

SEQ ID NO: 1369205 - DNA, 22 bp, Artificial Sequence
  chemically synthesized
aattcaatccatttgtgaaacc

SEQ ID NO: 1369206 - DNA, 22 bp, Artificial Sequence
  chemically synthesized
taaattcaatccatttgtgaaa

SEQ ID NO: 1369207 - DNA, 22 bp, Artificial Sequence
  chemically synthesized
ctctaaattcaatccatttgtg

SEQ ID NO: 1369208 - DNA, 22 bp, Artificial Sequence
  chemically synthesized
aaatgaggtttcacaaatggat

SEQ ID NO: 1369209 - DNA, 22 bp, Artificial Sequence
  chemically synthesized
aatgaggtttcacaaatggatt

SEQ ID NO: 1369210 - DNA, 22 bp, Artificial Sequence
  chemically synthesized
tcctcctctaaattcaatccat

SEQ ID NO: 1369211 - DNA, 22 bp, Artificial Sequence
  chemically synthesized
atcctcctctaaattcaatcca

SEQ ID NO: 1369212 - DNA, 22 bp, Artificial Sequence
  chemically synthesized
tatcctcctctaaattcaatcc

SEQ ID NO: 1369213 - DNA, 22 bp, Artificial Sequence
  chemically synthesized
ttatcctcctctaaattcaatc

SEQ ID NO: 1369214 - DNA, 22 bp, Artificial Sequence
  chemically synthesized
tttatcctcctctaaattcaat

SEQ ID NO: 1369215 - DNA, 22 bp, Artificial Sequence
  chemically synthesized
ttttatcctcctctaaattcaa

SEQ ID NO: 1369216 - DNA, 22 bp, Artificial Sequence
  chemically synthesized
tttttatcctcctctaaattca

SEQ ID NO: 1369217 - DNA, 22 bp, Artificial Sequence
  chemically synthesized
cacaaatggattgaatttagag

SEQ ID NO: 1369218 - DNA, 22 bp, Artificial Sequence
  chemically synthesized
acaaatggattgaatttagagg

SEQ ID NO: 1369219 - DNA, 22 bp, Artificial Sequence
  chemically synthesized
aatttagaggaggataaaaaaa

SEQ ID NO: 1369220 - DNA, 22 bp, Artificial Sequence
  chemically synthesized
agaggaggataaaaaaagtttt

SEQ ID NO: 1369221 - DNA, 22 bp, Artificial Sequence
  chemically synthesized
gaggaggataaaaaaagtttta

SEQ ID NO: 1369222 - DNA, 22 bp, Artificial Sequence
  chemically synthesized
agacataaaccaatataaaact

SEQ ID NO: 1369223 - DNA, 22 bp, Artificial Sequence
  chemically synthesized
gagacataaaccaatataaaac

SEQ ID NO: 1369224 - DNA, 22 bp, Artificial Sequence
  chemically synthesized
tgagacataaaccaatataaaa

SEQ ID NO: 1369225 - DNA, 22 bp, Artificial Sequence
  chemically synthesized
aacagaattttgagacataaac

SEQ ID NO: 1369226 - DNA, 22 bp, Artificial Sequence
  chemically synthesized
tatattggtttatgtctcaaaa

SEQ ID NO: 1369227 - DNA, 22 bp, Artificial Sequence
  chemically synthesized
atattggtttatgtctcaaaat

SEQ ID NO: 1369228 - DNA, 22 bp, Artificial Sequence
  chemically synthesized
tattggtttatgtctcaaaatt

SEQ ID NO: 1369229 - DNA, 22 bp, Artificial Sequence
  chemically synthesized
taaaactgaacagaattttgag

SEQ ID NO: 1369230 - DNA, 22 bp, Artificial Sequence
  chemically synthesized
ataaaactgaacagaattttga

SEQ ID NO: 1369231 - DNA, 22 bp, Artificial Sequence
  chemically synthesized
tataaaactgaacagaattttg

SEQ ID NO: 1369232 - DNA, 22 bp, Artificial Sequence
  chemically synthesized
gtttatgtctcaaaattctgtt

SEQ ID NO: 1369233 - DNA, 22 bp, Artificial Sequence
  chemically synthesized
atgtctcaaaattctgttcagt

SEQ ID NO: 1369234 - DNA, 22 bp, Artificial Sequence
  chemically synthesized
tgtctcaaaattctgttcagtt

SEQ ID NO: 1369235 - DNA, 22 bp, Artificial Sequence
  chemically synthesized
aacattttataaaactgaacag

SEQ ID NO: 1369236 - DNA, 22 bp, Artificial Sequence
  chemically synthesized
aaacattttataaaactgaaca

SEQ ID NO: 1369237 - DNA, 22 bp, Artificial Sequence
  chemically synthesized
aaaattctgttcagttttataa

SEQ ID NO: 1369238 - DNA, 22 bp, Artificial Sequence
  chemically synthesized
acaatgtttaaacattttataa

SEQ ID NO: 1369239 - DNA, 22 bp, Artificial Sequence
  chemically synthesized
cacaatgtttaaacattttata

SEQ ID NO: 1369240 - DNA, 22 bp, Artificial Sequence
  chemically synthesized
tgttcagttttataaaatgttt

SEQ ID NO: 1369241 - DNA, 22 bp, Artificial Sequence
  chemically synthesized
ttcagttttataaaatgtttaa

SEQ ID NO: 1369242 - DNA, 22 bp, Artificial Sequence
  chemically synthesized
agttttataaaatgtttaaaca

SEQ ID NO: 1369243 - DNA, 22 bp, Artificial Sequence
  chemically synthesized
tataaaatgtttaaacattgtg

SEQ ID NO: 1369244 - DNA, 22 bp, Artificial Sequence
  chemically synthesized
ataaaatgtttaaacattgtga

SEQ ID NO: 1369245 - DNA, 22 bp, Artificial Sequence
  chemically synthesized
taaaatgtttaaacattgtgaa

SEQ ID NO: 1369246 - DNA, 22 bp, Artificial Sequence
  chemically synthesized
aaataaccagacttcacaatgt

SEQ ID NO: 1369247 - DNA, 22 bp, Artificial Sequence
  chemically synthesized
caaataaccagacttcacaatg

SEQ ID NO: 1369248 - DNA, 22 bp, Artificial Sequence
  chemically synthesized
tcaaataaccagacttcacaat

SEQ ID NO: 1369249 - DNA, 22 bp, Artificial Sequence
  chemically synthesized
tctttcaaataaccagacttca

SEQ ID NO: 1369250 - DNA, 22 bp, Artificial Sequence
  chemically synthesized
aaacattgtgaagtctggttat

SEQ ID NO: 1369251 - DNA, 22 bp, Artificial Sequence
  chemically synthesized
aacattgtgaagtctggttatt

SEQ ID NO: 1369252 - DNA, 22 bp, Artificial Sequence
  chemically synthesized
aaagctatctttcaaataacca

SEQ ID NO: 1369253 - DNA, 22 bp, Artificial Sequence
  chemically synthesized
tgaagtctggttatttgaaaga

SEQ ID NO: 1369254 - DNA, 22 bp, Artificial Sequence
  chemically synthesized
tagattaaaagctatctttcaa

SEQ ID NO: 1369255 - DNA, 22 bp, Artificial Sequence
  chemically synthesized
gttatttgaaagatagctttta

SEQ ID NO: 1369256 - DNA, 22 bp, Artificial Sequence
  chemically synthesized
atatactatagattaaaagcta

SEQ ID NO: 1369257 - DNA, 22 bp, Artificial Sequence
  chemically synthesized
aatatactatagattaaaagct

SEQ ID NO: 1369258 - DNA, 22 bp, Artificial Sequence
  chemically synthesized
taatatactatagattaaaagc

SEQ ID NO: 1369259 - DNA, 22 bp, Artificial Sequence
  chemically synthesized
tttgaaagatagcttttaatct

SEQ ID NO: 1369260 - DNA, 22 bp, Artificial Sequence
  chemically synthesized
gaaagatagcttttaatctata

SEQ ID NO: 1369261 - DNA, 22 bp, Artificial Sequence
  chemically synthesized
aaagatagcttttaatctatag

SEQ ID NO: 1369262 - DNA, 22 bp, Artificial Sequence
  chemically synthesized
atctttaatatactatagatta

SEQ ID NO: 1369263 - DNA, 22 bp, Artificial Sequence
  chemically synthesized
agcactaatctttaatatacta

SEQ ID NO: 1369264 - DNA, 22 bp, Artificial Sequence
  chemically synthesized
aagcactaatctttaatatact

SEQ ID NO: 1369265 - DNA, 22 bp, Artificial Sequence
  chemically synthesized
taagcactaatctttaatatac

SEQ ID NO: 1369266 - DNA, 22 bp, Artificial Sequence
  chemically synthesized
ttaatctatagtatattaaaga

SEQ ID NO: 1369267 - DNA, 22 bp, Artificial Sequence
  chemically synthesized
taatctatagtatattaaagat

SEQ ID NO: 1369268 - DNA, 22 bp, Artificial Sequence
  chemically synthesized
aatctatagtatattaaagatt

SEQ ID NO: 1369269 - DNA, 22 bp, Artificial Sequence
  chemically synthesized
atctatagtatattaaagatta

SEQ ID NO: 1369270 - DNA, 22 bp, Artificial Sequence
  chemically synthesized
tagtatattaaagattagtgct

SEQ ID NO: 1369271 - DNA, 22 bp, Artificial Sequence
  chemically synthesized
aacccagaatatactttaagca

SEQ ID NO: 1369272 - DNA, 22 bp, Artificial Sequence
  chemically synthesized
ttaaacccagaatatactttaa

SEQ ID NO: 1369273 - DNA, 22 bp, Artificial Sequence
  chemically synthesized
aagattagtgcttaaagtatat

SEQ ID NO: 1369274 - DNA, 22 bp, Artificial Sequence
  chemically synthesized
gtgcttaaagtatattctgggt

SEQ ID NO: 1369275 - DNA, 22 bp, Artificial Sequence
  chemically synthesized
gacatctattaaacccagaata

SEQ ID NO: 1369276 - DNA, 22 bp, Artificial Sequence
  chemically synthesized
agacatctattaaacccagaat

SEQ ID NO: 1369277 - DNA, 22 bp, Artificial Sequence
  chemically synthesized
tttagacatctattaaacccag

SEQ ID NO: 1369278 - DNA, 22 bp, Artificial Sequence
  chemically synthesized
aaagtatattctgggtttaata

SEQ ID NO: 1369279 - DNA, 22 bp, Artificial Sequence
  chemically synthesized
aagtatattctgggtttaatag

SEQ ID NO: 1369280 - DNA, 22 bp, Artificial Sequence
  chemically synthesized
ggttgtttagacatctattaaa

SEQ ID NO: 1369281 - DNA, 22 bp, Artificial Sequence
  chemically synthesized
aggttgtttagacatctattaa

SEQ ID NO: 1369282 - DNA, 22 bp, Artificial Sequence
  chemically synthesized
tttaggttgtttagacatctat

SEQ ID NO: 1369283 - DNA, 22 bp, Artificial Sequence
  chemically synthesized
tgggtttaatagatgtctaaac

SEQ ID NO: 1369284 - DNA, 22 bp, Artificial Sequence
  chemically synthesized
ggttgtttaggttgtttagaca

SEQ ID NO: 1369285 - DNA, 22 bp, Artificial Sequence
  chemically synthesized
ggtttaatagatgtctaaacaa

SEQ ID NO: 1369286 - DNA, 22 bp, Artificial Sequence
  chemically synthesized
aggttgtttaggttgtttagac

SEQ ID NO: 1369287 - DNA, 22 bp, Artificial Sequence
  chemically synthesized
taggttgtttaggttgtttaga

SEQ ID NO: 1369288 - DNA, 22 bp, Artificial Sequence
  chemically synthesized
aatagatgtctaaacaacctaa

SEQ ID NO: 1369289 - DNA, 22 bp, Artificial Sequence
  chemically synthesized
atagatgtctaaacaacctaaa

SEQ ID NO: 1369290 - DNA, 22 bp, Artificial Sequence
  chemically synthesized
aacaacctaaacaacctaaagc

SEQ ID NO: 1369291 - DNA, 22 bp, Artificial Sequence
  chemically synthesized
aggaaatataaatgctttaggt

SEQ ID NO: 1369292 - DNA, 22 bp, Artificial Sequence
  chemically synthesized
aaggaaatataaatgctttagg

SEQ ID NO: 1369293 - DNA, 22 bp, Artificial Sequence
  chemically synthesized
aacaacctaaagcatttatatt

SEQ ID NO: 1369294 - DNA, 22 bp, Artificial Sequence
  chemically synthesized
aaaatgtttaaggaaatataaa

SEQ ID NO: 1369295 - DNA, 22 bp, Artificial Sequence
  chemically synthesized
aaaaatgtttaaggaaatataa

SEQ ID NO: 1369296 - DNA, 22 bp, Artificial Sequence
  chemically synthesized
taaaaatgtttaaggaaatata

SEQ ID NO: 1369297 - DNA, 22 bp, Artificial Sequence
  chemically synthesized
aagcatttatatttccttaaac

SEQ ID NO: 1369298 - DNA, 22 bp, Artificial Sequence
  chemically synthesized
aatattttaaaaatgtttaagg

SEQ ID NO: 1369299 - DNA, 22 bp, Artificial Sequence
  chemically synthesized
caatattttaaaaatgtttaag

SEQ ID NO: 1369300 - DNA, 22 bp, Artificial Sequence
  chemically synthesized
tcaatattttaaaaatgtttaa

SEQ ID NO: 1369301 - DNA, 22 bp, Artificial Sequence
  chemically synthesized
atatttccttaaacatttttaa

SEQ ID NO: 1369302 - DNA, 22 bp, Artificial Sequence
  chemically synthesized
tatttccttaaacatttttaaa

SEQ ID NO: 1369303 - DNA, 22 bp, Artificial Sequence
  chemically synthesized
ccttaaacatttttaaaatatt

SEQ ID NO: 1369304 - DNA, 22 bp, Artificial Sequence
  chemically synthesized
cttaaacatttttaaaatattg

SEQ ID NO: 1369305 - DNA, 22 bp, Artificial Sequence
  chemically synthesized
accataagattttcaatatttt

SEQ ID NO: 1369306 - DNA, 22 bp, Artificial Sequence
  chemically synthesized
aaacatttttaaaatattgaaa

SEQ ID NO: 1369307 - DNA, 22 bp, Artificial Sequence
  chemically synthesized
aacatttttaaaatattgaaaa

SEQ ID NO: 1369308 - DNA, 22 bp, Artificial Sequence
  chemically synthesized
aagattcaccataagattttca

SEQ ID NO: 1369309 - DNA, 22 bp, Artificial Sequence
  chemically synthesized
taaagattcaccataagatttt

SEQ ID NO: 1369310 - DNA, 22 bp, Artificial Sequence
  chemically synthesized
ttaaaatattgaaaatcttatg

SEQ ID NO: 1369311 - DNA, 22 bp, Artificial Sequence
  chemically synthesized
taaaatattgaaaatcttatgg

SEQ ID NO: 1369312 - DNA, 22 bp, Artificial Sequence
  chemically synthesized
aaaatattgaaaatcttatggt

SEQ ID NO: 1369313 - DNA, 22 bp, Artificial Sequence
  chemically synthesized
aaatattgaaaatcttatggtg

SEQ ID NO: 1369314 - DNA, 22 bp, Artificial Sequence
  chemically synthesized
actctaaagattcaccataaga

SEQ ID NO: 1369315 - DNA, 22 bp, Artificial Sequence
  chemically synthesized
aaaatcttatggtgaatcttta

SEQ ID NO: 1369316 - DNA, 22 bp, Artificial Sequence
  chemically synthesized
caaataaagttaactctaaaga

SEQ ID NO: 1369317 - DNA, 22 bp, Artificial Sequence
  chemically synthesized
atggtgaatctttagagttaac

SEQ ID NO: 1369318 - DNA, 22 bp, Artificial Sequence
  chemically synthesized
tggtgaatctttagagttaact

SEQ ID NO: 1369319 - DNA, 22 bp, Artificial Sequence
  chemically synthesized
aatattccaaataaagttaact

SEQ ID NO: 1369320 - DNA, 22 bp, Artificial Sequence
  chemically synthesized
tcaatattccaaataaagttaa

SEQ ID NO: 1369321 - DNA, 22 bp, Artificial Sequence
  chemically synthesized
ctcaatattccaaataaagtta

SEQ ID NO: 1369322 - DNA, 22 bp, Artificial Sequence
  chemically synthesized
tagagttaactttatttggaat

SEQ ID NO: 1369323 - DNA, 22 bp, Artificial Sequence
  chemically synthesized
agagttaactttatttggaata

SEQ ID NO: 1369324 - DNA, 22 bp, Artificial Sequence
  chemically synthesized
gagttaactttatttggaatat

SEQ ID NO: 1369325 - DNA, 22 bp, Artificial Sequence
  chemically synthesized
actttatttggaatattgagaa

SEQ ID NO: 1369326 - DNA, 22 bp, Artificial Sequence
  chemically synthesized
aataacatcatacttctcaata

SEQ ID NO: 1369327 - DNA, 22 bp, Artificial Sequence
  chemically synthesized
tatttggaatattgagaagtat

SEQ ID NO: 1369328 - DNA, 22 bp, Artificial Sequence
  chemically synthesized
atttggaatattgagaagtatg

SEQ ID NO: 1369329 - DNA, 22 bp, Artificial Sequence
  chemically synthesized
tttggaatattgagaagtatga

SEQ ID NO: 1369330 - DNA, 22 bp, Artificial Sequence
  chemically synthesized
ggttcaataacatcatacttct

SEQ ID NO: 1369331 - DNA, 22 bp, Artificial Sequence
  chemically synthesized
gggttcaataacatcatacttc

SEQ ID NO: 1369332 - DNA, 22 bp, Artificial Sequence
  chemically synthesized
ggaatattgagaagtatgatgt

SEQ ID NO: 1369333 - DNA, 22 bp, Artificial Sequence
  chemically synthesized
gaatattgagaagtatgatgtt

SEQ ID NO: 1369334 - DNA, 22 bp, Artificial Sequence
  chemically synthesized
aacttgggttcaataacatcat

SEQ ID NO: 1369335 - DNA, 22 bp, Artificial Sequence
  chemically synthesized
agaagtatgatgttattgaacc

SEQ ID NO: 1369336 - DNA, 22 bp, Artificial Sequence
  chemically synthesized
aataacatattaaacttgggtt

SEQ ID NO: 1369337 - DNA, 22 bp, Artificial Sequence
  chemically synthesized
ggttcaataacatattaaactt

SEQ ID NO: 1369338 - DNA, 22 bp, Artificial Sequence
  chemically synthesized
gggttcaataacatattaaact

SEQ ID NO: 1369339 - DNA, 22 bp, Artificial Sequence
  chemically synthesized
ttgaacccaagtttaatatgtt

SEQ ID NO: 1369340 - DNA, 22 bp, Artificial Sequence
  chemically synthesized
aacttgggttcaataacatatt

SEQ ID NO: 1369341 - DNA, 22 bp, Artificial Sequence
  chemically synthesized
aacccaagtttaatatgttatt

SEQ ID NO: 1369342 - DNA, 22 bp, Artificial Sequence
  chemically synthesized
aaacttgggttcaataacatat

SEQ ID NO: 1369343 - DNA, 22 bp, Artificial Sequence
  chemically synthesized
aatatgttattgaacccaagtt

SEQ ID NO: 1369344 - DNA, 22 bp, Artificial Sequence
  chemically synthesized
atatgttattgaacccaagttt

SEQ ID NO: 1369345 - DNA, 22 bp, Artificial Sequence
  chemically synthesized
ttgaacccaagtttaagtgtgt

SEQ ID NO: 1369346 - DNA, 22 bp, Artificial Sequence
  chemically synthesized
aacccaagtttaagtgtgtgtg

SEQ ID NO: 1369347 - DNA, 22 bp, Artificial Sequence
  chemically synthesized
aagtgtgtgtgtgtgtgtgtgt

SEQ ID NO: 1369348 - DNA, 22 bp, Artificial Sequence
  chemically synthesized
agtgtgtgtgtgtgtgtgtgtg

SEQ ID NO: 1369349 - DNA, 22 bp, Artificial Sequence
  chemically synthesized
cacacacacacacacacacaca

SEQ ID NO: 1369350 - DNA, 22 bp, Artificial Sequence
  chemically synthesized
tgatggaaaaagcatatgccta

SEQ ID NO: 1369351 - DNA, 22 bp, Artificial Sequence
  chemically synthesized
gtgatggaaaaagcatatgcct

SEQ ID NO: 1369352 - DNA, 22 bp, Artificial Sequence
  chemically synthesized
gaagataatttgtgatggaaaa

SEQ ID NO: 1369353 - DNA, 22 bp, Artificial Sequence
  chemically synthesized
ggaagataatttgtgatggaaa

SEQ ID NO: 1369354 - DNA, 22 bp, Artificial Sequence
  chemically synthesized
tttccatcacaaattatcttcc

SEQ ID NO: 1369355 - DNA, 22 bp, Artificial Sequence
  chemically synthesized
ttccatcacaaattatcttcca

SEQ ID NO: 1369356 - DNA, 22 bp, Artificial Sequence
  chemically synthesized
tccatcacaaattatcttccaa

SEQ ID NO: 1369357 - DNA, 22 bp, Artificial Sequence
  chemically synthesized
ccatcacaaattatcttccaag

SEQ ID NO: 1369358 - DNA, 22 bp, Artificial Sequence
  chemically synthesized
catcacaaattatcttccaagg

SEQ ID NO: 1369359 - DNA, 22 bp, Artificial Sequence
  chemically synthesized
acgtggagagagagacatgtac

SEQ ID NO: 1369360 - DNA, 22 bp, Artificial Sequence
  chemically synthesized
tcttccaaggtacatgtctctc

SEQ ID NO: 1369361 - DNA, 22 bp, Artificial Sequence
  chemically synthesized
ctaacgtggagagagagacatg

SEQ ID NO: 1369362 - DNA, 22 bp, Artificial Sequence
  chemically synthesized
gctaacgtggagagagagacat

SEQ ID NO: 1369363 - DNA, 22 bp, Artificial Sequence
  chemically synthesized
ccaaggtacatgtctctctctc

SEQ ID NO: 1369364 - DNA, 22 bp, Artificial Sequence
  chemically synthesized
caaggtacatgtctctctctcc

SEQ ID NO: 1369365 - DNA, 22 bp, Artificial Sequence
  chemically synthesized
atttgctaacgtggagagagag

SEQ ID NO: 1369366 - DNA, 22 bp, Artificial Sequence
  chemically synthesized
aatgtacctcatttgctaacgt

SEQ ID NO: 1369367 - DNA, 22 bp, Artificial Sequence
  chemically synthesized
aaatgtacctcatttgctaacg

SEQ ID NO: 1369368 - DNA, 22 bp, Artificial Sequence
  chemically synthesized
tctctccacgttagcaaatgag

SEQ ID NO: 1369369 - DNA, 22 bp, Artificial Sequence
  chemically synthesized
tctccacgttagcaaatgaggt

SEQ ID NO: 1369370 - DNA, 22 bp, Artificial Sequence
  chemically synthesized
tccacgttagcaaatgaggtac

SEQ ID NO: 1369371 - DNA, 22 bp, Artificial Sequence
  chemically synthesized
cacgttagcaaatgaggtacat

SEQ ID NO: 1369372 - DNA, 22 bp, Artificial Sequence
  chemically synthesized
gcaaatgaggtacatttaaggg

SEQ ID NO: 1369373 - DNA, 22 bp, Artificial Sequence
  chemically synthesized
agaatatgaaaacccttaaatg

SEQ ID NO: 1369374 - DNA, 22 bp, Artificial Sequence
  chemically synthesized
cctcagaatatgaaaaccctta

SEQ ID NO: 1369375 - DNA, 22 bp, Artificial Sequence
  chemically synthesized
aaggtattacctcagaatatga

SEQ ID NO: 1369376 - DNA, 22 bp, Artificial Sequence
  chemically synthesized
ctgaaggtattacctcagaata

SEQ ID NO: 1369377 - DNA, 22 bp, Artificial Sequence
  chemically synthesized
aagggttttcatattctgaggt

SEQ ID NO: 1369378 - DNA, 22 bp, Artificial Sequence
  chemically synthesized
agggttttcatattctgaggta

SEQ ID NO: 1369379 - DNA, 22 bp, Artificial Sequence
  chemically synthesized
caagttcctgaaggtattacct

SEQ ID NO: 1369380 - DNA, 22 bp, Artificial Sequence
  chemically synthesized
tcatattctgaggtaatacctt

SEQ ID NO: 1369381 - DNA, 22 bp, Artificial Sequence
  chemically synthesized
tccaagttcctgaaggtattac

SEQ ID NO: 1369382 - DNA, 22 bp, Artificial Sequence
  chemically synthesized
catattctgaggtaataccttc

SEQ ID NO: 1369383 - DNA, 22 bp, Artificial Sequence
  chemically synthesized
ctccaagttcctgaaggtatta

SEQ ID NO: 1369384 - DNA, 22 bp, Artificial Sequence
  chemically synthesized
atattctgaggtaataccttca

SEQ ID NO: 1369385 - DNA, 22 bp, Artificial Sequence
  chemically synthesized
ttctccaagttcctgaaggtat

SEQ ID NO: 1369386 - DNA, 22 bp, Artificial Sequence
  chemically synthesized
tcttctccaagttcctgaaggt

SEQ ID NO: 1369387 - DNA, 22 bp, Artificial Sequence
  chemically synthesized
tgaggtaataccttcaggaact

SEQ ID NO: 1369388 - DNA, 22 bp, Artificial Sequence
  chemically synthesized
ctctcttctccaagttcctgaa

SEQ ID NO: 1369389 - DNA, 22 bp, Artificial Sequence
  chemically synthesized
actctcttctccaagttcctga

SEQ ID NO: 1369390 - DNA, 22 bp, Artificial Sequence
  chemically synthesized
aggtaataccttcaggaacttg

SEQ ID NO: 1369391 - DNA, 22 bp, Artificial Sequence
  chemically synthesized
atcttactctcttctccaagtt

SEQ ID NO: 1369392 - DNA, 22 bp, Artificial Sequence
  chemically synthesized
taatcttactctcttctccaag

SEQ ID NO: 1369393 - DNA, 22 bp, Artificial Sequence
  chemically synthesized
ctaatcttactctcttctccaa

SEQ ID NO: 1369394 - DNA, 22 bp, Artificial Sequence
  chemically synthesized
tttctaatcttactctcttctc

SEQ ID NO: 1369395 - DNA, 22 bp, Artificial Sequence
  chemically synthesized
caggaacttggagaagagagta

SEQ ID NO: 1369396 - DNA, 22 bp, Artificial Sequence
  chemically synthesized
aggaacttggagaagagagtaa

SEQ ID NO: 1369397 - DNA, 22 bp, Artificial Sequence
  chemically synthesized
aactatttctaatcttactctc

SEQ ID NO: 1369398 - DNA, 22 bp, Artificial Sequence
  chemically synthesized
aaactatttctaatcttactct

SEQ ID NO: 1369399 - DNA, 22 bp, Artificial Sequence
  chemically synthesized
taaactatttctaatcttactc

SEQ ID NO: 1369400 - DNA, 22 bp, Artificial Sequence
  chemically synthesized
ggagaagagagtaagattagaa

SEQ ID NO: 1369401 - DNA, 22 bp, Artificial Sequence
  chemically synthesized
gagaagagagtaagattagaaa

SEQ ID NO: 1369402 - DNA, 22 bp, Artificial Sequence
  chemically synthesized
aatatagagattttaaactatt

SEQ ID NO: 1369403 - DNA, 22 bp, Artificial Sequence
  chemically synthesized
aaatatagagattttaaactat

SEQ ID NO: 1369404 - DNA, 22 bp, Artificial Sequence
  chemically synthesized
taaatatagagattttaaacta

SEQ ID NO: 1369405 - DNA, 22 bp, Artificial Sequence
  chemically synthesized
ttttaaatatagagattttaaa

SEQ ID NO: 1369406 - DNA, 22 bp, Artificial Sequence
  chemically synthesized
attttaaatatagagattttaa

SEQ ID NO: 1369407 - DNA, 22 bp, Artificial Sequence
  chemically synthesized
tattttaaatatagagatttta

SEQ ID NO: 1369408 - DNA, 22 bp, Artificial Sequence
  chemically synthesized
ttattttaaatatagagatttt

SEQ ID NO: 1369409 - DNA, 22 bp, Artificial Sequence
  chemically synthesized
tttattttaaatatagagattt

SEQ ID NO: 1369410 - DNA, 22 bp, Artificial Sequence
  chemically synthesized
gaaatagtttaaaatctctata

SEQ ID NO: 1369411 - DNA, 22 bp, Artificial Sequence
  chemically synthesized
ccctttttattttaaatataga

SEQ ID NO: 1369412 - DNA, 22 bp, Artificial Sequence
  chemically synthesized
aaaatctctatatttaaaataa

SEQ ID NO: 1369413 - DNA, 22 bp, Artificial Sequence
  chemically synthesized
aaatctctatatttaaaataaa

SEQ ID NO: 1369414 - DNA, 22 bp, Artificial Sequence
  chemically synthesized
caagtccctcccctttttattt

SEQ ID NO: 1369415 - DNA, 22 bp, Artificial Sequence
  chemically synthesized
tccaagtccctcccctttttat

SEQ ID NO: 1369416 - DNA, 22 bp, Artificial Sequence
  chemically synthesized
ctccaagtccctccccttttta

SEQ ID NO: 1369417 - DNA, 22 bp, Artificial Sequence
  chemically synthesized
tatatttaaaataaaaagggga

SEQ ID NO: 1369418 - DNA, 22 bp, Artificial Sequence
  chemically synthesized
tatttaaaataaaaaggggagg

SEQ ID NO: 1369419 - DNA, 22 bp, Artificial Sequence
  chemically synthesized
aaaataaaaaggggagggactt

SEQ ID NO: 1369420 - DNA, 22 bp, Artificial Sequence
  chemically synthesized
aaataaaaaggggagggacttg

SEQ ID NO: 1369421 - DNA, 22 bp, Artificial Sequence
  chemically synthesized
tcgaagtagcccttctccaagt

SEQ ID NO: 1369422 - DNA, 22 bp, Artificial Sequence
  chemically synthesized
atcgaagtagcccttctccaag

SEQ ID NO: 1369423 - DNA, 22 bp, Artificial Sequence
  chemically synthesized
tatcgaagtagcccttctccaa

SEQ ID NO: 1369424 - DNA, 22 bp, Artificial Sequence
  chemically synthesized
aggttttatcgaagtagccctt

SEQ ID NO: 1369425 - DNA, 22 bp, Artificial Sequence
  chemically synthesized
atactgaggttttatcgaagta

SEQ ID NO: 1369426 - DNA, 22 bp, Artificial Sequence
  chemically synthesized
catactgaggttttatcgaagt

SEQ ID NO: 1369427 - DNA, 22 bp, Artificial Sequence
  chemically synthesized
ggagaagggctacttcgataaa

SEQ ID NO: 1369428 - DNA, 22 bp, Artificial Sequence
  chemically synthesized
tcatactgaggttttatcgaag

SEQ ID NO: 1369429 - DNA, 22 bp, Artificial Sequence
  chemically synthesized
gagaagggctacttcgataaaa

SEQ ID NO: 1369430 - DNA, 22 bp, Artificial Sequence
  chemically synthesized
cccgttttcatactgaggtttt

SEQ ID NO: 1369431 - DNA, 22 bp, Artificial Sequence
  chemically synthesized
ccccgttttcatactgaggttt

SEQ ID NO: 1369432 - DNA, 22 bp, Artificial Sequence
  chemically synthesized
cttcgataaaacctcagtatga

SEQ ID NO: 1369433 - DNA, 22 bp, Artificial Sequence
  chemically synthesized
agatttccccgttttcatactg

SEQ ID NO: 1369434 - DNA, 22 bp, Artificial Sequence
  chemically synthesized
cgataaaacctcagtatgaaaa

SEQ ID NO: 1369435 - DNA, 22 bp, Artificial Sequence
  chemically synthesized
gataaaacctcagtatgaaaac

SEQ ID NO: 1369436 - DNA, 22 bp, Artificial Sequence
  chemically synthesized
tcagatttccccgttttcatac

SEQ ID NO: 1369437 - DNA, 22 bp, Artificial Sequence
  chemically synthesized
tactctcagatttccccgtttt

SEQ ID NO: 1369438 - DNA, 22 bp, Artificial Sequence
  chemically synthesized
agtatgaaaacggggaaatctg

SEQ ID NO: 1369439 - DNA, 22 bp, Artificial Sequence
  chemically synthesized
ggagccaattgtactctcagat

SEQ ID NO: 1369440 - DNA, 22 bp, Artificial Sequence
  chemically synthesized
taggagccaattgtactctcag

SEQ ID NO: 1369441 - DNA, 22 bp, Artificial Sequence
  chemically synthesized
ctaggagccaattgtactctca

SEQ ID NO: 1369442 - DNA, 22 bp, Artificial Sequence
  chemically synthesized
accaaccttctaggagccaatt

SEQ ID NO: 1369443 - DNA, 22 bp, Artificial Sequence
  chemically synthesized
ctaaccaaccttctaggagcca

SEQ ID NO: 1369444 - DNA, 22 bp, Artificial Sequence
  chemically synthesized
gctaaccaaccttctaggagcc

SEQ ID NO: 1369445 - DNA, 22 bp, Artificial Sequence
  chemically synthesized
agagtacaattggctcctagaa

SEQ ID NO: 1369446 - DNA, 22 bp, Artificial Sequence
  chemically synthesized
tgctaaccaaccttctaggagc

SEQ ID NO: 1369447 - DNA, 22 bp, Artificial Sequence
  chemically synthesized
ttgctaaccaaccttctaggag

SEQ ID NO: 1369448 - DNA, 22 bp, Artificial Sequence
  chemically synthesized
tatttttgctaaccaaccttct

SEQ ID NO: 1369449 - DNA, 22 bp, Artificial Sequence
  chemically synthesized
gctcctagaaggttggttagca

SEQ ID NO: 1369450 - DNA, 22 bp, Artificial Sequence
  chemically synthesized
ctagaaggttggttagcaaaaa

SEQ ID NO: 1369451 - DNA, 22 bp, Artificial Sequence
  chemically synthesized
aaaatgtattatatttttgcta

SEQ ID NO: 1369452 - DNA, 22 bp, Artificial Sequence
  chemically synthesized
aaaaatgtattatatttttgct

SEQ ID NO: 1369453 - DNA, 22 bp, Artificial Sequence
  chemically synthesized
gaaggttggttagcaaaaatat

SEQ ID NO: 1369454 - DNA, 22 bp, Artificial Sequence
  chemically synthesized
tttaaaaatgtattatattttt

SEQ ID NO: 1369455 - DNA, 22 bp, Artificial Sequence
  chemically synthesized
tatttaaaaatgtattatattt

SEQ ID NO: 1369456 - DNA, 22 bp, Artificial Sequence
  chemically synthesized
ctatttaaaaatgtattatatt

SEQ ID NO: 1369457 - DNA, 22 bp, Artificial Sequence
  chemically synthesized
gttagcaaaaatataatacatt

SEQ ID NO: 1369458 - DNA, 22 bp, Artificial Sequence
  chemically synthesized
cttctatttaaaaatgtattat

SEQ ID NO: 1369459 - DNA, 22 bp, Artificial Sequence
  chemically synthesized
gcaaaaatataatacattttta

SEQ ID NO: 1369460 - DNA, 22 bp, Artificial Sequence
  chemically synthesized
tcattgcttctatttaaaaatg

SEQ ID NO: 1369461 - DNA, 22 bp, Artificial Sequence
  chemically synthesized
atcattgcttctatttaaaaat

SEQ ID NO: 1369462 - DNA, 22 bp, Artificial Sequence
  chemically synthesized
ttatcattgcttctatttaaaa

SEQ ID NO: 1369463 - DNA, 22 bp, Artificial Sequence
  chemically synthesized
ctcttatcattgcttctattta

SEQ ID NO: 1369464 - DNA, 22 bp, Artificial Sequence
  chemically synthesized
ctgctcttatcattgcttctat

SEQ ID NO: 1369465 - DNA, 22 bp, Artificial Sequence
  chemically synthesized
actgctgctcttatcattgctt

SEQ ID NO: 1369466 - DNA, 22 bp, Artificial Sequence
  chemically synthesized
aactgctgctcttatcattgct

SEQ ID NO: 1369467 - DNA, 22 bp, Artificial Sequence
  chemically synthesized
ttaaatagaagcaatgataaga

SEQ ID NO: 1369468 - DNA, 22 bp, Artificial Sequence
  chemically synthesized
taaatagaagcaatgataagag

SEQ ID NO: 1369469 - DNA, 22 bp, Artificial Sequence
  chemically synthesized
aaatagaagcaatgataagagc

SEQ ID NO: 1369470 - DNA, 22 bp, Artificial Sequence
  chemically synthesized
aatagaagcaatgataagagca

SEQ ID NO: 1369471 - DNA, 22 bp, Artificial Sequence
  chemically synthesized
atgtatttaactgctgctctta

SEQ ID NO: 1369472 - DNA, 22 bp, Artificial Sequence
  chemically synthesized
taatgtatttaactgctgctct

SEQ ID NO: 1369473 - DNA, 22 bp, Artificial Sequence
  chemically synthesized
ctaatgtatttaactgctgctc

SEQ ID NO: 1369474 - DNA, 22 bp, Artificial Sequence
  chemically synthesized
tctaatgtatttaactgctgct

SEQ ID NO: 1369475 - DNA, 22 bp, Artificial Sequence
  chemically synthesized
ttctaatgtatttaactgctgc

SEQ ID NO: 1369476 - DNA, 22 bp, Artificial Sequence
  chemically synthesized
tcttttctaatgtatttaactg

SEQ ID NO: 1369477 - DNA, 22 bp, Artificial Sequence
  chemically synthesized
atcttttctaatgtatttaact

SEQ ID NO: 1369478 - DNA, 22 bp, Artificial Sequence
  chemically synthesized
tatcttttctaatgtatttaac

SEQ ID NO: 1369479 - DNA, 22 bp, Artificial Sequence
  chemically synthesized
atatactttatcttttctaatg

SEQ ID NO: 1369480 - DNA, 22 bp, Artificial Sequence
  chemically synthesized
aatacattagaaaagataaagt

SEQ ID NO: 1369481 - DNA, 22 bp, Artificial Sequence
  chemically synthesized
atagcctaatatactttatctt

SEQ ID NO: 1369482 - DNA, 22 bp, Artificial Sequence
  chemically synthesized
gaaaagataaagtatattaggc

SEQ ID NO: 1369483 - DNA, 22 bp, Artificial Sequence
  chemically synthesized
ggctatcaggctctcacttcca

SEQ ID NO: 1369484 - DNA, 22 bp, Artificial Sequence
  chemically synthesized
aatggggaatataggtggaagt

SEQ ID NO: 1369485 - DNA, 22 bp, Artificial Sequence
  chemically synthesized
aaatggggaatataggtggaag

SEQ ID NO: 1369486 - DNA, 22 bp, Artificial Sequence
  chemically synthesized
tcaggctctcacttccacctat

SEQ ID NO: 1369487 - DNA, 22 bp, Artificial Sequence
  chemically synthesized
taaatggggaatataggtggaa

SEQ ID NO: 1369488 - DNA, 22 bp, Artificial Sequence
  chemically synthesized
ttaaatggggaatataggtgga

SEQ ID NO: 1369489 - DNA, 22 bp, Artificial Sequence
  chemically synthesized
tttaaatggggaatataggtgg

SEQ ID NO: 1369490 - DNA, 22 bp, Artificial Sequence
  chemically synthesized
ttttaaatggggaatataggtg

SEQ ID NO: 1369491 - DNA, 22 bp, Artificial Sequence
  chemically synthesized
tcacttccacctatattcccca

SEQ ID NO: 1369492 - DNA, 22 bp, Artificial Sequence
  chemically synthesized
acttccacctatattccccatt

SEQ ID NO: 1369493 - DNA, 22 bp, Artificial Sequence
  chemically synthesized
ccacctatattccccatttaaa

SEQ ID NO: 1369494 - DNA, 22 bp, Artificial Sequence
  chemically synthesized
aagaaaaatttttttaaatggg

SEQ ID NO: 1369495 - DNA, 22 bp, Artificial Sequence
  chemically synthesized
cacctatattccccatttaaaa

SEQ ID NO: 1369496 - DNA, 22 bp, Artificial Sequence
  chemically synthesized
tattccccatttaaaaaaattt

SEQ ID NO: 1369497 - DNA, 22 bp, Artificial Sequence
  chemically synthesized
cccatttaaaaaaatttttctt

SEQ ID NO: 1369498 - DNA, 22 bp, Artificial Sequence
  chemically synthesized
aaaaaaaaaaaaagctgaagaa

SEQ ID NO: 1369499 - DNA, 22 bp, Artificial Sequence
  chemically synthesized
aaaaaaatttttcttcagcttt

SEQ ID NO: 1369500 - DNA, 22 bp, Artificial Sequence
  chemically synthesized
aaaaaatttttcttcagctttt

SEQ ID NO: 1369501 - DNA, 22 bp, Artificial Sequence
  chemically synthesized
tctcaaaaaaaaaaaaagctga

SEQ ID NO: 1369502 - DNA, 22 bp, Artificial Sequence
  chemically synthesized
ttcttcagcttttttttttttt

SEQ ID NO: 1369503 - DNA, 22 bp, Artificial Sequence
  chemically synthesized
tcttcagctttttttttttttg

SEQ ID NO: 1369504 - DNA, 22 bp, Artificial Sequence
  chemically synthesized
cttcagctttttttttttttga

SEQ ID NO: 1369505 - DNA, 22 bp, Artificial Sequence
  chemically synthesized
ttcagctttttttttttttgag

SEQ ID NO: 1369506 - DNA, 22 bp, Artificial Sequence
  chemically synthesized
cagctttttttttttttgagac

SEQ ID NO: 1369507 - DNA, 22 bp, Artificial Sequence
  chemically synthesized
agctttttttttttttgagaca

SEQ ID NO: 1369508 - DNA, 22 bp, Artificial Sequence
  chemically synthesized
tttttttttttgagacagggtc

SEQ ID NO: 1369509 - DNA, 22 bp, Artificial Sequence
  chemically synthesized
ttttttttttgagacagggtct

SEQ ID NO: 1369510 - DNA, 22 bp, Artificial Sequence
  chemically synthesized
ggcaacagagtgagaccctgtc

SEQ ID NO: 1369511 - DNA, 22 bp, Artificial Sequence
  chemically synthesized
tttttttttgagacagggtctc

SEQ ID NO: 1369512 - DNA, 22 bp, Artificial Sequence
  chemically synthesized
ttttttttgagacagggtctca

SEQ ID NO: 1369513 - DNA, 22 bp, Artificial Sequence
  chemically synthesized
tttttttgagacagggtctcac

SEQ ID NO: 1369514 - DNA, 22 bp, Artificial Sequence
  chemically synthesized
ttttttgagacagggtctcact

SEQ ID NO: 1369515 - DNA, 22 bp, Artificial Sequence
  chemically synthesized
tttttgagacagggtctcactc

SEQ ID NO: 1369516 - DNA, 22 bp, Artificial Sequence
  chemically synthesized
ttttgagacagggtctcactct

SEQ ID NO: 1369517 - DNA, 22 bp, Artificial Sequence
  chemically synthesized
tttgagacagggtctcactctg

SEQ ID NO: 1369518 - DNA, 22 bp, Artificial Sequence
  chemically synthesized
cagcctgggcaacagagtgaga

SEQ ID NO: 1369519 - DNA, 22 bp, Artificial Sequence
  chemically synthesized
ttgagacagggtctcactctgt

SEQ ID NO: 1369520 - DNA, 22 bp, Artificial Sequence
  chemically synthesized
tgagacagggtctcactctgtt

SEQ ID NO: 1369521 - DNA, 22 bp, Artificial Sequence
  chemically synthesized
gagacagggtctcactctgttg

SEQ ID NO: 1369522 - DNA, 22 bp, Artificial Sequence
  chemically synthesized
agacagggtctcactctgttgc

SEQ ID NO: 1369523 - DNA, 22 bp, Artificial Sequence
  chemically synthesized
ccactccagcctgggcaacaga

SEQ ID NO: 1369524 - DNA, 22 bp, Artificial Sequence
  chemically synthesized
accactccagcctgggcaacag

SEQ ID NO: 1369525 - DNA, 22 bp, Artificial Sequence
  chemically synthesized
actctgttgcccaggctggagt

SEQ ID NO: 1369526 - DNA, 22 bp, Artificial Sequence
  chemically synthesized
tgtatgtttaccactccagcct

SEQ ID NO: 1369527 - DNA, 22 bp, Artificial Sequence
  chemically synthesized
tgttgcccaggctggagtggta

SEQ ID NO: 1369528 - DNA, 22 bp, Artificial Sequence
  chemically synthesized
ttgcccaggctggagtggtaaa

SEQ ID NO: 1369529 - DNA, 22 bp, Artificial Sequence
  chemically synthesized
cccaggctggagtggtaaacat

SEQ ID NO: 1369530 - DNA, 22 bp, Artificial Sequence
  chemically synthesized
aaaataaacaaacactgtgtat

SEQ ID NO: 1369531 - DNA, 22 bp, Artificial Sequence
  chemically synthesized
gagtggtaaacatacacagtgt

SEQ ID NO: 1369532 - DNA, 22 bp, Artificial Sequence
  chemically synthesized
ttaaaaataaacaaacactgtg

SEQ ID NO: 1369533 - DNA, 22 bp, Artificial Sequence
  chemically synthesized
gttaaaaataaacaaacactgt

SEQ ID NO: 1369534 - DNA, 22 bp, Artificial Sequence
  chemically synthesized
gcagtttgttaaaaataaacaa

SEQ ID NO: 1369535 - DNA, 22 bp, Artificial Sequence
  chemically synthesized
ggcagtttgttaaaaataaaca

SEQ ID NO: 1369536 - DNA, 22 bp, Artificial Sequence
  chemically synthesized
gaaaatagtttggcagtttgtt

SEQ ID NO: 1369537 - DNA, 22 bp, Artificial Sequence
  chemically synthesized
gtttatttttaacaaactgcca

SEQ ID NO: 1369538 - DNA, 22 bp, Artificial Sequence
  chemically synthesized
tttatttttaacaaactgccaa

SEQ ID NO: 1369539 - DNA, 22 bp, Artificial Sequence
  chemically synthesized
atttttaacaaactgccaaact

SEQ ID NO: 1369540 - DNA, 22 bp, Artificial Sequence
  chemically synthesized
tttttaacaaactgccaaacta

SEQ ID NO: 1369541 - DNA, 22 bp, Artificial Sequence
  chemically synthesized
ttaacaaactgccaaactattt

SEQ ID NO: 1369542 - DNA, 22 bp, Artificial Sequence
  chemically synthesized
taacaaactgccaaactatttt

SEQ ID NO: 1369543 - DNA, 22 bp, Artificial Sequence
  chemically synthesized
aacaaactgccaaactattttc

SEQ ID NO: 1369544 - DNA, 22 bp, Artificial Sequence
  chemically synthesized
acaaactgccaaactattttcc

SEQ ID NO: 1369545 - DNA, 22 bp, Artificial Sequence
  chemically synthesized
aaaagaatatcagtctggaaaa

SEQ ID NO: 1369546 - DNA, 22 bp, Artificial Sequence
  chemically synthesized
ctgaaaagaatatcagtctgga

SEQ ID NO: 1369547 - DNA, 22 bp, Artificial Sequence
  chemically synthesized
ccaaactattttccagactgat

SEQ ID NO: 1369548 - DNA, 22 bp, Artificial Sequence
  chemically synthesized
gtacattactgaaaagaatatc

SEQ ID NO: 1369549 - DNA, 22 bp, Artificial Sequence
  chemically synthesized
ttttccagactgatattctttt

SEQ ID NO: 1369550 - DNA, 22 bp, Artificial Sequence
  chemically synthesized
tccagactgatattcttttcag

SEQ ID NO: 1369551 - DNA, 22 bp, Artificial Sequence
  chemically synthesized
ccagactgatattcttttcagt

SEQ ID NO: 1369552 - DNA, 22 bp, Artificial Sequence
  chemically synthesized
cagactgatattcttttcagta

SEQ ID NO: 1369553 - DNA, 22 bp, Artificial Sequence
  chemically synthesized
atattcttttcagtaatgtacg

SEQ ID NO: 1369554 - DNA, 22 bp, Artificial Sequence
  chemically synthesized
ttttcagtaatgtacgagtgat

SEQ ID NO: 1369555 - DNA, 22 bp, Artificial Sequence
  chemically synthesized
ttcagtaatgtacgagtgatcc

SEQ ID NO: 1369556 - DNA, 22 bp, Artificial Sequence
  chemically synthesized
tcagtaatgtacgagtgatccc

SEQ ID NO: 1369557 - DNA, 22 bp, Artificial Sequence
  chemically synthesized
cagtaatgtacgagtgatccca

SEQ ID NO: 1369558 - DNA, 22 bp, Artificial Sequence
  chemically synthesized
agtaatgtacgagtgatcccat

SEQ ID NO: 1369559 - DNA, 22 bp, Artificial Sequence
  chemically synthesized
gcaaaaatgtggagaaatggga

SEQ ID NO: 1369560 - DNA, 22 bp, Artificial Sequence
  chemically synthesized
ccaccaaataactagcaaaaat

SEQ ID NO: 1369561 - DNA, 22 bp, Artificial Sequence
  chemically synthesized
ctccacatttttgctagttatt

SEQ ID NO: 1369562 - DNA, 22 bp, Artificial Sequence
  chemically synthesized
tccacatttttgctagttattt

SEQ ID NO: 1369563 - DNA, 22 bp, Artificial Sequence
  chemically synthesized
cacatttttgctagttatttgg

SEQ ID NO: 1369564 - DNA, 22 bp, Artificial Sequence
  chemically synthesized
ttgctagttatttggtggtagt

SEQ ID NO: 1369565 - DNA, 22 bp, Artificial Sequence
  chemically synthesized
tgctagttatttggtggtagtg

SEQ ID NO: 1369566 - DNA, 22 bp, Artificial Sequence
  chemically synthesized
gctagttatttggtggtagtgt

SEQ ID NO: 1369567 - DNA, 22 bp, Artificial Sequence
  chemically synthesized
ctagttatttggtggtagtgtc

SEQ ID NO: 1369568 - DNA, 22 bp, Artificial Sequence
  chemically synthesized
aaataaaaaatagtgacactac

SEQ ID NO: 1369569 - DNA, 22 bp, Artificial Sequence
  chemically synthesized
gttatttggtggtagtgtcact

SEQ ID NO: 1369570 - DNA, 22 bp, Artificial Sequence
  chemically synthesized
tttggtggtagtgtcactattt

SEQ ID NO: 1369571 - DNA, 22 bp, Artificial Sequence
  chemically synthesized
ggtggtagtgtcactatttttt

SEQ ID NO: 1369572 - DNA, 22 bp, Artificial Sequence
  chemically synthesized
gtggtagtgtcactatttttta

SEQ ID NO: 1369573 - DNA, 22 bp, Artificial Sequence
  chemically synthesized
agagtgtctgaaataaaaaata

SEQ ID NO: 1369574 - DNA, 22 bp, Artificial Sequence
  chemically synthesized
cagagtgtctgaaataaaaaat

SEQ ID NO: 1369575 - DNA, 22 bp, Artificial Sequence
  chemically synthesized
tcagagtgtctgaaataaaaaa

SEQ ID NO: 1369576 - DNA, 22 bp, Artificial Sequence
  chemically synthesized
ttcagagtgtctgaaataaaaa

SEQ ID NO: 1369577 - DNA, 22 bp, Artificial Sequence
  chemically synthesized
cacatttttcagagtgtctgaa

SEQ ID NO: 1369578 - DNA, 22 bp, Artificial Sequence
  chemically synthesized
ttttttatttcagacactctga

SEQ ID NO: 1369579 - DNA, 22 bp, Artificial Sequence
  chemically synthesized
tttatttcagacactctgaaaa

SEQ ID NO: 1369580 - DNA, 22 bp, Artificial Sequence
  chemically synthesized
ttatttcagacactctgaaaaa

SEQ ID NO: 1369581 - DNA, 22 bp, Artificial Sequence
  chemically synthesized
tatttcagacactctgaaaaat

SEQ ID NO: 1369582 - DNA, 22 bp, Artificial Sequence
  chemically synthesized
atttcagacactctgaaaaatg

SEQ ID NO: 1369583 - DNA, 22 bp, Artificial Sequence
  chemically synthesized
tttcagacactctgaaaaatgt

SEQ ID NO: 1369584 - DNA, 22 bp, Artificial Sequence
  chemically synthesized
cagacactctgaaaaatgtgta

SEQ ID NO: 1369585 - DNA, 22 bp, Artificial Sequence
  chemically synthesized
agacactctgaaaaatgtgtag

SEQ ID NO: 1369586 - DNA, 22 bp, Artificial Sequence
  chemically synthesized
aaaccacagtgagataaaacta

SEQ ID NO: 1369587 - DNA, 22 bp, Artificial Sequence
  chemically synthesized
tgaaaaatgtgtagttttatct

SEQ ID NO: 1369588 - DNA, 22 bp, Artificial Sequence
  chemically synthesized
aaaaatgtgtagttttatctca

SEQ ID NO: 1369589 - DNA, 22 bp, Artificial Sequence
  chemically synthesized
tatctcactgtggtttcaattt

SEQ ID NO: 1369590 - DNA, 22 bp, Artificial Sequence
  chemically synthesized
atctcactgtggtttcaattta

SEQ ID NO: 1369591 - DNA, 22 bp, Artificial Sequence
  chemically synthesized
tctcactgtggtttcaatttat

SEQ ID NO: 1369592 - DNA, 22 bp, Artificial Sequence
  chemically synthesized
gacatcaagcaaatataaattg

SEQ ID NO: 1369593 - DNA, 22 bp, Artificial Sequence
  chemically synthesized
actgtggtttcaatttatattt

SEQ ID NO: 1369594 - DNA, 22 bp, Artificial Sequence
  chemically synthesized
tggtttcaatttatatttgctt

SEQ ID NO: 1369595 - DNA, 22 bp, Artificial Sequence
  chemically synthesized
aatatcactagacatcaagcaa

SEQ ID NO: 1369596 - DNA, 22 bp, Artificial Sequence
  chemically synthesized
caatttatatttgcttgatgtc

SEQ ID NO: 1369597 - DNA, 22 bp, Artificial Sequence
  chemically synthesized
aatttatatttgcttgatgtct

SEQ ID NO: 1369598 - DNA, 22 bp, Artificial Sequence
  chemically synthesized
atatttgcttgatgtctagtga

SEQ ID NO: 1369599 - DNA, 22 bp, Artificial Sequence
  chemically synthesized
tatttgcttgatgtctagtgat

SEQ ID NO: 1369600 - DNA, 22 bp, Artificial Sequence
  chemically synthesized
gcttgatgtctagtgatattta

SEQ ID NO: 1369601 - DNA, 22 bp, Artificial Sequence
  chemically synthesized
cttgatgtctagtgatatttaa

SEQ ID NO: 1369602 - DNA, 22 bp, Artificial Sequence
  chemically synthesized
gatgtctagtgatatttaatat

SEQ ID NO: 1369603 - DNA, 22 bp, Artificial Sequence
  chemically synthesized
atgtctagtgatatttaatatc

SEQ ID NO: 1369604 - DNA, 22 bp, Artificial Sequence
  chemically synthesized
gtgatatttaatatcttttcca

SEQ ID NO: 1369605 - DNA, 22 bp, Artificial Sequence
  chemically synthesized
aatatcttttccatatgtttgt

SEQ ID NO: 1369606 - DNA, 22 bp, Artificial Sequence
  chemically synthesized
atatcttttccatatgtttgtc

SEQ ID NO: 1369607 - DNA, 22 bp, Artificial Sequence
  chemically synthesized
aatagtatatataaatgacaaa

SEQ ID NO: 1369608 - DNA, 22 bp, Artificial Sequence
  chemically synthesized
ttccatatgtttgtcatttata

SEQ ID NO: 1369609 - DNA, 22 bp, Artificial Sequence
  chemically synthesized
ctgaatagtatatataaatgac

SEQ ID NO: 1369610 - DNA, 22 bp, Artificial Sequence
  chemically synthesized
tccatatgtttgtcatttatat

SEQ ID NO: 1369611 - DNA, 22 bp, Artificial Sequence
  chemically synthesized
actgaatagtatatataaatga

SEQ ID NO: 1369612 - DNA, 22 bp, Artificial Sequence
  chemically synthesized
ccatatgtttgtcatttatata

SEQ ID NO: 1369613 - DNA, 22 bp, Artificial Sequence
  chemically synthesized
tactgaatagtatatataaatg

SEQ ID NO: 1369614 - DNA, 22 bp, Artificial Sequence
  chemically synthesized
catatgtttgtcatttatatat

SEQ ID NO: 1369615 - DNA, 22 bp, Artificial Sequence
  chemically synthesized
gtcatttatatatactattcag

SEQ ID NO: 1369616 - DNA, 22 bp, Artificial Sequence
  chemically synthesized
tcatttatatatactattcagt

SEQ ID NO: 1369617 - DNA, 22 bp, Artificial Sequence
  chemically synthesized
atatatactattcagtaaaatg

SEQ ID NO: 1369618 - DNA, 22 bp, Artificial Sequence
  chemically synthesized
tatatactattcagtaaaatgt

SEQ ID NO: 1369619 - DNA, 22 bp, Artificial Sequence
  chemically synthesized
ttcagtaaaatgtctcttcgtg

SEQ ID NO: 1369620 - DNA, 22 bp, Artificial Sequence
  chemically synthesized
agtaaaatgtctcttcgtgcct

SEQ ID NO: 1369621 - DNA, 22 bp, Artificial Sequence
  chemically synthesized
ggaaatgagccaaaggcacgaa

SEQ ID NO: 1369622 - DNA, 22 bp, Artificial Sequence
  chemically synthesized
attaggaaatgagccaaaggca

SEQ ID NO: 1369623 - DNA, 22 bp, Artificial Sequence
  chemically synthesized
ttcgtgcctttggctcatttcc

SEQ ID NO: 1369624 - DNA, 22 bp, Artificial Sequence
  chemically synthesized
cgtgcctttggctcatttccta

SEQ ID NO: 1369625 - DNA, 22 bp, Artificial Sequence
  chemically synthesized
gtgcctttggctcatttcctaa

SEQ ID NO: 1369626 - DNA, 22 bp, Artificial Sequence
  chemically synthesized
tggctcatttcctaattaattt

SEQ ID NO: 1369627 - DNA, 22 bp, Artificial Sequence
  chemically synthesized
ggctcatttcctaattaattta

SEQ ID NO: 1369628 - DNA, 22 bp, Artificial Sequence
  chemically synthesized
gctcatttcctaattaatttat

SEQ ID NO: 1369629 - DNA, 22 bp, Artificial Sequence
  chemically synthesized
atttcctaattaatttattttt

SEQ ID NO: 1369630 - DNA, 22 bp, Artificial Sequence
  chemically synthesized
aaaagcaaaaatccaaaaataa

SEQ ID NO: 1369631 - DNA, 22 bp, Artificial Sequence
  chemically synthesized
cctaattaatttatttttggat

SEQ ID NO: 1369632 - DNA, 22 bp, Artificial Sequence
  chemically synthesized
ctaattaatttatttttggatt

SEQ ID NO: 1369633 - DNA, 22 bp, Artificial Sequence
  chemically synthesized
attaatttatttttggattttt

SEQ ID NO: 1369634 - DNA, 22 bp, Artificial Sequence
  chemically synthesized
gaaaactcaaaagcaaaaatcc

SEQ ID NO: 1369635 - DNA, 22 bp, Artificial Sequence
  chemically synthesized
agaaaactcaaaagcaaaaatc

SEQ ID NO: 1369636 - DNA, 22 bp, Artificial Sequence
  chemically synthesized
atttatttttggatttttgctt

SEQ ID NO: 1369637 - DNA, 22 bp, Artificial Sequence
  chemically synthesized
atttttggatttttgcttttga

SEQ ID NO: 1369638 - DNA, 22 bp, Artificial Sequence
  chemically synthesized
tttttggatttttgcttttgag

SEQ ID NO: 1369639 - DNA, 22 bp, Artificial Sequence
  chemically synthesized
ttggatttttgcttttgagttt

SEQ ID NO: 1369640 - DNA, 22 bp, Artificial Sequence
  chemically synthesized
tggatttttgcttttgagtttt

SEQ ID NO: 1369641 - DNA, 22 bp, Artificial Sequence
  chemically synthesized
ggatttttgcttttgagttttc

SEQ ID NO: 1369642 - DNA, 22 bp, Artificial Sequence
  chemically synthesized
gatttttgcttttgagttttct

SEQ ID NO: 1369643 - DNA, 22 bp, Artificial Sequence
  chemically synthesized
tatacgaagaacttagaaaact

SEQ ID NO: 1369644 - DNA, 22 bp, Artificial Sequence
  chemically synthesized
ttgcttttgagttttctaagtt

SEQ ID NO: 1369645 - DNA, 22 bp, Artificial Sequence
  chemically synthesized
tgcttttgagttttctaagttc

SEQ ID NO: 1369646 - DNA, 22 bp, Artificial Sequence
  chemically synthesized
gcttttgagttttctaagttct

SEQ ID NO: 1369647 - DNA, 22 bp, Artificial Sequence
  chemically synthesized
cttttgagttttctaagttctt

SEQ ID NO: 1369648 - DNA, 22 bp, Artificial Sequence
  chemically synthesized
ttgagttttctaagttcttcgt

SEQ ID NO: 1369649 - DNA, 22 bp, Artificial Sequence
  chemically synthesized
tgagttttctaagttcttcgta

SEQ ID NO: 1369650 - DNA, 22 bp, Artificial Sequence
  chemically synthesized
gagttttctaagttcttcgtat

SEQ ID NO: 1369651 - DNA, 22 bp, Artificial Sequence
  chemically synthesized
agttttctaagttcttcgtata

SEQ ID NO: 1369652 - DNA, 22 bp, Artificial Sequence
  chemically synthesized
caaaaacagggactatatacga

SEQ ID NO: 1369653 - DNA, 22 bp, Artificial Sequence
  chemically synthesized
tctaagttcttcgtatatagtc

SEQ ID NO: 1369654 - DNA, 22 bp, Artificial Sequence
  chemically synthesized
ctaagttcttcgtatatagtcc

SEQ ID NO: 1369655 - DNA, 22 bp, Artificial Sequence
  chemically synthesized
taagttcttcgtatatagtccc

SEQ ID NO: 1369656 - DNA, 22 bp, Artificial Sequence
  chemically synthesized
agttcttcgtatatagtccctg

SEQ ID NO: 1369657 - DNA, 22 bp, Artificial Sequence
  chemically synthesized
ttcgtatatagtccctgttttt

SEQ ID NO: 1369658 - DNA, 22 bp, Artificial Sequence
  chemically synthesized
catatcagttgcaaaaacaggg

SEQ ID NO: 1369659 - DNA, 22 bp, Artificial Sequence
  chemically synthesized
gcatatcagttgcaaaaacagg

SEQ ID NO: 1369660 - DNA, 22 bp, Artificial Sequence
  chemically synthesized
cgtatatagtccctgtttttgc

SEQ ID NO: 1369661 - DNA, 22 bp, Artificial Sequence
  chemically synthesized
gtatatagtccctgtttttgca

SEQ ID NO: 1369662 - DNA, 22 bp, Artificial Sequence
  chemically synthesized
tttttgcaactgatatgcaaat

SEQ ID NO: 1369663 - DNA, 22 bp, Artificial Sequence
  chemically synthesized
ttgcaactgatatgcaaatatt

SEQ ID NO: 1369664 - DNA, 22 bp, Artificial Sequence
  chemically synthesized
tgcaactgatatgcaaatattt

SEQ ID NO: 1369665 - DNA, 22 bp, Artificial Sequence
  chemically synthesized
gcaactgatatgcaaatatttt

SEQ ID NO: 1369666 - DNA, 22 bp, Artificial Sequence
  chemically synthesized
caactgatatgcaaatattttc

SEQ ID NO: 1369667 - DNA, 22 bp, Artificial Sequence
  chemically synthesized
atatgcaaatattttctcccat

SEQ ID NO: 1369668 - DNA, 22 bp, Artificial Sequence
  chemically synthesized
agaagtgaaatacaaggtacag

SEQ ID NO: 1369669 - DNA, 22 bp, Artificial Sequence
  chemically synthesized
aagaagtgaaatacaaggtaca

SEQ ID NO: 1369670 - DNA, 22 bp, Artificial Sequence
  chemically synthesized
tctcccattctgtaccttgtat

SEQ ID NO: 1369671 - DNA, 22 bp, Artificial Sequence
  chemically synthesized
ttaagaagtgaaatacaaggta

SEQ ID NO: 1369672 - DNA, 22 bp, Artificial Sequence
  chemically synthesized
ctcccattctgtaccttgtatt

SEQ ID NO: 1369673 - DNA, 22 bp, Artificial Sequence
  chemically synthesized
tcccattctgtaccttgtattt

SEQ ID NO: 1369674 - DNA, 22 bp, Artificial Sequence
  chemically synthesized
ccattctgtaccttgtatttca

SEQ ID NO: 1369675 - DNA, 22 bp, Artificial Sequence
  chemically synthesized
tgtaccttgtatttcacttctt

SEQ ID NO: 1369676 - DNA, 22 bp, Artificial Sequence
  chemically synthesized
taccttgtatttcacttcttaa

SEQ ID NO: 1369677 - DNA, 22 bp, Artificial Sequence
  chemically synthesized
aaaaggatcctcttaagaagtg

SEQ ID NO: 1369678 - DNA, 22 bp, Artificial Sequence
  chemically synthesized
atctgaaaaggatcctcttaag

SEQ ID NO: 1369679 - DNA, 22 bp, Artificial Sequence
  chemically synthesized
gtatttcacttcttaagaggat

SEQ ID NO: 1369680 - DNA, 22 bp, Artificial Sequence
  chemically synthesized
gatctgaaaaggatcctcttaa

SEQ ID NO: 1369681 - DNA, 22 bp, Artificial Sequence
  chemically synthesized
tatttcacttcttaagaggatc

SEQ ID NO: 1369682 - DNA, 22 bp, Artificial Sequence
  chemically synthesized
tgatctgaaaaggatcctctta

SEQ ID NO: 1369683 - DNA, 22 bp, Artificial Sequence
  chemically synthesized
ttgatctgaaaaggatcctctt

SEQ ID NO: 1369684 - DNA, 22 bp, Artificial Sequence
  chemically synthesized
cacttcttaagaggatcctttt

SEQ ID NO: 1369685 - DNA, 22 bp, Artificial Sequence
  chemically synthesized
acttcttaagaggatccttttc

SEQ ID NO: 1369686 - DNA, 22 bp, Artificial Sequence
  chemically synthesized
aaacttttgatctgaaaaggat

SEQ ID NO: 1369687 - DNA, 22 bp, Artificial Sequence
  chemically synthesized
cttaagaggatccttttcagat

SEQ ID NO: 1369688 - DNA, 22 bp, Artificial Sequence
  chemically synthesized
ttaagaggatccttttcagatc

SEQ ID NO: 1369689 - DNA, 22 bp, Artificial Sequence
  chemically synthesized
aagaggatccttttcagatcaa

SEQ ID NO: 1369690 - DNA, 22 bp, Artificial Sequence
  chemically synthesized
aaattaaaacttttgatctgaa

SEQ ID NO: 1369691 - DNA, 22 bp, Artificial Sequence
  chemically synthesized
agaggatccttttcagatcaaa

SEQ ID NO: 1369692 - DNA, 22 bp, Artificial Sequence
  chemically synthesized
gttaaaattaaaacttttgatc

SEQ ID NO: 1369693 - DNA, 22 bp, Artificial Sequence
  chemically synthesized
cgttaaaattaaaacttttgat

SEQ ID NO: 1369694 - DNA, 22 bp, Artificial Sequence
  chemically synthesized
gacttcgttaaaattaaaactt

SEQ ID NO: 1369695 - DNA, 22 bp, Artificial Sequence
  chemically synthesized
ttcagatcaaaagttttaattt

SEQ ID NO: 1369696 - DNA, 22 bp, Artificial Sequence
  chemically synthesized
tcagatcaaaagttttaatttt

SEQ ID NO: 1369697 - DNA, 22 bp, Artificial Sequence
  chemically synthesized
cagatcaaaagttttaatttta

SEQ ID NO: 1369698 - DNA, 22 bp, Artificial Sequence
  chemically synthesized
agatcaaaagttttaattttaa

SEQ ID NO: 1369699 - DNA, 22 bp, Artificial Sequence
  chemically synthesized
ataaattggacttcgttaaaat

SEQ ID NO: 1369700 - DNA, 22 bp, Artificial Sequence
  chemically synthesized
taattttaacgaagtccaattt

SEQ ID NO: 1369701 - DNA, 22 bp, Artificial Sequence
  chemically synthesized
aattttaacgaagtccaattta

SEQ ID NO: 1369702 - DNA, 22 bp, Artificial Sequence
  chemically synthesized
attttaacgaagtccaatttat

SEQ ID NO: 1369703 - DNA, 22 bp, Artificial Sequence
  chemically synthesized
taacgaagtccaatttatcagt

SEQ ID NO: 1369704 - DNA, 22 bp, Artificial Sequence
  chemically synthesized
aacgaagtccaatttatcagtt

SEQ ID NO: 1369705 - DNA, 22 bp, Artificial Sequence
  chemically synthesized
acgaagtccaatttatcagttt

SEQ ID NO: 1369706 - DNA, 22 bp, Artificial Sequence
  chemically synthesized
atcagtttttcttttttatgga

SEQ ID NO: 1369707 - DNA, 22 bp, Artificial Sequence
  chemically synthesized
tcagtttttcttttttatggat

SEQ ID NO: 1369708 - DNA, 22 bp, Artificial Sequence
  chemically synthesized
cacaaatagcacaatccataaa

SEQ ID NO: 1369709 - DNA, 22 bp, Artificial Sequence
  chemically synthesized
acacaaatagcacaatccataa

SEQ ID NO: 1369710 - DNA, 22 bp, Artificial Sequence
  chemically synthesized
tacacaaatagcacaatccata

SEQ ID NO: 1369711 - DNA, 22 bp, Artificial Sequence
  chemically synthesized
ttcttttttatggattgtgcta

SEQ ID NO: 1369712 - DNA, 22 bp, Artificial Sequence
  chemically synthesized
tcttttttatggattgtgctat

SEQ ID NO: 1369713 - DNA, 22 bp, Artificial Sequence
  chemically synthesized
cactttacacaaatagcacaat

SEQ ID NO: 1369714 - DNA, 22 bp, Artificial Sequence
  chemically synthesized
cttttttatggattgtgctatt

SEQ ID NO: 1369715 - DNA, 22 bp, Artificial Sequence
  chemically synthesized
acactttacacaaatagcacaa

SEQ ID NO: 1369716 - DNA, 22 bp, Artificial Sequence
  chemically synthesized
ttttttatggattgtgctattt

SEQ ID NO: 1369717 - DNA, 22 bp, Artificial Sequence
  chemically synthesized
tacactttacacaaatagcaca

SEQ ID NO: 1369718 - DNA, 22 bp, Artificial Sequence
  chemically synthesized
ttacactttacacaaatagcac

SEQ ID NO: 1369719 - DNA, 22 bp, Artificial Sequence
  chemically synthesized
ttttatggattgtgctatttgt

SEQ ID NO: 1369720 - DNA, 22 bp, Artificial Sequence
  chemically synthesized
tttacactttacacaaatagca

SEQ ID NO: 1369721 - DNA, 22 bp, Artificial Sequence
  chemically synthesized
tttatggattgtgctatttgtg

SEQ ID NO: 1369722 - DNA, 22 bp, Artificial Sequence
  chemically synthesized
ttatggattgtgctatttgtgt

SEQ ID NO: 1369723 - DNA, 22 bp, Artificial Sequence
  chemically synthesized
tatggattgtgctatttgtgta

SEQ ID NO: 1369724 - DNA, 22 bp, Artificial Sequence
  chemically synthesized
atggattgtgctatttgtgtaa

SEQ ID NO: 1369725 - DNA, 22 bp, Artificial Sequence
  chemically synthesized
tggattgtgctatttgtgtaaa

SEQ ID NO: 1369726 - DNA, 22 bp, Artificial Sequence
  chemically synthesized
tgctatttgtgtaaagtgtaaa

SEQ ID NO: 1369727 - DNA, 22 bp, Artificial Sequence
  chemically synthesized
aggcaaagactttttacacttt

SEQ ID NO: 1369728 - DNA, 22 bp, Artificial Sequence
  chemically synthesized
tttgtgtaaagtgtaaaaagtc

SEQ ID NO: 1369729 - DNA, 22 bp, Artificial Sequence
  chemically synthesized
tgactgaggcaaagacttttta

SEQ ID NO: 1369730 - DNA, 22 bp, Artificial Sequence
  chemically synthesized
gtgactgaggcaaagacttttt

SEQ ID NO: 1369731 - DNA, 22 bp, Artificial Sequence
  chemically synthesized
gtgtaaagtgtaaaaagtcttt

SEQ ID NO: 1369732 - DNA, 22 bp, Artificial Sequence
  chemically synthesized
tgtgactgaggcaaagactttt

SEQ ID NO: 1369733 - DNA, 22 bp, Artificial Sequence
  chemically synthesized
tgtaaagtgtaaaaagtctttg

SEQ ID NO: 1369734 - DNA, 22 bp, Artificial Sequence
  chemically synthesized
tgcctcagtcacaaaattttct

SEQ ID NO: 1369735 - DNA, 22 bp, Artificial Sequence
  chemically synthesized
gcctcagtcacaaaattttctc

SEQ ID NO: 1369736 - DNA, 22 bp, Artificial Sequence
  chemically synthesized
cctcagtcacaaaattttctcc

SEQ ID NO: 1369737 - DNA, 22 bp, Artificial Sequence
  chemically synthesized
gaaaaacatatgggagaaaatt

SEQ ID NO: 1369738 - DNA, 22 bp, Artificial Sequence
  chemically synthesized
agaaaaacatatgggagaaaat

SEQ ID NO: 1369739 - DNA, 22 bp, Artificial Sequence
  chemically synthesized
tagaaaaacatatgggagaaaa

SEQ ID NO: 1369740 - DNA, 22 bp, Artificial Sequence
  chemically synthesized
agtcacaaaattttctcccata

SEQ ID NO: 1369741 - DNA, 22 bp, Artificial Sequence
  chemically synthesized
caaatattttagaaaaacatat

SEQ ID NO: 1369742 - DNA, 22 bp, Artificial Sequence
  chemically synthesized
tctcccatatgtttttctaaaa

SEQ ID NO: 1369743 - DNA, 22 bp, Artificial Sequence
  chemically synthesized
ctcccatatgtttttctaaaat

SEQ ID NO: 1369744 - DNA, 22 bp, Artificial Sequence
  chemically synthesized
tcccatatgtttttctaaaata

SEQ ID NO: 1369745 - DNA, 22 bp, Artificial Sequence
  chemically synthesized
ccatatgtttttctaaaatatt

SEQ ID NO: 1369746 - DNA, 22 bp, Artificial Sequence
  chemically synthesized
ttctaaaatatttgtagtttta

SEQ ID NO: 1369747 - DNA, 22 bp, Artificial Sequence
  chemically synthesized
tctaaaatatttgtagttttat

SEQ ID NO: 1369748 - DNA, 22 bp, Artificial Sequence
  chemically synthesized
ctaaaatatttgtagttttatg

SEQ ID NO: 1369749 - DNA, 22 bp, Artificial Sequence
  chemically synthesized
taaaatatttgtagttttatgt

SEQ ID NO: 1369750 - DNA, 22 bp, Artificial Sequence
  chemically synthesized
aaatatttgtagttttatgttt

SEQ ID NO: 1369751 - DNA, 22 bp, Artificial Sequence
  chemically synthesized
aaatgtcaaatataaaacataa

SEQ ID NO: 1369752 - DNA, 22 bp, Artificial Sequence
  chemically synthesized
tctcaaatgtcaaatataaaac

SEQ ID NO: 1369753 - DNA, 22 bp, Artificial Sequence
  chemically synthesized
gtagttttatgttttatatttg

SEQ ID NO: 1369754 - DNA, 22 bp, Artificial Sequence
  chemically synthesized
tagttttatgttttatatttga

SEQ ID NO: 1369755 - DNA, 22 bp, Artificial Sequence
  chemically synthesized
tatgttttatatttgacatttg

SEQ ID NO: 1369756 - DNA, 22 bp, Artificial Sequence
  chemically synthesized
atgttttatatttgacatttga

SEQ ID NO: 1369757 - DNA, 22 bp, Artificial Sequence
  chemically synthesized
tgcaaaattatctcaaatgtca

SEQ ID NO: 1369758 - DNA, 22 bp, Artificial Sequence
  chemically synthesized
tgttttatatttgacatttgag

SEQ ID NO: 1369759 - DNA, 22 bp, Artificial Sequence
  chemically synthesized
atgcaaaattatctcaaatgtc

SEQ ID NO: 1369760 - DNA, 22 bp, Artificial Sequence
  chemically synthesized
tatatttgacatttgagataat

SEQ ID NO: 1369761 - DNA, 22 bp, Artificial Sequence
  chemically synthesized
atatttgacatttgagataatt

SEQ ID NO: 1369762 - DNA, 22 bp, Artificial Sequence
  chemically synthesized
agtcttatgcaaaattatctca

SEQ ID NO: 1369763 - DNA, 22 bp, Artificial Sequence
  chemically synthesized
tatttgacatttgagataattt

SEQ ID NO: 1369764 - DNA, 22 bp, Artificial Sequence
  chemically synthesized
aagtcttatgcaaaattatctc

SEQ ID NO: 1369765 - DNA, 22 bp, Artificial Sequence
  chemically synthesized
gacatttgagataattttgcat

SEQ ID NO: 1369766 - DNA, 22 bp, Artificial Sequence
  chemically synthesized
aacttaagtcttatgcaaaatt

SEQ ID NO: 1369767 - DNA, 22 bp, Artificial Sequence
  chemically synthesized
acatttgagataattttgcata

SEQ ID NO: 1369768 - DNA, 22 bp, Artificial Sequence
  chemically synthesized
gagataattttgcataagactt

SEQ ID NO: 1369769 - DNA, 22 bp, Artificial Sequence
  chemically synthesized
agataattttgcataagactta

SEQ ID NO: 1369770 - DNA, 22 bp, Artificial Sequence
  chemically synthesized
tgcataagacttaagttgaggc

SEQ ID NO: 1369771 - DNA, 22 bp, Artificial Sequence
  chemically synthesized
gcataagacttaagttgaggct

SEQ ID NO: 1369772 - DNA, 22 bp, Artificial Sequence
  chemically synthesized
cataagacttaagttgaggctc

SEQ ID NO: 1369773 - DNA, 22 bp, Artificial Sequence
  chemically synthesized
aagttgaggctctatttattta

SEQ ID NO: 1369774 - DNA, 22 bp, Artificial Sequence
  chemically synthesized
agttgaggctctatttatttac

SEQ ID NO: 1369775 - DNA, 22 bp, Artificial Sequence
  chemically synthesized
aggctctatttatttacttata

SEQ ID NO: 1369776 - DNA, 22 bp, Artificial Sequence
  chemically synthesized
tatttatttacttatatattta

SEQ ID NO: 1369777 - DNA, 22 bp, Artificial Sequence
  chemically synthesized
tttatttacttatatatttatg

SEQ ID NO: 1369778 - DNA, 22 bp, Artificial Sequence
  chemically synthesized
atttacttatatatttatgggt

SEQ ID NO: 1369779 - DNA, 22 bp, Artificial Sequence
  chemically synthesized
tttacttatatatttatgggtg

SEQ ID NO: 1369780 - DNA, 22 bp, Artificial Sequence
  chemically synthesized
acttatatatttatgggtgggc

SEQ ID NO: 1369781 - DNA, 22 bp, Artificial Sequence
  chemically synthesized
cttatatatttatgggtgggct

SEQ ID NO: 1369782 - DNA, 22 bp, Artificial Sequence
  chemically synthesized
atatatttatgggtgggctttg

SEQ ID NO: 1369783 - DNA, 22 bp, Artificial Sequence
  chemically synthesized
tatatttatgggtgggctttgt

SEQ ID NO: 1369784 - DNA, 22 bp, Artificial Sequence
  chemically synthesized
aaggcaaaacaaacaaagccca

SEQ ID NO: 1369785 - DNA, 22 bp, Artificial Sequence
  chemically synthesized
atgggtgggctttgtttgtttt

SEQ ID NO: 1369786 - DNA, 22 bp, Artificial Sequence
  chemically synthesized
tgggtgggctttgtttgttttg

SEQ ID NO: 1369787 - DNA, 22 bp, Artificial Sequence
  chemically synthesized
agcaagtagacatctaaaggca

SEQ ID NO: 1369788 - DNA, 22 bp, Artificial Sequence
  chemically synthesized
gagcaagtagacatctaaaggc

SEQ ID NO: 1369789 - DNA, 22 bp, Artificial Sequence
  chemically synthesized
tgtttgttttgcctttagatgt

SEQ ID NO: 1369790 - DNA, 22 bp, Artificial Sequence
  chemically synthesized
gtttgttttgcctttagatgtc

SEQ ID NO: 1369791 - DNA, 22 bp, Artificial Sequence
  chemically synthesized
tttgttttgcctttagatgtct

SEQ ID NO: 1369792 - DNA, 22 bp, Artificial Sequence
  chemically synthesized
gttttgcctttagatgtctact

SEQ ID NO: 1369793 - DNA, 22 bp, Artificial Sequence
  chemically synthesized
ttttgcctttagatgtctactt

SEQ ID NO: 1369794 - DNA, 22 bp, Artificial Sequence
  chemically synthesized
tgcctttagatgtctacttgct

SEQ ID NO: 1369795 - DNA, 22 bp, Artificial Sequence
  chemically synthesized
gcctttagatgtctacttgctc

SEQ ID NO: 1369796 - DNA, 22 bp, Artificial Sequence
  chemically synthesized
cctttagatgtctacttgctca

SEQ ID NO: 1369797 - DNA, 22 bp, Artificial Sequence
  chemically synthesized
agtgagtggtgtttgagcaagt

SEQ ID NO: 1369798 - DNA, 22 bp, Artificial Sequence
  chemically synthesized
taagtgagtggtgtttgagcaa

SEQ ID NO: 1369799 - DNA, 22 bp, Artificial Sequence
  chemically synthesized
tagatgtctacttgctcaaaca

SEQ ID NO: 1369800 - DNA, 22 bp, Artificial Sequence
  chemically synthesized
ctaagtgagtggtgtttgagca

SEQ ID NO: 1369801 - DNA, 22 bp, Artificial Sequence
  chemically synthesized
agatgtctacttgctcaaacac

SEQ ID NO: 1369802 - DNA, 22 bp, Artificial Sequence
  chemically synthesized
tctaagtgagtggtgtttgagc

SEQ ID NO: 1369803 - DNA, 22 bp, Artificial Sequence
  chemically synthesized
gatgtctacttgctcaaacacc

SEQ ID NO: 1369804 - DNA, 22 bp, Artificial Sequence
  chemically synthesized
ttctaagtgagtggtgtttgag

SEQ ID NO: 1369805 - DNA, 22 bp, Artificial Sequence
  chemically synthesized
tttctaagtgagtggtgtttga

SEQ ID NO: 1369806 - DNA, 22 bp, Artificial Sequence
  chemically synthesized
cttgctcaaacaccactcactt

SEQ ID NO: 1369807 - DNA, 22 bp, Artificial Sequence
  chemically synthesized
gctcaaacaccactcacttaga

SEQ ID NO: 1369808 - DNA, 22 bp, Artificial Sequence
  chemically synthesized
ctcaaacaccactcacttagaa

SEQ ID NO: 1369809 - DNA, 22 bp, Artificial Sequence
  chemically synthesized
aaacaccactcacttagaaaaa

SEQ ID NO: 1369810 - DNA, 22 bp, Artificial Sequence
  chemically synthesized
aacaaatagtgtgcgttttttc

SEQ ID NO: 1369811 - DNA, 22 bp, Artificial Sequence
  chemically synthesized
caacaaatagtgtgcgtttttt

SEQ ID NO: 1369812 - DNA, 22 bp, Artificial Sequence
  chemically synthesized
tcaacaaatagtgtgcgttttt

SEQ ID NO: 1369813 - DNA, 22 bp, Artificial Sequence
  chemically synthesized
ttcaacaaatagtgtgcgtttt

SEQ ID NO: 1369814 - DNA, 22 bp, Artificial Sequence
  chemically synthesized
acttagaaaaaacgcacactat

SEQ ID NO: 1369815 - DNA, 22 bp, Artificial Sequence
  chemically synthesized
tagccttttcaacaaatagtgt

SEQ ID NO: 1369816 - DNA, 22 bp, Artificial Sequence
  chemically synthesized
agaaaaaacgcacactatttgt

SEQ ID NO: 1369817 - DNA, 22 bp, Artificial Sequence
  chemically synthesized
gaaaaaacgcacactatttgtt

SEQ ID NO: 1369818 - DNA, 22 bp, Artificial Sequence
  chemically synthesized
tatagccttttcaacaaatagt

SEQ ID NO: 1369819 - DNA, 22 bp, Artificial Sequence
  chemically synthesized
ctatagccttttcaacaaatag

SEQ ID NO: 1369820 - DNA, 22 bp, Artificial Sequence
  chemically synthesized
catttctatagccttttcaaca

SEQ ID NO: 1369821 - DNA, 22 bp, Artificial Sequence
  chemically synthesized
ccatttctatagccttttcaac

SEQ ID NO: 1369822 - DNA, 22 bp, Artificial Sequence
  chemically synthesized
tccatttctatagccttttcaa

SEQ ID NO: 1369823 - DNA, 22 bp, Artificial Sequence
  chemically synthesized
tttgttgaaaaggctatagaaa

SEQ ID NO: 1369824 - DNA, 22 bp, Artificial Sequence
  chemically synthesized
acagcctttccatttctatagc

SEQ ID NO: 1369825 - DNA, 22 bp, Artificial Sequence
  chemically synthesized
aacagcctttccatttctatag

SEQ ID NO: 1369826 - DNA, 22 bp, Artificial Sequence
  chemically synthesized
taacagcctttccatttctata

SEQ ID NO: 1369827 - DNA, 22 bp, Artificial Sequence
  chemically synthesized
gttgaaaaggctatagaaatgg

SEQ ID NO: 1369828 - DNA, 22 bp, Artificial Sequence
  chemically synthesized
ttgaaaaggctatagaaatgga

SEQ ID NO: 1369829 - DNA, 22 bp, Artificial Sequence
  chemically synthesized
aaaaggctatagaaatggaaag

SEQ ID NO: 1369830 - DNA, 22 bp, Artificial Sequence
  chemically synthesized
caaggaggaattttaacagcct

SEQ ID NO: 1369831 - DNA, 22 bp, Artificial Sequence
  chemically synthesized
tagaaatggaaaggctgttaaa

SEQ ID NO: 1369832 - DNA, 22 bp, Artificial Sequence
  chemically synthesized
tgaaagcaattccaaggaggaa

SEQ ID NO: 1369833 - DNA, 22 bp, Artificial Sequence
  chemically synthesized
ttaaaattcctccttggaattg

SEQ ID NO: 1369834 - DNA, 22 bp, Artificial Sequence
  chemically synthesized
aaaagttgtgaaagcaattcca

SEQ ID NO: 1369835 - DNA, 22 bp, Artificial Sequence
  chemically synthesized
aaattcctccttggaattgctt

SEQ ID NO: 1369836 - DNA, 22 bp, Artificial Sequence
  chemically synthesized
aaaaagttgtgaaagcaattcc

SEQ ID NO: 1369837 - DNA, 22 bp, Artificial Sequence
  chemically synthesized
taaaaagttgtgaaagcaattc

SEQ ID NO: 1369838 - DNA, 22 bp, Artificial Sequence
  chemically synthesized
ttaaaaagttgtgaaagcaatt

SEQ ID NO: 1369839 - DNA, 22 bp, Artificial Sequence
  chemically synthesized
tttaaaaagttgtgaaagcaat

SEQ ID NO: 1369840 - DNA, 22 bp, Artificial Sequence
  chemically synthesized
ctccttggaattgctttcacaa

SEQ ID NO: 1369841 - DNA, 22 bp, Artificial Sequence
  chemically synthesized
attttttaaaaagttgtgaaag

SEQ ID NO: 1369842 - DNA, 22 bp, Artificial Sequence
  chemically synthesized
cttggaattgctttcacaactt

SEQ ID NO: 1369843 - DNA, 22 bp, Artificial Sequence
  chemically synthesized
ggaattgctttcacaacttttt

SEQ ID NO: 1369844 - DNA, 22 bp, Artificial Sequence
  chemically synthesized
gaattgctttcacaacttttta

SEQ ID NO: 1369845 - DNA, 22 bp, Artificial Sequence
  chemically synthesized
ctttcacaactttttaaaaaat

SEQ ID NO: 1369846 - DNA, 22 bp, Artificial Sequence
  chemically synthesized
tcacaactttttaaaaaatgag

SEQ ID NO: 1369847 - DNA, 22 bp, Artificial Sequence
  chemically synthesized
cacaactttttaaaaaatgagt

SEQ ID NO: 1369848 - DNA, 22 bp, Artificial Sequence
  chemically synthesized
acaactttttaaaaaatgagtt

SEQ ID NO: 1369849 - DNA, 22 bp, Artificial Sequence
  chemically synthesized
tttaaaaaatgagtttgcacat

SEQ ID NO: 1369850 - DNA, 22 bp, Artificial Sequence
  chemically synthesized
ttaaaaaatgagtttgcacata

SEQ ID NO: 1369851 - DNA, 22 bp, Artificial Sequence
  chemically synthesized
taaaaaatgagtttgcacatat

SEQ ID NO: 1369852 - DNA, 22 bp, Artificial Sequence
  chemically synthesized
aaaaaatgagtttgcacatatt

SEQ ID NO: 1369853 - DNA, 22 bp, Artificial Sequence
  chemically synthesized
aaaaatgagtttgcacatattt

SEQ ID NO: 1369854 - DNA, 22 bp, Artificial Sequence
  chemically synthesized
cagaaatagacccgcacaaata

SEQ ID NO: 1369855 - DNA, 22 bp, Artificial Sequence
  chemically synthesized
gcacatatttgtgcgggtctat

SEQ ID NO: 1369856 - DNA, 22 bp, Artificial Sequence
  chemically synthesized
cacatatttgtgcgggtctatt

SEQ ID NO: 1369857 - DNA, 22 bp, Artificial Sequence
  chemically synthesized
gtgcgggtctatttctggaatc

SEQ ID NO: 1369858 - DNA, 22 bp, Artificial Sequence
  chemically synthesized
tgcgggtctatttctggaatct

SEQ ID NO: 1369859 - DNA, 22 bp, Artificial Sequence
  chemically synthesized
aatgcaatagaatagagattcc

SEQ ID NO: 1369860 - DNA, 22 bp, Artificial Sequence
  chemically synthesized
tttctggaatctctattctatt

SEQ ID NO: 1369861 - DNA, 22 bp, Artificial Sequence
  chemically synthesized
ctggaatctctattctattgca

SEQ ID NO: 1369862 - DNA, 22 bp, Artificial Sequence
  chemically synthesized
tggaatctctattctattgcat

SEQ ID NO: 1369863 - DNA, 22 bp, Artificial Sequence
  chemically synthesized
gaatctctattctattgcattg

SEQ ID NO: 1369864 - DNA, 22 bp, Artificial Sequence
  chemically synthesized
tattctattgcattgaactatg

SEQ ID NO: 1369865 - DNA, 22 bp, Artificial Sequence
  chemically synthesized
ttctattgcattgaactatgcg

SEQ ID NO: 1369866 - DNA, 22 bp, Artificial Sequence
  chemically synthesized
ggggagagatagacgcatagtt

SEQ ID NO: 1369867 - DNA, 22 bp, Artificial Sequence
  chemically synthesized
tattgcattgaactatgcgtct

SEQ ID NO: 1369868 - DNA, 22 bp, Artificial Sequence
  chemically synthesized
ttgcattgaactatgcgtctat

SEQ ID NO: 1369869 - DNA, 22 bp, Artificial Sequence
  chemically synthesized
cattgaactatgcgtctatctc

SEQ ID NO: 1369870 - DNA, 22 bp, Artificial Sequence
  chemically synthesized
aactatgcgtctatctctcccc

SEQ ID NO: 1369871 - DNA, 22 bp, Artificial Sequence
  chemically synthesized
tgcgtctatctctcccccaatt

SEQ ID NO: 1369872 - DNA, 22 bp, Artificial Sequence
  chemically synthesized
tctctcccccaattccacactg

SEQ ID NO: 1369873 - DNA, 22 bp, Artificial Sequence
  chemically synthesized
cagtaatcaagacagtgtggaa

SEQ ID NO: 1369874 - DNA, 22 bp, Artificial Sequence
  chemically synthesized
tcccccaattccacactgtctt

SEQ ID NO: 1369875 - DNA, 22 bp, Artificial Sequence
  chemically synthesized
ccccaattccacactgtcttga

SEQ ID NO: 1369876 - DNA, 22 bp, Artificial Sequence
  chemically synthesized
tgtagctacagtaatcaagaca

SEQ ID NO: 1369877 - DNA, 22 bp, Artificial Sequence
  chemically synthesized
ttatgtagctacagtaatcaag

SEQ ID NO: 1369878 - DNA, 22 bp, Artificial Sequence
  chemically synthesized
attatgtagctacagtaatcaa

SEQ ID NO: 1369879 - DNA, 22 bp, Artificial Sequence
  chemically synthesized
cacactgtcttgattactgtag

SEQ ID NO: 1369880 - DNA, 22 bp, Artificial Sequence
  chemically synthesized
aggcttattatgtagctacagt

SEQ ID NO: 1369881 - DNA, 22 bp, Artificial Sequence
  chemically synthesized
tcttgattactgtagctacata

SEQ ID NO: 1369882 - DNA, 22 bp, Artificial Sequence
  chemically synthesized
aatattaaggcttattatgtag

SEQ ID NO: 1369883 - DNA, 22 bp, Artificial Sequence
  chemically synthesized
gattactgtagctacataataa

SEQ ID NO: 1369884 - DNA, 22 bp, Artificial Sequence
  chemically synthesized
attactgtagctacataataag

SEQ ID NO: 1369885 - DNA, 22 bp, Artificial Sequence
  chemically synthesized
cactaaatattaaggcttatta

SEQ ID NO: 1369886 - DNA, 22 bp, Artificial Sequence
  chemically synthesized
ctgtagctacataataagcctt

SEQ ID NO: 1369887 - DNA, 22 bp, Artificial Sequence
  chemically synthesized
tagctacataataagccttaat

SEQ ID NO: 1369888 - DNA, 22 bp, Artificial Sequence
  chemically synthesized
cataataagccttaatatttag

SEQ ID NO: 1369889 - DNA, 22 bp, Artificial Sequence
  chemically synthesized
aatatttagtggagtgattctt

SEQ ID NO: 1369890 - DNA, 22 bp, Artificial Sequence
  chemically synthesized
atatttagtggagtgattcttt

SEQ ID NO: 1369891 - DNA, 22 bp, Artificial Sequence
  chemically synthesized
agtggagtgattctttccactt

SEQ ID NO: 1369892 - DNA, 22 bp, Artificial Sequence
  chemically synthesized
gtggagtgattctttccacttt

SEQ ID NO: 1369893 - DNA, 22 bp, Artificial Sequence
  chemically synthesized
acaaagaagaataaagtggaaa

SEQ ID NO: 1369894 - DNA, 22 bp, Artificial Sequence
  chemically synthesized
gacaaagaagaataaagtggaa

SEQ ID NO: 1369895 - DNA, 22 bp, Artificial Sequence
  chemically synthesized
atacaatcttgacaaagaagaa

SEQ ID NO: 1369896 - DNA, 22 bp, Artificial Sequence
  chemically synthesized
tttccactttattcttctttgt

SEQ ID NO: 1369897 - DNA, 22 bp, Artificial Sequence
  chemically synthesized
tccactttattcttctttgtca

SEQ ID NO: 1369898 - DNA, 22 bp, Artificial Sequence
  chemically synthesized
ccactttattcttctttgtcaa

SEQ ID NO: 1369899 - DNA, 22 bp, Artificial Sequence
  chemically synthesized
cactttattcttctttgtcaag

SEQ ID NO: 1369900 - DNA, 22 bp, Artificial Sequence
  chemically synthesized
tattcttctttgtcaagattgt

SEQ ID NO: 1369901 - DNA, 22 bp, Artificial Sequence
  chemically synthesized
ataatagctaatacaatcttga

SEQ ID NO: 1369902 - DNA, 22 bp, Artificial Sequence
  chemically synthesized
attcttctttgtcaagattgta

SEQ ID NO: 1369903 - DNA, 22 bp, Artificial Sequence
  chemically synthesized
ttcttctttgtcaagattgtat

SEQ ID NO: 1369904 - DNA, 22 bp, Artificial Sequence
  chemically synthesized
ttctttgtcaagattgtattag

SEQ ID NO: 1369905 - DNA, 22 bp, Artificial Sequence
  chemically synthesized
ctttgtcaagattgtattagct

SEQ ID NO: 1369906 - DNA, 22 bp, Artificial Sequence
  chemically synthesized
tttgtcaagattgtattagcta

SEQ ID NO: 1369907 - DNA, 22 bp, Artificial Sequence
  chemically synthesized
tgtcaagattgtattagctatt

SEQ ID NO: 1369908 - DNA, 22 bp, Artificial Sequence
  chemically synthesized
gtcaagattgtattagctatta

SEQ ID NO: 1369909 - DNA, 22 bp, Artificial Sequence
  chemically synthesized
tcaagattgtattagctattat

SEQ ID NO: 1369910 - DNA, 22 bp, Artificial Sequence
  chemically synthesized
tacggaaaagtacaagcctgat

SEQ ID NO: 1369911 - DNA, 22 bp, Artificial Sequence
  chemically synthesized
tattagctattatcaggcttgt

SEQ ID NO: 1369912 - DNA, 22 bp, Artificial Sequence
  chemically synthesized
atacggaaaagtacaagcctga

SEQ ID NO: 1369913 - DNA, 22 bp, Artificial Sequence
  chemically synthesized
gctattatcaggcttgtacttt

SEQ ID NO: 1369914 - DNA, 22 bp, Artificial Sequence
  chemically synthesized
aatttatacggaaaagtacaag

SEQ ID NO: 1369915 - DNA, 22 bp, Artificial Sequence
  chemically synthesized
taaatttatacggaaaagtaca

SEQ ID NO: 1369916 - DNA, 22 bp, Artificial Sequence
  chemically synthesized
ttatcaggcttgtacttttccg

SEQ ID NO: 1369917 - DNA, 22 bp, Artificial Sequence
  chemically synthesized
ttctaaatttatacggaaaagt

SEQ ID NO: 1369918 - DNA, 22 bp, Artificial Sequence
  chemically synthesized
attctaaatttatacggaaaag

SEQ ID NO: 1369919 - DNA, 22 bp, Artificial Sequence
  chemically synthesized
tcaggcttgtacttttccgtat

SEQ ID NO: 1369920 - DNA, 22 bp, Artificial Sequence
  chemically synthesized
gtacttttccgtataaatttag

SEQ ID NO: 1369921 - DNA, 22 bp, Artificial Sequence
  chemically synthesized
gatcagcttattctaaatttat

SEQ ID NO: 1369922 - DNA, 22 bp, Artificial Sequence
  chemically synthesized
tacttttccgtataaatttaga

SEQ ID NO: 1369923 - DNA, 22 bp, Artificial Sequence
  chemically synthesized
ggatcagcttattctaaattta

SEQ ID NO: 1369924 - DNA, 22 bp, Artificial Sequence
  chemically synthesized
ttccgtataaatttagaataag

SEQ ID NO: 1369925 - DNA, 22 bp, Artificial Sequence
  chemically synthesized
tccgtataaatttagaataagc

SEQ ID NO: 1369926 - DNA, 22 bp, Artificial Sequence
  chemically synthesized
ccgtataaatttagaataagct

SEQ ID NO: 1369927 - DNA, 22 bp, Artificial Sequence
  chemically synthesized
cgtataaatttagaataagctg

SEQ ID NO: 1369928 - DNA, 22 bp, Artificial Sequence
  chemically synthesized
gtagacttggatcagcttattc

SEQ ID NO: 1369929 - DNA, 22 bp, Artificial Sequence
  chemically synthesized
agtagacttggatcagcttatt

SEQ ID NO: 1369930 - DNA, 22 bp, Artificial Sequence
  chemically synthesized
tagtagacttggatcagcttat

SEQ ID NO: 1369931 - DNA, 22 bp, Artificial Sequence
  chemically synthesized
ttagtagacttggatcagctta

SEQ ID NO: 1369932 - DNA, 22 bp, Artificial Sequence
  chemically synthesized
tttagtagacttggatcagctt

SEQ ID NO: 1369933 - DNA, 22 bp, Artificial Sequence
  chemically synthesized
agaataagctgatccaagtcta

SEQ ID NO: 1369934 - DNA, 22 bp, Artificial Sequence
  chemically synthesized
gaataagctgatccaagtctac

SEQ ID NO: 1369935 - DNA, 22 bp, Artificial Sequence
  chemically synthesized
atccaagtctactaaaaagacc

SEQ ID NO: 1369936 - DNA, 22 bp, Artificial Sequence
  chemically synthesized
aaataccagcaaggtcttttta

SEQ ID NO: 1369937 - DNA, 22 bp, Artificial Sequence
  chemically synthesized
ctaaaataccagcaaggtcttt

SEQ ID NO: 1369938 - DNA, 22 bp, Artificial Sequence
  chemically synthesized
tactaaaataccagcaaggtct

SEQ ID NO: 1369939 - DNA, 22 bp, Artificial Sequence
  chemically synthesized
ctactaaaataccagcaaggtc

SEQ ID NO: 1369940 - DNA, 22 bp, Artificial Sequence
  chemically synthesized
ctaaaaagaccttgctggtatt

SEQ ID NO: 1369941 - DNA, 22 bp, Artificial Sequence
  chemically synthesized
aaaagaccttgctggtatttta

SEQ ID NO: 1369942 - DNA, 22 bp, Artificial Sequence
  chemically synthesized
atgccatttctactaaaatacc

SEQ ID NO: 1369943 - DNA, 22 bp, Artificial Sequence
  chemically synthesized
aatgccatttctactaaaatac

SEQ ID NO: 1369944 - DNA, 22 bp, Artificial Sequence
  chemically synthesized
taatgccatttctactaaaata

SEQ ID NO: 1369945 - DNA, 22 bp, Artificial Sequence
  chemically synthesized
tagttttaatgccatttctact

SEQ ID NO: 1369946 - DNA, 22 bp, Artificial Sequence
  chemically synthesized
gctggtattttagtagaaatgg

SEQ ID NO: 1369947 - DNA, 22 bp, Artificial Sequence
  chemically synthesized
ctggtattttagtagaaatggc

SEQ ID NO: 1369948 - DNA, 22 bp, Artificial Sequence
  chemically synthesized
gtattttagtagaaatggcatt

SEQ ID NO: 1369949 - DNA, 22 bp, Artificial Sequence
  chemically synthesized
atctatagttttaatgccattt

SEQ ID NO: 1369950 - DNA, 22 bp, Artificial Sequence
  chemically synthesized
tagtagaaatggcattaaaact

SEQ ID NO: 1369951 - DNA, 22 bp, Artificial Sequence
  chemically synthesized
agtagaaatggcattaaaacta

SEQ ID NO: 1369952 - DNA, 22 bp, Artificial Sequence
  chemically synthesized
caaattaatctatagttttaat

SEQ ID NO: 1369953 - DNA, 22 bp, Artificial Sequence
  chemically synthesized
gtagaaatggcattaaaactat

SEQ ID NO: 1369954 - DNA, 22 bp, Artificial Sequence
  chemically synthesized
tctccaaattaatctatagttt

SEQ ID NO: 1369955 - DNA, 22 bp, Artificial Sequence
  chemically synthesized
aaactatagattaatttggaga

SEQ ID NO: 1369956 - DNA, 22 bp, Artificial Sequence
  chemically synthesized
tagattaatttggagataattg

SEQ ID NO: 1369957 - DNA, 22 bp, Artificial Sequence
  chemically synthesized
aacatggtaaagatgtcaatta

SEQ ID NO: 1369958 - DNA, 22 bp, Artificial Sequence
  chemically synthesized
atttggagataattgacatctt

SEQ ID NO: 1369959 - DNA, 22 bp, Artificial Sequence
  chemically synthesized
ggagataattgacatctttacc

SEQ ID NO: 1369960 - DNA, 22 bp, Artificial Sequence
  chemically synthesized
gagataattgacatctttacca

SEQ ID NO: 1369961 - DNA, 22 bp, Artificial Sequence
  chemically synthesized
gaatactcaacatggtaaagat

SEQ ID NO: 1369962 - DNA, 22 bp, Artificial Sequence
  chemically synthesized
atggattggaatactcaacatg

SEQ ID NO: 1369963 - DNA, 22 bp, Artificial Sequence
  chemically synthesized
acatctttaccatgttgagtat

SEQ ID NO: 1369964 - DNA, 22 bp, Artificial Sequence
  chemically synthesized
ctaatggattggaatactcaac

SEQ ID NO: 1369965 - DNA, 22 bp, Artificial Sequence
  chemically synthesized
tgctaatggattggaatactca

SEQ ID NO: 1369966 - DNA, 22 bp, Artificial Sequence
  chemically synthesized
taccatgttgagtattccaatc

SEQ ID NO: 1369967 - DNA, 22 bp, Artificial Sequence
  chemically synthesized
accatgttgagtattccaatcc

SEQ ID NO: 1369968 - DNA, 22 bp, Artificial Sequence
  chemically synthesized
ccatgttgagtattccaatcca

SEQ ID NO: 1369969 - DNA, 22 bp, Artificial Sequence
  chemically synthesized
agtattccaatccattagcaga

SEQ ID NO: 1369970 - DNA, 22 bp, Artificial Sequence
  chemically synthesized
taaatggagagatatactctgc

SEQ ID NO: 1369971 - DNA, 22 bp, Artificial Sequence
  chemically synthesized
ataaatggagagatatactctg

SEQ ID NO: 1369972 - DNA, 22 bp, Artificial Sequence
  chemically synthesized
caatccattagcagagtatatc

SEQ ID NO: 1369973 - DNA, 22 bp, Artificial Sequence
  chemically synthesized
acttataaatggagagatatac

SEQ ID NO: 1369974 - DNA, 22 bp, Artificial Sequence
  chemically synthesized
gcagagtatatctctccattta

SEQ ID NO: 1369975 - DNA, 22 bp, Artificial Sequence
  chemically synthesized
tccatttataagttaatttttt

SEQ ID NO: 1369976 - DNA, 22 bp, Artificial Sequence
  chemically synthesized
catttataagttaattttttat

SEQ ID NO: 1369977 - DNA, 22 bp, Artificial Sequence
  chemically synthesized
aaaaacacagcatgataaaaaa

SEQ ID NO: 1369978 - DNA, 22 bp, Artificial Sequence
  chemically synthesized
ataagttaattttttatcatgc

SEQ ID NO: 1369979 - DNA, 22 bp, Artificial Sequence
  chemically synthesized
ttgaaaaacacagcatgataaa

SEQ ID NO: 1369980 - DNA, 22 bp, Artificial Sequence
  chemically synthesized
taagttaattttttatcatgct

SEQ ID NO: 1369981 - DNA, 22 bp, Artificial Sequence
  chemically synthesized
attttttatcatgctgtgtttt

SEQ ID NO: 1369982 - DNA, 22 bp, Artificial Sequence
  chemically synthesized
tttatcatgctgtgtttttcaa

SEQ ID NO: 1369983 - DNA, 22 bp, Artificial Sequence
  chemically synthesized
ttatcatgctgtgtttttcaac

SEQ ID NO: 1369984 - DNA, 22 bp, Artificial Sequence
  chemically synthesized
tatcatgctgtgtttttcaaca

SEQ ID NO: 1369985 - DNA, 22 bp, Artificial Sequence
  chemically synthesized
aatgcaaaacactgttgaaaaa

SEQ ID NO: 1369986 - DNA, 22 bp, Artificial Sequence
  chemically synthesized
atcatgctgtgtttttcaacag

SEQ ID NO: 1369987 - DNA, 22 bp, Artificial Sequence
  chemically synthesized
tcatgctgtgtttttcaacagt

SEQ ID NO: 1369988 - DNA, 22 bp, Artificial Sequence
  chemically synthesized
atctcaatgcaaaacactgttg

SEQ ID NO: 1369989 - DNA, 22 bp, Artificial Sequence
  chemically synthesized
tgtttttcaacagtgttttgca

SEQ ID NO: 1369990 - DNA, 22 bp, Artificial Sequence
  chemically synthesized
ttcaacagtgttttgcattgag

SEQ ID NO: 1369991 - DNA, 22 bp, Artificial Sequence
  chemically synthesized
tcaacagtgttttgcattgaga

SEQ ID NO: 1369992 - DNA, 22 bp, Artificial Sequence
  chemically synthesized
caacagtgttttgcattgagat

SEQ ID NO: 1369993 - DNA, 22 bp, Artificial Sequence
  chemically synthesized
aacagtgttttgcattgagatt

SEQ ID NO: 1369994 - DNA, 22 bp, Artificial Sequence
  chemically synthesized
gaaatatgaaaacacagtctaa

SEQ ID NO: 1369995 - DNA, 22 bp, Artificial Sequence
  chemically synthesized
tgcattgagattagactgtgtt

SEQ ID NO: 1369996 - DNA, 22 bp, Artificial Sequence
  chemically synthesized
gcattgagattagactgtgttt

SEQ ID NO: 1369997 - DNA, 22 bp, Artificial Sequence
  chemically synthesized
cattgagattagactgtgtttt

SEQ ID NO: 1369998 - DNA, 22 bp, Artificial Sequence
  chemically synthesized
agattagactgtgttttcatat

SEQ ID NO: 1369999 - DNA, 22 bp, Artificial Sequence
  chemically synthesized
taagtatattagaaatatgaaa

SEQ ID NO: 1370000 - DNA, 22 bp, Artificial Sequence
  chemically synthesized
gactgtgttttcatatttctaa

SEQ ID NO: 1370001 - DNA, 22 bp, Artificial Sequence
  chemically synthesized
tgttttcatatttctaatatac

SEQ ID NO: 1370002 - DNA, 22 bp, Artificial Sequence
  chemically synthesized
tcatatttctaatatacttaca

SEQ ID NO: 1370003 - DNA, 22 bp, Artificial Sequence
  chemically synthesized
catatttctaatatacttacaa

SEQ ID NO: 1370004 - DNA, 22 bp, Artificial Sequence
  chemically synthesized
atatttctaatatacttacaat

SEQ ID NO: 1370005 - DNA, 22 bp, Artificial Sequence
  chemically synthesized
ctaatatacttacaatgtgcta

SEQ ID NO: 1370006 - DNA, 22 bp, Artificial Sequence
  chemically synthesized
taatatacttacaatgtgctat

SEQ ID NO: 1370007 - DNA, 22 bp, Artificial Sequence
  chemically synthesized
atatacttacaatgtgctattg

SEQ ID NO: 1370008 - DNA, 22 bp, Artificial Sequence
  chemically synthesized
acaatgtgctattgtctgctat

SEQ ID NO: 1370009 - DNA, 22 bp, Artificial Sequence
  chemically synthesized
caatgtgctattgtctgctatg

SEQ ID NO: 1370010 - DNA, 22 bp, Artificial Sequence
  chemically synthesized
tgtaatcacatgcatagcagac

SEQ ID NO: 1370011 - DNA, 22 bp, Artificial Sequence
  chemically synthesized
gtgtaatcacatgcatagcaga

SEQ ID NO: 1370012 - DNA, 22 bp, Artificial Sequence
  chemically synthesized
tgtgtaatcacatgcatagcag

SEQ ID NO: 1370013 - DNA, 22 bp, Artificial Sequence
  chemically synthesized
ttgtctgctatgcatgtgatta

SEQ ID NO: 1370014 - DNA, 22 bp, Artificial Sequence
  chemically synthesized
gcaatctttgtgtaatcacatg

SEQ ID NO: 1370015 - DNA, 22 bp, Artificial Sequence
  chemically synthesized
tctgctatgcatgtgattacac

SEQ ID NO: 1370016 - DNA, 22 bp, Artificial Sequence
  chemically synthesized
tgttcgcaatctttgtgtaatc

SEQ ID NO: 1370017 - DNA, 22 bp, Artificial Sequence
  chemically synthesized
ctatgcatgtgattacacaaag

SEQ ID NO: 1370018 - DNA, 22 bp, Artificial Sequence
  chemically synthesized
ctatgttcgcaatctttgtgta

SEQ ID NO: 1370019 - DNA, 22 bp, Artificial Sequence
  chemically synthesized
gctatgttcgcaatctttgtgt

SEQ ID NO: 1370020 - DNA, 22 bp, Artificial Sequence
  chemically synthesized
tgcatgtgattacacaaagatt

SEQ ID NO: 1370021 - DNA, 22 bp, Artificial Sequence
  chemically synthesized
tgctatgttcgcaatctttgtg

SEQ ID NO: 1370022 - DNA, 22 bp, Artificial Sequence
  chemically synthesized
ttgctatgttcgcaatctttgt

SEQ ID NO: 1370023 - DNA, 22 bp, Artificial Sequence
  chemically synthesized
gaccttttgctatgttcgcaat

SEQ ID NO: 1370024 - DNA, 22 bp, Artificial Sequence
  chemically synthesized
agaccttttgctatgttcgcaa

SEQ ID NO: 1370025 - DNA, 22 bp, Artificial Sequence
  chemically synthesized
tagaccttttgctatgttcgca

SEQ ID NO: 1370026 - DNA, 22 bp, Artificial Sequence
  chemically synthesized
cacaaagattgcgaacatagca

SEQ ID NO: 1370027 - DNA, 22 bp, Artificial Sequence
  chemically synthesized
aatcataattttagaccttttg

SEQ ID NO: 1370028 - DNA, 22 bp, Artificial Sequence
  chemically synthesized
taaatcataattttagaccttt

SEQ ID NO: 1370029 - DNA, 22 bp, Artificial Sequence
  chemically synthesized
cgaacatagcaaaaggtctaaa

SEQ ID NO: 1370030 - DNA, 22 bp, Artificial Sequence
  chemically synthesized
ctaaatcataattttagacctt

SEQ ID NO: 1370031 - DNA, 22 bp, Artificial Sequence
  chemically synthesized
tctaaatcataattttagacct

SEQ ID NO: 1370032 - DNA, 22 bp, Artificial Sequence
  chemically synthesized
ttctaaatcataattttagacc

SEQ ID NO: 1370033 - DNA, 22 bp, Artificial Sequence
  chemically synthesized
ttttctaaatcataattttaga

SEQ ID NO: 1370034 - DNA, 22 bp, Artificial Sequence
  chemically synthesized
cttttctaaatcataattttag

SEQ ID NO: 1370035 - DNA, 22 bp, Artificial Sequence
  chemically synthesized
tcttttctaaatcataatttta

SEQ ID NO: 1370036 - DNA, 22 bp, Artificial Sequence
  chemically synthesized
ctttcttttctaaatcataatt

SEQ ID NO: 1370037 - DNA, 22 bp, Artificial Sequence
  chemically synthesized
aaatctgctttcttttctaaat

SEQ ID NO: 1370038 - DNA, 22 bp, Artificial Sequence
  chemically synthesized
aaaatctgctttcttttctaaa

SEQ ID NO: 1370039 - DNA, 22 bp, Artificial Sequence
  chemically synthesized
taaaatctgctttcttttctaa

SEQ ID NO: 1370040 - DNA, 22 bp, Artificial Sequence
  chemically synthesized
ttaaaatctgctttcttttcta

SEQ ID NO: 1370041 - DNA, 22 bp, Artificial Sequence
  chemically synthesized
aaattatgatttagaaaagaaa

SEQ ID NO: 1370042 - DNA, 22 bp, Artificial Sequence
  chemically synthesized
ggtttttaaaatctgctttctt

SEQ ID NO: 1370043 - DNA, 22 bp, Artificial Sequence
  chemically synthesized
aggtttttaaaatctgctttct

SEQ ID NO: 1370044 - DNA, 22 bp, Artificial Sequence
  chemically synthesized
tgatttagaaaagaaagcagat

SEQ ID NO: 1370045 - DNA, 22 bp, Artificial Sequence
  chemically synthesized
agaaaagaaagcagattttaaa

SEQ ID NO: 1370046 - DNA, 22 bp, Artificial Sequence
  chemically synthesized
gaaaagaaagcagattttaaaa

SEQ ID NO: 1370047 - DNA, 22 bp, Artificial Sequence
  chemically synthesized
tagtcgtttaggtttttaaaat

SEQ ID NO: 1370048 - DNA, 22 bp, Artificial Sequence
  chemically synthesized
gctatagtcgtttaggttttta

SEQ ID NO: 1370049 - DNA, 22 bp, Artificial Sequence
  chemically synthesized
agctatagtcgtttaggttttt

SEQ ID NO: 1370050 - DNA, 22 bp, Artificial Sequence
  chemically synthesized
taaaaacctaaacgactatagc

SEQ ID NO: 1370051 - DNA, 22 bp, Artificial Sequence
  chemically synthesized
aaaaacctaaacgactatagct

SEQ ID NO: 1370052 - DNA, 22 bp, Artificial Sequence
  chemically synthesized
aaaacctaaacgactatagcta

SEQ ID NO: 1370053 - DNA, 22 bp, Artificial Sequence
  chemically synthesized
aacgactatagctaaatataca

SEQ ID NO: 1370054 - DNA, 22 bp, Artificial Sequence
  chemically synthesized
aacatcatacacatatggtgta

SEQ ID NO: 1370055 - DNA, 22 bp, Artificial Sequence
  chemically synthesized
caacatcatacacatatggtgt

SEQ ID NO: 1370056 - DNA, 22 bp, Artificial Sequence
  chemically synthesized
tagctaaatatacaccatatgt

SEQ ID NO: 1370057 - DNA, 22 bp, Artificial Sequence
  chemically synthesized
tttcaacatcatacacatatgg

SEQ ID NO: 1370058 - DNA, 22 bp, Artificial Sequence
  chemically synthesized
aatatacaccatatgtgtatga

SEQ ID NO: 1370059 - DNA, 22 bp, Artificial Sequence
  chemically synthesized
aaattatttcaacatcatacac

SEQ ID NO: 1370060 - DNA, 22 bp, Artificial Sequence
  chemically synthesized
aaaattatttcaacatcataca

SEQ ID NO: 1370061 - DNA, 22 bp, Artificial Sequence
  chemically synthesized
cttaaaattatttcaacatcat

SEQ ID NO: 1370062 - DNA, 22 bp, Artificial Sequence
  chemically synthesized
ttacttaaaattatttcaacat

SEQ ID NO: 1370063 - DNA, 22 bp, Artificial Sequence
  chemically synthesized
attacttaaaattatttcaaca

SEQ ID NO: 1370064 - DNA, 22 bp, Artificial Sequence
  chemically synthesized
taatcttattacttaaaattat

SEQ ID NO: 1370065 - DNA, 22 bp, Artificial Sequence
  chemically synthesized
aaataattttaagtaataagat

SEQ ID NO: 1370066 - DNA, 22 bp, Artificial Sequence
  chemically synthesized
taaacaattataatcttattac

SEQ ID NO: 1370067 - DNA, 22 bp, Artificial Sequence
  chemically synthesized
tataaacaattataatcttatt

SEQ ID NO: 1370068 - DNA, 22 bp, Artificial Sequence
  chemically synthesized
taagtaataagattataattgt

SEQ ID NO: 1370069 - DNA, 22 bp, Artificial Sequence
  chemically synthesized
aagtaataagattataattgtt

SEQ ID NO: 1370070 - DNA, 22 bp, Artificial Sequence
  chemically synthesized
agtaataagattataattgttt

SEQ ID NO: 1370071 - DNA, 22 bp, Artificial Sequence
  chemically synthesized
tcaatccctctataaacaatta

SEQ ID NO: 1370072 - DNA, 22 bp, Artificial Sequence
  chemically synthesized
tatcaatccctctataaacaat

SEQ ID NO: 1370073 - DNA, 22 bp, Artificial Sequence
  chemically synthesized
caggtctctatcaatccctcta

SEQ ID NO: 1370074 - DNA, 22 bp, Artificial Sequence
  chemically synthesized
taattgtttatagagggattga

SEQ ID NO: 1370075 - DNA, 22 bp, Artificial Sequence
  chemically synthesized
tttatagagggattgatagaga

SEQ ID NO: 1370076 - DNA, 22 bp, Artificial Sequence
  chemically synthesized
atagagggattgatagagacct

SEQ ID NO: 1370077 - DNA, 22 bp, Artificial Sequence
  chemically synthesized
atgaaaaattacaggtctctat

SEQ ID NO: 1370078 - DNA, 22 bp, Artificial Sequence
  chemically synthesized
tagagggattgatagagacctg

SEQ ID NO: 1370079 - DNA, 22 bp, Artificial Sequence
  chemically synthesized
cattcatgaaaaattacaggtc

SEQ ID NO: 1370080 - DNA, 22 bp, Artificial Sequence
  chemically synthesized
gcattcatgaaaaattacaggt

SEQ ID NO: 1370081 - DNA, 22 bp, Artificial Sequence
  chemically synthesized
tgcattcatgaaaaattacagg

SEQ ID NO: 1370082 - DNA, 22 bp, Artificial Sequence
  chemically synthesized
atagagacctgtaatttttcat

SEQ ID NO: 1370083 - DNA, 22 bp, Artificial Sequence
  chemically synthesized
aaatatattttgcattcatgaa

SEQ ID NO: 1370084 - DNA, 22 bp, Artificial Sequence
  chemically synthesized
taatttttcatgaatgcaaaat

SEQ ID NO: 1370085 - DNA, 22 bp, Artificial Sequence
  chemically synthesized
atgtaattaaaatatattttgc

SEQ ID NO: 1370086 - DNA, 22 bp, Artificial Sequence
  chemically synthesized
aatgtaattaaaatatattttg

SEQ ID NO: 1370087 - DNA, 22 bp, Artificial Sequence
  chemically synthesized
taatgtaattaaaatatatttt

SEQ ID NO: 1370088 - DNA, 22 bp, Artificial Sequence
  chemically synthesized
ttcatgaatgcaaaatatattt

SEQ ID NO: 1370089 - DNA, 22 bp, Artificial Sequence
  chemically synthesized
tcatgaatgcaaaatatatttt

SEQ ID NO: 1370090 - DNA, 22 bp, Artificial Sequence
  chemically synthesized
catgaatgcaaaatatatttta

SEQ ID NO: 1370091 - DNA, 22 bp, Artificial Sequence
  chemically synthesized
atgaatgcaaaatatattttaa

SEQ ID NO: 1370092 - DNA, 22 bp, Artificial Sequence
  chemically synthesized
atgcatgactttaatgtaatta

SEQ ID NO: 1370093 - DNA, 22 bp, Artificial Sequence
  chemically synthesized
tgatgcatgactttaatgtaat

SEQ ID NO: 1370094 - DNA, 22 bp, Artificial Sequence
  chemically synthesized
taattacattaaagtcatgcat

SEQ ID NO: 1370095 - DNA, 22 bp, Artificial Sequence
  chemically synthesized
aaaaacactctgatgcatgact

SEQ ID NO: 1370096 - DNA, 22 bp, Artificial Sequence
  chemically synthesized
aattacattaaagtcatgcatc

SEQ ID NO: 1370097 - DNA, 22 bp, Artificial Sequence
  chemically synthesized
attacattaaagtcatgcatca

SEQ ID NO: 1370098 - DNA, 22 bp, Artificial Sequence
  chemically synthesized
cattaaagtcatgcatcagagt

SEQ ID NO: 1370099 - DNA, 22 bp, Artificial Sequence
  chemically synthesized
aagtcatgcatcagagtgtttt

SEQ ID NO: 1370100 - DNA, 22 bp, Artificial Sequence
  chemically synthesized
aagaaaagtaattaaaaaacac

SEQ ID NO: 1370101 - DNA, 22 bp, Artificial Sequence
  chemically synthesized
taggctaaagaaaagtaattaa

SEQ ID NO: 1370102 - DNA, 22 bp, Artificial Sequence
  chemically synthesized
tttaattacttttctttagcct

SEQ ID NO: 1370103 - DNA, 22 bp, Artificial Sequence
  chemically synthesized
ttaattacttttctttagccta

SEQ ID NO: 1370104 - DNA, 22 bp, Artificial Sequence
  chemically synthesized
taattacttttctttagcctac

SEQ ID NO: 1370105 - DNA, 22 bp, Artificial Sequence
  chemically synthesized
aattacttttctttagcctaca

SEQ ID NO: 1370106 - DNA, 22 bp, Artificial Sequence
  chemically synthesized
attacttttctttagcctacag

SEQ ID NO: 1370107 - DNA, 22 bp, Artificial Sequence
  chemically synthesized
cttttctttagcctacagtttt

SEQ ID NO: 1370108 - DNA, 22 bp, Artificial Sequence
  chemically synthesized
caacatgtatcataaaactgta

SEQ ID NO: 1370109 - DNA, 22 bp, Artificial Sequence
  chemically synthesized
acaacatgtatcataaaactgt

SEQ ID NO: 1370110 - DNA, 22 bp, Artificial Sequence
  chemically synthesized
ttctttagcctacagttttatg

SEQ ID NO: 1370111 - DNA, 22 bp, Artificial Sequence
  chemically synthesized
tacaacatgtatcataaaactg

SEQ ID NO: 1370112 - DNA, 22 bp, Artificial Sequence
  chemically synthesized
tctttagcctacagttttatga

SEQ ID NO: 1370113 - DNA, 22 bp, Artificial Sequence
  chemically synthesized
ctttagcctacagttttatgat

SEQ ID NO: 1370114 - DNA, 22 bp, Artificial Sequence
  chemically synthesized
tttagcctacagttttatgata

SEQ ID NO: 1370115 - DNA, 22 bp, Artificial Sequence
  chemically synthesized
attttacaacatgtatcataaa

SEQ ID NO: 1370116 - DNA, 22 bp, Artificial Sequence
  chemically synthesized
tagcctacagttttatgataca

SEQ ID NO: 1370117 - DNA, 22 bp, Artificial Sequence
  chemically synthesized
cattttacaacatgtatcataa

SEQ ID NO: 1370118 - DNA, 22 bp, Artificial Sequence
  chemically synthesized
agcctacagttttatgatacat

SEQ ID NO: 1370119 - DNA, 22 bp, Artificial Sequence
  chemically synthesized
gcctacagttttatgatacatg

SEQ ID NO: 1370120 - DNA, 22 bp, Artificial Sequence
  chemically synthesized
cagttttatgatacatgttgta

SEQ ID NO: 1370121 - DNA, 22 bp, Artificial Sequence
  chemically synthesized
tatgatacatgttgtaaaatga

SEQ ID NO: 1370122 - DNA, 22 bp, Artificial Sequence
  chemically synthesized
atgatacatgttgtaaaatgaa

SEQ ID NO: 1370123 - DNA, 22 bp, Artificial Sequence
  chemically synthesized
tgatacatgttgtaaaatgaag

SEQ ID NO: 1370124 - DNA, 22 bp, Artificial Sequence
  chemically synthesized
caatataagcaaggaccagtct

SEQ ID NO: 1370125 - DNA, 22 bp, Artificial Sequence
  chemically synthesized
taaaatgaagactggtccttgc

SEQ ID NO: 1370126 - DNA, 22 bp, Artificial Sequence
  chemically synthesized
atactgcaatataagcaaggac

SEQ ID NO: 1370127 - DNA, 22 bp, Artificial Sequence
  chemically synthesized
gtccttgcttatattgcagtat

SEQ ID NO: 1370128 - DNA, 22 bp, Artificial Sequence
  chemically synthesized
tgatacaggttaatactgcaat

SEQ ID NO: 1370129 - DNA, 22 bp, Artificial Sequence
  chemically synthesized
atgatacaggttaatactgcaa

SEQ ID NO: 1370130 - DNA, 22 bp, Artificial Sequence
  chemically synthesized
tatgatacaggttaatactgca

SEQ ID NO: 1370131 - DNA, 22 bp, Artificial Sequence
  chemically synthesized
ttttatgatacaggttaatact

SEQ ID NO: 1370132 - DNA, 22 bp, Artificial Sequence
  chemically synthesized
gcttatattgcagtattaacct

SEQ ID NO: 1370133 - DNA, 22 bp, Artificial Sequence
  chemically synthesized
cttatattgcagtattaacctg

SEQ ID NO: 1370134 - DNA, 22 bp, Artificial Sequence
  chemically synthesized
atattgcagtattaacctgtat

SEQ ID NO: 1370135 - DNA, 22 bp, Artificial Sequence
  chemically synthesized
tattgcagtattaacctgtatc

SEQ ID NO: 1370136 - DNA, 22 bp, Artificial Sequence
  chemically synthesized
tcatctgttttatgatacaggt

SEQ ID NO: 1370137 - DNA, 22 bp, Artificial Sequence
  chemically synthesized
gtcatctgttttatgatacagg

SEQ ID NO: 1370138 - DNA, 22 bp, Artificial Sequence
  chemically synthesized
cagtattaacctgtatcataaa

SEQ ID NO: 1370139 - DNA, 22 bp, Artificial Sequence
  chemically synthesized
agagtttgtcatctgttttatg

SEQ ID NO: 1370140 - DNA, 22 bp, Artificial Sequence
  chemically synthesized
taagagtttgtcatctgtttta

SEQ ID NO: 1370141 - DNA, 22 bp, Artificial Sequence
  chemically synthesized
acctgtatcataaaacagatga

SEQ ID NO: 1370142 - DNA, 22 bp, Artificial Sequence
  chemically synthesized
gttctaagagtttgtcatctgt

SEQ ID NO: 1370143 - DNA, 22 bp, Artificial Sequence
  chemically synthesized
agttctaagagtttgtcatctg

SEQ ID NO: 1370144 - DNA, 22 bp, Artificial Sequence
  chemically synthesized
tatcataaaacagatgacaaac

SEQ ID NO: 1370145 - DNA, 22 bp, Artificial Sequence
  chemically synthesized
ttagttctaagagtttgtcatc

SEQ ID NO: 1370146 - DNA, 22 bp, Artificial Sequence
  chemically synthesized
gtgctcttagttctaagagttt

SEQ ID NO: 1370147 - DNA, 22 bp, Artificial Sequence
  chemically synthesized
agtgctcttagttctaagagtt

SEQ ID NO: 1370148 - DNA, 22 bp, Artificial Sequence
  chemically synthesized
aatttagtgctcttagttctaa

SEQ ID NO: 1370149 - DNA, 22 bp, Artificial Sequence
  chemically synthesized
aaatttagtgctcttagttcta

SEQ ID NO: 1370150 - DNA, 22 bp, Artificial Sequence
  chemically synthesized
taaatttagtgctcttagttct

SEQ ID NO: 1370151 - DNA, 22 bp, Artificial Sequence
  chemically synthesized
ttaaatttagtgctcttagttc

SEQ ID NO: 1370152 - DNA, 22 bp, Artificial Sequence
  chemically synthesized
acttttaaatttagtgctctta

SEQ ID NO: 1370153 - DNA, 22 bp, Artificial Sequence
  chemically synthesized
ttcacttttaaatttagtgctc

SEQ ID NO: 1370154 - DNA, 22 bp, Artificial Sequence
  chemically synthesized
gttcacttttaaatttagtgct

SEQ ID NO: 1370155 - DNA, 22 bp, Artificial Sequence
  chemically synthesized
ttagaactaagagcactaaatt

SEQ ID NO: 1370156 - DNA, 22 bp, Artificial Sequence
  chemically synthesized
ttgttcacttttaaatttagtg

SEQ ID NO: 1370157 - DNA, 22 bp, Artificial Sequence
  chemically synthesized
agaactaagagcactaaattta

SEQ ID NO: 1370158 - DNA, 22 bp, Artificial Sequence
  chemically synthesized
cttgttcacttttaaatttagt

SEQ ID NO: 1370159 - DNA, 22 bp, Artificial Sequence
  chemically synthesized
gaactaagagcactaaatttaa

SEQ ID NO: 1370160 - DNA, 22 bp, Artificial Sequence
  chemically synthesized
atttcttgttcacttttaaatt

SEQ ID NO: 1370161 - DNA, 22 bp, Artificial Sequence
  chemically synthesized
agagcactaaatttaaaagtga

SEQ ID NO: 1370162 - DNA, 22 bp, Artificial Sequence
  chemically synthesized
agaattcatttcttgttcactt

SEQ ID NO: 1370163 - DNA, 22 bp, Artificial Sequence
  chemically synthesized
aagaattcatttcttgttcact

SEQ ID NO: 1370164 - DNA, 22 bp, Artificial Sequence
  chemically synthesized
aatttaaaagtgaacaagaaat

SEQ ID NO: 1370165 - DNA, 22 bp, Artificial Sequence
  chemically synthesized
agatacttaagaattcatttct

SEQ ID NO: 1370166 - DNA, 22 bp, Artificial Sequence
  chemically synthesized
aaaagtgaacaagaaatgaatt

SEQ ID NO: 1370167 - DNA, 22 bp, Artificial Sequence
  chemically synthesized
aagatacttaagaattcatttc

SEQ ID NO: 1370168 - DNA, 22 bp, Artificial Sequence
  chemically synthesized
aaagtgaacaagaaatgaattc

SEQ ID NO: 1370169 - DNA, 22 bp, Artificial Sequence
  chemically synthesized
taagatacttaagaattcattt

SEQ ID NO: 1370170 - DNA, 22 bp, Artificial Sequence
  chemically synthesized
gggttttaagatacttaagaat

SEQ ID NO: 1370171 - DNA, 22 bp, Artificial Sequence
  chemically synthesized
agggttttaagatacttaagaa

SEQ ID NO: 1370172 - DNA, 22 bp, Artificial Sequence
  chemically synthesized
tagggttttaagatacttaaga

SEQ ID NO: 1370173 - DNA, 22 bp, Artificial Sequence
  chemically synthesized
aaaatgcctttagggttttaag

SEQ ID NO: 1370174 - DNA, 22 bp, Artificial Sequence
  chemically synthesized
aaaaatgcctttagggttttaa

SEQ ID NO: 1370175 - DNA, 22 bp, Artificial Sequence
  chemically synthesized
taaaaatgcctttagggtttta

SEQ ID NO: 1370176 - DNA, 22 bp, Artificial Sequence
  chemically synthesized
ttaaaaatgcctttagggtttt

SEQ ID NO: 1370177 - DNA, 22 bp, Artificial Sequence
  chemically synthesized
ttaagtatcttaaaaccctaaa

SEQ ID NO: 1370178 - DNA, 22 bp, Artificial Sequence
  chemically synthesized
aagtatcttaaaaccctaaagg

SEQ ID NO: 1370179 - DNA, 22 bp, Artificial Sequence
  chemically synthesized
tttttaaaaatgcctttagggt

SEQ ID NO: 1370180 - DNA, 22 bp, Artificial Sequence
  chemically synthesized
agtatcttaaaaccctaaaggc

SEQ ID NO: 1370181 - DNA, 22 bp, Artificial Sequence
  chemically synthesized
atttttaaaaatgcctttaggg

SEQ ID NO: 1370182 - DNA, 22 bp, Artificial Sequence
  chemically synthesized
aaaaccctaaaggcatttttaa

SEQ ID NO: 1370183 - DNA, 22 bp, Artificial Sequence
  chemically synthesized
aaaccctaaaggcatttttaaa

SEQ ID NO: 1370184 - DNA, 22 bp, Artificial Sequence
  chemically synthesized
aaggcatttttaaaaataaata

SEQ ID NO: 1370185 - DNA, 22 bp, Artificial Sequence
  chemically synthesized
ttaaaaataaatatatatttta

SEQ ID NO: 1370186 - DNA, 22 bp, Artificial Sequence
  chemically synthesized
taaaaataaatatatattttat

SEQ ID NO: 1370187 - DNA, 22 bp, Artificial Sequence
  chemically synthesized
aaaaataaatatatattttatt

SEQ ID NO: 1370188 - DNA, 22 bp, Artificial Sequence
  chemically synthesized
aaaataaatatatattttattt

SEQ ID NO: 1370189 - DNA, 22 bp, Artificial Sequence
  chemically synthesized
catccacaatgtatgatgaaat

SEQ ID NO: 1370190 - DNA, 22 bp, Artificial Sequence
  chemically synthesized
tacatccacaatgtatgatgaa

SEQ ID NO: 1370191 - DNA, 22 bp, Artificial Sequence
  chemically synthesized
tatttcatcatacattgtggat

SEQ ID NO: 1370192 - DNA, 22 bp, Artificial Sequence
  chemically synthesized
atttcatcatacattgtggatg

SEQ ID NO: 1370193 - DNA, 22 bp, Artificial Sequence
  chemically synthesized
tttcatcatacattgtggatgt

SEQ ID NO: 1370194 - DNA, 22 bp, Artificial Sequence
  chemically synthesized
accaatgactctacatccacaa

SEQ ID NO: 1370195 - DNA, 22 bp, Artificial Sequence
  chemically synthesized
tcaccaatgactctacatccac

SEQ ID NO: 1370196 - DNA, 22 bp, Artificial Sequence
  chemically synthesized
catcatacattgtggatgtaga

SEQ ID NO: 1370197 - DNA, 22 bp, Artificial Sequence
  chemically synthesized
ctcaccaatgactctacatcca

SEQ ID NO: 1370198 - DNA, 22 bp, Artificial Sequence
  chemically synthesized
atcatacattgtggatgtagag

SEQ ID NO: 1370199 - DNA, 22 bp, Artificial Sequence
  chemically synthesized
tggatgtagagtcattggtgag

SEQ ID NO: 1370200 - DNA, 22 bp, Artificial Sequence
  chemically synthesized
taatgcaggggatatatttctc

SEQ ID NO: 1370201 - DNA, 22 bp, Artificial Sequence
  chemically synthesized
ttataatgcaggggatatattt

SEQ ID NO: 1370202 - DNA, 22 bp, Artificial Sequence
  chemically synthesized
tattgttataatgcaggggata

SEQ ID NO: 1370203 - DNA, 22 bp, Artificial Sequence
  chemically synthesized
gtgagaaatatatcccctgcat

SEQ ID NO: 1370204 - DNA, 22 bp, Artificial Sequence
  chemically synthesized
caataattatattgttataatg

SEQ ID NO: 1370205 - DNA, 22 bp, Artificial Sequence
  chemically synthesized
ccaataattatattgttataat

SEQ ID NO: 1370206 - DNA, 22 bp, Artificial Sequence
  chemically synthesized
tccaataattatattgttataa

SEQ ID NO: 1370207 - DNA, 22 bp, Artificial Sequence
  chemically synthesized
tactttccaataattatattgt

SEQ ID NO: 1370208 - DNA, 22 bp, Artificial Sequence
  chemically synthesized
cattataacaatataattattg

SEQ ID NO: 1370209 - DNA, 22 bp, Artificial Sequence
  chemically synthesized
taacaatataattattggaaag

SEQ ID NO: 1370210 - DNA, 22 bp, Artificial Sequence
  chemically synthesized
aaagaatattatactttccaat

SEQ ID NO: 1370211 - DNA, 22 bp, Artificial Sequence
  chemically synthesized
gatattaaaagaatattatact

SEQ ID NO: 1370212 - DNA, 22 bp, Artificial Sequence
  chemically synthesized
aattagatattaaaagaatatt

SEQ ID NO: 1370213 - DNA, 22 bp, Artificial Sequence
  chemically synthesized
ttggaaagtataatattctttt

SEQ ID NO: 1370214 - DNA, 22 bp, Artificial Sequence
  chemically synthesized
gaaagtataatattcttttaat

SEQ ID NO: 1370215 - DNA, 22 bp, Artificial Sequence
  chemically synthesized
catgttgaattagatattaaaa

SEQ ID NO: 1370216 - DNA, 22 bp, Artificial Sequence
  chemically synthesized
ttccatgttgaattagatatta

SEQ ID NO: 1370217 - DNA, 22 bp, Artificial Sequence
  chemically synthesized
ttattccatgttgaattagata

SEQ ID NO: 1370218 - DNA, 22 bp, Artificial Sequence
  chemically synthesized
ttttaatatctaattcaacatg

SEQ ID NO: 1370219 - DNA, 22 bp, Artificial Sequence
  chemically synthesized
ttaatatctaattcaacatgga

SEQ ID NO: 1370220 - DNA, 22 bp, Artificial Sequence
  chemically synthesized
aaaatctattattccatgttga

SEQ ID NO: 1370221 - DNA, 22 bp, Artificial Sequence
  chemically synthesized
taatatctaattcaacatggaa

SEQ ID NO: 1370222 - DNA, 22 bp, Artificial Sequence
  chemically synthesized
aatatctaattcaacatggaat

SEQ ID NO: 1370223 - DNA, 22 bp, Artificial Sequence
  chemically synthesized
atatctaattcaacatggaata

SEQ ID NO: 1370224 - DNA, 22 bp, Artificial Sequence
  chemically synthesized
ctgaaaatctattattccatgt

SEQ ID NO: 1370225 - DNA, 22 bp, Artificial Sequence
  chemically synthesized
gctgaaaatctattattccatg

SEQ ID NO: 1370226 - DNA, 22 bp, Artificial Sequence
  chemically synthesized
tgctgaaaatctattattccat

SEQ ID NO: 1370227 - DNA, 22 bp, Artificial Sequence
  chemically synthesized
ttgctgaaaatctattattcca

SEQ ID NO: 1370228 - DNA, 22 bp, Artificial Sequence
  chemically synthesized
cttttgctgaaaatctattatt

SEQ ID NO: 1370229 - DNA, 22 bp, Artificial Sequence
  chemically synthesized
attcaacatggaataatagatt

SEQ ID NO: 1370230 - DNA, 22 bp, Artificial Sequence
  chemically synthesized
cctccttttgctgaaaatctat

SEQ ID NO: 1370231 - DNA, 22 bp, Artificial Sequence
  chemically synthesized
aacatggaataatagattttca

SEQ ID NO: 1370232 - DNA, 22 bp, Artificial Sequence
  chemically synthesized
tcagcaaaaggagggagttgca

SEQ ID NO: 1370233 - DNA, 22 bp, Artificial Sequence
  chemically synthesized
cagcaaaaggagggagttgcat

SEQ ID NO: 1370234 - DNA, 22 bp, Artificial Sequence
  chemically synthesized
agcaaaaggagggagttgcata

SEQ ID NO: 1370235 - DNA, 22 bp, Artificial Sequence
  chemically synthesized
tcaataaaggtcagatatatgc

SEQ ID NO: 1370236 - DNA, 22 bp, Artificial Sequence
  chemically synthesized
catatatctgacctttattgac

SEQ ID NO: 1370237 - DNA, 22 bp, Artificial Sequence
  chemically synthesized
gagacaaaaaggcctgtcaata

SEQ ID NO: 1370238 - DNA, 22 bp, Artificial Sequence
  chemically synthesized
ctggagacaaaaaggcctgtca

SEQ ID NO: 1370239 - DNA, 22 bp, Artificial Sequence
  chemically synthesized
acctttattgacaggccttttt

SEQ ID NO: 1370240 - DNA, 22 bp, Artificial Sequence
  chemically synthesized
ggtaattactggagacaaaaag

SEQ ID NO: 1370241 - DNA, 22 bp, Artificial Sequence
  chemically synthesized
tattgacaggcctttttgtctc

SEQ ID NO: 1370242 - DNA, 22 bp, Artificial Sequence
  chemically synthesized
attgacaggcctttttgtctcc

SEQ ID NO: 1370243 - DNA, 22 bp, Artificial Sequence
  chemically synthesized
ttgacaggcctttttgtctcca

SEQ ID NO: 1370244 - DNA, 22 bp, Artificial Sequence
  chemically synthesized
acaggcctttttgtctccagta

SEQ ID NO: 1370245 - DNA, 22 bp, Artificial Sequence
  chemically synthesized
tttgtctccagtaattacccaa

SEQ ID NO: 1370246 - DNA, 22 bp, Artificial Sequence
  chemically synthesized
ttgtctccagtaattacccaat

SEQ ID NO: 1370247 - DNA, 22 bp, Artificial Sequence
  chemically synthesized
aatcgcatagagattgggtaat

SEQ ID NO: 1370248 - DNA, 22 bp, Artificial Sequence
  chemically synthesized
tgtctccagtaattacccaatc

SEQ ID NO: 1370249 - DNA, 22 bp, Artificial Sequence
  chemically synthesized
gtctccagtaattacccaatct

SEQ ID NO: 1370250 - DNA, 22 bp, Artificial Sequence
  chemically synthesized
tctccagtaattacccaatctc

SEQ ID NO: 1370251 - DNA, 22 bp, Artificial Sequence
  chemically synthesized
cagtaattacccaatctctatg

SEQ ID NO: 1370252 - DNA, 22 bp, Artificial Sequence
  chemically synthesized
agaacactgaatcgcatagaga

SEQ ID NO: 1370253 - DNA, 22 bp, Artificial Sequence
  chemically synthesized
aagaacactgaatcgcatagag

SEQ ID NO: 1370254 - DNA, 22 bp, Artificial Sequence
  chemically synthesized
cttaagaacactgaatcgcata

SEQ ID NO: 1370255 - DNA, 22 bp, Artificial Sequence
  chemically synthesized
ccttaagaacactgaatcgcat

SEQ ID NO: 1370256 - DNA, 22 bp, Artificial Sequence
  chemically synthesized
cccaatctctatgcgattcagt

SEQ ID NO: 1370257 - DNA, 22 bp, Artificial Sequence
  chemically synthesized
gatttccttaagaacactgaat

SEQ ID NO: 1370258 - DNA, 22 bp, Artificial Sequence
  chemically synthesized
tatgcgattcagtgttcttaag

SEQ ID NO: 1370259 - DNA, 22 bp, Artificial Sequence
  chemically synthesized
tgcgattcagtgttcttaagga

SEQ ID NO: 1370260 - DNA, 22 bp, Artificial Sequence
  chemically synthesized
agtgttcttaaggaaatccaac

SEQ ID NO: 1370261 - DNA, 22 bp, Artificial Sequence
  chemically synthesized
agagcaagaaaagttggatttc

SEQ ID NO: 1370262 - DNA, 22 bp, Artificial Sequence
  chemically synthesized
ttaaggaaatccaacttttctt

SEQ ID NO: 1370263 - DNA, 22 bp, Artificial Sequence
  chemically synthesized
aaggaaatccaacttttcttgc

SEQ ID NO: 1370264 - DNA, 22 bp, Artificial Sequence
  chemically synthesized
aggaaatccaacttttcttgct

SEQ ID NO: 1370265 - DNA, 22 bp, Artificial Sequence
  chemically synthesized
tggaaacaaataattaagagca

SEQ ID NO: 1370266 - DNA, 22 bp, Artificial Sequence
  chemically synthesized
gtggaaacaaataattaagagc

SEQ ID NO: 1370267 - DNA, 22 bp, Artificial Sequence
  chemically synthesized
tgtggaaacaaataattaagag

SEQ ID NO: 1370268 - DNA, 22 bp, Artificial Sequence
  chemically synthesized
ttcttgctcttaattatttgtt

SEQ ID NO: 1370269 - DNA, 22 bp, Artificial Sequence
  chemically synthesized
gtattttgtggaaacaaataat

SEQ ID NO: 1370270 - DNA, 22 bp, Artificial Sequence
  chemically synthesized
tcttgctcttaattatttgttt

SEQ ID NO: 1370271 - DNA, 22 bp, Artificial Sequence
  chemically synthesized
cttgctcttaattatttgtttc

SEQ ID NO: 1370272 - DNA, 22 bp, Artificial Sequence
  chemically synthesized
ttgctcttaattatttgtttcc

SEQ ID NO: 1370273 - DNA, 22 bp, Artificial Sequence
  chemically synthesized
gctagtattttgtggaaacaaa

SEQ ID NO: 1370274 - DNA, 22 bp, Artificial Sequence
  chemically synthesized
gctcttaattatttgtttccac

SEQ ID NO: 1370275 - DNA, 22 bp, Artificial Sequence
  chemically synthesized
ggctagtattttgtggaaacaa

SEQ ID NO: 1370276 - DNA, 22 bp, Artificial Sequence
  chemically synthesized
ctcttaattatttgtttccaca

SEQ ID NO: 1370277 - DNA, 22 bp, Artificial Sequence
  chemically synthesized
ttaattatttgtttccacaaaa

SEQ ID NO: 1370278 - DNA, 22 bp, Artificial Sequence
  chemically synthesized
aattatttgtttccacaaaata

SEQ ID NO: 1370279 - DNA, 22 bp, Artificial Sequence
  chemically synthesized
attatttgtttccacaaaatac

SEQ ID NO: 1370280 - DNA, 22 bp, Artificial Sequence
  chemically synthesized
tgtgtttggctagtattttgtg

SEQ ID NO: 1370281 - DNA, 22 bp, Artificial Sequence
  chemically synthesized
tttgtttccacaaaatactagc

SEQ ID NO: 1370282 - DNA, 22 bp, Artificial Sequence
  chemically synthesized
gtttccacaaaatactagccaa

SEQ ID NO: 1370283 - DNA, 22 bp, Artificial Sequence
  chemically synthesized
atagctatgtgtttggctagta

SEQ ID NO: 1370284 - DNA, 22 bp, Artificial Sequence
  chemically synthesized
tttccacaaaatactagccaaa

SEQ ID NO: 1370285 - DNA, 22 bp, Artificial Sequence
  chemically synthesized
ccacaaaatactagccaaacac

SEQ ID NO: 1370286 - DNA, 22 bp, Artificial Sequence
  chemically synthesized
cacaaaatactagccaaacaca

SEQ ID NO: 1370287 - DNA, 22 bp, Artificial Sequence
  chemically synthesized
acatagacctaatagctatgtg

SEQ ID NO: 1370288 - DNA, 22 bp, Artificial Sequence
  chemically synthesized
gccaaacacatagctattaggt

SEQ ID NO: 1370289 - DNA, 22 bp, Artificial Sequence
  chemically synthesized
atgtatacgtccacctcacata

SEQ ID NO: 1370290 - DNA, 22 bp, Artificial Sequence
  chemically synthesized
gatgtatacgtccacctcacat

SEQ ID NO: 1370291 - DNA, 22 bp, Artificial Sequence
  chemically synthesized
tgatgtatacgtccacctcaca

SEQ ID NO: 1370292 - DNA, 22 bp, Artificial Sequence
  chemically synthesized
ttaggtctatgtgaggtggacg

SEQ ID NO: 1370293 - DNA, 22 bp, Artificial Sequence
  chemically synthesized
ggtctatgtgaggtggacgtat

SEQ ID NO: 1370294 - DNA, 22 bp, Artificial Sequence
  chemically synthesized
tgaagaaattttgatgtatacg

SEQ ID NO: 1370295 - DNA, 22 bp, Artificial Sequence
  chemically synthesized
tgtgaggtggacgtatacatca

SEQ ID NO: 1370296 - DNA, 22 bp, Artificial Sequence
  chemically synthesized
agtggctgtgaagaaattttga

SEQ ID NO: 1370297 - DNA, 22 bp, Artificial Sequence
  chemically synthesized
gttaagtggctgtgaagaaatt

SEQ ID NO: 1370298 - DNA, 22 bp, Artificial Sequence
  chemically synthesized
gcacgttggttaagtggctgtg

SEQ ID NO: 1370299 - DNA, 22 bp, Artificial Sequence
  chemically synthesized
agcacgttggttaagtggctgt

SEQ ID NO: 1370300 - DNA, 22 bp, Artificial Sequence
  chemically synthesized
cttcacagccacttaaccaacg

SEQ ID NO: 1370301 - DNA, 22 bp, Artificial Sequence
  chemically synthesized
gaaaacttagcacgttggttaa

SEQ ID NO: 1370302 - DNA, 22 bp, Artificial Sequence
  chemically synthesized
ttcacagccacttaaccaacgt

SEQ ID NO: 1370303 - DNA, 22 bp, Artificial Sequence
  chemically synthesized
tggaaaacttagcacgttggtt

SEQ ID NO: 1370304 - DNA, 22 bp, Artificial Sequence
  chemically synthesized
cacagccacttaaccaacgtgc

SEQ ID NO: 1370305 - DNA, 22 bp, Artificial Sequence
  chemically synthesized
acagccacttaaccaacgtgct

SEQ ID NO: 1370306 - DNA, 22 bp, Artificial Sequence
  chemically synthesized
gattctggaaaacttagcacgt

SEQ ID NO: 1370307 - DNA, 22 bp, Artificial Sequence
  chemically synthesized
ggattctggaaaacttagcacg

SEQ ID NO: 1370308 - DNA, 22 bp, Artificial Sequence
  chemically synthesized
tggattctggaaaacttagcac

SEQ ID NO: 1370309 - DNA, 22 bp, Artificial Sequence
  chemically synthesized
ttttggattctggaaaacttag

SEQ ID NO: 1370310 - DNA, 22 bp, Artificial Sequence
  chemically synthesized
gttttggattctggaaaactta

SEQ ID NO: 1370311 - DNA, 22 bp, Artificial Sequence
  chemically synthesized
aaccaacgtgctaagttttcca

SEQ ID NO: 1370312 - DNA, 22 bp, Artificial Sequence
  chemically synthesized
accaacgtgctaagttttccag

SEQ ID NO: 1370313 - DNA, 22 bp, Artificial Sequence
  chemically synthesized
atttgttttggattctggaaaa

SEQ ID NO: 1370314 - DNA, 22 bp, Artificial Sequence
  chemically synthesized
aactgatttgttttggattctg

SEQ ID NO: 1370315 - DNA, 22 bp, Artificial Sequence
  chemically synthesized
aaactgatttgttttggattct

SEQ ID NO: 1370316 - DNA, 22 bp, Artificial Sequence
  chemically synthesized
ttaaactgatttgttttggatt

SEQ ID NO: 1370317 - DNA, 22 bp, Artificial Sequence
  chemically synthesized
agttttccagaatccaaaacaa

SEQ ID NO: 1370318 - DNA, 22 bp, Artificial Sequence
  chemically synthesized
cctcttaaactgatttgttttg

SEQ ID NO: 1370319 - DNA, 22 bp, Artificial Sequence
  chemically synthesized
tccagaatccaaaacaaatcag

SEQ ID NO: 1370320 - DNA, 22 bp, Artificial Sequence
  chemically synthesized
ccagaatccaaaacaaatcagt

SEQ ID NO: 1370321 - DNA, 22 bp, Artificial Sequence
  chemically synthesized
cagaatccaaaacaaatcagtt

SEQ ID NO: 1370322 - DNA, 22 bp, Artificial Sequence
  chemically synthesized
catacctacctcttaaactgat

SEQ ID NO: 1370323 - DNA, 22 bp, Artificial Sequence
  chemically synthesized
gcatacctacctcttaaactga

SEQ ID NO: 1370324 - DNA, 22 bp, Artificial Sequence
  chemically synthesized
tgcatacctacctcttaaactg

SEQ ID NO: 1370325 - DNA, 22 bp, Artificial Sequence
  chemically synthesized
cagggtctttgcatacctacct

SEQ ID NO: 1370326 - DNA, 22 bp, Artificial Sequence
  chemically synthesized
gagtattacagggtctttgcat

SEQ ID NO: 1370327 - DNA, 22 bp, Artificial Sequence
  chemically synthesized
aagaggtaggtatgcaaagacc

SEQ ID NO: 1370328 - DNA, 22 bp, Artificial Sequence
  chemically synthesized
agaggtaggtatgcaaagaccc

SEQ ID NO: 1370329 - DNA, 22 bp, Artificial Sequence
  chemically synthesized
aaatctagagtattacagggtc

SEQ ID NO: 1370330 - DNA, 22 bp, Artificial Sequence
  chemically synthesized
aaaatctagagtattacagggt

SEQ ID NO: 1370331 - DNA, 22 bp, Artificial Sequence
  chemically synthesized
taaaatctagagtattacaggg

SEQ ID NO: 1370332 - DNA, 22 bp, Artificial Sequence
  chemically synthesized
ttaaaatctagagtattacagg

SEQ ID NO: 1370333 - DNA, 22 bp, Artificial Sequence
  chemically synthesized
tttaaaatctagagtattacag

SEQ ID NO: 1370334 - DNA, 22 bp, Artificial Sequence
  chemically synthesized
ttttaaaatctagagtattaca

SEQ ID NO: 1370335 - DNA, 22 bp, Artificial Sequence
  chemically synthesized
aggatacttttttaaaatctag

SEQ ID NO: 1370336 - DNA, 22 bp, Artificial Sequence
  chemically synthesized
actaaggatacttttttaaaat

SEQ ID NO: 1370337 - DNA, 22 bp, Artificial Sequence
  chemically synthesized
taatactctagattttaaaaaa

SEQ ID NO: 1370338 - DNA, 22 bp, Artificial Sequence
  chemically synthesized
aactaaggatacttttttaaaa

SEQ ID NO: 1370339 - DNA, 22 bp, Artificial Sequence
  chemically synthesized
tagattttaaaaaagtatcctt

SEQ ID NO: 1370340 - DNA, 22 bp, Artificial Sequence
  chemically synthesized
atggtacttaactaaggatact

SEQ ID NO: 1370341 - DNA, 22 bp, Artificial Sequence
  chemically synthesized
gattttaaaaaagtatccttag

SEQ ID NO: 1370342 - DNA, 22 bp, Artificial Sequence
  chemically synthesized
tcatggtacttaactaaggata

SEQ ID NO: 1370343 - DNA, 22 bp, Artificial Sequence
  chemically synthesized
ctcatggtacttaactaaggat

SEQ ID NO: 1370344 - DNA, 22 bp, Artificial Sequence
  chemically synthesized
tctcatggtacttaactaagga

SEQ ID NO: 1370345 - DNA, 22 bp, Artificial Sequence
  chemically synthesized
taaaaaagtatccttagttaag

SEQ ID NO: 1370346 - DNA, 22 bp, Artificial Sequence
  chemically synthesized
aaaaaagtatccttagttaagt

SEQ ID NO: 1370347 - DNA, 22 bp, Artificial Sequence
  chemically synthesized
aaaaagtatccttagttaagta

SEQ ID NO: 1370348 - DNA, 22 bp, Artificial Sequence
  chemically synthesized
attttctcatggtacttaacta

SEQ ID NO: 1370349 - DNA, 22 bp, Artificial Sequence
  chemically synthesized
gctcattttctcatggtactta

SEQ ID NO: 1370350 - DNA, 22 bp, Artificial Sequence
  chemically synthesized
agttaagtaccatgagaaaatg

SEQ ID NO: 1370351 - DNA, 22 bp, Artificial Sequence
  chemically synthesized
gttaagtaccatgagaaaatga

SEQ ID NO: 1370352 - DNA, 22 bp, Artificial Sequence
  chemically synthesized
agtaccatgagaaaatgagcta

SEQ ID NO: 1370353 - DNA, 22 bp, Artificial Sequence
  chemically synthesized
acatagcacataaactagctca

SEQ ID NO: 1370354 - DNA, 22 bp, Artificial Sequence
  chemically synthesized
ctaacatagcacataaactagc

SEQ ID NO: 1370355 - DNA, 22 bp, Artificial Sequence
  chemically synthesized
tgttcctaacatagcacataaa

SEQ ID NO: 1370356 - DNA, 22 bp, Artificial Sequence
  chemically synthesized
ttatgttcctaacatagcacat

SEQ ID NO: 1370357 - DNA, 22 bp, Artificial Sequence
  chemically synthesized
gctattatgttcctaacatagc

SEQ ID NO: 1370358 - DNA, 22 bp, Artificial Sequence
  chemically synthesized
ggctattatgttcctaacatag

SEQ ID NO: 1370359 - DNA, 22 bp, Artificial Sequence
  chemically synthesized
tggctattatgttcctaacata

SEQ ID NO: 1370360 - DNA, 22 bp, Artificial Sequence
  chemically synthesized
ttggctattatgttcctaacat

SEQ ID NO: 1370361 - DNA, 22 bp, Artificial Sequence
  chemically synthesized
gtttatgtgctatgttaggaac

SEQ ID NO: 1370362 - DNA, 22 bp, Artificial Sequence
  chemically synthesized
tttggctattatgttcctaaca

SEQ ID NO: 1370363 - DNA, 22 bp, Artificial Sequence
  chemically synthesized
ttttggctattatgttcctaac

SEQ ID NO: 1370364 - DNA, 22 bp, Artificial Sequence
  chemically synthesized
tttttggctattatgttcctaa

SEQ ID NO: 1370365 - DNA, 22 bp, Artificial Sequence
  chemically synthesized
ttttttggctattatgttccta

SEQ ID NO: 1370366 - DNA, 22 bp, Artificial Sequence
  chemically synthesized
atgtgctatgttaggaacataa

SEQ ID NO: 1370367 - DNA, 22 bp, Artificial Sequence
  chemically synthesized
tttttttggctattatgttcct

SEQ ID NO: 1370368 - DNA, 22 bp, Artificial Sequence
  chemically synthesized
tgtgctatgttaggaacataat

SEQ ID NO: 1370369 - DNA, 22 bp, Artificial Sequence
  chemically synthesized
ttttttttggctattatgttcc

SEQ ID NO: 1370370 - DNA, 22 bp, Artificial Sequence
  chemically synthesized
tttttttttggctattatgttc

SEQ ID NO: 1370371 - DNA, 22 bp, Artificial Sequence
  chemically synthesized
ttttttttttggctattatgtt

SEQ ID NO: 1370372 - DNA, 22 bp, Artificial Sequence
  chemically synthesized
tttttttttttggctattatgt

SEQ ID NO: 1370373 - DNA, 22 bp, Artificial Sequence
  chemically synthesized
ttttttttttttggctattatg

SEQ ID NO: 1370374 - DNA, 22 bp, Artificial Sequence
  chemically synthesized
tgttaggaacataatagccaaa

SEQ ID NO: 1370375 - DNA, 22 bp, Artificial Sequence
  chemically synthesized
tttttttttttttttggctatt

SEQ ID NO: 1370376 - DNA, 22 bp, Artificial Sequence
  chemically synthesized
atttttttttttttttggctat

SEQ ID NO: 1370377 - DNA, 22 bp, Artificial Sequence
  chemically synthesized
tttatttttttttttttttggc

SEQ ID NO: 1370378 - DNA, 22 bp, Artificial Sequence
  chemically synthesized
ggaacataatagccaaaaaaaa

SEQ ID NO: 1370379 - DNA, 22 bp, Artificial Sequence
  chemically synthesized
ttatttattttttttttttttt

SEQ ID NO: 1370380 - DNA, 22 bp, Artificial Sequence
  chemically synthesized
caactgttatttattttttttt

SEQ ID NO: 1370381 - DNA, 22 bp, Artificial Sequence
  chemically synthesized
attccaactgttatttattttt

SEQ ID NO: 1370382 - DNA, 22 bp, Artificial Sequence
  chemically synthesized
atgaagtaccaaggtgcctgat

SEQ ID NO: 1370383 - DNA, 22 bp, Artificial Sequence
  chemically synthesized
gaatcaggcaccttggtacttc

SEQ ID NO: 1370384 - DNA, 22 bp, Artificial Sequence
  chemically synthesized
caaaatactcatgaagtaccaa

SEQ ID NO: 1370385 - DNA, 22 bp, Artificial Sequence
  chemically synthesized
ttgcaaaatactcatgaagtac

SEQ ID NO: 1370386 - DNA, 22 bp, Artificial Sequence
  chemically synthesized
tactgttgcaaaatactcatga

SEQ ID NO: 1370387 - DNA, 22 bp, Artificial Sequence
  chemically synthesized
ttatactgttgcaaaatactca

SEQ ID NO: 1370388 - DNA, 22 bp, Artificial Sequence
  chemically synthesized
ggtacttcatgagtattttgca

SEQ ID NO: 1370389 - DNA, 22 bp, Artificial Sequence
  chemically synthesized
gtacttcatgagtattttgcaa

SEQ ID NO: 1370390 - DNA, 22 bp, Artificial Sequence
  chemically synthesized
catgagtattttgcaacagtat

SEQ ID NO: 1370391 - DNA, 22 bp, Artificial Sequence
  chemically synthesized
aaaggccctattatactgttgc

SEQ ID NO: 1370392 - DNA, 22 bp, Artificial Sequence
  chemically synthesized
atgagtattttgcaacagtata

SEQ ID NO: 1370393 - DNA, 22 bp, Artificial Sequence
  chemically synthesized
ctgaaaggccctattatactgt

SEQ ID NO: 1370394 - DNA, 22 bp, Artificial Sequence
  chemically synthesized
tgcaacagtataatagggcctt

SEQ ID NO: 1370395 - DNA, 22 bp, Artificial Sequence
  chemically synthesized
gcaacagtataatagggccttt

SEQ ID NO: 1370396 - DNA, 22 bp, Artificial Sequence
  chemically synthesized
caacagtataatagggcctttc

SEQ ID NO: 1370397 - DNA, 22 bp, Artificial Sequence
  chemically synthesized
tgcaagcacatcattactgaaa

SEQ ID NO: 1370398 - DNA, 22 bp, Artificial Sequence
  chemically synthesized
tatgcaagcacatcattactga

SEQ ID NO: 1370399 - DNA, 22 bp, Artificial Sequence
  chemically synthesized
ctatgcaagcacatcattactg

SEQ ID NO: 1370400 - DNA, 22 bp, Artificial Sequence
  chemically synthesized
atgtatttctatgcaagcacat

SEQ ID NO: 1370401 - DNA, 22 bp, Artificial Sequence
  chemically synthesized
catgtatttctatgcaagcaca

SEQ ID NO: 1370402 - DNA, 22 bp, Artificial Sequence
  chemically synthesized
tcatgtatttctatgcaagcac

SEQ ID NO: 1370403 - DNA, 22 bp, Artificial Sequence
  chemically synthesized
tcagtaatgatgtgcttgcata

SEQ ID NO: 1370404 - DNA, 22 bp, Artificial Sequence
  chemically synthesized
cagtaatgatgtgcttgcatag

SEQ ID NO: 1370405 - DNA, 22 bp, Artificial Sequence
  chemically synthesized
agtaatgatgtgcttgcataga

SEQ ID NO: 1370406 - DNA, 22 bp, Artificial Sequence
  chemically synthesized
tgtaattttcatgtatttctat

SEQ ID NO: 1370407 - DNA, 22 bp, Artificial Sequence
  chemically synthesized
gtgtaattttcatgtatttcta

SEQ ID NO: 1370408 - DNA, 22 bp, Artificial Sequence
  chemically synthesized
gcatagaaatacatgaaaatta

SEQ ID NO: 1370409 - DNA, 22 bp, Artificial Sequence
  chemically synthesized
catagaaatacatgaaaattac

SEQ ID NO: 1370410 - DNA, 22 bp, Artificial Sequence
  chemically synthesized
aaaatatcaaatttgtgtaatt

SEQ ID NO: 1370411 - DNA, 22 bp, Artificial Sequence
  chemically synthesized
ctaaaaatatcaaatttgtgta

SEQ ID NO: 1370412 - DNA, 22 bp, Artificial Sequence
  chemically synthesized
agttactaaaaatatcaaattt

SEQ ID NO: 1370413 - DNA, 22 bp, Artificial Sequence
  chemically synthesized
aattcagttactaaaaatatca

SEQ ID NO: 1370414 - DNA, 22 bp, Artificial Sequence
  chemically synthesized
cacaaatttgatatttttagta

SEQ ID NO: 1370415 - DNA, 22 bp, Artificial Sequence
  chemically synthesized
aactaaattcagttactaaaaa

SEQ ID NO: 1370416 - DNA, 22 bp, Artificial Sequence
  chemically synthesized
gatatttttagtaactgaattt

SEQ ID NO: 1370417 - DNA, 22 bp, Artificial Sequence
  chemically synthesized
caaaactaaactaaattcagtt

SEQ ID NO: 1370418 - DNA, 22 bp, Artificial Sequence
  chemically synthesized
atatttttagtaactgaattta

SEQ ID NO: 1370419 - DNA, 22 bp, Artificial Sequence
  chemically synthesized
acaaaactaaactaaattcagt

SEQ ID NO: 1370420 - DNA, 22 bp, Artificial Sequence
  chemically synthesized
agtttacaaaactaaactaaat

SEQ ID NO: 1370421 - DNA, 22 bp, Artificial Sequence
  chemically synthesized
ttagtaactgaatttagtttag

SEQ ID NO: 1370422 - DNA, 22 bp, Artificial Sequence
  chemically synthesized
tagtaactgaatttagtttagt

SEQ ID NO: 1370423 - DNA, 22 bp, Artificial Sequence
  chemically synthesized
tgagtttacaaaactaaactaa

SEQ ID NO: 1370424 - DNA, 22 bp, Artificial Sequence
  chemically synthesized
agtaactgaatttagtttagtt

SEQ ID NO: 1370425 - DNA, 22 bp, Artificial Sequence
  chemically synthesized
gtaactgaatttagtttagttt

SEQ ID NO: 1370426 - DNA, 22 bp, Artificial Sequence
  chemically synthesized
agttctgagtttacaaaactaa

SEQ ID NO: 1370427 - DNA, 22 bp, Artificial Sequence
  chemically synthesized
gagttctgagtttacaaaacta

SEQ ID NO: 1370428 - DNA, 22 bp, Artificial Sequence
  chemically synthesized
aatttagtttagttttgtaaac

SEQ ID NO: 1370429 - DNA, 22 bp, Artificial Sequence
  chemically synthesized
agtttagttttgtaaactcaga

SEQ ID NO: 1370430 - DNA, 22 bp, Artificial Sequence
  chemically synthesized
gtttagttttgtaaactcagaa

SEQ ID NO: 1370431 - DNA, 22 bp, Artificial Sequence
  chemically synthesized
agttttgtaaactcagaactca

SEQ ID NO: 1370432 - DNA, 22 bp, Artificial Sequence
  chemically synthesized
gttttgtaaactcagaactcaa

SEQ ID NO: 1370433 - DNA, 22 bp, Artificial Sequence
  chemically synthesized
tgtaaactcagaactcaagggt

SEQ ID NO: 1370434 - DNA, 22 bp, Artificial Sequence
  chemically synthesized
gtaaactcagaactcaagggtg

SEQ ID NO: 1370435 - DNA, 22 bp, Artificial Sequence
  chemically synthesized
taaactcagaactcaagggtga

SEQ ID NO: 1370436 - DNA, 22 bp, Artificial Sequence
  chemically synthesized
cacgcacatatgcacgtcaccc

SEQ ID NO: 1370437 - DNA, 22 bp, Artificial Sequence
  chemically synthesized
agaactcaagggtgacgtgcat

SEQ ID NO: 1370438 - DNA, 22 bp, Artificial Sequence
  chemically synthesized
aagggtgacgtgcatatgtgcg

SEQ ID NO: 1370439 - DNA, 22 bp, Artificial Sequence
  chemically synthesized
tgtatgtatgtgtaagtcactc

SEQ ID NO: 1370440 - DNA, 22 bp, Artificial Sequence
  chemically synthesized
gtgtatgtatgtgtaagtcact

SEQ ID NO: 1370441 - DNA, 22 bp, Artificial Sequence
  chemically synthesized
cttgtgtatgtatgtgtaagtc

SEQ ID NO: 1370442 - DNA, 22 bp, Artificial Sequence
  chemically synthesized
tacatatgattgcttgtgtatg

SEQ ID NO: 1370443 - DNA, 22 bp, Artificial Sequence
  chemically synthesized
acacatacatacacaagcaatc

SEQ ID NO: 1370444 - DNA, 22 bp, Artificial Sequence
  chemically synthesized
cacatacatacacaagcaatca

SEQ ID NO: 1370445 - DNA, 22 bp, Artificial Sequence
  chemically synthesized
agagcccaagttgtacatatga

SEQ ID NO: 1370446 - DNA, 22 bp, Artificial Sequence
  chemically synthesized
taagagcccaagttgtacatat

SEQ ID NO: 1370447 - DNA, 22 bp, Artificial Sequence
  chemically synthesized
ctaagagcccaagttgtacata

SEQ ID NO: 1370448 - DNA, 22 bp, Artificial Sequence
  chemically synthesized
tctaagagcccaagttgtacat

SEQ ID NO: 1370449 - DNA, 22 bp, Artificial Sequence
  chemically synthesized
ctttctaagagcccaagttgta

SEQ ID NO: 1370450 - DNA, 22 bp, Artificial Sequence
  chemically synthesized
gtgacaatgtgccctactttct

SEQ ID NO: 1370451 - DNA, 22 bp, Artificial Sequence
  chemically synthesized
gggctcttagaaagtagggcac

SEQ ID NO: 1370452 - DNA, 22 bp, Artificial Sequence
  chemically synthesized
ggctcttagaaagtagggcaca

SEQ ID NO: 1370453 - DNA, 22 bp, Artificial Sequence
  chemically synthesized
aactggtgacaatgtgccctac

SEQ ID NO: 1370454 - DNA, 22 bp, Artificial Sequence
  chemically synthesized
ttagaaagtagggcacattgtc

SEQ ID NO: 1370455 - DNA, 22 bp, Artificial Sequence
  chemically synthesized
agaaagtagggcacattgtcac

SEQ ID NO: 1370456 - DNA, 22 bp, Artificial Sequence
  chemically synthesized
gaaagtagggcacattgtcacc

SEQ ID NO: 1370457 - DNA, 22 bp, Artificial Sequence
  chemically synthesized
aatcaggaatcatatgacaatt

SEQ ID NO: 1370458 - DNA, 22 bp, Artificial Sequence
  chemically synthesized
aaatcaggaatcatatgacaat

SEQ ID NO: 1370459 - DNA, 22 bp, Artificial Sequence
  chemically synthesized
tcaccagttgaattgtcatatg

SEQ ID NO: 1370460 - DNA, 22 bp, Artificial Sequence
  chemically synthesized
tcatttaaatcaggaatcatat

SEQ ID NO: 1370461 - DNA, 22 bp, Artificial Sequence
  chemically synthesized
atcatttaaatcaggaatcata

SEQ ID NO: 1370462 - DNA, 22 bp, Artificial Sequence
  chemically synthesized
aattgtcatatgattcctgatt

SEQ ID NO: 1370463 - DNA, 22 bp, Artificial Sequence
  chemically synthesized
tcatatgattcctgatttaaat

SEQ ID NO: 1370464 - DNA, 22 bp, Artificial Sequence
  chemically synthesized
gaacgacttatcatttaaatca

SEQ ID NO: 1370465 - DNA, 22 bp, Artificial Sequence
  chemically synthesized
aagaaattggaacgacttatca

SEQ ID NO: 1370466 - DNA, 22 bp, Artificial Sequence
  chemically synthesized
ctgatttaaatgataagtcgtt

SEQ ID NO: 1370467 - DNA, 22 bp, Artificial Sequence
  chemically synthesized
atttaaatgataagtcgttcca

SEQ ID NO: 1370468 - DNA, 22 bp, Artificial Sequence
  chemically synthesized
aaatgataagtcgttccaattt

SEQ ID NO: 1370469 - DNA, 22 bp, Artificial Sequence
  chemically synthesized
aatgataagtcgttccaatttc

SEQ ID NO: 1370470 - DNA, 22 bp, Artificial Sequence
  chemically synthesized
aagaagtaagggttgaagaaat

SEQ ID NO: 1370471 - DNA, 22 bp, Artificial Sequence
  chemically synthesized
gctcaagaagtaagggttgaag

SEQ ID NO: 1370472 - DNA, 22 bp, Artificial Sequence
  chemically synthesized
ttcgctcaagaagtaagggttg

SEQ ID NO: 1370473 - DNA, 22 bp, Artificial Sequence
  chemically synthesized
caatttcttcaacccttacttc

SEQ ID NO: 1370474 - DNA, 22 bp, Artificial Sequence
  chemically synthesized
cttcaacccttacttcttgagc

SEQ ID NO: 1370475 - DNA, 22 bp, Artificial Sequence
  chemically synthesized
ttcaacccttacttcttgagcg

SEQ ID NO: 1370476 - DNA, 22 bp, Artificial Sequence
  chemically synthesized
catatggactgttcgctcaaga

SEQ ID NO: 1370477 - DNA, 22 bp, Artificial Sequence
  chemically synthesized
caacccttacttcttgagcgaa

SEQ ID NO: 1370478 - DNA, 22 bp, Artificial Sequence
  chemically synthesized
gcatatggactgttcgctcaag

SEQ ID NO: 1370479 - DNA, 22 bp, Artificial Sequence
  chemically synthesized
aacccttacttcttgagcgaac

SEQ ID NO: 1370480 - DNA, 22 bp, Artificial Sequence
  chemically synthesized
atttgcatatggactgttcgct

SEQ ID NO: 1370481 - DNA, 22 bp, Artificial Sequence
  chemically synthesized
acttcttgagcgaacagtccat

SEQ ID NO: 1370482 - DNA, 22 bp, Artificial Sequence
  chemically synthesized
cttcttgagcgaacagtccata

SEQ ID NO: 1370483 - DNA, 22 bp, Artificial Sequence
  chemically synthesized
catactgatttgcatatggact

SEQ ID NO: 1370484 - DNA, 22 bp, Artificial Sequence
  chemically synthesized
cttgagcgaacagtccatatgc

SEQ ID NO: 1370485 - DNA, 22 bp, Artificial Sequence
  chemically synthesized
ttgagcgaacagtccatatgca

SEQ ID NO: 1370486 - DNA, 22 bp, Artificial Sequence
  chemically synthesized
gagcgaacagtccatatgcaaa

SEQ ID NO: 1370487 - DNA, 22 bp, Artificial Sequence
  chemically synthesized
agcgaacagtccatatgcaaat

SEQ ID NO: 1370488 - DNA, 22 bp, Artificial Sequence
  chemically synthesized
ccactccatactgatttgcata

SEQ ID NO: 1370489 - DNA, 22 bp, Artificial Sequence
  chemically synthesized
gccactccatactgatttgcat

SEQ ID NO: 1370490 - DNA, 22 bp, Artificial Sequence
  chemically synthesized
aagtttgccactccatactgat

SEQ ID NO: 1370491 - DNA, 22 bp, Artificial Sequence
  chemically synthesized
gaacgtgagattaaagtttgcc

SEQ ID NO: 1370492 - DNA, 22 bp, Artificial Sequence
  chemically synthesized
actagaacgtgagattaaagtt

SEQ ID NO: 1370493 - DNA, 22 bp, Artificial Sequence
  chemically synthesized
gtataaaatactcactagaacg

SEQ ID NO: 1370494 - DNA, 22 bp, Artificial Sequence
  chemically synthesized
agtataaaatactcactagaac

SEQ ID NO: 1370495 - DNA, 22 bp, Artificial Sequence
  chemically synthesized
tagtataaaatactcactagaa

SEQ ID NO: 1370496 - DNA, 22 bp, Artificial Sequence
  chemically synthesized
ttagtataaaatactcactaga

SEQ ID NO: 1370497 - DNA, 22 bp, Artificial Sequence
  chemically synthesized
taatctcacgttctagtgagta

SEQ ID NO: 1370498 - DNA, 22 bp, Artificial Sequence
  chemically synthesized
aatctcacgttctagtgagtat

SEQ ID NO: 1370499 - DNA, 22 bp, Artificial Sequence
  chemically synthesized
atctcacgttctagtgagtatt

SEQ ID NO: 1370500 - DNA, 22 bp, Artificial Sequence
  chemically synthesized
gtggtttttagtataaaatact

SEQ ID NO: 1370501 - DNA, 22 bp, Artificial Sequence
  chemically synthesized
acgttctagtgagtattttata

SEQ ID NO: 1370502 - DNA, 22 bp, Artificial Sequence
  chemically synthesized
tctggtggtttttagtataaaa

SEQ ID NO: 1370503 - DNA, 22 bp, Artificial Sequence
  chemically synthesized
tatctggtggtttttagtataa

SEQ ID NO: 1370504 - DNA, 22 bp, Artificial Sequence
  chemically synthesized
tagtgagtattttatactaaaa

SEQ ID NO: 1370505 - DNA, 22 bp, Artificial Sequence
  chemically synthesized
gtgagtattttatactaaaaac

SEQ ID NO: 1370506 - DNA, 22 bp, Artificial Sequence
  chemically synthesized
atgactctatctggtggttttt

SEQ ID NO: 1370507 - DNA, 22 bp, Artificial Sequence
  chemically synthesized
catgactctatctggtggtttt

SEQ ID NO: 1370508 - DNA, 22 bp, Artificial Sequence
  chemically synthesized
tcatgactctatctggtggttt

SEQ ID NO: 1370509 - DNA, 22 bp, Artificial Sequence
  chemically synthesized
ttcatgactctatctggtggtt

SEQ ID NO: 1370510 - DNA, 22 bp, Artificial Sequence
  chemically synthesized
tatactaaaaaccaccagatag

SEQ ID NO: 1370511 - DNA, 22 bp, Artificial Sequence
  chemically synthesized
cttttcatgactctatctggtg

SEQ ID NO: 1370512 - DNA, 22 bp, Artificial Sequence
  chemically synthesized
atactaaaaaccaccagataga

SEQ ID NO: 1370513 - DNA, 22 bp, Artificial Sequence
  chemically synthesized
tactaaaaaccaccagatagag

SEQ ID NO: 1370514 - DNA, 22 bp, Artificial Sequence
  chemically synthesized
tacttttcatgactctatctgg

SEQ ID NO: 1370515 - DNA, 22 bp, Artificial Sequence
  chemically synthesized
ctacttttcatgactctatctg

SEQ ID NO: 1370516 - DNA, 22 bp, Artificial Sequence
  chemically synthesized
aaaaccaccagatagagtcatg

SEQ ID NO: 1370517 - DNA, 22 bp, Artificial Sequence
  chemically synthesized
tgtatatataaacaatttctac

SEQ ID NO: 1370518 - DNA, 22 bp, Artificial Sequence
  chemically synthesized
gtgtatatataaacaatttcta

SEQ ID NO: 1370519 - DNA, 22 bp, Artificial Sequence
  chemically synthesized
agaaaatgcgtttgtgtatata

SEQ ID NO: 1370520 - DNA, 22 bp, Artificial Sequence
  chemically synthesized
aagaaaatgcgtttgtgtatat

SEQ ID NO: 1370521 - DNA, 22 bp, Artificial Sequence
  chemically synthesized
taagaaaatgcgtttgtgtata

SEQ ID NO: 1370522 - DNA, 22 bp, Artificial Sequence
  chemically synthesized
ctttaagaaaatgcgtttgtgt

SEQ ID NO: 1370523 - DNA, 22 bp, Artificial Sequence
  chemically synthesized
tttatatatacacaaacgcatt

SEQ ID NO: 1370524 - DNA, 22 bp, Artificial Sequence
  chemically synthesized
atatatacacaaacgcattttc

SEQ ID NO: 1370525 - DNA, 22 bp, Artificial Sequence
  chemically synthesized
tatatacacaaacgcattttct

SEQ ID NO: 1370526 - DNA, 22 bp, Artificial Sequence
  chemically synthesized
atagttactttaagaaaatgcg

SEQ ID NO: 1370527 - DNA, 22 bp, Artificial Sequence
  chemically synthesized
tcttaaagtaactatgagtttc

SEQ ID NO: 1370528 - DNA, 22 bp, Artificial Sequence
  chemically synthesized
cttaaagtaactatgagtttca

SEQ ID NO: 1370529 - DNA, 22 bp, Artificial Sequence
  chemically synthesized
ttaaagtaactatgagtttcat

SEQ ID NO: 1370530 - DNA, 22 bp, Artificial Sequence
  chemically synthesized
aaagtaactatgagtttcattt

SEQ ID NO: 1370531 - DNA, 22 bp, Artificial Sequence
  chemically synthesized
aagtaactatgagtttcattta

SEQ ID NO: 1370532 - DNA, 22 bp, Artificial Sequence
  chemically synthesized
tgagtttcatttactttcatct

SEQ ID NO: 1370533 - DNA, 22 bp, Artificial Sequence
  chemically synthesized
aagtaacaaagtataagatgaa

SEQ ID NO: 1370534 - DNA, 22 bp, Artificial Sequence
  chemically synthesized
gaagtaacaaagtataagatga

SEQ ID NO: 1370535 - DNA, 22 bp, Artificial Sequence
  chemically synthesized
tgaagtaacaaagtataagatg

SEQ ID NO: 1370536 - DNA, 22 bp, Artificial Sequence
  chemically synthesized
catttactttcatcttatactt

SEQ ID NO: 1370537 - DNA, 22 bp, Artificial Sequence
  chemically synthesized
atttactttcatcttatacttt

SEQ ID NO: 1370538 - DNA, 22 bp, Artificial Sequence
  chemically synthesized
cctttgaagtaacaaagtataa

SEQ ID NO: 1370539 - DNA, 22 bp, Artificial Sequence
  chemically synthesized
tccctttgaagtaacaaagtat

SEQ ID NO: 1370540 - DNA, 22 bp, Artificial Sequence
  chemically synthesized
actttcatcttatactttgtta

SEQ ID NO: 1370541 - DNA, 22 bp, Artificial Sequence
  chemically synthesized
ctccctttgaagtaacaaagta

SEQ ID NO: 1370542 - DNA, 22 bp, Artificial Sequence
  chemically synthesized
ctttcatcttatactttgttac

SEQ ID NO: 1370543 - DNA, 22 bp, Artificial Sequence
  chemically synthesized
tcatcttatactttgttacttc

SEQ ID NO: 1370544 - DNA, 22 bp, Artificial Sequence
  chemically synthesized
catcttatactttgttacttca

SEQ ID NO: 1370545 - DNA, 22 bp, Artificial Sequence
  chemically synthesized
atcttatactttgttacttcaa

SEQ ID NO: 1370546 - DNA, 22 bp, Artificial Sequence
  chemically synthesized
atactttgttacttcaaaggga

SEQ ID NO: 1370547 - DNA, 22 bp, Artificial Sequence
  chemically synthesized
tactttgttacttcaaagggag

SEQ ID NO: 1370548 - DNA, 22 bp, Artificial Sequence
  chemically synthesized
tgttacttcaaagggagaagtt

SEQ ID NO: 1370549 - DNA, 22 bp, Artificial Sequence
  chemically synthesized
gttacttcaaagggagaagtta

SEQ ID NO: 1370550 - DNA, 22 bp, Artificial Sequence
  chemically synthesized
ttacttcaaagggagaagttac

SEQ ID NO: 1370551 - DNA, 22 bp, Artificial Sequence
  chemically synthesized
cttcaaagggagaagttactga

SEQ ID NO: 1370552 - DNA, 22 bp, Artificial Sequence
  chemically synthesized
caaagggagaagttactgattt

SEQ ID NO: 1370553 - DNA, 22 bp, Artificial Sequence
  chemically synthesized
aaagggagaagttactgatttt

SEQ ID NO: 1370554 - DNA, 22 bp, Artificial Sequence
  chemically synthesized
ataaagggagataagaaaaatc

SEQ ID NO: 1370555 - DNA, 22 bp, Artificial Sequence
  chemically synthesized
ctgatttttcttatctcccttt

SEQ ID NO: 1370556 - DNA, 22 bp, Artificial Sequence
  chemically synthesized
atttttcttatctccctttatc

SEQ ID NO: 1370557 - DNA, 22 bp, Artificial Sequence
  chemically synthesized
ccagggacatggctgataaagg

SEQ ID NO: 1370558 - DNA, 22 bp, Artificial Sequence
  chemically synthesized
gccagggacatggctgataaag

SEQ ID NO: 1370559 - DNA, 22 bp, Artificial Sequence
  chemically synthesized
ttcttatctccctttatcagcc

SEQ ID NO: 1370560 - DNA, 22 bp, Artificial Sequence
  chemically synthesized
tcttatctccctttatcagcca

SEQ ID NO: 1370561 - DNA, 22 bp, Artificial Sequence
  chemically synthesized
ttgccagggacatggctgataa

SEQ ID NO: 1370562 - DNA, 22 bp, Artificial Sequence
  chemically synthesized
cttatctccctttatcagccat

SEQ ID NO: 1370563 - DNA, 22 bp, Artificial Sequence
  chemically synthesized
cttgccagggacatggctgata

SEQ ID NO: 1370564 - DNA, 22 bp, Artificial Sequence
  chemically synthesized
ttatctccctttatcagccatg

SEQ ID NO: 1370565 - DNA, 22 bp, Artificial Sequence
  chemically synthesized
atctccctttatcagccatgtc

SEQ ID NO: 1370566 - DNA, 22 bp, Artificial Sequence
  chemically synthesized
tttcttgccagggacatggctg

SEQ ID NO: 1370567 - DNA, 22 bp, Artificial Sequence
  chemically synthesized
tctccctttatcagccatgtcc

SEQ ID NO: 1370568 - DNA, 22 bp, Artificial Sequence
  chemically synthesized
tatttcttgccagggacatggc

SEQ ID NO: 1370569 - DNA, 22 bp, Artificial Sequence
  chemically synthesized
cctttatcagccatgtccctgg

SEQ ID NO: 1370570 - DNA, 22 bp, Artificial Sequence
  chemically synthesized
aattctatttcttgccagggac

SEQ ID NO: 1370571 - DNA, 22 bp, Artificial Sequence
  chemically synthesized
tatcagccatgtccctggcaag

SEQ ID NO: 1370572 - DNA, 22 bp, Artificial Sequence
  chemically synthesized
atcagccatgtccctggcaaga

SEQ ID NO: 1370573 - DNA, 22 bp, Artificial Sequence
  chemically synthesized
tcagccatgtccctggcaagaa

SEQ ID NO: 1370574 - DNA, 22 bp, Artificial Sequence
  chemically synthesized
aaccatccatgttgaattctat

SEQ ID NO: 1370575 - DNA, 22 bp, Artificial Sequence
  chemically synthesized
ttgaaccatccatgttgaattc

SEQ ID NO: 1370576 - DNA, 22 bp, Artificial Sequence
  chemically synthesized
attgaaccatccatgttgaatt

SEQ ID NO: 1370577 - DNA, 22 bp, Artificial Sequence
  chemically synthesized
gcaagaaatagaattcaacatg

SEQ ID NO: 1370578 - DNA, 22 bp, Artificial Sequence
  chemically synthesized
tattgaaccatccatgttgaat

SEQ ID NO: 1370579 - DNA, 22 bp, Artificial Sequence
  chemically synthesized
ttttattgaaccatccatgttg

SEQ ID NO: 1370580 - DNA, 22 bp, Artificial Sequence
  chemically synthesized
tactgttttattgaaccatcca

SEQ ID NO: 1370581 - DNA, 22 bp, Artificial Sequence
  chemically synthesized
gtactgttttattgaaccatcc

SEQ ID NO: 1370582 - DNA, 22 bp, Artificial Sequence
  chemically synthesized
tgtactgttttattgaaccatc

SEQ ID NO: 1370583 - DNA, 22 bp, Artificial Sequence
  chemically synthesized
ctttgtactgttttattgaacc

SEQ ID NO: 1370584 - DNA, 22 bp, Artificial Sequence
  chemically synthesized
aacatggatggttcaataaaac

SEQ ID NO: 1370585 - DNA, 22 bp, Artificial Sequence
  chemically synthesized
aaagtagttcctttgtactgtt

SEQ ID NO: 1370586 - DNA, 22 bp, Artificial Sequence
  chemically synthesized
tgaaagtagttcctttgtactg

SEQ ID NO: 1370587 - DNA, 22 bp, Artificial Sequence
  chemically synthesized
aataaaacagtacaaaggaact

SEQ ID NO: 1370588 - DNA, 22 bp, Artificial Sequence
  chemically synthesized
acacctctgaaagtagttcctt

SEQ ID NO: 1370589 - DNA, 22 bp, Artificial Sequence
  chemically synthesized
agcccattcacacctctgaaag

SEQ ID NO: 1370590 - DNA, 22 bp, Artificial Sequence
  chemically synthesized
aagcccattcacacctctgaaa

SEQ ID NO: 1370591 - DNA, 22 bp, Artificial Sequence
  chemically synthesized
taagcccattcacacctctgaa

SEQ ID NO: 1370592 - DNA, 22 bp, Artificial Sequence
  chemically synthesized
tttaagcccattcacacctctg

SEQ ID NO: 1370593 - DNA, 22 bp, Artificial Sequence
  chemically synthesized
ctttaagcccattcacacctct

SEQ ID NO: 1370594 - DNA, 22 bp, Artificial Sequence
  chemically synthesized
gtttctttaagcccattcacac

SEQ ID NO: 1370595 - DNA, 22 bp, Artificial Sequence
  chemically synthesized
ggtttctttaagcccattcaca

SEQ ID NO: 1370596 - DNA, 22 bp, Artificial Sequence
  chemically synthesized
tggtttctttaagcccattcac

SEQ ID NO: 1370597 - DNA, 22 bp, Artificial Sequence
  chemically synthesized
ctttcagaggtgtgaatgggct

SEQ ID NO: 1370598 - DNA, 22 bp, Artificial Sequence
  chemically synthesized
ttggtttctttaagcccattca

SEQ ID NO: 1370599 - DNA, 22 bp, Artificial Sequence
  chemically synthesized
tcagaggtgtgaatgggcttaa

SEQ ID NO: 1370600 - DNA, 22 bp, Artificial Sequence
  chemically synthesized
cagaggtgtgaatgggcttaaa

SEQ ID NO: 1370601 - DNA, 22 bp, Artificial Sequence
  chemically synthesized
agaggtgtgaatgggcttaaag

SEQ ID NO: 1370602 - DNA, 22 bp, Artificial Sequence
  chemically synthesized
gatagccccttttggtttcttt

SEQ ID NO: 1370603 - DNA, 22 bp, Artificial Sequence
  chemically synthesized
ggtgcctcgatagccccttttg

SEQ ID NO: 1370604 - DNA, 22 bp, Artificial Sequence
  chemically synthesized
taggtgcctcgatagccccttt

SEQ ID NO: 1370605 - DNA, 22 bp, Artificial Sequence
  chemically synthesized
aaagaaaccaaaaggggctatc

SEQ ID NO: 1370606 - DNA, 22 bp, Artificial Sequence
  chemically synthesized
aagaaaccaaaaggggctatcg

SEQ ID NO: 1370607 - DNA, 22 bp, Artificial Sequence
  chemically synthesized
tctctaggtgcctcgatagccc

SEQ ID NO: 1370608 - DNA, 22 bp, Artificial Sequence
  chemically synthesized
gaggttgtctctaggtgcctcg

SEQ ID NO: 1370609 - DNA, 22 bp, Artificial Sequence
  chemically synthesized
ctggaggttgtctctaggtgcc

SEQ ID NO: 1370610 - DNA, 22 bp, Artificial Sequence
  chemically synthesized
cctactggaggttgtctctagg

SEQ ID NO: 1370611 - DNA, 22 bp, Artificial Sequence
  chemically synthesized
tcgaggcacctagagacaacct

SEQ ID NO: 1370612 - DNA, 22 bp, Artificial Sequence
  chemically synthesized
gagacaacctccagtaggcaat

SEQ ID NO: 1370613 - DNA, 22 bp, Artificial Sequence
  chemically synthesized
ggaaaggtatatcacaattgcc

SEQ ID NO: 1370614 - DNA, 22 bp, Artificial Sequence
  chemically synthesized
cagtaggcaattgtgatatacc

SEQ ID NO: 1370615 - DNA, 22 bp, Artificial Sequence
  chemically synthesized
aggcatggtaaggctgggaaag

SEQ ID NO: 1370616 - DNA, 22 bp, Artificial Sequence
  chemically synthesized
caggcatggtaaggctgggaaa

SEQ ID NO: 1370617 - DNA, 22 bp, Artificial Sequence
  chemically synthesized
ttcaggcatggtaaggctggga

SEQ ID NO: 1370618 - DNA, 22 bp, Artificial Sequence
  chemically synthesized
tgatatacctttcccagcctta

SEQ ID NO: 1370619 - DNA, 22 bp, Artificial Sequence
  chemically synthesized
actcttcaggcatggtaaggct

SEQ ID NO: 1370620 - DNA, 22 bp, Artificial Sequence
  chemically synthesized
gactcttcaggcatggtaaggc

SEQ ID NO: 1370621 - DNA, 22 bp, Artificial Sequence
  chemically synthesized
acttgactcttcaggcatggta

SEQ ID NO: 1370622 - DNA, 22 bp, Artificial Sequence
  chemically synthesized
cacttgactcttcaggcatggt

SEQ ID NO: 1370623 - DNA, 22 bp, Artificial Sequence
  chemically synthesized
tcccagccttaccatgcctgaa

SEQ ID NO: 1370624 - DNA, 22 bp, Artificial Sequence
  chemically synthesized
cccagccttaccatgcctgaag

SEQ ID NO: 1370625 - DNA, 22 bp, Artificial Sequence
  chemically synthesized
cttcacttgactcttcaggcat

SEQ ID NO: 1370626 - DNA, 22 bp, Artificial Sequence
  chemically synthesized
ccagccttaccatgcctgaaga

SEQ ID NO: 1370627 - DNA, 22 bp, Artificial Sequence
  chemically synthesized
ccttcacttgactcttcaggca

SEQ ID NO: 1370628 - DNA, 22 bp, Artificial Sequence
  chemically synthesized
cttccttcacttgactcttcag

SEQ ID NO: 1370629 - DNA, 22 bp, Artificial Sequence
  chemically synthesized
accatgcctgaagagtcaagtg

SEQ ID NO: 1370630 - DNA, 22 bp, Artificial Sequence
  chemically synthesized
ccatgcctgaagagtcaagtga

SEQ ID NO: 1370631 - DNA, 22 bp, Artificial Sequence
  chemically synthesized
gaaaatcctacttccttcactt

SEQ ID NO: 1370632 - DNA, 22 bp, Artificial Sequence
  chemically synthesized
agaaaatcctacttccttcact

SEQ ID NO: 1370633 - DNA, 22 bp, Artificial Sequence
  chemically synthesized
aagagtcaagtgaaggaagtag

SEQ ID NO: 1370634 - DNA, 22 bp, Artificial Sequence
  chemically synthesized
gatttagaaaatcctacttcct

SEQ ID NO: 1370635 - DNA, 22 bp, Artificial Sequence
  chemically synthesized
ctggatttagaaaatcctactt

SEQ ID NO: 1370636 - DNA, 22 bp, Artificial Sequence
  chemically synthesized
actggatttagaaaatcctact

SEQ ID NO: 1370637 - DNA, 22 bp, Artificial Sequence
  chemically synthesized
ttactggatttagaaaatccta

SEQ ID NO: 1370638 - DNA, 22 bp, Artificial Sequence
  chemically synthesized
tctcttactggatttagaaaat

SEQ ID NO: 1370639 - DNA, 22 bp, Artificial Sequence
  chemically synthesized
tatctcttactggatttagaaa

SEQ ID NO: 1370640 - DNA, 22 bp, Artificial Sequence
  chemically synthesized
tggctctatctcttactggatt

SEQ ID NO: 1370641 - DNA, 22 bp, Artificial Sequence
  chemically synthesized
tatggctctatctcttactgga

SEQ ID NO: 1370642 - DNA, 22 bp, Artificial Sequence
  chemically synthesized
ctctatggctctatctcttact

SEQ ID NO: 1370643 - DNA, 22 bp, Artificial Sequence
  chemically synthesized
tctaaatccagtaagagataga

SEQ ID NO: 1370644 - DNA, 22 bp, Artificial Sequence
  chemically synthesized
ctaaatccagtaagagatagag

SEQ ID NO: 1370645 - DNA, 22 bp, Artificial Sequence
  chemically synthesized
taaatccagtaagagatagagc

SEQ ID NO: 1370646 - DNA, 22 bp, Artificial Sequence
  chemically synthesized
aatccagtaagagatagagcca

SEQ ID NO: 1370647 - DNA, 22 bp, Artificial Sequence
  chemically synthesized
agaatctcctctatggctctat

SEQ ID NO: 1370648 - DNA, 22 bp, Artificial Sequence
  chemically synthesized
ttaagaatctcctctatggctc

SEQ ID NO: 1370649 - DNA, 22 bp, Artificial Sequence
  chemically synthesized
tcctgttaagaatctcctctat

SEQ ID NO: 1370650 - DNA, 22 bp, Artificial Sequence
  chemically synthesized
actatcctgttaagaatctcct

SEQ ID NO: 1370651 - DNA, 22 bp, Artificial Sequence
  chemically synthesized
taactatcctgttaagaatctc

SEQ ID NO: 1370652 - DNA, 22 bp, Artificial Sequence
  chemically synthesized
tatctctaactatcctgttaag

SEQ ID NO: 1370653 - DNA, 22 bp, Artificial Sequence
  chemically synthesized
atatctctaactatcctgttaa

SEQ ID NO: 1370654 - DNA, 22 bp, Artificial Sequence
  chemically synthesized
ttaacaggatagttagagatat

SEQ ID NO: 1370655 - DNA, 22 bp, Artificial Sequence
  chemically synthesized
aacaggatagttagagatataa

SEQ ID NO: 1370656 - DNA, 22 bp, Artificial Sequence
  chemically synthesized
acaggatagttagagatataag

SEQ ID NO: 1370657 - DNA, 22 bp, Artificial Sequence
  chemically synthesized
ccaccatggcagcttatatctc

SEQ ID NO: 1370658 - DNA, 22 bp, Artificial Sequence
  chemically synthesized
cccaccatggcagcttatatct

SEQ ID NO: 1370659 - DNA, 22 bp, Artificial Sequence
  chemically synthesized
tttcccaccatggcagcttata

SEQ ID NO: 1370660 - DNA, 22 bp, Artificial Sequence
  chemically synthesized
atttcccaccatggcagcttat

SEQ ID NO: 1370661 - DNA, 22 bp, Artificial Sequence
  chemically synthesized
tgccttatttcccaccatggca

SEQ ID NO: 1370662 - DNA, 22 bp, Artificial Sequence
  chemically synthesized
gagatataagctgccatggtgg

SEQ ID NO: 1370663 - DNA, 22 bp, Artificial Sequence
  chemically synthesized
gtgccttatttcccaccatggc

SEQ ID NO: 1370664 - DNA, 22 bp, Artificial Sequence
  chemically synthesized
tgtgccttatttcccaccatgg

SEQ ID NO: 1370665 - DNA, 22 bp, Artificial Sequence
  chemically synthesized
tttgtgccttatttcccaccat

SEQ ID NO: 1370666 - DNA, 22 bp, Artificial Sequence
  chemically synthesized
tctttgtgccttatttcccacc

SEQ ID NO: 1370667 - DNA, 22 bp, Artificial Sequence
  chemically synthesized
cactctctttgtgccttatttc

SEQ ID NO: 1370668 - DNA, 22 bp, Artificial Sequence
  chemically synthesized
ccatggtgggaaataaggcaca

SEQ ID NO: 1370669 - DNA, 22 bp, Artificial Sequence
  chemically synthesized
acctccactctctttgtgcctt

SEQ ID NO: 1370670 - DNA, 22 bp, Artificial Sequence
  chemically synthesized
cattgacctccactctctttgt

SEQ ID NO: 1370671 - DNA, 22 bp, Artificial Sequence
  chemically synthesized
acattgacctccactctctttg

SEQ ID NO: 1370672 - DNA, 22 bp, Artificial Sequence
  chemically synthesized
tacattgacctccactctcttt

SEQ ID NO: 1370673 - DNA, 22 bp, Artificial Sequence
  chemically synthesized
ttacattgacctccactctctt

SEQ ID NO: 1370674 - DNA, 22 bp, Artificial Sequence
  chemically synthesized
cttttacattgacctccactct

SEQ ID NO: 1370675 - DNA, 22 bp, Artificial Sequence
  chemically synthesized
ggacattccttttacattgacc

SEQ ID NO: 1370676 - DNA, 22 bp, Artificial Sequence
  chemically synthesized
ctctctttctgcctttctgtct

SEQ ID NO: 1370677 - DNA, 22 bp, Artificial Sequence
  chemically synthesized
tctttctgcctttctgtcttat

SEQ ID NO: 1370678 - DNA, 22 bp, Artificial Sequence
  chemically synthesized
tttctgcctttctgtcttatgt

SEQ ID NO: 1370679 - DNA, 22 bp, Artificial Sequence
  chemically synthesized
tctgcctttctgtcttatgttt

SEQ ID NO: 1370680 - DNA, 22 bp, Artificial Sequence
  chemically synthesized
ctgcctttctgtcttatgttta

SEQ ID NO: 1370681 - DNA, 22 bp, Artificial Sequence
  chemically synthesized
tgcctttctgtcttatgtttat

SEQ ID NO: 1370682 - DNA, 22 bp, Artificial Sequence
  chemically synthesized
gccaatggaaggcataaacata

SEQ ID NO: 1370683 - DNA, 22 bp, Artificial Sequence
  chemically synthesized
cctttctgtcttatgtttatgc

SEQ ID NO: 1370684 - DNA, 22 bp, Artificial Sequence
  chemically synthesized
ggccaatggaaggcataaacat

SEQ ID NO: 1370685 - DNA, 22 bp, Artificial Sequence
  chemically synthesized
tggccaatggaaggcataaaca

SEQ ID NO: 1370686 - DNA, 22 bp, Artificial Sequence
  chemically synthesized
tctgtcttatgtttatgccttc

SEQ ID NO: 1370687 - DNA, 22 bp, Artificial Sequence
  chemically synthesized
ctgtcttatgtttatgccttcc

SEQ ID NO: 1370688 - DNA, 22 bp, Artificial Sequence
  chemically synthesized
gttttggccaatggaaggcata

SEQ ID NO: 1370689 - DNA, 22 bp, Artificial Sequence
  chemically synthesized
tgtcttatgtttatgccttcca

SEQ ID NO: 1370690 - DNA, 22 bp, Artificial Sequence
  chemically synthesized
tcttatgtttatgccttccatt

SEQ ID NO: 1370691 - DNA, 22 bp, Artificial Sequence
  chemically synthesized
ttggttttggccaatggaaggc

SEQ ID NO: 1370692 - DNA, 22 bp, Artificial Sequence
  chemically synthesized
ctgttggttttggccaatggaa

SEQ ID NO: 1370693 - DNA, 22 bp, Artificial Sequence
  chemically synthesized
atgtttatgccttccattggcc

SEQ ID NO: 1370694 - DNA, 22 bp, Artificial Sequence
  chemically synthesized
tgtttatgccttccattggcca

SEQ ID NO: 1370695 - DNA, 22 bp, Artificial Sequence
  chemically synthesized
atgccttccattggccaaaacc

SEQ ID NO: 1370696 - DNA, 22 bp, Artificial Sequence
  chemically synthesized
tgccttccattggccaaaacca

SEQ ID NO: 1370697 - DNA, 22 bp, Artificial Sequence
  chemically synthesized
ccgagtagtctcctgttggttt

SEQ ID NO: 1370698 - DNA, 22 bp, Artificial Sequence
  chemically synthesized
gccgagtagtctcctgttggtt

SEQ ID NO: 1370699 - DNA, 22 bp, Artificial Sequence
  chemically synthesized
ccattggccaaaaccaacagga

SEQ ID NO: 1370700 - DNA, 22 bp, Artificial Sequence
  chemically synthesized
cattggccaaaaccaacaggag

SEQ ID NO: 1370701 - DNA, 22 bp, Artificial Sequence
  chemically synthesized
ccttgccgagtagtctcctgtt

SEQ ID NO: 1370702 - DNA, 22 bp, Artificial Sequence
  chemically synthesized
gccaaaaccaacaggagactac

SEQ ID NO: 1370703 - DNA, 22 bp, Artificial Sequence
  chemically synthesized
gctcccttgccgagtagtctcc

SEQ ID NO: 1370704 - DNA, 22 bp, Artificial Sequence
  chemically synthesized
agctcccttgccgagtagtctc

SEQ ID NO: 1370705 - DNA, 22 bp, Artificial Sequence
  chemically synthesized
cttagctcccttgccgagtagt

SEQ ID NO: 1370706 - DNA, 22 bp, Artificial Sequence
  chemically synthesized
ccttagctcccttgccgagtag

SEQ ID NO: 1370707 - DNA, 22 bp, Artificial Sequence
  chemically synthesized
catttccttagctcccttgccg

SEQ ID NO: 1370708 - DNA, 22 bp, Artificial Sequence
  chemically synthesized
taaattgcatttccttagctcc

SEQ ID NO: 1370709 - DNA, 22 bp, Artificial Sequence
  chemically synthesized
ctcggcaagggagctaaggaaa

SEQ ID NO: 1370710 - DNA, 22 bp, Artificial Sequence
  chemically synthesized
ggcaagggagctaaggaaatgc

SEQ ID NO: 1370711 - DNA, 22 bp, Artificial Sequence
  chemically synthesized
acccctataaattgcatttcct

SEQ ID NO: 1370712 - DNA, 22 bp, Artificial Sequence
  chemically synthesized
tgaagctgacccctataaattg

SEQ ID NO: 1370713 - DNA, 22 bp, Artificial Sequence
  chemically synthesized
aggaaatgcaatttataggggt

SEQ ID NO: 1370714 - DNA, 22 bp, Artificial Sequence
  chemically synthesized
tcactgtgaagctgacccctat

SEQ ID NO: 1370715 - DNA, 22 bp, Artificial Sequence
  chemically synthesized
tgtcactgtgaagctgacccct

SEQ ID NO: 1370716 - DNA, 22 bp, Artificial Sequence
  chemically synthesized
ctctgtcactgtgaagctgacc

SEQ ID NO: 1370717 - DNA, 22 bp, Artificial Sequence
  chemically synthesized
tgctctgtcactgtgaagctga

SEQ ID NO: 1370718 - DNA, 22 bp, Artificial Sequence
  chemically synthesized
ttctgctctgtcactgtgaagc

SEQ ID NO: 1370719 - DNA, 22 bp, Artificial Sequence
  chemically synthesized
gttctgctctgtcactgtgaag

SEQ ID NO: 1370720 - DNA, 22 bp, Artificial Sequence
  chemically synthesized
ataggggtcagcttcacagtga

SEQ ID NO: 1370721 - DNA, 22 bp, Artificial Sequence
  chemically synthesized
tgttctgctctgtcactgtgaa

SEQ ID NO: 1370722 - DNA, 22 bp, Artificial Sequence
  chemically synthesized
taggggtcagcttcacagtgac

SEQ ID NO: 1370723 - DNA, 22 bp, Artificial Sequence
  chemically synthesized
ttgttctgctctgtcactgtga

SEQ ID NO: 1370724 - DNA, 22 bp, Artificial Sequence
  chemically synthesized
tttgttctgctctgtcactgtg

SEQ ID NO: 1370725 - DNA, 22 bp, Artificial Sequence
  chemically synthesized
ttttgttctgctctgtcactgt

SEQ ID NO: 1370726 - DNA, 22 bp, Artificial Sequence
  chemically synthesized
ttttttgttctgctctgtcact

SEQ ID NO: 1370727 - DNA, 22 bp, Artificial Sequence
  chemically synthesized
tgctcttttttgttctgctctg

SEQ ID NO: 1370728 - DNA, 22 bp, Artificial Sequence
  chemically synthesized
atgctcttttttgttctgctct

SEQ ID NO: 1370729 - DNA, 22 bp, Artificial Sequence
  chemically synthesized
tatgctcttttttgttctgctc

SEQ ID NO: 1370730 - DNA, 22 bp, Artificial Sequence
  chemically synthesized
cacagtgacagagcagaacaaa

SEQ ID NO: 1370731 - DNA, 22 bp, Artificial Sequence
  chemically synthesized
acagtgacagagcagaacaaaa

SEQ ID NO: 1370732 - DNA, 22 bp, Artificial Sequence
  chemically synthesized
gcccaatccattttatgctctt

SEQ ID NO: 1370733 - DNA, 22 bp, Artificial Sequence
  chemically synthesized
ggcccaatccattttatgctct

SEQ ID NO: 1370734 - DNA, 22 bp, Artificial Sequence
  chemically synthesized
gcttggcccaatccattttatg

SEQ ID NO: 1370735 - DNA, 22 bp, Artificial Sequence
  chemically synthesized
ctggcttggcccaatccatttt

SEQ ID NO: 1370736 - DNA, 22 bp, Artificial Sequence
  chemically synthesized
gctggcttggcccaatccattt

SEQ ID NO: 1370737 - DNA, 22 bp, Artificial Sequence
  chemically synthesized
ttgctggcttggcccaatccat

SEQ ID NO: 1370738 - DNA, 22 bp, Artificial Sequence
  chemically synthesized
cttgctggcttggcccaatcca

SEQ ID NO: 1370739 - DNA, 22 bp, Artificial Sequence
  chemically synthesized
tcttgctggcttggcccaatcc

SEQ ID NO: 1370740 - DNA, 22 bp, Artificial Sequence
  chemically synthesized
ttcttgctggcttggcccaatc

SEQ ID NO: 1370741 - DNA, 22 bp, Artificial Sequence
  chemically synthesized
ttttcttgctggcttggcccaa

SEQ ID NO: 1370742 - DNA, 22 bp, Artificial Sequence
  chemically synthesized
agtacactcttttcttgctggc

SEQ ID NO: 1370743 - DNA, 22 bp, Artificial Sequence
  chemically synthesized
cagtacactcttttcttgctgg

SEQ ID NO: 1370744 - DNA, 22 bp, Artificial Sequence
  chemically synthesized
ggccaagccagcaagaaaagag

SEQ ID NO: 1370745 - DNA, 22 bp, Artificial Sequence
  chemically synthesized
aatatttcagtacactcttttc

SEQ ID NO: 1370746 - DNA, 22 bp, Artificial Sequence
  chemically synthesized
aaatatttcagtacactctttt

SEQ ID NO: 1370747 - DNA, 22 bp, Artificial Sequence
  chemically synthesized
taaatatttcagtacactcttt

SEQ ID NO: 1370748 - DNA, 22 bp, Artificial Sequence
  chemically synthesized
aattttaaatatttcagtacac

SEQ ID NO: 1370749 - DNA, 22 bp, Artificial Sequence
  chemically synthesized
taaattttaaatatttcagtac

SEQ ID NO: 1370750 - DNA, 22 bp, Artificial Sequence
  chemically synthesized
tctaaattttaaatatttcagt

SEQ ID NO: 1370751 - DNA, 22 bp, Artificial Sequence
  chemically synthesized
tctctaaattttaaatatttca

SEQ ID NO: 1370752 - DNA, 22 bp, Artificial Sequence
  chemically synthesized
ctctctaaattttaaatatttc

SEQ ID NO: 1370753 - DNA, 22 bp, Artificial Sequence
  chemically synthesized
tctctctaaattttaaatattt

SEQ ID NO: 1370754 - DNA, 22 bp, Artificial Sequence
  chemically synthesized
ttctctctaaattttaaatatt

SEQ ID NO: 1370755 - DNA, 22 bp, Artificial Sequence
  chemically synthesized
tttctctctaaattttaaatat

SEQ ID NO: 1370756 - DNA, 22 bp, Artificial Sequence
  chemically synthesized
ttttttctctctaaattttaaa

SEQ ID NO: 1370757 - DNA, 22 bp, Artificial Sequence
  chemically synthesized
attttttctctctaaattttaa

SEQ ID NO: 1370758 - DNA, 22 bp, Artificial Sequence
  chemically synthesized
aaatatttaaaatttagagaga

SEQ ID NO: 1370759 - DNA, 22 bp, Artificial Sequence
  chemically synthesized
gtggatttattttttctctcta

SEQ ID NO: 1370760 - DNA, 22 bp, Artificial Sequence
  chemically synthesized
ggttggtggatttattttttct

SEQ ID NO: 1370761 - DNA, 22 bp, Artificial Sequence
  chemically synthesized
aaaatttagagagaaaaaataa

SEQ ID NO: 1370762 - DNA, 22 bp, Artificial Sequence
  chemically synthesized
aggttggtggatttattttttc

SEQ ID NO: 1370763 - DNA, 22 bp, Artificial Sequence
  chemically synthesized
aaatttagagagaaaaaataaa

SEQ ID NO: 1370764 - DNA, 22 bp, Artificial Sequence
  chemically synthesized
taggttggtggatttatttttt

SEQ ID NO: 1370765 - DNA, 22 bp, Artificial Sequence
  chemically synthesized
agagagaaaaaataaatccacc

SEQ ID NO: 1370766 - DNA, 22 bp, Artificial Sequence
  chemically synthesized
gagagaaaaaataaatccacca

SEQ ID NO: 1370767 - DNA, 22 bp, Artificial Sequence
  chemically synthesized
accaatacagcattttaggttg

SEQ ID NO: 1370768 - DNA, 22 bp, Artificial Sequence
  chemically synthesized
caccaatacagcattttaggtt

SEQ ID NO: 1370769 - DNA, 22 bp, Artificial Sequence
  chemically synthesized
aaggataatttcaccaatacag

SEQ ID NO: 1370770 - DNA, 22 bp, Artificial Sequence
  chemically synthesized
gaaggataatttcaccaataca

SEQ ID NO: 1370771 - DNA, 22 bp, Artificial Sequence
  chemically synthesized
tgaaggataatttcaccaatac

SEQ ID NO: 1370772 - DNA, 22 bp, Artificial Sequence
  chemically synthesized
ttgaaggataatttcaccaata

SEQ ID NO: 1370773 - DNA, 22 bp, Artificial Sequence
  chemically synthesized
cttttgaaggataatttcacca

SEQ ID NO: 1370774 - DNA, 22 bp, Artificial Sequence
  chemically synthesized
aaatgctgtattggtgaaatta

SEQ ID NO: 1370775 - DNA, 22 bp, Artificial Sequence
  chemically synthesized
acttttgaaggataatttcacc

SEQ ID NO: 1370776 - DNA, 22 bp, Artificial Sequence
  chemically synthesized
tacttttgaaggataatttcac

SEQ ID NO: 1370777 - DNA, 22 bp, Artificial Sequence
  chemically synthesized
ttacttttgaaggataatttca

SEQ ID NO: 1370778 - DNA, 22 bp, Artificial Sequence
  chemically synthesized
ttttacttttgaaggataattt

SEQ ID NO: 1370779 - DNA, 22 bp, Artificial Sequence
  chemically synthesized
tcttttacttttgaaggataat

SEQ ID NO: 1370780 - DNA, 22 bp, Artificial Sequence
  chemically synthesized
ctcttttacttttgaaggataa

SEQ ID NO: 1370781 - DNA, 22 bp, Artificial Sequence
  chemically synthesized
tattggtgaaattatccttcaa

SEQ ID NO: 1370782 - DNA, 22 bp, Artificial Sequence
  chemically synthesized
atttctcttttacttttgaagg

SEQ ID NO: 1370783 - DNA, 22 bp, Artificial Sequence
  chemically synthesized
gtgaaattatccttcaaaagta

SEQ ID NO: 1370784 - DNA, 22 bp, Artificial Sequence
  chemically synthesized
tccttcaaaagtaaaagagaaa

SEQ ID NO: 1370785 - DNA, 22 bp, Artificial Sequence
  chemically synthesized
ataaagtattcatttctctttt

SEQ ID NO: 1370786 - DNA, 22 bp, Artificial Sequence
  chemically synthesized
tctgataaagtattcatttctc

SEQ ID NO: 1370787 - DNA, 22 bp, Artificial Sequence
  chemically synthesized
caaaagtaaaagagaaatgaat

SEQ ID NO: 1370788 - DNA, 22 bp, Artificial Sequence
  chemically synthesized
gtctgataaagtattcatttct

SEQ ID NO: 1370789 - DNA, 22 bp, Artificial Sequence
  chemically synthesized
aaaagtaaaagagaaatgaata

SEQ ID NO: 1370790 - DNA, 22 bp, Artificial Sequence
  chemically synthesized
agcgtgtttgtctgataaagta

SEQ ID NO: 1370791 - DNA, 22 bp, Artificial Sequence
  chemically synthesized
cctcagcgtgtttgtctgataa

SEQ ID NO: 1370792 - DNA, 22 bp, Artificial Sequence
  chemically synthesized
gcagcaaattccctcagcgtgt

SEQ ID NO: 1370793 - DNA, 22 bp, Artificial Sequence
  chemically synthesized
tatcagacaaacacgctgaggg

SEQ ID NO: 1370794 - DNA, 22 bp, Artificial Sequence
  chemically synthesized
atcagacaaacacgctgaggga

SEQ ID NO: 1370795 - DNA, 22 bp, Artificial Sequence
  chemically synthesized
ctggcagcaaattccctcagcg

SEQ ID NO: 1370796 - DNA, 22 bp, Artificial Sequence
  chemically synthesized
tcagacaaacacgctgagggaa

SEQ ID NO: 1370797 - DNA, 22 bp, Artificial Sequence
  chemically synthesized
caaggcagatctactggcagca

SEQ ID NO: 1370798 - DNA, 22 bp, Artificial Sequence
  chemically synthesized
gcaaggcagatctactggcagc

SEQ ID NO: 1370799 - DNA, 22 bp, Artificial Sequence
  chemically synthesized
ttgcaaggcagatctactggca

SEQ ID NO: 1370800 - DNA, 22 bp, Artificial Sequence
  chemically synthesized
agggaatttgctgccagtagat

SEQ ID NO: 1370801 - DNA, 22 bp, Artificial Sequence
  chemically synthesized
cttgcaaggcagatctactggc

SEQ ID NO: 1370802 - DNA, 22 bp, Artificial Sequence
  chemically synthesized
acatttcttgcaaggcagatct

SEQ ID NO: 1370803 - DNA, 22 bp, Artificial Sequence
  chemically synthesized
gacatttcttgcaaggcagatc

SEQ ID NO: 1370804 - DNA, 22 bp, Artificial Sequence
  chemically synthesized
tgacatttcttgcaaggcagat

SEQ ID NO: 1370805 - DNA, 22 bp, Artificial Sequence
  chemically synthesized
gctgccagtagatctgccttgc

SEQ ID NO: 1370806 - DNA, 22 bp, Artificial Sequence
  chemically synthesized
ttgacatttcttgcaaggcaga

SEQ ID NO: 1370807 - DNA, 22 bp, Artificial Sequence
  chemically synthesized
ctgccagtagatctgccttgca

SEQ ID NO: 1370808 - DNA, 22 bp, Artificial Sequence
  chemically synthesized
ttttgacatttcttgcaaggca

SEQ ID NO: 1370809 - DNA, 22 bp, Artificial Sequence
  chemically synthesized
cttttgacatttcttgcaaggc

SEQ ID NO: 1370810 - DNA, 22 bp, Artificial Sequence
  chemically synthesized
ccagtagatctgccttgcaaga

SEQ ID NO: 1370811 - DNA, 22 bp, Artificial Sequence
  chemically synthesized
aagtccttcttttgacatttct

SEQ ID NO: 1370812 - DNA, 22 bp, Artificial Sequence
  chemically synthesized
tgaagtccttcttttgacattt

SEQ ID NO: 1370813 - DNA, 22 bp, Artificial Sequence
  chemically synthesized
tctgaagtccttcttttgacat

SEQ ID NO: 1370814 - DNA, 22 bp, Artificial Sequence
  chemically synthesized
ccttgcaagaaatgtcaaaaga

SEQ ID NO: 1370815 - DNA, 22 bp, Artificial Sequence
  chemically synthesized
ctctgaagtccttcttttgaca

SEQ ID NO: 1370816 - DNA, 22 bp, Artificial Sequence
  chemically synthesized
tctctgaagtccttcttttgac

SEQ ID NO: 1370817 - DNA, 22 bp, Artificial Sequence
  chemically synthesized
ttctctgaagtccttcttttga

SEQ ID NO: 1370818 - DNA, 22 bp, Artificial Sequence
  chemically synthesized
tttctctgaagtccttcttttg

SEQ ID NO: 1370819 - DNA, 22 bp, Artificial Sequence
  chemically synthesized
gcaagaaatgtcaaaagaagga

SEQ ID NO: 1370820 - DNA, 22 bp, Artificial Sequence
  chemically synthesized
caagaaatgtcaaaagaaggac

SEQ ID NO: 1370821 - DNA, 22 bp, Artificial Sequence
  chemically synthesized
tttttctctgaagtccttcttt

SEQ ID NO: 1370822 - DNA, 22 bp, Artificial Sequence
  chemically synthesized
ctttttctctgaagtccttctt

SEQ ID NO: 1370823 - DNA, 22 bp, Artificial Sequence
  chemically synthesized
tctttttctctgaagtccttct

SEQ ID NO: 1370824 - DNA, 22 bp, Artificial Sequence
  chemically synthesized
catcattttctttttctctgaa

SEQ ID NO: 1370825 - DNA, 22 bp, Artificial Sequence
  chemically synthesized
acatcattttctttttctctga

SEQ ID NO: 1370826 - DNA, 22 bp, Artificial Sequence
  chemically synthesized
acttacatcattttctttttct

SEQ ID NO: 1370827 - DNA, 22 bp, Artificial Sequence
  chemically synthesized
tgacttacatcattttcttttt

SEQ ID NO: 1370828 - DNA, 22 bp, Artificial Sequence
  chemically synthesized
ctgacttacatcattttctttt

SEQ ID NO: 1370829 - DNA, 22 bp, Artificial Sequence
  chemically synthesized
agtttctgacttacatcatttt

SEQ ID NO: 1370830 - DNA, 22 bp, Artificial Sequence
  chemically synthesized
cagagaaaaagaaaatgatgta

SEQ ID NO: 1370831 - DNA, 22 bp, Artificial Sequence
  chemically synthesized
agagaaaaagaaaatgatgtaa

SEQ ID NO: 1370832 - DNA, 22 bp, Artificial Sequence
  chemically synthesized
tgtagatctaagtttctgactt

SEQ ID NO: 1370833 - DNA, 22 bp, Artificial Sequence
  chemically synthesized
atgtagatctaagtttctgact

SEQ ID NO: 1370834 - DNA, 22 bp, Artificial Sequence
  chemically synthesized
tatgtagatctaagtttctgac

SEQ ID NO: 1370835 - DNA, 22 bp, Artificial Sequence
  chemically synthesized
tttatgtagatctaagtttctg

SEQ ID NO: 1370836 - DNA, 22 bp, Artificial Sequence
  chemically synthesized
ctttatgtagatctaagtttct

SEQ ID NO: 1370837 - DNA, 22 bp, Artificial Sequence
  chemically synthesized
tctttatgtagatctaagtttc

SEQ ID NO: 1370838 - DNA, 22 bp, Artificial Sequence
  chemically synthesized
ctttctttatgtagatctaagt

SEQ ID NO: 1370839 - DNA, 22 bp, Artificial Sequence
  chemically synthesized
cctttctttatgtagatctaag

SEQ ID NO: 1370840 - DNA, 22 bp, Artificial Sequence
  chemically synthesized
atgtacttcctttctttatgta

SEQ ID NO: 1370841 - DNA, 22 bp, Artificial Sequence
  chemically synthesized
taatgtacttcctttctttatg

SEQ ID NO: 1370842 - DNA, 22 bp, Artificial Sequence
  chemically synthesized
tctaatgtacttcctttcttta

SEQ ID NO: 1370843 - DNA, 22 bp, Artificial Sequence
  chemically synthesized
ctctaatgtacttcctttcttt

SEQ ID NO: 1370844 - DNA, 22 bp, Artificial Sequence
  chemically synthesized
agatctacataaagaaaggaag

SEQ ID NO: 1370845 - DNA, 22 bp, Artificial Sequence
  chemically synthesized
gatctacataaagaaaggaagt

SEQ ID NO: 1370846 - DNA, 22 bp, Artificial Sequence
  chemically synthesized
cttctctaatgtacttcctttc

SEQ ID NO: 1370847 - DNA, 22 bp, Artificial Sequence
  chemically synthesized
ccttctctaatgtacttccttt

SEQ ID NO: 1370848 - DNA, 22 bp, Artificial Sequence
  chemically synthesized
tccttctctaatgtacttcctt

SEQ ID NO: 1370849 - DNA, 22 bp, Artificial Sequence
  chemically synthesized
ttccttctctaatgtacttcct

SEQ ID NO: 1370850 - DNA, 22 bp, Artificial Sequence
  chemically synthesized
tttccttctctaatgtacttcc

SEQ ID NO: 1370851 - DNA, 22 bp, Artificial Sequence
  chemically synthesized
cataaagaaaggaagtacatta

SEQ ID NO: 1370852 - DNA, 22 bp, Artificial Sequence
  chemically synthesized
attttttccttctctaatgtac

SEQ ID NO: 1370853 - DNA, 22 bp, Artificial Sequence
  chemically synthesized
cattttttccttctctaatgta

SEQ ID NO: 1370854 - DNA, 22 bp, Artificial Sequence
  chemically synthesized
tcattttttccttctctaatgt

SEQ ID NO: 1370855 - DNA, 22 bp, Artificial Sequence
  chemically synthesized
ctttcattttttccttctctaa

SEQ ID NO: 1370856 - DNA, 22 bp, Artificial Sequence
  chemically synthesized
actttcattttttccttctcta

SEQ ID NO: 1370857 - DNA, 22 bp, Artificial Sequence
  chemically synthesized
tactttcattttttccttctct

SEQ ID NO: 1370858 - DNA, 22 bp, Artificial Sequence
  chemically synthesized
ttttactttcattttttccttc

SEQ ID NO: 1370859 - DNA, 22 bp, Artificial Sequence
  chemically synthesized
gttttactttcattttttcctt

SEQ ID NO: 1370860 - DNA, 22 bp, Artificial Sequence
  chemically synthesized
tgttttactttcattttttcct

SEQ ID NO: 1370861 - DNA, 22 bp, Artificial Sequence
  chemically synthesized
gagaaggaaaaaatgaaagtaa

SEQ ID NO: 1370862 - DNA, 22 bp, Artificial Sequence
  chemically synthesized
gatcaatcaggaataggaagaa

SEQ ID NO: 1370863 - DNA, 22 bp, Artificial Sequence
  chemically synthesized
ttagatcaatcaggaataggaa

SEQ ID NO: 1370864 - DNA, 22 bp, Artificial Sequence
  chemically synthesized
attagatcaatcaggaatagga

SEQ ID NO: 1370865 - DNA, 22 bp, Artificial Sequence
  chemically synthesized
tctattcttcctattcctgatt

SEQ ID NO: 1370866 - DNA, 22 bp, Artificial Sequence
  chemically synthesized
ttcttcctattcctgattgatc

SEQ ID NO: 1370867 - DNA, 22 bp, Artificial Sequence
  chemically synthesized
ttcctattcctgattgatctaa

SEQ ID NO: 1370868 - DNA, 22 bp, Artificial Sequence
  chemically synthesized
aacaaatatttattagatcaat

SEQ ID NO: 1370869 - DNA, 22 bp, Artificial Sequence
  chemically synthesized
cctattcctgattgatctaata

SEQ ID NO: 1370870 - DNA, 22 bp, Artificial Sequence
  chemically synthesized
ctattcctgattgatctaataa

SEQ ID NO: 1370871 - DNA, 22 bp, Artificial Sequence
  chemically synthesized
tattgaacaaatatttattaga

SEQ ID NO: 1370872 - DNA, 22 bp, Artificial Sequence
  chemically synthesized
ttcctgattgatctaataaata

SEQ ID NO: 1370873 - DNA, 22 bp, Artificial Sequence
  chemically synthesized
ttatattgaacaaatatttatt

SEQ ID NO: 1370874 - DNA, 22 bp, Artificial Sequence
  chemically synthesized
ctgattgatctaataaatattt

SEQ ID NO: 1370875 - DNA, 22 bp, Artificial Sequence
  chemically synthesized
ttattatattgaacaaatattt

SEQ ID NO: 1370876 - DNA, 22 bp, Artificial Sequence
  chemically synthesized
attgatctaataaatatttgtt

SEQ ID NO: 1370877 - DNA, 22 bp, Artificial Sequence
  chemically synthesized
ctgttattatattgaacaaata

SEQ ID NO: 1370878 - DNA, 22 bp, Artificial Sequence
  chemically synthesized
gctgttattatattgaacaaat

SEQ ID NO: 1370879 - DNA, 22 bp, Artificial Sequence
  chemically synthesized
atctaataaatatttgttcaat

SEQ ID NO: 1370880 - DNA, 22 bp, Artificial Sequence
  chemically synthesized
ttgctgttattatattgaacaa

SEQ ID NO: 1370881 - DNA, 22 bp, Artificial Sequence
  chemically synthesized
cttgctgttattatattgaaca

SEQ ID NO: 1370882 - DNA, 22 bp, Artificial Sequence
  chemically synthesized
ttcttgctgttattatattgaa

SEQ ID NO: 1370883 - DNA, 22 bp, Artificial Sequence
  chemically synthesized
ataaatatttgttcaatataat

SEQ ID NO: 1370884 - DNA, 22 bp, Artificial Sequence
  chemically synthesized
cttcttgctgttattatattga

SEQ ID NO: 1370885 - DNA, 22 bp, Artificial Sequence
  chemically synthesized
gttcaatataataacagcaaga

SEQ ID NO: 1370886 - DNA, 22 bp, Artificial Sequence
  chemically synthesized
ttcaatataataacagcaagaa

SEQ ID NO: 1370887 - DNA, 22 bp, Artificial Sequence
  chemically synthesized
aatataataacagcaagaagaa

SEQ ID NO: 1370888 - DNA, 22 bp, Artificial Sequence
  chemically synthesized
atcatccaatgtttcttcttgc

SEQ ID NO: 1370889 - DNA, 22 bp, Artificial Sequence
  chemically synthesized
taatcatccaatgtttcttctt

SEQ ID NO: 1370890 - DNA, 22 bp, Artificial Sequence
  chemically synthesized
tccataagctctaatcatccaa

SEQ ID NO: 1370891 - DNA, 22 bp, Artificial Sequence
  chemically synthesized
atccataagctctaatcatcca

SEQ ID NO: 1370892 - DNA, 22 bp, Artificial Sequence
  chemically synthesized
ttatccataagctctaatcatc

SEQ ID NO: 1370893 - DNA, 22 bp, Artificial Sequence
  chemically synthesized
tcttatccataagctctaatca

SEQ ID NO: 1370894 - DNA, 22 bp, Artificial Sequence
  chemically synthesized
ctcttatccataagctctaatc

SEQ ID NO: 1370895 - DNA, 22 bp, Artificial Sequence
  chemically synthesized
gtttctcttatccataagctct

SEQ ID NO: 1370896 - DNA, 22 bp, Artificial Sequence
  chemically synthesized
gatgattagagcttatggataa

SEQ ID NO: 1370897 - DNA, 22 bp, Artificial Sequence
  chemically synthesized
gcattcgtttctcttatccata

SEQ ID NO: 1370898 - DNA, 22 bp, Artificial Sequence
  chemically synthesized
ctggcattcgtttctcttatcc

SEQ ID NO: 1370899 - DNA, 22 bp, Artificial Sequence
  chemically synthesized
gagcttatggataagagaaacg

SEQ ID NO: 1370900 - DNA, 22 bp, Artificial Sequence
  chemically synthesized
taacattactggcattcgtttc

SEQ ID NO: 1370901 - DNA, 22 bp, Artificial Sequence
  chemically synthesized
gtaacattactggcattcgttt

SEQ ID NO: 1370902 - DNA, 22 bp, Artificial Sequence
  chemically synthesized
atggataagagaaacgaatgcc

SEQ ID NO: 1370903 - DNA, 22 bp, Artificial Sequence
  chemically synthesized
tgtaacattactggcattcgtt

SEQ ID NO: 1370904 - DNA, 22 bp, Artificial Sequence
  chemically synthesized
tggataagagaaacgaatgcca

SEQ ID NO: 1370905 - DNA, 22 bp, Artificial Sequence
  chemically synthesized
aacctttgtaacattactggca

SEQ ID NO: 1370906 - DNA, 22 bp, Artificial Sequence
  chemically synthesized
gaacctttgtaacattactggc

SEQ ID NO: 1370907 - DNA, 22 bp, Artificial Sequence
  chemically synthesized
ttgaacctttgtaacattactg

SEQ ID NO: 1370908 - DNA, 22 bp, Artificial Sequence
  chemically synthesized
cttgaacctttgtaacattact

SEQ ID NO: 1370909 - DNA, 22 bp, Artificial Sequence
  chemically synthesized
cttcttgaacctttgtaacatt

SEQ ID NO: 1370910 - DNA, 22 bp, Artificial Sequence
  chemically synthesized
ccttcttgaacctttgtaacat

SEQ ID NO: 1370911 - DNA, 22 bp, Artificial Sequence
  chemically synthesized
ttccttcttgaacctttgtaac

SEQ ID NO: 1370912 - DNA, 22 bp, Artificial Sequence
  chemically synthesized
ccaactcttccttcttgaacct

SEQ ID NO: 1370913 - DNA, 22 bp, Artificial Sequence
  chemically synthesized
caaaggttcaagaaggaagagt

SEQ ID NO: 1370914 - DNA, 22 bp, Artificial Sequence
  chemically synthesized
ccacacagaatattcccaactc

SEQ ID NO: 1370915 - DNA, 22 bp, Artificial Sequence
  chemically synthesized
cccacacagaatattcccaact

SEQ ID NO: 1370916 - DNA, 22 bp, Artificial Sequence
  chemically synthesized
tcccacacagaatattcccaac

SEQ ID NO: 1370917 - DNA, 22 bp, Artificial Sequence
  chemically synthesized
aagaaggaagagttgggaatat

SEQ ID NO: 1370918 - DNA, 22 bp, Artificial Sequence
  chemically synthesized
ttcccacacagaatattcccaa

SEQ ID NO: 1370919 - DNA, 22 bp, Artificial Sequence
  chemically synthesized
tttcccacacagaatattccca

SEQ ID NO: 1370920 - DNA, 22 bp, Artificial Sequence
  chemically synthesized
caatccgttttttcccacacag

SEQ ID NO: 1370921 - DNA, 22 bp, Artificial Sequence
  chemically synthesized
ggaatattctgtgtgggaaaaa

SEQ ID NO: 1370922 - DNA, 22 bp, Artificial Sequence
  chemically synthesized
ccactccaatccgttttttccc

SEQ ID NO: 1370923 - DNA, 22 bp, Artificial Sequence
  chemically synthesized
ctcccactccaatccgtttttt

SEQ ID NO: 1370924 - DNA, 22 bp, Artificial Sequence
  chemically synthesized
tgctcccactccaatccgtttt

SEQ ID NO: 1370925 - DNA, 22 bp, Artificial Sequence
  chemically synthesized
ctgctcccactccaatccgttt

SEQ ID NO: 1370926 - DNA, 22 bp, Artificial Sequence
  chemically synthesized
tgtgtgggaaaaaacggattgg

SEQ ID NO: 1370927 - DNA, 22 bp, Artificial Sequence
  chemically synthesized
tctgctcccactccaatccgtt

SEQ ID NO: 1370928 - DNA, 22 bp, Artificial Sequence
  chemically synthesized
ttctgctcccactccaatccgt

SEQ ID NO: 1370929 - DNA, 22 bp, Artificial Sequence
  chemically synthesized
tgtgggaaaaaacggattggag

SEQ ID NO: 1370930 - DNA, 22 bp, Artificial Sequence
  chemically synthesized
tttttctgctcccactccaatc

SEQ ID NO: 1370931 - DNA, 22 bp, Artificial Sequence
  chemically synthesized
gtttttctgctcccactccaat

SEQ ID NO: 1370932 - DNA, 22 bp, Artificial Sequence
  chemically synthesized
tgtttttctgctcccactccaa

SEQ ID NO: 1370933 - DNA, 22 bp, Artificial Sequence
  chemically synthesized
ttgtttttctgctcccactcca

SEQ ID NO: 1370934 - DNA, 22 bp, Artificial Sequence
  chemically synthesized
tgatttttgtttttctgctccc

SEQ ID NO: 1370935 - DNA, 22 bp, Artificial Sequence
  chemically synthesized
gagtgggagcagaaaaacaaaa

SEQ ID NO: 1370936 - DNA, 22 bp, Artificial Sequence
  chemically synthesized
cgtaaaggaattgtgatttttg

SEQ ID NO: 1370937 - DNA, 22 bp, Artificial Sequence
  chemically synthesized
acgtaaaggaattgtgattttt

SEQ ID NO: 1370938 - DNA, 22 bp, Artificial Sequence
  chemically synthesized
atttacgtaaaggaattgtgat

SEQ ID NO: 1370939 - DNA, 22 bp, Artificial Sequence
  chemically synthesized
atgttaatttacgtaaaggaat

SEQ ID NO: 1370940 - DNA, 22 bp, Artificial Sequence
  chemically synthesized
tgatgttaatttacgtaaagga

SEQ ID NO: 1370941 - DNA, 22 bp, Artificial Sequence
  chemically synthesized
gaggatggttctgatgttaatt

SEQ ID NO: 1370942 - DNA, 22 bp, Artificial Sequence
  chemically synthesized
ctttacgtaaattaacatcaga

SEQ ID NO: 1370943 - DNA, 22 bp, Artificial Sequence
  chemically synthesized
attagaggatggttctgatgtt

SEQ ID NO: 1370944 - DNA, 22 bp, Artificial Sequence
  chemically synthesized
tacgtaaattaacatcagaacc

SEQ ID NO: 1370945 - DNA, 22 bp, Artificial Sequence
  chemically synthesized
acgtaaattaacatcagaacca

SEQ ID NO: 1370946 - DNA, 22 bp, Artificial Sequence
  chemically synthesized
ctaattagaggatggttctgat

SEQ ID NO: 1370947 - DNA, 22 bp, Artificial Sequence
  chemically synthesized
cgtaaattaacatcagaaccat

SEQ ID NO: 1370948 - DNA, 22 bp, Artificial Sequence
  chemically synthesized
aactcctaattagaggatggtt

SEQ ID NO: 1370949 - DNA, 22 bp, Artificial Sequence
  chemically synthesized
gaactcctaattagaggatggt

SEQ ID NO: 1370950 - DNA, 22 bp, Artificial Sequence
  chemically synthesized
acatcagaaccatcctctaatt

SEQ ID NO: 1370951 - DNA, 22 bp, Artificial Sequence
  chemically synthesized
aacttgaactcctaattagagg

SEQ ID NO: 1370952 - DNA, 22 bp, Artificial Sequence
  chemically synthesized
taattaggagttcaagttcaac

SEQ ID NO: 1370953 - DNA, 22 bp, Artificial Sequence
  chemically synthesized
caaccaagtgaagttgaacttg

SEQ ID NO: 1370954 - DNA, 22 bp, Artificial Sequence
  chemically synthesized
attaggagttcaagttcaactt

SEQ ID NO: 1370955 - DNA, 22 bp, Artificial Sequence
  chemically synthesized
ggagttcaagttcaacttcact

SEQ ID NO: 1370956 - DNA, 22 bp, Artificial Sequence
  chemically synthesized
tgattacaaccaagtgaagttg

SEQ ID NO: 1370957 - DNA, 22 bp, Artificial Sequence
  chemically synthesized
aaattatgattacaaccaagtg

SEQ ID NO: 1370958 - DNA, 22 bp, Artificial Sequence
  chemically synthesized
aagttcaacttcacttggttgt

SEQ ID NO: 1370959 - DNA, 22 bp, Artificial Sequence
  chemically synthesized
aacttcacttggttgtaatcat

SEQ ID NO: 1370960 - DNA, 22 bp, Artificial Sequence
  chemically synthesized
cacttggttgtaatcataattt

SEQ ID NO: 1370961 - DNA, 22 bp, Artificial Sequence
  chemically synthesized
acttggttgtaatcataatttc

SEQ ID NO: 1370962 - DNA, 22 bp, Artificial Sequence
  chemically synthesized
agaagagaaagaattgaaatta

SEQ ID NO: 1370963 - DNA, 22 bp, Artificial Sequence
  chemically synthesized
ggttgtaatcataatttcaatt

SEQ ID NO: 1370964 - DNA, 22 bp, Artificial Sequence
  chemically synthesized
aagaagagaaagaattgaaatt

SEQ ID NO: 1370965 - DNA, 22 bp, Artificial Sequence
  chemically synthesized
gttgtaatcataatttcaattc

SEQ ID NO: 1370966 - DNA, 22 bp, Artificial Sequence
  chemically synthesized
taagaagagaaagaattgaaat

SEQ ID NO: 1370967 - DNA, 22 bp, Artificial Sequence
  chemically synthesized
ttaagaagagaaagaattgaaa

SEQ ID NO: 1370968 - DNA, 22 bp, Artificial Sequence
  chemically synthesized
taatcataatttcaattctttc

SEQ ID NO: 1370969 - DNA, 22 bp, Artificial Sequence
  chemically synthesized
gcttttaagaagagaaagaatt

SEQ ID NO: 1370970 - DNA, 22 bp, Artificial Sequence
  chemically synthesized
agcttttaagaagagaaagaat

SEQ ID NO: 1370971 - DNA, 22 bp, Artificial Sequence
  chemically synthesized
tagcttttaagaagagaaagaa

SEQ ID NO: 1370972 - DNA, 22 bp, Artificial Sequence
  chemically synthesized
ctttagcttttaagaagagaaa

SEQ ID NO: 1370973 - DNA, 22 bp, Artificial Sequence
  chemically synthesized
gctcctttagcttttaagaaga

SEQ ID NO: 1370974 - DNA, 22 bp, Artificial Sequence
  chemically synthesized
caattctttctcttcttaaaag

SEQ ID NO: 1370975 - DNA, 22 bp, Artificial Sequence
  chemically synthesized
aattctttctcttcttaaaagc

SEQ ID NO: 1370976 - DNA, 22 bp, Artificial Sequence
  chemically synthesized
tttctcttcttaaaagctaaag

SEQ ID NO: 1370977 - DNA, 22 bp, Artificial Sequence
  chemically synthesized
cgcacctggctcctttagcttt

SEQ ID NO: 1370978 - DNA, 22 bp, Artificial Sequence
  chemically synthesized
tctcttcttaaaagctaaagga

SEQ ID NO: 1370979 - DNA, 22 bp, Artificial Sequence
  chemically synthesized
ctcttcttaaaagctaaaggag

SEQ ID NO: 1370980 - DNA, 22 bp, Artificial Sequence
  chemically synthesized
tcttcttaaaagctaaaggagc

SEQ ID NO: 1370981 - DNA, 22 bp, Artificial Sequence
  chemically synthesized
ttcttaaaagctaaaggagcca

SEQ ID NO: 1370982 - DNA, 22 bp, Artificial Sequence
  chemically synthesized
cttaaaagctaaaggagccagg

SEQ ID NO: 1370983 - DNA, 22 bp, Artificial Sequence
  chemically synthesized
ttaaaagctaaaggagccaggt

SEQ ID NO: 1370984 - DNA, 22 bp, Artificial Sequence
  chemically synthesized
aaaagctaaaggagccaggtgc

SEQ ID NO: 1370985 - DNA, 22 bp, Artificial Sequence
  chemically synthesized
aaagctaaaggagccaggtgcg

SEQ ID NO: 1370986 - DNA, 22 bp, Artificial Sequence
  chemically synthesized
caggtgtgagactccgcacctg

SEQ ID NO: 1370987 - DNA, 22 bp, Artificial Sequence
  chemically synthesized
aaggagccaggtgcggagtctc

SEQ ID NO: 1370988 - DNA, 22 bp, Artificial Sequence
  chemically synthesized
ggattacaggtgtgagactccg

SEQ ID NO: 1370989 - DNA, 22 bp, Artificial Sequence
  chemically synthesized
ccaaagtgctaggattacaggt

SEQ ID NO: 1370990 - DNA, 22 bp, Artificial Sequence
  chemically synthesized
ggcctcccaaagtgctaggatt

SEQ ID NO: 1370991 - DNA, 22 bp, Artificial Sequence
  chemically synthesized
tcggcctcccaaagtgctagga

SEQ ID NO: 1370992 - DNA, 22 bp, Artificial Sequence
  chemically synthesized
acacctgtaatcctagcacttt

SEQ ID NO: 1370993 - DNA, 22 bp, Artificial Sequence
  chemically synthesized
cccctctcggcctcccaaagtg

SEQ ID NO: 1370994 - DNA, 22 bp, Artificial Sequence
  chemically synthesized
taatcctagcactttgggaggc

SEQ ID NO: 1370995 - DNA, 22 bp, Artificial Sequence
  chemically synthesized
aagtgatctgcccctctcggcc

SEQ ID NO: 1370996 - DNA, 22 bp, Artificial Sequence
  chemically synthesized
gcactttgggaggccgagaggg

SEQ ID NO: 1370997 - DNA, 22 bp, Artificial Sequence
  chemically synthesized
acctcaagtgatctgcccctct

SEQ ID NO: 1370998 - DNA, 22 bp, Artificial Sequence
  chemically synthesized
tgggaggccgagaggggcagat

SEQ ID NO: 1370999 - DNA, 22 bp, Artificial Sequence
  chemically synthesized
gggaggccgagaggggcagatc

SEQ ID NO: 1371000 - DNA, 22 bp, Artificial Sequence
  chemically synthesized
ctgacctcaagtgatctgcccc

SEQ ID NO: 1371001 - DNA, 22 bp, Artificial Sequence
  chemically synthesized
ggaggccgagaggggcagatca

SEQ ID NO: 1371002 - DNA, 22 bp, Artificial Sequence
  chemically synthesized
aaactcctgacctcaagtgatc

SEQ ID NO: 1371003 - DNA, 22 bp, Artificial Sequence
  chemically synthesized
gtctcaaactcctgacctcaag

SEQ ID NO: 1371004 - DNA, 22 bp, Artificial Sequence
  chemically synthesized
accatgctggtctcaaactcct

SEQ ID NO: 1371005 - DNA, 22 bp, Artificial Sequence
  chemically synthesized
gaggtcaggagtttgagaccag

SEQ ID NO: 1371006 - DNA, 22 bp, Artificial Sequence
  chemically synthesized
aggtcaggagtttgagaccagc

SEQ ID NO: 1371007 - DNA, 22 bp, Artificial Sequence
  chemically synthesized
aacatgttgaccatgctggtct

SEQ ID NO: 1371008 - DNA, 22 bp, Artificial Sequence
  chemically synthesized
caacatgttgaccatgctggtc

SEQ ID NO: 1371009 - DNA, 22 bp, Artificial Sequence
  chemically synthesized
gagaccagcatggtcaacatgt

SEQ ID NO: 1371010 - DNA, 22 bp, Artificial Sequence
  chemically synthesized
agaccagcatggtcaacatgtt

SEQ ID NO: 1371011 - DNA, 22 bp, Artificial Sequence
  chemically synthesized
gtagagaaggggtttcaacatg

SEQ ID NO: 1371012 - DNA, 22 bp, Artificial Sequence
  chemically synthesized
agtagagaaggggtttcaacat

SEQ ID NO: 1371013 - DNA, 22 bp, Artificial Sequence
  chemically synthesized
tagtagagaaggggtttcaaca

SEQ ID NO: 1371014 - DNA, 22 bp, Artificial Sequence
  chemically synthesized
ttagtagagaaggggtttcaac

SEQ ID NO: 1371015 - DNA, 22 bp, Artificial Sequence
  chemically synthesized
tatttttagtagagaaggggtt

SEQ ID NO: 1371016 - DNA, 22 bp, Artificial Sequence
  chemically synthesized
gtatttttagtagagaaggggt

SEQ ID NO: 1371017 - DNA, 22 bp, Artificial Sequence
  chemically synthesized
tgtatttttagtagagaagggg

SEQ ID NO: 1371018 - DNA, 22 bp, Artificial Sequence
  chemically synthesized
ttgtatttttagtagagaaggg

SEQ ID NO: 1371019 - DNA, 22 bp, Artificial Sequence
  chemically synthesized
tttgtatttttagtagagaagg

SEQ ID NO: 1371020 - DNA, 22 bp, Artificial Sequence
  chemically synthesized
attttttgtatttttagtagag

SEQ ID NO: 1371021 - DNA, 22 bp, Artificial Sequence
  chemically synthesized
aaaccccttctctactaaaaat

SEQ ID NO: 1371022 - DNA, 22 bp, Artificial Sequence
  chemically synthesized
ggctaattttttgtatttttag

SEQ ID NO: 1371023 - DNA, 22 bp, Artificial Sequence
  chemically synthesized
ctctactaaaaatacaaaaaat

SEQ ID NO: 1371024 - DNA, 22 bp, Artificial Sequence
  chemically synthesized
tctactaaaaatacaaaaaatt

SEQ ID NO: 1371025 - DNA, 22 bp, Artificial Sequence
  chemically synthesized
tactaaaaatacaaaaaattag

SEQ ID NO: 1371026 - DNA, 22 bp, Artificial Sequence
  chemically synthesized
ctaaaaatacaaaaaattagcc

SEQ ID NO: 1371027 - DNA, 22 bp, Artificial Sequence
  chemically synthesized
aaaatacaaaaaattagccgag

SEQ ID NO: 1371028 - DNA, 22 bp, Artificial Sequence
  chemically synthesized
caggcgcccgccaccatgctcg

SEQ ID NO: 1371029 - DNA, 22 bp, Artificial Sequence
  chemically synthesized
ggactgcaggcgcccgccacca

SEQ ID NO: 1371030 - DNA, 22 bp, Artificial Sequence
  chemically synthesized
gccgagcatggtggcgggcgcc

SEQ ID NO: 1371031 - DNA, 22 bp, Artificial Sequence
  chemically synthesized
agtagctgggactgcaggcgcc

SEQ ID NO: 1371032 - DNA, 22 bp, Artificial Sequence
  chemically synthesized
gagtagctgggactgcaggcgc

SEQ ID NO: 1371033 - DNA, 22 bp, Artificial Sequence
  chemically synthesized
ttgagtagctgggactgcaggc

SEQ ID NO: 1371034 - DNA, 22 bp, Artificial Sequence
  chemically synthesized
agtctcttgagtagctgggact

SEQ ID NO: 1371035 - DNA, 22 bp, Artificial Sequence
  chemically synthesized
atgcctcagtctcttgagtagc

SEQ ID NO: 1371036 - DNA, 22 bp, Artificial Sequence
  chemically synthesized
tcatgcctcagtctcttgagta

SEQ ID NO: 1371037 - DNA, 22 bp, Artificial Sequence
  chemically synthesized
cagtcccagctactcaagagac

SEQ ID NO: 1371038 - DNA, 22 bp, Artificial Sequence
  chemically synthesized
agcgattctcatgcctcagtct

SEQ ID NO: 1371039 - DNA, 22 bp, Artificial Sequence
  chemically synthesized
aagcgattctcatgcctcagtc

SEQ ID NO: 1371040 - DNA, 22 bp, Artificial Sequence
  chemically synthesized
ctcaagagactgaggcatgaga

SEQ ID NO: 1371041 - DNA, 22 bp, Artificial Sequence
  chemically synthesized
ggtttaagcgattctcatgcct

SEQ ID NO: 1371042 - DNA, 22 bp, Artificial Sequence
  chemically synthesized
aagagactgaggcatgagaatc

SEQ ID NO: 1371043 - DNA, 22 bp, Artificial Sequence
  chemically synthesized
ctgggtttaagcgattctcatg

SEQ ID NO: 1371044 - DNA, 22 bp, Artificial Sequence
  chemically synthesized
cacctgctgggtttaagcgatt

SEQ ID NO: 1371045 - DNA, 22 bp, Artificial Sequence
  chemically synthesized
aggcatgagaatcgcttaaacc

SEQ ID NO: 1371046 - DNA, 22 bp, Artificial Sequence
  chemically synthesized
aaatgcagcctccacctgctgg

SEQ ID NO: 1371047 - DNA, 22 bp, Artificial Sequence
  chemically synthesized
aaacccagcaggtggaggctgc

SEQ ID NO: 1371048 - DNA, 22 bp, Artificial Sequence
  chemically synthesized
aacccagcaggtggaggctgca

SEQ ID NO: 1371049 - DNA, 22 bp, Artificial Sequence
  chemically synthesized
tccatcatcagatgaataaata

SEQ ID NO: 1371050 - DNA, 22 bp, Artificial Sequence
  chemically synthesized
tgtccatcatcagatgaataaa

SEQ ID NO: 1371051 - DNA, 22 bp, Artificial Sequence
  chemically synthesized
cattttaattatttattcatct

SEQ ID NO: 1371052 - DNA, 22 bp, Artificial Sequence
  chemically synthesized
gattctgtccatcatcagatga

SEQ ID NO: 1371053 - DNA, 22 bp, Artificial Sequence
  chemically synthesized
taattatttattcatctgatga

SEQ ID NO: 1371054 - DNA, 22 bp, Artificial Sequence
  chemically synthesized
agattctgtccatcatcagatg

SEQ ID NO: 1371055 - DNA, 22 bp, Artificial Sequence
  chemically synthesized
aattatttattcatctgatgat

SEQ ID NO: 1371056 - DNA, 22 bp, Artificial Sequence
  chemically synthesized
tagattctgtccatcatcagat

SEQ ID NO: 1371057 - DNA, 22 bp, Artificial Sequence
  chemically synthesized
attatttattcatctgatgatg

SEQ ID NO: 1371058 - DNA, 22 bp, Artificial Sequence
  chemically synthesized
ttagattctgtccatcatcaga

SEQ ID NO: 1371059 - DNA, 22 bp, Artificial Sequence
  chemically synthesized
tttagattctgtccatcatcag

SEQ ID NO: 1371060 - DNA, 22 bp, Artificial Sequence
  chemically synthesized
ttttagattctgtccatcatca

SEQ ID NO: 1371061 - DNA, 22 bp, Artificial Sequence
  chemically synthesized
tttattcatctgatgatggaca

SEQ ID NO: 1371062 - DNA, 22 bp, Artificial Sequence
  chemically synthesized
attcatctgatgatggacagaa

SEQ ID NO: 1371063 - DNA, 22 bp, Artificial Sequence
  chemically synthesized
aacttttttagattctgtccat

SEQ ID NO: 1371064 - DNA, 22 bp, Artificial Sequence
  chemically synthesized
ttcatctgatgatggacagaat

SEQ ID NO: 1371065 - DNA, 22 bp, Artificial Sequence
  chemically synthesized
atctgatgatggacagaatcta

SEQ ID NO: 1371066 - DNA, 22 bp, Artificial Sequence
  chemically synthesized
tgagttcaacttttttagattc

SEQ ID NO: 1371067 - DNA, 22 bp, Artificial Sequence
  chemically synthesized
atgatggacagaatctaaaaaa

SEQ ID NO: 1371068 - DNA, 22 bp, Artificial Sequence
  chemically synthesized
tatgagttcaacttttttagat

SEQ ID NO: 1371069 - DNA, 22 bp, Artificial Sequence
  chemically synthesized
ctatgagttcaacttttttaga

SEQ ID NO: 1371070 - DNA, 22 bp, Artificial Sequence
  chemically synthesized
tatttctatgagttcaactttt

SEQ ID NO: 1371071 - DNA, 22 bp, Artificial Sequence
  chemically synthesized
atctgtatttctatgagttcaa

SEQ ID NO: 1371072 - DNA, 22 bp, Artificial Sequence
  chemically synthesized
taatctgtatttctatgagttc

SEQ ID NO: 1371073 - DNA, 22 bp, Artificial Sequence
  chemically synthesized
aaaaagttgaactcatagaaat

SEQ ID NO: 1371074 - DNA, 22 bp, Artificial Sequence
  chemically synthesized
attctaatctgtatttctatga

SEQ ID NO: 1371075 - DNA, 22 bp, Artificial Sequence
  chemically synthesized
cattctaatctgtatttctatg

SEQ ID NO: 1371076 - DNA, 22 bp, Artificial Sequence
  chemically synthesized
aactcatagaaatacagattag

SEQ ID NO: 1371077 - DNA, 22 bp, Artificial Sequence
  chemically synthesized
tggtaatcttcattctaatctg

SEQ ID NO: 1371078 - DNA, 22 bp, Artificial Sequence
  chemically synthesized
tgtggtaatcttcattctaatc

SEQ ID NO: 1371079 - DNA, 22 bp, Artificial Sequence
  chemically synthesized
atagaaatacagattagaatga

SEQ ID NO: 1371080 - DNA, 22 bp, Artificial Sequence
  chemically synthesized
ctgtggtaatcttcattctaat

SEQ ID NO: 1371081 - DNA, 22 bp, Artificial Sequence
  chemically synthesized
cgccatttctgtggtaatcttc

SEQ ID NO: 1371082 - DNA, 22 bp, Artificial Sequence
  chemically synthesized
ccgccatttctgtggtaatctt

SEQ ID NO: 1371083 - DNA, 22 bp, Artificial Sequence
  chemically synthesized
gaatgaagattaccacagaaat

SEQ ID NO: 1371084 - DNA, 22 bp, Artificial Sequence
  chemically synthesized
ccggtaggacccttccgccatt

SEQ ID NO: 1371085 - DNA, 22 bp, Artificial Sequence
  chemically synthesized
cccggtaggacccttccgccat

SEQ ID NO: 1371086 - DNA, 22 bp, Artificial Sequence
  chemically synthesized
tcccggtaggacccttccgcca

SEQ ID NO: 1371087 - DNA, 22 bp, Artificial Sequence
  chemically synthesized
ttcccggtaggacccttccgcc

SEQ ID NO: 1371088 - DNA, 22 bp, Artificial Sequence
  chemically synthesized
ccacagaaatggcggaagggtc

SEQ ID NO: 1371089 - DNA, 22 bp, Artificial Sequence
  chemically synthesized
ttttcccggtaggacccttccg

SEQ ID NO: 1371090 - DNA, 22 bp, Artificial Sequence
  chemically synthesized
cttttcccggtaggacccttcc

SEQ ID NO: 1371091 - DNA, 22 bp, Artificial Sequence
  chemically synthesized
tcttttcccggtaggacccttc

SEQ ID NO: 1371092 - DNA, 22 bp, Artificial Sequence
  chemically synthesized
atcaacatctttcttttcccgg

SEQ ID NO: 1371093 - DNA, 22 bp, Artificial Sequence
  chemically synthesized
gatcaacatctttcttttcccg

SEQ ID NO: 1371094 - DNA, 22 bp, Artificial Sequence
  chemically synthesized
tgatcaacatctttcttttccc

SEQ ID NO: 1371095 - DNA, 22 bp, Artificial Sequence
  chemically synthesized
gtaccctttgatcaacatcttt

SEQ ID NO: 1371096 - DNA, 22 bp, Artificial Sequence
  chemically synthesized
ccgggaaaagaaagatgttgat

SEQ ID NO: 1371097 - DNA, 22 bp, Artificial Sequence
  chemically synthesized
aaaattcgtaccctttgatcaa

SEQ ID NO: 1371098 - DNA, 22 bp, Artificial Sequence
  chemically synthesized
actaaaaattcgtaccctttga

SEQ ID NO: 1371099 - DNA, 22 bp, Artificial Sequence
  chemically synthesized
cctaactaaaaattcgtaccct

SEQ ID NO: 1371100 - DNA, 22 bp, Artificial Sequence
  chemically synthesized
ctacctaactaaaaattcgtac

SEQ ID NO: 1371101 - DNA, 22 bp, Artificial Sequence
  chemically synthesized
ctcctacctaactaaaaattcg

SEQ ID NO: 1371102 - DNA, 22 bp, Artificial Sequence
  chemically synthesized
atcaaagggtacgaatttttag

SEQ ID NO: 1371103 - DNA, 22 bp, Artificial Sequence
  chemically synthesized
cctcctacctaactaaaaattc

SEQ ID NO: 1371104 - DNA, 22 bp, Artificial Sequence
  chemically synthesized
ttcctcctacctaactaaaaat

SEQ ID NO: 1371105 - DNA, 22 bp, Artificial Sequence
  chemically synthesized
cttcctcctacctaactaaaaa

SEQ ID NO: 1371106 - DNA, 22 bp, Artificial Sequence
  chemically synthesized
aagcttcttcctcctacctaac

SEQ ID NO: 1371107 - DNA, 22 bp, Artificial Sequence
  chemically synthesized
ttagttaggtaggaggaagaag

SEQ ID NO: 1371108 - DNA, 22 bp, Artificial Sequence
  chemically synthesized
tagttaggtaggaggaagaagc

SEQ ID NO: 1371109 - DNA, 22 bp, Artificial Sequence
  chemically synthesized
agttaggtaggaggaagaagct

SEQ ID NO: 1371110 - DNA, 22 bp, Artificial Sequence
  chemically synthesized
gttaggtaggaggaagaagctt

SEQ ID NO: 1371111 - DNA, 22 bp, Artificial Sequence
  chemically synthesized
ggtaggaggaagaagctttagt

SEQ ID NO: 1371112 - DNA, 22 bp, Artificial Sequence
  chemically synthesized
tagtcaccatcatgtacaatag

SEQ ID NO: 1371113 - DNA, 22 bp, Artificial Sequence
  chemically synthesized
tagtgatctattgtacatgatg

SEQ ID NO: 1371114 - DNA, 22 bp, Artificial Sequence
  chemically synthesized
agtgatctattgtacatgatgg

SEQ ID NO: 1371115 - DNA, 22 bp, Artificial Sequence
  chemically synthesized
gtgatctattgtacatgatggt

SEQ ID NO: 1371116 - DNA, 22 bp, Artificial Sequence
  chemically synthesized
tgatatattatagtcaccatca

SEQ ID NO: 1371117 - DNA, 22 bp, Artificial Sequence
  chemically synthesized
ttgtacatgatggtgactataa

SEQ ID NO: 1371118 - DNA, 22 bp, Artificial Sequence
  chemically synthesized
tacatgatggtgactataatat

SEQ ID NO: 1371119 - DNA, 22 bp, Artificial Sequence
  chemically synthesized
aaatatatgatgcattatgata

SEQ ID NO: 1371120 - DNA, 22 bp, Artificial Sequence
  chemically synthesized
gaaatatatgatgcattatgat

SEQ ID NO: 1371121 - DNA, 22 bp, Artificial Sequence
  chemically synthesized
tgaaatatatgatgcattatga

SEQ ID NO: 1371122 - DNA, 22 bp, Artificial Sequence
  chemically synthesized
taatatatcataatgcatcata

SEQ ID NO: 1371123 - DNA, 22 bp, Artificial Sequence
  chemically synthesized
agcaattttgaaatatatgatg

SEQ ID NO: 1371124 - DNA, 22 bp, Artificial Sequence
  chemically synthesized
cagcaattttgaaatatatgat

SEQ ID NO: 1371125 - DNA, 22 bp, Artificial Sequence
  chemically synthesized
tttcagcaattttgaaatatat

SEQ ID NO: 1371126 - DNA, 22 bp, Artificial Sequence
  chemically synthesized
aaatccactatttcagcaattt

SEQ ID NO: 1371127 - DNA, 22 bp, Artificial Sequence
  chemically synthesized
caaaattgctgaaatagtggat

SEQ ID NO: 1371128 - DNA, 22 bp, Artificial Sequence
  chemically synthesized
aaaattgctgaaatagtggatt

SEQ ID NO: 1371129 - DNA, 22 bp, Artificial Sequence
  chemically synthesized
tggtgaaaatattaaaatccac

SEQ ID NO: 1371130 - DNA, 22 bp, Artificial Sequence
  chemically synthesized
gtggtgaaaatattaaaatcca

SEQ ID NO: 1371131 - DNA, 22 bp, Artificial Sequence
  chemically synthesized
tgtggtgaaaatattaaaatcc

SEQ ID NO: 1371132 - DNA, 22 bp, Artificial Sequence
  chemically synthesized
ttgtggtgaaaatattaaaatc

SEQ ID NO: 1371133 - DNA, 22 bp, Artificial Sequence
  chemically synthesized
ctgaaatagtggattttaatat

SEQ ID NO: 1371134 - DNA, 22 bp, Artificial Sequence
  chemically synthesized
tttgtggtgaaaatattaaaat

SEQ ID NO: 1371135 - DNA, 22 bp, Artificial Sequence
  chemically synthesized
ttttgtggtgaaaatattaaaa

SEQ ID NO: 1371136 - DNA, 22 bp, Artificial Sequence
  chemically synthesized
tttttgtggtgaaaatattaaa

SEQ ID NO: 1371137 - DNA, 22 bp, Artificial Sequence
  chemically synthesized
aaatagtggattttaatatttt

SEQ ID NO: 1371138 - DNA, 22 bp, Artificial Sequence
  chemically synthesized
atattttttttgtggtgaaaat

SEQ ID NO: 1371139 - DNA, 22 bp, Artificial Sequence
  chemically synthesized
cctcatattttttttgtggtga

SEQ ID NO: 1371140 - DNA, 22 bp, Artificial Sequence
  chemically synthesized
ttacctcatattttttttgtgg

SEQ ID NO: 1371141 - DNA, 22 bp, Artificial Sequence
  chemically synthesized
taatattttcaccacaaaaaaa

SEQ ID NO: 1371142 - DNA, 22 bp, Artificial Sequence
  chemically synthesized
aatattttcaccacaaaaaaaa

SEQ ID NO: 1371143 - DNA, 22 bp, Artificial Sequence
  chemically synthesized
atattttcaccacaaaaaaaat

SEQ ID NO: 1371144 - DNA, 22 bp, Artificial Sequence
  chemically synthesized
tcaccacaaaaaaaatatgagg

SEQ ID NO: 1371145 - DNA, 22 bp, Artificial Sequence
  chemically synthesized
atgaatctgttacctcatattt

SEQ ID NO: 1371146 - DNA, 22 bp, Artificial Sequence
  chemically synthesized
caccacaaaaaaaatatgaggt

SEQ ID NO: 1371147 - DNA, 22 bp, Artificial Sequence
  chemically synthesized
accacaaaaaaaatatgaggta

SEQ ID NO: 1371148 - DNA, 22 bp, Artificial Sequence
  chemically synthesized
aatcaggttaatgaatctgtta

SEQ ID NO: 1371149 - DNA, 22 bp, Artificial Sequence
  chemically synthesized
caatgcagagtgattaaatcag

SEQ ID NO: 1371150 - DNA, 22 bp, Artificial Sequence
  chemically synthesized
acaatgcagagtgattaaatca

SEQ ID NO: 1371151 - DNA, 22 bp, Artificial Sequence
  chemically synthesized
attaacctgatttaatcactct

SEQ ID NO: 1371152 - DNA, 22 bp, Artificial Sequence
  chemically synthesized
acctgatttaatcactctgcat

SEQ ID NO: 1371153 - DNA, 22 bp, Artificial Sequence
  chemically synthesized
atatatgcttacaatgcagagt

SEQ ID NO: 1371154 - DNA, 22 bp, Artificial Sequence
  chemically synthesized
gatatatgcttacaatgcagag

SEQ ID NO: 1371155 - DNA, 22 bp, Artificial Sequence
  chemically synthesized
tgatatatgcttacaatgcaga

SEQ ID NO: 1371156 - DNA, 22 bp, Artificial Sequence
  chemically synthesized
atttaatcactctgcattgtaa

SEQ ID NO: 1371157 - DNA, 22 bp, Artificial Sequence
  chemically synthesized
aatcactctgcattgtaagcat

SEQ ID NO: 1371158 - DNA, 22 bp, Artificial Sequence
  chemically synthesized
atcactctgcattgtaagcata

SEQ ID NO: 1371159 - DNA, 22 bp, Artificial Sequence
  chemically synthesized
caatatggtgctttgatatatg

SEQ ID NO: 1371160 - DNA, 22 bp, Artificial Sequence
  chemically synthesized
tgcattgtaagcatatatcaaa

SEQ ID NO: 1371161 - DNA, 22 bp, Artificial Sequence
  chemically synthesized
cattgtaagcatatatcaaagc

SEQ ID NO: 1371162 - DNA, 22 bp, Artificial Sequence
  chemically synthesized
taggttacaatatggtgctttg

SEQ ID NO: 1371163 - DNA, 22 bp, Artificial Sequence
  chemically synthesized
taagcatatatcaaagcaccat

SEQ ID NO: 1371164 - DNA, 22 bp, Artificial Sequence
  chemically synthesized
ataggttacaatatggtgcttt

SEQ ID NO: 1371165 - DNA, 22 bp, Artificial Sequence
  chemically synthesized
tatttataggttacaatatggt

SEQ ID NO: 1371166 - DNA, 22 bp, Artificial Sequence
  chemically synthesized
gtatttataggttacaatatgg

SEQ ID NO: 1371167 - DNA, 22 bp, Artificial Sequence
  chemically synthesized
tttgtatttataggttacaata

SEQ ID NO: 1371168 - DNA, 22 bp, Artificial Sequence
  chemically synthesized
gtttgtatttataggttacaat

SEQ ID NO: 1371169 - DNA, 22 bp, Artificial Sequence
  chemically synthesized
atatttgtttgtatttataggt

SEQ ID NO: 1371170 - DNA, 22 bp, Artificial Sequence
  chemically synthesized
acaattaatatttgtttgtatt

SEQ ID NO: 1371171 - DNA, 22 bp, Artificial Sequence
  chemically synthesized
taacctataaatacaaacaaat

SEQ ID NO: 1371172 - DNA, 22 bp, Artificial Sequence
  chemically synthesized
attgacaattaatatttgtttg

SEQ ID NO: 1371173 - DNA, 22 bp, Artificial Sequence
  chemically synthesized
cattgacaattaatatttgttt

SEQ ID NO: 1371174 - DNA, 22 bp, Artificial Sequence
  chemically synthesized
tcattgacaattaatatttgtt

SEQ ID NO: 1371175 - DNA, 22 bp, Artificial Sequence
  chemically synthesized
ttcattgacaattaatatttgt

SEQ ID NO: 1371176 - DNA, 22 bp, Artificial Sequence
  chemically synthesized
tttcattgacaattaatatttg

SEQ ID NO: 1371177 - DNA, 22 bp, Artificial Sequence
  chemically synthesized
taaatacaaacaaatattaatt

SEQ ID NO: 1371178 - DNA, 22 bp, Artificial Sequence
  chemically synthesized
tttttcattgacaattaatatt

SEQ ID NO: 1371179 - DNA, 22 bp, Artificial Sequence
  chemically synthesized
ctttttcattgacaattaatat

SEQ ID NO: 1371180 - DNA, 22 bp, Artificial Sequence
  chemically synthesized
aatttctttttcattgacaatt

SEQ ID NO: 1371181 - DNA, 22 bp, Artificial Sequence
  chemically synthesized
aaatttctttttcattgacaat

SEQ ID NO: 1371182 - DNA, 22 bp, Artificial Sequence
  chemically synthesized
taaatttctttttcattgacaa

SEQ ID NO: 1371183 - DNA, 22 bp, Artificial Sequence
  chemically synthesized
ttaaatttctttttcattgaca

SEQ ID NO: 1371184 - DNA, 22 bp, Artificial Sequence
  chemically synthesized
tttttaaatttctttttcattg

SEQ ID NO: 1371185 - DNA, 22 bp, Artificial Sequence
  chemically synthesized
atttttaaatttctttttcatt

SEQ ID NO: 1371186 - DNA, 22 bp, Artificial Sequence
  chemically synthesized
attgtcaatgaaaaagaaattt

SEQ ID NO: 1371187 - DNA, 22 bp, Artificial Sequence
  chemically synthesized
tcgtttatttttaaatttcttt

SEQ ID NO: 1371188 - DNA, 22 bp, Artificial Sequence
  chemically synthesized
tcaatgaaaaagaaatttaaaa

SEQ ID NO: 1371189 - DNA, 22 bp, Artificial Sequence
  chemically synthesized
atgttgtcgtttatttttaaat

SEQ ID NO: 1371190 - DNA, 22 bp, Artificial Sequence
  chemically synthesized
atatgtcgtattgatgttgtcg

SEQ ID NO: 1371191 - DNA, 22 bp, Artificial Sequence
  chemically synthesized
aaaaataaacgacaacatcaat

SEQ ID NO: 1371192 - DNA, 22 bp, Artificial Sequence
  chemically synthesized
aaaataaacgacaacatcaata

SEQ ID NO: 1371193 - DNA, 22 bp, Artificial Sequence
  chemically synthesized
taatggtagtctcatatgtcgt

SEQ ID NO: 1371194 - DNA, 22 bp, Artificial Sequence
  chemically synthesized
gactataatggtagtctcatat

SEQ ID NO: 1371195 - DNA, 22 bp, Artificial Sequence
  chemically synthesized
ggactataatggtagtctcata

SEQ ID NO: 1371196 - DNA, 22 bp, Artificial Sequence
  chemically synthesized
tggactataatggtagtctcat

SEQ ID NO: 1371197 - DNA, 22 bp, Artificial Sequence
  chemically synthesized
ttggactataatggtagtctca

SEQ ID NO: 1371198 - DNA, 22 bp, Artificial Sequence
  chemically synthesized
tttggactataatggtagtctc

SEQ ID NO: 1371199 - DNA, 22 bp, Artificial Sequence
  chemically synthesized
ccattatagtccaaaaagtgca

SEQ ID NO: 1371200 - DNA, 22 bp, Artificial Sequence
  chemically synthesized
ggataaatgcccaggagtgcac

SEQ ID NO: 1371201 - DNA, 22 bp, Artificial Sequence
  chemically synthesized
tagtccaaaaagtgcactcctg

SEQ ID NO: 1371202 - DNA, 22 bp, Artificial Sequence
  chemically synthesized
tgggataaatgcccaggagtgc

SEQ ID NO: 1371203 - DNA, 22 bp, Artificial Sequence
  chemically synthesized
tctgggataaatgcccaggagt

SEQ ID NO: 1371204 - DNA, 22 bp, Artificial Sequence
  chemically synthesized
ctctgggataaatgcccaggag

SEQ ID NO: 1371205 - DNA, 22 bp, Artificial Sequence
  chemically synthesized
atttctctgggataaatgccca

SEQ ID NO: 1371206 - DNA, 22 bp, Artificial Sequence
  chemically synthesized
catttctctgggataaatgccc

SEQ ID NO: 1371207 - DNA, 22 bp, Artificial Sequence
  chemically synthesized
ctgggcatttatcccagagaaa

SEQ ID NO: 1371208 - DNA, 22 bp, Artificial Sequence
  chemically synthesized
ggcatttatcccagagaaatga

SEQ ID NO: 1371209 - DNA, 22 bp, Artificial Sequence
  chemically synthesized
tgtgaacataagtcttcatttc

SEQ ID NO: 1371210 - DNA, 22 bp, Artificial Sequence
  chemically synthesized
gtgtgaacataagtcttcattt

SEQ ID NO: 1371211 - DNA, 22 bp, Artificial Sequence
  chemically synthesized
atcccagagaaatgaagactta

SEQ ID NO: 1371212 - DNA, 22 bp, Artificial Sequence
  chemically synthesized
tcccagagaaatgaagacttat

SEQ ID NO: 1371213 - DNA, 22 bp, Artificial Sequence
  chemically synthesized
atgtacaggatttgtgtgaaca

SEQ ID NO: 1371214 - DNA, 22 bp, Artificial Sequence
  chemically synthesized
tgaaccctaatgtacaggattt

SEQ ID NO: 1371215 - DNA, 22 bp, Artificial Sequence
  chemically synthesized
atgttcacacaaatcctgtaca

SEQ ID NO: 1371216 - DNA, 22 bp, Artificial Sequence
  chemically synthesized
tgttcacacaaatcctgtacat

SEQ ID NO: 1371217 - DNA, 22 bp, Artificial Sequence
  chemically synthesized
ctgtgaaccctaatgtacagga

SEQ ID NO: 1371218 - DNA, 22 bp, Artificial Sequence
  chemically synthesized
acacaaatcctgtacattaggg

SEQ ID NO: 1371219 - DNA, 22 bp, Artificial Sequence
  chemically synthesized
ataaaattgctgtgaaccctaa

SEQ ID NO: 1371220 - DNA, 22 bp, Artificial Sequence
  chemically synthesized
ctaataaaattgctgtgaaccc

SEQ ID NO: 1371221 - DNA, 22 bp, Artificial Sequence
  chemically synthesized
ttactaataaaattgctgtgaa

SEQ ID NO: 1371222 - DNA, 22 bp, Artificial Sequence
  chemically synthesized
tacattagggttcacagcaatt

SEQ ID NO: 1371223 - DNA, 22 bp, Artificial Sequence
  chemically synthesized
gggttcacagcaattttattag

SEQ ID NO: 1371224 - DNA, 22 bp, Artificial Sequence
  chemically synthesized
cagtgtggggctgttactaata

SEQ ID NO: 1371225 - DNA, 22 bp, Artificial Sequence
  chemically synthesized
acagtgtggggctgttactaat

SEQ ID NO: 1371226 - DNA, 22 bp, Artificial Sequence
  chemically synthesized
acagcaattttattagtaacag

SEQ ID NO: 1371227 - DNA, 22 bp, Artificial Sequence
  chemically synthesized
tttacagtgtggggctgttact

SEQ ID NO: 1371228 - DNA, 22 bp, Artificial Sequence
  chemically synthesized
ttgtttacagtgtggggctgtt

SEQ ID NO: 1371229 - DNA, 22 bp, Artificial Sequence
  chemically synthesized
tattagtaacagccccacactg

SEQ ID NO: 1371230 - DNA, 22 bp, Artificial Sequence
  chemically synthesized
attagtaacagccccacactgt

SEQ ID NO: 1371231 - DNA, 22 bp, Artificial Sequence
  chemically synthesized
ttagtaacagccccacactgta

SEQ ID NO: 1371232 - DNA, 22 bp, Artificial Sequence
  chemically synthesized
gtaacagccccacactgtaaac

SEQ ID NO: 1371233 - DNA, 22 bp, Artificial Sequence
  chemically synthesized
agagatattgttgtttacagtg

SEQ ID NO: 1371234 - DNA, 22 bp, Artificial Sequence
  chemically synthesized
actgagagatattgttgtttac

SEQ ID NO: 1371235 - DNA, 22 bp, Artificial Sequence
  chemically synthesized
actgactgagagatattgttgt

SEQ ID NO: 1371236 - DNA, 22 bp, Artificial Sequence
  chemically synthesized
accattcactgactgagagata

SEQ ID NO: 1371237 - DNA, 22 bp, Artificial Sequence
  chemically synthesized
caccattcactgactgagagat

SEQ ID NO: 1371238 - DNA, 22 bp, Artificial Sequence
  chemically synthesized
taaacaacaatatctctcagtc

SEQ ID NO: 1371239 - DNA, 22 bp, Artificial Sequence
  chemically synthesized
cagtttcaccattcactgactg

SEQ ID NO: 1371240 - DNA, 22 bp, Artificial Sequence
  chemically synthesized
tcagtcagtgaatggtgaaact

SEQ ID NO: 1371241 - DNA, 22 bp, Artificial Sequence
  chemically synthesized
tggacatcctacagtttcacca

SEQ ID NO: 1371242 - DNA, 22 bp, Artificial Sequence
  chemically synthesized
agtcagtgaatggtgaaactgt

SEQ ID NO: 1371243 - DNA, 22 bp, Artificial Sequence
  chemically synthesized
tggttgtggacatcctacagtt

SEQ ID NO: 1371244 - DNA, 22 bp, Artificial Sequence
  chemically synthesized
atggttgtggacatcctacagt

SEQ ID NO: 1371245 - DNA, 22 bp, Artificial Sequence
  chemically synthesized
tttatggttgtggacatcctac

SEQ ID NO: 1371246 - DNA, 22 bp, Artificial Sequence
  chemically synthesized
atttatggttgtggacatccta

SEQ ID NO: 1371247 - DNA, 22 bp, Artificial Sequence
  chemically synthesized
atttatttatggttgtggacat

SEQ ID NO: 1371248 - DNA, 22 bp, Artificial Sequence
  chemically synthesized
ctgatttatttatggttgtgga

SEQ ID NO: 1371249 - DNA, 22 bp, Artificial Sequence
  chemically synthesized
taggatgtccacaaccataaat

SEQ ID NO: 1371250 - DNA, 22 bp, Artificial Sequence
  chemically synthesized
atatatgttgctgatttattta

SEQ ID NO: 1371251 - DNA, 22 bp, Artificial Sequence
  chemically synthesized
ctaatatatgttgctgatttat

SEQ ID NO: 1371252 - DNA, 22 bp, Artificial Sequence
  chemically synthesized
ttactaatatatgttgctgatt

SEQ ID NO: 1371253 - DNA, 22 bp, Artificial Sequence
  chemically synthesized
attactaatatatgttgctgat

SEQ ID NO: 1371254 - DNA, 22 bp, Artificial Sequence
  chemically synthesized
tattactaatatatgttgctga

SEQ ID NO: 1371255 - DNA, 22 bp, Artificial Sequence
  chemically synthesized
ttattactaatatatgttgctg

SEQ ID NO: 1371256 - DNA, 22 bp, Artificial Sequence
  chemically synthesized
tttattactaatatatgttgct

SEQ ID NO: 1371257 - DNA, 22 bp, Artificial Sequence
  chemically synthesized
ctttttattactaatatatgtt

SEQ ID NO: 1371258 - DNA, 22 bp, Artificial Sequence
  chemically synthesized
ttactttttattactaatatat

SEQ ID NO: 1371259 - DNA, 22 bp, Artificial Sequence
  chemically synthesized
gttactttttattactaatata

SEQ ID NO: 1371260 - DNA, 22 bp, Artificial Sequence
  chemically synthesized
caatagtttgttactttttatt

SEQ ID NO: 1371261 - DNA, 22 bp, Artificial Sequence
  chemically synthesized
catattgcaatagtttgttact

SEQ ID NO: 1371262 - DNA, 22 bp, Artificial Sequence
  chemically synthesized
gtaataaaaagtaacaaactat

SEQ ID NO: 1371263 - DNA, 22 bp, Artificial Sequence
  chemically synthesized
ttgcatattgcaatagtttgtt

SEQ ID NO: 1371264 - DNA, 22 bp, Artificial Sequence
  chemically synthesized
aattgttgcatattgcaatagt

SEQ ID NO: 1371265 - DNA, 22 bp, Artificial Sequence
  chemically synthesized
atgatccatctaaattgttgca

SEQ ID NO: 1371266 - DNA, 22 bp, Artificial Sequence
  chemically synthesized
aatgatccatctaaattgttgc

SEQ ID NO: 1371267 - DNA, 22 bp, Artificial Sequence
  chemically synthesized
ttgcaatatgcaacaatttaga

SEQ ID NO: 1371268 - DNA, 22 bp, Artificial Sequence
  chemically synthesized
cttaatgatccatctaaattgt

SEQ ID NO: 1371269 - DNA, 22 bp, Artificial Sequence
  chemically synthesized
caatatgcaacaatttagatgg

SEQ ID NO: 1371270 - DNA, 22 bp, Artificial Sequence
  chemically synthesized
agccagcataattgcttaatga

SEQ ID NO: 1371271 - DNA, 22 bp, Artificial Sequence
  chemically synthesized
cagccagcataattgcttaatg

SEQ ID NO: 1371272 - DNA, 22 bp, Artificial Sequence
  chemically synthesized
tcagccagcataattgcttaat

SEQ ID NO: 1371273 - DNA, 22 bp, Artificial Sequence
  chemically synthesized
ttcagccagcataattgcttaa

SEQ ID NO: 1371274 - DNA, 22 bp, Artificial Sequence
  chemically synthesized
tttcagccagcataattgctta

SEQ ID NO: 1371275 - DNA, 22 bp, Artificial Sequence
  chemically synthesized
agatggatcattaagcaattat

SEQ ID NO: 1371276 - DNA, 22 bp, Artificial Sequence
  chemically synthesized
ttttcagccagcataattgctt

SEQ ID NO: 1371277 - DNA, 22 bp, Artificial Sequence
  chemically synthesized
gatggatcattaagcaattatg

SEQ ID NO: 1371278 - DNA, 22 bp, Artificial Sequence
  chemically synthesized
gcttttttcagccagcataatt

SEQ ID NO: 1371279 - DNA, 22 bp, Artificial Sequence
  chemically synthesized
gaactagcttttttcagccagc

SEQ ID NO: 1371280 - DNA, 22 bp, Artificial Sequence
  chemically synthesized
cgaactagcttttttcagccag

SEQ ID NO: 1371281 - DNA, 22 bp, Artificial Sequence
  chemically synthesized
tcgaactagcttttttcagcca

SEQ ID NO: 1371282 - DNA, 22 bp, Artificial Sequence
  chemically synthesized
agcaattatgctggctgaaaaa

SEQ ID NO: 1371283 - DNA, 22 bp, Artificial Sequence
  chemically synthesized
atcctttcgaactagctttttt

SEQ ID NO: 1371284 - DNA, 22 bp, Artificial Sequence
  chemically synthesized
aatcctttcgaactagcttttt

SEQ ID NO: 1371285 - DNA, 22 bp, Artificial Sequence
  chemically synthesized
tgctggctgaaaaaagctagtt

SEQ ID NO: 1371286 - DNA, 22 bp, Artificial Sequence
  chemically synthesized
gctgaaaaaagctagttcgaaa

SEQ ID NO: 1371287 - DNA, 22 bp, Artificial Sequence
  chemically synthesized
tatggtatttaatcctttcgaa

SEQ ID NO: 1371288 - DNA, 22 bp, Artificial Sequence
  chemically synthesized
aaaaaagctagttcgaaaggat

SEQ ID NO: 1371289 - DNA, 22 bp, Artificial Sequence
  chemically synthesized
gttcgaaaggattaaataccat

SEQ ID NO: 1371290 - DNA, 22 bp, Artificial Sequence
  chemically synthesized
tgcaaatagaattgtatggtat

SEQ ID NO: 1371291 - DNA, 22 bp, Artificial Sequence
  chemically synthesized
gaaaggattaaataccatacaa

SEQ ID NO: 1371292 - DNA, 22 bp, Artificial Sequence
  chemically synthesized
aagaatattatgcaaatagaat

SEQ ID NO: 1371293 - DNA, 22 bp, Artificial Sequence
  chemically synthesized
aataccatacaattctatttgc

SEQ ID NO: 1371294 - DNA, 22 bp, Artificial Sequence
  chemically synthesized
caagaatattatgcaaatagaa

SEQ ID NO: 1371295 - DNA, 22 bp, Artificial Sequence
  chemically synthesized
tcatttcaagaatattatgcaa

SEQ ID NO: 1371296 - DNA, 22 bp, Artificial Sequence
  chemically synthesized
gtcatttcaagaatattatgca

SEQ ID NO: 1371297 - DNA, 22 bp, Artificial Sequence
  chemically synthesized
tgtcatttcaagaatattatgc

SEQ ID NO: 1371298 - DNA, 22 bp, Artificial Sequence
  chemically synthesized
taattttgtcatttcaagaata

SEQ ID NO: 1371299 - DNA, 22 bp, Artificial Sequence
  chemically synthesized
tatttgcataatattcttgaaa

SEQ ID NO: 1371300 - DNA, 22 bp, Artificial Sequence
  chemically synthesized
tttgcataatattcttgaaatg

SEQ ID NO: 1371301 - DNA, 22 bp, Artificial Sequence
  chemically synthesized
gcataatattcttgaaatgaca

SEQ ID NO: 1371302 - DNA, 22 bp, Artificial Sequence
  chemically synthesized
cataatattcttgaaatgacaa

SEQ ID NO: 1371303 - DNA, 22 bp, Artificial Sequence
  chemically synthesized
atgtctataattttgtcatttc

SEQ ID NO: 1371304 - DNA, 22 bp, Artificial Sequence
  chemically synthesized
catgtctataattttgtcattt

SEQ ID NO: 1371305 - DNA, 22 bp, Artificial Sequence
  chemically synthesized
ttcatgtctataattttgtcat

SEQ ID NO: 1371306 - DNA, 22 bp, Artificial Sequence
  chemically synthesized
ttcttcatgtctataattttgt

SEQ ID NO: 1371307 - DNA, 22 bp, Artificial Sequence
  chemically synthesized
ttgaaatgacaaaattatagac

SEQ ID NO: 1371308 - DNA, 22 bp, Artificial Sequence
  chemically synthesized
atctgttcttcatgtctataat

SEQ ID NO: 1371309 - DNA, 22 bp, Artificial Sequence
  chemically synthesized
gaaatgacaaaattatagacat

SEQ ID NO: 1371310 - DNA, 22 bp, Artificial Sequence
  chemically synthesized
aaatgacaaaattatagacatg

SEQ ID NO: 1371311 - DNA, 22 bp, Artificial Sequence
  chemically synthesized
tagacatgaagaacagattaat

SEQ ID NO: 1371312 - DNA, 22 bp, Artificial Sequence
  chemically synthesized
acatgtggcaaccattaatctg

SEQ ID NO: 1371313 - DNA, 22 bp, Artificial Sequence
  chemically synthesized
tcccatgcctaacatgtggcaa

SEQ ID NO: 1371314 - DNA, 22 bp, Artificial Sequence
  chemically synthesized
atggttgccacatgttaggcat

SEQ ID NO: 1371315 - DNA, 22 bp, Artificial Sequence
  chemically synthesized
tcaccctgtcccatgcctaaca

SEQ ID NO: 1371316 - DNA, 22 bp, Artificial Sequence
  chemically synthesized
gtcaccctgtcccatgcctaac

SEQ ID NO: 1371317 - DNA, 22 bp, Artificial Sequence
  chemically synthesized
ttgtcaccctgtcccatgccta

SEQ ID NO: 1371318 - DNA, 22 bp, Artificial Sequence
  chemically synthesized
ctcttgtcaccctgtcccatgc

SEQ ID NO: 1371319 - DNA, 22 bp, Artificial Sequence
  chemically synthesized
ccacatgttaggcatgggacag

SEQ ID NO: 1371320 - DNA, 22 bp, Artificial Sequence
  chemically synthesized
cctcttgtcaccctgtcccatg

SEQ ID NO: 1371321 - DNA, 22 bp, Artificial Sequence
  chemically synthesized
ggcatgggacagggtgacaaga

SEQ ID NO: 1371322 - DNA, 22 bp, Artificial Sequence
  chemically synthesized
ataaaatcatcaagcttcctct

SEQ ID NO: 1371323 - DNA, 22 bp, Artificial Sequence
  chemically synthesized
aataaaatcatcaagcttcctc

SEQ ID NO: 1371324 - DNA, 22 bp, Artificial Sequence
  chemically synthesized
taataaaatcatcaagcttcct

SEQ ID NO: 1371325 - DNA, 22 bp, Artificial Sequence
  chemically synthesized
acctttaataaaatcatcaagc

SEQ ID NO: 1371326 - DNA, 22 bp, Artificial Sequence
  chemically synthesized
ttgacctttaataaaatcatca

SEQ ID NO: 1371327 - DNA, 22 bp, Artificial Sequence
  chemically synthesized
ctgttgacctttaataaaatca

SEQ ID NO: 1371328 - DNA, 22 bp, Artificial Sequence
  chemically synthesized
tcctgttgacctttaataaaat

SEQ ID NO: 1371329 - DNA, 22 bp, Artificial Sequence
  chemically synthesized
gatgattttattaaaggtcaac

SEQ ID NO: 1371330 - DNA, 22 bp, Artificial Sequence
  chemically synthesized
atgattttattaaaggtcaaca

SEQ ID NO: 1371331 - DNA, 22 bp, Artificial Sequence
  chemically synthesized
tattaaaggtcaacaggagaga

SEQ ID NO: 1371332 - DNA, 22 bp, Artificial Sequence
  chemically synthesized
attaaaggtcaacaggagagat

SEQ ID NO: 1371333 - DNA, 22 bp, Artificial Sequence
  chemically synthesized
ttaaaggtcaacaggagagatc

SEQ ID NO: 1371334 - DNA, 22 bp, Artificial Sequence
  chemically synthesized
catgaccacaaagatctctcct

SEQ ID NO: 1371335 - DNA, 22 bp, Artificial Sequence
  chemically synthesized
aaggtcaacaggagagatcttt

SEQ ID NO: 1371336 - DNA, 22 bp, Artificial Sequence
  chemically synthesized
tgtggtcatgtaacatccgtat

SEQ ID NO: 1371337 - DNA, 22 bp, Artificial Sequence
  chemically synthesized
gtggtcatgtaacatccgtatt

SEQ ID NO: 1371338 - DNA, 22 bp, Artificial Sequence
  chemically synthesized
tggtcatgtaacatccgtattt

SEQ ID NO: 1371339 - DNA, 22 bp, Artificial Sequence
  chemically synthesized
gtgcgtccaccacgacagtcaa

SEQ ID NO: 1371340 - DNA, 22 bp, Artificial Sequence
  chemically synthesized
tgactgtcgtggtggacgcact

SEQ ID NO: 1371341 - DNA, 22 bp, Artificial Sequence
  chemically synthesized
cacatgtagattagtgcgtcca

SEQ ID NO: 1371342 - DNA, 22 bp, Artificial Sequence
  chemically synthesized
gactgtcgtggtggacgcacta

SEQ ID NO: 1371343 - DNA, 22 bp, Artificial Sequence
  chemically synthesized
acacatgtagattagtgcgtcc

SEQ ID NO: 1371344 - DNA, 22 bp, Artificial Sequence
  chemically synthesized
actgtcgtggtggacgcactaa

SEQ ID NO: 1371345 - DNA, 22 bp, Artificial Sequence
  chemically synthesized
tacacatgtagattagtgcgtc

SEQ ID NO: 1371346 - DNA, 22 bp, Artificial Sequence
  chemically synthesized
ttacacatgtagattagtgcgt

SEQ ID NO: 1371347 - DNA, 22 bp, Artificial Sequence
  chemically synthesized
tcgtggtggacgcactaatcta

SEQ ID NO: 1371348 - DNA, 22 bp, Artificial Sequence
  chemically synthesized
aatgcaatttttacacatgtag

SEQ ID NO: 1371349 - DNA, 22 bp, Artificial Sequence
  chemically synthesized
gttaaatgcaatttttacacat

SEQ ID NO: 1371350 - DNA, 22 bp, Artificial Sequence
  chemically synthesized
agttaaatgcaatttttacaca

SEQ ID NO: 1371351 - DNA, 22 bp, Artificial Sequence
  chemically synthesized
atctacatgtgtaaaaattgca

SEQ ID NO: 1371352 - DNA, 22 bp, Artificial Sequence
  chemically synthesized
catgtgtaaaaattgcatttaa

SEQ ID NO: 1371353 - DNA, 22 bp, Artificial Sequence
  chemically synthesized
atgtgtgtgtatatatttagtt

SEQ ID NO: 1371354 - DNA, 22 bp, Artificial Sequence
  chemically synthesized
tactcatgtgtgtgtatatatt

SEQ ID NO: 1371355 - DNA, 22 bp, Artificial Sequence
  chemically synthesized
catttaactaaatatatacaca

SEQ ID NO: 1371356 - DNA, 22 bp, Artificial Sequence
  chemically synthesized
cctatactcatgtgtgtgtata

SEQ ID NO: 1371357 - DNA, 22 bp, Artificial Sequence
  chemically synthesized
acctatactcatgtgtgtgtat

SEQ ID NO: 1371358 - DNA, 22 bp, Artificial Sequence
  chemically synthesized
tacctatactcatgtgtgtgta

SEQ ID NO: 1371359 - DNA, 22 bp, Artificial Sequence
  chemically synthesized
aactaaatatatacacacacat

SEQ ID NO: 1371360 - DNA, 22 bp, Artificial Sequence
  chemically synthesized
actaaatatatacacacacatg

SEQ ID NO: 1371361 - DNA, 22 bp, Artificial Sequence
  chemically synthesized
aatatatacacacacatgagta

SEQ ID NO: 1371362 - DNA, 22 bp, Artificial Sequence
  chemically synthesized
ccagttttacctatactcatgt

SEQ ID NO: 1371363 - DNA, 22 bp, Artificial Sequence
  chemically synthesized
cccagttttacctatactcatg

SEQ ID NO: 1371364 - DNA, 22 bp, Artificial Sequence
  chemically synthesized
tcccagttttacctatactcat

SEQ ID NO: 1371365 - DNA, 22 bp, Artificial Sequence
  chemically synthesized
agattttcccagttttacctat

SEQ ID NO: 1371366 - DNA, 22 bp, Artificial Sequence
  chemically synthesized
attcagattttcccagttttac

SEQ ID NO: 1371367 - DNA, 22 bp, Artificial Sequence
  chemically synthesized
taattcagattttcccagtttt

SEQ ID NO: 1371368 - DNA, 22 bp, Artificial Sequence
  chemically synthesized
tctaattcagattttcccagtt

SEQ ID NO: 1371369 - DNA, 22 bp, Artificial Sequence
  chemically synthesized
acctctctaattcagattttcc

SEQ ID NO: 1371370 - DNA, 22 bp, Artificial Sequence
  chemically synthesized
caattaacctctctaattcaga

SEQ ID NO: 1371371 - DNA, 22 bp, Artificial Sequence
  chemically synthesized
ttacaattaacctctctaattc

SEQ ID NO: 1371372 - DNA, 22 bp, Artificial Sequence
  chemically synthesized
gttacaattaacctctctaatt

SEQ ID NO: 1371373 - DNA, 22 bp, Artificial Sequence
  chemically synthesized
tgttacaattaacctctctaat

SEQ ID NO: 1371374 - DNA, 22 bp, Artificial Sequence
  chemically synthesized
ggaaaatctgaattagagaggt

SEQ ID NO: 1371375 - DNA, 22 bp, Artificial Sequence
  chemically synthesized
aattagagaggttaattgtaac

SEQ ID NO: 1371376 - DNA, 22 bp, Artificial Sequence
  chemically synthesized
taatgaggattttgttacaatt

SEQ ID NO: 1371377 - DNA, 22 bp, Artificial Sequence
  chemically synthesized
gagaggttaattgtaacaaaat

SEQ ID NO: 1371378 - DNA, 22 bp, Artificial Sequence
  chemically synthesized
aaacattataatgaggattttg

SEQ ID NO: 1371379 - DNA, 22 bp, Artificial Sequence
  chemically synthesized
attgtaacaaaatcctcattat

SEQ ID NO: 1371380 - DNA, 22 bp, Artificial Sequence
  chemically synthesized
tattcaaacattataatgagga

SEQ ID NO: 1371381 - DNA, 22 bp, Artificial Sequence
  chemically synthesized
taacaaaatcctcattataatg

SEQ ID NO: 1371382 - DNA, 22 bp, Artificial Sequence
  chemically synthesized
caaattatattcaaacattata

SEQ ID NO: 1371383 - DNA, 22 bp, Artificial Sequence
  chemically synthesized
gcaaattatattcaaacattat

SEQ ID NO: 1371384 - DNA, 22 bp, Artificial Sequence
  chemically synthesized
attataatgtttgaatataatt

SEQ ID NO: 1371385 - DNA, 22 bp, Artificial Sequence
  chemically synthesized
taatatcttgcaaattatattc

SEQ ID NO: 1371386 - DNA, 22 bp, Artificial Sequence
  chemically synthesized
taatgtttgaatataatttgca

SEQ ID NO: 1371387 - DNA, 22 bp, Artificial Sequence
  chemically synthesized
tccccaattgtaatatcttgca

SEQ ID NO: 1371388 - DNA, 22 bp, Artificial Sequence
  chemically synthesized
gaatataatttgcaagatatta

SEQ ID NO: 1371389 - DNA, 22 bp, Artificial Sequence
  chemically synthesized
aatataatttgcaagatattac

SEQ ID NO: 1371390 - DNA, 22 bp, Artificial Sequence
  chemically synthesized
ggttatccccaattgtaatatc

SEQ ID NO: 1371391 - DNA, 22 bp, Artificial Sequence
  chemically synthesized
ctcggttatccccaattgtaat

SEQ ID NO: 1371392 - DNA, 22 bp, Artificial Sequence
  chemically synthesized
gctcggttatccccaattgtaa

SEQ ID NO: 1371393 - DNA, 22 bp, Artificial Sequence
  chemically synthesized
tgctcggttatccccaattgta

SEQ ID NO: 1371394 - DNA, 22 bp, Artificial Sequence
  chemically synthesized
ttgctcggttatccccaattgt

SEQ ID NO: 1371395 - DNA, 22 bp, Artificial Sequence
  chemically synthesized
gcaagatattacaattggggat

SEQ ID NO: 1371396 - DNA, 22 bp, Artificial Sequence
  chemically synthesized
caagatattacaattggggata

SEQ ID NO: 1371397 - DNA, 22 bp, Artificial Sequence
  chemically synthesized
tgtggcttttgctcggttatcc

SEQ ID NO: 1371398 - DNA, 22 bp, Artificial Sequence
  chemically synthesized
caattggggataaccgagcaaa

SEQ ID NO: 1371399 - DNA, 22 bp, Artificial Sequence
  chemically synthesized
gggataaccgagcaaaagccac

SEQ ID NO: 1371400 - DNA, 22 bp, Artificial Sequence
  chemically synthesized
tgtgaaatatcctgtgtggctt

SEQ ID NO: 1371401 - DNA, 22 bp, Artificial Sequence
  chemically synthesized
taaaaaataatataaaagatcc

SEQ ID NO: 1371402 - DNA, 22 bp, Artificial Sequence
  chemically synthesized
cacataggatcttttatattat

SEQ ID NO: 1371403 - DNA, 22 bp, Artificial Sequence
  chemically synthesized
acataggatcttttatattatt

SEQ ID NO: 1371404 - DNA, 22 bp, Artificial Sequence
  chemically synthesized
agaacagttgtaaaaaataata

SEQ ID NO: 1371405 - DNA, 22 bp, Artificial Sequence
  chemically synthesized
tagagttaagaacagttgtaaa

SEQ ID NO: 1371406 - DNA, 22 bp, Artificial Sequence
  chemically synthesized
ttatattattttttacaactgt

SEQ ID NO: 1371407 - DNA, 22 bp, Artificial Sequence
  chemically synthesized
tatattattttttacaactgtt

SEQ ID NO: 1371408 - DNA, 22 bp, Artificial Sequence
  chemically synthesized
atattattttttacaactgttc

SEQ ID NO: 1371409 - DNA, 22 bp, Artificial Sequence
  chemically synthesized
tattattttttacaactgttct

SEQ ID NO: 1371410 - DNA, 22 bp, Artificial Sequence
  chemically synthesized
ttttttacaactgttcttaact

SEQ ID NO: 1371411 - DNA, 22 bp, Artificial Sequence
  chemically synthesized
aaagagttgtagagttaagaac

SEQ ID NO: 1371412 - DNA, 22 bp, Artificial Sequence
  chemically synthesized
caaagagttgtagagttaagaa

SEQ ID NO: 1371413 - DNA, 22 bp, Artificial Sequence
  chemically synthesized
tcaaagagttgtagagttaaga

SEQ ID NO: 1371414 - DNA, 22 bp, Artificial Sequence
  chemically synthesized
tttacaactgttcttaactcta

SEQ ID NO: 1371415 - DNA, 22 bp, Artificial Sequence
  chemically synthesized
ttacaactgttcttaactctac

SEQ ID NO: 1371416 - DNA, 22 bp, Artificial Sequence
  chemically synthesized
tacaactgttcttaactctaca

SEQ ID NO: 1371417 - DNA, 22 bp, Artificial Sequence
  chemically synthesized
ttttcaaagagttgtagagtta

SEQ ID NO: 1371418 - DNA, 22 bp, Artificial Sequence
  chemically synthesized
acaactgttcttaactctacaa

SEQ ID NO: 1371419 - DNA, 22 bp, Artificial Sequence
  chemically synthesized
attttcaaagagttgtagagtt

SEQ ID NO: 1371420 - DNA, 22 bp, Artificial Sequence
  chemically synthesized
caactgttcttaactctacaac

SEQ ID NO: 1371421 - DNA, 22 bp, Artificial Sequence
  chemically synthesized
tattttcaaagagttgtagagt

SEQ ID NO: 1371422 - DNA, 22 bp, Artificial Sequence
  chemically synthesized
ttcttaactctacaactctttg

SEQ ID NO: 1371423 - DNA, 22 bp, Artificial Sequence
  chemically synthesized
aacattttattttcaaagagtt

SEQ ID NO: 1371424 - DNA, 22 bp, Artificial Sequence
  chemically synthesized
ttaactctacaactctttgaaa

SEQ ID NO: 1371425 - DNA, 22 bp, Artificial Sequence
  chemically synthesized
aactctacaactctttgaaaat

SEQ ID NO: 1371426 - DNA, 22 bp, Artificial Sequence
  chemically synthesized
actctacaactctttgaaaata

SEQ ID NO: 1371427 - DNA, 22 bp, Artificial Sequence
  chemically synthesized
aaagttaaacattttattttca

SEQ ID NO: 1371428 - DNA, 22 bp, Artificial Sequence
  chemically synthesized
aaaagttaaacattttattttc

SEQ ID NO: 1371429 - DNA, 22 bp, Artificial Sequence
  chemically synthesized
tacaactctttgaaaataaaat

SEQ ID NO: 1371430 - DNA, 22 bp, Artificial Sequence
  chemically synthesized
taaaagttaaacattttatttt

SEQ ID NO: 1371431 - DNA, 22 bp, Artificial Sequence
  chemically synthesized
ttaaaagttaaacattttattt

SEQ ID NO: 1371432 - DNA, 22 bp, Artificial Sequence
  chemically synthesized
caactctttgaaaataaaatgt

SEQ ID NO: 1371433 - DNA, 22 bp, Artificial Sequence
  chemically synthesized
tttaaaagttaaacattttatt

SEQ ID NO: 1371434 - DNA, 22 bp, Artificial Sequence
  chemically synthesized
tttgaaaataaaatgtttaact

SEQ ID NO: 1371435 - DNA, 22 bp, Artificial Sequence
  chemically synthesized
tgaaaataaaatgtttaacttt

SEQ ID NO: 1371436 - DNA, 22 bp, Artificial Sequence
  chemically synthesized
agaaactttttaaaagttaaac

SEQ ID NO: 1371437 - DNA, 22 bp, Artificial Sequence
  chemically synthesized
gaaaataaaatgtttaactttt

SEQ ID NO: 1371438 - DNA, 22 bp, Artificial Sequence
  chemically synthesized
gagaaactttttaaaagttaaa

SEQ ID NO: 1371439 - DNA, 22 bp, Artificial Sequence
  chemically synthesized
aaaataaaatgtttaactttta

SEQ ID NO: 1371440 - DNA, 22 bp, Artificial Sequence
  chemically synthesized
agcaagcttgagaaacttttta

SEQ ID NO: 1371441 - DNA, 22 bp, Artificial Sequence
  chemically synthesized
aacttttaaaaagtttctcaag

SEQ ID NO: 1371442 - DNA, 22 bp, Artificial Sequence
  chemically synthesized
acttttaaaaagtttctcaagc

SEQ ID NO: 1371443 - DNA, 22 bp, Artificial Sequence
  chemically synthesized
acacaagctaagcaagcttgag

SEQ ID NO: 1371444 - DNA, 22 bp, Artificial Sequence
  chemically synthesized
ttaaaaagtttctcaagcttgc

SEQ ID NO: 1371445 - DNA, 22 bp, Artificial Sequence
  chemically synthesized
taaaaagtttctcaagcttgct

SEQ ID NO: 1371446 - DNA, 22 bp, Artificial Sequence
  chemically synthesized
tgacacaagctaagcaagcttg

SEQ ID NO: 1371447 - DNA, 22 bp, Artificial Sequence
  chemically synthesized
aaaaagtttctcaagcttgctt

SEQ ID NO: 1371448 - DNA, 22 bp, Artificial Sequence
  chemically synthesized
aaaagtttctcaagcttgctta

SEQ ID NO: 1371449 - DNA, 22 bp, Artificial Sequence
  chemically synthesized
ctcaagcttgcttagcttgtgt

SEQ ID NO: 1371450 - DNA, 22 bp, Artificial Sequence
  chemically synthesized
tcaagcttgcttagcttgtgtc

SEQ ID NO: 1371451 - DNA, 22 bp, Artificial Sequence
  chemically synthesized
gaatccaagctctgacacaagc

SEQ ID NO: 1371452 - DNA, 22 bp, Artificial Sequence
  chemically synthesized
aagcttgcttagcttgtgtcag

SEQ ID NO: 1371453 - DNA, 22 bp, Artificial Sequence
  chemically synthesized
cattggaatccaagctctgaca

SEQ ID NO: 1371454 - DNA, 22 bp, Artificial Sequence
  chemically synthesized
gcttagcttgtgtcagagcttg

SEQ ID NO: 1371455 - DNA, 22 bp, Artificial Sequence
  chemically synthesized
cttagcttgtgtcagagcttgg

SEQ ID NO: 1371456 - DNA, 22 bp, Artificial Sequence
  chemically synthesized
agcttgtgtcagagcttggatt

SEQ ID NO: 1371457 - DNA, 22 bp, Artificial Sequence
  chemically synthesized
gcttgtgtcagagcttggattc

SEQ ID NO: 1371458 - DNA, 22 bp, Artificial Sequence
  chemically synthesized
atatctgcattggaatccaagc

SEQ ID NO: 1371459 - DNA, 22 bp, Artificial Sequence
  chemically synthesized
catatctgcattggaatccaag

SEQ ID NO: 1371460 - DNA, 22 bp, Artificial Sequence
  chemically synthesized
gtgtcagagcttggattccaat

SEQ ID NO: 1371461 - DNA, 22 bp, Artificial Sequence
  chemically synthesized
tgtcagagcttggattccaatg

SEQ ID NO: 1371462 - DNA, 22 bp, Artificial Sequence
  chemically synthesized
gcttcatatctgcattggaatc

SEQ ID NO: 1371463 - DNA, 22 bp, Artificial Sequence
  chemically synthesized
tggcttcatatctgcattggaa

SEQ ID NO: 1371464 - DNA, 22 bp, Artificial Sequence
  chemically synthesized
ggattccaatgcagatatgaag

SEQ ID NO: 1371465 - DNA, 22 bp, Artificial Sequence
  chemically synthesized
gattccaatgcagatatgaagc

SEQ ID NO: 1371466 - DNA, 22 bp, Artificial Sequence
  chemically synthesized
caatgcagatatgaagccagag

SEQ ID NO: 1371467 - DNA, 22 bp, Artificial Sequence
  chemically synthesized
aggaccggtatagagcaatgac

SEQ ID NO: 1371468 - DNA, 22 bp, Artificial Sequence
  chemically synthesized
tgaggaccggtatagagcaatg

SEQ ID NO: 1371469 - DNA, 22 bp, Artificial Sequence
  chemically synthesized
gcttcctgtcattgctctatac

SEQ ID NO: 1371470 - DNA, 22 bp, Artificial Sequence
  chemically synthesized
cttcctgtcattgctctatacc

SEQ ID NO: 1371471 - DNA, 22 bp, Artificial Sequence
  chemically synthesized
cctgtcattgctctataccggt

SEQ ID NO: 1371472 - DNA, 22 bp, Artificial Sequence
  chemically synthesized
ggaactctgaggaccggtatag

SEQ ID NO: 1371473 - DNA, 22 bp, Artificial Sequence
  chemically synthesized
ctgtcattgctctataccggtc

SEQ ID NO: 1371474 - DNA, 22 bp, Artificial Sequence
  chemically synthesized
tcattgctctataccggtcctc

SEQ ID NO: 1371475 - DNA, 22 bp, Artificial Sequence
  chemically synthesized
cgtcctgggaactctgaggacc

SEQ ID NO: 1371476 - DNA, 22 bp, Artificial Sequence
  chemically synthesized
ctctataccggtcctcagagtt

SEQ ID NO: 1371477 - DNA, 22 bp, Artificial Sequence
  chemically synthesized
ctgcgtcctgggaactctgagg

SEQ ID NO: 1371478 - DNA, 22 bp, Artificial Sequence
  chemically synthesized
cctgcgtcctgggaactctgag

SEQ ID NO: 1371479 - DNA, 22 bp, Artificial Sequence
  chemically synthesized
tataccggtcctcagagttccc

SEQ ID NO: 1371480 - DNA, 22 bp, Artificial Sequence
  chemically synthesized
taccggtcctcagagttcccag

SEQ ID NO: 1371481 - DNA, 22 bp, Artificial Sequence
  chemically synthesized
ccttcctgcgtcctgggaactc

SEQ ID NO: 1371482 - DNA, 22 bp, Artificial Sequence
  chemically synthesized
caatctaccttcctgcgtcctg

SEQ ID NO: 1371483 - DNA, 22 bp, Artificial Sequence
  chemically synthesized
agagttcccaggacgcaggaag

SEQ ID NO: 1371484 - DNA, 22 bp, Artificial Sequence
  chemically synthesized
ccaggacgcaggaaggtagatt

SEQ ID NO: 1371485 - DNA, 22 bp, Artificial Sequence
  chemically synthesized
cagtgcaattccaatctacctt

SEQ ID NO: 1371486 - DNA, 22 bp, Artificial Sequence
  chemically synthesized
tgcctgcagtgcaattccaatc

SEQ ID NO: 1371487 - DNA, 22 bp, Artificial Sequence
  chemically synthesized
aattgtgcctgcagtgcaattc

SEQ ID NO: 1371488 - DNA, 22 bp, Artificial Sequence
  chemically synthesized
tggtggttaaattgtgcctgca

SEQ ID NO: 1371489 - DNA, 22 bp, Artificial Sequence
  chemically synthesized
gaattgcactgcaggcacaatt

SEQ ID NO: 1371490 - DNA, 22 bp, Artificial Sequence
  chemically synthesized
ttatggtggttaaattgtgcct

SEQ ID NO: 1371491 - DNA, 22 bp, Artificial Sequence
  chemically synthesized
cactgcaggcacaatttaacca

SEQ ID NO: 1371492 - DNA, 22 bp, Artificial Sequence
  chemically synthesized
ggatatctgttatggtggttaa

SEQ ID NO: 1371493 - DNA, 22 bp, Artificial Sequence
  chemically synthesized
aggatatctgttatggtggtta

SEQ ID NO: 1371494 - DNA, 22 bp, Artificial Sequence
  chemically synthesized
caggcacaatttaaccaccata

SEQ ID NO: 1371495 - DNA, 22 bp, Artificial Sequence
  chemically synthesized
aaccaccataacagatatccta

SEQ ID NO: 1371496 - DNA, 22 bp, Artificial Sequence
  chemically synthesized
accaccataacagatatcctaa

SEQ ID NO: 1371497 - DNA, 22 bp, Artificial Sequence
  chemically synthesized
aaaataaaaaaataatttagga

SEQ ID NO: 1371498 - DNA, 22 bp, Artificial Sequence
  chemically synthesized
acaaaaattaaaaataaaaaaa

SEQ ID NO: 1371499 - DNA, 22 bp, Artificial Sequence
  chemically synthesized
aattatttttttatttttaatt

SEQ ID NO: 1371500 - DNA, 22 bp, Artificial Sequence
  chemically synthesized
tgtactcacaaaaattaaaaat

SEQ ID NO: 1371501 - DNA, 22 bp, Artificial Sequence
  chemically synthesized
ttgtgtactcacaaaaattaaa

SEQ ID NO: 1371502 - DNA, 22 bp, Artificial Sequence
  chemically synthesized
tttttttatttttaatttttgt

SEQ ID NO: 1371503 - DNA, 22 bp, Artificial Sequence
  chemically synthesized
ttttatttttaatttttgtgag

SEQ ID NO: 1371504 - DNA, 22 bp, Artificial Sequence
  chemically synthesized
tttatttttaatttttgtgagt

SEQ ID NO: 1371505 - DNA, 22 bp, Artificial Sequence
  chemically synthesized
ttatttttaatttttgtgagta

SEQ ID NO: 1371506 - DNA, 22 bp, Artificial Sequence
  chemically synthesized
tatttttaatttttgtgagtac

SEQ ID NO: 1371507 - DNA, 22 bp, Artificial Sequence
  chemically synthesized
atttttaatttttgtgagtaca

SEQ ID NO: 1371508 - DNA, 22 bp, Artificial Sequence
  chemically synthesized
tttttaatttttgtgagtacac

SEQ ID NO: 1371509 - DNA, 22 bp, Artificial Sequence
  chemically synthesized
ttaatttttgtgagtacacaat

SEQ ID NO: 1371510 - DNA, 22 bp, Artificial Sequence
  chemically synthesized
taatttttgtgagtacacaata

SEQ ID NO: 1371511 - DNA, 22 bp, Artificial Sequence
  chemically synthesized
aatatgtacatctattgtgtac

SEQ ID NO: 1371512 - DNA, 22 bp, Artificial Sequence
  chemically synthesized
aatttttgtgagtacacaatag

SEQ ID NO: 1371513 - DNA, 22 bp, Artificial Sequence
  chemically synthesized
atttttgtgagtacacaataga

SEQ ID NO: 1371514 - DNA, 22 bp, Artificial Sequence
  chemically synthesized
ttgtgagtacacaatagatgta

SEQ ID NO: 1371515 - DNA, 22 bp, Artificial Sequence
  chemically synthesized
tgtgagtacacaatagatgtac

SEQ ID NO: 1371516 - DNA, 22 bp, Artificial Sequence
  chemically synthesized
gtgagtacacaatagatgtaca

SEQ ID NO: 1371517 - DNA, 22 bp, Artificial Sequence
  chemically synthesized
tgagtacacaatagatgtacat

SEQ ID NO: 1371518 - DNA, 22 bp, Artificial Sequence
  chemically synthesized
tgtaccgctaaatatgtacatc

SEQ ID NO: 1371519 - DNA, 22 bp, Artificial Sequence
  chemically synthesized
atgtaccgctaaatatgtacat

SEQ ID NO: 1371520 - DNA, 22 bp, Artificial Sequence
  chemically synthesized
gaatttatgtaccgctaaatat

SEQ ID NO: 1371521 - DNA, 22 bp, Artificial Sequence
  chemically synthesized
agaatttatgtaccgctaaata

SEQ ID NO: 1371522 - DNA, 22 bp, Artificial Sequence
  chemically synthesized
gtagcttagaatttatgtaccg

SEQ ID NO: 1371523 - DNA, 22 bp, Artificial Sequence
  chemically synthesized
ttggtagcttagaatttatgta

SEQ ID NO: 1371524 - DNA, 22 bp, Artificial Sequence
  chemically synthesized
agcggtacataaattctaagct

SEQ ID NO: 1371525 - DNA, 22 bp, Artificial Sequence
  chemically synthesized
aaatctattggtagcttagaat

SEQ ID NO: 1371526 - DNA, 22 bp, Artificial Sequence
  chemically synthesized
gcggtacataaattctaagcta

SEQ ID NO: 1371527 - DNA, 22 bp, Artificial Sequence
  chemically synthesized
taagctaccaatagattttaga

SEQ ID NO: 1371528 - DNA, 22 bp, Artificial Sequence
  chemically synthesized
caagaccatatgatctaaaatc

SEQ ID NO: 1371529 - DNA, 22 bp, Artificial Sequence
  chemically synthesized
agctaccaatagattttagatc

SEQ ID NO: 1371530 - DNA, 22 bp, Artificial Sequence
  chemically synthesized
acaagaccatatgatctaaaat

SEQ ID NO: 1371531 - DNA, 22 bp, Artificial Sequence
  chemically synthesized
tacaagaccatatgatctaaaa

SEQ ID NO: 1371532 - DNA, 22 bp, Artificial Sequence
  chemically synthesized
ttttacaagaccatatgatcta

SEQ ID NO: 1371533 - DNA, 22 bp, Artificial Sequence
  chemically synthesized
ccaatagattttagatcatatg

SEQ ID NO: 1371534 - DNA, 22 bp, Artificial Sequence
  chemically synthesized
atactattttacaagaccatat

SEQ ID NO: 1371535 - DNA, 22 bp, Artificial Sequence
  chemically synthesized
tagatcatatggtcttgtaaaa

SEQ ID NO: 1371536 - DNA, 22 bp, Artificial Sequence
  chemically synthesized
agatcatatggtcttgtaaaat

SEQ ID NO: 1371537 - DNA, 22 bp, Artificial Sequence
  chemically synthesized
catgctcatactattttacaag

SEQ ID NO: 1371538 - DNA, 22 bp, Artificial Sequence
  chemically synthesized
gatcatatggtcttgtaaaata

SEQ ID NO: 1371539 - DNA, 22 bp, Artificial Sequence
  chemically synthesized
accgttgcatgctcatactatt

SEQ ID NO: 1371540 - DNA, 22 bp, Artificial Sequence
  chemically synthesized
gtaaaatagtatgagcatgcaa

SEQ ID NO: 1371541 - DNA, 22 bp, Artificial Sequence
  chemically synthesized
taaaatagtatgagcatgcaac

SEQ ID NO: 1371542 - DNA, 22 bp, Artificial Sequence
  chemically synthesized
gcagcatgatcctaaccgttgc

SEQ ID NO: 1371543 - DNA, 22 bp, Artificial Sequence
  chemically synthesized
agtggtagaggttggcagcatg

SEQ ID NO: 1371544 - DNA, 22 bp, Artificial Sequence
  chemically synthesized
ttaagtggtagaggttggcagc

SEQ ID NO: 1371545 - DNA, 22 bp, Artificial Sequence
  chemically synthesized
ggatcatgctgccaacctctac

SEQ ID NO: 1371546 - DNA, 22 bp, Artificial Sequence
  chemically synthesized
ccaacctctaccacttaataga

SEQ ID NO: 1371547 - DNA, 22 bp, Artificial Sequence
  chemically synthesized
taccacttaatagatgggtgtg

SEQ ID NO: 1371548 - DNA, 22 bp, Artificial Sequence
  chemically synthesized
ccacttaatagatgggtgtgtg

SEQ ID NO: 1371549 - DNA, 22 bp, Artificial Sequence
  chemically synthesized
aatagatgggtgtgtgtgtgtg

SEQ ID NO: 1371550 - DNA, 22 bp, Artificial Sequence
  chemically synthesized
atagatgggtgtgtgtgtgtgt

SEQ ID NO: 1371551 - DNA, 22 bp, Artificial Sequence
  chemically synthesized
gtgtgtgcgtctatgtgtgtgt

SEQ ID NO: 1371552 - DNA, 22 bp, Artificial Sequence
  chemically synthesized
tgtgtgcgtctatgtgtgtgtg

SEQ ID NO: 1371553 - DNA, 22 bp, Artificial Sequence
  chemically synthesized
acaaatacacacagacacacac

SEQ ID NO: 1371554 - DNA, 22 bp, Artificial Sequence
  chemically synthesized
tgtgtgtgtgtgtctgtgtgta

SEQ ID NO: 1371555 - DNA, 22 bp, Artificial Sequence
  chemically synthesized
caaggtgtcacacattcacaaa

SEQ ID NO: 1371556 - DNA, 22 bp, Artificial Sequence
  chemically synthesized
tccaaggtgtcacacattcaca

SEQ ID NO: 1371557 - DNA, 22 bp, Artificial Sequence
  chemically synthesized
ctccaaggtgtcacacattcac

SEQ ID NO: 1371558 - DNA, 22 bp, Artificial Sequence
  chemically synthesized
ttctccaaggtgtcacacattc

SEQ ID NO: 1371559 - DNA, 22 bp, Artificial Sequence
  chemically synthesized
tgtgtatttgtgaatgtgtgac

SEQ ID NO: 1371560 - DNA, 22 bp, Artificial Sequence
  chemically synthesized
cttctccaaggtgtcacacatt

SEQ ID NO: 1371561 - DNA, 22 bp, Artificial Sequence
  chemically synthesized
tcttctccaaggtgtcacacat

SEQ ID NO: 1371562 - DNA, 22 bp, Artificial Sequence
  chemically synthesized
gtgaatgtgtgacaccttggag

SEQ ID NO: 1371563 - DNA, 22 bp, Artificial Sequence
  chemically synthesized
tgaatgtgtgacaccttggaga

SEQ ID NO: 1371564 - DNA, 22 bp, Artificial Sequence
  chemically synthesized
aggtgtgaaaaattttcttctc

SEQ ID NO: 1371565 - DNA, 22 bp, Artificial Sequence
  chemically synthesized
gggaaactgaggtgtgaaaaat

SEQ ID NO: 1371566 - DNA, 22 bp, Artificial Sequence
  chemically synthesized
ggagaagaaaatttttcacacc

SEQ ID NO: 1371567 - DNA, 22 bp, Artificial Sequence
  chemically synthesized
gagaagaaaatttttcacacct

SEQ ID NO: 1371568 - DNA, 22 bp, Artificial Sequence
  chemically synthesized
acaattggggaaactgaggtgt

SEQ ID NO: 1371569 - DNA, 22 bp, Artificial Sequence
  chemically synthesized
aacaattggggaaactgaggtg

SEQ ID NO: 1371570 - DNA, 22 bp, Artificial Sequence
  chemically synthesized
atttaacaattggggaaactga

SEQ ID NO: 1371571 - DNA, 22 bp, Artificial Sequence
  chemically synthesized
ttcacacctcagtttccccaat

SEQ ID NO: 1371572 - DNA, 22 bp, Artificial Sequence
  chemically synthesized
tcacacctcagtttccccaatt

SEQ ID NO: 1371573 - DNA, 22 bp, Artificial Sequence
  chemically synthesized
cacacctcagtttccccaattg

SEQ ID NO: 1371574 - DNA, 22 bp, Artificial Sequence
  chemically synthesized
tccctcatttaacaattgggga

SEQ ID NO: 1371575 - DNA, 22 bp, Artificial Sequence
  chemically synthesized
acacctcagtttccccaattgt

SEQ ID NO: 1371576 - DNA, 22 bp, Artificial Sequence
  chemically synthesized
ttatccctcatttaacaattgg

SEQ ID NO: 1371577 - DNA, 22 bp, Artificial Sequence
  chemically synthesized
agtttccccaattgttaaatga

SEQ ID NO: 1371578 - DNA, 22 bp, Artificial Sequence
  chemically synthesized
ccccaattgttaaatgagggat

SEQ ID NO: 1371579 - DNA, 22 bp, Artificial Sequence
  chemically synthesized
gcaacagttgttatccctcatt

SEQ ID NO: 1371580 - DNA, 22 bp, Artificial Sequence
  chemically synthesized
cccaattgttaaatgagggata

SEQ ID NO: 1371581 - DNA, 22 bp, Artificial Sequence
  chemically synthesized
ttaaatgagggataacaactgt

SEQ ID NO: 1371582 - DNA, 22 bp, Artificial Sequence
  chemically synthesized
agtgagttagcaacagttgtta

SEQ ID NO: 1371583 - DNA, 22 bp, Artificial Sequence
  chemically synthesized
aatgagggataacaactgttgc

SEQ ID NO: 1371584 - DNA, 22 bp, Artificial Sequence
  chemically synthesized
taactcagtgagttagcaacag

SEQ ID NO: 1371585 - DNA, 22 bp, Artificial Sequence
  chemically synthesized
gtaactcagtgagttagcaaca

SEQ ID NO: 1371586 - DNA, 22 bp, Artificial Sequence
  chemically synthesized
agtcatttgtaactcagtgagt

SEQ ID NO: 1371587 - DNA, 22 bp, Artificial Sequence
  chemically synthesized
ttgctaactcactgagttacaa

SEQ ID NO: 1371588 - DNA, 22 bp, Artificial Sequence
  chemically synthesized
ctaactcactgagttacaaatg

SEQ ID NO: 1371589 - DNA, 22 bp, Artificial Sequence
  chemically synthesized
tcgatattaagtcatttgtaac

SEQ ID NO: 1371590 - DNA, 22 bp, Artificial Sequence
  chemically synthesized
actcactgagttacaaatgact

SEQ ID NO: 1371591 - DNA, 22 bp, Artificial Sequence
  chemically synthesized
actgagttacaaatgacttaat

SEQ ID NO: 1371592 - DNA, 22 bp, Artificial Sequence
  chemically synthesized
agtgcattgtcgatattaagtc

SEQ ID NO: 1371593 - DNA, 22 bp, Artificial Sequence
  chemically synthesized
agttacaaatgacttaatatcg

SEQ ID NO: 1371594 - DNA, 22 bp, Artificial Sequence
  chemically synthesized
taagtgcattgtcgatattaag

SEQ ID NO: 1371595 - DNA, 22 bp, Artificial Sequence
  chemically synthesized
caaatgacttaatatcgacaat

SEQ ID NO: 1371596 - DNA, 22 bp, Artificial Sequence
  chemically synthesized
ggtggtattctaagtgcattgt

SEQ ID NO: 1371597 - DNA, 22 bp, Artificial Sequence
  chemically synthesized
tgggtggtattctaagtgcatt

SEQ ID NO: 1371598 - DNA, 22 bp, Artificial Sequence
  chemically synthesized
aatatcgacaatgcacttagaa

SEQ ID NO: 1371599 - DNA, 22 bp, Artificial Sequence
  chemically synthesized
atatcgacaatgcacttagaat

SEQ ID NO: 1371600 - DNA, 22 bp, Artificial Sequence
  chemically synthesized
gtatgttctgggtggtattcta

SEQ ID NO: 1371601 - DNA, 22 bp, Artificial Sequence
  chemically synthesized
agtatgttctgggtggtattct

SEQ ID NO: 1371602 - DNA, 22 bp, Artificial Sequence
  chemically synthesized
agaataccacccagaacatact

SEQ ID NO: 1371603 - DNA, 22 bp, Artificial Sequence
  chemically synthesized
gaataccacccagaacatacta

SEQ ID NO: 1371604 - DNA, 22 bp, Artificial Sequence
  chemically synthesized
acacatacaacttagtatgttc

SEQ ID NO: 1371605 - DNA, 22 bp, Artificial Sequence
  chemically synthesized
agttgtatgtgttagatattat

SEQ ID NO: 1371606 - DNA, 22 bp, Artificial Sequence
  chemically synthesized
tatgtgttagatattattatta

SEQ ID NO: 1371607 - DNA, 22 bp, Artificial Sequence
  chemically synthesized
caatcagtagtagtaataataa

SEQ ID NO: 1371608 - DNA, 22 bp, Artificial Sequence
  chemically synthesized
tgcaatcagtagtagtaataat

SEQ ID NO: 1371609 - DNA, 22 bp, Artificial Sequence
  chemically synthesized
ctgcaatcagtagtagtaataa

SEQ ID NO: 1371610 - DNA, 22 bp, Artificial Sequence
  chemically synthesized
gatattattattactactactg

SEQ ID NO: 1371611 - DNA, 22 bp, Artificial Sequence
  chemically synthesized
tcatttctgcaatcagtagtag

SEQ ID NO: 1371612 - DNA, 22 bp, Artificial Sequence
  chemically synthesized
atcatttctgcaatcagtagta

SEQ ID NO: 1371613 - DNA, 22 bp, Artificial Sequence
  chemically synthesized
tatcatttctgcaatcagtagt

SEQ ID NO: 1371614 - DNA, 22 bp, Artificial Sequence
  chemically synthesized
ttattactactactgattgcag

SEQ ID NO: 1371615 - DNA, 22 bp, Artificial Sequence
  chemically synthesized
atattttatcatttctgcaatc

SEQ ID NO: 1371616 - DNA, 22 bp, Artificial Sequence
  chemically synthesized
ttactactactgattgcagaaa

SEQ ID NO: 1371617 - DNA, 22 bp, Artificial Sequence
  chemically synthesized
catattttatcatttctgcaat

SEQ ID NO: 1371618 - DNA, 22 bp, Artificial Sequence
  chemically synthesized
tcatattttatcatttctgcaa

SEQ ID NO: 1371619 - DNA, 22 bp, Artificial Sequence
  chemically synthesized
ttcatattttatcatttctgca

SEQ ID NO: 1371620 - DNA, 22 bp, Artificial Sequence
  chemically synthesized
ctactactgattgcagaaatga

SEQ ID NO: 1371621 - DNA, 22 bp, Artificial Sequence
  chemically synthesized
ctactgattgcagaaatgataa

SEQ ID NO: 1371622 - DNA, 22 bp, Artificial Sequence
  chemically synthesized
ctgattgcagaaatgataaaat

SEQ ID NO: 1371623 - DNA, 22 bp, Artificial Sequence
  chemically synthesized
attgcagaaatgataaaatatg

SEQ ID NO: 1371624 - DNA, 22 bp, Artificial Sequence
  chemically synthesized
aaagaacatttttcatatttta

SEQ ID NO: 1371625 - DNA, 22 bp, Artificial Sequence
  chemically synthesized
taaaagaacatttttcatattt

SEQ ID NO: 1371626 - DNA, 22 bp, Artificial Sequence
  chemically synthesized
cagaaatgataaaatatgaaaa

SEQ ID NO: 1371627 - DNA, 22 bp, Artificial Sequence
  chemically synthesized
ctaaaagaacatttttcatatt

SEQ ID NO: 1371628 - DNA, 22 bp, Artificial Sequence
  chemically synthesized
ttctaaaagaacatttttcata

SEQ ID NO: 1371629 - DNA, 22 bp, Artificial Sequence
  chemically synthesized
cttctaaaagaacatttttcat

SEQ ID NO: 1371630 - DNA, 22 bp, Artificial Sequence
  chemically synthesized
ccacatttcttctaaaagaaca

SEQ ID NO: 1371631 - DNA, 22 bp, Artificial Sequence
  chemically synthesized
gccacatttcttctaaaagaac

SEQ ID NO: 1371632 - DNA, 22 bp, Artificial Sequence
  chemically synthesized
ttttagaagaaatgtggcaaac

SEQ ID NO: 1371633 - DNA, 22 bp, Artificial Sequence
  chemically synthesized
ttagaagaaatgtggcaaacac

SEQ ID NO: 1371634 - DNA, 22 bp, Artificial Sequence
  chemically synthesized
aatcatgtcagtgtgtttgcca

SEQ ID NO: 1371635 - DNA, 22 bp, Artificial Sequence
  chemically synthesized
tagaagaaatgtggcaaacaca

SEQ ID NO: 1371636 - DNA, 22 bp, Artificial Sequence
  chemically synthesized
agaagaaatgtggcaaacacac

SEQ ID NO: 1371637 - DNA, 22 bp, Artificial Sequence
  chemically synthesized
gaagaaatgtggcaaacacact

SEQ ID NO: 1371638 - DNA, 22 bp, Artificial Sequence
  chemically synthesized
attgaatcatgtcagtgtgttt

SEQ ID NO: 1371639 - DNA, 22 bp, Artificial Sequence
  chemically synthesized
ttcattgaatcatgtcagtgtg

SEQ ID NO: 1371640 - DNA, 22 bp, Artificial Sequence
  chemically synthesized
ctgttcattgaatcatgtcagt

SEQ ID NO: 1371641 - DNA, 22 bp, Artificial Sequence
  chemically synthesized
gactgctgttcattgaatcatg

SEQ ID NO: 1371642 - DNA, 22 bp, Artificial Sequence
  chemically synthesized
acatgattcaatgaacagcagt

SEQ ID NO: 1371643 - DNA, 22 bp, Artificial Sequence
  chemically synthesized
aatgaacagcagtctagattat

SEQ ID NO: 1371644 - DNA, 22 bp, Artificial Sequence
  chemically synthesized
taagacaatatacataatctag

SEQ ID NO: 1371645 - DNA, 22 bp, Artificial Sequence
  chemically synthesized
gattatgtatattgtcttataa

SEQ ID NO: 1371646 - DNA, 22 bp, Artificial Sequence
  chemically synthesized
tgtatattgtcttataatttta

SEQ ID NO: 1371647 - DNA, 22 bp, Artificial Sequence
  chemically synthesized
ggtcacgtagatgataaaatta

SEQ ID NO: 1371648 - DNA, 22 bp, Artificial Sequence
  chemically synthesized
aggtcacgtagatgataaaatt

SEQ ID NO: 1371649 - DNA, 22 bp, Artificial Sequence
  chemically synthesized
tcttataattttatcatctacg

SEQ ID NO: 1371650 - DNA, 22 bp, Artificial Sequence
  chemically synthesized
atacttaggtcacgtagatgat

SEQ ID NO: 1371651 - DNA, 22 bp, Artificial Sequence
  chemically synthesized
ataattttatcatctacgtgac

SEQ ID NO: 1371652 - DNA, 22 bp, Artificial Sequence
  chemically synthesized
taattttatcatctacgtgacc

SEQ ID NO: 1371653 - DNA, 22 bp, Artificial Sequence
  chemically synthesized
tatcatctacgtgacctaagta

SEQ ID NO: 1371654 - DNA, 22 bp, Artificial Sequence
  chemically synthesized
atcatctacgtgacctaagtat

SEQ ID NO: 1371655 - DNA, 22 bp, Artificial Sequence
  chemically synthesized
tcatctacgtgacctaagtatt

SEQ ID NO: 1371656 - DNA, 22 bp, Artificial Sequence
  chemically synthesized
gaatggcagcggtggctaatac

SEQ ID NO: 1371657 - DNA, 22 bp, Artificial Sequence
  chemically synthesized
ggaatggcagcggtggctaata

SEQ ID NO: 1371658 - DNA, 22 bp, Artificial Sequence
  chemically synthesized
cgtgacctaagtattagccacc

SEQ ID NO: 1371659 - DNA, 22 bp, Artificial Sequence
  chemically synthesized
ttggaatggcagcggtggctaa

SEQ ID NO: 1371660 - DNA, 22 bp, Artificial Sequence
  chemically synthesized
agtattagccaccgctgccatt

SEQ ID NO: 1371661 - DNA, 22 bp, Artificial Sequence
  chemically synthesized
caaaaaatcgactcttggaatg

SEQ ID NO: 1371662 - DNA, 22 bp, Artificial Sequence
  chemically synthesized
gccaccgctgccattccaagag

SEQ ID NO: 1371663 - DNA, 22 bp, Artificial Sequence
  chemically synthesized
acaaaaaatcgactcttggaat

SEQ ID NO: 1371664 - DNA, 22 bp, Artificial Sequence
  chemically synthesized
tacaaaaaatcgactcttggaa

SEQ ID NO: 1371665 - DNA, 22 bp, Artificial Sequence
  chemically synthesized
ccattccaagagtcgatttttt

SEQ ID NO: 1371666 - DNA, 22 bp, Artificial Sequence
  chemically synthesized
ccagaattttacaaaaaatcga

SEQ ID NO: 1371667 - DNA, 22 bp, Artificial Sequence
  chemically synthesized
cccagaattttacaaaaaatcg

SEQ ID NO: 1371668 - DNA, 22 bp, Artificial Sequence
  chemically synthesized
tcccagaattttacaaaaaatc

SEQ ID NO: 1371669 - DNA, 22 bp, Artificial Sequence
  chemically synthesized
ttcccagaattttacaaaaaat

SEQ ID NO: 1371670 - DNA, 22 bp, Artificial Sequence
  chemically synthesized
ttttcccagaattttacaaaaa

SEQ ID NO: 1371671 - DNA, 22 bp, Artificial Sequence
  chemically synthesized
caagagtcgattttttgtaaaa

SEQ ID NO: 1371672 - DNA, 22 bp, Artificial Sequence
  chemically synthesized
tttgtaaaattctgggaaaaga

SEQ ID NO: 1371673 - DNA, 22 bp, Artificial Sequence
  chemically synthesized
ttgtaaaattctgggaaaagag

SEQ ID NO: 1371674 - DNA, 22 bp, Artificial Sequence
  chemically synthesized
tgtaaaattctgggaaaagaga

SEQ ID NO: 1371675 - DNA, 22 bp, Artificial Sequence
  chemically synthesized
gtaaaattctgggaaaagagat

SEQ ID NO: 1371676 - DNA, 22 bp, Artificial Sequence
  chemically synthesized
taaaattctgggaaaagagatt

SEQ ID NO: 1371677 - DNA, 22 bp, Artificial Sequence
  chemically synthesized
tgggaaaagagattttgcttct

SEQ ID NO: 1371678 - DNA, 22 bp, Artificial Sequence
  chemically synthesized
ggagtaaatgtgagaagcaaaa

SEQ ID NO: 1371679 - DNA, 22 bp, Artificial Sequence
  chemically synthesized
aggagtaaatgtgagaagcaaa

SEQ ID NO: 1371680 - DNA, 22 bp, Artificial Sequence
  chemically synthesized
ggaaaagagattttgcttctca

SEQ ID NO: 1371681 - DNA, 22 bp, Artificial Sequence
  chemically synthesized
acttaggagtaaatgtgagaag

SEQ ID NO: 1371682 - DNA, 22 bp, Artificial Sequence
  chemically synthesized
tgacttaggagtaaatgtgaga

SEQ ID NO: 1371683 - DNA, 22 bp, Artificial Sequence
  chemically synthesized
ctgacttaggagtaaatgtgag

SEQ ID NO: 1371684 - DNA, 22 bp, Artificial Sequence
  chemically synthesized
tgcttctcacatttactcctaa

SEQ ID NO: 1371685 - DNA, 22 bp, Artificial Sequence
  chemically synthesized
gcttctcacatttactcctaag

SEQ ID NO: 1371686 - DNA, 22 bp, Artificial Sequence
  chemically synthesized
cttctcacatttactcctaagt

SEQ ID NO: 1371687 - DNA, 22 bp, Artificial Sequence
  chemically synthesized
ctcacatttactcctaagtcag

SEQ ID NO: 1371688 - DNA, 22 bp, Artificial Sequence
  chemically synthesized
cccaatagacttctgacttagg

SEQ ID NO: 1371689 - DNA, 22 bp, Artificial Sequence
  chemically synthesized
tcacatttactcctaagtcaga

SEQ ID NO: 1371690 - DNA, 22 bp, Artificial Sequence
  chemically synthesized
acatttactcctaagtcagaag

SEQ ID NO: 1371691 - DNA, 22 bp, Artificial Sequence
  chemically synthesized
actcctaagtcagaagtctatt

SEQ ID NO: 1371692 - DNA, 22 bp, Artificial Sequence
  chemically synthesized
ctcctaagtcagaagtctattg

SEQ ID NO: 1371693 - DNA, 22 bp, Artificial Sequence
  chemically synthesized
ctaagtcagaagtctattgggt

SEQ ID NO: 1371694 - DNA, 22 bp, Artificial Sequence
  chemically synthesized
agtcagaagtctattgggtaat

SEQ ID NO: 1371695 - DNA, 22 bp, Artificial Sequence
  chemically synthesized
aacccagagaagtgattaccca

SEQ ID NO: 1371696 - DNA, 22 bp, Artificial Sequence
  chemically synthesized
ttgggtaatcacttctctgggt

SEQ ID NO: 1371697 - DNA, 22 bp, Artificial Sequence
  chemically synthesized
ggtaatcacttctctgggttta

SEQ ID NO: 1371698 - DNA, 22 bp, Artificial Sequence
  chemically synthesized
agagtggccaggagggatctaa

SEQ ID NO: 1371699 - DNA, 22 bp, Artificial Sequence
  chemically synthesized
ctctgggtttagatccctcctg

SEQ ID NO: 1371700 - DNA, 22 bp, Artificial Sequence
  chemically synthesized
tctgggtttagatccctcctgg

SEQ ID NO: 1371701 - DNA, 22 bp, Artificial Sequence
  chemically synthesized
tgggtttagatccctcctggcc

SEQ ID NO: 1371702 - DNA, 22 bp, Artificial Sequence
  chemically synthesized
ggtttagatccctcctggccac

SEQ ID NO: 1371703 - DNA, 22 bp, Artificial Sequence
  chemically synthesized
agatccctcctggccactctca

SEQ ID NO: 1371704 - DNA, 22 bp, Artificial Sequence
  chemically synthesized
gatccctcctggccactctcag

SEQ ID NO: 1371705 - DNA, 22 bp, Artificial Sequence
  chemically synthesized
ggcgaaagaatcactgagagtg

SEQ ID NO: 1371706 - DNA, 22 bp, Artificial Sequence
  chemically synthesized
ctggccactctcagtgattctt

SEQ ID NO: 1371707 - DNA, 22 bp, Artificial Sequence
  chemically synthesized
gccactctcagtgattctttcg

SEQ ID NO: 1371708 - DNA, 22 bp, Artificial Sequence
  chemically synthesized
gcgaacagtggcctgggcgaaa

SEQ ID NO: 1371709 - DNA, 22 bp, Artificial Sequence
  chemically synthesized
agcgaacagtggcctgggcgaa

SEQ ID NO: 1371710 - DNA, 22 bp, Artificial Sequence
  chemically synthesized
tcagtgattctttcgcccaggc

SEQ ID NO: 1371711 - DNA, 22 bp, Artificial Sequence
  chemically synthesized
agtgattctttcgcccaggcca

SEQ ID NO: 1371712 - DNA, 22 bp, Artificial Sequence
  chemically synthesized
tttcgcccaggccactgttcgc

SEQ ID NO: 1371713 - DNA, 22 bp, Artificial Sequence
  chemically synthesized
tcgcccaggccactgttcgcta

SEQ ID NO: 1371714 - DNA, 22 bp, Artificial Sequence
  chemically synthesized
cgcccaggccactgttcgctaa

SEQ ID NO: 1371715 - DNA, 22 bp, Artificial Sequence
  chemically synthesized
gcccaggccactgttcgctaag

SEQ ID NO: 1371716 - DNA, 22 bp, Artificial Sequence
  chemically synthesized
ttcgctaagcttgtcaccacat

SEQ ID NO: 1371717 - DNA, 22 bp, Artificial Sequence
  chemically synthesized
tccagtaaatccatgtggtgac

SEQ ID NO: 1371718 - DNA, 22 bp, Artificial Sequence
  chemically synthesized
gctaagcttgtcaccacatgga

SEQ ID NO: 1371719 - DNA, 22 bp, Artificial Sequence
  chemically synthesized
agcttgtcaccacatggattta

SEQ ID NO: 1371720 - DNA, 22 bp, Artificial Sequence
  chemically synthesized
gtcaccacatggatttactgga

SEQ ID NO: 1371721 - DNA, 22 bp, Artificial Sequence
  chemically synthesized
tcaccacatggatttactggac

SEQ ID NO: 1371722 - DNA, 22 bp, Artificial Sequence
  chemically synthesized
tccagtaaatggacaattgtcc

SEQ ID NO: 1371723 - DNA, 22 bp, Artificial Sequence
  chemically synthesized
actggacaattgtccatttact

SEQ ID NO: 1371724 - DNA, 22 bp, Artificial Sequence
  chemically synthesized
ctggacaattgtccatttactg

SEQ ID NO: 1371725 - DNA, 22 bp, Artificial Sequence
  chemically synthesized
gacaattgtccatttactggac

SEQ ID NO: 1371726 - DNA, 22 bp, Artificial Sequence
  chemically synthesized
ggaagagccattgtccagtaaa

SEQ ID NO: 1371727 - DNA, 22 bp, Artificial Sequence
  chemically synthesized
tccatttactggacaatggctc

SEQ ID NO: 1371728 - DNA, 22 bp, Artificial Sequence
  chemically synthesized
actggacaatggctcttcctag

SEQ ID NO: 1371729 - DNA, 22 bp, Artificial Sequence
  chemically synthesized
ctggacaatggctcttcctagt

SEQ ID NO: 1371730 - DNA, 22 bp, Artificial Sequence
  chemically synthesized
aggggcagcagcacactaggaa

SEQ ID NO: 1371731 - DNA, 22 bp, Artificial Sequence
  chemically synthesized
gacaatggctcttcctagtgtg

SEQ ID NO: 1371732 - DNA, 22 bp, Artificial Sequence
  chemically synthesized
ttcctagtgtgctgctgcccct

SEQ ID NO: 1371733 - DNA, 22 bp, Artificial Sequence
  chemically synthesized
aagcccatgctgaggggcagca

SEQ ID NO: 1371734 - DNA, 22 bp, Artificial Sequence
  chemically synthesized
cctagtgtgctgctgcccctca

SEQ ID NO: 1371735 - DNA, 22 bp, Artificial Sequence
  chemically synthesized
ctagtgtgctgctgcccctcag

SEQ ID NO: 1371736 - DNA, 22 bp, Artificial Sequence
  chemically synthesized
gtgtgctgctgcccctcagcat

SEQ ID NO: 1371737 - DNA, 22 bp, Artificial Sequence
  chemically synthesized
gtgtggggctgaagcccatgct

SEQ ID NO: 1371738 - DNA, 22 bp, Artificial Sequence
  chemically synthesized
ggtgtggggctgaagcccatgc

SEQ ID NO: 1371739 - DNA, 22 bp, Artificial Sequence
  chemically synthesized
ctgcccctcagcatgggcttca

SEQ ID NO: 1371740 - DNA, 22 bp, Artificial Sequence
  chemically synthesized
cccctcagcatgggcttcagcc

SEQ ID NO: 1371741 - DNA, 22 bp, Artificial Sequence
  chemically synthesized
catgtttggtgtggggctgaag

SEQ ID NO: 1371742 - DNA, 22 bp, Artificial Sequence
  chemically synthesized
ttccatgtttggtgtggggctg

SEQ ID NO: 1371743 - DNA, 22 bp, Artificial Sequence
  chemically synthesized
agcatgggcttcagccccacac

SEQ ID NO: 1371744 - DNA, 22 bp, Artificial Sequence
  chemically synthesized
cagccccacaccaaacatggaa

SEQ ID NO: 1371745 - DNA, 22 bp, Artificial Sequence
  chemically synthesized
agccccacaccaaacatggaac

SEQ ID NO: 1371746 - DNA, 22 bp, Artificial Sequence
  chemically synthesized
taagggtgagtagtaacaggag

SEQ ID NO: 1371747 - DNA, 22 bp, Artificial Sequence
  chemically synthesized
tggggactataagggtgagtag

SEQ ID NO: 1371748 - DNA, 22 bp, Artificial Sequence
  chemically synthesized
tcctcctgttactactcaccct

SEQ ID NO: 1371749 - DNA, 22 bp, Artificial Sequence
  chemically synthesized
ctcctgttactactcaccctta

SEQ ID NO: 1371750 - DNA, 22 bp, Artificial Sequence
  chemically synthesized
ctgttactactcacccttatag

SEQ ID NO: 1371751 - DNA, 22 bp, Artificial Sequence
  chemically synthesized
ttactactcacccttatagtcc

SEQ ID NO: 1371752 - DNA, 22 bp, Artificial Sequence
  chemically synthesized
atggagttgtggggactataag

SEQ ID NO: 1371753 - DNA, 22 bp, Artificial Sequence
  chemically synthesized
tgatggagttgtggggactata

SEQ ID NO: 1371754 - DNA, 22 bp, Artificial Sequence
  chemically synthesized
ctactcacccttatagtcccca

SEQ ID NO: 1371755 - DNA, 22 bp, Artificial Sequence
  chemically synthesized
tctgatggagttgtggggacta

SEQ ID NO: 1371756 - DNA, 22 bp, Artificial Sequence
  chemically synthesized
ctcacccttatagtccccacaa

SEQ ID NO: 1371757 - DNA, 22 bp, Artificial Sequence
  chemically synthesized
acccttatagtccccacaactc

SEQ ID NO: 1371758 - DNA, 22 bp, Artificial Sequence
  chemically synthesized
cagaactctctgatggagttgt

SEQ ID NO: 1371759 - DNA, 22 bp, Artificial Sequence
  chemically synthesized
atagtccccacaactccatcag

SEQ ID NO: 1371760 - DNA, 22 bp, Artificial Sequence
  chemically synthesized
ctacagaactctctgatggagt

SEQ ID NO: 1371761 - DNA, 22 bp, Artificial Sequence
  chemically synthesized
tagtccccacaactccatcaga

SEQ ID NO: 1371762 - DNA, 22 bp, Artificial Sequence
  chemically synthesized
catcagagagttctgtaggaat

SEQ ID NO: 1371763 - DNA, 22 bp, Artificial Sequence
  chemically synthesized
cagtaaaggccagtattcctac

SEQ ID NO: 1371764 - DNA, 22 bp, Artificial Sequence
  chemically synthesized
tgtaggaatactggcctttact

SEQ ID NO: 1371765 - DNA, 22 bp, Artificial Sequence
  chemically synthesized
taggaatactggcctttactgg

SEQ ID NO: 1371766 - DNA, 22 bp, Artificial Sequence
  chemically synthesized
cccccaatcccaaccctccagt

SEQ ID NO: 1371767 - DNA, 22 bp, Artificial Sequence
  chemically synthesized
gttacccccaatcccaaccctc

SEQ ID NO: 1371768 - DNA, 22 bp, Artificial Sequence
  chemically synthesized
agttacccccaatcccaaccct

SEQ ID NO: 1371769 - DNA, 22 bp, Artificial Sequence
  chemically synthesized
gcctttactggagggttgggat

SEQ ID NO: 1371770 - DNA, 22 bp, Artificial Sequence
  chemically synthesized
ttagttacccccaatcccaacc

SEQ ID NO: 1371771 - DNA, 22 bp, Artificial Sequence
  chemically synthesized
tcttagttacccccaatcccaa

SEQ ID NO: 1371772 - DNA, 22 bp, Artificial Sequence
  chemically synthesized
tactggagggttgggattgggg

SEQ ID NO: 1371773 - DNA, 22 bp, Artificial Sequence
  chemically synthesized
actggagggttgggattggggg

SEQ ID NO: 1371774 - DNA, 22 bp, Artificial Sequence
  chemically synthesized
ctggagggttgggattgggggt

SEQ ID NO: 1371775 - DNA, 22 bp, Artificial Sequence
  chemically synthesized
gagggttgggattgggggtaac

SEQ ID NO: 1371776 - DNA, 22 bp, Artificial Sequence
  chemically synthesized
acgtaattctcttagttacccc

SEQ ID NO: 1371777 - DNA, 22 bp, Artificial Sequence
  chemically synthesized
aacgtaattctcttagttaccc

SEQ ID NO: 1371778 - DNA, 22 bp, Artificial Sequence
  chemically synthesized
ggattgggggtaactaagagaa

SEQ ID NO: 1371779 - DNA, 22 bp, Artificial Sequence
  chemically synthesized
catcccttaacgtaattctctt

SEQ ID NO: 1371780 - DNA, 22 bp, Artificial Sequence
  chemically synthesized
tccatcccttaacgtaattctc

SEQ ID NO: 1371781 - DNA, 22 bp, Artificial Sequence
  chemically synthesized
ggggtaactaagagaattacgt

SEQ ID NO: 1371782 - DNA, 22 bp, Artificial Sequence
  chemically synthesized
ctccatcccttaacgtaattct

SEQ ID NO: 1371783 - DNA, 22 bp, Artificial Sequence
  chemically synthesized
tctccatcccttaacgtaattc

SEQ ID NO: 1371784 - DNA, 22 bp, Artificial Sequence
  chemically synthesized
gcctttctccatcccttaacgt

SEQ ID NO: 1371785 - DNA, 22 bp, Artificial Sequence
  chemically synthesized
ggcctttctccatcccttaacg

SEQ ID NO: 1371786 - DNA, 22 bp, Artificial Sequence
  chemically synthesized
agagaattacgttaagggatgg

SEQ ID NO: 1371787 - DNA, 22 bp, Artificial Sequence
  chemically synthesized
gtatagagtttggcctttctcc

SEQ ID NO: 1371788 - DNA, 22 bp, Artificial Sequence
  chemically synthesized
cgttaagggatggagaaaggcc

SEQ ID NO: 1371789 - DNA, 22 bp, Artificial Sequence
  chemically synthesized
ttagtatagagtttggcctttc

SEQ ID NO: 1371790 - DNA, 22 bp, Artificial Sequence
  chemically synthesized
agggatggagaaaggccaaact

SEQ ID NO: 1371791 - DNA, 22 bp, Artificial Sequence
  chemically synthesized
cacaacacaagaccaagccatt

SEQ ID NO: 1371792 - DNA, 22 bp, Artificial Sequence
  chemically synthesized
tatactaacaatggcttggtct

SEQ ID NO: 1371793 - DNA, 22 bp, Artificial Sequence
  chemically synthesized
ctacacaacacaagaccaagcc

SEQ ID NO: 1371794 - DNA, 22 bp, Artificial Sequence
  chemically synthesized
tactaacaatggcttggtcttg

SEQ ID NO: 1371795 - DNA, 22 bp, Artificial Sequence
  chemically synthesized
tgctacacaacacaagaccaag

SEQ ID NO: 1371796 - DNA, 22 bp, Artificial Sequence
  chemically synthesized
ctgctacacaacacaagaccaa

SEQ ID NO: 1371797 - DNA, 22 bp, Artificial Sequence
  chemically synthesized
tctgctacacaacacaagacca

SEQ ID NO: 1371798 - DNA, 22 bp, Artificial Sequence
  chemically synthesized
ttctgctacacaacacaagacc

SEQ ID NO: 1371799 - DNA, 22 bp, Artificial Sequence
  chemically synthesized
acaatggcttggtcttgtgttg

SEQ ID NO: 1371800 - DNA, 22 bp, Artificial Sequence
  chemically synthesized
cttttctgctacacaacacaag

SEQ ID NO: 1371801 - DNA, 22 bp, Artificial Sequence
  chemically synthesized
ctgcttttctgctacacaacac

SEQ ID NO: 1371802 - DNA, 22 bp, Artificial Sequence
  chemically synthesized
cctgcttttctgctacacaaca

SEQ ID NO: 1371803 - DNA, 22 bp, Artificial Sequence
  chemically synthesized
tcctgcttttctgctacacaac

SEQ ID NO: 1371804 - DNA, 22 bp, Artificial Sequence
  chemically synthesized
ttcctgcttttctgctacacaa

SEQ ID NO: 1371805 - DNA, 22 bp, Artificial Sequence
  chemically synthesized
tttcctgcttttctgctacaca

SEQ ID NO: 1371806 - DNA, 22 bp, Artificial Sequence
  chemically synthesized
ggtcttgtgttgtgtagcagaa

SEQ ID NO: 1371807 - DNA, 22 bp, Artificial Sequence
  chemically synthesized
gtcttgtgttgtgtagcagaaa

SEQ ID NO: 1371808 - DNA, 22 bp, Artificial Sequence
  chemically synthesized
attttttcctgcttttctgcta

SEQ ID NO: 1371809 - DNA, 22 bp, Artificial Sequence
  chemically synthesized
gtgttgtgtagcagaaaagcag

SEQ ID NO: 1371810 - DNA, 22 bp, Artificial Sequence
  chemically synthesized
tgttgtgtagcagaaaagcagg

SEQ ID NO: 1371811 - DNA, 22 bp, Artificial Sequence
  chemically synthesized
tgtagcagaaaagcaggaaaaa

SEQ ID NO: 1371812 - DNA, 22 bp, Artificial Sequence
  chemically synthesized
tgtaggggttaattttttcctg

SEQ ID NO: 1371813 - DNA, 22 bp, Artificial Sequence
  chemically synthesized
acaaaaaacgttgtgtaggggt

SEQ ID NO: 1371814 - DNA, 22 bp, Artificial Sequence
  chemically synthesized
gtgcgtgctcacaaaaaacgtt

SEQ ID NO: 1371815 - DNA, 22 bp, Artificial Sequence
  chemically synthesized
acccctacacaacgttttttgt

SEQ ID NO: 1371816 - DNA, 22 bp, Artificial Sequence
  chemically synthesized
cacaacgttttttgtgagcacg

SEQ ID NO: 1371817 - DNA, 22 bp, Artificial Sequence
  chemically synthesized
tttgtgagcacgcaccagttcc

SEQ ID NO: 1371818 - DNA, 22 bp, Artificial Sequence
  chemically synthesized
ttgtgagcacgcaccagttcct

SEQ ID NO: 1371819 - DNA, 22 bp, Artificial Sequence
  chemically synthesized
tgtgagcacgcaccagttccta

SEQ ID NO: 1371820 - DNA, 22 bp, Artificial Sequence
  chemically synthesized
gtgagcacgcaccagttcctat

SEQ ID NO: 1371821 - DNA, 22 bp, Artificial Sequence
  chemically synthesized
tgagcacgcaccagttcctatt

SEQ ID NO: 1371822 - DNA, 22 bp, Artificial Sequence
  chemically synthesized
aataggaaagagtaagaatagg

SEQ ID NO: 1371823 - DNA, 22 bp, Artificial Sequence
  chemically synthesized
caataggaaagagtaagaatag

SEQ ID NO: 1371824 - DNA, 22 bp, Artificial Sequence
  chemically synthesized
ctattcttactctttcctattg

SEQ ID NO: 1371825 - DNA, 22 bp, Artificial Sequence
  chemically synthesized
ttcttactctttcctattgaag

SEQ ID NO: 1371826 - DNA, 22 bp, Artificial Sequence
  chemically synthesized
ttactctttcctattgaaggct

SEQ ID NO: 1371827 - DNA, 22 bp, Artificial Sequence
  chemically synthesized
actctttcctattgaaggctat

SEQ ID NO: 1371828 - DNA, 22 bp, Artificial Sequence
  chemically synthesized
gaaaggaagcccatagccttca

SEQ ID NO: 1371829 - DNA, 22 bp, Artificial Sequence
  chemically synthesized
ctctttcctattgaaggctatg

SEQ ID NO: 1371830 - DNA, 22 bp, Artificial Sequence
  chemically synthesized
agaaaggaagcccatagccttc

SEQ ID NO: 1371831 - DNA, 22 bp, Artificial Sequence
  chemically synthesized
tagaaaggaagcccatagcctt

SEQ ID NO: 1371832 - DNA, 22 bp, Artificial Sequence
  chemically synthesized
ttagaaaggaagcccatagcct

SEQ ID NO: 1371833 - DNA, 22 bp, Artificial Sequence
  chemically synthesized
tttcctattgaaggctatgggc

SEQ ID NO: 1371834 - DNA, 22 bp, Artificial Sequence
  chemically synthesized
tcctattgaaggctatgggctt

SEQ ID NO: 1371835 - DNA, 22 bp, Artificial Sequence
  chemically synthesized
cctattgaaggctatgggcttc

SEQ ID NO: 1371836 - DNA, 22 bp, Artificial Sequence
  chemically synthesized
ctattgaaggctatgggcttcc

SEQ ID NO: 1371837 - DNA, 22 bp, Artificial Sequence
  chemically synthesized
ttgaaggctatgggcttccttt

SEQ ID NO: 1371838 - DNA, 22 bp, Artificial Sequence
  chemically synthesized
aaggctatgggcttcctttcta

SEQ ID NO: 1371839 - DNA, 22 bp, Artificial Sequence
  chemically synthesized
aaaatggaggccttttagaaag

SEQ ID NO: 1371840 - DNA, 22 bp, Artificial Sequence
  chemically synthesized
gaaaatggaggccttttagaaa

SEQ ID NO: 1371841 - DNA, 22 bp, Artificial Sequence
  chemically synthesized
tgggcttcctttctaaaaggcc

SEQ ID NO: 1371842 - DNA, 22 bp, Artificial Sequence
  chemically synthesized
gcttgaaaatggaggcctttta

SEQ ID NO: 1371843 - DNA, 22 bp, Artificial Sequence
  chemically synthesized
tagcttgaaaatggaggccttt

SEQ ID NO: 1371844 - DNA, 22 bp, Artificial Sequence
  chemically synthesized
ctagcttgaaaatggaggcctt

SEQ ID NO: 1371845 - DNA, 22 bp, Artificial Sequence
  chemically synthesized
cctttctaaaaggcctccattt

SEQ ID NO: 1371846 - DNA, 22 bp, Artificial Sequence
  chemically synthesized
ctttctaaaaggcctccatttt

SEQ ID NO: 1371847 - DNA, 22 bp, Artificial Sequence
  chemically synthesized
tctaaaaggcctccattttcaa

SEQ ID NO: 1371848 - DNA, 22 bp, Artificial Sequence
  chemically synthesized
ctaaaaggcctccattttcaag

SEQ ID NO: 1371849 - DNA, 22 bp, Artificial Sequence
  chemically synthesized
taaaaggcctccattttcaagc

SEQ ID NO: 1371850 - DNA, 22 bp, Artificial Sequence
  chemically synthesized
aaaggcctccattttcaagcta

SEQ ID NO: 1371851 - DNA, 22 bp, Artificial Sequence
  chemically synthesized
aaggaaggcagtcatttctagc

SEQ ID NO: 1371852 - DNA, 22 bp, Artificial Sequence
  chemically synthesized
cattttcaagctagaaatgact

SEQ ID NO: 1371853 - DNA, 22 bp, Artificial Sequence
  chemically synthesized
cctgaaggaaggcagtcatttc

SEQ ID NO: 1371854 - DNA, 22 bp, Artificial Sequence
  chemically synthesized
ccctgaaggaaggcagtcattt

SEQ ID NO: 1371855 - DNA, 22 bp, Artificial Sequence
  chemically synthesized
tcaagctagaaatgactgcctt

SEQ ID NO: 1371856 - DNA, 22 bp, Artificial Sequence
  chemically synthesized
caagctagaaatgactgccttc

SEQ ID NO: 1371857 - DNA, 22 bp, Artificial Sequence
  chemically synthesized
aagctagaaatgactgccttcc

SEQ ID NO: 1371858 - DNA, 22 bp, Artificial Sequence
  chemically synthesized
gaaatgactgccttccttcagg

SEQ ID NO: 1371859 - DNA, 22 bp, Artificial Sequence
  chemically synthesized
tggggtggaatttccctgaagg

SEQ ID NO: 1371860 - DNA, 22 bp, Artificial Sequence
  chemically synthesized
ttatggggtggaatttccctga

SEQ ID NO: 1371861 - DNA, 22 bp, Artificial Sequence
  chemically synthesized
ctattatggggtggaatttccc

SEQ ID NO: 1371862 - DNA, 22 bp, Artificial Sequence
  chemically synthesized
cctattatggggtggaatttcc

SEQ ID NO: 1371863 - DNA, 22 bp, Artificial Sequence
  chemically synthesized
ccttccttcagggaaattccac

SEQ ID NO: 1371864 - DNA, 22 bp, Artificial Sequence
  chemically synthesized
ccttcagggaaattccacccca

SEQ ID NO: 1371865 - DNA, 22 bp, Artificial Sequence
  chemically synthesized
cttcagggaaattccaccccat

SEQ ID NO: 1371866 - DNA, 22 bp, Artificial Sequence
  chemically synthesized
cagggaaattccaccccataat

SEQ ID NO: 1371867 - DNA, 22 bp, Artificial Sequence
  chemically synthesized
agggaaattccaccccataata

SEQ ID NO: 1371868 - DNA, 22 bp, Artificial Sequence
  chemically synthesized
caccccataataggaaacattg

SEQ ID NO: 1371869 - DNA, 22 bp, Artificial Sequence
  chemically synthesized
gcatatagtaaatgatcaatgt

SEQ ID NO: 1371870 - DNA, 22 bp, Artificial Sequence
  chemically synthesized
ggcatatagtaaatgatcaatg

SEQ ID NO: 1371871 - DNA, 22 bp, Artificial Sequence
  chemically synthesized
gatcaatacttggcatatagta

SEQ ID NO: 1371872 - DNA, 22 bp, Artificial Sequence
  chemically synthesized
agatcaatacttggcatatagt

SEQ ID NO: 1371873 - DNA, 22 bp, Artificial Sequence
  chemically synthesized
cttagatcaatacttggcatat

SEQ ID NO: 1371874 - DNA, 22 bp, Artificial Sequence
  chemically synthesized
atcatttactatatgccaagta

SEQ ID NO: 1371875 - DNA, 22 bp, Artificial Sequence
  chemically synthesized
atgagttgcttagatcaatact

SEQ ID NO: 1371876 - DNA, 22 bp, Artificial Sequence
  chemically synthesized
actatatgccaagtattgatct

SEQ ID NO: 1371877 - DNA, 22 bp, Artificial Sequence
  chemically synthesized
ctatatgccaagtattgatcta

SEQ ID NO: 1371878 - DNA, 22 bp, Artificial Sequence
  chemically synthesized
tgatgagttgcttagatcaata

SEQ ID NO: 1371879 - DNA, 22 bp, Artificial Sequence
  chemically synthesized
tatgccaagtattgatctaagc

SEQ ID NO: 1371880 - DNA, 22 bp, Artificial Sequence
  chemically synthesized
attctgatgagttgcttagatc

SEQ ID NO: 1371881 - DNA, 22 bp, Artificial Sequence
  chemically synthesized
atctaagcaactcatcagaatt

SEQ ID NO: 1371882 - DNA, 22 bp, Artificial Sequence
  chemically synthesized
aatacagtagttaattctgatg

SEQ ID NO: 1371883 - DNA, 22 bp, Artificial Sequence
  chemically synthesized
agcaactcatcagaattaacta

SEQ ID NO: 1371884 - DNA, 22 bp, Artificial Sequence
  chemically synthesized
agaatcaattaaatacagtagt

SEQ ID NO: 1371885 - DNA, 22 bp, Artificial Sequence
  chemically synthesized
atcagaattaactactgtattt

SEQ ID NO: 1371886 - DNA, 22 bp, Artificial Sequence
  chemically synthesized
actactgtatttaattgattct

SEQ ID NO: 1371887 - DNA, 22 bp, Artificial Sequence
  chemically synthesized
ctgtatttaattgattctgaga

SEQ ID NO: 1371888 - DNA, 22 bp, Artificial Sequence
  chemically synthesized
tatttaattgattctgagatga

SEQ ID NO: 1371889 - DNA, 22 bp, Artificial Sequence
  chemically synthesized
aaatgtgaaatgtcatctcaga

SEQ ID NO: 1371890 - DNA, 22 bp, Artificial Sequence
  chemically synthesized
aattgattctgagatgacattt

SEQ ID NO: 1371891 - DNA, 22 bp, Artificial Sequence
  chemically synthesized
attgattctgagatgacatttc

SEQ ID NO: 1371892 - DNA, 22 bp, Artificial Sequence
  chemically synthesized
gaaatgttaaaatgtgaaatgt

SEQ ID NO: 1371893 - DNA, 22 bp, Artificial Sequence
  chemically synthesized
attctgagatgacatttcacat

SEQ ID NO: 1371894 - DNA, 22 bp, Artificial Sequence
  chemically synthesized
agaaatgttaaaatgtgaaatg

SEQ ID NO: 1371895 - DNA, 22 bp, Artificial Sequence
  chemically synthesized
tagaaatgttaaaatgtgaaat

SEQ ID NO: 1371896 - DNA, 22 bp, Artificial Sequence
  chemically synthesized
tgagatgacatttcacatttta

SEQ ID NO: 1371897 - DNA, 22 bp, Artificial Sequence
  chemically synthesized
attttagaaatgttaaaatgtg

SEQ ID NO: 1371898 - DNA, 22 bp, Artificial Sequence
  chemically synthesized
agatgacatttcacattttaac

SEQ ID NO: 1371899 - DNA, 22 bp, Artificial Sequence
  chemically synthesized
agacatattgattttagaaatg

SEQ ID NO: 1371900 - DNA, 22 bp, Artificial Sequence
  chemically synthesized
aagacatattgattttagaaat

SEQ ID NO: 1371901 - DNA, 22 bp, Artificial Sequence
  chemically synthesized
cacattttaacatttctaaaat

SEQ ID NO: 1371902 - DNA, 22 bp, Artificial Sequence
  chemically synthesized
taagacatattgattttagaaa

SEQ ID NO: 1371903 - DNA, 22 bp, Artificial Sequence
  chemically synthesized
acattttaacatttctaaaatc

SEQ ID NO: 1371904 - DNA, 22 bp, Artificial Sequence
  chemically synthesized
taacatttctaaaatcaatatg

SEQ ID NO: 1371905 - DNA, 22 bp, Artificial Sequence
  chemically synthesized
atgattttaagacatattgatt

SEQ ID NO: 1371906 - DNA, 22 bp, Artificial Sequence
  chemically synthesized
aacatttctaaaatcaatatgt

SEQ ID NO: 1371907 - DNA, 22 bp, Artificial Sequence
  chemically synthesized
acatttctaaaatcaatatgtc

SEQ ID NO: 1371908 - DNA, 22 bp, Artificial Sequence
  chemically synthesized
tacactaatgattttaagacat

SEQ ID NO: 1371909 - DNA, 22 bp, Artificial Sequence
  chemically synthesized
ctaaaatcaatatgtcttaaaa

SEQ ID NO: 1371910 - DNA, 22 bp, Artificial Sequence
  chemically synthesized
taaaatcaatatgtcttaaaat

SEQ ID NO: 1371911 - DNA, 22 bp, Artificial Sequence
  chemically synthesized
aaatcaatatgtcttaaaatca

SEQ ID NO: 1371912 - DNA, 22 bp, Artificial Sequence
  chemically synthesized
aacgctatacactaatgatttt

SEQ ID NO: 1371913 - DNA, 22 bp, Artificial Sequence
  chemically synthesized
aaaatcattagtgtatagcgtt

SEQ ID NO: 1371914 - DNA, 22 bp, Artificial Sequence
  chemically synthesized
aaatcattagtgtatagcgttt

SEQ ID NO: 1371915 - DNA, 22 bp, Artificial Sequence
  chemically synthesized
aaaaacaggatacccctaaacg

SEQ ID NO: 1371916 - DNA, 22 bp, Artificial Sequence
  chemically synthesized
gtgtatagcgtttaggggtatc

SEQ ID NO: 1371917 - DNA, 22 bp, Artificial Sequence
  chemically synthesized
acaaattaaaaaacaggatacc

SEQ ID NO: 1371918 - DNA, 22 bp, Artificial Sequence
  chemically synthesized
aggggtatcctgttttttaatt

SEQ ID NO: 1371919 - DNA, 22 bp, Artificial Sequence
  chemically synthesized
ggggtatcctgttttttaattt

SEQ ID NO: 1371920 - DNA, 22 bp, Artificial Sequence
  chemically synthesized
tgtgtaggactaacaaattaaa

SEQ ID NO: 1371921 - DNA, 22 bp, Artificial Sequence
  chemically synthesized
ttgtgtgtaggactaacaaatt

SEQ ID NO: 1371922 - DNA, 22 bp, Artificial Sequence
  chemically synthesized
ttttttaatttgttagtcctac

SEQ ID NO: 1371923 - DNA, 22 bp, Artificial Sequence
  chemically synthesized
tttaatttgttagtcctacaca

SEQ ID NO: 1371924 - DNA, 22 bp, Artificial Sequence
  chemically synthesized
ttaatttgttagtcctacacac

SEQ ID NO: 1371925 - DNA, 22 bp, Artificial Sequence
  chemically synthesized
taatttgttagtcctacacaca

SEQ ID NO: 1371926 - DNA, 22 bp, Artificial Sequence
  chemically synthesized
aatttgttagtcctacacacaa

SEQ ID NO: 1371927 - DNA, 22 bp, Artificial Sequence
  chemically synthesized
atttgttagtcctacacacaac

SEQ ID NO: 1371928 - DNA, 22 bp, Artificial Sequence
  chemically synthesized
caagatagaccattgttgtgtg

SEQ ID NO: 1371929 - DNA, 22 bp, Artificial Sequence
  chemically synthesized
gttagtcctacacacaacaatg

SEQ ID NO: 1371930 - DNA, 22 bp, Artificial Sequence
  chemically synthesized
ttagtcctacacacaacaatgg

SEQ ID NO: 1371931 - DNA, 22 bp, Artificial Sequence
  chemically synthesized
gtcctacacacaacaatggtct

SEQ ID NO: 1371932 - DNA, 22 bp, Artificial Sequence
  chemically synthesized
cacacaacaatggtctatcttg

SEQ ID NO: 1371933 - DNA, 22 bp, Artificial Sequence
  chemically synthesized
agaaataataaattgcaagata

SEQ ID NO: 1371934 - DNA, 22 bp, Artificial Sequence
  chemically synthesized
aatctaagaaataataaattgc

SEQ ID NO: 1371935 - DNA, 22 bp, Artificial Sequence
  chemically synthesized
tcttgcaatttattatttctta

SEQ ID NO: 1371936 - DNA, 22 bp, Artificial Sequence
  chemically synthesized
tatgtcattgaatctaagaaat

SEQ ID NO: 1371937 - DNA, 22 bp, Artificial Sequence
  chemically synthesized
gcaatttattatttcttagatt

SEQ ID NO: 1371938 - DNA, 22 bp, Artificial Sequence
  chemically synthesized
caatttattatttcttagattc

SEQ ID NO: 1371939 - DNA, 22 bp, Artificial Sequence
  chemically synthesized
ctgtatgtcattgaatctaaga

SEQ ID NO: 1371940 - DNA, 22 bp, Artificial Sequence
  chemically synthesized
tattgctgtatgtcattgaatc

SEQ ID NO: 1371941 - DNA, 22 bp, Artificial Sequence
  chemically synthesized
attatttcttagattcaatgac

SEQ ID NO: 1371942 - DNA, 22 bp, Artificial Sequence
  chemically synthesized
ttatttcttagattcaatgaca

SEQ ID NO: 1371943 - DNA, 22 bp, Artificial Sequence
  chemically synthesized
tttcttagattcaatgacatac

SEQ ID NO: 1371944 - DNA, 22 bp, Artificial Sequence
  chemically synthesized
cttagattcaatgacatacagc

SEQ ID NO: 1371945 - DNA, 22 bp, Artificial Sequence
  chemically synthesized
ttagattcaatgacatacagca

SEQ ID NO: 1371946 - DNA, 22 bp, Artificial Sequence
  chemically synthesized
tgaaaactatattgctgtatgt

SEQ ID NO: 1371947 - DNA, 22 bp, Artificial Sequence
  chemically synthesized
agattcaatgacatacagcaat

SEQ ID NO: 1371948 - DNA, 22 bp, Artificial Sequence
  chemically synthesized
gattcaatgacatacagcaata

SEQ ID NO: 1371949 - DNA, 22 bp, Artificial Sequence
  chemically synthesized
ttgtgaaaactatattgctgta

SEQ ID NO: 1371950 - DNA, 22 bp, Artificial Sequence
  chemically synthesized
aatgacatacagcaatatagtt

SEQ ID NO: 1371951 - DNA, 22 bp, Artificial Sequence
  chemically synthesized
aactgttgtgaaaactatattg

SEQ ID NO: 1371952 - DNA, 22 bp, Artificial Sequence
  chemically synthesized
aatgattaaactgttgtgaaaa

SEQ ID NO: 1371953 - DNA, 22 bp, Artificial Sequence
  chemically synthesized
tcacaacagtttaatcatttag

SEQ ID NO: 1371954 - DNA, 22 bp, Artificial Sequence
  chemically synthesized
cacaacagtttaatcatttagg

SEQ ID NO: 1371955 - DNA, 22 bp, Artificial Sequence
  chemically synthesized
ataaaataagtccctaaatgat

SEQ ID NO: 1371956 - DNA, 22 bp, Artificial Sequence
  chemically synthesized
acaacagtttaatcatttaggg

SEQ ID NO: 1371957 - DNA, 22 bp, Artificial Sequence
  chemically synthesized
taaaatgttgataaaataagtc

SEQ ID NO: 1371958 - DNA, 22 bp, Artificial Sequence
  chemically synthesized
aatcatttagggacttatttta

SEQ ID NO: 1371959 - DNA, 22 bp, Artificial Sequence
  chemically synthesized
atcatttagggacttattttat

SEQ ID NO: 1371960 - DNA, 22 bp, Artificial Sequence
  chemically synthesized
agggacttattttatcaacatt

SEQ ID NO: 1371961 - DNA, 22 bp, Artificial Sequence
  chemically synthesized
tgacatctataaaatgttgata

SEQ ID NO: 1371962 - DNA, 22 bp, Artificial Sequence
  chemically synthesized
gggacttattttatcaacattt

SEQ ID NO: 1371963 - DNA, 22 bp, Artificial Sequence
  chemically synthesized
gattgtgacatctataaaatgt

SEQ ID NO: 1371964 - DNA, 22 bp, Artificial Sequence
  chemically synthesized
attttatcaacattttatagat

SEQ ID NO: 1371965 - DNA, 22 bp, Artificial Sequence
  chemically synthesized
ttttatcaacattttatagatg

SEQ ID NO: 1371966 - DNA, 22 bp, Artificial Sequence
  chemically synthesized
agactcgattgtgacatctata

SEQ ID NO: 1371967 - DNA, 22 bp, Artificial Sequence
  chemically synthesized
tatcaacattttatagatgtca

SEQ ID NO: 1371968 - DNA, 22 bp, Artificial Sequence
  chemically synthesized
atcaacattttatagatgtcac

SEQ ID NO: 1371969 - DNA, 22 bp, Artificial Sequence
  chemically synthesized
tgagactcgattgtgacatcta

SEQ ID NO: 1371970 - DNA, 22 bp, Artificial Sequence
  chemically synthesized
tcaacattttatagatgtcaca

SEQ ID NO: 1371971 - DNA, 22 bp, Artificial Sequence
  chemically synthesized
tatagatgtcacaatcgagtct

SEQ ID NO: 1371972 - DNA, 22 bp, Artificial Sequence
  chemically synthesized
atagatgtcacaatcgagtctc

SEQ ID NO: 1371973 - DNA, 22 bp, Artificial Sequence
  chemically synthesized
tagatgtcacaatcgagtctca

SEQ ID NO: 1371974 - DNA, 22 bp, Artificial Sequence
  chemically synthesized
ggtgtgtatcacctctgagact

SEQ ID NO: 1371975 - DNA, 22 bp, Artificial Sequence
  chemically synthesized
ctaggtgtgtatcacctctgag

SEQ ID NO: 1371976 - DNA, 22 bp, Artificial Sequence
  chemically synthesized
aggttgctaggtgtgtatcacc

SEQ ID NO: 1371977 - DNA, 22 bp, Artificial Sequence
  chemically synthesized
gaggttgctaggtgtgtatcac

SEQ ID NO: 1371978 - DNA, 22 bp, Artificial Sequence
  chemically synthesized
agaggtgatacacacctagcaa

SEQ ID NO: 1371979 - DNA, 22 bp, Artificial Sequence
  chemically synthesized
agcaaccttgaggttgctaggt

SEQ ID NO: 1371980 - DNA, 22 bp, Artificial Sequence
  chemically synthesized
gagcaaccttgaggttgctagg

SEQ ID NO: 1371981 - DNA, 22 bp, Artificial Sequence
  chemically synthesized
tgtgaccttgagcaaccttgag

SEQ ID NO: 1371982 - DNA, 22 bp, Artificial Sequence
  chemically synthesized
gctgtgtgaccttgagcaacct

SEQ ID NO: 1371983 - DNA, 22 bp, Artificial Sequence
  chemically synthesized
gcaacctcaaggttgctcaagg

SEQ ID NO: 1371984 - DNA, 22 bp, Artificial Sequence
  chemically synthesized
actagctgtgtgaccttgagca

SEQ ID NO: 1371985 - DNA, 22 bp, Artificial Sequence
  chemically synthesized
ccattgactagctgtgtgacct

SEQ ID NO: 1371986 - DNA, 22 bp, Artificial Sequence
  chemically synthesized
aaggttgctcaaggtcacacag

SEQ ID NO: 1371987 - DNA, 22 bp, Artificial Sequence
  chemically synthesized
aatctaccattgactagctgtg

SEQ ID NO: 1371988 - DNA, 22 bp, Artificial Sequence
  chemically synthesized
ctcaaggtcacacagctagtca

SEQ ID NO: 1371989 - DNA, 22 bp, Artificial Sequence
  chemically synthesized
aaggtcacacagctagtcaatg

SEQ ID NO: 1371990 - DNA, 22 bp, Artificial Sequence
  chemically synthesized
ggattaaatctaccattgacta

SEQ ID NO: 1371991 - DNA, 22 bp, Artificial Sequence
  chemically synthesized
tctgggattaaatctaccattg

SEQ ID NO: 1371992 - DNA, 22 bp, Artificial Sequence
  chemically synthesized
gtcaatggtagatttaatccca

SEQ ID NO: 1371993 - DNA, 22 bp, Artificial Sequence
  chemically synthesized
gatcaggctatctgggattaaa

SEQ ID NO: 1371994 - DNA, 22 bp, Artificial Sequence
  chemically synthesized
ggatcaggctatctgggattaa

SEQ ID NO: 1371995 - DNA, 22 bp, Artificial Sequence
  chemically synthesized
ttggatcaggctatctgggatt

SEQ ID NO: 1371996 - DNA, 22 bp, Artificial Sequence
  chemically synthesized
aatcccagatagcctgatccaa

SEQ ID NO: 1371997 - DNA, 22 bp, Artificial Sequence
  chemically synthesized
atcccagatagcctgatccaag

SEQ ID NO: 1371998 - DNA, 22 bp, Artificial Sequence
  chemically synthesized
agggtacaggctcttggatcag

SEQ ID NO: 1371999 - DNA, 22 bp, Artificial Sequence
  chemically synthesized
taagggtacaggctcttggatc

SEQ ID NO: 1372000 - DNA, 22 bp, Artificial Sequence
  chemically synthesized
tattctaagggtacaggctctt

SEQ ID NO: 1372001 - DNA, 22 bp, Artificial Sequence
  chemically synthesized
atccaagagcctgtacccttag

SEQ ID NO: 1372002 - DNA, 22 bp, Artificial Sequence
  chemically synthesized
ggaggagcagattatattctaa

SEQ ID NO: 1372003 - DNA, 22 bp, Artificial Sequence
  chemically synthesized
atctgggaggagcagattatat

SEQ ID NO: 1372004 - DNA, 22 bp, Artificial Sequence
  chemically synthesized
tacccttagaatataatctgct

SEQ ID NO: 1372005 - DNA, 22 bp, Artificial Sequence
  chemically synthesized
agaatataatctgctcctccca

SEQ ID NO: 1372006 - DNA, 22 bp, Artificial Sequence
  chemically synthesized
gaatataatctgctcctcccag

SEQ ID NO: 1372007 - DNA, 22 bp, Artificial Sequence
  chemically synthesized
ctcctcccagattagcgccatc

SEQ ID NO: 1372008 - DNA, 22 bp, Artificial Sequence
  chemically synthesized
ctcccagattagcgccatctcc

SEQ ID NO: 1372009 - DNA, 22 bp, Artificial Sequence
  chemically synthesized
atggggacccatgggagatggc

SEQ ID NO: 1372010 - DNA, 22 bp, Artificial Sequence
  chemically synthesized
ccagattagcgccatctcccat

SEQ ID NO: 1372011 - DNA, 22 bp, Artificial Sequence
  chemically synthesized
attaatggggacccatgggaga

SEQ ID NO: 1372012 - DNA, 22 bp, Artificial Sequence
  chemically synthesized
ctaattaatggggacccatggg

SEQ ID NO: 1372013 - DNA, 22 bp, Artificial Sequence
  chemically synthesized
gctaattaatggggacccatgg

SEQ ID NO: 1372014 - DNA, 22 bp, Artificial Sequence
  chemically synthesized
gcgccatctcccatgggtcccc

SEQ ID NO: 1372015 - DNA, 22 bp, Artificial Sequence
  chemically synthesized
tccttgctaattaatggggacc

SEQ ID NO: 1372016 - DNA, 22 bp, Artificial Sequence
  chemically synthesized
ggctgtccttgctaattaatgg

SEQ ID NO: 1372017 - DNA, 22 bp, Artificial Sequence
  chemically synthesized
ccatgggtccccattaattagc

SEQ ID NO: 1372018 - DNA, 22 bp, Artificial Sequence
  chemically synthesized
gattaggctgtccttgctaatt

SEQ ID NO: 1372019 - DNA, 22 bp, Artificial Sequence
  chemically synthesized
tgaattagattaggctgtcctt

SEQ ID NO: 1372020 - DNA, 22 bp, Artificial Sequence
  chemically synthesized
actatgaattagattaggctgt

SEQ ID NO: 1372021 - DNA, 22 bp, Artificial Sequence
  chemically synthesized
attagcaaggacagcctaatct

SEQ ID NO: 1372022 - DNA, 22 bp, Artificial Sequence
  chemically synthesized
ctcactatgaattagattaggc

SEQ ID NO: 1372023 - DNA, 22 bp, Artificial Sequence
  chemically synthesized
cctcactatgaattagattagg

SEQ ID NO: 1372024 - DNA, 22 bp, Artificial Sequence
  chemically synthesized
gcaaggacagcctaatctaatt

SEQ ID NO: 1372025 - DNA, 22 bp, Artificial Sequence
  chemically synthesized
ttcctcactatgaattagatta

SEQ ID NO: 1372026 - DNA, 22 bp, Artificial Sequence
  chemically synthesized
tcttcctcactatgaattagat

SEQ ID NO: 1372027 - DNA, 22 bp, Artificial Sequence
  chemically synthesized
ctcttcctcactatgaattaga

SEQ ID NO: 1372028 - DNA, 22 bp, Artificial Sequence
  chemically synthesized
gaaaatgtttctcttcctcact

SEQ ID NO: 1372029 - DNA, 22 bp, Artificial Sequence
  chemically synthesized
atctaattcatagtgaggaaga

SEQ ID NO: 1372030 - DNA, 22 bp, Artificial Sequence
  chemically synthesized
ggaaaatgtttctcttcctcac

SEQ ID NO: 1372031 - DNA, 22 bp, Artificial Sequence
  chemically synthesized
tggaaaatgtttctcttcctca

SEQ ID NO: 1372032 - DNA, 22 bp, Artificial Sequence
  chemically synthesized
attcatagtgaggaagagaaac

SEQ ID NO: 1372033 - DNA, 22 bp, Artificial Sequence
  chemically synthesized
caaactttggaaaatgtttctc

SEQ ID NO: 1372034 - DNA, 22 bp, Artificial Sequence
  chemically synthesized
atagtgaggaagagaaacattt

SEQ ID NO: 1372035 - DNA, 22 bp, Artificial Sequence
  chemically synthesized
gcaaactttggaaaatgtttct

SEQ ID NO: 1372036 - DNA, 22 bp, Artificial Sequence
  chemically synthesized
tgcaaactttggaaaatgtttc

SEQ ID NO: 1372037 - DNA, 22 bp, Artificial Sequence
  chemically synthesized
gcaagttttgcaaactttggaa

SEQ ID NO: 1372038 - DNA, 22 bp, Artificial Sequence
  chemically synthesized
ggcaagttttgcaaactttgga

SEQ ID NO: 1372039 - DNA, 22 bp, Artificial Sequence
  chemically synthesized
gccagcttggcaagttttgcaa

SEQ ID NO: 1372040 - DNA, 22 bp, Artificial Sequence
  chemically synthesized
tccaaagtttgcaaaacttgcc

SEQ ID NO: 1372041 - DNA, 22 bp, Artificial Sequence
  chemically synthesized
ccaaagtttgcaaaacttgcca

SEQ ID NO: 1372042 - DNA, 22 bp, Artificial Sequence
  chemically synthesized
caaagtttgcaaaacttgccaa

SEQ ID NO: 1372043 - DNA, 22 bp, Artificial Sequence
  chemically synthesized
gcaaaacttgccaagctggcca

SEQ ID NO: 1372044 - DNA, 22 bp, Artificial Sequence
  chemically synthesized
caaaacttgccaagctggccaa

SEQ ID NO: 1372045 - DNA, 22 bp, Artificial Sequence
  chemically synthesized
gccaagctggccaacttatatt

SEQ ID NO: 1372046 - DNA, 22 bp, Artificial Sequence
  chemically synthesized
ccaagctggccaacttatatta

SEQ ID NO: 1372047 - DNA, 22 bp, Artificial Sequence
  chemically synthesized
gccaacttatattattattatt

SEQ ID NO: 1372048 - DNA, 22 bp, Artificial Sequence
  chemically synthesized
atattattattattattattat

SEQ ID NO: 1372049 - DNA, 22 bp, Artificial Sequence
  chemically synthesized
tattattattattattattatt

SEQ ID NO: 1372050 - DNA, 22 bp, Artificial Sequence
  chemically synthesized
ataaaaaaaaaaaaaaataata

SEQ ID NO: 1372051 - DNA, 22 bp, Artificial Sequence
  chemically synthesized
ttattattattattattttttt

SEQ ID NO: 1372052 - DNA, 22 bp, Artificial Sequence
  chemically synthesized
ttattattattatttttttttt

SEQ ID NO: 1372053 - DNA, 22 bp, Artificial Sequence
  chemically synthesized
cgtctcataaaaaaaaaaaaaa

SEQ ID NO: 1372054 - DNA, 22 bp, Artificial Sequence
  chemically synthesized
ttattattattttttttttttt

SEQ ID NO: 1372055 - DNA, 22 bp, Artificial Sequence
  chemically synthesized
ttattattttttttttttttta

SEQ ID NO: 1372056 - DNA, 22 bp, Artificial Sequence
  chemically synthesized
ttatttttttttttttttatga

SEQ ID NO: 1372057 - DNA, 22 bp, Artificial Sequence
  chemically synthesized
agccagattccgtctcataaaa

SEQ ID NO: 1372058 - DNA, 22 bp, Artificial Sequence
  chemically synthesized
tttttttttttttttatgagac

SEQ ID NO: 1372059 - DNA, 22 bp, Artificial Sequence
  chemically synthesized
ttttttttttttatgagacgga

SEQ ID NO: 1372060 - DNA, 22 bp, Artificial Sequence
  chemically synthesized
tttttttttttatgagacggaa

SEQ ID NO: 1372061 - DNA, 22 bp, Artificial Sequence
  chemically synthesized
ttttttttttatgagacggaat

SEQ ID NO: 1372062 - DNA, 22 bp, Artificial Sequence
  chemically synthesized
tttttttttatgagacggaatc

SEQ ID NO: 1372063 - DNA, 22 bp, Artificial Sequence
  chemically synthesized
ttttttttatgagacggaatct

SEQ ID NO: 1372064 - DNA, 22 bp, Artificial Sequence
  chemically synthesized
gacgactgagccagattccgtc

SEQ ID NO: 1372065 - DNA, 22 bp, Artificial Sequence
  chemically synthesized
tttttttatgagacggaatctg

SEQ ID NO: 1372066 - DNA, 22 bp, Artificial Sequence
  chemically synthesized
ttttttatgagacggaatctgg

SEQ ID NO: 1372067 - DNA, 22 bp, Artificial Sequence
  chemically synthesized
tttttatgagacggaatctggc

SEQ ID NO: 1372068 - DNA, 22 bp, Artificial Sequence
  chemically synthesized
ttttatgagacggaatctggct

SEQ ID NO: 1372069 - DNA, 22 bp, Artificial Sequence
  chemically synthesized
tttatgagacggaatctggctc

SEQ ID NO: 1372070 - DNA, 22 bp, Artificial Sequence
  chemically synthesized
ttatgagacggaatctggctca

SEQ ID NO: 1372071 - DNA, 22 bp, Artificial Sequence
  chemically synthesized
tatgagacggaatctggctcag

SEQ ID NO: 1372072 - DNA, 22 bp, Artificial Sequence
  chemically synthesized
cagcctggacgactgagccaga

SEQ ID NO: 1372073 - DNA, 22 bp, Artificial Sequence
  chemically synthesized
atgagacggaatctggctcagt

SEQ ID NO: 1372074 - DNA, 22 bp, Artificial Sequence
  chemically synthesized
tgagacggaatctggctcagtc

SEQ ID NO: 1372075 - DNA, 22 bp, Artificial Sequence
  chemically synthesized
cactccagcctggacgactgag

SEQ ID NO: 1372076 - DNA, 22 bp, Artificial Sequence
  chemically synthesized
gctcagtcgtccaggctggagt

SEQ ID NO: 1372077 - DNA, 22 bp, Artificial Sequence
  chemically synthesized
agtcgtccaggctggagtgcag

SEQ ID NO: 1372078 - DNA, 22 bp, Artificial Sequence
  chemically synthesized
cagtgagccgagatcgcgccac

SEQ ID NO: 1372079 - DNA, 22 bp, Artificial Sequence
  chemically synthesized
gcagtgagccgagatcgcgcca

SEQ ID NO: 1372080 - DNA, 22 bp, Artificial Sequence
  chemically synthesized
gagtgcagtggcgcgatctcgg

SEQ ID NO: 1372081 - DNA, 22 bp, Artificial Sequence
  chemically synthesized
ggctcactgcaagctccgcctc

SEQ ID NO: 1372082 - DNA, 22 bp, Artificial Sequence
  chemically synthesized
actgcaagctccgcctcccggg

SEQ ID NO: 1372083 - DNA, 22 bp, Artificial Sequence
  chemically synthesized
caagctccgcctcccgggttca

SEQ ID NO: 1372084 - DNA, 22 bp, Artificial Sequence
  chemically synthesized
cgcctcccgggttcatgccatt

SEQ ID NO: 1372085 - DNA, 22 bp, Artificial Sequence
  chemically synthesized
ccgggttcatgccattctcctg

SEQ ID NO: 1372086 - DNA, 22 bp, Artificial Sequence
  chemically synthesized
aggaggcagaggcaggagaatg

SEQ ID NO: 1372087 - DNA, 22 bp, Artificial Sequence
  chemically synthesized
ctcaggaggcagaggcaggaga

SEQ ID NO: 1372088 - DNA, 22 bp, Artificial Sequence
  chemically synthesized
atgccattctcctgcctctgcc

SEQ ID NO: 1372089 - DNA, 22 bp, Artificial Sequence
  chemically synthesized
tggtcccagctactcaggaggc

SEQ ID NO: 1372090 - DNA, 22 bp, Artificial Sequence
  chemically synthesized
tcctgcctctgcctcctgagta

SEQ ID NO: 1372091 - DNA, 22 bp, Artificial Sequence
  chemically synthesized
ctgcctctgcctcctgagtagc

SEQ ID NO: 1372092 - DNA, 22 bp, Artificial Sequence
  chemically synthesized
cctctgcctcctgagtagctgg

SEQ ID NO: 1372093 - DNA, 22 bp, Artificial Sequence
  chemically synthesized
tgcctcctgagtagctgggacc

SEQ ID NO: 1372094 - DNA, 22 bp, Artificial Sequence
  chemically synthesized
cctcctgagtagctgggaccac

SEQ ID NO: 1372095 - DNA, 22 bp, Artificial Sequence
  chemically synthesized
ctgagtagctgggaccacaggc

SEQ ID NO: 1372096 - DNA, 22 bp, Artificial Sequence
  chemically synthesized
agtagctgggaccacaggcacc

SEQ ID NO: 1372097 - DNA, 22 bp, Artificial Sequence
  chemically synthesized
gccgggcgtggtggcaggtgcc

SEQ ID NO: 1372098 - DNA, 22 bp, Artificial Sequence
  chemically synthesized
ggaccacaggcacctgccacca

SEQ ID NO: 1372099 - DNA, 22 bp, Artificial Sequence
  chemically synthesized
aaaatacaaaaaaattagccgg

SEQ ID NO: 1372100 - DNA, 22 bp, Artificial Sequence
  chemically synthesized
ccaccacgcccggctaattttt

SEQ ID NO: 1372101 - DNA, 22 bp, Artificial Sequence
  chemically synthesized
ctaaaaatacaaaaaaattagc

SEQ ID NO: 1372102 - DNA, 22 bp, Artificial Sequence
  chemically synthesized
tactaaaaatacaaaaaaatta

SEQ ID NO: 1372103 - DNA, 22 bp, Artificial Sequence
  chemically synthesized
atttttttgtatttttagtaga

SEQ ID NO: 1372104 - DNA, 22 bp, Artificial Sequence
  chemically synthesized
ttttgtatttttagtagagatg

SEQ ID NO: 1372105 - DNA, 22 bp, Artificial Sequence
  chemically synthesized
tttgtatttttagtagagatgg

SEQ ID NO: 1372106 - DNA, 22 bp, Artificial Sequence
  chemically synthesized
ttgtatttttagtagagatggg

SEQ ID NO: 1372107 - DNA, 22 bp, Artificial Sequence
  chemically synthesized
acaaggtgaaaccccatctcta

SEQ ID NO: 1372108 - DNA, 22 bp, Artificial Sequence
  chemically synthesized
tgtatttttagtagagatgggg

SEQ ID NO: 1372109 - DNA, 22 bp, Artificial Sequence
  chemically synthesized
gtatttttagtagagatggggt

SEQ ID NO: 1372110 - DNA, 22 bp, Artificial Sequence
  chemically synthesized
tatttttagtagagatggggtt

SEQ ID NO: 1372111 - DNA, 22 bp, Artificial Sequence
  chemically synthesized
gctaacaaggtgaaaccccatc

SEQ ID NO: 1372112 - DNA, 22 bp, Artificial Sequence
  chemically synthesized
ttagtagagatggggtttcacc

SEQ ID NO: 1372113 - DNA, 22 bp, Artificial Sequence
  chemically synthesized
tagtagagatggggtttcacct

SEQ ID NO: 1372114 - DNA, 22 bp, Artificial Sequence
  chemically synthesized
agtagagatggggtttcacctt

SEQ ID NO: 1372115 - DNA, 22 bp, Artificial Sequence
  chemically synthesized
gtagagatggggtttcaccttg

SEQ ID NO: 1372116 - DNA, 22 bp, Artificial Sequence
  chemically synthesized
caccttgttagccaggatggtc

SEQ ID NO: 1372117 - DNA, 22 bp, Artificial Sequence
  chemically synthesized
accttgttagccaggatggtct

SEQ ID NO: 1372118 - DNA, 22 bp, Artificial Sequence
  chemically synthesized
gttagccaggatggtctcgatc

SEQ ID NO: 1372119 - DNA, 22 bp, Artificial Sequence
  chemically synthesized
ttagccaggatggtctcgatct

SEQ ID NO: 1372120 - DNA, 22 bp, Artificial Sequence
  chemically synthesized
gccaggatggtctcgatctcat

SEQ ID NO: 1372121 - DNA, 22 bp, Artificial Sequence
  chemically synthesized
gatctcatgacctcgtgatccg

SEQ ID NO: 1372122 - DNA, 22 bp, Artificial Sequence
  chemically synthesized
ggaggccgaggcgggcggatca

SEQ ID NO: 1372123 - DNA, 22 bp, Artificial Sequence
  chemically synthesized
gggaggccgaggcgggcggatc

SEQ ID NO: 1372124 - DNA, 22 bp, Artificial Sequence
  chemically synthesized
tgggaggccgaggcgggcggat

SEQ ID NO: 1372125 - DNA, 22 bp, Artificial Sequence
  chemically synthesized
atgacctcgtgatccgcccgcc

SEQ ID NO: 1372126 - DNA, 22 bp, Artificial Sequence
  chemically synthesized
gtgatccgcccgcctcggcctc

SEQ ID NO: 1372127 - DNA, 22 bp, Artificial Sequence
  chemically synthesized
taatcccagcactttgggaggc

SEQ ID NO: 1372128 - DNA, 22 bp, Artificial Sequence
  chemically synthesized
acacctgtaatcccagcacttt

SEQ ID NO: 1372129 - DNA, 22 bp, Artificial Sequence
  chemically synthesized
ggcctcccaaagtgctgggatt

SEQ ID NO: 1372130 - DNA, 22 bp, Artificial Sequence
  chemically synthesized
ccaaagtgctgggattacaggt

SEQ ID NO: 1372131 - DNA, 22 bp, Artificial Sequence
  chemically synthesized
ggattacaggtgtgagccactg

SEQ ID NO: 1372132 - DNA, 22 bp, Artificial Sequence
  chemically synthesized
taacggacaggcgcagtggctc

SEQ ID NO: 1372133 - DNA, 22 bp, Artificial Sequence
  chemically synthesized
caggtgtgagccactgcgcctg

SEQ ID NO: 1372134 - DNA, 22 bp, Artificial Sequence
  chemically synthesized
atactataacggacaggcgcag

SEQ ID NO: 1372135 - DNA, 22 bp, Artificial Sequence
  chemically synthesized
aatactataacggacaggcgca

SEQ ID NO: 1372136 - DNA, 22 bp, Artificial Sequence
  chemically synthesized
cttaatactataacggacaggc

SEQ ID NO: 1372137 - DNA, 22 bp, Artificial Sequence
  chemically synthesized
gcttaatactataacggacagg

SEQ ID NO: 1372138 - DNA, 22 bp, Artificial Sequence
  chemically synthesized
tgcttaatactataacggacag

SEQ ID NO: 1372139 - DNA, 22 bp, Artificial Sequence
  chemically synthesized
gttttgcttaatactataacgg

SEQ ID NO: 1372140 - DNA, 22 bp, Artificial Sequence
  chemically synthesized
cgcctgtccgttatagtattaa

SEQ ID NO: 1372141 - DNA, 22 bp, Artificial Sequence
  chemically synthesized
gcactcgttttgcttaatacta

SEQ ID NO: 1372142 - DNA, 22 bp, Artificial Sequence
  chemically synthesized
tccgttatagtattaagcaaaa

SEQ ID NO: 1372143 - DNA, 22 bp, Artificial Sequence
  chemically synthesized
tagtattaagcaaaacgagtgc

SEQ ID NO: 1372144 - DNA, 22 bp, Artificial Sequence
  chemically synthesized
agcaaaacgagtgccaatattt

SEQ ID NO: 1372145 - DNA, 22 bp, Artificial Sequence
  chemically synthesized
ggcttctccttccttttttttt

SEQ ID NO: 1372146 - DNA, 22 bp, Artificial Sequence
  chemically synthesized
gcttctccttcctttttttttt

SEQ ID NO: 1372147 - DNA, 22 bp, Artificial Sequence
  chemically synthesized
tcaaaaaaaaagaaaaaaaaaa

SEQ ID NO: 1372148 - DNA, 22 bp, Artificial Sequence
  chemically synthesized
gtcaaaaaaaaagaaaaaaaaa

SEQ ID NO: 1372149 - DNA, 22 bp, Artificial Sequence
  chemically synthesized
tgtcaaaaaaaaagaaaaaaaa

SEQ ID NO: 1372150 - DNA, 22 bp, Artificial Sequence
  chemically synthesized
ctccttcctttttttttttctt

SEQ ID NO: 1372151 - DNA, 22 bp, Artificial Sequence
  chemically synthesized
tccttcctttttttttttcttt

SEQ ID NO: 1372152 - DNA, 22 bp, Artificial Sequence
  chemically synthesized
cttcctttttttttttcttttt

SEQ ID NO: 1372153 - DNA, 22 bp, Artificial Sequence
  chemically synthesized
cctttttttttttctttttttt

SEQ ID NO: 1372154 - DNA, 22 bp, Artificial Sequence
  chemically synthesized
ctttttttttttcttttttttt

SEQ ID NO: 1372155 - DNA, 22 bp, Artificial Sequence
  chemically synthesized
tttttttttctttttttttgac

SEQ ID NO: 1372156 - DNA, 22 bp, Artificial Sequence
  chemically synthesized
ttttttttctttttttttgaca

SEQ ID NO: 1372157 - DNA, 22 bp, Artificial Sequence
  chemically synthesized
tttttttctttttttttgacaa

SEQ ID NO: 1372158 - DNA, 22 bp, Artificial Sequence
  chemically synthesized
ttttttctttttttttgacaaa

SEQ ID NO: 1372159 - DNA, 22 bp, Artificial Sequence
  chemically synthesized
tttttctttttttttgacaaag

SEQ ID NO: 1372160 - DNA, 22 bp, Artificial Sequence
  chemically synthesized
ttttctttttttttgacaaagt

SEQ ID NO: 1372161 - DNA, 22 bp, Artificial Sequence
  chemically synthesized
tttctttttttttgacaaagtt

SEQ ID NO: 1372162 - DNA, 22 bp, Artificial Sequence
  chemically synthesized
ttctttttttttgacaaagttt

SEQ ID NO: 1372163 - DNA, 22 bp, Artificial Sequence
  chemically synthesized
tctttttttttgacaaagtttc

SEQ ID NO: 1372164 - DNA, 22 bp, Artificial Sequence
  chemically synthesized
ggtgacaagagggaaactttgt

SEQ ID NO: 1372165 - DNA, 22 bp, Artificial Sequence
  chemically synthesized
ctttttttttgacaaagtttcc

SEQ ID NO: 1372166 - DNA, 22 bp, Artificial Sequence
  chemically synthesized
tttttttttgacaaagtttccc

SEQ ID NO: 1372167 - DNA, 22 bp, Artificial Sequence
  chemically synthesized
tttttttgacaaagtttccctc

SEQ ID NO: 1372168 - DNA, 22 bp, Artificial Sequence
  chemically synthesized
ttttttgacaaagtttccctct

SEQ ID NO: 1372169 - DNA, 22 bp, Artificial Sequence
  chemically synthesized
tttttgacaaagtttccctctt

SEQ ID NO: 1372170 - DNA, 22 bp, Artificial Sequence
  chemically synthesized
ttttgacaaagtttccctcttg

SEQ ID NO: 1372171 - DNA, 22 bp, Artificial Sequence
  chemically synthesized
cagcctaggtgacaagagggaa

SEQ ID NO: 1372172 - DNA, 22 bp, Artificial Sequence
  chemically synthesized
tttgacaaagtttccctcttgt

SEQ ID NO: 1372173 - DNA, 22 bp, Artificial Sequence
  chemically synthesized
ttgacaaagtttccctcttgtc

SEQ ID NO: 1372174 - DNA, 22 bp, Artificial Sequence
  chemically synthesized
tgacaaagtttccctcttgtca

SEQ ID NO: 1372175 - DNA, 22 bp, Artificial Sequence
  chemically synthesized
gacaaagtttccctcttgtcac

SEQ ID NO: 1372176 - DNA, 22 bp, Artificial Sequence
  chemically synthesized
acaaagtttccctcttgtcacc

SEQ ID NO: 1372177 - DNA, 22 bp, Artificial Sequence
  chemically synthesized
cactccagcctaggtgacaaga

SEQ ID NO: 1372178 - DNA, 22 bp, Artificial Sequence
  chemically synthesized
ccctcttgtcacctaggctgga

SEQ ID NO: 1372179 - DNA, 22 bp, Artificial Sequence
  chemically synthesized
cctcttgtcacctaggctggag

SEQ ID NO: 1372180 - DNA, 22 bp, Artificial Sequence
  chemically synthesized
ttgtcacctaggctggagtgca

SEQ ID NO: 1372181 - DNA, 22 bp, Artificial Sequence
  chemically synthesized
gtcacctaggctggagtgcaat

SEQ ID NO: 1372182 - DNA, 22 bp, Artificial Sequence
  chemically synthesized
tcacctaggctggagtgcaatg

SEQ ID NO: 1372183 - DNA, 22 bp, Artificial Sequence
  chemically synthesized
ggctggagtgcaatggcgcgat

SEQ ID NO: 1372184 - DNA, 22 bp, Artificial Sequence
  chemically synthesized
cagtgagccgagatcgcgccat

SEQ ID NO: 1372185 - DNA, 22 bp, Artificial Sequence
  chemically synthesized
gagtgcaatggcgcgatctcgg

SEQ ID NO: 1372186 - DNA, 22 bp, Artificial Sequence
  chemically synthesized
aggttgcagtgagccgagatcg

SEQ ID NO: 1372187 - DNA, 22 bp, Artificial Sequence
  chemically synthesized
gaaggctgaggttgcagtgagc

SEQ ID NO: 1372188 - DNA, 22 bp, Artificial Sequence
  chemically synthesized
gaacctggaaggctgaggttgc

SEQ ID NO: 1372189 - DNA, 22 bp, Artificial Sequence
  chemically synthesized
ggctcactgcaacctcagcctt

SEQ ID NO: 1372190 - DNA, 22 bp, Artificial Sequence
  chemically synthesized
actgcaacctcagccttccagg

SEQ ID NO: 1372191 - DNA, 22 bp, Artificial Sequence
  chemically synthesized
caacctcagccttccaggttct

SEQ ID NO: 1372192 - DNA, 22 bp, Artificial Sequence
  chemically synthesized
aggcaggagaatcactagaacc

SEQ ID NO: 1372193 - DNA, 22 bp, Artificial Sequence
  chemically synthesized
agccttccaggttctagtgatt

SEQ ID NO: 1372194 - DNA, 22 bp, Artificial Sequence
  chemically synthesized
agaggctgaggcaggagaatca

SEQ ID NO: 1372195 - DNA, 22 bp, Artificial Sequence
  chemically synthesized
ccaggttctagtgattctcctg

SEQ ID NO: 1372196 - DNA, 22 bp, Artificial Sequence
  chemically synthesized
gagaggctgaggcaggagaatc

SEQ ID NO: 1372197 - DNA, 22 bp, Artificial Sequence
  chemically synthesized
caggttctagtgattctcctgc

SEQ ID NO: 1372198 - DNA, 22 bp, Artificial Sequence
  chemically synthesized
cttgagaggctgaggcaggaga

SEQ ID NO: 1372199 - DNA, 22 bp, Artificial Sequence
  chemically synthesized
tagtgattctcctgcctcagcc

SEQ ID NO: 1372200 - DNA, 22 bp, Artificial Sequence
  chemically synthesized
gtgattctcctgcctcagcctc

SEQ ID NO: 1372201 - DNA, 22 bp, Artificial Sequence
  chemically synthesized
taatcccagctacttgagaggc

SEQ ID NO: 1372202 - DNA, 22 bp, Artificial Sequence
  chemically synthesized
tcctgcctcagcctctcaagta

SEQ ID NO: 1372203 - DNA, 22 bp, Artificial Sequence
  chemically synthesized
ctgcctcagcctctcaagtagc

SEQ ID NO: 1372204 - DNA, 22 bp, Artificial Sequence
  chemically synthesized
cctcagcctctcaagtagctgg

SEQ ID NO: 1372205 - DNA, 22 bp, Artificial Sequence
  chemically synthesized
agcctctcaagtagctgggatt

SEQ ID NO: 1372206 - DNA, 22 bp, Artificial Sequence
  chemically synthesized
tcaagtagctgggattacaggc

SEQ ID NO: 1372207 - DNA, 22 bp, Artificial Sequence
  chemically synthesized
aagtagctgggattacaggcat

SEQ ID NO: 1372208 - DNA, 22 bp, Artificial Sequence
  chemically synthesized
ggtgtggtggtgcatgcctgta

SEQ ID NO: 1372209 - DNA, 22 bp, Artificial Sequence
  chemically synthesized
gctgggtgtggtggtgcatgcc

SEQ ID NO: 1372210 - DNA, 22 bp, Artificial Sequence
  chemically synthesized
ggattacaggcatgcaccacca

SEQ ID NO: 1372211 - DNA, 22 bp, Artificial Sequence
  chemically synthesized
caggcatgcaccaccacaccca

SEQ ID NO: 1372212 - DNA, 22 bp, Artificial Sequence
  chemically synthesized
aaaatacaacaattagctgggt

SEQ ID NO: 1372213 - DNA, 22 bp, Artificial Sequence
  chemically synthesized
tactaaaaatacaacaattagc

SEQ ID NO: 1372214 - DNA, 22 bp, Artificial Sequence
  chemically synthesized
attgttgtatttttagtacaga

SEQ ID NO: 1372215 - DNA, 22 bp, Artificial Sequence
  chemically synthesized
ttgtatttttagtacagatggg

SEQ ID NO: 1372216 - DNA, 22 bp, Artificial Sequence
  chemically synthesized
tatttttagtacagatggggtt

SEQ ID NO: 1372217 - DNA, 22 bp, Artificial Sequence
  chemically synthesized
gccaacatggtgaaaccccatc

SEQ ID NO: 1372218 - DNA, 22 bp, Artificial Sequence
  chemically synthesized
ttagtacagatggggtttcacc

SEQ ID NO: 1372219 - DNA, 22 bp, Artificial Sequence
  chemically synthesized
tagtacagatggggtttcacca

SEQ ID NO: 1372220 - DNA, 22 bp, Artificial Sequence
  chemically synthesized
agtacagatggggtttcaccat

SEQ ID NO: 1372221 - DNA, 22 bp, Artificial Sequence
  chemically synthesized
gtacagatggggtttcaccatg

SEQ ID NO: 1372222 - DNA, 22 bp, Artificial Sequence
  chemically synthesized
aagaccagcctggccaacatgg

SEQ ID NO: 1372223 - DNA, 22 bp, Artificial Sequence
  chemically synthesized
caccatgttggccaggctggtc

SEQ ID NO: 1372224 - DNA, 22 bp, Artificial Sequence
  chemically synthesized
accatgttggccaggctggtct

SEQ ID NO: 1372225 - DNA, 22 bp, Artificial Sequence
  chemically synthesized
agatcaggagttcaagaccagc

SEQ ID NO: 1372226 - DNA, 22 bp, Artificial Sequence
  chemically synthesized
gagatcaggagttcaagaccag

SEQ ID NO: 1372227 - DNA, 22 bp, Artificial Sequence
  chemically synthesized
gccaggctggtcttgaactcct

SEQ ID NO: 1372228 - DNA, 22 bp, Artificial Sequence
  chemically synthesized
ggtgggtcacttgagatcagga

SEQ ID NO: 1372229 - DNA, 22 bp, Artificial Sequence
  chemically synthesized
gtcttgaactcctgatctcaag

SEQ ID NO: 1372230 - DNA, 22 bp, Artificial Sequence
  chemically synthesized
gaactcctgatctcaagtgacc

SEQ ID NO: 1372231 - DNA, 22 bp, Artificial Sequence
  chemically synthesized
aactcctgatctcaagtgaccc

SEQ ID NO: 1372232 - DNA, 22 bp, Artificial Sequence
  chemically synthesized
ggaggccaagttgggtgggtca

SEQ ID NO: 1372233 - DNA, 22 bp, Artificial Sequence
  chemically synthesized
ctgatctcaagtgacccaccca

SEQ ID NO: 1372234 - DNA, 22 bp, Artificial Sequence
  chemically synthesized
gggaggccaagttgggtgggtc

SEQ ID NO: 1372235 - DNA, 22 bp, Artificial Sequence
  chemically synthesized
atctcaagtgacccacccaact

SEQ ID NO: 1372236 - DNA, 22 bp, Artificial Sequence
  chemically synthesized
aagtgacccacccaacttggcc

SEQ ID NO: 1372237 - DNA, 22 bp, Artificial Sequence
  chemically synthesized
taatcccagaagtttgggaggc

SEQ ID NO: 1372238 - DNA, 22 bp, Artificial Sequence
  chemically synthesized
acacctgtaatcccagaagttt

SEQ ID NO: 1372239 - DNA, 22 bp, Artificial Sequence
  chemically synthesized
ggcctcccaaacttctgggatt

SEQ ID NO: 1372240 - DNA, 22 bp, Artificial Sequence
  chemically synthesized
gcctcccaaacttctgggatta

SEQ ID NO: 1372241 - DNA, 22 bp, Artificial Sequence
  chemically synthesized
ccaaacttctgggattacaggt

SEQ ID NO: 1372242 - DNA, 22 bp, Artificial Sequence
  chemically synthesized
ctgggattacaggtgtgagcca

SEQ ID NO: 1372243 - DNA, 22 bp, Artificial Sequence
  chemically synthesized
tgggattacaggtgtgagccac

SEQ ID NO: 1372244 - DNA, 22 bp, Artificial Sequence
  chemically synthesized
ggattacaggtgtgagccaccg

SEQ ID NO: 1372245 - DNA, 22 bp, Artificial Sequence
  chemically synthesized
caggtgtgagccaccgcgtccg

SEQ ID NO: 1372246 - DNA, 22 bp, Artificial Sequence
  chemically synthesized
aaagaggaaggagagtccggac

SEQ ID NO: 1372247 - DNA, 22 bp, Artificial Sequence
  chemically synthesized
gaaagaggaaggagagtccgga

SEQ ID NO: 1372248 - DNA, 22 bp, Artificial Sequence
  chemically synthesized
tccttcctctttcaagttgttt

SEQ ID NO: 1372249 - DNA, 22 bp, Artificial Sequence
  chemically synthesized
cttcctctttcaagttgtttcc

SEQ ID NO: 1372250 - DNA, 22 bp, Artificial Sequence
  chemically synthesized
cctctttcaagttgtttcctgg

SEQ ID NO: 1372251 - DNA, 22 bp, Artificial Sequence
  chemically synthesized
ctctttcaagttgtttcctggg

SEQ ID NO: 1372252 - DNA, 22 bp, Artificial Sequence
  chemically synthesized
tttcaagttgtttcctgggtgt

SEQ ID NO: 1372253 - DNA, 22 bp, Artificial Sequence
  chemically synthesized
cccaccacaccccacacccagg

SEQ ID NO: 1372254 - DNA, 22 bp, Artificial Sequence
  chemically synthesized
tcaagttgtttcctgggtgtgg

SEQ ID NO: 1372255 - DNA, 22 bp, Artificial Sequence
  chemically synthesized
caagttgtttcctgggtgtggg

SEQ ID NO: 1372256 - DNA, 22 bp, Artificial Sequence
  chemically synthesized
aagttgtttcctgggtgtgggg

SEQ ID NO: 1372257 - DNA, 22 bp, Artificial Sequence
  chemically synthesized
ttccccaccacaccccacaccc

SEQ ID NO: 1372258 - DNA, 22 bp, Artificial Sequence
  chemically synthesized
tgttccccaccacaccccacac

SEQ ID NO: 1372259 - DNA, 22 bp, Artificial Sequence
  chemically synthesized
tttcctgggtgtggggtgtggt

SEQ ID NO: 1372260 - DNA, 22 bp, Artificial Sequence
  chemically synthesized
cgcctctgttccccaccacacc

SEQ ID NO: 1372261 - DNA, 22 bp, Artificial Sequence
  chemically synthesized
cctgggtgtggggtgtggtggg

SEQ ID NO: 1372262 - DNA, 22 bp, Artificial Sequence
  chemically synthesized
acgcctctgttccccaccacac

SEQ ID NO: 1372263 - DNA, 22 bp, Artificial Sequence
  chemically synthesized
ctgggtgtggggtgtggtgggg

SEQ ID NO: 1372264 - DNA, 22 bp, Artificial Sequence
  chemically synthesized
tttacgcctctgttccccacca

SEQ ID NO: 1372265 - DNA, 22 bp, Artificial Sequence
  chemically synthesized
ggtgtggggtgtggtggggaac

SEQ ID NO: 1372266 - DNA, 22 bp, Artificial Sequence
  chemically synthesized
ctatttacgcctctgttcccca

SEQ ID NO: 1372267 - DNA, 22 bp, Artificial Sequence
  chemically synthesized
taaaggacctgctatttacgcc

SEQ ID NO: 1372268 - DNA, 22 bp, Artificial Sequence
  chemically synthesized
tgtaaaggacctgctatttacg

SEQ ID NO: 1372269 - DNA, 22 bp, Artificial Sequence
  chemically synthesized
tggtaggtggttctgtaaagga

SEQ ID NO: 1372270 - DNA, 22 bp, Artificial Sequence
  chemically synthesized
gtggtaggtggttctgtaaagg

SEQ ID NO: 1372271 - DNA, 22 bp, Artificial Sequence
  chemically synthesized
tgtggtaggtggttctgtaaag

SEQ ID NO: 1372272 - DNA, 22 bp, Artificial Sequence
  chemically synthesized
tacagaaccacctaccacaaag

SEQ ID NO: 1372273 - DNA, 22 bp, Artificial Sequence
  chemically synthesized
acagaaccacctaccacaaaga

SEQ ID NO: 1372274 - DNA, 22 bp, Artificial Sequence
  chemically synthesized
cagaaccacctaccacaaagat

SEQ ID NO: 1372275 - DNA, 22 bp, Artificial Sequence
  chemically synthesized
tgtaggcaaagtgtagtcatct

SEQ ID NO: 1372276 - DNA, 22 bp, Artificial Sequence
  chemically synthesized
gtgtaggcaaagtgtagtcatc

SEQ ID NO: 1372277 - DNA, 22 bp, Artificial Sequence
  chemically synthesized
tgtgtaggcaaagtgtagtcat

SEQ ID NO: 1372278 - DNA, 22 bp, Artificial Sequence
  chemically synthesized
ttgtgtaggcaaagtgtagtca

SEQ ID NO: 1372279 - DNA, 22 bp, Artificial Sequence
  chemically synthesized
tttgtgtaggcaaagtgtagtc

SEQ ID NO: 1372280 - DNA, 22 bp, Artificial Sequence
  chemically synthesized
ccacaaagatgactacactttg

SEQ ID NO: 1372281 - DNA, 22 bp, Artificial Sequence
  chemically synthesized
ccagctttttgtgtaggcaaag

SEQ ID NO: 1372282 - DNA, 22 bp, Artificial Sequence
  chemically synthesized
tgccagctttttgtgtaggcaa

SEQ ID NO: 1372283 - DNA, 22 bp, Artificial Sequence
  chemically synthesized
ctgccagctttttgtgtaggca

SEQ ID NO: 1372284 - DNA, 22 bp, Artificial Sequence
  chemically synthesized
cactttgcctacacaaaaagct

SEQ ID NO: 1372285 - DNA, 22 bp, Artificial Sequence
  chemically synthesized
tgcctacacaaaaagctggcag

SEQ ID NO: 1372286 - DNA, 22 bp, Artificial Sequence
  chemically synthesized
gcctacacaaaaagctggcaga

SEQ ID NO: 1372287 - DNA, 22 bp, Artificial Sequence
  chemically synthesized
cctacacaaaaagctggcagaa

SEQ ID NO: 1372288 - DNA, 22 bp, Artificial Sequence
  chemically synthesized
cacaaaaagctggcagaagctt

SEQ ID NO: 1372289 - DNA, 22 bp, Artificial Sequence
  chemically synthesized
caaaataaagcaaaaagcttct

SEQ ID NO: 1372290 - DNA, 22 bp, Artificial Sequence
  chemically synthesized
gcagaagctttttgctttattt

SEQ ID NO: 1372291 - DNA, 22 bp, Artificial Sequence
  chemically synthesized
ataaggcctccaaaataaagca

SEQ ID NO: 1372292 - DNA, 22 bp, Artificial Sequence
  chemically synthesized
gataaggcctccaaaataaagc

SEQ ID NO: 1372293 - DNA, 22 bp, Artificial Sequence
  chemically synthesized
gtgtttgataaggcctccaaaa

SEQ ID NO: 1372294 - DNA, 22 bp, Artificial Sequence
  chemically synthesized
tttgctttattttggaggcctt

SEQ ID NO: 1372295 - DNA, 22 bp, Artificial Sequence
  chemically synthesized
ttgctttattttggaggcctta

SEQ ID NO: 1372296 - DNA, 22 bp, Artificial Sequence
  chemically synthesized
tgctttattttggaggccttat

SEQ ID NO: 1372297 - DNA, 22 bp, Artificial Sequence
  chemically synthesized
ccctggtgtttgataaggcctc

SEQ ID NO: 1372298 - DNA, 22 bp, Artificial Sequence
  chemically synthesized
gctttattttggaggccttatc

SEQ ID NO: 1372299 - DNA, 22 bp, Artificial Sequence
  chemically synthesized
ctttattttggaggccttatca

SEQ ID NO: 1372300 - DNA, 22 bp, Artificial Sequence
  chemically synthesized
tgccctggtgtttgataaggcc

SEQ ID NO: 1372301 - DNA, 22 bp, Artificial Sequence
  chemically synthesized
tattttggaggccttatcaaac

SEQ ID NO: 1372302 - DNA, 22 bp, Artificial Sequence
  chemically synthesized
attttggaggccttatcaaaca

SEQ ID NO: 1372303 - DNA, 22 bp, Artificial Sequence
  chemically synthesized
ttttggaggccttatcaaacac

SEQ ID NO: 1372304 - DNA, 22 bp, Artificial Sequence
  chemically synthesized
tggaggccttatcaaacaccag

SEQ ID NO: 1372305 - DNA, 22 bp, Artificial Sequence
  chemically synthesized
ggaggccttatcaaacaccagg

SEQ ID NO: 1372306 - DNA, 22 bp, Artificial Sequence
  chemically synthesized
gaggccttatcaaacaccaggg

SEQ ID NO: 1372307 - DNA, 22 bp, Artificial Sequence
  chemically synthesized
cagatcattctgccctggtgtt

SEQ ID NO: 1372308 - DNA, 22 bp, Artificial Sequence
  chemically synthesized
atcaaacaccagggcagaatga

SEQ ID NO: 1372309 - DNA, 22 bp, Artificial Sequence
  chemically synthesized
agagattacagatcattctgcc

SEQ ID NO: 1372310 - DNA, 22 bp, Artificial Sequence
  chemically synthesized
tcaaacaccagggcagaatgat

SEQ ID NO: 1372311 - DNA, 22 bp, Artificial Sequence
  chemically synthesized
acctcagagattacagatcatt

SEQ ID NO: 1372312 - DNA, 22 bp, Artificial Sequence
  chemically synthesized
tcacctcagagattacagatca

SEQ ID NO: 1372313 - DNA, 22 bp, Artificial Sequence
  chemically synthesized
ctcacctcagagattacagatc

SEQ ID NO: 1372314 - DNA, 22 bp, Artificial Sequence
  chemically synthesized
gcttctcacctcagagattaca

SEQ ID NO: 1372315 - DNA, 22 bp, Artificial Sequence
  chemically synthesized
actagcttctcacctcagagat

SEQ ID NO: 1372316 - DNA, 22 bp, Artificial Sequence
  chemically synthesized
atcctcactagcttctcacctc

SEQ ID NO: 1372317 - DNA, 22 bp, Artificial Sequence
  chemically synthesized
taatctctgaggtgagaagcta

SEQ ID NO: 1372318 - DNA, 22 bp, Artificial Sequence
  chemically synthesized
tgaggtgagaagctagtgagga

SEQ ID NO: 1372319 - DNA, 22 bp, Artificial Sequence
  chemically synthesized
aggtgagaagctagtgaggatt

SEQ ID NO: 1372320 - DNA, 22 bp, Artificial Sequence
  chemically synthesized
ggagagaaaagtggttaatcct

SEQ ID NO: 1372321 - DNA, 22 bp, Artificial Sequence
  chemically synthesized
ctaggagagaaaagtggttaat

SEQ ID NO: 1372322 - DNA, 22 bp, Artificial Sequence
  chemically synthesized
gctaggagagaaaagtggttaa

SEQ ID NO: 1372323 - DNA, 22 bp, Artificial Sequence
  chemically synthesized
tgctaggagagaaaagtggtta

SEQ ID NO: 1372324 - DNA, 22 bp, Artificial Sequence
  chemically synthesized
ttgctaggagagaaaagtggtt

SEQ ID NO: 1372325 - DNA, 22 bp, Artificial Sequence
  chemically synthesized
gtgaggattaaccacttttctc

SEQ ID NO: 1372326 - DNA, 22 bp, Artificial Sequence
  chemically synthesized
ggagtttttgctaggagagaaa

SEQ ID NO: 1372327 - DNA, 22 bp, Artificial Sequence
  chemically synthesized
gggagtttttgctaggagagaa

SEQ ID NO: 1372328 - DNA, 22 bp, Artificial Sequence
  chemically synthesized
accacttttctctcctagcaaa

SEQ ID NO: 1372329 - DNA, 22 bp, Artificial Sequence
  chemically synthesized
accatttgggagtttttgctag

SEQ ID NO: 1372330 - DNA, 22 bp, Artificial Sequence
  chemically synthesized
ttctctcctagcaaaaactccc

SEQ ID NO: 1372331 - DNA, 22 bp, Artificial Sequence
  chemically synthesized
gcctcaccatttgggagttttt

SEQ ID NO: 1372332 - DNA, 22 bp, Artificial Sequence
  chemically synthesized
tctctcctagcaaaaactccca

SEQ ID NO: 1372333 - DNA, 22 bp, Artificial Sequence
  chemically synthesized
ctctcctagcaaaaactcccaa

SEQ ID NO: 1372334 - DNA, 22 bp, Artificial Sequence
  chemically synthesized
tctcctagcaaaaactcccaaa

SEQ ID NO: 1372335 - DNA, 22 bp, Artificial Sequence
  chemically synthesized
tcctagcaaaaactcccaaatg

SEQ ID NO: 1372336 - DNA, 22 bp, Artificial Sequence
  chemically synthesized
ctagcaaaaactcccaaatggt

SEQ ID NO: 1372337 - DNA, 22 bp, Artificial Sequence
  chemically synthesized
cccactagcctcaccatttggg

SEQ ID NO: 1372338 - DNA, 22 bp, Artificial Sequence
  chemically synthesized
ccccactagcctcaccatttgg

SEQ ID NO: 1372339 - DNA, 22 bp, Artificial Sequence
  chemically synthesized
gcaaaaactcccaaatggtgag

SEQ ID NO: 1372340 - DNA, 22 bp, Artificial Sequence
  chemically synthesized
ccaaatggtgaggctagtgggg

SEQ ID NO: 1372341 - DNA, 22 bp, Artificial Sequence
  chemically synthesized
ccacccggtccttccccactag

SEQ ID NO: 1372342 - DNA, 22 bp, Artificial Sequence
  chemically synthesized
gtggggaaggaccgggtggtag

SEQ ID NO: 1372343 - DNA, 22 bp, Artificial Sequence
  chemically synthesized
gaagaacaataacactaccacc

SEQ ID NO: 1372344 - DNA, 22 bp, Artificial Sequence
  chemically synthesized
caaatacatgtaactggaagaa

SEQ ID NO: 1372345 - DNA, 22 bp, Artificial Sequence
  chemically synthesized
ttgttcttccagttacatgtat

SEQ ID NO: 1372346 - DNA, 22 bp, Artificial Sequence
  chemically synthesized
aataatattacaaatacatgta

SEQ ID NO: 1372347 - DNA, 22 bp, Artificial Sequence
  chemically synthesized
ttcttccagttacatgtatttg

SEQ ID NO: 1372348 - DNA, 22 bp, Artificial Sequence
  chemically synthesized
ttccagttacatgtatttgtaa

SEQ ID NO: 1372349 - DNA, 22 bp, Artificial Sequence
  chemically synthesized
ccagttacatgtatttgtaata

SEQ ID NO: 1372350 - DNA, 22 bp, Artificial Sequence
  chemically synthesized
cagttacatgtatttgtaatat

SEQ ID NO: 1372351 - DNA, 22 bp, Artificial Sequence
  chemically synthesized
catgtatttgtaatattattca

SEQ ID NO: 1372352 - DNA, 22 bp, Artificial Sequence
  chemically synthesized
atagataaggtacattgaataa

SEQ ID NO: 1372353 - DNA, 22 bp, Artificial Sequence
  chemically synthesized
gtaatattattcaatgtacctt

SEQ ID NO: 1372354 - DNA, 22 bp, Artificial Sequence
  chemically synthesized
taatattattcaatgtacctta

SEQ ID NO: 1372355 - DNA, 22 bp, Artificial Sequence
  chemically synthesized
ttcaatgtaccttatctattaa

SEQ ID NO: 1372356 - DNA, 22 bp, Artificial Sequence
  chemically synthesized
aatgtaccttatctattaatta

SEQ ID NO: 1372357 - DNA, 22 bp, Artificial Sequence
  chemically synthesized
ataaaatatacataattaatag

SEQ ID NO: 1372358 - DNA, 22 bp, Artificial Sequence
  chemically synthesized
atctattaattatgtatatttt

SEQ ID NO: 1372359 - DNA, 22 bp, Artificial Sequence
  chemically synthesized
tctattaattatgtatatttta

SEQ ID NO: 1372360 - DNA, 22 bp, Artificial Sequence
  chemically synthesized
ttaattatgtatattttatcag

SEQ ID NO: 1372361 - DNA, 22 bp, Artificial Sequence
  chemically synthesized
gatggggaatgagctgataaaa

SEQ ID NO: 1372362 - DNA, 22 bp, Artificial Sequence
  chemically synthesized
attatgtatattttatcagctc

SEQ ID NO: 1372363 - DNA, 22 bp, Artificial Sequence
  chemically synthesized
tgtatattttatcagctcattc

SEQ ID NO: 1372364 - DNA, 22 bp, Artificial Sequence
  chemically synthesized
tcacagttggatggggaatgag

SEQ ID NO: 1372365 - DNA, 22 bp, Artificial Sequence
  chemically synthesized
tgtcacagttggatggggaatg

SEQ ID NO: 1372366 - DNA, 22 bp, Artificial Sequence
  chemically synthesized
tatcagctcattccccatccaa

SEQ ID NO: 1372367 - DNA, 22 bp, Artificial Sequence
  chemically synthesized
cctctgtcacagttggatgggg

SEQ ID NO: 1372368 - DNA, 22 bp, Artificial Sequence
  chemically synthesized
atcagctcattccccatccaac

SEQ ID NO: 1372369 - DNA, 22 bp, Artificial Sequence
  chemically synthesized
ccctctgtcacagttggatggg

SEQ ID NO: 1372370 - DNA, 22 bp, Artificial Sequence
  chemically synthesized
tcagctcattccccatccaact

SEQ ID NO: 1372371 - DNA, 22 bp, Artificial Sequence
  chemically synthesized
attccccatccaactgtgacag

SEQ ID NO: 1372372 - DNA, 22 bp, Artificial Sequence
  chemically synthesized
tgtcacacttccctctgtcaca

SEQ ID NO: 1372373 - DNA, 22 bp, Artificial Sequence
  chemically synthesized
gtgtcacacttccctctgtcac

SEQ ID NO: 1372374 - DNA, 22 bp, Artificial Sequence
  chemically synthesized
cccatccaactgtgacagaggg

SEQ ID NO: 1372375 - DNA, 22 bp, Artificial Sequence
  chemically synthesized
ttgtgtcacacttccctctgtc

SEQ ID NO: 1372376 - DNA, 22 bp, Artificial Sequence
  chemically synthesized
cttgtgtcacacttccctctgt

SEQ ID NO: 1372377 - DNA, 22 bp, Artificial Sequence
  chemically synthesized
cttcttgtgtcacacttccctc

SEQ ID NO: 1372378 - DNA, 22 bp, Artificial Sequence
  chemically synthesized
tgacagagggaagtgtgacaca

SEQ ID NO: 1372379 - DNA, 22 bp, Artificial Sequence
  chemically synthesized
atcactacttcttgtgtcacac

SEQ ID NO: 1372380 - DNA, 22 bp, Artificial Sequence
  chemically synthesized
aatcactacttcttgtgtcaca

SEQ ID NO: 1372381 - DNA, 22 bp, Artificial Sequence
  chemically synthesized
agatatttaatcactacttctt

SEQ ID NO: 1372382 - DNA, 22 bp, Artificial Sequence
  chemically synthesized
gatgcatgaacatgttgagata

SEQ ID NO: 1372383 - DNA, 22 bp, Artificial Sequence
  chemically synthesized
gctggatgcatgaacatgttga

SEQ ID NO: 1372384 - DNA, 22 bp, Artificial Sequence
  chemically synthesized
ctcgctggatgcatgaacatgt

SEQ ID NO: 1372385 - DNA, 22 bp, Artificial Sequence
  chemically synthesized
gctcgctggatgcatgaacatg

SEQ ID NO: 1372386 - DNA, 22 bp, Artificial Sequence
  chemically synthesized
tgctcgctggatgcatgaacat

SEQ ID NO: 1372387 - DNA, 22 bp, Artificial Sequence
  chemically synthesized
aatatctcaacatgttcatgca

SEQ ID NO: 1372388 - DNA, 22 bp, Artificial Sequence
  chemically synthesized
ttgctcgctggatgcatgaaca

SEQ ID NO: 1372389 - DNA, 22 bp, Artificial Sequence
  chemically synthesized
ggtttttgctcgctggatgcat

SEQ ID NO: 1372390 - DNA, 22 bp, Artificial Sequence
  chemically synthesized
aacatgttcatgcatccagcga

SEQ ID NO: 1372391 - DNA, 22 bp, Artificial Sequence
  chemically synthesized
aaagtagtctgggtttttgctc

SEQ ID NO: 1372392 - DNA, 22 bp, Artificial Sequence
  chemically synthesized
atgcatccagcgagcaaaaacc

SEQ ID NO: 1372393 - DNA, 22 bp, Artificial Sequence
  chemically synthesized
caaagtagtctgggtttttgct

SEQ ID NO: 1372394 - DNA, 22 bp, Artificial Sequence
  chemically synthesized
cttcaaagtagtctgggttttt

SEQ ID NO: 1372395 - DNA, 22 bp, Artificial Sequence
  chemically synthesized
acttcaaagtagtctgggtttt

SEQ ID NO: 1372396 - DNA, 22 bp, Artificial Sequence
  chemically synthesized
tccttacttcaaagtagtctgg

SEQ ID NO: 1372397 - DNA, 22 bp, Artificial Sequence
  chemically synthesized
acatagtctatccttacttcaa

SEQ ID NO: 1372398 - DNA, 22 bp, Artificial Sequence
  chemically synthesized
ctttgaagtaaggatagactat

SEQ ID NO: 1372399 - DNA, 22 bp, Artificial Sequence
  chemically synthesized
gtaatggggctgacatagtcta

SEQ ID NO: 1372400 - DNA, 22 bp, Artificial Sequence
  chemically synthesized
tgaagtaaggatagactatgtc

SEQ ID NO: 1372401 - DNA, 22 bp, Artificial Sequence
  chemically synthesized
ggtaatggggctgacatagtct

SEQ ID NO: 1372402 - DNA, 22 bp, Artificial Sequence
  chemically synthesized
gaagtaaggatagactatgtca

SEQ ID NO: 1372403 - DNA, 22 bp, Artificial Sequence
  chemically synthesized
aagtaaggatagactatgtcag

SEQ ID NO: 1372404 - DNA, 22 bp, Artificial Sequence
  chemically synthesized
aaatatttggtaatggggctga

SEQ ID NO: 1372405 - DNA, 22 bp, Artificial Sequence
  chemically synthesized
cctcaaatatttggtaatgggg

SEQ ID NO: 1372406 - DNA, 22 bp, Artificial Sequence
  chemically synthesized
ccctcaaatatttggtaatggg

SEQ ID NO: 1372407 - DNA, 22 bp, Artificial Sequence
  chemically synthesized
tgtcagccccattaccaaatat

SEQ ID NO: 1372408 - DNA, 22 bp, Artificial Sequence
  chemically synthesized
tacaaccgtttccctcaaatat

SEQ ID NO: 1372409 - DNA, 22 bp, Artificial Sequence
  chemically synthesized
tattgtacaaccgtttccctca

SEQ ID NO: 1372410 - DNA, 22 bp, Artificial Sequence
  chemically synthesized
atattgtacaaccgtttccctc

SEQ ID NO: 1372411 - DNA, 22 bp, Artificial Sequence
  chemically synthesized
tatattgtacaaccgtttccct

SEQ ID NO: 1372412 - DNA, 22 bp, Artificial Sequence
  chemically synthesized
ccaaatatttgagggaaacggt

SEQ ID NO: 1372413 - DNA, 22 bp, Artificial Sequence
  chemically synthesized
gagggaaacggttgtacaatat

SEQ ID NO: 1372414 - DNA, 22 bp, Artificial Sequence
  chemically synthesized
agaaatggttttatattgtaca

SEQ ID NO: 1372415 - DNA, 22 bp, Artificial Sequence
  chemically synthesized
agggaaacggttgtacaatata

SEQ ID NO: 1372416 - DNA, 22 bp, Artificial Sequence
  chemically synthesized
aaattcagaaatggttttatat

SEQ ID NO: 1372417 - DNA, 22 bp, Artificial Sequence
  chemically synthesized
taaaattcagaaatggttttat

SEQ ID NO: 1372418 - DNA, 22 bp, Artificial Sequence
  chemically synthesized
ctctaaaattcagaaatggttt

SEQ ID NO: 1372419 - DNA, 22 bp, Artificial Sequence
  chemically synthesized
tacaatataaaaccatttctga

SEQ ID NO: 1372420 - DNA, 22 bp, Artificial Sequence
  chemically synthesized
actcctctaaaattcagaaatg

SEQ ID NO: 1372421 - DNA, 22 bp, Artificial Sequence
  chemically synthesized
gactcctctaaaattcagaaat

SEQ ID NO: 1372422 - DNA, 22 bp, Artificial Sequence
  chemically synthesized
tatttgactcctctaaaattca

SEQ ID NO: 1372423 - DNA, 22 bp, Artificial Sequence
  chemically synthesized
atatttgactcctctaaaattc

SEQ ID NO: 1372424 - DNA, 22 bp, Artificial Sequence
  chemically synthesized
gaaaccttatatttgactcctc

SEQ ID NO: 1372425 - DNA, 22 bp, Artificial Sequence
  chemically synthesized
ggaaaccttatatttgactcct

SEQ ID NO: 1372426 - DNA, 22 bp, Artificial Sequence
  chemically synthesized
ctgaattttagaggagtcaaat

SEQ ID NO: 1372427 - DNA, 22 bp, Artificial Sequence
  chemically synthesized
tgaattttagaggagtcaaata

SEQ ID NO: 1372428 - DNA, 22 bp, Artificial Sequence
  chemically synthesized
tttggaaaccttatatttgact

SEQ ID NO: 1372429 - DNA, 22 bp, Artificial Sequence
  chemically synthesized
aattttagaggagtcaaatata

SEQ ID NO: 1372430 - DNA, 22 bp, Artificial Sequence
  chemically synthesized
tattatttggaaaccttatatt

SEQ ID NO: 1372431 - DNA, 22 bp, Artificial Sequence
  chemically synthesized
tagaggagtcaaatataaggtt

SEQ ID NO: 1372432 - DNA, 22 bp, Artificial Sequence
  chemically synthesized
atattatttggaaaccttatat

SEQ ID NO: 1372433 - DNA, 22 bp, Artificial Sequence
  chemically synthesized
agaggagtcaaatataaggttt

SEQ ID NO: 1372434 - DNA, 22 bp, Artificial Sequence
  chemically synthesized
tatattatttggaaaccttata

SEQ ID NO: 1372435 - DNA, 22 bp, Artificial Sequence
  chemically synthesized
gaggagtcaaatataaggtttc

SEQ ID NO: 1372436 - DNA, 22 bp, Artificial Sequence
  chemically synthesized
ccaaataatataaaacgcacgc

SEQ ID NO: 1372437 - DNA, 22 bp, Artificial Sequence
  chemically synthesized
caaataatataaaacgcacgcc

SEQ ID NO: 1372438 - DNA, 22 bp, Artificial Sequence
  chemically synthesized
gtttcctccctccctccctccc

SEQ ID NO: 1372439 - DNA, 22 bp, Artificial Sequence
  chemically synthesized
cctccctccctccctccccttc

SEQ ID NO: 1372440 - DNA, 22 bp, Artificial Sequence
  chemically synthesized
ctccctccctccctccccttcc

SEQ ID NO: 1372441 - DNA, 22 bp, Artificial Sequence
  chemically synthesized
cctccctccctccccttcctcc

SEQ ID NO: 1372442 - DNA, 22 bp, Artificial Sequence
  chemically synthesized
cctccctccccttcctccctcc

SEQ ID NO: 1372443 - DNA, 22 bp, Artificial Sequence
  chemically synthesized
cctccccttcctccctccttcc

SEQ ID NO: 1372444 - DNA, 22 bp, Artificial Sequence
  chemically synthesized
cccttcctccctccttccctcc

SEQ ID NO: 1372445 - DNA, 22 bp, Artificial Sequence
  chemically synthesized
cctccctccttccctcccttcc

SEQ ID NO: 1372446 - DNA, 22 bp, Artificial Sequence
  chemically synthesized
ctccctccttccctcccttcct

SEQ ID NO: 1372447 - DNA, 22 bp, Artificial Sequence
  chemically synthesized
cctccttccctcccttcctccc

SEQ ID NO: 1372448 - DNA, 22 bp, Artificial Sequence
  chemically synthesized
cttccctcccttcctcccttcc

SEQ ID NO: 1372449 - DNA, 22 bp, Artificial Sequence
  chemically synthesized
ccctcccttcctcccttccttc

SEQ ID NO: 1372450 - DNA, 22 bp, Artificial Sequence
  chemically synthesized
cctcccttcctcccttccttcc

SEQ ID NO: 1372451 - DNA, 22 bp, Artificial Sequence
  chemically synthesized
ccttcctcccttccttccctcc

SEQ ID NO: 1372452 - DNA, 22 bp, Artificial Sequence
  chemically synthesized
cctcccttccttccctccctcc

SEQ ID NO: 1372453 - DNA, 22 bp, Artificial Sequence
  chemically synthesized
ctcccttccttccctccctccc

SEQ ID NO: 1372454 - DNA, 22 bp, Artificial Sequence
  chemically synthesized
ccttccttccctccctccctcc

SEQ ID NO: 1372455 - DNA, 22 bp, Artificial Sequence
  chemically synthesized
ccttccctccctccctccctct

SEQ ID NO: 1372456 - DNA, 22 bp, Artificial Sequence
  chemically synthesized
cttccctccctccctccctctt

SEQ ID NO: 1372457 - DNA, 22 bp, Artificial Sequence
  chemically synthesized
ccctccctccctccctctttct

SEQ ID NO: 1372458 - DNA, 22 bp, Artificial Sequence
  chemically synthesized
cctccctccctccctctttctt

SEQ ID NO: 1372459 - DNA, 22 bp, Artificial Sequence
  chemically synthesized
cctccctccctctttctttttc

SEQ ID NO: 1372460 - DNA, 22 bp, Artificial Sequence
  chemically synthesized
cctccctctttctttttctttc

SEQ ID NO: 1372461 - DNA, 22 bp, Artificial Sequence
  chemically synthesized
aaaaaaaaaagagagaaagaaa

SEQ ID NO: 1372462 - DNA, 22 bp, Artificial Sequence
  chemically synthesized
caaaaaaaaaagagagaaagaa

SEQ ID NO: 1372463 - DNA, 22 bp, Artificial Sequence
  chemically synthesized
cctctttctttttctttctctc

SEQ ID NO: 1372464 - DNA, 22 bp, Artificial Sequence
  chemically synthesized
tttctttttctttctctctttt

SEQ ID NO: 1372465 - DNA, 22 bp, Artificial Sequence
  chemically synthesized
catttcaaaaaaaaaagagaga

SEQ ID NO: 1372466 - DNA, 22 bp, Artificial Sequence
  chemically synthesized
tctttttctttctctctttttt

SEQ ID NO: 1372467 - DNA, 22 bp, Artificial Sequence
  chemically synthesized
ctttttctttctctcttttttt

SEQ ID NO: 1372468 - DNA, 22 bp, Artificial Sequence
  chemically synthesized
tttttctttctctctttttttt

SEQ ID NO: 1372469 - DNA, 22 bp, Artificial Sequence
  chemically synthesized
tttctttctctctttttttttt

SEQ ID NO: 1372470 - DNA, 22 bp, Artificial Sequence
  chemically synthesized
ttctttctctcttttttttttg

SEQ ID NO: 1372471 - DNA, 22 bp, Artificial Sequence
  chemically synthesized
tctttctctcttttttttttga

SEQ ID NO: 1372472 - DNA, 22 bp, Artificial Sequence
  chemically synthesized
ctttctctcttttttttttgaa

SEQ ID NO: 1372473 - DNA, 22 bp, Artificial Sequence
  chemically synthesized
tttctctcttttttttttgaaa

SEQ ID NO: 1372474 - DNA, 22 bp, Artificial Sequence
  chemically synthesized
tctctcttttttttttgaaatg

SEQ ID NO: 1372475 - DNA, 22 bp, Artificial Sequence
  chemically synthesized
ctctcttttttttttgaaatgg

SEQ ID NO: 1372476 - DNA, 22 bp, Artificial Sequence
  chemically synthesized
tctcttttttttttgaaatgga

SEQ ID NO: 1372477 - DNA, 22 bp, Artificial Sequence
  chemically synthesized
tcttttttttttgaaatggagt

SEQ ID NO: 1372478 - DNA, 22 bp, Artificial Sequence
  chemically synthesized
ttttttttttgaaatggagttt

SEQ ID NO: 1372479 - DNA, 22 bp, Artificial Sequence
  chemically synthesized
ggcaacaagagtgaaactccat

SEQ ID NO: 1372480 - DNA, 22 bp, Artificial Sequence
  chemically synthesized
ttttttttgaaatggagtttca

SEQ ID NO: 1372481 - DNA, 22 bp, Artificial Sequence
  chemically synthesized
tttttttgaaatggagtttcac

SEQ ID NO: 1372482 - DNA, 22 bp, Artificial Sequence
  chemically synthesized
ttttttgaaatggagtttcact

SEQ ID NO: 1372483 - DNA, 22 bp, Artificial Sequence
  chemically synthesized
tttttgaaatggagtttcactc

SEQ ID NO: 1372484 - DNA, 22 bp, Artificial Sequence
  chemically synthesized
ttttgaaatggagtttcactct

SEQ ID NO: 1372485 - DNA, 22 bp, Artificial Sequence
  chemically synthesized
tttgaaatggagtttcactctt

SEQ ID NO: 1372486 - DNA, 22 bp, Artificial Sequence
  chemically synthesized
ttgaaatggagtttcactcttg

SEQ ID NO: 1372487 - DNA, 22 bp, Artificial Sequence
  chemically synthesized
cagcctgggcaacaagagtgaa

SEQ ID NO: 1372488 - DNA, 22 bp, Artificial Sequence
  chemically synthesized
tgaaatggagtttcactcttgt

SEQ ID NO: 1372489 - DNA, 22 bp, Artificial Sequence
  chemically synthesized
gaaatggagtttcactcttgtt

SEQ ID NO: 1372490 - DNA, 22 bp, Artificial Sequence
  chemically synthesized
aaatggagtttcactcttgttg

SEQ ID NO: 1372491 - DNA, 22 bp, Artificial Sequence
  chemically synthesized
tactccagcctgggcaacaaga

SEQ ID NO: 1372492 - DNA, 22 bp, Artificial Sequence
  chemically synthesized
cactcttgttgcccaggctgga

SEQ ID NO: 1372493 - DNA, 22 bp, Artificial Sequence
  chemically synthesized
actcttgttgcccaggctggag

SEQ ID NO: 1372494 - DNA, 22 bp, Artificial Sequence
  chemically synthesized
ttgttgcccaggctggagtaca

SEQ ID NO: 1372495 - DNA, 22 bp, Artificial Sequence
  chemically synthesized
gttgcccaggctggagtacaat

SEQ ID NO: 1372496 - DNA, 22 bp, Artificial Sequence
  chemically synthesized
ttgcccaggctggagtacaatg

SEQ ID NO: 1372497 - DNA, 22 bp, Artificial Sequence
  chemically synthesized
cccaggctggagtacaatggcg

SEQ ID NO: 1372498 - DNA, 22 bp, Artificial Sequence
  chemically synthesized
cagtgagccgagatcgcgccat

SEQ ID NO: 1372499 - DNA, 22 bp, Artificial Sequence
  chemically synthesized
gagtacaatggcgcgatctcgg

SEQ ID NO: 1372500 - DNA, 22 bp, Artificial Sequence
  chemically synthesized
gaaggcacaggttgcagtgagc

SEQ ID NO: 1372501 - DNA, 22 bp, Artificial Sequence
  chemically synthesized
aacctggaaggcacaggttgca

SEQ ID NO: 1372502 - DNA, 22 bp, Artificial Sequence
  chemically synthesized
gaacctggaaggcacaggttgc

SEQ ID NO: 1372503 - DNA, 22 bp, Artificial Sequence
  chemically synthesized
ggctcactgcaacctgtgcctt

SEQ ID NO: 1372504 - DNA, 22 bp, Artificial Sequence
  chemically synthesized
actgcaacctgtgccttccagg

SEQ ID NO: 1372505 - DNA, 22 bp, Artificial Sequence
  chemically synthesized
caacctgtgccttccaggttca

SEQ ID NO: 1372506 - DNA, 22 bp, Artificial Sequence
  chemically synthesized
aggcagaagaatcgcttgaacc

SEQ ID NO: 1372507 - DNA, 22 bp, Artificial Sequence
  chemically synthesized
tgccttccaggttcaagcgatt

SEQ ID NO: 1372508 - DNA, 22 bp, Artificial Sequence
  chemically synthesized
ggaggctgaggcagaagaatcg

SEQ ID NO: 1372509 - DNA, 22 bp, Artificial Sequence
  chemically synthesized
ccaggttcaagcgattcttctg

SEQ ID NO: 1372510 - DNA, 22 bp, Artificial Sequence
  chemically synthesized
gggaggctgaggcagaagaatc

SEQ ID NO: 1372511 - DNA, 22 bp, Artificial Sequence
  chemically synthesized
caggttcaagcgattcttctgc

SEQ ID NO: 1372512 - DNA, 22 bp, Artificial Sequence
  chemically synthesized
cttgggaggctgaggcagaaga

SEQ ID NO: 1372513 - DNA, 22 bp, Artificial Sequence
  chemically synthesized
aagcgattcttctgcctcagcc

SEQ ID NO: 1372514 - DNA, 22 bp, Artificial Sequence
  chemically synthesized
agctacttgggaggctgaggca

SEQ ID NO: 1372515 - DNA, 22 bp, Artificial Sequence
  chemically synthesized
taatctcagctacttgggaggc

SEQ ID NO: 1372516 - DNA, 22 bp, Artificial Sequence
  chemically synthesized
ttctgcctcagcctcccaagta

SEQ ID NO: 1372517 - DNA, 22 bp, Artificial Sequence
  chemically synthesized
ctgcctcagcctcccaagtagc

SEQ ID NO: 1372518 - DNA, 22 bp, Artificial Sequence
  chemically synthesized
tgcctcagcctcccaagtagct

SEQ ID NO: 1372519 - DNA, 22 bp, Artificial Sequence
  chemically synthesized
cctcagcctcccaagtagctga

SEQ ID NO: 1372520 - DNA, 22 bp, Artificial Sequence
  chemically synthesized
agcctcccaagtagctgagatt

SEQ ID NO: 1372521 - DNA, 22 bp, Artificial Sequence
  chemically synthesized
ccaagtagctgagattacaggc

SEQ ID NO: 1372522 - DNA, 22 bp, Artificial Sequence
  chemically synthesized
gccgggcgtggtggcacacgcc

SEQ ID NO: 1372523 - DNA, 22 bp, Artificial Sequence
  chemically synthesized
agattacaggcgtgtgccacca

SEQ ID NO: 1372524 - DNA, 22 bp, Artificial Sequence
  chemically synthesized
caggcgtgtgccaccacgcccg

SEQ ID NO: 1372525 - DNA, 22 bp, Artificial Sequence
  chemically synthesized
aaaaaatacaaaattagccggg

SEQ ID NO: 1372526 - DNA, 22 bp, Artificial Sequence
  chemically synthesized
ctaaaaaaatacaaaattagcc

SEQ ID NO: 1372527 - DNA, 22 bp, Artificial Sequence
  chemically synthesized
tactaaaaaaatacaaaattag

SEQ ID NO: 1372528 - DNA, 22 bp, Artificial Sequence
  chemically synthesized
tctctactaaaaaaatacaaaa

SEQ ID NO: 1372529 - DNA, 22 bp, Artificial Sequence
  chemically synthesized
tgtctctactaaaaaaatacaa

SEQ ID NO: 1372530 - DNA, 22 bp, Artificial Sequence
  chemically synthesized
attttgtatttttttagtagag

SEQ ID NO: 1372531 - DNA, 22 bp, Artificial Sequence
  chemically synthesized
tgtatttttttagtagagacag

SEQ ID NO: 1372532 - DNA, 22 bp, Artificial Sequence
  chemically synthesized
gtatttttttagtagagacaga

SEQ ID NO: 1372533 - DNA, 22 bp, Artificial Sequence
  chemically synthesized
tatttttttagtagagacagag

SEQ ID NO: 1372534 - DNA, 22 bp, Artificial Sequence
  chemically synthesized
accaacatggtgaaactctgtc

SEQ ID NO: 1372535 - DNA, 22 bp, Artificial Sequence
  chemically synthesized
ttttagtagagacagagtttca

SEQ ID NO: 1372536 - DNA, 22 bp, Artificial Sequence
  chemically synthesized
tttagtagagacagagtttcac

SEQ ID NO: 1372537 - DNA, 22 bp, Artificial Sequence
  chemically synthesized
ttagtagagacagagtttcacc

SEQ ID NO: 1372538 - DNA, 22 bp, Artificial Sequence
  chemically synthesized
tagtagagacagagtttcacca

SEQ ID NO: 1372539 - DNA, 22 bp, Artificial Sequence
  chemically synthesized
agtagagacagagtttcaccat

SEQ ID NO: 1372540 - DNA, 22 bp, Artificial Sequence
  chemically synthesized
gtagagacagagtttcaccatg

SEQ ID NO: 1372541 - DNA, 22 bp, Artificial Sequence
  chemically synthesized
aagtccagcctgaccaacatgg

SEQ ID NO: 1372542 - DNA, 22 bp, Artificial Sequence
  chemically synthesized
caccatgttggtcaggctggac

SEQ ID NO: 1372543 - DNA, 22 bp, Artificial Sequence
  chemically synthesized
accatgttggtcaggctggact

SEQ ID NO: 1372544 - DNA, 22 bp, Artificial Sequence
  chemically synthesized
aggtcaggagttcaagtccagc

SEQ ID NO: 1372545 - DNA, 22 bp, Artificial Sequence
  chemically synthesized
gaggtcaggagttcaagtccag

SEQ ID NO: 1372546 - DNA, 22 bp, Artificial Sequence
  chemically synthesized
gtcaggctggacttgaactcct

SEQ ID NO: 1372547 - DNA, 22 bp, Artificial Sequence
  chemically synthesized
gacttgaactcctgacctcaag

SEQ ID NO: 1372548 - DNA, 22 bp, Artificial Sequence
  chemically synthesized
gaactcctgacctcaagtgatc

SEQ ID NO: 1372549 - DNA, 22 bp, Artificial Sequence
  chemically synthesized
aactcctgacctcaagtgatcc

SEQ ID NO: 1372550 - DNA, 22 bp, Artificial Sequence
  chemically synthesized
ggaagccaaggtgagtggatca

SEQ ID NO: 1372551 - DNA, 22 bp, Artificial Sequence
  chemically synthesized
ctgacctcaagtgatccactca

SEQ ID NO: 1372552 - DNA, 22 bp, Artificial Sequence
  chemically synthesized
gggaagccaaggtgagtggatc

SEQ ID NO: 1372553 - DNA, 22 bp, Artificial Sequence
  chemically synthesized
tgggaagccaaggtgagtggat

SEQ ID NO: 1372554 - DNA, 22 bp, Artificial Sequence
  chemically synthesized
acctcaagtgatccactcacct

SEQ ID NO: 1372555 - DNA, 22 bp, Artificial Sequence
  chemically synthesized
aagtgatccactcaccttggct

SEQ ID NO: 1372556 - DNA, 22 bp, Artificial Sequence
  chemically synthesized
taatcccagcattttgggaagc

SEQ ID NO: 1372557 - DNA, 22 bp, Artificial Sequence
  chemically synthesized
accttggcttcccaaaatgctg

SEQ ID NO: 1372558 - DNA, 22 bp, Artificial Sequence
  chemically synthesized
gtgcctgtaatcccagcatttt

SEQ ID NO: 1372559 - DNA, 22 bp, Artificial Sequence
  chemically synthesized
ggcttcccaaaatgctgggatt

SEQ ID NO: 1372560 - DNA, 22 bp, Artificial Sequence
  chemically synthesized
gcttcccaaaatgctgggatta

SEQ ID NO: 1372561 - DNA, 22 bp, Artificial Sequence
  chemically synthesized
tggctcgtgcctgtaatcccag

SEQ ID NO: 1372562 - DNA, 22 bp, Artificial Sequence
  chemically synthesized
cccaaaatgctgggattacagg

SEQ ID NO: 1372563 - DNA, 22 bp, Artificial Sequence
  chemically synthesized
ccaaaatgctgggattacaggc

SEQ ID NO: 1372564 - DNA, 22 bp, Artificial Sequence
  chemically synthesized
gcggggcactgtggctcgtgcc

SEQ ID NO: 1372565 - DNA, 22 bp, Artificial Sequence
  chemically synthesized
ggattacaggcacgagccacag

SEQ ID NO: 1372566 - DNA, 22 bp, Artificial Sequence
  chemically synthesized
caggcacgagccacagtgcccc

SEQ ID NO: 1372567 - DNA, 22 bp, Artificial Sequence
  chemically synthesized
aaaaaggtgtagccaaagaaag

SEQ ID NO: 1372568 - DNA, 22 bp, Artificial Sequence
  chemically synthesized
cctcaaaaaggtgtagccaaag

SEQ ID NO: 1372569 - DNA, 22 bp, Artificial Sequence
  chemically synthesized
tctttctttggctacacctttt

SEQ ID NO: 1372570 - DNA, 22 bp, Artificial Sequence
  chemically synthesized
tctttggctacacctttttgag

SEQ ID NO: 1372571 - DNA, 22 bp, Artificial Sequence
  chemically synthesized
ctttggctacacctttttgagg

SEQ ID NO: 1372572 - DNA, 22 bp, Artificial Sequence
  chemically synthesized
tttggctacacctttttgaggt

SEQ ID NO: 1372573 - DNA, 22 bp, Artificial Sequence
  chemically synthesized
tggctacacctttttgaggtag

SEQ ID NO: 1372574 - DNA, 22 bp, Artificial Sequence
  chemically synthesized
ggctacacctttttgaggtagg

SEQ ID NO: 1372575 - DNA, 22 bp, Artificial Sequence
  chemically synthesized
gctacacctttttgaggtagga

SEQ ID NO: 1372576 - DNA, 22 bp, Artificial Sequence
  chemically synthesized
cacctttttgaggtaggacttt

SEQ ID NO: 1372577 - DNA, 22 bp, Artificial Sequence
  chemically synthesized
cccagtggtatgaaagtcctac

SEQ ID NO: 1372578 - DNA, 22 bp, Artificial Sequence
  chemically synthesized
ttgcccagtggtatgaaagtcc

SEQ ID NO: 1372579 - DNA, 22 bp, Artificial Sequence
  chemically synthesized
tttgaggtaggactttcatacc

SEQ ID NO: 1372580 - DNA, 22 bp, Artificial Sequence
  chemically synthesized
ctattgcccagtggtatgaaag

SEQ ID NO: 1372581 - DNA, 22 bp, Artificial Sequence
  chemically synthesized
ttgaggtaggactttcatacca

SEQ ID NO: 1372582 - DNA, 22 bp, Artificial Sequence
  chemically synthesized
tgaggtaggactttcataccac

SEQ ID NO: 1372583 - DNA, 22 bp, Artificial Sequence
  chemically synthesized
gaggtaggactttcataccact

SEQ ID NO: 1372584 - DNA, 22 bp, Artificial Sequence
  chemically synthesized
aggtaggactttcataccactg

SEQ ID NO: 1372585 - DNA, 22 bp, Artificial Sequence
  chemically synthesized
agttgctattgcccagtggtat

SEQ ID NO: 1372586 - DNA, 22 bp, Artificial Sequence
  chemically synthesized
tattcagttgctattgcccagt

SEQ ID NO: 1372587 - DNA, 22 bp, Artificial Sequence
  chemically synthesized
ctatattcagttgctattgccc

SEQ ID NO: 1372588 - DNA, 22 bp, Artificial Sequence
  chemically synthesized
tcataccactgggcaatagcaa

SEQ ID NO: 1372589 - DNA, 22 bp, Artificial Sequence
  chemically synthesized
cataccactgggcaatagcaac

SEQ ID NO: 1372590 - DNA, 22 bp, Artificial Sequence
  chemically synthesized
ataccactgggcaatagcaact

SEQ ID NO: 1372591 - DNA, 22 bp, Artificial Sequence
  chemically synthesized
attcctatattcagttgctatt

SEQ ID NO: 1372592 - DNA, 22 bp, Artificial Sequence
  chemically synthesized
agttcattcctatattcagttg

SEQ ID NO: 1372593 - DNA, 22 bp, Artificial Sequence
  chemically synthesized
ggcaatagcaactgaatatagg

SEQ ID NO: 1372594 - DNA, 22 bp, Artificial Sequence
  chemically synthesized
atgtatgagaaatattaagttc

SEQ ID NO: 1372595 - DNA, 22 bp, Artificial Sequence
  chemically synthesized
aatataggaatgaacttaatat

SEQ ID NO: 1372596 - DNA, 22 bp, Artificial Sequence
  chemically synthesized
catgtatgagaaatattaagtt

SEQ ID NO: 1372597 - DNA, 22 bp, Artificial Sequence
  chemically synthesized
aatatttctcatacatgaagat

SEQ ID NO: 1372598 - DNA, 22 bp, Artificial Sequence
  chemically synthesized
atatttctcatacatgaagatt

SEQ ID NO: 1372599 - DNA, 22 bp, Artificial Sequence
  chemically synthesized
ctcatacatgaagattatggca

SEQ ID NO: 1372600 - DNA, 22 bp, Artificial Sequence
  chemically synthesized
tcatacatgaagattatggcat

SEQ ID NO: 1372601 - DNA, 22 bp, Artificial Sequence
  chemically synthesized
atacatgaagattatggcattt

SEQ ID NO: 1372602 - DNA, 22 bp, Artificial Sequence
  chemically synthesized
acaaatagaaatgaaatgccat

SEQ ID NO: 1372603 - DNA, 22 bp, Artificial Sequence
  chemically synthesized
cacaaatagaaatgaaatgcca

SEQ ID NO: 1372604 - DNA, 22 bp, Artificial Sequence
  chemically synthesized
tggcatttcatttctatttgtg

SEQ ID NO: 1372605 - DNA, 22 bp, Artificial Sequence
  chemically synthesized
atatatccgtgcccacttcaca

SEQ ID NO: 1372606 - DNA, 22 bp, Artificial Sequence
  chemically synthesized
aatatatccgtgcccacttcac

SEQ ID NO: 1372607 - DNA, 22 bp, Artificial Sequence
  chemically synthesized
catttctatttgtgaagtgggc

SEQ ID NO: 1372608 - DNA, 22 bp, Artificial Sequence
  chemically synthesized
taatatatccgtgcccacttca

SEQ ID NO: 1372609 - DNA, 22 bp, Artificial Sequence
  chemically synthesized
atttctatttgtgaagtgggca

SEQ ID NO: 1372610 - DNA, 22 bp, Artificial Sequence
  chemically synthesized
ttaatatatccgtgcccacttc

SEQ ID NO: 1372611 - DNA, 22 bp, Artificial Sequence
  chemically synthesized
ctatttgtgaagtgggcacgga

SEQ ID NO: 1372612 - DNA, 22 bp, Artificial Sequence
  chemically synthesized
tatttgtgaagtgggcacggat

SEQ ID NO: 1372613 - DNA, 22 bp, Artificial Sequence
  chemically synthesized
tatttttaatatatccgtgccc

SEQ ID NO: 1372614 - DNA, 22 bp, Artificial Sequence
  chemically synthesized
tttgtgaagtgggcacggatat

SEQ ID NO: 1372615 - DNA, 22 bp, Artificial Sequence
  chemically synthesized
tatatttttaatatatccgtgc

SEQ ID NO: 1372616 - DNA, 22 bp, Artificial Sequence
  chemically synthesized
ctatatttttaatatatccgtg

SEQ ID NO: 1372617 - DNA, 22 bp, Artificial Sequence
  chemically synthesized
tctatatttttaatatatccgt

SEQ ID NO: 1372618 - DNA, 22 bp, Artificial Sequence
  chemically synthesized
gtgaagtgggcacggatatatt

SEQ ID NO: 1372619 - DNA, 22 bp, Artificial Sequence
  chemically synthesized
tgaagtgggcacggatatatta

SEQ ID NO: 1372620 - DNA, 22 bp, Artificial Sequence
  chemically synthesized
aatgagaacagtaaggttttct

SEQ ID NO: 1372621 - DNA, 22 bp, Artificial Sequence
  chemically synthesized
aaatgagaacagtaaggttttc

SEQ ID NO: 1372622 - DNA, 22 bp, Artificial Sequence
  chemically synthesized
taaatgagaacagtaaggtttt

SEQ ID NO: 1372623 - DNA, 22 bp, Artificial Sequence
  chemically synthesized
aaaatatagaaaaccttactgt

SEQ ID NO: 1372624 - DNA, 22 bp, Artificial Sequence
  chemically synthesized
actgttctcatttaaaattttt

SEQ ID NO: 1372625 - DNA, 22 bp, Artificial Sequence
  chemically synthesized
ctgttctcatttaaaatttttt

SEQ ID NO: 1372626 - DNA, 22 bp, Artificial Sequence
  chemically synthesized
ttctcatttaaaattttttcac

SEQ ID NO: 1372627 - DNA, 22 bp, Artificial Sequence
  chemically synthesized
tcatttaaaattttttcacgat

SEQ ID NO: 1372628 - DNA, 22 bp, Artificial Sequence
  chemically synthesized
atttaaaattttttcacgatat

SEQ ID NO: 1372629 - DNA, 22 bp, Artificial Sequence
  chemically synthesized
tatgaaatgtgatgtatatcgt

SEQ ID NO: 1372630 - DNA, 22 bp, Artificial Sequence
  chemically synthesized
aaaattttttcacgatatacat

SEQ ID NO: 1372631 - DNA, 22 bp, Artificial Sequence
  chemically synthesized
gtatgaaatgtgatgtatatcg

SEQ ID NO: 1372632 - DNA, 22 bp, Artificial Sequence
  chemically synthesized
aaattttttcacgatatacatc

SEQ ID NO: 1372633 - DNA, 22 bp, Artificial Sequence
  chemically synthesized
tgtatgaaatgtgatgtatatc

SEQ ID NO: 1372634 - DNA, 22 bp, Artificial Sequence
  chemically synthesized
attttgtatgaaatgtgatgta

SEQ ID NO: 1372635 - DNA, 22 bp, Artificial Sequence
  chemically synthesized
cattttgtatgaaatgtgatgt

SEQ ID NO: 1372636 - DNA, 22 bp, Artificial Sequence
  chemically synthesized
tttcacgatatacatcacattt

SEQ ID NO: 1372637 - DNA, 22 bp, Artificial Sequence
  chemically synthesized
tcattttgtatgaaatgtgatg

SEQ ID NO: 1372638 - DNA, 22 bp, Artificial Sequence
  chemically synthesized
ttcacgatatacatcacatttc

SEQ ID NO: 1372639 - DNA, 22 bp, Artificial Sequence
  chemically synthesized
tcacgatatacatcacatttca

SEQ ID NO: 1372640 - DNA, 22 bp, Artificial Sequence
  chemically synthesized
cacgatatacatcacatttcat

SEQ ID NO: 1372641 - DNA, 22 bp, Artificial Sequence
  chemically synthesized
acgatatacatcacatttcata

SEQ ID NO: 1372642 - DNA, 22 bp, Artificial Sequence
  chemically synthesized
catacaaaatgaaaatatgtat

SEQ ID NO: 1372643 - DNA, 22 bp, Artificial Sequence
  chemically synthesized
atacaaaatgaaaatatgtatt

SEQ ID NO: 1372644 - DNA, 22 bp, Artificial Sequence
  chemically synthesized
acaatcaagtacaagatatatc

SEQ ID NO: 1372645 - DNA, 22 bp, Artificial Sequence
  chemically synthesized
ctcgattttgatatatcttgta

SEQ ID NO: 1372646 - DNA, 22 bp, Artificial Sequence
  chemically synthesized
attgacaatcaagtacaagata

SEQ ID NO: 1372647 - DNA, 22 bp, Artificial Sequence
  chemically synthesized
aattgacaatcaagtacaagat

SEQ ID NO: 1372648 - DNA, 22 bp, Artificial Sequence
  chemically synthesized
gattttgatatatcttgtactt

SEQ ID NO: 1372649 - DNA, 22 bp, Artificial Sequence
  chemically synthesized
taattgacaatcaagtacaaga

SEQ ID NO: 1372650 - DNA, 22 bp, Artificial Sequence
  chemically synthesized
attttaattgacaatcaagtac

SEQ ID NO: 1372651 - DNA, 22 bp, Artificial Sequence
  chemically synthesized
tgatatatcttgtacttgattg

SEQ ID NO: 1372652 - DNA, 22 bp, Artificial Sequence
  chemically synthesized
gatatatcttgtacttgattgt

SEQ ID NO: 1372653 - DNA, 22 bp, Artificial Sequence
  chemically synthesized
atatatcttgtacttgattgtc

SEQ ID NO: 1372654 - DNA, 22 bp, Artificial Sequence
  chemically synthesized
attcattttaattgacaatcaa

SEQ ID NO: 1372655 - DNA, 22 bp, Artificial Sequence
  chemically synthesized
gtacttgattgtcaattaaaat

SEQ ID NO: 1372656 - DNA, 22 bp, Artificial Sequence
  chemically synthesized
tacttgattgtcaattaaaatg

SEQ ID NO: 1372657 - DNA, 22 bp, Artificial Sequence
  chemically synthesized
aatacaaaaattaattcatttt

SEQ ID NO: 1372658 - DNA, 22 bp, Artificial Sequence
  chemically synthesized
gattgtcaattaaaatgaatta

SEQ ID NO: 1372659 - DNA, 22 bp, Artificial Sequence
  chemically synthesized
caatacaaaaattaattcattt

SEQ ID NO: 1372660 - DNA, 22 bp, Artificial Sequence
  chemically synthesized
attgtcaattaaaatgaattaa

SEQ ID NO: 1372661 - DNA, 22 bp, Artificial Sequence
  chemically synthesized
tcaatacaaaaattaattcatt

SEQ ID NO: 1372662 - DNA, 22 bp, Artificial Sequence
  chemically synthesized
ttcaatacaaaaattaattcat

SEQ ID NO: 1372663 - DNA, 22 bp, Artificial Sequence
  chemically synthesized
tcaattaaaatgaattaatttt

SEQ ID NO: 1372664 - DNA, 22 bp, Artificial Sequence
  chemically synthesized
aatttttcaatacaaaaattaa

SEQ ID NO: 1372665 - DNA, 22 bp, Artificial Sequence
  chemically synthesized
ctaaatttttcaatacaaaaat

SEQ ID NO: 1372666 - DNA, 22 bp, Artificial Sequence
  chemically synthesized
aaatgaattaatttttgtattg

SEQ ID NO: 1372667 - DNA, 22 bp, Artificial Sequence
  chemically synthesized
ttactaaatttttcaatacaaa

SEQ ID NO: 1372668 - DNA, 22 bp, Artificial Sequence
  chemically synthesized
attactaaatttttcaatacaa

SEQ ID NO: 1372669 - DNA, 22 bp, Artificial Sequence
  chemically synthesized
tattactaaatttttcaataca

SEQ ID NO: 1372670 - DNA, 22 bp, Artificial Sequence
  chemically synthesized
ttattactaaatttttcaatac

SEQ ID NO: 1372671 - DNA, 22 bp, Artificial Sequence
  chemically synthesized
agtttttattactaaatttttc

SEQ ID NO: 1372672 - DNA, 22 bp, Artificial Sequence
  chemically synthesized
atttttgtattgaaaaatttag

SEQ ID NO: 1372673 - DNA, 22 bp, Artificial Sequence
  chemically synthesized
tcagtttttattactaaatttt

SEQ ID NO: 1372674 - DNA, 22 bp, Artificial Sequence
  chemically synthesized
ttgtattgaaaaatttagtaat

SEQ ID NO: 1372675 - DNA, 22 bp, Artificial Sequence
  chemically synthesized
tgtattgaaaaatttagtaata

SEQ ID NO: 1372676 - DNA, 22 bp, Artificial Sequence
  chemically synthesized
gtattgaaaaatttagtaataa

SEQ ID NO: 1372677 - DNA, 22 bp, Artificial Sequence
  chemically synthesized
tattgaaaaatttagtaataaa

SEQ ID NO: 1372678 - DNA, 22 bp, Artificial Sequence
  chemically synthesized
acattctcagtttttattacta

SEQ ID NO: 1372679 - DNA, 22 bp, Artificial Sequence
  chemically synthesized
aaaaatttagtaataaaaactg

SEQ ID NO: 1372680 - DNA, 22 bp, Artificial Sequence
  chemically synthesized
agtaataaaaactgagaatgtg

SEQ ID NO: 1372681 - DNA, 22 bp, Artificial Sequence
  chemically synthesized
gtaataaaaactgagaatgtga

SEQ ID NO: 1372682 - DNA, 22 bp, Artificial Sequence
  chemically synthesized
tgcacgtatatgggtgtgtagt

SEQ ID NO: 1372683 - DNA, 22 bp, Artificial Sequence
  chemically synthesized
agaatgtgaactacacacccat

SEQ ID NO: 1372684 - DNA, 22 bp, Artificial Sequence
  chemically synthesized
ttgtgcacgtatatgggtgtgt

SEQ ID NO: 1372685 - DNA, 22 bp, Artificial Sequence
  chemically synthesized
gttgtgcacgtatatgggtgtg

SEQ ID NO: 1372686 - DNA, 22 bp, Artificial Sequence
  chemically synthesized
tgttgtgcacgtatatgggtgt

SEQ ID NO: 1372687 - DNA, 22 bp, Artificial Sequence
  chemically synthesized
ttgttgtgcacgtatatgggtg

SEQ ID NO: 1372688 - DNA, 22 bp, Artificial Sequence
  chemically synthesized
agcttttgttgtgcacgtatat

SEQ ID NO: 1372689 - DNA, 22 bp, Artificial Sequence
  chemically synthesized
cacacccatatacgtgcacaac

SEQ ID NO: 1372690 - DNA, 22 bp, Artificial Sequence
  chemically synthesized
tagataccatgttaagcttttg

SEQ ID NO: 1372691 - DNA, 22 bp, Artificial Sequence
  chemically synthesized
ttatagataccatgttaagctt

SEQ ID NO: 1372692 - DNA, 22 bp, Artificial Sequence
  chemically synthesized
attatagataccatgttaagct

SEQ ID NO: 1372693 - DNA, 22 bp, Artificial Sequence
  chemically synthesized
taggcttattatagataccatg

SEQ ID NO: 1372694 - DNA, 22 bp, Artificial Sequence
  chemically synthesized
tgtaggcttattatagatacca

SEQ ID NO: 1372695 - DNA, 22 bp, Artificial Sequence
  chemically synthesized
aacatggtatctataataagcc

SEQ ID NO: 1372696 - DNA, 22 bp, Artificial Sequence
  chemically synthesized
acatggtatctataataagcct

SEQ ID NO: 1372697 - DNA, 22 bp, Artificial Sequence
  chemically synthesized
aaagaactctgtaggcttatta

SEQ ID NO: 1372698 - DNA, 22 bp, Artificial Sequence
  chemically synthesized
aaaagaactctgtaggcttatt

SEQ ID NO: 1372699 - DNA, 22 bp, Artificial Sequence
  chemically synthesized
gtttaaaagaactctgtaggct

SEQ ID NO: 1372700 - DNA, 22 bp, Artificial Sequence
  chemically synthesized
agtttaaaagaactctgtaggc

SEQ ID NO: 1372701 - DNA, 22 bp, Artificial Sequence
  chemically synthesized
tgtttagtttaaaagaactctg

SEQ ID NO: 1372702 - DNA, 22 bp, Artificial Sequence
  chemically synthesized
taataagcctacagagttcttt

SEQ ID NO: 1372703 - DNA, 22 bp, Artificial Sequence
  chemically synthesized
ttatgtttagtttaaaagaact

SEQ ID NO: 1372704 - DNA, 22 bp, Artificial Sequence
  chemically synthesized
gcaactattatgtttagtttaa

SEQ ID NO: 1372705 - DNA, 22 bp, Artificial Sequence
  chemically synthesized
ggcaactattatgtttagttta

SEQ ID NO: 1372706 - DNA, 22 bp, Artificial Sequence
  chemically synthesized
cagagttcttttaaactaaaca

SEQ ID NO: 1372707 - DNA, 22 bp, Artificial Sequence
  chemically synthesized
tggcaactattatgtttagttt

SEQ ID NO: 1372708 - DNA, 22 bp, Artificial Sequence
  chemically synthesized
ttggcaactattatgtttagtt

SEQ ID NO: 1372709 - DNA, 22 bp, Artificial Sequence
  chemically synthesized
ttttaaactaaacataatagtt

SEQ ID NO: 1372710 - DNA, 22 bp, Artificial Sequence
  chemically synthesized
ttaaactaaacataatagttgc

SEQ ID NO: 1372711 - DNA, 22 bp, Artificial Sequence
  chemically synthesized
taaactaaacataatagttgcc

SEQ ID NO: 1372712 - DNA, 22 bp, Artificial Sequence
  chemically synthesized
tgaatcccttttggcaactatt

SEQ ID NO: 1372713 - DNA, 22 bp, Artificial Sequence
  chemically synthesized
aaactaaacataatagttgcca

SEQ ID NO: 1372714 - DNA, 22 bp, Artificial Sequence
  chemically synthesized
aactaaacataatagttgccaa

SEQ ID NO: 1372715 - DNA, 22 bp, Artificial Sequence
  chemically synthesized
aacataatagttgccaaaaggg

SEQ ID NO: 1372716 - DNA, 22 bp, Artificial Sequence
  chemically synthesized
aaaagctatgaatcccttttgg

SEQ ID NO: 1372717 - DNA, 22 bp, Artificial Sequence
  chemically synthesized
aatcaattcaaaagctatgaat

SEQ ID NO: 1372718 - DNA, 22 bp, Artificial Sequence
  chemically synthesized
aaatcaattcaaaagctatgaa

SEQ ID NO: 1372719 - DNA, 22 bp, Artificial Sequence
  chemically synthesized
taaatcaattcaaaagctatga

SEQ ID NO: 1372720 - DNA, 22 bp, Artificial Sequence
  chemically synthesized
ccaaaagggattcatagctttt

SEQ ID NO: 1372721 - DNA, 22 bp, Artificial Sequence
  chemically synthesized
attttaaatcaattcaaaagct

SEQ ID NO: 1372722 - DNA, 22 bp, Artificial Sequence
  chemically synthesized
atagcttttgaattgatttaaa

SEQ ID NO: 1372723 - DNA, 22 bp, Artificial Sequence
  chemically synthesized
ttgaattgatttaaaattaacc

SEQ ID NO: 1372724 - DNA, 22 bp, Artificial Sequence
  chemically synthesized
tgaattgatttaaaattaacct

SEQ ID NO: 1372725 - DNA, 22 bp, Artificial Sequence
  chemically synthesized
gaagtgacagggaggttaattt

SEQ ID NO: 1372726 - DNA, 22 bp, Artificial Sequence
  chemically synthesized
gaattgatttaaaattaacctc

SEQ ID NO: 1372727 - DNA, 22 bp, Artificial Sequence
  chemically synthesized
ggaagtgacagggaggttaatt

SEQ ID NO: 1372728 - DNA, 22 bp, Artificial Sequence
  chemically synthesized
aattgatttaaaattaacctcc

SEQ ID NO: 1372729 - DNA, 22 bp, Artificial Sequence
  chemically synthesized
atttggaagtgacagggaggtt

SEQ ID NO: 1372730 - DNA, 22 bp, Artificial Sequence
  chemically synthesized
atttaaaattaacctccctgtc

SEQ ID NO: 1372731 - DNA, 22 bp, Artificial Sequence
  chemically synthesized
aaaattaacctccctgtcactt

SEQ ID NO: 1372732 - DNA, 22 bp, Artificial Sequence
  chemically synthesized
aaattaacctccctgtcacttc

SEQ ID NO: 1372733 - DNA, 22 bp, Artificial Sequence
  chemically synthesized
acctccctgtcacttccaaatg

SEQ ID NO: 1372734 - DNA, 22 bp, Artificial Sequence
  chemically synthesized
cataaatggaaattcatttgga

SEQ ID NO: 1372735 - DNA, 22 bp, Artificial Sequence
  chemically synthesized
cctgtcacttccaaatgaattt

SEQ ID NO: 1372736 - DNA, 22 bp, Artificial Sequence
  chemically synthesized
tgttacataaatggaaattcat

SEQ ID NO: 1372737 - DNA, 22 bp, Artificial Sequence
  chemically synthesized
atgttacataaatggaaattca

SEQ ID NO: 1372738 - DNA, 22 bp, Artificial Sequence
  chemically synthesized
tcacttccaaatgaatttccat

SEQ ID NO: 1372739 - DNA, 22 bp, Artificial Sequence
  chemically synthesized
tatgttacataaatggaaattc

SEQ ID NO: 1372740 - DNA, 22 bp, Artificial Sequence
  chemically synthesized
ccaaatgaatttccatttatgt

SEQ ID NO: 1372741 - DNA, 22 bp, Artificial Sequence
  chemically synthesized
caaatgaatttccatttatgta

SEQ ID NO: 1372742 - DNA, 22 bp, Artificial Sequence
  chemically synthesized
tcatgggacaattttatgttac

SEQ ID NO: 1372743 - DNA, 22 bp, Artificial Sequence
  chemically synthesized
gtcatgggacaattttatgtta

SEQ ID NO: 1372744 - DNA, 22 bp, Artificial Sequence
  chemically synthesized
tgtcatgggacaattttatgtt

SEQ ID NO: 1372745 - DNA, 22 bp, Artificial Sequence
  chemically synthesized
ccatttatgtaacataaaattg

SEQ ID NO: 1372746 - DNA, 22 bp, Artificial Sequence
  chemically synthesized
catttatgtaacataaaattgt

SEQ ID NO: 1372747 - DNA, 22 bp, Artificial Sequence
  chemically synthesized
aaagttttgtcatgggacaatt

SEQ ID NO: 1372748 - DNA, 22 bp, Artificial Sequence
  chemically synthesized
atgtaacataaaattgtcccat

SEQ ID NO: 1372749 - DNA, 22 bp, Artificial Sequence
  chemically synthesized
tgtaacataaaattgtcccatg

SEQ ID NO: 1372750 - DNA, 22 bp, Artificial Sequence
  chemically synthesized
cggctgaaagttttgtcatggg

SEQ ID NO: 1372751 - DNA, 22 bp, Artificial Sequence
  chemically synthesized
tcccatgacaaaactttcagcc

SEQ ID NO: 1372752 - DNA, 22 bp, Artificial Sequence
  chemically synthesized
aagaaggaataaatgtattccg

SEQ ID NO: 1372753 - DNA, 22 bp, Artificial Sequence
  chemically synthesized
tcagccggaatacatttattcc

SEQ ID NO: 1372754 - DNA, 22 bp, Artificial Sequence
  chemically synthesized
cagccggaatacatttattcct

SEQ ID NO: 1372755 - DNA, 22 bp, Artificial Sequence
  chemically synthesized
agccggaatacatttattcctt

SEQ ID NO: 1372756 - DNA, 22 bp, Artificial Sequence
  chemically synthesized
caaatgatagactcaagaagga

SEQ ID NO: 1372757 - DNA, 22 bp, Artificial Sequence
  chemically synthesized
gcaaatgatagactcaagaagg

SEQ ID NO: 1372758 - DNA, 22 bp, Artificial Sequence
  chemically synthesized
tgcaaatgatagactcaagaag

SEQ ID NO: 1372759 - DNA, 22 bp, Artificial Sequence
  chemically synthesized
attccttcttgagtctatcatt

SEQ ID NO: 1372760 - DNA, 22 bp, Artificial Sequence
  chemically synthesized
ttccttcttgagtctatcattt

SEQ ID NO: 1372761 - DNA, 22 bp, Artificial Sequence
  chemically synthesized
cttcttgagtctatcatttgca

SEQ ID NO: 1372762 - DNA, 22 bp, Artificial Sequence
  chemically synthesized
cttgagtctatcatttgcaaag

SEQ ID NO: 1372763 - DNA, 22 bp, Artificial Sequence
  chemically synthesized
ttgagtctatcatttgcaaagc

SEQ ID NO: 1372764 - DNA, 22 bp, Artificial Sequence
  chemically synthesized
gagtctatcatttgcaaagcac

SEQ ID NO: 1372765 - DNA, 22 bp, Artificial Sequence
  chemically synthesized
agtctatcatttgcaaagcact

SEQ ID NO: 1372766 - DNA, 22 bp, Artificial Sequence
  chemically synthesized
caagtggcacaccatagtgctt

SEQ ID NO: 1372767 - DNA, 22 bp, Artificial Sequence
  chemically synthesized
ccaagtggcacaccatagtgct

SEQ ID NO: 1372768 - DNA, 22 bp, Artificial Sequence
  chemically synthesized
tccaagtggcacaccatagtgc

SEQ ID NO: 1372769 - DNA, 22 bp, Artificial Sequence
  chemically synthesized
tcatttgcaaagcactatggtg

SEQ ID NO: 1372770 - DNA, 22 bp, Artificial Sequence
  chemically synthesized
gcaaagcactatggtgtgccac

SEQ ID NO: 1372771 - DNA, 22 bp, Artificial Sequence
  chemically synthesized
caaagcactatggtgtgccact

SEQ ID NO: 1372772 - DNA, 22 bp, Artificial Sequence
  chemically synthesized
gatccctttccaagtggcacac

SEQ ID NO: 1372773 - DNA, 22 bp, Artificial Sequence
  chemically synthesized
agatccctttccaagtggcaca

SEQ ID NO: 1372774 - DNA, 22 bp, Artificial Sequence
  chemically synthesized
atttagatccctttccaagtgg

SEQ ID NO: 1372775 - DNA, 22 bp, Artificial Sequence
  chemically synthesized
taatttagatccctttccaagt

SEQ ID NO: 1372776 - DNA, 22 bp, Artificial Sequence
  chemically synthesized
tggtgtgccacttggaaaggga

SEQ ID NO: 1372777 - DNA, 22 bp, Artificial Sequence
  chemically synthesized
ggaaaaattctaatttagatcc

SEQ ID NO: 1372778 - DNA, 22 bp, Artificial Sequence
  chemically synthesized
gggaaaaattctaatttagatc

SEQ ID NO: 1372779 - DNA, 22 bp, Artificial Sequence
  chemically synthesized
tgggaaaaattctaatttagat

SEQ ID NO: 1372780 - DNA, 22 bp, Artificial Sequence
  chemically synthesized
ttgggaaaaattctaatttaga

SEQ ID NO: 1372781 - DNA, 22 bp, Artificial Sequence
  chemically synthesized
ggaaagggatctaaattagaat

SEQ ID NO: 1372782 - DNA, 22 bp, Artificial Sequence
  chemically synthesized
gaaagggatctaaattagaatt

SEQ ID NO: 1372783 - DNA, 22 bp, Artificial Sequence
  chemically synthesized
tggcttttgggaaaaattctaa

SEQ ID NO: 1372784 - DNA, 22 bp, Artificial Sequence
  chemically synthesized
gttatggcttttgggaaaaatt

SEQ ID NO: 1372785 - DNA, 22 bp, Artificial Sequence
  chemically synthesized
aattagaatttttcccaaaagc

SEQ ID NO: 1372786 - DNA, 22 bp, Artificial Sequence
  chemically synthesized
gaatttttcccaaaagccataa

SEQ ID NO: 1372787 - DNA, 22 bp, Artificial Sequence
  chemically synthesized
catgtcatatacctggttatgg

SEQ ID NO: 1372788 - DNA, 22 bp, Artificial Sequence
  chemically synthesized
ttcccaaaagccataaccaggt

SEQ ID NO: 1372789 - DNA, 22 bp, Artificial Sequence
  chemically synthesized
tcccaaaagccataaccaggta

SEQ ID NO: 1372790 - DNA, 22 bp, Artificial Sequence
  chemically synthesized
cccaaaagccataaccaggtat

SEQ ID NO: 1372791 - DNA, 22 bp, Artificial Sequence
  chemically synthesized
ccaaaagccataaccaggtata

SEQ ID NO: 1372792 - DNA, 22 bp, Artificial Sequence
  chemically synthesized
aaatgctgcatgtcatatacct

SEQ ID NO: 1372793 - DNA, 22 bp, Artificial Sequence
  chemically synthesized
aaaatgctgcatgtcatatacc

SEQ ID NO: 1372794 - DNA, 22 bp, Artificial Sequence
  chemically synthesized
taaaatgctgcatgtcatatac

SEQ ID NO: 1372795 - DNA, 22 bp, Artificial Sequence
  chemically synthesized
aagagtaccctttaaaatgctg

SEQ ID NO: 1372796 - DNA, 22 bp, Artificial Sequence
  chemically synthesized
taaagggtactcttgaattcat

SEQ ID NO: 1372797 - DNA, 22 bp, Artificial Sequence
  chemically synthesized
aaagggtactcttgaattcatt

SEQ ID NO: 1372798 - DNA, 22 bp, Artificial Sequence
  chemically synthesized
aagggtactcttgaattcattt

SEQ ID NO: 1372799 - DNA, 22 bp, Artificial Sequence
  chemically synthesized
aagtgagtacaggcatcaaaat

SEQ ID NO: 1372800 - DNA, 22 bp, Artificial Sequence
  chemically synthesized
ttgaattcattttgatgcctgt

SEQ ID NO: 1372801 - DNA, 22 bp, Artificial Sequence
  chemically synthesized
gaattcattttgatgcctgtac

SEQ ID NO: 1372802 - DNA, 22 bp, Artificial Sequence
  chemically synthesized
aattcattttgatgcctgtact

SEQ ID NO: 1372803 - DNA, 22 bp, Artificial Sequence
  chemically synthesized
attttgatgcctgtactcactt

SEQ ID NO: 1372804 - DNA, 22 bp, Artificial Sequence
  chemically synthesized
tgatgcctgtactcacttgagc

SEQ ID NO: 1372805 - DNA, 22 bp, Artificial Sequence
  chemically synthesized
taaaacatatgtgctcaagtga

SEQ ID NO: 1372806 - DNA, 22 bp, Artificial Sequence
  chemically synthesized
gatgcctgtactcacttgagca

SEQ ID NO: 1372807 - DNA, 22 bp, Artificial Sequence
  chemically synthesized
atgcctgtactcacttgagcac

SEQ ID NO: 1372808 - DNA, 22 bp, Artificial Sequence
  chemically synthesized
aaagttgtaaaacatatgtgct

SEQ ID NO: 1372809 - DNA, 22 bp, Artificial Sequence
  chemically synthesized
caaagttgtaaaacatatgtgc

SEQ ID NO: 1372810 - DNA, 22 bp, Artificial Sequence
  chemically synthesized
tactcacttgagcacatatgtt

SEQ ID NO: 1372811 - DNA, 22 bp, Artificial Sequence
  chemically synthesized
acttgagcacatatgttttaca

SEQ ID NO: 1372812 - DNA, 22 bp, Artificial Sequence
  chemically synthesized
gagcacatatgttttacaactt

SEQ ID NO: 1372813 - DNA, 22 bp, Artificial Sequence
  chemically synthesized
agcacatatgttttacaacttt

SEQ ID NO: 1372814 - DNA, 22 bp, Artificial Sequence
  chemically synthesized
agagagggaggtcttcaaagtt

SEQ ID NO: 1372815 - DNA, 22 bp, Artificial Sequence
  chemically synthesized
tacaactttgaagacctccctc

SEQ ID NO: 1372816 - DNA, 22 bp, Artificial Sequence
  chemically synthesized
acaactttgaagacctccctct

SEQ ID NO: 1372817 - DNA, 22 bp, Artificial Sequence
  chemically synthesized
caactttgaagacctccctctc

SEQ ID NO: 1372818 - DNA, 22 bp, Artificial Sequence
  chemically synthesized
gaacccagctaagagagggagg

SEQ ID NO: 1372819 - DNA, 22 bp, Artificial Sequence
  chemically synthesized
tgaagacctccctctcttagct

SEQ ID NO: 1372820 - DNA, 22 bp, Artificial Sequence
  chemically synthesized
gaagacctccctctcttagctg

SEQ ID NO: 1372821 - DNA, 22 bp, Artificial Sequence
  chemically synthesized
aagacctccctctcttagctgg

SEQ ID NO: 1372822 - DNA, 22 bp, Artificial Sequence
  chemically synthesized
tgtgagctagaacccagctaag

SEQ ID NO: 1372823 - DNA, 22 bp, Artificial Sequence
  chemically synthesized
cctctcttagctgggttctagc

SEQ ID NO: 1372824 - DNA, 22 bp, Artificial Sequence
  chemically synthesized
gagcattgtgtgagctagaacc

SEQ ID NO: 1372825 - DNA, 22 bp, Artificial Sequence
  chemically synthesized
tcttagctgggttctagctcac

SEQ ID NO: 1372826 - DNA, 22 bp, Artificial Sequence
  chemically synthesized
ttagctgggttctagctcacac

SEQ ID NO: 1372827 - DNA, 22 bp, Artificial Sequence
  chemically synthesized
agctgggttctagctcacacaa

SEQ ID NO: 1372828 - DNA, 22 bp, Artificial Sequence
  chemically synthesized
aatgctggagcattgtgtgagc

SEQ ID NO: 1372829 - DNA, 22 bp, Artificial Sequence
  chemically synthesized
gctgggttctagctcacacaat

SEQ ID NO: 1372830 - DNA, 22 bp, Artificial Sequence
  chemically synthesized
caatgctggagcattgtgtgag

SEQ ID NO: 1372831 - DNA, 22 bp, Artificial Sequence
  chemically synthesized
ggttctagctcacacaatgctc

SEQ ID NO: 1372832 - DNA, 22 bp, Artificial Sequence
  chemically synthesized
aacatcttcaatgctggagcat

SEQ ID NO: 1372833 - DNA, 22 bp, Artificial Sequence
  chemically synthesized
tagctcacacaatgctccagca

SEQ ID NO: 1372834 - DNA, 22 bp, Artificial Sequence
  chemically synthesized
caacatcttcaatgctggagca

SEQ ID NO: 1372835 - DNA, 22 bp, Artificial Sequence
  chemically synthesized
tcaacatcttcaatgctggagc

SEQ ID NO: 1372836 - DNA, 22 bp, Artificial Sequence
  chemically synthesized
gctcacacaatgctccagcatt

SEQ ID NO: 1372837 - DNA, 22 bp, Artificial Sequence
  chemically synthesized
ttcaacatcttcaatgctggag

SEQ ID NO: 1372838 - DNA, 22 bp, Artificial Sequence
  chemically synthesized
tttcaacatcttcaatgctgga

SEQ ID NO: 1372839 - DNA, 22 bp, Artificial Sequence
  chemically synthesized
ttttcaacatcttcaatgctgg

SEQ ID NO: 1372840 - DNA, 22 bp, Artificial Sequence
  chemically synthesized
acacaatgctccagcattgaag

SEQ ID NO: 1372841 - DNA, 22 bp, Artificial Sequence
  chemically synthesized
agacacatcttttttcaacatc

SEQ ID NO: 1372842 - DNA, 22 bp, Artificial Sequence
  chemically synthesized
cagcattgaagatgttgaaaaa

SEQ ID NO: 1372843 - DNA, 22 bp, Artificial Sequence
  chemically synthesized
aagatgttgaaaaaagatgtgt

SEQ ID NO: 1372844 - DNA, 22 bp, Artificial Sequence
  chemically synthesized
tgtgtgtgtgaatattcagaca

SEQ ID NO: 1372845 - DNA, 22 bp, Artificial Sequence
  chemically synthesized
gtgtgtgtgtgaatattcagac

SEQ ID NO: 1372846 - DNA, 22 bp, Artificial Sequence
  chemically synthesized
aaaaaagatgtgtctgaatatt

SEQ ID NO: 1372847 - DNA, 22 bp, Artificial Sequence
  chemically synthesized
tcacttgtgtgtgtgtgaatat

SEQ ID NO: 1372848 - DNA, 22 bp, Artificial Sequence
  chemically synthesized
aatattcacacacacacaagtg

SEQ ID NO: 1372849 - DNA, 22 bp, Artificial Sequence
  chemically synthesized
tgtaggtattatcacttgtgtg

SEQ ID NO: 1372850 - DNA, 22 bp, Artificial Sequence
  chemically synthesized
acacacacacaagtgataatac

SEQ ID NO: 1372851 - DNA, 22 bp, Artificial Sequence
  chemically synthesized
ataaaccatcaacccagtatta

SEQ ID NO: 1372852 - DNA, 22 bp, Artificial Sequence
  chemically synthesized
aataaaccatcaacccagtatt

SEQ ID NO: 1372853 - DNA, 22 bp, Artificial Sequence
  chemically synthesized
taataaaccatcaacccagtat

SEQ ID NO: 1372854 - DNA, 22 bp, Artificial Sequence
  chemically synthesized
tgttttaataaaccatcaaccc

SEQ ID NO: 1372855 - DNA, 22 bp, Artificial Sequence
  chemically synthesized
gtgttttaataaaccatcaacc

SEQ ID NO: 1372856 - DNA, 22 bp, Artificial Sequence
  chemically synthesized
cataatactgggttgatggttt

SEQ ID NO: 1372857 - DNA, 22 bp, Artificial Sequence
  chemically synthesized
ttgtgttttaataaaccatcaa

SEQ ID NO: 1372858 - DNA, 22 bp, Artificial Sequence
  chemically synthesized
cttgtgttttaataaaccatca

SEQ ID NO: 1372859 - DNA, 22 bp, Artificial Sequence
  chemically synthesized
gatgcttcttgtgttttaataa

SEQ ID NO: 1372860 - DNA, 22 bp, Artificial Sequence
  chemically synthesized
agatgcttcttgtgttttaata

SEQ ID NO: 1372861 - DNA, 22 bp, Artificial Sequence
  chemically synthesized
ggttgatggtttattaaaacac

SEQ ID NO: 1372862 - DNA, 22 bp, Artificial Sequence
  chemically synthesized
atggtttattaaaacacaagaa

SEQ ID NO: 1372863 - DNA, 22 bp, Artificial Sequence
  chemically synthesized
tggggcagtttagatgcttctt

SEQ ID NO: 1372864 - DNA, 22 bp, Artificial Sequence
  chemically synthesized
gtggggcagtttagatgcttct

SEQ ID NO: 1372865 - DNA, 22 bp, Artificial Sequence
  chemically synthesized
attaaaacacaagaagcatcta

SEQ ID NO: 1372866 - DNA, 22 bp, Artificial Sequence
  chemically synthesized
ttaaaacacaagaagcatctaa

SEQ ID NO: 1372867 - DNA, 22 bp, Artificial Sequence
  chemically synthesized
aaacacaagaagcatctaaact

SEQ ID NO: 1372868 - DNA, 22 bp, Artificial Sequence
  chemically synthesized
aatatgcatgatatttgtgggg

SEQ ID NO: 1372869 - DNA, 22 bp, Artificial Sequence
  chemically synthesized
taaatatgcatgatatttgtgg

SEQ ID NO: 1372870 - DNA, 22 bp, Artificial Sequence
  chemically synthesized
ctaaatatgcatgatatttgtg

SEQ ID NO: 1372871 - DNA, 22 bp, Artificial Sequence
  chemically synthesized
aactgccccacaaatatcatgc

SEQ ID NO: 1372872 - DNA, 22 bp, Artificial Sequence
  chemically synthesized
gtatttctaaatatgcatgata

SEQ ID NO: 1372873 - DNA, 22 bp, Artificial Sequence
  chemically synthesized
ccccacaaatatcatgcatatt

SEQ ID NO: 1372874 - DNA, 22 bp, Artificial Sequence
  chemically synthesized
agaaataccagattcattttgc

SEQ ID NO: 1372875 - DNA, 22 bp, Artificial Sequence
  chemically synthesized
gaaataccagattcattttgca

SEQ ID NO: 1372876 - DNA, 22 bp, Artificial Sequence
  chemically synthesized
tataaggaatccacaagatatg

SEQ ID NO: 1372877 - DNA, 22 bp, Artificial Sequence
  chemically synthesized
attttgcatatcttgtggattc

SEQ ID NO: 1372878 - DNA, 22 bp, Artificial Sequence
  chemically synthesized
tgcatatcttgtggattcctta

SEQ ID NO: 1372879 - DNA, 22 bp, Artificial Sequence
  chemically synthesized
gcatatcttgtggattccttat

SEQ ID NO: 1372880 - DNA, 22 bp, Artificial Sequence
  chemically synthesized
catatcttgtggattccttata

SEQ ID NO: 1372881 - DNA, 22 bp, Artificial Sequence
  chemically synthesized
gtggattccttatacagcaccc

SEQ ID NO: 1372882 - DNA, 22 bp, Artificial Sequence
  chemically synthesized
tggattccttatacagcaccct

SEQ ID NO: 1372883 - DNA, 22 bp, Artificial Sequence
  chemically synthesized
cttatacagcaccctctctccc

SEQ ID NO: 1372884 - DNA, 22 bp, Artificial Sequence
  chemically synthesized
atacagcaccctctctcccccc

SEQ ID NO: 1372885 - DNA, 22 bp, Artificial Sequence
  chemically synthesized
tacagcaccctctctcccccct

SEQ ID NO: 1372886 - DNA, 22 bp, Artificial Sequence
  chemically synthesized
tctcccccctgtttgtgtgtgt

SEQ ID NO: 1372887 - DNA, 22 bp, Artificial Sequence
  chemically synthesized
tcccccctgtttgtgtgtgtat

SEQ ID NO: 1372888 - DNA, 22 bp, Artificial Sequence
  chemically synthesized
acacacacacacatacacacac

SEQ ID NO: 1372889 - DNA, 22 bp, Artificial Sequence
  chemically synthesized
ccccctgtttgtgtgtgtatgt

SEQ ID NO: 1372890 - DNA, 22 bp, Artificial Sequence
  chemically synthesized
tttgtgtgtgtatgtgtgtgtg

SEQ ID NO: 1372891 - DNA, 22 bp, Artificial Sequence
  chemically synthesized
gtgtgtgtatgtgtgtgtgtgt

SEQ ID NO: 1372892 - DNA, 22 bp, Artificial Sequence
  chemically synthesized
tgtgtgtatgtgtgtgtgtgtt

SEQ ID NO: 1372893 - DNA, 22 bp, Artificial Sequence
  chemically synthesized
cacacagacacacacattaaca

SEQ ID NO: 1372894 - DNA, 22 bp, Artificial Sequence
  chemically synthesized
cacatctacacacagacacaca

SEQ ID NO: 1372895 - DNA, 22 bp, Artificial Sequence
  chemically synthesized
tacacatctacacacagacaca

SEQ ID NO: 1372896 - DNA, 22 bp, Artificial Sequence
  chemically synthesized
ctacacatctacacacagacac

SEQ ID NO: 1372897 - DNA, 22 bp, Artificial Sequence
  chemically synthesized
cttctacacatctacacacaga

SEQ ID NO: 1372898 - DNA, 22 bp, Artificial Sequence
  chemically synthesized
atgtgtgtgtctgtgtgtagat

SEQ ID NO: 1372899 - DNA, 22 bp, Artificial Sequence
  chemically synthesized
gattccttctacacatctacac

SEQ ID NO: 1372900 - DNA, 22 bp, Artificial Sequence
  chemically synthesized
gaaatactagattccttctaca

SEQ ID NO: 1372901 - DNA, 22 bp, Artificial Sequence
  chemically synthesized
agaaatactagattccttctac

SEQ ID NO: 1372902 - DNA, 22 bp, Artificial Sequence
  chemically synthesized
tgtgtagatgtgtagaaggaat

SEQ ID NO: 1372903 - DNA, 22 bp, Artificial Sequence
  chemically synthesized
tcatgtgaatttagaaatacta

SEQ ID NO: 1372904 - DNA, 22 bp, Artificial Sequence
  chemically synthesized
gtatttctaaattcacatgata

SEQ ID NO: 1372905 - DNA, 22 bp, Artificial Sequence
  chemically synthesized
aaatgccccacaattatcatgt

SEQ ID NO: 1372906 - DNA, 22 bp, Artificial Sequence
  chemically synthesized
ctaaattcacatgataattgtg

SEQ ID NO: 1372907 - DNA, 22 bp, Artificial Sequence
  chemically synthesized
taaattcacatgataattgtgg

SEQ ID NO: 1372908 - DNA, 22 bp, Artificial Sequence
  chemically synthesized
aattcacatgataattgtgggg

SEQ ID NO: 1372909 - DNA, 22 bp, Artificial Sequence
  chemically synthesized
acatgataattgtggggcattt

SEQ ID NO: 1372910 - DNA, 22 bp, Artificial Sequence
  chemically synthesized
aatcacaaaaagcatctaaaat

SEQ ID NO: 1372911 - DNA, 22 bp, Artificial Sequence
  chemically synthesized
ttcaatcacaaaaagcatctaa

SEQ ID NO: 1372912 - DNA, 22 bp, Artificial Sequence
  chemically synthesized
attcaatcacaaaaagcatcta

SEQ ID NO: 1372913 - DNA, 22 bp, Artificial Sequence
  chemically synthesized
tggggcattttagatgcttttt

SEQ ID NO: 1372914 - DNA, 22 bp, Artificial Sequence
  chemically synthesized
atggtttattcaatcacaaaaa

SEQ ID NO: 1372915 - DNA, 22 bp, Artificial Sequence
  chemically synthesized
tagatgctttttgtgattgaat

SEQ ID NO: 1372916 - DNA, 22 bp, Artificial Sequence
  chemically synthesized
tgttaatggtttattcaatcac

SEQ ID NO: 1372917 - DNA, 22 bp, Artificial Sequence
  chemically synthesized
agatgctttttgtgattgaata

SEQ ID NO: 1372918 - DNA, 22 bp, Artificial Sequence
  chemically synthesized
gatgctttttgtgattgaataa

SEQ ID NO: 1372919 - DNA, 22 bp, Artificial Sequence
  chemically synthesized
tttgtgattgaataaaccatta

SEQ ID NO: 1372920 - DNA, 22 bp, Artificial Sequence
  chemically synthesized
ttgtgattgaataaaccattaa

SEQ ID NO: 1372921 - DNA, 22 bp, Artificial Sequence
  chemically synthesized
cacaatactgtgttaatggttt

SEQ ID NO: 1372922 - DNA, 22 bp, Artificial Sequence
  chemically synthesized
tgtgattgaataaaccattaac

SEQ ID NO: 1372923 - DNA, 22 bp, Artificial Sequence
  chemically synthesized
acacaatactgtgttaatggtt

SEQ ID NO: 1372924 - DNA, 22 bp, Artificial Sequence
  chemically synthesized
gtgattgaataaaccattaaca

SEQ ID NO: 1372925 - DNA, 22 bp, Artificial Sequence
  chemically synthesized
tgattgaataaaccattaacac

SEQ ID NO: 1372926 - DNA, 22 bp, Artificial Sequence
  chemically synthesized
cttacacaatactgtgttaatg

SEQ ID NO: 1372927 - DNA, 22 bp, Artificial Sequence
  chemically synthesized
tacttacacaatactgtgttaa

SEQ ID NO: 1372928 - DNA, 22 bp, Artificial Sequence
  chemically synthesized
aataaaccattaacacagtatt

SEQ ID NO: 1372929 - DNA, 22 bp, Artificial Sequence
  chemically synthesized
acacagtattgtgtaagtagaa

SEQ ID NO: 1372930 - DNA, 22 bp, Artificial Sequence
  chemically synthesized
caaaatgtgaataattctactt

SEQ ID NO: 1372931 - DNA, 22 bp, Artificial Sequence
  chemically synthesized
tctgcaaaatgtgaataattct

SEQ ID NO: 1372932 - DNA, 22 bp, Artificial Sequence
  chemically synthesized
atctgcaaaatgtgaataattc

SEQ ID NO: 1372933 - DNA, 22 bp, Artificial Sequence
  chemically synthesized
ttatctgcaaaatgtgaataat

SEQ ID NO: 1372934 - DNA, 22 bp, Artificial Sequence
  chemically synthesized
cttatctgcaaaatgtgaataa

SEQ ID NO: 1372935 - DNA, 22 bp, Artificial Sequence
  chemically synthesized
tgtaagtagaattattcacatt

SEQ ID NO: 1372936 - DNA, 22 bp, Artificial Sequence
  chemically synthesized
tcttatctgcaaaatgtgaata

SEQ ID NO: 1372937 - DNA, 22 bp, Artificial Sequence
  chemically synthesized
agttttcttatctgcaaaatgt

SEQ ID NO: 1372938 - DNA, 22 bp, Artificial Sequence
  chemically synthesized
aatctcagttttcttatctgca

SEQ ID NO: 1372939 - DNA, 22 bp, Artificial Sequence
  chemically synthesized
ttcacattttgcagataagaaa

SEQ ID NO: 1372940 - DNA, 22 bp, Artificial Sequence
  chemically synthesized
ctaaatctcagttttcttatct

SEQ ID NO: 1372941 - DNA, 22 bp, Artificial Sequence
  chemically synthesized
actaaatctcagttttcttatc

SEQ ID NO: 1372942 - DNA, 22 bp, Artificial Sequence
  chemically synthesized
acattttgcagataagaaaact

SEQ ID NO: 1372943 - DNA, 22 bp, Artificial Sequence
  chemically synthesized
tgcagataagaaaactgagatt

SEQ ID NO: 1372944 - DNA, 22 bp, Artificial Sequence
  chemically synthesized
gcagataagaaaactgagattt

SEQ ID NO: 1372945 - DNA, 22 bp, Artificial Sequence
  chemically synthesized
cagataagaaaactgagattta

SEQ ID NO: 1372946 - DNA, 22 bp, Artificial Sequence
  chemically synthesized
gacaaaaaacttactaaatctc

SEQ ID NO: 1372947 - DNA, 22 bp, Artificial Sequence
  chemically synthesized
ggacaaaaaacttactaaatct

SEQ ID NO: 1372948 - DNA, 22 bp, Artificial Sequence
  chemically synthesized
tggacaaaaaacttactaaatc

SEQ ID NO: 1372949 - DNA, 22 bp, Artificial Sequence
  chemically synthesized
tagctttggacaaaaaacttac

SEQ ID NO: 1372950 - DNA, 22 bp, Artificial Sequence
  chemically synthesized
agatttagtaagttttttgtcc

SEQ ID NO: 1372951 - DNA, 22 bp, Artificial Sequence
  chemically synthesized
ggttatagctttggacaaaaaa

SEQ ID NO: 1372952 - DNA, 22 bp, Artificial Sequence
  chemically synthesized
agtaagttttttgtccaaagct

SEQ ID NO: 1372953 - DNA, 22 bp, Artificial Sequence
  chemically synthesized
gtaagttttttgtccaaagcta

SEQ ID NO: 1372954 - DNA, 22 bp, Artificial Sequence
  chemically synthesized
aaatctcggttatagctttgga

SEQ ID NO: 1372955 - DNA, 22 bp, Artificial Sequence
  chemically synthesized
aaaatctcggttatagctttgg

SEQ ID NO: 1372956 - DNA, 22 bp, Artificial Sequence
  chemically synthesized
taaaatctcggttatagctttg

SEQ ID NO: 1372957 - DNA, 22 bp, Artificial Sequence
  chemically synthesized
tttgtccaaagctataaccgag

SEQ ID NO: 1372958 - DNA, 22 bp, Artificial Sequence
  chemically synthesized
ttgtccaaagctataaccgaga

SEQ ID NO: 1372959 - DNA, 22 bp, Artificial Sequence
  chemically synthesized
tgtccaaagctataaccgagat

SEQ ID NO: 1372960 - DNA, 22 bp, Artificial Sequence
  chemically synthesized
gtccaaagctataaccgagatt

SEQ ID NO: 1372961 - DNA, 22 bp, Artificial Sequence
  chemically synthesized
tccaaagctataaccgagattt

SEQ ID NO: 1372962 - DNA, 22 bp, Artificial Sequence
  chemically synthesized
acgtcacaggactttaaaatct

SEQ ID NO: 1372963 - DNA, 22 bp, Artificial Sequence
  chemically synthesized
aacgtcacaggactttaaaatc

SEQ ID NO: 1372964 - DNA, 22 bp, Artificial Sequence
  chemically synthesized
taaccgagattttaaagtcctg

SEQ ID NO: 1372965 - DNA, 22 bp, Artificial Sequence
  chemically synthesized
gggtttaacgtcacaggacttt

SEQ ID NO: 1372966 - DNA, 22 bp, Artificial Sequence
  chemically synthesized
agggtttaacgtcacaggactt

SEQ ID NO: 1372967 - DNA, 22 bp, Artificial Sequence
  chemically synthesized
tagggtttaacgtcacaggact

SEQ ID NO: 1372968 - DNA, 22 bp, Artificial Sequence
  chemically synthesized
taaagtcctgtgacgttaaacc

SEQ ID NO: 1372969 - DNA, 22 bp, Artificial Sequence
  chemically synthesized
aaagtcctgtgacgttaaaccc

SEQ ID NO: 1372970 - DNA, 22 bp, Artificial Sequence
  chemically synthesized
aagtcctgtgacgttaaaccct

SEQ ID NO: 1372971 - DNA, 22 bp, Artificial Sequence
  chemically synthesized
aaagcatatgttttagggttta

SEQ ID NO: 1372972 - DNA, 22 bp, Artificial Sequence
  chemically synthesized
tgacgttaaaccctaaaacata

SEQ ID NO: 1372973 - DNA, 22 bp, Artificial Sequence
  chemically synthesized
tgatactaaaagcatatgtttt

SEQ ID NO: 1372974 - DNA, 22 bp, Artificial Sequence
  chemically synthesized
aaccctaaaacatatgctttta

SEQ ID NO: 1372975 - DNA, 22 bp, Artificial Sequence
  chemically synthesized
aaacatatgcttttagtatcat

SEQ ID NO: 1372976 - DNA, 22 bp, Artificial Sequence
  chemically synthesized
gtaaccatggtaaagattatga

SEQ ID NO: 1372977 - DNA, 22 bp, Artificial Sequence
  chemically synthesized
ttagtatcataatctttaccat

SEQ ID NO: 1372978 - DNA, 22 bp, Artificial Sequence
  chemically synthesized
tagtatcataatctttaccatg

SEQ ID NO: 1372979 - DNA, 22 bp, Artificial Sequence
  chemically synthesized
agtatcataatctttaccatgg

SEQ ID NO: 1372980 - DNA, 22 bp, Artificial Sequence
  chemically synthesized
gtatcataatctttaccatggt

SEQ ID NO: 1372981 - DNA, 22 bp, Artificial Sequence
  chemically synthesized
acatgtcatctggtaaccatgg

SEQ ID NO: 1372982 - DNA, 22 bp, Artificial Sequence
  chemically synthesized
aacatgtcatctggtaaccatg

SEQ ID NO: 1372983 - DNA, 22 bp, Artificial Sequence
  chemically synthesized
taacatgtcatctggtaaccat

SEQ ID NO: 1372984 - DNA, 22 bp, Artificial Sequence
  chemically synthesized
ttaacatgtcatctggtaacca

SEQ ID NO: 1372985 - DNA, 22 bp, Artificial Sequence
  chemically synthesized
taccatggttaccagatgacat

SEQ ID NO: 1372986 - DNA, 22 bp, Artificial Sequence
  chemically synthesized
accatggttaccagatgacatg

SEQ ID NO: 1372987 - DNA, 22 bp, Artificial Sequence
  chemically synthesized
gcagatttttaacatgtcatct

SEQ ID NO: 1372988 - DNA, 22 bp, Artificial Sequence
  chemically synthesized
ccatggttaccagatgacatgt

SEQ ID NO: 1372989 - DNA, 22 bp, Artificial Sequence
  chemically synthesized
agcagatttttaacatgtcatc

SEQ ID NO: 1372990 - DNA, 22 bp, Artificial Sequence
  chemically synthesized
cttagcagatttttaacatgtc

SEQ ID NO: 1372991 - DNA, 22 bp, Artificial Sequence
  chemically synthesized
acttagcagatttttaacatgt

SEQ ID NO: 1372992 - DNA, 22 bp, Artificial Sequence
  chemically synthesized
tacttagcagatttttaacatg

SEQ ID NO: 1372993 - DNA, 22 bp, Artificial Sequence
  chemically synthesized
ccagatgacatgttaaaaatct

SEQ ID NO: 1372994 - DNA, 22 bp, Artificial Sequence
  chemically synthesized
tcctttacttagcagattttta

SEQ ID NO: 1372995 - DNA, 22 bp, Artificial Sequence
  chemically synthesized
gtgtcctatcctttacttagca

SEQ ID NO: 1372996 - DNA, 22 bp, Artificial Sequence
  chemically synthesized
ttggtgtcctatcctttactta

SEQ ID NO: 1372997 - DNA, 22 bp, Artificial Sequence
  chemically synthesized
aaaatctgctaagtaaaggata

SEQ ID NO: 1372998 - DNA, 22 bp, Artificial Sequence
  chemically synthesized
ggttattggtgtcctatccttt

SEQ ID NO: 1372999 - DNA, 22 bp, Artificial Sequence
  chemically synthesized
gggttattggtgtcctatcctt

SEQ ID NO: 1373000 - DNA, 22 bp, Artificial Sequence
  chemically synthesized
ctaagtaaaggataggacacca

SEQ ID NO: 1373001 - DNA, 22 bp, Artificial Sequence
  chemically synthesized
ataatttgggttattggtgtcc

SEQ ID NO: 1373002 - DNA, 22 bp, Artificial Sequence
  chemically synthesized
agtaaaggataggacaccaata

SEQ ID NO: 1373003 - DNA, 22 bp, Artificial Sequence
  chemically synthesized
aataatttgggttattggtgtc

SEQ ID NO: 1373004 - DNA, 22 bp, Artificial Sequence
  chemically synthesized
gatagcatttaataatttgggt

SEQ ID NO: 1373005 - DNA, 22 bp, Artificial Sequence
  chemically synthesized
aacctagatagcatttaataat

SEQ ID NO: 1373006 - DNA, 22 bp, Artificial Sequence
  chemically synthesized
aaacctagatagcatttaataa

SEQ ID NO: 1373007 - DNA, 22 bp, Artificial Sequence
  chemically synthesized
acttaaacctagatagcattta

SEQ ID NO: 1373008 - DNA, 22 bp, Artificial Sequence
  chemically synthesized
ttaaatgctatctaggtttaag

SEQ ID NO: 1373009 - DNA, 22 bp, Artificial Sequence
  chemically synthesized
atggaagccctcacttaaacct

SEQ ID NO: 1373010 - DNA, 22 bp, Artificial Sequence
  chemically synthesized
aatgctatctaggtttaagtga

SEQ ID NO: 1373011 - DNA, 22 bp, Artificial Sequence
  chemically synthesized
agtattgatggaagccctcact

SEQ ID NO: 1373012 - DNA, 22 bp, Artificial Sequence
  chemically synthesized
tctaggtttaagtgagggcttc

SEQ ID NO: 1373013 - DNA, 22 bp, Artificial Sequence
  chemically synthesized
tcagtattgatggaagccctca

SEQ ID NO: 1373014 - DNA, 22 bp, Artificial Sequence
  chemically synthesized
ctcagtattgatggaagccctc

SEQ ID NO: 1373015 - DNA, 22 bp, Artificial Sequence
  chemically synthesized
tctcagtattgatggaagccct

SEQ ID NO: 1373016 - DNA, 22 bp, Artificial Sequence
  chemically synthesized
ggtttaagtgagggcttccatc

SEQ ID NO: 1373017 - DNA, 22 bp, Artificial Sequence
  chemically synthesized
aagtgagggcttccatcaatac

SEQ ID NO: 1373018 - DNA, 22 bp, Artificial Sequence
  chemically synthesized
agtgagggcttccatcaatact

SEQ ID NO: 1373019 - DNA, 22 bp, Artificial Sequence
  chemically synthesized
ccatcaatactgagaaaacttt

SEQ ID NO: 1373020 - DNA, 22 bp, Artificial Sequence
  chemically synthesized
catcaatactgagaaaactttg

SEQ ID NO: 1373021 - DNA, 22 bp, Artificial Sequence
  chemically synthesized
agaaaactttgcctgcatgcac

SEQ ID NO: 1373022 - DNA, 22 bp, Artificial Sequence
  chemically synthesized
gtaagtagcaagggtgcatgca

SEQ ID NO: 1373023 - DNA, 22 bp, Artificial Sequence
  chemically synthesized
attggtaagtagcaagggtgca

SEQ ID NO: 1373024 - DNA, 22 bp, Artificial Sequence
  chemically synthesized
ttaattggtaagtagcaagggt

SEQ ID NO: 1373025 - DNA, 22 bp, Artificial Sequence
  chemically synthesized
tgcctgcatgcacccttgctac

SEQ ID NO: 1373026 - DNA, 22 bp, Artificial Sequence
  chemically synthesized
gcctgcatgcacccttgctact

SEQ ID NO: 1373027 - DNA, 22 bp, Artificial Sequence
  chemically synthesized
cctgcatgcacccttgctactt

SEQ ID NO: 1373028 - DNA, 22 bp, Artificial Sequence
  chemically synthesized
catgcacccttgctacttacca

SEQ ID NO: 1373029 - DNA, 22 bp, Artificial Sequence
  chemically synthesized
gctacttaccaattaacagcat

SEQ ID NO: 1373030 - DNA, 22 bp, Artificial Sequence
  chemically synthesized
ctacttaccaattaacagcatc

SEQ ID NO: 1373031 - DNA, 22 bp, Artificial Sequence
  chemically synthesized
atatataacggcgatgctgtta

SEQ ID NO: 1373032 - DNA, 22 bp, Artificial Sequence
  chemically synthesized
cttaccaattaacagcatcgcc

SEQ ID NO: 1373033 - DNA, 22 bp, Artificial Sequence
  chemically synthesized
accaattaacagcatcgccgtt

SEQ ID NO: 1373034 - DNA, 22 bp, Artificial Sequence
  chemically synthesized
ccaattaacagcatcgccgtta

SEQ ID NO: 1373035 - DNA, 22 bp, Artificial Sequence
  chemically synthesized
acaagctcatatataacggcga

SEQ ID NO: 1373036 - DNA, 22 bp, Artificial Sequence
  chemically synthesized
aacaagctcatatataacggcg

SEQ ID NO: 1373037 - DNA, 22 bp, Artificial Sequence
  chemically synthesized
cttaacaagctcatatataacg

SEQ ID NO: 1373038 - DNA, 22 bp, Artificial Sequence
  chemically synthesized
acttaacaagctcatatataac

SEQ ID NO: 1373039 - DNA, 22 bp, Artificial Sequence
  chemically synthesized
acagcatcgccgttatatatga

SEQ ID NO: 1373040 - DNA, 22 bp, Artificial Sequence
  chemically synthesized
aacatcttacttaacaagctca

SEQ ID NO: 1373041 - DNA, 22 bp, Artificial Sequence
  chemically synthesized
tatatgagcttgttaagtaaga

SEQ ID NO: 1373042 - DNA, 22 bp, Artificial Sequence
  chemically synthesized
gttaagtaagatgttgaatact

SEQ ID NO: 1373043 - DNA, 22 bp, Artificial Sequence
  chemically synthesized
ttaagtaagatgttgaatactg

SEQ ID NO: 1373044 - DNA, 22 bp, Artificial Sequence
  chemically synthesized
agtaagatgttgaatactggcc

SEQ ID NO: 1373045 - DNA, 22 bp, Artificial Sequence
  chemically synthesized
caagtgtgagccaccacacccg

SEQ ID NO: 1373046 - DNA, 22 bp, Artificial Sequence
  chemically synthesized
aatactggccgggtgtggtggc

SEQ ID NO: 1373047 - DNA, 22 bp, Artificial Sequence
  chemically synthesized
ggattacaagtgtgagccacca

SEQ ID NO: 1373048 - DNA, 22 bp, Artificial Sequence
  chemically synthesized
tgggattacaagtgtgagccac

SEQ ID NO: 1373049 - DNA, 22 bp, Artificial Sequence
  chemically synthesized
gccgggtgtggtggctcacact

SEQ ID NO: 1373050 - DNA, 22 bp, Artificial Sequence
  chemically synthesized
ccaaagttctgggattacaagt

SEQ ID NO: 1373051 - DNA, 22 bp, Artificial Sequence
  chemically synthesized
agcctcccaaagttctgggatt

SEQ ID NO: 1373052 - DNA, 22 bp, Artificial Sequence
  chemically synthesized
acacttgtaatcccagaacttt

SEQ ID NO: 1373053 - DNA, 22 bp, Artificial Sequence
  chemically synthesized
accccctcagcctcccaaagtt

SEQ ID NO: 1373054 - DNA, 22 bp, Artificial Sequence
  chemically synthesized
gtaatcccagaactttgggagg

SEQ ID NO: 1373055 - DNA, 22 bp, Artificial Sequence
  chemically synthesized
taatcccagaactttgggaggc

SEQ ID NO: 1373056 - DNA, 22 bp, Artificial Sequence
  chemically synthesized
aagtgatctaaccccctcagcc

SEQ ID NO: 1373057 - DNA, 22 bp, Artificial Sequence
  chemically synthesized
acctcaagtgatctaaccccct

SEQ ID NO: 1373058 - DNA, 22 bp, Artificial Sequence
  chemically synthesized
tgggaggctgagggggttagat

SEQ ID NO: 1373059 - DNA, 22 bp, Artificial Sequence
  chemically synthesized
gggaggctgagggggttagatc

SEQ ID NO: 1373060 - DNA, 22 bp, Artificial Sequence
  chemically synthesized
ctgacctcaagtgatctaaccc

SEQ ID NO: 1373061 - DNA, 22 bp, Artificial Sequence
  chemically synthesized
ggaggctgagggggttagatca

SEQ ID NO: 1373062 - DNA, 22 bp, Artificial Sequence
  chemically synthesized
gaactcctgacctcaagtgatc

SEQ ID NO: 1373063 - DNA, 22 bp, Artificial Sequence
  chemically synthesized
agggggttagatcacttgaggt

SEQ ID NO: 1373064 - DNA, 22 bp, Artificial Sequence
  chemically synthesized
gtctcgaactcctgacctcaag

SEQ ID NO: 1373065 - DNA, 22 bp, Artificial Sequence
  chemically synthesized
gatcacttgaggtcaggagttc

SEQ ID NO: 1373066 - DNA, 22 bp, Artificial Sequence
  chemically synthesized
gccaggctggtctcgaactcct

SEQ ID NO: 1373067 - DNA, 22 bp, Artificial Sequence
  chemically synthesized
gaggtcaggagttcgagaccag

SEQ ID NO: 1373068 - DNA, 22 bp, Artificial Sequence
  chemically synthesized
aggtcaggagttcgagaccagc

SEQ ID NO: 1373069 - DNA, 22 bp, Artificial Sequence
  chemically synthesized
accatgttggccaggctggtct

SEQ ID NO: 1373070 - DNA, 22 bp, Artificial Sequence
  chemically synthesized
caccatgttggccaggctggtc

SEQ ID NO: 1373071 - DNA, 22 bp, Artificial Sequence
  chemically synthesized
gagaccagcctggccaacatgg

SEQ ID NO: 1373072 - DNA, 22 bp, Artificial Sequence
  chemically synthesized
gtagagacggtgtttcaccatg

SEQ ID NO: 1373073 - DNA, 22 bp, Artificial Sequence
  chemically synthesized
agtagagacggtgtttcaccat

SEQ ID NO: 1373074 - DNA, 22 bp, Artificial Sequence
  chemically synthesized
tagtagagacggtgtttcacca

SEQ ID NO: 1373075 - DNA, 22 bp, Artificial Sequence
  chemically synthesized
ttagtagagacggtgtttcacc

SEQ ID NO: 1373076 - DNA, 22 bp, Artificial Sequence
  chemically synthesized
gccaacatggtgaaacaccgtc

SEQ ID NO: 1373077 - DNA, 22 bp, Artificial Sequence
  chemically synthesized
tatttttagtagagacggtgtt

SEQ ID NO: 1373078 - DNA, 22 bp, Artificial Sequence
  chemically synthesized
gtatttttagtagagacggtgt

SEQ ID NO: 1373079 - DNA, 22 bp, Artificial Sequence
  chemically synthesized
tgtatttttagtagagacggtg

SEQ ID NO: 1373080 - DNA, 22 bp, Artificial Sequence
  chemically synthesized
ttgtatttttagtagagacggt

SEQ ID NO: 1373081 - DNA, 22 bp, Artificial Sequence
  chemically synthesized
atttttgtatttttagtagaga

SEQ ID NO: 1373082 - DNA, 22 bp, Artificial Sequence
  chemically synthesized
tactaaaaatacaaaaattagc

SEQ ID NO: 1373083 - DNA, 22 bp, Artificial Sequence
  chemically synthesized
ctaaaaatacaaaaattagctg

SEQ ID NO: 1373084 - DNA, 22 bp, Artificial Sequence
  chemically synthesized
aaaatacaaaaattagctgggt

SEQ ID NO: 1373085 - DNA, 22 bp, Artificial Sequence
  chemically synthesized
caggcgcccaccaccacaccca

SEQ ID NO: 1373086 - DNA, 22 bp, Artificial Sequence
  chemically synthesized
ggattacaggcgcccaccacca

SEQ ID NO: 1373087 - DNA, 22 bp, Artificial Sequence
  chemically synthesized
gctgggtgtggtggtgggcgcc

SEQ ID NO: 1373088 - DNA, 22 bp, Artificial Sequence
  chemically synthesized
ggtgtggtggtgggcgcctgta

SEQ ID NO: 1373089 - DNA, 22 bp, Artificial Sequence
  chemically synthesized
agcccccagagtagctgggatt

SEQ ID NO: 1373090 - DNA, 22 bp, Artificial Sequence
  chemically synthesized
cctcagcccccagagtagctgg

SEQ ID NO: 1373091 - DNA, 22 bp, Artificial Sequence
  chemically synthesized
ctgcctcagcccccagagtagc

SEQ ID NO: 1373092 - DNA, 22 bp, Artificial Sequence
  chemically synthesized
tcctgcctcagcccccagagta

SEQ ID NO: 1373093 - DNA, 22 bp, Artificial Sequence
  chemically synthesized
taatcccagctactctgggggc

SEQ ID NO: 1373094 - DNA, 22 bp, Artificial Sequence
  chemically synthesized
aagtgattctcctgcctcagcc

SEQ ID NO: 1373095 - DNA, 22 bp, Artificial Sequence
  chemically synthesized
ctctgggggctgaggcaggaga

SEQ ID NO: 1373096 - DNA, 22 bp, Artificial Sequence
  chemically synthesized
tgggggctgaggcaggagaatc

SEQ ID NO: 1373097 - DNA, 22 bp, Artificial Sequence
  chemically synthesized
cggggttcaagtgattctcctg

SEQ ID NO: 1373098 - DNA, 22 bp, Artificial Sequence
  chemically synthesized
ggggctgaggcaggagaatcac

SEQ ID NO: 1373099 - DNA, 22 bp, Artificial Sequence
  chemically synthesized
cacctccggggttcaagtgatt

SEQ ID NO: 1373100 - DNA, 22 bp, Artificial Sequence
  chemically synthesized
aggcaggagaatcacttgaacc

SEQ ID NO: 1373101 - DNA, 22 bp, Artificial Sequence
  chemically synthesized
caacctccacctccggggttca

SEQ ID NO: 1373102 - DNA, 22 bp, Artificial Sequence
  chemically synthesized
actgcaacctccacctccgggg

SEQ ID NO: 1373103 - DNA, 22 bp, Artificial Sequence
  chemically synthesized
ggctcactgcaacctccacctc

SEQ ID NO: 1373104 - DNA, 22 bp, Artificial Sequence
  chemically synthesized
gaaccccggaggtggaggttgc

SEQ ID NO: 1373105 - DNA, 22 bp, Artificial Sequence
  chemically synthesized
aaccccggaggtggaggttgca

SEQ ID NO: 1373106 - DNA, 22 bp, Artificial Sequence
  chemically synthesized
gagtgcagtggtgggatctcgg

SEQ ID NO: 1373107 - DNA, 22 bp, Artificial Sequence
  chemically synthesized
cagtgagccgagatcccaccac

SEQ ID NO: 1373108 - DNA, 22 bp, Artificial Sequence
  chemically synthesized
agtggtggctggagtgcagtgg

SEQ ID NO: 1373109 - DNA, 22 bp, Artificial Sequence
  chemically synthesized
gagttcagtggtggctggagtg

SEQ ID NO: 1373110 - DNA, 22 bp, Artificial Sequence
  chemically synthesized
cactccagccaccactgaactc

SEQ ID NO: 1373111 - DNA, 22 bp, Artificial Sequence
  chemically synthesized
tcacccaggctggagttcagtg

SEQ ID NO: 1373112 - DNA, 22 bp, Artificial Sequence
  chemically synthesized
tgtcacccaggctggagttcag

SEQ ID NO: 1373113 - DNA, 22 bp, Artificial Sequence
  chemically synthesized
cagccaccactgaactccagcc

SEQ ID NO: 1373114 - DNA, 22 bp, Artificial Sequence
  chemically synthesized
ctctgtcacccaggctggagtt

SEQ ID NO: 1373115 - DNA, 22 bp, Artificial Sequence
  chemically synthesized
gctctgtcacccaggctggagt

SEQ ID NO: 1373116 - DNA, 22 bp, Artificial Sequence
  chemically synthesized
aactccagcctgggtgacagag

SEQ ID NO: 1373117 - DNA, 22 bp, Artificial Sequence
  chemically synthesized
gagacagagtcttgctctgtca

SEQ ID NO: 1373118 - DNA, 22 bp, Artificial Sequence
  chemically synthesized
ggagacagagtcttgctctgtc

SEQ ID NO: 1373119 - DNA, 22 bp, Artificial Sequence
  chemically synthesized
tggagacagagtcttgctctgt

SEQ ID NO: 1373120 - DNA, 22 bp, Artificial Sequence
  chemically synthesized
cagcctgggtgacagagcaaga

SEQ ID NO: 1373121 - DNA, 22 bp, Artificial Sequence
  chemically synthesized
ttggagacagagtcttgctctg

SEQ ID NO: 1373122 - DNA, 22 bp, Artificial Sequence
  chemically synthesized
tttggagacagagtcttgctct

SEQ ID NO: 1373123 - DNA, 22 bp, Artificial Sequence
  chemically synthesized
ttttggagacagagtcttgctc

SEQ ID NO: 1373124 - DNA, 22 bp, Artificial Sequence
  chemically synthesized
tttttggagacagagtcttgct

SEQ ID NO: 1373125 - DNA, 22 bp, Artificial Sequence
  chemically synthesized
ttttttggagacagagtcttgc

SEQ ID NO: 1373126 - DNA, 22 bp, Artificial Sequence
  chemically synthesized
tttttttggagacagagtcttg

SEQ ID NO: 1373127 - DNA, 22 bp, Artificial Sequence
  chemically synthesized
ttttttttggagacagagtctt

SEQ ID NO: 1373128 - DNA, 22 bp, Artificial Sequence
  chemically synthesized
ggtgacagagcaagactctgtc

SEQ ID NO: 1373129 - DNA, 22 bp, Artificial Sequence
  chemically synthesized
tttttttttggagacagagtct

SEQ ID NO: 1373130 - DNA, 22 bp, Artificial Sequence
  chemically synthesized
ttttttttttggagacagagtc

SEQ ID NO: 1373131 - DNA, 22 bp, Artificial Sequence
  chemically synthesized
tttttttttttggagacagagt

SEQ ID NO: 1373132 - DNA, 22 bp, Artificial Sequence
  chemically synthesized
ttttttttttttggagacagag

SEQ ID NO: 1373133 - DNA, 22 bp, Artificial Sequence
  chemically synthesized
tttttttttttttggagacaga

SEQ ID NO: 1373134 - DNA, 22 bp, Artificial Sequence
  chemically synthesized
ttttttttttttttggagacag

SEQ ID NO: 1373135 - DNA, 22 bp, Artificial Sequence
  chemically synthesized
tttttttttttttttggagaca

SEQ ID NO: 1373136 - DNA, 22 bp, Artificial Sequence
  chemically synthesized
ttttttttttttttttggagac

SEQ ID NO: 1373137 - DNA, 22 bp, Artificial Sequence
  chemically synthesized
tttttttttttttttttggaga

SEQ ID NO: 1373138 - DNA, 22 bp, Artificial Sequence
  chemically synthesized
ttttttttttttttttttggag

SEQ ID NO: 1373139 - DNA, 22 bp, Artificial Sequence
  chemically synthesized
tttttttttttttttttttgga

SEQ ID NO: 1373140 - DNA, 22 bp, Artificial Sequence
  chemically synthesized
ttttttttttttttttttttgg

SEQ ID NO: 1373141 - DNA, 22 bp, Artificial Sequence
  chemically synthesized
tttttttttttttttttttttg

SEQ ID NO: 1373142 - DNA, 22 bp, Artificial Sequence
  chemically synthesized
tttttttttttttttttttttt

SEQ ID NO: 1373143 - DNA, 22 bp, Artificial Sequence
  chemically synthesized
tttttttttttttttttttttt

SEQ ID NO: 1373144 - DNA, 22 bp, Artificial Sequence
  chemically synthesized
tttttttttttttttttttttt

SEQ ID NO: 1373145 - DNA, 22 bp, Artificial Sequence
  chemically synthesized
tgtctccaaaaaaaaaaaaaaa

SEQ ID NO: 1373146 - DNA, 22 bp, Artificial Sequence
  chemically synthesized
tctccaaaaaaaaaaaaaaaaa

SEQ ID NO: 1373147 - DNA, 22 bp, Artificial Sequence
  chemically synthesized
gacatttttttttttttttttt

SEQ ID NO: 1373148 - DNA, 22 bp, Artificial Sequence
  chemically synthesized
caaaaaaaaaaaaaaaaaaaaa

SEQ ID NO: 1373149 - DNA, 22 bp, Artificial Sequence
  chemically synthesized
acattcgacatttttttttttt

SEQ ID NO: 1373150 - DNA, 22 bp, Artificial Sequence
  chemically synthesized
gaatgtgcctgacattcgacat

SEQ ID NO: 1373151 - DNA, 22 bp, Artificial Sequence
  chemically synthesized
ggaatgtgcctgacattcgaca

SEQ ID NO: 1373152 - DNA, 22 bp, Artificial Sequence
  chemically synthesized
agtaggtttggaatgtgcctga

SEQ ID NO: 1373153 - DNA, 22 bp, Artificial Sequence
  chemically synthesized
cagtaggtttggaatgtgcctg

SEQ ID NO: 1373154 - DNA, 22 bp, Artificial Sequence
  chemically synthesized
tttcagtaggtttggaatgtgc

SEQ ID NO: 1373155 - DNA, 22 bp, Artificial Sequence
  chemically synthesized
gagtctgtttcagtaggtttgg

SEQ ID NO: 1373156 - DNA, 22 bp, Artificial Sequence
  chemically synthesized
agagtctgtttcagtaggtttg

SEQ ID NO: 1373157 - DNA, 22 bp, Artificial Sequence
  chemically synthesized
tagagtctgtttcagtaggttt

SEQ ID NO: 1373158 - DNA, 22 bp, Artificial Sequence
  chemically synthesized
aattttagagtctgtttcagta

SEQ ID NO: 1373159 - DNA, 22 bp, Artificial Sequence
  chemically synthesized
ttaaattttagagtctgtttca

SEQ ID NO: 1373160 - DNA, 22 bp, Artificial Sequence
  chemically synthesized
gttaaattttagagtctgtttc

SEQ ID NO: 1373161 - DNA, 22 bp, Artificial Sequence
  chemically synthesized
caaacctactgaaacagactct

SEQ ID NO: 1373162 - DNA, 22 bp, Artificial Sequence
  chemically synthesized
ttgttaaattttagagtctgtt

SEQ ID NO: 1373163 - DNA, 22 bp, Artificial Sequence
  chemically synthesized
gggttcttgttaaattttagag

SEQ ID NO: 1373164 - DNA, 22 bp, Artificial Sequence
  chemically synthesized
ctgaaacagactctaaaattta

SEQ ID NO: 1373165 - DNA, 22 bp, Artificial Sequence
  chemically synthesized
aaacagactctaaaatttaaca

SEQ ID NO: 1373166 - DNA, 22 bp, Artificial Sequence
  chemically synthesized
aataatctggggttcttgttaa

SEQ ID NO: 1373167 - DNA, 22 bp, Artificial Sequence
  chemically synthesized
taaaatttaacaagaaccccag

SEQ ID NO: 1373168 - DNA, 22 bp, Artificial Sequence
  chemically synthesized
tgtctaaataatctggggttct

SEQ ID NO: 1373169 - DNA, 22 bp, Artificial Sequence
  chemically synthesized
aaatttaacaagaaccccagat

SEQ ID NO: 1373170 - DNA, 22 bp, Artificial Sequence
  chemically synthesized
aacaagaaccccagattattta

SEQ ID NO: 1373171 - DNA, 22 bp, Artificial Sequence
  chemically synthesized
acaagaaccccagattatttag

SEQ ID NO: 1373172 - DNA, 22 bp, Artificial Sequence
  chemically synthesized
catacataactgtgtctaaata

SEQ ID NO: 1373173 - DNA, 22 bp, Artificial Sequence
  chemically synthesized
ttgcatacataactgtgtctaa

SEQ ID NO: 1373174 - DNA, 22 bp, Artificial Sequence
  chemically synthesized
tttagacacagttatgtatgca

SEQ ID NO: 1373175 - DNA, 22 bp, Artificial Sequence
  chemically synthesized
tagaatatagctgttgcataca

SEQ ID NO: 1373176 - DNA, 22 bp, Artificial Sequence
  chemically synthesized
agacacagttatgtatgcaaca

SEQ ID NO: 1373177 - DNA, 22 bp, Artificial Sequence
  chemically synthesized
gacacagttatgtatgcaacag

SEQ ID NO: 1373178 - DNA, 22 bp, Artificial Sequence
  chemically synthesized
cacctgtagaatatagctgttg

SEQ ID NO: 1373179 - DNA, 22 bp, Artificial Sequence
  chemically synthesized
ttacacctgtagaatatagctg

SEQ ID NO: 1373180 - DNA, 22 bp, Artificial Sequence
  chemically synthesized
gttacacctgtagaatatagct

SEQ ID NO: 1373181 - DNA, 22 bp, Artificial Sequence
  chemically synthesized
tgtatgcaacagctatattcta

SEQ ID NO: 1373182 - DNA, 22 bp, Artificial Sequence
  chemically synthesized
ttgttacacctgtagaatatag

SEQ ID NO: 1373183 - DNA, 22 bp, Artificial Sequence
  chemically synthesized
cttgttacacctgtagaatata

SEQ ID NO: 1373184 - DNA, 22 bp, Artificial Sequence
  chemically synthesized
tttcttgttacacctgtagaat

SEQ ID NO: 1373185 - DNA, 22 bp, Artificial Sequence
  chemically synthesized
gtttcttgttacacctgtagaa

SEQ ID NO: 1373186 - DNA, 22 bp, Artificial Sequence
  chemically synthesized
tgtttcttgttacacctgtaga

SEQ ID NO: 1373187 - DNA, 22 bp, Artificial Sequence
  chemically synthesized
gctttgtttcttgttacacctg

SEQ ID NO: 1373188 - DNA, 22 bp, Artificial Sequence
  chemically synthesized
agctttgtttcttgttacacct

SEQ ID NO: 1373189 - DNA, 22 bp, Artificial Sequence
  chemically synthesized
tattctacaggtgtaacaagaa

SEQ ID NO: 1373190 - DNA, 22 bp, Artificial Sequence
  chemically synthesized
gtccttagctttgtttcttgtt

SEQ ID NO: 1373191 - DNA, 22 bp, Artificial Sequence
  chemically synthesized
tacaggtgtaacaagaaacaaa

SEQ ID NO: 1373192 - DNA, 22 bp, Artificial Sequence
  chemically synthesized
caggtgtaacaagaaacaaagc

SEQ ID NO: 1373193 - DNA, 22 bp, Artificial Sequence
  chemically synthesized
gattggtccttagctttgtttc

SEQ ID NO: 1373194 - DNA, 22 bp, Artificial Sequence
  chemically synthesized
agattggtccttagctttgttt

SEQ ID NO: 1373195 - DNA, 22 bp, Artificial Sequence
  chemically synthesized
ggaaatgtttagattggtcctt

SEQ ID NO: 1373196 - DNA, 22 bp, Artificial Sequence
  chemically synthesized
aggaaatgtttagattggtcct

SEQ ID NO: 1373197 - DNA, 22 bp, Artificial Sequence
  chemically synthesized
cttaggaaatgtttagattggt

SEQ ID NO: 1373198 - DNA, 22 bp, Artificial Sequence
  chemically synthesized
ccttaggaaatgtttagattgg

SEQ ID NO: 1373199 - DNA, 22 bp, Artificial Sequence
  chemically synthesized
tccttaggaaatgtttagattg

SEQ ID NO: 1373200 - DNA, 22 bp, Artificial Sequence
  chemically synthesized
ttccttaggaaatgtttagatt

SEQ ID NO: 1373201 - DNA, 22 bp, Artificial Sequence
  chemically synthesized
tttccttaggaaatgtttagat

SEQ ID NO: 1373202 - DNA, 22 bp, Artificial Sequence
  chemically synthesized
ttttccttaggaaatgtttaga

SEQ ID NO: 1373203 - DNA, 22 bp, Artificial Sequence
  chemically synthesized
tttttccttaggaaatgtttag

SEQ ID NO: 1373204 - DNA, 22 bp, Artificial Sequence
  chemically synthesized
ttttttccttaggaaatgttta

SEQ ID NO: 1373205 - DNA, 22 bp, Artificial Sequence
  chemically synthesized
aggaccaatctaaacatttcct

SEQ ID NO: 1373206 - DNA, 22 bp, Artificial Sequence
  chemically synthesized
cttttttttccttaggaaatgt

SEQ ID NO: 1373207 - DNA, 22 bp, Artificial Sequence
  chemically synthesized
ccctccttttttttccttagga

SEQ ID NO: 1373208 - DNA, 22 bp, Artificial Sequence
  chemically synthesized
aacatttcctaaggaaaaaaaa

SEQ ID NO: 1373209 - DNA, 22 bp, Artificial Sequence
  chemically synthesized
cctaaggaaaaaaaaggagggc

SEQ ID NO: 1373210 - DNA, 22 bp, Artificial Sequence
  chemically synthesized
ctaaggaaaaaaaaggagggca

SEQ ID NO: 1373211 - DNA, 22 bp, Artificial Sequence
  chemically synthesized
aggaaaaaaaaggagggcaata

SEQ ID NO: 1373212 - DNA, 22 bp, Artificial Sequence
  chemically synthesized
aaagtaataaaggaataagtaa

SEQ ID NO: 1373213 - DNA, 22 bp, Artificial Sequence
  chemically synthesized
gaaagtaataaaggaataagta

SEQ ID NO: 1373214 - DNA, 22 bp, Artificial Sequence
  chemically synthesized
tgaaagtaataaaggaataagt

SEQ ID NO: 1373215 - DNA, 22 bp, Artificial Sequence
  chemically synthesized
ttgaaagtaataaaggaataag

SEQ ID NO: 1373216 - DNA, 22 bp, Artificial Sequence
  chemically synthesized
tttgaaagtaataaaggaataa

SEQ ID NO: 1373217 - DNA, 22 bp, Artificial Sequence
  chemically synthesized
tacttattcctttattactttc

SEQ ID NO: 1373218 - DNA, 22 bp, Artificial Sequence
  chemically synthesized
taaaatctttttgaaagtaata

SEQ ID NO: 1373219 - DNA, 22 bp, Artificial Sequence
  chemically synthesized
acttattcctttattactttca

SEQ ID NO: 1373220 - DNA, 22 bp, Artificial Sequence
  chemically synthesized
cttattcctttattactttcaa

SEQ ID NO: 1373221 - DNA, 22 bp, Artificial Sequence
  chemically synthesized
attcctttattactttcaaaaa

SEQ ID NO: 1373222 - DNA, 22 bp, Artificial Sequence
  chemically synthesized
ttcctttattactttcaaaaag

SEQ ID NO: 1373223 - DNA, 22 bp, Artificial Sequence
  chemically synthesized
ctttattactttcaaaaagatt

SEQ ID NO: 1373224 - DNA, 22 bp, Artificial Sequence
  chemically synthesized
gcaaatcattataaaatctttt

SEQ ID NO: 1373225 - DNA, 22 bp, Artificial Sequence
  chemically synthesized
tattactttcaaaaagatttta

SEQ ID NO: 1373226 - DNA, 22 bp, Artificial Sequence
  chemically synthesized
agcaaatcattataaaatcttt

SEQ ID NO: 1373227 - DNA, 22 bp, Artificial Sequence
  chemically synthesized
attactttcaaaaagattttat

SEQ ID NO: 1373228 - DNA, 22 bp, Artificial Sequence
  chemically synthesized
ttactttcaaaaagattttata

SEQ ID NO: 1373229 - DNA, 22 bp, Artificial Sequence
  chemically synthesized
ctttcaaaaagattttataatg

SEQ ID NO: 1373230 - DNA, 22 bp, Artificial Sequence
  chemically synthesized
tcaaaaagattttataatgatt

SEQ ID NO: 1373231 - DNA, 22 bp, Artificial Sequence
  chemically synthesized
caaaaagattttataatgattt

SEQ ID NO: 1373232 - DNA, 22 bp, Artificial Sequence
  chemically synthesized
aaaaagattttataatgatttg

SEQ ID NO: 1373233 - DNA, 22 bp, Artificial Sequence
  chemically synthesized
atcagggcgaacagaatttagc

SEQ ID NO: 1373234 - DNA, 22 bp, Artificial Sequence
  chemically synthesized
tataatgatttgctaaattctg

SEQ ID NO: 1373235 - DNA, 22 bp, Artificial Sequence
  chemically synthesized
ataatgatttgctaaattctgt

SEQ ID NO: 1373236 - DNA, 22 bp, Artificial Sequence
  chemically synthesized
taatgatttgctaaattctgtt

SEQ ID NO: 1373237 - DNA, 22 bp, Artificial Sequence
  chemically synthesized
tctgatcagggcgaacagaatt

SEQ ID NO: 1373238 - DNA, 22 bp, Artificial Sequence
  chemically synthesized
gctaaattctgttcgccctgat

SEQ ID NO: 1373239 - DNA, 22 bp, Artificial Sequence
  chemically synthesized
ctaaattctgttcgccctgatc

SEQ ID NO: 1373240 - DNA, 22 bp, Artificial Sequence
  chemically synthesized
aattctgttcgccctgatcaga

SEQ ID NO: 1373241 - DNA, 22 bp, Artificial Sequence
  chemically synthesized
gatgcagacatattatctgatc

SEQ ID NO: 1373242 - DNA, 22 bp, Artificial Sequence
  chemically synthesized
agatgcagacatattatctgat

SEQ ID NO: 1373243 - DNA, 22 bp, Artificial Sequence
  chemically synthesized
tgttcgccctgatcagataata

SEQ ID NO: 1373244 - DNA, 22 bp, Artificial Sequence
  chemically synthesized
ttcgccctgatcagataatatg

SEQ ID NO: 1373245 - DNA, 22 bp, Artificial Sequence
  chemically synthesized
acttagatgcagacatattatc

SEQ ID NO: 1373246 - DNA, 22 bp, Artificial Sequence
  chemically synthesized
aacttagatgcagacatattat

SEQ ID NO: 1373247 - DNA, 22 bp, Artificial Sequence
  chemically synthesized
gccctgatcagataatatgtct

SEQ ID NO: 1373248 - DNA, 22 bp, Artificial Sequence
  chemically synthesized
taacttagatgcagacatatta

SEQ ID NO: 1373249 - DNA, 22 bp, Artificial Sequence
  chemically synthesized
ttaacttagatgcagacatatt

SEQ ID NO: 1373250 - DNA, 22 bp, Artificial Sequence
  chemically synthesized
tttaacttagatgcagacatat

SEQ ID NO: 1373251 - DNA, 22 bp, Artificial Sequence
  chemically synthesized
ttttaacttagatgcagacata

SEQ ID NO: 1373252 - DNA, 22 bp, Artificial Sequence
  chemically synthesized
atcagataatatgtctgcatct

SEQ ID NO: 1373253 - DNA, 22 bp, Artificial Sequence
  chemically synthesized
gatttttttaacttagatgcag

SEQ ID NO: 1373254 - DNA, 22 bp, Artificial Sequence
  chemically synthesized
tggatttttttaacttagatgc

SEQ ID NO: 1373255 - DNA, 22 bp, Artificial Sequence
  chemically synthesized
attctggatttttttaacttag

SEQ ID NO: 1373256 - DNA, 22 bp, Artificial Sequence
  chemically synthesized
gattctggatttttttaactta

SEQ ID NO: 1373257 - DNA, 22 bp, Artificial Sequence
  chemically synthesized
tgattctggatttttttaactt

SEQ ID NO: 1373258 - DNA, 22 bp, Artificial Sequence
  chemically synthesized
attttgattctggattttttta

SEQ ID NO: 1373259 - DNA, 22 bp, Artificial Sequence
  chemically synthesized
gattttgattctggattttttt

SEQ ID NO: 1373260 - DNA, 22 bp, Artificial Sequence
  chemically synthesized
catctaagttaaaaaaatccag

SEQ ID NO: 1373261 - DNA, 22 bp, Artificial Sequence
  chemically synthesized
caagtttgattttgattctgga

SEQ ID NO: 1373262 - DNA, 22 bp, Artificial Sequence
  chemically synthesized
agttaaaaaaatccagaatcaa

SEQ ID NO: 1373263 - DNA, 22 bp, Artificial Sequence
  chemically synthesized
acaagtttgattttgattctgg

SEQ ID NO: 1373264 - DNA, 22 bp, Artificial Sequence
  chemically synthesized
tacaagtttgattttgattctg

SEQ ID NO: 1373265 - DNA, 22 bp, Artificial Sequence
  chemically synthesized
aaaaaatccagaatcaaaatca

SEQ ID NO: 1373266 - DNA, 22 bp, Artificial Sequence
  chemically synthesized
aaaacaagaattttacaagttt

SEQ ID NO: 1373267 - DNA, 22 bp, Artificial Sequence
  chemically synthesized
gaaaacaagaattttacaagtt

SEQ ID NO: 1373268 - DNA, 22 bp, Artificial Sequence
  chemically synthesized
aaaaataagcttgaaaacaaga

SEQ ID NO: 1373269 - DNA, 22 bp, Artificial Sequence
  chemically synthesized
aaaaaataagcttgaaaacaag

SEQ ID NO: 1373270 - DNA, 22 bp, Artificial Sequence
  chemically synthesized
gtaaaattcttgttttcaagct

SEQ ID NO: 1373271 - DNA, 22 bp, Artificial Sequence
  chemically synthesized
atttaaaaaataagcttgaaaa

SEQ ID NO: 1373272 - DNA, 22 bp, Artificial Sequence
  chemically synthesized
taaaattcttgttttcaagctt

SEQ ID NO: 1373273 - DNA, 22 bp, Artificial Sequence
  chemically synthesized
tgttcatttaaaaaataagctt

SEQ ID NO: 1373274 - DNA, 22 bp, Artificial Sequence
  chemically synthesized
tatgttcatttaaaaaataagc

SEQ ID NO: 1373275 - DNA, 22 bp, Artificial Sequence
  chemically synthesized
ttgttttcaagcttatttttta

SEQ ID NO: 1373276 - DNA, 22 bp, Artificial Sequence
  chemically synthesized
tctatgttcatttaaaaaataa

SEQ ID NO: 1373277 - DNA, 22 bp, Artificial Sequence
  chemically synthesized
gttttcaagcttattttttaaa

SEQ ID NO: 1373278 - DNA, 22 bp, Artificial Sequence
  chemically synthesized
ttttcaagcttattttttaaat

SEQ ID NO: 1373279 - DNA, 22 bp, Artificial Sequence
  chemically synthesized
tcaagcttattttttaaatgaa

SEQ ID NO: 1373280 - DNA, 22 bp, Artificial Sequence
  chemically synthesized
caagcttattttttaaatgaac

SEQ ID NO: 1373281 - DNA, 22 bp, Artificial Sequence
  chemically synthesized
aagcttattttttaaatgaaca

SEQ ID NO: 1373282 - DNA, 22 bp, Artificial Sequence
  chemically synthesized
attttttaaatgaacatagaga

SEQ ID NO: 1373283 - DNA, 22 bp, Artificial Sequence
  chemically synthesized
ttttttaaatgaacatagagaa

SEQ ID NO: 1373284 - DNA, 22 bp, Artificial Sequence
  chemically synthesized
tttaaatgaacatagagaattg

SEQ ID NO: 1373285 - DNA, 22 bp, Artificial Sequence
  chemically synthesized
ttaaatgaacatagagaattgt

SEQ ID NO: 1373286 - DNA, 22 bp, Artificial Sequence
  chemically synthesized
taaatgaacatagagaattgta

SEQ ID NO: 1373287 - DNA, 22 bp, Artificial Sequence
  chemically synthesized
aaatgaacatagagaattgtat

SEQ ID NO: 1373288 - DNA, 22 bp, Artificial Sequence
  chemically synthesized
aatgaacatagagaattgtatg

SEQ ID NO: 1373289 - DNA, 22 bp, Artificial Sequence
  chemically synthesized
aacacaataaatacatacaatt

SEQ ID NO: 1373290 - DNA, 22 bp, Artificial Sequence
  chemically synthesized
aaaccatcatgttgaacacaat

SEQ ID NO: 1373291 - DNA, 22 bp, Artificial Sequence
  chemically synthesized
caaaccatcatgttgaacacaa

SEQ ID NO: 1373292 - DNA, 22 bp, Artificial Sequence
  chemically synthesized
tatgtatttattgtgttcaaca

SEQ ID NO: 1373293 - DNA, 22 bp, Artificial Sequence
  chemically synthesized
attgtgttcaacatgatggttt

SEQ ID NO: 1373294 - DNA, 22 bp, Artificial Sequence
  chemically synthesized
ttgtgttcaacatgatggtttg

SEQ ID NO: 1373295 - DNA, 22 bp, Artificial Sequence
  chemically synthesized
tgttcaacatgatggtttgaag

SEQ ID NO: 1373296 - DNA, 22 bp, Artificial Sequence
  chemically synthesized
aacatgatggtttgaagtacat

SEQ ID NO: 1373297 - DNA, 22 bp, Artificial Sequence
  chemically synthesized
accatatcacaatgtatatgta

SEQ ID NO: 1373298 - DNA, 22 bp, Artificial Sequence
  chemically synthesized
aaccatatcacaatgtatatgt

SEQ ID NO: 1373299 - DNA, 22 bp, Artificial Sequence
  chemically synthesized
gatttaaccatatcacaatgta

SEQ ID NO: 1373300 - DNA, 22 bp, Artificial Sequence
  chemically synthesized
gaagtacatatacattgtgata

SEQ ID NO: 1373301 - DNA, 22 bp, Artificial Sequence
  chemically synthesized
aagtacatatacattgtgatat

SEQ ID NO: 1373302 - DNA, 22 bp, Artificial Sequence
  chemically synthesized
gctagatttaaccatatcacaa

SEQ ID NO: 1373303 - DNA, 22 bp, Artificial Sequence
  chemically synthesized
attagctagatttaaccatatc

SEQ ID NO: 1373304 - DNA, 22 bp, Artificial Sequence
  chemically synthesized
ttaattagctagatttaaccat

SEQ ID NO: 1373305 - DNA, 22 bp, Artificial Sequence
  chemically synthesized
gttaattagctagatttaacca

SEQ ID NO: 1373306 - DNA, 22 bp, Artificial Sequence
  chemically synthesized
tgatatggttaaatctagctaa

SEQ ID NO: 1373307 - DNA, 22 bp, Artificial Sequence
  chemically synthesized
aatctagctaattaacaaatgc

SEQ ID NO: 1373308 - DNA, 22 bp, Artificial Sequence
  chemically synthesized
gctaattaacaaatgcattccc

SEQ ID NO: 1373309 - DNA, 22 bp, Artificial Sequence
  chemically synthesized
aatgataacatgtgagggaatg

SEQ ID NO: 1373310 - DNA, 22 bp, Artificial Sequence
  chemically synthesized
attaacaaatgcattccctcac

SEQ ID NO: 1373311 - DNA, 22 bp, Artificial Sequence
  chemically synthesized
acaaatgcattccctcacatgt

SEQ ID NO: 1373312 - DNA, 22 bp, Artificial Sequence
  chemically synthesized
agagagtggatgttaaatgata

SEQ ID NO: 1373313 - DNA, 22 bp, Artificial Sequence
  chemically synthesized
cctcacatgttatcatttaaca

SEQ ID NO: 1373314 - DNA, 22 bp, Artificial Sequence
  chemically synthesized
acatgttatcatttaacatcca

SEQ ID NO: 1373315 - DNA, 22 bp, Artificial Sequence
  chemically synthesized
tcatttaacatccactctctta

SEQ ID NO: 1373316 - DNA, 22 bp, Artificial Sequence
  chemically synthesized
aaatgaaaaatactaagagagt

SEQ ID NO: 1373317 - DNA, 22 bp, Artificial Sequence
  chemically synthesized
caaatgaaaaatactaagagag

SEQ ID NO: 1373318 - DNA, 22 bp, Artificial Sequence
  chemically synthesized
tcaaatgaaaaatactaagaga

SEQ ID NO: 1373319 - DNA, 22 bp, Artificial Sequence
  chemically synthesized
ttcaaatgaaaaatactaagag

SEQ ID NO: 1373320 - DNA, 22 bp, Artificial Sequence
  chemically synthesized
tttcaaatgaaaaatactaaga

SEQ ID NO: 1373321 - DNA, 22 bp, Artificial Sequence
  chemically synthesized
aacatccactctcttagtattt

SEQ ID NO: 1373322 - DNA, 22 bp, Artificial Sequence
  chemically synthesized
ttttcaaatgaaaaatactaag

SEQ ID NO: 1373323 - DNA, 22 bp, Artificial Sequence
  chemically synthesized
acatccactctcttagtatttt

SEQ ID NO: 1373324 - DNA, 22 bp, Artificial Sequence
  chemically synthesized
atttttttcaaatgaaaaatac

SEQ ID NO: 1373325 - DNA, 22 bp, Artificial Sequence
  chemically synthesized
aacctaatttttttcaaatgaa

SEQ ID NO: 1373326 - DNA, 22 bp, Artificial Sequence
  chemically synthesized
tcttagtatttttcatttgaaa

SEQ ID NO: 1373327 - DNA, 22 bp, Artificial Sequence
  chemically synthesized
ttagtatttttcatttgaaaaa

SEQ ID NO: 1373328 - DNA, 22 bp, Artificial Sequence
  chemically synthesized
agtatttttcatttgaaaaaaa

SEQ ID NO: 1373329 - DNA, 22 bp, Artificial Sequence
  chemically synthesized
gtatttttcatttgaaaaaaat

SEQ ID NO: 1373330 - DNA, 22 bp, Artificial Sequence
  chemically synthesized
gggatgctcaacctaatttttt

SEQ ID NO: 1373331 - DNA, 22 bp, Artificial Sequence
  chemically synthesized
ttcatttgaaaaaaattaggtt

SEQ ID NO: 1373332 - DNA, 22 bp, Artificial Sequence
  chemically synthesized
tcatttgaaaaaaattaggttg

SEQ ID NO: 1373333 - DNA, 22 bp, Artificial Sequence
  chemically synthesized
catttgaaaaaaattaggttga

SEQ ID NO: 1373334 - DNA, 22 bp, Artificial Sequence
  chemically synthesized
gattagggatgctcaacctaat

SEQ ID NO: 1373335 - DNA, 22 bp, Artificial Sequence
  chemically synthesized
atttgaaaaaaattaggttgag

SEQ ID NO: 1373336 - DNA, 22 bp, Artificial Sequence
  chemically synthesized
ggattagggatgctcaacctaa

SEQ ID NO: 1373337 - DNA, 22 bp, Artificial Sequence
  chemically synthesized
tggattagggatgctcaaccta

SEQ ID NO: 1373338 - DNA, 22 bp, Artificial Sequence
  chemically synthesized
ttggattagggatgctcaacct

SEQ ID NO: 1373339 - DNA, 22 bp, Artificial Sequence
  chemically synthesized
gaaaaaaattaggttgagcatc

SEQ ID NO: 1373340 - DNA, 22 bp, Artificial Sequence
  chemically synthesized
aaaaaaattaggttgagcatcc

SEQ ID NO: 1373341 - DNA, 22 bp, Artificial Sequence
  chemically synthesized
ggttgagcatccctaatccaaa

SEQ ID NO: 1373342 - DNA, 22 bp, Artificial Sequence
  chemically synthesized
agagtgtgtatttttggattag

SEQ ID NO: 1373343 - DNA, 22 bp, Artificial Sequence
  chemically synthesized
cagagtgtgtatttttggatta

SEQ ID NO: 1373344 - DNA, 22 bp, Artificial Sequence
  chemically synthesized
agcatccctaatccaaaaatac

SEQ ID NO: 1373345 - DNA, 22 bp, Artificial Sequence
  chemically synthesized
gagcatttcagagtgtgtattt

SEQ ID NO: 1373346 - DNA, 22 bp, Artificial Sequence
  chemically synthesized
ggagcatttcagagtgtgtatt

SEQ ID NO: 1373347 - DNA, 22 bp, Artificial Sequence
  chemically synthesized
tggagcatttcagagtgtgtat

SEQ ID NO: 1373348 - DNA, 22 bp, Artificial Sequence
  chemically synthesized
atccaaaaatacacactctgaa

SEQ ID NO: 1373349 - DNA, 22 bp, Artificial Sequence
  chemically synthesized
agattttggagcatttcagagt

SEQ ID NO: 1373350 - DNA, 22 bp, Artificial Sequence
  chemically synthesized
cagattttggagcatttcagag

SEQ ID NO: 1373351 - DNA, 22 bp, Artificial Sequence
  chemically synthesized
aaaaagtttcagattttggagc

SEQ ID NO: 1373352 - DNA, 22 bp, Artificial Sequence
  chemically synthesized
tgaaatgctccaaaatctgaaa

SEQ ID NO: 1373353 - DNA, 22 bp, Artificial Sequence
  chemically synthesized
agtgctcaaaaagtttcagatt

SEQ ID NO: 1373354 - DNA, 22 bp, Artificial Sequence
  chemically synthesized
aaatgctccaaaatctgaaact

SEQ ID NO: 1373355 - DNA, 22 bp, Artificial Sequence
  chemically synthesized
cagtgctcaaaaagtttcagat

SEQ ID NO: 1373356 - DNA, 22 bp, Artificial Sequence
  chemically synthesized
caaaatctgaaactttttgagc

SEQ ID NO: 1373357 - DNA, 22 bp, Artificial Sequence
  chemically synthesized
aaactttttgagcactgaaatg

SEQ ID NO: 1373358 - DNA, 22 bp, Artificial Sequence
  chemically synthesized
cacgtatgacatcatttcagtg

SEQ ID NO: 1373359 - DNA, 22 bp, Artificial Sequence
  chemically synthesized
ccacgtatgacatcatttcagt

SEQ ID NO: 1373360 - DNA, 22 bp, Artificial Sequence
  chemically synthesized
tccacgtatgacatcatttcag

SEQ ID NO: 1373361 - DNA, 22 bp, Artificial Sequence
  chemically synthesized
tttgagcactgaaatgatgtca

SEQ ID NO: 1373362 - DNA, 22 bp, Artificial Sequence
  chemically synthesized
ttgagcactgaaatgatgtcat

SEQ ID NO: 1373363 - DNA, 22 bp, Artificial Sequence
  chemically synthesized
tgagcactgaaatgatgtcata

SEQ ID NO: 1373364 - DNA, 22 bp, Artificial Sequence
  chemically synthesized
gagcactgaaatgatgtcatac

SEQ ID NO: 1373365 - DNA, 22 bp, Artificial Sequence
  chemically synthesized
agcactgaaatgatgtcatacg

SEQ ID NO: 1373366 - DNA, 22 bp, Artificial Sequence
  chemically synthesized
tatgtccaattttccacgtatg

SEQ ID NO: 1373367 - DNA, 22 bp, Artificial Sequence
  chemically synthesized
atatgtccaattttccacgtat

SEQ ID NO: 1373368 - DNA, 22 bp, Artificial Sequence
  chemically synthesized
aaatgatgtcatacgtggaaaa

SEQ ID NO: 1373369 - DNA, 22 bp, Artificial Sequence
  chemically synthesized
aatacttatatgtccaattttc

SEQ ID NO: 1373370 - DNA, 22 bp, Artificial Sequence
  chemically synthesized
cattaaatacttatatgtccaa

SEQ ID NO: 1373371 - DNA, 22 bp, Artificial Sequence
  chemically synthesized
gcattaaatacttatatgtcca

SEQ ID NO: 1373372 - DNA, 22 bp, Artificial Sequence
  chemically synthesized
aaaaaaagtttgcattaaatac

SEQ ID NO: 1373373 - DNA, 22 bp, Artificial Sequence
  chemically synthesized
gaaaaaaagtttgcattaaata

SEQ ID NO: 1373374 - DNA, 22 bp, Artificial Sequence
  chemically synthesized
gacatataagtatttaatgcaa

SEQ ID NO: 1373375 - DNA, 22 bp, Artificial Sequence
  chemically synthesized
tgcttgaaaaaaagtttgcatt

SEQ ID NO: 1373376 - DNA, 22 bp, Artificial Sequence
  chemically synthesized
gtgcttgaaaaaaagtttgcat

SEQ ID NO: 1373377 - DNA, 22 bp, Artificial Sequence
  chemically synthesized
tgtgcttgaaaaaaagtttgca

SEQ ID NO: 1373378 - DNA, 22 bp, Artificial Sequence
  chemically synthesized
gcagttttgtgcttgaaaaaaa

SEQ ID NO: 1373379 - DNA, 22 bp, Artificial Sequence
  chemically synthesized
agcagttttgtgcttgaaaaaa

SEQ ID NO: 1373380 - DNA, 22 bp, Artificial Sequence
  chemically synthesized
tagcagttttgtgcttgaaaaa

SEQ ID NO: 1373381 - DNA, 22 bp, Artificial Sequence
  chemically synthesized
aatgcaaactttttttcaagca

SEQ ID NO: 1373382 - DNA, 22 bp, Artificial Sequence
  chemically synthesized
ttagcagttttgtgcttgaaaa

SEQ ID NO: 1373383 - DNA, 22 bp, Artificial Sequence
  chemically synthesized
atgcaaactttttttcaagcac

SEQ ID NO: 1373384 - DNA, 22 bp, Artificial Sequence
  chemically synthesized
tacagtatttttagcagttttg

SEQ ID NO: 1373385 - DNA, 22 bp, Artificial Sequence
  chemically synthesized
tttttcaagcacaaaactgcta

SEQ ID NO: 1373386 - DNA, 22 bp, Artificial Sequence
  chemically synthesized
atacagtatttttagcagtttt

SEQ ID NO: 1373387 - DNA, 22 bp, Artificial Sequence
  chemically synthesized
ttttcaagcacaaaactgctaa

SEQ ID NO: 1373388 - DNA, 22 bp, Artificial Sequence
  chemically synthesized
tatacagtatttttagcagttt

SEQ ID NO: 1373389 - DNA, 22 bp, Artificial Sequence
  chemically synthesized
tttcaagcacaaaactgctaaa

SEQ ID NO: 1373390 - DNA, 22 bp, Artificial Sequence
  chemically synthesized
ttcaagcacaaaactgctaaaa

SEQ ID NO: 1373391 - DNA, 22 bp, Artificial Sequence
  chemically synthesized
tcaagcacaaaactgctaaaaa

SEQ ID NO: 1373392 - DNA, 22 bp, Artificial Sequence
  chemically synthesized
caagcacaaaactgctaaaaat

SEQ ID NO: 1373393 - DNA, 22 bp, Artificial Sequence
  chemically synthesized
aagcacaaaactgctaaaaata

SEQ ID NO: 1373394 - DNA, 22 bp, Artificial Sequence
  chemically synthesized
aggtaattttatacagtatttt

SEQ ID NO: 1373395 - DNA, 22 bp, Artificial Sequence
  chemically synthesized
gaggtaattttatacagtattt

SEQ ID NO: 1373396 - DNA, 22 bp, Artificial Sequence
  chemically synthesized
tgaggtaattttatacagtatt

SEQ ID NO: 1373397 - DNA, 22 bp, Artificial Sequence
  chemically synthesized
ctaaaaatactgtataaaatta

SEQ ID NO: 1373398 - DNA, 22 bp, Artificial Sequence
  chemically synthesized
aaaatactgtataaaattacct

SEQ ID NO: 1373399 - DNA, 22 bp, Artificial Sequence
  chemically synthesized
tacacgtaactttgaggtaatt

SEQ ID NO: 1373400 - DNA, 22 bp, Artificial Sequence
  chemically synthesized
atacacgtaactttgaggtaat

SEQ ID NO: 1373401 - DNA, 22 bp, Artificial Sequence
  chemically synthesized
tatacacgtaactttgaggtaa

SEQ ID NO: 1373402 - DNA, 22 bp, Artificial Sequence
  chemically synthesized
tataaaattacctcaaagttac

SEQ ID NO: 1373403 - DNA, 22 bp, Artificial Sequence
  chemically synthesized
cactttatacacgtaactttga

SEQ ID NO: 1373404 - DNA, 22 bp, Artificial Sequence
  chemically synthesized
ctgcactttatacacgtaactt

SEQ ID NO: 1373405 - DNA, 22 bp, Artificial Sequence
  chemically synthesized
cctgcactttatacacgtaact

SEQ ID NO: 1373406 - DNA, 22 bp, Artificial Sequence
  chemically synthesized
tcctgcactttatacacgtaac

SEQ ID NO: 1373407 - DNA, 22 bp, Artificial Sequence
  chemically synthesized
cctcaaagttacgtgtataaag

SEQ ID NO: 1373408 - DNA, 22 bp, Artificial Sequence
  chemically synthesized
tgttttcctgcactttatacac

SEQ ID NO: 1373409 - DNA, 22 bp, Artificial Sequence
  chemically synthesized
atgttttcctgcactttataca

SEQ ID NO: 1373410 - DNA, 22 bp, Artificial Sequence
  chemically synthesized
aaagttacgtgtataaagtgca

SEQ ID NO: 1373411 - DNA, 22 bp, Artificial Sequence
  chemically synthesized
acttatgttttcctgcacttta

SEQ ID NO: 1373412 - DNA, 22 bp, Artificial Sequence
  chemically synthesized
cgtgtataaagtgcaggaaaac

SEQ ID NO: 1373413 - DNA, 22 bp, Artificial Sequence
  chemically synthesized
aacacaaattcacttatgtttt

SEQ ID NO: 1373414 - DNA, 22 bp, Artificial Sequence
  chemically synthesized
ggcatgggacccaagactaaac

SEQ ID NO: 1373415 - DNA, 22 bp, Artificial Sequence
  chemically synthesized
gggcatgggacccaagactaaa

SEQ ID NO: 1373416 - DNA, 22 bp, Artificial Sequence
  chemically synthesized
gtgtttagtcttgggtcccatg

SEQ ID NO: 1373417 - DNA, 22 bp, Artificial Sequence
  chemically synthesized
tgtttagtcttgggtcccatgc

SEQ ID NO: 1373418 - DNA, 22 bp, Artificial Sequence
  chemically synthesized
agtcttgggtcccatgcccaag

SEQ ID NO: 1373419 - DNA, 22 bp, Artificial Sequence
  chemically synthesized
gtcttgggtcccatgcccaaga

SEQ ID NO: 1373420 - DNA, 22 bp, Artificial Sequence
  chemically synthesized
gggtcccatgcccaagatacct

SEQ ID NO: 1373421 - DNA, 22 bp, Artificial Sequence
  chemically synthesized
ggtcccatgcccaagatacctt

SEQ ID NO: 1373422 - DNA, 22 bp, Artificial Sequence
  chemically synthesized
catatacataataaggtatctt

SEQ ID NO: 1373423 - DNA, 22 bp, Artificial Sequence
  chemically synthesized
acatatacataataaggtatct

SEQ ID NO: 1373424 - DNA, 22 bp, Artificial Sequence
  chemically synthesized
tggaatgcttacatatacataa

SEQ ID NO: 1373425 - DNA, 22 bp, Artificial Sequence
  chemically synthesized
atggaatgcttacatatacata

SEQ ID NO: 1373426 - DNA, 22 bp, Artificial Sequence
  chemically synthesized
tatggaatgcttacatatacat

SEQ ID NO: 1373427 - DNA, 22 bp, Artificial Sequence
  chemically synthesized
ggattttatggaatgcttacat

SEQ ID NO: 1373428 - DNA, 22 bp, Artificial Sequence
  chemically synthesized
gggattttatggaatgcttaca

SEQ ID NO: 1373429 - DNA, 22 bp, Artificial Sequence
  chemically synthesized
attatgtatatgtaagcattcc

SEQ ID NO: 1373430 - DNA, 22 bp, Artificial Sequence
  chemically synthesized
ttatgtatatgtaagcattcca

SEQ ID NO: 1373431 - DNA, 22 bp, Artificial Sequence
  chemically synthesized
tgtatatgtaagcattccataa

SEQ ID NO: 1373432 - DNA, 22 bp, Artificial Sequence
  chemically synthesized
agatttgggattttatggaatg

SEQ ID NO: 1373433 - DNA, 22 bp, Artificial Sequence
  chemically synthesized
cagatttgggattttatggaat

SEQ ID NO: 1373434 - DNA, 22 bp, Artificial Sequence
  chemically synthesized
aagtgtttcagatttgggattt

SEQ ID NO: 1373435 - DNA, 22 bp, Artificial Sequence
  chemically synthesized
ggacctgaagtgtttcagattt

SEQ ID NO: 1373436 - DNA, 22 bp, Artificial Sequence
  chemically synthesized
cataaaatcccaaatctgaaac

SEQ ID NO: 1373437 - DNA, 22 bp, Artificial Sequence
  chemically synthesized
gggacctgaagtgtttcagatt

SEQ ID NO: 1373438 - DNA, 22 bp, Artificial Sequence
  chemically synthesized
tccaaaatgcttgggacctgaa

SEQ ID NO: 1373439 - DNA, 22 bp, Artificial Sequence
  chemically synthesized
atccaaaatgcttgggacctga

SEQ ID NO: 1373440 - DNA, 22 bp, Artificial Sequence
  chemically synthesized
cttatccaaaatgcttgggacc

SEQ ID NO: 1373441 - DNA, 22 bp, Artificial Sequence
  chemically synthesized
aaacacttcaggtcccaagcat

SEQ ID NO: 1373442 - DNA, 22 bp, Artificial Sequence
  chemically synthesized
agtattccttatccaaaatgct

SEQ ID NO: 1373443 - DNA, 22 bp, Artificial Sequence
  chemically synthesized
caggtcccaagcattttggata

SEQ ID NO: 1373444 - DNA, 22 bp, Artificial Sequence
  chemically synthesized
aggtcccaagcattttggataa

SEQ ID NO: 1373445 - DNA, 22 bp, Artificial Sequence
  chemically synthesized
atgatgatacggattgagtatt

SEQ ID NO: 1373446 - DNA, 22 bp, Artificial Sequence
  chemically synthesized
tggataaggaatactcaatccg

SEQ ID NO: 1373447 - DNA, 22 bp, Artificial Sequence
  chemically synthesized
ggataaggaatactcaatccgt

SEQ ID NO: 1373448 - DNA, 22 bp, Artificial Sequence
  chemically synthesized
gataaggaatactcaatccgta

SEQ ID NO: 1373449 - DNA, 22 bp, Artificial Sequence
  chemically synthesized
tagttaatgatgatacggattg

SEQ ID NO: 1373450 - DNA, 22 bp, Artificial Sequence
  chemically synthesized
aatccgtatcatcattaactat

SEQ ID NO: 1373451 - DNA, 22 bp, Artificial Sequence
  chemically synthesized
tacaatatggtgactatagtta

SEQ ID NO: 1373452 - DNA, 22 bp, Artificial Sequence
  chemically synthesized
ttgtacaatatggtgactatag

SEQ ID NO: 1373453 - DNA, 22 bp, Artificial Sequence
  chemically synthesized
actatagtcaccatattgtaca

SEQ ID NO: 1373454 - DNA, 22 bp, Artificial Sequence
  chemically synthesized
tagtcaccatattgtacaatag

SEQ ID NO: 1373455 - DNA, 22 bp, Artificial Sequence
  chemically synthesized
gatatgagaaataaaatcaaga

SEQ ID NO: 1373456 - DNA, 22 bp, Artificial Sequence
  chemically synthesized
tacaatagatctcttgatttta

SEQ ID NO: 1373457 - DNA, 22 bp, Artificial Sequence
  chemically synthesized
cagttagatatgagaaataaaa

SEQ ID NO: 1373458 - DNA, 22 bp, Artificial Sequence
  chemically synthesized
acagttagatatgagaaataaa

SEQ ID NO: 1373459 - DNA, 22 bp, Artificial Sequence
  chemically synthesized
ttgattttatttctcatatcta

SEQ ID NO: 1373460 - DNA, 22 bp, Artificial Sequence
  chemically synthesized
gattttatttctcatatctaac

SEQ ID NO: 1373461 - DNA, 22 bp, Artificial Sequence
  chemically synthesized
attttatttctcatatctaact

SEQ ID NO: 1373462 - DNA, 22 bp, Artificial Sequence
  chemically synthesized
tatttctcatatctaactgtaa

SEQ ID NO: 1373463 - DNA, 22 bp, Artificial Sequence
  chemically synthesized
aataatacatatttacagttag

SEQ ID NO: 1373464 - DNA, 22 bp, Artificial Sequence
  chemically synthesized
atttctcatatctaactgtaaa

SEQ ID NO: 1373465 - DNA, 22 bp, Artificial Sequence
  chemically synthesized
tttctcatatctaactgtaaat

SEQ ID NO: 1373466 - DNA, 22 bp, Artificial Sequence
  chemically synthesized
ctcatatctaactgtaaatatg

SEQ ID NO: 1373467 - DNA, 22 bp, Artificial Sequence
  chemically synthesized
tcatatctaactgtaaatatgt

SEQ ID NO: 1373468 - DNA, 22 bp, Artificial Sequence
  chemically synthesized
atatctaactgtaaatatgtat

SEQ ID NO: 1373469 - DNA, 22 bp, Artificial Sequence
  chemically synthesized
actgtaaatatgtattatttaa

SEQ ID NO: 1373470 - DNA, 22 bp, Artificial Sequence
  chemically synthesized
tgaagataacggttaaataata

SEQ ID NO: 1373471 - DNA, 22 bp, Artificial Sequence
  chemically synthesized
taaatatgtattatttaaccgt

SEQ ID NO: 1373472 - DNA, 22 bp, Artificial Sequence
  chemically synthesized
tttaaccgttatcttcataatc

SEQ ID NO: 1373473 - DNA, 22 bp, Artificial Sequence
  chemically synthesized
agagagagggaggattatgaag

SEQ ID NO: 1373474 - DNA, 22 bp, Artificial Sequence
  chemically synthesized
aaccgttatcttcataatcctc

SEQ ID NO: 1373475 - DNA, 22 bp, Artificial Sequence
  chemically synthesized
accgttatcttcataatcctcc

SEQ ID NO: 1373476 - DNA, 22 bp, Artificial Sequence
  chemically synthesized
tcttcataatcctccctctctc

SEQ ID NO: 1373477 - DNA, 22 bp, Artificial Sequence
  chemically synthesized
cataatcctccctctctcttaa

SEQ ID NO: 1373478 - DNA, 22 bp, Artificial Sequence
  chemically synthesized
ataatcctccctctctcttaac

SEQ ID NO: 1373479 - DNA, 22 bp, Artificial Sequence
  chemically synthesized
ccagaaggtgaggtagttaaga

SEQ ID NO: 1373480 - DNA, 22 bp, Artificial Sequence
  chemically synthesized
gttaccagaaggtgaggtagtt

SEQ ID NO: 1373481 - DNA, 22 bp, Artificial Sequence
  chemically synthesized
cctctctcttaactacctcacc

SEQ ID NO: 1373482 - DNA, 22 bp, Artificial Sequence
  chemically synthesized
tctcttaactacctcaccttct

SEQ ID NO: 1373483 - DNA, 22 bp, Artificial Sequence
  chemically synthesized
tcttaactacctcaccttctgg

SEQ ID NO: 1373484 - DNA, 22 bp, Artificial Sequence
  chemically synthesized
ttaactacctcaccttctggta

SEQ ID NO: 1373485 - DNA, 22 bp, Artificial Sequence
  chemically synthesized
aactacctcaccttctggtaac

SEQ ID NO: 1373486 - DNA, 22 bp, Artificial Sequence
  chemically synthesized
actacctcaccttctggtaacc

SEQ ID NO: 1373487 - DNA, 22 bp, Artificial Sequence
  chemically synthesized
cctcaccttctggtaaccaaca

SEQ ID NO: 1373488 - DNA, 22 bp, Artificial Sequence
  chemically synthesized
aagtagagaataaaatgttggt

SEQ ID NO: 1373489 - DNA, 22 bp, Artificial Sequence
  chemically synthesized
accttctggtaaccaacatttt

SEQ ID NO: 1373490 - DNA, 22 bp, Artificial Sequence
  chemically synthesized
aaagtagagaataaaatgttgg

SEQ ID NO: 1373491 - DNA, 22 bp, Artificial Sequence
  chemically synthesized
taaagtagagaataaaatgttg

SEQ ID NO: 1373492 - DNA, 22 bp, Artificial Sequence
  chemically synthesized
ctggtaaccaacattttattct

SEQ ID NO: 1373493 - DNA, 22 bp, Artificial Sequence
  chemically synthesized
attttaaagtagagaataaaat

SEQ ID NO: 1373494 - DNA, 22 bp, Artificial Sequence
  chemically synthesized
tggtaaccaacattttattctc

SEQ ID NO: 1373495 - DNA, 22 bp, Artificial Sequence
  chemically synthesized
gtaaccaacattttattctcta

SEQ ID NO: 1373496 - DNA, 22 bp, Artificial Sequence
  chemically synthesized
aaaaggttgattttaaagtaga

SEQ ID NO: 1373497 - DNA, 22 bp, Artificial Sequence
  chemically synthesized
tattctctactttaaaatcaac

SEQ ID NO: 1373498 - DNA, 22 bp, Artificial Sequence
  chemically synthesized
attctctactttaaaatcaacc

SEQ ID NO: 1373499 - DNA, 22 bp, Artificial Sequence
  chemically synthesized
ttctctactttaaaatcaacct

SEQ ID NO: 1373500 - DNA, 22 bp, Artificial Sequence
  chemically synthesized
tgcggaatctgaaaaggttgat

SEQ ID NO: 1373501 - DNA, 22 bp, Artificial Sequence
  chemically synthesized
tctactttaaaatcaacctttt

SEQ ID NO: 1373502 - DNA, 22 bp, Artificial Sequence
  chemically synthesized
atgcggaatctgaaaaggttga

SEQ ID NO: 1373503 - DNA, 22 bp, Artificial Sequence
  chemically synthesized
tatgcggaatctgaaaaggttg

SEQ ID NO: 1373504 - DNA, 22 bp, Artificial Sequence
  chemically synthesized
tactttaaaatcaaccttttca

SEQ ID NO: 1373505 - DNA, 22 bp, Artificial Sequence
  chemically synthesized
ctttaaaatcaaccttttcaga

SEQ ID NO: 1373506 - DNA, 22 bp, Artificial Sequence
  chemically synthesized
ctttatgcggaatctgaaaagg

SEQ ID NO: 1373507 - DNA, 22 bp, Artificial Sequence
  chemically synthesized
actttatgcggaatctgaaaag

SEQ ID NO: 1373508 - DNA, 22 bp, Artificial Sequence
  chemically synthesized
taaaatcaaccttttcagattc

SEQ ID NO: 1373509 - DNA, 22 bp, Artificial Sequence
  chemically synthesized
aaaatcaaccttttcagattcc

SEQ ID NO: 1373510 - DNA, 22 bp, Artificial Sequence
  chemically synthesized
aaatcaaccttttcagattccg

SEQ ID NO: 1373511 - DNA, 22 bp, Artificial Sequence
  chemically synthesized
tcttactttatgcggaatctga

SEQ ID NO: 1373512 - DNA, 22 bp, Artificial Sequence
  chemically synthesized
ttcagattccgcataaagtaag

SEQ ID NO: 1373513 - DNA, 22 bp, Artificial Sequence
  chemically synthesized
tcagattccgcataaagtaaga

SEQ ID NO: 1373514 - DNA, 22 bp, Artificial Sequence
  chemically synthesized
cagattccgcataaagtaagat

SEQ ID NO: 1373515 - DNA, 22 bp, Artificial Sequence
  chemically synthesized
agattccgcataaagtaagata

SEQ ID NO: 1373516 - DNA, 22 bp, Artificial Sequence
  chemically synthesized
cgcataaagtaagataacgtgg

SEQ ID NO: 1373517 - DNA, 22 bp, Artificial Sequence
  chemically synthesized
aataagccaggcagagaaagaa

SEQ ID NO: 1373518 - DNA, 22 bp, Artificial Sequence
  chemically synthesized
agttaaataagccaggcagaga

SEQ ID NO: 1373519 - DNA, 22 bp, Artificial Sequence
  chemically synthesized
tttctttctctgcctggcttat

SEQ ID NO: 1373520 - DNA, 22 bp, Artificial Sequence
  chemically synthesized
ttctttctctgcctggcttatt

SEQ ID NO: 1373521 - DNA, 22 bp, Artificial Sequence
  chemically synthesized
tctttctctgcctggcttattt

SEQ ID NO: 1373522 - DNA, 22 bp, Artificial Sequence
  chemically synthesized
ctttctctgcctggcttattta

SEQ ID NO: 1373523 - DNA, 22 bp, Artificial Sequence
  chemically synthesized
tttctctgcctggcttatttaa

SEQ ID NO: 1373524 - DNA, 22 bp, Artificial Sequence
  chemically synthesized
gaggatattaagttaaataagc

SEQ ID NO: 1373525 - DNA, 22 bp, Artificial Sequence
  chemically synthesized
tctctgcctggcttatttaact

SEQ ID NO: 1373526 - DNA, 22 bp, Artificial Sequence
  chemically synthesized
ctctgcctggcttatttaactt

SEQ ID NO: 1373527 - DNA, 22 bp, Artificial Sequence
  chemically synthesized
tctgcctggcttatttaactta

SEQ ID NO: 1373528 - DNA, 22 bp, Artificial Sequence
  chemically synthesized
tgcctggcttatttaacttaat

SEQ ID NO: 1373529 - DNA, 22 bp, Artificial Sequence
  chemically synthesized
cctggcttatttaacttaatat

SEQ ID NO: 1373530 - DNA, 22 bp, Artificial Sequence
  chemically synthesized
gcttatttaacttaatatcctc

SEQ ID NO: 1373531 - DNA, 22 bp, Artificial Sequence
  chemically synthesized
atttaacttaatatcctccagg

SEQ ID NO: 1373532 - DNA, 22 bp, Artificial Sequence
  chemically synthesized
tttaacttaatatcctccaggt

SEQ ID NO: 1373533 - DNA, 22 bp, Artificial Sequence
  chemically synthesized
aacttaatatcctccaggttca

SEQ ID NO: 1373534 - DNA, 22 bp, Artificial Sequence
  chemically synthesized
cagcaacatgaatgaacctgga

SEQ ID NO: 1373535 - DNA, 22 bp, Artificial Sequence
  chemically synthesized
acttaatatcctccaggttcat

SEQ ID NO: 1373536 - DNA, 22 bp, Artificial Sequence
  chemically synthesized
gcagcaacatgaatgaacctgg

SEQ ID NO: 1373537 - DNA, 22 bp, Artificial Sequence
  chemically synthesized
aatatcctccaggttcattcat

SEQ ID NO: 1373538 - DNA, 22 bp, Artificial Sequence
  chemically synthesized
atatcctccaggttcattcatg

SEQ ID NO: 1373539 - DNA, 22 bp, Artificial Sequence
  chemically synthesized
ccatttgcagcaacatgaatga

SEQ ID NO: 1373540 - DNA, 22 bp, Artificial Sequence
  chemically synthesized
caggttcattcatgttgctgca

SEQ ID NO: 1373541 - DNA, 22 bp, Artificial Sequence
  chemically synthesized
attcatgttgctgcaaatggca

SEQ ID NO: 1373542 - DNA, 22 bp, Artificial Sequence
  chemically synthesized
atgttgctgcaaatggcaggtt

SEQ ID NO: 1373543 - DNA, 22 bp, Artificial Sequence
  chemically synthesized
atccatgaagagaatgaaacct

SEQ ID NO: 1373544 - DNA, 22 bp, Artificial Sequence
  chemically synthesized
ctgcaaatggcaggtttcattc

SEQ ID NO: 1373545 - DNA, 22 bp, Artificial Sequence
  chemically synthesized
ttcatccatgaagagaatgaaa

SEQ ID NO: 1373546 - DNA, 22 bp, Artificial Sequence
  chemically synthesized
caaatggcaggtttcattctct

SEQ ID NO: 1373547 - DNA, 22 bp, Artificial Sequence
  chemically synthesized
cattctcttcatggatgaacag

SEQ ID NO: 1373548 - DNA, 22 bp, Artificial Sequence
  chemically synthesized
attctcttcatggatgaacagt

SEQ ID NO: 1373549 - DNA, 22 bp, Artificial Sequence
  chemically synthesized
tcttcatggatgaacagtattc

SEQ ID NO: 1373550 - DNA, 22 bp, Artificial Sequence
  chemically synthesized
ttcatggatgaacagtattcta

SEQ ID NO: 1373551 - DNA, 22 bp, Artificial Sequence
  chemically synthesized
catggatgaacagtattctatt

SEQ ID NO: 1373552 - DNA, 22 bp, Artificial Sequence
  chemically synthesized
atggatgaacagtattctattg

SEQ ID NO: 1373553 - DNA, 22 bp, Artificial Sequence
  chemically synthesized
tattgtgtacgtataccacatt

SEQ ID NO: 1373554 - DNA, 22 bp, Artificial Sequence
  chemically synthesized
ttgtgtacgtataccacatttt

SEQ ID NO: 1373555 - DNA, 22 bp, Artificial Sequence
  chemically synthesized
tgtacgtataccacattttttc

SEQ ID NO: 1373556 - DNA, 22 bp, Artificial Sequence
  chemically synthesized
gtgaatgaataaaagaaaaaat

SEQ ID NO: 1373557 - DNA, 22 bp, Artificial Sequence
  chemically synthesized
agggtccatcaactggtgaatg

SEQ ID NO: 1373558 - DNA, 22 bp, Artificial Sequence
  chemically synthesized
tttcttttattcattcaccagt

SEQ ID NO: 1373559 - DNA, 22 bp, Artificial Sequence
  chemically synthesized
ttcttttattcattcaccagtt

SEQ ID NO: 1373560 - DNA, 22 bp, Artificial Sequence
  chemically synthesized
tcttttattcattcaccagttg

SEQ ID NO: 1373561 - DNA, 22 bp, Artificial Sequence
  chemically synthesized
cttttattcattcaccagttga

SEQ ID NO: 1373562 - DNA, 22 bp, Artificial Sequence
  chemically synthesized
ttttattcattcaccagttgat

SEQ ID NO: 1373563 - DNA, 22 bp, Artificial Sequence
  chemically synthesized
ttattcattcaccagttgatgg

SEQ ID NO: 1373564 - DNA, 22 bp, Artificial Sequence
  chemically synthesized
tattcattcaccagttgatgga

SEQ ID NO: 1373565 - DNA, 22 bp, Artificial Sequence
  chemically synthesized
attcattcaccagttgatggac

SEQ ID NO: 1373566 - DNA, 22 bp, Artificial Sequence
  chemically synthesized
ttcattcaccagttgatggacc

SEQ ID NO: 1373567 - DNA, 22 bp, Artificial Sequence
  chemically synthesized
attcaccagttgatggaccctt

SEQ ID NO: 1373568 - DNA, 22 bp, Artificial Sequence
  chemically synthesized
accagttgatggacccttaggt

SEQ ID NO: 1373569 - DNA, 22 bp, Artificial Sequence
  chemically synthesized
agatatggaatcaacctaaggg

SEQ ID NO: 1373570 - DNA, 22 bp, Artificial Sequence
  chemically synthesized
ctgagatatggaatcaacctaa

SEQ ID NO: 1373571 - DNA, 22 bp, Artificial Sequence
  chemically synthesized
atggacccttaggttgattcca

SEQ ID NO: 1373572 - DNA, 22 bp, Artificial Sequence
  chemically synthesized
acaattgctgagatatggaatc

SEQ ID NO: 1373573 - DNA, 22 bp, Artificial Sequence
  chemically synthesized
aggttgattccatatctcagca

SEQ ID NO: 1373574 - DNA, 22 bp, Artificial Sequence
  chemically synthesized
ggttgattccatatctcagcaa

SEQ ID NO: 1373575 - DNA, 22 bp, Artificial Sequence
  chemically synthesized
cagcacattcacaattgctgag

SEQ ID NO: 1373576 - DNA, 22 bp, Artificial Sequence
  chemically synthesized
attccatatctcagcaattgtg

SEQ ID NO: 1373577 - DNA, 22 bp, Artificial Sequence
  chemically synthesized
ttgcagcacattcacaattgct

SEQ ID NO: 1373578 - DNA, 22 bp, Artificial Sequence
  chemically synthesized
attgcagcacattcacaattgc

SEQ ID NO: 1373579 - DNA, 22 bp, Artificial Sequence
  chemically synthesized
catatctcagcaattgtgaatg

SEQ ID NO: 1373580 - DNA, 22 bp, Artificial Sequence
  chemically synthesized
agcaattgtgaatgtgctgcaa

SEQ ID NO: 1373581 - DNA, 22 bp, Artificial Sequence
  chemically synthesized
cacacccaagtttattgcagca

SEQ ID NO: 1373582 - DNA, 22 bp, Artificial Sequence
  chemically synthesized
tgaatgtgctgcaataaacttg

SEQ ID NO: 1373583 - DNA, 22 bp, Artificial Sequence
  chemically synthesized
aagagatatctgcacacccaag

SEQ ID NO: 1373584 - DNA, 22 bp, Artificial Sequence
  chemically synthesized
caataaacttgggtgtgcagat

SEQ ID NO: 1373585 - DNA, 22 bp, Artificial Sequence
  chemically synthesized
gggtgtgcagatatctcttcaa

SEQ ID NO: 1373586 - DNA, 22 bp, Artificial Sequence
  chemically synthesized
ggtgtgcagatatctcttcaac

SEQ ID NO: 1373587 - DNA, 22 bp, Artificial Sequence
  chemically synthesized
tataccgaaaggaaatgaaatc

SEQ ID NO: 1373588 - DNA, 22 bp, Artificial Sequence
  chemically synthesized
ttcaacgtgttgatttcatttc

SEQ ID NO: 1373589 - DNA, 22 bp, Artificial Sequence
  chemically synthesized
caacgtgttgatttcatttcct

SEQ ID NO: 1373590 - DNA, 22 bp, Artificial Sequence
  chemically synthesized
aacgtgttgatttcatttcctt

SEQ ID NO: 1373591 - DNA, 22 bp, Artificial Sequence
  chemically synthesized
gctatataccgaaaggaaatga

SEQ ID NO: 1373592 - DNA, 22 bp, Artificial Sequence
  chemically synthesized
ctggctatataccgaaaggaaa

SEQ ID NO: 1373593 - DNA, 22 bp, Artificial Sequence
  chemically synthesized
atttcatttcctttcggtatat

SEQ ID NO: 1373594 - DNA, 22 bp, Artificial Sequence
  chemically synthesized
catttcctttcggtatatagcc

SEQ ID NO: 1373595 - DNA, 22 bp, Artificial Sequence
  chemically synthesized
atttcctttcggtatatagcca

SEQ ID NO: 1373596 - DNA, 22 bp, Artificial Sequence
  chemically synthesized
cctttcggtatatagccagtag

SEQ ID NO: 1373597 - DNA, 22 bp, Artificial Sequence
  chemically synthesized
ctttcggtatatagccagtagt

SEQ ID NO: 1373598 - DNA, 22 bp, Artificial Sequence
  chemically synthesized
tcggtatatagccagtagtggg

SEQ ID NO: 1373599 - DNA, 22 bp, Artificial Sequence
  chemically synthesized
cggtatatagccagtagtggga

SEQ ID NO: 1373600 - DNA, 22 bp, Artificial Sequence
  chemically synthesized
ggtatatagccagtagtgggac

SEQ ID NO: 1373601 - DNA, 22 bp, Artificial Sequence
  chemically synthesized
acatatgatccagcagtcccac

SEQ ID NO: 1373602 - DNA, 22 bp, Artificial Sequence
  chemically synthesized
gaactaacatatgatccagcag

SEQ ID NO: 1373603 - DNA, 22 bp, Artificial Sequence
  chemically synthesized
aaactagaactaacatatgatc

SEQ ID NO: 1373604 - DNA, 22 bp, Artificial Sequence
  chemically synthesized
ctggatcatatgttagttctag

SEQ ID NO: 1373605 - DNA, 22 bp, Artificial Sequence
  chemically synthesized
aaaaaaattaaaactagaacta

SEQ ID NO: 1373606 - DNA, 22 bp, Artificial Sequence
  chemically synthesized
gatcatatgttagttctagttt

SEQ ID NO: 1373607 - DNA, 22 bp, Artificial Sequence
  chemically synthesized
tcaaaaaaattaaaactagaac

SEQ ID NO: 1373608 - DNA, 22 bp, Artificial Sequence
  chemically synthesized
ctcaaaaaaattaaaactagaa

SEQ ID NO: 1373609 - DNA, 22 bp, Artificial Sequence
  chemically synthesized
tctcaaaaaaattaaaactaga

SEQ ID NO: 1373610 - DNA, 22 bp, Artificial Sequence
  chemically synthesized
gttctagttttaatttttttga

SEQ ID NO: 1373611 - DNA, 22 bp, Artificial Sequence
  chemically synthesized
tagttttaatttttttgagaaa

SEQ ID NO: 1373612 - DNA, 22 bp, Artificial Sequence
  chemically synthesized
gttttaatttttttgagaaagc

SEQ ID NO: 1373613 - DNA, 22 bp, Artificial Sequence
  chemically synthesized
aaaacagtaggggctttctcaa

SEQ ID NO: 1373614 - DNA, 22 bp, Artificial Sequence
  chemically synthesized
ttgaaaacagtaggggctttct

SEQ ID NO: 1373615 - DNA, 22 bp, Artificial Sequence
  chemically synthesized
taatttttttgagaaagcccct

SEQ ID NO: 1373616 - DNA, 22 bp, Artificial Sequence
  chemically synthesized
aatttttttgagaaagccccta

SEQ ID NO: 1373617 - DNA, 22 bp, Artificial Sequence
  chemically synthesized
atttttttgagaaagcccctac

SEQ ID NO: 1373618 - DNA, 22 bp, Artificial Sequence
  chemically synthesized
ttttgagaaagcccctactgtt

SEQ ID NO: 1373619 - DNA, 22 bp, Artificial Sequence
  chemically synthesized
tttgagaaagcccctactgttt

SEQ ID NO: 1373620 - DNA, 22 bp, Artificial Sequence
  chemically synthesized
ttgagaaagcccctactgtttt

SEQ ID NO: 1373621 - DNA, 22 bp, Artificial Sequence
  chemically synthesized
tgagaaagcccctactgttttc

SEQ ID NO: 1373622 - DNA, 22 bp, Artificial Sequence
  chemically synthesized
gagaaagcccctactgttttca

SEQ ID NO: 1373623 - DNA, 22 bp, Artificial Sequence
  chemically synthesized
agaaagcccctactgttttcaa

SEQ ID NO: 1373624 - DNA, 22 bp, Artificial Sequence
  chemically synthesized
atataaccattattgaaaacag

SEQ ID NO: 1373625 - DNA, 22 bp, Artificial Sequence
  chemically synthesized
ctgttttcaataatggttatat

SEQ ID NO: 1373626 - DNA, 22 bp, Artificial Sequence
  chemically synthesized
ttttcaataatggttatattaa

SEQ ID NO: 1373627 - DNA, 22 bp, Artificial Sequence
  chemically synthesized
gtgggaatgtgaattaatataa

SEQ ID NO: 1373628 - DNA, 22 bp, Artificial Sequence
  chemically synthesized
tcaataatggttatattaattc

SEQ ID NO: 1373629 - DNA, 22 bp, Artificial Sequence
  chemically synthesized
caataatggttatattaattca

SEQ ID NO: 1373630 - DNA, 22 bp, Artificial Sequence
  chemically synthesized
aataatggttatattaattcac

SEQ ID NO: 1373631 - DNA, 22 bp, Artificial Sequence
  chemically synthesized
cacaccgttggtgggaatgtga

SEQ ID NO: 1373632 - DNA, 22 bp, Artificial Sequence
  chemically synthesized
gcacaccgttggtgggaatgtg

SEQ ID NO: 1373633 - DNA, 22 bp, Artificial Sequence
  chemically synthesized
tattaattcacattcccaccaa

SEQ ID NO: 1373634 - DNA, 22 bp, Artificial Sequence
  chemically synthesized
attcacattcccaccaacggtg

SEQ ID NO: 1373635 - DNA, 22 bp, Artificial Sequence
  chemically synthesized
acattcccaccaacggtgtgca

SEQ ID NO: 1373636 - DNA, 22 bp, Artificial Sequence
  chemically synthesized
ccaccaacggtgtgcaagggtt

SEQ ID NO: 1373637 - DNA, 22 bp, Artificial Sequence
  chemically synthesized
agaaggtagagaaaagggaacc

SEQ ID NO: 1373638 - DNA, 22 bp, Artificial Sequence
  chemically synthesized
ctgagaaggtagagaaaaggga

SEQ ID NO: 1373639 - DNA, 22 bp, Artificial Sequence
  chemically synthesized
ccttttctctaccttctcagga

SEQ ID NO: 1373640 - DNA, 22 bp, Artificial Sequence
  chemically synthesized
ttctctaccttctcaggaacac

SEQ ID NO: 1373641 - DNA, 22 bp, Artificial Sequence
  chemically synthesized
tctctaccttctcaggaacact

SEQ ID NO: 1373642 - DNA, 22 bp, Artificial Sequence
  chemically synthesized
ctctaccttctcaggaacactt

SEQ ID NO: 1373643 - DNA, 22 bp, Artificial Sequence
  chemically synthesized
tctaccttctcaggaacacttg

SEQ ID NO: 1373644 - DNA, 22 bp, Artificial Sequence
  chemically synthesized
taccttctcaggaacacttgtt

SEQ ID NO: 1373645 - DNA, 22 bp, Artificial Sequence
  chemically synthesized
ccttctcaggaacacttgttat

SEQ ID NO: 1373646 - DNA, 22 bp, Artificial Sequence
  chemically synthesized
ctcaggaacacttgttatcttt

SEQ ID NO: 1373647 - DNA, 22 bp, Artificial Sequence
  chemically synthesized
tcaggaacacttgttatctttt

SEQ ID NO: 1373648 - DNA, 22 bp, Artificial Sequence
  chemically synthesized
aggaacacttgttatcttttgc

SEQ ID NO: 1373649 - DNA, 22 bp, Artificial Sequence
  chemically synthesized
gaatgacatcaagaaggcaaaa

SEQ ID NO: 1373650 - DNA, 22 bp, Artificial Sequence
  chemically synthesized
ttagaatgacatcaagaaggca

SEQ ID NO: 1373651 - DNA, 22 bp, Artificial Sequence
  chemically synthesized
gttatcttttgccttcttgatg

SEQ ID NO: 1373652 - DNA, 22 bp, Artificial Sequence
  chemically synthesized
ttatcttttgccttcttgatgt

SEQ ID NO: 1373653 - DNA, 22 bp, Artificial Sequence
  chemically synthesized
tcttttgccttcttgatgtcat

SEQ ID NO: 1373654 - DNA, 22 bp, Artificial Sequence
  chemically synthesized
aaacctgttagaatgacatcaa

SEQ ID NO: 1373655 - DNA, 22 bp, Artificial Sequence
  chemically synthesized
ttgccttcttgatgtcattcta

SEQ ID NO: 1373656 - DNA, 22 bp, Artificial Sequence
  chemically synthesized
tgccttcttgatgtcattctaa

SEQ ID NO: 1373657 - DNA, 22 bp, Artificial Sequence
  chemically synthesized
gccttcttgatgtcattctaac

SEQ ID NO: 1373658 - DNA, 22 bp, Artificial Sequence
  chemically synthesized
ccttcttgatgtcattctaaca

SEQ ID NO: 1373659 - DNA, 22 bp, Artificial Sequence
  chemically synthesized
cttgatgtcattctaacaggtt

SEQ ID NO: 1373660 - DNA, 22 bp, Artificial Sequence
  chemically synthesized
ttgatgtcattctaacaggttt

SEQ ID NO: 1373661 - DNA, 22 bp, Artificial Sequence
  chemically synthesized
gatgtcattctaacaggtttga

SEQ ID NO: 1373662 - DNA, 22 bp, Artificial Sequence
  chemically synthesized
atgtcattctaacaggtttgag

SEQ ID NO: 1373663 - DNA, 22 bp, Artificial Sequence
  chemically synthesized
taacaggtttgagttgatatct

SEQ ID NO: 1373664 - DNA, 22 bp, Artificial Sequence
  chemically synthesized
acaggtttgagttgatatctca

SEQ ID NO: 1373665 - DNA, 22 bp, Artificial Sequence
  chemically synthesized
gagttgatatctcactgtggat

SEQ ID NO: 1373666 - DNA, 22 bp, Artificial Sequence
  chemically synthesized
agttgatatctcactgtggatt

SEQ ID NO: 1373667 - DNA, 22 bp, Artificial Sequence
  chemically synthesized
atatctcactgtggatttattt

SEQ ID NO: 1373668 - DNA, 22 bp, Artificial Sequence
  chemically synthesized
aacatcaggtaaatgtaaataa

SEQ ID NO: 1373669 - DNA, 22 bp, Artificial Sequence
  chemically synthesized
actgtggatttatttacattta

SEQ ID NO: 1373670 - DNA, 22 bp, Artificial Sequence
  chemically synthesized
tggatttatttacatttacctg

SEQ ID NO: 1373671 - DNA, 22 bp, Artificial Sequence
  chemically synthesized
agcatcattaaacatcaggtaa

SEQ ID NO: 1373672 - DNA, 22 bp, Artificial Sequence
  chemically synthesized
atttacatttacctgatgttta

SEQ ID NO: 1373673 - DNA, 22 bp, Artificial Sequence
  chemically synthesized
tttacatttacctgatgtttaa

SEQ ID NO: 1373674 - DNA, 22 bp, Artificial Sequence
  chemically synthesized
acatttacctgatgtttaatga

SEQ ID NO: 1373675 - DNA, 22 bp, Artificial Sequence
  chemically synthesized
catttacctgatgtttaatgat

SEQ ID NO: 1373676 - DNA, 22 bp, Artificial Sequence
  chemically synthesized
acctgatgtttaatgatgctga

SEQ ID NO: 1373677 - DNA, 22 bp, Artificial Sequence
  chemically synthesized
cctgatgtttaatgatgctgaa

SEQ ID NO: 1373678 - DNA, 22 bp, Artificial Sequence
  chemically synthesized
atgtttaatgatgctgaacatg

SEQ ID NO: 1373679 - DNA, 22 bp, Artificial Sequence
  chemically synthesized
aatgatgctgaacatgttttcg

SEQ ID NO: 1373680 - DNA, 22 bp, Artificial Sequence
  chemically synthesized
atgatgctgaacatgttttcgt

SEQ ID NO: 1373681 - DNA, 22 bp, Artificial Sequence
  chemically synthesized
acatagccaacaggaatacgaa

SEQ ID NO: 1373682 - DNA, 22 bp, Artificial Sequence
  chemically synthesized
aacatgttttcgtattcctgtt

SEQ ID NO: 1373683 - DNA, 22 bp, Artificial Sequence
  chemically synthesized
tcgtattcctgttggctatgtg

SEQ ID NO: 1373684 - DNA, 22 bp, Artificial Sequence
  chemically synthesized
cgtattcctgttggctatgtga

SEQ ID NO: 1373685 - DNA, 22 bp, Artificial Sequence
  chemically synthesized
aagagaagacattcacatagcc

SEQ ID NO: 1373686 - DNA, 22 bp, Artificial Sequence
  chemically synthesized
gtattcctgttggctatgtgaa

SEQ ID NO: 1373687 - DNA, 22 bp, Artificial Sequence
  chemically synthesized
tcaagagaagacattcacatag

SEQ ID NO: 1373688 - DNA, 22 bp, Artificial Sequence
  chemically synthesized
ctcaagagaagacattcacata

SEQ ID NO: 1373689 - DNA, 22 bp, Artificial Sequence
  chemically synthesized
ctgttggctatgtgaatgtctt

SEQ ID NO: 1373690 - DNA, 22 bp, Artificial Sequence
  chemically synthesized
ttggctatgtgaatgtcttctc

SEQ ID NO: 1373691 - DNA, 22 bp, Artificial Sequence
  chemically synthesized
gctatgtgaatgtcttctcttg

SEQ ID NO: 1373692 - DNA, 22 bp, Artificial Sequence
  chemically synthesized
agcaggcatttctcaagagaag

SEQ ID NO: 1373693 - DNA, 22 bp, Artificial Sequence
  chemically synthesized
tgtgaatgtcttctcttgagaa

SEQ ID NO: 1373694 - DNA, 22 bp, Artificial Sequence
  chemically synthesized
ctcttgagaaatgcctgctcag

SEQ ID NO: 1373695 - DNA, 22 bp, Artificial Sequence
  chemically synthesized
tcttgagaaatgcctgctcaga

SEQ ID NO: 1373696 - DNA, 22 bp, Artificial Sequence
  chemically synthesized
ttgagaaatgcctgctcagatc

SEQ ID NO: 1373697 - DNA, 22 bp, Artificial Sequence
  chemically synthesized
aaaatgagcaaaagatctgagc

SEQ ID NO: 1373698 - DNA, 22 bp, Artificial Sequence
  chemically synthesized
gagaaatgcctgctcagatctt

SEQ ID NO: 1373699 - DNA, 22 bp, Artificial Sequence
  chemically synthesized
agaaatgcctgctcagatcttt

SEQ ID NO: 1373700 - DNA, 22 bp, Artificial Sequence
  chemically synthesized
ctcagatcttttgctcattttt

SEQ ID NO: 1373701 - DNA, 22 bp, Artificial Sequence
  chemically synthesized
agatcttttgctcatttttaat

SEQ ID NO: 1373702 - DNA, 22 bp, Artificial Sequence
  chemically synthesized
ttgctcatttttaattgggtta

SEQ ID NO: 1373703 - DNA, 22 bp, Artificial Sequence
  chemically synthesized
tgctcatttttaattgggttat

SEQ ID NO: 1373704 - DNA, 22 bp, Artificial Sequence
  chemically synthesized
gctcatttttaattgggttatt

SEQ ID NO: 1373705 - DNA, 22 bp, Artificial Sequence
  chemically synthesized
ctcatttttaattgggttattt

SEQ ID NO: 1373706 - DNA, 22 bp, Artificial Sequence
  chemically synthesized
atttttaattgggttatttgtt

SEQ ID NO: 1373707 - DNA, 22 bp, Artificial Sequence
  chemically synthesized
ttaattgggttatttgttttct

SEQ ID NO: 1373708 - DNA, 22 bp, Artificial Sequence
  chemically synthesized
taattgggttatttgttttctt

SEQ ID NO: 1373709 - DNA, 22 bp, Artificial Sequence
  chemically synthesized
aattgggttatttgttttcttg

SEQ ID NO: 1373710 - DNA, 22 bp, Artificial Sequence
  chemically synthesized
attgggttatttgttttcttgc

SEQ ID NO: 1373711 - DNA, 22 bp, Artificial Sequence
  chemically synthesized
aaacaaataaatagcaagaaaa

SEQ ID NO: 1373712 - DNA, 22 bp, Artificial Sequence
  chemically synthesized
ggttatttgttttcttgctatt

SEQ ID NO: 1373713 - DNA, 22 bp, Artificial Sequence
  chemically synthesized
tttgttttcttgctatttattt

SEQ ID NO: 1373714 - DNA, 22 bp, Artificial Sequence
  chemically synthesized
gttttcttgctatttatttgtt

SEQ ID NO: 1373715 - DNA, 22 bp, Artificial Sequence
  chemically synthesized
ttttcttgctatttatttgttt

SEQ ID NO: 1373716 - DNA, 22 bp, Artificial Sequence
  chemically synthesized
tcttgctatttatttgtttgag

SEQ ID NO: 1373717 - DNA, 22 bp, Artificial Sequence
  chemically synthesized
cttgctatttatttgtttgagt

SEQ ID NO: 1373718 - DNA, 22 bp, Artificial Sequence
  chemically synthesized
ttgctatttatttgtttgagtt

SEQ ID NO: 1373719 - DNA, 22 bp, Artificial Sequence
  chemically synthesized
gctatttatttgtttgagttac

SEQ ID NO: 1373720 - DNA, 22 bp, Artificial Sequence
  chemically synthesized
ctatttatttgtttgagttact

SEQ ID NO: 1373721 - DNA, 22 bp, Artificial Sequence
  chemically synthesized
tttatttgtttgagttactgat

SEQ ID NO: 1373722 - DNA, 22 bp, Artificial Sequence
  chemically synthesized
gtagccaaaatagatcagtaac

SEQ ID NO: 1373723 - DNA, 22 bp, Artificial Sequence
  chemically synthesized
atttgtttgagttactgatcta

SEQ ID NO: 1373724 - DNA, 22 bp, Artificial Sequence
  chemically synthesized
tttgtttgagttactgatctat

SEQ ID NO: 1373725 - DNA, 22 bp, Artificial Sequence
  chemically synthesized
gtttgagttactgatctatttt

SEQ ID NO: 1373726 - DNA, 22 bp, Artificial Sequence
  chemically synthesized
tttgagttactgatctattttg

SEQ ID NO: 1373727 - DNA, 22 bp, Artificial Sequence
  chemically synthesized
gagttactgatctattttggct

SEQ ID NO: 1373728 - DNA, 22 bp, Artificial Sequence
  chemically synthesized
taaggggttagtagccaaaata

SEQ ID NO: 1373729 - DNA, 22 bp, Artificial Sequence
  chemically synthesized
agttactgatctattttggcta

SEQ ID NO: 1373730 - DNA, 22 bp, Artificial Sequence
  chemically synthesized
ataaggggttagtagccaaaat

SEQ ID NO: 1373731 - DNA, 22 bp, Artificial Sequence
  chemically synthesized
ctgatctattttggctactaac

SEQ ID NO: 1373732 - DNA, 22 bp, Artificial Sequence
  chemically synthesized
atctattttggctactaacccc

SEQ ID NO: 1373733 - DNA, 22 bp, Artificial Sequence
  chemically synthesized
ttttggctactaaccccttata

SEQ ID NO: 1373734 - DNA, 22 bp, Artificial Sequence
  chemically synthesized
tacaccatacatcttataaggg

SEQ ID NO: 1373735 - DNA, 22 bp, Artificial Sequence
  chemically synthesized
tggctactaaccccttataaga

SEQ ID NO: 1373736 - DNA, 22 bp, Artificial Sequence
  chemically synthesized
gtacaccatacatcttataagg

SEQ ID NO: 1373737 - DNA, 22 bp, Artificial Sequence
  chemically synthesized
ggctactaaccccttataagat

SEQ ID NO: 1373738 - DNA, 22 bp, Artificial Sequence
  chemically synthesized
gctactaaccccttataagatg

SEQ ID NO: 1373739 - DNA, 22 bp, Artificial Sequence
  chemically synthesized
ctaaccccttataagatgtatg

SEQ ID NO: 1373740 - DNA, 22 bp, Artificial Sequence
  chemically synthesized
accccttataagatgtatggtg

SEQ ID NO: 1373741 - DNA, 22 bp, Artificial Sequence
  chemically synthesized
ataagatgtatggtgtacaaat

SEQ ID NO: 1373742 - DNA, 22 bp, Artificial Sequence
  chemically synthesized
taagatgtatggtgtacaaata

SEQ ID NO: 1373743 - DNA, 22 bp, Artificial Sequence
  chemically synthesized
cagaatgggatgaaatatttgt

SEQ ID NO: 1373744 - DNA, 22 bp, Artificial Sequence
  chemically synthesized
catcccattctgtaggttttct

SEQ ID NO: 1373745 - DNA, 22 bp, Artificial Sequence
  chemically synthesized
atcccattctgtaggttttctc

SEQ ID NO: 1373746 - DNA, 22 bp, Artificial Sequence
  chemically synthesized
tgtaggttttctcttcactctg

SEQ ID NO: 1373747 - DNA, 22 bp, Artificial Sequence
  chemically synthesized
taggttttctcttcactctgtt

SEQ ID NO: 1373748 - DNA, 22 bp, Artificial Sequence
  chemically synthesized
tctcttcactctgttgattctt

SEQ ID NO: 1373749 - DNA, 22 bp, Artificial Sequence
  chemically synthesized
cacagtaaaggaaagaatcaac

SEQ ID NO: 1373750 - DNA, 22 bp, Artificial Sequence
  chemically synthesized
ctcttcactctgttgattcttt

SEQ ID NO: 1373751 - DNA, 22 bp, Artificial Sequence
  chemically synthesized
tcttcactctgttgattctttc

SEQ ID NO: 1373752 - DNA, 22 bp, Artificial Sequence
  chemically synthesized
tgcacagtaaaggaaagaatca

SEQ ID NO: 1373753 - DNA, 22 bp, Artificial Sequence
  chemically synthesized
ttcactctgttgattctttcct

SEQ ID NO: 1373754 - DNA, 22 bp, Artificial Sequence
  chemically synthesized
cactctgttgattctttccttt

SEQ ID NO: 1373755 - DNA, 22 bp, Artificial Sequence
  chemically synthesized
actctgttgattctttccttta

SEQ ID NO: 1373756 - DNA, 22 bp, Artificial Sequence
  chemically synthesized
tgttgattctttcctttactgt

SEQ ID NO: 1373757 - DNA, 22 bp, Artificial Sequence
  chemically synthesized
aaaaagttctgcacagtaaagg

SEQ ID NO: 1373758 - DNA, 22 bp, Artificial Sequence
  chemically synthesized
ttgattctttcctttactgtgc

SEQ ID NO: 1373759 - DNA, 22 bp, Artificial Sequence
  chemically synthesized
attctttcctttactgtgcaga

SEQ ID NO: 1373760 - DNA, 22 bp, Artificial Sequence
  chemically synthesized
tttcctttactgtgcagaactt

SEQ ID NO: 1373761 - DNA, 22 bp, Artificial Sequence
  chemically synthesized
catcaaactcaaaaagttctgc

SEQ ID NO: 1373762 - DNA, 22 bp, Artificial Sequence
  chemically synthesized
tcctttactgtgcagaactttt

SEQ ID NO: 1373763 - DNA, 22 bp, Artificial Sequence
  chemically synthesized
cctttactgtgcagaacttttt

SEQ ID NO: 1373764 - DNA, 22 bp, Artificial Sequence
  chemically synthesized
ctttactgtgcagaactttttg

SEQ ID NO: 1373765 - DNA, 22 bp, Artificial Sequence
  chemically synthesized
tactgtgcagaactttttgagt

SEQ ID NO: 1373766 - DNA, 22 bp, Artificial Sequence
  chemically synthesized
actgtgcagaactttttgagtt

SEQ ID NO: 1373767 - DNA, 22 bp, Artificial Sequence
  chemically synthesized
ctgtgcagaactttttgagttt

SEQ ID NO: 1373768 - DNA, 22 bp, Artificial Sequence
  chemically synthesized
tgcagaactttttgagtttgat

SEQ ID NO: 1373769 - DNA, 22 bp, Artificial Sequence
  chemically synthesized
tttgagtttgatgtaatcccat

SEQ ID NO: 1373770 - DNA, 22 bp, Artificial Sequence
  chemically synthesized
ttgagtttgatgtaatcccatt

SEQ ID NO: 1373771 - DNA, 22 bp, Artificial Sequence
  chemically synthesized
tgagtttgatgtaatcccattt

SEQ ID NO: 1373772 - DNA, 22 bp, Artificial Sequence
  chemically synthesized
gagtttgatgtaatcccatttg

SEQ ID NO: 1373773 - DNA, 22 bp, Artificial Sequence
  chemically synthesized
agtttgatgtaatcccatttgt

SEQ ID NO: 1373774 - DNA, 22 bp, Artificial Sequence
  chemically synthesized
gatgtaatcccatttgtctata

SEQ ID NO: 1373775 - DNA, 22 bp, Artificial Sequence
  chemically synthesized
atgtaatcccatttgtctatat

SEQ ID NO: 1373776 - DNA, 22 bp, Artificial Sequence
  chemically synthesized
aaaagcacaggaaacaaaacca

SEQ ID NO: 1373777 - DNA, 22 bp, Artificial Sequence
  chemically synthesized
gtctatatttggttttgtttcc

SEQ ID NO: 1373778 - DNA, 22 bp, Artificial Sequence
  chemically synthesized
tctatatttggttttgtttcct

SEQ ID NO: 1373779 - DNA, 22 bp, Artificial Sequence
  chemically synthesized
tatttggttttgtttcctgtgc

SEQ ID NO: 1373780 - DNA, 22 bp, Artificial Sequence
  chemically synthesized
gatatgacctcaaaagcacagg

SEQ ID NO: 1373781 - DNA, 22 bp, Artificial Sequence
  chemically synthesized
ggttttgtttcctgtgcttttg

SEQ ID NO: 1373782 - DNA, 22 bp, Artificial Sequence
  chemically synthesized
tggatatgacctcaaaagcaca

SEQ ID NO: 1373783 - DNA, 22 bp, Artificial Sequence
  chemically synthesized
gttttgtttcctgtgcttttga

SEQ ID NO: 1373784 - DNA, 22 bp, Artificial Sequence
  chemically synthesized
ctggatatgacctcaaaagcac

SEQ ID NO: 1373785 - DNA, 22 bp, Artificial Sequence
  chemically synthesized
tctggatatgacctcaaaagca

SEQ ID NO: 1373786 - DNA, 22 bp, Artificial Sequence
  chemically synthesized
tgtttcctgtgcttttgaggtc

SEQ ID NO: 1373787 - DNA, 22 bp, Artificial Sequence
  chemically synthesized
gtttcctgtgcttttgaggtca

SEQ ID NO: 1373788 - DNA, 22 bp, Artificial Sequence
  chemically synthesized
tttcctgtgcttttgaggtcat

SEQ ID NO: 1373789 - DNA, 22 bp, Artificial Sequence
  chemically synthesized
cctgtgcttttgaggtcatatc

SEQ ID NO: 1373790 - DNA, 22 bp, Artificial Sequence
  chemically synthesized
ctgtgcttttgaggtcatatcc

SEQ ID NO: 1373791 - DNA, 22 bp, Artificial Sequence
  chemically synthesized
ggcaaaaattttctggatatga

SEQ ID NO: 1373792 - DNA, 22 bp, Artificial Sequence
  chemically synthesized
tgcttttgaggtcatatccaga

SEQ ID NO: 1373793 - DNA, 22 bp, Artificial Sequence
  chemically synthesized
ttgaggtcatatccagaaaatt

SEQ ID NO: 1373794 - DNA, 22 bp, Artificial Sequence
  chemically synthesized
tgaggtcatatccagaaaattt

SEQ ID NO: 1373795 - DNA, 22 bp, Artificial Sequence
  chemically synthesized
tgatctgggcaaaaattttctg

SEQ ID NO: 1373796 - DNA, 22 bp, Artificial Sequence
  chemically synthesized
gaggtcatatccagaaaatttt

SEQ ID NO: 1373797 - DNA, 22 bp, Artificial Sequence
  chemically synthesized
aggtcatatccagaaaattttt

SEQ ID NO: 1373798 - DNA, 22 bp, Artificial Sequence
  chemically synthesized
catgactatgatctgggcaaaa

SEQ ID NO: 1373799 - DNA, 22 bp, Artificial Sequence
  chemically synthesized
ttgcccagatcatagtcatgga

SEQ ID NO: 1373800 - DNA, 22 bp, Artificial Sequence
  chemically synthesized
tgcccagatcatagtcatggag

SEQ ID NO: 1373801 - DNA, 22 bp, Artificial Sequence
  chemically synthesized
gcccagatcatagtcatggaga

SEQ ID NO: 1373802 - DNA, 22 bp, Artificial Sequence
  chemically synthesized
cccagatcatagtcatggagac

SEQ ID NO: 1373803 - DNA, 22 bp, Artificial Sequence
  chemically synthesized
ccagaaggaaacataagggaag

SEQ ID NO: 1373804 - DNA, 22 bp, Artificial Sequence
  chemically synthesized
taagactaccagaaggaaacat

SEQ ID NO: 1373805 - DNA, 22 bp, Artificial Sequence
  chemically synthesized
aaactataagactaccagaagg

SEQ ID NO: 1373806 - DNA, 22 bp, Artificial Sequence
  chemically synthesized
cccttatgtttccttctggtag

SEQ ID NO: 1373807 - DNA, 22 bp, Artificial Sequence
  chemically synthesized
ccttatgtttccttctggtagt

SEQ ID NO: 1373808 - DNA, 22 bp, Artificial Sequence
  chemically synthesized
atgtttccttctggtagtctta

SEQ ID NO: 1373809 - DNA, 22 bp, Artificial Sequence
  chemically synthesized
tgtttccttctggtagtcttat

SEQ ID NO: 1373810 - DNA, 22 bp, Artificial Sequence
  chemically synthesized
ccttctggtagtcttatagttt

SEQ ID NO: 1373811 - DNA, 22 bp, Artificial Sequence
  chemically synthesized
cttctggtagtcttatagtttc

SEQ ID NO: 1373812 - DNA, 22 bp, Artificial Sequence
  chemically synthesized
ctggtagtcttatagtttcagg

SEQ ID NO: 1373813 - DNA, 22 bp, Artificial Sequence
  chemically synthesized
tggtagtcttatagtttcaggt

SEQ ID NO: 1373814 - DNA, 22 bp, Artificial Sequence
  chemically synthesized
gtagtcttatagtttcaggtct

SEQ ID NO: 1373815 - DNA, 22 bp, Artificial Sequence
  chemically synthesized
aaggcataaacgtaagacctga

SEQ ID NO: 1373816 - DNA, 22 bp, Artificial Sequence
  chemically synthesized
atagtttcaggtcttacgttta

SEQ ID NO: 1373817 - DNA, 22 bp, Artificial Sequence
  chemically synthesized
tagtttcaggtcttacgtttat

SEQ ID NO: 1373818 - DNA, 22 bp, Artificial Sequence
  chemically synthesized
ataatggattaaaggcataaac

SEQ ID NO: 1373819 - DNA, 22 bp, Artificial Sequence
  chemically synthesized
caggtcttacgtttatgccttt

SEQ ID NO: 1373820 - DNA, 22 bp, Artificial Sequence
  chemically synthesized
aggtcttacgtttatgccttta

SEQ ID NO: 1373821 - DNA, 22 bp, Artificial Sequence
  chemically synthesized
actcataatggattaaaggcat

SEQ ID NO: 1373822 - DNA, 22 bp, Artificial Sequence
  chemically synthesized
acgtttatgcctttaatccatt

SEQ ID NO: 1373823 - DNA, 22 bp, Artificial Sequence
  chemically synthesized
cgtttatgcctttaatccatta

SEQ ID NO: 1373824 - DNA, 22 bp, Artificial Sequence
  chemically synthesized
atgcctttaatccattatgagt

SEQ ID NO: 1373825 - DNA, 22 bp, Artificial Sequence
  chemically synthesized
tgcctttaatccattatgagtt

SEQ ID NO: 1373826 - DNA, 22 bp, Artificial Sequence
  chemically synthesized
taatccattatgagttaatttt

SEQ ID NO: 1373827 - DNA, 22 bp, Artificial Sequence
  chemically synthesized
aatccattatgagttaattttt

SEQ ID NO: 1373828 - DNA, 22 bp, Artificial Sequence
  chemically synthesized
atccattatgagttaatttttg

SEQ ID NO: 1373829 - DNA, 22 bp, Artificial Sequence
  chemically synthesized
tatcagaccatgtacaaaaatt

SEQ ID NO: 1373830 - DNA, 22 bp, Artificial Sequence
  chemically synthesized
atatcagaccatgtacaaaaat

SEQ ID NO: 1373831 - DNA, 22 bp, Artificial Sequence
  chemically synthesized
tgagttaatttttgtacatggt

SEQ ID NO: 1373832 - DNA, 22 bp, Artificial Sequence
  chemically synthesized
gacccttatatcagaccatgta

SEQ ID NO: 1373833 - DNA, 22 bp, Artificial Sequence
  chemically synthesized
atttttgtacatggtctgatat

SEQ ID NO: 1373834 - DNA, 22 bp, Artificial Sequence
  chemically synthesized
ttgtacatggtctgatataagg

SEQ ID NO: 1373835 - DNA, 22 bp, Artificial Sequence
  chemically synthesized
tgtacatggtctgatataaggg

SEQ ID NO: 1373836 - DNA, 22 bp, Artificial Sequence
  chemically synthesized
gtacatggtctgatataagggt

SEQ ID NO: 1373837 - DNA, 22 bp, Artificial Sequence
  chemically synthesized
tacatggtctgatataagggtc

SEQ ID NO: 1373838 - DNA, 22 bp, Artificial Sequence
  chemically synthesized
atataagggtctaattttttct

SEQ ID NO: 1373839 - DNA, 22 bp, Artificial Sequence
  chemically synthesized
gaaaaaatagatatccacatgc

SEQ ID NO: 1373840 - DNA, 22 bp, Artificial Sequence
  chemically synthesized
attttttctgcatgtggatatc

SEQ ID NO: 1373841 - DNA, 22 bp, Artificial Sequence
  chemically synthesized
tttctgcatgtggatatctatt

SEQ ID NO: 1373842 - DNA, 22 bp, Artificial Sequence
  chemically synthesized
ttctgcatgtggatatctattt

SEQ ID NO: 1373843 - DNA, 22 bp, Artificial Sequence
  chemically synthesized
tctgcatgtggatatctatttt

SEQ ID NO: 1373844 - DNA, 22 bp, Artificial Sequence
  chemically synthesized
ctgcatgtggatatctattttt

SEQ ID NO: 1373845 - DNA, 22 bp, Artificial Sequence
  chemically synthesized
tgcatgtggatatctatttttt

SEQ ID NO: 1373846 - DNA, 22 bp, Artificial Sequence
  chemically synthesized
catgtggatatctattttttcc

SEQ ID NO: 1373847 - DNA, 22 bp, Artificial Sequence
  chemically synthesized
aataaatggtgctggaaaaaat

SEQ ID NO: 1373848 - DNA, 22 bp, Artificial Sequence
  chemically synthesized
tcaataaatggtgctggaaaaa

SEQ ID NO: 1373849 - DNA, 22 bp, Artificial Sequence
  chemically synthesized
ctcaataaatggtgctggaaaa

SEQ ID NO: 1373850 - DNA, 22 bp, Artificial Sequence
  chemically synthesized
ttttttccagcaccatttattg

SEQ ID NO: 1373851 - DNA, 22 bp, Artificial Sequence
  chemically synthesized
tttccagcaccatttattgaga

SEQ ID NO: 1373852 - DNA, 22 bp, Artificial Sequence
  chemically synthesized
ttccagcaccatttattgagaa

SEQ ID NO: 1373853 - DNA, 22 bp, Artificial Sequence
  chemically synthesized
tccagcaccatttattgagaag

SEQ ID NO: 1373854 - DNA, 22 bp, Artificial Sequence
  chemically synthesized
ccagcaccatttattgagaaga

SEQ ID NO: 1373855 - DNA, 22 bp, Artificial Sequence
  chemically synthesized
cagcaccatttattgagaagat

SEQ ID NO: 1373856 - DNA, 22 bp, Artificial Sequence
  chemically synthesized
attgagaagattgttcttttcg

SEQ ID NO: 1373857 - DNA, 22 bp, Artificial Sequence
  chemically synthesized
ttgagaagattgttcttttcgc

SEQ ID NO: 1373858 - DNA, 22 bp, Artificial Sequence
  chemically synthesized
agaagattgttcttttcgcatt

SEQ ID NO: 1373859 - DNA, 22 bp, Artificial Sequence
  chemically synthesized
ttcttttcgcattggatatacc

SEQ ID NO: 1373860 - DNA, 22 bp, Artificial Sequence
  chemically synthesized
aacaatggtaccaggtatatcc

SEQ ID NO: 1373861 - DNA, 22 bp, Artificial Sequence
  chemically synthesized
caacaatggtaccaggtatatc

SEQ ID NO: 1373862 - DNA, 22 bp, Artificial Sequence
  chemically synthesized
ttttcgcattggatatacctgg

SEQ ID NO: 1373863 - DNA, 22 bp, Artificial Sequence
  chemically synthesized
tcaacaatggtaccaggtatat

SEQ ID NO: 1373864 - DNA, 22 bp, Artificial Sequence
  chemically synthesized
ttcgcattggatatacctggta

SEQ ID NO: 1373865 - DNA, 22 bp, Artificial Sequence
  chemically synthesized
tcgcattggatatacctggtac

SEQ ID NO: 1373866 - DNA, 22 bp, Artificial Sequence
  chemically synthesized
cgcattggatatacctggtacc

SEQ ID NO: 1373867 - DNA, 22 bp, Artificial Sequence
  chemically synthesized
attttcaacaatggtaccaggt

SEQ ID NO: 1373868 - DNA, 22 bp, Artificial Sequence
  chemically synthesized
gcattggatatacctggtacca

SEQ ID NO: 1373869 - DNA, 22 bp, Artificial Sequence
  chemically synthesized
gatatacctggtaccattgttg

SEQ ID NO: 1373870 - DNA, 22 bp, Artificial Sequence
  chemically synthesized
tagccagctgattttcaacaat

SEQ ID NO: 1373871 - DNA, 22 bp, Artificial Sequence
  chemically synthesized
gtaccattgttgaaaatcagct

SEQ ID NO: 1373872 - DNA, 22 bp, Artificial Sequence
  chemically synthesized
ttgaaaatcagctggctataat

SEQ ID NO: 1373873 - DNA, 22 bp, Artificial Sequence
  chemically synthesized
aaaatcagctggctataattct

SEQ ID NO: 1373874 - DNA, 22 bp, Artificial Sequence
  chemically synthesized
gctataattctgtggatttatt

SEQ ID NO: 1373875 - DNA, 22 bp, Artificial Sequence
  chemically synthesized
taattctgtggatttatttctg

SEQ ID NO: 1373876 - DNA, 22 bp, Artificial Sequence
  chemically synthesized
tgtggatttatttctggcctct

SEQ ID NO: 1373877 - DNA, 22 bp, Artificial Sequence
  chemically synthesized
tggatttatttctggcctctgt

SEQ ID NO: 1373878 - DNA, 22 bp, Artificial Sequence
  chemically synthesized
atttctggcctctgttttattc

SEQ ID NO: 1373879 - DNA, 22 bp, Artificial Sequence
  chemically synthesized
tttctggcctctgttttattcc

SEQ ID NO: 1373880 - DNA, 22 bp, Artificial Sequence
  chemically synthesized
ctggcctctgttttattccatt

SEQ ID NO: 1373881 - DNA, 22 bp, Artificial Sequence
  chemically synthesized
tggcctctgttttattccattg

SEQ ID NO: 1373882 - DNA, 22 bp, Artificial Sequence
  chemically synthesized
gcctctgttttattccattggt

SEQ ID NO: 1373883 - DNA, 22 bp, Artificial Sequence
  chemically synthesized
tgttttattccattggtctatg

SEQ ID NO: 1373884 - DNA, 22 bp, Artificial Sequence
  chemically synthesized
ttttattccattggtctatgtg

SEQ ID NO: 1373885 - DNA, 22 bp, Artificial Sequence
  chemically synthesized
gcataaaaacagacacatagac

SEQ ID NO: 1373886 - DNA, 22 bp, Artificial Sequence
  chemically synthesized
tattccattggtctatgtgtct

SEQ ID NO: 1373887 - DNA, 22 bp, Artificial Sequence
  chemically synthesized
attccattggtctatgtgtctg

SEQ ID NO: 1373888 - DNA, 22 bp, Artificial Sequence
  chemically synthesized
ttccattggtctatgtgtctgt

SEQ ID NO: 1373889 - DNA, 22 bp, Artificial Sequence
  chemically synthesized
cattggtctatgtgtctgtttt

SEQ ID NO: 1373890 - DNA, 22 bp, Artificial Sequence
  chemically synthesized
gtctatgtgtctgtttttatgc

SEQ ID NO: 1373891 - DNA, 22 bp, Artificial Sequence
  chemically synthesized
tgtgtctgtttttatgccagca

SEQ ID NO: 1373892 - DNA, 22 bp, Artificial Sequence
  chemically synthesized
tggtaaccaaaacagatggtgc

SEQ ID NO: 1373893 - DNA, 22 bp, Artificial Sequence
  chemically synthesized
tttttatgccagcaccatctgt

SEQ ID NO: 1373894 - DNA, 22 bp, Artificial Sequence
  chemically synthesized
ttatgccagcaccatctgtttt

SEQ ID NO: 1373895 - DNA, 22 bp, Artificial Sequence
  chemically synthesized
tatgccagcaccatctgttttg

SEQ ID NO: 1373896 - DNA, 22 bp, Artificial Sequence
  chemically synthesized
atgccagcaccatctgttttgg

SEQ ID NO: 1373897 - DNA, 22 bp, Artificial Sequence
  chemically synthesized
tgccagcaccatctgttttggt

SEQ ID NO: 1373898 - DNA, 22 bp, Artificial Sequence
  chemically synthesized
caaagctatggtaaccaaaaca

SEQ ID NO: 1373899 - DNA, 22 bp, Artificial Sequence
  chemically synthesized
ttttggttaccatagctttgta

SEQ ID NO: 1373900 - DNA, 22 bp, Artificial Sequence
  chemically synthesized
acaccaaaatatactacaaagc

SEQ ID NO: 1373901 - DNA, 22 bp, Artificial Sequence
  chemically synthesized
tggttaccatagctttgtagta

SEQ ID NO: 1373902 - DNA, 22 bp, Artificial Sequence
  chemically synthesized
gacaccaaaatatactacaaag

SEQ ID NO: 1373903 - DNA, 22 bp, Artificial Sequence
  chemically synthesized
ggttaccatagctttgtagtat

SEQ ID NO: 1373904 - DNA, 22 bp, Artificial Sequence
  chemically synthesized
gttaccatagctttgtagtata

SEQ ID NO: 1373905 - DNA, 22 bp, Artificial Sequence
  chemically synthesized
cttgacaccaaaatatactaca

SEQ ID NO: 1373906 - DNA, 22 bp, Artificial Sequence
  chemically synthesized
ccatagctttgtagtatatttt

SEQ ID NO: 1373907 - DNA, 22 bp, Artificial Sequence
  chemically synthesized
tgtagtatattttggtgtcaag

SEQ ID NO: 1373908 - DNA, 22 bp, Artificial Sequence
  chemically synthesized
gtagtatattttggtgtcaagt

SEQ ID NO: 1373909 - DNA, 22 bp, Artificial Sequence
  chemically synthesized
tagtatattttggtgtcaagta

SEQ ID NO: 1373910 - DNA, 22 bp, Artificial Sequence
  chemically synthesized
gtgtcatcacactacttgacac

SEQ ID NO: 1373911 - DNA, 22 bp, Artificial Sequence
  chemically synthesized
tggtgtcaagtagtgtgatgac

SEQ ID NO: 1373912 - DNA, 22 bp, Artificial Sequence
  chemically synthesized
ggtgtcaagtagtgtgatgaca

SEQ ID NO: 1373913 - DNA, 22 bp, Artificial Sequence
  chemically synthesized
gtgtcaagtagtgtgatgacac

SEQ ID NO: 1373914 - DNA, 22 bp, Artificial Sequence
  chemically synthesized
agcaaaaagaacaaaactggtg

SEQ ID NO: 1373915 - DNA, 22 bp, Artificial Sequence
  chemically synthesized
aagacccaaaataatgttgagc

SEQ ID NO: 1373916 - DNA, 22 bp, Artificial Sequence
  chemically synthesized
gaagacccaaaataatgttgag

SEQ ID NO: 1373917 - DNA, 22 bp, Artificial Sequence
  chemically synthesized
tgttctttttgctcaacattat

SEQ ID NO: 1373918 - DNA, 22 bp, Artificial Sequence
  chemically synthesized
gttctttttgctcaacattatt

SEQ ID NO: 1373919 - DNA, 22 bp, Artificial Sequence
  chemically synthesized
ttctttttgctcaacattattt

SEQ ID NO: 1373920 - DNA, 22 bp, Artificial Sequence
  chemically synthesized
tttttgctcaacattattttgg

SEQ ID NO: 1373921 - DNA, 22 bp, Artificial Sequence
  chemically synthesized
tttgctcaacattattttgggt

SEQ ID NO: 1373922 - DNA, 22 bp, Artificial Sequence
  chemically synthesized
ttgctcaacattattttgggtc

SEQ ID NO: 1373923 - DNA, 22 bp, Artificial Sequence
  chemically synthesized
tgctcaacattattttgggtct

SEQ ID NO: 1373924 - DNA, 22 bp, Artificial Sequence
  chemically synthesized
gctcaacattattttgggtctt

SEQ ID NO: 1373925 - DNA, 22 bp, Artificial Sequence
  chemically synthesized
ctcaacattattttgggtcttc

SEQ ID NO: 1373926 - DNA, 22 bp, Artificial Sequence
  chemically synthesized
aacattattttgggtcttcaag

SEQ ID NO: 1373927 - DNA, 22 bp, Artificial Sequence
  chemically synthesized
gaaccacaaaagagcttgaaga

SEQ ID NO: 1373928 - DNA, 22 bp, Artificial Sequence
  chemically synthesized
ttttgggtcttcaagctctttt

SEQ ID NO: 1373929 - DNA, 22 bp, Artificial Sequence
  chemically synthesized
tgggtcttcaagctcttttgtg

SEQ ID NO: 1373930 - DNA, 22 bp, Artificial Sequence
  chemically synthesized
gggtcttcaagctcttttgtgg

SEQ ID NO: 1373931 - DNA, 22 bp, Artificial Sequence
  chemically synthesized
cagaaattggaaccacaaaaga

SEQ ID NO: 1373932 - DNA, 22 bp, Artificial Sequence
  chemically synthesized
ggtcttcaagctcttttgtggt

SEQ ID NO: 1373933 - DNA, 22 bp, Artificial Sequence
  chemically synthesized
acagaaattggaaccacaaaag

SEQ ID NO: 1373934 - DNA, 22 bp, Artificial Sequence
  chemically synthesized
tacagaaattggaaccacaaaa

SEQ ID NO: 1373935 - DNA, 22 bp, Artificial Sequence
  chemically synthesized
ttacagaaattggaaccacaaa

SEQ ID NO: 1373936 - DNA, 22 bp, Artificial Sequence
  chemically synthesized
tttacagaaattggaaccacaa

SEQ ID NO: 1373937 - DNA, 22 bp, Artificial Sequence
  chemically synthesized
caagctcttttgtggttccaat

SEQ ID NO: 1373938 - DNA, 22 bp, Artificial Sequence
  chemically synthesized
aagctcttttgtggttccaatt

SEQ ID NO: 1373939 - DNA, 22 bp, Artificial Sequence
  chemically synthesized
ttttgtggttccaatttctgta

SEQ ID NO: 1373940 - DNA, 22 bp, Artificial Sequence
  chemically synthesized
ttgtggttccaatttctgtaaa

SEQ ID NO: 1373941 - DNA, 22 bp, Artificial Sequence
  chemically synthesized
tgtggttccaatttctgtaaaa

SEQ ID NO: 1373942 - DNA, 22 bp, Artificial Sequence
  chemically synthesized
gtggttccaatttctgtaaaaa

SEQ ID NO: 1373943 - DNA, 22 bp, Artificial Sequence
  chemically synthesized
tggttccaatttctgtaaaaaa

SEQ ID NO: 1373944 - DNA, 22 bp, Artificial Sequence
  chemically synthesized
tcaaaacaccagtgacattttt

SEQ ID NO: 1373945 - DNA, 22 bp, Artificial Sequence
  chemically synthesized
caatttctgtaaaaaatgtcac

SEQ ID NO: 1373946 - DNA, 22 bp, Artificial Sequence
  chemically synthesized
atcaaaacaccagtgacatttt

SEQ ID NO: 1373947 - DNA, 22 bp, Artificial Sequence
  chemically synthesized
tatcaaaacaccagtgacattt

SEQ ID NO: 1373948 - DNA, 22 bp, Artificial Sequence
  chemically synthesized
ctgtaaaaaatgtcactggtgt

SEQ ID NO: 1373949 - DNA, 22 bp, Artificial Sequence
  chemically synthesized
tgtaaaaaatgtcactggtgtt

SEQ ID NO: 1373950 - DNA, 22 bp, Artificial Sequence
  chemically synthesized
taaaaaatgtcactggtgtttt

SEQ ID NO: 1373951 - DNA, 22 bp, Artificial Sequence
  chemically synthesized
cagtcaatgcaatctttatcaa

SEQ ID NO: 1373952 - DNA, 22 bp, Artificial Sequence
  chemically synthesized
tacagtcaatgcaatctttatc

SEQ ID NO: 1373953 - DNA, 22 bp, Artificial Sequence
  chemically synthesized
ctacagtcaatgcaatctttat

SEQ ID NO: 1373954 - DNA, 22 bp, Artificial Sequence
  chemically synthesized
tctacagtcaatgcaatcttta

SEQ ID NO: 1373955 - DNA, 22 bp, Artificial Sequence
  chemically synthesized
gtgttttgataaagattgcatt

SEQ ID NO: 1373956 - DNA, 22 bp, Artificial Sequence
  chemically synthesized
tgataaagattgcattgactgt

SEQ ID NO: 1373957 - DNA, 22 bp, Artificial Sequence
  chemically synthesized
gataaagattgcattgactgta

SEQ ID NO: 1373958 - DNA, 22 bp, Artificial Sequence
  chemically synthesized
cccaaagctttctacagtcaat

SEQ ID NO: 1373959 - DNA, 22 bp, Artificial Sequence
  chemically synthesized
ataaagattgcattgactgtag

SEQ ID NO: 1373960 - DNA, 22 bp, Artificial Sequence
  chemically synthesized
cactacccaaagctttctacag

SEQ ID NO: 1373961 - DNA, 22 bp, Artificial Sequence
  chemically synthesized
ctacactacccaaagctttcta

SEQ ID NO: 1373962 - DNA, 22 bp, Artificial Sequence
  chemically synthesized
cattgactgtagaaagctttgg

SEQ ID NO: 1373963 - DNA, 22 bp, Artificial Sequence
  chemically synthesized
aaattcctacactacccaaagc

SEQ ID NO: 1373964 - DNA, 22 bp, Artificial Sequence
  chemically synthesized
actgtagaaagctttgggtagt

SEQ ID NO: 1373965 - DNA, 22 bp, Artificial Sequence
  chemically synthesized
ttaaaattcctacactacccaa

SEQ ID NO: 1373966 - DNA, 22 bp, Artificial Sequence
  chemically synthesized
tagaaagctttgggtagtgtag

SEQ ID NO: 1373967 - DNA, 22 bp, Artificial Sequence
  chemically synthesized
atattgttaaaattcctacact

SEQ ID NO: 1373968 - DNA, 22 bp, Artificial Sequence
  chemically synthesized
tgggtagtgtaggaattttaac

SEQ ID NO: 1373969 - DNA, 22 bp, Artificial Sequence
  chemically synthesized
gggtagtgtaggaattttaaca

SEQ ID NO: 1373970 - DNA, 22 bp, Artificial Sequence
  chemically synthesized
ggtagtgtaggaattttaacaa

SEQ ID NO: 1373971 - DNA, 22 bp, Artificial Sequence
  chemically synthesized
gaagaattaatattgttaaaat

SEQ ID NO: 1373972 - DNA, 22 bp, Artificial Sequence
  chemically synthesized
atgtattggaagaattaatatt

SEQ ID NO: 1373973 - DNA, 22 bp, Artificial Sequence
  chemically synthesized
tgttcatgtattggaagaatta

SEQ ID NO: 1373974 - DNA, 22 bp, Artificial Sequence
  chemically synthesized
tgtgttcatgtattggaagaat

SEQ ID NO: 1373975 - DNA, 22 bp, Artificial Sequence
  chemically synthesized
taacaatattaattcttccaat

SEQ ID NO: 1373976 - DNA, 22 bp, Artificial Sequence
  chemically synthesized
aacaatattaattcttccaata

SEQ ID NO: 1373977 - DNA, 22 bp, Artificial Sequence
  chemically synthesized
acaatattaattcttccaatac

SEQ ID NO: 1373978 - DNA, 22 bp, Artificial Sequence
  chemically synthesized
attcttccaatacatgaacaca

SEQ ID NO: 1373979 - DNA, 22 bp, Artificial Sequence
  chemically synthesized
ttccaatacatgaacacagaat

SEQ ID NO: 1373980 - DNA, 22 bp, Artificial Sequence
  chemically synthesized
ccaatacatgaacacagaatac

SEQ ID NO: 1373981 - DNA, 22 bp, Artificial Sequence
  chemically synthesized
caatacatgaacacagaatacc

SEQ ID NO: 1373982 - DNA, 22 bp, Artificial Sequence
  chemically synthesized
aagaagccacaaataaatggaa

SEQ ID NO: 1373983 - DNA, 22 bp, Artificial Sequence
  chemically synthesized
tccatttatttgtggcttcttc

SEQ ID NO: 1373984 - DNA, 22 bp, Artificial Sequence
  chemically synthesized
atgaaagcaattgaagaagcca

SEQ ID NO: 1373985 - DNA, 22 bp, Artificial Sequence
  chemically synthesized
ccatttatttgtggcttcttca

SEQ ID NO: 1373986 - DNA, 22 bp, Artificial Sequence
  chemically synthesized
catttatttgtggcttcttcaa

SEQ ID NO: 1373987 - DNA, 22 bp, Artificial Sequence
  chemically synthesized
atttgtggcttcttcaattgct

SEQ ID NO: 1373988 - DNA, 22 bp, Artificial Sequence
  chemically synthesized
tttgtggcttcttcaattgctt

SEQ ID NO: 1373989 - DNA, 22 bp, Artificial Sequence
  chemically synthesized
taagacattgatgaaagcaatt

SEQ ID NO: 1373990 - DNA, 22 bp, Artificial Sequence
  chemically synthesized
gtggcttcttcaattgctttca

SEQ ID NO: 1373991 - DNA, 22 bp, Artificial Sequence
  chemically synthesized
tggcttcttcaattgctttcat

SEQ ID NO: 1373992 - DNA, 22 bp, Artificial Sequence
  chemically synthesized
gaaactgtaagacattgatgaa

SEQ ID NO: 1373993 - DNA, 22 bp, Artificial Sequence
  chemically synthesized
cttcaattgctttcatcaatgt

SEQ ID NO: 1373994 - DNA, 22 bp, Artificial Sequence
  chemically synthesized
ttcaattgctttcatcaatgtc

SEQ ID NO: 1373995 - DNA, 22 bp, Artificial Sequence
  chemically synthesized
caattgctttcatcaatgtctt

SEQ ID NO: 1373996 - DNA, 22 bp, Artificial Sequence
  chemically synthesized
aattgctttcatcaatgtctta

SEQ ID NO: 1373997 - DNA, 22 bp, Artificial Sequence
  chemically synthesized
ctttcatcaatgtcttacagtt

SEQ ID NO: 1373998 - DNA, 22 bp, Artificial Sequence
  chemically synthesized
tcatcaatgtcttacagtttcc

SEQ ID NO: 1373999 - DNA, 22 bp, Artificial Sequence
  chemically synthesized
catcaatgtcttacagtttcca

SEQ ID NO: 1374000 - DNA, 22 bp, Artificial Sequence
  chemically synthesized
atcaatgtcttacagtttccag

SEQ ID NO: 1374001 - DNA, 22 bp, Artificial Sequence
  chemically synthesized
accaaagaagtgaaagacctgg

SEQ ID NO: 1374002 - DNA, 22 bp, Artificial Sequence
  chemically synthesized
aaccaaagaagtgaaagacctg

SEQ ID NO: 1374003 - DNA, 22 bp, Artificial Sequence
  chemically synthesized
acagtttccaggtctttcactt

SEQ ID NO: 1374004 - DNA, 22 bp, Artificial Sequence
  chemically synthesized
cagtttccaggtctttcacttc

SEQ ID NO: 1374005 - DNA, 22 bp, Artificial Sequence
  chemically synthesized
ccaggtctttcacttctttggt

SEQ ID NO: 1374006 - DNA, 22 bp, Artificial Sequence
  chemically synthesized
caggtctttcacttctttggtt

SEQ ID NO: 1374007 - DNA, 22 bp, Artificial Sequence
  chemically synthesized
tcacttctttggttaaatttat

SEQ ID NO: 1374008 - DNA, 22 bp, Artificial Sequence
  chemically synthesized
cacttctttggttaaatttatt

SEQ ID NO: 1374009 - DNA, 22 bp, Artificial Sequence
  chemically synthesized
acttctttggttaaatttattc

SEQ ID NO: 1374010 - DNA, 22 bp, Artificial Sequence
  chemically synthesized
ctttggttaaatttattccttt

SEQ ID NO: 1374011 - DNA, 22 bp, Artificial Sequence
  chemically synthesized
tttggttaaatttattcctttt

SEQ ID NO: 1374012 - DNA, 22 bp, Artificial Sequence
  chemically synthesized
tggttaaatttattcctttttt

SEQ ID NO: 1374013 - DNA, 22 bp, Artificial Sequence
  chemically synthesized
ggttaaatttattccttttttt

SEQ ID NO: 1374014 - DNA, 22 bp, Artificial Sequence
  chemically synthesized
gttaaatttattcctttttttg

SEQ ID NO: 1374015 - DNA, 22 bp, Artificial Sequence
  chemically synthesized
tccacccgcccccacaaaaaaa

SEQ ID NO: 1374016 - DNA, 22 bp, Artificial Sequence
  chemically synthesized
aatttattcctttttttgtggg

SEQ ID NO: 1374017 - DNA, 22 bp, Artificial Sequence
  chemically synthesized
tgtccacccgcccccacaaaaa

SEQ ID NO: 1374018 - DNA, 22 bp, Artificial Sequence
  chemically synthesized
attcctttttttgtgggggcgg

SEQ ID NO: 1374019 - DNA, 22 bp, Artificial Sequence
  chemically synthesized
tcctctgtccacccgcccccac

SEQ ID NO: 1374020 - DNA, 22 bp, Artificial Sequence
  chemically synthesized
ttcctttttttgtgggggcggg

SEQ ID NO: 1374021 - DNA, 22 bp, Artificial Sequence
  chemically synthesized
tgtcctctgtccacccgccccc

SEQ ID NO: 1374022 - DNA, 22 bp, Artificial Sequence
  chemically synthesized
ctttttttgtgggggcgggtgg

SEQ ID NO: 1374023 - DNA, 22 bp, Artificial Sequence
  chemically synthesized
tttttgtgggggcgggtggaca

SEQ ID NO: 1374024 - DNA, 22 bp, Artificial Sequence
  chemically synthesized
ttttgtgggggcgggtggacag

SEQ ID NO: 1374025 - DNA, 22 bp, Artificial Sequence
  chemically synthesized
tttgtgggggcgggtggacaga

SEQ ID NO: 1374026 - DNA, 22 bp, Artificial Sequence
  chemically synthesized
ttgtgggggcgggtggacagag

SEQ ID NO: 1374027 - DNA, 22 bp, Artificial Sequence
  chemically synthesized
tgtgggggcgggtggacagagg

SEQ ID NO: 1374028 - DNA, 22 bp, Artificial Sequence
  chemically synthesized
gtgggggcgggtggacagagga

SEQ ID NO: 1374029 - DNA, 22 bp, Artificial Sequence
  chemically synthesized
tgggggcgggtggacagaggac

SEQ ID NO: 1374030 - DNA, 22 bp, Artificial Sequence
  chemically synthesized
ggcgacagagcaagactctgtc

SEQ ID NO: 1374031 - DNA, 22 bp, Artificial Sequence
  chemically synthesized
cagactgggcgacagagcaaga

SEQ ID NO: 1374032 - DNA, 22 bp, Artificial Sequence
  chemically synthesized
cactccagactgggcgacagag

SEQ ID NO: 1374033 - DNA, 22 bp, Artificial Sequence
  chemically synthesized
gctctgtcgcccagtctggagt

SEQ ID NO: 1374034 - DNA, 22 bp, Artificial Sequence
  chemically synthesized
ctctgtcgcccagtctggagtg

SEQ ID NO: 1374035 - DNA, 22 bp, Artificial Sequence
  chemically synthesized
tgtcgcccagtctggagtgcag

SEQ ID NO: 1374036 - DNA, 22 bp, Artificial Sequence
  chemically synthesized
tcgcccagtctggagtgcagtg

SEQ ID NO: 1374037 - DNA, 22 bp, Artificial Sequence
  chemically synthesized
cagtgagcagagatcatgacac

SEQ ID NO: 1374038 - DNA, 22 bp, Artificial Sequence
  chemically synthesized
gagtgcagtgtcatgatctctg

SEQ ID NO: 1374039 - DNA, 22 bp, Artificial Sequence
  chemically synthesized
gaatccaggaggcagaggttgc

SEQ ID NO: 1374040 - DNA, 22 bp, Artificial Sequence
  chemically synthesized
tgctcactgcaacctctgcctc

SEQ ID NO: 1374041 - DNA, 22 bp, Artificial Sequence
  chemically synthesized
ctcactgcaacctctgcctcct

SEQ ID NO: 1374042 - DNA, 22 bp, Artificial Sequence
  chemically synthesized
actgcaacctctgcctcctgga

SEQ ID NO: 1374043 - DNA, 22 bp, Artificial Sequence
  chemically synthesized
caacctctgcctcctggattcc

SEQ ID NO: 1374044 - DNA, 22 bp, Artificial Sequence
  chemically synthesized
tgcctcctggattccagcgatt

SEQ ID NO: 1374045 - DNA, 22 bp, Artificial Sequence
  chemically synthesized
cctcctggattccagcgattct

SEQ ID NO: 1374046 - DNA, 22 bp, Artificial Sequence
  chemically synthesized
ggtggccgaggcatgagaatcg

SEQ ID NO: 1374047 - DNA, 22 bp, Artificial Sequence
  chemically synthesized
ctggattccagcgattctcatg

SEQ ID NO: 1374048 - DNA, 22 bp, Artificial Sequence
  chemically synthesized
gattccagcgattctcatgcct

SEQ ID NO: 1374049 - DNA, 22 bp, Artificial Sequence
  chemically synthesized
cctgggtggccgaggcatgaga

SEQ ID NO: 1374050 - DNA, 22 bp, Artificial Sequence
  chemically synthesized
cagcgattctcatgcctcggcc

SEQ ID NO: 1374051 - DNA, 22 bp, Artificial Sequence
  chemically synthesized
taatcccagctacctgggtggc

SEQ ID NO: 1374052 - DNA, 22 bp, Artificial Sequence
  chemically synthesized
tcatgcctcggccacccaggta

SEQ ID NO: 1374053 - DNA, 22 bp, Artificial Sequence
  chemically synthesized
atgcctcggccacccaggtagc

SEQ ID NO: 1374054 - DNA, 22 bp, Artificial Sequence
  chemically synthesized
ggccacccaggtagctgggatt

SEQ ID NO: 1374055 - DNA, 22 bp, Artificial Sequence
  chemically synthesized
atgtggaggcacacacctgtaa

SEQ ID NO: 1374056 - DNA, 22 bp, Artificial Sequence
  chemically synthesized
gcctaatgtggaggcacacacc

SEQ ID NO: 1374057 - DNA, 22 bp, Artificial Sequence
  chemically synthesized
ggattacaggtgtgtgcctcca

SEQ ID NO: 1374058 - DNA, 22 bp, Artificial Sequence
  chemically synthesized
caggtgtgtgcctccacattag

SEQ ID NO: 1374059 - DNA, 22 bp, Artificial Sequence
  chemically synthesized
aaaatacaaaaattagcctaat

SEQ ID NO: 1374060 - DNA, 22 bp, Artificial Sequence
  chemically synthesized
ctaaaaatacaaaaattagcct

SEQ ID NO: 1374061 - DNA, 22 bp, Artificial Sequence
  chemically synthesized
tactaaaaatacaaaaattagc

SEQ ID NO: 1374062 - DNA, 22 bp, Artificial Sequence
  chemically synthesized
cacattaggctaatttttgtat

SEQ ID NO: 1374063 - DNA, 22 bp, Artificial Sequence
  chemically synthesized
tctctactaaaaatacaaaaat

SEQ ID NO: 1374064 - DNA, 22 bp, Artificial Sequence
  chemically synthesized
ggctaatttttgtatttttagt

SEQ ID NO: 1374065 - DNA, 22 bp, Artificial Sequence
  chemically synthesized
atttttgtatttttagtagaga

SEQ ID NO: 1374066 - DNA, 22 bp, Artificial Sequence
  chemically synthesized
ttgtatttttagtagagacagg

SEQ ID NO: 1374067 - DNA, 22 bp, Artificial Sequence
  chemically synthesized
tgtatttttagtagagacaggg

SEQ ID NO: 1374068 - DNA, 22 bp, Artificial Sequence
  chemically synthesized
gtatttttagtagagacagggc

SEQ ID NO: 1374069 - DNA, 22 bp, Artificial Sequence
  chemically synthesized
tatttttagtagagacagggct

SEQ ID NO: 1374070 - DNA, 22 bp, Artificial Sequence
  chemically synthesized
accaacgtggtgaagccctgtc

SEQ ID NO: 1374071 - DNA, 22 bp, Artificial Sequence
  chemically synthesized
ttagtagagacagggcttcacc

SEQ ID NO: 1374072 - DNA, 22 bp, Artificial Sequence
  chemically synthesized
tagtagagacagggcttcacca

SEQ ID NO: 1374073 - DNA, 22 bp, Artificial Sequence
  chemically synthesized
agtagagacagggcttcaccac

SEQ ID NO: 1374074 - DNA, 22 bp, Artificial Sequence
  chemically synthesized
gtagagacagggcttcaccacg

SEQ ID NO: 1374075 - DNA, 22 bp, Artificial Sequence
  chemically synthesized
aaaccagactgaccaacgtggt

SEQ ID NO: 1374076 - DNA, 22 bp, Artificial Sequence
  chemically synthesized
gaaaccagactgaccaacgtgg

SEQ ID NO: 1374077 - DNA, 22 bp, Artificial Sequence
  chemically synthesized
caccacgttggtcagtctggtt

SEQ ID NO: 1374078 - DNA, 22 bp, Artificial Sequence
  chemically synthesized
accacgttggtcagtctggttt

SEQ ID NO: 1374079 - DNA, 22 bp, Artificial Sequence
  chemically synthesized
aggtcaggagtttgaaaccaga

SEQ ID NO: 1374080 - DNA, 22 bp, Artificial Sequence
  chemically synthesized
gtcagtctggtttcaaactcct

SEQ ID NO: 1374081 - DNA, 22 bp, Artificial Sequence
  chemically synthesized
gcggatcacctgaggtcaggag

SEQ ID NO: 1374082 - DNA, 22 bp, Artificial Sequence
  chemically synthesized
gtttcaaactcctgacctcagg

SEQ ID NO: 1374083 - DNA, 22 bp, Artificial Sequence
  chemically synthesized
caaactcctgacctcaggtgat

SEQ ID NO: 1374084 - DNA, 22 bp, Artificial Sequence
  chemically synthesized
aaactcctgacctcaggtgatc

SEQ ID NO: 1374085 - DNA, 22 bp, Artificial Sequence
  chemically synthesized
ggaggccgaggttggcggatca

SEQ ID NO: 1374086 - DNA, 22 bp, Artificial Sequence
  chemically synthesized
ctgacctcaggtgatccgccaa

SEQ ID NO: 1374087 - DNA, 22 bp, Artificial Sequence
  chemically synthesized
gggaggccgaggttggcggatc

SEQ ID NO: 1374088 - DNA, 22 bp, Artificial Sequence
  chemically synthesized
tgggaggccgaggttggcggat

SEQ ID NO: 1374089 - DNA, 22 bp, Artificial Sequence
  chemically synthesized
acctcaggtgatccgccaacct

SEQ ID NO: 1374090 - DNA, 22 bp, Artificial Sequence
  chemically synthesized
aggtgatccgccaacctcggcc

SEQ ID NO: 1374091 - DNA, 22 bp, Artificial Sequence
  chemically synthesized
taatcccatcactttgggaggc

SEQ ID NO: 1374092 - DNA, 22 bp, Artificial Sequence
  chemically synthesized
acgcctgtaatcccatcacttt

SEQ ID NO: 1374093 - DNA, 22 bp, Artificial Sequence
  chemically synthesized
ggcctcccaaagtgatgggatt

SEQ ID NO: 1374094 - DNA, 22 bp, Artificial Sequence
  chemically synthesized
ccaaagtgatgggattacaggc

SEQ ID NO: 1374095 - DNA, 22 bp, Artificial Sequence
  chemically synthesized
gccgggcacggtggctcacgcc

SEQ ID NO: 1374096 - DNA, 22 bp, Artificial Sequence
  chemically synthesized
ggaactggccgggcacggtggc

SEQ ID NO: 1374097 - DNA, 22 bp, Artificial Sequence
  chemically synthesized
aggaactggccgggcacggtgg

SEQ ID NO: 1374098 - DNA, 22 bp, Artificial Sequence
  chemically synthesized
caggcgtgagccaccgtgcccg

SEQ ID NO: 1374099 - DNA, 22 bp, Artificial Sequence
  chemically synthesized
caaaaaatacttaggaactggc

SEQ ID NO: 1374100 - DNA, 22 bp, Artificial Sequence
  chemically synthesized
caatagctacaaaaaatactta

SEQ ID NO: 1374101 - DNA, 22 bp, Artificial Sequence
  chemically synthesized
acaatagctacaaaaaatactt

SEQ ID NO: 1374102 - DNA, 22 bp, Artificial Sequence
  chemically synthesized
ctaagtattttttgtagctatt

SEQ ID NO: 1374103 - DNA, 22 bp, Artificial Sequence
  chemically synthesized
agtattttttgtagctattgta

SEQ ID NO: 1374104 - DNA, 22 bp, Artificial Sequence
  chemically synthesized
aaaaatcccatttacaatagct

SEQ ID NO: 1374105 - DNA, 22 bp, Artificial Sequence
  chemically synthesized
aaaaaatcccatttacaatagc

SEQ ID NO: 1374106 - DNA, 22 bp, Artificial Sequence
  chemically synthesized
taaaaaatcccatttacaatag

SEQ ID NO: 1374107 - DNA, 22 bp, Artificial Sequence
  chemically synthesized
ttaaaaaatcccatttacaata

SEQ ID NO: 1374108 - DNA, 22 bp, Artificial Sequence
  chemically synthesized
tttgtagctattgtaaatggga

SEQ ID NO: 1374109 - DNA, 22 bp, Artificial Sequence
  chemically synthesized
ttgtagctattgtaaatgggat

SEQ ID NO: 1374110 - DNA, 22 bp, Artificial Sequence
  chemically synthesized
tgtagctattgtaaatgggatt

SEQ ID NO: 1374111 - DNA, 22 bp, Artificial Sequence
  chemically synthesized
gtagctattgtaaatgggattt

SEQ ID NO: 1374112 - DNA, 22 bp, Artificial Sequence
  chemically synthesized
tagctattgtaaatgggatttt

SEQ ID NO: 1374113 - DNA, 22 bp, Artificial Sequence
  chemically synthesized
ttgtaaatgggattttttaaaa

SEQ ID NO: 1374114 - DNA, 22 bp, Artificial Sequence
  chemically synthesized
taaatgggattttttaaaaatt

SEQ ID NO: 1374115 - DNA, 22 bp, Artificial Sequence
  chemically synthesized
gggaaaataaaaaataaatttt

SEQ ID NO: 1374116 - DNA, 22 bp, Artificial Sequence
  chemically synthesized
agggaaaataaaaaataaattt

SEQ ID NO: 1374117 - DNA, 22 bp, Artificial Sequence
  chemically synthesized
tttaaaaatttattttttattt

SEQ ID NO: 1374118 - DNA, 22 bp, Artificial Sequence
  chemically synthesized
ttaaaaatttattttttatttt

SEQ ID NO: 1374119 - DNA, 22 bp, Artificial Sequence
  chemically synthesized
taaaaatttattttttattttc

SEQ ID NO: 1374120 - DNA, 22 bp, Artificial Sequence
  chemically synthesized
aaaaatttattttttattttcc

SEQ ID NO: 1374121 - DNA, 22 bp, Artificial Sequence
  chemically synthesized
aaaatttattttttattttccc

SEQ ID NO: 1374122 - DNA, 22 bp, Artificial Sequence
  chemically synthesized
taccccaataacttagggaaaa

SEQ ID NO: 1374123 - DNA, 22 bp, Artificial Sequence
  chemically synthesized
attttttattttccctaagtta

SEQ ID NO: 1374124 - DNA, 22 bp, Artificial Sequence
  chemically synthesized
ttttttattttccctaagttat

SEQ ID NO: 1374125 - DNA, 22 bp, Artificial Sequence
  chemically synthesized
tttattttccctaagttattgg

SEQ ID NO: 1374126 - DNA, 22 bp, Artificial Sequence
  chemically synthesized
ttattttccctaagttattggg

SEQ ID NO: 1374127 - DNA, 22 bp, Artificial Sequence
  chemically synthesized
tattttccctaagttattgggg

SEQ ID NO: 1374128 - DNA, 22 bp, Artificial Sequence
  chemically synthesized
attttccctaagttattggggt

SEQ ID NO: 1374129 - DNA, 22 bp, Artificial Sequence
  chemically synthesized
ttttccctaagttattggggta

SEQ ID NO: 1374130 - DNA, 22 bp, Artificial Sequence
  chemically synthesized
tccctaagttattggggtacag

SEQ ID NO: 1374131 - DNA, 22 bp, Artificial Sequence
  chemically synthesized
ccctaagttattggggtacagg

SEQ ID NO: 1374132 - DNA, 22 bp, Artificial Sequence
  chemically synthesized
cctaagttattggggtacaggt

SEQ ID NO: 1374133 - DNA, 22 bp, Artificial Sequence
  chemically synthesized
agttattggggtacaggtggta

SEQ ID NO: 1374134 - DNA, 22 bp, Artificial Sequence
  chemically synthesized
gtcatgcaatcaaataccacct

SEQ ID NO: 1374135 - DNA, 22 bp, Artificial Sequence
  chemically synthesized
agtcatgcaatcaaataccacc

SEQ ID NO: 1374136 - DNA, 22 bp, Artificial Sequence
  chemically synthesized
ttggggtacaggtggtatttga

SEQ ID NO: 1374137 - DNA, 22 bp, Artificial Sequence
  chemically synthesized
gggtacaggtggtatttgattg

SEQ ID NO: 1374138 - DNA, 22 bp, Artificial Sequence
  chemically synthesized
aagaacttagtcatgcaatcaa

SEQ ID NO: 1374139 - DNA, 22 bp, Artificial Sequence
  chemically synthesized
gattgcatgactaagttcttta

SEQ ID NO: 1374140 - DNA, 22 bp, Artificial Sequence
  chemically synthesized
acaaatcaccactaaagaactt

SEQ ID NO: 1374141 - DNA, 22 bp, Artificial Sequence
  chemically synthesized
attgcatgactaagttctttag

SEQ ID NO: 1374142 - DNA, 22 bp, Artificial Sequence
  chemically synthesized
catgactaagttctttagtggt

SEQ ID NO: 1374143 - DNA, 22 bp, Artificial Sequence
  chemically synthesized
agttctttagtggtgatttgtg

SEQ ID NO: 1374144 - DNA, 22 bp, Artificial Sequence
  chemically synthesized
tttagtggtgatttgtgagatt

SEQ ID NO: 1374145 - DNA, 22 bp, Artificial Sequence
  chemically synthesized
tagtggtgatttgtgagatttt

SEQ ID NO: 1374146 - DNA, 22 bp, Artificial Sequence
  chemically synthesized
agtggtgatttgtgagattttg

SEQ ID NO: 1374147 - DNA, 22 bp, Artificial Sequence
  chemically synthesized
gtggtgatttgtgagattttgg

SEQ ID NO: 1374148 - DNA, 22 bp, Artificial Sequence
  chemically synthesized
ggtgatgggtgcaccaaaatct

SEQ ID NO: 1374149 - DNA, 22 bp, Artificial Sequence
  chemically synthesized
gggtgatgggtgcaccaaaatc

SEQ ID NO: 1374150 - DNA, 22 bp, Artificial Sequence
  chemically synthesized
cttgggtgatgggtgcaccaaa

SEQ ID NO: 1374151 - DNA, 22 bp, Artificial Sequence
  chemically synthesized
gtgagattttggtgcacccatc

SEQ ID NO: 1374152 - DNA, 22 bp, Artificial Sequence
  chemically synthesized
tgagattttggtgcacccatca

SEQ ID NO: 1374153 - DNA, 22 bp, Artificial Sequence
  chemically synthesized
tgtatactgcttgggtgatggg

SEQ ID NO: 1374154 - DNA, 22 bp, Artificial Sequence
  chemically synthesized
tggtgcacccatcacccaagca

SEQ ID NO: 1374155 - DNA, 22 bp, Artificial Sequence
  chemically synthesized
ggtgcacccatcacccaagcag

SEQ ID NO: 1374156 - DNA, 22 bp, Artificial Sequence
  chemically synthesized
gtgcacccatcacccaagcagt

SEQ ID NO: 1374157 - DNA, 22 bp, Artificial Sequence
  chemically synthesized
caaatacggtgctgtgtatact

SEQ ID NO: 1374158 - DNA, 22 bp, Artificial Sequence
  chemically synthesized
ggggaggcaagggataaaagac

SEQ ID NO: 1374159 - DNA, 22 bp, Artificial Sequence
  chemically synthesized
gtagtcttttatcccttgcctc

SEQ ID NO: 1374160 - DNA, 22 bp, Artificial Sequence
  chemically synthesized
tagtcttttatcccttgcctcc

SEQ ID NO: 1374161 - DNA, 22 bp, Artificial Sequence
  chemically synthesized
gggagaagagttgggggaggca

SEQ ID NO: 1374162 - DNA, 22 bp, Artificial Sequence
  chemically synthesized
ggggagaagagttgggggaggc

SEQ ID NO: 1374163 - DNA, 22 bp, Artificial Sequence
  chemically synthesized
ttatcccttgcctcccccaact

SEQ ID NO: 1374164 - DNA, 22 bp, Artificial Sequence
  chemically synthesized
tatcccttgcctcccccaactc

SEQ ID NO: 1374165 - DNA, 22 bp, Artificial Sequence
  chemically synthesized
atcccttgcctcccccaactct

SEQ ID NO: 1374166 - DNA, 22 bp, Artificial Sequence
  chemically synthesized
tcccttgcctcccccaactctt

SEQ ID NO: 1374167 - DNA, 22 bp, Artificial Sequence
  chemically synthesized
gggacttggggagaagagttgg

SEQ ID NO: 1374168 - DNA, 22 bp, Artificial Sequence
  chemically synthesized
ggggacttggggagaagagttg

SEQ ID NO: 1374169 - DNA, 22 bp, Artificial Sequence
  chemically synthesized
tggggacttggggagaagagtt

SEQ ID NO: 1374170 - DNA, 22 bp, Artificial Sequence
  chemically synthesized
gcctcccccaactcttctcccc

SEQ ID NO: 1374171 - DNA, 22 bp, Artificial Sequence
  chemically synthesized
cctcccccaactcttctcccca

SEQ ID NO: 1374172 - DNA, 22 bp, Artificial Sequence
  chemically synthesized
ccccaactcttctccccaagtc

SEQ ID NO: 1374173 - DNA, 22 bp, Artificial Sequence
  chemically synthesized
ttctccccaagtccccaaagtc

SEQ ID NO: 1374174 - DNA, 22 bp, Artificial Sequence
  chemically synthesized
ctccccaagtccccaaagtcca

SEQ ID NO: 1374175 - DNA, 22 bp, Artificial Sequence
  chemically synthesized
tccccaagtccccaaagtccat

SEQ ID NO: 1374176 - DNA, 22 bp, Artificial Sequence
  chemically synthesized
cccaagtccccaaagtccattg

SEQ ID NO: 1374177 - DNA, 22 bp, Artificial Sequence
  chemically synthesized
taagaacacaaaggcataagaa

SEQ ID NO: 1374178 - DNA, 22 bp, Artificial Sequence
  chemically synthesized
tattattcttatgcctttgtgt

SEQ ID NO: 1374179 - DNA, 22 bp, Artificial Sequence
  chemically synthesized
ttcttatgcctttgtgttctta

SEQ ID NO: 1374180 - DNA, 22 bp, Artificial Sequence
  chemically synthesized
ttatgcctttgtgttcttatag

SEQ ID NO: 1374181 - DNA, 22 bp, Artificial Sequence
  chemically synthesized
atgcctttgtgttcttatagct

SEQ ID NO: 1374182 - DNA, 22 bp, Artificial Sequence
  chemically synthesized
tgcctttgtgttcttatagctt

SEQ ID NO: 1374183 - DNA, 22 bp, Artificial Sequence
  chemically synthesized
atatgtaggagataagctataa

SEQ ID NO: 1374184 - DNA, 22 bp, Artificial Sequence
  chemically synthesized
actgatatgtaggagataagct

SEQ ID NO: 1374185 - DNA, 22 bp, Artificial Sequence
  chemically synthesized
tgtgttcttatagcttatctcc

SEQ ID NO: 1374186 - DNA, 22 bp, Artificial Sequence
  chemically synthesized
gtgttcttatagcttatctcct

SEQ ID NO: 1374187 - DNA, 22 bp, Artificial Sequence
  chemically synthesized
tcactgatatgtaggagataag

SEQ ID NO: 1374188 - DNA, 22 bp, Artificial Sequence
  chemically synthesized
tgttcttatagcttatctccta

SEQ ID NO: 1374189 - DNA, 22 bp, Artificial Sequence
  chemically synthesized
ttatagcttatctcctacatat

SEQ ID NO: 1374190 - DNA, 22 bp, Artificial Sequence
  chemically synthesized
atagcttatctcctacatatca

SEQ ID NO: 1374191 - DNA, 22 bp, Artificial Sequence
  chemically synthesized
tagcttatctcctacatatcag

SEQ ID NO: 1374192 - DNA, 22 bp, Artificial Sequence
  chemically synthesized
atctcctacatatcagtgagaa

SEQ ID NO: 1374193 - DNA, 22 bp, Artificial Sequence
  chemically synthesized
tctcctacatatcagtgagaac

SEQ ID NO: 1374194 - DNA, 22 bp, Artificial Sequence
  chemically synthesized
ctacatatcagtgagaacacac

SEQ ID NO: 1374195 - DNA, 22 bp, Artificial Sequence
  chemically synthesized
catatcagtgagaacacacgat

SEQ ID NO: 1374196 - DNA, 22 bp, Artificial Sequence
  chemically synthesized
aggaatggaaaaccaaacatcg

SEQ ID NO: 1374197 - DNA, 22 bp, Artificial Sequence
  chemically synthesized
agtgaagtaactcaggaatgga

SEQ ID NO: 1374198 - DNA, 22 bp, Artificial Sequence
  chemically synthesized
taagtgaagtaactcaggaatg

SEQ ID NO: 1374199 - DNA, 22 bp, Artificial Sequence
  chemically synthesized
ttctaagtgaagtaactcagga

SEQ ID NO: 1374200 - DNA, 22 bp, Artificial Sequence
  chemically synthesized
ggttttccattcctgagttact

SEQ ID NO: 1374201 - DNA, 22 bp, Artificial Sequence
  chemically synthesized
gttttccattcctgagttactt

SEQ ID NO: 1374202 - DNA, 22 bp, Artificial Sequence
  chemically synthesized
ttattctaagtgaagtaactca

SEQ ID NO: 1374203 - DNA, 22 bp, Artificial Sequence
  chemically synthesized
tccattcctgagttacttcact

SEQ ID NO: 1374204 - DNA, 22 bp, Artificial Sequence
  chemically synthesized
ccattcctgagttacttcactt

SEQ ID NO: 1374205 - DNA, 22 bp, Artificial Sequence
  chemically synthesized
cattcctgagttacttcactta

SEQ ID NO: 1374206 - DNA, 22 bp, Artificial Sequence
  chemically synthesized
gagactattattctaagtgaag

SEQ ID NO: 1374207 - DNA, 22 bp, Artificial Sequence
  chemically synthesized
ctgagttacttcacttagaata

SEQ ID NO: 1374208 - DNA, 22 bp, Artificial Sequence
  chemically synthesized
agttacttcacttagaataata

SEQ ID NO: 1374209 - DNA, 22 bp, Artificial Sequence
  chemically synthesized
gatgagattggagactattatt

SEQ ID NO: 1374210 - DNA, 22 bp, Artificial Sequence
  chemically synthesized
cttcacttagaataatagtctc

SEQ ID NO: 1374211 - DNA, 22 bp, Artificial Sequence
  chemically synthesized
cacttagaataatagtctccaa

SEQ ID NO: 1374212 - DNA, 22 bp, Artificial Sequence
  chemically synthesized
acttagaataatagtctccaat

SEQ ID NO: 1374213 - DNA, 22 bp, Artificial Sequence
  chemically synthesized
agaataatagtctccaatctca

SEQ ID NO: 1374214 - DNA, 22 bp, Artificial Sequence
  chemically synthesized
cagtgacctggatgagattgga

SEQ ID NO: 1374215 - DNA, 22 bp, Artificial Sequence
  chemically synthesized
gaataatagtctccaatctcat

SEQ ID NO: 1374216 - DNA, 22 bp, Artificial Sequence
  chemically synthesized
gcagtgacctggatgagattgg

SEQ ID NO: 1374217 - DNA, 22 bp, Artificial Sequence
  chemically synthesized
acagcatttgcagtgacctgga

SEQ ID NO: 1374218 - DNA, 22 bp, Artificial Sequence
  chemically synthesized
caatctcatccaggtcactgca

SEQ ID NO: 1374219 - DNA, 22 bp, Artificial Sequence
  chemically synthesized
atccaggtcactgcaaatgctg

SEQ ID NO: 1374220 - DNA, 22 bp, Artificial Sequence
  chemically synthesized
tggccacaaaaaggaagaaatt

SEQ ID NO: 1374221 - DNA, 22 bp, Artificial Sequence
  chemically synthesized
caaatgctgttaatttcttcct

SEQ ID NO: 1374222 - DNA, 22 bp, Artificial Sequence
  chemically synthesized
ttaatttcttcctttttgtggc

SEQ ID NO: 1374223 - DNA, 22 bp, Artificial Sequence
  chemically synthesized
tggtataactgtggccacaaaa

SEQ ID NO: 1374224 - DNA, 22 bp, Artificial Sequence
  chemically synthesized
atttcttcctttttgtggccac

SEQ ID NO: 1374225 - DNA, 22 bp, Artificial Sequence
  chemically synthesized
cttcctttttgtggccacagtt

SEQ ID NO: 1374226 - DNA, 22 bp, Artificial Sequence
  chemically synthesized
ttcctttttgtggccacagtta

SEQ ID NO: 1374227 - DNA, 22 bp, Artificial Sequence
  chemically synthesized
cctttttgtggccacagttata

SEQ ID NO: 1374228 - DNA, 22 bp, Artificial Sequence
  chemically synthesized
ctttttgtggccacagttatac

SEQ ID NO: 1374229 - DNA, 22 bp, Artificial Sequence
  chemically synthesized
tttgtggccacagttataccac

SEQ ID NO: 1374230 - DNA, 22 bp, Artificial Sequence
  chemically synthesized
ttgtggccacagttataccaca

SEQ ID NO: 1374231 - DNA, 22 bp, Artificial Sequence
  chemically synthesized
tgtggccacagttataccacag

SEQ ID NO: 1374232 - DNA, 22 bp, Artificial Sequence
  chemically synthesized
gtggccacagttataccacagt

SEQ ID NO: 1374233 - DNA, 22 bp, Artificial Sequence
  chemically synthesized
tggccacagttataccacagtt

SEQ ID NO: 1374234 - DNA, 22 bp, Artificial Sequence
  chemically synthesized
taccacagtttctctttatcca

SEQ ID NO: 1374235 - DNA, 22 bp, Artificial Sequence
  chemically synthesized
ctctttatccactcgttgattg

SEQ ID NO: 1374236 - DNA, 22 bp, Artificial Sequence
  chemically synthesized
tctttatccactcgttgattga

SEQ ID NO: 1374237 - DNA, 22 bp, Artificial Sequence
  chemically synthesized
tttatccactcgttgattgatg

SEQ ID NO: 1374238 - DNA, 22 bp, Artificial Sequence
  chemically synthesized
tatccactcgttgattgatggg

SEQ ID NO: 1374239 - DNA, 22 bp, Artificial Sequence
  chemically synthesized
atccactcgttgattgatgggc

SEQ ID NO: 1374240 - DNA, 22 bp, Artificial Sequence
  chemically synthesized
tccactcgttgattgatgggcc

SEQ ID NO: 1374241 - DNA, 22 bp, Artificial Sequence
  chemically synthesized
gttgattgatgggcctttgggt

SEQ ID NO: 1374242 - DNA, 22 bp, Artificial Sequence
  chemically synthesized
attgatgggcctttgggttggt

SEQ ID NO: 1374243 - DNA, 22 bp, Artificial Sequence
  chemically synthesized
caaaatcgtggaaccaacccaa

SEQ ID NO: 1374244 - DNA, 22 bp, Artificial Sequence
  chemically synthesized
atgggcctttgggttggttcca

SEQ ID NO: 1374245 - DNA, 22 bp, Artificial Sequence
  chemically synthesized
tgggttggttccacgattttgc

SEQ ID NO: 1374246 - DNA, 22 bp, Artificial Sequence
  chemically synthesized
gggttggttccacgattttgca

SEQ ID NO: 1374247 - DNA, 22 bp, Artificial Sequence
  chemically synthesized
ggttggttccacgattttgcaa

SEQ ID NO: 1374248 - DNA, 22 bp, Artificial Sequence
  chemically synthesized
gttccacgattttgcaattgcg

SEQ ID NO: 1374249 - DNA, 22 bp, Artificial Sequence
  chemically synthesized
cagcaacacaaagcgcaattgc

SEQ ID NO: 1374250 - DNA, 22 bp, Artificial Sequence
  chemically synthesized
acagcaacacaaagcgcaattg

SEQ ID NO: 1374251 - DNA, 22 bp, Artificial Sequence
  chemically synthesized
cacgattttgcaattgcgcttt

SEQ ID NO: 1374252 - DNA, 22 bp, Artificial Sequence
  chemically synthesized
tgcaattgcgctttgtgttgct

SEQ ID NO: 1374253 - DNA, 22 bp, Artificial Sequence
  chemically synthesized
gcaattgcgctttgtgttgctg

SEQ ID NO: 1374254 - DNA, 22 bp, Artificial Sequence
  chemically synthesized
caattgcgctttgtgttgctgt

SEQ ID NO: 1374255 - DNA, 22 bp, Artificial Sequence
  chemically synthesized
cacacacaagtttacagcaaca

SEQ ID NO: 1374256 - DNA, 22 bp, Artificial Sequence
  chemically synthesized
gcacacacaagtttacagcaac

SEQ ID NO: 1374257 - DNA, 22 bp, Artificial Sequence
  chemically synthesized
cgctttgtgttgctgtaaactt

SEQ ID NO: 1374258 - DNA, 22 bp, Artificial Sequence
  chemically synthesized
tgtgttgctgtaaacttgtgtg

SEQ ID NO: 1374259 - DNA, 22 bp, Artificial Sequence
  chemically synthesized
gtgttgctgtaaacttgtgtgt

SEQ ID NO: 1374260 - DNA, 22 bp, Artificial Sequence
  chemically synthesized
tgttgctgtaaacttgtgtgtg

SEQ ID NO: 1374261 - DNA, 22 bp, Artificial Sequence
  chemically synthesized
ctgtaaacttgtgtgtgcaagt

SEQ ID NO: 1374262 - DNA, 22 bp, Artificial Sequence
  chemically synthesized
tatgtaaaagatacttgcacac

SEQ ID NO: 1374263 - DNA, 22 bp, Artificial Sequence
  chemically synthesized
taaacttgtgtgtgcaagtatc

SEQ ID NO: 1374264 - DNA, 22 bp, Artificial Sequence
  chemically synthesized
ttatatgtaaaagatacttgca

SEQ ID NO: 1374265 - DNA, 22 bp, Artificial Sequence
  chemically synthesized
gtgtgtgcaagtatcttttaca

SEQ ID NO: 1374266 - DNA, 22 bp, Artificial Sequence
  chemically synthesized
tgtgtgcaagtatcttttacat

SEQ ID NO: 1374267 - DNA, 22 bp, Artificial Sequence
  chemically synthesized
cccagacaaaaataagttatta

SEQ ID NO: 1374268 - DNA, 22 bp, Artificial Sequence
  chemically synthesized
ttacatataataacttattttt

SEQ ID NO: 1374269 - DNA, 22 bp, Artificial Sequence
  chemically synthesized
tacatataataacttatttttg

SEQ ID NO: 1374270 - DNA, 22 bp, Artificial Sequence
  chemically synthesized
acatataataacttatttttgt

SEQ ID NO: 1374271 - DNA, 22 bp, Artificial Sequence
  chemically synthesized
catataataacttatttttgtc

SEQ ID NO: 1374272 - DNA, 22 bp, Artificial Sequence
  chemically synthesized
ccagatatctacccagacaaaa

SEQ ID NO: 1374273 - DNA, 22 bp, Artificial Sequence
  chemically synthesized
atttttgtctgggtagatatct

SEQ ID NO: 1374274 - DNA, 22 bp, Artificial Sequence
  chemically synthesized
tttttgtctgggtagatatctg

SEQ ID NO: 1374275 - DNA, 22 bp, Artificial Sequence
  chemically synthesized
agcaatcccactaccagatatc

SEQ ID NO: 1374276 - DNA, 22 bp, Artificial Sequence
  chemically synthesized
ttgtctgggtagatatctggta

SEQ ID NO: 1374277 - DNA, 22 bp, Artificial Sequence
  chemically synthesized
tgtctgggtagatatctggtag

SEQ ID NO: 1374278 - DNA, 22 bp, Artificial Sequence
  chemically synthesized
gtctgggtagatatctggtagt

SEQ ID NO: 1374279 - DNA, 22 bp, Artificial Sequence
  chemically synthesized
tctgggtagatatctggtagtg

SEQ ID NO: 1374280 - DNA, 22 bp, Artificial Sequence
  chemically synthesized
attcagcaatcccactaccaga

SEQ ID NO: 1374281 - DNA, 22 bp, Artificial Sequence
  chemically synthesized
gattcagcaatcccactaccag

SEQ ID NO: 1374282 - DNA, 22 bp, Artificial Sequence
  chemically synthesized
ggtagatatctggtagtgggat

SEQ ID NO: 1374283 - DNA, 22 bp, Artificial Sequence
  chemically synthesized
ccatttgattcagcaatcccac

SEQ ID NO: 1374284 - DNA, 22 bp, Artificial Sequence
  chemically synthesized
gtagtgggattgctgaatcaaa

SEQ ID NO: 1374285 - DNA, 22 bp, Artificial Sequence
  chemically synthesized
aaagtagaactaccatttgatt

SEQ ID NO: 1374286 - DNA, 22 bp, Artificial Sequence
  chemically synthesized
aataactaaaagtagaactacc

SEQ ID NO: 1374287 - DNA, 22 bp, Artificial Sequence
  chemically synthesized
ctgaatcaaatggtagttctac

SEQ ID NO: 1374288 - DNA, 22 bp, Artificial Sequence
  chemically synthesized
aaataactaaaagtagaactac

SEQ ID NO: 1374289 - DNA, 22 bp, Artificial Sequence
  chemically synthesized
aatcaaatggtagttctacttt

SEQ ID NO: 1374290 - DNA, 22 bp, Artificial Sequence
  chemically synthesized
cttaaataactaaaagtagaac

SEQ ID NO: 1374291 - DNA, 22 bp, Artificial Sequence
  chemically synthesized
tacttttagttatttaaggaat

SEQ ID NO: 1374292 - DNA, 22 bp, Artificial Sequence
  chemically synthesized
cttttagttatttaaggaatct

SEQ ID NO: 1374293 - DNA, 22 bp, Artificial Sequence
  chemically synthesized
ttagttatttaaggaatctcca

SEQ ID NO: 1374294 - DNA, 22 bp, Artificial Sequence
  chemically synthesized
tggaaaacagtgtggagattcc

SEQ ID NO: 1374295 - DNA, 22 bp, Artificial Sequence
  chemically synthesized
tagttatttaaggaatctccac

SEQ ID NO: 1374296 - DNA, 22 bp, Artificial Sequence
  chemically synthesized
agttatttaaggaatctccaca

SEQ ID NO: 1374297 - DNA, 22 bp, Artificial Sequence
  chemically synthesized
gttatttaaggaatctccacac

SEQ ID NO: 1374298 - DNA, 22 bp, Artificial Sequence
  chemically synthesized
tttaaggaatctccacactgtt

SEQ ID NO: 1374299 - DNA, 22 bp, Artificial Sequence
  chemically synthesized
aaggaatctccacactgttttc

SEQ ID NO: 1374300 - DNA, 22 bp, Artificial Sequence
  chemically synthesized
aggaatctccacactgttttcc

SEQ ID NO: 1374301 - DNA, 22 bp, Artificial Sequence
  chemically synthesized
gtatacaaccgctatggaaaac

SEQ ID NO: 1374302 - DNA, 22 bp, Artificial Sequence
  chemically synthesized
cacactgttttccatagcggtt

SEQ ID NO: 1374303 - DNA, 22 bp, Artificial Sequence
  chemically synthesized
ttttccatagcggttgtatact

SEQ ID NO: 1374304 - DNA, 22 bp, Artificial Sequence
  chemically synthesized
tccatagcggttgtatactagt

SEQ ID NO: 1374305 - DNA, 22 bp, Artificial Sequence
  chemically synthesized
gtggggatgtagactagtatac

SEQ ID NO: 1374306 - DNA, 22 bp, Artificial Sequence
  chemically synthesized
ccatagcggttgtatactagtc

SEQ ID NO: 1374307 - DNA, 22 bp, Artificial Sequence
  chemically synthesized
catagcggttgtatactagtct

SEQ ID NO: 1374308 - DNA, 22 bp, Artificial Sequence
  chemically synthesized
ctggtggggatgtagactagta

SEQ ID NO: 1374309 - DNA, 22 bp, Artificial Sequence
  chemically synthesized
cactgctggtggggatgtagac

SEQ ID NO: 1374310 - DNA, 22 bp, Artificial Sequence
  chemically synthesized
tacactgctggtggggatgtag

SEQ ID NO: 1374311 - DNA, 22 bp, Artificial Sequence
  chemically synthesized
ctacactgctggtggggatgta

SEQ ID NO: 1374312 - DNA, 22 bp, Artificial Sequence
  chemically synthesized
tatactagtctacatccccacc

SEQ ID NO: 1374313 - DNA, 22 bp, Artificial Sequence
  chemically synthesized
gtctacatccccaccagcagtg

SEQ ID NO: 1374314 - DNA, 22 bp, Artificial Sequence
  chemically synthesized
catccccaccagcagtgtagaa

SEQ ID NO: 1374315 - DNA, 22 bp, Artificial Sequence
  chemically synthesized
gcatggatgtggtgatcaggga

SEQ ID NO: 1374316 - DNA, 22 bp, Artificial Sequence
  chemically synthesized
cctgatcaccacatccatgcca

SEQ ID NO: 1374317 - DNA, 22 bp, Artificial Sequence
  chemically synthesized
atcaccacatccatgccaacat

SEQ ID NO: 1374318 - DNA, 22 bp, Artificial Sequence
  chemically synthesized
ccgttttttgattttttgatta

SEQ ID NO: 1374319 - DNA, 22 bp, Artificial Sequence
  chemically synthesized
caagaatggccataatcaaaaa

SEQ ID NO: 1374320 - DNA, 22 bp, Artificial Sequence
  chemically synthesized
ctgcaagaatggccataatcaa

SEQ ID NO: 1374321 - DNA, 22 bp, Artificial Sequence
  chemically synthesized
tttgattttttgattatggcca

SEQ ID NO: 1374322 - DNA, 22 bp, Artificial Sequence
  chemically synthesized
ctcctgcaagaatggccataat

SEQ ID NO: 1374323 - DNA, 22 bp, Artificial Sequence
  chemically synthesized
ttgattttttgattatggccat

SEQ ID NO: 1374324 - DNA, 22 bp, Artificial Sequence
  chemically synthesized
actcctgcaagaatggccataa

SEQ ID NO: 1374325 - DNA, 22 bp, Artificial Sequence
  chemically synthesized
tgattttttgattatggccatt

SEQ ID NO: 1374326 - DNA, 22 bp, Artificial Sequence
  chemically synthesized
gattttttgattatggccattc

SEQ ID NO: 1374327 - DNA, 22 bp, Artificial Sequence
  chemically synthesized
attttttgattatggccattct

SEQ ID NO: 1374328 - DNA, 22 bp, Artificial Sequence
  chemically synthesized
tttgattatggccattcttgca

SEQ ID NO: 1374329 - DNA, 22 bp, Artificial Sequence
  chemically synthesized
ttgattatggccattcttgcag

SEQ ID NO: 1374330 - DNA, 22 bp, Artificial Sequence
  chemically synthesized
tgattatggccattcttgcagg

SEQ ID NO: 1374331 - DNA, 22 bp, Artificial Sequence
  chemically synthesized
gattatggccattcttgcagga

SEQ ID NO: 1374332 - DNA, 22 bp, Artificial Sequence
  chemically synthesized
attatggccattcttgcaggag

SEQ ID NO: 1374333 - DNA, 22 bp, Artificial Sequence
  chemically synthesized
tggccattcttgcaggagtaag

SEQ ID NO: 1374334 - DNA, 22 bp, Artificial Sequence
  chemically synthesized
ttgcaggagtaaggtggtatca

SEQ ID NO: 1374335 - DNA, 22 bp, Artificial Sequence
  chemically synthesized
gcaggagtaaggtggtatcaca

SEQ ID NO: 1374336 - DNA, 22 bp, Artificial Sequence
  chemically synthesized
caggagtaaggtggtatcacat

SEQ ID NO: 1374337 - DNA, 22 bp, Artificial Sequence
  chemically synthesized
atgatcagggaaatgcaaatca

SEQ ID NO: 1374338 - DNA, 22 bp, Artificial Sequence
  chemically synthesized
aacatcactaatgatcagggaa

SEQ ID NO: 1374339 - DNA, 22 bp, Artificial Sequence
  chemically synthesized
tgatttgcatttccctgatcat

SEQ ID NO: 1374340 - DNA, 22 bp, Artificial Sequence
  chemically synthesized
gatttgcatttccctgatcatt

SEQ ID NO: 1374341 - DNA, 22 bp, Artificial Sequence
  chemically synthesized
atttgcatttccctgatcatta

SEQ ID NO: 1374342 - DNA, 22 bp, Artificial Sequence
  chemically synthesized
gcatttccctgatcattagtga

SEQ ID NO: 1374343 - DNA, 22 bp, Artificial Sequence
  chemically synthesized
catttccctgatcattagtgat

SEQ ID NO: 1374344 - DNA, 22 bp, Artificial Sequence
  chemically synthesized
ccctgatcattagtgatgttga

SEQ ID NO: 1374345 - DNA, 22 bp, Artificial Sequence
  chemically synthesized
cctgatcattagtgatgttgag

SEQ ID NO: 1374346 - DNA, 22 bp, Artificial Sequence
  chemically synthesized
atcattagtgatgttgagcatt

SEQ ID NO: 1374347 - DNA, 22 bp, Artificial Sequence
  chemically synthesized
gtgatgttgagcattttttcat

SEQ ID NO: 1374348 - DNA, 22 bp, Artificial Sequence
  chemically synthesized
cagatggccaacaaacatatga

SEQ ID NO: 1374349 - DNA, 22 bp, Artificial Sequence
  chemically synthesized
agcattttttcatatgtttgtt

SEQ ID NO: 1374350 - DNA, 22 bp, Artificial Sequence
  chemically synthesized
tttcatatgtttgttggccatc

SEQ ID NO: 1374351 - DNA, 22 bp, Artificial Sequence
  chemically synthesized
ttcatatgtttgttggccatct

SEQ ID NO: 1374352 - DNA, 22 bp, Artificial Sequence
  chemically synthesized
aagaagatctacagatggccaa

SEQ ID NO: 1374353 - DNA, 22 bp, Artificial Sequence
  chemically synthesized
tcatatgtttgttggccatctg

SEQ ID NO: 1374354 - DNA, 22 bp, Artificial Sequence
  chemically synthesized
catatgtttgttggccatctgt

SEQ ID NO: 1374355 - DNA, 22 bp, Artificial Sequence
  chemically synthesized
atatgtttgttggccatctgta

SEQ ID NO: 1374356 - DNA, 22 bp, Artificial Sequence
  chemically synthesized
cctaaagaagatctacagatgg

SEQ ID NO: 1374357 - DNA, 22 bp, Artificial Sequence
  chemically synthesized
gttggccatctgtagatcttct

SEQ ID NO: 1374358 - DNA, 22 bp, Artificial Sequence
  chemically synthesized
ttggccatctgtagatcttctt

SEQ ID NO: 1374359 - DNA, 22 bp, Artificial Sequence
  chemically synthesized
gccatctgtagatcttctttag

SEQ ID NO: 1374360 - DNA, 22 bp, Artificial Sequence
  chemically synthesized
tagatcttctttagggaattgt

SEQ ID NO: 1374361 - DNA, 22 bp, Artificial Sequence
  chemically synthesized
aggatatgaatagacaattccc

SEQ ID NO: 1374362 - DNA, 22 bp, Artificial Sequence
  chemically synthesized
taaggatatgaatagacaattc

SEQ ID NO: 1374363 - DNA, 22 bp, Artificial Sequence
  chemically synthesized
ctttagggaattgtctattcat

SEQ ID NO: 1374364 - DNA, 22 bp, Artificial Sequence
  chemically synthesized
tttagggaattgtctattcata

SEQ ID NO: 1374365 - DNA, 22 bp, Artificial Sequence
  chemically synthesized
tagggaattgtctattcatatc

SEQ ID NO: 1374366 - DNA, 22 bp, Artificial Sequence
  chemically synthesized
agggaattgtctattcatatcc

SEQ ID NO: 1374367 - DNA, 22 bp, Artificial Sequence
  chemically synthesized
gggaattgtctattcatatcct

SEQ ID NO: 1374368 - DNA, 22 bp, Artificial Sequence
  chemically synthesized
tctattcatatccttagaacac

SEQ ID NO: 1374369 - DNA, 22 bp, Artificial Sequence
  chemically synthesized
ttcatatccttagaacactttt

SEQ ID NO: 1374370 - DNA, 22 bp, Artificial Sequence
  chemically synthesized
atatccttagaacactttttga

SEQ ID NO: 1374371 - DNA, 22 bp, Artificial Sequence
  chemically synthesized
agaacactttttgatgggattg

SEQ ID NO: 1374372 - DNA, 22 bp, Artificial Sequence
  chemically synthesized
gaacactttttgatgggattgt

SEQ ID NO: 1374373 - DNA, 22 bp, Artificial Sequence
  chemically synthesized
tttgatgggattgtttgtttcc

SEQ ID NO: 1374374 - DNA, 22 bp, Artificial Sequence
  chemically synthesized
ttgatgggattgtttgtttcct

SEQ ID NO: 1374375 - DNA, 22 bp, Artificial Sequence
  chemically synthesized
tgatgggattgtttgtttcctt

SEQ ID NO: 1374376 - DNA, 22 bp, Artificial Sequence
  chemically synthesized
gatgggattgtttgtttccttc

SEQ ID NO: 1374377 - DNA, 22 bp, Artificial Sequence
  chemically synthesized
atgggattgtttgtttccttct

SEQ ID NO: 1374378 - DNA, 22 bp, Artificial Sequence
  chemically synthesized
tttgtttccttcttactgattt

SEQ ID NO: 1374379 - DNA, 22 bp, Artificial Sequence
  chemically synthesized
caatgaacacaaacaaatcagt

SEQ ID NO: 1374380 - DNA, 22 bp, Artificial Sequence
  chemically synthesized
gtttccttcttactgatttgtt

SEQ ID NO: 1374381 - DNA, 22 bp, Artificial Sequence
  chemically synthesized
tttccttcttactgatttgttt

SEQ ID NO: 1374382 - DNA, 22 bp, Artificial Sequence
  chemically synthesized
ccttcttactgatttgtttgtg

SEQ ID NO: 1374383 - DNA, 22 bp, Artificial Sequence
  chemically synthesized
cttcttactgatttgtttgtgt

SEQ ID NO: 1374384 - DNA, 22 bp, Artificial Sequence
  chemically synthesized
cttactgatttgtttgtgttca

SEQ ID NO: 1374385 - DNA, 22 bp, Artificial Sequence
  chemically synthesized
ttactgatttgtttgtgttcat

SEQ ID NO: 1374386 - DNA, 22 bp, Artificial Sequence
  chemically synthesized
actgatttgtttgtgttcattg

SEQ ID NO: 1374387 - DNA, 22 bp, Artificial Sequence
  chemically synthesized
ctgatttgtttgtgttcattgt

SEQ ID NO: 1374388 - DNA, 22 bp, Artificial Sequence
  chemically synthesized
atatccagaatctacaatgaac

SEQ ID NO: 1374389 - DNA, 22 bp, Artificial Sequence
  chemically synthesized
atttgtttgtgttcattgtaga

SEQ ID NO: 1374390 - DNA, 22 bp, Artificial Sequence
  chemically synthesized
gtttgtgttcattgtagattct

SEQ ID NO: 1374391 - DNA, 22 bp, Artificial Sequence
  chemically synthesized
tttgtgttcattgtagattctg

SEQ ID NO: 1374392 - DNA, 22 bp, Artificial Sequence
  chemically synthesized
gtgttcattgtagattctggat

SEQ ID NO: 1374393 - DNA, 22 bp, Artificial Sequence
  chemically synthesized
tgttcattgtagattctggata

SEQ ID NO: 1374394 - DNA, 22 bp, Artificial Sequence
  chemically synthesized
acagaggactaatatccagaat

SEQ ID NO: 1374395 - DNA, 22 bp, Artificial Sequence
  chemically synthesized
attgtagattctggatattagt

SEQ ID NO: 1374396 - DNA, 22 bp, Artificial Sequence
  chemically synthesized
tacatctgacagaggactaata

SEQ ID NO: 1374397 - DNA, 22 bp, Artificial Sequence
  chemically synthesized
tagattctggatattagtcctc

SEQ ID NO: 1374398 - DNA, 22 bp, Artificial Sequence
  chemically synthesized
tggatattagtcctctgtcaga

SEQ ID NO: 1374399 - DNA, 22 bp, Artificial Sequence
  chemically synthesized
acaatctatacatctgacagag

SEQ ID NO: 1374400 - DNA, 22 bp, Artificial Sequence
  chemically synthesized
cacaatctatacatctgacaga

SEQ ID NO: 1374401 - DNA, 22 bp, Artificial Sequence
  chemically synthesized
gatattagtcctctgtcagatg

SEQ ID NO: 1374402 - DNA, 22 bp, Artificial Sequence
  chemically synthesized
gtcctctgtcagatgtatagat

SEQ ID NO: 1374403 - DNA, 22 bp, Artificial Sequence
  chemically synthesized
tgtcagatgtatagattgtgaa

SEQ ID NO: 1374404 - DNA, 22 bp, Artificial Sequence
  chemically synthesized
tcagatgtatagattgtgaaga

SEQ ID NO: 1374405 - DNA, 22 bp, Artificial Sequence
  chemically synthesized
tgaagattttctaccgctctgt

SEQ ID NO: 1374406 - DNA, 22 bp, Artificial Sequence
  chemically synthesized
tctaccgctctgtgtgttgtct

SEQ ID NO: 1374407 - DNA, 22 bp, Artificial Sequence
  chemically synthesized
ctaccgctctgtgtgttgtctg

SEQ ID NO: 1374408 - DNA, 22 bp, Artificial Sequence
  chemically synthesized
taccgctctgtgtgttgtctgt

SEQ ID NO: 1374409 - DNA, 22 bp, Artificial Sequence
  chemically synthesized
ccgctctgtgtgttgtctgttt

SEQ ID NO: 1374410 - DNA, 22 bp, Artificial Sequence
  chemically synthesized
tgtgtgttgtctgtttgtttac

SEQ ID NO: 1374411 - DNA, 22 bp, Artificial Sequence
  chemically synthesized
tgtgttgtctgtttgtttactc

SEQ ID NO: 1374412 - DNA, 22 bp, Artificial Sequence
  chemically synthesized
tctgtttgtttactctgctgac

SEQ ID NO: 1374413 - DNA, 22 bp, Artificial Sequence
  chemically synthesized
tttgtttactctgctgactgtt

SEQ ID NO: 1374414 - DNA, 22 bp, Artificial Sequence
  chemically synthesized
cagggcaaaaggaacagtcagc

SEQ ID NO: 1374415 - DNA, 22 bp, Artificial Sequence
  chemically synthesized
gcagggcaaaaggaacagtcag

SEQ ID NO: 1374416 - DNA, 22 bp, Artificial Sequence
  chemically synthesized
tgcagggcaaaaggaacagtca

SEQ ID NO: 1374417 - DNA, 22 bp, Artificial Sequence
  chemically synthesized
gtttactctgctgactgttcct

SEQ ID NO: 1374418 - DNA, 22 bp, Artificial Sequence
  chemically synthesized
ttgcagggcaaaaggaacagtc

SEQ ID NO: 1374419 - DNA, 22 bp, Artificial Sequence
  chemically synthesized
tttactctgctgactgttcctt

SEQ ID NO: 1374420 - DNA, 22 bp, Artificial Sequence
  chemically synthesized
actctgctgactgttccttttg

SEQ ID NO: 1374421 - DNA, 22 bp, Artificial Sequence
  chemically synthesized
ctctgctgactgttccttttgc

SEQ ID NO: 1374422 - DNA, 22 bp, Artificial Sequence
  chemically synthesized
tgctgactgttccttttgccct

SEQ ID NO: 1374423 - DNA, 22 bp, Artificial Sequence
  chemically synthesized
aagagcttttgcagggcaaaag

SEQ ID NO: 1374424 - DNA, 22 bp, Artificial Sequence
  chemically synthesized
ctgactgttccttttgccctgc

SEQ ID NO: 1374425 - DNA, 22 bp, Artificial Sequence
  chemically synthesized
actgttccttttgccctgcaaa

SEQ ID NO: 1374426 - DNA, 22 bp, Artificial Sequence
  chemically synthesized
ttccttttgccctgcaaaagct

SEQ ID NO: 1374427 - DNA, 22 bp, Artificial Sequence
  chemically synthesized
atgaaactaaagagcttttgca

SEQ ID NO: 1374428 - DNA, 22 bp, Artificial Sequence
  chemically synthesized
cttttgccctgcaaaagctctt

SEQ ID NO: 1374429 - DNA, 22 bp, Artificial Sequence
  chemically synthesized
ttgccctgcaaaagctctttag

SEQ ID NO: 1374430 - DNA, 22 bp, Artificial Sequence
  chemically synthesized
tgccctgcaaaagctctttagt

SEQ ID NO: 1374431 - DNA, 22 bp, Artificial Sequence
  chemically synthesized
gggcctaatgaaactaaagagc

SEQ ID NO: 1374432 - DNA, 22 bp, Artificial Sequence
  chemically synthesized
gccctgcaaaagctctttagtt

SEQ ID NO: 1374433 - DNA, 22 bp, Artificial Sequence
  chemically synthesized
ccctgcaaaagctctttagttt

SEQ ID NO: 1374434 - DNA, 22 bp, Artificial Sequence
  chemically synthesized
caaaagctctttagtttcatta

SEQ ID NO: 1374435 - DNA, 22 bp, Artificial Sequence
  chemically synthesized
tttagtttcattaggccccagc

SEQ ID NO: 1374436 - DNA, 22 bp, Artificial Sequence
  chemically synthesized
tagtttcattaggccccagcta

SEQ ID NO: 1374437 - DNA, 22 bp, Artificial Sequence
  chemically synthesized
agtttcattaggccccagctat

SEQ ID NO: 1374438 - DNA, 22 bp, Artificial Sequence
  chemically synthesized
gtttcattaggccccagctatt

SEQ ID NO: 1374439 - DNA, 22 bp, Artificial Sequence
  chemically synthesized
cattaggccccagctatttatc

SEQ ID NO: 1374440 - DNA, 22 bp, Artificial Sequence
  chemically synthesized
attaggccccagctatttatct

SEQ ID NO: 1374441 - DNA, 22 bp, Artificial Sequence
  chemically synthesized
ggccccagctatttatctttgt

SEQ ID NO: 1374442 - DNA, 22 bp, Artificial Sequence
  chemically synthesized
tttatctttgtttttactgcat

SEQ ID NO: 1374443 - DNA, 22 bp, Artificial Sequence
  chemically synthesized
atctttgtttttactgcatttg

SEQ ID NO: 1374444 - DNA, 22 bp, Artificial Sequence
  chemically synthesized
tctttgtttttactgcatttgc

SEQ ID NO: 1374445 - DNA, 22 bp, Artificial Sequence
  chemically synthesized
tgtttttactgcatttgctttt

SEQ ID NO: 1374446 - DNA, 22 bp, Artificial Sequence
  chemically synthesized
gtttttactgcatttgcttttg

SEQ ID NO: 1374447 - DNA, 22 bp, Artificial Sequence
  chemically synthesized
tttttactgcatttgcttttgg

SEQ ID NO: 1374448 - DNA, 22 bp, Artificial Sequence
  chemically synthesized
atgaccaagaacccaaaagcaa

SEQ ID NO: 1374449 - DNA, 22 bp, Artificial Sequence
  chemically synthesized
catgaccaagaacccaaaagca

SEQ ID NO: 1374450 - DNA, 22 bp, Artificial Sequence
  chemically synthesized
ttactgcatttgcttttgggtt

SEQ ID NO: 1374451 - DNA, 22 bp, Artificial Sequence
  chemically synthesized
tactgcatttgcttttgggttc

SEQ ID NO: 1374452 - DNA, 22 bp, Artificial Sequence
  chemically synthesized
actgcatttgcttttgggttct

SEQ ID NO: 1374453 - DNA, 22 bp, Artificial Sequence
  chemically synthesized
ctgcatttgcttttgggttctt

SEQ ID NO: 1374454 - DNA, 22 bp, Artificial Sequence
  chemically synthesized
catttgcttttgggttcttggt

SEQ ID NO: 1374455 - DNA, 22 bp, Artificial Sequence
  chemically synthesized
ggcaaggatttcatgaccaaga

SEQ ID NO: 1374456 - DNA, 22 bp, Artificial Sequence
  chemically synthesized
aggcaaggatttcatgaccaag

SEQ ID NO: 1374457 - DNA, 22 bp, Artificial Sequence
  chemically synthesized
gcttttgggttcttggtcatga

SEQ ID NO: 1374458 - DNA, 22 bp, Artificial Sequence
  chemically synthesized
cttttgggttcttggtcatgaa

SEQ ID NO: 1374459 - DNA, 22 bp, Artificial Sequence
  chemically synthesized
gcttaggcaaggatttcatgac

SEQ ID NO: 1374460 - DNA, 22 bp, Artificial Sequence
  chemically synthesized
ttgggttcttggtcatgaaatc

SEQ ID NO: 1374461 - DNA, 22 bp, Artificial Sequence
  chemically synthesized
tgggttcttggtcatgaaatcc

SEQ ID NO: 1374462 - DNA, 22 bp, Artificial Sequence
  chemically synthesized
gggttcttggtcatgaaatcct

SEQ ID NO: 1374463 - DNA, 22 bp, Artificial Sequence
  chemically synthesized
ggttcttggtcatgaaatcctt

SEQ ID NO: 1374464 - DNA, 22 bp, Artificial Sequence
  chemically synthesized
gacattggcttaggcaaggatt

SEQ ID NO: 1374465 - DNA, 22 bp, Artificial Sequence
  chemically synthesized
ttggtcatgaaatccttgccta

SEQ ID NO: 1374466 - DNA, 22 bp, Artificial Sequence
  chemically synthesized
tagacattggcttaggcaagga

SEQ ID NO: 1374467 - DNA, 22 bp, Artificial Sequence
  chemically synthesized
ctagacattggcttaggcaagg

SEQ ID NO: 1374468 - DNA, 22 bp, Artificial Sequence
  chemically synthesized
ggtcatgaaatccttgcctaag

SEQ ID NO: 1374469 - DNA, 22 bp, Artificial Sequence
  chemically synthesized
gtcatgaaatccttgcctaagc

SEQ ID NO: 1374470 - DNA, 22 bp, Artificial Sequence
  chemically synthesized
gaaaaacccttctagacattgg

SEQ ID NO: 1374471 - DNA, 22 bp, Artificial Sequence
  chemically synthesized
gcctaagccaatgtctagaagg

SEQ ID NO: 1374472 - DNA, 22 bp, Artificial Sequence
  chemically synthesized
cctaagccaatgtctagaaggg

SEQ ID NO: 1374473 - DNA, 22 bp, Artificial Sequence
  chemically synthesized
agccaatgtctagaagggtttt

SEQ ID NO: 1374474 - DNA, 22 bp, Artificial Sequence
  chemically synthesized
gaagataacattggaaaaaccc

SEQ ID NO: 1374475 - DNA, 22 bp, Artificial Sequence
  chemically synthesized
tagaagataacattggaaaaac

SEQ ID NO: 1374476 - DNA, 22 bp, Artificial Sequence
  chemically synthesized
gaagggtttttccaatgttatc

SEQ ID NO: 1374477 - DNA, 22 bp, Artificial Sequence
  chemically synthesized
taaaaattctagaagataacat

SEQ ID NO: 1374478 - DNA, 22 bp, Artificial Sequence
  chemically synthesized
aaactataaaaattctagaaga

SEQ ID NO: 1374479 - DNA, 22 bp, Artificial Sequence
  chemically synthesized
ttccaatgttatcttctagaat

SEQ ID NO: 1374480 - DNA, 22 bp, Artificial Sequence
  chemically synthesized
tccaatgttatcttctagaatt

SEQ ID NO: 1374481 - DNA, 22 bp, Artificial Sequence
  chemically synthesized
ccaatgttatcttctagaattt

SEQ ID NO: 1374482 - DNA, 22 bp, Artificial Sequence
  chemically synthesized
caatgttatcttctagaatttt

SEQ ID NO: 1374483 - DNA, 22 bp, Artificial Sequence
  chemically synthesized
tcttctagaatttttatagttt

SEQ ID NO: 1374484 - DNA, 22 bp, Artificial Sequence
  chemically synthesized
ctagaatttttatagtttcagg

SEQ ID NO: 1374485 - DNA, 22 bp, Artificial Sequence
  chemically synthesized
tagaatttttatagtttcaggt

SEQ ID NO: 1374486 - DNA, 22 bp, Artificial Sequence
  chemically synthesized
gaatttttatagtttcaggtct

SEQ ID NO: 1374487 - DNA, 22 bp, Artificial Sequence
  chemically synthesized
aaaaagaaatccagacctgaaa

SEQ ID NO: 1374488 - DNA, 22 bp, Artificial Sequence
  chemically synthesized
tctgaaaaagaaatccagacct

SEQ ID NO: 1374489 - DNA, 22 bp, Artificial Sequence
  chemically synthesized
ttatagtttcaggtctggattt

SEQ ID NO: 1374490 - DNA, 22 bp, Artificial Sequence
  chemically synthesized
tatagtttcaggtctggatttc

SEQ ID NO: 1374491 - DNA, 22 bp, Artificial Sequence
  chemically synthesized
atagtttcaggtctggatttct

SEQ ID NO: 1374492 - DNA, 22 bp, Artificial Sequence
  chemically synthesized
tagtttcaggtctggatttctt

SEQ ID NO: 1374493 - DNA, 22 bp, Artificial Sequence
  chemically synthesized
caggtctggatttctttttcag

SEQ ID NO: 1374494 - DNA, 22 bp, Artificial Sequence
  chemically synthesized
aggtctggatttctttttcaga

SEQ ID NO: 1374495 - DNA, 22 bp, Artificial Sequence
  chemically synthesized
ccatagcaatctatctgaaaaa

SEQ ID NO: 1374496 - DNA, 22 bp, Artificial Sequence
  chemically synthesized
gatttctttttcagatagattg

SEQ ID NO: 1374497 - DNA, 22 bp, Artificial Sequence
  chemically synthesized
ctttttcagatagattgctatg

SEQ ID NO: 1374498 - DNA, 22 bp, Artificial Sequence
  chemically synthesized
tttttcagatagattgctatgg

SEQ ID NO: 1374499 - DNA, 22 bp, Artificial Sequence
  chemically synthesized
tttcagatagattgctatggga

SEQ ID NO: 1374500 - DNA, 22 bp, Artificial Sequence
  chemically synthesized
ttcagatagattgctatgggaa

SEQ ID NO: 1374501 - DNA, 22 bp, Artificial Sequence
  chemically synthesized
tcagatagattgctatgggaat

SEQ ID NO: 1374502 - DNA, 22 bp, Artificial Sequence
  chemically synthesized
cagatagattgctatgggaatg

SEQ ID NO: 1374503 - DNA, 22 bp, Artificial Sequence
  chemically synthesized
agatagattgctatgggaatgc

SEQ ID NO: 1374504 - DNA, 22 bp, Artificial Sequence
  chemically synthesized
ctatgggaatgctactgatatg

SEQ ID NO: 1374505 - DNA, 22 bp, Artificial Sequence
  chemically synthesized
tgggaatgctactgatatgttg

SEQ ID NO: 1374506 - DNA, 22 bp, Artificial Sequence
  chemically synthesized
caggatacaaaatcaacatatc

SEQ ID NO: 1374507 - DNA, 22 bp, Artificial Sequence
  chemically synthesized
ctgatatgttgattttgtatcc

SEQ ID NO: 1374508 - DNA, 22 bp, Artificial Sequence
  chemically synthesized
agtaaaattgcaggatacaaaa

SEQ ID NO: 1374509 - DNA, 22 bp, Artificial Sequence
  chemically synthesized
atatgttgattttgtatcctgc

SEQ ID NO: 1374510 - DNA, 22 bp, Artificial Sequence
  chemically synthesized
attttgtatcctgcaattttac

SEQ ID NO: 1374511 - DNA, 22 bp, Artificial Sequence
  chemically synthesized
tgtatcctgcaattttactgaa

SEQ ID NO: 1374512 - DNA, 22 bp, Artificial Sequence
  chemically synthesized
gtatcctgcaattttactgaat

SEQ ID NO: 1374513 - DNA, 22 bp, Artificial Sequence
  chemically synthesized
tatcctgcaattttactgaatt

SEQ ID NO: 1374514 - DNA, 22 bp, Artificial Sequence
  chemically synthesized
gaaataataaacaaattcagta

SEQ ID NO: 1374515 - DNA, 22 bp, Artificial Sequence
  chemically synthesized
ttagaaataataaacaaattca

SEQ ID NO: 1374516 - DNA, 22 bp, Artificial Sequence
  chemically synthesized
caattttactgaatttgtttat

SEQ ID NO: 1374517 - DNA, 22 bp, Artificial Sequence
  chemically synthesized
tactgaatttgtttattatttc

SEQ ID NO: 1374518 - DNA, 22 bp, Artificial Sequence
  chemically synthesized
actgaatttgtttattatttct

SEQ ID NO: 1374519 - DNA, 22 bp, Artificial Sequence
  chemically synthesized
ctgaatttgtttattatttcta

SEQ ID NO: 1374520 - DNA, 22 bp, Artificial Sequence
  chemically synthesized
caccaaaaactgttagaaataa

SEQ ID NO: 1374521 - DNA, 22 bp, Artificial Sequence
  chemically synthesized
aatttgtttattatttctaaca

SEQ ID NO: 1374522 - DNA, 22 bp, Artificial Sequence
  chemically synthesized
gtttattatttctaacagtttt

SEQ ID NO: 1374523 - DNA, 22 bp, Artificial Sequence
  chemically synthesized
tttattatttctaacagttttt

SEQ ID NO: 1374524 - DNA, 22 bp, Artificial Sequence
  chemically synthesized
attatttctaacagtttttggt

SEQ ID NO: 1374525 - DNA, 22 bp, Artificial Sequence
  chemically synthesized
ttatttctaacagtttttggtg

SEQ ID NO: 1374526 - DNA, 22 bp, Artificial Sequence
  chemically synthesized
gtgtaaaaaattccaccaaaaa

SEQ ID NO: 1374527 - DNA, 22 bp, Artificial Sequence
  chemically synthesized
tttctaacagtttttggtggaa

SEQ ID NO: 1374528 - DNA, 22 bp, Artificial Sequence
  chemically synthesized
actggtgtaaaaaattccacca

SEQ ID NO: 1374529 - DNA, 22 bp, Artificial Sequence
  chemically synthesized
ctaacagtttttggtggaattt

SEQ ID NO: 1374530 - DNA, 22 bp, Artificial Sequence
  chemically synthesized
gactggtgtaaaaaattccacc

SEQ ID NO: 1374531 - DNA, 22 bp, Artificial Sequence
  chemically synthesized
taacagtttttggtggaatttt

SEQ ID NO: 1374532 - DNA, 22 bp, Artificial Sequence
  chemically synthesized
tgactggtgtaaaaaattccac

SEQ ID NO: 1374533 - DNA, 22 bp, Artificial Sequence
  chemically synthesized
acagtttttggtggaatttttt

SEQ ID NO: 1374534 - DNA, 22 bp, Artificial Sequence
  chemically synthesized
ttggtggaattttttacaccag

SEQ ID NO: 1374535 - DNA, 22 bp, Artificial Sequence
  chemically synthesized
tggtggaattttttacaccagt

SEQ ID NO: 1374536 - DNA, 22 bp, Artificial Sequence
  chemically synthesized
ggtggaattttttacaccagtc

SEQ ID NO: 1374537 - DNA, 22 bp, Artificial Sequence
  chemically synthesized
gtggaattttttacaccagtca

SEQ ID NO: 1374538 - DNA, 22 bp, Artificial Sequence
  chemically synthesized
ataatagccattttgactggtg

SEQ ID NO: 1374539 - DNA, 22 bp, Artificial Sequence
  chemically synthesized
aataatagccattttgactggt

SEQ ID NO: 1374540 - DNA, 22 bp, Artificial Sequence
  chemically synthesized
taataatagccattttgactgg

SEQ ID NO: 1374541 - DNA, 22 bp, Artificial Sequence
  chemically synthesized
ttaataatagccattttgactg

SEQ ID NO: 1374542 - DNA, 22 bp, Artificial Sequence
  chemically synthesized
tttaataatagccattttgact

SEQ ID NO: 1374543 - DNA, 22 bp, Artificial Sequence
  chemically synthesized
ttttttaataatagccattttg

SEQ ID NO: 1374544 - DNA, 22 bp, Artificial Sequence
  chemically synthesized
tttacaccagtcaaaatggcta

SEQ ID NO: 1374545 - DNA, 22 bp, Artificial Sequence
  chemically synthesized
gttttttaataatagccatttt

SEQ ID NO: 1374546 - DNA, 22 bp, Artificial Sequence
  chemically synthesized
ttacaccagtcaaaatggctat

SEQ ID NO: 1374547 - DNA, 22 bp, Artificial Sequence
  chemically synthesized
tacaccagtcaaaatggctatt

SEQ ID NO: 1374548 - DNA, 22 bp, Artificial Sequence
  chemically synthesized
acaccagtcaaaatggctatta

SEQ ID NO: 1374549 - DNA, 22 bp, Artificial Sequence
  chemically synthesized
tttgttttttaataatagccat

SEQ ID NO: 1374550 - DNA, 22 bp, Artificial Sequence
  chemically synthesized
caccagtcaaaatggctattat

SEQ ID NO: 1374551 - DNA, 22 bp, Artificial Sequence
  chemically synthesized
atttgttttttaataatagcca

SEQ ID NO: 1374552 - DNA, 22 bp, Artificial Sequence
  chemically synthesized
tttatttgttttttaataatag

SEQ ID NO: 1374553 - DNA, 22 bp, Artificial Sequence
  chemically synthesized
gtttatttgttttttaataata

SEQ ID NO: 1374554 - DNA, 22 bp, Artificial Sequence
  chemically synthesized
tgtttatttgttttttaataat

SEQ ID NO: 1374555 - DNA, 22 bp, Artificial Sequence
  chemically synthesized
ttgtttatttgttttttaataa

SEQ ID NO: 1374556 - DNA, 22 bp, Artificial Sequence
  chemically synthesized
tttgtttatttgttttttaata

SEQ ID NO: 1374557 - DNA, 22 bp, Artificial Sequence
  chemically synthesized
ttttgtttatttgttttttaat

SEQ ID NO: 1374558 - DNA, 22 bp, Artificial Sequence
  chemically synthesized
ttattaaaaaacaaataaacaa

SEQ ID NO: 1374559 - DNA, 22 bp, Artificial Sequence
  chemically synthesized
ttaaaaaacaaataaacaaaaa

SEQ ID NO: 1374560 - DNA, 22 bp, Artificial Sequence
  chemically synthesized
aaaaacaaataaacaaaaaaat

SEQ ID NO: 1374561 - DNA, 22 bp, Artificial Sequence
  chemically synthesized
ccaacatgtggagatttttttg

SEQ ID NO: 1374562 - DNA, 22 bp, Artificial Sequence
  chemically synthesized
gccaacatgtggagattttttt

SEQ ID NO: 1374563 - DNA, 22 bp, Artificial Sequence
  chemically synthesized
catatccttgccaacatgtgga

SEQ ID NO: 1374564 - DNA, 22 bp, Artificial Sequence
  chemically synthesized
tccatatccttgccaacatgtg

SEQ ID NO: 1374565 - DNA, 22 bp, Artificial Sequence
  chemically synthesized
ctccatatccttgccaacatgt

SEQ ID NO: 1374566 - DNA, 22 bp, Artificial Sequence
  chemically synthesized
tctccatatccttgccaacatg

SEQ ID NO: 1374567 - DNA, 22 bp, Artificial Sequence
  chemically synthesized
ttctccatatccttgccaacat

SEQ ID NO: 1374568 - DNA, 22 bp, Artificial Sequence
  chemically synthesized
tcttttctccatatccttgcca

SEQ ID NO: 1374569 - DNA, 22 bp, Artificial Sequence
  chemically synthesized
cacatgttggcaaggatatgga

SEQ ID NO: 1374570 - DNA, 22 bp, Artificial Sequence
  chemically synthesized
agcattgtcttttctccatatc

SEQ ID NO: 1374571 - DNA, 22 bp, Artificial Sequence
  chemically synthesized
aagcattgtcttttctccatat

SEQ ID NO: 1374572 - DNA, 22 bp, Artificial Sequence
  chemically synthesized
gcaaggatatggagaaaagaca

SEQ ID NO: 1374573 - DNA, 22 bp, Artificial Sequence
  chemically synthesized
tcaccaaccgtatttaagcatt

SEQ ID NO: 1374574 - DNA, 22 bp, Artificial Sequence
  chemically synthesized
cattgtcaccaaccgtatttaa

SEQ ID NO: 1374575 - DNA, 22 bp, Artificial Sequence
  chemically synthesized
acattgtcaccaaccgtattta

SEQ ID NO: 1374576 - DNA, 22 bp, Artificial Sequence
  chemically synthesized
atttacattgtcaccaaccgta

SEQ ID NO: 1374577 - DNA, 22 bp, Artificial Sequence
  chemically synthesized
aaatacggttggtgacaatgta

SEQ ID NO: 1374578 - DNA, 22 bp, Artificial Sequence
  chemically synthesized
aatacggttggtgacaatgtaa

SEQ ID NO: 1374579 - DNA, 22 bp, Artificial Sequence
  chemically synthesized
atagatgtactaatttacattg

SEQ ID NO: 1374580 - DNA, 22 bp, Artificial Sequence
  chemically synthesized
catagatgtactaatttacatt

SEQ ID NO: 1374581 - DNA, 22 bp, Artificial Sequence
  chemically synthesized
tcatagatgtactaatttacat

SEQ ID NO: 1374582 - DNA, 22 bp, Artificial Sequence
  chemically synthesized
ttcatagatgtactaatttaca

SEQ ID NO: 1374583 - DNA, 22 bp, Artificial Sequence
  chemically synthesized
tttttcatagatgtactaattt

SEQ ID NO: 1374584 - DNA, 22 bp, Artificial Sequence
  chemically synthesized
gtgacaatgtaaattagtacat

SEQ ID NO: 1374585 - DNA, 22 bp, Artificial Sequence
  chemically synthesized
tatttttcatagatgtactaat

SEQ ID NO: 1374586 - DNA, 22 bp, Artificial Sequence
  chemically synthesized
cattctatttttcatagatgta

SEQ ID NO: 1374587 - DNA, 22 bp, Artificial Sequence
  chemically synthesized
gagaaatctccattctattttt

SEQ ID NO: 1374588 - DNA, 22 bp, Artificial Sequence
  chemically synthesized
gtacatctatgaaaaatagaat

SEQ ID NO: 1374589 - DNA, 22 bp, Artificial Sequence
  chemically synthesized
agagaaatctccattctatttt

SEQ ID NO: 1374590 - DNA, 22 bp, Artificial Sequence
  chemically synthesized
ttagagaaatctccattctatt

SEQ ID NO: 1374591 - DNA, 22 bp, Artificial Sequence
  chemically synthesized
attcttagagaaatctccattc

SEQ ID NO: 1374592 - DNA, 22 bp, Artificial Sequence
  chemically synthesized
aattcttagagaaatctccatt

SEQ ID NO: 1374593 - DNA, 22 bp, Artificial Sequence
  chemically synthesized
taattcttagagaaatctccat

SEQ ID NO: 1374594 - DNA, 22 bp, Artificial Sequence
  chemically synthesized
tgaaaaatagaatggagatttc

SEQ ID NO: 1374595 - DNA, 22 bp, Artificial Sequence
  chemically synthesized
ttaattcttagagaaatctcca

SEQ ID NO: 1374596 - DNA, 22 bp, Artificial Sequence
  chemically synthesized
tttttaattcttagagaaatct

SEQ ID NO: 1374597 - DNA, 22 bp, Artificial Sequence
  chemically synthesized
tatttttaattcttagagaaat

SEQ ID NO: 1374598 - DNA, 22 bp, Artificial Sequence
  chemically synthesized
ctctaagaattaaaaatagagc

SEQ ID NO: 1374599 - DNA, 22 bp, Artificial Sequence
  chemically synthesized
tatcaaatggtagctctatttt

SEQ ID NO: 1374600 - DNA, 22 bp, Artificial Sequence
  chemically synthesized
tctaagaattaaaaatagagct

SEQ ID NO: 1374601 - DNA, 22 bp, Artificial Sequence
  chemically synthesized
taagaattaaaaatagagctac

SEQ ID NO: 1374602 - DNA, 22 bp, Artificial Sequence
  chemically synthesized
agaattaaaaatagagctacca

SEQ ID NO: 1374603 - DNA, 22 bp, Artificial Sequence
  chemically synthesized
tgagaatactatatcaaatggt

SEQ ID NO: 1374604 - DNA, 22 bp, Artificial Sequence
  chemically synthesized
aaaatagagctaccatttgata

SEQ ID NO: 1374605 - DNA, 22 bp, Artificial Sequence
  chemically synthesized
ccatttgatatagtattctcac

SEQ ID NO: 1374606 - DNA, 22 bp, Artificial Sequence
  chemically synthesized
ggtagatacccagttgtgagaa

SEQ ID NO: 1374607 - DNA, 22 bp, Artificial Sequence
  chemically synthesized
gggtagatacccagttgtgaga

SEQ ID NO: 1374608 - DNA, 22 bp, Artificial Sequence
  chemically synthesized
gatatagtattctcacaactgg

SEQ ID NO: 1374609 - DNA, 22 bp, Artificial Sequence
  chemically synthesized
atatagtattctcacaactggg

SEQ ID NO: 1374610 - DNA, 22 bp, Artificial Sequence
  chemically synthesized
atttgggtagatacccagttgt

SEQ ID NO: 1374611 - DNA, 22 bp, Artificial Sequence
  chemically synthesized
catttgggtagatacccagttg

SEQ ID NO: 1374612 - DNA, 22 bp, Artificial Sequence
  chemically synthesized
tcatttgggtagatacccagtt

SEQ ID NO: 1374613 - DNA, 22 bp, Artificial Sequence
  chemically synthesized
ttcatttgggtagatacccagt

SEQ ID NO: 1374614 - DNA, 22 bp, Artificial Sequence
  chemically synthesized
ttttcatttgggtagataccca

SEQ ID NO: 1374615 - DNA, 22 bp, Artificial Sequence
  chemically synthesized
cttttcatttgggtagataccc

SEQ ID NO: 1374616 - DNA, 22 bp, Artificial Sequence
  chemically synthesized
tttcttttcatttgggtagata

SEQ ID NO: 1374617 - DNA, 22 bp, Artificial Sequence
  chemically synthesized
tcacaactgggtatctacccaa

SEQ ID NO: 1374618 - DNA, 22 bp, Artificial Sequence
  chemically synthesized
acaactgggtatctacccaaat

SEQ ID NO: 1374619 - DNA, 22 bp, Artificial Sequence
  chemically synthesized
atataattatttcttttcattt

SEQ ID NO: 1374620 - DNA, 22 bp, Artificial Sequence
  chemically synthesized
ggtatctacccaaatgaaaaga

SEQ ID NO: 1374621 - DNA, 22 bp, Artificial Sequence
  chemically synthesized
aatataattatttcttttcatt

SEQ ID NO: 1374622 - DNA, 22 bp, Artificial Sequence
  chemically synthesized
taatataattatttcttttcat

SEQ ID NO: 1374623 - DNA, 22 bp, Artificial Sequence
  chemically synthesized
ttaatataattatttcttttca

SEQ ID NO: 1374624 - DNA, 22 bp, Artificial Sequence
  chemically synthesized
tttaatataattatttcttttc

SEQ ID NO: 1374625 - DNA, 22 bp, Artificial Sequence
  chemically synthesized
cccaaatgaaaagaaataatta

SEQ ID NO: 1374626 - DNA, 22 bp, Artificial Sequence
  chemically synthesized
cagtaaacatatgagtgaggta

SEQ ID NO: 1374627 - DNA, 22 bp, Artificial Sequence
  chemically synthesized
tattaaaaagatacctcactca

SEQ ID NO: 1374628 - DNA, 22 bp, Artificial Sequence
  chemically synthesized
aaaagatacctcactcatatgt

SEQ ID NO: 1374629 - DNA, 22 bp, Artificial Sequence
  chemically synthesized
tgaatagtgctgcagtaaacat

SEQ ID NO: 1374630 - DNA, 22 bp, Artificial Sequence
  chemically synthesized
ttgtgaatagtgctgcagtaaa

SEQ ID NO: 1374631 - DNA, 22 bp, Artificial Sequence
  chemically synthesized
actcatatgtttactgcagcac

SEQ ID NO: 1374632 - DNA, 22 bp, Artificial Sequence
  chemically synthesized
ctattgtgaatagtgctgcagt

SEQ ID NO: 1374633 - DNA, 22 bp, Artificial Sequence
  chemically synthesized
gctattgtgaatagtgctgcag

SEQ ID NO: 1374634 - DNA, 22 bp, Artificial Sequence
  chemically synthesized
atatgtttactgcagcactatt

SEQ ID NO: 1374635 - DNA, 22 bp, Artificial Sequence
  chemically synthesized
tatatttgctattgtgaatagt

SEQ ID NO: 1374636 - DNA, 22 bp, Artificial Sequence
  chemically synthesized
tatatatttgctattgtgaata

SEQ ID NO: 1374637 - DNA, 22 bp, Artificial Sequence
  chemically synthesized
actgcagcactattcacaatag

SEQ ID NO: 1374638 - DNA, 22 bp, Artificial Sequence
  chemically synthesized
ctgcagcactattcacaatagc

SEQ ID NO: 1374639 - DNA, 22 bp, Artificial Sequence
  chemically synthesized
cagcactattcacaatagcaaa

SEQ ID NO: 1374640 - DNA, 22 bp, Artificial Sequence
  chemically synthesized
agtaaattctatatatttgcta

SEQ ID NO: 1374641 - DNA, 22 bp, Artificial Sequence
  chemically synthesized
aagtaaattctatatatttgct

SEQ ID NO: 1374642 - DNA, 22 bp, Artificial Sequence
  chemically synthesized
ttcacaatagcaaatatataga

SEQ ID NO: 1374643 - DNA, 22 bp, Artificial Sequence
  chemically synthesized
acaatagcaaatatatagaatt

SEQ ID NO: 1374644 - DNA, 22 bp, Artificial Sequence
  chemically synthesized
atccaatcaacttaagtaaatt

SEQ ID NO: 1374645 - DNA, 22 bp, Artificial Sequence
  chemically synthesized
ctcatccaatcaacttaagtaa

SEQ ID NO: 1374646 - DNA, 22 bp, Artificial Sequence
  chemically synthesized
cctcatccaatcaacttaagta

SEQ ID NO: 1374647 - DNA, 22 bp, Artificial Sequence
  chemically synthesized
tcctcatccaatcaacttaagt

SEQ ID NO: 1374648 - DNA, 22 bp, Artificial Sequence
  chemically synthesized
acttaagttgattggatgagga

SEQ ID NO: 1374649 - DNA, 22 bp, Artificial Sequence
  chemically synthesized
cttaagttgattggatgaggaa

SEQ ID NO: 1374650 - DNA, 22 bp, Artificial Sequence
  chemically synthesized
aagttgattggatgaggaaaat

SEQ ID NO: 1374651 - DNA, 22 bp, Artificial Sequence
  chemically synthesized
agttgattggatgaggaaaatg

SEQ ID NO: 1374652 - DNA, 22 bp, Artificial Sequence
  chemically synthesized
tgtatatataccacattttcct

SEQ ID NO: 1374653 - DNA, 22 bp, Artificial Sequence
  chemically synthesized
ttgtgtatatataccacatttt

SEQ ID NO: 1374654 - DNA, 22 bp, Artificial Sequence
  chemically synthesized
attggatgaggaaaatgtggta

SEQ ID NO: 1374655 - DNA, 22 bp, Artificial Sequence
  chemically synthesized
attgtgtatatataccacattt

SEQ ID NO: 1374656 - DNA, 22 bp, Artificial Sequence
  chemically synthesized
tattgtgtatatataccacatt

SEQ ID NO: 1374657 - DNA, 22 bp, Artificial Sequence
  chemically synthesized
gatgaggaaaatgtggtatata

SEQ ID NO: 1374658 - DNA, 22 bp, Artificial Sequence
  chemically synthesized
aataatgttttattgtgtatat

SEQ ID NO: 1374659 - DNA, 22 bp, Artificial Sequence
  chemically synthesized
tggctaaataatgttttattgt

SEQ ID NO: 1374660 - DNA, 22 bp, Artificial Sequence
  chemically synthesized
gtggctaaataatgttttattg

SEQ ID NO: 1374661 - DNA, 22 bp, Artificial Sequence
  chemically synthesized
tgtggctaaataatgttttatt

SEQ ID NO: 1374662 - DNA, 22 bp, Artificial Sequence
  chemically synthesized
ttgtggctaaataatgttttat

SEQ ID NO: 1374663 - DNA, 22 bp, Artificial Sequence
  chemically synthesized
cttttgtggctaaataatgttt

SEQ ID NO: 1374664 - DNA, 22 bp, Artificial Sequence
  chemically synthesized
ttccttttgtggctaaataatg

SEQ ID NO: 1374665 - DNA, 22 bp, Artificial Sequence
  chemically synthesized
attccttttgtggctaaataat

SEQ ID NO: 1374666 - DNA, 22 bp, Artificial Sequence
  chemically synthesized
tattccttttgtggctaaataa

SEQ ID NO: 1374667 - DNA, 22 bp, Artificial Sequence
  chemically synthesized
tttagccacaaaaggaataaaa

SEQ ID NO: 1374668 - DNA, 22 bp, Artificial Sequence
  chemically synthesized
caaaagacatgattttattcct

SEQ ID NO: 1374669 - DNA, 22 bp, Artificial Sequence
  chemically synthesized
agccacaaaaggaataaaatca

SEQ ID NO: 1374670 - DNA, 22 bp, Artificial Sequence
  chemically synthesized
ttgcaaaagacatgattttatt

SEQ ID NO: 1374671 - DNA, 22 bp, Artificial Sequence
  chemically synthesized
gccacaaaaggaataaaatcat

SEQ ID NO: 1374672 - DNA, 22 bp, Artificial Sequence
  chemically synthesized
catccatgttgttgcaaaagac

SEQ ID NO: 1374673 - DNA, 22 bp, Artificial Sequence
  chemically synthesized
cggttccatccatgttgttgca

SEQ ID NO: 1374674 - DNA, 22 bp, Artificial Sequence
  chemically synthesized
ttgcaacaacatggatggaacc

SEQ ID NO: 1374675 - DNA, 22 bp, Artificial Sequence
  chemically synthesized
tgcaacaacatggatggaaccg

SEQ ID NO: 1374676 - DNA, 22 bp, Artificial Sequence
  chemically synthesized
gcaacaacatggatggaaccgg

SEQ ID NO: 1374677 - DNA, 22 bp, Artificial Sequence
  chemically synthesized
agataatggcctccggttccat

SEQ ID NO: 1374678 - DNA, 22 bp, Artificial Sequence
  chemically synthesized
caacaacatggatggaaccgga

SEQ ID NO: 1374679 - DNA, 22 bp, Artificial Sequence
  chemically synthesized
aagataatggcctccggttcca

SEQ ID NO: 1374680 - DNA, 22 bp, Artificial Sequence
  chemically synthesized
acttaagataatggcctccggt

SEQ ID NO: 1374681 - DNA, 22 bp, Artificial Sequence
  chemically synthesized
cacttaagataatggcctccgg

SEQ ID NO: 1374682 - DNA, 22 bp, Artificial Sequence
  chemically synthesized
tttcacttaagataatggcctc

SEQ ID NO: 1374683 - DNA, 22 bp, Artificial Sequence
  chemically synthesized
aattgtttcacttaagataatg

SEQ ID NO: 1374684 - DNA, 22 bp, Artificial Sequence
  chemically synthesized
agtgtctgaattgtttcactta

SEQ ID NO: 1374685 - DNA, 22 bp, Artificial Sequence
  chemically synthesized
cagtgtctgaattgtttcactt

SEQ ID NO: 1374686 - DNA, 22 bp, Artificial Sequence
  chemically synthesized
tcagtgtctgaattgtttcact

SEQ ID NO: 1374687 - DNA, 22 bp, Artificial Sequence
  chemically synthesized
tctttcagtgtctgaattgttt

SEQ ID NO: 1374688 - DNA, 22 bp, Artificial Sequence
  chemically synthesized
gtctttcagtgtctgaattgtt

SEQ ID NO: 1374689 - DNA, 22 bp, Artificial Sequence
  chemically synthesized
tcttaagtgaaacaattcagac

SEQ ID NO: 1374690 - DNA, 22 bp, Artificial Sequence
  chemically synthesized
aagtgaaacaattcagacactg

SEQ ID NO: 1374691 - DNA, 22 bp, Artificial Sequence
  chemically synthesized
agtgaaacaattcagacactga

SEQ ID NO: 1374692 - DNA, 22 bp, Artificial Sequence
  chemically synthesized
agacactgaaagacaaatactg

SEQ ID NO: 1374693 - DNA, 22 bp, Artificial Sequence
  chemically synthesized
aaagacaaatactgcatgttct

SEQ ID NO: 1374694 - DNA, 22 bp, Artificial Sequence
  chemically synthesized
ccacatgtaagtgagaacatgc

SEQ ID NO: 1374695 - DNA, 22 bp, Artificial Sequence
  chemically synthesized
ctcccacatgtaagtgagaaca

SEQ ID NO: 1374696 - DNA, 22 bp, Artificial Sequence
  chemically synthesized
gctcccacatgtaagtgagaac

SEQ ID NO: 1374697 - DNA, 22 bp, Artificial Sequence
  chemically synthesized
tgctcccacatgtaagtgagaa

SEQ ID NO: 1374698 - DNA, 22 bp, Artificial Sequence
  chemically synthesized
ttttgctcccacatgtaagtga

SEQ ID NO: 1374699 - DNA, 22 bp, Artificial Sequence
  chemically synthesized
catgttctcacttacatgtggg

SEQ ID NO: 1374700 - DNA, 22 bp, Artificial Sequence
  chemically synthesized
tcacttacatgtgggagcaaaa

SEQ ID NO: 1374701 - DNA, 22 bp, Artificial Sequence
  chemically synthesized
acttacatgtgggagcaaaata

SEQ ID NO: 1374702 - DNA, 22 bp, Artificial Sequence
  chemically synthesized
aaatgtacacattattttgctc

SEQ ID NO: 1374703 - DNA, 22 bp, Artificial Sequence
  chemically synthesized
caaatgtacacattattttgct

SEQ ID NO: 1374704 - DNA, 22 bp, Artificial Sequence
  chemically synthesized
tcaaatgtacacattattttgc

SEQ ID NO: 1374705 - DNA, 22 bp, Artificial Sequence
  chemically synthesized
acatgtgggagcaaaataatgt

SEQ ID NO: 1374706 - DNA, 22 bp, Artificial Sequence
  chemically synthesized
catgtgggagcaaaataatgtg

SEQ ID NO: 1374707 - DNA, 22 bp, Artificial Sequence
  chemically synthesized
ctttcaaatgtacacattattt

SEQ ID NO: 1374708 - DNA, 22 bp, Artificial Sequence
  chemically synthesized
tactttcaaatgtacacattat

SEQ ID NO: 1374709 - DNA, 22 bp, Artificial Sequence
  chemically synthesized
cacactctactttcaaatgtac

SEQ ID NO: 1374710 - DNA, 22 bp, Artificial Sequence
  chemically synthesized
tcaatcattccacactctactt

SEQ ID NO: 1374711 - DNA, 22 bp, Artificial Sequence
  chemically synthesized
cccattgtcaatcattccacac

SEQ ID NO: 1374712 - DNA, 22 bp, Artificial Sequence
  chemically synthesized
gaaagtagagtgtggaatgatt

SEQ ID NO: 1374713 - DNA, 22 bp, Artificial Sequence
  chemically synthesized
aaagtagagtgtggaatgattg

SEQ ID NO: 1374714 - DNA, 22 bp, Artificial Sequence
  chemically synthesized
attccccattgtcaatcattcc

SEQ ID NO: 1374715 - DNA, 22 bp, Artificial Sequence
  chemically synthesized
tgattccccattgtcaatcatt

SEQ ID NO: 1374716 - DNA, 22 bp, Artificial Sequence
  chemically synthesized
ctgattccccattgtcaatcat

SEQ ID NO: 1374717 - DNA, 22 bp, Artificial Sequence
  chemically synthesized
cacccttctgattccccattgt

SEQ ID NO: 1374718 - DNA, 22 bp, Artificial Sequence
  chemically synthesized
ccatgcctccacccttctgatt

SEQ ID NO: 1374719 - DNA, 22 bp, Artificial Sequence
  chemically synthesized
acaatggggaatcagaagggtg

SEQ ID NO: 1374720 - DNA, 22 bp, Artificial Sequence
  chemically synthesized
atcatacaaccccctcccatgc

SEQ ID NO: 1374721 - DNA, 22 bp, Artificial Sequence
  chemically synthesized
tcatcatacaaccccctcccat

SEQ ID NO: 1374722 - DNA, 22 bp, Artificial Sequence
  chemically synthesized
ctcatcatacaaccccctccca

SEQ ID NO: 1374723 - DNA, 22 bp, Artificial Sequence
  chemically synthesized
agtaatttctcatcatacaacc

SEQ ID NO: 1374724 - DNA, 22 bp, Artificial Sequence
  chemically synthesized
tacacattaagtaatttctcat

SEQ ID NO: 1374725 - DNA, 22 bp, Artificial Sequence
  chemically synthesized
tatgatgagaaattacttaatg

SEQ ID NO: 1374726 - DNA, 22 bp, Artificial Sequence
  chemically synthesized
aataatatgcattgtacacatt

SEQ ID NO: 1374727 - DNA, 22 bp, Artificial Sequence
  chemically synthesized
atcacctgaataatatgcattg

SEQ ID NO: 1374728 - DNA, 22 bp, Artificial Sequence
  chemically synthesized
cttaatgtgtacaatgcatatt

SEQ ID NO: 1374729 - DNA, 22 bp, Artificial Sequence
  chemically synthesized
aatgtgtacaatgcatattatt

SEQ ID NO: 1374730 - DNA, 22 bp, Artificial Sequence
  chemically synthesized
atgtgtacaatgcatattattc

SEQ ID NO: 1374731 - DNA, 22 bp, Artificial Sequence
  chemically synthesized
gggcattcatcacctgaataat

SEQ ID NO: 1374732 - DNA, 22 bp, Artificial Sequence
  chemically synthesized
agggcattcatcacctgaataa

SEQ ID NO: 1374733 - DNA, 22 bp, Artificial Sequence
  chemically synthesized
tagggcattcatcacctgaata

SEQ ID NO: 1374734 - DNA, 22 bp, Artificial Sequence
  chemically synthesized
ttttagggcattcatcacctga

SEQ ID NO: 1374735 - DNA, 22 bp, Artificial Sequence
  chemically synthesized
attttagggcattcatcacctg

SEQ ID NO: 1374736 - DNA, 22 bp, Artificial Sequence
  chemically synthesized
tattttagggcattcatcacct

SEQ ID NO: 1374737 - DNA, 22 bp, Artificial Sequence
  chemically synthesized
ttcaggtgatgaatgccctaaa

SEQ ID NO: 1374738 - DNA, 22 bp, Artificial Sequence
  chemically synthesized
aggtgatgaatgccctaaaata

SEQ ID NO: 1374739 - DNA, 22 bp, Artificial Sequence
  chemically synthesized
aggaatacaagtgtaattttat

SEQ ID NO: 1374740 - DNA, 22 bp, Artificial Sequence
  chemically synthesized
aaggaatacaagtgtaatttta

SEQ ID NO: 1374741 - DNA, 22 bp, Artificial Sequence
  chemically synthesized
aaataaaattacacttgtattc

SEQ ID NO: 1374742 - DNA, 22 bp, Artificial Sequence
  chemically synthesized
tatatatttaaggaatacaagt

SEQ ID NO: 1374743 - DNA, 22 bp, Artificial Sequence
  chemically synthesized
gtatatatttaaggaatacaag

SEQ ID NO: 1374744 - DNA, 22 bp, Artificial Sequence
  chemically synthesized
tttgtatatatttaaggaatac

SEQ ID NO: 1374745 - DNA, 22 bp, Artificial Sequence
  chemically synthesized
cacttgtattccttaaatatat

SEQ ID NO: 1374746 - DNA, 22 bp, Artificial Sequence
  chemically synthesized
aaaatgttatttgtatatattt

SEQ ID NO: 1374747 - DNA, 22 bp, Artificial Sequence
  chemically synthesized
aaaaatgttatttgtatatatt

SEQ ID NO: 1374748 - DNA, 22 bp, Artificial Sequence
  chemically synthesized
taaaaatgttatttgtatatat

SEQ ID NO: 1374749 - DNA, 22 bp, Artificial Sequence
  chemically synthesized
gtattccttaaatatatacaaa

SEQ ID NO: 1374750 - DNA, 22 bp, Artificial Sequence
  chemically synthesized
ttaaaaatgttatttgtatata

SEQ ID NO: 1374751 - DNA, 22 bp, Artificial Sequence
  chemically synthesized
tattccttaaatatatacaaat

SEQ ID NO: 1374752 - DNA, 22 bp, Artificial Sequence
  chemically synthesized
tttttaaaaatgttatttgtat

SEQ ID NO: 1374753 - DNA, 22 bp, Artificial Sequence
  chemically synthesized
atttttaaaaatgttatttgta

SEQ ID NO: 1374754 - DNA, 22 bp, Artificial Sequence
  chemically synthesized
tatttttaaaaatgttatttgt

SEQ ID NO: 1374755 - DNA, 22 bp, Artificial Sequence
  chemically synthesized
cttaaatatatacaaataacat

SEQ ID NO: 1374756 - DNA, 22 bp, Artificial Sequence
  chemically synthesized
ttatttttaaaaatgttatttg

SEQ ID NO: 1374757 - DNA, 22 bp, Artificial Sequence
  chemically synthesized
aaatatatacaaataacatttt

SEQ ID NO: 1374758 - DNA, 22 bp, Artificial Sequence
  chemically synthesized
tttttatttttaaaaatgttat

SEQ ID NO: 1374759 - DNA, 22 bp, Artificial Sequence
  chemically synthesized
aatatatacaaataacattttt

SEQ ID NO: 1374760 - DNA, 22 bp, Artificial Sequence
  chemically synthesized
tagaacccctatttttattttt

SEQ ID NO: 1374761 - DNA, 22 bp, Artificial Sequence
  chemically synthesized
ttaaaaataaaaataggggttc

SEQ ID NO: 1374762 - DNA, 22 bp, Artificial Sequence
  chemically synthesized
taaaaataaaaataggggttct

SEQ ID NO: 1374763 - DNA, 22 bp, Artificial Sequence
  chemically synthesized
aaaaataaaaataggggttcta

SEQ ID NO: 1374764 - DNA, 22 bp, Artificial Sequence
  chemically synthesized
aaaataaaaataggggttctat

SEQ ID NO: 1374765 - DNA, 22 bp, Artificial Sequence
  chemically synthesized
tgtgccgatgacataatgttat

SEQ ID NO: 1374766 - DNA, 22 bp, Artificial Sequence
  chemically synthesized
tccctgtgtgccgatgacataa

SEQ ID NO: 1374767 - DNA, 22 bp, Artificial Sequence
  chemically synthesized
tataacattatgtcatcggcac

SEQ ID NO: 1374768 - DNA, 22 bp, Artificial Sequence
  chemically synthesized
agttatccctgtgtgccgatga

SEQ ID NO: 1374769 - DNA, 22 bp, Artificial Sequence
  chemically synthesized
taacattatgtcatcggcacac

SEQ ID NO: 1374770 - DNA, 22 bp, Artificial Sequence
  chemically synthesized
tgtcatcggcacacagggataa

SEQ ID NO: 1374771 - DNA, 22 bp, Artificial Sequence
  chemically synthesized
aacttctttttttcctatttgg

SEQ ID NO: 1374772 - DNA, 22 bp, Artificial Sequence
  chemically synthesized
acttctttttttcctatttgga

SEQ ID NO: 1374773 - DNA, 22 bp, Artificial Sequence
  chemically synthesized
ctttttttcctatttggatgcc

SEQ ID NO: 1374774 - DNA, 22 bp, Artificial Sequence
  chemically synthesized
tttttttcctatttggatgcct

SEQ ID NO: 1374775 - DNA, 22 bp, Artificial Sequence
  chemically synthesized
tttttcctatttggatgccttt

SEQ ID NO: 1374776 - DNA, 22 bp, Artificial Sequence
  chemically synthesized
ttttcctatttggatgcctttt

SEQ ID NO: 1374777 - DNA, 22 bp, Artificial Sequence
  chemically synthesized
tttcctatttggatgccttttg

SEQ ID NO: 1374778 - DNA, 22 bp, Artificial Sequence
  chemically synthesized
ttcctatttggatgccttttgt

SEQ ID NO: 1374779 - DNA, 22 bp, Artificial Sequence
  chemically synthesized
tcctatttggatgccttttgtt

SEQ ID NO: 1374780 - DNA, 22 bp, Artificial Sequence
  chemically synthesized
cctatttggatgccttttgttt

SEQ ID NO: 1374781 - DNA, 22 bp, Artificial Sequence
  chemically synthesized
ggcaagaagaataaacaaaagg

SEQ ID NO: 1374782 - DNA, 22 bp, Artificial Sequence
  chemically synthesized
ctatttggatgccttttgttta

SEQ ID NO: 1374783 - DNA, 22 bp, Artificial Sequence
  chemically synthesized
tttggatgccttttgtttattc

SEQ ID NO: 1374784 - DNA, 22 bp, Artificial Sequence
  chemically synthesized
ggatgccttttgtttattcttc

SEQ ID NO: 1374785 - DNA, 22 bp, Artificial Sequence
  chemically synthesized
gatgccttttgtttattcttct

SEQ ID NO: 1374786 - DNA, 22 bp, Artificial Sequence
  chemically synthesized
gaagtaattaggcaagaagaat

SEQ ID NO: 1374787 - DNA, 22 bp, Artificial Sequence
  chemically synthesized
ttgtttattcttcttgcctaat

SEQ ID NO: 1374788 - DNA, 22 bp, Artificial Sequence
  chemically synthesized
tgtttattcttcttgcctaatt

SEQ ID NO: 1374789 - DNA, 22 bp, Artificial Sequence
  chemically synthesized
gtttattcttcttgcctaatta

SEQ ID NO: 1374790 - DNA, 22 bp, Artificial Sequence
  chemically synthesized
tttattcttcttgcctaattac

SEQ ID NO: 1374791 - DNA, 22 bp, Artificial Sequence
  chemically synthesized
attcttcttgcctaattacttc

SEQ ID NO: 1374792 - DNA, 22 bp, Artificial Sequence
  chemically synthesized
aacacagtcctggaagtaatta

SEQ ID NO: 1374793 - DNA, 22 bp, Artificial Sequence
  chemically synthesized
ttcttcttgcctaattacttcc

SEQ ID NO: 1374794 - DNA, 22 bp, Artificial Sequence
  chemically synthesized
ttcaacacagtcctggaagtaa

SEQ ID NO: 1374795 - DNA, 22 bp, Artificial Sequence
  chemically synthesized
ttcttgcctaattacttccagg

SEQ ID NO: 1374796 - DNA, 22 bp, Artificial Sequence
  chemically synthesized
tattcaacacagtcctggaagt

SEQ ID NO: 1374797 - DNA, 22 bp, Artificial Sequence
  chemically synthesized
cttgcctaattacttccaggac

SEQ ID NO: 1374798 - DNA, 22 bp, Artificial Sequence
  chemically synthesized
ctattcaacacagtcctggaag

SEQ ID NO: 1374799 - DNA, 22 bp, Artificial Sequence
  chemically synthesized
ttgcctaattacttccaggact

SEQ ID NO: 1374800 - DNA, 22 bp, Artificial Sequence
  chemically synthesized
gcctaattacttccaggactgt

SEQ ID NO: 1374801 - DNA, 22 bp, Artificial Sequence
  chemically synthesized
cctaattacttccaggactgtg

SEQ ID NO: 1374802 - DNA, 22 bp, Artificial Sequence
  chemically synthesized
cacttctattcaacacagtcct

SEQ ID NO: 1374803 - DNA, 22 bp, Artificial Sequence
  chemically synthesized
attacttccaggactgtgttga

SEQ ID NO: 1374804 - DNA, 22 bp, Artificial Sequence
  chemically synthesized
tctccacttctattcaacacag

SEQ ID NO: 1374805 - DNA, 22 bp, Artificial Sequence
  chemically synthesized
cttccaggactgtgttgaatag

SEQ ID NO: 1374806 - DNA, 22 bp, Artificial Sequence
  chemically synthesized
actgtctccacttctattcaac

SEQ ID NO: 1374807 - DNA, 22 bp, Artificial Sequence
  chemically synthesized
ccaggactgtgttgaatagaag

SEQ ID NO: 1374808 - DNA, 22 bp, Artificial Sequence
  chemically synthesized
caggactgtgttgaatagaagt

SEQ ID NO: 1374809 - DNA, 22 bp, Artificial Sequence
  chemically synthesized
tgttgaatagaagtggagacag

SEQ ID NO: 1374810 - DNA, 22 bp, Artificial Sequence
  chemically synthesized
aatagaagtggagacagtgagt

SEQ ID NO: 1374811 - DNA, 22 bp, Artificial Sequence
  chemically synthesized
gcacaagacgaggatactcact

SEQ ID NO: 1374812 - DNA, 22 bp, Artificial Sequence
  chemically synthesized
agatctggcacaagacgaggat

SEQ ID NO: 1374813 - DNA, 22 bp, Artificial Sequence
  chemically synthesized
taagatctggcacaagacgagg

SEQ ID NO: 1374814 - DNA, 22 bp, Artificial Sequence
  chemically synthesized
ctctaagatctggcacaagacg

SEQ ID NO: 1374815 - DNA, 22 bp, Artificial Sequence
  chemically synthesized
cctctaagatctggcacaagac

SEQ ID NO: 1374816 - DNA, 22 bp, Artificial Sequence
  chemically synthesized
tcctctaagatctggcacaaga

SEQ ID NO: 1374817 - DNA, 22 bp, Artificial Sequence
  chemically synthesized
ttcctctaagatctggcacaag

SEQ ID NO: 1374818 - DNA, 22 bp, Artificial Sequence
  chemically synthesized
aaagcttttcctctaagatctg

SEQ ID NO: 1374819 - DNA, 22 bp, Artificial Sequence
  chemically synthesized
gtcttgtgccagatcttagagg

SEQ ID NO: 1374820 - DNA, 22 bp, Artificial Sequence
  chemically synthesized
gtgccagatcttagaggaaaag

SEQ ID NO: 1374821 - DNA, 22 bp, Artificial Sequence
  chemically synthesized
tgccagatcttagaggaaaagc

SEQ ID NO: 1374822 - DNA, 22 bp, Artificial Sequence
  chemically synthesized
gatggggaaaagttgaaagctt

SEQ ID NO: 1374823 - DNA, 22 bp, Artificial Sequence
  chemically synthesized
agaggaaaagctttcaactttt

SEQ ID NO: 1374824 - DNA, 22 bp, Artificial Sequence
  chemically synthesized
tactggatggggaaaagttgaa

SEQ ID NO: 1374825 - DNA, 22 bp, Artificial Sequence
  chemically synthesized
gaggaaaagctttcaacttttc

SEQ ID NO: 1374826 - DNA, 22 bp, Artificial Sequence
  chemically synthesized
tcaacttttccccatccagtat

SEQ ID NO: 1374827 - DNA, 22 bp, Artificial Sequence
  chemically synthesized
caacttttccccatccagtata

SEQ ID NO: 1374828 - DNA, 22 bp, Artificial Sequence
  chemically synthesized
aacttttccccatccagtataa

SEQ ID NO: 1374829 - DNA, 22 bp, Artificial Sequence
  chemically synthesized
aataaagcaagaattatactgg

SEQ ID NO: 1374830 - DNA, 22 bp, Artificial Sequence
  chemically synthesized
caataaagcaagaattatactg

SEQ ID NO: 1374831 - DNA, 22 bp, Artificial Sequence
  chemically synthesized
ttcaataaagcaagaattatac

SEQ ID NO: 1374832 - DNA, 22 bp, Artificial Sequence
  chemically synthesized
ttccccatccagtataattctt

SEQ ID NO: 1374833 - DNA, 22 bp, Artificial Sequence
  chemically synthesized
cttcaataaagcaagaattata

SEQ ID NO: 1374834 - DNA, 22 bp, Artificial Sequence
  chemically synthesized
tccccatccagtataattcttg

SEQ ID NO: 1374835 - DNA, 22 bp, Artificial Sequence
  chemically synthesized
tcttcaataaagcaagaattat

SEQ ID NO: 1374836 - DNA, 22 bp, Artificial Sequence
  chemically synthesized
ccccatccagtataattcttgc

SEQ ID NO: 1374837 - DNA, 22 bp, Artificial Sequence
  chemically synthesized
cccatccagtataattcttgct

SEQ ID NO: 1374838 - DNA, 22 bp, Artificial Sequence
  chemically synthesized
acagaagtatggcattttcttc

SEQ ID NO: 1374839 - DNA, 22 bp, Artificial Sequence
  chemically synthesized
ttgctttattgaagaaaatgcc

SEQ ID NO: 1374840 - DNA, 22 bp, Artificial Sequence
  chemically synthesized
gctttattgaagaaaatgccat

SEQ ID NO: 1374841 - DNA, 22 bp, Artificial Sequence
  chemically synthesized
ctttattgaagaaaatgccata

SEQ ID NO: 1374842 - DNA, 22 bp, Artificial Sequence
  chemically synthesized
tattgaagaaaatgccatactt

SEQ ID NO: 1374843 - DNA, 22 bp, Artificial Sequence
  chemically synthesized
attgaagaaaatgccatacttc

SEQ ID NO: 1374844 - DNA, 22 bp, Artificial Sequence
  chemically synthesized
ttgaagaaaatgccatacttct

SEQ ID NO: 1374845 - DNA, 22 bp, Artificial Sequence
  chemically synthesized
taccagtggttgacagaagtat

SEQ ID NO: 1374846 - DNA, 22 bp, Artificial Sequence
  chemically synthesized
aagaaaatgccatacttctgtc

SEQ ID NO: 1374847 - DNA, 22 bp, Artificial Sequence
  chemically synthesized
tctataccagtggttgacagaa

SEQ ID NO: 1374848 - DNA, 22 bp, Artificial Sequence
  chemically synthesized
tataatcagctgtctataccag

SEQ ID NO: 1374849 - DNA, 22 bp, Artificial Sequence
  chemically synthesized
atataatcagctgtctatacca

SEQ ID NO: 1374850 - DNA, 22 bp, Artificial Sequence
  chemically synthesized
ctgtcaaccactggtatagaca

SEQ ID NO: 1374851 - DNA, 22 bp, Artificial Sequence
  chemically synthesized
tgtcaaccactggtatagacag

SEQ ID NO: 1374852 - DNA, 22 bp, Artificial Sequence
  chemically synthesized
tcaaccactggtatagacagct

SEQ ID NO: 1374853 - DNA, 22 bp, Artificial Sequence
  chemically synthesized
gtatagacagctgattatataa

SEQ ID NO: 1374854 - DNA, 22 bp, Artificial Sequence
  chemically synthesized
ataagatccaacttatataatc

SEQ ID NO: 1374855 - DNA, 22 bp, Artificial Sequence
  chemically synthesized
ttaataagatccaacttatata

SEQ ID NO: 1374856 - DNA, 22 bp, Artificial Sequence
  chemically synthesized
attaataagatccaacttatat

SEQ ID NO: 1374857 - DNA, 22 bp, Artificial Sequence
  chemically synthesized
acttattaataagatccaactt

SEQ ID NO: 1374858 - DNA, 22 bp, Artificial Sequence
  chemically synthesized
tcacttattaataagatccaac

SEQ ID NO: 1374859 - DNA, 22 bp, Artificial Sequence
  chemically synthesized
ctcacttattaataagatccaa

SEQ ID NO: 1374860 - DNA, 22 bp, Artificial Sequence
  chemically synthesized
tctcacttattaataagatcca

SEQ ID NO: 1374861 - DNA, 22 bp, Artificial Sequence
  chemically synthesized
attatataagttggatcttatt

SEQ ID NO: 1374862 - DNA, 22 bp, Artificial Sequence
  chemically synthesized
actttctcacttattaataaga

SEQ ID NO: 1374863 - DNA, 22 bp, Artificial Sequence
  chemically synthesized
tataagttggatcttattaata

SEQ ID NO: 1374864 - DNA, 22 bp, Artificial Sequence
  chemically synthesized
ctgactttctcacttattaata

SEQ ID NO: 1374865 - DNA, 22 bp, Artificial Sequence
  chemically synthesized
gctgactttctcacttattaat

SEQ ID NO: 1374866 - DNA, 22 bp, Artificial Sequence
  chemically synthesized
tgctgactttctcacttattaa

SEQ ID NO: 1374867 - DNA, 22 bp, Artificial Sequence
  chemically synthesized
attttgctgactttctcactta

SEQ ID NO: 1374868 - DNA, 22 bp, Artificial Sequence
  chemically synthesized
gatcttattaataagtgagaaa

SEQ ID NO: 1374869 - DNA, 22 bp, Artificial Sequence
  chemically synthesized
aattttgctgactttctcactt

SEQ ID NO: 1374870 - DNA, 22 bp, Artificial Sequence
  chemically synthesized
taattttgctgactttctcact

SEQ ID NO: 1374871 - DNA, 22 bp, Artificial Sequence
  chemically synthesized
attaataagtgagaaagtcagc

SEQ ID NO: 1374872 - DNA, 22 bp, Artificial Sequence
  chemically synthesized
ttaataagtgagaaagtcagca

SEQ ID NO: 1374873 - DNA, 22 bp, Artificial Sequence
  chemically synthesized
ataagtgagaaagtcagcaaaa

SEQ ID NO: 1374874 - DNA, 22 bp, Artificial Sequence
  chemically synthesized
tataaaaagcagcaacacttta

SEQ ID NO: 1374875 - DNA, 22 bp, Artificial Sequence
  chemically synthesized
aaattatataaaaagcagcaac

SEQ ID NO: 1374876 - DNA, 22 bp, Artificial Sequence
  chemically synthesized
aaaattatataaaaagcagcaa

SEQ ID NO: 1374877 - DNA, 22 bp, Artificial Sequence
  chemically synthesized
taaaattatataaaaagcagca

SEQ ID NO: 1374878 - DNA, 22 bp, Artificial Sequence
  chemically synthesized
aagtgttgctgctttttatata

SEQ ID NO: 1374879 - DNA, 22 bp, Artificial Sequence
  chemically synthesized
ggaatcctttaaaattatataa

SEQ ID NO: 1374880 - DNA, 22 bp, Artificial Sequence
  chemically synthesized
cggaatcctttaaaattatata

SEQ ID NO: 1374881 - DNA, 22 bp, Artificial Sequence
  chemically synthesized
tcggaatcctttaaaattatat

SEQ ID NO: 1374882 - DNA, 22 bp, Artificial Sequence
  chemically synthesized
ctgctttttatataattttaaa

SEQ ID NO: 1374883 - DNA, 22 bp, Artificial Sequence
  chemically synthesized
ttttcggaatcctttaaaatta

SEQ ID NO: 1374884 - DNA, 22 bp, Artificial Sequence
  chemically synthesized
ctttttatataattttaaagga

SEQ ID NO: 1374885 - DNA, 22 bp, Artificial Sequence
  chemically synthesized
tttatataattttaaaggattc

SEQ ID NO: 1374886 - DNA, 22 bp, Artificial Sequence
  chemically synthesized
ttatataattttaaaggattcc

SEQ ID NO: 1374887 - DNA, 22 bp, Artificial Sequence
  chemically synthesized
tatataattttaaaggattccg

SEQ ID NO: 1374888 - DNA, 22 bp, Artificial Sequence
  chemically synthesized
atataattttaaaggattccga

SEQ ID NO: 1374889 - DNA, 22 bp, Artificial Sequence
  chemically synthesized
tataattttaaaggattccgaa

SEQ ID NO: 1374890 - DNA, 22 bp, Artificial Sequence
  chemically synthesized
tcgtaatcatattgttttcgga

SEQ ID NO: 1374891 - DNA, 22 bp, Artificial Sequence
  chemically synthesized
atcgtaatcatattgttttcgg

SEQ ID NO: 1374892 - DNA, 22 bp, Artificial Sequence
  chemically synthesized
tatcgtaatcatattgttttcg

SEQ ID NO: 1374893 - DNA, 22 bp, Artificial Sequence
  chemically synthesized
taaaggattccgaaaacaatat

SEQ ID NO: 1374894 - DNA, 22 bp, Artificial Sequence
  chemically synthesized
aaaggattccgaaaacaatatg

SEQ ID NO: 1374895 - DNA, 22 bp, Artificial Sequence
  chemically synthesized
aaggattccgaaaacaatatga

SEQ ID NO: 1374896 - DNA, 22 bp, Artificial Sequence
  chemically synthesized
agattttatcgtaatcatattg

SEQ ID NO: 1374897 - DNA, 22 bp, Artificial Sequence
  chemically synthesized
cagattttatcgtaatcatatt

SEQ ID NO: 1374898 - DNA, 22 bp, Artificial Sequence
  chemically synthesized
tcagattttatcgtaatcatat

SEQ ID NO: 1374899 - DNA, 22 bp, Artificial Sequence
  chemically synthesized
ttcagattttatcgtaatcata

SEQ ID NO: 1374900 - DNA, 22 bp, Artificial Sequence
  chemically synthesized
tttcagattttatcgtaatcat

SEQ ID NO: 1374901 - DNA, 22 bp, Artificial Sequence
  chemically synthesized
ttttcagattttatcgtaatca

SEQ ID NO: 1374902 - DNA, 22 bp, Artificial Sequence
  chemically synthesized
cgaaaacaatatgattacgata

SEQ ID NO: 1374903 - DNA, 22 bp, Artificial Sequence
  chemically synthesized
cttttttcagattttatcgtaa

SEQ ID NO: 1374904 - DNA, 22 bp, Artificial Sequence
  chemically synthesized
acttttttcagattttatcgta

SEQ ID NO: 1374905 - DNA, 22 bp, Artificial Sequence
  chemically synthesized
cgataaaatctgaaaaaagtaa

SEQ ID NO: 1374906 - DNA, 22 bp, Artificial Sequence
  chemically synthesized
gtatagatatccatttactttt

SEQ ID NO: 1374907 - DNA, 22 bp, Artificial Sequence
  chemically synthesized
agcaaactggtatagatatcca

SEQ ID NO: 1374908 - DNA, 22 bp, Artificial Sequence
  chemically synthesized
aaaaaagtaaatggatatctat

SEQ ID NO: 1374909 - DNA, 22 bp, Artificial Sequence
  chemically synthesized
tgagcaaactggtatagatatc

SEQ ID NO: 1374910 - DNA, 22 bp, Artificial Sequence
  chemically synthesized
tatagttctgagcaaactggta

SEQ ID NO: 1374911 - DNA, 22 bp, Artificial Sequence
  chemically synthesized
atatagttctgagcaaactggt

SEQ ID NO: 1374912 - DNA, 22 bp, Artificial Sequence
  chemically synthesized
taccagtttgctcagaactata

SEQ ID NO: 1374913 - DNA, 22 bp, Artificial Sequence
  chemically synthesized
ataccatccttatatagttctg

SEQ ID NO: 1374914 - DNA, 22 bp, Artificial Sequence
  chemically synthesized
acctgataccatccttatatag

SEQ ID NO: 1374915 - DNA, 22 bp, Artificial Sequence
  chemically synthesized
gctcagaactatataaggatgg

SEQ ID NO: 1374916 - DNA, 22 bp, Artificial Sequence
  chemically synthesized
ctcagaactatataaggatggt

SEQ ID NO: 1374917 - DNA, 22 bp, Artificial Sequence
  chemically synthesized
agaactatataaggatggtatc

SEQ ID NO: 1374918 - DNA, 22 bp, Artificial Sequence
  chemically synthesized
accaagctaacctgataccatc

SEQ ID NO: 1374919 - DNA, 22 bp, Artificial Sequence
  chemically synthesized
gaccaagctaacctgataccat

SEQ ID NO: 1374920 - DNA, 22 bp, Artificial Sequence
  chemically synthesized
tataaggatggtatcaggttag

SEQ ID NO: 1374921 - DNA, 22 bp, Artificial Sequence
  chemically synthesized
tatttgaccaagctaacctgat

SEQ ID NO: 1374922 - DNA, 22 bp, Artificial Sequence
  chemically synthesized
gtatttgaccaagctaacctga

SEQ ID NO: 1374923 - DNA, 22 bp, Artificial Sequence
  chemically synthesized
tgtacttgtatttgaccaagct

SEQ ID NO: 1374924 - DNA, 22 bp, Artificial Sequence
  chemically synthesized
ttatgtacttgtatttgaccaa

SEQ ID NO: 1374925 - DNA, 22 bp, Artificial Sequence
  chemically synthesized
gttatgtacttgtatttgacca

SEQ ID NO: 1374926 - DNA, 22 bp, Artificial Sequence
  chemically synthesized
tgttatgtacttgtatttgacc

SEQ ID NO: 1374927 - DNA, 22 bp, Artificial Sequence
  chemically synthesized
ttgttatgtacttgtatttgac

SEQ ID NO: 1374928 - DNA, 22 bp, Artificial Sequence
  chemically synthesized
tttgttatgtacttgtatttga

SEQ ID NO: 1374929 - DNA, 22 bp, Artificial Sequence
  chemically synthesized
ttttgttatgtacttgtatttg

SEQ ID NO: 1374930 - DNA, 22 bp, Artificial Sequence
  chemically synthesized
cttttttgttatgtacttgtat

SEQ ID NO: 1374931 - DNA, 22 bp, Artificial Sequence
  chemically synthesized
acttttttgttatgtacttgta

SEQ ID NO: 1374932 - DNA, 22 bp, Artificial Sequence
  chemically synthesized
gcttggtcaaatacaagtacat

SEQ ID NO: 1374933 - DNA, 22 bp, Artificial Sequence
  chemically synthesized
tacttttttgttatgtacttgt

SEQ ID NO: 1374934 - DNA, 22 bp, Artificial Sequence
  chemically synthesized
ttttacttttttgttatgtact

SEQ ID NO: 1374935 - DNA, 22 bp, Artificial Sequence
  chemically synthesized
ggtcaaatacaagtacataaca

SEQ ID NO: 1374936 - DNA, 22 bp, Artificial Sequence
  chemically synthesized
attttacttttttgttatgtac

SEQ ID NO: 1374937 - DNA, 22 bp, Artificial Sequence
  chemically synthesized
gtcaaatacaagtacataacaa

SEQ ID NO: 1374938 - DNA, 22 bp, Artificial Sequence
  chemically synthesized
aaaatatttattttactttttt

SEQ ID NO: 1374939 - DNA, 22 bp, Artificial Sequence
  chemically synthesized
aaaaatatttattttacttttt

SEQ ID NO: 1374940 - DNA, 22 bp, Artificial Sequence
  chemically synthesized
agccttaaaaatatttatttta

SEQ ID NO: 1374941 - DNA, 22 bp, Artificial Sequence
  chemically synthesized
aactcagccttaaaaatattta

SEQ ID NO: 1374942 - DNA, 22 bp, Artificial Sequence
  chemically synthesized
agttgaactcagccttaaaaat

SEQ ID NO: 1374943 - DNA, 22 bp, Artificial Sequence
  chemically synthesized
gagttgaactcagccttaaaaa

SEQ ID NO: 1374944 - DNA, 22 bp, Artificial Sequence
  chemically synthesized
ttaaggctgagttcaactcaag

SEQ ID NO: 1374945 - DNA, 22 bp, Artificial Sequence
  chemically synthesized
taaggctgagttcaactcaagc

SEQ ID NO: 1374946 - DNA, 22 bp, Artificial Sequence
  chemically synthesized
agagtagaaatagcttgagttg

SEQ ID NO: 1374947 - DNA, 22 bp, Artificial Sequence
  chemically synthesized
aaggctgagttcaactcaagct

SEQ ID NO: 1374948 - DNA, 22 bp, Artificial Sequence
  chemically synthesized
aggctgagttcaactcaagcta

SEQ ID NO: 1374949 - DNA, 22 bp, Artificial Sequence
  chemically synthesized
caaactcagagtagaaatagct

SEQ ID NO: 1374950 - DNA, 22 bp, Artificial Sequence
  chemically synthesized
agttcaactcaagctatttcta

SEQ ID NO: 1374951 - DNA, 22 bp, Artificial Sequence
  chemically synthesized
gcaaactcagagtagaaatagc

SEQ ID NO: 1374952 - DNA, 22 bp, Artificial Sequence
  chemically synthesized
aactcaagctatttctactctg

SEQ ID NO: 1374953 - DNA, 22 bp, Artificial Sequence
  chemically synthesized
aacttgcaaactcagagtagaa

SEQ ID NO: 1374954 - DNA, 22 bp, Artificial Sequence
  chemically synthesized
aagctatttctactctgagttt

SEQ ID NO: 1374955 - DNA, 22 bp, Artificial Sequence
  chemically synthesized
tttctactctgagtttgcaagt

SEQ ID NO: 1374956 - DNA, 22 bp, Artificial Sequence
  chemically synthesized
ctactctgagtttgcaagttta

SEQ ID NO: 1374957 - DNA, 22 bp, Artificial Sequence
  chemically synthesized
aaatcaaataactaaacttgca

SEQ ID NO: 1374958 - DNA, 22 bp, Artificial Sequence
  chemically synthesized
tactctgagtttgcaagtttag

SEQ ID NO: 1374959 - DNA, 22 bp, Artificial Sequence
  chemically synthesized
gaaatcaaataactaaacttgc

SEQ ID NO: 1374960 - DNA, 22 bp, Artificial Sequence
  chemically synthesized
ctctgagtttgcaagtttagtt

SEQ ID NO: 1374961 - DNA, 22 bp, Artificial Sequence
  chemically synthesized
tgagtttgcaagtttagttatt

SEQ ID NO: 1374962 - DNA, 22 bp, Artificial Sequence
  chemically synthesized
agtttgcaagtttagttatttg

SEQ ID NO: 1374963 - DNA, 22 bp, Artificial Sequence
  chemically synthesized
gcaagtttagttatttgatttc

SEQ ID NO: 1374964 - DNA, 22 bp, Artificial Sequence
  chemically synthesized
caagtttagttatttgatttca

SEQ ID NO: 1374965 - DNA, 22 bp, Artificial Sequence
  chemically synthesized
agttatttgatttcaaatgatc

SEQ ID NO: 1374966 - DNA, 22 bp, Artificial Sequence
  chemically synthesized
gttatttgatttcaaatgatcc

SEQ ID NO: 1374967 - DNA, 22 bp, Artificial Sequence
  chemically synthesized
tttgatttcaaatgatcctttt

SEQ ID NO: 1374968 - DNA, 22 bp, Artificial Sequence
  chemically synthesized
gatttcaaatgatccttttgct

SEQ ID NO: 1374969 - DNA, 22 bp, Artificial Sequence
  chemically synthesized
atttcaaatgatccttttgctt

SEQ ID NO: 1374970 - DNA, 22 bp, Artificial Sequence
  chemically synthesized
ggggaaaatcaaaccaagcaaa

SEQ ID NO: 1374971 - DNA, 22 bp, Artificial Sequence
  chemically synthesized
caaatgatccttttgcttggtt

SEQ ID NO: 1374972 - DNA, 22 bp, Artificial Sequence
  chemically synthesized
cggggaaaatcaaaccaagcaa

SEQ ID NO: 1374973 - DNA, 22 bp, Artificial Sequence
  chemically synthesized
aaatgatccttttgcttggttt

SEQ ID NO: 1374974 - DNA, 22 bp, Artificial Sequence
  chemically synthesized
accatttcggggaaaatcaaac

SEQ ID NO: 1374975 - DNA, 22 bp, Artificial Sequence
  chemically synthesized
ttgcttggtttgattttccccg

SEQ ID NO: 1374976 - DNA, 22 bp, Artificial Sequence
  chemically synthesized
tgcttggtttgattttccccga

SEQ ID NO: 1374977 - DNA, 22 bp, Artificial Sequence
  chemically synthesized
gcttggtttgattttccccgaa

SEQ ID NO: 1374978 - DNA, 22 bp, Artificial Sequence
  chemically synthesized
acaattgaccatttcggggaaa

SEQ ID NO: 1374979 - DNA, 22 bp, Artificial Sequence
  chemically synthesized
cttggtttgattttccccgaaa

SEQ ID NO: 1374980 - DNA, 22 bp, Artificial Sequence
  chemically synthesized
ttcacaattgaccatttcgggg

SEQ ID NO: 1374981 - DNA, 22 bp, Artificial Sequence
  chemically synthesized
ggtttgattttccccgaaatgg

SEQ ID NO: 1374982 - DNA, 22 bp, Artificial Sequence
  chemically synthesized
attcacaattgaccatttcggg

SEQ ID NO: 1374983 - DNA, 22 bp, Artificial Sequence
  chemically synthesized
gtttgattttccccgaaatggt

SEQ ID NO: 1374984 - DNA, 22 bp, Artificial Sequence
  chemically synthesized
gattttccccgaaatggtcaat

SEQ ID NO: 1374985 - DNA, 22 bp, Artificial Sequence
  chemically synthesized
attttccccgaaatggtcaatt

SEQ ID NO: 1374986 - DNA, 22 bp, Artificial Sequence
  chemically synthesized
tccccgaaatggtcaattgtga

SEQ ID NO: 1374987 - DNA, 22 bp, Artificial Sequence
  chemically synthesized
ccccgaaatggtcaattgtgaa

SEQ ID NO: 1374988 - DNA, 22 bp, Artificial Sequence
  chemically synthesized
cccgaaatggtcaattgtgaat

SEQ ID NO: 1374989 - DNA, 22 bp, Artificial Sequence
  chemically synthesized
cgaatcaaatcaaacaatttat

SEQ ID NO: 1374990 - DNA, 22 bp, Artificial Sequence
  chemically synthesized
aaaaactacgaatcaaatcaaa

SEQ ID NO: 1374991 - DNA, 22 bp, Artificial Sequence
  chemically synthesized
tgaataaattgtttgatttgat

SEQ ID NO: 1374992 - DNA, 22 bp, Artificial Sequence
  chemically synthesized
agttaaaaaactacgaatcaaa

SEQ ID NO: 1374993 - DNA, 22 bp, Artificial Sequence
  chemically synthesized
ctcagttaaaaaactacgaatc

SEQ ID NO: 1374994 - DNA, 22 bp, Artificial Sequence
  chemically synthesized
tttgatttgattcgtagttttt

SEQ ID NO: 1374995 - DNA, 22 bp, Artificial Sequence
  chemically synthesized
cctactcagttaaaaaactacg

SEQ ID NO: 1374996 - DNA, 22 bp, Artificial Sequence
  chemically synthesized
gcctactcagttaaaaaactac

SEQ ID NO: 1374997 - DNA, 22 bp, Artificial Sequence
  chemically synthesized
gatttgattcgtagttttttaa

SEQ ID NO: 1374998 - DNA, 22 bp, Artificial Sequence
  chemically synthesized
atttgattcgtagttttttaac

SEQ ID NO: 1374999 - DNA, 22 bp, Artificial Sequence
  chemically synthesized
gattcgtagttttttaactgag

SEQ ID NO: 1375000 - DNA, 22 bp, Artificial Sequence
  chemically synthesized
agaccttgcctactcagttaaa

SEQ ID NO: 1375001 - DNA, 22 bp, Artificial Sequence
  chemically synthesized
attcgtagttttttaactgagt

SEQ ID NO: 1375002 - DNA, 22 bp, Artificial Sequence
  chemically synthesized
gtagttttttaactgagtaggc

SEQ ID NO: 1375003 - DNA, 22 bp, Artificial Sequence
  chemically synthesized
tttaactgagtaggcaaggtct

SEQ ID NO: 1375004 - DNA, 22 bp, Artificial Sequence
  chemically synthesized
ttaactgagtaggcaaggtctc

SEQ ID NO: 1375005 - DNA, 22 bp, Artificial Sequence
  chemically synthesized
taactgagtaggcaaggtctca

SEQ ID NO: 1375006 - DNA, 22 bp, Artificial Sequence
  chemically synthesized
aactgagtaggcaaggtctcag

SEQ ID NO: 1375007 - DNA, 22 bp, Artificial Sequence
  chemically synthesized
actgagtaggcaaggtctcaga

SEQ ID NO: 1375008 - DNA, 22 bp, Artificial Sequence
  chemically synthesized
aagagaagtaaatctgagacct

SEQ ID NO: 1375009 - DNA, 22 bp, Artificial Sequence
  chemically synthesized
caagagaagtaaatctgagacc

SEQ ID NO: 1375010 - DNA, 22 bp, Artificial Sequence
  chemically synthesized
agtaggcaaggtctcagattta

SEQ ID NO: 1375011 - DNA, 22 bp, Artificial Sequence
  chemically synthesized
gtcttcaagagaagtaaatctg

SEQ ID NO: 1375012 - DNA, 22 bp, Artificial Sequence
  chemically synthesized
ttagtcttcaagagaagtaaat

SEQ ID NO: 1375013 - DNA, 22 bp, Artificial Sequence
  chemically synthesized
attagtcttcaagagaagtaaa

SEQ ID NO: 1375014 - DNA, 22 bp, Artificial Sequence
  chemically synthesized
tattagtcttcaagagaagtaa

SEQ ID NO: 1375015 - DNA, 22 bp, Artificial Sequence
  chemically synthesized
tttattagtcttcaagagaagt

SEQ ID NO: 1375016 - DNA, 22 bp, Artificial Sequence
  chemically synthesized
ctttattagtcttcaagagaag

SEQ ID NO: 1375017 - DNA, 22 bp, Artificial Sequence
  chemically synthesized
agatttacttctcttgaagact

SEQ ID NO: 1375018 - DNA, 22 bp, Artificial Sequence
  chemically synthesized
atgtcttctttattagtcttca

SEQ ID NO: 1375019 - DNA, 22 bp, Artificial Sequence
  chemically synthesized
acttctcttgaagactaataaa

SEQ ID NO: 1375020 - DNA, 22 bp, Artificial Sequence
  chemically synthesized
cttctcttgaagactaataaag

SEQ ID NO: 1375021 - DNA, 22 bp, Artificial Sequence
  chemically synthesized
gatattaatgtcttctttatta

SEQ ID NO: 1375022 - DNA, 22 bp, Artificial Sequence
  chemically synthesized
ctcttgaagactaataaagaag

SEQ ID NO: 1375023 - DNA, 22 bp, Artificial Sequence
  chemically synthesized
tcttgaagactaataaagaaga

SEQ ID NO: 1375024 - DNA, 22 bp, Artificial Sequence
  chemically synthesized
ttgaagactaataaagaagaca

SEQ ID NO: 1375025 - DNA, 22 bp, Artificial Sequence
  chemically synthesized
gaagactaataaagaagacatt

SEQ ID NO: 1375026 - DNA, 22 bp, Artificial Sequence
  chemically synthesized
aagactaataaagaagacatta

SEQ ID NO: 1375027 - DNA, 22 bp, Artificial Sequence
  chemically synthesized
taaacaggttagatattaatgt

SEQ ID NO: 1375028 - DNA, 22 bp, Artificial Sequence
  chemically synthesized
ataaagaagacattaatatcta

SEQ ID NO: 1375029 - DNA, 22 bp, Artificial Sequence
  chemically synthesized
ctgtaaacaggttagatattaa

SEQ ID NO: 1375030 - DNA, 22 bp, Artificial Sequence
  chemically synthesized
ttcctgtaaacaggttagatat

SEQ ID NO: 1375031 - DNA, 22 bp, Artificial Sequence
  chemically synthesized
tgttcctgtaaacaggttagat

SEQ ID NO: 1375032 - DNA, 22 bp, Artificial Sequence
  chemically synthesized
aagaaactctgttcctgtaaac

SEQ ID NO: 1375033 - DNA, 22 bp, Artificial Sequence
  chemically synthesized
atatctaacctgtttacaggaa

SEQ ID NO: 1375034 - DNA, 22 bp, Artificial Sequence
  chemically synthesized
tgctcaagaaactctgttcctg

SEQ ID NO: 1375035 - DNA, 22 bp, Artificial Sequence
  chemically synthesized
acctgtttacaggaacagagtt

SEQ ID NO: 1375036 - DNA, 22 bp, Artificial Sequence
  chemically synthesized
agctgtgctcaagaaactctgt

SEQ ID NO: 1375037 - DNA, 22 bp, Artificial Sequence
  chemically synthesized
tttacaggaacagagtttcttg

SEQ ID NO: 1375038 - DNA, 22 bp, Artificial Sequence
  chemically synthesized
acaggaacagagtttcttgagc

SEQ ID NO: 1375039 - DNA, 22 bp, Artificial Sequence
  chemically synthesized
caggaacagagtttcttgagca

SEQ ID NO: 1375040 - DNA, 22 bp, Artificial Sequence
  chemically synthesized
ggaagctcagctgtgctcaaga

SEQ ID NO: 1375041 - DNA, 22 bp, Artificial Sequence
  chemically synthesized
gggaagctcagctgtgctcaag

SEQ ID NO: 1375042 - DNA, 22 bp, Artificial Sequence
  chemically synthesized
tggcatttgggaagctcagctg

SEQ ID NO: 1375043 - DNA, 22 bp, Artificial Sequence
  chemically synthesized
tatggcatttgggaagctcagc

SEQ ID NO: 1375044 - DNA, 22 bp, Artificial Sequence
  chemically synthesized
ctatggcatttgggaagctcag

SEQ ID NO: 1375045 - DNA, 22 bp, Artificial Sequence
  chemically synthesized
cttgagcacagctgagcttccc

SEQ ID NO: 1375046 - DNA, 22 bp, Artificial Sequence
  chemically synthesized
ttgagcacagctgagcttccca

SEQ ID NO: 1375047 - DNA, 22 bp, Artificial Sequence
  chemically synthesized
tttctatggcatttgggaagct

SEQ ID NO: 1375048 - DNA, 22 bp, Artificial Sequence
  chemically synthesized
gagcacagctgagcttcccaaa

SEQ ID NO: 1375049 - DNA, 22 bp, Artificial Sequence
  chemically synthesized
gtttctatggcatttgggaagc

SEQ ID NO: 1375050 - DNA, 22 bp, Artificial Sequence
  chemically synthesized
agcacagctgagcttcccaaat

SEQ ID NO: 1375051 - DNA, 22 bp, Artificial Sequence
  chemically synthesized
tgtttctatggcatttgggaag

SEQ ID NO: 1375052 - DNA, 22 bp, Artificial Sequence
  chemically synthesized
gttttgtttctatggcatttgg

SEQ ID NO: 1375053 - DNA, 22 bp, Artificial Sequence
  chemically synthesized
cgttttgtttctatggcatttg

SEQ ID NO: 1375054 - DNA, 22 bp, Artificial Sequence
  chemically synthesized
agcttcccaaatgccatagaaa

SEQ ID NO: 1375055 - DNA, 22 bp, Artificial Sequence
  chemically synthesized
catttcgttttgtttctatggc

SEQ ID NO: 1375056 - DNA, 22 bp, Artificial Sequence
  chemically synthesized
ccatttcgttttgtttctatgg

SEQ ID NO: 1375057 - DNA, 22 bp, Artificial Sequence
  chemically synthesized
ttccatttcgttttgtttctat

SEQ ID NO: 1375058 - DNA, 22 bp, Artificial Sequence
  chemically synthesized
cccaaatgccatagaaacaaaa

SEQ ID NO: 1375059 - DNA, 22 bp, Artificial Sequence
  chemically synthesized
ccaaatgccatagaaacaaaac

SEQ ID NO: 1375060 - DNA, 22 bp, Artificial Sequence
  chemically synthesized
ccagataaattcttccatttcg

SEQ ID NO: 1375061 - DNA, 22 bp, Artificial Sequence
  chemically synthesized
ctaccagataaattcttccatt

SEQ ID NO: 1375062 - DNA, 22 bp, Artificial Sequence
  chemically synthesized
ggtcacatcaaaatacactcct

SEQ ID NO: 1375063 - DNA, 22 bp, Artificial Sequence
  chemically synthesized
ttaggtcacatcaaaatacact

SEQ ID NO: 1375064 - DNA, 22 bp, Artificial Sequence
  chemically synthesized
atctggtaggagtgtattttga

SEQ ID NO: 1375065 - DNA, 22 bp, Artificial Sequence
  chemically synthesized
tattaggtcacatcaaaataca

SEQ ID NO: 1375066 - DNA, 22 bp, Artificial Sequence
  chemically synthesized
tctggtaggagtgtattttgat

SEQ ID NO: 1375067 - DNA, 22 bp, Artificial Sequence
  chemically synthesized
gtaggagtgtattttgatgtga

SEQ ID NO: 1375068 - DNA, 22 bp, Artificial Sequence
  chemically synthesized
aattctattaggtcacatcaaa

SEQ ID NO: 1375069 - DNA, 22 bp, Artificial Sequence
  chemically synthesized
attgaattctattaggtcacat

SEQ ID NO: 1375070 - DNA, 22 bp, Artificial Sequence
  chemically synthesized
cattgaattctattaggtcaca

SEQ ID NO: 1375071 - DNA, 22 bp, Artificial Sequence
  chemically synthesized
tgatgtgacctaatagaattca

SEQ ID NO: 1375072 - DNA, 22 bp, Artificial Sequence
  chemically synthesized
gatgtgacctaatagaattcaa

SEQ ID NO: 1375073 - DNA, 22 bp, Artificial Sequence
  chemically synthesized
atgtgacctaatagaattcaat

SEQ ID NO: 1375074 - DNA, 22 bp, Artificial Sequence
  chemically synthesized
taaaatgaagcttcattgaatt

SEQ ID NO: 1375075 - DNA, 22 bp, Artificial Sequence
  chemically synthesized
atagaattcaatgaagcttcat

SEQ ID NO: 1375076 - DNA, 22 bp, Artificial Sequence
  chemically synthesized
tatagcaagttataaaatgaag

SEQ ID NO: 1375077 - DNA, 22 bp, Artificial Sequence
  chemically synthesized
attgtatagcaagttataaaat

SEQ ID NO: 1375078 - DNA, 22 bp, Artificial Sequence
  chemically synthesized
aatgaagcttcattttataact

SEQ ID NO: 1375079 - DNA, 22 bp, Artificial Sequence
  chemically synthesized
cattttataacttgctatacaa

SEQ ID NO: 1375080 - DNA, 22 bp, Artificial Sequence
  chemically synthesized
attttataacttgctatacaat

SEQ ID NO: 1375081 - DNA, 22 bp, Artificial Sequence
  chemically synthesized
tcaatatatattaattgtatag

SEQ ID NO: 1375082 - DNA, 22 bp, Artificial Sequence
  chemically synthesized
gtcaatatatattaattgtata

SEQ ID NO: 1375083 - DNA, 22 bp, Artificial Sequence
  chemically synthesized
tataacttgctatacaattaat

SEQ ID NO: 1375084 - DNA, 22 bp, Artificial Sequence
  chemically synthesized
ataacttgctatacaattaata

SEQ ID NO: 1375085 - DNA, 22 bp, Artificial Sequence
  chemically synthesized
taacttgctatacaattaatat

SEQ ID NO: 1375086 - DNA, 22 bp, Artificial Sequence
  chemically synthesized
gggcttgtcaatatatattaat

SEQ ID NO: 1375087 - DNA, 22 bp, Artificial Sequence
  chemically synthesized
gctatacaattaatatatattg

SEQ ID NO: 1375088 - DNA, 22 bp, Artificial Sequence
  chemically synthesized
ctatacaattaatatatattga

SEQ ID NO: 1375089 - DNA, 22 bp, Artificial Sequence
  chemically synthesized
tacaattaatatatattgacaa

SEQ ID NO: 1375090 - DNA, 22 bp, Artificial Sequence
  chemically synthesized
aagacactagggcttgtcaata

SEQ ID NO: 1375091 - DNA, 22 bp, Artificial Sequence
  chemically synthesized
gaagacactagggcttgtcaat

SEQ ID NO: 1375092 - DNA, 22 bp, Artificial Sequence
  chemically synthesized
atatatattgacaagccctagt

SEQ ID NO: 1375093 - DNA, 22 bp, Artificial Sequence
  chemically synthesized
tgcatgacttgaagacactagg

SEQ ID NO: 1375094 - DNA, 22 bp, Artificial Sequence
  chemically synthesized
atgcatgacttgaagacactag

SEQ ID NO: 1375095 - DNA, 22 bp, Artificial Sequence
  chemically synthesized
tatgcatgacttgaagacacta

SEQ ID NO: 1375096 - DNA, 22 bp, Artificial Sequence
  chemically synthesized
acaagccctagtgtcttcaagt

SEQ ID NO: 1375097 - DNA, 22 bp, Artificial Sequence
  chemically synthesized
aaaagcattttatgcatgactt

SEQ ID NO: 1375098 - DNA, 22 bp, Artificial Sequence
  chemically synthesized
caaaagcattttatgcatgact

SEQ ID NO: 1375099 - DNA, 22 bp, Artificial Sequence
  chemically synthesized
gtgtcttcaagtcatgcataaa

SEQ ID NO: 1375100 - DNA, 22 bp, Artificial Sequence
  chemically synthesized
tttcaaaagcattttatgcatg

SEQ ID NO: 1375101 - DNA, 22 bp, Artificial Sequence
  chemically synthesized
gtttcaaaagcattttatgcat

SEQ ID NO: 1375102 - DNA, 22 bp, Artificial Sequence
  chemically synthesized
caagtcatgcataaaatgcttt

SEQ ID NO: 1375103 - DNA, 22 bp, Artificial Sequence
  chemically synthesized
aagtcatgcataaaatgctttt

SEQ ID NO: 1375104 - DNA, 22 bp, Artificial Sequence
  chemically synthesized
ataatttgtttcaaaagcattt

SEQ ID NO: 1375105 - DNA, 22 bp, Artificial Sequence
  chemically synthesized
acaaataaatgctgataatttg

SEQ ID NO: 1375106 - DNA, 22 bp, Artificial Sequence
  chemically synthesized
actcacaaataaatgctgataa

SEQ ID NO: 1375107 - DNA, 22 bp, Artificial Sequence
  chemically synthesized
aactcacaaataaatgctgata

SEQ ID NO: 1375108 - DNA, 22 bp, Artificial Sequence
  chemically synthesized
ttgaaacaaattatcagcattt

SEQ ID NO: 1375109 - DNA, 22 bp, Artificial Sequence
  chemically synthesized
tgaaacaaattatcagcattta

SEQ ID NO: 1375110 - DNA, 22 bp, Artificial Sequence
  chemically synthesized
gaaacaaattatcagcatttat

SEQ ID NO: 1375111 - DNA, 22 bp, Artificial Sequence
  chemically synthesized
tttaactcacaaataaatgctg

SEQ ID NO: 1375112 - DNA, 22 bp, Artificial Sequence
  chemically synthesized
aaacaaattatcagcatttatt

SEQ ID NO: 1375113 - DNA, 22 bp, Artificial Sequence
  chemically synthesized
gaaaagttatttaactcacaaa

SEQ ID NO: 1375114 - DNA, 22 bp, Artificial Sequence
  chemically synthesized
agaaaagttatttaactcacaa

SEQ ID NO: 1375115 - DNA, 22 bp, Artificial Sequence
  chemically synthesized
tcagcatttatttgtgagttaa

SEQ ID NO: 1375116 - DNA, 22 bp, Artificial Sequence
  chemically synthesized
atttgtgagttaaataactttt

SEQ ID NO: 1375117 - DNA, 22 bp, Artificial Sequence
  chemically synthesized
tttgtgagttaaataacttttc

SEQ ID NO: 1375118 - DNA, 22 bp, Artificial Sequence
  chemically synthesized
atgatacacttagaaaagttat

SEQ ID NO: 1375119 - DNA, 22 bp, Artificial Sequence
  chemically synthesized
tcatgatacacttagaaaagtt

SEQ ID NO: 1375120 - DNA, 22 bp, Artificial Sequence
  chemically synthesized
gtgagttaaataacttttctaa

SEQ ID NO: 1375121 - DNA, 22 bp, Artificial Sequence
  chemically synthesized
ctcatgatacacttagaaaagt

SEQ ID NO: 1375122 - DNA, 22 bp, Artificial Sequence
  chemically synthesized
tgagttaaataacttttctaag

SEQ ID NO: 1375123 - DNA, 22 bp, Artificial Sequence
  chemically synthesized
aataacttttctaagtgtatca

SEQ ID NO: 1375124 - DNA, 22 bp, Artificial Sequence
  chemically synthesized
acccatttctcatgatacactt

SEQ ID NO: 1375125 - DNA, 22 bp, Artificial Sequence
  chemically synthesized
aacccatttctcatgatacact

SEQ ID NO: 1375126 - DNA, 22 bp, Artificial Sequence
  chemically synthesized
tgtttaacccatttctcatgat

SEQ ID NO: 1375127 - DNA, 22 bp, Artificial Sequence
  chemically synthesized
ttctaagtgtatcatgagaaat

SEQ ID NO: 1375128 - DNA, 22 bp, Artificial Sequence
  chemically synthesized
tctaagtgtatcatgagaaatg

SEQ ID NO: 1375129 - DNA, 22 bp, Artificial Sequence
  chemically synthesized
ctaagtgtatcatgagaaatgg

SEQ ID NO: 1375130 - DNA, 22 bp, Artificial Sequence
  chemically synthesized
taagtgtatcatgagaaatggg

SEQ ID NO: 1375131 - DNA, 22 bp, Artificial Sequence
  chemically synthesized
agtgtatcatgagaaatgggtt

SEQ ID NO: 1375132 - DNA, 22 bp, Artificial Sequence
  chemically synthesized
aacacaactttttggcatattc

SEQ ID NO: 1375133 - DNA, 22 bp, Artificial Sequence
  chemically synthesized
agtggtagcaggaagaatatgc

SEQ ID NO: 1375134 - DNA, 22 bp, Artificial Sequence
  chemically synthesized
aagtggtagcaggaagaatatg

SEQ ID NO: 1375135 - DNA, 22 bp, Artificial Sequence
  chemically synthesized
taagtggtagcaggaagaatat

SEQ ID NO: 1375136 - DNA, 22 bp, Artificial Sequence
  chemically synthesized
ttaagtggtagcaggaagaata

SEQ ID NO: 1375137 - DNA, 22 bp, Artificial Sequence
  chemically synthesized
tttaagtggtagcaggaagaat

SEQ ID NO: 1375138 - DNA, 22 bp, Artificial Sequence
  chemically synthesized
ttttaagtggtagcaggaagaa

SEQ ID NO: 1375139 - DNA, 22 bp, Artificial Sequence
  chemically synthesized
tttggcatattcttcctgctac

SEQ ID NO: 1375140 - DNA, 22 bp, Artificial Sequence
  chemically synthesized
ttggcatattcttcctgctacc

SEQ ID NO: 1375141 - DNA, 22 bp, Artificial Sequence
  chemically synthesized
tggcatattcttcctgctacca

SEQ ID NO: 1375142 - DNA, 22 bp, Artificial Sequence
  chemically synthesized
ggcatattcttcctgctaccac

SEQ ID NO: 1375143 - DNA, 22 bp, Artificial Sequence
  chemically synthesized
gcatattcttcctgctaccact

SEQ ID NO: 1375144 - DNA, 22 bp, Artificial Sequence
  chemically synthesized
ttcctgctaccacttaaaaaag

SEQ ID NO: 1375145 - DNA, 22 bp, Artificial Sequence
  chemically synthesized
cctgctaccacttaaaaaagca

SEQ ID NO: 1375146 - DNA, 22 bp, Artificial Sequence
  chemically synthesized
ctgctaccacttaaaaaagcac

SEQ ID NO: 1375147 - DNA, 22 bp, Artificial Sequence
  chemically synthesized
ctaccacttaaaaaagcacatc

SEQ ID NO: 1375148 - DNA, 22 bp, Artificial Sequence
  chemically synthesized
ccacttaaaaaagcacatcatt

SEQ ID NO: 1375149 - DNA, 22 bp, Artificial Sequence
  chemically synthesized
aaaatgaaatatacaaatgatg

SEQ ID NO: 1375150 - DNA, 22 bp, Artificial Sequence
  chemically synthesized
gaaaatgaaatatacaaatgat

SEQ ID NO: 1375151 - DNA, 22 bp, Artificial Sequence
  chemically synthesized
aaaaaagcacatcatttgtata

SEQ ID NO: 1375152 - DNA, 22 bp, Artificial Sequence
  chemically synthesized
aaaaagcacatcatttgtatat

SEQ ID NO: 1375153 - DNA, 22 bp, Artificial Sequence
  chemically synthesized
gtatatttcattttcaaatatg

SEQ ID NO: 1375154 - DNA, 22 bp, Artificial Sequence
  chemically synthesized
tatatttcattttcaaatatgt

SEQ ID NO: 1375155 - DNA, 22 bp, Artificial Sequence
  chemically synthesized
cattttcaaatatgtgacttcc

SEQ ID NO: 1375156 - DNA, 22 bp, Artificial Sequence
  chemically synthesized
attttcaaatatgtgacttcct

SEQ ID NO: 1375157 - DNA, 22 bp, Artificial Sequence
  chemically synthesized
aatcatgaacaggaaggaagtc

SEQ ID NO: 1375158 - DNA, 22 bp, Artificial Sequence
  chemically synthesized
tcaaatatgtgacttccttcct

SEQ ID NO: 1375159 - DNA, 22 bp, Artificial Sequence
  chemically synthesized
caaatatgtgacttccttcctg

SEQ ID NO: 1375160 - DNA, 22 bp, Artificial Sequence
  chemically synthesized
aaatatgtgacttccttcctgt

SEQ ID NO: 1375161 - DNA, 22 bp, Artificial Sequence
  chemically synthesized
aaaatatggattaaatcatgaa

SEQ ID NO: 1375162 - DNA, 22 bp, Artificial Sequence
  chemically synthesized
aaaaatatggattaaatcatga

SEQ ID NO: 1375163 - DNA, 22 bp, Artificial Sequence
  chemically synthesized
ccttcctgttcatgatttaatc

SEQ ID NO: 1375164 - DNA, 22 bp, Artificial Sequence
  chemically synthesized
cttcctgttcatgatttaatcc

SEQ ID NO: 1375165 - DNA, 22 bp, Artificial Sequence
  chemically synthesized
tgtttaaaaatatggattaaat

SEQ ID NO: 1375166 - DNA, 22 bp, Artificial Sequence
  chemically synthesized
atgtttaaaaatatggattaaa

SEQ ID NO: 1375167 - DNA, 22 bp, Artificial Sequence
  chemically synthesized
cctgttcatgatttaatccata

SEQ ID NO: 1375168 - DNA, 22 bp, Artificial Sequence
  chemically synthesized
tatgtttaaaaatatggattaa

SEQ ID NO: 1375169 - DNA, 22 bp, Artificial Sequence
  chemically synthesized
ctgttcatgatttaatccatat

SEQ ID NO: 1375170 - DNA, 22 bp, Artificial Sequence
  chemically synthesized
ttttatgtttaaaaatatggat

SEQ ID NO: 1375171 - DNA, 22 bp, Artificial Sequence
  chemically synthesized
ttcatgatttaatccatatttt

SEQ ID NO: 1375172 - DNA, 22 bp, Artificial Sequence
  chemically synthesized
attttatgtttaaaaatatgga

SEQ ID NO: 1375173 - DNA, 22 bp, Artificial Sequence
  chemically synthesized
atgatttaatccatatttttaa

SEQ ID NO: 1375174 - DNA, 22 bp, Artificial Sequence
  chemically synthesized
gcttattttatgtttaaaaata

SEQ ID NO: 1375175 - DNA, 22 bp, Artificial Sequence
  chemically synthesized
agctagcttattttatgtttaa

SEQ ID NO: 1375176 - DNA, 22 bp, Artificial Sequence
  chemically synthesized
aatccatatttttaaacataaa

SEQ ID NO: 1375177 - DNA, 22 bp, Artificial Sequence
  chemically synthesized
atccatatttttaaacataaaa

SEQ ID NO: 1375178 - DNA, 22 bp, Artificial Sequence
  chemically synthesized
ttaaacataaaataagctagct

SEQ ID NO: 1375179 - DNA, 22 bp, Artificial Sequence
  chemically synthesized
taataaaagttaagctagctta

SEQ ID NO: 1375180 - DNA, 22 bp, Artificial Sequence
  chemically synthesized
taaacataaaataagctagctt

SEQ ID NO: 1375181 - DNA, 22 bp, Artificial Sequence
  chemically synthesized
aaacataaaataagctagctta

SEQ ID NO: 1375182 - DNA, 22 bp, Artificial Sequence
  chemically synthesized
aacataaaataagctagcttaa

SEQ ID NO: 1375183 - DNA, 22 bp, Artificial Sequence
  chemically synthesized
ttgtaataaaagttaagctagc

SEQ ID NO: 1375184 - DNA, 22 bp, Artificial Sequence
  chemically synthesized
tgttgtaataaaagttaagcta

SEQ ID NO: 1375185 - DNA, 22 bp, Artificial Sequence
  chemically synthesized
ctgttgtaataaaagttaagct

SEQ ID NO: 1375186 - DNA, 22 bp, Artificial Sequence
  chemically synthesized
gcttaacttttattacaacaga

SEQ ID NO: 1375187 - DNA, 22 bp, Artificial Sequence
  chemically synthesized
cagataaacagacttctgttgt

SEQ ID NO: 1375188 - DNA, 22 bp, Artificial Sequence
  chemically synthesized
aacttttattacaacagaagtc

SEQ ID NO: 1375189 - DNA, 22 bp, Artificial Sequence
  chemically synthesized
acttttattacaacagaagtct

SEQ ID NO: 1375190 - DNA, 22 bp, Artificial Sequence
  chemically synthesized
actccagataaacagacttctg

SEQ ID NO: 1375191 - DNA, 22 bp, Artificial Sequence
  chemically synthesized
ttattacaacagaagtctgttt

SEQ ID NO: 1375192 - DNA, 22 bp, Artificial Sequence
  chemically synthesized
tattacaacagaagtctgttta

SEQ ID NO: 1375193 - DNA, 22 bp, Artificial Sequence
  chemically synthesized
attacaacagaagtctgtttat

SEQ ID NO: 1375194 - DNA, 22 bp, Artificial Sequence
  chemically synthesized
ttacaacagaagtctgtttatc

SEQ ID NO: 1375195 - DNA, 22 bp, Artificial Sequence
  chemically synthesized
aaacctcactccagataaacag

SEQ ID NO: 1375196 - DNA, 22 bp, Artificial Sequence
  chemically synthesized
aaaacctcactccagataaaca

SEQ ID NO: 1375197 - DNA, 22 bp, Artificial Sequence
  chemically synthesized
caacagaagtctgtttatctgg

SEQ ID NO: 1375198 - DNA, 22 bp, Artificial Sequence
  chemically synthesized
tatttaaaacctcactccagat

SEQ ID NO: 1375199 - DNA, 22 bp, Artificial Sequence
  chemically synthesized
tttatctggagtgaggttttaa

SEQ ID NO: 1375200 - DNA, 22 bp, Artificial Sequence
  chemically synthesized
atctggagtgaggttttaaata

SEQ ID NO: 1375201 - DNA, 22 bp, Artificial Sequence
  chemically synthesized
tctggagtgaggttttaaatat

SEQ ID NO: 1375202 - DNA, 22 bp, Artificial Sequence
  chemically synthesized
gagtgaggttttaaatatagac

SEQ ID NO: 1375203 - DNA, 22 bp, Artificial Sequence
  chemically synthesized
aaggagcaaaaatgtctatatt

SEQ ID NO: 1375204 - DNA, 22 bp, Artificial Sequence
  chemically synthesized
taaatatagacatttttgctcc

SEQ ID NO: 1375205 - DNA, 22 bp, Artificial Sequence
  chemically synthesized
aaatatagacatttttgctcct

SEQ ID NO: 1375206 - DNA, 22 bp, Artificial Sequence
  chemically synthesized
aaacaatactgaaggagcaaaa

SEQ ID NO: 1375207 - DNA, 22 bp, Artificial Sequence
  chemically synthesized
aatatagacatttttgctcctt

SEQ ID NO: 1375208 - DNA, 22 bp, Artificial Sequence
  chemically synthesized
aaaacaatactgaaggagcaaa

SEQ ID NO: 1375209 - DNA, 22 bp, Artificial Sequence
  chemically synthesized
gtttaaaacaatactgaaggag

SEQ ID NO: 1375210 - DNA, 22 bp, Artificial Sequence
  chemically synthesized
ttgctccttcagtattgtttta

SEQ ID NO: 1375211 - DNA, 22 bp, Artificial Sequence
  chemically synthesized
tgctccttcagtattgttttaa

SEQ ID NO: 1375212 - DNA, 22 bp, Artificial Sequence
  chemically synthesized
aaatgcattagtttaaaacaat

SEQ ID NO: 1375213 - DNA, 22 bp, Artificial Sequence
  chemically synthesized
gctccttcagtattgttttaaa

SEQ ID NO: 1375214 - DNA, 22 bp, Artificial Sequence
  chemically synthesized
ctccttcagtattgttttaaac

SEQ ID NO: 1375215 - DNA, 22 bp, Artificial Sequence
  chemically synthesized
ttgaaatgcattagtttaaaac

SEQ ID NO: 1375216 - DNA, 22 bp, Artificial Sequence
  chemically synthesized
attgaaatgcattagtttaaaa

SEQ ID NO: 1375217 - DNA, 22 bp, Artificial Sequence
  chemically synthesized
cttcagtattgttttaaactaa

SEQ ID NO: 1375218 - DNA, 22 bp, Artificial Sequence
  chemically synthesized
cagtattgttttaaactaatgc

SEQ ID NO: 1375219 - DNA, 22 bp, Artificial Sequence
  chemically synthesized
agtattgttttaaactaatgca

SEQ ID NO: 1375220 - DNA, 22 bp, Artificial Sequence
  chemically synthesized
gtcttattgaaatgcattagtt

SEQ ID NO: 1375221 - DNA, 22 bp, Artificial Sequence
  chemically synthesized
ttttaaactaatgcatttcaat

SEQ ID NO: 1375222 - DNA, 22 bp, Artificial Sequence
  chemically synthesized
taaactaatgcatttcaataag

SEQ ID NO: 1375223 - DNA, 22 bp, Artificial Sequence
  chemically synthesized
aaactaatgcatttcaataaga

SEQ ID NO: 1375224 - DNA, 22 bp, Artificial Sequence
  chemically synthesized
aactaatgcatttcaataagac

SEQ ID NO: 1375225 - DNA, 22 bp, Artificial Sequence
  chemically synthesized
atgcatttcaataagactagtt

SEQ ID NO: 1375226 - DNA, 22 bp, Artificial Sequence
  chemically synthesized
tcagtacaatgtataataaact

SEQ ID NO: 1375227 - DNA, 22 bp, Artificial Sequence
  chemically synthesized
caataagactagtttattatac

SEQ ID NO: 1375228 - DNA, 22 bp, Artificial Sequence
  chemically synthesized
aataagactagtttattataca

SEQ ID NO: 1375229 - DNA, 22 bp, Artificial Sequence
  chemically synthesized
actatcagtacaatgtataata

SEQ ID NO: 1375230 - DNA, 22 bp, Artificial Sequence
  chemically synthesized
aactatcagtacaatgtataat

SEQ ID NO: 1375231 - DNA, 22 bp, Artificial Sequence
  chemically synthesized
taactatcagtacaatgtataa

SEQ ID NO: 1375232 - DNA, 22 bp, Artificial Sequence
  chemically synthesized
ctttaactatcagtacaatgta

SEQ ID NO: 1375233 - DNA, 22 bp, Artificial Sequence
  chemically synthesized
gtttattatacattgtactgat

SEQ ID NO: 1375234 - DNA, 22 bp, Artificial Sequence
  chemically synthesized
acagttactttaactatcagta

SEQ ID NO: 1375235 - DNA, 22 bp, Artificial Sequence
  chemically synthesized
attatacattgtactgatagtt

SEQ ID NO: 1375236 - DNA, 22 bp, Artificial Sequence
  chemically synthesized
ttatacattgtactgatagtta

SEQ ID NO: 1375237 - DNA, 22 bp, Artificial Sequence
  chemically synthesized
tacattgtactgatagttaaag

SEQ ID NO: 1375238 - DNA, 22 bp, Artificial Sequence
  chemically synthesized
tactgatagttaaagtaactgt

SEQ ID NO: 1375239 - DNA, 22 bp, Artificial Sequence
  chemically synthesized
aaaaaatagccattaacagtta

SEQ ID NO: 1375240 - DNA, 22 bp, Artificial Sequence
  chemically synthesized
atagttaaagtaactgttaatg

SEQ ID NO: 1375241 - DNA, 22 bp, Artificial Sequence
  chemically synthesized
aagtaactgttaatggctattt

SEQ ID NO: 1375242 - DNA, 22 bp, Artificial Sequence
  chemically synthesized
agagccctgaaaaaatagccat

SEQ ID NO: 1375243 - DNA, 22 bp, Artificial Sequence
  chemically synthesized
cagagccctgaaaaaatagcca

SEQ ID NO: 1375244 - DNA, 22 bp, Artificial Sequence
  chemically synthesized
tcagagccctgaaaaaatagcc

SEQ ID NO: 1375245 - DNA, 22 bp, Artificial Sequence
  chemically synthesized
ttcagagccctgaaaaaatagc

SEQ ID NO: 1375246 - DNA, 22 bp, Artificial Sequence
  chemically synthesized
cttttcagagccctgaaaaaat

SEQ ID NO: 1375247 - DNA, 22 bp, Artificial Sequence
  chemically synthesized
acttttcagagccctgaaaaaa

SEQ ID NO: 1375248 - DNA, 22 bp, Artificial Sequence
  chemically synthesized
tacttttcagagccctgaaaaa

SEQ ID NO: 1375249 - DNA, 22 bp, Artificial Sequence
  chemically synthesized
ttaatggctattttttcagggc

SEQ ID NO: 1375250 - DNA, 22 bp, Artificial Sequence
  chemically synthesized
ttacttttcagagccctgaaaa

SEQ ID NO: 1375251 - DNA, 22 bp, Artificial Sequence
  chemically synthesized
tttacttttcagagccctgaaa

SEQ ID NO: 1375252 - DNA, 22 bp, Artificial Sequence
  chemically synthesized
ttttacttttcagagccctgaa

SEQ ID NO: 1375253 - DNA, 22 bp, Artificial Sequence
  chemically synthesized
atggctattttttcagggctct

SEQ ID NO: 1375254 - DNA, 22 bp, Artificial Sequence
  chemically synthesized
tttttacttttcagagccctga

SEQ ID NO: 1375255 - DNA, 22 bp, Artificial Sequence
  chemically synthesized
ttttttacttttcagagccctg

SEQ ID NO: 1375256 - DNA, 22 bp, Artificial Sequence
  chemically synthesized
tttttttacttttcagagccct

SEQ ID NO: 1375257 - DNA, 22 bp, Artificial Sequence
  chemically synthesized
ttttttttacttttcagagccc

SEQ ID NO: 1375258 - DNA, 22 bp, Artificial Sequence
  chemically synthesized
tttttttttacttttcagagcc

SEQ ID NO: 1375259 - DNA, 22 bp, Artificial Sequence
  chemically synthesized
ttttttttttacttttcagagc

SEQ ID NO: 1375260 - DNA, 22 bp, Artificial Sequence
  chemically synthesized
tttttttttttacttttcagag

SEQ ID NO: 1375261 - DNA, 22 bp, Artificial Sequence
  chemically synthesized
ttttttcagggctctgaaaagt

SEQ ID NO: 1375262 - DNA, 22 bp, Artificial Sequence
  chemically synthesized
tttttttttttttacttttcag

SEQ ID NO: 1375263 - DNA, 22 bp, Artificial Sequence
  chemically synthesized
ctttttttttttttacttttca

SEQ ID NO: 1375264 - DNA, 22 bp, Artificial Sequence
  chemically synthesized
tttcagggctctgaaaagtaaa

SEQ ID NO: 1375265 - DNA, 22 bp, Artificial Sequence
  chemically synthesized
tctttttttttttttacttttc

SEQ ID NO: 1375266 - DNA, 22 bp, Artificial Sequence
  chemically synthesized
ttcagggctctgaaaagtaaaa

SEQ ID NO: 1375267 - DNA, 22 bp, Artificial Sequence
  chemically synthesized
ttctttttttttttttactttt

SEQ ID NO: 1375268 - DNA, 22 bp, Artificial Sequence
  chemically synthesized
tcagggctctgaaaagtaaaaa

SEQ ID NO: 1375269 - DNA, 22 bp, Artificial Sequence
  chemically synthesized
cagggctctgaaaagtaaaaaa

SEQ ID NO: 1375270 - DNA, 22 bp, Artificial Sequence
  chemically synthesized
agggctctgaaaagtaaaaaaa

SEQ ID NO: 1375271 - DNA, 22 bp, Artificial Sequence
  chemically synthesized
tgaaaagtaaaaaaaaaaaaag

SEQ ID NO: 1375272 - DNA, 22 bp, Artificial Sequence
  chemically synthesized
aaaagtaaaaaaaaaaaaagaa

SEQ ID NO: 1375273 - DNA, 22 bp, Artificial Sequence
  chemically synthesized
gggtagtgatttttcttttttt

SEQ ID NO: 1375274 - DNA, 22 bp, Artificial Sequence
  chemically synthesized
cgggtagtgatttttctttttt

SEQ ID NO: 1375275 - DNA, 22 bp, Artificial Sequence
  chemically synthesized
agaatgatatttcgggtagtga

SEQ ID NO: 1375276 - DNA, 22 bp, Artificial Sequence
  chemically synthesized
ctaagaatgatatttcgggtag

SEQ ID NO: 1375277 - DNA, 22 bp, Artificial Sequence
  chemically synthesized
cctaagaatgatatttcgggta

SEQ ID NO: 1375278 - DNA, 22 bp, Artificial Sequence
  chemically synthesized
tcctaagaatgatatttcgggt

SEQ ID NO: 1375279 - DNA, 22 bp, Artificial Sequence
  chemically synthesized
ttcctaagaatgatatttcggg

SEQ ID NO: 1375280 - DNA, 22 bp, Artificial Sequence
  chemically synthesized
tttcctaagaatgatatttcgg

SEQ ID NO: 1375281 - DNA, 22 bp, Artificial Sequence
  chemically synthesized
ccagctttttcctaagaatgat

SEQ ID NO: 1375282 - DNA, 22 bp, Artificial Sequence
  chemically synthesized
cccgaaatatcattcttaggaa

SEQ ID NO: 1375283 - DNA, 22 bp, Artificial Sequence
  chemically synthesized
actcccagctttttcctaagaa

SEQ ID NO: 1375284 - DNA, 22 bp, Artificial Sequence
  chemically synthesized
caattaactcccagctttttcc

SEQ ID NO: 1375285 - DNA, 22 bp, Artificial Sequence
  chemically synthesized
ccaattaactcccagctttttc

SEQ ID NO: 1375286 - DNA, 22 bp, Artificial Sequence
  chemically synthesized
tccaattaactcccagcttttt

SEQ ID NO: 1375287 - DNA, 22 bp, Artificial Sequence
  chemically synthesized
actttccaattaactcccagct

SEQ ID NO: 1375288 - DNA, 22 bp, Artificial Sequence
  chemically synthesized
ttaggaaaaagctgggagttaa

SEQ ID NO: 1375289 - DNA, 22 bp, Artificial Sequence
  chemically synthesized
ttcactttccaattaactccca

SEQ ID NO: 1375290 - DNA, 22 bp, Artificial Sequence
  chemically synthesized
aggaaaaagctgggagttaatt

SEQ ID NO: 1375291 - DNA, 22 bp, Artificial Sequence
  chemically synthesized
tattcactttccaattaactcc

SEQ ID NO: 1375292 - DNA, 22 bp, Artificial Sequence
  chemically synthesized
ggaaaaagctgggagttaattg

SEQ ID NO: 1375293 - DNA, 22 bp, Artificial Sequence
  chemically synthesized
ctattcactttccaattaactc

SEQ ID NO: 1375294 - DNA, 22 bp, Artificial Sequence
  chemically synthesized
ggagttaattggaaagtgaata

SEQ ID NO: 1375295 - DNA, 22 bp, Artificial Sequence
  chemically synthesized
agagtgagtgtttctattcact

SEQ ID NO: 1375296 - DNA, 22 bp, Artificial Sequence
  chemically synthesized
ttcagagtgagtgtttctattc

SEQ ID NO: 1375297 - DNA, 22 bp, Artificial Sequence
  chemically synthesized
attggaaagtgaatagaaacac

SEQ ID NO: 1375298 - DNA, 22 bp, Artificial Sequence
  chemically synthesized
actattcagagtgagtgtttct

SEQ ID NO: 1375299 - DNA, 22 bp, Artificial Sequence
  chemically synthesized
gactattcagagtgagtgtttc

SEQ ID NO: 1375300 - DNA, 22 bp, Artificial Sequence
  chemically synthesized
gaaagtgaatagaaacactcac

SEQ ID NO: 1375301 - DNA, 22 bp, Artificial Sequence
  chemically synthesized
tgactattcagagtgagtgttt

SEQ ID NO: 1375302 - DNA, 22 bp, Artificial Sequence
  chemically synthesized
atcagttttgactattcagagt

SEQ ID NO: 1375303 - DNA, 22 bp, Artificial Sequence
  chemically synthesized
catcagttttgactattcagag

SEQ ID NO: 1375304 - DNA, 22 bp, Artificial Sequence
  chemically synthesized
atttcatcagttttgactattc

SEQ ID NO: 1375305 - DNA, 22 bp, Artificial Sequence
  chemically synthesized
ttaatttcatcagttttgacta

SEQ ID NO: 1375306 - DNA, 22 bp, Artificial Sequence
  chemically synthesized
attaatttcatcagttttgact

SEQ ID NO: 1375307 - DNA, 22 bp, Artificial Sequence
  chemically synthesized
tattaatttcatcagttttgac

SEQ ID NO: 1375308 - DNA, 22 bp, Artificial Sequence
  chemically synthesized
actctgaatagtcaaaactgat

SEQ ID NO: 1375309 - DNA, 22 bp, Artificial Sequence
  chemically synthesized
tgaatagtcaaaactgatgaaa

SEQ ID NO: 1375310 - DNA, 22 bp, Artificial Sequence
  chemically synthesized
aatagtcaaaactgatgaaatt

SEQ ID NO: 1375311 - DNA, 22 bp, Artificial Sequence
  chemically synthesized
atgaaattaataaaactacata

SEQ ID NO: 1375312 - DNA, 22 bp, Artificial Sequence
  chemically synthesized
ataaaactacatatgttgcatt

SEQ ID NO: 1375313 - DNA, 22 bp, Artificial Sequence
  chemically synthesized
acaaagaacataaataaatgca

SEQ ID NO: 1375314 - DNA, 22 bp, Artificial Sequence
  chemically synthesized
ttaacaaagaacataaataaat

SEQ ID NO: 1375315 - DNA, 22 bp, Artificial Sequence
  chemically synthesized
catatgttgcatttatttatgt

SEQ ID NO: 1375316 - DNA, 22 bp, Artificial Sequence
  chemically synthesized
attattaacaaagaacataaat

SEQ ID NO: 1375317 - DNA, 22 bp, Artificial Sequence
  chemically synthesized
catttatttatgttctttgtta

SEQ ID NO: 1375318 - DNA, 22 bp, Artificial Sequence
  chemically synthesized
gtgactgattattaacaaagaa

SEQ ID NO: 1375319 - DNA, 22 bp, Artificial Sequence
  chemically synthesized
agtgactgattattaacaaaga

SEQ ID NO: 1375320 - DNA, 22 bp, Artificial Sequence
  chemically synthesized
atttatgttctttgttaataat

SEQ ID NO: 1375321 - DNA, 22 bp, Artificial Sequence
  chemically synthesized
tttatgttctttgttaataatc

SEQ ID NO: 1375322 - DNA, 22 bp, Artificial Sequence
  chemically synthesized
taggtttagtgactgattatta

SEQ ID NO: 1375323 - DNA, 22 bp, Artificial Sequence
  chemically synthesized
atgttctttgttaataatcagt

SEQ ID NO: 1375324 - DNA, 22 bp, Artificial Sequence
  chemically synthesized
tgttctttgttaataatcagtc

SEQ ID NO: 1375325 - DNA, 22 bp, Artificial Sequence
  chemically synthesized
tttgttaataatcagtcactaa

SEQ ID NO: 1375326 - DNA, 22 bp, Artificial Sequence
  chemically synthesized
tgttaataatcagtcactaaac

SEQ ID NO: 1375327 - DNA, 22 bp, Artificial Sequence
  chemically synthesized
gttaataatcagtcactaaacc

SEQ ID NO: 1375328 - DNA, 22 bp, Artificial Sequence
  chemically synthesized
ttaataatcagtcactaaacct

SEQ ID NO: 1375329 - DNA, 22 bp, Artificial Sequence
  chemically synthesized
ataatcagtcactaaacctata

SEQ ID NO: 1375330 - DNA, 22 bp, Artificial Sequence
  chemically synthesized
gtaagtgaataatggaaaaatt

SEQ ID NO: 1375331 - DNA, 22 bp, Artificial Sequence
  chemically synthesized
ggtaagtgaataatggaaaaat

SEQ ID NO: 1375332 - DNA, 22 bp, Artificial Sequence
  chemically synthesized
tggtaagtgaataatggaaaaa

SEQ ID NO: 1375333 - DNA, 22 bp, Artificial Sequence
  chemically synthesized
ttggtaagtgaataatggaaaa

SEQ ID NO: 1375334 - DNA, 22 bp, Artificial Sequence
  chemically synthesized
tttggtaagtgaataatggaaa

SEQ ID NO: 1375335 - DNA, 22 bp, Artificial Sequence
  chemically synthesized
aacctataatttttccattatt

SEQ ID NO: 1375336 - DNA, 22 bp, Artificial Sequence
  chemically synthesized
ttttttggtaagtgaataatgg

SEQ ID NO: 1375337 - DNA, 22 bp, Artificial Sequence
  chemically synthesized
attttttggtaagtgaataatg

SEQ ID NO: 1375338 - DNA, 22 bp, Artificial Sequence
  chemically synthesized
tattttttggtaagtgaataat

SEQ ID NO: 1375339 - DNA, 22 bp, Artificial Sequence
  chemically synthesized
ttattttttggtaagtgaataa

SEQ ID NO: 1375340 - DNA, 22 bp, Artificial Sequence
  chemically synthesized
taatttttccattattcactta

SEQ ID NO: 1375341 - DNA, 22 bp, Artificial Sequence
  chemically synthesized
cttttattttttggtaagtgaa

SEQ ID NO: 1375342 - DNA, 22 bp, Artificial Sequence
  chemically synthesized
ccttttattttttggtaagtga

SEQ ID NO: 1375343 - DNA, 22 bp, Artificial Sequence
  chemically synthesized
tccttttattttttggtaagtg

SEQ ID NO: 1375344 - DNA, 22 bp, Artificial Sequence
  chemically synthesized
ttccattattcacttaccaaaa

SEQ ID NO: 1375345 - DNA, 22 bp, Artificial Sequence
  chemically synthesized
tccattattcacttaccaaaaa

SEQ ID NO: 1375346 - DNA, 22 bp, Artificial Sequence
  chemically synthesized
ccattattcacttaccaaaaaa

SEQ ID NO: 1375347 - DNA, 22 bp, Artificial Sequence
  chemically synthesized
cattattcacttaccaaaaaat

SEQ ID NO: 1375348 - DNA, 22 bp, Artificial Sequence
  chemically synthesized
aattttccttttattttttggt

SEQ ID NO: 1375349 - DNA, 22 bp, Artificial Sequence
  chemically synthesized
taaattttccttttattttttg

SEQ ID NO: 1375350 - DNA, 22 bp, Artificial Sequence
  chemically synthesized
ctaaattttccttttatttttt

SEQ ID NO: 1375351 - DNA, 22 bp, Artificial Sequence
  chemically synthesized
ttcacttaccaaaaaataaaag

SEQ ID NO: 1375352 - DNA, 22 bp, Artificial Sequence
  chemically synthesized
acttaccaaaaaataaaaggaa

SEQ ID NO: 1375353 - DNA, 22 bp, Artificial Sequence
  chemically synthesized
accttctaaattttccttttat

SEQ ID NO: 1375354 - DNA, 22 bp, Artificial Sequence
  chemically synthesized
accaaaaaataaaaggaaaatt

SEQ ID NO: 1375355 - DNA, 22 bp, Artificial Sequence
  chemically synthesized
gttcaccttctaaattttcctt

SEQ ID NO: 1375356 - DNA, 22 bp, Artificial Sequence
  chemically synthesized
ccaaaaaataaaaggaaaattt

SEQ ID NO: 1375357 - DNA, 22 bp, Artificial Sequence
  chemically synthesized
agaaggtgaactagatctattc

SEQ ID NO: 1375358 - DNA, 22 bp, Artificial Sequence
  chemically synthesized
gaaggtgaactagatctattct

SEQ ID NO: 1375359 - DNA, 22 bp, Artificial Sequence
  chemically synthesized
agcagaacaagacaacaacaca

SEQ ID NO: 1375360 - DNA, 22 bp, Artificial Sequence
  chemically synthesized
cagcagaacaagacaacaacac

SEQ ID NO: 1375361 - DNA, 22 bp, Artificial Sequence
  chemically synthesized
gatctattctgtgttgttgtct

SEQ ID NO: 1375362 - DNA, 22 bp, Artificial Sequence
  chemically synthesized
ataacttcagcagaacaagaca

SEQ ID NO: 1375363 - DNA, 22 bp, Artificial Sequence
  chemically synthesized
ttctgtgttgttgtcttgttct

SEQ ID NO: 1375364 - DNA, 22 bp, Artificial Sequence
  chemically synthesized
tgtgttgttgtcttgttctgct

SEQ ID NO: 1375365 - DNA, 22 bp, Artificial Sequence
  chemically synthesized
tgttgttgtcttgttctgctga

SEQ ID NO: 1375366 - DNA, 22 bp, Artificial Sequence
  chemically synthesized
ttgtcttgttctgctgaagtta

SEQ ID NO: 1375367 - DNA, 22 bp, Artificial Sequence
  chemically synthesized
tcttgttctgctgaagttatga

SEQ ID NO: 1375368 - DNA, 22 bp, Artificial Sequence
  chemically synthesized
atcacaaatcattcataacttc

SEQ ID NO: 1375369 - DNA, 22 bp, Artificial Sequence
  chemically synthesized
catcacaaatcattcataactt

SEQ ID NO: 1375370 - DNA, 22 bp, Artificial Sequence
  chemically synthesized
gttctgctgaagttatgaatga

SEQ ID NO: 1375371 - DNA, 22 bp, Artificial Sequence
  chemically synthesized
ttctgctgaagttatgaatgat

SEQ ID NO: 1375372 - DNA, 22 bp, Artificial Sequence
  chemically synthesized
gacttcatcacaaatcattcat

SEQ ID NO: 1375373 - DNA, 22 bp, Artificial Sequence
  chemically synthesized
ggacttcatcacaaatcattca

SEQ ID NO: 1375374 - DNA, 22 bp, Artificial Sequence
  chemically synthesized
tgctgaagttatgaatgatttg

SEQ ID NO: 1375375 - DNA, 22 bp, Artificial Sequence
  chemically synthesized
ctgaagttatgaatgatttgtg

SEQ ID NO: 1375376 - DNA, 22 bp, Artificial Sequence
  chemically synthesized
aagttatgaatgatttgtgatg

SEQ ID NO: 1375377 - DNA, 22 bp, Artificial Sequence
  chemically synthesized
tgaatgatttgtgatgaagtcc

SEQ ID NO: 1375378 - DNA, 22 bp, Artificial Sequence
  chemically synthesized
aggcccatacttggacttcatc

SEQ ID NO: 1375379 - DNA, 22 bp, Artificial Sequence
  chemically synthesized
gactgaggcccatacttggact

SEQ ID NO: 1375380 - DNA, 22 bp, Artificial Sequence
  chemically synthesized
tagactgaggcccatacttgga

SEQ ID NO: 1375381 - DNA, 22 bp, Artificial Sequence
  chemically synthesized
tctagactgaggcccatacttg

SEQ ID NO: 1375382 - DNA, 22 bp, Artificial Sequence
  chemically synthesized
gtgatgaagtccaagtatgggc

SEQ ID NO: 1375383 - DNA, 22 bp, Artificial Sequence
  chemically synthesized
tgatgaagtccaagtatgggcc

SEQ ID NO: 1375384 - DNA, 22 bp, Artificial Sequence
  chemically synthesized
gccagccagttctctagactga

SEQ ID NO: 1375385 - DNA, 22 bp, Artificial Sequence
  chemically synthesized
ggccagccagttctctagactg

SEQ ID NO: 1375386 - DNA, 22 bp, Artificial Sequence
  chemically synthesized
tggccagccagttctctagact

SEQ ID NO: 1375387 - DNA, 22 bp, Artificial Sequence
  chemically synthesized
ttttggccagccagttctctag

SEQ ID NO: 1375388 - DNA, 22 bp, Artificial Sequence
  chemically synthesized
atagttgttttggccagccagt

SEQ ID NO: 1375389 - DNA, 22 bp, Artificial Sequence
  chemically synthesized
agtctagagaactggctggcca

SEQ ID NO: 1375390 - DNA, 22 bp, Artificial Sequence
  chemically synthesized
aaattcatagttgttttggcca

SEQ ID NO: 1375391 - DNA, 22 bp, Artificial Sequence
  chemically synthesized
gagaactggctggccaaaacaa

SEQ ID NO: 1375392 - DNA, 22 bp, Artificial Sequence
  chemically synthesized
ttaaaattcatagttgttttgg

SEQ ID NO: 1375393 - DNA, 22 bp, Artificial Sequence
  chemically synthesized
tgttaaaattcatagttgtttt

SEQ ID NO: 1375394 - DNA, 22 bp, Artificial Sequence
  chemically synthesized
gctggccaaaacaactatgaat

SEQ ID NO: 1375395 - DNA, 22 bp, Artificial Sequence
  chemically synthesized
gccaaaacaactatgaatttta

SEQ ID NO: 1375396 - DNA, 22 bp, Artificial Sequence
  chemically synthesized
atgcaattctgttaaaattcat

SEQ ID NO: 1375397 - DNA, 22 bp, Artificial Sequence
  chemically synthesized
catgcaattctgttaaaattca

SEQ ID NO: 1375398 - DNA, 22 bp, Artificial Sequence
  chemically synthesized
gcacttcatgcaattctgttaa

SEQ ID NO: 1375399 - DNA, 22 bp, Artificial Sequence
  chemically synthesized
tagcacttcatgcaattctgtt

SEQ ID NO: 1375400 - DNA, 22 bp, Artificial Sequence
  chemically synthesized
tgaattttaacagaattgcatg

SEQ ID NO: 1375401 - DNA, 22 bp, Artificial Sequence
  chemically synthesized
agattctagcacttcatgcaat

SEQ ID NO: 1375402 - DNA, 22 bp, Artificial Sequence
  chemically synthesized
taacagaattgcatgaagtgct

SEQ ID NO: 1375403 - DNA, 22 bp, Artificial Sequence
  chemically synthesized
aactgagattctagcacttcat

SEQ ID NO: 1375404 - DNA, 22 bp, Artificial Sequence
  chemically synthesized
aacagaattgcatgaagtgcta

SEQ ID NO: 1375405 - DNA, 22 bp, Artificial Sequence
  chemically synthesized
aaactgagattctagcacttca

SEQ ID NO: 1375406 - DNA, 22 bp, Artificial Sequence
  chemically synthesized
acagaattgcatgaagtgctag

SEQ ID NO: 1375407 - DNA, 22 bp, Artificial Sequence
  chemically synthesized
atttaaactgagattctagcac

SEQ ID NO: 1375408 - DNA, 22 bp, Artificial Sequence
  chemically synthesized
cattcatttaaactgagattct

SEQ ID NO: 1375409 - DNA, 22 bp, Artificial Sequence
  chemically synthesized
catgaagtgctagaatctcagt

SEQ ID NO: 1375410 - DNA, 22 bp, Artificial Sequence
  chemically synthesized
gaatctcagtttaaatgaatgc

SEQ ID NO: 1375411 - DNA, 22 bp, Artificial Sequence
  chemically synthesized
gaagtagccactgcattcattt

SEQ ID NO: 1375412 - DNA, 22 bp, Artificial Sequence
  chemically synthesized
agaagtagccactgcattcatt

SEQ ID NO: 1375413 - DNA, 22 bp, Artificial Sequence
  chemically synthesized
tttagaagtagccactgcattc

SEQ ID NO: 1375414 - DNA, 22 bp, Artificial Sequence
  chemically synthesized
agtttaaatgaatgcagtggct

SEQ ID NO: 1375415 - DNA, 22 bp, Artificial Sequence
  chemically synthesized
actatttagaagtagccactgc

SEQ ID NO: 1375416 - DNA, 22 bp, Artificial Sequence
  chemically synthesized
ctgactatttagaagtagccac

SEQ ID NO: 1375417 - DNA, 22 bp, Artificial Sequence
  chemically synthesized
aaatgaatgcagtggctacttc

SEQ ID NO: 1375418 - DNA, 22 bp, Artificial Sequence
  chemically synthesized
aatgaatgcagtggctacttct

SEQ ID NO: 1375419 - DNA, 22 bp, Artificial Sequence
  chemically synthesized
cttctaaatagtcagtagactc

SEQ ID NO: 1375420 - DNA, 22 bp, Artificial Sequence
  chemically synthesized
tgatacaaagtagagtctactg

SEQ ID NO: 1375421 - DNA, 22 bp, Artificial Sequence
  chemically synthesized
tatgatacaaagtagagtctac

SEQ ID NO: 1375422 - DNA, 22 bp, Artificial Sequence
  chemically synthesized
ctaaatagtcagtagactctac

SEQ ID NO: 1375423 - DNA, 22 bp, Artificial Sequence
  chemically synthesized
ctatgatacaaagtagagtcta

SEQ ID NO: 1375424 - DNA, 22 bp, Artificial Sequence
  chemically synthesized
taaatagtcagtagactctact

SEQ ID NO: 1375425 - DNA, 22 bp, Artificial Sequence
  chemically synthesized
aatagtcagtagactctacttt

SEQ ID NO: 1375426 - DNA, 22 bp, Artificial Sequence
  chemically synthesized
cttctatgatacaaagtagagt

SEQ ID NO: 1375427 - DNA, 22 bp, Artificial Sequence
  chemically synthesized
caagtattacttctatgataca

SEQ ID NO: 1375428 - DNA, 22 bp, Artificial Sequence
  chemically synthesized
acaagtattacttctatgatac

SEQ ID NO: 1375429 - DNA, 22 bp, Artificial Sequence
  chemically synthesized
tactttgtatcatagaagtaat

SEQ ID NO: 1375430 - DNA, 22 bp, Artificial Sequence
  chemically synthesized
taaatttacaagtattacttct

SEQ ID NO: 1375431 - DNA, 22 bp, Artificial Sequence
  chemically synthesized
ctttgtatcatagaagtaatac

SEQ ID NO: 1375432 - DNA, 22 bp, Artificial Sequence
  chemically synthesized
tgtatcatagaagtaatacttg

SEQ ID NO: 1375433 - DNA, 22 bp, Artificial Sequence
  chemically synthesized
gtatcatagaagtaatacttgt

SEQ ID NO: 1375434 - DNA, 22 bp, Artificial Sequence
  chemically synthesized
tatcatagaagtaatacttgta

SEQ ID NO: 1375435 - DNA, 22 bp, Artificial Sequence
  chemically synthesized
atcaacaaagttgtaaatttac

SEQ ID NO: 1375436 - DNA, 22 bp, Artificial Sequence
  chemically synthesized
gtaaatttacaactttgttgat

SEQ ID NO: 1375437 - DNA, 22 bp, Artificial Sequence
  chemically synthesized
taaatttacaactttgttgatg

SEQ ID NO: 1375438 - DNA, 22 bp, Artificial Sequence
  chemically synthesized
acaactttgttgatgagttttg

SEQ ID NO: 1375439 - DNA, 22 bp, Artificial Sequence
  chemically synthesized
caactttgttgatgagttttgc

SEQ ID NO: 1375440 - DNA, 22 bp, Artificial Sequence
  chemically synthesized
aaaatgtggaatcatgcaaaac

SEQ ID NO: 1375441 - DNA, 22 bp, Artificial Sequence
  chemically synthesized
aaaaatgtggaatcatgcaaaa

SEQ ID NO: 1375442 - DNA, 22 bp, Artificial Sequence
  chemically synthesized
taaaaatgtggaatcatgcaaa

SEQ ID NO: 1375443 - DNA, 22 bp, Artificial Sequence
  chemically synthesized
tgttgatgagttttgcatgatt

SEQ ID NO: 1375444 - DNA, 22 bp, Artificial Sequence
  chemically synthesized
gttgatgagttttgcatgattc

SEQ ID NO: 1375445 - DNA, 22 bp, Artificial Sequence
  chemically synthesized
tttaaaaatgtggaatcatgca

SEQ ID NO: 1375446 - DNA, 22 bp, Artificial Sequence
  chemically synthesized
ttgatgagttttgcatgattcc

SEQ ID NO: 1375447 - DNA, 22 bp, Artificial Sequence
  chemically synthesized
ctttaaaaatgtggaatcatgc

SEQ ID NO: 1375448 - DNA, 22 bp, Artificial Sequence
  chemically synthesized
tctttaaaaatgtggaatcatg

SEQ ID NO: 1375449 - DNA, 22 bp, Artificial Sequence
  chemically synthesized
ttctttaaaaatgtggaatcat

SEQ ID NO: 1375450 - DNA, 22 bp, Artificial Sequence
  chemically synthesized
atgagttttgcatgattccaca

SEQ ID NO: 1375451 - DNA, 22 bp, Artificial Sequence
  chemically synthesized
gcaaatttttctttaaaaatgt

SEQ ID NO: 1375452 - DNA, 22 bp, Artificial Sequence
  chemically synthesized
tgcatgattccacatttttaaa

SEQ ID NO: 1375453 - DNA, 22 bp, Artificial Sequence
  chemically synthesized
agcaaatttttctttaaaaatg

SEQ ID NO: 1375454 - DNA, 22 bp, Artificial Sequence
  chemically synthesized
gcatgattccacatttttaaag

SEQ ID NO: 1375455 - DNA, 22 bp, Artificial Sequence
  chemically synthesized
catgattccacatttttaaaga

SEQ ID NO: 1375456 - DNA, 22 bp, Artificial Sequence
  chemically synthesized
agtttagcaaatttttctttaa

SEQ ID NO: 1375457 - DNA, 22 bp, Artificial Sequence
  chemically synthesized
cacatttttaaagaaaaatttg

SEQ ID NO: 1375458 - DNA, 22 bp, Artificial Sequence
  chemically synthesized
ttaaagaaaaatttgctaaact

SEQ ID NO: 1375459 - DNA, 22 bp, Artificial Sequence
  chemically synthesized
taaagaaaaatttgctaaactg

SEQ ID NO: 1375460 - DNA, 22 bp, Artificial Sequence
  chemically synthesized
caaaaatatgttcagtttagca

SEQ ID NO: 1375461 - DNA, 22 bp, Artificial Sequence
  chemically synthesized
aaagaaaaatttgctaaactga

SEQ ID NO: 1375462 - DNA, 22 bp, Artificial Sequence
  chemically synthesized
aagaaaaatttgctaaactgaa

SEQ ID NO: 1375463 - DNA, 22 bp, Artificial Sequence
  chemically synthesized
atggattacaaaaatatgttca

SEQ ID NO: 1375464 - DNA, 22 bp, Artificial Sequence
  chemically synthesized
aatggattacaaaaatatgttc

SEQ ID NO: 1375465 - DNA, 22 bp, Artificial Sequence
  chemically synthesized
ttaatggattacaaaaatatgt

SEQ ID NO: 1375466 - DNA, 22 bp, Artificial Sequence
  chemically synthesized
gctaaactgaacatatttttgt

SEQ ID NO: 1375467 - DNA, 22 bp, Artificial Sequence
  chemically synthesized
ctaaactgaacatatttttgta

SEQ ID NO: 1375468 - DNA, 22 bp, Artificial Sequence
  chemically synthesized
ttcttaatggattacaaaaata

SEQ ID NO: 1375469 - DNA, 22 bp, Artificial Sequence
  chemically synthesized
tgttcttaatggattacaaaaa

SEQ ID NO: 1375470 - DNA, 22 bp, Artificial Sequence
  chemically synthesized
aactgaacatatttttgtaatc

SEQ ID NO: 1375471 - DNA, 22 bp, Artificial Sequence
  chemically synthesized
attctgttcttaatggattaca

SEQ ID NO: 1375472 - DNA, 22 bp, Artificial Sequence
  chemically synthesized
cattctgttcttaatggattac

SEQ ID NO: 1375473 - DNA, 22 bp, Artificial Sequence
  chemically synthesized
aacatatttttgtaatccatta

SEQ ID NO: 1375474 - DNA, 22 bp, Artificial Sequence
  chemically synthesized
tcattctgttcttaatggatta

SEQ ID NO: 1375475 - DNA, 22 bp, Artificial Sequence
  chemically synthesized
agttttcattctgttcttaatg

SEQ ID NO: 1375476 - DNA, 22 bp, Artificial Sequence
  chemically synthesized
ttcagttttcattctgttctta

SEQ ID NO: 1375477 - DNA, 22 bp, Artificial Sequence
  chemically synthesized
ttgtaatccattaagaacagaa

SEQ ID NO: 1375478 - DNA, 22 bp, Artificial Sequence
  chemically synthesized
tgtaatccattaagaacagaat

SEQ ID NO: 1375479 - DNA, 22 bp, Artificial Sequence
  chemically synthesized
gtaatccattaagaacagaatg

SEQ ID NO: 1375480 - DNA, 22 bp, Artificial Sequence
  chemically synthesized
ttattcagttttcattctgttc

SEQ ID NO: 1375481 - DNA, 22 bp, Artificial Sequence
  chemically synthesized
taatccattaagaacagaatga

SEQ ID NO: 1375482 - DNA, 22 bp, Artificial Sequence
  chemically synthesized
agaacagaatgaaaactgaata

SEQ ID NO: 1375483 - DNA, 22 bp, Artificial Sequence
  chemically synthesized
ggtacaacatagatcatattgt

SEQ ID NO: 1375484 - DNA, 22 bp, Artificial Sequence
  chemically synthesized
gggtacaacatagatcatattg

SEQ ID NO: 1375485 - DNA, 22 bp, Artificial Sequence
  chemically synthesized
tgggtacaacatagatcatatt

SEQ ID NO: 1375486 - DNA, 22 bp, Artificial Sequence
  chemically synthesized
ggttttgggtacaacatagatc

SEQ ID NO: 1375487 - DNA, 22 bp, Artificial Sequence
  chemically synthesized
aataacaatatgatctatgttg

SEQ ID NO: 1375488 - DNA, 22 bp, Artificial Sequence
  chemically synthesized
caggaaaatacattaggttttg

SEQ ID NO: 1375489 - DNA, 22 bp, Artificial Sequence
  chemically synthesized
acaggaaaatacattaggtttt

SEQ ID NO: 1375490 - DNA, 22 bp, Artificial Sequence
  chemically synthesized
tacaggaaaatacattaggttt

SEQ ID NO: 1375491 - DNA, 22 bp, Artificial Sequence
  chemically synthesized
tgttgtacccaaaacctaatgt

SEQ ID NO: 1375492 - DNA, 22 bp, Artificial Sequence
  chemically synthesized
ttacaggaaaatacattaggtt

SEQ ID NO: 1375493 - DNA, 22 bp, Artificial Sequence
  chemically synthesized
tttacaggaaaatacattaggt

SEQ ID NO: 1375494 - DNA, 22 bp, Artificial Sequence
  chemically synthesized
ttttacaggaaaatacattagg

SEQ ID NO: 1375495 - DNA, 22 bp, Artificial Sequence
  chemically synthesized
tacccaaaacctaatgtatttt

SEQ ID NO: 1375496 - DNA, 22 bp, Artificial Sequence
  chemically synthesized
tttttttacaggaaaatacatt

SEQ ID NO: 1375497 - DNA, 22 bp, Artificial Sequence
  chemically synthesized
atttttttacaggaaaatacat

SEQ ID NO: 1375498 - DNA, 22 bp, Artificial Sequence
  chemically synthesized
tatttttttacaggaaaataca

SEQ ID NO: 1375499 - DNA, 22 bp, Artificial Sequence
  chemically synthesized
ttatttttttacaggaaaatac

SEQ ID NO: 1375500 - DNA, 22 bp, Artificial Sequence
  chemically synthesized
gatttttatttttttacaggaa

SEQ ID NO: 1375501 - DNA, 22 bp, Artificial Sequence
  chemically synthesized
atgtattttcctgtaaaaaaat

SEQ ID NO: 1375502 - DNA, 22 bp, Artificial Sequence
  chemically synthesized
cagaagctagatttttattttt

SEQ ID NO: 1375503 - DNA, 22 bp, Artificial Sequence
  chemically synthesized
tcctgtaaaaaaataaaaatct

SEQ ID NO: 1375504 - DNA, 22 bp, Artificial Sequence
  chemically synthesized
gttacagaagctagatttttat

SEQ ID NO: 1375505 - DNA, 22 bp, Artificial Sequence
  chemically synthesized
cctgtaaaaaaataaaaatcta

SEQ ID NO: 1375506 - DNA, 22 bp, Artificial Sequence
  chemically synthesized
ctgtaaaaaaataaaaatctag

SEQ ID NO: 1375507 - DNA, 22 bp, Artificial Sequence
  chemically synthesized
ctagttacagaagctagatttt

SEQ ID NO: 1375508 - DNA, 22 bp, Artificial Sequence
  chemically synthesized
taaaaaaataaaaatctagctt

SEQ ID NO: 1375509 - DNA, 22 bp, Artificial Sequence
  chemically synthesized
tagtgttcctagttacagaagc

SEQ ID NO: 1375510 - DNA, 22 bp, Artificial Sequence
  chemically synthesized
gtagtgttcctagttacagaag

SEQ ID NO: 1375511 - DNA, 22 bp, Artificial Sequence
  chemically synthesized
tgtagtgttcctagttacagaa

SEQ ID NO: 1375512 - DNA, 22 bp, Artificial Sequence
  chemically synthesized
agttttgtagtgttcctagtta

SEQ ID NO: 1375513 - DNA, 22 bp, Artificial Sequence
  chemically synthesized
cagttttgtagtgttcctagtt

SEQ ID NO: 1375514 - DNA, 22 bp, Artificial Sequence
  chemically synthesized
gcttctgtaactaggaacacta

SEQ ID NO: 1375515 - DNA, 22 bp, Artificial Sequence
  chemically synthesized
cagtttcagttttgtagtgttc

SEQ ID NO: 1375516 - DNA, 22 bp, Artificial Sequence
  chemically synthesized
ctgtaactaggaacactacaaa

SEQ ID NO: 1375517 - DNA, 22 bp, Artificial Sequence
  chemically synthesized
tgtaactaggaacactacaaaa

SEQ ID NO: 1375518 - DNA, 22 bp, Artificial Sequence
  chemically synthesized
taactaggaacactacaaaact

SEQ ID NO: 1375519 - DNA, 22 bp, Artificial Sequence
  chemically synthesized
aagagtctacagtttcagtttt

SEQ ID NO: 1375520 - DNA, 22 bp, Artificial Sequence
  chemically synthesized
ggaacactacaaaactgaaact

SEQ ID NO: 1375521 - DNA, 22 bp, Artificial Sequence
  chemically synthesized
aaattaaagagtctacagtttc

SEQ ID NO: 1375522 - DNA, 22 bp, Artificial Sequence
  chemically synthesized
caaaactgaaactgtagactct

SEQ ID NO: 1375523 - DNA, 22 bp, Artificial Sequence
  chemically synthesized
atgaaccctgaaattaaagagt

SEQ ID NO: 1375524 - DNA, 22 bp, Artificial Sequence
  chemically synthesized
catgaaccctgaaattaaagag

SEQ ID NO: 1375525 - DNA, 22 bp, Artificial Sequence
  chemically synthesized
aaactgtagactctttaatttc

SEQ ID NO: 1375526 - DNA, 22 bp, Artificial Sequence
  chemically synthesized
cttcatgaaccctgaaattaaa

SEQ ID NO: 1375527 - DNA, 22 bp, Artificial Sequence
  chemically synthesized
tagactctttaatttcagggtt

SEQ ID NO: 1375528 - DNA, 22 bp, Artificial Sequence
  chemically synthesized
tttaatttcagggttcatgaag

SEQ ID NO: 1375529 - DNA, 22 bp, Artificial Sequence
  chemically synthesized
taatttcagggttcatgaagga

SEQ ID NO: 1375530 - DNA, 22 bp, Artificial Sequence
  chemically synthesized
aatttcagggttcatgaaggaa

SEQ ID NO: 1375531 - DNA, 22 bp, Artificial Sequence
  chemically synthesized
atttcagggttcatgaaggaat

SEQ ID NO: 1375532 - DNA, 22 bp, Artificial Sequence
  chemically synthesized
cagggttcatgaaggaattttt

SEQ ID NO: 1375533 - DNA, 22 bp, Artificial Sequence
  chemically synthesized
agggttcatgaaggaatttttt

SEQ ID NO: 1375534 - DNA, 22 bp, Artificial Sequence
  chemically synthesized
atgaaggaatttttttccatac

SEQ ID NO: 1375535 - DNA, 22 bp, Artificial Sequence
  chemically synthesized
atgtaacatgtcagtatggaaa

SEQ ID NO: 1375536 - DNA, 22 bp, Artificial Sequence
  chemically synthesized
gagtattaatgtaacatgtcag

SEQ ID NO: 1375537 - DNA, 22 bp, Artificial Sequence
  chemically synthesized
ttttccatactgacatgttaca

SEQ ID NO: 1375538 - DNA, 22 bp, Artificial Sequence
  chemically synthesized
ctagagtattaatgtaacatgt

SEQ ID NO: 1375539 - DNA, 22 bp, Artificial Sequence
  chemically synthesized
tttccatactgacatgttacat

SEQ ID NO: 1375540 - DNA, 22 bp, Artificial Sequence
  chemically synthesized
ttccatactgacatgttacatt

SEQ ID NO: 1375541 - DNA, 22 bp, Artificial Sequence
  chemically synthesized
tccatactgacatgttacatta

SEQ ID NO: 1375542 - DNA, 22 bp, Artificial Sequence
  chemically synthesized
ccatactgacatgttacattaa

SEQ ID NO: 1375543 - DNA, 22 bp, Artificial Sequence
  chemically synthesized
attcctagagtattaatgtaac

SEQ ID NO: 1375544 - DNA, 22 bp, Artificial Sequence
  chemically synthesized
catactgacatgttacattaat

SEQ ID NO: 1375545 - DNA, 22 bp, Artificial Sequence
  chemically synthesized
acattaattcctagagtattaa

SEQ ID NO: 1375546 - DNA, 22 bp, Artificial Sequence
  chemically synthesized
acatgttacattaatactctag

SEQ ID NO: 1375547 - DNA, 22 bp, Artificial Sequence
  chemically synthesized
taacattaattcctagagtatt

SEQ ID NO: 1375548 - DNA, 22 bp, Artificial Sequence
  chemically synthesized
ctaacattaattcctagagtat

SEQ ID NO: 1375549 - DNA, 22 bp, Artificial Sequence
  chemically synthesized
cattaatactctaggaattaat

SEQ ID NO: 1375550 - DNA, 22 bp, Artificial Sequence
  chemically synthesized
aaatacttctaacattaattcc

SEQ ID NO: 1375551 - DNA, 22 bp, Artificial Sequence
  chemically synthesized
atactctaggaattaatgttag

SEQ ID NO: 1375552 - DNA, 22 bp, Artificial Sequence
  chemically synthesized
gttcaaatacttctaacattaa

SEQ ID NO: 1375553 - DNA, 22 bp, Artificial Sequence
  chemically synthesized
taggaattaatgttagaagtat

SEQ ID NO: 1375554 - DNA, 22 bp, Artificial Sequence
  chemically synthesized
aatactagttcaaatacttcta

SEQ ID NO: 1375555 - DNA, 22 bp, Artificial Sequence
  chemically synthesized
ggaattaatgttagaagtattt

SEQ ID NO: 1375556 - DNA, 22 bp, Artificial Sequence
  chemically synthesized
atgttagaagtatttgaactag

SEQ ID NO: 1375557 - DNA, 22 bp, Artificial Sequence
  chemically synthesized
acatatattgaatactagttca

SEQ ID NO: 1375558 - DNA, 22 bp, Artificial Sequence
  chemically synthesized
gaagtatttgaactagtattca

SEQ ID NO: 1375559 - DNA, 22 bp, Artificial Sequence
  chemically synthesized
attaacatatattgaatactag

SEQ ID NO: 1375560 - DNA, 22 bp, Artificial Sequence
  chemically synthesized
cattaacatatattgaatacta

SEQ ID NO: 1375561 - DNA, 22 bp, Artificial Sequence
  chemically synthesized
catttcattaacatatattgaa

SEQ ID NO: 1375562 - DNA, 22 bp, Artificial Sequence
  chemically synthesized
gaactagtattcaatatatgtt

SEQ ID NO: 1375563 - DNA, 22 bp, Artificial Sequence
  chemically synthesized
aactagtattcaatatatgtta

SEQ ID NO: 1375564 - DNA, 22 bp, Artificial Sequence
  chemically synthesized
gtattcaatatatgttaatgaa

SEQ ID NO: 1375565 - DNA, 22 bp, Artificial Sequence
  chemically synthesized
aatatatgttaatgaaatgtag

SEQ ID NO: 1375566 - DNA, 22 bp, Artificial Sequence
  chemically synthesized
atgaaatgtagtacatatcccc

SEQ ID NO: 1375567 - DNA, 22 bp, Artificial Sequence
  chemically synthesized
ggtcacaaccaatggggatatg

SEQ ID NO: 1375568 - DNA, 22 bp, Artificial Sequence
  chemically synthesized
aaaacgattaggtcacaaccaa

SEQ ID NO: 1375569 - DNA, 22 bp, Artificial Sequence
  chemically synthesized
aaaaacgattaggtcacaacca

SEQ ID NO: 1375570 - DNA, 22 bp, Artificial Sequence
  chemically synthesized
gttgtgacctaatcgtttttaa

SEQ ID NO: 1375571 - DNA, 22 bp, Artificial Sequence
  chemically synthesized
tgacctaatcgtttttaaatac

SEQ ID NO: 1375572 - DNA, 22 bp, Artificial Sequence
  chemically synthesized
tcaaatgtaatgtacgtattta

SEQ ID NO: 1375573 - DNA, 22 bp, Artificial Sequence
  chemically synthesized
atcgtttttaaatacgtacatt

SEQ ID NO: 1375574 - DNA, 22 bp, Artificial Sequence
  chemically synthesized
agcatctatcaaatgtaatgta

SEQ ID NO: 1375575 - DNA, 22 bp, Artificial Sequence
  chemically synthesized
ttaaatacgtacattacatttg

SEQ ID NO: 1375576 - DNA, 22 bp, Artificial Sequence
  chemically synthesized
taaatacgtacattacatttga

SEQ ID NO: 1375577 - DNA, 22 bp, Artificial Sequence
  chemically synthesized
aaatacgtacattacatttgat

SEQ ID NO: 1375578 - DNA, 22 bp, Artificial Sequence
  chemically synthesized
aatacgtacattacatttgata

SEQ ID NO: 1375579 - DNA, 22 bp, Artificial Sequence
  chemically synthesized
ataattgagcatctatcaaatg

SEQ ID NO: 1375580 - DNA, 22 bp, Artificial Sequence
  chemically synthesized
catttgatagatgctcaattat

SEQ ID NO: 1375581 - DNA, 22 bp, Artificial Sequence
  chemically synthesized
aaaaagcaggattcataattga

SEQ ID NO: 1375582 - DNA, 22 bp, Artificial Sequence
  chemically synthesized
gaaaaagcaggattcataattg

SEQ ID NO: 1375583 - DNA, 22 bp, Artificial Sequence
  chemically synthesized
gatagatgctcaattatgaatc

SEQ ID NO: 1375584 - DNA, 22 bp, Artificial Sequence
  chemically synthesized
atagatgctcaattatgaatcc

SEQ ID NO: 1375585 - DNA, 22 bp, Artificial Sequence
  chemically synthesized
caccttgaaaaagcaggattca

SEQ ID NO: 1375586 - DNA, 22 bp, Artificial Sequence
  chemically synthesized
aattatgaatcctgctttttca

SEQ ID NO: 1375587 - DNA, 22 bp, Artificial Sequence
  chemically synthesized
agatattccaccttgaaaaagc

SEQ ID NO: 1375588 - DNA, 22 bp, Artificial Sequence
  chemically synthesized
tcagatattccaccttgaaaaa

SEQ ID NO: 1375589 - DNA, 22 bp, Artificial Sequence
  chemically synthesized
ctcagatattccaccttgaaaa

SEQ ID NO: 1375590 - DNA, 22 bp, Artificial Sequence
  chemically synthesized
tgaatcctgctttttcaaggtg

SEQ ID NO: 1375591 - DNA, 22 bp, Artificial Sequence
  chemically synthesized
ctttttcaaggtggaatatctg

SEQ ID NO: 1375592 - DNA, 22 bp, Artificial Sequence
  chemically synthesized
tttcaaggtggaatatctgaga

SEQ ID NO: 1375593 - DNA, 22 bp, Artificial Sequence
  chemically synthesized
ttcaaggtggaatatctgagaa

SEQ ID NO: 1375594 - DNA, 22 bp, Artificial Sequence
  chemically synthesized
tcaaggtggaatatctgagaaa

SEQ ID NO: 1375595 - DNA, 22 bp, Artificial Sequence
  chemically synthesized
caaggtggaatatctgagaaac

SEQ ID NO: 1375596 - DNA, 22 bp, Artificial Sequence
  chemically synthesized
aaggtggaatatctgagaaact

SEQ ID NO: 1375597 - DNA, 22 bp, Artificial Sequence
  chemically synthesized
atcagtgaaacaagtttctcag

SEQ ID NO: 1375598 - DNA, 22 bp, Artificial Sequence
  chemically synthesized
gatcagtgaaacaagtttctca

SEQ ID NO: 1375599 - DNA, 22 bp, Artificial Sequence
  chemically synthesized
agaaacttgtttcactgatcaa

SEQ ID NO: 1375600 - DNA, 22 bp, Artificial Sequence
  chemically synthesized
atatcacatcaggacatttgat

SEQ ID NO: 1375601 - DNA, 22 bp, Artificial Sequence
  chemically synthesized
aatatcacatcaggacatttga

SEQ ID NO: 1375602 - DNA, 22 bp, Artificial Sequence
  chemically synthesized
gtttcactgatcaaatgtcctg

SEQ ID NO: 1375603 - DNA, 22 bp, Artificial Sequence
  chemically synthesized
tttcactgatcaaatgtcctga

SEQ ID NO: 1375604 - DNA, 22 bp, Artificial Sequence
  chemically synthesized
cactgatcaaatgtcctgatgt

SEQ ID NO: 1375605 - DNA, 22 bp, Artificial Sequence
  chemically synthesized
tatcttaatatcacatcaggac

SEQ ID NO: 1375606 - DNA, 22 bp, Artificial Sequence
  chemically synthesized
actgatcaaatgtcctgatgtg

SEQ ID NO: 1375607 - DNA, 22 bp, Artificial Sequence
  chemically synthesized
atcaaatgtcctgatgtgatat

SEQ ID NO: 1375608 - DNA, 22 bp, Artificial Sequence
  chemically synthesized
gtactgtatcttaatatcacat

SEQ ID NO: 1375609 - DNA, 22 bp, Artificial Sequence
  chemically synthesized
agtactgtatcttaatatcaca

SEQ ID NO: 1375610 - DNA, 22 bp, Artificial Sequence
  chemically synthesized
tttagtactgtatcttaatatc

SEQ ID NO: 1375611 - DNA, 22 bp, Artificial Sequence
  chemically synthesized
aggctgtttagtactgtatctt

SEQ ID NO: 1375612 - DNA, 22 bp, Artificial Sequence
  chemically synthesized
atgtgatattaagatacagtac

SEQ ID NO: 1375613 - DNA, 22 bp, Artificial Sequence
  chemically synthesized
cctcaggctgtttagtactgta

SEQ ID NO: 1375614 - DNA, 22 bp, Artificial Sequence
  chemically synthesized
actgcctcaggctgtttagtac

SEQ ID NO: 1375615 - DNA, 22 bp, Artificial Sequence
  chemically synthesized
agatacagtactaaacagcctg

SEQ ID NO: 1375616 - DNA, 22 bp, Artificial Sequence
  chemically synthesized
aatgctcactgcctcaggctgt

SEQ ID NO: 1375617 - DNA, 22 bp, Artificial Sequence
  chemically synthesized
gactaaatgctcactgcctcag

SEQ ID NO: 1375618 - DNA, 22 bp, Artificial Sequence
  chemically synthesized
aacagcctgaggcagtgagcat

SEQ ID NO: 1375619 - DNA, 22 bp, Artificial Sequence
  chemically synthesized
gccagattagactaaatgctca

SEQ ID NO: 1375620 - DNA, 22 bp, Artificial Sequence
  chemically synthesized
cactggccagattagactaaat

SEQ ID NO: 1375621 - DNA, 22 bp, Artificial Sequence
  chemically synthesized
aggcagtgagcatttagtctaa

SEQ ID NO: 1375622 - DNA, 22 bp, Artificial Sequence
  chemically synthesized
tgcactggccagattagactaa

SEQ ID NO: 1375623 - DNA, 22 bp, Artificial Sequence
  chemically synthesized
agtctaatctggccagtgcaga

SEQ ID NO: 1375624 - DNA, 22 bp, Artificial Sequence
  chemically synthesized
gtctaatctggccagtgcagaa

SEQ ID NO: 1375625 - DNA, 22 bp, Artificial Sequence
  chemically synthesized
atctggccagtgcagaacacac

SEQ ID NO: 1375626 - DNA, 22 bp, Artificial Sequence
  chemically synthesized
gccagtgcagaacacacctggg

SEQ ID NO: 1375627 - DNA, 22 bp, Artificial Sequence
  chemically synthesized
ggcctccctggggttgctgtgg

SEQ ID NO: 1375628 - DNA, 22 bp, Artificial Sequence
  chemically synthesized
gatggcagaatggtcaccacag

SEQ ID NO: 1375629 - DNA, 22 bp, Artificial Sequence
  chemically synthesized
cctggggttgctgtggtgacca

SEQ ID NO: 1375630 - DNA, 22 bp, Artificial Sequence
  chemically synthesized
gggttgctgtggtgaccattct

SEQ ID NO: 1375631 - DNA, 22 bp, Artificial Sequence
  chemically synthesized
aggactagatggcagaatggtc

SEQ ID NO: 1375632 - DNA, 22 bp, Artificial Sequence
  chemically synthesized
ctgtggtgaccattctgccatc

SEQ ID NO: 1375633 - DNA, 22 bp, Artificial Sequence
  chemically synthesized
tggtgaccattctgccatctag

SEQ ID NO: 1375634 - DNA, 22 bp, Artificial Sequence
  chemically synthesized
atgatgctgaggactagatggc

SEQ ID NO: 1375635 - DNA, 22 bp, Artificial Sequence
  chemically synthesized
accctgatgatgctgaggacta

SEQ ID NO: 1375636 - DNA, 22 bp, Artificial Sequence
  chemically synthesized
ttgaccctgatgatgctgagga

SEQ ID NO: 1375637 - DNA, 22 bp, Artificial Sequence
  chemically synthesized
gttgaccctgatgatgctgagg

SEQ ID NO: 1375638 - DNA, 22 bp, Artificial Sequence
  chemically synthesized
tgccatctagtcctcagcatca

SEQ ID NO: 1375639 - DNA, 22 bp, Artificial Sequence
  chemically synthesized
ccatctagtcctcagcatcatc

SEQ ID NO: 1375640 - DNA, 22 bp, Artificial Sequence
  chemically synthesized
gcttgttgaccctgatgatgct

SEQ ID NO: 1375641 - DNA, 22 bp, Artificial Sequence
  chemically synthesized
ttagcttgttgaccctgatgat

SEQ ID NO: 1375642 - DNA, 22 bp, Artificial Sequence
  chemically synthesized
gtcctcagcatcatcagggtca

SEQ ID NO: 1375643 - DNA, 22 bp, Artificial Sequence
  chemically synthesized
ccactgttagcttgttgaccct

SEQ ID NO: 1375644 - DNA, 22 bp, Artificial Sequence
  chemically synthesized
agcatcatcagggtcaacaagc

SEQ ID NO: 1375645 - DNA, 22 bp, Artificial Sequence
  chemically synthesized
ttgccactgttagcttgttgac

SEQ ID NO: 1375646 - DNA, 22 bp, Artificial Sequence
  chemically synthesized
tgttgccactgttagcttgttg

SEQ ID NO: 1375647 - DNA, 22 bp, Artificial Sequence
  chemically synthesized
tataaatgaaacaactctgttg

SEQ ID NO: 1375648 - DNA, 22 bp, Artificial Sequence
  chemically synthesized
acagtggcaacagagttgtttc

SEQ ID NO: 1375649 - DNA, 22 bp, Artificial Sequence
  chemically synthesized
gaactgtataaatgaaacaact

SEQ ID NO: 1375650 - DNA, 22 bp, Artificial Sequence
  chemically synthesized
tttcatttatacagttccagtg

SEQ ID NO: 1375651 - DNA, 22 bp, Artificial Sequence
  chemically synthesized
catttatacagttccagtgata

SEQ ID NO: 1375652 - DNA, 22 bp, Artificial Sequence
  chemically synthesized
atttatacagttccagtgatat

SEQ ID NO: 1375653 - DNA, 22 bp, Artificial Sequence
  chemically synthesized
atacagttccagtgatatcgtt

SEQ ID NO: 1375654 - DNA, 22 bp, Artificial Sequence
  chemically synthesized
tacagttccagtgatatcgttg

SEQ ID NO: 1375655 - DNA, 22 bp, Artificial Sequence
  chemically synthesized
cagtgatatcgttgccttcctg

SEQ ID NO: 1375656 - DNA, 22 bp, Artificial Sequence
  chemically synthesized
gaaacacaacacagccaggaag

SEQ ID NO: 1375657 - DNA, 22 bp, Artificial Sequence
  chemically synthesized
ccttcctggctgtgttgtgttt

SEQ ID NO: 1375658 - DNA, 22 bp, Artificial Sequence
  chemically synthesized
ggagcaacattagaaacacaac

SEQ ID NO: 1375659 - DNA, 22 bp, Artificial Sequence
  chemically synthesized
cctggctgtgttgtgtttctaa

SEQ ID NO: 1375660 - DNA, 22 bp, Artificial Sequence
  chemically synthesized
ctggctgtgttgtgtttctaat

SEQ ID NO: 1375661 - DNA, 22 bp, Artificial Sequence
  chemically synthesized
gctgtgttgtgtttctaatgtt

SEQ ID NO: 1375662 - DNA, 22 bp, Artificial Sequence
  chemically synthesized
tgttgtgtttctaatgttgctc

SEQ ID NO: 1375663 - DNA, 22 bp, Artificial Sequence
  chemically synthesized
tgtttctaatgttgctcctagc

SEQ ID NO: 1375664 - DNA, 22 bp, Artificial Sequence
  chemically synthesized
gaaatggtggcaaagagctagg

SEQ ID NO: 1375665 - DNA, 22 bp, Artificial Sequence
  chemically synthesized
ctaatgttgctcctagctcttt

SEQ ID NO: 1375666 - DNA, 22 bp, Artificial Sequence
  chemically synthesized
taatgttgctcctagctctttg

SEQ ID NO: 1375667 - DNA, 22 bp, Artificial Sequence
  chemically synthesized
atgttgctcctagctctttgcc

SEQ ID NO: 1375668 - DNA, 22 bp, Artificial Sequence
  chemically synthesized
ctcctagctctttgccaccatt

SEQ ID NO: 1375669 - DNA, 22 bp, Artificial Sequence
  chemically synthesized
ctagctctttgccaccatttct

SEQ ID NO: 1375670 - DNA, 22 bp, Artificial Sequence
  chemically synthesized
gctctttgccaccatttctaat

SEQ ID NO: 1375671 - DNA, 22 bp, Artificial Sequence
  chemically synthesized
gggagcagaagaattagaaatg

SEQ ID NO: 1375672 - DNA, 22 bp, Artificial Sequence
  chemically synthesized
ggggagcagaagaattagaaat

SEQ ID NO: 1375673 - DNA, 22 bp, Artificial Sequence
  chemically synthesized
ttggggagcagaagaattagaa

SEQ ID NO: 1375674 - DNA, 22 bp, Artificial Sequence
  chemically synthesized
tttgccaccatttctaattctt

SEQ ID NO: 1375675 - DNA, 22 bp, Artificial Sequence
  chemically synthesized
tgccaccatttctaattcttct

SEQ ID NO: 1375676 - DNA, 22 bp, Artificial Sequence
  chemically synthesized
gccaccatttctaattcttctg

SEQ ID NO: 1375677 - DNA, 22 bp, Artificial Sequence
  chemically synthesized
ccaccatttctaattcttctgc

SEQ ID NO: 1375678 - DNA, 22 bp, Artificial Sequence
  chemically synthesized
ctaattcttctgctccccaaga

SEQ ID NO: 1375679 - DNA, 22 bp, Artificial Sequence
  chemically synthesized
taattcttctgctccccaagag

SEQ ID NO: 1375680 - DNA, 22 bp, Artificial Sequence
  chemically synthesized
attcttctgctccccaagagtc

SEQ ID NO: 1375681 - DNA, 22 bp, Artificial Sequence
  chemically synthesized
aagataatatcaaagactcttg

SEQ ID NO: 1375682 - DNA, 22 bp, Artificial Sequence
  chemically synthesized
ttctgctccccaagagtctttg

SEQ ID NO: 1375683 - DNA, 22 bp, Artificial Sequence
  chemically synthesized
ctgctccccaagagtctttgat

SEQ ID NO: 1375684 - DNA, 22 bp, Artificial Sequence
  chemically synthesized
tgctccccaagagtctttgata

SEQ ID NO: 1375685 - DNA, 22 bp, Artificial Sequence
  chemically synthesized
ctccccaagagtctttgatatt

SEQ ID NO: 1375686 - DNA, 22 bp, Artificial Sequence
  chemically synthesized
cccaagagtctttgatattatc

SEQ ID NO: 1375687 - DNA, 22 bp, Artificial Sequence
  chemically synthesized
tgatattatctttagtgtggcc

SEQ ID NO: 1375688 - DNA, 22 bp, Artificial Sequence
  chemically synthesized
gatattatctttagtgtggccc

SEQ ID NO: 1375689 - DNA, 22 bp, Artificial Sequence
  chemically synthesized
atattatctttagtgtggccct

SEQ ID NO: 1375690 - DNA, 22 bp, Artificial Sequence
  chemically synthesized
gggtaaacagtaagggccacac

SEQ ID NO: 1375691 - DNA, 22 bp, Artificial Sequence
  chemically synthesized
tagggtaaacagtaagggccac

SEQ ID NO: 1375692 - DNA, 22 bp, Artificial Sequence
  chemically synthesized
tctttagtgtggcccttactgt

SEQ ID NO: 1375693 - DNA, 22 bp, Artificial Sequence
  chemically synthesized
tctctagggtaaacagtaaggg

SEQ ID NO: 1375694 - DNA, 22 bp, Artificial Sequence
  chemically synthesized
tagtgtggcccttactgtttac

SEQ ID NO: 1375695 - DNA, 22 bp, Artificial Sequence
  chemically synthesized
actatctctagggtaaacagta

SEQ ID NO: 1375696 - DNA, 22 bp, Artificial Sequence
  chemically synthesized
agtgtggcccttactgtttacc

SEQ ID NO: 1375697 - DNA, 22 bp, Artificial Sequence
  chemically synthesized
gtgtggcccttactgtttaccc

SEQ ID NO: 1375698 - DNA, 22 bp, Artificial Sequence
  chemically synthesized
actgtttaccctagagatagtg

SEQ ID NO: 1375699 - DNA, 22 bp, Artificial Sequence
  chemically synthesized
ctgtttaccctagagatagtga

SEQ ID NO: 1375700 - DNA, 22 bp, Artificial Sequence
  chemically synthesized
tcaagtaacagaattcactatc

SEQ ID NO: 1375701 - DNA, 22 bp, Artificial Sequence
  chemically synthesized
tttaccctagagatagtgaatt

SEQ ID NO: 1375702 - DNA, 22 bp, Artificial Sequence
  chemically synthesized
accctagagatagtgaattctg

SEQ ID NO: 1375703 - DNA, 22 bp, Artificial Sequence
  chemically synthesized
ccctagagatagtgaattctgt

SEQ ID NO: 1375704 - DNA, 22 bp, Artificial Sequence
  chemically synthesized
aattgtcaagtaacagaattca

SEQ ID NO: 1375705 - DNA, 22 bp, Artificial Sequence
  chemically synthesized
gagatagtgaattctgttactt

SEQ ID NO: 1375706 - DNA, 22 bp, Artificial Sequence
  chemically synthesized
atcagtgtcctaaattgtcaag

SEQ ID NO: 1375707 - DNA, 22 bp, Artificial Sequence
  chemically synthesized
ttcatcagtgtcctaaattgtc

SEQ ID NO: 1375708 - DNA, 22 bp, Artificial Sequence
  chemically synthesized
tgttcatcagtgtcctaaattg

SEQ ID NO: 1375709 - DNA, 22 bp, Artificial Sequence
  chemically synthesized
tgttacttgacaatttaggaca

SEQ ID NO: 1375710 - DNA, 22 bp, Artificial Sequence
  chemically synthesized
ttctgttcatcagtgtcctaaa

SEQ ID NO: 1375711 - DNA, 22 bp, Artificial Sequence
  chemically synthesized
ttacttgacaatttaggacact

SEQ ID NO: 1375712 - DNA, 22 bp, Artificial Sequence
  chemically synthesized
attctgttcatcagtgtcctaa

SEQ ID NO: 1375713 - DNA, 22 bp, Artificial Sequence
  chemically synthesized
tattctgttcatcagtgtccta

SEQ ID NO: 1375714 - DNA, 22 bp, Artificial Sequence
  chemically synthesized
cttgacaatttaggacactgat

SEQ ID NO: 1375715 - DNA, 22 bp, Artificial Sequence
  chemically synthesized
gacaatttaggacactgatgaa

SEQ ID NO: 1375716 - DNA, 22 bp, Artificial Sequence
  chemically synthesized
tactttattctgttcatcagtg

SEQ ID NO: 1375717 - DNA, 22 bp, Artificial Sequence
  chemically synthesized
acaatttaggacactgatgaac

SEQ ID NO: 1375718 - DNA, 22 bp, Artificial Sequence
  chemically synthesized
aggacactgatgaacagaataa

SEQ ID NO: 1375719 - DNA, 22 bp, Artificial Sequence
  chemically synthesized
ggacactgatgaacagaataaa

SEQ ID NO: 1375720 - DNA, 22 bp, Artificial Sequence
  chemically synthesized
atacaattatactttattctgt

SEQ ID NO: 1375721 - DNA, 22 bp, Artificial Sequence
  chemically synthesized
atgaacagaataaagtataatt

SEQ ID NO: 1375722 - DNA, 22 bp, Artificial Sequence
  chemically synthesized
tagacattgatacaattatact

SEQ ID NO: 1375723 - DNA, 22 bp, Artificial Sequence
  chemically synthesized
atagacattgatacaattatac

SEQ ID NO: 1375724 - DNA, 22 bp, Artificial Sequence
  chemically synthesized
cttatagacattgatacaatta

SEQ ID NO: 1375725 - DNA, 22 bp, Artificial Sequence
  chemically synthesized
aatggctacttatagacattga

SEQ ID NO: 1375726 - DNA, 22 bp, Artificial Sequence
  chemically synthesized
aaatggctacttatagacattg

SEQ ID NO: 1375727 - DNA, 22 bp, Artificial Sequence
  chemically synthesized
taaatggctacttatagacatt

SEQ ID NO: 1375728 - DNA, 22 bp, Artificial Sequence
  chemically synthesized
ttaaatggctacttatagacat

SEQ ID NO: 1375729 - DNA, 22 bp, Artificial Sequence
  chemically synthesized
tatcaatgtctataagtagcca

SEQ ID NO: 1375730 - DNA, 22 bp, Artificial Sequence
  chemically synthesized
tgtataaatttttaaatggcta

SEQ ID NO: 1375731 - DNA, 22 bp, Artificial Sequence
  chemically synthesized
atgtataaatttttaaatggct

SEQ ID NO: 1375732 - DNA, 22 bp, Artificial Sequence
  chemically synthesized
ttatgtataaatttttaaatgg

SEQ ID NO: 1375733 - DNA, 22 bp, Artificial Sequence
  chemically synthesized
taagtagccatttaaaaattta

SEQ ID NO: 1375734 - DNA, 22 bp, Artificial Sequence
  chemically synthesized
agagaatgattcttatgtataa

SEQ ID NO: 1375735 - DNA, 22 bp, Artificial Sequence
  chemically synthesized
aaaaatttatacataagaatca

SEQ ID NO: 1375736 - DNA, 22 bp, Artificial Sequence
  chemically synthesized
aaaatttatacataagaatcat

SEQ ID NO: 1375737 - DNA, 22 bp, Artificial Sequence
  chemically synthesized
atgcctgagagaatgattctta

SEQ ID NO: 1375738 - DNA, 22 bp, Artificial Sequence
  chemically synthesized
aatgcctgagagaatgattctt

SEQ ID NO: 1375739 - DNA, 22 bp, Artificial Sequence
  chemically synthesized
atttaatgcctgagagaatgat

SEQ ID NO: 1375740 - DNA, 22 bp, Artificial Sequence
  chemically synthesized
catttaatgcctgagagaatga

SEQ ID NO: 1375741 - DNA, 22 bp, Artificial Sequence
  chemically synthesized
atacataagaatcattctctca

SEQ ID NO: 1375742 - DNA, 22 bp, Artificial Sequence
  chemically synthesized
tacataagaatcattctctcag

SEQ ID NO: 1375743 - DNA, 22 bp, Artificial Sequence
  chemically synthesized
atttcatttaatgcctgagaga

SEQ ID NO: 1375744 - DNA, 22 bp, Artificial Sequence
  chemically synthesized
taatttcatttaatgcctgaga

SEQ ID NO: 1375745 - DNA, 22 bp, Artificial Sequence
  chemically synthesized
tctaatttcatttaatgcctga

SEQ ID NO: 1375746 - DNA, 22 bp, Artificial Sequence
  chemically synthesized
ctctaatttcatttaatgcctg

SEQ ID NO: 1375747 - DNA, 22 bp, Artificial Sequence
  chemically synthesized
tctcaggcattaaatgaaatta

SEQ ID NO: 1375748 - DNA, 22 bp, Artificial Sequence
  chemically synthesized
tcaggcattaaatgaaattaga

SEQ ID NO: 1375749 - DNA, 22 bp, Artificial Sequence
  chemically synthesized
aggcattaaatgaaattagaga

SEQ ID NO: 1375750 - DNA, 22 bp, Artificial Sequence
  chemically synthesized
aatgaaattagagaaattattt

SEQ ID NO: 1375751 - DNA, 22 bp, Artificial Sequence
  chemically synthesized
gagaaattatttcatttttggt

SEQ ID NO: 1375752 - DNA, 22 bp, Artificial Sequence
  chemically synthesized
tttcatttttggttttttttgc

SEQ ID NO: 1375753 - DNA, 22 bp, Artificial Sequence
  chemically synthesized
catttttggttttttttgcttg

SEQ ID NO: 1375754 - DNA, 22 bp, Artificial Sequence
  chemically synthesized
atttttggttttttttgcttgt

SEQ ID NO: 1375755 - DNA, 22 bp, Artificial Sequence
  chemically synthesized
ttggttttttttgcttgtttgt

SEQ ID NO: 1375756 - DNA, 22 bp, Artificial Sequence
  chemically synthesized
tggttttttttgcttgtttgtt

SEQ ID NO: 1375757 - DNA, 22 bp, Artificial Sequence
  chemically synthesized
ggttttttttgcttgtttgttt

SEQ ID NO: 1375758 - DNA, 22 bp, Artificial Sequence
  chemically synthesized
gttttttttgcttgtttgtttg

SEQ ID NO: 1375759 - DNA, 22 bp, Artificial Sequence
  chemically synthesized
tttttgcttgtttgtttgtttt

SEQ ID NO: 1375760 - DNA, 22 bp, Artificial Sequence
  chemically synthesized
ttttgcttgtttgtttgttttg

SEQ ID NO: 1375761 - DNA, 22 bp, Artificial Sequence
  chemically synthesized
aaaaaaacaaaacaaaacaaac

SEQ ID NO: 1375762 - DNA, 22 bp, Artificial Sequence
  chemically synthesized
tttgcttgtttgtttgttttgt

SEQ ID NO: 1375763 - DNA, 22 bp, Artificial Sequence
  chemically synthesized
ttgcttgtttgtttgttttgtt

SEQ ID NO: 1375764 - DNA, 22 bp, Artificial Sequence
  chemically synthesized
tgcttgtttgtttgttttgttt

SEQ ID NO: 1375765 - DNA, 22 bp, Artificial Sequence
  chemically synthesized
gcttgtttgtttgttttgtttt

SEQ ID NO: 1375766 - DNA, 22 bp, Artificial Sequence
  chemically synthesized
cttgtttgtttgttttgttttg

SEQ ID NO: 1375767 - DNA, 22 bp, Artificial Sequence
  chemically synthesized
catctcaaaaaaacaaaacaaa

SEQ ID NO: 1375768 - DNA, 22 bp, Artificial Sequence
  chemically synthesized
gtttgtttgttttgttttgttt

SEQ ID NO: 1375769 - DNA, 22 bp, Artificial Sequence
  chemically synthesized
tttgtttgttttgttttgtttt

SEQ ID NO: 1375770 - DNA, 22 bp, Artificial Sequence
  chemically synthesized
gtttgttttgttttgttttttt

SEQ ID NO: 1375771 - DNA, 22 bp, Artificial Sequence
  chemically synthesized
tttgttttgttttgtttttttg

SEQ ID NO: 1375772 - DNA, 22 bp, Artificial Sequence
  chemically synthesized
gttttgttttgtttttttgaga

SEQ ID NO: 1375773 - DNA, 22 bp, Artificial Sequence
  chemically synthesized
ttttgttttgtttttttgagat

SEQ ID NO: 1375774 - DNA, 22 bp, Artificial Sequence
  chemically synthesized
tgttttgtttttttgagatgga

SEQ ID NO: 1375775 - DNA, 22 bp, Artificial Sequence
  chemically synthesized
gttttgtttttttgagatggaa

SEQ ID NO: 1375776 - DNA, 22 bp, Artificial Sequence
  chemically synthesized
ttttgtttttttgagatggaat

SEQ ID NO: 1375777 - DNA, 22 bp, Artificial Sequence
  chemically synthesized
ggcaacagagcgagattccatc

SEQ ID NO: 1375778 - DNA, 22 bp, Artificial Sequence
  chemically synthesized
tgtttttttgagatggaatctc

SEQ ID NO: 1375779 - DNA, 22 bp, Artificial Sequence
  chemically synthesized
gtttttttgagatggaatctcg

SEQ ID NO: 1375780 - DNA, 22 bp, Artificial Sequence
  chemically synthesized
tttttttgagatggaatctcgc

SEQ ID NO: 1375781 - DNA, 22 bp, Artificial Sequence
  chemically synthesized
ttttgagatggaatctcgctct

SEQ ID NO: 1375782 - DNA, 22 bp, Artificial Sequence
  chemically synthesized
tttgagatggaatctcgctctg

SEQ ID NO: 1375783 - DNA, 22 bp, Artificial Sequence
  chemically synthesized
cagcctgggcaacagagcgaga

SEQ ID NO: 1375784 - DNA, 22 bp, Artificial Sequence
  chemically synthesized
ttgagatggaatctcgctctgt

SEQ ID NO: 1375785 - DNA, 22 bp, Artificial Sequence
  chemically synthesized
tgagatggaatctcgctctgtt

SEQ ID NO: 1375786 - DNA, 22 bp, Artificial Sequence
  chemically synthesized
gagatggaatctcgctctgttg

SEQ ID NO: 1375787 - DNA, 22 bp, Artificial Sequence
  chemically synthesized
agatggaatctcgctctgttgc

SEQ ID NO: 1375788 - DNA, 22 bp, Artificial Sequence
  chemically synthesized
gctctgttgcccaggctggagt

SEQ ID NO: 1375789 - DNA, 22 bp, Artificial Sequence
  chemically synthesized
aggtcgcgccaccacactccag

SEQ ID NO: 1375790 - DNA, 22 bp, Artificial Sequence
  chemically synthesized
tgttgcccaggctggagtgtgg

SEQ ID NO: 1375791 - DNA, 22 bp, Artificial Sequence
  chemically synthesized
ttgcccaggctggagtgtggtg

SEQ ID NO: 1375792 - DNA, 22 bp, Artificial Sequence
  chemically synthesized
cccaggctggagtgtggtggcg

SEQ ID NO: 1375793 - DNA, 22 bp, Artificial Sequence
  chemically synthesized
cagtgagctgaggtcgcgccac

SEQ ID NO: 1375794 - DNA, 22 bp, Artificial Sequence
  chemically synthesized
gagtgtggtggcgcgacctcag

SEQ ID NO: 1375795 - DNA, 22 bp, Artificial Sequence
  chemically synthesized
aacccggaaggtggacgttgca

SEQ ID NO: 1375796 - DNA, 22 bp, Artificial Sequence
  chemically synthesized
gaacccggaaggtggacgttgc

SEQ ID NO: 1375797 - DNA, 22 bp, Artificial Sequence
  chemically synthesized
ttgaacccggaaggtggacgtt

SEQ ID NO: 1375798 - DNA, 22 bp, Artificial Sequence
  chemically synthesized
agctcactgcaacgtccacctt

SEQ ID NO: 1375799 - DNA, 22 bp, Artificial Sequence
  chemically synthesized
actgcaacgtccaccttccggg

SEQ ID NO: 1375800 - DNA, 22 bp, Artificial Sequence
  chemically synthesized
caacgtccaccttccgggttca

SEQ ID NO: 1375801 - DNA, 22 bp, Artificial Sequence
  chemically synthesized
aggcaggagagtctcttgaacc

SEQ ID NO: 1375802 - DNA, 22 bp, Artificial Sequence
  chemically synthesized
ccgggttcaagagactctcctg

SEQ ID NO: 1375803 - DNA, 22 bp, Artificial Sequence
  chemically synthesized
aggaggctgaggcaggagagtc

SEQ ID NO: 1375804 - DNA, 22 bp, Artificial Sequence
  chemically synthesized
cgggttcaagagactctcctgc

SEQ ID NO: 1375805 - DNA, 22 bp, Artificial Sequence
  chemically synthesized
ttcaggaggctgaggcaggaga

SEQ ID NO: 1375806 - DNA, 22 bp, Artificial Sequence
  chemically synthesized
aagagactctcctgcctcagcc

SEQ ID NO: 1375807 - DNA, 22 bp, Artificial Sequence
  chemically synthesized
taatcccagctattcaggaggc

SEQ ID NO: 1375808 - DNA, 22 bp, Artificial Sequence
  chemically synthesized
tcctgcctcagcctcctgaata

SEQ ID NO: 1375809 - DNA, 22 bp, Artificial Sequence
  chemically synthesized
ctgcctcagcctcctgaatagc

SEQ ID NO: 1375810 - DNA, 22 bp, Artificial Sequence
  chemically synthesized
cctcagcctcctgaatagctgg

SEQ ID NO: 1375811 - DNA, 22 bp, Artificial Sequence
  chemically synthesized
agcctcctgaatagctgggatt

SEQ ID NO: 1375812 - DNA, 22 bp, Artificial Sequence
  chemically synthesized
ctgaatagctgggattacaggc

SEQ ID NO: 1375813 - DNA, 22 bp, Artificial Sequence
  chemically synthesized
aatagctgggattacaggcgca

SEQ ID NO: 1375814 - DNA, 22 bp, Artificial Sequence
  chemically synthesized
ggggtggtggtgtgcgcctgta

SEQ ID NO: 1375815 - DNA, 22 bp, Artificial Sequence
  chemically synthesized
gctgggggtggtggtgtgcgcc

SEQ ID NO: 1375816 - DNA, 22 bp, Artificial Sequence
  chemically synthesized
ggattacaggcgcacaccacca

SEQ ID NO: 1375817 - DNA, 22 bp, Artificial Sequence
  chemically synthesized
caaaaattagctgggggtggtg

SEQ ID NO: 1375818 - DNA, 22 bp, Artificial Sequence
  chemically synthesized
caggcgcacaccaccaccccca

SEQ ID NO: 1375819 - DNA, 22 bp, Artificial Sequence
  chemically synthesized
aaactacaaaaattagctgggg

SEQ ID NO: 1375820 - DNA, 22 bp, Artificial Sequence
  chemically synthesized
ctaaaactacaaaaattagctg

SEQ ID NO: 1375821 - DNA, 22 bp, Artificial Sequence
  chemically synthesized
tactaaaactacaaaaattagc

SEQ ID NO: 1375822 - DNA, 22 bp, Artificial Sequence
  chemically synthesized
atttttgtagttttagtagaga

SEQ ID NO: 1375823 - DNA, 22 bp, Artificial Sequence
  chemically synthesized
ttgtagttttagtagagacggg

SEQ ID NO: 1375824 - DNA, 22 bp, Artificial Sequence
  chemically synthesized
tgtagttttagtagagacgggg

SEQ ID NO: 1375825 - DNA, 22 bp, Artificial Sequence
  chemically synthesized
gtagttttagtagagacggggc

SEQ ID NO: 1375826 - DNA, 22 bp, Artificial Sequence
  chemically synthesized
tagttttagtagagacggggct

SEQ ID NO: 1375827 - DNA, 22 bp, Artificial Sequence
  chemically synthesized
acaagcatggtgaagccccgtc

SEQ ID NO: 1375828 - DNA, 22 bp, Artificial Sequence
  chemically synthesized
tagtagagacggggcttcacca

SEQ ID NO: 1375829 - DNA, 22 bp, Artificial Sequence
  chemically synthesized
agtagagacggggcttcaccat

SEQ ID NO: 1375830 - DNA, 22 bp, Artificial Sequence
  chemically synthesized
gtagagacggggcttcaccatg

SEQ ID NO: 1375831 - DNA, 22 bp, Artificial Sequence
  chemically synthesized
gagaccagcctgacaagcatgg

SEQ ID NO: 1375832 - DNA, 22 bp, Artificial Sequence
  chemically synthesized
caccatgcttgtcaggctggtc

SEQ ID NO: 1375833 - DNA, 22 bp, Artificial Sequence
  chemically synthesized
accatgcttgtcaggctggtct

SEQ ID NO: 1375834 - DNA, 22 bp, Artificial Sequence
  chemically synthesized
gtcaggctggtctcgaactcct

SEQ ID NO: 1375835 - DNA, 22 bp, Artificial Sequence
  chemically synthesized
tcaggctggtctcgaactcctg

SEQ ID NO: 1375836 - DNA, 22 bp, Artificial Sequence
  chemically synthesized
gtctcgaactcctgacctcatg

SEQ ID NO: 1375837 - DNA, 22 bp, Artificial Sequence
  chemically synthesized
aggtgggcagatcatgaggtca

SEQ ID NO: 1375838 - DNA, 22 bp, Artificial Sequence
  chemically synthesized
gaactcctgacctcatgatctg

SEQ ID NO: 1375839 - DNA, 22 bp, Artificial Sequence
  chemically synthesized
ggaagctgaggtgggcagatca

SEQ ID NO: 1375840 - DNA, 22 bp, Artificial Sequence
  chemically synthesized
gggaagctgaggtgggcagatc

SEQ ID NO: 1375841 - DNA, 22 bp, Artificial Sequence
  chemically synthesized
tgggaagctgaggtgggcagat

SEQ ID NO: 1375842 - DNA, 22 bp, Artificial Sequence
  chemically synthesized
ctgacctcatgatctgcccacc

SEQ ID NO: 1375843 - DNA, 22 bp, Artificial Sequence
  chemically synthesized
acctcatgatctgcccacctca

SEQ ID NO: 1375844 - DNA, 22 bp, Artificial Sequence
  chemically synthesized
atgatctgcccacctcagcttc

SEQ ID NO: 1375845 - DNA, 22 bp, Artificial Sequence
  chemically synthesized
cccacctcagcttcccaaagtg

SEQ ID NO: 1375846 - DNA, 22 bp, Artificial Sequence
  chemically synthesized
atgcccgtaatgccagcacttt

SEQ ID NO: 1375847 - DNA, 22 bp, Artificial Sequence
  chemically synthesized
agcttcccaaagtgctggcatt

SEQ ID NO: 1375848 - DNA, 22 bp, Artificial Sequence
  chemically synthesized
cccaaagtgctggcattacggg

SEQ ID NO: 1375849 - DNA, 22 bp, Artificial Sequence
  chemically synthesized
ccaaagtgctggcattacgggc

SEQ ID NO: 1375850 - DNA, 22 bp, Artificial Sequence
  chemically synthesized
gccgggcatggtggctcatgcc

SEQ ID NO: 1375851 - DNA, 22 bp, Artificial Sequence
  chemically synthesized
gcattacgggcatgagccacca

SEQ ID NO: 1375852 - DNA, 22 bp, Artificial Sequence
  chemically synthesized
cgggcatgagccaccatgcccg

SEQ ID NO: 1375853 - DNA, 22 bp, Artificial Sequence
  chemically synthesized
aagaccgagataattggccggg

SEQ ID NO: 1375854 - DNA, 22 bp, Artificial Sequence
  chemically synthesized
gaagaccgagataattggccgg

SEQ ID NO: 1375855 - DNA, 22 bp, Artificial Sequence
  chemically synthesized
aaacagagtttgaagaccgaga

SEQ ID NO: 1375856 - DNA, 22 bp, Artificial Sequence
  chemically synthesized
agtactaaaacagagtttgaag

SEQ ID NO: 1375857 - DNA, 22 bp, Artificial Sequence
  chemically synthesized
aagtactaaaacagagtttgaa

SEQ ID NO: 1375858 - DNA, 22 bp, Artificial Sequence
  chemically synthesized
tttaagtactaaaacagagttt

SEQ ID NO: 1375859 - DNA, 22 bp, Artificial Sequence
  chemically synthesized
tctcggtcttcaaactctgttt

SEQ ID NO: 1375860 - DNA, 22 bp, Artificial Sequence
  chemically synthesized
gtttaagtactaaaacagagtt

SEQ ID NO: 1375861 - DNA, 22 bp, Artificial Sequence
  chemically synthesized
tgtttaagtactaaaacagagt

SEQ ID NO: 1375862 - DNA, 22 bp, Artificial Sequence
  chemically synthesized
ggtcttcaaactctgttttagt

SEQ ID NO: 1375863 - DNA, 22 bp, Artificial Sequence
  chemically synthesized
aggctttgtttaagtactaaaa

SEQ ID NO: 1375864 - DNA, 22 bp, Artificial Sequence
  chemically synthesized
aaggctttgtttaagtactaaa

SEQ ID NO: 1375865 - DNA, 22 bp, Artificial Sequence
  chemically synthesized
caaactctgttttagtacttaa

SEQ ID NO: 1375866 - DNA, 22 bp, Artificial Sequence
  chemically synthesized
aaactctgttttagtacttaaa

SEQ ID NO: 1375867 - DNA, 22 bp, Artificial Sequence
  chemically synthesized
tgttttagtacttaaacaaagc

SEQ ID NO: 1375868 - DNA, 22 bp, Artificial Sequence
  chemically synthesized
aagcagtttaaggctttgttta

SEQ ID NO: 1375869 - DNA, 22 bp, Artificial Sequence
  chemically synthesized
gaagcagtttaaggctttgttt

SEQ ID NO: 1375870 - DNA, 22 bp, Artificial Sequence
  chemically synthesized
ttttagtacttaaacaaagcct

SEQ ID NO: 1375871 - DNA, 22 bp, Artificial Sequence
  chemically synthesized
ttgaagcagtttaaggctttgt

SEQ ID NO: 1375872 - DNA, 22 bp, Artificial Sequence
  chemically synthesized
tagtacttaaacaaagccttaa

SEQ ID NO: 1375873 - DNA, 22 bp, Artificial Sequence
  chemically synthesized
agtacttaaacaaagccttaaa

SEQ ID NO: 1375874 - DNA, 22 bp, Artificial Sequence
  chemically synthesized
gtacttaaacaaagccttaaac

SEQ ID NO: 1375875 - DNA, 22 bp, Artificial Sequence
  chemically synthesized
agtgttcttgaagcagtttaag

SEQ ID NO: 1375876 - DNA, 22 bp, Artificial Sequence
  chemically synthesized
aaacaaagccttaaactgcttc

SEQ ID NO: 1375877 - DNA, 22 bp, Artificial Sequence
  chemically synthesized
aacaaagccttaaactgcttca

SEQ ID NO: 1375878 - DNA, 22 bp, Artificial Sequence
  chemically synthesized
tcattcagtgttcttgaagcag

SEQ ID NO: 1375879 - DNA, 22 bp, Artificial Sequence
  chemically synthesized
atcattcagtgttcttgaagca

SEQ ID NO: 1375880 - DNA, 22 bp, Artificial Sequence
  chemically synthesized
atttatcattcagtgttcttga

SEQ ID NO: 1375881 - DNA, 22 bp, Artificial Sequence
  chemically synthesized
aaactgcttcaagaacactgaa

SEQ ID NO: 1375882 - DNA, 22 bp, Artificial Sequence
  chemically synthesized
aactgcttcaagaacactgaat

SEQ ID NO: 1375883 - DNA, 22 bp, Artificial Sequence
  chemically synthesized
cttcaagaacactgaatgataa

SEQ ID NO: 1375884 - DNA, 22 bp, Artificial Sequence
  chemically synthesized
caagaacactgaatgataaatg

SEQ ID NO: 1375885 - DNA, 22 bp, Artificial Sequence
  chemically synthesized
aagaacactgaatgataaatga

SEQ ID NO: 1375886 - DNA, 22 bp, Artificial Sequence
  chemically synthesized
aatgtagaataattcatttatc

SEQ ID NO: 1375887 - DNA, 22 bp, Artificial Sequence
  chemically synthesized
caatgtagaataattcatttat

SEQ ID NO: 1375888 - DNA, 22 bp, Artificial Sequence
  chemically synthesized
tcaatgtagaataattcattta

SEQ ID NO: 1375889 - DNA, 22 bp, Artificial Sequence
  chemically synthesized
attttcaatgtagaataattca

SEQ ID NO: 1375890 - DNA, 22 bp, Artificial Sequence
  chemically synthesized
aatgataaatgaattattctac

SEQ ID NO: 1375891 - DNA, 22 bp, Artificial Sequence
  chemically synthesized
ataaaagttcattttcaatgta

SEQ ID NO: 1375892 - DNA, 22 bp, Artificial Sequence
  chemically synthesized
aaattgataaaagttcattttc

SEQ ID NO: 1375893 - DNA, 22 bp, Artificial Sequence
  chemically synthesized
ttctacattgaaaatgaacttt

SEQ ID NO: 1375894 - DNA, 22 bp, Artificial Sequence
  chemically synthesized
aactaaaattgataaaagttca

SEQ ID NO: 1375895 - DNA, 22 bp, Artificial Sequence
  chemically synthesized
tacattgaaaatgaacttttat

SEQ ID NO: 1375896 - DNA, 22 bp, Artificial Sequence
  chemically synthesized
cattgaaaatgaacttttatca

SEQ ID NO: 1375897 - DNA, 22 bp, Artificial Sequence
  chemically synthesized
aaaatgaacttttatcaatttt

SEQ ID NO: 1375898 - DNA, 22 bp, Artificial Sequence
  chemically synthesized
ttatcaattttagttgaatatg

SEQ ID NO: 1375899 - DNA, 22 bp, Artificial Sequence
  chemically synthesized
tatcaattttagttgaatatgg

SEQ ID NO: 1375900 - DNA, 22 bp, Artificial Sequence
  chemically synthesized
atcaattttagttgaatatggt

SEQ ID NO: 1375901 - DNA, 22 bp, Artificial Sequence
  chemically synthesized
aaggaagaagaaaccatattca

SEQ ID NO: 1375902 - DNA, 22 bp, Artificial Sequence
  chemically synthesized
tcaattttagttgaatatggtt

SEQ ID NO: 1375903 - DNA, 22 bp, Artificial Sequence
  chemically synthesized
gactcaaggaagaagaaaccat

SEQ ID NO: 1375904 - DNA, 22 bp, Artificial Sequence
  chemically synthesized
tagttgaatatggtttcttctt

SEQ ID NO: 1375905 - DNA, 22 bp, Artificial Sequence
  chemically synthesized
agttgaatatggtttcttcttc

SEQ ID NO: 1375906 - DNA, 22 bp, Artificial Sequence
  chemically synthesized
actggactcaaggaagaagaaa

SEQ ID NO: 1375907 - DNA, 22 bp, Artificial Sequence
  chemically synthesized
gttgaatatggtttcttcttcc

SEQ ID NO: 1375908 - DNA, 22 bp, Artificial Sequence
  chemically synthesized
aactggactcaaggaagaagaa

SEQ ID NO: 1375909 - DNA, 22 bp, Artificial Sequence
  chemically synthesized
taactggactcaaggaagaaga

SEQ ID NO: 1375910 - DNA, 22 bp, Artificial Sequence
  chemically synthesized
aatatggtttcttcttccttga

SEQ ID NO: 1375911 - DNA, 22 bp, Artificial Sequence
  chemically synthesized
cctttaactggactcaaggaag

SEQ ID NO: 1375912 - DNA, 22 bp, Artificial Sequence
  chemically synthesized
ccaagctacctttaactggact

SEQ ID NO: 1375913 - DNA, 22 bp, Artificial Sequence
  chemically synthesized
cttcttccttgagtccagttaa

SEQ ID NO: 1375914 - DNA, 22 bp, Artificial Sequence
  chemically synthesized
ttcttccttgagtccagttaaa

SEQ ID NO: 1375915 - DNA, 22 bp, Artificial Sequence
  chemically synthesized
ctcccaagctacctttaactgg

SEQ ID NO: 1375916 - DNA, 22 bp, Artificial Sequence
  chemically synthesized
cttccttgagtccagttaaagg

SEQ ID NO: 1375917 - DNA, 22 bp, Artificial Sequence
  chemically synthesized
ttccttgagtccagttaaaggt

SEQ ID NO: 1375918 - DNA, 22 bp, Artificial Sequence
  chemically synthesized
ccttgagtccagttaaaggtag

SEQ ID NO: 1375919 - DNA, 22 bp, Artificial Sequence
  chemically synthesized
cttgagtccagttaaaggtagc

SEQ ID NO: 1375920 - DNA, 22 bp, Artificial Sequence
  chemically synthesized
agtattgctcccaagctacctt

SEQ ID NO: 1375921 - DNA, 22 bp, Artificial Sequence
  chemically synthesized
gagtccagttaaaggtagcttg

SEQ ID NO: 1375922 - DNA, 22 bp, Artificial Sequence
  chemically synthesized
gagtattgctcccaagctacct

SEQ ID NO: 1375923 - DNA, 22 bp, Artificial Sequence
  chemically synthesized
agtccagttaaaggtagcttgg

SEQ ID NO: 1375924 - DNA, 22 bp, Artificial Sequence
  chemically synthesized
aaggtagcttgggagcaatact

SEQ ID NO: 1375925 - DNA, 22 bp, Artificial Sequence
  chemically synthesized
catgtgatgtgacttgagtatt

SEQ ID NO: 1375926 - DNA, 22 bp, Artificial Sequence
  chemically synthesized
actacatgtgatgtgacttgag

SEQ ID NO: 1375927 - DNA, 22 bp, Artificial Sequence
  chemically synthesized
aactacatgtgatgtgacttga

SEQ ID NO: 1375928 - DNA, 22 bp, Artificial Sequence
  chemically synthesized
gggagcaatactcaagtcacat

SEQ ID NO: 1375929 - DNA, 22 bp, Artificial Sequence
  chemically synthesized
ggagcaatactcaagtcacatc

SEQ ID NO: 1375930 - DNA, 22 bp, Artificial Sequence
  chemically synthesized
aagtcacatcacatgtagttaa

SEQ ID NO: 1375931 - DNA, 22 bp, Artificial Sequence
  chemically synthesized
ggaatataaaagtttaactaca

SEQ ID NO: 1375932 - DNA, 22 bp, Artificial Sequence
  chemically synthesized
attcggaatataaaagtttaac

SEQ ID NO: 1375933 - DNA, 22 bp, Artificial Sequence
  chemically synthesized
aaggactgattcggaatataaa

SEQ ID NO: 1375934 - DNA, 22 bp, Artificial Sequence
  chemically synthesized
aaaggactgattcggaatataa

SEQ ID NO: 1375935 - DNA, 22 bp, Artificial Sequence
  chemically synthesized
cttaaaggactgattcggaata

SEQ ID NO: 1375936 - DNA, 22 bp, Artificial Sequence
  chemically synthesized
acttaaaggactgattcggaat

SEQ ID NO: 1375937 - DNA, 22 bp, Artificial Sequence
  chemically synthesized
aacttttatattccgaatcagt

SEQ ID NO: 1375938 - DNA, 22 bp, Artificial Sequence
  chemically synthesized
tcttacttaaaggactgattcg

SEQ ID NO: 1375939 - DNA, 22 bp, Artificial Sequence
  chemically synthesized
ttatattccgaatcagtccttt

SEQ ID NO: 1375940 - DNA, 22 bp, Artificial Sequence
  chemically synthesized
gctgtcttacttaaaggactga

SEQ ID NO: 1375941 - DNA, 22 bp, Artificial Sequence
  chemically synthesized
tatattccgaatcagtccttta

SEQ ID NO: 1375942 - DNA, 22 bp, Artificial Sequence
  chemically synthesized
atattccgaatcagtcctttaa

SEQ ID NO: 1375943 - DNA, 22 bp, Artificial Sequence
  chemically synthesized
tattccgaatcagtcctttaag

SEQ ID NO: 1375944 - DNA, 22 bp, Artificial Sequence
  chemically synthesized
cgaatcagtcctttaagtaaga

SEQ ID NO: 1375945 - DNA, 22 bp, Artificial Sequence
  chemically synthesized
tcaacccctggctgtcttactt

SEQ ID NO: 1375946 - DNA, 22 bp, Artificial Sequence
  chemically synthesized
atcaacccctggctgtcttact

SEQ ID NO: 1375947 - DNA, 22 bp, Artificial Sequence
  chemically synthesized
gtttatcaacccctggctgtct

SEQ ID NO: 1375948 - DNA, 22 bp, Artificial Sequence
  chemically synthesized
gttagtttatcaacccctggct

SEQ ID NO: 1375949 - DNA, 22 bp, Artificial Sequence
  chemically synthesized
ggttagtttatcaacccctggc

SEQ ID NO: 1375950 - DNA, 22 bp, Artificial Sequence
  chemically synthesized
taagtaagacagccaggggttg

SEQ ID NO: 1375951 - DNA, 22 bp, Artificial Sequence
  chemically synthesized
tggttagtttatcaacccctgg

SEQ ID NO: 1375952 - DNA, 22 bp, Artificial Sequence
  chemically synthesized
aagtaagacagccaggggttga

SEQ ID NO: 1375953 - DNA, 22 bp, Artificial Sequence
  chemically synthesized
agtaagacagccaggggttgat

SEQ ID NO: 1375954 - DNA, 22 bp, Artificial Sequence
  chemically synthesized
ataaactaaccaaaatcctatc

SEQ ID NO: 1375955 - DNA, 22 bp, Artificial Sequence
  chemically synthesized
taatggatgtgacggataggat

SEQ ID NO: 1375956 - DNA, 22 bp, Artificial Sequence
  chemically synthesized
gtaatggatgtgacggatagga

SEQ ID NO: 1375957 - DNA, 22 bp, Artificial Sequence
  chemically synthesized
accaaaatcctatccgtcacat

SEQ ID NO: 1375958 - DNA, 22 bp, Artificial Sequence
  chemically synthesized
taatgcttgtaatggatgtgac

SEQ ID NO: 1375959 - DNA, 22 bp, Artificial Sequence
  chemically synthesized
cattgtaatgcttgtaatggat

SEQ ID NO: 1375960 - DNA, 22 bp, Artificial Sequence
  chemically synthesized
ttacattgtaatgcttgtaatg

SEQ ID NO: 1375961 - DNA, 22 bp, Artificial Sequence
  chemically synthesized
tccgtcacatccattacaagca

SEQ ID NO: 1375962 - DNA, 22 bp, Artificial Sequence
  chemically synthesized
tctgttacattgtaatgcttgt

SEQ ID NO: 1375963 - DNA, 22 bp, Artificial Sequence
  chemically synthesized
aggttatctgttacattgtaat

SEQ ID NO: 1375964 - DNA, 22 bp, Artificial Sequence
  chemically synthesized
caagcattacaatgtaacagat

SEQ ID NO: 1375965 - DNA, 22 bp, Artificial Sequence
  chemically synthesized
caatgtaacagataacctgaat

SEQ ID NO: 1375966 - DNA, 22 bp, Artificial Sequence
  chemically synthesized
agaatataagaaacaaaatata

SEQ ID NO: 1375967 - DNA, 22 bp, Artificial Sequence
  chemically synthesized
aagaatataagaaacaaaatat

SEQ ID NO: 1375968 - DNA, 22 bp, Artificial Sequence
  chemically synthesized
aattttcttatatattttgttt

SEQ ID NO: 1375969 - DNA, 22 bp, Artificial Sequence
  chemically synthesized
taagaatataagaaacaaaata

SEQ ID NO: 1375970 - DNA, 22 bp, Artificial Sequence
  chemically synthesized
tcttatatattttgtttcttat

SEQ ID NO: 1375971 - DNA, 22 bp, Artificial Sequence
  chemically synthesized
aattttaagaatataagaaaca

SEQ ID NO: 1375972 - DNA, 22 bp, Artificial Sequence
  chemically synthesized
cttatatattttgtttcttata

SEQ ID NO: 1375973 - DNA, 22 bp, Artificial Sequence
  chemically synthesized
ttatatattttgtttcttatat

SEQ ID NO: 1375974 - DNA, 22 bp, Artificial Sequence
  chemically synthesized
ctaaattttaagaatataagaa

SEQ ID NO: 1375975 - DNA, 22 bp, Artificial Sequence
  chemically synthesized
atatattttgtttcttatattc

SEQ ID NO: 1375976 - DNA, 22 bp, Artificial Sequence
  chemically synthesized
tatattttgtttcttatattct

SEQ ID NO: 1375977 - DNA, 22 bp, Artificial Sequence
  chemically synthesized
ctactaaattttaagaatataa

SEQ ID NO: 1375978 - DNA, 22 bp, Artificial Sequence
  chemically synthesized
gctactaaattttaagaatata

SEQ ID NO: 1375979 - DNA, 22 bp, Artificial Sequence
  chemically synthesized
tgtttcttatattcttaaaatt

SEQ ID NO: 1375980 - DNA, 22 bp, Artificial Sequence
  chemically synthesized
gtttcttatattcttaaaattt

SEQ ID NO: 1375981 - DNA, 22 bp, Artificial Sequence
  chemically synthesized
tttcttatattcttaaaattta

SEQ ID NO: 1375982 - DNA, 22 bp, Artificial Sequence
  chemically synthesized
cttatattcttaaaatttagta

SEQ ID NO: 1375983 - DNA, 22 bp, Artificial Sequence
  chemically synthesized
ttatattcttaaaatttagtag

SEQ ID NO: 1375984 - DNA, 22 bp, Artificial Sequence
  chemically synthesized
atattcttaaaatttagtagca

SEQ ID NO: 1375985 - DNA, 22 bp, Artificial Sequence
  chemically synthesized
tattcttaaaatttagtagcaa

SEQ ID NO: 1375986 - DNA, 22 bp, Artificial Sequence
  chemically synthesized
aatgaacatgtatttgctacta

SEQ ID NO: 1375987 - DNA, 22 bp, Artificial Sequence
  chemically synthesized
ttaaaatttagtagcaaataca

SEQ ID NO: 1375988 - DNA, 22 bp, Artificial Sequence
  chemically synthesized
aaaatttagtagcaaatacatg

SEQ ID NO: 1375989 - DNA, 22 bp, Artificial Sequence
  chemically synthesized
aaatttagtagcaaatacatgt

SEQ ID NO: 1375990 - DNA, 22 bp, Artificial Sequence
  chemically synthesized
agtagcaaatacatgttcattc

SEQ ID NO: 1375991 - DNA, 22 bp, Artificial Sequence
  chemically synthesized
aataggcaaattgaatgaacat

SEQ ID NO: 1375992 - DNA, 22 bp, Artificial Sequence
  chemically synthesized
gtagcaaatacatgttcattca

SEQ ID NO: 1375993 - DNA, 22 bp, Artificial Sequence
  chemically synthesized
caataggcaaattgaatgaaca

SEQ ID NO: 1375994 - DNA, 22 bp, Artificial Sequence
  chemically synthesized
tcaataggcaaattgaatgaac

SEQ ID NO: 1375995 - DNA, 22 bp, Artificial Sequence
  chemically synthesized
aatatgataaattttcaatagg

SEQ ID NO: 1375996 - DNA, 22 bp, Artificial Sequence
  chemically synthesized
attcaatttgcctattgaaaat

SEQ ID NO: 1375997 - DNA, 22 bp, Artificial Sequence
  chemically synthesized
aatttgcctattgaaaatttat

SEQ ID NO: 1375998 - DNA, 22 bp, Artificial Sequence
  chemically synthesized
cccaaagctaaatatgataaat

SEQ ID NO: 1375999 - DNA, 22 bp, Artificial Sequence
  chemically synthesized
gcctattgaaaatttatcatat

SEQ ID NO: 1376000 - DNA, 22 bp, Artificial Sequence
  chemically synthesized
ccccaaagctaaatatgataaa

SEQ ID NO: 1376001 - DNA, 22 bp, Artificial Sequence
  chemically synthesized
cctattgaaaatttatcatatt

SEQ ID NO: 1376002 - DNA, 22 bp, Artificial Sequence
  chemically synthesized
ttgaaaatttatcatatttagc

SEQ ID NO: 1376003 - DNA, 22 bp, Artificial Sequence
  chemically synthesized
aaaatttatcatatttagcttt

SEQ ID NO: 1376004 - DNA, 22 bp, Artificial Sequence
  chemically synthesized
aaaatatttccccaaagctaaa

SEQ ID NO: 1376005 - DNA, 22 bp, Artificial Sequence
  chemically synthesized
atcatatttagctttggggaaa

SEQ ID NO: 1376006 - DNA, 22 bp, Artificial Sequence
  chemically synthesized
tcatatttagctttggggaaat

SEQ ID NO: 1376007 - DNA, 22 bp, Artificial Sequence
  chemically synthesized
aaaaattaaaaatatttcccca

SEQ ID NO: 1376008 - DNA, 22 bp, Artificial Sequence
  chemically synthesized
aatctcaaaaattaaaaatatt

SEQ ID NO: 1376009 - DNA, 22 bp, Artificial Sequence
  chemically synthesized
agctttggggaaatatttttaa

SEQ ID NO: 1376010 - DNA, 22 bp, Artificial Sequence
  chemically synthesized
caatctcaaaaattaaaaatat

SEQ ID NO: 1376011 - DNA, 22 bp, Artificial Sequence
  chemically synthesized
gctttggggaaatatttttaat

SEQ ID NO: 1376012 - DNA, 22 bp, Artificial Sequence
  chemically synthesized
tggggaaatatttttaattttt

SEQ ID NO: 1376013 - DNA, 22 bp, Artificial Sequence
  chemically synthesized
tatttcaatctcaaaaattaaa

SEQ ID NO: 1376014 - DNA, 22 bp, Artificial Sequence
  chemically synthesized
ggggaaatatttttaatttttg

SEQ ID NO: 1376015 - DNA, 22 bp, Artificial Sequence
  chemically synthesized
atatttcaatctcaaaaattaa

SEQ ID NO: 1376016 - DNA, 22 bp, Artificial Sequence
  chemically synthesized
gggaaatatttttaatttttga

SEQ ID NO: 1376017 - DNA, 22 bp, Artificial Sequence
  chemically synthesized
tatatttcaatctcaaaaatta

SEQ ID NO: 1376018 - DNA, 22 bp, Artificial Sequence
  chemically synthesized
ttaatttttgagattgaaatat

SEQ ID NO: 1376019 - DNA, 22 bp, Artificial Sequence
  chemically synthesized
acagagtattttatatttcaat

SEQ ID NO: 1376020 - DNA, 22 bp, Artificial Sequence
  chemically synthesized
taatttttgagattgaaatata

SEQ ID NO: 1376021 - DNA, 22 bp, Artificial Sequence
  chemically synthesized
aatttttgagattgaaatataa

SEQ ID NO: 1376022 - DNA, 22 bp, Artificial Sequence
  chemically synthesized
atttttgagattgaaatataaa

SEQ ID NO: 1376023 - DNA, 22 bp, Artificial Sequence
  chemically synthesized
tactaacagagtattttatatt

SEQ ID NO: 1376024 - DNA, 22 bp, Artificial Sequence
  chemically synthesized
ttgagattgaaatataaaatac

SEQ ID NO: 1376025 - DNA, 22 bp, Artificial Sequence
  chemically synthesized
tgagattgaaatataaaatact

SEQ ID NO: 1376026 - DNA, 22 bp, Artificial Sequence
  chemically synthesized
gagattgaaatataaaatactc

SEQ ID NO: 1376027 - DNA, 22 bp, Artificial Sequence
  chemically synthesized
agattgaaatataaaatactct

SEQ ID NO: 1376028 - DNA, 22 bp, Artificial Sequence
  chemically synthesized
ggaattgtactaacagagtatt

SEQ ID NO: 1376029 - DNA, 22 bp, Artificial Sequence
  chemically synthesized
taggaattgtactaacagagta

SEQ ID NO: 1376030 - DNA, 22 bp, Artificial Sequence
  chemically synthesized
aaatataaaatactctgttagt

SEQ ID NO: 1376031 - DNA, 22 bp, Artificial Sequence
  chemically synthesized
aatatattctaggaattgtact

SEQ ID NO: 1376032 - DNA, 22 bp, Artificial Sequence
  chemically synthesized
tgttagtacaattcctagaata

SEQ ID NO: 1376033 - DNA, 22 bp, Artificial Sequence
  chemically synthesized
ttagtacaattcctagaatata

SEQ ID NO: 1376034 - DNA, 22 bp, Artificial Sequence
  chemically synthesized
gtacaattcctagaatatattt

SEQ ID NO: 1376035 - DNA, 22 bp, Artificial Sequence
  chemically synthesized
ctagaatatatttaacttctgt

SEQ ID NO: 1376036 - DNA, 22 bp, Artificial Sequence
  chemically synthesized
aacatatggagtacagaagtta

SEQ ID NO: 1376037 - DNA, 22 bp, Artificial Sequence
  chemically synthesized
taaacatatggagtacagaagt

SEQ ID NO: 1376038 - DNA, 22 bp, Artificial Sequence
  chemically synthesized
gaatatatttaacttctgtact

SEQ ID NO: 1376039 - DNA, 22 bp, Artificial Sequence
  chemically synthesized
ctaaacatatggagtacagaag

SEQ ID NO: 1376040 - DNA, 22 bp, Artificial Sequence
  chemically synthesized
ttctaaacatatggagtacaga

SEQ ID NO: 1376041 - DNA, 22 bp, Artificial Sequence
  chemically synthesized
attcttctaaacatatggagta

SEQ ID NO: 1376042 - DNA, 22 bp, Artificial Sequence
  chemically synthesized
tcattcttctaaacatatggag

SEQ ID NO: 1376043 - DNA, 22 bp, Artificial Sequence
  chemically synthesized
ctcattcttctaaacatatgga

SEQ ID NO: 1376044 - DNA, 22 bp, Artificial Sequence
  chemically synthesized
aacttctgtactccatatgttt

SEQ ID NO: 1376045 - DNA, 22 bp, Artificial Sequence
  chemically synthesized
acttctgtactccatatgttta

SEQ ID NO: 1376046 - DNA, 22 bp, Artificial Sequence
  chemically synthesized
ctgtactccatatgtttagaag

SEQ ID NO: 1376047 - DNA, 22 bp, Artificial Sequence
  chemically synthesized
tgtactccatatgtttagaaga

SEQ ID NO: 1376048 - DNA, 22 bp, Artificial Sequence
  chemically synthesized
tactccatatgtttagaagaat

SEQ ID NO: 1376049 - DNA, 22 bp, Artificial Sequence
  chemically synthesized
aatacacttctcattcttctaa

SEQ ID NO: 1376050 - DNA, 22 bp, Artificial Sequence
  chemically synthesized
caatacacttctcattcttcta

SEQ ID NO: 1376051 - DNA, 22 bp, Artificial Sequence
  chemically synthesized
tcaatacacttctcattcttct

SEQ ID NO: 1376052 - DNA, 22 bp, Artificial Sequence
  chemically synthesized
catatgtttagaagaatgagaa

SEQ ID NO: 1376053 - DNA, 22 bp, Artificial Sequence
  chemically synthesized
agaagaatgagaagtgtattga

SEQ ID NO: 1376054 - DNA, 22 bp, Artificial Sequence
  chemically synthesized
gaagaatgagaagtgtattgaa

SEQ ID NO: 1376055 - DNA, 22 bp, Artificial Sequence
  chemically synthesized
taagatacaattttcaatacac

SEQ ID NO: 1376056 - DNA, 22 bp, Artificial Sequence
  chemically synthesized
tagtagaacaactataagatac

SEQ ID NO: 1376057 - DNA, 22 bp, Artificial Sequence
  chemically synthesized
atagtagaacaactataagata

SEQ ID NO: 1376058 - DNA, 22 bp, Artificial Sequence
  chemically synthesized
tatagtagaacaactataagat

SEQ ID NO: 1376059 - DNA, 22 bp, Artificial Sequence
  chemically synthesized
aaaattgtatcttatagttgtt

SEQ ID NO: 1376060 - DNA, 22 bp, Artificial Sequence
  chemically synthesized
gttttatagtagaacaactata

SEQ ID NO: 1376061 - DNA, 22 bp, Artificial Sequence
  chemically synthesized
caattggttttatagtagaaca

SEQ ID NO: 1376062 - DNA, 22 bp, Artificial Sequence
  chemically synthesized
tatcttatagttgttctactat

SEQ ID NO: 1376063 - DNA, 22 bp, Artificial Sequence
  chemically synthesized
acaattggttttatagtagaac

SEQ ID NO: 1376064 - DNA, 22 bp, Artificial Sequence
  chemically synthesized
atagttgttctactataaaacc

SEQ ID NO: 1376065 - DNA, 22 bp, Artificial Sequence
  chemically synthesized
tagttgttctactataaaacca

SEQ ID NO: 1376066 - DNA, 22 bp, Artificial Sequence
  chemically synthesized
aatgatatttacaattggtttt

SEQ ID NO: 1376067 - DNA, 22 bp, Artificial Sequence
  chemically synthesized
ttctactataaaaccaattgta

SEQ ID NO: 1376068 - DNA, 22 bp, Artificial Sequence
  chemically synthesized
tactataaaaccaattgtaaat

SEQ ID NO: 1376069 - DNA, 22 bp, Artificial Sequence
  chemically synthesized
tccattgaatgatatttacaat

SEQ ID NO: 1376070 - DNA, 22 bp, Artificial Sequence
  chemically synthesized
ctataaaaccaattgtaaatat

SEQ ID NO: 1376071 - DNA, 22 bp, Artificial Sequence
  chemically synthesized
atccattgaatgatatttacaa

SEQ ID NO: 1376072 - DNA, 22 bp, Artificial Sequence
  chemically synthesized
taaaaccaattgtaaatatcat

SEQ ID NO: 1376073 - DNA, 22 bp, Artificial Sequence
  chemically synthesized
taaatatcattcaatggataaa

SEQ ID NO: 1376074 - DNA, 22 bp, Artificial Sequence
  chemically synthesized
aatggataaattattattatca

SEQ ID NO: 1376075 - DNA, 22 bp, Artificial Sequence
  chemically synthesized
aataacaataacaacaatgata

SEQ ID NO: 1376076 - DNA, 22 bp, Artificial Sequence
  chemically synthesized
ggattaaataacaataacaaca

SEQ ID NO: 1376077 - DNA, 22 bp, Artificial Sequence
  chemically synthesized
gggattaaataacaataacaac

SEQ ID NO: 1376078 - DNA, 22 bp, Artificial Sequence
  chemically synthesized
ttattatcattgttgttattgt

SEQ ID NO: 1376079 - DNA, 22 bp, Artificial Sequence
  chemically synthesized
ttatcattgttgttattgttat

SEQ ID NO: 1376080 - DNA, 22 bp, Artificial Sequence
  chemically synthesized
tcattgttgttattgttattta

SEQ ID NO: 1376081 - DNA, 22 bp, Artificial Sequence
  chemically synthesized
ttgttattgttatttaatccca

SEQ ID NO: 1376082 - DNA, 22 bp, Artificial Sequence
  chemically synthesized
agtagaccaatttgggattaaa

SEQ ID NO: 1376083 - DNA, 22 bp, Artificial Sequence
  chemically synthesized
ttattgttatttaatcccaaat

SEQ ID NO: 1376084 - DNA, 22 bp, Artificial Sequence
  chemically synthesized
ttgttatttaatcccaaattgg

SEQ ID NO: 1376085 - DNA, 22 bp, Artificial Sequence
  chemically synthesized
ttatttaatcccaaattggtct

SEQ ID NO: 1376086 - DNA, 22 bp, Artificial Sequence
  chemically synthesized
gccacattaagtagaccaattt

SEQ ID NO: 1376087 - DNA, 22 bp, Artificial Sequence
  chemically synthesized
agccacattaagtagaccaatt

SEQ ID NO: 1376088 - DNA, 22 bp, Artificial Sequence
  chemically synthesized
tagccacattaagtagaccaat

SEQ ID NO: 1376089 - DNA, 22 bp, Artificial Sequence
  chemically synthesized
tttaatcccaaattggtctact

SEQ ID NO: 1376090 - DNA, 22 bp, Artificial Sequence
  chemically synthesized
aatcccaaattggtctacttaa

SEQ ID NO: 1376091 - DNA, 22 bp, Artificial Sequence
  chemically synthesized
atcccaaattggtctacttaat

SEQ ID NO: 1376092 - DNA, 22 bp, Artificial Sequence
  chemically synthesized
tgagaaattttagccacattaa

SEQ ID NO: 1376093 - DNA, 22 bp, Artificial Sequence
  chemically synthesized
gtctacttaatgtggctaaaat

SEQ ID NO: 1376094 - DNA, 22 bp, Artificial Sequence
  chemically synthesized
gagtctatgagaaattttagcc

SEQ ID NO: 1376095 - DNA, 22 bp, Artificial Sequence
  chemically synthesized
cttaatgtggctaaaatttctc

SEQ ID NO: 1376096 - DNA, 22 bp, Artificial Sequence
  chemically synthesized
aattagagtctatgagaaattt

SEQ ID NO: 1376097 - DNA, 22 bp, Artificial Sequence
  chemically synthesized
aatgtggctaaaatttctcata

SEQ ID NO: 1376098 - DNA, 22 bp, Artificial Sequence
  chemically synthesized
tgaattagagtctatgagaaat

SEQ ID NO: 1376099 - DNA, 22 bp, Artificial Sequence
  chemically synthesized
atgtggctaaaatttctcatag

SEQ ID NO: 1376100 - DNA, 22 bp, Artificial Sequence
  chemically synthesized
ctgaattagagtctatgagaaa

SEQ ID NO: 1376101 - DNA, 22 bp, Artificial Sequence
  chemically synthesized
tctgaattagagtctatgagaa

SEQ ID NO: 1376102 - DNA, 22 bp, Artificial Sequence
  chemically synthesized
aaatttctcatagactctaatt

SEQ ID NO: 1376103 - DNA, 22 bp, Artificial Sequence
  chemically synthesized
ctcatagactctaattcagaaa

SEQ ID NO: 1376104 - DNA, 22 bp, Artificial Sequence
  chemically synthesized
tcatagactctaattcagaaaa

SEQ ID NO: 1376105 - DNA, 22 bp, Artificial Sequence
  chemically synthesized
aaacaaaatatattttctgaat

SEQ ID NO: 1376106 - DNA, 22 bp, Artificial Sequence
  chemically synthesized
aaaacaaaatatattttctgaa

SEQ ID NO: 1376107 - DNA, 22 bp, Artificial Sequence
  chemically synthesized
atagactctaattcagaaaata

SEQ ID NO: 1376108 - DNA, 22 bp, Artificial Sequence
  chemically synthesized
taattcagaaaatatattttgt

SEQ ID NO: 1376109 - DNA, 22 bp, Artificial Sequence
  chemically synthesized
attcagaaaatatattttgttt

SEQ ID NO: 1376110 - DNA, 22 bp, Artificial Sequence
  chemically synthesized
gtgcaaataacttaaaacaaaa

SEQ ID NO: 1376111 - DNA, 22 bp, Artificial Sequence
  chemically synthesized
agaaaatatattttgttttaag

SEQ ID NO: 1376112 - DNA, 22 bp, Artificial Sequence
  chemically synthesized
tcacaagtagttagtgcaaata

SEQ ID NO: 1376113 - DNA, 22 bp, Artificial Sequence
  chemically synthesized
tgttttaagttatttgcactaa

SEQ ID NO: 1376114 - DNA, 22 bp, Artificial Sequence
  chemically synthesized
gttttaagttatttgcactaac

SEQ ID NO: 1376115 - DNA, 22 bp, Artificial Sequence
  chemically synthesized
ttttaagttatttgcactaact

SEQ ID NO: 1376116 - DNA, 22 bp, Artificial Sequence
  chemically synthesized
taagttatttgcactaactact

SEQ ID NO: 1376117 - DNA, 22 bp, Artificial Sequence
  chemically synthesized
aagttatttgcactaactactt

SEQ ID NO: 1376118 - DNA, 22 bp, Artificial Sequence
  chemically synthesized
aatatctatcacaagtagttag

SEQ ID NO: 1376119 - DNA, 22 bp, Artificial Sequence
  chemically synthesized
agttatttgcactaactacttg

SEQ ID NO: 1376120 - DNA, 22 bp, Artificial Sequence
  chemically synthesized
aaatatctatcacaagtagtta

SEQ ID NO: 1376121 - DNA, 22 bp, Artificial Sequence
  chemically synthesized
taaatatctatcacaagtagtt

SEQ ID NO: 1376122 - DNA, 22 bp, Artificial Sequence
  chemically synthesized
ttaaatatctatcacaagtagt

SEQ ID NO: 1376123 - DNA, 22 bp, Artificial Sequence
  chemically synthesized
tttgcactaactacttgtgata

SEQ ID NO: 1376124 - DNA, 22 bp, Artificial Sequence
  chemically synthesized
gcactaactacttgtgatagat

SEQ ID NO: 1376125 - DNA, 22 bp, Artificial Sequence
  chemically synthesized
cactaactacttgtgatagata

SEQ ID NO: 1376126 - DNA, 22 bp, Artificial Sequence
  chemically synthesized
actacttgtgatagatatttaa

SEQ ID NO: 1376127 - DNA, 22 bp, Artificial Sequence
  chemically synthesized
cttgtgatagatatttaaaaat

SEQ ID NO: 1376128 - DNA, 22 bp, Artificial Sequence
  chemically synthesized
gtgatagatatttaaaaatata

SEQ ID NO: 1376129 - DNA, 22 bp, Artificial Sequence
  chemically synthesized
tgatagatatttaaaaatatat

SEQ ID NO: 1376130 - DNA, 22 bp, Artificial Sequence
  chemically synthesized
aggatgagtcacatatattttt

SEQ ID NO: 1376131 - DNA, 22 bp, Artificial Sequence
  chemically synthesized
ttcaggatgagtcacatatatt

SEQ ID NO: 1376132 - DNA, 22 bp, Artificial Sequence
  chemically synthesized
aaaaatatatgtgactcatcct

SEQ ID NO: 1376133 - DNA, 22 bp, Artificial Sequence
  chemically synthesized
aaaatatatgtgactcatcctg

SEQ ID NO: 1376134 - DNA, 22 bp, Artificial Sequence
  chemically synthesized
tgcataaaatcactattcagga

SEQ ID NO: 1376135 - DNA, 22 bp, Artificial Sequence
  chemically synthesized
cagctgtgcataaaatcactat

SEQ ID NO: 1376136 - DNA, 22 bp, Artificial Sequence
  chemically synthesized
atcctgaatagtgattttatgc

SEQ ID NO: 1376137 - DNA, 22 bp, Artificial Sequence
  chemically synthesized
catctacagctgtgcataaaat

SEQ ID NO: 1376138 - DNA, 22 bp, Artificial Sequence
  chemically synthesized
gcatctacagctgtgcataaaa

SEQ ID NO: 1376139 - DNA, 22 bp, Artificial Sequence
  chemically synthesized
aatagtgattttatgcacagct

SEQ ID NO: 1376140 - DNA, 22 bp, Artificial Sequence
  chemically synthesized
atttgcatctacagctgtgcat

SEQ ID NO: 1376141 - DNA, 22 bp, Artificial Sequence
  chemically synthesized
catttgcatctacagctgtgca

SEQ ID NO: 1376142 - DNA, 22 bp, Artificial Sequence
  chemically synthesized
tatgcacagctgtagatgcaaa

SEQ ID NO: 1376143 - DNA, 22 bp, Artificial Sequence
  chemically synthesized
atgcacagctgtagatgcaaat

SEQ ID NO: 1376144 - DNA, 22 bp, Artificial Sequence
  chemically synthesized
tgcacagctgtagatgcaaatg

SEQ ID NO: 1376145 - DNA, 22 bp, Artificial Sequence
  chemically synthesized
ataaatatacttcatttgcatc

SEQ ID NO: 1376146 - DNA, 22 bp, Artificial Sequence
  chemically synthesized
gttaataaatatacttcatttg

SEQ ID NO: 1376147 - DNA, 22 bp, Artificial Sequence
  chemically synthesized
ttagttaataaatatacttcat

SEQ ID NO: 1376148 - DNA, 22 bp, Artificial Sequence
  chemically synthesized
gttagttaataaatatacttca

SEQ ID NO: 1376149 - DNA, 22 bp, Artificial Sequence
  chemically synthesized
tagatgcaaatgaagtatattt

SEQ ID NO: 1376150 - DNA, 22 bp, Artificial Sequence
  chemically synthesized
tagcatttgttagttaataaat

SEQ ID NO: 1376151 - DNA, 22 bp, Artificial Sequence
  chemically synthesized
atagcatttgttagttaataaa

SEQ ID NO: 1376152 - DNA, 22 bp, Artificial Sequence
  chemically synthesized
attaactaacaaatgctataag

SEQ ID NO: 1376153 - DNA, 22 bp, Artificial Sequence
  chemically synthesized
ttaactaacaaatgctataagc

SEQ ID NO: 1376154 - DNA, 22 bp, Artificial Sequence
  chemically synthesized
ccaacataaaaatgcttatagc

SEQ ID NO: 1376155 - DNA, 22 bp, Artificial Sequence
  chemically synthesized
accaacataaaaatgcttatag

SEQ ID NO: 1376156 - DNA, 22 bp, Artificial Sequence
  chemically synthesized
actaacaaatgctataagcatt

SEQ ID NO: 1376157 - DNA, 22 bp, Artificial Sequence
  chemically synthesized
atttaccaacataaaaatgctt

SEQ ID NO: 1376158 - DNA, 22 bp, Artificial Sequence
  chemically synthesized
acaaatgctataagcattttta

SEQ ID NO: 1376159 - DNA, 22 bp, Artificial Sequence
  chemically synthesized
aatttaccaacataaaaatgct

SEQ ID NO: 1376160 - DNA, 22 bp, Artificial Sequence
  chemically synthesized
taagcatttttatgttggtaaa

SEQ ID NO: 1376161 - DNA, 22 bp, Artificial Sequence
  chemically synthesized
tcatgcaacccagtcttaattt

SEQ ID NO: 1376162 - DNA, 22 bp, Artificial Sequence
  chemically synthesized
ttatgttggtaaattaagactg

SEQ ID NO: 1376163 - DNA, 22 bp, Artificial Sequence
  chemically synthesized
tatgttggtaaattaagactgg

SEQ ID NO: 1376164 - DNA, 22 bp, Artificial Sequence
  chemically synthesized
atgttggtaaattaagactggg

SEQ ID NO: 1376165 - DNA, 22 bp, Artificial Sequence
  chemically synthesized
tgttggtaaattaagactgggt

SEQ ID NO: 1376166 - DNA, 22 bp, Artificial Sequence
  chemically synthesized
aactatcatgcaacccagtctt

SEQ ID NO: 1376167 - DNA, 22 bp, Artificial Sequence
  chemically synthesized
gtaaattaagactgggttgcat

SEQ ID NO: 1376168 - DNA, 22 bp, Artificial Sequence
  chemically synthesized
aattcaactatcatgcaaccca

SEQ ID NO: 1376169 - DNA, 22 bp, Artificial Sequence
  chemically synthesized
tgaattaaattcaactatcatg

SEQ ID NO: 1376170 - DNA, 22 bp, Artificial Sequence
  chemically synthesized
agactgggttgcatgatagttg

SEQ ID NO: 1376171 - DNA, 22 bp, Artificial Sequence
  chemically synthesized
tatgaattaaattcaactatca

SEQ ID NO: 1376172 - DNA, 22 bp, Artificial Sequence
  chemically synthesized
ggttgcatgatagttgaattta

SEQ ID NO: 1376173 - DNA, 22 bp, Artificial Sequence
  chemically synthesized
tgttctatgaattaaattcaac

SEQ ID NO: 1376174 - DNA, 22 bp, Artificial Sequence
  chemically synthesized
catgatagttgaatttaattca

SEQ ID NO: 1376175 - DNA, 22 bp, Artificial Sequence
  chemically synthesized
ataattgtgttctatgaattaa

SEQ ID NO: 1376176 - DNA, 22 bp, Artificial Sequence
  chemically synthesized
aatttaattcatagaacacaat

SEQ ID NO: 1376177 - DNA, 22 bp, Artificial Sequence
  chemically synthesized
gggtagttgataattgtgttct

SEQ ID NO: 1376178 - DNA, 22 bp, Artificial Sequence
  chemically synthesized
agggtagttgataattgtgttc

SEQ ID NO: 1376179 - DNA, 22 bp, Artificial Sequence
  chemically synthesized
tagggtagttgataattgtgtt

SEQ ID NO: 1376180 - DNA, 22 bp, Artificial Sequence
  chemically synthesized
aattcatagaacacaattatca

SEQ ID NO: 1376181 - DNA, 22 bp, Artificial Sequence
  chemically synthesized
ttttagggtagttgataattgt

SEQ ID NO: 1376182 - DNA, 22 bp, Artificial Sequence
  chemically synthesized
attcatagaacacaattatcaa

SEQ ID NO: 1376183 - DNA, 22 bp, Artificial Sequence
  chemically synthesized
atagaacacaattatcaactac

SEQ ID NO: 1376184 - DNA, 22 bp, Artificial Sequence
  chemically synthesized
tgtaaattattttagggtagtt

SEQ ID NO: 1376185 - DNA, 22 bp, Artificial Sequence
  chemically synthesized
tcatagttatgtaaattatttt

SEQ ID NO: 1376186 - DNA, 22 bp, Artificial Sequence
  chemically synthesized
tcaactaccctaaaataattta

SEQ ID NO: 1376187 - DNA, 22 bp, Artificial Sequence
  chemically synthesized
gtcatagttatgtaaattattt

SEQ ID NO: 1376188 - DNA, 22 bp, Artificial Sequence
  chemically synthesized
ccctaaaataatttacataact

SEQ ID NO: 1376189 - DNA, 22 bp, Artificial Sequence
  chemically synthesized
atataacttgtcatagttatgt

SEQ ID NO: 1376190 - DNA, 22 bp, Artificial Sequence
  chemically synthesized
gatataacttgtcatagttatg

SEQ ID NO: 1376191 - DNA, 22 bp, Artificial Sequence
  chemically synthesized
tgatataacttgtcatagttat

SEQ ID NO: 1376192 - DNA, 22 bp, Artificial Sequence
  chemically synthesized
aaataatttacataactatgac

SEQ ID NO: 1376193 - DNA, 22 bp, Artificial Sequence
  chemically synthesized
acataactatgacaagttatat

SEQ ID NO: 1376194 - DNA, 22 bp, Artificial Sequence
  chemically synthesized
cataactatgacaagttatatc

SEQ ID NO: 1376195 - DNA, 22 bp, Artificial Sequence
  chemically synthesized
agagtaaattttgatataactt

SEQ ID NO: 1376196 - DNA, 22 bp, Artificial Sequence
  chemically synthesized
gagagtaaattttgatataact

SEQ ID NO: 1376197 - DNA, 22 bp, Artificial Sequence
  chemically synthesized
atttgagagtaaattttgatat

SEQ ID NO: 1376198 - DNA, 22 bp, Artificial Sequence
  chemically synthesized
aatttgagagtaaattttgata

SEQ ID NO: 1376199 - DNA, 22 bp, Artificial Sequence
  chemically synthesized
tgacaagttatatcaaaattta

SEQ ID NO: 1376200 - DNA, 22 bp, Artificial Sequence
  chemically synthesized
tatcaaaatttactctcaaatt

SEQ ID NO: 1376201 - DNA, 22 bp, Artificial Sequence
  chemically synthesized
aataaccaacttaatttgagag

SEQ ID NO: 1376202 - DNA, 22 bp, Artificial Sequence
  chemically synthesized
gaataaccaacttaatttgaga

SEQ ID NO: 1376203 - DNA, 22 bp, Artificial Sequence
  chemically synthesized
tgaataaccaacttaatttgag

SEQ ID NO: 1376204 - DNA, 22 bp, Artificial Sequence
  chemically synthesized
actctcaaattaagttggttat

SEQ ID NO: 1376205 - DNA, 22 bp, Artificial Sequence
  chemically synthesized
ctctcaaattaagttggttatt

SEQ ID NO: 1376206 - DNA, 22 bp, Artificial Sequence
  chemically synthesized
tcaaattaagttggttattcaa

SEQ ID NO: 1376207 - DNA, 22 bp, Artificial Sequence
  chemically synthesized
aaattaagttggttattcaaaa

SEQ ID NO: 1376208 - DNA, 22 bp, Artificial Sequence
  chemically synthesized
agttggttattcaaaatattca

SEQ ID NO: 1376209 - DNA, 22 bp, Artificial Sequence
  chemically synthesized
gttattcaaaatattcattttt

SEQ ID NO: 1376210 - DNA, 22 bp, Artificial Sequence
  chemically synthesized
tacagaatggacataaaaatga

SEQ ID NO: 1376211 - DNA, 22 bp, Artificial Sequence
  chemically synthesized
atacagaatggacataaaaatg

SEQ ID NO: 1376212 - DNA, 22 bp, Artificial Sequence
  chemically synthesized
ttcaaaatattcatttttatgt

SEQ ID NO: 1376213 - DNA, 22 bp, Artificial Sequence
  chemically synthesized
aaaatattcatttttatgtcca

SEQ ID NO: 1376214 - DNA, 22 bp, Artificial Sequence
  chemically synthesized
tatttatacagaatggacataa

SEQ ID NO: 1376215 - DNA, 22 bp, Artificial Sequence
  chemically synthesized
gtatttatacagaatggacata

SEQ ID NO: 1376216 - DNA, 22 bp, Artificial Sequence
  chemically synthesized
atttttatgtccattctgtata

SEQ ID NO: 1376217 - DNA, 22 bp, Artificial Sequence
  chemically synthesized
ttatgtccattctgtataaata

SEQ ID NO: 1376218 - DNA, 22 bp, Artificial Sequence
  chemically synthesized
tatgtccattctgtataaatac

SEQ ID NO: 1376219 - DNA, 22 bp, Artificial Sequence
  chemically synthesized
atgtccattctgtataaataca

SEQ ID NO: 1376220 - DNA, 22 bp, Artificial Sequence
  chemically synthesized
tgtccattctgtataaatacaa

SEQ ID NO: 1376221 - DNA, 22 bp, Artificial Sequence
  chemically synthesized
cagtatggcaatcacttgtatt

SEQ ID NO: 1376222 - DNA, 22 bp, Artificial Sequence
  chemically synthesized
acagtatggcaatcacttgtat

SEQ ID NO: 1376223 - DNA, 22 bp, Artificial Sequence
  chemically synthesized
tgtataaatacaagtgattgcc

SEQ ID NO: 1376224 - DNA, 22 bp, Artificial Sequence
  chemically synthesized
tataaatacaagtgattgccat

SEQ ID NO: 1376225 - DNA, 22 bp, Artificial Sequence
  chemically synthesized
tgagcatgagtcttacagtatg

SEQ ID NO: 1376226 - DNA, 22 bp, Artificial Sequence
  chemically synthesized
cattatgagcatgagtcttaca

SEQ ID NO: 1376227 - DNA, 22 bp, Artificial Sequence
  chemically synthesized
tccattatgagcatgagtctta

SEQ ID NO: 1376228 - DNA, 22 bp, Artificial Sequence
  chemically synthesized
ttctccattatgagcatgagtc

SEQ ID NO: 1376229 - DNA, 22 bp, Artificial Sequence
  chemically synthesized
ccatactgtaagactcatgctc

SEQ ID NO: 1376230 - DNA, 22 bp, Artificial Sequence
  chemically synthesized
attctccattatgagcatgagt

SEQ ID NO: 1376231 - DNA, 22 bp, Artificial Sequence
  chemically synthesized
tttattctccattatgagcatg

SEQ ID NO: 1376232 - DNA, 22 bp, Artificial Sequence
  chemically synthesized
taagactcatgctcataatgga

SEQ ID NO: 1376233 - DNA, 22 bp, Artificial Sequence
  chemically synthesized
atgctcataatggagaataaat

SEQ ID NO: 1376234 - DNA, 22 bp, Artificial Sequence
  chemically synthesized
ataatggagaataaataatatt

SEQ ID NO: 1376235 - DNA, 22 bp, Artificial Sequence
  chemically synthesized
tattgtatttatttatttattt

SEQ ID NO: 1376236 - DNA, 22 bp, Artificial Sequence
  chemically synthesized
attgtatttatttatttattta

SEQ ID NO: 1376237 - DNA, 22 bp, Artificial Sequence
  chemically synthesized
ttgtatttatttatttatttac

SEQ ID NO: 1376238 - DNA, 22 bp, Artificial Sequence
  chemically synthesized
aaaaaaataaataagtaaataa

SEQ ID NO: 1376239 - DNA, 22 bp, Artificial Sequence
  chemically synthesized
tatttatttatttatttactta

SEQ ID NO: 1376240 - DNA, 22 bp, Artificial Sequence
  chemically synthesized
atttatttatttacttatttat

SEQ ID NO: 1376241 - DNA, 22 bp, Artificial Sequence
  chemically synthesized
catctcaaaaaaataaataagt

SEQ ID NO: 1376242 - DNA, 22 bp, Artificial Sequence
  chemically synthesized
tttatttatttacttatttatt

SEQ ID NO: 1376243 - DNA, 22 bp, Artificial Sequence
  chemically synthesized
atttatttacttatttattttt

SEQ ID NO: 1376244 - DNA, 22 bp, Artificial Sequence
  chemically synthesized
tttatttacttatttatttttt

SEQ ID NO: 1376245 - DNA, 22 bp, Artificial Sequence
  chemically synthesized
atttacttatttatttttttga

SEQ ID NO: 1376246 - DNA, 22 bp, Artificial Sequence
  chemically synthesized
tttacttatttatttttttgag

SEQ ID NO: 1376247 - DNA, 22 bp, Artificial Sequence
  chemically synthesized
acttatttatttttttgagatg

SEQ ID NO: 1376248 - DNA, 22 bp, Artificial Sequence
  chemically synthesized
cttatttatttttttgagatgg

SEQ ID NO: 1376249 - DNA, 22 bp, Artificial Sequence
  chemically synthesized
atttatttttttgagatggagc

SEQ ID NO: 1376250 - DNA, 22 bp, Artificial Sequence
  chemically synthesized
tttatttttttgagatggagcc

SEQ ID NO: 1376251 - DNA, 22 bp, Artificial Sequence
  chemically synthesized
ggccacagagcgaggctccatc

SEQ ID NO: 1376252 - DNA, 22 bp, Artificial Sequence
  chemically synthesized
atttttttgagatggagcctcg

SEQ ID NO: 1376253 - DNA, 22 bp, Artificial Sequence
  chemically synthesized
tttttttgagatggagcctcgc

SEQ ID NO: 1376254 - DNA, 22 bp, Artificial Sequence
  chemically synthesized
ttttgagatggagcctcgctct

SEQ ID NO: 1376255 - DNA, 22 bp, Artificial Sequence
  chemically synthesized
tttgagatggagcctcgctctg

SEQ ID NO: 1376256 - DNA, 22 bp, Artificial Sequence
  chemically synthesized
cagcctgggccacagagcgagg

SEQ ID NO: 1376257 - DNA, 22 bp, Artificial Sequence
  chemically synthesized
ttgagatggagcctcgctctgt

SEQ ID NO: 1376258 - DNA, 22 bp, Artificial Sequence
  chemically synthesized
tgagatggagcctcgctctgtg

SEQ ID NO: 1376259 - DNA, 22 bp, Artificial Sequence
  chemically synthesized
gagatggagcctcgctctgtgg

SEQ ID NO: 1376260 - DNA, 22 bp, Artificial Sequence
  chemically synthesized
agatggagcctcgctctgtggc

SEQ ID NO: 1376261 - DNA, 22 bp, Artificial Sequence
  chemically synthesized
gctctgtggcccaggctggagt

SEQ ID NO: 1376262 - DNA, 22 bp, Artificial Sequence
  chemically synthesized
agatcgcgccaccgcactccag

SEQ ID NO: 1376263 - DNA, 22 bp, Artificial Sequence
  chemically synthesized
tgtggcccaggctggagtgcgg

SEQ ID NO: 1376264 - DNA, 22 bp, Artificial Sequence
  chemically synthesized
tggcccaggctggagtgcggtg

SEQ ID NO: 1376265 - DNA, 22 bp, Artificial Sequence
  chemically synthesized
cagtgagctgagatcgcgccac

SEQ ID NO: 1376266 - DNA, 22 bp, Artificial Sequence
  chemically synthesized
acagtgagctgagatcgcgcca

SEQ ID NO: 1376267 - DNA, 22 bp, Artificial Sequence
  chemically synthesized
gagtgcggtggcgcgatctcag

SEQ ID NO: 1376268 - DNA, 22 bp, Artificial Sequence
  chemically synthesized
agctcactgtaagctccgcctc

SEQ ID NO: 1376269 - DNA, 22 bp, Artificial Sequence
  chemically synthesized
actgtaagctccgcctcccggg

SEQ ID NO: 1376270 - DNA, 22 bp, Artificial Sequence
  chemically synthesized
taagctccgcctcccgggttca

SEQ ID NO: 1376271 - DNA, 22 bp, Artificial Sequence
  chemically synthesized
aggcaggagaatggtgtgaacc

SEQ ID NO: 1376272 - DNA, 22 bp, Artificial Sequence
  chemically synthesized
cgcctcccgggttcacaccatt

SEQ ID NO: 1376273 - DNA, 22 bp, Artificial Sequence
  chemically synthesized
ccgggttcacaccattctcctg

SEQ ID NO: 1376274 - DNA, 22 bp, Artificial Sequence
  chemically synthesized
gggaggctgaggcaggagaatg

SEQ ID NO: 1376275 - DNA, 22 bp, Artificial Sequence
  chemically synthesized
ctggggaggctgaggcaggaga

SEQ ID NO: 1376276 - DNA, 22 bp, Artificial Sequence
  chemically synthesized
acaccattctcctgcctcagcc

SEQ ID NO: 1376277 - DNA, 22 bp, Artificial Sequence
  chemically synthesized
tagtcgcagctactggggaggc

SEQ ID NO: 1376278 - DNA, 22 bp, Artificial Sequence
  chemically synthesized
tcctgcctcagcctccccagta

SEQ ID NO: 1376279 - DNA, 22 bp, Artificial Sequence
  chemically synthesized
ctgcctcagcctccccagtagc

SEQ ID NO: 1376280 - DNA, 22 bp, Artificial Sequence
  chemically synthesized
cctcagcctccccagtagctgc

SEQ ID NO: 1376281 - DNA, 22 bp, Artificial Sequence
  chemically synthesized
agcctccccagtagctgcgact

SEQ ID NO: 1376282 - DNA, 22 bp, Artificial Sequence
  chemically synthesized
cccagtagctgcgactacaggc

SEQ ID NO: 1376283 - DNA, 22 bp, Artificial Sequence
  chemically synthesized
gtcaggcgtggtggcgggtgcc

SEQ ID NO: 1376284 - DNA, 22 bp, Artificial Sequence
  chemically synthesized
cgactacaggcacccgccacca

SEQ ID NO: 1376285 - DNA, 22 bp, Artificial Sequence
  chemically synthesized
caggcacccgccaccacgcctg

SEQ ID NO: 1376286 - DNA, 22 bp, Artificial Sequence
  chemically synthesized
aaaatacaaaaaattagtcagg

SEQ ID NO: 1376287 - DNA, 22 bp, Artificial Sequence
  chemically synthesized
tactaaaaatacaaaaaattag

SEQ ID NO: 1376288 - DNA, 22 bp, Artificial Sequence
  chemically synthesized
actaattttttgtatttttagt

SEQ ID NO: 1376289 - DNA, 22 bp, Artificial Sequence
  chemically synthesized
attttttgtatttttagtatag

SEQ ID NO: 1376290 - DNA, 22 bp, Artificial Sequence
  chemically synthesized
tttgtatttttagtatagacgt

SEQ ID NO: 1376291 - DNA, 22 bp, Artificial Sequence
  chemically synthesized
ttgtatttttagtatagacgtg

SEQ ID NO: 1376292 - DNA, 22 bp, Artificial Sequence
  chemically synthesized
acacggtgaaaccacgtctata

SEQ ID NO: 1376293 - DNA, 22 bp, Artificial Sequence
  chemically synthesized
tgtatttttagtatagacgtgg

SEQ ID NO: 1376294 - DNA, 22 bp, Artificial Sequence
  chemically synthesized
gtatttttagtatagacgtggt

SEQ ID NO: 1376295 - DNA, 22 bp, Artificial Sequence
  chemically synthesized
tatttttagtatagacgtggtt

SEQ ID NO: 1376296 - DNA, 22 bp, Artificial Sequence
  chemically synthesized
gctaacacggtgaaaccacgtc

SEQ ID NO: 1376297 - DNA, 22 bp, Artificial Sequence
  chemically synthesized
ttagtatagacgtggtttcacc

SEQ ID NO: 1376298 - DNA, 22 bp, Artificial Sequence
  chemically synthesized
tagtatagacgtggtttcaccg

SEQ ID NO: 1376299 - DNA, 22 bp, Artificial Sequence
  chemically synthesized
agtatagacgtggtttcaccgt

SEQ ID NO: 1376300 - DNA, 22 bp, Artificial Sequence
  chemically synthesized
gtatagacgtggtttcaccgtg

SEQ ID NO: 1376301 - DNA, 22 bp, Artificial Sequence
  chemically synthesized
caccgtgttagccaggatggtc

SEQ ID NO: 1376302 - DNA, 22 bp, Artificial Sequence
  chemically synthesized
accgtgttagccaggatggtct

SEQ ID NO: 1376303 - DNA, 22 bp, Artificial Sequence
  chemically synthesized
gccaggatggtctcgatctcct

SEQ ID NO: 1376304 - DNA, 22 bp, Artificial Sequence
  chemically synthesized
aggtgggcggatcatgaggtca

SEQ ID NO: 1376305 - DNA, 22 bp, Artificial Sequence
  chemically synthesized
gatctcctgacctcatgatccg

SEQ ID NO: 1376306 - DNA, 22 bp, Artificial Sequence
  chemically synthesized
ggaggctgaggtgggcggatca

SEQ ID NO: 1376307 - DNA, 22 bp, Artificial Sequence
  chemically synthesized
gggaggctgaggtgggcggatc

SEQ ID NO: 1376308 - DNA, 22 bp, Artificial Sequence
  chemically synthesized
tgggaggctgaggtgggcggat

SEQ ID NO: 1376309 - DNA, 22 bp, Artificial Sequence
  chemically synthesized
ctgacctcatgatccgcccacc

SEQ ID NO: 1376310 - DNA, 22 bp, Artificial Sequence
  chemically synthesized
acctcatgatccgcccacctca

SEQ ID NO: 1376311 - DNA, 22 bp, Artificial Sequence
  chemically synthesized
atgatccgcccacctcagcctc

SEQ ID NO: 1376312 - DNA, 22 bp, Artificial Sequence
  chemically synthesized
taatcccagcactttgggaggc

SEQ ID NO: 1376313 - DNA, 22 bp, Artificial Sequence
  chemically synthesized
acgcctgtaatcccagcacttt

SEQ ID NO: 1376314 - DNA, 22 bp, Artificial Sequence
  chemically synthesized
agcctcccaaagtgctgggatt

SEQ ID NO: 1376315 - DNA, 22 bp, Artificial Sequence
  chemically synthesized
ccaaagtgctgggattacaggc

SEQ ID NO: 1376316 - DNA, 22 bp, Artificial Sequence
  chemically synthesized
gcggccaggcgcagtggctcac

SEQ ID NO: 1376317 - DNA, 22 bp, Artificial Sequence
  chemically synthesized
ggattacaggcgtgagccactg

SEQ ID NO: 1376318 - DNA, 22 bp, Artificial Sequence
  chemically synthesized
tcgcggccaggcgcagtggctc

SEQ ID NO: 1376319 - DNA, 22 bp, Artificial Sequence
  chemically synthesized
ttctcgcggccaggcgcagtgg

SEQ ID NO: 1376320 - DNA, 22 bp, Artificial Sequence
  chemically synthesized
attctcgcggccaggcgcagtg

SEQ ID NO: 1376321 - DNA, 22 bp, Artificial Sequence
  chemically synthesized
caggcgtgagccactgcgcctg

SEQ ID NO: 1376322 - DNA, 22 bp, Artificial Sequence
  chemically synthesized
tttattctcgcggccaggcgca

SEQ ID NO: 1376323 - DNA, 22 bp, Artificial Sequence
  chemically synthesized
gaaaatattatttattctcgcg

SEQ ID NO: 1376324 - DNA, 22 bp, Artificial Sequence
  chemically synthesized
agaaaatattatttattctcgc

SEQ ID NO: 1376325 - DNA, 22 bp, Artificial Sequence
  chemically synthesized
ttagaaaatattatttattctc

SEQ ID NO: 1376326 - DNA, 22 bp, Artificial Sequence
  chemically synthesized
cgcctggccgcgagaataaata

SEQ ID NO: 1376327 - DNA, 22 bp, Artificial Sequence
  chemically synthesized
cttagaaaatattatttattct

SEQ ID NO: 1376328 - DNA, 22 bp, Artificial Sequence
  chemically synthesized
tcttagaaaatattatttattc

SEQ ID NO: 1376329 - DNA, 22 bp, Artificial Sequence
  chemically synthesized
attttcttagaaaatattattt

SEQ ID NO: 1376330 - DNA, 22 bp, Artificial Sequence
  chemically synthesized
gccgcgagaataaataatattt

SEQ ID NO: 1376331 - DNA, 22 bp, Artificial Sequence
  chemically synthesized
aaagttaattttcttagaaaat

SEQ ID NO: 1376332 - DNA, 22 bp, Artificial Sequence
  chemically synthesized
ggtgaaaaattaaaagttaatt

SEQ ID NO: 1376333 - DNA, 22 bp, Artificial Sequence
  chemically synthesized
aggtgaaaaattaaaagttaat

SEQ ID NO: 1376334 - DNA, 22 bp, Artificial Sequence
  chemically synthesized
taggtgaaaaattaaaagttaa

SEQ ID NO: 1376335 - DNA, 22 bp, Artificial Sequence
  chemically synthesized
ttaggtgaaaaattaaaagtta

SEQ ID NO: 1376336 - DNA, 22 bp, Artificial Sequence
  chemically synthesized
tctaagaaaattaacttttaat

SEQ ID NO: 1376337 - DNA, 22 bp, Artificial Sequence
  chemically synthesized
ctaagaaaattaacttttaatt

SEQ ID NO: 1376338 - DNA, 22 bp, Artificial Sequence
  chemically synthesized
taagaaaattaacttttaattt

SEQ ID NO: 1376339 - DNA, 22 bp, Artificial Sequence
  chemically synthesized
agaaaattaacttttaattttt

SEQ ID NO: 1376340 - DNA, 22 bp, Artificial Sequence
  chemically synthesized
ggatttttaggtgaaaaattaa

SEQ ID NO: 1376341 - DNA, 22 bp, Artificial Sequence
  chemically synthesized
acttttaatttttcacctaaaa

SEQ ID NO: 1376342 - DNA, 22 bp, Artificial Sequence
  chemically synthesized
ttaatttttcacctaaaaatcc

SEQ ID NO: 1376343 - DNA, 22 bp, Artificial Sequence
  chemically synthesized
taatttttcacctaaaaatcct

SEQ ID NO: 1376344 - DNA, 22 bp, Artificial Sequence
  chemically synthesized
aatttttcacctaaaaatccta

SEQ ID NO: 1376345 - DNA, 22 bp, Artificial Sequence
  chemically synthesized
atttttcacctaaaaatcctaa

SEQ ID NO: 1376346 - DNA, 22 bp, Artificial Sequence
  chemically synthesized
ttcacctaaaaatcctaatttt

SEQ ID NO: 1376347 - DNA, 22 bp, Artificial Sequence
  chemically synthesized
tcacctaaaaatcctaattttc

SEQ ID NO: 1376348 - DNA, 22 bp, Artificial Sequence
  chemically synthesized
cacctaaaaatcctaattttcc

SEQ ID NO: 1376349 - DNA, 22 bp, Artificial Sequence
  chemically synthesized
atagaaaaaaatggaaaattag

SEQ ID NO: 1376350 - DNA, 22 bp, Artificial Sequence
  chemically synthesized
acctaaaaatcctaattttcca

SEQ ID NO: 1376351 - DNA, 22 bp, Artificial Sequence
  chemically synthesized
ctcatagaaaaaaatggaaaat

SEQ ID NO: 1376352 - DNA, 22 bp, Artificial Sequence
  chemically synthesized
cctcatagaaaaaaatggaaaa

SEQ ID NO: 1376353 - DNA, 22 bp, Artificial Sequence
  chemically synthesized
aaaatcctaattttccattttt

SEQ ID NO: 1376354 - DNA, 22 bp, Artificial Sequence
  chemically synthesized
attttccatttttttctatgag

SEQ ID NO: 1376355 - DNA, 22 bp, Artificial Sequence
  chemically synthesized
tccatttttttctatgaggaaa

SEQ ID NO: 1376356 - DNA, 22 bp, Artificial Sequence
  chemically synthesized
ccatttttttctatgaggaaat

SEQ ID NO: 1376357 - DNA, 22 bp, Artificial Sequence
  chemically synthesized
catttttttctatgaggaaatt

SEQ ID NO: 1376358 - DNA, 22 bp, Artificial Sequence
  chemically synthesized
ttttctatgaggaaattatcat

SEQ ID NO: 1376359 - DNA, 22 bp, Artificial Sequence
  chemically synthesized
tttctatgaggaaattatcatt

SEQ ID NO: 1376360 - DNA, 22 bp, Artificial Sequence
  chemically synthesized
ttctatgaggaaattatcatta

SEQ ID NO: 1376361 - DNA, 22 bp, Artificial Sequence
  chemically synthesized
tctatgaggaaattatcattat

SEQ ID NO: 1376362 - DNA, 22 bp, Artificial Sequence
  chemically synthesized
ctatgaggaaattatcattatt

SEQ ID NO: 1376363 - DNA, 22 bp, Artificial Sequence
  chemically synthesized
aaacaaaaataaaataatgata

SEQ ID NO: 1376364 - DNA, 22 bp, Artificial Sequence
  chemically synthesized
tatgaggaaattatcattattt

SEQ ID NO: 1376365 - DNA, 22 bp, Artificial Sequence
  chemically synthesized
aaaacaaaaataaaataatgat

SEQ ID NO: 1376366 - DNA, 22 bp, Artificial Sequence
  chemically synthesized
taaaacaaaaataaaataatga

SEQ ID NO: 1376367 - DNA, 22 bp, Artificial Sequence
  chemically synthesized
tgaggaaattatcattatttta

SEQ ID NO: 1376368 - DNA, 22 bp, Artificial Sequence
  chemically synthesized
ttaaaacaaaaataaaataatg

SEQ ID NO: 1376369 - DNA, 22 bp, Artificial Sequence
  chemically synthesized
tttttaaaacaaaaataaaata

SEQ ID NO: 1376370 - DNA, 22 bp, Artificial Sequence
  chemically synthesized
gtttttaaaacaaaaataaaat

SEQ ID NO: 1376371 - DNA, 22 bp, Artificial Sequence
  chemically synthesized
tcattattttatttttgtttta

SEQ ID NO: 1376372 - DNA, 22 bp, Artificial Sequence
  chemically synthesized
tgaaacttgtttttaaaacaaa

SEQ ID NO: 1376373 - DNA, 22 bp, Artificial Sequence
  chemically synthesized
tctgtgaaacttgtttttaaaa

SEQ ID NO: 1376374 - DNA, 22 bp, Artificial Sequence
  chemically synthesized
ttttatttttgttttaaaaaca

SEQ ID NO: 1376375 - DNA, 22 bp, Artificial Sequence
  chemically synthesized
ctatctgtgaaacttgttttta

SEQ ID NO: 1376376 - DNA, 22 bp, Artificial Sequence
  chemically synthesized
tatttttgttttaaaaacaagt

SEQ ID NO: 1376377 - DNA, 22 bp, Artificial Sequence
  chemically synthesized
atttttgttttaaaaacaagtt

SEQ ID NO: 1376378 - DNA, 22 bp, Artificial Sequence
  chemically synthesized
tttttgttttaaaaacaagttt

SEQ ID NO: 1376379 - DNA, 22 bp, Artificial Sequence
  chemically synthesized
ttgttttaaaaacaagtttcac

SEQ ID NO: 1376380 - DNA, 22 bp, Artificial Sequence
  chemically synthesized
tgttttaaaaacaagtttcaca

SEQ ID NO: 1376381 - DNA, 22 bp, Artificial Sequence
  chemically synthesized
gttttaaaaacaagtttcacag

SEQ ID NO: 1376382 - DNA, 22 bp, Artificial Sequence
  chemically synthesized
ttttaaaaacaagtttcacaga

SEQ ID NO: 1376383 - DNA, 22 bp, Artificial Sequence
  chemically synthesized
taaaaacaagtttcacagatag

SEQ ID NO: 1376384 - DNA, 22 bp, Artificial Sequence
  chemically synthesized
aaaaacaagtttcacagatagg

SEQ ID NO: 1376385 - DNA, 22 bp, Artificial Sequence
  chemically synthesized
aaaacaagtttcacagatagga

SEQ ID NO: 1376386 - DNA, 22 bp, Artificial Sequence
  chemically synthesized
cacagataggagtatgttgtgt

SEQ ID NO: 1376387 - DNA, 22 bp, Artificial Sequence
  chemically synthesized
acagataggagtatgttgtgtg

SEQ ID NO: 1376388 - DNA, 22 bp, Artificial Sequence
  chemically synthesized
tgtgctctattttattttttca

SEQ ID NO: 1376389 - DNA, 22 bp, Artificial Sequence
  chemically synthesized
tattttattttttcacccattt

SEQ ID NO: 1376390 - DNA, 22 bp, Artificial Sequence
  chemically synthesized
ttttattttttcacccattttt

SEQ ID NO: 1376391 - DNA, 22 bp, Artificial Sequence
  chemically synthesized
tattttttcacccatttttatt

SEQ ID NO: 1376392 - DNA, 22 bp, Artificial Sequence
  chemically synthesized
attttttcacccatttttattc

SEQ ID NO: 1376393 - DNA, 22 bp, Artificial Sequence
  chemically synthesized
ttttttcacccatttttattct

SEQ ID NO: 1376394 - DNA, 22 bp, Artificial Sequence
  chemically synthesized
aaaataaaatgtgagaataaaa

SEQ ID NO: 1376395 - DNA, 22 bp, Artificial Sequence
  chemically synthesized
tttcacccatttttattctcac

SEQ ID NO: 1376396 - DNA, 22 bp, Artificial Sequence
  chemically synthesized
ttcacccatttttattctcaca

SEQ ID NO: 1376397 - DNA, 22 bp, Artificial Sequence
  chemically synthesized
ctaaaaataaaatgtgagaata

SEQ ID NO: 1376398 - DNA, 22 bp, Artificial Sequence
  chemically synthesized
tcacccatttttattctcacat

SEQ ID NO: 1376399 - DNA, 22 bp, Artificial Sequence
  chemically synthesized
actaaaaataaaatgtgagaat

SEQ ID NO: 1376400 - DNA, 22 bp, Artificial Sequence
  chemically synthesized
cacccatttttattctcacatt

SEQ ID NO: 1376401 - DNA, 22 bp, Artificial Sequence
  chemically synthesized
tactaaaaataaaatgtgagaa

SEQ ID NO: 1376402 - DNA, 22 bp, Artificial Sequence
  chemically synthesized
acccatttttattctcacattt

SEQ ID NO: 1376403 - DNA, 22 bp, Artificial Sequence
  chemically synthesized
gttttactaaaaataaaatgtg

SEQ ID NO: 1376404 - DNA, 22 bp, Artificial Sequence
  chemically synthesized
ttattctcacattttattttta

SEQ ID NO: 1376405 - DNA, 22 bp, Artificial Sequence
  chemically synthesized
tattctcacattttatttttag

SEQ ID NO: 1376406 - DNA, 22 bp, Artificial Sequence
  chemically synthesized
attctcacattttatttttagt

SEQ ID NO: 1376407 - DNA, 22 bp, Artificial Sequence
  chemically synthesized
ttctcacattttatttttagta

SEQ ID NO: 1376408 - DNA, 22 bp, Artificial Sequence
  chemically synthesized
tcacattttatttttagtaaaa

SEQ ID NO: 1376409 - DNA, 22 bp, Artificial Sequence
  chemically synthesized
acattttatttttagtaaaact

SEQ ID NO: 1376410 - DNA, 22 bp, Artificial Sequence
  chemically synthesized
taaaaaaatgacaattagtttt

SEQ ID NO: 1376411 - DNA, 22 bp, Artificial Sequence
  chemically synthesized
tatttttagtaaaactaattgt

SEQ ID NO: 1376412 - DNA, 22 bp, Artificial Sequence
  chemically synthesized
atttttagtaaaactaattgtc

SEQ ID NO: 1376413 - DNA, 22 bp, Artificial Sequence
  chemically synthesized
tttttagtaaaactaattgtca

SEQ ID NO: 1376414 - DNA, 22 bp, Artificial Sequence
  chemically synthesized
gtctgtaaaaaaatgacaatta

SEQ ID NO: 1376415 - DNA, 22 bp, Artificial Sequence
  chemically synthesized
ttagtaaaactaattgtcattt

SEQ ID NO: 1376416 - DNA, 22 bp, Artificial Sequence
  chemically synthesized
tggtctgtaaaaaaatgacaat

SEQ ID NO: 1376417 - DNA, 22 bp, Artificial Sequence
  chemically synthesized
tagtaaaactaattgtcatttt

SEQ ID NO: 1376418 - DNA, 22 bp, Artificial Sequence
  chemically synthesized
ctggtctgtaaaaaaatgacaa

SEQ ID NO: 1376419 - DNA, 22 bp, Artificial Sequence
  chemically synthesized
agtaaaactaattgtcattttt

SEQ ID NO: 1376420 - DNA, 22 bp, Artificial Sequence
  chemically synthesized
gtaaaactaattgtcatttttt

SEQ ID NO: 1376421 - DNA, 22 bp, Artificial Sequence
  chemically synthesized
agagtttctggtctgtaaaaaa

SEQ ID NO: 1376422 - DNA, 22 bp, Artificial Sequence
  chemically synthesized
cagagtttctggtctgtaaaaa

SEQ ID NO: 1376423 - DNA, 22 bp, Artificial Sequence
  chemically synthesized
tcagagtttctggtctgtaaaa

SEQ ID NO: 1376424 - DNA, 22 bp, Artificial Sequence
  chemically synthesized
attgtcatttttttacagacca

SEQ ID NO: 1376425 - DNA, 22 bp, Artificial Sequence
  chemically synthesized
attttcagagtttctggtctgt

SEQ ID NO: 1376426 - DNA, 22 bp, Artificial Sequence
  chemically synthesized
tcatttttttacagaccagaaa

SEQ ID NO: 1376427 - DNA, 22 bp, Artificial Sequence
  chemically synthesized
taattttcagagtttctggtct

SEQ ID NO: 1376428 - DNA, 22 bp, Artificial Sequence
  chemically synthesized
ctaattttcagagtttctggtc

SEQ ID NO: 1376429 - DNA, 22 bp, Artificial Sequence
  chemically synthesized
tctaattttcagagtttctggt

SEQ ID NO: 1376430 - DNA, 22 bp, Artificial Sequence
  chemically synthesized
ttttacagaccagaaactctga

SEQ ID NO: 1376431 - DNA, 22 bp, Artificial Sequence
  chemically synthesized
tttacagaccagaaactctgaa

SEQ ID NO: 1376432 - DNA, 22 bp, Artificial Sequence
  chemically synthesized
ttacagaccagaaactctgaaa

SEQ ID NO: 1376433 - DNA, 22 bp, Artificial Sequence
  chemically synthesized
tacagaccagaaactctgaaaa

SEQ ID NO: 1376434 - DNA, 22 bp, Artificial Sequence
  chemically synthesized
acagaccagaaactctgaaaat

SEQ ID NO: 1376435 - DNA, 22 bp, Artificial Sequence
  chemically synthesized
cagaccagaaactctgaaaatt

SEQ ID NO: 1376436 - DNA, 22 bp, Artificial Sequence
  chemically synthesized
atgaatgtcactttctaatttt

SEQ ID NO: 1376437 - DNA, 22 bp, Artificial Sequence
  chemically synthesized
cattcatgaatgtcactttcta

SEQ ID NO: 1376438 - DNA, 22 bp, Artificial Sequence
  chemically synthesized
tgaaaattagaaagtgacattc

SEQ ID NO: 1376439 - DNA, 22 bp, Artificial Sequence
  chemically synthesized
aaaattagaaagtgacattcat

SEQ ID NO: 1376440 - DNA, 22 bp, Artificial Sequence
  chemically synthesized
ataactacattcatgaatgtca

SEQ ID NO: 1376441 - DNA, 22 bp, Artificial Sequence
  chemically synthesized
aataactacattcatgaatgtc

SEQ ID NO: 1376442 - DNA, 22 bp, Artificial Sequence
  chemically synthesized
taataactacattcatgaatgt

SEQ ID NO: 1376443 - DNA, 22 bp, Artificial Sequence
  chemically synthesized
ttaataactacattcatgaatg

SEQ ID NO: 1376444 - DNA, 22 bp, Artificial Sequence
  chemically synthesized
tttaataactacattcatgaat

SEQ ID NO: 1376445 - DNA, 22 bp, Artificial Sequence
  chemically synthesized
gaaagtgacattcatgaatgta

SEQ ID NO: 1376446 - DNA, 22 bp, Artificial Sequence
  chemically synthesized
atgaatgtagttattaaaaaat

SEQ ID NO: 1376447 - DNA, 22 bp, Artificial Sequence
  chemically synthesized
tgaaagatggagagtatttttt

SEQ ID NO: 1376448 - DNA, 22 bp, Artificial Sequence
  chemically synthesized
ctgtgaaagatggagagtattt

SEQ ID NO: 1376449 - DNA, 22 bp, Artificial Sequence
  chemically synthesized
ttcctgtgaaagatggagagta

SEQ ID NO: 1376450 - DNA, 22 bp, Artificial Sequence
  chemically synthesized
attcctgtgaaagatggagagt

SEQ ID NO: 1376451 - DNA, 22 bp, Artificial Sequence
  chemically synthesized
ttaaaaaatactctccatcttt

SEQ ID NO: 1376452 - DNA, 22 bp, Artificial Sequence
  chemically synthesized
aaaaatactctccatctttcac

SEQ ID NO: 1376453 - DNA, 22 bp, Artificial Sequence
  chemically synthesized
acatttattcctgtgaaagatg

SEQ ID NO: 1376454 - DNA, 22 bp, Artificial Sequence
  chemically synthesized
taacatttattcctgtgaaaga

SEQ ID NO: 1376455 - DNA, 22 bp, Artificial Sequence
  chemically synthesized
ctaacatttattcctgtgaaag

SEQ ID NO: 1376456 - DNA, 22 bp, Artificial Sequence
  chemically synthesized
tccatctttcacaggaataaat

SEQ ID NO: 1376457 - DNA, 22 bp, Artificial Sequence
  chemically synthesized
catctttcacaggaataaatgt

SEQ ID NO: 1376458 - DNA, 22 bp, Artificial Sequence
  chemically synthesized
tcacaggaataaatgttagaag

SEQ ID NO: 1376459 - DNA, 22 bp, Artificial Sequence
  chemically synthesized
cacaggaataaatgttagaagt

SEQ ID NO: 1376460 - DNA, 22 bp, Artificial Sequence
  chemically synthesized
acaggaataaatgttagaagta

SEQ ID NO: 1376461 - DNA, 22 bp, Artificial Sequence
  chemically synthesized
tgccataaataagcatacttct

SEQ ID NO: 1376462 - DNA, 22 bp, Artificial Sequence
  chemically synthesized
gtaattatgccataaataagca

SEQ ID NO: 1376463 - DNA, 22 bp, Artificial Sequence
  chemically synthesized
tggtaattatgccataaataag

SEQ ID NO: 1376464 - DNA, 22 bp, Artificial Sequence
  chemically synthesized
ctctggtaattatgccataaat

SEQ ID NO: 1376465 - DNA, 22 bp, Artificial Sequence
  chemically synthesized
gaagtatgcttatttatggcat

SEQ ID NO: 1376466 - DNA, 22 bp, Artificial Sequence
  chemically synthesized
cctctggtaattatgccataaa

SEQ ID NO: 1376467 - DNA, 22 bp, Artificial Sequence
  chemically synthesized
ttcctctggtaattatgccata

SEQ ID NO: 1376468 - DNA, 22 bp, Artificial Sequence
  chemically synthesized
tcttcctctggtaattatgcca

SEQ ID NO: 1376469 - DNA, 22 bp, Artificial Sequence
  chemically synthesized
ctcttcctctggtaattatgcc

SEQ ID NO: 1376470 - DNA, 22 bp, Artificial Sequence
  chemically synthesized
tctcttcctctggtaattatgc

SEQ ID NO: 1376471 - DNA, 22 bp, Artificial Sequence
  chemically synthesized
atttatggcataattaccagag

SEQ ID NO: 1376472 - DNA, 22 bp, Artificial Sequence
  chemically synthesized
tttatggcataattaccagagg

SEQ ID NO: 1376473 - DNA, 22 bp, Artificial Sequence
  chemically synthesized
atggcataattaccagaggaag

SEQ ID NO: 1376474 - DNA, 22 bp, Artificial Sequence
  chemically synthesized
tggcataattaccagaggaaga

SEQ ID NO: 1376475 - DNA, 22 bp, Artificial Sequence
  chemically synthesized
ataggataattttctcttcctc

SEQ ID NO: 1376476 - DNA, 22 bp, Artificial Sequence
  chemically synthesized
aattgataggataattttctct

SEQ ID NO: 1376477 - DNA, 22 bp, Artificial Sequence
  chemically synthesized
ccagaggaagagaaaattatcc

SEQ ID NO: 1376478 - DNA, 22 bp, Artificial Sequence
  chemically synthesized
gataaaattcaattgataggat

SEQ ID NO: 1376479 - DNA, 22 bp, Artificial Sequence
  chemically synthesized
tagataaaattcaattgatagg

SEQ ID NO: 1376480 - DNA, 22 bp, Artificial Sequence
  chemically synthesized
ctagataaaattcaattgatag

SEQ ID NO: 1376481 - DNA, 22 bp, Artificial Sequence
  chemically synthesized
tctagataaaattcaattgata

SEQ ID NO: 1376482 - DNA, 22 bp, Artificial Sequence
  chemically synthesized
attttctagataaaattcaatt

SEQ ID NO: 1376483 - DNA, 22 bp, Artificial Sequence
  chemically synthesized
cattttctagataaaattcaat

SEQ ID NO: 1376484 - DNA, 22 bp, Artificial Sequence
  chemically synthesized
tcattttctagataaaattcaa

SEQ ID NO: 1376485 - DNA, 22 bp, Artificial Sequence
  chemically synthesized
ttcattttctagataaaattca

SEQ ID NO: 1376486 - DNA, 22 bp, Artificial Sequence
  chemically synthesized
tcctatcaattgaattttatct

SEQ ID NO: 1376487 - DNA, 22 bp, Artificial Sequence
  chemically synthesized
tcaattgaattttatctagaaa

SEQ ID NO: 1376488 - DNA, 22 bp, Artificial Sequence
  chemically synthesized
acaatacttttcattttctaga

SEQ ID NO: 1376489 - DNA, 22 bp, Artificial Sequence
  chemically synthesized
ctaacaatacttttcattttct

SEQ ID NO: 1376490 - DNA, 22 bp, Artificial Sequence
  chemically synthesized
aattttatctagaaaatgaaaa

SEQ ID NO: 1376491 - DNA, 22 bp, Artificial Sequence
  chemically synthesized
tatctagaaaatgaaaagtatt

SEQ ID NO: 1376492 - DNA, 22 bp, Artificial Sequence
  chemically synthesized
atctagaaaatgaaaagtattg

SEQ ID NO: 1376493 - DNA, 22 bp, Artificial Sequence
  chemically synthesized
aggaattactaacaatactttt

SEQ ID NO: 1376494 - DNA, 22 bp, Artificial Sequence
  chemically synthesized
tctagaaaatgaaaagtattgt

SEQ ID NO: 1376495 - DNA, 22 bp, Artificial Sequence
  chemically synthesized
ctgaggaattactaacaatact

SEQ ID NO: 1376496 - DNA, 22 bp, Artificial Sequence
  chemically synthesized
actgaggaattactaacaatac

SEQ ID NO: 1376497 - DNA, 22 bp, Artificial Sequence
  chemically synthesized
gaaaatgaaaagtattgttagt

SEQ ID NO: 1376498 - DNA, 22 bp, Artificial Sequence
  chemically synthesized
tatcatttactgaggaattact

SEQ ID NO: 1376499 - DNA, 22 bp, Artificial Sequence
  chemically synthesized
ttagtaattcctcagtaaatga

SEQ ID NO: 1376500 - DNA, 22 bp, Artificial Sequence
  chemically synthesized
tgtatagctgtatcatttactg

SEQ ID NO: 1376501 - DNA, 22 bp, Artificial Sequence
  chemically synthesized
gtaattcctcagtaaatgatac

SEQ ID NO: 1376502 - DNA, 22 bp, Artificial Sequence
  chemically synthesized
ttatgtatagctgtatcattta

SEQ ID NO: 1376503 - DNA, 22 bp, Artificial Sequence
  chemically synthesized
ctcagtaaatgatacagctata

SEQ ID NO: 1376504 - DNA, 22 bp, Artificial Sequence
  chemically synthesized
tatattattatgtatagctgta

SEQ ID NO: 1376505 - DNA, 22 bp, Artificial Sequence
  chemically synthesized
agtaaatgatacagctatacat

SEQ ID NO: 1376506 - DNA, 22 bp, Artificial Sequence
  chemically synthesized
gagttatatattattatgtata

SEQ ID NO: 1376507 - DNA, 22 bp, Artificial Sequence
  chemically synthesized
aattagagttatatattattat

SEQ ID NO: 1376508 - DNA, 22 bp, Artificial Sequence
  chemically synthesized
tacataataatatataactcta

SEQ ID NO: 1376509 - DNA, 22 bp, Artificial Sequence
  chemically synthesized
agaacatatctaaattagagtt

SEQ ID NO: 1376510 - DNA, 22 bp, Artificial Sequence
  chemically synthesized
agcaaatcgttaagaacatatc

SEQ ID NO: 1376511 - DNA, 22 bp, Artificial Sequence
  chemically synthesized
cagcaaatcgttaagaacatat

SEQ ID NO: 1376512 - DNA, 22 bp, Artificial Sequence
  chemically synthesized
tttcagcaaatcgttaagaaca

SEQ ID NO: 1376513 - DNA, 22 bp, Artificial Sequence
  chemically synthesized
taatttagatatgttcttaacg

SEQ ID NO: 1376514 - DNA, 22 bp, Artificial Sequence
  chemically synthesized
atttagatatgttcttaacgat

SEQ ID NO: 1376515 - DNA, 22 bp, Artificial Sequence
  chemically synthesized
ggttgtttcagcaaatcgttaa

SEQ ID NO: 1376516 - DNA, 22 bp, Artificial Sequence
  chemically synthesized
agatatgttcttaacgatttgc

SEQ ID NO: 1376517 - DNA, 22 bp, Artificial Sequence
  chemically synthesized
tgggttgtttcagcaaatcgtt

SEQ ID NO: 1376518 - DNA, 22 bp, Artificial Sequence
  chemically synthesized
gatatgttcttaacgatttgct

SEQ ID NO: 1376519 - DNA, 22 bp, Artificial Sequence
  chemically synthesized
ctgggttgtttcagcaaatcgt

SEQ ID NO: 1376520 - DNA, 22 bp, Artificial Sequence
  chemically synthesized
ttaacgatttgctgaaacaacc

SEQ ID NO: 1376521 - DNA, 22 bp, Artificial Sequence
  chemically synthesized
aacgatttgctgaaacaaccca

SEQ ID NO: 1376522 - DNA, 22 bp, Artificial Sequence
  chemically synthesized
acgatttgctgaaacaacccag

SEQ ID NO: 1376523 - DNA, 22 bp, Artificial Sequence
  chemically synthesized
gatcaatcatttctgggttgtt

SEQ ID NO: 1376524 - DNA, 22 bp, Artificial Sequence
  chemically synthesized
tggatcaatcatttctgggttg

SEQ ID NO: 1376525 - DNA, 22 bp, Artificial Sequence
  chemically synthesized
gctgaaacaacccagaaatgat

SEQ ID NO: 1376526 - DNA, 22 bp, Artificial Sequence
  chemically synthesized
ctgaaacaacccagaaatgatt

SEQ ID NO: 1376527 - DNA, 22 bp, Artificial Sequence
  chemically synthesized
atgattctggatcaatcatttc

SEQ ID NO: 1376528 - DNA, 22 bp, Artificial Sequence
  chemically synthesized
aaacaacccagaaatgattgat

SEQ ID NO: 1376529 - DNA, 22 bp, Artificial Sequence
  chemically synthesized
ctcatgattctggatcaatcat

SEQ ID NO: 1376530 - DNA, 22 bp, Artificial Sequence
  chemically synthesized
gctcatgattctggatcaatca

SEQ ID NO: 1376531 - DNA, 22 bp, Artificial Sequence
  chemically synthesized
atttgctcatgattctggatca

SEQ ID NO: 1376532 - DNA, 22 bp, Artificial Sequence
  chemically synthesized
tctaatttgctcatgattctgg

SEQ ID NO: 1376533 - DNA, 22 bp, Artificial Sequence
  chemically synthesized
atctaatttgctcatgattctg

SEQ ID NO: 1376534 - DNA, 22 bp, Artificial Sequence
  chemically synthesized
atccagaatcatgagcaaatta

SEQ ID NO: 1376535 - DNA, 22 bp, Artificial Sequence
  chemically synthesized
ccaatgatttatctaatttgct

SEQ ID NO: 1376536 - DNA, 22 bp, Artificial Sequence
  chemically synthesized
ttgccaatgatttatctaattt

SEQ ID NO: 1376537 - DNA, 22 bp, Artificial Sequence
  chemically synthesized
agttgttgccaatgatttatct

SEQ ID NO: 1376538 - DNA, 22 bp, Artificial Sequence
  chemically synthesized
aagttgttgccaatgatttatc

SEQ ID NO: 1376539 - DNA, 22 bp, Artificial Sequence
  chemically synthesized
taagttgttgccaatgatttat

SEQ ID NO: 1376540 - DNA, 22 bp, Artificial Sequence
  chemically synthesized
ttaagttgttgccaatgattta

SEQ ID NO: 1376541 - DNA, 22 bp, Artificial Sequence
  chemically synthesized
tttaagttgttgccaatgattt

SEQ ID NO: 1376542 - DNA, 22 bp, Artificial Sequence
  chemically synthesized
attttttaagttgttgccaatg

SEQ ID NO: 1376543 - DNA, 22 bp, Artificial Sequence
  chemically synthesized
ttgattttttaagttgttgcca

SEQ ID NO: 1376544 - DNA, 22 bp, Artificial Sequence
  chemically synthesized
gataaatcattggcaacaactt

SEQ ID NO: 1376545 - DNA, 22 bp, Artificial Sequence
  chemically synthesized
aaattgttgattttttaagttg

SEQ ID NO: 1376546 - DNA, 22 bp, Artificial Sequence
  chemically synthesized
caaattgttgattttttaagtt

SEQ ID NO: 1376547 - DNA, 22 bp, Artificial Sequence
  chemically synthesized
tcaaattgttgattttttaagt

SEQ ID NO: 1376548 - DNA, 22 bp, Artificial Sequence
  chemically synthesized
attttcaaattgttgatttttt

SEQ ID NO: 1376549 - DNA, 22 bp, Artificial Sequence
  chemically synthesized
aattttcaaattgttgattttt

SEQ ID NO: 1376550 - DNA, 22 bp, Artificial Sequence
  chemically synthesized
gcaacaacttaaaaaatcaaca

SEQ ID NO: 1376551 - DNA, 22 bp, Artificial Sequence
  chemically synthesized
taattttcaaattgttgatttt

SEQ ID NO: 1376552 - DNA, 22 bp, Artificial Sequence
  chemically synthesized
aaaaaatcaacaatttgaaaat

SEQ ID NO: 1376553 - DNA, 22 bp, Artificial Sequence
  chemically synthesized
aaaaatcaacaatttgaaaatt

SEQ ID NO: 1376554 - DNA, 22 bp, Artificial Sequence
  chemically synthesized
tataccaaaaataattttaatt

SEQ ID NO: 1376555 - DNA, 22 bp, Artificial Sequence
  chemically synthesized
gaaaattaaaattatttttggt

SEQ ID NO: 1376556 - DNA, 22 bp, Artificial Sequence
  chemically synthesized
aaaattaaaattatttttggta

SEQ ID NO: 1376557 - DNA, 22 bp, Artificial Sequence
  chemically synthesized
gcacatactatataccaaaaat

SEQ ID NO: 1376558 - DNA, 22 bp, Artificial Sequence
  chemically synthesized
ggcacatactatataccaaaaa

SEQ ID NO: 1376559 - DNA, 22 bp, Artificial Sequence
  chemically synthesized
agcttggcacatactatatacc

SEQ ID NO: 1376560 - DNA, 22 bp, Artificial Sequence
  chemically synthesized
aaattatttttggtatatagta

SEQ ID NO: 1376561 - DNA, 22 bp, Artificial Sequence
  chemically synthesized
atactaagcttggcacatacta

SEQ ID NO: 1376562 - DNA, 22 bp, Artificial Sequence
  chemically synthesized
tttttggtatatagtatgtgcc

SEQ ID NO: 1376563 - DNA, 22 bp, Artificial Sequence
  chemically synthesized
aatactaagcttggcacatact

SEQ ID NO: 1376564 - DNA, 22 bp, Artificial Sequence
  chemically synthesized
ttggtatatagtatgtgccaag

SEQ ID NO: 1376565 - DNA, 22 bp, Artificial Sequence
  chemically synthesized
tggtatatagtatgtgccaagc

SEQ ID NO: 1376566 - DNA, 22 bp, Artificial Sequence
  chemically synthesized
ggtatatagtatgtgccaagct

SEQ ID NO: 1376567 - DNA, 22 bp, Artificial Sequence
  chemically synthesized
tgtttaatactaagcttggcac

SEQ ID NO: 1376568 - DNA, 22 bp, Artificial Sequence
  chemically synthesized
gtatatagtatgtgccaagctt

SEQ ID NO: 1376569 - DNA, 22 bp, Artificial Sequence
  chemically synthesized
atgtttaatactaagcttggca

SEQ ID NO: 1376570 - DNA, 22 bp, Artificial Sequence
  chemically synthesized
tatgtttaatactaagcttggc

SEQ ID NO: 1376571 - DNA, 22 bp, Artificial Sequence
  chemically synthesized
gctttatgtttaatactaagct

SEQ ID NO: 1376572 - DNA, 22 bp, Artificial Sequence
  chemically synthesized
ttggctttatgtttaatactaa

SEQ ID NO: 1376573 - DNA, 22 bp, Artificial Sequence
  chemically synthesized
attggctttatgtttaatacta

SEQ ID NO: 1376574 - DNA, 22 bp, Artificial Sequence
  chemically synthesized
catttattggctttatgtttaa

SEQ ID NO: 1376575 - DNA, 22 bp, Artificial Sequence
  chemically synthesized
aattgcatttattggctttatg

SEQ ID NO: 1376576 - DNA, 22 bp, Artificial Sequence
  chemically synthesized
agtattaaacataaagccaata

SEQ ID NO: 1376577 - DNA, 22 bp, Artificial Sequence
  chemically synthesized
gtattaaacataaagccaataa

SEQ ID NO: 1376578 - DNA, 22 bp, Artificial Sequence
  chemically synthesized
acatgctgaattgcatttattg

SEQ ID NO: 1376579 - DNA, 22 bp, Artificial Sequence
  chemically synthesized
cacatgctgaattgcatttatt

SEQ ID NO: 1376580 - DNA, 22 bp, Artificial Sequence
  chemically synthesized
aacataaagccaataaatgcaa

SEQ ID NO: 1376581 - DNA, 22 bp, Artificial Sequence
  chemically synthesized
tcacatgctgaattgcatttat

SEQ ID NO: 1376582 - DNA, 22 bp, Artificial Sequence
  chemically synthesized
cattttcacatgctgaattgca

SEQ ID NO: 1376583 - DNA, 22 bp, Artificial Sequence
  chemically synthesized
aaagttacattttcacatgctg

SEQ ID NO: 1376584 - DNA, 22 bp, Artificial Sequence
  chemically synthesized
attcaaagttacattttcacat

SEQ ID NO: 1376585 - DNA, 22 bp, Artificial Sequence
  chemically synthesized
ctaattcaaagttacattttca

SEQ ID NO: 1376586 - DNA, 22 bp, Artificial Sequence
  chemically synthesized
cctaattcaaagttacattttc

SEQ ID NO: 1376587 - DNA, 22 bp, Artificial Sequence
  chemically synthesized
tcctaattcaaagttacatttt

SEQ ID NO: 1376588 - DNA, 22 bp, Artificial Sequence
  chemically synthesized
agcatgtgaaaatgtaactttg

SEQ ID NO: 1376589 - DNA, 22 bp, Artificial Sequence
  chemically synthesized
caattttcctaattcaaagtta

SEQ ID NO: 1376590 - DNA, 22 bp, Artificial Sequence
  chemically synthesized
tgcaattttcctaattcaaagt

SEQ ID NO: 1376591 - DNA, 22 bp, Artificial Sequence
  chemically synthesized
cattctgcaattttcctaattc

SEQ ID NO: 1376592 - DNA, 22 bp, Artificial Sequence
  chemically synthesized
tgcattctgcaattttcctaat

SEQ ID NO: 1376593 - DNA, 22 bp, Artificial Sequence
  chemically synthesized
tgaattaggaaaattgcagaat

SEQ ID NO: 1376594 - DNA, 22 bp, Artificial Sequence
  chemically synthesized
gaattaggaaaattgcagaatg

SEQ ID NO: 1376595 - DNA, 22 bp, Artificial Sequence
  chemically synthesized
aattaggaaaattgcagaatgc

SEQ ID NO: 1376596 - DNA, 22 bp, Artificial Sequence
  chemically synthesized
ggaaaattgcagaatgcagagg

SEQ ID NO: 1376597 - DNA, 22 bp, Artificial Sequence
  chemically synthesized
cagaatgcagagggttgtattt

SEQ ID NO: 1376598 - DNA, 22 bp, Artificial Sequence
  chemically synthesized
aagaaacatagagtaataaata

SEQ ID NO: 1376599 - DNA, 22 bp, Artificial Sequence
  chemically synthesized
tatttattactctatgtttctt

SEQ ID NO: 1376600 - DNA, 22 bp, Artificial Sequence
  chemically synthesized
tcaataacaagattgaagaaac

SEQ ID NO: 1376601 - DNA, 22 bp, Artificial Sequence
  chemically synthesized
attactctatgtttcttcaatc

SEQ ID NO: 1376602 - DNA, 22 bp, Artificial Sequence
  chemically synthesized
tgtcaataacaagattgaagaa

SEQ ID NO: 1376603 - DNA, 22 bp, Artificial Sequence
  chemically synthesized
ttactctatgtttcttcaatct

SEQ ID NO: 1376604 - DNA, 22 bp, Artificial Sequence
  chemically synthesized
ctgtcaataacaagattgaaga

SEQ ID NO: 1376605 - DNA, 22 bp, Artificial Sequence
  chemically synthesized
ctctatgtttcttcaatcttgt

SEQ ID NO: 1376606 - DNA, 22 bp, Artificial Sequence
  chemically synthesized
tatgtttcttcaatcttgttat

SEQ ID NO: 1376607 - DNA, 22 bp, Artificial Sequence
  chemically synthesized
tgtttcttcaatcttgttattg

SEQ ID NO: 1376608 - DNA, 22 bp, Artificial Sequence
  chemically synthesized
cttcaatcttgttattgacaga

SEQ ID NO: 1376609 - DNA, 22 bp, Artificial Sequence
  chemically synthesized
tacatacaaatttctgtcaata

SEQ ID NO: 1376610 - DNA, 22 bp, Artificial Sequence
  chemically synthesized
ttcaatcttgttattgacagaa

SEQ ID NO: 1376611 - DNA, 22 bp, Artificial Sequence
  chemically synthesized
tatacatacaaatttctgtcaa

SEQ ID NO: 1376612 - DNA, 22 bp, Artificial Sequence
  chemically synthesized
caatcttgttattgacagaaat

SEQ ID NO: 1376613 - DNA, 22 bp, Artificial Sequence
  chemically synthesized
ctatacatacaaatttctgtca

SEQ ID NO: 1376614 - DNA, 22 bp, Artificial Sequence
  chemically synthesized
aatcttgttattgacagaaatt

SEQ ID NO: 1376615 - DNA, 22 bp, Artificial Sequence
  chemically synthesized
tctatacatacaaatttctgtc

SEQ ID NO: 1376616 - DNA, 22 bp, Artificial Sequence
  chemically synthesized
gttattgacagaaatttgtatg

SEQ ID NO: 1376617 - DNA, 22 bp, Artificial Sequence
  chemically synthesized
ttattgacagaaatttgtatgt

SEQ ID NO: 1376618 - DNA, 22 bp, Artificial Sequence
  chemically synthesized
atacagctttctatacatacaa

SEQ ID NO: 1376619 - DNA, 22 bp, Artificial Sequence
  chemically synthesized
ttgacagaaatttgtatgtata

SEQ ID NO: 1376620 - DNA, 22 bp, Artificial Sequence
  chemically synthesized
catacagctttctatacataca

SEQ ID NO: 1376621 - DNA, 22 bp, Artificial Sequence
  chemically synthesized
tcatacagctttctatacatac

SEQ ID NO: 1376622 - DNA, 22 bp, Artificial Sequence
  chemically synthesized
acagaaatttgtatgtatagaa

SEQ ID NO: 1376623 - DNA, 22 bp, Artificial Sequence
  chemically synthesized
ttttcatacagctttctataca

SEQ ID NO: 1376624 - DNA, 22 bp, Artificial Sequence
  chemically synthesized
attttcatacagctttctatac

SEQ ID NO: 1376625 - DNA, 22 bp, Artificial Sequence
  chemically synthesized
cttattttcatacagctttcta

SEQ ID NO: 1376626 - DNA, 22 bp, Artificial Sequence
  chemically synthesized
gtatgtatagaaagctgtatga

SEQ ID NO: 1376627 - DNA, 22 bp, Artificial Sequence
  chemically synthesized
tatgtatagaaagctgtatgaa

SEQ ID NO: 1376628 - DNA, 22 bp, Artificial Sequence
  chemically synthesized
tatggaaagttacttattttca

SEQ ID NO: 1376629 - DNA, 22 bp, Artificial Sequence
  chemically synthesized
gtatggaaagttacttattttc

SEQ ID NO: 1376630 - DNA, 22 bp, Artificial Sequence
  chemically synthesized
tgtatggaaagttacttatttt

SEQ ID NO: 1376631 - DNA, 22 bp, Artificial Sequence
  chemically synthesized
ggctttgtatggaaagttactt

SEQ ID NO: 1376632 - DNA, 22 bp, Artificial Sequence
  chemically synthesized
gggctttgtatggaaagttact

SEQ ID NO: 1376633 - DNA, 22 bp, Artificial Sequence
  chemically synthesized
tatgaaaataagtaactttcca

SEQ ID NO: 1376634 - DNA, 22 bp, Artificial Sequence
  chemically synthesized
tttgggctttgtatggaaagtt

SEQ ID NO: 1376635 - DNA, 22 bp, Artificial Sequence
  chemically synthesized
tccatacaaagcccaaataacc

SEQ ID NO: 1376636 - DNA, 22 bp, Artificial Sequence
  chemically synthesized
ccatacaaagcccaaataacca

SEQ ID NO: 1376637 - DNA, 22 bp, Artificial Sequence
  chemically synthesized
catacaaagcccaaataaccac

SEQ ID NO: 1376638 - DNA, 22 bp, Artificial Sequence
  chemically synthesized
agcgataataaagggtggttat

SEQ ID NO: 1376639 - DNA, 22 bp, Artificial Sequence
  chemically synthesized
gagcgataataaagggtggtta

SEQ ID NO: 1376640 - DNA, 22 bp, Artificial Sequence
  chemically synthesized
tattatcgctcaaatttattta

SEQ ID NO: 1376641 - DNA, 22 bp, Artificial Sequence
  chemically synthesized
attatcgctcaaatttatttat

SEQ ID NO: 1376642 - DNA, 22 bp, Artificial Sequence
  chemically synthesized
ttatcgctcaaatttatttatt

SEQ ID NO: 1376643 - DNA, 22 bp, Artificial Sequence
  chemically synthesized
tcgctcaaatttatttattttt

SEQ ID NO: 1376644 - DNA, 22 bp, Artificial Sequence
  chemically synthesized
aaaaataaataaataaaaataa

SEQ ID NO: 1376645 - DNA, 22 bp, Artificial Sequence
  chemically synthesized
aaatttatttatttttatttat

SEQ ID NO: 1376646 - DNA, 22 bp, Artificial Sequence
  chemically synthesized
catctcaaaaataaataaataa

SEQ ID NO: 1376647 - DNA, 22 bp, Artificial Sequence
  chemically synthesized
atttatttttatttatttattt

SEQ ID NO: 1376648 - DNA, 22 bp, Artificial Sequence
  chemically synthesized
tttatttttatttatttatttt

SEQ ID NO: 1376649 - DNA, 22 bp, Artificial Sequence
  chemically synthesized
atttttatttatttatttttga

SEQ ID NO: 1376650 - DNA, 22 bp, Artificial Sequence
  chemically synthesized
tttttatttatttatttttgag

SEQ ID NO: 1376651 - DNA, 22 bp, Artificial Sequence
  chemically synthesized
ttatttatttatttttgagatg

SEQ ID NO: 1376652 - DNA, 22 bp, Artificial Sequence
  chemically synthesized
tatttatttatttttgagatgg

SEQ ID NO: 1376653 - DNA, 22 bp, Artificial Sequence
  chemically synthesized
atttatttatttttgagatgga

SEQ ID NO: 1376654 - DNA, 22 bp, Artificial Sequence
  chemically synthesized
tttatttatttttgagatggag

SEQ ID NO: 1376655 - DNA, 22 bp, Artificial Sequence
  chemically synthesized
atttatttttgagatggagttt

SEQ ID NO: 1376656 - DNA, 22 bp, Artificial Sequence
  chemically synthesized
tttatttttgagatggagtttt

SEQ ID NO: 1376657 - DNA, 22 bp, Artificial Sequence
  chemically synthesized
ggcaacaagagcaaaactccat

SEQ ID NO: 1376658 - DNA, 22 bp, Artificial Sequence
  chemically synthesized
atttttgagatggagttttgct

SEQ ID NO: 1376659 - DNA, 22 bp, Artificial Sequence
  chemically synthesized
tttttgagatggagttttgctc

SEQ ID NO: 1376660 - DNA, 22 bp, Artificial Sequence
  chemically synthesized
ttgagatggagttttgctcttg

SEQ ID NO: 1376661 - DNA, 22 bp, Artificial Sequence
  chemically synthesized
cagcctgggcaacaagagcaaa

SEQ ID NO: 1376662 - DNA, 22 bp, Artificial Sequence
  chemically synthesized
tgagatggagttttgctcttgt

SEQ ID NO: 1376663 - DNA, 22 bp, Artificial Sequence
  chemically synthesized
gagatggagttttgctcttgtt

SEQ ID NO: 1376664 - DNA, 22 bp, Artificial Sequence
  chemically synthesized
agatggagttttgctcttgttg

SEQ ID NO: 1376665 - DNA, 22 bp, Artificial Sequence
  chemically synthesized
cactccagcctgggcaacaaga

SEQ ID NO: 1376666 - DNA, 22 bp, Artificial Sequence
  chemically synthesized
tgccattgcactccagcctggg

SEQ ID NO: 1376667 - DNA, 22 bp, Artificial Sequence
  chemically synthesized
tgctcttgttgcccaggctgga

SEQ ID NO: 1376668 - DNA, 22 bp, Artificial Sequence
  chemically synthesized
gctcttgttgcccaggctggag

SEQ ID NO: 1376669 - DNA, 22 bp, Artificial Sequence
  chemically synthesized
ctcttgttgcccaggctggagt

SEQ ID NO: 1376670 - DNA, 22 bp, Artificial Sequence
  chemically synthesized
ttgttgcccaggctggagtgca

SEQ ID NO: 1376671 - DNA, 22 bp, Artificial Sequence
  chemically synthesized
gttgcccaggctggagtgcaat

SEQ ID NO: 1376672 - DNA, 22 bp, Artificial Sequence
  chemically synthesized
ttgcccaggctggagtgcaatg

SEQ ID NO: 1376673 - DNA, 22 bp, Artificial Sequence
  chemically synthesized
cccaggctggagtgcaatggca

SEQ ID NO: 1376674 - DNA, 22 bp, Artificial Sequence
  chemically synthesized
gagtgcaatggcacaatctcgg

SEQ ID NO: 1376675 - DNA, 22 bp, Artificial Sequence
  chemically synthesized
aacccaggaggtggaggtcgca

SEQ ID NO: 1376676 - DNA, 22 bp, Artificial Sequence
  chemically synthesized
gaacccaggaggtggaggtcgc

SEQ ID NO: 1376677 - DNA, 22 bp, Artificial Sequence
  chemically synthesized
ggctcattgcgacctccacctc

SEQ ID NO: 1376678 - DNA, 22 bp, Artificial Sequence
  chemically synthesized
attgcgacctccacctcctggg

SEQ ID NO: 1376679 - DNA, 22 bp, Artificial Sequence
  chemically synthesized
cgacctccacctcctgggttca

SEQ ID NO: 1376680 - DNA, 22 bp, Artificial Sequence
  chemically synthesized
aggcaggagaatggcttgaacc

SEQ ID NO: 1376681 - DNA, 22 bp, Artificial Sequence
  chemically synthesized
cacctcctgggttcaagccatt

SEQ ID NO: 1376682 - DNA, 22 bp, Artificial Sequence
  chemically synthesized
ctgggttcaagccattctcctg

SEQ ID NO: 1376683 - DNA, 22 bp, Artificial Sequence
  chemically synthesized
gggaggctgaggcaggagaatg

SEQ ID NO: 1376684 - DNA, 22 bp, Artificial Sequence
  chemically synthesized
ggttcaagccattctcctgcct

SEQ ID NO: 1376685 - DNA, 22 bp, Artificial Sequence
  chemically synthesized
ctagggaggctgaggcaggaga

SEQ ID NO: 1376686 - DNA, 22 bp, Artificial Sequence
  chemically synthesized
aagccattctcctgcctcagcc

SEQ ID NO: 1376687 - DNA, 22 bp, Artificial Sequence
  chemically synthesized
tcatcccagctactagggaggc

SEQ ID NO: 1376688 - DNA, 22 bp, Artificial Sequence
  chemically synthesized
tcctgcctcagcctccctagta

SEQ ID NO: 1376689 - DNA, 22 bp, Artificial Sequence
  chemically synthesized
ctgcctcagcctccctagtagc

SEQ ID NO: 1376690 - DNA, 22 bp, Artificial Sequence
  chemically synthesized
cctcagcctccctagtagctgg

SEQ ID NO: 1376691 - DNA, 22 bp, Artificial Sequence
  chemically synthesized
agcctccctagtagctgggatg

SEQ ID NO: 1376692 - DNA, 22 bp, Artificial Sequence
  chemically synthesized
cctagtagctgggatgacaggc

SEQ ID NO: 1376693 - DNA, 22 bp, Artificial Sequence
  chemically synthesized
gtagctgggatgacaggcatct

SEQ ID NO: 1376694 - DNA, 22 bp, Artificial Sequence
  chemically synthesized
gccaggtgtggtggcagatgcc

SEQ ID NO: 1376695 - DNA, 22 bp, Artificial Sequence
  chemically synthesized
ggatgacaggcatctgccacca

SEQ ID NO: 1376696 - DNA, 22 bp, Artificial Sequence
  chemically synthesized
aaaatacaaaaattagccaggt

SEQ ID NO: 1376697 - DNA, 22 bp, Artificial Sequence
  chemically synthesized
ctgaaaatacaaaaattagcca

SEQ ID NO: 1376698 - DNA, 22 bp, Artificial Sequence
  chemically synthesized
ccaccacacctggctaattttt

SEQ ID NO: 1376699 - DNA, 22 bp, Artificial Sequence
  chemically synthesized
tactgaaaatacaaaaattagc

SEQ ID NO: 1376700 - DNA, 22 bp, Artificial Sequence
  chemically synthesized
gctaatttttgtattttcagta

SEQ ID NO: 1376701 - DNA, 22 bp, Artificial Sequence
  chemically synthesized
atttttgtattttcagtagaga

SEQ ID NO: 1376702 - DNA, 22 bp, Artificial Sequence
  chemically synthesized
ttgtattttcagtagagaccgg

SEQ ID NO: 1376703 - DNA, 22 bp, Artificial Sequence
  chemically synthesized
tgtattttcagtagagaccggg

SEQ ID NO: 1376704 - DNA, 22 bp, Artificial Sequence
  chemically synthesized
gtattttcagtagagaccgggt

SEQ ID NO: 1376705 - DNA, 22 bp, Artificial Sequence
  chemically synthesized
tattttcagtagagaccgggtt

SEQ ID NO: 1376706 - DNA, 22 bp, Artificial Sequence
  chemically synthesized
gccaacgtggtgaaacccggtc

SEQ ID NO: 1376707 - DNA, 22 bp, Artificial Sequence
  chemically synthesized
tcagtagagaccgggtttcacc

SEQ ID NO: 1376708 - DNA, 22 bp, Artificial Sequence
  chemically synthesized
cagtagagaccgggtttcacca

SEQ ID NO: 1376709 - DNA, 22 bp, Artificial Sequence
  chemically synthesized
agtagagaccgggtttcaccac

SEQ ID NO: 1376710 - DNA, 22 bp, Artificial Sequence
  chemically synthesized
gagaccagcctggccaacgtgg

SEQ ID NO: 1376711 - DNA, 22 bp, Artificial Sequence
  chemically synthesized
caccacgttggccaggctggtc

SEQ ID NO: 1376712 - DNA, 22 bp, Artificial Sequence
  chemically synthesized
accacgttggccaggctggtct

SEQ ID NO: 1376713 - DNA, 22 bp, Artificial Sequence
  chemically synthesized
aggtcaggagttcgagaccagc

SEQ ID NO: 1376714 - DNA, 22 bp, Artificial Sequence
  chemically synthesized
gccaggctggtctcgaactcct

SEQ ID NO: 1376715 - DNA, 22 bp, Artificial Sequence
  chemically synthesized
gtctcgaactcctgaccttagg

SEQ ID NO: 1376716 - DNA, 22 bp, Artificial Sequence
  chemically synthesized
gaactcctgaccttaggtgatc

SEQ ID NO: 1376717 - DNA, 22 bp, Artificial Sequence
  chemically synthesized
ggaggccaaggtgggcagatca

SEQ ID NO: 1376718 - DNA, 22 bp, Artificial Sequence
  chemically synthesized
ctgaccttaggtgatctgccca

SEQ ID NO: 1376719 - DNA, 22 bp, Artificial Sequence
  chemically synthesized
gggaggccaaggtgggcagatc

SEQ ID NO: 1376720 - DNA, 22 bp, Artificial Sequence
  chemically synthesized
tgggaggccaaggtgggcagat

SEQ ID NO: 1376721 - DNA, 22 bp, Artificial Sequence
  chemically synthesized
accttaggtgatctgcccacct

SEQ ID NO: 1376722 - DNA, 22 bp, Artificial Sequence
  chemically synthesized
aggtgatctgcccaccttggcc

SEQ ID NO: 1376723 - DNA, 22 bp, Artificial Sequence
  chemically synthesized
ggtgatctgcccaccttggcct

SEQ ID NO: 1376724 - DNA, 22 bp, Artificial Sequence
  chemically synthesized
taataccagcactttgggaggc

SEQ ID NO: 1376725 - DNA, 22 bp, Artificial Sequence
  chemically synthesized
cccaccttggcctcccaaagtg

SEQ ID NO: 1376726 - DNA, 22 bp, Artificial Sequence
  chemically synthesized
atgcctgtaataccagcacttt

SEQ ID NO: 1376727 - DNA, 22 bp, Artificial Sequence
  chemically synthesized
ggcctcccaaagtgctggtatt

SEQ ID NO: 1376728 - DNA, 22 bp, Artificial Sequence
  chemically synthesized
gcctcccaaagtgctggtatta

SEQ ID NO: 1376729 - DNA, 22 bp, Artificial Sequence
  chemically synthesized
ccaaagtgctggtattacaggc

SEQ ID NO: 1376730 - DNA, 22 bp, Artificial Sequence
  chemically synthesized
gccaggcatggtggctcatgcc

SEQ ID NO: 1376731 - DNA, 22 bp, Artificial Sequence
  chemically synthesized
gtattacaggcatgagccacca

SEQ ID NO: 1376732 - DNA, 22 bp, Artificial Sequence
  chemically synthesized
caggcatgagccaccatgcctg

SEQ ID NO: 1376733 - DNA, 22 bp, Artificial Sequence
  chemically synthesized
aatgagagcaattggccaggca

SEQ ID NO: 1376734 - DNA, 22 bp, Artificial Sequence
  chemically synthesized
aaatgagagcaattggccaggc

SEQ ID NO: 1376735 - DNA, 22 bp, Artificial Sequence
  chemically synthesized
aatttaaatgagagcaattggc

SEQ ID NO: 1376736 - DNA, 22 bp, Artificial Sequence
  chemically synthesized
gaatttaaatgagagcaattgg

SEQ ID NO: 1376737 - DNA, 22 bp, Artificial Sequence
  chemically synthesized
cataatttgaatttaaatgaga

SEQ ID NO: 1376738 - DNA, 22 bp, Artificial Sequence
  chemically synthesized
gccaattgctctcatttaaatt

SEQ ID NO: 1376739 - DNA, 22 bp, Artificial Sequence
  chemically synthesized
ctctcatttaaattcaaattat

SEQ ID NO: 1376740 - DNA, 22 bp, Artificial Sequence
  chemically synthesized
tcatttaaattcaaattatgta

SEQ ID NO: 1376741 - DNA, 22 bp, Artificial Sequence
  chemically synthesized
atttaaattcaaattatgtagc

SEQ ID NO: 1376742 - DNA, 22 bp, Artificial Sequence
  chemically synthesized
aaattcaaattatgtagcattt

SEQ ID NO: 1376743 - DNA, 22 bp, Artificial Sequence
  chemically synthesized
aattcaaattatgtagcattta

SEQ ID NO: 1376744 - DNA, 22 bp, Artificial Sequence
  chemically synthesized
aaattatgtagcatttatgctc

SEQ ID NO: 1376745 - DNA, 22 bp, Artificial Sequence
  chemically synthesized
tgtagcatttatgctccccata

SEQ ID NO: 1376746 - DNA, 22 bp, Artificial Sequence
  chemically synthesized
tgaagtaaatgcaataatgata

SEQ ID NO: 1376747 - DNA, 22 bp, Artificial Sequence
  chemically synthesized
atgaagtaaatgcaataatgat

SEQ ID NO: 1376748 - DNA, 22 bp, Artificial Sequence
  chemically synthesized
atgctccccatatcattattgc

SEQ ID NO: 1376749 - DNA, 22 bp, Artificial Sequence
  chemically synthesized
tgctccccatatcattattgca

SEQ ID NO: 1376750 - DNA, 22 bp, Artificial Sequence
  chemically synthesized
cccatatcattattgcatttac

SEQ ID NO: 1376751 - DNA, 22 bp, Artificial Sequence
  chemically synthesized
tgtaagtatgtcttatgaagta

SEQ ID NO: 1376752 - DNA, 22 bp, Artificial Sequence
  chemically synthesized
atgtaagtatgtcttatgaagt

SEQ ID NO: 1376753 - DNA, 22 bp, Artificial Sequence
  chemically synthesized
ttgcatttacttcataagacat

SEQ ID NO: 1376754 - DNA, 22 bp, Artificial Sequence
  chemically synthesized
catttacttcataagacatact

SEQ ID NO: 1376755 - DNA, 22 bp, Artificial Sequence
  chemically synthesized
acttcataagacatacttacat

SEQ ID NO: 1376756 - DNA, 22 bp, Artificial Sequence
  chemically synthesized
cttcataagacatacttacata

SEQ ID NO: 1376757 - DNA, 22 bp, Artificial Sequence
  chemically synthesized
cataagacatacttacataaat

SEQ ID NO: 1376758 - DNA, 22 bp, Artificial Sequence
  chemically synthesized
ataagacatacttacataaatt

SEQ ID NO: 1376759 - DNA, 22 bp, Artificial Sequence
  chemically synthesized
acataaatttgatttgattggg

SEQ ID NO: 1376760 - DNA, 22 bp, Artificial Sequence
  chemically synthesized
cataaatttgatttgattggga

SEQ ID NO: 1376761 - DNA, 22 bp, Artificial Sequence
  chemically synthesized
acataatgtcgtaagtaatatc

SEQ ID NO: 1376762 - DNA, 22 bp, Artificial Sequence
  chemically synthesized
gatttgattgggatattactta

SEQ ID NO: 1376763 - DNA, 22 bp, Artificial Sequence
  chemically synthesized
aacataatgtcgtaagtaatat

SEQ ID NO: 1376764 - DNA, 22 bp, Artificial Sequence
  chemically synthesized
atttgattgggatattacttac

SEQ ID NO: 1376765 - DNA, 22 bp, Artificial Sequence
  chemically synthesized
taacataatgtcgtaagtaata

SEQ ID NO: 1376766 - DNA, 22 bp, Artificial Sequence
  chemically synthesized
gattgggatattacttacgaca

SEQ ID NO: 1376767 - DNA, 22 bp, Artificial Sequence
  chemically synthesized
attgggatattacttacgacat

SEQ ID NO: 1376768 - DNA, 22 bp, Artificial Sequence
  chemically synthesized
ggatattacttacgacattatg

SEQ ID NO: 1376769 - DNA, 22 bp, Artificial Sequence
  chemically synthesized
cttacgacattatgttaaagat

SEQ ID NO: 1376770 - DNA, 22 bp, Artificial Sequence
  chemically synthesized
acgacattatgttaaagataca

SEQ ID NO: 1376771 - DNA, 22 bp, Artificial Sequence
  chemically synthesized
cgacattatgttaaagatacat

SEQ ID NO: 1376772 - DNA, 22 bp, Artificial Sequence
  chemically synthesized
tgttaaagatacattgcactct

SEQ ID NO: 1376773 - DNA, 22 bp, Artificial Sequence
  chemically synthesized
aaaatgggcaggccaagagtgc

SEQ ID NO: 1376774 - DNA, 22 bp, Artificial Sequence
  chemically synthesized
aagatacattgcactcttggcc

SEQ ID NO: 1376775 - DNA, 22 bp, Artificial Sequence
  chemically synthesized
ttaaaaatgggcaggccaagag

SEQ ID NO: 1376776 - DNA, 22 bp, Artificial Sequence
  chemically synthesized
cgttgttaaaaatgggcaggcc

SEQ ID NO: 1376777 - DNA, 22 bp, Artificial Sequence
  chemically synthesized
ctacgttgttaaaaatgggcag

SEQ ID NO: 1376778 - DNA, 22 bp, Artificial Sequence
  chemically synthesized
cctacgttgttaaaaatgggca

SEQ ID NO: 1376779 - DNA, 22 bp, Artificial Sequence
  chemically synthesized
cactcttggcctgcccattttt

SEQ ID NO: 1376780 - DNA, 22 bp, Artificial Sequence
  chemically synthesized
tttcctacgttgttaaaaatgg

SEQ ID NO: 1376781 - DNA, 22 bp, Artificial Sequence
  chemically synthesized
ttggcctgcccatttttaacaa

SEQ ID NO: 1376782 - DNA, 22 bp, Artificial Sequence
  chemically synthesized
ggcctgcccatttttaacaacg

SEQ ID NO: 1376783 - DNA, 22 bp, Artificial Sequence
  chemically synthesized
gcctgcccatttttaacaacgt

SEQ ID NO: 1376784 - DNA, 22 bp, Artificial Sequence
  chemically synthesized
cagctgtttcctacgttgttaa

SEQ ID NO: 1376785 - DNA, 22 bp, Artificial Sequence
  chemically synthesized
gcagctgtttcctacgttgtta

SEQ ID NO: 1376786 - DNA, 22 bp, Artificial Sequence
  chemically synthesized
cccatttttaacaacgtaggaa

SEQ ID NO: 1376787 - DNA, 22 bp, Artificial Sequence
  chemically synthesized
ttaacaacgtaggaaacagctg

SEQ ID NO: 1376788 - DNA, 22 bp, Artificial Sequence
  chemically synthesized
taacaacgtaggaaacagctgc

SEQ ID NO: 1376789 - DNA, 22 bp, Artificial Sequence
  chemically synthesized
aacaacgtaggaaacagctgca

SEQ ID NO: 1376790 - DNA, 22 bp, Artificial Sequence
  chemically synthesized
acaacgtaggaaacagctgcaa

SEQ ID NO: 1376791 - DNA, 22 bp, Artificial Sequence
  chemically synthesized
caggagtaaggagtgtttgcag

SEQ ID NO: 1376792 - DNA, 22 bp, Artificial Sequence
  chemically synthesized
gcaggagtaaggagtgtttgca

SEQ ID NO: 1376793 - DNA, 22 bp, Artificial Sequence
  chemically synthesized
tgcaggagtaaggagtgtttgc

SEQ ID NO: 1376794 - DNA, 22 bp, Artificial Sequence
  chemically synthesized
ttgcaggagtaaggagtgtttg

SEQ ID NO: 1376795 - DNA, 22 bp, Artificial Sequence
  chemically synthesized
catttttgcaggagtaaggagt

SEQ ID NO: 1376796 - DNA, 22 bp, Artificial Sequence
  chemically synthesized
gcatttttgcaggagtaaggag

SEQ ID NO: 1376797 - DNA, 22 bp, Artificial Sequence
  chemically synthesized
cttgcatttttgcaggagtaag

SEQ ID NO: 1376798 - DNA, 22 bp, Artificial Sequence
  chemically synthesized
caaacactccttactcctgcaa

SEQ ID NO: 1376799 - DNA, 22 bp, Artificial Sequence
  chemically synthesized
aattccttgcatttttgcagga

SEQ ID NO: 1376800 - DNA, 22 bp, Artificial Sequence
  chemically synthesized
caattccttgcatttttgcagg

SEQ ID NO: 1376801 - DNA, 22 bp, Artificial Sequence
  chemically synthesized
tcaattccttgcatttttgcag

SEQ ID NO: 1376802 - DNA, 22 bp, Artificial Sequence
  chemically synthesized
ttttcaattccttgcatttttg

SEQ ID NO: 1376803 - DNA, 22 bp, Artificial Sequence
  chemically synthesized
cttactcctgcaaaaatgcaag

SEQ ID NO: 1376804 - DNA, 22 bp, Artificial Sequence
  chemically synthesized
actcctgcaaaaatgcaaggaa

SEQ ID NO: 1376805 - DNA, 22 bp, Artificial Sequence
  chemically synthesized
ctcctgcaaaaatgcaaggaat

SEQ ID NO: 1376806 - DNA, 22 bp, Artificial Sequence
  chemically synthesized
ctgcaaaaatgcaaggaattga

SEQ ID NO: 1376807 - DNA, 22 bp, Artificial Sequence
  chemically synthesized
gacataggttattttcaattcc

SEQ ID NO: 1376808 - DNA, 22 bp, Artificial Sequence
  chemically synthesized
caaaaatgcaaggaattgaaaa

SEQ ID NO: 1376809 - DNA, 22 bp, Artificial Sequence
  chemically synthesized
aaaataacctatgtccaatcat

SEQ ID NO: 1376810 - DNA, 22 bp, Artificial Sequence
  chemically synthesized
caaaagtgcaacatgattggac

SEQ ID NO: 1376811 - DNA, 22 bp, Artificial Sequence
  chemically synthesized
gcaaaagtgcaacatgattgga

SEQ ID NO: 1376812 - DNA, 22 bp, Artificial Sequence
  chemically synthesized
tgtccaatcatgttgcactttt

SEQ ID NO: 1376813 - DNA, 22 bp, Artificial Sequence
  chemically synthesized
gggagaggtagggaatgtttgc

SEQ ID NO: 1376814 - DNA, 22 bp, Artificial Sequence
  chemically synthesized
ggggagaggtagggaatgtttg

SEQ ID NO: 1376815 - DNA, 22 bp, Artificial Sequence
  chemically synthesized
cacttttgcaaacattccctac

SEQ ID NO: 1376816 - DNA, 22 bp, Artificial Sequence
  chemically synthesized
atttggggagaggtagggaatg

SEQ ID NO: 1376817 - DNA, 22 bp, Artificial Sequence
  chemically synthesized
catttggggagaggtagggaat

SEQ ID NO: 1376818 - DNA, 22 bp, Artificial Sequence
  chemically synthesized
cttcatttggggagaggtaggg

SEQ ID NO: 1376819 - DNA, 22 bp, Artificial Sequence
  chemically synthesized
ttgcaaacattccctacctctc

SEQ ID NO: 1376820 - DNA, 22 bp, Artificial Sequence
  chemically synthesized
tgcaaacattccctacctctcc

SEQ ID NO: 1376821 - DNA, 22 bp, Artificial Sequence
  chemically synthesized
gcaaacattccctacctctccc

SEQ ID NO: 1376822 - DNA, 22 bp, Artificial Sequence
  chemically synthesized
caaacattccctacctctcccc

SEQ ID NO: 1376823 - DNA, 22 bp, Artificial Sequence
  chemically synthesized
tgttacttcatttggggagagg

SEQ ID NO: 1376824 - DNA, 22 bp, Artificial Sequence
  chemically synthesized
aaaactgtgttacttcatttgg

SEQ ID NO: 1376825 - DNA, 22 bp, Artificial Sequence
  chemically synthesized
cctacctctccccaaatgaagt

SEQ ID NO: 1376826 - DNA, 22 bp, Artificial Sequence
  chemically synthesized
ttcaaaactgtgttacttcatt

SEQ ID NO: 1376827 - DNA, 22 bp, Artificial Sequence
  chemically synthesized
cctctccccaaatgaagtaaca

SEQ ID NO: 1376828 - DNA, 22 bp, Artificial Sequence
  chemically synthesized
tccccaaatgaagtaacacagt

SEQ ID NO: 1376829 - DNA, 22 bp, Artificial Sequence
  chemically synthesized
cccaaatgaagtaacacagttt

SEQ ID NO: 1376830 - DNA, 22 bp, Artificial Sequence
  chemically synthesized
tgaataatttcttcatcatttc

SEQ ID NO: 1376831 - DNA, 22 bp, Artificial Sequence
  chemically synthesized
gaataatttcttcatcatttct

SEQ ID NO: 1376832 - DNA, 22 bp, Artificial Sequence
  chemically synthesized
aataatttcttcatcatttctt

SEQ ID NO: 1376833 - DNA, 22 bp, Artificial Sequence
  chemically synthesized
ataaacatataaaaagaaaaga

SEQ ID NO: 1376834 - DNA, 22 bp, Artificial Sequence
  chemically synthesized
aataaacatataaaaagaaaag

SEQ ID NO: 1376835 - DNA, 22 bp, Artificial Sequence
  chemically synthesized
cttcatcatttcttttcttttt

SEQ ID NO: 1376836 - DNA, 22 bp, Artificial Sequence
  chemically synthesized
ttcatcatttcttttcttttta

SEQ ID NO: 1376837 - DNA, 22 bp, Artificial Sequence
  chemically synthesized
catcatttcttttctttttata

SEQ ID NO: 1376838 - DNA, 22 bp, Artificial Sequence
  chemically synthesized
atcatttcttttctttttatat

SEQ ID NO: 1376839 - DNA, 22 bp, Artificial Sequence
  chemically synthesized
cttttctttttatatgtttatt

SEQ ID NO: 1376840 - DNA, 22 bp, Artificial Sequence
  chemically synthesized
ttttctttttatatgtttatta

SEQ ID NO: 1376841 - DNA, 22 bp, Artificial Sequence
  chemically synthesized
ttctttttatatgtttattaaa

SEQ ID NO: 1376842 - DNA, 22 bp, Artificial Sequence
  chemically synthesized
tctttttatatgtttattaaac

SEQ ID NO: 1376843 - DNA, 22 bp, Artificial Sequence
  chemically synthesized
ctttttatatgtttattaaaca

SEQ ID NO: 1376844 - DNA, 22 bp, Artificial Sequence
  chemically synthesized
tttttatatgtttattaaacac

SEQ ID NO: 1376845 - DNA, 22 bp, Artificial Sequence
  chemically synthesized
tttatatgtttattaaacacac

SEQ ID NO: 1376846 - DNA, 22 bp, Artificial Sequence
  chemically synthesized
ggaataatatgtgtgtgtttaa

SEQ ID NO: 1376847 - DNA, 22 bp, Artificial Sequence
  chemically synthesized
ttatatgtttattaaacacaca

SEQ ID NO: 1376848 - DNA, 22 bp, Artificial Sequence
  chemically synthesized
aggaataatatgtgtgtgttta

SEQ ID NO: 1376849 - DNA, 22 bp, Artificial Sequence
  chemically synthesized
tatatgtttattaaacacacac

SEQ ID NO: 1376850 - DNA, 22 bp, Artificial Sequence
  chemically synthesized
taggaataatatgtgtgtgttt

SEQ ID NO: 1376851 - DNA, 22 bp, Artificial Sequence
  chemically synthesized
atatgtttattaaacacacaca

SEQ ID NO: 1376852 - DNA, 22 bp, Artificial Sequence
  chemically synthesized
tatgtttattaaacacacacat

SEQ ID NO: 1376853 - DNA, 22 bp, Artificial Sequence
  chemically synthesized
gtctttaggaataatatgtgtg

SEQ ID NO: 1376854 - DNA, 22 bp, Artificial Sequence
  chemically synthesized
agtctttaggaataatatgtgt

SEQ ID NO: 1376855 - DNA, 22 bp, Artificial Sequence
  chemically synthesized
tagtctttaggaataatatgtg

SEQ ID NO: 1376856 - DNA, 22 bp, Artificial Sequence
  chemically synthesized
attaaacacacacatattattc

SEQ ID NO: 1376857 - DNA, 22 bp, Artificial Sequence
  chemically synthesized
ttaaacacacacatattattcc

SEQ ID NO: 1376858 - DNA, 22 bp, Artificial Sequence
  chemically synthesized
aacacacacatattattcctaa

SEQ ID NO: 1376859 - DNA, 22 bp, Artificial Sequence
  chemically synthesized
aaaataaaattttagtctttag

SEQ ID NO: 1376860 - DNA, 22 bp, Artificial Sequence
  chemically synthesized
ttcctaaagactaaaattttat

SEQ ID NO: 1376861 - DNA, 22 bp, Artificial Sequence
  chemically synthesized
ctaaagactaaaattttatttt

SEQ ID NO: 1376862 - DNA, 22 bp, Artificial Sequence
  chemically synthesized
aagactaaaattttattttcaa

SEQ ID NO: 1376863 - DNA, 22 bp, Artificial Sequence
  chemically synthesized
cataaagccaaacatattgaaa

SEQ ID NO: 1376864 - DNA, 22 bp, Artificial Sequence
  chemically synthesized
aaattttattttcaatatgttt

SEQ ID NO: 1376865 - DNA, 22 bp, Artificial Sequence
  chemically synthesized
tattttcaatatgtttggcttt

SEQ ID NO: 1376866 - DNA, 22 bp, Artificial Sequence
  chemically synthesized
attttcaatatgtttggcttta

SEQ ID NO: 1376867 - DNA, 22 bp, Artificial Sequence
  chemically synthesized
ttttcaatatgtttggctttat

SEQ ID NO: 1376868 - DNA, 22 bp, Artificial Sequence
  chemically synthesized
tcaatatgtttggctttatgga

SEQ ID NO: 1376869 - DNA, 22 bp, Artificial Sequence
  chemically synthesized
caatatgtttggctttatggag

SEQ ID NO: 1376870 - DNA, 22 bp, Artificial Sequence
  chemically synthesized
aatatgtttggctttatggaga

SEQ ID NO: 1376871 - DNA, 22 bp, Artificial Sequence
  chemically synthesized
catggtaaatatcatctccata

SEQ ID NO: 1376872 - DNA, 22 bp, Artificial Sequence
  chemically synthesized
ggctttatggagatgatattta

SEQ ID NO: 1376873 - DNA, 22 bp, Artificial Sequence
  chemically synthesized
gctttatggagatgatatttac

SEQ ID NO: 1376874 - DNA, 22 bp, Artificial Sequence
  chemically synthesized
tatggagatgatatttaccatg

SEQ ID NO: 1376875 - DNA, 22 bp, Artificial Sequence
  chemically synthesized
atggagatgatatttaccatgt

SEQ ID NO: 1376876 - DNA, 22 bp, Artificial Sequence
  chemically synthesized
tggagatgatatttaccatgta

SEQ ID NO: 1376877 - DNA, 22 bp, Artificial Sequence
  chemically synthesized
aatggaacatactacatggtaa

SEQ ID NO: 1376878 - DNA, 22 bp, Artificial Sequence
  chemically synthesized
atacctgaatggaacatactac

SEQ ID NO: 1376879 - DNA, 22 bp, Artificial Sequence
  chemically synthesized
gatacctgaatggaacatacta

SEQ ID NO: 1376880 - DNA, 22 bp, Artificial Sequence
  chemically synthesized
accatgtagtatgttccattca

SEQ ID NO: 1376881 - DNA, 22 bp, Artificial Sequence
  chemically synthesized
ccatgtagtatgttccattcag

SEQ ID NO: 1376882 - DNA, 22 bp, Artificial Sequence
  chemically synthesized
agtacagtatcccttgatacct

SEQ ID NO: 1376883 - DNA, 22 bp, Artificial Sequence
  chemically synthesized
tgagtacagtatcccttgatac

SEQ ID NO: 1376884 - DNA, 22 bp, Artificial Sequence
  chemically synthesized
tctgagtacagtatcccttgat

SEQ ID NO: 1376885 - DNA, 22 bp, Artificial Sequence
  chemically synthesized
cattcaggtatcaagggatact

SEQ ID NO: 1376886 - DNA, 22 bp, Artificial Sequence
  chemically synthesized
aggtatcaagggatactgtact

SEQ ID NO: 1376887 - DNA, 22 bp, Artificial Sequence
  chemically synthesized
ataaaaatgtcagatggtgcat

SEQ ID NO: 1376888 - DNA, 22 bp, Artificial Sequence
  chemically synthesized
aataaaaatgtcagatggtgca

SEQ ID NO: 1376889 - DNA, 22 bp, Artificial Sequence
  chemically synthesized
tactcagagaatgcaccatctg

SEQ ID NO: 1376890 - DNA, 22 bp, Artificial Sequence
  chemically synthesized
agagaatgcaccatctgacatt

SEQ ID NO: 1376891 - DNA, 22 bp, Artificial Sequence
  chemically synthesized
aatccaataaatttaataaaaa

SEQ ID NO: 1376892 - DNA, 22 bp, Artificial Sequence
  chemically synthesized
acatttttattaaatttattgg

SEQ ID NO: 1376893 - DNA, 22 bp, Artificial Sequence
  chemically synthesized
ttattaaatttattggatttaa

SEQ ID NO: 1376894 - DNA, 22 bp, Artificial Sequence
  chemically synthesized
tattaaatttattggatttaat

SEQ ID NO: 1376895 - DNA, 22 bp, Artificial Sequence
  chemically synthesized
aaaaaacccaatattaaatcca

SEQ ID NO: 1376896 - DNA, 22 bp, Artificial Sequence
  chemically synthesized
attaaatttattggatttaata

SEQ ID NO: 1376897 - DNA, 22 bp, Artificial Sequence
  chemically synthesized
ttaaatttattggatttaatat

SEQ ID NO: 1376898 - DNA, 22 bp, Artificial Sequence
  chemically synthesized
aatttattggatttaatattgg

SEQ ID NO: 1376899 - DNA, 22 bp, Artificial Sequence
  chemically synthesized
taattcaaaaaacccaatatta

SEQ ID NO: 1376900 - DNA, 22 bp, Artificial Sequence
  chemically synthesized
attggatttaatattgggtttt

SEQ ID NO: 1376901 - DNA, 22 bp, Artificial Sequence
  chemically synthesized
ttggatttaatattgggttttt

SEQ ID NO: 1376902 - DNA, 22 bp, Artificial Sequence
  chemically synthesized
gatttaatattgggttttttga

SEQ ID NO: 1376903 - DNA, 22 bp, Artificial Sequence
  chemically synthesized
aatattgggttttttgaattat

SEQ ID NO: 1376904 - DNA, 22 bp, Artificial Sequence
  chemically synthesized
atattgggttttttgaattata

SEQ ID NO: 1376905 - DNA, 22 bp, Artificial Sequence
  chemically synthesized
ggttttttgaattataatgttg

SEQ ID NO: 1376906 - DNA, 22 bp, Artificial Sequence
  chemically synthesized
tttgaattataatgttggattt

SEQ ID NO: 1376907 - DNA, 22 bp, Artificial Sequence
  chemically synthesized
ttgaattataatgttggattta

SEQ ID NO: 1376908 - DNA, 22 bp, Artificial Sequence
  chemically synthesized
tgaattataatgttggatttat

SEQ ID NO: 1376909 - DNA, 22 bp, Artificial Sequence
  chemically synthesized
gaattataatgttggatttatt

SEQ ID NO: 1376910 - DNA, 22 bp, Artificial Sequence
  chemically synthesized
aattataatgttggatttattt

SEQ ID NO: 1376911 - DNA, 22 bp, Artificial Sequence
  chemically synthesized
taatgttggatttatttttttc

SEQ ID NO: 1376912 - DNA, 22 bp, Artificial Sequence
  chemically synthesized
gcagtataatatccaaagaaaa

SEQ ID NO: 1376913 - DNA, 22 bp, Artificial Sequence
  chemically synthesized
gatttatttttttctttggata

SEQ ID NO: 1376914 - DNA, 22 bp, Artificial Sequence
  chemically synthesized
atttttttctttggatattata

SEQ ID NO: 1376915 - DNA, 22 bp, Artificial Sequence
  chemically synthesized
tttttttctttggatattatac

SEQ ID NO: 1376916 - DNA, 22 bp, Artificial Sequence
  chemically synthesized
ttttctttggatattatactgc

SEQ ID NO: 1376917 - DNA, 22 bp, Artificial Sequence
  chemically synthesized
tttctttggatattatactgct

SEQ ID NO: 1376918 - DNA, 22 bp, Artificial Sequence
  chemically synthesized
ttctttggatattatactgcta

SEQ ID NO: 1376919 - DNA, 22 bp, Artificial Sequence
  chemically synthesized
tctttggatattatactgctaa

SEQ ID NO: 1376920 - DNA, 22 bp, Artificial Sequence
  chemically synthesized
ctttggatattatactgctaac

SEQ ID NO: 1376921 - DNA, 22 bp, Artificial Sequence
  chemically synthesized
tttggatattatactgctaaca

SEQ ID NO: 1376922 - DNA, 22 bp, Artificial Sequence
  chemically synthesized
tggatattatactgctaacatt

SEQ ID NO: 1376923 - DNA, 22 bp, Artificial Sequence
  chemically synthesized
ggatattatactgctaacattc

SEQ ID NO: 1376924 - DNA, 22 bp, Artificial Sequence
  chemically synthesized
gatattatactgctaacattca

SEQ ID NO: 1376925 - DNA, 22 bp, Artificial Sequence
  chemically synthesized
tactgctaacattcatcgatat

SEQ ID NO: 1376926 - DNA, 22 bp, Artificial Sequence
  chemically synthesized
ctaacattcatcgatattgttt

SEQ ID NO: 1376927 - DNA, 22 bp, Artificial Sequence
  chemically synthesized
acattcatcgatattgttttgt

SEQ ID NO: 1376928 - DNA, 22 bp, Artificial Sequence
  chemically synthesized
atcgatattgttttgtgttgtt

SEQ ID NO: 1376929 - DNA, 22 bp, Artificial Sequence
  chemically synthesized
aaaaaagaaccacaacaacaca

SEQ ID NO: 1376930 - DNA, 22 bp, Artificial Sequence
  chemically synthesized
ttttgtgttgttgtggttcttt

SEQ ID NO: 1376931 - DNA, 22 bp, Artificial Sequence
  chemically synthesized
tacagaactgaaaaaagaacca

SEQ ID NO: 1376932 - DNA, 22 bp, Artificial Sequence
  chemically synthesized
tgtgttgttgtggttctttttt

SEQ ID NO: 1376933 - DNA, 22 bp, Artificial Sequence
  chemically synthesized
gtgttgttgtggttcttttttc

SEQ ID NO: 1376934 - DNA, 22 bp, Artificial Sequence
  chemically synthesized
ttatacagaactgaaaaaagaa

SEQ ID NO: 1376935 - DNA, 22 bp, Artificial Sequence
  chemically synthesized
tgttgttgtggttcttttttca

SEQ ID NO: 1376936 - DNA, 22 bp, Artificial Sequence
  chemically synthesized
ttgtggttcttttttcagttct

SEQ ID NO: 1376937 - DNA, 22 bp, Artificial Sequence
  chemically synthesized
tggttcttttttcagttctgta

SEQ ID NO: 1376938 - DNA, 22 bp, Artificial Sequence
  chemically synthesized
tgtgggctattatacagaactg

SEQ ID NO: 1376939 - DNA, 22 bp, Artificial Sequence
  chemically synthesized
ctatgtgggctattatacagaa

SEQ ID NO: 1376940 - DNA, 22 bp, Artificial Sequence
  chemically synthesized
ttttttcagttctgtataatag

SEQ ID NO: 1376941 - DNA, 22 bp, Artificial Sequence
  chemically synthesized
ctactatgtgggctattataca

SEQ ID NO: 1376942 - DNA, 22 bp, Artificial Sequence
  chemically synthesized
actactatgtgggctattatac

SEQ ID NO: 1376943 - DNA, 22 bp, Artificial Sequence
  chemically synthesized
ttttcagttctgtataatagcc

SEQ ID NO: 1376944 - DNA, 22 bp, Artificial Sequence
  chemically synthesized
tttcagttctgtataatagccc

SEQ ID NO: 1376945 - DNA, 22 bp, Artificial Sequence
  chemically synthesized
ttcagttctgtataatagccca

SEQ ID NO: 1376946 - DNA, 22 bp, Artificial Sequence
  chemically synthesized
tcagttctgtataatagcccac

SEQ ID NO: 1376947 - DNA, 22 bp, Artificial Sequence
  chemically synthesized
cagttctgtataatagcccaca

SEQ ID NO: 1376948 - DNA, 22 bp, Artificial Sequence
  chemically synthesized
agttctgtataatagcccacat

SEQ ID NO: 1376949 - DNA, 22 bp, Artificial Sequence
  chemically synthesized
tgtataatagcccacatagtag

SEQ ID NO: 1376950 - DNA, 22 bp, Artificial Sequence
  chemically synthesized
tataatagcccacatagtagta

SEQ ID NO: 1376951 - DNA, 22 bp, Artificial Sequence
  chemically synthesized
atatatatatatatatatatat

SEQ ID NO: 1376952 - DNA, 22 bp, Artificial Sequence
  chemically synthesized
ttcattatatatatatatatat

SEQ ID NO: 1376953 - DNA, 22 bp, Artificial Sequence
  chemically synthesized
attatatatatatatatatata

SEQ ID NO: 1376954 - DNA, 22 bp, Artificial Sequence
  chemically synthesized
tatatatatatatatatatata

SEQ ID NO: 1376955 - DNA, 22 bp, Artificial Sequence
  chemically synthesized
atacacacatacacacacatac

SEQ ID NO: 1376956 - DNA, 22 bp, Artificial Sequence
  chemically synthesized
taatacacacatacacacacat

SEQ ID NO: 1376957 - DNA, 22 bp, Artificial Sequence
  chemically synthesized
gtatgtatgtatgtgtgtgtat

SEQ ID NO: 1376958 - DNA, 22 bp, Artificial Sequence
  chemically synthesized
tatgtatgtatgtgtgtgtatg

SEQ ID NO: 1376959 - DNA, 22 bp, Artificial Sequence
  chemically synthesized
ttctaatacacacatacacaca

SEQ ID NO: 1376960 - DNA, 22 bp, Artificial Sequence
  chemically synthesized
gggaccactgttctaatacaca

SEQ ID NO: 1376961 - DNA, 22 bp, Artificial Sequence
  chemically synthesized
gtgccaaaaaggttggggacca

SEQ ID NO: 1376962 - DNA, 22 bp, Artificial Sequence
  chemically synthesized
cctagtgccaaaaaggttgggg

SEQ ID NO: 1376963 - DNA, 22 bp, Artificial Sequence
  chemically synthesized
gaacagtggtccccaacctttt

SEQ ID NO: 1376964 - DNA, 22 bp, Artificial Sequence
  chemically synthesized
ttccctagtgccaaaaaggttg

SEQ ID NO: 1376965 - DNA, 22 bp, Artificial Sequence
  chemically synthesized
cacaaaactgttccctagtgcc

SEQ ID NO: 1376966 - DNA, 22 bp, Artificial Sequence
  chemically synthesized
ccacaaaactgttccctagtgc

SEQ ID NO: 1376967 - DNA, 22 bp, Artificial Sequence
  chemically synthesized
tcttccacaaaactgttcccta

SEQ ID NO: 1376968 - DNA, 22 bp, Artificial Sequence
  chemically synthesized
tttggcactagggaacagtttt

SEQ ID NO: 1376969 - DNA, 22 bp, Artificial Sequence
  chemically synthesized
ttggcactagggaacagttttg

SEQ ID NO: 1376970 - DNA, 22 bp, Artificial Sequence
  chemically synthesized
tggcactagggaacagttttgt

SEQ ID NO: 1376971 - DNA, 22 bp, Artificial Sequence
  chemically synthesized
ggcactagggaacagttttgtg

SEQ ID NO: 1376972 - DNA, 22 bp, Artificial Sequence
  chemically synthesized
gcactagggaacagttttgtgg

SEQ ID NO: 1376973 - DNA, 22 bp, Artificial Sequence
  chemically synthesized
tggaataattgtcttccacaaa

SEQ ID NO: 1376974 - DNA, 22 bp, Artificial Sequence
  chemically synthesized
gggaacagttttgtggaagaca

SEQ ID NO: 1376975 - DNA, 22 bp, Artificial Sequence
  chemically synthesized
tctgtggaataattgtcttcca

SEQ ID NO: 1376976 - DNA, 22 bp, Artificial Sequence
  chemically synthesized
tgtggaagacaattattccaca

SEQ ID NO: 1376977 - DNA, 22 bp, Artificial Sequence
  chemically synthesized
gtggaagacaattattccacag

SEQ ID NO: 1376978 - DNA, 22 bp, Artificial Sequence
  chemically synthesized
tggaagacaattattccacaga

SEQ ID NO: 1376979 - DNA, 22 bp, Artificial Sequence
  chemically synthesized
ccccaaacccctgtctgtggaa

SEQ ID NO: 1376980 - DNA, 22 bp, Artificial Sequence
  chemically synthesized
acctcccccaaacccctgtctg

SEQ ID NO: 1376981 - DNA, 22 bp, Artificial Sequence
  chemically synthesized
cacctcccccaaacccctgtct

SEQ ID NO: 1376982 - DNA, 22 bp, Artificial Sequence
  chemically synthesized
tcacctcccccaaacccctgtc

SEQ ID NO: 1376983 - DNA, 22 bp, Artificial Sequence
  chemically synthesized
ttccacagacaggggtttgggg

SEQ ID NO: 1376984 - DNA, 22 bp, Artificial Sequence
  chemically synthesized
cacagacaggggtttgggggag

SEQ ID NO: 1376985 - DNA, 22 bp, Artificial Sequence
  chemically synthesized
tacccccagattttcacctccc

SEQ ID NO: 1376986 - DNA, 22 bp, Artificial Sequence
  chemically synthesized
gggggaggtgaaaatctggggg

SEQ ID NO: 1376987 - DNA, 22 bp, Artificial Sequence
  chemically synthesized
ggggaggtgaaaatctgggggt

SEQ ID NO: 1376988 - DNA, 22 bp, Artificial Sequence
  chemically synthesized
aaccccaaaccacaacccctat

SEQ ID NO: 1376989 - DNA, 22 bp, Artificial Sequence
  chemically synthesized
caaccccaaaccacaaccccta

SEQ ID NO: 1376990 - DNA, 22 bp, Artificial Sequence
  chemically synthesized
ggggtataggggttgtggtttg

SEQ ID NO: 1376991 - DNA, 22 bp, Artificial Sequence
  chemically synthesized
aggtggaacagtttcaacccca

SEQ ID NO: 1376992 - DNA, 22 bp, Artificial Sequence
  chemically synthesized
tggtttggggttgaaactgttc

SEQ ID NO: 1376993 - DNA, 22 bp, Artificial Sequence
  chemically synthesized
atgagctgaggtggaacagttt

SEQ ID NO: 1376994 - DNA, 22 bp, Artificial Sequence
  chemically synthesized
ggggttgaaactgttccacctc

SEQ ID NO: 1376995 - DNA, 22 bp, Artificial Sequence
  chemically synthesized
gggttgaaactgttccacctca

SEQ ID NO: 1376996 - DNA, 22 bp, Artificial Sequence
  chemically synthesized
atgcctaatgagctgaggtgga

SEQ ID NO: 1376997 - DNA, 22 bp, Artificial Sequence
  chemically synthesized
aaactgttccacctcagctcat

SEQ ID NO: 1376998 - DNA, 22 bp, Artificial Sequence
  chemically synthesized
tatgaatctaatgcctaatgag

SEQ ID NO: 1376999 - DNA, 22 bp, Artificial Sequence
  chemically synthesized
ttccacctcagctcattaggca

SEQ ID NO: 1377000 - DNA, 22 bp, Artificial Sequence
  chemically synthesized
atatgaatctaatgcctaatga

SEQ ID NO: 1377001 - DNA, 22 bp, Artificial Sequence
  chemically synthesized
cacctcagctcattaggcatta

SEQ ID NO: 1377002 - DNA, 22 bp, Artificial Sequence
  chemically synthesized
cttatatgaatctaatgcctaa

SEQ ID NO: 1377003 - DNA, 22 bp, Artificial Sequence
  chemically synthesized
agctcattaggcattagattca

SEQ ID NO: 1377004 - DNA, 22 bp, Artificial Sequence
  chemically synthesized
caggctccttatatgaatctaa

SEQ ID NO: 1377005 - DNA, 22 bp, Artificial Sequence
  chemically synthesized
attaggcattagattcatataa

SEQ ID NO: 1377006 - DNA, 22 bp, Artificial Sequence
  chemically synthesized
ggcattagattcatataaggag

SEQ ID NO: 1377007 - DNA, 22 bp, Artificial Sequence
  chemically synthesized
gattcatataaggagcctgcaa

SEQ ID NO: 1377008 - DNA, 22 bp, Artificial Sequence
  chemically synthesized
atataaggagcctgcaacttat

SEQ ID NO: 1377009 - DNA, 22 bp, Artificial Sequence
  chemically synthesized
cgcatgtgagggaaataagttg

SEQ ID NO: 1377010 - DNA, 22 bp, Artificial Sequence
  chemically synthesized
tgaactgcgcatgtgagggaaa

SEQ ID NO: 1377011 - DNA, 22 bp, Artificial Sequence
  chemically synthesized
ctgtgaactgcgcatgtgaggg

SEQ ID NO: 1377012 - DNA, 22 bp, Artificial Sequence
  chemically synthesized
caacttatttccctcacatgcg

SEQ ID NO: 1377013 - DNA, 22 bp, Artificial Sequence
  chemically synthesized
atttccctcacatgcgcagttc

SEQ ID NO: 1377014 - DNA, 22 bp, Artificial Sequence
  chemically synthesized
tttccctcacatgcgcagttca

SEQ ID NO: 1377015 - DNA, 22 bp, Artificial Sequence
  chemically synthesized
ccctcacatgcgcagttcacag

SEQ ID NO: 1377016 - DNA, 22 bp, Artificial Sequence
  chemically synthesized
cctcacatgcgcagttcacagt

SEQ ID NO: 1377017 - DNA, 22 bp, Artificial Sequence
  chemically synthesized
acatgcgcagttcacagtaggg

SEQ ID NO: 1377018 - DNA, 22 bp, Artificial Sequence
  chemically synthesized
ataggagagccaaccctactgt

SEQ ID NO: 1377019 - DNA, 22 bp, Artificial Sequence
  chemically synthesized
tcataggagagccaaccctact

SEQ ID NO: 1377020 - DNA, 22 bp, Artificial Sequence
  chemically synthesized
gattctcataggagagccaacc

SEQ ID NO: 1377021 - DNA, 22 bp, Artificial Sequence
  chemically synthesized
acagtagggttggctctcctat

SEQ ID NO: 1377022 - DNA, 22 bp, Artificial Sequence
  chemically synthesized
gctctcctatgagaatctaatg

SEQ ID NO: 1377023 - DNA, 22 bp, Artificial Sequence
  chemically synthesized
tcatatcagtggcagcattaga

SEQ ID NO: 1377024 - DNA, 22 bp, Artificial Sequence
  chemically synthesized
tcctatgagaatctaatgctgc

SEQ ID NO: 1377025 - DNA, 22 bp, Artificial Sequence
  chemically synthesized
ctatgagaatctaatgctgcca

SEQ ID NO: 1377026 - DNA, 22 bp, Artificial Sequence
  chemically synthesized
ctgtcatatcagtggcagcatt

SEQ ID NO: 1377027 - DNA, 22 bp, Artificial Sequence
  chemically synthesized
tgagaatctaatgctgccactg

SEQ ID NO: 1377028 - DNA, 22 bp, Artificial Sequence
  chemically synthesized
cctcctgtcatatcagtggcag

SEQ ID NO: 1377029 - DNA, 22 bp, Artificial Sequence
  chemically synthesized
tgcctcctgtcatatcagtggc

SEQ ID NO: 1377030 - DNA, 22 bp, Artificial Sequence
  chemically synthesized
agctctgcctcctgtcatatca

SEQ ID NO: 1377031 - DNA, 22 bp, Artificial Sequence
  chemically synthesized
atgctgccactgatatgacagg

SEQ ID NO: 1377032 - DNA, 22 bp, Artificial Sequence
  chemically synthesized
cctgagctctgcctcctgtcat

SEQ ID NO: 1377033 - DNA, 22 bp, Artificial Sequence
  chemically synthesized
ctgcctgagctctgcctcctgt

SEQ ID NO: 1377034 - DNA, 22 bp, Artificial Sequence
  chemically synthesized
ccactgatatgacaggaggcag

SEQ ID NO: 1377035 - DNA, 22 bp, Artificial Sequence
  chemically synthesized
atatgacaggaggcagagctca

SEQ ID NO: 1377036 - DNA, 22 bp, Artificial Sequence
  chemically synthesized
aggcagtaatgtttgctcacct

SEQ ID NO: 1377037 - DNA, 22 bp, Artificial Sequence
  chemically synthesized
cacagcaggaggtgagcagaag

SEQ ID NO: 1377038 - DNA, 22 bp, Artificial Sequence
  chemically synthesized
gctcaccttctgctcacctcct

SEQ ID NO: 1377039 - DNA, 22 bp, Artificial Sequence
  chemically synthesized
ctcaccttctgctcacctcctg

SEQ ID NO: 1377040 - DNA, 22 bp, Artificial Sequence
  chemically synthesized
accttctgctcacctcctgctg

SEQ ID NO: 1377041 - DNA, 22 bp, Artificial Sequence
  chemically synthesized
ggaacccagctgcacagcagga

SEQ ID NO: 1377042 - DNA, 22 bp, Artificial Sequence
  chemically synthesized
ctgctcacctcctgctgtgcag

SEQ ID NO: 1377043 - DNA, 22 bp, Artificial Sequence
  chemically synthesized
ttaggaacccagctgcacagca

SEQ ID NO: 1377044 - DNA, 22 bp, Artificial Sequence
  chemically synthesized
tgctcacctcctgctgtgcagc

SEQ ID NO: 1377045 - DNA, 22 bp, Artificial Sequence
  chemically synthesized
ctcacctcctgctgtgcagctg

SEQ ID NO: 1377046 - DNA, 22 bp, Artificial Sequence
  chemically synthesized
acctcctgctgtgcagctgggt

SEQ ID NO: 1377047 - DNA, 22 bp, Artificial Sequence
  chemically synthesized
tggcctgttaggaacccagctg

SEQ ID NO: 1377048 - DNA, 22 bp, Artificial Sequence
  chemically synthesized
ctgctgtgcagctgggttccta

SEQ ID NO: 1377049 - DNA, 22 bp, Artificial Sequence
  chemically synthesized
gtctgtggcctgttaggaaccc

SEQ ID NO: 1377050 - DNA, 22 bp, Artificial Sequence
  chemically synthesized
ctgtgcagctgggttcctaaca

SEQ ID NO: 1377051 - DNA, 22 bp, Artificial Sequence
  chemically synthesized
tgcagctgggttcctaacaggc

SEQ ID NO: 1377052 - DNA, 22 bp, Artificial Sequence
  chemically synthesized
ggttcctaacaggccacagacc

SEQ ID NO: 1377053 - DNA, 22 bp, Artificial Sequence
  chemically synthesized
ctaacaggccacagaccagtac

SEQ ID NO: 1377054 - DNA, 22 bp, Artificial Sequence
  chemically synthesized
ggccaaggaccggtactggtct

SEQ ID NO: 1377055 - DNA, 22 bp, Artificial Sequence
  chemically synthesized
acaggccacagaccagtaccgg

SEQ ID NO: 1377056 - DNA, 22 bp, Artificial Sequence
  chemically synthesized
atacaagggtccccaacccctg

SEQ ID NO: 1377057 - DNA, 22 bp, Artificial Sequence
  chemically synthesized
taatacaagggtccccaacccc

SEQ ID NO: 1377058 - DNA, 22 bp, Artificial Sequence
  chemically synthesized
ctaatacaagggtccccaaccc

SEQ ID NO: 1377059 - DNA, 22 bp, Artificial Sequence
  chemically synthesized
ggcccaggggttggggaccctt

SEQ ID NO: 1377060 - DNA, 22 bp, Artificial Sequence
  chemically synthesized
gcccaggggttggggacccttg

SEQ ID NO: 1377061 - DNA, 22 bp, Artificial Sequence
  chemically synthesized
tatatgtgtgtcttctaataca

SEQ ID NO: 1377062 - DNA, 22 bp, Artificial Sequence
  chemically synthesized
gtatatgtgtgtcttctaatac

SEQ ID NO: 1377063 - DNA, 22 bp, Artificial Sequence
  chemically synthesized
tgtatatgtgtgtcttctaata

SEQ ID NO: 1377064 - DNA, 22 bp, Artificial Sequence
  chemically synthesized
gggacccttgtattagaagaca

SEQ ID NO: 1377065 - DNA, 22 bp, Artificial Sequence
  chemically synthesized
taatggttttgtatatgtgtgt

SEQ ID NO: 1377066 - DNA, 22 bp, Artificial Sequence
  chemically synthesized
gtaatggttttgtatatgtgtg

SEQ ID NO: 1377067 - DNA, 22 bp, Artificial Sequence
  chemically synthesized
gtattagaagacacacatatac

SEQ ID NO: 1377068 - DNA, 22 bp, Artificial Sequence
  chemically synthesized
tattagaagacacacatataca

SEQ ID NO: 1377069 - DNA, 22 bp, Artificial Sequence
  chemically synthesized
tgatttgtaatggttttgtata

SEQ ID NO: 1377070 - DNA, 22 bp, Artificial Sequence
  chemically synthesized
gaagacacacatatacaaaacc

SEQ ID NO: 1377071 - DNA, 22 bp, Artificial Sequence
  chemically synthesized
gtgatttgtaatggttttgtat

SEQ ID NO: 1377072 - DNA, 22 bp, Artificial Sequence
  chemically synthesized
tatatatgtatatatgtttgtg

SEQ ID NO: 1377073 - DNA, 22 bp, Artificial Sequence
  chemically synthesized
gtatatatgtatatatgtttgt

SEQ ID NO: 1377074 - DNA, 22 bp, Artificial Sequence
  chemically synthesized
caaatcacaaacatatatacat

SEQ ID NO: 1377075 - DNA, 22 bp, Artificial Sequence
  chemically synthesized
tatatgtgtttgtatatatgta

SEQ ID NO: 1377076 - DNA, 22 bp, Artificial Sequence
  chemically synthesized
atatatgtgtttgtatatatgt

SEQ ID NO: 1377077 - DNA, 22 bp, Artificial Sequence
  chemically synthesized
aaaatagacaatacgtatttat

SEQ ID NO: 1377078 - DNA, 22 bp, Artificial Sequence
  chemically synthesized
aattaaaaatagacaatacgta

SEQ ID NO: 1377079 - DNA, 22 bp, Artificial Sequence
  chemically synthesized
gaattaaaaatagacaatacgt

SEQ ID NO: 1377080 - DNA, 22 bp, Artificial Sequence
  chemically synthesized
ccttgaattaaaaatagacaat

SEQ ID NO: 1377081 - DNA, 22 bp, Artificial Sequence
  chemically synthesized
accttgaattaaaaatagacaa

SEQ ID NO: 1377082 - DNA, 22 bp, Artificial Sequence
  chemically synthesized
ccaaaacttaccttgaattaaa

SEQ ID NO: 1377083 - DNA, 22 bp, Artificial Sequence
  chemically synthesized
gccaaaacttaccttgaattaa

SEQ ID NO: 1377084 - DNA, 22 bp, Artificial Sequence
  chemically synthesized
tttgccaaaacttaccttgaat

SEQ ID NO: 1377085 - DNA, 22 bp, Artificial Sequence
  chemically synthesized
tctatttttaattcaaggtaag

SEQ ID NO: 1377086 - DNA, 22 bp, Artificial Sequence
  chemically synthesized
tatttgccaaaacttaccttga

SEQ ID NO: 1377087 - DNA, 22 bp, Artificial Sequence
  chemically synthesized
ctatttgccaaaacttaccttg

SEQ ID NO: 1377088 - DNA, 22 bp, Artificial Sequence
  chemically synthesized
tctatttgccaaaacttacctt

SEQ ID NO: 1377089 - DNA, 22 bp, Artificial Sequence
  chemically synthesized
tttttaattcaaggtaagtttt

SEQ ID NO: 1377090 - DNA, 22 bp, Artificial Sequence
  chemically synthesized
ctttctatttgccaaaacttac

SEQ ID NO: 1377091 - DNA, 22 bp, Artificial Sequence
  chemically synthesized
ttaattcaaggtaagttttggc

SEQ ID NO: 1377092 - DNA, 22 bp, Artificial Sequence
  chemically synthesized
taattcaaggtaagttttggca

SEQ ID NO: 1377093 - DNA, 22 bp, Artificial Sequence
  chemically synthesized
aattcaaggtaagttttggcaa

SEQ ID NO: 1377094 - DNA, 22 bp, Artificial Sequence
  chemically synthesized
attcaaggtaagttttggcaaa

SEQ ID NO: 1377095 - DNA, 22 bp, Artificial Sequence
  chemically synthesized
aaggtaagttttggcaaataga

SEQ ID NO: 1377096 - DNA, 22 bp, Artificial Sequence
  chemically synthesized
agaaagcattactttctatttg

SEQ ID NO: 1377097 - DNA, 22 bp, Artificial Sequence
  chemically synthesized
tggcaaatagaaagtaatgctt

SEQ ID NO: 1377098 - DNA, 22 bp, Artificial Sequence
  chemically synthesized
ggcaaatagaaagtaatgcttt

SEQ ID NO: 1377099 - DNA, 22 bp, Artificial Sequence
  chemically synthesized
gcaaatagaaagtaatgctttc

SEQ ID NO: 1377100 - DNA, 22 bp, Artificial Sequence
  chemically synthesized
aataaatatgatagttaagaaa

SEQ ID NO: 1377101 - DNA, 22 bp, Artificial Sequence
  chemically synthesized
gaataaatatgatagttaagaa

SEQ ID NO: 1377102 - DNA, 22 bp, Artificial Sequence
  chemically synthesized
catatatttgaataaatatgat

SEQ ID NO: 1377103 - DNA, 22 bp, Artificial Sequence
  chemically synthesized
ccatatatttgaataaatatga

SEQ ID NO: 1377104 - DNA, 22 bp, Artificial Sequence
  chemically synthesized
tcttaactatcatatttattca

SEQ ID NO: 1377105 - DNA, 22 bp, Artificial Sequence
  chemically synthesized
cttaactatcatatttattcaa

SEQ ID NO: 1377106 - DNA, 22 bp, Artificial Sequence
  chemically synthesized
ttaactatcatatttattcaaa

SEQ ID NO: 1377107 - DNA, 22 bp, Artificial Sequence
  chemically synthesized
aactatcatatttattcaaata

SEQ ID NO: 1377108 - DNA, 22 bp, Artificial Sequence
  chemically synthesized
actatcatatttattcaaatat

SEQ ID NO: 1377109 - DNA, 22 bp, Artificial Sequence
  chemically synthesized
gaggcaaatttccatatatttg

SEQ ID NO: 1377110 - DNA, 22 bp, Artificial Sequence
  chemically synthesized
tcatatttattcaaatatatgg

SEQ ID NO: 1377111 - DNA, 22 bp, Artificial Sequence
  chemically synthesized
ggaggcaaatttccatatattt

SEQ ID NO: 1377112 - DNA, 22 bp, Artificial Sequence
  chemically synthesized
atatttggaggcaaatttccat

SEQ ID NO: 1377113 - DNA, 22 bp, Artificial Sequence
  chemically synthesized
gatatttggaggcaaatttcca

SEQ ID NO: 1377114 - DNA, 22 bp, Artificial Sequence
  chemically synthesized
attcaaatatatggaaatttgc

SEQ ID NO: 1377115 - DNA, 22 bp, Artificial Sequence
  chemically synthesized
ttcaaatatatggaaatttgcc

SEQ ID NO: 1377116 - DNA, 22 bp, Artificial Sequence
  chemically synthesized
aaatatatggaaatttgcctcc

SEQ ID NO: 1377117 - DNA, 22 bp, Artificial Sequence
  chemically synthesized
acaaatttgatatttggaggca

SEQ ID NO: 1377118 - DNA, 22 bp, Artificial Sequence
  chemically synthesized
aacaaatttgatatttggaggc

SEQ ID NO: 1377119 - DNA, 22 bp, Artificial Sequence
  chemically synthesized
tttaacaaatttgatatttgga

SEQ ID NO: 1377120 - DNA, 22 bp, Artificial Sequence
  chemically synthesized
cacctgtttaacaaatttgata

SEQ ID NO: 1377121 - DNA, 22 bp, Artificial Sequence
  chemically synthesized
tccacctgtttaacaaatttga

SEQ ID NO: 1377122 - DNA, 22 bp, Artificial Sequence
  chemically synthesized
gcctccaaatatcaaatttgtt

SEQ ID NO: 1377123 - DNA, 22 bp, Artificial Sequence
  chemically synthesized
cctccaaatatcaaatttgtta

SEQ ID NO: 1377124 - DNA, 22 bp, Artificial Sequence
  chemically synthesized
ttctccacctgtttaacaaatt

SEQ ID NO: 1377125 - DNA, 22 bp, Artificial Sequence
  chemically synthesized
tattctccacctgtttaacaaa

SEQ ID NO: 1377126 - DNA, 22 bp, Artificial Sequence
  chemically synthesized
caaatatcaaatttgttaaaca

SEQ ID NO: 1377127 - DNA, 22 bp, Artificial Sequence
  chemically synthesized
ctattctccacctgtttaacaa

SEQ ID NO: 1377128 - DNA, 22 bp, Artificial Sequence
  chemically synthesized
cttctattctccacctgtttaa

SEQ ID NO: 1377129 - DNA, 22 bp, Artificial Sequence
  chemically synthesized
gttaaacaggtggagaatagaa

SEQ ID NO: 1377130 - DNA, 22 bp, Artificial Sequence
  chemically synthesized
ttaaacaggtggagaatagaag

SEQ ID NO: 1377131 - DNA, 22 bp, Artificial Sequence
  chemically synthesized
atatgaatagttacttctattc

SEQ ID NO: 1377132 - DNA, 22 bp, Artificial Sequence
  chemically synthesized
gatatgaatagttacttctatt

SEQ ID NO: 1377133 - DNA, 22 bp, Artificial Sequence
  chemically synthesized
aacaggtggagaatagaagtaa

SEQ ID NO: 1377134 - DNA, 22 bp, Artificial Sequence
  chemically synthesized
tgatatgaatagttacttctat

SEQ ID NO: 1377135 - DNA, 22 bp, Artificial Sequence
  chemically synthesized
aatggttttgatatgaatagtt

SEQ ID NO: 1377136 - DNA, 22 bp, Artificial Sequence
  chemically synthesized
aaatggttttgatatgaatagt

SEQ ID NO: 1377137 - DNA, 22 bp, Artificial Sequence
  chemically synthesized
taaatggttttgatatgaatag

SEQ ID NO: 1377138 - DNA, 22 bp, Artificial Sequence
  chemically synthesized
tattttaaatggttttgatatg

SEQ ID NO: 1377139 - DNA, 22 bp, Artificial Sequence
  chemically synthesized
atattttaaatggttttgatat

SEQ ID NO: 1377140 - DNA, 22 bp, Artificial Sequence
  chemically synthesized
tatttatattttaaatggtttt

SEQ ID NO: 1377141 - DNA, 22 bp, Artificial Sequence
  chemically synthesized
ttcatatcaaaaccatttaaaa

SEQ ID NO: 1377142 - DNA, 22 bp, Artificial Sequence
  chemically synthesized
atatcaaaaccatttaaaatat

SEQ ID NO: 1377143 - DNA, 22 bp, Artificial Sequence
  chemically synthesized
ataattatatttatattttaaa

SEQ ID NO: 1377144 - DNA, 22 bp, Artificial Sequence
  chemically synthesized
gataattatatttatattttaa

SEQ ID NO: 1377145 - DNA, 22 bp, Artificial Sequence
  chemically synthesized
tgataattatatttatatttta

SEQ ID NO: 1377146 - DNA, 22 bp, Artificial Sequence
  chemically synthesized
aaaatataaatataattatcaa

SEQ ID NO: 1377147 - DNA, 22 bp, Artificial Sequence
  chemically synthesized
aaatataaatataattatcaaa

SEQ ID NO: 1377148 - DNA, 22 bp, Artificial Sequence
  chemically synthesized
gaatatatagtagagttttgat

SEQ ID NO: 1377149 - DNA, 22 bp, Artificial Sequence
  chemically synthesized
agaatatatagtagagttttga

SEQ ID NO: 1377150 - DNA, 22 bp, Artificial Sequence
  chemically synthesized
tcaaaactctactatatattct

SEQ ID NO: 1377151 - DNA, 22 bp, Artificial Sequence
  chemically synthesized
tactatatattctaaattatat

SEQ ID NO: 1377152 - DNA, 22 bp, Artificial Sequence
  chemically synthesized
ctatatattctaaattatatat

SEQ ID NO: 1377153 - DNA, 22 bp, Artificial Sequence
  chemically synthesized
cacaaataaaaaatatataatt

SEQ ID NO: 1377154 - DNA, 22 bp, Artificial Sequence
  chemically synthesized
tgcacaaataaaaaatatataa

SEQ ID NO: 1377155 - DNA, 22 bp, Artificial Sequence
  chemically synthesized
tatattctaaattatatatttt

SEQ ID NO: 1377156 - DNA, 22 bp, Artificial Sequence
  chemically synthesized
ctctgcacaaataaaaaatata

SEQ ID NO: 1377157 - DNA, 22 bp, Artificial Sequence
  chemically synthesized
taaattatatattttttatttg

SEQ ID NO: 1377158 - DNA, 22 bp, Artificial Sequence
  chemically synthesized
cattcctctgcacaaataaaaa

SEQ ID NO: 1377159 - DNA, 22 bp, Artificial Sequence
  chemically synthesized
aattatatattttttatttgtg

SEQ ID NO: 1377160 - DNA, 22 bp, Artificial Sequence
  chemically synthesized
caactgcattcctctgcacaaa

SEQ ID NO: 1377161 - DNA, 22 bp, Artificial Sequence
  chemically synthesized
tatattttttatttgtgcagag

SEQ ID NO: 1377162 - DNA, 22 bp, Artificial Sequence
  chemically synthesized
acaactgcattcctctgcacaa

SEQ ID NO: 1377163 - DNA, 22 bp, Artificial Sequence
  chemically synthesized
tacaactgcattcctctgcaca

SEQ ID NO: 1377164 - DNA, 22 bp, Artificial Sequence
  chemically synthesized
tttacaactgcattcctctgca

SEQ ID NO: 1377165 - DNA, 22 bp, Artificial Sequence
  chemically synthesized
ctttacaactgcattcctctgc

SEQ ID NO: 1377166 - DNA, 22 bp, Artificial Sequence
  chemically synthesized
tctttacaactgcattcctctg

SEQ ID NO: 1377167 - DNA, 22 bp, Artificial Sequence
  chemically synthesized
tttatttgtgcagaggaatgca

SEQ ID NO: 1377168 - DNA, 22 bp, Artificial Sequence
  chemically synthesized
ttatttgtgcagaggaatgcag

SEQ ID NO: 1377169 - DNA, 22 bp, Artificial Sequence
  chemically synthesized
ttttctttacaactgcattcct

SEQ ID NO: 1377170 - DNA, 22 bp, Artificial Sequence
  chemically synthesized
tatttgtgcagaggaatgcagt

SEQ ID NO: 1377171 - DNA, 22 bp, Artificial Sequence
  chemically synthesized
attttctttacaactgcattcc

SEQ ID NO: 1377172 - DNA, 22 bp, Artificial Sequence
  chemically synthesized
atttgtgcagaggaatgcagtt

SEQ ID NO: 1377173 - DNA, 22 bp, Artificial Sequence
  chemically synthesized
tttgtgcagaggaatgcagttg

SEQ ID NO: 1377174 - DNA, 22 bp, Artificial Sequence
  chemically synthesized
tttattttctttacaactgcat

SEQ ID NO: 1377175 - DNA, 22 bp, Artificial Sequence
  chemically synthesized
atttattttctttacaactgca

SEQ ID NO: 1377176 - DNA, 22 bp, Artificial Sequence
  chemically synthesized
gtgcagaggaatgcagttgtaa

SEQ ID NO: 1377177 - DNA, 22 bp, Artificial Sequence
  chemically synthesized
tgcagaggaatgcagttgtaaa

SEQ ID NO: 1377178 - DNA, 22 bp, Artificial Sequence
  chemically synthesized
aaaatataaatttatttatttt

SEQ ID NO: 1377179 - DNA, 22 bp, Artificial Sequence
  chemically synthesized
caaaatataaatttatttattt

SEQ ID NO: 1377180 - DNA, 22 bp, Artificial Sequence
  chemically synthesized
taaagaaaataaataaatttat

SEQ ID NO: 1377181 - DNA, 22 bp, Artificial Sequence
  chemically synthesized
ccccatttcaaaatataaattt

SEQ ID NO: 1377182 - DNA, 22 bp, Artificial Sequence
  chemically synthesized
gccccatttcaaaatataaatt

SEQ ID NO: 1377183 - DNA, 22 bp, Artificial Sequence
  chemically synthesized
tgccccatttcaaaatataaat

SEQ ID NO: 1377184 - DNA, 22 bp, Artificial Sequence
  chemically synthesized
ttgccccatttcaaaatataaa

SEQ ID NO: 1377185 - DNA, 22 bp, Artificial Sequence
  chemically synthesized
tttgccccatttcaaaatataa

SEQ ID NO: 1377186 - DNA, 22 bp, Artificial Sequence
  chemically synthesized
ttttgccccatttcaaaatata

SEQ ID NO: 1377187 - DNA, 22 bp, Artificial Sequence
  chemically synthesized
acatcttttttgccccatttca

SEQ ID NO: 1377188 - DNA, 22 bp, Artificial Sequence
  chemically synthesized
gacatcttttttgccccatttc

SEQ ID NO: 1377189 - DNA, 22 bp, Artificial Sequence
  chemically synthesized
atattttgaaatggggcaaaaa

SEQ ID NO: 1377190 - DNA, 22 bp, Artificial Sequence
  chemically synthesized
tattttgaaatggggcaaaaaa

SEQ ID NO: 1377191 - DNA, 22 bp, Artificial Sequence
  chemically synthesized
aatatttgacatcttttttgcc

SEQ ID NO: 1377192 - DNA, 22 bp, Artificial Sequence
  chemically synthesized
tgaaatggggcaaaaaagatgt

SEQ ID NO: 1377193 - DNA, 22 bp, Artificial Sequence
  chemically synthesized
gaaatggggcaaaaaagatgtc

SEQ ID NO: 1377194 - DNA, 22 bp, Artificial Sequence
  chemically synthesized
aaatggggcaaaaaagatgtca

SEQ ID NO: 1377195 - DNA, 22 bp, Artificial Sequence
  chemically synthesized
tatctcaatatttgacatcttt

SEQ ID NO: 1377196 - DNA, 22 bp, Artificial Sequence
  chemically synthesized
atatctcaatatttgacatctt

SEQ ID NO: 1377197 - DNA, 22 bp, Artificial Sequence
  chemically synthesized
tatatctcaatatttgacatct

SEQ ID NO: 1377198 - DNA, 22 bp, Artificial Sequence
  chemically synthesized
ttatatctcaatatttgacatc

SEQ ID NO: 1377199 - DNA, 22 bp, Artificial Sequence
  chemically synthesized
tttatatctcaatatttgacat

SEQ ID NO: 1377200 - DNA, 22 bp, Artificial Sequence
  chemically synthesized
ctttttatatctcaatatttga

SEQ ID NO: 1377201 - DNA, 22 bp, Artificial Sequence
  chemically synthesized
gtactactttttatatctcaat

SEQ ID NO: 1377202 - DNA, 22 bp, Artificial Sequence
  chemically synthesized
tctggtactactttttatatct

SEQ ID NO: 1377203 - DNA, 22 bp, Artificial Sequence
  chemically synthesized
atctggtactactttttatatc

SEQ ID NO: 1377204 - DNA, 22 bp, Artificial Sequence
  chemically synthesized
tatctggtactactttttatat

SEQ ID NO: 1377205 - DNA, 22 bp, Artificial Sequence
  chemically synthesized
ttatctggtactactttttata

SEQ ID NO: 1377206 - DNA, 22 bp, Artificial Sequence
  chemically synthesized
tgcatcttttatctggtactac

SEQ ID NO: 1377207 - DNA, 22 bp, Artificial Sequence
  chemically synthesized
agatataaaaagtagtaccaga

SEQ ID NO: 1377208 - DNA, 22 bp, Artificial Sequence
  chemically synthesized
tctatgcatcttttatctggta

SEQ ID NO: 1377209 - DNA, 22 bp, Artificial Sequence
  chemically synthesized
gggttatctatgcatcttttat

SEQ ID NO: 1377210 - DNA, 22 bp, Artificial Sequence
  chemically synthesized
agggttatctatgcatctttta

SEQ ID NO: 1377211 - DNA, 22 bp, Artificial Sequence
  chemically synthesized
ttagggttatctatgcatcttt

SEQ ID NO: 1377212 - DNA, 22 bp, Artificial Sequence
  chemically synthesized
attcttagggttatctatgcat

SEQ ID NO: 1377213 - DNA, 22 bp, Artificial Sequence
  chemically synthesized
tcattcttagggttatctatgc

SEQ ID NO: 1377214 - DNA, 22 bp, Artificial Sequence
  chemically synthesized
catataaaatgtgattctcatt

SEQ ID NO: 1377215 - DNA, 22 bp, Artificial Sequence
  chemically synthesized
gccctacatataaaatgtgatt

SEQ ID NO: 1377216 - DNA, 22 bp, Artificial Sequence
  chemically synthesized
agccctacatataaaatgtgat

SEQ ID NO: 1377217 - DNA, 22 bp, Artificial Sequence
  chemically synthesized
agaatgagaatcacattttata

SEQ ID NO: 1377218 - DNA, 22 bp, Artificial Sequence
  chemically synthesized
tatatgtagggctaagccattt

SEQ ID NO: 1377219 - DNA, 22 bp, Artificial Sequence
  chemically synthesized
atatgtagggctaagccatttc

SEQ ID NO: 1377220 - DNA, 22 bp, Artificial Sequence
  chemically synthesized
tatgtagggctaagccatttcc

SEQ ID NO: 1377221 - DNA, 22 bp, Artificial Sequence
  chemically synthesized
gtcagccagaaaatatatatag

SEQ ID NO: 1377222 - DNA, 22 bp, Artificial Sequence
  chemically synthesized
agccatttcctatatatatttt

SEQ ID NO: 1377223 - DNA, 22 bp, Artificial Sequence
  chemically synthesized
attagtcagccagaaaatatat

SEQ ID NO: 1377224 - DNA, 22 bp, Artificial Sequence
  chemically synthesized
ctaattagtcagccagaaaata

SEQ ID NO: 1377225 - DNA, 22 bp, Artificial Sequence
  chemically synthesized
cctatatatattttctggctga

SEQ ID NO: 1377226 - DNA, 22 bp, Artificial Sequence
  chemically synthesized
ctatatatattttctggctgac

SEQ ID NO: 1377227 - DNA, 22 bp, Artificial Sequence
  chemically synthesized
ccattgctaattagtcagccag

SEQ ID NO: 1377228 - DNA, 22 bp, Artificial Sequence
  chemically synthesized
accattgctaattagtcagcca

SEQ ID NO: 1377229 - DNA, 22 bp, Artificial Sequence
  chemically synthesized
tatatattttctggctgactaa

SEQ ID NO: 1377230 - DNA, 22 bp, Artificial Sequence
  chemically synthesized
taccattgctaattagtcagcc

SEQ ID NO: 1377231 - DNA, 22 bp, Artificial Sequence
  chemically synthesized
atctttaccattgctaattagt

SEQ ID NO: 1377232 - DNA, 22 bp, Artificial Sequence
  chemically synthesized
gatctttaccattgctaattag

SEQ ID NO: 1377233 - DNA, 22 bp, Artificial Sequence
  chemically synthesized
tctggctgactaattagcaatg

SEQ ID NO: 1377234 - DNA, 22 bp, Artificial Sequence
  chemically synthesized
ctggctgactaattagcaatgg

SEQ ID NO: 1377235 - DNA, 22 bp, Artificial Sequence
  chemically synthesized
tggctgactaattagcaatggt

SEQ ID NO: 1377236 - DNA, 22 bp, Artificial Sequence
  chemically synthesized
gctgactaattagcaatggtaa

SEQ ID NO: 1377237 - DNA, 22 bp, Artificial Sequence
  chemically synthesized
actaattagcaatggtaaagat

SEQ ID NO: 1377238 - DNA, 22 bp, Artificial Sequence
  chemically synthesized
atgtaaaacttgatctttacca

SEQ ID NO: 1377239 - DNA, 22 bp, Artificial Sequence
  chemically synthesized
attagcaatggtaaagatcaag

SEQ ID NO: 1377240 - DNA, 22 bp, Artificial Sequence
  chemically synthesized
gcaatggtaaagatcaagtttt

SEQ ID NO: 1377241 - DNA, 22 bp, Artificial Sequence
  chemically synthesized
aaagcattgatgtaaaacttga

SEQ ID NO: 1377242 - DNA, 22 bp, Artificial Sequence
  chemically synthesized
gaaagcattgatgtaaaacttg

SEQ ID NO: 1377243 - DNA, 22 bp, Artificial Sequence
  chemically synthesized
tacatcaatgctttcaaatcat

SEQ ID NO: 1377244 - DNA, 22 bp, Artificial Sequence
  chemically synthesized
acatcaatgctttcaaatcatg

SEQ ID NO: 1377245 - DNA, 22 bp, Artificial Sequence
  chemically synthesized
catcaatgctttcaaatcatgg

SEQ ID NO: 1377246 - DNA, 22 bp, Artificial Sequence
  chemically synthesized
agcaagtagaaaaaataaacac

SEQ ID NO: 1377247 - DNA, 22 bp, Artificial Sequence
  chemically synthesized
tcaaatcatggtgtttattttt

SEQ ID NO: 1377248 - DNA, 22 bp, Artificial Sequence
  chemically synthesized
caaatcatggtgtttatttttt

SEQ ID NO: 1377249 - DNA, 22 bp, Artificial Sequence
  chemically synthesized
aaatcatggtgtttattttttc

SEQ ID NO: 1377250 - DNA, 22 bp, Artificial Sequence
  chemically synthesized
caaagtacgggctcagcaagta

SEQ ID NO: 1377251 - DNA, 22 bp, Artificial Sequence
  chemically synthesized
attttttctacttgctgagccc

SEQ ID NO: 1377252 - DNA, 22 bp, Artificial Sequence
  chemically synthesized
ttttttctacttgctgagcccg

SEQ ID NO: 1377253 - DNA, 22 bp, Artificial Sequence
  chemically synthesized
tttctacttgctgagcccgtac

SEQ ID NO: 1377254 - DNA, 22 bp, Artificial Sequence
  chemically synthesized
ttctacttgctgagcccgtact

SEQ ID NO: 1377255 - DNA, 22 bp, Artificial Sequence
  chemically synthesized
tctacttgctgagcccgtactt

SEQ ID NO: 1377256 - DNA, 22 bp, Artificial Sequence
  chemically synthesized
ctacttgctgagcccgtacttt

SEQ ID NO: 1377257 - DNA, 22 bp, Artificial Sequence
  chemically synthesized
tacttgctgagcccgtactttg

SEQ ID NO: 1377258 - DNA, 22 bp, Artificial Sequence
  chemically synthesized
cttgctgagcccgtactttgga

SEQ ID NO: 1377259 - DNA, 22 bp, Artificial Sequence
  chemically synthesized
gctgagcccgtactttggaatt

SEQ ID NO: 1377260 - DNA, 22 bp, Artificial Sequence
  chemically synthesized
ctgagcccgtactttggaatta

SEQ ID NO: 1377261 - DNA, 22 bp, Artificial Sequence
  chemically synthesized
agcccgtactttggaattatat

SEQ ID NO: 1377262 - DNA, 22 bp, Artificial Sequence
  chemically synthesized
tggaattatatattactatatt

SEQ ID NO: 1377263 - DNA, 22 bp, Artificial Sequence
  chemically synthesized
ggaattatatattactatattt

SEQ ID NO: 1377264 - DNA, 22 bp, Artificial Sequence
  chemically synthesized
gaattatatattactatatttt

SEQ ID NO: 1377265 - DNA, 22 bp, Artificial Sequence
  chemically synthesized
aagagggcacacaataaaatat

SEQ ID NO: 1377266 - DNA, 22 bp, Artificial Sequence
  chemically synthesized
tatattactatattttattgtg

SEQ ID NO: 1377267 - DNA, 22 bp, Artificial Sequence
  chemically synthesized
ctatattttattgtgtgccctc

SEQ ID NO: 1377268 - DNA, 22 bp, Artificial Sequence
  chemically synthesized
tattttattgtgtgccctcttg

SEQ ID NO: 1377269 - DNA, 22 bp, Artificial Sequence
  chemically synthesized
catgaataaatacattcaagag

SEQ ID NO: 1377270 - DNA, 22 bp, Artificial Sequence
  chemically synthesized
tattgtgtgccctcttgaatgt

SEQ ID NO: 1377271 - DNA, 22 bp, Artificial Sequence
  chemically synthesized
attgtgtgccctcttgaatgta

SEQ ID NO: 1377272 - DNA, 22 bp, Artificial Sequence
  chemically synthesized
ttgtgtgccctcttgaatgtat

SEQ ID NO: 1377273 - DNA, 22 bp, Artificial Sequence
  chemically synthesized
ctacatgaataaatacattcaa

SEQ ID NO: 1377274 - DNA, 22 bp, Artificial Sequence
  chemically synthesized
gctacatgaataaatacattca

SEQ ID NO: 1377275 - DNA, 22 bp, Artificial Sequence
  chemically synthesized
tgctacatgaataaatacattc

SEQ ID NO: 1377276 - DNA, 22 bp, Artificial Sequence
  chemically synthesized
tgtgccctcttgaatgtattta

SEQ ID NO: 1377277 - DNA, 22 bp, Artificial Sequence
  chemically synthesized
ttgctacatgaataaatacatt

SEQ ID NO: 1377278 - DNA, 22 bp, Artificial Sequence
  chemically synthesized
tttttgctacatgaataaatac

SEQ ID NO: 1377279 - DNA, 22 bp, Artificial Sequence
  chemically synthesized
atttttgctacatgaataaata

SEQ ID NO: 1377280 - DNA, 22 bp, Artificial Sequence
  chemically synthesized
tatttttgctacatgaataaat

SEQ ID NO: 1377281 - DNA, 22 bp, Artificial Sequence
  chemically synthesized
ttatttttgctacatgaataaa

SEQ ID NO: 1377282 - DNA, 22 bp, Artificial Sequence
  chemically synthesized
ttgaatgtatttattcatgtag

SEQ ID NO: 1377283 - DNA, 22 bp, Artificial Sequence
  chemically synthesized
atttttatttttgctacatgaa

SEQ ID NO: 1377284 - DNA, 22 bp, Artificial Sequence
  chemically synthesized
gaatgtatttattcatgtagca

SEQ ID NO: 1377285 - DNA, 22 bp, Artificial Sequence
  chemically synthesized
aatgtatttattcatgtagcaa

SEQ ID NO: 1377286 - DNA, 22 bp, Artificial Sequence
  chemically synthesized
attaatttttatttttgctaca

SEQ ID NO: 1377287 - DNA, 22 bp, Artificial Sequence
  chemically synthesized
attaattaatttttatttttgc

SEQ ID NO: 1377288 - DNA, 22 bp, Artificial Sequence
  chemically synthesized
attcatgtagcaaaaataaaaa

SEQ ID NO: 1377289 - DNA, 22 bp, Artificial Sequence
  chemically synthesized
ttaattaattaatttttatttt

SEQ ID NO: 1377290 - DNA, 22 bp, Artificial Sequence
  chemically synthesized
ttcatgtagcaaaaataaaaat

SEQ ID NO: 1377291 - DNA, 22 bp, Artificial Sequence
  chemically synthesized
attaattaattaatttttattt

SEQ ID NO: 1377292 - DNA, 22 bp, Artificial Sequence
  chemically synthesized
atgtagcaaaaataaaaattaa

SEQ ID NO: 1377293 - DNA, 22 bp, Artificial Sequence
  chemically synthesized
tcttattaattaattaattttt

SEQ ID NO: 1377294 - DNA, 22 bp, Artificial Sequence
  chemically synthesized
atcttattaattaattaatttt

SEQ ID NO: 1377295 - DNA, 22 bp, Artificial Sequence
  chemically synthesized
tatcttattaattaattaattt

SEQ ID NO: 1377296 - DNA, 22 bp, Artificial Sequence
  chemically synthesized
cctttatcttattaattaatta

SEQ ID NO: 1377297 - DNA, 22 bp, Artificial Sequence
  chemically synthesized
cataattacctttatcttatta

SEQ ID NO: 1377298 - DNA, 22 bp, Artificial Sequence
  chemically synthesized
acataattacctttatcttatt

SEQ ID NO: 1377299 - DNA, 22 bp, Artificial Sequence
  chemically synthesized
attaattaataagataaaggta

SEQ ID NO: 1377300 - DNA, 22 bp, Artificial Sequence
  chemically synthesized
atcttacataattacctttatc

SEQ ID NO: 1377301 - DNA, 22 bp, Artificial Sequence
  chemically synthesized
aatcttacataattacctttat

SEQ ID NO: 1377302 - DNA, 22 bp, Artificial Sequence
  chemically synthesized
ttaatcttacataattaccttt

SEQ ID NO: 1377303 - DNA, 22 bp, Artificial Sequence
  chemically synthesized
attaataagataaaggtaatta

SEQ ID NO: 1377304 - DNA, 22 bp, Artificial Sequence
  chemically synthesized
cttaatcttacataattacctt

SEQ ID NO: 1377305 - DNA, 22 bp, Artificial Sequence
  chemically synthesized
tcttaatcttacataattacct

SEQ ID NO: 1377306 - DNA, 22 bp, Artificial Sequence
  chemically synthesized
ataagataaaggtaattatgta

SEQ ID NO: 1377307 - DNA, 22 bp, Artificial Sequence
  chemically synthesized
tgactttcttaatcttacataa

SEQ ID NO: 1377308 - DNA, 22 bp, Artificial Sequence
  chemically synthesized
tgtgactttcttaatcttacat

SEQ ID NO: 1377309 - DNA, 22 bp, Artificial Sequence
  chemically synthesized
ctgtgactttcttaatcttaca

SEQ ID NO: 1377310 - DNA, 22 bp, Artificial Sequence
  chemically synthesized
tgtttctgtgactttcttaatc

SEQ ID NO: 1377311 - DNA, 22 bp, Artificial Sequence
  chemically synthesized
tatgtttctgtgactttcttaa

SEQ ID NO: 1377312 - DNA, 22 bp, Artificial Sequence
  chemically synthesized
ctatgtttctgtgactttctta

SEQ ID NO: 1377313 - DNA, 22 bp, Artificial Sequence
  chemically synthesized
tgtaagattaagaaagtcacag

SEQ ID NO: 1377314 - DNA, 22 bp, Artificial Sequence
  chemically synthesized
ggtcagtttctatgtttctgtg

SEQ ID NO: 1377315 - DNA, 22 bp, Artificial Sequence
  chemically synthesized
aggtcagtttctatgtttctgt

SEQ ID NO: 1377316 - DNA, 22 bp, Artificial Sequence
  chemically synthesized
agaaagtcacagaaacatagaa

SEQ ID NO: 1377317 - DNA, 22 bp, Artificial Sequence
  chemically synthesized
acttaggtcagtttctatgttt

SEQ ID NO: 1377318 - DNA, 22 bp, Artificial Sequence
  chemically synthesized
tagtacgcactaacttaggtca

SEQ ID NO: 1377319 - DNA, 22 bp, Artificial Sequence
  chemically synthesized
ttatagtacgcactaacttagg

SEQ ID NO: 1377320 - DNA, 22 bp, Artificial Sequence
  chemically synthesized
attatagtacgcactaacttag

SEQ ID NO: 1377321 - DNA, 22 bp, Artificial Sequence
  chemically synthesized
tattatagtacgcactaactta

SEQ ID NO: 1377322 - DNA, 22 bp, Artificial Sequence
  chemically synthesized
acctaagttagtgcgtactata

SEQ ID NO: 1377323 - DNA, 22 bp, Artificial Sequence
  chemically synthesized
agttagtgcgtactataataaa

SEQ ID NO: 1377324 - DNA, 22 bp, Artificial Sequence
  chemically synthesized
gtgcgtactataataaaaccta

SEQ ID NO: 1377325 - DNA, 22 bp, Artificial Sequence
  chemically synthesized
gacatagacaaagaaataagta

SEQ ID NO: 1377326 - DNA, 22 bp, Artificial Sequence
  chemically synthesized
agacatagacaaagaaataagt

SEQ ID NO: 1377327 - DNA, 22 bp, Artificial Sequence
  chemically synthesized
taataaaacctacttatttctt

SEQ ID NO: 1377328 - DNA, 22 bp, Artificial Sequence
  chemically synthesized
tagacatagacaaagaaataag

SEQ ID NO: 1377329 - DNA, 22 bp, Artificial Sequence
  chemically synthesized
ttagacatagacaaagaaataa

SEQ ID NO: 1377330 - DNA, 22 bp, Artificial Sequence
  chemically synthesized
cttatttctttgtctatgtcta

SEQ ID NO: 1377331 - DNA, 22 bp, Artificial Sequence
  chemically synthesized
atttctttgtctatgtctaaaa

SEQ ID NO: 1377332 - DNA, 22 bp, Artificial Sequence
  chemically synthesized
tttctttgtctatgtctaaaaa

SEQ ID NO: 1377333 - DNA, 22 bp, Artificial Sequence
  chemically synthesized
ctttgtctatgtctaaaaatgc

SEQ ID NO: 1377334 - DNA, 22 bp, Artificial Sequence
  chemically synthesized
tttgtctatgtctaaaaatgca

SEQ ID NO: 1377335 - DNA, 22 bp, Artificial Sequence
  chemically synthesized
tgtctatgtctaaaaatgcatt

SEQ ID NO: 1377336 - DNA, 22 bp, Artificial Sequence
  chemically synthesized
gtctatgtctaaaaatgcattt

SEQ ID NO: 1377337 - DNA, 22 bp, Artificial Sequence
  chemically synthesized
tctatgtctaaaaatgcatttc

SEQ ID NO: 1377338 - DNA, 22 bp, Artificial Sequence
  chemically synthesized
gacatagagaaagaaatgcatt

SEQ ID NO: 1377339 - DNA, 22 bp, Artificial Sequence
  chemically synthesized
agacatagagaaagaaatgcat

SEQ ID NO: 1377340 - DNA, 22 bp, Artificial Sequence
  chemically synthesized
tagacatagagaaagaaatgca

SEQ ID NO: 1377341 - DNA, 22 bp, Artificial Sequence
  chemically synthesized
ttagacatagagaaagaaatgc

SEQ ID NO: 1377342 - DNA, 22 bp, Artificial Sequence
  chemically synthesized
tgtctaaaaatgcatttctttc

SEQ ID NO: 1377343 - DNA, 22 bp, Artificial Sequence
  chemically synthesized
aaaatgcatttctttctctatg

SEQ ID NO: 1377344 - DNA, 22 bp, Artificial Sequence
  chemically synthesized
tgcatttttagacatagagaaa

SEQ ID NO: 1377345 - DNA, 22 bp, Artificial Sequence
  chemically synthesized
aattgtgcatttttagacatag

SEQ ID NO: 1377346 - DNA, 22 bp, Artificial Sequence
  chemically synthesized
gaattgtgcatttttagacata

SEQ ID NO: 1377347 - DNA, 22 bp, Artificial Sequence
  chemically synthesized
ctttctctatgtctaaaaatgc

SEQ ID NO: 1377348 - DNA, 22 bp, Artificial Sequence
  chemically synthesized
tttctctatgtctaaaaatgca

SEQ ID NO: 1377349 - DNA, 22 bp, Artificial Sequence
  chemically synthesized
gaatttgaattgtgcattttta

SEQ ID NO: 1377350 - DNA, 22 bp, Artificial Sequence
  chemically synthesized
tctctatgtctaaaaatgcaca

SEQ ID NO: 1377351 - DNA, 22 bp, Artificial Sequence
  chemically synthesized
ctctatgtctaaaaatgcacaa

SEQ ID NO: 1377352 - DNA, 22 bp, Artificial Sequence
  chemically synthesized
tctatgtctaaaaatgcacaat

SEQ ID NO: 1377353 - DNA, 22 bp, Artificial Sequence
  chemically synthesized
tctggaatttgaattgtgcatt

SEQ ID NO: 1377354 - DNA, 22 bp, Artificial Sequence
  chemically synthesized
atctggaatttgaattgtgcat

SEQ ID NO: 1377355 - DNA, 22 bp, Artificial Sequence
  chemically synthesized
tatgtctaaaaatgcacaattc

SEQ ID NO: 1377356 - DNA, 22 bp, Artificial Sequence
  chemically synthesized
tgtctaaaaatgcacaattcaa

SEQ ID NO: 1377357 - DNA, 22 bp, Artificial Sequence
  chemically synthesized
gagtttatctggaatttgaatt

SEQ ID NO: 1377358 - DNA, 22 bp, Artificial Sequence
  chemically synthesized
aaaatgcacaattcaaattcca

SEQ ID NO: 1377359 - DNA, 22 bp, Artificial Sequence
  chemically synthesized
gatgggcaggtctagagtttat

SEQ ID NO: 1377360 - DNA, 22 bp, Artificial Sequence
  chemically synthesized
aaattccagataaactctagac

SEQ ID NO: 1377361 - DNA, 22 bp, Artificial Sequence
  chemically synthesized
cagataaactctagacctgccc

SEQ ID NO: 1377362 - DNA, 22 bp, Artificial Sequence
  chemically synthesized
acaaagaggaggaaactggatg

SEQ ID NO: 1377363 - DNA, 22 bp, Artificial Sequence
  chemically synthesized
tagacctgcccatccagtttcc

SEQ ID NO: 1377364 - DNA, 22 bp, Artificial Sequence
  chemically synthesized
ttgacaaagaggaggaaactgg

SEQ ID NO: 1377365 - DNA, 22 bp, Artificial Sequence
  chemically synthesized
gacctgcccatccagtttcctc

SEQ ID NO: 1377366 - DNA, 22 bp, Artificial Sequence
  chemically synthesized
tgttgacaaagaggaggaaact

SEQ ID NO: 1377367 - DNA, 22 bp, Artificial Sequence
  chemically synthesized
cccatccagtttcctcctcttt

SEQ ID NO: 1377368 - DNA, 22 bp, Artificial Sequence
  chemically synthesized
gagttctgttgacaaagaggag

SEQ ID NO: 1377369 - DNA, 22 bp, Artificial Sequence
  chemically synthesized
cctcctctttgtcaacagaact

SEQ ID NO: 1377370 - DNA, 22 bp, Artificial Sequence
  chemically synthesized
ctcctctttgtcaacagaactc

SEQ ID NO: 1377371 - DNA, 22 bp, Artificial Sequence
  chemically synthesized
ctctttgtcaacagaactccaa

SEQ ID NO: 1377372 - DNA, 22 bp, Artificial Sequence
  chemically synthesized
atacccgaatggaattggagtt

SEQ ID NO: 1377373 - DNA, 22 bp, Artificial Sequence
  chemically synthesized
tttgtcaacagaactccaattc

SEQ ID NO: 1377374 - DNA, 22 bp, Artificial Sequence
  chemically synthesized
gatacccgaatggaattggagt

SEQ ID NO: 1377375 - DNA, 22 bp, Artificial Sequence
  chemically synthesized
tgtcaacagaactccaattcca

SEQ ID NO: 1377376 - DNA, 22 bp, Artificial Sequence
  chemically synthesized
gtcaacagaactccaattccat

SEQ ID NO: 1377377 - DNA, 22 bp, Artificial Sequence
  chemically synthesized
tcaacagaactccaattccatt

SEQ ID NO: 1377378 - DNA, 22 bp, Artificial Sequence
  chemically synthesized
ccttgatacccgaatggaattg

SEQ ID NO: 1377379 - DNA, 22 bp, Artificial Sequence
  chemically synthesized
tgcacagtctcccttgataccc

SEQ ID NO: 1377380 - DNA, 22 bp, Artificial Sequence
  chemically synthesized
caattccattcgggtatcaagg

SEQ ID NO: 1377381 - DNA, 22 bp, Artificial Sequence
  chemically synthesized
gtgcacagtctcccttgatacc

SEQ ID NO: 1377382 - DNA, 22 bp, Artificial Sequence
  chemically synthesized
cttgtgcacagtctcccttgat

SEQ ID NO: 1377383 - DNA, 22 bp, Artificial Sequence
  chemically synthesized
cattcgggtatcaagggagact

SEQ ID NO: 1377384 - DNA, 22 bp, Artificial Sequence
  chemically synthesized
gggtatcaagggagactgtgca

SEQ ID NO: 1377385 - DNA, 22 bp, Artificial Sequence
  chemically synthesized
ggatgagtacattgcttgtgca

SEQ ID NO: 1377386 - DNA, 22 bp, Artificial Sequence
  chemically synthesized
gggatgagtacattgcttgtgc

SEQ ID NO: 1377387 - DNA, 22 bp, Artificial Sequence
  chemically synthesized
tgggatgagtacattgcttgtg

SEQ ID NO: 1377388 - DNA, 22 bp, Artificial Sequence
  chemically synthesized
tttgggatgagtacattgcttg

SEQ ID NO: 1377389 - DNA, 22 bp, Artificial Sequence
  chemically synthesized
ttctttgggatgagtacattgc

SEQ ID NO: 1377390 - DNA, 22 bp, Artificial Sequence
  chemically synthesized
gttctttgggatgagtacattg

SEQ ID NO: 1377391 - DNA, 22 bp, Artificial Sequence
  chemically synthesized
tgcacaagcaatgtactcatcc

SEQ ID NO: 1377392 - DNA, 22 bp, Artificial Sequence
  chemically synthesized
gccaatcatgatttgttctttg

SEQ ID NO: 1377393 - DNA, 22 bp, Artificial Sequence
  chemically synthesized
gcctggccaatcatgatttgtt

SEQ ID NO: 1377394 - DNA, 22 bp, Artificial Sequence
  chemically synthesized
atcccaaagaacaaatcatgat

SEQ ID NO: 1377395 - DNA, 22 bp, Artificial Sequence
  chemically synthesized
gccaggctaatcatgttgatcc

SEQ ID NO: 1377396 - DNA, 22 bp, Artificial Sequence
  chemically synthesized
gcagaaaaagaacaggatcaac

SEQ ID NO: 1377397 - DNA, 22 bp, Artificial Sequence
  chemically synthesized
atcatgttgatcctgttctttt

SEQ ID NO: 1377398 - DNA, 22 bp, Artificial Sequence
  chemically synthesized
caggcagtccctggcagaaaaa

SEQ ID NO: 1377399 - DNA, 22 bp, Artificial Sequence
  chemically synthesized
atcctgttctttttctgccagg

SEQ ID NO: 1377400 - DNA, 22 bp, Artificial Sequence
  chemically synthesized
cattccaggcagtccctggcag

SEQ ID NO: 1377401 - DNA, 22 bp, Artificial Sequence
  chemically synthesized
ttctttttctgccagggactgc

SEQ ID NO: 1377402 - DNA, 22 bp, Artificial Sequence
  chemically synthesized
actccattccaggcagtccctg

SEQ ID NO: 1377403 - DNA, 22 bp, Artificial Sequence
  chemically synthesized
cactccattccaggcagtccct

SEQ ID NO: 1377404 - DNA, 22 bp, Artificial Sequence
  chemically synthesized
tttttctgccagggactgcctg

SEQ ID NO: 1377405 - DNA, 22 bp, Artificial Sequence
  chemically synthesized
tttctgccagggactgcctgga

SEQ ID NO: 1377406 - DNA, 22 bp, Artificial Sequence
  chemically synthesized
ttctgccagggactgcctggaa

SEQ ID NO: 1377407 - DNA, 22 bp, Artificial Sequence
  chemically synthesized
aatttcactccattccaggcag

SEQ ID NO: 1377408 - DNA, 22 bp, Artificial Sequence
  chemically synthesized
tctgccagggactgcctggaat

SEQ ID NO: 1377409 - DNA, 22 bp, Artificial Sequence
  chemically synthesized
ctgccagggactgcctggaatg

SEQ ID NO: 1377410 - DNA, 22 bp, Artificial Sequence
  chemically synthesized
tgccagggactgcctggaatgg

SEQ ID NO: 1377411 - DNA, 22 bp, Artificial Sequence
  chemically synthesized
ccagggactgcctggaatggag

SEQ ID NO: 1377412 - DNA, 22 bp, Artificial Sequence
  chemically synthesized
ggcatctcaatttcactccatt

SEQ ID NO: 1377413 - DNA, 22 bp, Artificial Sequence
  chemically synthesized
aggcatctcaatttcactccat

SEQ ID NO: 1377414 - DNA, 22 bp, Artificial Sequence
  chemically synthesized
gtttaggcatctcaatttcact

SEQ ID NO: 1377415 - DNA, 22 bp, Artificial Sequence
  chemically synthesized
cctggaatggagtgaaattgag

SEQ ID NO: 1377416 - DNA, 22 bp, Artificial Sequence
  chemically synthesized
gaatggagtgaaattgagatgc

SEQ ID NO: 1377417 - DNA, 22 bp, Artificial Sequence
  chemically synthesized
tcattggtttaggcatctcaat

SEQ ID NO: 1377418 - DNA, 22 bp, Artificial Sequence
  chemically synthesized
tgtcattggtttaggcatctca

SEQ ID NO: 1377419 - DNA, 22 bp, Artificial Sequence
  chemically synthesized
ctgtcattggtttaggcatctc

SEQ ID NO: 1377420 - DNA, 22 bp, Artificial Sequence
  chemically synthesized
tctgtcattggtttaggcatct

SEQ ID NO: 1377421 - DNA, 22 bp, Artificial Sequence
  chemically synthesized
ttctgtcattggtttaggcatc

SEQ ID NO: 1377422 - DNA, 22 bp, Artificial Sequence
  chemically synthesized
agatgcctaaaccaatgacaga

SEQ ID NO: 1377423 - DNA, 22 bp, Artificial Sequence
  chemically synthesized
aaccaatgacagaaaagctacc

SEQ ID NO: 1377424 - DNA, 22 bp, Artificial Sequence
  chemically synthesized
atgtagcaaggagtgcagaggt

SEQ ID NO: 1377425 - DNA, 22 bp, Artificial Sequence
  chemically synthesized
catgtagcaaggagtgcagagg

SEQ ID NO: 1377426 - DNA, 22 bp, Artificial Sequence
  chemically synthesized
tttcatgtagcaaggagtgcag

SEQ ID NO: 1377427 - DNA, 22 bp, Artificial Sequence
  chemically synthesized
cctctgcactccttgctacatg

SEQ ID NO: 1377428 - DNA, 22 bp, Artificial Sequence
  chemically synthesized
tgcactccttgctacatgaaat

SEQ ID NO: 1377429 - DNA, 22 bp, Artificial Sequence
  chemically synthesized
cactccttgctacatgaaataa

SEQ ID NO: 1377430 - DNA, 22 bp, Artificial Sequence
  chemically synthesized
gggaaaaaaggtgaattatttc

SEQ ID NO: 1377431 - DNA, 22 bp, Artificial Sequence
  chemically synthesized
cttgctacatgaaataattcac

SEQ ID NO: 1377432 - DNA, 22 bp, Artificial Sequence
  chemically synthesized
gctacatgaaataattcacctt

SEQ ID NO: 1377433 - DNA, 22 bp, Artificial Sequence
  chemically synthesized
ctacatgaaataattcaccttt

SEQ ID NO: 1377434 - DNA, 22 bp, Artificial Sequence
  chemically synthesized
catgaaataattcacctttttt

SEQ ID NO: 1377435 - DNA, 22 bp, Artificial Sequence
  chemically synthesized
aataccagataaatgtagctcg

SEQ ID NO: 1377436 - DNA, 22 bp, Artificial Sequence
  chemically synthesized
accttttttcccgagctacatt

SEQ ID NO: 1377437 - DNA, 22 bp, Artificial Sequence
  chemically synthesized
ttttcccgagctacatttatct

SEQ ID NO: 1377438 - DNA, 22 bp, Artificial Sequence
  chemically synthesized
tttcccgagctacatttatctg

SEQ ID NO: 1377439 - DNA, 22 bp, Artificial Sequence
  chemically synthesized
ttcccgagctacatttatctgg

SEQ ID NO: 1377440 - DNA, 22 bp, Artificial Sequence
  chemically synthesized
tatacctgaataccagataaat

SEQ ID NO: 1377441 - DNA, 22 bp, Artificial Sequence
  chemically synthesized
tcccgagctacatttatctggt

SEQ ID NO: 1377442 - DNA, 22 bp, Artificial Sequence
  chemically synthesized
cccgagctacatttatctggta

SEQ ID NO: 1377443 - DNA, 22 bp, Artificial Sequence
  chemically synthesized
ccgagctacatttatctggtat

SEQ ID NO: 1377444 - DNA, 22 bp, Artificial Sequence
  chemically synthesized
catttatctggtattcaggtat

SEQ ID NO: 1377445 - DNA, 22 bp, Artificial Sequence
  chemically synthesized
catgtaacactatatacctgaa

SEQ ID NO: 1377446 - DNA, 22 bp, Artificial Sequence
  chemically synthesized
ttgcatgtaacactatatacct

SEQ ID NO: 1377447 - DNA, 22 bp, Artificial Sequence
  chemically synthesized
atctggtattcaggtatatagt

SEQ ID NO: 1377448 - DNA, 22 bp, Artificial Sequence
  chemically synthesized
tctggtattcaggtatatagtg

SEQ ID NO: 1377449 - DNA, 22 bp, Artificial Sequence
  chemically synthesized
gtattcaggtatatagtgttac

SEQ ID NO: 1377450 - DNA, 22 bp, Artificial Sequence
  chemically synthesized
aggtatatagtgttacatgcaa

SEQ ID NO: 1377451 - DNA, 22 bp, Artificial Sequence
  chemically synthesized
atggtcatatatctattgcatg

SEQ ID NO: 1377452 - DNA, 22 bp, Artificial Sequence
  chemically synthesized
catgcaatagatatatgaccat

SEQ ID NO: 1377453 - DNA, 22 bp, Artificial Sequence
  chemically synthesized
catataacactgatggtcatat

SEQ ID NO: 1377454 - DNA, 22 bp, Artificial Sequence
  chemically synthesized
ctgcatataacactgatggtca

SEQ ID NO: 1377455 - DNA, 22 bp, Artificial Sequence
  chemically synthesized
gtcatatatctactgcatataa

SEQ ID NO: 1377456 - DNA, 22 bp, Artificial Sequence
  chemically synthesized
gattggtcatatatctactgca

SEQ ID NO: 1377457 - DNA, 22 bp, Artificial Sequence
  chemically synthesized
aaaaactagattggtcatatat

SEQ ID NO: 1377458 - DNA, 22 bp, Artificial Sequence
  chemically synthesized
tatgcagtagatatatgaccaa

SEQ ID NO: 1377459 - DNA, 22 bp, Artificial Sequence
  chemically synthesized
tattaaaaaactagattggtca

SEQ ID NO: 1377460 - DNA, 22 bp, Artificial Sequence
  chemically synthesized
gttttttaatataatggtatat

SEQ ID NO: 1377461 - DNA, 22 bp, Artificial Sequence
  chemically synthesized
tttaatataatggtatattgga

SEQ ID NO: 1377462 - DNA, 22 bp, Artificial Sequence
  chemically synthesized
ttaatataatggtatattggat

SEQ ID NO: 1377463 - DNA, 22 bp, Artificial Sequence
  chemically synthesized
taatataatggtatattggata

SEQ ID NO: 1377464 - DNA, 22 bp, Artificial Sequence
  chemically synthesized
aatataatggtatattggatat

SEQ ID NO: 1377465 - DNA, 22 bp, Artificial Sequence
  chemically synthesized
atagtataaaaaatatccaata

SEQ ID NO: 1377466 - DNA, 22 bp, Artificial Sequence
  chemically synthesized
atataatggtatattggatatt

SEQ ID NO: 1377467 - DNA, 22 bp, Artificial Sequence
  chemically synthesized
gatagtataaaaaatatccaat

SEQ ID NO: 1377468 - DNA, 22 bp, Artificial Sequence
  chemically synthesized
gatattttttatactatcaagg

SEQ ID NO: 1377469 - DNA, 22 bp, Artificial Sequence
  chemically synthesized
gggagaagaatcccttgatagt

SEQ ID NO: 1377470 - DNA, 22 bp, Artificial Sequence
  chemically synthesized
tggggagaagaatcccttgata

SEQ ID NO: 1377471 - DNA, 22 bp, Artificial Sequence
  chemically synthesized
tttatactatcaagggattctt

SEQ ID NO: 1377472 - DNA, 22 bp, Artificial Sequence
  chemically synthesized
ttatactatcaagggattcttc

SEQ ID NO: 1377473 - DNA, 22 bp, Artificial Sequence
  chemically synthesized
tatactatcaagggattcttct

SEQ ID NO: 1377474 - DNA, 22 bp, Artificial Sequence
  chemically synthesized
gtatctctggggagaagaatcc

SEQ ID NO: 1377475 - DNA, 22 bp, Artificial Sequence
  chemically synthesized
atactatcaagggattcttctc

SEQ ID NO: 1377476 - DNA, 22 bp, Artificial Sequence
  chemically synthesized
tactatcaagggattcttctcc

SEQ ID NO: 1377477 - DNA, 22 bp, Artificial Sequence
  chemically synthesized
agttggtatctctggggagaag

SEQ ID NO: 1377478 - DNA, 22 bp, Artificial Sequence
  chemically synthesized
tcaagggattcttctccccaga

SEQ ID NO: 1377479 - DNA, 22 bp, Artificial Sequence
  chemically synthesized
tcagttggtatctctggggaga

SEQ ID NO: 1377480 - DNA, 22 bp, Artificial Sequence
  chemically synthesized
ctcagttggtatctctggggag

SEQ ID NO: 1377481 - DNA, 22 bp, Artificial Sequence
  chemically synthesized
tctcagttggtatctctgggga

SEQ ID NO: 1377482 - DNA, 22 bp, Artificial Sequence
  chemically synthesized
ttctccccagagataccaactg

SEQ ID NO: 1377483 - DNA, 22 bp, Artificial Sequence
  chemically synthesized
ctccccagagataccaactgag

SEQ ID NO: 1377484 - DNA, 22 bp, Artificial Sequence
  chemically synthesized
tccccagagataccaactgaga

SEQ ID NO: 1377485 - DNA, 22 bp, Artificial Sequence
  chemically synthesized
cccagagataccaactgagaaa

SEQ ID NO: 1377486 - DNA, 22 bp, Artificial Sequence
  chemically synthesized
ccaaccacaggttttctcagtt

SEQ ID NO: 1377487 - DNA, 22 bp, Artificial Sequence
  chemically synthesized
cactgccaaccacaggttttct

SEQ ID NO: 1377488 - DNA, 22 bp, Artificial Sequence
  chemically synthesized
agaaaacctgtggttggcagtg

SEQ ID NO: 1377489 - DNA, 22 bp, Artificial Sequence
  chemically synthesized
tggttggcagtgcaggtggctt

SEQ ID NO: 1377490 - DNA, 22 bp, Artificial Sequence
  chemically synthesized
aagatgtggcccacaagccacc

SEQ ID NO: 1377491 - DNA, 22 bp, Artificial Sequence
  chemically synthesized
tcaagatgtggcccacaagcca

SEQ ID NO: 1377492 - DNA, 22 bp, Artificial Sequence
  chemically synthesized
ctcaagatgtggcccacaagcc

SEQ ID NO: 1377493 - DNA, 22 bp, Artificial Sequence
  chemically synthesized
gcagtgcaggtggcttgtgggc

SEQ ID NO: 1377494 - DNA, 22 bp, Artificial Sequence
  chemically synthesized
tctcaagatgtggcccacaagc

SEQ ID NO: 1377495 - DNA, 22 bp, Artificial Sequence
  chemically synthesized
ttttctcaagatgtggcccaca

SEQ ID NO: 1377496 - DNA, 22 bp, Artificial Sequence
  chemically synthesized
agacattattttctcaagatgt

SEQ ID NO: 1377497 - DNA, 22 bp, Artificial Sequence
  chemically synthesized
aagacattattttctcaagatg

SEQ ID NO: 1377498 - DNA, 22 bp, Artificial Sequence
  chemically synthesized
taagacattattttctcaagat

SEQ ID NO: 1377499 - DNA, 22 bp, Artificial Sequence
  chemically synthesized
gtgggccacatcttgagaaaat

SEQ ID NO: 1377500 - DNA, 22 bp, Artificial Sequence
  chemically synthesized
ctttaagacattattttctcaa

SEQ ID NO: 1377501 - DNA, 22 bp, Artificial Sequence
  chemically synthesized
tgggccacatcttgagaaaata

SEQ ID NO: 1377502 - DNA, 22 bp, Artificial Sequence
  chemically synthesized
gaattcctttaagacattattt

SEQ ID NO: 1377503 - DNA, 22 bp, Artificial Sequence
  chemically synthesized
actggaattcctttaagacatt

SEQ ID NO: 1377504 - DNA, 22 bp, Artificial Sequence
  chemically synthesized
cactggaattcctttaagacat

SEQ ID NO: 1377505 - DNA, 22 bp, Artificial Sequence
  chemically synthesized
gagaaaataatgtcttaaagga

SEQ ID NO: 1377506 - DNA, 22 bp, Artificial Sequence
  chemically synthesized
tttcactggaattcctttaaga

SEQ ID NO: 1377507 - DNA, 22 bp, Artificial Sequence
  chemically synthesized
agaaaataatgtcttaaaggaa

SEQ ID NO: 1377508 - DNA, 22 bp, Artificial Sequence
  chemically synthesized
atttcactggaattcctttaag

SEQ ID NO: 1377509 - DNA, 22 bp, Artificial Sequence
  chemically synthesized
tttatttcactggaattccttt

SEQ ID NO: 1377510 - DNA, 22 bp, Artificial Sequence
  chemically synthesized
atttatttcactggaattcctt

SEQ ID NO: 1377511 - DNA, 22 bp, Artificial Sequence
  chemically synthesized
tttatttatttcactggaattc

SEQ ID NO: 1377512 - DNA, 22 bp, Artificial Sequence
  chemically synthesized
atttatttatttcactggaatt

SEQ ID NO: 1377513 - DNA, 22 bp, Artificial Sequence
  chemically synthesized
cttatttatttatttcactgga

SEQ ID NO: 1377514 - DNA, 22 bp, Artificial Sequence
  chemically synthesized
ccttatttatttatttcactgg

SEQ ID NO: 1377515 - DNA, 22 bp, Artificial Sequence
  chemically synthesized
tccttatttatttatttcactg

SEQ ID NO: 1377516 - DNA, 22 bp, Artificial Sequence
  chemically synthesized
aaaggaattccagtgaaataaa

SEQ ID NO: 1377517 - DNA, 22 bp, Artificial Sequence
  chemically synthesized
aaggaattccagtgaaataaat

SEQ ID NO: 1377518 - DNA, 22 bp, Artificial Sequence
  chemically synthesized
aacatattttccttatttattt

SEQ ID NO: 1377519 - DNA, 22 bp, Artificial Sequence
  chemically synthesized
cagtgaaataaataaataagga

SEQ ID NO: 1377520 - DNA, 22 bp, Artificial Sequence
  chemically synthesized
aactaaacatattttccttatt

SEQ ID NO: 1377521 - DNA, 22 bp, Artificial Sequence
  chemically synthesized
acaagttaaactaaacatattt

SEQ ID NO: 1377522 - DNA, 22 bp, Artificial Sequence
  chemically synthesized
cacaagttaaactaaacatatt

SEQ ID NO: 1377523 - DNA, 22 bp, Artificial Sequence
  chemically synthesized
ttcacaagttaaactaaacata

SEQ ID NO: 1377524 - DNA, 22 bp, Artificial Sequence
  chemically synthesized
cttcacaagttaaactaaacat

SEQ ID NO: 1377525 - DNA, 22 bp, Artificial Sequence
  chemically synthesized
tcttcacaagttaaactaaaca

SEQ ID NO: 1377526 - DNA, 22 bp, Artificial Sequence
  chemically synthesized
ctttcttcacaagttaaactaa

SEQ ID NO: 1377527 - DNA, 22 bp, Artificial Sequence
  chemically synthesized
ctgctttcttcacaagttaaac

SEQ ID NO: 1377528 - DNA, 22 bp, Artificial Sequence
  chemically synthesized
gctgctttcttcacaagttaaa

SEQ ID NO: 1377529 - DNA, 22 bp, Artificial Sequence
  chemically synthesized
acatttgctgctttcttcacaa

SEQ ID NO: 1377530 - DNA, 22 bp, Artificial Sequence
  chemically synthesized
agtttaacttgtgaagaaagca

SEQ ID NO: 1377531 - DNA, 22 bp, Artificial Sequence
  chemically synthesized
gtttaacttgtgaagaaagcag

SEQ ID NO: 1377532 - DNA, 22 bp, Artificial Sequence
  chemically synthesized
acacattaacatttgctgcttt

SEQ ID NO: 1377533 - DNA, 22 bp, Artificial Sequence
  chemically synthesized
aacttgtgaagaaagcagcaaa

SEQ ID NO: 1377534 - DNA, 22 bp, Artificial Sequence
  chemically synthesized
cacacattaacatttgctgctt

SEQ ID NO: 1377535 - DNA, 22 bp, Artificial Sequence
  chemically synthesized
acttgtgaagaaagcagcaaat

SEQ ID NO: 1377536 - DNA, 22 bp, Artificial Sequence
  chemically synthesized
tttcacacattaacatttgctg

SEQ ID NO: 1377537 - DNA, 22 bp, Artificial Sequence
  chemically synthesized
atttcacacattaacatttgct

SEQ ID NO: 1377538 - DNA, 22 bp, Artificial Sequence
  chemically synthesized
gtgaagaaagcagcaaatgtta

SEQ ID NO: 1377539 - DNA, 22 bp, Artificial Sequence
  chemically synthesized
tgaagaaagcagcaaatgttaa

SEQ ID NO: 1377540 - DNA, 22 bp, Artificial Sequence
  chemically synthesized
ttatttcacacattaacatttg

SEQ ID NO: 1377541 - DNA, 22 bp, Artificial Sequence
  chemically synthesized
gaaagttcttatttcacacatt

SEQ ID NO: 1377542 - DNA, 22 bp, Artificial Sequence
  chemically synthesized
atgtgtgaaataagaactttct

SEQ ID NO: 1377543 - DNA, 22 bp, Artificial Sequence
  chemically synthesized
agggtatccccaactagaaagt

SEQ ID NO: 1377544 - DNA, 22 bp, Artificial Sequence
  chemically synthesized
taagggtatccccaactagaaa

SEQ ID NO: 1377545 - DNA, 22 bp, Artificial Sequence
  chemically synthesized
tagctctaagggtatccccaac

SEQ ID NO: 1377546 - DNA, 22 bp, Artificial Sequence
  chemically synthesized
ttgtagctctaagggtatcccc

SEQ ID NO: 1377547 - DNA, 22 bp, Artificial Sequence
  chemically synthesized
tctagttggggatacccttaga

SEQ ID NO: 1377548 - DNA, 22 bp, Artificial Sequence
  chemically synthesized
ctagttggggatacccttagag

SEQ ID NO: 1377549 - DNA, 22 bp, Artificial Sequence
  chemically synthesized
tagttggggatacccttagagc

SEQ ID NO: 1377550 - DNA, 22 bp, Artificial Sequence
  chemically synthesized
gttggggatacccttagagcta

SEQ ID NO: 1377551 - DNA, 22 bp, Artificial Sequence
  chemically synthesized
gggatacccttagagctacaat

SEQ ID NO: 1377552 - DNA, 22 bp, Artificial Sequence
  chemically synthesized
agtaaatgtaaactattgtagc

SEQ ID NO: 1377553 - DNA, 22 bp, Artificial Sequence
  chemically synthesized
aatcctcagtaaatgtaaacta

SEQ ID NO: 1377554 - DNA, 22 bp, Artificial Sequence
  chemically synthesized
gaatcctcagtaaatgtaaact

SEQ ID NO: 1377555 - DNA, 22 bp, Artificial Sequence
  chemically synthesized
agagctacaatagtttacattt

SEQ ID NO: 1377556 - DNA, 22 bp, Artificial Sequence
  chemically synthesized
gagctacaatagtttacattta

SEQ ID NO: 1377557 - DNA, 22 bp, Artificial Sequence
  chemically synthesized
tttgaatcctcagtaaatgtaa

SEQ ID NO: 1377558 - DNA, 22 bp, Artificial Sequence
  chemically synthesized
caatagtttacatttactgagg

SEQ ID NO: 1377559 - DNA, 22 bp, Artificial Sequence
  chemically synthesized
gaattgtttgaatcctcagtaa

SEQ ID NO: 1377560 - DNA, 22 bp, Artificial Sequence
  chemically synthesized
agttggaattgtttgaatcctc

SEQ ID NO: 1377561 - DNA, 22 bp, Artificial Sequence
  chemically synthesized
cagttggaattgtttgaatcct

SEQ ID NO: 1377562 - DNA, 22 bp, Artificial Sequence
  chemically synthesized
acatttactgaggattcaaaca

SEQ ID NO: 1377563 - DNA, 22 bp, Artificial Sequence
  chemically synthesized
catttactgaggattcaaacaa

SEQ ID NO: 1377564 - DNA, 22 bp, Artificial Sequence
  chemically synthesized
tttcagttggaattgtttgaat

SEQ ID NO: 1377565 - DNA, 22 bp, Artificial Sequence
  chemically synthesized
tatttcagttggaattgtttga

SEQ ID NO: 1377566 - DNA, 22 bp, Artificial Sequence
  chemically synthesized
ctatttcagttggaattgtttg

SEQ ID NO: 1377567 - DNA, 22 bp, Artificial Sequence
  chemically synthesized
tctatttcagttggaattgttt

SEQ ID NO: 1377568 - DNA, 22 bp, Artificial Sequence
  chemically synthesized
actgaggattcaaacaattcca

SEQ ID NO: 1377569 - DNA, 22 bp, Artificial Sequence
  chemically synthesized
ctgaggattcaaacaattccaa

SEQ ID NO: 1377570 - DNA, 22 bp, Artificial Sequence
  chemically synthesized
ctttctatttcagttggaattg

SEQ ID NO: 1377571 - DNA, 22 bp, Artificial Sequence
  chemically synthesized
aggattcaaacaattccaactg

SEQ ID NO: 1377572 - DNA, 22 bp, Artificial Sequence
  chemically synthesized
aaacaattccaactgaaataga

SEQ ID NO: 1377573 - DNA, 22 bp, Artificial Sequence
  chemically synthesized
acataaaattgctttctatttc

SEQ ID NO: 1377574 - DNA, 22 bp, Artificial Sequence
  chemically synthesized
caactgaaatagaaagcaattt

SEQ ID NO: 1377575 - DNA, 22 bp, Artificial Sequence
  chemically synthesized
agtattgacataaaattgcttt

SEQ ID NO: 1377576 - DNA, 22 bp, Artificial Sequence
  chemically synthesized
aagtattgacataaaattgctt

SEQ ID NO: 1377577 - DNA, 22 bp, Artificial Sequence
  chemically synthesized
aaatagaaagcaattttatgtc

SEQ ID NO: 1377578 - DNA, 22 bp, Artificial Sequence
  chemically synthesized
agtagtttaagtattgacataa

SEQ ID NO: 1377579 - DNA, 22 bp, Artificial Sequence
  chemically synthesized
gagtagtttaagtattgacata

SEQ ID NO: 1377580 - DNA, 22 bp, Artificial Sequence
  chemically synthesized
aatgcttgagtagtttaagtat

SEQ ID NO: 1377581 - DNA, 22 bp, Artificial Sequence
  chemically synthesized
taaatgcttgagtagtttaagt

SEQ ID NO: 1377582 - DNA, 22 bp, Artificial Sequence
  chemically synthesized
tatgtcaatacttaaactactc

SEQ ID NO: 1377583 - DNA, 22 bp, Artificial Sequence
  chemically synthesized
atgtcaatacttaaactactca

SEQ ID NO: 1377584 - DNA, 22 bp, Artificial Sequence
  chemically synthesized
tgtcaatacttaaactactcaa

SEQ ID NO: 1377585 - DNA, 22 bp, Artificial Sequence
  chemically synthesized
gtaacatgttctaaatgcttga

SEQ ID NO: 1377586 - DNA, 22 bp, Artificial Sequence
  chemically synthesized
agtaacatgttctaaatgcttg

SEQ ID NO: 1377587 - DNA, 22 bp, Artificial Sequence
  chemically synthesized
tagtaacatgttctaaatgctt

SEQ ID NO: 1377588 - DNA, 22 bp, Artificial Sequence
  chemically synthesized
aaactactcaagcatttagaac

SEQ ID NO: 1377589 - DNA, 22 bp, Artificial Sequence
  chemically synthesized
aactactcaagcatttagaaca

SEQ ID NO: 1377590 - DNA, 22 bp, Artificial Sequence
  chemically synthesized
acattttagtaacatgttctaa

SEQ ID NO: 1377591 - DNA, 22 bp, Artificial Sequence
  chemically synthesized
ctcaagcatttagaacatgtta

SEQ ID NO: 1377592 - DNA, 22 bp, Artificial Sequence
  chemically synthesized
aagcatttagaacatgttacta

SEQ ID NO: 1377593 - DNA, 22 bp, Artificial Sequence
  chemically synthesized
tatactaacattttagtaacat

SEQ ID NO: 1377594 - DNA, 22 bp, Artificial Sequence
  chemically synthesized
agaacatgttactaaaatgtta

SEQ ID NO: 1377595 - DNA, 22 bp, Artificial Sequence
  chemically synthesized
gaacatgttactaaaatgttag

SEQ ID NO: 1377596 - DNA, 22 bp, Artificial Sequence
  chemically synthesized
agagattatatactaacatttt

SEQ ID NO: 1377597 - DNA, 22 bp, Artificial Sequence
  chemically synthesized
cctcagagattatatactaaca

SEQ ID NO: 1377598 - DNA, 22 bp, Artificial Sequence
  chemically synthesized
ctaaaatgttagtatataatct

SEQ ID NO: 1377599 - DNA, 22 bp, Artificial Sequence
  chemically synthesized
taggctacctcagagattatat

SEQ ID NO: 1377600 - DNA, 22 bp, Artificial Sequence
  chemically synthesized
ataggctacctcagagattata

SEQ ID NO: 1377601 - DNA, 22 bp, Artificial Sequence
  chemically synthesized
aaatgttagtatataatctctg

SEQ ID NO: 1377602 - DNA, 22 bp, Artificial Sequence
  chemically synthesized
tataggctacctcagagattat

SEQ ID NO: 1377603 - DNA, 22 bp, Artificial Sequence
  chemically synthesized
ttataggctacctcagagatta

SEQ ID NO: 1377604 - DNA, 22 bp, Artificial Sequence
  chemically synthesized
gtatataatctctgaggtagcc

SEQ ID NO: 1377605 - DNA, 22 bp, Artificial Sequence
  chemically synthesized
aaacatttttataggctacctc

SEQ ID NO: 1377606 - DNA, 22 bp, Artificial Sequence
  chemically synthesized
tgaggtagcctataaaaatgtt

SEQ ID NO: 1377607 - DNA, 22 bp, Artificial Sequence
  chemically synthesized
aggtagcctataaaaatgtttc

SEQ ID NO: 1377608 - DNA, 22 bp, Artificial Sequence
  chemically synthesized
taaaaagaaagctgaaacattt

SEQ ID NO: 1377609 - DNA, 22 bp, Artificial Sequence
  chemically synthesized
gtaaaaagaaagctgaaacatt

SEQ ID NO: 1377610 - DNA, 22 bp, Artificial Sequence
  chemically synthesized
catttgtaaaaagaaagctgaa

SEQ ID NO: 1377611 - DNA, 22 bp, Artificial Sequence
  chemically synthesized
ccatttgtaaaaagaaagctga

SEQ ID NO: 1377612 - DNA, 22 bp, Artificial Sequence
  chemically synthesized
taaaaatgtttcagctttcttt

SEQ ID NO: 1377613 - DNA, 22 bp, Artificial Sequence
  chemically synthesized
tttccatttgtaaaaagaaagc

SEQ ID NO: 1377614 - DNA, 22 bp, Artificial Sequence
  chemically synthesized
atttccatttgtaaaaagaaag

SEQ ID NO: 1377615 - DNA, 22 bp, Artificial Sequence
  chemically synthesized
cagctttctttttacaaatgga

SEQ ID NO: 1377616 - DNA, 22 bp, Artificial Sequence
  chemically synthesized
aagatatttatttccatttgta

SEQ ID NO: 1377617 - DNA, 22 bp, Artificial Sequence
  chemically synthesized
agctttctttttacaaatggaa

SEQ ID NO: 1377618 - DNA, 22 bp, Artificial Sequence
  chemically synthesized
caagatatttatttccatttgt

SEQ ID NO: 1377619 - DNA, 22 bp, Artificial Sequence
  chemically synthesized
tctttttacaaatggaaataaa

SEQ ID NO: 1377620 - DNA, 22 bp, Artificial Sequence
  chemically synthesized
atcttcaagatatttatttcca

SEQ ID NO: 1377621 - DNA, 22 bp, Artificial Sequence
  chemically synthesized
ctttttacaaatggaaataaat

SEQ ID NO: 1377622 - DNA, 22 bp, Artificial Sequence
  chemically synthesized
catcttcaagatatttatttcc

SEQ ID NO: 1377623 - DNA, 22 bp, Artificial Sequence
  chemically synthesized
tttttacaaatggaaataaata

SEQ ID NO: 1377624 - DNA, 22 bp, Artificial Sequence
  chemically synthesized
tttacaaatggaaataaatatc

SEQ ID NO: 1377625 - DNA, 22 bp, Artificial Sequence
  chemically synthesized
ttacaaatggaaataaatatct

SEQ ID NO: 1377626 - DNA, 22 bp, Artificial Sequence
  chemically synthesized
gcttcatcttcaagatatttat

SEQ ID NO: 1377627 - DNA, 22 bp, Artificial Sequence
  chemically synthesized
tacaaatggaaataaatatctt

SEQ ID NO: 1377628 - DNA, 22 bp, Artificial Sequence
  chemically synthesized
acaaatggaaataaatatcttg

SEQ ID NO: 1377629 - DNA, 22 bp, Artificial Sequence
  chemically synthesized
tagcttcatcttcaagatattt

SEQ ID NO: 1377630 - DNA, 22 bp, Artificial Sequence
  chemically synthesized
caaatggaaataaatatcttga

SEQ ID NO: 1377631 - DNA, 22 bp, Artificial Sequence
  chemically synthesized
ctagcttcatcttcaagatatt

SEQ ID NO: 1377632 - DNA, 22 bp, Artificial Sequence
  chemically synthesized
tttctagcttcatcttcaagat

SEQ ID NO: 1377633 - DNA, 22 bp, Artificial Sequence
  chemically synthesized
gaagatgaagctagaaacagcg

SEQ ID NO: 1377634 - DNA, 22 bp, Artificial Sequence
  chemically synthesized
aacacgagaaaacgctgtttct

SEQ ID NO: 1377635 - DNA, 22 bp, Artificial Sequence
  chemically synthesized
aagatgaagctagaaacagcgt

SEQ ID NO: 1377636 - DNA, 22 bp, Artificial Sequence
  chemically synthesized
gaacacgagaaaacgctgtttc

SEQ ID NO: 1377637 - DNA, 22 bp, Artificial Sequence
  chemically synthesized
ttgaacacgagaaaacgctgtt

SEQ ID NO: 1377638 - DNA, 22 bp, Artificial Sequence
  chemically synthesized
gaaacagcgttttctcgtgttc

SEQ ID NO: 1377639 - DNA, 22 bp, Artificial Sequence
  chemically synthesized
aataccatgcctcttgaacacg

SEQ ID NO: 1377640 - DNA, 22 bp, Artificial Sequence
  chemically synthesized
tcaataccatgcctcttgaaca

SEQ ID NO: 1377641 - DNA, 22 bp, Artificial Sequence
  chemically synthesized
ctcaataccatgcctcttgaac

SEQ ID NO: 1377642 - DNA, 22 bp, Artificial Sequence
  chemically synthesized
tttctcaataccatgcctcttg

SEQ ID NO: 1377643 - DNA, 22 bp, Artificial Sequence
  chemically synthesized
tctcgtgttcaagaggcatggt

SEQ ID NO: 1377644 - DNA, 22 bp, Artificial Sequence
  chemically synthesized
ctcgtgttcaagaggcatggta

SEQ ID NO: 1377645 - DNA, 22 bp, Artificial Sequence
  chemically synthesized
tcgtgttcaagaggcatggtat

SEQ ID NO: 1377646 - DNA, 22 bp, Artificial Sequence
  chemically synthesized
gtgttcaagaggcatggtattg

SEQ ID NO: 1377647 - DNA, 22 bp, Artificial Sequence
  chemically synthesized
taaattgtttctcaataccatg

SEQ ID NO: 1377648 - DNA, 22 bp, Artificial Sequence
  chemically synthesized
tgtaaattgtttctcaatacca

SEQ ID NO: 1377649 - DNA, 22 bp, Artificial Sequence
  chemically synthesized
aagaggcatggtattgagaaac

SEQ ID NO: 1377650 - DNA, 22 bp, Artificial Sequence
  chemically synthesized
attctgtaaattgtttctcaat

SEQ ID NO: 1377651 - DNA, 22 bp, Artificial Sequence
  chemically synthesized
cattctgtaaattgtttctcaa

SEQ ID NO: 1377652 - DNA, 22 bp, Artificial Sequence
  chemically synthesized
atttcattctgtaaattgtttc

SEQ ID NO: 1377653 - DNA, 22 bp, Artificial Sequence
  chemically synthesized
actcatttcattctgtaaattg

SEQ ID NO: 1377654 - DNA, 22 bp, Artificial Sequence
  chemically synthesized
cactcatttcattctgtaaatt

SEQ ID NO: 1377655 - DNA, 22 bp, Artificial Sequence
  chemically synthesized
tcactcatttcattctgtaaat

SEQ ID NO: 1377656 - DNA, 22 bp, Artificial Sequence
  chemically synthesized
tttcactcatttcattctgtaa

SEQ ID NO: 1377657 - DNA, 22 bp, Artificial Sequence
  chemically synthesized
agaaacaatttacagaatgaaa

SEQ ID NO: 1377658 - DNA, 22 bp, Artificial Sequence
  chemically synthesized
ctctttcactcatttcattctg

SEQ ID NO: 1377659 - DNA, 22 bp, Artificial Sequence
  chemically synthesized
cctctttcactcatttcattct

SEQ ID NO: 1377660 - DNA, 22 bp, Artificial Sequence
  chemically synthesized
tagcttcctctttcactcattt

SEQ ID NO: 1377661 - DNA, 22 bp, Artificial Sequence
  chemically synthesized
acagaatgaaatgagtgaaaga

SEQ ID NO: 1377662 - DNA, 22 bp, Artificial Sequence
  chemically synthesized
actgtagcttcctctttcactc

SEQ ID NO: 1377663 - DNA, 22 bp, Artificial Sequence
  chemically synthesized
cagaatgaaatgagtgaaagag

SEQ ID NO: 1377664 - DNA, 22 bp, Artificial Sequence
  chemically synthesized
aaaatatctgactgtagcttcc

SEQ ID NO: 1377665 - DNA, 22 bp, Artificial Sequence
  chemically synthesized
taaatcatctcaaaatatctga

SEQ ID NO: 1377666 - DNA, 22 bp, Artificial Sequence
  chemically synthesized
ctgtaaatcatctcaaaatatc

SEQ ID NO: 1377667 - DNA, 22 bp, Artificial Sequence
  chemically synthesized
cctgtaaatcatctcaaaatat

SEQ ID NO: 1377668 - DNA, 22 bp, Artificial Sequence
  chemically synthesized
tcctgtaaatcatctcaaaata

SEQ ID NO: 1377669 - DNA, 22 bp, Artificial Sequence
  chemically synthesized
cagtcagatattttgagatgat

SEQ ID NO: 1377670 - DNA, 22 bp, Artificial Sequence
  chemically synthesized
tgctttcctgtaaatcatctca

SEQ ID NO: 1377671 - DNA, 22 bp, Artificial Sequence
  chemically synthesized
atgctttcctgtaaatcatctc

SEQ ID NO: 1377672 - DNA, 22 bp, Artificial Sequence
  chemically synthesized
tatgctttcctgtaaatcatct

SEQ ID NO: 1377673 - DNA, 22 bp, Artificial Sequence
  chemically synthesized
ttttatgctttcctgtaaatca

SEQ ID NO: 1377674 - DNA, 22 bp, Artificial Sequence
  chemically synthesized
gttttatgctttcctgtaaatc

SEQ ID NO: 1377675 - DNA, 22 bp, Artificial Sequence
  chemically synthesized
tttgttttatgctttcctgtaa

SEQ ID NO: 1377676 - DNA, 22 bp, Artificial Sequence
  chemically synthesized
gtttgttttatgctttcctgta

SEQ ID NO: 1377677 - DNA, 22 bp, Artificial Sequence
  chemically synthesized
tgtttgttttatgctttcctgt

SEQ ID NO: 1377678 - DNA, 22 bp, Artificial Sequence
  chemically synthesized
tgagatgatttacaggaaagca

SEQ ID NO: 1377679 - DNA, 22 bp, Artificial Sequence
  chemically synthesized
ttgtttgttttatgctttcctg

SEQ ID NO: 1377680 - DNA, 22 bp, Artificial Sequence
  chemically synthesized
gagatgatttacaggaaagcat

SEQ ID NO: 1377681 - DNA, 22 bp, Artificial Sequence
  chemically synthesized
agatgatttacaggaaagcata

SEQ ID NO: 1377682 - DNA, 22 bp, Artificial Sequence
  chemically synthesized
tttttgtttgttttatgctttc

SEQ ID NO: 1377683 - DNA, 22 bp, Artificial Sequence
  chemically synthesized
atttttgtttgttttatgcttt

SEQ ID NO: 1377684 - DNA, 22 bp, Artificial Sequence
  chemically synthesized
tatttttgtttgttttatgctt

SEQ ID NO: 1377685 - DNA, 22 bp, Artificial Sequence
  chemically synthesized
ttttatttttgtttgttttatg

SEQ ID NO: 1377686 - DNA, 22 bp, Artificial Sequence
  chemically synthesized
gttttatttttgtttgttttat

SEQ ID NO: 1377687 - DNA, 22 bp, Artificial Sequence
  chemically synthesized
tgttttatttttgtttgtttta

SEQ ID NO: 1377688 - DNA, 22 bp, Artificial Sequence
  chemically synthesized
acaggaaagcataaaacaaaca

SEQ ID NO: 1377689 - DNA, 22 bp, Artificial Sequence
  chemically synthesized
caggaaagcataaaacaaacaa

SEQ ID NO: 1377690 - DNA, 22 bp, Artificial Sequence
  chemically synthesized
ttttgttttatttttgtttgtt

SEQ ID NO: 1377691 - DNA, 22 bp, Artificial Sequence
  chemically synthesized
gttttgttttatttttgtttgt

SEQ ID NO: 1377692 - DNA, 22 bp, Artificial Sequence
  chemically synthesized
tgttttgttttatttttgtttg

SEQ ID NO: 1377693 - DNA, 22 bp, Artificial Sequence
  chemically synthesized
ttgttttgttttatttttgttt

SEQ ID NO: 1377694 - DNA, 22 bp, Artificial Sequence
  chemically synthesized
tttttgttttgttttatttttg

SEQ ID NO: 1377695 - DNA, 22 bp, Artificial Sequence
  chemically synthesized
gtttttgttttgttttattttt

SEQ ID NO: 1377696 - DNA, 22 bp, Artificial Sequence
  chemically synthesized
ccttgtttttgttttgttttat

SEQ ID NO: 1377697 - DNA, 22 bp, Artificial Sequence
  chemically synthesized
gtagctgccttgtttttgtttt

SEQ ID NO: 1377698 - DNA, 22 bp, Artificial Sequence
  chemically synthesized
tggtagctgccttgtttttgtt

SEQ ID NO: 1377699 - DNA, 22 bp, Artificial Sequence
  chemically synthesized
tctggtagctgccttgtttttg

SEQ ID NO: 1377700 - DNA, 22 bp, Artificial Sequence
  chemically synthesized
tctctggtagctgccttgtttt

SEQ ID NO: 1377701 - DNA, 22 bp, Artificial Sequence
  chemically synthesized
tcagtatctctctctggtagct

SEQ ID NO: 1377702 - DNA, 22 bp, Artificial Sequence
  chemically synthesized
agaaaaaaatctgtcagtatct

SEQ ID NO: 1377703 - DNA, 22 bp, Artificial Sequence
  chemically synthesized
aagaaaaaaatctgtcagtatc

SEQ ID NO: 1377704 - DNA, 22 bp, Artificial Sequence
  chemically synthesized
ccagagagagatactgacagat

SEQ ID NO: 1377705 - DNA, 22 bp, Artificial Sequence
  chemically synthesized
acagatttttttcttaagtact

SEQ ID NO: 1377706 - DNA, 22 bp, Artificial Sequence
  chemically synthesized
aaagacaaaaggagatagtact

SEQ ID NO: 1377707 - DNA, 22 bp, Artificial Sequence
  chemically synthesized
ttttcttaagtactatctcctt

SEQ ID NO: 1377708 - DNA, 22 bp, Artificial Sequence
  chemically synthesized
tttcttaagtactatctccttt

SEQ ID NO: 1377709 - DNA, 22 bp, Artificial Sequence
  chemically synthesized
ttcttaagtactatctcctttt

SEQ ID NO: 1377710 - DNA, 22 bp, Artificial Sequence
  chemically synthesized
tcttaagtactatctccttttg

SEQ ID NO: 1377711 - DNA, 22 bp, Artificial Sequence
  chemically synthesized
cttaagtactatctccttttgt

SEQ ID NO: 1377712 - DNA, 22 bp, Artificial Sequence
  chemically synthesized
ttaagtactatctccttttgtc

SEQ ID NO: 1377713 - DNA, 22 bp, Artificial Sequence
  chemically synthesized
aagtactatctccttttgtctt

SEQ ID NO: 1377714 - DNA, 22 bp, Artificial Sequence
  chemically synthesized
agtactatctccttttgtcttt

SEQ ID NO: 1377715 - DNA, 22 bp, Artificial Sequence
  chemically synthesized
tctccttttgtcttttagtggg

SEQ ID NO: 1377716 - DNA, 22 bp, Artificial Sequence
  chemically synthesized
cttttgtcttttagtggggtct

SEQ ID NO: 1377717 - DNA, 22 bp, Artificial Sequence
  chemically synthesized
ttgtcttttagtggggtctatc

SEQ ID NO: 1377718 - DNA, 22 bp, Artificial Sequence
  chemically synthesized
tgtcttttagtggggtctatcc

SEQ ID NO: 1377719 - DNA, 22 bp, Artificial Sequence
  chemically synthesized
gtcttttagtggggtctatcca

SEQ ID NO: 1377720 - DNA, 22 bp, Artificial Sequence
  chemically synthesized
tcttttagtggggtctatccac

SEQ ID NO: 1377721 - DNA, 22 bp, Artificial Sequence
  chemically synthesized
aaggaagtgagtgaggtggata

SEQ ID NO: 1377722 - DNA, 22 bp, Artificial Sequence
  chemically synthesized
ttagtggggtctatccacctca

SEQ ID NO: 1377723 - DNA, 22 bp, Artificial Sequence
  chemically synthesized
tagtggggtctatccacctcac

SEQ ID NO: 1377724 - DNA, 22 bp, Artificial Sequence
  chemically synthesized
agtggggtctatccacctcact

SEQ ID NO: 1377725 - DNA, 22 bp, Artificial Sequence
  chemically synthesized
gtggggtctatccacctcactc

SEQ ID NO: 1377726 - DNA, 22 bp, Artificial Sequence
  chemically synthesized
agctaaaggaagtgagtgaggt

SEQ ID NO: 1377727 - DNA, 22 bp, Artificial Sequence
  chemically synthesized
aagctaaaggaagtgagtgagg

SEQ ID NO: 1377728 - DNA, 22 bp, Artificial Sequence
  chemically synthesized
tccacctcactcacttccttta

SEQ ID NO: 1377729 - DNA, 22 bp, Artificial Sequence
  chemically synthesized
actcacttcctttagcttaagt

SEQ ID NO: 1377730 - DNA, 22 bp, Artificial Sequence
  chemically synthesized
gtaaagggaaggcaacttaagc

SEQ ID NO: 1377731 - DNA, 22 bp, Artificial Sequence
  chemically synthesized
ggtaaagggaaggcaacttaag

SEQ ID NO: 1377732 - DNA, 22 bp, Artificial Sequence
  chemically synthesized
acttcctttagcttaagttgcc

SEQ ID NO: 1377733 - DNA, 22 bp, Artificial Sequence
  chemically synthesized
cctttagcttaagttgccttcc

SEQ ID NO: 1377734 - DNA, 22 bp, Artificial Sequence
  chemically synthesized
ctttagcttaagttgccttccc

SEQ ID NO: 1377735 - DNA, 22 bp, Artificial Sequence
  chemically synthesized
tagcttaagttgccttcccttt

SEQ ID NO: 1377736 - DNA, 22 bp, Artificial Sequence
  chemically synthesized
agcttaagttgccttcccttta

SEQ ID NO: 1377737 - DNA, 22 bp, Artificial Sequence
  chemically synthesized
gcttaagttgccttccctttac

SEQ ID NO: 1377738 - DNA, 22 bp, Artificial Sequence
  chemically synthesized
aagttgccttccctttaccaaa

SEQ ID NO: 1377739 - DNA, 22 bp, Artificial Sequence
  chemically synthesized
agttgccttccctttaccaaat

SEQ ID NO: 1377740 - DNA, 22 bp, Artificial Sequence
  chemically synthesized
atgataagaggcaaaatttggt

SEQ ID NO: 1377741 - DNA, 22 bp, Artificial Sequence
  chemically synthesized
ccttccctttaccaaattttgc

SEQ ID NO: 1377742 - DNA, 22 bp, Artificial Sequence
  chemically synthesized
ttaatgataagaggcaaaattt

SEQ ID NO: 1377743 - DNA, 22 bp, Artificial Sequence
  chemically synthesized
ccctttaccaaattttgcctct

SEQ ID NO: 1377744 - DNA, 22 bp, Artificial Sequence
  chemically synthesized
cctttaccaaattttgcctctt

SEQ ID NO: 1377745 - DNA, 22 bp, Artificial Sequence
  chemically synthesized
taccaaattttgcctcttatca

SEQ ID NO: 1377746 - DNA, 22 bp, Artificial Sequence
  chemically synthesized
accaaattttgcctcttatcat

SEQ ID NO: 1377747 - DNA, 22 bp, Artificial Sequence
  chemically synthesized
ccaaattttgcctcttatcatt

SEQ ID NO: 1377748 - DNA, 22 bp, Artificial Sequence
  chemically synthesized
tgcctcttatcattaacagcca

SEQ ID NO: 1377749 - DNA, 22 bp, Artificial Sequence
  chemically synthesized
gcctcttatcattaacagccac

SEQ ID NO: 1377750 - DNA, 22 bp, Artificial Sequence
  chemically synthesized
cctcttatcattaacagccacc

SEQ ID NO: 1377751 - DNA, 22 bp, Artificial Sequence
  chemically synthesized
ttatcattaacagccacctatc

SEQ ID NO: 1377752 - DNA, 22 bp, Artificial Sequence
  chemically synthesized
atcattaacagccacctatctg

SEQ ID NO: 1377753 - DNA, 22 bp, Artificial Sequence
  chemically synthesized
tcattaacagccacctatctgt

SEQ ID NO: 1377754 - DNA, 22 bp, Artificial Sequence
  chemically synthesized
tggagagcagagagaagacaga

SEQ ID NO: 1377755 - DNA, 22 bp, Artificial Sequence
  chemically synthesized
acagccacctatctgtcttctc

SEQ ID NO: 1377756 - DNA, 22 bp, Artificial Sequence
  chemically synthesized
tctgtcttctctctgctctcca

SEQ ID NO: 1377757 - DNA, 22 bp, Artificial Sequence
  chemically synthesized
tcttctctctgctctccacagg

SEQ ID NO: 1377758 - DNA, 22 bp, Artificial Sequence
  chemically synthesized
ctctctgctctccacagggctt

SEQ ID NO: 1377759 - DNA, 22 bp, Artificial Sequence
  chemically synthesized
aaggaacaaagaaagccctgtg

SEQ ID NO: 1377760 - DNA, 22 bp, Artificial Sequence
  chemically synthesized
tctctgctctccacagggcttt

SEQ ID NO: 1377761 - DNA, 22 bp, Artificial Sequence
  chemically synthesized
tctgctctccacagggctttct

SEQ ID NO: 1377762 - DNA, 22 bp, Artificial Sequence
  chemically synthesized
tgctctccacagggctttcttt

SEQ ID NO: 1377763 - DNA, 22 bp, Artificial Sequence
  chemically synthesized
ctctccacagggctttctttgt

SEQ ID NO: 1377764 - DNA, 22 bp, Artificial Sequence
  chemically synthesized
caagttcaaggaacaaagaaag

SEQ ID NO: 1377765 - DNA, 22 bp, Artificial Sequence
  chemically synthesized
gcaagttcaaggaacaaagaaa

SEQ ID NO: 1377766 - DNA, 22 bp, Artificial Sequence
  chemically synthesized
tgcaagttcaaggaacaaagaa

SEQ ID NO: 1377767 - DNA, 22 bp, Artificial Sequence
  chemically synthesized
tccacagggctttctttgttcc

SEQ ID NO: 1377768 - DNA, 22 bp, Artificial Sequence
  chemically synthesized
cacagggctttctttgttcctt

SEQ ID NO: 1377769 - DNA, 22 bp, Artificial Sequence
  chemically synthesized
tccctttgcaagttcaaggaac

SEQ ID NO: 1377770 - DNA, 22 bp, Artificial Sequence
  chemically synthesized
actgtccctttgcaagttcaag

SEQ ID NO: 1377771 - DNA, 22 bp, Artificial Sequence
  chemically synthesized
tctttgttccttgaacttgcaa

SEQ ID NO: 1377772 - DNA, 22 bp, Artificial Sequence
  chemically synthesized
ctttgttccttgaacttgcaaa

SEQ ID NO: 1377773 - DNA, 22 bp, Artificial Sequence
  chemically synthesized
gttaactgtccctttgcaagtt

SEQ ID NO: 1377774 - DNA, 22 bp, Artificial Sequence
  chemically synthesized
tttgttccttgaacttgcaaag

SEQ ID NO: 1377775 - DNA, 22 bp, Artificial Sequence
  chemically synthesized
tgttccttgaacttgcaaaggg

SEQ ID NO: 1377776 - DNA, 22 bp, Artificial Sequence
  chemically synthesized
gttccttgaacttgcaaaggga

SEQ ID NO: 1377777 - DNA, 22 bp, Artificial Sequence
  chemically synthesized
ttccttgaacttgcaaagggac

SEQ ID NO: 1377778 - DNA, 22 bp, Artificial Sequence
  chemically synthesized
cttgaacttgcaaagggacagt

SEQ ID NO: 1377779 - DNA, 22 bp, Artificial Sequence
  chemically synthesized
atgagattagttaactgtccct

SEQ ID NO: 1377780 - DNA, 22 bp, Artificial Sequence
  chemically synthesized
gaacttgcaaagggacagttaa

SEQ ID NO: 1377781 - DNA, 22 bp, Artificial Sequence
  chemically synthesized
aacttgcaaagggacagttaac

SEQ ID NO: 1377782 - DNA, 22 bp, Artificial Sequence
  chemically synthesized
gcaaagggacagttaactaatc

SEQ ID NO: 1377783 - DNA, 22 bp, Artificial Sequence
  chemically synthesized
caaagggacagttaactaatct

SEQ ID NO: 1377784 - DNA, 22 bp, Artificial Sequence
  chemically synthesized
aatgtcatgtccattaatgaga

SEQ ID NO: 1377785 - DNA, 22 bp, Artificial Sequence
  chemically synthesized
aaatgtcatgtccattaatgag

SEQ ID NO: 1377786 - DNA, 22 bp, Artificial Sequence
  chemically synthesized
taaatgtcatgtccattaatga

SEQ ID NO: 1377787 - DNA, 22 bp, Artificial Sequence
  chemically synthesized
actaatctcattaatggacatg

SEQ ID NO: 1377788 - DNA, 22 bp, Artificial Sequence
  chemically synthesized
atctcattaatggacatgacat

SEQ ID NO: 1377789 - DNA, 22 bp, Artificial Sequence
  chemically synthesized
attaatggacatgacatttaaa

SEQ ID NO: 1377790 - DNA, 22 bp, Artificial Sequence
  chemically synthesized
atggacatgacatttaaaactt

SEQ ID NO: 1377791 - DNA, 22 bp, Artificial Sequence
  chemically synthesized
aagcaaagaatgtagaacatca

SEQ ID NO: 1377792 - DNA, 22 bp, Artificial Sequence
  chemically synthesized
aaagcaaagaatgtagaacatc

SEQ ID NO: 1377793 - DNA, 22 bp, Artificial Sequence
  chemically synthesized
taaagcaaagaatgtagaacat

SEQ ID NO: 1377794 - DNA, 22 bp, Artificial Sequence
  chemically synthesized
aaaacttgatgttctacattct

SEQ ID NO: 1377795 - DNA, 22 bp, Artificial Sequence
  chemically synthesized
aaacttgatgttctacattctt

SEQ ID NO: 1377796 - DNA, 22 bp, Artificial Sequence
  chemically synthesized
gatgttctacattctttgcttt

SEQ ID NO: 1377797 - DNA, 22 bp, Artificial Sequence
  chemically synthesized
atgttctacattctttgcttta

SEQ ID NO: 1377798 - DNA, 22 bp, Artificial Sequence
  chemically synthesized
tacattctttgctttaaaacat

SEQ ID NO: 1377799 - DNA, 22 bp, Artificial Sequence
  chemically synthesized
acatgaatgccacatgttttaa

SEQ ID NO: 1377800 - DNA, 22 bp, Artificial Sequence
  chemically synthesized
cattctttgctttaaaacatgt

SEQ ID NO: 1377801 - DNA, 22 bp, Artificial Sequence
  chemically synthesized
tttgctttaaaacatgtggcat

SEQ ID NO: 1377802 - DNA, 22 bp, Artificial Sequence
  chemically synthesized
aggctaacatgaatgccacatg

SEQ ID NO: 1377803 - DNA, 22 bp, Artificial Sequence
  chemically synthesized
tgctttaaaacatgtggcattc

SEQ ID NO: 1377804 - DNA, 22 bp, Artificial Sequence
  chemically synthesized
gctttaaaacatgtggcattca

SEQ ID NO: 1377805 - DNA, 22 bp, Artificial Sequence
  chemically synthesized
ctaaggctaacatgaatgccac

SEQ ID NO: 1377806 - DNA, 22 bp, Artificial Sequence
  chemically synthesized
ctttaaaacatgtggcattcat

SEQ ID NO: 1377807 - DNA, 22 bp, Artificial Sequence
  chemically synthesized
cctaaggctaacatgaatgcca

SEQ ID NO: 1377808 - DNA, 22 bp, Artificial Sequence
  chemically synthesized
ttcctaaggctaacatgaatgc

SEQ ID NO: 1377809 - DNA, 22 bp, Artificial Sequence
  chemically synthesized
taaaacatgtggcattcatgtt

SEQ ID NO: 1377810 - DNA, 22 bp, Artificial Sequence
  chemically synthesized
aaaacatgtggcattcatgtta

SEQ ID NO: 1377811 - DNA, 22 bp, Artificial Sequence
  chemically synthesized
aaacatgtggcattcatgttag

SEQ ID NO: 1377812 - DNA, 22 bp, Artificial Sequence
  chemically synthesized
gttcttcctaaggctaacatga

SEQ ID NO: 1377813 - DNA, 22 bp, Artificial Sequence
  chemically synthesized
agggaggactagttcttcctaa

SEQ ID NO: 1377814 - DNA, 22 bp, Artificial Sequence
  chemically synthesized
tcagggaggactagttcttcct

SEQ ID NO: 1377815 - DNA, 22 bp, Artificial Sequence
  chemically synthesized
atgttagccttaggaagaacta

SEQ ID NO: 1377816 - DNA, 22 bp, Artificial Sequence
  chemically synthesized
cattctcagggaggactagttc

SEQ ID NO: 1377817 - DNA, 22 bp, Artificial Sequence
  chemically synthesized
gccttaggaagaactagtcctc

SEQ ID NO: 1377818 - DNA, 22 bp, Artificial Sequence
  chemically synthesized
aggaagaactagtcctccctga

SEQ ID NO: 1377819 - DNA, 22 bp, Artificial Sequence
  chemically synthesized
ggaagaactagtcctccctgag

SEQ ID NO: 1377820 - DNA, 22 bp, Artificial Sequence
  chemically synthesized
aaccccaaatcccctacattct

SEQ ID NO: 1377821 - DNA, 22 bp, Artificial Sequence
  chemically synthesized
gtcctccctgagaatgtagggg

SEQ ID NO: 1377822 - DNA, 22 bp, Artificial Sequence
  chemically synthesized
cctgagaatgtaggggatttgg

SEQ ID NO: 1377823 - DNA, 22 bp, Artificial Sequence
  chemically synthesized
agaatgtaggggatttggggtt

SEQ ID NO: 1377824 - DNA, 22 bp, Artificial Sequence
  chemically synthesized
tcaccccccccattcaacccca

SEQ ID NO: 1377825 - DNA, 22 bp, Artificial Sequence
  chemically synthesized
ggggttgaatggggggggtgac

SEQ ID NO: 1377826 - DNA, 22 bp, Artificial Sequence
  chemically synthesized
gggttgaatggggggggtgaca

SEQ ID NO: 1377827 - DNA, 22 bp, Artificial Sequence
  chemically synthesized
aatggggggggtgacaggtgac

SEQ ID NO: 1377828 - DNA, 22 bp, Artificial Sequence
  chemically synthesized
caggatgtgatgagtcacctgt

SEQ ID NO: 1377829 - DNA, 22 bp, Artificial Sequence
  chemically synthesized
tccaggatgtgatgagtcacct

SEQ ID NO: 1377830 - DNA, 22 bp, Artificial Sequence
  chemically synthesized
gatcctctccaggatgtgatga

SEQ ID NO: 1377831 - DNA, 22 bp, Artificial Sequence
  chemically synthesized
atcacatcctggagaggatcca

SEQ ID NO: 1377832 - DNA, 22 bp, Artificial Sequence
  chemically synthesized
gagaggatccaatgccacattg

SEQ ID NO: 1377833 - DNA, 22 bp, Artificial Sequence
  chemically synthesized
tgaatagcaaaatgcaaaccaa

SEQ ID NO: 1377834 - DNA, 22 bp, Artificial Sequence
  chemically synthesized
gtgaatagcaaaatgcaaacca

SEQ ID NO: 1377835 - DNA, 22 bp, Artificial Sequence
  chemically synthesized
tcatagtgacttgtgaatagca

SEQ ID NO: 1377836 - DNA, 22 bp, Artificial Sequence
  chemically synthesized
gtttgcattttgctattcacaa

SEQ ID NO: 1377837 - DNA, 22 bp, Artificial Sequence
  chemically synthesized
gcattttgctattcacaagtca

SEQ ID NO: 1377838 - DNA, 22 bp, Artificial Sequence
  chemically synthesized
cattttgctattcacaagtcac

SEQ ID NO: 1377839 - DNA, 22 bp, Artificial Sequence
  chemically synthesized
tgctattcacaagtcactatga

SEQ ID NO: 1377840 - DNA, 22 bp, Artificial Sequence
  chemically synthesized
gctattcacaagtcactatgat

SEQ ID NO: 1377841 - DNA, 22 bp, Artificial Sequence
  chemically synthesized
agtagcgaaattatcatagtga

SEQ ID NO: 1377842 - DNA, 22 bp, Artificial Sequence
  chemically synthesized
ctattcacaagtcactatgata

SEQ ID NO: 1377843 - DNA, 22 bp, Artificial Sequence
  chemically synthesized
aagtagcgaaattatcatagtg

SEQ ID NO: 1377844 - DNA, 22 bp, Artificial Sequence
  chemically synthesized
taagtagcgaaattatcatagt

SEQ ID NO: 1377845 - DNA, 22 bp, Artificial Sequence
  chemically synthesized
ttaagtagcgaaattatcatag

SEQ ID NO: 1377846 - DNA, 22 bp, Artificial Sequence
  chemically synthesized
ttcacaagtcactatgataatt

SEQ ID NO: 1377847 - DNA, 22 bp, Artificial Sequence
  chemically synthesized
tttaagtagcgaaattatcata

SEQ ID NO: 1377848 - DNA, 22 bp, Artificial Sequence
  chemically synthesized
acaagtcactatgataatttcg

SEQ ID NO: 1377849 - DNA, 22 bp, Artificial Sequence
  chemically synthesized
tgataatttcgctacttaaaaa

SEQ ID NO: 1377850 - DNA, 22 bp, Artificial Sequence
  chemically synthesized
agatggtatatcattttttaag

SEQ ID NO: 1377851 - DNA, 22 bp, Artificial Sequence
  chemically synthesized
cagatggtatatcattttttaa

SEQ ID NO: 1377852 - DNA, 22 bp, Artificial Sequence
  chemically synthesized
cgctacttaaaaaatgatatac

SEQ ID NO: 1377853 - DNA, 22 bp, Artificial Sequence
  chemically synthesized
gctacttaaaaaatgatatacc

SEQ ID NO: 1377854 - DNA, 22 bp, Artificial Sequence
  chemically synthesized
ataaaaatttcagatggtatat

SEQ ID NO: 1377855 - DNA, 22 bp, Artificial Sequence
  chemically synthesized
cttaaaaaatgatataccatct

SEQ ID NO: 1377856 - DNA, 22 bp, Artificial Sequence
  chemically synthesized
aataaaaatttcagatggtata

SEQ ID NO: 1377857 - DNA, 22 bp, Artificial Sequence
  chemically synthesized
taataaaaatttcagatggtat

SEQ ID NO: 1377858 - DNA, 22 bp, Artificial Sequence
  chemically synthesized
aaaaaatgatataccatctgaa

SEQ ID NO: 1377859 - DNA, 22 bp, Artificial Sequence
  chemically synthesized
aaaaatgatataccatctgaaa

SEQ ID NO: 1377860 - DNA, 22 bp, Artificial Sequence
  chemically synthesized
ctttaataaaaatttcagatgg

SEQ ID NO: 1377861 - DNA, 22 bp, Artificial Sequence
  chemically synthesized
aaatttttattaaagcaatata

SEQ ID NO: 1377862 - DNA, 22 bp, Artificial Sequence
  chemically synthesized
aatgtgtgtgtatgtatatatt

SEQ ID NO: 1377863 - DNA, 22 bp, Artificial Sequence
  chemically synthesized
ttattaaagcaatatatacata

SEQ ID NO: 1377864 - DNA, 22 bp, Artificial Sequence
  chemically synthesized
taaatgtgtgtgtatgtatata

SEQ ID NO: 1377865 - DNA, 22 bp, Artificial Sequence
  chemically synthesized
tattaaagcaatatatacatac

SEQ ID NO: 1377866 - DNA, 22 bp, Artificial Sequence
  chemically synthesized
ctaaatgtgtgtgtatgtatat

SEQ ID NO: 1377867 - DNA, 22 bp, Artificial Sequence
  chemically synthesized
attaaagcaatatatacataca

SEQ ID NO: 1377868 - DNA, 22 bp, Artificial Sequence
  chemically synthesized
ttaaagcaatatatacatacac

SEQ ID NO: 1377869 - DNA, 22 bp, Artificial Sequence
  chemically synthesized
aagcaatatatacatacacaca

SEQ ID NO: 1377870 - DNA, 22 bp, Artificial Sequence
  chemically synthesized
tgtgatgatcttctaaatgtgt

SEQ ID NO: 1377871 - DNA, 22 bp, Artificial Sequence
  chemically synthesized
gtgtgatgatcttctaaatgtg

SEQ ID NO: 1377872 - DNA, 22 bp, Artificial Sequence
  chemically synthesized
tttgtgtgatgatcttctaaat

SEQ ID NO: 1377873 - DNA, 22 bp, Artificial Sequence
  chemically synthesized
agaagatcatcacacaaataac

SEQ ID NO: 1377874 - DNA, 22 bp, Artificial Sequence
  chemically synthesized
agcaaataaatggttatttgtg

SEQ ID NO: 1377875 - DNA, 22 bp, Artificial Sequence
  chemically synthesized
gaagatcatcacacaaataacc

SEQ ID NO: 1377876 - DNA, 22 bp, Artificial Sequence
  chemically synthesized
agctaagcaaataaatggttat

SEQ ID NO: 1377877 - DNA, 22 bp, Artificial Sequence
  chemically synthesized
agcaacattaagctaagcaaat

SEQ ID NO: 1377878 - DNA, 22 bp, Artificial Sequence
  chemically synthesized
atttgcttagcttaatgttgct

SEQ ID NO: 1377879 - DNA, 22 bp, Artificial Sequence
  chemically synthesized
tttgcttagcttaatgttgctt

SEQ ID NO: 1377880 - DNA, 22 bp, Artificial Sequence
  chemically synthesized
tgaggaaatacctaagcaacat

SEQ ID NO: 1377881 - DNA, 22 bp, Artificial Sequence
  chemically synthesized
atgaggaaatacctaagcaaca

SEQ ID NO: 1377882 - DNA, 22 bp, Artificial Sequence
  chemically synthesized
gcttagcttaatgttgcttagg

SEQ ID NO: 1377883 - DNA, 22 bp, Artificial Sequence
  chemically synthesized
cttagcttaatgttgcttaggt

SEQ ID NO: 1377884 - DNA, 22 bp, Artificial Sequence
  chemically synthesized
ccttatgaggaaatacctaagc

SEQ ID NO: 1377885 - DNA, 22 bp, Artificial Sequence
  chemically synthesized
agcttaatgttgcttaggtatt

SEQ ID NO: 1377886 - DNA, 22 bp, Artificial Sequence
  chemically synthesized
cccttatgaggaaatacctaag

SEQ ID NO: 1377887 - DNA, 22 bp, Artificial Sequence
  chemically synthesized
gcttaatgttgcttaggtattt

SEQ ID NO: 1377888 - DNA, 22 bp, Artificial Sequence
  chemically synthesized
tcccttatgaggaaatacctaa

SEQ ID NO: 1377889 - DNA, 22 bp, Artificial Sequence
  chemically synthesized
ttcccttatgaggaaataccta

SEQ ID NO: 1377890 - DNA, 22 bp, Artificial Sequence
  chemically synthesized
aatgttgcttaggtatttcctc

SEQ ID NO: 1377891 - DNA, 22 bp, Artificial Sequence
  chemically synthesized
atgttgcttaggtatttcctca

SEQ ID NO: 1377892 - DNA, 22 bp, Artificial Sequence
  chemically synthesized
ggtttttcccttatgaggaaat

SEQ ID NO: 1377893 - DNA, 22 bp, Artificial Sequence
  chemically synthesized
tgggtttttcccttatgaggaa

SEQ ID NO: 1377894 - DNA, 22 bp, Artificial Sequence
  chemically synthesized
cttaggtatttcctcataaggg

SEQ ID NO: 1377895 - DNA, 22 bp, Artificial Sequence
  chemically synthesized
attctgggtttttcccttatga

SEQ ID NO: 1377896 - DNA, 22 bp, Artificial Sequence
  chemically synthesized
aggtatttcctcataagggaaa

SEQ ID NO: 1377897 - DNA, 22 bp, Artificial Sequence
  chemically synthesized
ggtatttcctcataagggaaaa

SEQ ID NO: 1377898 - DNA, 22 bp, Artificial Sequence
  chemically synthesized
cctcataagggaaaaacccaga

SEQ ID NO: 1377899 - DNA, 22 bp, Artificial Sequence
  chemically synthesized
ctcataagggaaaaacccagaa

SEQ ID NO: 1377900 - DNA, 22 bp, Artificial Sequence
  chemically synthesized
ataagggaaaaacccagaatca

SEQ ID NO: 1377901 - DNA, 22 bp, Artificial Sequence
  chemically synthesized
aatataaatataaatgactgat

SEQ ID NO: 1377902 - DNA, 22 bp, Artificial Sequence
  chemically synthesized
aaatataaatataaatgactga

SEQ ID NO: 1377903 - DNA, 22 bp, Artificial Sequence
  chemically synthesized
taaatataaatataaatgactg

SEQ ID NO: 1377904 - DNA, 22 bp, Artificial Sequence
  chemically synthesized
acattttaaatataaatataaa

SEQ ID NO: 1377905 - DNA, 22 bp, Artificial Sequence
  chemically synthesized
cacattttaaatataaatataa

SEQ ID NO: 1377906 - DNA, 22 bp, Artificial Sequence
  chemically synthesized
tcacattttaaatataaatata

SEQ ID NO: 1377907 - DNA, 22 bp, Artificial Sequence
  chemically synthesized
tttcacattttaaatataaata

SEQ ID NO: 1377908 - DNA, 22 bp, Artificial Sequence
  chemically synthesized
ctttcacattttaaatataaat

SEQ ID NO: 1377909 - DNA, 22 bp, Artificial Sequence
  chemically synthesized
atatttatatttaaaatgtgaa

SEQ ID NO: 1377910 - DNA, 22 bp, Artificial Sequence
  chemically synthesized
tatttatatttaaaatgtgaaa

SEQ ID NO: 1377911 - DNA, 22 bp, Artificial Sequence
  chemically synthesized
atatttaaaatgtgaaagaaac

SEQ ID NO: 1377912 - DNA, 22 bp, Artificial Sequence
  chemically synthesized
tatttaaaatgtgaaagaaact

SEQ ID NO: 1377913 - DNA, 22 bp, Artificial Sequence
  chemically synthesized
aaaatgtgaaagaaacttctta

SEQ ID NO: 1377914 - DNA, 22 bp, Artificial Sequence
  chemically synthesized
aaatgtgaaagaaacttcttac

SEQ ID NO: 1377915 - DNA, 22 bp, Artificial Sequence
  chemically synthesized
tcatatacaaacatgtaagaag

SEQ ID NO: 1377916 - DNA, 22 bp, Artificial Sequence
  chemically synthesized
ctgtcatatacaaacatgtaag

SEQ ID NO: 1377917 - DNA, 22 bp, Artificial Sequence
  chemically synthesized
ttgctgtcatatacaaacatgt

SEQ ID NO: 1377918 - DNA, 22 bp, Artificial Sequence
  chemically synthesized
gcattgttgctgtcatatacaa

SEQ ID NO: 1377919 - DNA, 22 bp, Artificial Sequence
  chemically synthesized
agcattgttgctgtcatataca

SEQ ID NO: 1377920 - DNA, 22 bp, Artificial Sequence
  chemically synthesized
cttacatgtttgtatatgacag

SEQ ID NO: 1377921 - DNA, 22 bp, Artificial Sequence
  chemically synthesized
ttacatgtttgtatatgacagc

SEQ ID NO: 1377922 - DNA, 22 bp, Artificial Sequence
  chemically synthesized
acatgtttgtatatgacagcaa

SEQ ID NO: 1377923 - DNA, 22 bp, Artificial Sequence
  chemically synthesized
catgtttgtatatgacagcaac

SEQ ID NO: 1377924 - DNA, 22 bp, Artificial Sequence
  chemically synthesized
gtatatgacagcaacaatgcta

SEQ ID NO: 1377925 - DNA, 22 bp, Artificial Sequence
  chemically synthesized
tatatgacagcaacaatgctaa

SEQ ID NO: 1377926 - DNA, 22 bp, Artificial Sequence
  chemically synthesized
aagtgaatcaagaaaaaattta

SEQ ID NO: 1377927 - DNA, 22 bp, Artificial Sequence
  chemically synthesized
gctaaagtgaatcaagaaaaaa

SEQ ID NO: 1377928 - DNA, 22 bp, Artificial Sequence
  chemically synthesized
ttggctaaagtgaatcaagaaa

SEQ ID NO: 1377929 - DNA, 22 bp, Artificial Sequence
  chemically synthesized
aattttttcttgattcacttta

SEQ ID NO: 1377930 - DNA, 22 bp, Artificial Sequence
  chemically synthesized
tttcttgattcactttagccaa

SEQ ID NO: 1377931 - DNA, 22 bp, Artificial Sequence
  chemically synthesized
ttcttgattcactttagccaat

SEQ ID NO: 1377932 - DNA, 22 bp, Artificial Sequence
  chemically synthesized
tcttgattcactttagccaata

SEQ ID NO: 1377933 - DNA, 22 bp, Artificial Sequence
  chemically synthesized
cttgattcactttagccaataa

SEQ ID NO: 1377934 - DNA, 22 bp, Artificial Sequence
  chemically synthesized
ttgattcactttagccaataat

SEQ ID NO: 1377935 - DNA, 22 bp, Artificial Sequence
  chemically synthesized
gattcactttagccaataatac

SEQ ID NO: 1377936 - DNA, 22 bp, Artificial Sequence
  chemically synthesized
attcactttagccaataatact

SEQ ID NO: 1377937 - DNA, 22 bp, Artificial Sequence
  chemically synthesized
aatcataacagaaagtattatt

SEQ ID NO: 1377938 - DNA, 22 bp, Artificial Sequence
  chemically synthesized
actttagccaataatactttct

SEQ ID NO: 1377939 - DNA, 22 bp, Artificial Sequence
  chemically synthesized
tagccaataatactttctgtta

SEQ ID NO: 1377940 - DNA, 22 bp, Artificial Sequence
  chemically synthesized
agccaataatactttctgttat

SEQ ID NO: 1377941 - DNA, 22 bp, Artificial Sequence
  chemically synthesized
tccaactaaatcataacagaaa

SEQ ID NO: 1377942 - DNA, 22 bp, Artificial Sequence
  chemically synthesized
gccaataatactttctgttatg

SEQ ID NO: 1377943 - DNA, 22 bp, Artificial Sequence
  chemically synthesized
tctgttatgatttagttggata

SEQ ID NO: 1377944 - DNA, 22 bp, Artificial Sequence
  chemically synthesized
ataatccagaattatccaacta

SEQ ID NO: 1377945 - DNA, 22 bp, Artificial Sequence
  chemically synthesized
ctgttatgatttagttggataa

SEQ ID NO: 1377946 - DNA, 22 bp, Artificial Sequence
  chemically synthesized
tgttatgatttagttggataat

SEQ ID NO: 1377947 - DNA, 22 bp, Artificial Sequence
  chemically synthesized
ttatgatttagttggataattc

SEQ ID NO: 1377948 - DNA, 22 bp, Artificial Sequence
  chemically synthesized
actcataatccagaattatcca

SEQ ID NO: 1377949 - DNA, 22 bp, Artificial Sequence
  chemically synthesized
tgatttagttggataattctgg

SEQ ID NO: 1377950 - DNA, 22 bp, Artificial Sequence
  chemically synthesized
aaactgactcataatccagaat

SEQ ID NO: 1377951 - DNA, 22 bp, Artificial Sequence
  chemically synthesized
caaactgactcataatccagaa

SEQ ID NO: 1377952 - DNA, 22 bp, Artificial Sequence
  chemically synthesized
agttggataattctggattatg

SEQ ID NO: 1377953 - DNA, 22 bp, Artificial Sequence
  chemically synthesized
gttggataattctggattatga

SEQ ID NO: 1377954 - DNA, 22 bp, Artificial Sequence
  chemically synthesized
atttcaaactgactcataatcc

SEQ ID NO: 1377955 - DNA, 22 bp, Artificial Sequence
  chemically synthesized
gataattctggattatgagtca

SEQ ID NO: 1377956 - DNA, 22 bp, Artificial Sequence
  chemically synthesized
tcatggcctcatttcaaactga

SEQ ID NO: 1377957 - DNA, 22 bp, Artificial Sequence
  chemically synthesized
tggattatgagtcagtttgaaa

SEQ ID NO: 1377958 - DNA, 22 bp, Artificial Sequence
  chemically synthesized
gtcatggcctcatttcaaactg

SEQ ID NO: 1377959 - DNA, 22 bp, Artificial Sequence
  chemically synthesized
tgtcatggcctcatttcaaact

SEQ ID NO: 1377960 - DNA, 22 bp, Artificial Sequence
  chemically synthesized
gattatgagtcagtttgaaatg

SEQ ID NO: 1377961 - DNA, 22 bp, Artificial Sequence
  chemically synthesized
ttgtcatggcctcatttcaaac

SEQ ID NO: 1377962 - DNA, 22 bp, Artificial Sequence
  chemically synthesized
tttttgtcatggcctcatttca

SEQ ID NO: 1377963 - DNA, 22 bp, Artificial Sequence
  chemically synthesized
atttttgtcatggcctcatttc

SEQ ID NO: 1377964 - DNA, 22 bp, Artificial Sequence
  chemically synthesized
tgagtcagtttgaaatgaggcc

SEQ ID NO: 1377965 - DNA, 22 bp, Artificial Sequence
  chemically synthesized
tatttttgtcatggcctcattt

SEQ ID NO: 1377966 - DNA, 22 bp, Artificial Sequence
  chemically synthesized
attttatttttgtcatggcctc

SEQ ID NO: 1377967 - DNA, 22 bp, Artificial Sequence
  chemically synthesized
gattttatttttgtcatggcct

SEQ ID NO: 1377968 - DNA, 22 bp, Artificial Sequence
  chemically synthesized
tgattttatttttgtcatggcc

SEQ ID NO: 1377969 - DNA, 22 bp, Artificial Sequence
  chemically synthesized
ctttgattttatttttgtcatg

SEQ ID NO: 1377970 - DNA, 22 bp, Artificial Sequence
  chemically synthesized
actttgattttatttttgtcat

SEQ ID NO: 1377971 - DNA, 22 bp, Artificial Sequence
  chemically synthesized
gaaatgaggccatgacaaaaat

SEQ ID NO: 1377972 - DNA, 22 bp, Artificial Sequence
  chemically synthesized
tactttgattttatttttgtca

SEQ ID NO: 1377973 - DNA, 22 bp, Artificial Sequence
  chemically synthesized
aaatgaggccatgacaaaaata

SEQ ID NO: 1377974 - DNA, 22 bp, Artificial Sequence
  chemically synthesized
gttttactttgattttattttt

SEQ ID NO: 1377975 - DNA, 22 bp, Artificial Sequence
  chemically synthesized
agttttactttgattttatttt

SEQ ID NO: 1377976 - DNA, 22 bp, Artificial Sequence
  chemically synthesized
tagttttactttgattttattt

SEQ ID NO: 1377977 - DNA, 22 bp, Artificial Sequence
  chemically synthesized
ttagttttactttgattttatt

SEQ ID NO: 1377978 - DNA, 22 bp, Artificial Sequence
  chemically synthesized
gatatttttagttttactttga

SEQ ID NO: 1377979 - DNA, 22 bp, Artificial Sequence
  chemically synthesized
atgttcgatatttttagtttta

SEQ ID NO: 1377980 - DNA, 22 bp, Artificial Sequence
  chemically synthesized
gatgttcgatatttttagtttt

SEQ ID NO: 1377981 - DNA, 22 bp, Artificial Sequence
  chemically synthesized
ttgatgttcgatatttttagtt

SEQ ID NO: 1377982 - DNA, 22 bp, Artificial Sequence
  chemically synthesized
tcttgatgttcgatatttttag

SEQ ID NO: 1377983 - DNA, 22 bp, Artificial Sequence
  chemically synthesized
ggagatggatactctcttgatg

SEQ ID NO: 1377984 - DNA, 22 bp, Artificial Sequence
  chemically synthesized
aaaatatcgaacatcaagagag

SEQ ID NO: 1377985 - DNA, 22 bp, Artificial Sequence
  chemically synthesized
aggagatggatactctcttgat

SEQ ID NO: 1377986 - DNA, 22 bp, Artificial Sequence
  chemically synthesized
aaacccttaggagatggatact

SEQ ID NO: 1377987 - DNA, 22 bp, Artificial Sequence
  chemically synthesized
atcacctcaaacccttaggaga

SEQ ID NO: 1377988 - DNA, 22 bp, Artificial Sequence
  chemically synthesized
ggatactcatcacctcaaaccc

SEQ ID NO: 1377989 - DNA, 22 bp, Artificial Sequence
  chemically synthesized
ctaagggtttgaggtgatgagt

SEQ ID NO: 1377990 - DNA, 22 bp, Artificial Sequence
  chemically synthesized
agggtttgaggtgatgagtatc

SEQ ID NO: 1377991 - DNA, 22 bp, Artificial Sequence
  chemically synthesized
gaggtgatgagtatcccaatta

SEQ ID NO: 1377992 - DNA, 22 bp, Artificial Sequence
  chemically synthesized
aggtgatgagtatcccaattat

SEQ ID NO: 1377993 - DNA, 22 bp, Artificial Sequence
  chemically synthesized
tgtaatgtataatgatcaaatc

SEQ ID NO: 1377994 - DNA, 22 bp, Artificial Sequence
  chemically synthesized
atgtaatgtataatgatcaaat

SEQ ID NO: 1377995 - DNA, 22 bp, Artificial Sequence
  chemically synthesized
tgtttatgtaatgtataatgat

SEQ ID NO: 1377996 - DNA, 22 bp, Artificial Sequence
  chemically synthesized
tcctgatttgatcattatacat

SEQ ID NO: 1377997 - DNA, 22 bp, Artificial Sequence
  chemically synthesized
ctgtgtttatgtaatgtataat

SEQ ID NO: 1377998 - DNA, 22 bp, Artificial Sequence
  chemically synthesized
gctgtgtttatgtaatgtataa

SEQ ID NO: 1377999 - DNA, 22 bp, Artificial Sequence
  chemically synthesized
tgctgtgtttatgtaatgtata

SEQ ID NO: 1378000 - DNA, 22 bp, Artificial Sequence
  chemically synthesized
atttgatcattatacattacat

SEQ ID NO: 1378001 - DNA, 22 bp, Artificial Sequence
  chemically synthesized
gatcattatacattacataaac

SEQ ID NO: 1378002 - DNA, 22 bp, Artificial Sequence
  chemically synthesized
atcattatacattacataaaca

SEQ ID NO: 1378003 - DNA, 22 bp, Artificial Sequence
  chemically synthesized
tacattacataaacacagcaaa

SEQ ID NO: 1378004 - DNA, 22 bp, Artificial Sequence
  chemically synthesized
aggtcacataagattttgctgt

SEQ ID NO: 1378005 - DNA, 22 bp, Artificial Sequence
  chemically synthesized
gaggtcacataagattttgctg

SEQ ID NO: 1378006 - DNA, 22 bp, Artificial Sequence
  chemically synthesized
tgaggtcacataagattttgct

SEQ ID NO: 1378007 - DNA, 22 bp, Artificial Sequence
  chemically synthesized
cataaacacagcaaaatcttat

SEQ ID NO: 1378008 - DNA, 22 bp, Artificial Sequence
  chemically synthesized
tacatattttgaggtcacataa

SEQ ID NO: 1378009 - DNA, 22 bp, Artificial Sequence
  chemically synthesized
atgtgacctcaaaatatgtaca

SEQ ID NO: 1378010 - DNA, 22 bp, Artificial Sequence
  chemically synthesized
atacataatagttgtacatatt

SEQ ID NO: 1378011 - DNA, 22 bp, Artificial Sequence
  chemically synthesized
tgtgacctcaaaatatgtacaa

SEQ ID NO: 1378012 - DNA, 22 bp, Artificial Sequence
  chemically synthesized
ttgatacataatagttgtacat

SEQ ID NO: 1378013 - DNA, 22 bp, Artificial Sequence
  chemically synthesized
attgatacataatagttgtaca

SEQ ID NO: 1378014 - DNA, 22 bp, Artificial Sequence
  chemically synthesized
tattgatacataatagttgtac

SEQ ID NO: 1378015 - DNA, 22 bp, Artificial Sequence
  chemically synthesized
ttattgatacataatagttgta

SEQ ID NO: 1378016 - DNA, 22 bp, Artificial Sequence
  chemically synthesized
aaaatatgtacaactattatgt

SEQ ID NO: 1378017 - DNA, 22 bp, Artificial Sequence
  chemically synthesized
aataggaggtggatccttttat

SEQ ID NO: 1378018 - DNA, 22 bp, Artificial Sequence
  chemically synthesized
ttatgtatcaataaaaggatcc

SEQ ID NO: 1378019 - DNA, 22 bp, Artificial Sequence
  chemically synthesized
tcaataggaggtggatcctttt

SEQ ID NO: 1378020 - DNA, 22 bp, Artificial Sequence
  chemically synthesized
ctcaataggaggtggatccttt

SEQ ID NO: 1378021 - DNA, 22 bp, Artificial Sequence
  chemically synthesized
tgtatcaataaaaggatccacc

SEQ ID NO: 1378022 - DNA, 22 bp, Artificial Sequence
  chemically synthesized
aagtatagtttctcaataggag

SEQ ID NO: 1378023 - DNA, 22 bp, Artificial Sequence
  chemically synthesized
aaatgggttcaagtatagtttc

SEQ ID NO: 1378024 - DNA, 22 bp, Artificial Sequence
  chemically synthesized
ctattgagaaactatacttgaa

SEQ ID NO: 1378025 - DNA, 22 bp, Artificial Sequence
  chemically synthesized
ttgagaaactatacttgaaccc

SEQ ID NO: 1378026 - DNA, 22 bp, Artificial Sequence
  chemically synthesized
agaaactatacttgaacccatt

SEQ ID NO: 1378027 - DNA, 22 bp, Artificial Sequence
  chemically synthesized
acatatacatactaaaatgggt

SEQ ID NO: 1378028 - DNA, 22 bp, Artificial Sequence
  chemically synthesized
tacttgaacccattttagtatg

SEQ ID NO: 1378029 - DNA, 22 bp, Artificial Sequence
  chemically synthesized
gaacccattttagtatgtatat

SEQ ID NO: 1378030 - DNA, 22 bp, Artificial Sequence
  chemically synthesized
aacccattttagtatgtatatg

SEQ ID NO: 1378031 - DNA, 22 bp, Artificial Sequence
  chemically synthesized
cagtatgtacctgacatataca

SEQ ID NO: 1378032 - DNA, 22 bp, Artificial Sequence
  chemically synthesized
gcagtatgtacctgacatatac

SEQ ID NO: 1378033 - DNA, 22 bp, Artificial Sequence
  chemically synthesized
tttgcagtatgtacctgacata

SEQ ID NO: 1378034 - DNA, 22 bp, Artificial Sequence
  chemically synthesized
tagtatgtatatgtcaggtaca

SEQ ID NO: 1378035 - DNA, 22 bp, Artificial Sequence
  chemically synthesized
ttatttgcagtatgtacctgac

SEQ ID NO: 1378036 - DNA, 22 bp, Artificial Sequence
  chemically synthesized
agtatgtatatgtcaggtacat

SEQ ID NO: 1378037 - DNA, 22 bp, Artificial Sequence
  chemically synthesized
gtatgtatatgtcaggtacata

SEQ ID NO: 1378038 - DNA, 22 bp, Artificial Sequence
  chemically synthesized
caattattatttgcagtatgta

SEQ ID NO: 1378039 - DNA, 22 bp, Artificial Sequence
  chemically synthesized
gtccataccaaagttccaatta

SEQ ID NO: 1378040 - DNA, 22 bp, Artificial Sequence
  chemically synthesized
ggtccataccaaagttccaatt

SEQ ID NO: 1378041 - DNA, 22 bp, Artificial Sequence
  chemically synthesized
ttggtccataccaaagttccaa

SEQ ID NO: 1378042 - DNA, 22 bp, Artificial Sequence
  chemically synthesized
caaataataattggaactttgg

SEQ ID NO: 1378043 - DNA, 22 bp, Artificial Sequence
  chemically synthesized
ttcttggtccataccaaagttc

SEQ ID NO: 1378044 - DNA, 22 bp, Artificial Sequence
  chemically synthesized
attattcttggtccataccaaa

SEQ ID NO: 1378045 - DNA, 22 bp, Artificial Sequence
  chemically synthesized
gaactttggtatggaccaagaa

SEQ ID NO: 1378046 - DNA, 22 bp, Artificial Sequence
  chemically synthesized
tggtatggaccaagaataatga

SEQ ID NO: 1378047 - DNA, 22 bp, Artificial Sequence
  chemically synthesized
ggtatggaccaagaataatgaa

SEQ ID NO: 1378048 - DNA, 22 bp, Artificial Sequence
  chemically synthesized
gtatggaccaagaataatgaat

SEQ ID NO: 1378049 - DNA, 22 bp, Artificial Sequence
  chemically synthesized
tagataaatgtccattcattat

SEQ ID NO: 1378050 - DNA, 22 bp, Artificial Sequence
  chemically synthesized
aataaacctgtagataaatgtc

SEQ ID NO: 1378051 - DNA, 22 bp, Artificial Sequence
  chemically synthesized
atatgtctaaataaacctgtag

SEQ ID NO: 1378052 - DNA, 22 bp, Artificial Sequence
  chemically synthesized
atctacaggtttatttagacat

SEQ ID NO: 1378053 - DNA, 22 bp, Artificial Sequence
  chemically synthesized
tcaagaactaatatgtctaaat

SEQ ID NO: 1378054 - DNA, 22 bp, Artificial Sequence
  chemically synthesized
tctacaggtttatttagacata

SEQ ID NO: 1378055 - DNA, 22 bp, Artificial Sequence
  chemically synthesized
ttatcaagaactaatatgtcta

SEQ ID NO: 1378056 - DNA, 22 bp, Artificial Sequence
  chemically synthesized
caggtttatttagacatattag

SEQ ID NO: 1378057 - DNA, 22 bp, Artificial Sequence
  chemically synthesized
atttagacatattagttcttga

SEQ ID NO: 1378058 - DNA, 22 bp, Artificial Sequence
  chemically synthesized
tttagacatattagttcttgat

SEQ ID NO: 1378059 - DNA, 22 bp, Artificial Sequence
  chemically synthesized
ataatcaattgttatcaagaac

SEQ ID NO: 1378060 - DNA, 22 bp, Artificial Sequence
  chemically synthesized
cataatcaattgttatcaagaa

SEQ ID NO: 1378061 - DNA, 22 bp, Artificial Sequence
  chemically synthesized
agacatattagttcttgataac

SEQ ID NO: 1378062 - DNA, 22 bp, Artificial Sequence
  chemically synthesized
gacatattagttcttgataaca

SEQ ID NO: 1378063 - DNA, 22 bp, Artificial Sequence
  chemically synthesized
gtgtcttcataatcaattgtta

SEQ ID NO: 1378064 - DNA, 22 bp, Artificial Sequence
  chemically synthesized
gttcttgataacaattgattat

SEQ ID NO: 1378065 - DNA, 22 bp, Artificial Sequence
  chemically synthesized
ttgataacaattgattatgaag

SEQ ID NO: 1378066 - DNA, 22 bp, Artificial Sequence
  chemically synthesized
gataacaattgattatgaagac

SEQ ID NO: 1378067 - DNA, 22 bp, Artificial Sequence
  chemically synthesized
ataacaattgattatgaagaca

SEQ ID NO: 1378068 - DNA, 22 bp, Artificial Sequence
  chemically synthesized
gtagaagtagttcgtgtcttca

SEQ ID NO: 1378069 - DNA, 22 bp, Artificial Sequence
  chemically synthesized
aattagtagaagtagttcgtgt

SEQ ID NO: 1378070 - DNA, 22 bp, Artificial Sequence
  chemically synthesized
attatgaagacacgaactactt

SEQ ID NO: 1378071 - DNA, 22 bp, Artificial Sequence
  chemically synthesized
ttaaattagtagaagtagttcg

SEQ ID NO: 1378072 - DNA, 22 bp, Artificial Sequence
  chemically synthesized
tattaaattagtagaagtagtt

SEQ ID NO: 1378073 - DNA, 22 bp, Artificial Sequence
  chemically synthesized
tgaagacacgaactacttctac

SEQ ID NO: 1378074 - DNA, 22 bp, Artificial Sequence
  chemically synthesized
gttctattaaattagtagaagt

SEQ ID NO: 1378075 - DNA, 22 bp, Artificial Sequence
  chemically synthesized
tagttctattaaattagtagaa

SEQ ID NO: 1378076 - DNA, 22 bp, Artificial Sequence
  chemically synthesized
tctagttctattaaattagtag

SEQ ID NO: 1378077 - DNA, 22 bp, Artificial Sequence
  chemically synthesized
attctctagttctattaaatta

SEQ ID NO: 1378078 - DNA, 22 bp, Artificial Sequence
  chemically synthesized
cctgattctctagttctattaa

SEQ ID NO: 1378079 - DNA, 22 bp, Artificial Sequence
  chemically synthesized
cttctactaatttaatagaact

SEQ ID NO: 1378080 - DNA, 22 bp, Artificial Sequence
  chemically synthesized
ccctgattctctagttctatta

SEQ ID NO: 1378081 - DNA, 22 bp, Artificial Sequence
  chemically synthesized
tccctgattctctagttctatt

SEQ ID NO: 1378082 - DNA, 22 bp, Artificial Sequence
  chemically synthesized
ctactaatttaatagaactaga

SEQ ID NO: 1378083 - DNA, 22 bp, Artificial Sequence
  chemically synthesized
tactaatttaatagaactagag

SEQ ID NO: 1378084 - DNA, 22 bp, Artificial Sequence
  chemically synthesized
tctttccctgattctctagttc

SEQ ID NO: 1378085 - DNA, 22 bp, Artificial Sequence
  chemically synthesized
ctaatttaatagaactagagaa

SEQ ID NO: 1378086 - DNA, 22 bp, Artificial Sequence
  chemically synthesized
gtctttccctgattctctagtt

SEQ ID NO: 1378087 - DNA, 22 bp, Artificial Sequence
  chemically synthesized
atttaatagaactagagaatca

SEQ ID NO: 1378088 - DNA, 22 bp, Artificial Sequence
  chemically synthesized
aatagaactagagaatcaggga

SEQ ID NO: 1378089 - DNA, 22 bp, Artificial Sequence
  chemically synthesized
atagaactagagaatcagggaa

SEQ ID NO: 1378090 - DNA, 22 bp, Artificial Sequence
  chemically synthesized
tacagcttgtctttccctgatt

SEQ ID NO: 1378091 - DNA, 22 bp, Artificial Sequence
  chemically synthesized
tatacagcttgtctttccctga

SEQ ID NO: 1378092 - DNA, 22 bp, Artificial Sequence
  chemically synthesized
aattctatacagcttgtctttc

SEQ ID NO: 1378093 - DNA, 22 bp, Artificial Sequence
  chemically synthesized
aaattctatacagcttgtcttt

SEQ ID NO: 1378094 - DNA, 22 bp, Artificial Sequence
  chemically synthesized
gagaatcagggaaagacaagct

SEQ ID NO: 1378095 - DNA, 22 bp, Artificial Sequence
  chemically synthesized
taaattctatacagcttgtctt

SEQ ID NO: 1378096 - DNA, 22 bp, Artificial Sequence
  chemically synthesized
cactttaaattctatacagctt

SEQ ID NO: 1378097 - DNA, 22 bp, Artificial Sequence
  chemically synthesized
ccactttaaattctatacagct

SEQ ID NO: 1378098 - DNA, 22 bp, Artificial Sequence
  chemically synthesized
ttccactttaaattctatacag

SEQ ID NO: 1378099 - DNA, 22 bp, Artificial Sequence
  chemically synthesized
taataaattcttccactttaaa

SEQ ID NO: 1378100 - DNA, 22 bp, Artificial Sequence
  chemically synthesized
tataataaattcttccacttta

SEQ ID NO: 1378101 - DNA, 22 bp, Artificial Sequence
  chemically synthesized
tatagaatttaaagtggaagaa

SEQ ID NO: 1378102 - DNA, 22 bp, Artificial Sequence
  chemically synthesized
actctataataaattcttccac

SEQ ID NO: 1378103 - DNA, 22 bp, Artificial Sequence
  chemically synthesized
aactctataataaattcttcca

SEQ ID NO: 1378104 - DNA, 22 bp, Artificial Sequence
  chemically synthesized
taactctataataaattcttcc

SEQ ID NO: 1378105 - DNA, 22 bp, Artificial Sequence
  chemically synthesized
aaagtggaagaatttattatag

SEQ ID NO: 1378106 - DNA, 22 bp, Artificial Sequence
  chemically synthesized
aagtggaagaatttattataga

SEQ ID NO: 1378107 - DNA, 22 bp, Artificial Sequence
  chemically synthesized
ataaaatggatgaagctttaac

SEQ ID NO: 1378108 - DNA, 22 bp, Artificial Sequence
  chemically synthesized
attatagagttaaagcttcatc

SEQ ID NO: 1378109 - DNA, 22 bp, Artificial Sequence
  chemically synthesized
ttatagagttaaagcttcatcc

SEQ ID NO: 1378110 - DNA, 22 bp, Artificial Sequence
  chemically synthesized
gcattaataaaatggatgaagc

SEQ ID NO: 1378111 - DNA, 22 bp, Artificial Sequence
  chemically synthesized
agcattaataaaatggatgaag

SEQ ID NO: 1378112 - DNA, 22 bp, Artificial Sequence
  chemically synthesized
tagagttaaagcttcatccatt

SEQ ID NO: 1378113 - DNA, 22 bp, Artificial Sequence
  chemically synthesized
tagcattaataaaatggatgaa

SEQ ID NO: 1378114 - DNA, 22 bp, Artificial Sequence
  chemically synthesized
ttagcattaataaaatggatga

SEQ ID NO: 1378115 - DNA, 22 bp, Artificial Sequence
  chemically synthesized
tttttagcattaataaaatgga

SEQ ID NO: 1378116 - DNA, 22 bp, Artificial Sequence
  chemically synthesized
aagcttcatccattttattaat

SEQ ID NO: 1378117 - DNA, 22 bp, Artificial Sequence
  chemically synthesized
catccattttattaatgctaaa

SEQ ID NO: 1378118 - DNA, 22 bp, Artificial Sequence
  chemically synthesized
atccattttattaatgctaaaa

SEQ ID NO: 1378119 - DNA, 22 bp, Artificial Sequence
  chemically synthesized
taatgataaatgtatctatttt

SEQ ID NO: 1378120 - DNA, 22 bp, Artificial Sequence
  chemically synthesized
tattaatgctaaaaatagatac

SEQ ID NO: 1378121 - DNA, 22 bp, Artificial Sequence
  chemically synthesized
attaatgctaaaaatagataca

SEQ ID NO: 1378122 - DNA, 22 bp, Artificial Sequence
  chemically synthesized
tataatgataaatgtatctatt

SEQ ID NO: 1378123 - DNA, 22 bp, Artificial Sequence
  chemically synthesized
ttaatgctaaaaatagatacat

SEQ ID NO: 1378124 - DNA, 22 bp, Artificial Sequence
  chemically synthesized
atgctaaaaatagatacattta

SEQ ID NO: 1378125 - DNA, 22 bp, Artificial Sequence
  chemically synthesized
actctataatgataaatgtatc

SEQ ID NO: 1378126 - DNA, 22 bp, Artificial Sequence
  chemically synthesized
gactctataatgataaatgtat

SEQ ID NO: 1378127 - DNA, 22 bp, Artificial Sequence
  chemically synthesized
tttgactctataatgataaatg

SEQ ID NO: 1378128 - DNA, 22 bp, Artificial Sequence
  chemically synthesized
gtttgactctataatgataaat

SEQ ID NO: 1378129 - DNA, 22 bp, Artificial Sequence
  chemically synthesized
aaaatagatacatttatcatta

SEQ ID NO: 1378130 - DNA, 22 bp, Artificial Sequence
  chemically synthesized
tgtttgactctataatgataaa

SEQ ID NO: 1378131 - DNA, 22 bp, Artificial Sequence
  chemically synthesized
ttgtttgactctataatgataa

SEQ ID NO: 1378132 - DNA, 22 bp, Artificial Sequence
  chemically synthesized
tttgtttgactctataatgata

SEQ ID NO: 1378133 - DNA, 22 bp, Artificial Sequence
  chemically synthesized
ttttgtttgactctataatgat

SEQ ID NO: 1378134 - DNA, 22 bp, Artificial Sequence
  chemically synthesized
aaatttttttgtttgactctat

SEQ ID NO: 1378135 - DNA, 22 bp, Artificial Sequence
  chemically synthesized
attgaaatttttttgtttgact

SEQ ID NO: 1378136 - DNA, 22 bp, Artificial Sequence
  chemically synthesized
atcattatagagtcaaacaaaa

SEQ ID NO: 1378137 - DNA, 22 bp, Artificial Sequence
  chemically synthesized
tcattatagagtcaaacaaaaa

SEQ ID NO: 1378138 - DNA, 22 bp, Artificial Sequence
  chemically synthesized
actcattgaaatttttttgttt

SEQ ID NO: 1378139 - DNA, 22 bp, Artificial Sequence
  chemically synthesized
tagagtcaaacaaaaaaatttc

SEQ ID NO: 1378140 - DNA, 22 bp, Artificial Sequence
  chemically synthesized
aaattcactcattgaaattttt

SEQ ID NO: 1378141 - DNA, 22 bp, Artificial Sequence
  chemically synthesized
cagtacattaaaattcactcat

SEQ ID NO: 1378142 - DNA, 22 bp, Artificial Sequence
  chemically synthesized
cacagtctacagtacattaaaa

SEQ ID NO: 1378143 - DNA, 22 bp, Artificial Sequence
  chemically synthesized
caatgagtgaattttaatgtac

SEQ ID NO: 1378144 - DNA, 22 bp, Artificial Sequence
  chemically synthesized
aatgagtgaattttaatgtact

SEQ ID NO: 1378145 - DNA, 22 bp, Artificial Sequence
  chemically synthesized
aatatctccacagtctacagta

SEQ ID NO: 1378146 - DNA, 22 bp, Artificial Sequence
  chemically synthesized
caatatctccacagtctacagt

SEQ ID NO: 1378147 - DNA, 22 bp, Artificial Sequence
  chemically synthesized
tcaatatctccacagtctacag

SEQ ID NO: 1378148 - DNA, 22 bp, Artificial Sequence
  chemically synthesized
taatgtactgtagactgtggag

SEQ ID NO: 1378149 - DNA, 22 bp, Artificial Sequence
  chemically synthesized
aactttcaatatctccacagtc

SEQ ID NO: 1378150 - DNA, 22 bp, Artificial Sequence
  chemically synthesized
aatgtactgtagactgtggaga

SEQ ID NO: 1378151 - DNA, 22 bp, Artificial Sequence
  chemically synthesized
atgtactgtagactgtggagat

SEQ ID NO: 1378152 - DNA, 22 bp, Artificial Sequence
  chemically synthesized
agttaaactttcaatatctcca

SEQ ID NO: 1378153 - DNA, 22 bp, Artificial Sequence
  chemically synthesized
cagttaaactttcaatatctcc

SEQ ID NO: 1378154 - DNA, 22 bp, Artificial Sequence
  chemically synthesized
ttcagttaaactttcaatatct

SEQ ID NO: 1378155 - DNA, 22 bp, Artificial Sequence
  chemically synthesized
cttcagttaaactttcaatatc

SEQ ID NO: 1378156 - DNA, 22 bp, Artificial Sequence
  chemically synthesized
tagactgtggagatattgaaag

SEQ ID NO: 1378157 - DNA, 22 bp, Artificial Sequence
  chemically synthesized
tcttcagttaaactttcaatat

SEQ ID NO: 1378158 - DNA, 22 bp, Artificial Sequence
  chemically synthesized
tggagatattgaaagtttaact

SEQ ID NO: 1378159 - DNA, 22 bp, Artificial Sequence
  chemically synthesized
gacagattttcttcagttaaac

SEQ ID NO: 1378160 - DNA, 22 bp, Artificial Sequence
  chemically synthesized
aaagtttaactgaagaaaatct

SEQ ID NO: 1378161 - DNA, 22 bp, Artificial Sequence
  chemically synthesized
aactgaagaaaatctgtctagc

SEQ ID NO: 1378162 - DNA, 22 bp, Artificial Sequence
  chemically synthesized
actgaagaaaatctgtctagct

SEQ ID NO: 1378163 - DNA, 22 bp, Artificial Sequence
  chemically synthesized
atggatgagaagtaaagctaga

SEQ ID NO: 1378164 - DNA, 22 bp, Artificial Sequence
  chemically synthesized
aagaaaatctgtctagctttac

SEQ ID NO: 1378165 - DNA, 22 bp, Artificial Sequence
  chemically synthesized
aatggatgagaagtaaagctag

SEQ ID NO: 1378166 - DNA, 22 bp, Artificial Sequence
  chemically synthesized
tttaatggatgagaagtaaagc

SEQ ID NO: 1378167 - DNA, 22 bp, Artificial Sequence
  chemically synthesized
tatttaatggatgagaagtaaa

SEQ ID NO: 1378168 - DNA, 22 bp, Artificial Sequence
  chemically synthesized
ctctatttaatggatgagaagt

SEQ ID NO: 1378169 - DNA, 22 bp, Artificial Sequence
  chemically synthesized
gctctatttaatggatgagaag

SEQ ID NO: 1378170 - DNA, 22 bp, Artificial Sequence
  chemically synthesized
tctagctttacttctcatccat

SEQ ID NO: 1378171 - DNA, 22 bp, Artificial Sequence
  chemically synthesized
gctttacttctcatccattaaa

SEQ ID NO: 1378172 - DNA, 22 bp, Artificial Sequence
  chemically synthesized
tacttctcatccattaaataga

SEQ ID NO: 1378173 - DNA, 22 bp, Artificial Sequence
  chemically synthesized
acttctcatccattaaatagag

SEQ ID NO: 1378174 - DNA, 22 bp, Artificial Sequence
  chemically synthesized
cttctcatccattaaatagagc

SEQ ID NO: 1378175 - DNA, 22 bp, Artificial Sequence
  chemically synthesized
ccaagcatacttgctctattta

SEQ ID NO: 1378176 - DNA, 22 bp, Artificial Sequence
  chemically synthesized
gccaagcatacttgctctattt

SEQ ID NO: 1378177 - DNA, 22 bp, Artificial Sequence
  chemically synthesized
tgccaagcatacttgctctatt

SEQ ID NO: 1378178 - DNA, 22 bp, Artificial Sequence
  chemically synthesized
ctcatccattaaatagagcaag

SEQ ID NO: 1378179 - DNA, 22 bp, Artificial Sequence
  chemically synthesized
ttgccaagcatacttgctctat

SEQ ID NO: 1378180 - DNA, 22 bp, Artificial Sequence
  chemically synthesized
tcatccattaaatagagcaagt

SEQ ID NO: 1378181 - DNA, 22 bp, Artificial Sequence
  chemically synthesized
ttttgccaagcatacttgctct

SEQ ID NO: 1378182 - DNA, 22 bp, Artificial Sequence
  chemically synthesized
atccattaaatagagcaagtat

SEQ ID NO: 1378183 - DNA, 22 bp, Artificial Sequence
  chemically synthesized
ggtattcttttgccaagcatac

SEQ ID NO: 1378184 - DNA, 22 bp, Artificial Sequence
  chemically synthesized
aggtattcttttgccaagcata

SEQ ID NO: 1378185 - DNA, 22 bp, Artificial Sequence
  chemically synthesized
aatagagcaagtatgcttggca

SEQ ID NO: 1378186 - DNA, 22 bp, Artificial Sequence
  chemically synthesized
taggtattcttttgccaagcat

SEQ ID NO: 1378187 - DNA, 22 bp, Artificial Sequence
  chemically synthesized
ttaggtattcttttgccaagca

SEQ ID NO: 1378188 - DNA, 22 bp, Artificial Sequence
  chemically synthesized
tttaggtattcttttgccaagc

SEQ ID NO: 1378189 - DNA, 22 bp, Artificial Sequence
  chemically synthesized
ttttaggtattcttttgccaag

SEQ ID NO: 1378190 - DNA, 22 bp, Artificial Sequence
  chemically synthesized
gaaatttttttaggtattcttt

SEQ ID NO: 1378191 - DNA, 22 bp, Artificial Sequence
  chemically synthesized
ggcaaaagaatacctaaaaaaa

SEQ ID NO: 1378192 - DNA, 22 bp, Artificial Sequence
  chemically synthesized
gcaaaagaatacctaaaaaaat

SEQ ID NO: 1378193 - DNA, 22 bp, Artificial Sequence
  chemically synthesized
gagaagggactggaaatttttt

SEQ ID NO: 1378194 - DNA, 22 bp, Artificial Sequence
  chemically synthesized
agagaagggactggaaattttt

SEQ ID NO: 1378195 - DNA, 22 bp, Artificial Sequence
  chemically synthesized
tcacttagagaagggactggaa

SEQ ID NO: 1378196 - DNA, 22 bp, Artificial Sequence
  chemically synthesized
gtcacttagagaagggactgga

SEQ ID NO: 1378197 - DNA, 22 bp, Artificial Sequence
  chemically synthesized
tgtcacttagagaagggactgg

SEQ ID NO: 1378198 - DNA, 22 bp, Artificial Sequence
  chemically synthesized
aaaaaatttccagtcccttctc

SEQ ID NO: 1378199 - DNA, 22 bp, Artificial Sequence
  chemically synthesized
ccagtcccttctctaagtgaca

SEQ ID NO: 1378200 - DNA, 22 bp, Artificial Sequence
  chemically synthesized
cagtcccttctctaagtgacaa

SEQ ID NO: 1378201 - DNA, 22 bp, Artificial Sequence
  chemically synthesized
ctctaagtgacaaaattctgat

SEQ ID NO: 1378202 - DNA, 22 bp, Artificial Sequence
  chemically synthesized
tctaagtgacaaaattctgatg

SEQ ID NO: 1378203 - DNA, 22 bp, Artificial Sequence
  chemically synthesized
taagtgacaaaattctgatggc

SEQ ID NO: 1378204 - DNA, 22 bp, Artificial Sequence
  chemically synthesized
agtgacaaaattctgatggcct

SEQ ID NO: 1378205 - DNA, 22 bp, Artificial Sequence
  chemically synthesized
taaaatatcgagaggccatcag

SEQ ID NO: 1378206 - DNA, 22 bp, Artificial Sequence
  chemically synthesized
ttgtaaaatatcgagaggccat

SEQ ID NO: 1378207 - DNA, 22 bp, Artificial Sequence
  chemically synthesized
tacctgttgtaaaatatcgaga

SEQ ID NO: 1378208 - DNA, 22 bp, Artificial Sequence
  chemically synthesized
atacctgttgtaaaatatcgag

SEQ ID NO: 1378209 - DNA, 22 bp, Artificial Sequence
  chemically synthesized
tgatggcctctcgatattttac

SEQ ID NO: 1378210 - DNA, 22 bp, Artificial Sequence
  chemically synthesized
atggcctctcgatattttacaa

SEQ ID NO: 1378211 - DNA, 22 bp, Artificial Sequence
  chemically synthesized
ataaccgcttatacctgttgta

SEQ ID NO: 1378212 - DNA, 22 bp, Artificial Sequence
  chemically synthesized
cataaccgcttatacctgttgt

SEQ ID NO: 1378213 - DNA, 22 bp, Artificial Sequence
  chemically synthesized
tcgatattttacaacaggtata

SEQ ID NO: 1378214 - DNA, 22 bp, Artificial Sequence
  chemically synthesized
cttcataaccgcttatacctgt

SEQ ID NO: 1378215 - DNA, 22 bp, Artificial Sequence
  chemically synthesized
gatattttacaacaggtataag

SEQ ID NO: 1378216 - DNA, 22 bp, Artificial Sequence
  chemically synthesized
acttcataaccgcttatacctg

SEQ ID NO: 1378217 - DNA, 22 bp, Artificial Sequence
  chemically synthesized
tacttcataaccgcttatacct

SEQ ID NO: 1378218 - DNA, 22 bp, Artificial Sequence
  chemically synthesized
ttacttcataaccgcttatacc

SEQ ID NO: 1378219 - DNA, 22 bp, Artificial Sequence
  chemically synthesized
tacaacaggtataagcggttat

SEQ ID NO: 1378220 - DNA, 22 bp, Artificial Sequence
  chemically synthesized
acaacaggtataagcggttatg

SEQ ID NO: 1378221 - DNA, 22 bp, Artificial Sequence
  chemically synthesized
caacaggtataagcggttatga

SEQ ID NO: 1378222 - DNA, 22 bp, Artificial Sequence
  chemically synthesized
tgaagtaaaaatatcaccgtct

SEQ ID NO: 1378223 - DNA, 22 bp, Artificial Sequence
  chemically synthesized
gatgaccatcagagacggtgat

SEQ ID NO: 1378224 - DNA, 22 bp, Artificial Sequence
  chemically synthesized
gagactagatgaccatcagaga

SEQ ID NO: 1378225 - DNA, 22 bp, Artificial Sequence
  chemically synthesized
attagagactagatgaccatca

SEQ ID NO: 1378226 - DNA, 22 bp, Artificial Sequence
  chemically synthesized
cctcattagagactagatgacc

SEQ ID NO: 1378227 - DNA, 22 bp, Artificial Sequence
  chemically synthesized
ccctcattagagactagatgac

SEQ ID NO: 1378228 - DNA, 22 bp, Artificial Sequence
  chemically synthesized
gtttccctcattagagactaga

SEQ ID NO: 1378229 - DNA, 22 bp, Artificial Sequence
  chemically synthesized
tgatggtcatctagtctctaat

SEQ ID NO: 1378230 - DNA, 22 bp, Artificial Sequence
  chemically synthesized
ttggtttccctcattagagact

SEQ ID NO: 1378231 - DNA, 22 bp, Artificial Sequence
  chemically synthesized
attggtttccctcattagagac

SEQ ID NO: 1378232 - DNA, 22 bp, Artificial Sequence
  chemically synthesized
atggtcatctagtctctaatga

SEQ ID NO: 1378233 - DNA, 22 bp, Artificial Sequence
  chemically synthesized
tggatttattggtttccctcat

SEQ ID NO: 1378234 - DNA, 22 bp, Artificial Sequence
  chemically synthesized
atggatttattggtttccctca

SEQ ID NO: 1378235 - DNA, 22 bp, Artificial Sequence
  chemically synthesized
gtctctaatgagggaaaccaat

SEQ ID NO: 1378236 - DNA, 22 bp, Artificial Sequence
  chemically synthesized
gtatttatggatttattggttt

SEQ ID NO: 1378237 - DNA, 22 bp, Artificial Sequence
  chemically synthesized
taatgagggaaaccaataaatc

SEQ ID NO: 1378238 - DNA, 22 bp, Artificial Sequence
  chemically synthesized
attagtatttatggatttattg

SEQ ID NO: 1378239 - DNA, 22 bp, Artificial Sequence
  chemically synthesized
atgagggaaaccaataaatcca

SEQ ID NO: 1378240 - DNA, 22 bp, Artificial Sequence
  chemically synthesized
cattagtatttatggatttatt

SEQ ID NO: 1378241 - DNA, 22 bp, Artificial Sequence
  chemically synthesized
aaaaatttcattagtatttatg

SEQ ID NO: 1378242 - DNA, 22 bp, Artificial Sequence
  chemically synthesized
gaaaaatttcattagtatttat

SEQ ID NO: 1378243 - DNA, 22 bp, Artificial Sequence
  chemically synthesized
gagtttgaaaaatttcattagt

SEQ ID NO: 1378244 - DNA, 22 bp, Artificial Sequence
  chemically synthesized
agaatggggattagagtttgaa

SEQ ID NO: 1378245 - DNA, 22 bp, Artificial Sequence
  chemically synthesized
atgaaatttttcaaactctaat

SEQ ID NO: 1378246 - DNA, 22 bp, Artificial Sequence
  chemically synthesized
ataactaagaatggggattaga

SEQ ID NO: 1378247 - DNA, 22 bp, Artificial Sequence
  chemically synthesized
ttcaaactctaatccccattct

SEQ ID NO: 1378248 - DNA, 22 bp, Artificial Sequence
  chemically synthesized
tcaaactctaatccccattctt

SEQ ID NO: 1378249 - DNA, 22 bp, Artificial Sequence
  chemically synthesized
caaactctaatccccattctta

SEQ ID NO: 1378250 - DNA, 22 bp, Artificial Sequence
  chemically synthesized
aaactctaatccccattcttag

SEQ ID NO: 1378251 - DNA, 22 bp, Artificial Sequence
  chemically synthesized
taatccccattcttagttatca

SEQ ID NO: 1378252 - DNA, 22 bp, Artificial Sequence
  chemically synthesized
aaataacaaaaattgataacta

SEQ ID NO: 1378253 - DNA, 22 bp, Artificial Sequence
  chemically synthesized
atccccattcttagttatcaat

SEQ ID NO: 1378254 - DNA, 22 bp, Artificial Sequence
  chemically synthesized
ttaaaataacaaaaattgataa

SEQ ID NO: 1378255 - DNA, 22 bp, Artificial Sequence
  chemically synthesized
ctattaaaataacaaaaattga

SEQ ID NO: 1378256 - DNA, 22 bp, Artificial Sequence
  chemically synthesized
ttagttatcaatttttgttatt

SEQ ID NO: 1378257 - DNA, 22 bp, Artificial Sequence
  chemically synthesized
agttatcaatttttgttatttt

SEQ ID NO: 1378258 - DNA, 22 bp, Artificial Sequence
  chemically synthesized
gttatcaatttttgttatttta

SEQ ID NO: 1378259 - DNA, 22 bp, Artificial Sequence
  chemically synthesized
tcaatttttgttattttaatag

SEQ ID NO: 1378260 - DNA, 22 bp, Artificial Sequence
  chemically synthesized
tacatgaataaattactattaa

SEQ ID NO: 1378261 - DNA, 22 bp, Artificial Sequence
  chemically synthesized
atacatgaataaattactatta

SEQ ID NO: 1378262 - DNA, 22 bp, Artificial Sequence
  chemically synthesized
tatacatgaataaattactatt

SEQ ID NO: 1378263 - DNA, 22 bp, Artificial Sequence
  chemically synthesized
ttgttattttaatagtaattta

SEQ ID NO: 1378264 - DNA, 22 bp, Artificial Sequence
  chemically synthesized
tgttattttaatagtaatttat

SEQ ID NO: 1378265 - DNA, 22 bp, Artificial Sequence
  chemically synthesized
gttattttaatagtaatttatt

SEQ ID NO: 1378266 - DNA, 22 bp, Artificial Sequence
  chemically synthesized
ttattttaatagtaatttattc

SEQ ID NO: 1378267 - DNA, 22 bp, Artificial Sequence
  chemically synthesized
cagttttatacatgaataaatt

SEQ ID NO: 1378268 - DNA, 22 bp, Artificial Sequence
  chemically synthesized
ccagttttatacatgaataaat

SEQ ID NO: 1378269 - DNA, 22 bp, Artificial Sequence
  chemically synthesized
ttttaatagtaatttattcatg

SEQ ID NO: 1378270 - DNA, 22 bp, Artificial Sequence
  chemically synthesized
tccagttttatacatgaataaa

SEQ ID NO: 1378271 - DNA, 22 bp, Artificial Sequence
  chemically synthesized
taatagtaatttattcatgtat

SEQ ID NO: 1378272 - DNA, 22 bp, Artificial Sequence
  chemically synthesized
aatagtaatttattcatgtata

SEQ ID NO: 1378273 - DNA, 22 bp, Artificial Sequence
  chemically synthesized
atagtaatttattcatgtataa

SEQ ID NO: 1378274 - DNA, 22 bp, Artificial Sequence
  chemically synthesized
atgatgggattttccagtttta

SEQ ID NO: 1378275 - DNA, 22 bp, Artificial Sequence
  chemically synthesized
attcatgtataaaactggaaaa

SEQ ID NO: 1378276 - DNA, 22 bp, Artificial Sequence
  chemically synthesized
ttcatgtataaaactggaaaat

SEQ ID NO: 1378277 - DNA, 22 bp, Artificial Sequence
  chemically synthesized
attaatgatgggattttccagt

SEQ ID NO: 1378278 - DNA, 22 bp, Artificial Sequence
  chemically synthesized
atgtataaaactggaaaatccc

SEQ ID NO: 1378279 - DNA, 22 bp, Artificial Sequence
  chemically synthesized
ctaattaatgatgggattttcc

SEQ ID NO: 1378280 - DNA, 22 bp, Artificial Sequence
  chemically synthesized
ttgctaattaatgatgggattt

SEQ ID NO: 1378281 - DNA, 22 bp, Artificial Sequence
  chemically synthesized
gaaaatcccatcattaattagc

SEQ ID NO: 1378282 - DNA, 22 bp, Artificial Sequence
  chemically synthesized
ataaagagctattgctaattaa

SEQ ID NO: 1378283 - DNA, 22 bp, Artificial Sequence
  chemically synthesized
aaatattaataaagagctattg

SEQ ID NO: 1378284 - DNA, 22 bp, Artificial Sequence
  chemically synthesized
aaaatattaataaagagctatt

SEQ ID NO: 1378285 - DNA, 22 bp, Artificial Sequence
  chemically synthesized
taaaatattaataaagagctat

SEQ ID NO: 1378286 - DNA, 22 bp, Artificial Sequence
  chemically synthesized
ttttaaaatattaataaagagc

SEQ ID NO: 1378287 - DNA, 22 bp, Artificial Sequence
  chemically synthesized
attagcaatagctctttattaa

SEQ ID NO: 1378288 - DNA, 22 bp, Artificial Sequence
  chemically synthesized
gcaatagctctttattaatatt

SEQ ID NO: 1378289 - DNA, 22 bp, Artificial Sequence
  chemically synthesized
gaaactattttaaaatattaat

SEQ ID NO: 1378290 - DNA, 22 bp, Artificial Sequence
  chemically synthesized
ggaaactattttaaaatattaa

SEQ ID NO: 1378291 - DNA, 22 bp, Artificial Sequence
  chemically synthesized
gtttggaaactattttaaaata

SEQ ID NO: 1378292 - DNA, 22 bp, Artificial Sequence
  chemically synthesized
agtttggaaactattttaaaat

SEQ ID NO: 1378293 - DNA, 22 bp, Artificial Sequence
  chemically synthesized
tttattaatattttaaaatagt

SEQ ID NO: 1378294 - DNA, 22 bp, Artificial Sequence
  chemically synthesized
tattaatattttaaaatagttt

SEQ ID NO: 1378295 - DNA, 22 bp, Artificial Sequence
  chemically synthesized
attaatattttaaaatagtttc

SEQ ID NO: 1378296 - DNA, 22 bp, Artificial Sequence
  chemically synthesized
ttaatattttaaaatagtttcc

SEQ ID NO: 1378297 - DNA, 22 bp, Artificial Sequence
  chemically synthesized
agagtttagtttggaaactatt

SEQ ID NO: 1378298 - DNA, 22 bp, Artificial Sequence
  chemically synthesized
atattttaaaatagtttccaaa

SEQ ID NO: 1378299 - DNA, 22 bp, Artificial Sequence
  chemically synthesized
taaaatagtttccaaactaaac

SEQ ID NO: 1378300 - DNA, 22 bp, Artificial Sequence
  chemically synthesized
ggcatattaagagtttagtttg

SEQ ID NO: 1378301 - DNA, 22 bp, Artificial Sequence
  chemically synthesized
aaaatagtttccaaactaaact

SEQ ID NO: 1378302 - DNA, 22 bp, Artificial Sequence
  chemically synthesized
aaatagtttccaaactaaactc

SEQ ID NO: 1378303 - DNA, 22 bp, Artificial Sequence
  chemically synthesized
ccaaactaaactcttaatatgc

SEQ ID NO: 1378304 - DNA, 22 bp, Artificial Sequence
  chemically synthesized
caaactaaactcttaatatgcc

SEQ ID NO: 1378305 - DNA, 22 bp, Artificial Sequence
  chemically synthesized
aagggatcatgacattaggcat

SEQ ID NO: 1378306 - DNA, 22 bp, Artificial Sequence
  chemically synthesized
aactcttaatatgcctaatgtc

SEQ ID NO: 1378307 - DNA, 22 bp, Artificial Sequence
  chemically synthesized
attaaagggatcatgacattag

SEQ ID NO: 1378308 - DNA, 22 bp, Artificial Sequence
  chemically synthesized
tcattaaagggatcatgacatt

SEQ ID NO: 1378309 - DNA, 22 bp, Artificial Sequence
  chemically synthesized
ttaatatgcctaatgtcatgat

SEQ ID NO: 1378310 - DNA, 22 bp, Artificial Sequence
  chemically synthesized
ctcattaaagggatcatgacat

SEQ ID NO: 1378311 - DNA, 22 bp, Artificial Sequence
  chemically synthesized
aatatgcctaatgtcatgatcc

SEQ ID NO: 1378312 - DNA, 22 bp, Artificial Sequence
  chemically synthesized
atatgcctaatgtcatgatccc

SEQ ID NO: 1378313 - DNA, 22 bp, Artificial Sequence
  chemically synthesized
gtttctcattaaagggatcatg

SEQ ID NO: 1378314 - DNA, 22 bp, Artificial Sequence
  chemically synthesized
atggctagtttctcattaaagg

SEQ ID NO: 1378315 - DNA, 22 bp, Artificial Sequence
  chemically synthesized
atgtcatgatccctttaatgag

SEQ ID NO: 1378316 - DNA, 22 bp, Artificial Sequence
  chemically synthesized
aatggctagtttctcattaaag

SEQ ID NO: 1378317 - DNA, 22 bp, Artificial Sequence
  chemically synthesized
taatggctagtttctcattaaa

SEQ ID NO: 1378318 - DNA, 22 bp, Artificial Sequence
  chemically synthesized
ttaatggctagtttctcattaa

SEQ ID NO: 1378319 - DNA, 22 bp, Artificial Sequence
  chemically synthesized
ttttaatggctagtttctcatt

SEQ ID NO: 1378320 - DNA, 22 bp, Artificial Sequence
  chemically synthesized
cttttaatggctagtttctcat

SEQ ID NO: 1378321 - DNA, 22 bp, Artificial Sequence
  chemically synthesized
tcttttaatggctagtttctca

SEQ ID NO: 1378322 - DNA, 22 bp, Artificial Sequence
  chemically synthesized
ttttcttttaatggctagtttc

SEQ ID NO: 1378323 - DNA, 22 bp, Artificial Sequence
  chemically synthesized
taatgagaaactagccattaaa

SEQ ID NO: 1378324 - DNA, 22 bp, Artificial Sequence
  chemically synthesized
aatgagaaactagccattaaaa

SEQ ID NO: 1378325 - DNA, 22 bp, Artificial Sequence
  chemically synthesized
atgagaaactagccattaaaag

SEQ ID NO: 1378326 - DNA, 22 bp, Artificial Sequence
  chemically synthesized
gccattaaaagaaaatagctta

SEQ ID NO: 1378327 - DNA, 22 bp, Artificial Sequence
  chemically synthesized
tatatagaaatgagtataagct

SEQ ID NO: 1378328 - DNA, 22 bp, Artificial Sequence
  chemically synthesized
atatatagaaatgagtataagc

SEQ ID NO: 1378329 - DNA, 22 bp, Artificial Sequence
  chemically synthesized
aaagaaaatagcttatactcat

SEQ ID NO: 1378330 - DNA, 22 bp, Artificial Sequence
  chemically synthesized
atactcatttctatatataagt

SEQ ID NO: 1378331 - DNA, 22 bp, Artificial Sequence
  chemically synthesized
tactcatttctatatataagta

SEQ ID NO: 1378332 - DNA, 22 bp, Artificial Sequence
  chemically synthesized
caaaataatatgtacttatata

SEQ ID NO: 1378333 - DNA, 22 bp, Artificial Sequence
  chemically synthesized
acaaaataatatgtacttatat

SEQ ID NO: 1378334 - DNA, 22 bp, Artificial Sequence
  chemically synthesized
tttacaaaataatatgtactta

SEQ ID NO: 1378335 - DNA, 22 bp, Artificial Sequence
  chemically synthesized
atttctatatataagtacatat

SEQ ID NO: 1378336 - DNA, 22 bp, Artificial Sequence
  chemically synthesized
actgtttacaaaataatatgta

SEQ ID NO: 1378337 - DNA, 22 bp, Artificial Sequence
  chemically synthesized
ctatatataagtacatattatt

SEQ ID NO: 1378338 - DNA, 22 bp, Artificial Sequence
  chemically synthesized
tatatataagtacatattattt

SEQ ID NO: 1378339 - DNA, 22 bp, Artificial Sequence
  chemically synthesized
ctaactgtttacaaaataatat

SEQ ID NO: 1378340 - DNA, 22 bp, Artificial Sequence
  chemically synthesized
tatataagtacatattattttg

SEQ ID NO: 1378341 - DNA, 22 bp, Artificial Sequence
  chemically synthesized
tgctaactgtttacaaaataat

SEQ ID NO: 1378342 - DNA, 22 bp, Artificial Sequence
  chemically synthesized
ctgctaactgtttacaaaataa

SEQ ID NO: 1378343 - DNA, 22 bp, Artificial Sequence
  chemically synthesized
tctgctaactgtttacaaaata

SEQ ID NO: 1378344 - DNA, 22 bp, Artificial Sequence
  chemically synthesized
acggtgaaattttctgctaact

SEQ ID NO: 1378345 - DNA, 22 bp, Artificial Sequence
  chemically synthesized
aacggtgaaattttctgctaac

SEQ ID NO: 1378346 - DNA, 22 bp, Artificial Sequence
  chemically synthesized
ttttgtaaacagttagcagaaa

SEQ ID NO: 1378347 - DNA, 22 bp, Artificial Sequence
  chemically synthesized
taacggtgaaattttctgctaa

SEQ ID NO: 1378348 - DNA, 22 bp, Artificial Sequence
  chemically synthesized
ttaacggtgaaattttctgcta

SEQ ID NO: 1378349 - DNA, 22 bp, Artificial Sequence
  chemically synthesized
tgtaaacagttagcagaaaatt

SEQ ID NO: 1378350 - DNA, 22 bp, Artificial Sequence
  chemically synthesized
gtaaacagttagcagaaaattt

SEQ ID NO: 1378351 - DNA, 22 bp, Artificial Sequence
  chemically synthesized
taaacagttagcagaaaatttc

SEQ ID NO: 1378352 - DNA, 22 bp, Artificial Sequence
  chemically synthesized
atttttaacggtgaaattttct

SEQ ID NO: 1378353 - DNA, 22 bp, Artificial Sequence
  chemically synthesized
catttttaacggtgaaattttc

SEQ ID NO: 1378354 - DNA, 22 bp, Artificial Sequence
  chemically synthesized
gcagaaaatttcaccgttaaaa

SEQ ID NO: 1378355 - DNA, 22 bp, Artificial Sequence
  chemically synthesized
caccgttaaaaatgaaatattt

SEQ ID NO: 1378356 - DNA, 22 bp, Artificial Sequence
  chemically synthesized
accgttaaaaatgaaatatttt

SEQ ID NO: 1378357 - DNA, 22 bp, Artificial Sequence
  chemically synthesized
aaatgcaaaaatggaaaatatt

SEQ ID NO: 1378358 - DNA, 22 bp, Artificial Sequence
  chemically synthesized
aaaatgaaatattttccatttt

SEQ ID NO: 1378359 - DNA, 22 bp, Artificial Sequence
  chemically synthesized
agatattcaaatgcaaaaatgg

SEQ ID NO: 1378360 - DNA, 22 bp, Artificial Sequence
  chemically synthesized
tcagatattcaaatgcaaaaat

SEQ ID NO: 1378361 - DNA, 22 bp, Artificial Sequence
  chemically synthesized
tccatttttgcatttgaatatc

SEQ ID NO: 1378362 - DNA, 22 bp, Artificial Sequence
  chemically synthesized
ccatttttgcatttgaatatct

SEQ ID NO: 1378363 - DNA, 22 bp, Artificial Sequence
  chemically synthesized
catttttgcatttgaatatctg

SEQ ID NO: 1378364 - DNA, 22 bp, Artificial Sequence
  chemically synthesized
ttgcatttgaatatctgagaat

SEQ ID NO: 1378365 - DNA, 22 bp, Artificial Sequence
  chemically synthesized
tgcatttgaatatctgagaata

SEQ ID NO: 1378366 - DNA, 22 bp, Artificial Sequence
  chemically synthesized
gcatttgaatatctgagaatat

SEQ ID NO: 1378367 - DNA, 22 bp, Artificial Sequence
  chemically synthesized
catttgaatatctgagaatatg

SEQ ID NO: 1378368 - DNA, 22 bp, Artificial Sequence
  chemically synthesized
gcaagaatatcgggaacatatt

SEQ ID NO: 1378369 - DNA, 22 bp, Artificial Sequence
  chemically synthesized
gaatatctgagaatatgttccc

SEQ ID NO: 1378370 - DNA, 22 bp, Artificial Sequence
  chemically synthesized
aatatctgagaatatgttcccg

SEQ ID NO: 1378371 - DNA, 22 bp, Artificial Sequence
  chemically synthesized
taaactggcaagaatatcggga

SEQ ID NO: 1378372 - DNA, 22 bp, Artificial Sequence
  chemically synthesized
ataaactggcaagaatatcggg

SEQ ID NO: 1378373 - DNA, 22 bp, Artificial Sequence
  chemically synthesized
agaatatgttcccgatattctt

SEQ ID NO: 1378374 - DNA, 22 bp, Artificial Sequence
  chemically synthesized
aaatataggtttataaactggc

SEQ ID NO: 1378375 - DNA, 22 bp, Artificial Sequence
  chemically synthesized
ccgatattcttgccagtttata

SEQ ID NO: 1378376 - DNA, 22 bp, Artificial Sequence
  chemically synthesized
ttaaaatataggtttataaact

SEQ ID NO: 1378377 - DNA, 22 bp, Artificial Sequence
  chemically synthesized
ttgccagtttataaacctatat

SEQ ID NO: 1378378 - DNA, 22 bp, Artificial Sequence
  chemically synthesized
gccagtttataaacctatattt

SEQ ID NO: 1378379 - DNA, 22 bp, Artificial Sequence
  chemically synthesized
ccagtactgttaaaatataggt

SEQ ID NO: 1378380 - DNA, 22 bp, Artificial Sequence
  chemically synthesized
ccagtttataaacctatatttt

SEQ ID NO: 1378381 - DNA, 22 bp, Artificial Sequence
  chemically synthesized
agcattaccagtactgttaaaa

SEQ ID NO: 1378382 - DNA, 22 bp, Artificial Sequence
  chemically synthesized
ataaacctatattttaacagta

SEQ ID NO: 1378383 - DNA, 22 bp, Artificial Sequence
  chemically synthesized
taaacctatattttaacagtac

SEQ ID NO: 1378384 - DNA, 22 bp, Artificial Sequence
  chemically synthesized
tattttaacagtactggtaatg

SEQ ID NO: 1378385 - DNA, 22 bp, Artificial Sequence
  chemically synthesized
tgtataattaagcattaccagt

SEQ ID NO: 1378386 - DNA, 22 bp, Artificial Sequence
  chemically synthesized
gtgtataattaagcattaccag

SEQ ID NO: 1378387 - DNA, 22 bp, Artificial Sequence
  chemically synthesized
taacagtactggtaatgcttaa

SEQ ID NO: 1378388 - DNA, 22 bp, Artificial Sequence
  chemically synthesized
aacagtactggtaatgcttaat

SEQ ID NO: 1378389 - DNA, 22 bp, Artificial Sequence
  chemically synthesized
acagtactggtaatgcttaatt

SEQ ID NO: 1378390 - DNA, 22 bp, Artificial Sequence
  chemically synthesized
gtaatgcttaattatacacaaa

SEQ ID NO: 1378391 - DNA, 22 bp, Artificial Sequence
  chemically synthesized
tgatgtgaaataaagcaaattt

SEQ ID NO: 1378392 - DNA, 22 bp, Artificial Sequence
  chemically synthesized
gtgatgtgaaataaagcaaatt

SEQ ID NO: 1378393 - DNA, 22 bp, Artificial Sequence
  chemically synthesized
aattatacacaaatttgcttta

SEQ ID NO: 1378394 - DNA, 22 bp, Artificial Sequence
  chemically synthesized
attatacacaaatttgctttat

SEQ ID NO: 1378395 - DNA, 22 bp, Artificial Sequence
  chemically synthesized
tacacaaatttgctttatttca

SEQ ID NO: 1378396 - DNA, 22 bp, Artificial Sequence
  chemically synthesized
gctttatttcacatcacaaggc

SEQ ID NO: 1378397 - DNA, 22 bp, Artificial Sequence
  chemically synthesized
cagacaaacaaagccttgtgat

SEQ ID NO: 1378398 - DNA, 22 bp, Artificial Sequence
  chemically synthesized
ctttatttcacatcacaaggct

SEQ ID NO: 1378399 - DNA, 22 bp, Artificial Sequence
  chemically synthesized
tatttcacatcacaaggctttg

SEQ ID NO: 1378400 - DNA, 22 bp, Artificial Sequence
  chemically synthesized
atttcacatcacaaggctttgt

SEQ ID NO: 1378401 - DNA, 22 bp, Artificial Sequence
  chemically synthesized
tttcacatcacaaggctttgtt

SEQ ID NO: 1378402 - DNA, 22 bp, Artificial Sequence
  chemically synthesized
cacatcacaaggctttgtttgt

SEQ ID NO: 1378403 - DNA, 22 bp, Artificial Sequence
  chemically synthesized
acatcacaaggctttgtttgtc

SEQ ID NO: 1378404 - DNA, 22 bp, Artificial Sequence
  chemically synthesized
tgtttgtctggagcatacacta

SEQ ID NO: 1378405 - DNA, 22 bp, Artificial Sequence
  chemically synthesized
gtttgtctggagcatacactat

SEQ ID NO: 1378406 - DNA, 22 bp, Artificial Sequence
  chemically synthesized
tttgtctggagcatacactatt

SEQ ID NO: 1378407 - DNA, 22 bp, Artificial Sequence
  chemically synthesized
tacagtgtaaacaatagtgtat

SEQ ID NO: 1378408 - DNA, 22 bp, Artificial Sequence
  chemically synthesized
gtctggagcatacactattgtt

SEQ ID NO: 1378409 - DNA, 22 bp, Artificial Sequence
  chemically synthesized
tctggagcatacactattgttt

SEQ ID NO: 1378410 - DNA, 22 bp, Artificial Sequence
  chemically synthesized
gagcatacactattgtttacac

SEQ ID NO: 1378411 - DNA, 22 bp, Artificial Sequence
  chemically synthesized
ttgtttacactgtacagttctt

SEQ ID NO: 1378412 - DNA, 22 bp, Artificial Sequence
  chemically synthesized
tttacactgtacagttcttttt

SEQ ID NO: 1378413 - DNA, 22 bp, Artificial Sequence
  chemically synthesized
acactgtacagttctttttgtt

SEQ ID NO: 1378414 - DNA, 22 bp, Artificial Sequence
  chemically synthesized
cactgtacagttctttttgtta

SEQ ID NO: 1378415 - DNA, 22 bp, Artificial Sequence
  chemically synthesized
aaagcatccaaatcgtaacaaa

SEQ ID NO: 1378416 - DNA, 22 bp, Artificial Sequence
  chemically synthesized
aaaagcatccaaatcgtaacaa

SEQ ID NO: 1378417 - DNA, 22 bp, Artificial Sequence
  chemically synthesized
tacagttctttttgttacgatt

SEQ ID NO: 1378418 - DNA, 22 bp, Artificial Sequence
  chemically synthesized
taaaagcatccaaatcgtaaca

SEQ ID NO: 1378419 - DNA, 22 bp, Artificial Sequence
  chemically synthesized
ttaaaagcatccaaatcgtaac

SEQ ID NO: 1378420 - DNA, 22 bp, Artificial Sequence
  chemically synthesized
ttttaaaagcatccaaatcgta

SEQ ID NO: 1378421 - DNA, 22 bp, Artificial Sequence
  chemically synthesized
tttttgttacgatttggatgct

SEQ ID NO: 1378422 - DNA, 22 bp, Artificial Sequence
  chemically synthesized
tttgttacgatttggatgcttt

SEQ ID NO: 1378423 - DNA, 22 bp, Artificial Sequence
  chemically synthesized
aaatctcttttaaaagcatcca

SEQ ID NO: 1378424 - DNA, 22 bp, Artificial Sequence
  chemically synthesized
ttgttacgatttggatgctttt

SEQ ID NO: 1378425 - DNA, 22 bp, Artificial Sequence
  chemically synthesized
aaaatctcttttaaaagcatcc

SEQ ID NO: 1378426 - DNA, 22 bp, Artificial Sequence
  chemically synthesized
tgttacgatttggatgctttta

SEQ ID NO: 1378427 - DNA, 22 bp, Artificial Sequence
  chemically synthesized
gttacgatttggatgcttttaa

SEQ ID NO: 1378428 - DNA, 22 bp, Artificial Sequence
  chemically synthesized
ttacgatttggatgcttttaaa

SEQ ID NO: 1378429 - DNA, 22 bp, Artificial Sequence
  chemically synthesized
cgatttggatgcttttaaaaga

SEQ ID NO: 1378430 - DNA, 22 bp, Artificial Sequence
  chemically synthesized
ggatgcttttaaaagagatttt

SEQ ID NO: 1378431 - DNA, 22 bp, Artificial Sequence
  chemically synthesized
gatgcttttaaaagagatttta

SEQ ID NO: 1378432 - DNA, 22 bp, Artificial Sequence
  chemically synthesized
agagcaaatatttaaaatctct

SEQ ID NO: 1378433 - DNA, 22 bp, Artificial Sequence
  chemically synthesized
ttaaaagagattttaaatattt

SEQ ID NO: 1378434 - DNA, 22 bp, Artificial Sequence
  chemically synthesized
taaaagagattttaaatatttg

SEQ ID NO: 1378435 - DNA, 22 bp, Artificial Sequence
  chemically synthesized
aaaagagattttaaatatttgc

SEQ ID NO: 1378436 - DNA, 22 bp, Artificial Sequence
  chemically synthesized
ataaacctgagagcaaatattt

SEQ ID NO: 1378437 - DNA, 22 bp, Artificial Sequence
  chemically synthesized
aaagagattttaaatatttgct

SEQ ID NO: 1378438 - DNA, 22 bp, Artificial Sequence
  chemically synthesized
aataaacctgagagcaaatatt

SEQ ID NO: 1378439 - DNA, 22 bp, Artificial Sequence
  chemically synthesized
taataaacctgagagcaaatat

SEQ ID NO: 1378440 - DNA, 22 bp, Artificial Sequence
  chemically synthesized
ttaataaacctgagagcaaata

SEQ ID NO: 1378441 - DNA, 22 bp, Artificial Sequence
  chemically synthesized
tttaataaacctgagagcaaat

SEQ ID NO: 1378442 - DNA, 22 bp, Artificial Sequence
  chemically synthesized
tgttttttaataaacctgagag

SEQ ID NO: 1378443 - DNA, 22 bp, Artificial Sequence
  chemically synthesized
taaatatttgctctcaggttta

SEQ ID NO: 1378444 - DNA, 22 bp, Artificial Sequence
  chemically synthesized
aaatatttgctctcaggtttat

SEQ ID NO: 1378445 - DNA, 22 bp, Artificial Sequence
  chemically synthesized
aatatttgctctcaggtttatt

SEQ ID NO: 1378446 - DNA, 22 bp, Artificial Sequence
  chemically synthesized
aagtctatgttttttaataaac

SEQ ID NO: 1378447 - DNA, 22 bp, Artificial Sequence
  chemically synthesized
caagtctatgttttttaataaa

SEQ ID NO: 1378448 - DNA, 22 bp, Artificial Sequence
  chemically synthesized
tcaagtctatgttttttaataa

SEQ ID NO: 1378449 - DNA, 22 bp, Artificial Sequence
  chemically synthesized
ttcaagtctatgttttttaata

SEQ ID NO: 1378450 - DNA, 22 bp, Artificial Sequence
  chemically synthesized
gctctcaggtttattaaaaaac

SEQ ID NO: 1378451 - DNA, 22 bp, Artificial Sequence
  chemically synthesized
tttcaagtctatgttttttaat

SEQ ID NO: 1378452 - DNA, 22 bp, Artificial Sequence
  chemically synthesized
ctctcaggtttattaaaaaaca

SEQ ID NO: 1378453 - DNA, 22 bp, Artificial Sequence
  chemically synthesized
ttttcaagtctatgttttttaa

SEQ ID NO: 1378454 - DNA, 22 bp, Artificial Sequence
  chemically synthesized
tcaggtttattaaaaaacatag

SEQ ID NO: 1378455 - DNA, 22 bp, Artificial Sequence
  chemically synthesized
aggtttattaaaaaacatagac

SEQ ID NO: 1378456 - DNA, 22 bp, Artificial Sequence
  chemically synthesized
attaaaaaacatagacttgaaa

SEQ ID NO: 1378457 - DNA, 22 bp, Artificial Sequence
  chemically synthesized
ttaaaaaacatagacttgaaaa

SEQ ID NO: 1378458 - DNA, 22 bp, Artificial Sequence
  chemically synthesized
aaaaacatagacttgaaaaaag

SEQ ID NO: 1378459 - DNA, 22 bp, Artificial Sequence
  chemically synthesized
aatatatcatatcttttttcaa

SEQ ID NO: 1378460 - DNA, 22 bp, Artificial Sequence
  chemically synthesized
taattgaatatatcatatcttt

SEQ ID NO: 1378461 - DNA, 22 bp, Artificial Sequence
  chemically synthesized
ataattgaatatatcatatctt

SEQ ID NO: 1378462 - DNA, 22 bp, Artificial Sequence
  chemically synthesized
tataattgaatatatcatatct

SEQ ID NO: 1378463 - DNA, 22 bp, Artificial Sequence
  chemically synthesized
ttataattgaatatatcatatc

SEQ ID NO: 1378464 - DNA, 22 bp, Artificial Sequence
  chemically synthesized
gaaaaaagatatgatatattca

SEQ ID NO: 1378465 - DNA, 22 bp, Artificial Sequence
  chemically synthesized
aaaaaagatatgatatattcaa

SEQ ID NO: 1378466 - DNA, 22 bp, Artificial Sequence
  chemically synthesized
atacaatttttataattgaata

SEQ ID NO: 1378467 - DNA, 22 bp, Artificial Sequence
  chemically synthesized
ttaatacaatttttataattga

SEQ ID NO: 1378468 - DNA, 22 bp, Artificial Sequence
  chemically synthesized
gttaatacaatttttataattg

SEQ ID NO: 1378469 - DNA, 22 bp, Artificial Sequence
  chemically synthesized
gaatttgttaatacaattttta

SEQ ID NO: 1378470 - DNA, 22 bp, Artificial Sequence
  chemically synthesized
agaatttgttaatacaattttt

SEQ ID NO: 1378471 - DNA, 22 bp, Artificial Sequence
  chemically synthesized
tagaatttgttaatacaatttt

SEQ ID NO: 1378472 - DNA, 22 bp, Artificial Sequence
  chemically synthesized
ttagaatttgttaatacaattt

SEQ ID NO: 1378473 - DNA, 22 bp, Artificial Sequence
  chemically synthesized
aattataaaaattgtattaaca

SEQ ID NO: 1378474 - DNA, 22 bp, Artificial Sequence
  chemically synthesized
taaaaattgtattaacaaattc

SEQ ID NO: 1378475 - DNA, 22 bp, Artificial Sequence
  chemically synthesized
ggataatgataaacttttagaa

SEQ ID NO: 1378476 - DNA, 22 bp, Artificial Sequence
  chemically synthesized
aggataatgataaacttttaga

SEQ ID NO: 1378477 - DNA, 22 bp, Artificial Sequence
  chemically synthesized
tattaacaaattctaaaagttt

SEQ ID NO: 1378478 - DNA, 22 bp, Artificial Sequence
  chemically synthesized
taggataatgataaacttttag

SEQ ID NO: 1378479 - DNA, 22 bp, Artificial Sequence
  chemically synthesized
acaaattctaaaagtttatcat

SEQ ID NO: 1378480 - DNA, 22 bp, Artificial Sequence
  chemically synthesized
taaaagtttatcattatcctaa

SEQ ID NO: 1378481 - DNA, 22 bp, Artificial Sequence
  chemically synthesized
aaagtttatcattatcctaaaa

SEQ ID NO: 1378482 - DNA, 22 bp, Artificial Sequence
  chemically synthesized
ccccagaccccaaattttagga

SEQ ID NO: 1378483 - DNA, 22 bp, Artificial Sequence
  chemically synthesized
gccccagaccccaaattttagg

SEQ ID NO: 1378484 - DNA, 22 bp, Artificial Sequence
  chemically synthesized
atcattatcctaaaatttgggg

SEQ ID NO: 1378485 - DNA, 22 bp, Artificial Sequence
  chemically synthesized
atttgccccagaccccaaattt

SEQ ID NO: 1378486 - DNA, 22 bp, Artificial Sequence
  chemically synthesized
tcattatcctaaaatttggggt

SEQ ID NO: 1378487 - DNA, 22 bp, Artificial Sequence
  chemically synthesized
taatttgccccagaccccaaat

SEQ ID NO: 1378488 - DNA, 22 bp, Artificial Sequence
  chemically synthesized
tcctaaaatttggggtctgggg

SEQ ID NO: 1378489 - DNA, 22 bp, Artificial Sequence
  chemically synthesized
catatctctaatttgccccaga

SEQ ID NO: 1378490 - DNA, 22 bp, Artificial Sequence
  chemically synthesized
gcatatctctaatttgccccag

SEQ ID NO: 1378491 - DNA, 22 bp, Artificial Sequence
  chemically synthesized
aaatttggggtctggggcaaat

SEQ ID NO: 1378492 - DNA, 22 bp, Artificial Sequence
  chemically synthesized
tgcatatctctaatttgcccca

SEQ ID NO: 1378493 - DNA, 22 bp, Artificial Sequence
  chemically synthesized
ttgcatatctctaatttgcccc

SEQ ID NO: 1378494 - DNA, 22 bp, Artificial Sequence
  chemically synthesized
ggggtctggggcaaattagaga

SEQ ID NO: 1378495 - DNA, 22 bp, Artificial Sequence
  chemically synthesized
gggtctggggcaaattagagat

SEQ ID NO: 1378496 - DNA, 22 bp, Artificial Sequence
  chemically synthesized
accatttttgcatatctctaat

SEQ ID NO: 1378497 - DNA, 22 bp, Artificial Sequence
  chemically synthesized
ctaaccatttttgcatatctct

SEQ ID NO: 1378498 - DNA, 22 bp, Artificial Sequence
  chemically synthesized
gctaaccatttttgcatatctc

SEQ ID NO: 1378499 - DNA, 22 bp, Artificial Sequence
  chemically synthesized
gggcaaattagagatatgcaaa

SEQ ID NO: 1378500 - DNA, 22 bp, Artificial Sequence
  chemically synthesized
aaaaatttgctaaccatttttg

SEQ ID NO: 1378501 - DNA, 22 bp, Artificial Sequence
  chemically synthesized
gagatatgcaaaaatggttagc

SEQ ID NO: 1378502 - DNA, 22 bp, Artificial Sequence
  chemically synthesized
agacacattcaaaaatttgcta

SEQ ID NO: 1378503 - DNA, 22 bp, Artificial Sequence
  chemically synthesized
taagacacattcaaaaatttgc

SEQ ID NO: 1378504 - DNA, 22 bp, Artificial Sequence
  chemically synthesized
ctaagacacattcaaaaatttg

SEQ ID NO: 1378505 - DNA, 22 bp, Artificial Sequence
  chemically synthesized
tctaagacacattcaaaaattt

SEQ ID NO: 1378506 - DNA, 22 bp, Artificial Sequence
  chemically synthesized
ttctaagacacattcaaaaatt

SEQ ID NO: 1378507 - DNA, 22 bp, Artificial Sequence
  chemically synthesized
tttctaagacacattcaaaaat

SEQ ID NO: 1378508 - DNA, 22 bp, Artificial Sequence
  chemically synthesized
ttttctaagacacattcaaaaa

SEQ ID NO: 1378509 - DNA, 22 bp, Artificial Sequence
  chemically synthesized
tttttctaagacacattcaaaa

SEQ ID NO: 1378510 - DNA, 22 bp, Artificial Sequence
  chemically synthesized
gcaaatttttgaatgtgtctta

SEQ ID NO: 1378511 - DNA, 22 bp, Artificial Sequence
  chemically synthesized
ttgaatgtgtcttagaaaaaaa

SEQ ID NO: 1378512 - DNA, 22 bp, Artificial Sequence
  chemically synthesized
tgaatgtgtcttagaaaaaaaa

SEQ ID NO: 1378513 - DNA, 22 bp, Artificial Sequence
  chemically synthesized
gaatgtgtcttagaaaaaaaat

SEQ ID NO: 1378514 - DNA, 22 bp, Artificial Sequence
  chemically synthesized
aatgtgtcttagaaaaaaaatt

SEQ ID NO: 1378515 - DNA, 22 bp, Artificial Sequence
  chemically synthesized
aggtcgcaagtgaaaatttttt

SEQ ID NO: 1378516 - DNA, 22 bp, Artificial Sequence
  chemically synthesized
agaaaaaaaattttcacttgcg

SEQ ID NO: 1378517 - DNA, 22 bp, Artificial Sequence
  chemically synthesized
gaaaaaaaattttcacttgcga

SEQ ID NO: 1378518 - DNA, 22 bp, Artificial Sequence
  chemically synthesized
tcacttgcgaccttaggctttt

SEQ ID NO: 1378519 - DNA, 22 bp, Artificial Sequence
  chemically synthesized
cacttgcgaccttaggcttttc

SEQ ID NO: 1378520 - DNA, 22 bp, Artificial Sequence
  chemically synthesized
acttgcgaccttaggcttttcc

SEQ ID NO: 1378521 - DNA, 22 bp, Artificial Sequence
  chemically synthesized
tatcaaaatatagggggaaaag

SEQ ID NO: 1378522 - DNA, 22 bp, Artificial Sequence
  chemically synthesized
gcgaccttaggcttttccccct

SEQ ID NO: 1378523 - DNA, 22 bp, Artificial Sequence
  chemically synthesized
cgaccttaggcttttcccccta

SEQ ID NO: 1378524 - DNA, 22 bp, Artificial Sequence
  chemically synthesized
aggcttttccccctatattttg

SEQ ID NO: 1378525 - DNA, 22 bp, Artificial Sequence
  chemically synthesized
tgaagtctatatcaaaatatag

SEQ ID NO: 1378526 - DNA, 22 bp, Artificial Sequence
  chemically synthesized
ggcttttccccctatattttga

SEQ ID NO: 1378527 - DNA, 22 bp, Artificial Sequence
  chemically synthesized
tattgtgaagtctatatcaaaa

SEQ ID NO: 1378528 - DNA, 22 bp, Artificial Sequence
  chemically synthesized
ttccccctatattttgatatag

SEQ ID NO: 1378529 - DNA, 22 bp, Artificial Sequence
  chemically synthesized
tccccctatattttgatataga

SEQ ID NO: 1378530 - DNA, 22 bp, Artificial Sequence
  chemically synthesized
ccccctatattttgatatagac

SEQ ID NO: 1378531 - DNA, 22 bp, Artificial Sequence
  chemically synthesized
cccctatattttgatatagact

SEQ ID NO: 1378532 - DNA, 22 bp, Artificial Sequence
  chemically synthesized
taagaactatattgtgaagtct

SEQ ID NO: 1378533 - DNA, 22 bp, Artificial Sequence
  chemically synthesized
tattttgatatagacttcacaa

SEQ ID NO: 1378534 - DNA, 22 bp, Artificial Sequence
  chemically synthesized
ttataagaactatattgtgaag

SEQ ID NO: 1378535 - DNA, 22 bp, Artificial Sequence
  chemically synthesized
tgatatagacttcacaatatag

SEQ ID NO: 1378536 - DNA, 22 bp, Artificial Sequence
  chemically synthesized
gatatagacttcacaatatagt

SEQ ID NO: 1378537 - DNA, 22 bp, Artificial Sequence
  chemically synthesized
atatagacttcacaatatagtt

SEQ ID NO: 1378538 - DNA, 22 bp, Artificial Sequence
  chemically synthesized
cccactattataagaactatat

SEQ ID NO: 1378539 - DNA, 22 bp, Artificial Sequence
  chemically synthesized
tatctccccactattataagaa

SEQ ID NO: 1378540 - DNA, 22 bp, Artificial Sequence
  chemically synthesized
gtatctccccactattataaga

SEQ ID NO: 1378541 - DNA, 22 bp, Artificial Sequence
  chemically synthesized
cacaatatagttcttataatag

SEQ ID NO: 1378542 - DNA, 22 bp, Artificial Sequence
  chemically synthesized
tgtatctccccactattataag

SEQ ID NO: 1378543 - DNA, 22 bp, Artificial Sequence
  chemically synthesized
acaatatagttcttataatagt

SEQ ID NO: 1378544 - DNA, 22 bp, Artificial Sequence
  chemically synthesized
aaatgttttgtatctccccact

SEQ ID NO: 1378545 - DNA, 22 bp, Artificial Sequence
  chemically synthesized
caaatgttttgtatctccccac

SEQ ID NO: 1378546 - DNA, 22 bp, Artificial Sequence
  chemically synthesized
ttataatagtggggagatacaa

SEQ ID NO: 1378547 - DNA, 22 bp, Artificial Sequence
  chemically synthesized
atttcaaatgttttgtatctcc

SEQ ID NO: 1378548 - DNA, 22 bp, Artificial Sequence
  chemically synthesized
ataatagtggggagatacaaaa

SEQ ID NO: 1378549 - DNA, 22 bp, Artificial Sequence
  chemically synthesized
taatagtggggagatacaaaac

SEQ ID NO: 1378550 - DNA, 22 bp, Artificial Sequence
  chemically synthesized
aaattgatttcaaatgttttgt

SEQ ID NO: 1378551 - DNA, 22 bp, Artificial Sequence
  chemically synthesized
tcaattaaaattgatttcaaat

SEQ ID NO: 1378552 - DNA, 22 bp, Artificial Sequence
  chemically synthesized
aagttgtcaattaaaattgatt

SEQ ID NO: 1378553 - DNA, 22 bp, Artificial Sequence
  chemically synthesized
aaagttgtcaattaaaattgat

SEQ ID NO: 1378554 - DNA, 22 bp, Artificial Sequence
  chemically synthesized
gaaatcaattttaattgacaac

SEQ ID NO: 1378555 - DNA, 22 bp, Artificial Sequence
  chemically synthesized
aaatcaattttaattgacaact

SEQ ID NO: 1378556 - DNA, 22 bp, Artificial Sequence
  chemically synthesized
taattgacaactttaagattta

SEQ ID NO: 1378557 - DNA, 22 bp, Artificial Sequence
  chemically synthesized
aattgacaactttaagatttat

SEQ ID NO: 1378558 - DNA, 22 bp, Artificial Sequence
  chemically synthesized
attgacaactttaagatttatt

SEQ ID NO: 1378559 - DNA, 22 bp, Artificial Sequence
  chemically synthesized
acaactttaagatttattattt

SEQ ID NO: 1378560 - DNA, 22 bp, Artificial Sequence
  chemically synthesized
gaatcatcacatcaaataataa

SEQ ID NO: 1378561 - DNA, 22 bp, Artificial Sequence
  chemically synthesized
cgaatcatcacatcaaataata

SEQ ID NO: 1378562 - DNA, 22 bp, Artificial Sequence
  chemically synthesized
tcgaatcatcacatcaaataat

SEQ ID NO: 1378563 - DNA, 22 bp, Artificial Sequence
  chemically synthesized
tttcgaatcatcacatcaaata

SEQ ID NO: 1378564 - DNA, 22 bp, Artificial Sequence
  chemically synthesized
ctttcgaatcatcacatcaaat

SEQ ID NO: 1378565 - DNA, 22 bp, Artificial Sequence
  chemically synthesized
taagatttattatttgatgtga

SEQ ID NO: 1378566 - DNA, 22 bp, Artificial Sequence
  chemically synthesized
aagatttattatttgatgtgat

SEQ ID NO: 1378567 - DNA, 22 bp, Artificial Sequence
  chemically synthesized
agatttattatttgatgtgatg

SEQ ID NO: 1378568 - DNA, 22 bp, Artificial Sequence
  chemically synthesized
tttctttcgaatcatcacatca

SEQ ID NO: 1378569 - DNA, 22 bp, Artificial Sequence
  chemically synthesized
atttctttcgaatcatcacatc

SEQ ID NO: 1378570 - DNA, 22 bp, Artificial Sequence
  chemically synthesized
atttatttctttcgaatcatca

SEQ ID NO: 1378571 - DNA, 22 bp, Artificial Sequence
  chemically synthesized
attatttgatgtgatgattcga

SEQ ID NO: 1378572 - DNA, 22 bp, Artificial Sequence
  chemically synthesized
ttatttgatgtgatgattcgaa

SEQ ID NO: 1378573 - DNA, 22 bp, Artificial Sequence
  chemically synthesized
tgatttatttctttcgaatcat

SEQ ID NO: 1378574 - DNA, 22 bp, Artificial Sequence
  chemically synthesized
tctgatttatttctttcgaatc

SEQ ID NO: 1378575 - DNA, 22 bp, Artificial Sequence
  chemically synthesized
tttgatgtgatgattcgaaaga

SEQ ID NO: 1378576 - DNA, 22 bp, Artificial Sequence
  chemically synthesized
ctctgatttatttctttcgaat

SEQ ID NO: 1378577 - DNA, 22 bp, Artificial Sequence
  chemically synthesized
tctctgatttatttctttcgaa

SEQ ID NO: 1378578 - DNA, 22 bp, Artificial Sequence
  chemically synthesized
ttctctgatttatttctttcga

SEQ ID NO: 1378579 - DNA, 22 bp, Artificial Sequence
  chemically synthesized
gatgtgatgattcgaaagaaat

SEQ ID NO: 1378580 - DNA, 22 bp, Artificial Sequence
  chemically synthesized
tttctctgatttatttctttcg

SEQ ID NO: 1378581 - DNA, 22 bp, Artificial Sequence
  chemically synthesized
atgtgatgattcgaaagaaata

SEQ ID NO: 1378582 - DNA, 22 bp, Artificial Sequence
  chemically synthesized
ttttttctctgatttatttctt

SEQ ID NO: 1378583 - DNA, 22 bp, Artificial Sequence
  chemically synthesized
gcatgctgttttttctctgatt

SEQ ID NO: 1378584 - DNA, 22 bp, Artificial Sequence
  chemically synthesized
agcatgctgttttttctctgat

SEQ ID NO: 1378585 - DNA, 22 bp, Artificial Sequence
  chemically synthesized
gaaagaaataaatcagagaaaa

SEQ ID NO: 1378586 - DNA, 22 bp, Artificial Sequence
  chemically synthesized
tagcatgctgttttttctctga

SEQ ID NO: 1378587 - DNA, 22 bp, Artificial Sequence
  chemically synthesized
cattttagcatgctgttttttc

SEQ ID NO: 1378588 - DNA, 22 bp, Artificial Sequence
  chemically synthesized
acattttagcatgctgtttttt

SEQ ID NO: 1378589 - DNA, 22 bp, Artificial Sequence
  chemically synthesized
tataagatttacattttagcat

SEQ ID NO: 1378590 - DNA, 22 bp, Artificial Sequence
  chemically synthesized
ccaaagcaatcagtctgtataa

SEQ ID NO: 1378591 - DNA, 22 bp, Artificial Sequence
  chemically synthesized
aaatgtaaatcttatacagact

SEQ ID NO: 1378592 - DNA, 22 bp, Artificial Sequence
  chemically synthesized
accaaagcaatcagtctgtata

SEQ ID NO: 1378593 - DNA, 22 bp, Artificial Sequence
  chemically synthesized
tatatttaccaaagcaatcagt

SEQ ID NO: 1378594 - DNA, 22 bp, Artificial Sequence
  chemically synthesized
atatatttaccaaagcaatcag

SEQ ID NO: 1378595 - DNA, 22 bp, Artificial Sequence
  chemically synthesized
tatatatttaccaaagcaatca

SEQ ID NO: 1378596 - DNA, 22 bp, Artificial Sequence
  chemically synthesized
ttttatatatttaccaaagcaa

SEQ ID NO: 1378597 - DNA, 22 bp, Artificial Sequence
  chemically synthesized
atacagactgattgctttggta

SEQ ID NO: 1378598 - DNA, 22 bp, Artificial Sequence
  chemically synthesized
tacagactgattgctttggtaa

SEQ ID NO: 1378599 - DNA, 22 bp, Artificial Sequence
  chemically synthesized
ttattttatatatttaccaaag

SEQ ID NO: 1378600 - DNA, 22 bp, Artificial Sequence
  chemically synthesized
attattttatatatttaccaaa

SEQ ID NO: 1378601 - DNA, 22 bp, Artificial Sequence
  chemically synthesized
ttattattttatatatttacca

SEQ ID NO: 1378602 - DNA, 22 bp, Artificial Sequence
  chemically synthesized
attgctttggtaaatatataaa

SEQ ID NO: 1378603 - DNA, 22 bp, Artificial Sequence
  chemically synthesized
ataactcttattattttatata

SEQ ID NO: 1378604 - DNA, 22 bp, Artificial Sequence
  chemically synthesized
aataactcttattattttatat

SEQ ID NO: 1378605 - DNA, 22 bp, Artificial Sequence
  chemically synthesized
ctttggtaaatatataaaataa

SEQ ID NO: 1378606 - DNA, 22 bp, Artificial Sequence
  chemically synthesized
taataactcttattattttata

SEQ ID NO: 1378607 - DNA, 22 bp, Artificial Sequence
  chemically synthesized
tggtaaatatataaaataataa

SEQ ID NO: 1378608 - DNA, 22 bp, Artificial Sequence
  chemically synthesized
ggtaaatatataaaataataag

SEQ ID NO: 1378609 - DNA, 22 bp, Artificial Sequence
  chemically synthesized
gtaaatatataaaataataaga

SEQ ID NO: 1378610 - DNA, 22 bp, Artificial Sequence
  chemically synthesized
aacaagttttaataactcttat

SEQ ID NO: 1378611 - DNA, 22 bp, Artificial Sequence
  chemically synthesized
taaacaagttttaataactctt

SEQ ID NO: 1378612 - DNA, 22 bp, Artificial Sequence
  chemically synthesized
ctaaacaagttttaataactct

SEQ ID NO: 1378613 - DNA, 22 bp, Artificial Sequence
  chemically synthesized
tctaaacaagttttaataactc

SEQ ID NO: 1378614 - DNA, 22 bp, Artificial Sequence
  chemically synthesized
ttctaaacaagttttaataact

SEQ ID NO: 1378615 - DNA, 22 bp, Artificial Sequence
  chemically synthesized
ggtttttctaaacaagttttaa

SEQ ID NO: 1378616 - DNA, 22 bp, Artificial Sequence
  chemically synthesized
gggtttttctaaacaagtttta

SEQ ID NO: 1378617 - DNA, 22 bp, Artificial Sequence
  chemically synthesized
tgggtttttctaaacaagtttt

SEQ ID NO: 1378618 - DNA, 22 bp, Artificial Sequence
  chemically synthesized
tccaaattttgggtttttctaa

SEQ ID NO: 1378619 - DNA, 22 bp, Artificial Sequence
  chemically synthesized
ttaaaacttgtttagaaaaacc

SEQ ID NO: 1378620 - DNA, 22 bp, Artificial Sequence
  chemically synthesized
gtccaaattttgggtttttcta

SEQ ID NO: 1378621 - DNA, 22 bp, Artificial Sequence
  chemically synthesized
aaacttgtttagaaaaacccaa

SEQ ID NO: 1378622 - DNA, 22 bp, Artificial Sequence
  chemically synthesized
aatcttgtccaaattttgggtt

SEQ ID NO: 1378623 - DNA, 22 bp, Artificial Sequence
  chemically synthesized
gtttagaaaaacccaaaatttg

SEQ ID NO: 1378624 - DNA, 22 bp, Artificial Sequence
  chemically synthesized
ctcaatcttgtccaaattttgg

SEQ ID NO: 1378625 - DNA, 22 bp, Artificial Sequence
  chemically synthesized
tttagaaaaacccaaaatttgg

SEQ ID NO: 1378626 - DNA, 22 bp, Artificial Sequence
  chemically synthesized
ttcctcaatcttgtccaaattt

SEQ ID NO: 1378627 - DNA, 22 bp, Artificial Sequence
  chemically synthesized
agaaaaacccaaaatttggaca

SEQ ID NO: 1378628 - DNA, 22 bp, Artificial Sequence
  chemically synthesized
gttcctcaatcttgtccaaatt

SEQ ID NO: 1378629 - DNA, 22 bp, Artificial Sequence
  chemically synthesized
gaaaaacccaaaatttggacaa

SEQ ID NO: 1378630 - DNA, 22 bp, Artificial Sequence
  chemically synthesized
tgttcctcaatcttgtccaaat

SEQ ID NO: 1378631 - DNA, 22 bp, Artificial Sequence
  chemically synthesized
tccaaaaccacctttgttcctc

SEQ ID NO: 1378632 - DNA, 22 bp, Artificial Sequence
  chemically synthesized
atccaaaaccacctttgttcct

SEQ ID NO: 1378633 - DNA, 22 bp, Artificial Sequence
  chemically synthesized
ggacaagattgaggaacaaagg

SEQ ID NO: 1378634 - DNA, 22 bp, Artificial Sequence
  chemically synthesized
tatccaaaaccacctttgttcc

SEQ ID NO: 1378635 - DNA, 22 bp, Artificial Sequence
  chemically synthesized
gacaagattgaggaacaaaggt

SEQ ID NO: 1378636 - DNA, 22 bp, Artificial Sequence
  chemically synthesized
aggaacaaaggtggttttggat

SEQ ID NO: 1378637 - DNA, 22 bp, Artificial Sequence
  chemically synthesized
atgaaatcaaaacctttatcca

SEQ ID NO: 1378638 - DNA, 22 bp, Artificial Sequence
  chemically synthesized
actcatgaaatcaaaaccttta

SEQ ID NO: 1378639 - DNA, 22 bp, Artificial Sequence
  chemically synthesized
aactcatgaaatcaaaaccttt

SEQ ID NO: 1378640 - DNA, 22 bp, Artificial Sequence
  chemically synthesized
tggataaaggttttgatttcat

SEQ ID NO: 1378641 - DNA, 22 bp, Artificial Sequence
  chemically synthesized
ggataaaggttttgatttcatg

SEQ ID NO: 1378642 - DNA, 22 bp, Artificial Sequence
  chemically synthesized
gataaaggttttgatttcatga

SEQ ID NO: 1378643 - DNA, 22 bp, Artificial Sequence
  chemically synthesized
tgatttcatgagttaaattttt

SEQ ID NO: 1378644 - DNA, 22 bp, Artificial Sequence
  chemically synthesized
gatttcatgagttaaatttttt

SEQ ID NO: 1378645 - DNA, 22 bp, Artificial Sequence
  chemically synthesized
atttcatgagttaaattttttt

SEQ ID NO: 1378646 - DNA, 22 bp, Artificial Sequence
  chemically synthesized
caataagaagaaaaaaaaattt

SEQ ID NO: 1378647 - DNA, 22 bp, Artificial Sequence
  chemically synthesized
gcaataagaagaaaaaaaaatt

SEQ ID NO: 1378648 - DNA, 22 bp, Artificial Sequence
  chemically synthesized
tgcaataagaagaaaaaaaaat

SEQ ID NO: 1378649 - DNA, 22 bp, Artificial Sequence
  chemically synthesized
catgagttaaatttttttttct

SEQ ID NO: 1378650 - DNA, 22 bp, Artificial Sequence
  chemically synthesized
atgagttaaatttttttttctt

SEQ ID NO: 1378651 - DNA, 22 bp, Artificial Sequence
  chemically synthesized
aatttttttttcttcttattgc

SEQ ID NO: 1378652 - DNA, 22 bp, Artificial Sequence
  chemically synthesized
ttttttcttcttattgcaaaat

SEQ ID NO: 1378653 - DNA, 22 bp, Artificial Sequence
  chemically synthesized
tttttcttcttattgcaaaatg

SEQ ID NO: 1378654 - DNA, 22 bp, Artificial Sequence
  chemically synthesized
ttttcttcttattgcaaaatgt

SEQ ID NO: 1378655 - DNA, 22 bp, Artificial Sequence
  chemically synthesized
tttcttcttattgcaaaatgtg

SEQ ID NO: 1378656 - DNA, 22 bp, Artificial Sequence
  chemically synthesized
ttcttcttattgcaaaatgtga

SEQ ID NO: 1378657 - DNA, 22 bp, Artificial Sequence
  chemically synthesized
tcttcttattgcaaaatgtgat

SEQ ID NO: 1378658 - DNA, 22 bp, Artificial Sequence
  chemically synthesized
cttcttattgcaaaatgtgatg

SEQ ID NO: 1378659 - DNA, 22 bp, Artificial Sequence
  chemically synthesized
ttcttattgcaaaatgtgatgg

SEQ ID NO: 1378660 - DNA, 22 bp, Artificial Sequence
  chemically synthesized
cttattgcaaaatgtgatggtc

SEQ ID NO: 1378661 - DNA, 22 bp, Artificial Sequence
  chemically synthesized
ttattgcaaaatgtgatggtct

SEQ ID NO: 1378662 - DNA, 22 bp, Artificial Sequence
  chemically synthesized
attgcaaaatgtgatggtctat

SEQ ID NO: 1378663 - DNA, 22 bp, Artificial Sequence
  chemically synthesized
ttgcaaaatgtgatggtctatt

SEQ ID NO: 1378664 - DNA, 22 bp, Artificial Sequence
  chemically synthesized
caaaatgtgatggtctattcat

SEQ ID NO: 1378665 - DNA, 22 bp, Artificial Sequence
  chemically synthesized
tcatatgaaaatcatatgaata

SEQ ID NO: 1378666 - DNA, 22 bp, Artificial Sequence
  chemically synthesized
gtcatatgaaaatcatatgaat

SEQ ID NO: 1378667 - DNA, 22 bp, Artificial Sequence
  chemically synthesized
tgtcatatgaaaatcatatgaa

SEQ ID NO: 1378668 - DNA, 22 bp, Artificial Sequence
  chemically synthesized
ttgtcatatgaaaatcatatga

SEQ ID NO: 1378669 - DNA, 22 bp, Artificial Sequence
  chemically synthesized
aaggagcttttgtcatatgaaa

SEQ ID NO: 1378670 - DNA, 22 bp, Artificial Sequence
  chemically synthesized
ttcatatgattttcatatgaca

SEQ ID NO: 1378671 - DNA, 22 bp, Artificial Sequence
  chemically synthesized
ctaaaggagcttttgtcatatg

SEQ ID NO: 1378672 - DNA, 22 bp, Artificial Sequence
  chemically synthesized
atatgattttcatatgacaaaa

SEQ ID NO: 1378673 - DNA, 22 bp, Artificial Sequence
  chemically synthesized
ggttactaaaggagcttttgtc

SEQ ID NO: 1378674 - DNA, 22 bp, Artificial Sequence
  chemically synthesized
aggttactaaaggagcttttgt

SEQ ID NO: 1378675 - DNA, 22 bp, Artificial Sequence
  chemically synthesized
taggttactaaaggagcttttg

SEQ ID NO: 1378676 - DNA, 22 bp, Artificial Sequence
  chemically synthesized
ttaggttactaaaggagctttt

SEQ ID NO: 1378677 - DNA, 22 bp, Artificial Sequence
  chemically synthesized
tcatatgacaaaagctccttta

SEQ ID NO: 1378678 - DNA, 22 bp, Artificial Sequence
  chemically synthesized
catatgacaaaagctcctttag

SEQ ID NO: 1378679 - DNA, 22 bp, Artificial Sequence
  chemically synthesized
atatgacaaaagctcctttagt

SEQ ID NO: 1378680 - DNA, 22 bp, Artificial Sequence
  chemically synthesized
aaatatcttttaggttactaaa

SEQ ID NO: 1378681 - DNA, 22 bp, Artificial Sequence
  chemically synthesized
aaatcattcaaatatcttttag

SEQ ID NO: 1378682 - DNA, 22 bp, Artificial Sequence
  chemically synthesized
aaaatcattcaaatatctttta

SEQ ID NO: 1378683 - DNA, 22 bp, Artificial Sequence
  chemically synthesized
ctttagtaacctaaaagatatt

SEQ ID NO: 1378684 - DNA, 22 bp, Artificial Sequence
  chemically synthesized
ttaaaatcattcaaatatcttt

SEQ ID NO: 1378685 - DNA, 22 bp, Artificial Sequence
  chemically synthesized
cttaaaatcattcaaatatctt

SEQ ID NO: 1378686 - DNA, 22 bp, Artificial Sequence
  chemically synthesized
tagtaacctaaaagatatttga

SEQ ID NO: 1378687 - DNA, 22 bp, Artificial Sequence
  chemically synthesized
agtaacctaaaagatatttgaa

SEQ ID NO: 1378688 - DNA, 22 bp, Artificial Sequence
  chemically synthesized
gtaacctaaaagatatttgaat

SEQ ID NO: 1378689 - DNA, 22 bp, Artificial Sequence
  chemically synthesized
tttcttaaaatcattcaaatat

SEQ ID NO: 1378690 - DNA, 22 bp, Artificial Sequence
  chemically synthesized
aaagatatttgaatgattttaa

SEQ ID NO: 1378691 - DNA, 22 bp, Artificial Sequence
  chemically synthesized
tgtcaaactatttcttaaaatc

SEQ ID NO: 1378692 - DNA, 22 bp, Artificial Sequence
  chemically synthesized
atgtcaaactatttcttaaaat

SEQ ID NO: 1378693 - DNA, 22 bp, Artificial Sequence
  chemically synthesized
tatgtcaaactatttcttaaaa

SEQ ID NO: 1378694 - DNA, 22 bp, Artificial Sequence
  chemically synthesized
ttttatgtcaaactatttctta

SEQ ID NO: 1378695 - DNA, 22 bp, Artificial Sequence
  chemically synthesized
tattttatgtcaaactatttct

SEQ ID NO: 1378696 - DNA, 22 bp, Artificial Sequence
  chemically synthesized
gaatgattttaagaaatagttt

SEQ ID NO: 1378697 - DNA, 22 bp, Artificial Sequence
  chemically synthesized
aatgattttaagaaatagtttg

SEQ ID NO: 1378698 - DNA, 22 bp, Artificial Sequence
  chemically synthesized
taagaaatagtttgacataaaa

SEQ ID NO: 1378699 - DNA, 22 bp, Artificial Sequence
  chemically synthesized
aagaaatagtttgacataaaat

SEQ ID NO: 1378700 - DNA, 22 bp, Artificial Sequence
  chemically synthesized
agaaatagtttgacataaaata

SEQ ID NO: 1378701 - DNA, 22 bp, Artificial Sequence
  chemically synthesized
cacacgtgaggtgttctatttt

SEQ ID NO: 1378702 - DNA, 22 bp, Artificial Sequence
  chemically synthesized
gacataaaatagaacacctcac

SEQ ID NO: 1378703 - DNA, 22 bp, Artificial Sequence
  chemically synthesized
acataaaatagaacacctcacg

SEQ ID NO: 1378704 - DNA, 22 bp, Artificial Sequence
  chemically synthesized
acgtgtgcaattacaccatttt

SEQ ID NO: 1378705 - DNA, 22 bp, Artificial Sequence
  chemically synthesized
caccattttattttcttatata

SEQ ID NO: 1378706 - DNA, 22 bp, Artificial Sequence
  chemically synthesized
tattttcttatatattatcctt

SEQ ID NO: 1378707 - DNA, 22 bp, Artificial Sequence
  chemically synthesized
attttcttatatattatccttc

SEQ ID NO: 1378708 - DNA, 22 bp, Artificial Sequence
  chemically synthesized
ttttcttatatattatccttct

SEQ ID NO: 1378709 - DNA, 22 bp, Artificial Sequence
  chemically synthesized
tcttatatattatccttcttta

SEQ ID NO: 1378710 - DNA, 22 bp, Artificial Sequence
  chemically synthesized
cttatatattatccttctttat

SEQ ID NO: 1378711 - DNA, 22 bp, Artificial Sequence
  chemically synthesized
ttatatattatccttctttata

SEQ ID NO: 1378712 - DNA, 22 bp, Artificial Sequence
  chemically synthesized
atatattatccttctttatatt

SEQ ID NO: 1378713 - DNA, 22 bp, Artificial Sequence
  chemically synthesized
tatattatccttctttatattt

SEQ ID NO: 1378714 - DNA, 22 bp, Artificial Sequence
  chemically synthesized
taaaataatgcacaaatataaa

SEQ ID NO: 1378715 - DNA, 22 bp, Artificial Sequence
  chemically synthesized
tccttctttatatttgtgcatt

SEQ ID NO: 1378716 - DNA, 22 bp, Artificial Sequence
  chemically synthesized
cacattataaaataatgcacaa

SEQ ID NO: 1378717 - DNA, 22 bp, Artificial Sequence
  chemically synthesized
tccacattataaaataatgcac

SEQ ID NO: 1378718 - DNA, 22 bp, Artificial Sequence
  chemically synthesized
ctttatatttgtgcattatttt

SEQ ID NO: 1378719 - DNA, 22 bp, Artificial Sequence
  chemically synthesized
tttatatttgtgcattatttta

SEQ ID NO: 1378720 - DNA, 22 bp, Artificial Sequence
  chemically synthesized
tatatttgtgcattattttata

SEQ ID NO: 1378721 - DNA, 22 bp, Artificial Sequence
  chemically synthesized
atatttgtgcattattttataa

SEQ ID NO: 1378722 - DNA, 22 bp, Artificial Sequence
  chemically synthesized
tatttgtgcattattttataat

SEQ ID NO: 1378723 - DNA, 22 bp, Artificial Sequence
  chemically synthesized
gtgcattattttataatgtgga

SEQ ID NO: 1378724 - DNA, 22 bp, Artificial Sequence
  chemically synthesized
tgcattattttataatgtggag

SEQ ID NO: 1378725 - DNA, 22 bp, Artificial Sequence
  chemically synthesized
aaaagtaatataacctctccac

SEQ ID NO: 1378726 - DNA, 22 bp, Artificial Sequence
  chemically synthesized
ttttataatgtggagaggttat

SEQ ID NO: 1378727 - DNA, 22 bp, Artificial Sequence
  chemically synthesized
tataatgtggagaggttatatt

SEQ ID NO: 1378728 - DNA, 22 bp, Artificial Sequence
  chemically synthesized
ataatgtggagaggttatatta

SEQ ID NO: 1378729 - DNA, 22 bp, Artificial Sequence
  chemically synthesized
taatgtggagaggttatattac

SEQ ID NO: 1378730 - DNA, 22 bp, Artificial Sequence
  chemically synthesized
tattacttttgaatatctatta

SEQ ID NO: 1378731 - DNA, 22 bp, Artificial Sequence
  chemically synthesized
tgtgtaaacatataatagatat

SEQ ID NO: 1378732 - DNA, 22 bp, Artificial Sequence
  chemically synthesized
atgtgtaaacatataatagata

SEQ ID NO: 1378733 - DNA, 22 bp, Artificial Sequence
  chemically synthesized
cttttgaatatctattatatgt

SEQ ID NO: 1378734 - DNA, 22 bp, Artificial Sequence
  chemically synthesized
tgtttatgtgtaaacatataat

SEQ ID NO: 1378735 - DNA, 22 bp, Artificial Sequence
  chemically synthesized
ttgaatatctattatatgttta

SEQ ID NO: 1378736 - DNA, 22 bp, Artificial Sequence
  chemically synthesized
tgtgtttatgtgtaaacatata

SEQ ID NO: 1378737 - DNA, 22 bp, Artificial Sequence
  chemically synthesized
tgaatatctattatatgtttac

SEQ ID NO: 1378738 - DNA, 22 bp, Artificial Sequence
  chemically synthesized
gaatatctattatatgtttaca

SEQ ID NO: 1378739 - DNA, 22 bp, Artificial Sequence
  chemically synthesized
tctgtgtttatgtgtaaacata

SEQ ID NO: 1378740 - DNA, 22 bp, Artificial Sequence
  chemically synthesized
aatatctattatatgtttacac

SEQ ID NO: 1378741 - DNA, 22 bp, Artificial Sequence
  chemically synthesized
tgcattctctgtgtttatgtgt

SEQ ID NO: 1378742 - DNA, 22 bp, Artificial Sequence
  chemically synthesized
ttatatgtttacacataaacac

SEQ ID NO: 1378743 - DNA, 22 bp, Artificial Sequence
  chemically synthesized
ctgtgcattctctgtgtttatg

SEQ ID NO: 1378744 - DNA, 22 bp, Artificial Sequence
  chemically synthesized
actgtgcattctctgtgtttat

SEQ ID NO: 1378745 - DNA, 22 bp, Artificial Sequence
  chemically synthesized
tatgtttacacataaacacaga

SEQ ID NO: 1378746 - DNA, 22 bp, Artificial Sequence
  chemically synthesized
acacataaacacagagaatgca

SEQ ID NO: 1378747 - DNA, 22 bp, Artificial Sequence
  chemically synthesized
cacataaacacagagaatgcac

SEQ ID NO: 1378748 - DNA, 22 bp, Artificial Sequence
  chemically synthesized
aatagagtgccatagatatcac

SEQ ID NO: 1378749 - DNA, 22 bp, Artificial Sequence
  chemically synthesized
caatagagtgccatagatatca

SEQ ID NO: 1378750 - DNA, 22 bp, Artificial Sequence
  chemically synthesized
tcaatagagtgccatagatatc

SEQ ID NO: 1378751 - DNA, 22 bp, Artificial Sequence
  chemically synthesized
ctttcaatagagtgccatagat

SEQ ID NO: 1378752 - DNA, 22 bp, Artificial Sequence
  chemically synthesized
actttcaatagagtgccataga

SEQ ID NO: 1378753 - DNA, 22 bp, Artificial Sequence
  chemically synthesized
caccaagaatttactttcaata

SEQ ID NO: 1378754 - DNA, 22 bp, Artificial Sequence
  chemically synthesized
tggcactctattgaaagtaaat

SEQ ID NO: 1378755 - DNA, 22 bp, Artificial Sequence
  chemically synthesized
tattgaaagtaaattcttggtg

SEQ ID NO: 1378756 - DNA, 22 bp, Artificial Sequence
  chemically synthesized
ttgaaagtaaattcttggtgta

SEQ ID NO: 1378757 - DNA, 22 bp, Artificial Sequence
  chemically synthesized
atgatcaagagtgttacaccaa

SEQ ID NO: 1378758 - DNA, 22 bp, Artificial Sequence
  chemically synthesized
aaagtaaattcttggtgtaaca

SEQ ID NO: 1378759 - DNA, 22 bp, Artificial Sequence
  chemically synthesized
ttcatgatcaagagtgttacac

SEQ ID NO: 1378760 - DNA, 22 bp, Artificial Sequence
  chemically synthesized
ttggtgtaacactcttgatcat

SEQ ID NO: 1378761 - DNA, 22 bp, Artificial Sequence
  chemically synthesized
ggtgtaacactcttgatcatga

SEQ ID NO: 1378762 - DNA, 22 bp, Artificial Sequence
  chemically synthesized
gtaaatatctgttcatgatcaa

SEQ ID NO: 1378763 - DNA, 22 bp, Artificial Sequence
  chemically synthesized
gtgtaacactcttgatcatgaa

SEQ ID NO: 1378764 - DNA, 22 bp, Artificial Sequence
  chemically synthesized
atagttggtaaatatctgttca

SEQ ID NO: 1378765 - DNA, 22 bp, Artificial Sequence
  chemically synthesized
gatagttggtaaatatctgttc

SEQ ID NO: 1378766 - DNA, 22 bp, Artificial Sequence
  chemically synthesized
ttgatagttggtaaatatctgt

SEQ ID NO: 1378767 - DNA, 22 bp, Artificial Sequence
  chemically synthesized
cttgatagttggtaaatatctg

SEQ ID NO: 1378768 - DNA, 22 bp, Artificial Sequence
  chemically synthesized
ttgatcatgaacagatatttac

SEQ ID NO: 1378769 - DNA, 22 bp, Artificial Sequence
  chemically synthesized
tcttgatagttggtaaatatct

SEQ ID NO: 1378770 - DNA, 22 bp, Artificial Sequence
  chemically synthesized
ttcttgatagttggtaaatatc

SEQ ID NO: 1378771 - DNA, 22 bp, Artificial Sequence
  chemically synthesized
gatcatgaacagatatttacca

SEQ ID NO: 1378772 - DNA, 22 bp, Artificial Sequence
  chemically synthesized
atcatgaacagatatttaccaa

SEQ ID NO: 1378773 - DNA, 22 bp, Artificial Sequence
  chemically synthesized
agtttttcttgatagttggtaa

SEQ ID NO: 1378774 - DNA, 22 bp, Artificial Sequence
  chemically synthesized
aagtttttcttgatagttggta

SEQ ID NO: 1378775 - DNA, 22 bp, Artificial Sequence
  chemically synthesized
aatgtcttaagtttttcttgat

SEQ ID NO: 1378776 - DNA, 22 bp, Artificial Sequence
  chemically synthesized
ctcaatgtcttaagtttttctt

SEQ ID NO: 1378777 - DNA, 22 bp, Artificial Sequence
  chemically synthesized
gctcaatgtcttaagtttttct

SEQ ID NO: 1378778 - DNA, 22 bp, Artificial Sequence
  chemically synthesized
accaactatcaagaaaaactta

SEQ ID NO: 1378779 - DNA, 22 bp, Artificial Sequence
  chemically synthesized
ccaactatcaagaaaaacttaa

SEQ ID NO: 1378780 - DNA, 22 bp, Artificial Sequence
  chemically synthesized
tcaagaaaaacttaagacattg

SEQ ID NO: 1378781 - DNA, 22 bp, Artificial Sequence
  chemically synthesized
atgacatttgctcaatgtctta

SEQ ID NO: 1378782 - DNA, 22 bp, Artificial Sequence
  chemically synthesized
actaatgacatttgctcaatgt

SEQ ID NO: 1378783 - DNA, 22 bp, Artificial Sequence
  chemically synthesized
aactaatgacatttgctcaatg

SEQ ID NO: 1378784 - DNA, 22 bp, Artificial Sequence
  chemically synthesized
aagacattgagcaaatgtcatt

SEQ ID NO: 1378785 - DNA, 22 bp, Artificial Sequence
  chemically synthesized
aatgacttaactaatgacattt

SEQ ID NO: 1378786 - DNA, 22 bp, Artificial Sequence
  chemically synthesized
agacattgagcaaatgtcatta

SEQ ID NO: 1378787 - DNA, 22 bp, Artificial Sequence
  chemically synthesized
gaatgacttaactaatgacatt

SEQ ID NO: 1378788 - DNA, 22 bp, Artificial Sequence
  chemically synthesized
agcaaatgtcattagttaagtc

SEQ ID NO: 1378789 - DNA, 22 bp, Artificial Sequence
  chemically synthesized
aatatgaggtgatttgaatgac

SEQ ID NO: 1378790 - DNA, 22 bp, Artificial Sequence
  chemically synthesized
ttaaatatgaggtgatttgaat

SEQ ID NO: 1378791 - DNA, 22 bp, Artificial Sequence
  chemically synthesized
gttaaatatgaggtgatttgaa

SEQ ID NO: 1378792 - DNA, 22 bp, Artificial Sequence
  chemically synthesized
gttaagtcattcaaatcacctc

SEQ ID NO: 1378793 - DNA, 22 bp, Artificial Sequence
  chemically synthesized
gatttgttaaatatgaggtgat

SEQ ID NO: 1378794 - DNA, 22 bp, Artificial Sequence
  chemically synthesized
agatttgttaaatatgaggtga

SEQ ID NO: 1378795 - DNA, 22 bp, Artificial Sequence
  chemically synthesized
agtcattcaaatcacctcatat

SEQ ID NO: 1378796 - DNA, 22 bp, Artificial Sequence
  chemically synthesized
cacttagatttgttaaatatga

SEQ ID NO: 1378797 - DNA, 22 bp, Artificial Sequence
  chemically synthesized
ccacttagatttgttaaatatg

SEQ ID NO: 1378798 - DNA, 22 bp, Artificial Sequence
  chemically synthesized
aaatcacctcatatttaacaaa

SEQ ID NO: 1378799 - DNA, 22 bp, Artificial Sequence
  chemically synthesized
gacttccacttagatttgttaa

SEQ ID NO: 1378800 - DNA, 22 bp, Artificial Sequence
  chemically synthesized
ggacttccacttagatttgtta

SEQ ID NO: 1378801 - DNA, 22 bp, Artificial Sequence
  chemically synthesized
cccttggacttccacttagatt

SEQ ID NO: 1378802 - DNA, 22 bp, Artificial Sequence
  chemically synthesized
atatttaacaaatctaagtgga

SEQ ID NO: 1378803 - DNA, 22 bp, Artificial Sequence
  chemically synthesized
gaattccccttggacttccact

SEQ ID NO: 1378804 - DNA, 22 bp, Artificial Sequence
  chemically synthesized
ggaattccccttggacttccac

SEQ ID NO: 1378805 - DNA, 22 bp, Artificial Sequence
  chemically synthesized
aacaaatctaagtggaagtcca

SEQ ID NO: 1378806 - DNA, 22 bp, Artificial Sequence
  chemically synthesized
acaaatctaagtggaagtccaa

SEQ ID NO: 1378807 - DNA, 22 bp, Artificial Sequence
  chemically synthesized
tttggaattccccttggacttc

SEQ ID NO: 1378808 - DNA, 22 bp, Artificial Sequence
  chemically synthesized
atttggaattccccttggactt

SEQ ID NO: 1378809 - DNA, 22 bp, Artificial Sequence
  chemically synthesized
agtggaagtccaaggggaattc

SEQ ID NO: 1378810 - DNA, 22 bp, Artificial Sequence
  chemically synthesized
agtataacagtgatgtttattt

SEQ ID NO: 1378811 - DNA, 22 bp, Artificial Sequence
  chemically synthesized
cattcagtataacagtgatgtt

SEQ ID NO: 1378812 - DNA, 22 bp, Artificial Sequence
  chemically synthesized
actacattcagtataacagtga

SEQ ID NO: 1378813 - DNA, 22 bp, Artificial Sequence
  chemically synthesized
caaataaacatcactgttatac

SEQ ID NO: 1378814 - DNA, 22 bp, Artificial Sequence
  chemically synthesized
ttgactacattcagtataacag

SEQ ID NO: 1378815 - DNA, 22 bp, Artificial Sequence
  chemically synthesized
tattgactacattcagtataac

SEQ ID NO: 1378816 - DNA, 22 bp, Artificial Sequence
  chemically synthesized
tctattgactacattcagtata

SEQ ID NO: 1378817 - DNA, 22 bp, Artificial Sequence
  chemically synthesized
ttatactgaatgtagtcaatag

SEQ ID NO: 1378818 - DNA, 22 bp, Artificial Sequence
  chemically synthesized
tactgaatgtagtcaatagaga

SEQ ID NO: 1378819 - DNA, 22 bp, Artificial Sequence
  chemically synthesized
caatgatataataattctctat

SEQ ID NO: 1378820 - DNA, 22 bp, Artificial Sequence
  chemically synthesized
aatgtagtcaatagagaattat

SEQ ID NO: 1378821 - DNA, 22 bp, Artificial Sequence
  chemically synthesized
actccaatgatataataattct

SEQ ID NO: 1378822 - DNA, 22 bp, Artificial Sequence
  chemically synthesized
aactccaatgatataataattc

SEQ ID NO: 1378823 - DNA, 22 bp, Artificial Sequence
  chemically synthesized
atttaactccaatgatataata

SEQ ID NO: 1378824 - DNA, 22 bp, Artificial Sequence
  chemically synthesized
ttatatcattggagttaaatga

SEQ ID NO: 1378825 - DNA, 22 bp, Artificial Sequence
  chemically synthesized
tatcattggagttaaatgaaca

SEQ ID NO: 1378826 - DNA, 22 bp, Artificial Sequence
  chemically synthesized
gaaatgtaatggatgtgttcat

SEQ ID NO: 1378827 - DNA, 22 bp, Artificial Sequence
  chemically synthesized
agaaatgtaatggatgtgttca

SEQ ID NO: 1378828 - DNA, 22 bp, Artificial Sequence
  chemically synthesized
tttagaaatgtaatggatgtgt

SEQ ID NO: 1378829 - DNA, 22 bp, Artificial Sequence
  chemically synthesized
gagttaaatgaacacatccatt

SEQ ID NO: 1378830 - DNA, 22 bp, Artificial Sequence
  chemically synthesized
atttagaaatgtaatggatgtg

SEQ ID NO: 1378831 - DNA, 22 bp, Artificial Sequence
  chemically synthesized
aatgaacacatccattacattt

SEQ ID NO: 1378832 - DNA, 22 bp, Artificial Sequence
  chemically synthesized
ccacatttatttagaaatgtaa

SEQ ID NO: 1378833 - DNA, 22 bp, Artificial Sequence
  chemically synthesized
cccacatttatttagaaatgta

SEQ ID NO: 1378834 - DNA, 22 bp, Artificial Sequence
  chemically synthesized
catttctaaataaatgtgggaa

SEQ ID NO: 1378835 - DNA, 22 bp, Artificial Sequence
  chemically synthesized
ggataaaaagcacttcccacat

SEQ ID NO: 1378836 - DNA, 22 bp, Artificial Sequence
  chemically synthesized
ctaaataaatgtgggaagtgct

SEQ ID NO: 1378837 - DNA, 22 bp, Artificial Sequence
  chemically synthesized
taaataaatgtgggaagtgctt

SEQ ID NO: 1378838 - DNA, 22 bp, Artificial Sequence
  chemically synthesized
cgtctgggataaaaagcacttc

SEQ ID NO: 1378839 - DNA, 22 bp, Artificial Sequence
  chemically synthesized
aataaatgtgggaagtgctttt

SEQ ID NO: 1378840 - DNA, 22 bp, Artificial Sequence
  chemically synthesized
ttccgtctgggataaaaagcac

SEQ ID NO: 1378841 - DNA, 22 bp, Artificial Sequence
  chemically synthesized
ttattccgtctgggataaaaag

SEQ ID NO: 1378842 - DNA, 22 bp, Artificial Sequence
  chemically synthesized
gcattgttattccgtctgggat

SEQ ID NO: 1378843 - DNA, 22 bp, Artificial Sequence
  chemically synthesized
agcattgttattccgtctggga

SEQ ID NO: 1378844 - DNA, 22 bp, Artificial Sequence
  chemically synthesized
tagcattgttattccgtctggg

SEQ ID NO: 1378845 - DNA, 22 bp, Artificial Sequence
  chemically synthesized
ctttagcattgttattccgtct

SEQ ID NO: 1378846 - DNA, 22 bp, Artificial Sequence
  chemically synthesized
tttatcccagacggaataacaa

SEQ ID NO: 1378847 - DNA, 22 bp, Artificial Sequence
  chemically synthesized
ttatcccagacggaataacaat

SEQ ID NO: 1378848 - DNA, 22 bp, Artificial Sequence
  chemically synthesized
tatcccagacggaataacaatg

SEQ ID NO: 1378849 - DNA, 22 bp, Artificial Sequence
  chemically synthesized
atcccagacggaataacaatgc

SEQ ID NO: 1378850 - DNA, 22 bp, Artificial Sequence
  chemically synthesized
tcccagacggaataacaatgct

SEQ ID NO: 1378851 - DNA, 22 bp, Artificial Sequence
  chemically synthesized
taaaatacggatgacaatctcc

SEQ ID NO: 1378852 - DNA, 22 bp, Artificial Sequence
  chemically synthesized
ctataaaatacggatgacaatc

SEQ ID NO: 1378853 - DNA, 22 bp, Artificial Sequence
  chemically synthesized
cctataaaatacggatgacaat

SEQ ID NO: 1378854 - DNA, 22 bp, Artificial Sequence
  chemically synthesized
tcctataaaatacggatgacaa

SEQ ID NO: 1378855 - DNA, 22 bp, Artificial Sequence
  chemically synthesized
aaggagattgtcatccgtattt

SEQ ID NO: 1378856 - DNA, 22 bp, Artificial Sequence
  chemically synthesized
gagtacctttcctataaaatac

SEQ ID NO: 1378857 - DNA, 22 bp, Artificial Sequence
  chemically synthesized
tggagtacctttcctataaaat

SEQ ID NO: 1378858 - DNA, 22 bp, Artificial Sequence
  chemically synthesized
ctggagtacctttcctataaaa

SEQ ID NO: 1378859 - DNA, 22 bp, Artificial Sequence
  chemically synthesized
tcatccgtattttataggaaag

SEQ ID NO: 1378860 - DNA, 22 bp, Artificial Sequence
  chemically synthesized
tataggaaaggtactccagaaa

SEQ ID NO: 1378861 - DNA, 22 bp, Artificial Sequence
  chemically synthesized
gcaacataaacatttctggagt

SEQ ID NO: 1378862 - DNA, 22 bp, Artificial Sequence
  chemically synthesized
ataggaaaggtactccagaaat

SEQ ID NO: 1378863 - DNA, 22 bp, Artificial Sequence
  chemically synthesized
taggaaaggtactccagaaatg

SEQ ID NO: 1378864 - DNA, 22 bp, Artificial Sequence
  chemically synthesized
ttagcaacataaacatttctgg

SEQ ID NO: 1378865 - DNA, 22 bp, Artificial Sequence
  chemically synthesized
attgttagcaacataaacattt

SEQ ID NO: 1378866 - DNA, 22 bp, Artificial Sequence
  chemically synthesized
gattgttagcaacataaacatt

SEQ ID NO: 1378867 - DNA, 22 bp, Artificial Sequence
  chemically synthesized
cagaaatgtttatgttgctaac

SEQ ID NO: 1378868 - DNA, 22 bp, Artificial Sequence
  chemically synthesized
gtaaatttgattgttagcaaca

SEQ ID NO: 1378869 - DNA, 22 bp, Artificial Sequence
  chemically synthesized
atattagtaaatttgattgtta

SEQ ID NO: 1378870 - DNA, 22 bp, Artificial Sequence
  chemically synthesized
actaatattagtaaatttgatt

SEQ ID NO: 1378871 - DNA, 22 bp, Artificial Sequence
  chemically synthesized
atgttgctaacaatcaaattta

SEQ ID NO: 1378872 - DNA, 22 bp, Artificial Sequence
  chemically synthesized
gactaatattagtaaatttgat

SEQ ID NO: 1378873 - DNA, 22 bp, Artificial Sequence
  chemically synthesized
tgttgctaacaatcaaatttac

SEQ ID NO: 1378874 - DNA, 22 bp, Artificial Sequence
  chemically synthesized
ctaacaatcaaatttactaata

SEQ ID NO: 1378875 - DNA, 22 bp, Artificial Sequence
  chemically synthesized
acaatcaaatttactaatatta

SEQ ID NO: 1378876 - DNA, 22 bp, Artificial Sequence
  chemically synthesized
tatggtcaagtttgactaatat

SEQ ID NO: 1378877 - DNA, 22 bp, Artificial Sequence
  chemically synthesized
atatggtcaagtttgactaata

SEQ ID NO: 1378878 - DNA, 22 bp, Artificial Sequence
  chemically synthesized
actaatattagtcaaacttgac

SEQ ID NO: 1378879 - DNA, 22 bp, Artificial Sequence
  chemically synthesized
ctaatattagtcaaacttgacc

SEQ ID NO: 1378880 - DNA, 22 bp, Artificial Sequence
  chemically synthesized
atattagtcaaacttgaccata

SEQ ID NO: 1378881 - DNA, 22 bp, Artificial Sequence
  chemically synthesized
tataaatccgatttatatggtc

SEQ ID NO: 1378882 - DNA, 22 bp, Artificial Sequence
  chemically synthesized
gtcaaacttgaccatataaatc

SEQ ID NO: 1378883 - DNA, 22 bp, Artificial Sequence
  chemically synthesized
gaccatataaatcggatttata

SEQ ID NO: 1378884 - DNA, 22 bp, Artificial Sequence
  chemically synthesized
agatatggattatataaatccg

SEQ ID NO: 1378885 - DNA, 22 bp, Artificial Sequence
  chemically synthesized
accatataaatcggatttatat

SEQ ID NO: 1378886 - DNA, 22 bp, Artificial Sequence
  chemically synthesized
aagatatggattatataaatcc

SEQ ID NO: 1378887 - DNA, 22 bp, Artificial Sequence
  chemically synthesized
taagatatggattatataaatc

SEQ ID NO: 1378888 - DNA, 22 bp, Artificial Sequence
  chemically synthesized
gaattttaagatatggattata

SEQ ID NO: 1378889 - DNA, 22 bp, Artificial Sequence
  chemically synthesized
agaagttagaattttaagatat

SEQ ID NO: 1378890 - DNA, 22 bp, Artificial Sequence
  chemically synthesized
atataatccatatcttaaaatt

SEQ ID NO: 1378891 - DNA, 22 bp, Artificial Sequence
  chemically synthesized
ttaagaagttagaattttaaga

SEQ ID NO: 1378892 - DNA, 22 bp, Artificial Sequence
  chemically synthesized
tataatccatatcttaaaattc

SEQ ID NO: 1378893 - DNA, 22 bp, Artificial Sequence
  chemically synthesized
gttaagaagttagaattttaag

SEQ ID NO: 1378894 - DNA, 22 bp, Artificial Sequence
  chemically synthesized
aaaattctaacttcttaacaaa

SEQ ID NO: 1378895 - DNA, 22 bp, Artificial Sequence
  chemically synthesized
aaattctaacttcttaacaaat

SEQ ID NO: 1378896 - DNA, 22 bp, Artificial Sequence
  chemically synthesized
aaataatcaagtggtatttgtt

SEQ ID NO: 1378897 - DNA, 22 bp, Artificial Sequence
  chemically synthesized
aaaataatcaagtggtatttgt

SEQ ID NO: 1378898 - DNA, 22 bp, Artificial Sequence
  chemically synthesized
taaaataatcaagtggtatttg

SEQ ID NO: 1378899 - DNA, 22 bp, Artificial Sequence
  chemically synthesized
taacttcttaacaaataccact

SEQ ID NO: 1378900 - DNA, 22 bp, Artificial Sequence
  chemically synthesized
acttcttaacaaataccacttg

SEQ ID NO: 1378901 - DNA, 22 bp, Artificial Sequence
  chemically synthesized
tggttttaaaataatcaagtgg

SEQ ID NO: 1378902 - DNA, 22 bp, Artificial Sequence
  chemically synthesized
cttaacaaataccacttgatta

SEQ ID NO: 1378903 - DNA, 22 bp, Artificial Sequence
  chemically synthesized
ttaacaaataccacttgattat

SEQ ID NO: 1378904 - DNA, 22 bp, Artificial Sequence
  chemically synthesized
aacaaataccacttgattattt

SEQ ID NO: 1378905 - DNA, 22 bp, Artificial Sequence
  chemically synthesized
acaaataccacttgattatttt

SEQ ID NO: 1378906 - DNA, 22 bp, Artificial Sequence
  chemically synthesized
atctatggttttaaaataatca

SEQ ID NO: 1378907 - DNA, 22 bp, Artificial Sequence
  chemically synthesized
catctatggttttaaaataatc

SEQ ID NO: 1378908 - DNA, 22 bp, Artificial Sequence
  chemically synthesized
tcatctatggttttaaaataat

SEQ ID NO: 1378909 - DNA, 22 bp, Artificial Sequence
  chemically synthesized
ttcatctatggttttaaaataa

SEQ ID NO: 1378910 - DNA, 22 bp, Artificial Sequence
  chemically synthesized
ttttcatctatggttttaaaat

SEQ ID NO: 1378911 - DNA, 22 bp, Artificial Sequence
  chemically synthesized
agtgttcttttcatctatggtt

SEQ ID NO: 1378912 - DNA, 22 bp, Artificial Sequence
  chemically synthesized
gattattttaaaaccatagatg

SEQ ID NO: 1378913 - DNA, 22 bp, Artificial Sequence
  chemically synthesized
attattttaaaaccatagatga

SEQ ID NO: 1378914 - DNA, 22 bp, Artificial Sequence
  chemically synthesized
tcagtgttcttttcatctatgg

SEQ ID NO: 1378915 - DNA, 22 bp, Artificial Sequence
  chemically synthesized
ttttaaaaccatagatgaaaag

SEQ ID NO: 1378916 - DNA, 22 bp, Artificial Sequence
  chemically synthesized
cctctcagtgttcttttcatct

SEQ ID NO: 1378917 - DNA, 22 bp, Artificial Sequence
  chemically synthesized
taaaaccatagatgaaaagaac

SEQ ID NO: 1378918 - DNA, 22 bp, Artificial Sequence
  chemically synthesized
aaaaccatagatgaaaagaaca

SEQ ID NO: 1378919 - DNA, 22 bp, Artificial Sequence
  chemically synthesized
aaaccatagatgaaaagaacac

SEQ ID NO: 1378920 - DNA, 22 bp, Artificial Sequence
  chemically synthesized
aacctccctctcagtgttcttt

SEQ ID NO: 1378921 - DNA, 22 bp, Artificial Sequence
  chemically synthesized
taaacctccctctcagtgttct

SEQ ID NO: 1378922 - DNA, 22 bp, Artificial Sequence
  chemically synthesized
ctaaacctccctctcagtgttc

SEQ ID NO: 1378923 - DNA, 22 bp, Artificial Sequence
  chemically synthesized
cttctaaacctccctctcagtg

SEQ ID NO: 1378924 - DNA, 22 bp, Artificial Sequence
  chemically synthesized
agagggaggtttagaagcagga

SEQ ID NO: 1378925 - DNA, 22 bp, Artificial Sequence
  chemically synthesized
aagcatcaaaatcatacatata

SEQ ID NO: 1378926 - DNA, 22 bp, Artificial Sequence
  chemically synthesized
agaagcaggatatatgtatgat

SEQ ID NO: 1378927 - DNA, 22 bp, Artificial Sequence
  chemically synthesized
gaagcaggatatatgtatgatt

SEQ ID NO: 1378928 - DNA, 22 bp, Artificial Sequence
  chemically synthesized
ttgaagcatcaaaatcatacat

SEQ ID NO: 1378929 - DNA, 22 bp, Artificial Sequence
  chemically synthesized
cagttattgaagcatcaaaatc

SEQ ID NO: 1378930 - DNA, 22 bp, Artificial Sequence
  chemically synthesized
gcagttattgaagcatcaaaat

SEQ ID NO: 1378931 - DNA, 22 bp, Artificial Sequence
  chemically synthesized
tgcagttattgaagcatcaaaa

SEQ ID NO: 1378932 - DNA, 22 bp, Artificial Sequence
  chemically synthesized
tccaaggctttgcagttattga

SEQ ID NO: 1378933 - DNA, 22 bp, Artificial Sequence
  chemically synthesized
tgatgcttcaataactgcaaag

SEQ ID NO: 1378934 - DNA, 22 bp, Artificial Sequence
  chemically synthesized
gatgcttcaataactgcaaagc

SEQ ID NO: 1378935 - DNA, 22 bp, Artificial Sequence
  chemically synthesized
atgcttcaataactgcaaagcc

SEQ ID NO: 1378936 - DNA, 22 bp, Artificial Sequence
  chemically synthesized
caataactgcaaagccttggac

SEQ ID NO: 1378937 - DNA, 22 bp, Artificial Sequence
  chemically synthesized
aataactgcaaagccttggaca

SEQ ID NO: 1378938 - DNA, 22 bp, Artificial Sequence
  chemically synthesized
gggaaacacagaggtgaattgt

SEQ ID NO: 1378939 - DNA, 22 bp, Artificial Sequence
  chemically synthesized
caaagccttggacaattcacct

SEQ ID NO: 1378940 - DNA, 22 bp, Artificial Sequence
  chemically synthesized
ggacaattcacctctgtgtttc

SEQ ID NO: 1378941 - DNA, 22 bp, Artificial Sequence
  chemically synthesized
gacaattcacctctgtgtttcc

SEQ ID NO: 1378942 - DNA, 22 bp, Artificial Sequence
  chemically synthesized
cagatatgaaatctggggaaac

SEQ ID NO: 1378943 - DNA, 22 bp, Artificial Sequence
  chemically synthesized
acagatatgaaatctggggaaa

SEQ ID NO: 1378944 - DNA, 22 bp, Artificial Sequence
  chemically synthesized
acctctgtgtttccccagattt

SEQ ID NO: 1378945 - DNA, 22 bp, Artificial Sequence
  chemically synthesized
tttacagatatgaaatctgggg

SEQ ID NO: 1378946 - DNA, 22 bp, Artificial Sequence
  chemically synthesized
tgtgtttccccagatttcatat

SEQ ID NO: 1378947 - DNA, 22 bp, Artificial Sequence
  chemically synthesized
gtctgtttacagatatgaaatc

SEQ ID NO: 1378948 - DNA, 22 bp, Artificial Sequence
  chemically synthesized
tgtttccccagatttcatatct

SEQ ID NO: 1378949 - DNA, 22 bp, Artificial Sequence
  chemically synthesized
ccccagatttcatatctgtaaa

SEQ ID NO: 1378950 - DNA, 22 bp, Artificial Sequence
  chemically synthesized
cccagatttcatatctgtaaac

SEQ ID NO: 1378951 - DNA, 22 bp, Artificial Sequence
  chemically synthesized
agagatcatctagtctgtttac

SEQ ID NO: 1378952 - DNA, 22 bp, Artificial Sequence
  chemically synthesized
gagagatcatctagtctgttta

SEQ ID NO: 1378953 - DNA, 22 bp, Artificial Sequence
  chemically synthesized
tgagagatcatctagtctgttt

SEQ ID NO: 1378954 - DNA, 22 bp, Artificial Sequence
  chemically synthesized
ttgagagatcatctagtctgtt

SEQ ID NO: 1378955 - DNA, 22 bp, Artificial Sequence
  chemically synthesized
catatctgtaaacagactagat

SEQ ID NO: 1378956 - DNA, 22 bp, Artificial Sequence
  chemically synthesized
ttttgagagatcatctagtctg

SEQ ID NO: 1378957 - DNA, 22 bp, Artificial Sequence
  chemically synthesized
atatctgtaaacagactagatg

SEQ ID NO: 1378958 - DNA, 22 bp, Artificial Sequence
  chemically synthesized
taaacagactagatgatctctc

SEQ ID NO: 1378959 - DNA, 22 bp, Artificial Sequence
  chemically synthesized
gatgtggaattcttttgagaga

SEQ ID NO: 1378960 - DNA, 22 bp, Artificial Sequence
  chemically synthesized
agatgtggaattcttttgagag

SEQ ID NO: 1378961 - DNA, 22 bp, Artificial Sequence
  chemically synthesized
tagatgtggaattcttttgaga

SEQ ID NO: 1378962 - DNA, 22 bp, Artificial Sequence
  chemically synthesized
gatgatctctcaaaagaattcc

SEQ ID NO: 1378963 - DNA, 22 bp, Artificial Sequence
  chemically synthesized
tcaaaagaattccacatctaaa

SEQ ID NO: 1378964 - DNA, 22 bp, Artificial Sequence
  chemically synthesized
aaaagaattccacatctaaaac

SEQ ID NO: 1378965 - DNA, 22 bp, Artificial Sequence
  chemically synthesized
cacatctaaaactctctttttc

SEQ ID NO: 1378966 - DNA, 22 bp, Artificial Sequence
  chemically synthesized
aaaggcaggacacagaaaaaga

SEQ ID NO: 1378967 - DNA, 22 bp, Artificial Sequence
  chemically synthesized
aaactctctttttctgtgtcct

SEQ ID NO: 1378968 - DNA, 22 bp, Artificial Sequence
  chemically synthesized
tctttttctgtgtcctgccttt

SEQ ID NO: 1378969 - DNA, 22 bp, Artificial Sequence
  chemically synthesized
tttttctgtgtcctgcctttca

SEQ ID NO: 1378970 - DNA, 22 bp, Artificial Sequence
  chemically synthesized
aaggaaaaatactgaaaggcag

SEQ ID NO: 1378971 - DNA, 22 bp, Artificial Sequence
  chemically synthesized
tttctgtgtcctgcctttcagt

SEQ ID NO: 1378972 - DNA, 22 bp, Artificial Sequence
  chemically synthesized
ttctgtgtcctgcctttcagta

SEQ ID NO: 1378973 - DNA, 22 bp, Artificial Sequence
  chemically synthesized
tctgtgtcctgcctttcagtat

SEQ ID NO: 1378974 - DNA, 22 bp, Artificial Sequence
  chemically synthesized
ctgtgtcctgcctttcagtatt

SEQ ID NO: 1378975 - DNA, 22 bp, Artificial Sequence
  chemically synthesized
aattaaaggaaaaatactgaaa

SEQ ID NO: 1378976 - DNA, 22 bp, Artificial Sequence
  chemically synthesized
tgtgtcctgcctttcagtattt

SEQ ID NO: 1378977 - DNA, 22 bp, Artificial Sequence
  chemically synthesized
tgtcctgcctttcagtattttt

SEQ ID NO: 1378978 - DNA, 22 bp, Artificial Sequence
  chemically synthesized
cctttcagtatttttcctttaa

SEQ ID NO: 1378979 - DNA, 22 bp, Artificial Sequence
  chemically synthesized
tcagtatttttcctttaattga

SEQ ID NO: 1378980 - DNA, 22 bp, Artificial Sequence
  chemically synthesized
cagtatttttcctttaattgaa

SEQ ID NO: 1378981 - DNA, 22 bp, Artificial Sequence
  chemically synthesized
agtatttttcctttaattgaat

SEQ ID NO: 1378982 - DNA, 22 bp, Artificial Sequence
  chemically synthesized
ttcctttaattgaatcatttat

SEQ ID NO: 1378983 - DNA, 22 bp, Artificial Sequence
  chemically synthesized
tcctttaattgaatcatttatt

SEQ ID NO: 1378984 - DNA, 22 bp, Artificial Sequence
  chemically synthesized
cctttaattgaatcatttattt

SEQ ID NO: 1378985 - DNA, 22 bp, Artificial Sequence
  chemically synthesized
ctttaattgaatcatttatttt

SEQ ID NO: 1378986 - DNA, 22 bp, Artificial Sequence
  chemically synthesized
taattgaatcatttattttctt

SEQ ID NO: 1378987 - DNA, 22 bp, Artificial Sequence
  chemically synthesized
aattgaatcatttattttcttc

SEQ ID NO: 1378988 - DNA, 22 bp, Artificial Sequence
  chemically synthesized
cataagatcaaagaagaaaata

SEQ ID NO: 1378989 - DNA, 22 bp, Artificial Sequence
  chemically synthesized
attgaatcatttattttcttct

SEQ ID NO: 1378990 - DNA, 22 bp, Artificial Sequence
  chemically synthesized
aatcatttattttcttctttga

SEQ ID NO: 1378991 - DNA, 22 bp, Artificial Sequence
  chemically synthesized
tagcattgcataagatcaaaga

SEQ ID NO: 1378992 - DNA, 22 bp, Artificial Sequence
  chemically synthesized
ttgtagcattgcataagatcaa

SEQ ID NO: 1378993 - DNA, 22 bp, Artificial Sequence
  chemically synthesized
attgtagcattgcataagatca

SEQ ID NO: 1378994 - DNA, 22 bp, Artificial Sequence
  chemically synthesized
attttcttctttgatcttatgc

SEQ ID NO: 1378995 - DNA, 22 bp, Artificial Sequence
  chemically synthesized
tattgtagcattgcataagatc

SEQ ID NO: 1378996 - DNA, 22 bp, Artificial Sequence
  chemically synthesized
ttttcttctttgatcttatgca

SEQ ID NO: 1378997 - DNA, 22 bp, Artificial Sequence
  chemically synthesized
ttattgtagcattgcataagat

SEQ ID NO: 1378998 - DNA, 22 bp, Artificial Sequence
  chemically synthesized
tcttctttgatcttatgcaatg

SEQ ID NO: 1378999 - DNA, 22 bp, Artificial Sequence
  chemically synthesized
tttttattgtagcattgcataa

SEQ ID NO: 1379000 - DNA, 22 bp, Artificial Sequence
  chemically synthesized
cttctttgatcttatgcaatgc

SEQ ID NO: 1379001 - DNA, 22 bp, Artificial Sequence
  chemically synthesized
gtttttattgtagcattgcata

SEQ ID NO: 1379002 - DNA, 22 bp, Artificial Sequence
  chemically synthesized
ttctttgatcttatgcaatgct

SEQ ID NO: 1379003 - DNA, 22 bp, Artificial Sequence
  chemically synthesized
tgtttttattgtagcattgcat

SEQ ID NO: 1379004 - DNA, 22 bp, Artificial Sequence
  chemically synthesized
ttgtttttattgtagcattgca

SEQ ID NO: 1379005 - DNA, 22 bp, Artificial Sequence
  chemically synthesized
ctttgatcttatgcaatgctac

SEQ ID NO: 1379006 - DNA, 22 bp, Artificial Sequence
  chemically synthesized
tttgatcttatgcaatgctaca

SEQ ID NO: 1379007 - DNA, 22 bp, Artificial Sequence
  chemically synthesized
tttttgtttttattgtagcatt

SEQ ID NO: 1379008 - DNA, 22 bp, Artificial Sequence
  chemically synthesized
tgatcttatgcaatgctacaat

SEQ ID NO: 1379009 - DNA, 22 bp, Artificial Sequence
  chemically synthesized
gtttttgtttttattgtagcat

SEQ ID NO: 1379010 - DNA, 22 bp, Artificial Sequence
  chemically synthesized
gatcttatgcaatgctacaata

SEQ ID NO: 1379011 - DNA, 22 bp, Artificial Sequence
  chemically synthesized
tgtttttgtttttattgtagca

SEQ ID NO: 1379012 - DNA, 22 bp, Artificial Sequence
  chemically synthesized
atcttatgcaatgctacaataa

SEQ ID NO: 1379013 - DNA, 22 bp, Artificial Sequence
  chemically synthesized
gctttgtttttgtttttattgt

SEQ ID NO: 1379014 - DNA, 22 bp, Artificial Sequence
  chemically synthesized
atgcaatgctacaataaaaaca

SEQ ID NO: 1379015 - DNA, 22 bp, Artificial Sequence
  chemically synthesized
tgcaatgctacaataaaaacaa

SEQ ID NO: 1379016 - DNA, 22 bp, Artificial Sequence
  chemically synthesized
tcaaattggctttgtttttgtt

SEQ ID NO: 1379017 - DNA, 22 bp, Artificial Sequence
  chemically synthesized
atcaaattggctttgtttttgt

SEQ ID NO: 1379018 - DNA, 22 bp, Artificial Sequence
  chemically synthesized
tatcaaattggctttgtttttg

SEQ ID NO: 1379019 - DNA, 22 bp, Artificial Sequence
  chemically synthesized
caataaaaacaaaaacaaagcc

SEQ ID NO: 1379020 - DNA, 22 bp, Artificial Sequence
  chemically synthesized
atagagaatgtgatattttatc

SEQ ID NO: 1379021 - DNA, 22 bp, Artificial Sequence
  chemically synthesized
gataaaatatcacattctctat

SEQ ID NO: 1379022 - DNA, 22 bp, Artificial Sequence
  chemically synthesized
ataaaatatcacattctctatt

SEQ ID NO: 1379023 - DNA, 22 bp, Artificial Sequence
  chemically synthesized
agataacaaaaatcactaatag

SEQ ID NO: 1379024 - DNA, 22 bp, Artificial Sequence
  chemically synthesized
taacagctcagataacaaaaat

SEQ ID NO: 1379025 - DNA, 22 bp, Artificial Sequence
  chemically synthesized
gtaacagctcagataacaaaaa

SEQ ID NO: 1379026 - DNA, 22 bp, Artificial Sequence
  chemically synthesized
tctattagtgatttttgttatc

SEQ ID NO: 1379027 - DNA, 22 bp, Artificial Sequence
  chemically synthesized
tgtaacagctcagataacaaaa

SEQ ID NO: 1379028 - DNA, 22 bp, Artificial Sequence
  chemically synthesized
ttgtaacagctcagataacaaa

SEQ ID NO: 1379029 - DNA, 22 bp, Artificial Sequence
  chemically synthesized
tattagtgatttttgttatctg

SEQ ID NO: 1379030 - DNA, 22 bp, Artificial Sequence
  chemically synthesized
ttagtgatttttgttatctgag

SEQ ID NO: 1379031 - DNA, 22 bp, Artificial Sequence
  chemically synthesized
gtgatttttgttatctgagctg

SEQ ID NO: 1379032 - DNA, 22 bp, Artificial Sequence
  chemically synthesized
ttgttatctgagctgttacaaa

SEQ ID NO: 1379033 - DNA, 22 bp, Artificial Sequence
  chemically synthesized
tgttatctgagctgttacaaaa

SEQ ID NO: 1379034 - DNA, 22 bp, Artificial Sequence
  chemically synthesized
gttatctgagctgttacaaaag

SEQ ID NO: 1379035 - DNA, 22 bp, Artificial Sequence
  chemically synthesized
ttatctgagctgttacaaaagt

SEQ ID NO: 1379036 - DNA, 22 bp, Artificial Sequence
  chemically synthesized
tctgagctgttacaaaagtggt

SEQ ID NO: 1379037 - DNA, 22 bp, Artificial Sequence
  chemically synthesized
tggaataaatccaaccactttt

SEQ ID NO: 1379038 - DNA, 22 bp, Artificial Sequence
  chemically synthesized
gtggaataaatccaaccacttt

SEQ ID NO: 1379039 - DNA, 22 bp, Artificial Sequence
  chemically synthesized
agctgttacaaaagtggttgga

SEQ ID NO: 1379040 - DNA, 22 bp, Artificial Sequence
  chemically synthesized
atttgtggaataaatccaacca

SEQ ID NO: 1379041 - DNA, 22 bp, Artificial Sequence
  chemically synthesized
ttacaaaagtggttggatttat

SEQ ID NO: 1379042 - DNA, 22 bp, Artificial Sequence
  chemically synthesized
caaaagtggttggatttattcc

SEQ ID NO: 1379043 - DNA, 22 bp, Artificial Sequence
  chemically synthesized
gatttattccacaaattaggcc

SEQ ID NO: 1379044 - DNA, 22 bp, Artificial Sequence
  chemically synthesized
attccacaaattaggccatcca

SEQ ID NO: 1379045 - DNA, 22 bp, Artificial Sequence
  chemically synthesized
ttccacaaattaggccatccat

SEQ ID NO: 1379046 - DNA, 22 bp, Artificial Sequence
  chemically synthesized
cagaaaggcaggtatggatggc

SEQ ID NO: 1379047 - DNA, 22 bp, Artificial Sequence
  chemically synthesized
cacaaattaggccatccatacc

SEQ ID NO: 1379048 - DNA, 22 bp, Artificial Sequence
  chemically synthesized
ggccatccatacctgcctttct

SEQ ID NO: 1379049 - DNA, 22 bp, Artificial Sequence
  chemically synthesized
atgcatatgattacagaaaggc

SEQ ID NO: 1379050 - DNA, 22 bp, Artificial Sequence
  chemically synthesized
catgcatatgattacagaaagg

SEQ ID NO: 1379051 - DNA, 22 bp, Artificial Sequence
  chemically synthesized
ttcatgcatatgattacagaaa

SEQ ID NO: 1379052 - DNA, 22 bp, Artificial Sequence
  chemically synthesized
cttcatgcatatgattacagaa

SEQ ID NO: 1379053 - DNA, 22 bp, Artificial Sequence
  chemically synthesized
tcttcatgcatatgattacaga

SEQ ID NO: 1379054 - DNA, 22 bp, Artificial Sequence
  chemically synthesized
tttcttcatgcatatgattaca

SEQ ID NO: 1379055 - DNA, 22 bp, Artificial Sequence
  chemically synthesized
ctttcttcatgcatatgattac

SEQ ID NO: 1379056 - DNA, 22 bp, Artificial Sequence
  chemically synthesized
tctttcttcatgcatatgatta

SEQ ID NO: 1379057 - DNA, 22 bp, Artificial Sequence
  chemically synthesized
ttctttcttcatgcatatgatt

SEQ ID NO: 1379058 - DNA, 22 bp, Artificial Sequence
  chemically synthesized
cctttctgtaatcatatgcatg

SEQ ID NO: 1379059 - DNA, 22 bp, Artificial Sequence
  chemically synthesized
tctgtaatcatatgcatgaaga

SEQ ID NO: 1379060 - DNA, 22 bp, Artificial Sequence
  chemically synthesized
ctgtaatcatatgcatgaagaa

SEQ ID NO: 1379061 - DNA, 22 bp, Artificial Sequence
  chemically synthesized
tgaagtttttctttcttcatgc

SEQ ID NO: 1379062 - DNA, 22 bp, Artificial Sequence
  chemically synthesized
tgtaatcatatgcatgaagaaa

SEQ ID NO: 1379063 - DNA, 22 bp, Artificial Sequence
  chemically synthesized
taatcatatgcatgaagaaaga

SEQ ID NO: 1379064 - DNA, 22 bp, Artificial Sequence
  chemically synthesized
cacaagttgtgaagtttttctt

SEQ ID NO: 1379065 - DNA, 22 bp, Artificial Sequence
  chemically synthesized
ctacacaagttgtgaagttttt

SEQ ID NO: 1379066 - DNA, 22 bp, Artificial Sequence
  chemically synthesized
gactcctacacaagttgtgaag

SEQ ID NO: 1379067 - DNA, 22 bp, Artificial Sequence
  chemically synthesized
aaaaattagactcctacacaag

SEQ ID NO: 1379068 - DNA, 22 bp, Artificial Sequence
  chemically synthesized
aattgaaaaattagactcctac

SEQ ID NO: 1379069 - DNA, 22 bp, Artificial Sequence
  chemically synthesized
cacaacttgtgtaggagtctaa

SEQ ID NO: 1379070 - DNA, 22 bp, Artificial Sequence
  chemically synthesized
acaacttgtgtaggagtctaat

SEQ ID NO: 1379071 - DNA, 22 bp, Artificial Sequence
  chemically synthesized
tcaatactaaattgaaaaatta

SEQ ID NO: 1379072 - DNA, 22 bp, Artificial Sequence
  chemically synthesized
gtgtaggagtctaatttttcaa

SEQ ID NO: 1379073 - DNA, 22 bp, Artificial Sequence
  chemically synthesized
tgtaggagtctaatttttcaat

SEQ ID NO: 1379074 - DNA, 22 bp, Artificial Sequence
  chemically synthesized
atttttcaatttagtattgaca

SEQ ID NO: 1379075 - DNA, 22 bp, Artificial Sequence
  chemically synthesized
ttcaatttagtattgacagtct

SEQ ID NO: 1379076 - DNA, 22 bp, Artificial Sequence
  chemically synthesized
aaacccatggtcagactgtcaa

SEQ ID NO: 1379077 - DNA, 22 bp, Artificial Sequence
  chemically synthesized
tcaatttagtattgacagtctg

SEQ ID NO: 1379078 - DNA, 22 bp, Artificial Sequence
  chemically synthesized
caatttagtattgacagtctga

SEQ ID NO: 1379079 - DNA, 22 bp, Artificial Sequence
  chemically synthesized
aatttagtattgacagtctgac

SEQ ID NO: 1379080 - DNA, 22 bp, Artificial Sequence
  chemically synthesized
actcaaacccatggtcagactg

SEQ ID NO: 1379081 - DNA, 22 bp, Artificial Sequence
  chemically synthesized
cactcaaacccatggtcagact

SEQ ID NO: 1379082 - DNA, 22 bp, Artificial Sequence
  chemically synthesized
tcactcaaacccatggtcagac

SEQ ID NO: 1379083 - DNA, 22 bp, Artificial Sequence
  chemically synthesized
agtattgacagtctgaccatgg

SEQ ID NO: 1379084 - DNA, 22 bp, Artificial Sequence
  chemically synthesized
gtattgacagtctgaccatggg

SEQ ID NO: 1379085 - DNA, 22 bp, Artificial Sequence
  chemically synthesized
aactttcactcaaacccatggt

SEQ ID NO: 1379086 - DNA, 22 bp, Artificial Sequence
  chemically synthesized
acagtctgaccatgggtttgag

SEQ ID NO: 1379087 - DNA, 22 bp, Artificial Sequence
  chemically synthesized
caaaatctaaactttcactcaa

SEQ ID NO: 1379088 - DNA, 22 bp, Artificial Sequence
  chemically synthesized
accatgggtttgagtgaaagtt

SEQ ID NO: 1379089 - DNA, 22 bp, Artificial Sequence
  chemically synthesized
gagtgaaagtttagattttgta

SEQ ID NO: 1379090 - DNA, 22 bp, Artificial Sequence
  chemically synthesized
agtgaaagtttagattttgtag

SEQ ID NO: 1379091 - DNA, 22 bp, Artificial Sequence
  chemically synthesized
tcaggaaaccaaagtatctaca

SEQ ID NO: 1379092 - DNA, 22 bp, Artificial Sequence
  chemically synthesized
agattttgtagatactttggtt

SEQ ID NO: 1379093 - DNA, 22 bp, Artificial Sequence
  chemically synthesized
agattatcaggaaaccaaagta

SEQ ID NO: 1379094 - DNA, 22 bp, Artificial Sequence
  chemically synthesized
gattttgtagatactttggttt

SEQ ID NO: 1379095 - DNA, 22 bp, Artificial Sequence
  chemically synthesized
gagattatcaggaaaccaaagt

SEQ ID NO: 1379096 - DNA, 22 bp, Artificial Sequence
  chemically synthesized
tgagattatcaggaaaccaaag

SEQ ID NO: 1379097 - DNA, 22 bp, Artificial Sequence
  chemically synthesized
ttgagattatcaggaaaccaaa

SEQ ID NO: 1379098 - DNA, 22 bp, Artificial Sequence
  chemically synthesized
tgtagatactttggtttcctga

SEQ ID NO: 1379099 - DNA, 22 bp, Artificial Sequence
  chemically synthesized
gtagatactttggtttcctgat

SEQ ID NO: 1379100 - DNA, 22 bp, Artificial Sequence
  chemically synthesized
tagatactttggtttcctgata

SEQ ID NO: 1379101 - DNA, 22 bp, Artificial Sequence
  chemically synthesized
agcttttgagattatcaggaaa

SEQ ID NO: 1379102 - DNA, 22 bp, Artificial Sequence
  chemically synthesized
tggtttcctgataatctcaaaa

SEQ ID NO: 1379103 - DNA, 22 bp, Artificial Sequence
  chemically synthesized
ggtttcctgataatctcaaaag

SEQ ID NO: 1379104 - DNA, 22 bp, Artificial Sequence
  chemically synthesized
gtttcctgataatctcaaaagc

SEQ ID NO: 1379105 - DNA, 22 bp, Artificial Sequence
  chemically synthesized
taaagtataactgagcttttga

SEQ ID NO: 1379106 - DNA, 22 bp, Artificial Sequence
  chemically synthesized
cctgataatctcaaaagctcag

SEQ ID NO: 1379107 - DNA, 22 bp, Artificial Sequence
  chemically synthesized
ctgataatctcaaaagctcagt

SEQ ID NO: 1379108 - DNA, 22 bp, Artificial Sequence
  chemically synthesized
ataatctcaaaagctcagttat

SEQ ID NO: 1379109 - DNA, 22 bp, Artificial Sequence
  chemically synthesized
aaaagctcagttatactttata

SEQ ID NO: 1379110 - DNA, 22 bp, Artificial Sequence
  chemically synthesized
taaacataaatattataaagta

SEQ ID NO: 1379111 - DNA, 22 bp, Artificial Sequence
  chemically synthesized
attgtaaacataaatattataa

SEQ ID NO: 1379112 - DNA, 22 bp, Artificial Sequence
  chemically synthesized
gattgtaaacataaatattata

SEQ ID NO: 1379113 - DNA, 22 bp, Artificial Sequence
  chemically synthesized
agttatactttataatatttat

SEQ ID NO: 1379114 - DNA, 22 bp, Artificial Sequence
  chemically synthesized
ttgattgtaaacataaatatta

SEQ ID NO: 1379115 - DNA, 22 bp, Artificial Sequence
  chemically synthesized
cttgattgtaaacataaatatt

SEQ ID NO: 1379116 - DNA, 22 bp, Artificial Sequence
  chemically synthesized
tcttgattgtaaacataaatat

SEQ ID NO: 1379117 - DNA, 22 bp, Artificial Sequence
  chemically synthesized
tactttataatatttatgttta

SEQ ID NO: 1379118 - DNA, 22 bp, Artificial Sequence
  chemically synthesized
tataatatttatgtttacaatc

SEQ ID NO: 1379119 - DNA, 22 bp, Artificial Sequence
  chemically synthesized
ataatatttatgtttacaatca

SEQ ID NO: 1379120 - DNA, 22 bp, Artificial Sequence
  chemically synthesized
taatatttatgtttacaatcaa

SEQ ID NO: 1379121 - DNA, 22 bp, Artificial Sequence
  chemically synthesized
atgtttacaatcaagaaagtct

SEQ ID NO: 1379122 - DNA, 22 bp, Artificial Sequence
  chemically synthesized
tgtttacaatcaagaaagtctt

SEQ ID NO: 1379123 - DNA, 22 bp, Artificial Sequence
  chemically synthesized
tagaaatatatgtaaagacttt

SEQ ID NO: 1379124 - DNA, 22 bp, Artificial Sequence
  chemically synthesized
acaatcaagaaagtctttacat

SEQ ID NO: 1379125 - DNA, 22 bp, Artificial Sequence
  chemically synthesized
ttatagaaatatatgtaaagac

SEQ ID NO: 1379126 - DNA, 22 bp, Artificial Sequence
  chemically synthesized
caatcaagaaagtctttacata

SEQ ID NO: 1379127 - DNA, 22 bp, Artificial Sequence
  chemically synthesized
attatagaaatatatgtaaaga

SEQ ID NO: 1379128 - DNA, 22 bp, Artificial Sequence
  chemically synthesized
tagcttattatagaaatatatg

SEQ ID NO: 1379129 - DNA, 22 bp, Artificial Sequence
  chemically synthesized
atagcttattatagaaatatat

SEQ ID NO: 1379130 - DNA, 22 bp, Artificial Sequence
  chemically synthesized
tacatatatttctataataagc

SEQ ID NO: 1379131 - DNA, 22 bp, Artificial Sequence
  chemically synthesized
acatatatttctataataagct

SEQ ID NO: 1379132 - DNA, 22 bp, Artificial Sequence
  chemically synthesized
catatatttctataataagcta

SEQ ID NO: 1379133 - DNA, 22 bp, Artificial Sequence
  chemically synthesized
agagaaggtgataatatttata

SEQ ID NO: 1379134 - DNA, 22 bp, Artificial Sequence
  chemically synthesized
ctataataagctataaatatta

SEQ ID NO: 1379135 - DNA, 22 bp, Artificial Sequence
  chemically synthesized
tataataagctataaatattat

SEQ ID NO: 1379136 - DNA, 22 bp, Artificial Sequence
  chemically synthesized
taataagctataaatattatca

SEQ ID NO: 1379137 - DNA, 22 bp, Artificial Sequence
  chemically synthesized
gacaattcagagaaggtgataa

SEQ ID NO: 1379138 - DNA, 22 bp, Artificial Sequence
  chemically synthesized
taaatattatcaccttctctga

SEQ ID NO: 1379139 - DNA, 22 bp, Artificial Sequence
  chemically synthesized
tcaccttctctgaattgtctaa

SEQ ID NO: 1379140 - DNA, 22 bp, Artificial Sequence
  chemically synthesized
tgcagaaggacaataattagac

SEQ ID NO: 1379141 - DNA, 22 bp, Artificial Sequence
  chemically synthesized
ctctgaattgtctaattattgt

SEQ ID NO: 1379142 - DNA, 22 bp, Artificial Sequence
  chemically synthesized
tctgaattgtctaattattgtc

SEQ ID NO: 1379143 - DNA, 22 bp, Artificial Sequence
  chemically synthesized
tctatgcagaaggacaataatt

SEQ ID NO: 1379144 - DNA, 22 bp, Artificial Sequence
  chemically synthesized
gtctatgcagaaggacaataat

SEQ ID NO: 1379145 - DNA, 22 bp, Artificial Sequence
  chemically synthesized
tgaattgtctaattattgtcct

SEQ ID NO: 1379146 - DNA, 22 bp, Artificial Sequence
  chemically synthesized
aattgtctaattattgtccttc

SEQ ID NO: 1379147 - DNA, 22 bp, Artificial Sequence
  chemically synthesized
gcttgtctatgcagaaggacaa

SEQ ID NO: 1379148 - DNA, 22 bp, Artificial Sequence
  chemically synthesized
tctaattattgtccttctgcat

SEQ ID NO: 1379149 - DNA, 22 bp, Artificial Sequence
  chemically synthesized
attattgtccttctgcatagac

SEQ ID NO: 1379150 - DNA, 22 bp, Artificial Sequence
  chemically synthesized
ttgtccttctgcatagacaagc

SEQ ID NO: 1379151 - DNA, 22 bp, Artificial Sequence
  chemically synthesized
tccttctgcatagacaagctag

SEQ ID NO: 1379152 - DNA, 22 bp, Artificial Sequence
  chemically synthesized
ctgcatagacaagctagcatgc

SEQ ID NO: 1379153 - DNA, 22 bp, Artificial Sequence
  chemically synthesized
tgcatagacaagctagcatgct

SEQ ID NO: 1379154 - DNA, 22 bp, Artificial Sequence
  chemically synthesized
catagacaagctagcatgctat

SEQ ID NO: 1379155 - DNA, 22 bp, Artificial Sequence
  chemically synthesized
tccatatgatgtatagcatgct

SEQ ID NO: 1379156 - DNA, 22 bp, Artificial Sequence
  chemically synthesized
atccatatgatgtatagcatgc

SEQ ID NO: 1379157 - DNA, 22 bp, Artificial Sequence
  chemically synthesized
tatccatatgatgtatagcatg

SEQ ID NO: 1379158 - DNA, 22 bp, Artificial Sequence
  chemically synthesized
tggctttatccatatgatgtat

SEQ ID NO: 1379159 - DNA, 22 bp, Artificial Sequence
  chemically synthesized
gtggctttatccatatgatgta

SEQ ID NO: 1379160 - DNA, 22 bp, Artificial Sequence
  chemically synthesized
gcatgctatacatcatatggat

SEQ ID NO: 1379161 - DNA, 22 bp, Artificial Sequence
  chemically synthesized
gcaagaaatttgtggctttatc

SEQ ID NO: 1379162 - DNA, 22 bp, Artificial Sequence
  chemically synthesized
tacatcatatggataaagccac

SEQ ID NO: 1379163 - DNA, 22 bp, Artificial Sequence
  chemically synthesized
tctggcaagaaatttgtggctt

SEQ ID NO: 1379164 - DNA, 22 bp, Artificial Sequence
  chemically synthesized
aaaattatctggcaagaaattt

SEQ ID NO: 1379165 - DNA, 22 bp, Artificial Sequence
  chemically synthesized
gttcaaaattatctggcaagaa

SEQ ID NO: 1379166 - DNA, 22 bp, Artificial Sequence
  chemically synthesized
aaactagttcaaaattatctgg

SEQ ID NO: 1379167 - DNA, 22 bp, Artificial Sequence
  chemically synthesized
gaaactagttcaaaattatctg

SEQ ID NO: 1379168 - DNA, 22 bp, Artificial Sequence
  chemically synthesized
atatttgaaactagttcaaaat

SEQ ID NO: 1379169 - DNA, 22 bp, Artificial Sequence
  chemically synthesized
cttgccagataattttgaacta

SEQ ID NO: 1379170 - DNA, 22 bp, Artificial Sequence
  chemically synthesized
ttgccagataattttgaactag

SEQ ID NO: 1379171 - DNA, 22 bp, Artificial Sequence
  chemically synthesized
ctaatatttgaaactagttcaa

SEQ ID NO: 1379172 - DNA, 22 bp, Artificial Sequence
  chemically synthesized
gccagataattttgaactagtt

SEQ ID NO: 1379173 - DNA, 22 bp, Artificial Sequence
  chemically synthesized
gctaatatttgaaactagttca

SEQ ID NO: 1379174 - DNA, 22 bp, Artificial Sequence
  chemically synthesized
ccagataattttgaactagttt

SEQ ID NO: 1379175 - DNA, 22 bp, Artificial Sequence
  chemically synthesized
atatatttgctaatatttgaaa

SEQ ID NO: 1379176 - DNA, 22 bp, Artificial Sequence
  chemically synthesized
tgaactagtttcaaatattagc

SEQ ID NO: 1379177 - DNA, 22 bp, Artificial Sequence
  chemically synthesized
gaactagtttcaaatattagca

SEQ ID NO: 1379178 - DNA, 22 bp, Artificial Sequence
  chemically synthesized
aactagtttcaaatattagcaa

SEQ ID NO: 1379179 - DNA, 22 bp, Artificial Sequence
  chemically synthesized
tccctaatatatttgctaatat

SEQ ID NO: 1379180 - DNA, 22 bp, Artificial Sequence
  chemically synthesized
gtttcaaatattagcaaatata

SEQ ID NO: 1379181 - DNA, 22 bp, Artificial Sequence
  chemically synthesized
caaatattagcaaatatattag

SEQ ID NO: 1379182 - DNA, 22 bp, Artificial Sequence
  chemically synthesized
aaatattagcaaatatattagg

SEQ ID NO: 1379183 - DNA, 22 bp, Artificial Sequence
  chemically synthesized
acatgaaattgtccctaatata

SEQ ID NO: 1379184 - DNA, 22 bp, Artificial Sequence
  chemically synthesized
gacatgaaattgtccctaatat

SEQ ID NO: 1379185 - DNA, 22 bp, Artificial Sequence
  chemically synthesized
tgacatgaaattgtccctaata

SEQ ID NO: 1379186 - DNA, 22 bp, Artificial Sequence
  chemically synthesized
gcaaatatattagggacaattt

SEQ ID NO: 1379187 - DNA, 22 bp, Artificial Sequence
  chemically synthesized
aatgttttgacatgaaattgtc

SEQ ID NO: 1379188 - DNA, 22 bp, Artificial Sequence
  chemically synthesized
ctcaatgttttgacatgaaatt

SEQ ID NO: 1379189 - DNA, 22 bp, Artificial Sequence
  chemically synthesized
gggacaatttcatgtcaaaaca

SEQ ID NO: 1379190 - DNA, 22 bp, Artificial Sequence
  chemically synthesized
tatcatgactactcaatgtttt

SEQ ID NO: 1379191 - DNA, 22 bp, Artificial Sequence
  chemically synthesized
ttatatcatgactactcaatgt

SEQ ID NO: 1379192 - DNA, 22 bp, Artificial Sequence
  chemically synthesized
attatatcatgactactcaatg

SEQ ID NO: 1379193 - DNA, 22 bp, Artificial Sequence
  chemically synthesized
tattatatcatgactactcaat

SEQ ID NO: 1379194 - DNA, 22 bp, Artificial Sequence
  chemically synthesized
catgtcaaaacattgagtagtc

SEQ ID NO: 1379195 - DNA, 22 bp, Artificial Sequence
  chemically synthesized
atgtcaaaacattgagtagtca

SEQ ID NO: 1379196 - DNA, 22 bp, Artificial Sequence
  chemically synthesized
tactttattatatcatgactac

SEQ ID NO: 1379197 - DNA, 22 bp, Artificial Sequence
  chemically synthesized
ttatactttattatatcatgac

SEQ ID NO: 1379198 - DNA, 22 bp, Artificial Sequence
  chemically synthesized
tctattatactttattatatca

SEQ ID NO: 1379199 - DNA, 22 bp, Artificial Sequence
  chemically synthesized
agtagtcatgatataataaagt

SEQ ID NO: 1379200 - DNA, 22 bp, Artificial Sequence
  chemically synthesized
ggaattgtctattatactttat

SEQ ID NO: 1379201 - DNA, 22 bp, Artificial Sequence
  chemically synthesized
aacattaggaattgtctattat

SEQ ID NO: 1379202 - DNA, 22 bp, Artificial Sequence
  chemically synthesized
aaacattaggaattgtctatta

SEQ ID NO: 1379203 - DNA, 22 bp, Artificial Sequence
  chemically synthesized
taaacattaggaattgtctatt

SEQ ID NO: 1379204 - DNA, 22 bp, Artificial Sequence
  chemically synthesized
ttaaacattaggaattgtctat

SEQ ID NO: 1379205 - DNA, 22 bp, Artificial Sequence
  chemically synthesized
atttttaaacattaggaattgt

SEQ ID NO: 1379206 - DNA, 22 bp, Artificial Sequence
  chemically synthesized
aatactaatttttaaacattag

SEQ ID NO: 1379207 - DNA, 22 bp, Artificial Sequence
  chemically synthesized
ttgaatactaatttttaaacat

SEQ ID NO: 1379208 - DNA, 22 bp, Artificial Sequence
  chemically synthesized
tgactgttgaatactaattttt

SEQ ID NO: 1379209 - DNA, 22 bp, Artificial Sequence
  chemically synthesized
tgtgactgttgaatactaattt

SEQ ID NO: 1379210 - DNA, 22 bp, Artificial Sequence
  chemically synthesized
ctaatgtttaaaaattagtatt

SEQ ID NO: 1379211 - DNA, 22 bp, Artificial Sequence
  chemically synthesized
ctgtgactgttgaatactaatt

SEQ ID NO: 1379212 - DNA, 22 bp, Artificial Sequence
  chemically synthesized
tctgtgactgttgaatactaat

SEQ ID NO: 1379213 - DNA, 22 bp, Artificial Sequence
  chemically synthesized
atgtttaaaaattagtattcaa

SEQ ID NO: 1379214 - DNA, 22 bp, Artificial Sequence
  chemically synthesized
tttctgtgactgttgaatacta

SEQ ID NO: 1379215 - DNA, 22 bp, Artificial Sequence
  chemically synthesized
ctctttctgtgactgttgaata

SEQ ID NO: 1379216 - DNA, 22 bp, Artificial Sequence
  chemically synthesized
cctctttctgtgactgttgaat

SEQ ID NO: 1379217 - DNA, 22 bp, Artificial Sequence
  chemically synthesized
aaaaattagtattcaacagtca

SEQ ID NO: 1379218 - DNA, 22 bp, Artificial Sequence
  chemically synthesized
aaaattagtattcaacagtcac

SEQ ID NO: 1379219 - DNA, 22 bp, Artificial Sequence
  chemically synthesized
gtattcaacagtcacagaaaga

SEQ ID NO: 1379220 - DNA, 22 bp, Artificial Sequence
  chemically synthesized
aagcataatttcctctttctgt

SEQ ID NO: 1379221 - DNA, 22 bp, Artificial Sequence
  chemically synthesized
aacagtcacagaaagaggaaat

SEQ ID NO: 1379222 - DNA, 22 bp, Artificial Sequence
  chemically synthesized
ccatcaaactaaagcataattt

SEQ ID NO: 1379223 - DNA, 22 bp, Artificial Sequence
  chemically synthesized
ggatggtgttaccatcaaacta

SEQ ID NO: 1379224 - DNA, 22 bp, Artificial Sequence
  chemically synthesized
acgctaggatggtgttaccatc

SEQ ID NO: 1379225 - DNA, 22 bp, Artificial Sequence
  chemically synthesized
tgctttagtttgatggtaacac

SEQ ID NO: 1379226 - DNA, 22 bp, Artificial Sequence
  chemically synthesized
gacgctaggatggtgttaccat

SEQ ID NO: 1379227 - DNA, 22 bp, Artificial Sequence
  chemically synthesized
tagtttgatggtaacaccatcc

SEQ ID NO: 1379228 - DNA, 22 bp, Artificial Sequence
  chemically synthesized
agtttgatggtaacaccatcct

SEQ ID NO: 1379229 - DNA, 22 bp, Artificial Sequence
  chemically synthesized
gtttgatggtaacaccatccta

SEQ ID NO: 1379230 - DNA, 22 bp, Artificial Sequence
  chemically synthesized
gatggtaacaccatcctagcgt

SEQ ID NO: 1379231 - DNA, 22 bp, Artificial Sequence
  chemically synthesized
atggtaacaccatcctagcgtc

SEQ ID NO: 1379232 - DNA, 22 bp, Artificial Sequence
  chemically synthesized
agagaaatgtaaccatgcttga

SEQ ID NO: 1379233 - DNA, 22 bp, Artificial Sequence
  chemically synthesized
gcgtcaagcatggttacatttc

SEQ ID NO: 1379234 - DNA, 22 bp, Artificial Sequence
  chemically synthesized
ggaaaaatattaagagaaatgt

SEQ ID NO: 1379235 - DNA, 22 bp, Artificial Sequence
  chemically synthesized
taggaaaaatattaagagaaat

SEQ ID NO: 1379236 - DNA, 22 bp, Artificial Sequence
  chemically synthesized
ctaggaaaaatattaagagaaa

SEQ ID NO: 1379237 - DNA, 22 bp, Artificial Sequence
  chemically synthesized
tctaggaaaaatattaagagaa

SEQ ID NO: 1379238 - DNA, 22 bp, Artificial Sequence
  chemically synthesized
ttctaggaaaaatattaagaga

SEQ ID NO: 1379239 - DNA, 22 bp, Artificial Sequence
  chemically synthesized
catttctcttaatatttttcct

SEQ ID NO: 1379240 - DNA, 22 bp, Artificial Sequence
  chemically synthesized
gaagccacgcttttctaggaaa

SEQ ID NO: 1379241 - DNA, 22 bp, Artificial Sequence
  chemically synthesized
ctcttaatatttttcctagaaa

SEQ ID NO: 1379242 - DNA, 22 bp, Artificial Sequence
  chemically synthesized
tcttaatatttttcctagaaaa

SEQ ID NO: 1379243 - DNA, 22 bp, Artificial Sequence
  chemically synthesized
ttaatatttttcctagaaaagc

SEQ ID NO: 1379244 - DNA, 22 bp, Artificial Sequence
  chemically synthesized
aatatttttcctagaaaagcgt

SEQ ID NO: 1379245 - DNA, 22 bp, Artificial Sequence
  chemically synthesized
atatttttcctagaaaagcgtg

SEQ ID NO: 1379246 - DNA, 22 bp, Artificial Sequence
  chemically synthesized
ttcctagaaaagcgtggcttct

SEQ ID NO: 1379247 - DNA, 22 bp, Artificial Sequence
  chemically synthesized
atcaaataagctagaagccacg

SEQ ID NO: 1379248 - DNA, 22 bp, Artificial Sequence
  chemically synthesized
tcctagaaaagcgtggcttcta

SEQ ID NO: 1379249 - DNA, 22 bp, Artificial Sequence
  chemically synthesized
cctagaaaagcgtggcttctag

SEQ ID NO: 1379250 - DNA, 22 bp, Artificial Sequence
  chemically synthesized
ctagaaaagcgtggcttctagc

SEQ ID NO: 1379251 - DNA, 22 bp, Artificial Sequence
  chemically synthesized
tattaatcaaataagctagaag

SEQ ID NO: 1379252 - DNA, 22 bp, Artificial Sequence
  chemically synthesized
gaaaagcgtggcttctagctta

SEQ ID NO: 1379253 - DNA, 22 bp, Artificial Sequence
  chemically synthesized
gtattaatcaaataagctagaa

SEQ ID NO: 1379254 - DNA, 22 bp, Artificial Sequence
  chemically synthesized
aaggatttgtattaatcaaata

SEQ ID NO: 1379255 - DNA, 22 bp, Artificial Sequence
  chemically synthesized
gaaggatttgtattaatcaaat

SEQ ID NO: 1379256 - DNA, 22 bp, Artificial Sequence
  chemically synthesized
tgaaggatttgtattaatcaaa

SEQ ID NO: 1379257 - DNA, 22 bp, Artificial Sequence
  chemically synthesized
ctagcttatttgattaatacaa

SEQ ID NO: 1379258 - DNA, 22 bp, Artificial Sequence
  chemically synthesized
tagcttatttgattaatacaaa

SEQ ID NO: 1379259 - DNA, 22 bp, Artificial Sequence
  chemically synthesized
gcttatttgattaatacaaatc

SEQ ID NO: 1379260 - DNA, 22 bp, Artificial Sequence
  chemically synthesized
atttgattaatacaaatccttc

SEQ ID NO: 1379261 - DNA, 22 bp, Artificial Sequence
  chemically synthesized
tttgattaatacaaatccttca

SEQ ID NO: 1379262 - DNA, 22 bp, Artificial Sequence
  chemically synthesized
gattaatacaaatccttcaaaa

SEQ ID NO: 1379263 - DNA, 22 bp, Artificial Sequence
  chemically synthesized
attaatacaaatccttcaaaat

SEQ ID NO: 1379264 - DNA, 22 bp, Artificial Sequence
  chemically synthesized
gaacagaataaaaagattttga

SEQ ID NO: 1379265 - DNA, 22 bp, Artificial Sequence
  chemically synthesized
atacaaatccttcaaaatcttt

SEQ ID NO: 1379266 - DNA, 22 bp, Artificial Sequence
  chemically synthesized
atcctagaacagaataaaaaga

SEQ ID NO: 1379267 - DNA, 22 bp, Artificial Sequence
  chemically synthesized
tcatcctagaacagaataaaaa

SEQ ID NO: 1379268 - DNA, 22 bp, Artificial Sequence
  chemically synthesized
ctctcatcctagaacagaataa

SEQ ID NO: 1379269 - DNA, 22 bp, Artificial Sequence
  chemically synthesized
cctctcatcctagaacagaata

SEQ ID NO: 1379270 - DNA, 22 bp, Artificial Sequence
  chemically synthesized
caaaatctttttattctgttct

SEQ ID NO: 1379271 - DNA, 22 bp, Artificial Sequence
  chemically synthesized
aaaatctttttattctgttcta

SEQ ID NO: 1379272 - DNA, 22 bp, Artificial Sequence
  chemically synthesized
tatttcctctcatcctagaaca

SEQ ID NO: 1379273 - DNA, 22 bp, Artificial Sequence
  chemically synthesized
tttattctgttctaggatgaga

SEQ ID NO: 1379274 - DNA, 22 bp, Artificial Sequence
  chemically synthesized
ttattctgttctaggatgagag

SEQ ID NO: 1379275 - DNA, 22 bp, Artificial Sequence
  chemically synthesized
tattctgttctaggatgagagg

SEQ ID NO: 1379276 - DNA, 22 bp, Artificial Sequence
  chemically synthesized
attctgttctaggatgagagga

SEQ ID NO: 1379277 - DNA, 22 bp, Artificial Sequence
  chemically synthesized
ttctgttctaggatgagaggaa

SEQ ID NO: 1379278 - DNA, 22 bp, Artificial Sequence
  chemically synthesized
tgttctaggatgagaggaaata

SEQ ID NO: 1379279 - DNA, 22 bp, Artificial Sequence
  chemically synthesized
ttctaggatgagaggaaatata

SEQ ID NO: 1379280 - DNA, 22 bp, Artificial Sequence
  chemically synthesized
aaatataaatgttatatttcct

SEQ ID NO: 1379281 - DNA, 22 bp, Artificial Sequence
  chemically synthesized
aaaatataaatgttatatttcc

SEQ ID NO: 1379282 - DNA, 22 bp, Artificial Sequence
  chemically synthesized
taggatgagaggaaatataaca

SEQ ID NO: 1379283 - DNA, 22 bp, Artificial Sequence
  chemically synthesized
ggatgagaggaaatataacatt

SEQ ID NO: 1379284 - DNA, 22 bp, Artificial Sequence
  chemically synthesized
atttaaaatataaatgttatat

SEQ ID NO: 1379285 - DNA, 22 bp, Artificial Sequence
  chemically synthesized
tgattaatttaaaatataaatg

SEQ ID NO: 1379286 - DNA, 22 bp, Artificial Sequence
  chemically synthesized
atgattaatttaaaatataaat

SEQ ID NO: 1379287 - DNA, 22 bp, Artificial Sequence
  chemically synthesized
atgtatagtttatgattaattt

SEQ ID NO: 1379288 - DNA, 22 bp, Artificial Sequence
  chemically synthesized
atattttaaattaatcataaac

SEQ ID NO: 1379289 - DNA, 22 bp, Artificial Sequence
  chemically synthesized
tattttaaattaatcataaact

SEQ ID NO: 1379290 - DNA, 22 bp, Artificial Sequence
  chemically synthesized
taaattaatcataaactataca

SEQ ID NO: 1379291 - DNA, 22 bp, Artificial Sequence
  chemically synthesized
aatcaagattaatgtatagttt

SEQ ID NO: 1379292 - DNA, 22 bp, Artificial Sequence
  chemically synthesized
aaattaatcataaactatacat

SEQ ID NO: 1379293 - DNA, 22 bp, Artificial Sequence
  chemically synthesized
aaatcaagattaatgtatagtt

SEQ ID NO: 1379294 - DNA, 22 bp, Artificial Sequence
  chemically synthesized
aattaatcataaactatacatt

SEQ ID NO: 1379295 - DNA, 22 bp, Artificial Sequence
  chemically synthesized
taaatcaagattaatgtatagt

SEQ ID NO: 1379296 - DNA, 22 bp, Artificial Sequence
  chemically synthesized
ttttaaatcaagattaatgtat

SEQ ID NO: 1379297 - DNA, 22 bp, Artificial Sequence
  chemically synthesized
atcataaactatacattaatct

SEQ ID NO: 1379298 - DNA, 22 bp, Artificial Sequence
  chemically synthesized
tattttaaatcaagattaatgt

SEQ ID NO: 1379299 - DNA, 22 bp, Artificial Sequence
  chemically synthesized
ctattttaaatcaagattaatg

SEQ ID NO: 1379300 - DNA, 22 bp, Artificial Sequence
  chemically synthesized
tacattaatcttgatttaaaat

SEQ ID NO: 1379301 - DNA, 22 bp, Artificial Sequence
  chemically synthesized
aaaagtaggtttctattttaaa

SEQ ID NO: 1379302 - DNA, 22 bp, Artificial Sequence
  chemically synthesized
atcttgatttaaaatagaaacc

SEQ ID NO: 1379303 - DNA, 22 bp, Artificial Sequence
  chemically synthesized
ggttgaaaagtaggtttctatt

SEQ ID NO: 1379304 - DNA, 22 bp, Artificial Sequence
  chemically synthesized
tcggttgaaaagtaggtttcta

SEQ ID NO: 1379305 - DNA, 22 bp, Artificial Sequence
  chemically synthesized
gatttaaaatagaaacctactt

SEQ ID NO: 1379306 - DNA, 22 bp, Artificial Sequence
  chemically synthesized
atttaaaatagaaacctacttt

SEQ ID NO: 1379307 - DNA, 22 bp, Artificial Sequence
  chemically synthesized
aaaatagaaacctacttttcaa

SEQ ID NO: 1379308 - DNA, 22 bp, Artificial Sequence
  chemically synthesized
aaatagaaacctacttttcaac

SEQ ID NO: 1379309 - DNA, 22 bp, Artificial Sequence
  chemically synthesized
agatgacaggtgtacattctcg

SEQ ID NO: 1379310 - DNA, 22 bp, Artificial Sequence
  chemically synthesized
gagatgacaggtgtacattctc

SEQ ID NO: 1379311 - DNA, 22 bp, Artificial Sequence
  chemically synthesized
tgagatgacaggtgtacattct

SEQ ID NO: 1379312 - DNA, 22 bp, Artificial Sequence
  chemically synthesized
cttttcaaccgagaatgtacac

SEQ ID NO: 1379313 - DNA, 22 bp, Artificial Sequence
  chemically synthesized
ttgagatgacaggtgtacattc

SEQ ID NO: 1379314 - DNA, 22 bp, Artificial Sequence
  chemically synthesized
ttttgagatgacaggtgtacat

SEQ ID NO: 1379315 - DNA, 22 bp, Artificial Sequence
  chemically synthesized
ttcaaccgagaatgtacacctg

SEQ ID NO: 1379316 - DNA, 22 bp, Artificial Sequence
  chemically synthesized
cttttgagatgacaggtgtaca

SEQ ID NO: 1379317 - DNA, 22 bp, Artificial Sequence
  chemically synthesized
tcaaccgagaatgtacacctgt

SEQ ID NO: 1379318 - DNA, 22 bp, Artificial Sequence
  chemically synthesized
caaccgagaatgtacacctgtc

SEQ ID NO: 1379319 - DNA, 22 bp, Artificial Sequence
  chemically synthesized
aaccgagaatgtacacctgtca

SEQ ID NO: 1379320 - DNA, 22 bp, Artificial Sequence
  chemically synthesized
atatgtaaatataccttctttt

SEQ ID NO: 1379321 - DNA, 22 bp, Artificial Sequence
  chemically synthesized
tcatctcaaaagaaggtatatt

SEQ ID NO: 1379322 - DNA, 22 bp, Artificial Sequence
  chemically synthesized
aaaagaaggtatatttacatat

SEQ ID NO: 1379323 - DNA, 22 bp, Artificial Sequence
  chemically synthesized
aaatataaaattaatatgtaaa

SEQ ID NO: 1379324 - DNA, 22 bp, Artificial Sequence
  chemically synthesized
tatctgaaatataaaattaata

SEQ ID NO: 1379325 - DNA, 22 bp, Artificial Sequence
  chemically synthesized
atatctgaaatataaaattaat

SEQ ID NO: 1379326 - DNA, 22 bp, Artificial Sequence
  chemically synthesized
acatattaattttatatttcag

SEQ ID NO: 1379327 - DNA, 22 bp, Artificial Sequence
  chemically synthesized
catattaattttatatttcaga

SEQ ID NO: 1379328 - DNA, 22 bp, Artificial Sequence
  chemically synthesized
ataaatgtttatatctgaaata

SEQ ID NO: 1379329 - DNA, 22 bp, Artificial Sequence
  chemically synthesized
aataaatgtttatatctgaaat

SEQ ID NO: 1379330 - DNA, 22 bp, Artificial Sequence
  chemically synthesized
attttatatttcagatataaac

SEQ ID NO: 1379331 - DNA, 22 bp, Artificial Sequence
  chemically synthesized
tatatttcagatataaacattt

SEQ ID NO: 1379332 - DNA, 22 bp, Artificial Sequence
  chemically synthesized
atatttcagatataaacattta

SEQ ID NO: 1379333 - DNA, 22 bp, Artificial Sequence
  chemically synthesized
tatttcagatataaacatttat

SEQ ID NO: 1379334 - DNA, 22 bp, Artificial Sequence
  chemically synthesized
cagatataaacatttattaaat

SEQ ID NO: 1379335 - DNA, 22 bp, Artificial Sequence
  chemically synthesized
agatataaacatttattaaatt

SEQ ID NO: 1379336 - DNA, 22 bp, Artificial Sequence
  chemically synthesized
aggtgaaacaaaaaatgagaat

SEQ ID NO: 1379337 - DNA, 22 bp, Artificial Sequence
  chemically synthesized
gttcaggtgaaacaaaaaatga

SEQ ID NO: 1379338 - DNA, 22 bp, Artificial Sequence
  chemically synthesized
attaaattctcattttttgttt

SEQ ID NO: 1379339 - DNA, 22 bp, Artificial Sequence
  chemically synthesized
ttaaattctcattttttgtttc

SEQ ID NO: 1379340 - DNA, 22 bp, Artificial Sequence
  chemically synthesized
aattctcattttttgtttcacc

SEQ ID NO: 1379341 - DNA, 22 bp, Artificial Sequence
  chemically synthesized
catgttagttcaggtgaaacaa

SEQ ID NO: 1379342 - DNA, 22 bp, Artificial Sequence
  chemically synthesized
actacatgttagttcaggtgaa

SEQ ID NO: 1379343 - DNA, 22 bp, Artificial Sequence
  chemically synthesized
tcattttttgtttcacctgaac

SEQ ID NO: 1379344 - DNA, 22 bp, Artificial Sequence
  chemically synthesized
taactacatgttagttcaggtg

SEQ ID NO: 1379345 - DNA, 22 bp, Artificial Sequence
  chemically synthesized
attttttgtttcacctgaacta

SEQ ID NO: 1379346 - DNA, 22 bp, Artificial Sequence
  chemically synthesized
tctaactacatgttagttcagg

SEQ ID NO: 1379347 - DNA, 22 bp, Artificial Sequence
  chemically synthesized
ctctaactacatgttagttcag

SEQ ID NO: 1379348 - DNA, 22 bp, Artificial Sequence
  chemically synthesized
tttgtttcacctgaactaacat

SEQ ID NO: 1379349 - DNA, 22 bp, Artificial Sequence
  chemically synthesized
ttgtttcacctgaactaacatg

SEQ ID NO: 1379350 - DNA, 22 bp, Artificial Sequence
  chemically synthesized
tgtttcacctgaactaacatgt

SEQ ID NO: 1379351 - DNA, 22 bp, Artificial Sequence
  chemically synthesized
gtttcacctgaactaacatgta

SEQ ID NO: 1379352 - DNA, 22 bp, Artificial Sequence
  chemically synthesized
tttcacctgaactaacatgtag

SEQ ID NO: 1379353 - DNA, 22 bp, Artificial Sequence
  chemically synthesized
cacctgaactaacatgtagtta

SEQ ID NO: 1379354 - DNA, 22 bp, Artificial Sequence
  chemically synthesized
acctgaactaacatgtagttag

SEQ ID NO: 1379355 - DNA, 22 bp, Artificial Sequence
  chemically synthesized
aaatgtatttctctaactacat

SEQ ID NO: 1379356 - DNA, 22 bp, Artificial Sequence
  chemically synthesized
taaaatgtatttctctaactac

SEQ ID NO: 1379357 - DNA, 22 bp, Artificial Sequence
  chemically synthesized
ctaaaatgtatttctctaacta

SEQ ID NO: 1379358 - DNA, 22 bp, Artificial Sequence
  chemically synthesized
tctaaaatgtatttctctaact

SEQ ID NO: 1379359 - DNA, 22 bp, Artificial Sequence
  chemically synthesized
aactaacatgtagttagagaaa

SEQ ID NO: 1379360 - DNA, 22 bp, Artificial Sequence
  chemically synthesized
ttctaaaatgtatttctctaac

SEQ ID NO: 1379361 - DNA, 22 bp, Artificial Sequence
  chemically synthesized
tttctaaaatgtatttctctaa

SEQ ID NO: 1379362 - DNA, 22 bp, Artificial Sequence
  chemically synthesized
acatgtagttagagaaatacat

SEQ ID NO: 1379363 - DNA, 22 bp, Artificial Sequence
  chemically synthesized
attttttctaaaatgtatttct

SEQ ID NO: 1379364 - DNA, 22 bp, Artificial Sequence
  chemically synthesized
ttaattttttctaaaatgtatt

SEQ ID NO: 1379365 - DNA, 22 bp, Artificial Sequence
  chemically synthesized
ctattaattttttctaaaatgt

SEQ ID NO: 1379366 - DNA, 22 bp, Artificial Sequence
  chemically synthesized
actattaattttttctaaaatg

SEQ ID NO: 1379367 - DNA, 22 bp, Artificial Sequence
  chemically synthesized
gagaaatacattttagaaaaaa

SEQ ID NO: 1379368 - DNA, 22 bp, Artificial Sequence
  chemically synthesized
agtaagatacacttactattaa

SEQ ID NO: 1379369 - DNA, 22 bp, Artificial Sequence
  chemically synthesized
gagtaagatacacttactatta

SEQ ID NO: 1379370 - DNA, 22 bp, Artificial Sequence
  chemically synthesized
tgagtaagatacacttactatt

SEQ ID NO: 1379371 - DNA, 22 bp, Artificial Sequence
  chemically synthesized
tagaaaaaattaatagtaagtg

SEQ ID NO: 1379372 - DNA, 22 bp, Artificial Sequence
  chemically synthesized
agaaaaaattaatagtaagtgt

SEQ ID NO: 1379373 - DNA, 22 bp, Artificial Sequence
  chemically synthesized
gaaaaaattaatagtaagtgta

SEQ ID NO: 1379374 - DNA, 22 bp, Artificial Sequence
  chemically synthesized
ttttgagtaagatacacttact

SEQ ID NO: 1379375 - DNA, 22 bp, Artificial Sequence
  chemically synthesized
atagtaagtgtatcttactcaa

SEQ ID NO: 1379376 - DNA, 22 bp, Artificial Sequence
  chemically synthesized
gagtgaattattttgagtaaga

SEQ ID NO: 1379377 - DNA, 22 bp, Artificial Sequence
  chemically synthesized
agaaaatctagagtgaattatt

SEQ ID NO: 1379378 - DNA, 22 bp, Artificial Sequence
  chemically synthesized
actcaaaataattcactctaga

SEQ ID NO: 1379379 - DNA, 22 bp, Artificial Sequence
  chemically synthesized
ctcaaaataattcactctagat

SEQ ID NO: 1379380 - DNA, 22 bp, Artificial Sequence
  chemically synthesized
ataattgagaaaatctagagtg

SEQ ID NO: 1379381 - DNA, 22 bp, Artificial Sequence
  chemically synthesized
aataattgagaaaatctagagt

SEQ ID NO: 1379382 - DNA, 22 bp, Artificial Sequence
  chemically synthesized
aaaataattcactctagatttt

SEQ ID NO: 1379383 - DNA, 22 bp, Artificial Sequence
  chemically synthesized
ccatttaataattgagaaaatc

SEQ ID NO: 1379384 - DNA, 22 bp, Artificial Sequence
  chemically synthesized
gccatttaataattgagaaaat

SEQ ID NO: 1379385 - DNA, 22 bp, Artificial Sequence
  chemically synthesized
actctagattttctcaattatt

SEQ ID NO: 1379386 - DNA, 22 bp, Artificial Sequence
  chemically synthesized
cacttgccatttaataattgag

SEQ ID NO: 1379387 - DNA, 22 bp, Artificial Sequence
  chemically synthesized
tagattttctcaattattaaat

SEQ ID NO: 1379388 - DNA, 22 bp, Artificial Sequence
  chemically synthesized
gattttctcaattattaaatgg

SEQ ID NO: 1379389 - DNA, 22 bp, Artificial Sequence
  chemically synthesized
tctcaattattaaatggcaagt

SEQ ID NO: 1379390 - DNA, 22 bp, Artificial Sequence
  chemically synthesized
ctcaattattaaatggcaagtg

SEQ ID NO: 1379391 - DNA, 22 bp, Artificial Sequence
  chemically synthesized
tcaattattaaatggcaagtgc

SEQ ID NO: 1379392 - DNA, 22 bp, Artificial Sequence
  chemically synthesized
aattattaaatggcaagtgcaa

SEQ ID NO: 1379393 - DNA, 22 bp, Artificial Sequence
  chemically synthesized
taaagaagaaacattgcacttg

SEQ ID NO: 1379394 - DNA, 22 bp, Artificial Sequence
  chemically synthesized
ttaaatggcaagtgcaatgttt

SEQ ID NO: 1379395 - DNA, 22 bp, Artificial Sequence
  chemically synthesized
aatggcaagtgcaatgtttctt

SEQ ID NO: 1379396 - DNA, 22 bp, Artificial Sequence
  chemically synthesized
catagtaacaatatcataatac

SEQ ID NO: 1379397 - DNA, 22 bp, Artificial Sequence
  chemically synthesized
cttctttacagtattatgatat

SEQ ID NO: 1379398 - DNA, 22 bp, Artificial Sequence
  chemically synthesized
ttctttacagtattatgatatt

SEQ ID NO: 1379399 - DNA, 22 bp, Artificial Sequence
  chemically synthesized
ctttacagtattatgatattgt

SEQ ID NO: 1379400 - DNA, 22 bp, Artificial Sequence
  chemically synthesized
tttacagtattatgatattgtt

SEQ ID NO: 1379401 - DNA, 22 bp, Artificial Sequence
  chemically synthesized
tacagtattatgatattgttac

SEQ ID NO: 1379402 - DNA, 22 bp, Artificial Sequence
  chemically synthesized
acagtattatgatattgttact

SEQ ID NO: 1379403 - DNA, 22 bp, Artificial Sequence
  chemically synthesized
cagtattatgatattgttacta

SEQ ID NO: 1379404 - DNA, 22 bp, Artificial Sequence
  chemically synthesized
tgatattgttactatgcagacc

SEQ ID NO: 1379405 - DNA, 22 bp, Artificial Sequence
  chemically synthesized
ttactatgcagaccactattca

SEQ ID NO: 1379406 - DNA, 22 bp, Artificial Sequence
  chemically synthesized
ctatgcagaccactattcattt

SEQ ID NO: 1379407 - DNA, 22 bp, Artificial Sequence
  chemically synthesized
tgcagaccactattcatttttc

SEQ ID NO: 1379408 - DNA, 22 bp, Artificial Sequence
  chemically synthesized
taggaagtaacaggaaaaatga

SEQ ID NO: 1379409 - DNA, 22 bp, Artificial Sequence
  chemically synthesized
agttataggaagtaacaggaaa

SEQ ID NO: 1379410 - DNA, 22 bp, Artificial Sequence
  chemically synthesized
ttcatttttcctgttacttcct

SEQ ID NO: 1379411 - DNA, 22 bp, Artificial Sequence
  chemically synthesized
atttttcctgttacttcctata

SEQ ID NO: 1379412 - DNA, 22 bp, Artificial Sequence
  chemically synthesized
aagaagaaactcagttatagga

SEQ ID NO: 1379413 - DNA, 22 bp, Artificial Sequence
  chemically synthesized
ttcctgttacttcctataactg

SEQ ID NO: 1379414 - DNA, 22 bp, Artificial Sequence
  chemically synthesized
tcctgttacttcctataactga

SEQ ID NO: 1379415 - DNA, 22 bp, Artificial Sequence
  chemically synthesized
cctgttacttcctataactgag

SEQ ID NO: 1379416 - DNA, 22 bp, Artificial Sequence
  chemically synthesized
ctgttacttcctataactgagt

SEQ ID NO: 1379417 - DNA, 22 bp, Artificial Sequence
  chemically synthesized
atactaaagaagaaactcagtt

SEQ ID NO: 1379418 - DNA, 22 bp, Artificial Sequence
  chemically synthesized
ttacttcctataactgagtttc

SEQ ID NO: 1379419 - DNA, 22 bp, Artificial Sequence
  chemically synthesized
ttaatactaaagaagaaactca

SEQ ID NO: 1379420 - DNA, 22 bp, Artificial Sequence
  chemically synthesized
cttcctataactgagtttcttc

SEQ ID NO: 1379421 - DNA, 22 bp, Artificial Sequence
  chemically synthesized
attaatactaaagaagaaactc

SEQ ID NO: 1379422 - DNA, 22 bp, Artificial Sequence
  chemically synthesized
tattaatactaaagaagaaact

SEQ ID NO: 1379423 - DNA, 22 bp, Artificial Sequence
  chemically synthesized
cctataactgagtttcttcttt

SEQ ID NO: 1379424 - DNA, 22 bp, Artificial Sequence
  chemically synthesized
ctataactgagtttcttcttta

SEQ ID NO: 1379425 - DNA, 22 bp, Artificial Sequence
  chemically synthesized
cattttattaatactaaagaag

SEQ ID NO: 1379426 - DNA, 22 bp, Artificial Sequence
  chemically synthesized
taactgagtttcttctttagta

SEQ ID NO: 1379427 - DNA, 22 bp, Artificial Sequence
  chemically synthesized
agtttcttctttagtattaata

SEQ ID NO: 1379428 - DNA, 22 bp, Artificial Sequence
  chemically synthesized
cttctttagtattaataaaatg

SEQ ID NO: 1379429 - DNA, 22 bp, Artificial Sequence
  chemically synthesized
ttctttagtattaataaaatgc

SEQ ID NO: 1379430 - DNA, 22 bp, Artificial Sequence
  chemically synthesized
ctttagtattaataaaatgcaa

SEQ ID NO: 1379431 - DNA, 22 bp, Artificial Sequence
  chemically synthesized
tttagtattaataaaatgcaac

SEQ ID NO: 1379432 - DNA, 22 bp, Artificial Sequence
  chemically synthesized
aagagatatagatgttgcattt

SEQ ID NO: 1379433 - DNA, 22 bp, Artificial Sequence
  chemically synthesized
tagtattaataaaatgcaacat

SEQ ID NO: 1379434 - DNA, 22 bp, Artificial Sequence
  chemically synthesized
agtattaataaaatgcaacatc

SEQ ID NO: 1379435 - DNA, 22 bp, Artificial Sequence
  chemically synthesized
gtattaataaaatgcaacatct

SEQ ID NO: 1379436 - DNA, 22 bp, Artificial Sequence
  chemically synthesized
ataaaatgcaacatctatatct

SEQ ID NO: 1379437 - DNA, 22 bp, Artificial Sequence
  chemically synthesized
caaaggggctgaagagatatag

SEQ ID NO: 1379438 - DNA, 22 bp, Artificial Sequence
  chemically synthesized
acaaaggggctgaagagatata

SEQ ID NO: 1379439 - DNA, 22 bp, Artificial Sequence
  chemically synthesized
cacgtttacaaaggggctgaag

SEQ ID NO: 1379440 - DNA, 22 bp, Artificial Sequence
  chemically synthesized
cgttacacgtttacaaaggggc

SEQ ID NO: 1379441 - DNA, 22 bp, Artificial Sequence
  chemically synthesized
tatctcttcagcccctttgtaa

SEQ ID NO: 1379442 - DNA, 22 bp, Artificial Sequence
  chemically synthesized
ctccgttacacgtttacaaagg

SEQ ID NO: 1379443 - DNA, 22 bp, Artificial Sequence
  chemically synthesized
ttcagcccctttgtaaacgtgt

SEQ ID NO: 1379444 - DNA, 22 bp, Artificial Sequence
  chemically synthesized
cagcccctttgtaaacgtgtaa

SEQ ID NO: 1379445 - DNA, 22 bp, Artificial Sequence
  chemically synthesized
agcccctttgtaaacgtgtaac

SEQ ID NO: 1379446 - DNA, 22 bp, Artificial Sequence
  chemically synthesized
aagatgtgttactccgttacac

SEQ ID NO: 1379447 - DNA, 22 bp, Artificial Sequence
  chemically synthesized
ttcaagatgtgttactccgtta

SEQ ID NO: 1379448 - DNA, 22 bp, Artificial Sequence
  chemically synthesized
tgtaaacgtgtaacggagtaac

SEQ ID NO: 1379449 - DNA, 22 bp, Artificial Sequence
  chemically synthesized
gtaaacgtgtaacggagtaaca

SEQ ID NO: 1379450 - DNA, 22 bp, Artificial Sequence
  chemically synthesized
taaacgtgtaacggagtaacac

SEQ ID NO: 1379451 - DNA, 22 bp, Artificial Sequence
  chemically synthesized
gaattgttcaagatgtgttact

SEQ ID NO: 1379452 - DNA, 22 bp, Artificial Sequence
  chemically synthesized
cacatatcgtaaaatggtgact

SEQ ID NO: 1379453 - DNA, 22 bp, Artificial Sequence
  chemically synthesized
gcacatatcgtaaaatggtgac

SEQ ID NO: 1379454 - DNA, 22 bp, Artificial Sequence
  chemically synthesized
gaacaattctagtcaccatttt

SEQ ID NO: 1379455 - DNA, 22 bp, Artificial Sequence
  chemically synthesized
tgcacatatcgtaaaatggtga

SEQ ID NO: 1379456 - DNA, 22 bp, Artificial Sequence
  chemically synthesized
aacaattctagtcaccatttta

SEQ ID NO: 1379457 - DNA, 22 bp, Artificial Sequence
  chemically synthesized
ttgcacatatcgtaaaatggtg

SEQ ID NO: 1379458 - DNA, 22 bp, Artificial Sequence
  chemically synthesized
aatttttgcacatatcgtaaaa

SEQ ID NO: 1379459 - DNA, 22 bp, Artificial Sequence
  chemically synthesized
tagtcaccattttacgatatgt

SEQ ID NO: 1379460 - DNA, 22 bp, Artificial Sequence
  chemically synthesized
gtcaccattttacgatatgtgc

SEQ ID NO: 1379461 - DNA, 22 bp, Artificial Sequence
  chemically synthesized
cagtccctgaatttttgcacat

SEQ ID NO: 1379462 - DNA, 22 bp, Artificial Sequence
  chemically synthesized
acagtccctgaatttttgcaca

SEQ ID NO: 1379463 - DNA, 22 bp, Artificial Sequence
  chemically synthesized
tacgatatgtgcaaaaattcag

SEQ ID NO: 1379464 - DNA, 22 bp, Artificial Sequence
  chemically synthesized
tacttacagtccctgaattttt

SEQ ID NO: 1379465 - DNA, 22 bp, Artificial Sequence
  chemically synthesized
acgatatgtgcaaaaattcagg

SEQ ID NO: 1379466 - DNA, 22 bp, Artificial Sequence
  chemically synthesized
cgatatgtgcaaaaattcaggg

SEQ ID NO: 1379467 - DNA, 22 bp, Artificial Sequence
  chemically synthesized
taggtaggttatacttacagtc

SEQ ID NO: 1379468 - DNA, 22 bp, Artificial Sequence
  chemically synthesized
agggactgtaagtataacctac

SEQ ID NO: 1379469 - DNA, 22 bp, Artificial Sequence
  chemically synthesized
aaaatagaaaaattgtaggtag

SEQ ID NO: 1379470 - DNA, 22 bp, Artificial Sequence
  chemically synthesized
taagtataacctacctacaatt

SEQ ID NO: 1379471 - DNA, 22 bp, Artificial Sequence
  chemically synthesized
tgaaaatagaaaaattgtaggt

SEQ ID NO: 1379472 - DNA, 22 bp, Artificial Sequence
  chemically synthesized
ctgaaaatagaaaaattgtagg

SEQ ID NO: 1379473 - DNA, 22 bp, Artificial Sequence
  chemically synthesized
tctgaaaatagaaaaattgtag

SEQ ID NO: 1379474 - DNA, 22 bp, Artificial Sequence
  chemically synthesized
cctacaatttttctattttcag

SEQ ID NO: 1379475 - DNA, 22 bp, Artificial Sequence
  chemically synthesized
caatttttctattttcagaaag

SEQ ID NO: 1379476 - DNA, 22 bp, Artificial Sequence
  chemically synthesized
ttctattttcagaaagccatac

SEQ ID NO: 1379477 - DNA, 22 bp, Artificial Sequence
  chemically synthesized
tctattttcagaaagccatact

SEQ ID NO: 1379478 - DNA, 22 bp, Artificial Sequence
  chemically synthesized
ctattttcagaaagccatactt

SEQ ID NO: 1379479 - DNA, 22 bp, Artificial Sequence
  chemically synthesized
tattttcagaaagccatacttg

SEQ ID NO: 1379480 - DNA, 22 bp, Artificial Sequence
  chemically synthesized
ttttcagaaagccatacttgct

SEQ ID NO: 1379481 - DNA, 22 bp, Artificial Sequence
  chemically synthesized
atcacaccaaaagagcaagtat

SEQ ID NO: 1379482 - DNA, 22 bp, Artificial Sequence
  chemically synthesized
gatcacaccaaaagagcaagta

SEQ ID NO: 1379483 - DNA, 22 bp, Artificial Sequence
  chemically synthesized
tcagaaagccatacttgctctt

SEQ ID NO: 1379484 - DNA, 22 bp, Artificial Sequence
  chemically synthesized
cagaaagccatacttgctcttt

SEQ ID NO: 1379485 - DNA, 22 bp, Artificial Sequence
  chemically synthesized
agaaagccatacttgctctttt

SEQ ID NO: 1379486 - DNA, 22 bp, Artificial Sequence
  chemically synthesized
cagaaaccccttgatcacacca

SEQ ID NO: 1379487 - DNA, 22 bp, Artificial Sequence
  chemically synthesized
gctcttttggtgtgatcaaggg

SEQ ID NO: 1379488 - DNA, 22 bp, Artificial Sequence
  chemically synthesized
ctcttttggtgtgatcaagggg

SEQ ID NO: 1379489 - DNA, 22 bp, Artificial Sequence
  chemically synthesized
ggtctccagaaaccccttgatc

SEQ ID NO: 1379490 - DNA, 22 bp, Artificial Sequence
  chemically synthesized
tcggtctccagaaaccccttga

SEQ ID NO: 1379491 - DNA, 22 bp, Artificial Sequence
  chemically synthesized
ttttggtgtgatcaaggggttt

SEQ ID NO: 1379492 - DNA, 22 bp, Artificial Sequence
  chemically synthesized
ctcggtctccagaaaccccttg

SEQ ID NO: 1379493 - DNA, 22 bp, Artificial Sequence
  chemically synthesized
ttggtgtgatcaaggggtttct

SEQ ID NO: 1379494 - DNA, 22 bp, Artificial Sequence
  chemically synthesized
tggtgtgatcaaggggtttctg

SEQ ID NO: 1379495 - DNA, 22 bp, Artificial Sequence
  chemically synthesized
ggtgtgatcaaggggtttctgg

SEQ ID NO: 1379496 - DNA, 22 bp, Artificial Sequence
  chemically synthesized
ccttctcggtctccagaaaccc

SEQ ID NO: 1379497 - DNA, 22 bp, Artificial Sequence
  chemically synthesized
gtgtgatcaaggggtttctgga

SEQ ID NO: 1379498 - DNA, 22 bp, Artificial Sequence
  chemically synthesized
cccttctcggtctccagaaacc

SEQ ID NO: 1379499 - DNA, 22 bp, Artificial Sequence
  chemically synthesized
tcccttctcggtctccagaaac

SEQ ID NO: 1379500 - DNA, 22 bp, Artificial Sequence
  chemically synthesized
ctggagaccgagaagggaaaat

SEQ ID NO: 1379501 - DNA, 22 bp, Artificial Sequence
  chemically synthesized
agaaatggacacattttccctt

SEQ ID NO: 1379502 - DNA, 22 bp, Artificial Sequence
  chemically synthesized
tggagaccgagaagggaaaatg

SEQ ID NO: 1379503 - DNA, 22 bp, Artificial Sequence
  chemically synthesized
tcagaaatggacacattttccc

SEQ ID NO: 1379504 - DNA, 22 bp, Artificial Sequence
  chemically synthesized
gagaccgagaagggaaaatgtg

SEQ ID NO: 1379505 - DNA, 22 bp, Artificial Sequence
  chemically synthesized
ctcagaaatggacacattttcc

SEQ ID NO: 1379506 - DNA, 22 bp, Artificial Sequence
  chemically synthesized
cagtgagtgtttctcagaaatg

SEQ ID NO: 1379507 - DNA, 22 bp, Artificial Sequence
  chemically synthesized
ctacagtgagtgtttctcagaa

SEQ ID NO: 1379508 - DNA, 22 bp, Artificial Sequence
  chemically synthesized
cctacagtgagtgtttctcaga

SEQ ID NO: 1379509 - DNA, 22 bp, Artificial Sequence
  chemically synthesized
tcctacagtgagtgtttctcag

SEQ ID NO: 1379510 - DNA, 22 bp, Artificial Sequence
  chemically synthesized
tttcctacagtgagtgtttctc

SEQ ID NO: 1379511 - DNA, 22 bp, Artificial Sequence
  chemically synthesized
ctttcctacagtgagtgtttct

SEQ ID NO: 1379512 - DNA, 22 bp, Artificial Sequence
  chemically synthesized
ctgagaaacactcactgtagga

SEQ ID NO: 1379513 - DNA, 22 bp, Artificial Sequence
  chemically synthesized
tgagaaacactcactgtaggaa

SEQ ID NO: 1379514 - DNA, 22 bp, Artificial Sequence
  chemically synthesized
agaaacactcactgtaggaaag

SEQ ID NO: 1379515 - DNA, 22 bp, Artificial Sequence
  chemically synthesized
aatgcaaatagcaccttctttc

SEQ ID NO: 1379516 - DNA, 22 bp, Artificial Sequence
  chemically synthesized
actgtaggaaagaaggtgctat

SEQ ID NO: 1379517 - DNA, 22 bp, Artificial Sequence
  chemically synthesized
cattaaatgcaaatagcacctt

SEQ ID NO: 1379518 - DNA, 22 bp, Artificial Sequence
  chemically synthesized
acattaaatgcaaatagcacct

SEQ ID NO: 1379519 - DNA, 22 bp, Artificial Sequence
  chemically synthesized
taggaaagaaggtgctatttgc

SEQ ID NO: 1379520 - DNA, 22 bp, Artificial Sequence
  chemically synthesized
tttgcatttaatgtaaatacca

SEQ ID NO: 1379521 - DNA, 22 bp, Artificial Sequence
  chemically synthesized
aaaggaacgaaagtggtattta

SEQ ID NO: 1379522 - DNA, 22 bp, Artificial Sequence
  chemically synthesized
gcatttaatgtaaataccactt

SEQ ID NO: 1379523 - DNA, 22 bp, Artificial Sequence
  chemically synthesized
catttaatgtaaataccacttt

SEQ ID NO: 1379524 - DNA, 22 bp, Artificial Sequence
  chemically synthesized
attaaaaggaacgaaagtggta

SEQ ID NO: 1379525 - DNA, 22 bp, Artificial Sequence
  chemically synthesized
aattaaaaggaacgaaagtggt

SEQ ID NO: 1379526 - DNA, 22 bp, Artificial Sequence
  chemically synthesized
taattaaaaggaacgaaagtgg

SEQ ID NO: 1379527 - DNA, 22 bp, Artificial Sequence
  chemically synthesized
ttaattaaaaggaacgaaagtg

SEQ ID NO: 1379528 - DNA, 22 bp, Artificial Sequence
  chemically synthesized
aatgtaaataccactttcgttc

SEQ ID NO: 1379529 - DNA, 22 bp, Artificial Sequence
  chemically synthesized
atgtaaataccactttcgttcc

SEQ ID NO: 1379530 - DNA, 22 bp, Artificial Sequence
  chemically synthesized
ttttaattaaaaggaacgaaag

SEQ ID NO: 1379531 - DNA, 22 bp, Artificial Sequence
  chemically synthesized
tcttttaattaaaaggaacgaa

SEQ ID NO: 1379532 - DNA, 22 bp, Artificial Sequence
  chemically synthesized
ctcttttaattaaaaggaacga

SEQ ID NO: 1379533 - DNA, 22 bp, Artificial Sequence
  chemically synthesized
tttctcttttaattaaaaggaa

SEQ ID NO: 1379534 - DNA, 22 bp, Artificial Sequence
  chemically synthesized
tgtttctcttttaattaaaagg

SEQ ID NO: 1379535 - DNA, 22 bp, Artificial Sequence
  chemically synthesized
ctgtttctcttttaattaaaag

SEQ ID NO: 1379536 - DNA, 22 bp, Artificial Sequence
  chemically synthesized
tcgttccttttaattaaaagag

SEQ ID NO: 1379537 - DNA, 22 bp, Artificial Sequence
  chemically synthesized
cgttccttttaattaaaagaga

SEQ ID NO: 1379538 - DNA, 22 bp, Artificial Sequence
  chemically synthesized
gttccttttaattaaaagagaa

SEQ ID NO: 1379539 - DNA, 22 bp, Artificial Sequence
  chemically synthesized
cttttaattaaaagagaaacag

SEQ ID NO: 1379540 - DNA, 22 bp, Artificial Sequence
  chemically synthesized
ttaattaaaagagaaacagaaa

SEQ ID NO: 1379541 - DNA, 22 bp, Artificial Sequence
  chemically synthesized
taattaaaagagaaacagaaac

SEQ ID NO: 1379542 - DNA, 22 bp, Artificial Sequence
  chemically synthesized
gaatatagaagggtttctgttt

SEQ ID NO: 1379543 - DNA, 22 bp, Artificial Sequence
  chemically synthesized
aattaaaagagaaacagaaacc

SEQ ID NO: 1379544 - DNA, 22 bp, Artificial Sequence
  chemically synthesized
agaatatagaagggtttctgtt

SEQ ID NO: 1379545 - DNA, 22 bp, Artificial Sequence
  chemically synthesized
attaaaagagaaacagaaaccc

SEQ ID NO: 1379546 - DNA, 22 bp, Artificial Sequence
  chemically synthesized
aaagagaaacagaaacccttct

SEQ ID NO: 1379547 - DNA, 22 bp, Artificial Sequence
  chemically synthesized
tgtttagaatatagaagggttt

SEQ ID NO: 1379548 - DNA, 22 bp, Artificial Sequence
  chemically synthesized
atgtttagaatatagaagggtt

SEQ ID NO: 1379549 - DNA, 22 bp, Artificial Sequence
  chemically synthesized
tatgtttagaatatagaagggt

SEQ ID NO: 1379550 - DNA, 22 bp, Artificial Sequence
  chemically synthesized
ttatgtttagaatatagaaggg

SEQ ID NO: 1379551 - DNA, 22 bp, Artificial Sequence
  chemically synthesized
tttatgtttagaatatagaagg

SEQ ID NO: 1379552 - DNA, 22 bp, Artificial Sequence
  chemically synthesized
ttttttatgtttagaatataga

SEQ ID NO: 1379553 - DNA, 22 bp, Artificial Sequence
  chemically synthesized
attttttatgtttagaatatag

SEQ ID NO: 1379554 - DNA, 22 bp, Artificial Sequence
  chemically synthesized
tattttttatgtttagaatata

SEQ ID NO: 1379555 - DNA, 22 bp, Artificial Sequence
  chemically synthesized
ttattttttatgtttagaatat

SEQ ID NO: 1379556 - DNA, 22 bp, Artificial Sequence
  chemically synthesized
ctatattctaaacataaaaaat

SEQ ID NO: 1379557 - DNA, 22 bp, Artificial Sequence
  chemically synthesized
tatattctaaacataaaaaata

SEQ ID NO: 1379558 - DNA, 22 bp, Artificial Sequence
  chemically synthesized
agaaaaaacttttattttttat

SEQ ID NO: 1379559 - DNA, 22 bp, Artificial Sequence
  chemically synthesized
tattctaaacataaaaaataaa

SEQ ID NO: 1379560 - DNA, 22 bp, Artificial Sequence
  chemically synthesized
taaacataaaaaataaaagttt

SEQ ID NO: 1379561 - DNA, 22 bp, Artificial Sequence
  chemically synthesized
ccatattgagaaaaaactttta

SEQ ID NO: 1379562 - DNA, 22 bp, Artificial Sequence
  chemically synthesized
aacataaaaaataaaagttttt

SEQ ID NO: 1379563 - DNA, 22 bp, Artificial Sequence
  chemically synthesized
caatcaactaccatattgagaa

SEQ ID NO: 1379564 - DNA, 22 bp, Artificial Sequence
  chemically synthesized
gcaatcaactaccatattgaga

SEQ ID NO: 1379565 - DNA, 22 bp, Artificial Sequence
  chemically synthesized
tgcaatcaactaccatattgag

SEQ ID NO: 1379566 - DNA, 22 bp, Artificial Sequence
  chemically synthesized
tttctcaatatggtagttgatt

SEQ ID NO: 1379567 - DNA, 22 bp, Artificial Sequence
  chemically synthesized
ttctcaatatggtagttgattg

SEQ ID NO: 1379568 - DNA, 22 bp, Artificial Sequence
  chemically synthesized
tctcaatatggtagttgattgc

SEQ ID NO: 1379569 - DNA, 22 bp, Artificial Sequence
  chemically synthesized
ctcaatatggtagttgattgca

SEQ ID NO: 1379570 - DNA, 22 bp, Artificial Sequence
  chemically synthesized
tcaatatggtagttgattgcaa

SEQ ID NO: 1379571 - DNA, 22 bp, Artificial Sequence
  chemically synthesized
aatatggtagttgattgcaaag

SEQ ID NO: 1379572 - DNA, 22 bp, Artificial Sequence
  chemically synthesized
catacagaatggtctttgcaat

SEQ ID NO: 1379573 - DNA, 22 bp, Artificial Sequence
  chemically synthesized
tacatacagaatggtctttgca

SEQ ID NO: 1379574 - DNA, 22 bp, Artificial Sequence
  chemically synthesized
attgcaaagaccattctgtatg

SEQ ID NO: 1379575 - DNA, 22 bp, Artificial Sequence
  chemically synthesized
caaagaccattctgtatgtaga

SEQ ID NO: 1379576 - DNA, 22 bp, Artificial Sequence
  chemically synthesized
gagggaggaccatctctacata

SEQ ID NO: 1379577 - DNA, 22 bp, Artificial Sequence
  chemically synthesized
tgtatgtagagatggtcctccc

SEQ ID NO: 1379578 - DNA, 22 bp, Artificial Sequence
  chemically synthesized
aaaaaaattggagggaggacca

SEQ ID NO: 1379579 - DNA, 22 bp, Artificial Sequence
  chemically synthesized
tatgtagagatggtcctccctc

SEQ ID NO: 1379580 - DNA, 22 bp, Artificial Sequence
  chemically synthesized
cctccaattttttttagcatca

SEQ ID NO: 1379581 - DNA, 22 bp, Artificial Sequence
  chemically synthesized
aatgaaaatagcatgatgctaa

SEQ ID NO: 1379582 - DNA, 22 bp, Artificial Sequence
  chemically synthesized
taaatgaaaatagcatgatgct

SEQ ID NO: 1379583 - DNA, 22 bp, Artificial Sequence
  chemically synthesized
caattttttttagcatcatgct

SEQ ID NO: 1379584 - DNA, 22 bp, Artificial Sequence
  chemically synthesized
ctaaatgaaaatagcatgatgc

SEQ ID NO: 1379585 - DNA, 22 bp, Artificial Sequence
  chemically synthesized
tctaaatgaaaatagcatgatg

SEQ ID NO: 1379586 - DNA, 22 bp, Artificial Sequence
  chemically synthesized
tttttagcatcatgctattttc

SEQ ID NO: 1379587 - DNA, 22 bp, Artificial Sequence
  chemically synthesized
ttttagcatcatgctattttca

SEQ ID NO: 1379588 - DNA, 22 bp, Artificial Sequence
  chemically synthesized
tttagcatcatgctattttcat

SEQ ID NO: 1379589 - DNA, 22 bp, Artificial Sequence
  chemically synthesized
ttagcatcatgctattttcatt

SEQ ID NO: 1379590 - DNA, 22 bp, Artificial Sequence
  chemically synthesized
tagcatcatgctattttcattt

SEQ ID NO: 1379591 - DNA, 22 bp, Artificial Sequence
  chemically synthesized
agcatcatgctattttcattta

SEQ ID NO: 1379592 - DNA, 22 bp, Artificial Sequence
  chemically synthesized
atgtgacctttctaaatgaaaa

SEQ ID NO: 1379593 - DNA, 22 bp, Artificial Sequence
  chemically synthesized
gcatcatgctattttcatttag

SEQ ID NO: 1379594 - DNA, 22 bp, Artificial Sequence
  chemically synthesized
ttttcatttagaaaggtcacat

SEQ ID NO: 1379595 - DNA, 22 bp, Artificial Sequence
  chemically synthesized
agcaaaagactcatgtgacctt

SEQ ID NO: 1379596 - DNA, 22 bp, Artificial Sequence
  chemically synthesized
cagcaaaagactcatgtgacct

SEQ ID NO: 1379597 - DNA, 22 bp, Artificial Sequence
  chemically synthesized
tcatttagaaaggtcacatgag

SEQ ID NO: 1379598 - DNA, 22 bp, Artificial Sequence
  chemically synthesized
catttagaaaggtcacatgagt

SEQ ID NO: 1379599 - DNA, 22 bp, Artificial Sequence
  chemically synthesized
atttagaaaggtcacatgagtc

SEQ ID NO: 1379600 - DNA, 22 bp, Artificial Sequence
  chemically synthesized
gtttcagcaaaagactcatgtg

SEQ ID NO: 1379601 - DNA, 22 bp, Artificial Sequence
  chemically synthesized
agaaaggtcacatgagtctttt

SEQ ID NO: 1379602 - DNA, 22 bp, Artificial Sequence
  chemically synthesized
gaaaggtcacatgagtcttttg

SEQ ID NO: 1379603 - DNA, 22 bp, Artificial Sequence
  chemically synthesized
ggaaaatcacattggtttcagc

SEQ ID NO: 1379604 - DNA, 22 bp, Artificial Sequence
  chemically synthesized
ttaggaaaatcacattggtttc

SEQ ID NO: 1379605 - DNA, 22 bp, Artificial Sequence
  chemically synthesized
attaggaaaatcacattggttt

SEQ ID NO: 1379606 - DNA, 22 bp, Artificial Sequence
  chemically synthesized
ttgctgaaaccaatgtgatttt

SEQ ID NO: 1379607 - DNA, 22 bp, Artificial Sequence
  chemically synthesized
tgctgaaaccaatgtgattttc

SEQ ID NO: 1379608 - DNA, 22 bp, Artificial Sequence
  chemically synthesized
gctgaaaccaatgtgattttcc

SEQ ID NO: 1379609 - DNA, 22 bp, Artificial Sequence
  chemically synthesized
ctgaaaccaatgtgattttcct

SEQ ID NO: 1379610 - DNA, 22 bp, Artificial Sequence
  chemically synthesized
aaaccaatgtgattttcctaat

SEQ ID NO: 1379611 - DNA, 22 bp, Artificial Sequence
  chemically synthesized
gcatggtgagcttattaggaaa

SEQ ID NO: 1379612 - DNA, 22 bp, Artificial Sequence
  chemically synthesized
agcatggtgagcttattaggaa

SEQ ID NO: 1379613 - DNA, 22 bp, Artificial Sequence
  chemically synthesized
gatcacttagcatggtgagctt

SEQ ID NO: 1379614 - DNA, 22 bp, Artificial Sequence
  chemically synthesized
ttggatcacttagcatggtgag

SEQ ID NO: 1379615 - DNA, 22 bp, Artificial Sequence
  chemically synthesized
tcctaataagctcaccatgcta

SEQ ID NO: 1379616 - DNA, 22 bp, Artificial Sequence
  chemically synthesized
tgttggatcacttagcatggtg

SEQ ID NO: 1379617 - DNA, 22 bp, Artificial Sequence
  chemically synthesized
cctaataagctcaccatgctaa

SEQ ID NO: 1379618 - DNA, 22 bp, Artificial Sequence
  chemically synthesized
ctaataagctcaccatgctaag

SEQ ID NO: 1379619 - DNA, 22 bp, Artificial Sequence
  chemically synthesized
ataagctcaccatgctaagtga

SEQ ID NO: 1379620 - DNA, 22 bp, Artificial Sequence
  chemically synthesized
accatgctaagtgatccaacag

SEQ ID NO: 1379621 - DNA, 22 bp, Artificial Sequence
  chemically synthesized
acaaacagagcaattctgttgg

SEQ ID NO: 1379622 - DNA, 22 bp, Artificial Sequence
  chemically synthesized
ttaacaaacagagcaattctgt

SEQ ID NO: 1379623 - DNA, 22 bp, Artificial Sequence
  chemically synthesized
attaacaaacagagcaattctg

SEQ ID NO: 1379624 - DNA, 22 bp, Artificial Sequence
  chemically synthesized
agtgatccaacagaattgctct

SEQ ID NO: 1379625 - DNA, 22 bp, Artificial Sequence
  chemically synthesized
cttattaacaaacagagcaatt

SEQ ID NO: 1379626 - DNA, 22 bp, Artificial Sequence
  chemically synthesized
tccttattaacaaacagagcaa

SEQ ID NO: 1379627 - DNA, 22 bp, Artificial Sequence
  chemically synthesized
ctctccttattaacaaacagag

SEQ ID NO: 1379628 - DNA, 22 bp, Artificial Sequence
  chemically synthesized
actctccttattaacaaacaga

SEQ ID NO: 1379629 - DNA, 22 bp, Artificial Sequence
  chemically synthesized
ctctgtttgttaataaggagag

SEQ ID NO: 1379630 - DNA, 22 bp, Artificial Sequence
  chemically synthesized
tgtttgttaataaggagagtaa

SEQ ID NO: 1379631 - DNA, 22 bp, Artificial Sequence
  chemically synthesized
tttgttaataaggagagtaaat

SEQ ID NO: 1379632 - DNA, 22 bp, Artificial Sequence
  chemically synthesized
tcaagtaatgtcatttactctc

SEQ ID NO: 1379633 - DNA, 22 bp, Artificial Sequence
  chemically synthesized
tgtcaagtaatgtcatttactc

SEQ ID NO: 1379634 - DNA, 22 bp, Artificial Sequence
  chemically synthesized
gttaataaggagagtaaatgac

SEQ ID NO: 1379635 - DNA, 22 bp, Artificial Sequence
  chemically synthesized
ctgtcaagtaatgtcatttact

SEQ ID NO: 1379636 - DNA, 22 bp, Artificial Sequence
  chemically synthesized
ttaataaggagagtaaatgaca

SEQ ID NO: 1379637 - DNA, 22 bp, Artificial Sequence
  chemically synthesized
ataaggagagtaaatgacatta

SEQ ID NO: 1379638 - DNA, 22 bp, Artificial Sequence
  chemically synthesized
aaagagcgtttctgtcaagtaa

SEQ ID NO: 1379639 - DNA, 22 bp, Artificial Sequence
  chemically synthesized
cttgacagaaacgctctttcaa

SEQ ID NO: 1379640 - DNA, 22 bp, Artificial Sequence
  chemically synthesized
gaataaaccaccattgaaagag

SEQ ID NO: 1379641 - DNA, 22 bp, Artificial Sequence
  chemically synthesized
ggaataaaccaccattgaaaga

SEQ ID NO: 1379642 - DNA, 22 bp, Artificial Sequence
  chemically synthesized
gacagaaacgctctttcaatgg

SEQ ID NO: 1379643 - DNA, 22 bp, Artificial Sequence
  chemically synthesized
acagaaacgctctttcaatggt

SEQ ID NO: 1379644 - DNA, 22 bp, Artificial Sequence
  chemically synthesized
ttggaataaaccaccattgaaa

SEQ ID NO: 1379645 - DNA, 22 bp, Artificial Sequence
  chemically synthesized
atctcttggaataaaccaccat

SEQ ID NO: 1379646 - DNA, 22 bp, Artificial Sequence
  chemically synthesized
tttcaatggtggtttattccaa

SEQ ID NO: 1379647 - DNA, 22 bp, Artificial Sequence
  chemically synthesized
tcaatggtggtttattccaaga

SEQ ID NO: 1379648 - DNA, 22 bp, Artificial Sequence
  chemically synthesized
caatggtggtttattccaagag

SEQ ID NO: 1379649 - DNA, 22 bp, Artificial Sequence
  chemically synthesized
aatggtggtttattccaagaga

SEQ ID NO: 1379650 - DNA, 22 bp, Artificial Sequence
  chemically synthesized
gacaagtaaggatgaattaatc

SEQ ID NO: 1379651 - DNA, 22 bp, Artificial Sequence
  chemically synthesized
attccaagagattaattcatcc

SEQ ID NO: 1379652 - DNA, 22 bp, Artificial Sequence
  chemically synthesized
ttccaagagattaattcatcct

SEQ ID NO: 1379653 - DNA, 22 bp, Artificial Sequence
  chemically synthesized
caagagattaattcatccttac

SEQ ID NO: 1379654 - DNA, 22 bp, Artificial Sequence
  chemically synthesized
attcatccttacttgtccagtg

SEQ ID NO: 1379655 - DNA, 22 bp, Artificial Sequence
  chemically synthesized
ataacgtatatgtgacactgga

SEQ ID NO: 1379656 - DNA, 22 bp, Artificial Sequence
  chemically synthesized
atccttacttgtccagtgtcac

SEQ ID NO: 1379657 - DNA, 22 bp, Artificial Sequence
  chemically synthesized
aataacgtatatgtgacactgg

SEQ ID NO: 1379658 - DNA, 22 bp, Artificial Sequence
  chemically synthesized
acttgtccagtgtcacatatac

SEQ ID NO: 1379659 - DNA, 22 bp, Artificial Sequence
  chemically synthesized
cttgtccagtgtcacatatacg

SEQ ID NO: 1379660 - DNA, 22 bp, Artificial Sequence
  chemically synthesized
catatttaataacgtatatgtg

SEQ ID NO: 1379661 - DNA, 22 bp, Artificial Sequence
  chemically synthesized
gtccagtgtcacatatacgtta

SEQ ID NO: 1379662 - DNA, 22 bp, Artificial Sequence
  chemically synthesized
tccagtgtcacatatacgttat

SEQ ID NO: 1379663 - DNA, 22 bp, Artificial Sequence
  chemically synthesized
cattgcatatttaataacgtat

SEQ ID NO: 1379664 - DNA, 22 bp, Artificial Sequence
  chemically synthesized
aataagaaggatgctacattgc

SEQ ID NO: 1379665 - DNA, 22 bp, Artificial Sequence
  chemically synthesized
ttaaatatgcaatgtagcatcc

SEQ ID NO: 1379666 - DNA, 22 bp, Artificial Sequence
  chemically synthesized
aatatgcaatgtagcatccttc

SEQ ID NO: 1379667 - DNA, 22 bp, Artificial Sequence
  chemically synthesized
tcataattgaataagaaggatg

SEQ ID NO: 1379668 - DNA, 22 bp, Artificial Sequence
  chemically synthesized
ataaaacagcaaattatcataa

SEQ ID NO: 1379669 - DNA, 22 bp, Artificial Sequence
  chemically synthesized
cttattcaattatgataatttg

SEQ ID NO: 1379670 - DNA, 22 bp, Artificial Sequence
  chemically synthesized
ttattcaattatgataatttgc

SEQ ID NO: 1379671 - DNA, 22 bp, Artificial Sequence
  chemically synthesized
attcaattatgataatttgctg

SEQ ID NO: 1379672 - DNA, 22 bp, Artificial Sequence
  chemically synthesized
ttcaattatgataatttgctgt

SEQ ID NO: 1379673 - DNA, 22 bp, Artificial Sequence
  chemically synthesized
caagtattaataaaacagcaaa

SEQ ID NO: 1379674 - DNA, 22 bp, Artificial Sequence
  chemically synthesized
aattatgataatttgctgtttt

SEQ ID NO: 1379675 - DNA, 22 bp, Artificial Sequence
  chemically synthesized
ccaagtattaataaaacagcaa

SEQ ID NO: 1379676 - DNA, 22 bp, Artificial Sequence
  chemically synthesized
tttccaagtattaataaaacag

SEQ ID NO: 1379677 - DNA, 22 bp, Artificial Sequence
  chemically synthesized
atttccaagtattaataaaaca

SEQ ID NO: 1379678 - DNA, 22 bp, Artificial Sequence
  chemically synthesized
tgataatttgctgttttattaa

SEQ ID NO: 1379679 - DNA, 22 bp, Artificial Sequence
  chemically synthesized
tatttccaagtattaataaaac

SEQ ID NO: 1379680 - DNA, 22 bp, Artificial Sequence
  chemically synthesized
gctgttttattaatacttggaa

SEQ ID NO: 1379681 - DNA, 22 bp, Artificial Sequence
  chemically synthesized
ctgttttattaatacttggaaa

SEQ ID NO: 1379682 - DNA, 22 bp, Artificial Sequence
  chemically synthesized
ttttattaatacttggaaataa

SEQ ID NO: 1379683 - DNA, 22 bp, Artificial Sequence
  chemically synthesized
tattaatacttggaaataaaat

SEQ ID NO: 1379684 - DNA, 22 bp, Artificial Sequence
  chemically synthesized
attaatacttggaaataaaata

SEQ ID NO: 1379685 - DNA, 22 bp, Artificial Sequence
  chemically synthesized
ttaatacttggaaataaaatat

SEQ ID NO: 1379686 - DNA, 22 bp, Artificial Sequence
  chemically synthesized
atggatggagtgatatatttta

SEQ ID NO: 1379687 - DNA, 22 bp, Artificial Sequence
  chemically synthesized
atacttggaaataaaatatatc

SEQ ID NO: 1379688 - DNA, 22 bp, Artificial Sequence
  chemically synthesized
ctaatggatggagtgatatatt

SEQ ID NO: 1379689 - DNA, 22 bp, Artificial Sequence
  chemically synthesized
ggaaataaaatatatcactcca

SEQ ID NO: 1379690 - DNA, 22 bp, Artificial Sequence
  chemically synthesized
gaaataaaatatatcactccat

SEQ ID NO: 1379691 - DNA, 22 bp, Artificial Sequence
  chemically synthesized
atcaccgtgattactaatggat

SEQ ID NO: 1379692 - DNA, 22 bp, Artificial Sequence
  chemically synthesized
catcaccgtgattactaatgga

SEQ ID NO: 1379693 - DNA, 22 bp, Artificial Sequence
  chemically synthesized
catccattagtaatcacggtga

SEQ ID NO: 1379694 - DNA, 22 bp, Artificial Sequence
  chemically synthesized
gtaatcacggtgatgaaactat

SEQ ID NO: 1379695 - DNA, 22 bp, Artificial Sequence
  chemically synthesized
atatggtatcacatagtttcat

SEQ ID NO: 1379696 - DNA, 22 bp, Artificial Sequence
  chemically synthesized
taatatggtatcacatagtttc

SEQ ID NO: 1379697 - DNA, 22 bp, Artificial Sequence
  chemically synthesized
ctaatatggtatcacatagttt

SEQ ID NO: 1379698 - DNA, 22 bp, Artificial Sequence
  chemically synthesized
cttctaatatggtatcacatag

SEQ ID NO: 1379699 - DNA, 22 bp, Artificial Sequence
  chemically synthesized
gcttctaatatggtatcacata

SEQ ID NO: 1379700 - DNA, 22 bp, Artificial Sequence
  chemically synthesized
gacttgcttctaatatggtatc

SEQ ID NO: 1379701 - DNA, 22 bp, Artificial Sequence
  chemically synthesized
ggacttgcttctaatatggtat

SEQ ID NO: 1379702 - DNA, 22 bp, Artificial Sequence
  chemically synthesized
ataccttggacttgcttctaat

SEQ ID NO: 1379703 - DNA, 22 bp, Artificial Sequence
  chemically synthesized
tgtgataccatattagaagcaa

SEQ ID NO: 1379704 - DNA, 22 bp, Artificial Sequence
  chemically synthesized
taataccttggacttgcttcta

SEQ ID NO: 1379705 - DNA, 22 bp, Artificial Sequence
  chemically synthesized
aacatggatctctaataccttg

SEQ ID NO: 1379706 - DNA, 22 bp, Artificial Sequence
  chemically synthesized
gaagcaagtccaaggtattaga

SEQ ID NO: 1379707 - DNA, 22 bp, Artificial Sequence
  chemically synthesized
tagaagttgaacatggatctct

SEQ ID NO: 1379708 - DNA, 22 bp, Artificial Sequence
  chemically synthesized
atagaagttgaacatggatctc

SEQ ID NO: 1379709 - DNA, 22 bp, Artificial Sequence
  chemically synthesized
tatagaagttgaacatggatct

SEQ ID NO: 1379710 - DNA, 22 bp, Artificial Sequence
  chemically synthesized
ccattttatagaagttgaacat

SEQ ID NO: 1379711 - DNA, 22 bp, Artificial Sequence
  chemically synthesized
accattttatagaagttgaaca

SEQ ID NO: 1379712 - DNA, 22 bp, Artificial Sequence
  chemically synthesized
gagatccatgttcaacttctat

SEQ ID NO: 1379713 - DNA, 22 bp, Artificial Sequence
  chemically synthesized
tcgaacttaccattttatagaa

SEQ ID NO: 1379714 - DNA, 22 bp, Artificial Sequence
  chemically synthesized
atcgaacttaccattttataga

SEQ ID NO: 1379715 - DNA, 22 bp, Artificial Sequence
  chemically synthesized
aacttctataaaatggtaagtt

SEQ ID NO: 1379716 - DNA, 22 bp, Artificial Sequence
  chemically synthesized
ctataaaatggtaagttcgata

SEQ ID NO: 1379717 - DNA, 22 bp, Artificial Sequence
  chemically synthesized
tgcaaaatggcttatcgaactt

SEQ ID NO: 1379718 - DNA, 22 bp, Artificial Sequence
  chemically synthesized
tataaaatggtaagttcgataa

SEQ ID NO: 1379719 - DNA, 22 bp, Artificial Sequence
  chemically synthesized
taaaatggtaagttcgataagc

SEQ ID NO: 1379720 - DNA, 22 bp, Artificial Sequence
  chemically synthesized
gaaaaatataactgtgcaaaat

SEQ ID NO: 1379721 - DNA, 22 bp, Artificial Sequence
  chemically synthesized
ggaaaaatataactgtgcaaaa

SEQ ID NO: 1379722 - DNA, 22 bp, Artificial Sequence
  chemically synthesized
gataagccattttgcacagtta

SEQ ID NO: 1379723 - DNA, 22 bp, Artificial Sequence
  chemically synthesized
tgcacagttatatttttccaag

SEQ ID NO: 1379724 - DNA, 22 bp, Artificial Sequence
  chemically synthesized
aaggacaagaagcttggaaaaa

SEQ ID NO: 1379725 - DNA, 22 bp, Artificial Sequence
  chemically synthesized
gcacagttatatttttccaagc

SEQ ID NO: 1379726 - DNA, 22 bp, Artificial Sequence
  chemically synthesized
cacagttatatttttccaagct

SEQ ID NO: 1379727 - DNA, 22 bp, Artificial Sequence
  chemically synthesized
aatctgaaggacaagaagcttg

SEQ ID NO: 1379728 - DNA, 22 bp, Artificial Sequence
  chemically synthesized
tatttttccaagcttcttgtcc

SEQ ID NO: 1379729 - DNA, 22 bp, Artificial Sequence
  chemically synthesized
actaaatctgaaggacaagaag

SEQ ID NO: 1379730 - DNA, 22 bp, Artificial Sequence
  chemically synthesized
ttccaagcttcttgtccttcag

SEQ ID NO: 1379731 - DNA, 22 bp, Artificial Sequence
  chemically synthesized
tccaagcttcttgtccttcaga

SEQ ID NO: 1379732 - DNA, 22 bp, Artificial Sequence
  chemically synthesized
ccaagcttcttgtccttcagat

SEQ ID NO: 1379733 - DNA, 22 bp, Artificial Sequence
  chemically synthesized
accactaactaaatctgaagga

SEQ ID NO: 1379734 - DNA, 22 bp, Artificial Sequence
  chemically synthesized
caagcttcttgtccttcagatt

SEQ ID NO: 1379735 - DNA, 22 bp, Artificial Sequence
  chemically synthesized
cttgtccttcagatttagttag

SEQ ID NO: 1379736 - DNA, 22 bp, Artificial Sequence
  chemically synthesized
ttgtccttcagatttagttagt

SEQ ID NO: 1379737 - DNA, 22 bp, Artificial Sequence
  chemically synthesized
gtccttcagatttagttagtgg

SEQ ID NO: 1379738 - DNA, 22 bp, Artificial Sequence
  chemically synthesized
atagtgaattgaccactaacta

SEQ ID NO: 1379739 - DNA, 22 bp, Artificial Sequence
  chemically synthesized
tccttcagatttagttagtggt

SEQ ID NO: 1379740 - DNA, 22 bp, Artificial Sequence
  chemically synthesized
taatagtgaattgaccactaac

SEQ ID NO: 1379741 - DNA, 22 bp, Artificial Sequence
  chemically synthesized
ctctaatagtgaattgaccact

SEQ ID NO: 1379742 - DNA, 22 bp, Artificial Sequence
  chemically synthesized
cagatttagttagtggtcaatt

SEQ ID NO: 1379743 - DNA, 22 bp, Artificial Sequence
  chemically synthesized
agatttagttagtggtcaattc

SEQ ID NO: 1379744 - DNA, 22 bp, Artificial Sequence
  chemically synthesized
cattcctctaatagtgaattga

SEQ ID NO: 1379745 - DNA, 22 bp, Artificial Sequence
  chemically synthesized
agttagtggtcaattcactatt

SEQ ID NO: 1379746 - DNA, 22 bp, Artificial Sequence
  chemically synthesized
gttagtggtcaattcactatta

SEQ ID NO: 1379747 - DNA, 22 bp, Artificial Sequence
  chemically synthesized
gtggtcaattcactattagagg

SEQ ID NO: 1379748 - DNA, 22 bp, Artificial Sequence
  chemically synthesized
actattagaggaatgtaattat

SEQ ID NO: 1379749 - DNA, 22 bp, Artificial Sequence
  chemically synthesized
agtgccaaccagaaaataatta

SEQ ID NO: 1379750 - DNA, 22 bp, Artificial Sequence
  chemically synthesized
ttagaggaatgtaattattttc

SEQ ID NO: 1379751 - DNA, 22 bp, Artificial Sequence
  chemically synthesized
gaggaatgtaattattttctgg

SEQ ID NO: 1379752 - DNA, 22 bp, Artificial Sequence
  chemically synthesized
atcctcagtgccaaccagaaaa

SEQ ID NO: 1379753 - DNA, 22 bp, Artificial Sequence
  chemically synthesized
ctcatcctcagtgccaaccaga

SEQ ID NO: 1379754 - DNA, 22 bp, Artificial Sequence
  chemically synthesized
actcatcctcagtgccaaccag

SEQ ID NO: 1379755 - DNA, 22 bp, Artificial Sequence
  chemically synthesized
tcttactcatcctcagtgccaa

SEQ ID NO: 1379756 - DNA, 22 bp, Artificial Sequence
  chemically synthesized
gtcttactcatcctcagtgcca

SEQ ID NO: 1379757 - DNA, 22 bp, Artificial Sequence
  chemically synthesized
tgtcttactcatcctcagtgcc

SEQ ID NO: 1379758 - DNA, 22 bp, Artificial Sequence
  chemically synthesized
ttgtcttactcatcctcagtgc

SEQ ID NO: 1379759 - DNA, 22 bp, Artificial Sequence
  chemically synthesized
ttttctggttggcactgaggat

SEQ ID NO: 1379760 - DNA, 22 bp, Artificial Sequence
  chemically synthesized
tctggttggcactgaggatgag

SEQ ID NO: 1379761 - DNA, 22 bp, Artificial Sequence
  chemically synthesized
ctggttggcactgaggatgagt

SEQ ID NO: 1379762 - DNA, 22 bp, Artificial Sequence
  chemically synthesized
tggttggcactgaggatgagta

SEQ ID NO: 1379763 - DNA, 22 bp, Artificial Sequence
  chemically synthesized
gttggcactgaggatgagtaag

SEQ ID NO: 1379764 - DNA, 22 bp, Artificial Sequence
  chemically synthesized
gcactgaggatgagtaagacaa

SEQ ID NO: 1379765 - DNA, 22 bp, Artificial Sequence
  chemically synthesized
agtgatagggtgatttttgtct

SEQ ID NO: 1379766 - DNA, 22 bp, Artificial Sequence
  chemically synthesized
cagtgatagggtgatttttgtc

SEQ ID NO: 1379767 - DNA, 22 bp, Artificial Sequence
  chemically synthesized
aggatgagtaagacaaaaatca

SEQ ID NO: 1379768 - DNA, 22 bp, Artificial Sequence
  chemically synthesized
tggcaccttcagtgatagggtg

SEQ ID NO: 1379769 - DNA, 22 bp, Artificial Sequence
  chemically synthesized
aggctatggcaccttcagtgat

SEQ ID NO: 1379770 - DNA, 22 bp, Artificial Sequence
  chemically synthesized
gaggctatggcaccttcagtga

SEQ ID NO: 1379771 - DNA, 22 bp, Artificial Sequence
  chemically synthesized
tcactgaaggtgccatagcctc

SEQ ID NO: 1379772 - DNA, 22 bp, Artificial Sequence
  chemically synthesized
gagtgagtagggtatttgaggc

SEQ ID NO: 1379773 - DNA, 22 bp, Artificial Sequence
  chemically synthesized
aaggtgccatagcctcaaatac

SEQ ID NO: 1379774 - DNA, 22 bp, Artificial Sequence
  chemically synthesized
tataaatgcagctggagtgagt

SEQ ID NO: 1379775 - DNA, 22 bp, Artificial Sequence
  chemically synthesized
tatataaatgcagctggagtga

SEQ ID NO: 1379776 - DNA, 22 bp, Artificial Sequence
  chemically synthesized
aaataccctactcactccagct

SEQ ID NO: 1379777 - DNA, 22 bp, Artificial Sequence
  chemically synthesized
agagcctctatataaatgcagc

SEQ ID NO: 1379778 - DNA, 22 bp, Artificial Sequence
  chemically synthesized
ctcactccagctgcatttatat

SEQ ID NO: 1379779 - DNA, 22 bp, Artificial Sequence
  chemically synthesized
actccagctgcatttatataga

SEQ ID NO: 1379780 - DNA, 22 bp, Artificial Sequence
  chemically synthesized
tgcaactgagagcctctatata

SEQ ID NO: 1379781 - DNA, 22 bp, Artificial Sequence
  chemically synthesized
gtgcaactgagagcctctatat

SEQ ID NO: 1379782 - DNA, 22 bp, Artificial Sequence
  chemically synthesized
cagctgcatttatatagaggct

SEQ ID NO: 1379783 - DNA, 22 bp, Artificial Sequence
  chemically synthesized
tgtgcaactgagagcctctata

SEQ ID NO: 1379784 - DNA, 22 bp, Artificial Sequence
  chemically synthesized
ttgtgcaactgagagcctctat

SEQ ID NO: 1379785 - DNA, 22 bp, Artificial Sequence
  chemically synthesized
catttatatagaggctctcagt

SEQ ID NO: 1379786 - DNA, 22 bp, Artificial Sequence
  chemically synthesized
atcttttgtgcaactgagagcc

SEQ ID NO: 1379787 - DNA, 22 bp, Artificial Sequence
  chemically synthesized
gatcttttgtgcaactgagagc

SEQ ID NO: 1379788 - DNA, 22 bp, Artificial Sequence
  chemically synthesized
atatagaggctctcagttgcac

SEQ ID NO: 1379789 - DNA, 22 bp, Artificial Sequence
  chemically synthesized
tatagaggctctcagttgcaca

SEQ ID NO: 1379790 - DNA, 22 bp, Artificial Sequence
  chemically synthesized
gatacaacagtttgatcttttg

SEQ ID NO: 1379791 - DNA, 22 bp, Artificial Sequence
  chemically synthesized
agatacaacagtttgatctttt

SEQ ID NO: 1379792 - DNA, 22 bp, Artificial Sequence
  chemically synthesized
tagatacaacagtttgatcttt

SEQ ID NO: 1379793 - DNA, 22 bp, Artificial Sequence
  chemically synthesized
tcagttgcacaaaagatcaaac

SEQ ID NO: 1379794 - DNA, 22 bp, Artificial Sequence
  chemically synthesized
agttgcacaaaagatcaaactg

SEQ ID NO: 1379795 - DNA, 22 bp, Artificial Sequence
  chemically synthesized
atctttagatacaacagtttga

SEQ ID NO: 1379796 - DNA, 22 bp, Artificial Sequence
  chemically synthesized
gatctttagatacaacagtttg

SEQ ID NO: 1379797 - DNA, 22 bp, Artificial Sequence
  chemically synthesized
cacaaaagatcaaactgttgta

SEQ ID NO: 1379798 - DNA, 22 bp, Artificial Sequence
  chemically synthesized
gcttgatctttagatacaacag

SEQ ID NO: 1379799 - DNA, 22 bp, Artificial Sequence
  chemically synthesized
tggcttgatctttagatacaac

SEQ ID NO: 1379800 - DNA, 22 bp, Artificial Sequence
  chemically synthesized
aaaagcattctggcttgatctt

SEQ ID NO: 1379801 - DNA, 22 bp, Artificial Sequence
  chemically synthesized
gaaaagcattctggcttgatct

SEQ ID NO: 1379802 - DNA, 22 bp, Artificial Sequence
  chemically synthesized
ttgtatctaaagatcaagccag

SEQ ID NO: 1379803 - DNA, 22 bp, Artificial Sequence
  chemically synthesized
tatctaaagatcaagccagaat

SEQ ID NO: 1379804 - DNA, 22 bp, Artificial Sequence
  chemically synthesized
atgtttgaaaagcattctggct

SEQ ID NO: 1379805 - DNA, 22 bp, Artificial Sequence
  chemically synthesized
aagatcaagccagaatgctttt

SEQ ID NO: 1379806 - DNA, 22 bp, Artificial Sequence
  chemically synthesized
ggaaggatctaatgtttgaaaa

SEQ ID NO: 1379807 - DNA, 22 bp, Artificial Sequence
  chemically synthesized
gggaaggatctaatgtttgaaa

SEQ ID NO: 1379808 - DNA, 22 bp, Artificial Sequence
  chemically synthesized
tgggaaggatctaatgtttgaa

SEQ ID NO: 1379809 - DNA, 22 bp, Artificial Sequence
  chemically synthesized
ctttgggaaggatctaatgttt

SEQ ID NO: 1379810 - DNA, 22 bp, Artificial Sequence
  chemically synthesized
ttcaaacattagatccttccca

SEQ ID NO: 1379811 - DNA, 22 bp, Artificial Sequence
  chemically synthesized
tcaaacattagatccttcccaa

SEQ ID NO: 1379812 - DNA, 22 bp, Artificial Sequence
  chemically synthesized
caaacattagatccttcccaaa

SEQ ID NO: 1379813 - DNA, 22 bp, Artificial Sequence
  chemically synthesized
aaacattagatccttcccaaag

SEQ ID NO: 1379814 - DNA, 22 bp, Artificial Sequence
  chemically synthesized
cacaaagaattgctttgggaag

SEQ ID NO: 1379815 - DNA, 22 bp, Artificial Sequence
  chemically synthesized
gttacacaaagaattgctttgg

SEQ ID NO: 1379816 - DNA, 22 bp, Artificial Sequence
  chemically synthesized
gatccttcccaaagcaattctt

SEQ ID NO: 1379817 - DNA, 22 bp, Artificial Sequence
  chemically synthesized
gaaactggttacacaaagaatt

SEQ ID NO: 1379818 - DNA, 22 bp, Artificial Sequence
  chemically synthesized
ggaaactggttacacaaagaat

SEQ ID NO: 1379819 - DNA, 22 bp, Artificial Sequence
  chemically synthesized
tggaaactggttacacaaagaa

SEQ ID NO: 1379820 - DNA, 22 bp, Artificial Sequence
  chemically synthesized
ttggaaactggttacacaaaga

SEQ ID NO: 1379821 - DNA, 22 bp, Artificial Sequence
  chemically synthesized
cccaaagcaattctttgtgtaa

SEQ ID NO: 1379822 - DNA, 22 bp, Artificial Sequence
  chemically synthesized
tttggaaactggttacacaaag

SEQ ID NO: 1379823 - DNA, 22 bp, Artificial Sequence
  chemically synthesized
ccaaagcaattctttgtgtaac

SEQ ID NO: 1379824 - DNA, 22 bp, Artificial Sequence
  chemically synthesized
ttttggaaactggttacacaaa

SEQ ID NO: 1379825 - DNA, 22 bp, Artificial Sequence
  chemically synthesized
agacttttttggaaactggtta

SEQ ID NO: 1379826 - DNA, 22 bp, Artificial Sequence
  chemically synthesized
ctcagacttttttggaaactgg

SEQ ID NO: 1379827 - DNA, 22 bp, Artificial Sequence
  chemically synthesized
cctcagacttttttggaaactg

SEQ ID NO: 1379828 - DNA, 22 bp, Artificial Sequence
  chemically synthesized
tcctcagacttttttggaaact

SEQ ID NO: 1379829 - DNA, 22 bp, Artificial Sequence
  chemically synthesized
tttgtgtaaccagtttccaaaa

SEQ ID NO: 1379830 - DNA, 22 bp, Artificial Sequence
  chemically synthesized
ttcctcagacttttttggaaac

SEQ ID NO: 1379831 - DNA, 22 bp, Artificial Sequence
  chemically synthesized
tgtgtaaccagtttccaaaaaa

SEQ ID NO: 1379832 - DNA, 22 bp, Artificial Sequence
  chemically synthesized
gtgtaaccagtttccaaaaaag

SEQ ID NO: 1379833 - DNA, 22 bp, Artificial Sequence
  chemically synthesized
tgtaaccagtttccaaaaaagt

SEQ ID NO: 1379834 - DNA, 22 bp, Artificial Sequence
  chemically synthesized
ccaaaaaagtctgaggaaaaat

SEQ ID NO: 1379835 - DNA, 22 bp, Artificial Sequence
  chemically synthesized
caaaaaagtctgaggaaaaatt

SEQ ID NO: 1379836 - DNA, 22 bp, Artificial Sequence
  chemically synthesized
ataacgataggaaacaatggaa

SEQ ID NO: 1379837 - DNA, 22 bp, Artificial Sequence
  chemically synthesized
aggaaaaatttccattgtttcc

SEQ ID NO: 1379838 - DNA, 22 bp, Artificial Sequence
  chemically synthesized
ccattgtttcctatcgttatta

SEQ ID NO: 1379839 - DNA, 22 bp, Artificial Sequence
  chemically synthesized
cattgtttcctatcgttattag

SEQ ID NO: 1379840 - DNA, 22 bp, Artificial Sequence
  chemically synthesized
tttcctatcgttattagactgt

SEQ ID NO: 1379841 - DNA, 22 bp, Artificial Sequence
  chemically synthesized
cctatcgttattagactgttgg

SEQ ID NO: 1379842 - DNA, 22 bp, Artificial Sequence
  chemically synthesized
cgtcagtaggacccaacagtct

SEQ ID NO: 1379843 - DNA, 22 bp, Artificial Sequence
  chemically synthesized
ctatcgttattagactgttggg

SEQ ID NO: 1379844 - DNA, 22 bp, Artificial Sequence
  chemically synthesized
ttacgtcagtaggacccaacag

SEQ ID NO: 1379845 - DNA, 22 bp, Artificial Sequence
  chemically synthesized
tcgttattagactgttgggtcc

SEQ ID NO: 1379846 - DNA, 22 bp, Artificial Sequence
  chemically synthesized
attacgtcagtaggacccaaca

SEQ ID NO: 1379847 - DNA, 22 bp, Artificial Sequence
  chemically synthesized
ttagactgttgggtcctactga

SEQ ID NO: 1379848 - DNA, 22 bp, Artificial Sequence
  chemically synthesized
tatatttattacgtcagtagga

SEQ ID NO: 1379849 - DNA, 22 bp, Artificial Sequence
  chemically synthesized
gtatatttattacgtcagtagg

SEQ ID NO: 1379850 - DNA, 22 bp, Artificial Sequence
  chemically synthesized
gactgttgggtcctactgacgt

SEQ ID NO: 1379851 - DNA, 22 bp, Artificial Sequence
  chemically synthesized
ttgggtcctactgacgtaataa

SEQ ID NO: 1379852 - DNA, 22 bp, Artificial Sequence
  chemically synthesized
ggtcctactgacgtaataaata

SEQ ID NO: 1379853 - DNA, 22 bp, Artificial Sequence
  chemically synthesized
aaacaatagtgatttgtatatt

SEQ ID NO: 1379854 - DNA, 22 bp, Artificial Sequence
  chemically synthesized
ctgacgtaataaatatacaaat

SEQ ID NO: 1379855 - DNA, 22 bp, Artificial Sequence
  chemically synthesized
acgtaataaatatacaaatcac

SEQ ID NO: 1379856 - DNA, 22 bp, Artificial Sequence
  chemically synthesized
tgctgaaacaatagtgatttgt

SEQ ID NO: 1379857 - DNA, 22 bp, Artificial Sequence
  chemically synthesized
aaatgtcatgcataaaacattg

SEQ ID NO: 1379858 - DNA, 22 bp, Artificial Sequence
  chemically synthesized
ttgtttcagcacaatgttttat

SEQ ID NO: 1379859 - DNA, 22 bp, Artificial Sequence
  chemically synthesized
aaaatgtcatgcataaaacatt

SEQ ID NO: 1379860 - DNA, 22 bp, Artificial Sequence
  chemically synthesized
ttaaaatgtcatgcataaaaca

SEQ ID NO: 1379861 - DNA, 22 bp, Artificial Sequence
  chemically synthesized
tttcagcacaatgttttatgca

SEQ ID NO: 1379862 - DNA, 22 bp, Artificial Sequence
  chemically synthesized
cagcacaatgttttatgcatga

SEQ ID NO: 1379863 - DNA, 22 bp, Artificial Sequence
  chemically synthesized
agcacaatgttttatgcatgac

SEQ ID NO: 1379864 - DNA, 22 bp, Artificial Sequence
  chemically synthesized
tacagttcttaaaatgtcatgc

SEQ ID NO: 1379865 - DNA, 22 bp, Artificial Sequence
  chemically synthesized
gtacagttcttaaaatgtcatg

SEQ ID NO: 1379866 - DNA, 22 bp, Artificial Sequence
  chemically synthesized
tgtacagttcttaaaatgtcat

SEQ ID NO: 1379867 - DNA, 22 bp, Artificial Sequence
  chemically synthesized
tgttttgtacagttcttaaaat

SEQ ID NO: 1379868 - DNA, 22 bp, Artificial Sequence
  chemically synthesized
tatgcatgacattttaagaact

SEQ ID NO: 1379869 - DNA, 22 bp, Artificial Sequence
  chemically synthesized
atgcatgacattttaagaactg

SEQ ID NO: 1379870 - DNA, 22 bp, Artificial Sequence
  chemically synthesized
tgcatgacattttaagaactgt

SEQ ID NO: 1379871 - DNA, 22 bp, Artificial Sequence
  chemically synthesized
atattgtgttttgtacagttct

SEQ ID NO: 1379872 - DNA, 22 bp, Artificial Sequence
  chemically synthesized
aatattgtgttttgtacagttc

SEQ ID NO: 1379873 - DNA, 22 bp, Artificial Sequence
  chemically synthesized
taatattgtgttttgtacagtt

SEQ ID NO: 1379874 - DNA, 22 bp, Artificial Sequence
  chemically synthesized
agaattttaatattgtgttttg

SEQ ID NO: 1379875 - DNA, 22 bp, Artificial Sequence
  chemically synthesized
taagaactgtacaaaacacaat

SEQ ID NO: 1379876 - DNA, 22 bp, Artificial Sequence
  chemically synthesized
cagaattttaatattgtgtttt

SEQ ID NO: 1379877 - DNA, 22 bp, Artificial Sequence
  chemically synthesized
aagaactgtacaaaacacaata

SEQ ID NO: 1379878 - DNA, 22 bp, Artificial Sequence
  chemically synthesized
agaactgtacaaaacacaatat

SEQ ID NO: 1379879 - DNA, 22 bp, Artificial Sequence
  chemically synthesized
acttcagaattttaatattgtg

SEQ ID NO: 1379880 - DNA, 22 bp, Artificial Sequence
  chemically synthesized
cacttcagaattttaatattgt

SEQ ID NO: 1379881 - DNA, 22 bp, Artificial Sequence
  chemically synthesized
tcacttcagaattttaatattg

SEQ ID NO: 1379882 - DNA, 22 bp, Artificial Sequence
  chemically synthesized
ttcacttcagaattttaatatt

SEQ ID NO: 1379883 - DNA, 22 bp, Artificial Sequence
  chemically synthesized
tacaaaacacaatattaaaatt

SEQ ID NO: 1379884 - DNA, 22 bp, Artificial Sequence
  chemically synthesized
tttttcacttcagaattttaat

SEQ ID NO: 1379885 - DNA, 22 bp, Artificial Sequence
  chemically synthesized
ttatttttcacttcagaatttt

SEQ ID NO: 1379886 - DNA, 22 bp, Artificial Sequence
  chemically synthesized
aaattctgaagtgaaaaataat

SEQ ID NO: 1379887 - DNA, 22 bp, Artificial Sequence
  chemically synthesized
tgaagtgaaaaataatagcatt

SEQ ID NO: 1379888 - DNA, 22 bp, Artificial Sequence
  chemically synthesized
aagtgaaaaataatagcattat

SEQ ID NO: 1379889 - DNA, 22 bp, Artificial Sequence
  chemically synthesized
ccacaatatagaatgtaatgag

SEQ ID NO: 1379890 - DNA, 22 bp, Artificial Sequence
  chemically synthesized
aaactaccacaatatagaatgt

SEQ ID NO: 1379891 - DNA, 22 bp, Artificial Sequence
  chemically synthesized
tggctcattacattctatattg

SEQ ID NO: 1379892 - DNA, 22 bp, Artificial Sequence
  chemically synthesized
acagttcaaactaccacaatat

SEQ ID NO: 1379893 - DNA, 22 bp, Artificial Sequence
  chemically synthesized
attacattctatattgtggtag

SEQ ID NO: 1379894 - DNA, 22 bp, Artificial Sequence
  chemically synthesized
ctcacagttcaaactaccacaa

SEQ ID NO: 1379895 - DNA, 22 bp, Artificial Sequence
  chemically synthesized
cattctatattgtggtagtttg

SEQ ID NO: 1379896 - DNA, 22 bp, Artificial Sequence
  chemically synthesized
tatattgtggtagtttgaactg

SEQ ID NO: 1379897 - DNA, 22 bp, Artificial Sequence
  chemically synthesized
tattgtggtagtttgaactgtg

SEQ ID NO: 1379898 - DNA, 22 bp, Artificial Sequence
  chemically synthesized
tggtagtttgaactgtgagtaa

SEQ ID NO: 1379899 - DNA, 22 bp, Artificial Sequence
  chemically synthesized
acaggatgacagtacagttact

SEQ ID NO: 1379900 - DNA, 22 bp, Artificial Sequence
  chemically synthesized
gaactgtgagtaactgtactgt

SEQ ID NO: 1379901 - DNA, 22 bp, Artificial Sequence
  chemically synthesized
aactgtgagtaactgtactgtc

SEQ ID NO: 1379902 - DNA, 22 bp, Artificial Sequence
  chemically synthesized
tgagtaactgtactgtcatcct

SEQ ID NO: 1379903 - DNA, 22 bp, Artificial Sequence
  chemically synthesized
aagtgagttgacaggatgacag

SEQ ID NO: 1379904 - DNA, 22 bp, Artificial Sequence
  chemically synthesized
aaagtgagttgacaggatgaca

SEQ ID NO: 1379905 - DNA, 22 bp, Artificial Sequence
  chemically synthesized
taaagtgagttgacaggatgac

SEQ ID NO: 1379906 - DNA, 22 bp, Artificial Sequence
  chemically synthesized
ttaaagtgagttgacaggatga

SEQ ID NO: 1379907 - DNA, 22 bp, Artificial Sequence
  chemically synthesized
tactgtcatcctgtcaactcac

SEQ ID NO: 1379908 - DNA, 22 bp, Artificial Sequence
  chemically synthesized
tcatcctgtcaactcactttaa

SEQ ID NO: 1379909 - DNA, 22 bp, Artificial Sequence
  chemically synthesized
tcaactcactttaaaagatccg

SEQ ID NO: 1379910 - DNA, 22 bp, Artificial Sequence
  chemically synthesized
tgtaaaacaatatagcggatct

SEQ ID NO: 1379911 - DNA, 22 bp, Artificial Sequence
  chemically synthesized
actttaaaagatccgctatatt

SEQ ID NO: 1379912 - DNA, 22 bp, Artificial Sequence
  chemically synthesized
taaaagatccgctatattgttt

SEQ ID NO: 1379913 - DNA, 22 bp, Artificial Sequence
  chemically synthesized
aaaagatccgctatattgtttt

SEQ ID NO: 1379914 - DNA, 22 bp, Artificial Sequence
  chemically synthesized
aaagatccgctatattgtttta

SEQ ID NO: 1379915 - DNA, 22 bp, Artificial Sequence
  chemically synthesized
tgaaataaatgacattgtgtaa

SEQ ID NO: 1379916 - DNA, 22 bp, Artificial Sequence
  chemically synthesized
tattgttttacacaatgtcatt

SEQ ID NO: 1379917 - DNA, 22 bp, Artificial Sequence
  chemically synthesized
tacctgtgaaataaatgacatt

SEQ ID NO: 1379918 - DNA, 22 bp, Artificial Sequence
  chemically synthesized
ttttacacaatgtcatttattt

SEQ ID NO: 1379919 - DNA, 22 bp, Artificial Sequence
  chemically synthesized
tacacaatgtcatttatttcac

SEQ ID NO: 1379920 - DNA, 22 bp, Artificial Sequence
  chemically synthesized
acacaatgtcatttatttcaca

SEQ ID NO: 1379921 - DNA, 22 bp, Artificial Sequence
  chemically synthesized
cacaatgtcatttatttcacag

SEQ ID NO: 1379922 - DNA, 22 bp, Artificial Sequence
  chemically synthesized
gtatagttatacctgtgaaata

SEQ ID NO: 1379923 - DNA, 22 bp, Artificial Sequence
  chemically synthesized
ggtatagttatacctgtgaaat

SEQ ID NO: 1379924 - DNA, 22 bp, Artificial Sequence
  chemically synthesized
tggtatagttatacctgtgaaa

SEQ ID NO: 1379925 - DNA, 22 bp, Artificial Sequence
  chemically synthesized
atttcacaggtataactatacc

SEQ ID NO: 1379926 - DNA, 22 bp, Artificial Sequence
  chemically synthesized
tttcacaggtataactatacca

SEQ ID NO: 1379927 - DNA, 22 bp, Artificial Sequence
  chemically synthesized
cacaggtataactataccaaag

SEQ ID NO: 1379928 - DNA, 22 bp, Artificial Sequence
  chemically synthesized
caaaccggaacactttggtata

SEQ ID NO: 1379929 - DNA, 22 bp, Artificial Sequence
  chemically synthesized
acaggtataactataccaaagt

SEQ ID NO: 1379930 - DNA, 22 bp, Artificial Sequence
  chemically synthesized
ccaaaccggaacactttggtat

SEQ ID NO: 1379931 - DNA, 22 bp, Artificial Sequence
  chemically synthesized
tgtttccaaaccggaacacttt

SEQ ID NO: 1379932 - DNA, 22 bp, Artificial Sequence
  chemically synthesized
cactatgtttccaaaccggaac

SEQ ID NO: 1379933 - DNA, 22 bp, Artificial Sequence
  chemically synthesized
acactatgtttccaaaccggaa

SEQ ID NO: 1379934 - DNA, 22 bp, Artificial Sequence
  chemically synthesized
taccaaagtgttccggtttgga

SEQ ID NO: 1379935 - DNA, 22 bp, Artificial Sequence
  chemically synthesized
aacatttacactatgtttccaa

SEQ ID NO: 1379936 - DNA, 22 bp, Artificial Sequence
  chemically synthesized
aaacatttacactatgtttcca

SEQ ID NO: 1379937 - DNA, 22 bp, Artificial Sequence
  chemically synthesized
taaacatttacactatgtttcc

SEQ ID NO: 1379938 - DNA, 22 bp, Artificial Sequence
  chemically synthesized
ttaaacatttacactatgtttc

SEQ ID NO: 1379939 - DNA, 22 bp, Artificial Sequence
  chemically synthesized
cggtttggaaacatagtgtaaa

SEQ ID NO: 1379940 - DNA, 22 bp, Artificial Sequence
  chemically synthesized
ggaaacatagtgtaaatgttta

SEQ ID NO: 1379941 - DNA, 22 bp, Artificial Sequence
  chemically synthesized
gaaacatagtgtaaatgtttaa

SEQ ID NO: 1379942 - DNA, 22 bp, Artificial Sequence
  chemically synthesized
tgtgaaaatatttttaaacatt

SEQ ID NO: 1379943 - DNA, 22 bp, Artificial Sequence
  chemically synthesized
aggtaactgtgtgaaaatattt

SEQ ID NO: 1379944 - DNA, 22 bp, Artificial Sequence
  chemically synthesized
caggtaactgtgtgaaaatatt

SEQ ID NO: 1379945 - DNA, 22 bp, Artificial Sequence
  chemically synthesized
tcaggtaactgtgtgaaaatat

SEQ ID NO: 1379946 - DNA, 22 bp, Artificial Sequence
  chemically synthesized
ttcaggtaactgtgtgaaaata

SEQ ID NO: 1379947 - DNA, 22 bp, Artificial Sequence
  chemically synthesized
aaaaatattttcacacagttac

SEQ ID NO: 1379948 - DNA, 22 bp, Artificial Sequence
  chemically synthesized
aaaatattttcacacagttacc

SEQ ID NO: 1379949 - DNA, 22 bp, Artificial Sequence
  chemically synthesized
agtgcaagtatttttcaggtaa

SEQ ID NO: 1379950 - DNA, 22 bp, Artificial Sequence
  chemically synthesized
cagtgcaagtatttttcaggta

SEQ ID NO: 1379951 - DNA, 22 bp, Artificial Sequence
  chemically synthesized
tcagtgcaagtatttttcaggt

SEQ ID NO: 1379952 - DNA, 22 bp, Artificial Sequence
  chemically synthesized
tcacacagttacctgaaaaata

SEQ ID NO: 1379953 - DNA, 22 bp, Artificial Sequence
  chemically synthesized
cacacagttacctgaaaaatac

SEQ ID NO: 1379954 - DNA, 22 bp, Artificial Sequence
  chemically synthesized
acacagttacctgaaaaatact

SEQ ID NO: 1379955 - DNA, 22 bp, Artificial Sequence
  chemically synthesized
gctttcagtgcaagtatttttc

SEQ ID NO: 1379956 - DNA, 22 bp, Artificial Sequence
  chemically synthesized
atgattagctttcagtgcaagt

SEQ ID NO: 1379957 - DNA, 22 bp, Artificial Sequence
  chemically synthesized
cctgaaaaatacttgcactgaa

SEQ ID NO: 1379958 - DNA, 22 bp, Artificial Sequence
  chemically synthesized
aaaaatacttgcactgaaagct

SEQ ID NO: 1379959 - DNA, 22 bp, Artificial Sequence
  chemically synthesized
taactgatgattagctttcagt

SEQ ID NO: 1379960 - DNA, 22 bp, Artificial Sequence
  chemically synthesized
tgtaactgatgattagctttca

SEQ ID NO: 1379961 - DNA, 22 bp, Artificial Sequence
  chemically synthesized
gtggttctgtaactgatgatta

SEQ ID NO: 1379962 - DNA, 22 bp, Artificial Sequence
  chemically synthesized
gcactgaaagctaatcatcagt

SEQ ID NO: 1379963 - DNA, 22 bp, Artificial Sequence
  chemically synthesized
cactgaaagctaatcatcagtt

SEQ ID NO: 1379964 - DNA, 22 bp, Artificial Sequence
  chemically synthesized
ttggtggttctgtaactgatga

SEQ ID NO: 1379965 - DNA, 22 bp, Artificial Sequence
  chemically synthesized
gttggtggttctgtaactgatg

SEQ ID NO: 1379966 - DNA, 22 bp, Artificial Sequence
  chemically synthesized
tgttggtggttctgtaactgat

SEQ ID NO: 1379967 - DNA, 22 bp, Artificial Sequence
  chemically synthesized
ttgttggtggttctgtaactga

SEQ ID NO: 1379968 - DNA, 22 bp, Artificial Sequence
  chemically synthesized
aaagctaatcatcagttacaga

SEQ ID NO: 1379969 - DNA, 22 bp, Artificial Sequence
  chemically synthesized
atcatcagttacagaaccacca

SEQ ID NO: 1379970 - DNA, 22 bp, Artificial Sequence
  chemically synthesized
tagtagcagaacttttgttggt

SEQ ID NO: 1379971 - DNA, 22 bp, Artificial Sequence
  chemically synthesized
gtagtagcagaacttttgttgg

SEQ ID NO: 1379972 - DNA, 22 bp, Artificial Sequence
  chemically synthesized
tttgtagtagcagaacttttgt

SEQ ID NO: 1379973 - DNA, 22 bp, Artificial Sequence
  chemically synthesized
cagaaccaccaacaaaagttct

SEQ ID NO: 1379974 - DNA, 22 bp, Artificial Sequence
  chemically synthesized
atcaaaactatttgtagtagca

SEQ ID NO: 1379975 - DNA, 22 bp, Artificial Sequence
  chemically synthesized
catcaaaactatttgtagtagc

SEQ ID NO: 1379976 - DNA, 22 bp, Artificial Sequence
  chemically synthesized
tttcatcaaaactatttgtagt

SEQ ID NO: 1379977 - DNA, 22 bp, Artificial Sequence
  chemically synthesized
gtttcatcaaaactatttgtag

SEQ ID NO: 1379978 - DNA, 22 bp, Artificial Sequence
  chemically synthesized
tcttgtttcatcaaaactattt

SEQ ID NO: 1379979 - DNA, 22 bp, Artificial Sequence
  chemically synthesized
gtcttgtttcatcaaaactatt

SEQ ID NO: 1379980 - DNA, 22 bp, Artificial Sequence
  chemically synthesized
tgctactacaaatagttttgat

SEQ ID NO: 1379981 - DNA, 22 bp, Artificial Sequence
  chemically synthesized
tttgtcttgtttcatcaaaact

SEQ ID NO: 1379982 - DNA, 22 bp, Artificial Sequence
  chemically synthesized
ctactacaaatagttttgatga

SEQ ID NO: 1379983 - DNA, 22 bp, Artificial Sequence
  chemically synthesized
ctacaaatagttttgatgaaac

SEQ ID NO: 1379984 - DNA, 22 bp, Artificial Sequence
  chemically synthesized
caaatagttttgatgaaacaag

SEQ ID NO: 1379985 - DNA, 22 bp, Artificial Sequence
  chemically synthesized
gtacgttgtttgtcttgtttca

SEQ ID NO: 1379986 - DNA, 22 bp, Artificial Sequence
  chemically synthesized
agtacgttgtttgtcttgtttc

SEQ ID NO: 1379987 - DNA, 22 bp, Artificial Sequence
  chemically synthesized
tgatgaaacaagacaaacaacg

SEQ ID NO: 1379988 - DNA, 22 bp, Artificial Sequence
  chemically synthesized
gatgaaacaagacaaacaacgt

SEQ ID NO: 1379989 - DNA, 22 bp, Artificial Sequence
  chemically synthesized
atgaaacaagacaaacaacgta

SEQ ID NO: 1379990 - DNA, 22 bp, Artificial Sequence
  chemically synthesized
caaaatgtttagtacgttgttt

SEQ ID NO: 1379991 - DNA, 22 bp, Artificial Sequence
  chemically synthesized
ttccaaaatgtttagtacgttg

SEQ ID NO: 1379992 - DNA, 22 bp, Artificial Sequence
  chemically synthesized
aaaaattattccaaaatgttta

SEQ ID NO: 1379993 - DNA, 22 bp, Artificial Sequence
  chemically synthesized
aacattttggaataatttttca

SEQ ID NO: 1379994 - DNA, 22 bp, Artificial Sequence
  chemically synthesized
tggaataatttttcaatattat

SEQ ID NO: 1379995 - DNA, 22 bp, Artificial Sequence
  chemically synthesized
ggaataatttttcaatattatt

SEQ ID NO: 1379996 - DNA, 22 bp, Artificial Sequence
  chemically synthesized
gaataatttttcaatattatta

SEQ ID NO: 1379997 - DNA, 22 bp, Artificial Sequence
  chemically synthesized
agaacaaatcagaaggtaataa

SEQ ID NO: 1379998 - DNA, 22 bp, Artificial Sequence
  chemically synthesized
ttcaatattattattaccttct

SEQ ID NO: 1379999 - DNA, 22 bp, Artificial Sequence
  chemically synthesized
tcaatattattattaccttctg

SEQ ID NO: 1380000 - DNA, 22 bp, Artificial Sequence
  chemically synthesized
caatattattattaccttctga

SEQ ID NO: 1380001 - DNA, 22 bp, Artificial Sequence
  chemically synthesized
aatattattattaccttctgat

SEQ ID NO: 1380002 - DNA, 22 bp, Artificial Sequence
  chemically synthesized
aagtctaagaacaaatcagaag

SEQ ID NO: 1380003 - DNA, 22 bp, Artificial Sequence
  chemically synthesized
aaagtctaagaacaaatcagaa

SEQ ID NO: 1380004 - DNA, 22 bp, Artificial Sequence
  chemically synthesized
taaagtctaagaacaaatcaga

SEQ ID NO: 1380005 - DNA, 22 bp, Artificial Sequence
  chemically synthesized
ttattaccttctgatttgttct

SEQ ID NO: 1380006 - DNA, 22 bp, Artificial Sequence
  chemically synthesized
ttaccttctgatttgttcttag

SEQ ID NO: 1380007 - DNA, 22 bp, Artificial Sequence
  chemically synthesized
ccttctgatttgttcttagact

SEQ ID NO: 1380008 - DNA, 22 bp, Artificial Sequence
  chemically synthesized
gggaatctttaaagtctaagaa

SEQ ID NO: 1380009 - DNA, 22 bp, Artificial Sequence
  chemically synthesized
agggaatctttaaagtctaaga

SEQ ID NO: 1380010 - DNA, 22 bp, Artificial Sequence
  chemically synthesized
tagggaatctttaaagtctaag

SEQ ID NO: 1380011 - DNA, 22 bp, Artificial Sequence
  chemically synthesized
ctgatttgttcttagactttaa

SEQ ID NO: 1380012 - DNA, 22 bp, Artificial Sequence
  chemically synthesized
tgatttgttcttagactttaaa

SEQ ID NO: 1380013 - DNA, 22 bp, Artificial Sequence
  chemically synthesized
atttgttcttagactttaaaga

SEQ ID NO: 1380014 - DNA, 22 bp, Artificial Sequence
  chemically synthesized
gttcttagactttaaagattcc

SEQ ID NO: 1380015 - DNA, 22 bp, Artificial Sequence
  chemically synthesized
ccaatattttagggaatcttta

SEQ ID NO: 1380016 - DNA, 22 bp, Artificial Sequence
  chemically synthesized
ttcttagactttaaagattccc

SEQ ID NO: 1380017 - DNA, 22 bp, Artificial Sequence
  chemically synthesized
accaatattttagggaatcttt

SEQ ID NO: 1380018 - DNA, 22 bp, Artificial Sequence
  chemically synthesized
ttagactttaaagattccctaa

SEQ ID NO: 1380019 - DNA, 22 bp, Artificial Sequence
  chemically synthesized
agactttaaagattccctaaaa

SEQ ID NO: 1380020 - DNA, 22 bp, Artificial Sequence
  chemically synthesized
gactttaaagattccctaaaat

SEQ ID NO: 1380021 - DNA, 22 bp, Artificial Sequence
  chemically synthesized
taaagattccctaaaatattgg

SEQ ID NO: 1380022 - DNA, 22 bp, Artificial Sequence
  chemically synthesized
catcatcatttaccaatatttt

SEQ ID NO: 1380023 - DNA, 22 bp, Artificial Sequence
  chemically synthesized
aaagattccctaaaatattggt

SEQ ID NO: 1380024 - DNA, 22 bp, Artificial Sequence
  chemically synthesized
ccatcatcatttaccaatattt

SEQ ID NO: 1380025 - DNA, 22 bp, Artificial Sequence
  chemically synthesized
aagattccctaaaatattggta

SEQ ID NO: 1380026 - DNA, 22 bp, Artificial Sequence
  chemically synthesized
cctaaaatattggtaaatgatg

SEQ ID NO: 1380027 - DNA, 22 bp, Artificial Sequence
  chemically synthesized
gaaaaaggtttccatcatcatt

SEQ ID NO: 1380028 - DNA, 22 bp, Artificial Sequence
  chemically synthesized
aaatattggtaaatgatgatgg

SEQ ID NO: 1380029 - DNA, 22 bp, Artificial Sequence
  chemically synthesized
agaaaaaggtttccatcatcat

SEQ ID NO: 1380030 - DNA, 22 bp, Artificial Sequence
  chemically synthesized
tagaaaaaggtttccatcatca

SEQ ID NO: 1380031 - DNA, 22 bp, Artificial Sequence
  chemically synthesized
ttagaaaaaggtttccatcatc

SEQ ID NO: 1380032 - DNA, 22 bp, Artificial Sequence
  chemically synthesized
gtaaatgatgatggaaaccttt

SEQ ID NO: 1380033 - DNA, 22 bp, Artificial Sequence
  chemically synthesized
ccatcaaagcaatatttttaga

SEQ ID NO: 1380034 - DNA, 22 bp, Artificial Sequence
  chemically synthesized
accatcaaagcaatatttttag

SEQ ID NO: 1380035 - DNA, 22 bp, Artificial Sequence
  chemically synthesized
taccatcaaagcaatattttta

SEQ ID NO: 1380036 - DNA, 22 bp, Artificial Sequence
  chemically synthesized
tttctaaaaatattgctttgat

SEQ ID NO: 1380037 - DNA, 22 bp, Artificial Sequence
  chemically synthesized
ttctaaaaatattgctttgatg

SEQ ID NO: 1380038 - DNA, 22 bp, Artificial Sequence
  chemically synthesized
tctaaaaatattgctttgatgg

SEQ ID NO: 1380039 - DNA, 22 bp, Artificial Sequence
  chemically synthesized
ccagtcgttttaccatcaaagc

SEQ ID NO: 1380040 - DNA, 22 bp, Artificial Sequence
  chemically synthesized
ctaaaaatattgctttgatggt

SEQ ID NO: 1380041 - DNA, 22 bp, Artificial Sequence
  chemically synthesized
taaaaatattgctttgatggta

SEQ ID NO: 1380042 - DNA, 22 bp, Artificial Sequence
  chemically synthesized
ttgccagtcgttttaccatcaa

SEQ ID NO: 1380043 - DNA, 22 bp, Artificial Sequence
  chemically synthesized
aaaatattgctttgatggtaaa

SEQ ID NO: 1380044 - DNA, 22 bp, Artificial Sequence
  chemically synthesized
gttgccagtcgttttaccatca

SEQ ID NO: 1380045 - DNA, 22 bp, Artificial Sequence
  chemically synthesized
tgttgccagtcgttttaccatc

SEQ ID NO: 1380046 - DNA, 22 bp, Artificial Sequence
  chemically synthesized
tcattttgttgccagtcgtttt

SEQ ID NO: 1380047 - DNA, 22 bp, Artificial Sequence
  chemically synthesized
ctttgatggtaaaacgactggc

SEQ ID NO: 1380048 - DNA, 22 bp, Artificial Sequence
  chemically synthesized
tgtcattttgttgccagtcgtt

SEQ ID NO: 1380049 - DNA, 22 bp, Artificial Sequence
  chemically synthesized
ctgtcattttgttgccagtcgt

SEQ ID NO: 1380050 - DNA, 22 bp, Artificial Sequence
  chemically synthesized
tgatggtaaaacgactggcaac

SEQ ID NO: 1380051 - DNA, 22 bp, Artificial Sequence
  chemically synthesized
gatggtaaaacgactggcaaca

SEQ ID NO: 1380052 - DNA, 22 bp, Artificial Sequence
  chemically synthesized
atggtaaaacgactggcaacaa

SEQ ID NO: 1380053 - DNA, 22 bp, Artificial Sequence
  chemically synthesized
tcttctgtcattttgttgccag

SEQ ID NO: 1380054 - DNA, 22 bp, Artificial Sequence
  chemically synthesized
gggctatcttctgtcattttgt

SEQ ID NO: 1380055 - DNA, 22 bp, Artificial Sequence
  chemically synthesized
tagggctatcttctgtcatttt

SEQ ID NO: 1380056 - DNA, 22 bp, Artificial Sequence
  chemically synthesized
gcaacaaaatgacagaagatag

SEQ ID NO: 1380057 - DNA, 22 bp, Artificial Sequence
  chemically synthesized
ggataaagtggagaaaggcatc

SEQ ID NO: 1380058 - DNA, 22 bp, Artificial Sequence
  chemically synthesized
gagatgcctttctccactttat

SEQ ID NO: 1380059 - DNA, 22 bp, Artificial Sequence
  chemically synthesized
aagacatactaggataaagtgg

SEQ ID NO: 1380060 - DNA, 22 bp, Artificial Sequence
  chemically synthesized
taaagacatactaggataaagt

SEQ ID NO: 1380061 - DNA, 22 bp, Artificial Sequence
  chemically synthesized
tctccactttatcctagtatgt

SEQ ID NO: 1380062 - DNA, 22 bp, Artificial Sequence
  chemically synthesized
ctccactttatcctagtatgtc

SEQ ID NO: 1380063 - DNA, 22 bp, Artificial Sequence
  chemically synthesized
tccactttatcctagtatgtct

SEQ ID NO: 1380064 - DNA, 22 bp, Artificial Sequence
  chemically synthesized
cactttatcctagtatgtcttt

SEQ ID NO: 1380065 - DNA, 22 bp, Artificial Sequence
  chemically synthesized
tatcagggctctaaagacatac

SEQ ID NO: 1380066 - DNA, 22 bp, Artificial Sequence
  chemically synthesized
atatcagggctctaaagacata

SEQ ID NO: 1380067 - DNA, 22 bp, Artificial Sequence
  chemically synthesized
tatcctagtatgtctttagagc

SEQ ID NO: 1380068 - DNA, 22 bp, Artificial Sequence
  chemically synthesized
atcctagtatgtctttagagcc

SEQ ID NO: 1380069 - DNA, 22 bp, Artificial Sequence
  chemically synthesized
tcctagtatgtctttagagccc

SEQ ID NO: 1380070 - DNA, 22 bp, Artificial Sequence
  chemically synthesized
gtatgtctttagagccctgata

SEQ ID NO: 1380071 - DNA, 22 bp, Artificial Sequence
  chemically synthesized
gaatatcatatatatttatatc

SEQ ID NO: 1380072 - DNA, 22 bp, Artificial Sequence
  chemically synthesized
ggaatatcatatatatttatat

SEQ ID NO: 1380073 - DNA, 22 bp, Artificial Sequence
  chemically synthesized
tagagccctgatataaatatat

SEQ ID NO: 1380074 - DNA, 22 bp, Artificial Sequence
  chemically synthesized
agagccctgatataaatatata

SEQ ID NO: 1380075 - DNA, 22 bp, Artificial Sequence
  chemically synthesized
gagccctgatataaatatatat

SEQ ID NO: 1380076 - DNA, 22 bp, Artificial Sequence
  chemically synthesized
atataaatatatatgatattcc

SEQ ID NO: 1380077 - DNA, 22 bp, Artificial Sequence
  chemically synthesized
tgtaaaatgatgaaagcaaagg

SEQ ID NO: 1380078 - DNA, 22 bp, Artificial Sequence
  chemically synthesized
caagaccctttgctttcatcat

SEQ ID NO: 1380079 - DNA, 22 bp, Artificial Sequence
  chemically synthesized
taggagtgactgtgtaaaatga

SEQ ID NO: 1380080 - DNA, 22 bp, Artificial Sequence
  chemically synthesized
tgtaggagtgactgtgtaaaat

SEQ ID NO: 1380081 - DNA, 22 bp, Artificial Sequence
  chemically synthesized
ctgtaggagtgactgtgtaaaa

SEQ ID NO: 1380082 - DNA, 22 bp, Artificial Sequence
  chemically synthesized
tgctttcatcattttacacagt

SEQ ID NO: 1380083 - DNA, 22 bp, Artificial Sequence
  chemically synthesized
gctttcatcattttacacagtc

SEQ ID NO: 1380084 - DNA, 22 bp, Artificial Sequence
  chemically synthesized
ctttcatcattttacacagtca

SEQ ID NO: 1380085 - DNA, 22 bp, Artificial Sequence
  chemically synthesized
tcatcattttacacagtcactc

SEQ ID NO: 1380086 - DNA, 22 bp, Artificial Sequence
  chemically synthesized
catcattttacacagtcactcc

SEQ ID NO: 1380087 - DNA, 22 bp, Artificial Sequence
  chemically synthesized
atcattttacacagtcactcct

SEQ ID NO: 1380088 - DNA, 22 bp, Artificial Sequence
  chemically synthesized
tgaggaaagcttctgtaggagt

SEQ ID NO: 1380089 - DNA, 22 bp, Artificial Sequence
  chemically synthesized
tacacagtcactcctacagaag

SEQ ID NO: 1380090 - DNA, 22 bp, Artificial Sequence
  chemically synthesized
acacagtcactcctacagaagc

SEQ ID NO: 1380091 - DNA, 22 bp, Artificial Sequence
  chemically synthesized
cacagtcactcctacagaagct

SEQ ID NO: 1380092 - DNA, 22 bp, Artificial Sequence
  chemically synthesized
cagttatgaggaaagcttctgt

SEQ ID NO: 1380093 - DNA, 22 bp, Artificial Sequence
  chemically synthesized
ctacagaagctttcctcataac

SEQ ID NO: 1380094 - DNA, 22 bp, Artificial Sequence
  chemically synthesized
cagaagctttcctcataactgt

SEQ ID NO: 1380095 - DNA, 22 bp, Artificial Sequence
  chemically synthesized
tcctcataactgtaggatcatc

SEQ ID NO: 1380096 - DNA, 22 bp, Artificial Sequence
  chemically synthesized
cctcataactgtaggatcatct

SEQ ID NO: 1380097 - DNA, 22 bp, Artificial Sequence
  chemically synthesized
ctcataactgtaggatcatctg

SEQ ID NO: 1380098 - DNA, 22 bp, Artificial Sequence
  chemically synthesized
ataactgtaggatcatctgccg

SEQ ID NO: 1380099 - DNA, 22 bp, Artificial Sequence
  chemically synthesized
taggatcatctgccgctgatgg

SEQ ID NO: 1380100 - DNA, 22 bp, Artificial Sequence
  chemically synthesized
agatccgaacaaaccatcagcg

SEQ ID NO: 1380101 - DNA, 22 bp, Artificial Sequence
  chemically synthesized
ccgctgatggtttgttcggatc

SEQ ID NO: 1380102 - DNA, 22 bp, Artificial Sequence
  chemically synthesized
cataagacaattaagatccgaa

SEQ ID NO: 1380103 - DNA, 22 bp, Artificial Sequence
  chemically synthesized
atggtttgttcggatcttaatt

SEQ ID NO: 1380104 - DNA, 22 bp, Artificial Sequence
  chemically synthesized
gttcggatcttaattgtcttat

SEQ ID NO: 1380105 - DNA, 22 bp, Artificial Sequence
  chemically synthesized
agtatgtactacataagacaat

SEQ ID NO: 1380106 - DNA, 22 bp, Artificial Sequence
  chemically synthesized
ttcggatcttaattgtcttatg

SEQ ID NO: 1380107 - DNA, 22 bp, Artificial Sequence
  chemically synthesized
ggatcttaattgtcttatgtag

SEQ ID NO: 1380108 - DNA, 22 bp, Artificial Sequence
  chemically synthesized
attgagtatgtactacataaga

SEQ ID NO: 1380109 - DNA, 22 bp, Artificial Sequence
  chemically synthesized
aattgagtatgtactacataag

SEQ ID NO: 1380110 - DNA, 22 bp, Artificial Sequence
  chemically synthesized
taattgagtatgtactacataa

SEQ ID NO: 1380111 - DNA, 22 bp, Artificial Sequence
  chemically synthesized
aattgtcttatgtagtacatac

SEQ ID NO: 1380112 - DNA, 22 bp, Artificial Sequence
  chemically synthesized
attgtcttatgtagtacatact

SEQ ID NO: 1380113 - DNA, 22 bp, Artificial Sequence
  chemically synthesized
tcttatgtagtacatactcaat

SEQ ID NO: 1380114 - DNA, 22 bp, Artificial Sequence
  chemically synthesized
cagcatgagttttaattgagta

SEQ ID NO: 1380115 - DNA, 22 bp, Artificial Sequence
  chemically synthesized
atgtagtacatactcaattaaa

SEQ ID NO: 1380116 - DNA, 22 bp, Artificial Sequence
  chemically synthesized
tgtagtacatactcaattaaaa

SEQ ID NO: 1380117 - DNA, 22 bp, Artificial Sequence
  chemically synthesized
ctccagcatgagttttaattga

SEQ ID NO: 1380118 - DNA, 22 bp, Artificial Sequence
  chemically synthesized
gacagtcctgctccagcatgag

SEQ ID NO: 1380119 - DNA, 22 bp, Artificial Sequence
  chemically synthesized
aattaaaactcatgctggagca

SEQ ID NO: 1380120 - DNA, 22 bp, Artificial Sequence
  chemically synthesized
aaactcatgctggagcaggact

SEQ ID NO: 1380121 - DNA, 22 bp, Artificial Sequence
  chemically synthesized
ccaaagtctagacagtcctgct

SEQ ID NO: 1380122 - DNA, 22 bp, Artificial Sequence
  chemically synthesized
atgctggagcaggactgtctag

SEQ ID NO: 1380123 - DNA, 22 bp, Artificial Sequence
  chemically synthesized
gagcaggactgtctagactttg

SEQ ID NO: 1380124 - DNA, 22 bp, Artificial Sequence
  chemically synthesized
ataagcagttaccaaagtctag

SEQ ID NO: 1380125 - DNA, 22 bp, Artificial Sequence
  chemically synthesized
aataagcagttaccaaagtcta

SEQ ID NO: 1380126 - DNA, 22 bp, Artificial Sequence
  chemically synthesized
tttaataagcagttaccaaagt

SEQ ID NO: 1380127 - DNA, 22 bp, Artificial Sequence
  chemically synthesized
actatttaataagcagttacca

SEQ ID NO: 1380128 - DNA, 22 bp, Artificial Sequence
  chemically synthesized
aactatttaataagcagttacc

SEQ ID NO: 1380129 - DNA, 22 bp, Artificial Sequence
  chemically synthesized
tctagactttggtaactgctta

SEQ ID NO: 1380130 - DNA, 22 bp, Artificial Sequence
  chemically synthesized
gactttggtaactgcttattaa

SEQ ID NO: 1380131 - DNA, 22 bp, Artificial Sequence
  chemically synthesized
tggtaactgcttattaaatagt

SEQ ID NO: 1380132 - DNA, 22 bp, Artificial Sequence
  chemically synthesized
ggtaactgcttattaaatagtt

SEQ ID NO: 1380133 - DNA, 22 bp, Artificial Sequence
  chemically synthesized
atacaacatcttaactatttaa

SEQ ID NO: 1380134 - DNA, 22 bp, Artificial Sequence
  chemically synthesized
gtaactgcttattaaatagtta

SEQ ID NO: 1380135 - DNA, 22 bp, Artificial Sequence
  chemically synthesized
ctcatacaacatcttaactatt

SEQ ID NO: 1380136 - DNA, 22 bp, Artificial Sequence
  chemically synthesized
ctcctcatacaacatcttaact

SEQ ID NO: 1380137 - DNA, 22 bp, Artificial Sequence
  chemically synthesized
gctcctcatacaacatcttaac

SEQ ID NO: 1380138 - DNA, 22 bp, Artificial Sequence
  chemically synthesized
cttattaaatagttaagatgtt

SEQ ID NO: 1380139 - DNA, 22 bp, Artificial Sequence
  chemically synthesized
attaaatagttaagatgttgta

SEQ ID NO: 1380140 - DNA, 22 bp, Artificial Sequence
  chemically synthesized
ttaaatagttaagatgttgtat

SEQ ID NO: 1380141 - DNA, 22 bp, Artificial Sequence
  chemically synthesized
tcacttgctcctcatacaacat

SEQ ID NO: 1380142 - DNA, 22 bp, Artificial Sequence
  chemically synthesized
gtcacttgctcctcatacaaca

SEQ ID NO: 1380143 - DNA, 22 bp, Artificial Sequence
  chemically synthesized
aatagttaagatgttgtatgag

SEQ ID NO: 1380144 - DNA, 22 bp, Artificial Sequence
  chemically synthesized
atttgtcacttgctcctcatac

SEQ ID NO: 1380145 - DNA, 22 bp, Artificial Sequence
  chemically synthesized
ctaatttgtcacttgctcctca

SEQ ID NO: 1380146 - DNA, 22 bp, Artificial Sequence
  chemically synthesized
gctaatttgtcacttgctcctc

SEQ ID NO: 1380147 - DNA, 22 bp, Artificial Sequence
  chemically synthesized
agatgttgtatgaggagcaagt

SEQ ID NO: 1380148 - DNA, 22 bp, Artificial Sequence
  chemically synthesized
tatgaggagcaagtgacaaatt

SEQ ID NO: 1380149 - DNA, 22 bp, Artificial Sequence
  chemically synthesized
atatatgtttgctaatttgtca

SEQ ID NO: 1380150 - DNA, 22 bp, Artificial Sequence
  chemically synthesized
aaagcctcatatatgtttgcta

SEQ ID NO: 1380151 - DNA, 22 bp, Artificial Sequence
  chemically synthesized
ttcaaagcctcatatatgtttg

SEQ ID NO: 1380152 - DNA, 22 bp, Artificial Sequence
  chemically synthesized
ttattcaaagcctcatatatgt

SEQ ID NO: 1380153 - DNA, 22 bp, Artificial Sequence
  chemically synthesized
gctgttattcaaagcctcatat

SEQ ID NO: 1380154 - DNA, 22 bp, Artificial Sequence
  chemically synthesized
tggctgttattcaaagcctcat

SEQ ID NO: 1380155 - DNA, 22 bp, Artificial Sequence
  chemically synthesized
gcaaacatatatgaggctttga

SEQ ID NO: 1380156 - DNA, 22 bp, Artificial Sequence
  chemically synthesized
ctctggctgttattcaaagcct

SEQ ID NO: 1380157 - DNA, 22 bp, Artificial Sequence
  chemically synthesized
gtattactctggctgttattca

SEQ ID NO: 1380158 - DNA, 22 bp, Artificial Sequence
  chemically synthesized
agcctggtattactctggctgt

SEQ ID NO: 1380159 - DNA, 22 bp, Artificial Sequence
  chemically synthesized
attcagcctggtattactctgg

SEQ ID NO: 1380160 - DNA, 22 bp, Artificial Sequence
  chemically synthesized
tgaataacagccagagtaatac

SEQ ID NO: 1380161 - DNA, 22 bp, Artificial Sequence
  chemically synthesized
gaataacagccagagtaatacc

SEQ ID NO: 1380162 - DNA, 22 bp, Artificial Sequence
  chemically synthesized
aataacagccagagtaatacca

SEQ ID NO: 1380163 - DNA, 22 bp, Artificial Sequence
  chemically synthesized
acatggtaattaattcagcctg

SEQ ID NO: 1380164 - DNA, 22 bp, Artificial Sequence
  chemically synthesized
aacatggtaattaattcagcct

SEQ ID NO: 1380165 - DNA, 22 bp, Artificial Sequence
  chemically synthesized
catatatttaacatggtaatta

SEQ ID NO: 1380166 - DNA, 22 bp, Artificial Sequence
  chemically synthesized
tgcatatatttaacatggtaat

SEQ ID NO: 1380167 - DNA, 22 bp, Artificial Sequence
  chemically synthesized
ccattctgcatatatttaacat

SEQ ID NO: 1380168 - DNA, 22 bp, Artificial Sequence
  chemically synthesized
aattaattaccatgttaaatat

SEQ ID NO: 1380169 - DNA, 22 bp, Artificial Sequence
  chemically synthesized
cccattctgcatatatttaaca

SEQ ID NO: 1380170 - DNA, 22 bp, Artificial Sequence
  chemically synthesized
tcccattctgcatatatttaac

SEQ ID NO: 1380171 - DNA, 22 bp, Artificial Sequence
  chemically synthesized
ttttcccattctgcatatattt

SEQ ID NO: 1380172 - DNA, 22 bp, Artificial Sequence
  chemically synthesized
attaccatgttaaatatatgca

SEQ ID NO: 1380173 - DNA, 22 bp, Artificial Sequence
  chemically synthesized
attttcccattctgcatatatt

SEQ ID NO: 1380174 - DNA, 22 bp, Artificial Sequence
  chemically synthesized
tattttcccattctgcatatat

SEQ ID NO: 1380175 - DNA, 22 bp, Artificial Sequence
  chemically synthesized
ccatgttaaatatatgcagaat

SEQ ID NO: 1380176 - DNA, 22 bp, Artificial Sequence
  chemically synthesized
aatatatgcagaatgggaaaat

SEQ ID NO: 1380177 - DNA, 22 bp, Artificial Sequence
  chemically synthesized
tccatatcatagcaggtatttt

SEQ ID NO: 1380178 - DNA, 22 bp, Artificial Sequence
  chemically synthesized
gtccatatcatagcaggtattt

SEQ ID NO: 1380179 - DNA, 22 bp, Artificial Sequence
  chemically synthesized
tgtccatatcatagcaggtatt

SEQ ID NO: 1380180 - DNA, 22 bp, Artificial Sequence
  chemically synthesized
agataagttttgtccatatcat

SEQ ID NO: 1380181 - DNA, 22 bp, Artificial Sequence
  chemically synthesized
ctatgatatggacaaaacttat

SEQ ID NO: 1380182 - DNA, 22 bp, Artificial Sequence
  chemically synthesized
tgatatggacaaaacttatctt

SEQ ID NO: 1380183 - DNA, 22 bp, Artificial Sequence
  chemically synthesized
aaacaagtatattaagataagt

SEQ ID NO: 1380184 - DNA, 22 bp, Artificial Sequence
  chemically synthesized
caaacaagtatattaagataag

SEQ ID NO: 1380185 - DNA, 22 bp, Artificial Sequence
  chemically synthesized
gaagcgcccatcttcaaacaag

SEQ ID NO: 1380186 - DNA, 22 bp, Artificial Sequence
  chemically synthesized
atcttaatatacttgtttgaag

SEQ ID NO: 1380187 - DNA, 22 bp, Artificial Sequence
  chemically synthesized
ggaagcgcccatcttcaaacaa

SEQ ID NO: 1380188 - DNA, 22 bp, Artificial Sequence
  chemically synthesized
tcttaatatacttgtttgaaga

SEQ ID NO: 1380189 - DNA, 22 bp, Artificial Sequence
  chemically synthesized
tggaagcgcccatcttcaaaca

SEQ ID NO: 1380190 - DNA, 22 bp, Artificial Sequence
  chemically synthesized
ctttggaagcgcccatcttcaa

SEQ ID NO: 1380191 - DNA, 22 bp, Artificial Sequence
  chemically synthesized
aatatacttgtttgaagatggg

SEQ ID NO: 1380192 - DNA, 22 bp, Artificial Sequence
  chemically synthesized
cctttggaagcgcccatcttca

SEQ ID NO: 1380193 - DNA, 22 bp, Artificial Sequence
  chemically synthesized
atatacttgtttgaagatgggc

SEQ ID NO: 1380194 - DNA, 22 bp, Artificial Sequence
  chemically synthesized
atgagcttcctttggaagcgcc

SEQ ID NO: 1380195 - DNA, 22 bp, Artificial Sequence
  chemically synthesized
gtttgaagatgggcgcttccaa

SEQ ID NO: 1380196 - DNA, 22 bp, Artificial Sequence
  chemically synthesized
tttgaagatgggcgcttccaaa

SEQ ID NO: 1380197 - DNA, 22 bp, Artificial Sequence
  chemically synthesized
gaagatgggcgcttccaaagga

SEQ ID NO: 1380198 - DNA, 22 bp, Artificial Sequence
  chemically synthesized
aagatgggcgcttccaaaggaa

SEQ ID NO: 1380199 - DNA, 22 bp, Artificial Sequence
  chemically synthesized
ccaaaggaagctcatgagcata

SEQ ID NO: 1380200 - DNA, 22 bp, Artificial Sequence
  chemically synthesized
caaaggaagctcatgagcatat

SEQ ID NO: 1380201 - DNA, 22 bp, Artificial Sequence
  chemically synthesized
aacgcacagtaaagcgccatat

SEQ ID NO: 1380202 - DNA, 22 bp, Artificial Sequence
  chemically synthesized
aaacgcacagtaaagcgccata

SEQ ID NO: 1380203 - DNA, 22 bp, Artificial Sequence
  chemically synthesized
taaacgcacagtaaagcgccat

SEQ ID NO: 1380204 - DNA, 22 bp, Artificial Sequence
  chemically synthesized
ttaaacgcacagtaaagcgcca

SEQ ID NO: 1380205 - DNA, 22 bp, Artificial Sequence
  chemically synthesized
tttaaacgcacagtaaagcgcc

SEQ ID NO: 1380206 - DNA, 22 bp, Artificial Sequence
  chemically synthesized
atgagcatatggcgctttactg

SEQ ID NO: 1380207 - DNA, 22 bp, Artificial Sequence
  chemically synthesized
gcacaattttttaaacgcacag

SEQ ID NO: 1380208 - DNA, 22 bp, Artificial Sequence
  chemically synthesized
agcacaattttttaaacgcaca

SEQ ID NO: 1380209 - DNA, 22 bp, Artificial Sequence
  chemically synthesized
tagcacaattttttaaacgcac

SEQ ID NO: 1380210 - DNA, 22 bp, Artificial Sequence
  chemically synthesized
ttagcacaattttttaaacgca

SEQ ID NO: 1380211 - DNA, 22 bp, Artificial Sequence
  chemically synthesized
tactgtgcgtttaaaaaattgt

SEQ ID NO: 1380212 - DNA, 22 bp, Artificial Sequence
  chemically synthesized
actgtgcgtttaaaaaattgtg

SEQ ID NO: 1380213 - DNA, 22 bp, Artificial Sequence
  chemically synthesized
ctgtgcgtttaaaaaattgtgc

SEQ ID NO: 1380214 - DNA, 22 bp, Artificial Sequence
  chemically synthesized
tgcgtttaaaaaattgtgctaa

SEQ ID NO: 1380215 - DNA, 22 bp, Artificial Sequence
  chemically synthesized
ggacaaaacatgtttttagcac

SEQ ID NO: 1380216 - DNA, 22 bp, Artificial Sequence
  chemically synthesized
ctaggacaaaacatgtttttag

SEQ ID NO: 1380217 - DNA, 22 bp, Artificial Sequence
  chemically synthesized
aaaaaattgtgctaaaaacatg

SEQ ID NO: 1380218 - DNA, 22 bp, Artificial Sequence
  chemically synthesized
actaggacaaaacatgttttta

SEQ ID NO: 1380219 - DNA, 22 bp, Artificial Sequence
  chemically synthesized
aaaaattgtgctaaaaacatgt

SEQ ID NO: 1380220 - DNA, 22 bp, Artificial Sequence
  chemically synthesized
tgctaaaaacatgttttgtcct

SEQ ID NO: 1380221 - DNA, 22 bp, Artificial Sequence
  chemically synthesized
aaaaaacatttactaggacaaa

SEQ ID NO: 1380222 - DNA, 22 bp, Artificial Sequence
  chemically synthesized
aaaaaaacatttactaggacaa

SEQ ID NO: 1380223 - DNA, 22 bp, Artificial Sequence
  chemically synthesized
taaaaaaacatttactaggaca

SEQ ID NO: 1380224 - DNA, 22 bp, Artificial Sequence
  chemically synthesized
aaaacatgttttgtcctagtaa

SEQ ID NO: 1380225 - DNA, 22 bp, Artificial Sequence
  chemically synthesized
ttaaaaaaacatttactaggac

SEQ ID NO: 1380226 - DNA, 22 bp, Artificial Sequence
  chemically synthesized
tttttaaaaaaacatttactag

SEQ ID NO: 1380227 - DNA, 22 bp, Artificial Sequence
  chemically synthesized
tgtcctagtaaatgttttttta

SEQ ID NO: 1380228 - DNA, 22 bp, Artificial Sequence
  chemically synthesized
gtcctagtaaatgtttttttaa

SEQ ID NO: 1380229 - DNA, 22 bp, Artificial Sequence
  chemically synthesized
tcctagtaaatgtttttttaaa

SEQ ID NO: 1380230 - DNA, 22 bp, Artificial Sequence
  chemically synthesized
aaaaacaaagtctatttttaaa

SEQ ID NO: 1380231 - DNA, 22 bp, Artificial Sequence
  chemically synthesized
gtaaatgtttttttaaaaatag

SEQ ID NO: 1380232 - DNA, 22 bp, Artificial Sequence
  chemically synthesized
taaaaaacaaagtctattttta

SEQ ID NO: 1380233 - DNA, 22 bp, Artificial Sequence
  chemically synthesized
ctctaaaaaacaaagtctattt

SEQ ID NO: 1380234 - DNA, 22 bp, Artificial Sequence
  chemically synthesized
ttttaaaaatagactttgtttt

SEQ ID NO: 1380235 - DNA, 22 bp, Artificial Sequence
  chemically synthesized
tttaaaaatagactttgttttt

SEQ ID NO: 1380236 - DNA, 22 bp, Artificial Sequence
  chemically synthesized
ttaaaaatagactttgtttttt

SEQ ID NO: 1380237 - DNA, 22 bp, Artificial Sequence
  chemically synthesized
taaaaatagactttgtttttta

SEQ ID NO: 1380238 - DNA, 22 bp, Artificial Sequence
  chemically synthesized
aaaaatagactttgttttttag

SEQ ID NO: 1380239 - DNA, 22 bp, Artificial Sequence
  chemically synthesized
aaaatagactttgttttttaga

SEQ ID NO: 1380240 - DNA, 22 bp, Artificial Sequence
  chemically synthesized
tgaacgtaaaactcctctaaaa

SEQ ID NO: 1380241 - DNA, 22 bp, Artificial Sequence
  chemically synthesized
ctgtgaacgtaaaactcctcta

SEQ ID NO: 1380242 - DNA, 22 bp, Artificial Sequence
  chemically synthesized
tgttttttagaggagttttacg

SEQ ID NO: 1380243 - DNA, 22 bp, Artificial Sequence
  chemically synthesized
gttttttagaggagttttacgt

SEQ ID NO: 1380244 - DNA, 22 bp, Artificial Sequence
  chemically synthesized
gtcctgctgtgaacgtaaaact

SEQ ID NO: 1380245 - DNA, 22 bp, Artificial Sequence
  chemically synthesized
ttttttagaggagttttacgtt

SEQ ID NO: 1380246 - DNA, 22 bp, Artificial Sequence
  chemically synthesized
agtcctgctgtgaacgtaaaac

SEQ ID NO: 1380247 - DNA, 22 bp, Artificial Sequence
  chemically synthesized
tttagaggagttttacgttcac

SEQ ID NO: 1380248 - DNA, 22 bp, Artificial Sequence
  chemically synthesized
ttagaggagttttacgttcaca

SEQ ID NO: 1380249 - DNA, 22 bp, Artificial Sequence
  chemically synthesized
tagaggagttttacgttcacag

SEQ ID NO: 1380250 - DNA, 22 bp, Artificial Sequence
  chemically synthesized
cacttagtcctgctgtgaacgt

SEQ ID NO: 1380251 - DNA, 22 bp, Artificial Sequence
  chemically synthesized
agaggagttttacgttcacagc

SEQ ID NO: 1380252 - DNA, 22 bp, Artificial Sequence
  chemically synthesized
ccacttagtcctgctgtgaacg

SEQ ID NO: 1380253 - DNA, 22 bp, Artificial Sequence
  chemically synthesized
gaggagttttacgttcacagca

SEQ ID NO: 1380254 - DNA, 22 bp, Artificial Sequence
  chemically synthesized
cttccacttagtcctgctgtga

SEQ ID NO: 1380255 - DNA, 22 bp, Artificial Sequence
  chemically synthesized
ccttccacttagtcctgctgtg

SEQ ID NO: 1380256 - DNA, 22 bp, Artificial Sequence
  chemically synthesized
ttccttccacttagtcctgctg

SEQ ID NO: 1380257 - DNA, 22 bp, Artificial Sequence
  chemically synthesized
tcttccttccacttagtcctgc

SEQ ID NO: 1380258 - DNA, 22 bp, Artificial Sequence
  chemically synthesized
tacgttcacagcaggactaagt

SEQ ID NO: 1380259 - DNA, 22 bp, Artificial Sequence
  chemically synthesized
acgttcacagcaggactaagtg

SEQ ID NO: 1380260 - DNA, 22 bp, Artificial Sequence
  chemically synthesized
cgttcacagcaggactaagtgg

SEQ ID NO: 1380261 - DNA, 22 bp, Artificial Sequence
  chemically synthesized
acagcaggactaagtggaagga

SEQ ID NO: 1380262 - DNA, 22 bp, Artificial Sequence
  chemically synthesized
gatggtatatgagaaacctctc

SEQ ID NO: 1380263 - DNA, 22 bp, Artificial Sequence
  chemically synthesized
agtggaaggaagagaggtttct

SEQ ID NO: 1380264 - DNA, 22 bp, Artificial Sequence
  chemically synthesized
gtagggctagatggtatatgag

SEQ ID NO: 1380265 - DNA, 22 bp, Artificial Sequence
  chemically synthesized
tatgttcgtagggctagatggt

SEQ ID NO: 1380266 - DNA, 22 bp, Artificial Sequence
  chemically synthesized
ctcatataccatctagccctac

SEQ ID NO: 1380267 - DNA, 22 bp, Artificial Sequence
  chemically synthesized
tcatataccatctagccctacg

SEQ ID NO: 1380268 - DNA, 22 bp, Artificial Sequence
  chemically synthesized
atataccatctagccctacgaa

SEQ ID NO: 1380269 - DNA, 22 bp, Artificial Sequence
  chemically synthesized
atggtgggggaagctgtatgtt

SEQ ID NO: 1380270 - DNA, 22 bp, Artificial Sequence
  chemically synthesized
gatggtgggggaagctgtatgt

SEQ ID NO: 1380271 - DNA, 22 bp, Artificial Sequence
  chemically synthesized
tgatggtgggggaagctgtatg

SEQ ID NO: 1380272 - DNA, 22 bp, Artificial Sequence
  chemically synthesized
gccctacgaacatacagcttcc

SEQ ID NO: 1380273 - DNA, 22 bp, Artificial Sequence
  chemically synthesized
cgaacatacagcttcccccacc

SEQ ID NO: 1380274 - DNA, 22 bp, Artificial Sequence
  chemically synthesized
tggtatgaagttttgatggtgg

SEQ ID NO: 1380275 - DNA, 22 bp, Artificial Sequence
  chemically synthesized
cccccaccatcaaaacttcata

SEQ ID NO: 1380276 - DNA, 22 bp, Artificial Sequence
  chemically synthesized
ccccaccatcaaaacttcatac

SEQ ID NO: 1380277 - DNA, 22 bp, Artificial Sequence
  chemically synthesized
taacataccattgtggtatgaa

SEQ ID NO: 1380278 - DNA, 22 bp, Artificial Sequence
  chemically synthesized
atcaattgtaacataccattgt

SEQ ID NO: 1380279 - DNA, 22 bp, Artificial Sequence
  chemically synthesized
cataccacaatggtatgttaca

SEQ ID NO: 1380280 - DNA, 22 bp, Artificial Sequence
  chemically synthesized
ataccacaatggtatgttacaa

SEQ ID NO: 1380281 - DNA, 22 bp, Artificial Sequence
  chemically synthesized
tatcaatgtaggctcatcaatt

SEQ ID NO: 1380282 - DNA, 22 bp, Artificial Sequence
  chemically synthesized
acattgtatcaatgtaggctca

SEQ ID NO: 1380283 - DNA, 22 bp, Artificial Sequence
  chemically synthesized
gctgacattgtatcaatgtagg

SEQ ID NO: 1380284 - DNA, 22 bp, Artificial Sequence
  chemically synthesized
caattgatgagcctacattgat

SEQ ID NO: 1380285 - DNA, 22 bp, Artificial Sequence
  chemically synthesized
ggctgacattgtatcaatgtag

SEQ ID NO: 1380286 - DNA, 22 bp, Artificial Sequence
  chemically synthesized
tggctgacattgtatcaatgta

SEQ ID NO: 1380287 - DNA, 22 bp, Artificial Sequence
  chemically synthesized
atgagcctacattgatacaatg

SEQ ID NO: 1380288 - DNA, 22 bp, Artificial Sequence
  chemically synthesized
tggactttggctgacattgtat

SEQ ID NO: 1380289 - DNA, 22 bp, Artificial Sequence
  chemically synthesized
cattgatacaatgtcagccaaa

SEQ ID NO: 1380290 - DNA, 22 bp, Artificial Sequence
  chemically synthesized
atgtaatctatggactttggct

SEQ ID NO: 1380291 - DNA, 22 bp, Artificial Sequence
  chemically synthesized
atacaatgtcagccaaagtcca

SEQ ID NO: 1380292 - DNA, 22 bp, Artificial Sequence
  chemically synthesized
agtgaaacctaatgtaatctat

SEQ ID NO: 1380293 - DNA, 22 bp, Artificial Sequence
  chemically synthesized
tagcatgtacaacactgagtga

SEQ ID NO: 1380294 - DNA, 22 bp, Artificial Sequence
  chemically synthesized
cattaggtttcactcagtgttg

SEQ ID NO: 1380295 - DNA, 22 bp, Artificial Sequence
  chemically synthesized
ggtttcactcagtgttgtacat

SEQ ID NO: 1380296 - DNA, 22 bp, Artificial Sequence
  chemically synthesized
cccaaacctatagcatgtacaa

SEQ ID NO: 1380297 - DNA, 22 bp, Artificial Sequence
  chemically synthesized
gcccaaacctatagcatgtaca

SEQ ID NO: 1380298 - DNA, 22 bp, Artificial Sequence
  chemically synthesized
cactcagtgttgtacatgctat

SEQ ID NO: 1380299 - DNA, 22 bp, Artificial Sequence
  chemically synthesized
actcagtgttgtacatgctata

SEQ ID NO: 1380300 - DNA, 22 bp, Artificial Sequence
  chemically synthesized
agtgttgtacatgctataggtt

SEQ ID NO: 1380301 - DNA, 22 bp, Artificial Sequence
  chemically synthesized
aatacttgcccaaacctatagc

SEQ ID NO: 1380302 - DNA, 22 bp, Artificial Sequence
  chemically synthesized
tacatgctataggtttgggcaa

SEQ ID NO: 1380303 - DNA, 22 bp, Artificial Sequence
  chemically synthesized
taggtttgggcaagtattcaac

SEQ ID NO: 1380304 - DNA, 22 bp, Artificial Sequence
  chemically synthesized
tagtggtggacacatcgttgaa

SEQ ID NO: 1380305 - DNA, 22 bp, Artificial Sequence
  chemically synthesized
tatagtggtggacacatcgttg

SEQ ID NO: 1380306 - DNA, 22 bp, Artificial Sequence
  chemically synthesized
gggcaagtattcaacgatgtgt

SEQ ID NO: 1380307 - DNA, 22 bp, Artificial Sequence
  chemically synthesized
ggcaagtattcaacgatgtgtc

SEQ ID NO: 1380308 - DNA, 22 bp, Artificial Sequence
  chemically synthesized
tatgattctatagtggtggaca

SEQ ID NO: 1380309 - DNA, 22 bp, Artificial Sequence
  chemically synthesized
aacgatgtgtccaccactatag

SEQ ID NO: 1380310 - DNA, 22 bp, Artificial Sequence
  chemically synthesized
aacctgtatgattctatagtgg

SEQ ID NO: 1380311 - DNA, 22 bp, Artificial Sequence
  chemically synthesized
agatgttcaacctgtatgattc

SEQ ID NO: 1380312 - DNA, 22 bp, Artificial Sequence
  chemically synthesized
gagatgttcaacctgtatgatt

SEQ ID NO: 1380313 - DNA, 22 bp, Artificial Sequence
  chemically synthesized
gatttgagatgttcaacctgta

SEQ ID NO: 1380314 - DNA, 22 bp, Artificial Sequence
  chemically synthesized
agatttgagatgttcaacctgt

SEQ ID NO: 1380315 - DNA, 22 bp, Artificial Sequence
  chemically synthesized
tagatttgagatgttcaacctg

SEQ ID NO: 1380316 - DNA, 22 bp, Artificial Sequence
  chemically synthesized
ttagatttgagatgttcaacct

SEQ ID NO: 1380317 - DNA, 22 bp, Artificial Sequence
  chemically synthesized
tagaatcatacaggttgaacat

SEQ ID NO: 1380318 - DNA, 22 bp, Artificial Sequence
  chemically synthesized
gatttttagatttgagatgttc

SEQ ID NO: 1380319 - DNA, 22 bp, Artificial Sequence
  chemically synthesized
agatttttagatttgagatgtt

SEQ ID NO: 1380320 - DNA, 22 bp, Artificial Sequence
  chemically synthesized
tagatttttagatttgagatgt

SEQ ID NO: 1380321 - DNA, 22 bp, Artificial Sequence
  chemically synthesized
aattttagatttttagatttga

SEQ ID NO: 1380322 - DNA, 22 bp, Artificial Sequence
  chemically synthesized
gaattttagatttttagatttg

SEQ ID NO: 1380323 - DNA, 22 bp, Artificial Sequence
  chemically synthesized
aacatctcaaatctaaaaatct

SEQ ID NO: 1380324 - DNA, 22 bp, Artificial Sequence
  chemically synthesized
gagcatttgaattttagatttt

SEQ ID NO: 1380325 - DNA, 22 bp, Artificial Sequence
  chemically synthesized
ggagcatttgaattttagattt

SEQ ID NO: 1380326 - DNA, 22 bp, Artificial Sequence
  chemically synthesized
tggagcatttgaattttagatt

SEQ ID NO: 1380327 - DNA, 22 bp, Artificial Sequence
  chemically synthesized
aaatctaaaaatctaaaattca

SEQ ID NO: 1380328 - DNA, 22 bp, Artificial Sequence
  chemically synthesized
aattttggagcatttgaatttt

SEQ ID NO: 1380329 - DNA, 22 bp, Artificial Sequence
  chemically synthesized
gaattttggagcatttgaattt

SEQ ID NO: 1380330 - DNA, 22 bp, Artificial Sequence
  chemically synthesized
tgaattttggagcatttgaatt

SEQ ID NO: 1380331 - DNA, 22 bp, Artificial Sequence
  chemically synthesized
aaaatctaaaattcaaatgctc

SEQ ID NO: 1380332 - DNA, 22 bp, Artificial Sequence
  chemically synthesized
aaaagttttgaattttggagca

SEQ ID NO: 1380333 - DNA, 22 bp, Artificial Sequence
  chemically synthesized
caaaagttttgaattttggagc

SEQ ID NO: 1380334 - DNA, 22 bp, Artificial Sequence
  chemically synthesized
aaattcaaatgctccaaaattc

SEQ ID NO: 1380335 - DNA, 22 bp, Artificial Sequence
  chemically synthesized
aaatgctccaaaattcaaaact

SEQ ID NO: 1380336 - DNA, 22 bp, Artificial Sequence
  chemically synthesized
tcagcacttcaaaagttttgaa

SEQ ID NO: 1380337 - DNA, 22 bp, Artificial Sequence
  chemically synthesized
atcagcacttcaaaagttttga

SEQ ID NO: 1380338 - DNA, 22 bp, Artificial Sequence
  chemically synthesized
caaaattcaaaacttttgaagt

SEQ ID NO: 1380339 - DNA, 22 bp, Artificial Sequence
  chemically synthesized
gacatcttatcagcacttcaaa

SEQ ID NO: 1380340 - DNA, 22 bp, Artificial Sequence
  chemically synthesized
ggacatcttatcagcacttcaa

SEQ ID NO: 1380341 - DNA, 22 bp, Artificial Sequence
  chemically synthesized
tggacatcttatcagcacttca

SEQ ID NO: 1380342 - DNA, 22 bp, Artificial Sequence
  chemically synthesized
ctttggacatcttatcagcact

SEQ ID NO: 1380343 - DNA, 22 bp, Artificial Sequence
  chemically synthesized
aaaacttttgaagtgctgataa

SEQ ID NO: 1380344 - DNA, 22 bp, Artificial Sequence
  chemically synthesized
gctttggacatcttatcagcac

SEQ ID NO: 1380345 - DNA, 22 bp, Artificial Sequence
  chemically synthesized
ttgaagtgctgataagatgtcc

SEQ ID NO: 1380346 - DNA, 22 bp, Artificial Sequence
  chemically synthesized
tgaagtgctgataagatgtcca

SEQ ID NO: 1380347 - DNA, 22 bp, Artificial Sequence
  chemically synthesized
gaagtgctgataagatgtccaa

SEQ ID NO: 1380348 - DNA, 22 bp, Artificial Sequence
  chemically synthesized
aagtgctgataagatgtccaaa

SEQ ID NO: 1380349 - DNA, 22 bp, Artificial Sequence
  chemically synthesized
caatgagcatttgctttggaca

SEQ ID NO: 1380350 - DNA, 22 bp, Artificial Sequence
  chemically synthesized
ataagatgtccaaagcaaatgc

SEQ ID NO: 1380351 - DNA, 22 bp, Artificial Sequence
  chemically synthesized
aaatccaaaatgctccaatgag

SEQ ID NO: 1380352 - DNA, 22 bp, Artificial Sequence
  chemically synthesized
gaaatccaaaatgctccaatga

SEQ ID NO: 1380353 - DNA, 22 bp, Artificial Sequence
  chemically synthesized
aaaatttgaaatccaaaatgct

SEQ ID NO: 1380354 - DNA, 22 bp, Artificial Sequence
  chemically synthesized
attggagcattttggatttcaa

SEQ ID NO: 1380355 - DNA, 22 bp, Artificial Sequence
  chemically synthesized
gagcattttggatttcaaattt

SEQ ID NO: 1380356 - DNA, 22 bp, Artificial Sequence
  chemically synthesized
agcatcccaaatctgaaaattt

SEQ ID NO: 1380357 - DNA, 22 bp, Artificial Sequence
  chemically synthesized
tggatttcaaattttcagattt

SEQ ID NO: 1380358 - DNA, 22 bp, Artificial Sequence
  chemically synthesized
ggatttcaaattttcagatttg

SEQ ID NO: 1380359 - DNA, 22 bp, Artificial Sequence
  chemically synthesized
gatttcaaattttcagatttgg

SEQ ID NO: 1380360 - DNA, 22 bp, Artificial Sequence
  chemically synthesized
ccagttgagcatcccaaatctg

SEQ ID NO: 1380361 - DNA, 22 bp, Artificial Sequence
  chemically synthesized
accagttgagcatcccaaatct

SEQ ID NO: 1380362 - DNA, 22 bp, Artificial Sequence
  chemically synthesized
caaattttcagatttgggatgc

SEQ ID NO: 1380363 - DNA, 22 bp, Artificial Sequence
  chemically synthesized
aaattttcagatttgggatgct

SEQ ID NO: 1380364 - DNA, 22 bp, Artificial Sequence
  chemically synthesized
cacttaccagttgagcatccca

SEQ ID NO: 1380365 - DNA, 22 bp, Artificial Sequence
  chemically synthesized
tcagatttgggatgctcaactg

SEQ ID NO: 1380366 - DNA, 22 bp, Artificial Sequence
  chemically synthesized
cattacacttaccagttgagca

SEQ ID NO: 1380367 - DNA, 22 bp, Artificial Sequence
  chemically synthesized
cagatttgggatgctcaactgg

SEQ ID NO: 1380368 - DNA, 22 bp, Artificial Sequence
  chemically synthesized
acattacacttaccagttgagc

SEQ ID NO: 1380369 - DNA, 22 bp, Artificial Sequence
  chemically synthesized
agatttgggatgctcaactggt

SEQ ID NO: 1380370 - DNA, 22 bp, Artificial Sequence
  chemically synthesized
gggatgctcaactggtaagtgt

SEQ ID NO: 1380371 - DNA, 22 bp, Artificial Sequence
  chemically synthesized
ggatgctcaactggtaagtgta

SEQ ID NO: 1380372 - DNA, 22 bp, Artificial Sequence
  chemically synthesized
aaatatttacattacacttacc

SEQ ID NO: 1380373 - DNA, 22 bp, Artificial Sequence
  chemically synthesized
gaaatatttacattacacttac

SEQ ID NO: 1380374 - DNA, 22 bp, Artificial Sequence
  chemically synthesized
tgaaatatttacattacactta

SEQ ID NO: 1380375 - DNA, 22 bp, Artificial Sequence
  chemically synthesized
aactggtaagtgtaatgtaaat

SEQ ID NO: 1380376 - DNA, 22 bp, Artificial Sequence
  chemically synthesized
gtaagtgtaatgtaaatatttc

SEQ ID NO: 1380377 - DNA, 22 bp, Artificial Sequence
  chemically synthesized
gggggggggggcgattttgaaa

SEQ ID NO: 1380378 - DNA, 22 bp, Artificial Sequence
  chemically synthesized
ggggggggggggcgattttgaa

SEQ ID NO: 1380379 - DNA, 22 bp, Artificial Sequence
  chemically synthesized
tggggggggggggcgattttga

SEQ ID NO: 1380380 - DNA, 22 bp, Artificial Sequence
  chemically synthesized
ttggggggggggggcgattttg

SEQ ID NO: 1380381 - DNA, 22 bp, Artificial Sequence
  chemically synthesized
tttggggggggggggcgatttt

SEQ ID NO: 1380382 - DNA, 22 bp, Artificial Sequence
  chemically synthesized
ttttggggggggggggcgattt

SEQ ID NO: 1380383 - DNA, 22 bp, Artificial Sequence
  chemically synthesized
tttttggggggggggggcgatt

SEQ ID NO: 1380384 - DNA, 22 bp, Artificial Sequence
  chemically synthesized
ttttttggggggggggggcgat

SEQ ID NO: 1380385 - DNA, 22 bp, Artificial Sequence
  chemically synthesized
tttttttggggggggggggcga

SEQ ID NO: 1380386 - DNA, 22 bp, Artificial Sequence
  chemically synthesized
ttttttttggggggggggggcg

SEQ ID NO: 1380387 - DNA, 22 bp, Artificial Sequence
  chemically synthesized
tttttttttggggggggggggc

SEQ ID NO: 1380388 - DNA, 22 bp, Artificial Sequence
  chemically synthesized
ctttttttttttgggggggggg

SEQ ID NO: 1380389 - DNA, 22 bp, Artificial Sequence
  chemically synthesized
cctttttttttttggggggggg

SEQ ID NO: 1380390 - DNA, 22 bp, Artificial Sequence
  chemically synthesized
caaaatcgccccccccccccaa

SEQ ID NO: 1380391 - DNA, 22 bp, Artificial Sequence
  chemically synthesized
aaaatcgccccccccccccaaa

SEQ ID NO: 1380392 - DNA, 22 bp, Artificial Sequence
  chemically synthesized
agatttcctttttttttttggg

SEQ ID NO: 1380393 - DNA, 22 bp, Artificial Sequence
  chemically synthesized
cagatttcctttttttttttgg

SEQ ID NO: 1380394 - DNA, 22 bp, Artificial Sequence
  chemically synthesized
cgaccagaagtgtttcagattt

SEQ ID NO: 1380395 - DNA, 22 bp, Artificial Sequence
  chemically synthesized
gcgaccagaagtgtttcagatt

SEQ ID NO: 1380396 - DNA, 22 bp, Artificial Sequence
  chemically synthesized
tccgaaatgcttgcgaccagaa

SEQ ID NO: 1380397 - DNA, 22 bp, Artificial Sequence
  chemically synthesized
aaacacttctggtcgcaagcat

SEQ ID NO: 1380398 - DNA, 22 bp, Artificial Sequence
  chemically synthesized
tatattatccgaaatgcttgcg

SEQ ID NO: 1380399 - DNA, 22 bp, Artificial Sequence
  chemically synthesized
ctggtcgcaagcatttcggata

SEQ ID NO: 1380400 - DNA, 22 bp, Artificial Sequence
  chemically synthesized
tggtcgcaagcatttcggataa

SEQ ID NO: 1380401 - DNA, 22 bp, Artificial Sequence
  chemically synthesized
gtcgcaagcatttcggataata

SEQ ID NO: 1380402 - DNA, 22 bp, Artificial Sequence
  chemically synthesized
aggcagtgattatatattatcc

SEQ ID NO: 1380403 - DNA, 22 bp, Artificial Sequence
  chemically synthesized
aaggcagtgattatatattatc

SEQ ID NO: 1380404 - DNA, 22 bp, Artificial Sequence
  chemically synthesized
taaggcagtgattatatattat

SEQ ID NO: 1380405 - DNA, 22 bp, Artificial Sequence
  chemically synthesized
cggataatatataatcactgcc

SEQ ID NO: 1380406 - DNA, 22 bp, Artificial Sequence
  chemically synthesized
ggataatatataatcactgcct

SEQ ID NO: 1380407 - DNA, 22 bp, Artificial Sequence
  chemically synthesized
cagaagatctttaaggcagtga

SEQ ID NO: 1380408 - DNA, 22 bp, Artificial Sequence
  chemically synthesized
ccttaaagatcttctgtaatct

SEQ ID NO: 1380409 - DNA, 22 bp, Artificial Sequence
  chemically synthesized
aaagatcttctgtaatctgtct

SEQ ID NO: 1380410 - DNA, 22 bp, Artificial Sequence
  chemically synthesized
aagatcttctgtaatctgtcta

SEQ ID NO: 1380411 - DNA, 22 bp, Artificial Sequence
  chemically synthesized
cggcaggaggtggaatgtatag

SEQ ID NO: 1380412 - DNA, 22 bp, Artificial Sequence
  chemically synthesized
ctgtaatctgtctatacattcc

SEQ ID NO: 1380413 - DNA, 22 bp, Artificial Sequence
  chemically synthesized
tgtaatctgtctatacattcca

SEQ ID NO: 1380414 - DNA, 22 bp, Artificial Sequence
  chemically synthesized
taatctgtctatacattccacc

SEQ ID NO: 1380415 - DNA, 22 bp, Artificial Sequence
  chemically synthesized
ccaggggttgcggcaggaggtg

SEQ ID NO: 1380416 - DNA, 22 bp, Artificial Sequence
  chemically synthesized
tctatacattccacctcctgcc

SEQ ID NO: 1380417 - DNA, 22 bp, Artificial Sequence
  chemically synthesized
tacattccacctcctgccgcaa

SEQ ID NO: 1380418 - DNA, 22 bp, Artificial Sequence
  chemically synthesized
agtggttgccaggggttgcggc

SEQ ID NO: 1380419 - DNA, 22 bp, Artificial Sequence
  chemically synthesized
cagtggttgccaggggttgcgg

SEQ ID NO: 1380420 - DNA, 22 bp, Artificial Sequence
  chemically synthesized
cacctcctgccgcaacccctgg

SEQ ID NO: 1380421 - DNA, 22 bp, Artificial Sequence
  chemically synthesized
ctgccgcaacccctggcaacca

SEQ ID NO: 1380422 - DNA, 22 bp, Artificial Sequence
  chemically synthesized
ccgcaacccctggcaaccactg

SEQ ID NO: 1380423 - DNA, 22 bp, Artificial Sequence
  chemically synthesized
gcaaccactgaaaccactcatc

SEQ ID NO: 1380424 - DNA, 22 bp, Artificial Sequence
  chemically synthesized
tgatcacagtaaacagatgagt

SEQ ID NO: 1380425 - DNA, 22 bp, Artificial Sequence
  chemically synthesized
aaaccactcatctgtttactgt

SEQ ID NO: 1380426 - DNA, 22 bp, Artificial Sequence
  chemically synthesized
gaaatggcaaaactatgatcac

SEQ ID NO: 1380427 - DNA, 22 bp, Artificial Sequence
  chemically synthesized
atctgtttactgtgatcatagt

SEQ ID NO: 1380428 - DNA, 22 bp, Artificial Sequence
  chemically synthesized
tagaaatggcaaaactatgatc

SEQ ID NO: 1380429 - DNA, 22 bp, Artificial Sequence
  chemically synthesized
tttactgtgatcatagttttgc

SEQ ID NO: 1380430 - DNA, 22 bp, Artificial Sequence
  chemically synthesized
actgtgatcatagttttgccat

SEQ ID NO: 1380431 - DNA, 22 bp, Artificial Sequence
  chemically synthesized
ctgtgatcatagttttgccatt

SEQ ID NO: 1380432 - DNA, 22 bp, Artificial Sequence
  chemically synthesized
tgtggcattctagaaatggcaa

SEQ ID NO: 1380433 - DNA, 22 bp, Artificial Sequence
  chemically synthesized
tgatcatagttttgccatttct

SEQ ID NO: 1380434 - DNA, 22 bp, Artificial Sequence
  chemically synthesized
gactatgtggcattctagaaat

SEQ ID NO: 1380435 - DNA, 22 bp, Artificial Sequence
  chemically synthesized
cgactatgtggcattctagaaa

SEQ ID NO: 1380436 - DNA, 22 bp, Artificial Sequence
  chemically synthesized
aatttcgactatgtggcattct

SEQ ID NO: 1380437 - DNA, 22 bp, Artificial Sequence
  chemically synthesized
tgccatttctagaatgccacat

SEQ ID NO: 1380438 - DNA, 22 bp, Artificial Sequence
  chemically synthesized
gccatttctagaatgccacata

SEQ ID NO: 1380439 - DNA, 22 bp, Artificial Sequence
  chemically synthesized
ttgaatttcgactatgtggcat

SEQ ID NO: 1380440 - DNA, 22 bp, Artificial Sequence
  chemically synthesized
ccatttctagaatgccacatag

SEQ ID NO: 1380441 - DNA, 22 bp, Artificial Sequence
  chemically synthesized
ctagaatgccacatagtcgaaa

SEQ ID NO: 1380442 - DNA, 22 bp, Artificial Sequence
  chemically synthesized
catactgttgaatttcgactat

SEQ ID NO: 1380443 - DNA, 22 bp, Artificial Sequence
  chemically synthesized
tagaatgccacatagtcgaaat

SEQ ID NO: 1380444 - DNA, 22 bp, Artificial Sequence
  chemically synthesized
gaatgccacatagtcgaaattc

SEQ ID NO: 1380445 - DNA, 22 bp, Artificial Sequence
  chemically synthesized
aaagggttacatactgttgaat

SEQ ID NO: 1380446 - DNA, 22 bp, Artificial Sequence
  chemically synthesized
gaaagggttacatactgttgaa

SEQ ID NO: 1380447 - DNA, 22 bp, Artificial Sequence
  chemically synthesized
atttgaaagggttacatactgt

SEQ ID NO: 1380448 - DNA, 22 bp, Artificial Sequence
  chemically synthesized
aacagtatgtaaccctttcaaa

SEQ ID NO: 1380449 - DNA, 22 bp, Artificial Sequence
  chemically synthesized
agtgaaagaagctaatttgaaa

SEQ ID NO: 1380450 - DNA, 22 bp, Artificial Sequence
  chemically synthesized
ctaagtgaaagaagctaatttg

SEQ ID NO: 1380451 - DNA, 22 bp, Artificial Sequence
  chemically synthesized
tcaaattagcttctttcactta

SEQ ID NO: 1380452 - DNA, 22 bp, Artificial Sequence
  chemically synthesized
caaattagcttctttcacttag

SEQ ID NO: 1380453 - DNA, 22 bp, Artificial Sequence
  chemically synthesized
aaattagcttctttcacttagt

SEQ ID NO: 1380454 - DNA, 22 bp, Artificial Sequence
  chemically synthesized
taagtgcatattactaagtgaa

SEQ ID NO: 1380455 - DNA, 22 bp, Artificial Sequence
  chemically synthesized
gcttctttcacttagtaatatg

SEQ ID NO: 1380456 - DNA, 22 bp, Artificial Sequence
  chemically synthesized
ctttcacttagtaatatgcact

SEQ ID NO: 1380457 - DNA, 22 bp, Artificial Sequence
  chemically synthesized
tttcacttagtaatatgcactt

SEQ ID NO: 1380458 - DNA, 22 bp, Artificial Sequence
  chemically synthesized
tcacttagtaatatgcacttac

SEQ ID NO: 1380459 - DNA, 22 bp, Artificial Sequence
  chemically synthesized
cacttagtaatatgcacttaca

SEQ ID NO: 1380460 - DNA, 22 bp, Artificial Sequence
  chemically synthesized
acttagtaatatgcacttacag

SEQ ID NO: 1380461 - DNA, 22 bp, Artificial Sequence
  chemically synthesized
agtaatatgcacttacagttcc

SEQ ID NO: 1380462 - DNA, 22 bp, Artificial Sequence
  chemically synthesized
gtaatatgcacttacagttccc

SEQ ID NO: 1380463 - DNA, 22 bp, Artificial Sequence
  chemically synthesized
acagttcccccatatttgttgg

SEQ ID NO: 1380464 - DNA, 22 bp, Artificial Sequence
  chemically synthesized
cagttcccccatatttgttggt

SEQ ID NO: 1380465 - DNA, 22 bp, Artificial Sequence
  chemically synthesized
taaagccatgaaaaaagaccaa

SEQ ID NO: 1380466 - DNA, 22 bp, Artificial Sequence
  chemically synthesized
ccccatatttgttggtcttttt

SEQ ID NO: 1380467 - DNA, 22 bp, Artificial Sequence
  chemically synthesized
aaatgagctataaagccatgaa

SEQ ID NO: 1380468 - DNA, 22 bp, Artificial Sequence
  chemically synthesized
gttggtcttttttcatggcttt

SEQ ID NO: 1380469 - DNA, 22 bp, Artificial Sequence
  chemically synthesized
gaaatgagctataaagccatga

SEQ ID NO: 1380470 - DNA, 22 bp, Artificial Sequence
  chemically synthesized
ttggtcttttttcatggcttta

SEQ ID NO: 1380471 - DNA, 22 bp, Artificial Sequence
  chemically synthesized
tgaaatgagctataaagccatg

SEQ ID NO: 1380472 - DNA, 22 bp, Artificial Sequence
  chemically synthesized
gtcttttttcatggctttatag

SEQ ID NO: 1380473 - DNA, 22 bp, Artificial Sequence
  chemically synthesized
ttttcatggctttatagctcat

SEQ ID NO: 1380474 - DNA, 22 bp, Artificial Sequence
  chemically synthesized
aggacctttgaaatgagctata

SEQ ID NO: 1380475 - DNA, 22 bp, Artificial Sequence
  chemically synthesized
tttcatggctttatagctcatt

SEQ ID NO: 1380476 - DNA, 22 bp, Artificial Sequence
  chemically synthesized
ttcatggctttatagctcattt

SEQ ID NO: 1380477 - DNA, 22 bp, Artificial Sequence
  chemically synthesized
tcatggctttatagctcatttc

SEQ ID NO: 1380478 - DNA, 22 bp, Artificial Sequence
  chemically synthesized
ttcaggacctttgaaatgagct

SEQ ID NO: 1380479 - DNA, 22 bp, Artificial Sequence
  chemically synthesized
catggctttatagctcatttca

SEQ ID NO: 1380480 - DNA, 22 bp, Artificial Sequence
  chemically synthesized
atggctttatagctcatttcaa

SEQ ID NO: 1380481 - DNA, 22 bp, Artificial Sequence
  chemically synthesized
tatagctcatttcaaaggtcct

SEQ ID NO: 1380482 - DNA, 22 bp, Artificial Sequence
  chemically synthesized
atagctcatttcaaaggtcctg

SEQ ID NO: 1380483 - DNA, 22 bp, Artificial Sequence
  chemically synthesized
tagctcatttcaaaggtcctga

SEQ ID NO: 1380484 - DNA, 22 bp, Artificial Sequence
  chemically synthesized
atttcaaaggtcctgaataata

SEQ ID NO: 1380485 - DNA, 22 bp, Artificial Sequence
  chemically synthesized
caaaggtcctgaataatattct

SEQ ID NO: 1380486 - DNA, 22 bp, Artificial Sequence
  chemically synthesized
aaaggtcctgaataatattcta

SEQ ID NO: 1380487 - DNA, 22 bp, Artificial Sequence
  chemically synthesized
aataatattctattggctgcat

SEQ ID NO: 1380488 - DNA, 22 bp, Artificial Sequence
  chemically synthesized
tattggctgcatgtacctgttc

SEQ ID NO: 1380489 - DNA, 22 bp, Artificial Sequence
  chemically synthesized
ttggctgcatgtacctgttcat

SEQ ID NO: 1380490 - DNA, 22 bp, Artificial Sequence
  chemically synthesized
gctgcatgtacctgttcattca

SEQ ID NO: 1380491 - DNA, 22 bp, Artificial Sequence
  chemically synthesized
catgtacctgttcattcattca

SEQ ID NO: 1380492 - DNA, 22 bp, Artificial Sequence
  chemically synthesized
cataggtgagtgaatgaatgaa

SEQ ID NO: 1380493 - DNA, 22 bp, Artificial Sequence
  chemically synthesized
ccataggtgagtgaatgaatga

SEQ ID NO: 1380494 - DNA, 22 bp, Artificial Sequence
  chemically synthesized
cttccataggtgagtgaatgaa

SEQ ID NO: 1380495 - DNA, 22 bp, Artificial Sequence
  chemically synthesized
tccttccataggtgagtgaatg

SEQ ID NO: 1380496 - DNA, 22 bp, Artificial Sequence
  chemically synthesized
ttcattcattcattcactcacc

SEQ ID NO: 1380497 - DNA, 22 bp, Artificial Sequence
  chemically synthesized
attcattcattcactcacctat

SEQ ID NO: 1380498 - DNA, 22 bp, Artificial Sequence
  chemically synthesized
attcattcactcacctatggaa

SEQ ID NO: 1380499 - DNA, 22 bp, Artificial Sequence
  chemically synthesized
attcactcacctatggaaggag

SEQ ID NO: 1380500 - DNA, 22 bp, Artificial Sequence
  chemically synthesized
taaacaatcaagctctccttcc

SEQ ID NO: 1380501 - DNA, 22 bp, Artificial Sequence
  chemically synthesized
gtaaacaatcaagctctccttc

SEQ ID NO: 1380502 - DNA, 22 bp, Artificial Sequence
  chemically synthesized
actcacctatggaaggagagct

SEQ ID NO: 1380503 - DNA, 22 bp, Artificial Sequence
  chemically synthesized
acctatggaaggagagcttgat

SEQ ID NO: 1380504 - DNA, 22 bp, Artificial Sequence
  chemically synthesized
accaaacttgtaaacaatcaag

SEQ ID NO: 1380505 - DNA, 22 bp, Artificial Sequence
  chemically synthesized
tggaaggagagcttgattgttt

SEQ ID NO: 1380506 - DNA, 22 bp, Artificial Sequence
  chemically synthesized
ataattgaccaaacttgtaaac

SEQ ID NO: 1380507 - DNA, 22 bp, Artificial Sequence
  chemically synthesized
ttcataattgaccaaacttgta

SEQ ID NO: 1380508 - DNA, 22 bp, Artificial Sequence
  chemically synthesized
gattgtttacaagtttggtcaa

SEQ ID NO: 1380509 - DNA, 22 bp, Artificial Sequence
  chemically synthesized
attgtttacaagtttggtcaat

SEQ ID NO: 1380510 - DNA, 22 bp, Artificial Sequence
  chemically synthesized
taattattcataattgaccaaa

SEQ ID NO: 1380511 - DNA, 22 bp, Artificial Sequence
  chemically synthesized
ataattattcataattgaccaa

SEQ ID NO: 1380512 - DNA, 22 bp, Artificial Sequence
  chemically synthesized
tttacaagtttggtcaattatg

SEQ ID NO: 1380513 - DNA, 22 bp, Artificial Sequence
  chemically synthesized
acaagtttggtcaattatgaat

SEQ ID NO: 1380514 - DNA, 22 bp, Artificial Sequence
  chemically synthesized
caagtttggtcaattatgaata

SEQ ID NO: 1380515 - DNA, 22 bp, Artificial Sequence
  chemically synthesized
agtgcaaatatttataattatt

SEQ ID NO: 1380516 - DNA, 22 bp, Artificial Sequence
  chemically synthesized
ggtcaattatgaataattataa

SEQ ID NO: 1380517 - DNA, 22 bp, Artificial Sequence
  chemically synthesized
gtcaattatgaataattataaa

SEQ ID NO: 1380518 - DNA, 22 bp, Artificial Sequence
  chemically synthesized
tgaataattataaatatttgca

SEQ ID NO: 1380519 - DNA, 22 bp, Artificial Sequence
  chemically synthesized
taaatatttgcactcaggtttt

SEQ ID NO: 1380520 - DNA, 22 bp, Artificial Sequence
  chemically synthesized
aaacatatccacacaaaaacct

SEQ ID NO: 1380521 - DNA, 22 bp, Artificial Sequence
  chemically synthesized
aaaacatatccacacaaaaacc

SEQ ID NO: 1380522 - DNA, 22 bp, Artificial Sequence
  chemically synthesized
gcactcaggtttttgtgtggat

SEQ ID NO: 1380523 - DNA, 22 bp, Artificial Sequence
  chemically synthesized
cactcaggtttttgtgtggata

SEQ ID NO: 1380524 - DNA, 22 bp, Artificial Sequence
  chemically synthesized
aggtttttgtgtggatatgttt

SEQ ID NO: 1380525 - DNA, 22 bp, Artificial Sequence
  chemically synthesized
cccagataagcttaaaacatat

SEQ ID NO: 1380526 - DNA, 22 bp, Artificial Sequence
  chemically synthesized
acccagataagcttaaaacata

SEQ ID NO: 1380527 - DNA, 22 bp, Artificial Sequence
  chemically synthesized
ttgtgtggatatgttttaagct

SEQ ID NO: 1380528 - DNA, 22 bp, Artificial Sequence
  chemically synthesized
tgtgtggatatgttttaagctt

SEQ ID NO: 1380529 - DNA, 22 bp, Artificial Sequence
  chemically synthesized
gtgtggatatgttttaagctta

SEQ ID NO: 1380530 - DNA, 22 bp, Artificial Sequence
  chemically synthesized
tgtggatatgttttaagcttat

SEQ ID NO: 1380531 - DNA, 22 bp, Artificial Sequence
  chemically synthesized
gtatttacccagataagcttaa

SEQ ID NO: 1380532 - DNA, 22 bp, Artificial Sequence
  chemically synthesized
ggtatttacccagataagctta

SEQ ID NO: 1380533 - DNA, 22 bp, Artificial Sequence
  chemically synthesized
cttggtatttacccagataagc

SEQ ID NO: 1380534 - DNA, 22 bp, Artificial Sequence
  chemically synthesized
tactccttggtatttacccaga

SEQ ID NO: 1380535 - DNA, 22 bp, Artificial Sequence
  chemically synthesized
taagcttatctgggtaaatacc

SEQ ID NO: 1380536 - DNA, 22 bp, Artificial Sequence
  chemically synthesized
aagcttatctgggtaaatacca

SEQ ID NO: 1380537 - DNA, 22 bp, Artificial Sequence
  chemically synthesized
agcttatctgggtaaataccaa

SEQ ID NO: 1380538 - DNA, 22 bp, Artificial Sequence
  chemically synthesized
gcaattgtactccttggtattt

SEQ ID NO: 1380539 - DNA, 22 bp, Artificial Sequence
  chemically synthesized
atctgggtaaataccaaggagt

SEQ ID NO: 1380540 - DNA, 22 bp, Artificial Sequence
  chemically synthesized
tctgggtaaataccaaggagta

SEQ ID NO: 1380541 - DNA, 22 bp, Artificial Sequence
  chemically synthesized
ggtaaataccaaggagtacaat

SEQ ID NO: 1380542 - DNA, 22 bp, Artificial Sequence
  chemically synthesized
tcatatgatctagcaattgtac

SEQ ID NO: 1380543 - DNA, 22 bp, Artificial Sequence
  chemically synthesized
atcatatgatctagcaattgta

SEQ ID NO: 1380544 - DNA, 22 bp, Artificial Sequence
  chemically synthesized
aacacacacttatcatatgatc

SEQ ID NO: 1380545 - DNA, 22 bp, Artificial Sequence
  chemically synthesized
ctagatcatatgataagtgtgt

SEQ ID NO: 1380546 - DNA, 22 bp, Artificial Sequence
  chemically synthesized
acaaaactaaacacacacttat

SEQ ID NO: 1380547 - DNA, 22 bp, Artificial Sequence
  chemically synthesized
tcacaaaactaaacacacactt

SEQ ID NO: 1380548 - DNA, 22 bp, Artificial Sequence
  chemically synthesized
gatcatatgataagtgtgtgtt

SEQ ID NO: 1380549 - DNA, 22 bp, Artificial Sequence
  chemically synthesized
ctcacaaaactaaacacacact

SEQ ID NO: 1380550 - DNA, 22 bp, Artificial Sequence
  chemically synthesized
gcagtttctcacaaaactaaac

SEQ ID NO: 1380551 - DNA, 22 bp, Artificial Sequence
  chemically synthesized
ggcagtttctcacaaaactaaa

SEQ ID NO: 1380552 - DNA, 22 bp, Artificial Sequence
  chemically synthesized
gaaaacaatttggcagtttctc

SEQ ID NO: 1380553 - DNA, 22 bp, Artificial Sequence
  chemically synthesized
ggaaaacaatttggcagtttct

SEQ ID NO: 1380554 - DNA, 22 bp, Artificial Sequence
  chemically synthesized
tggaaaacaatttggcagtttc

SEQ ID NO: 1380555 - DNA, 22 bp, Artificial Sequence
  chemically synthesized
agttttgtgagaaactgccaaa

SEQ ID NO: 1380556 - DNA, 22 bp, Artificial Sequence
  chemically synthesized
tttggaaaacaatttggcagtt

SEQ ID NO: 1380557 - DNA, 22 bp, Artificial Sequence
  chemically synthesized
gttttgtgagaaactgccaaat

SEQ ID NO: 1380558 - DNA, 22 bp, Artificial Sequence
  chemically synthesized
tgtgagaaactgccaaattgtt

SEQ ID NO: 1380559 - DNA, 22 bp, Artificial Sequence
  chemically synthesized
gtgagaaactgccaaattgttt

SEQ ID NO: 1380560 - DNA, 22 bp, Artificial Sequence
  chemically synthesized
tgagaaactgccaaattgtttt

SEQ ID NO: 1380561 - DNA, 22 bp, Artificial Sequence
  chemically synthesized
ccaaattgttttccaaagaggc

SEQ ID NO: 1380562 - DNA, 22 bp, Artificial Sequence
  chemically synthesized
ttttccaaagaggctgtaccct

SEQ ID NO: 1380563 - DNA, 22 bp, Artificial Sequence
  chemically synthesized
gtgggaatgcaaaagggtacag

SEQ ID NO: 1380564 - DNA, 22 bp, Artificial Sequence
  chemically synthesized
tccaaagaggctgtaccctttt

SEQ ID NO: 1380565 - DNA, 22 bp, Artificial Sequence
  chemically synthesized
ccaaagaggctgtacccttttg

SEQ ID NO: 1380566 - DNA, 22 bp, Artificial Sequence
  chemically synthesized
ctggtgggaatgcaaaagggta

SEQ ID NO: 1380567 - DNA, 22 bp, Artificial Sequence
  chemically synthesized
caaagaggctgtacccttttgc

SEQ ID NO: 1380568 - DNA, 22 bp, Artificial Sequence
  chemically synthesized
attgctggtgggaatgcaaaag

SEQ ID NO: 1380569 - DNA, 22 bp, Artificial Sequence
  chemically synthesized
cattgctggtgggaatgcaaaa

SEQ ID NO: 1380570 - DNA, 22 bp, Artificial Sequence
  chemically synthesized
tcattgctggtgggaatgcaaa

SEQ ID NO: 1380571 - DNA, 22 bp, Artificial Sequence
  chemically synthesized
tttcattgctggtgggaatgca

SEQ ID NO: 1380572 - DNA, 22 bp, Artificial Sequence
  chemically synthesized
tacccttttgcattcccaccag

SEQ ID NO: 1380573 - DNA, 22 bp, Artificial Sequence
  chemically synthesized
ttgcattcccaccagcaatgaa

SEQ ID NO: 1380574 - DNA, 22 bp, Artificial Sequence
  chemically synthesized
tgcattcccaccagcaatgaaa

SEQ ID NO: 1380575 - DNA, 22 bp, Artificial Sequence
  chemically synthesized
gcattcccaccagcaatgaaag

SEQ ID NO: 1380576 - DNA, 22 bp, Artificial Sequence
  chemically synthesized
cattcccaccagcaatgaaaga

SEQ ID NO: 1380577 - DNA, 22 bp, Artificial Sequence
  chemically synthesized
tgtaacaacaaaatctctttca

SEQ ID NO: 1380578 - DNA, 22 bp, Artificial Sequence
  chemically synthesized
ccaccagcaatgaaagagattt

SEQ ID NO: 1380579 - DNA, 22 bp, Artificial Sequence
  chemically synthesized
accaggttatgtaacaacaaaa

SEQ ID NO: 1380580 - DNA, 22 bp, Artificial Sequence
  chemically synthesized
tgttgttacataacctggtcag

SEQ ID NO: 1380581 - DNA, 22 bp, Artificial Sequence
  chemically synthesized
gttgttacataacctggtcagc

SEQ ID NO: 1380582 - DNA, 22 bp, Artificial Sequence
  chemically synthesized
acaacatcaaatgctgaccagg

SEQ ID NO: 1380583 - DNA, 22 bp, Artificial Sequence
  chemically synthesized
ttgttacataacctggtcagca

SEQ ID NO: 1380584 - DNA, 22 bp, Artificial Sequence
  chemically synthesized
ttacataacctggtcagcattt

SEQ ID NO: 1380585 - DNA, 22 bp, Artificial Sequence
  chemically synthesized
cataacctggtcagcatttgat

SEQ ID NO: 1380586 - DNA, 22 bp, Artificial Sequence
  chemically synthesized
gtcagcatttgatgttgtcagt

SEQ ID NO: 1380587 - DNA, 22 bp, Artificial Sequence
  chemically synthesized
gaatggccaaaatccaaaacac

SEQ ID NO: 1380588 - DNA, 22 bp, Artificial Sequence
  chemically synthesized
agaatggccaaaatccaaaaca

SEQ ID NO: 1380589 - DNA, 22 bp, Artificial Sequence
  chemically synthesized
gatgttgtcagtgttttggatt

SEQ ID NO: 1380590 - DNA, 22 bp, Artificial Sequence
  chemically synthesized
atgttgtcagtgttttggattt

SEQ ID NO: 1380591 - DNA, 22 bp, Artificial Sequence
  chemically synthesized
ttagaatggccaaaatccaaaa

SEQ ID NO: 1380592 - DNA, 22 bp, Artificial Sequence
  chemically synthesized
tcagtgttttggattttggcca

SEQ ID NO: 1380593 - DNA, 22 bp, Artificial Sequence
  chemically synthesized
agcacctcttagaatggccaaa

SEQ ID NO: 1380594 - DNA, 22 bp, Artificial Sequence
  chemically synthesized
ttaagcacctcttagaatggcc

SEQ ID NO: 1380595 - DNA, 22 bp, Artificial Sequence
  chemically synthesized
tggattttggccattctaagag

SEQ ID NO: 1380596 - DNA, 22 bp, Artificial Sequence
  chemically synthesized
cctgttaagcacctcttagaat

SEQ ID NO: 1380597 - DNA, 22 bp, Artificial Sequence
  chemically synthesized
ggattttggccattctaagagg

SEQ ID NO: 1380598 - DNA, 22 bp, Artificial Sequence
  chemically synthesized
acctgttaagcacctcttagaa

SEQ ID NO: 1380599 - DNA, 22 bp, Artificial Sequence
  chemically synthesized
gattttggccattctaagaggt

SEQ ID NO: 1380600 - DNA, 22 bp, Artificial Sequence
  chemically synthesized
tggccattctaagaggtgctta

SEQ ID NO: 1380601 - DNA, 22 bp, Artificial Sequence
  chemically synthesized
ggccattctaagaggtgcttaa

SEQ ID NO: 1380602 - DNA, 22 bp, Artificial Sequence
  chemically synthesized
gccattctaagaggtgcttaac

SEQ ID NO: 1380603 - DNA, 22 bp, Artificial Sequence
  chemically synthesized
aaaatatttacctgttaagcac

SEQ ID NO: 1380604 - DNA, 22 bp, Artificial Sequence
  chemically synthesized
aaaaatatttacctgttaagca

SEQ ID NO: 1380605 - DNA, 22 bp, Artificial Sequence
  chemically synthesized
cttaaaaatatttacctgttaa

SEQ ID NO: 1380606 - DNA, 22 bp, Artificial Sequence
  chemically synthesized
taagaggtgcttaacaggtaaa

SEQ ID NO: 1380607 - DNA, 22 bp, Artificial Sequence
  chemically synthesized
ttacttaaaaatatttacctgt

SEQ ID NO: 1380608 - DNA, 22 bp, Artificial Sequence
  chemically synthesized
agaggtgcttaacaggtaaata

SEQ ID NO: 1380609 - DNA, 22 bp, Artificial Sequence
  chemically synthesized
ttgttacttaaaaatatttacc

SEQ ID NO: 1380610 - DNA, 22 bp, Artificial Sequence
  chemically synthesized
aacaggtaaatatttttaagta

SEQ ID NO: 1380611 - DNA, 22 bp, Artificial Sequence
  chemically synthesized
acaggtaaatatttttaagtaa

SEQ ID NO: 1380612 - DNA, 22 bp, Artificial Sequence
  chemically synthesized
agaaagcatcattattgttact

SEQ ID NO: 1380613 - DNA, 22 bp, Artificial Sequence
  chemically synthesized
aagaaagcatcattattgttac

SEQ ID NO: 1380614 - DNA, 22 bp, Artificial Sequence
  chemically synthesized
taagaaagcatcattattgtta

SEQ ID NO: 1380615 - DNA, 22 bp, Artificial Sequence
  chemically synthesized
ttaagaaagcatcattattgtt

SEQ ID NO: 1380616 - DNA, 22 bp, Artificial Sequence
  chemically synthesized
tttaagaaagcatcattattgt

SEQ ID NO: 1380617 - DNA, 22 bp, Artificial Sequence
  chemically synthesized
ttaagtaacaataatgatgctt

SEQ ID NO: 1380618 - DNA, 22 bp, Artificial Sequence
  chemically synthesized
taagtaacaataatgatgcttt

SEQ ID NO: 1380619 - DNA, 22 bp, Artificial Sequence
  chemically synthesized
aagtaacaataatgatgctttc

SEQ ID NO: 1380620 - DNA, 22 bp, Artificial Sequence
  chemically synthesized
aaatctttttaagaaagcatca

SEQ ID NO: 1380621 - DNA, 22 bp, Artificial Sequence
  chemically synthesized
agtaacaataatgatgctttct

SEQ ID NO: 1380622 - DNA, 22 bp, Artificial Sequence
  chemically synthesized
aaaatctttttaagaaagcatc

SEQ ID NO: 1380623 - DNA, 22 bp, Artificial Sequence
  chemically synthesized
taaaatctttttaagaaagcat

SEQ ID NO: 1380624 - DNA, 22 bp, Artificial Sequence
  chemically synthesized
ttaaaatctttttaagaaagca

SEQ ID NO: 1380625 - DNA, 22 bp, Artificial Sequence
  chemically synthesized
tttaaaatctttttaagaaagc

SEQ ID NO: 1380626 - DNA, 22 bp, Artificial Sequence
  chemically synthesized
ttttaaaatctttttaagaaag

SEQ ID NO: 1380627 - DNA, 22 bp, Artificial Sequence
  chemically synthesized
aagaatttttttaaaatctttt

SEQ ID NO: 1380628 - DNA, 22 bp, Artificial Sequence
  chemically synthesized
gaagaatttttttaaaatcttt

SEQ ID NO: 1380629 - DNA, 22 bp, Artificial Sequence
  chemically synthesized
ttgaagaatttttttaaaatct

SEQ ID NO: 1380630 - DNA, 22 bp, Artificial Sequence
  chemically synthesized
tcttaaaaagattttaaaaaaa

SEQ ID NO: 1380631 - DNA, 22 bp, Artificial Sequence
  chemically synthesized
attcttgaagaatttttttaaa

SEQ ID NO: 1380632 - DNA, 22 bp, Artificial Sequence
  chemically synthesized
cttaaaaagattttaaaaaaat

SEQ ID NO: 1380633 - DNA, 22 bp, Artificial Sequence
  chemically synthesized
ttaaaaagattttaaaaaaatt

SEQ ID NO: 1380634 - DNA, 22 bp, Artificial Sequence
  chemically synthesized
aaaaagattttaaaaaaattct

SEQ ID NO: 1380635 - DNA, 22 bp, Artificial Sequence
  chemically synthesized
aaaagattttaaaaaaattctt

SEQ ID NO: 1380636 - DNA, 22 bp, Artificial Sequence
  chemically synthesized
taaaaaaattcttcaagaatca

SEQ ID NO: 1380637 - DNA, 22 bp, Artificial Sequence
  chemically synthesized
ggagtgtgtcgctgattcttga

SEQ ID NO: 1380638 - DNA, 22 bp, Artificial Sequence
  chemically synthesized
aaaaaaattcttcaagaatcag

SEQ ID NO: 1380639 - DNA, 22 bp, Artificial Sequence
  chemically synthesized
aggagtgtgtcgctgattcttg

SEQ ID NO: 1380640 - DNA, 22 bp, Artificial Sequence
  chemically synthesized
aaaaaattcttcaagaatcagc

SEQ ID NO: 1380641 - DNA, 22 bp, Artificial Sequence
  chemically synthesized
taggagtgtgtcgctgattctt

SEQ ID NO: 1380642 - DNA, 22 bp, Artificial Sequence
  chemically synthesized
gattttaggagtgtgtcgctga

SEQ ID NO: 1380643 - DNA, 22 bp, Artificial Sequence
  chemically synthesized
ggattttaggagtgtgtcgctg

SEQ ID NO: 1380644 - DNA, 22 bp, Artificial Sequence
  chemically synthesized
ttcaagaatcagcgacacactc

SEQ ID NO: 1380645 - DNA, 22 bp, Artificial Sequence
  chemically synthesized
caagaatcagcgacacactcct

SEQ ID NO: 1380646 - DNA, 22 bp, Artificial Sequence
  chemically synthesized
aagaatcagcgacacactccta

SEQ ID NO: 1380647 - DNA, 22 bp, Artificial Sequence
  chemically synthesized
agtatttggattttaggagtgt

SEQ ID NO: 1380648 - DNA, 22 bp, Artificial Sequence
  chemically synthesized
ttcagtatttggattttaggag

SEQ ID NO: 1380649 - DNA, 22 bp, Artificial Sequence
  chemically synthesized
ctgttcagtatttggattttag

SEQ ID NO: 1380650 - DNA, 22 bp, Artificial Sequence
  chemically synthesized
ctaaaatccaaatactgaacag

SEQ ID NO: 1380651 - DNA, 22 bp, Artificial Sequence
  chemically synthesized
aaatccaaatactgaacaggag

SEQ ID NO: 1380652 - DNA, 22 bp, Artificial Sequence
  chemically synthesized
gagaatgtgaacatgcactcct

SEQ ID NO: 1380653 - DNA, 22 bp, Artificial Sequence
  chemically synthesized
gactggagaatgtgaacatgca

SEQ ID NO: 1380654 - DNA, 22 bp, Artificial Sequence
  chemically synthesized
aacaggagtgcatgttcacatt

SEQ ID NO: 1380655 - DNA, 22 bp, Artificial Sequence
  chemically synthesized
aaaagtaactggactggagaat

SEQ ID NO: 1380656 - DNA, 22 bp, Artificial Sequence
  chemically synthesized
ctgaaaagtaactggactggag

SEQ ID NO: 1380657 - DNA, 22 bp, Artificial Sequence
  chemically synthesized
tgttactgaaaagtaactggac

SEQ ID NO: 1380658 - DNA, 22 bp, Artificial Sequence
  chemically synthesized
acattctccagtccagttactt

SEQ ID NO: 1380659 - DNA, 22 bp, Artificial Sequence
  chemically synthesized
tctatgttactgaaaagtaact

SEQ ID NO: 1380660 - DNA, 22 bp, Artificial Sequence
  chemically synthesized
ttgtctatgttactgaaaagta

SEQ ID NO: 1380661 - DNA, 22 bp, Artificial Sequence
  chemically synthesized
tccagtccagttacttttcagt

SEQ ID NO: 1380662 - DNA, 22 bp, Artificial Sequence
  chemically synthesized
cagtccagttacttttcagtaa

SEQ ID NO: 1380663 - DNA, 22 bp, Artificial Sequence
  chemically synthesized
cttttcagtaacatagacaaca

SEQ ID NO: 1380664 - DNA, 22 bp, Artificial Sequence
  chemically synthesized
gtagggcagtgctgttgtctat

SEQ ID NO: 1380665 - DNA, 22 bp, Artificial Sequence
  chemically synthesized
agtagggcagtgctgttgtcta

SEQ ID NO: 1380666 - DNA, 22 bp, Artificial Sequence
  chemically synthesized
tagtagggcagtgctgttgtct

SEQ ID NO: 1380667 - DNA, 22 bp, Artificial Sequence
  chemically synthesized
ttcagtaacatagacaacagca

SEQ ID NO: 1380668 - DNA, 22 bp, Artificial Sequence
  chemically synthesized
ttagtagggcagtgctgttgtc

SEQ ID NO: 1380669 - DNA, 22 bp, Artificial Sequence
  chemically synthesized
tcagtaacatagacaacagcac

SEQ ID NO: 1380670 - DNA, 22 bp, Artificial Sequence
  chemically synthesized
cagtaacatagacaacagcact

SEQ ID NO: 1380671 - DNA, 22 bp, Artificial Sequence
  chemically synthesized
agtaacatagacaacagcactg

SEQ ID NO: 1380672 - DNA, 22 bp, Artificial Sequence
  chemically synthesized
aagatttttagtagggcagtgc

SEQ ID NO: 1380673 - DNA, 22 bp, Artificial Sequence
  chemically synthesized
gaagatttttagtagggcagtg

SEQ ID NO: 1380674 - DNA, 22 bp, Artificial Sequence
  chemically synthesized
agaacacatcacttgaagattt

SEQ ID NO: 1380675 - DNA, 22 bp, Artificial Sequence
  chemically synthesized
gagaacacatcacttgaagatt

SEQ ID NO: 1380676 - DNA, 22 bp, Artificial Sequence
  chemically synthesized
tgagaacacatcacttgaagat

SEQ ID NO: 1380677 - DNA, 22 bp, Artificial Sequence
  chemically synthesized
ccctactaaaaatcttcaagtg

SEQ ID NO: 1380678 - DNA, 22 bp, Artificial Sequence
  chemically synthesized
ctaaaaatcttcaagtgatgtg

SEQ ID NO: 1380679 - DNA, 22 bp, Artificial Sequence
  chemically synthesized
aaaatcttcaagtgatgtgttc

SEQ ID NO: 1380680 - DNA, 22 bp, Artificial Sequence
  chemically synthesized
atgatgttttgagaacacatca

SEQ ID NO: 1380681 - DNA, 22 bp, Artificial Sequence
  chemically synthesized
tgatgatgttttgagaacacat

SEQ ID NO: 1380682 - DNA, 22 bp, Artificial Sequence
  chemically synthesized
tctgatgatgttttgagaacac

SEQ ID NO: 1380683 - DNA, 22 bp, Artificial Sequence
  chemically synthesized
caagtgatgtgttctcaaaaca

SEQ ID NO: 1380684 - DNA, 22 bp, Artificial Sequence
  chemically synthesized
attctctgatgatgttttgaga

SEQ ID NO: 1380685 - DNA, 22 bp, Artificial Sequence
  chemically synthesized
aagtgatgtgttctcaaaacat

SEQ ID NO: 1380686 - DNA, 22 bp, Artificial Sequence
  chemically synthesized
aattctctgatgatgttttgag

SEQ ID NO: 1380687 - DNA, 22 bp, Artificial Sequence
  chemically synthesized
taattctctgatgatgttttga

SEQ ID NO: 1380688 - DNA, 22 bp, Artificial Sequence
  chemically synthesized
attttaattctctgatgatgtt

SEQ ID NO: 1380689 - DNA, 22 bp, Artificial Sequence
  chemically synthesized
gctaattttaattctctgatga

SEQ ID NO: 1380690 - DNA, 22 bp, Artificial Sequence
  chemically synthesized
cgctaattttaattctctgatg

SEQ ID NO: 1380691 - DNA, 22 bp, Artificial Sequence
  chemically synthesized
tcaaaacatcatcagagaatta

SEQ ID NO: 1380692 - DNA, 22 bp, Artificial Sequence
  chemically synthesized
tcttcgctaattttaattctct

SEQ ID NO: 1380693 - DNA, 22 bp, Artificial Sequence
  chemically synthesized
aaaacatcatcagagaattaaa

SEQ ID NO: 1380694 - DNA, 22 bp, Artificial Sequence
  chemically synthesized
gtcttcgctaattttaattctc

SEQ ID NO: 1380695 - DNA, 22 bp, Artificial Sequence
  chemically synthesized
ttgtcttcgctaattttaattc

SEQ ID NO: 1380696 - DNA, 22 bp, Artificial Sequence
  chemically synthesized
tcttgtcttcgctaattttaat

SEQ ID NO: 1380697 - DNA, 22 bp, Artificial Sequence
  chemically synthesized
ctcttgtcttcgctaattttaa

SEQ ID NO: 1380698 - DNA, 22 bp, Artificial Sequence
  chemically synthesized
tctcttgtcttcgctaatttta

SEQ ID NO: 1380699 - DNA, 22 bp, Artificial Sequence
  chemically synthesized
ttctcttgtcttcgctaatttt

SEQ ID NO: 1380700 - DNA, 22 bp, Artificial Sequence
  chemically synthesized
tttttctcttgtcttcgctaat

SEQ ID NO: 1380701 - DNA, 22 bp, Artificial Sequence
  chemically synthesized
ttatttttctcttgtcttcgct

SEQ ID NO: 1380702 - DNA, 22 bp, Artificial Sequence
  chemically synthesized
aaattagcgaagacaagagaaa

SEQ ID NO: 1380703 - DNA, 22 bp, Artificial Sequence
  chemically synthesized
agaggttattatttttctcttg

SEQ ID NO: 1380704 - DNA, 22 bp, Artificial Sequence
  chemically synthesized
attcagaggttattatttttct

SEQ ID NO: 1380705 - DNA, 22 bp, Artificial Sequence
  chemically synthesized
gcgaagacaagagaaaaataat

SEQ ID NO: 1380706 - DNA, 22 bp, Artificial Sequence
  chemically synthesized
gattcagaggttattatttttc

SEQ ID NO: 1380707 - DNA, 22 bp, Artificial Sequence
  chemically synthesized
tttgattcagaggttattattt

SEQ ID NO: 1380708 - DNA, 22 bp, Artificial Sequence
  chemically synthesized
aaaggtatctatttgattcaga

SEQ ID NO: 1380709 - DNA, 22 bp, Artificial Sequence
  chemically synthesized
aaaaggtatctatttgattcag

SEQ ID NO: 1380710 - DNA, 22 bp, Artificial Sequence
  chemically synthesized
taaaaggtatctatttgattca

SEQ ID NO: 1380711 - DNA, 22 bp, Artificial Sequence
  chemically synthesized
tccctttaaaaggtatctattt

SEQ ID NO: 1380712 - DNA, 22 bp, Artificial Sequence
  chemically synthesized
tgaatcaaatagatacctttta

SEQ ID NO: 1380713 - DNA, 22 bp, Artificial Sequence
  chemically synthesized
aatcaaatagataccttttaaa

SEQ ID NO: 1380714 - DNA, 22 bp, Artificial Sequence
  chemically synthesized
taacagtaatgactatcccttt

SEQ ID NO: 1380715 - DNA, 22 bp, Artificial Sequence
  chemically synthesized
gtaacagtaatgactatccctt

SEQ ID NO: 1380716 - DNA, 22 bp, Artificial Sequence
  chemically synthesized
tgtaacagtaatgactatccct

SEQ ID NO: 1380717 - DNA, 22 bp, Artificial Sequence
  chemically synthesized
tattttgtaacagtaatgacta

SEQ ID NO: 1380718 - DNA, 22 bp, Artificial Sequence
  chemically synthesized
tatattttgtaacagtaatgac

SEQ ID NO: 1380719 - DNA, 22 bp, Artificial Sequence
  chemically synthesized
ttaaagggatagtcattactgt

SEQ ID NO: 1380720 - DNA, 22 bp, Artificial Sequence
  chemically synthesized
taaagggatagtcattactgtt

SEQ ID NO: 1380721 - DNA, 22 bp, Artificial Sequence
  chemically synthesized
tctatattttgtaacagtaatg

SEQ ID NO: 1380722 - DNA, 22 bp, Artificial Sequence
  chemically synthesized
aaagggatagtcattactgtta

SEQ ID NO: 1380723 - DNA, 22 bp, Artificial Sequence
  chemically synthesized
ctctatattttgtaacagtaat

SEQ ID NO: 1380724 - DNA, 22 bp, Artificial Sequence
  chemically synthesized
aagggatagtcattactgttac

SEQ ID NO: 1380725 - DNA, 22 bp, Artificial Sequence
  chemically synthesized
ctgttacaaaatatagagaaga

SEQ ID NO: 1380726 - DNA, 22 bp, Artificial Sequence
  chemically synthesized
ttacaaaatatagagaagattg

SEQ ID NO: 1380727 - DNA, 22 bp, Artificial Sequence
  chemically synthesized
caaaatatagagaagattgtat

SEQ ID NO: 1380728 - DNA, 22 bp, Artificial Sequence
  chemically synthesized
tgtaaatataatagcaagtata

SEQ ID NO: 1380729 - DNA, 22 bp, Artificial Sequence
  chemically synthesized
atgtaaatataatagcaagtat

SEQ ID NO: 1380730 - DNA, 22 bp, Artificial Sequence
  chemically synthesized
ataatatttatgtaaatataat

SEQ ID NO: 1380731 - DNA, 22 bp, Artificial Sequence
  chemically synthesized
tatacttgctattatatttaca

SEQ ID NO: 1380732 - DNA, 22 bp, Artificial Sequence
  chemically synthesized
ctaataatatttatgtaaatat

SEQ ID NO: 1380733 - DNA, 22 bp, Artificial Sequence
  chemically synthesized
cctaataatatttatgtaaata

SEQ ID NO: 1380734 - DNA, 22 bp, Artificial Sequence
  chemically synthesized
gctattatatttacataaatat

SEQ ID NO: 1380735 - DNA, 22 bp, Artificial Sequence
  chemically synthesized
ctattatatttacataaatatt

SEQ ID NO: 1380736 - DNA, 22 bp, Artificial Sequence
  chemically synthesized
atgagtttcctaataatattta

SEQ ID NO: 1380737 - DNA, 22 bp, Artificial Sequence
  chemically synthesized
ttatatttacataaatattatt

SEQ ID NO: 1380738 - DNA, 22 bp, Artificial Sequence
  chemically synthesized
gatgagtttcctaataatattt

SEQ ID NO: 1380739 - DNA, 22 bp, Artificial Sequence
  chemically synthesized
tatttacataaatattattagg

SEQ ID NO: 1380740 - DNA, 22 bp, Artificial Sequence
  chemically synthesized
acataaatattattaggaaact

SEQ ID NO: 1380741 - DNA, 22 bp, Artificial Sequence
  chemically synthesized
cataaatattattaggaaactc

SEQ ID NO: 1380742 - DNA, 22 bp, Artificial Sequence
  chemically synthesized
agtgaggcatttgatgagtttc

SEQ ID NO: 1380743 - DNA, 22 bp, Artificial Sequence
  chemically synthesized
tcagtgaggcatttgatgagtt

SEQ ID NO: 1380744 - DNA, 22 bp, Artificial Sequence
  chemically synthesized
aattctcagtgaggcatttgat

SEQ ID NO: 1380745 - DNA, 22 bp, Artificial Sequence
  chemically synthesized
ttaggaaactcatcaaatgcct

SEQ ID NO: 1380746 - DNA, 22 bp, Artificial Sequence
  chemically synthesized
aaattctcagtgaggcatttga

SEQ ID NO: 1380747 - DNA, 22 bp, Artificial Sequence
  chemically synthesized
taaattctcagtgaggcatttg

SEQ ID NO: 1380748 - DNA, 22 bp, Artificial Sequence
  chemically synthesized
ttaaattctcagtgaggcattt

SEQ ID NO: 1380749 - DNA, 22 bp, Artificial Sequence
  chemically synthesized
ggaaactcatcaaatgcctcac

SEQ ID NO: 1380750 - DNA, 22 bp, Artificial Sequence
  chemically synthesized
tttaaattctcagtgaggcatt

SEQ ID NO: 1380751 - DNA, 22 bp, Artificial Sequence
  chemically synthesized
atcaaatgcctcactgagaatt

SEQ ID NO: 1380752 - DNA, 22 bp, Artificial Sequence
  chemically synthesized
atacaaaatactttttaaattc

SEQ ID NO: 1380753 - DNA, 22 bp, Artificial Sequence
  chemically synthesized
actgagaatttaaaaagtattt

SEQ ID NO: 1380754 - DNA, 22 bp, Artificial Sequence
  chemically synthesized
tataaagctgatacaaaatact

SEQ ID NO: 1380755 - DNA, 22 bp, Artificial Sequence
  chemically synthesized
agaatttaaaaagtattttgta

SEQ ID NO: 1380756 - DNA, 22 bp, Artificial Sequence
  chemically synthesized
atataaagctgatacaaaatac

SEQ ID NO: 1380757 - DNA, 22 bp, Artificial Sequence
  chemically synthesized
tatataaagctgatacaaaata

SEQ ID NO: 1380758 - DNA, 22 bp, Artificial Sequence
  chemically synthesized
ttatataaagctgatacaaaat

SEQ ID NO: 1380759 - DNA, 22 bp, Artificial Sequence
  chemically synthesized
aaaaagtattttgtatcagctt

SEQ ID NO: 1380760 - DNA, 22 bp, Artificial Sequence
  chemically synthesized
aaaagtattttgtatcagcttt

SEQ ID NO: 1380761 - DNA, 22 bp, Artificial Sequence
  chemically synthesized
ataggcttttatataaagctga

SEQ ID NO: 1380762 - DNA, 22 bp, Artificial Sequence
  chemically synthesized
gataggcttttatataaagctg

SEQ ID NO: 1380763 - DNA, 22 bp, Artificial Sequence
  chemically synthesized
tgataggcttttatataaagct

SEQ ID NO: 1380764 - DNA, 22 bp, Artificial Sequence
  chemically synthesized
ttgataggcttttatataaagc

SEQ ID NO: 1380765 - DNA, 22 bp, Artificial Sequence
  chemically synthesized
acttttgataggcttttatata

SEQ ID NO: 1380766 - DNA, 22 bp, Artificial Sequence
  chemically synthesized
tgtatcagctttatataaaagc

SEQ ID NO: 1380767 - DNA, 22 bp, Artificial Sequence
  chemically synthesized
cacttttgataggcttttatat

SEQ ID NO: 1380768 - DNA, 22 bp, Artificial Sequence
  chemically synthesized
gtatcagctttatataaaagcc

SEQ ID NO: 1380769 - DNA, 22 bp, Artificial Sequence
  chemically synthesized
tatcagctttatataaaagcct

SEQ ID NO: 1380770 - DNA, 22 bp, Artificial Sequence
  chemically synthesized
atcccatttcacttttgatagg

SEQ ID NO: 1380771 - DNA, 22 bp, Artificial Sequence
  chemically synthesized
tatataaaagcctatcaaaagt

SEQ ID NO: 1380772 - DNA, 22 bp, Artificial Sequence
  chemically synthesized
atataaaagcctatcaaaagtg

SEQ ID NO: 1380773 - DNA, 22 bp, Artificial Sequence
  chemically synthesized
tataaaagcctatcaaaagtga

SEQ ID NO: 1380774 - DNA, 22 bp, Artificial Sequence
  chemically synthesized
tcaaaagtgaaatgggattaat

SEQ ID NO: 1380775 - DNA, 22 bp, Artificial Sequence
  chemically synthesized
atttactattacacattcttat

SEQ ID NO: 1380776 - DNA, 22 bp, Artificial Sequence
  chemically synthesized
actattacacattcttattcat

SEQ ID NO: 1380777 - DNA, 22 bp, Artificial Sequence
  chemically synthesized
ctattacacattcttattcatt

SEQ ID NO: 1380778 - DNA, 22 bp, Artificial Sequence
  chemically synthesized
ttacacattcttattcattctg

SEQ ID NO: 1380779 - DNA, 22 bp, Artificial Sequence
  chemically synthesized
cacattcttattcattctgttt

SEQ ID NO: 1380780 - DNA, 22 bp, Artificial Sequence
  chemically synthesized
ttattcattctgttttcttgct

SEQ ID NO: 1380781 - DNA, 22 bp, Artificial Sequence
  chemically synthesized
tataaagtgatgagcaagaaaa

SEQ ID NO: 1380782 - DNA, 22 bp, Artificial Sequence
  chemically synthesized
attcattctgttttcttgctca

SEQ ID NO: 1380783 - DNA, 22 bp, Artificial Sequence
  chemically synthesized
ttcattctgttttcttgctcat

SEQ ID NO: 1380784 - DNA, 22 bp, Artificial Sequence
  chemically synthesized
attctgttttcttgctcatcac

SEQ ID NO: 1380785 - DNA, 22 bp, Artificial Sequence
  chemically synthesized
tgttttcttgctcatcacttta

SEQ ID NO: 1380786 - DNA, 22 bp, Artificial Sequence
  chemically synthesized
ttttcttgctcatcactttata

SEQ ID NO: 1380787 - DNA, 22 bp, Artificial Sequence
  chemically synthesized
aaaatatataattgtataaagt

SEQ ID NO: 1380788 - DNA, 22 bp, Artificial Sequence
  chemically synthesized
tcttgctcatcactttatacaa

SEQ ID NO: 1380789 - DNA, 22 bp, Artificial Sequence
  chemically synthesized
aaaaatatataattgtataaag

SEQ ID NO: 1380790 - DNA, 22 bp, Artificial Sequence
  chemically synthesized
cttgctcatcactttatacaat

SEQ ID NO: 1380791 - DNA, 22 bp, Artificial Sequence
  chemically synthesized
taaaaatatataattgtataaa

SEQ ID NO: 1380792 - DNA, 22 bp, Artificial Sequence
  chemically synthesized
ttgctcatcactttatacaatt

SEQ ID NO: 1380793 - DNA, 22 bp, Artificial Sequence
  chemically synthesized
ttaaaaatatataattgtataa

SEQ ID NO: 1380794 - DNA, 22 bp, Artificial Sequence
  chemically synthesized
tttaaaaatatataattgtata

SEQ ID NO: 1380795 - DNA, 22 bp, Artificial Sequence
  chemically synthesized
gctcatcactttatacaattat

SEQ ID NO: 1380796 - DNA, 22 bp, Artificial Sequence
  chemically synthesized
ctcatcactttatacaattata

SEQ ID NO: 1380797 - DNA, 22 bp, Artificial Sequence
  chemically synthesized
atcactttatacaattatatat

SEQ ID NO: 1380798 - DNA, 22 bp, Artificial Sequence
  chemically synthesized
tatacaattatatatttttaaa

SEQ ID NO: 1380799 - DNA, 22 bp, Artificial Sequence
  chemically synthesized
atacaattatatatttttaaaa

SEQ ID NO: 1380800 - DNA, 22 bp, Artificial Sequence
  chemically synthesized
tacaattatatatttttaaaaa

SEQ ID NO: 1380801 - DNA, 22 bp, Artificial Sequence
  chemically synthesized
tatatttttaaaaagtacttat

SEQ ID NO: 1380802 - DNA, 22 bp, Artificial Sequence
  chemically synthesized
ttaaaaagtacttattgccttt

SEQ ID NO: 1380803 - DNA, 22 bp, Artificial Sequence
  chemically synthesized
taaaaagtacttattgcctttg

SEQ ID NO: 1380804 - DNA, 22 bp, Artificial Sequence
  chemically synthesized
aaaaagtacttattgcctttgt

SEQ ID NO: 1380805 - DNA, 22 bp, Artificial Sequence
  chemically synthesized
aaaagtacttattgcctttgta

SEQ ID NO: 1380806 - DNA, 22 bp, Artificial Sequence
  chemically synthesized
tcatcgacaaaatacaaaggca

SEQ ID NO: 1380807 - DNA, 22 bp, Artificial Sequence
  chemically synthesized
caacctatcatcgacaaaatac

SEQ ID NO: 1380808 - DNA, 22 bp, Artificial Sequence
  chemically synthesized
acaacctatcatcgacaaaata

SEQ ID NO: 1380809 - DNA, 22 bp, Artificial Sequence
  chemically synthesized
attgcctttgtattttgtcgat

SEQ ID NO: 1380810 - DNA, 22 bp, Artificial Sequence
  chemically synthesized
ttgcctttgtattttgtcgatg

SEQ ID NO: 1380811 - DNA, 22 bp, Artificial Sequence
  chemically synthesized
cctttgtattttgtcgatgata

SEQ ID NO: 1380812 - DNA, 22 bp, Artificial Sequence
  chemically synthesized
cagtaccttacaacctatcatc

SEQ ID NO: 1380813 - DNA, 22 bp, Artificial Sequence
  chemically synthesized
tgtattttgtcgatgataggtt

SEQ ID NO: 1380814 - DNA, 22 bp, Artificial Sequence
  chemically synthesized
gtattttgtcgatgataggttg

SEQ ID NO: 1380815 - DNA, 22 bp, Artificial Sequence
  chemically synthesized
tattttgtcgatgataggttgt

SEQ ID NO: 1380816 - DNA, 22 bp, Artificial Sequence
  chemically synthesized
tactacagtaccttacaaccta

SEQ ID NO: 1380817 - DNA, 22 bp, Artificial Sequence
  chemically synthesized
tgtactacagtaccttacaacc

SEQ ID NO: 1380818 - DNA, 22 bp, Artificial Sequence
  chemically synthesized
tgtcgatgataggttgtaaggt

SEQ ID NO: 1380819 - DNA, 22 bp, Artificial Sequence
  chemically synthesized
ctgtactacagtaccttacaac

SEQ ID NO: 1380820 - DNA, 22 bp, Artificial Sequence
  chemically synthesized
gtcgatgataggttgtaaggta

SEQ ID NO: 1380821 - DNA, 22 bp, Artificial Sequence
  chemically synthesized
tcgatgataggttgtaaggtac

SEQ ID NO: 1380822 - DNA, 22 bp, Artificial Sequence
  chemically synthesized
taaggtactgtagtacagaagc

SEQ ID NO: 1380823 - DNA, 22 bp, Artificial Sequence
  chemically synthesized
tagtacagaagctgcatctatg

SEQ ID NO: 1380824 - DNA, 22 bp, Artificial Sequence
  chemically synthesized
ggagacacacaggcatagatgc

SEQ ID NO: 1380825 - DNA, 22 bp, Artificial Sequence
  chemically synthesized
aggagacacacaggcatagatg

SEQ ID NO: 1380826 - DNA, 22 bp, Artificial Sequence
  chemically synthesized
tttaggagacacacaggcatag

SEQ ID NO: 1380827 - DNA, 22 bp, Artificial Sequence
  chemically synthesized
catctatgcctgtgtgtctcct

SEQ ID NO: 1380828 - DNA, 22 bp, Artificial Sequence
  chemically synthesized
aatcaatgactgtttaggagac

SEQ ID NO: 1380829 - DNA, 22 bp, Artificial Sequence
  chemically synthesized
tgcctgtgtgtctcctaaacag

SEQ ID NO: 1380830 - DNA, 22 bp, Artificial Sequence
  chemically synthesized
attgaatcaatgactgtttagg

SEQ ID NO: 1380831 - DNA, 22 bp, Artificial Sequence
  chemically synthesized
tgtgtctcctaaacagtcattg

SEQ ID NO: 1380832 - DNA, 22 bp, Artificial Sequence
  chemically synthesized
ctaaacagtcattgattcaatt

SEQ ID NO: 1380833 - DNA, 22 bp, Artificial Sequence
  chemically synthesized
aacagtcattgattcaattaat

SEQ ID NO: 1380834 - DNA, 22 bp, Artificial Sequence
  chemically synthesized
gaaaacaggtccacaaatatta

SEQ ID NO: 1380835 - DNA, 22 bp, Artificial Sequence
  chemically synthesized
attcaattaatatttgtggacc

SEQ ID NO: 1380836 - DNA, 22 bp, Artificial Sequence
  chemically synthesized
aattaatatttgtggacctgtt

SEQ ID NO: 1380837 - DNA, 22 bp, Artificial Sequence
  chemically synthesized
gcatgatagctggaaaacaggt

SEQ ID NO: 1380838 - DNA, 22 bp, Artificial Sequence
  chemically synthesized
atatttgtggacctgttttcca

SEQ ID NO: 1380839 - DNA, 22 bp, Artificial Sequence
  chemically synthesized
gaaactagcatgatagctggaa

SEQ ID NO: 1380840 - DNA, 22 bp, Artificial Sequence
  chemically synthesized
gtggacctgttttccagctatc

SEQ ID NO: 1380841 - DNA, 22 bp, Artificial Sequence
  chemically synthesized
tggacctgttttccagctatca

SEQ ID NO: 1380842 - DNA, 22 bp, Artificial Sequence
  chemically synthesized
tggaaactagcatgatagctgg

SEQ ID NO: 1380843 - DNA, 22 bp, Artificial Sequence
  chemically synthesized
ctggaaactagcatgatagctg

SEQ ID NO: 1380844 - DNA, 22 bp, Artificial Sequence
  chemically synthesized
ttttccagctatcatgctagtt

SEQ ID NO: 1380845 - DNA, 22 bp, Artificial Sequence
  chemically synthesized
atcatacttctggaaactagca

SEQ ID NO: 1380846 - DNA, 22 bp, Artificial Sequence
  chemically synthesized
tccagctatcatgctagtttcc

SEQ ID NO: 1380847 - DNA, 22 bp, Artificial Sequence
  chemically synthesized
gatcatacttctggaaactagc

SEQ ID NO: 1380848 - DNA, 22 bp, Artificial Sequence
  chemically synthesized
ccagctatcatgctagtttcca

SEQ ID NO: 1380849 - DNA, 22 bp, Artificial Sequence
  chemically synthesized
tgatcatacttctggaaactag

SEQ ID NO: 1380850 - DNA, 22 bp, Artificial Sequence
  chemically synthesized
cagctatcatgctagtttccag

SEQ ID NO: 1380851 - DNA, 22 bp, Artificial Sequence
  chemically synthesized
ttgatcatacttctggaaacta

SEQ ID NO: 1380852 - DNA, 22 bp, Artificial Sequence
  chemically synthesized
tcatgctagtttccagaagtat

SEQ ID NO: 1380853 - DNA, 22 bp, Artificial Sequence
  chemically synthesized
taatttttgatcatacttctgg

SEQ ID NO: 1380854 - DNA, 22 bp, Artificial Sequence
  chemically synthesized
ttgtaatttttgatcatacttc

SEQ ID NO: 1380855 - DNA, 22 bp, Artificial Sequence
  chemically synthesized
gttgtaatttttgatcatactt

SEQ ID NO: 1380856 - DNA, 22 bp, Artificial Sequence
  chemically synthesized
tgttgtaatttttgatcatact

SEQ ID NO: 1380857 - DNA, 22 bp, Artificial Sequence
  chemically synthesized
ttgttgtaatttttgatcatac

SEQ ID NO: 1380858 - DNA, 22 bp, Artificial Sequence
  chemically synthesized
gtttccagaagtatgatcaaaa

SEQ ID NO: 1380859 - DNA, 22 bp, Artificial Sequence
  chemically synthesized
ccagaagtatgatcaaaaatta

SEQ ID NO: 1380860 - DNA, 22 bp, Artificial Sequence
  chemically synthesized
cagaagtatgatcaaaaattac

SEQ ID NO: 1380861 - DNA, 22 bp, Artificial Sequence
  chemically synthesized
tgtgtgtaagtgtggatcgctt

SEQ ID NO: 1380862 - DNA, 22 bp, Artificial Sequence
  chemically synthesized
ttgtgtgtgtaagtgtggatcg

SEQ ID NO: 1380863 - DNA, 22 bp, Artificial Sequence
  chemically synthesized
caacaaaagcgatccacactta

SEQ ID NO: 1380864 - DNA, 22 bp, Artificial Sequence
  chemically synthesized
ctgttgtgtgtgtaagtgtgga

SEQ ID NO: 1380865 - DNA, 22 bp, Artificial Sequence
  chemically synthesized
ggactgctgttgtgtgtgtaag

SEQ ID NO: 1380866 - DNA, 22 bp, Artificial Sequence
  chemically synthesized
agaattaggactgctgttgtgt

SEQ ID NO: 1380867 - DNA, 22 bp, Artificial Sequence
  chemically synthesized
gagaattaggactgctgttgtg

SEQ ID NO: 1380868 - DNA, 22 bp, Artificial Sequence
  chemically synthesized
ttgagaattaggactgctgttg

SEQ ID NO: 1380869 - DNA, 22 bp, Artificial Sequence
  chemically synthesized
acacacacaacagcagtcctaa

SEQ ID NO: 1380870 - DNA, 22 bp, Artificial Sequence
  chemically synthesized
cacacacaacagcagtcctaat

SEQ ID NO: 1380871 - DNA, 22 bp, Artificial Sequence
  chemically synthesized
taatacaggttcttgagaatta

SEQ ID NO: 1380872 - DNA, 22 bp, Artificial Sequence
  chemically synthesized
tctataatacaggttcttgaga

SEQ ID NO: 1380873 - DNA, 22 bp, Artificial Sequence
  chemically synthesized
ctgtctataatacaggttcttg

SEQ ID NO: 1380874 - DNA, 22 bp, Artificial Sequence
  chemically synthesized
tattactgtctataatacaggt

SEQ ID NO: 1380875 - DNA, 22 bp, Artificial Sequence
  chemically synthesized
attctcaagaacctgtattata

SEQ ID NO: 1380876 - DNA, 22 bp, Artificial Sequence
  chemically synthesized
tcaagaacctgtattatagaca

SEQ ID NO: 1380877 - DNA, 22 bp, Artificial Sequence
  chemically synthesized
aagaacctgtattatagacagt

SEQ ID NO: 1380878 - DNA, 22 bp, Artificial Sequence
  chemically synthesized
tgtatctatattactgtctata

SEQ ID NO: 1380879 - DNA, 22 bp, Artificial Sequence
  chemically synthesized
atgtatctatattactgtctat

SEQ ID NO: 1380880 - DNA, 22 bp, Artificial Sequence
  chemically synthesized
tatgtatctatattactgtcta

SEQ ID NO: 1380881 - DNA, 22 bp, Artificial Sequence
  chemically synthesized
ttatgtatctatattactgtct

SEQ ID NO: 1380882 - DNA, 22 bp, Artificial Sequence
  chemically synthesized
tttttatgtatctatattactg

SEQ ID NO: 1380883 - DNA, 22 bp, Artificial Sequence
  chemically synthesized
tattatagacagtaatatagat

SEQ ID NO: 1380884 - DNA, 22 bp, Artificial Sequence
  chemically synthesized
attgtttttatgtatctatatt

SEQ ID NO: 1380885 - DNA, 22 bp, Artificial Sequence
  chemically synthesized
aattgtttttatgtatctatat

SEQ ID NO: 1380886 - DNA, 22 bp, Artificial Sequence
  chemically synthesized
taattgtttttatgtatctata

SEQ ID NO: 1380887 - DNA, 22 bp, Artificial Sequence
  chemically synthesized
tagacagtaatatagatacata

SEQ ID NO: 1380888 - DNA, 22 bp, Artificial Sequence
  chemically synthesized
aattttaattgtttttatgtat

SEQ ID NO: 1380889 - DNA, 22 bp, Artificial Sequence
  chemically synthesized
aagctgaattttaattgttttt

SEQ ID NO: 1380890 - DNA, 22 bp, Artificial Sequence
  chemically synthesized
ttaaagctgaattttaattgtt

SEQ ID NO: 1380891 - DNA, 22 bp, Artificial Sequence
  chemically synthesized
attaaagctgaattttaattgt

SEQ ID NO: 1380892 - DNA, 22 bp, Artificial Sequence
  chemically synthesized
ttattaaagctgaattttaatt

SEQ ID NO: 1380893 - DNA, 22 bp, Artificial Sequence
  chemically synthesized
tcttattaaagctgaattttaa

SEQ ID NO: 1380894 - DNA, 22 bp, Artificial Sequence
  chemically synthesized
ctcttattaaagctgaatttta

SEQ ID NO: 1380895 - DNA, 22 bp, Artificial Sequence
  chemically synthesized
aaattcagctttaataagagaa

SEQ ID NO: 1380896 - DNA, 22 bp, Artificial Sequence
  chemically synthesized
agctttaataagagaaacctct

SEQ ID NO: 1380897 - DNA, 22 bp, Artificial Sequence
  chemically synthesized
taataagagaaacctctggtgt

SEQ ID NO: 1380898 - DNA, 22 bp, Artificial Sequence
  chemically synthesized
acataaaaccaaacaccagagg

SEQ ID NO: 1380899 - DNA, 22 bp, Artificial Sequence
  chemically synthesized
aataagagaaacctctggtgtt

SEQ ID NO: 1380900 - DNA, 22 bp, Artificial Sequence
  chemically synthesized
ataagagaaacctctggtgttt

SEQ ID NO: 1380901 - DNA, 22 bp, Artificial Sequence
  chemically synthesized
tggtgtttggttttatgttaat

SEQ ID NO: 1380902 - DNA, 22 bp, Artificial Sequence
  chemically synthesized
gtgtttggttttatgttaattg

SEQ ID NO: 1380903 - DNA, 22 bp, Artificial Sequence
  chemically synthesized
tcatgacacagtacaattaaca

SEQ ID NO: 1380904 - DNA, 22 bp, Artificial Sequence
  chemically synthesized
ggttttatgttaattgtactgt

SEQ ID NO: 1380905 - DNA, 22 bp, Artificial Sequence
  chemically synthesized
gttttatgttaattgtactgtg

SEQ ID NO: 1380906 - DNA, 22 bp, Artificial Sequence
  chemically synthesized
tatgttaattgtactgtgtcat

SEQ ID NO: 1380907 - DNA, 22 bp, Artificial Sequence
  chemically synthesized
atgttaattgtactgtgtcatg

SEQ ID NO: 1380908 - DNA, 22 bp, Artificial Sequence
  chemically synthesized
tgttaattgtactgtgtcatga

SEQ ID NO: 1380909 - DNA, 22 bp, Artificial Sequence
  chemically synthesized
attgtactgtgtcatgatagta

SEQ ID NO: 1380910 - DNA, 22 bp, Artificial Sequence
  chemically synthesized
tactgtgtcatgatagtatgtg

SEQ ID NO: 1380911 - DNA, 22 bp, Artificial Sequence
  chemically synthesized
gggaaaaatacacacatactat

SEQ ID NO: 1380912 - DNA, 22 bp, Artificial Sequence
  chemically synthesized
agggaaaaatacacacatacta

SEQ ID NO: 1380913 - DNA, 22 bp, Artificial Sequence
  chemically synthesized
tgtcatgatagtatgtgtgtat

SEQ ID NO: 1380914 - DNA, 22 bp, Artificial Sequence
  chemically synthesized
tgtttagggaaaaatacacaca

SEQ ID NO: 1380915 - DNA, 22 bp, Artificial Sequence
  chemically synthesized
ggatcattatgtttagggaaaa

SEQ ID NO: 1380916 - DNA, 22 bp, Artificial Sequence
  chemically synthesized
ttccctaaacataatgatccta

SEQ ID NO: 1380917 - DNA, 22 bp, Artificial Sequence
  chemically synthesized
tccctaaacataatgatcctag

SEQ ID NO: 1380918 - DNA, 22 bp, Artificial Sequence
  chemically synthesized
atagaagacaaactaggatcat

SEQ ID NO: 1380919 - DNA, 22 bp, Artificial Sequence
  chemically synthesized
ccctaaacataatgatcctagt

SEQ ID NO: 1380920 - DNA, 22 bp, Artificial Sequence
  chemically synthesized
cctaaacataatgatcctagtt

SEQ ID NO: 1380921 - DNA, 22 bp, Artificial Sequence
  chemically synthesized
aacataatgatcctagtttgtc

SEQ ID NO: 1380922 - DNA, 22 bp, Artificial Sequence
  chemically synthesized
aaatactaatagaagacaaact

SEQ ID NO: 1380923 - DNA, 22 bp, Artificial Sequence
  chemically synthesized
ctaaaatactaatagaagacaa

SEQ ID NO: 1380924 - DNA, 22 bp, Artificial Sequence
  chemically synthesized
gtttgtcttctattagtatttt

SEQ ID NO: 1380925 - DNA, 22 bp, Artificial Sequence
  chemically synthesized
aggcatatactactaaaatact

SEQ ID NO: 1380926 - DNA, 22 bp, Artificial Sequence
  chemically synthesized
gtcttctattagtattttagta

SEQ ID NO: 1380927 - DNA, 22 bp, Artificial Sequence
  chemically synthesized
tcttctattagtattttagtag

SEQ ID NO: 1380928 - DNA, 22 bp, Artificial Sequence
  chemically synthesized
acattcaggcatatactactaa

SEQ ID NO: 1380929 - DNA, 22 bp, Artificial Sequence
  chemically synthesized
ctattagtattttagtagtata

SEQ ID NO: 1380930 - DNA, 22 bp, Artificial Sequence
  chemically synthesized
tattagtattttagtagtatat

SEQ ID NO: 1380931 - DNA, 22 bp, Artificial Sequence
  chemically synthesized
ttagtattttagtagtatatgc

SEQ ID NO: 1380932 - DNA, 22 bp, Artificial Sequence
  chemically synthesized
aaactcacattcaggcatatac

SEQ ID NO: 1380933 - DNA, 22 bp, Artificial Sequence
  chemically synthesized
gtattttagtagtatatgcctg

SEQ ID NO: 1380934 - DNA, 22 bp, Artificial Sequence
  chemically synthesized
tagtagtatatgcctgaatgtg

SEQ ID NO: 1380935 - DNA, 22 bp, Artificial Sequence
  chemically synthesized
agtagtatatgcctgaatgtga

SEQ ID NO: 1380936 - DNA, 22 bp, Artificial Sequence
  chemically synthesized
gtagtatatgcctgaatgtgag

SEQ ID NO: 1380937 - DNA, 22 bp, Artificial Sequence
  chemically synthesized
caatgtcaaattaaaactcaca

SEQ ID NO: 1380938 - DNA, 22 bp, Artificial Sequence
  chemically synthesized
acaatgtcaaattaaaactcac

SEQ ID NO: 1380939 - DNA, 22 bp, Artificial Sequence
  chemically synthesized
tacaatgtcaaattaaaactca

SEQ ID NO: 1380940 - DNA, 22 bp, Artificial Sequence
  chemically synthesized
actttacaatgtcaaattaaaa

SEQ ID NO: 1380941 - DNA, 22 bp, Artificial Sequence
  chemically synthesized
ttgactttacaatgtcaaatta

SEQ ID NO: 1380942 - DNA, 22 bp, Artificial Sequence
  chemically synthesized
aatgtgagttttaatttgacat

SEQ ID NO: 1380943 - DNA, 22 bp, Artificial Sequence
  chemically synthesized
attgactttacaatgtcaaatt

SEQ ID NO: 1380944 - DNA, 22 bp, Artificial Sequence
  chemically synthesized
tttattgactttacaatgtcaa

SEQ ID NO: 1380945 - DNA, 22 bp, Artificial Sequence
  chemically synthesized
ccgttatttattgactttacaa

SEQ ID NO: 1380946 - DNA, 22 bp, Artificial Sequence
  chemically synthesized
taatttgacattgtaaagtcaa

SEQ ID NO: 1380947 - DNA, 22 bp, Artificial Sequence
  chemically synthesized
aatttgacattgtaaagtcaat

SEQ ID NO: 1380948 - DNA, 22 bp, Artificial Sequence
  chemically synthesized
atttgacattgtaaagtcaata

SEQ ID NO: 1380949 - DNA, 22 bp, Artificial Sequence
  chemically synthesized
atctcccgttatttattgactt

SEQ ID NO: 1380950 - DNA, 22 bp, Artificial Sequence
  chemically synthesized
aatctcccgttatttattgact

SEQ ID NO: 1380951 - DNA, 22 bp, Artificial Sequence
  chemically synthesized
gacattgtaaagtcaataaata

SEQ ID NO: 1380952 - DNA, 22 bp, Artificial Sequence
  chemically synthesized
acattgtaaagtcaataaataa

SEQ ID NO: 1380953 - DNA, 22 bp, Artificial Sequence
  chemically synthesized
tatttaatctcccgttatttat

SEQ ID NO: 1380954 - DNA, 22 bp, Artificial Sequence
  chemically synthesized
atatttaatctcccgttattta

SEQ ID NO: 1380955 - DNA, 22 bp, Artificial Sequence
  chemically synthesized
tatatttaatctcccgttattt

SEQ ID NO: 1380956 - DNA, 22 bp, Artificial Sequence
  chemically synthesized
taaagtcaataaataacgggag

SEQ ID NO: 1380957 - DNA, 22 bp, Artificial Sequence
  chemically synthesized
aatgttttatatttaatctccc

SEQ ID NO: 1380958 - DNA, 22 bp, Artificial Sequence
  chemically synthesized
aaatgttttatatttaatctcc

SEQ ID NO: 1380959 - DNA, 22 bp, Artificial Sequence
  chemically synthesized
aagaggtttaaatgttttatat

SEQ ID NO: 1380960 - DNA, 22 bp, Artificial Sequence
  chemically synthesized
actgaagaggtttaaatgtttt

SEQ ID NO: 1380961 - DNA, 22 bp, Artificial Sequence
  chemically synthesized
aactgaagaggtttaaatgttt

SEQ ID NO: 1380962 - DNA, 22 bp, Artificial Sequence
  chemically synthesized
aatataaaacatttaaacctct

SEQ ID NO: 1380963 - DNA, 22 bp, Artificial Sequence
  chemically synthesized
catgccatcttaactgaagagg

SEQ ID NO: 1380964 - DNA, 22 bp, Artificial Sequence
  chemically synthesized
ccatgccatcttaactgaagag

SEQ ID NO: 1380965 - DNA, 22 bp, Artificial Sequence
  chemically synthesized
aaacctcttcagttaagatggc

SEQ ID NO: 1380966 - DNA, 22 bp, Artificial Sequence
  chemically synthesized
aacctcttcagttaagatggca

SEQ ID NO: 1380967 - DNA, 22 bp, Artificial Sequence
  chemically synthesized
ttcagttaagatggcatggaaa

SEQ ID NO: 1380968 - DNA, 22 bp, Artificial Sequence
  chemically synthesized
cagttaagatggcatggaaatt

SEQ ID NO: 1380969 - DNA, 22 bp, Artificial Sequence
  chemically synthesized
agttaagatggcatggaaattt

SEQ ID NO: 1380970 - DNA, 22 bp, Artificial Sequence
  chemically synthesized
agatggcatggaaatttcatga

SEQ ID NO: 1380971 - DNA, 22 bp, Artificial Sequence
  chemically synthesized
aataagtgtcaagtcatgaaat

SEQ ID NO: 1380972 - DNA, 22 bp, Artificial Sequence
  chemically synthesized
tatattaaataagtgtcaagtc

SEQ ID NO: 1380973 - DNA, 22 bp, Artificial Sequence
  chemically synthesized
tatatattaaataagtgtcaag

SEQ ID NO: 1380974 - DNA, 22 bp, Artificial Sequence
  chemically synthesized
ctatatattaaataagtgtcaa

SEQ ID NO: 1380975 - DNA, 22 bp, Artificial Sequence
  chemically synthesized
ttctatatattaaataagtgtc

SEQ ID NO: 1380976 - DNA, 22 bp, Artificial Sequence
  chemically synthesized
ttcttctatatattaaataagt

SEQ ID NO: 1380977 - DNA, 22 bp, Artificial Sequence
  chemically synthesized
catgacttgacacttatttaat

SEQ ID NO: 1380978 - DNA, 22 bp, Artificial Sequence
  chemically synthesized
attcttctatatattaaataag

SEQ ID NO: 1380979 - DNA, 22 bp, Artificial Sequence
  chemically synthesized
atgacttgacacttatttaata

SEQ ID NO: 1380980 - DNA, 22 bp, Artificial Sequence
  chemically synthesized
ttattcttctatatattaaata

SEQ ID NO: 1380981 - DNA, 22 bp, Artificial Sequence
  chemically synthesized
cttattcttctatatattaaat

SEQ ID NO: 1380982 - DNA, 22 bp, Artificial Sequence
  chemically synthesized
tcttattcttctatatattaaa

SEQ ID NO: 1380983 - DNA, 22 bp, Artificial Sequence
  chemically synthesized
tttcttattcttctatatatta

SEQ ID NO: 1380984 - DNA, 22 bp, Artificial Sequence
  chemically synthesized
ctttcttattcttctatatatt

SEQ ID NO: 1380985 - DNA, 22 bp, Artificial Sequence
  chemically synthesized
gacacttatttaatatatagaa

SEQ ID NO: 1380986 - DNA, 22 bp, Artificial Sequence
  chemically synthesized
tctttcttattcttctatatat

SEQ ID NO: 1380987 - DNA, 22 bp, Artificial Sequence
  chemically synthesized
acacttatttaatatatagaag

SEQ ID NO: 1380988 - DNA, 22 bp, Artificial Sequence
  chemically synthesized
tattttctttcttattcttcta

SEQ ID NO: 1380989 - DNA, 22 bp, Artificial Sequence
  chemically synthesized
atattttctttcttattcttct

SEQ ID NO: 1380990 - DNA, 22 bp, Artificial Sequence
  chemically synthesized
atttaatatatagaagaataag

SEQ ID NO: 1380991 - DNA, 22 bp, Artificial Sequence
  chemically synthesized
tatattttctttcttattcttc

SEQ ID NO: 1380992 - DNA, 22 bp, Artificial Sequence
  chemically synthesized
tttaatatatagaagaataaga

SEQ ID NO: 1380993 - DNA, 22 bp, Artificial Sequence
  chemically synthesized
ttatattttctttcttattctt

SEQ ID NO: 1380994 - DNA, 22 bp, Artificial Sequence
  chemically synthesized
tttatattttctttcttattct

SEQ ID NO: 1380995 - DNA, 22 bp, Artificial Sequence
  chemically synthesized
ttttatattttctttcttattc

SEQ ID NO: 1380996 - DNA, 22 bp, Artificial Sequence
  chemically synthesized
aatatatagaagaataagaaag

SEQ ID NO: 1380997 - DNA, 22 bp, Artificial Sequence
  chemically synthesized
tttttatattttctttcttatt

SEQ ID NO: 1380998 - DNA, 22 bp, Artificial Sequence
  chemically synthesized
atatatagaagaataagaaaga

SEQ ID NO: 1380999 - DNA, 22 bp, Artificial Sequence
  chemically synthesized
tttttttatattttctttctta

SEQ ID NO: 1381000 - DNA, 22 bp, Artificial Sequence
  chemically synthesized
ctttttttatattttctttctt

SEQ ID NO: 1381001 - DNA, 22 bp, Artificial Sequence
  chemically synthesized
tctttttttatattttctttct

SEQ ID NO: 1381002 - DNA, 22 bp, Artificial Sequence
  chemically synthesized
tttctttttttatattttcttt

SEQ ID NO: 1381003 - DNA, 22 bp, Artificial Sequence
  chemically synthesized
taacactctttctttttttata

SEQ ID NO: 1381004 - DNA, 22 bp, Artificial Sequence
  chemically synthesized
tgttataacactctttcttttt

SEQ ID NO: 1381005 - DNA, 22 bp, Artificial Sequence
  chemically synthesized
ctgtgttataacactctttctt

SEQ ID NO: 1381006 - DNA, 22 bp, Artificial Sequence
  chemically synthesized
agtcctactgtgttataacact

SEQ ID NO: 1381007 - DNA, 22 bp, Artificial Sequence
  chemically synthesized
tgtctaagtcctactgtgttat

SEQ ID NO: 1381008 - DNA, 22 bp, Artificial Sequence
  chemically synthesized
taacacagtaggacttagacac

SEQ ID NO: 1381009 - DNA, 22 bp, Artificial Sequence
  chemically synthesized
atatgtggaggtgccaagattg

SEQ ID NO: 1381010 - DNA, 22 bp, Artificial Sequence
  chemically synthesized
tgtctgatatgtggaggtgcca

SEQ ID NO: 1381011 - DNA, 22 bp, Artificial Sequence
  chemically synthesized
agacacaatcttggcacctcca

SEQ ID NO: 1381012 - DNA, 22 bp, Artificial Sequence
  chemically synthesized
gacacaatcttggcacctccac

SEQ ID NO: 1381013 - DNA, 22 bp, Artificial Sequence
  chemically synthesized
ctgtgtctgatatgtggaggtg

SEQ ID NO: 1381014 - DNA, 22 bp, Artificial Sequence
  chemically synthesized
cagctactgtgtctgatatgtg

SEQ ID NO: 1381015 - DNA, 22 bp, Artificial Sequence
  chemically synthesized
ggcacctccacatatcagacac

SEQ ID NO: 1381016 - DNA, 22 bp, Artificial Sequence
  chemically synthesized
gcacctccacatatcagacaca

SEQ ID NO: 1381017 - DNA, 22 bp, Artificial Sequence
  chemically synthesized
tcaggactgcagctactgtgtc

SEQ ID NO: 1381018 - DNA, 22 bp, Artificial Sequence
  chemically synthesized
cacatatcagacacagtagctg

SEQ ID NO: 1381019 - DNA, 22 bp, Artificial Sequence
  chemically synthesized
cccatggggggaaaatagtctg

SEQ ID NO: 1381020 - DNA, 22 bp, Artificial Sequence
  chemically synthesized
cagtcctgacagactattttcc

SEQ ID NO: 1381021 - DNA, 22 bp, Artificial Sequence
  chemically synthesized
acagactattttccccccatgg

SEQ ID NO: 1381022 - DNA, 22 bp, Artificial Sequence
  chemically synthesized
aatgcgaagccactacccatgg

SEQ ID NO: 1381023 - DNA, 22 bp, Artificial Sequence
  chemically synthesized
ttttccccccatgggtagtggc

SEQ ID NO: 1381024 - DNA, 22 bp, Artificial Sequence
  chemically synthesized
tccccccatgggtagtggcttc

SEQ ID NO: 1381025 - DNA, 22 bp, Artificial Sequence
  chemically synthesized
ccccccatgggtagtggcttcg

SEQ ID NO: 1381026 - DNA, 22 bp, Artificial Sequence
  chemically synthesized
cccccatgggtagtggcttcgc

SEQ ID NO: 1381027 - DNA, 22 bp, Artificial Sequence
  chemically synthesized
gtgaaggaatctaaatgcgaag

SEQ ID NO: 1381028 - DNA, 22 bp, Artificial Sequence
  chemically synthesized
agtgaaggaatctaaatgcgaa

SEQ ID NO: 1381029 - DNA, 22 bp, Artificial Sequence
  chemically synthesized
ttagtgaaggaatctaaatgcg

SEQ ID NO: 1381030 - DNA, 22 bp, Artificial Sequence
  chemically synthesized
cgcatttagattccttcactaa

SEQ ID NO: 1381031 - DNA, 22 bp, Artificial Sequence
  chemically synthesized
gcatttagattccttcactaag

SEQ ID NO: 1381032 - DNA, 22 bp, Artificial Sequence
  chemically synthesized
tacatgtggactcttagtgaag

SEQ ID NO: 1381033 - DNA, 22 bp, Artificial Sequence
  chemically synthesized
tcctgtacatgtggactcttag

SEQ ID NO: 1381034 - DNA, 22 bp, Artificial Sequence
  chemically synthesized
agattccttcactaagagtcca

SEQ ID NO: 1381035 - DNA, 22 bp, Artificial Sequence
  chemically synthesized
atcctgtacatgtggactctta

SEQ ID NO: 1381036 - DNA, 22 bp, Artificial Sequence
  chemically synthesized
gattccttcactaagagtccac

SEQ ID NO: 1381037 - DNA, 22 bp, Artificial Sequence
  chemically synthesized
gtttatcctgtacatgtggact

SEQ ID NO: 1381038 - DNA, 22 bp, Artificial Sequence
  chemically synthesized
cttcactaagagtccacatgta

SEQ ID NO: 1381039 - DNA, 22 bp, Artificial Sequence
  chemically synthesized
tagtttatcctgtacatgtgga

SEQ ID NO: 1381040 - DNA, 22 bp, Artificial Sequence
  chemically synthesized
cactaagagtccacatgtacag

SEQ ID NO: 1381041 - DNA, 22 bp, Artificial Sequence
  chemically synthesized
actaagagtccacatgtacagg

SEQ ID NO: 1381042 - DNA, 22 bp, Artificial Sequence
  chemically synthesized
attctagtttatcctgtacatg

SEQ ID NO: 1381043 - DNA, 22 bp, Artificial Sequence
  chemically synthesized
aattctagtttatcctgtacat

SEQ ID NO: 1381044 - DNA, 22 bp, Artificial Sequence
  chemically synthesized
agagtccacatgtacaggataa

SEQ ID NO: 1381045 - DNA, 22 bp, Artificial Sequence
  chemically synthesized
aagcagtgatcttaattctagt

SEQ ID NO: 1381046 - DNA, 22 bp, Artificial Sequence
  chemically synthesized
caagcagtgatcttaattctag

SEQ ID NO: 1381047 - DNA, 22 bp, Artificial Sequence
  chemically synthesized
tgacttcaagcagtgatcttaa

SEQ ID NO: 1381048 - DNA, 22 bp, Artificial Sequence
  chemically synthesized
gtgacttcaagcagtgatctta

SEQ ID NO: 1381049 - DNA, 22 bp, Artificial Sequence
  chemically synthesized
gaattaagatcactgcttgaag

SEQ ID NO: 1381050 - DNA, 22 bp, Artificial Sequence
  chemically synthesized
ccataacttgtgacttcaagca

SEQ ID NO: 1381051 - DNA, 22 bp, Artificial Sequence
  chemically synthesized
gccataacttgtgacttcaagc

SEQ ID NO: 1381052 - DNA, 22 bp, Artificial Sequence
  chemically synthesized
tgccataacttgtgacttcaag

SEQ ID NO: 1381053 - DNA, 22 bp, Artificial Sequence
  chemically synthesized
ttgccataacttgtgacttcaa

SEQ ID NO: 1381054 - DNA, 22 bp, Artificial Sequence
  chemically synthesized
agatcactgcttgaagtcacaa

SEQ ID NO: 1381055 - DNA, 22 bp, Artificial Sequence
  chemically synthesized
ggtgaacttttgccataacttg

SEQ ID NO: 1381056 - DNA, 22 bp, Artificial Sequence
  chemically synthesized
cttgaagtcacaagttatggca

SEQ ID NO: 1381057 - DNA, 22 bp, Artificial Sequence
  chemically synthesized
ctgggtgaacttttgccataac

SEQ ID NO: 1381058 - DNA, 22 bp, Artificial Sequence
  chemically synthesized
gaagtcacaagttatggcaaaa

SEQ ID NO: 1381059 - DNA, 22 bp, Artificial Sequence
  chemically synthesized
aagtcacaagttatggcaaaag

SEQ ID NO: 1381060 - DNA, 22 bp, Artificial Sequence
  chemically synthesized
aagaatgattgctgggtgaact

SEQ ID NO: 1381061 - DNA, 22 bp, Artificial Sequence
  chemically synthesized
caagaatgattgctgggtgaac

SEQ ID NO: 1381062 - DNA, 22 bp, Artificial Sequence
  chemically synthesized
tcaagaatgattgctgggtgaa

SEQ ID NO: 1381063 - DNA, 22 bp, Artificial Sequence
  chemically synthesized
ttcaagaatgattgctgggtga

SEQ ID NO: 1381064 - DNA, 22 bp, Artificial Sequence
  chemically synthesized
tggcaaaagttcacccagcaat

SEQ ID NO: 1381065 - DNA, 22 bp, Artificial Sequence
  chemically synthesized
ttttcaagaatgattgctgggt

SEQ ID NO: 1381066 - DNA, 22 bp, Artificial Sequence
  chemically synthesized
cttttcaagaatgattgctggg

SEQ ID NO: 1381067 - DNA, 22 bp, Artificial Sequence
  chemically synthesized
tcttttcaagaatgattgctgg

SEQ ID NO: 1381068 - DNA, 22 bp, Artificial Sequence
  chemically synthesized
ttcttttcaagaatgattgctg

SEQ ID NO: 1381069 - DNA, 22 bp, Artificial Sequence
  chemically synthesized
agacatttttcttttcaagaat

SEQ ID NO: 1381070 - DNA, 22 bp, Artificial Sequence
  chemically synthesized
acccagcaatcattcttgaaaa

SEQ ID NO: 1381071 - DNA, 22 bp, Artificial Sequence
  chemically synthesized
aagacatttttcttttcaagaa

SEQ ID NO: 1381072 - DNA, 22 bp, Artificial Sequence
  chemically synthesized
taagacatttttcttttcaaga

SEQ ID NO: 1381073 - DNA, 22 bp, Artificial Sequence
  chemically synthesized
ttaagacatttttcttttcaag

SEQ ID NO: 1381074 - DNA, 22 bp, Artificial Sequence
  chemically synthesized
ttgaaaagaaaaatgtcttaaa

SEQ ID NO: 1381075 - DNA, 22 bp, Artificial Sequence
  chemically synthesized
gaaaagaaaaatgtcttaaaaa

SEQ ID NO: 1381076 - DNA, 22 bp, Artificial Sequence
  chemically synthesized
aaaagaaaaatgtcttaaaaat

SEQ ID NO: 1381077 - DNA, 22 bp, Artificial Sequence
  chemically synthesized
aggcagcaggtcagcaaaattt

SEQ ID NO: 1381078 - DNA, 22 bp, Artificial Sequence
  chemically synthesized
tcaggcagcaggtcagcaaaat

SEQ ID NO: 1381079 - DNA, 22 bp, Artificial Sequence
  chemically synthesized
aaaaattttgctgacctgctgc

SEQ ID NO: 1381080 - DNA, 22 bp, Artificial Sequence
  chemically synthesized
aaaattttgctgacctgctgcc

SEQ ID NO: 1381081 - DNA, 22 bp, Artificial Sequence
  chemically synthesized
acataataggctctcaggcagc

SEQ ID NO: 1381082 - DNA, 22 bp, Artificial Sequence
  chemically synthesized
tgctgacctgctgcctgagagc

SEQ ID NO: 1381083 - DNA, 22 bp, Artificial Sequence
  chemically synthesized
ctaacataataggctctcaggc

SEQ ID NO: 1381084 - DNA, 22 bp, Artificial Sequence
  chemically synthesized
gctgacctgctgcctgagagcc

SEQ ID NO: 1381085 - DNA, 22 bp, Artificial Sequence
  chemically synthesized
ctgacctgctgcctgagagcct

SEQ ID NO: 1381086 - DNA, 22 bp, Artificial Sequence
  chemically synthesized
acctgctgcctgagagcctatt

SEQ ID NO: 1381087 - DNA, 22 bp, Artificial Sequence
  chemically synthesized
ctgcctgagagcctattatgtt

SEQ ID NO: 1381088 - DNA, 22 bp, Artificial Sequence
  chemically synthesized
cctgagagcctattatgttagg

SEQ ID NO: 1381089 - DNA, 22 bp, Artificial Sequence
  chemically synthesized
gtgtaacagattcctaacataa

SEQ ID NO: 1381090 - DNA, 22 bp, Artificial Sequence
  chemically synthesized
tagtgtaacagattcctaacat

SEQ ID NO: 1381091 - DNA, 22 bp, Artificial Sequence
  chemically synthesized
agagcctattatgttaggaatc

SEQ ID NO: 1381092 - DNA, 22 bp, Artificial Sequence
  chemically synthesized
ccgtatctctagtgtaacagat

SEQ ID NO: 1381093 - DNA, 22 bp, Artificial Sequence
  chemically synthesized
ttatgttaggaatctgttacac

SEQ ID NO: 1381094 - DNA, 22 bp, Artificial Sequence
  chemically synthesized
cccgtatctctagtgtaacaga

SEQ ID NO: 1381095 - DNA, 22 bp, Artificial Sequence
  chemically synthesized
ttcccgtatctctagtgtaaca

SEQ ID NO: 1381096 - DNA, 22 bp, Artificial Sequence
  chemically synthesized
tgttaggaatctgttacactag

SEQ ID NO: 1381097 - DNA, 22 bp, Artificial Sequence
  chemically synthesized
ggaatctgttacactagagata

SEQ ID NO: 1381098 - DNA, 22 bp, Artificial Sequence
  chemically synthesized
ttacactagagatacgggaaga

SEQ ID NO: 1381099 - DNA, 22 bp, Artificial Sequence
  chemically synthesized
cactagagatacgggaagaaca

SEQ ID NO: 1381100 - DNA, 22 bp, Artificial Sequence
  chemically synthesized
gagatacgggaagaacacacac

SEQ ID NO: 1381101 - DNA, 22 bp, Artificial Sequence
  chemically synthesized
atggcgtgtgtgtgtgtgtgtg

SEQ ID NO: 1381102 - DNA, 22 bp, Artificial Sequence
  chemically synthesized
catggcgtgtgtgtgtgtgtgt

SEQ ID NO: 1381103 - DNA, 22 bp, Artificial Sequence
  chemically synthesized
ccttcatggcgtgtgtgtgtgt

SEQ ID NO: 1381104 - DNA, 22 bp, Artificial Sequence
  chemically synthesized
tgccttcatggcgtgtgtgtgt

SEQ ID NO: 1381105 - DNA, 22 bp, Artificial Sequence
  chemically synthesized
ctgccttcatggcgtgtgtgtg

SEQ ID NO: 1381106 - DNA, 22 bp, Artificial Sequence
  chemically synthesized
cttctgccttcatggcgtgtgt

SEQ ID NO: 1381107 - DNA, 22 bp, Artificial Sequence
  chemically synthesized
ggctgcttctgccttcatggcg

SEQ ID NO: 1381108 - DNA, 22 bp, Artificial Sequence
  chemically synthesized
gggctgcttctgccttcatggc

SEQ ID NO: 1381109 - DNA, 22 bp, Artificial Sequence
  chemically synthesized
tgggctgcttctgccttcatgg

SEQ ID NO: 1381110 - DNA, 22 bp, Artificial Sequence
  chemically synthesized
ttttgggctgcttctgccttca

SEQ ID NO: 1381111 - DNA, 22 bp, Artificial Sequence
  chemically synthesized
gttttgggctgcttctgccttc

SEQ ID NO: 1381112 - DNA, 22 bp, Artificial Sequence
  chemically synthesized
atttgttttgggctgcttctgc

SEQ ID NO: 1381113 - DNA, 22 bp, Artificial Sequence
  chemically synthesized
aaattcatttgttttgggctgc

SEQ ID NO: 1381114 - DNA, 22 bp, Artificial Sequence
  chemically synthesized
agtactcaaattcatttgtttt

SEQ ID NO: 1381115 - DNA, 22 bp, Artificial Sequence
  chemically synthesized
aagattcagtactcaaattcat

SEQ ID NO: 1381116 - DNA, 22 bp, Artificial Sequence
  chemically synthesized
gaaatattgaagattcagtact

SEQ ID NO: 1381117 - DNA, 22 bp, Artificial Sequence
  chemically synthesized
attagaaatattgaagattcag

SEQ ID NO: 1381118 - DNA, 22 bp, Artificial Sequence
  chemically synthesized
gagtactgaatcttcaatattt

SEQ ID NO: 1381119 - DNA, 22 bp, Artificial Sequence
  chemically synthesized
agtactgaatcttcaatatttc

SEQ ID NO: 1381120 - DNA, 22 bp, Artificial Sequence
  chemically synthesized
tggtgataattaattagaaata

SEQ ID NO: 1381121 - DNA, 22 bp, Artificial Sequence
  chemically synthesized
gtggtgataattaattagaaat

SEQ ID NO: 1381122 - DNA, 22 bp, Artificial Sequence
  chemically synthesized
aatcttcaatatttctaattaa

SEQ ID NO: 1381123 - DNA, 22 bp, Artificial Sequence
  chemically synthesized
tttgtggtgataattaattaga

SEQ ID NO: 1381124 - DNA, 22 bp, Artificial Sequence
  chemically synthesized
caatatttctaattaattatca

SEQ ID NO: 1381125 - DNA, 22 bp, Artificial Sequence
  chemically synthesized
aatatttctaattaattatcac

SEQ ID NO: 1381126 - DNA, 22 bp, Artificial Sequence
  chemically synthesized
ctaattaattatcaccacaaac

SEQ ID NO: 1381127 - DNA, 22 bp, Artificial Sequence
  chemically synthesized
taattaattatcaccacaaaca

SEQ ID NO: 1381128 - DNA, 22 bp, Artificial Sequence
  chemically synthesized
ccacgtggagtgctgtttgtgg

SEQ ID NO: 1381129 - DNA, 22 bp, Artificial Sequence
  chemically synthesized
attaattatcaccacaaacagc

SEQ ID NO: 1381130 - DNA, 22 bp, Artificial Sequence
  chemically synthesized
ctaccacgtggagtgctgtttg

SEQ ID NO: 1381131 - DNA, 22 bp, Artificial Sequence
  chemically synthesized
attatcaccacaaacagcactc

SEQ ID NO: 1381132 - DNA, 22 bp, Artificial Sequence
  chemically synthesized
tcaccacaaacagcactccacg

SEQ ID NO: 1381133 - DNA, 22 bp, Artificial Sequence
  chemically synthesized
agatagtctactaccacgtgga

SEQ ID NO: 1381134 - DNA, 22 bp, Artificial Sequence
  chemically synthesized
gattcagatagtctactaccac

SEQ ID NO: 1381135 - DNA, 22 bp, Artificial Sequence
  chemically synthesized
cctagattcagatagtctacta

SEQ ID NO: 1381136 - DNA, 22 bp, Artificial Sequence
  chemically synthesized
cacgtggtagtagactatctga

SEQ ID NO: 1381137 - DNA, 22 bp, Artificial Sequence
  chemically synthesized
gaatagctgcctagattcagat

SEQ ID NO: 1381138 - DNA, 22 bp, Artificial Sequence
  chemically synthesized
gcccctggaatagctgcctaga

SEQ ID NO: 1381139 - DNA, 22 bp, Artificial Sequence
  chemically synthesized
tctgaatctaggcagctattcc

SEQ ID NO: 1381140 - DNA, 22 bp, Artificial Sequence
  chemically synthesized
aatctaggcagctattccaggg

SEQ ID NO: 1381141 - DNA, 22 bp, Artificial Sequence
  chemically synthesized
tccccatctggcccctggaata

SEQ ID NO: 1381142 - DNA, 22 bp, Artificial Sequence
  chemically synthesized
ttgtccccatctggcccctgga

SEQ ID NO: 1381143 - DNA, 22 bp, Artificial Sequence
  chemically synthesized
ggcagctattccaggggccaga

SEQ ID NO: 1381144 - DNA, 22 bp, Artificial Sequence
  chemically synthesized
ctgttgtccccatctggcccct

SEQ ID NO: 1381145 - DNA, 22 bp, Artificial Sequence
  chemically synthesized
gctgttgtccccatctggcccc

SEQ ID NO: 1381146 - DNA, 22 bp, Artificial Sequence
  chemically synthesized
tgctgttgtccccatctggccc

SEQ ID NO: 1381147 - DNA, 22 bp, Artificial Sequence
  chemically synthesized
ttccaggggccagatggggaca

SEQ ID NO: 1381148 - DNA, 22 bp, Artificial Sequence
  chemically synthesized
caccactttgctgttgtcccca

SEQ ID NO: 1381149 - DNA, 22 bp, Artificial Sequence
  chemically synthesized
caggggccagatggggacaaca

SEQ ID NO: 1381150 - DNA, 22 bp, Artificial Sequence
  chemically synthesized
ttccaccactttgctgttgtcc

SEQ ID NO: 1381151 - DNA, 22 bp, Artificial Sequence
  chemically synthesized
tatctgttccaccactttgctg

SEQ ID NO: 1381152 - DNA, 22 bp, Artificial Sequence
  chemically synthesized
ttatatctgttccaccactttg

SEQ ID NO: 1381153 - DNA, 22 bp, Artificial Sequence
  chemically synthesized
attatatctgttccaccacttt

SEQ ID NO: 1381154 - DNA, 22 bp, Artificial Sequence
  chemically synthesized
tgtttattatatctgttccacc

SEQ ID NO: 1381155 - DNA, 22 bp, Artificial Sequence
  chemically synthesized
tcattgtgtttattatatctgt

SEQ ID NO: 1381156 - DNA, 22 bp, Artificial Sequence
  chemically synthesized
ttgtcattgtgtttattatatc

SEQ ID NO: 1381157 - DNA, 22 bp, Artificial Sequence
  chemically synthesized
attgtcattgtgtttattatat

SEQ ID NO: 1381158 - DNA, 22 bp, Artificial Sequence
  chemically synthesized
tattgtcattgtgtttattata

SEQ ID NO: 1381159 - DNA, 22 bp, Artificial Sequence
  chemically synthesized
ttattgtcattgtgtttattat

SEQ ID NO: 1381160 - DNA, 22 bp, Artificial Sequence
  chemically synthesized
cttttattgtcattgtgtttat

SEQ ID NO: 1381161 - DNA, 22 bp, Artificial Sequence
  chemically synthesized
gcttttattgtcattgtgttta

SEQ ID NO: 1381162 - DNA, 22 bp, Artificial Sequence
  chemically synthesized
gagtaaaagggtttgcttttat

SEQ ID NO: 1381163 - DNA, 22 bp, Artificial Sequence
  chemically synthesized
agagtaaaagggtttgctttta

SEQ ID NO: 1381164 - DNA, 22 bp, Artificial Sequence
  chemically synthesized
gagcatttagagtaaaagggtt

SEQ ID NO: 1381165 - DNA, 22 bp, Artificial Sequence
  chemically synthesized
tggagcatttagagtaaaaggg

SEQ ID NO: 1381166 - DNA, 22 bp, Artificial Sequence
  chemically synthesized
ctggagcatttagagtaaaagg

SEQ ID NO: 1381167 - DNA, 22 bp, Artificial Sequence
  chemically synthesized
acagatttctggagcatttaga

SEQ ID NO: 1381168 - DNA, 22 bp, Artificial Sequence
  chemically synthesized
ttcacagatttctggagcattt

SEQ ID NO: 1381169 - DNA, 22 bp, Artificial Sequence
  chemically synthesized
attcacagatttctggagcatt

SEQ ID NO: 1381170 - DNA, 22 bp, Artificial Sequence
  chemically synthesized
tttattcacagatttctggagc

SEQ ID NO: 1381171 - DNA, 22 bp, Artificial Sequence
  chemically synthesized
ttactctaaatgctccagaaat

SEQ ID NO: 1381172 - DNA, 22 bp, Artificial Sequence
  chemically synthesized
atttattcacagatttctggag

SEQ ID NO: 1381173 - DNA, 22 bp, Artificial Sequence
  chemically synthesized
tactctaaatgctccagaaatc

SEQ ID NO: 1381174 - DNA, 22 bp, Artificial Sequence
  chemically synthesized
tatttattcacagatttctgga

SEQ ID NO: 1381175 - DNA, 22 bp, Artificial Sequence
  chemically synthesized
actctaaatgctccagaaatct

SEQ ID NO: 1381176 - DNA, 22 bp, Artificial Sequence
  chemically synthesized
ctctaaatgctccagaaatctg

SEQ ID NO: 1381177 - DNA, 22 bp, Artificial Sequence
  chemically synthesized
taaatgctccagaaatctgtga

SEQ ID NO: 1381178 - DNA, 22 bp, Artificial Sequence
  chemically synthesized
ggcctttatttattcacagatt

SEQ ID NO: 1381179 - DNA, 22 bp, Artificial Sequence
  chemically synthesized
aatgctccagaaatctgtgaat

SEQ ID NO: 1381180 - DNA, 22 bp, Artificial Sequence
  chemically synthesized
aggcctttatttattcacagat

SEQ ID NO: 1381181 - DNA, 22 bp, Artificial Sequence
  chemically synthesized
taggcctttatttattcacaga

SEQ ID NO: 1381182 - DNA, 22 bp, Artificial Sequence
  chemically synthesized
ttaggcctttatttattcacag

SEQ ID NO: 1381183 - DNA, 22 bp, Artificial Sequence
  chemically synthesized
tttaggcctttatttattcaca

SEQ ID NO: 1381184 - DNA, 22 bp, Artificial Sequence
  chemically synthesized
ttttaggcctttatttattcac

SEQ ID NO: 1381185 - DNA, 22 bp, Artificial Sequence
  chemically synthesized
cagaaatctgtgaataaataaa

SEQ ID NO: 1381186 - DNA, 22 bp, Artificial Sequence
  chemically synthesized
ccttttttaggcctttatttat

SEQ ID NO: 1381187 - DNA, 22 bp, Artificial Sequence
  chemically synthesized
tgccttttttaggcctttattt

SEQ ID NO: 1381188 - DNA, 22 bp, Artificial Sequence
  chemically synthesized
ctgccttttttaggcctttatt

SEQ ID NO: 1381189 - DNA, 22 bp, Artificial Sequence
  chemically synthesized
tctgccttttttaggcctttat

SEQ ID NO: 1381190 - DNA, 22 bp, Artificial Sequence
  chemically synthesized
tgaataaataaaggcctaaaaa

SEQ ID NO: 1381191 - DNA, 22 bp, Artificial Sequence
  chemically synthesized
aaaaaggcagaaaaccaccacc

SEQ ID NO: 1381192 - DNA, 22 bp, Artificial Sequence
  chemically synthesized
tggtggtggtggtggtggtggt

SEQ ID NO: 1381193 - DNA, 22 bp, Artificial Sequence
  chemically synthesized
tggttgtggtggtggtggtggt

SEQ ID NO: 1381194 - DNA, 22 bp, Artificial Sequence
  chemically synthesized
aatcattgtggttgtggtggtg

SEQ ID NO: 1381195 - DNA, 22 bp, Artificial Sequence
  chemically synthesized
atggttgaatcattgtggttgt

SEQ ID NO: 1381196 - DNA, 22 bp, Artificial Sequence
  chemically synthesized
aactcatggttgaatcattgtg

SEQ ID NO: 1381197 - DNA, 22 bp, Artificial Sequence
  chemically synthesized
gactgaactcatggttgaatca

SEQ ID NO: 1381198 - DNA, 22 bp, Artificial Sequence
  chemically synthesized
atctagactgaactcatggttg

SEQ ID NO: 1381199 - DNA, 22 bp, Artificial Sequence
  chemically synthesized
catctagactgaactcatggtt

SEQ ID NO: 1381200 - DNA, 22 bp, Artificial Sequence
  chemically synthesized
aaccatgagttcagtctagatg

SEQ ID NO: 1381201 - DNA, 22 bp, Artificial Sequence
  chemically synthesized
tatgagaataatttcatctaga

SEQ ID NO: 1381202 - DNA, 22 bp, Artificial Sequence
  chemically synthesized
agacatctatatgagaataatt

SEQ ID NO: 1381203 - DNA, 22 bp, Artificial Sequence
  chemically synthesized
agtctagatgaaattattctca

SEQ ID NO: 1381204 - DNA, 22 bp, Artificial Sequence
  chemically synthesized
cagacatctatatgagaataat

SEQ ID NO: 1381205 - DNA, 22 bp, Artificial Sequence
  chemically synthesized
ttcagacatctatatgagaata

SEQ ID NO: 1381206 - DNA, 22 bp, Artificial Sequence
  chemically synthesized
gatgaaattattctcatataga

SEQ ID NO: 1381207 - DNA, 22 bp, Artificial Sequence
  chemically synthesized
aaaatgttcttcagacatctat

SEQ ID NO: 1381208 - DNA, 22 bp, Artificial Sequence
  chemically synthesized
aaaaatgttcttcagacatcta

SEQ ID NO: 1381209 - DNA, 22 bp, Artificial Sequence
  chemically synthesized
tttaaaaatgttcttcagacat

SEQ ID NO: 1381210 - DNA, 22 bp, Artificial Sequence
  chemically synthesized
ttctcatatagatgtctgaaga

SEQ ID NO: 1381211 - DNA, 22 bp, Artificial Sequence
  chemically synthesized
tcatatagatgtctgaagaaca

SEQ ID NO: 1381212 - DNA, 22 bp, Artificial Sequence
  chemically synthesized
atatagatgtctgaagaacatt

SEQ ID NO: 1381213 - DNA, 22 bp, Artificial Sequence
  chemically synthesized
aacatattatttaaaaatgttc

SEQ ID NO: 1381214 - DNA, 22 bp, Artificial Sequence
  chemically synthesized
taaacatattatttaaaaatgt

SEQ ID NO: 1381215 - DNA, 22 bp, Artificial Sequence
  chemically synthesized
agaattctaaacatattattta

SEQ ID NO: 1381216 - DNA, 22 bp, Artificial Sequence
  chemically synthesized
aagaacatttttaaataatatg

SEQ ID NO: 1381217 - DNA, 22 bp, Artificial Sequence
  chemically synthesized
ttgagaattctaaacatattat

SEQ ID NO: 1381218 - DNA, 22 bp, Artificial Sequence
  chemically synthesized
ttgttgagaattctaaacatat

SEQ ID NO: 1381219 - DNA, 22 bp, Artificial Sequence
  chemically synthesized
attgttgagaattctaaacata

SEQ ID NO: 1381220 - DNA, 22 bp, Artificial Sequence
  chemically synthesized
tattgttgagaattctaaacat

SEQ ID NO: 1381221 - DNA, 22 bp, Artificial Sequence
  chemically synthesized
ttaaataatatgtttagaattc

SEQ ID NO: 1381222 - DNA, 22 bp, Artificial Sequence
  chemically synthesized
taaataatatgtttagaattct

SEQ ID NO: 1381223 - DNA, 22 bp, Artificial Sequence
  chemically synthesized
attttattgttgagaattctaa

SEQ ID NO: 1381224 - DNA, 22 bp, Artificial Sequence
  chemically synthesized
aaataatatgtttagaattctc

SEQ ID NO: 1381225 - DNA, 22 bp, Artificial Sequence
  chemically synthesized
aattttattgttgagaattcta

SEQ ID NO: 1381226 - DNA, 22 bp, Artificial Sequence
  chemically synthesized
aataatatgtttagaattctca

SEQ ID NO: 1381227 - DNA, 22 bp, Artificial Sequence
  chemically synthesized
taattttattgttgagaattct

SEQ ID NO: 1381228 - DNA, 22 bp, Artificial Sequence
  chemically synthesized
ttaattttattgttgagaattc

SEQ ID NO: 1381229 - DNA, 22 bp, Artificial Sequence
  chemically synthesized
tcttttaattttattgttgaga

SEQ ID NO: 1381230 - DNA, 22 bp, Artificial Sequence
  chemically synthesized
atcttttaattttattgttgag

SEQ ID NO: 1381231 - DNA, 22 bp, Artificial Sequence
  chemically synthesized
tatcttttaattttattgttga

SEQ ID NO: 1381232 - DNA, 22 bp, Artificial Sequence
  chemically synthesized
agaattctcaacaataaaatta

SEQ ID NO: 1381233 - DNA, 22 bp, Artificial Sequence
  chemically synthesized
agttttatcttttaattttatt

SEQ ID NO: 1381234 - DNA, 22 bp, Artificial Sequence
  chemically synthesized
gaattctcaacaataaaattaa

SEQ ID NO: 1381235 - DNA, 22 bp, Artificial Sequence
  chemically synthesized
ttgagttttatcttttaatttt

SEQ ID NO: 1381236 - DNA, 22 bp, Artificial Sequence
  chemically synthesized
attgagttttatcttttaattt

SEQ ID NO: 1381237 - DNA, 22 bp, Artificial Sequence
  chemically synthesized
tattgagttttatcttttaatt

SEQ ID NO: 1381238 - DNA, 22 bp, Artificial Sequence
  chemically synthesized
ttattgagttttatcttttaat

SEQ ID NO: 1381239 - DNA, 22 bp, Artificial Sequence
  chemically synthesized
tcaacaataaaattaaaagata

SEQ ID NO: 1381240 - DNA, 22 bp, Artificial Sequence
  chemically synthesized
tttattgagttttatcttttaa

SEQ ID NO: 1381241 - DNA, 22 bp, Artificial Sequence
  chemically synthesized
aacaataaaattaaaagataaa

SEQ ID NO: 1381242 - DNA, 22 bp, Artificial Sequence
  chemically synthesized
tttttattgagttttatctttt

SEQ ID NO: 1381243 - DNA, 22 bp, Artificial Sequence
  chemically synthesized
ttctttttattgagttttatct

SEQ ID NO: 1381244 - DNA, 22 bp, Artificial Sequence
  chemically synthesized
gttctttttattgagttttatc

SEQ ID NO: 1381245 - DNA, 22 bp, Artificial Sequence
  chemically synthesized
cttgttctttttattgagtttt

SEQ ID NO: 1381246 - DNA, 22 bp, Artificial Sequence
  chemically synthesized
aaagataaaactcaataaaaag

SEQ ID NO: 1381247 - DNA, 22 bp, Artificial Sequence
  chemically synthesized
taactacttgttctttttattg

SEQ ID NO: 1381248 - DNA, 22 bp, Artificial Sequence
  chemically synthesized
ataactacttgttctttttatt

SEQ ID NO: 1381249 - DNA, 22 bp, Artificial Sequence
  chemically synthesized
tataactacttgttctttttat

SEQ ID NO: 1381250 - DNA, 22 bp, Artificial Sequence
  chemically synthesized
ttttataactacttgttctttt

SEQ ID NO: 1381251 - DNA, 22 bp, Artificial Sequence
  chemically synthesized
gttttataactacttgttcttt

SEQ ID NO: 1381252 - DNA, 22 bp, Artificial Sequence
  chemically synthesized
tgttttataactacttgttctt

SEQ ID NO: 1381253 - DNA, 22 bp, Artificial Sequence
  chemically synthesized
ttgttttataactacttgttct

SEQ ID NO: 1381254 - DNA, 22 bp, Artificial Sequence
  chemically synthesized
aataaaaagaacaagtagttat

SEQ ID NO: 1381255 - DNA, 22 bp, Artificial Sequence
  chemically synthesized
catgcttttgttttataactac

SEQ ID NO: 1381256 - DNA, 22 bp, Artificial Sequence
  chemically synthesized
tacatgcttttgttttataact

SEQ ID NO: 1381257 - DNA, 22 bp, Artificial Sequence
  chemically synthesized
ctacatgcttttgttttataac

SEQ ID NO: 1381258 - DNA, 22 bp, Artificial Sequence
  chemically synthesized
atttctacatgcttttgtttta

SEQ ID NO: 1381259 - DNA, 22 bp, Artificial Sequence
  chemically synthesized
aatttctacatgcttttgtttt

SEQ ID NO: 1381260 - DNA, 22 bp, Artificial Sequence
  chemically synthesized
taatttctacatgcttttgttt

SEQ ID NO: 1381261 - DNA, 22 bp, Artificial Sequence
  chemically synthesized
ttttaatttctacatgcttttg

SEQ ID NO: 1381262 - DNA, 22 bp, Artificial Sequence
  chemically synthesized
taaaacaaaagcatgtagaaat

SEQ ID NO: 1381263 - DNA, 22 bp, Artificial Sequence
  chemically synthesized
aatatgaaattattttaatttc

SEQ ID NO: 1381264 - DNA, 22 bp, Artificial Sequence
  chemically synthesized
tcaatatgaaattattttaatt

SEQ ID NO: 1381265 - DNA, 22 bp, Artificial Sequence
  chemically synthesized
ctcaatatgaaattattttaat

SEQ ID NO: 1381266 - DNA, 22 bp, Artificial Sequence
  chemically synthesized
ttctcaatatgaaattatttta

SEQ ID NO: 1381267 - DNA, 22 bp, Artificial Sequence
  chemically synthesized
cttctcaatatgaaattatttt

SEQ ID NO: 1381268 - DNA, 22 bp, Artificial Sequence
  chemically synthesized
tcttctcaatatgaaattattt

SEQ ID NO: 1381269 - DNA, 22 bp, Artificial Sequence
  chemically synthesized
ttcttctcaatatgaaattatt

SEQ ID NO: 1381270 - DNA, 22 bp, Artificial Sequence
  chemically synthesized
tttcttctcaatatgaaattat

SEQ ID NO: 1381271 - DNA, 22 bp, Artificial Sequence
  chemically synthesized
ttttcttctcaatatgaaatta

SEQ ID NO: 1381272 - DNA, 22 bp, Artificial Sequence
  chemically synthesized
tagcttttttcttctcaatatg

SEQ ID NO: 1381273 - DNA, 22 bp, Artificial Sequence
  chemically synthesized
atagcttttttcttctcaatat

SEQ ID NO: 1381274 - DNA, 22 bp, Artificial Sequence
  chemically synthesized
aaataatttcatattgagaaga

SEQ ID NO: 1381275 - DNA, 22 bp, Artificial Sequence
  chemically synthesized
caacatttatagcttttttctt

SEQ ID NO: 1381276 - DNA, 22 bp, Artificial Sequence
  chemically synthesized
ccaacatttatagcttttttct

SEQ ID NO: 1381277 - DNA, 22 bp, Artificial Sequence
  chemically synthesized
catattgagaagaaaaaagcta

SEQ ID NO: 1381278 - DNA, 22 bp, Artificial Sequence
  chemically synthesized
atattgagaagaaaaaagctat

SEQ ID NO: 1381279 - DNA, 22 bp, Artificial Sequence
  chemically synthesized
atttccaacatttatagctttt

SEQ ID NO: 1381280 - DNA, 22 bp, Artificial Sequence
  chemically synthesized
catttccaacatttatagcttt

SEQ ID NO: 1381281 - DNA, 22 bp, Artificial Sequence
  chemically synthesized
tcatttccaacatttatagctt

SEQ ID NO: 1381282 - DNA, 22 bp, Artificial Sequence
  chemically synthesized
ttcatttccaacatttatagct

SEQ ID NO: 1381283 - DNA, 22 bp, Artificial Sequence
  chemically synthesized
agaagaaaaaagctataaatgt

SEQ ID NO: 1381284 - DNA, 22 bp, Artificial Sequence
  chemically synthesized
catttttcatttccaacattta

SEQ ID NO: 1381285 - DNA, 22 bp, Artificial Sequence
  chemically synthesized
ctacatttttcatttccaacat

SEQ ID NO: 1381286 - DNA, 22 bp, Artificial Sequence
  chemically synthesized
actacatttttcatttccaaca

SEQ ID NO: 1381287 - DNA, 22 bp, Artificial Sequence
  chemically synthesized
atttactacatttttcatttcc

SEQ ID NO: 1381288 - DNA, 22 bp, Artificial Sequence
  chemically synthesized
taaatgttggaaatgaaaaatg

SEQ ID NO: 1381289 - DNA, 22 bp, Artificial Sequence
  chemically synthesized
attcatttactacatttttcat

SEQ ID NO: 1381290 - DNA, 22 bp, Artificial Sequence
  chemically synthesized
aaattgattcatttactacatt

SEQ ID NO: 1381291 - DNA, 22 bp, Artificial Sequence
  chemically synthesized
aaaattgattcatttactacat

SEQ ID NO: 1381292 - DNA, 22 bp, Artificial Sequence
  chemically synthesized
taaaattgattcatttactaca

SEQ ID NO: 1381293 - DNA, 22 bp, Artificial Sequence
  chemically synthesized
gaaatgaaaaatgtagtaaatg

SEQ ID NO: 1381294 - DNA, 22 bp, Artificial Sequence
  chemically synthesized
tttaaaattgattcatttacta

SEQ ID NO: 1381295 - DNA, 22 bp, Artificial Sequence
  chemically synthesized
ctttaaaattgattcatttact

SEQ ID NO: 1381296 - DNA, 22 bp, Artificial Sequence
  chemically synthesized
tttctttaaaattgattcattt

SEQ ID NO: 1381297 - DNA, 22 bp, Artificial Sequence
  chemically synthesized
atttctttaaaattgattcatt

SEQ ID NO: 1381298 - DNA, 22 bp, Artificial Sequence
  chemically synthesized
tttatttctttaaaattgattc

SEQ ID NO: 1381299 - DNA, 22 bp, Artificial Sequence
  chemically synthesized
agctgtttatttctttaaaatt

SEQ ID NO: 1381300 - DNA, 22 bp, Artificial Sequence
  chemically synthesized
aagctgtttatttctttaaaat

SEQ ID NO: 1381301 - DNA, 22 bp, Artificial Sequence
  chemically synthesized
aatccagatacttaagctgttt

SEQ ID NO: 1381302 - DNA, 22 bp, Artificial Sequence
  chemically synthesized
taaagaaataaacagcttaagt

SEQ ID NO: 1381303 - DNA, 22 bp, Artificial Sequence
  chemically synthesized
ttcaatccagatacttaagctg

SEQ ID NO: 1381304 - DNA, 22 bp, Artificial Sequence
  chemically synthesized
aaagaaataaacagcttaagta

SEQ ID NO: 1381305 - DNA, 22 bp, Artificial Sequence
  chemically synthesized
gttcaatccagatacttaagct

SEQ ID NO: 1381306 - DNA, 22 bp, Artificial Sequence
  chemically synthesized
aagaaataaacagcttaagtat

SEQ ID NO: 1381307 - DNA, 22 bp, Artificial Sequence
  chemically synthesized
ttgttcaatccagatacttaag

SEQ ID NO: 1381308 - DNA, 22 bp, Artificial Sequence
  chemically synthesized
cttgttcaatccagatacttaa

SEQ ID NO: 1381309 - DNA, 22 bp, Artificial Sequence
  chemically synthesized
tcttcttgttcaatccagatac

SEQ ID NO: 1381310 - DNA, 22 bp, Artificial Sequence
  chemically synthesized
atcttcttgttcaatccagata

SEQ ID NO: 1381311 - DNA, 22 bp, Artificial Sequence
  chemically synthesized
tatcttcttgttcaatccagat

SEQ ID NO: 1381312 - DNA, 22 bp, Artificial Sequence
  chemically synthesized
attttatcttcttgttcaatcc

SEQ ID NO: 1381313 - DNA, 22 bp, Artificial Sequence
  chemically synthesized
aagtatctggattgaacaagaa

SEQ ID NO: 1381314 - DNA, 22 bp, Artificial Sequence
  chemically synthesized
actaattttatcttcttgttca

SEQ ID NO: 1381315 - DNA, 22 bp, Artificial Sequence
  chemically synthesized
agtatctggattgaacaagaag

SEQ ID NO: 1381316 - DNA, 22 bp, Artificial Sequence
  chemically synthesized
attcactaattttatcttcttg

SEQ ID NO: 1381317 - DNA, 22 bp, Artificial Sequence
  chemically synthesized
taattcactaattttatcttct

SEQ ID NO: 1381318 - DNA, 22 bp, Artificial Sequence
  chemically synthesized
ctaattcactaattttatcttc

SEQ ID NO: 1381319 - DNA, 22 bp, Artificial Sequence
  chemically synthesized
gattgaacaagaagataaaatt

SEQ ID NO: 1381320 - DNA, 22 bp, Artificial Sequence
  chemically synthesized
aacaagaagataaaattagtga

SEQ ID NO: 1381321 - DNA, 22 bp, Artificial Sequence
  chemically synthesized
gtatcttctaattcactaattt

SEQ ID NO: 1381322 - DNA, 22 bp, Artificial Sequence
  chemically synthesized
attagtatcttctaattcacta

SEQ ID NO: 1381323 - DNA, 22 bp, Artificial Sequence
  chemically synthesized
cattagtatcttctaattcact

SEQ ID NO: 1381324 - DNA, 22 bp, Artificial Sequence
  chemically synthesized
ttcattagtatcttctaattca

SEQ ID NO: 1381325 - DNA, 22 bp, Artificial Sequence
  chemically synthesized
gatgaattcttcattagtatct

SEQ ID NO: 1381326 - DNA, 22 bp, Artificial Sequence
  chemically synthesized
gtgaattagaagatactaatga

SEQ ID NO: 1381327 - DNA, 22 bp, Artificial Sequence
  chemically synthesized
tggatgaattcttcattagtat

SEQ ID NO: 1381328 - DNA, 22 bp, Artificial Sequence
  chemically synthesized
cgttctggatgaattcttcatt

SEQ ID NO: 1381329 - DNA, 22 bp, Artificial Sequence
  chemically synthesized
gaagatactaatgaagaattca

SEQ ID NO: 1381330 - DNA, 22 bp, Artificial Sequence
  chemically synthesized
tgttacgttctggatgaattct

SEQ ID NO: 1381331 - DNA, 22 bp, Artificial Sequence
  chemically synthesized
cctgtgttacgttctggatgaa

SEQ ID NO: 1381332 - DNA, 22 bp, Artificial Sequence
  chemically synthesized
atgaagaattcatccagaacgt

SEQ ID NO: 1381333 - DNA, 22 bp, Artificial Sequence
  chemically synthesized
cctccctgtgttacgttctgga

SEQ ID NO: 1381334 - DNA, 22 bp, Artificial Sequence
  chemically synthesized
gcctccctgtgttacgttctgg

SEQ ID NO: 1381335 - DNA, 22 bp, Artificial Sequence
  chemically synthesized
cttgcctccctgtgttacgttc

SEQ ID NO: 1381336 - DNA, 22 bp, Artificial Sequence
  chemically synthesized
acttgcctccctgtgttacgtt

SEQ ID NO: 1381337 - DNA, 22 bp, Artificial Sequence
  chemically synthesized
atccagaacgtaacacagggag

SEQ ID NO: 1381338 - DNA, 22 bp, Artificial Sequence
  chemically synthesized
acatttacttgcctccctgtgt

SEQ ID NO: 1381339 - DNA, 22 bp, Artificial Sequence
  chemically synthesized
aacatttacttgcctccctgtg

SEQ ID NO: 1381340 - DNA, 22 bp, Artificial Sequence
  chemically synthesized
taacatttacttgcctccctgt

SEQ ID NO: 1381341 - DNA, 22 bp, Artificial Sequence
  chemically synthesized
ttaacatttacttgcctccctg

SEQ ID NO: 1381342 - DNA, 22 bp, Artificial Sequence
  chemically synthesized
tttttaacatttacttgcctcc

SEQ ID NO: 1381343 - DNA, 22 bp, Artificial Sequence
  chemically synthesized
atttttaacatttacttgcctc

SEQ ID NO: 1381344 - DNA, 22 bp, Artificial Sequence
  chemically synthesized
tatttttaacatttacttgcct

SEQ ID NO: 1381345 - DNA, 22 bp, Artificial Sequence
  chemically synthesized
gtattttatttttaacatttac

SEQ ID NO: 1381346 - DNA, 22 bp, Artificial Sequence
  chemically synthesized
agtattttatttttaacattta

SEQ ID NO: 1381347 - DNA, 22 bp, Artificial Sequence
  chemically synthesized
tgtccttagtattttattttta

SEQ ID NO: 1381348 - DNA, 22 bp, Artificial Sequence
  chemically synthesized
atgtccttagtattttattttt

SEQ ID NO: 1381349 - DNA, 22 bp, Artificial Sequence
  chemically synthesized
tatgtccttagtattttatttt

SEQ ID NO: 1381350 - DNA, 22 bp, Artificial Sequence
  chemically synthesized
ttatgtccttagtattttattt

SEQ ID NO: 1381351 - DNA, 22 bp, Artificial Sequence
  chemically synthesized
tccatcttttatgtccttagta

SEQ ID NO: 1381352 - DNA, 22 bp, Artificial Sequence
  chemically synthesized
aaaataaaatactaaggacata

SEQ ID NO: 1381353 - DNA, 22 bp, Artificial Sequence
  chemically synthesized
tcgtataatattgtccatcttt

SEQ ID NO: 1381354 - DNA, 22 bp, Artificial Sequence
  chemically synthesized
ttgtcgtataatattgtccatc

SEQ ID NO: 1381355 - DNA, 22 bp, Artificial Sequence
  chemically synthesized
aggacataaaagatggacaata

SEQ ID NO: 1381356 - DNA, 22 bp, Artificial Sequence
  chemically synthesized
attgtcgtataatattgtccat

SEQ ID NO: 1381357 - DNA, 22 bp, Artificial Sequence
  chemically synthesized
ttattgtcgtataatattgtcc

SEQ ID NO: 1381358 - DNA, 22 bp, Artificial Sequence
  chemically synthesized
ggaactcttattgtcgtataat

SEQ ID NO: 1381359 - DNA, 22 bp, Artificial Sequence
  chemically synthesized
aggaactcttattgtcgtataa

SEQ ID NO: 1381360 - DNA, 22 bp, Artificial Sequence
  chemically synthesized
taggaactcttattgtcgtata

SEQ ID NO: 1381361 - DNA, 22 bp, Artificial Sequence
  chemically synthesized
tttaggaactcttattgtcgta

SEQ ID NO: 1381362 - DNA, 22 bp, Artificial Sequence
  chemically synthesized
ctttaggaactcttattgtcgt

SEQ ID NO: 1381363 - DNA, 22 bp, Artificial Sequence
  chemically synthesized
ttctttaggaactcttattgtc

SEQ ID NO: 1381364 - DNA, 22 bp, Artificial Sequence
  chemically synthesized
tcttctttaggaactcttattg

SEQ ID NO: 1381365 - DNA, 22 bp, Artificial Sequence
  chemically synthesized
attctcttctttaggaactctt

SEQ ID NO: 1381366 - DNA, 22 bp, Artificial Sequence
  chemically synthesized
tacgacaataagagttcctaaa

SEQ ID NO: 1381367 - DNA, 22 bp, Artificial Sequence
  chemically synthesized
cattcattctcttctttaggaa

SEQ ID NO: 1381368 - DNA, 22 bp, Artificial Sequence
  chemically synthesized
caattccattcattctcttctt

SEQ ID NO: 1381369 - DNA, 22 bp, Artificial Sequence
  chemically synthesized
tgcaattccattcattctcttc

SEQ ID NO: 1381370 - DNA, 22 bp, Artificial Sequence
  chemically synthesized
tctgcaattccattcattctct

SEQ ID NO: 1381371 - DNA, 22 bp, Artificial Sequence
  chemically synthesized
ctctgcaattccattcattctc

SEQ ID NO: 1381372 - DNA, 22 bp, Artificial Sequence
  chemically synthesized
ctaaagaagagaatgaatggaa

SEQ ID NO: 1381373 - DNA, 22 bp, Artificial Sequence
  chemically synthesized
gcttctctgcaattccattcat

SEQ ID NO: 1381374 - DNA, 22 bp, Artificial Sequence
  chemically synthesized
aagaagagaatgaatggaattg

SEQ ID NO: 1381375 - DNA, 22 bp, Artificial Sequence
  chemically synthesized
aatctggcttctctgcaattcc

SEQ ID NO: 1381376 - DNA, 22 bp, Artificial Sequence
  chemically synthesized
aaatctggcttctctgcaattc

SEQ ID NO: 1381377 - DNA, 22 bp, Artificial Sequence
  chemically synthesized
taaatctggcttctctgcaatt

SEQ ID NO: 1381378 - DNA, 22 bp, Artificial Sequence
  chemically synthesized
tctttaaatctggcttctctgc

SEQ ID NO: 1381379 - DNA, 22 bp, Artificial Sequence
  chemically synthesized
tcagccattatctttaaatctg

SEQ ID NO: 1381380 - DNA, 22 bp, Artificial Sequence
  chemically synthesized
cagagaagccagatttaaagat

SEQ ID NO: 1381381 - DNA, 22 bp, Artificial Sequence
  chemically synthesized
taaaattatcagccattatctt

SEQ ID NO: 1381382 - DNA, 22 bp, Artificial Sequence
  chemically synthesized
tataaaattatcagccattatc

SEQ ID NO: 1381383 - DNA, 22 bp, Artificial Sequence
  chemically synthesized
aaagataatggctgataatttt

SEQ ID NO: 1381384 - DNA, 22 bp, Artificial Sequence
  chemically synthesized
aagataatggctgataatttta

SEQ ID NO: 1381385 - DNA, 22 bp, Artificial Sequence
  chemically synthesized
tcatcagttctataaaattatc

SEQ ID NO: 1381386 - DNA, 22 bp, Artificial Sequence
  chemically synthesized
tctatcatcagttctataaaat

SEQ ID NO: 1381387 - DNA, 22 bp, Artificial Sequence
  chemically synthesized
gtctatcatcagttctataaaa

SEQ ID NO: 1381388 - DNA, 22 bp, Artificial Sequence
  chemically synthesized
tgtctatcatcagttctataaa

SEQ ID NO: 1381389 - DNA, 22 bp, Artificial Sequence
  chemically synthesized
ccctttgtctatcatcagttct

SEQ ID NO: 1381390 - DNA, 22 bp, Artificial Sequence
  chemically synthesized
gccctttgtctatcatcagttc

SEQ ID NO: 1381391 - DNA, 22 bp, Artificial Sequence
  chemically synthesized
ataattttatagaactgatgat

SEQ ID NO: 1381392 - DNA, 22 bp, Artificial Sequence
  chemically synthesized
tatagaactgatgatagacaaa

SEQ ID NO: 1381393 - DNA, 22 bp, Artificial Sequence
  chemically synthesized
atagaactgatgatagacaaag

SEQ ID NO: 1381394 - DNA, 22 bp, Artificial Sequence
  chemically synthesized
tagaactgatgatagacaaagg

SEQ ID NO: 1381395 - DNA, 22 bp, Artificial Sequence
  chemically synthesized
gataaaccttgccctttgtcta

SEQ ID NO: 1381396 - DNA, 22 bp, Artificial Sequence
  chemically synthesized
agataaaccttgccctttgtct

SEQ ID NO: 1381397 - DNA, 22 bp, Artificial Sequence
  chemically synthesized
ttagataaaccttgccctttgt

SEQ ID NO: 1381398 - DNA, 22 bp, Artificial Sequence
  chemically synthesized
cttagataaaccttgccctttg

SEQ ID NO: 1381399 - DNA, 22 bp, Artificial Sequence
  chemically synthesized
tcttagataaaccttgcccttt

SEQ ID NO: 1381400 - DNA, 22 bp, Artificial Sequence
  chemically synthesized
atgatagacaaagggcaaggtt

SEQ ID NO: 1381401 - DNA, 22 bp, Artificial Sequence
  chemically synthesized
aaaactttcttagataaacctt

SEQ ID NO: 1381402 - DNA, 22 bp, Artificial Sequence
  chemically synthesized
caaaactttcttagataaacct

SEQ ID NO: 1381403 - DNA, 22 bp, Artificial Sequence
  chemically synthesized
ttcaaaactttcttagataaac

SEQ ID NO: 1381404 - DNA, 22 bp, Artificial Sequence
  chemically synthesized
cttcaaaactttcttagataaa

SEQ ID NO: 1381405 - DNA, 22 bp, Artificial Sequence
  chemically synthesized
tcttcaaaactttcttagataa

SEQ ID NO: 1381406 - DNA, 22 bp, Artificial Sequence
  chemically synthesized
ttcttcaaaactttcttagata

SEQ ID NO: 1381407 - DNA, 22 bp, Artificial Sequence
  chemically synthesized
tttttcttcaaaactttcttag

SEQ ID NO: 1381408 - DNA, 22 bp, Artificial Sequence
  chemically synthesized
gtttttcttcaaaactttctta

SEQ ID NO: 1381409 - DNA, 22 bp, Artificial Sequence
  chemically synthesized
acttgtttttcttcaaaacttt

SEQ ID NO: 1381410 - DNA, 22 bp, Artificial Sequence
  chemically synthesized
atctaagaaagttttgaagaaa

SEQ ID NO: 1381411 - DNA, 22 bp, Artificial Sequence
  chemically synthesized
tctaagaaagttttgaagaaaa

SEQ ID NO: 1381412 - DNA, 22 bp, Artificial Sequence
  chemically synthesized
agaaagttttgaagaaaaacaa

SEQ ID NO: 1381413 - DNA, 22 bp, Artificial Sequence
  chemically synthesized
tgaagaaaaacaagttagggtg

SEQ ID NO: 1381414 - DNA, 22 bp, Artificial Sequence
  chemically synthesized
gaagaaaaacaagttagggtgt

SEQ ID NO: 1381415 - DNA, 22 bp, Artificial Sequence
  chemically synthesized
aagaaaaacaagttagggtgtc

SEQ ID NO: 1381416 - DNA, 22 bp, Artificial Sequence
  chemically synthesized
acatgtggtagggccagacacc

SEQ ID NO: 1381417 - DNA, 22 bp, Artificial Sequence
  chemically synthesized
gccctgacatgtggtagggcca

SEQ ID NO: 1381418 - DNA, 22 bp, Artificial Sequence
  chemically synthesized
agccctgacatgtggtagggcc

SEQ ID NO: 1381419 - DNA, 22 bp, Artificial Sequence
  chemically synthesized
gggtgtctggccctaccacatg

SEQ ID NO: 1381420 - DNA, 22 bp, Artificial Sequence
  chemically synthesized
tatttagccctgacatgtggta

SEQ ID NO: 1381421 - DNA, 22 bp, Artificial Sequence
  chemically synthesized
atatttagccctgacatgtggt

SEQ ID NO: 1381422 - DNA, 22 bp, Artificial Sequence
  chemically synthesized
gccctaccacatgtcagggcta

SEQ ID NO: 1381423 - DNA, 22 bp, Artificial Sequence
  chemically synthesized
ccatagatttatatttagccct

SEQ ID NO: 1381424 - DNA, 22 bp, Artificial Sequence
  chemically synthesized
ccacatgtcagggctaaatata

SEQ ID NO: 1381425 - DNA, 22 bp, Artificial Sequence
  chemically synthesized
aattaccatagatttatattta

SEQ ID NO: 1381426 - DNA, 22 bp, Artificial Sequence
  chemically synthesized
taatatgtctcaattaccatag

SEQ ID NO: 1381427 - DNA, 22 bp, Artificial Sequence
  chemically synthesized
aatataaatctatggtaattga

SEQ ID NO: 1381428 - DNA, 22 bp, Artificial Sequence
  chemically synthesized
tgccagtactataatatgtctc

SEQ ID NO: 1381429 - DNA, 22 bp, Artificial Sequence
  chemically synthesized
ctgtgccagtactataatatgt

SEQ ID NO: 1381430 - DNA, 22 bp, Artificial Sequence
  chemically synthesized
tggtaattgagacatattatag

SEQ ID NO: 1381431 - DNA, 22 bp, Artificial Sequence
  chemically synthesized
ccaattcctgtgccagtactat

SEQ ID NO: 1381432 - DNA, 22 bp, Artificial Sequence
  chemically synthesized
gccaattcctgtgccagtacta

SEQ ID NO: 1381433 - DNA, 22 bp, Artificial Sequence
  chemically synthesized
agacatattatagtactggcac

SEQ ID NO: 1381434 - DNA, 22 bp, Artificial Sequence
  chemically synthesized
atttgccaattcctgtgccagt

SEQ ID NO: 1381435 - DNA, 22 bp, Artificial Sequence
  chemically synthesized
catttgccaattcctgtgccag

SEQ ID NO: 1381436 - DNA, 22 bp, Artificial Sequence
  chemically synthesized
ttcatttgccaattcctgtgcc

SEQ ID NO: 1381437 - DNA, 22 bp, Artificial Sequence
  chemically synthesized
ttcttcatttgccaattcctgt

SEQ ID NO: 1381438 - DNA, 22 bp, Artificial Sequence
  chemically synthesized
tagtactggcacaggaattggc

SEQ ID NO: 1381439 - DNA, 22 bp, Artificial Sequence
  chemically synthesized
tgttcttcatttgccaattcct

SEQ ID NO: 1381440 - DNA, 22 bp, Artificial Sequence
  chemically synthesized
ttctgttcttcatttgccaatt

SEQ ID NO: 1381441 - DNA, 22 bp, Artificial Sequence
  chemically synthesized
gttctgttcttcatttgccaat

SEQ ID NO: 1381442 - DNA, 22 bp, Artificial Sequence
  chemically synthesized
tgttctgttcttcatttgccaa

SEQ ID NO: 1381443 - DNA, 22 bp, Artificial Sequence
  chemically synthesized
ttgttctgttcttcatttgcca

SEQ ID NO: 1381444 - DNA, 22 bp, Artificial Sequence
  chemically synthesized
tttgttctgttcttcatttgcc

SEQ ID NO: 1381445 - DNA, 22 bp, Artificial Sequence
  chemically synthesized
gcacaggaattggcaaatgaag

SEQ ID NO: 1381446 - DNA, 22 bp, Artificial Sequence
  chemically synthesized
ttttgttctgttcttcatttgc

SEQ ID NO: 1381447 - DNA, 22 bp, Artificial Sequence
  chemically synthesized
tttttgttctgttcttcatttg

SEQ ID NO: 1381448 - DNA, 22 bp, Artificial Sequence
  chemically synthesized
ggcatctttttttgttctgttc

SEQ ID NO: 1381449 - DNA, 22 bp, Artificial Sequence
  chemically synthesized
tgggcatctttttttgttctgt

SEQ ID NO: 1381450 - DNA, 22 bp, Artificial Sequence
  chemically synthesized
gcaaatgaagaacagaacaaaa

SEQ ID NO: 1381451 - DNA, 22 bp, Artificial Sequence
  chemically synthesized
ctgggcatctttttttgttctg

SEQ ID NO: 1381452 - DNA, 22 bp, Artificial Sequence
  chemically synthesized
gtatttctgggcatcttttttt

SEQ ID NO: 1381453 - DNA, 22 bp, Artificial Sequence
  chemically synthesized
gtatgtacattagtatttctgg

SEQ ID NO: 1381454 - DNA, 22 bp, Artificial Sequence
  chemically synthesized
gattagtatgtacattagtatt

SEQ ID NO: 1381455 - DNA, 22 bp, Artificial Sequence
  chemically synthesized
gtatatacatgtacattagatt

SEQ ID NO: 1381456 - DNA, 22 bp, Artificial Sequence
  chemically synthesized
atgtacatactaatctaatgta

SEQ ID NO: 1381457 - DNA, 22 bp, Artificial Sequence
  chemically synthesized
catcgagattagtatatacatg

SEQ ID NO: 1381458 - DNA, 22 bp, Artificial Sequence
  chemically synthesized
gcatcgagattagtatatacat

SEQ ID NO: 1381459 - DNA, 22 bp, Artificial Sequence
  chemically synthesized
atctaatgtacatgtatatact

SEQ ID NO: 1381460 - DNA, 22 bp, Artificial Sequence
  chemically synthesized
tgcatcgagattagtatataca

SEQ ID NO: 1381461 - DNA, 22 bp, Artificial Sequence
  chemically synthesized
ttttgcatcgagattagtatat

SEQ ID NO: 1381462 - DNA, 22 bp, Artificial Sequence
  chemically synthesized
atgtacatgtatatactaatct

SEQ ID NO: 1381463 - DNA, 22 bp, Artificial Sequence
  chemically synthesized
tgttttgcatcgagattagtat

SEQ ID NO: 1381464 - DNA, 22 bp, Artificial Sequence
  chemically synthesized
tagtgtcacctctgttttgcat

SEQ ID NO: 1381465 - DNA, 22 bp, Artificial Sequence
  chemically synthesized
acctgtagtgtcacctctgttt

SEQ ID NO: 1381466 - DNA, 22 bp, Artificial Sequence
  chemically synthesized
atctcgatgcaaaacagaggtg

SEQ ID NO: 1381467 - DNA, 22 bp, Artificial Sequence
  chemically synthesized
ttcacctgtagtgtcacctctg

SEQ ID NO: 1381468 - DNA, 22 bp, Artificial Sequence
  chemically synthesized
tattcacctgtagtgtcacctc

SEQ ID NO: 1381469 - DNA, 22 bp, Artificial Sequence
  chemically synthesized
gatgcaaaacagaggtgacact

SEQ ID NO: 1381470 - DNA, 22 bp, Artificial Sequence
  chemically synthesized
tctattcacctgtagtgtcacc

SEQ ID NO: 1381471 - DNA, 22 bp, Artificial Sequence
  chemically synthesized
ctctattcacctgtagtgtcac

SEQ ID NO: 1381472 - DNA, 22 bp, Artificial Sequence
  chemically synthesized
tctctattcacctgtagtgtca

SEQ ID NO: 1381473 - DNA, 22 bp, Artificial Sequence
  chemically synthesized
ttctctattcacctgtagtgtc

SEQ ID NO: 1381474 - DNA, 22 bp, Artificial Sequence
  chemically synthesized
ccttttctctattcacctgtag

SEQ ID NO: 1381475 - DNA, 22 bp, Artificial Sequence
  chemically synthesized
aatgtctaccttttctctattc

SEQ ID NO: 1381476 - DNA, 22 bp, Artificial Sequence
  chemically synthesized
aaatgtctaccttttctctatt

SEQ ID NO: 1381477 - DNA, 22 bp, Artificial Sequence
  chemically synthesized
tttaaatgtctaccttttctct

SEQ ID NO: 1381478 - DNA, 22 bp, Artificial Sequence
  chemically synthesized
caggtgaatagagaaaaggtag

SEQ ID NO: 1381479 - DNA, 22 bp, Artificial Sequence
  chemically synthesized
ccatcattgtttaaatgtctac

SEQ ID NO: 1381480 - DNA, 22 bp, Artificial Sequence
  chemically synthesized
tcctaccatcattgtttaaatg

SEQ ID NO: 1381481 - DNA, 22 bp, Artificial Sequence
  chemically synthesized
gagtaaataactgtcctaccat

SEQ ID NO: 1381482 - DNA, 22 bp, Artificial Sequence
  chemically synthesized
agagtaaataactgtcctacca

SEQ ID NO: 1381483 - DNA, 22 bp, Artificial Sequence
  chemically synthesized
tagagtaaataactgtcctacc

SEQ ID NO: 1381484 - DNA, 22 bp, Artificial Sequence
  chemically synthesized
aaacaatgatggtaggacagtt

SEQ ID NO: 1381485 - DNA, 22 bp, Artificial Sequence
  chemically synthesized
aacaatgatggtaggacagtta

SEQ ID NO: 1381486 - DNA, 22 bp, Artificial Sequence
  chemically synthesized
ttttagagtaaataactgtcct

SEQ ID NO: 1381487 - DNA, 22 bp, Artificial Sequence
  chemically synthesized
tgaattattttagagtaaataa

SEQ ID NO: 1381488 - DNA, 22 bp, Artificial Sequence
  chemically synthesized
gtgaattattttagagtaaata

SEQ ID NO: 1381489 - DNA, 22 bp, Artificial Sequence
  chemically synthesized
tgtgaattattttagagtaaat

SEQ ID NO: 1381490 - DNA, 22 bp, Artificial Sequence
  chemically synthesized
tttactctaaaataattcacaa

SEQ ID NO: 1381491 - DNA, 22 bp, Artificial Sequence
  chemically synthesized
actctaaaataattcacaaaat

SEQ ID NO: 1381492 - DNA, 22 bp, Artificial Sequence
  chemically synthesized
ctctaaaataattcacaaaatt

SEQ ID NO: 1381493 - DNA, 22 bp, Artificial Sequence
  chemically synthesized
tgaatagtgaataattttgtga

SEQ ID NO: 1381494 - DNA, 22 bp, Artificial Sequence
  chemically synthesized
gtgaatagtgaataattttgtg

SEQ ID NO: 1381495 - DNA, 22 bp, Artificial Sequence
  chemically synthesized
tgtgaatagtgaataattttgt

SEQ ID NO: 1381496 - DNA, 22 bp, Artificial Sequence
  chemically synthesized
taaaataattcacaaaattatt

SEQ ID NO: 1381497 - DNA, 22 bp, Artificial Sequence
  chemically synthesized
ttgtgaatagtgaataattttg

SEQ ID NO: 1381498 - DNA, 22 bp, Artificial Sequence
  chemically synthesized
tttgtgaatagtgaataatttt

SEQ ID NO: 1381499 - DNA, 22 bp, Artificial Sequence
  chemically synthesized
aaataattcacaaaattattca

SEQ ID NO: 1381500 - DNA, 22 bp, Artificial Sequence
  chemically synthesized
ttttgtgaatagtgaataattt

SEQ ID NO: 1381501 - DNA, 22 bp, Artificial Sequence
  chemically synthesized
ggggtttttttgtgaatagtga

SEQ ID NO: 1381502 - DNA, 22 bp, Artificial Sequence
  chemically synthesized
aggggtttttttgtgaatagtg

SEQ ID NO: 1381503 - DNA, 22 bp, Artificial Sequence
  chemically synthesized
acaaaattattcactattcaca

SEQ ID NO: 1381504 - DNA, 22 bp, Artificial Sequence
  chemically synthesized
taggggtttttttgtgaatagt

SEQ ID NO: 1381505 - DNA, 22 bp, Artificial Sequence
  chemically synthesized
ttaggggtttttttgtgaatag

SEQ ID NO: 1381506 - DNA, 22 bp, Artificial Sequence
  chemically synthesized
ttcactattcacaaaaaaaccc

SEQ ID NO: 1381507 - DNA, 22 bp, Artificial Sequence
  chemically synthesized
gaaataatttttaggggttttt

SEQ ID NO: 1381508 - DNA, 22 bp, Artificial Sequence
  chemically synthesized
actattcacaaaaaaaccccta

SEQ ID NO: 1381509 - DNA, 22 bp, Artificial Sequence
  chemically synthesized
ggaaataatttttaggggtttt

SEQ ID NO: 1381510 - DNA, 22 bp, Artificial Sequence
  chemically synthesized
ttcacaaaaaaacccctaaaaa

SEQ ID NO: 1381511 - DNA, 22 bp, Artificial Sequence
  chemically synthesized
acaaaaaaacccctaaaaatta

SEQ ID NO: 1381512 - DNA, 22 bp, Artificial Sequence
  chemically synthesized
aataaacttggaaataattttt

SEQ ID NO: 1381513 - DNA, 22 bp, Artificial Sequence
  chemically synthesized
taaataaacttggaaataattt

SEQ ID NO: 1381514 - DNA, 22 bp, Artificial Sequence
  chemically synthesized
atcggtctctaaataaacttgg

SEQ ID NO: 1381515 - DNA, 22 bp, Artificial Sequence
  chemically synthesized
aaaattatttccaagtttattt

SEQ ID NO: 1381516 - DNA, 22 bp, Artificial Sequence
  chemically synthesized
actcatcggtctctaaataaac

SEQ ID NO: 1381517 - DNA, 22 bp, Artificial Sequence
  chemically synthesized
cactcatcggtctctaaataaa

SEQ ID NO: 1381518 - DNA, 22 bp, Artificial Sequence
  chemically synthesized
tcactcatcggtctctaaataa

SEQ ID NO: 1381519 - DNA, 22 bp, Artificial Sequence
  chemically synthesized
tttccaagtttatttagagacc

SEQ ID NO: 1381520 - DNA, 22 bp, Artificial Sequence
  chemically synthesized
cctttcactcatcggtctctaa

SEQ ID NO: 1381521 - DNA, 22 bp, Artificial Sequence
  chemically synthesized
ccctttcactcatcggtctcta

SEQ ID NO: 1381522 - DNA, 22 bp, Artificial Sequence
  chemically synthesized
ccaagtttatttagagaccgat

SEQ ID NO: 1381523 - DNA, 22 bp, Artificial Sequence
  chemically synthesized
tccctttcactcatcggtctct

SEQ ID NO: 1381524 - DNA, 22 bp, Artificial Sequence
  chemically synthesized
caagtttatttagagaccgatg

SEQ ID NO: 1381525 - DNA, 22 bp, Artificial Sequence
  chemically synthesized
ttccctttcactcatcggtctc

SEQ ID NO: 1381526 - DNA, 22 bp, Artificial Sequence
  chemically synthesized
cagtttttccctttcactcatc

SEQ ID NO: 1381527 - DNA, 22 bp, Artificial Sequence
  chemically synthesized
atttagagaccgatgagtgaaa

SEQ ID NO: 1381528 - DNA, 22 bp, Artificial Sequence
  chemically synthesized
tttagagaccgatgagtgaaag

SEQ ID NO: 1381529 - DNA, 22 bp, Artificial Sequence
  chemically synthesized
agagaccgatgagtgaaaggga

SEQ ID NO: 1381530 - DNA, 22 bp, Artificial Sequence
  chemically synthesized
gagaccgatgagtgaaagggaa

SEQ ID NO: 1381531 - DNA, 22 bp, Artificial Sequence
  chemically synthesized
ggtattacagtttttccctttc

SEQ ID NO: 1381532 - DNA, 22 bp, Artificial Sequence
  chemically synthesized
aggtattacagtttttcccttt

SEQ ID NO: 1381533 - DNA, 22 bp, Artificial Sequence
  chemically synthesized
taggtattacagtttttccctt

SEQ ID NO: 1381534 - DNA, 22 bp, Artificial Sequence
  chemically synthesized
tttaggtattacagtttttccc

SEQ ID NO: 1381535 - DNA, 22 bp, Artificial Sequence
  chemically synthesized
atgtaattctttaggtattaca

SEQ ID NO: 1381536 - DNA, 22 bp, Artificial Sequence
  chemically synthesized
catgtaattctttaggtattac

SEQ ID NO: 1381537 - DNA, 22 bp, Artificial Sequence
  chemically synthesized
tcatgtaattctttaggtatta

SEQ ID NO: 1381538 - DNA, 22 bp, Artificial Sequence
  chemically synthesized
ttttcatgtaattctttaggta

SEQ ID NO: 1381539 - DNA, 22 bp, Artificial Sequence
  chemically synthesized
attttcatgtaattctttaggt

SEQ ID NO: 1381540 - DNA, 22 bp, Artificial Sequence
  chemically synthesized
ttattttcatgtaattctttag

SEQ ID NO: 1381541 - DNA, 22 bp, Artificial Sequence
  chemically synthesized
cttattttcatgtaattcttta

SEQ ID NO: 1381542 - DNA, 22 bp, Artificial Sequence
  chemically synthesized
tttcttattttcatgtaattct

SEQ ID NO: 1381543 - DNA, 22 bp, Artificial Sequence
  chemically synthesized
taatacctaaagaattacatga

SEQ ID NO: 1381544 - DNA, 22 bp, Artificial Sequence
  chemically synthesized
gtctatttcttattttcatgta

SEQ ID NO: 1381545 - DNA, 22 bp, Artificial Sequence
  chemically synthesized
ggtctatttcttattttcatgt

SEQ ID NO: 1381546 - DNA, 22 bp, Artificial Sequence
  chemically synthesized
tggtctatttcttattttcatg

SEQ ID NO: 1381547 - DNA, 22 bp, Artificial Sequence
  chemically synthesized
ttggtctatttcttattttcat

SEQ ID NO: 1381548 - DNA, 22 bp, Artificial Sequence
  chemically synthesized
aagaattacatgaaaataagaa

SEQ ID NO: 1381549 - DNA, 22 bp, Artificial Sequence
  chemically synthesized
acttttggtctatttcttattt

SEQ ID NO: 1381550 - DNA, 22 bp, Artificial Sequence
  chemically synthesized
aattgacttttggtctatttct

SEQ ID NO: 1381551 - DNA, 22 bp, Artificial Sequence
  chemically synthesized
caattgacttttggtctatttc

SEQ ID NO: 1381552 - DNA, 22 bp, Artificial Sequence
  chemically synthesized
catgaaaataagaaatagacca

SEQ ID NO: 1381553 - DNA, 22 bp, Artificial Sequence
  chemically synthesized
tcaattgacttttggtctattt

SEQ ID NO: 1381554 - DNA, 22 bp, Artificial Sequence
  chemically synthesized
ttcaattgacttttggtctatt

SEQ ID NO: 1381555 - DNA, 22 bp, Artificial Sequence
  chemically synthesized
ccaatttttcaattgacttttg

SEQ ID NO: 1381556 - DNA, 22 bp, Artificial Sequence
  chemically synthesized
gccaatttttcaattgactttt

SEQ ID NO: 1381557 - DNA, 22 bp, Artificial Sequence
  chemically synthesized
tgccaatttttcaattgacttt

SEQ ID NO: 1381558 - DNA, 22 bp, Artificial Sequence
  chemically synthesized
atgtcctttgccaatttttcaa

SEQ ID NO: 1381559 - DNA, 22 bp, Artificial Sequence
  chemically synthesized
ttcatgtcctttgccaattttt

SEQ ID NO: 1381560 - DNA, 22 bp, Artificial Sequence
  chemically synthesized
aatcatctgttcatgtcctttg

SEQ ID NO: 1381561 - DNA, 22 bp, Artificial Sequence
  chemically synthesized
tgaatcatctgttcatgtcctt

SEQ ID NO: 1381562 - DNA, 22 bp, Artificial Sequence
  chemically synthesized
aaaaattggcaaaggacatgaa

SEQ ID NO: 1381563 - DNA, 22 bp, Artificial Sequence
  chemically synthesized
ctctgaatcatctgttcatgtc

SEQ ID NO: 1381564 - DNA, 22 bp, Artificial Sequence
  chemically synthesized
ctgctctgaatcatctgttcat

SEQ ID NO: 1381565 - DNA, 22 bp, Artificial Sequence
  chemically synthesized
cctgctctgaatcatctgttca

SEQ ID NO: 1381566 - DNA, 22 bp, Artificial Sequence
  chemically synthesized
gcaaaggacatgaacagatgat

SEQ ID NO: 1381567 - DNA, 22 bp, Artificial Sequence
  chemically synthesized
tttcctgctctgaatcatctgt

SEQ ID NO: 1381568 - DNA, 22 bp, Artificial Sequence
  chemically synthesized
ttatttcctgctctgaatcatc

SEQ ID NO: 1381569 - DNA, 22 bp, Artificial Sequence
  chemically synthesized
attatttcctgctctgaatcat

SEQ ID NO: 1381570 - DNA, 22 bp, Artificial Sequence
  chemically synthesized
tattatttcctgctctgaatca

SEQ ID NO: 1381571 - DNA, 22 bp, Artificial Sequence
  chemically synthesized
accctttattatttcctgctct

SEQ ID NO: 1381572 - DNA, 22 bp, Artificial Sequence
  chemically synthesized
attgaccctttattatttcctg

SEQ ID NO: 1381573 - DNA, 22 bp, Artificial Sequence
  chemically synthesized
tattcattgaccctttattatt

SEQ ID NO: 1381574 - DNA, 22 bp, Artificial Sequence
  chemically synthesized
atattcattgaccctttattat

SEQ ID NO: 1381575 - DNA, 22 bp, Artificial Sequence
  chemically synthesized
tatattcattgaccctttatta

SEQ ID NO: 1381576 - DNA, 22 bp, Artificial Sequence
  chemically synthesized
agagcaggaaataataaagggt

SEQ ID NO: 1381577 - DNA, 22 bp, Artificial Sequence
  chemically synthesized
ttatattcattgaccctttatt

SEQ ID NO: 1381578 - DNA, 22 bp, Artificial Sequence
  chemically synthesized
atcaatgtatcttttatattca

SEQ ID NO: 1381579 - DNA, 22 bp, Artificial Sequence
  chemically synthesized
gatcaatgtatcttttatattc

SEQ ID NO: 1381580 - DNA, 22 bp, Artificial Sequence
  chemically synthesized
tgatcaatgtatcttttatatt

SEQ ID NO: 1381581 - DNA, 22 bp, Artificial Sequence
  chemically synthesized
ttgatcaatgtatcttttatat

SEQ ID NO: 1381582 - DNA, 22 bp, Artificial Sequence
  chemically synthesized
tttgatcaatgtatcttttata

SEQ ID NO: 1381583 - DNA, 22 bp, Artificial Sequence
  chemically synthesized
ttttttgatcaatgtatctttt

SEQ ID NO: 1381584 - DNA, 22 bp, Artificial Sequence
  chemically synthesized
gttttttgatcaatgtatcttt

SEQ ID NO: 1381585 - DNA, 22 bp, Artificial Sequence
  chemically synthesized
atttgttttttgatcaatgtat

SEQ ID NO: 1381586 - DNA, 22 bp, Artificial Sequence
  chemically synthesized
tatctcatttgttttttgatca

SEQ ID NO: 1381587 - DNA, 22 bp, Artificial Sequence
  chemically synthesized
atcaaaaaacaaatgagatata

SEQ ID NO: 1381588 - DNA, 22 bp, Artificial Sequence
  chemically synthesized
atgagtatgaaattatatctca

SEQ ID NO: 1381589 - DNA, 22 bp, Artificial Sequence
  chemically synthesized
gatgagtatgaaattatatctc

SEQ ID NO: 1381590 - DNA, 22 bp, Artificial Sequence
  chemically synthesized
tcaatttgatgagtatgaaatt

SEQ ID NO: 1381591 - DNA, 22 bp, Artificial Sequence
  chemically synthesized
atcaatttgatgagtatgaaat

SEQ ID NO: 1381592 - DNA, 22 bp, Artificial Sequence
  chemically synthesized
tatcaatttgatgagtatgaaa

SEQ ID NO: 1381593 - DNA, 22 bp, Artificial Sequence
  chemically synthesized
ttatcaatttgatgagtatgaa

SEQ ID NO: 1381594 - DNA, 22 bp, Artificial Sequence
  chemically synthesized
taatttttatcaatttgatgag

SEQ ID NO: 1381595 - DNA, 22 bp, Artificial Sequence
  chemically synthesized
ataatttttatcaatttgatga

SEQ ID NO: 1381596 - DNA, 22 bp, Artificial Sequence
  chemically synthesized
tataatttttatcaatttgatg

SEQ ID NO: 1381597 - DNA, 22 bp, Artificial Sequence
  chemically synthesized
catactcatcaaattgataaaa

SEQ ID NO: 1381598 - DNA, 22 bp, Artificial Sequence
  chemically synthesized
acactttataatttttatcaat

SEQ ID NO: 1381599 - DNA, 22 bp, Artificial Sequence
  chemically synthesized
atactcatcaaattgataaaaa

SEQ ID NO: 1381600 - DNA, 22 bp, Artificial Sequence
  chemically synthesized
atcaaattgataaaaattataa

SEQ ID NO: 1381601 - DNA, 22 bp, Artificial Sequence
  chemically synthesized
gatattgacactttataatttt

SEQ ID NO: 1381602 - DNA, 22 bp, Artificial Sequence
  chemically synthesized
tcaactagatattgacacttta

SEQ ID NO: 1381603 - DNA, 22 bp, Artificial Sequence
  chemically synthesized
atcaactagatattgacacttt

SEQ ID NO: 1381604 - DNA, 22 bp, Artificial Sequence
  chemically synthesized
ataaaaattataaagtgtcaat

SEQ ID NO: 1381605 - DNA, 22 bp, Artificial Sequence
  chemically synthesized
ttatcaactagatattgacact

SEQ ID NO: 1381606 - DNA, 22 bp, Artificial Sequence
  chemically synthesized
aaattcttatcaactagatatt

SEQ ID NO: 1381607 - DNA, 22 bp, Artificial Sequence
  chemically synthesized
caaattcttatcaactagatat

SEQ ID NO: 1381608 - DNA, 22 bp, Artificial Sequence
  chemically synthesized
tcaaattcttatcaactagata

SEQ ID NO: 1381609 - DNA, 22 bp, Artificial Sequence
  chemically synthesized
taaagtgtcaatatctagttga

SEQ ID NO: 1381610 - DNA, 22 bp, Artificial Sequence
  chemically synthesized
ttcaaattcttatcaactagat

SEQ ID NO: 1381611 - DNA, 22 bp, Artificial Sequence
  chemically synthesized
gttgataagaatttgaaaaatg

SEQ ID NO: 1381612 - DNA, 22 bp, Artificial Sequence
  chemically synthesized
ataagaatttgaaaaatggggg

SEQ ID NO: 1381613 - DNA, 22 bp, Artificial Sequence
  chemically synthesized
caacagtagtgtatgcatcccc

SEQ ID NO: 1381614 - DNA, 22 bp, Artificial Sequence
  chemically synthesized
gaaaaatgggggatgcatacac

SEQ ID NO: 1381615 - DNA, 22 bp, Artificial Sequence
  chemically synthesized
aaaaatgggggatgcatacact

SEQ ID NO: 1381616 - DNA, 22 bp, Artificial Sequence
  chemically synthesized
tgcctccaacagtagtgtatgc

SEQ ID NO: 1381617 - DNA, 22 bp, Artificial Sequence
  chemically synthesized
atgcctccaacagtagtgtatg

SEQ ID NO: 1381618 - DNA, 22 bp, Artificial Sequence
  chemically synthesized
gaatggtggtaccaatttatgc

SEQ ID NO: 1381619 - DNA, 22 bp, Artificial Sequence
  chemically synthesized
agaatggtggtaccaatttatg

SEQ ID NO: 1381620 - DNA, 22 bp, Artificial Sequence
  chemically synthesized
tagaatggtggtaccaatttat

SEQ ID NO: 1381621 - DNA, 22 bp, Artificial Sequence
  chemically synthesized
ctgttggaggcataaattggta

SEQ ID NO: 1381622 - DNA, 22 bp, Artificial Sequence
  chemically synthesized
ttggaggcataaattggtacca

SEQ ID NO: 1381623 - DNA, 22 bp, Artificial Sequence
  chemically synthesized
attttagaatggtggtaccaat

SEQ ID NO: 1381624 - DNA, 22 bp, Artificial Sequence
  chemically synthesized
gattttagaatggtggtaccaa

SEQ ID NO: 1381625 - DNA, 22 bp, Artificial Sequence
  chemically synthesized
gaggcataaattggtaccacca

SEQ ID NO: 1381626 - DNA, 22 bp, Artificial Sequence
  chemically synthesized
ccgtacttgattttagaatggt

SEQ ID NO: 1381627 - DNA, 22 bp, Artificial Sequence
  chemically synthesized
gccgtacttgattttagaatgg

SEQ ID NO: 1381628 - DNA, 22 bp, Artificial Sequence
  chemically synthesized
tgccgtacttgattttagaatg

SEQ ID NO: 1381629 - DNA, 22 bp, Artificial Sequence
  chemically synthesized
gtaccaccattctaaaatcaag

SEQ ID NO: 1381630 - DNA, 22 bp, Artificial Sequence
  chemically synthesized
atataacattttgccgtacttg

SEQ ID NO: 1381631 - DNA, 22 bp, Artificial Sequence
  chemically synthesized
taaaatcaagtacggcaaaatg

SEQ ID NO: 1381632 - DNA, 22 bp, Artificial Sequence
  chemically synthesized
aaatcaagtacggcaaaatgtt

SEQ ID NO: 1381633 - DNA, 22 bp, Artificial Sequence
  chemically synthesized
aaaataatattaatataacatt

SEQ ID NO: 1381634 - DNA, 22 bp, Artificial Sequence
  chemically synthesized
gaggatgactaaaaataatatt

SEQ ID NO: 1381635 - DNA, 22 bp, Artificial Sequence
  chemically synthesized
tattaatattatttttagtcat

SEQ ID NO: 1381636 - DNA, 22 bp, Artificial Sequence
  chemically synthesized
atattatttttagtcatcctcc

SEQ ID NO: 1381637 - DNA, 22 bp, Artificial Sequence
  chemically synthesized
tttttagtcatcctccagttgt

SEQ ID NO: 1381638 - DNA, 22 bp, Artificial Sequence
  chemically synthesized
tgaaatatgtcaaacaactgga

SEQ ID NO: 1381639 - DNA, 22 bp, Artificial Sequence
  chemically synthesized
ttagtcatcctccagttgtttg

SEQ ID NO: 1381640 - DNA, 22 bp, Artificial Sequence
  chemically synthesized
tagtcatcctccagttgtttga

SEQ ID NO: 1381641 - DNA, 22 bp, Artificial Sequence
  chemically synthesized
ttatgaaatatgtcaaacaact

SEQ ID NO: 1381642 - DNA, 22 bp, Artificial Sequence
  chemically synthesized
agtcatcctccagttgtttgac

SEQ ID NO: 1381643 - DNA, 22 bp, Artificial Sequence
  chemically synthesized
gtcatcctccagttgtttgaca

SEQ ID NO: 1381644 - DNA, 22 bp, Artificial Sequence
  chemically synthesized
ttattatgaaatatgtcaaaca

SEQ ID NO: 1381645 - DNA, 22 bp, Artificial Sequence
  chemically synthesized
attattatgaaatatgtcaaac

SEQ ID NO: 1381646 - DNA, 22 bp, Artificial Sequence
  chemically synthesized
tattattatgaaatatgtcaaa

SEQ ID NO: 1381647 - DNA, 22 bp, Artificial Sequence
  chemically synthesized
cagttgtttgacatatttcata

SEQ ID NO: 1381648 - DNA, 22 bp, Artificial Sequence
  chemically synthesized
tttgacatatttcataataata

SEQ ID NO: 1381649 - DNA, 22 bp, Artificial Sequence
  chemically synthesized
gacatatttcataataataaaa

SEQ ID NO: 1381650 - DNA, 22 bp, Artificial Sequence
  chemically synthesized
acatatttcataataataaaat

SEQ ID NO: 1381651 - DNA, 22 bp, Artificial Sequence
  chemically synthesized
atacatgtatatattttattat

SEQ ID NO: 1381652 - DNA, 22 bp, Artificial Sequence
  chemically synthesized
gatacatgtatatattttatta

SEQ ID NO: 1381653 - DNA, 22 bp, Artificial Sequence
  chemically synthesized
tgatacatgtatatattttatt

SEQ ID NO: 1381654 - DNA, 22 bp, Artificial Sequence
  chemically synthesized
ttttgatacatgtatatatttt

SEQ ID NO: 1381655 - DNA, 22 bp, Artificial Sequence
  chemically synthesized
cataataataaaatatatacat

SEQ ID NO: 1381656 - DNA, 22 bp, Artificial Sequence
  chemically synthesized
ataataataaaatatatacatg

SEQ ID NO: 1381657 - DNA, 22 bp, Artificial Sequence
  chemically synthesized
agctattttgatacatgtatat

SEQ ID NO: 1381658 - DNA, 22 bp, Artificial Sequence
  chemically synthesized
aattgagctattttgatacatg

SEQ ID NO: 1381659 - DNA, 22 bp, Artificial Sequence
  chemically synthesized
aaattgagctattttgatacat

SEQ ID NO: 1381660 - DNA, 22 bp, Artificial Sequence
  chemically synthesized
atttaaattgagctattttgat

SEQ ID NO: 1381661 - DNA, 22 bp, Artificial Sequence
  chemically synthesized
taatttaaattgagctattttg

SEQ ID NO: 1381662 - DNA, 22 bp, Artificial Sequence
  chemically synthesized
ctaatttaaattgagctatttt

SEQ ID NO: 1381663 - DNA, 22 bp, Artificial Sequence
  chemically synthesized
tctaatttaaattgagctattt

SEQ ID NO: 1381664 - DNA, 22 bp, Artificial Sequence
  chemically synthesized
attttctaatttaaattgagct

SEQ ID NO: 1381665 - DNA, 22 bp, Artificial Sequence
  chemically synthesized
aatttaaattagaaaatgaata

SEQ ID NO: 1381666 - DNA, 22 bp, Artificial Sequence
  chemically synthesized
aagataggtcatgtatattcat

SEQ ID NO: 1381667 - DNA, 22 bp, Artificial Sequence
  chemically synthesized
aaagataggtcatgtatattca

SEQ ID NO: 1381668 - DNA, 22 bp, Artificial Sequence
  chemically synthesized
aaattagaaaatgaatatacat

SEQ ID NO: 1381669 - DNA, 22 bp, Artificial Sequence
  chemically synthesized
aattagaaaatgaatatacatg

SEQ ID NO: 1381670 - DNA, 22 bp, Artificial Sequence
  chemically synthesized
ttaaagataggtcatgtatatt

SEQ ID NO: 1381671 - DNA, 22 bp, Artificial Sequence
  chemically synthesized
gttcttaaagataggtcatgta

SEQ ID NO: 1381672 - DNA, 22 bp, Artificial Sequence
  chemically synthesized
gaaaatgaatatacatgaccta

SEQ ID NO: 1381673 - DNA, 22 bp, Artificial Sequence
  chemically synthesized
tctttaagaactagtctgtatg

SEQ ID NO: 1381674 - DNA, 22 bp, Artificial Sequence
  chemically synthesized
taagaactagtctgtatgttta

SEQ ID NO: 1381675 - DNA, 22 bp, Artificial Sequence
  chemically synthesized
aaatggaaatggtaaacataca

SEQ ID NO: 1381676 - DNA, 22 bp, Artificial Sequence
  chemically synthesized
aagaactagtctgtatgtttac

SEQ ID NO: 1381677 - DNA, 22 bp, Artificial Sequence
  chemically synthesized
agaactagtctgtatgtttacc

SEQ ID NO: 1381678 - DNA, 22 bp, Artificial Sequence
  chemically synthesized
gtctgtatgtttaccatttcca

SEQ ID NO: 1381679 - DNA, 22 bp, Artificial Sequence
  chemically synthesized
tatgtttaccatttccatttga

SEQ ID NO: 1381680 - DNA, 22 bp, Artificial Sequence
  chemically synthesized
accatttccatttgaacatttt

SEQ ID NO: 1381681 - DNA, 22 bp, Artificial Sequence
  chemically synthesized
ccatttccatttgaacattttt

SEQ ID NO: 1381682 - DNA, 22 bp, Artificial Sequence
  chemically synthesized
taagagaaatgaataaaaaatg

SEQ ID NO: 1381683 - DNA, 22 bp, Artificial Sequence
  chemically synthesized
ccatttgaacattttttattca

SEQ ID NO: 1381684 - DNA, 22 bp, Artificial Sequence
  chemically synthesized
catttgaacattttttattcat

SEQ ID NO: 1381685 - DNA, 22 bp, Artificial Sequence
  chemically synthesized
gaacattttttattcatttctc

SEQ ID NO: 1381686 - DNA, 22 bp, Artificial Sequence
  chemically synthesized
aacattttttattcatttctct

SEQ ID NO: 1381687 - DNA, 22 bp, Artificial Sequence
  chemically synthesized
aatatataggatctataagaga

SEQ ID NO: 1381688 - DNA, 22 bp, Artificial Sequence
  chemically synthesized
tttattcatttctcttatagat

SEQ ID NO: 1381689 - DNA, 22 bp, Artificial Sequence
  chemically synthesized
ttattcatttctcttatagatc

SEQ ID NO: 1381690 - DNA, 22 bp, Artificial Sequence
  chemically synthesized
tattcatttctcttatagatcc

SEQ ID NO: 1381691 - DNA, 22 bp, Artificial Sequence
  chemically synthesized
attcatttctcttatagatcct

SEQ ID NO: 1381692 - DNA, 22 bp, Artificial Sequence
  chemically synthesized
ttcatttctcttatagatccta

SEQ ID NO: 1381693 - DNA, 22 bp, Artificial Sequence
  chemically synthesized
atttctcttatagatcctatat

SEQ ID NO: 1381694 - DNA, 22 bp, Artificial Sequence
  chemically synthesized
ctcttatagatcctatatattt

SEQ ID NO: 1381695 - DNA, 22 bp, Artificial Sequence
  chemically synthesized
tcttatagatcctatatattta

SEQ ID NO: 1381696 - DNA, 22 bp, Artificial Sequence
  chemically synthesized
ttatagatcctatatatttaat

SEQ ID NO: 1381697 - DNA, 22 bp, Artificial Sequence
  chemically synthesized
atagatcctatatatttaatgt

SEQ ID NO: 1381698 - DNA, 22 bp, Artificial Sequence
  chemically synthesized
tagatcctatatatttaatgtg

SEQ ID NO: 1381699 - DNA, 22 bp, Artificial Sequence
  chemically synthesized
acagcaaaagcaagaacacatt

SEQ ID NO: 1381700 - DNA, 22 bp, Artificial Sequence
  chemically synthesized
aacagcaaaagcaagaacacat

SEQ ID NO: 1381701 - DNA, 22 bp, Artificial Sequence
  chemically synthesized
taacagcaaaagcaagaacaca

SEQ ID NO: 1381702 - DNA, 22 bp, Artificial Sequence
  chemically synthesized
tatatttaatgtgttcttgctt

SEQ ID NO: 1381703 - DNA, 22 bp, Artificial Sequence
  chemically synthesized
cctttaacagcaaaagcaagaa

SEQ ID NO: 1381704 - DNA, 22 bp, Artificial Sequence
  chemically synthesized
gcctttaacagcaaaagcaaga

SEQ ID NO: 1381705 - DNA, 22 bp, Artificial Sequence
  chemically synthesized
aatgtgttcttgcttttgctgt

SEQ ID NO: 1381706 - DNA, 22 bp, Artificial Sequence
  chemically synthesized
atgtgttcttgcttttgctgtt

SEQ ID NO: 1381707 - DNA, 22 bp, Artificial Sequence
  chemically synthesized
cagtcttgcctttaacagcaaa

SEQ ID NO: 1381708 - DNA, 22 bp, Artificial Sequence
  chemically synthesized
ttgcttttgctgttaaaggcaa

SEQ ID NO: 1381709 - DNA, 22 bp, Artificial Sequence
  chemically synthesized
gcttttgctgttaaaggcaaga

SEQ ID NO: 1381710 - DNA, 22 bp, Artificial Sequence
  chemically synthesized
cttttgctgttaaaggcaagac

SEQ ID NO: 1381711 - DNA, 22 bp, Artificial Sequence
  chemically synthesized
aagaagtctccagtcttgcctt

SEQ ID NO: 1381712 - DNA, 22 bp, Artificial Sequence
  chemically synthesized
aaagaagtctccagtcttgcct

SEQ ID NO: 1381713 - DNA, 22 bp, Artificial Sequence
  chemically synthesized
ttgctgttaaaggcaagactgg

SEQ ID NO: 1381714 - DNA, 22 bp, Artificial Sequence
  chemically synthesized
tgctgttaaaggcaagactgga

SEQ ID NO: 1381715 - DNA, 22 bp, Artificial Sequence
  chemically synthesized
gctgttaaaggcaagactggag

SEQ ID NO: 1381716 - DNA, 22 bp, Artificial Sequence
  chemically synthesized
ctgttaaaggcaagactggaga

SEQ ID NO: 1381717 - DNA, 22 bp, Artificial Sequence
  chemically synthesized
taatttaaagaagtctccagtc

SEQ ID NO: 1381718 - DNA, 22 bp, Artificial Sequence
  chemically synthesized
ttaaaggcaagactggagactt

SEQ ID NO: 1381719 - DNA, 22 bp, Artificial Sequence
  chemically synthesized
aaggcaagactggagacttctt

SEQ ID NO: 1381720 - DNA, 22 bp, Artificial Sequence
  chemically synthesized
ataaagcactgtaatttaaaga

SEQ ID NO: 1381721 - DNA, 22 bp, Artificial Sequence
  chemically synthesized
gagacttctttaaattacagtg

SEQ ID NO: 1381722 - DNA, 22 bp, Artificial Sequence
  chemically synthesized
ctttaaattacagtgctttatc

SEQ ID NO: 1381723 - DNA, 22 bp, Artificial Sequence
  chemically synthesized
tttaaattacagtgctttatca

SEQ ID NO: 1381724 - DNA, 22 bp, Artificial Sequence
  chemically synthesized
aaatgatgcatgttgataaagc

SEQ ID NO: 1381725 - DNA, 22 bp, Artificial Sequence
  chemically synthesized
taaattacagtgctttatcaac

SEQ ID NO: 1381726 - DNA, 22 bp, Artificial Sequence
  chemically synthesized
aaattacagtgctttatcaaca

SEQ ID NO: 1381727 - DNA, 22 bp, Artificial Sequence
  chemically synthesized
aattacagtgctttatcaacat

SEQ ID NO: 1381728 - DNA, 22 bp, Artificial Sequence
  chemically synthesized
cagtgctttatcaacatgcatc

SEQ ID NO: 1381729 - DNA, 22 bp, Artificial Sequence
  chemically synthesized
tgaatctaaaatgatgcatgtt

SEQ ID NO: 1381730 - DNA, 22 bp, Artificial Sequence
  chemically synthesized
gtgaatctaaaatgatgcatgt

SEQ ID NO: 1381731 - DNA, 22 bp, Artificial Sequence
  chemically synthesized
tatcaacatgcatcattttaga

SEQ ID NO: 1381732 - DNA, 22 bp, Artificial Sequence
  chemically synthesized
atcaacatgcatcattttagat

SEQ ID NO: 1381733 - DNA, 22 bp, Artificial Sequence
  chemically synthesized
tcaacatgcatcattttagatt

SEQ ID NO: 1381734 - DNA, 22 bp, Artificial Sequence
  chemically synthesized
aggatgcttgtgaatctaaaat

SEQ ID NO: 1381735 - DNA, 22 bp, Artificial Sequence
  chemically synthesized
gttaaggatgcttgtgaatcta

SEQ ID NO: 1381736 - DNA, 22 bp, Artificial Sequence
  chemically synthesized
tggttaaggatgcttgtgaatc

SEQ ID NO: 1381737 - DNA, 22 bp, Artificial Sequence
  chemically synthesized
actctggttaaggatgcttgtg

SEQ ID NO: 1381738 - DNA, 22 bp, Artificial Sequence
  chemically synthesized
tgactctggttaaggatgcttg

SEQ ID NO: 1381739 - DNA, 22 bp, Artificial Sequence
  chemically synthesized
tctgactctggttaaggatgct

SEQ ID NO: 1381740 - DNA, 22 bp, Artificial Sequence
  chemically synthesized
tagattcacaagcatccttaac

SEQ ID NO: 1381741 - DNA, 22 bp, Artificial Sequence
  chemically synthesized
agattcacaagcatccttaacc

SEQ ID NO: 1381742 - DNA, 22 bp, Artificial Sequence
  chemically synthesized
gattcacaagcatccttaacca

SEQ ID NO: 1381743 - DNA, 22 bp, Artificial Sequence
  chemically synthesized
aaaagctctctgactctggtta

SEQ ID NO: 1381744 - DNA, 22 bp, Artificial Sequence
  chemically synthesized
acaagcatccttaaccagagtc

SEQ ID NO: 1381745 - DNA, 22 bp, Artificial Sequence
  chemically synthesized
aaaaagctctctgactctggtt

SEQ ID NO: 1381746 - DNA, 22 bp, Artificial Sequence
  chemically synthesized
taaaaagctctctgactctggt

SEQ ID NO: 1381747 - DNA, 22 bp, Artificial Sequence
  chemically synthesized
ttaaaaagctctctgactctgg

SEQ ID NO: 1381748 - DNA, 22 bp, Artificial Sequence
  chemically synthesized
tttaaaaagctctctgactctg

SEQ ID NO: 1381749 - DNA, 22 bp, Artificial Sequence
  chemically synthesized
aaccagagtcagagagcttttt

SEQ ID NO: 1381750 - DNA, 22 bp, Artificial Sequence
  chemically synthesized
accagagtcagagagcttttta

SEQ ID NO: 1381751 - DNA, 22 bp, Artificial Sequence
  chemically synthesized
tatatatatatatatatttttt

SEQ ID NO: 1381752 - DNA, 22 bp, Artificial Sequence
  chemically synthesized
tatatatatatatatatatttt

SEQ ID NO: 1381753 - DNA, 22 bp, Artificial Sequence
  chemically synthesized
ctatatatatatatatatattt

SEQ ID NO: 1381754 - DNA, 22 bp, Artificial Sequence
  chemically synthesized
tctatatatatatatatatatt

SEQ ID NO: 1381755 - DNA, 22 bp, Artificial Sequence
  chemically synthesized
tttaaaaaatatatatatatat

SEQ ID NO: 1381756 - DNA, 22 bp, Artificial Sequence
  chemically synthesized
ttaaaaaatatatatatatata

SEQ ID NO: 1381757 - DNA, 22 bp, Artificial Sequence
  chemically synthesized
taaaaaatatatatatatatat

SEQ ID NO: 1381758 - DNA, 22 bp, Artificial Sequence
  chemically synthesized
aaaaaatatatatatatatata

SEQ ID NO: 1381759 - DNA, 22 bp, Artificial Sequence
  chemically synthesized
aaaaatatatatatatatatat

SEQ ID NO: 1381760 - DNA, 22 bp, Artificial Sequence
  chemically synthesized
aaaatccatataacacagaaag

SEQ ID NO: 1381761 - DNA, 22 bp, Artificial Sequence
  chemically synthesized
ctcccttttactttctgtgtta

SEQ ID NO: 1381762 - DNA, 22 bp, Artificial Sequence
  chemically synthesized
ccttttactttctgtgttatat

SEQ ID NO: 1381763 - DNA, 22 bp, Artificial Sequence
  chemically synthesized
agaaactcaaaatccatataac

SEQ ID NO: 1381764 - DNA, 22 bp, Artificial Sequence
  chemically synthesized
ttactttctgtgttatatggat

SEQ ID NO: 1381765 - DNA, 22 bp, Artificial Sequence
  chemically synthesized
tactttctgtgttatatggatt

SEQ ID NO: 1381766 - DNA, 22 bp, Artificial Sequence
  chemically synthesized
actttctgtgttatatggattt

SEQ ID NO: 1381767 - DNA, 22 bp, Artificial Sequence
  chemically synthesized
ctttctgtgttatatggatttt

SEQ ID NO: 1381768 - DNA, 22 bp, Artificial Sequence
  chemically synthesized
tctgtgttatatggattttgag

SEQ ID NO: 1381769 - DNA, 22 bp, Artificial Sequence
  chemically synthesized
aaaactaagaaactcaaaatcc

SEQ ID NO: 1381770 - DNA, 22 bp, Artificial Sequence
  chemically synthesized
ctgtgttatatggattttgagt

SEQ ID NO: 1381771 - DNA, 22 bp, Artificial Sequence
  chemically synthesized
tgtgttatatggattttgagtt

SEQ ID NO: 1381772 - DNA, 22 bp, Artificial Sequence
  chemically synthesized
tgttatatggattttgagtttc

SEQ ID NO: 1381773 - DNA, 22 bp, Artificial Sequence
  chemically synthesized
catagctcaaaactaagaaact

SEQ ID NO: 1381774 - DNA, 22 bp, Artificial Sequence
  chemically synthesized
tatggattttgagtttcttagt

SEQ ID NO: 1381775 - DNA, 22 bp, Artificial Sequence
  chemically synthesized
tgagtttcttagttttgagcta

SEQ ID NO: 1381776 - DNA, 22 bp, Artificial Sequence
  chemically synthesized
gagtttcttagttttgagctat

SEQ ID NO: 1381777 - DNA, 22 bp, Artificial Sequence
  chemically synthesized
agtttcttagttttgagctatg

SEQ ID NO: 1381778 - DNA, 22 bp, Artificial Sequence
  chemically synthesized
cttagttttgagctatggaatt

SEQ ID NO: 1381779 - DNA, 22 bp, Artificial Sequence
  chemically synthesized
ttagttttgagctatggaattt

SEQ ID NO: 1381780 - DNA, 22 bp, Artificial Sequence
  chemically synthesized
agttttgagctatggaattttc

SEQ ID NO: 1381781 - DNA, 22 bp, Artificial Sequence
  chemically synthesized
gttttgagctatggaattttct

SEQ ID NO: 1381782 - DNA, 22 bp, Artificial Sequence
  chemically synthesized
tgagctatggaattttctttct

SEQ ID NO: 1381783 - DNA, 22 bp, Artificial Sequence
  chemically synthesized
gagctatggaattttctttcta

SEQ ID NO: 1381784 - DNA, 22 bp, Artificial Sequence
  chemically synthesized
agctatggaattttctttctat

SEQ ID NO: 1381785 - DNA, 22 bp, Artificial Sequence
  chemically synthesized
aaaagaataaacccatagaaag

SEQ ID NO: 1381786 - DNA, 22 bp, Artificial Sequence
  chemically synthesized
aaaaagaataaacccatagaaa

SEQ ID NO: 1381787 - DNA, 22 bp, Artificial Sequence
  chemically synthesized
taaaaagaataaacccatagaa

SEQ ID NO: 1381788 - DNA, 22 bp, Artificial Sequence
  chemically synthesized
tggaattttctttctatgggtt

SEQ ID NO: 1381789 - DNA, 22 bp, Artificial Sequence
  chemically synthesized
ttaaaaagaataaacccataga

SEQ ID NO: 1381790 - DNA, 22 bp, Artificial Sequence
  chemically synthesized
cttttaaaaagaataaacccat

SEQ ID NO: 1381791 - DNA, 22 bp, Artificial Sequence
  chemically synthesized
tctttctatgggtttattcttt

SEQ ID NO: 1381792 - DNA, 22 bp, Artificial Sequence
  chemically synthesized
ctttctatgggtttattctttt

SEQ ID NO: 1381793 - DNA, 22 bp, Artificial Sequence
  chemically synthesized
tttctatgggtttattcttttt

SEQ ID NO: 1381794 - DNA, 22 bp, Artificial Sequence
  chemically synthesized
tctatgggtttattctttttaa

SEQ ID NO: 1381795 - DNA, 22 bp, Artificial Sequence
  chemically synthesized
ctatgggtttattctttttaaa

SEQ ID NO: 1381796 - DNA, 22 bp, Artificial Sequence
  chemically synthesized
aatagcactacttttaaaaaga

SEQ ID NO: 1381797 - DNA, 22 bp, Artificial Sequence
  chemically synthesized
tatgggtttattctttttaaaa

SEQ ID NO: 1381798 - DNA, 22 bp, Artificial Sequence
  chemically synthesized
tgggtttattctttttaaaagt

SEQ ID NO: 1381799 - DNA, 22 bp, Artificial Sequence
  chemically synthesized
attctttttaaaagtagtgcta

SEQ ID NO: 1381800 - DNA, 22 bp, Artificial Sequence
  chemically synthesized
ttctttttaaaagtagtgctat

SEQ ID NO: 1381801 - DNA, 22 bp, Artificial Sequence
  chemically synthesized
tttttaaaagtagtgctattta

SEQ ID NO: 1381802 - DNA, 22 bp, Artificial Sequence
  chemically synthesized
tttaaaagtagtgctatttaga

SEQ ID NO: 1381803 - DNA, 22 bp, Artificial Sequence
  chemically synthesized
ttaaaagtagtgctatttagat

SEQ ID NO: 1381804 - DNA, 22 bp, Artificial Sequence
  chemically synthesized
taaaagtagtgctatttagatt

SEQ ID NO: 1381805 - DNA, 22 bp, Artificial Sequence
  chemically synthesized
aaaagtagtgctatttagattt

SEQ ID NO: 1381806 - DNA, 22 bp, Artificial Sequence
  chemically synthesized
aaagtagtgctatttagatttc

SEQ ID NO: 1381807 - DNA, 22 bp, Artificial Sequence
  chemically synthesized
aagaacaatatataaatggaaa

SEQ ID NO: 1381808 - DNA, 22 bp, Artificial Sequence
  chemically synthesized
tttagatttccatttatatatt

SEQ ID NO: 1381809 - DNA, 22 bp, Artificial Sequence
  chemically synthesized
aggggctaaagaacaatatata

SEQ ID NO: 1381810 - DNA, 22 bp, Artificial Sequence
  chemically synthesized
agatttccatttatatattgtt

SEQ ID NO: 1381811 - DNA, 22 bp, Artificial Sequence
  chemically synthesized
aaggggctaaagaacaatatat

SEQ ID NO: 1381812 - DNA, 22 bp, Artificial Sequence
  chemically synthesized
gatttccatttatatattgttc

SEQ ID NO: 1381813 - DNA, 22 bp, Artificial Sequence
  chemically synthesized
cttaaggggctaaagaacaata

SEQ ID NO: 1381814 - DNA, 22 bp, Artificial Sequence
  chemically synthesized
gcttaaggggctaaagaacaat

SEQ ID NO: 1381815 - DNA, 22 bp, Artificial Sequence
  chemically synthesized
ccatttatatattgttctttag

SEQ ID NO: 1381816 - DNA, 22 bp, Artificial Sequence
  chemically synthesized
catttatatattgttctttagc

SEQ ID NO: 1381817 - DNA, 22 bp, Artificial Sequence
  chemically synthesized
atgatttgcttaaggggctaaa

SEQ ID NO: 1381818 - DNA, 22 bp, Artificial Sequence
  chemically synthesized
atatattgttctttagcccctt

SEQ ID NO: 1381819 - DNA, 22 bp, Artificial Sequence
  chemically synthesized
tatattgttctttagcccctta

SEQ ID NO: 1381820 - DNA, 22 bp, Artificial Sequence
  chemically synthesized
agtctgatgatttgcttaaggg

SEQ ID NO: 1381821 - DNA, 22 bp, Artificial Sequence
  chemically synthesized
aagtctgatgatttgcttaagg

SEQ ID NO: 1381822 - DNA, 22 bp, Artificial Sequence
  chemically synthesized
ttctttagccccttaagcaaat

SEQ ID NO: 1381823 - DNA, 22 bp, Artificial Sequence
  chemically synthesized
tttagccccttaagcaaatcat

SEQ ID NO: 1381824 - DNA, 22 bp, Artificial Sequence
  chemically synthesized
tagccccttaagcaaatcatca

SEQ ID NO: 1381825 - DNA, 22 bp, Artificial Sequence
  chemically synthesized
agccccttaagcaaatcatcag

SEQ ID NO: 1381826 - DNA, 22 bp, Artificial Sequence
  chemically synthesized
gccccttaagcaaatcatcaga

SEQ ID NO: 1381827 - DNA, 22 bp, Artificial Sequence
  chemically synthesized
tgaatggtgcccttaagtctga

SEQ ID NO: 1381828 - DNA, 22 bp, Artificial Sequence
  chemically synthesized
aagcaaatcatcagacttaagg

SEQ ID NO: 1381829 - DNA, 22 bp, Artificial Sequence
  chemically synthesized
agcaaatcatcagacttaaggg

SEQ ID NO: 1381830 - DNA, 22 bp, Artificial Sequence
  chemically synthesized
aagggcaccattcataatacta

SEQ ID NO: 1381831 - DNA, 22 bp, Artificial Sequence
  chemically synthesized
agggcaccattcataatactat

SEQ ID NO: 1381832 - DNA, 22 bp, Artificial Sequence
  chemically synthesized
ataatatgtaataatagtatta

SEQ ID NO: 1381833 - DNA, 22 bp, Artificial Sequence
  chemically synthesized
actaataatatgtaataatagt

SEQ ID NO: 1381834 - DNA, 22 bp, Artificial Sequence
  chemically synthesized
gactaataatatgtaataatag

SEQ ID NO: 1381835 - DNA, 22 bp, Artificial Sequence
  chemically synthesized
ataatactattattacatatta

SEQ ID NO: 1381836 - DNA, 22 bp, Artificial Sequence
  chemically synthesized
tagatatttgactaataatatg

SEQ ID NO: 1381837 - DNA, 22 bp, Artificial Sequence
  chemically synthesized
atagatatttgactaataatat

SEQ ID NO: 1381838 - DNA, 22 bp, Artificial Sequence
  chemically synthesized
tatagatatttgactaataata

SEQ ID NO: 1381839 - DNA, 22 bp, Artificial Sequence
  chemically synthesized
ttatagatatttgactaataat

SEQ ID NO: 1381840 - DNA, 22 bp, Artificial Sequence
  chemically synthesized
tttatagatatttgactaataa

SEQ ID NO: 1381841 - DNA, 22 bp, Artificial Sequence
  chemically synthesized
ttattacatattattagtcaaa

SEQ ID NO: 1381842 - DNA, 22 bp, Artificial Sequence
  chemically synthesized
ttacatattattagtcaaatat

SEQ ID NO: 1381843 - DNA, 22 bp, Artificial Sequence
  chemically synthesized
atctttttatagatatttgact

SEQ ID NO: 1381844 - DNA, 22 bp, Artificial Sequence
  chemically synthesized
catattattagtcaaatatcta

SEQ ID NO: 1381845 - DNA, 22 bp, Artificial Sequence
  chemically synthesized
ttagtcaaatatctataaaaag

SEQ ID NO: 1381846 - DNA, 22 bp, Artificial Sequence
  chemically synthesized
gtgtcatattcatctttttata

SEQ ID NO: 1381847 - DNA, 22 bp, Artificial Sequence
  chemically synthesized
ggtgtcatattcatctttttat

SEQ ID NO: 1381848 - DNA, 22 bp, Artificial Sequence
  chemically synthesized
gtcaaatatctataaaaagatg

SEQ ID NO: 1381849 - DNA, 22 bp, Artificial Sequence
  chemically synthesized
tcacttggtgtcatattcatct

SEQ ID NO: 1381850 - DNA, 22 bp, Artificial Sequence
  chemically synthesized
tatcacttggtgtcatattcat

SEQ ID NO: 1381851 - DNA, 22 bp, Artificial Sequence
  chemically synthesized
taaaaagatgaatatgacacca

SEQ ID NO: 1381852 - DNA, 22 bp, Artificial Sequence
  chemically synthesized
atgacattctatcacttggtgt

SEQ ID NO: 1381853 - DNA, 22 bp, Artificial Sequence
  chemically synthesized
gagagactgatgacattctatc

SEQ ID NO: 1381854 - DNA, 22 bp, Artificial Sequence
  chemically synthesized
agagagactgatgacattctat

SEQ ID NO: 1381855 - DNA, 22 bp, Artificial Sequence
  chemically synthesized
tagagagactgatgacattcta

SEQ ID NO: 1381856 - DNA, 22 bp, Artificial Sequence
  chemically synthesized
ttagagagactgatgacattct

SEQ ID NO: 1381857 - DNA, 22 bp, Artificial Sequence
  chemically synthesized
tttttagagagactgatgacat

SEQ ID NO: 1381858 - DNA, 22 bp, Artificial Sequence
  chemically synthesized
ttatttttagagagactgatga

SEQ ID NO: 1381859 - DNA, 22 bp, Artificial Sequence
  chemically synthesized
ctattatttttagagagactga

SEQ ID NO: 1381860 - DNA, 22 bp, Artificial Sequence
  chemically synthesized
ttactattatttttagagagac

SEQ ID NO: 1381861 - DNA, 22 bp, Artificial Sequence
  chemically synthesized
attactattatttttagagaga

SEQ ID NO: 1381862 - DNA, 22 bp, Artificial Sequence
  chemically synthesized
tattactattatttttagagag

SEQ ID NO: 1381863 - DNA, 22 bp, Artificial Sequence
  chemically synthesized
ttattactattatttttagaga

SEQ ID NO: 1381864 - DNA, 22 bp, Artificial Sequence
  chemically synthesized
tttttattactattatttttag

SEQ ID NO: 1381865 - DNA, 22 bp, Artificial Sequence
  chemically synthesized
ctatttttattactattatttt

SEQ ID NO: 1381866 - DNA, 22 bp, Artificial Sequence
  chemically synthesized
tattactatttttattactatt

SEQ ID NO: 1381867 - DNA, 22 bp, Artificial Sequence
  chemically synthesized
tctaaaaataatagtaataaaa

SEQ ID NO: 1381868 - DNA, 22 bp, Artificial Sequence
  chemically synthesized
taaaaataatagtaataaaaat

SEQ ID NO: 1381869 - DNA, 22 bp, Artificial Sequence
  chemically synthesized
aaaataatagtaataaaaatag

SEQ ID NO: 1381870 - DNA, 22 bp, Artificial Sequence
  chemically synthesized
tatgattgtattactattttta

SEQ ID NO: 1381871 - DNA, 22 bp, Artificial Sequence
  chemically synthesized
gtatgattgtattactattttt

SEQ ID NO: 1381872 - DNA, 22 bp, Artificial Sequence
  chemically synthesized
ttgtatgattgtattactattt

SEQ ID NO: 1381873 - DNA, 22 bp, Artificial Sequence
  chemically synthesized
cttgtatgattgtattactatt

SEQ ID NO: 1381874 - DNA, 22 bp, Artificial Sequence
  chemically synthesized
agcaaacaacttcttgtatgat

SEQ ID NO: 1381875 - DNA, 22 bp, Artificial Sequence
  chemically synthesized
acctgagcaaacaacttcttgt

SEQ ID NO: 1381876 - DNA, 22 bp, Artificial Sequence
  chemically synthesized
aacctgagcaaacaacttcttg

SEQ ID NO: 1381877 - DNA, 22 bp, Artificial Sequence
  chemically synthesized
aatttaacctgagcaaacaact

SEQ ID NO: 1381878 - DNA, 22 bp, Artificial Sequence
  chemically synthesized
agggtataaattaaatttaacc

SEQ ID NO: 1381879 - DNA, 22 bp, Artificial Sequence
  chemically synthesized
cagggtataaattaaatttaac

SEQ ID NO: 1381880 - DNA, 22 bp, Artificial Sequence
  chemically synthesized
tttgctcaggttaaatttaatt

SEQ ID NO: 1381881 - DNA, 22 bp, Artificial Sequence
  chemically synthesized
tttcagggtataaattaaattt

SEQ ID NO: 1381882 - DNA, 22 bp, Artificial Sequence
  chemically synthesized
gctcaggttaaatttaatttat

SEQ ID NO: 1381883 - DNA, 22 bp, Artificial Sequence
  chemically synthesized
ttatttcagggtataaattaaa

SEQ ID NO: 1381884 - DNA, 22 bp, Artificial Sequence
  chemically synthesized
ctcaggttaaatttaatttata

SEQ ID NO: 1381885 - DNA, 22 bp, Artificial Sequence
  chemically synthesized
attatttcagggtataaattaa

SEQ ID NO: 1381886 - DNA, 22 bp, Artificial Sequence
  chemically synthesized
ttattatttcagggtataaatt

SEQ ID NO: 1381887 - DNA, 22 bp, Artificial Sequence
  chemically synthesized
aggttaaatttaatttataccc

SEQ ID NO: 1381888 - DNA, 22 bp, Artificial Sequence
  chemically synthesized
aatttaatttataccctgaaat

SEQ ID NO: 1381889 - DNA, 22 bp, Artificial Sequence
  chemically synthesized
aatttataccctgaaataataa

SEQ ID NO: 1381890 - DNA, 22 bp, Artificial Sequence
  chemically synthesized
atttataccctgaaataataag

SEQ ID NO: 1381891 - DNA, 22 bp, Artificial Sequence
  chemically synthesized
ataccctgaaataataagaatt

SEQ ID NO: 1381892 - DNA, 22 bp, Artificial Sequence
  chemically synthesized
taccctgaaataataagaatta

SEQ ID NO: 1381893 - DNA, 22 bp, Artificial Sequence
  chemically synthesized
aaataataagaattatattgct

SEQ ID NO: 1381894 - DNA, 22 bp, Artificial Sequence
  chemically synthesized
ccagacgtgcaaagcaatataa

SEQ ID NO: 1381895 - DNA, 22 bp, Artificial Sequence
  chemically synthesized
cccagacgtgcaaagcaatata

SEQ ID NO: 1381896 - DNA, 22 bp, Artificial Sequence
  chemically synthesized
tttcccagacgtgcaaagcaat

SEQ ID NO: 1381897 - DNA, 22 bp, Artificial Sequence
  chemically synthesized
tgtttcccagacgtgcaaagca

SEQ ID NO: 1381898 - DNA, 22 bp, Artificial Sequence
  chemically synthesized
taagttctgtttcccagacgtg

SEQ ID NO: 1381899 - DNA, 22 bp, Artificial Sequence
  chemically synthesized
gtaagttctgtttcccagacgt

SEQ ID NO: 1381900 - DNA, 22 bp, Artificial Sequence
  chemically synthesized
tattgctttgcacgtctgggaa

SEQ ID NO: 1381901 - DNA, 22 bp, Artificial Sequence
  chemically synthesized
tgtaagttctgtttcccagacg

SEQ ID NO: 1381902 - DNA, 22 bp, Artificial Sequence
  chemically synthesized
ttgtaagttctgtttcccagac

SEQ ID NO: 1381903 - DNA, 22 bp, Artificial Sequence
  chemically synthesized
tttgtaagttctgtttcccaga

SEQ ID NO: 1381904 - DNA, 22 bp, Artificial Sequence
  chemically synthesized
ttttgtaagttctgtttcccag

SEQ ID NO: 1381905 - DNA, 22 bp, Artificial Sequence
  chemically synthesized
ctttgcacgtctgggaaacaga

SEQ ID NO: 1381906 - DNA, 22 bp, Artificial Sequence
  chemically synthesized
ccttttttgtaagttctgtttc

SEQ ID NO: 1381907 - DNA, 22 bp, Artificial Sequence
  chemically synthesized
tgcacgtctgggaaacagaact

SEQ ID NO: 1381908 - DNA, 22 bp, Artificial Sequence
  chemically synthesized
cccttttttgtaagttctgttt

SEQ ID NO: 1381909 - DNA, 22 bp, Artificial Sequence
  chemically synthesized
gcacgtctgggaaacagaactt

SEQ ID NO: 1381910 - DNA, 22 bp, Artificial Sequence
  chemically synthesized
cacgtctgggaaacagaactta

SEQ ID NO: 1381911 - DNA, 22 bp, Artificial Sequence
  chemically synthesized
ggaaacagaacttacaaaaaag

SEQ ID NO: 1381912 - DNA, 22 bp, Artificial Sequence
  chemically synthesized
tgagtcagtttcccttttttgt

SEQ ID NO: 1381913 - DNA, 22 bp, Artificial Sequence
  chemically synthesized
atgagtcagtttcccttttttg

SEQ ID NO: 1381914 - DNA, 22 bp, Artificial Sequence
  chemically synthesized
tatgagtcagtttccctttttt

SEQ ID NO: 1381915 - DNA, 22 bp, Artificial Sequence
  chemically synthesized
acaaaaaagggaaactgactca

SEQ ID NO: 1381916 - DNA, 22 bp, Artificial Sequence
  chemically synthesized
caaaaaagggaaactgactcat

SEQ ID NO: 1381917 - DNA, 22 bp, Artificial Sequence
  chemically synthesized
aaatataagtactttatgagtc

SEQ ID NO: 1381918 - DNA, 22 bp, Artificial Sequence
  chemically synthesized
aaaatataagtactttatgagt

SEQ ID NO: 1381919 - DNA, 22 bp, Artificial Sequence
  chemically synthesized
taaaatataagtactttatgag

SEQ ID NO: 1381920 - DNA, 22 bp, Artificial Sequence
  chemically synthesized
actcataaagtacttatatttt

SEQ ID NO: 1381921 - DNA, 22 bp, Artificial Sequence
  chemically synthesized
gataaataattttaaaatataa

SEQ ID NO: 1381922 - DNA, 22 bp, Artificial Sequence
  chemically synthesized
ataaagtacttatattttaaaa

SEQ ID NO: 1381923 - DNA, 22 bp, Artificial Sequence
  chemically synthesized
atattttaaaattatttatcta

SEQ ID NO: 1381924 - DNA, 22 bp, Artificial Sequence
  chemically synthesized
tattttaaaattatttatctaa

SEQ ID NO: 1381925 - DNA, 22 bp, Artificial Sequence
  chemically synthesized
aacaaatgagaattagataaat

SEQ ID NO: 1381926 - DNA, 22 bp, Artificial Sequence
  chemically synthesized
ttgaacaaatgagaattagata

SEQ ID NO: 1381927 - DNA, 22 bp, Artificial Sequence
  chemically synthesized
gttgaacaaatgagaattagat

SEQ ID NO: 1381928 - DNA, 22 bp, Artificial Sequence
  chemically synthesized
taaaattatttatctaattctc

SEQ ID NO: 1381929 - DNA, 22 bp, Artificial Sequence
  chemically synthesized
aaaattatttatctaattctca

SEQ ID NO: 1381930 - DNA, 22 bp, Artificial Sequence
  chemically synthesized
aaattatttatctaattctcat

SEQ ID NO: 1381931 - DNA, 22 bp, Artificial Sequence
  chemically synthesized
tgcaatttgttgaacaaatgag

SEQ ID NO: 1381932 - DNA, 22 bp, Artificial Sequence
  chemically synthesized
tttatctaattctcatttgttc

SEQ ID NO: 1381933 - DNA, 22 bp, Artificial Sequence
  chemically synthesized
gtgcaatttgttgaacaaatga

SEQ ID NO: 1381934 - DNA, 22 bp, Artificial Sequence
  chemically synthesized
atctaattctcatttgttcaac

SEQ ID NO: 1381935 - DNA, 22 bp, Artificial Sequence
  chemically synthesized
tctaattctcatttgttcaaca

SEQ ID NO: 1381936 - DNA, 22 bp, Artificial Sequence
  chemically synthesized
tatatttgtgcaatttgttgaa

SEQ ID NO: 1381937 - DNA, 22 bp, Artificial Sequence
  chemically synthesized
attctcatttgttcaacaaatt

SEQ ID NO: 1381938 - DNA, 22 bp, Artificial Sequence
  chemically synthesized
gtatatttgtgcaatttgttga

SEQ ID NO: 1381939 - DNA, 22 bp, Artificial Sequence
  chemically synthesized
tcatttgttcaacaaattgcac

SEQ ID NO: 1381940 - DNA, 22 bp, Artificial Sequence
  chemically synthesized
aacttgtatatttgtgcaattt

SEQ ID NO: 1381941 - DNA, 22 bp, Artificial Sequence
  chemically synthesized
atttgttcaacaaattgcacaa

SEQ ID NO: 1381942 - DNA, 22 bp, Artificial Sequence
  chemically synthesized
caacttgtatatttgtgcaatt

SEQ ID NO: 1381943 - DNA, 22 bp, Artificial Sequence
  chemically synthesized
tcaacttgtatatttgtgcaat

SEQ ID NO: 1381944 - DNA, 22 bp, Artificial Sequence
  chemically synthesized
gttcaacaaattgcacaaatat

SEQ ID NO: 1381945 - DNA, 22 bp, Artificial Sequence
  chemically synthesized
ttttcaacttgtatatttgtgc

SEQ ID NO: 1381946 - DNA, 22 bp, Artificial Sequence
  chemically synthesized
ttcaacaaattgcacaaatata

SEQ ID NO: 1381947 - DNA, 22 bp, Artificial Sequence
  chemically synthesized
aacaaattgcacaaatatacaa

SEQ ID NO: 1381948 - DNA, 22 bp, Artificial Sequence
  chemically synthesized
tactgttttcaacttgtatatt

SEQ ID NO: 1381949 - DNA, 22 bp, Artificial Sequence
  chemically synthesized
atactgttttcaacttgtatat

SEQ ID NO: 1381950 - DNA, 22 bp, Artificial Sequence
  chemically synthesized
tatactgttttcaacttgtata

SEQ ID NO: 1381951 - DNA, 22 bp, Artificial Sequence
  chemically synthesized
ttatactgttttcaacttgtat

SEQ ID NO: 1381952 - DNA, 22 bp, Artificial Sequence
  chemically synthesized
tttttatactgttttcaacttg

SEQ ID NO: 1381953 - DNA, 22 bp, Artificial Sequence
  chemically synthesized
cacaaatatacaagttgaaaac

SEQ ID NO: 1381954 - DNA, 22 bp, Artificial Sequence
  chemically synthesized
agtgtaagattatttttatact

SEQ ID NO: 1381955 - DNA, 22 bp, Artificial Sequence
  chemically synthesized
aagtgtaagattatttttatac

SEQ ID NO: 1381956 - DNA, 22 bp, Artificial Sequence
  chemically synthesized
aaaacagtataaaaataatctt

SEQ ID NO: 1381957 - DNA, 22 bp, Artificial Sequence
  chemically synthesized
aaagaagatcttaagtgtaaga

SEQ ID NO: 1381958 - DNA, 22 bp, Artificial Sequence
  chemically synthesized
gaaagaagatcttaagtgtaag

SEQ ID NO: 1381959 - DNA, 22 bp, Artificial Sequence
  chemically synthesized
gatttgaaagaagatcttaagt

SEQ ID NO: 1381960 - DNA, 22 bp, Artificial Sequence
  chemically synthesized
gactagatttgaaagaagatct

SEQ ID NO: 1381961 - DNA, 22 bp, Artificial Sequence
  chemically synthesized
agactagatttgaaagaagatc

SEQ ID NO: 1381962 - DNA, 22 bp, Artificial Sequence
  chemically synthesized
tttagactagatttgaaagaag

SEQ ID NO: 1381963 - DNA, 22 bp, Artificial Sequence
  chemically synthesized
acacttaagatcttctttcaaa

SEQ ID NO: 1381964 - DNA, 22 bp, Artificial Sequence
  chemically synthesized
gtttagactagatttgaaagaa

SEQ ID NO: 1381965 - DNA, 22 bp, Artificial Sequence
  chemically synthesized
cacttaagatcttctttcaaat

SEQ ID NO: 1381966 - DNA, 22 bp, Artificial Sequence
  chemically synthesized
aagatcttctttcaaatctagt

SEQ ID NO: 1381967 - DNA, 22 bp, Artificial Sequence
  chemically synthesized
agatcttctttcaaatctagtc

SEQ ID NO: 1381968 - DNA, 22 bp, Artificial Sequence
  chemically synthesized
cagtagacttgtttagactaga

SEQ ID NO: 1381969 - DNA, 22 bp, Artificial Sequence
  chemically synthesized
ccagtagacttgtttagactag

SEQ ID NO: 1381970 - DNA, 22 bp, Artificial Sequence
  chemically synthesized
ctttcaaatctagtctaaacaa

SEQ ID NO: 1381971 - DNA, 22 bp, Artificial Sequence
  chemically synthesized
tttcaaatctagtctaaacaag

SEQ ID NO: 1381972 - DNA, 22 bp, Artificial Sequence
  chemically synthesized
tcaaatctagtctaaacaagtc

SEQ ID NO: 1381973 - DNA, 22 bp, Artificial Sequence
  chemically synthesized
caaatctagtctaaacaagtct

SEQ ID NO: 1381974 - DNA, 22 bp, Artificial Sequence
  chemically synthesized
aaatctagtctaaacaagtcta

SEQ ID NO: 1381975 - DNA, 22 bp, Artificial Sequence
  chemically synthesized
tccaaagtcttccagtagactt

SEQ ID NO: 1381976 - DNA, 22 bp, Artificial Sequence
  chemically synthesized
gtctaaacaagtctactggaag

SEQ ID NO: 1381977 - DNA, 22 bp, Artificial Sequence
  chemically synthesized
aacaagtctactggaagacttt

SEQ ID NO: 1381978 - DNA, 22 bp, Artificial Sequence
  chemically synthesized
acatagaagactatccaaagtc

SEQ ID NO: 1381979 - DNA, 22 bp, Artificial Sequence
  chemically synthesized
ctggaagactttggatagtctt

SEQ ID NO: 1381980 - DNA, 22 bp, Artificial Sequence
  chemically synthesized
gaagactttggatagtcttcta

SEQ ID NO: 1381981 - DNA, 22 bp, Artificial Sequence
  chemically synthesized
tggatagtcttctatgttagta

SEQ ID NO: 1381982 - DNA, 22 bp, Artificial Sequence
  chemically synthesized
ggatagtcttctatgttagtac

SEQ ID NO: 1381983 - DNA, 22 bp, Artificial Sequence
  chemically synthesized
gatagtcttctatgttagtact

SEQ ID NO: 1381984 - DNA, 22 bp, Artificial Sequence
  chemically synthesized
atccagcagaggcaaagtacta

SEQ ID NO: 1381985 - DNA, 22 bp, Artificial Sequence
  chemically synthesized
catccagcagaggcaaagtact

SEQ ID NO: 1381986 - DNA, 22 bp, Artificial Sequence
  chemically synthesized
tcatccagcagaggcaaagtac

SEQ ID NO: 1381987 - DNA, 22 bp, Artificial Sequence
  chemically synthesized
tttcatccagcagaggcaaagt

SEQ ID NO: 1381988 - DNA, 22 bp, Artificial Sequence
  chemically synthesized
ctatgttagtactttgcctctg

SEQ ID NO: 1381989 - DNA, 22 bp, Artificial Sequence
  chemically synthesized
tatgttagtactttgcctctgc

SEQ ID NO: 1381990 - DNA, 22 bp, Artificial Sequence
  chemically synthesized
tgttagtactttgcctctgctg

SEQ ID NO: 1381991 - DNA, 22 bp, Artificial Sequence
  chemically synthesized
tgttctttcatccagcagaggc

SEQ ID NO: 1381992 - DNA, 22 bp, Artificial Sequence
  chemically synthesized
cctgtgttctttcatccagcag

SEQ ID NO: 1381993 - DNA, 22 bp, Artificial Sequence
  chemically synthesized
gtactttgcctctgctggatga

SEQ ID NO: 1381994 - DNA, 22 bp, Artificial Sequence
  chemically synthesized
attgcctgtgttctttcatcca

SEQ ID NO: 1381995 - DNA, 22 bp, Artificial Sequence
  chemically synthesized
tgcctctgctggatgaaagaac

SEQ ID NO: 1381996 - DNA, 22 bp, Artificial Sequence
  chemically synthesized
gcctctgctggatgaaagaaca

SEQ ID NO: 1381997 - DNA, 22 bp, Artificial Sequence
  chemically synthesized
cctctgctggatgaaagaacac

SEQ ID NO: 1381998 - DNA, 22 bp, Artificial Sequence
  chemically synthesized
tgttgattgcctgtgttctttc

SEQ ID NO: 1381999 - DNA, 22 bp, Artificial Sequence
  chemically synthesized
tgctggatgaaagaacacaggc

SEQ ID NO: 1382000 - DNA, 22 bp, Artificial Sequence
  chemically synthesized
actgtgttgattgcctgtgttc

SEQ ID NO: 1382001 - DNA, 22 bp, Artificial Sequence
  chemically synthesized
ctggatgaaagaacacaggcaa

SEQ ID NO: 1382002 - DNA, 22 bp, Artificial Sequence
  chemically synthesized
attaactgtgttgattgcctgt

SEQ ID NO: 1382003 - DNA, 22 bp, Artificial Sequence
  chemically synthesized
gatgaaagaacacaggcaatca

SEQ ID NO: 1382004 - DNA, 22 bp, Artificial Sequence
  chemically synthesized
cattaactgtgttgattgcctg

SEQ ID NO: 1382005 - DNA, 22 bp, Artificial Sequence
  chemically synthesized
ttcattaactgtgttgattgcc

SEQ ID NO: 1382006 - DNA, 22 bp, Artificial Sequence
  chemically synthesized
cttcattaactgtgttgattgc

SEQ ID NO: 1382007 - DNA, 22 bp, Artificial Sequence
  chemically synthesized
tcttcattaactgtgttgattg

SEQ ID NO: 1382008 - DNA, 22 bp, Artificial Sequence
  chemically synthesized
ttcttcattaactgtgttgatt

SEQ ID NO: 1382009 - DNA, 22 bp, Artificial Sequence
  chemically synthesized
taatatgtacatttttcttcat

SEQ ID NO: 1382010 - DNA, 22 bp, Artificial Sequence
  chemically synthesized
atgaagaaaaatgtacatatta

SEQ ID NO: 1382011 - DNA, 22 bp, Artificial Sequence
  chemically synthesized
caatatgtatatacaggccaaa

SEQ ID NO: 1382012 - DNA, 22 bp, Artificial Sequence
  chemically synthesized
tagtcattgtttggcctgtata

SEQ ID NO: 1382013 - DNA, 22 bp, Artificial Sequence
  chemically synthesized
tttggcctgtatatacatattg

SEQ ID NO: 1382014 - DNA, 22 bp, Artificial Sequence
  chemically synthesized
gcagagtaagttccaatatgta

SEQ ID NO: 1382015 - DNA, 22 bp, Artificial Sequence
  chemically synthesized
ggcctgtatatacatattggaa

SEQ ID NO: 1382016 - DNA, 22 bp, Artificial Sequence
  chemically synthesized
gcctgtatatacatattggaac

SEQ ID NO: 1382017 - DNA, 22 bp, Artificial Sequence
  chemically synthesized
tcctagcagagtaagttccaat

SEQ ID NO: 1382018 - DNA, 22 bp, Artificial Sequence
  chemically synthesized
atcctagcagagtaagttccaa

SEQ ID NO: 1382019 - DNA, 22 bp, Artificial Sequence
  chemically synthesized
tatatacatattggaacttact

SEQ ID NO: 1382020 - DNA, 22 bp, Artificial Sequence
  chemically synthesized
tgcaatttatcctagcagagta

SEQ ID NO: 1382021 - DNA, 22 bp, Artificial Sequence
  chemically synthesized
gtgcaatttatcctagcagagt

SEQ ID NO: 1382022 - DNA, 22 bp, Artificial Sequence
  chemically synthesized
gaacttactctgctaggataaa

SEQ ID NO: 1382023 - DNA, 22 bp, Artificial Sequence
  chemically synthesized
actctgctaggataaattgcac

SEQ ID NO: 1382024 - DNA, 22 bp, Artificial Sequence
  chemically synthesized
ctctgctaggataaattgcaca

SEQ ID NO: 1382025 - DNA, 22 bp, Artificial Sequence
  chemically synthesized
tgctaggataaattgcacaaat

SEQ ID NO: 1382026 - DNA, 22 bp, Artificial Sequence
  chemically synthesized
ctaggataaattgcacaaatat

SEQ ID NO: 1382027 - DNA, 22 bp, Artificial Sequence
  chemically synthesized
gaaaaggcgtgtatatttgtgc

SEQ ID NO: 1382028 - DNA, 22 bp, Artificial Sequence
  chemically synthesized
agaaaaggcgtgtatatttgtg

SEQ ID NO: 1382029 - DNA, 22 bp, Artificial Sequence
  chemically synthesized
tagaaaaggcgtgtatatttgt

SEQ ID NO: 1382030 - DNA, 22 bp, Artificial Sequence
  chemically synthesized
ggataaattgcacaaatataca

SEQ ID NO: 1382031 - DNA, 22 bp, Artificial Sequence
  chemically synthesized
ttttagaaaaggcgtgtatatt

SEQ ID NO: 1382032 - DNA, 22 bp, Artificial Sequence
  chemically synthesized
attttagaaaaggcgtgtatat

SEQ ID NO: 1382033 - DNA, 22 bp, Artificial Sequence
  chemically synthesized
cacaaatatacacgccttttct

SEQ ID NO: 1382034 - DNA, 22 bp, Artificial Sequence
  chemically synthesized
gacagtgcatttattttagaaa

SEQ ID NO: 1382035 - DNA, 22 bp, Artificial Sequence
  chemically synthesized
tccatggactcgacagtgcatt

SEQ ID NO: 1382036 - DNA, 22 bp, Artificial Sequence
  chemically synthesized
atccatggactcgacagtgcat

SEQ ID NO: 1382037 - DNA, 22 bp, Artificial Sequence
  chemically synthesized
ttctaaaataaatgcactgtcg

SEQ ID NO: 1382038 - DNA, 22 bp, Artificial Sequence
  chemically synthesized
tatccatggactcgacagtgca

SEQ ID NO: 1382039 - DNA, 22 bp, Artificial Sequence
  chemically synthesized
tctaaaataaatgcactgtcga

SEQ ID NO: 1382040 - DNA, 22 bp, Artificial Sequence
  chemically synthesized
ctaaaataaatgcactgtcgag

SEQ ID NO: 1382041 - DNA, 22 bp, Artificial Sequence
  chemically synthesized
taaaataaatgcactgtcgagt

SEQ ID NO: 1382042 - DNA, 22 bp, Artificial Sequence
  chemically synthesized
aaataaatgcactgtcgagtcc

SEQ ID NO: 1382043 - DNA, 22 bp, Artificial Sequence
  chemically synthesized
gcaaggataggactttatccat

SEQ ID NO: 1382044 - DNA, 22 bp, Artificial Sequence
  chemically synthesized
tcgagtccatggataaagtcct

SEQ ID NO: 1382045 - DNA, 22 bp, Artificial Sequence
  chemically synthesized
tctggcaaggataggactttat

SEQ ID NO: 1382046 - DNA, 22 bp, Artificial Sequence
  chemically synthesized
ttatctggcaaggataggactt

SEQ ID NO: 1382047 - DNA, 22 bp, Artificial Sequence
  chemically synthesized
gaattattatctggcaaggata

SEQ ID NO: 1382048 - DNA, 22 bp, Artificial Sequence
  chemically synthesized
agaattattatctggcaaggat

SEQ ID NO: 1382049 - DNA, 22 bp, Artificial Sequence
  chemically synthesized
tagaattattatctggcaagga

SEQ ID NO: 1382050 - DNA, 22 bp, Artificial Sequence
  chemically synthesized
ttagaattattatctggcaagg

SEQ ID NO: 1382051 - DNA, 22 bp, Artificial Sequence
  chemically synthesized
tttttagaattattatctggca

SEQ ID NO: 1382052 - DNA, 22 bp, Artificial Sequence
  chemically synthesized
gtttttagaattattatctggc

SEQ ID NO: 1382053 - DNA, 22 bp, Artificial Sequence
  chemically synthesized
ttgtttttagaattattatctg

SEQ ID NO: 1382054 - DNA, 22 bp, Artificial Sequence
  chemically synthesized
cttgtttttagaattattatct

SEQ ID NO: 1382055 - DNA, 22 bp, Artificial Sequence
  chemically synthesized
tccttgccagataataattcta

SEQ ID NO: 1382056 - DNA, 22 bp, Artificial Sequence
  chemically synthesized
gtttcttgtttttagaattatt

SEQ ID NO: 1382057 - DNA, 22 bp, Artificial Sequence
  chemically synthesized
ggtttcttgtttttagaattat

SEQ ID NO: 1382058 - DNA, 22 bp, Artificial Sequence
  chemically synthesized
tggtttcttgtttttagaatta

SEQ ID NO: 1382059 - DNA, 22 bp, Artificial Sequence
  chemically synthesized
ttggtttcttgtttttagaatt

SEQ ID NO: 1382060 - DNA, 22 bp, Artificial Sequence
  chemically synthesized
gccagataataattctaaaaac

SEQ ID NO: 1382061 - DNA, 22 bp, Artificial Sequence
  chemically synthesized
ccagataataattctaaaaaca

SEQ ID NO: 1382062 - DNA, 22 bp, Artificial Sequence
  chemically synthesized
tttttggtttcttgtttttaga

SEQ ID NO: 1382063 - DNA, 22 bp, Artificial Sequence
  chemically synthesized
atttttggtttcttgtttttag

SEQ ID NO: 1382064 - DNA, 22 bp, Artificial Sequence
  chemically synthesized
tatttttggtttcttgttttta

SEQ ID NO: 1382065 - DNA, 22 bp, Artificial Sequence
  chemically synthesized
ttatttttggtttcttgttttt

SEQ ID NO: 1382066 - DNA, 22 bp, Artificial Sequence
  chemically synthesized
tttatttttggtttcttgtttt

SEQ ID NO: 1382067 - DNA, 22 bp, Artificial Sequence
  chemically synthesized
ttttatttttggtttcttgttt

SEQ ID NO: 1382068 - DNA, 22 bp, Artificial Sequence
  chemically synthesized
tttttttatttttggtttcttg

SEQ ID NO: 1382069 - DNA, 22 bp, Artificial Sequence
  chemically synthesized
atttttttatttttggtttctt

SEQ ID NO: 1382070 - DNA, 22 bp, Artificial Sequence
  chemically synthesized
tatttttttatttttggtttct

SEQ ID NO: 1382071 - DNA, 22 bp, Artificial Sequence
  chemically synthesized
taaaaacaagaaaccaaaaata

SEQ ID NO: 1382072 - DNA, 22 bp, Artificial Sequence
  chemically synthesized
aaaacaagaaaccaaaaataaa

SEQ ID NO: 1382073 - DNA, 22 bp, Artificial Sequence
  chemically synthesized
aaaattttatttttttattttt

SEQ ID NO: 1382074 - DNA, 22 bp, Artificial Sequence
  chemically synthesized
caaaattttatttttttatttt

SEQ ID NO: 1382075 - DNA, 22 bp, Artificial Sequence
  chemically synthesized
tcaaaattttatttttttattt

SEQ ID NO: 1382076 - DNA, 22 bp, Artificial Sequence
  chemically synthesized
ctttcaaaattttattttttta

SEQ ID NO: 1382077 - DNA, 22 bp, Artificial Sequence
  chemically synthesized
cctttcaaaattttattttttt

SEQ ID NO: 1382078 - DNA, 22 bp, Artificial Sequence
  chemically synthesized
tttcctttcaaaattttatttt

SEQ ID NO: 1382079 - DNA, 22 bp, Artificial Sequence
  chemically synthesized
atttcctttcaaaattttattt

SEQ ID NO: 1382080 - DNA, 22 bp, Artificial Sequence
  chemically synthesized
tatttcctttcaaaattttatt

SEQ ID NO: 1382081 - DNA, 22 bp, Artificial Sequence
  chemically synthesized
aaaggtacatgaagttttattt

SEQ ID NO: 1382082 - DNA, 22 bp, Artificial Sequence
  chemically synthesized
gaaaggtacatgaagttttatt

SEQ ID NO: 1382083 - DNA, 22 bp, Artificial Sequence
  chemically synthesized
tgaaaggaaataaaacttcatg

SEQ ID NO: 1382084 - DNA, 22 bp, Artificial Sequence
  chemically synthesized
ccttgaaaggtacatgaagttt

SEQ ID NO: 1382085 - DNA, 22 bp, Artificial Sequence
  chemically synthesized
gaaaggaaataaaacttcatgt

SEQ ID NO: 1382086 - DNA, 22 bp, Artificial Sequence
  chemically synthesized
aaaggaaataaaacttcatgta

SEQ ID NO: 1382087 - DNA, 22 bp, Artificial Sequence
  chemically synthesized
ctcccttgaaaggtacatgaag

SEQ ID NO: 1382088 - DNA, 22 bp, Artificial Sequence
  chemically synthesized
gtcacctactcccttgaaaggt

SEQ ID NO: 1382089 - DNA, 22 bp, Artificial Sequence
  chemically synthesized
cgtcacctactcccttgaaagg

SEQ ID NO: 1382090 - DNA, 22 bp, Artificial Sequence
  chemically synthesized
catgtacctttcaagggagtag

SEQ ID NO: 1382091 - DNA, 22 bp, Artificial Sequence
  chemically synthesized
atgtacctttcaagggagtagg

SEQ ID NO: 1382092 - DNA, 22 bp, Artificial Sequence
  chemically synthesized
gcaccatcttcgtcacctactc

SEQ ID NO: 1382093 - DNA, 22 bp, Artificial Sequence
  chemically synthesized
tagcaccatcttcgtcacctac

SEQ ID NO: 1382094 - DNA, 22 bp, Artificial Sequence
  chemically synthesized
tcaagggagtaggtgacgaaga

SEQ ID NO: 1382095 - DNA, 22 bp, Artificial Sequence
  chemically synthesized
caagggagtaggtgacgaagat

SEQ ID NO: 1382096 - DNA, 22 bp, Artificial Sequence
  chemically synthesized
aagggagtaggtgacgaagatg

SEQ ID NO: 1382097 - DNA, 22 bp, Artificial Sequence
  chemically synthesized
agagtcattctagcaccatctt

SEQ ID NO: 1382098 - DNA, 22 bp, Artificial Sequence
  chemically synthesized
ggctgagagtcattctagcacc

SEQ ID NO: 1382099 - DNA, 22 bp, Artificial Sequence
  chemically synthesized
tgacacaccaccctaggctgag

SEQ ID NO: 1382100 - DNA, 22 bp, Artificial Sequence
  chemically synthesized
atgacacaccaccctaggctga

SEQ ID NO: 1382101 - DNA, 22 bp, Artificial Sequence
  chemically synthesized
gaatgactctcagcctagggtg

SEQ ID NO: 1382102 - DNA, 22 bp, Artificial Sequence
  chemically synthesized
atcttatgacacaccaccctag

SEQ ID NO: 1382103 - DNA, 22 bp, Artificial Sequence
  chemically synthesized
taatcttatgacacaccaccct

SEQ ID NO: 1382104 - DNA, 22 bp, Artificial Sequence
  chemically synthesized
ctaatcttatgacacaccaccc

SEQ ID NO: 1382105 - DNA, 22 bp, Artificial Sequence
  chemically synthesized
tctaatcttatgacacaccacc

SEQ ID NO: 1382106 - DNA, 22 bp, Artificial Sequence
  chemically synthesized
tcagcctagggtggtgtgtcat

SEQ ID NO: 1382107 - DNA, 22 bp, Artificial Sequence
  chemically synthesized
agcctagggtggtgtgtcataa

SEQ ID NO: 1382108 - DNA, 22 bp, Artificial Sequence
  chemically synthesized
gggtggtgtgtcataagattag

SEQ ID NO: 1382109 - DNA, 22 bp, Artificial Sequence
  chemically synthesized
gaacacatctttctaatcttat

SEQ ID NO: 1382110 - DNA, 22 bp, Artificial Sequence
  chemically synthesized
cagagattagaacacatctttc

SEQ ID NO: 1382111 - DNA, 22 bp, Artificial Sequence
  chemically synthesized
acagagattagaacacatcttt

SEQ ID NO: 1382112 - DNA, 22 bp, Artificial Sequence
  chemically synthesized
gcttacagagattagaacacat

SEQ ID NO: 1382113 - DNA, 22 bp, Artificial Sequence
  chemically synthesized
ggcttacagagattagaacaca

SEQ ID NO: 1382114 - DNA, 22 bp, Artificial Sequence
  chemically synthesized
gaaagatgtgttctaatctctg

SEQ ID NO: 1382115 - DNA, 22 bp, Artificial Sequence
  chemically synthesized
ccacttggcttacagagattag

SEQ ID NO: 1382116 - DNA, 22 bp, Artificial Sequence
  chemically synthesized
atgaactaccacttggcttaca

SEQ ID NO: 1382117 - DNA, 22 bp, Artificial Sequence
  chemically synthesized
ctgatgaactaccacttggctt

SEQ ID NO: 1382118 - DNA, 22 bp, Artificial Sequence
  chemically synthesized
gctgatgaactaccacttggct

SEQ ID NO: 1382119 - DNA, 22 bp, Artificial Sequence
  chemically synthesized
taatctctgtaagccaagtggt

SEQ ID NO: 1382120 - DNA, 22 bp, Artificial Sequence
  chemically synthesized
tgctgatgaactaccacttggc

SEQ ID NO: 1382121 - DNA, 22 bp, Artificial Sequence
  chemically synthesized
ttgctgatgaactaccacttgg

SEQ ID NO: 1382122 - DNA, 22 bp, Artificial Sequence
  chemically synthesized
atctctgtaagccaagtggtag

SEQ ID NO: 1382123 - DNA, 22 bp, Artificial Sequence
  chemically synthesized
tgtaagccaagtggtagttcat

SEQ ID NO: 1382124 - DNA, 22 bp, Artificial Sequence
  chemically synthesized
ataatttttgctgatgaactac

SEQ ID NO: 1382125 - DNA, 22 bp, Artificial Sequence
  chemically synthesized
taagccaagtggtagttcatca

SEQ ID NO: 1382126 - DNA, 22 bp, Artificial Sequence
  chemically synthesized
acaatgaactgataatttttgc

SEQ ID NO: 1382127 - DNA, 22 bp, Artificial Sequence
  chemically synthesized
atcagcaaaaattatcagttca

SEQ ID NO: 1382128 - DNA, 22 bp, Artificial Sequence
  chemically synthesized
tcagttcattgttaattcctgg

SEQ ID NO: 1382129 - DNA, 22 bp, Artificial Sequence
  chemically synthesized
aaagagaaataaaccaggaatt

SEQ ID NO: 1382130 - DNA, 22 bp, Artificial Sequence
  chemically synthesized
attgttaattcctggtttattt

SEQ ID NO: 1382131 - DNA, 22 bp, Artificial Sequence
  chemically synthesized
ttaattcctggtttatttctct

SEQ ID NO: 1382132 - DNA, 22 bp, Artificial Sequence
  chemically synthesized
attcctggtttatttctctttc

SEQ ID NO: 1382133 - DNA, 22 bp, Artificial Sequence
  chemically synthesized
ggcggtaaaaactgaaagagaa

SEQ ID NO: 1382134 - DNA, 22 bp, Artificial Sequence
  chemically synthesized
aggcggtaaaaactgaaagaga

SEQ ID NO: 1382135 - DNA, 22 bp, Artificial Sequence
  chemically synthesized
taggcggtaaaaactgaaagag

SEQ ID NO: 1382136 - DNA, 22 bp, Artificial Sequence
  chemically synthesized
ctggtttatttctctttcagtt

SEQ ID NO: 1382137 - DNA, 22 bp, Artificial Sequence
  chemically synthesized
gtttatttctctttcagttttt

SEQ ID NO: 1382138 - DNA, 22 bp, Artificial Sequence
  chemically synthesized
atttctctttcagtttttaccg

SEQ ID NO: 1382139 - DNA, 22 bp, Artificial Sequence
  chemically synthesized
tttctctttcagtttttaccgc

SEQ ID NO: 1382140 - DNA, 22 bp, Artificial Sequence
  chemically synthesized
aacaagactttaggcggtaaaa

SEQ ID NO: 1382141 - DNA, 22 bp, Artificial Sequence
  chemically synthesized
aaacaagactttaggcggtaaa

SEQ ID NO: 1382142 - DNA, 22 bp, Artificial Sequence
  chemically synthesized
ctctttcagtttttaccgccta

SEQ ID NO: 1382143 - DNA, 22 bp, Artificial Sequence
  chemically synthesized
taaacaagactttaggcggtaa

SEQ ID NO: 1382144 - DNA, 22 bp, Artificial Sequence
  chemically synthesized
tctttcagtttttaccgcctaa

SEQ ID NO: 1382145 - DNA, 22 bp, Artificial Sequence
  chemically synthesized
tttcagtttttaccgcctaaag

SEQ ID NO: 1382146 - DNA, 22 bp, Artificial Sequence
  chemically synthesized
tcagtttttaccgcctaaagtc

SEQ ID NO: 1382147 - DNA, 22 bp, Artificial Sequence
  chemically synthesized
cagtttttaccgcctaaagtct

SEQ ID NO: 1382148 - DNA, 22 bp, Artificial Sequence
  chemically synthesized
agtttttaccgcctaaagtctt

SEQ ID NO: 1382149 - DNA, 22 bp, Artificial Sequence
  chemically synthesized
ttaccgcctaaagtcttgttta

SEQ ID NO: 1382150 - DNA, 22 bp, Artificial Sequence
  chemically synthesized
taccgcctaaagtcttgtttaa

SEQ ID NO: 1382151 - DNA, 22 bp, Artificial Sequence
  chemically synthesized
accgcctaaagtcttgtttaaa

SEQ ID NO: 1382152 - DNA, 22 bp, Artificial Sequence
  chemically synthesized
ccgcctaaagtcttgtttaaaa

SEQ ID NO: 1382153 - DNA, 22 bp, Artificial Sequence
  chemically synthesized
gcccagtcaaaagttttaaaca

SEQ ID NO: 1382154 - DNA, 22 bp, Artificial Sequence
  chemically synthesized
aagtcttgtttaaaacttttga

SEQ ID NO: 1382155 - DNA, 22 bp, Artificial Sequence
  chemically synthesized
aatctggcccagtcaaaagttt

SEQ ID NO: 1382156 - DNA, 22 bp, Artificial Sequence
  chemically synthesized
aaatctggcccagtcaaaagtt

SEQ ID NO: 1382157 - DNA, 22 bp, Artificial Sequence
  chemically synthesized
gtttaaaacttttgactgggcc

SEQ ID NO: 1382158 - DNA, 22 bp, Artificial Sequence
  chemically synthesized
tttaaaacttttgactgggcca

SEQ ID NO: 1382159 - DNA, 22 bp, Artificial Sequence
  chemically synthesized
aaaacttttgactgggccagat

SEQ ID NO: 1382160 - DNA, 22 bp, Artificial Sequence
  chemically synthesized
aaacttttgactgggccagatt

SEQ ID NO: 1382161 - DNA, 22 bp, Artificial Sequence
  chemically synthesized
ttgactgggccagatttaagat

SEQ ID NO: 1382162 - DNA, 22 bp, Artificial Sequence
  chemically synthesized
acaacatgtgtaatcttaaatc

SEQ ID NO: 1382163 - DNA, 22 bp, Artificial Sequence
  chemically synthesized
tgactgggccagatttaagatt

SEQ ID NO: 1382164 - DNA, 22 bp, Artificial Sequence
  chemically synthesized
aacaacatgtgtaatcttaaat

SEQ ID NO: 1382165 - DNA, 22 bp, Artificial Sequence
  chemically synthesized
gactgggccagatttaagatta

SEQ ID NO: 1382166 - DNA, 22 bp, Artificial Sequence
  chemically synthesized
actgggccagatttaagattac

SEQ ID NO: 1382167 - DNA, 22 bp, Artificial Sequence
  chemically synthesized
ggccagatttaagattacacat

SEQ ID NO: 1382168 - DNA, 22 bp, Artificial Sequence
  chemically synthesized
ccccttaacaacatgtgtaatc

SEQ ID NO: 1382169 - DNA, 22 bp, Artificial Sequence
  chemically synthesized
gccccttaacaacatgtgtaat

SEQ ID NO: 1382170 - DNA, 22 bp, Artificial Sequence
  chemically synthesized
ccttgccccttaacaacatgtg

SEQ ID NO: 1382171 - DNA, 22 bp, Artificial Sequence
  chemically synthesized
aagattacacatgttgttaagg

SEQ ID NO: 1382172 - DNA, 22 bp, Artificial Sequence
  chemically synthesized
agattacacatgttgttaaggg

SEQ ID NO: 1382173 - DNA, 22 bp, Artificial Sequence
  chemically synthesized
ggacctgccttgccccttaaca

SEQ ID NO: 1382174 - DNA, 22 bp, Artificial Sequence
  chemically synthesized
cacatgttgttaaggggcaagg

SEQ ID NO: 1382175 - DNA, 22 bp, Artificial Sequence
  chemically synthesized
gggtaaactaggacctgccttg

SEQ ID NO: 1382176 - DNA, 22 bp, Artificial Sequence
  chemically synthesized
ttaaggggcaaggcaggtccta

SEQ ID NO: 1382177 - DNA, 22 bp, Artificial Sequence
  chemically synthesized
atcctagggtaaactaggacct

SEQ ID NO: 1382178 - DNA, 22 bp, Artificial Sequence
  chemically synthesized
aggggcaaggcaggtcctagtt

SEQ ID NO: 1382179 - DNA, 22 bp, Artificial Sequence
  chemically synthesized
taatcctagggtaaactaggac

SEQ ID NO: 1382180 - DNA, 22 bp, Artificial Sequence
  chemically synthesized
acattctaatcctagggtaaac

SEQ ID NO: 1382181 - DNA, 22 bp, Artificial Sequence
  chemically synthesized
aacattctaatcctagggtaaa

SEQ ID NO: 1382182 - DNA, 22 bp, Artificial Sequence
  chemically synthesized
gtggcttaacattctaatccta

SEQ ID NO: 1382183 - DNA, 22 bp, Artificial Sequence
  chemically synthesized
gtttaccctaggattagaatgt

SEQ ID NO: 1382184 - DNA, 22 bp, Artificial Sequence
  chemically synthesized
gttggtggcttaacattctaat

SEQ ID NO: 1382185 - DNA, 22 bp, Artificial Sequence
  chemically synthesized
ctggttggtggcttaacattct

SEQ ID NO: 1382186 - DNA, 22 bp, Artificial Sequence
  chemically synthesized
accctaggattagaatgttaag

SEQ ID NO: 1382187 - DNA, 22 bp, Artificial Sequence
  chemically synthesized
gctggttggtggcttaacattc

SEQ ID NO: 1382188 - DNA, 22 bp, Artificial Sequence
  chemically synthesized
ccctaggattagaatgttaagc

SEQ ID NO: 1382189 - DNA, 22 bp, Artificial Sequence
  chemically synthesized
tgctggttggtggcttaacatt

SEQ ID NO: 1382190 - DNA, 22 bp, Artificial Sequence
  chemically synthesized
ttttgctggttggtggcttaac

SEQ ID NO: 1382191 - DNA, 22 bp, Artificial Sequence
  chemically synthesized
ggattagaatgttaagccacca

SEQ ID NO: 1382192 - DNA, 22 bp, Artificial Sequence
  chemically synthesized
gggttattttgctggttggtgg

SEQ ID NO: 1382193 - DNA, 22 bp, Artificial Sequence
  chemically synthesized
gaatgttaagccaccaaccagc

SEQ ID NO: 1382194 - DNA, 22 bp, Artificial Sequence
  chemically synthesized
tccctagggttattttgctggt

SEQ ID NO: 1382195 - DNA, 22 bp, Artificial Sequence
  chemically synthesized
gtccctagggttattttgctgg

SEQ ID NO: 1382196 - DNA, 22 bp, Artificial Sequence
  chemically synthesized
tgtccctagggttattttgctg

SEQ ID NO: 1382197 - DNA, 22 bp, Artificial Sequence
  chemically synthesized
agccaccaaccagcaaaataac

SEQ ID NO: 1382198 - DNA, 22 bp, Artificial Sequence
  chemically synthesized
ttttgtccctagggttattttg

SEQ ID NO: 1382199 - DNA, 22 bp, Artificial Sequence
  chemically synthesized
attttgtccctagggttatttt

SEQ ID NO: 1382200 - DNA, 22 bp, Artificial Sequence
  chemically synthesized
tattttgtccctagggttattt

SEQ ID NO: 1382201 - DNA, 22 bp, Artificial Sequence
  chemically synthesized
actttattttgtccctagggtt

SEQ ID NO: 1382202 - DNA, 22 bp, Artificial Sequence
  chemically synthesized
atccaactgactttattttgtc

SEQ ID NO: 1382203 - DNA, 22 bp, Artificial Sequence
  chemically synthesized
tgatccaactgactttattttg

SEQ ID NO: 1382204 - DNA, 22 bp, Artificial Sequence
  chemically synthesized
aattctgatccaactgacttta

SEQ ID NO: 1382205 - DNA, 22 bp, Artificial Sequence
  chemically synthesized
caattctgatccaactgacttt

SEQ ID NO: 1382206 - DNA, 22 bp, Artificial Sequence
  chemically synthesized
gggacaaaataaagtcagttgg

SEQ ID NO: 1382207 - DNA, 22 bp, Artificial Sequence
  chemically synthesized
agtttcaattctgatccaactg

SEQ ID NO: 1382208 - DNA, 22 bp, Artificial Sequence
  chemically synthesized
gatcagaattgaaactgagggg

SEQ ID NO: 1382209 - DNA, 22 bp, Artificial Sequence
  chemically synthesized
gggaaagaagagtggagacccc

SEQ ID NO: 1382210 - DNA, 22 bp, Artificial Sequence
  chemically synthesized
ggggaaagaagagtggagaccc

SEQ ID NO: 1382211 - DNA, 22 bp, Artificial Sequence
  chemically synthesized
tggggaaagaagagtggagacc

SEQ ID NO: 1382212 - DNA, 22 bp, Artificial Sequence
  chemically synthesized
tttggggaaagaagagtggaga

SEQ ID NO: 1382213 - DNA, 22 bp, Artificial Sequence
  chemically synthesized
aaactgaggggtctccactctt

SEQ ID NO: 1382214 - DNA, 22 bp, Artificial Sequence
  chemically synthesized
aggggtctccactcttctttcc

SEQ ID NO: 1382215 - DNA, 22 bp, Artificial Sequence
  chemically synthesized
cactcttctttccccaaagaat

SEQ ID NO: 1382216 - DNA, 22 bp, Artificial Sequence
  chemically synthesized
ataacgaaggagaaaattcttt

SEQ ID NO: 1382217 - DNA, 22 bp, Artificial Sequence
  chemically synthesized
ttctttccccaaagaattttct

SEQ ID NO: 1382218 - DNA, 22 bp, Artificial Sequence
  chemically synthesized
ctttccccaaagaattttctcc

SEQ ID NO: 1382219 - DNA, 22 bp, Artificial Sequence
  chemically synthesized
tttccccaaagaattttctcct

SEQ ID NO: 1382220 - DNA, 22 bp, Artificial Sequence
  chemically synthesized
tccccaaagaattttctccttc

SEQ ID NO: 1382221 - DNA, 22 bp, Artificial Sequence
  chemically synthesized
cagattcataacgaaggagaaa

SEQ ID NO: 1382222 - DNA, 22 bp, Artificial Sequence
  chemically synthesized
ccccaaagaattttctccttcg

SEQ ID NO: 1382223 - DNA, 22 bp, Artificial Sequence
  chemically synthesized
cccaaagaattttctccttcgt

SEQ ID NO: 1382224 - DNA, 22 bp, Artificial Sequence
  chemically synthesized
tctccttcgttatgaatctgga

SEQ ID NO: 1382225 - DNA, 22 bp, Artificial Sequence
  chemically synthesized
aaatacatatcctccagattca

SEQ ID NO: 1382226 - DNA, 22 bp, Artificial Sequence
  chemically synthesized
ctccttcgttatgaatctggag

SEQ ID NO: 1382227 - DNA, 22 bp, Artificial Sequence
  chemically synthesized
tccttcgttatgaatctggagg

SEQ ID NO: 1382228 - DNA, 22 bp, Artificial Sequence
  chemically synthesized
ctaaaatacatatcctccagat

SEQ ID NO: 1382229 - DNA, 22 bp, Artificial Sequence
  chemically synthesized
cttcgttatgaatctggaggat

SEQ ID NO: 1382230 - DNA, 22 bp, Artificial Sequence
  chemically synthesized
actaaaatacatatcctccaga

SEQ ID NO: 1382231 - DNA, 22 bp, Artificial Sequence
  chemically synthesized
tactaaaatacatatcctccag

SEQ ID NO: 1382232 - DNA, 22 bp, Artificial Sequence
  chemically synthesized
cgttatgaatctggaggatatg

SEQ ID NO: 1382233 - DNA, 22 bp, Artificial Sequence
  chemically synthesized
gttatgaatctggaggatatgt

SEQ ID NO: 1382234 - DNA, 22 bp, Artificial Sequence
  chemically synthesized
tctttactaaaatacatatcct

SEQ ID NO: 1382235 - DNA, 22 bp, Artificial Sequence
  chemically synthesized
atctttactaaaatacatatcc

SEQ ID NO: 1382236 - DNA, 22 bp, Artificial Sequence
  chemically synthesized
tatctttactaaaatacatatc

SEQ ID NO: 1382237 - DNA, 22 bp, Artificial Sequence
  chemically synthesized
tgaatctggaggatatgtattt

SEQ ID NO: 1382238 - DNA, 22 bp, Artificial Sequence
  chemically synthesized
gaggatatgtattttagtaaag

SEQ ID NO: 1382239 - DNA, 22 bp, Artificial Sequence
  chemically synthesized
tagtaaagataaaggttttttt

SEQ ID NO: 1382240 - DNA, 22 bp, Artificial Sequence
  chemically synthesized
agtaaagataaaggtttttttt

SEQ ID NO: 1382241 - DNA, 22 bp, Artificial Sequence
  chemically synthesized
gtaaagataaaggttttttttt

SEQ ID NO: 1382242 - DNA, 22 bp, Artificial Sequence
  chemically synthesized
caatcaatatatgtaaaaaaaa

SEQ ID NO: 1382243 - DNA, 22 bp, Artificial Sequence
  chemically synthesized
tgaatgccctccaatcaatata

SEQ ID NO: 1382244 - DNA, 22 bp, Artificial Sequence
  chemically synthesized
tttttttacatatattgattgg

SEQ ID NO: 1382245 - DNA, 22 bp, Artificial Sequence
  chemically synthesized
ttttttacatatattgattgga

SEQ ID NO: 1382246 - DNA, 22 bp, Artificial Sequence
  chemically synthesized
tttttacatatattgattggag

SEQ ID NO: 1382247 - DNA, 22 bp, Artificial Sequence
  chemically synthesized
attatgaatgccctccaatcaa

SEQ ID NO: 1382248 - DNA, 22 bp, Artificial Sequence
  chemically synthesized
ttttacatatattgattggagg

SEQ ID NO: 1382249 - DNA, 22 bp, Artificial Sequence
  chemically synthesized
tttacatatattgattggaggg

SEQ ID NO: 1382250 - DNA, 22 bp, Artificial Sequence
  chemically synthesized
ttacatatattgattggagggc

SEQ ID NO: 1382251 - DNA, 22 bp, Artificial Sequence
  chemically synthesized
tacatatattgattggagggca

SEQ ID NO: 1382252 - DNA, 22 bp, Artificial Sequence
  chemically synthesized
acatatattgattggagggcat

SEQ ID NO: 1382253 - DNA, 22 bp, Artificial Sequence
  chemically synthesized
catatattgattggagggcatt

SEQ ID NO: 1382254 - DNA, 22 bp, Artificial Sequence
  chemically synthesized
aaaattgattatgaatgccctc

SEQ ID NO: 1382255 - DNA, 22 bp, Artificial Sequence
  chemically synthesized
gaaaattgattatgaatgccct

SEQ ID NO: 1382256 - DNA, 22 bp, Artificial Sequence
  chemically synthesized
tgaaaattgattatgaatgccc

SEQ ID NO: 1382257 - DNA, 22 bp, Artificial Sequence
  chemically synthesized
tttgaaaattgattatgaatgc

SEQ ID NO: 1382258 - DNA, 22 bp, Artificial Sequence
  chemically synthesized
ctttgaaaattgattatgaatg

SEQ ID NO: 1382259 - DNA, 22 bp, Artificial Sequence
  chemically synthesized
attggagggcattcataatcaa

SEQ ID NO: 1382260 - DNA, 22 bp, Artificial Sequence
  chemically synthesized
atttctttgaaaattgattatg

SEQ ID NO: 1382261 - DNA, 22 bp, Artificial Sequence
  chemically synthesized
gagggcattcataatcaatttt

SEQ ID NO: 1382262 - DNA, 22 bp, Artificial Sequence
  chemically synthesized
aatgctaatttctttgaaaatt

SEQ ID NO: 1382263 - DNA, 22 bp, Artificial Sequence
  chemically synthesized
caatgctaatttctttgaaaat

SEQ ID NO: 1382264 - DNA, 22 bp, Artificial Sequence
  chemically synthesized
cttcaatgctaatttctttgaa

SEQ ID NO: 1382265 - DNA, 22 bp, Artificial Sequence
  chemically synthesized
ccttcaatgctaatttctttga

SEQ ID NO: 1382266 - DNA, 22 bp, Artificial Sequence
  chemically synthesized
ataatcaattttcaaagaaatt

SEQ ID NO: 1382267 - DNA, 22 bp, Artificial Sequence
  chemically synthesized
tttccttcaatgctaatttctt

SEQ ID NO: 1382268 - DNA, 22 bp, Artificial Sequence
  chemically synthesized
atttccttcaatgctaatttct

SEQ ID NO: 1382269 - DNA, 22 bp, Artificial Sequence
  chemically synthesized
cttatttccttcaatgctaatt

SEQ ID NO: 1382270 - DNA, 22 bp, Artificial Sequence
  chemically synthesized
ctccttatttccttcaatgcta

SEQ ID NO: 1382271 - DNA, 22 bp, Artificial Sequence
  chemically synthesized
tcaaagaaattagcattgaagg

SEQ ID NO: 1382272 - DNA, 22 bp, Artificial Sequence
  chemically synthesized
caaagaaattagcattgaagga

SEQ ID NO: 1382273 - DNA, 22 bp, Artificial Sequence
  chemically synthesized
aaagaaattagcattgaaggaa

SEQ ID NO: 1382274 - DNA, 22 bp, Artificial Sequence
  chemically synthesized
taacctgctccttatttccttc

SEQ ID NO: 1382275 - DNA, 22 bp, Artificial Sequence
  chemically synthesized
gcattgaaggaaataaggagca

SEQ ID NO: 1382276 - DNA, 22 bp, Artificial Sequence
  chemically synthesized
taaagaaattgtaacctgctcc

SEQ ID NO: 1382277 - DNA, 22 bp, Artificial Sequence
  chemically synthesized
aaggaaataaggagcaggttac

SEQ ID NO: 1382278 - DNA, 22 bp, Artificial Sequence
  chemically synthesized
tgactgtaaagaaattgtaacc

SEQ ID NO: 1382279 - DNA, 22 bp, Artificial Sequence
  chemically synthesized
ctatgactgtaaagaaattgta

SEQ ID NO: 1382280 - DNA, 22 bp, Artificial Sequence
  chemically synthesized
ccacaacctactatgactgtaa

SEQ ID NO: 1382281 - DNA, 22 bp, Artificial Sequence
  chemically synthesized
tcccacaacctactatgactgt

SEQ ID NO: 1382282 - DNA, 22 bp, Artificial Sequence
  chemically synthesized
caatttctttacagtcatagta

SEQ ID NO: 1382283 - DNA, 22 bp, Artificial Sequence
  chemically synthesized
ctttacagtcatagtaggttgt

SEQ ID NO: 1382284 - DNA, 22 bp, Artificial Sequence
  chemically synthesized
tttacagtcatagtaggttgtg

SEQ ID NO: 1382285 - DNA, 22 bp, Artificial Sequence
  chemically synthesized
tacagtcatagtaggttgtggg

SEQ ID NO: 1382286 - DNA, 22 bp, Artificial Sequence
  chemically synthesized
acagtcatagtaggttgtggga

SEQ ID NO: 1382287 - DNA, 22 bp, Artificial Sequence
  chemically synthesized
cagtcatagtaggttgtgggag

SEQ ID NO: 1382288 - DNA, 22 bp, Artificial Sequence
  chemically synthesized
tagtccagcatctctcccacaa

SEQ ID NO: 1382289 - DNA, 22 bp, Artificial Sequence
  chemically synthesized
atagtccagcatctctcccaca

SEQ ID NO: 1382290 - DNA, 22 bp, Artificial Sequence
  chemically synthesized
tgggagagatgctggactataa

SEQ ID NO: 1382291 - DNA, 22 bp, Artificial Sequence
  chemically synthesized
agaatatgggagtttatagtcc

SEQ ID NO: 1382292 - DNA, 22 bp, Artificial Sequence
  chemically synthesized
gactataaactcccatattctg

SEQ ID NO: 1382293 - DNA, 22 bp, Artificial Sequence
  chemically synthesized
taaactcccatattctgagctt

SEQ ID NO: 1382294 - DNA, 22 bp, Artificial Sequence
  chemically synthesized
tgccaggataacaagctcagaa

SEQ ID NO: 1382295 - DNA, 22 bp, Artificial Sequence
  chemically synthesized
tgtgccaggataacaagctcag

SEQ ID NO: 1382296 - DNA, 22 bp, Artificial Sequence
  chemically synthesized
ctgtgccaggataacaagctca

SEQ ID NO: 1382297 - DNA, 22 bp, Artificial Sequence
  chemically synthesized
ccatattctgagcttgttatcc

SEQ ID NO: 1382298 - DNA, 22 bp, Artificial Sequence
  chemically synthesized
tgagcttgttatcctggcacag

SEQ ID NO: 1382299 - DNA, 22 bp, Artificial Sequence
  chemically synthesized
agcttgttatcctggcacagaa

SEQ ID NO: 1382300 - DNA, 22 bp, Artificial Sequence
  chemically synthesized
aatgtcatcataatttctgtgc

SEQ ID NO: 1382301 - DNA, 22 bp, Artificial Sequence
  chemically synthesized
caatgtcatcataatttctgtg

SEQ ID NO: 1382302 - DNA, 22 bp, Artificial Sequence
  chemically synthesized
tcaatgtcatcataatttctgt

SEQ ID NO: 1382303 - DNA, 22 bp, Artificial Sequence
  chemically synthesized
gttatcctggcacagaaattat

SEQ ID NO: 1382304 - DNA, 22 bp, Artificial Sequence
  chemically synthesized
ttcaatgtcatcataatttctg

SEQ ID NO: 1382305 - DNA, 22 bp, Artificial Sequence
  chemically synthesized
ttatcctggcacagaaattatg

SEQ ID NO: 1382306 - DNA, 22 bp, Artificial Sequence
  chemically synthesized
tttcaatgtcatcataatttct

SEQ ID NO: 1382307 - DNA, 22 bp, Artificial Sequence
  chemically synthesized
ttttcaatgtcatcataatttc

SEQ ID NO: 1382308 - DNA, 22 bp, Artificial Sequence
  chemically synthesized
tcctggcacagaaattatgatg

SEQ ID NO: 1382309 - DNA, 22 bp, Artificial Sequence
  chemically synthesized
gcacagaaattatgatgacatt

SEQ ID NO: 1382310 - DNA, 22 bp, Artificial Sequence
  chemically synthesized
tgaaaatatttttttcaatgtc

SEQ ID NO: 1382311 - DNA, 22 bp, Artificial Sequence
  chemically synthesized
cattatgaaaatatttttttca

SEQ ID NO: 1382312 - DNA, 22 bp, Artificial Sequence
  chemically synthesized
tgatgacattgaaaaaaatatt

SEQ ID NO: 1382313 - DNA, 22 bp, Artificial Sequence
  chemically synthesized
atggactacattatgaaaatat

SEQ ID NO: 1382314 - DNA, 22 bp, Artificial Sequence
  chemically synthesized
aatggactacattatgaaaata

SEQ ID NO: 1382315 - DNA, 22 bp, Artificial Sequence
  chemically synthesized
aaaaaaatattttcataatgta

SEQ ID NO: 1382316 - DNA, 22 bp, Artificial Sequence
  chemically synthesized
tcataatgtagtccattaaatt

SEQ ID NO: 1382317 - DNA, 22 bp, Artificial Sequence
  chemically synthesized
cataatgtagtccattaaattt

SEQ ID NO: 1382318 - DNA, 22 bp, Artificial Sequence
  chemically synthesized
ataatgtagtccattaaatttc

SEQ ID NO: 1382319 - DNA, 22 bp, Artificial Sequence
  chemically synthesized
cataatgtagacatgaaattta

SEQ ID NO: 1382320 - DNA, 22 bp, Artificial Sequence
  chemically synthesized
ccataatgtagacatgaaattt

SEQ ID NO: 1382321 - DNA, 22 bp, Artificial Sequence
  chemically synthesized
agtttccataatgtagacatga

SEQ ID NO: 1382322 - DNA, 22 bp, Artificial Sequence
  chemically synthesized
tgagtttccataatgtagacat

SEQ ID NO: 1382323 - DNA, 22 bp, Artificial Sequence
  chemically synthesized
aatttcatgtctacattatgga

SEQ ID NO: 1382324 - DNA, 22 bp, Artificial Sequence
  chemically synthesized
catgtctacattatggaaactc

SEQ ID NO: 1382325 - DNA, 22 bp, Artificial Sequence
  chemically synthesized
atgtctacattatggaaactca

SEQ ID NO: 1382326 - DNA, 22 bp, Artificial Sequence
  chemically synthesized
tgtgaccataaacctctgagtt

SEQ ID NO: 1382327 - DNA, 22 bp, Artificial Sequence
  chemically synthesized
atgtgaccataaacctctgagt

SEQ ID NO: 1382328 - DNA, 22 bp, Artificial Sequence
  chemically synthesized
cattatggaaactcagaggttt

SEQ ID NO: 1382329 - DNA, 22 bp, Artificial Sequence
  chemically synthesized
ttatgtgaccataaacctctga

SEQ ID NO: 1382330 - DNA, 22 bp, Artificial Sequence
  chemically synthesized
actcttatgtgaccataaacct

SEQ ID NO: 1382331 - DNA, 22 bp, Artificial Sequence
  chemically synthesized
tggaaactcagaggtttatggt

SEQ ID NO: 1382332 - DNA, 22 bp, Artificial Sequence
  chemically synthesized
cactcttatgtgaccataaacc

SEQ ID NO: 1382333 - DNA, 22 bp, Artificial Sequence
  chemically synthesized
tcactcttatgtgaccataaac

SEQ ID NO: 1382334 - DNA, 22 bp, Artificial Sequence
  chemically synthesized
ccctttcactcttatgtgacca

SEQ ID NO: 1382335 - DNA, 22 bp, Artificial Sequence
  chemically synthesized
agaggtttatggtcacataaga

SEQ ID NO: 1382336 - DNA, 22 bp, Artificial Sequence
  chemically synthesized
attgccctttcactcttatgtg

SEQ ID NO: 1382337 - DNA, 22 bp, Artificial Sequence
  chemically synthesized
gattgccctttcactcttatgt

SEQ ID NO: 1382338 - DNA, 22 bp, Artificial Sequence
  chemically synthesized
cttgattgccctttcactctta

SEQ ID NO: 1382339 - DNA, 22 bp, Artificial Sequence
  chemically synthesized
atggtcacataagagtgaaagg

SEQ ID NO: 1382340 - DNA, 22 bp, Artificial Sequence
  chemically synthesized
ctccttgattgccctttcactc

SEQ ID NO: 1382341 - DNA, 22 bp, Artificial Sequence
  chemically synthesized
tggtcacataagagtgaaaggg

SEQ ID NO: 1382342 - DNA, 22 bp, Artificial Sequence
  chemically synthesized
actccttgattgccctttcact

SEQ ID NO: 1382343 - DNA, 22 bp, Artificial Sequence
  chemically synthesized
cttactccttgattgccctttc

SEQ ID NO: 1382344 - DNA, 22 bp, Artificial Sequence
  chemically synthesized
ccttactccttgattgcccttt

SEQ ID NO: 1382345 - DNA, 22 bp, Artificial Sequence
  chemically synthesized
tccttactccttgattgccctt

SEQ ID NO: 1382346 - DNA, 22 bp, Artificial Sequence
  chemically synthesized
ttccttactccttgattgccct

SEQ ID NO: 1382347 - DNA, 22 bp, Artificial Sequence
  chemically synthesized
cataatttttccttactccttg

SEQ ID NO: 1382348 - DNA, 22 bp, Artificial Sequence
  chemically synthesized
tgcataatttttccttactcct

SEQ ID NO: 1382349 - DNA, 22 bp, Artificial Sequence
  chemically synthesized
ctgcataatttttccttactcc

SEQ ID NO: 1382350 - DNA, 22 bp, Artificial Sequence
  chemically synthesized
tctgcataatttttccttactc

SEQ ID NO: 1382351 - DNA, 22 bp, Artificial Sequence
  chemically synthesized
ctttctgcataatttttcctta

SEQ ID NO: 1382352 - DNA, 22 bp, Artificial Sequence
  chemically synthesized
tcctttctgcataatttttcct

SEQ ID NO: 1382353 - DNA, 22 bp, Artificial Sequence
  chemically synthesized
ctcctttctgcataatttttcc

SEQ ID NO: 1382354 - DNA, 22 bp, Artificial Sequence
  chemically synthesized
tctcctttctgcataatttttc

SEQ ID NO: 1382355 - DNA, 22 bp, Artificial Sequence
  chemically synthesized
ttctcctttctgcataattttt

SEQ ID NO: 1382356 - DNA, 22 bp, Artificial Sequence
  chemically synthesized
cttttctcctttctgcataatt

SEQ ID NO: 1382357 - DNA, 22 bp, Artificial Sequence
  chemically synthesized
accaagcatcattgcttttctc

SEQ ID NO: 1382358 - DNA, 22 bp, Artificial Sequence
  chemically synthesized
tcaccaagcatcattgcttttc

SEQ ID NO: 1382359 - DNA, 22 bp, Artificial Sequence
  chemically synthesized
tgcagaaaggagaaaagcaatg

SEQ ID NO: 1382360 - DNA, 22 bp, Artificial Sequence
  chemically synthesized
ttctcaccaagcatcattgctt

SEQ ID NO: 1382361 - DNA, 22 bp, Artificial Sequence
  chemically synthesized
gtatgattgttctcaccaagca

SEQ ID NO: 1382362 - DNA, 22 bp, Artificial Sequence
  chemically synthesized
agtatgattgttctcaccaagc

SEQ ID NO: 1382363 - DNA, 22 bp, Artificial Sequence
  chemically synthesized
acacttagtatgattgttctca

SEQ ID NO: 1382364 - DNA, 22 bp, Artificial Sequence
  chemically synthesized
tcacacttagtatgattgttct

SEQ ID NO: 1382365 - DNA, 22 bp, Artificial Sequence
  chemically synthesized
ttctcacacttagtatgattgt

SEQ ID NO: 1382366 - DNA, 22 bp, Artificial Sequence
  chemically synthesized
gttctcacacttagtatgattg

SEQ ID NO: 1382367 - DNA, 22 bp, Artificial Sequence
  chemically synthesized
tgttctcacacttagtatgatt

SEQ ID NO: 1382368 - DNA, 22 bp, Artificial Sequence
  chemically synthesized
ggtgagaacaatcatactaagt

SEQ ID NO: 1382369 - DNA, 22 bp, Artificial Sequence
  chemically synthesized
gtgagaacaatcatactaagtg

SEQ ID NO: 1382370 - DNA, 22 bp, Artificial Sequence
  chemically synthesized
ggtacatcatctttgttctcac

SEQ ID NO: 1382371 - DNA, 22 bp, Artificial Sequence
  chemically synthesized
aactaggtacatcatctttgtt

SEQ ID NO: 1382372 - DNA, 22 bp, Artificial Sequence
  chemically synthesized
agtgtgagaacaaagatgatgt

SEQ ID NO: 1382373 - DNA, 22 bp, Artificial Sequence
  chemically synthesized
gaaaatctgaactaggtacatc

SEQ ID NO: 1382374 - DNA, 22 bp, Artificial Sequence
  chemically synthesized
aagtgactagaaaatctgaact

SEQ ID NO: 1382375 - DNA, 22 bp, Artificial Sequence
  chemically synthesized
caagtgactagaaaatctgaac

SEQ ID NO: 1382376 - DNA, 22 bp, Artificial Sequence
  chemically synthesized
gttcagattttctagtcacttg

SEQ ID NO: 1382377 - DNA, 22 bp, Artificial Sequence
  chemically synthesized
agattttctagtcacttgaaat

SEQ ID NO: 1382378 - DNA, 22 bp, Artificial Sequence
  chemically synthesized
gaggtcagtaatatttcaagtg

SEQ ID NO: 1382379 - DNA, 22 bp, Artificial Sequence
  chemically synthesized
agaggtcagtaatatttcaagt

SEQ ID NO: 1382380 - DNA, 22 bp, Artificial Sequence
  chemically synthesized
tagaggtcagtaatatttcaag

SEQ ID NO: 1382381 - DNA, 22 bp, Artificial Sequence
  chemically synthesized
tctagtcacttgaaatattact

SEQ ID NO: 1382382 - DNA, 22 bp, Artificial Sequence
  chemically synthesized
ctagtcacttgaaatattactg

SEQ ID NO: 1382383 - DNA, 22 bp, Artificial Sequence
  chemically synthesized
agttttagaggtcagtaatatt

SEQ ID NO: 1382384 - DNA, 22 bp, Artificial Sequence
  chemically synthesized
tagtcacttgaaatattactga

SEQ ID NO: 1382385 - DNA, 22 bp, Artificial Sequence
  chemically synthesized
gtcacttgaaatattactgacc

SEQ ID NO: 1382386 - DNA, 22 bp, Artificial Sequence
  chemically synthesized
gaaatattactgacctctaaaa

SEQ ID NO: 1382387 - DNA, 22 bp, Artificial Sequence
  chemically synthesized
aaatattactgacctctaaaac

SEQ ID NO: 1382388 - DNA, 22 bp, Artificial Sequence
  chemically synthesized
aagtccccctaagttttagagg

SEQ ID NO: 1382389 - DNA, 22 bp, Artificial Sequence
  chemically synthesized
agcctaaagtccccctaagttt

SEQ ID NO: 1382390 - DNA, 22 bp, Artificial Sequence
  chemically synthesized
ctgacctctaaaacttaggggg

SEQ ID NO: 1382391 - DNA, 22 bp, Artificial Sequence
  chemically synthesized
acctctaaaacttagggggact

SEQ ID NO: 1382392 - DNA, 22 bp, Artificial Sequence
  chemically synthesized
gactcagcctaaagtcccccta

SEQ ID NO: 1382393 - DNA, 22 bp, Artificial Sequence
  chemically synthesized
ctggactcagcctaaagtcccc

SEQ ID NO: 1382394 - DNA, 22 bp, Artificial Sequence
  chemically synthesized
taaaacttagggggactttagg

SEQ ID NO: 1382395 - DNA, 22 bp, Artificial Sequence
  chemically synthesized
aaacttagggggactttaggct

SEQ ID NO: 1382396 - DNA, 22 bp, Artificial Sequence
  chemically synthesized
agggggactttaggctgagtcc

SEQ ID NO: 1382397 - DNA, 22 bp, Artificial Sequence
  chemically synthesized
gggggactttaggctgagtcca

SEQ ID NO: 1382398 - DNA, 22 bp, Artificial Sequence
  chemically synthesized
gggaaaaaaaaattcctggact

SEQ ID NO: 1382399 - DNA, 22 bp, Artificial Sequence
  chemically synthesized
agggaaaaaaaaattcctggac

SEQ ID NO: 1382400 - DNA, 22 bp, Artificial Sequence
  chemically synthesized
tagggaaaaaaaaattcctgga

SEQ ID NO: 1382401 - DNA, 22 bp, Artificial Sequence
  chemically synthesized
tttagggaaaaaaaaattcctg

SEQ ID NO: 1382402 - DNA, 22 bp, Artificial Sequence
  chemically synthesized
taggctgagtccaggaattttt

SEQ ID NO: 1382403 - DNA, 22 bp, Artificial Sequence
  chemically synthesized
aggctgagtccaggaatttttt

SEQ ID NO: 1382404 - DNA, 22 bp, Artificial Sequence
  chemically synthesized
ggctgagtccaggaattttttt

SEQ ID NO: 1382405 - DNA, 22 bp, Artificial Sequence
  chemically synthesized
cagttctttagggaaaaaaaaa

SEQ ID NO: 1382406 - DNA, 22 bp, Artificial Sequence
  chemically synthesized
agtccaggaatttttttttccc

SEQ ID NO: 1382407 - DNA, 22 bp, Artificial Sequence
  chemically synthesized
ccaagtctacagttctttaggg

SEQ ID NO: 1382408 - DNA, 22 bp, Artificial Sequence
  chemically synthesized
gccaagtctacagttctttagg

SEQ ID NO: 1382409 - DNA, 22 bp, Artificial Sequence
  chemically synthesized
ttttttccctaaagaactgtag

SEQ ID NO: 1382410 - DNA, 22 bp, Artificial Sequence
  chemically synthesized
tttttccctaaagaactgtaga

SEQ ID NO: 1382411 - DNA, 22 bp, Artificial Sequence
  chemically synthesized
ttttccctaaagaactgtagac

SEQ ID NO: 1382412 - DNA, 22 bp, Artificial Sequence
  chemically synthesized
tttccctaaagaactgtagact

SEQ ID NO: 1382413 - DNA, 22 bp, Artificial Sequence
  chemically synthesized
ttccctaaagaactgtagactt

SEQ ID NO: 1382414 - DNA, 22 bp, Artificial Sequence
  chemically synthesized
tccctaaagaactgtagacttg

SEQ ID NO: 1382415 - DNA, 22 bp, Artificial Sequence
  chemically synthesized
ccctaaagaactgtagacttgg

SEQ ID NO: 1382416 - DNA, 22 bp, Artificial Sequence
  chemically synthesized
aatatagacttgccaagtctac

SEQ ID NO: 1382417 - DNA, 22 bp, Artificial Sequence
  chemically synthesized
cctaaagaactgtagacttggc

SEQ ID NO: 1382418 - DNA, 22 bp, Artificial Sequence
  chemically synthesized
aagaactgtagacttggcaagt

SEQ ID NO: 1382419 - DNA, 22 bp, Artificial Sequence
  chemically synthesized
tagacttggcaagtctatattt

SEQ ID NO: 1382420 - DNA, 22 bp, Artificial Sequence
  chemically synthesized
ggcaagtctatatttagtgtac

SEQ ID NO: 1382421 - DNA, 22 bp, Artificial Sequence
  chemically synthesized
gcaagtctatatttagtgtact

SEQ ID NO: 1382422 - DNA, 22 bp, Artificial Sequence
  chemically synthesized
agaaaaacagtgagtacactaa

SEQ ID NO: 1382423 - DNA, 22 bp, Artificial Sequence
  chemically synthesized
tatttagtgtactcactgtttt

SEQ ID NO: 1382424 - DNA, 22 bp, Artificial Sequence
  chemically synthesized
ggcaaaattcagaaaaacagtg

SEQ ID NO: 1382425 - DNA, 22 bp, Artificial Sequence
  chemically synthesized
agtgtactcactgtttttctga

SEQ ID NO: 1382426 - DNA, 22 bp, Artificial Sequence
  chemically synthesized
gtgtactcactgtttttctgaa

SEQ ID NO: 1382427 - DNA, 22 bp, Artificial Sequence
  chemically synthesized
actgtttttctgaattttgcct

SEQ ID NO: 1382428 - DNA, 22 bp, Artificial Sequence
  chemically synthesized
tgacagtcaggatctaggcaaa

SEQ ID NO: 1382429 - DNA, 22 bp, Artificial Sequence
  chemically synthesized
tttttctgaattttgcctagat

SEQ ID NO: 1382430 - DNA, 22 bp, Artificial Sequence
  chemically synthesized
ttctgaattttgcctagatcct

SEQ ID NO: 1382431 - DNA, 22 bp, Artificial Sequence
  chemically synthesized
tctgaattttgcctagatcctg

SEQ ID NO: 1382432 - DNA, 22 bp, Artificial Sequence
  chemically synthesized
ctgaattttgcctagatcctga

SEQ ID NO: 1382433 - DNA, 22 bp, Artificial Sequence
  chemically synthesized
tacctgtgacagtcaggatcta

SEQ ID NO: 1382434 - DNA, 22 bp, Artificial Sequence
  chemically synthesized
tgaattttgcctagatcctgac

SEQ ID NO: 1382435 - DNA, 22 bp, Artificial Sequence
  chemically synthesized
aattttgcctagatcctgactg

SEQ ID NO: 1382436 - DNA, 22 bp, Artificial Sequence
  chemically synthesized
atctgtacctgtgacagtcagg

SEQ ID NO: 1382437 - DNA, 22 bp, Artificial Sequence
  chemically synthesized
tgcctagatcctgactgtcaca

SEQ ID NO: 1382438 - DNA, 22 bp, Artificial Sequence
  chemically synthesized
gcctagatcctgactgtcacag

SEQ ID NO: 1382439 - DNA, 22 bp, Artificial Sequence
  chemically synthesized
cctagatcctgactgtcacagg

SEQ ID NO: 1382440 - DNA, 22 bp, Artificial Sequence
  chemically synthesized
aattcatctgtacctgtgacag

SEQ ID NO: 1382441 - DNA, 22 bp, Artificial Sequence
  chemically synthesized
gatcctgactgtcacaggtaca

SEQ ID NO: 1382442 - DNA, 22 bp, Artificial Sequence
  chemically synthesized
actgtcacaggtacagatgaat

SEQ ID NO: 1382443 - DNA, 22 bp, Artificial Sequence
  chemically synthesized
cgggtgtgttgaattcatctgt

SEQ ID NO: 1382444 - DNA, 22 bp, Artificial Sequence
  chemically synthesized
tcacaggtacagatgaattcaa

SEQ ID NO: 1382445 - DNA, 22 bp, Artificial Sequence
  chemically synthesized
caacaagagccctccgggtgtg

SEQ ID NO: 1382446 - DNA, 22 bp, Artificial Sequence
  chemically synthesized
ccaacaagagccctccgggtgt

SEQ ID NO: 1382447 - DNA, 22 bp, Artificial Sequence
  chemically synthesized
aggtttccaacaagagccctcc

SEQ ID NO: 1382448 - DNA, 22 bp, Artificial Sequence
  chemically synthesized
caggtttccaacaagagccctc

SEQ ID NO: 1382449 - DNA, 22 bp, Artificial Sequence
  chemically synthesized
aacacacccggagggctcttgt

SEQ ID NO: 1382450 - DNA, 22 bp, Artificial Sequence
  chemically synthesized
ttcaggtttccaacaagagccc

SEQ ID NO: 1382451 - DNA, 22 bp, Artificial Sequence
  chemically synthesized
atggaaattcttcaggtttcca

SEQ ID NO: 1382452 - DNA, 22 bp, Artificial Sequence
  chemically synthesized
catggaaattcttcaggtttcc

SEQ ID NO: 1382453 - DNA, 22 bp, Artificial Sequence
  chemically synthesized
ttgttggaaacctgaagaattt

SEQ ID NO: 1382454 - DNA, 22 bp, Artificial Sequence
  chemically synthesized
gagatttcatggaaattcttca

SEQ ID NO: 1382455 - DNA, 22 bp, Artificial Sequence
  chemically synthesized
ggagatttcatggaaattcttc

SEQ ID NO: 1382456 - DNA, 22 bp, Artificial Sequence
  chemically synthesized
gttggaaacctgaagaatttcc

SEQ ID NO: 1382457 - DNA, 22 bp, Artificial Sequence
  chemically synthesized
tggagatttcatggaaattctt

SEQ ID NO: 1382458 - DNA, 22 bp, Artificial Sequence
  chemically synthesized
ttggaaacctgaagaatttcca

SEQ ID NO: 1382459 - DNA, 22 bp, Artificial Sequence
  chemically synthesized
ttggagatttcatggaaattct

SEQ ID NO: 1382460 - DNA, 22 bp, Artificial Sequence
  chemically synthesized
gaaacctgaagaatttccatga

SEQ ID NO: 1382461 - DNA, 22 bp, Artificial Sequence
  chemically synthesized
acttttggagatttcatggaaa

SEQ ID NO: 1382462 - DNA, 22 bp, Artificial Sequence
  chemically synthesized
gacttttggagatttcatggaa

SEQ ID NO: 1382463 - DNA, 22 bp, Artificial Sequence
  chemically synthesized
tgacttttggagatttcatgga

SEQ ID NO: 1382464 - DNA, 22 bp, Artificial Sequence
  chemically synthesized
ttgacttttggagatttcatgg

SEQ ID NO: 1382465 - DNA, 22 bp, Artificial Sequence
  chemically synthesized
aagaatttccatgaaatctcca

SEQ ID NO: 1382466 - DNA, 22 bp, Artificial Sequence
  chemically synthesized
ccatgaaatctccaaaagtcaa

SEQ ID NO: 1382467 - DNA, 22 bp, Artificial Sequence
  chemically synthesized
catgaaatctccaaaagtcaaa

SEQ ID NO: 1382468 - DNA, 22 bp, Artificial Sequence
  chemically synthesized
taataatggcatcttttgactt

SEQ ID NO: 1382469 - DNA, 22 bp, Artificial Sequence
  chemically synthesized
gagtgttgtaataatggcatct

SEQ ID NO: 1382470 - DNA, 22 bp, Artificial Sequence
  chemically synthesized
caaaagtcaaaagatgccatta

SEQ ID NO: 1382471 - DNA, 22 bp, Artificial Sequence
  chemically synthesized
tagagtgttgtaataatggcat

SEQ ID NO: 1382472 - DNA, 22 bp, Artificial Sequence
  chemically synthesized
ccaacctctagagtgttgtaat

SEQ ID NO: 1382473 - DNA, 22 bp, Artificial Sequence
  chemically synthesized
gccaacctctagagtgttgtaa

SEQ ID NO: 1382474 - DNA, 22 bp, Artificial Sequence
  chemically synthesized
ttacaacactctagaggttggc

SEQ ID NO: 1382475 - DNA, 22 bp, Artificial Sequence
  chemically synthesized
caacactctagaggttggcaaa

SEQ ID NO: 1382476 - DNA, 22 bp, Artificial Sequence
  chemically synthesized
tagaggttggcaaactaccttt

SEQ ID NO: 1382477 - DNA, 22 bp, Artificial Sequence
  chemically synthesized
gaggttggcaaactacctttta

SEQ ID NO: 1382478 - DNA, 22 bp, Artificial Sequence
  chemically synthesized
gcaaactaccttttatttattt

SEQ ID NO: 1382479 - DNA, 22 bp, Artificial Sequence
  chemically synthesized
tagcaaaaaaataaataaataa

SEQ ID NO: 1382480 - DNA, 22 bp, Artificial Sequence
  chemically synthesized
aattgtagcaaaaaaataaata

SEQ ID NO: 1382481 - DNA, 22 bp, Artificial Sequence
  chemically synthesized
caattgtagcaaaaaaataaat

SEQ ID NO: 1382482 - DNA, 22 bp, Artificial Sequence
  chemically synthesized
tcaattgtagcaaaaaaataaa

SEQ ID NO: 1382483 - DNA, 22 bp, Artificial Sequence
  chemically synthesized
ccttttatttatttattttttt

SEQ ID NO: 1382484 - DNA, 22 bp, Artificial Sequence
  chemically synthesized
ttttcaattgtagcaaaaaaat

SEQ ID NO: 1382485 - DNA, 22 bp, Artificial Sequence
  chemically synthesized
attttcaattgtagcaaaaaaa

SEQ ID NO: 1382486 - DNA, 22 bp, Artificial Sequence
  chemically synthesized
ttatttatttatttttttgcta

SEQ ID NO: 1382487 - DNA, 22 bp, Artificial Sequence
  chemically synthesized
tattttcaattgtagcaaaaaa

SEQ ID NO: 1382488 - DNA, 22 bp, Artificial Sequence
  chemically synthesized
tatttatttatttttttgctac

SEQ ID NO: 1382489 - DNA, 22 bp, Artificial Sequence
  chemically synthesized
atttatttatttttttgctaca

SEQ ID NO: 1382490 - DNA, 22 bp, Artificial Sequence
  chemically synthesized
tttatttatttttttgctacaa

SEQ ID NO: 1382491 - DNA, 22 bp, Artificial Sequence
  chemically synthesized
gttttattttcaattgtagcaa

SEQ ID NO: 1382492 - DNA, 22 bp, Artificial Sequence
  chemically synthesized
atttatttttttgctacaattg

SEQ ID NO: 1382493 - DNA, 22 bp, Artificial Sequence
  chemically synthesized
tttatttttttgctacaattga

SEQ ID NO: 1382494 - DNA, 22 bp, Artificial Sequence
  chemically synthesized
atttttttgctacaattgaaaa

SEQ ID NO: 1382495 - DNA, 22 bp, Artificial Sequence
  chemically synthesized
tttttttgctacaattgaaaat

SEQ ID NO: 1382496 - DNA, 22 bp, Artificial Sequence
  chemically synthesized
ttttgctacaattgaaaataaa

SEQ ID NO: 1382497 - DNA, 22 bp, Artificial Sequence
  chemically synthesized
tttgctacaattgaaaataaaa

SEQ ID NO: 1382498 - DNA, 22 bp, Artificial Sequence
  chemically synthesized
ttgctacaattgaaaataaaac

SEQ ID NO: 1382499 - DNA, 22 bp, Artificial Sequence
  chemically synthesized
tgctacaattgaaaataaaacc

SEQ ID NO: 1382500 - DNA, 22 bp, Artificial Sequence
  chemically synthesized
gctacaattgaaaataaaacca

SEQ ID NO: 1382501 - DNA, 22 bp, Artificial Sequence
  chemically synthesized
ctacaattgaaaataaaaccaa

SEQ ID NO: 1382502 - DNA, 22 bp, Artificial Sequence
  chemically synthesized
tggaacaatacatgttggtttt

SEQ ID NO: 1382503 - DNA, 22 bp, Artificial Sequence
  chemically synthesized
caattgaaaataaaaccaacat

SEQ ID NO: 1382504 - DNA, 22 bp, Artificial Sequence
  chemically synthesized
aaaataaaaccaacatgtattg

SEQ ID NO: 1382505 - DNA, 22 bp, Artificial Sequence
  chemically synthesized
caaggggcctatggaacaatac

SEQ ID NO: 1382506 - DNA, 22 bp, Artificial Sequence
  chemically synthesized
acaaggggcctatggaacaata

SEQ ID NO: 1382507 - DNA, 22 bp, Artificial Sequence
  chemically synthesized
tacaaataaatttacaaggggc

SEQ ID NO: 1382508 - DNA, 22 bp, Artificial Sequence
  chemically synthesized
atacaaataaatttacaagggg

SEQ ID NO: 1382509 - DNA, 22 bp, Artificial Sequence
  chemically synthesized
ttccataggccccttgtaaatt

SEQ ID NO: 1382510 - DNA, 22 bp, Artificial Sequence
  chemically synthesized
cataggccccttgtaaatttat

SEQ ID NO: 1382511 - DNA, 22 bp, Artificial Sequence
  chemically synthesized
agcagtttatacaaataaattt

SEQ ID NO: 1382512 - DNA, 22 bp, Artificial Sequence
  chemically synthesized
tcagcagtttatacaaataaat

SEQ ID NO: 1382513 - DNA, 22 bp, Artificial Sequence
  chemically synthesized
gtaaatttatttgtataaactg

SEQ ID NO: 1382514 - DNA, 22 bp, Artificial Sequence
  chemically synthesized
taaatttatttgtataaactgc

SEQ ID NO: 1382515 - DNA, 22 bp, Artificial Sequence
  chemically synthesized
acgtaaattctcagcagtttat

SEQ ID NO: 1382516 - DNA, 22 bp, Artificial Sequence
  chemically synthesized
atttgtataaactgctgagaat

SEQ ID NO: 1382517 - DNA, 22 bp, Artificial Sequence
  chemically synthesized
tttgtataaactgctgagaatt

SEQ ID NO: 1382518 - DNA, 22 bp, Artificial Sequence
  chemically synthesized
gtataaactgctgagaatttac

SEQ ID NO: 1382519 - DNA, 22 bp, Artificial Sequence
  chemically synthesized
tataaactgctgagaatttacg

SEQ ID NO: 1382520 - DNA, 22 bp, Artificial Sequence
  chemically synthesized
ctgagaatttacgttaatgtct

SEQ ID NO: 1382521 - DNA, 22 bp, Artificial Sequence
  chemically synthesized
agaatttacgttaatgtctttt

SEQ ID NO: 1382522 - DNA, 22 bp, Artificial Sequence
  chemically synthesized
acgttaatgtcttttacttctt

SEQ ID NO: 1382523 - DNA, 22 bp, Artificial Sequence
  chemically synthesized
aaatgcaaaaagaagaagtaaa

SEQ ID NO: 1382524 - DNA, 22 bp, Artificial Sequence
  chemically synthesized
cgttaatgtcttttacttcttc

SEQ ID NO: 1382525 - DNA, 22 bp, Artificial Sequence
  chemically synthesized
aattgaaatgcaaaaagaagaa

SEQ ID NO: 1382526 - DNA, 22 bp, Artificial Sequence
  chemically synthesized
atgtcttttacttcttcttttt

SEQ ID NO: 1382527 - DNA, 22 bp, Artificial Sequence
  chemically synthesized
caattgaaatgcaaaaagaaga

SEQ ID NO: 1382528 - DNA, 22 bp, Artificial Sequence
  chemically synthesized
ggatttcaattgaaatgcaaaa

SEQ ID NO: 1382529 - DNA, 22 bp, Artificial Sequence
  chemically synthesized
ttacttcttctttttgcatttc

SEQ ID NO: 1382530 - DNA, 22 bp, Artificial Sequence
  chemically synthesized
tacttcttctttttgcatttca

SEQ ID NO: 1382531 - DNA, 22 bp, Artificial Sequence
  chemically synthesized
acttcttctttttgcatttcaa

SEQ ID NO: 1382532 - DNA, 22 bp, Artificial Sequence
  chemically synthesized
ctaggatttcaattgaaatgca

SEQ ID NO: 1382533 - DNA, 22 bp, Artificial Sequence
  chemically synthesized
cttcttctttttgcatttcaat

SEQ ID NO: 1382534 - DNA, 22 bp, Artificial Sequence
  chemically synthesized
cctaggatttcaattgaaatgc

SEQ ID NO: 1382535 - DNA, 22 bp, Artificial Sequence
  chemically synthesized
cttctttttgcatttcaattga

SEQ ID NO: 1382536 - DNA, 22 bp, Artificial Sequence
  chemically synthesized
ttctttttgcatttcaattgaa

SEQ ID NO: 1382537 - DNA, 22 bp, Artificial Sequence
  chemically synthesized
ctttttgcatttcaattgaaat

SEQ ID NO: 1382538 - DNA, 22 bp, Artificial Sequence
  chemically synthesized
tttttgcatttcaattgaaatc

SEQ ID NO: 1382539 - DNA, 22 bp, Artificial Sequence
  chemically synthesized
tttgcatttcaattgaaatcct

SEQ ID NO: 1382540 - DNA, 22 bp, Artificial Sequence
  chemically synthesized
ccaaagtttcctaggatttcaa

SEQ ID NO: 1382541 - DNA, 22 bp, Artificial Sequence
  chemically synthesized
ttgcatttcaattgaaatccta

SEQ ID NO: 1382542 - DNA, 22 bp, Artificial Sequence
  chemically synthesized
tgcatttcaattgaaatcctag

SEQ ID NO: 1382543 - DNA, 22 bp, Artificial Sequence
  chemically synthesized
gcatttcaattgaaatcctagg

SEQ ID NO: 1382544 - DNA, 22 bp, Artificial Sequence
  chemically synthesized
ttgccaaagtttcctaggattt

SEQ ID NO: 1382545 - DNA, 22 bp, Artificial Sequence
  chemically synthesized
catttcaattgaaatcctagga

SEQ ID NO: 1382546 - DNA, 22 bp, Artificial Sequence
  chemically synthesized
attgccaaagtttcctaggatt

SEQ ID NO: 1382547 - DNA, 22 bp, Artificial Sequence
  chemically synthesized
tattgccaaagtttcctaggat

SEQ ID NO: 1382548 - DNA, 22 bp, Artificial Sequence
  chemically synthesized
ttattgccaaagtttcctagga

SEQ ID NO: 1382549 - DNA, 22 bp, Artificial Sequence
  chemically synthesized
caattgaaatcctaggaaactt

SEQ ID NO: 1382550 - DNA, 22 bp, Artificial Sequence
  chemically synthesized
aattgaaatcctaggaaacttt

SEQ ID NO: 1382551 - DNA, 22 bp, Artificial Sequence
  chemically synthesized
gatcttttattgccaaagtttc

SEQ ID NO: 1382552 - DNA, 22 bp, Artificial Sequence
  chemically synthesized
aaatcctaggaaactttggcaa

SEQ ID NO: 1382553 - DNA, 22 bp, Artificial Sequence
  chemically synthesized
ttggatcttttattgccaaagt

SEQ ID NO: 1382554 - DNA, 22 bp, Artificial Sequence
  chemically synthesized
attggatcttttattgccaaag

SEQ ID NO: 1382555 - DNA, 22 bp, Artificial Sequence
  chemically synthesized
ggaaactttggcaataaaagat

SEQ ID NO: 1382556 - DNA, 22 bp, Artificial Sequence
  chemically synthesized
tcaataacttattggatctttt

SEQ ID NO: 1382557 - DNA, 22 bp, Artificial Sequence
  chemically synthesized
tggcaataaaagatccaataag

SEQ ID NO: 1382558 - DNA, 22 bp, Artificial Sequence
  chemically synthesized
aattatcaataacttattggat

SEQ ID NO: 1382559 - DNA, 22 bp, Artificial Sequence
  chemically synthesized
ggcaataaaagatccaataagt

SEQ ID NO: 1382560 - DNA, 22 bp, Artificial Sequence
  chemically synthesized
aaattatcaataacttattgga

SEQ ID NO: 1382561 - DNA, 22 bp, Artificial Sequence
  chemically synthesized
gcaataaaagatccaataagtt

SEQ ID NO: 1382562 - DNA, 22 bp, Artificial Sequence
  chemically synthesized
taaattatcaataacttattgg

SEQ ID NO: 1382563 - DNA, 22 bp, Artificial Sequence
  chemically synthesized
ttaaattatcaataacttattg

SEQ ID NO: 1382564 - DNA, 22 bp, Artificial Sequence
  chemically synthesized
tttaaattatcaataacttatt

SEQ ID NO: 1382565 - DNA, 22 bp, Artificial Sequence
  chemically synthesized
tggaatcattttttaaattatc

SEQ ID NO: 1382566 - DNA, 22 bp, Artificial Sequence
  chemically synthesized
atgctatggaatcattttttaa

SEQ ID NO: 1382567 - DNA, 22 bp, Artificial Sequence
  chemically synthesized
ttgatgctatggaatcattttt

SEQ ID NO: 1382568 - DNA, 22 bp, Artificial Sequence
  chemically synthesized
ttgataatttaaaaaatgattc

SEQ ID NO: 1382569 - DNA, 22 bp, Artificial Sequence
  chemically synthesized
gttgatgctatggaatcatttt

SEQ ID NO: 1382570 - DNA, 22 bp, Artificial Sequence
  chemically synthesized
ataatttaaaaaatgattccat

SEQ ID NO: 1382571 - DNA, 22 bp, Artificial Sequence
  chemically synthesized
atatagtttgttgatgctatgg

SEQ ID NO: 1382572 - DNA, 22 bp, Artificial Sequence
  chemically synthesized
aaaaaatgattccatagcatca

SEQ ID NO: 1382573 - DNA, 22 bp, Artificial Sequence
  chemically synthesized
aatatagtttgttgatgctatg

SEQ ID NO: 1382574 - DNA, 22 bp, Artificial Sequence
  chemically synthesized
aaaaatgattccatagcatcaa

SEQ ID NO: 1382575 - DNA, 22 bp, Artificial Sequence
  chemically synthesized
gaatttaatatagtttgttgat

SEQ ID NO: 1382576 - DNA, 22 bp, Artificial Sequence
  chemically synthesized
catagcatcaacaaactatatt

SEQ ID NO: 1382577 - DNA, 22 bp, Artificial Sequence
  chemically synthesized
aatcatagaatgggatattgga

SEQ ID NO: 1382578 - DNA, 22 bp, Artificial Sequence
  chemically synthesized
tattaaattccaatatcccatt

SEQ ID NO: 1382579 - DNA, 22 bp, Artificial Sequence
  chemically synthesized
aattccaatatcccattctatg

SEQ ID NO: 1382580 - DNA, 22 bp, Artificial Sequence
  chemically synthesized
caatatcccattctatgattca

SEQ ID NO: 1382581 - DNA, 22 bp, Artificial Sequence
  chemically synthesized
catgggccaagactgaatcata

SEQ ID NO: 1382582 - DNA, 22 bp, Artificial Sequence
  chemically synthesized
acatgggccaagactgaatcat

SEQ ID NO: 1382583 - DNA, 22 bp, Artificial Sequence
  chemically synthesized
tcacagatttacatgggccaag

SEQ ID NO: 1382584 - DNA, 22 bp, Artificial Sequence
  chemically synthesized
tatgattcagtcttggcccatg

SEQ ID NO: 1382585 - DNA, 22 bp, Artificial Sequence
  chemically synthesized
tatcacagatttacatgggcca

SEQ ID NO: 1382586 - DNA, 22 bp, Artificial Sequence
  chemically synthesized
tgattcagtcttggcccatgta

SEQ ID NO: 1382587 - DNA, 22 bp, Artificial Sequence
  chemically synthesized
ctatcacagatttacatgggcc

SEQ ID NO: 1382588 - DNA, 22 bp, Artificial Sequence
  chemically synthesized
tctatcacagatttacatgggc

SEQ ID NO: 1382589 - DNA, 22 bp, Artificial Sequence
  chemically synthesized
ttttctatcacagatttacatg

SEQ ID NO: 1382590 - DNA, 22 bp, Artificial Sequence
  chemically synthesized
attttctatcacagatttacat

SEQ ID NO: 1382591 - DNA, 22 bp, Artificial Sequence
  chemically synthesized
agtcttggcccatgtaaatctg

SEQ ID NO: 1382592 - DNA, 22 bp, Artificial Sequence
  chemically synthesized
agcttattttctatcacagatt

SEQ ID NO: 1382593 - DNA, 22 bp, Artificial Sequence
  chemically synthesized
cagcttattttctatcacagat

SEQ ID NO: 1382594 - DNA, 22 bp, Artificial Sequence
  chemically synthesized
ggcccatgtaaatctgtgatag

SEQ ID NO: 1382595 - DNA, 22 bp, Artificial Sequence
  chemically synthesized
tcagcttattttctatcacaga

SEQ ID NO: 1382596 - DNA, 22 bp, Artificial Sequence
  chemically synthesized
gcccatgtaaatctgtgataga

SEQ ID NO: 1382597 - DNA, 22 bp, Artificial Sequence
  chemically synthesized
gtattttcagcttattttctat

SEQ ID NO: 1382598 - DNA, 22 bp, Artificial Sequence
  chemically synthesized
cccatattggtattttcagctt

SEQ ID NO: 1382599 - DNA, 22 bp, Artificial Sequence
  chemically synthesized
tgatagaaaataagctgaaaat

SEQ ID NO: 1382600 - DNA, 22 bp, Artificial Sequence
  chemically synthesized
tgcccatattggtattttcagc

SEQ ID NO: 1382601 - DNA, 22 bp, Artificial Sequence
  chemically synthesized
ttctgcccatattggtattttc

SEQ ID NO: 1382602 - DNA, 22 bp, Artificial Sequence
  chemically synthesized
gttctgcccatattggtatttt

SEQ ID NO: 1382603 - DNA, 22 bp, Artificial Sequence
  chemically synthesized
tgttctgcccatattggtattt

SEQ ID NO: 1382604 - DNA, 22 bp, Artificial Sequence
  chemically synthesized
cgtattttgttctgcccatatt

SEQ ID NO: 1382605 - DNA, 22 bp, Artificial Sequence
  chemically synthesized
acgtattttgttctgcccatat

SEQ ID NO: 1382606 - DNA, 22 bp, Artificial Sequence
  chemically synthesized
tacgtattttgttctgcccata

SEQ ID NO: 1382607 - DNA, 22 bp, Artificial Sequence
  chemically synthesized
aaaataccaatatgggcagaac

SEQ ID NO: 1382608 - DNA, 22 bp, Artificial Sequence
  chemically synthesized
tctttacgtattttgttctgcc

SEQ ID NO: 1382609 - DNA, 22 bp, Artificial Sequence
  chemically synthesized
atctttacgtattttgttctgc

SEQ ID NO: 1382610 - DNA, 22 bp, Artificial Sequence
  chemically synthesized
agagatttatctttacgtattt

SEQ ID NO: 1382611 - DNA, 22 bp, Artificial Sequence
  chemically synthesized
gaacgtatgatataaaaattga

SEQ ID NO: 1382612 - DNA, 22 bp, Artificial Sequence
  chemically synthesized
aatatcctggaacgtatgatat

SEQ ID NO: 1382613 - DNA, 22 bp, Artificial Sequence
  chemically synthesized
tcaatttttatatcatacgttc

SEQ ID NO: 1382614 - DNA, 22 bp, Artificial Sequence
  chemically synthesized
attaaatatcctggaacgtatg

SEQ ID NO: 1382615 - DNA, 22 bp, Artificial Sequence
  chemically synthesized
aatttttatatcatacgttcca

SEQ ID NO: 1382616 - DNA, 22 bp, Artificial Sequence
  chemically synthesized
cattaaatatcctggaacgtat

SEQ ID NO: 1382617 - DNA, 22 bp, Artificial Sequence
  chemically synthesized
tcattaaatatcctggaacgta

SEQ ID NO: 1382618 - DNA, 22 bp, Artificial Sequence
  chemically synthesized
ttcattaaatatcctggaacgt

SEQ ID NO: 1382619 - DNA, 22 bp, Artificial Sequence
  chemically synthesized
ttatatcatacgttccaggata

SEQ ID NO: 1382620 - DNA, 22 bp, Artificial Sequence
  chemically synthesized
tatatcatacgttccaggatat

SEQ ID NO: 1382621 - DNA, 22 bp, Artificial Sequence
  chemically synthesized
atatcatacgttccaggatatt

SEQ ID NO: 1382622 - DNA, 22 bp, Artificial Sequence
  chemically synthesized
tatcatacgttccaggatattt

SEQ ID NO: 1382623 - DNA, 22 bp, Artificial Sequence
  chemically synthesized
aaagtgtttttcattaaatatc

SEQ ID NO: 1382624 - DNA, 22 bp, Artificial Sequence
  chemically synthesized
ggactcaaagtgtttttcatta

SEQ ID NO: 1382625 - DNA, 22 bp, Artificial Sequence
  chemically synthesized
aggactcaaagtgtttttcatt

SEQ ID NO: 1382626 - DNA, 22 bp, Artificial Sequence
  chemically synthesized
caggatatttaatgaaaaacac

SEQ ID NO: 1382627 - DNA, 22 bp, Artificial Sequence
  chemically synthesized
ttaggactcaaagtgtttttca

SEQ ID NO: 1382628 - DNA, 22 bp, Artificial Sequence
  chemically synthesized
aatgaaaaacactttgagtcct

SEQ ID NO: 1382629 - DNA, 22 bp, Artificial Sequence
  chemically synthesized
atatggactcttaggactcaaa

SEQ ID NO: 1382630 - DNA, 22 bp, Artificial Sequence
  chemically synthesized
atgaaaaacactttgagtccta

SEQ ID NO: 1382631 - DNA, 22 bp, Artificial Sequence
  chemically synthesized
ttaatatggactcttaggactc

SEQ ID NO: 1382632 - DNA, 22 bp, Artificial Sequence
  chemically synthesized
tattaatatggactcttaggac

SEQ ID NO: 1382633 - DNA, 22 bp, Artificial Sequence
  chemically synthesized
tgagtcctaagagtccatatta

SEQ ID NO: 1382634 - DNA, 22 bp, Artificial Sequence
  chemically synthesized
gagtcctaagagtccatattaa

SEQ ID NO: 1382635 - DNA, 22 bp, Artificial Sequence
  chemically synthesized
agtcctaagagtccatattaat

SEQ ID NO: 1382636 - DNA, 22 bp, Artificial Sequence
  chemically synthesized
acgtggaattctattaatatgg

SEQ ID NO: 1382637 - DNA, 22 bp, Artificial Sequence
  chemically synthesized
aacgtggaattctattaatatg

SEQ ID NO: 1382638 - DNA, 22 bp, Artificial Sequence
  chemically synthesized
taacgtggaattctattaatat

SEQ ID NO: 1382639 - DNA, 22 bp, Artificial Sequence
  chemically synthesized
agagtccatattaatagaattc

SEQ ID NO: 1382640 - DNA, 22 bp, Artificial Sequence
  chemically synthesized
aggagttttaacgtggaattct

SEQ ID NO: 1382641 - DNA, 22 bp, Artificial Sequence
  chemically synthesized
agttcaggagttttaacgtgga

SEQ ID NO: 1382642 - DNA, 22 bp, Artificial Sequence
  chemically synthesized
atagaattccacgttaaaactc

SEQ ID NO: 1382643 - DNA, 22 bp, Artificial Sequence
  chemically synthesized
tattaagttcaggagttttaac

SEQ ID NO: 1382644 - DNA, 22 bp, Artificial Sequence
  chemically synthesized
atattaagttcaggagttttaa

SEQ ID NO: 1382645 - DNA, 22 bp, Artificial Sequence
  chemically synthesized
cacgttaaaactcctgaactta

SEQ ID NO: 1382646 - DNA, 22 bp, Artificial Sequence
  chemically synthesized
ataaagcttatattaagttcag

SEQ ID NO: 1382647 - DNA, 22 bp, Artificial Sequence
  chemically synthesized
ctgataaagcttatattaagtt

SEQ ID NO: 1382648 - DNA, 22 bp, Artificial Sequence
  chemically synthesized
aaactcctgaacttaatataag

SEQ ID NO: 1382649 - DNA, 22 bp, Artificial Sequence
  chemically synthesized
tgttgctgataaagcttatatt

SEQ ID NO: 1382650 - DNA, 22 bp, Artificial Sequence
  chemically synthesized
ctgaacttaatataagctttat

SEQ ID NO: 1382651 - DNA, 22 bp, Artificial Sequence
  chemically synthesized
aacttaatataagctttatcag

SEQ ID NO: 1382652 - DNA, 22 bp, Artificial Sequence
  chemically synthesized
aaagctatgttgctgataaagc

SEQ ID NO: 1382653 - DNA, 22 bp, Artificial Sequence
  chemically synthesized
actgaaagctatgttgctgata

SEQ ID NO: 1382654 - DNA, 22 bp, Artificial Sequence
  chemically synthesized
aatataagctttatcagcaaca

SEQ ID NO: 1382655 - DNA, 22 bp, Artificial Sequence
  chemically synthesized
atataagctttatcagcaacat

SEQ ID NO: 1382656 - DNA, 22 bp, Artificial Sequence
  chemically synthesized
tgttaactgaaagctatgttgc

SEQ ID NO: 1382657 - DNA, 22 bp, Artificial Sequence
  chemically synthesized
atgttaactgaaagctatgttg

SEQ ID NO: 1382658 - DNA, 22 bp, Artificial Sequence
  chemically synthesized
tatgttaactgaaagctatgtt

SEQ ID NO: 1382659 - DNA, 22 bp, Artificial Sequence
  chemically synthesized
ttttatgttaactgaaagctat

SEQ ID NO: 1382660 - DNA, 22 bp, Artificial Sequence
  chemically synthesized
attttatgttaactgaaagcta

SEQ ID NO: 1382661 - DNA, 22 bp, Artificial Sequence
  chemically synthesized
tatcagcaacatagctttcagt

SEQ ID NO: 1382662 - DNA, 22 bp, Artificial Sequence
  chemically synthesized
atcagcaacatagctttcagtt

SEQ ID NO: 1382663 - DNA, 22 bp, Artificial Sequence
  chemically synthesized
tcagcaacatagctttcagtta

SEQ ID NO: 1382664 - DNA, 22 bp, Artificial Sequence
  chemically synthesized
catttattttatgttaactgaa

SEQ ID NO: 1382665 - DNA, 22 bp, Artificial Sequence
  chemically synthesized
acatttattttatgttaactga

SEQ ID NO: 1382666 - DNA, 22 bp, Artificial Sequence
  chemically synthesized
tttacatttattttatgttaac

SEQ ID NO: 1382667 - DNA, 22 bp, Artificial Sequence
  chemically synthesized
tcagttaacataaaataaatgt

SEQ ID NO: 1382668 - DNA, 22 bp, Artificial Sequence
  chemically synthesized
tcaatgttatttacatttattt

SEQ ID NO: 1382669 - DNA, 22 bp, Artificial Sequence
  chemically synthesized
cagttaacataaaataaatgta

SEQ ID NO: 1382670 - DNA, 22 bp, Artificial Sequence
  chemically synthesized
agttaacataaaataaatgtaa

SEQ ID NO: 1382671 - DNA, 22 bp, Artificial Sequence
  chemically synthesized
acataaaataaatgtaaataac

SEQ ID NO: 1382672 - DNA, 22 bp, Artificial Sequence
  chemically synthesized
aaatgacctgtcaatgttattt

SEQ ID NO: 1382673 - DNA, 22 bp, Artificial Sequence
  chemically synthesized
gtactaaaatgacctgtcaatg

SEQ ID NO: 1382674 - DNA, 22 bp, Artificial Sequence
  chemically synthesized
agtactaaaatgacctgtcaat

SEQ ID NO: 1382675 - DNA, 22 bp, Artificial Sequence
  chemically synthesized
atatttagtactaaaatgacct

SEQ ID NO: 1382676 - DNA, 22 bp, Artificial Sequence
  chemically synthesized
acaggtcattttagtactaaat

SEQ ID NO: 1382677 - DNA, 22 bp, Artificial Sequence
  chemically synthesized
taaagcactaatatttagtact

SEQ ID NO: 1382678 - DNA, 22 bp, Artificial Sequence
  chemically synthesized
ataaagcactaatatttagtac

SEQ ID NO: 1382679 - DNA, 22 bp, Artificial Sequence
  chemically synthesized
cttataaagcactaatatttag

SEQ ID NO: 1382680 - DNA, 22 bp, Artificial Sequence
  chemically synthesized
gttgcttataaagcactaatat

SEQ ID NO: 1382681 - DNA, 22 bp, Artificial Sequence
  chemically synthesized
agttgcttataaagcactaata

SEQ ID NO: 1382682 - DNA, 22 bp, Artificial Sequence
  chemically synthesized
tagtactaaatattagtgcttt

SEQ ID NO: 1382683 - DNA, 22 bp, Artificial Sequence
  chemically synthesized
agtactaaatattagtgcttta

SEQ ID NO: 1382684 - DNA, 22 bp, Artificial Sequence
  chemically synthesized
gtactaaatattagtgctttat

SEQ ID NO: 1382685 - DNA, 22 bp, Artificial Sequence
  chemically synthesized
aataatttagttgcttataaag

SEQ ID NO: 1382686 - DNA, 22 bp, Artificial Sequence
  chemically synthesized
aatattagtgctttataagcaa

SEQ ID NO: 1382687 - DNA, 22 bp, Artificial Sequence
  chemically synthesized
actaaataatttagttgcttat

SEQ ID NO: 1382688 - DNA, 22 bp, Artificial Sequence
  chemically synthesized
gtgctttataagcaactaaatt

SEQ ID NO: 1382689 - DNA, 22 bp, Artificial Sequence
  chemically synthesized
tataagcaactaaattatttag

SEQ ID NO: 1382690 - DNA, 22 bp, Artificial Sequence
  chemically synthesized
gaataaagctgactaaataatt

SEQ ID NO: 1382691 - DNA, 22 bp, Artificial Sequence
  chemically synthesized
ataagcaactaaattatttagt

SEQ ID NO: 1382692 - DNA, 22 bp, Artificial Sequence
  chemically synthesized
taagcaactaaattatttagtc

SEQ ID NO: 1382693 - DNA, 22 bp, Artificial Sequence
  chemically synthesized
tctggaataaagctgactaaat

SEQ ID NO: 1382694 - DNA, 22 bp, Artificial Sequence
  chemically synthesized
atctggaataaagctgactaaa

SEQ ID NO: 1382695 - DNA, 22 bp, Artificial Sequence
  chemically synthesized
ttatctggaataaagctgacta

SEQ ID NO: 1382696 - DNA, 22 bp, Artificial Sequence
  chemically synthesized
cttatctggaataaagctgact

SEQ ID NO: 1382697 - DNA, 22 bp, Artificial Sequence
  chemically synthesized
aattatttagtcagctttattc

SEQ ID NO: 1382698 - DNA, 22 bp, Artificial Sequence
  chemically synthesized
tttagtcagctttattccagat

SEQ ID NO: 1382699 - DNA, 22 bp, Artificial Sequence
  chemically synthesized
agtcagctttattccagataag

SEQ ID NO: 1382700 - DNA, 22 bp, Artificial Sequence
  chemically synthesized
gtcagctttattccagataaga

SEQ ID NO: 1382701 - DNA, 22 bp, Artificial Sequence
  chemically synthesized
ataaatccaagggtcttcttat

SEQ ID NO: 1382702 - DNA, 22 bp, Artificial Sequence
  chemically synthesized
aataaatccaagggtcttctta

SEQ ID NO: 1382703 - DNA, 22 bp, Artificial Sequence
  chemically synthesized
tattccagataagaagaccctt

SEQ ID NO: 1382704 - DNA, 22 bp, Artificial Sequence
  chemically synthesized
attccagataagaagacccttg

SEQ ID NO: 1382705 - DNA, 22 bp, Artificial Sequence
  chemically synthesized
ttccagataagaagacccttgg

SEQ ID NO: 1382706 - DNA, 22 bp, Artificial Sequence
  chemically synthesized
taatttaataaatccaagggtc

SEQ ID NO: 1382707 - DNA, 22 bp, Artificial Sequence
  chemically synthesized
cagataagaagacccttggatt

SEQ ID NO: 1382708 - DNA, 22 bp, Artificial Sequence
  chemically synthesized
atctataatttaataaatccaa

SEQ ID NO: 1382709 - DNA, 22 bp, Artificial Sequence
  chemically synthesized
aatctataatttaataaatcca

SEQ ID NO: 1382710 - DNA, 22 bp, Artificial Sequence
  chemically synthesized
ggatttattaaattatagatta

SEQ ID NO: 1382711 - DNA, 22 bp, Artificial Sequence
  chemically synthesized
gatttattaaattatagattaa

SEQ ID NO: 1382712 - DNA, 22 bp, Artificial Sequence
  chemically synthesized
attaaattatagattaaatact

SEQ ID NO: 1382713 - DNA, 22 bp, Artificial Sequence
  chemically synthesized
ttaaattatagattaaatactg

SEQ ID NO: 1382714 - DNA, 22 bp, Artificial Sequence
  chemically synthesized
aattatagattaaatactgatg

SEQ ID NO: 1382715 - DNA, 22 bp, Artificial Sequence
  chemically synthesized
aggaatagtcagacacatcagt

SEQ ID NO: 1382716 - DNA, 22 bp, Artificial Sequence
  chemically synthesized
tagattaaatactgatgtgtct

SEQ ID NO: 1382717 - DNA, 22 bp, Artificial Sequence
  chemically synthesized
tcaggaatagtcagacacatca

SEQ ID NO: 1382718 - DNA, 22 bp, Artificial Sequence
  chemically synthesized
ctcaggaatagtcagacacatc

SEQ ID NO: 1382719 - DNA, 22 bp, Artificial Sequence
  chemically synthesized
aatactgatgtgtctgactatt

SEQ ID NO: 1382720 - DNA, 22 bp, Artificial Sequence
  chemically synthesized
ggtgtttctcaggaatagtcag

SEQ ID NO: 1382721 - DNA, 22 bp, Artificial Sequence
  chemically synthesized
cggtgtttctcaggaatagtca

SEQ ID NO: 1382722 - DNA, 22 bp, Artificial Sequence
  chemically synthesized
atgtgtctgactattcctgaga

SEQ ID NO: 1382723 - DNA, 22 bp, Artificial Sequence
  chemically synthesized
actattcctgagaaacaccgaa

SEQ ID NO: 1382724 - DNA, 22 bp, Artificial Sequence
  chemically synthesized
gacatagtggggcttcggtgtt

SEQ ID NO: 1382725 - DNA, 22 bp, Artificial Sequence
  chemically synthesized
tagacatagtggggcttcggtg

SEQ ID NO: 1382726 - DNA, 22 bp, Artificial Sequence
  chemically synthesized
ttcctgagaaacaccgaagccc

SEQ ID NO: 1382727 - DNA, 22 bp, Artificial Sequence
  chemically synthesized
ctgagaaacaccgaagccccac

SEQ ID NO: 1382728 - DNA, 22 bp, Artificial Sequence
  chemically synthesized
agaaacaccgaagccccactat

SEQ ID NO: 1382729 - DNA, 22 bp, Artificial Sequence
  chemically synthesized
agtaaatatcaatattctagac

SEQ ID NO: 1382730 - DNA, 22 bp, Artificial Sequence
  chemically synthesized
tgtctagaatattgatatttac

SEQ ID NO: 1382731 - DNA, 22 bp, Artificial Sequence
  chemically synthesized
tgtatgaacctcagtaaatatc

SEQ ID NO: 1382732 - DNA, 22 bp, Artificial Sequence
  chemically synthesized
atgtatgaacctcagtaaatat

SEQ ID NO: 1382733 - DNA, 22 bp, Artificial Sequence
  chemically synthesized
gaatattgatatttactgaggt

SEQ ID NO: 1382734 - DNA, 22 bp, Artificial Sequence
  chemically synthesized
atatttactgaggttcatacat

SEQ ID NO: 1382735 - DNA, 22 bp, Artificial Sequence
  chemically synthesized
gcatagcgacttatgtatgaac

SEQ ID NO: 1382736 - DNA, 22 bp, Artificial Sequence
  chemically synthesized
actagcatagcgacttatgtat

SEQ ID NO: 1382737 - DNA, 22 bp, Artificial Sequence
  chemically synthesized
actgaggttcatacataagtcg

SEQ ID NO: 1382738 - DNA, 22 bp, Artificial Sequence
  chemically synthesized
tcactagcatagcgacttatgt

SEQ ID NO: 1382739 - DNA, 22 bp, Artificial Sequence
  chemically synthesized
ctgaggttcatacataagtcgc

SEQ ID NO: 1382740 - DNA, 22 bp, Artificial Sequence
  chemically synthesized
aggttcatacataagtcgctat

SEQ ID NO: 1382741 - DNA, 22 bp, Artificial Sequence
  chemically synthesized
aatctctcactagcatagcgac

SEQ ID NO: 1382742 - DNA, 22 bp, Artificial Sequence
  chemically synthesized
gaatctctcactagcatagcga

SEQ ID NO: 1382743 - DNA, 22 bp, Artificial Sequence
  chemically synthesized
atacataagtcgctatgctagt

SEQ ID NO: 1382744 - DNA, 22 bp, Artificial Sequence
  chemically synthesized
atcttgaatctctcactagcat

SEQ ID NO: 1382745 - DNA, 22 bp, Artificial Sequence
  chemically synthesized
catcttgaatctctcactagca

SEQ ID NO: 1382746 - DNA, 22 bp, Artificial Sequence
  chemically synthesized
gagtttcatcttgaatctctca

SEQ ID NO: 1382747 - DNA, 22 bp, Artificial Sequence
  chemically synthesized
tgctagtgagagattcaagatg

SEQ ID NO: 1382748 - DNA, 22 bp, Artificial Sequence
  chemically synthesized
gtgagagattcaagatgaaact

SEQ ID NO: 1382749 - DNA, 22 bp, Artificial Sequence
  chemically synthesized
ataaagagaaagctagagtttc

SEQ ID NO: 1382750 - DNA, 22 bp, Artificial Sequence
  chemically synthesized
aataaagagaaagctagagttt

SEQ ID NO: 1382751 - DNA, 22 bp, Artificial Sequence
  chemically synthesized
atttaataaagagaaagctaga

SEQ ID NO: 1382752 - DNA, 22 bp, Artificial Sequence
  chemically synthesized
aagatgaaactctagctttctc

SEQ ID NO: 1382753 - DNA, 22 bp, Artificial Sequence
  chemically synthesized
tagctttctctttattaaatca

SEQ ID NO: 1382754 - DNA, 22 bp, Artificial Sequence
  chemically synthesized
gctttctctttattaaatcagc

SEQ ID NO: 1382755 - DNA, 22 bp, Artificial Sequence
  chemically synthesized
tctctttattaaatcagccttg

SEQ ID NO: 1382756 - DNA, 22 bp, Artificial Sequence
  chemically synthesized
ctctttattaaatcagccttgg

SEQ ID NO: 1382757 - DNA, 22 bp, Artificial Sequence
  chemically synthesized
tctttattaaatcagccttggc

SEQ ID NO: 1382758 - DNA, 22 bp, Artificial Sequence
  chemically synthesized
tttattaaatcagccttggcct

SEQ ID NO: 1382759 - DNA, 22 bp, Artificial Sequence
  chemically synthesized
tattaaatcagccttggcctcc

SEQ ID NO: 1382760 - DNA, 22 bp, Artificial Sequence
  chemically synthesized
attaaatcagccttggcctccc

SEQ ID NO: 1382761 - DNA, 22 bp, Artificial Sequence
  chemically synthesized
cataaaaataaggggaggccaa

SEQ ID NO: 1382762 - DNA, 22 bp, Artificial Sequence
  chemically synthesized
ttaaatcagccttggcctcccc

SEQ ID NO: 1382763 - DNA, 22 bp, Artificial Sequence
  chemically synthesized
aatcagccttggcctcccctta

SEQ ID NO: 1382764 - DNA, 22 bp, Artificial Sequence
  chemically synthesized
ggcctccccttatttttatgta

SEQ ID NO: 1382765 - DNA, 22 bp, Artificial Sequence
  chemically synthesized
gcctccccttatttttatgtag

SEQ ID NO: 1382766 - DNA, 22 bp, Artificial Sequence
  chemically synthesized
cccttatttttatgtaggtatt

SEQ ID NO: 1382767 - DNA, 22 bp, Artificial Sequence
  chemically synthesized
aaatcaaggaaatcaataccta

SEQ ID NO: 1382768 - DNA, 22 bp, Artificial Sequence
  chemically synthesized
caaatcaaggaaatcaatacct

SEQ ID NO: 1382769 - DNA, 22 bp, Artificial Sequence
  chemically synthesized
atttttatgtaggtattgattt

SEQ ID NO: 1382770 - DNA, 22 bp, Artificial Sequence
  chemically synthesized
tttttatgtaggtattgatttc

SEQ ID NO: 1382771 - DNA, 22 bp, Artificial Sequence
  chemically synthesized
cttcaaatcaaggaaatcaata

SEQ ID NO: 1382772 - DNA, 22 bp, Artificial Sequence
  chemically synthesized
gcttcaaatcaaggaaatcaat

SEQ ID NO: 1382773 - DNA, 22 bp, Artificial Sequence
  chemically synthesized
ttatgtaggtattgatttcctt

SEQ ID NO: 1382774 - DNA, 22 bp, Artificial Sequence
  chemically synthesized
tatgtaggtattgatttccttg

SEQ ID NO: 1382775 - DNA, 22 bp, Artificial Sequence
  chemically synthesized
atgtaggtattgatttccttga

SEQ ID NO: 1382776 - DNA, 22 bp, Artificial Sequence
  chemically synthesized
tgtaggtattgatttccttgat

SEQ ID NO: 1382777 - DNA, 22 bp, Artificial Sequence
  chemically synthesized
aaaagaggaaagtttgcttcaa

SEQ ID NO: 1382778 - DNA, 22 bp, Artificial Sequence
  chemically synthesized
atttccttgatttgaagcaaac

SEQ ID NO: 1382779 - DNA, 22 bp, Artificial Sequence
  chemically synthesized
tcaaaagaggaaagtttgcttc

SEQ ID NO: 1382780 - DNA, 22 bp, Artificial Sequence
  chemically synthesized
ctcaaaagaggaaagtttgctt

SEQ ID NO: 1382781 - DNA, 22 bp, Artificial Sequence
  chemically synthesized
tctcaaaagaggaaagtttgct

SEQ ID NO: 1382782 - DNA, 22 bp, Artificial Sequence
  chemically synthesized
ccttgatttgaagcaaactttc

SEQ ID NO: 1382783 - DNA, 22 bp, Artificial Sequence
  chemically synthesized
ttctcaaaagaggaaagtttgc

SEQ ID NO: 1382784 - DNA, 22 bp, Artificial Sequence
  chemically synthesized
cttgatttgaagcaaactttcc

SEQ ID NO: 1382785 - DNA, 22 bp, Artificial Sequence
  chemically synthesized
tttttctcaaaagaggaaagtt

SEQ ID NO: 1382786 - DNA, 22 bp, Artificial Sequence
  chemically synthesized
gatttgaagcaaactttcctct

SEQ ID NO: 1382787 - DNA, 22 bp, Artificial Sequence
  chemically synthesized
atttttctcaaaagaggaaagt

SEQ ID NO: 1382788 - DNA, 22 bp, Artificial Sequence
  chemically synthesized
atttgaagcaaactttcctctt

SEQ ID NO: 1382789 - DNA, 22 bp, Artificial Sequence
  chemically synthesized
gaagcaaactttcctcttttga

SEQ ID NO: 1382790 - DNA, 22 bp, Artificial Sequence
  chemically synthesized
aagcaaactttcctcttttgag

SEQ ID NO: 1382791 - DNA, 22 bp, Artificial Sequence
  chemically synthesized
tgatttatttttctcaaaagag

SEQ ID NO: 1382792 - DNA, 22 bp, Artificial Sequence
  chemically synthesized
tcctcttttgagaaaaataaat

SEQ ID NO: 1382793 - DNA, 22 bp, Artificial Sequence
  chemically synthesized
cctcttttgagaaaaataaatc

SEQ ID NO: 1382794 - DNA, 22 bp, Artificial Sequence
  chemically synthesized
ctcttttgagaaaaataaatca

SEQ ID NO: 1382795 - DNA, 22 bp, Artificial Sequence
  chemically synthesized
ttttgagaaaaataaatcacaa

SEQ ID NO: 1382796 - DNA, 22 bp, Artificial Sequence
  chemically synthesized
ttgagaaaaataaatcacaact

SEQ ID NO: 1382797 - DNA, 22 bp, Artificial Sequence
  chemically synthesized
tgagaaaaataaatcacaactc

SEQ ID NO: 1382798 - DNA, 22 bp, Artificial Sequence
  chemically synthesized
gagaaaaataaatcacaactca

SEQ ID NO: 1382799 - DNA, 22 bp, Artificial Sequence
  chemically synthesized
agaaaaataaatcacaactcat

SEQ ID NO: 1382800 - DNA, 22 bp, Artificial Sequence
  chemically synthesized
gggtagaagaagtgggagagat

SEQ ID NO: 1382801 - DNA, 22 bp, Artificial Sequence
  chemically synthesized
attgctttaccatctctcccac

SEQ ID NO: 1382802 - DNA, 22 bp, Artificial Sequence
  chemically synthesized
agggtagaagaagtgggagaga

SEQ ID NO: 1382803 - DNA, 22 bp, Artificial Sequence
  chemically synthesized
tagggtagaagaagtgggagag

SEQ ID NO: 1382804 - DNA, 22 bp, Artificial Sequence
  chemically synthesized
ctttaccatctctcccacttct

SEQ ID NO: 1382805 - DNA, 22 bp, Artificial Sequence
  chemically synthesized
tctttagggtagaagaagtggg

SEQ ID NO: 1382806 - DNA, 22 bp, Artificial Sequence
  chemically synthesized
taccatctctcccacttcttct

SEQ ID NO: 1382807 - DNA, 22 bp, Artificial Sequence
  chemically synthesized
accatctctcccacttcttcta

SEQ ID NO: 1382808 - DNA, 22 bp, Artificial Sequence
  chemically synthesized
ccatctctcccacttcttctac

SEQ ID NO: 1382809 - DNA, 22 bp, Artificial Sequence
  chemically synthesized
tcagctatctttagggtagaag

SEQ ID NO: 1382810 - DNA, 22 bp, Artificial Sequence
  chemically synthesized
gtcagctatctttagggtagaa

SEQ ID NO: 1382811 - DNA, 22 bp, Artificial Sequence
  chemically synthesized
tcccacttcttctaccctaaag

SEQ ID NO: 1382812 - DNA, 22 bp, Artificial Sequence
  chemically synthesized
ccacttcttctaccctaaagat

SEQ ID NO: 1382813 - DNA, 22 bp, Artificial Sequence
  chemically synthesized
ccagccttgtcagctatcttta

SEQ ID NO: 1382814 - DNA, 22 bp, Artificial Sequence
  chemically synthesized
cttctaccctaaagatagctga

SEQ ID NO: 1382815 - DNA, 22 bp, Artificial Sequence
  chemically synthesized
ttgccagccttgtcagctatct

SEQ ID NO: 1382816 - DNA, 22 bp, Artificial Sequence
  chemically synthesized
ttctaccctaaagatagctgac

SEQ ID NO: 1382817 - DNA, 22 bp, Artificial Sequence
  chemically synthesized
attgccagccttgtcagctatc

SEQ ID NO: 1382818 - DNA, 22 bp, Artificial Sequence
  chemically synthesized
tattgccagccttgtcagctat

SEQ ID NO: 1382819 - DNA, 22 bp, Artificial Sequence
  chemically synthesized
ctaccctaaagatagctgacaa

SEQ ID NO: 1382820 - DNA, 22 bp, Artificial Sequence
  chemically synthesized
ttattgccagccttgtcagcta

SEQ ID NO: 1382821 - DNA, 22 bp, Artificial Sequence
  chemically synthesized
taccctaaagatagctgacaag

SEQ ID NO: 1382822 - DNA, 22 bp, Artificial Sequence
  chemically synthesized
tttattgccagccttgtcagct

SEQ ID NO: 1382823 - DNA, 22 bp, Artificial Sequence
  chemically synthesized
ccctaaagatagctgacaaggc

SEQ ID NO: 1382824 - DNA, 22 bp, Artificial Sequence
  chemically synthesized
cctttttattgccagccttgtc

SEQ ID NO: 1382825 - DNA, 22 bp, Artificial Sequence
  chemically synthesized
tacctttttattgccagccttg

SEQ ID NO: 1382826 - DNA, 22 bp, Artificial Sequence
  chemically synthesized
aagatagctgacaaggctggca

SEQ ID NO: 1382827 - DNA, 22 bp, Artificial Sequence
  chemically synthesized
ctacctttttattgccagcctt

SEQ ID NO: 1382828 - DNA, 22 bp, Artificial Sequence
  chemically synthesized
tctacctttttattgccagcct

SEQ ID NO: 1382829 - DNA, 22 bp, Artificial Sequence
  chemically synthesized
ttctacctttttattgccagcc

SEQ ID NO: 1382830 - DNA, 22 bp, Artificial Sequence
  chemically synthesized
tttctacctttttattgccagc

SEQ ID NO: 1382831 - DNA, 22 bp, Artificial Sequence
  chemically synthesized
ctttttctacctttttattgcc

SEQ ID NO: 1382832 - DNA, 22 bp, Artificial Sequence
  chemically synthesized
actttttctacctttttattgc

SEQ ID NO: 1382833 - DNA, 22 bp, Artificial Sequence
  chemically synthesized
tactttttctacctttttattg

SEQ ID NO: 1382834 - DNA, 22 bp, Artificial Sequence
  chemically synthesized
acaaggctggcaataaaaaggt

SEQ ID NO: 1382835 - DNA, 22 bp, Artificial Sequence
  chemically synthesized
tttactttttctacctttttat

SEQ ID NO: 1382836 - DNA, 22 bp, Artificial Sequence
  chemically synthesized
taagactctttactttttctac

SEQ ID NO: 1382837 - DNA, 22 bp, Artificial Sequence
  chemically synthesized
gcaataaaaaggtagaaaaagt

SEQ ID NO: 1382838 - DNA, 22 bp, Artificial Sequence
  chemically synthesized
cgttgtaagactctttactttt

SEQ ID NO: 1382839 - DNA, 22 bp, Artificial Sequence
  chemically synthesized
ggtcaaaaatcatctacgttgt

SEQ ID NO: 1382840 - DNA, 22 bp, Artificial Sequence
  chemically synthesized
ctgggtcaaaaatcatctacgt

SEQ ID NO: 1382841 - DNA, 22 bp, Artificial Sequence
  chemically synthesized
cctgggtcaaaaatcatctacg

SEQ ID NO: 1382842 - DNA, 22 bp, Artificial Sequence
  chemically synthesized
tacttcctgggtcaaaaatcat

SEQ ID NO: 1382843 - DNA, 22 bp, Artificial Sequence
  chemically synthesized
gtacttcctgggtcaaaaatca

SEQ ID NO: 1382844 - DNA, 22 bp, Artificial Sequence
  chemically synthesized
acaacgtagatgatttttgacc

SEQ ID NO: 1382845 - DNA, 22 bp, Artificial Sequence
  chemically synthesized
caacgtagatgatttttgaccc

SEQ ID NO: 1382846 - DNA, 22 bp, Artificial Sequence
  chemically synthesized
aacttgtacttcctgggtcaaa

SEQ ID NO: 1382847 - DNA, 22 bp, Artificial Sequence
  chemically synthesized
tattaaacttgtacttcctggg

SEQ ID NO: 1382848 - DNA, 22 bp, Artificial Sequence
  chemically synthesized
attatattaaacttgtacttcc

SEQ ID NO: 1382849 - DNA, 22 bp, Artificial Sequence
  chemically synthesized
aattatattaaacttgtacttc

SEQ ID NO: 1382850 - DNA, 22 bp, Artificial Sequence
  chemically synthesized
taattatattaaacttgtactt

SEQ ID NO: 1382851 - DNA, 22 bp, Artificial Sequence
  chemically synthesized
ttaattatattaaacttgtact

SEQ ID NO: 1382852 - DNA, 22 bp, Artificial Sequence
  chemically synthesized
ttgacccaggaagtacaagttt

SEQ ID NO: 1382853 - DNA, 22 bp, Artificial Sequence
  chemically synthesized
tgacccaggaagtacaagttta

SEQ ID NO: 1382854 - DNA, 22 bp, Artificial Sequence
  chemically synthesized
gacccaggaagtacaagtttaa

SEQ ID NO: 1382855 - DNA, 22 bp, Artificial Sequence
  chemically synthesized
acccaggaagtacaagtttaat

SEQ ID NO: 1382856 - DNA, 22 bp, Artificial Sequence
  chemically synthesized
cacttttaattatattaaactt

SEQ ID NO: 1382857 - DNA, 22 bp, Artificial Sequence
  chemically synthesized
aacattgcacttttaattatat

SEQ ID NO: 1382858 - DNA, 22 bp, Artificial Sequence
  chemically synthesized
caacattgcacttttaattata

SEQ ID NO: 1382859 - DNA, 22 bp, Artificial Sequence
  chemically synthesized
atttcaacattgcacttttaat

SEQ ID NO: 1382860 - DNA, 22 bp, Artificial Sequence
  chemically synthesized
ctgatttcaacattgcactttt

SEQ ID NO: 1382861 - DNA, 22 bp, Artificial Sequence
  chemically synthesized
gctgatttcaacattgcacttt

SEQ ID NO: 1382862 - DNA, 22 bp, Artificial Sequence
  chemically synthesized
aatataattaaaagtgcaatgt

SEQ ID NO: 1382863 - DNA, 22 bp, Artificial Sequence
  chemically synthesized
ttgctgatttcaacattgcact

SEQ ID NO: 1382864 - DNA, 22 bp, Artificial Sequence
  chemically synthesized
atataattaaaagtgcaatgtt

SEQ ID NO: 1382865 - DNA, 22 bp, Artificial Sequence
  chemically synthesized
aaagtgcaatgttgaaatcagc

SEQ ID NO: 1382866 - DNA, 22 bp, Artificial Sequence
  chemically synthesized
aaaaatacaaactcttgctgat

SEQ ID NO: 1382867 - DNA, 22 bp, Artificial Sequence
  chemically synthesized
aataattcaaaaatacaaactc

SEQ ID NO: 1382868 - DNA, 22 bp, Artificial Sequence
  chemically synthesized
aaatcagcaagagtttgtattt

SEQ ID NO: 1382869 - DNA, 22 bp, Artificial Sequence
  chemically synthesized
gtatttttgaattattcaaccc

SEQ ID NO: 1382870 - DNA, 22 bp, Artificial Sequence
  chemically synthesized
tatttttgaattattcaacccc

SEQ ID NO: 1382871 - DNA, 22 bp, Artificial Sequence
  chemically synthesized
tagagaacataatggggttgaa

SEQ ID NO: 1382872 - DNA, 22 bp, Artificial Sequence
  chemically synthesized
tatagagaacataatggggttg

SEQ ID NO: 1382873 - DNA, 22 bp, Artificial Sequence
  chemically synthesized
ctatagagaacataatggggtt

SEQ ID NO: 1382874 - DNA, 22 bp, Artificial Sequence
  chemically synthesized
ttgaattattcaaccccattat

SEQ ID NO: 1382875 - DNA, 22 bp, Artificial Sequence
  chemically synthesized
tctatagagaacataatggggt

SEQ ID NO: 1382876 - DNA, 22 bp, Artificial Sequence
  chemically synthesized
tgaattattcaaccccattatg

SEQ ID NO: 1382877 - DNA, 22 bp, Artificial Sequence
  chemically synthesized
gaattattcaaccccattatgt

SEQ ID NO: 1382878 - DNA, 22 bp, Artificial Sequence
  chemically synthesized
aattattcaaccccattatgtt

SEQ ID NO: 1382879 - DNA, 22 bp, Artificial Sequence
  chemically synthesized
gttttctatagagaacataatg

SEQ ID NO: 1382880 - DNA, 22 bp, Artificial Sequence
  chemically synthesized
ggttttctatagagaacataat

SEQ ID NO: 1382881 - DNA, 22 bp, Artificial Sequence
  chemically synthesized
tggttttctatagagaacataa

SEQ ID NO: 1382882 - DNA, 22 bp, Artificial Sequence
  chemically synthesized
ttcaaccccattatgttctcta

SEQ ID NO: 1382883 - DNA, 22 bp, Artificial Sequence
  chemically synthesized
tttggttttctatagagaacat

SEQ ID NO: 1382884 - DNA, 22 bp, Artificial Sequence
  chemically synthesized
ctttggttttctatagagaaca

SEQ ID NO: 1382885 - DNA, 22 bp, Artificial Sequence
  chemically synthesized
tctttggttttctatagagaac

SEQ ID NO: 1382886 - DNA, 22 bp, Artificial Sequence
  chemically synthesized
aaccccattatgttctctatag

SEQ ID NO: 1382887 - DNA, 22 bp, Artificial Sequence
  chemically synthesized
ttctttggttttctatagagaa

SEQ ID NO: 1382888 - DNA, 22 bp, Artificial Sequence
  chemically synthesized
tttttctttggttttctataga

SEQ ID NO: 1382889 - DNA, 22 bp, Artificial Sequence
  chemically synthesized
atttttctttggttttctatag

SEQ ID NO: 1382890 - DNA, 22 bp, Artificial Sequence
  chemically synthesized
tttatttttctttggttttcta

SEQ ID NO: 1382891 - DNA, 22 bp, Artificial Sequence
  chemically synthesized
tgttctctatagaaaaccaaag

SEQ ID NO: 1382892 - DNA, 22 bp, Artificial Sequence
  chemically synthesized
gttatttatttttctttggttt

SEQ ID NO: 1382893 - DNA, 22 bp, Artificial Sequence
  chemically synthesized
ggttatttatttttctttggtt

SEQ ID NO: 1382894 - DNA, 22 bp, Artificial Sequence
  chemically synthesized
tggttatttatttttctttggt

SEQ ID NO: 1382895 - DNA, 22 bp, Artificial Sequence
  chemically synthesized
ttggttatttatttttctttgg

SEQ ID NO: 1382896 - DNA, 22 bp, Artificial Sequence
  chemically synthesized
tctatagaaaaccaaagaaaaa

SEQ ID NO: 1382897 - DNA, 22 bp, Artificial Sequence
  chemically synthesized
ttttggttatttatttttcttt

SEQ ID NO: 1382898 - DNA, 22 bp, Artificial Sequence
  chemically synthesized
tatagaaaaccaaagaaaaata

SEQ ID NO: 1382899 - DNA, 22 bp, Artificial Sequence
  chemically synthesized
tcttttggttatttatttttct

SEQ ID NO: 1382900 - DNA, 22 bp, Artificial Sequence
  chemically synthesized
tagaaaaccaaagaaaaataaa

SEQ ID NO: 1382901 - DNA, 22 bp, Artificial Sequence
  chemically synthesized
ctcttttggttatttatttttc

SEQ ID NO: 1382902 - DNA, 22 bp, Artificial Sequence
  chemically synthesized
cagcttctcttttggttattta

SEQ ID NO: 1382903 - DNA, 22 bp, Artificial Sequence
  chemically synthesized
gcagcttctcttttggttattt

SEQ ID NO: 1382904 - DNA, 22 bp, Artificial Sequence
  chemically synthesized
tgcagcttctcttttggttatt

SEQ ID NO: 1382905 - DNA, 22 bp, Artificial Sequence
  chemically synthesized
ttgcagcttctcttttggttat

SEQ ID NO: 1382906 - DNA, 22 bp, Artificial Sequence
  chemically synthesized
aatgaaacacttttgcagcttc

SEQ ID NO: 1382907 - DNA, 22 bp, Artificial Sequence
  chemically synthesized
tactcaatgaaacacttttgca

SEQ ID NO: 1382908 - DNA, 22 bp, Artificial Sequence
  chemically synthesized
aacgctgtactcaatgaaacac

SEQ ID NO: 1382909 - DNA, 22 bp, Artificial Sequence
  chemically synthesized
caaaagtgtttcattgagtaca

SEQ ID NO: 1382910 - DNA, 22 bp, Artificial Sequence
  chemically synthesized
acgaggtattgaacgctgtact

SEQ ID NO: 1382911 - DNA, 22 bp, Artificial Sequence
  chemically synthesized
gacgaggtattgaacgctgtac

SEQ ID NO: 1382912 - DNA, 22 bp, Artificial Sequence
  chemically synthesized
tttgacgaggtattgaacgctg

SEQ ID NO: 1382913 - DNA, 22 bp, Artificial Sequence
  chemically synthesized
cattgagtacagcgttcaatac

SEQ ID NO: 1382914 - DNA, 22 bp, Artificial Sequence
  chemically synthesized
ctatttgacgaggtattgaacg

SEQ ID NO: 1382915 - DNA, 22 bp, Artificial Sequence
  chemically synthesized
attgagtacagcgttcaatacc

SEQ ID NO: 1382916 - DNA, 22 bp, Artificial Sequence
  chemically synthesized
actcctatttgacgaggtattg

SEQ ID NO: 1382917 - DNA, 22 bp, Artificial Sequence
  chemically synthesized
agtacagcgttcaatacctcgt

SEQ ID NO: 1382918 - DNA, 22 bp, Artificial Sequence
  chemically synthesized
aactcctatttgacgaggtatt

SEQ ID NO: 1382919 - DNA, 22 bp, Artificial Sequence
  chemically synthesized
taactcctatttgacgaggtat

SEQ ID NO: 1382920 - DNA, 22 bp, Artificial Sequence
  chemically synthesized
aatctttaactcctatttgacg

SEQ ID NO: 1382921 - DNA, 22 bp, Artificial Sequence
  chemically synthesized
actaaatctttaactcctattt

SEQ ID NO: 1382922 - DNA, 22 bp, Artificial Sequence
  chemically synthesized
aatacctcgtcaaataggagtt

SEQ ID NO: 1382923 - DNA, 22 bp, Artificial Sequence
  chemically synthesized
cactaaatctttaactcctatt

SEQ ID NO: 1382924 - DNA, 22 bp, Artificial Sequence
  chemically synthesized
tcactaaatctttaactcctat

SEQ ID NO: 1382925 - DNA, 22 bp, Artificial Sequence
  chemically synthesized
aactttcactaaatctttaact

SEQ ID NO: 1382926 - DNA, 22 bp, Artificial Sequence
  chemically synthesized
caactttcactaaatctttaac

SEQ ID NO: 1382927 - DNA, 22 bp, Artificial Sequence
  chemically synthesized
gtcaaataggagttaaagattt

SEQ ID NO: 1382928 - DNA, 22 bp, Artificial Sequence
  chemically synthesized
tcaactttcactaaatctttaa

SEQ ID NO: 1382929 - DNA, 22 bp, Artificial Sequence
  chemically synthesized
accaccctttcaactttcacta

SEQ ID NO: 1382930 - DNA, 22 bp, Artificial Sequence
  chemically synthesized
aagatttagtgaaagttgaaag

SEQ ID NO: 1382931 - DNA, 22 bp, Artificial Sequence
  chemically synthesized
aagttaaccaccctttcaactt

SEQ ID NO: 1382932 - DNA, 22 bp, Artificial Sequence
  chemically synthesized
caagttaaccaccctttcaact

SEQ ID NO: 1382933 - DNA, 22 bp, Artificial Sequence
  chemically synthesized
tcaagttaaccaccctttcaac

SEQ ID NO: 1382934 - DNA, 22 bp, Artificial Sequence
  chemically synthesized
tttcaagttaaccaccctttca

SEQ ID NO: 1382935 - DNA, 22 bp, Artificial Sequence
  chemically synthesized
ctttcaagttaaccaccctttc

SEQ ID NO: 1382936 - DNA, 22 bp, Artificial Sequence
  chemically synthesized
agtgaaagttgaaagggtggtt

SEQ ID NO: 1382937 - DNA, 22 bp, Artificial Sequence
  chemically synthesized
gtgaaagttgaaagggtggtta

SEQ ID NO: 1382938 - DNA, 22 bp, Artificial Sequence
  chemically synthesized
tcttctttcaagttaaccaccc

SEQ ID NO: 1382939 - DNA, 22 bp, Artificial Sequence
  chemically synthesized
caactatcttctttcaagttaa

SEQ ID NO: 1382940 - DNA, 22 bp, Artificial Sequence
  chemically synthesized
aaagggtggttaacttgaaaga

SEQ ID NO: 1382941 - DNA, 22 bp, Artificial Sequence
  chemically synthesized
cctccaactatcttctttcaag

SEQ ID NO: 1382942 - DNA, 22 bp, Artificial Sequence
  chemically synthesized
tattgcctccaactatcttctt

SEQ ID NO: 1382943 - DNA, 22 bp, Artificial Sequence
  chemically synthesized
gtattgcctccaactatcttct

SEQ ID NO: 1382944 - DNA, 22 bp, Artificial Sequence
  chemically synthesized
acttgaaagaagatagttggag

SEQ ID NO: 1382945 - DNA, 22 bp, Artificial Sequence
  chemically synthesized
atatttgtattgcctccaacta

SEQ ID NO: 1382946 - DNA, 22 bp, Artificial Sequence
  chemically synthesized
gaaagaagatagttggaggcaa

SEQ ID NO: 1382947 - DNA, 22 bp, Artificial Sequence
  chemically synthesized
aaagaagatagttggaggcaat

SEQ ID NO: 1382948 - DNA, 22 bp, Artificial Sequence
  chemically synthesized
caaacatcataattcatatttg

SEQ ID NO: 1382949 - DNA, 22 bp, Artificial Sequence
  chemically synthesized
gaggcaatacaaatatgaatta

SEQ ID NO: 1382950 - DNA, 22 bp, Artificial Sequence
  chemically synthesized
aaacctgcaaacatcataattc

SEQ ID NO: 1382951 - DNA, 22 bp, Artificial Sequence
  chemically synthesized
taaaacctgcaaacatcataat

SEQ ID NO: 1382952 - DNA, 22 bp, Artificial Sequence
  chemically synthesized
ctaaaacctgcaaacatcataa

SEQ ID NO: 1382953 - DNA, 22 bp, Artificial Sequence
  chemically synthesized
ttctaaaacctgcaaacatcat

SEQ ID NO: 1382954 - DNA, 22 bp, Artificial Sequence
  chemically synthesized
cttctaaaacctgcaaacatca

SEQ ID NO: 1382955 - DNA, 22 bp, Artificial Sequence
  chemically synthesized
tcttctaaaacctgcaaacatc

SEQ ID NO: 1382956 - DNA, 22 bp, Artificial Sequence
  chemically synthesized
tgatgtttgcaggttttagaag

SEQ ID NO: 1382957 - DNA, 22 bp, Artificial Sequence
  chemically synthesized
gcaggttttagaagaaagtctt

SEQ ID NO: 1382958 - DNA, 22 bp, Artificial Sequence
  chemically synthesized
atgaaaaaatccaagactttct

SEQ ID NO: 1382959 - DNA, 22 bp, Artificial Sequence
  chemically synthesized
caggttttagaagaaagtcttg

SEQ ID NO: 1382960 - DNA, 22 bp, Artificial Sequence
  chemically synthesized
gatgaaaaaatccaagactttc

SEQ ID NO: 1382961 - DNA, 22 bp, Artificial Sequence
  chemically synthesized
tcatttgatgaaaaaatccaag

SEQ ID NO: 1382962 - DNA, 22 bp, Artificial Sequence
  chemically synthesized
tagaagaaagtcttggattttt

SEQ ID NO: 1382963 - DNA, 22 bp, Artificial Sequence
  chemically synthesized
agaagaaagtcttggatttttt

SEQ ID NO: 1382964 - DNA, 22 bp, Artificial Sequence
  chemically synthesized
gaagaaagtcttggattttttc

SEQ ID NO: 1382965 - DNA, 22 bp, Artificial Sequence
  chemically synthesized
atctgtcatttgatgaaaaaat

SEQ ID NO: 1382966 - DNA, 22 bp, Artificial Sequence
  chemically synthesized
tcatctgtcatttgatgaaaaa

SEQ ID NO: 1382967 - DNA, 22 bp, Artificial Sequence
  chemically synthesized
gtctctcatctgtcatttgatg

SEQ ID NO: 1382968 - DNA, 22 bp, Artificial Sequence
  chemically synthesized
cgtctctcatctgtcatttgat

SEQ ID NO: 1382969 - DNA, 22 bp, Artificial Sequence
  chemically synthesized
ggattttttcatcaaatgacag

SEQ ID NO: 1382970 - DNA, 22 bp, Artificial Sequence
  chemically synthesized
gattttttcatcaaatgacaga

SEQ ID NO: 1382971 - DNA, 22 bp, Artificial Sequence
  chemically synthesized
tttcatcaaatgacagatgaga

SEQ ID NO: 1382972 - DNA, 22 bp, Artificial Sequence
  chemically synthesized
ttcatcaaatgacagatgagag

SEQ ID NO: 1382973 - DNA, 22 bp, Artificial Sequence
  chemically synthesized
tcatcaaatgacagatgagaga

SEQ ID NO: 1382974 - DNA, 22 bp, Artificial Sequence
  chemically synthesized
catcaaatgacagatgagagac

SEQ ID NO: 1382975 - DNA, 22 bp, Artificial Sequence
  chemically synthesized
atcaaatgacagatgagagacg

SEQ ID NO: 1382976 - DNA, 22 bp, Artificial Sequence
  chemically synthesized
cagaaataaaaaatgcttcgtc

SEQ ID NO: 1382977 - DNA, 22 bp, Artificial Sequence
  chemically synthesized
ttacagaaataaaaaatgcttc

SEQ ID NO: 1382978 - DNA, 22 bp, Artificial Sequence
  chemically synthesized
attacagaaataaaaaatgctt

SEQ ID NO: 1382979 - DNA, 22 bp, Artificial Sequence
  chemically synthesized
tattacagaaataaaaaatgct

SEQ ID NO: 1382980 - DNA, 22 bp, Artificial Sequence
  chemically synthesized
ttattacagaaataaaaaatgc

SEQ ID NO: 1382981 - DNA, 22 bp, Artificial Sequence
  chemically synthesized
tttattacagaaataaaaaatg

SEQ ID NO: 1382982 - DNA, 22 bp, Artificial Sequence
  chemically synthesized
tttatttctgtaataaaaagta

SEQ ID NO: 1382983 - DNA, 22 bp, Artificial Sequence
  chemically synthesized
ttatttctgtaataaaaagtat

SEQ ID NO: 1382984 - DNA, 22 bp, Artificial Sequence
  chemically synthesized
tatttctgtaataaaaagtatg

SEQ ID NO: 1382985 - DNA, 22 bp, Artificial Sequence
  chemically synthesized
atttctgtaataaaaagtatgg

SEQ ID NO: 1382986 - DNA, 22 bp, Artificial Sequence
  chemically synthesized
tttctgtaataaaaagtatggg

SEQ ID NO: 1382987 - DNA, 22 bp, Artificial Sequence
  chemically synthesized
ctgtaataaaaagtatgggtgg

SEQ ID NO: 1382988 - DNA, 22 bp, Artificial Sequence
  chemically synthesized
tgtaataaaaagtatgggtggc

SEQ ID NO: 1382989 - DNA, 22 bp, Artificial Sequence
  chemically synthesized
agtgacagtatagccacccata

SEQ ID NO: 1382990 - DNA, 22 bp, Artificial Sequence
  chemically synthesized
aagtgacagtatagccacccat

SEQ ID NO: 1382991 - DNA, 22 bp, Artificial Sequence
  chemically synthesized
taataaaaagtatgggtggcta

SEQ ID NO: 1382992 - DNA, 22 bp, Artificial Sequence
  chemically synthesized
aaaatatttaagtgacagtata

SEQ ID NO: 1382993 - DNA, 22 bp, Artificial Sequence
  chemically synthesized
gcaattaaaaatatttaagtga

SEQ ID NO: 1382994 - DNA, 22 bp, Artificial Sequence
  chemically synthesized
cgcaattaaaaatatttaagtg

SEQ ID NO: 1382995 - DNA, 22 bp, Artificial Sequence
  chemically synthesized
ttcgcaattaaaaatatttaag

SEQ ID NO: 1382996 - DNA, 22 bp, Artificial Sequence
  chemically synthesized
cttcgcaattaaaaatatttaa

SEQ ID NO: 1382997 - DNA, 22 bp, Artificial Sequence
  chemically synthesized
tactgtcacttaaatattttta

SEQ ID NO: 1382998 - DNA, 22 bp, Artificial Sequence
  chemically synthesized
tcacttaaatatttttaattgc

SEQ ID NO: 1382999 - DNA, 22 bp, Artificial Sequence
  chemically synthesized
atgagatgtttcttcgcaatta

SEQ ID NO: 1383000 - DNA, 22 bp, Artificial Sequence
  chemically synthesized
gatgagatgtttcttcgcaatt

SEQ ID NO: 1383001 - DNA, 22 bp, Artificial Sequence
  chemically synthesized
aaatatttttaattgcgaagaa

SEQ ID NO: 1383002 - DNA, 22 bp, Artificial Sequence
  chemically synthesized
aatatttttaattgcgaagaaa

SEQ ID NO: 1383003 - DNA, 22 bp, Artificial Sequence
  chemically synthesized
cttgatgagatgtttcttcgca

SEQ ID NO: 1383004 - DNA, 22 bp, Artificial Sequence
  chemically synthesized
acttgatgagatgtttcttcgc

SEQ ID NO: 1383005 - DNA, 22 bp, Artificial Sequence
  chemically synthesized
tacttgatgagatgtttcttcg

SEQ ID NO: 1383006 - DNA, 22 bp, Artificial Sequence
  chemically synthesized
ttacttgatgagatgtttcttc

SEQ ID NO: 1383007 - DNA, 22 bp, Artificial Sequence
  chemically synthesized
tttacttgatgagatgtttctt

SEQ ID NO: 1383008 - DNA, 22 bp, Artificial Sequence
  chemically synthesized
ttaattgcgaagaaacatctca

SEQ ID NO: 1383009 - DNA, 22 bp, Artificial Sequence
  chemically synthesized
ctttttacttgatgagatgttt

SEQ ID NO: 1383010 - DNA, 22 bp, Artificial Sequence
  chemically synthesized
taattgcgaagaaacatctcat

SEQ ID NO: 1383011 - DNA, 22 bp, Artificial Sequence
  chemically synthesized
aattgcgaagaaacatctcatc

SEQ ID NO: 1383012 - DNA, 22 bp, Artificial Sequence
  chemically synthesized
attgcgaagaaacatctcatca

SEQ ID NO: 1383013 - DNA, 22 bp, Artificial Sequence
  chemically synthesized
tctactttttacttgatgagat

SEQ ID NO: 1383014 - DNA, 22 bp, Artificial Sequence
  chemically synthesized
atctactttttacttgatgaga

SEQ ID NO: 1383015 - DNA, 22 bp, Artificial Sequence
  chemically synthesized
cgaagaaacatctcatcaagta

SEQ ID NO: 1383016 - DNA, 22 bp, Artificial Sequence
  chemically synthesized
ttatctactttttacttgatga

SEQ ID NO: 1383017 - DNA, 22 bp, Artificial Sequence
  chemically synthesized
ttcttatctactttttacttga

SEQ ID NO: 1383018 - DNA, 22 bp, Artificial Sequence
  chemically synthesized
attcttatctactttttacttg

SEQ ID NO: 1383019 - DNA, 22 bp, Artificial Sequence
  chemically synthesized
tttattcttatctactttttac

SEQ ID NO: 1383020 - DNA, 22 bp, Artificial Sequence
  chemically synthesized
gtttattcttatctacttttta

SEQ ID NO: 1383021 - DNA, 22 bp, Artificial Sequence
  chemically synthesized
atcaagtaaaaagtagataaga

SEQ ID NO: 1383022 - DNA, 22 bp, Artificial Sequence
  chemically synthesized
gcgtcttgtttattcttatcta

SEQ ID NO: 1383023 - DNA, 22 bp, Artificial Sequence
  chemically synthesized
agcgtcttgtttattcttatct

SEQ ID NO: 1383024 - DNA, 22 bp, Artificial Sequence
  chemically synthesized
tgcttagcgtcttgtttattct

SEQ ID NO: 1383025 - DNA, 22 bp, Artificial Sequence
  chemically synthesized
tctatgcttagcgtcttgttta

SEQ ID NO: 1383026 - DNA, 22 bp, Artificial Sequence
  chemically synthesized
tgtctatgcttagcgtcttgtt

SEQ ID NO: 1383027 - DNA, 22 bp, Artificial Sequence
  chemically synthesized
ctgtctatgcttagcgtcttgt

SEQ ID NO: 1383028 - DNA, 22 bp, Artificial Sequence
  chemically synthesized
tctgtctatgcttagcgtcttg

SEQ ID NO: 1383029 - DNA, 22 bp, Artificial Sequence
  chemically synthesized
aaataggacactttctgtctat

SEQ ID NO: 1383030 - DNA, 22 bp, Artificial Sequence
  chemically synthesized
cattaaaataggacactttctg

SEQ ID NO: 1383031 - DNA, 22 bp, Artificial Sequence
  chemically synthesized
tgcattaaaataggacactttc

SEQ ID NO: 1383032 - DNA, 22 bp, Artificial Sequence
  chemically synthesized
ctgcattaaaataggacacttt

SEQ ID NO: 1383033 - DNA, 22 bp, Artificial Sequence
  chemically synthesized
agcatagacagaaagtgtccta

SEQ ID NO: 1383034 - DNA, 22 bp, Artificial Sequence
  chemically synthesized
tctgcattaaaataggacactt

SEQ ID NO: 1383035 - DNA, 22 bp, Artificial Sequence
  chemically synthesized
ttctgcattaaaataggacact

SEQ ID NO: 1383036 - DNA, 22 bp, Artificial Sequence
  chemically synthesized
tttctgcattaaaataggacac

SEQ ID NO: 1383037 - DNA, 22 bp, Artificial Sequence
  chemically synthesized
ttttctgcattaaaataggaca

SEQ ID NO: 1383038 - DNA, 22 bp, Artificial Sequence
  chemically synthesized
aaaacttttttctgcattaaaa

SEQ ID NO: 1383039 - DNA, 22 bp, Artificial Sequence
  chemically synthesized
ttgaaaacttttttctgcatta

SEQ ID NO: 1383040 - DNA, 22 bp, Artificial Sequence
  chemically synthesized
attgaaaacttttttctgcatt

SEQ ID NO: 1383041 - DNA, 22 bp, Artificial Sequence
  chemically synthesized
tattgaaaacttttttctgcat

SEQ ID NO: 1383042 - DNA, 22 bp, Artificial Sequence
  chemically synthesized
gattttattgaaaacttttttc

SEQ ID NO: 1383043 - DNA, 22 bp, Artificial Sequence
  chemically synthesized
ttttaatgcagaaaaaagtttt

SEQ ID NO: 1383044 - DNA, 22 bp, Artificial Sequence
  chemically synthesized
taatgcagaaaaaagttttcaa

SEQ ID NO: 1383045 - DNA, 22 bp, Artificial Sequence
  chemically synthesized
aatgcagaaaaaagttttcaat

SEQ ID NO: 1383046 - DNA, 22 bp, Artificial Sequence
  chemically synthesized
atgcagaaaaaagttttcaata

SEQ ID NO: 1383047 - DNA, 22 bp, Artificial Sequence
  chemically synthesized
tcatgaagggatgttggatttt

SEQ ID NO: 1383048 - DNA, 22 bp, Artificial Sequence
  chemically synthesized
atcatgaagggatgttggattt

SEQ ID NO: 1383049 - DNA, 22 bp, Artificial Sequence
  chemically synthesized
tatcatgaagggatgttggatt

SEQ ID NO: 1383050 - DNA, 22 bp, Artificial Sequence
  chemically synthesized
ttatcatgaagggatgttggat

SEQ ID NO: 1383051 - DNA, 22 bp, Artificial Sequence
  chemically synthesized
tcaataaaatccaacatccctt

SEQ ID NO: 1383052 - DNA, 22 bp, Artificial Sequence
  chemically synthesized
caataaaatccaacatcccttc

SEQ ID NO: 1383053 - DNA, 22 bp, Artificial Sequence
  chemically synthesized
aataaaatccaacatcccttca

SEQ ID NO: 1383054 - DNA, 22 bp, Artificial Sequence
  chemically synthesized
agggtttttatcatgaagggat

SEQ ID NO: 1383055 - DNA, 22 bp, Artificial Sequence
  chemically synthesized
ttgagggtttttatcatgaagg

SEQ ID NO: 1383056 - DNA, 22 bp, Artificial Sequence
  chemically synthesized
gtctgttgagggtttttatcat

SEQ ID NO: 1383057 - DNA, 22 bp, Artificial Sequence
  chemically synthesized
agtgcctagtctgttgagggtt

SEQ ID NO: 1383058 - DNA, 22 bp, Artificial Sequence
  chemically synthesized
cagtgcctagtctgttgagggt

SEQ ID NO: 1383059 - DNA, 22 bp, Artificial Sequence
  chemically synthesized
catgataaaaaccctcaacaga

SEQ ID NO: 1383060 - DNA, 22 bp, Artificial Sequence
  chemically synthesized
atgataaaaaccctcaacagac

SEQ ID NO: 1383061 - DNA, 22 bp, Artificial Sequence
  chemically synthesized
cttcagtgcctagtctgttgag

SEQ ID NO: 1383062 - DNA, 22 bp, Artificial Sequence
  chemically synthesized
aggtatgttccttcagtgccta

SEQ ID NO: 1383063 - DNA, 22 bp, Artificial Sequence
  chemically synthesized
gaggtatgttccttcagtgcct

SEQ ID NO: 1383064 - DNA, 22 bp, Artificial Sequence
  chemically synthesized
tgaggtatgttccttcagtgcc

SEQ ID NO: 1383065 - DNA, 22 bp, Artificial Sequence
  chemically synthesized
aacagactaggcactgaaggaa

SEQ ID NO: 1383066 - DNA, 22 bp, Artificial Sequence
  chemically synthesized
ttttgaggtatgttccttcagt

SEQ ID NO: 1383067 - DNA, 22 bp, Artificial Sequence
  chemically synthesized
ttattttgaggtatgttccttc

SEQ ID NO: 1383068 - DNA, 22 bp, Artificial Sequence
  chemically synthesized
attattttgaggtatgttcctt

SEQ ID NO: 1383069 - DNA, 22 bp, Artificial Sequence
  chemically synthesized
ttattattttgaggtatgttcc

SEQ ID NO: 1383070 - DNA, 22 bp, Artificial Sequence
  chemically synthesized
ggcactgaaggaacatacctca

SEQ ID NO: 1383071 - DNA, 22 bp, Artificial Sequence
  chemically synthesized
aaggaacatacctcaaaataat

SEQ ID NO: 1383072 - DNA, 22 bp, Artificial Sequence
  chemically synthesized
tcatagatggttcttattattt

SEQ ID NO: 1383073 - DNA, 22 bp, Artificial Sequence
  chemically synthesized
gtcatagatggttcttattatt

SEQ ID NO: 1383074 - DNA, 22 bp, Artificial Sequence
  chemically synthesized
tggatttgtcatagatggttct

SEQ ID NO: 1383075 - DNA, 22 bp, Artificial Sequence
  chemically synthesized
aaaataataagaaccatctatg

SEQ ID NO: 1383076 - DNA, 22 bp, Artificial Sequence
  chemically synthesized
gctatggatttgtcatagatgg

SEQ ID NO: 1383077 - DNA, 22 bp, Artificial Sequence
  chemically synthesized
ggtatgatgttggctatggatt

SEQ ID NO: 1383078 - DNA, 22 bp, Artificial Sequence
  chemically synthesized
tgacaaatccatagccaacatc

SEQ ID NO: 1383079 - DNA, 22 bp, Artificial Sequence
  chemically synthesized
cccattcggtatgatgttggct

SEQ ID NO: 1383080 - DNA, 22 bp, Artificial Sequence
  chemically synthesized
gcccattcggtatgatgttggc

SEQ ID NO: 1383081 - DNA, 22 bp, Artificial Sequence
  chemically synthesized
tgcccattcggtatgatgttgg

SEQ ID NO: 1383082 - DNA, 22 bp, Artificial Sequence
  chemically synthesized
ttgcccattcggtatgatgttg

SEQ ID NO: 1383083 - DNA, 22 bp, Artificial Sequence
  chemically synthesized
caacttttgcccattcggtatg

SEQ ID NO: 1383084 - DNA, 22 bp, Artificial Sequence
  chemically synthesized
agtgggaatcgttccaactttt

SEQ ID NO: 1383085 - DNA, 22 bp, Artificial Sequence
  chemically synthesized
tcagtgggaatcgttccaactt

SEQ ID NO: 1383086 - DNA, 22 bp, Artificial Sequence
  chemically synthesized
cagttctcagtgggaatcgttc

SEQ ID NO: 1383087 - DNA, 22 bp, Artificial Sequence
  chemically synthesized
ttccagttctcagtgggaatcg

SEQ ID NO: 1383088 - DNA, 22 bp, Artificial Sequence
  chemically synthesized
gttccagttctcagtgggaatc

SEQ ID NO: 1383089 - DNA, 22 bp, Artificial Sequence
  chemically synthesized
tgttccagttctcagtgggaat

SEQ ID NO: 1383090 - DNA, 22 bp, Artificial Sequence
  chemically synthesized
ttttgttccagttctcagtggg

SEQ ID NO: 1383091 - DNA, 22 bp, Artificial Sequence
  chemically synthesized
gttttgttccagttctcagtgg

SEQ ID NO: 1383092 - DNA, 22 bp, Artificial Sequence
  chemically synthesized
gaacgattcccactgagaactg

SEQ ID NO: 1383093 - DNA, 22 bp, Artificial Sequence
  chemically synthesized
ccactgagaactggaacaaaac

SEQ ID NO: 1383094 - DNA, 22 bp, Artificial Sequence
  chemically synthesized
agaactggaacaaaacaaggat

SEQ ID NO: 1383095 - DNA, 22 bp, Artificial Sequence
  chemically synthesized
gtgagagtgggcatccttgttt

SEQ ID NO: 1383096 - DNA, 22 bp, Artificial Sequence
  chemically synthesized
gaacaaaacaaggatgcccact

SEQ ID NO: 1383097 - DNA, 22 bp, Artificial Sequence
  chemically synthesized
ataaaactggtgagagtgggca

SEQ ID NO: 1383098 - DNA, 22 bp, Artificial Sequence
  chemically synthesized
aataaaactggtgagagtgggc

SEQ ID NO: 1383099 - DNA, 22 bp, Artificial Sequence
  chemically synthesized
tgtttaataaaactggtgagag

SEQ ID NO: 1383100 - DNA, 22 bp, Artificial Sequence
  chemically synthesized
cagtactatgtttaataaaact

SEQ ID NO: 1383101 - DNA, 22 bp, Artificial Sequence
  chemically synthesized
ccagtactatgtttaataaaac

SEQ ID NO: 1383102 - DNA, 22 bp, Artificial Sequence
  chemically synthesized
tcaccagttttattaaacatag

SEQ ID NO: 1383103 - DNA, 22 bp, Artificial Sequence
  chemically synthesized
ggacttccagtactatgtttaa

SEQ ID NO: 1383104 - DNA, 22 bp, Artificial Sequence
  chemically synthesized
accagttttattaaacatagta

SEQ ID NO: 1383105 - DNA, 22 bp, Artificial Sequence
  chemically synthesized
tggctaggacttccagtactat

SEQ ID NO: 1383106 - DNA, 22 bp, Artificial Sequence
  chemically synthesized
ctgtggctaggacttccagtac

SEQ ID NO: 1383107 - DNA, 22 bp, Artificial Sequence
  chemically synthesized
tattaaacatagtactggaagt

SEQ ID NO: 1383108 - DNA, 22 bp, Artificial Sequence
  chemically synthesized
attaaacatagtactggaagtc

SEQ ID NO: 1383109 - DNA, 22 bp, Artificial Sequence
  chemically synthesized
ttaaacatagtactggaagtcc

SEQ ID NO: 1383110 - DNA, 22 bp, Artificial Sequence
  chemically synthesized
attgctgtggctaggacttcca

SEQ ID NO: 1383111 - DNA, 22 bp, Artificial Sequence
  chemically synthesized
aacatagtactggaagtcctag

SEQ ID NO: 1383112 - DNA, 22 bp, Artificial Sequence
  chemically synthesized
cctaattgctgtggctaggact

SEQ ID NO: 1383113 - DNA, 22 bp, Artificial Sequence
  chemically synthesized
gcctaattgctgtggctaggac

SEQ ID NO: 1383114 - DNA, 22 bp, Artificial Sequence
  chemically synthesized
ttgcctaattgctgtggctagg

SEQ ID NO: 1383115 - DNA, 22 bp, Artificial Sequence
  chemically synthesized
tcttgcctaattgctgtggcta

SEQ ID NO: 1383116 - DNA, 22 bp, Artificial Sequence
  chemically synthesized
ctcttgcctaattgctgtggct

SEQ ID NO: 1383117 - DNA, 22 bp, Artificial Sequence
  chemically synthesized
tctcttgcctaattgctgtggc

SEQ ID NO: 1383118 - DNA, 22 bp, Artificial Sequence
  chemically synthesized
tttctcttgcctaattgctgtg

SEQ ID NO: 1383119 - DNA, 22 bp, Artificial Sequence
  chemically synthesized
gaagtcctagccacagcaatta

SEQ ID NO: 1383120 - DNA, 22 bp, Artificial Sequence
  chemically synthesized
ctttctcttgcctaattgctgt

SEQ ID NO: 1383121 - DNA, 22 bp, Artificial Sequence
  chemically synthesized
tttctttctcttgcctaattgc

SEQ ID NO: 1383122 - DNA, 22 bp, Artificial Sequence
  chemically synthesized
atttctttctcttgcctaattg

SEQ ID NO: 1383123 - DNA, 22 bp, Artificial Sequence
  chemically synthesized
tatttctttctcttgcctaatt

SEQ ID NO: 1383124 - DNA, 22 bp, Artificial Sequence
  chemically synthesized
gccacagcaattaggcaagaga

SEQ ID NO: 1383125 - DNA, 22 bp, Artificial Sequence
  chemically synthesized
gatgcattttatttctttctct

SEQ ID NO: 1383126 - DNA, 22 bp, Artificial Sequence
  chemically synthesized
ggatgcattttatttctttctc

SEQ ID NO: 1383127 - DNA, 22 bp, Artificial Sequence
  chemically synthesized
tttggatgcattttatttcttt

SEQ ID NO: 1383128 - DNA, 22 bp, Artificial Sequence
  chemically synthesized
tatttggatgcattttatttct

SEQ ID NO: 1383129 - DNA, 22 bp, Artificial Sequence
  chemically synthesized
ctatttggatgcattttatttc

SEQ ID NO: 1383130 - DNA, 22 bp, Artificial Sequence
  chemically synthesized
ggcaagagaaagaaataaaatg

SEQ ID NO: 1383131 - DNA, 22 bp, Artificial Sequence
  chemically synthesized
tctatttggatgcattttattt

SEQ ID NO: 1383132 - DNA, 22 bp, Artificial Sequence
  chemically synthesized
ttctatttggatgcattttatt

SEQ ID NO: 1383133 - DNA, 22 bp, Artificial Sequence
  chemically synthesized
tttctatttggatgcattttat

SEQ ID NO: 1383134 - DNA, 22 bp, Artificial Sequence
  chemically synthesized
tttttctatttggatgcatttt

SEQ ID NO: 1383135 - DNA, 22 bp, Artificial Sequence
  chemically synthesized
ctttttctatttggatgcattt

SEQ ID NO: 1383136 - DNA, 22 bp, Artificial Sequence
  chemically synthesized
acttctttttctatttggatgc

SEQ ID NO: 1383137 - DNA, 22 bp, Artificial Sequence
  chemically synthesized
gacttctttttctatttggatg

SEQ ID NO: 1383138 - DNA, 22 bp, Artificial Sequence
  chemically synthesized
agtatagaatcataccgtcagt

SEQ ID NO: 1383139 - DNA, 22 bp, Artificial Sequence
  chemically synthesized
taagtatagaatcataccgtca

SEQ ID NO: 1383140 - DNA, 22 bp, Artificial Sequence
  chemically synthesized
tcttttttcactgacggtatga

SEQ ID NO: 1383141 - DNA, 22 bp, Artificial Sequence
  chemically synthesized
ctaagtatagaatcataccgtc

SEQ ID NO: 1383142 - DNA, 22 bp, Artificial Sequence
  chemically synthesized
tctaagtatagaatcataccgt

SEQ ID NO: 1383143 - DNA, 22 bp, Artificial Sequence
  chemically synthesized
ttttcactgacggtatgattct

SEQ ID NO: 1383144 - DNA, 22 bp, Artificial Sequence
  chemically synthesized
tttcactgacggtatgattcta

SEQ ID NO: 1383145 - DNA, 22 bp, Artificial Sequence
  chemically synthesized
ttcactgacggtatgattctat

SEQ ID NO: 1383146 - DNA, 22 bp, Artificial Sequence
  chemically synthesized
ggttttctaagtatagaatcat

SEQ ID NO: 1383147 - DNA, 22 bp, Artificial Sequence
  chemically synthesized
tcactgacggtatgattctata

SEQ ID NO: 1383148 - DNA, 22 bp, Artificial Sequence
  chemically synthesized
gggttttctaagtatagaatca

SEQ ID NO: 1383149 - DNA, 22 bp, Artificial Sequence
  chemically synthesized
cactgacggtatgattctatac

SEQ ID NO: 1383150 - DNA, 22 bp, Artificial Sequence
  chemically synthesized
tgggttttctaagtatagaatc

SEQ ID NO: 1383151 - DNA, 22 bp, Artificial Sequence
  chemically synthesized
actgacggtatgattctatact

SEQ ID NO: 1383152 - DNA, 22 bp, Artificial Sequence
  chemically synthesized
acggtatgattctatacttaga

SEQ ID NO: 1383153 - DNA, 22 bp, Artificial Sequence
  chemically synthesized
gtggagtctttgggttttctaa

SEQ ID NO: 1383154 - DNA, 22 bp, Artificial Sequence
  chemically synthesized
ggtggagtctttgggttttcta

SEQ ID NO: 1383155 - DNA, 22 bp, Artificial Sequence
  chemically synthesized
tggtggagtctttgggttttct

SEQ ID NO: 1383156 - DNA, 22 bp, Artificial Sequence
  chemically synthesized
ttggtggagtctttgggttttc

SEQ ID NO: 1383157 - DNA, 22 bp, Artificial Sequence
  chemically synthesized
tatacttagaaaacccaaagac

SEQ ID NO: 1383158 - DNA, 22 bp, Artificial Sequence
  chemically synthesized
tacttagaaaacccaaagactc

SEQ ID NO: 1383159 - DNA, 22 bp, Artificial Sequence
  chemically synthesized
gtagccttttggtggagtcttt

SEQ ID NO: 1383160 - DNA, 22 bp, Artificial Sequence
  chemically synthesized
tagtagccttttggtggagtct

SEQ ID NO: 1383161 - DNA, 22 bp, Artificial Sequence
  chemically synthesized
agaaaacccaaagactccacca

SEQ ID NO: 1383162 - DNA, 22 bp, Artificial Sequence
  chemically synthesized
gaaaacccaaagactccaccaa

SEQ ID NO: 1383163 - DNA, 22 bp, Artificial Sequence
  chemically synthesized
tcagttctagtagccttttggt

SEQ ID NO: 1383164 - DNA, 22 bp, Artificial Sequence
  chemically synthesized
atcagttctagtagccttttgg

SEQ ID NO: 1383165 - DNA, 22 bp, Artificial Sequence
  chemically synthesized
tttatcagttctagtagccttt

SEQ ID NO: 1383166 - DNA, 22 bp, Artificial Sequence
  chemically synthesized
aaattgtttatcagttctagta

SEQ ID NO: 1383167 - DNA, 22 bp, Artificial Sequence
  chemically synthesized
caccaaaaggctactagaactg

SEQ ID NO: 1383168 - DNA, 22 bp, Artificial Sequence
  chemically synthesized
gttaaaattgtttatcagttct

SEQ ID NO: 1383169 - DNA, 22 bp, Artificial Sequence
  chemically synthesized
aaacctcgttaaaattgtttat

SEQ ID NO: 1383170 - DNA, 22 bp, Artificial Sequence
  chemically synthesized
gaaacctcgttaaaattgttta

SEQ ID NO: 1383171 - DNA, 22 bp, Artificial Sequence
  chemically synthesized
ctagaactgataaacaatttta

SEQ ID NO: 1383172 - DNA, 22 bp, Artificial Sequence
  chemically synthesized
gaactgataaacaattttaacg

SEQ ID NO: 1383173 - DNA, 22 bp, Artificial Sequence
  chemically synthesized
tatatcttgaaacctcgttaaa

SEQ ID NO: 1383174 - DNA, 22 bp, Artificial Sequence
  chemically synthesized
ataaacaattttaacgaggttt

SEQ ID NO: 1383175 - DNA, 22 bp, Artificial Sequence
  chemically synthesized
tgtattgtatatcttgaaacct

SEQ ID NO: 1383176 - DNA, 22 bp, Artificial Sequence
  chemically synthesized
atgtattgtatatcttgaaacc

SEQ ID NO: 1383177 - DNA, 22 bp, Artificial Sequence
  chemically synthesized
tatgtattgtatatcttgaaac

SEQ ID NO: 1383178 - DNA, 22 bp, Artificial Sequence
  chemically synthesized
ttatgtattgtatatcttgaaa

SEQ ID NO: 1383179 - DNA, 22 bp, Artificial Sequence
  chemically synthesized
taacgaggtttcaagatataca

SEQ ID NO: 1383180 - DNA, 22 bp, Artificial Sequence
  chemically synthesized
aacgaggtttcaagatatacaa

SEQ ID NO: 1383181 - DNA, 22 bp, Artificial Sequence
  chemically synthesized
acgaggtttcaagatatacaat

SEQ ID NO: 1383182 - DNA, 22 bp, Artificial Sequence
  chemically synthesized
taaaaatatatttttatgtatt

SEQ ID NO: 1383183 - DNA, 22 bp, Artificial Sequence
  chemically synthesized
caagatatacaatacataaaaa

SEQ ID NO: 1383184 - DNA, 22 bp, Artificial Sequence
  chemically synthesized
aagatatacaatacataaaaat

SEQ ID NO: 1383185 - DNA, 22 bp, Artificial Sequence
  chemically synthesized
ctataaaaatatatttttatgt

SEQ ID NO: 1383186 - DNA, 22 bp, Artificial Sequence
  chemically synthesized
actataaaaatatatttttatg

SEQ ID NO: 1383187 - DNA, 22 bp, Artificial Sequence
  chemically synthesized
tactataaaaatatatttttat

SEQ ID NO: 1383188 - DNA, 22 bp, Artificial Sequence
  chemically synthesized
tatgttttactataaaaatata

SEQ ID NO: 1383189 - DNA, 22 bp, Artificial Sequence
  chemically synthesized
atatgttttactataaaaatat

SEQ ID NO: 1383190 - DNA, 22 bp, Artificial Sequence
  chemically synthesized
tatatgttttactataaaaata

SEQ ID NO: 1383191 - DNA, 22 bp, Artificial Sequence
  chemically synthesized
ttatatgttttactataaaaat

SEQ ID NO: 1383192 - DNA, 22 bp, Artificial Sequence
  chemically synthesized
atttttatatgttttactataa

SEQ ID NO: 1383193 - DNA, 22 bp, Artificial Sequence
  chemically synthesized
ttaatttttatatgttttacta

SEQ ID NO: 1383194 - DNA, 22 bp, Artificial Sequence
  chemically synthesized
ttatagtaaaacatataaaaat

SEQ ID NO: 1383195 - DNA, 22 bp, Artificial Sequence
  chemically synthesized
tatagtaaaacatataaaaatt

SEQ ID NO: 1383196 - DNA, 22 bp, Artificial Sequence
  chemically synthesized
atagtaaaacatataaaaatta

SEQ ID NO: 1383197 - DNA, 22 bp, Artificial Sequence
  chemically synthesized
tagtaaaacatataaaaattaa

SEQ ID NO: 1383198 - DNA, 22 bp, Artificial Sequence
  chemically synthesized
tatagaaatgctattaattttt

SEQ ID NO: 1383199 - DNA, 22 bp, Artificial Sequence
  chemically synthesized
ttgtatagaaatgctattaatt

SEQ ID NO: 1383200 - DNA, 22 bp, Artificial Sequence
  chemically synthesized
ttgttgtatagaaatgctatta

SEQ ID NO: 1383201 - DNA, 22 bp, Artificial Sequence
  chemically synthesized
gtcattattgttgtatagaaat

SEQ ID NO: 1383202 - DNA, 22 bp, Artificial Sequence
  chemically synthesized
ggtcattattgttgtatagaaa

SEQ ID NO: 1383203 - DNA, 22 bp, Artificial Sequence
  chemically synthesized
agcttggtcattattgttgtat

SEQ ID NO: 1383204 - DNA, 22 bp, Artificial Sequence
  chemically synthesized
atagcatttctatacaacaata

SEQ ID NO: 1383205 - DNA, 22 bp, Artificial Sequence
  chemically synthesized
tcagcttggtcattattgttgt

SEQ ID NO: 1383206 - DNA, 22 bp, Artificial Sequence
  chemically synthesized
actctcagcttggtcattattg

SEQ ID NO: 1383207 - DNA, 22 bp, Artificial Sequence
  chemically synthesized
gactctcagcttggtcattatt

SEQ ID NO: 1383208 - DNA, 22 bp, Artificial Sequence
  chemically synthesized
ctatacaacaataatgaccaag

SEQ ID NO: 1383209 - DNA, 22 bp, Artificial Sequence
  chemically synthesized
tatacaacaataatgaccaagc

SEQ ID NO: 1383210 - DNA, 22 bp, Artificial Sequence
  chemically synthesized
atttgactctcagcttggtcat

SEQ ID NO: 1383211 - DNA, 22 bp, Artificial Sequence
  chemically synthesized
catttgactctcagcttggtca

SEQ ID NO: 1383212 - DNA, 22 bp, Artificial Sequence
  chemically synthesized
tacaacaataatgaccaagctg

SEQ ID NO: 1383213 - DNA, 22 bp, Artificial Sequence
  chemically synthesized
ttcatttgactctcagcttggt

SEQ ID NO: 1383214 - DNA, 22 bp, Artificial Sequence
  chemically synthesized
tgttcttcatttgactctcagc

SEQ ID NO: 1383215 - DNA, 22 bp, Artificial Sequence
  chemically synthesized
taaatgggattgtgttcttcat

SEQ ID NO: 1383216 - DNA, 22 bp, Artificial Sequence
  chemically synthesized
ttgtaaatgggattgtgttctt

SEQ ID NO: 1383217 - DNA, 22 bp, Artificial Sequence
  chemically synthesized
agagtcaaatgaagaacacaat

SEQ ID NO: 1383218 - DNA, 22 bp, Artificial Sequence
  chemically synthesized
gctattgtaaatgggattgtgt

SEQ ID NO: 1383219 - DNA, 22 bp, Artificial Sequence
  chemically synthesized
ggctattgtaaatgggattgtg

SEQ ID NO: 1383220 - DNA, 22 bp, Artificial Sequence
  chemically synthesized
tggctattgtaaatgggattgt

SEQ ID NO: 1383221 - DNA, 22 bp, Artificial Sequence
  chemically synthesized
tttggctattgtaaatgggatt

SEQ ID NO: 1383222 - DNA, 22 bp, Artificial Sequence
  chemically synthesized
ctttggctattgtaaatgggat

SEQ ID NO: 1383223 - DNA, 22 bp, Artificial Sequence
  chemically synthesized
tctttggctattgtaaatggga

SEQ ID NO: 1383224 - DNA, 22 bp, Artificial Sequence
  chemically synthesized
attttctttggctattgtaaat

SEQ ID NO: 1383225 - DNA, 22 bp, Artificial Sequence
  chemically synthesized
cattttctttggctattgtaaa

SEQ ID NO: 1383226 - DNA, 22 bp, Artificial Sequence
  chemically synthesized
ggtatttcattttctttggcta

SEQ ID NO: 1383227 - DNA, 22 bp, Artificial Sequence
  chemically synthesized
ctaggtatttcattttctttgg

SEQ ID NO: 1383228 - DNA, 22 bp, Artificial Sequence
  chemically synthesized
acaatagccaaagaaaatgaaa

SEQ ID NO: 1383229 - DNA, 22 bp, Artificial Sequence
  chemically synthesized
caatagccaaagaaaatgaaat

SEQ ID NO: 1383230 - DNA, 22 bp, Artificial Sequence
  chemically synthesized
ggtgtattcctaggtatttcat

SEQ ID NO: 1383231 - DNA, 22 bp, Artificial Sequence
  chemically synthesized
gttaggtgtattcctaggtatt

SEQ ID NO: 1383232 - DNA, 22 bp, Artificial Sequence
  chemically synthesized
ggttaggtgtattcctaggtat

SEQ ID NO: 1383233 - DNA, 22 bp, Artificial Sequence
  chemically synthesized
agcatcttggttaggtgtattc

SEQ ID NO: 1383234 - DNA, 22 bp, Artificial Sequence
  chemically synthesized
cagcatcttggttaggtgtatt

SEQ ID NO: 1383235 - DNA, 22 bp, Artificial Sequence
  chemically synthesized
tcagcatcttggttaggtgtat

SEQ ID NO: 1383236 - DNA, 22 bp, Artificial Sequence
  chemically synthesized
ggaatacacctaaccaagatgc

SEQ ID NO: 1383237 - DNA, 22 bp, Artificial Sequence
  chemically synthesized
cagagatctttcagcatcttgg

SEQ ID NO: 1383238 - DNA, 22 bp, Artificial Sequence
  chemically synthesized
acagagatctttcagcatcttg

SEQ ID NO: 1383239 - DNA, 22 bp, Artificial Sequence
  chemically synthesized
cttacagagatctttcagcatc

SEQ ID NO: 1383240 - DNA, 22 bp, Artificial Sequence
  chemically synthesized
atactccttacagagatctttc

SEQ ID NO: 1383241 - DNA, 22 bp, Artificial Sequence
  chemically synthesized
accaagatgctgaaagatctct

SEQ ID NO: 1383242 - DNA, 22 bp, Artificial Sequence
  chemically synthesized
aatactccttacagagatcttt

SEQ ID NO: 1383243 - DNA, 22 bp, Artificial Sequence
  chemically synthesized
taatactccttacagagatctt

SEQ ID NO: 1383244 - DNA, 22 bp, Artificial Sequence
  chemically synthesized
ttaatactccttacagagatct

SEQ ID NO: 1383245 - DNA, 22 bp, Artificial Sequence
  chemically synthesized
tttaatactccttacagagatc

SEQ ID NO: 1383246 - DNA, 22 bp, Artificial Sequence
  chemically synthesized
aaagatctctgtaaggagtatt

SEQ ID NO: 1383247 - DNA, 22 bp, Artificial Sequence
  chemically synthesized
aacaatgttttttaatactcct

SEQ ID NO: 1383248 - DNA, 22 bp, Artificial Sequence
  chemically synthesized
caacaatgttttttaatactcc

SEQ ID NO: 1383249 - DNA, 22 bp, Artificial Sequence
  chemically synthesized
tcaacaatgttttttaatactc

SEQ ID NO: 1383250 - DNA, 22 bp, Artificial Sequence
  chemically synthesized
tttcaacaatgttttttaatac

SEQ ID NO: 1383251 - DNA, 22 bp, Artificial Sequence
  chemically synthesized
ctttcaacaatgttttttaata

SEQ ID NO: 1383252 - DNA, 22 bp, Artificial Sequence
  chemically synthesized
tgtaaggagtattaaaaaacat

SEQ ID NO: 1383253 - DNA, 22 bp, Artificial Sequence
  chemically synthesized
taaggagtattaaaaaacattg

SEQ ID NO: 1383254 - DNA, 22 bp, Artificial Sequence
  chemically synthesized
tgtttctttcaacaatgttttt

SEQ ID NO: 1383255 - DNA, 22 bp, Artificial Sequence
  chemically synthesized
tctgtgtttctttcaacaatgt

SEQ ID NO: 1383256 - DNA, 22 bp, Artificial Sequence
  chemically synthesized
atctgtgtttctttcaacaatg

SEQ ID NO: 1383257 - DNA, 22 bp, Artificial Sequence
  chemically synthesized
gtttatctgtgtttctttcaac

SEQ ID NO: 1383258 - DNA, 22 bp, Artificial Sequence
  chemically synthesized
cgtttatctgtgtttctttcaa

SEQ ID NO: 1383259 - DNA, 22 bp, Artificial Sequence
  chemically synthesized
tcgtttatctgtgtttctttca

SEQ ID NO: 1383260 - DNA, 22 bp, Artificial Sequence
  chemically synthesized
aaaaacattgttgaaagaaaca

SEQ ID NO: 1383261 - DNA, 22 bp, Artificial Sequence
  chemically synthesized
ttcgtttatctgtgtttctttc

SEQ ID NO: 1383262 - DNA, 22 bp, Artificial Sequence
  chemically synthesized
tttcgtttatctgtgtttcttt

SEQ ID NO: 1383263 - DNA, 22 bp, Artificial Sequence
  chemically synthesized
ttgaaagaaacacagataaacg

SEQ ID NO: 1383264 - DNA, 22 bp, Artificial Sequence
  chemically synthesized
aaagaaacacagataaacgaaa

SEQ ID NO: 1383265 - DNA, 22 bp, Artificial Sequence
  chemically synthesized
caatgagcatggaatgcttttt

SEQ ID NO: 1383266 - DNA, 22 bp, Artificial Sequence
  chemically synthesized
ccaatgagcatggaatgctttt

SEQ ID NO: 1383267 - DNA, 22 bp, Artificial Sequence
  chemically synthesized
ttccaatgagcatggaatgctt

SEQ ID NO: 1383268 - DNA, 22 bp, Artificial Sequence
  chemically synthesized
cttccaatgagcatggaatgct

SEQ ID NO: 1383269 - DNA, 22 bp, Artificial Sequence
  chemically synthesized
tttcttccaatgagcatggaat

SEQ ID NO: 1383270 - DNA, 22 bp, Artificial Sequence
  chemically synthesized
tattgtttcttccaatgagcat

SEQ ID NO: 1383271 - DNA, 22 bp, Artificial Sequence
  chemically synthesized
attatattgtttcttccaatga

SEQ ID NO: 1383272 - DNA, 22 bp, Artificial Sequence
  chemically synthesized
aattatattgtttcttccaatg

SEQ ID NO: 1383273 - DNA, 22 bp, Artificial Sequence
  chemically synthesized
taattatattgtttcttccaat

SEQ ID NO: 1383274 - DNA, 22 bp, Artificial Sequence
  chemically synthesized
catgctcattggaagaaacaat

SEQ ID NO: 1383275 - DNA, 22 bp, Artificial Sequence
  chemically synthesized
attggaagaaacaatataatta

SEQ ID NO: 1383276 - DNA, 22 bp, Artificial Sequence
  chemically synthesized
gaagaaacaatataattaaaat

SEQ ID NO: 1383277 - DNA, 22 bp, Artificial Sequence
  chemically synthesized
tgcagtatagccattttaatta

SEQ ID NO: 1383278 - DNA, 22 bp, Artificial Sequence
  chemically synthesized
gtgcagtatagccattttaatt

SEQ ID NO: 1383279 - DNA, 22 bp, Artificial Sequence
  chemically synthesized
tgtgcagtatagccattttaat

SEQ ID NO: 1383280 - DNA, 22 bp, Artificial Sequence
  chemically synthesized
ttttgtgcagtatagccatttt

SEQ ID NO: 1383281 - DNA, 22 bp, Artificial Sequence
  chemically synthesized
taagttgttttgtgcagtatag

SEQ ID NO: 1383282 - DNA, 22 bp, Artificial Sequence
  chemically synthesized
aaatggctatactgcacaaaac

SEQ ID NO: 1383283 - DNA, 22 bp, Artificial Sequence
  chemically synthesized
aatctataagttgttttgtgca

SEQ ID NO: 1383284 - DNA, 22 bp, Artificial Sequence
  chemically synthesized
tactgcacaaaacaacttatag

SEQ ID NO: 1383285 - DNA, 22 bp, Artificial Sequence
  chemically synthesized
cacaaaacaacttatagattca

SEQ ID NO: 1383286 - DNA, 22 bp, Artificial Sequence
  chemically synthesized
ataaggacagcattgaatctat

SEQ ID NO: 1383287 - DNA, 22 bp, Artificial Sequence
  chemically synthesized
gataaggacagcattgaatcta

SEQ ID NO: 1383288 - DNA, 22 bp, Artificial Sequence
  chemically synthesized
gtagtttgataaggacagcatt

SEQ ID NO: 1383289 - DNA, 22 bp, Artificial Sequence
  chemically synthesized
ggtagtttgataaggacagcat

SEQ ID NO: 1383290 - DNA, 22 bp, Artificial Sequence
  chemically synthesized
atagattcaatgctgtccttat

SEQ ID NO: 1383291 - DNA, 22 bp, Artificial Sequence
  chemically synthesized
tagattcaatgctgtccttatc

SEQ ID NO: 1383292 - DNA, 22 bp, Artificial Sequence
  chemically synthesized
aatgctgtccttatcaaactac

SEQ ID NO: 1383293 - DNA, 22 bp, Artificial Sequence
  chemically synthesized
tgaggaatgaccttggtagttt

SEQ ID NO: 1383294 - DNA, 22 bp, Artificial Sequence
  chemically synthesized
tgtgaggaatgaccttggtagt

SEQ ID NO: 1383295 - DNA, 22 bp, Artificial Sequence
  chemically synthesized
tccttatcaaactaccaaggtc

SEQ ID NO: 1383296 - DNA, 22 bp, Artificial Sequence
  chemically synthesized
attctgtgaggaatgaccttgg

SEQ ID NO: 1383297 - DNA, 22 bp, Artificial Sequence
  chemically synthesized
taattctgtgaggaatgacctt

SEQ ID NO: 1383298 - DNA, 22 bp, Artificial Sequence
  chemically synthesized
atcaaactaccaaggtcattcc

SEQ ID NO: 1383299 - DNA, 22 bp, Artificial Sequence
  chemically synthesized
ctaattctgtgaggaatgacct

SEQ ID NO: 1383300 - DNA, 22 bp, Artificial Sequence
  chemically synthesized
tcaaactaccaaggtcattcct

SEQ ID NO: 1383301 - DNA, 22 bp, Artificial Sequence
  chemically synthesized
tctaattctgtgaggaatgacc

SEQ ID NO: 1383302 - DNA, 22 bp, Artificial Sequence
  chemically synthesized
ttctaattctgtgaggaatgac

SEQ ID NO: 1383303 - DNA, 22 bp, Artificial Sequence
  chemically synthesized
tttctaattctgtgaggaatga

SEQ ID NO: 1383304 - DNA, 22 bp, Artificial Sequence
  chemically synthesized
ttttttctaattctgtgaggaa

SEQ ID NO: 1383305 - DNA, 22 bp, Artificial Sequence
  chemically synthesized
ccaaggtcattcctcacagaat

SEQ ID NO: 1383306 - DNA, 22 bp, Artificial Sequence
  chemically synthesized
gaattgttttttctaattctgt

SEQ ID NO: 1383307 - DNA, 22 bp, Artificial Sequence
  chemically synthesized
agaattgttttttctaattctg

SEQ ID NO: 1383308 - DNA, 22 bp, Artificial Sequence
  chemically synthesized
tagaattgttttttctaattct

SEQ ID NO: 1383309 - DNA, 22 bp, Artificial Sequence
  chemically synthesized
ctcacagaattagaaaaaacaa

SEQ ID NO: 1383310 - DNA, 22 bp, Artificial Sequence
  chemically synthesized
acagaattagaaaaaacaattc

SEQ ID NO: 1383311 - DNA, 22 bp, Artificial Sequence
  chemically synthesized
catatgaattttagaattgttt

SEQ ID NO: 1383312 - DNA, 22 bp, Artificial Sequence
  chemically synthesized
gttgcatatgaattttagaatt

SEQ ID NO: 1383313 - DNA, 22 bp, Artificial Sequence
  chemically synthesized
ggttgcatatgaattttagaat

SEQ ID NO: 1383314 - DNA, 22 bp, Artificial Sequence
  chemically synthesized
tggttgcatatgaattttagaa

SEQ ID NO: 1383315 - DNA, 22 bp, Artificial Sequence
  chemically synthesized
ttggttgcatatgaattttaga

SEQ ID NO: 1383316 - DNA, 22 bp, Artificial Sequence
  chemically synthesized
gaaaaaacaattctaaaattca

SEQ ID NO: 1383317 - DNA, 22 bp, Artificial Sequence
  chemically synthesized
tttggttgcatatgaattttag

SEQ ID NO: 1383318 - DNA, 22 bp, Artificial Sequence
  chemically synthesized
ttttggttgcatatgaatttta

SEQ ID NO: 1383319 - DNA, 22 bp, Artificial Sequence
  chemically synthesized
tttttggttgcatatgaatttt

SEQ ID NO: 1383320 - DNA, 22 bp, Artificial Sequence
  chemically synthesized
ttttttggttgcatatgaattt

SEQ ID NO: 1383321 - DNA, 22 bp, Artificial Sequence
  chemically synthesized
tttttttggttgcatatgaatt

SEQ ID NO: 1383322 - DNA, 22 bp, Artificial Sequence
  chemically synthesized
ttttttttggttgcatatgaat

SEQ ID NO: 1383323 - DNA, 22 bp, Artificial Sequence
  chemically synthesized
tttttttttttggttgcatatg

SEQ ID NO: 1383324 - DNA, 22 bp, Artificial Sequence
  chemically synthesized
atttttttttttggttgcatat

SEQ ID NO: 1383325 - DNA, 22 bp, Artificial Sequence
  chemically synthesized
tatttttttttttggttgcata

SEQ ID NO: 1383326 - DNA, 22 bp, Artificial Sequence
  chemically synthesized
ttatttttttttttggttgcat

SEQ ID NO: 1383327 - DNA, 22 bp, Artificial Sequence
  chemically synthesized
taaaattcatatgcaaccaaaa

SEQ ID NO: 1383328 - DNA, 22 bp, Artificial Sequence
  chemically synthesized
ttttatttttttttttggttgc

SEQ ID NO: 1383329 - DNA, 22 bp, Artificial Sequence
  chemically synthesized
aaattcatatgcaaccaaaaaa

SEQ ID NO: 1383330 - DNA, 22 bp, Artificial Sequence
  chemically synthesized
atatgcaaccaaaaaaaaaaat

SEQ ID NO: 1383331 - DNA, 22 bp, Artificial Sequence
  chemically synthesized
tatgcgctcttttatttttttt

SEQ ID NO: 1383332 - DNA, 22 bp, Artificial Sequence
  chemically synthesized
ggctatatgcgctcttttattt

SEQ ID NO: 1383333 - DNA, 22 bp, Artificial Sequence
  chemically synthesized
cggctatatgcgctcttttatt

SEQ ID NO: 1383334 - DNA, 22 bp, Artificial Sequence
  chemically synthesized
ggatggcttcggctatatgcgc

SEQ ID NO: 1383335 - DNA, 22 bp, Artificial Sequence
  chemically synthesized
aggatggcttcggctatatgcg

SEQ ID NO: 1383336 - DNA, 22 bp, Artificial Sequence
  chemically synthesized
cttaggatggcttcggctatat

SEQ ID NO: 1383337 - DNA, 22 bp, Artificial Sequence
  chemically synthesized
ctgcttaggatggcttcggcta

SEQ ID NO: 1383338 - DNA, 22 bp, Artificial Sequence
  chemically synthesized
gctgcttaggatggcttcggct

SEQ ID NO: 1383339 - DNA, 22 bp, Artificial Sequence
  chemically synthesized
ttgctgcttaggatggcttcgg

SEQ ID NO: 1383340 - DNA, 22 bp, Artificial Sequence
  chemically synthesized
ttcttgctgcttaggatggctt

SEQ ID NO: 1383341 - DNA, 22 bp, Artificial Sequence
  chemically synthesized
gttcttgctgcttaggatggct

SEQ ID NO: 1383342 - DNA, 22 bp, Artificial Sequence
  chemically synthesized
tgttcttgctgcttaggatggc

SEQ ID NO: 1383343 - DNA, 22 bp, Artificial Sequence
  chemically synthesized
caattttgttcttgctgcttag

SEQ ID NO: 1383344 - DNA, 22 bp, Artificial Sequence
  chemically synthesized
tagtgtgatgcctccaattttg

SEQ ID NO: 1383345 - DNA, 22 bp, Artificial Sequence
  chemically synthesized
agcagcaagaacaaaattggag

SEQ ID NO: 1383346 - DNA, 22 bp, Artificial Sequence
  chemically synthesized
tagggtgaagtactgtagtgtg

SEQ ID NO: 1383347 - DNA, 22 bp, Artificial Sequence
  chemically synthesized
ttgtagggtgaagtactgtagt

SEQ ID NO: 1383348 - DNA, 22 bp, Artificial Sequence
  chemically synthesized
gaggcatcacactacagtactt

SEQ ID NO: 1383349 - DNA, 22 bp, Artificial Sequence
  chemically synthesized
tggtgtgaattattgtagggtg

SEQ ID NO: 1383350 - DNA, 22 bp, Artificial Sequence
  chemically synthesized
cagtacttcaccctacaataat

SEQ ID NO: 1383351 - DNA, 22 bp, Artificial Sequence
  chemically synthesized
caccctacaataattcacacca

SEQ ID NO: 1383352 - DNA, 22 bp, Artificial Sequence
  chemically synthesized
accctacaataattcacaccac

SEQ ID NO: 1383353 - DNA, 22 bp, Artificial Sequence
  chemically synthesized
tagtgtgatgtactgtggtgtg

SEQ ID NO: 1383354 - DNA, 22 bp, Artificial Sequence
  chemically synthesized
tatagtgtgatgtactgtggtg

SEQ ID NO: 1383355 - DNA, 22 bp, Artificial Sequence
  chemically synthesized
caataattcacaccacagtaca

SEQ ID NO: 1383356 - DNA, 22 bp, Artificial Sequence
  chemically synthesized
gaagttctatagtgtgatgtac

SEQ ID NO: 1383357 - DNA, 22 bp, Artificial Sequence
  chemically synthesized
acaccacagtacatcacactat

SEQ ID NO: 1383358 - DNA, 22 bp, Artificial Sequence
  chemically synthesized
tagcatagttggaagttctata

SEQ ID NO: 1383359 - DNA, 22 bp, Artificial Sequence
  chemically synthesized
gtagcatagttggaagttctat

SEQ ID NO: 1383360 - DNA, 22 bp, Artificial Sequence
  chemically synthesized
tagtcttgtagcatagttggaa

SEQ ID NO: 1383361 - DNA, 22 bp, Artificial Sequence
  chemically synthesized
ctgtagtcttgtagcatagttg

SEQ ID NO: 1383362 - DNA, 22 bp, Artificial Sequence
  chemically synthesized
tagaacttccaactatgctaca

SEQ ID NO: 1383363 - DNA, 22 bp, Artificial Sequence
  chemically synthesized
gctactgtagtcttgtagcata

SEQ ID NO: 1383364 - DNA, 22 bp, Artificial Sequence
  chemically synthesized
tattggctactgtagtcttgta

SEQ ID NO: 1383365 - DNA, 22 bp, Artificial Sequence
  chemically synthesized
ccaactatgctacaagactaca

SEQ ID NO: 1383366 - DNA, 22 bp, Artificial Sequence
  chemically synthesized
caactatgctacaagactacag

SEQ ID NO: 1383367 - DNA, 22 bp, Artificial Sequence
  chemically synthesized
tgctgtattggctactgtagtc

SEQ ID NO: 1383368 - DNA, 22 bp, Artificial Sequence
  chemically synthesized
tgctacaagactacagtagcca

SEQ ID NO: 1383369 - DNA, 22 bp, Artificial Sequence
  chemically synthesized
caagactacagtagccaataca

SEQ ID NO: 1383370 - DNA, 22 bp, Artificial Sequence
  chemically synthesized
taccaatattatgctgtattgg

SEQ ID NO: 1383371 - DNA, 22 bp, Artificial Sequence
  chemically synthesized
tgtaccaatattatgctgtatt

SEQ ID NO: 1383372 - DNA, 22 bp, Artificial Sequence
  chemically synthesized
ctgtaccaatattatgctgtat

SEQ ID NO: 1383373 - DNA, 22 bp, Artificial Sequence
  chemically synthesized
cagtagccaatacagcataata

SEQ ID NO: 1383374 - DNA, 22 bp, Artificial Sequence
  chemically synthesized
tttctgtaccaatattatgctg

SEQ ID NO: 1383375 - DNA, 22 bp, Artificial Sequence
  chemically synthesized
tatgtctgtttctgtaccaata

SEQ ID NO: 1383376 - DNA, 22 bp, Artificial Sequence
  chemically synthesized
gtctatatgtctgtttctgtac

SEQ ID NO: 1383377 - DNA, 22 bp, Artificial Sequence
  chemically synthesized
cattggtctatatgtctgtttc

SEQ ID NO: 1383378 - DNA, 22 bp, Artificial Sequence
  chemically synthesized
ttccattggtctatatgtctgt

SEQ ID NO: 1383379 - DNA, 22 bp, Artificial Sequence
  chemically synthesized
tgttccattggtctatatgtct

SEQ ID NO: 1383380 - DNA, 22 bp, Artificial Sequence
  chemically synthesized
gtacagaaacagacatatagac

SEQ ID NO: 1383381 - DNA, 22 bp, Artificial Sequence
  chemically synthesized
ttctgttccattggtctatatg

SEQ ID NO: 1383382 - DNA, 22 bp, Artificial Sequence
  chemically synthesized
tattctgttccattggtctata

SEQ ID NO: 1383383 - DNA, 22 bp, Artificial Sequence
  chemically synthesized
ctattctgttccattggtctat

SEQ ID NO: 1383384 - DNA, 22 bp, Artificial Sequence
  chemically synthesized
tctattctgttccattggtcta

SEQ ID NO: 1383385 - DNA, 22 bp, Artificial Sequence
  chemically synthesized
tgttttctattctgttccattg

SEQ ID NO: 1383386 - DNA, 22 bp, Artificial Sequence
  chemically synthesized
tgtgttttctattctgttccat

SEQ ID NO: 1383387 - DNA, 22 bp, Artificial Sequence
  chemically synthesized
ctgtgttttctattctgttcca

SEQ ID NO: 1383388 - DNA, 22 bp, Artificial Sequence
  chemically synthesized
tttctgtgttttctattctgtt

SEQ ID NO: 1383389 - DNA, 22 bp, Artificial Sequence
  chemically synthesized
atttctgtgttttctattctgt

SEQ ID NO: 1383390 - DNA, 22 bp, Artificial Sequence
  chemically synthesized
tatttctgtgttttctattctg

SEQ ID NO: 1383391 - DNA, 22 bp, Artificial Sequence
  chemically synthesized
aaggtgtatggctttatttctg

SEQ ID NO: 1383392 - DNA, 22 bp, Artificial Sequence
  chemically synthesized
gttgaaggtgtatggctttatt

SEQ ID NO: 1383393 - DNA, 22 bp, Artificial Sequence
  chemically synthesized
tcgaaggctggttgaaggtgta

SEQ ID NO: 1383394 - DNA, 22 bp, Artificial Sequence
  chemically synthesized
gtcgaaggctggttgaaggtgt

SEQ ID NO: 1383395 - DNA, 22 bp, Artificial Sequence
  chemically synthesized
ccagccttgtcgaaggctggtt

SEQ ID NO: 1383396 - DNA, 22 bp, Artificial Sequence
  chemically synthesized
gccagccttgtcgaaggctggt

SEQ ID NO: 1383397 - DNA, 22 bp, Artificial Sequence
  chemically synthesized
tgccagccttgtcgaaggctgg

SEQ ID NO: 1383398 - DNA, 22 bp, Artificial Sequence
  chemically synthesized
ttgccagccttgtcgaaggctg

SEQ ID NO: 1383399 - DNA, 22 bp, Artificial Sequence
  chemically synthesized
tttttgccagccttgtcgaagg

SEQ ID NO: 1383400 - DNA, 22 bp, Artificial Sequence
  chemically synthesized
gtttttgccagccttgtcgaag

SEQ ID NO: 1383401 - DNA, 22 bp, Artificial Sequence
  chemically synthesized
cttgtttttgccagccttgtcg

SEQ ID NO: 1383402 - DNA, 22 bp, Artificial Sequence
  chemically synthesized
caaccagccttcgacaaggctg

SEQ ID NO: 1383403 - DNA, 22 bp, Artificial Sequence
  chemically synthesized
aaccagccttcgacaaggctgg

SEQ ID NO: 1383404 - DNA, 22 bp, Artificial Sequence
  chemically synthesized
ccattgcttgtttttgccagcc

SEQ ID NO: 1383405 - DNA, 22 bp, Artificial Sequence
  chemically synthesized
accattgcttgtttttgccagc

SEQ ID NO: 1383406 - DNA, 22 bp, Artificial Sequence
  chemically synthesized
taccattgcttgtttttgccag

SEQ ID NO: 1383407 - DNA, 22 bp, Artificial Sequence
  chemically synthesized
ttaccattgcttgtttttgcca

SEQ ID NO: 1383408 - DNA, 22 bp, Artificial Sequence
  chemically synthesized
cgacaaggctggcaaaaacaag

SEQ ID NO: 1383409 - DNA, 22 bp, Artificial Sequence
  chemically synthesized
gacaaggctggcaaaaacaagc

SEQ ID NO: 1383410 - DNA, 22 bp, Artificial Sequence
  chemically synthesized
gcaaaaacaagcaatggtaaaa

SEQ ID NO: 1383411 - DNA, 22 bp, Artificial Sequence
  chemically synthesized
aataggaagtccttttaccatt

SEQ ID NO: 1383412 - DNA, 22 bp, Artificial Sequence
  chemically synthesized
ttgaataggaagtccttttacc

SEQ ID NO: 1383413 - DNA, 22 bp, Artificial Sequence
  chemically synthesized
attgaataggaagtccttttac

SEQ ID NO: 1383414 - DNA, 22 bp, Artificial Sequence
  chemically synthesized
gcatcatttattgaataggaag

SEQ ID NO: 1383415 - DNA, 22 bp, Artificial Sequence
  chemically synthesized
gccagtgatcctggcatcattt

SEQ ID NO: 1383416 - DNA, 22 bp, Artificial Sequence
  chemically synthesized
cctattcaataaatgatgccag

SEQ ID NO: 1383417 - DNA, 22 bp, Artificial Sequence
  chemically synthesized
ctattcaataaatgatgccagg

SEQ ID NO: 1383418 - DNA, 22 bp, Artificial Sequence
  chemically synthesized
ttcaataaatgatgccaggatc

SEQ ID NO: 1383419 - DNA, 22 bp, Artificial Sequence
  chemically synthesized
aataaatgatgccaggatcact

SEQ ID NO: 1383420 - DNA, 22 bp, Artificial Sequence
  chemically synthesized
catatggctagccagtgatcct

SEQ ID NO: 1383421 - DNA, 22 bp, Artificial Sequence
  chemically synthesized
tgcatatggctagccagtgatc

SEQ ID NO: 1383422 - DNA, 22 bp, Artificial Sequence
  chemically synthesized
ctgcatatggctagccagtgat

SEQ ID NO: 1383423 - DNA, 22 bp, Artificial Sequence
  chemically synthesized
ttctgcatatggctagccagtg

SEQ ID NO: 1383424 - DNA, 22 bp, Artificial Sequence
  chemically synthesized
attcttctgcatatggctagcc

SEQ ID NO: 1383425 - DNA, 22 bp, Artificial Sequence
  chemically synthesized
cattcttctgcatatggctagc

SEQ ID NO: 1383426 - DNA, 22 bp, Artificial Sequence
  chemically synthesized
gctagccatatgcagaagaatg

SEQ ID NO: 1383427 - DNA, 22 bp, Artificial Sequence
  chemically synthesized
gccatatgcagaagaatgaaac

SEQ ID NO: 1383428 - DNA, 22 bp, Artificial Sequence
  chemically synthesized
tatatggcaaaaggtagggatc

SEQ ID NO: 1383429 - DNA, 22 bp, Artificial Sequence
  chemically synthesized
gtatatggcaaaaggtagggat

SEQ ID NO: 1383430 - DNA, 22 bp, Artificial Sequence
  chemically synthesized
tgtatatggcaaaaggtaggga

SEQ ID NO: 1383431 - DNA, 22 bp, Artificial Sequence
  chemically synthesized
ttgtatatggcaaaaggtaggg

SEQ ID NO: 1383432 - DNA, 22 bp, Artificial Sequence
  chemically synthesized
tttttgtatatggcaaaaggta

SEQ ID NO: 1383433 - DNA, 22 bp, Artificial Sequence
  chemically synthesized
atttttgtatatggcaaaaggt

SEQ ID NO: 1383434 - DNA, 22 bp, Artificial Sequence
  chemically synthesized
gatccctaccttttgccatata

SEQ ID NO: 1383435 - DNA, 22 bp, Artificial Sequence
  chemically synthesized
atccctaccttttgccatatac

SEQ ID NO: 1383436 - DNA, 22 bp, Artificial Sequence
  chemically synthesized
ccttttgccatatacaaaaata

SEQ ID NO: 1383437 - DNA, 22 bp, Artificial Sequence
  chemically synthesized
atccaccatgagtttatttttg

SEQ ID NO: 1383438 - DNA, 22 bp, Artificial Sequence
  chemically synthesized
aatccaccatgagtttattttt

SEQ ID NO: 1383439 - DNA, 22 bp, Artificial Sequence
  chemically synthesized
ttgccatatacaaaaataaact

SEQ ID NO: 1383440 - DNA, 22 bp, Artificial Sequence
  chemically synthesized
taatccaccatgagtttatttt

SEQ ID NO: 1383441 - DNA, 22 bp, Artificial Sequence
  chemically synthesized
tgccatatacaaaaataaactc

SEQ ID NO: 1383442 - DNA, 22 bp, Artificial Sequence
  chemically synthesized
gccatatacaaaaataaactca

SEQ ID NO: 1383443 - DNA, 22 bp, Artificial Sequence
  chemically synthesized
ccatatacaaaaataaactcat

SEQ ID NO: 1383444 - DNA, 22 bp, Artificial Sequence
  chemically synthesized
atatctttaatccaccatgagt

SEQ ID NO: 1383445 - DNA, 22 bp, Artificial Sequence
  chemically synthesized
cattaatatctttaatccacca

SEQ ID NO: 1383446 - DNA, 22 bp, Artificial Sequence
  chemically synthesized
acattaatatctttaatccacc

SEQ ID NO: 1383447 - DNA, 22 bp, Artificial Sequence
  chemically synthesized
ggtcttacattaatatctttaa

SEQ ID NO: 1383448 - DNA, 22 bp, Artificial Sequence
  chemically synthesized
aggtcttacattaatatcttta

SEQ ID NO: 1383449 - DNA, 22 bp, Artificial Sequence
  chemically synthesized
taggtcttacattaatatcttt

SEQ ID NO: 1383450 - DNA, 22 bp, Artificial Sequence
  chemically synthesized
atggtggattaaagatattaat

SEQ ID NO: 1383451 - DNA, 22 bp, Artificial Sequence
  chemically synthesized
tagttttaggtcttacattaat

SEQ ID NO: 1383452 - DNA, 22 bp, Artificial Sequence
  chemically synthesized
gtagttttaggtcttacattaa

SEQ ID NO: 1383453 - DNA, 22 bp, Artificial Sequence
  chemically synthesized
aagatattaatgtaagacctaa

SEQ ID NO: 1383454 - DNA, 22 bp, Artificial Sequence
  chemically synthesized
ggatttgtagttttaggtctta

SEQ ID NO: 1383455 - DNA, 22 bp, Artificial Sequence
  chemically synthesized
taggatttgtagttttaggtct

SEQ ID NO: 1383456 - DNA, 22 bp, Artificial Sequence
  chemically synthesized
ctaggatttgtagttttaggtc

SEQ ID NO: 1383457 - DNA, 22 bp, Artificial Sequence
  chemically synthesized
tttctaggatttgtagttttag

SEQ ID NO: 1383458 - DNA, 22 bp, Artificial Sequence
  chemically synthesized
gtttctaggatttgtagtttta

SEQ ID NO: 1383459 - DNA, 22 bp, Artificial Sequence
  chemically synthesized
atgtaagacctaaaactacaaa

SEQ ID NO: 1383460 - DNA, 22 bp, Artificial Sequence
  chemically synthesized
ggtttgtttctaggatttgtag

SEQ ID NO: 1383461 - DNA, 22 bp, Artificial Sequence
  chemically synthesized
ctaggtttgtttctaggatttg

SEQ ID NO: 1383462 - DNA, 22 bp, Artificial Sequence
  chemically synthesized
cctaggtttgtttctaggattt

SEQ ID NO: 1383463 - DNA, 22 bp, Artificial Sequence
  chemically synthesized
aaactacaaatcctagaaacaa

SEQ ID NO: 1383464 - DNA, 22 bp, Artificial Sequence
  chemically synthesized
caaatcctagaaacaaacctag

SEQ ID NO: 1383465 - DNA, 22 bp, Artificial Sequence
  chemically synthesized
gaaacaaacctaggaaatgtcc

SEQ ID NO: 1383466 - DNA, 22 bp, Artificial Sequence
  chemically synthesized
ccaatgccaatgtcaagaagga

SEQ ID NO: 1383467 - DNA, 22 bp, Artificial Sequence
  chemically synthesized
ggaaatgtccttcttgacattg

SEQ ID NO: 1383468 - DNA, 22 bp, Artificial Sequence
  chemically synthesized
cttgacattggcattggcaatt

SEQ ID NO: 1383469 - DNA, 22 bp, Artificial Sequence
  chemically synthesized
ttgacattggcattggcaattt

SEQ ID NO: 1383470 - DNA, 22 bp, Artificial Sequence
  chemically synthesized
gacattggcattggcaattttt

SEQ ID NO: 1383471 - DNA, 22 bp, Artificial Sequence
  chemically synthesized
acattggcattggcaatttttt

SEQ ID NO: 1383472 - DNA, 22 bp, Artificial Sequence
  chemically synthesized
tcaaaaaaaaaaaaaaaattgc

SEQ ID NO: 1383473 - DNA, 22 bp, Artificial Sequence
  chemically synthesized
tgtcaaaaaaaaaaaaaaaatt

SEQ ID NO: 1383474 - DNA, 22 bp, Artificial Sequence
  chemically synthesized
gcattggcaatttttttttttt

SEQ ID NO: 1383475 - DNA, 22 bp, Artificial Sequence
  chemically synthesized
gcaattttttttttttttttga

SEQ ID NO: 1383476 - DNA, 22 bp, Artificial Sequence
  chemically synthesized
tttttttttttttgacagagtc

SEQ ID NO: 1383477 - DNA, 22 bp, Artificial Sequence
  chemically synthesized
ttttttttttttgacagagtct

SEQ ID NO: 1383478 - DNA, 22 bp, Artificial Sequence
  chemically synthesized
ggcgacagagtgagactctgtc

SEQ ID NO: 1383479 - DNA, 22 bp, Artificial Sequence
  chemically synthesized
tttttttttttgacagagtctc

SEQ ID NO: 1383480 - DNA, 22 bp, Artificial Sequence
  chemically synthesized
ttttttttttgacagagtctca

SEQ ID NO: 1383481 - DNA, 22 bp, Artificial Sequence
  chemically synthesized
tttttttttgacagagtctcac

SEQ ID NO: 1383482 - DNA, 22 bp, Artificial Sequence
  chemically synthesized
ttttttttgacagagtctcact

SEQ ID NO: 1383483 - DNA, 22 bp, Artificial Sequence
  chemically synthesized
tttttttgacagagtctcactc

SEQ ID NO: 1383484 - DNA, 22 bp, Artificial Sequence
  chemically synthesized
ttttttgacagagtctcactct

SEQ ID NO: 1383485 - DNA, 22 bp, Artificial Sequence
  chemically synthesized
tttttgacagagtctcactctg

SEQ ID NO: 1383486 - DNA, 22 bp, Artificial Sequence
  chemically synthesized
cagcctgggcgacagagtgaga

SEQ ID NO: 1383487 - DNA, 22 bp, Artificial Sequence
  chemically synthesized
ttttgacagagtctcactctgt

SEQ ID NO: 1383488 - DNA, 22 bp, Artificial Sequence
  chemically synthesized
tttgacagagtctcactctgtc

SEQ ID NO: 1383489 - DNA, 22 bp, Artificial Sequence
  chemically synthesized
ttgacagagtctcactctgtcg

SEQ ID NO: 1383490 - DNA, 22 bp, Artificial Sequence
  chemically synthesized
tgacagagtctcactctgtcgc

SEQ ID NO: 1383491 - DNA, 22 bp, Artificial Sequence
  chemically synthesized
gacagagtctcactctgtcgcc

SEQ ID NO: 1383492 - DNA, 22 bp, Artificial Sequence
  chemically synthesized
tactccagcctgggcgacagag

SEQ ID NO: 1383493 - DNA, 22 bp, Artificial Sequence
  chemically synthesized
acagagtctcactctgtcgccc

SEQ ID NO: 1383494 - DNA, 22 bp, Artificial Sequence
  chemically synthesized
actctgtcgcccaggctggagt

SEQ ID NO: 1383495 - DNA, 22 bp, Artificial Sequence
  chemically synthesized
tgtcgcccaggctggagtacag

SEQ ID NO: 1383496 - DNA, 22 bp, Artificial Sequence
  chemically synthesized
tcgcccaggctggagtacagtg

SEQ ID NO: 1383497 - DNA, 22 bp, Artificial Sequence
  chemically synthesized
caatgagtccagatcacaccac

SEQ ID NO: 1383498 - DNA, 22 bp, Artificial Sequence
  chemically synthesized
gagtacagtggtgtgatctgga

SEQ ID NO: 1383499 - DNA, 22 bp, Artificial Sequence
  chemically synthesized
accccaggaggcagaggttgca

SEQ ID NO: 1383500 - DNA, 22 bp, Artificial Sequence
  chemically synthesized
gaccccaggaggcagaggttgc

SEQ ID NO: 1383501 - DNA, 22 bp, Artificial Sequence
  chemically synthesized
tttgaccccaggaggcagaggt

SEQ ID NO: 1383502 - DNA, 22 bp, Artificial Sequence
  chemically synthesized
gactcattgcaacctctgcctc

SEQ ID NO: 1383503 - DNA, 22 bp, Artificial Sequence
  chemically synthesized
attgcaacctctgcctcctggg

SEQ ID NO: 1383504 - DNA, 22 bp, Artificial Sequence
  chemically synthesized
caacctctgcctcctggggtca

SEQ ID NO: 1383505 - DNA, 22 bp, Artificial Sequence
  chemically synthesized
aggcaggagaactgtttgaccc

SEQ ID NO: 1383506 - DNA, 22 bp, Artificial Sequence
  chemically synthesized
tgcctcctggggtcaaacagtt

SEQ ID NO: 1383507 - DNA, 22 bp, Artificial Sequence
  chemically synthesized
cctcctggggtcaaacagttct

SEQ ID NO: 1383508 - DNA, 22 bp, Artificial Sequence
  chemically synthesized
ggaggctgaggcaggagaactg

SEQ ID NO: 1383509 - DNA, 22 bp, Artificial Sequence
  chemically synthesized
ctggggtcaaacagttctcctg

SEQ ID NO: 1383510 - DNA, 22 bp, Artificial Sequence
  chemically synthesized
gggaggctgaggcaggagaact

SEQ ID NO: 1383511 - DNA, 22 bp, Artificial Sequence
  chemically synthesized
gggtcaaacagttctcctgcct

SEQ ID NO: 1383512 - DNA, 22 bp, Artificial Sequence
  chemically synthesized
cttgggaggctgaggcaggaga

SEQ ID NO: 1383513 - DNA, 22 bp, Artificial Sequence
  chemically synthesized
taatcccagctacttgggaggc

SEQ ID NO: 1383514 - DNA, 22 bp, Artificial Sequence
  chemically synthesized
tcctgcctcagcctcccaagta

SEQ ID NO: 1383515 - DNA, 22 bp, Artificial Sequence
  chemically synthesized
ctgcctcagcctcccaagtagc

SEQ ID NO: 1383516 - DNA, 22 bp, Artificial Sequence
  chemically synthesized
cctcagcctcccaagtagctgg

SEQ ID NO: 1383517 - DNA, 22 bp, Artificial Sequence
  chemically synthesized
agcctcccaagtagctgggatt

SEQ ID NO: 1383518 - DNA, 22 bp, Artificial Sequence
  chemically synthesized
ccaagtagctgggattacaggc

SEQ ID NO: 1383519 - DNA, 22 bp, Artificial Sequence
  chemically synthesized
gccgggtgtggtggcagacgcc

SEQ ID NO: 1383520 - DNA, 22 bp, Artificial Sequence
  chemically synthesized
ggattacaggcgtctgccacca

SEQ ID NO: 1383521 - DNA, 22 bp, Artificial Sequence
  chemically synthesized
caggcgtctgccaccacacccg

SEQ ID NO: 1383522 - DNA, 22 bp, Artificial Sequence
  chemically synthesized
ccaaaaatacaaaaattagccg

SEQ ID NO: 1383523 - DNA, 22 bp, Artificial Sequence
  chemically synthesized
ccaccacacccggctaattttt

SEQ ID NO: 1383524 - DNA, 22 bp, Artificial Sequence
  chemically synthesized
taccaaaaatacaaaaattagc

SEQ ID NO: 1383525 - DNA, 22 bp, Artificial Sequence
  chemically synthesized
tctctaccaaaaatacaaaaat

SEQ ID NO: 1383526 - DNA, 22 bp, Artificial Sequence
  chemically synthesized
atttttgtatttttggtagaga

SEQ ID NO: 1383527 - DNA, 22 bp, Artificial Sequence
  chemically synthesized
ttgtatttttggtagagacagg

SEQ ID NO: 1383528 - DNA, 22 bp, Artificial Sequence
  chemically synthesized
tgtatttttggtagagacaggg

SEQ ID NO: 1383529 - DNA, 22 bp, Artificial Sequence
  chemically synthesized
gtatttttggtagagacagggt

SEQ ID NO: 1383530 - DNA, 22 bp, Artificial Sequence
  chemically synthesized
tatttttggtagagacagggtt

SEQ ID NO: 1383531 - DNA, 22 bp, Artificial Sequence
  chemically synthesized
accaacgtggcaaaaccctgtc

SEQ ID NO: 1383532 - DNA, 22 bp, Artificial Sequence
  chemically synthesized
ttggtagagacagggttttgcc

SEQ ID NO: 1383533 - DNA, 22 bp, Artificial Sequence
  chemically synthesized
tggtagagacagggttttgcca

SEQ ID NO: 1383534 - DNA, 22 bp, Artificial Sequence
  chemically synthesized
ggtagagacagggttttgccac

SEQ ID NO: 1383535 - DNA, 22 bp, Artificial Sequence
  chemically synthesized
gtagagacagggttttgccacg

SEQ ID NO: 1383536 - DNA, 22 bp, Artificial Sequence
  chemically synthesized
gaaagcagcctgaccaacgtgg

SEQ ID NO: 1383537 - DNA, 22 bp, Artificial Sequence
  chemically synthesized
tgccacgttggtcaggctgctt

SEQ ID NO: 1383538 - DNA, 22 bp, Artificial Sequence
  chemically synthesized
gccacgttggtcaggctgcttt

SEQ ID NO: 1383539 - DNA, 22 bp, Artificial Sequence
  chemically synthesized
ccacgttggtcaggctgctttc

SEQ ID NO: 1383540 - DNA, 22 bp, Artificial Sequence
  chemically synthesized
cccgaagccaggagttcgaaag

SEQ ID NO: 1383541 - DNA, 22 bp, Artificial Sequence
  chemically synthesized
gtcaggctgctttcgaactcct

SEQ ID NO: 1383542 - DNA, 22 bp, Artificial Sequence
  chemically synthesized
ctttcgaactcctggcttcggg

SEQ ID NO: 1383543 - DNA, 22 bp, Artificial Sequence
  chemically synthesized
tcgaactcctggcttcgggtaa

SEQ ID NO: 1383544 - DNA, 22 bp, Artificial Sequence
  chemically synthesized
cgaactcctggcttcgggtaat

SEQ ID NO: 1383545 - DNA, 22 bp, Artificial Sequence
  chemically synthesized
gaactcctggcttcgggtaatc

SEQ ID NO: 1383546 - DNA, 22 bp, Artificial Sequence
  chemically synthesized
ggagaccaaggtgggtggatta

SEQ ID NO: 1383547 - DNA, 22 bp, Artificial Sequence
  chemically synthesized
ctggcttcgggtaatccaccca

SEQ ID NO: 1383548 - DNA, 22 bp, Artificial Sequence
  chemically synthesized
gggagaccaaggtgggtggatt

SEQ ID NO: 1383549 - DNA, 22 bp, Artificial Sequence
  chemically synthesized
tgggagaccaaggtgggtggat

SEQ ID NO: 1383550 - DNA, 22 bp, Artificial Sequence
  chemically synthesized
gcttcgggtaatccacccacct

SEQ ID NO: 1383551 - DNA, 22 bp, Artificial Sequence
  chemically synthesized
cgggtaatccacccaccttggt

SEQ ID NO: 1383552 - DNA, 22 bp, Artificial Sequence
  chemically synthesized
gggtaatccacccaccttggtc

SEQ ID NO: 1383553 - DNA, 22 bp, Artificial Sequence
  chemically synthesized
taatcccagcactttgggagac

SEQ ID NO: 1383554 - DNA, 22 bp, Artificial Sequence
  chemically synthesized
atgcctgtaatcccagcacttt

SEQ ID NO: 1383555 - DNA, 22 bp, Artificial Sequence
  chemically synthesized
ggtctcccaaagtgctgggatt

SEQ ID NO: 1383556 - DNA, 22 bp, Artificial Sequence
  chemically synthesized
gtctcccaaagtgctgggatta

SEQ ID NO: 1383557 - DNA, 22 bp, Artificial Sequence
  chemically synthesized
ccaaagtgctgggattacaggc

SEQ ID NO: 1383558 - DNA, 22 bp, Artificial Sequence
  chemically synthesized
ccggccgggcgcagtgcctcat

SEQ ID NO: 1383559 - DNA, 22 bp, Artificial Sequence
  chemically synthesized
ggattacaggcatgaggcactg

SEQ ID NO: 1383560 - DNA, 22 bp, Artificial Sequence
  chemically synthesized
gccggccgggcgcagtgcctca

SEQ ID NO: 1383561 - DNA, 22 bp, Artificial Sequence
  chemically synthesized
tgccggccgggcgcagtgcctc

SEQ ID NO: 1383562 - DNA, 22 bp, Artificial Sequence
  chemically synthesized
tttgccggccgggcgcagtgcc

SEQ ID NO: 1383563 - DNA, 22 bp, Artificial Sequence
  chemically synthesized
caggcatgaggcactgcgcccg

SEQ ID NO: 1383564 - DNA, 22 bp, Artificial Sequence
  chemically synthesized
gccaaaaattctttgccggccg

SEQ ID NO: 1383565 - DNA, 22 bp, Artificial Sequence
  chemically synthesized
agccaaaaattctttgccggcc

SEQ ID NO: 1383566 - DNA, 22 bp, Artificial Sequence
  chemically synthesized
cgcccggccggcaaagaatttt

SEQ ID NO: 1383567 - DNA, 22 bp, Artificial Sequence
  chemically synthesized
gggacttagccaaaaattcttt

SEQ ID NO: 1383568 - DNA, 22 bp, Artificial Sequence
  chemically synthesized
ggggacttagccaaaaattctt

SEQ ID NO: 1383569 - DNA, 22 bp, Artificial Sequence
  chemically synthesized
tggggacttagccaaaaattct

SEQ ID NO: 1383570 - DNA, 22 bp, Artificial Sequence
  chemically synthesized
ttggggacttagccaaaaattc

SEQ ID NO: 1383571 - DNA, 22 bp, Artificial Sequence
  chemically synthesized
cttttggggacttagccaaaaa

SEQ ID NO: 1383572 - DNA, 22 bp, Artificial Sequence
  chemically synthesized
caattacttttggggacttagc

SEQ ID NO: 1383573 - DNA, 22 bp, Artificial Sequence
  chemically synthesized
ttacaattacttttggggactt

SEQ ID NO: 1383574 - DNA, 22 bp, Artificial Sequence
  chemically synthesized
gttacaattacttttggggact

SEQ ID NO: 1383575 - DNA, 22 bp, Artificial Sequence
  chemically synthesized
tgttacaattacttttggggac

SEQ ID NO: 1383576 - DNA, 22 bp, Artificial Sequence
  chemically synthesized
ttgttacaattacttttgggga

SEQ ID NO: 1383577 - DNA, 22 bp, Artificial Sequence
  chemically synthesized
ttggctaagtccccaaaagtaa

SEQ ID NO: 1383578 - DNA, 22 bp, Artificial Sequence
  chemically synthesized
tttttgttacaattacttttgg

SEQ ID NO: 1383579 - DNA, 22 bp, Artificial Sequence
  chemically synthesized
tggctaagtccccaaaagtaat

SEQ ID NO: 1383580 - DNA, 22 bp, Artificial Sequence
  chemically synthesized
atttttgttacaattacttttg

SEQ ID NO: 1383581 - DNA, 22 bp, Artificial Sequence
  chemically synthesized
ggctaagtccccaaaagtaatt

SEQ ID NO: 1383582 - DNA, 22 bp, Artificial Sequence
  chemically synthesized
tatttttgttacaattactttt

SEQ ID NO: 1383583 - DNA, 22 bp, Artificial Sequence
  chemically synthesized
gctaagtccccaaaagtaattg

SEQ ID NO: 1383584 - DNA, 22 bp, Artificial Sequence
  chemically synthesized
ttatttttgttacaattacttt

SEQ ID NO: 1383585 - DNA, 22 bp, Artificial Sequence
  chemically synthesized
agtccccaaaagtaattgtaac

SEQ ID NO: 1383586 - DNA, 22 bp, Artificial Sequence
  chemically synthesized
tcaatttttatttttgttacaa

SEQ ID NO: 1383587 - DNA, 22 bp, Artificial Sequence
  chemically synthesized
gtcaatttttatttttgttaca

SEQ ID NO: 1383588 - DNA, 22 bp, Artificial Sequence
  chemically synthesized
ttgtcaatttttatttttgtta

SEQ ID NO: 1383589 - DNA, 22 bp, Artificial Sequence
  chemically synthesized
ggtccctcttgtcaatttttat

SEQ ID NO: 1383590 - DNA, 22 bp, Artificial Sequence
  chemically synthesized
taacaaaaataaaaattgacaa

SEQ ID NO: 1383591 - DNA, 22 bp, Artificial Sequence
  chemically synthesized
attaggtccctcttgtcaattt

SEQ ID NO: 1383592 - DNA, 22 bp, Artificial Sequence
  chemically synthesized
aattaggtccctcttgtcaatt

SEQ ID NO: 1383593 - DNA, 22 bp, Artificial Sequence
  chemically synthesized
gtttaattaggtccctcttgtc

SEQ ID NO: 1383594 - DNA, 22 bp, Artificial Sequence
  chemically synthesized
agtttaattaggtccctcttgt

SEQ ID NO: 1383595 - DNA, 22 bp, Artificial Sequence
  chemically synthesized
tagtttaattaggtccctcttg

SEQ ID NO: 1383596 - DNA, 22 bp, Artificial Sequence
  chemically synthesized
tttagtttaattaggtccctct

SEQ ID NO: 1383597 - DNA, 22 bp, Artificial Sequence
  chemically synthesized
acaagagggacctaattaaact

SEQ ID NO: 1383598 - DNA, 22 bp, Artificial Sequence
  chemically synthesized
tgcagaagctctttagtttaat

SEQ ID NO: 1383599 - DNA, 22 bp, Artificial Sequence
  chemically synthesized
gctgtgcagaagctctttagtt

SEQ ID NO: 1383600 - DNA, 22 bp, Artificial Sequence
  chemically synthesized
ggctgtgcagaagctctttagt

SEQ ID NO: 1383601 - DNA, 22 bp, Artificial Sequence
  chemically synthesized
tggctgtgcagaagctctttag

SEQ ID NO: 1383602 - DNA, 22 bp, Artificial Sequence
  chemically synthesized
tttggctgtgcagaagctcttt

SEQ ID NO: 1383603 - DNA, 22 bp, Artificial Sequence
  chemically synthesized
ctttggctgtgcagaagctctt

SEQ ID NO: 1383604 - DNA, 22 bp, Artificial Sequence
  chemically synthesized
attaaactaaagagcttctgca

SEQ ID NO: 1383605 - DNA, 22 bp, Artificial Sequence
  chemically synthesized
aactaaagagcttctgcacagc

SEQ ID NO: 1383606 - DNA, 22 bp, Artificial Sequence
  chemically synthesized
atagtttctttggctgtgcaga

SEQ ID NO: 1383607 - DNA, 22 bp, Artificial Sequence
  chemically synthesized
ttgatagtttctttggctgtgc

SEQ ID NO: 1383608 - DNA, 22 bp, Artificial Sequence
  chemically synthesized
gttgatagtttctttggctgtg

SEQ ID NO: 1383609 - DNA, 22 bp, Artificial Sequence
  chemically synthesized
aagagcttctgcacagccaaag

SEQ ID NO: 1383610 - DNA, 22 bp, Artificial Sequence
  chemically synthesized
tgttgatagtttctttggctgt

SEQ ID NO: 1383611 - DNA, 22 bp, Artificial Sequence
  chemically synthesized
ctttgttgatagtttctttggc

SEQ ID NO: 1383612 - DNA, 22 bp, Artificial Sequence
  chemically synthesized
actttgttgatagtttctttgg

SEQ ID NO: 1383613 - DNA, 22 bp, Artificial Sequence
  chemically synthesized
tttactttgttgatagtttctt

SEQ ID NO: 1383614 - DNA, 22 bp, Artificial Sequence
  chemically synthesized
ctgcacagccaaagaaactatc

SEQ ID NO: 1383615 - DNA, 22 bp, Artificial Sequence
  chemically synthesized
tgcacagccaaagaaactatca

SEQ ID NO: 1383616 - DNA, 22 bp, Artificial Sequence
  chemically synthesized
cacagccaaagaaactatcaac

SEQ ID NO: 1383617 - DNA, 22 bp, Artificial Sequence
  chemically synthesized
tctgtttactttgttgatagtt

SEQ ID NO: 1383618 - DNA, 22 bp, Artificial Sequence
  chemically synthesized
tagattatctgtttactttgtt

SEQ ID NO: 1383619 - DNA, 22 bp, Artificial Sequence
  chemically synthesized
tgtagattatctgtttactttg

SEQ ID NO: 1383620 - DNA, 22 bp, Artificial Sequence
  chemically synthesized
ccattctgtagattatctgttt

SEQ ID NO: 1383621 - DNA, 22 bp, Artificial Sequence
  chemically synthesized
tcaacaaagtaaacagataatc

SEQ ID NO: 1383622 - DNA, 22 bp, Artificial Sequence
  chemically synthesized
tcccattctgtagattatctgt

SEQ ID NO: 1383623 - DNA, 22 bp, Artificial Sequence
  chemically synthesized
ctcccattctgtagattatctg

SEQ ID NO: 1383624 - DNA, 22 bp, Artificial Sequence
  chemically synthesized
tctcccattctgtagattatct

SEQ ID NO: 1383625 - DNA, 22 bp, Artificial Sequence
  chemically synthesized
tgaatattttctcccattctgt

SEQ ID NO: 1383626 - DNA, 22 bp, Artificial Sequence
  chemically synthesized
gtgaatattttctcccattctg

SEQ ID NO: 1383627 - DNA, 22 bp, Artificial Sequence
  chemically synthesized
cagaatgggagaaaatattcac

SEQ ID NO: 1383628 - DNA, 22 bp, Artificial Sequence
  chemically synthesized
tcaggtgcacagtttgtgaata

SEQ ID NO: 1383629 - DNA, 22 bp, Artificial Sequence
  chemically synthesized
gtcaggtgcacagtttgtgaat

SEQ ID NO: 1383630 - DNA, 22 bp, Artificial Sequence
  chemically synthesized
tgtcaggtgcacagtttgtgaa

SEQ ID NO: 1383631 - DNA, 22 bp, Artificial Sequence
  chemically synthesized
ttgtcaggtgcacagtttgtga

SEQ ID NO: 1383632 - DNA, 22 bp, Artificial Sequence
  chemically synthesized
gacttttgtcaggtgcacagtt

SEQ ID NO: 1383633 - DNA, 22 bp, Artificial Sequence
  chemically synthesized
atattagacttttgtcaggtgc

SEQ ID NO: 1383634 - DNA, 22 bp, Artificial Sequence
  chemically synthesized
aatattagacttttgtcaggtg

SEQ ID NO: 1383635 - DNA, 22 bp, Artificial Sequence
  chemically synthesized
taatattagacttttgtcaggt

SEQ ID NO: 1383636 - DNA, 22 bp, Artificial Sequence
  chemically synthesized
acaaactgtgcacctgacaaaa

SEQ ID NO: 1383637 - DNA, 22 bp, Artificial Sequence
  chemically synthesized
ttaatattagacttttgtcagg

SEQ ID NO: 1383638 - DNA, 22 bp, Artificial Sequence
  chemically synthesized
tttaatattagacttttgtcag

SEQ ID NO: 1383639 - DNA, 22 bp, Artificial Sequence
  chemically synthesized
tgcacctgacaaaagtctaata

SEQ ID NO: 1383640 - DNA, 22 bp, Artificial Sequence
  chemically synthesized
tccattttttaatattagactt

SEQ ID NO: 1383641 - DNA, 22 bp, Artificial Sequence
  chemically synthesized
gtccattttttaatattagact

SEQ ID NO: 1383642 - DNA, 22 bp, Artificial Sequence
  chemically synthesized
tgtccattttttaatattagac

SEQ ID NO: 1383643 - DNA, 22 bp, Artificial Sequence
  chemically synthesized
ttgtccattttttaatattaga

SEQ ID NO: 1383644 - DNA, 22 bp, Artificial Sequence
  chemically synthesized
acaaaagtctaatattaaaaaa

SEQ ID NO: 1383645 - DNA, 22 bp, Artificial Sequence
  chemically synthesized
atgtcttttgtccattttttaa

SEQ ID NO: 1383646 - DNA, 22 bp, Artificial Sequence
  chemically synthesized
ttcatgtcttttgtccattttt

SEQ ID NO: 1383647 - DNA, 22 bp, Artificial Sequence
  chemically synthesized
gttcatgtcttttgtccatttt

SEQ ID NO: 1383648 - DNA, 22 bp, Artificial Sequence
  chemically synthesized
atattaaaaaatggacaaaaga

SEQ ID NO: 1383649 - DNA, 22 bp, Artificial Sequence
  chemically synthesized
agaagtgtttgttcatgtcttt

SEQ ID NO: 1383650 - DNA, 22 bp, Artificial Sequence
  chemically synthesized
aaaaatggacaaaagacatgaa

SEQ ID NO: 1383651 - DNA, 22 bp, Artificial Sequence
  chemically synthesized
gagaagtgtttgttcatgtctt

SEQ ID NO: 1383652 - DNA, 22 bp, Artificial Sequence
  chemically synthesized
tgagaagtgtttgttcatgtct

SEQ ID NO: 1383653 - DNA, 22 bp, Artificial Sequence
  chemically synthesized
ctttgagaagtgtttgttcatg

SEQ ID NO: 1383654 - DNA, 22 bp, Artificial Sequence
  chemically synthesized
cctttgagaagtgtttgttcat

SEQ ID NO: 1383655 - DNA, 22 bp, Artificial Sequence
  chemically synthesized
catgtcttcctttgagaagtgt

SEQ ID NO: 1383656 - DNA, 22 bp, Artificial Sequence
  chemically synthesized
gcatgtcttcctttgagaagtg

SEQ ID NO: 1383657 - DNA, 22 bp, Artificial Sequence
  chemically synthesized
gtcgcttgcatgtcttcctttg

SEQ ID NO: 1383658 - DNA, 22 bp, Artificial Sequence
  chemically synthesized
ttggtcgcttgcatgtcttcct

SEQ ID NO: 1383659 - DNA, 22 bp, Artificial Sequence
  chemically synthesized
gttggtcgcttgcatgtcttcc

SEQ ID NO: 1383660 - DNA, 22 bp, Artificial Sequence
  chemically synthesized
ctcaaaggaagacatgcaagcg

SEQ ID NO: 1383661 - DNA, 22 bp, Artificial Sequence
  chemically synthesized
tcaaaggaagacatgcaagcga

SEQ ID NO: 1383662 - DNA, 22 bp, Artificial Sequence
  chemically synthesized
gtatgtttgttggtcgcttgca

SEQ ID NO: 1383663 - DNA, 22 bp, Artificial Sequence
  chemically synthesized
aaaggaagacatgcaagcgacc

SEQ ID NO: 1383664 - DNA, 22 bp, Artificial Sequence
  chemically synthesized
cgtatgtttgttggtcgcttgc

SEQ ID NO: 1383665 - DNA, 22 bp, Artificial Sequence
  chemically synthesized
ttcgtatgtttgttggtcgctt

SEQ ID NO: 1383666 - DNA, 22 bp, Artificial Sequence
  chemically synthesized
cttcgtatgtttgttggtcgct

SEQ ID NO: 1383667 - DNA, 22 bp, Artificial Sequence
  chemically synthesized
atgatgatgagcatttcttcgt

SEQ ID NO: 1383668 - DNA, 22 bp, Artificial Sequence
  chemically synthesized
atgattaatgatgatgagcatt

SEQ ID NO: 1383669 - DNA, 22 bp, Artificial Sequence
  chemically synthesized
tgatgattaatgatgatgagca

SEQ ID NO: 1383670 - DNA, 22 bp, Artificial Sequence
  chemically synthesized
tctgatgattaatgatgatgag

SEQ ID NO: 1383671 - DNA, 22 bp, Artificial Sequence
  chemically synthesized
ctctgatgattaatgatgatga

SEQ ID NO: 1383672 - DNA, 22 bp, Artificial Sequence
  chemically synthesized
atttctctgatgattaatgatg

SEQ ID NO: 1383673 - DNA, 22 bp, Artificial Sequence
  chemically synthesized
catttctctgatgattaatgat

SEQ ID NO: 1383674 - DNA, 22 bp, Artificial Sequence
  chemically synthesized
tcatttctctgatgattaatga

SEQ ID NO: 1383675 - DNA, 22 bp, Artificial Sequence
  chemically synthesized
ttcatttctctgatgattaatg

SEQ ID NO: 1383676 - DNA, 22 bp, Artificial Sequence
  chemically synthesized
cttttcatttctctgatgatta

SEQ ID NO: 1383677 - DNA, 22 bp, Artificial Sequence
  chemically synthesized
gcttttcatttctctgatgatt

SEQ ID NO: 1383678 - DNA, 22 bp, Artificial Sequence
  chemically synthesized
tgcttttcatttctctgatgat

SEQ ID NO: 1383679 - DNA, 22 bp, Artificial Sequence
  chemically synthesized
atcatcattaatcatcagagaa

SEQ ID NO: 1383680 - DNA, 22 bp, Artificial Sequence
  chemically synthesized
tggttttgcttttcatttctct

SEQ ID NO: 1383681 - DNA, 22 bp, Artificial Sequence
  chemically synthesized
attgtggttttgcttttcattt

SEQ ID NO: 1383682 - DNA, 22 bp, Artificial Sequence
  chemically synthesized
atcatcagagaaatgaaaagca

SEQ ID NO: 1383683 - DNA, 22 bp, Artificial Sequence
  chemically synthesized
gtgtgagatggtatctcattgt

SEQ ID NO: 1383684 - DNA, 22 bp, Artificial Sequence
  chemically synthesized
ggtgtgagatggtatctcattg

SEQ ID NO: 1383685 - DNA, 22 bp, Artificial Sequence
  chemically synthesized
tttggtgtgagatggtatctca

SEQ ID NO: 1383686 - DNA, 22 bp, Artificial Sequence
  chemically synthesized
tgtttggtgtgagatggtatct

SEQ ID NO: 1383687 - DNA, 22 bp, Artificial Sequence
  chemically synthesized
aataatagccattctgtttggt

SEQ ID NO: 1383688 - DNA, 22 bp, Artificial Sequence
  chemically synthesized
aaataatagccattctgtttgg

SEQ ID NO: 1383689 - DNA, 22 bp, Artificial Sequence
  chemically synthesized
taaataatagccattctgtttg

SEQ ID NO: 1383690 - DNA, 22 bp, Artificial Sequence
  chemically synthesized
ttaaataatagccattctgttt

SEQ ID NO: 1383691 - DNA, 22 bp, Artificial Sequence
  chemically synthesized
acttttaaataatagccattct

SEQ ID NO: 1383692 - DNA, 22 bp, Artificial Sequence
  chemically synthesized
gacttttaaataatagccattc

SEQ ID NO: 1383693 - DNA, 22 bp, Artificial Sequence
  chemically synthesized
acaccaaacagaatggctatta

SEQ ID NO: 1383694 - DNA, 22 bp, Artificial Sequence
  chemically synthesized
ttgacttttaaataatagccat

SEQ ID NO: 1383695 - DNA, 22 bp, Artificial Sequence
  chemically synthesized
cttgacttttaaataatagcca

SEQ ID NO: 1383696 - DNA, 22 bp, Artificial Sequence
  chemically synthesized
tcttgacttttaaataatagcc

SEQ ID NO: 1383697 - DNA, 22 bp, Artificial Sequence
  chemically synthesized
agcctttcttgacttttaaata

SEQ ID NO: 1383698 - DNA, 22 bp, Artificial Sequence
  chemically synthesized
cactcagcctttcttgactttt

SEQ ID NO: 1383699 - DNA, 22 bp, Artificial Sequence
  chemically synthesized
ttatttaaaagtcaagaaaggc

SEQ ID NO: 1383700 - DNA, 22 bp, Artificial Sequence
  chemically synthesized
tttaaaagtcaagaaaggctga

SEQ ID NO: 1383701 - DNA, 22 bp, Artificial Sequence
  chemically synthesized
aaaagtcaagaaaggctgagtg

SEQ ID NO: 1383702 - DNA, 22 bp, Artificial Sequence
  chemically synthesized
aaagtcaagaaaggctgagtgc

SEQ ID NO: 1383703 - DNA, 22 bp, Artificial Sequence
  chemically synthesized
caggcgcaagccactgcactca

SEQ ID NO: 1383704 - DNA, 22 bp, Artificial Sequence
  chemically synthesized
ggattacaggcgcaagccactg

SEQ ID NO: 1383705 - DNA, 22 bp, Artificial Sequence
  chemically synthesized
agtgcagtggcttgcgcctgta

SEQ ID NO: 1383706 - DNA, 22 bp, Artificial Sequence
  chemically synthesized
cagtgctgggattacaggcgca

SEQ ID NO: 1383707 - DNA, 22 bp, Artificial Sequence
  chemically synthesized
ctacagtgctgggattacaggc

SEQ ID NO: 1383708 - DNA, 22 bp, Artificial Sequence
  chemically synthesized
agcctcctacagtgctgggatt

SEQ ID NO: 1383709 - DNA, 22 bp, Artificial Sequence
  chemically synthesized
gcgcctgtaatcccagcactgt

SEQ ID NO: 1383710 - DNA, 22 bp, Artificial Sequence
  chemically synthesized
cctaagcctcctacagtgctgg

SEQ ID NO: 1383711 - DNA, 22 bp, Artificial Sequence
  chemically synthesized
cgcctgtaatcccagcactgta

SEQ ID NO: 1383712 - DNA, 22 bp, Artificial Sequence
  chemically synthesized
ctgcctaagcctcctacagtgc

SEQ ID NO: 1383713 - DNA, 22 bp, Artificial Sequence
  chemically synthesized
taatcccagcactgtaggaggc

SEQ ID NO: 1383714 - DNA, 22 bp, Artificial Sequence
  chemically synthesized
atatgatcctcctgcctaagcc

SEQ ID NO: 1383715 - DNA, 22 bp, Artificial Sequence
  chemically synthesized
gcctcatatgatcctcctgcct

SEQ ID NO: 1383716 - DNA, 22 bp, Artificial Sequence
  chemically synthesized
taggaggcttaggcaggaggat

SEQ ID NO: 1383717 - DNA, 22 bp, Artificial Sequence
  chemically synthesized
ctggcctcatatgatcctcctg

SEQ ID NO: 1383718 - DNA, 22 bp, Artificial Sequence
  chemically synthesized
aactcctggcctcatatgatcc

SEQ ID NO: 1383719 - DNA, 22 bp, Artificial Sequence
  chemically synthesized
gaactcctggcctcatatgatc

SEQ ID NO: 1383720 - DNA, 22 bp, Artificial Sequence
  chemically synthesized
aggcaggaggatcatatgaggc

SEQ ID NO: 1383721 - DNA, 22 bp, Artificial Sequence
  chemically synthesized
ggcaggaggatcatatgaggcc

SEQ ID NO: 1383722 - DNA, 22 bp, Artificial Sequence
  chemically synthesized
gtcttgaactcctggcctcata

SEQ ID NO: 1383723 - DNA, 22 bp, Artificial Sequence
  chemically synthesized
gccagtctggtcttgaactcct

SEQ ID NO: 1383724 - DNA, 22 bp, Artificial Sequence
  chemically synthesized
ggccagtctggtcttgaactcc

SEQ ID NO: 1383725 - DNA, 22 bp, Artificial Sequence
  chemically synthesized
tggccagtctggtcttgaactc

SEQ ID NO: 1383726 - DNA, 22 bp, Artificial Sequence
  chemically synthesized
accattttggccagtctggtct

SEQ ID NO: 1383727 - DNA, 22 bp, Artificial Sequence
  chemically synthesized
caccattttggccagtctggtc

SEQ ID NO: 1383728 - DNA, 22 bp, Artificial Sequence
  chemically synthesized
aagaccagactggccaaaatgg

SEQ ID NO: 1383729 - DNA, 22 bp, Artificial Sequence
  chemically synthesized
gagtcggggtttcaccattttg

SEQ ID NO: 1383730 - DNA, 22 bp, Artificial Sequence
  chemically synthesized
ctagagtcggggtttcaccatt

SEQ ID NO: 1383731 - DNA, 22 bp, Artificial Sequence
  chemically synthesized
actagagtcggggtttcaccat

SEQ ID NO: 1383732 - DNA, 22 bp, Artificial Sequence
  chemically synthesized
tactagagtcggggtttcacca

SEQ ID NO: 1383733 - DNA, 22 bp, Artificial Sequence
  chemically synthesized
ttactagagtcggggtttcacc

SEQ ID NO: 1383734 - DNA, 22 bp, Artificial Sequence
  chemically synthesized
gccaaaatggtgaaaccccgac

SEQ ID NO: 1383735 - DNA, 22 bp, Artificial Sequence
  chemically synthesized
tatttttactagagtcggggtt

SEQ ID NO: 1383736 - DNA, 22 bp, Artificial Sequence
  chemically synthesized
gtatttttactagagtcggggt

SEQ ID NO: 1383737 - DNA, 22 bp, Artificial Sequence
  chemically synthesized
tgtatttttactagagtcgggg

SEQ ID NO: 1383738 - DNA, 22 bp, Artificial Sequence
  chemically synthesized
ttgtatttttactagagtcggg

SEQ ID NO: 1383739 - DNA, 22 bp, Artificial Sequence
  chemically synthesized
atttttgtatttttactagagt

SEQ ID NO: 1383740 - DNA, 22 bp, Artificial Sequence
  chemically synthesized
tagtaaaaatacaaaaattagc

SEQ ID NO: 1383741 - DNA, 22 bp, Artificial Sequence
  chemically synthesized
gtaaaaatacaaaaattagctg

SEQ ID NO: 1383742 - DNA, 22 bp, Artificial Sequence
  chemically synthesized
cagatgtgtaccaccacaccca

SEQ ID NO: 1383743 - DNA, 22 bp, Artificial Sequence
  chemically synthesized
ggattacagatgtgtaccacca

SEQ ID NO: 1383744 - DNA, 22 bp, Artificial Sequence
  chemically synthesized
gctgggtgtggtggtacacatc

SEQ ID NO: 1383745 - DNA, 22 bp, Artificial Sequence
  chemically synthesized
gcagctgggattacagatgtgt

SEQ ID NO: 1383746 - DNA, 22 bp, Artificial Sequence
  chemically synthesized
ggtgtggtggtacacatctgta

SEQ ID NO: 1383747 - DNA, 22 bp, Artificial Sequence
  chemically synthesized
cctagcagctgggattacagat

SEQ ID NO: 1383748 - DNA, 22 bp, Artificial Sequence
  chemically synthesized
cagcctccctagcagctgggat

SEQ ID NO: 1383749 - DNA, 22 bp, Artificial Sequence
  chemically synthesized
atgctgcagcctccctagcagc

SEQ ID NO: 1383750 - DNA, 22 bp, Artificial Sequence
  chemically synthesized
tcatgctgcagcctccctagca

SEQ ID NO: 1383751 - DNA, 22 bp, Artificial Sequence
  chemically synthesized
taatcccagctgctagggaggc

SEQ ID NO: 1383752 - DNA, 22 bp, Artificial Sequence
  chemically synthesized
aaatgattctcatgctgcagcc

SEQ ID NO: 1383753 - DNA, 22 bp, Artificial Sequence
  chemically synthesized
ctagggaggctgcagcatgaga

SEQ ID NO: 1383754 - DNA, 22 bp, Artificial Sequence
  chemically synthesized
ggttcaaatgattctcatgctg

SEQ ID NO: 1383755 - DNA, 22 bp, Artificial Sequence
  chemically synthesized
gggaggctgcagcatgagaatc

SEQ ID NO: 1383756 - DNA, 22 bp, Artificial Sequence
  chemically synthesized
ctgggttcaaatgattctcatg

SEQ ID NO: 1383757 - DNA, 22 bp, Artificial Sequence
  chemically synthesized
aacctcctgggttcaaatgatt

SEQ ID NO: 1383758 - DNA, 22 bp, Artificial Sequence
  chemically synthesized
cagcatgagaatcatttgaacc

SEQ ID NO: 1383759 - DNA, 22 bp, Artificial Sequence
  chemically synthesized
cacctcaacctcctgggttcaa

SEQ ID NO: 1383760 - DNA, 22 bp, Artificial Sequence
  chemically synthesized
actgcacctcaacctcctgggt

SEQ ID NO: 1383761 - DNA, 22 bp, Artificial Sequence
  chemically synthesized
gctcactgcacctcaacctcct

SEQ ID NO: 1383762 - DNA, 22 bp, Artificial Sequence
  chemically synthesized
gaacccaggaggttgaggtgca

SEQ ID NO: 1383763 - DNA, 22 bp, Artificial Sequence
  chemically synthesized
aacccaggaggttgaggtgcag

SEQ ID NO: 1383764 - DNA, 22 bp, Artificial Sequence
  chemically synthesized
aggtgcagtgagccaggattgc

SEQ ID NO: 1383765 - DNA, 22 bp, Artificial Sequence
  chemically synthesized
gagtgcaatggggcaatcctgg

SEQ ID NO: 1383766 - DNA, 22 bp, Artificial Sequence
  chemically synthesized
tcacccaggctggagtgcaatg

SEQ ID NO: 1383767 - DNA, 22 bp, Artificial Sequence
  chemically synthesized
gtcacccaggctggagtgcaat

SEQ ID NO: 1383768 - DNA, 22 bp, Artificial Sequence
  chemically synthesized
tgtcacccaggctggagtgcaa

SEQ ID NO: 1383769 - DNA, 22 bp, Artificial Sequence
  chemically synthesized
ttgtcacccaggctggagtgca

SEQ ID NO: 1383770 - DNA, 22 bp, Artificial Sequence
  chemically synthesized
tttgtcacccaggctggagtgc

SEQ ID NO: 1383771 - DNA, 22 bp, Artificial Sequence
  chemically synthesized
ttttgtcacccaggctggagtg

SEQ ID NO: 1383772 - DNA, 22 bp, Artificial Sequence
  chemically synthesized
tttttgtcacccaggctggagt

SEQ ID NO: 1383773 - DNA, 22 bp, Artificial Sequence
  chemically synthesized
ttttttgtcacccaggctggag

SEQ ID NO: 1383774 - DNA, 22 bp, Artificial Sequence
  chemically synthesized
tttttttgtcacccaggctgga

SEQ ID NO: 1383775 - DNA, 22 bp, Artificial Sequence
  chemically synthesized
ccccattgcactccagcctggg

SEQ ID NO: 1383776 - DNA, 22 bp, Artificial Sequence
  chemically synthesized
ttttttttgtcacccaggctgg

SEQ ID NO: 1383777 - DNA, 22 bp, Artificial Sequence
  chemically synthesized
tttttttttgtcacccaggctg

SEQ ID NO: 1383778 - DNA, 22 bp, Artificial Sequence
  chemically synthesized
ttttttttttgtcacccaggct

SEQ ID NO: 1383779 - DNA, 22 bp, Artificial Sequence
  chemically synthesized
tttttttttttgtcacccaggc

SEQ ID NO: 1383780 - DNA, 22 bp, Artificial Sequence
  chemically synthesized
ttttttttttttgtcacccagg

SEQ ID NO: 1383781 - DNA, 22 bp, Artificial Sequence
  chemically synthesized
tttttttttttttgtcacccag

SEQ ID NO: 1383782 - DNA, 22 bp, Artificial Sequence
  chemically synthesized
ttttttttttttttgtcaccca

SEQ ID NO: 1383783 - DNA, 22 bp, Artificial Sequence
  chemically synthesized
tttttttttttttttgtcaccc

SEQ ID NO: 1383784 - DNA, 22 bp, Artificial Sequence
  chemically synthesized
cactccagcctgggtgacaaaa

SEQ ID NO: 1383785 - DNA, 22 bp, Artificial Sequence
  chemically synthesized
ttttttttttttttttgtcacc

SEQ ID NO: 1383786 - DNA, 22 bp, Artificial Sequence
  chemically synthesized
tttttttttttttttttgtcac

SEQ ID NO: 1383787 - DNA, 22 bp, Artificial Sequence
  chemically synthesized
ttttttttttttttttttgtca

SEQ ID NO: 1383788 - DNA, 22 bp, Artificial Sequence
  chemically synthesized
tttttttttttttttttttgtc

SEQ ID NO: 1383789 - DNA, 22 bp, Artificial Sequence
  chemically synthesized
cagcctgggtgacaaaaaaaaa

SEQ ID NO: 1383790 - DNA, 22 bp, Artificial Sequence
  chemically synthesized
attttttttttttttttttttt

SEQ ID NO: 1383791 - DNA, 22 bp, Artificial Sequence
  chemically synthesized
gatttttttttttttttttttt

SEQ ID NO: 1383792 - DNA, 22 bp, Artificial Sequence
  chemically synthesized
tgattttttttttttttttttt

SEQ ID NO: 1383793 - DNA, 22 bp, Artificial Sequence
  chemically synthesized
ttgatttttttttttttttttt

SEQ ID NO: 1383794 - DNA, 22 bp, Artificial Sequence
  chemically synthesized
ggtgacaaaaaaaaaaaaaaaa

SEQ ID NO: 1383795 - DNA, 22 bp, Artificial Sequence
  chemically synthesized
tcttttgatttttttttttttt

SEQ ID NO: 1383796 - DNA, 22 bp, Artificial Sequence
  chemically synthesized
atcttttgattttttttttttt

SEQ ID NO: 1383797 - DNA, 22 bp, Artificial Sequence
  chemically synthesized
accagcgtttatcttttgattt

SEQ ID NO: 1383798 - DNA, 22 bp, Artificial Sequence
  chemically synthesized
cagcctcaccagcgtttatctt

SEQ ID NO: 1383799 - DNA, 22 bp, Artificial Sequence
  chemically synthesized
tctacagcctcaccagcgttta

SEQ ID NO: 1383800 - DNA, 22 bp, Artificial Sequence
  chemically synthesized
atctacagcctcaccagcgttt

SEQ ID NO: 1383801 - DNA, 22 bp, Artificial Sequence
  chemically synthesized
tatctacagcctcaccagcgtt

SEQ ID NO: 1383802 - DNA, 22 bp, Artificial Sequence
  chemically synthesized
ttatctacagcctcaccagcgt

SEQ ID NO: 1383803 - DNA, 22 bp, Artificial Sequence
  chemically synthesized
ccttttatctacagcctcacca

SEQ ID NO: 1383804 - DNA, 22 bp, Artificial Sequence
  chemically synthesized
gtgaggctgtagataaaaggga

SEQ ID NO: 1383805 - DNA, 22 bp, Artificial Sequence
  chemically synthesized
tagataaaagggagtgcttata

SEQ ID NO: 1383806 - DNA, 22 bp, Artificial Sequence
  chemically synthesized
caaccaacagtgtataagcact

SEQ ID NO: 1383807 - DNA, 22 bp, Artificial Sequence
  chemically synthesized
cattccaaccaacagtgtataa

SEQ ID NO: 1383808 - DNA, 22 bp, Artificial Sequence
  chemically synthesized
acattccaaccaacagtgtata

SEQ ID NO: 1383809 - DNA, 22 bp, Artificial Sequence
  chemically synthesized
aaataatttacattccaaccaa

SEQ ID NO: 1383810 - DNA, 22 bp, Artificial Sequence
  chemically synthesized
atacactgttggttggaatgta

SEQ ID NO: 1383811 - DNA, 22 bp, Artificial Sequence
  chemically synthesized
tacactgttggttggaatgtaa

SEQ ID NO: 1383812 - DNA, 22 bp, Artificial Sequence
  chemically synthesized
ttggttggaatgtaaattattt

SEQ ID NO: 1383813 - DNA, 22 bp, Artificial Sequence
  chemically synthesized
ccacgggggctgaaataattta

SEQ ID NO: 1383814 - DNA, 22 bp, Artificial Sequence
  chemically synthesized
gccacgggggctgaaataattt

SEQ ID NO: 1383815 - DNA, 22 bp, Artificial Sequence
  chemically synthesized
gttggaatgtaaattatttcag

SEQ ID NO: 1383816 - DNA, 22 bp, Artificial Sequence
  chemically synthesized
cttgccacgggggctgaaataa

SEQ ID NO: 1383817 - DNA, 22 bp, Artificial Sequence
  chemically synthesized
gaatgtaaattatttcagcccc

SEQ ID NO: 1383818 - DNA, 22 bp, Artificial Sequence
  chemically synthesized
caaactgcttgccacgggggct

SEQ ID NO: 1383819 - DNA, 22 bp, Artificial Sequence
  chemically synthesized
tttcagcccccgtggcaagcag

SEQ ID NO: 1383820 - DNA, 22 bp, Artificial Sequence
  chemically synthesized
cagcccccgtggcaagcagttt

SEQ ID NO: 1383821 - DNA, 22 bp, Artificial Sequence
  chemically synthesized
tgagaaatctccaaactgcttg

SEQ ID NO: 1383822 - DNA, 22 bp, Artificial Sequence
  chemically synthesized
agcccccgtggcaagcagtttg

SEQ ID NO: 1383823 - DNA, 22 bp, Artificial Sequence
  chemically synthesized
tgtgagaaatctccaaactgct

SEQ ID NO: 1383824 - DNA, 22 bp, Artificial Sequence
  chemically synthesized
agttctgtgagaaatctccaaa

SEQ ID NO: 1383825 - DNA, 22 bp, Artificial Sequence
  chemically synthesized
aagttctgtgagaaatctccaa

SEQ ID NO: 1383826 - DNA, 22 bp, Artificial Sequence
  chemically synthesized
taagttctgtgagaaatctcca

SEQ ID NO: 1383827 - DNA, 22 bp, Artificial Sequence
  chemically synthesized
ttttaagttctgtgagaaatct

SEQ ID NO: 1383828 - DNA, 22 bp, Artificial Sequence
  chemically synthesized
ggagatttctcacagaacttaa

SEQ ID NO: 1383829 - DNA, 22 bp, Artificial Sequence
  chemically synthesized
gagatttctcacagaacttaaa

SEQ ID NO: 1383830 - DNA, 22 bp, Artificial Sequence
  chemically synthesized
aatgatagatctgttttaagtt

SEQ ID NO: 1383831 - DNA, 22 bp, Artificial Sequence
  chemically synthesized
ctcacagaacttaaaacagatc

SEQ ID NO: 1383832 - DNA, 22 bp, Artificial Sequence
  chemically synthesized
aattgaatgatagatctgtttt

SEQ ID NO: 1383833 - DNA, 22 bp, Artificial Sequence
  chemically synthesized
tcacagaacttaaaacagatct

SEQ ID NO: 1383834 - DNA, 22 bp, Artificial Sequence
  chemically synthesized
acagaacttaaaacagatctat

SEQ ID NO: 1383835 - DNA, 22 bp, Artificial Sequence
  chemically synthesized
ctgaattgaatgatagatctgt

SEQ ID NO: 1383836 - DNA, 22 bp, Artificial Sequence
  chemically synthesized
aaaacagatctatcattcaatt

SEQ ID NO: 1383837 - DNA, 22 bp, Artificial Sequence
  chemically synthesized
aaacagatctatcattcaattc

SEQ ID NO: 1383838 - DNA, 22 bp, Artificial Sequence
  chemically synthesized
agtaatgggattgctgaattga

SEQ ID NO: 1383839 - DNA, 22 bp, Artificial Sequence
  chemically synthesized
tcattcaattcagcaatcccat

SEQ ID NO: 1383840 - DNA, 22 bp, Artificial Sequence
  chemically synthesized
ggtatatactcagtaatgggat

SEQ ID NO: 1383841 - DNA, 22 bp, Artificial Sequence
  chemically synthesized
gggtatatactcagtaatggga

SEQ ID NO: 1383842 - DNA, 22 bp, Artificial Sequence
  chemically synthesized
tgggtatatactcagtaatggg

SEQ ID NO: 1383843 - DNA, 22 bp, Artificial Sequence
  chemically synthesized
aattcagcaatcccattactga

SEQ ID NO: 1383844 - DNA, 22 bp, Artificial Sequence
  chemically synthesized
ctttgggtatatactcagtaat

SEQ ID NO: 1383845 - DNA, 22 bp, Artificial Sequence
  chemically synthesized
cctttgggtatatactcagtaa

SEQ ID NO: 1383846 - DNA, 22 bp, Artificial Sequence
  chemically synthesized
tcctttgggtatatactcagta

SEQ ID NO: 1383847 - DNA, 22 bp, Artificial Sequence
  chemically synthesized
agcaatcccattactgagtata

SEQ ID NO: 1383848 - DNA, 22 bp, Artificial Sequence
  chemically synthesized
ttttcctttgggtatatactca

SEQ ID NO: 1383849 - DNA, 22 bp, Artificial Sequence
  chemically synthesized
ctgagtatatacccaaaggaaa

SEQ ID NO: 1383850 - DNA, 22 bp, Artificial Sequence
  chemically synthesized
ataaaatgatctattttccttt

SEQ ID NO: 1383851 - DNA, 22 bp, Artificial Sequence
  chemically synthesized
agtatatacccaaaggaaaata

SEQ ID NO: 1383852 - DNA, 22 bp, Artificial Sequence
  chemically synthesized
gataaaatgatctattttcctt

SEQ ID NO: 1383853 - DNA, 22 bp, Artificial Sequence
  chemically synthesized
tgataaaatgatctattttcct

SEQ ID NO: 1383854 - DNA, 22 bp, Artificial Sequence
  chemically synthesized
ttgataaaatgatctattttcc

SEQ ID NO: 1383855 - DNA, 22 bp, Artificial Sequence
  chemically synthesized
tttgataaaatgatctattttc

SEQ ID NO: 1383856 - DNA, 22 bp, Artificial Sequence
  chemically synthesized
tatcaaaaagacacatgcactg

SEQ ID NO: 1383857 - DNA, 22 bp, Artificial Sequence
  chemically synthesized
atcaaaaagacacatgcactgg

SEQ ID NO: 1383858 - DNA, 22 bp, Artificial Sequence
  chemically synthesized
tcaaaaagacacatgcactggt

SEQ ID NO: 1383859 - DNA, 22 bp, Artificial Sequence
  chemically synthesized
tgtgacaaagaacataccagtg

SEQ ID NO: 1383860 - DNA, 22 bp, Artificial Sequence
  chemically synthesized
tgaattgtgtgacaaagaacat

SEQ ID NO: 1383861 - DNA, 22 bp, Artificial Sequence
  chemically synthesized
ttgtgaattgtgtgacaaagaa

SEQ ID NO: 1383862 - DNA, 22 bp, Artificial Sequence
  chemically synthesized
ctattgtgaattgtgtgacaaa

SEQ ID NO: 1383863 - DNA, 22 bp, Artificial Sequence
  chemically synthesized
gctattgtgaattgtgtgacaa

SEQ ID NO: 1383864 - DNA, 22 bp, Artificial Sequence
  chemically synthesized
tgctattgtgaattgtgtgaca

SEQ ID NO: 1383865 - DNA, 22 bp, Artificial Sequence
  chemically synthesized
ttgctattgtgaattgtgtgac

SEQ ID NO: 1383866 - DNA, 22 bp, Artificial Sequence
  chemically synthesized
gtatgttctttgtcacacaatt

SEQ ID NO: 1383867 - DNA, 22 bp, Artificial Sequence
  chemically synthesized
gatatttttgctattgtgaatt

SEQ ID NO: 1383868 - DNA, 22 bp, Artificial Sequence
  chemically synthesized
tttgtcacacaattcacaatag

SEQ ID NO: 1383869 - DNA, 22 bp, Artificial Sequence
  chemically synthesized
tgtcacacaattcacaatagca

SEQ ID NO: 1383870 - DNA, 22 bp, Artificial Sequence
  chemically synthesized
attcgatatttttgctattgtg

SEQ ID NO: 1383871 - DNA, 22 bp, Artificial Sequence
  chemically synthesized
gtcacacaattcacaatagcaa

SEQ ID NO: 1383872 - DNA, 22 bp, Artificial Sequence
  chemically synthesized
tcacacaattcacaatagcaaa

SEQ ID NO: 1383873 - DNA, 22 bp, Artificial Sequence
  chemically synthesized
ggttgattcgatatttttgcta

SEQ ID NO: 1383874 - DNA, 22 bp, Artificial Sequence
  chemically synthesized
aggttgattcgatatttttgct

SEQ ID NO: 1383875 - DNA, 22 bp, Artificial Sequence
  chemically synthesized
taggttgattcgatatttttgc

SEQ ID NO: 1383876 - DNA, 22 bp, Artificial Sequence
  chemically synthesized
ttaggttgattcgatatttttg

SEQ ID NO: 1383877 - DNA, 22 bp, Artificial Sequence
  chemically synthesized
acaatagcaaaaatatcgaatc

SEQ ID NO: 1383878 - DNA, 22 bp, Artificial Sequence
  chemically synthesized
atgagcttttaggttgattcga

SEQ ID NO: 1383879 - DNA, 22 bp, Artificial Sequence
  chemically synthesized
tccagtcaaccattgatgagct

SEQ ID NO: 1383880 - DNA, 22 bp, Artificial Sequence
  chemically synthesized
atccagtcaaccattgatgagc

SEQ ID NO: 1383881 - DNA, 22 bp, Artificial Sequence
  chemically synthesized
tatccagtcaaccattgatgag

SEQ ID NO: 1383882 - DNA, 22 bp, Artificial Sequence
  chemically synthesized
tttatccagtcaaccattgatg

SEQ ID NO: 1383883 - DNA, 22 bp, Artificial Sequence
  chemically synthesized
ctttatccagtcaaccattgat

SEQ ID NO: 1383884 - DNA, 22 bp, Artificial Sequence
  chemically synthesized
tctttatccagtcaaccattga

SEQ ID NO: 1383885 - DNA, 22 bp, Artificial Sequence
  chemically synthesized
aaagctcatcaatggttgactg

SEQ ID NO: 1383886 - DNA, 22 bp, Artificial Sequence
  chemically synthesized
cattttctttatccagtcaacc

SEQ ID NO: 1383887 - DNA, 22 bp, Artificial Sequence
  chemically synthesized
atcaatggttgactggataaag

SEQ ID NO: 1383888 - DNA, 22 bp, Artificial Sequence
  chemically synthesized
actggataaagaaaatgtagta

SEQ ID NO: 1383889 - DNA, 22 bp, Artificial Sequence
  chemically synthesized
cgtggtgtgtatgtactacatt

SEQ ID NO: 1383890 - DNA, 22 bp, Artificial Sequence
  chemically synthesized
gataaagaaaatgtagtacata

SEQ ID NO: 1383891 - DNA, 22 bp, Artificial Sequence
  chemically synthesized
cataggattccgtggtgtgtat

SEQ ID NO: 1383892 - DNA, 22 bp, Artificial Sequence
  chemically synthesized
tggctgcataggattccgtggt

SEQ ID NO: 1383893 - DNA, 22 bp, Artificial Sequence
  chemically synthesized
atggctgcataggattccgtgg

SEQ ID NO: 1383894 - DNA, 22 bp, Artificial Sequence
  chemically synthesized
tatggctgcataggattccgtg

SEQ ID NO: 1383895 - DNA, 22 bp, Artificial Sequence
  chemically synthesized
ttatggctgcataggattccgt

SEQ ID NO: 1383896 - DNA, 22 bp, Artificial Sequence
  chemically synthesized
tttatggctgcataggattccg

SEQ ID NO: 1383897 - DNA, 22 bp, Artificial Sequence
  chemically synthesized
ttttatggctgcataggattcc

SEQ ID NO: 1383898 - DNA, 22 bp, Artificial Sequence
  chemically synthesized
ttttttatggctgcataggatt

SEQ ID NO: 1383899 - DNA, 22 bp, Artificial Sequence
  chemically synthesized
ttcttttttatggctgcatagg

SEQ ID NO: 1383900 - DNA, 22 bp, Artificial Sequence
  chemically synthesized
gttcttttttatggctgcatag

SEQ ID NO: 1383901 - DNA, 22 bp, Artificial Sequence
  chemically synthesized
tgttcttttttatggctgcata

SEQ ID NO: 1383902 - DNA, 22 bp, Artificial Sequence
  chemically synthesized
tgcagccataaaaaagaacaaa

SEQ ID NO: 1383903 - DNA, 22 bp, Artificial Sequence
  chemically synthesized
caaaggacatgattttgttctt

SEQ ID NO: 1383904 - DNA, 22 bp, Artificial Sequence
  chemically synthesized
catccatgtcgctgcaaaggac

SEQ ID NO: 1383905 - DNA, 22 bp, Artificial Sequence
  chemically synthesized
cagctccatccatgtcgctgca

SEQ ID NO: 1383906 - DNA, 22 bp, Artificial Sequence
  chemically synthesized
tgcagcgacatggatggagctg

SEQ ID NO: 1383907 - DNA, 22 bp, Artificial Sequence
  chemically synthesized
gcagcgacatggatggagctgg

SEQ ID NO: 1383908 - DNA, 22 bp, Artificial Sequence
  chemically synthesized
atataatgtcctccagctccat

SEQ ID NO: 1383909 - DNA, 22 bp, Artificial Sequence
  chemically synthesized
cagcgacatggatggagctgga

SEQ ID NO: 1383910 - DNA, 22 bp, Artificial Sequence
  chemically synthesized
aatataatgtcctccagctcca

SEQ ID NO: 1383911 - DNA, 22 bp, Artificial Sequence
  chemically synthesized
gcttaatataatgtcctccagc

SEQ ID NO: 1383912 - DNA, 22 bp, Artificial Sequence
  chemically synthesized
cgcttaatataatgtcctccag

SEQ ID NO: 1383913 - DNA, 22 bp, Artificial Sequence
  chemically synthesized
cttcgcttaatataatgtcctc

SEQ ID NO: 1383914 - DNA, 22 bp, Artificial Sequence
  chemically synthesized
cattacttcgcttaatataatg

SEQ ID NO: 1383915 - DNA, 22 bp, Artificial Sequence
  chemically synthesized
gcattacttcgcttaatataat

SEQ ID NO: 1383916 - DNA, 22 bp, Artificial Sequence
  chemically synthesized
ttgcattacttcgcttaatata

SEQ ID NO: 1383917 - DNA, 22 bp, Artificial Sequence
  chemically synthesized
ttcttgcattacttcgcttaat

SEQ ID NO: 1383918 - DNA, 22 bp, Artificial Sequence
  chemically synthesized
gaggacattatattaagcgaag

SEQ ID NO: 1383919 - DNA, 22 bp, Artificial Sequence
  chemically synthesized
tgttcttgcattacttcgctta

SEQ ID NO: 1383920 - DNA, 22 bp, Artificial Sequence
  chemically synthesized
ctgttcttgcattacttcgctt

SEQ ID NO: 1383921 - DNA, 22 bp, Artificial Sequence
  chemically synthesized
tctgttcttgcattacttcgct

SEQ ID NO: 1383922 - DNA, 22 bp, Artificial Sequence
  chemically synthesized
gttttctgttcttgcattactt

SEQ ID NO: 1383923 - DNA, 22 bp, Artificial Sequence
  chemically synthesized
ggttttctgttcttgcattact

SEQ ID NO: 1383924 - DNA, 22 bp, Artificial Sequence
  chemically synthesized
tattaagcgaagtaatgcaaga

SEQ ID NO: 1383925 - DNA, 22 bp, Artificial Sequence
  chemically synthesized
agcgaagtaatgcaagaacaga

SEQ ID NO: 1383926 - DNA, 22 bp, Artificial Sequence
  chemically synthesized
taagtgagagcatgtggcattt

SEQ ID NO: 1383927 - DNA, 22 bp, Artificial Sequence
  chemically synthesized
ataagtgagagcatgtggcatt

SEQ ID NO: 1383928 - DNA, 22 bp, Artificial Sequence
  chemically synthesized
ccatttataagtgagagcatgt

SEQ ID NO: 1383929 - DNA, 22 bp, Artificial Sequence
  chemically synthesized
gttcccatttataagtgagagc

SEQ ID NO: 1383930 - DNA, 22 bp, Artificial Sequence
  chemically synthesized
agttcccatttataagtgagag

SEQ ID NO: 1383931 - DNA, 22 bp, Artificial Sequence
  chemically synthesized
aatgtttagttcccatttataa

SEQ ID NO: 1383932 - DNA, 22 bp, Artificial Sequence
  chemically synthesized
tgctcaatgtttagttcccatt

SEQ ID NO: 1383933 - DNA, 22 bp, Artificial Sequence
  chemically synthesized
tcacttataaatgggaactaaa

SEQ ID NO: 1383934 - DNA, 22 bp, Artificial Sequence
  chemically synthesized
acttataaatgggaactaaaca

SEQ ID NO: 1383935 - DNA, 22 bp, Artificial Sequence
  chemically synthesized
ataaatgggaactaaacattga

SEQ ID NO: 1383936 - DNA, 22 bp, Artificial Sequence
  chemically synthesized
tgtccgttgtgctcaatgttta

SEQ ID NO: 1383937 - DNA, 22 bp, Artificial Sequence
  chemically synthesized
taaatgggaactaaacattgag

SEQ ID NO: 1383938 - DNA, 22 bp, Artificial Sequence
  chemically synthesized
atgtccgttgtgctcaatgttt

SEQ ID NO: 1383939 - DNA, 22 bp, Artificial Sequence
  chemically synthesized
atgtttatgtccgttgtgctca

SEQ ID NO: 1383940 - DNA, 22 bp, Artificial Sequence
  chemically synthesized
tcatgtttatgtccgttgtgct

SEQ ID NO: 1383941 - DNA, 22 bp, Artificial Sequence
  chemically synthesized
ttctcatgtttatgtccgttgt

SEQ ID NO: 1383942 - DNA, 22 bp, Artificial Sequence
  chemically synthesized
aacattgagcacaacggacata

SEQ ID NO: 1383943 - DNA, 22 bp, Artificial Sequence
  chemically synthesized
ttgttctcatgtttatgtccgt

SEQ ID NO: 1383944 - DNA, 22 bp, Artificial Sequence
  chemically synthesized
agcacaacggacataaacatga

SEQ ID NO: 1383945 - DNA, 22 bp, Artificial Sequence
  chemically synthesized
gtagtccacagtgtctgttgtt

SEQ ID NO: 1383946 - DNA, 22 bp, Artificial Sequence
  chemically synthesized
tagtagtccacagtgtctgttg

SEQ ID NO: 1383947 - DNA, 22 bp, Artificial Sequence
  chemically synthesized
cccactctagtagtccacagtg

SEQ ID NO: 1383948 - DNA, 22 bp, Artificial Sequence
  chemically synthesized
cccgccggtccctccccactct

SEQ ID NO: 1383949 - DNA, 22 bp, Artificial Sequence
  chemically synthesized
ccccgccggtccctccccactc

SEQ ID NO: 1383950 - DNA, 22 bp, Artificial Sequence
  chemically synthesized
tggactactagagtggggaggg

SEQ ID NO: 1383951 - DNA, 22 bp, Artificial Sequence
  chemically synthesized
cttccccgccggtccctcccca

SEQ ID NO: 1383952 - DNA, 22 bp, Artificial Sequence
  chemically synthesized
actccttccccgccggtccctc

SEQ ID NO: 1383953 - DNA, 22 bp, Artificial Sequence
  chemically synthesized
aactccttccccgccggtccct

SEQ ID NO: 1383954 - DNA, 22 bp, Artificial Sequence
  chemically synthesized
ctagagtggggagggaccggcg

SEQ ID NO: 1383955 - DNA, 22 bp, Artificial Sequence
  chemically synthesized
taactccttccccgccggtccc

SEQ ID NO: 1383956 - DNA, 22 bp, Artificial Sequence
  chemically synthesized
ttaactccttccccgccggtcc

SEQ ID NO: 1383957 - DNA, 22 bp, Artificial Sequence
  chemically synthesized
gagtggggagggaccggcgggg

SEQ ID NO: 1383958 - DNA, 22 bp, Artificial Sequence
  chemically synthesized
aaagctacctattgggtactat

SEQ ID NO: 1383959 - DNA, 22 bp, Artificial Sequence
  chemically synthesized
cacccagatagtaagcatagta

SEQ ID NO: 1383960 - DNA, 22 bp, Artificial Sequence
  chemically synthesized
cctattgggtactatgcttact

SEQ ID NO: 1383961 - DNA, 22 bp, Artificial Sequence
  chemically synthesized
ttgggtactatgcttactatct

SEQ ID NO: 1383962 - DNA, 22 bp, Artificial Sequence
  chemically synthesized
ggtactatgcttactatctggg

SEQ ID NO: 1383963 - DNA, 22 bp, Artificial Sequence
  chemically synthesized
aaacggtatattgcacccagat

SEQ ID NO: 1383964 - DNA, 22 bp, Artificial Sequence
  chemically synthesized
ttaaaacggtatattgcaccca

SEQ ID NO: 1383965 - DNA, 22 bp, Artificial Sequence
  chemically synthesized
tgcttactatctgggtgcaata

SEQ ID NO: 1383966 - DNA, 22 bp, Artificial Sequence
  chemically synthesized
gttaaaacggtatattgcaccc

SEQ ID NO: 1383967 - DNA, 22 bp, Artificial Sequence
  chemically synthesized
actatctgggtgcaatataccg

SEQ ID NO: 1383968 - DNA, 22 bp, Artificial Sequence
  chemically synthesized
ctatctgggtgcaatataccgt

SEQ ID NO: 1383969 - DNA, 22 bp, Artificial Sequence
  chemically synthesized
tctgggtgcaatataccgtttt

SEQ ID NO: 1383970 - DNA, 22 bp, Artificial Sequence
  chemically synthesized
ggtgcaatataccgttttaaca

SEQ ID NO: 1383971 - DNA, 22 bp, Artificial Sequence
  chemically synthesized
catacagggagtacacatgcag

SEQ ID NO: 1383972 - DNA, 22 bp, Artificial Sequence
  chemically synthesized
acatacagggagtacacatgca

SEQ ID NO: 1383973 - DNA, 22 bp, Artificial Sequence
  chemically synthesized
tacatacagggagtacacatgc

SEQ ID NO: 1383974 - DNA, 22 bp, Artificial Sequence
  chemically synthesized
taacaaatctgcatgtgtactc

SEQ ID NO: 1383975 - DNA, 22 bp, Artificial Sequence
  chemically synthesized
aacaaatctgcatgtgtactcc

SEQ ID NO: 1383976 - DNA, 22 bp, Artificial Sequence
  chemically synthesized
ttttacatacagggagtacaca

SEQ ID NO: 1383977 - DNA, 22 bp, Artificial Sequence
  chemically synthesized
acaaatctgcatgtgtactccc

SEQ ID NO: 1383978 - DNA, 22 bp, Artificial Sequence
  chemically synthesized
attttacatacagggagtacac

SEQ ID NO: 1383979 - DNA, 22 bp, Artificial Sequence
  chemically synthesized
tattttacatacagggagtaca

SEQ ID NO: 1383980 - DNA, 22 bp, Artificial Sequence
  chemically synthesized
ttattttacatacagggagtac

SEQ ID NO: 1383981 - DNA, 22 bp, Artificial Sequence
  chemically synthesized
aacttttattttacatacaggg

SEQ ID NO: 1383982 - DNA, 22 bp, Artificial Sequence
  chemically synthesized
caacttttattttacatacagg

SEQ ID NO: 1383983 - DNA, 22 bp, Artificial Sequence
  chemically synthesized
catgtgtactccctgtatgtaa

SEQ ID NO: 1383984 - DNA, 22 bp, Artificial Sequence
  chemically synthesized
atttcaacttttattttacata

SEQ ID NO: 1383985 - DNA, 22 bp, Artificial Sequence
  chemically synthesized
aatttcaacttttattttacat

SEQ ID NO: 1383986 - DNA, 22 bp, Artificial Sequence
  chemically synthesized
taatttcaacttttattttaca

SEQ ID NO: 1383987 - DNA, 22 bp, Artificial Sequence
  chemically synthesized
ttaatttcaacttttattttac

SEQ ID NO: 1383988 - DNA, 22 bp, Artificial Sequence
  chemically synthesized
tttttaatttcaacttttattt

SEQ ID NO: 1383989 - DNA, 22 bp, Artificial Sequence
  chemically synthesized
atttttaatttcaacttttatt

SEQ ID NO: 1383990 - DNA, 22 bp, Artificial Sequence
  chemically synthesized
cctgtatgtaaaataaaagttg

SEQ ID NO: 1383991 - DNA, 22 bp, Artificial Sequence
  chemically synthesized
tatttttaatttcaacttttat

SEQ ID NO: 1383992 - DNA, 22 bp, Artificial Sequence
  chemically synthesized
ttatttttaatttcaactttta

SEQ ID NO: 1383993 - DNA, 22 bp, Artificial Sequence
  chemically synthesized
tatgtaaaataaaagttgaaat

SEQ ID NO: 1383994 - DNA, 22 bp, Artificial Sequence
  chemically synthesized
aagtaggacacttttattttta

SEQ ID NO: 1383995 - DNA, 22 bp, Artificial Sequence
  chemically synthesized
aaagtaggacacttttattttt

SEQ ID NO: 1383996 - DNA, 22 bp, Artificial Sequence
  chemically synthesized
taaagtaggacacttttatttt

SEQ ID NO: 1383997 - DNA, 22 bp, Artificial Sequence
  chemically synthesized
tttaaagtaggacacttttatt

SEQ ID NO: 1383998 - DNA, 22 bp, Artificial Sequence
  chemically synthesized
ctttaaagtaggacacttttat

SEQ ID NO: 1383999 - DNA, 22 bp, Artificial Sequence
  chemically synthesized
tctttaaagtaggacactttta

SEQ ID NO: 1384000 - DNA, 22 bp, Artificial Sequence
  chemically synthesized
aaattaaaaataaaagtgtcct

SEQ ID NO: 1384001 - DNA, 22 bp, Artificial Sequence
  chemically synthesized
aaaataaaagtgtcctacttta

SEQ ID NO: 1384002 - DNA, 22 bp, Artificial Sequence
  chemically synthesized
gcatgttttctttaaagtagga

SEQ ID NO: 1384003 - DNA, 22 bp, Artificial Sequence
  chemically synthesized
tgtaataggtgcctggcatgtt

SEQ ID NO: 1384004 - DNA, 22 bp, Artificial Sequence
  chemically synthesized
ctttaaagaaaacatgccaggc

SEQ ID NO: 1384005 - DNA, 22 bp, Artificial Sequence
  chemically synthesized
ctgtgtaataggtgcctggcat

SEQ ID NO: 1384006 - DNA, 22 bp, Artificial Sequence
  chemically synthesized
gctgtgtaataggtgcctggca

SEQ ID NO: 1384007 - DNA, 22 bp, Artificial Sequence
  chemically synthesized
taaagaaaacatgccaggcacc

SEQ ID NO: 1384008 - DNA, 22 bp, Artificial Sequence
  chemically synthesized
aaagaaaacatgccaggcacct

SEQ ID NO: 1384009 - DNA, 22 bp, Artificial Sequence
  chemically synthesized
aagaaaacatgccaggcaccta

SEQ ID NO: 1384010 - DNA, 22 bp, Artificial Sequence
  chemically synthesized
tagtgagcgaataatgatactt

SEQ ID NO: 1384011 - DNA, 22 bp, Artificial Sequence
  chemically synthesized
ttacacagcaagtatcattatt

SEQ ID NO: 1384012 - DNA, 22 bp, Artificial Sequence
  chemically synthesized
cacagcaagtatcattattcgc

SEQ ID NO: 1384013 - DNA, 22 bp, Artificial Sequence
  chemically synthesized
aaaataattgtagtgagcgaat

SEQ ID NO: 1384014 - DNA, 22 bp, Artificial Sequence
  chemically synthesized
aatctgaaaataattgtagtga

SEQ ID NO: 1384015 - DNA, 22 bp, Artificial Sequence
  chemically synthesized
cctcaatctgaaaataattgta

SEQ ID NO: 1384016 - DNA, 22 bp, Artificial Sequence
  chemically synthesized
gcctcaatctgaaaataattgt

SEQ ID NO: 1384017 - DNA, 22 bp, Artificial Sequence
  chemically synthesized
ttcgctcactacaattattttc

SEQ ID NO: 1384018 - DNA, 22 bp, Artificial Sequence
  chemically synthesized
gctcactacaattattttcaga

SEQ ID NO: 1384019 - DNA, 22 bp, Artificial Sequence
  chemically synthesized
tgaacttgcctcaatctgaaaa

SEQ ID NO: 1384020 - DNA, 22 bp, Artificial Sequence
  chemically synthesized
actacaattattttcagattga

SEQ ID NO: 1384021 - DNA, 22 bp, Artificial Sequence
  chemically synthesized
actatgaacttgcctcaatctg

SEQ ID NO: 1384022 - DNA, 22 bp, Artificial Sequence
  chemically synthesized
aactatgaacttgcctcaatct

SEQ ID NO: 1384023 - DNA, 22 bp, Artificial Sequence
  chemically synthesized
caattattttcagattgaggca

SEQ ID NO: 1384024 - DNA, 22 bp, Artificial Sequence
  chemically synthesized
taactatgaacttgcctcaatc

SEQ ID NO: 1384025 - DNA, 22 bp, Artificial Sequence
  chemically synthesized
ttaactatgaacttgcctcaat

SEQ ID NO: 1384026 - DNA, 22 bp, Artificial Sequence
  chemically synthesized
ttttcagattgaggcaagttca

SEQ ID NO: 1384027 - DNA, 22 bp, Artificial Sequence
  chemically synthesized
aatttttaactatgaacttgcc

SEQ ID NO: 1384028 - DNA, 22 bp, Artificial Sequence
  chemically synthesized
tcagattgaggcaagttcatag

SEQ ID NO: 1384029 - DNA, 22 bp, Artificial Sequence
  chemically synthesized
cagattgaggcaagttcatagt

SEQ ID NO: 1384030 - DNA, 22 bp, Artificial Sequence
  chemically synthesized
agattgaggcaagttcatagtt

SEQ ID NO: 1384031 - DNA, 22 bp, Artificial Sequence
  chemically synthesized
aggcaagttcatagttaaaaat

SEQ ID NO: 1384032 - DNA, 22 bp, Artificial Sequence
  chemically synthesized
tatcaccccaattaaattttta

SEQ ID NO: 1384033 - DNA, 22 bp, Artificial Sequence
  chemically synthesized
tattatatcaccccaattaaat

SEQ ID NO: 1384034 - DNA, 22 bp, Artificial Sequence
  chemically synthesized
atagttaaaaatttaattgggg

SEQ ID NO: 1384035 - DNA, 22 bp, Artificial Sequence
  chemically synthesized
aaaatttaattggggtgatata

SEQ ID NO: 1384036 - DNA, 22 bp, Artificial Sequence
  chemically synthesized
aacaaaccacattgtattatat

SEQ ID NO: 1384037 - DNA, 22 bp, Artificial Sequence
  chemically synthesized
aattggggtgatataatacaat

SEQ ID NO: 1384038 - DNA, 22 bp, Artificial Sequence
  chemically synthesized
attggggtgatataatacaatg

SEQ ID NO: 1384039 - DNA, 22 bp, Artificial Sequence
  chemically synthesized
ctaaacaaaccacattgtatta

SEQ ID NO: 1384040 - DNA, 22 bp, Artificial Sequence
  chemically synthesized
ctactaaacaaaccacattgta

SEQ ID NO: 1384041 - DNA, 22 bp, Artificial Sequence
  chemically synthesized
gggtgatataatacaatgtggt

SEQ ID NO: 1384042 - DNA, 22 bp, Artificial Sequence
  chemically synthesized
aaataaaatctactactaaaca

SEQ ID NO: 1384043 - DNA, 22 bp, Artificial Sequence
  chemically synthesized
ttaaaataaaatctactactaa

SEQ ID NO: 1384044 - DNA, 22 bp, Artificial Sequence
  chemically synthesized
gtttagtagtagattttatttt

SEQ ID NO: 1384045 - DNA, 22 bp, Artificial Sequence
  chemically synthesized
tttagtagtagattttatttta

SEQ ID NO: 1384046 - DNA, 22 bp, Artificial Sequence
  chemically synthesized
agtagtagattttattttaata

SEQ ID NO: 1384047 - DNA, 22 bp, Artificial Sequence
  chemically synthesized
gtagtagattttattttaatag

SEQ ID NO: 1384048 - DNA, 22 bp, Artificial Sequence
  chemically synthesized
agtcatatataacactattaaa

SEQ ID NO: 1384049 - DNA, 22 bp, Artificial Sequence
  chemically synthesized
aagtcatatataacactattaa

SEQ ID NO: 1384050 - DNA, 22 bp, Artificial Sequence
  chemically synthesized
tattttaatagtgttatatatg

SEQ ID NO: 1384051 - DNA, 22 bp, Artificial Sequence
  chemically synthesized
attttaatagtgttatatatga

SEQ ID NO: 1384052 - DNA, 22 bp, Artificial Sequence
  chemically synthesized
tataaacttaagtcatatataa

SEQ ID NO: 1384053 - DNA, 22 bp, Artificial Sequence
  chemically synthesized
ttttaatagtgttatatatgac

SEQ ID NO: 1384054 - DNA, 22 bp, Artificial Sequence
  chemically synthesized
taatagtgttatatatgactta

SEQ ID NO: 1384055 - DNA, 22 bp, Artificial Sequence
  chemically synthesized
aatagtgttatatatgacttaa

SEQ ID NO: 1384056 - DNA, 22 bp, Artificial Sequence
  chemically synthesized
atagtgttatatatgacttaag

SEQ ID NO: 1384057 - DNA, 22 bp, Artificial Sequence
  chemically synthesized
atgattgtataaacttaagtca

SEQ ID NO: 1384058 - DNA, 22 bp, Artificial Sequence
  chemically synthesized
gatgattgtataaacttaagtc

SEQ ID NO: 1384059 - DNA, 22 bp, Artificial Sequence
  chemically synthesized
ttgatgattgtataaacttaag

SEQ ID NO: 1384060 - DNA, 22 bp, Artificial Sequence
  chemically synthesized
tatatgacttaagtttatacaa

SEQ ID NO: 1384061 - DNA, 22 bp, Artificial Sequence
  chemically synthesized
aagtttatacaatcatcaagag

SEQ ID NO: 1384062 - DNA, 22 bp, Artificial Sequence
  chemically synthesized
agtttatacaatcatcaagagt

SEQ ID NO: 1384063 - DNA, 22 bp, Artificial Sequence
  chemically synthesized
cagagaccccatcagactcttg

SEQ ID NO: 1384064 - DNA, 22 bp, Artificial Sequence
  chemically synthesized
atacaatcatcaagagtctgat

SEQ ID NO: 1384065 - DNA, 22 bp, Artificial Sequence
  chemically synthesized
tacaatcatcaagagtctgatg

SEQ ID NO: 1384066 - DNA, 22 bp, Artificial Sequence
  chemically synthesized
attacagagaccccatcagact

SEQ ID NO: 1384067 - DNA, 22 bp, Artificial Sequence
  chemically synthesized
atggggtctctgtaattagcca

SEQ ID NO: 1384068 - DNA, 22 bp, Artificial Sequence
  chemically synthesized
ataaaatgcagtaaagtatggc

SEQ ID NO: 1384069 - DNA, 22 bp, Artificial Sequence
  chemically synthesized
ctcataaaatgcagtaaagtat

SEQ ID NO: 1384070 - DNA, 22 bp, Artificial Sequence
  chemically synthesized
tgtaattagccatactttactg

SEQ ID NO: 1384071 - DNA, 22 bp, Artificial Sequence
  chemically synthesized
tactcataaaatgcagtaaagt

SEQ ID NO: 1384072 - DNA, 22 bp, Artificial Sequence
  chemically synthesized
taattagccatactttactgca

SEQ ID NO: 1384073 - DNA, 22 bp, Artificial Sequence
  chemically synthesized
gccatactttactgcattttat

SEQ ID NO: 1384074 - DNA, 22 bp, Artificial Sequence
  chemically synthesized
aggcatataattctactcataa

SEQ ID NO: 1384075 - DNA, 22 bp, Artificial Sequence
  chemically synthesized
tactgcattttatgagtagaat

SEQ ID NO: 1384076 - DNA, 22 bp, Artificial Sequence
  chemically synthesized
actgcattttatgagtagaatt

SEQ ID NO: 1384077 - DNA, 22 bp, Artificial Sequence
  chemically synthesized
ctgcattttatgagtagaatta

SEQ ID NO: 1384078 - DNA, 22 bp, Artificial Sequence
  chemically synthesized
cattttatgagtagaattatat

SEQ ID NO: 1384079 - DNA, 22 bp, Artificial Sequence
  chemically synthesized
caaacatcactaaggcatataa

SEQ ID NO: 1384080 - DNA, 22 bp, Artificial Sequence
  chemically synthesized
tatgagtagaattatatgcctt

SEQ ID NO: 1384081 - DNA, 22 bp, Artificial Sequence
  chemically synthesized
gcaaacatcactaaggcatata

SEQ ID NO: 1384082 - DNA, 22 bp, Artificial Sequence
  chemically synthesized
atgagtagaattatatgcctta

SEQ ID NO: 1384083 - DNA, 22 bp, Artificial Sequence
  chemically synthesized
tgagtagaattatatgccttag

SEQ ID NO: 1384084 - DNA, 22 bp, Artificial Sequence
  chemically synthesized
cgaatttgcaaacatcactaag

SEQ ID NO: 1384085 - DNA, 22 bp, Artificial Sequence
  chemically synthesized
tatgccttagtgatgtttgcaa

SEQ ID NO: 1384086 - DNA, 22 bp, Artificial Sequence
  chemically synthesized
caaaactccgaatttgcaaaca

SEQ ID NO: 1384087 - DNA, 22 bp, Artificial Sequence
  chemically synthesized
gcaaaactccgaatttgcaaac

SEQ ID NO: 1384088 - DNA, 22 bp, Artificial Sequence
  chemically synthesized
tgcaaaactccgaatttgcaaa

SEQ ID NO: 1384089 - DNA, 22 bp, Artificial Sequence
  chemically synthesized
agtgatgtttgcaaattcggag

SEQ ID NO: 1384090 - DNA, 22 bp, Artificial Sequence
  chemically synthesized
gtgatgtttgcaaattcggagt

SEQ ID NO: 1384091 - DNA, 22 bp, Artificial Sequence
  chemically synthesized
tcccaagatctttgcaaaactc

SEQ ID NO: 1384092 - DNA, 22 bp, Artificial Sequence
  chemically synthesized
gtcccaagatctttgcaaaact

SEQ ID NO: 1384093 - DNA, 22 bp, Artificial Sequence
  chemically synthesized
gcaaattcggagttttgcaaag

SEQ ID NO: 1384094 - DNA, 22 bp, Artificial Sequence
  chemically synthesized
caaattcggagttttgcaaaga

SEQ ID NO: 1384095 - DNA, 22 bp, Artificial Sequence
  chemically synthesized
ggagttttgcaaagatcttggg

SEQ ID NO: 1384096 - DNA, 22 bp, Artificial Sequence
  chemically synthesized
tgcaaagatcttgggacaaata

SEQ ID NO: 1384097 - DNA, 22 bp, Artificial Sequence
  chemically synthesized
gcaaagatcttgggacaaatac

SEQ ID NO: 1384098 - DNA, 22 bp, Artificial Sequence
  chemically synthesized
aagagccccagggtatttgtcc

SEQ ID NO: 1384099 - DNA, 22 bp, Artificial Sequence
  chemically synthesized
caaagatcttgggacaaatacc

SEQ ID NO: 1384100 - DNA, 22 bp, Artificial Sequence
  chemically synthesized
tgaagagccccagggtatttgt

SEQ ID NO: 1384101 - DNA, 22 bp, Artificial Sequence
  chemically synthesized
gactctgaagagccccagggta

SEQ ID NO: 1384102 - DNA, 22 bp, Artificial Sequence
  chemically synthesized
gggacaaataccctggggctct

SEQ ID NO: 1384103 - DNA, 22 bp, Artificial Sequence
  chemically synthesized
ggacaaataccctggggctctt

SEQ ID NO: 1384104 - DNA, 22 bp, Artificial Sequence
  chemically synthesized
cgtatatattagactctgaaga

SEQ ID NO: 1384105 - DNA, 22 bp, Artificial Sequence
  chemically synthesized
acgtatatattagactctgaag

SEQ ID NO: 1384106 - DNA, 22 bp, Artificial Sequence
  chemically synthesized
tacgtatatattagactctgaa

SEQ ID NO: 1384107 - DNA, 22 bp, Artificial Sequence
  chemically synthesized
ttttacgtatatattagactct

SEQ ID NO: 1384108 - DNA, 22 bp, Artificial Sequence
  chemically synthesized
attttacgtatatattagactc

SEQ ID NO: 1384109 - DNA, 22 bp, Artificial Sequence
  chemically synthesized
tattttacgtatatattagact

SEQ ID NO: 1384110 - DNA, 22 bp, Artificial Sequence
  chemically synthesized
gggctcttcagagtctaatata

SEQ ID NO: 1384111 - DNA, 22 bp, Artificial Sequence
  chemically synthesized
ttattttacgtatatattagac

SEQ ID NO: 1384112 - DNA, 22 bp, Artificial Sequence
  chemically synthesized
ttcagagtctaatatatacgta

SEQ ID NO: 1384113 - DNA, 22 bp, Artificial Sequence
  chemically synthesized
tgaccttttattttacgtatat

SEQ ID NO: 1384114 - DNA, 22 bp, Artificial Sequence
  chemically synthesized
cagagtctaatatatacgtaaa

SEQ ID NO: 1384115 - DNA, 22 bp, Artificial Sequence
  chemically synthesized
agagtctaatatatacgtaaaa

SEQ ID NO: 1384116 - DNA, 22 bp, Artificial Sequence
  chemically synthesized
ttatgaccttttattttacgta

SEQ ID NO: 1384117 - DNA, 22 bp, Artificial Sequence
  chemically synthesized
attatgaccttttattttacgt

SEQ ID NO: 1384118 - DNA, 22 bp, Artificial Sequence
  chemically synthesized
tttattatgaccttttatttta

SEQ ID NO: 1384119 - DNA, 22 bp, Artificial Sequence
  chemically synthesized
atttattatgaccttttatttt

SEQ ID NO: 1384120 - DNA, 22 bp, Artificial Sequence
  chemically synthesized
tatttattatgaccttttattt

SEQ ID NO: 1384121 - DNA, 22 bp, Artificial Sequence
  chemically synthesized
atatatacgtaaaataaaaggt

SEQ ID NO: 1384122 - DNA, 22 bp, Artificial Sequence
  chemically synthesized
catatgattttatttattatga

SEQ ID NO: 1384123 - DNA, 22 bp, Artificial Sequence
  chemically synthesized
tatatatatacatatatataag

SEQ ID NO: 1384124 - DNA, 22 bp, Artificial Sequence
  chemically synthesized
tgattatatatatatacatata

SEQ ID NO: 1384125 - DNA, 22 bp, Artificial Sequence
  chemically synthesized
taaatctgtgattatatatata

SEQ ID NO: 1384126 - DNA, 22 bp, Artificial Sequence
  chemically synthesized
atatatatgtatatatatataa

SEQ ID NO: 1384127 - DNA, 22 bp, Artificial Sequence
  chemically synthesized
tatatatgtatatatatataat

SEQ ID NO: 1384128 - DNA, 22 bp, Artificial Sequence
  chemically synthesized
gtaatcattataaatctgtgat

SEQ ID NO: 1384129 - DNA, 22 bp, Artificial Sequence
  chemically synthesized
ggtaatcattataaatctgtga

SEQ ID NO: 1384130 - DNA, 22 bp, Artificial Sequence
  chemically synthesized
cgatccacttggtaatcattat

SEQ ID NO: 1384131 - DNA, 22 bp, Artificial Sequence
  chemically synthesized
tagctacgatccacttggtaat

SEQ ID NO: 1384132 - DNA, 22 bp, Artificial Sequence
  chemically synthesized
atagctacgatccacttggtaa

SEQ ID NO: 1384133 - DNA, 22 bp, Artificial Sequence
  chemically synthesized
ataatgattaccaagtggatcg

SEQ ID NO: 1384134 - DNA, 22 bp, Artificial Sequence
  chemically synthesized
taatgattaccaagtggatcgt

SEQ ID NO: 1384135 - DNA, 22 bp, Artificial Sequence
  chemically synthesized
aatcacttatagctacgatcca

SEQ ID NO: 1384136 - DNA, 22 bp, Artificial Sequence
  chemically synthesized
ttaaatcacttatagctacgat

SEQ ID NO: 1384137 - DNA, 22 bp, Artificial Sequence
  chemically synthesized
ccaagtggatcgtagctataag

SEQ ID NO: 1384138 - DNA, 22 bp, Artificial Sequence
  chemically synthesized
cccctgttaaatcacttatagc

SEQ ID NO: 1384139 - DNA, 22 bp, Artificial Sequence
  chemically synthesized
taagtgatttaacaggggcaat

SEQ ID NO: 1384140 - DNA, 22 bp, Artificial Sequence
  chemically synthesized
aacaggggcaatgctttcttta

SEQ ID NO: 1384141 - DNA, 22 bp, Artificial Sequence
  chemically synthesized
atcagggtagagtaaagaaagc

SEQ ID NO: 1384142 - DNA, 22 bp, Artificial Sequence
  chemically synthesized
acaggggcaatgctttctttac

SEQ ID NO: 1384143 - DNA, 22 bp, Artificial Sequence
  chemically synthesized
tgttgatcagggtagagtaaag

SEQ ID NO: 1384144 - DNA, 22 bp, Artificial Sequence
  chemically synthesized
tctttactctaccctgatcaac

SEQ ID NO: 1384145 - DNA, 22 bp, Artificial Sequence
  chemically synthesized
ctttactctaccctgatcaaca

SEQ ID NO: 1384146 - DNA, 22 bp, Artificial Sequence
  chemically synthesized
tttactctaccctgatcaacac

SEQ ID NO: 1384147 - DNA, 22 bp, Artificial Sequence
  chemically synthesized
tactctaccctgatcaacacaa

SEQ ID NO: 1384148 - DNA, 22 bp, Artificial Sequence
  chemically synthesized
actctaccctgatcaacacaat

SEQ ID NO: 1384149 - DNA, 22 bp, Artificial Sequence
  chemically synthesized
ctctaccctgatcaacacaata

SEQ ID NO: 1384150 - DNA, 22 bp, Artificial Sequence
  chemically synthesized
taccctgatcaacacaatattt

SEQ ID NO: 1384151 - DNA, 22 bp, Artificial Sequence
  chemically synthesized
gagacataaacccaaatattgt

SEQ ID NO: 1384152 - DNA, 22 bp, Artificial Sequence
  chemically synthesized
ccctgatcaacacaatatttgg

SEQ ID NO: 1384153 - DNA, 22 bp, Artificial Sequence
  chemically synthesized
actagagacataaacccaaata

SEQ ID NO: 1384154 - DNA, 22 bp, Artificial Sequence
  chemically synthesized
atcaacacaatatttgggttta

SEQ ID NO: 1384155 - DNA, 22 bp, Artificial Sequence
  chemically synthesized
tctcactagagacataaaccca

SEQ ID NO: 1384156 - DNA, 22 bp, Artificial Sequence
  chemically synthesized
gggtttatgtctctagtgagat

SEQ ID NO: 1384157 - DNA, 22 bp, Artificial Sequence
  chemically synthesized
ggtttatgtctctagtgagata

SEQ ID NO: 1384158 - DNA, 22 bp, Artificial Sequence
  chemically synthesized
atgtctctagtgagataacgct

SEQ ID NO: 1384159 - DNA, 22 bp, Artificial Sequence
  chemically synthesized
tgtctctagtgagataacgctt

SEQ ID NO: 1384160 - DNA, 22 bp, Artificial Sequence
  chemically synthesized
tagtgagataacgcttatgttt

SEQ ID NO: 1384161 - DNA, 22 bp, Artificial Sequence
  chemically synthesized
gtgagataacgcttatgttttt

SEQ ID NO: 1384162 - DNA, 22 bp, Artificial Sequence
  chemically synthesized
aaagtatcaagataaaaacata

SEQ ID NO: 1384163 - DNA, 22 bp, Artificial Sequence
  chemically synthesized
aaaagtatcaagataaaaacat

SEQ ID NO: 1384164 - DNA, 22 bp, Artificial Sequence
  chemically synthesized
taaaagtatcaagataaaaaca

SEQ ID NO: 1384165 - DNA, 22 bp, Artificial Sequence
  chemically synthesized
atgtttttatcttgatactttt

SEQ ID NO: 1384166 - DNA, 22 bp, Artificial Sequence
  chemically synthesized
tgtttttatcttgatactttta

SEQ ID NO: 1384167 - DNA, 22 bp, Artificial Sequence
  chemically synthesized
ttatcttgatacttttaaaatt

SEQ ID NO: 1384168 - DNA, 22 bp, Artificial Sequence
  chemically synthesized
tatcttgatacttttaaaattc

SEQ ID NO: 1384169 - DNA, 22 bp, Artificial Sequence
  chemically synthesized
atcttgatacttttaaaattcc

SEQ ID NO: 1384170 - DNA, 22 bp, Artificial Sequence
  chemically synthesized
tcttgatacttttaaaattccc

SEQ ID NO: 1384171 - DNA, 22 bp, Artificial Sequence
  chemically synthesized
gatacttttaaaattcccactt

SEQ ID NO: 1384172 - DNA, 22 bp, Artificial Sequence
  chemically synthesized
atacttttaaaattcccacttc

SEQ ID NO: 1384173 - DNA, 22 bp, Artificial Sequence
  chemically synthesized
ttaaaattcccacttcaccttc

SEQ ID NO: 1384174 - DNA, 22 bp, Artificial Sequence
  chemically synthesized
taaaattcccacttcaccttct

SEQ ID NO: 1384175 - DNA, 22 bp, Artificial Sequence
  chemically synthesized
aaaattcccacttcaccttctg

SEQ ID NO: 1384176 - DNA, 22 bp, Artificial Sequence
  chemically synthesized
aaattcccacttcaccttctgg

SEQ ID NO: 1384177 - DNA, 22 bp, Artificial Sequence
  chemically synthesized
ccacttcaccttctggtcctta

SEQ ID NO: 1384178 - DNA, 22 bp, Artificial Sequence
  chemically synthesized
atgatatatgaaaaaaataagg

SEQ ID NO: 1384179 - DNA, 22 bp, Artificial Sequence
  chemically synthesized
caccttctggtccttatttttt

SEQ ID NO: 1384180 - DNA, 22 bp, Artificial Sequence
  chemically synthesized
accttctggtccttattttttt

SEQ ID NO: 1384181 - DNA, 22 bp, Artificial Sequence
  chemically synthesized
ctggtccttatttttttcatat

SEQ ID NO: 1384182 - DNA, 22 bp, Artificial Sequence
  chemically synthesized
tggtccttatttttttcatata

SEQ ID NO: 1384183 - DNA, 22 bp, Artificial Sequence
  chemically synthesized
gtccttatttttttcatatatc

SEQ ID NO: 1384184 - DNA, 22 bp, Artificial Sequence
  chemically synthesized
aatacccattgatgatatatga

SEQ ID NO: 1384185 - DNA, 22 bp, Artificial Sequence
  chemically synthesized
gaatacccattgatgatatatg

SEQ ID NO: 1384186 - DNA, 22 bp, Artificial Sequence
  chemically synthesized
cttgaatacccattgatgatat

SEQ ID NO: 1384187 - DNA, 22 bp, Artificial Sequence
  chemically synthesized
atttttttcatatatcatcaat

SEQ ID NO: 1384188 - DNA, 22 bp, Artificial Sequence
  chemically synthesized
ccttgaatacccattgatgata

SEQ ID NO: 1384189 - DNA, 22 bp, Artificial Sequence
  chemically synthesized
tttttttcatatatcatcaatg

SEQ ID NO: 1384190 - DNA, 22 bp, Artificial Sequence
  chemically synthesized
tccttgaatacccattgatgat

SEQ ID NO: 1384191 - DNA, 22 bp, Artificial Sequence
  chemically synthesized
ttccttgaatacccattgatga

SEQ ID NO: 1384192 - DNA, 22 bp, Artificial Sequence
  chemically synthesized
ttttcatatatcatcaatgggt

SEQ ID NO: 1384193 - DNA, 22 bp, Artificial Sequence
  chemically synthesized
ttttccttgaatacccattgat

SEQ ID NO: 1384194 - DNA, 22 bp, Artificial Sequence
  chemically synthesized
tttcatatatcatcaatgggta

SEQ ID NO: 1384195 - DNA, 22 bp, Artificial Sequence
  chemically synthesized
cttttccttgaatacccattga

SEQ ID NO: 1384196 - DNA, 22 bp, Artificial Sequence
  chemically synthesized
ttcatatatcatcaatgggtat

SEQ ID NO: 1384197 - DNA, 22 bp, Artificial Sequence
  chemically synthesized
tcttttccttgaatacccattg

SEQ ID NO: 1384198 - DNA, 22 bp, Artificial Sequence
  chemically synthesized
tcatatatcatcaatgggtatt

SEQ ID NO: 1384199 - DNA, 22 bp, Artificial Sequence
  chemically synthesized
catatatcatcaatgggtattc

SEQ ID NO: 1384200 - DNA, 22 bp, Artificial Sequence
  chemically synthesized
atatatcatcaatgggtattca

SEQ ID NO: 1384201 - DNA, 22 bp, Artificial Sequence
  chemically synthesized
tacaataattttcttttccttg

SEQ ID NO: 1384202 - DNA, 22 bp, Artificial Sequence
  chemically synthesized
atacaataattttcttttcctt

SEQ ID NO: 1384203 - DNA, 22 bp, Artificial Sequence
  chemically synthesized
aacccttatacaataattttct

SEQ ID NO: 1384204 - DNA, 22 bp, Artificial Sequence
  chemically synthesized
caacccttatacaataattttc

SEQ ID NO: 1384205 - DNA, 22 bp, Artificial Sequence
  chemically synthesized
tcaacccttatacaataatttt

SEQ ID NO: 1384206 - DNA, 22 bp, Artificial Sequence
  chemically synthesized
aaggaaaagaaaattattgtat

SEQ ID NO: 1384207 - DNA, 22 bp, Artificial Sequence
  chemically synthesized
atgttttcaacccttatacaat

SEQ ID NO: 1384208 - DNA, 22 bp, Artificial Sequence
  chemically synthesized
gatgttttcaacccttatacaa

SEQ ID NO: 1384209 - DNA, 22 bp, Artificial Sequence
  chemically synthesized
ttgatgttttcaacccttatac

SEQ ID NO: 1384210 - DNA, 22 bp, Artificial Sequence
  chemically synthesized
cttgatgttttcaacccttata

SEQ ID NO: 1384211 - DNA, 22 bp, Artificial Sequence
  chemically synthesized
tttcttgatgttttcaaccctt

SEQ ID NO: 1384212 - DNA, 22 bp, Artificial Sequence
  chemically synthesized
ttgtttcttgatgttttcaacc

SEQ ID NO: 1384213 - DNA, 22 bp, Artificial Sequence
  chemically synthesized
attgtttcttgatgttttcaac

SEQ ID NO: 1384214 - DNA, 22 bp, Artificial Sequence
  chemically synthesized
ttgtataagggttgaaaacatc

SEQ ID NO: 1384215 - DNA, 22 bp, Artificial Sequence
  chemically synthesized
tttattgtttcttgatgttttc

SEQ ID NO: 1384216 - DNA, 22 bp, Artificial Sequence
  chemically synthesized
tataagggttgaaaacatcaag

SEQ ID NO: 1384217 - DNA, 22 bp, Artificial Sequence
  chemically synthesized
actatttattgtttcttgatgt

SEQ ID NO: 1384218 - DNA, 22 bp, Artificial Sequence
  chemically synthesized
aaaatctgactatttattgttt

SEQ ID NO: 1384219 - DNA, 22 bp, Artificial Sequence
  chemically synthesized
aaaacatcaagaaacaataaat

SEQ ID NO: 1384220 - DNA, 22 bp, Artificial Sequence
  chemically synthesized
aaaaatctgactatttattgtt

SEQ ID NO: 1384221 - DNA, 22 bp, Artificial Sequence
  chemically synthesized
taaaaatctgactatttattgt

SEQ ID NO: 1384222 - DNA, 22 bp, Artificial Sequence
  chemically synthesized
ggaaaatgttttaaaaatctga

SEQ ID NO: 1384223 - DNA, 22 bp, Artificial Sequence
  chemically synthesized
gggaaaatgttttaaaaatctg

SEQ ID NO: 1384224 - DNA, 22 bp, Artificial Sequence
  chemically synthesized
aaaagatagtttgggaaaatgt

SEQ ID NO: 1384225 - DNA, 22 bp, Artificial Sequence
  chemically synthesized
tcaaaagatagtttgggaaaat

SEQ ID NO: 1384226 - DNA, 22 bp, Artificial Sequence
  chemically synthesized
gctctcaaaagatagtttggga

SEQ ID NO: 1384227 - DNA, 22 bp, Artificial Sequence
  chemically synthesized
ttaaaacattttcccaaactat

SEQ ID NO: 1384228 - DNA, 22 bp, Artificial Sequence
  chemically synthesized
ggctctcaaaagatagtttggg

SEQ ID NO: 1384229 - DNA, 22 bp, Artificial Sequence
  chemically synthesized
taaaacattttcccaaactatc

SEQ ID NO: 1384230 - DNA, 22 bp, Artificial Sequence
  chemically synthesized
tggctctcaaaagatagtttgg

SEQ ID NO: 1384231 - DNA, 22 bp, Artificial Sequence
  chemically synthesized
aaaacattttcccaaactatct

SEQ ID NO: 1384232 - DNA, 22 bp, Artificial Sequence
  chemically synthesized
aaacattttcccaaactatctt

SEQ ID NO: 1384233 - DNA, 22 bp, Artificial Sequence
  chemically synthesized
caattttggctctcaaaagata

SEQ ID NO: 1384234 - DNA, 22 bp, Artificial Sequence
  chemically synthesized
tcccaaactatcttttgagagc

SEQ ID NO: 1384235 - DNA, 22 bp, Artificial Sequence
  chemically synthesized
cccaaactatcttttgagagcc

SEQ ID NO: 1384236 - DNA, 22 bp, Artificial Sequence
  chemically synthesized
ccaaactatcttttgagagcca

SEQ ID NO: 1384237 - DNA, 22 bp, Artificial Sequence
  chemically synthesized
acagctacaattttggctctca

SEQ ID NO: 1384238 - DNA, 22 bp, Artificial Sequence
  chemically synthesized
ctcacagctacaattttggctc

SEQ ID NO: 1384239 - DNA, 22 bp, Artificial Sequence
  chemically synthesized
actcacagctacaattttggct

SEQ ID NO: 1384240 - DNA, 22 bp, Artificial Sequence
  chemically synthesized
tactcacagctacaattttggc

SEQ ID NO: 1384241 - DNA, 22 bp, Artificial Sequence
  chemically synthesized
tcttttgagagccaaaattgta

SEQ ID NO: 1384242 - DNA, 22 bp, Artificial Sequence
  chemically synthesized
ctttactcacagctacaatttt

SEQ ID NO: 1384243 - DNA, 22 bp, Artificial Sequence
  chemically synthesized
actttactcacagctacaattt

SEQ ID NO: 1384244 - DNA, 22 bp, Artificial Sequence
  chemically synthesized
ttgagagccaaaattgtagctg

SEQ ID NO: 1384245 - DNA, 22 bp, Artificial Sequence
  chemically synthesized
tgagagccaaaattgtagctgt

SEQ ID NO: 1384246 - DNA, 22 bp, Artificial Sequence
  chemically synthesized
gagagccaaaattgtagctgtg

SEQ ID NO: 1384247 - DNA, 22 bp, Artificial Sequence
  chemically synthesized
agagccaaaattgtagctgtga

SEQ ID NO: 1384248 - DNA, 22 bp, Artificial Sequence
  chemically synthesized
agccttactttactcacagcta

SEQ ID NO: 1384249 - DNA, 22 bp, Artificial Sequence
  chemically synthesized
ggataaactcagccttacttta

SEQ ID NO: 1384250 - DNA, 22 bp, Artificial Sequence
  chemically synthesized
aggataaactcagccttacttt

SEQ ID NO: 1384251 - DNA, 22 bp, Artificial Sequence
  chemically synthesized
tagctgtgagtaaagtaaggct

SEQ ID NO: 1384252 - DNA, 22 bp, Artificial Sequence
  chemically synthesized
taggataaactcagccttactt

SEQ ID NO: 1384253 - DNA, 22 bp, Artificial Sequence
  chemically synthesized
ctttaggataaactcagcctta

SEQ ID NO: 1384254 - DNA, 22 bp, Artificial Sequence
  chemically synthesized
tgagtaaagtaaggctgagttt

SEQ ID NO: 1384255 - DNA, 22 bp, Artificial Sequence
  chemically synthesized
ttgctttaggataaactcagcc

SEQ ID NO: 1384256 - DNA, 22 bp, Artificial Sequence
  chemically synthesized
tctattgctttaggataaactc

SEQ ID NO: 1384257 - DNA, 22 bp, Artificial Sequence
  chemically synthesized
gtctattgctttaggataaact

SEQ ID NO: 1384258 - DNA, 22 bp, Artificial Sequence
  chemically synthesized
cttgtctattgctttaggataa

SEQ ID NO: 1384259 - DNA, 22 bp, Artificial Sequence
  chemically synthesized
ccttgtctattgctttaggata

SEQ ID NO: 1384260 - DNA, 22 bp, Artificial Sequence
  chemically synthesized
tccttgtctattgctttaggat

SEQ ID NO: 1384261 - DNA, 22 bp, Artificial Sequence
  chemically synthesized
ttccttgtctattgctttagga

SEQ ID NO: 1384262 - DNA, 22 bp, Artificial Sequence
  chemically synthesized
tttccttgtctattgctttagg

SEQ ID NO: 1384263 - DNA, 22 bp, Artificial Sequence
  chemically synthesized
ttttccttgtctattgctttag

SEQ ID NO: 1384264 - DNA, 22 bp, Artificial Sequence
  chemically synthesized
tttttccttgtctattgcttta

SEQ ID NO: 1384265 - DNA, 22 bp, Artificial Sequence
  chemically synthesized
ttttttccttgtctattgcttt

SEQ ID NO: 1384266 - DNA, 22 bp, Artificial Sequence
  chemically synthesized
tttttttccttgtctattgctt

SEQ ID NO: 1384267 - DNA, 22 bp, Artificial Sequence
  chemically synthesized
agtttatcctaaagcaatagac

SEQ ID NO: 1384268 - DNA, 22 bp, Artificial Sequence
  chemically synthesized
ttttttttccttgtctattgct

SEQ ID NO: 1384269 - DNA, 22 bp, Artificial Sequence
  chemically synthesized
atttttttttttccttgtctat

SEQ ID NO: 1384270 - DNA, 22 bp, Artificial Sequence
  chemically synthesized
atcctaaagcaatagacaagga

SEQ ID NO: 1384271 - DNA, 22 bp, Artificial Sequence
  chemically synthesized
tcctaaagcaatagacaaggaa

SEQ ID NO: 1384272 - DNA, 22 bp, Artificial Sequence
  chemically synthesized
tctgatttttttttttccttgt

SEQ ID NO: 1384273 - DNA, 22 bp, Artificial Sequence
  chemically synthesized
gtctgatttttttttttccttg

SEQ ID NO: 1384274 - DNA, 22 bp, Artificial Sequence
  chemically synthesized
tgtctgatttttttttttcctt

SEQ ID NO: 1384275 - DNA, 22 bp, Artificial Sequence
  chemically synthesized
aagcaatagacaaggaaaaaaa

SEQ ID NO: 1384276 - DNA, 22 bp, Artificial Sequence
  chemically synthesized
tttgtctgatttttttttttcc

SEQ ID NO: 1384277 - DNA, 22 bp, Artificial Sequence
  chemically synthesized
ccattctttgtctgattttttt

SEQ ID NO: 1384278 - DNA, 22 bp, Artificial Sequence
  chemically synthesized
agggtagagaggtatagagttg

SEQ ID NO: 1384279 - DNA, 22 bp, Artificial Sequence
  chemically synthesized
aggtgtgtctcagggtagagag

SEQ ID NO: 1384280 - DNA, 22 bp, Artificial Sequence
  chemically synthesized
tatacctctctaccctgagaca

SEQ ID NO: 1384281 - DNA, 22 bp, Artificial Sequence
  chemically synthesized
tacctctctaccctgagacaca

SEQ ID NO: 1384282 - DNA, 22 bp, Artificial Sequence
  chemically synthesized
gggtggtctcaggtgtgtctca

SEQ ID NO: 1384283 - DNA, 22 bp, Artificial Sequence
  chemically synthesized
agggtggtctcaggtgtgtctc

SEQ ID NO: 1384284 - DNA, 22 bp, Artificial Sequence
  chemically synthesized
tagggtggtctcaggtgtgtct

SEQ ID NO: 1384285 - DNA, 22 bp, Artificial Sequence
  chemically synthesized
ttagggtggtctcaggtgtgtc

SEQ ID NO: 1384286 - DNA, 22 bp, Artificial Sequence
  chemically synthesized
tctaccctgagacacacctgag

SEQ ID NO: 1384287 - DNA, 22 bp, Artificial Sequence
  chemically synthesized
taccctgagacacacctgagac

SEQ ID NO: 1384288 - DNA, 22 bp, Artificial Sequence
  chemically synthesized
ccctgagacacacctgagacca

SEQ ID NO: 1384289 - DNA, 22 bp, Artificial Sequence
  chemically synthesized
gtgatttttagggtggtctcag

SEQ ID NO: 1384290 - DNA, 22 bp, Artificial Sequence
  chemically synthesized
agacacacctgagaccacccta

SEQ ID NO: 1384291 - DNA, 22 bp, Artificial Sequence
  chemically synthesized
agccctggtgatttttagggtg

SEQ ID NO: 1384292 - DNA, 22 bp, Artificial Sequence
  chemically synthesized
tcagccctggtgatttttaggg

SEQ ID NO: 1384293 - DNA, 22 bp, Artificial Sequence
  chemically synthesized
ttctcagccctggtgattttta

SEQ ID NO: 1384294 - DNA, 22 bp, Artificial Sequence
  chemically synthesized
agaccaccctaaaaatcaccag

SEQ ID NO: 1384295 - DNA, 22 bp, Artificial Sequence
  chemically synthesized
ctattctcagccctggtgattt

SEQ ID NO: 1384296 - DNA, 22 bp, Artificial Sequence
  chemically synthesized
aaaatcaccagggctgagaata

SEQ ID NO: 1384297 - DNA, 22 bp, Artificial Sequence
  chemically synthesized
tgagtgggtgcctcctattctc

SEQ ID NO: 1384298 - DNA, 22 bp, Artificial Sequence
  chemically synthesized
atgagtgggtgcctcctattct

SEQ ID NO: 1384299 - DNA, 22 bp, Artificial Sequence
  chemically synthesized
tatgagtgggtgcctcctattc

SEQ ID NO: 1384300 - DNA, 22 bp, Artificial Sequence
  chemically synthesized
agaataggaggcacccactcat

SEQ ID NO: 1384301 - DNA, 22 bp, Artificial Sequence
  chemically synthesized
ataaaatgtatctacccactct

SEQ ID NO: 1384302 - DNA, 22 bp, Artificial Sequence
  chemically synthesized
cccactctcatttgcatggctc

SEQ ID NO: 1384303 - DNA, 22 bp, Artificial Sequence
  chemically synthesized
tcatttgcatggctctacgtgg

SEQ ID NO: 1384304 - DNA, 22 bp, Artificial Sequence
  chemically synthesized
atttgcatggctctacgtgggt

SEQ ID NO: 1384305 - DNA, 22 bp, Artificial Sequence
  chemically synthesized
caaaagcagaaggacccacgta

SEQ ID NO: 1384306 - DNA, 22 bp, Artificial Sequence
  chemically synthesized
gcatggctctacgtgggtcctt

SEQ ID NO: 1384307 - DNA, 22 bp, Artificial Sequence
  chemically synthesized
catggctctacgtgggtccttc

SEQ ID NO: 1384308 - DNA, 22 bp, Artificial Sequence
  chemically synthesized
tacgtgggtccttctgcttttg

SEQ ID NO: 1384309 - DNA, 22 bp, Artificial Sequence
  chemically synthesized
cgtgggtccttctgcttttgca

SEQ ID NO: 1384310 - DNA, 22 bp, Artificial Sequence
  chemically synthesized
taaatgtcccaaggtattgcaa

SEQ ID NO: 1384311 - DNA, 22 bp, Artificial Sequence
  chemically synthesized
attgtaaatgtcccaaggtatt

SEQ ID NO: 1384312 - DNA, 22 bp, Artificial Sequence
  chemically synthesized
ctgcttttgcaataccttggga

SEQ ID NO: 1384313 - DNA, 22 bp, Artificial Sequence
  chemically synthesized
tgcttttgcaataccttgggac

SEQ ID NO: 1384314 - DNA, 22 bp, Artificial Sequence
  chemically synthesized
cttttgcaataccttgggacat

SEQ ID NO: 1384315 - DNA, 22 bp, Artificial Sequence
  chemically synthesized
ttgcaataccttgggacattta

SEQ ID NO: 1384316 - DNA, 22 bp, Artificial Sequence
  chemically synthesized
tgcaataccttgggacatttac

SEQ ID NO: 1384317 - DNA, 22 bp, Artificial Sequence
  chemically synthesized
gcaataccttgggacatttaca

SEQ ID NO: 1384318 - DNA, 22 bp, Artificial Sequence
  chemically synthesized
caataccttgggacatttacaa

SEQ ID NO: 1384319 - DNA, 22 bp, Artificial Sequence
  chemically synthesized
tgagggggttgattgtaaatgt

SEQ ID NO: 1384320 - DNA, 22 bp, Artificial Sequence
  chemically synthesized
ttgtgagggggttgattgtaaa

SEQ ID NO: 1384321 - DNA, 22 bp, Artificial Sequence
  chemically synthesized
tgttgtgagggggttgattgta

SEQ ID NO: 1384322 - DNA, 22 bp, Artificial Sequence
  chemically synthesized
tctgttgtgagggggttgattg

SEQ ID NO: 1384323 - DNA, 22 bp, Artificial Sequence
  chemically synthesized
gggacatttacaatcaaccccc

SEQ ID NO: 1384324 - DNA, 22 bp, Artificial Sequence
  chemically synthesized
ggacatttacaatcaaccccct

SEQ ID NO: 1384325 - DNA, 22 bp, Artificial Sequence
  chemically synthesized
actctctgttgtgagggggttg

SEQ ID NO: 1384326 - DNA, 22 bp, Artificial Sequence
  chemically synthesized
aactctctgttgtgagggggtt

SEQ ID NO: 1384327 - DNA, 22 bp, Artificial Sequence
  chemically synthesized
acaatcaaccccctcacaacag

SEQ ID NO: 1384328 - DNA, 22 bp, Artificial Sequence
  chemically synthesized
caatcaaccccctcacaacaga

SEQ ID NO: 1384329 - DNA, 22 bp, Artificial Sequence
  chemically synthesized
gaaatcaaggcacttaactctc

SEQ ID NO: 1384330 - DNA, 22 bp, Artificial Sequence
  chemically synthesized
tctggaaatcaaggcacttaac

SEQ ID NO: 1384331 - DNA, 22 bp, Artificial Sequence
  chemically synthesized
acaacagagagttaagtgcctt

SEQ ID NO: 1384332 - DNA, 22 bp, Artificial Sequence
  chemically synthesized
accactgtctggaaatcaaggc

SEQ ID NO: 1384333 - DNA, 22 bp, Artificial Sequence
  chemically synthesized
aaactcaccactgtctggaaat

SEQ ID NO: 1384334 - DNA, 22 bp, Artificial Sequence
  chemically synthesized
agtgccttgatttccagacagt

SEQ ID NO: 1384335 - DNA, 22 bp, Artificial Sequence
  chemically synthesized
ctaaaactcaccactgtctgga

SEQ ID NO: 1384336 - DNA, 22 bp, Artificial Sequence
  chemically synthesized
cctactaaaactcaccactgtc

SEQ ID NO: 1384337 - DNA, 22 bp, Artificial Sequence
  chemically synthesized
gatttccagacagtggtgagtt

SEQ ID NO: 1384338 - DNA, 22 bp, Artificial Sequence
  chemically synthesized
atttccagacagtggtgagttt

SEQ ID NO: 1384339 - DNA, 22 bp, Artificial Sequence
  chemically synthesized
aggcgttccctactaaaactca

SEQ ID NO: 1384340 - DNA, 22 bp, Artificial Sequence
  chemically synthesized
ccagacagtggtgagttttagt

SEQ ID NO: 1384341 - DNA, 22 bp, Artificial Sequence
  chemically synthesized
cagacagtggtgagttttagta

SEQ ID NO: 1384342 - DNA, 22 bp, Artificial Sequence
  chemically synthesized
agctgaggcgttccctactaaa

SEQ ID NO: 1384343 - DNA, 22 bp, Artificial Sequence
  chemically synthesized
aagtgtctaagctgaggcgttc

SEQ ID NO: 1384344 - DNA, 22 bp, Artificial Sequence
  chemically synthesized
tcaagtgtctaagctgaggcgt

SEQ ID NO: 1384345 - DNA, 22 bp, Artificial Sequence
  chemically synthesized
ctcaagtgtctaagctgaggcg

SEQ ID NO: 1384346 - DNA, 22 bp, Artificial Sequence
  chemically synthesized
tagtagggaacgcctcagctta

SEQ ID NO: 1384347 - DNA, 22 bp, Artificial Sequence
  chemically synthesized
ttctcaagtgtctaagctgagg

SEQ ID NO: 1384348 - DNA, 22 bp, Artificial Sequence
  chemically synthesized
agtagggaacgcctcagcttag

SEQ ID NO: 1384349 - DNA, 22 bp, Artificial Sequence
  chemically synthesized
cttctcaagtgtctaagctgag

SEQ ID NO: 1384350 - DNA, 22 bp, Artificial Sequence
  chemically synthesized
gtagggaacgcctcagcttaga

SEQ ID NO: 1384351 - DNA, 22 bp, Artificial Sequence
  chemically synthesized
gtttcttctcaagtgtctaagc

SEQ ID NO: 1384352 - DNA, 22 bp, Artificial Sequence
  chemically synthesized
ccgtctagtttcttctcaagtg

SEQ ID NO: 1384353 - DNA, 22 bp, Artificial Sequence
  chemically synthesized
ctgccgtctagtttcttctcaa

SEQ ID NO: 1384354 - DNA, 22 bp, Artificial Sequence
  chemically synthesized
agcttagacacttgagaagaaa

SEQ ID NO: 1384355 - DNA, 22 bp, Artificial Sequence
  chemically synthesized
gctgccgtctagtttcttctca

SEQ ID NO: 1384356 - DNA, 22 bp, Artificial Sequence
  chemically synthesized
tgctgccgtctagtttcttctc

SEQ ID NO: 1384357 - DNA, 22 bp, Artificial Sequence
  chemically synthesized
agacacttgagaagaaactaga

SEQ ID NO: 1384358 - DNA, 22 bp, Artificial Sequence
  chemically synthesized
gacacttgagaagaaactagac

SEQ ID NO: 1384359 - DNA, 22 bp, Artificial Sequence
  chemically synthesized
gagaagaaactagacggcagca

SEQ ID NO: 1384360 - DNA, 22 bp, Artificial Sequence
  chemically synthesized
agaagaaactagacggcagcaa

SEQ ID NO: 1384361 - DNA, 22 bp, Artificial Sequence
  chemically synthesized
gacggcagcaaaatccatcccg

SEQ ID NO: 1384362 - DNA, 22 bp, Artificial Sequence
  chemically synthesized
aggacgtgtgcaacgggatgga

SEQ ID NO: 1384363 - DNA, 22 bp, Artificial Sequence
  chemically synthesized
gttgaggacgtgtgcaacggga

SEQ ID NO: 1384364 - DNA, 22 bp, Artificial Sequence
  chemically synthesized
ctagttgaggacgtgtgcaacg

SEQ ID NO: 1384365 - DNA, 22 bp, Artificial Sequence
  chemically synthesized
cctagttgaggacgtgtgcaac

SEQ ID NO: 1384366 - DNA, 22 bp, Artificial Sequence
  chemically synthesized
acatttcctagttgaggacgtg

SEQ ID NO: 1384367 - DNA, 22 bp, Artificial Sequence
  chemically synthesized
cacacgtcctcaactaggaaat

SEQ ID NO: 1384368 - DNA, 22 bp, Artificial Sequence
  chemically synthesized
gaaggtgttaacatttcctagt

SEQ ID NO: 1384369 - DNA, 22 bp, Artificial Sequence
  chemically synthesized
ggaaggtgttaacatttcctag

SEQ ID NO: 1384370 - DNA, 22 bp, Artificial Sequence
  chemically synthesized
gataatcttggaaggtgttaac

SEQ ID NO: 1384371 - DNA, 22 bp, Artificial Sequence
  chemically synthesized
aactaggaaatgttaacacctt

SEQ ID NO: 1384372 - DNA, 22 bp, Artificial Sequence
  chemically synthesized
ggaaatgttaacaccttccaag

SEQ ID NO: 1384373 - DNA, 22 bp, Artificial Sequence
  chemically synthesized
accataaaattagataatcttg

SEQ ID NO: 1384374 - DNA, 22 bp, Artificial Sequence
  chemically synthesized
ttgaccataaaattagataatc

SEQ ID NO: 1384375 - DNA, 22 bp, Artificial Sequence
  chemically synthesized
acaccttccaagattatctaat

SEQ ID NO: 1384376 - DNA, 22 bp, Artificial Sequence
  chemically synthesized
ccaagattatctaattttatgg

SEQ ID NO: 1384377 - DNA, 22 bp, Artificial Sequence
  chemically synthesized
caagattatctaattttatggt

SEQ ID NO: 1384378 - DNA, 22 bp, Artificial Sequence
  chemically synthesized
aagaccaattattgaccataaa

SEQ ID NO: 1384379 - DNA, 22 bp, Artificial Sequence
  chemically synthesized
tgaagaccaattattgaccata

SEQ ID NO: 1384380 - DNA, 22 bp, Artificial Sequence
  chemically synthesized
ctgaagaccaattattgaccat

SEQ ID NO: 1384381 - DNA, 22 bp, Artificial Sequence
  chemically synthesized
tctgaagaccaattattgacca

SEQ ID NO: 1384382 - DNA, 22 bp, Artificial Sequence
  chemically synthesized
ttctgaagaccaattattgacc

SEQ ID NO: 1384383 - DNA, 22 bp, Artificial Sequence
  chemically synthesized
tctaattttatggtcaataatt

SEQ ID NO: 1384384 - DNA, 22 bp, Artificial Sequence
  chemically synthesized
tttctgaagaccaattattgac

SEQ ID NO: 1384385 - DNA, 22 bp, Artificial Sequence
  chemically synthesized
tttttctgaagaccaattattg

SEQ ID NO: 1384386 - DNA, 22 bp, Artificial Sequence
  chemically synthesized
attttatggtcaataattggtc

SEQ ID NO: 1384387 - DNA, 22 bp, Artificial Sequence
  chemically synthesized
tctttttctgaagaccaattat

SEQ ID NO: 1384388 - DNA, 22 bp, Artificial Sequence
  chemically synthesized
ctctctttttctgaagaccaat

SEQ ID NO: 1384389 - DNA, 22 bp, Artificial Sequence
  chemically synthesized
tatggtcaataattggtcttca

SEQ ID NO: 1384390 - DNA, 22 bp, Artificial Sequence
  chemically synthesized
gctctctttttctgaagaccaa

SEQ ID NO: 1384391 - DNA, 22 bp, Artificial Sequence
  chemically synthesized
atggtcaataattggtcttcag

SEQ ID NO: 1384392 - DNA, 22 bp, Artificial Sequence
  chemically synthesized
tggtcaataattggtcttcaga

SEQ ID NO: 1384393 - DNA, 22 bp, Artificial Sequence
  chemically synthesized
tatttgctctctttttctgaag

SEQ ID NO: 1384394 - DNA, 22 bp, Artificial Sequence
  chemically synthesized
atatttgctctctttttctgaa

SEQ ID NO: 1384395 - DNA, 22 bp, Artificial Sequence
  chemically synthesized
cttatatttgctctctttttct

SEQ ID NO: 1384396 - DNA, 22 bp, Artificial Sequence
  chemically synthesized
gcttatatttgctctctttttc

SEQ ID NO: 1384397 - DNA, 22 bp, Artificial Sequence
  chemically synthesized
tgcttatatttgctctcttttt

SEQ ID NO: 1384398 - DNA, 22 bp, Artificial Sequence
  chemically synthesized
gtcttcagaaaaagagagcaaa

SEQ ID NO: 1384399 - DNA, 22 bp, Artificial Sequence
  chemically synthesized
tattttgcttatatttgctctc

SEQ ID NO: 1384400 - DNA, 22 bp, Artificial Sequence
  chemically synthesized
atattttgcttatatttgctct

SEQ ID NO: 1384401 - DNA, 22 bp, Artificial Sequence
  chemically synthesized
cagaaaaagagagcaaatataa

SEQ ID NO: 1384402 - DNA, 22 bp, Artificial Sequence
  chemically synthesized
agaaaaagagagcaaatataag

SEQ ID NO: 1384403 - DNA, 22 bp, Artificial Sequence
  chemically synthesized
ccttatattttgcttatatttg

SEQ ID NO: 1384404 - DNA, 22 bp, Artificial Sequence
  chemically synthesized
ttcccttatattttgcttatat

SEQ ID NO: 1384405 - DNA, 22 bp, Artificial Sequence
  chemically synthesized
tatactattcccttatattttg

SEQ ID NO: 1384406 - DNA, 22 bp, Artificial Sequence
  chemically synthesized
atatactattcccttatatttt

SEQ ID NO: 1384407 - DNA, 22 bp, Artificial Sequence
  chemically synthesized
tttatatactattcccttatat

SEQ ID NO: 1384408 - DNA, 22 bp, Artificial Sequence
  chemically synthesized
gtttatatactattcccttata

SEQ ID NO: 1384409 - DNA, 22 bp, Artificial Sequence
  chemically synthesized
tgtttatatactattcccttat

SEQ ID NO: 1384410 - DNA, 22 bp, Artificial Sequence
  chemically synthesized
ttgtttatatactattccctta

SEQ ID NO: 1384411 - DNA, 22 bp, Artificial Sequence
  chemically synthesized
tttttgtttatatactattccc

SEQ ID NO: 1384412 - DNA, 22 bp, Artificial Sequence
  chemically synthesized
aaattgtttttgtttatatact

SEQ ID NO: 1384413 - DNA, 22 bp, Artificial Sequence
  chemically synthesized
tgttgaaattgtttttgtttat

SEQ ID NO: 1384414 - DNA, 22 bp, Artificial Sequence
  chemically synthesized
ctgtgttgaaattgtttttgtt

SEQ ID NO: 1384415 - DNA, 22 bp, Artificial Sequence
  chemically synthesized
cctgtgttgaaattgtttttgt

SEQ ID NO: 1384416 - DNA, 22 bp, Artificial Sequence
  chemically synthesized
agcttcctgtgttgaaattgtt

SEQ ID NO: 1384417 - DNA, 22 bp, Artificial Sequence
  chemically synthesized
ttcagcttcctgtgttgaaatt

SEQ ID NO: 1384418 - DNA, 22 bp, Artificial Sequence
  chemically synthesized
attcagcttcctgtgttgaaat

SEQ ID NO: 1384419 - DNA, 22 bp, Artificial Sequence
  chemically synthesized
atagtttattcagcttcctgtg

SEQ ID NO: 1384420 - DNA, 22 bp, Artificial Sequence
  chemically synthesized
aaaattaatagtttattcagct

SEQ ID NO: 1384421 - DNA, 22 bp, Artificial Sequence
  chemically synthesized
caacacaggaagctgaataaac

SEQ ID NO: 1384422 - DNA, 22 bp, Artificial Sequence
  chemically synthesized
taaaaattaatagtttattcag

SEQ ID NO: 1384423 - DNA, 22 bp, Artificial Sequence
  chemically synthesized
aacacaggaagctgaataaact

SEQ ID NO: 1384424 - DNA, 22 bp, Artificial Sequence
  chemically synthesized
tctaaaaattaatagtttattc

SEQ ID NO: 1384425 - DNA, 22 bp, Artificial Sequence
  chemically synthesized
ctctaaaaattaatagtttatt

SEQ ID NO: 1384426 - DNA, 22 bp, Artificial Sequence
  chemically synthesized
tctctaaaaattaatagtttat

SEQ ID NO: 1384427 - DNA, 22 bp, Artificial Sequence
  chemically synthesized
accctttctctaaaaattaata

SEQ ID NO: 1384428 - DNA, 22 bp, Artificial Sequence
  chemically synthesized
aataaactattaatttttagag

SEQ ID NO: 1384429 - DNA, 22 bp, Artificial Sequence
  chemically synthesized
tgttgaccctttctctaaaaat

SEQ ID NO: 1384430 - DNA, 22 bp, Artificial Sequence
  chemically synthesized
atgttgaccctttctctaaaaa

SEQ ID NO: 1384431 - DNA, 22 bp, Artificial Sequence
  chemically synthesized
ttaatttttagagaaagggtca

SEQ ID NO: 1384432 - DNA, 22 bp, Artificial Sequence
  chemically synthesized
atttttagagaaagggtcaaca

SEQ ID NO: 1384433 - DNA, 22 bp, Artificial Sequence
  chemically synthesized
ttagagaaagggtcaacataag

SEQ ID NO: 1384434 - DNA, 22 bp, Artificial Sequence
  chemically synthesized
tagagaaagggtcaacataaga

SEQ ID NO: 1384435 - DNA, 22 bp, Artificial Sequence
  chemically synthesized
agagaaagggtcaacataagat

SEQ ID NO: 1384436 - DNA, 22 bp, Artificial Sequence
  chemically synthesized
gagaaagggtcaacataagatc

SEQ ID NO: 1384437 - DNA, 22 bp, Artificial Sequence
  chemically synthesized
tagcataaaaaagcagtgatct

SEQ ID NO: 1384438 - DNA, 22 bp, Artificial Sequence
  chemically synthesized
atagcataaaaaagcagtgatc

SEQ ID NO: 1384439 - DNA, 22 bp, Artificial Sequence
  chemically synthesized
ggggccatatatatagtttata

SEQ ID NO: 1384440 - DNA, 22 bp, Artificial Sequence
  chemically synthesized
cttttttatgctataaactata

SEQ ID NO: 1384441 - DNA, 22 bp, Artificial Sequence
  chemically synthesized
gggggccatatatatagtttat

SEQ ID NO: 1384442 - DNA, 22 bp, Artificial Sequence
  chemically synthesized
ttttatgctataaactatatat

SEQ ID NO: 1384443 - DNA, 22 bp, Artificial Sequence
  chemically synthesized
tttatgctataaactatatata

SEQ ID NO: 1384444 - DNA, 22 bp, Artificial Sequence
  chemically synthesized
ttatgctataaactatatatat

SEQ ID NO: 1384445 - DNA, 22 bp, Artificial Sequence
  chemically synthesized
tgtttgggggccatatatatag

SEQ ID NO: 1384446 - DNA, 22 bp, Artificial Sequence
  chemically synthesized
tatgctataaactatatatatg

SEQ ID NO: 1384447 - DNA, 22 bp, Artificial Sequence
  chemically synthesized
atgtttgggggccatatatata

SEQ ID NO: 1384448 - DNA, 22 bp, Artificial Sequence
  chemically synthesized
atgctataaactatatatatgg

SEQ ID NO: 1384449 - DNA, 22 bp, Artificial Sequence
  chemically synthesized
tgctataaactatatatatggc

SEQ ID NO: 1384450 - DNA, 22 bp, Artificial Sequence
  chemically synthesized
atttatgtttgggggccatata

SEQ ID NO: 1384451 - DNA, 22 bp, Artificial Sequence
  chemically synthesized
taaactatatatatggccccca

SEQ ID NO: 1384452 - DNA, 22 bp, Artificial Sequence
  chemically synthesized
tattcatttatgtttgggggcc

SEQ ID NO: 1384453 - DNA, 22 bp, Artificial Sequence
  chemically synthesized
tatatatggcccccaaacataa

SEQ ID NO: 1384454 - DNA, 22 bp, Artificial Sequence
  chemically synthesized
aagcaataaaaataaatacagc

SEQ ID NO: 1384455 - DNA, 22 bp, Artificial Sequence
  chemically synthesized
aaagcaataaaaataaatacag

SEQ ID NO: 1384456 - DNA, 22 bp, Artificial Sequence
  chemically synthesized
taaagcaataaaaataaataca

SEQ ID NO: 1384457 - DNA, 22 bp, Artificial Sequence
  chemically synthesized
ttaaagcaataaaaataaatac

SEQ ID NO: 1384458 - DNA, 22 bp, Artificial Sequence
  chemically synthesized
atttttaaagcaataaaaataa

SEQ ID NO: 1384459 - DNA, 22 bp, Artificial Sequence
  chemically synthesized
ggctgtatttatttttattgct

SEQ ID NO: 1384460 - DNA, 22 bp, Artificial Sequence
  chemically synthesized
gctgtatttatttttattgctt

SEQ ID NO: 1384461 - DNA, 22 bp, Artificial Sequence
  chemically synthesized
tatttatttttattgctttaaa

SEQ ID NO: 1384462 - DNA, 22 bp, Artificial Sequence
  chemically synthesized
atttttattgctttaaaaatga

SEQ ID NO: 1384463 - DNA, 22 bp, Artificial Sequence
  chemically synthesized
tttttattgctttaaaaatgaa

SEQ ID NO: 1384464 - DNA, 22 bp, Artificial Sequence
  chemically synthesized
ataatataaataattcattttt

SEQ ID NO: 1384465 - DNA, 22 bp, Artificial Sequence
  chemically synthesized
ttattgctttaaaaatgaatta

SEQ ID NO: 1384466 - DNA, 22 bp, Artificial Sequence
  chemically synthesized
tattgctttaaaaatgaattat

SEQ ID NO: 1384467 - DNA, 22 bp, Artificial Sequence
  chemically synthesized
ttgataatataaataattcatt

SEQ ID NO: 1384468 - DNA, 22 bp, Artificial Sequence
  chemically synthesized
attgctttaaaaatgaattatt

SEQ ID NO: 1384469 - DNA, 22 bp, Artificial Sequence
  chemically synthesized
ttgctttaaaaatgaattattt

SEQ ID NO: 1384470 - DNA, 22 bp, Artificial Sequence
  chemically synthesized
ctttaaaaatgaattatttata

SEQ ID NO: 1384471 - DNA, 22 bp, Artificial Sequence
  chemically synthesized
taaaaatgaattatttatatta

SEQ ID NO: 1384472 - DNA, 22 bp, Artificial Sequence
  chemically synthesized
aaaaatgaattatttatattat

SEQ ID NO: 1384473 - DNA, 22 bp, Artificial Sequence
  chemically synthesized
aaaatgaattatttatattatc

SEQ ID NO: 1384474 - DNA, 22 bp, Artificial Sequence
  chemically synthesized
gccacagctgttgataatataa

SEQ ID NO: 1384475 - DNA, 22 bp, Artificial Sequence
  chemically synthesized
agccacagctgttgataatata

SEQ ID NO: 1384476 - DNA, 22 bp, Artificial Sequence
  chemically synthesized
tagccacagctgttgataatat

SEQ ID NO: 1384477 - DNA, 22 bp, Artificial Sequence
  chemically synthesized
tttagccacagctgttgataat

SEQ ID NO: 1384478 - DNA, 22 bp, Artificial Sequence
  chemically synthesized
ctttagccacagctgttgataa

SEQ ID NO: 1384479 - DNA, 22 bp, Artificial Sequence
  chemically synthesized
tctttagccacagctgttgata

SEQ ID NO: 1384480 - DNA, 22 bp, Artificial Sequence
  chemically synthesized
ttctttagccacagctgttgat

SEQ ID NO: 1384481 - DNA, 22 bp, Artificial Sequence
  chemically synthesized
tttctttagccacagctgttga

SEQ ID NO: 1384482 - DNA, 22 bp, Artificial Sequence
  chemically synthesized
ttttctttagccacagctgttg

SEQ ID NO: 1384483 - DNA, 22 bp, Artificial Sequence
  chemically synthesized
tttatattatcaacagctgtgg

SEQ ID NO: 1384484 - DNA, 22 bp, Artificial Sequence
  chemically synthesized
atattatcaacagctgtggcta

SEQ ID NO: 1384485 - DNA, 22 bp, Artificial Sequence
  chemically synthesized
tattatcaacagctgtggctaa

SEQ ID NO: 1384486 - DNA, 22 bp, Artificial Sequence
  chemically synthesized
tcaacagctgtggctaaagaaa

SEQ ID NO: 1384487 - DNA, 22 bp, Artificial Sequence
  chemically synthesized
gatgacaaaagtcttttttctt

SEQ ID NO: 1384488 - DNA, 22 bp, Artificial Sequence
  chemically synthesized
ggatgacaaaagtcttttttct

SEQ ID NO: 1384489 - DNA, 22 bp, Artificial Sequence
  chemically synthesized
tttggatgacaaaagtcttttt

SEQ ID NO: 1384490 - DNA, 22 bp, Artificial Sequence
  chemically synthesized
gtttggatgacaaaagtctttt

SEQ ID NO: 1384491 - DNA, 22 bp, Artificial Sequence
  chemically synthesized
tggctaaagaaaaaagactttt

SEQ ID NO: 1384492 - DNA, 22 bp, Artificial Sequence
  chemically synthesized
tgtttggatgacaaaagtcttt

SEQ ID NO: 1384493 - DNA, 22 bp, Artificial Sequence
  chemically synthesized
tttgtttggatgacaaaagtct

SEQ ID NO: 1384494 - DNA, 22 bp, Artificial Sequence
  chemically synthesized
aagaaaaaagacttttgtcatc

SEQ ID NO: 1384495 - DNA, 22 bp, Artificial Sequence
  chemically synthesized
taaatagttctttgtttggatg

SEQ ID NO: 1384496 - DNA, 22 bp, Artificial Sequence
  chemically synthesized
ttgtcatccaaacaaagaacta

SEQ ID NO: 1384497 - DNA, 22 bp, Artificial Sequence
  chemically synthesized
tgtcatccaaacaaagaactat

SEQ ID NO: 1384498 - DNA, 22 bp, Artificial Sequence
  chemically synthesized
gtcatccaaacaaagaactatt

SEQ ID NO: 1384499 - DNA, 22 bp, Artificial Sequence
  chemically synthesized
tcatccaaacaaagaactattt

SEQ ID NO: 1384500 - DNA, 22 bp, Artificial Sequence
  chemically synthesized
gaatatcagggttataaatagt

SEQ ID NO: 1384501 - DNA, 22 bp, Artificial Sequence
  chemically synthesized
ggaatatcagggttataaatag

SEQ ID NO: 1384502 - DNA, 22 bp, Artificial Sequence
  chemically synthesized
aatacaccttggaatatcaggg

SEQ ID NO: 1384503 - DNA, 22 bp, Artificial Sequence
  chemically synthesized
aaatacaccttggaatatcagg

SEQ ID NO: 1384504 - DNA, 22 bp, Artificial Sequence
  chemically synthesized
taaatacaccttggaatatcag

SEQ ID NO: 1384505 - DNA, 22 bp, Artificial Sequence
  chemically synthesized
ttaaatacaccttggaatatca

SEQ ID NO: 1384506 - DNA, 22 bp, Artificial Sequence
  chemically synthesized
tttaaatacaccttggaatatc

SEQ ID NO: 1384507 - DNA, 22 bp, Artificial Sequence
  chemically synthesized
tttataaccctgatattccaag

SEQ ID NO: 1384508 - DNA, 22 bp, Artificial Sequence
  chemically synthesized
ataaccctgatattccaaggtg

SEQ ID NO: 1384509 - DNA, 22 bp, Artificial Sequence
  chemically synthesized
taaccctgatattccaaggtgt

SEQ ID NO: 1384510 - DNA, 22 bp, Artificial Sequence
  chemically synthesized
atattccaaggtgtatttaaaa

SEQ ID NO: 1384511 - DNA, 22 bp, Artificial Sequence
  chemically synthesized
ccacaaataacacctttttaaa

SEQ ID NO: 1384512 - DNA, 22 bp, Artificial Sequence
  chemically synthesized
caaggtgtatttaaaaaggtgt

SEQ ID NO: 1384513 - DNA, 22 bp, Artificial Sequence
  chemically synthesized
aaaaaggtgttatttgtggcaa

SEQ ID NO: 1384514 - DNA, 22 bp, Artificial Sequence
  chemically synthesized
aaaaggtgttatttgtggcaat

SEQ ID NO: 1384515 - DNA, 22 bp, Artificial Sequence
  chemically synthesized
gagaaaatagatacaatattgc

SEQ ID NO: 1384516 - DNA, 22 bp, Artificial Sequence
  chemically synthesized
cgagaaaatagatacaatattg

SEQ ID NO: 1384517 - DNA, 22 bp, Artificial Sequence
  chemically synthesized
tttgtggcaatattgtatctat

SEQ ID NO: 1384518 - DNA, 22 bp, Artificial Sequence
  chemically synthesized
agatcttcgagaaaatagatac

SEQ ID NO: 1384519 - DNA, 22 bp, Artificial Sequence
  chemically synthesized
gtggcaatattgtatctatttt

SEQ ID NO: 1384520 - DNA, 22 bp, Artificial Sequence
  chemically synthesized
aagatcttcgagaaaatagata

SEQ ID NO: 1384521 - DNA, 22 bp, Artificial Sequence
  chemically synthesized
tggcaatattgtatctattttc

SEQ ID NO: 1384522 - DNA, 22 bp, Artificial Sequence
  chemically synthesized
taagatcttcgagaaaatagat

SEQ ID NO: 1384523 - DNA, 22 bp, Artificial Sequence
  chemically synthesized
attttaagatcttcgagaaaat

SEQ ID NO: 1384524 - DNA, 22 bp, Artificial Sequence
  chemically synthesized
ctaattttaagatcttcgagaa

SEQ ID NO: 1384525 - DNA, 22 bp, Artificial Sequence
  chemically synthesized
tatctattttctcgaagatctt

SEQ ID NO: 1384526 - DNA, 22 bp, Artificial Sequence
  chemically synthesized
ttttctcgaagatcttaaaatt

SEQ ID NO: 1384527 - DNA, 22 bp, Artificial Sequence
  chemically synthesized
atagtaattgctaattttaaga

SEQ ID NO: 1384528 - DNA, 22 bp, Artificial Sequence
  chemically synthesized
tctcgaagatcttaaaattagc

SEQ ID NO: 1384529 - DNA, 22 bp, Artificial Sequence
  chemically synthesized
ctcgaagatcttaaaattagca

SEQ ID NO: 1384530 - DNA, 22 bp, Artificial Sequence
  chemically synthesized
attgatagtaattgctaatttt

SEQ ID NO: 1384531 - DNA, 22 bp, Artificial Sequence
  chemically synthesized
tcgaagatcttaaaattagcaa

SEQ ID NO: 1384532 - DNA, 22 bp, Artificial Sequence
  chemically synthesized
gaagatcttaaaattagcaatt

SEQ ID NO: 1384533 - DNA, 22 bp, Artificial Sequence
  chemically synthesized
aataaatgttcattgatagtaa

SEQ ID NO: 1384534 - DNA, 22 bp, Artificial Sequence
  chemically synthesized
aaaattagcaattactatcaat

SEQ ID NO: 1384535 - DNA, 22 bp, Artificial Sequence
  chemically synthesized
aaattagcaattactatcaatg

SEQ ID NO: 1384536 - DNA, 22 bp, Artificial Sequence
  chemically synthesized
tattcaataaatgttcattgat

SEQ ID NO: 1384537 - DNA, 22 bp, Artificial Sequence
  chemically synthesized
atattcaataaatgttcattga

SEQ ID NO: 1384538 - DNA, 22 bp, Artificial Sequence
  chemically synthesized
tatattcaataaatgttcattg

SEQ ID NO: 1384539 - DNA, 22 bp, Artificial Sequence
  chemically synthesized
gcaattactatcaatgaacatt

SEQ ID NO: 1384540 - DNA, 22 bp, Artificial Sequence
  chemically synthesized
ctttatattcaataaatgttca

SEQ ID NO: 1384541 - DNA, 22 bp, Artificial Sequence
  chemically synthesized
ctatcaatgaacatttattgaa

SEQ ID NO: 1384542 - DNA, 22 bp, Artificial Sequence
  chemically synthesized
tcaatgaacatttattgaatat

SEQ ID NO: 1384543 - DNA, 22 bp, Artificial Sequence
  chemically synthesized
tacagttactttatattcaata

SEQ ID NO: 1384544 - DNA, 22 bp, Artificial Sequence
  chemically synthesized
attgaatataaagtaactgtat

SEQ ID NO: 1384545 - DNA, 22 bp, Artificial Sequence
  chemically synthesized
gatacaaatgctatacagttac

SEQ ID NO: 1384546 - DNA, 22 bp, Artificial Sequence
  chemically synthesized
ttgaatataaagtaactgtata

SEQ ID NO: 1384547 - DNA, 22 bp, Artificial Sequence
  chemically synthesized
aatataaagtaactgtatagca

SEQ ID NO: 1384548 - DNA, 22 bp, Artificial Sequence
  chemically synthesized
gaaatgcattagatacaaatgc

SEQ ID NO: 1384549 - DNA, 22 bp, Artificial Sequence
  chemically synthesized
gcaattagaaatgcattagata

SEQ ID NO: 1384550 - DNA, 22 bp, Artificial Sequence
  chemically synthesized
tatagcatttgtatctaatgca

SEQ ID NO: 1384551 - DNA, 22 bp, Artificial Sequence
  chemically synthesized
agcaattagaaatgcattagat

SEQ ID NO: 1384552 - DNA, 22 bp, Artificial Sequence
  chemically synthesized
taacttagcaattagaaatgca

SEQ ID NO: 1384553 - DNA, 22 bp, Artificial Sequence
  chemically synthesized
gtatctaatgcatttctaattg

SEQ ID NO: 1384554 - DNA, 22 bp, Artificial Sequence
  chemically synthesized
tatctaatgcatttctaattgc

SEQ ID NO: 1384555 - DNA, 22 bp, Artificial Sequence
  chemically synthesized
gaactgtaacttagcaattaga

SEQ ID NO: 1384556 - DNA, 22 bp, Artificial Sequence
  chemically synthesized
atgcatttctaattgctaagtt

SEQ ID NO: 1384557 - DNA, 22 bp, Artificial Sequence
  chemically synthesized
tgaaaatgttggaactgtaact

SEQ ID NO: 1384558 - DNA, 22 bp, Artificial Sequence
  chemically synthesized
ctaattgctaagttacagttcc

SEQ ID NO: 1384559 - DNA, 22 bp, Artificial Sequence
  chemically synthesized
taattgctaagttacagttcca

SEQ ID NO: 1384560 - DNA, 22 bp, Artificial Sequence
  chemically synthesized
attgctaagttacagttccaac

SEQ ID NO: 1384561 - DNA, 22 bp, Artificial Sequence
  chemically synthesized
gacactatgaaaatgttggaac

SEQ ID NO: 1384562 - DNA, 22 bp, Artificial Sequence
  chemically synthesized
ggacactatgaaaatgttggaa

SEQ ID NO: 1384563 - DNA, 22 bp, Artificial Sequence
  chemically synthesized
ctaagttacagttccaacattt

SEQ ID NO: 1384564 - DNA, 22 bp, Artificial Sequence
  chemically synthesized
agttacagttccaacattttca

SEQ ID NO: 1384565 - DNA, 22 bp, Artificial Sequence
  chemically synthesized
cagttccaacattttcatagtg

SEQ ID NO: 1384566 - DNA, 22 bp, Artificial Sequence
  chemically synthesized
caacattttcatagtgtccaag

SEQ ID NO: 1384567 - DNA, 22 bp, Artificial Sequence
  chemically synthesized
tcatagtgtccaagtgattatt

SEQ ID NO: 1384568 - DNA, 22 bp, Artificial Sequence
  chemically synthesized
catagtgtccaagtgattattt

SEQ ID NO: 1384569 - DNA, 22 bp, Artificial Sequence
  chemically synthesized
atagtgtccaagtgattatttt

SEQ ID NO: 1384570 - DNA, 22 bp, Artificial Sequence
  chemically synthesized
aaaagaaatatataaaataatc

SEQ ID NO: 1384571 - DNA, 22 bp, Artificial Sequence
  chemically synthesized
aaaaagaaatatataaaataat

SEQ ID NO: 1384572 - DNA, 22 bp, Artificial Sequence
  chemically synthesized
tttaaaaagaaatatataaaat

SEQ ID NO: 1384573 - DNA, 22 bp, Artificial Sequence
  chemically synthesized
ttatttaaaaagaaatatataa

SEQ ID NO: 1384574 - DNA, 22 bp, Artificial Sequence
  chemically synthesized
attatttaaaaagaaatatata

SEQ ID NO: 1384575 - DNA, 22 bp, Artificial Sequence
  chemically synthesized
tattatttaaaaagaaatatat

SEQ ID NO: 1384576 - DNA, 22 bp, Artificial Sequence
  chemically synthesized
ttattatttaaaaagaaatata

SEQ ID NO: 1384577 - DNA, 22 bp, Artificial Sequence
  chemically synthesized
ttttatatatttctttttaaat

SEQ ID NO: 1384578 - DNA, 22 bp, Artificial Sequence
  chemically synthesized
tgatacttttattatttaaaaa

SEQ ID NO: 1384579 - DNA, 22 bp, Artificial Sequence
  chemically synthesized
atgatacttttattatttaaaa

SEQ ID NO: 1384580 - DNA, 22 bp, Artificial Sequence
  chemically synthesized
tatatatttctttttaaataat

SEQ ID NO: 1384581 - DNA, 22 bp, Artificial Sequence
  chemically synthesized
atatatttctttttaaataata

SEQ ID NO: 1384582 - DNA, 22 bp, Artificial Sequence
  chemically synthesized
tatatttctttttaaataataa

SEQ ID NO: 1384583 - DNA, 22 bp, Artificial Sequence
  chemically synthesized
ctttttaaataataaaagtatc

SEQ ID NO: 1384584 - DNA, 22 bp, Artificial Sequence
  chemically synthesized
caaaaagtttatgatactttta

SEQ ID NO: 1384585 - DNA, 22 bp, Artificial Sequence
  chemically synthesized
tttttaaataataaaagtatca

SEQ ID NO: 1384586 - DNA, 22 bp, Artificial Sequence
  chemically synthesized
ccaaaaagtttatgatactttt

SEQ ID NO: 1384587 - DNA, 22 bp, Artificial Sequence
  chemically synthesized
tccaaaaagtttatgatacttt

SEQ ID NO: 1384588 - DNA, 22 bp, Artificial Sequence
  chemically synthesized
tttaaataataaaagtatcata

SEQ ID NO: 1384589 - DNA, 22 bp, Artificial Sequence
  chemically synthesized
ttccaaaaagtttatgatactt

SEQ ID NO: 1384590 - DNA, 22 bp, Artificial Sequence
  chemically synthesized
ttaaataataaaagtatcataa

SEQ ID NO: 1384591 - DNA, 22 bp, Artificial Sequence
  chemically synthesized
taaataataaaagtatcataaa

SEQ ID NO: 1384592 - DNA, 22 bp, Artificial Sequence
  chemically synthesized
aaataataaaagtatcataaac

SEQ ID NO: 1384593 - DNA, 22 bp, Artificial Sequence
  chemically synthesized
aataataaaagtatcataaact

SEQ ID NO: 1384594 - DNA, 22 bp, Artificial Sequence
  chemically synthesized
gtttttccaaaaagtttatgat

SEQ ID NO: 1384595 - DNA, 22 bp, Artificial Sequence
  chemically synthesized
agtttttccaaaaagtttatga

SEQ ID NO: 1384596 - DNA, 22 bp, Artificial Sequence
  chemically synthesized
tttggaaaaactaaacttccta

SEQ ID NO: 1384597 - DNA, 22 bp, Artificial Sequence
  chemically synthesized
ttggaaaaactaaacttcctat

SEQ ID NO: 1384598 - DNA, 22 bp, Artificial Sequence
  chemically synthesized
tggaaaaactaaacttcctatt

SEQ ID NO: 1384599 - DNA, 22 bp, Artificial Sequence
  chemically synthesized
ggaaaaactaaacttcctattt

SEQ ID NO: 1384600 - DNA, 22 bp, Artificial Sequence
  chemically synthesized
gaaaaactaaacttcctatttt

SEQ ID NO: 1384601 - DNA, 22 bp, Artificial Sequence
  chemically synthesized
aacttcctattttattgctact

SEQ ID NO: 1384602 - DNA, 22 bp, Artificial Sequence
  chemically synthesized
aataataggcaataagtagcaa

SEQ ID NO: 1384603 - DNA, 22 bp, Artificial Sequence
  chemically synthesized
cctattttattgctacttattg

SEQ ID NO: 1384604 - DNA, 22 bp, Artificial Sequence
  chemically synthesized
ctattttattgctacttattgc

SEQ ID NO: 1384605 - DNA, 22 bp, Artificial Sequence
  chemically synthesized
ttttattgctacttattgccta

SEQ ID NO: 1384606 - DNA, 22 bp, Artificial Sequence
  chemically synthesized
tattgctacttattgcctatta

SEQ ID NO: 1384607 - DNA, 22 bp, Artificial Sequence
  chemically synthesized
attgctacttattgcctattat

SEQ ID NO: 1384608 - DNA, 22 bp, Artificial Sequence
  chemically synthesized
ttgctacttattgcctattatt

SEQ ID NO: 1384609 - DNA, 22 bp, Artificial Sequence
  chemically synthesized
ctacttattgcctattatttaa

SEQ ID NO: 1384610 - DNA, 22 bp, Artificial Sequence
  chemically synthesized
acatataaaagattaaataata

SEQ ID NO: 1384611 - DNA, 22 bp, Artificial Sequence
  chemically synthesized
cttattgcctattatttaatct

SEQ ID NO: 1384612 - DNA, 22 bp, Artificial Sequence
  chemically synthesized
attgcctattatttaatctttt

SEQ ID NO: 1384613 - DNA, 22 bp, Artificial Sequence
  chemically synthesized
ttgcctattatttaatctttta

SEQ ID NO: 1384614 - DNA, 22 bp, Artificial Sequence
  chemically synthesized
atcatgttaacatataaaagat

SEQ ID NO: 1384615 - DNA, 22 bp, Artificial Sequence
  chemically synthesized
cctattatttaatcttttatat

SEQ ID NO: 1384616 - DNA, 22 bp, Artificial Sequence
  chemically synthesized
gatcatgttaacatataaaaga

SEQ ID NO: 1384617 - DNA, 22 bp, Artificial Sequence
  chemically synthesized
tgatcatgttaacatataaaag

SEQ ID NO: 1384618 - DNA, 22 bp, Artificial Sequence
  chemically synthesized
ttatttaatcttttatatgtta

SEQ ID NO: 1384619 - DNA, 22 bp, Artificial Sequence
  chemically synthesized
tttaatcttttatatgttaaca

SEQ ID NO: 1384620 - DNA, 22 bp, Artificial Sequence
  chemically synthesized
cacctttgatcatgttaacata

SEQ ID NO: 1384621 - DNA, 22 bp, Artificial Sequence
  chemically synthesized
acacctttgatcatgttaacat

SEQ ID NO: 1384622 - DNA, 22 bp, Artificial Sequence
  chemically synthesized
tacacctttgatcatgttaaca

SEQ ID NO: 1384623 - DNA, 22 bp, Artificial Sequence
  chemically synthesized
aatcttttatatgttaacatga

SEQ ID NO: 1384624 - DNA, 22 bp, Artificial Sequence
  chemically synthesized
ttacacctttgatcatgttaac

SEQ ID NO: 1384625 - DNA, 22 bp, Artificial Sequence
  chemically synthesized
atcttttatatgttaacatgat

SEQ ID NO: 1384626 - DNA, 22 bp, Artificial Sequence
  chemically synthesized
tttacacctttgatcatgttaa

SEQ ID NO: 1384627 - DNA, 22 bp, Artificial Sequence
  chemically synthesized
attttttacacctttgatcatg

SEQ ID NO: 1384628 - DNA, 22 bp, Artificial Sequence
  chemically synthesized
ttatatgttaacatgatcaaag

SEQ ID NO: 1384629 - DNA, 22 bp, Artificial Sequence
  chemically synthesized
tatatgttaacatgatcaaagg

SEQ ID NO: 1384630 - DNA, 22 bp, Artificial Sequence
  chemically synthesized
atatgttaacatgatcaaaggt

SEQ ID NO: 1384631 - DNA, 22 bp, Artificial Sequence
  chemically synthesized
tatgttaacatgatcaaaggtg

SEQ ID NO: 1384632 - DNA, 22 bp, Artificial Sequence
  chemically synthesized
aggatcattaattttttacacc

SEQ ID NO: 1384633 - DNA, 22 bp, Artificial Sequence
  chemically synthesized
acatgatcaaaggtgtaaaaaa

SEQ ID NO: 1384634 - DNA, 22 bp, Artificial Sequence
  chemically synthesized
ggtaaaattaaggatcattaat

SEQ ID NO: 1384635 - DNA, 22 bp, Artificial Sequence
  chemically synthesized
aggtaaaattaaggatcattaa

SEQ ID NO: 1384636 - DNA, 22 bp, Artificial Sequence
  chemically synthesized
taggtaaaattaaggatcatta

SEQ ID NO: 1384637 - DNA, 22 bp, Artificial Sequence
  chemically synthesized
gttttaggtaaaattaaggatc

SEQ ID NO: 1384638 - DNA, 22 bp, Artificial Sequence
  chemically synthesized
agttttaggtaaaattaaggat

SEQ ID NO: 1384639 - DNA, 22 bp, Artificial Sequence
  chemically synthesized
tagttttaggtaaaattaagga

SEQ ID NO: 1384640 - DNA, 22 bp, Artificial Sequence
  chemically synthesized
ttagttttaggtaaaattaagg

SEQ ID NO: 1384641 - DNA, 22 bp, Artificial Sequence
  chemically synthesized
tttagttttaggtaaaattaag

SEQ ID NO: 1384642 - DNA, 22 bp, Artificial Sequence
  chemically synthesized
ttttagttttaggtaaaattaa

SEQ ID NO: 1384643 - DNA, 22 bp, Artificial Sequence
  chemically synthesized
tttttagttttaggtaaaatta

SEQ ID NO: 1384644 - DNA, 22 bp, Artificial Sequence
  chemically synthesized
ttttttagttttaggtaaaatt

SEQ ID NO: 1384645 - DNA, 22 bp, Artificial Sequence
  chemically synthesized
tttttttagttttaggtaaaat

SEQ ID NO: 1384646 - DNA, 22 bp, Artificial Sequence
  chemically synthesized
ttttttttagttttaggtaaaa

SEQ ID NO: 1384647 - DNA, 22 bp, Artificial Sequence
  chemically synthesized
atgatccttaattttacctaaa

SEQ ID NO: 1384648 - DNA, 22 bp, Artificial Sequence
  chemically synthesized
tttttttttagttttaggtaaa

SEQ ID NO: 1384649 - DNA, 22 bp, Artificial Sequence
  chemically synthesized
ttttttttttagttttaggtaa

SEQ ID NO: 1384650 - DNA, 22 bp, Artificial Sequence
  chemically synthesized
cttttttttttttagttttagg

SEQ ID NO: 1384651 - DNA, 22 bp, Artificial Sequence
  chemically synthesized
gcttttttttttttagttttag

SEQ ID NO: 1384652 - DNA, 22 bp, Artificial Sequence
  chemically synthesized
aattttacctaaaactaaaaaa

SEQ ID NO: 1384653 - DNA, 22 bp, Artificial Sequence
  chemically synthesized
attttacctaaaactaaaaaaa

SEQ ID NO: 1384654 - DNA, 22 bp, Artificial Sequence
  chemically synthesized
tacctaaaactaaaaaaaaaaa

SEQ ID NO: 1384655 - DNA, 22 bp, Artificial Sequence
  chemically synthesized
acctaaaactaaaaaaaaaaaa

SEQ ID NO: 1384656 - DNA, 22 bp, Artificial Sequence
  chemically synthesized
ataaatatttgctttttttttt

SEQ ID NO: 1384657 - DNA, 22 bp, Artificial Sequence
  chemically synthesized
cctaaaactaaaaaaaaaaaag

SEQ ID NO: 1384658 - DNA, 22 bp, Artificial Sequence
  chemically synthesized
gataaatatttgcttttttttt

SEQ ID NO: 1384659 - DNA, 22 bp, Artificial Sequence
  chemically synthesized
aaactaaaaaaaaaaaagcaaa

SEQ ID NO: 1384660 - DNA, 22 bp, Artificial Sequence
  chemically synthesized
agcatttgataaatatttgctt

SEQ ID NO: 1384661 - DNA, 22 bp, Artificial Sequence
  chemically synthesized
aaaaaaaaaaagcaaatattta

SEQ ID NO: 1384662 - DNA, 22 bp, Artificial Sequence
  chemically synthesized
aaaaatattcagcatttgataa

SEQ ID NO: 1384663 - DNA, 22 bp, Artificial Sequence
  chemically synthesized
aaaaaatattcagcatttgata

SEQ ID NO: 1384664 - DNA, 22 bp, Artificial Sequence
  chemically synthesized
acagtgcttaaaaaatattcag

SEQ ID NO: 1384665 - DNA, 22 bp, Artificial Sequence
  chemically synthesized
ctaacagtgcttaaaaaatatt

SEQ ID NO: 1384666 - DNA, 22 bp, Artificial Sequence
  chemically synthesized
atcaaatgctgaatatttttta

SEQ ID NO: 1384667 - DNA, 22 bp, Artificial Sequence
  chemically synthesized
tcaaatgctgaatattttttaa

SEQ ID NO: 1384668 - DNA, 22 bp, Artificial Sequence
  chemically synthesized
aatattttttaagcactgttag

SEQ ID NO: 1384669 - DNA, 22 bp, Artificial Sequence
  chemically synthesized
tttaagcactgttagcaattat

SEQ ID NO: 1384670 - DNA, 22 bp, Artificial Sequence
  chemically synthesized
ttaagcactgttagcaattatc

SEQ ID NO: 1384671 - DNA, 22 bp, Artificial Sequence
  chemically synthesized
taagcactgttagcaattatct

SEQ ID NO: 1384672 - DNA, 22 bp, Artificial Sequence
  chemically synthesized
ggatagacagatagataattgc

SEQ ID NO: 1384673 - DNA, 22 bp, Artificial Sequence
  chemically synthesized
aagcactgttagcaattatcta

SEQ ID NO: 1384674 - DNA, 22 bp, Artificial Sequence
  chemically synthesized
agcactgttagcaattatctat

SEQ ID NO: 1384675 - DNA, 22 bp, Artificial Sequence
  chemically synthesized
taggatagacagatagataatt

SEQ ID NO: 1384676 - DNA, 22 bp, Artificial Sequence
  chemically synthesized
ttagcaattatctatctgtcta

SEQ ID NO: 1384677 - DNA, 22 bp, Artificial Sequence
  chemically synthesized
gcaattatctatctgtctatcc

SEQ ID NO: 1384678 - DNA, 22 bp, Artificial Sequence
  chemically synthesized
agagtggagattctaggataga

SEQ ID NO: 1384679 - DNA, 22 bp, Artificial Sequence
  chemically synthesized
tctatctgtctatcctagaatc

SEQ ID NO: 1384680 - DNA, 22 bp, Artificial Sequence
  chemically synthesized
tctgtctatcctagaatctcca

SEQ ID NO: 1384681 - DNA, 22 bp, Artificial Sequence
  chemically synthesized
tctatcctagaatctccactct

SEQ ID NO: 1384682 - DNA, 22 bp, Artificial Sequence
  chemically synthesized
tcctagaatctccactctgaac

SEQ ID NO: 1384683 - DNA, 22 bp, Artificial Sequence
  chemically synthesized
gaatctccactctgaacactgc

SEQ ID NO: 1384684 - DNA, 22 bp, Artificial Sequence
  chemically synthesized
atcacatggaatgcagtgttca

SEQ ID NO: 1384685 - DNA, 22 bp, Artificial Sequence
  chemically synthesized
catcacatggaatgcagtgttc

SEQ ID NO: 1384686 - DNA, 22 bp, Artificial Sequence
  chemically synthesized
cactctgaacactgcattccat

SEQ ID NO: 1384687 - DNA, 22 bp, Artificial Sequence
  chemically synthesized
atgtttcatcacatggaatgca

SEQ ID NO: 1384688 - DNA, 22 bp, Artificial Sequence
  chemically synthesized
tgaacactgcattccatgtgat

SEQ ID NO: 1384689 - DNA, 22 bp, Artificial Sequence
  chemically synthesized
aacactgcattccatgtgatga

SEQ ID NO: 1384690 - DNA, 22 bp, Artificial Sequence
  chemically synthesized
atatctaatgtttcatcacatg

SEQ ID NO: 1384691 - DNA, 22 bp, Artificial Sequence
  chemically synthesized
catatctaatgtttcatcacat

SEQ ID NO: 1384692 - DNA, 22 bp, Artificial Sequence
  chemically synthesized
tcatatctaatgtttcatcaca

SEQ ID NO: 1384693 - DNA, 22 bp, Artificial Sequence
  chemically synthesized
cattccatgtgatgaaacatta

SEQ ID NO: 1384694 - DNA, 22 bp, Artificial Sequence
  chemically synthesized
tgttttcatatctaatgtttca

SEQ ID NO: 1384695 - DNA, 22 bp, Artificial Sequence
  chemically synthesized
gtgttttcatatctaatgtttc

SEQ ID NO: 1384696 - DNA, 22 bp, Artificial Sequence
  chemically synthesized
catgtgatgaaacattagatat

SEQ ID NO: 1384697 - DNA, 22 bp, Artificial Sequence
  chemically synthesized
gatatgaaaacacaaggctggg

SEQ ID NO: 1384698 - DNA, 22 bp, Artificial Sequence
  chemically synthesized
caggcatgagccaccgcgccca

SEQ ID NO: 1384699 - DNA, 22 bp, Artificial Sequence
  chemically synthesized
gaattacaggcatgagccaccg

SEQ ID NO: 1384700 - DNA, 22 bp, Artificial Sequence
  chemically synthesized
ggcgcggtggctcatgcctgta

SEQ ID NO: 1384701 - DNA, 22 bp, Artificial Sequence
  chemically synthesized
ccaaagtgctggaattacaggc

SEQ ID NO: 1384702 - DNA, 22 bp, Artificial Sequence
  chemically synthesized
gcctcccaaagtgctggaatta

SEQ ID NO: 1384703 - DNA, 22 bp, Artificial Sequence
  chemically synthesized
ggcctcccaaagtgctggaatt

SEQ ID NO: 1384704 - DNA, 22 bp, Artificial Sequence
  chemically synthesized
atgcctgtaattccagcacttt

SEQ ID NO: 1384705 - DNA, 22 bp, Artificial Sequence
  chemically synthesized
ccttggcctcccaaagtgctgg

SEQ ID NO: 1384706 - DNA, 22 bp, Artificial Sequence
  chemically synthesized
cctgccttggcctcccaaagtg

SEQ ID NO: 1384707 - DNA, 22 bp, Artificial Sequence
  chemically synthesized
taattccagcactttgggaggc

SEQ ID NO: 1384708 - DNA, 22 bp, Artificial Sequence
  chemically synthesized
cagcactttgggaggccaaggc

SEQ ID NO: 1384709 - DNA, 22 bp, Artificial Sequence
  chemically synthesized
aggtgatctgcctgccttggcc

SEQ ID NO: 1384710 - DNA, 22 bp, Artificial Sequence
  chemically synthesized
acctcaggtgatctgcctgcct

SEQ ID NO: 1384711 - DNA, 22 bp, Artificial Sequence
  chemically synthesized
tgggaggccaaggcaggcagat

SEQ ID NO: 1384712 - DNA, 22 bp, Artificial Sequence
  chemically synthesized
gggaggccaaggcaggcagatc

SEQ ID NO: 1384713 - DNA, 22 bp, Artificial Sequence
  chemically synthesized
ctgacctcaggtgatctgcctg

SEQ ID NO: 1384714 - DNA, 22 bp, Artificial Sequence
  chemically synthesized
ggaggccaaggcaggcagatca

SEQ ID NO: 1384715 - DNA, 22 bp, Artificial Sequence
  chemically synthesized
aaactcctgacctcaggtgatc

SEQ ID NO: 1384716 - DNA, 22 bp, Artificial Sequence
  chemically synthesized
gtctgaaactcctgacctcagg

SEQ ID NO: 1384717 - DNA, 22 bp, Artificial Sequence
  chemically synthesized
gccaggctggtctgaaactcct

SEQ ID NO: 1384718 - DNA, 22 bp, Artificial Sequence
  chemically synthesized
aggtcaggagtttcagaccagc

SEQ ID NO: 1384719 - DNA, 22 bp, Artificial Sequence
  chemically synthesized
accatgttggccaggctggtct

SEQ ID NO: 1384720 - DNA, 22 bp, Artificial Sequence
  chemically synthesized
caccatgttggccaggctggtc

SEQ ID NO: 1384721 - DNA, 22 bp, Artificial Sequence
  chemically synthesized
cagaccagcctggccaacatgg

SEQ ID NO: 1384722 - DNA, 22 bp, Artificial Sequence
  chemically synthesized
agaccagcctggccaacatggt

SEQ ID NO: 1384723 - DNA, 22 bp, Artificial Sequence
  chemically synthesized
gtagagacgaggtttcaccatg

SEQ ID NO: 1384724 - DNA, 22 bp, Artificial Sequence
  chemically synthesized
agtagagacgaggtttcaccat

SEQ ID NO: 1384725 - DNA, 22 bp, Artificial Sequence
  chemically synthesized
tagtagagacgaggtttcacca

SEQ ID NO: 1384726 - DNA, 22 bp, Artificial Sequence
  chemically synthesized
ttagtagagacgaggtttcacc

SEQ ID NO: 1384727 - DNA, 22 bp, Artificial Sequence
  chemically synthesized
gccaacatggtgaaacctcgtc

SEQ ID NO: 1384728 - DNA, 22 bp, Artificial Sequence
  chemically synthesized
tatttttagtagagacgaggtt

SEQ ID NO: 1384729 - DNA, 22 bp, Artificial Sequence
  chemically synthesized
atatttttagtagagacgaggt

SEQ ID NO: 1384730 - DNA, 22 bp, Artificial Sequence
  chemically synthesized
tatatttttagtagagacgagg

SEQ ID NO: 1384731 - DNA, 22 bp, Artificial Sequence
  chemically synthesized
ttatatttttagtagagacgag

SEQ ID NO: 1384732 - DNA, 22 bp, Artificial Sequence
  chemically synthesized
atttttatatttttagtagaga

SEQ ID NO: 1384733 - DNA, 22 bp, Artificial Sequence
  chemically synthesized
gtctctactaaaaatataaaaa

SEQ ID NO: 1384734 - DNA, 22 bp, Artificial Sequence
  chemically synthesized
tactaaaaatataaaaattagc

SEQ ID NO: 1384735 - DNA, 22 bp, Artificial Sequence
  chemically synthesized
ctaaaaatataaaaattagccg

SEQ ID NO: 1384736 - DNA, 22 bp, Artificial Sequence
  chemically synthesized
aaaatataaaaattagccgggt

SEQ ID NO: 1384737 - DNA, 22 bp, Artificial Sequence
  chemically synthesized
caggcacccgccacacacccgg

SEQ ID NO: 1384738 - DNA, 22 bp, Artificial Sequence
  chemically synthesized
ggattacaggcacccgccacac

SEQ ID NO: 1384739 - DNA, 22 bp, Artificial Sequence
  chemically synthesized
gccgggtgtgtggcgggtgcct

SEQ ID NO: 1384740 - DNA, 22 bp, Artificial Sequence
  chemically synthesized
ccaagtagctgggattacaggc

SEQ ID NO: 1384741 - DNA, 22 bp, Artificial Sequence
  chemically synthesized
agcctcccaagtagctgggatt

SEQ ID NO: 1384742 - DNA, 22 bp, Artificial Sequence
  chemically synthesized
cctcagcctcccaagtagctgg

SEQ ID NO: 1384743 - DNA, 22 bp, Artificial Sequence
  chemically synthesized
ctgcctcagcctcccaagtagc

SEQ ID NO: 1384744 - DNA, 22 bp, Artificial Sequence
  chemically synthesized
tcctgcctcagcctcccaagta

SEQ ID NO: 1384745 - DNA, 22 bp, Artificial Sequence
  chemically synthesized
taatcccagctacttgggaggc

SEQ ID NO: 1384746 - DNA, 22 bp, Artificial Sequence
  chemically synthesized
aagcaattctcctgcctcagcc

SEQ ID NO: 1384747 - DNA, 22 bp, Artificial Sequence
  chemically synthesized
cttgggaggctgaggcaggaga

SEQ ID NO: 1384748 - DNA, 22 bp, Artificial Sequence
  chemically synthesized
gggttcaagcaattctcctgcc

SEQ ID NO: 1384749 - DNA, 22 bp, Artificial Sequence
  chemically synthesized
gggaggctgaggcaggagaatt

SEQ ID NO: 1384750 - DNA, 22 bp, Artificial Sequence
  chemically synthesized
tggggttcaagcaattctcctg

SEQ ID NO: 1384751 - DNA, 22 bp, Artificial Sequence
  chemically synthesized
ggaggctgaggcaggagaattg

SEQ ID NO: 1384752 - DNA, 22 bp, Artificial Sequence
  chemically synthesized
cgcctctggggttcaagcaatt

SEQ ID NO: 1384753 - DNA, 22 bp, Artificial Sequence
  chemically synthesized
aggcaggagaattgcttgaacc

SEQ ID NO: 1384754 - DNA, 22 bp, Artificial Sequence
  chemically synthesized
accacaacctccgcctctgggg

SEQ ID NO: 1384755 - DNA, 22 bp, Artificial Sequence
  chemically synthesized
ggctcaccacaacctccgcctc

SEQ ID NO: 1384756 - DNA, 22 bp, Artificial Sequence
  chemically synthesized
cttgaaccccagaggcggaggt

SEQ ID NO: 1384757 - DNA, 22 bp, Artificial Sequence
  chemically synthesized
gaaccccagaggcggaggttgt

SEQ ID NO: 1384758 - DNA, 22 bp, Artificial Sequence
  chemically synthesized
tctcggctcaccacaacctccg

SEQ ID NO: 1384759 - DNA, 22 bp, Artificial Sequence
  chemically synthesized
aaccccagaggcggaggttgtg

SEQ ID NO: 1384760 - DNA, 22 bp, Artificial Sequence
  chemically synthesized
gagtgtggtggcactatctcgg

SEQ ID NO: 1384761 - DNA, 22 bp, Artificial Sequence
  chemically synthesized
tggtgagccgagatagtgccac

SEQ ID NO: 1384762 - DNA, 22 bp, Artificial Sequence
  chemically synthesized
tcgcccaggctggagtgtggtg

SEQ ID NO: 1384763 - DNA, 22 bp, Artificial Sequence
  chemically synthesized
gtcgcccaggctggagtgtggt

SEQ ID NO: 1384764 - DNA, 22 bp, Artificial Sequence
  chemically synthesized
tgtcgcccaggctggagtgtgg

SEQ ID NO: 1384765 - DNA, 22 bp, Artificial Sequence
  chemically synthesized
gctttgtcgcccaggctggagt

SEQ ID NO: 1384766 - DNA, 22 bp, Artificial Sequence
  chemically synthesized
agacagagtctcgctttgtcgc

SEQ ID NO: 1384767 - DNA, 22 bp, Artificial Sequence
  chemically synthesized
gagacagagtctcgctttgtcg

SEQ ID NO: 1384768 - DNA, 22 bp, Artificial Sequence
  chemically synthesized
tgagacagagtctcgctttgtc

SEQ ID NO: 1384769 - DNA, 22 bp, Artificial Sequence
  chemically synthesized
ttgagacagagtctcgctttgt

SEQ ID NO: 1384770 - DNA, 22 bp, Artificial Sequence
  chemically synthesized
cagcctgggcgacaaagcgaga

SEQ ID NO: 1384771 - DNA, 22 bp, Artificial Sequence
  chemically synthesized
tttgagacagagtctcgctttg

SEQ ID NO: 1384772 - DNA, 22 bp, Artificial Sequence
  chemically synthesized
ttttgagacagagtctcgcttt

SEQ ID NO: 1384773 - DNA, 22 bp, Artificial Sequence
  chemically synthesized
tttttgagacagagtctcgctt

SEQ ID NO: 1384774 - DNA, 22 bp, Artificial Sequence
  chemically synthesized
ttttttgagacagagtctcgct

SEQ ID NO: 1384775 - DNA, 22 bp, Artificial Sequence
  chemically synthesized
tttttttgagacagagtctcgc

SEQ ID NO: 1384776 - DNA, 22 bp, Artificial Sequence
  chemically synthesized
ggcgacaaagcgagactctgtc

SEQ ID NO: 1384777 - DNA, 22 bp, Artificial Sequence
  chemically synthesized
gttttttttttgagacagagtc

SEQ ID NO: 1384778 - DNA, 22 bp, Artificial Sequence
  chemically synthesized
ggttttttttttgagacagagt

SEQ ID NO: 1384779 - DNA, 22 bp, Artificial Sequence
  chemically synthesized
tggttttttttttgagacagag

SEQ ID NO: 1384780 - DNA, 22 bp, Artificial Sequence
  chemically synthesized
ttggttttttttttgagacaga

SEQ ID NO: 1384781 - DNA, 22 bp, Artificial Sequence
  chemically synthesized
tttggttttttttttgagacag

SEQ ID NO: 1384782 - DNA, 22 bp, Artificial Sequence
  chemically synthesized
ttttggttttttttttgagaca

SEQ ID NO: 1384783 - DNA, 22 bp, Artificial Sequence
  chemically synthesized
tttttggttttttttttgagac

SEQ ID NO: 1384784 - DNA, 22 bp, Artificial Sequence
  chemically synthesized
ttttttggttttttttttgaga

SEQ ID NO: 1384785 - DNA, 22 bp, Artificial Sequence
  chemically synthesized
tttttttggttttttttttgag

SEQ ID NO: 1384786 - DNA, 22 bp, Artificial Sequence
  chemically synthesized
ttttttttggttttttttttga

SEQ ID NO: 1384787 - DNA, 22 bp, Artificial Sequence
  chemically synthesized
tttttttttggttttttttttg

SEQ ID NO: 1384788 - DNA, 22 bp, Artificial Sequence
  chemically synthesized
ttttttttttggtttttttttt

SEQ ID NO: 1384789 - DNA, 22 bp, Artificial Sequence
  chemically synthesized
gtttttttttttttggtttttt

SEQ ID NO: 1384790 - DNA, 22 bp, Artificial Sequence
  chemically synthesized
ggtttttttttttttggttttt

SEQ ID NO: 1384791 - DNA, 22 bp, Artificial Sequence
  chemically synthesized
tgtctcaaaaaaaaaaccaaaa

SEQ ID NO: 1384792 - DNA, 22 bp, Artificial Sequence
  chemically synthesized
tggtttttttttttttggtttt

SEQ ID NO: 1384793 - DNA, 22 bp, Artificial Sequence
  chemically synthesized
ttggtttttttttttttggttt

SEQ ID NO: 1384794 - DNA, 22 bp, Artificial Sequence
  chemically synthesized
tctcaaaaaaaaaaccaaaaaa

SEQ ID NO: 1384795 - DNA, 22 bp, Artificial Sequence
  chemically synthesized
tttggtttttttttttttggtt

SEQ ID NO: 1384796 - DNA, 22 bp, Artificial Sequence
  chemically synthesized
ttttggtttttttttttttggt

SEQ ID NO: 1384797 - DNA, 22 bp, Artificial Sequence
  chemically synthesized
tttttggtttttttttttttgg

SEQ ID NO: 1384798 - DNA, 22 bp, Artificial Sequence
  chemically synthesized
ttttttggtttttttttttttg

SEQ ID NO: 1384799 - DNA, 22 bp, Artificial Sequence
  chemically synthesized
aaaaaaaaaaccaaaaaaaaaa

SEQ ID NO: 1384800 - DNA, 22 bp, Artificial Sequence
  chemically synthesized
ttttttttggtttttttttttt

SEQ ID NO: 1384801 - DNA, 22 bp, Artificial Sequence
  chemically synthesized
cttttttttggttttttttttt

SEQ ID NO: 1384802 - DNA, 22 bp, Artificial Sequence
  chemically synthesized
tcttttttttggtttttttttt

SEQ ID NO: 1384803 - DNA, 22 bp, Artificial Sequence
  chemically synthesized
tgttttcttttttttggttttt

SEQ ID NO: 1384804 - DNA, 22 bp, Artificial Sequence
  chemically synthesized
ttgtgttttcttttttttggtt

SEQ ID NO: 1384805 - DNA, 22 bp, Artificial Sequence
  chemically synthesized
attgtgttttcttttttttggt

SEQ ID NO: 1384806 - DNA, 22 bp, Artificial Sequence
  chemically synthesized
aatggtcttattgtgttttctt

SEQ ID NO: 1384807 - DNA, 22 bp, Artificial Sequence
  chemically synthesized
aatcattgaatggtcttattgt

SEQ ID NO: 1384808 - DNA, 22 bp, Artificial Sequence
  chemically synthesized
aaatcattgaatggtcttattg

SEQ ID NO: 1384809 - DNA, 22 bp, Artificial Sequence
  chemically synthesized
acttaaatcattgaatggtctt

SEQ ID NO: 1384810 - DNA, 22 bp, Artificial Sequence
  chemically synthesized
aacttaaatcattgaatggtct

SEQ ID NO: 1384811 - DNA, 22 bp, Artificial Sequence
  chemically synthesized
taacttaaatcattgaatggtc

SEQ ID NO: 1384812 - DNA, 22 bp, Artificial Sequence
  chemically synthesized
atgttttaacttaaatcattga

SEQ ID NO: 1384813 - DNA, 22 bp, Artificial Sequence
  chemically synthesized
ttcatgttttaacttaaatcat

SEQ ID NO: 1384814 - DNA, 22 bp, Artificial Sequence
  chemically synthesized
aatgatttaagttaaaacatga

SEQ ID NO: 1384815 - DNA, 22 bp, Artificial Sequence
  chemically synthesized
acatggtcactattcatgtttt

SEQ ID NO: 1384816 - DNA, 22 bp, Artificial Sequence
  chemically synthesized
ccactcacatggtcactattca

SEQ ID NO: 1384817 - DNA, 22 bp, Artificial Sequence
  chemically synthesized
aagttaaaacatgaatagtgac

SEQ ID NO: 1384818 - DNA, 22 bp, Artificial Sequence
  chemically synthesized
gccactcacatggtcactattc

SEQ ID NO: 1384819 - DNA, 22 bp, Artificial Sequence
  chemically synthesized
agttaaaacatgaatagtgacc

SEQ ID NO: 1384820 - DNA, 22 bp, Artificial Sequence
  chemically synthesized
tgccactcacatggtcactatt

SEQ ID NO: 1384821 - DNA, 22 bp, Artificial Sequence
  chemically synthesized
ctttgccactcacatggtcact

SEQ ID NO: 1384822 - DNA, 22 bp, Artificial Sequence
  chemically synthesized
gctttgccactcacatggtcac

SEQ ID NO: 1384823 - DNA, 22 bp, Artificial Sequence
  chemically synthesized
aaacatgaatagtgaccatgtg

SEQ ID NO: 1384824 - DNA, 22 bp, Artificial Sequence
  chemically synthesized
aaaaaaaataaaaatgaaaaag

SEQ ID NO: 1384825 - DNA, 22 bp, Artificial Sequence
  chemically synthesized
tctcaaaaaaaataaaaatgaa

SEQ ID NO: 1384826 - DNA, 22 bp, Artificial Sequence
  chemically synthesized
tgtctcaaaaaaaataaaaatg

SEQ ID NO: 1384827 - DNA, 22 bp, Artificial Sequence
  chemically synthesized
tttttcatttttattttttttg

SEQ ID NO: 1384828 - DNA, 22 bp, Artificial Sequence
  chemically synthesized
tttcatttttattttttttgag

SEQ ID NO: 1384829 - DNA, 22 bp, Artificial Sequence
  chemically synthesized
ttcatttttattttttttgaga

SEQ ID NO: 1384830 - DNA, 22 bp, Artificial Sequence
  chemically synthesized
tcatttttattttttttgagac

SEQ ID NO: 1384831 - DNA, 22 bp, Artificial Sequence
  chemically synthesized
catttttattttttttgagaca

SEQ ID NO: 1384832 - DNA, 22 bp, Artificial Sequence
  chemically synthesized
atttttattttttttgagacag

SEQ ID NO: 1384833 - DNA, 22 bp, Artificial Sequence
  chemically synthesized
ttattttttttgagacagagtc

SEQ ID NO: 1384834 - DNA, 22 bp, Artificial Sequence
  chemically synthesized
tattttttttgagacagagtct

SEQ ID NO: 1384835 - DNA, 22 bp, Artificial Sequence
  chemically synthesized
ggcaacagagtgagactctgtc

SEQ ID NO: 1384836 - DNA, 22 bp, Artificial Sequence
  chemically synthesized
attttttttgagacagagtctc

SEQ ID NO: 1384837 - DNA, 22 bp, Artificial Sequence
  chemically synthesized
ttttttttgagacagagtctca

SEQ ID NO: 1384838 - DNA, 22 bp, Artificial Sequence
  chemically synthesized
tttttgagacagagtctcactc

SEQ ID NO: 1384839 - DNA, 22 bp, Artificial Sequence
  chemically synthesized
ttttgagacagagtctcactct

SEQ ID NO: 1384840 - DNA, 22 bp, Artificial Sequence
  chemically synthesized
tttgagacagagtctcactctg

SEQ ID NO: 1384841 - DNA, 22 bp, Artificial Sequence
  chemically synthesized
cagcctgggcaacagagtgaga

SEQ ID NO: 1384842 - DNA, 22 bp, Artificial Sequence
  chemically synthesized
ttgagacagagtctcactctgt

SEQ ID NO: 1384843 - DNA, 22 bp, Artificial Sequence
  chemically synthesized
tgagacagagtctcactctgtt

SEQ ID NO: 1384844 - DNA, 22 bp, Artificial Sequence
  chemically synthesized
gagacagagtctcactctgttg

SEQ ID NO: 1384845 - DNA, 22 bp, Artificial Sequence
  chemically synthesized
agacagagtctcactctgttgc

SEQ ID NO: 1384846 - DNA, 22 bp, Artificial Sequence
  chemically synthesized
cactccagcctgggcaacagag

SEQ ID NO: 1384847 - DNA, 22 bp, Artificial Sequence
  chemically synthesized
ctgcactccagcctgggcaaca

SEQ ID NO: 1384848 - DNA, 22 bp, Artificial Sequence
  chemically synthesized
cattactgcactccagcctggg

SEQ ID NO: 1384849 - DNA, 22 bp, Artificial Sequence
  chemically synthesized
actctgttgcccaggctggagt

SEQ ID NO: 1384850 - DNA, 22 bp, Artificial Sequence
  chemically synthesized
agattgcattactgcactccag

SEQ ID NO: 1384851 - DNA, 22 bp, Artificial Sequence
  chemically synthesized
tgttgcccaggctggagtgcag

SEQ ID NO: 1384852 - DNA, 22 bp, Artificial Sequence
  chemically synthesized
ttgcccaggctggagtgcagta

SEQ ID NO: 1384853 - DNA, 22 bp, Artificial Sequence
  chemically synthesized
cccaggctggagtgcagtaatg

SEQ ID NO: 1384854 - DNA, 22 bp, Artificial Sequence
  chemically synthesized
cagtgagctgagattgcattac

SEQ ID NO: 1384855 - DNA, 22 bp, Artificial Sequence
  chemically synthesized
gagtgcagtaatgcaatctcag

SEQ ID NO: 1384856 - DNA, 22 bp, Artificial Sequence
  chemically synthesized
aacccaggaggcagaggttgca

SEQ ID NO: 1384857 - DNA, 22 bp, Artificial Sequence
  chemically synthesized
gaacccaggaggcagaggttgc

SEQ ID NO: 1384858 - DNA, 22 bp, Artificial Sequence
  chemically synthesized
agctcactgcaacctctgcctc

SEQ ID NO: 1384859 - DNA, 22 bp, Artificial Sequence
  chemically synthesized
actgcaacctctgcctcctggg

SEQ ID NO: 1384860 - DNA, 22 bp, Artificial Sequence
  chemically synthesized
caacctctgcctcctgggttca

SEQ ID NO: 1384861 - DNA, 22 bp, Artificial Sequence
  chemically synthesized
aggcaggagaatcgcttgaacc

SEQ ID NO: 1384862 - DNA, 22 bp, Artificial Sequence
  chemically synthesized
tgcctcctgggttcaagcgatt

SEQ ID NO: 1384863 - DNA, 22 bp, Artificial Sequence
  chemically synthesized
cctcctgggttcaagcgattct

SEQ ID NO: 1384864 - DNA, 22 bp, Artificial Sequence
  chemically synthesized
ctgggttcaagcgattctcctg

SEQ ID NO: 1384865 - DNA, 22 bp, Artificial Sequence
  chemically synthesized
gggaggctgaggcaggagaatc

SEQ ID NO: 1384866 - DNA, 22 bp, Artificial Sequence
  chemically synthesized
ggttcaagcgattctcctgcct

SEQ ID NO: 1384867 - DNA, 22 bp, Artificial Sequence
  chemically synthesized
ctagggaggctgaggcaggaga

SEQ ID NO: 1384868 - DNA, 22 bp, Artificial Sequence
  chemically synthesized
aagcgattctcctgcctcagcc

SEQ ID NO: 1384869 - DNA, 22 bp, Artificial Sequence
  chemically synthesized
taatcccagctactagggaggc

SEQ ID NO: 1384870 - DNA, 22 bp, Artificial Sequence
  chemically synthesized
tcctgcctcagcctccctagta

SEQ ID NO: 1384871 - DNA, 22 bp, Artificial Sequence
  chemically synthesized
ctgcctcagcctccctagtagc

SEQ ID NO: 1384872 - DNA, 22 bp, Artificial Sequence
  chemically synthesized
cctcagcctccctagtagctgg

SEQ ID NO: 1384873 - DNA, 22 bp, Artificial Sequence
  chemically synthesized
agcctccctagtagctgggatt

SEQ ID NO: 1384874 - DNA, 22 bp, Artificial Sequence
  chemically synthesized
cctagtagctgggattacaggt

SEQ ID NO: 1384875 - DNA, 22 bp, Artificial Sequence
  chemically synthesized
gtagctgggattacaggtgccc

SEQ ID NO: 1384876 - DNA, 22 bp, Artificial Sequence
  chemically synthesized
gtcaggcgtggtggtgggcacc

SEQ ID NO: 1384877 - DNA, 22 bp, Artificial Sequence
  chemically synthesized
ggattacaggtgcccaccacca

SEQ ID NO: 1384878 - DNA, 22 bp, Artificial Sequence
  chemically synthesized
caggtgcccaccaccacgcctg

SEQ ID NO: 1384879 - DNA, 22 bp, Artificial Sequence
  chemically synthesized
aaaatacaaaaattagtcaggc

SEQ ID NO: 1384880 - DNA, 22 bp, Artificial Sequence
  chemically synthesized
ctaaaaatacaaaaattagtca

SEQ ID NO: 1384881 - DNA, 22 bp, Artificial Sequence
  chemically synthesized
tactaaaaatacaaaaattagt

SEQ ID NO: 1384882 - DNA, 22 bp, Artificial Sequence
  chemically synthesized
tctctactaaaaatacaaaaat

SEQ ID NO: 1384883 - DNA, 22 bp, Artificial Sequence
  chemically synthesized
actaatttttgtatttttagta

SEQ ID NO: 1384884 - DNA, 22 bp, Artificial Sequence
  chemically synthesized
atttttgtatttttagtagaga

SEQ ID NO: 1384885 - DNA, 22 bp, Artificial Sequence
  chemically synthesized
ttgtatttttagtagagacagg

SEQ ID NO: 1384886 - DNA, 22 bp, Artificial Sequence
  chemically synthesized
tgtatttttagtagagacaggg

SEQ ID NO: 1384887 - DNA, 22 bp, Artificial Sequence
  chemically synthesized
gtatttttagtagagacagggt

SEQ ID NO: 1384888 - DNA, 22 bp, Artificial Sequence
  chemically synthesized
tatttttagtagagacagggtt

SEQ ID NO: 1384889 - DNA, 22 bp, Artificial Sequence
  chemically synthesized
gccaacatggtgaaaccctgtc

SEQ ID NO: 1384890 - DNA, 22 bp, Artificial Sequence
  chemically synthesized
ttagtagagacagggtttcacc

SEQ ID NO: 1384891 - DNA, 22 bp, Artificial Sequence
  chemically synthesized
tagtagagacagggtttcacca

SEQ ID NO: 1384892 - DNA, 22 bp, Artificial Sequence
  chemically synthesized
agtagagacagggtttcaccat

SEQ ID NO: 1384893 - DNA, 22 bp, Artificial Sequence
  chemically synthesized
gtagagacagggtttcaccatg

SEQ ID NO: 1384894 - DNA, 22 bp, Artificial Sequence
  chemically synthesized
agaccagcctggccaacatggt

SEQ ID NO: 1384895 - DNA, 22 bp, Artificial Sequence
  chemically synthesized
gagaccagcctggccaacatgg

SEQ ID NO: 1384896 - DNA, 22 bp, Artificial Sequence
  chemically synthesized
caccatgttggccaggctggtc

SEQ ID NO: 1384897 - DNA, 22 bp, Artificial Sequence
  chemically synthesized
accatgttggccaggctggtct

SEQ ID NO: 1384898 - DNA, 22 bp, Artificial Sequence
  chemically synthesized
aggtcaggagtttgagaccagc

SEQ ID NO: 1384899 - DNA, 22 bp, Artificial Sequence
  chemically synthesized
gccaggctggtctcaaactcct

SEQ ID NO: 1384900 - DNA, 22 bp, Artificial Sequence
  chemically synthesized
gtctcaaactcctgacctcagg

SEQ ID NO: 1384901 - DNA, 22 bp, Artificial Sequence
  chemically synthesized
aggcaggcggatcacctgaggt

SEQ ID NO: 1384902 - DNA, 22 bp, Artificial Sequence
  chemically synthesized
aaactcctgacctcaggtgatc

SEQ ID NO: 1384903 - DNA, 22 bp, Artificial Sequence
  chemically synthesized
ggagactgaggcaggcggatca

SEQ ID NO: 1384904 - DNA, 22 bp, Artificial Sequence
  chemically synthesized
ctgacctcaggtgatccgcctg

SEQ ID NO: 1384905 - DNA, 22 bp, Artificial Sequence
  chemically synthesized
gggagactgaggcaggcggatc

SEQ ID NO: 1384906 - DNA, 22 bp, Artificial Sequence
  chemically synthesized
tgggagactgaggcaggcggat

SEQ ID NO: 1384907 - DNA, 22 bp, Artificial Sequence
  chemically synthesized
acctcaggtgatccgcctgcct

SEQ ID NO: 1384908 - DNA, 22 bp, Artificial Sequence
  chemically synthesized
aggtgatccgcctgcctcagtc

SEQ ID NO: 1384909 - DNA, 22 bp, Artificial Sequence
  chemically synthesized
taatcccagcactttgggagac

SEQ ID NO: 1384910 - DNA, 22 bp, Artificial Sequence
  chemically synthesized
cctcagtctcccaaagtgctgg

SEQ ID NO: 1384911 - DNA, 22 bp, Artificial Sequence
  chemically synthesized
acgcctgtaatcccagcacttt

SEQ ID NO: 1384912 - DNA, 22 bp, Artificial Sequence
  chemically synthesized
agtctcccaaagtgctgggatt

SEQ ID NO: 1384913 - DNA, 22 bp, Artificial Sequence
  chemically synthesized
ccaaagtgctgggattacaggc

SEQ ID NO: 1384914 - DNA, 22 bp, Artificial Sequence
  chemically synthesized
ggtatggaggctcacgcctgta

SEQ ID NO: 1384915 - DNA, 22 bp, Artificial Sequence
  chemically synthesized
ggattacaggcgtgagcctcca

SEQ ID NO: 1384916 - DNA, 22 bp, Artificial Sequence
  chemically synthesized
caggcgtgagcctccataccca

SEQ ID NO: 1384917 - DNA, 22 bp, Artificial Sequence
  chemically synthesized
aagggatcagggaggctgggta

SEQ ID NO: 1384918 - DNA, 22 bp, Artificial Sequence
  chemically synthesized
aaagggatcagggaggctgggt

SEQ ID NO: 1384919 - DNA, 22 bp, Artificial Sequence
  chemically synthesized
catacccagcctccctgatccc

SEQ ID NO: 1384920 - DNA, 22 bp, Artificial Sequence
  chemically synthesized
cctgatccctttaagatctttt

SEQ ID NO: 1384921 - DNA, 22 bp, Artificial Sequence
  chemically synthesized
gaaaaatgggggaaaagatctt

SEQ ID NO: 1384922 - DNA, 22 bp, Artificial Sequence
  chemically synthesized
atccctttaagatcttttcccc

SEQ ID NO: 1384923 - DNA, 22 bp, Artificial Sequence
  chemically synthesized
taagatcttttcccccattttt

SEQ ID NO: 1384924 - DNA, 22 bp, Artificial Sequence
  chemically synthesized
aagatcttttcccccatttttc

SEQ ID NO: 1384925 - DNA, 22 bp, Artificial Sequence
  chemically synthesized
agatcttttcccccatttttcc

SEQ ID NO: 1384926 - DNA, 22 bp, Artificial Sequence
  chemically synthesized
ttcccccatttttccaatgaca

SEQ ID NO: 1384927 - DNA, 22 bp, Artificial Sequence
  chemically synthesized
tcccccatttttccaatgacat

SEQ ID NO: 1384928 - DNA, 22 bp, Artificial Sequence
  chemically synthesized
cccccatttttccaatgacatc

SEQ ID NO: 1384929 - DNA, 22 bp, Artificial Sequence
  chemically synthesized
ccccatttttccaatgacatct

SEQ ID NO: 1384930 - DNA, 22 bp, Artificial Sequence
  chemically synthesized
atgtatatgcatataagatgtc

SEQ ID NO: 1384931 - DNA, 22 bp, Artificial Sequence
  chemically synthesized
tctcatgtatatgcatataaga

SEQ ID NO: 1384932 - DNA, 22 bp, Artificial Sequence
  chemically synthesized
ttccaatgacatcttatatgca

SEQ ID NO: 1384933 - DNA, 22 bp, Artificial Sequence
  chemically synthesized
tccaatgacatcttatatgcat

SEQ ID NO: 1384934 - DNA, 22 bp, Artificial Sequence
  chemically synthesized
tatctcatgtatatgcatataa

SEQ ID NO: 1384935 - DNA, 22 bp, Artificial Sequence
  chemically synthesized
ccaatgacatcttatatgcata

SEQ ID NO: 1384936 - DNA, 22 bp, Artificial Sequence
  chemically synthesized
caatgacatcttatatgcatat

SEQ ID NO: 1384937 - DNA, 22 bp, Artificial Sequence
  chemically synthesized
gaacacaaattctatctcatgt

SEQ ID NO: 1384938 - DNA, 22 bp, Artificial Sequence
  chemically synthesized
agaacacaaattctatctcatg

SEQ ID NO: 1384939 - DNA, 22 bp, Artificial Sequence
  chemically synthesized
atatgcatatacatgagataga

SEQ ID NO: 1384940 - DNA, 22 bp, Artificial Sequence
  chemically synthesized
tatgcatatacatgagatagaa

SEQ ID NO: 1384941 - DNA, 22 bp, Artificial Sequence
  chemically synthesized
aatttagaacacaaattctatc

SEQ ID NO: 1384942 - DNA, 22 bp, Artificial Sequence
  chemically synthesized
gaatttagaacacaaattctat

SEQ ID NO: 1384943 - DNA, 22 bp, Artificial Sequence
  chemically synthesized
tgaatttagaacacaaattcta

SEQ ID NO: 1384944 - DNA, 22 bp, Artificial Sequence
  chemically synthesized
tttgaatttagaacacaaattc

SEQ ID NO: 1384945 - DNA, 22 bp, Artificial Sequence
  chemically synthesized
ctttgaatttagaacacaaatt

SEQ ID NO: 1384946 - DNA, 22 bp, Artificial Sequence
  chemically synthesized
cttctttgaatttagaacacaa

SEQ ID NO: 1384947 - DNA, 22 bp, Artificial Sequence
  chemically synthesized
ccttctttgaatttagaacaca

SEQ ID NO: 1384948 - DNA, 22 bp, Artificial Sequence
  chemically synthesized
ttccttctttgaatttagaaca

SEQ ID NO: 1384949 - DNA, 22 bp, Artificial Sequence
  chemically synthesized
gtgttctaaattcaaagaagga

SEQ ID NO: 1384950 - DNA, 22 bp, Artificial Sequence
  chemically synthesized
tgttctaaattcaaagaaggaa

SEQ ID NO: 1384951 - DNA, 22 bp, Artificial Sequence
  chemically synthesized
taaattcaaagaaggaagagtt

SEQ ID NO: 1384952 - DNA, 22 bp, Artificial Sequence
  chemically synthesized
cccaaatccaatgaactcttcc

SEQ ID NO: 1384953 - DNA, 22 bp, Artificial Sequence
  chemically synthesized
aattcaaagaaggaagagttca

SEQ ID NO: 1384954 - DNA, 22 bp, Artificial Sequence
  chemically synthesized
tccccaaatccaatgaactctt

SEQ ID NO: 1384955 - DNA, 22 bp, Artificial Sequence
  chemically synthesized
aaagaaggaagagttcattgga

SEQ ID NO: 1384956 - DNA, 22 bp, Artificial Sequence
  chemically synthesized
aacatcgtccaagttctcccca

SEQ ID NO: 1384957 - DNA, 22 bp, Artificial Sequence
  chemically synthesized
attggatttggggagaacttgg

SEQ ID NO: 1384958 - DNA, 22 bp, Artificial Sequence
  chemically synthesized
gatttggggagaacttggacga

SEQ ID NO: 1384959 - DNA, 22 bp, Artificial Sequence
  chemically synthesized
ggggagaacttggacgatgttg

SEQ ID NO: 1384960 - DNA, 22 bp, Artificial Sequence
  chemically synthesized
gggagaacttggacgatgttga

SEQ ID NO: 1384961 - DNA, 22 bp, Artificial Sequence
  chemically synthesized
atcaataccaaccaactcaaca

SEQ ID NO: 1384962 - DNA, 22 bp, Artificial Sequence
  chemically synthesized
tgatcaataccaaccaactcaa

SEQ ID NO: 1384963 - DNA, 22 bp, Artificial Sequence
  chemically synthesized
tctgatcaataccaaccaactc

SEQ ID NO: 1384964 - DNA, 22 bp, Artificial Sequence
  chemically synthesized
ggacgatgttgagttggttggt

SEQ ID NO: 1384965 - DNA, 22 bp, Artificial Sequence
  chemically synthesized
gacgatgttgagttggttggta

SEQ ID NO: 1384966 - DNA, 22 bp, Artificial Sequence
  chemically synthesized
ctctctgatcaataccaaccaa

SEQ ID NO: 1384967 - DNA, 22 bp, Artificial Sequence
  chemically synthesized
cctctctgatcaataccaacca

SEQ ID NO: 1384968 - DNA, 22 bp, Artificial Sequence
  chemically synthesized
agttggttggtattgatcagag

SEQ ID NO: 1384969 - DNA, 22 bp, Artificial Sequence
  chemically synthesized
taaatacatttcctctctgatc

SEQ ID NO: 1384970 - DNA, 22 bp, Artificial Sequence
  chemically synthesized
tataaatacatttcctctctga

SEQ ID NO: 1384971 - DNA, 22 bp, Artificial Sequence
  chemically synthesized
gttggtattgatcagagaggaa

SEQ ID NO: 1384972 - DNA, 22 bp, Artificial Sequence
  chemically synthesized
tctataaatacatttcctctct

SEQ ID NO: 1384973 - DNA, 22 bp, Artificial Sequence
  chemically synthesized
ctctataaatacatttcctctc

SEQ ID NO: 1384974 - DNA, 22 bp, Artificial Sequence
  chemically synthesized
gtattgatcagagaggaaatgt

SEQ ID NO: 1384975 - DNA, 22 bp, Artificial Sequence
  chemically synthesized
atcagagaggaaatgtatttat

SEQ ID NO: 1384976 - DNA, 22 bp, Artificial Sequence
  chemically synthesized
catggatttctctataaataca

SEQ ID NO: 1384977 - DNA, 22 bp, Artificial Sequence
  chemically synthesized
tacatggatttctctataaata

SEQ ID NO: 1384978 - DNA, 22 bp, Artificial Sequence
  chemically synthesized
actctacatggatttctctata

SEQ ID NO: 1384979 - DNA, 22 bp, Artificial Sequence
  chemically synthesized
cactctacatggatttctctat

SEQ ID NO: 1384980 - DNA, 22 bp, Artificial Sequence
  chemically synthesized
cttcactctacatggatttctc

SEQ ID NO: 1384981 - DNA, 22 bp, Artificial Sequence
  chemically synthesized
ataattacttcactctacatgg

SEQ ID NO: 1384982 - DNA, 22 bp, Artificial Sequence
  chemically synthesized
gataattacttcactctacatg

SEQ ID NO: 1384983 - DNA, 22 bp, Artificial Sequence
  chemically synthesized
atagagaaatccatgtagagtg

SEQ ID NO: 1384984 - DNA, 22 bp, Artificial Sequence
  chemically synthesized
tagagaaatccatgtagagtga

SEQ ID NO: 1384985 - DNA, 22 bp, Artificial Sequence
  chemically synthesized
atatcagtcacaaaataacctt

SEQ ID NO: 1384986 - DNA, 22 bp, Artificial Sequence
  chemically synthesized
aattcatatcagtcacaaaata

SEQ ID NO: 1384987 - DNA, 22 bp, Artificial Sequence
  chemically synthesized
gaattcatatcagtcacaaaat

SEQ ID NO: 1384988 - DNA, 22 bp, Artificial Sequence
  chemically synthesized
tcaaggttattttgtgactgat

SEQ ID NO: 1384989 - DNA, 22 bp, Artificial Sequence
  chemically synthesized
ccccttgaattcatatcagtca

SEQ ID NO: 1384990 - DNA, 22 bp, Artificial Sequence
  chemically synthesized
ttttgtgactgatatgaattca

SEQ ID NO: 1384991 - DNA, 22 bp, Artificial Sequence
  chemically synthesized
taaactgccccttgaattcata

SEQ ID NO: 1384992 - DNA, 22 bp, Artificial Sequence
  chemically synthesized
tgtgactgatatgaattcaagg

SEQ ID NO: 1384993 - DNA, 22 bp, Artificial Sequence
  chemically synthesized
gtgactgatatgaattcaaggg

SEQ ID NO: 1384994 - DNA, 22 bp, Artificial Sequence
  chemically synthesized
tgactgatatgaattcaagggg

SEQ ID NO: 1384995 - DNA, 22 bp, Artificial Sequence
  chemically synthesized
aattataaactgccccttgaat

SEQ ID NO: 1384996 - DNA, 22 bp, Artificial Sequence
  chemically synthesized
atatgaattcaaggggcagttt

SEQ ID NO: 1384997 - DNA, 22 bp, Artificial Sequence
  chemically synthesized
acatgtgactgaattataaact

SEQ ID NO: 1384998 - DNA, 22 bp, Artificial Sequence
  chemically synthesized
aacatgtgactgaattataaac

SEQ ID NO: 1384999 - DNA, 22 bp, Artificial Sequence
  chemically synthesized
taacatgtgactgaattataaa

SEQ ID NO: 1385000 - DNA, 22 bp, Artificial Sequence
  chemically synthesized
tttaacatgtgactgaattata

SEQ ID NO: 1385001 - DNA, 22 bp, Artificial Sequence
  chemically synthesized
aaggggcagtttataattcagt

SEQ ID NO: 1385002 - DNA, 22 bp, Artificial Sequence
  chemically synthesized
ttctttaacatgtgactgaatt

SEQ ID NO: 1385003 - DNA, 22 bp, Artificial Sequence
  chemically synthesized
gttctttaacatgtgactgaat

SEQ ID NO: 1385004 - DNA, 22 bp, Artificial Sequence
  chemically synthesized
tgttctttaacatgtgactgaa

SEQ ID NO: 1385005 - DNA, 22 bp, Artificial Sequence
  chemically synthesized
ttgttctttaacatgtgactga

SEQ ID NO: 1385006 - DNA, 22 bp, Artificial Sequence
  chemically synthesized
tttgttctttaacatgtgactg

SEQ ID NO: 1385007 - DNA, 22 bp, Artificial Sequence
  chemically synthesized
ataattcagtcacatgttaaag

SEQ ID NO: 1385008 - DNA, 22 bp, Artificial Sequence
  chemically synthesized
gtcctttttgttctttaacatg

SEQ ID NO: 1385009 - DNA, 22 bp, Artificial Sequence
  chemically synthesized
taattcagtcacatgttaaaga

SEQ ID NO: 1385010 - DNA, 22 bp, Artificial Sequence
  chemically synthesized
cgtcctttttgttctttaacat

SEQ ID NO: 1385011 - DNA, 22 bp, Artificial Sequence
  chemically synthesized
tcgtcctttttgttctttaaca

SEQ ID NO: 1385012 - DNA, 22 bp, Artificial Sequence
  chemically synthesized
tttcgtcctttttgttctttaa

SEQ ID NO: 1385013 - DNA, 22 bp, Artificial Sequence
  chemically synthesized
ctttcgtcctttttgttcttta

SEQ ID NO: 1385014 - DNA, 22 bp, Artificial Sequence
  chemically synthesized
agtcacatgttaaagaacaaaa

SEQ ID NO: 1385015 - DNA, 22 bp, Artificial Sequence
  chemically synthesized
ttctttcgtcctttttgttctt

SEQ ID NO: 1385016 - DNA, 22 bp, Artificial Sequence
  chemically synthesized
ttcttctttcgtcctttttgtt

SEQ ID NO: 1385017 - DNA, 22 bp, Artificial Sequence
  chemically synthesized
attcttctttcgtcctttttgt

SEQ ID NO: 1385018 - DNA, 22 bp, Artificial Sequence
  chemically synthesized
tattcttctttcgtcctttttg

SEQ ID NO: 1385019 - DNA, 22 bp, Artificial Sequence
  chemically synthesized
ctttattcttctttcgtccttt

SEQ ID NO: 1385020 - DNA, 22 bp, Artificial Sequence
  chemically synthesized
aagaacaaaaaggacgaaagaa

SEQ ID NO: 1385021 - DNA, 22 bp, Artificial Sequence
  chemically synthesized
tctgctttattcttctttcgtc

SEQ ID NO: 1385022 - DNA, 22 bp, Artificial Sequence
  chemically synthesized
tatctgctttattcttctttcg

SEQ ID NO: 1385023 - DNA, 22 bp, Artificial Sequence
  chemically synthesized
acgattctatctgctttattct

SEQ ID NO: 1385024 - DNA, 22 bp, Artificial Sequence
  chemically synthesized
cacgattctatctgctttattc

SEQ ID NO: 1385025 - DNA, 22 bp, Artificial Sequence
  chemically synthesized
tggtgcaaataatgtaacccat

SEQ ID NO: 1385026 - DNA, 22 bp, Artificial Sequence
  chemically synthesized
atggtgcaaataatgtaaccca

SEQ ID NO: 1385027 - DNA, 22 bp, Artificial Sequence
  chemically synthesized
tatggtgcaaataatgtaaccc

SEQ ID NO: 1385028 - DNA, 22 bp, Artificial Sequence
  chemically synthesized
aactttatggtgcaaataatgt

SEQ ID NO: 1385029 - DNA, 22 bp, Artificial Sequence
  chemically synthesized
aaactttatggtgcaaataatg

SEQ ID NO: 1385030 - DNA, 22 bp, Artificial Sequence
  chemically synthesized
cttaaactttatggtgcaaata

SEQ ID NO: 1385031 - DNA, 22 bp, Artificial Sequence
  chemically synthesized
acttaaactttatggtgcaaat

SEQ ID NO: 1385032 - DNA, 22 bp, Artificial Sequence
  chemically synthesized
atttacttaaactttatggtgc

SEQ ID NO: 1385033 - DNA, 22 bp, Artificial Sequence
  chemically synthesized
gatttacttaaactttatggtg

SEQ ID NO: 1385034 - DNA, 22 bp, Artificial Sequence
  chemically synthesized
cattatttgcaccataaagttt

SEQ ID NO: 1385035 - DNA, 22 bp, Artificial Sequence
  chemically synthesized
tttgcaccataaagtttaagta

SEQ ID NO: 1385036 - DNA, 22 bp, Artificial Sequence
  chemically synthesized
ccaataatttgatttacttaaa

SEQ ID NO: 1385037 - DNA, 22 bp, Artificial Sequence
  chemically synthesized
gcaccataaagtttaagtaaat

SEQ ID NO: 1385038 - DNA, 22 bp, Artificial Sequence
  chemically synthesized
caccataaagtttaagtaaatc

SEQ ID NO: 1385039 - DNA, 22 bp, Artificial Sequence
  chemically synthesized
agaatattcccaataatttgat

SEQ ID NO: 1385040 - DNA, 22 bp, Artificial Sequence
  chemically synthesized
tctcagaatattcccaataatt

SEQ ID NO: 1385041 - DNA, 22 bp, Artificial Sequence
  chemically synthesized
aagtaaatcaaattattgggaa

SEQ ID NO: 1385042 - DNA, 22 bp, Artificial Sequence
  chemically synthesized
tatctcagaatattcccaataa

SEQ ID NO: 1385043 - DNA, 22 bp, Artificial Sequence
  chemically synthesized
agtaaatcaaattattgggaat

SEQ ID NO: 1385044 - DNA, 22 bp, Artificial Sequence
  chemically synthesized
gctctatctcagaatattccca

SEQ ID NO: 1385045 - DNA, 22 bp, Artificial Sequence
  chemically synthesized
agctctatctcagaatattccc

SEQ ID NO: 1385046 - DNA, 22 bp, Artificial Sequence
  chemically synthesized
tagctctatctcagaatattcc

SEQ ID NO: 1385047 - DNA, 22 bp, Artificial Sequence
  chemically synthesized
ttgggaatattctgagatagag

SEQ ID NO: 1385048 - DNA, 22 bp, Artificial Sequence
  chemically synthesized
agaaagactttagctctatctc

SEQ ID NO: 1385049 - DNA, 22 bp, Artificial Sequence
  chemically synthesized
gagaaagactttagctctatct

SEQ ID NO: 1385050 - DNA, 22 bp, Artificial Sequence
  chemically synthesized
ggaatattctgagatagagcta

SEQ ID NO: 1385051 - DNA, 22 bp, Artificial Sequence
  chemically synthesized
ttgagaaagactttagctctat

SEQ ID NO: 1385052 - DNA, 22 bp, Artificial Sequence
  chemically synthesized
tgagatagagctaaagtctttc

SEQ ID NO: 1385053 - DNA, 22 bp, Artificial Sequence
  chemically synthesized
agatagagctaaagtctttctc

SEQ ID NO: 1385054 - DNA, 22 bp, Artificial Sequence
  chemically synthesized
aaccatgactcttgagaaagac

SEQ ID NO: 1385055 - DNA, 22 bp, Artificial Sequence
  chemically synthesized
caaccatgactcttgagaaaga

SEQ ID NO: 1385056 - DNA, 22 bp, Artificial Sequence
  chemically synthesized
aagtctttctcaagagtcatgg

SEQ ID NO: 1385057 - DNA, 22 bp, Artificial Sequence
  chemically synthesized
cacaacatgtggtttcaaccat

SEQ ID NO: 1385058 - DNA, 22 bp, Artificial Sequence
  chemically synthesized
tctcaagagtcatggttgaaac

SEQ ID NO: 1385059 - DNA, 22 bp, Artificial Sequence
  chemically synthesized
ctcaagagtcatggttgaaacc

SEQ ID NO: 1385060 - DNA, 22 bp, Artificial Sequence
  chemically synthesized
tcaagagtcatggttgaaacca

SEQ ID NO: 1385061 - DNA, 22 bp, Artificial Sequence
  chemically synthesized
ctccacaacatgtggtttcaac

SEQ ID NO: 1385062 - DNA, 22 bp, Artificial Sequence
  chemically synthesized
aagagtcatggttgaaaccaca

SEQ ID NO: 1385063 - DNA, 22 bp, Artificial Sequence
  chemically synthesized
aaaccacatgttgtggaggaac

SEQ ID NO: 1385064 - DNA, 22 bp, Artificial Sequence
  chemically synthesized
tggaggaactgatggtgattgt

SEQ ID NO: 1385065 - DNA, 22 bp, Artificial Sequence
  chemically synthesized
atggtgattgttgccccattgt

SEQ ID NO: 1385066 - DNA, 22 bp, Artificial Sequence
  chemically synthesized
ccatagggaggaatcccacaat

SEQ ID NO: 1385067 - DNA, 22 bp, Artificial Sequence
  chemically synthesized
ttgccccattgtgggattcctc

SEQ ID NO: 1385068 - DNA, 22 bp, Artificial Sequence
  chemically synthesized
ccccattgtgggattcctccct

SEQ ID NO: 1385069 - DNA, 22 bp, Artificial Sequence
  chemically synthesized
atgtcattaccatagggaggaa

SEQ ID NO: 1385070 - DNA, 22 bp, Artificial Sequence
  chemically synthesized
gatgtcattaccatagggagga

SEQ ID NO: 1385071 - DNA, 22 bp, Artificial Sequence
  chemically synthesized
tgatgtcattaccatagggagg

SEQ ID NO: 1385072 - DNA, 22 bp, Artificial Sequence
  chemically synthesized
attttgatgtcattaccatagg

SEQ ID NO: 1385073 - DNA, 22 bp, Artificial Sequence
  chemically synthesized
tgggattcctccctatggtaat

SEQ ID NO: 1385074 - DNA, 22 bp, Artificial Sequence
  chemically synthesized
cattttgatgtcattaccatag

SEQ ID NO: 1385075 - DNA, 22 bp, Artificial Sequence
  chemically synthesized
tcattttgatgtcattaccata

SEQ ID NO: 1385076 - DNA, 22 bp, Artificial Sequence
  chemically synthesized
ttcattttgatgtcattaccat

SEQ ID NO: 1385077 - DNA, 22 bp, Artificial Sequence
  chemically synthesized
tttcattttgatgtcattacca

SEQ ID NO: 1385078 - DNA, 22 bp, Artificial Sequence
  chemically synthesized
ttttcattttgatgtcattacc

SEQ ID NO: 1385079 - DNA, 22 bp, Artificial Sequence
  chemically synthesized
tttttcattttgatgtcattac

SEQ ID NO: 1385080 - DNA, 22 bp, Artificial Sequence
  chemically synthesized
ttttttcattttgatgtcatta

SEQ ID NO: 1385081 - DNA, 22 bp, Artificial Sequence
  chemically synthesized
tttttttcattttgatgtcatt

SEQ ID NO: 1385082 - DNA, 22 bp, Artificial Sequence
  chemically synthesized
ctccctatggtaatgacatcaa

SEQ ID NO: 1385083 - DNA, 22 bp, Artificial Sequence
  chemically synthesized
ttttttttcattttgatgtcat

SEQ ID NO: 1385084 - DNA, 22 bp, Artificial Sequence
  chemically synthesized
tttttttttcattttgatgtca

SEQ ID NO: 1385085 - DNA, 22 bp, Artificial Sequence
  chemically synthesized
ttttttttttcattttgatgtc

SEQ ID NO: 1385086 - DNA, 22 bp, Artificial Sequence
  chemically synthesized
cctatggtaatgacatcaaaat

SEQ ID NO: 1385087 - DNA, 22 bp, Artificial Sequence
  chemically synthesized
tttttttttttcattttgatgt

SEQ ID NO: 1385088 - DNA, 22 bp, Artificial Sequence
  chemically synthesized
tggtaatgacatcaaaatgaaa

SEQ ID NO: 1385089 - DNA, 22 bp, Artificial Sequence
  chemically synthesized
tgtgtgtgtgtttttttttttt

SEQ ID NO: 1385090 - DNA, 22 bp, Artificial Sequence
  chemically synthesized
gtgtgtgtgtgttttttttttt

SEQ ID NO: 1385091 - DNA, 22 bp, Artificial Sequence
  chemically synthesized
ttgtgtgtgtgtgttttttttt

SEQ ID NO: 1385092 - DNA, 22 bp, Artificial Sequence
  chemically synthesized
cttgtgtgtgtgtgtttttttt

SEQ ID NO: 1385093 - DNA, 22 bp, Artificial Sequence
  chemically synthesized
tcttgtgtgtgtgtgttttttt

SEQ ID NO: 1385094 - DNA, 22 bp, Artificial Sequence
  chemically synthesized
cgtcattttcttgtgtgtgtgt

SEQ ID NO: 1385095 - DNA, 22 bp, Artificial Sequence
  chemically synthesized
caatctgcgtcattttcttgtg

SEQ ID NO: 1385096 - DNA, 22 bp, Artificial Sequence
  chemically synthesized
attacaatctgcgtcattttct

SEQ ID NO: 1385097 - DNA, 22 bp, Artificial Sequence
  chemically synthesized
taattacaatctgcgtcatttt

SEQ ID NO: 1385098 - DNA, 22 bp, Artificial Sequence
  chemically synthesized
cacctctaattacaatctgcgt

SEQ ID NO: 1385099 - DNA, 22 bp, Artificial Sequence
  chemically synthesized
taattagaggtggagctgttta

SEQ ID NO: 1385100 - DNA, 22 bp, Artificial Sequence
  chemically synthesized
gaggtggagctgtttatgatct

SEQ ID NO: 1385101 - DNA, 22 bp, Artificial Sequence
  chemically synthesized
ccagaacaatgtggagataacc

SEQ ID NO: 1385102 - DNA, 22 bp, Artificial Sequence
  chemically synthesized
cccagaacaatgtggagataac

SEQ ID NO: 1385103 - DNA, 22 bp, Artificial Sequence
  chemically synthesized
tttatgatctggttatctccac

SEQ ID NO: 1385104 - DNA, 22 bp, Artificial Sequence
  chemically synthesized
tcccagaacaatgtggagataa

SEQ ID NO: 1385105 - DNA, 22 bp, Artificial Sequence
  chemically synthesized
tttcccagaacaatgtggagat

SEQ ID NO: 1385106 - DNA, 22 bp, Artificial Sequence
  chemically synthesized
atgatctggttatctccacatt

SEQ ID NO: 1385107 - DNA, 22 bp, Artificial Sequence
  chemically synthesized
tgatctggttatctccacattg

SEQ ID NO: 1385108 - DNA, 22 bp, Artificial Sequence
  chemically synthesized
aattctttcccagaacaatgtg

SEQ ID NO: 1385109 - DNA, 22 bp, Artificial Sequence
  chemically synthesized
gttatctccacattgttctggg

SEQ ID NO: 1385110 - DNA, 22 bp, Artificial Sequence
  chemically synthesized
tctccacattgttctgggaaag

SEQ ID NO: 1385111 - DNA, 22 bp, Artificial Sequence
  chemically synthesized
cacattgttctgggaaagaatt

SEQ ID NO: 1385112 - DNA, 22 bp, Artificial Sequence
  chemically synthesized
acccagtaatgtctcaattctt

SEQ ID NO: 1385113 - DNA, 22 bp, Artificial Sequence
  chemically synthesized
gacccagtaatgtctcaattct

SEQ ID NO: 1385114 - DNA, 22 bp, Artificial Sequence
  chemically synthesized
ttctgggaaagaattgagacat

SEQ ID NO: 1385115 - DNA, 22 bp, Artificial Sequence
  chemically synthesized
tgggaaagaattgagacattac

SEQ ID NO: 1385116 - DNA, 22 bp, Artificial Sequence
  chemically synthesized
ggaaagaattgagacattactg

SEQ ID NO: 1385117 - DNA, 22 bp, Artificial Sequence
  chemically synthesized
acagacatgatttgacccagta

SEQ ID NO: 1385118 - DNA, 22 bp, Artificial Sequence
  chemically synthesized
tctcacagacatgatttgaccc

SEQ ID NO: 1385119 - DNA, 22 bp, Artificial Sequence
  chemically synthesized
gtctcacagacatgatttgacc

SEQ ID NO: 1385120 - DNA, 22 bp, Artificial Sequence
  chemically synthesized
agacattactgggtcaaatcat

SEQ ID NO: 1385121 - DNA, 22 bp, Artificial Sequence
  chemically synthesized
tgtctcacagacatgatttgac

SEQ ID NO: 1385122 - DNA, 22 bp, Artificial Sequence
  chemically synthesized
attttgtctcacagacatgatt

SEQ ID NO: 1385123 - DNA, 22 bp, Artificial Sequence
  chemically synthesized
cattttgtctcacagacatgat

SEQ ID NO: 1385124 - DNA, 22 bp, Artificial Sequence
  chemically synthesized
tcattttgtctcacagacatga

SEQ ID NO: 1385125 - DNA, 22 bp, Artificial Sequence
  chemically synthesized
ctgggtcaaatcatgtctgtga

SEQ ID NO: 1385126 - DNA, 22 bp, Artificial Sequence
  chemically synthesized
cctttcattttgtctcacagac

SEQ ID NO: 1385127 - DNA, 22 bp, Artificial Sequence
  chemically synthesized
ggtcaaatcatgtctgtgagac

SEQ ID NO: 1385128 - DNA, 22 bp, Artificial Sequence
  chemically synthesized
acctttcattttgtctcacaga

SEQ ID NO: 1385129 - DNA, 22 bp, Artificial Sequence
  chemically synthesized
tacctttcattttgtctcacag

SEQ ID NO: 1385130 - DNA, 22 bp, Artificial Sequence
  chemically synthesized
ttacctttcattttgtctcaca

SEQ ID NO: 1385131 - DNA, 22 bp, Artificial Sequence
  chemically synthesized
tttttacctttcattttgtctc

SEQ ID NO: 1385132 - DNA, 22 bp, Artificial Sequence
  chemically synthesized
actatttttacctttcattttg

SEQ ID NO: 1385133 - DNA, 22 bp, Artificial Sequence
  chemically synthesized
ttcactatttttacctttcatt

SEQ ID NO: 1385134 - DNA, 22 bp, Artificial Sequence
  chemically synthesized
attcactatttttacctttcat

SEQ ID NO: 1385135 - DNA, 22 bp, Artificial Sequence
  chemically synthesized
tattcactatttttacctttca

SEQ ID NO: 1385136 - DNA, 22 bp, Artificial Sequence
  chemically synthesized
ttattcactatttttacctttc

SEQ ID NO: 1385137 - DNA, 22 bp, Artificial Sequence
  chemically synthesized
tgagacaaaatgaaaggtaaaa

SEQ ID NO: 1385138 - DNA, 22 bp, Artificial Sequence
  chemically synthesized
tttattcactatttttaccttt

SEQ ID NO: 1385139 - DNA, 22 bp, Artificial Sequence
  chemically synthesized
tttttattcactatttttacct

SEQ ID NO: 1385140 - DNA, 22 bp, Artificial Sequence
  chemically synthesized
tctttttattcactatttttac

SEQ ID NO: 1385141 - DNA, 22 bp, Artificial Sequence
  chemically synthesized
ctctttttattcactattttta

SEQ ID NO: 1385142 - DNA, 22 bp, Artificial Sequence
  chemically synthesized
tctctttttattcactattttt

SEQ ID NO: 1385143 - DNA, 22 bp, Artificial Sequence
  chemically synthesized
atctttctctttttattcacta

SEQ ID NO: 1385144 - DNA, 22 bp, Artificial Sequence
  chemically synthesized
taatctttctctttttattcac

SEQ ID NO: 1385145 - DNA, 22 bp, Artificial Sequence
  chemically synthesized
ctaatctttctctttttattca

SEQ ID NO: 1385146 - DNA, 22 bp, Artificial Sequence
  chemically synthesized
tttctaatctttctctttttat

SEQ ID NO: 1385147 - DNA, 22 bp, Artificial Sequence
  chemically synthesized
gtttctaatctttctcttttta

SEQ ID NO: 1385148 - DNA, 22 bp, Artificial Sequence
  chemically synthesized
aagcttgtttctaatctttctc

SEQ ID NO: 1385149 - DNA, 22 bp, Artificial Sequence
  chemically synthesized
gaaacaagctttagtcacttgc

SEQ ID NO: 1385150 - DNA, 22 bp, Artificial Sequence
  chemically synthesized
ccgcaaggaagagcaagtgact

SEQ ID NO: 1385151 - DNA, 22 bp, Artificial Sequence
  chemically synthesized
caagggcctaccgcaaggaaga

SEQ ID NO: 1385152 - DNA, 22 bp, Artificial Sequence
  chemically synthesized
tagtcacttgctcttccttgcg

SEQ ID NO: 1385153 - DNA, 22 bp, Artificial Sequence
  chemically synthesized
agtcacttgctcttccttgcgg

SEQ ID NO: 1385154 - DNA, 22 bp, Artificial Sequence
  chemically synthesized
gtcacttgctcttccttgcggt

SEQ ID NO: 1385155 - DNA, 22 bp, Artificial Sequence
  chemically synthesized
tcaatattccaagggcctaccg

SEQ ID NO: 1385156 - DNA, 22 bp, Artificial Sequence
  chemically synthesized
gctcttccttgcggtaggccct

SEQ ID NO: 1385157 - DNA, 22 bp, Artificial Sequence
  chemically synthesized
gtcaatattccaagggcctacc

SEQ ID NO: 1385158 - DNA, 22 bp, Artificial Sequence
  chemically synthesized
ctcttccttgcggtaggccctt

SEQ ID NO: 1385159 - DNA, 22 bp, Artificial Sequence
  chemically synthesized
ttccttgcggtaggcccttgga

SEQ ID NO: 1385160 - DNA, 22 bp, Artificial Sequence
  chemically synthesized
ccttgcggtaggcccttggaat

SEQ ID NO: 1385161 - DNA, 22 bp, Artificial Sequence
  chemically synthesized
ggatttgtcaatattccaaggg

SEQ ID NO: 1385162 - DNA, 22 bp, Artificial Sequence
  chemically synthesized
cttgcggtaggcccttggaata

SEQ ID NO: 1385163 - DNA, 22 bp, Artificial Sequence
  chemically synthesized
aggatttgtcaatattccaagg

SEQ ID NO: 1385164 - DNA, 22 bp, Artificial Sequence
  chemically synthesized
taggatttgtcaatattccaag

SEQ ID NO: 1385165 - DNA, 22 bp, Artificial Sequence
  chemically synthesized
gcggtaggcccttggaatattg

SEQ ID NO: 1385166 - DNA, 22 bp, Artificial Sequence
  chemically synthesized
cggtaggcccttggaatattga

SEQ ID NO: 1385167 - DNA, 22 bp, Artificial Sequence
  chemically synthesized
ttttaggatttgtcaatattcc

SEQ ID NO: 1385168 - DNA, 22 bp, Artificial Sequence
  chemically synthesized
aattattttaggatttgtcaat

SEQ ID NO: 1385169 - DNA, 22 bp, Artificial Sequence
  chemically synthesized
aaattattttaggatttgtcaa

SEQ ID NO: 1385170 - DNA, 22 bp, Artificial Sequence
  chemically synthesized
taaattattttaggatttgtca

SEQ ID NO: 1385171 - DNA, 22 bp, Artificial Sequence
  chemically synthesized
ttaaattattttaggatttgtc

SEQ ID NO: 1385172 - DNA, 22 bp, Artificial Sequence
  chemically synthesized
tttaaattattttaggatttgt

SEQ ID NO: 1385173 - DNA, 22 bp, Artificial Sequence
  chemically synthesized
ttttaaattattttaggatttg

SEQ ID NO: 1385174 - DNA, 22 bp, Artificial Sequence
  chemically synthesized
tttttaaattattttaggattt

SEQ ID NO: 1385175 - DNA, 22 bp, Artificial Sequence
  chemically synthesized
ggaatattgacaaatcctaaaa

SEQ ID NO: 1385176 - DNA, 22 bp, Artificial Sequence
  chemically synthesized
ttttttaaattattttaggatt

SEQ ID NO: 1385177 - DNA, 22 bp, Artificial Sequence
  chemically synthesized
gaatattgacaaatcctaaaat

SEQ ID NO: 1385178 - DNA, 22 bp, Artificial Sequence
  chemically synthesized
tttttttttaaattattttagg

SEQ ID NO: 1385179 - DNA, 22 bp, Artificial Sequence
  chemically synthesized
acaaatcctaaaataatttaaa

SEQ ID NO: 1385180 - DNA, 22 bp, Artificial Sequence
  chemically synthesized
aaatccactgtttttttttaaa

SEQ ID NO: 1385181 - DNA, 22 bp, Artificial Sequence
  chemically synthesized
aaataatttaaaaaaaaacagt

SEQ ID NO: 1385182 - DNA, 22 bp, Artificial Sequence
  chemically synthesized
atggtgattaaaatccactgtt

SEQ ID NO: 1385183 - DNA, 22 bp, Artificial Sequence
  chemically synthesized
aaaaaaaaacagtggattttaa

SEQ ID NO: 1385184 - DNA, 22 bp, Artificial Sequence
  chemically synthesized
ccctcatggtgattaaaatcca

SEQ ID NO: 1385185 - DNA, 22 bp, Artificial Sequence
  chemically synthesized
aaaaaaaacagtggattttaat

SEQ ID NO: 1385186 - DNA, 22 bp, Artificial Sequence
  chemically synthesized
accctcatggtgattaaaatcc

SEQ ID NO: 1385187 - DNA, 22 bp, Artificial Sequence
  chemically synthesized
taccctcatggtgattaaaatc

SEQ ID NO: 1385188 - DNA, 22 bp, Artificial Sequence
  chemically synthesized
ttaccctcatggtgattaaaat

SEQ ID NO: 1385189 - DNA, 22 bp, Artificial Sequence
  chemically synthesized
tttttaccctcatggtgattaa

SEQ ID NO: 1385190 - DNA, 22 bp, Artificial Sequence
  chemically synthesized
taatcaccatgagggtaaaaat

SEQ ID NO: 1385191 - DNA, 22 bp, Artificial Sequence
  chemically synthesized
aatcaccatgagggtaaaaata

SEQ ID NO: 1385192 - DNA, 22 bp, Artificial Sequence
  chemically synthesized
atcaccatgagggtaaaaatag

SEQ ID NO: 1385193 - DNA, 22 bp, Artificial Sequence
  chemically synthesized
gaaatacagtggtaaacaagac

SEQ ID NO: 1385194 - DNA, 22 bp, Artificial Sequence
  chemically synthesized
tgtgttggaaatacagtggtaa

SEQ ID NO: 1385195 - DNA, 22 bp, Artificial Sequence
  chemically synthesized
gtttaccactgtatttccaaca

SEQ ID NO: 1385196 - DNA, 22 bp, Artificial Sequence
  chemically synthesized
tttaccactgtatttccaacac

SEQ ID NO: 1385197 - DNA, 22 bp, Artificial Sequence
  chemically synthesized
accactgtatttccaacacata

SEQ ID NO: 1385198 - DNA, 22 bp, Artificial Sequence
  chemically synthesized
ccactgtatttccaacacatag

SEQ ID NO: 1385199 - DNA, 22 bp, Artificial Sequence
  chemically synthesized
tatttccaacacatagcgtggt

SEQ ID NO: 1385200 - DNA, 22 bp, Artificial Sequence
  chemically synthesized
gggagggtcagataccacgcta

SEQ ID NO: 1385201 - DNA, 22 bp, Artificial Sequence
  chemically synthesized
agggagggtcagataccacgct

SEQ ID NO: 1385202 - DNA, 22 bp, Artificial Sequence
  chemically synthesized
ccaacacatagcgtggtatctg

SEQ ID NO: 1385203 - DNA, 22 bp, Artificial Sequence
  chemically synthesized
tttagggagggtcagataccac

SEQ ID NO: 1385204 - DNA, 22 bp, Artificial Sequence
  chemically synthesized
caacacatagcgtggtatctga

SEQ ID NO: 1385205 - DNA, 22 bp, Artificial Sequence
  chemically synthesized
aataattatttagggagggtca

SEQ ID NO: 1385206 - DNA, 22 bp, Artificial Sequence
  chemically synthesized
accctccctaaataattattga

SEQ ID NO: 1385207 - DNA, 22 bp, Artificial Sequence
  chemically synthesized
cctaaataattattgaattatt

SEQ ID NO: 1385208 - DNA, 22 bp, Artificial Sequence
  chemically synthesized
aaatgtgcaatcaataattcaa

SEQ ID NO: 1385209 - DNA, 22 bp, Artificial Sequence
  chemically synthesized
aataattattgaattattgatt

SEQ ID NO: 1385210 - DNA, 22 bp, Artificial Sequence
  chemically synthesized
ttgaattattgattgcacattt

SEQ ID NO: 1385211 - DNA, 22 bp, Artificial Sequence
  chemically synthesized
atatagtagtctaaaatgtgca

SEQ ID NO: 1385212 - DNA, 22 bp, Artificial Sequence
  chemically synthesized
aattattgattgcacattttag

SEQ ID NO: 1385213 - DNA, 22 bp, Artificial Sequence
  chemically synthesized
ttgattgcacattttagactac

SEQ ID NO: 1385214 - DNA, 22 bp, Artificial Sequence
  chemically synthesized
attgcacattttagactactat

SEQ ID NO: 1385215 - DNA, 22 bp, Artificial Sequence
  chemically synthesized
cacattttagactactatatta

SEQ ID NO: 1385216 - DNA, 22 bp, Artificial Sequence
  chemically synthesized
gaggtgggatatgctaatatag

SEQ ID NO: 1385217 - DNA, 22 bp, Artificial Sequence
  chemically synthesized
agaggtgggatatgctaatata

SEQ ID NO: 1385218 - DNA, 22 bp, Artificial Sequence
  chemically synthesized
tagactactatattagcatatc

SEQ ID NO: 1385219 - DNA, 22 bp, Artificial Sequence
  chemically synthesized
agactactatattagcatatcc

SEQ ID NO: 1385220 - DNA, 22 bp, Artificial Sequence
  chemically synthesized
gactactatattagcatatccc

SEQ ID NO: 1385221 - DNA, 22 bp, Artificial Sequence
  chemically synthesized
ctatattagcatatcccacctc

SEQ ID NO: 1385222 - DNA, 22 bp, Artificial Sequence
  chemically synthesized
agggtaatgcttagaggtggga

SEQ ID NO: 1385223 - DNA, 22 bp, Artificial Sequence
  chemically synthesized
tattagcatatcccacctctaa

SEQ ID NO: 1385224 - DNA, 22 bp, Artificial Sequence
  chemically synthesized
catctcagggtaatgcttagag

SEQ ID NO: 1385225 - DNA, 22 bp, Artificial Sequence
  chemically synthesized
gcatatcccacctctaagcatt

SEQ ID NO: 1385226 - DNA, 22 bp, Artificial Sequence
  chemically synthesized
cacagttacatctcagggtaat

SEQ ID NO: 1385227 - DNA, 22 bp, Artificial Sequence
  chemically synthesized
tattgcacagttacatctcagg

SEQ ID NO: 1385228 - DNA, 22 bp, Artificial Sequence
  chemically synthesized
taagcattaccctgagatgtaa

SEQ ID NO: 1385229 - DNA, 22 bp, Artificial Sequence
  chemically synthesized
ctgtattgcacagttacatctc

SEQ ID NO: 1385230 - DNA, 22 bp, Artificial Sequence
  chemically synthesized
agcattaccctgagatgtaact

SEQ ID NO: 1385231 - DNA, 22 bp, Artificial Sequence
  chemically synthesized
ttgctgtattgcacagttacat

SEQ ID NO: 1385232 - DNA, 22 bp, Artificial Sequence
  chemically synthesized
attgctgtattgcacagttaca

SEQ ID NO: 1385233 - DNA, 22 bp, Artificial Sequence
  chemically synthesized
tattgctgtattgcacagttac

SEQ ID NO: 1385234 - DNA, 22 bp, Artificial Sequence
  chemically synthesized
ccctgagatgtaactgtgcaat

SEQ ID NO: 1385235 - DNA, 22 bp, Artificial Sequence
  chemically synthesized
agatgtaactgtgcaatacagc

SEQ ID NO: 1385236 - DNA, 22 bp, Artificial Sequence
  chemically synthesized
tgcaatacagcaataaagggtg

SEQ ID NO: 1385237 - DNA, 22 bp, Artificial Sequence
  chemically synthesized
aggacacagtgacaccctttat

SEQ ID NO: 1385238 - DNA, 22 bp, Artificial Sequence
  chemically synthesized
gactgaggacacagtgacaccc

SEQ ID NO: 1385239 - DNA, 22 bp, Artificial Sequence
  chemically synthesized
ggcctggactgaggacacagtg

SEQ ID NO: 1385240 - DNA, 22 bp, Artificial Sequence
  chemically synthesized
tgtgttaggcctggactgagga

SEQ ID NO: 1385241 - DNA, 22 bp, Artificial Sequence
  chemically synthesized
aactgtgtgttaggcctggact

SEQ ID NO: 1385242 - DNA, 22 bp, Artificial Sequence
  chemically synthesized
tgtcctcagtccaggcctaaca

SEQ ID NO: 1385243 - DNA, 22 bp, Artificial Sequence
  chemically synthesized
agagctcaactgtgtgttaggc

SEQ ID NO: 1385244 - DNA, 22 bp, Artificial Sequence
  chemically synthesized
ttcagagctcaactgtgtgtta

SEQ ID NO: 1385245 - DNA, 22 bp, Artificial Sequence
  chemically synthesized
agtccaggcctaacacacagtt

SEQ ID NO: 1385246 - DNA, 22 bp, Artificial Sequence
  chemically synthesized
ttgttcagagctcaactgtgtg

SEQ ID NO: 1385247 - DNA, 22 bp, Artificial Sequence
  chemically synthesized
cattgttgttcagagctcaact

SEQ ID NO: 1385248 - DNA, 22 bp, Artificial Sequence
  chemically synthesized
acacacagttgagctctgaaca

SEQ ID NO: 1385249 - DNA, 22 bp, Artificial Sequence
  chemically synthesized
atgttacattgttgttcagagc

SEQ ID NO: 1385250 - DNA, 22 bp, Artificial Sequence
  chemically synthesized
gatgttacattgttgttcagag

SEQ ID NO: 1385251 - DNA, 22 bp, Artificial Sequence
  chemically synthesized
tttgatgttacattgttgttca

SEQ ID NO: 1385252 - DNA, 22 bp, Artificial Sequence
  chemically synthesized
agctctgaacaacaatgtaaca

SEQ ID NO: 1385253 - DNA, 22 bp, Artificial Sequence
  chemically synthesized
tgaacaacaatgtaacatcaaa

SEQ ID NO: 1385254 - DNA, 22 bp, Artificial Sequence
  chemically synthesized
aacaacaatgtaacatcaaaca

SEQ ID NO: 1385255 - DNA, 22 bp, Artificial Sequence
  chemically synthesized
caacagggtcactgtttgatgt

SEQ ID NO: 1385256 - DNA, 22 bp, Artificial Sequence
  chemically synthesized
gacaagtccagaacatgttaca

SEQ ID NO: 1385257 - DNA, 22 bp, Artificial Sequence
  chemically synthesized
agacaagtccagaacatgttac

SEQ ID NO: 1385258 - DNA, 22 bp, Artificial Sequence
  chemically synthesized
gcttagacaagtccagaacatg

SEQ ID NO: 1385259 - DNA, 22 bp, Artificial Sequence
  chemically synthesized
agcttagacaagtccagaacat

SEQ ID NO: 1385260 - DNA, 22 bp, Artificial Sequence
  chemically synthesized
tagcttagacaagtccagaaca

SEQ ID NO: 1385261 - DNA, 22 bp, Artificial Sequence
  chemically synthesized
ttgtaacatgttctggacttgt

SEQ ID NO: 1385262 - DNA, 22 bp, Artificial Sequence
  chemically synthesized
aactttagcttagacaagtcca

SEQ ID NO: 1385263 - DNA, 22 bp, Artificial Sequence
  chemically synthesized
gaactttagcttagacaagtcc

SEQ ID NO: 1385264 - DNA, 22 bp, Artificial Sequence
  chemically synthesized
taacatgttctggacttgtcta

SEQ ID NO: 1385265 - DNA, 22 bp, Artificial Sequence
  chemically synthesized
tggacttgtctaagctaaagtt

SEQ ID NO: 1385266 - DNA, 22 bp, Artificial Sequence
  chemically synthesized
gacttgtctaagctaaagttca

SEQ ID NO: 1385267 - DNA, 22 bp, Artificial Sequence
  chemically synthesized
gaagtatcatatttgaacttta

SEQ ID NO: 1385268 - DNA, 22 bp, Artificial Sequence
  chemically synthesized
gtctaagctaaagttcaaatat

SEQ ID NO: 1385269 - DNA, 22 bp, Artificial Sequence
  chemically synthesized
tctaagctaaagttcaaatatg

SEQ ID NO: 1385270 - DNA, 22 bp, Artificial Sequence
  chemically synthesized
agctaaagttcaaatatgatac

SEQ ID NO: 1385271 - DNA, 22 bp, Artificial Sequence
  chemically synthesized
taaccagggttggaagtatcat

SEQ ID NO: 1385272 - DNA, 22 bp, Artificial Sequence
  chemically synthesized
aagttcaaatatgatacttcca

SEQ ID NO: 1385273 - DNA, 22 bp, Artificial Sequence
  chemically synthesized
aaatatgatacttccaaccctg

SEQ ID NO: 1385274 - DNA, 22 bp, Artificial Sequence
  chemically synthesized
agagattataaccagggttgga

SEQ ID NO: 1385275 - DNA, 22 bp, Artificial Sequence
  chemically synthesized
ccaaccctggttataatctctg

SEQ ID NO: 1385276 - DNA, 22 bp, Artificial Sequence
  chemically synthesized
caaccctggttataatctctga

SEQ ID NO: 1385277 - DNA, 22 bp, Artificial Sequence
  chemically synthesized
tgtataaaatgcatcattcaga

SEQ ID NO: 1385278 - DNA, 22 bp, Artificial Sequence
  chemically synthesized
gttataatctctgaatgatgca

SEQ ID NO: 1385279 - DNA, 22 bp, Artificial Sequence
  chemically synthesized
ctatgtataaaatgcatcattc

SEQ ID NO: 1385280 - DNA, 22 bp, Artificial Sequence
  chemically synthesized
taatctctgaatgatgcatttt

SEQ ID NO: 1385281 - DNA, 22 bp, Artificial Sequence
  chemically synthesized
tgaatgatgcattttatacata

SEQ ID NO: 1385282 - DNA, 22 bp, Artificial Sequence
  chemically synthesized
aatgatgcattttatacatagc

SEQ ID NO: 1385283 - DNA, 22 bp, Artificial Sequence
  chemically synthesized
aaaaataaaaaagtcattgcta

SEQ ID NO: 1385284 - DNA, 22 bp, Artificial Sequence
  chemically synthesized
aaaaaataaaaaagtcattgct

SEQ ID NO: 1385285 - DNA, 22 bp, Artificial Sequence
  chemically synthesized
taaaaaataaaaaagtcattgc

SEQ ID NO: 1385286 - DNA, 22 bp, Artificial Sequence
  chemically synthesized
ttaaaaaataaaaaagtcattg

SEQ ID NO: 1385287 - DNA, 22 bp, Artificial Sequence
  chemically synthesized
tttaaaaaataaaaaagtcatt

SEQ ID NO: 1385288 - DNA, 22 bp, Artificial Sequence
  chemically synthesized
ttttaaaaaataaaaaagtcat

SEQ ID NO: 1385289 - DNA, 22 bp, Artificial Sequence
  chemically synthesized
tatacatagcaatgactttttt

SEQ ID NO: 1385290 - DNA, 22 bp, Artificial Sequence
  chemically synthesized
atacatagcaatgactttttta

SEQ ID NO: 1385291 - DNA, 22 bp, Artificial Sequence
  chemically synthesized
ttttttaaaaaataaaaaagtc

SEQ ID NO: 1385292 - DNA, 22 bp, Artificial Sequence
  chemically synthesized
tacatagcaatgacttttttat

SEQ ID NO: 1385293 - DNA, 22 bp, Artificial Sequence
  chemically synthesized
cttttttaaaaaataaaaaagt

SEQ ID NO: 1385294 - DNA, 22 bp, Artificial Sequence
  chemically synthesized
catggtaaatgcttctttttta

SEQ ID NO: 1385295 - DNA, 22 bp, Artificial Sequence
  chemically synthesized
gcatggtaaatgcttctttttt

SEQ ID NO: 1385296 - DNA, 22 bp, Artificial Sequence
  chemically synthesized
ttttattttttaaaaaagaagc

SEQ ID NO: 1385297 - DNA, 22 bp, Artificial Sequence
  chemically synthesized
tttattttttaaaaaagaagca

SEQ ID NO: 1385298 - DNA, 22 bp, Artificial Sequence
  chemically synthesized
ttgcatggtaaatgcttctttt

SEQ ID NO: 1385299 - DNA, 22 bp, Artificial Sequence
  chemically synthesized
ttattttttaaaaaagaagcat

SEQ ID NO: 1385300 - DNA, 22 bp, Artificial Sequence
  chemically synthesized
cttgcatggtaaatgcttcttt

SEQ ID NO: 1385301 - DNA, 22 bp, Artificial Sequence
  chemically synthesized
tattttttaaaaaagaagcatt

SEQ ID NO: 1385302 - DNA, 22 bp, Artificial Sequence
  chemically synthesized
tcttgcatggtaaatgcttctt

SEQ ID NO: 1385303 - DNA, 22 bp, Artificial Sequence
  chemically synthesized
attttttaaaaaagaagcattt

SEQ ID NO: 1385304 - DNA, 22 bp, Artificial Sequence
  chemically synthesized
ttcttgcatggtaaatgcttct

SEQ ID NO: 1385305 - DNA, 22 bp, Artificial Sequence
  chemically synthesized
ttttttaaaaaagaagcattta

SEQ ID NO: 1385306 - DNA, 22 bp, Artificial Sequence
  chemically synthesized
tttcttgcatggtaaatgcttc

SEQ ID NO: 1385307 - DNA, 22 bp, Artificial Sequence
  chemically synthesized
tttaaaaaagaagcatttacca

SEQ ID NO: 1385308 - DNA, 22 bp, Artificial Sequence
  chemically synthesized
ttaaaaaagaagcatttaccat

SEQ ID NO: 1385309 - DNA, 22 bp, Artificial Sequence
  chemically synthesized
taaaaaagaagcatttaccatg

SEQ ID NO: 1385310 - DNA, 22 bp, Artificial Sequence
  chemically synthesized
tcctttttcttgcatggtaaat

SEQ ID NO: 1385311 - DNA, 22 bp, Artificial Sequence
  chemically synthesized
aaaaaagaagcatttaccatgc

SEQ ID NO: 1385312 - DNA, 22 bp, Artificial Sequence
  chemically synthesized
aaaaagaagcatttaccatgca

SEQ ID NO: 1385313 - DNA, 22 bp, Artificial Sequence
  chemically synthesized
aagcaatgttgtcctttttctt

SEQ ID NO: 1385314 - DNA, 22 bp, Artificial Sequence
  chemically synthesized
gaagcaatgttgtcctttttct

SEQ ID NO: 1385315 - DNA, 22 bp, Artificial Sequence
  chemically synthesized
ttgaagcaatgttgtccttttt

SEQ ID NO: 1385316 - DNA, 22 bp, Artificial Sequence
  chemically synthesized
accatgcaagaaaaaggacaac

SEQ ID NO: 1385317 - DNA, 22 bp, Artificial Sequence
  chemically synthesized
ccatgcaagaaaaaggacaaca

SEQ ID NO: 1385318 - DNA, 22 bp, Artificial Sequence
  chemically synthesized
ttcttgaagcaatgttgtcctt

SEQ ID NO: 1385319 - DNA, 22 bp, Artificial Sequence
  chemically synthesized
ctattcttgaagcaatgttgtc

SEQ ID NO: 1385320 - DNA, 22 bp, Artificial Sequence
  chemically synthesized
attactattcttgaagcaatgt

SEQ ID NO: 1385321 - DNA, 22 bp, Artificial Sequence
  chemically synthesized
actgattactattcttgaagca

SEQ ID NO: 1385322 - DNA, 22 bp, Artificial Sequence
  chemically synthesized
cttcaagaatagtaatcagtca

SEQ ID NO: 1385323 - DNA, 22 bp, Artificial Sequence
  chemically synthesized
agatgggtgccactgactgatt

SEQ ID NO: 1385324 - DNA, 22 bp, Artificial Sequence
  chemically synthesized
caagaatagtaatcagtcagtg

SEQ ID NO: 1385325 - DNA, 22 bp, Artificial Sequence
  chemically synthesized
aagaatagtaatcagtcagtgg

SEQ ID NO: 1385326 - DNA, 22 bp, Artificial Sequence
  chemically synthesized
attaagatgggtgccactgact

SEQ ID NO: 1385327 - DNA, 22 bp, Artificial Sequence
  chemically synthesized
tcattaagatgggtgccactga

SEQ ID NO: 1385328 - DNA, 22 bp, Artificial Sequence
  chemically synthesized
aaatgaaaacaatgggatgtaa

SEQ ID NO: 1385329 - DNA, 22 bp, Artificial Sequence
  chemically synthesized
aatgagaggatttacatcccat

SEQ ID NO: 1385330 - DNA, 22 bp, Artificial Sequence
  chemically synthesized
aaaatgaaaacaatgggatgta

SEQ ID NO: 1385331 - DNA, 22 bp, Artificial Sequence
  chemically synthesized
atgagaggatttacatcccatt

SEQ ID NO: 1385332 - DNA, 22 bp, Artificial Sequence
  chemically synthesized
acatttaaaatgaaaacaatgg

SEQ ID NO: 1385333 - DNA, 22 bp, Artificial Sequence
  chemically synthesized
acatcccattgttttcatttta

SEQ ID NO: 1385334 - DNA, 22 bp, Artificial Sequence
  chemically synthesized
catcccattgttttcattttaa

SEQ ID NO: 1385335 - DNA, 22 bp, Artificial Sequence
  chemically synthesized
tatgtatgcacattgacattta

SEQ ID NO: 1385336 - DNA, 22 bp, Artificial Sequence
  chemically synthesized
atatgtatgcacattgacattt

SEQ ID NO: 1385337 - DNA, 22 bp, Artificial Sequence
  chemically synthesized
ttttcattttaaatgtcaatgt

SEQ ID NO: 1385338 - DNA, 22 bp, Artificial Sequence
  chemically synthesized
tcattttaaatgtcaatgtgca

SEQ ID NO: 1385339 - DNA, 22 bp, Artificial Sequence
  chemically synthesized
cattttaaatgtcaatgtgcat

SEQ ID NO: 1385340 - DNA, 22 bp, Artificial Sequence
  chemically synthesized
attttaaatgtcaatgtgcata

SEQ ID NO: 1385341 - DNA, 22 bp, Artificial Sequence
  chemically synthesized
aatgtttatatgtatgcacatt

SEQ ID NO: 1385342 - DNA, 22 bp, Artificial Sequence
  chemically synthesized
taaatgtttatatgtatgcaca

SEQ ID NO: 1385343 - DNA, 22 bp, Artificial Sequence
  chemically synthesized
ctaaatgtttatatgtatgcac

SEQ ID NO: 1385344 - DNA, 22 bp, Artificial Sequence
  chemically synthesized
taaatgtcaatgtgcatacata

SEQ ID NO: 1385345 - DNA, 22 bp, Artificial Sequence
  chemically synthesized
tctaaatgtttatatgtatgca

SEQ ID NO: 1385346 - DNA, 22 bp, Artificial Sequence
  chemically synthesized
aaatgtcaatgtgcatacatat

SEQ ID NO: 1385347 - DNA, 22 bp, Artificial Sequence
  chemically synthesized
ttctaaatgtttatatgtatgc

SEQ ID NO: 1385348 - DNA, 22 bp, Artificial Sequence
  chemically synthesized
aatgtcaatgtgcatacatata

SEQ ID NO: 1385349 - DNA, 22 bp, Artificial Sequence
  chemically synthesized
tttttctaaatgtttatatgta

SEQ ID NO: 1385350 - DNA, 22 bp, Artificial Sequence
  chemically synthesized
gaaacctgtttttctaaatgtt

SEQ ID NO: 1385351 - DNA, 22 bp, Artificial Sequence
  chemically synthesized
ctggaaacctgtttttctaaat

SEQ ID NO: 1385352 - DNA, 22 bp, Artificial Sequence
  chemically synthesized
cataacatgatctactggaaac

SEQ ID NO: 1385353 - DNA, 22 bp, Artificial Sequence
  chemically synthesized
acataacatgatctactggaaa

SEQ ID NO: 1385354 - DNA, 22 bp, Artificial Sequence
  chemically synthesized
agaaaaacaggtttccagtaga

SEQ ID NO: 1385355 - DNA, 22 bp, Artificial Sequence
  chemically synthesized
tacataacatgatctactggaa

SEQ ID NO: 1385356 - DNA, 22 bp, Artificial Sequence
  chemically synthesized
gaaaaacaggtttccagtagat

SEQ ID NO: 1385357 - DNA, 22 bp, Artificial Sequence
  chemically synthesized
tatgacctttacataacatgat

SEQ ID NO: 1385358 - DNA, 22 bp, Artificial Sequence
  chemically synthesized
ccagtagatcatgttatgtaaa

SEQ ID NO: 1385359 - DNA, 22 bp, Artificial Sequence
  chemically synthesized
cagtagatcatgttatgtaaag

SEQ ID NO: 1385360 - DNA, 22 bp, Artificial Sequence
  chemically synthesized
caaggtctgtatgacctttaca

SEQ ID NO: 1385361 - DNA, 22 bp, Artificial Sequence
  chemically synthesized
gcaaggtctgtatgacctttac

SEQ ID NO: 1385362 - DNA, 22 bp, Artificial Sequence
  chemically synthesized
tgtaaaggtcatacagaccttg

SEQ ID NO: 1385363 - DNA, 22 bp, Artificial Sequence
  chemically synthesized
gagatgcaggaatatttgcaag

SEQ ID NO: 1385364 - DNA, 22 bp, Artificial Sequence
  chemically synthesized
gttagagatgcaggaatatttg

SEQ ID NO: 1385365 - DNA, 22 bp, Artificial Sequence
  chemically synthesized
gattagttagagatgcaggaat

SEQ ID NO: 1385366 - DNA, 22 bp, Artificial Sequence
  chemically synthesized
gcaaatattcctgcatctctaa

SEQ ID NO: 1385367 - DNA, 22 bp, Artificial Sequence
  chemically synthesized
caaatattcctgcatctctaac

SEQ ID NO: 1385368 - DNA, 22 bp, Artificial Sequence
  chemically synthesized
ctgcatctctaactaatctaat

SEQ ID NO: 1385369 - DNA, 22 bp, Artificial Sequence
  chemically synthesized
aagtcaagaaccggattagatt

SEQ ID NO: 1385370 - DNA, 22 bp, Artificial Sequence
  chemically synthesized
catctctaactaatctaatccg

SEQ ID NO: 1385371 - DNA, 22 bp, Artificial Sequence
  chemically synthesized
gaagtcaagaaccggattagat

SEQ ID NO: 1385372 - DNA, 22 bp, Artificial Sequence
  chemically synthesized
taactaatctaatccggttctt

SEQ ID NO: 1385373 - DNA, 22 bp, Artificial Sequence
  chemically synthesized
atatttgaagtcaagaaccgga

SEQ ID NO: 1385374 - DNA, 22 bp, Artificial Sequence
  chemically synthesized
gatatttgaagtcaagaaccgg

SEQ ID NO: 1385375 - DNA, 22 bp, Artificial Sequence
  chemically synthesized
actaatctaatccggttcttga

SEQ ID NO: 1385376 - DNA, 22 bp, Artificial Sequence
  chemically synthesized
atctaatccggttcttgacttc

SEQ ID NO: 1385377 - DNA, 22 bp, Artificial Sequence
  chemically synthesized
atccggttcttgacttcaaata

SEQ ID NO: 1385378 - DNA, 22 bp, Artificial Sequence
  chemically synthesized
ttgacttcaaatatcaaatgat

SEQ ID NO: 1385379 - DNA, 22 bp, Artificial Sequence
  chemically synthesized
gacttcaaatatcaaatgatat

SEQ ID NO: 1385380 - DNA, 22 bp, Artificial Sequence
  chemically synthesized
acttcaaatatcaaatgatatc

SEQ ID NO: 1385381 - DNA, 22 bp, Artificial Sequence
  chemically synthesized
ggtggcagtaagggatatcatt

SEQ ID NO: 1385382 - DNA, 22 bp, Artificial Sequence
  chemically synthesized
tgggtggcagtaagggatatca

SEQ ID NO: 1385383 - DNA, 22 bp, Artificial Sequence
  chemically synthesized
caaatatcaaatgatatccctt

SEQ ID NO: 1385384 - DNA, 22 bp, Artificial Sequence
  chemically synthesized
aaatatcaaatgatatccctta

SEQ ID NO: 1385385 - DNA, 22 bp, Artificial Sequence
  chemically synthesized
aaaattctgggtggcagtaagg

SEQ ID NO: 1385386 - DNA, 22 bp, Artificial Sequence
  chemically synthesized
aataccagacattcaaaattct

SEQ ID NO: 1385387 - DNA, 22 bp, Artificial Sequence
  chemically synthesized
actgccacccagaattttgaat

SEQ ID NO: 1385388 - DNA, 22 bp, Artificial Sequence
  chemically synthesized
ctgccacccagaattttgaatg

SEQ ID NO: 1385389 - DNA, 22 bp, Artificial Sequence
  chemically synthesized
ccacccagaattttgaatgtct

SEQ ID NO: 1385390 - DNA, 22 bp, Artificial Sequence
  chemically synthesized
gaaaccactcaataccagacat

SEQ ID NO: 1385391 - DNA, 22 bp, Artificial Sequence
  chemically synthesized
agaaaccactcaataccagaca

SEQ ID NO: 1385392 - DNA, 22 bp, Artificial Sequence
  chemically synthesized
tagaaaccactcaataccagac

SEQ ID NO: 1385393 - DNA, 22 bp, Artificial Sequence
  chemically synthesized
ttagaaaccactcaataccaga

SEQ ID NO: 1385394 - DNA, 22 bp, Artificial Sequence
  chemically synthesized
tgaatgtctggtattgagtggt

SEQ ID NO: 1385395 - DNA, 22 bp, Artificial Sequence
  chemically synthesized
gaatgtctggtattgagtggtt

SEQ ID NO: 1385396 - DNA, 22 bp, Artificial Sequence
  chemically synthesized
aatgtctggtattgagtggttt

SEQ ID NO: 1385397 - DNA, 22 bp, Artificial Sequence
  chemically synthesized
gtattgagtggtttctaaaagt

SEQ ID NO: 1385398 - DNA, 22 bp, Artificial Sequence
  chemically synthesized
aaatataaaaagtcaaactttt

SEQ ID NO: 1385399 - DNA, 22 bp, Artificial Sequence
  chemically synthesized
caaatataaaaagtcaaacttt

SEQ ID NO: 1385400 - DNA, 22 bp, Artificial Sequence
  chemically synthesized
agtggtttctaaaagtttgact

SEQ ID NO: 1385401 - DNA, 22 bp, Artificial Sequence
  chemically synthesized
ctaaaagtttgactttttatat

SEQ ID NO: 1385402 - DNA, 22 bp, Artificial Sequence
  chemically synthesized
taaaagtttgactttttatatt

SEQ ID NO: 1385403 - DNA, 22 bp, Artificial Sequence
  chemically synthesized
aaagtttgactttttatatttg

SEQ ID NO: 1385404 - DNA, 22 bp, Artificial Sequence
  chemically synthesized
atgtgggcccttcaaatataaa

SEQ ID NO: 1385405 - DNA, 22 bp, Artificial Sequence
  chemically synthesized
catgtgggcccttcaaatataa

SEQ ID NO: 1385406 - DNA, 22 bp, Artificial Sequence
  chemically synthesized
gactttttatatttgaagggcc

SEQ ID NO: 1385407 - DNA, 22 bp, Artificial Sequence
  chemically synthesized
actttttatatttgaagggccc

SEQ ID NO: 1385408 - DNA, 22 bp, Artificial Sequence
  chemically synthesized
cgtatggcttcatgtgggccct

SEQ ID NO: 1385409 - DNA, 22 bp, Artificial Sequence
  chemically synthesized
tttatatttgaagggcccacat

SEQ ID NO: 1385410 - DNA, 22 bp, Artificial Sequence
  chemically synthesized
ttatatttgaagggcccacatg

SEQ ID NO: 1385411 - DNA, 22 bp, Artificial Sequence
  chemically synthesized
tatatttgaagggcccacatga

SEQ ID NO: 1385412 - DNA, 22 bp, Artificial Sequence
  chemically synthesized
atatttgaagggcccacatgaa

SEQ ID NO: 1385413 - DNA, 22 bp, Artificial Sequence
  chemically synthesized
attgcgtatggcttcatgtggg

SEQ ID NO: 1385414 - DNA, 22 bp, Artificial Sequence
  chemically synthesized
tatttgaagggcccacatgaag

SEQ ID NO: 1385415 - DNA, 22 bp, Artificial Sequence
  chemically synthesized
gaagggcccacatgaagccata

SEQ ID NO: 1385416 - DNA, 22 bp, Artificial Sequence
  chemically synthesized
aagggcccacatgaagccatac

SEQ ID NO: 1385417 - DNA, 22 bp, Artificial Sequence
  chemically synthesized
ccacaatacagcatatgctaat

SEQ ID NO: 1385418 - DNA, 22 bp, Artificial Sequence
  chemically synthesized
gccacaatacagcatatgctaa

SEQ ID NO: 1385419 - DNA, 22 bp, Artificial Sequence
  chemically synthesized
acagaacttgccacaatacagc

SEQ ID NO: 1385420 - DNA, 22 bp, Artificial Sequence
  chemically synthesized
gcatatgctgtattgtggcaag

SEQ ID NO: 1385421 - DNA, 22 bp, Artificial Sequence
  chemically synthesized
atgttaacagaacttgccacaa

SEQ ID NO: 1385422 - DNA, 22 bp, Artificial Sequence
  chemically synthesized
tattgtggcaagttctgttaac

SEQ ID NO: 1385423 - DNA, 22 bp, Artificial Sequence
  chemically synthesized
aatcaaagagctgatgttaaca

SEQ ID NO: 1385424 - DNA, 22 bp, Artificial Sequence
  chemically synthesized
tggcaagttctgttaacatcag

SEQ ID NO: 1385425 - DNA, 22 bp, Artificial Sequence
  chemically synthesized
ctcaatcaaagagctgatgtta

SEQ ID NO: 1385426 - DNA, 22 bp, Artificial Sequence
  chemically synthesized
cctcaatcaaagagctgatgtt

SEQ ID NO: 1385427 - DNA, 22 bp, Artificial Sequence
  chemically synthesized
ttcctcaatcaaagagctgatg

SEQ ID NO: 1385428 - DNA, 22 bp, Artificial Sequence
  chemically synthesized
tgttaacatcagctctttgatt

SEQ ID NO: 1385429 - DNA, 22 bp, Artificial Sequence
  chemically synthesized
gtgttcttcctcaatcaaagag

SEQ ID NO: 1385430 - DNA, 22 bp, Artificial Sequence
  chemically synthesized
ttaacatcagctctttgattga

SEQ ID NO: 1385431 - DNA, 22 bp, Artificial Sequence
  chemically synthesized
acatcagctctttgattgagga

SEQ ID NO: 1385432 - DNA, 22 bp, Artificial Sequence
  chemically synthesized
aacagttagtgttcttcctcaa

SEQ ID NO: 1385433 - DNA, 22 bp, Artificial Sequence
  chemically synthesized
tttgattgaggaagaacactaa

SEQ ID NO: 1385434 - DNA, 22 bp, Artificial Sequence
  chemically synthesized
atgattcaacagttagtgttct

SEQ ID NO: 1385435 - DNA, 22 bp, Artificial Sequence
  chemically synthesized
gatgattcaacagttagtgttc

SEQ ID NO: 1385436 - DNA, 22 bp, Artificial Sequence
  chemically synthesized
tgattgaggaagaacactaact

SEQ ID NO: 1385437 - DNA, 22 bp, Artificial Sequence
  chemically synthesized
tgatgattcaacagttagtgtt

SEQ ID NO: 1385438 - DNA, 22 bp, Artificial Sequence
  chemically synthesized
gattgaggaagaacactaactg

SEQ ID NO: 1385439 - DNA, 22 bp, Artificial Sequence
  chemically synthesized
attgaggaagaacactaactgt

SEQ ID NO: 1385440 - DNA, 22 bp, Artificial Sequence
  chemically synthesized
aggaagaacactaactgttgaa

SEQ ID NO: 1385441 - DNA, 22 bp, Artificial Sequence
  chemically synthesized
tagtgttttgatgattcaacag

SEQ ID NO: 1385442 - DNA, 22 bp, Artificial Sequence
  chemically synthesized
ctgtagtgttttgatgattcaa

SEQ ID NO: 1385443 - DNA, 22 bp, Artificial Sequence
  chemically synthesized
actgttgaatcatcaaaacact

SEQ ID NO: 1385444 - DNA, 22 bp, Artificial Sequence
  chemically synthesized
taaaatactgctgtagtgtttt

SEQ ID NO: 1385445 - DNA, 22 bp, Artificial Sequence
  chemically synthesized
ttgaatcatcaaaacactacag

SEQ ID NO: 1385446 - DNA, 22 bp, Artificial Sequence
  chemically synthesized
aatcatcaaaacactacagcag

SEQ ID NO: 1385447 - DNA, 22 bp, Artificial Sequence
  chemically synthesized
aggttgtaaaatactgctgtag

SEQ ID NO: 1385448 - DNA, 22 bp, Artificial Sequence
  chemically synthesized
tgcataactgaggttgtaaaat

SEQ ID NO: 1385449 - DNA, 22 bp, Artificial Sequence
  chemically synthesized
cagcagtattttacaacctcag

SEQ ID NO: 1385450 - DNA, 22 bp, Artificial Sequence
  chemically synthesized
acattatgcataactgaggttg

SEQ ID NO: 1385451 - DNA, 22 bp, Artificial Sequence
  chemically synthesized
cacattatgcataactgaggtt

SEQ ID NO: 1385452 - DNA, 22 bp, Artificial Sequence
  chemically synthesized
cttcacattatgcataactgag

SEQ ID NO: 1385453 - DNA, 22 bp, Artificial Sequence
  chemically synthesized
tacaacctcagttatgcataat

SEQ ID NO: 1385454 - DNA, 22 bp, Artificial Sequence
  chemically synthesized
acaacctcagttatgcataatg

SEQ ID NO: 1385455 - DNA, 22 bp, Artificial Sequence
  chemically synthesized
caacctcagttatgcataatgt

SEQ ID NO: 1385456 - DNA, 22 bp, Artificial Sequence
  chemically synthesized
agttatgcataatgtgaagtaa

SEQ ID NO: 1385457 - DNA, 22 bp, Artificial Sequence
  chemically synthesized
tgcataatgtgaagtaatatgc

SEQ ID NO: 1385458 - DNA, 22 bp, Artificial Sequence
  chemically synthesized
cagagggcaggccatgcatatt

SEQ ID NO: 1385459 - DNA, 22 bp, Artificial Sequence
  chemically synthesized
acagagggcaggccatgcatat

SEQ ID NO: 1385460 - DNA, 22 bp, Artificial Sequence
  chemically synthesized
atatttacagagggcaggccat

SEQ ID NO: 1385461 - DNA, 22 bp, Artificial Sequence
  chemically synthesized
tcatatttacagagggcaggcc

SEQ ID NO: 1385462 - DNA, 22 bp, Artificial Sequence
  chemically synthesized
cctctcatatttacagagggca

SEQ ID NO: 1385463 - DNA, 22 bp, Artificial Sequence
  chemically synthesized
ccctctgtaaatatgagaggca

SEQ ID NO: 1385464 - DNA, 22 bp, Artificial Sequence
  chemically synthesized
tgtaaatatgagaggcaatttg

SEQ ID NO: 1385465 - DNA, 22 bp, Artificial Sequence
  chemically synthesized
taaatatgagaggcaatttgtt

SEQ ID NO: 1385466 - DNA, 22 bp, Artificial Sequence
  chemically synthesized
aaagcaaaataaaatgtggagc

SEQ ID NO: 1385467 - DNA, 22 bp, Artificial Sequence
  chemically synthesized
gtttggctccacattttatttt

SEQ ID NO: 1385468 - DNA, 22 bp, Artificial Sequence
  chemically synthesized
tttggctccacattttattttg

SEQ ID NO: 1385469 - DNA, 22 bp, Artificial Sequence
  chemically synthesized
ggctccacattttattttgctt

SEQ ID NO: 1385470 - DNA, 22 bp, Artificial Sequence
  chemically synthesized
gctccacattttattttgcttt

SEQ ID NO: 1385471 - DNA, 22 bp, Artificial Sequence
  chemically synthesized
cacattttattttgctttcagg

SEQ ID NO: 1385472 - DNA, 22 bp, Artificial Sequence
  chemically synthesized
gtaagtagtataatcctgaaag

SEQ ID NO: 1385473 - DNA, 22 bp, Artificial Sequence
  chemically synthesized
tattttgctttcaggattatac

SEQ ID NO: 1385474 - DNA, 22 bp, Artificial Sequence
  chemically synthesized
attttgctttcaggattatact

SEQ ID NO: 1385475 - DNA, 22 bp, Artificial Sequence
  chemically synthesized
aagttagtaagtagtataatcc

SEQ ID NO: 1385476 - DNA, 22 bp, Artificial Sequence
  chemically synthesized
ttttgctttcaggattatacta

SEQ ID NO: 1385477 - DNA, 22 bp, Artificial Sequence
  chemically synthesized
ttgaagttagtaagtagtataa

SEQ ID NO: 1385478 - DNA, 22 bp, Artificial Sequence
  chemically synthesized
tgctttcaggattatactactt

SEQ ID NO: 1385479 - DNA, 22 bp, Artificial Sequence
  chemically synthesized
gttgaagttagtaagtagtata

SEQ ID NO: 1385480 - DNA, 22 bp, Artificial Sequence
  chemically synthesized
gctttcaggattatactactta

SEQ ID NO: 1385481 - DNA, 22 bp, Artificial Sequence
  chemically synthesized
tgttgaagttagtaagtagtat

SEQ ID NO: 1385482 - DNA, 22 bp, Artificial Sequence
  chemically synthesized
ctttcaggattatactacttac

SEQ ID NO: 1385483 - DNA, 22 bp, Artificial Sequence
  chemically synthesized
ttgttgaagttagtaagtagta

SEQ ID NO: 1385484 - DNA, 22 bp, Artificial Sequence
  chemically synthesized
tcaggattatactacttactaa

SEQ ID NO: 1385485 - DNA, 22 bp, Artificial Sequence
  chemically synthesized
cttttgttgaagttagtaagta

SEQ ID NO: 1385486 - DNA, 22 bp, Artificial Sequence
  chemically synthesized
caggattatactacttactaac

SEQ ID NO: 1385487 - DNA, 22 bp, Artificial Sequence
  chemically synthesized
aggattatactacttactaact

SEQ ID NO: 1385488 - DNA, 22 bp, Artificial Sequence
  chemically synthesized
tattgcttttgttgaagttagt

SEQ ID NO: 1385489 - DNA, 22 bp, Artificial Sequence
  chemically synthesized
ttatattgcttttgttgaagtt

SEQ ID NO: 1385490 - DNA, 22 bp, Artificial Sequence
  chemically synthesized
tactacttactaacttcaacaa

SEQ ID NO: 1385491 - DNA, 22 bp, Artificial Sequence
  chemically synthesized
attatattgcttttgttgaagt

SEQ ID NO: 1385492 - DNA, 22 bp, Artificial Sequence
  chemically synthesized
ttattatattgcttttgttgaa

SEQ ID NO: 1385493 - DNA, 22 bp, Artificial Sequence
  chemically synthesized
cttattatattgcttttgttga

SEQ ID NO: 1385494 - DNA, 22 bp, Artificial Sequence
  chemically synthesized
cttactaacttcaacaaaagca

SEQ ID NO: 1385495 - DNA, 22 bp, Artificial Sequence
  chemically synthesized
actaacttcaacaaaagcaata

SEQ ID NO: 1385496 - DNA, 22 bp, Artificial Sequence
  chemically synthesized
ctaacttcaacaaaagcaatat

SEQ ID NO: 1385497 - DNA, 22 bp, Artificial Sequence
  chemically synthesized
acttcaacaaaagcaatataat

SEQ ID NO: 1385498 - DNA, 22 bp, Artificial Sequence
  chemically synthesized
caacaaaagcaatataataaga

SEQ ID NO: 1385499 - DNA, 22 bp, Artificial Sequence
  chemically synthesized
tgaggcaatatttcttattata

SEQ ID NO: 1385500 - DNA, 22 bp, Artificial Sequence
  chemically synthesized
aacaaaagcaatataataagaa

SEQ ID NO: 1385501 - DNA, 22 bp, Artificial Sequence
  chemically synthesized
tggtattgtgaggcaatatttc

SEQ ID NO: 1385502 - DNA, 22 bp, Artificial Sequence
  chemically synthesized
atggacagagctgtggtattgt

SEQ ID NO: 1385503 - DNA, 22 bp, Artificial Sequence
  chemically synthesized
ttgatggacagagctgtggtat

SEQ ID NO: 1385504 - DNA, 22 bp, Artificial Sequence
  chemically synthesized
ctattgatggacagagctgtgg

SEQ ID NO: 1385505 - DNA, 22 bp, Artificial Sequence
  chemically synthesized
gctattgatggacagagctgtg

SEQ ID NO: 1385506 - DNA, 22 bp, Artificial Sequence
  chemically synthesized
cctcacaataccacagctctgt

SEQ ID NO: 1385507 - DNA, 22 bp, Artificial Sequence
  chemically synthesized
tgctattgatggacagagctgt

SEQ ID NO: 1385508 - DNA, 22 bp, Artificial Sequence
  chemically synthesized
ttgctattgatggacagagctg

SEQ ID NO: 1385509 - DNA, 22 bp, Artificial Sequence
  chemically synthesized
acaataccacagctctgtccat

SEQ ID NO: 1385510 - DNA, 22 bp, Artificial Sequence
  chemically synthesized
agaatttttgctattgatggac

SEQ ID NO: 1385511 - DNA, 22 bp, Artificial Sequence
  chemically synthesized
agattgagaatttttgctattg

SEQ ID NO: 1385512 - DNA, 22 bp, Artificial Sequence
  chemically synthesized
tgtccatcaatagcaaaaattc

SEQ ID NO: 1385513 - DNA, 22 bp, Artificial Sequence
  chemically synthesized
gtgctaagattgagaatttttg

SEQ ID NO: 1385514 - DNA, 22 bp, Artificial Sequence
  chemically synthesized
tccatcaatagcaaaaattctc

SEQ ID NO: 1385515 - DNA, 22 bp, Artificial Sequence
  chemically synthesized
gcactggtgctaagattgagaa

SEQ ID NO: 1385516 - DNA, 22 bp, Artificial Sequence
  chemically synthesized
ctggcactggtgctaagattga

SEQ ID NO: 1385517 - DNA, 22 bp, Artificial Sequence
  chemically synthesized
atctcctggcactggtgctaag

SEQ ID NO: 1385518 - DNA, 22 bp, Artificial Sequence
  chemically synthesized
tcaatcttagcaccagtgccag

SEQ ID NO: 1385519 - DNA, 22 bp, Artificial Sequence
  chemically synthesized
aatcttagcaccagtgccagga

SEQ ID NO: 1385520 - DNA, 22 bp, Artificial Sequence
  chemically synthesized
tcataatgagattcatctcctg

SEQ ID NO: 1385521 - DNA, 22 bp, Artificial Sequence
  chemically synthesized
agcaccagtgccaggagatgaa

SEQ ID NO: 1385522 - DNA, 22 bp, Artificial Sequence
  chemically synthesized
gcaccagtgccaggagatgaat

SEQ ID NO: 1385523 - DNA, 22 bp, Artificial Sequence
  chemically synthesized
aattatcataatgagattcatc

SEQ ID NO: 1385524 - DNA, 22 bp, Artificial Sequence
  chemically synthesized
attatgataattcagtgattgt

SEQ ID NO: 1385525 - DNA, 22 bp, Artificial Sequence
  chemically synthesized
tgataattcagtgattgtatac

SEQ ID NO: 1385526 - DNA, 22 bp, Artificial Sequence
  chemically synthesized
ggaaatgtgaatccgtatacaa

SEQ ID NO: 1385527 - DNA, 22 bp, Artificial Sequence
  chemically synthesized
agtgattgtatacggattcaca

SEQ ID NO: 1385528 - DNA, 22 bp, Artificial Sequence
  chemically synthesized
tgtatgctgggaaatgtgaatc

SEQ ID NO: 1385529 - DNA, 22 bp, Artificial Sequence
  chemically synthesized
atgtatgctgggaaatgtgaat

SEQ ID NO: 1385530 - DNA, 22 bp, Artificial Sequence
  chemically synthesized
ttatgtatgctgggaaatgtga

SEQ ID NO: 1385531 - DNA, 22 bp, Artificial Sequence
  chemically synthesized
tcttatgtatgctgggaaatgt

SEQ ID NO: 1385532 - DNA, 22 bp, Artificial Sequence
  chemically synthesized
tatacggattcacatttcccag

SEQ ID NO: 1385533 - DNA, 22 bp, Artificial Sequence
  chemically synthesized
tattctcttatgtatgctggga

SEQ ID NO: 1385534 - DNA, 22 bp, Artificial Sequence
  chemically synthesized
gtattctcttatgtatgctggg

SEQ ID NO: 1385535 - DNA, 22 bp, Artificial Sequence
  chemically synthesized
tgtattctcttatgtatgctgg

SEQ ID NO: 1385536 - DNA, 22 bp, Artificial Sequence
  chemically synthesized
ttttgtattctcttatgtatgc

SEQ ID NO: 1385537 - DNA, 22 bp, Artificial Sequence
  chemically synthesized
gttttgtattctcttatgtatg

SEQ ID NO: 1385538 - DNA, 22 bp, Artificial Sequence
  chemically synthesized
acatttcccagcatacataaga

SEQ ID NO: 1385539 - DNA, 22 bp, Artificial Sequence
  chemically synthesized
tgtttgttttgtattctcttat

SEQ ID NO: 1385540 - DNA, 22 bp, Artificial Sequence
  chemically synthesized
gtgtttgttttgtattctctta

SEQ ID NO: 1385541 - DNA, 22 bp, Artificial Sequence
  chemically synthesized
cccagcatacataagagaatac

SEQ ID NO: 1385542 - DNA, 22 bp, Artificial Sequence
  chemically synthesized
ccagcatacataagagaataca

SEQ ID NO: 1385543 - DNA, 22 bp, Artificial Sequence
  chemically synthesized
cttgtgtttgttttgtattctc

SEQ ID NO: 1385544 - DNA, 22 bp, Artificial Sequence
  chemically synthesized
tcctacttgtgtttgttttgta

SEQ ID NO: 1385545 - DNA, 22 bp, Artificial Sequence
  chemically synthesized
atcctacttgtgtttgttttgt

SEQ ID NO: 1385546 - DNA, 22 bp, Artificial Sequence
  chemically synthesized
cttatcctacttgtgtttgttt

SEQ ID NO: 1385547 - DNA, 22 bp, Artificial Sequence
  chemically synthesized
attgcttatcctacttgtgttt

SEQ ID NO: 1385548 - DNA, 22 bp, Artificial Sequence
  chemically synthesized
tctgattgcttatcctacttgt

SEQ ID NO: 1385549 - DNA, 22 bp, Artificial Sequence
  chemically synthesized
agttatctgattgcttatccta

SEQ ID NO: 1385550 - DNA, 22 bp, Artificial Sequence
  chemically synthesized
cagttatctgattgcttatcct

SEQ ID NO: 1385551 - DNA, 22 bp, Artificial Sequence
  chemically synthesized
acaaaaaaaacttcagttatct

SEQ ID NO: 1385552 - DNA, 22 bp, Artificial Sequence
  chemically synthesized
gacaaaaaaaacttcagttatc

SEQ ID NO: 1385553 - DNA, 22 bp, Artificial Sequence
  chemically synthesized
tgacaaaaaaaacttcagttat

SEQ ID NO: 1385554 - DNA, 22 bp, Artificial Sequence
  chemically synthesized
atatctttgacaaaaaaaactt

SEQ ID NO: 1385555 - DNA, 22 bp, Artificial Sequence
  chemically synthesized
aatatctttgacaaaaaaaact

SEQ ID NO: 1385556 - DNA, 22 bp, Artificial Sequence
  chemically synthesized
taatatctttgacaaaaaaaac

SEQ ID NO: 1385557 - DNA, 22 bp, Artificial Sequence
  chemically synthesized
tttaatatctttgacaaaaaaa

SEQ ID NO: 1385558 - DNA, 22 bp, Artificial Sequence
  chemically synthesized
aagttttttttgtcaaagatat

SEQ ID NO: 1385559 - DNA, 22 bp, Artificial Sequence
  chemically synthesized
acatactctttaatatctttga

SEQ ID NO: 1385560 - DNA, 22 bp, Artificial Sequence
  chemically synthesized
aacatactctttaatatctttg

SEQ ID NO: 1385561 - DNA, 22 bp, Artificial Sequence
  chemically synthesized
ttaacatactctttaatatctt

SEQ ID NO: 1385562 - DNA, 22 bp, Artificial Sequence
  chemically synthesized
tttttgtcaaagatattaaaga

SEQ ID NO: 1385563 - DNA, 22 bp, Artificial Sequence
  chemically synthesized
ttttgtcaaagatattaaagag

SEQ ID NO: 1385564 - DNA, 22 bp, Artificial Sequence
  chemically synthesized
tttgtcaaagatattaaagagt

SEQ ID NO: 1385565 - DNA, 22 bp, Artificial Sequence
  chemically synthesized
ttgtcaaagatattaaagagta

SEQ ID NO: 1385566 - DNA, 22 bp, Artificial Sequence
  chemically synthesized
tgtcaaagatattaaagagtat

SEQ ID NO: 1385567 - DNA, 22 bp, Artificial Sequence
  chemically synthesized
gtcaaagatattaaagagtatg

SEQ ID NO: 1385568 - DNA, 22 bp, Artificial Sequence
  chemically synthesized
gatgattcttaacatactcttt

SEQ ID NO: 1385569 - DNA, 22 bp, Artificial Sequence
  chemically synthesized
tcaaagatattaaagagtatgt

SEQ ID NO: 1385570 - DNA, 22 bp, Artificial Sequence
  chemically synthesized
aagagtatgttaagaatcatct

SEQ ID NO: 1385571 - DNA, 22 bp, Artificial Sequence
  chemically synthesized
cagtaatagggagatgacatta

SEQ ID NO: 1385572 - DNA, 22 bp, Artificial Sequence
  chemically synthesized
ccagtaatagggagatgacatt

SEQ ID NO: 1385573 - DNA, 22 bp, Artificial Sequence
  chemically synthesized
tccagtaatagggagatgacat

SEQ ID NO: 1385574 - DNA, 22 bp, Artificial Sequence
  chemically synthesized
agaatcatctaatgtcatctcc

SEQ ID NO: 1385575 - DNA, 22 bp, Artificial Sequence
  chemically synthesized
ttccagtaatagggagatgaca

SEQ ID NO: 1385576 - DNA, 22 bp, Artificial Sequence
  chemically synthesized
tttccagtaatagggagatgac

SEQ ID NO: 1385577 - DNA, 22 bp, Artificial Sequence
  chemically synthesized
cattttttccagtaatagggag

SEQ ID NO: 1385578 - DNA, 22 bp, Artificial Sequence
  chemically synthesized
ccattttttccagtaataggga

SEQ ID NO: 1385579 - DNA, 22 bp, Artificial Sequence
  chemically synthesized
atgtcatctccctattactgga

SEQ ID NO: 1385580 - DNA, 22 bp, Artificial Sequence
  chemically synthesized
agcttccattttttccagtaat

SEQ ID NO: 1385581 - DNA, 22 bp, Artificial Sequence
  chemically synthesized
cctattactggaaaaaatggaa

SEQ ID NO: 1385582 - DNA, 22 bp, Artificial Sequence
  chemically synthesized
tataaatcctgagcttccattt

SEQ ID NO: 1385583 - DNA, 22 bp, Artificial Sequence
  chemically synthesized
ttactggaaaaaatggaagctc

SEQ ID NO: 1385584 - DNA, 22 bp, Artificial Sequence
  chemically synthesized
attatataaatcctgagcttcc

SEQ ID NO: 1385585 - DNA, 22 bp, Artificial Sequence
  chemically synthesized
ctggaaaaaatggaagctcagg

SEQ ID NO: 1385586 - DNA, 22 bp, Artificial Sequence
  chemically synthesized
gaaaaaatggaagctcaggatt

SEQ ID NO: 1385587 - DNA, 22 bp, Artificial Sequence
  chemically synthesized
gagctaattatataaatcctga

SEQ ID NO: 1385588 - DNA, 22 bp, Artificial Sequence
  chemically synthesized
tgtgacctagagctaattatat

SEQ ID NO: 1385589 - DNA, 22 bp, Artificial Sequence
  chemically synthesized
cctgtgtgacctagagctaatt

SEQ ID NO: 1385590 - DNA, 22 bp, Artificial Sequence
  chemically synthesized
aggatttatataattagctcta

SEQ ID NO: 1385591 - DNA, 22 bp, Artificial Sequence
  chemically synthesized
atataattagctctaggtcaca

SEQ ID NO: 1385592 - DNA, 22 bp, Artificial Sequence
  chemically synthesized
tataattagctctaggtcacac

SEQ ID NO: 1385593 - DNA, 22 bp, Artificial Sequence
  chemically synthesized
ccatcaaactacctgtgtgacc

SEQ ID NO: 1385594 - DNA, 22 bp, Artificial Sequence
  chemically synthesized
accatcaaactacctgtgtgac

SEQ ID NO: 1385595 - DNA, 22 bp, Artificial Sequence
  chemically synthesized
gctctaggtcacacaggtagtt

SEQ ID NO: 1385596 - DNA, 22 bp, Artificial Sequence
  chemically synthesized
ggatttaccatcaaactacctg

SEQ ID NO: 1385597 - DNA, 22 bp, Artificial Sequence
  chemically synthesized
taggatttaccatcaaactacc

SEQ ID NO: 1385598 - DNA, 22 bp, Artificial Sequence
  chemically synthesized
taggtcacacaggtagtttgat

SEQ ID NO: 1385599 - DNA, 22 bp, Artificial Sequence
  chemically synthesized
tctaggatttaccatcaaacta

SEQ ID NO: 1385600 - DNA, 22 bp, Artificial Sequence
  chemically synthesized
ggtcacacaggtagtttgatgg

SEQ ID NO: 1385601 - DNA, 22 bp, Artificial Sequence
  chemically synthesized
gatggtaaatcctagagaattc

SEQ ID NO: 1385602 - DNA, 22 bp, Artificial Sequence
  chemically synthesized
atggtaaatcctagagaattct

SEQ ID NO: 1385603 - DNA, 22 bp, Artificial Sequence
  chemically synthesized
agaaatatgaacagtagaattc

SEQ ID NO: 1385604 - DNA, 22 bp, Artificial Sequence
  chemically synthesized
aagaaatatgaacagtagaatt

SEQ ID NO: 1385605 - DNA, 22 bp, Artificial Sequence
  chemically synthesized
gagaattctactgttcatattt

SEQ ID NO: 1385606 - DNA, 22 bp, Artificial Sequence
  chemically synthesized
tactgttcatatttcttaaaca

SEQ ID NO: 1385607 - DNA, 22 bp, Artificial Sequence
  chemically synthesized
ctgttcatatttcttaaacaca

SEQ ID NO: 1385608 - DNA, 22 bp, Artificial Sequence
  chemically synthesized
ttcatatttcttaaacacatat

SEQ ID NO: 1385609 - DNA, 22 bp, Artificial Sequence
  chemically synthesized
atatttcttaaacacatatttt

SEQ ID NO: 1385610 - DNA, 22 bp, Artificial Sequence
  chemically synthesized
cttaaacacatattttcttcat

SEQ ID NO: 1385611 - DNA, 22 bp, Artificial Sequence
  chemically synthesized
ttaaacacatattttcttcatt

SEQ ID NO: 1385612 - DNA, 22 bp, Artificial Sequence
  chemically synthesized
aaacacatattttcttcattat

SEQ ID NO: 1385613 - DNA, 22 bp, Artificial Sequence
  chemically synthesized
aacacatattttcttcattata

SEQ ID NO: 1385614 - DNA, 22 bp, Artificial Sequence
  chemically synthesized
taatacataaagtataatgaag

SEQ ID NO: 1385615 - DNA, 22 bp, Artificial Sequence
  chemically synthesized
atatcactgtaatacataaagt

SEQ ID NO: 1385616 - DNA, 22 bp, Artificial Sequence
  chemically synthesized
tcttcattatactttatgtatt

SEQ ID NO: 1385617 - DNA, 22 bp, Artificial Sequence
  chemically synthesized
cttcattatactttatgtatta

SEQ ID NO: 1385618 - DNA, 22 bp, Artificial Sequence
  chemically synthesized
ttcattatactttatgtattac

SEQ ID NO: 1385619 - DNA, 22 bp, Artificial Sequence
  chemically synthesized
cattatactttatgtattacag

SEQ ID NO: 1385620 - DNA, 22 bp, Artificial Sequence
  chemically synthesized
attatactttatgtattacagt

SEQ ID NO: 1385621 - DNA, 22 bp, Artificial Sequence
  chemically synthesized
gtagtggctaatatcactgtaa

SEQ ID NO: 1385622 - DNA, 22 bp, Artificial Sequence
  chemically synthesized
tactttatgtattacagtgata

SEQ ID NO: 1385623 - DNA, 22 bp, Artificial Sequence
  chemically synthesized
ggtagtggctaatatcactgta

SEQ ID NO: 1385624 - DNA, 22 bp, Artificial Sequence
  chemically synthesized
acttggtagtggctaatatcac

SEQ ID NO: 1385625 - DNA, 22 bp, Artificial Sequence
  chemically synthesized
tatgtattacagtgatattagc

SEQ ID NO: 1385626 - DNA, 22 bp, Artificial Sequence
  chemically synthesized
atgtattacagtgatattagcc

SEQ ID NO: 1385627 - DNA, 22 bp, Artificial Sequence
  chemically synthesized
tgtattacagtgatattagcca

SEQ ID NO: 1385628 - DNA, 22 bp, Artificial Sequence
  chemically synthesized
gtgctgacttggtagtggctaa

SEQ ID NO: 1385629 - DNA, 22 bp, Artificial Sequence
  chemically synthesized
cagtgatattagccactaccaa

SEQ ID NO: 1385630 - DNA, 22 bp, Artificial Sequence
  chemically synthesized
taattagtgctgacttggtagt

SEQ ID NO: 1385631 - DNA, 22 bp, Artificial Sequence
  chemically synthesized
tcaagttataattagtgctgac

SEQ ID NO: 1385632 - DNA, 22 bp, Artificial Sequence
  chemically synthesized
gccactaccaagtcagcactaa

SEQ ID NO: 1385633 - DNA, 22 bp, Artificial Sequence
  chemically synthesized
aatctatcaagttataattagt

SEQ ID NO: 1385634 - DNA, 22 bp, Artificial Sequence
  chemically synthesized
aaatctatcaagttataattag

SEQ ID NO: 1385635 - DNA, 22 bp, Artificial Sequence
  chemically synthesized
ccaagtcagcactaattataac

SEQ ID NO: 1385636 - DNA, 22 bp, Artificial Sequence
  chemically synthesized
taaatctatcaagttataatta

SEQ ID NO: 1385637 - DNA, 22 bp, Artificial Sequence
  chemically synthesized
gacctttaaatctatcaagtta

SEQ ID NO: 1385638 - DNA, 22 bp, Artificial Sequence
  chemically synthesized
agacctttaaatctatcaagtt

SEQ ID NO: 1385639 - DNA, 22 bp, Artificial Sequence
  chemically synthesized
agcttagacctttaaatctatc

SEQ ID NO: 1385640 - DNA, 22 bp, Artificial Sequence
  chemically synthesized
cagcttagacctttaaatctat

SEQ ID NO: 1385641 - DNA, 22 bp, Artificial Sequence
  chemically synthesized
attataacttgatagatttaaa

SEQ ID NO: 1385642 - DNA, 22 bp, Artificial Sequence
  chemically synthesized
tcagcttagacctttaaatcta

SEQ ID NO: 1385643 - DNA, 22 bp, Artificial Sequence
  chemically synthesized
taacttgatagatttaaaggtc

SEQ ID NO: 1385644 - DNA, 22 bp, Artificial Sequence
  chemically synthesized
aatattttcagcttagaccttt

SEQ ID NO: 1385645 - DNA, 22 bp, Artificial Sequence
  chemically synthesized
taaatattttcagcttagacct

SEQ ID NO: 1385646 - DNA, 22 bp, Artificial Sequence
  chemically synthesized
gatagatttaaaggtctaagct

SEQ ID NO: 1385647 - DNA, 22 bp, Artificial Sequence
  chemically synthesized
ctaaatattttcagcttagacc

SEQ ID NO: 1385648 - DNA, 22 bp, Artificial Sequence
  chemically synthesized
atagatttaaaggtctaagctg

SEQ ID NO: 1385649 - DNA, 22 bp, Artificial Sequence
  chemically synthesized
tctaaatattttcagcttagac

SEQ ID NO: 1385650 - DNA, 22 bp, Artificial Sequence
  chemically synthesized
aaaggtctaagctgaaaatatt

SEQ ID NO: 1385651 - DNA, 22 bp, Artificial Sequence
  chemically synthesized
aaggtctaagctgaaaatattt

SEQ ID NO: 1385652 - DNA, 22 bp, Artificial Sequence
  chemically synthesized
aacatgaattttctaaatattt

SEQ ID NO: 1385653 - DNA, 22 bp, Artificial Sequence
  chemically synthesized
tcaacatgaattttctaaatat

SEQ ID NO: 1385654 - DNA, 22 bp, Artificial Sequence
  chemically synthesized
agctgaaaatatttagaaaatt

SEQ ID NO: 1385655 - DNA, 22 bp, Artificial Sequence
  chemically synthesized
aatattctcaacatgaattttc

SEQ ID NO: 1385656 - DNA, 22 bp, Artificial Sequence
  chemically synthesized
aaaatatttagaaaattcatgt

SEQ ID NO: 1385657 - DNA, 22 bp, Artificial Sequence
  chemically synthesized
tcaatattctcaacatgaattt

SEQ ID NO: 1385658 - DNA, 22 bp, Artificial Sequence
  chemically synthesized
ctcaatattctcaacatgaatt

SEQ ID NO: 1385659 - DNA, 22 bp, Artificial Sequence
  chemically synthesized
tttctcaatattctcaacatga

SEQ ID NO: 1385660 - DNA, 22 bp, Artificial Sequence
  chemically synthesized
atttctcaatattctcaacatg

SEQ ID NO: 1385661 - DNA, 22 bp, Artificial Sequence
  chemically synthesized
agaaaattcatgttgagaatat

SEQ ID NO: 1385662 - DNA, 22 bp, Artificial Sequence
  chemically synthesized
gaaaattcatgttgagaatatt

SEQ ID NO: 1385663 - DNA, 22 bp, Artificial Sequence
  chemically synthesized
gatcccaccttatttctcaata

SEQ ID NO: 1385664 - DNA, 22 bp, Artificial Sequence
  chemically synthesized
ggatcccaccttatttctcaat

SEQ ID NO: 1385665 - DNA, 22 bp, Artificial Sequence
  chemically synthesized
atgttgagaatattgagaaata

SEQ ID NO: 1385666 - DNA, 22 bp, Artificial Sequence
  chemically synthesized
agaatattgagaaataaggtgg

SEQ ID NO: 1385667 - DNA, 22 bp, Artificial Sequence
  chemically synthesized
atgccaccttggatcccacctt

SEQ ID NO: 1385668 - DNA, 22 bp, Artificial Sequence
  chemically synthesized
catgccaccttggatcccacct

SEQ ID NO: 1385669 - DNA, 22 bp, Artificial Sequence
  chemically synthesized
tcatgccaccttggatcccacc

SEQ ID NO: 1385670 - DNA, 22 bp, Artificial Sequence
  chemically synthesized
agaaataaggtgggatccaagg

SEQ ID NO: 1385671 - DNA, 22 bp, Artificial Sequence
  chemically synthesized
acctttcatgccaccttggatc

SEQ ID NO: 1385672 - DNA, 22 bp, Artificial Sequence
  chemically synthesized
tgacctttcatgccaccttgga

SEQ ID NO: 1385673 - DNA, 22 bp, Artificial Sequence
  chemically synthesized
agactctgacctttcatgccac

SEQ ID NO: 1385674 - DNA, 22 bp, Artificial Sequence
  chemically synthesized
agactaagactctgacctttca

SEQ ID NO: 1385675 - DNA, 22 bp, Artificial Sequence
  chemically synthesized
gttcagactaagactctgacct

SEQ ID NO: 1385676 - DNA, 22 bp, Artificial Sequence
  chemically synthesized
tagttcagactaagactctgac

SEQ ID NO: 1385677 - DNA, 22 bp, Artificial Sequence
  chemically synthesized
catgcatgcattctagttcaga

SEQ ID NO: 1385678 - DNA, 22 bp, Artificial Sequence
  chemically synthesized
acatgcatgcattctagttcag

SEQ ID NO: 1385679 - DNA, 22 bp, Artificial Sequence
  chemically synthesized
agtctgaactagaatgcatgca

SEQ ID NO: 1385680 - DNA, 22 bp, Artificial Sequence
  chemically synthesized
gtctgaactagaatgcatgcat

SEQ ID NO: 1385681 - DNA, 22 bp, Artificial Sequence
  chemically synthesized
gcatgtgccttacatgcatgca

SEQ ID NO: 1385682 - DNA, 22 bp, Artificial Sequence
  chemically synthesized
tagcatgtgccttacatgcatg

SEQ ID NO: 1385683 - DNA, 22 bp, Artificial Sequence
  chemically synthesized
ctagcatgtgccttacatgcat

SEQ ID NO: 1385684 - DNA, 22 bp, Artificial Sequence
  chemically synthesized
aactagaatgcatgcatgtaag

SEQ ID NO: 1385685 - DNA, 22 bp, Artificial Sequence
  chemically synthesized
gaatgcatgcatgtaaggcaca

SEQ ID NO: 1385686 - DNA, 22 bp, Artificial Sequence
  chemically synthesized
acaaatttctagcatgtgcctt

SEQ ID NO: 1385687 - DNA, 22 bp, Artificial Sequence
  chemically synthesized
ctcacaaatttctagcatgtgc

SEQ ID NO: 1385688 - DNA, 22 bp, Artificial Sequence
  chemically synthesized
gctcacaaatttctagcatgtg

SEQ ID NO: 1385689 - DNA, 22 bp, Artificial Sequence
  chemically synthesized
tgctcacaaatttctagcatgt

SEQ ID NO: 1385690 - DNA, 22 bp, Artificial Sequence
  chemically synthesized
ctttgctcacaaatttctagca

SEQ ID NO: 1385691 - DNA, 22 bp, Artificial Sequence
  chemically synthesized
cctttgctcacaaatttctagc

SEQ ID NO: 1385692 - DNA, 22 bp, Artificial Sequence
  chemically synthesized
ttcctttgctcacaaatttcta

SEQ ID NO: 1385693 - DNA, 22 bp, Artificial Sequence
  chemically synthesized
cttcctttgctcacaaatttct

SEQ ID NO: 1385694 - DNA, 22 bp, Artificial Sequence
  chemically synthesized
acttcttcctttgctcacaaat

SEQ ID NO: 1385695 - DNA, 22 bp, Artificial Sequence
  chemically synthesized
tcacttcttcctttgctcacaa

SEQ ID NO: 1385696 - DNA, 22 bp, Artificial Sequence
  chemically synthesized
ctcacttcttcctttgctcaca

SEQ ID NO: 1385697 - DNA, 22 bp, Artificial Sequence
  chemically synthesized
tctcacttcttcctttgctcac

SEQ ID NO: 1385698 - DNA, 22 bp, Artificial Sequence
  chemically synthesized
ttctcacttcttcctttgctca

SEQ ID NO: 1385699 - DNA, 22 bp, Artificial Sequence
  chemically synthesized
tttctcacttcttcctttgctc

SEQ ID NO: 1385700 - DNA, 22 bp, Artificial Sequence
  chemically synthesized
ttttctcacttcttcctttgct

SEQ ID NO: 1385701 - DNA, 22 bp, Artificial Sequence
  chemically synthesized
gaaatttgtgagcaaaggaaga

SEQ ID NO: 1385702 - DNA, 22 bp, Artificial Sequence
  chemically synthesized
atttttttctcacttcttcctt

SEQ ID NO: 1385703 - DNA, 22 bp, Artificial Sequence
  chemically synthesized
gtgagcaaaggaagaagtgaga

SEQ ID NO: 1385704 - DNA, 22 bp, Artificial Sequence
  chemically synthesized
tgagcaaaggaagaagtgagaa

SEQ ID NO: 1385705 - DNA, 22 bp, Artificial Sequence
  chemically synthesized
aatattcatttttttctcactt

SEQ ID NO: 1385706 - DNA, 22 bp, Artificial Sequence
  chemically synthesized
ctaaatattcatttttttctca

SEQ ID NO: 1385707 - DNA, 22 bp, Artificial Sequence
  chemically synthesized
actaaatattcatttttttctc

SEQ ID NO: 1385708 - DNA, 22 bp, Artificial Sequence
  chemically synthesized
accttactaaatattcattttt

SEQ ID NO: 1385709 - DNA, 22 bp, Artificial Sequence
  chemically synthesized
caaattaaccttactaaatatt

SEQ ID NO: 1385710 - DNA, 22 bp, Artificial Sequence
  chemically synthesized
attacaaattaaccttactaaa

SEQ ID NO: 1385711 - DNA, 22 bp, Artificial Sequence
  chemically synthesized
tagactaattacaaattaacct

SEQ ID NO: 1385712 - DNA, 22 bp, Artificial Sequence
  chemically synthesized
tcctatagactaattacaaatt

SEQ ID NO: 1385713 - DNA, 22 bp, Artificial Sequence
  chemically synthesized
atcctatagactaattacaaat

SEQ ID NO: 1385714 - DNA, 22 bp, Artificial Sequence
  chemically synthesized
agtaaggttaatttgtaattag

SEQ ID NO: 1385715 - DNA, 22 bp, Artificial Sequence
  chemically synthesized
gtaaggttaatttgtaattagt

SEQ ID NO: 1385716 - DNA, 22 bp, Artificial Sequence
  chemically synthesized
caccttatcctatagactaatt

SEQ ID NO: 1385717 - DNA, 22 bp, Artificial Sequence
  chemically synthesized
cactccaccttatcctatagac

SEQ ID NO: 1385718 - DNA, 22 bp, Artificial Sequence
  chemically synthesized
atttgtaattagtctataggat

SEQ ID NO: 1385719 - DNA, 22 bp, Artificial Sequence
  chemically synthesized
tacactccaccttatcctatag

SEQ ID NO: 1385720 - DNA, 22 bp, Artificial Sequence
  chemically synthesized
ctacactccaccttatcctata

SEQ ID NO: 1385721 - DNA, 22 bp, Artificial Sequence
  chemically synthesized
gtaattagtctataggataagg

SEQ ID NO: 1385722 - DNA, 22 bp, Artificial Sequence
  chemically synthesized
taattagtctataggataaggt

SEQ ID NO: 1385723 - DNA, 22 bp, Artificial Sequence
  chemically synthesized
gtctataggataaggtggagtg

SEQ ID NO: 1385724 - DNA, 22 bp, Artificial Sequence
  chemically synthesized
gcagaatggtttctacactcca

SEQ ID NO: 1385725 - DNA, 22 bp, Artificial Sequence
  chemically synthesized
taggataaggtggagtgtagaa

SEQ ID NO: 1385726 - DNA, 22 bp, Artificial Sequence
  chemically synthesized
cctggcagaatggtttctacac

SEQ ID NO: 1385727 - DNA, 22 bp, Artificial Sequence
  chemically synthesized
atctccctggcagaatggtttc

SEQ ID NO: 1385728 - DNA, 22 bp, Artificial Sequence
  chemically synthesized
catctccctggcagaatggttt

SEQ ID NO: 1385729 - DNA, 22 bp, Artificial Sequence
  chemically synthesized
tcatctccctggcagaatggtt

SEQ ID NO: 1385730 - DNA, 22 bp, Artificial Sequence
  chemically synthesized
attttcatctccctggcagaat

SEQ ID NO: 1385731 - DNA, 22 bp, Artificial Sequence
  chemically synthesized
cctaattttcatctccctggca

SEQ ID NO: 1385732 - DNA, 22 bp, Artificial Sequence
  chemically synthesized
tgccagggagatgaaaattagg

SEQ ID NO: 1385733 - DNA, 22 bp, Artificial Sequence
  chemically synthesized
tacatgcaattccctaattttc

SEQ ID NO: 1385734 - DNA, 22 bp, Artificial Sequence
  chemically synthesized
gtacatgcaattccctaatttt

SEQ ID NO: 1385735 - DNA, 22 bp, Artificial Sequence
  chemically synthesized
ccagggagatgaaaattaggga

SEQ ID NO: 1385736 - DNA, 22 bp, Artificial Sequence
  chemically synthesized
atgaatttgtacatgcaattcc

SEQ ID NO: 1385737 - DNA, 22 bp, Artificial Sequence
  chemically synthesized
gctaatgaatttgtacatgcaa

SEQ ID NO: 1385738 - DNA, 22 bp, Artificial Sequence
  chemically synthesized
agctaatgaatttgtacatgca

SEQ ID NO: 1385739 - DNA, 22 bp, Artificial Sequence
  chemically synthesized
tagctaatgaatttgtacatgc

SEQ ID NO: 1385740 - DNA, 22 bp, Artificial Sequence
  chemically synthesized
ttttagctaatgaatttgtaca

SEQ ID NO: 1385741 - DNA, 22 bp, Artificial Sequence
  chemically synthesized
attttagctaatgaatttgtac

SEQ ID NO: 1385742 - DNA, 22 bp, Artificial Sequence
  chemically synthesized
gggaattgcatgtacaaattca

SEQ ID NO: 1385743 - DNA, 22 bp, Artificial Sequence
  chemically synthesized
catgtacaaattcattagctaa

SEQ ID NO: 1385744 - DNA, 22 bp, Artificial Sequence
  chemically synthesized
aaacaacagaaccttattttag

SEQ ID NO: 1385745 - DNA, 22 bp, Artificial Sequence
  chemically synthesized
attagctaaaataaggttctgt

SEQ ID NO: 1385746 - DNA, 22 bp, Artificial Sequence
  chemically synthesized
agagactcaaacaacagaacct

SEQ ID NO: 1385747 - DNA, 22 bp, Artificial Sequence
  chemically synthesized
gagagactcaaacaacagaacc

SEQ ID NO: 1385748 - DNA, 22 bp, Artificial Sequence
  chemically synthesized
tgagagactcaaacaacagaac

SEQ ID NO: 1385749 - DNA, 22 bp, Artificial Sequence
  chemically synthesized
gctaaaataaggttctgttgtt

SEQ ID NO: 1385750 - DNA, 22 bp, Artificial Sequence
  chemically synthesized
ttgagagactcaaacaacagaa

SEQ ID NO: 1385751 - DNA, 22 bp, Artificial Sequence
  chemically synthesized
ttttgagagactcaaacaacag

SEQ ID NO: 1385752 - DNA, 22 bp, Artificial Sequence
  chemically synthesized
cttttgagagactcaaacaaca

SEQ ID NO: 1385753 - DNA, 22 bp, Artificial Sequence
  chemically synthesized
aaataaggttctgttgtttgag

SEQ ID NO: 1385754 - DNA, 22 bp, Artificial Sequence
  chemically synthesized
agaagtgatttcttttgagaga

SEQ ID NO: 1385755 - DNA, 22 bp, Artificial Sequence
  chemically synthesized
tgttgtttgagtctctcaaaag

SEQ ID NO: 1385756 - DNA, 22 bp, Artificial Sequence
  chemically synthesized
ttgtttgagtctctcaaaagaa

SEQ ID NO: 1385757 - DNA, 22 bp, Artificial Sequence
  chemically synthesized
ttgagaagtgatttcttttgag

SEQ ID NO: 1385758 - DNA, 22 bp, Artificial Sequence
  chemically synthesized
tttgagtctctcaaaagaaatc

SEQ ID NO: 1385759 - DNA, 22 bp, Artificial Sequence
  chemically synthesized
gagtctctcaaaagaaatcact

SEQ ID NO: 1385760 - DNA, 22 bp, Artificial Sequence
  chemically synthesized
agtctctcaaaagaaatcactt

SEQ ID NO: 1385761 - DNA, 22 bp, Artificial Sequence
  chemically synthesized
cataactattgagaagtgattt

SEQ ID NO: 1385762 - DNA, 22 bp, Artificial Sequence
  chemically synthesized
acataactattgagaagtgatt

SEQ ID NO: 1385763 - DNA, 22 bp, Artificial Sequence
  chemically synthesized
tcaaaagaaatcacttctcaat

SEQ ID NO: 1385764 - DNA, 22 bp, Artificial Sequence
  chemically synthesized
aaaagaaatcacttctcaatag

SEQ ID NO: 1385765 - DNA, 22 bp, Artificial Sequence
  chemically synthesized
agtatttacataactattgaga

SEQ ID NO: 1385766 - DNA, 22 bp, Artificial Sequence
  chemically synthesized
cagtatttacataactattgag

SEQ ID NO: 1385767 - DNA, 22 bp, Artificial Sequence
  chemically synthesized
tatttcagtatttacataacta

SEQ ID NO: 1385768 - DNA, 22 bp, Artificial Sequence
  chemically synthesized
ctcaatagttatgtaaatactg

SEQ ID NO: 1385769 - DNA, 22 bp, Artificial Sequence
  chemically synthesized
aaagttgtatttcagtatttac

SEQ ID NO: 1385770 - DNA, 22 bp, Artificial Sequence
  chemically synthesized
tcaatagttatgtaaatactga

SEQ ID NO: 1385771 - DNA, 22 bp, Artificial Sequence
  chemically synthesized
caaagttgtatttcagtattta

SEQ ID NO: 1385772 - DNA, 22 bp, Artificial Sequence
  chemically synthesized
tcaaagttgtatttcagtattt

SEQ ID NO: 1385773 - DNA, 22 bp, Artificial Sequence
  chemically synthesized
aatagttatgtaaatactgaaa

SEQ ID NO: 1385774 - DNA, 22 bp, Artificial Sequence
  chemically synthesized
ttttcaaagttgtatttcagta

SEQ ID NO: 1385775 - DNA, 22 bp, Artificial Sequence
  chemically synthesized
tgtaaatactgaaatacaactt

SEQ ID NO: 1385776 - DNA, 22 bp, Artificial Sequence
  chemically synthesized
aaaattattttcaaagttgtat

SEQ ID NO: 1385777 - DNA, 22 bp, Artificial Sequence
  chemically synthesized
gtactaaaaattattttcaaag

SEQ ID NO: 1385778 - DNA, 22 bp, Artificial Sequence
  chemically synthesized
aaatacaactttgaaaataatt

SEQ ID NO: 1385779 - DNA, 22 bp, Artificial Sequence
  chemically synthesized
atggctagtactaaaaattatt

SEQ ID NO: 1385780 - DNA, 22 bp, Artificial Sequence
  chemically synthesized
gatggctagtactaaaaattat

SEQ ID NO: 1385781 - DNA, 22 bp, Artificial Sequence
  chemically synthesized
tgatggctagtactaaaaatta

SEQ ID NO: 1385782 - DNA, 22 bp, Artificial Sequence
  chemically synthesized
tgaaaataatttttagtactag

SEQ ID NO: 1385783 - DNA, 22 bp, Artificial Sequence
  chemically synthesized
gaaaataatttttagtactagc

SEQ ID NO: 1385784 - DNA, 22 bp, Artificial Sequence
  chemically synthesized
aaaataatttttagtactagcc

SEQ ID NO: 1385785 - DNA, 22 bp, Artificial Sequence
  chemically synthesized
ttagtactagccatcaaaattt

SEQ ID NO: 1385786 - DNA, 22 bp, Artificial Sequence
  chemically synthesized
tagtactagccatcaaaatttg

SEQ ID NO: 1385787 - DNA, 22 bp, Artificial Sequence
  chemically synthesized
agtactagccatcaaaatttgg

SEQ ID NO: 1385788 - DNA, 22 bp, Artificial Sequence
  chemically synthesized
gtactagccatcaaaatttggg

SEQ ID NO: 1385789 - DNA, 22 bp, Artificial Sequence
  chemically synthesized
tacatcataagccccaaatttt

SEQ ID NO: 1385790 - DNA, 22 bp, Artificial Sequence
  chemically synthesized
gtacatcataagccccaaattt

SEQ ID NO: 1385791 - DNA, 22 bp, Artificial Sequence
  chemically synthesized
gccatcaaaatttggggcttat

SEQ ID NO: 1385792 - DNA, 22 bp, Artificial Sequence
  chemically synthesized
aaacacacagtttgtacatcat

SEQ ID NO: 1385793 - DNA, 22 bp, Artificial Sequence
  chemically synthesized
gaaacacacagtttgtacatca

SEQ ID NO: 1385794 - DNA, 22 bp, Artificial Sequence
  chemically synthesized
ggggcttatgatgtacaaactg

SEQ ID NO: 1385795 - DNA, 22 bp, Artificial Sequence
  chemically synthesized
gggcttatgatgtacaaactgt

SEQ ID NO: 1385796 - DNA, 22 bp, Artificial Sequence
  chemically synthesized
atgatgtacaaactgtgtgttt

SEQ ID NO: 1385797 - DNA, 22 bp, Artificial Sequence
  chemically synthesized
tgatgtacaaactgtgtgtttc

SEQ ID NO: 1385798 - DNA, 22 bp, Artificial Sequence
  chemically synthesized
tgtgtttcaaacactactgatg

SEQ ID NO: 1385799 - DNA, 22 bp, Artificial Sequence
  chemically synthesized
gatggcagatcccatcagtagt

SEQ ID NO: 1385800 - DNA, 22 bp, Artificial Sequence
  chemically synthesized
ctcgatggcagatcccatcagt

SEQ ID NO: 1385801 - DNA, 22 bp, Artificial Sequence
  chemically synthesized
caaacactactgatgggatctg

SEQ ID NO: 1385802 - DNA, 22 bp, Artificial Sequence
  chemically synthesized
aaacactactgatgggatctgc

SEQ ID NO: 1385803 - DNA, 22 bp, Artificial Sequence
  chemically synthesized
agtcatgggctcctcgatggca

SEQ ID NO: 1385804 - DNA, 22 bp, Artificial Sequence
  chemically synthesized
ctgatgggatctgccatcgagg

SEQ ID NO: 1385805 - DNA, 22 bp, Artificial Sequence
  chemically synthesized
atgggatctgccatcgaggagc

SEQ ID NO: 1385806 - DNA, 22 bp, Artificial Sequence
  chemically synthesized
ccatcgaggagcccatgactga

SEQ ID NO: 1385807 - DNA, 22 bp, Artificial Sequence
  chemically synthesized
agattcctggtatgtgctatat

SEQ ID NO: 1385808 - DNA, 22 bp, Artificial Sequence
  chemically synthesized
ctggtatgtgctatatctgtat

SEQ ID NO: 1385809 - DNA, 22 bp, Artificial Sequence
  chemically synthesized
gaggaggcagatatacagatat

SEQ ID NO: 1385810 - DNA, 22 bp, Artificial Sequence
  chemically synthesized
gtatgtgctatatctgtatatc

SEQ ID NO: 1385811 - DNA, 22 bp, Artificial Sequence
  chemically synthesized
ctggaggaggcagatatacaga

SEQ ID NO: 1385812 - DNA, 22 bp, Artificial Sequence
  chemically synthesized
cctggaggaggcagatatacag

SEQ ID NO: 1385813 - DNA, 22 bp, Artificial Sequence
  chemically synthesized
aaatcttcctggaggaggcaga

SEQ ID NO: 1385814 - DNA, 22 bp, Artificial Sequence
  chemically synthesized
tatctgtatatctgcctcctcc

SEQ ID NO: 1385815 - DNA, 22 bp, Artificial Sequence
  chemically synthesized
tatatctgcctcctccaggaag

SEQ ID NO: 1385816 - DNA, 22 bp, Artificial Sequence
  chemically synthesized
aggccctcaaatcttcctggag

SEQ ID NO: 1385817 - DNA, 22 bp, Artificial Sequence
  chemically synthesized
tgaggccctcaaatcttcctgg

SEQ ID NO: 1385818 - DNA, 22 bp, Artificial Sequence
  chemically synthesized
ctgaggccctcaaatcttcctg

SEQ ID NO: 1385819 - DNA, 22 bp, Artificial Sequence
  chemically synthesized
cctcctccaggaagatttgagg

SEQ ID NO: 1385820 - DNA, 22 bp, Artificial Sequence
  chemically synthesized
ctccaggaagatttgagggcct

SEQ ID NO: 1385821 - DNA, 22 bp, Artificial Sequence
  chemically synthesized
gaaaaagtttctgaggccctca

SEQ ID NO: 1385822 - DNA, 22 bp, Artificial Sequence
  chemically synthesized
ggaaaaagtttctgaggccctc

SEQ ID NO: 1385823 - DNA, 22 bp, Artificial Sequence
  chemically synthesized
caggaagatttgagggcctcag

SEQ ID NO: 1385824 - DNA, 22 bp, Artificial Sequence
  chemically synthesized
taaacgtttggaaaaagtttct

SEQ ID NO: 1385825 - DNA, 22 bp, Artificial Sequence
  chemically synthesized
gagggcctcagaaactttttcc

SEQ ID NO: 1385826 - DNA, 22 bp, Artificial Sequence
  chemically synthesized
ttataaacgtttggaaaaagtt

SEQ ID NO: 1385827 - DNA, 22 bp, Artificial Sequence
  chemically synthesized
agggcctcagaaactttttcca

SEQ ID NO: 1385828 - DNA, 22 bp, Artificial Sequence
  chemically synthesized
gttataaacgtttggaaaaagt

SEQ ID NO: 1385829 - DNA, 22 bp, Artificial Sequence
  chemically synthesized
agaaactttttccaaacgttta

SEQ ID NO: 1385830 - DNA, 22 bp, Artificial Sequence
  chemically synthesized
ggatccttgttataaacgtttg

SEQ ID NO: 1385831 - DNA, 22 bp, Artificial Sequence
  chemically synthesized
aggatccttgttataaacgttt

SEQ ID NO: 1385832 - DNA, 22 bp, Artificial Sequence
  chemically synthesized
tttccaaacgtttataacaagg

SEQ ID NO: 1385833 - DNA, 22 bp, Artificial Sequence
  chemically synthesized
ttccaaacgtttataacaagga

SEQ ID NO: 1385834 - DNA, 22 bp, Artificial Sequence
  chemically synthesized
tccaaacgtttataacaaggat

SEQ ID NO: 1385835 - DNA, 22 bp, Artificial Sequence
  chemically synthesized
ccaaacgtttataacaaggatc

SEQ ID NO: 1385836 - DNA, 22 bp, Artificial Sequence
  chemically synthesized
caaacgtttataacaaggatcc

SEQ ID NO: 1385837 - DNA, 22 bp, Artificial Sequence
  chemically synthesized
tgaaggcaatagtcttaggatc

SEQ ID NO: 1385838 - DNA, 22 bp, Artificial Sequence
  chemically synthesized
ataacaaggatcctaagactat

SEQ ID NO: 1385839 - DNA, 22 bp, Artificial Sequence
  chemically synthesized
gctatgaaggcaatagtcttag

SEQ ID NO: 1385840 - DNA, 22 bp, Artificial Sequence
  chemically synthesized
taacaaggatcctaagactatt

SEQ ID NO: 1385841 - DNA, 22 bp, Artificial Sequence
  chemically synthesized
ctcgctatgaaggcaatagtct

SEQ ID NO: 1385842 - DNA, 22 bp, Artificial Sequence
  chemically synthesized
cctcgctatgaaggcaatagtc

SEQ ID NO: 1385843 - DNA, 22 bp, Artificial Sequence
  chemically synthesized
gcttcctcgctatgaaggcaat

SEQ ID NO: 1385844 - DNA, 22 bp, Artificial Sequence
  chemically synthesized
ctggcttcctcgctatgaaggc

SEQ ID NO: 1385845 - DNA, 22 bp, Artificial Sequence
  chemically synthesized
agactattgccttcatagcgag

SEQ ID NO: 1385846 - DNA, 22 bp, Artificial Sequence
  chemically synthesized
attgctggcttcctcgctatga

SEQ ID NO: 1385847 - DNA, 22 bp, Artificial Sequence
  chemically synthesized
ttgccttcatagcgaggaagcc

SEQ ID NO: 1385848 - DNA, 22 bp, Artificial Sequence
  chemically synthesized
ccttcatagcgaggaagccagc

SEQ ID NO: 1385849 - DNA, 22 bp, Artificial Sequence
  chemically synthesized
catagcgaggaagccagcaatg

SEQ ID NO: 1385850 - DNA, 22 bp, Artificial Sequence
  chemically synthesized
atagcgaggaagccagcaatga

SEQ ID NO: 1385851 - DNA, 22 bp, Artificial Sequence
  chemically synthesized
tccaggatccagctcattgctg

SEQ ID NO: 1385852 - DNA, 22 bp, Artificial Sequence
  chemically synthesized
cccatgtcaggggccagcatgc

SEQ ID NO: 1385853 - DNA, 22 bp, Artificial Sequence
  chemically synthesized
gatcctggacagcatgctggcc

SEQ ID NO: 1385854 - DNA, 22 bp, Artificial Sequence
  chemically synthesized
ttgcccatgtcaggggccagca

SEQ ID NO: 1385855 - DNA, 22 bp, Artificial Sequence
  chemically synthesized
gttgcccatgtcaggggccagc

SEQ ID NO: 1385856 - DNA, 22 bp, Artificial Sequence
  chemically synthesized
gacagcatgctggcccctgaca

SEQ ID NO: 1385857 - DNA, 22 bp, Artificial Sequence
  chemically synthesized
atttgttgcccatgtcaggggc

SEQ ID NO: 1385858 - DNA, 22 bp, Artificial Sequence
  chemically synthesized
tggcccatctaatttgttgccc

SEQ ID NO: 1385859 - DNA, 22 bp, Artificial Sequence
  chemically synthesized
gcccctgacatgggcaacaaat

SEQ ID NO: 1385860 - DNA, 22 bp, Artificial Sequence
  chemically synthesized
tgtggcccatctaatttgttgc

SEQ ID NO: 1385861 - DNA, 22 bp, Artificial Sequence
  chemically synthesized
ggttctgtggcccatctaattt

SEQ ID NO: 1385862 - DNA, 22 bp, Artificial Sequence
  chemically synthesized
acatgggcaacaaattagatgg

SEQ ID NO: 1385863 - DNA, 22 bp, Artificial Sequence
  chemically synthesized
tagaaattaggttctgtggccc

SEQ ID NO: 1385864 - DNA, 22 bp, Artificial Sequence
  chemically synthesized
gatgggccacagaacctaattt

SEQ ID NO: 1385865 - DNA, 22 bp, Artificial Sequence
  chemically synthesized
tggtgagtcaaggctatagaaa

SEQ ID NO: 1385866 - DNA, 22 bp, Artificial Sequence
  chemically synthesized
atttctatagccttgactcacc

SEQ ID NO: 1385867 - DNA, 22 bp, Artificial Sequence
  chemically synthesized
ctatagccttgactcaccacag

SEQ ID NO: 1385868 - DNA, 22 bp, Artificial Sequence
  chemically synthesized
tatagccttgactcaccacagg

SEQ ID NO: 1385869 - DNA, 22 bp, Artificial Sequence
  chemically synthesized
tagccttgactcaccacaggtt

SEQ ID NO: 1385870 - DNA, 22 bp, Artificial Sequence
  chemically synthesized
tgcgggagagcataaacctgtg

SEQ ID NO: 1385871 - DNA, 22 bp, Artificial Sequence
  chemically synthesized
gactcaccacaggtttatgctc

SEQ ID NO: 1385872 - DNA, 22 bp, Artificial Sequence
  chemically synthesized
actcaccacaggtttatgctct

SEQ ID NO: 1385873 - DNA, 22 bp, Artificial Sequence
  chemically synthesized
accacaggtttatgctctcccg

SEQ ID NO: 1385874 - DNA, 22 bp, Artificial Sequence
  chemically synthesized
ccccaatgccattgtgcgggag

SEQ ID NO: 1385875 - DNA, 22 bp, Artificial Sequence
  chemically synthesized
gccccaatgccattgtgcggga

SEQ ID NO: 1385876 - DNA, 22 bp, Artificial Sequence
  chemically synthesized
atgctctcccgcacaatggcat

SEQ ID NO: 1385877 - DNA, 22 bp, Artificial Sequence
  chemically synthesized
tgctctcccgcacaatggcatt

SEQ ID NO: 1385878 - DNA, 22 bp, Artificial Sequence
  chemically synthesized
tcccgcacaatggcattggggc

SEQ ID NO: 1385879 - DNA, 22 bp, Artificial Sequence
  chemically synthesized
ccgcacaatggcattggggcaa

SEQ ID NO: 1385880 - DNA, 22 bp, Artificial Sequence
  chemically synthesized
gggcaagtttatgtctttgtcg

SEQ ID NO: 1385881 - DNA, 22 bp, Artificial Sequence
  chemically synthesized
gaaaacaaacagcacaacacga

SEQ ID NO: 1385882 - DNA, 22 bp, Artificial Sequence
  chemically synthesized
agaaaacaaacagcacaacacg

SEQ ID NO: 1385883 - DNA, 22 bp, Artificial Sequence
  chemically synthesized
atgtctttgtcgtgttgtgctg

SEQ ID NO: 1385884 - DNA, 22 bp, Artificial Sequence
  chemically synthesized
tgtctttgtcgtgttgtgctgt

SEQ ID NO: 1385885 - DNA, 22 bp, Artificial Sequence
  chemically synthesized
cttagaaaacaaacagcacaac

SEQ ID NO: 1385886 - DNA, 22 bp, Artificial Sequence
  chemically synthesized
gcttagaaaacaaacagcacaa

SEQ ID NO: 1385887 - DNA, 22 bp, Artificial Sequence
  chemically synthesized
tgcttagaaaacaaacagcaca

SEQ ID NO: 1385888 - DNA, 22 bp, Artificial Sequence
  chemically synthesized
tgtcgtgttgtgctgtttgttt

SEQ ID NO: 1385889 - DNA, 22 bp, Artificial Sequence
  chemically synthesized
gtcgtgttgtgctgtttgtttt

SEQ ID NO: 1385890 - DNA, 22 bp, Artificial Sequence
  chemically synthesized
ccctttgcttagaaaacaaaca

SEQ ID NO: 1385891 - DNA, 22 bp, Artificial Sequence
  chemically synthesized
tcgtgttgtgctgtttgttttc

SEQ ID NO: 1385892 - DNA, 22 bp, Artificial Sequence
  chemically synthesized
tgctgtttgttttctaagcaaa

SEQ ID NO: 1385893 - DNA, 22 bp, Artificial Sequence
  chemically synthesized
tttgttttctaagcaaagggca

SEQ ID NO: 1385894 - DNA, 22 bp, Artificial Sequence
  chemically synthesized
gttttctaagcaaagggcagtc

SEQ ID NO: 1385895 - DNA, 22 bp, Artificial Sequence
  chemically synthesized
ttttctaagcaaagggcagtct

SEQ ID NO: 1385896 - DNA, 22 bp, Artificial Sequence
  chemically synthesized
gcatgagataggagactgccct

SEQ ID NO: 1385897 - DNA, 22 bp, Artificial Sequence
  chemically synthesized
ggcatgagataggagactgccc

SEQ ID NO: 1385898 - DNA, 22 bp, Artificial Sequence
  chemically synthesized
tctaagcaaagggcagtctcct

SEQ ID NO: 1385899 - DNA, 22 bp, Artificial Sequence
  chemically synthesized
ctaagcaaagggcagtctccta

SEQ ID NO: 1385900 - DNA, 22 bp, Artificial Sequence
  chemically synthesized
taagcaaagggcagtctcctat

SEQ ID NO: 1385901 - DNA, 22 bp, Artificial Sequence
  chemically synthesized
aatttggcatgagataggagac

SEQ ID NO: 1385902 - DNA, 22 bp, Artificial Sequence
  chemically synthesized
agcaaagggcagtctcctatct

SEQ ID NO: 1385903 - DNA, 22 bp, Artificial Sequence
  chemically synthesized
aaatttggcatgagataggaga

SEQ ID NO: 1385904 - DNA, 22 bp, Artificial Sequence
  chemically synthesized
taaatttggcatgagataggag

SEQ ID NO: 1385905 - DNA, 22 bp, Artificial Sequence
  chemically synthesized
aattttaaatttggcatgagat

SEQ ID NO: 1385906 - DNA, 22 bp, Artificial Sequence
  chemically synthesized
ctatctcatgccaaatttaaaa

SEQ ID NO: 1385907 - DNA, 22 bp, Artificial Sequence
  chemically synthesized
atgcagcctgaattttaaattt

SEQ ID NO: 1385908 - DNA, 22 bp, Artificial Sequence
  chemically synthesized
catgcagcctgaattttaaatt

SEQ ID NO: 1385909 - DNA, 22 bp, Artificial Sequence
  chemically synthesized
tctcatgccaaatttaaaattc

SEQ ID NO: 1385910 - DNA, 22 bp, Artificial Sequence
  chemically synthesized
atgccaaatttaaaattcaggc

SEQ ID NO: 1385911 - DNA, 22 bp, Artificial Sequence
  chemically synthesized
agatttcatgcagcctgaattt

SEQ ID NO: 1385912 - DNA, 22 bp, Artificial Sequence
  chemically synthesized
taagatttcatgcagcctgaat

SEQ ID NO: 1385913 - DNA, 22 bp, Artificial Sequence
  chemically synthesized
aaaattcaggctgcatgaaatc

SEQ ID NO: 1385914 - DNA, 22 bp, Artificial Sequence
  chemically synthesized
aaattcaggctgcatgaaatct

SEQ ID NO: 1385915 - DNA, 22 bp, Artificial Sequence
  chemically synthesized
agtgaaatctctaagatttcat

SEQ ID NO: 1385916 - DNA, 22 bp, Artificial Sequence
  chemically synthesized
aagtgaaatctctaagatttca

SEQ ID NO: 1385917 - DNA, 22 bp, Artificial Sequence
  chemically synthesized
aggctgcatgaaatcttagaga

SEQ ID NO: 1385918 - DNA, 22 bp, Artificial Sequence
  chemically synthesized
catgaaatcttagagatttcac

SEQ ID NO: 1385919 - DNA, 22 bp, Artificial Sequence
  chemically synthesized
cacaaaagcttaagtgaaatct

SEQ ID NO: 1385920 - DNA, 22 bp, Artificial Sequence
  chemically synthesized
gcacaaaagcttaagtgaaatc

SEQ ID NO: 1385921 - DNA, 22 bp, Artificial Sequence
  chemically synthesized
atttgcacaaaagcttaagtga

SEQ ID NO: 1385922 - DNA, 22 bp, Artificial Sequence
  chemically synthesized
agagatttcacttaagcttttg

SEQ ID NO: 1385923 - DNA, 22 bp, Artificial Sequence
  chemically synthesized
gagatttcacttaagcttttgt

SEQ ID NO: 1385924 - DNA, 22 bp, Artificial Sequence
  chemically synthesized
cacttaagcttttgtgcaaatt

SEQ ID NO: 1385925 - DNA, 22 bp, Artificial Sequence
  chemically synthesized
acttaagcttttgtgcaaatta

SEQ ID NO: 1385926 - DNA, 22 bp, Artificial Sequence
  chemically synthesized
aatcaaaccaactaatttgcac

SEQ ID NO: 1385927 - DNA, 22 bp, Artificial Sequence
  chemically synthesized
aagcttttgtgcaaattagttg

SEQ ID NO: 1385928 - DNA, 22 bp, Artificial Sequence
  chemically synthesized
attcaatcaaaccaactaattt

SEQ ID NO: 1385929 - DNA, 22 bp, Artificial Sequence
  chemically synthesized
agcttttgtgcaaattagttgg

SEQ ID NO: 1385930 - DNA, 22 bp, Artificial Sequence
  chemically synthesized
ttgtgcaaattagttggtttga

SEQ ID NO: 1385931 - DNA, 22 bp, Artificial Sequence
  chemically synthesized
tgtgcaaattagttggtttgat

SEQ ID NO: 1385932 - DNA, 22 bp, Artificial Sequence
  chemically synthesized
gtgcaaattagttggtttgatt

SEQ ID NO: 1385933 - DNA, 22 bp, Artificial Sequence
  chemically synthesized
tgcaaattagttggtttgattg

SEQ ID NO: 1385934 - DNA, 22 bp, Artificial Sequence
  chemically synthesized
taccatacactgattcaatcaa

SEQ ID NO: 1385935 - DNA, 22 bp, Artificial Sequence
  chemically synthesized
ggctgtaccatacactgattca

SEQ ID NO: 1385936 - DNA, 22 bp, Artificial Sequence
  chemically synthesized
gttggtttgattgaatcagtgt

SEQ ID NO: 1385937 - DNA, 22 bp, Artificial Sequence
  chemically synthesized
ctaggctgtaccatacactgat

SEQ ID NO: 1385938 - DNA, 22 bp, Artificial Sequence
  chemically synthesized
actaggctgtaccatacactga

SEQ ID NO: 1385939 - DNA, 22 bp, Artificial Sequence
  chemically synthesized
gtttgattgaatcagtgtatgg

SEQ ID NO: 1385940 - DNA, 22 bp, Artificial Sequence
  chemically synthesized
gattgaatcagtgtatggtaca

SEQ ID NO: 1385941 - DNA, 22 bp, Artificial Sequence
  chemically synthesized
attgaatcagtgtatggtacag

SEQ ID NO: 1385942 - DNA, 22 bp, Artificial Sequence
  chemically synthesized
aatcagtgtatggtacagccta

SEQ ID NO: 1385943 - DNA, 22 bp, Artificial Sequence
  chemically synthesized
aatgaatataagaatgacattt

SEQ ID NO: 1385944 - DNA, 22 bp, Artificial Sequence
  chemically synthesized
gaatgaatataagaatgacatt

SEQ ID NO: 1385945 - DNA, 22 bp, Artificial Sequence
  chemically synthesized
tgaatgaatataagaatgacat

SEQ ID NO: 1385946 - DNA, 22 bp, Artificial Sequence
  chemically synthesized
ttgaatgaatataagaatgaca

SEQ ID NO: 1385947 - DNA, 22 bp, Artificial Sequence
  chemically synthesized
ttttgaatgaatataagaatga

SEQ ID NO: 1385948 - DNA, 22 bp, Artificial Sequence
  chemically synthesized
gtaaatgtcattcttatattca

SEQ ID NO: 1385949 - DNA, 22 bp, Artificial Sequence
  chemically synthesized
tagaagcatgtattcttttgaa

SEQ ID NO: 1385950 - DNA, 22 bp, Artificial Sequence
  chemically synthesized
gtagaagcatgtattcttttga

SEQ ID NO: 1385951 - DNA, 22 bp, Artificial Sequence
  chemically synthesized
ttatattcattcaaaagaatac

SEQ ID NO: 1385952 - DNA, 22 bp, Artificial Sequence
  chemically synthesized
atattcattcaaaagaatacat

SEQ ID NO: 1385953 - DNA, 22 bp, Artificial Sequence
  chemically synthesized
tattcattcaaaagaatacatg

SEQ ID NO: 1385954 - DNA, 22 bp, Artificial Sequence
  chemically synthesized
attcaaaagaatacatgcttct

SEQ ID NO: 1385955 - DNA, 22 bp, Artificial Sequence
  chemically synthesized
tgagcaaatttgtagaagcatg

SEQ ID NO: 1385956 - DNA, 22 bp, Artificial Sequence
  chemically synthesized
atgagcaaatttgtagaagcat

SEQ ID NO: 1385957 - DNA, 22 bp, Artificial Sequence
  chemically synthesized
tatgagcaaatttgtagaagca

SEQ ID NO: 1385958 - DNA, 22 bp, Artificial Sequence
  chemically synthesized
aaaagaatacatgcttctacaa

SEQ ID NO: 1385959 - DNA, 22 bp, Artificial Sequence
  chemically synthesized
attttatgagcaaatttgtaga

SEQ ID NO: 1385960 - DNA, 22 bp, Artificial Sequence
  chemically synthesized
ctaattttatgagcaaatttgt

SEQ ID NO: 1385961 - DNA, 22 bp, Artificial Sequence
  chemically synthesized
attgctaattttatgagcaaat

SEQ ID NO: 1385962 - DNA, 22 bp, Artificial Sequence
  chemically synthesized
ctacaaatttgctcataaaatt

SEQ ID NO: 1385963 - DNA, 22 bp, Artificial Sequence
  chemically synthesized
tacaaatttgctcataaaatta

SEQ ID NO: 1385964 - DNA, 22 bp, Artificial Sequence
  chemically synthesized
caaatttgctcataaaattagc

SEQ ID NO: 1385965 - DNA, 22 bp, Artificial Sequence
  chemically synthesized
caccagtattcattgctaattt

SEQ ID NO: 1385966 - DNA, 22 bp, Artificial Sequence
  chemically synthesized
tccaccagtattcattgctaat

SEQ ID NO: 1385967 - DNA, 22 bp, Artificial Sequence
  chemically synthesized
gctcataaaattagcaatgaat

SEQ ID NO: 1385968 - DNA, 22 bp, Artificial Sequence
  chemically synthesized
ctcataaaattagcaatgaata

SEQ ID NO: 1385969 - DNA, 22 bp, Artificial Sequence
  chemically synthesized
ataaaattagcaatgaatactg

SEQ ID NO: 1385970 - DNA, 22 bp, Artificial Sequence
  chemically synthesized
ccatgtgtgactctccaccagt

SEQ ID NO: 1385971 - DNA, 22 bp, Artificial Sequence
  chemically synthesized
cccatgtgtgactctccaccag

SEQ ID NO: 1385972 - DNA, 22 bp, Artificial Sequence
  chemically synthesized
tcccatgtgtgactctccacca

SEQ ID NO: 1385973 - DNA, 22 bp, Artificial Sequence
  chemically synthesized
gcaatgaatactggtggagagt

SEQ ID NO: 1385974 - DNA, 22 bp, Artificial Sequence
  chemically synthesized
tttcccatgtgtgactctccac

SEQ ID NO: 1385975 - DNA, 22 bp, Artificial Sequence
  chemically synthesized
tctttcccatgtgtgactctcc

SEQ ID NO: 1385976 - DNA, 22 bp, Artificial Sequence
  chemically synthesized
ctctttcccatgtgtgactctc

SEQ ID NO: 1385977 - DNA, 22 bp, Artificial Sequence
  chemically synthesized
tctctttcccatgtgtgactct

SEQ ID NO: 1385978 - DNA, 22 bp, Artificial Sequence
  chemically synthesized
gtggagagtcacacatgggaaa

SEQ ID NO: 1385979 - DNA, 22 bp, Artificial Sequence
  chemically synthesized
tagccaggttttctctttccca

SEQ ID NO: 1385980 - DNA, 22 bp, Artificial Sequence
  chemically synthesized
atagccaggttttctctttccc

SEQ ID NO: 1385981 - DNA, 22 bp, Artificial Sequence
  chemically synthesized
agatttatagccaggttttctc

SEQ ID NO: 1385982 - DNA, 22 bp, Artificial Sequence
  chemically synthesized
gtcagtggtagagctgagattt

SEQ ID NO: 1385983 - DNA, 22 bp, Artificial Sequence
  chemically synthesized
agctagtcagtggtagagctga

SEQ ID NO: 1385984 - DNA, 22 bp, Artificial Sequence
  chemically synthesized
gctataaatctcagctctacca

SEQ ID NO: 1385985 - DNA, 22 bp, Artificial Sequence
  chemically synthesized
actcagctagtcagtggtagag

SEQ ID NO: 1385986 - DNA, 22 bp, Artificial Sequence
  chemically synthesized
taaatctcagctctaccactga

SEQ ID NO: 1385987 - DNA, 22 bp, Artificial Sequence
  chemically synthesized
gtgttaactcagctagtcagtg

SEQ ID NO: 1385988 - DNA, 22 bp, Artificial Sequence
  chemically synthesized
agctctaccactgactagctga

SEQ ID NO: 1385989 - DNA, 22 bp, Artificial Sequence
  chemically synthesized
aagttcgtgttaactcagctag

SEQ ID NO: 1385990 - DNA, 22 bp, Artificial Sequence
  chemically synthesized
aaagttcgtgttaactcagcta

SEQ ID NO: 1385991 - DNA, 22 bp, Artificial Sequence
  chemically synthesized
taccactgactagctgagttaa

SEQ ID NO: 1385992 - DNA, 22 bp, Artificial Sequence
  chemically synthesized
ccactgactagctgagttaaca

SEQ ID NO: 1385993 - DNA, 22 bp, Artificial Sequence
  chemically synthesized
aaagggcttaaagttcgtgtta

SEQ ID NO: 1385994 - DNA, 22 bp, Artificial Sequence
  chemically synthesized
actagctgagttaacacgaact

SEQ ID NO: 1385995 - DNA, 22 bp, Artificial Sequence
  chemically synthesized
gctgagttaacacgaactttaa

SEQ ID NO: 1385996 - DNA, 22 bp, Artificial Sequence
  chemically synthesized
agttaacacgaactttaagccc

SEQ ID NO: 1385997 - DNA, 22 bp, Artificial Sequence
  chemically synthesized
acacgaactttaagccctttta

SEQ ID NO: 1385998 - DNA, 22 bp, Artificial Sequence
  chemically synthesized
agatgagaaaagccaaagttaa

SEQ ID NO: 1385999 - DNA, 22 bp, Artificial Sequence
  chemically synthesized
cagatgagaaaagccaaagtta

SEQ ID NO: 1386000 - DNA, 22 bp, Artificial Sequence
  chemically synthesized
tcagatgagaaaagccaaagtt

SEQ ID NO: 1386001 - DNA, 22 bp, Artificial Sequence
  chemically synthesized
taagcccttttaactttggctt

SEQ ID NO: 1386002 - DNA, 22 bp, Artificial Sequence
  chemically synthesized
ttcagatgagaaaagccaaagt

SEQ ID NO: 1386003 - DNA, 22 bp, Artificial Sequence
  chemically synthesized
aagcccttttaactttggcttt

SEQ ID NO: 1386004 - DNA, 22 bp, Artificial Sequence
  chemically synthesized
agcccttttaactttggctttt

SEQ ID NO: 1386005 - DNA, 22 bp, Artificial Sequence
  chemically synthesized
cccatttttcagatgagaaaag

SEQ ID NO: 1386006 - DNA, 22 bp, Artificial Sequence
  chemically synthesized
ttaactttggcttttctcatct

SEQ ID NO: 1386007 - DNA, 22 bp, Artificial Sequence
  chemically synthesized
tgcccatttttcagatgagaaa

SEQ ID NO: 1386008 - DNA, 22 bp, Artificial Sequence
  chemically synthesized
taactttggcttttctcatctg

SEQ ID NO: 1386009 - DNA, 22 bp, Artificial Sequence
  chemically synthesized
ctgcccatttttcagatgagaa

SEQ ID NO: 1386010 - DNA, 22 bp, Artificial Sequence
  chemically synthesized
aactttggcttttctcatctga

SEQ ID NO: 1386011 - DNA, 22 bp, Artificial Sequence
  chemically synthesized
tctgcccatttttcagatgaga

SEQ ID NO: 1386012 - DNA, 22 bp, Artificial Sequence
  chemically synthesized
actttggcttttctcatctgaa

SEQ ID NO: 1386013 - DNA, 22 bp, Artificial Sequence
  chemically synthesized
tggcttttctcatctgaaaaat

SEQ ID NO: 1386014 - DNA, 22 bp, Artificial Sequence
  chemically synthesized
ggcttttctcatctgaaaaatg

SEQ ID NO: 1386015 - DNA, 22 bp, Artificial Sequence
  chemically synthesized
gcttttctcatctgaaaaatgg

SEQ ID NO: 1386016 - DNA, 22 bp, Artificial Sequence
  chemically synthesized
ttctcatctgaaaaatgggcag

SEQ ID NO: 1386017 - DNA, 22 bp, Artificial Sequence
  chemically synthesized
tctcatctgaaaaatgggcaga

SEQ ID NO: 1386018 - DNA, 22 bp, Artificial Sequence
  chemically synthesized
ctcatctgaaaaatgggcagaa

SEQ ID NO: 1386019 - DNA, 22 bp, Artificial Sequence
  chemically synthesized
tcatctgaaaaatgggcagaaa

SEQ ID NO: 1386020 - DNA, 22 bp, Artificial Sequence
  chemically synthesized
atctgaaaaatgggcagaaaat

SEQ ID NO: 1386021 - DNA, 22 bp, Artificial Sequence
  chemically synthesized
acaaaatcccacattttctgcc

SEQ ID NO: 1386022 - DNA, 22 bp, Artificial Sequence
  chemically synthesized
ctcacaaaatcccacattttct

SEQ ID NO: 1386023 - DNA, 22 bp, Artificial Sequence
  chemically synthesized
aaaaatgggcagaaaatgtggg

SEQ ID NO: 1386024 - DNA, 22 bp, Artificial Sequence
  chemically synthesized
ttcctcacaaaatcccacattt

SEQ ID NO: 1386025 - DNA, 22 bp, Artificial Sequence
  chemically synthesized
tattcctcacaaaatcccacat

SEQ ID NO: 1386026 - DNA, 22 bp, Artificial Sequence
  chemically synthesized
attctattcctcacaaaatccc

SEQ ID NO: 1386027 - DNA, 22 bp, Artificial Sequence
  chemically synthesized
gtattaattctattcctcacaa

SEQ ID NO: 1386028 - DNA, 22 bp, Artificial Sequence
  chemically synthesized
agtattaattctattcctcaca

SEQ ID NO: 1386029 - DNA, 22 bp, Artificial Sequence
  chemically synthesized
cttagtattaattctattcctc

SEQ ID NO: 1386030 - DNA, 22 bp, Artificial Sequence
  chemically synthesized
gcttagtattaattctattcct

SEQ ID NO: 1386031 - DNA, 22 bp, Artificial Sequence
  chemically synthesized
tgcttagtattaattctattcc

SEQ ID NO: 1386032 - DNA, 22 bp, Artificial Sequence
  chemically synthesized
ttgcttagtattaattctattc

SEQ ID NO: 1386033 - DNA, 22 bp, Artificial Sequence
  chemically synthesized
aacttttgcttagtattaattc

SEQ ID NO: 1386034 - DNA, 22 bp, Artificial Sequence
  chemically synthesized
tgtgaggaatagaattaatact

SEQ ID NO: 1386035 - DNA, 22 bp, Artificial Sequence
  chemically synthesized
gtgaggaatagaattaatacta

SEQ ID NO: 1386036 - DNA, 22 bp, Artificial Sequence
  chemically synthesized
tgaggaatagaattaatactaa

SEQ ID NO: 1386037 - DNA, 22 bp, Artificial Sequence
  chemically synthesized
aaacggatctgaacttttgctt

SEQ ID NO: 1386038 - DNA, 22 bp, Artificial Sequence
  chemically synthesized
aaaacggatctgaacttttgct

SEQ ID NO: 1386039 - DNA, 22 bp, Artificial Sequence
  chemically synthesized
atactaagcaaaagttcagatc

SEQ ID NO: 1386040 - DNA, 22 bp, Artificial Sequence
  chemically synthesized
acatttaaaacggatctgaact

SEQ ID NO: 1386041 - DNA, 22 bp, Artificial Sequence
  chemically synthesized
ctgacatttaaaacggatctga

SEQ ID NO: 1386042 - DNA, 22 bp, Artificial Sequence
  chemically synthesized
agcaaaagttcagatccgtttt

SEQ ID NO: 1386043 - DNA, 22 bp, Artificial Sequence
  chemically synthesized
agatccgttttaaatgtcagca

SEQ ID NO: 1386044 - DNA, 22 bp, Artificial Sequence
  chemically synthesized
aatagaaaaataattgctgaca

SEQ ID NO: 1386045 - DNA, 22 bp, Artificial Sequence
  chemically synthesized
aaatagaaaaataattgctgac

SEQ ID NO: 1386046 - DNA, 22 bp, Artificial Sequence
  chemically synthesized
taaatagaaaaataattgctga

SEQ ID NO: 1386047 - DNA, 22 bp, Artificial Sequence
  chemically synthesized
ttaaatagaaaaataattgctg

SEQ ID NO: 1386048 - DNA, 22 bp, Artificial Sequence
  chemically synthesized
tttaaatagaaaaataattgct

SEQ ID NO: 1386049 - DNA, 22 bp, Artificial Sequence
  chemically synthesized
ttttaaatagaaaaataattgc

SEQ ID NO: 1386050 - DNA, 22 bp, Artificial Sequence
  chemically synthesized
taaatgtcagcaattatttttc

SEQ ID NO: 1386051 - DNA, 22 bp, Artificial Sequence
  chemically synthesized
aaatgtcagcaattatttttct

SEQ ID NO: 1386052 - DNA, 22 bp, Artificial Sequence
  chemically synthesized
aatgtcagcaattatttttcta

SEQ ID NO: 1386053 - DNA, 22 bp, Artificial Sequence
  chemically synthesized
tatacttttttaaatagaaaaa

SEQ ID NO: 1386054 - DNA, 22 bp, Artificial Sequence
  chemically synthesized
tttttctatttaaaaaagtata

SEQ ID NO: 1386055 - DNA, 22 bp, Artificial Sequence
  chemically synthesized
ttctatttaaaaaagtatatag

SEQ ID NO: 1386056 - DNA, 22 bp, Artificial Sequence
  chemically synthesized
tctatttaaaaaagtatatagc

SEQ ID NO: 1386057 - DNA, 22 bp, Artificial Sequence
  chemically synthesized
ctatttaaaaaagtatatagcg

SEQ ID NO: 1386058 - DNA, 22 bp, Artificial Sequence
  chemically synthesized
tatttaaaaaagtatatagcgt

SEQ ID NO: 1386059 - DNA, 22 bp, Artificial Sequence
  chemically synthesized
tttaaaaaagtatatagcgtat

SEQ ID NO: 1386060 - DNA, 22 bp, Artificial Sequence
  chemically synthesized
gtgatacatgaacatacgctat

SEQ ID NO: 1386061 - DNA, 22 bp, Artificial Sequence
  chemically synthesized
agtgatacatgaacatacgcta

SEQ ID NO: 1386062 - DNA, 22 bp, Artificial Sequence
  chemically synthesized
aaaaaagtatatagcgtatgtt

SEQ ID NO: 1386063 - DNA, 22 bp, Artificial Sequence
  chemically synthesized
tagtgatacatgaacatacgct

SEQ ID NO: 1386064 - DNA, 22 bp, Artificial Sequence
  chemically synthesized
aaaaagtatatagcgtatgttc

SEQ ID NO: 1386065 - DNA, 22 bp, Artificial Sequence
  chemically synthesized
ttagtgatacatgaacatacgc

SEQ ID NO: 1386066 - DNA, 22 bp, Artificial Sequence
  chemically synthesized
tcccagaaatgatttttagtga

SEQ ID NO: 1386067 - DNA, 22 bp, Artificial Sequence
  chemically synthesized
gtcccagaaatgatttttagtg

SEQ ID NO: 1386068 - DNA, 22 bp, Artificial Sequence
  chemically synthesized
agcttgtcccagaaatgatttt

SEQ ID NO: 1386069 - DNA, 22 bp, Artificial Sequence
  chemically synthesized
atgtatcactaaaaatcatttc

SEQ ID NO: 1386070 - DNA, 22 bp, Artificial Sequence
  chemically synthesized
tggtatgtctcagcttgtccca

SEQ ID NO: 1386071 - DNA, 22 bp, Artificial Sequence
  chemically synthesized
aaaatcatttctgggacaagct

SEQ ID NO: 1386072 - DNA, 22 bp, Artificial Sequence
  chemically synthesized
ctgggacaagctgagacatacc

SEQ ID NO: 1386073 - DNA, 22 bp, Artificial Sequence
  chemically synthesized
acacataattatggtatgtctc

SEQ ID NO: 1386074 - DNA, 22 bp, Artificial Sequence
  chemically synthesized
tgggacaagctgagacatacca

SEQ ID NO: 1386075 - DNA, 22 bp, Artificial Sequence
  chemically synthesized
ggacaagctgagacataccata

SEQ ID NO: 1386076 - DNA, 22 bp, Artificial Sequence
  chemically synthesized
aggtgttgacacataattatgg

SEQ ID NO: 1386077 - DNA, 22 bp, Artificial Sequence
  chemically synthesized
agacataccataattatgtgtc

SEQ ID NO: 1386078 - DNA, 22 bp, Artificial Sequence
  chemically synthesized
cacgtacctcaggtgttgacac

SEQ ID NO: 1386079 - DNA, 22 bp, Artificial Sequence
  chemically synthesized
attacacgtacctcaggtgttg

SEQ ID NO: 1386080 - DNA, 22 bp, Artificial Sequence
  chemically synthesized
gcattaattacacgtacctcag

SEQ ID NO: 1386081 - DNA, 22 bp, Artificial Sequence
  chemically synthesized
tgtgtcaacacctgaggtacgt

SEQ ID NO: 1386082 - DNA, 22 bp, Artificial Sequence
  chemically synthesized
tagcattaattacacgtacctc

SEQ ID NO: 1386083 - DNA, 22 bp, Artificial Sequence
  chemically synthesized
tctagcattaattacacgtacc

SEQ ID NO: 1386084 - DNA, 22 bp, Artificial Sequence
  chemically synthesized
ctctagcattaattacacgtac

SEQ ID NO: 1386085 - DNA, 22 bp, Artificial Sequence
  chemically synthesized
accttctctagcattaattaca

SEQ ID NO: 1386086 - DNA, 22 bp, Artificial Sequence
  chemically synthesized
tgaccttctctagcattaatta

SEQ ID NO: 1386087 - DNA, 22 bp, Artificial Sequence
  chemically synthesized
ctgaccttctctagcattaatt

SEQ ID NO: 1386088 - DNA, 22 bp, Artificial Sequence
  chemically synthesized
aggtacgtgtaattaatgctag

SEQ ID NO: 1386089 - DNA, 22 bp, Artificial Sequence
  chemically synthesized
ttctgaccttctctagcattaa

SEQ ID NO: 1386090 - DNA, 22 bp, Artificial Sequence
  chemically synthesized
cttctgaccttctctagcatta

SEQ ID NO: 1386091 - DNA, 22 bp, Artificial Sequence
  chemically synthesized
ccttcttctgaccttctctagc

SEQ ID NO: 1386092 - DNA, 22 bp, Artificial Sequence
  chemically synthesized
agctcccttcttctgaccttct

SEQ ID NO: 1386093 - DNA, 22 bp, Artificial Sequence
  chemically synthesized
atgctagagaaggtcagaagaa

SEQ ID NO: 1386094 - DNA, 22 bp, Artificial Sequence
  chemically synthesized
ccaatgttaagctcccttcttc

SEQ ID NO: 1386095 - DNA, 22 bp, Artificial Sequence
  chemically synthesized
gagaaggtcagaagaagggagc

SEQ ID NO: 1386096 - DNA, 22 bp, Artificial Sequence
  chemically synthesized
aatagcaaattgccaatgttaa

SEQ ID NO: 1386097 - DNA, 22 bp, Artificial Sequence
  chemically synthesized
ctaaatagcaaattgccaatgt

SEQ ID NO: 1386098 - DNA, 22 bp, Artificial Sequence
  chemically synthesized
cctaaatagcaaattgccaatg

SEQ ID NO: 1386099 - DNA, 22 bp, Artificial Sequence
  chemically synthesized
gaacacttcctaaatagcaaat

SEQ ID NO: 1386100 - DNA, 22 bp, Artificial Sequence
  chemically synthesized
ggaacacttcctaaatagcaaa

SEQ ID NO: 1386101 - DNA, 22 bp, Artificial Sequence
  chemically synthesized
aacattggcaatttgctattta

SEQ ID NO: 1386102 - DNA, 22 bp, Artificial Sequence
  chemically synthesized
tggaacacttcctaaatagcaa

SEQ ID NO: 1386103 - DNA, 22 bp, Artificial Sequence
  chemically synthesized
acattggcaatttgctatttag

SEQ ID NO: 1386104 - DNA, 22 bp, Artificial Sequence
  chemically synthesized
tttggaacacttcctaaatagc

SEQ ID NO: 1386105 - DNA, 22 bp, Artificial Sequence
  chemically synthesized
ctttggaacacttcctaaatag

SEQ ID NO: 1386106 - DNA, 22 bp, Artificial Sequence
  chemically synthesized
tctttggaacacttcctaaata

SEQ ID NO: 1386107 - DNA, 22 bp, Artificial Sequence
  chemically synthesized
ttctttggaacacttcctaaat

SEQ ID NO: 1386108 - DNA, 22 bp, Artificial Sequence
  chemically synthesized
tttctttggaacacttcctaaa

SEQ ID NO: 1386109 - DNA, 22 bp, Artificial Sequence
  chemically synthesized
gcaatttgctatttaggaagtg

SEQ ID NO: 1386110 - DNA, 22 bp, Artificial Sequence
  chemically synthesized
gctatttaggaagtgttccaaa

SEQ ID NO: 1386111 - DNA, 22 bp, Artificial Sequence
  chemically synthesized
ctatttaggaagtgttccaaag

SEQ ID NO: 1386112 - DNA, 22 bp, Artificial Sequence
  chemically synthesized
tttaggaagtgttccaaagaaa

SEQ ID NO: 1386113 - DNA, 22 bp, Artificial Sequence
  chemically synthesized
aggaagtgttccaaagaaaaag

SEQ ID NO: 1386114 - DNA, 22 bp, Artificial Sequence
  chemically synthesized
ggaagtgttccaaagaaaaagt

SEQ ID NO: 1386115 - DNA, 22 bp, Artificial Sequence
  chemically synthesized
catagtccatcacaatcccact

SEQ ID NO: 1386116 - DNA, 22 bp, Artificial Sequence
  chemically synthesized
caaagaaaaagtgggattgtga

SEQ ID NO: 1386117 - DNA, 22 bp, Artificial Sequence
  chemically synthesized
agttccatagtccatcacaatc

SEQ ID NO: 1386118 - DNA, 22 bp, Artificial Sequence
  chemically synthesized
atctgagttccatagtccatca

SEQ ID NO: 1386119 - DNA, 22 bp, Artificial Sequence
  chemically synthesized
ctaatctgagttccatagtcca

SEQ ID NO: 1386120 - DNA, 22 bp, Artificial Sequence
  chemically synthesized
actaatctgagttccatagtcc

SEQ ID NO: 1386121 - DNA, 22 bp, Artificial Sequence
  chemically synthesized
tgatggactatggaactcagat

SEQ ID NO: 1386122 - DNA, 22 bp, Artificial Sequence
  chemically synthesized
gtccaagtcttactaatctgag

SEQ ID NO: 1386123 - DNA, 22 bp, Artificial Sequence
  chemically synthesized
agtccaagtcttactaatctga

SEQ ID NO: 1386124 - DNA, 22 bp, Artificial Sequence
  chemically synthesized
atttagtccaagtcttactaat

SEQ ID NO: 1386125 - DNA, 22 bp, Artificial Sequence
  chemically synthesized
catttagtccaagtcttactaa

SEQ ID NO: 1386126 - DNA, 22 bp, Artificial Sequence
  chemically synthesized
tggaactcagattagtaagact

SEQ ID NO: 1386127 - DNA, 22 bp, Artificial Sequence
  chemically synthesized
tcatttagtccaagtcttacta

SEQ ID NO: 1386128 - DNA, 22 bp, Artificial Sequence
  chemically synthesized
agattagtaagacttggactaa

SEQ ID NO: 1386129 - DNA, 22 bp, Artificial Sequence
  chemically synthesized
ggatgtctttcatttagtccaa

SEQ ID NO: 1386130 - DNA, 22 bp, Artificial Sequence
  chemically synthesized
gtaagacttggactaaatgaaa

SEQ ID NO: 1386131 - DNA, 22 bp, Artificial Sequence
  chemically synthesized
aatcattaggatgtctttcatt

SEQ ID NO: 1386132 - DNA, 22 bp, Artificial Sequence
  chemically synthesized
ttgaatcattaggatgtctttc

SEQ ID NO: 1386133 - DNA, 22 bp, Artificial Sequence
  chemically synthesized
ggactaaatgaaagacatccta

SEQ ID NO: 1386134 - DNA, 22 bp, Artificial Sequence
  chemically synthesized
gactaaatgaaagacatcctaa

SEQ ID NO: 1386135 - DNA, 22 bp, Artificial Sequence
  chemically synthesized
gtcctgttgaatcattaggatg

SEQ ID NO: 1386136 - DNA, 22 bp, Artificial Sequence
  chemically synthesized
agtcctgttgaatcattaggat

SEQ ID NO: 1386137 - DNA, 22 bp, Artificial Sequence
  chemically synthesized
tagtcctgttgaatcattagga

SEQ ID NO: 1386138 - DNA, 22 bp, Artificial Sequence
  chemically synthesized
aatgaaagacatcctaatgatt

SEQ ID NO: 1386139 - DNA, 22 bp, Artificial Sequence
  chemically synthesized
attttagtcctgttgaatcatt

SEQ ID NO: 1386140 - DNA, 22 bp, Artificial Sequence
  chemically synthesized
aattttagtcctgttgaatcat

SEQ ID NO: 1386141 - DNA, 22 bp, Artificial Sequence
  chemically synthesized
catatttaattttagtcctgtt

SEQ ID NO: 1386142 - DNA, 22 bp, Artificial Sequence
  chemically synthesized
atgattcaacaggactaaaatt

SEQ ID NO: 1386143 - DNA, 22 bp, Artificial Sequence
  chemically synthesized
aattccatatttaattttagtc

SEQ ID NO: 1386144 - DNA, 22 bp, Artificial Sequence
  chemically synthesized
ctcaattccatatttaatttta

SEQ ID NO: 1386145 - DNA, 22 bp, Artificial Sequence
  chemically synthesized
gctcaattccatatttaatttt

SEQ ID NO: 1386146 - DNA, 22 bp, Artificial Sequence
  chemically synthesized
tgctcaattccatatttaattt

SEQ ID NO: 1386147 - DNA, 22 bp, Artificial Sequence
  chemically synthesized
ttgctcaattccatatttaatt

SEQ ID NO: 1386148 - DNA, 22 bp, Artificial Sequence
  chemically synthesized
aacaggactaaaattaaatatg

SEQ ID NO: 1386149 - DNA, 22 bp, Artificial Sequence
  chemically synthesized
ttttgctcaattccatatttaa

SEQ ID NO: 1386150 - DNA, 22 bp, Artificial Sequence
  chemically synthesized
agtctcttttgctcaattccat

SEQ ID NO: 1386151 - DNA, 22 bp, Artificial Sequence
  chemically synthesized
aaattaaatatggaattgagca

SEQ ID NO: 1386152 - DNA, 22 bp, Artificial Sequence
  chemically synthesized
acactcagtctcttttgctcaa

SEQ ID NO: 1386153 - DNA, 22 bp, Artificial Sequence
  chemically synthesized
aatatggaattgagcaaaagag

SEQ ID NO: 1386154 - DNA, 22 bp, Artificial Sequence
  chemically synthesized
ggatgttaacactcagtctctt

SEQ ID NO: 1386155 - DNA, 22 bp, Artificial Sequence
  chemically synthesized
taggatgttaacactcagtctc

SEQ ID NO: 1386156 - DNA, 22 bp, Artificial Sequence
  chemically synthesized
ctaggatgttaacactcagtct

SEQ ID NO: 1386157 - DNA, 22 bp, Artificial Sequence
  chemically synthesized
tctaggatgttaacactcagtc

SEQ ID NO: 1386158 - DNA, 22 bp, Artificial Sequence
  chemically synthesized
agcaaaagagactgagtgttaa

SEQ ID NO: 1386159 - DNA, 22 bp, Artificial Sequence
  chemically synthesized
ccaattttctaggatgttaaca

SEQ ID NO: 1386160 - DNA, 22 bp, Artificial Sequence
  chemically synthesized
cccaattttctaggatgttaac

SEQ ID NO: 1386161 - DNA, 22 bp, Artificial Sequence
  chemically synthesized
tcccaattttctaggatgttaa

SEQ ID NO: 1386162 - DNA, 22 bp, Artificial Sequence
  chemically synthesized
agtgttaacatcctagaaaatt

SEQ ID NO: 1386163 - DNA, 22 bp, Artificial Sequence
  chemically synthesized
tgccaatattttcccaattttc

SEQ ID NO: 1386164 - DNA, 22 bp, Artificial Sequence
  chemically synthesized
acatcctagaaaattgggaaaa

SEQ ID NO: 1386165 - DNA, 22 bp, Artificial Sequence
  chemically synthesized
gaaaattgggaaaatattggca

SEQ ID NO: 1386166 - DNA, 22 bp, Artificial Sequence
  chemically synthesized
ccatgggcaaatgattatgcca

SEQ ID NO: 1386167 - DNA, 22 bp, Artificial Sequence
  chemically synthesized
cccatgggcaaatgattatgcc

SEQ ID NO: 1386168 - DNA, 22 bp, Artificial Sequence
  chemically synthesized
tcccatgggcaaatgattatgc

SEQ ID NO: 1386169 - DNA, 22 bp, Artificial Sequence
  chemically synthesized
ggaaaatattggcataatcatt

SEQ ID NO: 1386170 - DNA, 22 bp, Artificial Sequence
  chemically synthesized
gcataatcatttgcccatggga

SEQ ID NO: 1386171 - DNA, 22 bp, Artificial Sequence
  chemically synthesized
gcccatgggaaagcatatgaca

SEQ ID NO: 1386172 - DNA, 22 bp, Artificial Sequence
  chemically synthesized
cccatgggaaagcatatgacat

SEQ ID NO: 1386173 - DNA, 22 bp, Artificial Sequence
  chemically synthesized
gcatacacatatattccatata

SEQ ID NO: 1386174 - DNA, 22 bp, Artificial Sequence
  chemically synthesized
catacacatatattccatatat

SEQ ID NO: 1386175 - DNA, 22 bp, Artificial Sequence
  chemically synthesized
catatatgcatgcatctctgtg

SEQ ID NO: 1386176 - DNA, 22 bp, Artificial Sequence
  chemically synthesized
tgtgtatgtttacgtacatata

SEQ ID NO: 1386177 - DNA, 22 bp, Artificial Sequence
  chemically synthesized
tgtatgtttacgtacatataca

SEQ ID NO: 1386178 - DNA, 22 bp, Artificial Sequence
  chemically synthesized
agtgcaaatgatatgtatatgt

SEQ ID NO: 1386179 - DNA, 22 bp, Artificial Sequence
  chemically synthesized
tgagtgcaaatgatatgtatat

SEQ ID NO: 1386180 - DNA, 22 bp, Artificial Sequence
  chemically synthesized
ctgagtgcaaatgatatgtata

SEQ ID NO: 1386181 - DNA, 22 bp, Artificial Sequence
  chemically synthesized
tctgagtgcaaatgatatgtat

SEQ ID NO: 1386182 - DNA, 22 bp, Artificial Sequence
  chemically synthesized
acgtacatatacatatcatttg

SEQ ID NO: 1386183 - DNA, 22 bp, Artificial Sequence
  chemically synthesized
cgtacatatacatatcatttgc

SEQ ID NO: 1386184 - DNA, 22 bp, Artificial Sequence
  chemically synthesized
gtaatagtgttttctgagtgca

SEQ ID NO: 1386185 - DNA, 22 bp, Artificial Sequence
  chemically synthesized
tagtgttagtaatagtgttttc

SEQ ID NO: 1386186 - DNA, 22 bp, Artificial Sequence
  chemically synthesized
gcactcagaaaacactattact

SEQ ID NO: 1386187 - DNA, 22 bp, Artificial Sequence
  chemically synthesized
cactcagaaaacactattacta

SEQ ID NO: 1386188 - DNA, 22 bp, Artificial Sequence
  chemically synthesized
agaaaacactattactaacact

SEQ ID NO: 1386189 - DNA, 22 bp, Artificial Sequence
  chemically synthesized
ttactaacactacaatcatata

SEQ ID NO: 1386190 - DNA, 22 bp, Artificial Sequence
  chemically synthesized
ctaacactacaatcatatatat

SEQ ID NO: 1386191 - DNA, 22 bp, Artificial Sequence
  chemically synthesized
tatagtcacaccacatatatat

SEQ ID NO: 1386192 - DNA, 22 bp, Artificial Sequence
  chemically synthesized
acactacaatcatatatatgtg

SEQ ID NO: 1386193 - DNA, 22 bp, Artificial Sequence
  chemically synthesized
caatcatatatatgtggtgtga

SEQ ID NO: 1386194 - DNA, 22 bp, Artificial Sequence
  chemically synthesized
aaagaaaacaatcatacaattg

SEQ ID NO: 1386195 - DNA, 22 bp, Artificial Sequence
  chemically synthesized
caaagaaaacaatcatacaatt

SEQ ID NO: 1386196 - DNA, 22 bp, Artificial Sequence
  chemically synthesized
atgaacttcaaagaaaacaatc

SEQ ID NO: 1386197 - DNA, 22 bp, Artificial Sequence
  chemically synthesized
tacaattgtatgattgttttct

SEQ ID NO: 1386198 - DNA, 22 bp, Artificial Sequence
  chemically synthesized
aatgaacttcaaagaaaacaat

SEQ ID NO: 1386199 - DNA, 22 bp, Artificial Sequence
  chemically synthesized
taatgaacttcaaagaaaacaa

SEQ ID NO: 1386200 - DNA, 22 bp, Artificial Sequence
  chemically synthesized
tatgattgttttctttgaagtt

SEQ ID NO: 1386201 - DNA, 22 bp, Artificial Sequence
  chemically synthesized
ttttctttgaagttcattaaaa

SEQ ID NO: 1386202 - DNA, 22 bp, Artificial Sequence
  chemically synthesized
tctttgaagttcattaaaatca

SEQ ID NO: 1386203 - DNA, 22 bp, Artificial Sequence
  chemically synthesized
ctttgaagttcattaaaatcac

SEQ ID NO: 1386204 - DNA, 22 bp, Artificial Sequence
  chemically synthesized
caagtaatatatgtgattttaa

SEQ ID NO: 1386205 - DNA, 22 bp, Artificial Sequence
  chemically synthesized
tttgaagttcattaaaatcaca

SEQ ID NO: 1386206 - DNA, 22 bp, Artificial Sequence
  chemically synthesized
gcaagtaatatatgtgatttta

SEQ ID NO: 1386207 - DNA, 22 bp, Artificial Sequence
  chemically synthesized
tgaagttcattaaaatcacata

SEQ ID NO: 1386208 - DNA, 22 bp, Artificial Sequence
  chemically synthesized
gaagttcattaaaatcacatat

SEQ ID NO: 1386209 - DNA, 22 bp, Artificial Sequence
  chemically synthesized
aagttcattaaaatcacatata

SEQ ID NO: 1386210 - DNA, 22 bp, Artificial Sequence
  chemically synthesized
attaaaatcacatatattactt

SEQ ID NO: 1386211 - DNA, 22 bp, Artificial Sequence
  chemically synthesized
aaatcacatatattacttgcaa

SEQ ID NO: 1386212 - DNA, 22 bp, Artificial Sequence
  chemically synthesized
cttgcaaatttccgatttatgt

SEQ ID NO: 1386213 - DNA, 22 bp, Artificial Sequence
  chemically synthesized
gcaaatttccgatttatgtaca

SEQ ID NO: 1386214 - DNA, 22 bp, Artificial Sequence
  chemically synthesized
caaatttccgatttatgtacat

SEQ ID NO: 1386215 - DNA, 22 bp, Artificial Sequence
  chemically synthesized
agaggtatgcatatgtacataa

SEQ ID NO: 1386216 - DNA, 22 bp, Artificial Sequence
  chemically synthesized
aagaggtatgcatatgtacata

SEQ ID NO: 1386217 - DNA, 22 bp, Artificial Sequence
  chemically synthesized
taagaggtatgcatatgtacat

SEQ ID NO: 1386218 - DNA, 22 bp, Artificial Sequence
  chemically synthesized
ccgatttatgtacatatgcata

SEQ ID NO: 1386219 - DNA, 22 bp, Artificial Sequence
  chemically synthesized
cgatttatgtacatatgcatac

SEQ ID NO: 1386220 - DNA, 22 bp, Artificial Sequence
  chemically synthesized
atgtacatatgcatacctctta

SEQ ID NO: 1386221 - DNA, 22 bp, Artificial Sequence
  chemically synthesized
tatatcccattttaagaggtat

SEQ ID NO: 1386222 - DNA, 22 bp, Artificial Sequence
  chemically synthesized
tgtacatatgcatacctcttaa

SEQ ID NO: 1386223 - DNA, 22 bp, Artificial Sequence
  chemically synthesized
gatggaatactatatatcccat

SEQ ID NO: 1386224 - DNA, 22 bp, Artificial Sequence
  chemically synthesized
ttagatggaatactatatatcc

SEQ ID NO: 1386225 - DNA, 22 bp, Artificial Sequence
  chemically synthesized
attagatggaatactatatatc

SEQ ID NO: 1386226 - DNA, 22 bp, Artificial Sequence
  chemically synthesized
tattagatggaatactatatat

SEQ ID NO: 1386227 - DNA, 22 bp, Artificial Sequence
  chemically synthesized
ttaaaatgggatatatagtatt

SEQ ID NO: 1386228 - DNA, 22 bp, Artificial Sequence
  chemically synthesized
aaaatgggatatatagtattcc

SEQ ID NO: 1386229 - DNA, 22 bp, Artificial Sequence
  chemically synthesized
aaatgggatatatagtattcca

SEQ ID NO: 1386230 - DNA, 22 bp, Artificial Sequence
  chemically synthesized
atctttattagatggaatacta

SEQ ID NO: 1386231 - DNA, 22 bp, Artificial Sequence
  chemically synthesized
catctttattagatggaatact

SEQ ID NO: 1386232 - DNA, 22 bp, Artificial Sequence
  chemically synthesized
acaaaaatttcatctttattag

SEQ ID NO: 1386233 - DNA, 22 bp, Artificial Sequence
  chemically synthesized
caagcctgacaaaaatttcatc

SEQ ID NO: 1386234 - DNA, 22 bp, Artificial Sequence
  chemically synthesized
catctaataaagatgaaatttt

SEQ ID NO: 1386235 - DNA, 22 bp, Artificial Sequence
  chemically synthesized
aattccaagcctgacaaaaatt

SEQ ID NO: 1386236 - DNA, 22 bp, Artificial Sequence
  chemically synthesized
gaattccaagcctgacaaaaat

SEQ ID NO: 1386237 - DNA, 22 bp, Artificial Sequence
  chemically synthesized
ataaagatgaaatttttgtcag

SEQ ID NO: 1386238 - DNA, 22 bp, Artificial Sequence
  chemically synthesized
ttgaattccaagcctgacaaaa

SEQ ID NO: 1386239 - DNA, 22 bp, Artificial Sequence
  chemically synthesized
ttgtcaggcttggaattcaaga

SEQ ID NO: 1386240 - DNA, 22 bp, Artificial Sequence
  chemically synthesized
tgtcaggcttggaattcaagag

SEQ ID NO: 1386241 - DNA, 22 bp, Artificial Sequence
  chemically synthesized
gtcaggcttggaattcaagaga

SEQ ID NO: 1386242 - DNA, 22 bp, Artificial Sequence
  chemically synthesized
tcaggcttggaattcaagagat

SEQ ID NO: 1386243 - DNA, 22 bp, Artificial Sequence
  chemically synthesized
ggaattcaagagatcttccttt

SEQ ID NO: 1386244 - DNA, 22 bp, Artificial Sequence
  chemically synthesized
gaattcaagagatcttcctttt

SEQ ID NO: 1386245 - DNA, 22 bp, Artificial Sequence
  chemically synthesized
aagagatcttccttttatgtat

SEQ ID NO: 1386246 - DNA, 22 bp, Artificial Sequence
  chemically synthesized
agtaaaaatataatacataaaa

SEQ ID NO: 1386247 - DNA, 22 bp, Artificial Sequence
  chemically synthesized
gagtaaaaatataatacataaa

SEQ ID NO: 1386248 - DNA, 22 bp, Artificial Sequence
  chemically synthesized
ccttttatgtattatattttta

SEQ ID NO: 1386249 - DNA, 22 bp, Artificial Sequence
  chemically synthesized
cttttatgtattatatttttac

SEQ ID NO: 1386250 - DNA, 22 bp, Artificial Sequence
  chemically synthesized
ttatgtattatatttttactca

SEQ ID NO: 1386251 - DNA, 22 bp, Artificial Sequence
  chemically synthesized
tatgtattatatttttactcaa

SEQ ID NO: 1386252 - DNA, 22 bp, Artificial Sequence
  chemically synthesized
gcagtggtccatttgagtaaaa

SEQ ID NO: 1386253 - DNA, 22 bp, Artificial Sequence
  chemically synthesized
atgtattatatttttactcaaa

SEQ ID NO: 1386254 - DNA, 22 bp, Artificial Sequence
  chemically synthesized
tgtattatatttttactcaaat

SEQ ID NO: 1386255 - DNA, 22 bp, Artificial Sequence
  chemically synthesized
actagcagtggtccatttgagt

SEQ ID NO: 1386256 - DNA, 22 bp, Artificial Sequence
  chemically synthesized
aactagcagtggtccatttgag

SEQ ID NO: 1386257 - DNA, 22 bp, Artificial Sequence
  chemically synthesized
tatttttactcaaatggaccac

SEQ ID NO: 1386258 - DNA, 22 bp, Artificial Sequence
  chemically synthesized
ttactcaaatggaccactgcta

SEQ ID NO: 1386259 - DNA, 22 bp, Artificial Sequence
  chemically synthesized
tactcaaatggaccactgctag

SEQ ID NO: 1386260 - DNA, 22 bp, Artificial Sequence
  chemically synthesized
aaagaaacttaactagcagtgg

SEQ ID NO: 1386261 - DNA, 22 bp, Artificial Sequence
  chemically synthesized
actcaaatggaccactgctagt

SEQ ID NO: 1386262 - DNA, 22 bp, Artificial Sequence
  chemically synthesized
gaaagaaacttaactagcagtg

SEQ ID NO: 1386263 - DNA, 22 bp, Artificial Sequence
  chemically synthesized
ctcaaatggaccactgctagtt

SEQ ID NO: 1386264 - DNA, 22 bp, Artificial Sequence
  chemically synthesized
aaatggaccactgctagttaag

SEQ ID NO: 1386265 - DNA, 22 bp, Artificial Sequence
  chemically synthesized
ctagttaagtttctttcaagtt

SEQ ID NO: 1386266 - DNA, 22 bp, Artificial Sequence
  chemically synthesized
ccgaatcagagaaaacttgaaa

SEQ ID NO: 1386267 - DNA, 22 bp, Artificial Sequence
  chemically synthesized
accgaatcagagaaaacttgaa

SEQ ID NO: 1386268 - DNA, 22 bp, Artificial Sequence
  chemically synthesized
gttaagtttctttcaagttttc

SEQ ID NO: 1386269 - DNA, 22 bp, Artificial Sequence
  chemically synthesized
agtttctttcaagttttctctg

SEQ ID NO: 1386270 - DNA, 22 bp, Artificial Sequence
  chemically synthesized
ctttcaagttttctctgattcg

SEQ ID NO: 1386271 - DNA, 22 bp, Artificial Sequence
  chemically synthesized
tttcaagttttctctgattcgg

SEQ ID NO: 1386272 - DNA, 22 bp, Artificial Sequence
  chemically synthesized
aaatggcatttaccgaatcaga

SEQ ID NO: 1386273 - DNA, 22 bp, Artificial Sequence
  chemically synthesized
tcaagttttctctgattcggta

SEQ ID NO: 1386274 - DNA, 22 bp, Artificial Sequence
  chemically synthesized
caagttttctctgattcggtaa

SEQ ID NO: 1386275 - DNA, 22 bp, Artificial Sequence
  chemically synthesized
ctcaaatggcatttaccgaatc

SEQ ID NO: 1386276 - DNA, 22 bp, Artificial Sequence
  chemically synthesized
aagttttctctgattcggtaaa

SEQ ID NO: 1386277 - DNA, 22 bp, Artificial Sequence
  chemically synthesized
tctctgattcggtaaatgccat

SEQ ID NO: 1386278 - DNA, 22 bp, Artificial Sequence
  chemically synthesized
ctctgattcggtaaatgccatt

SEQ ID NO: 1386279 - DNA, 22 bp, Artificial Sequence
  chemically synthesized
atgaactcctcaaatggcattt

SEQ ID NO: 1386280 - DNA, 22 bp, Artificial Sequence
  chemically synthesized
tctgattcggtaaatgccattt

SEQ ID NO: 1386281 - DNA, 22 bp, Artificial Sequence
  chemically synthesized
tgattcggtaaatgccatttga

SEQ ID NO: 1386282 - DNA, 22 bp, Artificial Sequence
  chemically synthesized
attcggtaaatgccatttgagg

SEQ ID NO: 1386283 - DNA, 22 bp, Artificial Sequence
  chemically synthesized
ggtaaatgccatttgaggagtt

SEQ ID NO: 1386284 - DNA, 22 bp, Artificial Sequence
  chemically synthesized
aacgcatgttaatgaactcctc

SEQ ID NO: 1386285 - DNA, 22 bp, Artificial Sequence
  chemically synthesized
aaacgcatgttaatgaactcct

SEQ ID NO: 1386286 - DNA, 22 bp, Artificial Sequence
  chemically synthesized
aatttaaacgcatgttaatgaa

SEQ ID NO: 1386287 - DNA, 22 bp, Artificial Sequence
  chemically synthesized
gaggagttcattaacatgcgtt

SEQ ID NO: 1386288 - DNA, 22 bp, Artificial Sequence
  chemically synthesized
aggagttcattaacatgcgttt

SEQ ID NO: 1386289 - DNA, 22 bp, Artificial Sequence
  chemically synthesized
gaacctgaatttaaacgcatgt

SEQ ID NO: 1386290 - DNA, 22 bp, Artificial Sequence
  chemically synthesized
attaacatgcgtttaaattcag

SEQ ID NO: 1386291 - DNA, 22 bp, Artificial Sequence
  chemically synthesized
acatgcgtttaaattcaggttc

SEQ ID NO: 1386292 - DNA, 22 bp, Artificial Sequence
  chemically synthesized
aaattcaggttccagtgcatga

SEQ ID NO: 1386293 - DNA, 22 bp, Artificial Sequence
  chemically synthesized
atgtgaccgtcatcatgcactg

SEQ ID NO: 1386294 - DNA, 22 bp, Artificial Sequence
  chemically synthesized
aattcaggttccagtgcatgat

SEQ ID NO: 1386295 - DNA, 22 bp, Artificial Sequence
  chemically synthesized
aggttccagtgcatgatgacgg

SEQ ID NO: 1386296 - DNA, 22 bp, Artificial Sequence
  chemically synthesized
accatggcctgatgtgaccgtc

SEQ ID NO: 1386297 - DNA, 22 bp, Artificial Sequence
  chemically synthesized
cagtgcatgatgacggtcacat

SEQ ID NO: 1386298 - DNA, 22 bp, Artificial Sequence
  chemically synthesized
caccatggcctgatgtgaccgt

SEQ ID NO: 1386299 - DNA, 22 bp, Artificial Sequence
  chemically synthesized
tttcaccatggcctgatgtgac

SEQ ID NO: 1386300 - DNA, 22 bp, Artificial Sequence
  chemically synthesized
ctgtttcaccatggcctgatgt

SEQ ID NO: 1386301 - DNA, 22 bp, Artificial Sequence
  chemically synthesized
cctgtttcaccatggcctgatg

SEQ ID NO: 1386302 - DNA, 22 bp, Artificial Sequence
  chemically synthesized
atgtgtttcctgtttcaccatg

SEQ ID NO: 1386303 - DNA, 22 bp, Artificial Sequence
  chemically synthesized
catgtgtttcctgtttcaccat

SEQ ID NO: 1386304 - DNA, 22 bp, Artificial Sequence
  chemically synthesized
ttcatgtgtttcctgtttcacc

SEQ ID NO: 1386305 - DNA, 22 bp, Artificial Sequence
  chemically synthesized
cagcctcttcatgtgtttcctg

SEQ ID NO: 1386306 - DNA, 22 bp, Artificial Sequence
  chemically synthesized
aaaaaaaatactccagcctctt

SEQ ID NO: 1386307 - DNA, 22 bp, Artificial Sequence
  chemically synthesized
aaaaatgaaataattaaaaaaa

SEQ ID NO: 1386308 - DNA, 22 bp, Artificial Sequence
  chemically synthesized
gagtatttttttttaattattt

SEQ ID NO: 1386309 - DNA, 22 bp, Artificial Sequence
  chemically synthesized
atcacagaattaaaaaatgaaa

SEQ ID NO: 1386310 - DNA, 22 bp, Artificial Sequence
  chemically synthesized
ttttttaattatttcatttttt

SEQ ID NO: 1386311 - DNA, 22 bp, Artificial Sequence
  chemically synthesized
tttttaattatttcatttttta

SEQ ID NO: 1386312 - DNA, 22 bp, Artificial Sequence
  chemically synthesized
ttttaattatttcattttttaa

SEQ ID NO: 1386313 - DNA, 22 bp, Artificial Sequence
  chemically synthesized
tttaattatttcattttttaat

SEQ ID NO: 1386314 - DNA, 22 bp, Artificial Sequence
  chemically synthesized
ttaattatttcattttttaatt

SEQ ID NO: 1386315 - DNA, 22 bp, Artificial Sequence
  chemically synthesized
taattatttcattttttaattc

SEQ ID NO: 1386316 - DNA, 22 bp, Artificial Sequence
  chemically synthesized
aattatttcattttttaattct

SEQ ID NO: 1386317 - DNA, 22 bp, Artificial Sequence
  chemically synthesized
attatttcattttttaattctg

SEQ ID NO: 1386318 - DNA, 22 bp, Artificial Sequence
  chemically synthesized
gaaggacctgatcacagaatta

SEQ ID NO: 1386319 - DNA, 22 bp, Artificial Sequence
  chemically synthesized
ggaaggacctgatcacagaatt

SEQ ID NO: 1386320 - DNA, 22 bp, Artificial Sequence
  chemically synthesized
tttcattttttaattctgtgat

SEQ ID NO: 1386321 - DNA, 22 bp, Artificial Sequence
  chemically synthesized
cattttttaattctgtgatcag

SEQ ID NO: 1386322 - DNA, 22 bp, Artificial Sequence
  chemically synthesized
attttttaattctgtgatcagg

SEQ ID NO: 1386323 - DNA, 22 bp, Artificial Sequence
  chemically synthesized
tttaattctgtgatcaggtcct

SEQ ID NO: 1386324 - DNA, 22 bp, Artificial Sequence
  chemically synthesized
ttaattctgtgatcaggtcctt

SEQ ID NO: 1386325 - DNA, 22 bp, Artificial Sequence
  chemically synthesized
taattctgtgatcaggtccttc

SEQ ID NO: 1386326 - DNA, 22 bp, Artificial Sequence
  chemically synthesized
aattctgtgatcaggtccttcc

SEQ ID NO: 1386327 - DNA, 22 bp, Artificial Sequence
  chemically synthesized
attctgtgatcaggtccttcca

SEQ ID NO: 1386328 - DNA, 22 bp, Artificial Sequence
  chemically synthesized
tcagcaccaaaacttggaagga

SEQ ID NO: 1386329 - DNA, 22 bp, Artificial Sequence
  chemically synthesized
tgtgatcaggtccttccaagtt

SEQ ID NO: 1386330 - DNA, 22 bp, Artificial Sequence
  chemically synthesized
tgatcaggtccttccaagtttt

SEQ ID NO: 1386331 - DNA, 22 bp, Artificial Sequence
  chemically synthesized
ccaagttttggtgctgataggg

SEQ ID NO: 1386332 - DNA, 22 bp, Artificial Sequence
  chemically synthesized
caagttttggtgctgatagggt

SEQ ID NO: 1386333 - DNA, 22 bp, Artificial Sequence
  chemically synthesized
taatataaaagaaaaagaccct

SEQ ID NO: 1386334 - DNA, 22 bp, Artificial Sequence
  chemically synthesized
tggtgctgatagggtctttttc

SEQ ID NO: 1386335 - DNA, 22 bp, Artificial Sequence
  chemically synthesized
ggtgctgatagggtctttttct

SEQ ID NO: 1386336 - DNA, 22 bp, Artificial Sequence
  chemically synthesized
gtgctgatagggtctttttctt

SEQ ID NO: 1386337 - DNA, 22 bp, Artificial Sequence
  chemically synthesized
accattgtaatataaaagaaaa

SEQ ID NO: 1386338 - DNA, 22 bp, Artificial Sequence
  chemically synthesized
tcaccattgtaatataaaagaa

SEQ ID NO: 1386339 - DNA, 22 bp, Artificial Sequence
  chemically synthesized
atagggtctttttcttttatat

SEQ ID NO: 1386340 - DNA, 22 bp, Artificial Sequence
  chemically synthesized
ctcaccattgtaatataaaaga

SEQ ID NO: 1386341 - DNA, 22 bp, Artificial Sequence
  chemically synthesized
gggcttctcaccattgtaatat

SEQ ID NO: 1386342 - DNA, 22 bp, Artificial Sequence
  chemically synthesized
tttcttttatattacaatggtg

SEQ ID NO: 1386343 - DNA, 22 bp, Artificial Sequence
  chemically synthesized
attagggcttctcaccattgta

SEQ ID NO: 1386344 - DNA, 22 bp, Artificial Sequence
  chemically synthesized
ttcttttatattacaatggtga

SEQ ID NO: 1386345 - DNA, 22 bp, Artificial Sequence
  chemically synthesized
tcttttatattacaatggtgag

SEQ ID NO: 1386346 - DNA, 22 bp, Artificial Sequence
  chemically synthesized
cttttatattacaatggtgaga

SEQ ID NO: 1386347 - DNA, 22 bp, Artificial Sequence
  chemically synthesized
ctaattagggcttctcaccatt

SEQ ID NO: 1386348 - DNA, 22 bp, Artificial Sequence
  chemically synthesized
ttttatattacaatggtgagaa

SEQ ID NO: 1386349 - DNA, 22 bp, Artificial Sequence
  chemically synthesized
gctaattagggcttctcaccat

SEQ ID NO: 1386350 - DNA, 22 bp, Artificial Sequence
  chemically synthesized
tgctaattagggcttctcacca

SEQ ID NO: 1386351 - DNA, 22 bp, Artificial Sequence
  chemically synthesized
ttatattacaatggtgagaagc

SEQ ID NO: 1386352 - DNA, 22 bp, Artificial Sequence
  chemically synthesized
tatattacaatggtgagaagcc

SEQ ID NO: 1386353 - DNA, 22 bp, Artificial Sequence
  chemically synthesized
atattacaatggtgagaagccc

SEQ ID NO: 1386354 - DNA, 22 bp, Artificial Sequence
  chemically synthesized
ctttgctaattagggcttctca

SEQ ID NO: 1386355 - DNA, 22 bp, Artificial Sequence
  chemically synthesized
tattacaatggtgagaagccct

SEQ ID NO: 1386356 - DNA, 22 bp, Artificial Sequence
  chemically synthesized
actttgctaattagggcttctc

SEQ ID NO: 1386357 - DNA, 22 bp, Artificial Sequence
  chemically synthesized
ttactttgctaattagggcttc

SEQ ID NO: 1386358 - DNA, 22 bp, Artificial Sequence
  chemically synthesized
cttactttgctaattagggctt

SEQ ID NO: 1386359 - DNA, 22 bp, Artificial Sequence
  chemically synthesized
tcttactttgctaattagggct

SEQ ID NO: 1386360 - DNA, 22 bp, Artificial Sequence
  chemically synthesized
caatggtgagaagccctaatta

SEQ ID NO: 1386361 - DNA, 22 bp, Artificial Sequence
  chemically synthesized
ccattttcttactttgctaatt

SEQ ID NO: 1386362 - DNA, 22 bp, Artificial Sequence
  chemically synthesized
agttgccattttcttactttgc

SEQ ID NO: 1386363 - DNA, 22 bp, Artificial Sequence
  chemically synthesized
gagttgccattttcttactttg

SEQ ID NO: 1386364 - DNA, 22 bp, Artificial Sequence
  chemically synthesized
attagcaaagtaagaaaatggc

SEQ ID NO: 1386365 - DNA, 22 bp, Artificial Sequence
  chemically synthesized
gcaaagtaagaaaatggcaact

SEQ ID NO: 1386366 - DNA, 22 bp, Artificial Sequence
  chemically synthesized
gaaacaaaccagagatcaacct

SEQ ID NO: 1386367 - DNA, 22 bp, Artificial Sequence
  chemically synthesized
aaacaagttagaaacaaaccag

SEQ ID NO: 1386368 - DNA, 22 bp, Artificial Sequence
  chemically synthesized
aaggttgatctctggtttgttt

SEQ ID NO: 1386369 - DNA, 22 bp, Artificial Sequence
  chemically synthesized
aaaacaagttagaaacaaacca

SEQ ID NO: 1386370 - DNA, 22 bp, Artificial Sequence
  chemically synthesized
aatttaaaacaagttagaaaca

SEQ ID NO: 1386371 - DNA, 22 bp, Artificial Sequence
  chemically synthesized
atctctggtttgtttctaactt

SEQ ID NO: 1386372 - DNA, 22 bp, Artificial Sequence
  chemically synthesized
aactaaatttaaaacaagttag

SEQ ID NO: 1386373 - DNA, 22 bp, Artificial Sequence
  chemically synthesized
tggtttgtttctaacttgtttt

SEQ ID NO: 1386374 - DNA, 22 bp, Artificial Sequence
  chemically synthesized
gtttgtttctaacttgttttaa

SEQ ID NO: 1386375 - DNA, 22 bp, Artificial Sequence
  chemically synthesized
atgattcaactaaatttaaaac

SEQ ID NO: 1386376 - DNA, 22 bp, Artificial Sequence
  chemically synthesized
gtttctaacttgttttaaattt

SEQ ID NO: 1386377 - DNA, 22 bp, Artificial Sequence
  chemically synthesized
catgattcaactaaatttaaaa

SEQ ID NO: 1386378 - DNA, 22 bp, Artificial Sequence
  chemically synthesized
tttctaacttgttttaaattta

SEQ ID NO: 1386379 - DNA, 22 bp, Artificial Sequence
  chemically synthesized
ctaacttgttttaaatttagtt

SEQ ID NO: 1386380 - DNA, 22 bp, Artificial Sequence
  chemically synthesized
taacttgttttaaatttagttg

SEQ ID NO: 1386381 - DNA, 22 bp, Artificial Sequence
  chemically synthesized
gacttcatgattcaactaaatt

SEQ ID NO: 1386382 - DNA, 22 bp, Artificial Sequence
  chemically synthesized
agacttcatgattcaactaaat

SEQ ID NO: 1386383 - DNA, 22 bp, Artificial Sequence
  chemically synthesized
acttgttttaaatttagttgaa

SEQ ID NO: 1386384 - DNA, 22 bp, Artificial Sequence
  chemically synthesized
tagacttcatgattcaactaaa

SEQ ID NO: 1386385 - DNA, 22 bp, Artificial Sequence
  chemically synthesized
ttagacttcatgattcaactaa

SEQ ID NO: 1386386 - DNA, 22 bp, Artificial Sequence
  chemically synthesized
gttttaaatttagttgaatcat

SEQ ID NO: 1386387 - DNA, 22 bp, Artificial Sequence
  chemically synthesized
ttttaaatttagttgaatcatg

SEQ ID NO: 1386388 - DNA, 22 bp, Artificial Sequence
  chemically synthesized
gacttttagacttcatgattca

SEQ ID NO: 1386389 - DNA, 22 bp, Artificial Sequence
  chemically synthesized
taaatttagttgaatcatgaag

SEQ ID NO: 1386390 - DNA, 22 bp, Artificial Sequence
  chemically synthesized
tggacttttagacttcatgatt

SEQ ID NO: 1386391 - DNA, 22 bp, Artificial Sequence
  chemically synthesized
aaatttagttgaatcatgaagt

SEQ ID NO: 1386392 - DNA, 22 bp, Artificial Sequence
  chemically synthesized
aatttagttgaatcatgaagtc

SEQ ID NO: 1386393 - DNA, 22 bp, Artificial Sequence
  chemically synthesized
tctggacttttagacttcatga

SEQ ID NO: 1386394 - DNA, 22 bp, Artificial Sequence
  chemically synthesized
agttgaatcatgaagtctaaaa

SEQ ID NO: 1386395 - DNA, 22 bp, Artificial Sequence
  chemically synthesized
gttgaatcatgaagtctaaaag

SEQ ID NO: 1386396 - DNA, 22 bp, Artificial Sequence
  chemically synthesized
gtgctctctggacttttagact

SEQ ID NO: 1386397 - DNA, 22 bp, Artificial Sequence
  chemically synthesized
cgtgctctctggacttttagac

SEQ ID NO: 1386398 - DNA, 22 bp, Artificial Sequence
  chemically synthesized
aatcatgaagtctaaaagtcca

SEQ ID NO: 1386399 - DNA, 22 bp, Artificial Sequence
  chemically synthesized
gtttcgtgctctctggactttt

SEQ ID NO: 1386400 - DNA, 22 bp, Artificial Sequence
  chemically synthesized
agtttcgtgctctctggacttt

SEQ ID NO: 1386401 - DNA, 22 bp, Artificial Sequence
  chemically synthesized
atgtagcttagtttcgtgctct

SEQ ID NO: 1386402 - DNA, 22 bp, Artificial Sequence
  chemically synthesized
aaagtccagagagcacgaaact

SEQ ID NO: 1386403 - DNA, 22 bp, Artificial Sequence
  chemically synthesized
aaattaatgtagcttagtttcg

SEQ ID NO: 1386404 - DNA, 22 bp, Artificial Sequence
  chemically synthesized
tgtcagatgttcaaattaatgt

SEQ ID NO: 1386405 - DNA, 22 bp, Artificial Sequence
  chemically synthesized
atgtcagatgttcaaattaatg

SEQ ID NO: 1386406 - DNA, 22 bp, Artificial Sequence
  chemically synthesized
acttatgtcagatgttcaaatt

SEQ ID NO: 1386407 - DNA, 22 bp, Artificial Sequence
  chemically synthesized
agctacattaatttgaacatct

SEQ ID NO: 1386408 - DNA, 22 bp, Artificial Sequence
  chemically synthesized
gtctaacttatgtcagatgttc

SEQ ID NO: 1386409 - DNA, 22 bp, Artificial Sequence
  chemically synthesized
cattaatttgaacatctgacat

SEQ ID NO: 1386410 - DNA, 22 bp, Artificial Sequence
  chemically synthesized
atttgaacatctgacataagtt

SEQ ID NO: 1386411 - DNA, 22 bp, Artificial Sequence
  chemically synthesized
aaaaatactagtctaacttatg

SEQ ID NO: 1386412 - DNA, 22 bp, Artificial Sequence
  chemically synthesized
gaaaaatactagtctaacttat

SEQ ID NO: 1386413 - DNA, 22 bp, Artificial Sequence
  chemically synthesized
gaacatctgacataagttagac

SEQ ID NO: 1386414 - DNA, 22 bp, Artificial Sequence
  chemically synthesized
aacatctgacataagttagact

SEQ ID NO: 1386415 - DNA, 22 bp, Artificial Sequence
  chemically synthesized
acataagttagactagtatttt

SEQ ID NO: 1386416 - DNA, 22 bp, Artificial Sequence
  chemically synthesized
tagaatacaacttgaaaaatac

SEQ ID NO: 1386417 - DNA, 22 bp, Artificial Sequence
  chemically synthesized
tatagaatacaacttgaaaaat

SEQ ID NO: 1386418 - DNA, 22 bp, Artificial Sequence
  chemically synthesized
gactagtatttttcaagttgta

SEQ ID NO: 1386419 - DNA, 22 bp, Artificial Sequence
  chemically synthesized
gggagctctatagaatacaact

SEQ ID NO: 1386420 - DNA, 22 bp, Artificial Sequence
  chemically synthesized
gtatttttcaagttgtattcta

SEQ ID NO: 1386421 - DNA, 22 bp, Artificial Sequence
  chemically synthesized
attggggagctctatagaatac

SEQ ID NO: 1386422 - DNA, 22 bp, Artificial Sequence
  chemically synthesized
aattggggagctctatagaata

SEQ ID NO: 1386423 - DNA, 22 bp, Artificial Sequence
  chemically synthesized
ttcaagttgtattctatagagc

SEQ ID NO: 1386424 - DNA, 22 bp, Artificial Sequence
  chemically synthesized
tcaagttgtattctatagagct

SEQ ID NO: 1386425 - DNA, 22 bp, Artificial Sequence
  chemically synthesized
caagttgtattctatagagctc

SEQ ID NO: 1386426 - DNA, 22 bp, Artificial Sequence
  chemically synthesized
aatttaattggggagctctata

SEQ ID NO: 1386427 - DNA, 22 bp, Artificial Sequence
  chemically synthesized
aagttgtattctatagagctcc

SEQ ID NO: 1386428 - DNA, 22 bp, Artificial Sequence
  chemically synthesized
ctgaatttaattggggagctct

SEQ ID NO: 1386429 - DNA, 22 bp, Artificial Sequence
  chemically synthesized
gctgaatttaattggggagctc

SEQ ID NO: 1386430 - DNA, 22 bp, Artificial Sequence
  chemically synthesized
tgctgaatttaattggggagct

SEQ ID NO: 1386431 - DNA, 22 bp, Artificial Sequence
  chemically synthesized
tattctatagagctccccaatt

SEQ ID NO: 1386432 - DNA, 22 bp, Artificial Sequence
  chemically synthesized
tatagagctccccaattaaatt

SEQ ID NO: 1386433 - DNA, 22 bp, Artificial Sequence
  chemically synthesized
tagagctccccaattaaattca

SEQ ID NO: 1386434 - DNA, 22 bp, Artificial Sequence
  chemically synthesized
cccaattaaattcagcaaaatg

SEQ ID NO: 1386435 - DNA, 22 bp, Artificial Sequence
  chemically synthesized
caataccagtatcattttgctg

SEQ ID NO: 1386436 - DNA, 22 bp, Artificial Sequence
  chemically synthesized
acaataccagtatcattttgct

SEQ ID NO: 1386437 - DNA, 22 bp, Artificial Sequence
  chemically synthesized
cttacaataccagtatcatttt

SEQ ID NO: 1386438 - DNA, 22 bp, Artificial Sequence
  chemically synthesized
acttacaataccagtatcattt

SEQ ID NO: 1386439 - DNA, 22 bp, Artificial Sequence
  chemically synthesized
tacttacaataccagtatcatt

SEQ ID NO: 1386440 - DNA, 22 bp, Artificial Sequence
  chemically synthesized
ttacttacaataccagtatcat

SEQ ID NO: 1386441 - DNA, 22 bp, Artificial Sequence
  chemically synthesized
aattcagcaaaatgatactggt

SEQ ID NO: 1386442 - DNA, 22 bp, Artificial Sequence
  chemically synthesized
tttacttacaataccagtatca

SEQ ID NO: 1386443 - DNA, 22 bp, Artificial Sequence
  chemically synthesized
ttttacttacaataccagtatc

SEQ ID NO: 1386444 - DNA, 22 bp, Artificial Sequence
  chemically synthesized
ttttttacttacaataccagta

SEQ ID NO: 1386445 - DNA, 22 bp, Artificial Sequence
  chemically synthesized
cttttttacttacaataccagt

SEQ ID NO: 1386446 - DNA, 22 bp, Artificial Sequence
  chemically synthesized
agcaaaatgatactggtattgt

SEQ ID NO: 1386447 - DNA, 22 bp, Artificial Sequence
  chemically synthesized
tcttttttacttacaataccag

SEQ ID NO: 1386448 - DNA, 22 bp, Artificial Sequence
  chemically synthesized
ctttcttttttacttacaatac

SEQ ID NO: 1386449 - DNA, 22 bp, Artificial Sequence
  chemically synthesized
ttactttcttttttacttacaa

SEQ ID NO: 1386450 - DNA, 22 bp, Artificial Sequence
  chemically synthesized
gtattgtaagtaaaaaagaaag

SEQ ID NO: 1386451 - DNA, 22 bp, Artificial Sequence
  chemically synthesized
taagtaaaaaagaaagtaacaa

SEQ ID NO: 1386452 - DNA, 22 bp, Artificial Sequence
  chemically synthesized
acaaagaaagaaatgtaatagg

SEQ ID NO: 1386453 - DNA, 22 bp, Artificial Sequence
  chemically synthesized
gacaaagaaagaaatgtaatag

SEQ ID NO: 1386454 - DNA, 22 bp, Artificial Sequence
  chemically synthesized
tgacaaagaaagaaatgtaata

SEQ ID NO: 1386455 - DNA, 22 bp, Artificial Sequence
  chemically synthesized
ttgacaaagaaagaaatgtaat

SEQ ID NO: 1386456 - DNA, 22 bp, Artificial Sequence
  chemically synthesized
catatttttgacaaagaaagaa

SEQ ID NO: 1386457 - DNA, 22 bp, Artificial Sequence
  chemically synthesized
ttacatttctttctttgtcaaa

SEQ ID NO: 1386458 - DNA, 22 bp, Artificial Sequence
  chemically synthesized
gtagattacatatttttgacaa

SEQ ID NO: 1386459 - DNA, 22 bp, Artificial Sequence
  chemically synthesized
catttctttctttgtcaaaaat

SEQ ID NO: 1386460 - DNA, 22 bp, Artificial Sequence
  chemically synthesized
ctttctttgtcaaaaatatgta

SEQ ID NO: 1386461 - DNA, 22 bp, Artificial Sequence
  chemically synthesized
tttctttgtcaaaaatatgtaa

SEQ ID NO: 1386462 - DNA, 22 bp, Artificial Sequence
  chemically synthesized
tctttgtcaaaaatatgtaatc

SEQ ID NO: 1386463 - DNA, 22 bp, Artificial Sequence
  chemically synthesized
ctttgtcaaaaatatgtaatct

SEQ ID NO: 1386464 - DNA, 22 bp, Artificial Sequence
  chemically synthesized
tttgtcaaaaatatgtaatcta

SEQ ID NO: 1386465 - DNA, 22 bp, Artificial Sequence
  chemically synthesized
tgtcaaaaatatgtaatctacg

SEQ ID NO: 1386466 - DNA, 22 bp, Artificial Sequence
  chemically synthesized
accccaatgattcgtagattac

SEQ ID NO: 1386467 - DNA, 22 bp, Artificial Sequence
  chemically synthesized
gtcaaaaatatgtaatctacga

SEQ ID NO: 1386468 - DNA, 22 bp, Artificial Sequence
  chemically synthesized
tcaaaaatatgtaatctacgaa

SEQ ID NO: 1386469 - DNA, 22 bp, Artificial Sequence
  chemically synthesized
atgctcaccccaatgattcgta

SEQ ID NO: 1386470 - DNA, 22 bp, Artificial Sequence
  chemically synthesized
cgaatcattggggtgagcatca

SEQ ID NO: 1386471 - DNA, 22 bp, Artificial Sequence
  chemically synthesized
atcccatgtatataatattgat

SEQ ID NO: 1386472 - DNA, 22 bp, Artificial Sequence
  chemically synthesized
catcccatgtatataatattga

SEQ ID NO: 1386473 - DNA, 22 bp, Artificial Sequence
  chemically synthesized
tcatcccatgtatataatattg

SEQ ID NO: 1386474 - DNA, 22 bp, Artificial Sequence
  chemically synthesized
gggtgagcatcaatattatata

SEQ ID NO: 1386475 - DNA, 22 bp, Artificial Sequence
  chemically synthesized
attttcatcccatgtatataat

SEQ ID NO: 1386476 - DNA, 22 bp, Artificial Sequence
  chemically synthesized
aattcattttcatcccatgtat

SEQ ID NO: 1386477 - DNA, 22 bp, Artificial Sequence
  chemically synthesized
atgaaattaaattcattttcat

SEQ ID NO: 1386478 - DNA, 22 bp, Artificial Sequence
  chemically synthesized
tatacatgggatgaaaatgaat

SEQ ID NO: 1386479 - DNA, 22 bp, Artificial Sequence
  chemically synthesized
atcctaatgaaattaaattcat

SEQ ID NO: 1386480 - DNA, 22 bp, Artificial Sequence
  chemically synthesized
aagcctgatcctaatgaaatta

SEQ ID NO: 1386481 - DNA, 22 bp, Artificial Sequence
  chemically synthesized
aaagcctgatcctaatgaaatt

SEQ ID NO: 1386482 - DNA, 22 bp, Artificial Sequence
  chemically synthesized
taaagcctgatcctaatgaaat

SEQ ID NO: 1386483 - DNA, 22 bp, Artificial Sequence
  chemically synthesized
gatctttaaagcctgatcctaa

SEQ ID NO: 1386484 - DNA, 22 bp, Artificial Sequence
  chemically synthesized
agatctttaaagcctgatccta

SEQ ID NO: 1386485 - DNA, 22 bp, Artificial Sequence
  chemically synthesized
aatttcattaggatcaggcttt

SEQ ID NO: 1386486 - DNA, 22 bp, Artificial Sequence
  chemically synthesized
gtttagatctttaaagcctgat

SEQ ID NO: 1386487 - DNA, 22 bp, Artificial Sequence
  chemically synthesized
atttcattaggatcaggcttta

SEQ ID NO: 1386488 - DNA, 22 bp, Artificial Sequence
  chemically synthesized
agtttagatctttaaagcctga

SEQ ID NO: 1386489 - DNA, 22 bp, Artificial Sequence
  chemically synthesized
cattaggatcaggctttaaaga

SEQ ID NO: 1386490 - DNA, 22 bp, Artificial Sequence
  chemically synthesized
attaggatcaggctttaaagat

SEQ ID NO: 1386491 - DNA, 22 bp, Artificial Sequence
  chemically synthesized
ggatcaggctttaaagatctaa

SEQ ID NO: 1386492 - DNA, 22 bp, Artificial Sequence
  chemically synthesized
aaacagccttagtttagatctt

SEQ ID NO: 1386493 - DNA, 22 bp, Artificial Sequence
  chemically synthesized
taaagatctaaactaaggctgt

SEQ ID NO: 1386494 - DNA, 22 bp, Artificial Sequence
  chemically synthesized
aaagatctaaactaaggctgtt

SEQ ID NO: 1386495 - DNA, 22 bp, Artificial Sequence
  chemically synthesized
aagatctaaactaaggctgttt

SEQ ID NO: 1386496 - DNA, 22 bp, Artificial Sequence
  chemically synthesized
aaaagaaaaattcaaacagcct

SEQ ID NO: 1386497 - DNA, 22 bp, Artificial Sequence
  chemically synthesized
aactaaggctgtttgaattttt

SEQ ID NO: 1386498 - DNA, 22 bp, Artificial Sequence
  chemically synthesized
tcaaattaaaaagaaaaattca

SEQ ID NO: 1386499 - DNA, 22 bp, Artificial Sequence
  chemically synthesized
atcaaattaaaaagaaaaattc

SEQ ID NO: 1386500 - DNA, 22 bp, Artificial Sequence
  chemically synthesized
aggctgtttgaatttttctttt

SEQ ID NO: 1386501 - DNA, 22 bp, Artificial Sequence
  chemically synthesized
tagtttatcaaattaaaaagaa

SEQ ID NO: 1386502 - DNA, 22 bp, Artificial Sequence
  chemically synthesized
gtagtttatcaaattaaaaaga

SEQ ID NO: 1386503 - DNA, 22 bp, Artificial Sequence
  chemically synthesized
tttgaatttttctttttaattt

SEQ ID NO: 1386504 - DNA, 22 bp, Artificial Sequence
  chemically synthesized
gaatttttctttttaatttgat

SEQ ID NO: 1386505 - DNA, 22 bp, Artificial Sequence
  chemically synthesized
aatttttctttttaatttgata

SEQ ID NO: 1386506 - DNA, 22 bp, Artificial Sequence
  chemically synthesized
tgaacttgtagtttatcaaatt

SEQ ID NO: 1386507 - DNA, 22 bp, Artificial Sequence
  chemically synthesized
ctgtgaacttgtagtttatcaa

SEQ ID NO: 1386508 - DNA, 22 bp, Artificial Sequence
  chemically synthesized
ttctttttaatttgataaacta

SEQ ID NO: 1386509 - DNA, 22 bp, Artificial Sequence
  chemically synthesized
cctgtgaacttgtagtttatca

SEQ ID NO: 1386510 - DNA, 22 bp, Artificial Sequence
  chemically synthesized
tctttttaatttgataaactac

SEQ ID NO: 1386511 - DNA, 22 bp, Artificial Sequence
  chemically synthesized
ctttttaatttgataaactaca

SEQ ID NO: 1386512 - DNA, 22 bp, Artificial Sequence
  chemically synthesized
tttttaatttgataaactacaa

SEQ ID NO: 1386513 - DNA, 22 bp, Artificial Sequence
  chemically synthesized
tttaatttgataaactacaagt

SEQ ID NO: 1386514 - DNA, 22 bp, Artificial Sequence
  chemically synthesized
ttaatttgataaactacaagtt

SEQ ID NO: 1386515 - DNA, 22 bp, Artificial Sequence
  chemically synthesized
aaacttcctgtgaacttgtagt

SEQ ID NO: 1386516 - DNA, 22 bp, Artificial Sequence
  chemically synthesized
taatttgataaactacaagttc

SEQ ID NO: 1386517 - DNA, 22 bp, Artificial Sequence
  chemically synthesized
gaaacttcctgtgaacttgtag

SEQ ID NO: 1386518 - DNA, 22 bp, Artificial Sequence
  chemically synthesized
aatttgataaactacaagttca

SEQ ID NO: 1386519 - DNA, 22 bp, Artificial Sequence
  chemically synthesized
tgaaacttcctgtgaacttgta

SEQ ID NO: 1386520 - DNA, 22 bp, Artificial Sequence
  chemically synthesized
atttgataaactacaagttcac

SEQ ID NO: 1386521 - DNA, 22 bp, Artificial Sequence
  chemically synthesized
ttgaaacttcctgtgaacttgt

SEQ ID NO: 1386522 - DNA, 22 bp, Artificial Sequence
  chemically synthesized
tttgaaacttcctgtgaacttg

SEQ ID NO: 1386523 - DNA, 22 bp, Artificial Sequence
  chemically synthesized
gataaactacaagttcacagga

SEQ ID NO: 1386524 - DNA, 22 bp, Artificial Sequence
  chemically synthesized
ataaactacaagttcacaggaa

SEQ ID NO: 1386525 - DNA, 22 bp, Artificial Sequence
  chemically synthesized
tacaattttttgaaacttcctg

SEQ ID NO: 1386526 - DNA, 22 bp, Artificial Sequence
  chemically synthesized
caagttcacaggaagtttcaaa

SEQ ID NO: 1386527 - DNA, 22 bp, Artificial Sequence
  chemically synthesized
cctatacaattttttgaaactt

SEQ ID NO: 1386528 - DNA, 22 bp, Artificial Sequence
  chemically synthesized
aacctccctatacaattttttg

SEQ ID NO: 1386529 - DNA, 22 bp, Artificial Sequence
  chemically synthesized
acaggaagtttcaaaaaattgt

SEQ ID NO: 1386530 - DNA, 22 bp, Artificial Sequence
  chemically synthesized
caacctccctatacaatttttt

SEQ ID NO: 1386531 - DNA, 22 bp, Artificial Sequence
  chemically synthesized
caaaaaattgtatagggaggtt

SEQ ID NO: 1386532 - DNA, 22 bp, Artificial Sequence
  chemically synthesized
aaaaaattgtatagggaggttg

SEQ ID NO: 1386533 - DNA, 22 bp, Artificial Sequence
  chemically synthesized
tatagggaggttgaaggtcctg

SEQ ID NO: 1386534 - DNA, 22 bp, Artificial Sequence
  chemically synthesized
cgtgaagggtgcacaggacctt

SEQ ID NO: 1386535 - DNA, 22 bp, Artificial Sequence
  chemically synthesized
agtgagcctccgtgaagggtgc

SEQ ID NO: 1386536 - DNA, 22 bp, Artificial Sequence
  chemically synthesized
aaggtcctgtgcacccttcacg

SEQ ID NO: 1386537 - DNA, 22 bp, Artificial Sequence
  chemically synthesized
tgcacccttcacggaggctcac

SEQ ID NO: 1386538 - DNA, 22 bp, Artificial Sequence
  chemically synthesized
caagatgtaaatattgagtgag

SEQ ID NO: 1386539 - DNA, 22 bp, Artificial Sequence
  chemically synthesized
gcaagatgtaaatattgagtga

SEQ ID NO: 1386540 - DNA, 22 bp, Artificial Sequence
  chemically synthesized
tgcaagatgtaaatattgagtg

SEQ ID NO: 1386541 - DNA, 22 bp, Artificial Sequence
  chemically synthesized
cacggaggctcactcaatattt

SEQ ID NO: 1386542 - DNA, 22 bp, Artificial Sequence
  chemically synthesized
acggaggctcactcaatattta

SEQ ID NO: 1386543 - DNA, 22 bp, Artificial Sequence
  chemically synthesized
taccgcagttttgcaagatgta

SEQ ID NO: 1386544 - DNA, 22 bp, Artificial Sequence
  chemically synthesized
actcaatatttacatcttgcaa

SEQ ID NO: 1386545 - DNA, 22 bp, Artificial Sequence
  chemically synthesized
aatatttacatcttgcaaaact

SEQ ID NO: 1386546 - DNA, 22 bp, Artificial Sequence
  chemically synthesized
atattataccgcagttttgcaa

SEQ ID NO: 1386547 - DNA, 22 bp, Artificial Sequence
  chemically synthesized
gatattataccgcagttttgca

SEQ ID NO: 1386548 - DNA, 22 bp, Artificial Sequence
  chemically synthesized
tgatattataccgcagttttgc

SEQ ID NO: 1386549 - DNA, 22 bp, Artificial Sequence
  chemically synthesized
ttgatattataccgcagttttg

SEQ ID NO: 1386550 - DNA, 22 bp, Artificial Sequence
  chemically synthesized
ttttgatattataccgcagttt

SEQ ID NO: 1386551 - DNA, 22 bp, Artificial Sequence
  chemically synthesized
acatcttgcaaaactgcggtat

SEQ ID NO: 1386552 - DNA, 22 bp, Artificial Sequence
  chemically synthesized
catcttgcaaaactgcggtata

SEQ ID NO: 1386553 - DNA, 22 bp, Artificial Sequence
  chemically synthesized
gcaaaactgcggtataatatca

SEQ ID NO: 1386554 - DNA, 22 bp, Artificial Sequence
  chemically synthesized
caaaactgcggtataatatcaa

SEQ ID NO: 1386555 - DNA, 22 bp, Artificial Sequence
  chemically synthesized
taccaatgtcaattcttttgat

SEQ ID NO: 1386556 - DNA, 22 bp, Artificial Sequence
  chemically synthesized
cggtataatatcaaaagaattg

SEQ ID NO: 1386557 - DNA, 22 bp, Artificial Sequence
  chemically synthesized
tggattataccaatgtcaattc

SEQ ID NO: 1386558 - DNA, 22 bp, Artificial Sequence
  chemically synthesized
atggattataccaatgtcaatt

SEQ ID NO: 1386559 - DNA, 22 bp, Artificial Sequence
  chemically synthesized
acattggtataatccataaacc

SEQ ID NO: 1386560 - DNA, 22 bp, Artificial Sequence
  chemically synthesized
gtataatccataaaccttcttc

SEQ ID NO: 1386561 - DNA, 22 bp, Artificial Sequence
  chemically synthesized
cttctgatttcaccatttatgt

SEQ ID NO: 1386562 - DNA, 22 bp, Artificial Sequence
  chemically synthesized
ttctgatttcaccatttatgta

SEQ ID NO: 1386563 - DNA, 22 bp, Artificial Sequence
  chemically synthesized
ctgatttcaccatttatgtacg

SEQ ID NO: 1386564 - DNA, 22 bp, Artificial Sequence
  chemically synthesized
tgatttcaccatttatgtacgt

SEQ ID NO: 1386565 - DNA, 22 bp, Artificial Sequence
  chemically synthesized
atttcaccatttatgtacgtat

SEQ ID NO: 1386566 - DNA, 22 bp, Artificial Sequence
  chemically synthesized
caccatttatgtacgtatacat

SEQ ID NO: 1386567 - DNA, 22 bp, Artificial Sequence
  chemically synthesized
accatttatgtacgtatacatt

SEQ ID NO: 1386568 - DNA, 22 bp, Artificial Sequence
  chemically synthesized
atgtacgtatacatttgtgtgt

SEQ ID NO: 1386569 - DNA, 22 bp, Artificial Sequence
  chemically synthesized
tgtacgtatacatttgtgtgtg

SEQ ID NO: 1386570 - DNA, 22 bp, Artificial Sequence
  chemically synthesized
tatatacacacacacatacaca

SEQ ID NO: 1386571 - DNA, 22 bp, Artificial Sequence
  chemically synthesized
gtgtgtgtatgtgtgtgtgtat

SEQ ID NO: 1386572 - DNA, 22 bp, Artificial Sequence
  chemically synthesized
tgtgtgtatgtgtgtgtgtata

SEQ ID NO: 1386573 - DNA, 22 bp, Artificial Sequence
  chemically synthesized
agtataactatatatacacaca

SEQ ID NO: 1386574 - DNA, 22 bp, Artificial Sequence
  chemically synthesized
tgtggtaaaattgagtataact

SEQ ID NO: 1386575 - DNA, 22 bp, Artificial Sequence
  chemically synthesized
cgtgaagtgatctatgtggtaa

SEQ ID NO: 1386576 - DNA, 22 bp, Artificial Sequence
  chemically synthesized
acgtgaagtgatctatgtggta

SEQ ID NO: 1386577 - DNA, 22 bp, Artificial Sequence
  chemically synthesized
tactcaattttaccacatagat

SEQ ID NO: 1386578 - DNA, 22 bp, Artificial Sequence
  chemically synthesized
tgcttacgtgaagtgatctatg

SEQ ID NO: 1386579 - DNA, 22 bp, Artificial Sequence
  chemically synthesized
aattttaccacatagatcactt

SEQ ID NO: 1386580 - DNA, 22 bp, Artificial Sequence
  chemically synthesized
tgttgtgcttacgtgaagtgat

SEQ ID NO: 1386581 - DNA, 22 bp, Artificial Sequence
  chemically synthesized
gtgttgtgcttacgtgaagtga

SEQ ID NO: 1386582 - DNA, 22 bp, Artificial Sequence
  chemically synthesized
taccacatagatcacttcacgt

SEQ ID NO: 1386583 - DNA, 22 bp, Artificial Sequence
  chemically synthesized
accacatagatcacttcacgta

SEQ ID NO: 1386584 - DNA, 22 bp, Artificial Sequence
  chemically synthesized
ccacatagatcacttcacgtaa

SEQ ID NO: 1386585 - DNA, 22 bp, Artificial Sequence
  chemically synthesized
ccacttgtgttgtgcttacgtg

SEQ ID NO: 1386586 - DNA, 22 bp, Artificial Sequence
  chemically synthesized
cacgtaagcacaacacaagtgg

SEQ ID NO: 1386587 - DNA, 22 bp, Artificial Sequence
  chemically synthesized
acgtaagcacaacacaagtggt

SEQ ID NO: 1386588 - DNA, 22 bp, Artificial Sequence
  chemically synthesized
aggtgatggtacatctaccact

SEQ ID NO: 1386589 - DNA, 22 bp, Artificial Sequence
  chemically synthesized
gaggtgatggtacatctaccac

SEQ ID NO: 1386590 - DNA, 22 bp, Artificial Sequence
  chemically synthesized
taaaaggataacatggggtgtc

SEQ ID NO: 1386591 - DNA, 22 bp, Artificial Sequence
  chemically synthesized
aagacaccccatgttatccttt

SEQ ID NO: 1386592 - DNA, 22 bp, Artificial Sequence
  chemically synthesized
ggggaaggtggcaggtggccta

SEQ ID NO: 1386593 - DNA, 22 bp, Artificial Sequence
  chemically synthesized
tccttttataggccacctgcca

SEQ ID NO: 1386594 - DNA, 22 bp, Artificial Sequence
  chemically synthesized
ttataggccacctgccaccttc

SEQ ID NO: 1386595 - DNA, 22 bp, Artificial Sequence
  chemically synthesized
tataggccacctgccaccttcc

SEQ ID NO: 1386596 - DNA, 22 bp, Artificial Sequence
  chemically synthesized
ataggccacctgccaccttccc

SEQ ID NO: 1386597 - DNA, 22 bp, Artificial Sequence
  chemically synthesized
taggccacctgccaccttcccc

SEQ ID NO: 1386598 - DNA, 22 bp, Artificial Sequence
  chemically synthesized
agcataatgtgatatggattgg

SEQ ID NO: 1386599 - DNA, 22 bp, Artificial Sequence
  chemically synthesized
ccaccttcccccaatccatatc

SEQ ID NO: 1386600 - DNA, 22 bp, Artificial Sequence
  chemically synthesized
actcagcataatgtgatatgga

SEQ ID NO: 1386601 - DNA, 22 bp, Artificial Sequence
  chemically synthesized
cactcagcataatgtgatatgg

SEQ ID NO: 1386602 - DNA, 22 bp, Artificial Sequence
  chemically synthesized
tttcactcagcataatgtgata

SEQ ID NO: 1386603 - DNA, 22 bp, Artificial Sequence
  chemically synthesized
cccccaatccatatcacattat

SEQ ID NO: 1386604 - DNA, 22 bp, Artificial Sequence
  chemically synthesized
atttcactcagcataatgtgat

SEQ ID NO: 1386605 - DNA, 22 bp, Artificial Sequence
  chemically synthesized
ccccaatccatatcacattatg

SEQ ID NO: 1386606 - DNA, 22 bp, Artificial Sequence
  chemically synthesized
gtttatttcactcagcataatg

SEQ ID NO: 1386607 - DNA, 22 bp, Artificial Sequence
  chemically synthesized
tgactggtttatttcactcagc

SEQ ID NO: 1386608 - DNA, 22 bp, Artificial Sequence
  chemically synthesized
gtgactggtttatttcactcag

SEQ ID NO: 1386609 - DNA, 22 bp, Artificial Sequence
  chemically synthesized
tgctgagtgaaataaaccagtc

SEQ ID NO: 1386610 - DNA, 22 bp, Artificial Sequence
  chemically synthesized
tatgcagccccttgtgactggt

SEQ ID NO: 1386611 - DNA, 22 bp, Artificial Sequence
  chemically synthesized
agtgaaataaaccagtcacaag

SEQ ID NO: 1386612 - DNA, 22 bp, Artificial Sequence
  chemically synthesized
atgtcaatggaatcatgctgta

SEQ ID NO: 1386613 - DNA, 22 bp, Artificial Sequence
  chemically synthesized
catgtcaatggaatcatgctgt

SEQ ID NO: 1386614 - DNA, 22 bp, Artificial Sequence
  chemically synthesized
gtcttcatgtcaatggaatcat

SEQ ID NO: 1386615 - DNA, 22 bp, Artificial Sequence
  chemically synthesized
catacagcatgattccattgac

SEQ ID NO: 1386616 - DNA, 22 bp, Artificial Sequence
  chemically synthesized
ggtgacctggtcttcatgtcaa

SEQ ID NO: 1386617 - DNA, 22 bp, Artificial Sequence
  chemically synthesized
gggtgacctggtcttcatgtca

SEQ ID NO: 1386618 - DNA, 22 bp, Artificial Sequence
  chemically synthesized
aggatttgggtgacctggtctt

SEQ ID NO: 1386619 - DNA, 22 bp, Artificial Sequence
  chemically synthesized
cattgacatgaagaccaggtca

SEQ ID NO: 1386620 - DNA, 22 bp, Artificial Sequence
  chemically synthesized
taaggatttgggtgacctggtc

SEQ ID NO: 1386621 - DNA, 22 bp, Artificial Sequence
  chemically synthesized
tctctaaggatttgggtgacct

SEQ ID NO: 1386622 - DNA, 22 bp, Artificial Sequence
  chemically synthesized
acatgaagaccaggtcacccaa

SEQ ID NO: 1386623 - DNA, 22 bp, Artificial Sequence
  chemically synthesized
tgtctctaaggatttgggtgac

SEQ ID NO: 1386624 - DNA, 22 bp, Artificial Sequence
  chemically synthesized
ctgtctctaaggatttgggtga

SEQ ID NO: 1386625 - DNA, 22 bp, Artificial Sequence
  chemically synthesized
tctgtctctaaggatttgggtg

SEQ ID NO: 1386626 - DNA, 22 bp, Artificial Sequence
  chemically synthesized
gcaaccacgaaaccactttctg

SEQ ID NO: 1386627 - DNA, 22 bp, Artificial Sequence
  chemically synthesized
ttggcaaccacgaaaccacttt

SEQ ID NO: 1386628 - DNA, 22 bp, Artificial Sequence
  chemically synthesized
agagacagaaagtggtttcgtg

SEQ ID NO: 1386629 - DNA, 22 bp, Artificial Sequence
  chemically synthesized
gagacagaaagtggtttcgtgg

SEQ ID NO: 1386630 - DNA, 22 bp, Artificial Sequence
  chemically synthesized
acccagctgttggcaaccacga

SEQ ID NO: 1386631 - DNA, 22 bp, Artificial Sequence
  chemically synthesized
cctcacccagctgttggcaacc

SEQ ID NO: 1386632 - DNA, 22 bp, Artificial Sequence
  chemically synthesized
ctccctcacccagctgttggca

SEQ ID NO: 1386633 - DNA, 22 bp, Artificial Sequence
  chemically synthesized
cgtggttgccaacagctgggtg

SEQ ID NO: 1386634 - DNA, 22 bp, Artificial Sequence
  chemically synthesized
gtggttgccaacagctgggtga

SEQ ID NO: 1386635 - DNA, 22 bp, Artificial Sequence
  chemically synthesized
gtccacactcctccctcaccca

SEQ ID NO: 1386636 - DNA, 22 bp, Artificial Sequence
  chemically synthesized
ccaacagctgggtgagggagga

SEQ ID NO: 1386637 - DNA, 22 bp, Artificial Sequence
  chemically synthesized
tcagttagtccacactcctccc

SEQ ID NO: 1386638 - DNA, 22 bp, Artificial Sequence
  chemically synthesized
atcagttagtccacactcctcc

SEQ ID NO: 1386639 - DNA, 22 bp, Artificial Sequence
  chemically synthesized
ggtgagggaggagtgtggacta

SEQ ID NO: 1386640 - DNA, 22 bp, Artificial Sequence
  chemically synthesized
tatccatttatcagttagtcca

SEQ ID NO: 1386641 - DNA, 22 bp, Artificial Sequence
  chemically synthesized
actgataaatggatacagtggt

SEQ ID NO: 1386642 - DNA, 22 bp, Artificial Sequence
  chemically synthesized
atcaccccaaaggcaccactgt

SEQ ID NO: 1386643 - DNA, 22 bp, Artificial Sequence
  chemically synthesized
catcaccccaaaggcaccactg

SEQ ID NO: 1386644 - DNA, 22 bp, Artificial Sequence
  chemically synthesized
ataaatggatacagtggtgcct

SEQ ID NO: 1386645 - DNA, 22 bp, Artificial Sequence
  chemically synthesized
tcatcaccccaaaggcaccact

SEQ ID NO: 1386646 - DNA, 22 bp, Artificial Sequence
  chemically synthesized
gtccaaaatattttcatcaccc

SEQ ID NO: 1386647 - DNA, 22 bp, Artificial Sequence
  chemically synthesized
ggtccaaaatattttcatcacc

SEQ ID NO: 1386648 - DNA, 22 bp, Artificial Sequence
  chemically synthesized
tggtccaaaatattttcatcac

SEQ ID NO: 1386649 - DNA, 22 bp, Artificial Sequence
  chemically synthesized
ttttggtccaaaatattttcat

SEQ ID NO: 1386650 - DNA, 22 bp, Artificial Sequence
  chemically synthesized
tattttggtccaaaatattttc

SEQ ID NO: 1386651 - DNA, 22 bp, Artificial Sequence
  chemically synthesized
tggggtgatgaaaatattttgg

SEQ ID NO: 1386652 - DNA, 22 bp, Artificial Sequence
  chemically synthesized
ggggtgatgaaaatattttgga

SEQ ID NO: 1386653 - DNA, 22 bp, Artificial Sequence
  chemically synthesized
gggtgatgaaaatattttggac

SEQ ID NO: 1386654 - DNA, 22 bp, Artificial Sequence
  chemically synthesized
tggaccaaaatagagatgatgg

SEQ ID NO: 1386655 - DNA, 22 bp, Artificial Sequence
  chemically synthesized
ggaccaaaatagagatgatggt

SEQ ID NO: 1386656 - DNA, 22 bp, Artificial Sequence
  chemically synthesized
gaccaaaatagagatgatggtt

SEQ ID NO: 1386657 - DNA, 22 bp, Artificial Sequence
  chemically synthesized
acgatggtgtgcaaccatcatc

SEQ ID NO: 1386658 - DNA, 22 bp, Artificial Sequence
  chemically synthesized
gtacattcacgatggtgtgcaa

SEQ ID NO: 1386659 - DNA, 22 bp, Artificial Sequence
  chemically synthesized
cgtacattcacgatggtgtgca

SEQ ID NO: 1386660 - DNA, 22 bp, Artificial Sequence
  chemically synthesized
aatagcatttcgtacattcacg

SEQ ID NO: 1386661 - DNA, 22 bp, Artificial Sequence
  chemically synthesized
cacaccatcgtgaatgtacgaa

SEQ ID NO: 1386662 - DNA, 22 bp, Artificial Sequence
  chemically synthesized
aagtgtacaattcaatagcatt

SEQ ID NO: 1386663 - DNA, 22 bp, Artificial Sequence
  chemically synthesized
aaagtgtacaattcaatagcat

SEQ ID NO: 1386664 - DNA, 22 bp, Artificial Sequence
  chemically synthesized
taaagtgtacaattcaatagca

SEQ ID NO: 1386665 - DNA, 22 bp, Artificial Sequence
  chemically synthesized
ttgaattgtacactttaaaatg

SEQ ID NO: 1386666 - DNA, 22 bp, Artificial Sequence
  chemically synthesized
aattgtacactttaaaatggtt

SEQ ID NO: 1386667 - DNA, 22 bp, Artificial Sequence
  chemically synthesized
acataacataaaagtaaccatt

SEQ ID NO: 1386668 - DNA, 22 bp, Artificial Sequence
  chemically synthesized
tacactttaaaatggttacttt

SEQ ID NO: 1386669 - DNA, 22 bp, Artificial Sequence
  chemically synthesized
taaaatggttacttttatgtta

SEQ ID NO: 1386670 - DNA, 22 bp, Artificial Sequence
  chemically synthesized
aaaatggttacttttatgttat

SEQ ID NO: 1386671 - DNA, 22 bp, Artificial Sequence
  chemically synthesized
aaatggttacttttatgttatg

SEQ ID NO: 1386672 - DNA, 22 bp, Artificial Sequence
  chemically synthesized
aggtaaaattcacataacataa

SEQ ID NO: 1386673 - DNA, 22 bp, Artificial Sequence
  chemically synthesized
aattgaggtaaaattcacataa

SEQ ID NO: 1386674 - DNA, 22 bp, Artificial Sequence
  chemically synthesized
aaattgaggtaaaattcacata

SEQ ID NO: 1386675 - DNA, 22 bp, Artificial Sequence
  chemically synthesized
taaattgaggtaaaattcacat

SEQ ID NO: 1386676 - DNA, 22 bp, Artificial Sequence
  chemically synthesized
ttaaattgaggtaaaattcaca

SEQ ID NO: 1386677 - DNA, 22 bp, Artificial Sequence
  chemically synthesized
cttttatgttatgtgaatttta

SEQ ID NO: 1386678 - DNA, 22 bp, Artificial Sequence
  chemically synthesized
tttaaattgaggtaaaattcac

SEQ ID NO: 1386679 - DNA, 22 bp, Artificial Sequence
  chemically synthesized
ttatgttatgtgaattttacct

SEQ ID NO: 1386680 - DNA, 22 bp, Artificial Sequence
  chemically synthesized
tatgttatgtgaattttacctc

SEQ ID NO: 1386681 - DNA, 22 bp, Artificial Sequence
  chemically synthesized
atgttatgtgaattttacctca

SEQ ID NO: 1386682 - DNA, 22 bp, Artificial Sequence
  chemically synthesized
cattttttaaattgaggtaaaa

SEQ ID NO: 1386683 - DNA, 22 bp, Artificial Sequence
  chemically synthesized
tgttatgtgaattttacctcaa

SEQ ID NO: 1386684 - DNA, 22 bp, Artificial Sequence
  chemically synthesized
tgtgaattttacctcaatttaa

SEQ ID NO: 1386685 - DNA, 22 bp, Artificial Sequence
  chemically synthesized
tacctcaatttaaaaaatgcaa

SEQ ID NO: 1386686 - DNA, 22 bp, Artificial Sequence
  chemically synthesized
acctcaatttaaaaaatgcaac

SEQ ID NO: 1386687 - DNA, 22 bp, Artificial Sequence
  chemically synthesized
cctcaatttaaaaaatgcaacc

SEQ ID NO: 1386688 - DNA, 22 bp, Artificial Sequence
  chemically synthesized
aatttaaaaaatgcaacctcat

SEQ ID NO: 1386689 - DNA, 22 bp, Artificial Sequence
  chemically synthesized
aaaaaatgcaacctcatggccc

SEQ ID NO: 1386690 - DNA, 22 bp, Artificial Sequence
  chemically synthesized
aaaaatgcaacctcatggccct

SEQ ID NO: 1386691 - DNA, 22 bp, Artificial Sequence
  chemically synthesized
atggacagtcagagggccatga

SEQ ID NO: 1386692 - DNA, 22 bp, Artificial Sequence
  chemically synthesized
tcatggacagtcagagggccat

SEQ ID NO: 1386693 - DNA, 22 bp, Artificial Sequence
  chemically synthesized
tctcatggacagtcagagggcc

SEQ ID NO: 1386694 - DNA, 22 bp, Artificial Sequence
  chemically synthesized
gcctctctcatggacagtcaga

SEQ ID NO: 1386695 - DNA, 22 bp, Artificial Sequence
  chemically synthesized
atggccctctgactgtccatga

SEQ ID NO: 1386696 - DNA, 22 bp, Artificial Sequence
  chemically synthesized
caagtctggcctctctcatgga

SEQ ID NO: 1386697 - DNA, 22 bp, Artificial Sequence
  chemically synthesized
ccctgcaagtctggcctctctc

SEQ ID NO: 1386698 - DNA, 22 bp, Artificial Sequence
  chemically synthesized
tgactgtccatgagagaggcca

SEQ ID NO: 1386699 - DNA, 22 bp, Artificial Sequence
  chemically synthesized
actgtccatgagagaggccaga

SEQ ID NO: 1386700 - DNA, 22 bp, Artificial Sequence
  chemically synthesized
tccatgagagaggccagacttg

SEQ ID NO: 1386701 - DNA, 22 bp, Artificial Sequence
  chemically synthesized
cagaccctgccctgcaagtctg

SEQ ID NO: 1386702 - DNA, 22 bp, Artificial Sequence
  chemically synthesized
aggaaactgcagaccctgccct

SEQ ID NO: 1386703 - DNA, 22 bp, Artificial Sequence
  chemically synthesized
tcaggaaactgcagaccctgcc

SEQ ID NO: 1386704 - DNA, 22 bp, Artificial Sequence
  chemically synthesized
tgggttctcaggaaactgcaga

SEQ ID NO: 1386705 - DNA, 22 bp, Artificial Sequence
  chemically synthesized
gcagggcagggtctgcagtttc

SEQ ID NO: 1386706 - DNA, 22 bp, Artificial Sequence
  chemically synthesized
gtgggttctcaggaaactgcag

SEQ ID NO: 1386707 - DNA, 22 bp, Artificial Sequence
  chemically synthesized
cagggcagggtctgcagtttcc

SEQ ID NO: 1386708 - DNA, 22 bp, Artificial Sequence
  chemically synthesized
cttgtgggttctcaggaaactg

SEQ ID NO: 1386709 - DNA, 22 bp, Artificial Sequence
  chemically synthesized
cagtttcctgagaacccacaag

SEQ ID NO: 1386710 - DNA, 22 bp, Artificial Sequence
  chemically synthesized
ataaggacgtgtctgcttgtgg

SEQ ID NO: 1386711 - DNA, 22 bp, Artificial Sequence
  chemically synthesized
cctgagaacccacaagcagaca

SEQ ID NO: 1386712 - DNA, 22 bp, Artificial Sequence
  chemically synthesized
ctgagaacccacaagcagacac

SEQ ID NO: 1386713 - DNA, 22 bp, Artificial Sequence
  chemically synthesized
agaacccacaagcagacacgtc

SEQ ID NO: 1386714 - DNA, 22 bp, Artificial Sequence
  chemically synthesized
cagggcatgcatctcataagga

SEQ ID NO: 1386715 - DNA, 22 bp, Artificial Sequence
  chemically synthesized
ccagggcatgcatctcataagg

SEQ ID NO: 1386716 - DNA, 22 bp, Artificial Sequence
  chemically synthesized
tgaaagaaatttccagggcatg

SEQ ID NO: 1386717 - DNA, 22 bp, Artificial Sequence
  chemically synthesized
atgagatgcatgccctggaaat

SEQ ID NO: 1386718 - DNA, 22 bp, Artificial Sequence
  chemically synthesized
tgagatgcatgccctggaaatt

SEQ ID NO: 1386719 - DNA, 22 bp, Artificial Sequence
  chemically synthesized
gaaatttctttcacaacgtgtt

SEQ ID NO: 1386720 - DNA, 22 bp, Artificial Sequence
  chemically synthesized
ctttcacaacgtgtttatgact

SEQ ID NO: 1386721 - DNA, 22 bp, Artificial Sequence
  chemically synthesized
tttcacaacgtgtttatgactc

SEQ ID NO: 1386722 - DNA, 22 bp, Artificial Sequence
  chemically synthesized
tcacaacgtgtttatgactcct

SEQ ID NO: 1386723 - DNA, 22 bp, Artificial Sequence
  chemically synthesized
cacaacgtgtttatgactcctg

SEQ ID NO: 1386724 - DNA, 22 bp, Artificial Sequence
  chemically synthesized
acaacgtgtttatgactcctgg

SEQ ID NO: 1386725 - DNA, 22 bp, Artificial Sequence
  chemically synthesized
agcccaaaatgtccaggagtca

SEQ ID NO: 1386726 - DNA, 22 bp, Artificial Sequence
  chemically synthesized
ttcagcccaaaatgtccaggag

SEQ ID NO: 1386727 - DNA, 22 bp, Artificial Sequence
  chemically synthesized
tgactgttcagcccaaaatgtc

SEQ ID NO: 1386728 - DNA, 22 bp, Artificial Sequence
  chemically synthesized
gtgactgttcagcccaaaatgt

SEQ ID NO: 1386729 - DNA, 22 bp, Artificial Sequence
  chemically synthesized
atgactcctggacattttgggc

SEQ ID NO: 1386730 - DNA, 22 bp, Artificial Sequence
  chemically synthesized
tgactcctggacattttgggct

SEQ ID NO: 1386731 - DNA, 22 bp, Artificial Sequence
  chemically synthesized
ttgtgactgttcagcccaaaat

SEQ ID NO: 1386732 - DNA, 22 bp, Artificial Sequence
  chemically synthesized
tcttgtgactgttcagcccaaa

SEQ ID NO: 1386733 - DNA, 22 bp, Artificial Sequence
  chemically synthesized
ctcttgtgactgttcagcccaa

SEQ ID NO: 1386734 - DNA, 22 bp, Artificial Sequence
  chemically synthesized
ctggacattttgggctgaacag

SEQ ID NO: 1386735 - DNA, 22 bp, Artificial Sequence
  chemically synthesized
gcttctcttgtgactgttcagc

SEQ ID NO: 1386736 - DNA, 22 bp, Artificial Sequence
  chemically synthesized
gacattttgggctgaacagtca

SEQ ID NO: 1386737 - DNA, 22 bp, Artificial Sequence
  chemically synthesized
tgggctgaacagtcacaagaga

SEQ ID NO: 1386738 - DNA, 22 bp, Artificial Sequence
  chemically synthesized
gggctgaacagtcacaagagaa

SEQ ID NO: 1386739 - DNA, 22 bp, Artificial Sequence
  chemically synthesized
agcatgactagcttctcttgtg

SEQ ID NO: 1386740 - DNA, 22 bp, Artificial Sequence
  chemically synthesized
ggctgaacagtcacaagagaag

SEQ ID NO: 1386741 - DNA, 22 bp, Artificial Sequence
  chemically synthesized
aacagtcacaagagaagctagt

SEQ ID NO: 1386742 - DNA, 22 bp, Artificial Sequence
  chemically synthesized
gtcatgctcaatcatattttgc

SEQ ID NO: 1386743 - DNA, 22 bp, Artificial Sequence
  chemically synthesized
aatcatattttgcttccatggc

SEQ ID NO: 1386744 - DNA, 22 bp, Artificial Sequence
  chemically synthesized
agggtgggaaaatgccatggaa

SEQ ID NO: 1386745 - DNA, 22 bp, Artificial Sequence
  chemically synthesized
tgcttccatggcattttcccac

SEQ ID NO: 1386746 - DNA, 22 bp, Artificial Sequence
  chemically synthesized
gcttccatggcattttcccacc

SEQ ID NO: 1386747 - DNA, 22 bp, Artificial Sequence
  chemically synthesized
cttccatggcattttcccaccc

SEQ ID NO: 1386748 - DNA, 22 bp, Artificial Sequence
  chemically synthesized
ccatggcattttcccaccctca

SEQ ID NO: 1386749 - DNA, 22 bp, Artificial Sequence
  chemically synthesized
catggcattttcccaccctcag

SEQ ID NO: 1386750 - DNA, 22 bp, Artificial Sequence
  chemically synthesized
tgaaaaggagtaggaggctgag

SEQ ID NO: 1386751 - DNA, 22 bp, Artificial Sequence
  chemically synthesized
tcccaccctcagcctcctactc

SEQ ID NO: 1386752 - DNA, 22 bp, Artificial Sequence
  chemically synthesized
cccaccctcagcctcctactcc

SEQ ID NO: 1386753 - DNA, 22 bp, Artificial Sequence
  chemically synthesized
ccaccctcagcctcctactcct

SEQ ID NO: 1386754 - DNA, 22 bp, Artificial Sequence
  chemically synthesized
tgtgtgtgtctatgaaaaggag

SEQ ID NO: 1386755 - DNA, 22 bp, Artificial Sequence
  chemically synthesized
gtgtgtgtgtctatgaaaagga

SEQ ID NO: 1386756 - DNA, 22 bp, Artificial Sequence
  chemically synthesized
agcctcctactccttttcatag

SEQ ID NO: 1386757 - DNA, 22 bp, Artificial Sequence
  chemically synthesized
ctactccttttcatagacacac

SEQ ID NO: 1386758 - DNA, 22 bp, Artificial Sequence
  chemically synthesized
ctccttttcatagacacacaca

SEQ ID NO: 1386759 - DNA, 22 bp, Artificial Sequence
  chemically synthesized
cttttcatagacacacacacaa

SEQ ID NO: 1386760 - DNA, 22 bp, Artificial Sequence
  chemically synthesized
ttcatagacacacacacaaaca

SEQ ID NO: 1386761 - DNA, 22 bp, Artificial Sequence
  chemically synthesized
tcatagacacacacacaaacac

SEQ ID NO: 1386762 - DNA, 22 bp, Artificial Sequence
  chemically synthesized
catagacacacacacaaacaca

SEQ ID NO: 1386763 - DNA, 22 bp, Artificial Sequence
  chemically synthesized
atagacacacacacaaacacat

SEQ ID NO: 1386764 - DNA, 22 bp, Artificial Sequence
  chemically synthesized
gatccatagatatagcagaatg

SEQ ID NO: 1386765 - DNA, 22 bp, Artificial Sequence
  chemically synthesized
agaggctggatccatagatata

SEQ ID NO: 1386766 - DNA, 22 bp, Artificial Sequence
  chemically synthesized
agggctcagaggctggatccat

SEQ ID NO: 1386767 - DNA, 22 bp, Artificial Sequence
  chemically synthesized
gagggctcagaggctggatcca

SEQ ID NO: 1386768 - DNA, 22 bp, Artificial Sequence
  chemically synthesized
tgctatatctatggatccagcc

SEQ ID NO: 1386769 - DNA, 22 bp, Artificial Sequence
  chemically synthesized
ctatatctatggatccagcctc

SEQ ID NO: 1386770 - DNA, 22 bp, Artificial Sequence
  chemically synthesized
tatctatggatccagcctctga

SEQ ID NO: 1386771 - DNA, 22 bp, Artificial Sequence
  chemically synthesized
caccttgagggctcagaggctg

SEQ ID NO: 1386772 - DNA, 22 bp, Artificial Sequence
  chemically synthesized
ctccaccttgagggctcagagg

SEQ ID NO: 1386773 - DNA, 22 bp, Artificial Sequence
  chemically synthesized
tggatccagcctctgagccctc

SEQ ID NO: 1386774 - DNA, 22 bp, Artificial Sequence
  chemically synthesized
tgaactcctccaccttgagggc

SEQ ID NO: 1386775 - DNA, 22 bp, Artificial Sequence
  chemically synthesized
gtgaactcctccaccttgaggg

SEQ ID NO: 1386776 - DNA, 22 bp, Artificial Sequence
  chemically synthesized
cccgcttgtgaactcctccacc

SEQ ID NO: 1386777 - DNA, 22 bp, Artificial Sequence
  chemically synthesized
tgagccctcaaggtggaggagt

SEQ ID NO: 1386778 - DNA, 22 bp, Artificial Sequence
  chemically synthesized
agccctcaaggtggaggagttc

SEQ ID NO: 1386779 - DNA, 22 bp, Artificial Sequence
  chemically synthesized
aaggtggaggagttcacaagcg

SEQ ID NO: 1386780 - DNA, 22 bp, Artificial Sequence
  chemically synthesized
tggcaaatagatgagtggttgc

SEQ ID NO: 1386781 - DNA, 22 bp, Artificial Sequence
  chemically synthesized
ttatggcaaatagatgagtggt

SEQ ID NO: 1386782 - DNA, 22 bp, Artificial Sequence
  chemically synthesized
acaagcgggcaaccactcatct

SEQ ID NO: 1386783 - DNA, 22 bp, Artificial Sequence
  chemically synthesized
aagtaacattattatggcaaat

SEQ ID NO: 1386784 - DNA, 22 bp, Artificial Sequence
  chemically synthesized
tgaagtaacattattatggcaa

SEQ ID NO: 1386785 - DNA, 22 bp, Artificial Sequence
  chemically synthesized
ctgaagtaacattattatggca

SEQ ID NO: 1386786 - DNA, 22 bp, Artificial Sequence
  chemically synthesized
atctatttgccataataatgtt

SEQ ID NO: 1386787 - DNA, 22 bp, Artificial Sequence
  chemically synthesized
tttgccataataatgttacttc

SEQ ID NO: 1386788 - DNA, 22 bp, Artificial Sequence
  chemically synthesized
tgtaacatttctgaagtaacat

SEQ ID NO: 1386789 - DNA, 22 bp, Artificial Sequence
  chemically synthesized
gtgtaacatttctgaagtaaca

SEQ ID NO: 1386790 - DNA, 22 bp, Artificial Sequence
  chemically synthesized
gccataataatgttacttcaga

SEQ ID NO: 1386791 - DNA, 22 bp, Artificial Sequence
  chemically synthesized
ccataataatgttacttcagaa

SEQ ID NO: 1386792 - DNA, 22 bp, Artificial Sequence
  chemically synthesized
tttgtgtaacatttctgaagta

SEQ ID NO: 1386793 - DNA, 22 bp, Artificial Sequence
  chemically synthesized
tatttgtgtaacatttctgaag

SEQ ID NO: 1386794 - DNA, 22 bp, Artificial Sequence
  chemically synthesized
gtctctatttgtgtaacatttc

SEQ ID NO: 1386795 - DNA, 22 bp, Artificial Sequence
  chemically synthesized
catctggtctctatttgtgtaa

SEQ ID NO: 1386796 - DNA, 22 bp, Artificial Sequence
  chemically synthesized
cttcagaaatgttacacaaata

SEQ ID NO: 1386797 - DNA, 22 bp, Artificial Sequence
  chemically synthesized
cagaaatgttacacaaatagag

SEQ ID NO: 1386798 - DNA, 22 bp, Artificial Sequence
  chemically synthesized
agaaatgttacacaaatagaga

SEQ ID NO: 1386799 - DNA, 22 bp, Artificial Sequence
  chemically synthesized
cacaaatagagaccagatgcag

SEQ ID NO: 1386800 - DNA, 22 bp, Artificial Sequence
  chemically synthesized
caggtgtgagccactgcatctg

SEQ ID NO: 1386801 - DNA, 22 bp, Artificial Sequence
  chemically synthesized
agattacaggtgtgagccactg

SEQ ID NO: 1386802 - DNA, 22 bp, Artificial Sequence
  chemically synthesized
gaaatgctgagattacaggtgt

SEQ ID NO: 1386803 - DNA, 22 bp, Artificial Sequence
  chemically synthesized
tcgaaatgctgagattacaggt

SEQ ID NO: 1386804 - DNA, 22 bp, Artificial Sequence
  chemically synthesized
ctcgaaatgctgagattacagg

SEQ ID NO: 1386805 - DNA, 22 bp, Artificial Sequence
  chemically synthesized
acttctcgaaatgctgagatta

SEQ ID NO: 1386806 - DNA, 22 bp, Artificial Sequence
  chemically synthesized
gacttctcgaaatgctgagatt

SEQ ID NO: 1386807 - DNA, 22 bp, Artificial Sequence
  chemically synthesized
acacctgtaatctcagcatttc

SEQ ID NO: 1386808 - DNA, 22 bp, Artificial Sequence
  chemically synthesized
ccgccttgacttctcgaaatgc

SEQ ID NO: 1386809 - DNA, 22 bp, Artificial Sequence
  chemically synthesized
taatctcagcatttcgagaagt

SEQ ID NO: 1386810 - DNA, 22 bp, Artificial Sequence
  chemically synthesized
agcatttcgagaagtcaaggcg

SEQ ID NO: 1386811 - DNA, 22 bp, Artificial Sequence
  chemically synthesized
cagcgatcctcccgccttgact

SEQ ID NO: 1386812 - DNA, 22 bp, Artificial Sequence
  chemically synthesized
gtctccagcgatcctcccgcct

SEQ ID NO: 1386813 - DNA, 22 bp, Artificial Sequence
  chemically synthesized
cgagaagtcaaggcgggaggat

SEQ ID NO: 1386814 - DNA, 22 bp, Artificial Sequence
  chemically synthesized
gagaagtcaaggcgggaggatc

SEQ ID NO: 1386815 - DNA, 22 bp, Artificial Sequence
  chemically synthesized
tggtgacagaccaggatccctg

SEQ ID NO: 1386816 - DNA, 22 bp, Artificial Sequence
  chemically synthesized
actatggtgacagaccaggatc

SEQ ID NO: 1386817 - DNA, 22 bp, Artificial Sequence
  chemically synthesized
gagaccagggatcctggtctgt

SEQ ID NO: 1386818 - DNA, 22 bp, Artificial Sequence
  chemically synthesized
tgtagacagggtctcactatgg

SEQ ID NO: 1386819 - DNA, 22 bp, Artificial Sequence
  chemically synthesized
gtgtagacagggtctcactatg

SEQ ID NO: 1386820 - DNA, 22 bp, Artificial Sequence
  chemically synthesized
tgtgtagacagggtctcactat

SEQ ID NO: 1386821 - DNA, 22 bp, Artificial Sequence
  chemically synthesized
gtctgtcaccatagtgagaccc

SEQ ID NO: 1386822 - DNA, 22 bp, Artificial Sequence
  chemically synthesized
ttttgtgtagacagggtctcac

SEQ ID NO: 1386823 - DNA, 22 bp, Artificial Sequence
  chemically synthesized
tcaccatagtgagaccctgtct

SEQ ID NO: 1386824 - DNA, 22 bp, Artificial Sequence
  chemically synthesized
aaaattgttttgtgtagacagg

SEQ ID NO: 1386825 - DNA, 22 bp, Artificial Sequence
  chemically synthesized
aaaaattgttttgtgtagacag

SEQ ID NO: 1386826 - DNA, 22 bp, Artificial Sequence
  chemically synthesized
taaaaattgttttgtgtagaca

SEQ ID NO: 1386827 - DNA, 22 bp, Artificial Sequence
  chemically synthesized
ttaaaaattgttttgtgtagac

SEQ ID NO: 1386828 - DNA, 22 bp, Artificial Sequence
  chemically synthesized
gcccatttttaaaaattgtttt

SEQ ID NO: 1386829 - DNA, 22 bp, Artificial Sequence
  chemically synthesized
tctacacaaaacaatttttaaa

SEQ ID NO: 1386830 - DNA, 22 bp, Artificial Sequence
  chemically synthesized
cacaaaacaatttttaaaaatg

SEQ ID NO: 1386831 - DNA, 22 bp, Artificial Sequence
  chemically synthesized
ttaaaaatgggccaggtgtggt

SEQ ID NO: 1386832 - DNA, 22 bp, Artificial Sequence
  chemically synthesized
caggcacacaccaccacacctg

SEQ ID NO: 1386833 - DNA, 22 bp, Artificial Sequence
  chemically synthesized
taaaaatgggccaggtgtggtg

SEQ ID NO: 1386834 - DNA, 22 bp, Artificial Sequence
  chemically synthesized
aaaaatgggccaggtgtggtgg

SEQ ID NO: 1386835 - DNA, 22 bp, Artificial Sequence
  chemically synthesized
aaaatgggccaggtgtggtggt

SEQ ID NO: 1386836 - DNA, 22 bp, Artificial Sequence
  chemically synthesized
ggactacaggcacacaccacca

SEQ ID NO: 1386837 - DNA, 22 bp, Artificial Sequence
  chemically synthesized
aatagctgggactacaggcaca

SEQ ID NO: 1386838 - DNA, 22 bp, Artificial Sequence
  chemically synthesized
tgaatagctgggactacaggca

SEQ ID NO: 1386839 - DNA, 22 bp, Artificial Sequence
  chemically synthesized
ctgaatagctgggactacaggc

SEQ ID NO: 1386840 - DNA, 22 bp, Artificial Sequence
  chemically synthesized
tctgaatagctgggactacagg

SEQ ID NO: 1386841 - DNA, 22 bp, Artificial Sequence
  chemically synthesized
agctttctgaatagctgggact

SEQ ID NO: 1386842 - DNA, 22 bp, Artificial Sequence
  chemically synthesized
cctcagctttctgaatagctgg

SEQ ID NO: 1386843 - DNA, 22 bp, Artificial Sequence
  chemically synthesized
ctgcctcagctttctgaatagc

SEQ ID NO: 1386844 - DNA, 22 bp, Artificial Sequence
  chemically synthesized
tagtcccagctattcagaaagc

SEQ ID NO: 1386845 - DNA, 22 bp, Artificial Sequence
  chemically synthesized
aagtaatactcctgcctcagct

SEQ ID NO: 1386846 - DNA, 22 bp, Artificial Sequence
  chemically synthesized
ttcagaaagctgaggcaggagt

SEQ ID NO: 1386847 - DNA, 22 bp, Artificial Sequence
  chemically synthesized
ggctcaagtaatactcctgcct

SEQ ID NO: 1386848 - DNA, 22 bp, Artificial Sequence
  chemically synthesized
agaaagctgaggcaggagtatt

SEQ ID NO: 1386849 - DNA, 22 bp, Artificial Sequence
  chemically synthesized
aagtcctgggctcaagtaatac

SEQ ID NO: 1386850 - DNA, 22 bp, Artificial Sequence
  chemically synthesized
gaagtcctgggctcaagtaata

SEQ ID NO: 1386851 - DNA, 22 bp, Artificial Sequence
  chemically synthesized
aggcaggagtattacttgagcc

SEQ ID NO: 1386852 - DNA, 22 bp, Artificial Sequence
  chemically synthesized
cagccttgaagtcctgggctca

SEQ ID NO: 1386853 - DNA, 22 bp, Artificial Sequence
  chemically synthesized
actgcagccttgaagtcctggg

SEQ ID NO: 1386854 - DNA, 22 bp, Artificial Sequence
  chemically synthesized
cttgagcccaggacttcaaggc

SEQ ID NO: 1386855 - DNA, 22 bp, Artificial Sequence
  chemically synthesized
tagctcactgcagccttgaagt

SEQ ID NO: 1386856 - DNA, 22 bp, Artificial Sequence
  chemically synthesized
gagcccaggacttcaaggctgc

SEQ ID NO: 1386857 - DNA, 22 bp, Artificial Sequence
  chemically synthesized
agcccaggacttcaaggctgca

SEQ ID NO: 1386858 - DNA, 22 bp, Artificial Sequence
  chemically synthesized
caaggctgcagtgagctacaat

SEQ ID NO: 1386859 - DNA, 22 bp, Artificial Sequence
  chemically synthesized
aaggctgcagtgagctacaatc

SEQ ID NO: 1386860 - DNA, 22 bp, Artificial Sequence
  chemically synthesized
gagtgcagtggtgcgattgtag

SEQ ID NO: 1386861 - DNA, 22 bp, Artificial Sequence
  chemically synthesized
cagtgagctacaatcgcaccac

SEQ ID NO: 1386862 - DNA, 22 bp, Artificial Sequence
  chemically synthesized
cccaggctagagtgcagtggtg

SEQ ID NO: 1386863 - DNA, 22 bp, Artificial Sequence
  chemically synthesized
gcccaggctagagtgcagtggt

SEQ ID NO: 1386864 - DNA, 22 bp, Artificial Sequence
  chemically synthesized
ttgcccaggctagagtgcagtg

SEQ ID NO: 1386865 - DNA, 22 bp, Artificial Sequence
  chemically synthesized
caatcgcaccactgcactctag

SEQ ID NO: 1386866 - DNA, 22 bp, Artificial Sequence
  chemically synthesized
actcttgcccaggctagagtgc

SEQ ID NO: 1386867 - DNA, 22 bp, Artificial Sequence
  chemically synthesized
tcactcttgcccaggctagagt

SEQ ID NO: 1386868 - DNA, 22 bp, Artificial Sequence
  chemically synthesized
agacaggttctcactcttgccc

SEQ ID NO: 1386869 - DNA, 22 bp, Artificial Sequence
  chemically synthesized
cactctagcctgggcaagagtg

SEQ ID NO: 1386870 - DNA, 22 bp, Artificial Sequence
  chemically synthesized
gagacaggttctcactcttgcc

SEQ ID NO: 1386871 - DNA, 22 bp, Artificial Sequence
  chemically synthesized
tgagacaggttctcactcttgc

SEQ ID NO: 1386872 - DNA, 22 bp, Artificial Sequence
  chemically synthesized
ttgagacaggttctcactcttg

SEQ ID NO: 1386873 - DNA, 22 bp, Artificial Sequence
  chemically synthesized
tagcctgggcaagagtgagaac

SEQ ID NO: 1386874 - DNA, 22 bp, Artificial Sequence
  chemically synthesized
tttttgagacaggttctcactc

SEQ ID NO: 1386875 - DNA, 22 bp, Artificial Sequence
  chemically synthesized
gtttttgagacaggttctcact

SEQ ID NO: 1386876 - DNA, 22 bp, Artificial Sequence
  chemically synthesized
gcctgggcaagagtgagaacct

SEQ ID NO: 1386877 - DNA, 22 bp, Artificial Sequence
  chemically synthesized
tttgtttttgagacaggttctc

SEQ ID NO: 1386878 - DNA, 22 bp, Artificial Sequence
  chemically synthesized
gtttgtttttgagacaggttct

SEQ ID NO: 1386879 - DNA, 22 bp, Artificial Sequence
  chemically synthesized
ggcaagagtgagaacctgtctc

SEQ ID NO: 1386880 - DNA, 22 bp, Artificial Sequence
  chemically synthesized
cttgtttgtttttgagacaggt

SEQ ID NO: 1386881 - DNA, 22 bp, Artificial Sequence
  chemically synthesized
gcttgtttgtttttgagacagg

SEQ ID NO: 1386882 - DNA, 22 bp, Artificial Sequence
  chemically synthesized
cttgcttgtttgtttttgagac

SEQ ID NO: 1386883 - DNA, 22 bp, Artificial Sequence
  chemically synthesized
gcttgcttgtttgtttttgaga

SEQ ID NO: 1386884 - DNA, 22 bp, Artificial Sequence
  chemically synthesized
tgcttgcttgtttgtttttgag

SEQ ID NO: 1386885 - DNA, 22 bp, Artificial Sequence
  chemically synthesized
ttgcttgcttgtttgtttttga

SEQ ID NO: 1386886 - DNA, 22 bp, Artificial Sequence
  chemically synthesized
tttttgcttgcttgtttgtttt

SEQ ID NO: 1386887 - DNA, 22 bp, Artificial Sequence
  chemically synthesized
gtttttgcttgcttgtttgttt

SEQ ID NO: 1386888 - DNA, 22 bp, Artificial Sequence
  chemically synthesized
catttgtttttgcttgcttgtt

SEQ ID NO: 1386889 - DNA, 22 bp, Artificial Sequence
  chemically synthesized
tctcaaaaacaaacaagcaagc

SEQ ID NO: 1386890 - DNA, 22 bp, Artificial Sequence
  chemically synthesized
ccatttgtttttgcttgcttgt

SEQ ID NO: 1386891 - DNA, 22 bp, Artificial Sequence
  chemically synthesized
aaaaacaaacaagcaagcaaaa

SEQ ID NO: 1386892 - DNA, 22 bp, Artificial Sequence
  chemically synthesized
catgtttccatttgtttttgct

SEQ ID NO: 1386893 - DNA, 22 bp, Artificial Sequence
  chemically synthesized
aaatgaatgtatattgcatgtt

SEQ ID NO: 1386894 - DNA, 22 bp, Artificial Sequence
  chemically synthesized
aaatgtaaaaaaggaaaagcaa

SEQ ID NO: 1386895 - DNA, 22 bp, Artificial Sequence
  chemically synthesized
attttagattgttgcttttcct

SEQ ID NO: 1386896 - DNA, 22 bp, Artificial Sequence
  chemically synthesized
tagattgttgcttttccttttt

SEQ ID NO: 1386897 - DNA, 22 bp, Artificial Sequence
  chemically synthesized
agattgttgcttttcctttttt

SEQ ID NO: 1386898 - DNA, 22 bp, Artificial Sequence
  chemically synthesized
gattgttgcttttcctttttta

SEQ ID NO: 1386899 - DNA, 22 bp, Artificial Sequence
  chemically synthesized
ttgcttttccttttttacattt

SEQ ID NO: 1386900 - DNA, 22 bp, Artificial Sequence
  chemically synthesized
cttttccttttttacatttcaa

SEQ ID NO: 1386901 - DNA, 22 bp, Artificial Sequence
  chemically synthesized
ttccttttttacatttcaactt

SEQ ID NO: 1386902 - DNA, 22 bp, Artificial Sequence
  chemically synthesized
gatgtaaaataaaagttgaaat

SEQ ID NO: 1386903 - DNA, 22 bp, Artificial Sequence
  chemically synthesized
tccttttttacatttcaacttt

SEQ ID NO: 1386904 - DNA, 22 bp, Artificial Sequence
  chemically synthesized
ccttttttacatttcaactttt

SEQ ID NO: 1386905 - DNA, 22 bp, Artificial Sequence
  chemically synthesized
cttttttacatttcaactttta

SEQ ID NO: 1386906 - DNA, 22 bp, Artificial Sequence
  chemically synthesized
ttttacatttcaacttttattt

SEQ ID NO: 1386907 - DNA, 22 bp, Artificial Sequence
  chemically synthesized
tttacatttcaacttttatttt

SEQ ID NO: 1386908 - DNA, 22 bp, Artificial Sequence
  chemically synthesized
ttacatttcaacttttatttta

SEQ ID NO: 1386909 - DNA, 22 bp, Artificial Sequence
  chemically synthesized
tacatttcaacttttattttac

SEQ ID NO: 1386910 - DNA, 22 bp, Artificial Sequence
  chemically synthesized
acatttcaacttttattttaca

SEQ ID NO: 1386911 - DNA, 22 bp, Artificial Sequence
  chemically synthesized
catttcaacttttattttacat

SEQ ID NO: 1386912 - DNA, 22 bp, Artificial Sequence
  chemically synthesized
catatataccccctggatgtaa

SEQ ID NO: 1386913 - DNA, 22 bp, Artificial Sequence
  chemically synthesized
caacttttattttacatccagg

SEQ ID NO: 1386914 - DNA, 22 bp, Artificial Sequence
  chemically synthesized
aacttttattttacatccaggg

SEQ ID NO: 1386915 - DNA, 22 bp, Artificial Sequence
  chemically synthesized
ttattttacatccagggggtat

SEQ ID NO: 1386916 - DNA, 22 bp, Artificial Sequence
  chemically synthesized
tattttacatccagggggtata

SEQ ID NO: 1386917 - DNA, 22 bp, Artificial Sequence
  chemically synthesized
attttacatccagggggtatat

SEQ ID NO: 1386918 - DNA, 22 bp, Artificial Sequence
  chemically synthesized
ttttacatccagggggtatata

SEQ ID NO: 1386919 - DNA, 22 bp, Artificial Sequence
  chemically synthesized
taacaaacctgcatatataccc

SEQ ID NO: 1386920 - DNA, 22 bp, Artificial Sequence
  chemically synthesized
gtaacaaacctgcatatatacc

SEQ ID NO: 1386921 - DNA, 22 bp, Artificial Sequence
  chemically synthesized
tacatccagggggtatatatgc

SEQ ID NO: 1386922 - DNA, 22 bp, Artificial Sequence
  chemically synthesized
acatccagggggtatatatgca

SEQ ID NO: 1386923 - DNA, 22 bp, Artificial Sequence
  chemically synthesized
ttgtaacaaacctgcatatata

SEQ ID NO: 1386924 - DNA, 22 bp, Artificial Sequence
  chemically synthesized
catccagggggtatatatgcag

SEQ ID NO: 1386925 - DNA, 22 bp, Artificial Sequence
  chemically synthesized
aatatcacacaatatactcttg

SEQ ID NO: 1386926 - DNA, 22 bp, Artificial Sequence
  chemically synthesized
aaatatcacacaatatactctt

SEQ ID NO: 1386927 - DNA, 22 bp, Artificial Sequence
  chemically synthesized
gttacaagagtatattgtgtga

SEQ ID NO: 1386928 - DNA, 22 bp, Artificial Sequence
  chemically synthesized
ttacaagagtatattgtgtgat

SEQ ID NO: 1386929 - DNA, 22 bp, Artificial Sequence
  chemically synthesized
caagagtatattgtgtgatatt

SEQ ID NO: 1386930 - DNA, 22 bp, Artificial Sequence
  chemically synthesized
taccccagacttaaatatcaca

SEQ ID NO: 1386931 - DNA, 22 bp, Artificial Sequence
  chemically synthesized
agttgtaccccagacttaaata

SEQ ID NO: 1386932 - DNA, 22 bp, Artificial Sequence
  chemically synthesized
cagttgtaccccagacttaaat

SEQ ID NO: 1386933 - DNA, 22 bp, Artificial Sequence
  chemically synthesized
tgtgatatttaagtctggggta

SEQ ID NO: 1386934 - DNA, 22 bp, Artificial Sequence
  chemically synthesized
ggtgatgacttcagttgtaccc

SEQ ID NO: 1386935 - DNA, 22 bp, Artificial Sequence
  chemically synthesized
cctgggtgatgacttcagttgt

SEQ ID NO: 1386936 - DNA, 22 bp, Artificial Sequence
  chemically synthesized
aagtctggggtacaactgaagt

SEQ ID NO: 1386937 - DNA, 22 bp, Artificial Sequence
  chemically synthesized
agtctggggtacaactgaagtc

SEQ ID NO: 1386938 - DNA, 22 bp, Artificial Sequence
  chemically synthesized
actacctgggtgatgacttcag

SEQ ID NO: 1386939 - DNA, 22 bp, Artificial Sequence
  chemically synthesized
gggtacaactgaagtcatcacc

SEQ ID NO: 1386940 - DNA, 22 bp, Artificial Sequence
  chemically synthesized
tgctcactacctgggtgatgac

SEQ ID NO: 1386941 - DNA, 22 bp, Artificial Sequence
  chemically synthesized
ggtactatgctcactacctggg

SEQ ID NO: 1386942 - DNA, 22 bp, Artificial Sequence
  chemically synthesized
aagtcatcacccaggtagtgag

SEQ ID NO: 1386943 - DNA, 22 bp, Artificial Sequence
  chemically synthesized
ttgggtactatgctcactacct

SEQ ID NO: 1386944 - DNA, 22 bp, Artificial Sequence
  chemically synthesized
cctattgggtactatgctcact

SEQ ID NO: 1386945 - DNA, 22 bp, Artificial Sequence
  chemically synthesized
aaaagctacctattgggtacta

SEQ ID NO: 1386946 - DNA, 22 bp, Artificial Sequence
  chemically synthesized
ttcagcctttgccccttcctcc

SEQ ID NO: 1386947 - DNA, 22 bp, Artificial Sequence
  chemically synthesized
tcagcctttgccccttcctccc

SEQ ID NO: 1386948 - DNA, 22 bp, Artificial Sequence
  chemically synthesized
caatcgaggggagggaggaagg

SEQ ID NO: 1386949 - DNA, 22 bp, Artificial Sequence
  chemically synthesized
cagcctttgccccttcctccct

SEQ ID NO: 1386950 - DNA, 22 bp, Artificial Sequence
  chemically synthesized
agcctttgccccttcctccctc

SEQ ID NO: 1386951 - DNA, 22 bp, Artificial Sequence
  chemically synthesized
gggactacaatcgaggggaggg

SEQ ID NO: 1386952 - DNA, 22 bp, Artificial Sequence
  chemically synthesized
tgccccttcctccctcccctcg

SEQ ID NO: 1386953 - DNA, 22 bp, Artificial Sequence
  chemically synthesized
gccccttcctccctcccctcga

SEQ ID NO: 1386954 - DNA, 22 bp, Artificial Sequence
  chemically synthesized
tggggactacaatcgaggggag

SEQ ID NO: 1386955 - DNA, 22 bp, Artificial Sequence
  chemically synthesized
ccccttcctccctcccctcgat

SEQ ID NO: 1386956 - DNA, 22 bp, Artificial Sequence
  chemically synthesized
cctccctcccctcgattgtagt

SEQ ID NO: 1386957 - DNA, 22 bp, Artificial Sequence
  chemically synthesized
ctccctcccctcgattgtagtc

SEQ ID NO: 1386958 - DNA, 22 bp, Artificial Sequence
  chemically synthesized
cctcccctcgattgtagtcccc

SEQ ID NO: 1386959 - DNA, 22 bp, Artificial Sequence
  chemically synthesized
ccctcgattgtagtccccagag

SEQ ID NO: 1386960 - DNA, 22 bp, Artificial Sequence
  chemically synthesized
gattgtagtccccagagtctac

SEQ ID NO: 1386961 - DNA, 22 bp, Artificial Sequence
  chemically synthesized
tagtccccagagtctactgttc

SEQ ID NO: 1386962 - DNA, 22 bp, Artificial Sequence
  chemically synthesized
agtacacatgaacataaagatg

SEQ ID NO: 1386963 - DNA, 22 bp, Artificial Sequence
  chemically synthesized
ctgttctcatctttatgttcat

SEQ ID NO: 1386964 - DNA, 22 bp, Artificial Sequence
  chemically synthesized
aacactgagtacacatgaacat

SEQ ID NO: 1386965 - DNA, 22 bp, Artificial Sequence
  chemically synthesized
ttctcatctttatgttcatgtg

SEQ ID NO: 1386966 - DNA, 22 bp, Artificial Sequence
  chemically synthesized
tcatctttatgttcatgtgtac

SEQ ID NO: 1386967 - DNA, 22 bp, Artificial Sequence
  chemically synthesized
atctttatgttcatgtgtactc

SEQ ID NO: 1386968 - DNA, 22 bp, Artificial Sequence
  chemically synthesized
tatgttcatgtgtactcagtgt

SEQ ID NO: 1386969 - DNA, 22 bp, Artificial Sequence
  chemically synthesized
atgttcatgtgtactcagtgtt

SEQ ID NO: 1386970 - DNA, 22 bp, Artificial Sequence
  chemically synthesized
tgttcatgtgtactcagtgttt

SEQ ID NO: 1386971 - DNA, 22 bp, Artificial Sequence
  chemically synthesized
taagtgggagctaaacactgag

SEQ ID NO: 1386972 - DNA, 22 bp, Artificial Sequence
  chemically synthesized
ataagtgggagctaaacactga

SEQ ID NO: 1386973 - DNA, 22 bp, Artificial Sequence
  chemically synthesized
atgtgtactcagtgtttagctc

SEQ ID NO: 1386974 - DNA, 22 bp, Artificial Sequence
  chemically synthesized
acttataagtgggagctaaaca

SEQ ID NO: 1386975 - DNA, 22 bp, Artificial Sequence
  chemically synthesized
tcacttataagtgggagctaaa

SEQ ID NO: 1386976 - DNA, 22 bp, Artificial Sequence
  chemically synthesized
agtgtttagctcccacttataa

SEQ ID NO: 1386977 - DNA, 22 bp, Artificial Sequence
  chemically synthesized
agctcccacttataagtgagaa

SEQ ID NO: 1386978 - DNA, 22 bp, Artificial Sequence
  chemically synthesized
gctcccacttataagtgagaac

SEQ ID NO: 1386979 - DNA, 22 bp, Artificial Sequence
  chemically synthesized
ccacttataagtgagaacgtgt

SEQ ID NO: 1386980 - DNA, 22 bp, Artificial Sequence
  chemically synthesized
ataagtgagaacgtgtggtgct

SEQ ID NO: 1386981 - DNA, 22 bp, Artificial Sequence
  chemically synthesized
taagtgagaacgtgtggtgctt

SEQ ID NO: 1386982 - DNA, 22 bp, Artificial Sequence
  chemically synthesized
acacagaaacagaaaaccaagc

SEQ ID NO: 1386983 - DNA, 22 bp, Artificial Sequence
  chemically synthesized
agcgaattaacacagaaacaga

SEQ ID NO: 1386984 - DNA, 22 bp, Artificial Sequence
  chemically synthesized
tcctaagcgaattaacacagaa

SEQ ID NO: 1386985 - DNA, 22 bp, Artificial Sequence
  chemically synthesized
ggttttctgtttctgtgttaat

SEQ ID NO: 1386986 - DNA, 22 bp, Artificial Sequence
  chemically synthesized
gttttctgtttctgtgttaatt

SEQ ID NO: 1386987 - DNA, 22 bp, Artificial Sequence
  chemically synthesized
tctgtttctgtgttaattcgct

SEQ ID NO: 1386988 - DNA, 22 bp, Artificial Sequence
  chemically synthesized
ctgtttctgtgttaattcgctt

SEQ ID NO: 1386989 - DNA, 22 bp, Artificial Sequence
  chemically synthesized
tgtttctgtgttaattcgctta

SEQ ID NO: 1386990 - DNA, 22 bp, Artificial Sequence
  chemically synthesized
gaggacattatcctaagcgaat

SEQ ID NO: 1386991 - DNA, 22 bp, Artificial Sequence
  chemically synthesized
tttctgtgttaattcgcttagg

SEQ ID NO: 1386992 - DNA, 22 bp, Artificial Sequence
  chemically synthesized
ctgtgttaattcgcttaggata

SEQ ID NO: 1386993 - DNA, 22 bp, Artificial Sequence
  chemically synthesized
tgtgttaattcgcttaggataa

SEQ ID NO: 1386994 - DNA, 22 bp, Artificial Sequence
  chemically synthesized
tgttaattcgcttaggataatg

SEQ ID NO: 1386995 - DNA, 22 bp, Artificial Sequence
  chemically synthesized
atggagctggaggacattatcc

SEQ ID NO: 1386996 - DNA, 22 bp, Artificial Sequence
  chemically synthesized
attcgcttaggataatgtcctc

SEQ ID NO: 1386997 - DNA, 22 bp, Artificial Sequence
  chemically synthesized
gcttaggataatgtcctccagc

SEQ ID NO: 1386998 - DNA, 22 bp, Artificial Sequence
  chemically synthesized
aggataatgtcctccagctcca

SEQ ID NO: 1386999 - DNA, 22 bp, Artificial Sequence
  chemically synthesized
caacaacattgatggagctgga

SEQ ID NO: 1387000 - DNA, 22 bp, Artificial Sequence
  chemically synthesized
ggataatgtcctccagctccat

SEQ ID NO: 1387001 - DNA, 22 bp, Artificial Sequence
  chemically synthesized
gcaacaacattgatggagctgg

SEQ ID NO: 1387002 - DNA, 22 bp, Artificial Sequence
  chemically synthesized
tgcaacaacattgatggagctg

SEQ ID NO: 1387003 - DNA, 22 bp, Artificial Sequence
  chemically synthesized
cagctccatcaatgttgttgca

SEQ ID NO: 1387004 - DNA, 22 bp, Artificial Sequence
  chemically synthesized
catcaatgttgttgcaaaggat

SEQ ID NO: 1387005 - DNA, 22 bp, Artificial Sequence
  chemically synthesized
ttgcaaaggatatgattttttt

SEQ ID NO: 1387006 - DNA, 22 bp, Artificial Sequence
  chemically synthesized
caaaggatatgatttttttctt

SEQ ID NO: 1387007 - DNA, 22 bp, Artificial Sequence
  chemically synthesized
tgcagcaataaaaaaagaaaaa

SEQ ID NO: 1387008 - DNA, 22 bp, Artificial Sequence
  chemically synthesized
ttttctttttttattgctgcat

SEQ ID NO: 1387009 - DNA, 22 bp, Artificial Sequence
  chemically synthesized
tttctttttttattgctgcata

SEQ ID NO: 1387010 - DNA, 22 bp, Artificial Sequence
  chemically synthesized
ttctttttttattgctgcatag

SEQ ID NO: 1387011 - DNA, 22 bp, Artificial Sequence
  chemically synthesized
tctttttttattgctgcatagg

SEQ ID NO: 1387012 - DNA, 22 bp, Artificial Sequence
  chemically synthesized
ctttttttattgctgcatagga

SEQ ID NO: 1387013 - DNA, 22 bp, Artificial Sequence
  chemically synthesized
tttttttattgctgcataggat

SEQ ID NO: 1387014 - DNA, 22 bp, Artificial Sequence
  chemically synthesized
tttttattgctgcataggattt

SEQ ID NO: 1387015 - DNA, 22 bp, Artificial Sequence
  chemically synthesized
ttttattgctgcataggatttc

SEQ ID NO: 1387016 - DNA, 22 bp, Artificial Sequence
  chemically synthesized
tttattgctgcataggatttca

SEQ ID NO: 1387017 - DNA, 22 bp, Artificial Sequence
  chemically synthesized
ttattgctgcataggatttcat

SEQ ID NO: 1387018 - DNA, 22 bp, Artificial Sequence
  chemically synthesized
tattgctgcataggatttcatg

SEQ ID NO: 1387019 - DNA, 22 bp, Artificial Sequence
  chemically synthesized
attgctgcataggatttcatga

SEQ ID NO: 1387020 - DNA, 22 bp, Artificial Sequence
  chemically synthesized
ttgctgcataggatttcatgat

SEQ ID NO: 1387021 - DNA, 22 bp, Artificial Sequence
  chemically synthesized
ctgcataggatttcatgatgtg

SEQ ID NO: 1387022 - DNA, 22 bp, Artificial Sequence
  chemically synthesized
cataggatttcatgatgtgtat

SEQ ID NO: 1387023 - DNA, 22 bp, Artificial Sequence
  chemically synthesized
aagaaaatatggtacatacaca

SEQ ID NO: 1387024 - DNA, 22 bp, Artificial Sequence
  chemically synthesized
gctgaagaaaatatggtacata

SEQ ID NO: 1387025 - DNA, 22 bp, Artificial Sequence
  chemically synthesized
catgatgtgtatgtaccatatt

SEQ ID NO: 1387026 - DNA, 22 bp, Artificial Sequence
  chemically synthesized
atgatgtgtatgtaccatattt

SEQ ID NO: 1387027 - DNA, 22 bp, Artificial Sequence
  chemically synthesized
attggctgaagaaaatatggta

SEQ ID NO: 1387028 - DNA, 22 bp, Artificial Sequence
  chemically synthesized
catgcccacaatggttgattgg

SEQ ID NO: 1387029 - DNA, 22 bp, Artificial Sequence
  chemically synthesized
tcttcagccaatcaaccattgt

SEQ ID NO: 1387030 - DNA, 22 bp, Artificial Sequence
  chemically synthesized
cttcagccaatcaaccattgtg

SEQ ID NO: 1387031 - DNA, 22 bp, Artificial Sequence
  chemically synthesized
ttcagccaatcaaccattgtgg

SEQ ID NO: 1387032 - DNA, 22 bp, Artificial Sequence
  chemically synthesized
cagccaatcaaccattgtgggc

SEQ ID NO: 1387033 - DNA, 22 bp, Artificial Sequence
  chemically synthesized
agccaatcaaccattgtgggca

SEQ ID NO: 1387034 - DNA, 22 bp, Artificial Sequence
  chemically synthesized
tgggcatgtaggttgatgccac

SEQ ID NO: 1387035 - DNA, 22 bp, Artificial Sequence
  chemically synthesized
acaatagcaaagatgtggcatc

SEQ ID NO: 1387036 - DNA, 22 bp, Artificial Sequence
  chemically synthesized
ttcacaatagcaaagatgtggc

SEQ ID NO: 1387037 - DNA, 22 bp, Artificial Sequence
  chemically synthesized
cagcactgttcacaatagcaaa

SEQ ID NO: 1387038 - DNA, 22 bp, Artificial Sequence
  chemically synthesized
atgccacatctttgctattgtg

SEQ ID NO: 1387039 - DNA, 22 bp, Artificial Sequence
  chemically synthesized
attacagcactgttcacaatag

SEQ ID NO: 1387040 - DNA, 22 bp, Artificial Sequence
  chemically synthesized
ggatgttcattacagcactgtt

SEQ ID NO: 1387041 - DNA, 22 bp, Artificial Sequence
  chemically synthesized
tgctattgtgaacagtgctgta

SEQ ID NO: 1387042 - DNA, 22 bp, Artificial Sequence
  chemically synthesized
gctattgtgaacagtgctgtaa

SEQ ID NO: 1387043 - DNA, 22 bp, Artificial Sequence
  chemically synthesized
ctattgtgaacagtgctgtaat

SEQ ID NO: 1387044 - DNA, 22 bp, Artificial Sequence
  chemically synthesized
ttgtgaacagtgctgtaatgaa

SEQ ID NO: 1387045 - DNA, 22 bp, Artificial Sequence
  chemically synthesized
tgaacagtgctgtaatgaacat

SEQ ID NO: 1387046 - DNA, 22 bp, Artificial Sequence
  chemically synthesized
ccaaaaatcatatgcactggga

SEQ ID NO: 1387047 - DNA, 22 bp, Artificial Sequence
  chemically synthesized
taccaaaaatcatatgcactgg

SEQ ID NO: 1387048 - DNA, 22 bp, Artificial Sequence
  chemically synthesized
taatgaacatcccagtgcatat

SEQ ID NO: 1387049 - DNA, 22 bp, Artificial Sequence
  chemically synthesized
ttctaccaaaaatcatatgcac

SEQ ID NO: 1387050 - DNA, 22 bp, Artificial Sequence
  chemically synthesized
tacccaaaggaaaatagattat

SEQ ID NO: 1387051 - DNA, 22 bp, Artificial Sequence
  chemically synthesized
atacccaaaggaaaatagatta

SEQ ID NO: 1387052 - DNA, 22 bp, Artificial Sequence
  chemically synthesized
ttggtagaataatctattttcc

SEQ ID NO: 1387053 - DNA, 22 bp, Artificial Sequence
  chemically synthesized
tggtagaataatctattttcct

SEQ ID NO: 1387054 - DNA, 22 bp, Artificial Sequence
  chemically synthesized
ggtagaataatctattttcctt

SEQ ID NO: 1387055 - DNA, 22 bp, Artificial Sequence
  chemically synthesized
ggtttatacccaaaggaaaata

SEQ ID NO: 1387056 - DNA, 22 bp, Artificial Sequence
  chemically synthesized
gtagaataatctattttccttt

SEQ ID NO: 1387057 - DNA, 22 bp, Artificial Sequence
  chemically synthesized
ctgggtttatacccaaaggaaa

SEQ ID NO: 1387058 - DNA, 22 bp, Artificial Sequence
  chemically synthesized
attactgggtttatacccaaag

SEQ ID NO: 1387059 - DNA, 22 bp, Artificial Sequence
  chemically synthesized
ttttcctttgggtataaaccca

SEQ ID NO: 1387060 - DNA, 22 bp, Artificial Sequence
  chemically synthesized
tcctttgggtataaacccagta

SEQ ID NO: 1387061 - DNA, 22 bp, Artificial Sequence
  chemically synthesized
cctttgggtataaacccagtaa

SEQ ID NO: 1387062 - DNA, 22 bp, Artificial Sequence
  chemically synthesized
ctttgggtataaacccagtaat

SEQ ID NO: 1387063 - DNA, 22 bp, Artificial Sequence
  chemically synthesized
acccagcaatctcattactggg

SEQ ID NO: 1387064 - DNA, 22 bp, Artificial Sequence
  chemically synthesized
gacccagcaatctcattactgg

SEQ ID NO: 1387065 - DNA, 22 bp, Artificial Sequence
  chemically synthesized
tgggtataaacccagtaatgag

SEQ ID NO: 1387066 - DNA, 22 bp, Artificial Sequence
  chemically synthesized
gggtataaacccagtaatgaga

SEQ ID NO: 1387067 - DNA, 22 bp, Artificial Sequence
  chemically synthesized
ggtataaacccagtaatgagat

SEQ ID NO: 1387068 - DNA, 22 bp, Artificial Sequence
  chemically synthesized
ccatttgacccagcaatctcat

SEQ ID NO: 1387069 - DNA, 22 bp, Artificial Sequence
  chemically synthesized
aaagtaaggactaccatttgac

SEQ ID NO: 1387070 - DNA, 22 bp, Artificial Sequence
  chemically synthesized
ctgggtcaaatggtagtcctta

SEQ ID NO: 1387071 - DNA, 22 bp, Artificial Sequence
  chemically synthesized
gaagaactaaaagtaaggacta

SEQ ID NO: 1387072 - DNA, 22 bp, Artificial Sequence
  chemically synthesized
ggtcaaatggtagtccttactt

SEQ ID NO: 1387073 - DNA, 22 bp, Artificial Sequence
  chemically synthesized
tcgaagaactaaaagtaaggac

SEQ ID NO: 1387074 - DNA, 22 bp, Artificial Sequence
  chemically synthesized
ctcgaagaactaaaagtaagga

SEQ ID NO: 1387075 - DNA, 22 bp, Artificial Sequence
  chemically synthesized
gagatttctcgaagaactaaaa

SEQ ID NO: 1387076 - DNA, 22 bp, Artificial Sequence
  chemically synthesized
ggagatttctcgaagaactaaa

SEQ ID NO: 1387077 - DNA, 22 bp, Artificial Sequence
  chemically synthesized
acttttagttcttcgagaaatc

SEQ ID NO: 1387078 - DNA, 22 bp, Artificial Sequence
  chemically synthesized
cttttagttcttcgagaaatct

SEQ ID NO: 1387079 - DNA, 22 bp, Artificial Sequence
  chemically synthesized
ttagttcttcgagaaatctcca

SEQ ID NO: 1387080 - DNA, 22 bp, Artificial Sequence
  chemically synthesized
tgaaaagcagtttggagatttc

SEQ ID NO: 1387081 - DNA, 22 bp, Artificial Sequence
  chemically synthesized
tagttcttcgagaaatctccaa

SEQ ID NO: 1387082 - DNA, 22 bp, Artificial Sequence
  chemically synthesized
agttcttcgagaaatctccaaa

SEQ ID NO: 1387083 - DNA, 22 bp, Artificial Sequence
  chemically synthesized
gttcttcgagaaatctccaaac

SEQ ID NO: 1387084 - DNA, 22 bp, Artificial Sequence
  chemically synthesized
ctgtgaaaagcagtttggagat

SEQ ID NO: 1387085 - DNA, 22 bp, Artificial Sequence
  chemically synthesized
ttcgagaaatctccaaactgct

SEQ ID NO: 1387086 - DNA, 22 bp, Artificial Sequence
  chemically synthesized
cgagaaatctccaaactgcttt

SEQ ID NO: 1387087 - DNA, 22 bp, Artificial Sequence
  chemically synthesized
gagaaatctccaaactgctttt

SEQ ID NO: 1387088 - DNA, 22 bp, Artificial Sequence
  chemically synthesized
ggtcggctactgtgaaaagcag

SEQ ID NO: 1387089 - DNA, 22 bp, Artificial Sequence
  chemically synthesized
caaactgcttttcacagtagcc

SEQ ID NO: 1387090 - DNA, 22 bp, Artificial Sequence
  chemically synthesized
cttttcacagtagccgacctaa

SEQ ID NO: 1387091 - DNA, 22 bp, Artificial Sequence
  chemically synthesized
tgggagtgtaaattaggtcggc

SEQ ID NO: 1387092 - DNA, 22 bp, Artificial Sequence
  chemically synthesized
gtgggagtgtaaattaggtcgg

SEQ ID NO: 1387093 - DNA, 22 bp, Artificial Sequence
  chemically synthesized
ttcacagtagccgacctaattt

SEQ ID NO: 1387094 - DNA, 22 bp, Artificial Sequence
  chemically synthesized
tcacagtagccgacctaattta

SEQ ID NO: 1387095 - DNA, 22 bp, Artificial Sequence
  chemically synthesized
tttgtgggagtgtaaattaggt

SEQ ID NO: 1387096 - DNA, 22 bp, Artificial Sequence
  chemically synthesized
cacagtagccgacctaatttac

SEQ ID NO: 1387097 - DNA, 22 bp, Artificial Sequence
  chemically synthesized
acagtagccgacctaatttaca

SEQ ID NO: 1387098 - DNA, 22 bp, Artificial Sequence
  chemically synthesized
ctgtttgtgggagtgtaaatta

SEQ ID NO: 1387099 - DNA, 22 bp, Artificial Sequence
  chemically synthesized
actgtttgtgggagtgtaaatt

SEQ ID NO: 1387100 - DNA, 22 bp, Artificial Sequence
  chemically synthesized
tactgtttgtgggagtgtaaat

SEQ ID NO: 1387101 - DNA, 22 bp, Artificial Sequence
  chemically synthesized
ctttactgtttgtgggagtgta

SEQ ID NO: 1387102 - DNA, 22 bp, Artificial Sequence
  chemically synthesized
actttactgtttgtgggagtgt

SEQ ID NO: 1387103 - DNA, 22 bp, Artificial Sequence
  chemically synthesized
tactttactgtttgtgggagtg

SEQ ID NO: 1387104 - DNA, 22 bp, Artificial Sequence
  chemically synthesized
ttactttactgtttgtgggagt

SEQ ID NO: 1387105 - DNA, 22 bp, Artificial Sequence
  chemically synthesized
tttactttactgtttgtgggag

SEQ ID NO: 1387106 - DNA, 22 bp, Artificial Sequence
  chemically synthesized
ttttactttactgtttgtggga

SEQ ID NO: 1387107 - DNA, 22 bp, Artificial Sequence
  chemically synthesized
atttacactcccacaaacagta

SEQ ID NO: 1387108 - DNA, 22 bp, Artificial Sequence
  chemically synthesized
tccttttttactttactgtttg

SEQ ID NO: 1387109 - DNA, 22 bp, Artificial Sequence
  chemically synthesized
gtccttttttactttactgttt

SEQ ID NO: 1387110 - DNA, 22 bp, Artificial Sequence
  chemically synthesized
tgtccttttttactttactgtt

SEQ ID NO: 1387111 - DNA, 22 bp, Artificial Sequence
  chemically synthesized
acactcccacaaacagtaaagt

SEQ ID NO: 1387112 - DNA, 22 bp, Artificial Sequence
  chemically synthesized
cactcccacaaacagtaaagta

SEQ ID NO: 1387113 - DNA, 22 bp, Artificial Sequence
  chemically synthesized
tttgtccttttttactttactg

SEQ ID NO: 1387114 - DNA, 22 bp, Artificial Sequence
  chemically synthesized
ctttgtccttttttactttact

SEQ ID NO: 1387115 - DNA, 22 bp, Artificial Sequence
  chemically synthesized
ccacaaacagtaaagtaaaaaa

SEQ ID NO: 1387116 - DNA, 22 bp, Artificial Sequence
  chemically synthesized
tgtagtgaccttctttgtcctt

SEQ ID NO: 1387117 - DNA, 22 bp, Artificial Sequence
  chemically synthesized
tcattatgtagtgaccttcttt

SEQ ID NO: 1387118 - DNA, 22 bp, Artificial Sequence
  chemically synthesized
atcattatgtagtgaccttctt

SEQ ID NO: 1387119 - DNA, 22 bp, Artificial Sequence
  chemically synthesized
tatcattatgtagtgaccttct

SEQ ID NO: 1387120 - DNA, 22 bp, Artificial Sequence
  chemically synthesized
caccctttatcattatgtagtg

SEQ ID NO: 1387121 - DNA, 22 bp, Artificial Sequence
  chemically synthesized
aattacaccctttatcattatg

SEQ ID NO: 1387122 - DNA, 22 bp, Artificial Sequence
  chemically synthesized
ttgaattacaccctttatcatt

SEQ ID NO: 1387123 - DNA, 22 bp, Artificial Sequence
  chemically synthesized
gttgaattacaccctttatcat

SEQ ID NO: 1387124 - DNA, 22 bp, Artificial Sequence
  chemically synthesized
ttgttgaattacaccctttatc

SEQ ID NO: 1387125 - DNA, 22 bp, Artificial Sequence
  chemically synthesized
cttgttgaattacaccctttat

SEQ ID NO: 1387126 - DNA, 22 bp, Artificial Sequence
  chemically synthesized
tcttgttgaattacacccttta

SEQ ID NO: 1387127 - DNA, 22 bp, Artificial Sequence
  chemically synthesized
cataatgataaagggtgtaatt

SEQ ID NO: 1387128 - DNA, 22 bp, Artificial Sequence
  chemically synthesized
aattttcttgttgaattacacc

SEQ ID NO: 1387129 - DNA, 22 bp, Artificial Sequence
  chemically synthesized
tgatagttaaattttcttgttg

SEQ ID NO: 1387130 - DNA, 22 bp, Artificial Sequence
  chemically synthesized
atgatagttaaattttcttgtt

SEQ ID NO: 1387131 - DNA, 22 bp, Artificial Sequence
  chemically synthesized
aacaagaaaatttaactatcat

SEQ ID NO: 1387132 - DNA, 22 bp, Artificial Sequence
  chemically synthesized
ggtgcatatatatttatgatag

SEQ ID NO: 1387133 - DNA, 22 bp, Artificial Sequence
  chemically synthesized
aactatcataaatatatatgca

SEQ ID NO: 1387134 - DNA, 22 bp, Artificial Sequence
  chemically synthesized
actatcataaatatatatgcac

SEQ ID NO: 1387135 - DNA, 22 bp, Artificial Sequence
  chemically synthesized
gtgtgccaatgctgggtgcata

SEQ ID NO: 1387136 - DNA, 22 bp, Artificial Sequence
  chemically synthesized
tcataaatatatatgcacccag

SEQ ID NO: 1387137 - DNA, 22 bp, Artificial Sequence
  chemically synthesized
ggacattggtgtgccaatgctg

SEQ ID NO: 1387138 - DNA, 22 bp, Artificial Sequence
  chemically synthesized
aggacattggtgtgccaatgct

SEQ ID NO: 1387139 - DNA, 22 bp, Artificial Sequence
  chemically synthesized
atttaggacattggtgtgccaa

SEQ ID NO: 1387140 - DNA, 22 bp, Artificial Sequence
  chemically synthesized
gatttaggacattggtgtgcca

SEQ ID NO: 1387141 - DNA, 22 bp, Artificial Sequence
  chemically synthesized
aaaagtacttgatttaggacat

SEQ ID NO: 1387142 - DNA, 22 bp, Artificial Sequence
  chemically synthesized
gaaaagtacttgatttaggaca

SEQ ID NO: 1387143 - DNA, 22 bp, Artificial Sequence
  chemically synthesized
gcacaccaatgtcctaaatcaa

SEQ ID NO: 1387144 - DNA, 22 bp, Artificial Sequence
  chemically synthesized
gtaggtcttgaaaagtacttga

SEQ ID NO: 1387145 - DNA, 22 bp, Artificial Sequence
  chemically synthesized
cgtaggtcttgaaaagtacttg

SEQ ID NO: 1387146 - DNA, 22 bp, Artificial Sequence
  chemically synthesized
tcgtaggtcttgaaaagtactt

SEQ ID NO: 1387147 - DNA, 22 bp, Artificial Sequence
  chemically synthesized
agtgttttcgtaggtcttgaaa

SEQ ID NO: 1387148 - DNA, 22 bp, Artificial Sequence
  chemically synthesized
aatcaagtacttttcaagacct

SEQ ID NO: 1387149 - DNA, 22 bp, Artificial Sequence
  chemically synthesized
ctaagtgttttcgtaggtcttg

SEQ ID NO: 1387150 - DNA, 22 bp, Artificial Sequence
  chemically synthesized
cctaagtgttttcgtaggtctt

SEQ ID NO: 1387151 - DNA, 22 bp, Artificial Sequence
  chemically synthesized
tgtggcttcctaagtgttttcg

SEQ ID NO: 1387152 - DNA, 22 bp, Artificial Sequence
  chemically synthesized
ttcaagacctacgaaaacactt

SEQ ID NO: 1387153 - DNA, 22 bp, Artificial Sequence
  chemically synthesized
tcaagacctacgaaaacactta

SEQ ID NO: 1387154 - DNA, 22 bp, Artificial Sequence
  chemically synthesized
caagacctacgaaaacacttag

SEQ ID NO: 1387155 - DNA, 22 bp, Artificial Sequence
  chemically synthesized
ctgtgtggcttcctaagtgttt

SEQ ID NO: 1387156 - DNA, 22 bp, Artificial Sequence
  chemically synthesized
aagacctacgaaaacacttagg

SEQ ID NO: 1387157 - DNA, 22 bp, Artificial Sequence
  chemically synthesized
ttactgtgtggcttcctaagtg

SEQ ID NO: 1387158 - DNA, 22 bp, Artificial Sequence
  chemically synthesized
cgaaaacacttaggaagccaca

SEQ ID NO: 1387159 - DNA, 22 bp, Artificial Sequence
  chemically synthesized
aagtcccccattattactgtgt

SEQ ID NO: 1387160 - DNA, 22 bp, Artificial Sequence
  chemically synthesized
ttgaagtcccccattattactg

SEQ ID NO: 1387161 - DNA, 22 bp, Artificial Sequence
  chemically synthesized
aggaagccacacagtaataatg

SEQ ID NO: 1387162 - DNA, 22 bp, Artificial Sequence
  chemically synthesized
ggaagccacacagtaataatgg

SEQ ID NO: 1387163 - DNA, 22 bp, Artificial Sequence
  chemically synthesized
tcagtaggttgttgaagtcccc

SEQ ID NO: 1387164 - DNA, 22 bp, Artificial Sequence
  chemically synthesized
acactatcagtaggttgttgaa

SEQ ID NO: 1387165 - DNA, 22 bp, Artificial Sequence
  chemically synthesized
agtgatcggtctaacactatca

SEQ ID NO: 1387166 - DNA, 22 bp, Artificial Sequence
  chemically synthesized
caacaacctactgatagtgtta

SEQ ID NO: 1387167 - DNA, 22 bp, Artificial Sequence
  chemically synthesized
aacaacctactgatagtgttag

SEQ ID NO: 1387168 - DNA, 22 bp, Artificial Sequence
  chemically synthesized
cctcagtgatcggtctaacact

SEQ ID NO: 1387169 - DNA, 22 bp, Artificial Sequence
  chemically synthesized
tgcctcagtgatcggtctaaca

SEQ ID NO: 1387170 - DNA, 22 bp, Artificial Sequence
  chemically synthesized
ctgcctcagtgatcggtctaac

SEQ ID NO: 1387171 - DNA, 22 bp, Artificial Sequence
  chemically synthesized
tctgcctcagtgatcggtctaa

SEQ ID NO: 1387172 - DNA, 22 bp, Artificial Sequence
  chemically synthesized
ctgatagtgttagaccgatcac

SEQ ID NO: 1387173 - DNA, 22 bp, Artificial Sequence
  chemically synthesized
gttttctgcctcagtgatcggt

SEQ ID NO: 1387174 - DNA, 22 bp, Artificial Sequence
  chemically synthesized
atagtgttagaccgatcactga

SEQ ID NO: 1387175 - DNA, 22 bp, Artificial Sequence
  chemically synthesized
ttagttttctgcctcagtgatc

SEQ ID NO: 1387176 - DNA, 22 bp, Artificial Sequence
  chemically synthesized
gttagttttctgcctcagtgat

SEQ ID NO: 1387177 - DNA, 22 bp, Artificial Sequence
  chemically synthesized
tgttagttttctgcctcagtga

SEQ ID NO: 1387178 - DNA, 22 bp, Artificial Sequence
  chemically synthesized
tttgttagttttctgcctcagt

SEQ ID NO: 1387179 - DNA, 22 bp, Artificial Sequence
  chemically synthesized
ctttgttagttttctgcctcag

SEQ ID NO: 1387180 - DNA, 22 bp, Artificial Sequence
  chemically synthesized
gaccgatcactgaggcagaaaa

SEQ ID NO: 1387181 - DNA, 22 bp, Artificial Sequence
  chemically synthesized
atccagaatttctttgttagtt

SEQ ID NO: 1387182 - DNA, 22 bp, Artificial Sequence
  chemically synthesized
aatccagaatttctttgttagt

SEQ ID NO: 1387183 - DNA, 22 bp, Artificial Sequence
  chemically synthesized
aggcagaaaactaacaaagaaa

SEQ ID NO: 1387184 - DNA, 22 bp, Artificial Sequence
  chemically synthesized
acaaagaaattctggattaaat

SEQ ID NO: 1387185 - DNA, 22 bp, Artificial Sequence
  chemically synthesized
gtcaagagtcaaatttaatcca

SEQ ID NO: 1387186 - DNA, 22 bp, Artificial Sequence
  chemically synthesized
gttggtcaagagtcaaatttaa

SEQ ID NO: 1387187 - DNA, 22 bp, Artificial Sequence
  chemically synthesized
ggtctagttggtcaagagtcaa

SEQ ID NO: 1387188 - DNA, 22 bp, Artificial Sequence
  chemically synthesized
tggattaaatttgactcttgac

SEQ ID NO: 1387189 - DNA, 22 bp, Artificial Sequence
  chemically synthesized
ttaggtctagttggtcaagagt

SEQ ID NO: 1387190 - DNA, 22 bp, Artificial Sequence
  chemically synthesized
gattaaatttgactcttgacca

SEQ ID NO: 1387191 - DNA, 22 bp, Artificial Sequence
  chemically synthesized
aatttgactcttgaccaactag

SEQ ID NO: 1387192 - DNA, 22 bp, Artificial Sequence
  chemically synthesized
gactcttgaccaactagaccta

SEQ ID NO: 1387193 - DNA, 22 bp, Artificial Sequence
  chemically synthesized
actcttgaccaactagacctaa

SEQ ID NO: 1387194 - DNA, 22 bp, Artificial Sequence
  chemically synthesized
ttgaccaactagacctaataga

SEQ ID NO: 1387195 - DNA, 22 bp, Artificial Sequence
  chemically synthesized
gaccaactagacctaatagaca

SEQ ID NO: 1387196 - DNA, 22 bp, Artificial Sequence
  chemically synthesized
accaactagacctaatagacat

SEQ ID NO: 1387197 - DNA, 22 bp, Artificial Sequence
  chemically synthesized
ggtaaagtagtatgtagatgtc

SEQ ID NO: 1387198 - DNA, 22 bp, Artificial Sequence
  chemically synthesized
gggtaaagtagtatgtagatgt

SEQ ID NO: 1387199 - DNA, 22 bp, Artificial Sequence
  chemically synthesized
tgggtaaagtagtatgtagatg

SEQ ID NO: 1387200 - DNA, 22 bp, Artificial Sequence
  chemically synthesized
gacctaatagacatctacatac

SEQ ID NO: 1387201 - DNA, 22 bp, Artificial Sequence
  chemically synthesized
tggttttgggtaaagtagtatg

SEQ ID NO: 1387202 - DNA, 22 bp, Artificial Sequence
  chemically synthesized
atagacatctacatactacttt

SEQ ID NO: 1387203 - DNA, 22 bp, Artificial Sequence
  chemically synthesized
tgtggttttgggtaaagtagta

SEQ ID NO: 1387204 - DNA, 22 bp, Artificial Sequence
  chemically synthesized
catactactttacccaaaacca

SEQ ID NO: 1387205 - DNA, 22 bp, Artificial Sequence
  chemically synthesized
ctttacccaaaaccacagaata

SEQ ID NO: 1387206 - DNA, 22 bp, Artificial Sequence
  chemically synthesized
tacccaaaaccacagaatatac

SEQ ID NO: 1387207 - DNA, 22 bp, Artificial Sequence
  chemically synthesized
acccaaaaccacagaatataca

SEQ ID NO: 1387208 - DNA, 22 bp, Artificial Sequence
  chemically synthesized
cccaaaaccacagaatatacat

SEQ ID NO: 1387209 - DNA, 22 bp, Artificial Sequence
  chemically synthesized
tgtgcagatgagaagaatgtat

SEQ ID NO: 1387210 - DNA, 22 bp, Artificial Sequence
  chemically synthesized
tgtgtgcagatgagaagaatgt

SEQ ID NO: 1387211 - DNA, 22 bp, Artificial Sequence
  chemically synthesized
cagtacattctgtgtgcagatg

SEQ ID NO: 1387212 - DNA, 22 bp, Artificial Sequence
  chemically synthesized
gcagtacattctgtgtgcagat

SEQ ID NO: 1387213 - DNA, 22 bp, Artificial Sequence
  chemically synthesized
tcttgcagtacattctgtgtgc

SEQ ID NO: 1387214 - DNA, 22 bp, Artificial Sequence
  chemically synthesized
atcttgcagtacattctgtgtg

SEQ ID NO: 1387215 - DNA, 22 bp, Artificial Sequence
  chemically synthesized
ttctcatctgcacacagaatgt

SEQ ID NO: 1387216 - DNA, 22 bp, Artificial Sequence
  chemically synthesized
ctcatctgcacacagaatgtac

SEQ ID NO: 1387217 - DNA, 22 bp, Artificial Sequence
  chemically synthesized
tcatctgcacacagaatgtact

SEQ ID NO: 1387218 - DNA, 22 bp, Artificial Sequence
  chemically synthesized
atctgcacacagaatgtactgc

SEQ ID NO: 1387219 - DNA, 22 bp, Artificial Sequence
  chemically synthesized
cacacagaatgtactgcaagat

SEQ ID NO: 1387220 - DNA, 22 bp, Artificial Sequence
  chemically synthesized
agcatgtggtttatcttgcagt

SEQ ID NO: 1387221 - DNA, 22 bp, Artificial Sequence
  chemically synthesized
tggctgagcatgtggtttatct

SEQ ID NO: 1387222 - DNA, 22 bp, Artificial Sequence
  chemically synthesized
atggctgagcatgtggtttatc

SEQ ID NO: 1387223 - DNA, 22 bp, Artificial Sequence
  chemically synthesized
tatggctgagcatgtggtttat

SEQ ID NO: 1387224 - DNA, 22 bp, Artificial Sequence
  chemically synthesized
gctttatggctgagcatgtggt

SEQ ID NO: 1387225 - DNA, 22 bp, Artificial Sequence
  chemically synthesized
caagataaaccacatgctcagc

SEQ ID NO: 1387226 - DNA, 22 bp, Artificial Sequence
  chemically synthesized
agattcgctttatggctgagca

SEQ ID NO: 1387227 - DNA, 22 bp, Artificial Sequence
  chemically synthesized
ttgagattcgctttatggctga

SEQ ID NO: 1387228 - DNA, 22 bp, Artificial Sequence
  chemically synthesized
attgagattcgctttatggctg

SEQ ID NO: 1387229 - DNA, 22 bp, Artificial Sequence
  chemically synthesized
gaaatttattgagattcgcttt

SEQ ID NO: 1387230 - DNA, 22 bp, Artificial Sequence
  chemically synthesized
cgaaatttattgagattcgctt

SEQ ID NO: 1387231 - DNA, 22 bp, Artificial Sequence
  chemically synthesized
tcgaaatttattgagattcgct

SEQ ID NO: 1387232 - DNA, 22 bp, Artificial Sequence
  chemically synthesized
agccataaagcgaatctcaata

SEQ ID NO: 1387233 - DNA, 22 bp, Artificial Sequence
  chemically synthesized
aattttcgaaatttattgagat

SEQ ID NO: 1387234 - DNA, 22 bp, Artificial Sequence
  chemically synthesized
caattttcgaaatttattgaga

SEQ ID NO: 1387235 - DNA, 22 bp, Artificial Sequence
  chemically synthesized
tttcaattttcgaaatttattg

SEQ ID NO: 1387236 - DNA, 22 bp, Artificial Sequence
  chemically synthesized
atttcaattttcgaaatttatt

SEQ ID NO: 1387237 - DNA, 22 bp, Artificial Sequence
  chemically synthesized
tatttcaattttcgaaatttat

SEQ ID NO: 1387238 - DNA, 22 bp, Artificial Sequence
  chemically synthesized
ttatttcaattttcgaaattta

SEQ ID NO: 1387239 - DNA, 22 bp, Artificial Sequence
  chemically synthesized
cttttatttcaattttcgaaat

SEQ ID NO: 1387240 - DNA, 22 bp, Artificial Sequence
  chemically synthesized
gcttttatttcaattttcgaaa

SEQ ID NO: 1387241 - DNA, 22 bp, Artificial Sequence
  chemically synthesized
tttgcttttatttcaattttcg

SEQ ID NO: 1387242 - DNA, 22 bp, Artificial Sequence
  chemically synthesized
gtttgcttttatttcaattttc

SEQ ID NO: 1387243 - DNA, 22 bp, Artificial Sequence
  chemically synthesized
aataaatttcgaaaattgaaat

SEQ ID NO: 1387244 - DNA, 22 bp, Artificial Sequence
  chemically synthesized
cgaaaattgaaataaaagcaaa

SEQ ID NO: 1387245 - DNA, 22 bp, Artificial Sequence
  chemically synthesized
gaaaattgaaataaaagcaaac

SEQ ID NO: 1387246 - DNA, 22 bp, Artificial Sequence
  chemically synthesized
tggtccaagaatttgtttgctt

SEQ ID NO: 1387247 - DNA, 22 bp, Artificial Sequence
  chemically synthesized
cactgtggtccaagaatttgtt

SEQ ID NO: 1387248 - DNA, 22 bp, Artificial Sequence
  chemically synthesized
aaataaaagcaaacaaattctt

SEQ ID NO: 1387249 - DNA, 22 bp, Artificial Sequence
  chemically synthesized
ttccactgtggtccaagaattt

SEQ ID NO: 1387250 - DNA, 22 bp, Artificial Sequence
  chemically synthesized
attccactgtggtccaagaatt

SEQ ID NO: 1387251 - DNA, 22 bp, Artificial Sequence
  chemically synthesized
tattccactgtggtccaagaat

SEQ ID NO: 1387252 - DNA, 22 bp, Artificial Sequence
  chemically synthesized
ttattccactgtggtccaagaa

SEQ ID NO: 1387253 - DNA, 22 bp, Artificial Sequence
  chemically synthesized
tttttattccactgtggtccaa

SEQ ID NO: 1387254 - DNA, 22 bp, Artificial Sequence
  chemically synthesized
tatttttattccactgtggtcc

SEQ ID NO: 1387255 - DNA, 22 bp, Artificial Sequence
  chemically synthesized
ctatttttattccactgtggtc

SEQ ID NO: 1387256 - DNA, 22 bp, Artificial Sequence
  chemically synthesized
atttctatttttattccactgt

SEQ ID NO: 1387257 - DNA, 22 bp, Artificial Sequence
  chemically synthesized
ttggaccacagtggaataaaaa

SEQ ID NO: 1387258 - DNA, 22 bp, Artificial Sequence
  chemically synthesized
gtattgatttctatttttattc

SEQ ID NO: 1387259 - DNA, 22 bp, Artificial Sequence
  chemically synthesized
ggaccacagtggaataaaaata

SEQ ID NO: 1387260 - DNA, 22 bp, Artificial Sequence
  chemically synthesized
ggtattgatttctatttttatt

SEQ ID NO: 1387261 - DNA, 22 bp, Artificial Sequence
  chemically synthesized
gaccacagtggaataaaaatag

SEQ ID NO: 1387262 - DNA, 22 bp, Artificial Sequence
  chemically synthesized
ttggtattgatttctattttta

SEQ ID NO: 1387263 - DNA, 22 bp, Artificial Sequence
  chemically synthesized
agaggtcctcttggtattgatt

SEQ ID NO: 1387264 - DNA, 22 bp, Artificial Sequence
  chemically synthesized
gagaggtcctcttggtattgat

SEQ ID NO: 1387265 - DNA, 22 bp, Artificial Sequence
  chemically synthesized
tgagaggtcctcttggtattga

SEQ ID NO: 1387266 - DNA, 22 bp, Artificial Sequence
  chemically synthesized
tgtggttttgagaggtcctctt

SEQ ID NO: 1387267 - DNA, 22 bp, Artificial Sequence
  chemically synthesized
catgtaattgtgtggttttgag

SEQ ID NO: 1387268 - DNA, 22 bp, Artificial Sequence
  chemically synthesized
ccatgtaattgtgtggttttga

SEQ ID NO: 1387269 - DNA, 22 bp, Artificial Sequence
  chemically synthesized
gtttccatgtaattgtgtggtt

SEQ ID NO: 1387270 - DNA, 22 bp, Artificial Sequence
  chemically synthesized
ggtttccatgtaattgtgtggt

SEQ ID NO: 1387271 - DNA, 22 bp, Artificial Sequence
  chemically synthesized
tttggtttccatgtaattgtgt

SEQ ID NO: 1387272 - DNA, 22 bp, Artificial Sequence
  chemically synthesized
tcaaaaccacacaattacatgg

SEQ ID NO: 1387273 - DNA, 22 bp, Artificial Sequence
  chemically synthesized
aaaaccacacaattacatggaa

SEQ ID NO: 1387274 - DNA, 22 bp, Artificial Sequence
  chemically synthesized
aggagcaagttgtttggtttcc

SEQ ID NO: 1387275 - DNA, 22 bp, Artificial Sequence
  chemically synthesized
catggaaaccaaacaacttgct

SEQ ID NO: 1387276 - DNA, 22 bp, Artificial Sequence
  chemically synthesized
acccaaaagtcattcaggagca

SEQ ID NO: 1387277 - DNA, 22 bp, Artificial Sequence
  chemically synthesized
ttcacccaaaagtcattcagga

SEQ ID NO: 1387278 - DNA, 22 bp, Artificial Sequence
  chemically synthesized
ttgttcacccaaaagtcattca

SEQ ID NO: 1387279 - DNA, 22 bp, Artificial Sequence
  chemically synthesized
gttgttcacccaaaagtcattc

SEQ ID NO: 1387280 - DNA, 22 bp, Artificial Sequence
  chemically synthesized
tgttgttcacccaaaagtcatt

SEQ ID NO: 1387281 - DNA, 22 bp, Artificial Sequence
  chemically synthesized
attttgttgttcacccaaaagt

SEQ ID NO: 1387282 - DNA, 22 bp, Artificial Sequence
  chemically synthesized
gctcctgaatgacttttgggtg

SEQ ID NO: 1387283 - DNA, 22 bp, Artificial Sequence
  chemically synthesized
aattttgttgttcacccaaaag

SEQ ID NO: 1387284 - DNA, 22 bp, Artificial Sequence
  chemically synthesized
ctcctgaatgacttttgggtga

SEQ ID NO: 1387285 - DNA, 22 bp, Artificial Sequence
  chemically synthesized
cttaattttgttgttcacccaa

SEQ ID NO: 1387286 - DNA, 22 bp, Artificial Sequence
  chemically synthesized
ctgaatgacttttgggtgaaca

SEQ ID NO: 1387287 - DNA, 22 bp, Artificial Sequence
  chemically synthesized
tgcttaattttgttgttcaccc

SEQ ID NO: 1387288 - DNA, 22 bp, Artificial Sequence
  chemically synthesized
aatgacttttgggtgaacaaca

SEQ ID NO: 1387289 - DNA, 22 bp, Artificial Sequence
  chemically synthesized
ttgggtgaacaacaaaattaag

SEQ ID NO: 1387290 - DNA, 22 bp, Artificial Sequence
  chemically synthesized
tgggtgaacaacaaaattaagc

SEQ ID NO: 1387291 - DNA, 22 bp, Artificial Sequence
  chemically synthesized
gggtgaacaacaaaattaagca

SEQ ID NO: 1387292 - DNA, 22 bp, Artificial Sequence
  chemically synthesized
ggtgaacaacaaaattaagcag

SEQ ID NO: 1387293 - DNA, 22 bp, Artificial Sequence
  chemically synthesized
agtgaaaaaaaataacaatctc

SEQ ID NO: 1387294 - DNA, 22 bp, Artificial Sequence
  chemically synthesized
tactgagtgaaaaaaaataaca

SEQ ID NO: 1387295 - DNA, 22 bp, Artificial Sequence
  chemically synthesized
atactgagtgaaaaaaaataac

SEQ ID NO: 1387296 - DNA, 22 bp, Artificial Sequence
  chemically synthesized
agcagagattgttatttttttt

SEQ ID NO: 1387297 - DNA, 22 bp, Artificial Sequence
  chemically synthesized
gtgtaatttatactgagtgaaa

SEQ ID NO: 1387298 - DNA, 22 bp, Artificial Sequence
  chemically synthesized
ttattttttttcactcagtata

SEQ ID NO: 1387299 - DNA, 22 bp, Artificial Sequence
  chemically synthesized
ttttttttcactcagtataaat

SEQ ID NO: 1387300 - DNA, 22 bp, Artificial Sequence
  chemically synthesized
tttttcactcagtataaattac

SEQ ID NO: 1387301 - DNA, 22 bp, Artificial Sequence
  chemically synthesized
gataaacctggtgtaatttata

SEQ ID NO: 1387302 - DNA, 22 bp, Artificial Sequence
  chemically synthesized
ttttcactcagtataaattaca

SEQ ID NO: 1387303 - DNA, 22 bp, Artificial Sequence
  chemically synthesized
tttcactcagtataaattacac

SEQ ID NO: 1387304 - DNA, 22 bp, Artificial Sequence
  chemically synthesized
ttcactcagtataaattacacc

SEQ ID NO: 1387305 - DNA, 22 bp, Artificial Sequence
  chemically synthesized
ttggataaacctggtgtaattt

SEQ ID NO: 1387306 - DNA, 22 bp, Artificial Sequence
  chemically synthesized
tcactcagtataaattacacca

SEQ ID NO: 1387307 - DNA, 22 bp, Artificial Sequence
  chemically synthesized
cactcagtataaattacaccag

SEQ ID NO: 1387308 - DNA, 22 bp, Artificial Sequence
  chemically synthesized
actcagtataaattacaccagg

SEQ ID NO: 1387309 - DNA, 22 bp, Artificial Sequence
  chemically synthesized
actattggataaacctggtgta

SEQ ID NO: 1387310 - DNA, 22 bp, Artificial Sequence
  chemically synthesized
agtataaattacaccaggttta

SEQ ID NO: 1387311 - DNA, 22 bp, Artificial Sequence
  chemically synthesized
caccaggtttatccaatagtta

SEQ ID NO: 1387312 - DNA, 22 bp, Artificial Sequence
  chemically synthesized
cccagcaataaaaaggaattaa

SEQ ID NO: 1387313 - DNA, 22 bp, Artificial Sequence
  chemically synthesized
atccaatagttaattccttttt

SEQ ID NO: 1387314 - DNA, 22 bp, Artificial Sequence
  chemically synthesized
tccaatagttaattccttttta

SEQ ID NO: 1387315 - DNA, 22 bp, Artificial Sequence
  chemically synthesized
attcctttttattgctgggtaa

SEQ ID NO: 1387316 - DNA, 22 bp, Artificial Sequence
  chemically synthesized
ctttttattgctgggtaatatt

SEQ ID NO: 1387317 - DNA, 22 bp, Artificial Sequence
  chemically synthesized
tttattgctgggtaatattcca

SEQ ID NO: 1387318 - DNA, 22 bp, Artificial Sequence
  chemically synthesized
ttattgctgggtaatattccat

SEQ ID NO: 1387319 - DNA, 22 bp, Artificial Sequence
  chemically synthesized
tattgctgggtaatattccatg

SEQ ID NO: 1387320 - DNA, 22 bp, Artificial Sequence
  chemically synthesized
attgctgggtaatattccatgg

SEQ ID NO: 1387321 - DNA, 22 bp, Artificial Sequence
  chemically synthesized
ttgctgggtaatattccatggt

SEQ ID NO: 1387322 - DNA, 22 bp, Artificial Sequence
  chemically synthesized
tggtacatgcataccatggaat

SEQ ID NO: 1387323 - DNA, 22 bp, Artificial Sequence
  chemically synthesized
ctgggtaatattccatggtatg

SEQ ID NO: 1387324 - DNA, 22 bp, Artificial Sequence
  chemically synthesized
ggtaatattccatggtatgcat

SEQ ID NO: 1387325 - DNA, 22 bp, Artificial Sequence
  chemically synthesized
catggtatgcatgtaccacagg

SEQ ID NO: 1387326 - DNA, 22 bp, Artificial Sequence
  chemically synthesized
aaaaaaaaaaaaccctgtggta

SEQ ID NO: 1387327 - DNA, 22 bp, Artificial Sequence
  chemically synthesized
aaaaaaaaaaaaaccctgtggt

SEQ ID NO: 1387328 - DNA, 22 bp, Artificial Sequence
  chemically synthesized
cttaaaaaaaaaaaaaccctgt

SEQ ID NO: 1387329 - DNA, 22 bp, Artificial Sequence
  chemically synthesized
atatgtaattgcttaaaaaaaa

SEQ ID NO: 1387330 - DNA, 22 bp, Artificial Sequence
  chemically synthesized
gatatgtaattgcttaaaaaaa

SEQ ID NO: 1387331 - DNA, 22 bp, Artificial Sequence
  chemically synthesized
ttttttttttaagcaattacat

SEQ ID NO: 1387332 - DNA, 22 bp, Artificial Sequence
  chemically synthesized
tttttttttaagcaattacata

SEQ ID NO: 1387333 - DNA, 22 bp, Artificial Sequence
  chemically synthesized
ttttttttaagcaattacatat

SEQ ID NO: 1387334 - DNA, 22 bp, Artificial Sequence
  chemically synthesized
tttttttaagcaattacatatc

SEQ ID NO: 1387335 - DNA, 22 bp, Artificial Sequence
  chemically synthesized
ttttttaagcaattacatatca

SEQ ID NO: 1387336 - DNA, 22 bp, Artificial Sequence
  chemically synthesized
tttttaagcaattacatatcaa

SEQ ID NO: 1387337 - DNA, 22 bp, Artificial Sequence
  chemically synthesized
ttttaagcaattacatatcaag

SEQ ID NO: 1387338 - DNA, 22 bp, Artificial Sequence
  chemically synthesized
tttaagcaattacatatcaagg

SEQ ID NO: 1387339 - DNA, 22 bp, Artificial Sequence
  chemically synthesized
ttaagcaattacatatcaaggg

SEQ ID NO: 1387340 - DNA, 22 bp, Artificial Sequence
  chemically synthesized
taagcaattacatatcaaggga

SEQ ID NO: 1387341 - DNA, 22 bp, Artificial Sequence
  chemically synthesized
aagcaattacatatcaagggac

SEQ ID NO: 1387342 - DNA, 22 bp, Artificial Sequence
  chemically synthesized
agcaattacatatcaagggact

SEQ ID NO: 1387343 - DNA, 22 bp, Artificial Sequence
  chemically synthesized
catatcaagggacttttttgtg

SEQ ID NO: 1387344 - DNA, 22 bp, Artificial Sequence
  chemically synthesized
tagtaccaaaacacacaaaaaa

SEQ ID NO: 1387345 - DNA, 22 bp, Artificial Sequence
  chemically synthesized
atagtaccaaaacacacaaaaa

SEQ ID NO: 1387346 - DNA, 22 bp, Artificial Sequence
  chemically synthesized
atagcagccttatagtaccaaa

SEQ ID NO: 1387347 - DNA, 22 bp, Artificial Sequence
  chemically synthesized
ttttgtgtgttttggtactata

SEQ ID NO: 1387348 - DNA, 22 bp, Artificial Sequence
  chemically synthesized
tttgtgtgttttggtactataa

SEQ ID NO: 1387349 - DNA, 22 bp, Artificial Sequence
  chemically synthesized
ttgtgtgttttggtactataag

SEQ ID NO: 1387350 - DNA, 22 bp, Artificial Sequence
  chemically synthesized
tgtgtgttttggtactataagg

SEQ ID NO: 1387351 - DNA, 22 bp, Artificial Sequence
  chemically synthesized
gtgtgttttggtactataaggc

SEQ ID NO: 1387352 - DNA, 22 bp, Artificial Sequence
  chemically synthesized
tgtgttttggtactataaggct

SEQ ID NO: 1387353 - DNA, 22 bp, Artificial Sequence
  chemically synthesized
tggtactataaggctgctatga

SEQ ID NO: 1387354 - DNA, 22 bp, Artificial Sequence
  chemically synthesized
ggtactataaggctgctatgaa

SEQ ID NO: 1387355 - DNA, 22 bp, Artificial Sequence
  chemically synthesized
gtactataaggctgctatgaat

SEQ ID NO: 1387356 - DNA, 22 bp, Artificial Sequence
  chemically synthesized
taaggctgctatgaatatttgt

SEQ ID NO: 1387357 - DNA, 22 bp, Artificial Sequence
  chemically synthesized
atacagaaacgtatccacaaat

SEQ ID NO: 1387358 - DNA, 22 bp, Artificial Sequence
  chemically synthesized
catacagaaacgtatccacaaa

SEQ ID NO: 1387359 - DNA, 22 bp, Artificial Sequence
  chemically synthesized
tcatacagaaacgtatccacaa

SEQ ID NO: 1387360 - DNA, 22 bp, Artificial Sequence
  chemically synthesized
ctatgaatatttgtggatacgt

SEQ ID NO: 1387361 - DNA, 22 bp, Artificial Sequence
  chemically synthesized
ttttcatacagaaacgtatcca

SEQ ID NO: 1387362 - DNA, 22 bp, Artificial Sequence
  chemically synthesized
gttttcatacagaaacgtatcc

SEQ ID NO: 1387363 - DNA, 22 bp, Artificial Sequence
  chemically synthesized
tgaatatttgtggatacgtttc

SEQ ID NO: 1387364 - DNA, 22 bp, Artificial Sequence
  chemically synthesized
gtggatacgtttctgtatgaaa

SEQ ID NO: 1387365 - DNA, 22 bp, Artificial Sequence
  chemically synthesized
tggatacgtttctgtatgaaaa

SEQ ID NO: 1387366 - DNA, 22 bp, Artificial Sequence
  chemically synthesized
aaaaaatgaaaacttgttttca

SEQ ID NO: 1387367 - DNA, 22 bp, Artificial Sequence
  chemically synthesized
aaaaaaatgaaaacttgttttc

SEQ ID NO: 1387368 - DNA, 22 bp, Artificial Sequence
  chemically synthesized
ttaaaaaaatgaaaacttgttt

SEQ ID NO: 1387369 - DNA, 22 bp, Artificial Sequence
  chemically synthesized
ctgtatgaaaacaagttttcat

SEQ ID NO: 1387370 - DNA, 22 bp, Artificial Sequence
  chemically synthesized
tgtatgaaaacaagttttcatt

SEQ ID NO: 1387371 - DNA, 22 bp, Artificial Sequence
  chemically synthesized
tatgaaaacaagttttcatttt

SEQ ID NO: 1387372 - DNA, 22 bp, Artificial Sequence
  chemically synthesized
atcattcttaaaaaaatgaaaa

SEQ ID NO: 1387373 - DNA, 22 bp, Artificial Sequence
  chemically synthesized
aatcattcttaaaaaaatgaaa

SEQ ID NO: 1387374 - DNA, 22 bp, Artificial Sequence
  chemically synthesized
ttaatcattcttaaaaaaatga

SEQ ID NO: 1387375 - DNA, 22 bp, Artificial Sequence
  chemically synthesized
ccctcttaatcattcttaaaaa

SEQ ID NO: 1387376 - DNA, 22 bp, Artificial Sequence
  chemically synthesized
tcatttttttaagaatgattaa

SEQ ID NO: 1387377 - DNA, 22 bp, Artificial Sequence
  chemically synthesized
catttttttaagaatgattaag

SEQ ID NO: 1387378 - DNA, 22 bp, Artificial Sequence
  chemically synthesized
atttttttaagaatgattaaga

SEQ ID NO: 1387379 - DNA, 22 bp, Artificial Sequence
  chemically synthesized
ttttaagaatgattaagagggc

SEQ ID NO: 1387380 - DNA, 22 bp, Artificial Sequence
  chemically synthesized
tttaagaatgattaagagggca

SEQ ID NO: 1387381 - DNA, 22 bp, Artificial Sequence
  chemically synthesized
ttaagaatgattaagagggcaa

SEQ ID NO: 1387382 - DNA, 22 bp, Artificial Sequence
  chemically synthesized
taagaatgattaagagggcaat

SEQ ID NO: 1387383 - DNA, 22 bp, Artificial Sequence
  chemically synthesized
aagaatgattaagagggcaatt

SEQ ID NO: 1387384 - DNA, 22 bp, Artificial Sequence
  chemically synthesized
agaatgattaagagggcaattg

SEQ ID NO: 1387385 - DNA, 22 bp, Artificial Sequence
  chemically synthesized
gcatatgacacagcaattgccc

SEQ ID NO: 1387386 - DNA, 22 bp, Artificial Sequence
  chemically synthesized
agcatatgacacagcaattgcc

SEQ ID NO: 1387387 - DNA, 22 bp, Artificial Sequence
  chemically synthesized
agagggcaattgctgtgtcata

SEQ ID NO: 1387388 - DNA, 22 bp, Artificial Sequence
  chemically synthesized
aaaatggacttagcatatgaca

SEQ ID NO: 1387389 - DNA, 22 bp, Artificial Sequence
  chemically synthesized
aaactaaaaatggacttagcat

SEQ ID NO: 1387390 - DNA, 22 bp, Artificial Sequence
  chemically synthesized
caaactaaaaatggacttagca

SEQ ID NO: 1387391 - DNA, 22 bp, Artificial Sequence
  chemically synthesized
tcaaactaaaaatggacttagc

SEQ ID NO: 1387392 - DNA, 22 bp, Artificial Sequence
  chemically synthesized
ctgtgtcatatgctaagtccat

SEQ ID NO: 1387393 - DNA, 22 bp, Artificial Sequence
  chemically synthesized
tgtcatatgctaagtccatttt

SEQ ID NO: 1387394 - DNA, 22 bp, Artificial Sequence
  chemically synthesized
attttcaaactaaaaatggact

SEQ ID NO: 1387395 - DNA, 22 bp, Artificial Sequence
  chemically synthesized
gcagttcattttcaaactaaaa

SEQ ID NO: 1387396 - DNA, 22 bp, Artificial Sequence
  chemically synthesized
ggcagttcattttcaaactaaa

SEQ ID NO: 1387397 - DNA, 22 bp, Artificial Sequence
  chemically synthesized
agtccatttttagtttgaaaat

SEQ ID NO: 1387398 - DNA, 22 bp, Artificial Sequence
  chemically synthesized
gaaaatagtttggcagttcatt

SEQ ID NO: 1387399 - DNA, 22 bp, Artificial Sequence
  chemically synthesized
ttagtttgaaaatgaactgcca

SEQ ID NO: 1387400 - DNA, 22 bp, Artificial Sequence
  chemically synthesized
tagtttgaaaatgaactgccaa

SEQ ID NO: 1387401 - DNA, 22 bp, Artificial Sequence
  chemically synthesized
agtttgaaaatgaactgccaaa

SEQ ID NO: 1387402 - DNA, 22 bp, Artificial Sequence
  chemically synthesized
gtttgaaaatgaactgccaaac

SEQ ID NO: 1387403 - DNA, 22 bp, Artificial Sequence
  chemically synthesized
gaaaatgaactgccaaactatt

SEQ ID NO: 1387404 - DNA, 22 bp, Artificial Sequence
  chemically synthesized
aaaatgaactgccaaactattt

SEQ ID NO: 1387405 - DNA, 22 bp, Artificial Sequence
  chemically synthesized
aatggtatagccacactggaaa

SEQ ID NO: 1387406 - DNA, 22 bp, Artificial Sequence
  chemically synthesized
ccaaactattttccagtgtggc

SEQ ID NO: 1387407 - DNA, 22 bp, Artificial Sequence
  chemically synthesized
ttaaatggtatagccacactgg

SEQ ID NO: 1387408 - DNA, 22 bp, Artificial Sequence
  chemically synthesized
ttttccagtgtggctataccat

SEQ ID NO: 1387409 - DNA, 22 bp, Artificial Sequence
  chemically synthesized
gtgggactgttaaatggtatag

SEQ ID NO: 1387410 - DNA, 22 bp, Artificial Sequence
  chemically synthesized
tccagtgtggctataccattta

SEQ ID NO: 1387411 - DNA, 22 bp, Artificial Sequence
  chemically synthesized
ccagtgtggctataccatttaa

SEQ ID NO: 1387412 - DNA, 22 bp, Artificial Sequence
  chemically synthesized
ctggtgggactgttaaatggta

SEQ ID NO: 1387413 - DNA, 22 bp, Artificial Sequence
  chemically synthesized
cagtgtggctataccatttaac

SEQ ID NO: 1387414 - DNA, 22 bp, Artificial Sequence
  chemically synthesized
taccatttaacagtcccaccag

SEQ ID NO: 1387415 - DNA, 22 bp, Artificial Sequence
  chemically synthesized
ggtaaatcatatattgctggtg

SEQ ID NO: 1387416 - DNA, 22 bp, Artificial Sequence
  chemically synthesized
aacagtcccaccagcaatatat

SEQ ID NO: 1387417 - DNA, 22 bp, Artificial Sequence
  chemically synthesized
acagtcccaccagcaatatatg

SEQ ID NO: 1387418 - DNA, 22 bp, Artificial Sequence
  chemically synthesized
gcaaggaagcggagaaactggg

SEQ ID NO: 1387419 - DNA, 22 bp, Artificial Sequence
  chemically synthesized
acccagtttctccgcttccttg

SEQ ID NO: 1387420 - DNA, 22 bp, Artificial Sequence
  chemically synthesized
cccagtttctccgcttccttgc

SEQ ID NO: 1387421 - DNA, 22 bp, Artificial Sequence
  chemically synthesized
ctccgcttccttgccagcatct

SEQ ID NO: 1387422 - DNA, 22 bp, Artificial Sequence
  chemically synthesized
tccgcttccttgccagcatctg

SEQ ID NO: 1387423 - DNA, 22 bp, Artificial Sequence
  chemically synthesized
cgcttccttgccagcatctggt

SEQ ID NO: 1387424 - DNA, 22 bp, Artificial Sequence
  chemically synthesized
aaataagaaaatagacaccaga

SEQ ID NO: 1387425 - DNA, 22 bp, Artificial Sequence
  chemically synthesized
ccttgccagcatctggtgtcta

SEQ ID NO: 1387426 - DNA, 22 bp, Artificial Sequence
  chemically synthesized
cttgccagcatctggtgtctat

SEQ ID NO: 1387427 - DNA, 22 bp, Artificial Sequence
  chemically synthesized
gccagcatctggtgtctatttt

SEQ ID NO: 1387428 - DNA, 22 bp, Artificial Sequence
  chemically synthesized
ccagcatctggtgtctattttc

SEQ ID NO: 1387429 - DNA, 22 bp, Artificial Sequence
  chemically synthesized
gtgtctattttcttattttagc

SEQ ID NO: 1387430 - DNA, 22 bp, Artificial Sequence
  chemically synthesized
gtagtcaaaatggctaaaataa

SEQ ID NO: 1387431 - DNA, 22 bp, Artificial Sequence
  chemically synthesized
cctagtagtcaaaatggctaaa

SEQ ID NO: 1387432 - DNA, 22 bp, Artificial Sequence
  chemically synthesized
ttttcttattttagccattttg

SEQ ID NO: 1387433 - DNA, 22 bp, Artificial Sequence
  chemically synthesized
ttacctagtagtcaaaatggct

SEQ ID NO: 1387434 - DNA, 22 bp, Artificial Sequence
  chemically synthesized
tcttattttagccattttgact

SEQ ID NO: 1387435 - DNA, 22 bp, Artificial Sequence
  chemically synthesized
cttattttagccattttgacta

SEQ ID NO: 1387436 - DNA, 22 bp, Artificial Sequence
  chemically synthesized
ttattttagccattttgactac

SEQ ID NO: 1387437 - DNA, 22 bp, Artificial Sequence
  chemically synthesized
attttagccattttgactacta

SEQ ID NO: 1387438 - DNA, 22 bp, Artificial Sequence
  chemically synthesized
ttttagccattttgactactag

SEQ ID NO: 1387439 - DNA, 22 bp, Artificial Sequence
  chemically synthesized
tagccattttgactactaggta

SEQ ID NO: 1387440 - DNA, 22 bp, Artificial Sequence
  chemically synthesized
agccattttgactactaggtaa

SEQ ID NO: 1387441 - DNA, 22 bp, Artificial Sequence
  chemically synthesized
gccattttgactactaggtaat

SEQ ID NO: 1387442 - DNA, 22 bp, Artificial Sequence
  chemically synthesized
aaaccaaagtgagatattatta

SEQ ID NO: 1387443 - DNA, 22 bp, Artificial Sequence
  chemically synthesized
tgactactaggtaataatatct

SEQ ID NO: 1387444 - DNA, 22 bp, Artificial Sequence
  chemically synthesized
gactactaggtaataatatctc

SEQ ID NO: 1387445 - DNA, 22 bp, Artificial Sequence
  chemically synthesized
actactaggtaataatatctca

SEQ ID NO: 1387446 - DNA, 22 bp, Artificial Sequence
  chemically synthesized
ctaggtaataatatctcacttt

SEQ ID NO: 1387447 - DNA, 22 bp, Artificial Sequence
  chemically synthesized
ggtaataatatctcactttggt

SEQ ID NO: 1387448 - DNA, 22 bp, Artificial Sequence
  chemically synthesized
gtaaaatggaaattaaaaccaa

SEQ ID NO: 1387449 - DNA, 22 bp, Artificial Sequence
  chemically synthesized
actttggttttaatttccattt

SEQ ID NO: 1387450 - DNA, 22 bp, Artificial Sequence
  chemically synthesized
tggttttaatttccattttact

SEQ ID NO: 1387451 - DNA, 22 bp, Artificial Sequence
  chemically synthesized
ggttttaatttccattttacta

SEQ ID NO: 1387452 - DNA, 22 bp, Artificial Sequence
  chemically synthesized
gttttaatttccattttactaa

SEQ ID NO: 1387453 - DNA, 22 bp, Artificial Sequence
  chemically synthesized
aacatcaacaaccattagtaaa

SEQ ID NO: 1387454 - DNA, 22 bp, Artificial Sequence
  chemically synthesized
taatttccattttactaatggt

SEQ ID NO: 1387455 - DNA, 22 bp, Artificial Sequence
  chemically synthesized
aatttccattttactaatggtt

SEQ ID NO: 1387456 - DNA, 22 bp, Artificial Sequence
  chemically synthesized
atttccattttactaatggttg

SEQ ID NO: 1387457 - DNA, 22 bp, Artificial Sequence
  chemically synthesized
ccattttactaatggttgttga

SEQ ID NO: 1387458 - DNA, 22 bp, Artificial Sequence
  chemically synthesized
cattttactaatggttgttgat

SEQ ID NO: 1387459 - DNA, 22 bp, Artificial Sequence
  chemically synthesized
aaaaatgttcaacatcaacaac

SEQ ID NO: 1387460 - DNA, 22 bp, Artificial Sequence
  chemically synthesized
tactaatggttgttgatgttga

SEQ ID NO: 1387461 - DNA, 22 bp, Artificial Sequence
  chemically synthesized
actaatggttgttgatgttgaa

SEQ ID NO: 1387462 - DNA, 22 bp, Artificial Sequence
  chemically synthesized
ctaatggttgttgatgttgaac

SEQ ID NO: 1387463 - DNA, 22 bp, Artificial Sequence
  chemically synthesized
atggttgttgatgttgaacatt

SEQ ID NO: 1387464 - DNA, 22 bp, Artificial Sequence
  chemically synthesized
ttgatgttgaacattttttaat

SEQ ID NO: 1387465 - DNA, 22 bp, Artificial Sequence
  chemically synthesized
atgttgaacattttttaatgca

SEQ ID NO: 1387466 - DNA, 22 bp, Artificial Sequence
  chemically synthesized
aacattttttaatgcatttata

SEQ ID NO: 1387467 - DNA, 22 bp, Artificial Sequence
  chemically synthesized
tttaatgcatttatatatgcca

SEQ ID NO: 1387468 - DNA, 22 bp, Artificial Sequence
  chemically synthesized
ttaatgcatttatatatgccat

SEQ ID NO: 1387469 - DNA, 22 bp, Artificial Sequence
  chemically synthesized
taatgcatttatatatgccatc

SEQ ID NO: 1387470 - DNA, 22 bp, Artificial Sequence
  chemically synthesized
aatgcatttatatatgccatct

SEQ ID NO: 1387471 - DNA, 22 bp, Artificial Sequence
  chemically synthesized
atgcatttatatatgccatctg

SEQ ID NO: 1387472 - DNA, 22 bp, Artificial Sequence
  chemically synthesized
accaatgaagatatacagatgg

SEQ ID NO: 1387473 - DNA, 22 bp, Artificial Sequence
  chemically synthesized
caccaatgaagatatacagatg

SEQ ID NO: 1387474 - DNA, 22 bp, Artificial Sequence
  chemically synthesized
atatatgccatctgtatatctt

SEQ ID NO: 1387475 - DNA, 22 bp, Artificial Sequence
  chemically synthesized
tatatgccatctgtatatcttc

SEQ ID NO: 1387476 - DNA, 22 bp, Artificial Sequence
  chemically synthesized
tatatcttcattggtgaaacat

SEQ ID NO: 1387477 - DNA, 22 bp, Artificial Sequence
  chemically synthesized
cattggtgaaacatctgtgcct

SEQ ID NO: 1387478 - DNA, 22 bp, Artificial Sequence
  chemically synthesized
attggtgaaacatctgtgcctg

SEQ ID NO: 1387479 - DNA, 22 bp, Artificial Sequence
  chemically synthesized
gtgaaacatctgtgcctgtctt

SEQ ID NO: 1387480 - DNA, 22 bp, Artificial Sequence
  chemically synthesized
tgcctgtcttttgtccattttc

SEQ ID NO: 1387481 - DNA, 22 bp, Artificial Sequence
  chemically synthesized
aaaatccaataagaaaatggac

SEQ ID NO: 1387482 - DNA, 22 bp, Artificial Sequence
  chemically synthesized
aaaaatccaataagaaaatgga

SEQ ID NO: 1387483 - DNA, 22 bp, Artificial Sequence
  chemically synthesized
taaaaatccaataagaaaatgg

SEQ ID NO: 1387484 - DNA, 22 bp, Artificial Sequence
  chemically synthesized
tcttttgtccattttcttattg

SEQ ID NO: 1387485 - DNA, 22 bp, Artificial Sequence
  chemically synthesized
aacattttaaaaatccaataag

SEQ ID NO: 1387486 - DNA, 22 bp, Artificial Sequence
  chemically synthesized
ttgtccattttcttattggatt

SEQ ID NO: 1387487 - DNA, 22 bp, Artificial Sequence
  chemically synthesized
tgtccattttcttattggattt

SEQ ID NO: 1387488 - DNA, 22 bp, Artificial Sequence
  chemically synthesized
gtccattttcttattggatttt

SEQ ID NO: 1387489 - DNA, 22 bp, Artificial Sequence
  chemically synthesized
tccattttcttattggattttt

SEQ ID NO: 1387490 - DNA, 22 bp, Artificial Sequence
  chemically synthesized
aaaactcaacattttaaaaatc

SEQ ID NO: 1387491 - DNA, 22 bp, Artificial Sequence
  chemically synthesized
tcaaaactcaacattttaaaaa

SEQ ID NO: 1387492 - DNA, 22 bp, Artificial Sequence
  chemically synthesized
tcttattggatttttaaaatgt

SEQ ID NO: 1387493 - DNA, 22 bp, Artificial Sequence
  chemically synthesized
cttattggatttttaaaatgtt

SEQ ID NO: 1387494 - DNA, 22 bp, Artificial Sequence
  chemically synthesized
ttattggatttttaaaatgttg

SEQ ID NO: 1387495 - DNA, 22 bp, Artificial Sequence
  chemically synthesized
attggatttttaaaatgttgag

SEQ ID NO: 1387496 - DNA, 22 bp, Artificial Sequence
  chemically synthesized
ttggatttttaaaatgttgagt

SEQ ID NO: 1387497 - DNA, 22 bp, Artificial Sequence
  chemically synthesized
gatttttaaaatgttgagtttt

SEQ ID NO: 1387498 - DNA, 22 bp, Artificial Sequence
  chemically synthesized
cataaagagctctcaaaactca

SEQ ID NO: 1387499 - DNA, 22 bp, Artificial Sequence
  chemically synthesized
ttaaaatgttgagttttgagag

SEQ ID NO: 1387500 - DNA, 22 bp, Artificial Sequence
  chemically synthesized
taaaatgttgagttttgagagc

SEQ ID NO: 1387501 - DNA, 22 bp, Artificial Sequence
  chemically synthesized
aaaatgttgagttttgagagct

SEQ ID NO: 1387502 - DNA, 22 bp, Artificial Sequence
  chemically synthesized
aaatgttgagttttgagagctc

SEQ ID NO: 1387503 - DNA, 22 bp, Artificial Sequence
  chemically synthesized
gtatcaaaactacataaagagc

SEQ ID NO: 1387504 - DNA, 22 bp, Artificial Sequence
  chemically synthesized
agttttgagagctctttatgta

SEQ ID NO: 1387505 - DNA, 22 bp, Artificial Sequence
  chemically synthesized
tgagagctctttatgtagtttt

SEQ ID NO: 1387506 - DNA, 22 bp, Artificial Sequence
  chemically synthesized
gagagctctttatgtagttttg

SEQ ID NO: 1387507 - DNA, 22 bp, Artificial Sequence
  chemically synthesized
agagctctttatgtagttttga

SEQ ID NO: 1387508 - DNA, 22 bp, Artificial Sequence
  chemically synthesized
gatatcaagaactagtatcaaa

SEQ ID NO: 1387509 - DNA, 22 bp, Artificial Sequence
  chemically synthesized
tttatgtagttttgatactagt

SEQ ID NO: 1387510 - DNA, 22 bp, Artificial Sequence
  chemically synthesized
tatgtagttttgatactagttc

SEQ ID NO: 1387511 - DNA, 22 bp, Artificial Sequence
  chemically synthesized
atgtagttttgatactagttct

SEQ ID NO: 1387512 - DNA, 22 bp, Artificial Sequence
  chemically synthesized
tgtagttttgatactagttctt

SEQ ID NO: 1387513 - DNA, 22 bp, Artificial Sequence
  chemically synthesized
tgatactagttcttgatatcta

SEQ ID NO: 1387514 - DNA, 22 bp, Artificial Sequence
  chemically synthesized
gatactagttcttgatatctag

SEQ ID NO: 1387515 - DNA, 22 bp, Artificial Sequence
  chemically synthesized
atactagttcttgatatctaga

SEQ ID NO: 1387516 - DNA, 22 bp, Artificial Sequence
  chemically synthesized
gcaaaccatatatctagatatc

SEQ ID NO: 1387517 - DNA, 22 bp, Artificial Sequence
  chemically synthesized
gttcttgatatctagatatatg

SEQ ID NO: 1387518 - DNA, 22 bp, Artificial Sequence
  chemically synthesized
ttgatatctagatatatggttt

SEQ ID NO: 1387519 - DNA, 22 bp, Artificial Sequence
  chemically synthesized
gatatctagatatatggtttgc

SEQ ID NO: 1387520 - DNA, 22 bp, Artificial Sequence
  chemically synthesized
atatctagatatatggtttgcc

SEQ ID NO: 1387521 - DNA, 22 bp, Artificial Sequence
  chemically synthesized
ggagaaaatattggcaaaccat

SEQ ID NO: 1387522 - DNA, 22 bp, Artificial Sequence
  chemically synthesized
gatatatggtttgccaatattt

SEQ ID NO: 1387523 - DNA, 22 bp, Artificial Sequence
  chemically synthesized
cagactgggagaaaatattggc

SEQ ID NO: 1387524 - DNA, 22 bp, Artificial Sequence
  chemically synthesized
gccaatattttctcccagtctg

SEQ ID NO: 1387525 - DNA, 22 bp, Artificial Sequence
  chemically synthesized
ccaatattttctcccagtctgt

SEQ ID NO: 1387526 - DNA, 22 bp, Artificial Sequence
  chemically synthesized
tctcccagtctgtagctcgtat

SEQ ID NO: 1387527 - DNA, 22 bp, Artificial Sequence
  chemically synthesized
ctcccagtctgtagctcgtatt

SEQ ID NO: 1387528 - DNA, 22 bp, Artificial Sequence
  chemically synthesized
tcccagtctgtagctcgtattt

SEQ ID NO: 1387529 - DNA, 22 bp, Artificial Sequence
  chemically synthesized
ccagtctgtagctcgtatttca

SEQ ID NO: 1387530 - DNA, 22 bp, Artificial Sequence
  chemically synthesized
aaaaaaagaaaaaaatgaaata

SEQ ID NO: 1387531 - DNA, 22 bp, Artificial Sequence
  chemically synthesized
tcaaaaaaagaaaaaaatgaaa

SEQ ID NO: 1387532 - DNA, 22 bp, Artificial Sequence
  chemically synthesized
tagctcgtatttcatttttttc

SEQ ID NO: 1387533 - DNA, 22 bp, Artificial Sequence
  chemically synthesized
cactctcaaaaaaagaaaaaaa

SEQ ID NO: 1387534 - DNA, 22 bp, Artificial Sequence
  chemically synthesized
gtatttcatttttttctttttt

SEQ ID NO: 1387535 - DNA, 22 bp, Artificial Sequence
  chemically synthesized
catttttttctttttttgagag

SEQ ID NO: 1387536 - DNA, 22 bp, Artificial Sequence
  chemically synthesized
atttttttctttttttgagagt

SEQ ID NO: 1387537 - DNA, 22 bp, Artificial Sequence
  chemically synthesized
ttttctttttttgagagtgcag

SEQ ID NO: 1387538 - DNA, 22 bp, Artificial Sequence
  chemically synthesized
tttctttttttgagagtgcagt

SEQ ID NO: 1387539 - DNA, 22 bp, Artificial Sequence
  chemically synthesized
ttctttttttgagagtgcagtg

SEQ ID NO: 1387540 - DNA, 22 bp, Artificial Sequence
  chemically synthesized
tctttttttgagagtgcagtgg

SEQ ID NO: 1387541 - DNA, 22 bp, Artificial Sequence
  chemically synthesized
ctttttttgagagtgcagtggt

SEQ ID NO: 1387542 - DNA, 22 bp, Artificial Sequence
  chemically synthesized
tttttttgagagtgcagtggta

SEQ ID NO: 1387543 - DNA, 22 bp, Artificial Sequence
  chemically synthesized
tttttgagagtgcagtggtatg

SEQ ID NO: 1387544 - DNA, 22 bp, Artificial Sequence
  chemically synthesized
ttttgagagtgcagtggtatga

SEQ ID NO: 1387545 - DNA, 22 bp, Artificial Sequence
  chemically synthesized
tttgagagtgcagtggtatgat

SEQ ID NO: 1387546 - DNA, 22 bp, Artificial Sequence
  chemically synthesized
cagtgagtcgagatcataccac

SEQ ID NO: 1387547 - DNA, 22 bp, Artificial Sequence
  chemically synthesized
ttgagagtgcagtggtatgatc

SEQ ID NO: 1387548 - DNA, 22 bp, Artificial Sequence
  chemically synthesized
tgagagtgcagtggtatgatct

SEQ ID NO: 1387549 - DNA, 22 bp, Artificial Sequence
  chemically synthesized
gagagtgcagtggtatgatctc

SEQ ID NO: 1387550 - DNA, 22 bp, Artificial Sequence
  chemically synthesized
agagtgcagtggtatgatctcg

SEQ ID NO: 1387551 - DNA, 22 bp, Artificial Sequence
  chemically synthesized
agcccaggaggcagaggttgca

SEQ ID NO: 1387552 - DNA, 22 bp, Artificial Sequence
  chemically synthesized
gagcccaggaggcagaggttgc

SEQ ID NO: 1387553 - DNA, 22 bp, Artificial Sequence
  chemically synthesized
gactcactgcaacctctgcctc

SEQ ID NO: 1387554 - DNA, 22 bp, Artificial Sequence
  chemically synthesized
actgcaacctctgcctcctggg

SEQ ID NO: 1387555 - DNA, 22 bp, Artificial Sequence
  chemically synthesized
caacctctgcctcctgggctca

SEQ ID NO: 1387556 - DNA, 22 bp, Artificial Sequence
  chemically synthesized
aggcatgagaatcgcttgagcc

SEQ ID NO: 1387557 - DNA, 22 bp, Artificial Sequence
  chemically synthesized
tgcctcctgggctcaagcgatt

SEQ ID NO: 1387558 - DNA, 22 bp, Artificial Sequence
  chemically synthesized
cctcctgggctcaagcgattct

SEQ ID NO: 1387559 - DNA, 22 bp, Artificial Sequence
  chemically synthesized
ggaagctgaggcatgagaatcg

SEQ ID NO: 1387560 - DNA, 22 bp, Artificial Sequence
  chemically synthesized
ctgggctcaagcgattctcatg

SEQ ID NO: 1387561 - DNA, 22 bp, Artificial Sequence
  chemically synthesized
gggaagctgaggcatgagaatc

SEQ ID NO: 1387562 - DNA, 22 bp, Artificial Sequence
  chemically synthesized
ggctcaagcgattctcatgcct

SEQ ID NO: 1387563 - DNA, 22 bp, Artificial Sequence
  chemically synthesized
cttgggaagctgaggcatgaga

SEQ ID NO: 1387564 - DNA, 22 bp, Artificial Sequence
  chemically synthesized
aagcgattctcatgcctcagct

SEQ ID NO: 1387565 - DNA, 22 bp, Artificial Sequence
  chemically synthesized
tagtaccacctacttgggaagc

SEQ ID NO: 1387566 - DNA, 22 bp, Artificial Sequence
  chemically synthesized
tcatgcctcagcttcccaagta

SEQ ID NO: 1387567 - DNA, 22 bp, Artificial Sequence
  chemically synthesized
atgcctcagcttcccaagtagg

SEQ ID NO: 1387568 - DNA, 22 bp, Artificial Sequence
  chemically synthesized
agcttcccaagtaggtggtact

SEQ ID NO: 1387569 - DNA, 22 bp, Artificial Sequence
  chemically synthesized
cccaagtaggtggtactacagg

SEQ ID NO: 1387570 - DNA, 22 bp, Artificial Sequence
  chemically synthesized
ccaagtaggtggtactacaggt

SEQ ID NO: 1387571 - DNA, 22 bp, Artificial Sequence
  chemically synthesized
ggcgtagtggcgcacacctgta

SEQ ID NO: 1387572 - DNA, 22 bp, Artificial Sequence
  chemically synthesized
gctgggcgtagtggcgcacacc

SEQ ID NO: 1387573 - DNA, 22 bp, Artificial Sequence
  chemically synthesized
caggtgtgcgccactacgccca

SEQ ID NO: 1387574 - DNA, 22 bp, Artificial Sequence
  chemically synthesized
gtaaaaatacaaaaattagctg

SEQ ID NO: 1387575 - DNA, 22 bp, Artificial Sequence
  chemically synthesized
tagtaaaaatacaaaaattagc

SEQ ID NO: 1387576 - DNA, 22 bp, Artificial Sequence
  chemically synthesized
tctctagtaaaaatacaaaaat

SEQ ID NO: 1387577 - DNA, 22 bp, Artificial Sequence
  chemically synthesized
cgcccagctaatttttgtattt

SEQ ID NO: 1387578 - DNA, 22 bp, Artificial Sequence
  chemically synthesized
tgtctctagtaaaaatacaaaa

SEQ ID NO: 1387579 - DNA, 22 bp, Artificial Sequence
  chemically synthesized
atttttgtatttttactagaga

SEQ ID NO: 1387580 - DNA, 22 bp, Artificial Sequence
  chemically synthesized
ttgtatttttactagagacaga

SEQ ID NO: 1387581 - DNA, 22 bp, Artificial Sequence
  chemically synthesized
tgtatttttactagagacagag

SEQ ID NO: 1387582 - DNA, 22 bp, Artificial Sequence
  chemically synthesized
gtatttttactagagacagagt

SEQ ID NO: 1387583 - DNA, 22 bp, Artificial Sequence
  chemically synthesized
tatttttactagagacagagtt

SEQ ID NO: 1387584 - DNA, 22 bp, Artificial Sequence
  chemically synthesized
gccaacatgatgaaactctgtc

SEQ ID NO: 1387585 - DNA, 22 bp, Artificial Sequence
  chemically synthesized
ttactagagacagagtttcatc

SEQ ID NO: 1387586 - DNA, 22 bp, Artificial Sequence
  chemically synthesized
tactagagacagagtttcatca

SEQ ID NO: 1387587 - DNA, 22 bp, Artificial Sequence
  chemically synthesized
actagagacagagtttcatcat

SEQ ID NO: 1387588 - DNA, 22 bp, Artificial Sequence
  chemically synthesized
ctagagacagagtttcatcatg

SEQ ID NO: 1387589 - DNA, 22 bp, Artificial Sequence
  chemically synthesized
gagacagagtttcatcatgttg

SEQ ID NO: 1387590 - DNA, 22 bp, Artificial Sequence
  chemically synthesized
gagaccagcctggccaacatga

SEQ ID NO: 1387591 - DNA, 22 bp, Artificial Sequence
  chemically synthesized
aggagttcgagaccagcctggc

SEQ ID NO: 1387592 - DNA, 22 bp, Artificial Sequence
  chemically synthesized
catcatgttggccaggctggtc

SEQ ID NO: 1387593 - DNA, 22 bp, Artificial Sequence
  chemically synthesized
atcatgttggccaggctggtct

SEQ ID NO: 1387594 - DNA, 22 bp, Artificial Sequence
  chemically synthesized
cgctcaggagttcgagaccagc

SEQ ID NO: 1387595 - DNA, 22 bp, Artificial Sequence
  chemically synthesized
acgctcaggagttcgagaccag

SEQ ID NO: 1387596 - DNA, 22 bp, Artificial Sequence
  chemically synthesized
gccaggctggtctcgaactcct

SEQ ID NO: 1387597 - DNA, 22 bp, Artificial Sequence
  chemically synthesized
gtcgcttacgctcaggagttcg

SEQ ID NO: 1387598 - DNA, 22 bp, Artificial Sequence
  chemically synthesized
gtctcgaactcctgagcgtaag

SEQ ID NO: 1387599 - DNA, 22 bp, Artificial Sequence
  chemically synthesized
aggcaagctggtcgcttacgct

SEQ ID NO: 1387600 - DNA, 22 bp, Artificial Sequence
  chemically synthesized
gaactcctgagcgtaagcgacc

SEQ ID NO: 1387601 - DNA, 22 bp, Artificial Sequence
  chemically synthesized
ggaagctgaggcaagctggtcg

SEQ ID NO: 1387602 - DNA, 22 bp, Artificial Sequence
  chemically synthesized
ctgagcgtaagcgaccagcttg

SEQ ID NO: 1387603 - DNA, 22 bp, Artificial Sequence
  chemically synthesized
gggaagctgaggcaagctggtc

SEQ ID NO: 1387604 - DNA, 22 bp, Artificial Sequence
  chemically synthesized
tgggaagctgaggcaagctggt

SEQ ID NO: 1387605 - DNA, 22 bp, Artificial Sequence
  chemically synthesized
agcgtaagcgaccagcttgcct

SEQ ID NO: 1387606 - DNA, 22 bp, Artificial Sequence
  chemically synthesized
ataccatcactttgggaagctg

SEQ ID NO: 1387607 - DNA, 22 bp, Artificial Sequence
  chemically synthesized
ttaataccatcactttgggaag

SEQ ID NO: 1387608 - DNA, 22 bp, Artificial Sequence
  chemically synthesized
gcctcagcttcccaaagtgatg

SEQ ID NO: 1387609 - DNA, 22 bp, Artificial Sequence
  chemically synthesized
cctcagcttcccaaagtgatgg

SEQ ID NO: 1387610 - DNA, 22 bp, Artificial Sequence
  chemically synthesized
gtgcctgttaataccatcactt

SEQ ID NO: 1387611 - DNA, 22 bp, Artificial Sequence
  chemically synthesized
agcttcccaaagtgatggtatt

SEQ ID NO: 1387612 - DNA, 22 bp, Artificial Sequence
  chemically synthesized
cccaaagtgatggtattaacag

SEQ ID NO: 1387613 - DNA, 22 bp, Artificial Sequence
  chemically synthesized
ccaaagtgatggtattaacagg

SEQ ID NO: 1387614 - DNA, 22 bp, Artificial Sequence
  chemically synthesized
acaggcacgagccaccacgccc

SEQ ID NO: 1387615 - DNA, 22 bp, Artificial Sequence
  chemically synthesized
agaagaaatataaccgggcgtg

SEQ ID NO: 1387616 - DNA, 22 bp, Artificial Sequence
  chemically synthesized
ttaagaagaaatataaccgggc

SEQ ID NO: 1387617 - DNA, 22 bp, Artificial Sequence
  chemically synthesized
tgttaagaagaaatataaccgg

SEQ ID NO: 1387618 - DNA, 22 bp, Artificial Sequence
  chemically synthesized
tgcaaaatattctgttaagaag

SEQ ID NO: 1387619 - DNA, 22 bp, Artificial Sequence
  chemically synthesized
ctatgcaaaatattctgttaag

SEQ ID NO: 1387620 - DNA, 22 bp, Artificial Sequence
  chemically synthesized
gctatgcaaaatattctgttaa

SEQ ID NO: 1387621 - DNA, 22 bp, Artificial Sequence
  chemically synthesized
tgctatgcaaaatattctgtta

SEQ ID NO: 1387622 - DNA, 22 bp, Artificial Sequence
  chemically synthesized
ttgctatgcaaaatattctgtt

SEQ ID NO: 1387623 - DNA, 22 bp, Artificial Sequence
  chemically synthesized
tatttcttcttaacagaatatt

SEQ ID NO: 1387624 - DNA, 22 bp, Artificial Sequence
  chemically synthesized
cttcttaacagaatattttgca

SEQ ID NO: 1387625 - DNA, 22 bp, Artificial Sequence
  chemically synthesized
ttcttaacagaatattttgcat

SEQ ID NO: 1387626 - DNA, 22 bp, Artificial Sequence
  chemically synthesized
cttaacagaatattttgcatag

SEQ ID NO: 1387627 - DNA, 22 bp, Artificial Sequence
  chemically synthesized
ttaacagaatattttgcatagc

SEQ ID NO: 1387628 - DNA, 22 bp, Artificial Sequence
  chemically synthesized
aacagaatattttgcatagcaa

SEQ ID NO: 1387629 - DNA, 22 bp, Artificial Sequence
  chemically synthesized
acagaatattttgcatagcaaa

SEQ ID NO: 1387630 - DNA, 22 bp, Artificial Sequence
  chemically synthesized
aaataaaaaacttttgctatgc

SEQ ID NO: 1387631 - DNA, 22 bp, Artificial Sequence
  chemically synthesized
attaaaataaaaaacttttgct

SEQ ID NO: 1387632 - DNA, 22 bp, Artificial Sequence
  chemically synthesized
tgcatagcaaaagttttttatt

SEQ ID NO: 1387633 - DNA, 22 bp, Artificial Sequence
  chemically synthesized
gcatagcaaaagttttttattt

SEQ ID NO: 1387634 - DNA, 22 bp, Artificial Sequence
  chemically synthesized
catagcaaaagttttttatttt

SEQ ID NO: 1387635 - DNA, 22 bp, Artificial Sequence
  chemically synthesized
ataaagtgaacctcattaaaat

SEQ ID NO: 1387636 - DNA, 22 bp, Artificial Sequence
  chemically synthesized
gataaagtgaacctcattaaaa

SEQ ID NO: 1387637 - DNA, 22 bp, Artificial Sequence
  chemically synthesized
tgataaagtgaacctcattaaa

SEQ ID NO: 1387638 - DNA, 22 bp, Artificial Sequence
  chemically synthesized
tttattttaatgaggttcactt

SEQ ID NO: 1387639 - DNA, 22 bp, Artificial Sequence
  chemically synthesized
ttattttaatgaggttcacttt

SEQ ID NO: 1387640 - DNA, 22 bp, Artificial Sequence
  chemically synthesized
tattttaatgaggttcacttta

SEQ ID NO: 1387641 - DNA, 22 bp, Artificial Sequence
  chemically synthesized
attttaatgaggttcactttat

SEQ ID NO: 1387642 - DNA, 22 bp, Artificial Sequence
  chemically synthesized
ttttaatgaggttcactttatc

SEQ ID NO: 1387643 - DNA, 22 bp, Artificial Sequence
  chemically synthesized
taatgaggttcactttatcaaa

SEQ ID NO: 1387644 - DNA, 22 bp, Artificial Sequence
  chemically synthesized
aatgaggttcactttatcaaaa

SEQ ID NO: 1387645 - DNA, 22 bp, Artificial Sequence
  chemically synthesized
atgaggttcactttatcaaaat

SEQ ID NO: 1387646 - DNA, 22 bp, Artificial Sequence
  chemically synthesized
actttatcaaaatttcctttta

SEQ ID NO: 1387647 - DNA, 22 bp, Artificial Sequence
  chemically synthesized
tatcaaaatttccttttatgga

SEQ ID NO: 1387648 - DNA, 22 bp, Artificial Sequence
  chemically synthesized
atcaaaatttccttttatggat

SEQ ID NO: 1387649 - DNA, 22 bp, Artificial Sequence
  chemically synthesized
tcaaaatttccttttatggatg

SEQ ID NO: 1387650 - DNA, 22 bp, Artificial Sequence
  chemically synthesized
acaccaaagtcgccatccataa

SEQ ID NO: 1387651 - DNA, 22 bp, Artificial Sequence
  chemically synthesized
gacaccaaagtcgccatccata

SEQ ID NO: 1387652 - DNA, 22 bp, Artificial Sequence
  chemically synthesized
gacttgacaccaaagtcgccat

SEQ ID NO: 1387653 - DNA, 22 bp, Artificial Sequence
  chemically synthesized
agacttgacaccaaagtcgcca

SEQ ID NO: 1387654 - DNA, 22 bp, Artificial Sequence
  chemically synthesized
ccttttatggatggcgactttg

SEQ ID NO: 1387655 - DNA, 22 bp, Artificial Sequence
  chemically synthesized
cttttatggatggcgactttgg

SEQ ID NO: 1387656 - DNA, 22 bp, Artificial Sequence
  chemically synthesized
ttagacttgacaccaaagtcgc

SEQ ID NO: 1387657 - DNA, 22 bp, Artificial Sequence
  chemically synthesized
ttatggatggcgactttggtgt

SEQ ID NO: 1387658 - DNA, 22 bp, Artificial Sequence
  chemically synthesized
tatggatggcgactttggtgtc

SEQ ID NO: 1387659 - DNA, 22 bp, Artificial Sequence
  chemically synthesized
atggatggcgactttggtgtca

SEQ ID NO: 1387660 - DNA, 22 bp, Artificial Sequence
  chemically synthesized
tggatggcgactttggtgtcaa

SEQ ID NO: 1387661 - DNA, 22 bp, Artificial Sequence
  chemically synthesized
aagtgttcttagacttgacacc

SEQ ID NO: 1387662 - DNA, 22 bp, Artificial Sequence
  chemically synthesized
acgttaaagtgttcttagactt

SEQ ID NO: 1387663 - DNA, 22 bp, Artificial Sequence
  chemically synthesized
tggtgtcaagtctaagaacact

SEQ ID NO: 1387664 - DNA, 22 bp, Artificial Sequence
  chemically synthesized
ggtgtcaagtctaagaacactt

SEQ ID NO: 1387665 - DNA, 22 bp, Artificial Sequence
  chemically synthesized
gtgtcaagtctaagaacacttt

SEQ ID NO: 1387666 - DNA, 22 bp, Artificial Sequence
  chemically synthesized
ggatctaacgttaaagtgttct

SEQ ID NO: 1387667 - DNA, 22 bp, Artificial Sequence
  chemically synthesized
gggatctaacgttaaagtgttc

SEQ ID NO: 1387668 - DNA, 22 bp, Artificial Sequence
  chemically synthesized
agaacactttaacgttagatcc

SEQ ID NO: 1387669 - DNA, 22 bp, Artificial Sequence
  chemically synthesized
aaaaatagaacatatttgggat

SEQ ID NO: 1387670 - DNA, 22 bp, Artificial Sequence
  chemically synthesized
taacgttagatcccaaatatgt

SEQ ID NO: 1387671 - DNA, 22 bp, Artificial Sequence
  chemically synthesized
ctcaaaaatagaacatatttgg

SEQ ID NO: 1387672 - DNA, 22 bp, Artificial Sequence
  chemically synthesized
aacgttagatcccaaatatgtt

SEQ ID NO: 1387673 - DNA, 22 bp, Artificial Sequence
  chemically synthesized
actcaaaaatagaacatatttg

SEQ ID NO: 1387674 - DNA, 22 bp, Artificial Sequence
  chemically synthesized
acgttagatcccaaatatgttc

SEQ ID NO: 1387675 - DNA, 22 bp, Artificial Sequence
  chemically synthesized
gatcccaaatatgttctatttt

SEQ ID NO: 1387676 - DNA, 22 bp, Artificial Sequence
  chemically synthesized
taaaacttactcaaaaatagaa

SEQ ID NO: 1387677 - DNA, 22 bp, Artificial Sequence
  chemically synthesized
aactgtaaaacttactcaaaaa

SEQ ID NO: 1387678 - DNA, 22 bp, Artificial Sequence
  chemically synthesized
aaactgtaaaacttactcaaaa

SEQ ID NO: 1387679 - DNA, 22 bp, Artificial Sequence
  chemically synthesized
tatttttgagtaagttttacag

SEQ ID NO: 1387680 - DNA, 22 bp, Artificial Sequence
  chemically synthesized
tttttgagtaagttttacagtt

SEQ ID NO: 1387681 - DNA, 22 bp, Artificial Sequence
  chemically synthesized
ttgagtaagttttacagtttaa

SEQ ID NO: 1387682 - DNA, 22 bp, Artificial Sequence
  chemically synthesized
tgagtaagttttacagtttaag

SEQ ID NO: 1387683 - DNA, 22 bp, Artificial Sequence
  chemically synthesized
gagtaagttttacagtttaagt

SEQ ID NO: 1387684 - DNA, 22 bp, Artificial Sequence
  chemically synthesized
aacatcagaagaacttaaactg

SEQ ID NO: 1387685 - DNA, 22 bp, Artificial Sequence
  chemically synthesized
agtaagttttacagtttaagtt

SEQ ID NO: 1387686 - DNA, 22 bp, Artificial Sequence
  chemically synthesized
atctaaacatcagaagaactta

SEQ ID NO: 1387687 - DNA, 22 bp, Artificial Sequence
  chemically synthesized
gatctaaacatcagaagaactt

SEQ ID NO: 1387688 - DNA, 22 bp, Artificial Sequence
  chemically synthesized
tacagtttaagttcttctgatg

SEQ ID NO: 1387689 - DNA, 22 bp, Artificial Sequence
  chemically synthesized
acagtttaagttcttctgatgt

SEQ ID NO: 1387690 - DNA, 22 bp, Artificial Sequence
  chemically synthesized
cagtttaagttcttctgatgtt

SEQ ID NO: 1387691 - DNA, 22 bp, Artificial Sequence
  chemically synthesized
aagttcttctgatgtttagatc

SEQ ID NO: 1387692 - DNA, 22 bp, Artificial Sequence
  chemically synthesized
agttcttctgatgtttagatca

SEQ ID NO: 1387693 - DNA, 22 bp, Artificial Sequence
  chemically synthesized
ttctgatgtttagatcaaggtg

SEQ ID NO: 1387694 - DNA, 22 bp, Artificial Sequence
  chemically synthesized
ctgatgtttagatcaaggtgtt

SEQ ID NO: 1387695 - DNA, 22 bp, Artificial Sequence
  chemically synthesized
tgatgtttagatcaaggtgttt

SEQ ID NO: 1387696 - DNA, 22 bp, Artificial Sequence
  chemically synthesized
atgtttagatcaaggtgttttt

SEQ ID NO: 1387697 - DNA, 22 bp, Artificial Sequence
  chemically synthesized
agatcaaggtgttttttgtttg

SEQ ID NO: 1387698 - DNA, 22 bp, Artificial Sequence
  chemically synthesized
gatcaaggtgttttttgtttgt

SEQ ID NO: 1387699 - DNA, 22 bp, Artificial Sequence
  chemically synthesized
tttgtttgttttttgcctatgg

SEQ ID NO: 1387700 - DNA, 22 bp, Artificial Sequence
  chemically synthesized
ttgtttgttttttgcctatggg

SEQ ID NO: 1387701 - DNA, 22 bp, Artificial Sequence
  chemically synthesized
tgtttgttttttgcctatgggt

SEQ ID NO: 1387702 - DNA, 22 bp, Artificial Sequence
  chemically synthesized
tagtaatccaacacccataggc

SEQ ID NO: 1387703 - DNA, 22 bp, Artificial Sequence
  chemically synthesized
gtttgttttttgcctatgggtg

SEQ ID NO: 1387704 - DNA, 22 bp, Artificial Sequence
  chemically synthesized
tttgttttttgcctatgggtgt

SEQ ID NO: 1387705 - DNA, 22 bp, Artificial Sequence
  chemically synthesized
gttttttgcctatgggtgttgg

SEQ ID NO: 1387706 - DNA, 22 bp, Artificial Sequence
  chemically synthesized
ttttttgcctatgggtgttgga

SEQ ID NO: 1387707 - DNA, 22 bp, Artificial Sequence
  chemically synthesized
tttgcctatgggtgttggatta

SEQ ID NO: 1387708 - DNA, 22 bp, Artificial Sequence
  chemically synthesized
ttgcctatgggtgttggattac

SEQ ID NO: 1387709 - DNA, 22 bp, Artificial Sequence
  chemically synthesized
tgcctatgggtgttggattact

SEQ ID NO: 1387710 - DNA, 22 bp, Artificial Sequence
  chemically synthesized
gcctatgggtgttggattacta

SEQ ID NO: 1387711 - DNA, 22 bp, Artificial Sequence
  chemically synthesized
cctatgggtgttggattactac

SEQ ID NO: 1387712 - DNA, 22 bp, Artificial Sequence
  chemically synthesized
ataaatggtgttgtagtaatcc

SEQ ID NO: 1387713 - DNA, 22 bp, Artificial Sequence
  chemically synthesized
aataaatggtgttgtagtaatc

SEQ ID NO: 1387714 - DNA, 22 bp, Artificial Sequence
  chemically synthesized
taataaatggtgttgtagtaat

SEQ ID NO: 1387715 - DNA, 22 bp, Artificial Sequence
  chemically synthesized
ttaataaatggtgttgtagtaa

SEQ ID NO: 1387716 - DNA, 22 bp, Artificial Sequence
  chemically synthesized
tgggtgttggattactacaaca

SEQ ID NO: 1387717 - DNA, 22 bp, Artificial Sequence
  chemically synthesized
tttaataaatggtgttgtagta

SEQ ID NO: 1387718 - DNA, 22 bp, Artificial Sequence
  chemically synthesized
gcctttttaataaatggtgttg

SEQ ID NO: 1387719 - DNA, 22 bp, Artificial Sequence
  chemically synthesized
gattactacaacaccatttatt

SEQ ID NO: 1387720 - DNA, 22 bp, Artificial Sequence
  chemically synthesized
ctacaacaccatttattaaaaa

SEQ ID NO: 1387721 - DNA, 22 bp, Artificial Sequence
  chemically synthesized
caacaccatttattaaaaaggc

SEQ ID NO: 1387722 - DNA, 22 bp, Artificial Sequence
  chemically synthesized
attaaaaaggctaaccctcctt

SEQ ID NO: 1387723 - DNA, 22 bp, Artificial Sequence
  chemically synthesized
ttaaaaaggctaaccctcctta

SEQ ID NO: 1387724 - DNA, 22 bp, Artificial Sequence
  chemically synthesized
aaaaggctaaccctccttactg

SEQ ID NO: 1387725 - DNA, 22 bp, Artificial Sequence
  chemically synthesized
gacgaagcaggaatccagtaag

SEQ ID NO: 1387726 - DNA, 22 bp, Artificial Sequence
  chemically synthesized
ggacgaagcaggaatccagtaa

SEQ ID NO: 1387727 - DNA, 22 bp, Artificial Sequence
  chemically synthesized
tggacgaagcaggaatccagta

SEQ ID NO: 1387728 - DNA, 22 bp, Artificial Sequence
  chemically synthesized
ttttggacgaagcaggaatcca

SEQ ID NO: 1387729 - DNA, 22 bp, Artificial Sequence
  chemically synthesized
accctccttactggattcctgc

SEQ ID NO: 1387730 - DNA, 22 bp, Artificial Sequence
  chemically synthesized
gttttggacgaagcaggaatcc

SEQ ID NO: 1387731 - DNA, 22 bp, Artificial Sequence
  chemically synthesized
tgttttggacgaagcaggaatc

SEQ ID NO: 1387732 - DNA, 22 bp, Artificial Sequence
  chemically synthesized
cttactggattcctgcttcgtc

SEQ ID NO: 1387733 - DNA, 22 bp, Artificial Sequence
  chemically synthesized
actggattcctgcttcgtccaa

SEQ ID NO: 1387734 - DNA, 22 bp, Artificial Sequence
  chemically synthesized
tgtccctttgttttggacgaag

SEQ ID NO: 1387735 - DNA, 22 bp, Artificial Sequence
  chemically synthesized
ctggattcctgcttcgtccaaa

SEQ ID NO: 1387736 - DNA, 22 bp, Artificial Sequence
  chemically synthesized
gtgtccctttgttttggacgaa

SEQ ID NO: 1387737 - DNA, 22 bp, Artificial Sequence
  chemically synthesized
gattcctgcttcgtccaaaaca

SEQ ID NO: 1387738 - DNA, 22 bp, Artificial Sequence
  chemically synthesized
cttgtgtccctttgttttggac

SEQ ID NO: 1387739 - DNA, 22 bp, Artificial Sequence
  chemically synthesized
ccttgtgtccctttgttttgga

SEQ ID NO: 1387740 - DNA, 22 bp, Artificial Sequence
  chemically synthesized
ctgcttcgtccaaaacaaaggg

SEQ ID NO: 1387741 - DNA, 22 bp, Artificial Sequence
  chemically synthesized
cttcgtccaaaacaaagggaca

SEQ ID NO: 1387742 - DNA, 22 bp, Artificial Sequence
  chemically synthesized
gaaaagtttccttgtgtccctt

SEQ ID NO: 1387743 - DNA, 22 bp, Artificial Sequence
  chemically synthesized
cgtccaaaacaaagggacacaa

SEQ ID NO: 1387744 - DNA, 22 bp, Artificial Sequence
  chemically synthesized
gtccaaaacaaagggacacaag

SEQ ID NO: 1387745 - DNA, 22 bp, Artificial Sequence
  chemically synthesized
cctggaaaagtttccttgtgtc

SEQ ID NO: 1387746 - DNA, 22 bp, Artificial Sequence
  chemically synthesized
ttccagggaattgatgtttgtt

SEQ ID NO: 1387747 - DNA, 22 bp, Artificial Sequence
  chemically synthesized
tccagggaattgatgtttgtta

SEQ ID NO: 1387748 - DNA, 22 bp, Artificial Sequence
  chemically synthesized
ccagggaattgatgtttgttat

SEQ ID NO: 1387749 - DNA, 22 bp, Artificial Sequence
  chemically synthesized
cagggaattgatgtttgttatt

SEQ ID NO: 1387750 - DNA, 22 bp, Artificial Sequence
  chemically synthesized
tgaaaccatcaccacaatcaaa

SEQ ID NO: 1387751 - DNA, 22 bp, Artificial Sequence
  chemically synthesized
atgtttgttatttgattgtggt

SEQ ID NO: 1387752 - DNA, 22 bp, Artificial Sequence
  chemically synthesized
gttatttgattgtggtgatggt

SEQ ID NO: 1387753 - DNA, 22 bp, Artificial Sequence
  chemically synthesized
ttatttgattgtggtgatggtt

SEQ ID NO: 1387754 - DNA, 22 bp, Artificial Sequence
  chemically synthesized
atatacctgtgaaaccatcacc

SEQ ID NO: 1387755 - DNA, 22 bp, Artificial Sequence
  chemically synthesized
tttgattgtggtgatggtttca

SEQ ID NO: 1387756 - DNA, 22 bp, Artificial Sequence
  chemically synthesized
gattgtggtgatggtttcacag

SEQ ID NO: 1387757 - DNA, 22 bp, Artificial Sequence
  chemically synthesized
attgtggtgatggtttcacagg

SEQ ID NO: 1387758 - DNA, 22 bp, Artificial Sequence
  chemically synthesized
gacatattcatatacctgtgaa

SEQ ID NO: 1387759 - DNA, 22 bp, Artificial Sequence
  chemically synthesized
ggacatattcatatacctgtga

SEQ ID NO: 1387760 - DNA, 22 bp, Artificial Sequence
  chemically synthesized
tggtgatggtttcacaggtata

SEQ ID NO: 1387761 - DNA, 22 bp, Artificial Sequence
  chemically synthesized
atgagtttggacatattcatat

SEQ ID NO: 1387762 - DNA, 22 bp, Artificial Sequence
  chemically synthesized
gatgagtttggacatattcata

SEQ ID NO: 1387763 - DNA, 22 bp, Artificial Sequence
  chemically synthesized
cacaggtatatgaatatgtcca

SEQ ID NO: 1387764 - DNA, 22 bp, Artificial Sequence
  chemically synthesized
acaggtatatgaatatgtccaa

SEQ ID NO: 1387765 - DNA, 22 bp, Artificial Sequence
  chemically synthesized
atgtatacaatttgatgagttt

SEQ ID NO: 1387766 - DNA, 22 bp, Artificial Sequence
  chemically synthesized
aatgtatacaatttgatgagtt

SEQ ID NO: 1387767 - DNA, 22 bp, Artificial Sequence
  chemically synthesized
cacatatttaatgtatacaatt

SEQ ID NO: 1387768 - DNA, 22 bp, Artificial Sequence
  chemically synthesized
atcaaattgtatacattaaata

SEQ ID NO: 1387769 - DNA, 22 bp, Artificial Sequence
  chemically synthesized
atatacaaaaatctgcacatat

SEQ ID NO: 1387770 - DNA, 22 bp, Artificial Sequence
  chemically synthesized
tatacattaaatatgtgcagat

SEQ ID NO: 1387771 - DNA, 22 bp, Artificial Sequence
  chemically synthesized
aatatgtgcagatttttgtata

SEQ ID NO: 1387772 - DNA, 22 bp, Artificial Sequence
  chemically synthesized
aagtataattgatatacaaaaa

SEQ ID NO: 1387773 - DNA, 22 bp, Artificial Sequence
  chemically synthesized
aaagtataattgatatacaaaa

SEQ ID NO: 1387774 - DNA, 22 bp, Artificial Sequence
  chemically synthesized
cagcttaaagtataattgatat

SEQ ID NO: 1387775 - DNA, 22 bp, Artificial Sequence
  chemically synthesized
acagcttaaagtataattgata

SEQ ID NO: 1387776 - DNA, 22 bp, Artificial Sequence
  chemically synthesized
tacagcttaaagtataattgat

SEQ ID NO: 1387777 - DNA, 22 bp, Artificial Sequence
  chemically synthesized
ttacagcttaaagtataattga

SEQ ID NO: 1387778 - DNA, 22 bp, Artificial Sequence
  chemically synthesized
tttttacagcttaaagtataat

SEQ ID NO: 1387779 - DNA, 22 bp, Artificial Sequence
  chemically synthesized
atttttacagcttaaagtataa

SEQ ID NO: 1387780 - DNA, 22 bp, Artificial Sequence
  chemically synthesized
ttgtatatcaattatactttaa

SEQ ID NO: 1387781 - DNA, 22 bp, Artificial Sequence
  chemically synthesized
tgtatatcaattatactttaag

SEQ ID NO: 1387782 - DNA, 22 bp, Artificial Sequence
  chemically synthesized
gtatatcaattatactttaagc

SEQ ID NO: 1387783 - DNA, 22 bp, Artificial Sequence
  chemically synthesized
tttatttttacagcttaaagta

SEQ ID NO: 1387784 - DNA, 22 bp, Artificial Sequence
  chemically synthesized
tatatcaattatactttaagct

SEQ ID NO: 1387785 - DNA, 22 bp, Artificial Sequence
  chemically synthesized
atttatttttacagcttaaagt

SEQ ID NO: 1387786 - DNA, 22 bp, Artificial Sequence
  chemically synthesized
tactttaagctgtaaaaataaa

SEQ ID NO: 1387787 - DNA, 22 bp, Artificial Sequence
  chemically synthesized
taagctgtaaaaataaataaat

SEQ ID NO: 1387788 - DNA, 22 bp, Artificial Sequence
  chemically synthesized
aagctgtaaaaataaataaatt

SEQ ID NO: 1387789 - DNA, 22 bp, Artificial Sequence
  chemically synthesized
agctgtaaaaataaataaattg

SEQ ID NO: 1387790 - DNA, 22 bp, Artificial Sequence
  chemically synthesized
taaaaataaataaattgggcat

SEQ ID NO: 1387791 - DNA, 22 bp, Artificial Sequence
  chemically synthesized
ggcatatttgtggatctatttc

SEQ ID NO: 1387792 - DNA, 22 bp, Artificial Sequence
  chemically synthesized
gtggatctatttctgggctctc

SEQ ID NO: 1387793 - DNA, 22 bp, Artificial Sequence
  chemically synthesized
tggatctatttctgggctctct

SEQ ID NO: 1387794 - DNA, 22 bp, Artificial Sequence
  chemically synthesized
tttctgggctctctattctgtt

SEQ ID NO: 1387795 - DNA, 22 bp, Artificial Sequence
  chemically synthesized
atatatcagtgaaacagaatag

SEQ ID NO: 1387796 - DNA, 22 bp, Artificial Sequence
  chemically synthesized
ctgggctctctattctgtttca

SEQ ID NO: 1387797 - DNA, 22 bp, Artificial Sequence
  chemically synthesized
tgggctctctattctgtttcac

SEQ ID NO: 1387798 - DNA, 22 bp, Artificial Sequence
  chemically synthesized
ggctctctattctgtttcactg

SEQ ID NO: 1387799 - DNA, 22 bp, Artificial Sequence
  chemically synthesized
tctattctgtttcactgatata

SEQ ID NO: 1387800 - DNA, 22 bp, Artificial Sequence
  chemically synthesized
tattctgtttcactgatatatg

SEQ ID NO: 1387801 - DNA, 22 bp, Artificial Sequence
  chemically synthesized
ttctgtttcactgatatatgag

SEQ ID NO: 1387802 - DNA, 22 bp, Artificial Sequence
  chemically synthesized
gtggtgtacagactcatatatc

SEQ ID NO: 1387803 - DNA, 22 bp, Artificial Sequence
  chemically synthesized
tgtttcactgatatatgagtct

SEQ ID NO: 1387804 - DNA, 22 bp, Artificial Sequence
  chemically synthesized
tttcactgatatatgagtctgt

SEQ ID NO: 1387805 - DNA, 22 bp, Artificial Sequence
  chemically synthesized
atactggtggtgtacagactca

SEQ ID NO: 1387806 - DNA, 22 bp, Artificial Sequence
  chemically synthesized
cactgatatatgagtctgtaca

SEQ ID NO: 1387807 - DNA, 22 bp, Artificial Sequence
  chemically synthesized
actgatatatgagtctgtacac

SEQ ID NO: 1387808 - DNA, 22 bp, Artificial Sequence
  chemically synthesized
atatatgagtctgtacaccacc

SEQ ID NO: 1387809 - DNA, 22 bp, Artificial Sequence
  chemically synthesized
gacagtctgatactggtggtgt

SEQ ID NO: 1387810 - DNA, 22 bp, Artificial Sequence
  chemically synthesized
tagacagtctgatactggtggt

SEQ ID NO: 1387811 - DNA, 22 bp, Artificial Sequence
  chemically synthesized
tacaccaccagtatcagactgt

SEQ ID NO: 1387812 - DNA, 22 bp, Artificial Sequence
  chemically synthesized
tatagcagcagtattctagaca

SEQ ID NO: 1387813 - DNA, 22 bp, Artificial Sequence
  chemically synthesized
attatatagcagcagtattcta

SEQ ID NO: 1387814 - DNA, 22 bp, Artificial Sequence
  chemically synthesized
aagttaattatatagcagcagt

SEQ ID NO: 1387815 - DNA, 22 bp, Artificial Sequence
  chemically synthesized
ttaaagttaattatatagcagc

SEQ ID NO: 1387816 - DNA, 22 bp, Artificial Sequence
  chemically synthesized
tctagaatactgctgctatata

SEQ ID NO: 1387817 - DNA, 22 bp, Artificial Sequence
  chemically synthesized
ttgttaaagttaattatatagc

SEQ ID NO: 1387818 - DNA, 22 bp, Artificial Sequence
  chemically synthesized
gaatactgctgctatataatta

SEQ ID NO: 1387819 - DNA, 22 bp, Artificial Sequence
  chemically synthesized
ctgttgttaaagttaattatat

SEQ ID NO: 1387820 - DNA, 22 bp, Artificial Sequence
  chemically synthesized
actgttgttaaagttaattata

SEQ ID NO: 1387821 - DNA, 22 bp, Artificial Sequence
  chemically synthesized
ttactgttgttaaagttaatta

SEQ ID NO: 1387822 - DNA, 22 bp, Artificial Sequence
  chemically synthesized
ctgctatataattaactttaac

SEQ ID NO: 1387823 - DNA, 22 bp, Artificial Sequence
  chemically synthesized
ctatataattaactttaacaac

SEQ ID NO: 1387824 - DNA, 22 bp, Artificial Sequence
  chemically synthesized
tataattaactttaacaacagt

SEQ ID NO: 1387825 - DNA, 22 bp, Artificial Sequence
  chemically synthesized
gagaaatcactcttactgttgt

SEQ ID NO: 1387826 - DNA, 22 bp, Artificial Sequence
  chemically synthesized
attagagaaatcactcttactg

SEQ ID NO: 1387827 - DNA, 22 bp, Artificial Sequence
  chemically synthesized
actttaacaacagtaagagtga

SEQ ID NO: 1387828 - DNA, 22 bp, Artificial Sequence
  chemically synthesized
taacaacagtaagagtgatttc

SEQ ID NO: 1387829 - DNA, 22 bp, Artificial Sequence
  chemically synthesized
aacaacagtaagagtgatttct

SEQ ID NO: 1387830 - DNA, 22 bp, Artificial Sequence
  chemically synthesized
acaacagtaagagtgatttctc

SEQ ID NO: 1387831 - DNA, 22 bp, Artificial Sequence
  chemically synthesized
aataaggaaaaattaattagag

SEQ ID NO: 1387832 - DNA, 22 bp, Artificial Sequence
  chemically synthesized
ttgaataaggaaaaattaatta

SEQ ID NO: 1387833 - DNA, 22 bp, Artificial Sequence
  chemically synthesized
ctctaattaatttttccttatt

SEQ ID NO: 1387834 - DNA, 22 bp, Artificial Sequence
  chemically synthesized
tctaattaatttttccttattc

SEQ ID NO: 1387835 - DNA, 22 bp, Artificial Sequence
  chemically synthesized
gccaaaactattgaataaggaa

SEQ ID NO: 1387836 - DNA, 22 bp, Artificial Sequence
  chemically synthesized
taattaatttttccttattcaa

SEQ ID NO: 1387837 - DNA, 22 bp, Artificial Sequence
  chemically synthesized
attaatttttccttattcaata

SEQ ID NO: 1387838 - DNA, 22 bp, Artificial Sequence
  chemically synthesized
tactagccaaaactattgaata

SEQ ID NO: 1387839 - DNA, 22 bp, Artificial Sequence
  chemically synthesized
atttttccttattcaatagttt

SEQ ID NO: 1387840 - DNA, 22 bp, Artificial Sequence
  chemically synthesized
ttccttattcaatagttttggc

SEQ ID NO: 1387841 - DNA, 22 bp, Artificial Sequence
  chemically synthesized
tccttattcaatagttttggct

SEQ ID NO: 1387842 - DNA, 22 bp, Artificial Sequence
  chemically synthesized
ccttattcaatagttttggcta

SEQ ID NO: 1387843 - DNA, 22 bp, Artificial Sequence
  chemically synthesized
cttattcaatagttttggctag

SEQ ID NO: 1387844 - DNA, 22 bp, Artificial Sequence
  chemically synthesized
attcaatagttttggctagtat

SEQ ID NO: 1387845 - DNA, 22 bp, Artificial Sequence
  chemically synthesized
ttcaatagttttggctagtata

SEQ ID NO: 1387846 - DNA, 22 bp, Artificial Sequence
  chemically synthesized
aatagttttggctagtataggt

SEQ ID NO: 1387847 - DNA, 22 bp, Artificial Sequence
  chemically synthesized
tggctagtataggtcctgtgcc

SEQ ID NO: 1387848 - DNA, 22 bp, Artificial Sequence
  chemically synthesized
ggctagtataggtcctgtgcca

SEQ ID NO: 1387849 - DNA, 22 bp, Artificial Sequence
  chemically synthesized
gctagtataggtcctgtgccat

SEQ ID NO: 1387850 - DNA, 22 bp, Artificial Sequence
  chemically synthesized
tataggatgtatagaatggcac

SEQ ID NO: 1387851 - DNA, 22 bp, Artificial Sequence
  chemically synthesized
gtataggtcctgtgccattcta

SEQ ID NO: 1387852 - DNA, 22 bp, Artificial Sequence
  chemically synthesized
taaaaattatataggatgtata

SEQ ID NO: 1387853 - DNA, 22 bp, Artificial Sequence
  chemically synthesized
ttataaaaattatataggatgt

SEQ ID NO: 1387854 - DNA, 22 bp, Artificial Sequence
  chemically synthesized
tgccattctatacatcctatat

SEQ ID NO: 1387855 - DNA, 22 bp, Artificial Sequence
  chemically synthesized
attataaaaattatataggatg

SEQ ID NO: 1387856 - DNA, 22 bp, Artificial Sequence
  chemically synthesized
tatacatcctatataattttta

SEQ ID NO: 1387857 - DNA, 22 bp, Artificial Sequence
  chemically synthesized
cacaggcttattataaaaatta

SEQ ID NO: 1387858 - DNA, 22 bp, Artificial Sequence
  chemically synthesized
tacatcctatataatttttata

SEQ ID NO: 1387859 - DNA, 22 bp, Artificial Sequence
  chemically synthesized
acacaggcttattataaaaatt

SEQ ID NO: 1387860 - DNA, 22 bp, Artificial Sequence
  chemically synthesized
aacttacacaggcttattataa

SEQ ID NO: 1387861 - DNA, 22 bp, Artificial Sequence
  chemically synthesized
gaacttacacaggcttattata

SEQ ID NO: 1387862 - DNA, 22 bp, Artificial Sequence
  chemically synthesized
tgaacttacacaggcttattat

SEQ ID NO: 1387863 - DNA, 22 bp, Artificial Sequence
  chemically synthesized
ttgaacttacacaggcttatta

SEQ ID NO: 1387864 - DNA, 22 bp, Artificial Sequence
  chemically synthesized
tataatttttataataagcctg

SEQ ID NO: 1387865 - DNA, 22 bp, Artificial Sequence
  chemically synthesized
ttataataagcctgtgtaagtt

SEQ ID NO: 1387866 - DNA, 22 bp, Artificial Sequence
  chemically synthesized
gcaatgtttttgaacttacaca

SEQ ID NO: 1387867 - DNA, 22 bp, Artificial Sequence
  chemically synthesized
tataataagcctgtgtaagttc

SEQ ID NO: 1387868 - DNA, 22 bp, Artificial Sequence
  chemically synthesized
agcaatgtttttgaacttacac

SEQ ID NO: 1387869 - DNA, 22 bp, Artificial Sequence
  chemically synthesized
ataataagcctgtgtaagttca

SEQ ID NO: 1387870 - DNA, 22 bp, Artificial Sequence
  chemically synthesized
tagcaatgtttttgaacttaca

SEQ ID NO: 1387871 - DNA, 22 bp, Artificial Sequence
  chemically synthesized
taataagcctgtgtaagttcaa

SEQ ID NO: 1387872 - DNA, 22 bp, Artificial Sequence
  chemically synthesized
cgaaaattttagcaatgttttt

SEQ ID NO: 1387873 - DNA, 22 bp, Artificial Sequence
  chemically synthesized
acgaaaattttagcaatgtttt

SEQ ID NO: 1387874 - DNA, 22 bp, Artificial Sequence
  chemically synthesized
tgtaagttcaaaaacattgcta

SEQ ID NO: 1387875 - DNA, 22 bp, Artificial Sequence
  chemically synthesized
ttacgaaaattttagcaatgtt

SEQ ID NO: 1387876 - DNA, 22 bp, Artificial Sequence
  chemically synthesized
aaaaacattgctaaaattttcg

SEQ ID NO: 1387877 - DNA, 22 bp, Artificial Sequence
  chemically synthesized
agacaattcttacgaaaatttt

SEQ ID NO: 1387878 - DNA, 22 bp, Artificial Sequence
  chemically synthesized
aagacaattcttacgaaaattt

SEQ ID NO: 1387879 - DNA, 22 bp, Artificial Sequence
  chemically synthesized
taagacaattcttacgaaaatt

SEQ ID NO: 1387880 - DNA, 22 bp, Artificial Sequence
  chemically synthesized
ttaagacaattcttacgaaaat

SEQ ID NO: 1387881 - DNA, 22 bp, Artificial Sequence
  chemically synthesized
tttttaagacaattcttacgaa

SEQ ID NO: 1387882 - DNA, 22 bp, Artificial Sequence
  chemically synthesized
ctaaaattttcgtaagaattgt

SEQ ID NO: 1387883 - DNA, 22 bp, Artificial Sequence
  chemically synthesized
atctatttttaagacaattctt

SEQ ID NO: 1387884 - DNA, 22 bp, Artificial Sequence
  chemically synthesized
aaattttcgtaagaattgtctt

SEQ ID NO: 1387885 - DNA, 22 bp, Artificial Sequence
  chemically synthesized
agttgatctatttttaagacaa

SEQ ID NO: 1387886 - DNA, 22 bp, Artificial Sequence
  chemically synthesized
taagttgatctatttttaagac

SEQ ID NO: 1387887 - DNA, 22 bp, Artificial Sequence
  chemically synthesized
tcgtaagaattgtcttaaaaat

SEQ ID NO: 1387888 - DNA, 22 bp, Artificial Sequence
  chemically synthesized
cgtaagaattgtcttaaaaata

SEQ ID NO: 1387889 - DNA, 22 bp, Artificial Sequence
  chemically synthesized
tctaagttgatctatttttaag

SEQ ID NO: 1387890 - DNA, 22 bp, Artificial Sequence
  chemically synthesized
gtaagaattgtcttaaaaatag

SEQ ID NO: 1387891 - DNA, 22 bp, Artificial Sequence
  chemically synthesized
tctctaagttgatctattttta

SEQ ID NO: 1387892 - DNA, 22 bp, Artificial Sequence
  chemically synthesized
tcttaaaaatagatcaacttag

SEQ ID NO: 1387893 - DNA, 22 bp, Artificial Sequence
  chemically synthesized
aaaaatagatcaacttagagag

SEQ ID NO: 1387894 - DNA, 22 bp, Artificial Sequence
  chemically synthesized
aaaatagatcaacttagagaga

SEQ ID NO: 1387895 - DNA, 22 bp, Artificial Sequence
  chemically synthesized
accatagtaaagatgtgaattc

SEQ ID NO: 1387896 - DNA, 22 bp, Artificial Sequence
  chemically synthesized
agagagaattcacatctttact

SEQ ID NO: 1387897 - DNA, 22 bp, Artificial Sequence
  chemically synthesized
gagagaattcacatctttacta

SEQ ID NO: 1387898 - DNA, 22 bp, Artificial Sequence
  chemically synthesized
gaaaactcaccatagtaaagat

SEQ ID NO: 1387899 - DNA, 22 bp, Artificial Sequence
  chemically synthesized
atggattggaaaactcaccata

SEQ ID NO: 1387900 - DNA, 22 bp, Artificial Sequence
  chemically synthesized
acatctttactatggtgagttt

SEQ ID NO: 1387901 - DNA, 22 bp, Artificial Sequence
  chemically synthesized
tgttcatggattggaaaactca

SEQ ID NO: 1387902 - DNA, 22 bp, Artificial Sequence
  chemically synthesized
tactatggtgagttttccaatc

SEQ ID NO: 1387903 - DNA, 22 bp, Artificial Sequence
  chemically synthesized
actatggtgagttttccaatcc

SEQ ID NO: 1387904 - DNA, 22 bp, Artificial Sequence
  chemically synthesized
ctatggtgagttttccaatcca

SEQ ID NO: 1387905 - DNA, 22 bp, Artificial Sequence
  chemically synthesized
tggtgagttttccaatccatga

SEQ ID NO: 1387906 - DNA, 22 bp, Artificial Sequence
  chemically synthesized
tccaatccatgaacataatgta

SEQ ID NO: 1387907 - DNA, 22 bp, Artificial Sequence
  chemically synthesized
aatatatggagatacattatgt

SEQ ID NO: 1387908 - DNA, 22 bp, Artificial Sequence
  chemically synthesized
ccaatccatgaacataatgtat

SEQ ID NO: 1387909 - DNA, 22 bp, Artificial Sequence
  chemically synthesized
caatccatgaacataatgtatc

SEQ ID NO: 1387910 - DNA, 22 bp, Artificial Sequence
  chemically synthesized
gtaaaataaataaagaagacct

SEQ ID NO: 1387911 - DNA, 22 bp, Artificial Sequence
  chemically synthesized
catatatttaggtcttctttat

SEQ ID NO: 1387912 - DNA, 22 bp, Artificial Sequence
  chemically synthesized
ccaagtgctagtaaaataaata

SEQ ID NO: 1387913 - DNA, 22 bp, Artificial Sequence
  chemically synthesized
aggtcttctttatttattttac

SEQ ID NO: 1387914 - DNA, 22 bp, Artificial Sequence
  chemically synthesized
ggtcttctttatttattttact

SEQ ID NO: 1387915 - DNA, 22 bp, Artificial Sequence
  chemically synthesized
ctttatttattttactagcact

SEQ ID NO: 1387916 - DNA, 22 bp, Artificial Sequence
  chemically synthesized
tttatttattttactagcactt

SEQ ID NO: 1387917 - DNA, 22 bp, Artificial Sequence
  chemically synthesized
tatttattttactagcacttgg

SEQ ID NO: 1387918 - DNA, 22 bp, Artificial Sequence
  chemically synthesized
atttattttactagcacttggt

SEQ ID NO: 1387919 - DNA, 22 bp, Artificial Sequence
  chemically synthesized
tttattttactagcacttggta

SEQ ID NO: 1387920 - DNA, 22 bp, Artificial Sequence
  chemically synthesized
tatgataaaagttaccaagtgc

SEQ ID NO: 1387921 - DNA, 22 bp, Artificial Sequence
  chemically synthesized
attttactagcacttggtaact

SEQ ID NO: 1387922 - DNA, 22 bp, Artificial Sequence
  chemically synthesized
ttttactagcacttggtaactt

SEQ ID NO: 1387923 - DNA, 22 bp, Artificial Sequence
  chemically synthesized
tactagcacttggtaactttta

SEQ ID NO: 1387924 - DNA, 22 bp, Artificial Sequence
  chemically synthesized
actagcacttggtaacttttat

SEQ ID NO: 1387925 - DNA, 22 bp, Artificial Sequence
  chemically synthesized
ctagcacttggtaacttttatc

SEQ ID NO: 1387926 - DNA, 22 bp, Artificial Sequence
  chemically synthesized
gcacttggtaacttttatcata

SEQ ID NO: 1387927 - DNA, 22 bp, Artificial Sequence
  chemically synthesized
ggtaacttttatcatacagatt

SEQ ID NO: 1387928 - DNA, 22 bp, Artificial Sequence
  chemically synthesized
gtaacttttatcatacagattc

SEQ ID NO: 1387929 - DNA, 22 bp, Artificial Sequence
  chemically synthesized
acaaaacatgcacagaatctgt

SEQ ID NO: 1387930 - DNA, 22 bp, Artificial Sequence
  chemically synthesized
ttatcatacagattctgtgcat

SEQ ID NO: 1387931 - DNA, 22 bp, Artificial Sequence
  chemically synthesized
tatcatacagattctgtgcatg

SEQ ID NO: 1387932 - DNA, 22 bp, Artificial Sequence
  chemically synthesized
atcatacagattctgtgcatgt

SEQ ID NO: 1387933 - DNA, 22 bp, Artificial Sequence
  chemically synthesized
tcatacagattctgtgcatgtt

SEQ ID NO: 1387934 - DNA, 22 bp, Artificial Sequence
  chemically synthesized
catataaaactaacaaaacatg

SEQ ID NO: 1387935 - DNA, 22 bp, Artificial Sequence
  chemically synthesized
acatataaaactaacaaaacat

SEQ ID NO: 1387936 - DNA, 22 bp, Artificial Sequence
  chemically synthesized
ttacatataaaactaacaaaac

SEQ ID NO: 1387937 - DNA, 22 bp, Artificial Sequence
  chemically synthesized
tgtgcatgttttgttagtttta

SEQ ID NO: 1387938 - DNA, 22 bp, Artificial Sequence
  chemically synthesized
tgcatgttttgttagttttata

SEQ ID NO: 1387939 - DNA, 22 bp, Artificial Sequence
  chemically synthesized
tgttagttttatatgtaagagt

SEQ ID NO: 1387940 - DNA, 22 bp, Artificial Sequence
  chemically synthesized
gttagttttatatgtaagagtt

SEQ ID NO: 1387941 - DNA, 22 bp, Artificial Sequence
  chemically synthesized
caaagaaaatgaaactcttaca

SEQ ID NO: 1387942 - DNA, 22 bp, Artificial Sequence
  chemically synthesized
ttagttttatatgtaagagttt

SEQ ID NO: 1387943 - DNA, 22 bp, Artificial Sequence
  chemically synthesized
tgcaaagaaaatgaaactctta

SEQ ID NO: 1387944 - DNA, 22 bp, Artificial Sequence
  chemically synthesized
ctgcaaagaaaatgaaactctt

SEQ ID NO: 1387945 - DNA, 22 bp, Artificial Sequence
  chemically synthesized
gttttatatgtaagagtttcat

SEQ ID NO: 1387946 - DNA, 22 bp, Artificial Sequence
  chemically synthesized
tatatgtaagagtttcattttc

SEQ ID NO: 1387947 - DNA, 22 bp, Artificial Sequence
  chemically synthesized
atatgtaagagtttcattttct

SEQ ID NO: 1387948 - DNA, 22 bp, Artificial Sequence
  chemically synthesized
tgatttctgcaaagaaaatgaa

SEQ ID NO: 1387949 - DNA, 22 bp, Artificial Sequence
  chemically synthesized
tatgtaagagtttcattttctt

SEQ ID NO: 1387950 - DNA, 22 bp, Artificial Sequence
  chemically synthesized
atgatttctgcaaagaaaatga

SEQ ID NO: 1387951 - DNA, 22 bp, Artificial Sequence
  chemically synthesized
cattttctttgcagaaatcata

SEQ ID NO: 1387952 - DNA, 22 bp, Artificial Sequence
  chemically synthesized
attttctttgcagaaatcataa

SEQ ID NO: 1387953 - DNA, 22 bp, Artificial Sequence
  chemically synthesized
tctttgcagaaatcataaatgc

SEQ ID NO: 1387954 - DNA, 22 bp, Artificial Sequence
  chemically synthesized
ctttgcagaaatcataaatgct

SEQ ID NO: 1387955 - DNA, 22 bp, Artificial Sequence
  chemically synthesized
tttgcagaaatcataaatgcta

SEQ ID NO: 1387956 - DNA, 22 bp, Artificial Sequence
  chemically synthesized
tgcagaaatcataaatgctatt

SEQ ID NO: 1387957 - DNA, 22 bp, Artificial Sequence
  chemically synthesized
gcagaaatcataaatgctattg

SEQ ID NO: 1387958 - DNA, 22 bp, Artificial Sequence
  chemically synthesized
cagaaatcataaatgctattgc

SEQ ID NO: 1387959 - DNA, 22 bp, Artificial Sequence
  chemically synthesized
aaaaaaaaaaaaaaaatgcaat

SEQ ID NO: 1387960 - DNA, 22 bp, Artificial Sequence
  chemically synthesized
cgtctcaaaaaaaaaaaaaaaa

SEQ ID NO: 1387961 - DNA, 22 bp, Artificial Sequence
  chemically synthesized
ttgcattttttttttttttttg

SEQ ID NO: 1387962 - DNA, 22 bp, Artificial Sequence
  chemically synthesized
cattttttttttttttttgaga

SEQ ID NO: 1387963 - DNA, 22 bp, Artificial Sequence
  chemically synthesized
tttttttttttttgagacggag

SEQ ID NO: 1387964 - DNA, 22 bp, Artificial Sequence
  chemically synthesized
ttttttttttttgagacggagt

SEQ ID NO: 1387965 - DNA, 22 bp, Artificial Sequence
  chemically synthesized
tttttttttttgagacggagtc

SEQ ID NO: 1387966 - DNA, 22 bp, Artificial Sequence
  chemically synthesized
ttttttttttgagacggagtct

SEQ ID NO: 1387967 - DNA, 22 bp, Artificial Sequence
  chemically synthesized
gaccacagagtgagactccgtc

SEQ ID NO: 1387968 - DNA, 22 bp, Artificial Sequence
  chemically synthesized
tttttttttgagacggagtctc

SEQ ID NO: 1387969 - DNA, 22 bp, Artificial Sequence
  chemically synthesized
ttttttttgagacggagtctca

SEQ ID NO: 1387970 - DNA, 22 bp, Artificial Sequence
  chemically synthesized
tttttttgagacggagtctcac

SEQ ID NO: 1387971 - DNA, 22 bp, Artificial Sequence
  chemically synthesized
ttttttgagacggagtctcact

SEQ ID NO: 1387972 - DNA, 22 bp, Artificial Sequence
  chemically synthesized
tttttgagacggagtctcactc

SEQ ID NO: 1387973 - DNA, 22 bp, Artificial Sequence
  chemically synthesized
ttttgagacggagtctcactct

SEQ ID NO: 1387974 - DNA, 22 bp, Artificial Sequence
  chemically synthesized
tttgagacggagtctcactctg

SEQ ID NO: 1387975 - DNA, 22 bp, Artificial Sequence
  chemically synthesized
cagcctggaccacagagtgaga

SEQ ID NO: 1387976 - DNA, 22 bp, Artificial Sequence
  chemically synthesized
ttgagacggagtctcactctgt

SEQ ID NO: 1387977 - DNA, 22 bp, Artificial Sequence
  chemically synthesized
tgagacggagtctcactctgtg

SEQ ID NO: 1387978 - DNA, 22 bp, Artificial Sequence
  chemically synthesized
gagacggagtctcactctgtgg

SEQ ID NO: 1387979 - DNA, 22 bp, Artificial Sequence
  chemically synthesized
agacggagtctcactctgtggt

SEQ ID NO: 1387980 - DNA, 22 bp, Artificial Sequence
  chemically synthesized
cactccagcctggaccacagag

SEQ ID NO: 1387981 - DNA, 22 bp, Artificial Sequence
  chemically synthesized
actctgtggtccaggctggagt

SEQ ID NO: 1387982 - DNA, 22 bp, Artificial Sequence
  chemically synthesized
tgtggtccaggctggagtgcag

SEQ ID NO: 1387983 - DNA, 22 bp, Artificial Sequence
  chemically synthesized
tggtccaggctggagtgcagtg

SEQ ID NO: 1387984 - DNA, 22 bp, Artificial Sequence
  chemically synthesized
cagtgaaccgagatcgcgccac

SEQ ID NO: 1387985 - DNA, 22 bp, Artificial Sequence
  chemically synthesized
gagtgcagtggcgcgatctcgg

SEQ ID NO: 1387986 - DNA, 22 bp, Artificial Sequence
  chemically synthesized
aacccgggagagagaggttgca

SEQ ID NO: 1387987 - DNA, 22 bp, Artificial Sequence
  chemically synthesized
gaacccgggagagagaggttgc

SEQ ID NO: 1387988 - DNA, 22 bp, Artificial Sequence
  chemically synthesized
ttgaacccgggagagagaggtt

SEQ ID NO: 1387989 - DNA, 22 bp, Artificial Sequence
  chemically synthesized
ggttcactgcaacctctctctc

SEQ ID NO: 1387990 - DNA, 22 bp, Artificial Sequence
  chemically synthesized
actgcaacctctctctcccggg

SEQ ID NO: 1387991 - DNA, 22 bp, Artificial Sequence
  chemically synthesized
caacctctctctcccgggttca

SEQ ID NO: 1387992 - DNA, 22 bp, Artificial Sequence
  chemically synthesized
aggcatgagggtctcttgaacc

SEQ ID NO: 1387993 - DNA, 22 bp, Artificial Sequence
  chemically synthesized
tctctcccgggttcaagagacc

SEQ ID NO: 1387994 - DNA, 22 bp, Artificial Sequence
  chemically synthesized
tctcccgggttcaagagaccct

SEQ ID NO: 1387995 - DNA, 22 bp, Artificial Sequence
  chemically synthesized
tcccgggttcaagagaccctca

SEQ ID NO: 1387996 - DNA, 22 bp, Artificial Sequence
  chemically synthesized
ccgggttcaagagaccctcatg

SEQ ID NO: 1387997 - DNA, 22 bp, Artificial Sequence
  chemically synthesized
aggaggctgaggcatgagggtc

SEQ ID NO: 1387998 - DNA, 22 bp, Artificial Sequence
  chemically synthesized
ctcaggaggctgaggcatgagg

SEQ ID NO: 1387999 - DNA, 22 bp, Artificial Sequence
  chemically synthesized
aagagaccctcatgcctcagcc

SEQ ID NO: 1388000 - DNA, 22 bp, Artificial Sequence
  chemically synthesized
taatcccagctactcaggaggc

SEQ ID NO: 1388001 - DNA, 22 bp, Artificial Sequence
  chemically synthesized
atgcctcagcctcctgagtagc

SEQ ID NO: 1388002 - DNA, 22 bp, Artificial Sequence
  chemically synthesized
agcctcctgagtagctgggatt

SEQ ID NO: 1388003 - DNA, 22 bp, Artificial Sequence
  chemically synthesized
ctgagtagctgggattacaggc

SEQ ID NO: 1388004 - DNA, 22 bp, Artificial Sequence
  chemically synthesized
agtagctgggattacaggcaca

SEQ ID NO: 1388005 - DNA, 22 bp, Artificial Sequence
  chemically synthesized
ggcatgatggtgtgtgcctgta

SEQ ID NO: 1388006 - DNA, 22 bp, Artificial Sequence
  chemically synthesized
gctgggcatgatggtgtgtgcc

SEQ ID NO: 1388007 - DNA, 22 bp, Artificial Sequence
  chemically synthesized
ggattacaggcacacaccatca

SEQ ID NO: 1388008 - DNA, 22 bp, Artificial Sequence
  chemically synthesized
caggcacacaccatcatgccca

SEQ ID NO: 1388009 - DNA, 22 bp, Artificial Sequence
  chemically synthesized
aaaatataaaaattagctgggc

SEQ ID NO: 1388010 - DNA, 22 bp, Artificial Sequence
  chemically synthesized
gactaaaaatataaaaattagc

SEQ ID NO: 1388011 - DNA, 22 bp, Artificial Sequence
  chemically synthesized
tctcgactaaaaatataaaaat

SEQ ID NO: 1388012 - DNA, 22 bp, Artificial Sequence
  chemically synthesized
atttttatatttttagtcgaga

SEQ ID NO: 1388013 - DNA, 22 bp, Artificial Sequence
  chemically synthesized
ttatatttttagtcgagacagg

SEQ ID NO: 1388014 - DNA, 22 bp, Artificial Sequence
  chemically synthesized
tatatttttagtcgagacaggg

SEQ ID NO: 1388015 - DNA, 22 bp, Artificial Sequence
  chemically synthesized
atatttttagtcgagacagggt

SEQ ID NO: 1388016 - DNA, 22 bp, Artificial Sequence
  chemically synthesized
tatttttagtcgagacagggtt

SEQ ID NO: 1388017 - DNA, 22 bp, Artificial Sequence
  chemically synthesized
gccaacatagtgaaaccctgtc

SEQ ID NO: 1388018 - DNA, 22 bp, Artificial Sequence
  chemically synthesized
ttagtcgagacagggtttcact

SEQ ID NO: 1388019 - DNA, 22 bp, Artificial Sequence
  chemically synthesized
tagtcgagacagggtttcacta

SEQ ID NO: 1388020 - DNA, 22 bp, Artificial Sequence
  chemically synthesized
agtcgagacagggtttcactat

SEQ ID NO: 1388021 - DNA, 22 bp, Artificial Sequence
  chemically synthesized
gtcgagacagggtttcactatg

SEQ ID NO: 1388022 - DNA, 22 bp, Artificial Sequence
  chemically synthesized
aagaccagcctggccaacatag

SEQ ID NO: 1388023 - DNA, 22 bp, Artificial Sequence
  chemically synthesized
cactatgttggccaggctggtc

SEQ ID NO: 1388024 - DNA, 22 bp, Artificial Sequence
  chemically synthesized
actatgttggccaggctggtct

SEQ ID NO: 1388025 - DNA, 22 bp, Artificial Sequence
  chemically synthesized
aggtcaggagttcaagaccagc

SEQ ID NO: 1388026 - DNA, 22 bp, Artificial Sequence
  chemically synthesized
tgttggccaggctggtcttgaa

SEQ ID NO: 1388027 - DNA, 22 bp, Artificial Sequence
  chemically synthesized
gccaggctggtcttgaactcct

SEQ ID NO: 1388028 - DNA, 22 bp, Artificial Sequence
  chemically synthesized
gtcttgaactcctgacctcagg

SEQ ID NO: 1388029 - DNA, 22 bp, Artificial Sequence
  chemically synthesized
gaactcctgacctcaggtgatc

SEQ ID NO: 1388030 - DNA, 22 bp, Artificial Sequence
  chemically synthesized
aactcctgacctcaggtgatcc

SEQ ID NO: 1388031 - DNA, 22 bp, Artificial Sequence
  chemically synthesized
ggagaccccggcgaccggatca

SEQ ID NO: 1388032 - DNA, 22 bp, Artificial Sequence
  chemically synthesized
ctgacctcaggtgatccggtcg

SEQ ID NO: 1388033 - DNA, 22 bp, Artificial Sequence
  chemically synthesized
gggagaccccggcgaccggatc

SEQ ID NO: 1388034 - DNA, 22 bp, Artificial Sequence
  chemically synthesized
tgggagaccccggcgaccggat

SEQ ID NO: 1388035 - DNA, 22 bp, Artificial Sequence
  chemically synthesized
acctcaggtgatccggtcgccg

SEQ ID NO: 1388036 - DNA, 22 bp, Artificial Sequence
  chemically synthesized
aggtgatccggtcgccggggtc

SEQ ID NO: 1388037 - DNA, 22 bp, Artificial Sequence
  chemically synthesized
atgcccgtaatcccagcacttt

SEQ ID NO: 1388038 - DNA, 22 bp, Artificial Sequence
  chemically synthesized
ccaaagtgctgggattacgggc

SEQ ID NO: 1388039 - DNA, 22 bp, Artificial Sequence
  chemically synthesized
ggattacgggcatgagccactg

SEQ ID NO: 1388040 - DNA, 22 bp, Artificial Sequence
  chemically synthesized
cgggcatgagccactgcgcctg

SEQ ID NO: 1388041 - DNA, 22 bp, Artificial Sequence
  chemically synthesized
aagtagaagtcaggccaggcgc

SEQ ID NO: 1388042 - DNA, 22 bp, Artificial Sequence
  chemically synthesized
aaagtagaagtcaggccaggcg

SEQ ID NO: 1388043 - DNA, 22 bp, Artificial Sequence
  chemically synthesized
taaagtagaagtcaggccaggc

SEQ ID NO: 1388044 - DNA, 22 bp, Artificial Sequence
  chemically synthesized
acaagaattttaaagtagaagt

SEQ ID NO: 1388045 - DNA, 22 bp, Artificial Sequence
  chemically synthesized
cgcctggcctgacttctacttt

SEQ ID NO: 1388046 - DNA, 22 bp, Artificial Sequence
  chemically synthesized
tctgacaagaattttaaagtag

SEQ ID NO: 1388047 - DNA, 22 bp, Artificial Sequence
  chemically synthesized
gcctgacttctactttaaaatt

SEQ ID NO: 1388048 - DNA, 22 bp, Artificial Sequence
  chemically synthesized
aaattatctgacaagaatttta

SEQ ID NO: 1388049 - DNA, 22 bp, Artificial Sequence
  chemically synthesized
acttctactttaaaattcttgt

SEQ ID NO: 1388050 - DNA, 22 bp, Artificial Sequence
  chemically synthesized
ctactttaaaattcttgtcaga

SEQ ID NO: 1388051 - DNA, 22 bp, Artificial Sequence
  chemically synthesized
tactttaaaattcttgtcagat

SEQ ID NO: 1388052 - DNA, 22 bp, Artificial Sequence
  chemically synthesized
gatgttgaaattatctgacaag

SEQ ID NO: 1388053 - DNA, 22 bp, Artificial Sequence
  chemically synthesized
ctttaaaattcttgtcagataa

SEQ ID NO: 1388054 - DNA, 22 bp, Artificial Sequence
  chemically synthesized
taaaattcttgtcagataattt

SEQ ID NO: 1388055 - DNA, 22 bp, Artificial Sequence
  chemically synthesized
aaaattcttgtcagataatttc

SEQ ID NO: 1388056 - DNA, 22 bp, Artificial Sequence
  chemically synthesized
aaattcttgtcagataatttca

SEQ ID NO: 1388057 - DNA, 22 bp, Artificial Sequence
  chemically synthesized
gataaattagatgttgaaatta

SEQ ID NO: 1388058 - DNA, 22 bp, Artificial Sequence
  chemically synthesized
agataaattagatgttgaaatt

SEQ ID NO: 1388059 - DNA, 22 bp, Artificial Sequence
  chemically synthesized
ttgtcagataatttcaacatct

SEQ ID NO: 1388060 - DNA, 22 bp, Artificial Sequence
  chemically synthesized
gtcagataatttcaacatctaa

SEQ ID NO: 1388061 - DNA, 22 bp, Artificial Sequence
  chemically synthesized
tcagataatttcaacatctaat

SEQ ID NO: 1388062 - DNA, 22 bp, Artificial Sequence
  chemically synthesized
tcacttagataaattagatgtt

SEQ ID NO: 1388063 - DNA, 22 bp, Artificial Sequence
  chemically synthesized
atgctatcacttagataaatta

SEQ ID NO: 1388064 - DNA, 22 bp, Artificial Sequence
  chemically synthesized
caacatctaatttatctaagtg

SEQ ID NO: 1388065 - DNA, 22 bp, Artificial Sequence
  chemically synthesized
aacatctaatttatctaagtga

SEQ ID NO: 1388066 - DNA, 22 bp, Artificial Sequence
  chemically synthesized
atttatctaagtgatagcatta

SEQ ID NO: 1388067 - DNA, 22 bp, Artificial Sequence
  chemically synthesized
atctaagtgatagcattagtcg

SEQ ID NO: 1388068 - DNA, 22 bp, Artificial Sequence
  chemically synthesized
tctaagtgatagcattagtcga

SEQ ID NO: 1388069 - DNA, 22 bp, Artificial Sequence
  chemically synthesized
gaatgagaaaagacatcgacta

SEQ ID NO: 1388070 - DNA, 22 bp, Artificial Sequence
  chemically synthesized
agtgatagcattagtcgatgtc

SEQ ID NO: 1388071 - DNA, 22 bp, Artificial Sequence
  chemically synthesized
gtcgatgtcttttctcattcta

SEQ ID NO: 1388072 - DNA, 22 bp, Artificial Sequence
  chemically synthesized
ttctcattctagttttgtttgt

SEQ ID NO: 1388073 - DNA, 22 bp, Artificial Sequence
  chemically synthesized
tctcattctagttttgtttgtt

SEQ ID NO: 1388074 - DNA, 22 bp, Artificial Sequence
  chemically synthesized
agaaccaaaacaaacaaacaaa

SEQ ID NO: 1388075 - DNA, 22 bp, Artificial Sequence
  chemically synthesized
ctcattctagttttgtttgttt

SEQ ID NO: 1388076 - DNA, 22 bp, Artificial Sequence
  chemically synthesized
tcattctagttttgtttgtttg

SEQ ID NO: 1388077 - DNA, 22 bp, Artificial Sequence
  chemically synthesized
attctagttttgtttgtttgtt

SEQ ID NO: 1388078 - DNA, 22 bp, Artificial Sequence
  chemically synthesized
catactgagaaccaaaacaaac

SEQ ID NO: 1388079 - DNA, 22 bp, Artificial Sequence
  chemically synthesized
tagttttgtttgtttgttttgg

SEQ ID NO: 1388080 - DNA, 22 bp, Artificial Sequence
  chemically synthesized
gttttgtttgtttgttttggtt

SEQ ID NO: 1388081 - DNA, 22 bp, Artificial Sequence
  chemically synthesized
tgtttgtttgttttggttctca

SEQ ID NO: 1388082 - DNA, 22 bp, Artificial Sequence
  chemically synthesized
gtttgtttgttttggttctcag

SEQ ID NO: 1388083 - DNA, 22 bp, Artificial Sequence
  chemically synthesized
tttgtttgttttggttctcagt

SEQ ID NO: 1388084 - DNA, 22 bp, Artificial Sequence
  chemically synthesized
gtttgttttggttctcagtatg

SEQ ID NO: 1388085 - DNA, 22 bp, Artificial Sequence
  chemically synthesized
tttgttttggttctcagtatgc

SEQ ID NO: 1388086 - DNA, 22 bp, Artificial Sequence
  chemically synthesized
gttttggttctcagtatgcagg

SEQ ID NO: 1388087 - DNA, 22 bp, Artificial Sequence
  chemically synthesized
ttttggttctcagtatgcaggc

SEQ ID NO: 1388088 - DNA, 22 bp, Artificial Sequence
  chemically synthesized
tggttctcagtatgcaggcgac

SEQ ID NO: 1388089 - DNA, 22 bp, Artificial Sequence
  chemically synthesized
ggttctcagtatgcaggcgact

SEQ ID NO: 1388090 - DNA, 22 bp, Artificial Sequence
  chemically synthesized
gttctcagtatgcaggcgactt

SEQ ID NO: 1388091 - DNA, 22 bp, Artificial Sequence
  chemically synthesized
tcagtatgcaggcgacttttga

SEQ ID NO: 1388092 - DNA, 22 bp, Artificial Sequence
  chemically synthesized
agtatgcaggcgacttttgatg

SEQ ID NO: 1388093 - DNA, 22 bp, Artificial Sequence
  chemically synthesized
ttgatggtactctggacatttt

SEQ ID NO: 1388094 - DNA, 22 bp, Artificial Sequence
  chemically synthesized
tgatggtactctggacattttg

SEQ ID NO: 1388095 - DNA, 22 bp, Artificial Sequence
  chemically synthesized
gatggtactctggacattttgt

SEQ ID NO: 1388096 - DNA, 22 bp, Artificial Sequence
  chemically synthesized
catatataatggacaaaatgtc

SEQ ID NO: 1388097 - DNA, 22 bp, Artificial Sequence
  chemically synthesized
atggtactctggacattttgtc

SEQ ID NO: 1388098 - DNA, 22 bp, Artificial Sequence
  chemically synthesized
tgcatatataatggacaaaatg

SEQ ID NO: 1388099 - DNA, 22 bp, Artificial Sequence
  chemically synthesized
tggacattttgtccattatata

SEQ ID NO: 1388100 - DNA, 22 bp, Artificial Sequence
  chemically synthesized
gacattttgtccattatatatg

SEQ ID NO: 1388101 - DNA, 22 bp, Artificial Sequence
  chemically synthesized
tgtccattatatatgcagaatc

SEQ ID NO: 1388102 - DNA, 22 bp, Artificial Sequence
  chemically synthesized
aaataagatccagattctgcat

SEQ ID NO: 1388103 - DNA, 22 bp, Artificial Sequence
  chemically synthesized
gtccattatatatgcagaatct

SEQ ID NO: 1388104 - DNA, 22 bp, Artificial Sequence
  chemically synthesized
tccattatatatgcagaatctg

SEQ ID NO: 1388105 - DNA, 22 bp, Artificial Sequence
  chemically synthesized
tatatgcagaatctggatctta

SEQ ID NO: 1388106 - DNA, 22 bp, Artificial Sequence
  chemically synthesized
aaataaaagattgaaataagat

SEQ ID NO: 1388107 - DNA, 22 bp, Artificial Sequence
  chemically synthesized
ctaaaataaaagattgaaataa

SEQ ID NO: 1388108 - DNA, 22 bp, Artificial Sequence
  chemically synthesized
gatcttatttcaatcttttatt

SEQ ID NO: 1388109 - DNA, 22 bp, Artificial Sequence
  chemically synthesized
atttcaatcttttattttagca

SEQ ID NO: 1388110 - DNA, 22 bp, Artificial Sequence
  chemically synthesized
tttcaatcttttattttagcag

SEQ ID NO: 1388111 - DNA, 22 bp, Artificial Sequence
  chemically synthesized
cgtatggtaaatacctgctaaa

SEQ ID NO: 1388112 - DNA, 22 bp, Artificial Sequence
  chemically synthesized
caatcttttattttagcaggta

SEQ ID NO: 1388113 - DNA, 22 bp, Artificial Sequence
  chemically synthesized
aatcttttattttagcaggtat

SEQ ID NO: 1388114 - DNA, 22 bp, Artificial Sequence
  chemically synthesized
aactacgtatggtaaatacctg

SEQ ID NO: 1388115 - DNA, 22 bp, Artificial Sequence
  chemically synthesized
ttattttagcaggtatttacca

SEQ ID NO: 1388116 - DNA, 22 bp, Artificial Sequence
  chemically synthesized
tattttagcaggtatttaccat

SEQ ID NO: 1388117 - DNA, 22 bp, Artificial Sequence
  chemically synthesized
attttagcaggtatttaccata

SEQ ID NO: 1388118 - DNA, 22 bp, Artificial Sequence
  chemically synthesized
ttttagcaggtatttaccatac

SEQ ID NO: 1388119 - DNA, 22 bp, Artificial Sequence
  chemically synthesized
tgtattgaactacgtatggtaa

SEQ ID NO: 1388120 - DNA, 22 bp, Artificial Sequence
  chemically synthesized
tagcaggtatttaccatacgta

SEQ ID NO: 1388121 - DNA, 22 bp, Artificial Sequence
  chemically synthesized
agcaggtatttaccatacgtag

SEQ ID NO: 1388122 - DNA, 22 bp, Artificial Sequence
  chemically synthesized
gcaggtatttaccatacgtagt

SEQ ID NO: 1388123 - DNA, 22 bp, Artificial Sequence
  chemically synthesized
accatacgtagttcaatacaca

SEQ ID NO: 1388124 - DNA, 22 bp, Artificial Sequence
  chemically synthesized
ccatacgtagttcaatacacag

SEQ ID NO: 1388125 - DNA, 22 bp, Artificial Sequence
  chemically synthesized
aatacacaggtgccattctact

SEQ ID NO: 1388126 - DNA, 22 bp, Artificial Sequence
  chemically synthesized
ggaccacagcccataaaagtag

SEQ ID NO: 1388127 - DNA, 22 bp, Artificial Sequence
  chemically synthesized
gggaccacagcccataaaagta

SEQ ID NO: 1388128 - DNA, 22 bp, Artificial Sequence
  chemically synthesized
tgggaccacagcccataaaagt

SEQ ID NO: 1388129 - DNA, 22 bp, Artificial Sequence
  chemically synthesized
tctttgggaccacagcccataa

SEQ ID NO: 1388130 - DNA, 22 bp, Artificial Sequence
  chemically synthesized
tacttttatgggctgtggtccc

SEQ ID NO: 1388131 - DNA, 22 bp, Artificial Sequence
  chemically synthesized
cttttatgggctgtggtcccaa

SEQ ID NO: 1388132 - DNA, 22 bp, Artificial Sequence
  chemically synthesized
ttatgggctgtggtcccaaaga

SEQ ID NO: 1388133 - DNA, 22 bp, Artificial Sequence
  chemically synthesized
aaaataaaactgtctttgggac

SEQ ID NO: 1388134 - DNA, 22 bp, Artificial Sequence
  chemically synthesized
tatgggctgtggtcccaaagac

SEQ ID NO: 1388135 - DNA, 22 bp, Artificial Sequence
  chemically synthesized
atgggctgtggtcccaaagaca

SEQ ID NO: 1388136 - DNA, 22 bp, Artificial Sequence
  chemically synthesized
tgaaaataaaactgtctttggg

SEQ ID NO: 1388137 - DNA, 22 bp, Artificial Sequence
  chemically synthesized
tgggctgtggtcccaaagacag

SEQ ID NO: 1388138 - DNA, 22 bp, Artificial Sequence
  chemically synthesized
tggtcccaaagacagttttatt

SEQ ID NO: 1388139 - DNA, 22 bp, Artificial Sequence
  chemically synthesized
aataacacgagaaatactctga

SEQ ID NO: 1388140 - DNA, 22 bp, Artificial Sequence
  chemically synthesized
tattttcagagtatttctcgtg

SEQ ID NO: 1388141 - DNA, 22 bp, Artificial Sequence
  chemically synthesized
attttcagagtatttctcgtgt

SEQ ID NO: 1388142 - DNA, 22 bp, Artificial Sequence
  chemically synthesized
ttttcagagtatttctcgtgtt

SEQ ID NO: 1388143 - DNA, 22 bp, Artificial Sequence
  chemically synthesized
tcagagtatttctcgtgttatt

SEQ ID NO: 1388144 - DNA, 22 bp, Artificial Sequence
  chemically synthesized
cagagtatttctcgtgttattg

SEQ ID NO: 1388145 - DNA, 22 bp, Artificial Sequence
  chemically synthesized
agagtatttctcgtgttattga

SEQ ID NO: 1388146 - DNA, 22 bp, Artificial Sequence
  chemically synthesized
gataaaccaagcaggcctcaat

SEQ ID NO: 1388147 - DNA, 22 bp, Artificial Sequence
  chemically synthesized
ctcgtgttattgaggcctgctt

SEQ ID NO: 1388148 - DNA, 22 bp, Artificial Sequence
  chemically synthesized
tcgtgttattgaggcctgcttg

SEQ ID NO: 1388149 - DNA, 22 bp, Artificial Sequence
  chemically synthesized
gtgttattgaggcctgcttggt

SEQ ID NO: 1388150 - DNA, 22 bp, Artificial Sequence
  chemically synthesized
ttgaggcctgcttggtttatct

SEQ ID NO: 1388151 - DNA, 22 bp, Artificial Sequence
  chemically synthesized
aggcctgcttggtttatctagt

SEQ ID NO: 1388152 - DNA, 22 bp, Artificial Sequence
  chemically synthesized
agagtaccagcatcactagata

SEQ ID NO: 1388153 - DNA, 22 bp, Artificial Sequence
  chemically synthesized
gagagtaccagcatcactagat

SEQ ID NO: 1388154 - DNA, 22 bp, Artificial Sequence
  chemically synthesized
tgagagtaccagcatcactaga

SEQ ID NO: 1388155 - DNA, 22 bp, Artificial Sequence
  chemically synthesized
ttgagagtaccagcatcactag

SEQ ID NO: 1388156 - DNA, 22 bp, Artificial Sequence
  chemically synthesized
cttggtttatctagtgatgctg

SEQ ID NO: 1388157 - DNA, 22 bp, Artificial Sequence
  chemically synthesized
ggtttatctagtgatgctggta

SEQ ID NO: 1388158 - DNA, 22 bp, Artificial Sequence
  chemically synthesized
gtttatctagtgatgctggtac

SEQ ID NO: 1388159 - DNA, 22 bp, Artificial Sequence
  chemically synthesized
atctagtgatgctggtactctc

SEQ ID NO: 1388160 - DNA, 22 bp, Artificial Sequence
  chemically synthesized
tctagtgatgctggtactctca

SEQ ID NO: 1388161 - DNA, 22 bp, Artificial Sequence
  chemically synthesized
gtgatgctggtactctcaaaaa

SEQ ID NO: 1388162 - DNA, 22 bp, Artificial Sequence
  chemically synthesized
agaatgtaccatcaaggatttt

SEQ ID NO: 1388163 - DNA, 22 bp, Artificial Sequence
  chemically synthesized
gtactctcaaaaatccttgatg

SEQ ID NO: 1388164 - DNA, 22 bp, Artificial Sequence
  chemically synthesized
cccactcagaatgtaccatcaa

SEQ ID NO: 1388165 - DNA, 22 bp, Artificial Sequence
  chemically synthesized
tcaaaaatccttgatggtacat

SEQ ID NO: 1388166 - DNA, 22 bp, Artificial Sequence
  chemically synthesized
tgcccactcagaatgtaccatc

SEQ ID NO: 1388167 - DNA, 22 bp, Artificial Sequence
  chemically synthesized
ctgcccactcagaatgtaccat

SEQ ID NO: 1388168 - DNA, 22 bp, Artificial Sequence
  chemically synthesized
aaaaatccttgatggtacattc

SEQ ID NO: 1388169 - DNA, 22 bp, Artificial Sequence
  chemically synthesized
cttctgcccactcagaatgtac

SEQ ID NO: 1388170 - DNA, 22 bp, Artificial Sequence
  chemically synthesized
gatggtacattctgagtgggca

SEQ ID NO: 1388171 - DNA, 22 bp, Artificial Sequence
  chemically synthesized
gggaactccttctgcccactca

SEQ ID NO: 1388172 - DNA, 22 bp, Artificial Sequence
  chemically synthesized
atggtacattctgagtgggcag

SEQ ID NO: 1388173 - DNA, 22 bp, Artificial Sequence
  chemically synthesized
gtctggggaactccttctgccc

SEQ ID NO: 1388174 - DNA, 22 bp, Artificial Sequence
  chemically synthesized
tgagtgggcagaaggagttccc

SEQ ID NO: 1388175 - DNA, 22 bp, Artificial Sequence
  chemically synthesized
agtgggcagaaggagttcccca

SEQ ID NO: 1388176 - DNA, 22 bp, Artificial Sequence
  chemically synthesized
gcagcaccagcaccctagtctg

SEQ ID NO: 1388177 - DNA, 22 bp, Artificial Sequence
  chemically synthesized
cctagcagcaccagcaccctag

SEQ ID NO: 1388178 - DNA, 22 bp, Artificial Sequence
  chemically synthesized
tacctagcagcaccagcaccct

SEQ ID NO: 1388179 - DNA, 22 bp, Artificial Sequence
  chemically synthesized
ctctacctagcagcaccagcac

SEQ ID NO: 1388180 - DNA, 22 bp, Artificial Sequence
  chemically synthesized
cccagactagggtgctggtgct

SEQ ID NO: 1388181 - DNA, 22 bp, Artificial Sequence
  chemically synthesized
gggtgctggtgctgctaggtag

SEQ ID NO: 1388182 - DNA, 22 bp, Artificial Sequence
  chemically synthesized
agaaacccctactctacctagc

SEQ ID NO: 1388183 - DNA, 22 bp, Artificial Sequence
  chemically synthesized
gtgctgctaggtagagtagggg

SEQ ID NO: 1388184 - DNA, 22 bp, Artificial Sequence
  chemically synthesized
tagatctaagaaacccctactc

SEQ ID NO: 1388185 - DNA, 22 bp, Artificial Sequence
  chemically synthesized
tatagatctaagaaacccctac

SEQ ID NO: 1388186 - DNA, 22 bp, Artificial Sequence
  chemically synthesized
ctaggtagagtaggggtttctt

SEQ ID NO: 1388187 - DNA, 22 bp, Artificial Sequence
  chemically synthesized
tctctatagatctaagaaaccc

SEQ ID NO: 1388188 - DNA, 22 bp, Artificial Sequence
  chemically synthesized
atctctatagatctaagaaacc

SEQ ID NO: 1388189 - DNA, 22 bp, Artificial Sequence
  chemically synthesized
ggtagagtaggggtttcttaga

SEQ ID NO: 1388190 - DNA, 22 bp, Artificial Sequence
  chemically synthesized
tatctctatagatctaagaaac

SEQ ID NO: 1388191 - DNA, 22 bp, Artificial Sequence
  chemically synthesized
ttatctctatagatctaagaaa

SEQ ID NO: 1388192 - DNA, 22 bp, Artificial Sequence
  chemically synthesized
ggaaacacttttatctctatag

SEQ ID NO: 1388193 - DNA, 22 bp, Artificial Sequence
  chemically synthesized
tctaggaaacacttttatctct

SEQ ID NO: 1388194 - DNA, 22 bp, Artificial Sequence
  chemically synthesized
cttagatctatagagataaaag

SEQ ID NO: 1388195 - DNA, 22 bp, Artificial Sequence
  chemically synthesized
ttagatctatagagataaaagt

SEQ ID NO: 1388196 - DNA, 22 bp, Artificial Sequence
  chemically synthesized
agatctatagagataaaagtgt

SEQ ID NO: 1388197 - DNA, 22 bp, Artificial Sequence
  chemically synthesized
gatctatagagataaaagtgtt

SEQ ID NO: 1388198 - DNA, 22 bp, Artificial Sequence
  chemically synthesized
tagagataaaagtgtttcctag

SEQ ID NO: 1388199 - DNA, 22 bp, Artificial Sequence
  chemically synthesized
acacaataatcctatctaggaa

SEQ ID NO: 1388200 - DNA, 22 bp, Artificial Sequence
  chemically synthesized
taacacaataatcctatctagg

SEQ ID NO: 1388201 - DNA, 22 bp, Artificial Sequence
  chemically synthesized
cctagataggattattgtgtta

SEQ ID NO: 1388202 - DNA, 22 bp, Artificial Sequence
  chemically synthesized
ctagataggattattgtgttag

SEQ ID NO: 1388203 - DNA, 22 bp, Artificial Sequence
  chemically synthesized
gataggattattgtgttagaat

SEQ ID NO: 1388204 - DNA, 22 bp, Artificial Sequence
  chemically synthesized
gagggtaccagtatagggattc

SEQ ID NO: 1388205 - DNA, 22 bp, Artificial Sequence
  chemically synthesized
ttgtgttagaatccctatactg

SEQ ID NO: 1388206 - DNA, 22 bp, Artificial Sequence
  chemically synthesized
tgttagaatccctatactggta

SEQ ID NO: 1388207 - DNA, 22 bp, Artificial Sequence
  chemically synthesized
gagcagctggagggtaccagta

SEQ ID NO: 1388208 - DNA, 22 bp, Artificial Sequence
  chemically synthesized
gaatccctatactggtaccctc

SEQ ID NO: 1388209 - DNA, 22 bp, Artificial Sequence
  chemically synthesized
tactggtaccctccagctgctc

SEQ ID NO: 1388210 - DNA, 22 bp, Artificial Sequence
  chemically synthesized
cccagagacattggagcagctg

SEQ ID NO: 1388211 - DNA, 22 bp, Artificial Sequence
  chemically synthesized
acccagagacattggagcagct

SEQ ID NO: 1388212 - DNA, 22 bp, Artificial Sequence
  chemically synthesized
tacccagagacattggagcagc

SEQ ID NO: 1388213 - DNA, 22 bp, Artificial Sequence
  chemically synthesized
ttacccagagacattggagcag

SEQ ID NO: 1388214 - DNA, 22 bp, Artificial Sequence
  chemically synthesized
gtaccctccagctgctccaatg

SEQ ID NO: 1388215 - DNA, 22 bp, Artificial Sequence
  chemically synthesized
cacttttacccagagacattgg

SEQ ID NO: 1388216 - DNA, 22 bp, Artificial Sequence
  chemically synthesized
cagctgctccaatgtctctggg

SEQ ID NO: 1388217 - DNA, 22 bp, Artificial Sequence
  chemically synthesized
ctccaatgtctctgggtaaaag

SEQ ID NO: 1388218 - DNA, 22 bp, Artificial Sequence
  chemically synthesized
caatgtctctgggtaaaagtgg

SEQ ID NO: 1388219 - DNA, 22 bp, Artificial Sequence
  chemically synthesized
tggccatgagaatccctccact

SEQ ID NO: 1388220 - DNA, 22 bp, Artificial Sequence
  chemically synthesized
tgggtaaaagtggagggattct

SEQ ID NO: 1388221 - DNA, 22 bp, Artificial Sequence
  chemically synthesized
ggtaaaagtggagggattctca

SEQ ID NO: 1388222 - DNA, 22 bp, Artificial Sequence
  chemically synthesized
gacgctatggccatgagaatcc

SEQ ID NO: 1388223 - DNA, 22 bp, Artificial Sequence
  chemically synthesized
ggaagcccgttggacgctatgg

SEQ ID NO: 1388224 - DNA, 22 bp, Artificial Sequence
  chemically synthesized
gcctgggaagcccgttggacgc

SEQ ID NO: 1388225 - DNA, 22 bp, Artificial Sequence
  chemically synthesized
tcatggccatagcgtccaacgg

SEQ ID NO: 1388226 - DNA, 22 bp, Artificial Sequence
  chemically synthesized
atggccatagcgtccaacgggc

SEQ ID NO: 1388227 - DNA, 22 bp, Artificial Sequence
  chemically synthesized
tccaccacaaagagtgactagc

SEQ ID NO: 1388228 - DNA, 22 bp, Artificial Sequence
  chemically synthesized
cccaggctagtcactctttgtg

SEQ ID NO: 1388229 - DNA, 22 bp, Artificial Sequence
  chemically synthesized
ccaggctagtcactctttgtgg

SEQ ID NO: 1388230 - DNA, 22 bp, Artificial Sequence
  chemically synthesized
gtaaggctatccaccacaaaga

SEQ ID NO: 1388231 - DNA, 22 bp, Artificial Sequence
  chemically synthesized
gtcactctttgtggtggatagc

SEQ ID NO: 1388232 - DNA, 22 bp, Artificial Sequence
  chemically synthesized
tttgtggtggatagccttacca

SEQ ID NO: 1388233 - DNA, 22 bp, Artificial Sequence
  chemically synthesized
tgtggtggatagccttaccagt

SEQ ID NO: 1388234 - DNA, 22 bp, Artificial Sequence
  chemically synthesized
gtggtggatagccttaccagtg

SEQ ID NO: 1388235 - DNA, 22 bp, Artificial Sequence
  chemically synthesized
tggtggatagccttaccagtgc

SEQ ID NO: 1388236 - DNA, 22 bp, Artificial Sequence
  chemically synthesized
ggcaaacacagagcactggtaa

SEQ ID NO: 1388237 - DNA, 22 bp, Artificial Sequence
  chemically synthesized
accagtgctctgtgtttgccca

SEQ ID NO: 1388238 - DNA, 22 bp, Artificial Sequence
  chemically synthesized
ccagtgctctgtgtttgcccag

SEQ ID NO: 1388239 - DNA, 22 bp, Artificial Sequence
  chemically synthesized
cccacccagagatacctgggca

SEQ ID NO: 1388240 - DNA, 22 bp, Artificial Sequence
  chemically synthesized
ccccacccagagatacctgggc

SEQ ID NO: 1388241 - DNA, 22 bp, Artificial Sequence
  chemically synthesized
ttccccacccagagatacctgg

SEQ ID NO: 1388242 - DNA, 22 bp, Artificial Sequence
  chemically synthesized
tcttccccacccagagatacct

SEQ ID NO: 1388243 - DNA, 22 bp, Artificial Sequence
  chemically synthesized
tgtgtttgcccaggtatctctg

SEQ ID NO: 1388244 - DNA, 22 bp, Artificial Sequence
  chemically synthesized
ctcttccccacccagagatacc

SEQ ID NO: 1388245 - DNA, 22 bp, Artificial Sequence
  chemically synthesized
tgtttgcccaggtatctctggg

SEQ ID NO: 1388246 - DNA, 22 bp, Artificial Sequence
  chemically synthesized
ggacttctcttccccacccaga

SEQ ID NO: 1388247 - DNA, 22 bp, Artificial Sequence
  chemically synthesized
gcccaggtatctctgggtgggg

SEQ ID NO: 1388248 - DNA, 22 bp, Artificial Sequence
  chemically synthesized
cccaggtatctctgggtgggga

SEQ ID NO: 1388249 - DNA, 22 bp, Artificial Sequence
  chemically synthesized
tgggtggggaagagaagtccta

SEQ ID NO: 1388250 - DNA, 22 bp, Artificial Sequence
  chemically synthesized
gtcatatggacctaggacttct

SEQ ID NO: 1388251 - DNA, 22 bp, Artificial Sequence
  chemically synthesized
ggtcatatggacctaggacttc

SEQ ID NO: 1388252 - DNA, 22 bp, Artificial Sequence
  chemically synthesized
ggtggggaagagaagtcctagg

SEQ ID NO: 1388253 - DNA, 22 bp, Artificial Sequence
  chemically synthesized
tggtcatatggacctaggactt

SEQ ID NO: 1388254 - DNA, 22 bp, Artificial Sequence
  chemically synthesized
agaaagcatctttggtcatatg

SEQ ID NO: 1388255 - DNA, 22 bp, Artificial Sequence
  chemically synthesized
gttcagaaagcatctttggtca

SEQ ID NO: 1388256 - DNA, 22 bp, Artificial Sequence
  chemically synthesized
ggtccatatgaccaaagatgct

SEQ ID NO: 1388257 - DNA, 22 bp, Artificial Sequence
  chemically synthesized
tctgaaccaggtcacttattat

SEQ ID NO: 1388258 - DNA, 22 bp, Artificial Sequence
  chemically synthesized
ctgaaccaggtcacttattatg

SEQ ID NO: 1388259 - DNA, 22 bp, Artificial Sequence
  chemically synthesized
tgaaccaggtcacttattatga

SEQ ID NO: 1388260 - DNA, 22 bp, Artificial Sequence
  chemically synthesized
caagagacacaatcataataag

SEQ ID NO: 1388261 - DNA, 22 bp, Artificial Sequence
  chemically synthesized
aaccaggtcacttattatgatt

SEQ ID NO: 1388262 - DNA, 22 bp, Artificial Sequence
  chemically synthesized
attatgattgtgtctcttgtaa

SEQ ID NO: 1388263 - DNA, 22 bp, Artificial Sequence
  chemically synthesized
ttatgattgtgtctcttgtaat

SEQ ID NO: 1388264 - DNA, 22 bp, Artificial Sequence
  chemically synthesized
tgattgtgtctcttgtaatttc

SEQ ID NO: 1388265 - DNA, 22 bp, Artificial Sequence
  chemically synthesized
tgtctcttgtaatttctgcctt

SEQ ID NO: 1388266 - DNA, 22 bp, Artificial Sequence
  chemically synthesized
ttgtaatttctgcctttccacc

SEQ ID NO: 1388267 - DNA, 22 bp, Artificial Sequence
  chemically synthesized
gtaatttctgcctttccacctc

SEQ ID NO: 1388268 - DNA, 22 bp, Artificial Sequence
  chemically synthesized
taatttctgcctttccacctcg

SEQ ID NO: 1388269 - DNA, 22 bp, Artificial Sequence
  chemically synthesized
cgacaggaagacatcgaggtgg

SEQ ID NO: 1388270 - DNA, 22 bp, Artificial Sequence
  chemically synthesized
ccgacaggaagacatcgaggtg

SEQ ID NO: 1388271 - DNA, 22 bp, Artificial Sequence
  chemically synthesized
tccgacaggaagacatcgaggt

SEQ ID NO: 1388272 - DNA, 22 bp, Artificial Sequence
  chemically synthesized
ttccgacaggaagacatcgagg

SEQ ID NO: 1388273 - DNA, 22 bp, Artificial Sequence
  chemically synthesized
ctgcctttccacctcgatgtct

SEQ ID NO: 1388274 - DNA, 22 bp, Artificial Sequence
  chemically synthesized
tgcctttccacctcgatgtctt

SEQ ID NO: 1388275 - DNA, 22 bp, Artificial Sequence
  chemically synthesized
ttttccgacaggaagacatcga

SEQ ID NO: 1388276 - DNA, 22 bp, Artificial Sequence
  chemically synthesized
cctttccacctcgatgtcttcc

SEQ ID NO: 1388277 - DNA, 22 bp, Artificial Sequence
  chemically synthesized
tcttttccgacaggaagacatc

SEQ ID NO: 1388278 - DNA, 22 bp, Artificial Sequence
  chemically synthesized
tccacctcgatgtcttcctgtc

SEQ ID NO: 1388279 - DNA, 22 bp, Artificial Sequence
  chemically synthesized
ccacctcgatgtcttcctgtcg

SEQ ID NO: 1388280 - DNA, 22 bp, Artificial Sequence
  chemically synthesized
cacctcgatgtcttcctgtcgg

SEQ ID NO: 1388281 - DNA, 22 bp, Artificial Sequence
  chemically synthesized
aggctctcttttccgacaggaa

SEQ ID NO: 1388282 - DNA, 22 bp, Artificial Sequence
  chemically synthesized
gatgtcttcctgtcggaaaaga

SEQ ID NO: 1388283 - DNA, 22 bp, Artificial Sequence
  chemically synthesized
cagaactgaggctctcttttcc

SEQ ID NO: 1388284 - DNA, 22 bp, Artificial Sequence
  chemically synthesized
cctgtcggaaaagagagcctca

SEQ ID NO: 1388285 - DNA, 22 bp, Artificial Sequence
  chemically synthesized
ctgtcggaaaagagagcctcag

SEQ ID NO: 1388286 - DNA, 22 bp, Artificial Sequence
  chemically synthesized
atacctgcagaactgaggctct

SEQ ID NO: 1388287 - DNA, 22 bp, Artificial Sequence
  chemically synthesized
catacctgcagaactgaggctc

SEQ ID NO: 1388288 - DNA, 22 bp, Artificial Sequence
  chemically synthesized
tcggaaaagagagcctcagttc

SEQ ID NO: 1388289 - DNA, 22 bp, Artificial Sequence
  chemically synthesized
ttcatacctgcagaactgaggc

SEQ ID NO: 1388290 - DNA, 22 bp, Artificial Sequence
  chemically synthesized
aagcctcttcatacctgcagaa

SEQ ID NO: 1388291 - DNA, 22 bp, Artificial Sequence
  chemically synthesized
ctgaagcctcttcatacctgca

SEQ ID NO: 1388292 - DNA, 22 bp, Artificial Sequence
  chemically synthesized
actactgaagcctcttcatacc

SEQ ID NO: 1388293 - DNA, 22 bp, Artificial Sequence
  chemically synthesized
agttctgcaggtatgaagaggc

SEQ ID NO: 1388294 - DNA, 22 bp, Artificial Sequence
  chemically synthesized
tgcaggtatgaagaggcttcag

SEQ ID NO: 1388295 - DNA, 22 bp, Artificial Sequence
  chemically synthesized
caggtatgaagaggcttcagta

SEQ ID NO: 1388296 - DNA, 22 bp, Artificial Sequence
  chemically synthesized
ccacaagtgtcctaactactga

SEQ ID NO: 1388297 - DNA, 22 bp, Artificial Sequence
  chemically synthesized
gccacaagtgtcctaactactg

SEQ ID NO: 1388298 - DNA, 22 bp, Artificial Sequence
  chemically synthesized
cagtagttaggacacttgtggc

SEQ ID NO: 1388299 - DNA, 22 bp, Artificial Sequence
  chemically synthesized
agtagttaggacacttgtggca

SEQ ID NO: 1388300 - DNA, 22 bp, Artificial Sequence
  chemically synthesized
ccaataggcacagagatcttgc

SEQ ID NO: 1388301 - DNA, 22 bp, Artificial Sequence
  chemically synthesized
ggacacttgtggcaagatctct

SEQ ID NO: 1388302 - DNA, 22 bp, Artificial Sequence
  chemically synthesized
ttcccaataggcacagagatct

SEQ ID NO: 1388303 - DNA, 22 bp, Artificial Sequence
  chemically synthesized
tctgttcccaataggcacagag

SEQ ID NO: 1388304 - DNA, 22 bp, Artificial Sequence
  chemically synthesized
gtggcaagatctctgtgcctat

SEQ ID NO: 1388305 - DNA, 22 bp, Artificial Sequence
  chemically synthesized
tggcaagatctctgtgcctatt

SEQ ID NO: 1388306 - DNA, 22 bp, Artificial Sequence
  chemically synthesized
tgtgcctattgggaacagacag

SEQ ID NO: 1388307 - DNA, 22 bp, Artificial Sequence
  chemically synthesized
tgcctattgggaacagacagtg

SEQ ID NO: 1388308 - DNA, 22 bp, Artificial Sequence
  chemically synthesized
ttgggaacagacagtgctttct

SEQ ID NO: 1388309 - DNA, 22 bp, Artificial Sequence
  chemically synthesized
ggaacagacagtgctttctgga

SEQ ID NO: 1388310 - DNA, 22 bp, Artificial Sequence
  chemically synthesized
aagaacaaaatcccatccagaa

SEQ ID NO: 1388311 - DNA, 22 bp, Artificial Sequence
  chemically synthesized
tctggatgggattttgttcttg

SEQ ID NO: 1388312 - DNA, 22 bp, Artificial Sequence
  chemically synthesized
ctggatgggattttgttcttga

SEQ ID NO: 1388313 - DNA, 22 bp, Artificial Sequence
  chemically synthesized
tggatgggattttgttcttgag

SEQ ID NO: 1388314 - DNA, 22 bp, Artificial Sequence
  chemically synthesized
gaagagggatccctcaagaaca

SEQ ID NO: 1388315 - DNA, 22 bp, Artificial Sequence
  chemically synthesized
gatgggattttgttcttgaggg

SEQ ID NO: 1388316 - DNA, 22 bp, Artificial Sequence
  chemically synthesized
tgttcttgagggatccctcttc

SEQ ID NO: 1388317 - DNA, 22 bp, Artificial Sequence
  chemically synthesized
gttcttgagggatccctcttct

SEQ ID NO: 1388318 - DNA, 22 bp, Artificial Sequence
  chemically synthesized
ttcttgagggatccctcttcta

SEQ ID NO: 1388319 - DNA, 22 bp, Artificial Sequence
  chemically synthesized
ttgagggatccctcttctagta

SEQ ID NO: 1388320 - DNA, 22 bp, Artificial Sequence
  chemically synthesized
gagggatccctcttctagtacc

SEQ ID NO: 1388321 - DNA, 22 bp, Artificial Sequence
  chemically synthesized
gggcagccacagggtactagaa

SEQ ID NO: 1388322 - DNA, 22 bp, Artificial Sequence
  chemically synthesized
agggatccctcttctagtaccc

SEQ ID NO: 1388323 - DNA, 22 bp, Artificial Sequence
  chemically synthesized
ttctagtaccctgtggctgccc

SEQ ID NO: 1388324 - DNA, 22 bp, Artificial Sequence
  chemically synthesized
tacagagatactggggcagcca

SEQ ID NO: 1388325 - DNA, 22 bp, Artificial Sequence
  chemically synthesized
ctagtaccctgtggctgcccca

SEQ ID NO: 1388326 - DNA, 22 bp, Artificial Sequence
  chemically synthesized
tagtaccctgtggctgccccag

SEQ ID NO: 1388327 - DNA, 22 bp, Artificial Sequence
  chemically synthesized
ttgtacagagatactggggcag

SEQ ID NO: 1388328 - DNA, 22 bp, Artificial Sequence
  chemically synthesized
gtaccctgtggctgccccagta

SEQ ID NO: 1388329 - DNA, 22 bp, Artificial Sequence
  chemically synthesized
tattgtacagagatactggggc

SEQ ID NO: 1388330 - DNA, 22 bp, Artificial Sequence
  chemically synthesized
ccctctattgtacagagatact

SEQ ID NO: 1388331 - DNA, 22 bp, Artificial Sequence
  chemically synthesized
tggctgccccagtatctctgta

SEQ ID NO: 1388332 - DNA, 22 bp, Artificial Sequence
  chemically synthesized
aggctgccctctattgtacaga

SEQ ID NO: 1388333 - DNA, 22 bp, Artificial Sequence
  chemically synthesized
ccccagtatctctgtacaatag

SEQ ID NO: 1388334 - DNA, 22 bp, Artificial Sequence
  chemically synthesized
tgggtctgaggctgccctctat

SEQ ID NO: 1388335 - DNA, 22 bp, Artificial Sequence
  chemically synthesized
ctgtgggtctgaggctgccctc

SEQ ID NO: 1388336 - DNA, 22 bp, Artificial Sequence
  chemically synthesized
tgtacaatagagggcagcctca

SEQ ID NO: 1388337 - DNA, 22 bp, Artificial Sequence
  chemically synthesized
ttcctgtgggtctgaggctgcc

SEQ ID NO: 1388338 - DNA, 22 bp, Artificial Sequence
  chemically synthesized
gttcctgtgggtctgaggctgc

SEQ ID NO: 1388339 - DNA, 22 bp, Artificial Sequence
  chemically synthesized
tacaatagagggcagcctcaga

SEQ ID NO: 1388340 - DNA, 22 bp, Artificial Sequence
  chemically synthesized
tgttcctgtgggtctgaggctg

SEQ ID NO: 1388341 - DNA, 22 bp, Artificial Sequence
  chemically synthesized
tttgttcctgtgggtctgaggc

SEQ ID NO: 1388342 - DNA, 22 bp, Artificial Sequence
  chemically synthesized
gtgcaggaagcctctttgttcc

SEQ ID NO: 1388343 - DNA, 22 bp, Artificial Sequence
  chemically synthesized
agacccacaggaacaaagaggc

SEQ ID NO: 1388344 - DNA, 22 bp, Artificial Sequence
  chemically synthesized
agtggcctagtgcaggaagcct

SEQ ID NO: 1388345 - DNA, 22 bp, Artificial Sequence
  chemically synthesized
taagtggcctagtgcaggaagc

SEQ ID NO: 1388346 - DNA, 22 bp, Artificial Sequence
  chemically synthesized
ccactctaagtggcctagtgca

SEQ ID NO: 1388347 - DNA, 22 bp, Artificial Sequence
  chemically synthesized
accactctaagtggcctagtgc

SEQ ID NO: 1388348 - DNA, 22 bp, Artificial Sequence
  chemically synthesized
taccactctaagtggcctagtg

SEQ ID NO: 1388349 - DNA, 22 bp, Artificial Sequence
  chemically synthesized
cctgcactaggccacttagagt

SEQ ID NO: 1388350 - DNA, 22 bp, Artificial Sequence
  chemically synthesized
ctgcactaggccacttagagtg

SEQ ID NO: 1388351 - DNA, 22 bp, Artificial Sequence
  chemically synthesized
cactaggccacttagagtggta

SEQ ID NO: 1388352 - DNA, 22 bp, Artificial Sequence
  chemically synthesized
ccacaagggattttaccactct

SEQ ID NO: 1388353 - DNA, 22 bp, Artificial Sequence
  chemically synthesized
ggccacttagagtggtaaaatc

SEQ ID NO: 1388354 - DNA, 22 bp, Artificial Sequence
  chemically synthesized
ggtgcaactgccacaagggatt

SEQ ID NO: 1388355 - DNA, 22 bp, Artificial Sequence
  chemically synthesized
agagtggtaaaatcccttgtgg

SEQ ID NO: 1388356 - DNA, 22 bp, Artificial Sequence
  chemically synthesized
gagtggtaaaatcccttgtggc

SEQ ID NO: 1388357 - DNA, 22 bp, Artificial Sequence
  chemically synthesized
ggtggctgggtgcaactgccac

SEQ ID NO: 1388358 - DNA, 22 bp, Artificial Sequence
  chemically synthesized
aggtggctgggtgcaactgcca

SEQ ID NO: 1388359 - DNA, 22 bp, Artificial Sequence
  chemically synthesized
gtggcagttgcacccagccacc

SEQ ID NO: 1388360 - DNA, 22 bp, Artificial Sequence
  chemically synthesized
tggcagttgcacccagccacct

SEQ ID NO: 1388361 - DNA, 22 bp, Artificial Sequence
  chemically synthesized
acaacaggaaatacttaggtgg

SEQ ID NO: 1388362 - DNA, 22 bp, Artificial Sequence
  chemically synthesized
actcacaacaggaaatacttag

SEQ ID NO: 1388363 - DNA, 22 bp, Artificial Sequence
  chemically synthesized
cacccagccacctaagtatttc

SEQ ID NO: 1388364 - DNA, 22 bp, Artificial Sequence
  chemically synthesized
tcactcacaacaggaaatactt

SEQ ID NO: 1388365 - DNA, 22 bp, Artificial Sequence
  chemically synthesized
actctcactcacaacaggaaat

SEQ ID NO: 1388366 - DNA, 22 bp, Artificial Sequence
  chemically synthesized
actcactctcactcacaacagg

SEQ ID NO: 1388367 - DNA, 22 bp, Artificial Sequence
  chemically synthesized
tcactcactctcactcacaaca

SEQ ID NO: 1388368 - DNA, 22 bp, Artificial Sequence
  chemically synthesized
agtatttcctgttgtgagtgag

SEQ ID NO: 1388369 - DNA, 22 bp, Artificial Sequence
  chemically synthesized
agacactctcactcactctcac

SEQ ID NO: 1388370 - DNA, 22 bp, Artificial Sequence
  chemically synthesized
cctgttgtgagtgagagtgagt

SEQ ID NO: 1388371 - DNA, 22 bp, Artificial Sequence
  chemically synthesized
ctgttgtgagtgagagtgagtg

SEQ ID NO: 1388372 - DNA, 22 bp, Artificial Sequence
  chemically synthesized
ttgtgagtgagagtgagtgaga

SEQ ID NO: 1388373 - DNA, 22 bp, Artificial Sequence
  chemically synthesized
caggcctaagacactctcactc

SEQ ID NO: 1388374 - DNA, 22 bp, Artificial Sequence
  chemically synthesized
tgagtgagagtgagtgagagtg

SEQ ID NO: 1388375 - DNA, 22 bp, Artificial Sequence
  chemically synthesized
tccctacaggcctaagacactc

SEQ ID NO: 1388376 - DNA, 22 bp, Artificial Sequence
  chemically synthesized
gtccctacaggcctaagacact

SEQ ID NO: 1388377 - DNA, 22 bp, Artificial Sequence
  chemically synthesized
tgtccctacaggcctaagacac

SEQ ID NO: 1388378 - DNA, 22 bp, Artificial Sequence
  chemically synthesized
tttgtccctacaggcctaagac

SEQ ID NO: 1388379 - DNA, 22 bp, Artificial Sequence
  chemically synthesized
ggaagcctctttgtccctacag

SEQ ID NO: 1388380 - DNA, 22 bp, Artificial Sequence
  chemically synthesized
aggcctgtagggacaaagaggc

SEQ ID NO: 1388381 - DNA, 22 bp, Artificial Sequence
  chemically synthesized
ggcctgtagggacaaagaggct

SEQ ID NO: 1388382 - DNA, 22 bp, Artificial Sequence
  chemically synthesized
tagggacaaagaggcttccgag

SEQ ID NO: 1388383 - DNA, 22 bp, Artificial Sequence
  chemically synthesized
tcacagcaagtggcccaacctc

SEQ ID NO: 1388384 - DNA, 22 bp, Artificial Sequence
  chemically synthesized
gtcacagcaagtggcccaacct

SEQ ID NO: 1388385 - DNA, 22 bp, Artificial Sequence
  chemically synthesized
tgtcacagcaagtggcccaacc

SEQ ID NO: 1388386 - DNA, 22 bp, Artificial Sequence
  chemically synthesized
ccgaggttgggccacttgctgt

SEQ ID NO: 1388387 - DNA, 22 bp, Artificial Sequence
  chemically synthesized
cgaggttgggccacttgctgtg

SEQ ID NO: 1388388 - DNA, 22 bp, Artificial Sequence
  chemically synthesized
gaggaattttgtcacagcaagt

SEQ ID NO: 1388389 - DNA, 22 bp, Artificial Sequence
  chemically synthesized
agaggaattttgtcacagcaag

SEQ ID NO: 1388390 - DNA, 22 bp, Artificial Sequence
  chemically synthesized
tttagaggaattttgtcacagc

SEQ ID NO: 1388391 - DNA, 22 bp, Artificial Sequence
  chemically synthesized
ggccacttgctgtgacaaaatt

SEQ ID NO: 1388392 - DNA, 22 bp, Artificial Sequence
  chemically synthesized
gctgtgacaaaattcctctaaa

SEQ ID NO: 1388393 - DNA, 22 bp, Artificial Sequence
  chemically synthesized
ctgtgacaaaattcctctaaac

SEQ ID NO: 1388394 - DNA, 22 bp, Artificial Sequence
  chemically synthesized
tgacaaaattcctctaaacaat

SEQ ID NO: 1388395 - DNA, 22 bp, Artificial Sequence
  chemically synthesized
aaaaatagacaagtggcagtat

SEQ ID NO: 1388396 - DNA, 22 bp, Artificial Sequence
  chemically synthesized
ctctaaacaatactgccacttg

SEQ ID NO: 1388397 - DNA, 22 bp, Artificial Sequence
  chemically synthesized
ctgaaaaatagacaagtggcag

SEQ ID NO: 1388398 - DNA, 22 bp, Artificial Sequence
  chemically synthesized
tgctgaaaaatagacaagtggc

SEQ ID NO: 1388399 - DNA, 22 bp, Artificial Sequence
  chemically synthesized
taaacaatactgccacttgtct

SEQ ID NO: 1388400 - DNA, 22 bp, Artificial Sequence
  chemically synthesized
aacaatactgccacttgtctat

SEQ ID NO: 1388401 - DNA, 22 bp, Artificial Sequence
  chemically synthesized
ccatgctctgctgaaaaataga

SEQ ID NO: 1388402 - DNA, 22 bp, Artificial Sequence
  chemically synthesized
ccacttgtctatttttcagcag

SEQ ID NO: 1388403 - DNA, 22 bp, Artificial Sequence
  chemically synthesized
ggactaccatgctctgctgaaa

SEQ ID NO: 1388404 - DNA, 22 bp, Artificial Sequence
  chemically synthesized
aggactaccatgctctgctgaa

SEQ ID NO: 1388405 - DNA, 22 bp, Artificial Sequence
  chemically synthesized
gtctatttttcagcagagcatg

SEQ ID NO: 1388406 - DNA, 22 bp, Artificial Sequence
  chemically synthesized
tctatttttcagcagagcatgg

SEQ ID NO: 1388407 - DNA, 22 bp, Artificial Sequence
  chemically synthesized
tttttcagcagagcatggtagt

SEQ ID NO: 1388408 - DNA, 22 bp, Artificial Sequence
  chemically synthesized
ccagggatttaggactaccatg

SEQ ID NO: 1388409 - DNA, 22 bp, Artificial Sequence
  chemically synthesized
cccagggatttaggactaccat

SEQ ID NO: 1388410 - DNA, 22 bp, Artificial Sequence
  chemically synthesized
ttcagcagagcatggtagtcct

SEQ ID NO: 1388411 - DNA, 22 bp, Artificial Sequence
  chemically synthesized
tcccagggatttaggactacca

SEQ ID NO: 1388412 - DNA, 22 bp, Artificial Sequence
  chemically synthesized
tcagcagagcatggtagtccta

SEQ ID NO: 1388413 - DNA, 22 bp, Artificial Sequence
  chemically synthesized
cagcagagcatggtagtcctaa

SEQ ID NO: 1388414 - DNA, 22 bp, Artificial Sequence
  chemically synthesized
agcagagcatggtagtcctaaa

SEQ ID NO: 1388415 - DNA, 22 bp, Artificial Sequence
  chemically synthesized
ctttcccagggatttaggacta

SEQ ID NO: 1388416 - DNA, 22 bp, Artificial Sequence
  chemically synthesized
tcctttcccagggatttaggac

SEQ ID NO: 1388417 - DNA, 22 bp, Artificial Sequence
  chemically synthesized
gggtaagtgcctctcctttccc

SEQ ID NO: 1388418 - DNA, 22 bp, Artificial Sequence
  chemically synthesized
aatccctgggaaaggagaggca

SEQ ID NO: 1388419 - DNA, 22 bp, Artificial Sequence
  chemically synthesized
agcagctagggtaagtgcctct

SEQ ID NO: 1388420 - DNA, 22 bp, Artificial Sequence
  chemically synthesized
ggaaaggagaggcacttaccct

SEQ ID NO: 1388421 - DNA, 22 bp, Artificial Sequence
  chemically synthesized
acattaagcagctagggtaagt

SEQ ID NO: 1388422 - DNA, 22 bp, Artificial Sequence
  chemically synthesized
accctagctgcttaatgttaga

SEQ ID NO: 1388423 - DNA, 22 bp, Artificial Sequence
  chemically synthesized
aatgggagcccatctaacatta

SEQ ID NO: 1388424 - DNA, 22 bp, Artificial Sequence
  chemically synthesized
ccctagctgcttaatgttagat

SEQ ID NO: 1388425 - DNA, 22 bp, Artificial Sequence
  chemically synthesized
ttgaatgggagcccatctaaca

SEQ ID NO: 1388426 - DNA, 22 bp, Artificial Sequence
  chemically synthesized
gctgcttaatgttagatgggct

SEQ ID NO: 1388427 - DNA, 22 bp, Artificial Sequence
  chemically synthesized
cttaatgttagatgggctccca

SEQ ID NO: 1388428 - DNA, 22 bp, Artificial Sequence
  chemically synthesized
aatgttagatgggctcccattc

SEQ ID NO: 1388429 - DNA, 22 bp, Artificial Sequence
  chemically synthesized
gcaagggctattgaatgggagc

SEQ ID NO: 1388430 - DNA, 22 bp, Artificial Sequence
  chemically synthesized
atgttagatgggctcccattca

SEQ ID NO: 1388431 - DNA, 22 bp, Artificial Sequence
  chemically synthesized
gatgggctcccattcaatagcc

SEQ ID NO: 1388432 - DNA, 22 bp, Artificial Sequence
  chemically synthesized
gtataactggcaagggctattg

SEQ ID NO: 1388433 - DNA, 22 bp, Artificial Sequence
  chemically synthesized
ccattcaatagcccttgccagt

SEQ ID NO: 1388434 - DNA, 22 bp, Artificial Sequence
  chemically synthesized
aatagcccttgccagttatacc

SEQ ID NO: 1388435 - DNA, 22 bp, Artificial Sequence
  chemically synthesized
agacaataccagatgagcctgg

SEQ ID NO: 1388436 - DNA, 22 bp, Artificial Sequence
  chemically synthesized
gccagttataccaggctcatct

SEQ ID NO: 1388437 - DNA, 22 bp, Artificial Sequence
  chemically synthesized
tcagacaataccagatgagcct

SEQ ID NO: 1388438 - DNA, 22 bp, Artificial Sequence
  chemically synthesized
ccagttataccaggctcatctg

SEQ ID NO: 1388439 - DNA, 22 bp, Artificial Sequence
  chemically synthesized
taccaggctcatctggtattgt

SEQ ID NO: 1388440 - DNA, 22 bp, Artificial Sequence
  chemically synthesized
aataggagtctctcagacaata

SEQ ID NO: 1388441 - DNA, 22 bp, Artificial Sequence
  chemically synthesized
aattgaataggagtctctcaga

SEQ ID NO: 1388442 - DNA, 22 bp, Artificial Sequence
  chemically synthesized
atctggtattgtctgagagact

SEQ ID NO: 1388443 - DNA, 22 bp, Artificial Sequence
  chemically synthesized
tgaattgaataggagtctctca

SEQ ID NO: 1388444 - DNA, 22 bp, Artificial Sequence
  chemically synthesized
tctgaattgaataggagtctct

SEQ ID NO: 1388445 - DNA, 22 bp, Artificial Sequence
  chemically synthesized
gtattgtctgagagactcctat

SEQ ID NO: 1388446 - DNA, 22 bp, Artificial Sequence
  chemically synthesized
ctctctgaattgaataggagtc

SEQ ID NO: 1388447 - DNA, 22 bp, Artificial Sequence
  chemically synthesized
cctctctgaattgaataggagt

SEQ ID NO: 1388448 - DNA, 22 bp, Artificial Sequence
  chemically synthesized
tctgagagactcctattcaatt

SEQ ID NO: 1388449 - DNA, 22 bp, Artificial Sequence
  chemically synthesized
gtttcctctctgaattgaatag

SEQ ID NO: 1388450 - DNA, 22 bp, Artificial Sequence
  chemically synthesized
agagactcctattcaattcaga

SEQ ID NO: 1388451 - DNA, 22 bp, Artificial Sequence
  chemically synthesized
ctattcaattcagagaggaaac

SEQ ID NO: 1388452 - DNA, 22 bp, Artificial Sequence
  chemically synthesized
ttcaattcagagaggaaactag

SEQ ID NO: 1388453 - DNA, 22 bp, Artificial Sequence
  chemically synthesized
aattcagagaggaaactagctg

SEQ ID NO: 1388454 - DNA, 22 bp, Artificial Sequence
  chemically synthesized
gtagcagaaggcagcccagcta

SEQ ID NO: 1388455 - DNA, 22 bp, Artificial Sequence
  chemically synthesized
agagaggaaactagctgggctg

SEQ ID NO: 1388456 - DNA, 22 bp, Artificial Sequence
  chemically synthesized
aagcctagtagcagaaggcagc

SEQ ID NO: 1388457 - DNA, 22 bp, Artificial Sequence
  chemically synthesized
caagcctagtagcagaaggcag

SEQ ID NO: 1388458 - DNA, 22 bp, Artificial Sequence
  chemically synthesized
tcaagcctagtagcagaaggca

SEQ ID NO: 1388459 - DNA, 22 bp, Artificial Sequence
  chemically synthesized
gctgggctgccttctgctacta

SEQ ID NO: 1388460 - DNA, 22 bp, Artificial Sequence
  chemically synthesized
caactttcaagcctagtagcag

SEQ ID NO: 1388461 - DNA, 22 bp, Artificial Sequence
  chemically synthesized
ccaactttcaagcctagtagca

SEQ ID NO: 1388462 - DNA, 22 bp, Artificial Sequence
  chemically synthesized
tccaactttcaagcctagtagc

SEQ ID NO: 1388463 - DNA, 22 bp, Artificial Sequence
  chemically synthesized
ggctgccttctgctactaggct

SEQ ID NO: 1388464 - DNA, 22 bp, Artificial Sequence
  chemically synthesized
ccttctgctactaggcttgaaa

SEQ ID NO: 1388465 - DNA, 22 bp, Artificial Sequence
  chemically synthesized
tcattttccaactttcaagcct

SEQ ID NO: 1388466 - DNA, 22 bp, Artificial Sequence
  chemically synthesized
ctgctactaggcttgaaagttg

SEQ ID NO: 1388467 - DNA, 22 bp, Artificial Sequence
  chemically synthesized
tgctactaggcttgaaagttgg

SEQ ID NO: 1388468 - DNA, 22 bp, Artificial Sequence
  chemically synthesized
ctactaggcttgaaagttggaa

SEQ ID NO: 1388469 - DNA, 22 bp, Artificial Sequence
  chemically synthesized
ctaggcttgaaagttggaaaat

SEQ ID NO: 1388470 - DNA, 22 bp, Artificial Sequence
  chemically synthesized
ggcttgaaagttggaaaatgac

SEQ ID NO: 1388471 - DNA, 22 bp, Artificial Sequence
  chemically synthesized
gaaagttggaaaatgacaggtg

SEQ ID NO: 1388472 - DNA, 22 bp, Artificial Sequence
  chemically synthesized
aaagttggaaaatgacaggtgg

SEQ ID NO: 1388473 - DNA, 22 bp, Artificial Sequence
  chemically synthesized
gaaaatgacaggtgggggtccc

SEQ ID NO: 1388474 - DNA, 22 bp, Artificial Sequence
  chemically synthesized
tccaacagaagatggggacccc

SEQ ID NO: 1388475 - DNA, 22 bp, Artificial Sequence
  chemically synthesized
atatgtgcccctatccaacaga

SEQ ID NO: 1388476 - DNA, 22 bp, Artificial Sequence
  chemically synthesized
tcatatgtgcccctatccaaca

SEQ ID NO: 1388477 - DNA, 22 bp, Artificial Sequence
  chemically synthesized
cagcacattctcatatgtgccc

SEQ ID NO: 1388478 - DNA, 22 bp, Artificial Sequence
  chemically synthesized
ctgttggataggggcacatatg

SEQ ID NO: 1388479 - DNA, 22 bp, Artificial Sequence
  chemically synthesized
tgttggataggggcacatatga

SEQ ID NO: 1388480 - DNA, 22 bp, Artificial Sequence
  chemically synthesized
ttggataggggcacatatgaga

SEQ ID NO: 1388481 - DNA, 22 bp, Artificial Sequence
  chemically synthesized
gataggggcacatatgagaatg

SEQ ID NO: 1388482 - DNA, 22 bp, Artificial Sequence
  chemically synthesized
gaggaaaataaactgcagcaca

SEQ ID NO: 1388483 - DNA, 22 bp, Artificial Sequence
  chemically synthesized
gcgctagaggaaaataaactgc

SEQ ID NO: 1388484 - DNA, 22 bp, Artificial Sequence
  chemically synthesized
agagcctcgcgctagaggaaaa

SEQ ID NO: 1388485 - DNA, 22 bp, Artificial Sequence
  chemically synthesized
gagagcctcgcgctagaggaaa

SEQ ID NO: 1388486 - DNA, 22 bp, Artificial Sequence
  chemically synthesized
tgagagcctcgcgctagaggaa

SEQ ID NO: 1388487 - DNA, 22 bp, Artificial Sequence
  chemically synthesized
cagtttattttcctctagcgcg

SEQ ID NO: 1388488 - DNA, 22 bp, Artificial Sequence
  chemically synthesized
ctttgagagcctcgcgctagag

SEQ ID NO: 1388489 - DNA, 22 bp, Artificial Sequence
  chemically synthesized
attttcctctagcgcgaggctc

SEQ ID NO: 1388490 - DNA, 22 bp, Artificial Sequence
  chemically synthesized
ttttcctctagcgcgaggctct

SEQ ID NO: 1388491 - DNA, 22 bp, Artificial Sequence
  chemically synthesized
tcctctagcgcgaggctctcaa

SEQ ID NO: 1388492 - DNA, 22 bp, Artificial Sequence
  chemically synthesized
cctctagcgcgaggctctcaaa

SEQ ID NO: 1388493 - DNA, 22 bp, Artificial Sequence
  chemically synthesized
ctctagcgcgaggctctcaaag

SEQ ID NO: 1388494 - DNA, 22 bp, Artificial Sequence
  chemically synthesized
tagcgcgaggctctcaaagcag

SEQ ID NO: 1388495 - DNA, 22 bp, Artificial Sequence
  chemically synthesized
gcgcgaggctctcaaagcagtt

SEQ ID NO: 1388496 - DNA, 22 bp, Artificial Sequence
  chemically synthesized
tcaaagcagtttgcttttctct

SEQ ID NO: 1388497 - DNA, 22 bp, Artificial Sequence
  chemically synthesized
taaaggatagtcagagaaaagc

SEQ ID NO: 1388498 - DNA, 22 bp, Artificial Sequence
  chemically synthesized
aaagcagtttgcttttctctga

SEQ ID NO: 1388499 - DNA, 22 bp, Artificial Sequence
  chemically synthesized
gcttttctctgactatccttta

SEQ ID NO: 1388500 - DNA, 22 bp, Artificial Sequence
  chemically synthesized
cttttctctgactatcctttac

SEQ ID NO: 1388501 - DNA, 22 bp, Artificial Sequence
  chemically synthesized
ttctctgactatcctttacaat

SEQ ID NO: 1388502 - DNA, 22 bp, Artificial Sequence
  chemically synthesized
tctctgactatcctttacaatt

SEQ ID NO: 1388503 - DNA, 22 bp, Artificial Sequence
  chemically synthesized
ctctgactatcctttacaattt

SEQ ID NO: 1388504 - DNA, 22 bp, Artificial Sequence
  chemically synthesized
tctgactatcctttacaatttt

SEQ ID NO: 1388505 - DNA, 22 bp, Artificial Sequence
  chemically synthesized
tgactatcctttacaattttct

SEQ ID NO: 1388506 - DNA, 22 bp, Artificial Sequence
  chemically synthesized
actatcctttacaattttcttt

SEQ ID NO: 1388507 - DNA, 22 bp, Artificial Sequence
  chemically synthesized
tcctttacaattttcttttgat

SEQ ID NO: 1388508 - DNA, 22 bp, Artificial Sequence
  chemically synthesized
tacaattttcttttgatggcct

SEQ ID NO: 1388509 - DNA, 22 bp, Artificial Sequence
  chemically synthesized
acaattttcttttgatggcctc

SEQ ID NO: 1388510 - DNA, 22 bp, Artificial Sequence
  chemically synthesized
gaaacaaaacaagaggccatca

SEQ ID NO: 1388511 - DNA, 22 bp, Artificial Sequence
  chemically synthesized
caattttcttttgatggcctct

SEQ ID NO: 1388512 - DNA, 22 bp, Artificial Sequence
  chemically synthesized
tcttttgatggcctcttgtttt

SEQ ID NO: 1388513 - DNA, 22 bp, Artificial Sequence
  chemically synthesized
cttttgatggcctcttgttttg

SEQ ID NO: 1388514 - DNA, 22 bp, Artificial Sequence
  chemically synthesized
ttttgatggcctcttgttttgt

SEQ ID NO: 1388515 - DNA, 22 bp, Artificial Sequence
  chemically synthesized
ttgatggcctcttgttttgttt

SEQ ID NO: 1388516 - DNA, 22 bp, Artificial Sequence
  chemically synthesized
tgatggcctcttgttttgtttc

SEQ ID NO: 1388517 - DNA, 22 bp, Artificial Sequence
  chemically synthesized
gatggcctcttgttttgtttct

SEQ ID NO: 1388518 - DNA, 22 bp, Artificial Sequence
  chemically synthesized
atggcctcttgttttgtttcta

SEQ ID NO: 1388519 - DNA, 22 bp, Artificial Sequence
  chemically synthesized
ttgttttgtttctaggttttat

SEQ ID NO: 1388520 - DNA, 22 bp, Artificial Sequence
  chemically synthesized
gttttgtttctaggttttattg

SEQ ID NO: 1388521 - DNA, 22 bp, Artificial Sequence
  chemically synthesized
ttttgtttctaggttttattgt

SEQ ID NO: 1388522 - DNA, 22 bp, Artificial Sequence
  chemically synthesized
atagtgaagaagaacaataaaa

SEQ ID NO: 1388523 - DNA, 22 bp, Artificial Sequence
  chemically synthesized
tgtttctaggttttattgttct

SEQ ID NO: 1388524 - DNA, 22 bp, Artificial Sequence
  chemically synthesized
gtttctaggttttattgttctt

SEQ ID NO: 1388525 - DNA, 22 bp, Artificial Sequence
  chemically synthesized
ctcatagtgaagaagaacaata

SEQ ID NO: 1388526 - DNA, 22 bp, Artificial Sequence
  chemically synthesized
tttctaggttttattgttcttc

SEQ ID NO: 1388527 - DNA, 22 bp, Artificial Sequence
  chemically synthesized
ctcctcatagtgaagaagaaca

SEQ ID NO: 1388528 - DNA, 22 bp, Artificial Sequence
  chemically synthesized
ctaggttttattgttcttcttc

SEQ ID NO: 1388529 - DNA, 22 bp, Artificial Sequence
  chemically synthesized
taggttttattgttcttcttca

SEQ ID NO: 1388530 - DNA, 22 bp, Artificial Sequence
  chemically synthesized
ggttttattgttcttcttcact

SEQ ID NO: 1388531 - DNA, 22 bp, Artificial Sequence
  chemically synthesized
cctgctcctcatagtgaagaag

SEQ ID NO: 1388532 - DNA, 22 bp, Artificial Sequence
  chemically synthesized
ccctgctcctcatagtgaagaa

SEQ ID NO: 1388533 - DNA, 22 bp, Artificial Sequence
  chemically synthesized
tccctgctcctcatagtgaaga

SEQ ID NO: 1388534 - DNA, 22 bp, Artificial Sequence
  chemically synthesized
ttccctgctcctcatagtgaag

SEQ ID NO: 1388535 - DNA, 22 bp, Artificial Sequence
  chemically synthesized
tattgttcttcttcactatgag

SEQ ID NO: 1388536 - DNA, 22 bp, Artificial Sequence
  chemically synthesized
attgttcttcttcactatgagg

SEQ ID NO: 1388537 - DNA, 22 bp, Artificial Sequence
  chemically synthesized
ttgttcttcttcactatgagga

SEQ ID NO: 1388538 - DNA, 22 bp, Artificial Sequence
  chemically synthesized
atttttccctgctcctcatagt

SEQ ID NO: 1388539 - DNA, 22 bp, Artificial Sequence
  chemically synthesized
ttcttcttcactatgaggagca

SEQ ID NO: 1388540 - DNA, 22 bp, Artificial Sequence
  chemically synthesized
ttcttcactatgaggagcaggg

SEQ ID NO: 1388541 - DNA, 22 bp, Artificial Sequence
  chemically synthesized
cttcactatgaggagcagggaa

SEQ ID NO: 1388542 - DNA, 22 bp, Artificial Sequence
  chemically synthesized
ttcactatgaggagcagggaaa

SEQ ID NO: 1388543 - DNA, 22 bp, Artificial Sequence
  chemically synthesized
cactatgaggagcagggaaaaa

SEQ ID NO: 1388544 - DNA, 22 bp, Artificial Sequence
  chemically synthesized
actatgaggagcagggaaaaat

SEQ ID NO: 1388545 - DNA, 22 bp, Artificial Sequence
  chemically synthesized
tgaggagcagggaaaaatcagt

SEQ ID NO: 1388546 - DNA, 22 bp, Artificial Sequence
  chemically synthesized
ggacaagatggcataaactgat

SEQ ID NO: 1388547 - DNA, 22 bp, Artificial Sequence
  chemically synthesized
cggacaagatggcataaactga

SEQ ID NO: 1388548 - DNA, 22 bp, Artificial Sequence
  chemically synthesized
catttcggacaagatggcataa

SEQ ID NO: 1388549 - DNA, 22 bp, Artificial Sequence
  chemically synthesized
agaattccatttcggacaagat

SEQ ID NO: 1388550 - DNA, 22 bp, Artificial Sequence
  chemically synthesized
atgccatcttgtccgaaatgga

SEQ ID NO: 1388551 - DNA, 22 bp, Artificial Sequence
  chemically synthesized
tgccatcttgtccgaaatggaa

SEQ ID NO: 1388552 - DNA, 22 bp, Artificial Sequence
  chemically synthesized
aaacaagactgagaattccatt

SEQ ID NO: 1388553 - DNA, 22 bp, Artificial Sequence
  chemically synthesized
gtccgaaatggaattctcagtc

SEQ ID NO: 1388554 - DNA, 22 bp, Artificial Sequence
  chemically synthesized
tccgaaatggaattctcagtct

SEQ ID NO: 1388555 - DNA, 22 bp, Artificial Sequence
  chemically synthesized
aaacatattaaaacaagactga

SEQ ID NO: 1388556 - DNA, 22 bp, Artificial Sequence
  chemically synthesized
tcagtcttgttttaatatgttt

SEQ ID NO: 1388557 - DNA, 22 bp, Artificial Sequence
  chemically synthesized
aatcacgtgttaaaacatatta

SEQ ID NO: 1388558 - DNA, 22 bp, Artificial Sequence
  chemically synthesized
agtcttgttttaatatgtttta

SEQ ID NO: 1388559 - DNA, 22 bp, Artificial Sequence
  chemically synthesized
tctgaatcacgtgttaaaacat

SEQ ID NO: 1388560 - DNA, 22 bp, Artificial Sequence
  chemically synthesized
gttttaatatgttttaacacgt

SEQ ID NO: 1388561 - DNA, 22 bp, Artificial Sequence
  chemically synthesized
ttttaatatgttttaacacgtg

SEQ ID NO: 1388562 - DNA, 22 bp, Artificial Sequence
  chemically synthesized
taatatgttttaacacgtgatt

SEQ ID NO: 1388563 - DNA, 22 bp, Artificial Sequence
  chemically synthesized
aatatgttttaacacgtgattc

SEQ ID NO: 1388564 - DNA, 22 bp, Artificial Sequence
  chemically synthesized
atatgttttaacacgtgattca

SEQ ID NO: 1388565 - DNA, 22 bp, Artificial Sequence
  chemically synthesized
aaaaccaagttatctgaatcac

SEQ ID NO: 1388566 - DNA, 22 bp, Artificial Sequence
  chemically synthesized
aaaaaccaagttatctgaatca

SEQ ID NO: 1388567 - DNA, 22 bp, Artificial Sequence
  chemically synthesized
taaaaaccaagttatctgaatc

SEQ ID NO: 1388568 - DNA, 22 bp, Artificial Sequence
  chemically synthesized
taacacgtgattcagataactt

SEQ ID NO: 1388569 - DNA, 22 bp, Artificial Sequence
  chemically synthesized
aacacgtgattcagataacttg

SEQ ID NO: 1388570 - DNA, 22 bp, Artificial Sequence
  chemically synthesized
acacgtgattcagataacttgg

SEQ ID NO: 1388571 - DNA, 22 bp, Artificial Sequence
  chemically synthesized
tgcacattttaaaaaccaagtt

SEQ ID NO: 1388572 - DNA, 22 bp, Artificial Sequence
  chemically synthesized
aaagttgtgcacattttaaaaa

SEQ ID NO: 1388573 - DNA, 22 bp, Artificial Sequence
  chemically synthesized
agataacttggtttttaaaatg

SEQ ID NO: 1388574 - DNA, 22 bp, Artificial Sequence
  chemically synthesized
aaaagttgtgcacattttaaaa

SEQ ID NO: 1388575 - DNA, 22 bp, Artificial Sequence
  chemically synthesized
taaaagttgtgcacattttaaa

SEQ ID NO: 1388576 - DNA, 22 bp, Artificial Sequence
  chemically synthesized
ttaaaagttgtgcacattttaa

SEQ ID NO: 1388577 - DNA, 22 bp, Artificial Sequence
  chemically synthesized
tttaaaagttgtgcacatttta

SEQ ID NO: 1388578 - DNA, 22 bp, Artificial Sequence
  chemically synthesized
tttttaaaagttgtgcacattt

SEQ ID NO: 1388579 - DNA, 22 bp, Artificial Sequence
  chemically synthesized
ctttttaaaagttgtgcacatt

SEQ ID NO: 1388580 - DNA, 22 bp, Artificial Sequence
  chemically synthesized
ggtttttaaaatgtgcacaact

SEQ ID NO: 1388581 - DNA, 22 bp, Artificial Sequence
  chemically synthesized
gtttttaaaatgtgcacaactt

SEQ ID NO: 1388582 - DNA, 22 bp, Artificial Sequence
  chemically synthesized
ttaaaatgtgcacaacttttaa

SEQ ID NO: 1388583 - DNA, 22 bp, Artificial Sequence
  chemically synthesized
gaacatttctttttaaaagttg

SEQ ID NO: 1388584 - DNA, 22 bp, Artificial Sequence
  chemically synthesized
taaaatgtgcacaacttttaaa

SEQ ID NO: 1388585 - DNA, 22 bp, Artificial Sequence
  chemically synthesized
ggaacatttctttttaaaagtt

SEQ ID NO: 1388586 - DNA, 22 bp, Artificial Sequence
  chemically synthesized
aaaatgtgcacaacttttaaaa

SEQ ID NO: 1388587 - DNA, 22 bp, Artificial Sequence
  chemically synthesized
tggaacatttctttttaaaagt

SEQ ID NO: 1388588 - DNA, 22 bp, Artificial Sequence
  chemically synthesized
aaatgtgcacaacttttaaaaa

SEQ ID NO: 1388589 - DNA, 22 bp, Artificial Sequence
  chemically synthesized
ttggaacatttctttttaaaag

SEQ ID NO: 1388590 - DNA, 22 bp, Artificial Sequence
  chemically synthesized
gcttttggaacatttcttttta

SEQ ID NO: 1388591 - DNA, 22 bp, Artificial Sequence
  chemically synthesized
agcttttggaacatttcttttt

SEQ ID NO: 1388592 - DNA, 22 bp, Artificial Sequence
  chemically synthesized
ttaaaaagaaatgttccaaaag

SEQ ID NO: 1388593 - DNA, 22 bp, Artificial Sequence
  chemically synthesized
taaaaagaaatgttccaaaagc

SEQ ID NO: 1388594 - DNA, 22 bp, Artificial Sequence
  chemically synthesized
aatgtatatttagcttttggaa

SEQ ID NO: 1388595 - DNA, 22 bp, Artificial Sequence
  chemically synthesized
aaaaagaaatgttccaaaagct

SEQ ID NO: 1388596 - DNA, 22 bp, Artificial Sequence
  chemically synthesized
aaaagaaatgttccaaaagcta

SEQ ID NO: 1388597 - DNA, 22 bp, Artificial Sequence
  chemically synthesized
caaaagctaaatatacatttaa

SEQ ID NO: 1388598 - DNA, 22 bp, Artificial Sequence
  chemically synthesized
cacgcagcatggtacaattaaa

SEQ ID NO: 1388599 - DNA, 22 bp, Artificial Sequence
  chemically synthesized
tacacgcagcatggtacaatta

SEQ ID NO: 1388600 - DNA, 22 bp, Artificial Sequence
  chemically synthesized
aatatacatttaattgtaccat

SEQ ID NO: 1388601 - DNA, 22 bp, Artificial Sequence
  chemically synthesized
ctctacacgcagcatggtacaa

SEQ ID NO: 1388602 - DNA, 22 bp, Artificial Sequence
  chemically synthesized
ccagctactctacacgcagcat

SEQ ID NO: 1388603 - DNA, 22 bp, Artificial Sequence
  chemically synthesized
aattgtaccatgctgcgtgtag

SEQ ID NO: 1388604 - DNA, 22 bp, Artificial Sequence
  chemically synthesized
attgtaccatgctgcgtgtaga

SEQ ID NO: 1388605 - DNA, 22 bp, Artificial Sequence
  chemically synthesized
taccatgctgcgtgtagagtag

SEQ ID NO: 1388606 - DNA, 22 bp, Artificial Sequence
  chemically synthesized
agtagttaccagctactctaca

SEQ ID NO: 1388607 - DNA, 22 bp, Artificial Sequence
  chemically synthesized
cagtagttaccagctactctac

SEQ ID NO: 1388608 - DNA, 22 bp, Artificial Sequence
  chemically synthesized
tgatttcagtagttaccagcta

SEQ ID NO: 1388609 - DNA, 22 bp, Artificial Sequence
  chemically synthesized
atgatttcagtagttaccagct

SEQ ID NO: 1388610 - DNA, 22 bp, Artificial Sequence
  chemically synthesized
cgtgtagagtagctggtaacta

SEQ ID NO: 1388611 - DNA, 22 bp, Artificial Sequence
  chemically synthesized
acatgtacttatgatttcagta

SEQ ID NO: 1388612 - DNA, 22 bp, Artificial Sequence
  chemically synthesized
gtaactactgaaatcataagta

SEQ ID NO: 1388613 - DNA, 22 bp, Artificial Sequence
  chemically synthesized
aaaggctgacatgtacttatga

SEQ ID NO: 1388614 - DNA, 22 bp, Artificial Sequence
  chemically synthesized
caaaggctgacatgtacttatg

SEQ ID NO: 1388615 - DNA, 22 bp, Artificial Sequence
  chemically synthesized
atttcaaaggctgacatgtact

SEQ ID NO: 1388616 - DNA, 22 bp, Artificial Sequence
  chemically synthesized
ctgaaatcataagtacatgtca

SEQ ID NO: 1388617 - DNA, 22 bp, Artificial Sequence
  chemically synthesized
ttaatttcaaaggctgacatgt

SEQ ID NO: 1388618 - DNA, 22 bp, Artificial Sequence
  chemically synthesized
aaatcataagtacatgtcagcc

SEQ ID NO: 1388619 - DNA, 22 bp, Artificial Sequence
  chemically synthesized
ttattaatttcaaaggctgaca

SEQ ID NO: 1388620 - DNA, 22 bp, Artificial Sequence
  chemically synthesized
gttattaatttcaaaggctgac

SEQ ID NO: 1388621 - DNA, 22 bp, Artificial Sequence
  chemically synthesized
tttgttattaatttcaaaggct

SEQ ID NO: 1388622 - DNA, 22 bp, Artificial Sequence
  chemically synthesized
atttgttattaatttcaaaggc

SEQ ID NO: 1388623 - DNA, 22 bp, Artificial Sequence
  chemically synthesized
tatttgttattaatttcaaagg

SEQ ID NO: 1388624 - DNA, 22 bp, Artificial Sequence
  chemically synthesized
atgttttatttgttattaattt

SEQ ID NO: 1388625 - DNA, 22 bp, Artificial Sequence
  chemically synthesized
accaagttgatgttttatttgt

SEQ ID NO: 1388626 - DNA, 22 bp, Artificial Sequence
  chemically synthesized
tgaaattaataacaaataaaac

SEQ ID NO: 1388627 - DNA, 22 bp, Artificial Sequence
  chemically synthesized
gaccaagttgatgttttatttg

SEQ ID NO: 1388628 - DNA, 22 bp, Artificial Sequence
  chemically synthesized
gaaattaataacaaataaaaca

SEQ ID NO: 1388629 - DNA, 22 bp, Artificial Sequence
  chemically synthesized
aaattaataacaaataaaacat

SEQ ID NO: 1388630 - DNA, 22 bp, Artificial Sequence
  chemically synthesized
ataacaaataaaacatcaactt

SEQ ID NO: 1388631 - DNA, 22 bp, Artificial Sequence
  chemically synthesized
caggcgtgagccaccgcatttg

SEQ ID NO: 1388632 - DNA, 22 bp, Artificial Sequence
  chemically synthesized
ggattacaggcgtgagccaccg

SEQ ID NO: 1388633 - DNA, 22 bp, Artificial Sequence
  chemically synthesized
ggtcaaatgcggtggctcacgc

SEQ ID NO: 1388634 - DNA, 22 bp, Artificial Sequence
  chemically synthesized
gtcaaatgcggtggctcacgcc

SEQ ID NO: 1388635 - DNA, 22 bp, Artificial Sequence
  chemically synthesized
ccaaagtgctgggattacaggc

SEQ ID NO: 1388636 - DNA, 22 bp, Artificial Sequence
  chemically synthesized
gcctcccaaagtgctgggatta

SEQ ID NO: 1388637 - DNA, 22 bp, Artificial Sequence
  chemically synthesized
acgcctgtaatcccagcacttt

SEQ ID NO: 1388638 - DNA, 22 bp, Artificial Sequence
  chemically synthesized
taatcccagcactttgggaggc

SEQ ID NO: 1388639 - DNA, 22 bp, Artificial Sequence
  chemically synthesized
aggtgatccacccacgttggcc

SEQ ID NO: 1388640 - DNA, 22 bp, Artificial Sequence
  chemically synthesized
acctcaggtgatccacccacgt

SEQ ID NO: 1388641 - DNA, 22 bp, Artificial Sequence
  chemically synthesized
tgggaggccaacgtgggtggat

SEQ ID NO: 1388642 - DNA, 22 bp, Artificial Sequence
  chemically synthesized
gggaggccaacgtgggtggatc

SEQ ID NO: 1388643 - DNA, 22 bp, Artificial Sequence
  chemically synthesized
ctgacctcaggtgatccaccca

SEQ ID NO: 1388644 - DNA, 22 bp, Artificial Sequence
  chemically synthesized
ggaggccaacgtgggtggatca

SEQ ID NO: 1388645 - DNA, 22 bp, Artificial Sequence
  chemically synthesized
aaactcctgacctcaggtgatc

SEQ ID NO: 1388646 - DNA, 22 bp, Artificial Sequence
  chemically synthesized
gtctcaaactcctgacctcagg

SEQ ID NO: 1388647 - DNA, 22 bp, Artificial Sequence
  chemically synthesized
gtcaggctggtctcaaactcct

SEQ ID NO: 1388648 - DNA, 22 bp, Artificial Sequence
  chemically synthesized
aggtcaggagtttgagaccagc

SEQ ID NO: 1388649 - DNA, 22 bp, Artificial Sequence
  chemically synthesized
accatgttggtcaggctggtct

SEQ ID NO: 1388650 - DNA, 22 bp, Artificial Sequence
  chemically synthesized
caccatgttggtcaggctggtc

SEQ ID NO: 1388651 - DNA, 22 bp, Artificial Sequence
  chemically synthesized
gagaccagcctgaccaacatgg

SEQ ID NO: 1388652 - DNA, 22 bp, Artificial Sequence
  chemically synthesized
agaccagcctgaccaacatggt

SEQ ID NO: 1388653 - DNA, 22 bp, Artificial Sequence
  chemically synthesized
gtagagacggggtttcaccatg

SEQ ID NO: 1388654 - DNA, 22 bp, Artificial Sequence
  chemically synthesized
agtagagacggggtttcaccat

SEQ ID NO: 1388655 - DNA, 22 bp, Artificial Sequence
  chemically synthesized
tagtagagacggggtttcacca

SEQ ID NO: 1388656 - DNA, 22 bp, Artificial Sequence
  chemically synthesized
ttagtagagacggggtttcacc

SEQ ID NO: 1388657 - DNA, 22 bp, Artificial Sequence
  chemically synthesized
accaacatggtgaaaccccgtc

SEQ ID NO: 1388658 - DNA, 22 bp, Artificial Sequence
  chemically synthesized
tatttttagtagagacggggtt

SEQ ID NO: 1388659 - DNA, 22 bp, Artificial Sequence
  chemically synthesized
gtatttttagtagagacggggt

SEQ ID NO: 1388660 - DNA, 22 bp, Artificial Sequence
  chemically synthesized
tgtatttttagtagagacgggg

SEQ ID NO: 1388661 - DNA, 22 bp, Artificial Sequence
  chemically synthesized
ttgtatttttagtagagacggg

SEQ ID NO: 1388662 - DNA, 22 bp, Artificial Sequence
  chemically synthesized
tttgtatttttagtagagacgg

SEQ ID NO: 1388663 - DNA, 22 bp, Artificial Sequence
  chemically synthesized
attttttgtatttttagtagag

SEQ ID NO: 1388664 - DNA, 22 bp, Artificial Sequence
  chemically synthesized
ggctaattttttgtatttttag

SEQ ID NO: 1388665 - DNA, 22 bp, Artificial Sequence
  chemically synthesized
tactaaaaatacaaaaaattag

SEQ ID NO: 1388666 - DNA, 22 bp, Artificial Sequence
  chemically synthesized
ctaaaaatacaaaaaattagcc

SEQ ID NO: 1388667 - DNA, 22 bp, Artificial Sequence
  chemically synthesized
aaaatacaaaaaattagccgag

SEQ ID NO: 1388668 - DNA, 22 bp, Artificial Sequence
  chemically synthesized
ccgagtgcccaccaccacgctc

SEQ ID NO: 1388669 - DNA, 22 bp, Artificial Sequence
  chemically synthesized
agcctcccgagtgcccaccacc

SEQ ID NO: 1388670 - DNA, 22 bp, Artificial Sequence
  chemically synthesized
gccgagcgtggtggtgggcact

SEQ ID NO: 1388671 - DNA, 22 bp, Artificial Sequence
  chemically synthesized
cctcagcctcccgagtgcccac

SEQ ID NO: 1388672 - DNA, 22 bp, Artificial Sequence
  chemically synthesized
ctgcctcagcctcccgagtgcc

SEQ ID NO: 1388673 - DNA, 22 bp, Artificial Sequence
  chemically synthesized
tcctgcctcagcctcccgagtg

SEQ ID NO: 1388674 - DNA, 22 bp, Artificial Sequence
  chemically synthesized
aagcaattctcctgcctcagcc

SEQ ID NO: 1388675 - DNA, 22 bp, Artificial Sequence
  chemically synthesized
ggttcaagcaattctcctgcct

SEQ ID NO: 1388676 - DNA, 22 bp, Artificial Sequence
  chemically synthesized
gggaggctgaggcaggagaatt

SEQ ID NO: 1388677 - DNA, 22 bp, Artificial Sequence
  chemically synthesized
ctgggttcaagcaattctcctg

SEQ ID NO: 1388678 - DNA, 22 bp, Artificial Sequence
  chemically synthesized
cacctcctgggttcaagcaatt

SEQ ID NO: 1388679 - DNA, 22 bp, Artificial Sequence
  chemically synthesized
aggcaggagaattgcttgaacc

SEQ ID NO: 1388680 - DNA, 22 bp, Artificial Sequence
  chemically synthesized
caacctccacctcctgggttca

SEQ ID NO: 1388681 - DNA, 22 bp, Artificial Sequence
  chemically synthesized
actgcaacctccacctcctggg

SEQ ID NO: 1388682 - DNA, 22 bp, Artificial Sequence
  chemically synthesized
agctcactgcaacctccacctc

SEQ ID NO: 1388683 - DNA, 22 bp, Artificial Sequence
  chemically synthesized
cttgaacccaggaggtggaggt

SEQ ID NO: 1388684 - DNA, 22 bp, Artificial Sequence
  chemically synthesized
gaacccaggaggtggaggttgc

SEQ ID NO: 1388685 - DNA, 22 bp, Artificial Sequence
  chemically synthesized
aacccaggaggtggaggttgca

SEQ ID NO: 1388686 - DNA, 22 bp, Artificial Sequence
  chemically synthesized
gagtacaatggtgcgatctcag

SEQ ID NO: 1388687 - DNA, 22 bp, Artificial Sequence
  chemically synthesized
cagtgagctgagatcgcaccat

SEQ ID NO: 1388688 - DNA, 22 bp, Artificial Sequence
  chemically synthesized
tcacccaggctggagtacaatg

SEQ ID NO: 1388689 - DNA, 22 bp, Artificial Sequence
  chemically synthesized
gtcacccaggctggagtacaat

SEQ ID NO: 1388690 - DNA, 22 bp, Artificial Sequence
  chemically synthesized
tgtcacccaggctggagtacaa

SEQ ID NO: 1388691 - DNA, 22 bp, Artificial Sequence
  chemically synthesized
agatcgcaccattgtactccag

SEQ ID NO: 1388692 - DNA, 22 bp, Artificial Sequence
  chemically synthesized
tttgtcacccaggctggagtac

SEQ ID NO: 1388693 - DNA, 22 bp, Artificial Sequence
  chemically synthesized
ctctttgtcacccaggctggag

SEQ ID NO: 1388694 - DNA, 22 bp, Artificial Sequence
  chemically synthesized
gctctttgtcacccaggctgga

SEQ ID NO: 1388695 - DNA, 22 bp, Artificial Sequence
  chemically synthesized
tgctctttgtcacccaggctgg

SEQ ID NO: 1388696 - DNA, 22 bp, Artificial Sequence
  chemically synthesized
tactccagcctgggtgacaaag

SEQ ID NO: 1388697 - DNA, 22 bp, Artificial Sequence
  chemically synthesized
agaccaaattttgctctttgtc

SEQ ID NO: 1388698 - DNA, 22 bp, Artificial Sequence
  chemically synthesized
gagaccaaattttgctctttgt

SEQ ID NO: 1388699 - DNA, 22 bp, Artificial Sequence
  chemically synthesized
cagcctgggtgacaaagagcaa

SEQ ID NO: 1388700 - DNA, 22 bp, Artificial Sequence
  chemically synthesized
tgagaccaaattttgctctttg

SEQ ID NO: 1388701 - DNA, 22 bp, Artificial Sequence
  chemically synthesized
tttgagaccaaattttgctctt

SEQ ID NO: 1388702 - DNA, 22 bp, Artificial Sequence
  chemically synthesized
ctttgagaccaaattttgctct

SEQ ID NO: 1388703 - DNA, 22 bp, Artificial Sequence
  chemically synthesized
tctttgagaccaaattttgctc

SEQ ID NO: 1388704 - DNA, 22 bp, Artificial Sequence
  chemically synthesized
ttctttgagaccaaattttgct

SEQ ID NO: 1388705 - DNA, 22 bp, Artificial Sequence
  chemically synthesized
tttctttgagaccaaattttgc

SEQ ID NO: 1388706 - DNA, 22 bp, Artificial Sequence
  chemically synthesized
ggtgacaaagagcaaaatttgg

SEQ ID NO: 1388707 - DNA, 22 bp, Artificial Sequence
  chemically synthesized
ttttctttgagaccaaattttg

SEQ ID NO: 1388708 - DNA, 22 bp, Artificial Sequence
  chemically synthesized
tttttctttgagaccaaatttt

SEQ ID NO: 1388709 - DNA, 22 bp, Artificial Sequence
  chemically synthesized
ttttttctttgagaccaaattt

SEQ ID NO: 1388710 - DNA, 22 bp, Artificial Sequence
  chemically synthesized
tttttttctttgagaccaaatt

SEQ ID NO: 1388711 - DNA, 22 bp, Artificial Sequence
  chemically synthesized
ttttttttctttgagaccaaat

SEQ ID NO: 1388712 - DNA, 22 bp, Artificial Sequence
  chemically synthesized
tttttttttctttgagaccaaa

SEQ ID NO: 1388713 - DNA, 22 bp, Artificial Sequence
  chemically synthesized
ttttttttttctttgagaccaa

SEQ ID NO: 1388714 - DNA, 22 bp, Artificial Sequence
  chemically synthesized
tttttttttttctttgagacca

SEQ ID NO: 1388715 - DNA, 22 bp, Artificial Sequence
  chemically synthesized
ttttttttttttctttgagacc

SEQ ID NO: 1388716 - DNA, 22 bp, Artificial Sequence
  chemically synthesized
atgtttttttttttttttcttt

SEQ ID NO: 1388717 - DNA, 22 bp, Artificial Sequence
  chemically synthesized
ggtctcaaagaaaaaaaaaaaa

SEQ ID NO: 1388718 - DNA, 22 bp, Artificial Sequence
  chemically synthesized
gtctcaaagaaaaaaaaaaaaa

SEQ ID NO: 1388719 - DNA, 22 bp, Artificial Sequence
  chemically synthesized
gtatagttgatgtttttttttt

SEQ ID NO: 1388720 - DNA, 22 bp, Artificial Sequence
  chemically synthesized
ggtatagttgatgttttttttt

SEQ ID NO: 1388721 - DNA, 22 bp, Artificial Sequence
  chemically synthesized
aaagaaaaaaaaaaaaaaacat

SEQ ID NO: 1388722 - DNA, 22 bp, Artificial Sequence
  chemically synthesized
atcacttggtatagttgatgtt

SEQ ID NO: 1388723 - DNA, 22 bp, Artificial Sequence
  chemically synthesized
ctcatcacttggtatagttgat

SEQ ID NO: 1388724 - DNA, 22 bp, Artificial Sequence
  chemically synthesized
tactcatcacttggtatagttg

SEQ ID NO: 1388725 - DNA, 22 bp, Artificial Sequence
  chemically synthesized
gtacagtcattctactcatcac

SEQ ID NO: 1388726 - DNA, 22 bp, Artificial Sequence
  chemically synthesized
taccaagtgatgagtagaatga

SEQ ID NO: 1388727 - DNA, 22 bp, Artificial Sequence
  chemically synthesized
aatatacaatgaaaacgaacat

SEQ ID NO: 1388728 - DNA, 22 bp, Artificial Sequence
  chemically synthesized
tactaggtatgttcgttttcat

SEQ ID NO: 1388729 - DNA, 22 bp, Artificial Sequence
  chemically synthesized
ggtatgttcgttttcattgtat

SEQ ID NO: 1388730 - DNA, 22 bp, Artificial Sequence
  chemically synthesized
aataaatactaaatatacaatg

SEQ ID NO: 1388731 - DNA, 22 bp, Artificial Sequence
  chemically synthesized
aaataaatactaaatatacaat

SEQ ID NO: 1388732 - DNA, 22 bp, Artificial Sequence
  chemically synthesized
cttaaataaatactaaatatac

SEQ ID NO: 1388733 - DNA, 22 bp, Artificial Sequence
  chemically synthesized
gttttcattgtatatttagtat

SEQ ID NO: 1388734 - DNA, 22 bp, Artificial Sequence
  chemically synthesized
ggttgcttaaataaatactaaa

SEQ ID NO: 1388735 - DNA, 22 bp, Artificial Sequence
  chemically synthesized
tcattgtatatttagtatttat

SEQ ID NO: 1388736 - DNA, 22 bp, Artificial Sequence
  chemically synthesized
cattgtatatttagtatttatt

SEQ ID NO: 1388737 - DNA, 22 bp, Artificial Sequence
  chemically synthesized
attgtatatttagtatttattt

SEQ ID NO: 1388738 - DNA, 22 bp, Artificial Sequence
  chemically synthesized
gttaggttgcttaaataaatac

SEQ ID NO: 1388739 - DNA, 22 bp, Artificial Sequence
  chemically synthesized
agttaggttgcttaaataaata

SEQ ID NO: 1388740 - DNA, 22 bp, Artificial Sequence
  chemically synthesized
tagttaggttgcttaaataaat

SEQ ID NO: 1388741 - DNA, 22 bp, Artificial Sequence
  chemically synthesized
ttagttaggttgcttaaataaa

SEQ ID NO: 1388742 - DNA, 22 bp, Artificial Sequence
  chemically synthesized
tatatttagtatttatttaagc

SEQ ID NO: 1388743 - DNA, 22 bp, Artificial Sequence
  chemically synthesized
tttttagttaggttgcttaaat

SEQ ID NO: 1388744 - DNA, 22 bp, Artificial Sequence
  chemically synthesized
agtatttatttaagcaacctaa

SEQ ID NO: 1388745 - DNA, 22 bp, Artificial Sequence
  chemically synthesized
gtatttatttaagcaacctaac

SEQ ID NO: 1388746 - DNA, 22 bp, Artificial Sequence
  chemically synthesized
tcggcactatttttagttaggt

SEQ ID NO: 1388747 - DNA, 22 bp, Artificial Sequence
  chemically synthesized
atttaagcaacctaactaaaaa

SEQ ID NO: 1388748 - DNA, 22 bp, Artificial Sequence
  chemically synthesized
ttgtcggcactatttttagtta

SEQ ID NO: 1388749 - DNA, 22 bp, Artificial Sequence
  chemically synthesized
tttaagcaacctaactaaaaat

SEQ ID NO: 1388750 - DNA, 22 bp, Artificial Sequence
  chemically synthesized
attgtcggcactatttttagtt

SEQ ID NO: 1388751 - DNA, 22 bp, Artificial Sequence
  chemically synthesized
tattgtcggcactatttttagt

SEQ ID NO: 1388752 - DNA, 22 bp, Artificial Sequence
  chemically synthesized
ttattgtcggcactatttttag

SEQ ID NO: 1388753 - DNA, 22 bp, Artificial Sequence
  chemically synthesized
aagcaacctaactaaaaatagt

SEQ ID NO: 1388754 - DNA, 22 bp, Artificial Sequence
  chemically synthesized
agcaacctaactaaaaatagtg

SEQ ID NO: 1388755 - DNA, 22 bp, Artificial Sequence
  chemically synthesized
agatatttttattgtcggcact

SEQ ID NO: 1388756 - DNA, 22 bp, Artificial Sequence
  chemically synthesized
actaaaaatagtgccgacaata

SEQ ID NO: 1388757 - DNA, 22 bp, Artificial Sequence
  chemically synthesized
aaaatagtgccgacaataaaaa

SEQ ID NO: 1388758 - DNA, 22 bp, Artificial Sequence
  chemically synthesized
taaattgagatatttttattgt

SEQ ID NO: 1388759 - DNA, 22 bp, Artificial Sequence
  chemically synthesized
tgtaaattgagatatttttatt

SEQ ID NO: 1388760 - DNA, 22 bp, Artificial Sequence
  chemically synthesized
ctgtaaattgagatatttttat

SEQ ID NO: 1388761 - DNA, 22 bp, Artificial Sequence
  chemically synthesized
tatatttctgtaaattgagata

SEQ ID NO: 1388762 - DNA, 22 bp, Artificial Sequence
  chemically synthesized
atatatttctgtaaattgagat

SEQ ID NO: 1388763 - DNA, 22 bp, Artificial Sequence
  chemically synthesized
tatatatttctgtaaattgaga

SEQ ID NO: 1388764 - DNA, 22 bp, Artificial Sequence
  chemically synthesized
aagttttatatatttctgtaaa

SEQ ID NO: 1388765 - DNA, 22 bp, Artificial Sequence
  chemically synthesized
catattaaagttttatatattt

SEQ ID NO: 1388766 - DNA, 22 bp, Artificial Sequence
  chemically synthesized
aatttacagaaatatataaaac

SEQ ID NO: 1388767 - DNA, 22 bp, Artificial Sequence
  chemically synthesized
acagaaatatataaaactttaa

SEQ ID NO: 1388768 - DNA, 22 bp, Artificial Sequence
  chemically synthesized
cagaaatatataaaactttaat

SEQ ID NO: 1388769 - DNA, 22 bp, Artificial Sequence
  chemically synthesized
aataataaaatacaatctacat

SEQ ID NO: 1388770 - DNA, 22 bp, Artificial Sequence
  chemically synthesized
taatatgtagattgtattttat

SEQ ID NO: 1388771 - DNA, 22 bp, Artificial Sequence
  chemically synthesized
aatatgtagattgtattttatt

SEQ ID NO: 1388772 - DNA, 22 bp, Artificial Sequence
  chemically synthesized
ataaaattaaataataaaatac

SEQ ID NO: 1388773 - DNA, 22 bp, Artificial Sequence
  chemically synthesized
atatgtagattgtattttatta

SEQ ID NO: 1388774 - DNA, 22 bp, Artificial Sequence
  chemically synthesized
cataaaattaaataataaaata

SEQ ID NO: 1388775 - DNA, 22 bp, Artificial Sequence
  chemically synthesized
tcataaaattaaataataaaat

SEQ ID NO: 1388776 - DNA, 22 bp, Artificial Sequence
  chemically synthesized
tattttattatttaattttatg

SEQ ID NO: 1388777 - DNA, 22 bp, Artificial Sequence
  chemically synthesized
gacagatgttttcataaaatta

SEQ ID NO: 1388778 - DNA, 22 bp, Artificial Sequence
  chemically synthesized
tattatttaattttatgaaaac

SEQ ID NO: 1388779 - DNA, 22 bp, Artificial Sequence
  chemically synthesized
gcctcgacagatgttttcataa

SEQ ID NO: 1388780 - DNA, 22 bp, Artificial Sequence
  chemically synthesized
attatttaattttatgaaaaca

SEQ ID NO: 1388781 - DNA, 22 bp, Artificial Sequence
  chemically synthesized
ttatttaattttatgaaaacat

SEQ ID NO: 1388782 - DNA, 22 bp, Artificial Sequence
  chemically synthesized
tttaattttatgaaaacatctg

SEQ ID NO: 1388783 - DNA, 22 bp, Artificial Sequence
  chemically synthesized
aattttatgaaaacatctgtcg

SEQ ID NO: 1388784 - DNA, 22 bp, Artificial Sequence
  chemically synthesized
attttatgaaaacatctgtcga

SEQ ID NO: 1388785 - DNA, 22 bp, Artificial Sequence
  chemically synthesized
tatgaaaacatctgtcgaggcc

SEQ ID NO: 1388786 - DNA, 22 bp, Artificial Sequence
  chemically synthesized
atgaaaacatctgtcgaggcca

SEQ ID NO: 1388787 - DNA, 22 bp, Artificial Sequence
  chemically synthesized
tgaaaacatctgtcgaggccag

SEQ ID NO: 1388788 - DNA, 22 bp, Artificial Sequence
  chemically synthesized
caggtgtgagccaccgcacctg

SEQ ID NO: 1388789 - DNA, 22 bp, Artificial Sequence
  chemically synthesized
tcgaggccaggtgcggtggctc

SEQ ID NO: 1388790 - DNA, 22 bp, Artificial Sequence
  chemically synthesized
ggattacaggtgtgagccaccg

SEQ ID NO: 1388791 - DNA, 22 bp, Artificial Sequence
  chemically synthesized
ccaaagtactgggattacaggt

SEQ ID NO: 1388792 - DNA, 22 bp, Artificial Sequence
  chemically synthesized
ggcctcccaaagtactgggatt

SEQ ID NO: 1388793 - DNA, 22 bp, Artificial Sequence
  chemically synthesized
acacctgtaatcccagtacttt

SEQ ID NO: 1388794 - DNA, 22 bp, Artificial Sequence
  chemically synthesized
taatcccagtactttgggaggc

SEQ ID NO: 1388795 - DNA, 22 bp, Artificial Sequence
  chemically synthesized
tgatccacccgcctcggcctcc

SEQ ID NO: 1388796 - DNA, 22 bp, Artificial Sequence
  chemically synthesized
gtgatccacccgcctcggcctc

SEQ ID NO: 1388797 - DNA, 22 bp, Artificial Sequence
  chemically synthesized
accttgtgatccacccgcctcg

SEQ ID NO: 1388798 - DNA, 22 bp, Artificial Sequence
  chemically synthesized
ctgaccttgtgatccacccgcc

SEQ ID NO: 1388799 - DNA, 22 bp, Artificial Sequence
  chemically synthesized
tgggaggccgaggcgggtggat

SEQ ID NO: 1388800 - DNA, 22 bp, Artificial Sequence
  chemically synthesized
gggaggccgaggcgggtggatc

SEQ ID NO: 1388801 - DNA, 22 bp, Artificial Sequence
  chemically synthesized
ggaggccgaggcgggtggatca

SEQ ID NO: 1388802 - DNA, 22 bp, Artificial Sequence
  chemically synthesized
aatctcctgaccttgtgatcca

SEQ ID NO: 1388803 - DNA, 22 bp, Artificial Sequence
  chemically synthesized
gccaggatggtctcaatctcct

SEQ ID NO: 1388804 - DNA, 22 bp, Artificial Sequence
  chemically synthesized
accatgttagccaggatggtct

SEQ ID NO: 1388805 - DNA, 22 bp, Artificial Sequence
  chemically synthesized
caccatgttagccaggatggtc

SEQ ID NO: 1388806 - DNA, 22 bp, Artificial Sequence
  chemically synthesized
agaccatcctggctaacatggt

SEQ ID NO: 1388807 - DNA, 22 bp, Artificial Sequence
  chemically synthesized
gtagagatgaggtttcaccatg

SEQ ID NO: 1388808 - DNA, 22 bp, Artificial Sequence
  chemically synthesized
agtagagatgaggtttcaccat

SEQ ID NO: 1388809 - DNA, 22 bp, Artificial Sequence
  chemically synthesized
tagtagagatgaggtttcacca

SEQ ID NO: 1388810 - DNA, 22 bp, Artificial Sequence
  chemically synthesized
ttagtagagatgaggtttcacc

SEQ ID NO: 1388811 - DNA, 22 bp, Artificial Sequence
  chemically synthesized
gctaacatggtgaaacctcatc

SEQ ID NO: 1388812 - DNA, 22 bp, Artificial Sequence
  chemically synthesized
tatttttagtagagatgaggtt

SEQ ID NO: 1388813 - DNA, 22 bp, Artificial Sequence
  chemically synthesized
gtatttttagtagagatgaggt

SEQ ID NO: 1388814 - DNA, 22 bp, Artificial Sequence
  chemically synthesized
tgtatttttagtagagatgagg

SEQ ID NO: 1388815 - DNA, 22 bp, Artificial Sequence
  chemically synthesized
acatggtgaaacctcatctcta

SEQ ID NO: 1388816 - DNA, 22 bp, Artificial Sequence
  chemically synthesized
ttgtatttttagtagagatgag

SEQ ID NO: 1388817 - DNA, 22 bp, Artificial Sequence
  chemically synthesized
tttgtatttttagtagagatga

SEQ ID NO: 1388818 - DNA, 22 bp, Artificial Sequence
  chemically synthesized
attttttgtatttttagtagag

SEQ ID NO: 1388819 - DNA, 22 bp, Artificial Sequence
  chemically synthesized
atctctactaaaaatacaaaaa

SEQ ID NO: 1388820 - DNA, 22 bp, Artificial Sequence
  chemically synthesized
tactaaaaatacaaaaaattag

SEQ ID NO: 1388821 - DNA, 22 bp, Artificial Sequence
  chemically synthesized
ctaaaaatacaaaaaattagct

SEQ ID NO: 1388822 - DNA, 22 bp, Artificial Sequence
  chemically synthesized
aaaatacaaaaaattagctggg

SEQ ID NO: 1388823 - DNA, 22 bp, Artificial Sequence
  chemically synthesized
caggcgcccgccaccatgccca

SEQ ID NO: 1388824 - DNA, 22 bp, Artificial Sequence
  chemically synthesized
ggactacaggcgcccgccacca

SEQ ID NO: 1388825 - DNA, 22 bp, Artificial Sequence
  chemically synthesized
gctgggcatggtggcgggcgcc

SEQ ID NO: 1388826 - DNA, 22 bp, Artificial Sequence
  chemically synthesized
ggcatggtggcgggcgcctgta

SEQ ID NO: 1388827 - DNA, 22 bp, Artificial Sequence
  chemically synthesized
agtagctgggactacaggcgcc

SEQ ID NO: 1388828 - DNA, 22 bp, Artificial Sequence
  chemically synthesized
ctgagtagctgggactacaggc

SEQ ID NO: 1388829 - DNA, 22 bp, Artificial Sequence
  chemically synthesized
agcctcctgagtagctgggact

SEQ ID NO: 1388830 - DNA, 22 bp, Artificial Sequence
  chemically synthesized
cctcagcctcctgagtagctgg

SEQ ID NO: 1388831 - DNA, 22 bp, Artificial Sequence
  chemically synthesized
ctgcctcagcctcctgagtagc

SEQ ID NO: 1388832 - DNA, 22 bp, Artificial Sequence
  chemically synthesized
tcctgcctcagcctcctgagta

SEQ ID NO: 1388833 - DNA, 22 bp, Artificial Sequence
  chemically synthesized
tagtcccagctactcaggaggc

SEQ ID NO: 1388834 - DNA, 22 bp, Artificial Sequence
  chemically synthesized
acgccattctcctgcctcagcc

SEQ ID NO: 1388835 - DNA, 22 bp, Artificial Sequence
  chemically synthesized
ctcaggaggctgaggcaggaga

SEQ ID NO: 1388836 - DNA, 22 bp, Artificial Sequence
  chemically synthesized
aggaggctgaggcaggagaatg

SEQ ID NO: 1388837 - DNA, 22 bp, Artificial Sequence
  chemically synthesized
ccgggttcacgccattctcctg

SEQ ID NO: 1388838 - DNA, 22 bp, Artificial Sequence
  chemically synthesized
cgcctcccgggttcacgccatt

SEQ ID NO: 1388839 - DNA, 22 bp, Artificial Sequence
  chemically synthesized
aggcaggagaatggcgtgaacc

SEQ ID NO: 1388840 - DNA, 22 bp, Artificial Sequence
  chemically synthesized
caacctccgcctcccgggttca

SEQ ID NO: 1388841 - DNA, 22 bp, Artificial Sequence
  chemically synthesized
actgcaacctccgcctcccggg

SEQ ID NO: 1388842 - DNA, 22 bp, Artificial Sequence
  chemically synthesized
gctcactgcaacctccgcctcc

SEQ ID NO: 1388843 - DNA, 22 bp, Artificial Sequence
  chemically synthesized
ggctcactgcaacctccgcctc

SEQ ID NO: 1388844 - DNA, 22 bp, Artificial Sequence
  chemically synthesized
gagtgcagtggcgcgatcttgg

SEQ ID NO: 1388845 - DNA, 22 bp, Artificial Sequence
  chemically synthesized
cagtgagccaagatcgcgccac

SEQ ID NO: 1388846 - DNA, 22 bp, Artificial Sequence
  chemically synthesized
tcgcccaggctggagtgcagtg

SEQ ID NO: 1388847 - DNA, 22 bp, Artificial Sequence
  chemically synthesized
tgtcgcccaggctggagtgcag

SEQ ID NO: 1388848 - DNA, 22 bp, Artificial Sequence
  chemically synthesized
tctgtcgcccaggctggagtgc

SEQ ID NO: 1388849 - DNA, 22 bp, Artificial Sequence
  chemically synthesized
ctctgtcgcccaggctggagtg

SEQ ID NO: 1388850 - DNA, 22 bp, Artificial Sequence
  chemically synthesized
tctctgtcgcccaggctggagt

SEQ ID NO: 1388851 - DNA, 22 bp, Artificial Sequence
  chemically synthesized
agacagtctttctctgtcgccc

SEQ ID NO: 1388852 - DNA, 22 bp, Artificial Sequence
  chemically synthesized
cactccagcctgggcgacagag

SEQ ID NO: 1388853 - DNA, 22 bp, Artificial Sequence
  chemically synthesized
gagacagtctttctctgtcgcc

SEQ ID NO: 1388854 - DNA, 22 bp, Artificial Sequence
  chemically synthesized
tgagacagtctttctctgtcgc

SEQ ID NO: 1388855 - DNA, 22 bp, Artificial Sequence
  chemically synthesized
ttgagacagtctttctctgtcg

SEQ ID NO: 1388856 - DNA, 22 bp, Artificial Sequence
  chemically synthesized
tttgagacagtctttctctgtc

SEQ ID NO: 1388857 - DNA, 22 bp, Artificial Sequence
  chemically synthesized
cagcctgggcgacagagaaaga

SEQ ID NO: 1388858 - DNA, 22 bp, Artificial Sequence
  chemically synthesized
ttttttgagacagtctttctct

SEQ ID NO: 1388859 - DNA, 22 bp, Artificial Sequence
  chemically synthesized
gttttttgagacagtctttctc

SEQ ID NO: 1388860 - DNA, 22 bp, Artificial Sequence
  chemically synthesized
tcttgttttttgagacagtctt

SEQ ID NO: 1388861 - DNA, 22 bp, Artificial Sequence
  chemically synthesized
ggcgacagagaaagactgtctc

SEQ ID NO: 1388862 - DNA, 22 bp, Artificial Sequence
  chemically synthesized
gtcttgttttttgagacagtct

SEQ ID NO: 1388863 - DNA, 22 bp, Artificial Sequence
  chemically synthesized
tgtcttgttttttgagacagtc

SEQ ID NO: 1388864 - DNA, 22 bp, Artificial Sequence
  chemically synthesized
ttttgtcttgttttttgagaca

SEQ ID NO: 1388865 - DNA, 22 bp, Artificial Sequence
  chemically synthesized
gttttgtcttgttttttgagac

SEQ ID NO: 1388866 - DNA, 22 bp, Artificial Sequence
  chemically synthesized
tgttttgtcttgttttttgaga

SEQ ID NO: 1388867 - DNA, 22 bp, Artificial Sequence
  chemically synthesized
ttttgttttgtcttgttttttg

SEQ ID NO: 1388868 - DNA, 22 bp, Artificial Sequence
  chemically synthesized
gttttgttttgtcttgtttttt

SEQ ID NO: 1388869 - DNA, 22 bp, Artificial Sequence
  chemically synthesized
tctcaaaaaacaagacaaaaca

SEQ ID NO: 1388870 - DNA, 22 bp, Artificial Sequence
  chemically synthesized
acagatttgttttgttttgtct

SEQ ID NO: 1388871 - DNA, 22 bp, Artificial Sequence
  chemically synthesized
gacagatttgttttgttttgtc

SEQ ID NO: 1388872 - DNA, 22 bp, Artificial Sequence
  chemically synthesized
tgacagatttgttttgttttgt

SEQ ID NO: 1388873 - DNA, 22 bp, Artificial Sequence
  chemically synthesized
aaaaaacaagacaaaacaaaac

SEQ ID NO: 1388874 - DNA, 22 bp, Artificial Sequence
  chemically synthesized
cataattttgacagatttgttt

SEQ ID NO: 1388875 - DNA, 22 bp, Artificial Sequence
  chemically synthesized
gcataattttgacagatttgtt

SEQ ID NO: 1388876 - DNA, 22 bp, Artificial Sequence
  chemically synthesized
tttgcataattttgacagattt

SEQ ID NO: 1388877 - DNA, 22 bp, Artificial Sequence
  chemically synthesized
gtttgcataattttgacagatt

SEQ ID NO: 1388878 - DNA, 22 bp, Artificial Sequence
  chemically synthesized
tgtttgcataattttgacagat

SEQ ID NO: 1388879 - DNA, 22 bp, Artificial Sequence
  chemically synthesized
ttgtttgcataattttgacaga

SEQ ID NO: 1388880 - DNA, 22 bp, Artificial Sequence
  chemically synthesized
gtagacatttttgtttgcataa

SEQ ID NO: 1388881 - DNA, 22 bp, Artificial Sequence
  chemically synthesized
tcaaaattatgcaaacaaaaat

SEQ ID NO: 1388882 - DNA, 22 bp, Artificial Sequence
  chemically synthesized
aagttggtagacatttttgttt

SEQ ID NO: 1388883 - DNA, 22 bp, Artificial Sequence
  chemically synthesized
caagttggtagacatttttgtt

SEQ ID NO: 1388884 - DNA, 22 bp, Artificial Sequence
  chemically synthesized
taatttcaagttggtagacatt

SEQ ID NO: 1388885 - DNA, 22 bp, Artificial Sequence
  chemically synthesized
tgcaaacaaaaatgtctaccaa

SEQ ID NO: 1388886 - DNA, 22 bp, Artificial Sequence
  chemically synthesized
atctgtaatttcaagttggtag

SEQ ID NO: 1388887 - DNA, 22 bp, Artificial Sequence
  chemically synthesized
tagtcatgtactcatctgtaat

SEQ ID NO: 1388888 - DNA, 22 bp, Artificial Sequence
  chemically synthesized
ccaacttgaaattacagatgag

SEQ ID NO: 1388889 - DNA, 22 bp, Artificial Sequence
  chemically synthesized
gaaattacagatgagtacatga

SEQ ID NO: 1388890 - DNA, 22 bp, Artificial Sequence
  chemically synthesized
aaattacagatgagtacatgac

SEQ ID NO: 1388891 - DNA, 22 bp, Artificial Sequence
  chemically synthesized
cagatgagtacatgactataat

SEQ ID NO: 1388892 - DNA, 22 bp, Artificial Sequence
  chemically synthesized
tatatatatataaaattatagt

SEQ ID NO: 1388893 - DNA, 22 bp, Artificial Sequence
  chemically synthesized
atatatatatataaaattatag

SEQ ID NO: 1388894 - DNA, 22 bp, Artificial Sequence
  chemically synthesized
tatatatatatataaaattata

SEQ ID NO: 1388895 - DNA, 22 bp, Artificial Sequence
  chemically synthesized
tatgtgtattttatatatatat

SEQ ID NO: 1388896 - DNA, 22 bp, Artificial Sequence
  chemically synthesized
taattttatatatatatataaa

SEQ ID NO: 1388897 - DNA, 22 bp, Artificial Sequence
  chemically synthesized
tatatatatatataaaatacac

SEQ ID NO: 1388898 - DNA, 22 bp, Artificial Sequence
  chemically synthesized
atatatatatataaaatacaca

SEQ ID NO: 1388899 - DNA, 22 bp, Artificial Sequence
  chemically synthesized
tcatatgttatatgtgtatttt

SEQ ID NO: 1388900 - DNA, 22 bp, Artificial Sequence
  chemically synthesized
tatatatatataaaatacacat

SEQ ID NO: 1388901 - DNA, 22 bp, Artificial Sequence
  chemically synthesized
atcatatgttatatgtgtattt

SEQ ID NO: 1388902 - DNA, 22 bp, Artificial Sequence
  chemically synthesized
tatcatatgttatatgtgtatt

SEQ ID NO: 1388903 - DNA, 22 bp, Artificial Sequence
  chemically synthesized
atgaatactttatcatatgtta

SEQ ID NO: 1388904 - DNA, 22 bp, Artificial Sequence
  chemically synthesized
gagacataaatgattaatgaat

SEQ ID NO: 1388905 - DNA, 22 bp, Artificial Sequence
  chemically synthesized
aaactagagacataaatgatta

SEQ ID NO: 1388906 - DNA, 22 bp, Artificial Sequence
  chemically synthesized
ttcaaactagagacataaatga

SEQ ID NO: 1388907 - DNA, 22 bp, Artificial Sequence
  chemically synthesized
tgttgttcaaactagagacata

SEQ ID NO: 1388908 - DNA, 22 bp, Artificial Sequence
  chemically synthesized
attaatcatttatgtctctagt

SEQ ID NO: 1388909 - DNA, 22 bp, Artificial Sequence
  chemically synthesized
cctgtgttgttcaaactagaga

SEQ ID NO: 1388910 - DNA, 22 bp, Artificial Sequence
  chemically synthesized
atcatttatgtctctagtttga

SEQ ID NO: 1388911 - DNA, 22 bp, Artificial Sequence
  chemically synthesized
aactccctgtgttgttcaaact

SEQ ID NO: 1388912 - DNA, 22 bp, Artificial Sequence
  chemically synthesized
atgtctctagtttgaacaacac

SEQ ID NO: 1388913 - DNA, 22 bp, Artificial Sequence
  chemically synthesized
tgtctctagtttgaacaacaca

SEQ ID NO: 1388914 - DNA, 22 bp, Artificial Sequence
  chemically synthesized
tagtttgaacaacacagggagt

SEQ ID NO: 1388915 - DNA, 22 bp, Artificial Sequence
  chemically synthesized
ggtgcatgttgaactccctgtg

SEQ ID NO: 1388916 - DNA, 22 bp, Artificial Sequence
  chemically synthesized
gtttgaacaacacagggagttc

SEQ ID NO: 1388917 - DNA, 22 bp, Artificial Sequence
  chemically synthesized
gaacaacacagggagttcaaca

SEQ ID NO: 1388918 - DNA, 22 bp, Artificial Sequence
  chemically synthesized
aacaacacagggagttcaacat

SEQ ID NO: 1388919 - DNA, 22 bp, Artificial Sequence
  chemically synthesized
cgcagtgtgctaggtgcatgtt

SEQ ID NO: 1388920 - DNA, 22 bp, Artificial Sequence
  chemically synthesized
acgcagtgtgctaggtgcatgt

SEQ ID NO: 1388921 - DNA, 22 bp, Artificial Sequence
  chemically synthesized
aacatgcacctagcacactgcg

SEQ ID NO: 1388922 - DNA, 22 bp, Artificial Sequence
  chemically synthesized
tagaaaggcttacgcagtgtgc

SEQ ID NO: 1388923 - DNA, 22 bp, Artificial Sequence
  chemically synthesized
aaacatctatagaaaggcttac

SEQ ID NO: 1388924 - DNA, 22 bp, Artificial Sequence
  chemically synthesized
gcacactgcgtaagcctttcta

SEQ ID NO: 1388925 - DNA, 22 bp, Artificial Sequence
  chemically synthesized
gctaaaacatctatagaaaggc

SEQ ID NO: 1388926 - DNA, 22 bp, Artificial Sequence
  chemically synthesized
ggctaaaacatctatagaaagg

SEQ ID NO: 1388927 - DNA, 22 bp, Artificial Sequence
  chemically synthesized
atcttggctaaaacatctatag

SEQ ID NO: 1388928 - DNA, 22 bp, Artificial Sequence
  chemically synthesized
cgtaagcctttctatagatgtt

SEQ ID NO: 1388929 - DNA, 22 bp, Artificial Sequence
  chemically synthesized
gatcttggctaaaacatctata

SEQ ID NO: 1388930 - DNA, 22 bp, Artificial Sequence
  chemically synthesized
tctatagatgttttagccaaga

SEQ ID NO: 1388931 - DNA, 22 bp, Artificial Sequence
  chemically synthesized
ctatagatgttttagccaagat

SEQ ID NO: 1388932 - DNA, 22 bp, Artificial Sequence
  chemically synthesized
tatagatgttttagccaagatc

SEQ ID NO: 1388933 - DNA, 22 bp, Artificial Sequence
  chemically synthesized
atagacagtcttgatcttggct

SEQ ID NO: 1388934 - DNA, 22 bp, Artificial Sequence
  chemically synthesized
tagatgttttagccaagatcaa

SEQ ID NO: 1388935 - DNA, 22 bp, Artificial Sequence
  chemically synthesized
ttaatagacagtcttgatcttg

SEQ ID NO: 1388936 - DNA, 22 bp, Artificial Sequence
  chemically synthesized
attaatagacagtcttgatctt

SEQ ID NO: 1388937 - DNA, 22 bp, Artificial Sequence
  chemically synthesized
tagccaagatcaagactgtcta

SEQ ID NO: 1388938 - DNA, 22 bp, Artificial Sequence
  chemically synthesized
agccaagatcaagactgtctat

SEQ ID NO: 1388939 - DNA, 22 bp, Artificial Sequence
  chemically synthesized
gatgtcttattaatagacagtc

SEQ ID NO: 1388940 - DNA, 22 bp, Artificial Sequence
  chemically synthesized
gccaagatcaagactgtctatt

SEQ ID NO: 1388941 - DNA, 22 bp, Artificial Sequence
  chemically synthesized
agatgtcttattaatagacagt

SEQ ID NO: 1388942 - DNA, 22 bp, Artificial Sequence
  chemically synthesized
tagatgtcttattaatagacag

SEQ ID NO: 1388943 - DNA, 22 bp, Artificial Sequence
  chemically synthesized
aatgttttagatgtcttattaa

SEQ ID NO: 1388944 - DNA, 22 bp, Artificial Sequence
  chemically synthesized
attaaatgttttagatgtctta

SEQ ID NO: 1388945 - DNA, 22 bp, Artificial Sequence
  chemically synthesized
gattaaatgttttagatgtctt

SEQ ID NO: 1388946 - DNA, 22 bp, Artificial Sequence
  chemically synthesized
tctattaataagacatctaaaa

SEQ ID NO: 1388947 - DNA, 22 bp, Artificial Sequence
  chemically synthesized
ttaataagacatctaaaacatt

SEQ ID NO: 1388948 - DNA, 22 bp, Artificial Sequence
  chemically synthesized
ataagacatctaaaacatttaa

SEQ ID NO: 1388949 - DNA, 22 bp, Artificial Sequence
  chemically synthesized
aaaccaaatgtgcttgattaaa

SEQ ID NO: 1388950 - DNA, 22 bp, Artificial Sequence
  chemically synthesized
tattcaaaccaaatgtgcttga

SEQ ID NO: 1388951 - DNA, 22 bp, Artificial Sequence
  chemically synthesized
atattcaaaccaaatgtgcttg

SEQ ID NO: 1388952 - DNA, 22 bp, Artificial Sequence
  chemically synthesized
aaacatttaatcaagcacattt

SEQ ID NO: 1388953 - DNA, 22 bp, Artificial Sequence
  chemically synthesized
tatattcaaaccaaatgtgctt

SEQ ID NO: 1388954 - DNA, 22 bp, Artificial Sequence
  chemically synthesized
ttatattcaaaccaaatgtgct

SEQ ID NO: 1388955 - DNA, 22 bp, Artificial Sequence
  chemically synthesized
tttatattcaaaccaaatgtgc

SEQ ID NO: 1388956 - DNA, 22 bp, Artificial Sequence
  chemically synthesized
aatcaagcacatttggtttgaa

SEQ ID NO: 1388957 - DNA, 22 bp, Artificial Sequence
  chemically synthesized
atcaagcacatttggtttgaat

SEQ ID NO: 1388958 - DNA, 22 bp, Artificial Sequence
  chemically synthesized
tcatctttttatattcaaacca

SEQ ID NO: 1388959 - DNA, 22 bp, Artificial Sequence
  chemically synthesized
tatcatctttttatattcaaac

SEQ ID NO: 1388960 - DNA, 22 bp, Artificial Sequence
  chemically synthesized
ctctatcatctttttatattca

SEQ ID NO: 1388961 - DNA, 22 bp, Artificial Sequence
  chemically synthesized
attgctctatcatctttttata

SEQ ID NO: 1388962 - DNA, 22 bp, Artificial Sequence
  chemically synthesized
ggtttgaatataaaaagatgat

SEQ ID NO: 1388963 - DNA, 22 bp, Artificial Sequence
  chemically synthesized
gtttgaatataaaaagatgata

SEQ ID NO: 1388964 - DNA, 22 bp, Artificial Sequence
  chemically synthesized
gaatataaaaagatgatagagc

SEQ ID NO: 1388965 - DNA, 22 bp, Artificial Sequence
  chemically synthesized
aatataaaaagatgatagagca

SEQ ID NO: 1388966 - DNA, 22 bp, Artificial Sequence
  chemically synthesized
agaaaaacctgattgctctatc

SEQ ID NO: 1388967 - DNA, 22 bp, Artificial Sequence
  chemically synthesized
ttgagaaaaacctgattgctct

SEQ ID NO: 1388968 - DNA, 22 bp, Artificial Sequence
  chemically synthesized
attgttgagaaaaacctgattg

SEQ ID NO: 1388969 - DNA, 22 bp, Artificial Sequence
  chemically synthesized
aaaaacactaattgttgagaaa

SEQ ID NO: 1388970 - DNA, 22 bp, Artificial Sequence
  chemically synthesized
ttaaaaaacactaattgttgag

SEQ ID NO: 1388971 - DNA, 22 bp, Artificial Sequence
  chemically synthesized
gttaaaaaacactaattgttga

SEQ ID NO: 1388972 - DNA, 22 bp, Artificial Sequence
  chemically synthesized
tgttaaaaaacactaattgttg

SEQ ID NO: 1388973 - DNA, 22 bp, Artificial Sequence
  chemically synthesized
ttgttaaaaaacactaattgtt

SEQ ID NO: 1388974 - DNA, 22 bp, Artificial Sequence
  chemically synthesized
ttctcaacaattagtgtttttt

SEQ ID NO: 1388975 - DNA, 22 bp, Artificial Sequence
  chemically synthesized
tgtccttttgttaaaaaacact

SEQ ID NO: 1388976 - DNA, 22 bp, Artificial Sequence
  chemically synthesized
tctcaacaattagtgtttttta

SEQ ID NO: 1388977 - DNA, 22 bp, Artificial Sequence
  chemically synthesized
ctcaacaattagtgttttttaa

SEQ ID NO: 1388978 - DNA, 22 bp, Artificial Sequence
  chemically synthesized
tcaacaattagtgttttttaac

SEQ ID NO: 1388979 - DNA, 22 bp, Artificial Sequence
  chemically synthesized
ttatgtccttttgttaaaaaac

SEQ ID NO: 1388980 - DNA, 22 bp, Artificial Sequence
  chemically synthesized
aacaattagtgttttttaacaa

SEQ ID NO: 1388981 - DNA, 22 bp, Artificial Sequence
  chemically synthesized
tgcactgttatgtccttttgtt

SEQ ID NO: 1388982 - DNA, 22 bp, Artificial Sequence
  chemically synthesized
gtgttttttaacaaaaggacat

SEQ ID NO: 1388983 - DNA, 22 bp, Artificial Sequence
  chemically synthesized
gctatgcactgttatgtccttt

SEQ ID NO: 1388984 - DNA, 22 bp, Artificial Sequence
  chemically synthesized
ggctatgcactgttatgtcctt

SEQ ID NO: 1388985 - DNA, 22 bp, Artificial Sequence
  chemically synthesized
tggctatgcactgttatgtcct

SEQ ID NO: 1388986 - DNA, 22 bp, Artificial Sequence
  chemically synthesized
ttggctatgcactgttatgtcc

SEQ ID NO: 1388987 - DNA, 22 bp, Artificial Sequence
  chemically synthesized
tttaacaaaaggacataacagt

SEQ ID NO: 1388988 - DNA, 22 bp, Artificial Sequence
  chemically synthesized
ttaacaaaaggacataacagtg

SEQ ID NO: 1388989 - DNA, 22 bp, Artificial Sequence
  chemically synthesized
taacaaaaggacataacagtgc

SEQ ID NO: 1388990 - DNA, 22 bp, Artificial Sequence
  chemically synthesized
aacaaaaggacataacagtgca

SEQ ID NO: 1388991 - DNA, 22 bp, Artificial Sequence
  chemically synthesized
acaaaaggacataacagtgcat

SEQ ID NO: 1388992 - DNA, 22 bp, Artificial Sequence
  chemically synthesized
ataaatttttggctatgcactg

SEQ ID NO: 1388993 - DNA, 22 bp, Artificial Sequence
  chemically synthesized
caaaaattaataaatttttggc

SEQ ID NO: 1388994 - DNA, 22 bp, Artificial Sequence
  chemically synthesized
aaagttccaaaaattaataaat

SEQ ID NO: 1388995 - DNA, 22 bp, Artificial Sequence
  chemically synthesized
gaaactaaaagttccaaaaatt

SEQ ID NO: 1388996 - DNA, 22 bp, Artificial Sequence
  chemically synthesized
ggaaactaaaagttccaaaaat

SEQ ID NO: 1388997 - DNA, 22 bp, Artificial Sequence
  chemically synthesized
attaatttttggaacttttagt

SEQ ID NO: 1388998 - DNA, 22 bp, Artificial Sequence
  chemically synthesized
ttaatttttggaacttttagtt

SEQ ID NO: 1388999 - DNA, 22 bp, Artificial Sequence
  chemically synthesized
atttttggaacttttagtttcc

SEQ ID NO: 1389000 - DNA, 22 bp, Artificial Sequence
  chemically synthesized
atgaagaagaatttggaaacta

SEQ ID NO: 1389001 - DNA, 22 bp, Artificial Sequence
  chemically synthesized
aatgaagaagaatttggaaact

SEQ ID NO: 1389002 - DNA, 22 bp, Artificial Sequence
  chemically synthesized
ttggaacttttagtttccaaat

SEQ ID NO: 1389003 - DNA, 22 bp, Artificial Sequence
  chemically synthesized
tggaacttttagtttccaaatt

SEQ ID NO: 1389004 - DNA, 22 bp, Artificial Sequence
  chemically synthesized
ggaacttttagtttccaaattc

SEQ ID NO: 1389005 - DNA, 22 bp, Artificial Sequence
  chemically synthesized
gaacttttagtttccaaattct

SEQ ID NO: 1389006 - DNA, 22 bp, Artificial Sequence
  chemically synthesized
tgtttaatgaagaagaatttgg

SEQ ID NO: 1389007 - DNA, 22 bp, Artificial Sequence
  chemically synthesized
gtgtttaatgaagaagaatttg

SEQ ID NO: 1389008 - DNA, 22 bp, Artificial Sequence
  chemically synthesized
ttagtttccaaattcttcttca

SEQ ID NO: 1389009 - DNA, 22 bp, Artificial Sequence
  chemically synthesized
tcttgtgtttaatgaagaagaa

SEQ ID NO: 1389010 - DNA, 22 bp, Artificial Sequence
  chemically synthesized
tagtttccaaattcttcttcat

SEQ ID NO: 1389011 - DNA, 22 bp, Artificial Sequence
  chemically synthesized
atcttgtgtttaatgaagaaga

SEQ ID NO: 1389012 - DNA, 22 bp, Artificial Sequence
  chemically synthesized
agtttccaaattcttcttcatt

SEQ ID NO: 1389013 - DNA, 22 bp, Artificial Sequence
  chemically synthesized
tatcttgtgtttaatgaagaag

SEQ ID NO: 1389014 - DNA, 22 bp, Artificial Sequence
  chemically synthesized
gtttccaaattcttcttcatta

SEQ ID NO: 1389015 - DNA, 22 bp, Artificial Sequence
  chemically synthesized
ttatcttgtgtttaatgaagaa

SEQ ID NO: 1389016 - DNA, 22 bp, Artificial Sequence
  chemically synthesized
ccaaattcttcttcattaaaca

SEQ ID NO: 1389017 - DNA, 22 bp, Artificial Sequence
  chemically synthesized
caaattcttcttcattaaacac

SEQ ID NO: 1389018 - DNA, 22 bp, Artificial Sequence
  chemically synthesized
agtatttttatcttgtgtttaa

SEQ ID NO: 1389019 - DNA, 22 bp, Artificial Sequence
  chemically synthesized
ttcttcattaaacacaagataa

SEQ ID NO: 1389020 - DNA, 22 bp, Artificial Sequence
  chemically synthesized
cttcattaaacacaagataaaa

SEQ ID NO: 1389021 - DNA, 22 bp, Artificial Sequence
  chemically synthesized
ttcattaaacacaagataaaaa

SEQ ID NO: 1389022 - DNA, 22 bp, Artificial Sequence
  chemically synthesized
aaaagttaagtatttttatctt

SEQ ID NO: 1389023 - DNA, 22 bp, Artificial Sequence
  chemically synthesized
aaaaagttaagtatttttatct

SEQ ID NO: 1389024 - DNA, 22 bp, Artificial Sequence
  chemically synthesized
cattaaacacaagataaaaata

SEQ ID NO: 1389025 - DNA, 22 bp, Artificial Sequence
  chemically synthesized
attaaacacaagataaaaatac

SEQ ID NO: 1389026 - DNA, 22 bp, Artificial Sequence
  chemically synthesized
tcttaaaaagttaagtattttt

SEQ ID NO: 1389027 - DNA, 22 bp, Artificial Sequence
  chemically synthesized
aacacaagataaaaatacttaa

SEQ ID NO: 1389028 - DNA, 22 bp, Artificial Sequence
  chemically synthesized
acctgtcttaaaaagttaagta

SEQ ID NO: 1389029 - DNA, 22 bp, Artificial Sequence
  chemically synthesized
ttcacctgtcttaaaaagttaa

SEQ ID NO: 1389030 - DNA, 22 bp, Artificial Sequence
  chemically synthesized
tattcacctgtcttaaaaagtt

SEQ ID NO: 1389031 - DNA, 22 bp, Artificial Sequence
  chemically synthesized
ctattcacctgtcttaaaaagt

SEQ ID NO: 1389032 - DNA, 22 bp, Artificial Sequence
  chemically synthesized
cttctattcacctgtcttaaaa

SEQ ID NO: 1389033 - DNA, 22 bp, Artificial Sequence
  chemically synthesized
ccttctattcacctgtcttaaa

SEQ ID NO: 1389034 - DNA, 22 bp, Artificial Sequence
  chemically synthesized
aactttttaagacaggtgaata

SEQ ID NO: 1389035 - DNA, 22 bp, Artificial Sequence
  chemically synthesized
actttttaagacaggtgaatag

SEQ ID NO: 1389036 - DNA, 22 bp, Artificial Sequence
  chemically synthesized
agcaaaaatttccttctattca

SEQ ID NO: 1389037 - DNA, 22 bp, Artificial Sequence
  chemically synthesized
tttaagacaggtgaatagaagg

SEQ ID NO: 1389038 - DNA, 22 bp, Artificial Sequence
  chemically synthesized
ttaagacaggtgaatagaagga

SEQ ID NO: 1389039 - DNA, 22 bp, Artificial Sequence
  chemically synthesized
taagacaggtgaatagaaggaa

SEQ ID NO: 1389040 - DNA, 22 bp, Artificial Sequence
  chemically synthesized
aagacaggtgaatagaaggaaa

SEQ ID NO: 1389041 - DNA, 22 bp, Artificial Sequence
  chemically synthesized
agacaggtgaatagaaggaaat

SEQ ID NO: 1389042 - DNA, 22 bp, Artificial Sequence
  chemically synthesized
acataaaaagtagaagaggctc

SEQ ID NO: 1389043 - DNA, 22 bp, Artificial Sequence
  chemically synthesized
aacataaaaagtagaagaggct

SEQ ID NO: 1389044 - DNA, 22 bp, Artificial Sequence
  chemically synthesized
ttgctgagcctcttctactttt

SEQ ID NO: 1389045 - DNA, 22 bp, Artificial Sequence
  chemically synthesized
tgctgagcctcttctacttttt

SEQ ID NO: 1389046 - DNA, 22 bp, Artificial Sequence
  chemically synthesized
gctgagcctcttctacttttta

SEQ ID NO: 1389047 - DNA, 22 bp, Artificial Sequence
  chemically synthesized
ctgagcctcttctactttttat

SEQ ID NO: 1389048 - DNA, 22 bp, Artificial Sequence
  chemically synthesized
agcctcttctactttttatgtt

SEQ ID NO: 1389049 - DNA, 22 bp, Artificial Sequence
  chemically synthesized
ttctactttttatgttaaatat

SEQ ID NO: 1389050 - DNA, 22 bp, Artificial Sequence
  chemically synthesized
ctactttttatgttaaatattt

SEQ ID NO: 1389051 - DNA, 22 bp, Artificial Sequence
  chemically synthesized
tactttttatgttaaatatttt

SEQ ID NO: 1389052 - DNA, 22 bp, Artificial Sequence
  chemically synthesized
ctttttatgttaaatattttat

SEQ ID NO: 1389053 - DNA, 22 bp, Artificial Sequence
  chemically synthesized
tttatgttaaatattttattct

SEQ ID NO: 1389054 - DNA, 22 bp, Artificial Sequence
  chemically synthesized
ttatgttaaatattttattcta

SEQ ID NO: 1389055 - DNA, 22 bp, Artificial Sequence
  chemically synthesized
tatgttaaatattttattctat

SEQ ID NO: 1389056 - DNA, 22 bp, Artificial Sequence
  chemically synthesized
atgttaaatattttattctatg

SEQ ID NO: 1389057 - DNA, 22 bp, Artificial Sequence
  chemically synthesized
tgttaaatattttattctatgc

SEQ ID NO: 1389058 - DNA, 22 bp, Artificial Sequence
  chemically synthesized
aatattttattctatgcttttt

SEQ ID NO: 1389059 - DNA, 22 bp, Artificial Sequence
  chemically synthesized
tgtaagccatgataaaaagcat

SEQ ID NO: 1389060 - DNA, 22 bp, Artificial Sequence
  chemically synthesized
gtgtaagccatgataaaaagca

SEQ ID NO: 1389061 - DNA, 22 bp, Artificial Sequence
  chemically synthesized
tattctatgctttttatcatgg

SEQ ID NO: 1389062 - DNA, 22 bp, Artificial Sequence
  chemically synthesized
attctatgctttttatcatggc

SEQ ID NO: 1389063 - DNA, 22 bp, Artificial Sequence
  chemically synthesized
ttctatgctttttatcatggct

SEQ ID NO: 1389064 - DNA, 22 bp, Artificial Sequence
  chemically synthesized
tgaaggtttgtgtaagccatga

SEQ ID NO: 1389065 - DNA, 22 bp, Artificial Sequence
  chemically synthesized
tatgctttttatcatggcttac

SEQ ID NO: 1389066 - DNA, 22 bp, Artificial Sequence
  chemically synthesized
tgctttttatcatggcttacac

SEQ ID NO: 1389067 - DNA, 22 bp, Artificial Sequence
  chemically synthesized
tttatcatggcttacacaaacc

SEQ ID NO: 1389068 - DNA, 22 bp, Artificial Sequence
  chemically synthesized
ttatcatggcttacacaaacct

SEQ ID NO: 1389069 - DNA, 22 bp, Artificial Sequence
  chemically synthesized
tatcatggcttacacaaacctt

SEQ ID NO: 1389070 - DNA, 22 bp, Artificial Sequence
  chemically synthesized
atcatggcttacacaaaccttc

SEQ ID NO: 1389071 - DNA, 22 bp, Artificial Sequence
  chemically synthesized
cagcaacattatgaaggtttgt

SEQ ID NO: 1389072 - DNA, 22 bp, Artificial Sequence
  chemically synthesized
tcatggcttacacaaaccttca

SEQ ID NO: 1389073 - DNA, 22 bp, Artificial Sequence
  chemically synthesized
acacaaaccttcataatgttgc

SEQ ID NO: 1389074 - DNA, 22 bp, Artificial Sequence
  chemically synthesized
cacaaaccttcataatgttgct

SEQ ID NO: 1389075 - DNA, 22 bp, Artificial Sequence
  chemically synthesized
atagtcagtaaatatattgcag

SEQ ID NO: 1389076 - DNA, 22 bp, Artificial Sequence
  chemically synthesized
cataatgttgctgcaatatatt

SEQ ID NO: 1389077 - DNA, 22 bp, Artificial Sequence
  chemically synthesized
ataatgttgctgcaatatattt

SEQ ID NO: 1389078 - DNA, 22 bp, Artificial Sequence
  chemically synthesized
ctgcaatatatttactgactat

SEQ ID NO: 1389079 - DNA, 22 bp, Artificial Sequence
  chemically synthesized
aagagagcattgatagtcagta

SEQ ID NO: 1389080 - DNA, 22 bp, Artificial Sequence
  chemically synthesized
gaagagagcattgatagtcagt

SEQ ID NO: 1389081 - DNA, 22 bp, Artificial Sequence
  chemically synthesized
caatatatttactgactatcaa

SEQ ID NO: 1389082 - DNA, 22 bp, Artificial Sequence
  chemically synthesized
taccaaatttgaagagagcatt

SEQ ID NO: 1389083 - DNA, 22 bp, Artificial Sequence
  chemically synthesized
actgactatcaatgctctcttc

SEQ ID NO: 1389084 - DNA, 22 bp, Artificial Sequence
  chemically synthesized
ctgactatcaatgctctcttca

SEQ ID NO: 1389085 - DNA, 22 bp, Artificial Sequence
  chemically synthesized
actatcaatgctctcttcaaat

SEQ ID NO: 1389086 - DNA, 22 bp, Artificial Sequence
  chemically synthesized
tcaatgctctcttcaaatttgg

SEQ ID NO: 1389087 - DNA, 22 bp, Artificial Sequence
  chemically synthesized
aaaaatatacctataccaaatt

SEQ ID NO: 1389088 - DNA, 22 bp, Artificial Sequence
  chemically synthesized
tcttcaaatttggtataggtat

SEQ ID NO: 1389089 - DNA, 22 bp, Artificial Sequence
  chemically synthesized
ttcaaatttggtataggtatat

SEQ ID NO: 1389090 - DNA, 22 bp, Artificial Sequence
  chemically synthesized
caaatttggtataggtatattt

SEQ ID NO: 1389091 - DNA, 22 bp, Artificial Sequence
  chemically synthesized
aaatttggtataggtatatttt

SEQ ID NO: 1389092 - DNA, 22 bp, Artificial Sequence
  chemically synthesized
ggtataggtatatttttcagcc

SEQ ID NO: 1389093 - DNA, 22 bp, Artificial Sequence
  chemically synthesized
gtataggtatatttttcagcct

SEQ ID NO: 1389094 - DNA, 22 bp, Artificial Sequence
  chemically synthesized
gagacaagaagggggaaaggct

SEQ ID NO: 1389095 - DNA, 22 bp, Artificial Sequence
  chemically synthesized
taactggagacaagaaggggga

SEQ ID NO: 1389096 - DNA, 22 bp, Artificial Sequence
  chemically synthesized
ttcagcctttcccccttcttgt

SEQ ID NO: 1389097 - DNA, 22 bp, Artificial Sequence
  chemically synthesized
tcagcctttcccccttcttgtc

SEQ ID NO: 1389098 - DNA, 22 bp, Artificial Sequence
  chemically synthesized
cagcctttcccccttcttgtct

SEQ ID NO: 1389099 - DNA, 22 bp, Artificial Sequence
  chemically synthesized
agcctttcccccttcttgtctc

SEQ ID NO: 1389100 - DNA, 22 bp, Artificial Sequence
  chemically synthesized
tcccccttcttgtctccagtta

SEQ ID NO: 1389101 - DNA, 22 bp, Artificial Sequence
  chemically synthesized
cccccttcttgtctccagttac

SEQ ID NO: 1389102 - DNA, 22 bp, Artificial Sequence
  chemically synthesized
ccccttcttgtctccagttaca

SEQ ID NO: 1389103 - DNA, 22 bp, Artificial Sequence
  chemically synthesized
cttgtctccagttacaggccct

SEQ ID NO: 1389104 - DNA, 22 bp, Artificial Sequence
  chemically synthesized
taggcccataaaagggcctgta

SEQ ID NO: 1389105 - DNA, 22 bp, Artificial Sequence
  chemically synthesized
ttgtctccagttacaggccctt

SEQ ID NO: 1389106 - DNA, 22 bp, Artificial Sequence
  chemically synthesized
gtctccagttacaggccctttt

SEQ ID NO: 1389107 - DNA, 22 bp, Artificial Sequence
  chemically synthesized
tctccagttacaggccctttta

SEQ ID NO: 1389108 - DNA, 22 bp, Artificial Sequence
  chemically synthesized
cagttacaggcccttttatggg

SEQ ID NO: 1389109 - DNA, 22 bp, Artificial Sequence
  chemically synthesized
caggcccttttatgggcctata

SEQ ID NO: 1389110 - DNA, 22 bp, Artificial Sequence
  chemically synthesized
agatagaaaaccaacgttatag

SEQ ID NO: 1389111 - DNA, 22 bp, Artificial Sequence
  chemically synthesized
ttatgggcctataacgttggtt

SEQ ID NO: 1389112 - DNA, 22 bp, Artificial Sequence
  chemically synthesized
tatgggcctataacgttggttt

SEQ ID NO: 1389113 - DNA, 22 bp, Artificial Sequence
  chemically synthesized
aattgagatagaaaaccaacgt

SEQ ID NO: 1389114 - DNA, 22 bp, Artificial Sequence
  chemically synthesized
atgggcctataacgttggtttt

SEQ ID NO: 1389115 - DNA, 22 bp, Artificial Sequence
  chemically synthesized
gaattgagatagaaaaccaacg

SEQ ID NO: 1389116 - DNA, 22 bp, Artificial Sequence
  chemically synthesized
tgggcctataacgttggttttc

SEQ ID NO: 1389117 - DNA, 22 bp, Artificial Sequence
  chemically synthesized
tgaattgagatagaaaaccaac

SEQ ID NO: 1389118 - DNA, 22 bp, Artificial Sequence
  chemically synthesized
aattttgaattgagatagaaaa

SEQ ID NO: 1389119 - DNA, 22 bp, Artificial Sequence
  chemically synthesized
gaattttgaattgagatagaaa

SEQ ID NO: 1389120 - DNA, 22 bp, Artificial Sequence
  chemically synthesized
tgaattttgaattgagatagaa

SEQ ID NO: 1389121 - DNA, 22 bp, Artificial Sequence
  chemically synthesized
taacgttggttttctatctcaa

SEQ ID NO: 1389122 - DNA, 22 bp, Artificial Sequence
  chemically synthesized
ttgaattttgaattgagataga

SEQ ID NO: 1389123 - DNA, 22 bp, Artificial Sequence
  chemically synthesized
ttttgaattttgaattgagata

SEQ ID NO: 1389124 - DNA, 22 bp, Artificial Sequence
  chemically synthesized
cttttgaattttgaattgagat

SEQ ID NO: 1389125 - DNA, 22 bp, Artificial Sequence
  chemically synthesized
tcttttgaattttgaattgaga

SEQ ID NO: 1389126 - DNA, 22 bp, Artificial Sequence
  chemically synthesized
ttcttttgaattttgaattgag

SEQ ID NO: 1389127 - DNA, 22 bp, Artificial Sequence
  chemically synthesized
gttttctatctcaattcaaaat

SEQ ID NO: 1389128 - DNA, 22 bp, Artificial Sequence
  chemically synthesized
tctatctcaattcaaaattcaa

SEQ ID NO: 1389129 - DNA, 22 bp, Artificial Sequence
  chemically synthesized
aagtcttttcttttgaattttg

SEQ ID NO: 1389130 - DNA, 22 bp, Artificial Sequence
  chemically synthesized
ctatctcaattcaaaattcaaa

SEQ ID NO: 1389131 - DNA, 22 bp, Artificial Sequence
  chemically synthesized
aaagtcttttcttttgaatttt

SEQ ID NO: 1389132 - DNA, 22 bp, Artificial Sequence
  chemically synthesized
tatctcaattcaaaattcaaaa

SEQ ID NO: 1389133 - DNA, 22 bp, Artificial Sequence
  chemically synthesized
taaagtcttttcttttgaattt

SEQ ID NO: 1389134 - DNA, 22 bp, Artificial Sequence
  chemically synthesized
ttaaagtcttttcttttgaatt

SEQ ID NO: 1389135 - DNA, 22 bp, Artificial Sequence
  chemically synthesized
tctcaattcaaaattcaaaaga

SEQ ID NO: 1389136 - DNA, 22 bp, Artificial Sequence
  chemically synthesized
aattcaaaattcaaaagaaaag

SEQ ID NO: 1389137 - DNA, 22 bp, Artificial Sequence
  chemically synthesized
aaaattcaaaagaaaagacttt

SEQ ID NO: 1389138 - DNA, 22 bp, Artificial Sequence
  chemically synthesized
aaaagaaaagactttaaaaatc

SEQ ID NO: 1389139 - DNA, 22 bp, Artificial Sequence
  chemically synthesized
gggcaaaaaaaaaaagatgatt

SEQ ID NO: 1389140 - DNA, 22 bp, Artificial Sequence
  chemically synthesized
agcattagggcaaaaaaaaaaa

SEQ ID NO: 1389141 - DNA, 22 bp, Artificial Sequence
  chemically synthesized
taaaaatcatcttttttttttt

SEQ ID NO: 1389142 - DNA, 22 bp, Artificial Sequence
  chemically synthesized
aaaaatcatctttttttttttg

SEQ ID NO: 1389143 - DNA, 22 bp, Artificial Sequence
  chemically synthesized
aaaatcatctttttttttttgc

SEQ ID NO: 1389144 - DNA, 22 bp, Artificial Sequence
  chemically synthesized
aattaagcattagggcaaaaaa

SEQ ID NO: 1389145 - DNA, 22 bp, Artificial Sequence
  chemically synthesized
taaattaagcattagggcaaaa

SEQ ID NO: 1389146 - DNA, 22 bp, Artificial Sequence
  chemically synthesized
cgctctaaattaagcattaggg

SEQ ID NO: 1389147 - DNA, 22 bp, Artificial Sequence
  chemically synthesized
tttttttttgccctaatgctta

SEQ ID NO: 1389148 - DNA, 22 bp, Artificial Sequence
  chemically synthesized
ttttttttgccctaatgcttaa

SEQ ID NO: 1389149 - DNA, 22 bp, Artificial Sequence
  chemically synthesized
tttttttgccctaatgcttaat

SEQ ID NO: 1389150 - DNA, 22 bp, Artificial Sequence
  chemically synthesized
ttttttgccctaatgcttaatt

SEQ ID NO: 1389151 - DNA, 22 bp, Artificial Sequence
  chemically synthesized
tttttgccctaatgcttaattt

SEQ ID NO: 1389152 - DNA, 22 bp, Artificial Sequence
  chemically synthesized
ttttgccctaatgcttaattta

SEQ ID NO: 1389153 - DNA, 22 bp, Artificial Sequence
  chemically synthesized
tgtgctacgctctaaattaagc

SEQ ID NO: 1389154 - DNA, 22 bp, Artificial Sequence
  chemically synthesized
tttgccctaatgcttaatttag

SEQ ID NO: 1389155 - DNA, 22 bp, Artificial Sequence
  chemically synthesized
ttgccctaatgcttaatttaga

SEQ ID NO: 1389156 - DNA, 22 bp, Artificial Sequence
  chemically synthesized
tgccctaatgcttaatttagag

SEQ ID NO: 1389157 - DNA, 22 bp, Artificial Sequence
  chemically synthesized
gccctaatgcttaatttagagc

SEQ ID NO: 1389158 - DNA, 22 bp, Artificial Sequence
  chemically synthesized
ccctaatgcttaatttagagcg

SEQ ID NO: 1389159 - DNA, 22 bp, Artificial Sequence
  chemically synthesized
atgcttaatttagagcgtagca

SEQ ID NO: 1389160 - DNA, 22 bp, Artificial Sequence
  chemically synthesized
ggaatatctatgtgctacgctc

SEQ ID NO: 1389161 - DNA, 22 bp, Artificial Sequence
  chemically synthesized
aatttagagcgtagcacataga

SEQ ID NO: 1389162 - DNA, 22 bp, Artificial Sequence
  chemically synthesized
atttagagcgtagcacatagat

SEQ ID NO: 1389163 - DNA, 22 bp, Artificial Sequence
  chemically synthesized
agagcgtagcacatagatattc

SEQ ID NO: 1389164 - DNA, 22 bp, Artificial Sequence
  chemically synthesized
gagcgtagcacatagatattcc

SEQ ID NO: 1389165 - DNA, 22 bp, Artificial Sequence
  chemically synthesized
atgagaacatattgggaatatc

SEQ ID NO: 1389166 - DNA, 22 bp, Artificial Sequence
  chemically synthesized
aatgagaacatattgggaatat

SEQ ID NO: 1389167 - DNA, 22 bp, Artificial Sequence
  chemically synthesized
taatgagaacatattgggaata

SEQ ID NO: 1389168 - DNA, 22 bp, Artificial Sequence
  chemically synthesized
ccaatatgttctcattaaaggt

SEQ ID NO: 1389169 - DNA, 22 bp, Artificial Sequence
  chemically synthesized
aaaatcaaagatcaataccttt

SEQ ID NO: 1389170 - DNA, 22 bp, Artificial Sequence
  chemically synthesized
aaaaatcaaagatcaatacctt

SEQ ID NO: 1389171 - DNA, 22 bp, Artificial Sequence
  chemically synthesized
taaaaatcaaagatcaatacct

SEQ ID NO: 1389172 - DNA, 22 bp, Artificial Sequence
  chemically synthesized
ttaaaaatcaaagatcaatacc

SEQ ID NO: 1389173 - DNA, 22 bp, Artificial Sequence
  chemically synthesized
cttttaaaaatcaaagatcaat

SEQ ID NO: 1389174 - DNA, 22 bp, Artificial Sequence
  chemically synthesized
tcattaaaggtattgatctttg

SEQ ID NO: 1389175 - DNA, 22 bp, Artificial Sequence
  chemically synthesized
acttttaaaaatcaaagatcaa

SEQ ID NO: 1389176 - DNA, 22 bp, Artificial Sequence
  chemically synthesized
attaaaggtattgatctttgat

SEQ ID NO: 1389177 - DNA, 22 bp, Artificial Sequence
  chemically synthesized
cttacttttaaaaatcaaagat

SEQ ID NO: 1389178 - DNA, 22 bp, Artificial Sequence
  chemically synthesized
aaggtattgatctttgattttt

SEQ ID NO: 1389179 - DNA, 22 bp, Artificial Sequence
  chemically synthesized
ttacttacttttaaaaatcaaa

SEQ ID NO: 1389180 - DNA, 22 bp, Artificial Sequence
  chemically synthesized
ttgttacttacttttaaaaatc

SEQ ID NO: 1389181 - DNA, 22 bp, Artificial Sequence
  chemically synthesized
gttgttacttacttttaaaaat

SEQ ID NO: 1389182 - DNA, 22 bp, Artificial Sequence
  chemically synthesized
tgttgttacttacttttaaaaa

SEQ ID NO: 1389183 - DNA, 22 bp, Artificial Sequence
  chemically synthesized
atctttgatttttaaaagtaag

SEQ ID NO: 1389184 - DNA, 22 bp, Artificial Sequence
  chemically synthesized
acagttttgttgttacttactt

SEQ ID NO: 1389185 - DNA, 22 bp, Artificial Sequence
  chemically synthesized
tgatttttaaaagtaagtaaca

SEQ ID NO: 1389186 - DNA, 22 bp, Artificial Sequence
  chemically synthesized
tcacagttttgttgttacttac

SEQ ID NO: 1389187 - DNA, 22 bp, Artificial Sequence
  chemically synthesized
gatttttaaaagtaagtaacaa

SEQ ID NO: 1389188 - DNA, 22 bp, Artificial Sequence
  chemically synthesized
atttttaaaagtaagtaacaac

SEQ ID NO: 1389189 - DNA, 22 bp, Artificial Sequence
  chemically synthesized
tctcacagttttgttgttactt

SEQ ID NO: 1389190 - DNA, 22 bp, Artificial Sequence
  chemically synthesized
ctctctcacagttttgttgtta

SEQ ID NO: 1389191 - DNA, 22 bp, Artificial Sequence
  chemically synthesized
ttaaaagtaagtaacaacaaaa

SEQ ID NO: 1389192 - DNA, 22 bp, Artificial Sequence
  chemically synthesized
taaaagtaagtaacaacaaaac

SEQ ID NO: 1389193 - DNA, 22 bp, Artificial Sequence
  chemically synthesized
aaaagtaagtaacaacaaaact

SEQ ID NO: 1389194 - DNA, 22 bp, Artificial Sequence
  chemically synthesized
ctcctctctcacagttttgttg

SEQ ID NO: 1389195 - DNA, 22 bp, Artificial Sequence
  chemically synthesized
aaagtaagtaacaacaaaactg

SEQ ID NO: 1389196 - DNA, 22 bp, Artificial Sequence
  chemically synthesized
aaaggaaaaagctgctcctctc

SEQ ID NO: 1389197 - DNA, 22 bp, Artificial Sequence
  chemically synthesized
tcaaaggaaaaagctgctcctc

SEQ ID NO: 1389198 - DNA, 22 bp, Artificial Sequence
  chemically synthesized
tgagagaggagcagctttttcc

SEQ ID NO: 1389199 - DNA, 22 bp, Artificial Sequence
  chemically synthesized
aaccacagttctcaaaggaaaa

SEQ ID NO: 1389200 - DNA, 22 bp, Artificial Sequence
  chemically synthesized
aaaccacagttctcaaaggaaa

SEQ ID NO: 1389201 - DNA, 22 bp, Artificial Sequence
  chemically synthesized
catttaaaccacagttctcaaa

SEQ ID NO: 1389202 - DNA, 22 bp, Artificial Sequence
  chemically synthesized
actgcatttaaaccacagttct

SEQ ID NO: 1389203 - DNA, 22 bp, Artificial Sequence
  chemically synthesized
tttcctttgagaactgtggttt

SEQ ID NO: 1389204 - DNA, 22 bp, Artificial Sequence
  chemically synthesized
ttcctttgagaactgtggttta

SEQ ID NO: 1389205 - DNA, 22 bp, Artificial Sequence
  chemically synthesized
tcctttgagaactgtggtttaa

SEQ ID NO: 1389206 - DNA, 22 bp, Artificial Sequence
  chemically synthesized
cctttgagaactgtggtttaaa

SEQ ID NO: 1389207 - DNA, 22 bp, Artificial Sequence
  chemically synthesized
ctttgagaactgtggtttaaat

SEQ ID NO: 1389208 - DNA, 22 bp, Artificial Sequence
  chemically synthesized
atacccctcactgcatttaaac

SEQ ID NO: 1389209 - DNA, 22 bp, Artificial Sequence
  chemically synthesized
tgagaactgtggtttaaatgca

SEQ ID NO: 1389210 - DNA, 22 bp, Artificial Sequence
  chemically synthesized
gagaactgtggtttaaatgcag

SEQ ID NO: 1389211 - DNA, 22 bp, Artificial Sequence
  chemically synthesized
agaactgtggtttaaatgcagt

SEQ ID NO: 1389212 - DNA, 22 bp, Artificial Sequence
  chemically synthesized
tggtttaaatgcagtgaggggt

SEQ ID NO: 1389213 - DNA, 22 bp, Artificial Sequence
  chemically synthesized
tgtagtcattaatacccctcac

SEQ ID NO: 1389214 - DNA, 22 bp, Artificial Sequence
  chemically synthesized
atgtagtcattaatacccctca

SEQ ID NO: 1389215 - DNA, 22 bp, Artificial Sequence
  chemically synthesized
aaatgcagtgaggggtattaat

SEQ ID NO: 1389216 - DNA, 22 bp, Artificial Sequence
  chemically synthesized
aatgcagtgaggggtattaatg

SEQ ID NO: 1389217 - DNA, 22 bp, Artificial Sequence
  chemically synthesized
aaataggaagtcatttatgtag

SEQ ID NO: 1389218 - DNA, 22 bp, Artificial Sequence
  chemically synthesized
actgaaataggaagtcatttat

SEQ ID NO: 1389219 - DNA, 22 bp, Artificial Sequence
  chemically synthesized
cactgaaataggaagtcattta

SEQ ID NO: 1389220 - DNA, 22 bp, Artificial Sequence
  chemically synthesized
atgactacataaatgacttcct

SEQ ID NO: 1389221 - DNA, 22 bp, Artificial Sequence
  chemically synthesized
aacacttcactgaaataggaag

SEQ ID NO: 1389222 - DNA, 22 bp, Artificial Sequence
  chemically synthesized
cataaatgacttcctatttcag

SEQ ID NO: 1389223 - DNA, 22 bp, Artificial Sequence
  chemically synthesized
ttaaacacttcactgaaatagg

SEQ ID NO: 1389224 - DNA, 22 bp, Artificial Sequence
  chemically synthesized
attaaacacttcactgaaatag

SEQ ID NO: 1389225 - DNA, 22 bp, Artificial Sequence
  chemically synthesized
aagaccttattaaacacttcac

SEQ ID NO: 1389226 - DNA, 22 bp, Artificial Sequence
  chemically synthesized
aaagaccttattaaacacttca

SEQ ID NO: 1389227 - DNA, 22 bp, Artificial Sequence
  chemically synthesized
taaagaccttattaaacacttc

SEQ ID NO: 1389228 - DNA, 22 bp, Artificial Sequence
  chemically synthesized
cctatttcagtgaagtgtttaa

SEQ ID NO: 1389229 - DNA, 22 bp, Artificial Sequence
  chemically synthesized
ctatttcagtgaagtgtttaat

SEQ ID NO: 1389230 - DNA, 22 bp, Artificial Sequence
  chemically synthesized
ttttaaagaccttattaaacac

SEQ ID NO: 1389231 - DNA, 22 bp, Artificial Sequence
  chemically synthesized
tttcagtgaagtgtttaataag

SEQ ID NO: 1389232 - DNA, 22 bp, Artificial Sequence
  chemically synthesized
cagtgaagtgtttaataaggtc

SEQ ID NO: 1389233 - DNA, 22 bp, Artificial Sequence
  chemically synthesized
agtgaagtgtttaataaggtct

SEQ ID NO: 1389234 - DNA, 22 bp, Artificial Sequence
  chemically synthesized
tgaagtactgttttaaagacct

SEQ ID NO: 1389235 - DNA, 22 bp, Artificial Sequence
  chemically synthesized
aataaggtctttaaaacagtac

SEQ ID NO: 1389236 - DNA, 22 bp, Artificial Sequence
  chemically synthesized
ataaggtctttaaaacagtact

SEQ ID NO: 1389237 - DNA, 22 bp, Artificial Sequence
  chemically synthesized
aagagcaggatgctatgaagta

SEQ ID NO: 1389238 - DNA, 22 bp, Artificial Sequence
  chemically synthesized
gaagagcaggatgctatgaagt

SEQ ID NO: 1389239 - DNA, 22 bp, Artificial Sequence
  chemically synthesized
tgaagagcaggatgctatgaag

SEQ ID NO: 1389240 - DNA, 22 bp, Artificial Sequence
  chemically synthesized
taaaacagtacttcatagcatc

SEQ ID NO: 1389241 - DNA, 22 bp, Artificial Sequence
  chemically synthesized
aaaacagtacttcatagcatcc

SEQ ID NO: 1389242 - DNA, 22 bp, Artificial Sequence
  chemically synthesized
ctttgaagagcaggatgctatg

SEQ ID NO: 1389243 - DNA, 22 bp, Artificial Sequence
  chemically synthesized
aaacagtacttcatagcatcct

SEQ ID NO: 1389244 - DNA, 22 bp, Artificial Sequence
  chemically synthesized
catagcatcctgctcttcaaag

SEQ ID NO: 1389245 - DNA, 22 bp, Artificial Sequence
  chemically synthesized
atagcatcctgctcttcaaagc

SEQ ID NO: 1389246 - DNA, 22 bp, Artificial Sequence
  chemically synthesized
ctcttcaaagcaacatctgtgg

SEQ ID NO: 1389247 - DNA, 22 bp, Artificial Sequence
  chemically synthesized
gaaccaaaaagagccacagatg

SEQ ID NO: 1389248 - DNA, 22 bp, Artificial Sequence
  chemically synthesized
ttcaaagcaacatctgtggctc

SEQ ID NO: 1389249 - DNA, 22 bp, Artificial Sequence
  chemically synthesized
ttggaaccaaaaagagccacag

SEQ ID NO: 1389250 - DNA, 22 bp, Artificial Sequence
  chemically synthesized
caaagcaacatctgtggctctt

SEQ ID NO: 1389251 - DNA, 22 bp, Artificial Sequence
  chemically synthesized
attggaaccaaaaagagccaca

SEQ ID NO: 1389252 - DNA, 22 bp, Artificial Sequence
  chemically synthesized
aaagcaacatctgtggctcttt

SEQ ID NO: 1389253 - DNA, 22 bp, Artificial Sequence
  chemically synthesized
tcacttattggaaccaaaaaga

SEQ ID NO: 1389254 - DNA, 22 bp, Artificial Sequence
  chemically synthesized
atcacttattggaaccaaaaag

SEQ ID NO: 1389255 - DNA, 22 bp, Artificial Sequence
  chemically synthesized
tttatcacttattggaaccaaa

SEQ ID NO: 1389256 - DNA, 22 bp, Artificial Sequence
  chemically synthesized
ttatttatcacttattggaacc

SEQ ID NO: 1389257 - DNA, 22 bp, Artificial Sequence
  chemically synthesized
tggctctttttggttccaataa

SEQ ID NO: 1389258 - DNA, 22 bp, Artificial Sequence
  chemically synthesized
ttgttatttatcacttattgga

SEQ ID NO: 1389259 - DNA, 22 bp, Artificial Sequence
  chemically synthesized
tttttggttccaataagtgata

SEQ ID NO: 1389260 - DNA, 22 bp, Artificial Sequence
  chemically synthesized
tttggttccaataagtgataaa

SEQ ID NO: 1389261 - DNA, 22 bp, Artificial Sequence
  chemically synthesized
ttggttccaataagtgataaat

SEQ ID NO: 1389262 - DNA, 22 bp, Artificial Sequence
  chemically synthesized
tggttccaataagtgataaata

SEQ ID NO: 1389263 - DNA, 22 bp, Artificial Sequence
  chemically synthesized
ggttccaataagtgataaataa

SEQ ID NO: 1389264 - DNA, 22 bp, Artificial Sequence
  chemically synthesized
gttccaataagtgataaataac

SEQ ID NO: 1389265 - DNA, 22 bp, Artificial Sequence
  chemically synthesized
caataagtgataaataacaaca

SEQ ID NO: 1389266 - DNA, 22 bp, Artificial Sequence
  chemically synthesized
cgtgaaccaaaatcctgttgtt

SEQ ID NO: 1389267 - DNA, 22 bp, Artificial Sequence
  chemically synthesized
acgtgaaccaaaatcctgttgt

SEQ ID NO: 1389268 - DNA, 22 bp, Artificial Sequence
  chemically synthesized
ggtccttacgtgaaccaaaatc

SEQ ID NO: 1389269 - DNA, 22 bp, Artificial Sequence
  chemically synthesized
aggtccttacgtgaaccaaaat

SEQ ID NO: 1389270 - DNA, 22 bp, Artificial Sequence
  chemically synthesized
taggtccttacgtgaaccaaaa

SEQ ID NO: 1389271 - DNA, 22 bp, Artificial Sequence
  chemically synthesized
ttttaggtccttacgtgaacca

SEQ ID NO: 1389272 - DNA, 22 bp, Artificial Sequence
  chemically synthesized
ctgttttaggtccttacgtgaa

SEQ ID NO: 1389273 - DNA, 22 bp, Artificial Sequence
  chemically synthesized
tcctgttttaggtccttacgtg

SEQ ID NO: 1389274 - DNA, 22 bp, Artificial Sequence
  chemically synthesized
tggttcacgtaaggacctaaaa

SEQ ID NO: 1389275 - DNA, 22 bp, Artificial Sequence
  chemically synthesized
ggttcacgtaaggacctaaaac

SEQ ID NO: 1389276 - DNA, 22 bp, Artificial Sequence
  chemically synthesized
accaactctcctgttttaggtc

SEQ ID NO: 1389277 - DNA, 22 bp, Artificial Sequence
  chemically synthesized
gttcacgtaaggacctaaaaca

SEQ ID NO: 1389278 - DNA, 22 bp, Artificial Sequence
  chemically synthesized
aaccaactctcctgttttaggt

SEQ ID NO: 1389279 - DNA, 22 bp, Artificial Sequence
  chemically synthesized
acgtaaggacctaaaacaggag

SEQ ID NO: 1389280 - DNA, 22 bp, Artificial Sequence
  chemically synthesized
aaacaggagagttggttaagct

SEQ ID NO: 1389281 - DNA, 22 bp, Artificial Sequence
  chemically synthesized
caaagcaacatgtatgaatagc

SEQ ID NO: 1389282 - DNA, 22 bp, Artificial Sequence
  chemically synthesized
gttaagctattcatacatgttg

SEQ ID NO: 1389283 - DNA, 22 bp, Artificial Sequence
  chemically synthesized
agctattcatacatgttgcttt

SEQ ID NO: 1389284 - DNA, 22 bp, Artificial Sequence
  chemically synthesized
catcagcccaattacaaagcaa

SEQ ID NO: 1389285 - DNA, 22 bp, Artificial Sequence
  chemically synthesized
ttcatacatgttgctttgtaat

SEQ ID NO: 1389286 - DNA, 22 bp, Artificial Sequence
  chemically synthesized
atacatgttgctttgtaattgg

SEQ ID NO: 1389287 - DNA, 22 bp, Artificial Sequence
  chemically synthesized
ctttgtaattgggctgatgtaa

SEQ ID NO: 1389288 - DNA, 22 bp, Artificial Sequence
  chemically synthesized
tgtaattgggctgatgtaattt

SEQ ID NO: 1389289 - DNA, 22 bp, Artificial Sequence
  chemically synthesized
gtaattgggctgatgtaatttt

SEQ ID NO: 1389290 - DNA, 22 bp, Artificial Sequence
  chemically synthesized
taattgggctgatgtaatttta

SEQ ID NO: 1389291 - DNA, 22 bp, Artificial Sequence
  chemically synthesized
aacacaataaaataaaattaca

SEQ ID NO: 1389292 - DNA, 22 bp, Artificial Sequence
  chemically synthesized
gaacacaataaaataaaattac

SEQ ID NO: 1389293 - DNA, 22 bp, Artificial Sequence
  chemically synthesized
tgaacacaataaaataaaatta

SEQ ID NO: 1389294 - DNA, 22 bp, Artificial Sequence
  chemically synthesized
ggctgatgtaattttattttat

SEQ ID NO: 1389295 - DNA, 22 bp, Artificial Sequence
  chemically synthesized
atgtaattttattttattgtgt

SEQ ID NO: 1389296 - DNA, 22 bp, Artificial Sequence
  chemically synthesized
tattttattgtgttcaaaattt

SEQ ID NO: 1389297 - DNA, 22 bp, Artificial Sequence
  chemically synthesized
attttattgtgttcaaaattta

SEQ ID NO: 1389298 - DNA, 22 bp, Artificial Sequence
  chemically synthesized
ttttattgtgttcaaaatttac

SEQ ID NO: 1389299 - DNA, 22 bp, Artificial Sequence
  chemically synthesized
acaaaataccagtgtaaatttt

SEQ ID NO: 1389300 - DNA, 22 bp, Artificial Sequence
  chemically synthesized
tattgtgttcaaaatttacact

SEQ ID NO: 1389301 - DNA, 22 bp, Artificial Sequence
  chemically synthesized
attgtgttcaaaatttacactg

SEQ ID NO: 1389302 - DNA, 22 bp, Artificial Sequence
  chemically synthesized
ttgtgttcaaaatttacactgg

SEQ ID NO: 1389303 - DNA, 22 bp, Artificial Sequence
  chemically synthesized
tgttcaaaatttacactggtat

SEQ ID NO: 1389304 - DNA, 22 bp, Artificial Sequence
  chemically synthesized
aaaatttacactggtattttgt

SEQ ID NO: 1389305 - DNA, 22 bp, Artificial Sequence
  chemically synthesized
agaaaaaaggtaattgacaaaa

SEQ ID NO: 1389306 - DNA, 22 bp, Artificial Sequence
  chemically synthesized
acactggtattttgtcaattac

SEQ ID NO: 1389307 - DNA, 22 bp, Artificial Sequence
  chemically synthesized
cactggtattttgtcaattacc

SEQ ID NO: 1389308 - DNA, 22 bp, Artificial Sequence
  chemically synthesized
taagttgagaaaaaaggtaatt

SEQ ID NO: 1389309 - DNA, 22 bp, Artificial Sequence
  chemically synthesized
gtaagttgagaaaaaaggtaat

SEQ ID NO: 1389310 - DNA, 22 bp, Artificial Sequence
  chemically synthesized
gtattttgtcaattaccttttt

SEQ ID NO: 1389311 - DNA, 22 bp, Artificial Sequence
  chemically synthesized
tgtaagttgagaaaaaaggtaa

SEQ ID NO: 1389312 - DNA, 22 bp, Artificial Sequence
  chemically synthesized
tgtcaattaccttttttctcaa

SEQ ID NO: 1389313 - DNA, 22 bp, Artificial Sequence
  chemically synthesized
gtcaattaccttttttctcaac

SEQ ID NO: 1389314 - DNA, 22 bp, Artificial Sequence
  chemically synthesized
tcaattaccttttttctcaact

SEQ ID NO: 1389315 - DNA, 22 bp, Artificial Sequence
  chemically synthesized
aaaatgtactttgtaagttgag

SEQ ID NO: 1389316 - DNA, 22 bp, Artificial Sequence
  chemically synthesized
aaaaatgtactttgtaagttga

SEQ ID NO: 1389317 - DNA, 22 bp, Artificial Sequence
  chemically synthesized
taaaaatgtactttgtaagttg

SEQ ID NO: 1389318 - DNA, 22 bp, Artificial Sequence
  chemically synthesized
ttaaaaatgtactttgtaagtt

SEQ ID NO: 1389319 - DNA, 22 bp, Artificial Sequence
  chemically synthesized
ccttttttctcaacttacaaag

SEQ ID NO: 1389320 - DNA, 22 bp, Artificial Sequence
  chemically synthesized
tttaaaaatgtactttgtaagt

SEQ ID NO: 1389321 - DNA, 22 bp, Artificial Sequence
  chemically synthesized
ttttaaaaatgtactttgtaag

SEQ ID NO: 1389322 - DNA, 22 bp, Artificial Sequence
  chemically synthesized
ttttttaaaaatgtactttgta

SEQ ID NO: 1389323 - DNA, 22 bp, Artificial Sequence
  chemically synthesized
ttttctcaacttacaaagtaca

SEQ ID NO: 1389324 - DNA, 22 bp, Artificial Sequence
  chemically synthesized
cttttttaaaaatgtactttgt

SEQ ID NO: 1389325 - DNA, 22 bp, Artificial Sequence
  chemically synthesized
tttctcaacttacaaagtacat

SEQ ID NO: 1389326 - DNA, 22 bp, Artificial Sequence
  chemically synthesized
tcttttttaaaaatgtactttg

SEQ ID NO: 1389327 - DNA, 22 bp, Artificial Sequence
  chemically synthesized
ttctcaacttacaaagtacatt

SEQ ID NO: 1389328 - DNA, 22 bp, Artificial Sequence
  chemically synthesized
tctcaacttacaaagtacattt

SEQ ID NO: 1389329 - DNA, 22 bp, Artificial Sequence
  chemically synthesized
ctcaacttacaaagtacatttt

SEQ ID NO: 1389330 - DNA, 22 bp, Artificial Sequence
  chemically synthesized
tcaacttacaaagtacattttt

SEQ ID NO: 1389331 - DNA, 22 bp, Artificial Sequence
  chemically synthesized
aacttacaaagtacatttttaa

SEQ ID NO: 1389332 - DNA, 22 bp, Artificial Sequence
  chemically synthesized
tatatggttttcttttttaaaa

SEQ ID NO: 1389333 - DNA, 22 bp, Artificial Sequence
  chemically synthesized
acaaagtacatttttaaaaaag

SEQ ID NO: 1389334 - DNA, 22 bp, Artificial Sequence
  chemically synthesized
gtatatggttttcttttttaaa

SEQ ID NO: 1389335 - DNA, 22 bp, Artificial Sequence
  chemically synthesized
caaagtacatttttaaaaaaga

SEQ ID NO: 1389336 - DNA, 22 bp, Artificial Sequence
  chemically synthesized
tgtatatggttttcttttttaa

SEQ ID NO: 1389337 - DNA, 22 bp, Artificial Sequence
  chemically synthesized
tgctttgtatatggttttcttt

SEQ ID NO: 1389338 - DNA, 22 bp, Artificial Sequence
  chemically synthesized
ttaaaaaagaaaaccatataca

SEQ ID NO: 1389339 - DNA, 22 bp, Artificial Sequence
  chemically synthesized
taaaaaagaaaaccatatacaa

SEQ ID NO: 1389340 - DNA, 22 bp, Artificial Sequence
  chemically synthesized
aaaaaagaaaaccatatacaaa

SEQ ID NO: 1389341 - DNA, 22 bp, Artificial Sequence
  chemically synthesized
cacaacctatgctttgtatatg

SEQ ID NO: 1389342 - DNA, 22 bp, Artificial Sequence
  chemically synthesized
aaaaagaaaaccatatacaaag

SEQ ID NO: 1389343 - DNA, 22 bp, Artificial Sequence
  chemically synthesized
tattacacaacctatgctttgt

SEQ ID NO: 1389344 - DNA, 22 bp, Artificial Sequence
  chemically synthesized
attatattacacaacctatgct

SEQ ID NO: 1389345 - DNA, 22 bp, Artificial Sequence
  chemically synthesized
gttcattatattacacaaccta

SEQ ID NO: 1389346 - DNA, 22 bp, Artificial Sequence
  chemically synthesized
tgtaatataatgaaccagtcat

SEQ ID NO: 1389347 - DNA, 22 bp, Artificial Sequence
  chemically synthesized
aatagagagataagaagaataa

SEQ ID NO: 1389348 - DNA, 22 bp, Artificial Sequence
  chemically synthesized
aaatagagagataagaagaata

SEQ ID NO: 1389349 - DNA, 22 bp, Artificial Sequence
  chemically synthesized
tgatttaaatagagagataaga

SEQ ID NO: 1389350 - DNA, 22 bp, Artificial Sequence
  chemically synthesized
aaatctatgatttaaatagaga

SEQ ID NO: 1389351 - DNA, 22 bp, Artificial Sequence
  chemically synthesized
ttcttcttatctctctatttaa

SEQ ID NO: 1389352 - DNA, 22 bp, Artificial Sequence
  chemically synthesized
gaaatctatgatttaaatagag

SEQ ID NO: 1389353 - DNA, 22 bp, Artificial Sequence
  chemically synthesized
tgaaatctatgatttaaataga

SEQ ID NO: 1389354 - DNA, 22 bp, Artificial Sequence
  chemically synthesized
ttgaaatctatgatttaaatag

SEQ ID NO: 1389355 - DNA, 22 bp, Artificial Sequence
  chemically synthesized
ttcttatctctctatttaaatc

SEQ ID NO: 1389356 - DNA, 22 bp, Artificial Sequence
  chemically synthesized
tttgaaatctatgatttaaata

SEQ ID NO: 1389357 - DNA, 22 bp, Artificial Sequence
  chemically synthesized
cttatctctctatttaaatcat

SEQ ID NO: 1389358 - DNA, 22 bp, Artificial Sequence
  chemically synthesized
ttatctctctatttaaatcata

SEQ ID NO: 1389359 - DNA, 22 bp, Artificial Sequence
  chemically synthesized
atctctctatttaaatcataga

SEQ ID NO: 1389360 - DNA, 22 bp, Artificial Sequence
  chemically synthesized
aactttttgaaatctatgattt

SEQ ID NO: 1389361 - DNA, 22 bp, Artificial Sequence
  chemically synthesized
tctctctatttaaatcatagat

SEQ ID NO: 1389362 - DNA, 22 bp, Artificial Sequence
  chemically synthesized
tctatttaaatcatagatttca

SEQ ID NO: 1389363 - DNA, 22 bp, Artificial Sequence
  chemically synthesized
gtattaaactttttgaaatcta

SEQ ID NO: 1389364 - DNA, 22 bp, Artificial Sequence
  chemically synthesized
tatttaaatcatagatttcaaa

SEQ ID NO: 1389365 - DNA, 22 bp, Artificial Sequence
  chemically synthesized
tttaaatcatagatttcaaaaa

SEQ ID NO: 1389366 - DNA, 22 bp, Artificial Sequence
  chemically synthesized
aaatcatagatttcaaaaagtt

SEQ ID NO: 1389367 - DNA, 22 bp, Artificial Sequence
  chemically synthesized
aatcatagatttcaaaaagttt

SEQ ID NO: 1389368 - DNA, 22 bp, Artificial Sequence
  chemically synthesized
caaaaagtttaatacgaattca

SEQ ID NO: 1389369 - DNA, 22 bp, Artificial Sequence
  chemically synthesized
aaaaagtttaatacgaattcat

SEQ ID NO: 1389370 - DNA, 22 bp, Artificial Sequence
  chemically synthesized
aatacgaattcatttgtgtgtg

SEQ ID NO: 1389371 - DNA, 22 bp, Artificial Sequence
  chemically synthesized
atacgaattcatttgtgtgtgt

SEQ ID NO: 1389372 - DNA, 22 bp, Artificial Sequence
  chemically synthesized
taacacacacacacacacacac

SEQ ID NO: 1389373 - DNA, 22 bp, Artificial Sequence
  chemically synthesized
cattataacacacacacacaca

SEQ ID NO: 1389374 - DNA, 22 bp, Artificial Sequence
  chemically synthesized
atttgtgtgtgtgtgtgtgtgt

SEQ ID NO: 1389375 - DNA, 22 bp, Artificial Sequence
  chemically synthesized
cactacattataacacacacac

SEQ ID NO: 1389376 - DNA, 22 bp, Artificial Sequence
  chemically synthesized
gtgtgtgtgtgtgtgtgtgtta

SEQ ID NO: 1389377 - DNA, 22 bp, Artificial Sequence
  chemically synthesized
tccactacattataacacacac

SEQ ID NO: 1389378 - DNA, 22 bp, Artificial Sequence
  chemically synthesized
tgtgtgtgtgtgtgtgtgttat

SEQ ID NO: 1389379 - DNA, 22 bp, Artificial Sequence
  chemically synthesized
ctccactacattataacacaca

SEQ ID NO: 1389380 - DNA, 22 bp, Artificial Sequence
  chemically synthesized
cttctccactacattataacac

SEQ ID NO: 1389381 - DNA, 22 bp, Artificial Sequence
  chemically synthesized
gcttctccactacattataaca

SEQ ID NO: 1389382 - DNA, 22 bp, Artificial Sequence
  chemically synthesized
aatgtatcaagtttgcttctcc

SEQ ID NO: 1389383 - DNA, 22 bp, Artificial Sequence
  chemically synthesized
taatgtagtggagaagcaaact

SEQ ID NO: 1389384 - DNA, 22 bp, Artificial Sequence
  chemically synthesized
cagcattaaatgtatcaagttt

SEQ ID NO: 1389385 - DNA, 22 bp, Artificial Sequence
  chemically synthesized
gatacatttaatgctgtaacat

SEQ ID NO: 1389386 - DNA, 22 bp, Artificial Sequence
  chemically synthesized
atacatttaatgctgtaacatt

SEQ ID NO: 1389387 - DNA, 22 bp, Artificial Sequence
  chemically synthesized
tgaatgcatcaatatgtaatgt

SEQ ID NO: 1389388 - DNA, 22 bp, Artificial Sequence
  chemically synthesized
aatgctgtaacattacatattg

SEQ ID NO: 1389389 - DNA, 22 bp, Artificial Sequence
  chemically synthesized
atgctgtaacattacatattga

SEQ ID NO: 1389390 - DNA, 22 bp, Artificial Sequence
  chemically synthesized
aattatgaatgcatcaatatgt

SEQ ID NO: 1389391 - DNA, 22 bp, Artificial Sequence
  chemically synthesized
gaattatgaatgcatcaatatg

SEQ ID NO: 1389392 - DNA, 22 bp, Artificial Sequence
  chemically synthesized
tgaattatgaatgcatcaatat

SEQ ID NO: 1389393 - DNA, 22 bp, Artificial Sequence
  chemically synthesized
taacattacatattgatgcatt

SEQ ID NO: 1389394 - DNA, 22 bp, Artificial Sequence
  chemically synthesized
ctttgaattatgaatgcatcaa

SEQ ID NO: 1389395 - DNA, 22 bp, Artificial Sequence
  chemically synthesized
catattgatgcattcataattc

SEQ ID NO: 1389396 - DNA, 22 bp, Artificial Sequence
  chemically synthesized
tcatgttactttgaattatgaa

SEQ ID NO: 1389397 - DNA, 22 bp, Artificial Sequence
  chemically synthesized
tatcatgttactttgaattatg

SEQ ID NO: 1389398 - DNA, 22 bp, Artificial Sequence
  chemically synthesized
ctatcatgttactttgaattat

SEQ ID NO: 1389399 - DNA, 22 bp, Artificial Sequence
  chemically synthesized
tctatcatgttactttgaatta

SEQ ID NO: 1389400 - DNA, 22 bp, Artificial Sequence
  chemically synthesized
tttctatcatgttactttgaat

SEQ ID NO: 1389401 - DNA, 22 bp, Artificial Sequence
  chemically synthesized
atgcattcataattcaaagtaa

SEQ ID NO: 1389402 - DNA, 22 bp, Artificial Sequence
  chemically synthesized
ctttctatcatgttactttgaa

SEQ ID NO: 1389403 - DNA, 22 bp, Artificial Sequence
  chemically synthesized
ataattcaaagtaacatgatag

SEQ ID NO: 1389404 - DNA, 22 bp, Artificial Sequence
  chemically synthesized
acatgtatgtttctttctatca

SEQ ID NO: 1389405 - DNA, 22 bp, Artificial Sequence
  chemically synthesized
cacatgtatgtttctttctatc

SEQ ID NO: 1389406 - DNA, 22 bp, Artificial Sequence
  chemically synthesized
aaagtaacatgatagaaagaaa

SEQ ID NO: 1389407 - DNA, 22 bp, Artificial Sequence
  chemically synthesized
atgccttcacatgtatgtttct

SEQ ID NO: 1389408 - DNA, 22 bp, Artificial Sequence
  chemically synthesized
aatgccttcacatgtatgtttc

SEQ ID NO: 1389409 - DNA, 22 bp, Artificial Sequence
  chemically synthesized
taatgccttcacatgtatgttt

SEQ ID NO: 1389410 - DNA, 22 bp, Artificial Sequence
  chemically synthesized
ttaatgccttcacatgtatgtt

SEQ ID NO: 1389411 - DNA, 22 bp, Artificial Sequence
  chemically synthesized
caaacaaaaatgtttttaatgc

SEQ ID NO: 1389412 - DNA, 22 bp, Artificial Sequence
  chemically synthesized
acaaacaaaaatgtttttaatg

SEQ ID NO: 1389413 - DNA, 22 bp, Artificial Sequence
  chemically synthesized
aaaatccttacaaacaaaaatg

SEQ ID NO: 1389414 - DNA, 22 bp, Artificial Sequence
  chemically synthesized
caaaatccttacaaacaaaaat

SEQ ID NO: 1389415 - DNA, 22 bp, Artificial Sequence
  chemically synthesized
aaaacatttttgtttgtaagga

SEQ ID NO: 1389416 - DNA, 22 bp, Artificial Sequence
  chemically synthesized
caagtttcaaaatccttacaaa

SEQ ID NO: 1389417 - DNA, 22 bp, Artificial Sequence
  chemically synthesized
atcctccaagtttcaaaatcct

SEQ ID NO: 1389418 - DNA, 22 bp, Artificial Sequence
  chemically synthesized
gatcctccaagtttcaaaatcc

SEQ ID NO: 1389419 - DNA, 22 bp, Artificial Sequence
  chemically synthesized
ttgtttgtaaggattttgaaac

SEQ ID NO: 1389420 - DNA, 22 bp, Artificial Sequence
  chemically synthesized
tgtttgtaaggattttgaaact

SEQ ID NO: 1389421 - DNA, 22 bp, Artificial Sequence
  chemically synthesized
tttgatcctccaagtttcaaaa

SEQ ID NO: 1389422 - DNA, 22 bp, Artificial Sequence
  chemically synthesized
gtttgtaaggattttgaaactt

SEQ ID NO: 1389423 - DNA, 22 bp, Artificial Sequence
  chemically synthesized
tttgtaaggattttgaaacttg

SEQ ID NO: 1389424 - DNA, 22 bp, Artificial Sequence
  chemically synthesized
gtaaggattttgaaacttggag

SEQ ID NO: 1389425 - DNA, 22 bp, Artificial Sequence
  chemically synthesized
tattatttgatcctccaagttt

SEQ ID NO: 1389426 - DNA, 22 bp, Artificial Sequence
  chemically synthesized
taaggattttgaaacttggagg

SEQ ID NO: 1389427 - DNA, 22 bp, Artificial Sequence
  chemically synthesized
agttatattatttgatcctcca

SEQ ID NO: 1389428 - DNA, 22 bp, Artificial Sequence
  chemically synthesized
tgagttatattatttgatcctc

SEQ ID NO: 1389429 - DNA, 22 bp, Artificial Sequence
  chemically synthesized
tgaaacttggaggatcaaataa

SEQ ID NO: 1389430 - DNA, 22 bp, Artificial Sequence
  chemically synthesized
gaaacttggaggatcaaataat

SEQ ID NO: 1389431 - DNA, 22 bp, Artificial Sequence
  chemically synthesized
aaacttggaggatcaaataata

SEQ ID NO: 1389432 - DNA, 22 bp, Artificial Sequence
  chemically synthesized
ggaggatcaaataatataactc

SEQ ID NO: 1389433 - DNA, 22 bp, Artificial Sequence
  chemically synthesized
gaggatcaaataatataactca

SEQ ID NO: 1389434 - DNA, 22 bp, Artificial Sequence
  chemically synthesized
acagaaagaattctgagttata

SEQ ID NO: 1389435 - DNA, 22 bp, Artificial Sequence
  chemically synthesized
gacagaaagaattctgagttat

SEQ ID NO: 1389436 - DNA, 22 bp, Artificial Sequence
  chemically synthesized
tgacagaaagaattctgagtta

SEQ ID NO: 1389437 - DNA, 22 bp, Artificial Sequence
  chemically synthesized
ttttgacagaaagaattctgag

SEQ ID NO: 1389438 - DNA, 22 bp, Artificial Sequence
  chemically synthesized
cacattattttgacagaaagaa

SEQ ID NO: 1389439 - DNA, 22 bp, Artificial Sequence
  chemically synthesized
ttccacattattttgacagaaa

SEQ ID NO: 1389440 - DNA, 22 bp, Artificial Sequence
  chemically synthesized
gttccacattattttgacagaa

SEQ ID NO: 1389441 - DNA, 22 bp, Artificial Sequence
  chemically synthesized
ttgttccacattattttgacag

SEQ ID NO: 1389442 - DNA, 22 bp, Artificial Sequence
  chemically synthesized
cttgttccacattattttgaca

SEQ ID NO: 1389443 - DNA, 22 bp, Artificial Sequence
  chemically synthesized
agaattctttctgtcaaaataa

SEQ ID NO: 1389444 - DNA, 22 bp, Artificial Sequence
  chemically synthesized
tttctgtcaaaataatgtggaa

SEQ ID NO: 1389445 - DNA, 22 bp, Artificial Sequence
  chemically synthesized
gtgtgtttcttgttccacatta

SEQ ID NO: 1389446 - DNA, 22 bp, Artificial Sequence
  chemically synthesized
agtgtgtttcttgttccacatt

SEQ ID NO: 1389447 - DNA, 22 bp, Artificial Sequence
  chemically synthesized
tctgtcaaaataatgtggaaca

SEQ ID NO: 1389448 - DNA, 22 bp, Artificial Sequence
  chemically synthesized
ctgtcaaaataatgtggaacaa

SEQ ID NO: 1389449 - DNA, 22 bp, Artificial Sequence
  chemically synthesized
tgtcaaaataatgtggaacaag

SEQ ID NO: 1389450 - DNA, 22 bp, Artificial Sequence
  chemically synthesized
tttagtgtgtttcttgttccac

SEQ ID NO: 1389451 - DNA, 22 bp, Artificial Sequence
  chemically synthesized
gtttagtgtgtttcttgttcca

SEQ ID NO: 1389452 - DNA, 22 bp, Artificial Sequence
  chemically synthesized
tcaaaataatgtggaacaagaa

SEQ ID NO: 1389453 - DNA, 22 bp, Artificial Sequence
  chemically synthesized
ttgtttagtgtgtttcttgttc

SEQ ID NO: 1389454 - DNA, 22 bp, Artificial Sequence
  chemically synthesized
ccaaatatctcttgtttagtgt

SEQ ID NO: 1389455 - DNA, 22 bp, Artificial Sequence
  chemically synthesized
cccaaatatctcttgtttagtg

SEQ ID NO: 1389456 - DNA, 22 bp, Artificial Sequence
  chemically synthesized
agtagaacttcccaaatatctc

SEQ ID NO: 1389457 - DNA, 22 bp, Artificial Sequence
  chemically synthesized
aacaagagatatttgggaagtt

SEQ ID NO: 1389458 - DNA, 22 bp, Artificial Sequence
  chemically synthesized
tggactgagtagaacttcccaa

SEQ ID NO: 1389459 - DNA, 22 bp, Artificial Sequence
  chemically synthesized
gggaagttctactcagtccata

SEQ ID NO: 1389460 - DNA, 22 bp, Artificial Sequence
  chemically synthesized
ggaagttctactcagtccataa

SEQ ID NO: 1389461 - DNA, 22 bp, Artificial Sequence
  chemically synthesized
tactcagtccataatttttctc

SEQ ID NO: 1389462 - DNA, 22 bp, Artificial Sequence
  chemically synthesized
ctcagtccataatttttctccc

SEQ ID NO: 1389463 - DNA, 22 bp, Artificial Sequence
  chemically synthesized
agtccataatttttctcccttc

SEQ ID NO: 1389464 - DNA, 22 bp, Artificial Sequence
  chemically synthesized
gagggtgatagtcgccagagaa

SEQ ID NO: 1389465 - DNA, 22 bp, Artificial Sequence
  chemically synthesized
actggagggtgatagtcgccag

SEQ ID NO: 1389466 - DNA, 22 bp, Artificial Sequence
  chemically synthesized
ttctcccttctctggcgactat

SEQ ID NO: 1389467 - DNA, 22 bp, Artificial Sequence
  chemically synthesized
gactggagggtgatagtcgcca

SEQ ID NO: 1389468 - DNA, 22 bp, Artificial Sequence
  chemically synthesized
tctcccttctctggcgactatc

SEQ ID NO: 1389469 - DNA, 22 bp, Artificial Sequence
  chemically synthesized
ctcccttctctggcgactatca

SEQ ID NO: 1389470 - DNA, 22 bp, Artificial Sequence
  chemically synthesized
tcccttctctggcgactatcac

SEQ ID NO: 1389471 - DNA, 22 bp, Artificial Sequence
  chemically synthesized
tttgactggagggtgatagtcg

SEQ ID NO: 1389472 - DNA, 22 bp, Artificial Sequence
  chemically synthesized
ccttctctggcgactatcaccc

SEQ ID NO: 1389473 - DNA, 22 bp, Artificial Sequence
  chemically synthesized
ctctggcgactatcaccctcca

SEQ ID NO: 1389474 - DNA, 22 bp, Artificial Sequence
  chemically synthesized
tctggcgactatcaccctccag

SEQ ID NO: 1389475 - DNA, 22 bp, Artificial Sequence
  chemically synthesized
tggattgtttgactggagggtg

SEQ ID NO: 1389476 - DNA, 22 bp, Artificial Sequence
  chemically synthesized
atggattgtttgactggagggt

SEQ ID NO: 1389477 - DNA, 22 bp, Artificial Sequence
  chemically synthesized
tggcgactatcaccctccagtc

SEQ ID NO: 1389478 - DNA, 22 bp, Artificial Sequence
  chemically synthesized
gcgactatcaccctccagtcaa

SEQ ID NO: 1389479 - DNA, 22 bp, Artificial Sequence
  chemically synthesized
cttatggattgtttgactggag

SEQ ID NO: 1389480 - DNA, 22 bp, Artificial Sequence
  chemically synthesized
tgcttatggattgtttgactgg

SEQ ID NO: 1389481 - DNA, 22 bp, Artificial Sequence
  chemically synthesized
tcaccctccagtcaaacaatcc

SEQ ID NO: 1389482 - DNA, 22 bp, Artificial Sequence
  chemically synthesized
cagtcaaacaatccataagcag

SEQ ID NO: 1389483 - DNA, 22 bp, Artificial Sequence
  chemically synthesized
gaggcaaatatcacacaataca

SEQ ID NO: 1389484 - DNA, 22 bp, Artificial Sequence
  chemically synthesized
gatatcatgtttgtattgtgtg

SEQ ID NO: 1389485 - DNA, 22 bp, Artificial Sequence
  chemically synthesized
atatcatgtttgtattgtgtga

SEQ ID NO: 1389486 - DNA, 22 bp, Artificial Sequence
  chemically synthesized
tcctagaggcaaatatcacaca

SEQ ID NO: 1389487 - DNA, 22 bp, Artificial Sequence
  chemically synthesized
gtcctagaggcaaatatcacac

SEQ ID NO: 1389488 - DNA, 22 bp, Artificial Sequence
  chemically synthesized
gtattgtgtgatatttgcctct

SEQ ID NO: 1389489 - DNA, 22 bp, Artificial Sequence
  chemically synthesized
tattgtgtgatatttgcctcta

SEQ ID NO: 1389490 - DNA, 22 bp, Artificial Sequence
  chemically synthesized
tgtgatatttgcctctaggaca

SEQ ID NO: 1389491 - DNA, 22 bp, Artificial Sequence
  chemically synthesized
gtccagtcagccttgtcctaga

SEQ ID NO: 1389492 - DNA, 22 bp, Artificial Sequence
  chemically synthesized
ggtccagtcagccttgtcctag

SEQ ID NO: 1389493 - DNA, 22 bp, Artificial Sequence
  chemically synthesized
aatcttggtccagtcagccttg

SEQ ID NO: 1389494 - DNA, 22 bp, Artificial Sequence
  chemically synthesized
gcctctaggacaaggctgactg

SEQ ID NO: 1389495 - DNA, 22 bp, Artificial Sequence
  chemically synthesized
cctctaggacaaggctgactgg

SEQ ID NO: 1389496 - DNA, 22 bp, Artificial Sequence
  chemically synthesized
taggacaaggctgactggacca

SEQ ID NO: 1389497 - DNA, 22 bp, Artificial Sequence
  chemically synthesized
ggacaaggctgactggaccaag

SEQ ID NO: 1389498 - DNA, 22 bp, Artificial Sequence
  chemically synthesized
aatcaggcctcaatcttggtcc

SEQ ID NO: 1389499 - DNA, 22 bp, Artificial Sequence
  chemically synthesized
caagttgaatcaggcctcaatc

SEQ ID NO: 1389500 - DNA, 22 bp, Artificial Sequence
  chemically synthesized
actggaccaagattgaggcctg

SEQ ID NO: 1389501 - DNA, 22 bp, Artificial Sequence
  chemically synthesized
ttccaagttgaatcaggcctca

SEQ ID NO: 1389502 - DNA, 22 bp, Artificial Sequence
  chemically synthesized
gttccaagttgaatcaggcctc

SEQ ID NO: 1389503 - DNA, 22 bp, Artificial Sequence
  chemically synthesized
gaccaagattgaggcctgattc

SEQ ID NO: 1389504 - DNA, 22 bp, Artificial Sequence
  chemically synthesized
tttgttccaagttgaatcaggc

SEQ ID NO: 1389505 - DNA, 22 bp, Artificial Sequence
  chemically synthesized
aggcctgattcaacttggaaca

SEQ ID NO: 1389506 - DNA, 22 bp, Artificial Sequence
  chemically synthesized
ggaagtgcatctgtttgttcca

SEQ ID NO: 1389507 - DNA, 22 bp, Artificial Sequence
  chemically synthesized
aggaagtgcatctgtttgttcc

SEQ ID NO: 1389508 - DNA, 22 bp, Artificial Sequence
  chemically synthesized
taggaagtgcatctgtttgttc

SEQ ID NO: 1389509 - DNA, 22 bp, Artificial Sequence
  chemically synthesized
attcaacttggaacaaacagat

SEQ ID NO: 1389510 - DNA, 22 bp, Artificial Sequence
  chemically synthesized
aacttggaacaaacagatgcac

SEQ ID NO: 1389511 - DNA, 22 bp, Artificial Sequence
  chemically synthesized
ggaacaaacagatgcacttcct

SEQ ID NO: 1389512 - DNA, 22 bp, Artificial Sequence
  chemically synthesized
gaacaaacagatgcacttccta

SEQ ID NO: 1389513 - DNA, 22 bp, Artificial Sequence
  chemically synthesized
aggtaaagtattttaggaagtg

SEQ ID NO: 1389514 - DNA, 22 bp, Artificial Sequence
  chemically synthesized
tgagtctcaggtaaagtatttt

SEQ ID NO: 1389515 - DNA, 22 bp, Artificial Sequence
  chemically synthesized
atgagtctcaggtaaagtattt

SEQ ID NO: 1389516 - DNA, 22 bp, Artificial Sequence
  chemically synthesized
tatgagtctcaggtaaagtatt

SEQ ID NO: 1389517 - DNA, 22 bp, Artificial Sequence
  chemically synthesized
attttatgagtctcaggtaaag

SEQ ID NO: 1389518 - DNA, 22 bp, Artificial Sequence
  chemically synthesized
tcattttatgagtctcaggtaa

SEQ ID NO: 1389519 - DNA, 22 bp, Artificial Sequence
  chemically synthesized
cctaaaatactttacctgagac

SEQ ID NO: 1389520 - DNA, 22 bp, Artificial Sequence
  chemically synthesized
ctaaaatactttacctgagact

SEQ ID NO: 1389521 - DNA, 22 bp, Artificial Sequence
  chemically synthesized
aaatactttacctgagactcat

SEQ ID NO: 1389522 - DNA, 22 bp, Artificial Sequence
  chemically synthesized
cacaaattctcattttatgagt

SEQ ID NO: 1389523 - DNA, 22 bp, Artificial Sequence
  chemically synthesized
tacctgagactcataaaatgag

SEQ ID NO: 1389524 - DNA, 22 bp, Artificial Sequence
  chemically synthesized
attgcacaaattctcattttat

SEQ ID NO: 1389525 - DNA, 22 bp, Artificial Sequence
  chemically synthesized
acctgagactcataaaatgaga

SEQ ID NO: 1389526 - DNA, 22 bp, Artificial Sequence
  chemically synthesized
cctgagactcataaaatgagaa

SEQ ID NO: 1389527 - DNA, 22 bp, Artificial Sequence
  chemically synthesized
agactcataaaatgagaatttg

SEQ ID NO: 1389528 - DNA, 22 bp, Artificial Sequence
  chemically synthesized
agaatgactcattgcacaaatt

SEQ ID NO: 1389529 - DNA, 22 bp, Artificial Sequence
  chemically synthesized
ataaaatgagaatttgtgcaat

SEQ ID NO: 1389530 - DNA, 22 bp, Artificial Sequence
  chemically synthesized
ctaagaatgactcattgcacaa

SEQ ID NO: 1389531 - DNA, 22 bp, Artificial Sequence
  chemically synthesized
gtgcaatgagtcattcttagta

SEQ ID NO: 1389532 - DNA, 22 bp, Artificial Sequence
  chemically synthesized
tgcaatgagtcattcttagtag

SEQ ID NO: 1389533 - DNA, 22 bp, Artificial Sequence
  chemically synthesized
catagtggtatgctactaagaa

SEQ ID NO: 1389534 - DNA, 22 bp, Artificial Sequence
  chemically synthesized
ttagtagcataccactatggag

SEQ ID NO: 1389535 - DNA, 22 bp, Artificial Sequence
  chemically synthesized
agtagcataccactatggagat

SEQ ID NO: 1389536 - DNA, 22 bp, Artificial Sequence
  chemically synthesized
gtagcataccactatggagatg

SEQ ID NO: 1389537 - DNA, 22 bp, Artificial Sequence
  chemically synthesized
tggagatggcctatggccccat

SEQ ID NO: 1389538 - DNA, 22 bp, Artificial Sequence
  chemically synthesized
caggccatgggaatgatggggc

SEQ ID NO: 1389539 - DNA, 22 bp, Artificial Sequence
  chemically synthesized
acctacaggccatgggaatgat

SEQ ID NO: 1389540 - DNA, 22 bp, Artificial Sequence
  chemically synthesized
aacctacaggccatgggaatga

SEQ ID NO: 1389541 - DNA, 22 bp, Artificial Sequence
  chemically synthesized
tggccccatcattcccatggcc

SEQ ID NO: 1389542 - DNA, 22 bp, Artificial Sequence
  chemically synthesized
ccatggcctgtaggttaaattt

SEQ ID NO: 1389543 - DNA, 22 bp, Artificial Sequence
  chemically synthesized
gtagaacccaagaaaaatttaa

SEQ ID NO: 1389544 - DNA, 22 bp, Artificial Sequence
  chemically synthesized
ctggtagaacccaagaaaaatt

SEQ ID NO: 1389545 - DNA, 22 bp, Artificial Sequence
  chemically synthesized
tctactggtagaacccaagaaa

SEQ ID NO: 1389546 - DNA, 22 bp, Artificial Sequence
  chemically synthesized
taggttaaatttttcttgggtt

SEQ ID NO: 1389547 - DNA, 22 bp, Artificial Sequence
  chemically synthesized
gattatctactggtagaaccca

SEQ ID NO: 1389548 - DNA, 22 bp, Artificial Sequence
  chemically synthesized
tggattatctactggtagaacc

SEQ ID NO: 1389549 - DNA, 22 bp, Artificial Sequence
  chemically synthesized
aatttttcttgggttctaccag

SEQ ID NO: 1389550 - DNA, 22 bp, Artificial Sequence
  chemically synthesized
ttcttgggttctaccagtagat

SEQ ID NO: 1389551 - DNA, 22 bp, Artificial Sequence
  chemically synthesized
tcttgggttctaccagtagata

SEQ ID NO: 1389552 - DNA, 22 bp, Artificial Sequence
  chemically synthesized
cttgggttctaccagtagataa

SEQ ID NO: 1389553 - DNA, 22 bp, Artificial Sequence
  chemically synthesized
ttgggttctaccagtagataat

SEQ ID NO: 1389554 - DNA, 22 bp, Artificial Sequence
  chemically synthesized
tgcatactctggattatctact

SEQ ID NO: 1389555 - DNA, 22 bp, Artificial Sequence
  chemically synthesized
gtgcatactctggattatctac

SEQ ID NO: 1389556 - DNA, 22 bp, Artificial Sequence
  chemically synthesized
gggttctaccagtagataatcc

SEQ ID NO: 1389557 - DNA, 22 bp, Artificial Sequence
  chemically synthesized
ggttctaccagtagataatcca

SEQ ID NO: 1389558 - DNA, 22 bp, Artificial Sequence
  chemically synthesized
taccagtagataatccagagta

SEQ ID NO: 1389559 - DNA, 22 bp, Artificial Sequence
  chemically synthesized
ccagtagataatccagagtatg

SEQ ID NO: 1389560 - DNA, 22 bp, Artificial Sequence
  chemically synthesized
aaggtgtatttgtgcatactct

SEQ ID NO: 1389561 - DNA, 22 bp, Artificial Sequence
  chemically synthesized
aaaattcaaggtgtatttgtgc

SEQ ID NO: 1389562 - DNA, 22 bp, Artificial Sequence
  chemically synthesized
gaattttgaattgtattttgtt

SEQ ID NO: 1389563 - DNA, 22 bp, Artificial Sequence
  chemically synthesized
aattttgaattgtattttgttt

SEQ ID NO: 1389564 - DNA, 22 bp, Artificial Sequence
  chemically synthesized
caagaaacagaaacccaaacaa

SEQ ID NO: 1389565 - DNA, 22 bp, Artificial Sequence
  chemically synthesized
tgaattgtattttgtttgggtt

SEQ ID NO: 1389566 - DNA, 22 bp, Artificial Sequence
  chemically synthesized
gcaagaaacagaaacccaaaca

SEQ ID NO: 1389567 - DNA, 22 bp, Artificial Sequence
  chemically synthesized
gaattgtattttgtttgggttt

SEQ ID NO: 1389568 - DNA, 22 bp, Artificial Sequence
  chemically synthesized
aattgtattttgtttgggtttc

SEQ ID NO: 1389569 - DNA, 22 bp, Artificial Sequence
  chemically synthesized
ttgcaagaaacagaaacccaaa

SEQ ID NO: 1389570 - DNA, 22 bp, Artificial Sequence
  chemically synthesized
cttgcaagaaacagaaacccaa

SEQ ID NO: 1389571 - DNA, 22 bp, Artificial Sequence
  chemically synthesized
tcttgcaagaaacagaaaccca

SEQ ID NO: 1389572 - DNA, 22 bp, Artificial Sequence
  chemically synthesized
tttcttgcaagaaacagaaacc

SEQ ID NO: 1389573 - DNA, 22 bp, Artificial Sequence
  chemically synthesized
tattttgtttgggtttctgttt

SEQ ID NO: 1389574 - DNA, 22 bp, Artificial Sequence
  chemically synthesized
ctttcttgcaagaaacagaaac

SEQ ID NO: 1389575 - DNA, 22 bp, Artificial Sequence
  chemically synthesized
tctttcttgcaagaaacagaaa

SEQ ID NO: 1389576 - DNA, 22 bp, Artificial Sequence
  chemically synthesized
tgtttgggtttctgtttcttgc

SEQ ID NO: 1389577 - DNA, 22 bp, Artificial Sequence
  chemically synthesized
gtttgggtttctgtttcttgca

SEQ ID NO: 1389578 - DNA, 22 bp, Artificial Sequence
  chemically synthesized
tttgggtttctgtttcttgcaa

SEQ ID NO: 1389579 - DNA, 22 bp, Artificial Sequence
  chemically synthesized
gggtttctgtttcttgcaagaa

SEQ ID NO: 1389580 - DNA, 22 bp, Artificial Sequence
  chemically synthesized
ggtttctgtttcttgcaagaaa

SEQ ID NO: 1389581 - DNA, 22 bp, Artificial Sequence
  chemically synthesized
ctgtttcttgcaagaaagaaag

SEQ ID NO: 1389582 - DNA, 22 bp, Artificial Sequence
  chemically synthesized
tgtttcttgcaagaaagaaaga

SEQ ID NO: 1389583 - DNA, 22 bp, Artificial Sequence
  chemically synthesized
tttcttgcaagaaagaaagaca

SEQ ID NO: 1389584 - DNA, 22 bp, Artificial Sequence
  chemically synthesized
taaatatcaataatgtctttct

SEQ ID NO: 1389585 - DNA, 22 bp, Artificial Sequence
  chemically synthesized
gtaaatatcaataatgtctttc

SEQ ID NO: 1389586 - DNA, 22 bp, Artificial Sequence
  chemically synthesized
cttgcaagaaagaaagacatta

SEQ ID NO: 1389587 - DNA, 22 bp, Artificial Sequence
  chemically synthesized
ttgcaagaaagaaagacattat

SEQ ID NO: 1389588 - DNA, 22 bp, Artificial Sequence
  chemically synthesized
gcaagaaagaaagacattattg

SEQ ID NO: 1389589 - DNA, 22 bp, Artificial Sequence
  chemically synthesized
caagaaagaaagacattattga

SEQ ID NO: 1389590 - DNA, 22 bp, Artificial Sequence
  chemically synthesized
agtcatcttgtaaatatcaata

SEQ ID NO: 1389591 - DNA, 22 bp, Artificial Sequence
  chemically synthesized
aagtcatcttgtaaatatcaat

SEQ ID NO: 1389592 - DNA, 22 bp, Artificial Sequence
  chemically synthesized
taagtcatcttgtaaatatcaa

SEQ ID NO: 1389593 - DNA, 22 bp, Artificial Sequence
  chemically synthesized
ttaagtcatcttgtaaatatca

SEQ ID NO: 1389594 - DNA, 22 bp, Artificial Sequence
  chemically synthesized
atttttaagtcatcttgtaaat

SEQ ID NO: 1389595 - DNA, 22 bp, Artificial Sequence
  chemically synthesized
ttgatatttacaagatgactta

SEQ ID NO: 1389596 - DNA, 22 bp, Artificial Sequence
  chemically synthesized
atatttacaagatgacttaaaa

SEQ ID NO: 1389597 - DNA, 22 bp, Artificial Sequence
  chemically synthesized
gaatatacctgatttttaagtc

SEQ ID NO: 1389598 - DNA, 22 bp, Artificial Sequence
  chemically synthesized
agaatatacctgatttttaagt

SEQ ID NO: 1389599 - DNA, 22 bp, Artificial Sequence
  chemically synthesized
tagaatatacctgatttttaag

SEQ ID NO: 1389600 - DNA, 22 bp, Artificial Sequence
  chemically synthesized
ttagaatatacctgatttttaa

SEQ ID NO: 1389601 - DNA, 22 bp, Artificial Sequence
  chemically synthesized
acaagatgacttaaaaatcagg

SEQ ID NO: 1389602 - DNA, 22 bp, Artificial Sequence
  chemically synthesized
ttttagaatatacctgattttt

SEQ ID NO: 1389603 - DNA, 22 bp, Artificial Sequence
  chemically synthesized
caagatgacttaaaaatcaggt

SEQ ID NO: 1389604 - DNA, 22 bp, Artificial Sequence
  chemically synthesized
cttttagaatatacctgatttt

SEQ ID NO: 1389605 - DNA, 22 bp, Artificial Sequence
  chemically synthesized
tcttttagaatatacctgattt

SEQ ID NO: 1389606 - DNA, 22 bp, Artificial Sequence
  chemically synthesized
ttcttttagaatatacctgatt

SEQ ID NO: 1389607 - DNA, 22 bp, Artificial Sequence
  chemically synthesized
atcttttcttttagaatatacc

SEQ ID NO: 1389608 - DNA, 22 bp, Artificial Sequence
  chemically synthesized
aaaaatcaggtatattctaaaa

SEQ ID NO: 1389609 - DNA, 22 bp, Artificial Sequence
  chemically synthesized
aaaatcaggtatattctaaaag

SEQ ID NO: 1389610 - DNA, 22 bp, Artificial Sequence
  chemically synthesized
aagtagtctcatcttttctttt

SEQ ID NO: 1389611 - DNA, 22 bp, Artificial Sequence
  chemically synthesized
gtatctcaagtagtctcatctt

SEQ ID NO: 1389612 - DNA, 22 bp, Artificial Sequence
  chemically synthesized
ggtatctcaagtagtctcatct

SEQ ID NO: 1389613 - DNA, 22 bp, Artificial Sequence
  chemically synthesized
tggtatctcaagtagtctcatc

SEQ ID NO: 1389614 - DNA, 22 bp, Artificial Sequence
  chemically synthesized
taaaagaaaagatgagactact

SEQ ID NO: 1389615 - DNA, 22 bp, Artificial Sequence
  chemically synthesized
ttttggtatctcaagtagtctc

SEQ ID NO: 1389616 - DNA, 22 bp, Artificial Sequence
  chemically synthesized
aaagaaaagatgagactacttg

SEQ ID NO: 1389617 - DNA, 22 bp, Artificial Sequence
  chemically synthesized
attttggtatctcaagtagtct

SEQ ID NO: 1389618 - DNA, 22 bp, Artificial Sequence
  chemically synthesized
tttattttggtatctcaagtag

SEQ ID NO: 1389619 - DNA, 22 bp, Artificial Sequence
  chemically synthesized
cctgtttattttggtatctcaa

SEQ ID NO: 1389620 - DNA, 22 bp, Artificial Sequence
  chemically synthesized
ttccctgtttattttggtatct

SEQ ID NO: 1389621 - DNA, 22 bp, Artificial Sequence
  chemically synthesized
gttccctgtttattttggtatc

SEQ ID NO: 1389622 - DNA, 22 bp, Artificial Sequence
  chemically synthesized
tgttccctgtttattttggtat

SEQ ID NO: 1389623 - DNA, 22 bp, Artificial Sequence
  chemically synthesized
ttgttccctgtttattttggta

SEQ ID NO: 1389624 - DNA, 22 bp, Artificial Sequence
  chemically synthesized
cttgagataccaaaataaacag

SEQ ID NO: 1389625 - DNA, 22 bp, Artificial Sequence
  chemically synthesized
gagataccaaaataaacaggga

SEQ ID NO: 1389626 - DNA, 22 bp, Artificial Sequence
  chemically synthesized
agataccaaaataaacagggaa

SEQ ID NO: 1389627 - DNA, 22 bp, Artificial Sequence
  chemically synthesized
gtaatatttttgttccctgttt

SEQ ID NO: 1389628 - DNA, 22 bp, Artificial Sequence
  chemically synthesized
catcacgataatatgttggtaa

SEQ ID NO: 1389629 - DNA, 22 bp, Artificial Sequence
  chemically synthesized
tctacatcacgataatatgttg

SEQ ID NO: 1389630 - DNA, 22 bp, Artificial Sequence
  chemically synthesized
ccaacatattatcgtgatgtag

SEQ ID NO: 1389631 - DNA, 22 bp, Artificial Sequence
  chemically synthesized
aaaaaaatcctatctacatcac

SEQ ID NO: 1389632 - DNA, 22 bp, Artificial Sequence
  chemically synthesized
gaaaaaaatcctatctacatca

SEQ ID NO: 1389633 - DNA, 22 bp, Artificial Sequence
  chemically synthesized
ttgaaaaaaatcctatctacat

SEQ ID NO: 1389634 - DNA, 22 bp, Artificial Sequence
  chemically synthesized
cttgaaaaaaatcctatctaca

SEQ ID NO: 1389635 - DNA, 22 bp, Artificial Sequence
  chemically synthesized
tcgtgatgtagataggattttt

SEQ ID NO: 1389636 - DNA, 22 bp, Artificial Sequence
  chemically synthesized
aagcttcttgaaaaaaatccta

SEQ ID NO: 1389637 - DNA, 22 bp, Artificial Sequence
  chemically synthesized
tcaagcttcttgaaaaaaatcc

SEQ ID NO: 1389638 - DNA, 22 bp, Artificial Sequence
  chemically synthesized
atatgctctcaagcttcttgaa

SEQ ID NO: 1389639 - DNA, 22 bp, Artificial Sequence
  chemically synthesized
ttttcaagaagcttgagagcat

SEQ ID NO: 1389640 - DNA, 22 bp, Artificial Sequence
  chemically synthesized
tttcaagaagcttgagagcata

SEQ ID NO: 1389641 - DNA, 22 bp, Artificial Sequence
  chemically synthesized
ttcaagaagcttgagagcatat

SEQ ID NO: 1389642 - DNA, 22 bp, Artificial Sequence
  chemically synthesized
tcaagaagcttgagagcatatt

SEQ ID NO: 1389643 - DNA, 22 bp, Artificial Sequence
  chemically synthesized
caagaagcttgagagcatatta

SEQ ID NO: 1389644 - DNA, 22 bp, Artificial Sequence
  chemically synthesized
aagaagcttgagagcatattag

SEQ ID NO: 1389645 - DNA, 22 bp, Artificial Sequence
  chemically synthesized
tgtaccaaatgcaatactaata

SEQ ID NO: 1389646 - DNA, 22 bp, Artificial Sequence
  chemically synthesized
gagagcatattagtattgcatt

SEQ ID NO: 1389647 - DNA, 22 bp, Artificial Sequence
  chemically synthesized
agagcatattagtattgcattt

SEQ ID NO: 1389648 - DNA, 22 bp, Artificial Sequence
  chemically synthesized
agattatgtaccaaatgcaata

SEQ ID NO: 1389649 - DNA, 22 bp, Artificial Sequence
  chemically synthesized
ttcagattatgtaccaaatgca

SEQ ID NO: 1389650 - DNA, 22 bp, Artificial Sequence
  chemically synthesized
gtattgcatttggtacataatc

SEQ ID NO: 1389651 - DNA, 22 bp, Artificial Sequence
  chemically synthesized
tcgtatggtcctattcagatta

SEQ ID NO: 1389652 - DNA, 22 bp, Artificial Sequence
  chemically synthesized
catttggtacataatctgaata

SEQ ID NO: 1389653 - DNA, 22 bp, Artificial Sequence
  chemically synthesized
atcgtatggtcctattcagatt

SEQ ID NO: 1389654 - DNA, 22 bp, Artificial Sequence
  chemically synthesized
tatcgtatggtcctattcagat

SEQ ID NO: 1389655 - DNA, 22 bp, Artificial Sequence
  chemically synthesized
tttatcgtatggtcctattcag

SEQ ID NO: 1389656 - DNA, 22 bp, Artificial Sequence
  chemically synthesized
ggtacataatctgaataggacc

SEQ ID NO: 1389657 - DNA, 22 bp, Artificial Sequence
  chemically synthesized
gtacataatctgaataggacca

SEQ ID NO: 1389658 - DNA, 22 bp, Artificial Sequence
  chemically synthesized
tacagtgttctttatcgtatgg

SEQ ID NO: 1389659 - DNA, 22 bp, Artificial Sequence
  chemically synthesized
aataggaccatacgataaagaa

SEQ ID NO: 1389660 - DNA, 22 bp, Artificial Sequence
  chemically synthesized
gtggaacattgtacagtgttct

SEQ ID NO: 1389661 - DNA, 22 bp, Artificial Sequence
  chemically synthesized
ggtggaacattgtacagtgttc

SEQ ID NO: 1389662 - DNA, 22 bp, Artificial Sequence
  chemically synthesized
tggtggaacattgtacagtgtt

SEQ ID NO: 1389663 - DNA, 22 bp, Artificial Sequence
  chemically synthesized
aggtatactttggtggaacatt

SEQ ID NO: 1389664 - DNA, 22 bp, Artificial Sequence
  chemically synthesized
ttaaggtatactttggtggaac

SEQ ID NO: 1389665 - DNA, 22 bp, Artificial Sequence
  chemically synthesized
ttattaaggtatactttggtgg

SEQ ID NO: 1389666 - DNA, 22 bp, Artificial Sequence
  chemically synthesized
tacaatgttccaccaaagtata

SEQ ID NO: 1389667 - DNA, 22 bp, Artificial Sequence
  chemically synthesized
ttgttattaaggtatactttgg

SEQ ID NO: 1389668 - DNA, 22 bp, Artificial Sequence
  chemically synthesized
ttgttgttattaaggtatactt

SEQ ID NO: 1389669 - DNA, 22 bp, Artificial Sequence
  chemically synthesized
caccaaagtataccttaataac

SEQ ID NO: 1389670 - DNA, 22 bp, Artificial Sequence
  chemically synthesized
taaaagctattgttgttattaa

SEQ ID NO: 1389671 - DNA, 22 bp, Artificial Sequence
  chemically synthesized
ataaaagctattgttgttatta

SEQ ID NO: 1389672 - DNA, 22 bp, Artificial Sequence
  chemically synthesized
tataaaagctattgttgttatt

SEQ ID NO: 1389673 - DNA, 22 bp, Artificial Sequence
  chemically synthesized
ttataaaagctattgttgttat

SEQ ID NO: 1389674 - DNA, 22 bp, Artificial Sequence
  chemically synthesized
aataacaacaatagcttttata

SEQ ID NO: 1389675 - DNA, 22 bp, Artificial Sequence
  chemically synthesized
ataacaacaatagcttttataa

SEQ ID NO: 1389676 - DNA, 22 bp, Artificial Sequence
  chemically synthesized
gatatataaaacaagaattttt

SEQ ID NO: 1389677 - DNA, 22 bp, Artificial Sequence
  chemically synthesized
tagatatataaaacaagaattt

SEQ ID NO: 1389678 - DNA, 22 bp, Artificial Sequence
  chemically synthesized
ttataaaaattcttgttttata

SEQ ID NO: 1389679 - DNA, 22 bp, Artificial Sequence
  chemically synthesized
tataaaaattcttgttttatat

SEQ ID NO: 1389680 - DNA, 22 bp, Artificial Sequence
  chemically synthesized
ataaaaattcttgttttatata

SEQ ID NO: 1389681 - DNA, 22 bp, Artificial Sequence
  chemically synthesized
taaaaattcttgttttatatat

SEQ ID NO: 1389682 - DNA, 22 bp, Artificial Sequence
  chemically synthesized
tgtaaaattctagatatataaa

SEQ ID NO: 1389683 - DNA, 22 bp, Artificial Sequence
  chemically synthesized
atgtaaaattctagatatataa

SEQ ID NO: 1389684 - DNA, 22 bp, Artificial Sequence
  chemically synthesized
catttatgtaaaattctagata

SEQ ID NO: 1389685 - DNA, 22 bp, Artificial Sequence
  chemically synthesized
acatttatgtaaaattctagat

SEQ ID NO: 1389686 - DNA, 22 bp, Artificial Sequence
  chemically synthesized
ttgttttatatatctagaattt

SEQ ID NO: 1389687 - DNA, 22 bp, Artificial Sequence
  chemically synthesized
tacatttatgtaaaattctaga

SEQ ID NO: 1389688 - DNA, 22 bp, Artificial Sequence
  chemically synthesized
ttacatttatgtaaaattctag

SEQ ID NO: 1389689 - DNA, 22 bp, Artificial Sequence
  chemically synthesized
gttttatatatctagaatttta

SEQ ID NO: 1389690 - DNA, 22 bp, Artificial Sequence
  chemically synthesized
tttacatttatgtaaaattcta

SEQ ID NO: 1389691 - DNA, 22 bp, Artificial Sequence
  chemically synthesized
ttttatatatctagaattttac

SEQ ID NO: 1389692 - DNA, 22 bp, Artificial Sequence
  chemically synthesized
ttttttacatttatgtaaaatt

SEQ ID NO: 1389693 - DNA, 22 bp, Artificial Sequence
  chemically synthesized
tatatatctagaattttacata

SEQ ID NO: 1389694 - DNA, 22 bp, Artificial Sequence
  chemically synthesized
atatatctagaattttacataa

SEQ ID NO: 1389695 - DNA, 22 bp, Artificial Sequence
  chemically synthesized
tatatctagaattttacataaa

SEQ ID NO: 1389696 - DNA, 22 bp, Artificial Sequence
  chemically synthesized
cattattttttacatttatgta

SEQ ID NO: 1389697 - DNA, 22 bp, Artificial Sequence
  chemically synthesized
gaattttacataaatgtaaaaa

SEQ ID NO: 1389698 - DNA, 22 bp, Artificial Sequence
  chemically synthesized
tacataaatgtaaaaaataatg

SEQ ID NO: 1389699 - DNA, 22 bp, Artificial Sequence
  chemically synthesized
acataaatgtaaaaaataatgt

SEQ ID NO: 1389700 - DNA, 22 bp, Artificial Sequence
  chemically synthesized
cataaatgtaaaaaataatgta

SEQ ID NO: 1389701 - DNA, 22 bp, Artificial Sequence
  chemically synthesized
aatgagatataacatctacatt

SEQ ID NO: 1389702 - DNA, 22 bp, Artificial Sequence
  chemically synthesized
aaatgagatataacatctacat

SEQ ID NO: 1389703 - DNA, 22 bp, Artificial Sequence
  chemically synthesized
atatttaaatgagatataacat

SEQ ID NO: 1389704 - DNA, 22 bp, Artificial Sequence
  chemically synthesized
tattgatatttaaatgagatat

SEQ ID NO: 1389705 - DNA, 22 bp, Artificial Sequence
  chemically synthesized
atattgatatttaaatgagata

SEQ ID NO: 1389706 - DNA, 22 bp, Artificial Sequence
  chemically synthesized
tatattgatatttaaatgagat

SEQ ID NO: 1389707 - DNA, 22 bp, Artificial Sequence
  chemically synthesized
ttatattgatatttaaatgaga

SEQ ID NO: 1389708 - DNA, 22 bp, Artificial Sequence
  chemically synthesized
acttttatattgatatttaaat

SEQ ID NO: 1389709 - DNA, 22 bp, Artificial Sequence
  chemically synthesized
tatctcatttaaatatcaatat

SEQ ID NO: 1389710 - DNA, 22 bp, Artificial Sequence
  chemically synthesized
atttaaatatcaatataaaagt

SEQ ID NO: 1389711 - DNA, 22 bp, Artificial Sequence
  chemically synthesized
tatcagccaattaacttttata

SEQ ID NO: 1389712 - DNA, 22 bp, Artificial Sequence
  chemically synthesized
gtatcagccaattaacttttat

SEQ ID NO: 1389713 - DNA, 22 bp, Artificial Sequence
  chemically synthesized
aaatatcaatataaaagttaat

SEQ ID NO: 1389714 - DNA, 22 bp, Artificial Sequence
  chemically synthesized
aatatcaatataaaagttaatt

SEQ ID NO: 1389715 - DNA, 22 bp, Artificial Sequence
  chemically synthesized
gatgtatttgtatcagccaatt

SEQ ID NO: 1389716 - DNA, 22 bp, Artificial Sequence
  chemically synthesized
agtaagttggatgtatttgtat

SEQ ID NO: 1389717 - DNA, 22 bp, Artificial Sequence
  chemically synthesized
attggctgatacaaatacatcc

SEQ ID NO: 1389718 - DNA, 22 bp, Artificial Sequence
  chemically synthesized
gctgatacaaatacatccaact

SEQ ID NO: 1389719 - DNA, 22 bp, Artificial Sequence
  chemically synthesized
atacaaatacatccaacttact

SEQ ID NO: 1389720 - DNA, 22 bp, Artificial Sequence
  chemically synthesized
aaaagaaaataaataagttgag

SEQ ID NO: 1389721 - DNA, 22 bp, Artificial Sequence
  chemically synthesized
tcaaaagaaaataaataagttg

SEQ ID NO: 1389722 - DNA, 22 bp, Artificial Sequence
  chemically synthesized
ctcaaaagaaaataaataagtt

SEQ ID NO: 1389723 - DNA, 22 bp, Artificial Sequence
  chemically synthesized
tctcaaaagaaaataaataagt

SEQ ID NO: 1389724 - DNA, 22 bp, Artificial Sequence
  chemically synthesized
cctttctcaaaagaaaataaat

SEQ ID NO: 1389725 - DNA, 22 bp, Artificial Sequence
  chemically synthesized
acctttctcaaaagaaaataaa

SEQ ID NO: 1389726 - DNA, 22 bp, Artificial Sequence
  chemically synthesized
tacctttctcaaaagaaaataa

SEQ ID NO: 1389727 - DNA, 22 bp, Artificial Sequence
  chemically synthesized
actcaacttatttattttcttt

SEQ ID NO: 1389728 - DNA, 22 bp, Artificial Sequence
  chemically synthesized
ctcaacttatttattttctttt

SEQ ID NO: 1389729 - DNA, 22 bp, Artificial Sequence
  chemically synthesized
attttacctttctcaaaagaaa

SEQ ID NO: 1389730 - DNA, 22 bp, Artificial Sequence
  chemically synthesized
aacttatttattttcttttgag

SEQ ID NO: 1389731 - DNA, 22 bp, Artificial Sequence
  chemically synthesized
taattttacctttctcaaaaga

SEQ ID NO: 1389732 - DNA, 22 bp, Artificial Sequence
  chemically synthesized
tctaattttacctttctcaaaa

SEQ ID NO: 1389733 - DNA, 22 bp, Artificial Sequence
  chemically synthesized
ctctaattttacctttctcaaa

SEQ ID NO: 1389734 - DNA, 22 bp, Artificial Sequence
  chemically synthesized
atttattttcttttgagaaagg

SEQ ID NO: 1389735 - DNA, 22 bp, Artificial Sequence
  chemically synthesized
tttattttcttttgagaaaggt

SEQ ID NO: 1389736 - DNA, 22 bp, Artificial Sequence
  chemically synthesized
attttcttttgagaaaggtaaa

SEQ ID NO: 1389737 - DNA, 22 bp, Artificial Sequence
  chemically synthesized
gacttctctaattttacctttc

SEQ ID NO: 1389738 - DNA, 22 bp, Artificial Sequence
  chemically synthesized
ttttcttttgagaaaggtaaaa

SEQ ID NO: 1389739 - DNA, 22 bp, Artificial Sequence
  chemically synthesized
tggacttctctaattttacctt

SEQ ID NO: 1389740 - DNA, 22 bp, Artificial Sequence
  chemically synthesized
tcttttgagaaaggtaaaatta

SEQ ID NO: 1389741 - DNA, 22 bp, Artificial Sequence
  chemically synthesized
cttttgagaaaggtaaaattag

SEQ ID NO: 1389742 - DNA, 22 bp, Artificial Sequence
  chemically synthesized
ttttgagaaaggtaaaattaga

SEQ ID NO: 1389743 - DNA, 22 bp, Artificial Sequence
  chemically synthesized
ttgagaaaggtaaaattagaga

SEQ ID NO: 1389744 - DNA, 22 bp, Artificial Sequence
  chemically synthesized
tgagaaaggtaaaattagagaa

SEQ ID NO: 1389745 - DNA, 22 bp, Artificial Sequence
  chemically synthesized
gagaaaggtaaaattagagaag

SEQ ID NO: 1389746 - DNA, 22 bp, Artificial Sequence
  chemically synthesized
agaaaggtaaaattagagaagt

SEQ ID NO: 1389747 - DNA, 22 bp, Artificial Sequence
  chemically synthesized
tataagtctctggacttctcta

SEQ ID NO: 1389748 - DNA, 22 bp, Artificial Sequence
  chemically synthesized
attgtataagtctctggacttc

SEQ ID NO: 1389749 - DNA, 22 bp, Artificial Sequence
  chemically synthesized
gagaagtccagagacttataca

SEQ ID NO: 1389750 - DNA, 22 bp, Artificial Sequence
  chemically synthesized
gagatatgtactcattgtataa

SEQ ID NO: 1389751 - DNA, 22 bp, Artificial Sequence
  chemically synthesized
ctggagatatgtactcattgta

SEQ ID NO: 1389752 - DNA, 22 bp, Artificial Sequence
  chemically synthesized
cctggagatatgtactcattgt

SEQ ID NO: 1389753 - DNA, 22 bp, Artificial Sequence
  chemically synthesized
tgatttcctggagatatgtact

SEQ ID NO: 1389754 - DNA, 22 bp, Artificial Sequence
  chemically synthesized
atacaatgagtacatatctcca

SEQ ID NO: 1389755 - DNA, 22 bp, Artificial Sequence
  chemically synthesized
tacaatgagtacatatctccag

SEQ ID NO: 1389756 - DNA, 22 bp, Artificial Sequence
  chemically synthesized
ataattatgatttcctggagat

SEQ ID NO: 1389757 - DNA, 22 bp, Artificial Sequence
  chemically synthesized
ttcataattatgatttcctgga

SEQ ID NO: 1389758 - DNA, 22 bp, Artificial Sequence
  chemically synthesized
ggacagattattcataattatg

SEQ ID NO: 1389759 - DNA, 22 bp, Artificial Sequence
  chemically synthesized
caggaaatcataattatgaata

SEQ ID NO: 1389760 - DNA, 22 bp, Artificial Sequence
  chemically synthesized
tgcacaataaattaggacagat

SEQ ID NO: 1389761 - DNA, 22 bp, Artificial Sequence
  chemically synthesized
gattatgcacaataaattagga

SEQ ID NO: 1389762 - DNA, 22 bp, Artificial Sequence
  chemically synthesized
tgaataatctgtcctaatttat

SEQ ID NO: 1389763 - DNA, 22 bp, Artificial Sequence
  chemically synthesized
taattagattatgcacaataaa

SEQ ID NO: 1389764 - DNA, 22 bp, Artificial Sequence
  chemically synthesized
ataattagattatgcacaataa

SEQ ID NO: 1389765 - DNA, 22 bp, Artificial Sequence
  chemically synthesized
tataattagattatgcacaata

SEQ ID NO: 1389766 - DNA, 22 bp, Artificial Sequence
  chemically synthesized
ttataattagattatgcacaat

SEQ ID NO: 1389767 - DNA, 22 bp, Artificial Sequence
  chemically synthesized
ttttataattagattatgcaca

SEQ ID NO: 1389768 - DNA, 22 bp, Artificial Sequence
  chemically synthesized
tcctaatttattgtgcataatc

SEQ ID NO: 1389769 - DNA, 22 bp, Artificial Sequence
  chemically synthesized
cttttataattagattatgcac

SEQ ID NO: 1389770 - DNA, 22 bp, Artificial Sequence
  chemically synthesized
tcttttataattagattatgca

SEQ ID NO: 1389771 - DNA, 22 bp, Artificial Sequence
  chemically synthesized
atttattgtgcataatctaatt

SEQ ID NO: 1389772 - DNA, 22 bp, Artificial Sequence
  chemically synthesized
attgtgcataatctaattataa

SEQ ID NO: 1389773 - DNA, 22 bp, Artificial Sequence
  chemically synthesized
aatcattttcttttataattag

SEQ ID NO: 1389774 - DNA, 22 bp, Artificial Sequence
  chemically synthesized
ttgtgcataatctaattataaa

SEQ ID NO: 1389775 - DNA, 22 bp, Artificial Sequence
  chemically synthesized
gaatcattttcttttataatta

SEQ ID NO: 1389776 - DNA, 22 bp, Artificial Sequence
  chemically synthesized
tgcataatctaattataaaaga

SEQ ID NO: 1389777 - DNA, 22 bp, Artificial Sequence
  chemically synthesized
acatgtatttgaatcattttct

SEQ ID NO: 1389778 - DNA, 22 bp, Artificial Sequence
  chemically synthesized
cacatgtatttgaatcattttc

SEQ ID NO: 1389779 - DNA, 22 bp, Artificial Sequence
  chemically synthesized
tcacatgtatttgaatcatttt

SEQ ID NO: 1389780 - DNA, 22 bp, Artificial Sequence
  chemically synthesized
attataaaagaaaatgattcaa

SEQ ID NO: 1389781 - DNA, 22 bp, Artificial Sequence
  chemically synthesized
taaaagaaaatgattcaaatac

SEQ ID NO: 1389782 - DNA, 22 bp, Artificial Sequence
  chemically synthesized
aaatacatgtgaaaacacttta

SEQ ID NO: 1389783 - DNA, 22 bp, Artificial Sequence
  chemically synthesized
gagataaggaagtaaagtgttt

SEQ ID NO: 1389784 - DNA, 22 bp, Artificial Sequence
  chemically synthesized
tacttccttatctccaggcctg

SEQ ID NO: 1389785 - DNA, 22 bp, Artificial Sequence
  chemically synthesized
acttccttatctccaggcctgt

SEQ ID NO: 1389786 - DNA, 22 bp, Artificial Sequence
  chemically synthesized
cttccttatctccaggcctgtt

SEQ ID NO: 1389787 - DNA, 22 bp, Artificial Sequence
  chemically synthesized
ccttatctccaggcctgttctc

SEQ ID NO: 1389788 - DNA, 22 bp, Artificial Sequence
  chemically synthesized
cttatctccaggcctgttctcc

SEQ ID NO: 1389789 - DNA, 22 bp, Artificial Sequence
  chemically synthesized
taaagacgagagcaggagaaca

SEQ ID NO: 1389790 - DNA, 22 bp, Artificial Sequence
  chemically synthesized
atctccaggcctgttctcctgc

SEQ ID NO: 1389791 - DNA, 22 bp, Artificial Sequence
  chemically synthesized
ataaagacgagagcaggagaac

SEQ ID NO: 1389792 - DNA, 22 bp, Artificial Sequence
  chemically synthesized
tctccaggcctgttctcctgct

SEQ ID NO: 1389793 - DNA, 22 bp, Artificial Sequence
  chemically synthesized
ttataaagacgagagcaggaga

SEQ ID NO: 1389794 - DNA, 22 bp, Artificial Sequence
  chemically synthesized
caggcctgttctcctgctctcg

SEQ ID NO: 1389795 - DNA, 22 bp, Artificial Sequence
  chemically synthesized
ttctcctgctctcgtctttata

SEQ ID NO: 1389796 - DNA, 22 bp, Artificial Sequence
  chemically synthesized
tcctgctctcgtctttataaga

SEQ ID NO: 1389797 - DNA, 22 bp, Artificial Sequence
  chemically synthesized
atatatcatggcctcttataaa

SEQ ID NO: 1389798 - DNA, 22 bp, Artificial Sequence
  chemically synthesized
ctgctctcgtctttataagagg

SEQ ID NO: 1389799 - DNA, 22 bp, Artificial Sequence
  chemically synthesized
ctctcgtctttataagaggcca

SEQ ID NO: 1389800 - DNA, 22 bp, Artificial Sequence
  chemically synthesized
tcgtctttataagaggccatga

SEQ ID NO: 1389801 - DNA, 22 bp, Artificial Sequence
  chemically synthesized
gtctttataagaggccatgata

SEQ ID NO: 1389802 - DNA, 22 bp, Artificial Sequence
  chemically synthesized
tataagaggccatgatatatga

SEQ ID NO: 1389803 - DNA, 22 bp, Artificial Sequence
  chemically synthesized
ataagaggccatgatatatgaa

SEQ ID NO: 1389804 - DNA, 22 bp, Artificial Sequence
  chemically synthesized
atgaacataaaattcatatatc

SEQ ID NO: 1389805 - DNA, 22 bp, Artificial Sequence
  chemically synthesized
taagaggccatgatatatgaat

SEQ ID NO: 1389806 - DNA, 22 bp, Artificial Sequence
  chemically synthesized
aattaatgaacataaaattcat

SEQ ID NO: 1389807 - DNA, 22 bp, Artificial Sequence
  chemically synthesized
agctaaattaatgaacataaaa

SEQ ID NO: 1389808 - DNA, 22 bp, Artificial Sequence
  chemically synthesized
tatgttcattaatttagctcaa

SEQ ID NO: 1389809 - DNA, 22 bp, Artificial Sequence
  chemically synthesized
atgttcattaatttagctcaat

SEQ ID NO: 1389810 - DNA, 22 bp, Artificial Sequence
  chemically synthesized
tgttcattaatttagctcaatt

SEQ ID NO: 1389811 - DNA, 22 bp, Artificial Sequence
  chemically synthesized
attaatttagctcaattgttct

SEQ ID NO: 1389812 - DNA, 22 bp, Artificial Sequence
  chemically synthesized
atttagctcaattgttctgctt

SEQ ID NO: 1389813 - DNA, 22 bp, Artificial Sequence
  chemically synthesized
agctcaattgttctgcttttca

SEQ ID NO: 1389814 - DNA, 22 bp, Artificial Sequence
  chemically synthesized
gctcaattgttctgcttttcac

SEQ ID NO: 1389815 - DNA, 22 bp, Artificial Sequence
  chemically synthesized
aattgttctgcttttcacatac

SEQ ID NO: 1389816 - DNA, 22 bp, Artificial Sequence
  chemically synthesized
tggatataggaatgtatgtgaa

SEQ ID NO: 1389817 - DNA, 22 bp, Artificial Sequence
  chemically synthesized
atggatataggaatgtatgtga

SEQ ID NO: 1389818 - DNA, 22 bp, Artificial Sequence
  chemically synthesized
ttctgcttttcacatacattcc

SEQ ID NO: 1389819 - DNA, 22 bp, Artificial Sequence
  chemically synthesized
tttatggatataggaatgtatg

SEQ ID NO: 1389820 - DNA, 22 bp, Artificial Sequence
  chemically synthesized
tgcttttcacatacattcctat

SEQ ID NO: 1389821 - DNA, 22 bp, Artificial Sequence
  chemically synthesized
cttttcacatacattcctatat

SEQ ID NO: 1389822 - DNA, 22 bp, Artificial Sequence
  chemically synthesized
tgtattgtttatggatatagga

SEQ ID NO: 1389823 - DNA, 22 bp, Artificial Sequence
  chemically synthesized
ttcacatacattcctatatcca

SEQ ID NO: 1389824 - DNA, 22 bp, Artificial Sequence
  chemically synthesized
tcacatacattcctatatccat

SEQ ID NO: 1389825 - DNA, 22 bp, Artificial Sequence
  chemically synthesized
cacatacattcctatatccata

SEQ ID NO: 1389826 - DNA, 22 bp, Artificial Sequence
  chemically synthesized
acatacattcctatatccataa

SEQ ID NO: 1389827 - DNA, 22 bp, Artificial Sequence
  chemically synthesized
ctatatccataaacaatacata

SEQ ID NO: 1389828 - DNA, 22 bp, Artificial Sequence
  chemically synthesized
tatccataaacaatacataatg

SEQ ID NO: 1389829 - DNA, 22 bp, Artificial Sequence
  chemically synthesized
taaagaacatacacacatacat

SEQ ID NO: 1389830 - DNA, 22 bp, Artificial Sequence
  chemically synthesized
gtaaagaacatacacacataca

SEQ ID NO: 1389831 - DNA, 22 bp, Artificial Sequence
  chemically synthesized
ttgttgtgtatgtatgtgtgta

SEQ ID NO: 1389832 - DNA, 22 bp, Artificial Sequence
  chemically synthesized
ttgtgtatgtatgtgtgtatgt

SEQ ID NO: 1389833 - DNA, 22 bp, Artificial Sequence
  chemically synthesized
tgtatgtatgtgtgtatgttct

SEQ ID NO: 1389834 - DNA, 22 bp, Artificial Sequence
  chemically synthesized
aagtaaatttgtaaagaacata

SEQ ID NO: 1389835 - DNA, 22 bp, Artificial Sequence
  chemically synthesized
tttacaaatttacttgagtgct

SEQ ID NO: 1389836 - DNA, 22 bp, Artificial Sequence
  chemically synthesized
tacaaatttacttgagtgcttg

SEQ ID NO: 1389837 - DNA, 22 bp, Artificial Sequence
  chemically synthesized
aatgaaggatgccaagcactca

SEQ ID NO: 1389838 - DNA, 22 bp, Artificial Sequence
  chemically synthesized
acaaatttacttgagtgcttgg

SEQ ID NO: 1389839 - DNA, 22 bp, Artificial Sequence
  chemically synthesized
caaatttacttgagtgcttggc

SEQ ID NO: 1389840 - DNA, 22 bp, Artificial Sequence
  chemically synthesized
gctcaatgaaggatgccaagca

SEQ ID NO: 1389841 - DNA, 22 bp, Artificial Sequence
  chemically synthesized
attagctcaatgaaggatgcca

SEQ ID NO: 1389842 - DNA, 22 bp, Artificial Sequence
  chemically synthesized
acttgagtgcttggcatccttc

SEQ ID NO: 1389843 - DNA, 22 bp, Artificial Sequence
  chemically synthesized
cttgagtgcttggcatccttca

SEQ ID NO: 1389844 - DNA, 22 bp, Artificial Sequence
  chemically synthesized
gagtgcttggcatccttcattg

SEQ ID NO: 1389845 - DNA, 22 bp, Artificial Sequence
  chemically synthesized
agtgcttggcatccttcattga

SEQ ID NO: 1389846 - DNA, 22 bp, Artificial Sequence
  chemically synthesized
tggatagctcattagctcaatg

SEQ ID NO: 1389847 - DNA, 22 bp, Artificial Sequence
  chemically synthesized
atggatagctcattagctcaat

SEQ ID NO: 1389848 - DNA, 22 bp, Artificial Sequence
  chemically synthesized
ggcatccttcattgagctaatg

SEQ ID NO: 1389849 - DNA, 22 bp, Artificial Sequence
  chemically synthesized
ttatggatagctcattagctca

SEQ ID NO: 1389850 - DNA, 22 bp, Artificial Sequence
  chemically synthesized
gcatccttcattgagctaatga

SEQ ID NO: 1389851 - DNA, 22 bp, Artificial Sequence
  chemically synthesized
cattgagctaatgagctatcca

SEQ ID NO: 1389852 - DNA, 22 bp, Artificial Sequence
  chemically synthesized
attgagctaatgagctatccat

SEQ ID NO: 1389853 - DNA, 22 bp, Artificial Sequence
  chemically synthesized
agctaatgagctatccataaga

SEQ ID NO: 1389854 - DNA, 22 bp, Artificial Sequence
  chemically synthesized
atgagctatccataagaatcca

SEQ ID NO: 1389855 - DNA, 22 bp, Artificial Sequence
  chemically synthesized
ggtatggagtggatcaacatgg

SEQ ID NO: 1389856 - DNA, 22 bp, Artificial Sequence
  chemically synthesized
tccataagaatccatgttgatc

SEQ ID NO: 1389857 - DNA, 22 bp, Artificial Sequence
  chemically synthesized
cctgggtatggagtggatcaac

SEQ ID NO: 1389858 - DNA, 22 bp, Artificial Sequence
  chemically synthesized
tcagcgatactacctgggtatg

SEQ ID NO: 1389859 - DNA, 22 bp, Artificial Sequence
  chemically synthesized
atccactccatacccaggtagt

SEQ ID NO: 1389860 - DNA, 22 bp, Artificial Sequence
  chemically synthesized
aacagcctgtcagcgatactac

SEQ ID NO: 1389861 - DNA, 22 bp, Artificial Sequence
  chemically synthesized
catacccaggtagtatcgctga

SEQ ID NO: 1389862 - DNA, 22 bp, Artificial Sequence
  chemically synthesized
gaggctgaacagcctgtcagcg

SEQ ID NO: 1389863 - DNA, 22 bp, Artificial Sequence
  chemically synthesized
tataatacaattagaggctgaa

SEQ ID NO: 1389864 - DNA, 22 bp, Artificial Sequence
  chemically synthesized
acaggctgttcagcctctaatt

SEQ ID NO: 1389865 - DNA, 22 bp, Artificial Sequence
  chemically synthesized
ttcagcctctaattgtattata

SEQ ID NO: 1389866 - DNA, 22 bp, Artificial Sequence
  chemically synthesized
agcctctaattgtattatatag

SEQ ID NO: 1389867 - DNA, 22 bp, Artificial Sequence
  chemically synthesized
catgcaagaagagctatataat

SEQ ID NO: 1389868 - DNA, 22 bp, Artificial Sequence
  chemically synthesized
taattgtattatatagctcttc

SEQ ID NO: 1389869 - DNA, 22 bp, Artificial Sequence
  chemically synthesized
attgtattatatagctcttctt

SEQ ID NO: 1389870 - DNA, 22 bp, Artificial Sequence
  chemically synthesized
tattatatagctcttcttgcat

SEQ ID NO: 1389871 - DNA, 22 bp, Artificial Sequence
  chemically synthesized
tatagctcttcttgcatgcagg

SEQ ID NO: 1389872 - DNA, 22 bp, Artificial Sequence
  chemically synthesized
ttcttgcatgcaggtgtggtta

SEQ ID NO: 1389873 - DNA, 22 bp, Artificial Sequence
  chemically synthesized
cttgcatgcaggtgtggttatt

SEQ ID NO: 1389874 - DNA, 22 bp, Artificial Sequence
  chemically synthesized
ttgcatgcaggtgtggttattt

SEQ ID NO: 1389875 - DNA, 22 bp, Artificial Sequence
  chemically synthesized
ggagaaacaaatcaaataacca

SEQ ID NO: 1389876 - DNA, 22 bp, Artificial Sequence
  chemically synthesized
gcatgcaggtgtggttatttga

SEQ ID NO: 1389877 - DNA, 22 bp, Artificial Sequence
  chemically synthesized
catgcaggtgtggttatttgat

SEQ ID NO: 1389878 - DNA, 22 bp, Artificial Sequence
  chemically synthesized
ctgggagaaacaaatcaaataa

SEQ ID NO: 1389879 - DNA, 22 bp, Artificial Sequence
  chemically synthesized
tactgggagaaacaaatcaaat

SEQ ID NO: 1389880 - DNA, 22 bp, Artificial Sequence
  chemically synthesized
atattctactgggagaaacaaa

SEQ ID NO: 1389881 - DNA, 22 bp, Artificial Sequence
  chemically synthesized
cactcatattctactgggagaa

SEQ ID NO: 1389882 - DNA, 22 bp, Artificial Sequence
  chemically synthesized
ccactcatattctactgggaga

SEQ ID NO: 1389883 - DNA, 22 bp, Artificial Sequence
  chemically synthesized
tttgatttgtttctcccagtag

SEQ ID NO: 1389884 - DNA, 22 bp, Artificial Sequence
  chemically synthesized
cttccactcatattctactggg

SEQ ID NO: 1389885 - DNA, 22 bp, Artificial Sequence
  chemically synthesized
gatttgtttctcccagtagaat

SEQ ID NO: 1389886 - DNA, 22 bp, Artificial Sequence
  chemically synthesized
atttgtttctcccagtagaata

SEQ ID NO: 1389887 - DNA, 22 bp, Artificial Sequence
  chemically synthesized
gtttctcccagtagaatatgag

SEQ ID NO: 1389888 - DNA, 22 bp, Artificial Sequence
  chemically synthesized
tttctcccagtagaatatgagt

SEQ ID NO: 1389889 - DNA, 22 bp, Artificial Sequence
  chemically synthesized
ctcccagtagaatatgagtgga

SEQ ID NO: 1389890 - DNA, 22 bp, Artificial Sequence
  chemically synthesized
acacaaattacttccactcata

SEQ ID NO: 1389891 - DNA, 22 bp, Artificial Sequence
  chemically synthesized
tcccagtagaatatgagtggaa

SEQ ID NO: 1389892 - DNA, 22 bp, Artificial Sequence
  chemically synthesized
ccagtagaatatgagtggaagt

SEQ ID NO: 1389893 - DNA, 22 bp, Artificial Sequence
  chemically synthesized
aattgacacaaattacttccac

SEQ ID NO: 1389894 - DNA, 22 bp, Artificial Sequence
  chemically synthesized
tgaattgacacaaattacttcc

SEQ ID NO: 1389895 - DNA, 22 bp, Artificial Sequence
  chemically synthesized
aagctctgaattgacacaaatt

SEQ ID NO: 1389896 - DNA, 22 bp, Artificial Sequence
  chemically synthesized
aaatctgaagctctgaattgac

SEQ ID NO: 1389897 - DNA, 22 bp, Artificial Sequence
  chemically synthesized
aaaatctgaagctctgaattga

SEQ ID NO: 1389898 - DNA, 22 bp, Artificial Sequence
  chemically synthesized
taaaatctgaagctctgaattg

SEQ ID NO: 1389899 - DNA, 22 bp, Artificial Sequence
  chemically synthesized
ttaaaatctgaagctctgaatt

SEQ ID NO: 1389900 - DNA, 22 bp, Artificial Sequence
  chemically synthesized
tttaaaatctgaagctctgaat

SEQ ID NO: 1389901 - DNA, 22 bp, Artificial Sequence
  chemically synthesized
gctttttaaaatctgaagctct

SEQ ID NO: 1389902 - DNA, 22 bp, Artificial Sequence
  chemically synthesized
gtgtcaattcagagcttcagat

SEQ ID NO: 1389903 - DNA, 22 bp, Artificial Sequence
  chemically synthesized
tgtcaattcagagcttcagatt

SEQ ID NO: 1389904 - DNA, 22 bp, Artificial Sequence
  chemically synthesized
agagcttcagattttaaaaagc

SEQ ID NO: 1389905 - DNA, 22 bp, Artificial Sequence
  chemically synthesized
cagattttaaaaagctaatata

SEQ ID NO: 1389906 - DNA, 22 bp, Artificial Sequence
  chemically synthesized
agattttaaaaagctaatatat

SEQ ID NO: 1389907 - DNA, 22 bp, Artificial Sequence
  chemically synthesized
taaaaagctaatatatcttctc

SEQ ID NO: 1389908 - DNA, 22 bp, Artificial Sequence
  chemically synthesized
aaaaagctaatatatcttctct

SEQ ID NO: 1389909 - DNA, 22 bp, Artificial Sequence
  chemically synthesized
aaaagctaatatatcttctctg

SEQ ID NO: 1389910 - DNA, 22 bp, Artificial Sequence
  chemically synthesized
atatatcttctctgctgtttct

SEQ ID NO: 1389911 - DNA, 22 bp, Artificial Sequence
  chemically synthesized
ctctgctgtttctttcccattc

SEQ ID NO: 1389912 - DNA, 22 bp, Artificial Sequence
  chemically synthesized
catacatccatagaatgggaaa

SEQ ID NO: 1389913 - DNA, 22 bp, Artificial Sequence
  chemically synthesized
tctgctgtttctttcccattct

SEQ ID NO: 1389914 - DNA, 22 bp, Artificial Sequence
  chemically synthesized
tgctgtttctttcccattctat

SEQ ID NO: 1389915 - DNA, 22 bp, Artificial Sequence
  chemically synthesized
ctgtttctttcccattctatgg

SEQ ID NO: 1389916 - DNA, 22 bp, Artificial Sequence
  chemically synthesized
tttctttcccattctatggatg

SEQ ID NO: 1389917 - DNA, 22 bp, Artificial Sequence
  chemically synthesized
ctttcccattctatggatgtat

SEQ ID NO: 1389918 - DNA, 22 bp, Artificial Sequence
  chemically synthesized
agagtcatctgcatacatccat

SEQ ID NO: 1389919 - DNA, 22 bp, Artificial Sequence
  chemically synthesized
tttcccattctatggatgtatg

SEQ ID NO: 1389920 - DNA, 22 bp, Artificial Sequence
  chemically synthesized
tcccattctatggatgtatgca

SEQ ID NO: 1389921 - DNA, 22 bp, Artificial Sequence
  chemically synthesized
cccattctatggatgtatgcag

SEQ ID NO: 1389922 - DNA, 22 bp, Artificial Sequence
  chemically synthesized
ccattctatggatgtatgcaga

SEQ ID NO: 1389923 - DNA, 22 bp, Artificial Sequence
  chemically synthesized
aacctcagagtcatctgcatac

SEQ ID NO: 1389924 - DNA, 22 bp, Artificial Sequence
  chemically synthesized
caacctcagagtcatctgcata

SEQ ID NO: 1389925 - DNA, 22 bp, Artificial Sequence
  chemically synthesized
ttcaacctcagagtcatctgca

SEQ ID NO: 1389926 - DNA, 22 bp, Artificial Sequence
  chemically synthesized
tatggatgtatgcagatgactc

SEQ ID NO: 1389927 - DNA, 22 bp, Artificial Sequence
  chemically synthesized
tggatgtatgcagatgactctg

SEQ ID NO: 1389928 - DNA, 22 bp, Artificial Sequence
  chemically synthesized
ccccgcatctcttcaacctcag

SEQ ID NO: 1389929 - DNA, 22 bp, Artificial Sequence
  chemically synthesized
ctcccccgcatctcttcaacct

SEQ ID NO: 1389930 - DNA, 22 bp, Artificial Sequence
  chemically synthesized
ttgctcccccgcatctcttcaa

SEQ ID NO: 1389931 - DNA, 22 bp, Artificial Sequence
  chemically synthesized
gttgctcccccgcatctcttca

SEQ ID NO: 1389932 - DNA, 22 bp, Artificial Sequence
  chemically synthesized
tgttgctcccccgcatctcttc

SEQ ID NO: 1389933 - DNA, 22 bp, Artificial Sequence
  chemically synthesized
tgaggttgaagagatgcggggg

SEQ ID NO: 1389934 - DNA, 22 bp, Artificial Sequence
  chemically synthesized
cattttgttgctcccccgcatc

SEQ ID NO: 1389935 - DNA, 22 bp, Artificial Sequence
  chemically synthesized
ccattttgttgctcccccgcat

SEQ ID NO: 1389936 - DNA, 22 bp, Artificial Sequence
  chemically synthesized
aggttgaagagatgcgggggag

SEQ ID NO: 1389937 - DNA, 22 bp, Artificial Sequence
  chemically synthesized
aagagatgcgggggagcaacaa

SEQ ID NO: 1389938 - DNA, 22 bp, Artificial Sequence
  chemically synthesized
catgtgacgatgcaaggatcca

SEQ ID NO: 1389939 - DNA, 22 bp, Artificial Sequence
  chemically synthesized
ctgcatgtgacgatgcaaggat

SEQ ID NO: 1389940 - DNA, 22 bp, Artificial Sequence
  chemically synthesized
cctgcatgtgacgatgcaagga

SEQ ID NO: 1389941 - DNA, 22 bp, Artificial Sequence
  chemically synthesized
tcctgcatgtgacgatgcaagg

SEQ ID NO: 1389942 - DNA, 22 bp, Artificial Sequence
  chemically synthesized
ctttcctgcatgtgacgatgca

SEQ ID NO: 1389943 - DNA, 22 bp, Artificial Sequence
  chemically synthesized
gatccttgcatcgtcacatgca

SEQ ID NO: 1389944 - DNA, 22 bp, Artificial Sequence
  chemically synthesized
gcatcgtcacatgcaggaaagc

SEQ ID NO: 1389945 - DNA, 22 bp, Artificial Sequence
  chemically synthesized
catcgtcacatgcaggaaagca

SEQ ID NO: 1389946 - DNA, 22 bp, Artificial Sequence
  chemically synthesized
catggcagcgtgttgctttcct

SEQ ID NO: 1389947 - DNA, 22 bp, Artificial Sequence
  chemically synthesized
atgtcacagtccatggcattcc

SEQ ID NO: 1389948 - DNA, 22 bp, Artificial Sequence
  chemically synthesized
ctcatgtcacagtccatggcat

SEQ ID NO: 1389949 - DNA, 22 bp, Artificial Sequence
  chemically synthesized
gctcatgtcacagtccatggca

SEQ ID NO: 1389950 - DNA, 22 bp, Artificial Sequence
  chemically synthesized
tttgctcatgtcacagtccatg

SEQ ID NO: 1389951 - DNA, 22 bp, Artificial Sequence
  chemically synthesized
ccatggaatgccatggactgtg

SEQ ID NO: 1389952 - DNA, 22 bp, Artificial Sequence
  chemically synthesized
ttgtttgctcatgtcacagtcc

SEQ ID NO: 1389953 - DNA, 22 bp, Artificial Sequence
  chemically synthesized
attgtttgctcatgtcacagtc

SEQ ID NO: 1389954 - DNA, 22 bp, Artificial Sequence
  chemically synthesized
acacaacagatatttattgttt

SEQ ID NO: 1389955 - DNA, 22 bp, Artificial Sequence
  chemically synthesized
aacacaacagatatttattgtt

SEQ ID NO: 1389956 - DNA, 22 bp, Artificial Sequence
  chemically synthesized
tgacatgagcaaacaataaata

SEQ ID NO: 1389957 - DNA, 22 bp, Artificial Sequence
  chemically synthesized
agtgccttaacacaacagatat

SEQ ID NO: 1389958 - DNA, 22 bp, Artificial Sequence
  chemically synthesized
cagtgccttaacacaacagata

SEQ ID NO: 1389959 - DNA, 22 bp, Artificial Sequence
  chemically synthesized
ttgtgttaaggcactgaaattg

SEQ ID NO: 1389960 - DNA, 22 bp, Artificial Sequence
  chemically synthesized
tgttaaggcactgaaattgtgg

SEQ ID NO: 1389961 - DNA, 22 bp, Artificial Sequence
  chemically synthesized
gcatagcaaaccaaacccacaa

SEQ ID NO: 1389962 - DNA, 22 bp, Artificial Sequence
  chemically synthesized
aggcactgaaattgtgggtttg

SEQ ID NO: 1389963 - DNA, 22 bp, Artificial Sequence
  chemically synthesized
gctagcatagcaaaccaaaccc

SEQ ID NO: 1389964 - DNA, 22 bp, Artificial Sequence
  chemically synthesized
aaattgtgggtttggtttgcta

SEQ ID NO: 1389965 - DNA, 22 bp, Artificial Sequence
  chemically synthesized
atgctagctagcatagcaaacc

SEQ ID NO: 1389966 - DNA, 22 bp, Artificial Sequence
  chemically synthesized
aatgctagctagcatagcaaac

SEQ ID NO: 1389967 - DNA, 22 bp, Artificial Sequence
  chemically synthesized
taatgctagctagcatagcaaa

SEQ ID NO: 1389968 - DNA, 22 bp, Artificial Sequence
  chemically synthesized
ttaatgctagctagcatagcaa

SEQ ID NO: 1389969 - DNA, 22 bp, Artificial Sequence
  chemically synthesized
tgggtttggtttgctatgctag

SEQ ID NO: 1389970 - DNA, 22 bp, Artificial Sequence
  chemically synthesized
ttttaatgctagctagcatagc

SEQ ID NO: 1389971 - DNA, 22 bp, Artificial Sequence
  chemically synthesized
attcttttaatgctagctagca

SEQ ID NO: 1389972 - DNA, 22 bp, Artificial Sequence
  chemically synthesized
ggtttgctatgctagctagcat

SEQ ID NO: 1389973 - DNA, 22 bp, Artificial Sequence
  chemically synthesized
gtttgctatgctagctagcatt

SEQ ID NO: 1389974 - DNA, 22 bp, Artificial Sequence
  chemically synthesized
gctatgctagctagcattaaaa

SEQ ID NO: 1389975 - DNA, 22 bp, Artificial Sequence
  chemically synthesized
ctatgctagctagcattaaaag

SEQ ID NO: 1389976 - DNA, 22 bp, Artificial Sequence
  chemically synthesized
tgctagctagcattaaaagaat

SEQ ID NO: 1389977 - DNA, 22 bp, Artificial Sequence
  chemically synthesized
gctagcattaaaagaatgaata

SEQ ID NO: 1389978 - DNA, 22 bp, Artificial Sequence
  chemically synthesized
caaagcgtgatagtatattcat

SEQ ID NO: 1389979 - DNA, 22 bp, Artificial Sequence
  chemically synthesized
gcattaaaagaatgaatatact

SEQ ID NO: 1389980 - DNA, 22 bp, Artificial Sequence
  chemically synthesized
aaagaatgaatatactatcacg

SEQ ID NO: 1389981 - DNA, 22 bp, Artificial Sequence
  chemically synthesized
tagaacgattgcaaagcgtgat

SEQ ID NO: 1389982 - DNA, 22 bp, Artificial Sequence
  chemically synthesized
tcacgctttgcaatcgttctac

SEQ ID NO: 1389983 - DNA, 22 bp, Artificial Sequence
  chemically synthesized
agtgaaaaaggaaagttgtaga

SEQ ID NO: 1389984 - DNA, 22 bp, Artificial Sequence
  chemically synthesized
tgcaatcgttctacaactttcc

SEQ ID NO: 1389985 - DNA, 22 bp, Artificial Sequence
  chemically synthesized
gcaatcgttctacaactttcct

SEQ ID NO: 1389986 - DNA, 22 bp, Artificial Sequence
  chemically synthesized
caatcgttctacaactttcctt

SEQ ID NO: 1389987 - DNA, 22 bp, Artificial Sequence
  chemically synthesized
tacaactttcctttttcactca

SEQ ID NO: 1389988 - DNA, 22 bp, Artificial Sequence
  chemically synthesized
caactttcctttttcactcaat

SEQ ID NO: 1389989 - DNA, 22 bp, Artificial Sequence
  chemically synthesized
tcctttttcactcaatattata

SEQ ID NO: 1389990 - DNA, 22 bp, Artificial Sequence
  chemically synthesized
cctttttcactcaatattatat

SEQ ID NO: 1389991 - DNA, 22 bp, Artificial Sequence
  chemically synthesized
tgtaacccaaatatataatatt

SEQ ID NO: 1389992 - DNA, 22 bp, Artificial Sequence
  chemically synthesized
ctttttcactcaatattatata

SEQ ID NO: 1389993 - DNA, 22 bp, Artificial Sequence
  chemically synthesized
tttcactcaatattatatattt

SEQ ID NO: 1389994 - DNA, 22 bp, Artificial Sequence
  chemically synthesized
ttcactcaatattatatatttg

SEQ ID NO: 1389995 - DNA, 22 bp, Artificial Sequence
  chemically synthesized
tcactcaatattatatatttgg

SEQ ID NO: 1389996 - DNA, 22 bp, Artificial Sequence
  chemically synthesized
cactcaatattatatatttggg

SEQ ID NO: 1389997 - DNA, 22 bp, Artificial Sequence
  chemically synthesized
actcaatattatatatttgggt

SEQ ID NO: 1389998 - DNA, 22 bp, Artificial Sequence
  chemically synthesized
acaataattatgtaacccaaat

SEQ ID NO: 1389999 - DNA, 22 bp, Artificial Sequence
  chemically synthesized
aatattatatatttgggttaca

SEQ ID NO: 1390000 - DNA, 22 bp, Artificial Sequence
  chemically synthesized
tatatttgggttacataattat

SEQ ID NO: 1390001 - DNA, 22 bp, Artificial Sequence
  chemically synthesized
gatccatatctcacaataatta

SEQ ID NO: 1390002 - DNA, 22 bp, Artificial Sequence
  chemically synthesized
gggttacataattattgtgaga

SEQ ID NO: 1390003 - DNA, 22 bp, Artificial Sequence
  chemically synthesized
attagatccatatctcacaata

SEQ ID NO: 1390004 - DNA, 22 bp, Artificial Sequence
  chemically synthesized
ggttacataattattgtgagat

SEQ ID NO: 1390005 - DNA, 22 bp, Artificial Sequence
  chemically synthesized
tattaattagatccatatctca

SEQ ID NO: 1390006 - DNA, 22 bp, Artificial Sequence
  chemically synthesized
cataattattgtgagatatgga

SEQ ID NO: 1390007 - DNA, 22 bp, Artificial Sequence
  chemically synthesized
ttgtgagatatggatctaatta

SEQ ID NO: 1390008 - DNA, 22 bp, Artificial Sequence
  chemically synthesized
aaaaaccctgtattaattagat

SEQ ID NO: 1390009 - DNA, 22 bp, Artificial Sequence
  chemically synthesized
gaaaaaccctgtattaattaga

SEQ ID NO: 1390010 - DNA, 22 bp, Artificial Sequence
  chemically synthesized
tgagatatggatctaattaata

SEQ ID NO: 1390011 - DNA, 22 bp, Artificial Sequence
  chemically synthesized
tgaaaaaccctgtattaattag

SEQ ID NO: 1390012 - DNA, 22 bp, Artificial Sequence
  chemically synthesized
ttgaaaaaccctgtattaatta

SEQ ID NO: 1390013 - DNA, 22 bp, Artificial Sequence
  chemically synthesized
aaagtgccacttttgaaaaacc

SEQ ID NO: 1390014 - DNA, 22 bp, Artificial Sequence
  chemically synthesized
attaatacagggtttttcaaaa

SEQ ID NO: 1390015 - DNA, 22 bp, Artificial Sequence
  chemically synthesized
atacagggtttttcaaaagtgg

SEQ ID NO: 1390016 - DNA, 22 bp, Artificial Sequence
  chemically synthesized
tcagtccaaaacgttaaaagtg

SEQ ID NO: 1390017 - DNA, 22 bp, Artificial Sequence
  chemically synthesized
ttcaaaagtggcacttttaacg

SEQ ID NO: 1390018 - DNA, 22 bp, Artificial Sequence
  chemically synthesized
tcaaaagtggcacttttaacgt

SEQ ID NO: 1390019 - DNA, 22 bp, Artificial Sequence
  chemically synthesized
caaaagtggcacttttaacgtt

SEQ ID NO: 1390020 - DNA, 22 bp, Artificial Sequence
  chemically synthesized
aaaagtggcacttttaacgttt

SEQ ID NO: 1390021 - DNA, 22 bp, Artificial Sequence
  chemically synthesized
ttaacgttttggactgataatt

SEQ ID NO: 1390022 - DNA, 22 bp, Artificial Sequence
  chemically synthesized
ccccgaacaaacaattatcagt

SEQ ID NO: 1390023 - DNA, 22 bp, Artificial Sequence
  chemically synthesized
taacgttttggactgataattg

SEQ ID NO: 1390024 - DNA, 22 bp, Artificial Sequence
  chemically synthesized
aacgttttggactgataattgt

SEQ ID NO: 1390025 - DNA, 22 bp, Artificial Sequence
  chemically synthesized
acgttttggactgataattgtt

SEQ ID NO: 1390026 - DNA, 22 bp, Artificial Sequence
  chemically synthesized
tggactgataattgtttgttcg

SEQ ID NO: 1390027 - DNA, 22 bp, Artificial Sequence
  chemically synthesized
ggactgataattgtttgttcgg

SEQ ID NO: 1390028 - DNA, 22 bp, Artificial Sequence
  chemically synthesized
gactgataattgtttgttcggg

SEQ ID NO: 1390029 - DNA, 22 bp, Artificial Sequence
  chemically synthesized
ataattgtttgttcgggggagg

SEQ ID NO: 1390030 - DNA, 22 bp, Artificial Sequence
  chemically synthesized
caatgcaaaggacggcctcccc

SEQ ID NO: 1390031 - DNA, 22 bp, Artificial Sequence
  chemically synthesized
tttgttcgggggaggccgtcct

SEQ ID NO: 1390032 - DNA, 22 bp, Artificial Sequence
  chemically synthesized
gttcgggggaggccgtcctttg

SEQ ID NO: 1390033 - DNA, 22 bp, Artificial Sequence
  chemically synthesized
ttcgggggaggccgtcctttgc

SEQ ID NO: 1390034 - DNA, 22 bp, Artificial Sequence
  chemically synthesized
gggggaggccgtcctttgcatt

SEQ ID NO: 1390035 - DNA, 22 bp, Artificial Sequence
  chemically synthesized
gcaaacatcctacaatgcaaag

SEQ ID NO: 1390036 - DNA, 22 bp, Artificial Sequence
  chemically synthesized
tggcaaacatcctacaatgcaa

SEQ ID NO: 1390037 - DNA, 22 bp, Artificial Sequence
  chemically synthesized
tgcattgtaggatgtttgccag

SEQ ID NO: 1390038 - DNA, 22 bp, Artificial Sequence
  chemically synthesized
gcattgtaggatgtttgccaga

SEQ ID NO: 1390039 - DNA, 22 bp, Artificial Sequence
  chemically synthesized
cattgtaggatgtttgccagaa

SEQ ID NO: 1390040 - DNA, 22 bp, Artificial Sequence
  chemically synthesized
taggatgtttgccagaatctct

SEQ ID NO: 1390041 - DNA, 22 bp, Artificial Sequence
  chemically synthesized
gtaggtagaagacagagattct

SEQ ID NO: 1390042 - DNA, 22 bp, Artificial Sequence
  chemically synthesized
gcatctagtaggtagaagacag

SEQ ID NO: 1390043 - DNA, 22 bp, Artificial Sequence
  chemically synthesized
gccagaatctctgtcttctacc

SEQ ID NO: 1390044 - DNA, 22 bp, Artificial Sequence
  chemically synthesized
ccagaatctctgtcttctacct

SEQ ID NO: 1390045 - DNA, 22 bp, Artificial Sequence
  chemically synthesized
tactggcatctagtaggtagaa

SEQ ID NO: 1390046 - DNA, 22 bp, Artificial Sequence
  chemically synthesized
tgtcttctacctactagatgcc

SEQ ID NO: 1390047 - DNA, 22 bp, Artificial Sequence
  chemically synthesized
tcttctacctactagatgccag

SEQ ID NO: 1390048 - DNA, 22 bp, Artificial Sequence
  chemically synthesized
ctacctactagatgccagtaca

SEQ ID NO: 1390049 - DNA, 22 bp, Artificial Sequence
  chemically synthesized
tacctactagatgccagtacaa

SEQ ID NO: 1390050 - DNA, 22 bp, Artificial Sequence
  chemically synthesized
cctactagatgccagtacaatg

SEQ ID NO: 1390051 - DNA, 22 bp, Artificial Sequence
  chemically synthesized
cggaagtggtagcattgtactg

SEQ ID NO: 1390052 - DNA, 22 bp, Artificial Sequence
  chemically synthesized
ctgcggaagtggtagcattgta

SEQ ID NO: 1390053 - DNA, 22 bp, Artificial Sequence
  chemically synthesized
ctagatgccagtacaatgctac

SEQ ID NO: 1390054 - DNA, 22 bp, Artificial Sequence
  chemically synthesized
gatgccagtacaatgctaccac

SEQ ID NO: 1390055 - DNA, 22 bp, Artificial Sequence
  chemically synthesized
tcgtaattactgcggaagtggt

SEQ ID NO: 1390056 - DNA, 22 bp, Artificial Sequence
  chemically synthesized
atcgtaattactgcggaagtgg

SEQ ID NO: 1390057 - DNA, 22 bp, Artificial Sequence
  chemically synthesized
tatcgtaattactgcggaagtg

SEQ ID NO: 1390058 - DNA, 22 bp, Artificial Sequence
  chemically synthesized
ttatcgtaattactgcggaagt

SEQ ID NO: 1390059 - DNA, 22 bp, Artificial Sequence
  chemically synthesized
tttatcgtaattactgcggaag

SEQ ID NO: 1390060 - DNA, 22 bp, Artificial Sequence
  chemically synthesized
ttttatcgtaattactgcggaa

SEQ ID NO: 1390061 - DNA, 22 bp, Artificial Sequence
  chemically synthesized
tttttatcgtaattactgcgga

SEQ ID NO: 1390062 - DNA, 22 bp, Artificial Sequence
  chemically synthesized
cagttttttttatcgtaattac

SEQ ID NO: 1390063 - DNA, 22 bp, Artificial Sequence
  chemically synthesized
ccacttccgcagtaattacgat

SEQ ID NO: 1390064 - DNA, 22 bp, Artificial Sequence
  chemically synthesized
ccgcagtaattacgataaaaaa

SEQ ID NO: 1390065 - DNA, 22 bp, Artificial Sequence
  chemically synthesized
cgcagtaattacgataaaaaaa

SEQ ID NO: 1390066 - DNA, 22 bp, Artificial Sequence
  chemically synthesized
acaatgtctgcagtttttttta

SEQ ID NO: 1390067 - DNA, 22 bp, Artificial Sequence
  chemically synthesized
gacaatgtctgcagtttttttt

SEQ ID NO: 1390068 - DNA, 22 bp, Artificial Sequence
  chemically synthesized
cgataaaaaaaactgcagacat

SEQ ID NO: 1390069 - DNA, 22 bp, Artificial Sequence
  chemically synthesized
gccatgaataagacatttgaca

SEQ ID NO: 1390070 - DNA, 22 bp, Artificial Sequence
  chemically synthesized
ggccatgaataagacatttgac

SEQ ID NO: 1390071 - DNA, 22 bp, Artificial Sequence
  chemically synthesized
cagacattgtcaaatgtcttat

SEQ ID NO: 1390072 - DNA, 22 bp, Artificial Sequence
  chemically synthesized
tcaaatgtcttattcatggcca

SEQ ID NO: 1390073 - DNA, 22 bp, Artificial Sequence
  chemically synthesized
aaccaggcatgagtttggccat

SEQ ID NO: 1390074 - DNA, 22 bp, Artificial Sequence
  chemically synthesized
tcaaccaggcatgagtttggcc

SEQ ID NO: 1390075 - DNA, 22 bp, Artificial Sequence
  chemically synthesized
attcatggccaaactcatgcct

SEQ ID NO: 1390076 - DNA, 22 bp, Artificial Sequence
  chemically synthesized
ttcatggccaaactcatgcctg

SEQ ID NO: 1390077 - DNA, 22 bp, Artificial Sequence
  chemically synthesized
atggccaaactcatgcctggtt

SEQ ID NO: 1390078 - DNA, 22 bp, Artificial Sequence
  chemically synthesized
gataagtggttctcaaccaggc

SEQ ID NO: 1390079 - DNA, 22 bp, Artificial Sequence
  chemically synthesized
atgcctggttgagaaccactta

SEQ ID NO: 1390080 - DNA, 22 bp, Artificial Sequence
  chemically synthesized
aaaagagtgtattagataagtg

SEQ ID NO: 1390081 - DNA, 22 bp, Artificial Sequence
  chemically synthesized
gttgagaaccacttatctaata

SEQ ID NO: 1390082 - DNA, 22 bp, Artificial Sequence
  chemically synthesized
agaaccacttatctaatacact

SEQ ID NO: 1390083 - DNA, 22 bp, Artificial Sequence
  chemically synthesized
tcaagcagctaaaaagagtgta

SEQ ID NO: 1390084 - DNA, 22 bp, Artificial Sequence
  chemically synthesized
atctaatacactctttttagct

SEQ ID NO: 1390085 - DNA, 22 bp, Artificial Sequence
  chemically synthesized
tctaatacactctttttagctg

SEQ ID NO: 1390086 - DNA, 22 bp, Artificial Sequence
  chemically synthesized
atacactctttttagctgcttg

SEQ ID NO: 1390087 - DNA, 22 bp, Artificial Sequence
  chemically synthesized
tggtgaaatactatcaagcagc

SEQ ID NO: 1390088 - DNA, 22 bp, Artificial Sequence
  chemically synthesized
tttttagctgcttgatagtatt

SEQ ID NO: 1390089 - DNA, 22 bp, Artificial Sequence
  chemically synthesized
atgcctgtggtgaaatactatc

SEQ ID NO: 1390090 - DNA, 22 bp, Artificial Sequence
  chemically synthesized
tttagctgcttgatagtatttc

SEQ ID NO: 1390091 - DNA, 22 bp, Artificial Sequence
  chemically synthesized
gatgcctgtggtgaaatactat

SEQ ID NO: 1390092 - DNA, 22 bp, Artificial Sequence
  chemically synthesized
ttagctgcttgatagtatttca

SEQ ID NO: 1390093 - DNA, 22 bp, Artificial Sequence
  chemically synthesized
tagctgcttgatagtatttcac

SEQ ID NO: 1390094 - DNA, 22 bp, Artificial Sequence
  chemically synthesized
agctgcttgatagtatttcacc

SEQ ID NO: 1390095 - DNA, 22 bp, Artificial Sequence
  chemically synthesized
gctgcttgatagtatttcacca

SEQ ID NO: 1390096 - DNA, 22 bp, Artificial Sequence
  chemically synthesized
cttgatagtatttcaccacagg

SEQ ID NO: 1390097 - DNA, 22 bp, Artificial Sequence
  chemically synthesized
gatagtatttcaccacaggcat

SEQ ID NO: 1390098 - DNA, 22 bp, Artificial Sequence
  chemically synthesized
atagtatttcaccacaggcatc

SEQ ID NO: 1390099 - DNA, 22 bp, Artificial Sequence
  chemically synthesized
caccacaggcatcaaggatatt

SEQ ID NO: 1390100 - DNA, 22 bp, Artificial Sequence
  chemically synthesized
accacaggcatcaaggatattt

SEQ ID NO: 1390101 - DNA, 22 bp, Artificial Sequence
  chemically synthesized
aatagtgtaaaaatataataaa

SEQ ID NO: 1390102 - DNA, 22 bp, Artificial Sequence
  chemically synthesized
ttcaatagtgtaaaaatataat

SEQ ID NO: 1390103 - DNA, 22 bp, Artificial Sequence
  chemically synthesized
attgttcaatagtgtaaaaata

SEQ ID NO: 1390104 - DNA, 22 bp, Artificial Sequence
  chemically synthesized
cattgttcaatagtgtaaaaat

SEQ ID NO: 1390105 - DNA, 22 bp, Artificial Sequence
  chemically synthesized
tcattgttcaatagtgtaaaaa

SEQ ID NO: 1390106 - DNA, 22 bp, Artificial Sequence
  chemically synthesized
attatatttttacactattgaa

SEQ ID NO: 1390107 - DNA, 22 bp, Artificial Sequence
  chemically synthesized
ttatatttttacactattgaac

SEQ ID NO: 1390108 - DNA, 22 bp, Artificial Sequence
  chemically synthesized
caaggattttcattgttcaata

SEQ ID NO: 1390109 - DNA, 22 bp, Artificial Sequence
  chemically synthesized
tatttttacactattgaacaat

SEQ ID NO: 1390110 - DNA, 22 bp, Artificial Sequence
  chemically synthesized
ttacactattgaacaatgaaaa

SEQ ID NO: 1390111 - DNA, 22 bp, Artificial Sequence
  chemically synthesized
tacactattgaacaatgaaaat

SEQ ID NO: 1390112 - DNA, 22 bp, Artificial Sequence
  chemically synthesized
acactattgaacaatgaaaatc

SEQ ID NO: 1390113 - DNA, 22 bp, Artificial Sequence
  chemically synthesized
cactattgaacaatgaaaatcc

SEQ ID NO: 1390114 - DNA, 22 bp, Artificial Sequence
  chemically synthesized
aaaatcagttacaaggattttc

SEQ ID NO: 1390115 - DNA, 22 bp, Artificial Sequence
  chemically synthesized
ttgaacaatgaaaatccttgta

SEQ ID NO: 1390116 - DNA, 22 bp, Artificial Sequence
  chemically synthesized
agctcaaaatcagttacaagga

SEQ ID NO: 1390117 - DNA, 22 bp, Artificial Sequence
  chemically synthesized
aacaatgaaaatccttgtaact

SEQ ID NO: 1390118 - DNA, 22 bp, Artificial Sequence
  chemically synthesized
gtaactgattttgagctgaatt

SEQ ID NO: 1390119 - DNA, 22 bp, Artificial Sequence
  chemically synthesized
taactgattttgagctgaatta

SEQ ID NO: 1390120 - DNA, 22 bp, Artificial Sequence
  chemically synthesized
gtatgggtatcataattcagct

SEQ ID NO: 1390121 - DNA, 22 bp, Artificial Sequence
  chemically synthesized
attttgagctgaattatgatac

SEQ ID NO: 1390122 - DNA, 22 bp, Artificial Sequence
  chemically synthesized
agcagctagtatgggtatcata

SEQ ID NO: 1390123 - DNA, 22 bp, Artificial Sequence
  chemically synthesized
aagcagctagtatgggtatcat

SEQ ID NO: 1390124 - DNA, 22 bp, Artificial Sequence
  chemically synthesized
tgagctgaattatgatacccat

SEQ ID NO: 1390125 - DNA, 22 bp, Artificial Sequence
  chemically synthesized
gagctgaattatgatacccata

SEQ ID NO: 1390126 - DNA, 22 bp, Artificial Sequence
  chemically synthesized
ttaagcagctagtatgggtatc

SEQ ID NO: 1390127 - DNA, 22 bp, Artificial Sequence
  chemically synthesized
agctgaattatgatacccatac

SEQ ID NO: 1390128 - DNA, 22 bp, Artificial Sequence
  chemically synthesized
cttaagcagctagtatgggtat

SEQ ID NO: 1390129 - DNA, 22 bp, Artificial Sequence
  chemically synthesized
ttcttaagcagctagtatgggt

SEQ ID NO: 1390130 - DNA, 22 bp, Artificial Sequence
  chemically synthesized
cttcttaagcagctagtatggg

SEQ ID NO: 1390131 - DNA, 22 bp, Artificial Sequence
  chemically synthesized
aattatgatacccatactagct

SEQ ID NO: 1390132 - DNA, 22 bp, Artificial Sequence
  chemically synthesized
ttcttcttaagcagctagtatg

SEQ ID NO: 1390133 - DNA, 22 bp, Artificial Sequence
  chemically synthesized
cttcttcttaagcagctagtat

SEQ ID NO: 1390134 - DNA, 22 bp, Artificial Sequence
  chemically synthesized
tgatacccatactagctgctta

SEQ ID NO: 1390135 - DNA, 22 bp, Artificial Sequence
  chemically synthesized
aagaaaaggcatttcttcttct

SEQ ID NO: 1390136 - DNA, 22 bp, Artificial Sequence
  chemically synthesized
gctgcttaagaagaagaaatgc

SEQ ID NO: 1390137 - DNA, 22 bp, Artificial Sequence
  chemically synthesized
atgttgaagaaaaggcatttct

SEQ ID NO: 1390138 - DNA, 22 bp, Artificial Sequence
  chemically synthesized
cttaagaagaagaaatgccttt

SEQ ID NO: 1390139 - DNA, 22 bp, Artificial Sequence
  chemically synthesized
ttgatgttgaagaaaaggcatt

SEQ ID NO: 1390140 - DNA, 22 bp, Artificial Sequence
  chemically synthesized
attgatgttgaagaaaaggcat

SEQ ID NO: 1390141 - DNA, 22 bp, Artificial Sequence
  chemically synthesized
aagaagaagaaatgccttttct

SEQ ID NO: 1390142 - DNA, 22 bp, Artificial Sequence
  chemically synthesized
tattgatgttgaagaaaaggca

SEQ ID NO: 1390143 - DNA, 22 bp, Artificial Sequence
  chemically synthesized
agaagaagaaatgccttttctt

SEQ ID NO: 1390144 - DNA, 22 bp, Artificial Sequence
  chemically synthesized
ttattgatgttgaagaaaaggc

SEQ ID NO: 1390145 - DNA, 22 bp, Artificial Sequence
  chemically synthesized
tttattgatgttgaagaaaagg

SEQ ID NO: 1390146 - DNA, 22 bp, Artificial Sequence
  chemically synthesized
ctttttattgatgttgaagaaa

SEQ ID NO: 1390147 - DNA, 22 bp, Artificial Sequence
  chemically synthesized
actttttattgatgttgaagaa

SEQ ID NO: 1390148 - DNA, 22 bp, Artificial Sequence
  chemically synthesized
tactttttattgatgttgaaga

SEQ ID NO: 1390149 - DNA, 22 bp, Artificial Sequence
  chemically synthesized
tgctttactttttattgatgtt

SEQ ID NO: 1390150 - DNA, 22 bp, Artificial Sequence
  chemically synthesized
atgctttactttttattgatgt

SEQ ID NO: 1390151 - DNA, 22 bp, Artificial Sequence
  chemically synthesized
tatgctttactttttattgatg

SEQ ID NO: 1390152 - DNA, 22 bp, Artificial Sequence
  chemically synthesized
ttcttcaacatcaataaaaagt

SEQ ID NO: 1390153 - DNA, 22 bp, Artificial Sequence
  chemically synthesized
tcttcaacatcaataaaaagta

SEQ ID NO: 1390154 - DNA, 22 bp, Artificial Sequence
  chemically synthesized
cttcaacatcaataaaaagtaa

SEQ ID NO: 1390155 - DNA, 22 bp, Artificial Sequence
  chemically synthesized
ttcaacatcaataaaaagtaaa

SEQ ID NO: 1390156 - DNA, 22 bp, Artificial Sequence
  chemically synthesized
tataattttatgctttactttt

SEQ ID NO: 1390157 - DNA, 22 bp, Artificial Sequence
  chemically synthesized
caacatcaataaaaagtaaagc

SEQ ID NO: 1390158 - DNA, 22 bp, Artificial Sequence
  chemically synthesized
aacatcaataaaaagtaaagca

SEQ ID NO: 1390159 - DNA, 22 bp, Artificial Sequence
  chemically synthesized
agatctatataattttatgctt

SEQ ID NO: 1390160 - DNA, 22 bp, Artificial Sequence
  chemically synthesized
cagatctatataattttatgct

SEQ ID NO: 1390161 - DNA, 22 bp, Artificial Sequence
  chemically synthesized
tcagatctatataattttatgc

SEQ ID NO: 1390162 - DNA, 22 bp, Artificial Sequence
  chemically synthesized
ttcagatctatataattttatg

SEQ ID NO: 1390163 - DNA, 22 bp, Artificial Sequence
  chemically synthesized
cttttcagatctatataatttt

SEQ ID NO: 1390164 - DNA, 22 bp, Artificial Sequence
  chemically synthesized
acttttcagatctatataattt

SEQ ID NO: 1390165 - DNA, 22 bp, Artificial Sequence
  chemically synthesized
cttacttttcagatctatataa

SEQ ID NO: 1390166 - DNA, 22 bp, Artificial Sequence
  chemically synthesized
accgttccttacttttcagatc

SEQ ID NO: 1390167 - DNA, 22 bp, Artificial Sequence
  chemically synthesized
aaccgttccttacttttcagat

SEQ ID NO: 1390168 - DNA, 22 bp, Artificial Sequence
  chemically synthesized
taaccgttccttacttttcaga

SEQ ID NO: 1390169 - DNA, 22 bp, Artificial Sequence
  chemically synthesized
ttaaccgttccttacttttcag

SEQ ID NO: 1390170 - DNA, 22 bp, Artificial Sequence
  chemically synthesized
tttaaccgttccttacttttca

SEQ ID NO: 1390171 - DNA, 22 bp, Artificial Sequence
  chemically synthesized
tatagatctgaaaagtaaggaa

SEQ ID NO: 1390172 - DNA, 22 bp, Artificial Sequence
  chemically synthesized
tctttttaaccgttccttactt

SEQ ID NO: 1390173 - DNA, 22 bp, Artificial Sequence
  chemically synthesized
ctgtctttttaaccgttcctta

SEQ ID NO: 1390174 - DNA, 22 bp, Artificial Sequence
  chemically synthesized
ctcctgtctttttaaccgttcc

SEQ ID NO: 1390175 - DNA, 22 bp, Artificial Sequence
  chemically synthesized
tactcctgtctttttaaccgtt

SEQ ID NO: 1390176 - DNA, 22 bp, Artificial Sequence
  chemically synthesized
aaaagtaaggaacggttaaaaa

SEQ ID NO: 1390177 - DNA, 22 bp, Artificial Sequence
  chemically synthesized
cattctactcctgtctttttaa

SEQ ID NO: 1390178 - DNA, 22 bp, Artificial Sequence
  chemically synthesized
tacattctactcctgtcttttt

SEQ ID NO: 1390179 - DNA, 22 bp, Artificial Sequence
  chemically synthesized
gtgctctacattctactcctgt

SEQ ID NO: 1390180 - DNA, 22 bp, Artificial Sequence
  chemically synthesized
gcctagtgctctacattctact

SEQ ID NO: 1390181 - DNA, 22 bp, Artificial Sequence
  chemically synthesized
aaaagacaggagtagaatgtag

SEQ ID NO: 1390182 - DNA, 22 bp, Artificial Sequence
  chemically synthesized
cactggcctagtgctctacatt

SEQ ID NO: 1390183 - DNA, 22 bp, Artificial Sequence
  chemically synthesized
gcactggcctagtgctctacat

SEQ ID NO: 1390184 - DNA, 22 bp, Artificial Sequence
  chemically synthesized
tgcactggcctagtgctctaca

SEQ ID NO: 1390185 - DNA, 22 bp, Artificial Sequence
  chemically synthesized
ttgcactggcctagtgctctac

SEQ ID NO: 1390186 - DNA, 22 bp, Artificial Sequence
  chemically synthesized
tttttgcactggcctagtgctc

SEQ ID NO: 1390187 - DNA, 22 bp, Artificial Sequence
  chemically synthesized
tatttttgcactggcctagtgc

SEQ ID NO: 1390188 - DNA, 22 bp, Artificial Sequence
  chemically synthesized
ctatttttgcactggcctagtg

SEQ ID NO: 1390189 - DNA, 22 bp, Artificial Sequence
  chemically synthesized
agcttctatttttgcactggcc

SEQ ID NO: 1390190 - DNA, 22 bp, Artificial Sequence
  chemically synthesized
gagttcagcttctatttttgca

SEQ ID NO: 1390191 - DNA, 22 bp, Artificial Sequence
  chemically synthesized
agagttcagcttctatttttgc

SEQ ID NO: 1390192 - DNA, 22 bp, Artificial Sequence
  chemically synthesized
ggccagtgcaaaaatagaagct

SEQ ID NO: 1390193 - DNA, 22 bp, Artificial Sequence
  chemically synthesized
tgtcccagtttagagttcagct

SEQ ID NO: 1390194 - DNA, 22 bp, Artificial Sequence
  chemically synthesized
aggtgtgattgtgtcccagttt

SEQ ID NO: 1390195 - DNA, 22 bp, Artificial Sequence
  chemically synthesized
aactctaaactgggacacaatc

SEQ ID NO: 1390196 - DNA, 22 bp, Artificial Sequence
  chemically synthesized
acaactaaggtgtgattgtgtc

SEQ ID NO: 1390197 - DNA, 22 bp, Artificial Sequence
  chemically synthesized
taaactgggacacaatcacacc

SEQ ID NO: 1390198 - DNA, 22 bp, Artificial Sequence
  chemically synthesized
aattaacaactaaggtgtgatt

SEQ ID NO: 1390199 - DNA, 22 bp, Artificial Sequence
  chemically synthesized
aactgggacacaatcacacctt

SEQ ID NO: 1390200 - DNA, 22 bp, Artificial Sequence
  chemically synthesized
aaattaacaactaaggtgtgat

SEQ ID NO: 1390201 - DNA, 22 bp, Artificial Sequence
  chemically synthesized
cttaaattaacaactaaggtgt

SEQ ID NO: 1390202 - DNA, 22 bp, Artificial Sequence
  chemically synthesized
ggacacaatcacaccttagttg

SEQ ID NO: 1390203 - DNA, 22 bp, Artificial Sequence
  chemically synthesized
agaagcatccattacttaaatt

SEQ ID NO: 1390204 - DNA, 22 bp, Artificial Sequence
  chemically synthesized
actcagaagcatccattactta

SEQ ID NO: 1390205 - DNA, 22 bp, Artificial Sequence
  chemically synthesized
agttgttaatttaagtaatgga

SEQ ID NO: 1390206 - DNA, 22 bp, Artificial Sequence
  chemically synthesized
gttgttaatttaagtaatggat

SEQ ID NO: 1390207 - DNA, 22 bp, Artificial Sequence
  chemically synthesized
ctaactcagaagcatccattac

SEQ ID NO: 1390208 - DNA, 22 bp, Artificial Sequence
  chemically synthesized
ttaatttaagtaatggatgctt

SEQ ID NO: 1390209 - DNA, 22 bp, Artificial Sequence
  chemically synthesized
atttaagtaatggatgcttctg

SEQ ID NO: 1390210 - DNA, 22 bp, Artificial Sequence
  chemically synthesized
atattcctaactcagaagcatc

SEQ ID NO: 1390211 - DNA, 22 bp, Artificial Sequence
  chemically synthesized
aagtaatggatgcttctgagtt

SEQ ID NO: 1390212 - DNA, 22 bp, Artificial Sequence
  chemically synthesized
agtaatggatgcttctgagtta

SEQ ID NO: 1390213 - DNA, 22 bp, Artificial Sequence
  chemically synthesized
tggtgtgagtgagctaatattc

SEQ ID NO: 1390214 - DNA, 22 bp, Artificial Sequence
  chemically synthesized
ctgagttaggaatattagctca

SEQ ID NO: 1390215 - DNA, 22 bp, Artificial Sequence
  chemically synthesized
tgagttaggaatattagctcac

SEQ ID NO: 1390216 - DNA, 22 bp, Artificial Sequence
  chemically synthesized
agttaggaatattagctcactc

SEQ ID NO: 1390217 - DNA, 22 bp, Artificial Sequence
  chemically synthesized
ggaatattagctcactcacacc

SEQ ID NO: 1390218 - DNA, 22 bp, Artificial Sequence
  chemically synthesized
atgatggattgtggtgtgagtg

SEQ ID NO: 1390219 - DNA, 22 bp, Artificial Sequence
  chemically synthesized
cctgatgatggattgtggtgtg

SEQ ID NO: 1390220 - DNA, 22 bp, Artificial Sequence
  chemically synthesized
gctcactcacaccacaatccat

SEQ ID NO: 1390221 - DNA, 22 bp, Artificial Sequence
  chemically synthesized
actcacaccacaatccatcatc

SEQ ID NO: 1390222 - DNA, 22 bp, Artificial Sequence
  chemically synthesized
acaccacaatccatcatcaggc

SEQ ID NO: 1390223 - DNA, 22 bp, Artificial Sequence
  chemically synthesized
gagaaggtaagaatcataaagg

SEQ ID NO: 1390224 - DNA, 22 bp, Artificial Sequence
  chemically synthesized
ggagaaggtaagaatcataaag

SEQ ID NO: 1390225 - DNA, 22 bp, Artificial Sequence
  chemically synthesized
tggagaaggtaagaatcataaa

SEQ ID NO: 1390226 - DNA, 22 bp, Artificial Sequence
  chemically synthesized
ttttggagaaggtaagaatcat

SEQ ID NO: 1390227 - DNA, 22 bp, Artificial Sequence
  chemically synthesized
tatgattcttaccttctccaaa

SEQ ID NO: 1390228 - DNA, 22 bp, Artificial Sequence
  chemically synthesized
atgattcttaccttctccaaaa

SEQ ID NO: 1390229 - DNA, 22 bp, Artificial Sequence
  chemically synthesized
tgattcttaccttctccaaaac

SEQ ID NO: 1390230 - DNA, 22 bp, Artificial Sequence
  chemically synthesized
aatggtaggaattgttttggag

SEQ ID NO: 1390231 - DNA, 22 bp, Artificial Sequence
  chemically synthesized
ttaccttctccaaaacaattcc

SEQ ID NO: 1390232 - DNA, 22 bp, Artificial Sequence
  chemically synthesized
accttctccaaaacaattccta

SEQ ID NO: 1390233 - DNA, 22 bp, Artificial Sequence
  chemically synthesized
ccttctccaaaacaattcctac

SEQ ID NO: 1390234 - DNA, 22 bp, Artificial Sequence
  chemically synthesized
cagatgagttgaatggtaggaa

SEQ ID NO: 1390235 - DNA, 22 bp, Artificial Sequence
  chemically synthesized
ctccaaaacaattcctaccatt

SEQ ID NO: 1390236 - DNA, 22 bp, Artificial Sequence
  chemically synthesized
gcagatgagttgaatggtagga

SEQ ID NO: 1390237 - DNA, 22 bp, Artificial Sequence
  chemically synthesized
tccaaaacaattcctaccattc

SEQ ID NO: 1390238 - DNA, 22 bp, Artificial Sequence
  chemically synthesized
tgcagatgagttgaatggtagg

SEQ ID NO: 1390239 - DNA, 22 bp, Artificial Sequence
  chemically synthesized
caaaacaattcctaccattcaa

SEQ ID NO: 1390240 - DNA, 22 bp, Artificial Sequence
  chemically synthesized
acaggctttgcagatgagttga

SEQ ID NO: 1390241 - DNA, 22 bp, Artificial Sequence
  chemically synthesized
ctaccattcaactcatctgcaa

SEQ ID NO: 1390242 - DNA, 22 bp, Artificial Sequence
  chemically synthesized
ccattcaactcatctgcaaagc

SEQ ID NO: 1390243 - DNA, 22 bp, Artificial Sequence
  chemically synthesized
cagggagcactgacaggctttg

SEQ ID NO: 1390244 - DNA, 22 bp, Artificial Sequence
  chemically synthesized
gcagggagcactgacaggcttt

SEQ ID NO: 1390245 - DNA, 22 bp, Artificial Sequence
  chemically synthesized
aactcatctgcaaagcctgtca

SEQ ID NO: 1390246 - DNA, 22 bp, Artificial Sequence
  chemically synthesized
tttgcagggagcactgacaggc

SEQ ID NO: 1390247 - DNA, 22 bp, Artificial Sequence
  chemically synthesized
atctgcaaagcctgtcagtgct

SEQ ID NO: 1390248 - DNA, 22 bp, Artificial Sequence
  chemically synthesized
caaagcctgtcagtgctccctg

SEQ ID NO: 1390249 - DNA, 22 bp, Artificial Sequence
  chemically synthesized
acatgaagtattatttgcaggg

SEQ ID NO: 1390250 - DNA, 22 bp, Artificial Sequence
  chemically synthesized
tcagtgctccctgcaaataata

SEQ ID NO: 1390251 - DNA, 22 bp, Artificial Sequence
  chemically synthesized
cctgcaaataatacttcatgtg

SEQ ID NO: 1390252 - DNA, 22 bp, Artificial Sequence
  chemically synthesized
caaataatacttcatgtgaggc

SEQ ID NO: 1390253 - DNA, 22 bp, Artificial Sequence
  chemically synthesized
tgaaggaaagaaagtagcctca

SEQ ID NO: 1390254 - DNA, 22 bp, Artificial Sequence
  chemically synthesized
atgaaggaaagaaagtagcctc

SEQ ID NO: 1390255 - DNA, 22 bp, Artificial Sequence
  chemically synthesized
catgtgaggctactttctttcc

SEQ ID NO: 1390256 - DNA, 22 bp, Artificial Sequence
  chemically synthesized
atgtgaggctactttctttcct

SEQ ID NO: 1390257 - DNA, 22 bp, Artificial Sequence
  chemically synthesized
acaagggtagtggcacttatga

SEQ ID NO: 1390258 - DNA, 22 bp, Artificial Sequence
  chemically synthesized
ctttctttccttcataagtgcc

SEQ ID NO: 1390259 - DNA, 22 bp, Artificial Sequence
  chemically synthesized
gacaagggtagtggcacttatg

SEQ ID NO: 1390260 - DNA, 22 bp, Artificial Sequence
  chemically synthesized
tgacaagggtagtggcacttat

SEQ ID NO: 1390261 - DNA, 22 bp, Artificial Sequence
  chemically synthesized
tctttccttcataagtgccact

SEQ ID NO: 1390262 - DNA, 22 bp, Artificial Sequence
  chemically synthesized
ctttccttcataagtgccacta

SEQ ID NO: 1390263 - DNA, 22 bp, Artificial Sequence
  chemically synthesized
tttccttcataagtgccactac

SEQ ID NO: 1390264 - DNA, 22 bp, Artificial Sequence
  chemically synthesized
tccttcataagtgccactaccc

SEQ ID NO: 1390265 - DNA, 22 bp, Artificial Sequence
  chemically synthesized
ccttcataagtgccactaccct

SEQ ID NO: 1390266 - DNA, 22 bp, Artificial Sequence
  chemically synthesized
cttcataagtgccactaccctt

SEQ ID NO: 1390267 - DNA, 22 bp, Artificial Sequence
  chemically synthesized
cataagtgccactacccttgtc

SEQ ID NO: 1390268 - DNA, 22 bp, Artificial Sequence
  chemically synthesized
cggggtggctttgacaagggta

SEQ ID NO: 1390269 - DNA, 22 bp, Artificial Sequence
  chemically synthesized
ataagtgccactacccttgtca

SEQ ID NO: 1390270 - DNA, 22 bp, Artificial Sequence
  chemically synthesized
gcggggtggctttgacaagggt

SEQ ID NO: 1390271 - DNA, 22 bp, Artificial Sequence
  chemically synthesized
tgcggggtggctttgacaaggg

SEQ ID NO: 1390272 - DNA, 22 bp, Artificial Sequence
  chemically synthesized
ttgcggggtggctttgacaagg

SEQ ID NO: 1390273 - DNA, 22 bp, Artificial Sequence
  chemically synthesized
acttttgcggggtggctttgac

SEQ ID NO: 1390274 - DNA, 22 bp, Artificial Sequence
  chemically synthesized
cacttttgcggggtggctttga

SEQ ID NO: 1390275 - DNA, 22 bp, Artificial Sequence
  chemically synthesized
tcacttttgcggggtggctttg

SEQ ID NO: 1390276 - DNA, 22 bp, Artificial Sequence
  chemically synthesized
tttcacttttgcggggtggctt

SEQ ID NO: 1390277 - DNA, 22 bp, Artificial Sequence
  chemically synthesized
cccttgtcaaagccaccccgca

SEQ ID NO: 1390278 - DNA, 22 bp, Artificial Sequence
  chemically synthesized
gtcaaagccaccccgcaaaagt

SEQ ID NO: 1390279 - DNA, 22 bp, Artificial Sequence
  chemically synthesized
tcaaagccaccccgcaaaagtg

SEQ ID NO: 1390280 - DNA, 22 bp, Artificial Sequence
  chemically synthesized
gaggaggctctttcacttttgc

SEQ ID NO: 1390281 - DNA, 22 bp, Artificial Sequence
  chemically synthesized
acctcgaggaggctctttcact

SEQ ID NO: 1390282 - DNA, 22 bp, Artificial Sequence
  chemically synthesized
gaaagccattcacctcgaggag

SEQ ID NO: 1390283 - DNA, 22 bp, Artificial Sequence
  chemically synthesized
cagaaggctggaaagccattca

SEQ ID NO: 1390284 - DNA, 22 bp, Artificial Sequence
  chemically synthesized
ccagaaggctggaaagccattc

SEQ ID NO: 1390285 - DNA, 22 bp, Artificial Sequence
  chemically synthesized
tccagaaggctggaaagccatt

SEQ ID NO: 1390286 - DNA, 22 bp, Artificial Sequence
  chemically synthesized
ctcgaggtgaatggctttccag

SEQ ID NO: 1390287 - DNA, 22 bp, Artificial Sequence
  chemically synthesized
gaggtgaatggctttccagcct

SEQ ID NO: 1390288 - DNA, 22 bp, Artificial Sequence
  chemically synthesized
agccagctttccagaaggctgg

SEQ ID NO: 1390289 - DNA, 22 bp, Artificial Sequence
  chemically synthesized
tccagccttctggaaagctggc

SEQ ID NO: 1390290 - DNA, 22 bp, Artificial Sequence
  chemically synthesized
ccagccttctggaaagctggct

SEQ ID NO: 1390291 - DNA, 22 bp, Artificial Sequence
  chemically synthesized
cagccttctggaaagctggctg

SEQ ID NO: 1390292 - DNA, 22 bp, Artificial Sequence
  chemically synthesized
ctggaaagctggctgagccact

SEQ ID NO: 1390293 - DNA, 22 bp, Artificial Sequence
  chemically synthesized
tggaaagctggctgagccactg

SEQ ID NO: 1390294 - DNA, 22 bp, Artificial Sequence
  chemically synthesized
gaaagctggctgagccactgat

SEQ ID NO: 1390295 - DNA, 22 bp, Artificial Sequence
  chemically synthesized
gctgagccactgatgatgatgt

SEQ ID NO: 1390296 - DNA, 22 bp, Artificial Sequence
  chemically synthesized
gaataaaaaggccacatcatca

SEQ ID NO: 1390297 - DNA, 22 bp, Artificial Sequence
  chemically synthesized
agccactgatgatgatgtggcc

SEQ ID NO: 1390298 - DNA, 22 bp, Artificial Sequence
  chemically synthesized
aacctagaataaaaaggccaca

SEQ ID NO: 1390299 - DNA, 22 bp, Artificial Sequence
  chemically synthesized
atgatgatgtggcctttttatt

SEQ ID NO: 1390300 - DNA, 22 bp, Artificial Sequence
  chemically synthesized
aactaaacctagaataaaaagg

SEQ ID NO: 1390301 - DNA, 22 bp, Artificial Sequence
  chemically synthesized
aaactaaacctagaataaaaag

SEQ ID NO: 1390302 - DNA, 22 bp, Artificial Sequence
  chemically synthesized
taatccttaaactaaacctaga

SEQ ID NO: 1390303 - DNA, 22 bp, Artificial Sequence
  chemically synthesized
ataatccttaaactaaacctag

SEQ ID NO: 1390304 - DNA, 22 bp, Artificial Sequence
  chemically synthesized
tataatccttaaactaaaccta

SEQ ID NO: 1390305 - DNA, 22 bp, Artificial Sequence
  chemically synthesized
ttataatccttaaactaaacct

SEQ ID NO: 1390306 - DNA, 22 bp, Artificial Sequence
  chemically synthesized
tttataatccttaaactaaacc

SEQ ID NO: 1390307 - DNA, 22 bp, Artificial Sequence
  chemically synthesized
tttattctaggtttagtttaag

SEQ ID NO: 1390308 - DNA, 22 bp, Artificial Sequence
  chemically synthesized
ttattctaggtttagtttaagg

SEQ ID NO: 1390309 - DNA, 22 bp, Artificial Sequence
  chemically synthesized
gttttttataatccttaaacta

SEQ ID NO: 1390310 - DNA, 22 bp, Artificial Sequence
  chemically synthesized
tattctaggtttagtttaagga

SEQ ID NO: 1390311 - DNA, 22 bp, Artificial Sequence
  chemically synthesized
attctaggtttagtttaaggat

SEQ ID NO: 1390312 - DNA, 22 bp, Artificial Sequence
  chemically synthesized
ttctaggtttagtttaaggatt

SEQ ID NO: 1390313 - DNA, 22 bp, Artificial Sequence
  chemically synthesized
taggtttagtttaaggattata

SEQ ID NO: 1390314 - DNA, 22 bp, Artificial Sequence
  chemically synthesized
ggtttagtttaaggattataaa

SEQ ID NO: 1390315 - DNA, 22 bp, Artificial Sequence
  chemically synthesized
tataaatatctggttttttata

SEQ ID NO: 1390316 - DNA, 22 bp, Artificial Sequence
  chemically synthesized
agtttaaggattataaaaaacc

SEQ ID NO: 1390317 - DNA, 22 bp, Artificial Sequence
  chemically synthesized
atataaatatctggttttttat

SEQ ID NO: 1390318 - DNA, 22 bp, Artificial Sequence
  chemically synthesized
gtttaaggattataaaaaacca

SEQ ID NO: 1390319 - DNA, 22 bp, Artificial Sequence
  chemically synthesized
aaggattataaaaaaccagata

SEQ ID NO: 1390320 - DNA, 22 bp, Artificial Sequence
  chemically synthesized
aggattataaaaaaccagatat

SEQ ID NO: 1390321 - DNA, 22 bp, Artificial Sequence
  chemically synthesized
aagagaatatttatataaatat

SEQ ID NO: 1390322 - DNA, 22 bp, Artificial Sequence
  chemically synthesized
taaaaaaccagatatttatata

SEQ ID NO: 1390323 - DNA, 22 bp, Artificial Sequence
  chemically synthesized
cattcaagagaatatttatata

SEQ ID NO: 1390324 - DNA, 22 bp, Artificial Sequence
  chemically synthesized
ccattcaagagaatatttatat

SEQ ID NO: 1390325 - DNA, 22 bp, Artificial Sequence
  chemically synthesized
tgtgcttccattcaagagaata

SEQ ID NO: 1390326 - DNA, 22 bp, Artificial Sequence
  chemically synthesized
atataaatattctcttgaatgg

SEQ ID NO: 1390327 - DNA, 22 bp, Artificial Sequence
  chemically synthesized
tataaatattctcttgaatgga

SEQ ID NO: 1390328 - DNA, 22 bp, Artificial Sequence
  chemically synthesized
atcatctatgtgcttccattca

SEQ ID NO: 1390329 - DNA, 22 bp, Artificial Sequence
  chemically synthesized
aactaatcatctatgtgcttcc

SEQ ID NO: 1390330 - DNA, 22 bp, Artificial Sequence
  chemically synthesized
gaactaatcatctatgtgcttc

SEQ ID NO: 1390331 - DNA, 22 bp, Artificial Sequence
  chemically synthesized
tcttgaatggaagcacatagat

SEQ ID NO: 1390332 - DNA, 22 bp, Artificial Sequence
  chemically synthesized
ttgaatggaagcacatagatga

SEQ ID NO: 1390333 - DNA, 22 bp, Artificial Sequence
  chemically synthesized
gaatggaagcacatagatgatt

SEQ ID NO: 1390334 - DNA, 22 bp, Artificial Sequence
  chemically synthesized
aatggaagcacatagatgatta

SEQ ID NO: 1390335 - DNA, 22 bp, Artificial Sequence
  chemically synthesized
gaaagaatttgaactaatcatc

SEQ ID NO: 1390336 - DNA, 22 bp, Artificial Sequence
  chemically synthesized
cgaaagaatttgaactaatcat

SEQ ID NO: 1390337 - DNA, 22 bp, Artificial Sequence
  chemically synthesized
catcaccacttcgaaagaattt

SEQ ID NO: 1390338 - DNA, 22 bp, Artificial Sequence
  chemically synthesized
gttcaaattctttcgaagtggt

SEQ ID NO: 1390339 - DNA, 22 bp, Artificial Sequence
  chemically synthesized
ggatattacatcaccacttcga

SEQ ID NO: 1390340 - DNA, 22 bp, Artificial Sequence
  chemically synthesized
aaattctttcgaagtggtgatg

SEQ ID NO: 1390341 - DNA, 22 bp, Artificial Sequence
  chemically synthesized
aactgggatattacatcaccac

SEQ ID NO: 1390342 - DNA, 22 bp, Artificial Sequence
  chemically synthesized
ttcaactgggatattacatcac

SEQ ID NO: 1390343 - DNA, 22 bp, Artificial Sequence
  chemically synthesized
tttcgaagtggtgatgtaatat

SEQ ID NO: 1390344 - DNA, 22 bp, Artificial Sequence
  chemically synthesized
tcgaagtggtgatgtaatatcc

SEQ ID NO: 1390345 - DNA, 22 bp, Artificial Sequence
  chemically synthesized
cgaagtggtgatgtaatatccc

SEQ ID NO: 1390346 - DNA, 22 bp, Artificial Sequence
  chemically synthesized
ccctgttcaactgggatattac

SEQ ID NO: 1390347 - DNA, 22 bp, Artificial Sequence
  chemically synthesized
gaagtggtgatgtaatatccca

SEQ ID NO: 1390348 - DNA, 22 bp, Artificial Sequence
  chemically synthesized
accctgttcaactgggatatta

SEQ ID NO: 1390349 - DNA, 22 bp, Artificial Sequence
  chemically synthesized
ccttaccctgttcaactgggat

SEQ ID NO: 1390350 - DNA, 22 bp, Artificial Sequence
  chemically synthesized
accttaccctgttcaactggga

SEQ ID NO: 1390351 - DNA, 22 bp, Artificial Sequence
  chemically synthesized
taccttaccctgttcaactggg

SEQ ID NO: 1390352 - DNA, 22 bp, Artificial Sequence
  chemically synthesized
ttaccttaccctgttcaactgg

SEQ ID NO: 1390353 - DNA, 22 bp, Artificial Sequence
  chemically synthesized
tttttaccttaccctgttcaac

SEQ ID NO: 1390354 - DNA, 22 bp, Artificial Sequence
  chemically synthesized
atttttaccttaccctgttcaa

SEQ ID NO: 1390355 - DNA, 22 bp, Artificial Sequence
  chemically synthesized
tatttttaccttaccctgttca

SEQ ID NO: 1390356 - DNA, 22 bp, Artificial Sequence
  chemically synthesized
aacagggtaaggtaaaaataaa

SEQ ID NO: 1390357 - DNA, 22 bp, Artificial Sequence
  chemically synthesized
tagaaagtaaaatctttatttt

SEQ ID NO: 1390358 - DNA, 22 bp, Artificial Sequence
  chemically synthesized
gttatagaaagtaaaatcttta

SEQ ID NO: 1390359 - DNA, 22 bp, Artificial Sequence
  chemically synthesized
cctagttatagaaagtaaaatc

SEQ ID NO: 1390360 - DNA, 22 bp, Artificial Sequence
  chemically synthesized
tactttctataactaggcagat

SEQ ID NO: 1390361 - DNA, 22 bp, Artificial Sequence
  chemically synthesized
actttctataactaggcagatc

SEQ ID NO: 1390362 - DNA, 22 bp, Artificial Sequence
  chemically synthesized
ctttctataactaggcagatct

SEQ ID NO: 1390363 - DNA, 22 bp, Artificial Sequence
  chemically synthesized
aaggcccaatgtgagatctgcc

SEQ ID NO: 1390364 - DNA, 22 bp, Artificial Sequence
  chemically synthesized
tctataactaggcagatctcac

SEQ ID NO: 1390365 - DNA, 22 bp, Artificial Sequence
  chemically synthesized
ctataactaggcagatctcaca

SEQ ID NO: 1390366 - DNA, 22 bp, Artificial Sequence
  chemically synthesized
tataactaggcagatctcacat

SEQ ID NO: 1390367 - DNA, 22 bp, Artificial Sequence
  chemically synthesized
taactaggcagatctcacattg

SEQ ID NO: 1390368 - DNA, 22 bp, Artificial Sequence
  chemically synthesized
ggcagatctcacattgggcctt

SEQ ID NO: 1390369 - DNA, 22 bp, Artificial Sequence
  chemically synthesized
acattgggcctttagtgtcatg

SEQ ID NO: 1390370 - DNA, 22 bp, Artificial Sequence
  chemically synthesized
ccagtggaatggcacccatgac

SEQ ID NO: 1390371 - DNA, 22 bp, Artificial Sequence
  chemically synthesized
cccagtggaatggcacccatga

SEQ ID NO: 1390372 - DNA, 22 bp, Artificial Sequence
  chemically synthesized
ggcctttagtgtcatgggtgcc

SEQ ID NO: 1390373 - DNA, 22 bp, Artificial Sequence
  chemically synthesized
tagtgtcatgggtgccattcca

SEQ ID NO: 1390374 - DNA, 22 bp, Artificial Sequence
  chemically synthesized
agtgtcatgggtgccattccac

SEQ ID NO: 1390375 - DNA, 22 bp, Artificial Sequence
  chemically synthesized
gtgtcatgggtgccattccact

SEQ ID NO: 1390376 - DNA, 22 bp, Artificial Sequence
  chemically synthesized
cccggtccatcagatttcccag

SEQ ID NO: 1390377 - DNA, 22 bp, Artificial Sequence
  chemically synthesized
ccccggtccatcagatttccca

SEQ ID NO: 1390378 - DNA, 22 bp, Artificial Sequence
  chemically synthesized
cactgggaaatctgatggaccg

SEQ ID NO: 1390379 - DNA, 22 bp, Artificial Sequence
  chemically synthesized
ggaaatatggcttccccggtcc

SEQ ID NO: 1390380 - DNA, 22 bp, Artificial Sequence
  chemically synthesized
ggaaatctgatggaccggggaa

SEQ ID NO: 1390381 - DNA, 22 bp, Artificial Sequence
  chemically synthesized
ttcggaaatatggcttccccgg

SEQ ID NO: 1390382 - DNA, 22 bp, Artificial Sequence
  chemically synthesized
atggaccggggaagccatattt

SEQ ID NO: 1390383 - DNA, 22 bp, Artificial Sequence
  chemically synthesized
ccgaataggttatctgttccta

SEQ ID NO: 1390384 - DNA, 22 bp, Artificial Sequence
  chemically synthesized
cgaataggttatctgttcctat

SEQ ID NO: 1390385 - DNA, 22 bp, Artificial Sequence
  chemically synthesized
gatgaccacataaataggaaca

SEQ ID NO: 1390386 - DNA, 22 bp, Artificial Sequence
  chemically synthesized
aaaaactggatgaccacataaa

SEQ ID NO: 1390387 - DNA, 22 bp, Artificial Sequence
  chemically synthesized
caaaaactggatgaccacataa

SEQ ID NO: 1390388 - DNA, 22 bp, Artificial Sequence
  chemically synthesized
tctgttcctatttatgtggtca

SEQ ID NO: 1390389 - DNA, 22 bp, Artificial Sequence
  chemically synthesized
ttcctatttatgtggtcatcca

SEQ ID NO: 1390390 - DNA, 22 bp, Artificial Sequence
  chemically synthesized
ctatttatgtggtcatccagtt

SEQ ID NO: 1390391 - DNA, 22 bp, Artificial Sequence
  chemically synthesized
aaaaatttcaaaaactggatga

SEQ ID NO: 1390392 - DNA, 22 bp, Artificial Sequence
  chemically synthesized
tttatgtggtcatccagttttt

SEQ ID NO: 1390393 - DNA, 22 bp, Artificial Sequence
  chemically synthesized
gttaaaaaatttcaaaaactgg

SEQ ID NO: 1390394 - DNA, 22 bp, Artificial Sequence
  chemically synthesized
agttaaaaaatttcaaaaactg

SEQ ID NO: 1390395 - DNA, 22 bp, Artificial Sequence
  chemically synthesized
atgtggtcatccagtttttgaa

SEQ ID NO: 1390396 - DNA, 22 bp, Artificial Sequence
  chemically synthesized
tgtggtcatccagtttttgaaa

SEQ ID NO: 1390397 - DNA, 22 bp, Artificial Sequence
  chemically synthesized
atttagttaaaaaatttcaaaa

SEQ ID NO: 1390398 - DNA, 22 bp, Artificial Sequence
  chemically synthesized
caattgatttagttaaaaaatt

SEQ ID NO: 1390399 - DNA, 22 bp, Artificial Sequence
  chemically synthesized
gcaattgatttagttaaaaaat

SEQ ID NO: 1390400 - DNA, 22 bp, Artificial Sequence
  chemically synthesized
ttgaaattttttaactaaatca

SEQ ID NO: 1390401 - DNA, 22 bp, Artificial Sequence
  chemically synthesized
tgaaattttttaactaaatcaa

SEQ ID NO: 1390402 - DNA, 22 bp, Artificial Sequence
  chemically synthesized
gaaattttttaactaaatcaat

SEQ ID NO: 1390403 - DNA, 22 bp, Artificial Sequence
  chemically synthesized
aaattttttaactaaatcaatt

SEQ ID NO: 1390404 - DNA, 22 bp, Artificial Sequence
  chemically synthesized
gatgaagtttgcaattgattta

SEQ ID NO: 1390405 - DNA, 22 bp, Artificial Sequence
  chemically synthesized
tttaactaaatcaattgcaaac

SEQ ID NO: 1390406 - DNA, 22 bp, Artificial Sequence
  chemically synthesized
ttaactaaatcaattgcaaact

SEQ ID NO: 1390407 - DNA, 22 bp, Artificial Sequence
  chemically synthesized
taactaaatcaattgcaaactt

SEQ ID NO: 1390408 - DNA, 22 bp, Artificial Sequence
  chemically synthesized
aactaaatcaattgcaaacttc

SEQ ID NO: 1390409 - DNA, 22 bp, Artificial Sequence
  chemically synthesized
actaaatcaattgcaaacttca

SEQ ID NO: 1390410 - DNA, 22 bp, Artificial Sequence
  chemically synthesized
tacaataaggttagatgaagtt

SEQ ID NO: 1390411 - DNA, 22 bp, Artificial Sequence
  chemically synthesized
aatcaattgcaaacttcatcta

SEQ ID NO: 1390412 - DNA, 22 bp, Artificial Sequence
  chemically synthesized
tctatacaataaggttagatga

SEQ ID NO: 1390413 - DNA, 22 bp, Artificial Sequence
  chemically synthesized
atctatacaataaggttagatg

SEQ ID NO: 1390414 - DNA, 22 bp, Artificial Sequence
  chemically synthesized
caaacttcatctaaccttattg

SEQ ID NO: 1390415 - DNA, 22 bp, Artificial Sequence
  chemically synthesized
tgtttatctatacaataaggtt

SEQ ID NO: 1390416 - DNA, 22 bp, Artificial Sequence
  chemically synthesized
catctaaccttattgtatagat

SEQ ID NO: 1390417 - DNA, 22 bp, Artificial Sequence
  chemically synthesized
atctaaccttattgtatagata

SEQ ID NO: 1390418 - DNA, 22 bp, Artificial Sequence
  chemically synthesized
accttattgtatagataaacac

SEQ ID NO: 1390419 - DNA, 22 bp, Artificial Sequence
  chemically synthesized
gccgaagtaaattgtgtttatc

SEQ ID NO: 1390420 - DNA, 22 bp, Artificial Sequence
  chemically synthesized
attgtatagataaacacaattt

SEQ ID NO: 1390421 - DNA, 22 bp, Artificial Sequence
  chemically synthesized
ttgtatagataaacacaattta

SEQ ID NO: 1390422 - DNA, 22 bp, Artificial Sequence
  chemically synthesized
tatagataaacacaatttactt

SEQ ID NO: 1390423 - DNA, 22 bp, Artificial Sequence
  chemically synthesized
ggtacaggttggccgaagtaaa

SEQ ID NO: 1390424 - DNA, 22 bp, Artificial Sequence
  chemically synthesized
tgttgggtacaggttggccgaa

SEQ ID NO: 1390425 - DNA, 22 bp, Artificial Sequence
  chemically synthesized
atgttgggtacaggttggccga

SEQ ID NO: 1390426 - DNA, 22 bp, Artificial Sequence
  chemically synthesized
tatgttgggtacaggttggccg

SEQ ID NO: 1390427 - DNA, 22 bp, Artificial Sequence
  chemically synthesized
acttcggccaacctgtacccaa

SEQ ID NO: 1390428 - DNA, 22 bp, Artificial Sequence
  chemically synthesized
cttcggccaacctgtacccaac

SEQ ID NO: 1390429 - DNA, 22 bp, Artificial Sequence
  chemically synthesized
cggccaacctgtacccaacata

SEQ ID NO: 1390430 - DNA, 22 bp, Artificial Sequence
  chemically synthesized
ggccaacctgtacccaacataa

SEQ ID NO: 1390431 - DNA, 22 bp, Artificial Sequence
  chemically synthesized
aggagatacagagttttatgtt

SEQ ID NO: 1390432 - DNA, 22 bp, Artificial Sequence
  chemically synthesized
tacccaacataaaactctgtat

SEQ ID NO: 1390433 - DNA, 22 bp, Artificial Sequence
  chemically synthesized
tgtatctcctgagatcttgccc

SEQ ID NO: 1390434 - DNA, 22 bp, Artificial Sequence
  chemically synthesized
tatctcctgagatcttgccctc

SEQ ID NO: 1390435 - DNA, 22 bp, Artificial Sequence
  chemically synthesized
ctgagatcttgccctctctata

SEQ ID NO: 1390436 - DNA, 22 bp, Artificial Sequence
  chemically synthesized
cagtgagaagaatatagagagg

SEQ ID NO: 1390437 - DNA, 22 bp, Artificial Sequence
  chemically synthesized
gcagtgagaagaatatagagag

SEQ ID NO: 1390438 - DNA, 22 bp, Artificial Sequence
  chemically synthesized
agatcttgccctctctatattc

SEQ ID NO: 1390439 - DNA, 22 bp, Artificial Sequence
  chemically synthesized
tttgcagtgagaagaatataga

SEQ ID NO: 1390440 - DNA, 22 bp, Artificial Sequence
  chemically synthesized
gccctctctatattcttctcac

SEQ ID NO: 1390441 - DNA, 22 bp, Artificial Sequence
  chemically synthesized
atgctgtttgcagtgagaagaa

SEQ ID NO: 1390442 - DNA, 22 bp, Artificial Sequence
  chemically synthesized
ccctctctatattcttctcact

SEQ ID NO: 1390443 - DNA, 22 bp, Artificial Sequence
  chemically synthesized
tgatgctgtttgcagtgagaag

SEQ ID NO: 1390444 - DNA, 22 bp, Artificial Sequence
  chemically synthesized
ctctgatgctgtttgcagtgag

SEQ ID NO: 1390445 - DNA, 22 bp, Artificial Sequence
  chemically synthesized
tctatattcttctcactgcaaa

SEQ ID NO: 1390446 - DNA, 22 bp, Artificial Sequence
  chemically synthesized
tatattcttctcactgcaaaca

SEQ ID NO: 1390447 - DNA, 22 bp, Artificial Sequence
  chemically synthesized
tattcttctcactgcaaacagc

SEQ ID NO: 1390448 - DNA, 22 bp, Artificial Sequence
  chemically synthesized
ggcattactctgatgctgtttg

SEQ ID NO: 1390449 - DNA, 22 bp, Artificial Sequence
  chemically synthesized
gggcattactctgatgctgttt

SEQ ID NO: 1390450 - DNA, 22 bp, Artificial Sequence
  chemically synthesized
ttctcactgcaaacagcatcag

SEQ ID NO: 1390451 - DNA, 22 bp, Artificial Sequence
  chemically synthesized
ctcactgcaaacagcatcagag

SEQ ID NO: 1390452 - DNA, 22 bp, Artificial Sequence
  chemically synthesized
tcactgcaaacagcatcagagt

SEQ ID NO: 1390453 - DNA, 22 bp, Artificial Sequence
  chemically synthesized
actgcaaacagcatcagagtaa

SEQ ID NO: 1390454 - DNA, 22 bp, Artificial Sequence
  chemically synthesized
caaacagcatcagagtaatgcc

SEQ ID NO: 1390455 - DNA, 22 bp, Artificial Sequence
  chemically synthesized
aggggatgtcacaatgggatgt

SEQ ID NO: 1390456 - DNA, 22 bp, Artificial Sequence
  chemically synthesized
gaggggatgtcacaatgggatg

SEQ ID NO: 1390457 - DNA, 22 bp, Artificial Sequence
  chemically synthesized
aacaatttgaggggatgtcaca

SEQ ID NO: 1390458 - DNA, 22 bp, Artificial Sequence
  chemically synthesized
tgacatcccctcaaattgttca

SEQ ID NO: 1390459 - DNA, 22 bp, Artificial Sequence
  chemically synthesized
aggtcaataggaggccattgaa

SEQ ID NO: 1390460 - DNA, 22 bp, Artificial Sequence
  chemically synthesized
aaattgttcaatggcctcctat

SEQ ID NO: 1390461 - DNA, 22 bp, Artificial Sequence
  chemically synthesized
atcctaaggtcaataggaggcc

SEQ ID NO: 1390462 - DNA, 22 bp, Artificial Sequence
  chemically synthesized
catcctaaggtcaataggaggc

SEQ ID NO: 1390463 - DNA, 22 bp, Artificial Sequence
  chemically synthesized
acttcatcctaaggtcaatagg

SEQ ID NO: 1390464 - DNA, 22 bp, Artificial Sequence
  chemically synthesized
ttcaatggcctcctattgacct

SEQ ID NO: 1390465 - DNA, 22 bp, Artificial Sequence
  chemically synthesized
aacttcatcctaaggtcaatag

SEQ ID NO: 1390466 - DNA, 22 bp, Artificial Sequence
  chemically synthesized
taacttcatcctaaggtcaata

SEQ ID NO: 1390467 - DNA, 22 bp, Artificial Sequence
  chemically synthesized
aatggcctcctattgaccttag

SEQ ID NO: 1390468 - DNA, 22 bp, Artificial Sequence
  chemically synthesized
gagtgttttaacttcatcctaa

SEQ ID NO: 1390469 - DNA, 22 bp, Artificial Sequence
  chemically synthesized
ctattgaccttaggatgaagtt

SEQ ID NO: 1390470 - DNA, 22 bp, Artificial Sequence
  chemically synthesized
ttgaccttaggatgaagttaaa

SEQ ID NO: 1390471 - DNA, 22 bp, Artificial Sequence
  chemically synthesized
tgaatctagagtgttttaactt

SEQ ID NO: 1390472 - DNA, 22 bp, Artificial Sequence
  chemically synthesized
accttaggatgaagttaaaaca

SEQ ID NO: 1390473 - DNA, 22 bp, Artificial Sequence
  chemically synthesized
aggatgaagttaaaacactcta

SEQ ID NO: 1390474 - DNA, 22 bp, Artificial Sequence
  chemically synthesized
ggatgaagttaaaacactctag

SEQ ID NO: 1390475 - DNA, 22 bp, Artificial Sequence
  chemically synthesized
acgggacacctgtgaatctaga

SEQ ID NO: 1390476 - DNA, 22 bp, Artificial Sequence
  chemically synthesized
gacgggacacctgtgaatctag

SEQ ID NO: 1390477 - DNA, 22 bp, Artificial Sequence
  chemically synthesized
aaacactctagattcacaggtg

SEQ ID NO: 1390478 - DNA, 22 bp, Artificial Sequence
  chemically synthesized
tagattcacaggtgtcccgtca

SEQ ID NO: 1390479 - DNA, 22 bp, Artificial Sequence
  chemically synthesized
gattcacaggtgtcccgtcaaa

SEQ ID NO: 1390480 - DNA, 22 bp, Artificial Sequence
  chemically synthesized
acaggtgtcccgtcaaactttc

SEQ ID NO: 1390481 - DNA, 22 bp, Artificial Sequence
  chemically synthesized
tggagccatgaaatgaggcagg

SEQ ID NO: 1390482 - DNA, 22 bp, Artificial Sequence
  chemically synthesized
tcctgcctcatttcatggctcc

SEQ ID NO: 1390483 - DNA, 22 bp, Artificial Sequence
  chemically synthesized
cctgcctcatttcatggctcca

SEQ ID NO: 1390484 - DNA, 22 bp, Artificial Sequence
  chemically synthesized
ctgcctcatttcatggctccac

SEQ ID NO: 1390485 - DNA, 22 bp, Artificial Sequence
  chemically synthesized
cctcatttcatggctccacaga

SEQ ID NO: 1390486 - DNA, 22 bp, Artificial Sequence
  chemically synthesized
atttcatggctccacagatgct

SEQ ID NO: 1390487 - DNA, 22 bp, Artificial Sequence
  chemically synthesized
catggctccacagatgctggcc

SEQ ID NO: 1390488 - DNA, 22 bp, Artificial Sequence
  chemically synthesized
atggctccacagatgctggcct

SEQ ID NO: 1390489 - DNA, 22 bp, Artificial Sequence
  chemically synthesized
gggaaatgatagaggccagcat

SEQ ID NO: 1390490 - DNA, 22 bp, Artificial Sequence
  chemically synthesized
agggaaatgatagaggccagca

SEQ ID NO: 1390491 - DNA, 22 bp, Artificial Sequence
  chemically synthesized
cacagatgctggcctctatcat

SEQ ID NO: 1390492 - DNA, 22 bp, Artificial Sequence
  chemically synthesized
gcgaacttagggaaatgataga

SEQ ID NO: 1390493 - DNA, 22 bp, Artificial Sequence
  chemically synthesized
gcctctatcatttccctaagtt

SEQ ID NO: 1390494 - DNA, 22 bp, Artificial Sequence
  chemically synthesized
gaagaattagcgaacttaggga

SEQ ID NO: 1390495 - DNA, 22 bp, Artificial Sequence
  chemically synthesized
cgaagaattagcgaacttaggg

SEQ ID NO: 1390496 - DNA, 22 bp, Artificial Sequence
  chemically synthesized
tatcatttccctaagttcgcta

SEQ ID NO: 1390497 - DNA, 22 bp, Artificial Sequence
  chemically synthesized
agcttcgaagaattagcgaact

SEQ ID NO: 1390498 - DNA, 22 bp, Artificial Sequence
  chemically synthesized
tcatttccctaagttcgctaat

SEQ ID NO: 1390499 - DNA, 22 bp, Artificial Sequence
  chemically synthesized
aagcttcgaagaattagcgaac

SEQ ID NO: 1390500 - DNA, 22 bp, Artificial Sequence
  chemically synthesized
ttaagcttcgaagaattagcga

SEQ ID NO: 1390501 - DNA, 22 bp, Artificial Sequence
  chemically synthesized
ccctaagttcgctaattcttcg

SEQ ID NO: 1390502 - DNA, 22 bp, Artificial Sequence
  chemically synthesized
cctaagttcgctaattcttcga

SEQ ID NO: 1390503 - DNA, 22 bp, Artificial Sequence
  chemically synthesized
agttcgctaattcttcgaagct

SEQ ID NO: 1390504 - DNA, 22 bp, Artificial Sequence
  chemically synthesized
gctaattcttcgaagcttaaga

SEQ ID NO: 1390505 - DNA, 22 bp, Artificial Sequence
  chemically synthesized
attcttcgaagcttaagagcca

SEQ ID NO: 1390506 - DNA, 22 bp, Artificial Sequence
  chemically synthesized
ttcgaagcttaagagccattgt

SEQ ID NO: 1390507 - DNA, 22 bp, Artificial Sequence
  chemically synthesized
cgaagcttaagagccattgtac

SEQ ID NO: 1390508 - DNA, 22 bp, Artificial Sequence
  chemically synthesized
gaagcttaagagccattgtaca

SEQ ID NO: 1390509 - DNA, 22 bp, Artificial Sequence
  chemically synthesized
agtacagagaaataacatgtac

SEQ ID NO: 1390510 - DNA, 22 bp, Artificial Sequence
  chemically synthesized
aagagccattgtacatgttatt

SEQ ID NO: 1390511 - DNA, 22 bp, Artificial Sequence
  chemically synthesized
agagccattgtacatgttattt

SEQ ID NO: 1390512 - DNA, 22 bp, Artificial Sequence
  chemically synthesized
tacatgttatttctctgtactg

SEQ ID NO: 1390513 - DNA, 22 bp, Artificial Sequence
  chemically synthesized
tttctctgtactgaatgtcttc

SEQ ID NO: 1390514 - DNA, 22 bp, Artificial Sequence
  chemically synthesized
ctctgtactgaatgtcttcccc

SEQ ID NO: 1390515 - DNA, 22 bp, Artificial Sequence
  chemically synthesized
tctgtactgaatgtcttcccct

SEQ ID NO: 1390516 - DNA, 22 bp, Artificial Sequence
  chemically synthesized
gagggagagagaaggggaagac

SEQ ID NO: 1390517 - DNA, 22 bp, Artificial Sequence
  chemically synthesized
tgtactgaatgtcttccccttc

SEQ ID NO: 1390518 - DNA, 22 bp, Artificial Sequence
  chemically synthesized
tactgaatgtcttccccttctc

SEQ ID NO: 1390519 - DNA, 22 bp, Artificial Sequence
  chemically synthesized
aatgtcttccccttctctctcc

SEQ ID NO: 1390520 - DNA, 22 bp, Artificial Sequence
  chemically synthesized
taaaaattggagggagagagaa

SEQ ID NO: 1390521 - DNA, 22 bp, Artificial Sequence
  chemically synthesized
aactataaaaattggagggaga

SEQ ID NO: 1390522 - DNA, 22 bp, Artificial Sequence
  chemically synthesized
tgaactataaaaattggaggga

SEQ ID NO: 1390523 - DNA, 22 bp, Artificial Sequence
  chemically synthesized
ccccttctctctccctccaatt

SEQ ID NO: 1390524 - DNA, 22 bp, Artificial Sequence
  chemically synthesized
cccttctctctccctccaattt

SEQ ID NO: 1390525 - DNA, 22 bp, Artificial Sequence
  chemically synthesized
ctctctccctccaatttttata

SEQ ID NO: 1390526 - DNA, 22 bp, Artificial Sequence
  chemically synthesized
tctctccctccaatttttatag

SEQ ID NO: 1390527 - DNA, 22 bp, Artificial Sequence
  chemically synthesized
agatcctctgaactataaaaat

SEQ ID NO: 1390528 - DNA, 22 bp, Artificial Sequence
  chemically synthesized
tctccctccaatttttatagtt

SEQ ID NO: 1390529 - DNA, 22 bp, Artificial Sequence
  chemically synthesized
tccctccaatttttatagttca

SEQ ID NO: 1390530 - DNA, 22 bp, Artificial Sequence
  chemically synthesized
cgctgagatcctctgaactata

SEQ ID NO: 1390531 - DNA, 22 bp, Artificial Sequence
  chemically synthesized
cctccaatttttatagttcaga

SEQ ID NO: 1390532 - DNA, 22 bp, Artificial Sequence
  chemically synthesized
acgctgagatcctctgaactat

SEQ ID NO: 1390533 - DNA, 22 bp, Artificial Sequence
  chemically synthesized
caatttttatagttcagaggat

SEQ ID NO: 1390534 - DNA, 22 bp, Artificial Sequence
  chemically synthesized
ttatagttcagaggatctcagc

SEQ ID NO: 1390535 - DNA, 22 bp, Artificial Sequence
  chemically synthesized
tatagttcagaggatctcagcg

SEQ ID NO: 1390536 - DNA, 22 bp, Artificial Sequence
  chemically synthesized
atagttcagaggatctcagcgt

SEQ ID NO: 1390537 - DNA, 22 bp, Artificial Sequence
  chemically synthesized
tagttcagaggatctcagcgta

SEQ ID NO: 1390538 - DNA, 22 bp, Artificial Sequence
  chemically synthesized
gaaaggtgatatttacgctgag

SEQ ID NO: 1390539 - DNA, 22 bp, Artificial Sequence
  chemically synthesized
tggaaaggtgatatttacgctg

SEQ ID NO: 1390540 - DNA, 22 bp, Artificial Sequence
  chemically synthesized
ctggaaaggtgatatttacgct

SEQ ID NO: 1390541 - DNA, 22 bp, Artificial Sequence
  chemically synthesized
tctggaaaggtgatatttacgc

SEQ ID NO: 1390542 - DNA, 22 bp, Artificial Sequence
  chemically synthesized
agaggatctcagcgtaaatatc

SEQ ID NO: 1390543 - DNA, 22 bp, Artificial Sequence
  chemically synthesized
atgacctttctggaaaggtgat

SEQ ID NO: 1390544 - DNA, 22 bp, Artificial Sequence
  chemically synthesized
taatgacctttctggaaaggtg

SEQ ID NO: 1390545 - DNA, 22 bp, Artificial Sequence
  chemically synthesized
agcgtaaatatcacctttccag

SEQ ID NO: 1390546 - DNA, 22 bp, Artificial Sequence
  chemically synthesized
atgttctaatgacctttctgga

SEQ ID NO: 1390547 - DNA, 22 bp, Artificial Sequence
  chemically synthesized
aatgttctaatgacctttctgg

SEQ ID NO: 1390548 - DNA, 22 bp, Artificial Sequence
  chemically synthesized
caatccttaatgttctaatgac

SEQ ID NO: 1390549 - DNA, 22 bp, Artificial Sequence
  chemically synthesized
tccagaaaggtcattagaacat

SEQ ID NO: 1390550 - DNA, 22 bp, Artificial Sequence
  chemically synthesized
ccagaaaggtcattagaacatt

SEQ ID NO: 1390551 - DNA, 22 bp, Artificial Sequence
  chemically synthesized
gttacaatccttaatgttctaa

SEQ ID NO: 1390552 - DNA, 22 bp, Artificial Sequence
  chemically synthesized
cagaaaggtcattagaacatta

SEQ ID NO: 1390553 - DNA, 22 bp, Artificial Sequence
  chemically synthesized
ggttacaatccttaatgttcta

SEQ ID NO: 1390554 - DNA, 22 bp, Artificial Sequence
  chemically synthesized
ttggttacaatccttaatgttc

SEQ ID NO: 1390555 - DNA, 22 bp, Artificial Sequence
  chemically synthesized
tctcttggttacaatccttaat

SEQ ID NO: 1390556 - DNA, 22 bp, Artificial Sequence
  chemically synthesized
ttgtctcttggttacaatcctt

SEQ ID NO: 1390557 - DNA, 22 bp, Artificial Sequence
  chemically synthesized
gaacattaaggattgtaaccaa

SEQ ID NO: 1390558 - DNA, 22 bp, Artificial Sequence
  chemically synthesized
aggattgtaaccaagagacaat

SEQ ID NO: 1390559 - DNA, 22 bp, Artificial Sequence
  chemically synthesized
taaccaagagacaatagctgtt

SEQ ID NO: 1390560 - DNA, 22 bp, Artificial Sequence
  chemically synthesized
gcatatgccacaagaataaaaa

SEQ ID NO: 1390561 - DNA, 22 bp, Artificial Sequence
  chemically synthesized
ttggttttattttttattcttg

SEQ ID NO: 1390562 - DNA, 22 bp, Artificial Sequence
  chemically synthesized
gttggcatatgccacaagaata

SEQ ID NO: 1390563 - DNA, 22 bp, Artificial Sequence
  chemically synthesized
gttttattttttattcttgtgg

SEQ ID NO: 1390564 - DNA, 22 bp, Artificial Sequence
  chemically synthesized
tattttttattcttgtggcata

SEQ ID NO: 1390565 - DNA, 22 bp, Artificial Sequence
  chemically synthesized
attttttattcttgtggcatat

SEQ ID NO: 1390566 - DNA, 22 bp, Artificial Sequence
  chemically synthesized
ttttttattcttgtggcatatg

SEQ ID NO: 1390567 - DNA, 22 bp, Artificial Sequence
  chemically synthesized
tgcaagttagttggcatatgcc

SEQ ID NO: 1390568 - DNA, 22 bp, Artificial Sequence
  chemically synthesized
tttattcttgtggcatatgcca

SEQ ID NO: 1390569 - DNA, 22 bp, Artificial Sequence
  chemically synthesized
ttattcttgtggcatatgccaa

SEQ ID NO: 1390570 - DNA, 22 bp, Artificial Sequence
  chemically synthesized
tattcttgtggcatatgccaac

SEQ ID NO: 1390571 - DNA, 22 bp, Artificial Sequence
  chemically synthesized
attcttgtggcatatgccaact

SEQ ID NO: 1390572 - DNA, 22 bp, Artificial Sequence
  chemically synthesized
ttcttgtggcatatgccaacta

SEQ ID NO: 1390573 - DNA, 22 bp, Artificial Sequence
  chemically synthesized
ggcactgtgcaagttagttggc

SEQ ID NO: 1390574 - DNA, 22 bp, Artificial Sequence
  chemically synthesized
ttgtggcatatgccaactaact

SEQ ID NO: 1390575 - DNA, 22 bp, Artificial Sequence
  chemically synthesized
aggcactgtgcaagttagttgg

SEQ ID NO: 1390576 - DNA, 22 bp, Artificial Sequence
  chemically synthesized
taggcactgtgcaagttagttg

SEQ ID NO: 1390577 - DNA, 22 bp, Artificial Sequence
  chemically synthesized
gtggcatatgccaactaacttg

SEQ ID NO: 1390578 - DNA, 22 bp, Artificial Sequence
  chemically synthesized
tggcatatgccaactaacttgc

SEQ ID NO: 1390579 - DNA, 22 bp, Artificial Sequence
  chemically synthesized
gactttaggcactgtgcaagtt

SEQ ID NO: 1390580 - DNA, 22 bp, Artificial Sequence
  chemically synthesized
cgactttaggcactgtgcaagt

SEQ ID NO: 1390581 - DNA, 22 bp, Artificial Sequence
  chemically synthesized
tcgactttaggcactgtgcaag

SEQ ID NO: 1390582 - DNA, 22 bp, Artificial Sequence
  chemically synthesized
ttcgactttaggcactgtgcaa

SEQ ID NO: 1390583 - DNA, 22 bp, Artificial Sequence
  chemically synthesized
agcccttttcgactttaggcac

SEQ ID NO: 1390584 - DNA, 22 bp, Artificial Sequence
  chemically synthesized
acttgcacagtgcctaaagtcg

SEQ ID NO: 1390585 - DNA, 22 bp, Artificial Sequence
  chemically synthesized
gcacagtgcctaaagtcgaaaa

SEQ ID NO: 1390586 - DNA, 22 bp, Artificial Sequence
  chemically synthesized
cacagtgcctaaagtcgaaaag

SEQ ID NO: 1390587 - DNA, 22 bp, Artificial Sequence
  chemically synthesized
tagtaactgagcccttttcgac

SEQ ID NO: 1390588 - DNA, 22 bp, Artificial Sequence
  chemically synthesized
tgtctatagtaactgagccctt

SEQ ID NO: 1390589 - DNA, 22 bp, Artificial Sequence
  chemically synthesized
gtgtctatagtaactgagccct

SEQ ID NO: 1390590 - DNA, 22 bp, Artificial Sequence
  chemically synthesized
aagtcgaaaagggctcagttac

SEQ ID NO: 1390591 - DNA, 22 bp, Artificial Sequence
  chemically synthesized
cttgtgtctatagtaactgagc

SEQ ID NO: 1390592 - DNA, 22 bp, Artificial Sequence
  chemically synthesized
gcttgtgtctatagtaactgag

SEQ ID NO: 1390593 - DNA, 22 bp, Artificial Sequence
  chemically synthesized
aggtcatatttgcttgtgtcta

SEQ ID NO: 1390594 - DNA, 22 bp, Artificial Sequence
  chemically synthesized
agttactatagacacaagcaaa

SEQ ID NO: 1390595 - DNA, 22 bp, Artificial Sequence
  chemically synthesized
gtagctcaggtcatatttgctt

SEQ ID NO: 1390596 - DNA, 22 bp, Artificial Sequence
  chemically synthesized
ctatagacacaagcaaatatga

SEQ ID NO: 1390597 - DNA, 22 bp, Artificial Sequence
  chemically synthesized
ttggtagctcaggtcatatttg

SEQ ID NO: 1390598 - DNA, 22 bp, Artificial Sequence
  chemically synthesized
gttggtagctcaggtcatattt

SEQ ID NO: 1390599 - DNA, 22 bp, Artificial Sequence
  chemically synthesized
tagacacaagcaaatatgacct

SEQ ID NO: 1390600 - DNA, 22 bp, Artificial Sequence
  chemically synthesized
tgttggtagctcaggtcatatt

SEQ ID NO: 1390601 - DNA, 22 bp, Artificial Sequence
  chemically synthesized
ggatgtaattttgttggtagct

SEQ ID NO: 1390602 - DNA, 22 bp, Artificial Sequence
  chemically synthesized
cggatgtaattttgttggtagc

SEQ ID NO: 1390603 - DNA, 22 bp, Artificial Sequence
  chemically synthesized
tcttcggatgtaattttgttgg

SEQ ID NO: 1390604 - DNA, 22 bp, Artificial Sequence
  chemically synthesized
ttgtcttcggatgtaattttgt

SEQ ID NO: 1390605 - DNA, 22 bp, Artificial Sequence
  chemically synthesized
ctgttgtcttcggatgtaattt

SEQ ID NO: 1390606 - DNA, 22 bp, Artificial Sequence
  chemically synthesized
agctaccaacaaaattacatcc

SEQ ID NO: 1390607 - DNA, 22 bp, Artificial Sequence
  chemically synthesized
cctgttgtcttcggatgtaatt

SEQ ID NO: 1390608 - DNA, 22 bp, Artificial Sequence
  chemically synthesized
ccaacaaaattacatccgaaga

SEQ ID NO: 1390609 - DNA, 22 bp, Artificial Sequence
  chemically synthesized
gtcttcctgttgtcttcggatg

SEQ ID NO: 1390610 - DNA, 22 bp, Artificial Sequence
  chemically synthesized
acagtctcgtcttcctgttgtc

SEQ ID NO: 1390611 - DNA, 22 bp, Artificial Sequence
  chemically synthesized
catccgaagacaacaggaagac

SEQ ID NO: 1390612 - DNA, 22 bp, Artificial Sequence
  chemically synthesized
gaaacctcacagtctcgtcttc

SEQ ID NO: 1390613 - DNA, 22 bp, Artificial Sequence
  chemically synthesized
ggaaacctcacagtctcgtctt

SEQ ID NO: 1390614 - DNA, 22 bp, Artificial Sequence
  chemically synthesized
taaacttggaaacctcacagtc

SEQ ID NO: 1390615 - DNA, 22 bp, Artificial Sequence
  chemically synthesized
tctataaacttggaaacctcac

SEQ ID NO: 1390616 - DNA, 22 bp, Artificial Sequence
  chemically synthesized
gtctataaacttggaaacctca

SEQ ID NO: 1390617 - DNA, 22 bp, Artificial Sequence
  chemically synthesized
accttgtctataaacttggaaa

SEQ ID NO: 1390618 - DNA, 22 bp, Artificial Sequence
  chemically synthesized
tctgaccttgtctataaacttg

SEQ ID NO: 1390619 - DNA, 22 bp, Artificial Sequence
  chemically synthesized
gtctgaccttgtctataaactt

SEQ ID NO: 1390620 - DNA, 22 bp, Artificial Sequence
  chemically synthesized
tgaggtttccaagtttatagac

SEQ ID NO: 1390621 - DNA, 22 bp, Artificial Sequence
  chemically synthesized
cttgtctgaccttgtctataaa

SEQ ID NO: 1390622 - DNA, 22 bp, Artificial Sequence
  chemically synthesized
ccttgtctgaccttgtctataa

SEQ ID NO: 1390623 - DNA, 22 bp, Artificial Sequence
  chemically synthesized
ccaagtttatagacaaggtcag

SEQ ID NO: 1390624 - DNA, 22 bp, Artificial Sequence
  chemically synthesized
caagtttatagacaaggtcaga

SEQ ID NO: 1390625 - DNA, 22 bp, Artificial Sequence
  chemically synthesized
atgacttccttgtctgaccttg

SEQ ID NO: 1390626 - DNA, 22 bp, Artificial Sequence
  chemically synthesized
atagacaaggtcagacaaggaa

SEQ ID NO: 1390627 - DNA, 22 bp, Artificial Sequence
  chemically synthesized
tagacaaggtcagacaaggaag

SEQ ID NO: 1390628 - DNA, 22 bp, Artificial Sequence
  chemically synthesized
acagagacgagcctaatgactt

SEQ ID NO: 1390629 - DNA, 22 bp, Artificial Sequence
  chemically synthesized
aaaattgacagagacgagccta

SEQ ID NO: 1390630 - DNA, 22 bp, Artificial Sequence
  chemically synthesized
ttcaaaattgacagagacgagc

SEQ ID NO: 1390631 - DNA, 22 bp, Artificial Sequence
  chemically synthesized
ttgttcaaaattgacagagacg

SEQ ID NO: 1390632 - DNA, 22 bp, Artificial Sequence
  chemically synthesized
gttgttcaaaattgacagagac

SEQ ID NO: 1390633 - DNA, 22 bp, Artificial Sequence
  chemically synthesized
tgttgttcaaaattgacagaga

SEQ ID NO: 1390634 - DNA, 22 bp, Artificial Sequence
  chemically synthesized
ggctcgtctctgtcaattttga

SEQ ID NO: 1390635 - DNA, 22 bp, Artificial Sequence
  chemically synthesized
gtctctgtcaattttgaacaac

SEQ ID NO: 1390636 - DNA, 22 bp, Artificial Sequence
  chemically synthesized
tgtcaattttgaacaacaaagt

SEQ ID NO: 1390637 - DNA, 22 bp, Artificial Sequence
  chemically synthesized
tcaattttgaacaacaaagtta

SEQ ID NO: 1390638 - DNA, 22 bp, Artificial Sequence
  chemically synthesized
caagatagaaataataactttg

SEQ ID NO: 1390639 - DNA, 22 bp, Artificial Sequence
  chemically synthesized
ttgcaagatagaaataataact

SEQ ID NO: 1390640 - DNA, 22 bp, Artificial Sequence
  chemically synthesized
tgaacaacaaagttattatttc

SEQ ID NO: 1390641 - DNA, 22 bp, Artificial Sequence
  chemically synthesized
gaacaacaaagttattatttct

SEQ ID NO: 1390642 - DNA, 22 bp, Artificial Sequence
  chemically synthesized
ttgttgcaagatagaaataata

SEQ ID NO: 1390643 - DNA, 22 bp, Artificial Sequence
  chemically synthesized
aacaacaaagttattatttcta

SEQ ID NO: 1390644 - DNA, 22 bp, Artificial Sequence
  chemically synthesized
gttgttgcaagatagaaataat

SEQ ID NO: 1390645 - DNA, 22 bp, Artificial Sequence
  chemically synthesized
tgttgttgcaagatagaaataa

SEQ ID NO: 1390646 - DNA, 22 bp, Artificial Sequence
  chemically synthesized
tattttgttgttgcaagataga

SEQ ID NO: 1390647 - DNA, 22 bp, Artificial Sequence
  chemically synthesized
ttatttctatcttgcaacaaca

SEQ ID NO: 1390648 - DNA, 22 bp, Artificial Sequence
  chemically synthesized
aaaaaactatattttgttgttg

SEQ ID NO: 1390649 - DNA, 22 bp, Artificial Sequence
  chemically synthesized
tttctatcttgcaacaacaaaa

SEQ ID NO: 1390650 - DNA, 22 bp, Artificial Sequence
  chemically synthesized
ctatcttgcaacaacaaaatat

SEQ ID NO: 1390651 - DNA, 22 bp, Artificial Sequence
  chemically synthesized
attaaaaaaactatattttgtt

SEQ ID NO: 1390652 - DNA, 22 bp, Artificial Sequence
  chemically synthesized
tatcttgcaacaacaaaatata

SEQ ID NO: 1390653 - DNA, 22 bp, Artificial Sequence
  chemically synthesized
aattaaaaaaactatattttgt

SEQ ID NO: 1390654 - DNA, 22 bp, Artificial Sequence
  chemically synthesized
taattaaaaaaactatattttg

SEQ ID NO: 1390655 - DNA, 22 bp, Artificial Sequence
  chemically synthesized
tcttgcaacaacaaaatatagt

SEQ ID NO: 1390656 - DNA, 22 bp, Artificial Sequence
  chemically synthesized
ttaattaaaaaaactatatttt

SEQ ID NO: 1390657 - DNA, 22 bp, Artificial Sequence
  chemically synthesized
tttaattaaaaaaactatattt

SEQ ID NO: 1390658 - DNA, 22 bp, Artificial Sequence
  chemically synthesized
ttttaattaaaaaaactatatt

SEQ ID NO: 1390659 - DNA, 22 bp, Artificial Sequence
  chemically synthesized
gcaacaacaaaatatagttttt

SEQ ID NO: 1390660 - DNA, 22 bp, Artificial Sequence
  chemically synthesized
caacaacaaaatatagtttttt

SEQ ID NO: 1390661 - DNA, 22 bp, Artificial Sequence
  chemically synthesized
aatgaagatttttttaattaaa

SEQ ID NO: 1390662 - DNA, 22 bp, Artificial Sequence
  chemically synthesized
aaatgaagatttttttaattaa

SEQ ID NO: 1390663 - DNA, 22 bp, Artificial Sequence
  chemically synthesized
ttaaatgaagatttttttaatt

SEQ ID NO: 1390664 - DNA, 22 bp, Artificial Sequence
  chemically synthesized
cttaaatgaagatttttttaat

SEQ ID NO: 1390665 - DNA, 22 bp, Artificial Sequence
  chemically synthesized
ttttaattaaaaaaatcttcat

SEQ ID NO: 1390666 - DNA, 22 bp, Artificial Sequence
  chemically synthesized
tttaattaaaaaaatcttcatt

SEQ ID NO: 1390667 - DNA, 22 bp, Artificial Sequence
  chemically synthesized
ttaattaaaaaaatcttcattt

SEQ ID NO: 1390668 - DNA, 22 bp, Artificial Sequence
  chemically synthesized
cagcaatttcttaaatgaagat

SEQ ID NO: 1390669 - DNA, 22 bp, Artificial Sequence
  chemically synthesized
taattaaaaaaatcttcattta

SEQ ID NO: 1390670 - DNA, 22 bp, Artificial Sequence
  chemically synthesized
aattaaaaaaatcttcatttaa

SEQ ID NO: 1390671 - DNA, 22 bp, Artificial Sequence
  chemically synthesized
attaaaaaaatcttcatttaag

SEQ ID NO: 1390672 - DNA, 22 bp, Artificial Sequence
  chemically synthesized
ctgcagcaatttcttaaatgaa

SEQ ID NO: 1390673 - DNA, 22 bp, Artificial Sequence
  chemically synthesized
cctgcagcaatttcttaaatga

SEQ ID NO: 1390674 - DNA, 22 bp, Artificial Sequence
  chemically synthesized
tcctgcagcaatttcttaaatg

SEQ ID NO: 1390675 - DNA, 22 bp, Artificial Sequence
  chemically synthesized
aaaaaatcttcatttaagaaat

SEQ ID NO: 1390676 - DNA, 22 bp, Artificial Sequence
  chemically synthesized
ttttcctgcagcaatttcttaa

SEQ ID NO: 1390677 - DNA, 22 bp, Artificial Sequence
  chemically synthesized
aaagttattttcctgcagcaat

SEQ ID NO: 1390678 - DNA, 22 bp, Artificial Sequence
  chemically synthesized
catttaagaaattgctgcagga

SEQ ID NO: 1390679 - DNA, 22 bp, Artificial Sequence
  chemically synthesized
atttaagaaattgctgcaggaa

SEQ ID NO: 1390680 - DNA, 22 bp, Artificial Sequence
  chemically synthesized
caattcaaagttattttcctgc

SEQ ID NO: 1390681 - DNA, 22 bp, Artificial Sequence
  chemically synthesized
aagaaattgctgcaggaaaata

SEQ ID NO: 1390682 - DNA, 22 bp, Artificial Sequence
  chemically synthesized
gcaattcaaagttattttcctg

SEQ ID NO: 1390683 - DNA, 22 bp, Artificial Sequence
  chemically synthesized
agaaattgctgcaggaaaataa

SEQ ID NO: 1390684 - DNA, 22 bp, Artificial Sequence
  chemically synthesized
tacttgcaattcaaagttattt

SEQ ID NO: 1390685 - DNA, 22 bp, Artificial Sequence
  chemically synthesized
atacttgcaattcaaagttatt

SEQ ID NO: 1390686 - DNA, 22 bp, Artificial Sequence
  chemically synthesized
tatacttgcaattcaaagttat

SEQ ID NO: 1390687 - DNA, 22 bp, Artificial Sequence
  chemically synthesized
ctgcaggaaaataactttgaat

SEQ ID NO: 1390688 - DNA, 22 bp, Artificial Sequence
  chemically synthesized
tttatacttgcaattcaaagtt

SEQ ID NO: 1390689 - DNA, 22 bp, Artificial Sequence
  chemically synthesized
ctttatacttgcaattcaaagt

SEQ ID NO: 1390690 - DNA, 22 bp, Artificial Sequence
  chemically synthesized
tctttatacttgcaattcaaag

SEQ ID NO: 1390691 - DNA, 22 bp, Artificial Sequence
  chemically synthesized
caggaaaataactttgaattgc

SEQ ID NO: 1390692 - DNA, 22 bp, Artificial Sequence
  chemically synthesized
agaaaattttctttatacttgc

SEQ ID NO: 1390693 - DNA, 22 bp, Artificial Sequence
  chemically synthesized
tgaattgcaagtataaagaaaa

SEQ ID NO: 1390694 - DNA, 22 bp, Artificial Sequence
  chemically synthesized
gggctcagaaaattttctttat

SEQ ID NO: 1390695 - DNA, 22 bp, Artificial Sequence
  chemically synthesized
gaattgcaagtataaagaaaat

SEQ ID NO: 1390696 - DNA, 22 bp, Artificial Sequence
  chemically synthesized
aattgcaagtataaagaaaatt

SEQ ID NO: 1390697 - DNA, 22 bp, Artificial Sequence
  chemically synthesized
caagtataaagaaaattttctg

SEQ ID NO: 1390698 - DNA, 22 bp, Artificial Sequence
  chemically synthesized
aaaggaaaaaaagagcatctag

SEQ ID NO: 1390699 - DNA, 22 bp, Artificial Sequence
  chemically synthesized
caaaggaaaaaaagagcatcta

SEQ ID NO: 1390700 - DNA, 22 bp, Artificial Sequence
  chemically synthesized
tcaaaggaaaaaaagagcatct

SEQ ID NO: 1390701 - DNA, 22 bp, Artificial Sequence
  chemically synthesized
tctgagccctagatgctctttt

SEQ ID NO: 1390702 - DNA, 22 bp, Artificial Sequence
  chemically synthesized
ctgagccctagatgctcttttt

SEQ ID NO: 1390703 - DNA, 22 bp, Artificial Sequence
  chemically synthesized
tgagccctagatgctctttttt

SEQ ID NO: 1390704 - DNA, 22 bp, Artificial Sequence
  chemically synthesized
agccctagatgctctttttttc

SEQ ID NO: 1390705 - DNA, 22 bp, Artificial Sequence
  chemically synthesized
gatgctctttttttcctttgaa

SEQ ID NO: 1390706 - DNA, 22 bp, Artificial Sequence
  chemically synthesized
aaaataatggttttcaaaggaa

SEQ ID NO: 1390707 - DNA, 22 bp, Artificial Sequence
  chemically synthesized
gaaaataatggttttcaaagga

SEQ ID NO: 1390708 - DNA, 22 bp, Artificial Sequence
  chemically synthesized
tgaaaataatggttttcaaagg

SEQ ID NO: 1390709 - DNA, 22 bp, Artificial Sequence
  chemically synthesized
ctttgaaaataatggttttcaa

SEQ ID NO: 1390710 - DNA, 22 bp, Artificial Sequence
  chemically synthesized
cctttgaaaataatggttttca

SEQ ID NO: 1390711 - DNA, 22 bp, Artificial Sequence
  chemically synthesized
tttttttcctttgaaaaccatt

SEQ ID NO: 1390712 - DNA, 22 bp, Artificial Sequence
  chemically synthesized
tttttcctttgaaaaccattat

SEQ ID NO: 1390713 - DNA, 22 bp, Artificial Sequence
  chemically synthesized
ttttcctttgaaaaccattatt

SEQ ID NO: 1390714 - DNA, 22 bp, Artificial Sequence
  chemically synthesized
tttcctttgaaaaccattattt

SEQ ID NO: 1390715 - DNA, 22 bp, Artificial Sequence
  chemically synthesized
ttcctttgaaaaccattatttt

SEQ ID NO: 1390716 - DNA, 22 bp, Artificial Sequence
  chemically synthesized
tcctttgaaaaccattattttc

SEQ ID NO: 1390717 - DNA, 22 bp, Artificial Sequence
  chemically synthesized
cctttgaaaaccattattttca

SEQ ID NO: 1390718 - DNA, 22 bp, Artificial Sequence
  chemically synthesized
ctttgaaaaccattattttcaa

SEQ ID NO: 1390719 - DNA, 22 bp, Artificial Sequence
  chemically synthesized
aaacaatttcctttgaaaataa

SEQ ID NO: 1390720 - DNA, 22 bp, Artificial Sequence
  chemically synthesized
aaaacaatttcctttgaaaata

SEQ ID NO: 1390721 - DNA, 22 bp, Artificial Sequence
  chemically synthesized
taaaacaatttcctttgaaaat

SEQ ID NO: 1390722 - DNA, 22 bp, Artificial Sequence
  chemically synthesized
tgaaaaccattattttcaaagg

SEQ ID NO: 1390723 - DNA, 22 bp, Artificial Sequence
  chemically synthesized
gaaaaccattattttcaaagga

SEQ ID NO: 1390724 - DNA, 22 bp, Artificial Sequence
  chemically synthesized
aaaaccattattttcaaaggaa

SEQ ID NO: 1390725 - DNA, 22 bp, Artificial Sequence
  chemically synthesized
tgttttaaaacaatttcctttg

SEQ ID NO: 1390726 - DNA, 22 bp, Artificial Sequence
  chemically synthesized
ttttcaaaggaaattgttttaa

SEQ ID NO: 1390727 - DNA, 22 bp, Artificial Sequence
  chemically synthesized
aaaaattatgttttaaaacaat

SEQ ID NO: 1390728 - DNA, 22 bp, Artificial Sequence
  chemically synthesized
aaaaaattatgttttaaaacaa

SEQ ID NO: 1390729 - DNA, 22 bp, Artificial Sequence
  chemically synthesized
taaaaaattatgttttaaaaca

SEQ ID NO: 1390730 - DNA, 22 bp, Artificial Sequence
  chemically synthesized
tcaaaggaaattgttttaaaac

SEQ ID NO: 1390731 - DNA, 22 bp, Artificial Sequence
  chemically synthesized
caaaggaaattgttttaaaaca

SEQ ID NO: 1390732 - DNA, 22 bp, Artificial Sequence
  chemically synthesized
aaaggaaattgttttaaaacat

SEQ ID NO: 1390733 - DNA, 22 bp, Artificial Sequence
  chemically synthesized
ttttaaaaaattatgttttaaa

SEQ ID NO: 1390734 - DNA, 22 bp, Artificial Sequence
  chemically synthesized
attttaaaaaattatgttttaa

SEQ ID NO: 1390735 - DNA, 22 bp, Artificial Sequence
  chemically synthesized
caccttattttaaaaaattatg

SEQ ID NO: 1390736 - DNA, 22 bp, Artificial Sequence
  chemically synthesized
acaccttattttaaaaaattat

SEQ ID NO: 1390737 - DNA, 22 bp, Artificial Sequence
  chemically synthesized
ttttaaaacataattttttaaa

SEQ ID NO: 1390738 - DNA, 22 bp, Artificial Sequence
  chemically synthesized
taaaacataattttttaaaata

SEQ ID NO: 1390739 - DNA, 22 bp, Artificial Sequence
  chemically synthesized
aaaacataattttttaaaataa

SEQ ID NO: 1390740 - DNA, 22 bp, Artificial Sequence
  chemically synthesized
aaacataattttttaaaataag

SEQ ID NO: 1390741 - DNA, 22 bp, Artificial Sequence
  chemically synthesized
tgaatgagcgtttacaccttat

SEQ ID NO: 1390742 - DNA, 22 bp, Artificial Sequence
  chemically synthesized
tgtgaatgagcgtttacacctt

SEQ ID NO: 1390743 - DNA, 22 bp, Artificial Sequence
  chemically synthesized
ctgtgaatgagcgtttacacct

SEQ ID NO: 1390744 - DNA, 22 bp, Artificial Sequence
  chemically synthesized
ttctgtgaatgagcgtttacac

SEQ ID NO: 1390745 - DNA, 22 bp, Artificial Sequence
  chemically synthesized
tttaaaataaggtgtaaacgct

SEQ ID NO: 1390746 - DNA, 22 bp, Artificial Sequence
  chemically synthesized
ttaaaataaggtgtaaacgctc

SEQ ID NO: 1390747 - DNA, 22 bp, Artificial Sequence
  chemically synthesized
taaaataaggtgtaaacgctca

SEQ ID NO: 1390748 - DNA, 22 bp, Artificial Sequence
  chemically synthesized
aaaataaggtgtaaacgctcat

SEQ ID NO: 1390749 - DNA, 22 bp, Artificial Sequence
  chemically synthesized
aaataaggtgtaaacgctcatt

SEQ ID NO: 1390750 - DNA, 22 bp, Artificial Sequence
  chemically synthesized
gggctcttctgtgaatgagcgt

SEQ ID NO: 1390751 - DNA, 22 bp, Artificial Sequence
  chemically synthesized
agggctcttctgtgaatgagcg

SEQ ID NO: 1390752 - DNA, 22 bp, Artificial Sequence
  chemically synthesized
tagcatgacttagggctcttct

SEQ ID NO: 1390753 - DNA, 22 bp, Artificial Sequence
  chemically synthesized
ttgtagcatgacttagggctct

SEQ ID NO: 1390754 - DNA, 22 bp, Artificial Sequence
  chemically synthesized
attgtagcatgacttagggctc

SEQ ID NO: 1390755 - DNA, 22 bp, Artificial Sequence
  chemically synthesized
tattgtagcatgacttagggct

SEQ ID NO: 1390756 - DNA, 22 bp, Artificial Sequence
  chemically synthesized
attcacagaagagccctaagtc

SEQ ID NO: 1390757 - DNA, 22 bp, Artificial Sequence
  chemically synthesized
acagaagagccctaagtcatgc

SEQ ID NO: 1390758 - DNA, 22 bp, Artificial Sequence
  chemically synthesized
catctttattgtagcatgactt

SEQ ID NO: 1390759 - DNA, 22 bp, Artificial Sequence
  chemically synthesized
acatctttattgtagcatgact

SEQ ID NO: 1390760 - DNA, 22 bp, Artificial Sequence
  chemically synthesized
cttacatctttattgtagcatg

SEQ ID NO: 1390761 - DNA, 22 bp, Artificial Sequence
  chemically synthesized
tacttacatctttattgtagca

SEQ ID NO: 1390762 - DNA, 22 bp, Artificial Sequence
  chemically synthesized
agtcatgctacaataaagatgt

SEQ ID NO: 1390763 - DNA, 22 bp, Artificial Sequence
  chemically synthesized
aaatcccatattctacttacat

SEQ ID NO: 1390764 - DNA, 22 bp, Artificial Sequence
  chemically synthesized
caataaagatgtaagtagaata

SEQ ID NO: 1390765 - DNA, 22 bp, Artificial Sequence
  chemically synthesized
aaaaaatgactcaaatcccata

SEQ ID NO: 1390766 - DNA, 22 bp, Artificial Sequence
  chemically synthesized
gattgaaaaaatgactcaaatc

SEQ ID NO: 1390767 - DNA, 22 bp, Artificial Sequence
  chemically synthesized
ggattgaaaaaatgactcaaat

SEQ ID NO: 1390768 - DNA, 22 bp, Artificial Sequence
  chemically synthesized
cttggattgaaaaaatgactca

SEQ ID NO: 1390769 - DNA, 22 bp, Artificial Sequence
  chemically synthesized
ccttggattgaaaaaatgactc

SEQ ID NO: 1390770 - DNA, 22 bp, Artificial Sequence
  chemically synthesized
tccttggattgaaaaaatgact

SEQ ID NO: 1390771 - DNA, 22 bp, Artificial Sequence
  chemically synthesized
aaattttccttggattgaaaaa

SEQ ID NO: 1390772 - DNA, 22 bp, Artificial Sequence
  chemically synthesized
tgaaattttccttggattgaaa

SEQ ID NO: 1390773 - DNA, 22 bp, Artificial Sequence
  chemically synthesized
gagtcattttttcaatccaagg

SEQ ID NO: 1390774 - DNA, 22 bp, Artificial Sequence
  chemically synthesized
ttctgaaattttccttggattg

SEQ ID NO: 1390775 - DNA, 22 bp, Artificial Sequence
  chemically synthesized
agtcattttttcaatccaagga

SEQ ID NO: 1390776 - DNA, 22 bp, Artificial Sequence
  chemically synthesized
gttctgaaattttccttggatt

SEQ ID NO: 1390777 - DNA, 22 bp, Artificial Sequence
  chemically synthesized
tgttctgaaattttccttggat

SEQ ID NO: 1390778 - DNA, 22 bp, Artificial Sequence
  chemically synthesized
tttcaatccaaggaaaatttca

SEQ ID NO: 1390779 - DNA, 22 bp, Artificial Sequence
  chemically synthesized
ttcaatccaaggaaaatttcag

SEQ ID NO: 1390780 - DNA, 22 bp, Artificial Sequence
  chemically synthesized
tcaatccaaggaaaatttcaga

SEQ ID NO: 1390781 - DNA, 22 bp, Artificial Sequence
  chemically synthesized
caatccaaggaaaatttcagaa

SEQ ID NO: 1390782 - DNA, 22 bp, Artificial Sequence
  chemically synthesized
aatccaaggaaaatttcagaac

SEQ ID NO: 1390783 - DNA, 22 bp, Artificial Sequence
  chemically synthesized
caaaaatattttgttctgaaat

SEQ ID NO: 1390784 - DNA, 22 bp, Artificial Sequence
  chemically synthesized
gacacctccaaaaatattttgt

SEQ ID NO: 1390785 - DNA, 22 bp, Artificial Sequence
  chemically synthesized
cagaacaaaatatttttggagg

SEQ ID NO: 1390786 - DNA, 22 bp, Artificial Sequence
  chemically synthesized
agaacaaaatatttttggaggt

SEQ ID NO: 1390787 - DNA, 22 bp, Artificial Sequence
  chemically synthesized
aacaaatattggacacctccaa

SEQ ID NO: 1390788 - DNA, 22 bp, Artificial Sequence
  chemically synthesized
tgtgaaactaaacaaatattgg

SEQ ID NO: 1390789 - DNA, 22 bp, Artificial Sequence
  chemically synthesized
ttggaggtgtccaatatttgtt

SEQ ID NO: 1390790 - DNA, 22 bp, Artificial Sequence
  chemically synthesized
tgtgtgaaactaaacaaatatt

SEQ ID NO: 1390791 - DNA, 22 bp, Artificial Sequence
  chemically synthesized
tggaggtgtccaatatttgttt

SEQ ID NO: 1390792 - DNA, 22 bp, Artificial Sequence
  chemically synthesized
ctgtgtgaaactaaacaaatat

SEQ ID NO: 1390793 - DNA, 22 bp, Artificial Sequence
  chemically synthesized
ggaggtgtccaatatttgttta

SEQ ID NO: 1390794 - DNA, 22 bp, Artificial Sequence
  chemically synthesized
tctgtgtgaaactaaacaaata

SEQ ID NO: 1390795 - DNA, 22 bp, Artificial Sequence
  chemically synthesized
gaggtgtccaatatttgtttag

SEQ ID NO: 1390796 - DNA, 22 bp, Artificial Sequence
  chemically synthesized
gtttagtttcacacagaaagac

SEQ ID NO: 1390797 - DNA, 22 bp, Artificial Sequence
  chemically synthesized
aatgtaaatagtgtctttctgt

SEQ ID NO: 1390798 - DNA, 22 bp, Artificial Sequence
  chemically synthesized
tttagtttcacacagaaagaca

SEQ ID NO: 1390799 - DNA, 22 bp, Artificial Sequence
  chemically synthesized
agtttcacacagaaagacacta

SEQ ID NO: 1390800 - DNA, 22 bp, Artificial Sequence
  chemically synthesized
gtttcacacagaaagacactat

SEQ ID NO: 1390801 - DNA, 22 bp, Artificial Sequence
  chemically synthesized
cacacagaaagacactatttac

SEQ ID NO: 1390802 - DNA, 22 bp, Artificial Sequence
  chemically synthesized
acacagaaagacactatttaca

SEQ ID NO: 1390803 - DNA, 22 bp, Artificial Sequence
  chemically synthesized
aaatatattgaatgtaaatagt

SEQ ID NO: 1390804 - DNA, 22 bp, Artificial Sequence
  chemically synthesized
aaaatatattgaatgtaaatag

SEQ ID NO: 1390805 - DNA, 22 bp, Artificial Sequence
  chemically synthesized
taaaatatattgaatgtaaata

SEQ ID NO: 1390806 - DNA, 22 bp, Artificial Sequence
  chemically synthesized
ttaaaatatattgaatgtaaat

SEQ ID NO: 1390807 - DNA, 22 bp, Artificial Sequence
  chemically synthesized
tttacattcaatatattttaaa

SEQ ID NO: 1390808 - DNA, 22 bp, Artificial Sequence
  chemically synthesized
acattcaatatattttaaaaac

SEQ ID NO: 1390809 - DNA, 22 bp, Artificial Sequence
  chemically synthesized
cattcaatatattttaaaaact

SEQ ID NO: 1390810 - DNA, 22 bp, Artificial Sequence
  chemically synthesized
tagaacatgtgtacagttttta

SEQ ID NO: 1390811 - DNA, 22 bp, Artificial Sequence
  chemically synthesized
atagaacatgtgtacagttttt

SEQ ID NO: 1390812 - DNA, 22 bp, Artificial Sequence
  chemically synthesized
aatatattttaaaaactgtaca

SEQ ID NO: 1390813 - DNA, 22 bp, Artificial Sequence
  chemically synthesized
ataatcttatagaacatgtgta

SEQ ID NO: 1390814 - DNA, 22 bp, Artificial Sequence
  chemically synthesized
taaaaactgtacacatgttcta

SEQ ID NO: 1390815 - DNA, 22 bp, Artificial Sequence
  chemically synthesized
aaaaactgtacacatgttctat

SEQ ID NO: 1390816 - DNA, 22 bp, Artificial Sequence
  chemically synthesized
aaaactgtacacatgttctata

SEQ ID NO: 1390817 - DNA, 22 bp, Artificial Sequence
  chemically synthesized
gtattgataatcttatagaaca

SEQ ID NO: 1390818 - DNA, 22 bp, Artificial Sequence
  chemically synthesized
tacacatgttctataagattat

SEQ ID NO: 1390819 - DNA, 22 bp, Artificial Sequence
  chemically synthesized
aaaaatgagtaaattggtattg

SEQ ID NO: 1390820 - DNA, 22 bp, Artificial Sequence
  chemically synthesized
tataagattatcaataccaatt

SEQ ID NO: 1390821 - DNA, 22 bp, Artificial Sequence
  chemically synthesized
gaaaaatgagtaaattggtatt

SEQ ID NO: 1390822 - DNA, 22 bp, Artificial Sequence
  chemically synthesized
tgaaaaatgagtaaattggtat

SEQ ID NO: 1390823 - DNA, 22 bp, Artificial Sequence
  chemically synthesized
taagattatcaataccaattta

SEQ ID NO: 1390824 - DNA, 22 bp, Artificial Sequence
  chemically synthesized
ttgaaaaatgagtaaattggta

SEQ ID NO: 1390825 - DNA, 22 bp, Artificial Sequence
  chemically synthesized
tcaataccaatttactcatttt

SEQ ID NO: 1390826 - DNA, 22 bp, Artificial Sequence
  chemically synthesized
aaaaatagtttttgaaaaatga

SEQ ID NO: 1390827 - DNA, 22 bp, Artificial Sequence
  chemically synthesized
aaaaaatagtttttgaaaaatg

SEQ ID NO: 1390828 - DNA, 22 bp, Artificial Sequence
  chemically synthesized
actcatttttcaaaaactattt

SEQ ID NO: 1390829 - DNA, 22 bp, Artificial Sequence
  chemically synthesized
ctcatttttcaaaaactatttt

SEQ ID NO: 1390830 - DNA, 22 bp, Artificial Sequence
  chemically synthesized
atttttcaaaaactatttttta

SEQ ID NO: 1390831 - DNA, 22 bp, Artificial Sequence
  chemically synthesized
tcaaacaaacacttaaaaaata

SEQ ID NO: 1390832 - DNA, 22 bp, Artificial Sequence
  chemically synthesized
ttcaaaaactattttttaagtg

SEQ ID NO: 1390833 - DNA, 22 bp, Artificial Sequence
  chemically synthesized
ttgtcaaacaaacacttaaaaa

SEQ ID NO: 1390834 - DNA, 22 bp, Artificial Sequence
  chemically synthesized
tcaaaaactattttttaagtgt

SEQ ID NO: 1390835 - DNA, 22 bp, Artificial Sequence
  chemically synthesized
attgtcaaacaaacacttaaaa

SEQ ID NO: 1390836 - DNA, 22 bp, Artificial Sequence
  chemically synthesized
caaaaactattttttaagtgtt

SEQ ID NO: 1390837 - DNA, 22 bp, Artificial Sequence
  chemically synthesized
aaaaactattttttaagtgttt

SEQ ID NO: 1390838 - DNA, 22 bp, Artificial Sequence
  chemically synthesized
ttattgtcaaacaaacacttaa

SEQ ID NO: 1390839 - DNA, 22 bp, Artificial Sequence
  chemically synthesized
cttattgtcaaacaaacactta

SEQ ID NO: 1390840 - DNA, 22 bp, Artificial Sequence
  chemically synthesized
tcttattgtcaaacaaacactt

SEQ ID NO: 1390841 - DNA, 22 bp, Artificial Sequence
  chemically synthesized
ttttttaagtgtttgtttgaca

SEQ ID NO: 1390842 - DNA, 22 bp, Artificial Sequence
  chemically synthesized
tttaagtgtttgtttgacaata

SEQ ID NO: 1390843 - DNA, 22 bp, Artificial Sequence
  chemically synthesized
aaagaattttcttattgtcaaa

SEQ ID NO: 1390844 - DNA, 22 bp, Artificial Sequence
  chemically synthesized
ttaagtgtttgtttgacaataa

SEQ ID NO: 1390845 - DNA, 22 bp, Artificial Sequence
  chemically synthesized
taagtgtttgtttgacaataag

SEQ ID NO: 1390846 - DNA, 22 bp, Artificial Sequence
  chemically synthesized
aagtgtttgtttgacaataaga

SEQ ID NO: 1390847 - DNA, 22 bp, Artificial Sequence
  chemically synthesized
agtgtttgtttgacaataagaa

SEQ ID NO: 1390848 - DNA, 22 bp, Artificial Sequence
  chemically synthesized
gtttgacaataagaaaattctt

SEQ ID NO: 1390849 - DNA, 22 bp, Artificial Sequence
  chemically synthesized
tttgacaataagaaaattcttt

SEQ ID NO: 1390850 - DNA, 22 bp, Artificial Sequence
  chemically synthesized
aaacaccacctaaaagaatttt

SEQ ID NO: 1390851 - DNA, 22 bp, Artificial Sequence
  chemically synthesized
gaaacaccacctaaaagaattt

SEQ ID NO: 1390852 - DNA, 22 bp, Artificial Sequence
  chemically synthesized
gacaataagaaaattcttttag

SEQ ID NO: 1390853 - DNA, 22 bp, Artificial Sequence
  chemically synthesized
acaataagaaaattcttttagg

SEQ ID NO: 1390854 - DNA, 22 bp, Artificial Sequence
  chemically synthesized
cttgaaacaccacctaaaagaa

SEQ ID NO: 1390855 - DNA, 22 bp, Artificial Sequence
  chemically synthesized
ccttgaaacaccacctaaaaga

SEQ ID NO: 1390856 - DNA, 22 bp, Artificial Sequence
  chemically synthesized
ttttaggtggtgtttcaaggaa

SEQ ID NO: 1390857 - DNA, 22 bp, Artificial Sequence
  chemically synthesized
aaatgtgtggccttccttgaaa

SEQ ID NO: 1390858 - DNA, 22 bp, Artificial Sequence
  chemically synthesized
ttaggtggtgtttcaaggaagg

SEQ ID NO: 1390859 - DNA, 22 bp, Artificial Sequence
  chemically synthesized
taggtggtgtttcaaggaaggc

SEQ ID NO: 1390860 - DNA, 22 bp, Artificial Sequence
  chemically synthesized
aggtggtgtttcaaggaaggcc

SEQ ID NO: 1390861 - DNA, 22 bp, Artificial Sequence
  chemically synthesized
ggtggtgtttcaaggaaggcca

SEQ ID NO: 1390862 - DNA, 22 bp, Artificial Sequence
  chemically synthesized
tgttaaaatgtgtggccttcct

SEQ ID NO: 1390863 - DNA, 22 bp, Artificial Sequence
  chemically synthesized
gaattatgttaaaatgtgtggc

SEQ ID NO: 1390864 - DNA, 22 bp, Artificial Sequence
  chemically synthesized
agaattatgttaaaatgtgtgg

SEQ ID NO: 1390865 - DNA, 22 bp, Artificial Sequence
  chemically synthesized
caaggaaggccacacattttaa

SEQ ID NO: 1390866 - DNA, 22 bp, Artificial Sequence
  chemically synthesized
aaggaaggccacacattttaac

SEQ ID NO: 1390867 - DNA, 22 bp, Artificial Sequence
  chemically synthesized
aacttagaattatgttaaaatg

SEQ ID NO: 1390868 - DNA, 22 bp, Artificial Sequence
  chemically synthesized
acctcaacttagaattatgtta

SEQ ID NO: 1390869 - DNA, 22 bp, Artificial Sequence
  chemically synthesized
tgaattcacctcaacttagaat

SEQ ID NO: 1390870 - DNA, 22 bp, Artificial Sequence
  chemically synthesized
taacataattctaagttgaggt

SEQ ID NO: 1390871 - DNA, 22 bp, Artificial Sequence
  chemically synthesized
tattatgaattcacctcaactt

SEQ ID NO: 1390872 - DNA, 22 bp, Artificial Sequence
  chemically synthesized
aacataattctaagttgaggtg

SEQ ID NO: 1390873 - DNA, 22 bp, Artificial Sequence
  chemically synthesized
atattatgaattcacctcaact

SEQ ID NO: 1390874 - DNA, 22 bp, Artificial Sequence
  chemically synthesized
acataattctaagttgaggtga

SEQ ID NO: 1390875 - DNA, 22 bp, Artificial Sequence
  chemically synthesized
taagttgaggtgaattcataat

SEQ ID NO: 1390876 - DNA, 22 bp, Artificial Sequence
  chemically synthesized
agttgaggtgaattcataatat

SEQ ID NO: 1390877 - DNA, 22 bp, Artificial Sequence
  chemically synthesized
aggtgaattcataatataagac

SEQ ID NO: 1390878 - DNA, 22 bp, Artificial Sequence
  chemically synthesized
acagatatcaaaatgtcttata

SEQ ID NO: 1390879 - DNA, 22 bp, Artificial Sequence
  chemically synthesized
ttgacagatatcaaaatgtctt

SEQ ID NO: 1390880 - DNA, 22 bp, Artificial Sequence
  chemically synthesized
gttgacagatatcaaaatgtct

SEQ ID NO: 1390881 - DNA, 22 bp, Artificial Sequence
  chemically synthesized
tgttgacagatatcaaaatgtc

SEQ ID NO: 1390882 - DNA, 22 bp, Artificial Sequence
  chemically synthesized
ataatataagacattttgatat

SEQ ID NO: 1390883 - DNA, 22 bp, Artificial Sequence
  chemically synthesized
aagtaaagagtctttgttgaca

SEQ ID NO: 1390884 - DNA, 22 bp, Artificial Sequence
  chemically synthesized
caagtaaagagtctttgttgac

SEQ ID NO: 1390885 - DNA, 22 bp, Artificial Sequence
  chemically synthesized
ttcaagtaaagagtctttgttg

SEQ ID NO: 1390886 - DNA, 22 bp, Artificial Sequence
  chemically synthesized
tgatatctgtcaacaaagactc

SEQ ID NO: 1390887 - DNA, 22 bp, Artificial Sequence
  chemically synthesized
gatatctgtcaacaaagactct

SEQ ID NO: 1390888 - DNA, 22 bp, Artificial Sequence
  chemically synthesized
ttcttcaagtaaagagtctttg

SEQ ID NO: 1390889 - DNA, 22 bp, Artificial Sequence
  chemically synthesized
atatctgtcaacaaagactctt

SEQ ID NO: 1390890 - DNA, 22 bp, Artificial Sequence
  chemically synthesized
tcaacaaagactctttacttga

SEQ ID NO: 1390891 - DNA, 22 bp, Artificial Sequence
  chemically synthesized
aatgactgttcttcaagtaaag

SEQ ID NO: 1390892 - DNA, 22 bp, Artificial Sequence
  chemically synthesized
gaatgactgttcttcaagtaaa

SEQ ID NO: 1390893 - DNA, 22 bp, Artificial Sequence
  chemically synthesized
tttacttgaagaacagtcattc

SEQ ID NO: 1390894 - DNA, 22 bp, Artificial Sequence
  chemically synthesized
tacttgaagaacagtcattcaa

SEQ ID NO: 1390895 - DNA, 22 bp, Artificial Sequence
  chemically synthesized
aggacacagaccttgaatgact

SEQ ID NO: 1390896 - DNA, 22 bp, Artificial Sequence
  chemically synthesized
acttgaagaacagtcattcaag

SEQ ID NO: 1390897 - DNA, 22 bp, Artificial Sequence
  chemically synthesized
aaggacacagaccttgaatgac

SEQ ID NO: 1390898 - DNA, 22 bp, Artificial Sequence
  chemically synthesized
cttgaagaacagtcattcaagg

SEQ ID NO: 1390899 - DNA, 22 bp, Artificial Sequence
  chemically synthesized
gaagaacagtcattcaaggtct

SEQ ID NO: 1390900 - DNA, 22 bp, Artificial Sequence
  chemically synthesized
aagaacagtcattcaaggtctg

SEQ ID NO: 1390901 - DNA, 22 bp, Artificial Sequence
  chemically synthesized
tatttaaggacacagaccttga

SEQ ID NO: 1390902 - DNA, 22 bp, Artificial Sequence
  chemically synthesized
gaatgttatatttaaggacaca

SEQ ID NO: 1390903 - DNA, 22 bp, Artificial Sequence
  chemically synthesized
tctggaatgttatatttaagga

SEQ ID NO: 1390904 - DNA, 22 bp, Artificial Sequence
  chemically synthesized
aaggtctgtgtccttaaatata

SEQ ID NO: 1390905 - DNA, 22 bp, Artificial Sequence
  chemically synthesized
aaagctatctggaatgttatat

SEQ ID NO: 1390906 - DNA, 22 bp, Artificial Sequence
  chemically synthesized
tgtccttaaatataacattcca

SEQ ID NO: 1390907 - DNA, 22 bp, Artificial Sequence
  chemically synthesized
aaattaaaagctatctggaatg

SEQ ID NO: 1390908 - DNA, 22 bp, Artificial Sequence
  chemically synthesized
gaaattaaaagctatctggaat

SEQ ID NO: 1390909 - DNA, 22 bp, Artificial Sequence
  chemically synthesized
aaatataacattccagatagct

SEQ ID NO: 1390910 - DNA, 22 bp, Artificial Sequence
  chemically synthesized
aatataacattccagatagctt

SEQ ID NO: 1390911 - DNA, 22 bp, Artificial Sequence
  chemically synthesized
gaaataaaagacttgaaattaa

SEQ ID NO: 1390912 - DNA, 22 bp, Artificial Sequence
  chemically synthesized
ggaaataaaagacttgaaatta

SEQ ID NO: 1390913 - DNA, 22 bp, Artificial Sequence
  chemically synthesized
cagatagcttttaatttcaagt
